United States Patent 10,706,955 (BIOINFORMATIC PROCESSES FOR DETERMINATION OF PEPTIDE BINDING) - sequence listing, part 20

SEQ ID NO: 770447 - protein, 20 aa, Mycobacterium
LGFTYDTGWYLQFRATEPDD

SEQ ID NO: 770448 - protein, 18 aa, Mycobacterium
LGGAFNCGKAQPGQIAAV

SEQ ID NO: 770449 - protein, 18 aa, Mycobacterium
LGGAFNCGKAQPGQIAPV

SEQ ID NO: 770450 - protein, 18 aa, Mycobacterium
LGGAFNCGKAQPGQVAAV

SEQ ID NO: 770451 - protein, 17 aa, Mycobacterium
LGGAPVRIGSFLADDHA

SEQ ID NO: 770452 - protein, 19 aa, Mycobacterium
LGGAYAVGPVFWAAELLGI

SEQ ID NO: 770453 - protein, 22 aa, Mycobacterium
LGGFRYGLPIKRWLLDHEAAAV

SEQ ID NO: 770454 - protein, 20 aa, Mycobacterium
LGGGHGWYSAQLCRRYPTLA

SEQ ID NO: 770455 - protein, 27 aa, Mycobacterium
LGGGKRLRPAFAYWGWRAVATDEPDEQ

SEQ ID NO: 770456 - protein, 24 aa, Mycobacterium
LGGKARSGPEFDKGYWIEPTIYLD

SEQ ID NO: 770457 - protein, 25 aa, Mycobacterium
LGGKWRVGAAFPWGIPVLLLTTTGR

SEQ ID NO: 770458 - protein, 20 aa, Mycobacterium
LGGLCERVALLPGADTQAFV

SEQ ID NO: 770459 - protein, 24 aa, Mycobacterium
LGGLTLPMLRSWLAAHAAAGTARS

SEQ ID NO: 770460 - protein, 19 aa, Mycobacterium
LGGNCPVIVLGDVDVEAVA

SEQ ID NO: 770461 - protein, 25 aa, Mycobacterium
LGHARLTRFLIRYSRGAWREAQATL

SEQ ID NO: 770462 - protein, 17 aa, Mycobacterium
LGHERVMLWLGYANLLG

SEQ ID NO: 770463 - protein, 19 aa, Mycobacterium
LGHFDAWAAQFVRYEVLIE

SEQ ID NO: 770464 - protein, 17 aa, Mycobacterium
LGHQWVLFHGHGQQRIR

SEQ ID NO: 770465 - protein, 24 aa, Mycobacterium
LGHRIRAAIHFDDLQWERGYDRIA

SEQ ID NO: 770466 - protein, 23 aa, Mycobacterium
LGHRIRAAIHFDDLQWERSYNRV

SEQ ID NO: 770467 - protein, 23 aa, Mycobacterium
LGHRLRAAIHFDDLQWEHRYDRI

SEQ ID NO: 770468 - protein, 19 aa, Mycobacterium
LGIAAARFHDEFVGNLRAA

SEQ ID NO: 770469 - protein, 18 aa, Mycobacterium
LGICGGFQMLGRVIRDPH

SEQ ID NO: 770470 - protein, 21 aa, Mycobacterium
LGIDWPLPVTMVSPRDAGAGS

SEQ ID NO: 770471 - protein, 20 aa, Mycobacterium
LGIRARPTWSGPPEFAYADF

SEQ ID NO: 770472 - protein, 18 aa, Mycobacterium
LGIRGCSVSMPFKEDVLA

SEQ ID NO: 770473 - protein, 18 aa, Mycobacterium
LGIRGCSVSMPFKQDVMA

SEQ ID NO: 770474 - protein, 18 aa, Mycobacterium
LGIVASTWHGKICEALLQ

SEQ ID NO: 770475 - protein, 19 aa, Mycobacterium
LGKLGSFDFNSRFYADDDL

SEQ ID NO: 770476 - protein, 23 aa, Mycobacterium
LGLARLWQSWGFEPDVVLGHSVG

SEQ ID NO: 770477 - protein, 24 aa, Mycobacterium
LGLARLWQSWGFEPDVVVGHSVGQ

SEQ ID NO: 770478 - protein, 24 aa, Mycobacterium
LGLDGDGLGTCWGREVATTMLADA

SEQ ID NO: 770479 - protein, 17 aa, Mycobacterium
LGLDYVDLYLIHWPAPA

SEQ ID NO: 770480 - protein, 20 aa, Mycobacterium
LGLEGAGLGTMWGRQLAESM

SEQ ID NO: 770481 - protein, 18 aa, Mycobacterium
LGLEIFDWLEVVDFGDAY

SEQ ID NO: 770482 - protein, 17 aa, Mycobacterium
LGLKVGMMICYDVEFPE

SEQ ID NO: 770483 - protein, 22 aa, Mycobacterium
LGLLRRFAKGWIVRANQVGVDE

SEQ ID NO: 770484 - protein, 17 aa, Mycobacterium
LGLLSWMYHRPLEGTEQ

SEQ ID NO: 770485 - protein, 17 aa, Mycobacterium
LGLLYRWVEQAFGGREH

SEQ ID NO: 770486 - protein, 26 aa, Mycobacterium
LGLMLRAPFRLARDVIPHMGPGSAII

SEQ ID NO: 770487 - protein, 26 aa, Mycobacterium
LGLMLRAPFRLARDVLPHMGPGSAII

SEQ ID NO: 770488 - protein, 18 aa, Mycobacterium
LGLPRGGVPVAFEVARAL

SEQ ID NO: 770489 - protein, 17 aa, Mycobacterium
LGLQDVIMTRDRDGQLH

SEQ ID NO: 770490 - protein, 24 aa, Mycobacterium
LGLRDVIFALQWVRDNIAAFGGDP

SEQ ID NO: 770491 - protein, 17 aa, Mycobacterium
LGLRPAPEFETWLRKVG

SEQ ID NO: 770492 - protein, 21 aa, Mycobacterium
LGLRVRLPWHTTRTPVTAAAD

SEQ ID NO: 770493 - protein, 25 aa, Mycobacterium
LGLTLPEFVCLRILSAQPRQSNAEL

SEQ ID NO: 770494 - protein, 22 aa, Mycobacterium
LGLVPMRAGNRWDISAPRNTYQ

SEQ ID NO: 770495 - protein, 17 aa, Mycobacterium
LGMPVNWGIGTPDLPIP

SEQ ID NO: 770496 - protein, 19 aa, Mycobacterium
LGMPWIVVVGRGWADGVVE

SEQ ID NO: 770497 - protein, 17 aa, Mycobacterium
LGMRPSWVLDLNNGGCA

SEQ ID NO: 770498 - protein, 20 aa, Mycobacterium
LGMTGLTAWIGIRDVGRPRA

SEQ ID NO: 770499 - protein, 20 aa, Mycobacterium
LGNAGFRWLVDACSPVDDPV

SEQ ID NO: 770500 - protein, 17 aa, Mycobacterium
LGNLIPEWNDLVRRGRW

SEQ ID NO: 770501 - protein, 21 aa, Mycobacterium
LGNLRARFNLALGIGSAGFSG

SEQ ID NO: 770502 - protein, 17 aa, Mycobacterium
LGNWTGIPVFKLTEAET

SEQ ID NO: 770503 - protein, 17 aa, Mycobacterium
LGPDGKRQPAHFDGLPV

SEQ ID NO: 770504 - protein, 17 aa, Mycobacterium
LGPQDALPRCRQTVHRG

SEQ ID NO: 770505 - protein, 20 aa, Mycobacterium
LGPRGRHVVLAKSFGGPQVT

SEQ ID NO: 770506 - protein, 19 aa, Mycobacterium
LGPRGRHVVLAKSFGGPTI

SEQ ID NO: 770507 - protein, 19 aa, Mycobacterium
LGPRGRHVVLAKSFGGPTV

SEQ ID NO: 770508 - protein, 20 aa, Mycobacterium
LGPRGRHVVLAKSWGGPTVT

SEQ ID NO: 770509 - protein, 17 aa, Mycobacterium
LGPRPASWWLRRWVHEV

SEQ ID NO: 770510 - protein, 17 aa, Mycobacterium
LGPTAWPSGNPAMLRLT

SEQ ID NO: 770511 - protein, 24 aa, Mycobacterium
LGPVADLFPILALPGQDVQGFSNL

SEQ ID NO: 770512 - protein, 18 aa, Mycobacterium
LGQLRAGDTVRFIRIEAS

SEQ ID NO: 770513 - protein, 23 aa, Mycobacterium
LGQLWWNKEFCRIVVIDGQHRAM

SEQ ID NO: 770514 - protein, 17 aa, Mycobacterium
LGRAAMRAFDWVSWRLN

SEQ ID NO: 770515 - protein, 17 aa, Mycobacterium
LGRCIGVGLARRGDDVA

SEQ ID NO: 770516 - protein, 17 aa, Mycobacterium
LGRGIKAGRVWTNCYHQ

SEQ ID NO: 770517 - protein, 23 aa, Mycobacterium
LGRHEFPLVLSPAVEEFLTAVAE

SEQ ID NO: 770518 - protein, 18 aa, Mycobacterium
LGRLCVYLSTRDCYATNA

SEQ ID NO: 770519 - protein, 20 aa, Mycobacterium
LGRLRFTTSLADMADRQLVI

SEQ ID NO: 770520 - protein, 26 aa, Mycobacterium
LGRPLRIAHAWSFAFDAAWQPLVALL

SEQ ID NO: 770521 - protein, 27 aa, Mycobacterium
LGRPLRIAHAWSFGFDAAWQPLVALLD

SEQ ID NO: 770522 - protein, 23 aa, Mycobacterium
LGRRSNVYVVEWQNVHGLTPSGL

SEQ ID NO: 770523 - protein, 20 aa, Mycobacterium
LGRSGLRVSPLCLGAMTFGE

SEQ ID NO: 770524 - protein, 21 aa, Mycobacterium
LGRSNGWSGLIINGAVRDAST

SEQ ID NO: 770525 - protein, 24 aa, Mycobacterium
LGRYGVCANAICPRARTAMTADVF

SEQ ID NO: 770526 - protein, 26 aa, Mycobacterium
LGSGWKGGAGSAYSEQWDKWHNGAGQ

SEQ ID NO: 770527 - protein, 19 aa, Mycobacterium
LGSIALTWDGGELTYRQLD

SEQ ID NO: 770528 - protein, 18 aa, Mycobacterium
LGSILRWFVAGTLGVGPV

SEQ ID NO: 770529 - protein, 21 aa, Mycobacterium
LGSILSWQNWEDMFSMAKFVG

SEQ ID NO: 770530 - protein, 24 aa, Mycobacterium
LGSKMSRFFLRNALVARLLSEASW

SEQ ID NO: 770531 - protein, 17 aa, Mycobacterium
LGSLGIRVTAIAPSLFA

SEQ ID NO: 770532 - protein, 21 aa, Mycobacterium
LGSLRVGNRFVHTGKPTAAGY

SEQ ID NO: 770533 - protein, 18 aa, Mycobacterium
LGSLRVGNRFVHTVKPTP

SEQ ID NO: 770534 - protein, 18 aa, Mycobacterium
LGSSTLRLARSALLEQQM

SEQ ID NO: 770535 - protein, 24 aa, Mycobacterium
LGTAAVCWRLRRRYGLPVHDIAPM

SEQ ID NO: 770536 - protein, 20 aa, Mycobacterium
LGTACAVAFGAAFELTSRRA

SEQ ID NO: 770537 - protein, 20 aa, Mycobacterium
LGTAWRLRSPWHGVRAQLDL

SEQ ID NO: 770538 - protein, 19 aa, Mycobacterium
LGTCKVCLYAGSIMPDDLL

SEQ ID NO: 770539 - protein, 25 aa, Mycobacterium
LGTFFIGQCLYRFANVYNKALRAEI

SEQ ID NO: 770540 - protein, 20 aa, Mycobacterium
LGTFLYWMLWKRPGLDIYLL

SEQ ID NO: 770541 - protein, 20 aa, Mycobacterium
LGTFSWPGAYGTWWQADPGA

SEQ ID NO: 770542 - protein, 23 aa, Mycobacterium
LGTVAVTPIMHWLRDVDGPIVEF

SEQ ID NO: 770543 - protein, 18 aa, Mycobacterium
LGTVPAIVDWYERRGVTP

SEQ ID NO: 770544 - protein, 21 aa, Mycobacterium
LGVALRIAWRALTFAGLHGSD

SEQ ID NO: 770545 - protein, 19 aa, Mycobacterium
LGVDEVWAIGGAQAVALLA

SEQ ID NO: 770546 - protein, 19 aa, Mycobacterium
LGVFCRRWGVPLIDGGTIR

SEQ ID NO: 770547 - protein, 18 aa, Mycobacterium
LGVFGGFELGDLAGDFSD

SEQ ID NO: 770548 - protein, 19 aa, Mycobacterium
LGVGIGRRFVECTPDSLLA

SEQ ID NO: 770549 - protein, 23 aa, Mycobacterium
LGVGWPKEFGGLGFGPIEQQIFV

SEQ ID NO: 770550 - protein, 24 aa, Mycobacterium
LGVGWPKEFGGLGFGPIEQSIFVN

SEQ ID NO: 770551 - protein, 25 aa, Mycobacterium
LGVMLRAPFRLARDVIVHMQPGSAI

SEQ ID NO: 770552 - protein, 17 aa, Mycobacterium
LGVPCAWPDDAVTVCSF

SEQ ID NO: 770553 - protein, 23 aa, Mycobacterium
LGVPGRLVLVGGLHRIEAALAQP

SEQ ID NO: 770554 - protein, 21 aa, Mycobacterium
LGVPMDFRLGFGAVFGPQTRL

SEQ ID NO: 770555 - protein, 19 aa, Mycobacterium
LGVPRLVVHPGELVNGQAA

SEQ ID NO: 770556 - protein, 18 aa, Mycobacterium
LGVQYARQGIRVNALCPG

SEQ ID NO: 770557 - protein, 17 aa, Mycobacterium
LGVRPAGLWAFEALRVA

SEQ ID NO: 770558 - protein, 20 aa, Mycobacterium
LGVRVALDWDRGVELISPIP

SEQ ID NO: 770559 - protein, 19 aa, Mycobacterium
LGVSAATCFAWADRDTDAA

SEQ ID NO: 770560 - protein, 20 aa, Mycobacterium
LGWARPGSDWERRFSAADGP

SEQ ID NO: 770561 - protein, 20 aa, Mycobacterium
LGWLCVWAVLEAVAEPGSAA

SEQ ID NO: 770562 - protein, 21 aa, Mycobacterium
LGYGDPRYGYSTAPANIETPF

SEQ ID NO: 770563 - protein, 21 aa, Mycobacterium
LGYGDPRYGYSTAPANVPTPF

SEQ ID NO: 770564 - protein, 30 aa, Mycobacterium
LGYNFKDWDLRTAFTWKFLRAATAEQITAS

SEQ ID NO: 770565 - protein, 26 aa, Mycobacterium
LGYQVGFPWSLGVGINFSYTTPNILI

SEQ ID NO: 770566 - protein, 23 aa, Mycobacterium
LGYRVRRLAGRVVWLAPPDAPTP

SEQ ID NO: 770567 - protein, 21 aa, Mycobacterium
LHAAAGCWRGLAAALGGAEQG

SEQ ID NO: 770568 - protein, 18 aa, Mycobacterium
LHAEWTWASSVFDRGALV

SEQ ID NO: 770569 - protein, 18 aa, Mycobacterium
LHAGFPPERITFHGNNKS

SEQ ID NO: 770570 - protein, 19 aa, Mycobacterium
LHALGPRWALVKGGHLRSS

SEQ ID NO: 770571 - protein, 17 aa, Mycobacterium
LHANWRWATSALTDEQV

SEQ ID NO: 770572 - protein, 17 aa, Mycobacterium
LHARLALEATEQGVPMN

SEQ ID NO: 770573 - protein, 17 aa, Mycobacterium
LHATWTWAPSALDREQV

SEQ ID NO: 770574 - protein, 18 aa, Mycobacterium
LHCGDAFYHVGTLDGQSK

SEQ ID NO: 770575 - protein, 17 aa, Mycobacterium
LHDIAWRAMQVHGALGV

SEQ ID NO: 770576 - protein, 18 aa, Mycobacterium
LHDPARWKYVHLGNHTLH

SEQ ID NO: 770577 - protein, 19 aa, Mycobacterium
LHDRMALEWSIVVLGPDTA

SEQ ID NO: 770578 - protein, 18 aa, Mycobacterium
LHDVLREAWGFKGFVVSD

SEQ ID NO: 770579 - protein, 17 aa, Mycobacterium
LHEGHAIEAARRVLDQP

SEQ ID NO: 770580 - protein, 18 aa, Mycobacterium
LHEIPWDLVASIGVTLRL

SEQ ID NO: 770581 - protein, 21 aa, Mycobacterium
LHFFPAAALELGWLQSQVTSA

SEQ ID NO: 770582 - protein, 23 aa, Mycobacterium
LHFFPARLWASGGMSPLITAAVD

SEQ ID NO: 770583 - protein, 22 aa, Mycobacterium
LHFGKPLVVLPLFWDQYENAQR

SEQ ID NO: 770584 - protein, 18 aa, Mycobacterium
LHGLAGWVDVKGPVVATA

SEQ ID NO: 770585 - protein, 18 aa, Mycobacterium
LHGLPVRKLWGIGPVAED

SEQ ID NO: 770586 - protein, 17 aa, Mycobacterium
LHHAVLMMIPEAWERHE

SEQ ID NO: 770587 - protein, 18 aa, Mycobacterium
LHHFPTRRMCNLASVTSF

SEQ ID NO: 770588 - protein, 17 aa, Mycobacterium
LHHLKAAGFGIDVATVS

SEQ ID NO: 770589 - protein, 19 aa, Mycobacterium
LHHTYSFLGIETYRQVSTE

SEQ ID NO: 770590 - protein, 18 aa, Mycobacterium
LHHTYSFLGVETYRQVST

SEQ ID NO: 770591 - protein, 18 aa, Mycobacterium
LHKHWGFGGGPHRCLGSH

SEQ ID NO: 770592 - protein, 18 aa, Mycobacterium
LHLKASNVIPGYFKHPEL

SEQ ID NO: 770593 - protein, 17 aa, Mycobacterium
LHLRAAAAALRSLRVGP

SEQ ID NO: 770594 - protein, 19 aa, Mycobacterium
LHLRMPEVWGIRLEGELPQ

SEQ ID NO: 770595 - protein, 23 aa, Mycobacterium
LHLYRCREVCAAVDVARADILLV

SEQ ID NO: 770596 - protein, 19 aa, Mycobacterium
LHPAWPMAMAVAGRAEFAD

SEQ ID NO: 770597 - protein, 25 aa, Mycobacterium
LHPDLKWDFRLPRVVSINVSGHKYG

SEQ ID NO: 770598 - protein, 25 aa, Mycobacterium
LHPDLQWDFRLPRVVSINVSGHKYG

SEQ ID NO: 770599 - protein, 23 aa, Mycobacterium
LHPEAIAALGIREWDAISLTGSR

SEQ ID NO: 770600 - protein, 23 aa, Mycobacterium
LHPEAIAALGIREWDAVSLTGAR

SEQ ID NO: 770601 - protein, 18 aa, Mycobacterium
LHPGEFVLGATLERCTLP

SEQ ID NO: 770602 - protein, 24 aa, Mycobacterium
LHPMSAPMSMEWLSARFRGEPLPT

SEQ ID NO: 770603 - protein, 19 aa, Mycobacterium
LHPTQWVRLWFSDGGKLHQ

SEQ ID NO: 770604 - protein, 19 aa, Mycobacterium
LHRGCAGLAEVARPAPHSV

SEQ ID NO: 770605 - protein, 18 aa, Mycobacterium
LHRHFGWLTRWYAFSSAD

SEQ ID NO: 770606 - protein, 24 aa, Mycobacterium
LHRLRGMFAFAIWDTVERELFCAR

SEQ ID NO: 770607 - protein, 23 aa, Mycobacterium
LHRLRGMFAFALWDTVEQELFCA

SEQ ID NO: 770608 - protein, 23 aa, Mycobacterium
LHRLRLPWWHVWRVAEAAGAATP

SEQ ID NO: 770609 - protein, 17 aa, Mycobacterium
LHRRGCVVQRLILLDPP

SEQ ID NO: 770610 - protein, 26 aa, Mycobacterium
LHRRRGWTWSGFRIMNVLWVFGTVEQ

SEQ ID NO: 770611 - protein, 22 aa, Mycobacterium
LHSGDKVMLCFGAANRDDEVFP

SEQ ID NO: 770612 - protein, 20 aa, Mycobacterium
LHSTPRWCIWIPDDDLPADV

SEQ ID NO: 770613 - protein, 22 aa, Mycobacterium
LHSVKVIPGRGAWLEFDVDKRD

SEQ ID NO: 770614 - protein, 17 aa, Mycobacterium
LHWECLNPVPPATTDTL

SEQ ID NO: 770615 - protein, 22 aa, Mycobacterium
LIAARWGFSRAQLDEFAATSHE

SEQ ID NO: 770616 - protein, 18 aa, Mycobacterium
LIAARWGLSRTQLDEFSA

SEQ ID NO: 770617 - protein, 17 aa, Mycobacterium
LIAEFGISWILPRLTSW

SEQ ID NO: 770618 - protein, 21 aa, Mycobacterium
LIAGAAYRWLRSWPTAPADPW

SEQ ID NO: 770619 - protein, 23 aa, Mycobacterium
LIAKRRLRFPVGHSVDADKVAAT

SEQ ID NO: 770620 - protein, 24 aa, Mycobacterium
LIALARRRINVIWAMLRDHTHYHE

SEQ ID NO: 770621 - protein, 17 aa, Mycobacterium
LIAPHWPAPWGVDAGPL

SEQ ID NO: 770622 - protein, 20 aa, Mycobacterium
LICIGGNPMAAWPDQRKTKR

SEQ ID NO: 770623 - protein, 18 aa, Mycobacterium
LIDARFPIQYVIRPQGGA

SEQ ID NO: 770624 - protein, 24 aa, Mycobacterium
LIDFWRFNVAFARQILAQQPISSP

SEQ ID NO: 770625 - protein, 20 aa, Mycobacterium
LIDGRWVRWDADRAAGAYAH

SEQ ID NO: 770626 - protein, 23 aa, Mycobacterium
LIDIPWRLHHPMWLQDCPVDLDY

SEQ ID NO: 770627 - protein, 17 aa, Mycobacterium
LIDLALRLRQRIADLDQ

SEQ ID NO: 770628 - protein, 21 aa, Mycobacterium
LIDPALLRPGRMERLVFVEPP

SEQ ID NO: 770629 - protein, 18 aa, Mycobacterium
LIDRIGVGKVMWSSDYPH

SEQ ID NO: 770630 - protein, 17 aa, Mycobacterium
LIEAMGLTVGWITAEST

SEQ ID NO: 770631 - protein, 17 aa, Mycobacterium
LIECCLELYAAHLVVGI

SEQ ID NO: 770632 - protein, 26 aa, Mycobacterium
LIEPDLRYLVNWGYGDPAYGWSTSPP

SEQ ID NO: 770633 - protein, 19 aa, Mycobacterium
LIEVRFPDGWSVAPRRLPF

SEQ ID NO: 770634 - protein, 18 aa, Mycobacterium
LIFNLGIGNVGTFNLGSG

SEQ ID NO: 770635 - protein, 19 aa, Mycobacterium
LIGAMLYRIFNRAKTVDET

SEQ ID NO: 770636 - protein, 17 aa, Mycobacterium
LIGAWCFIDHYGPVAAR

SEQ ID NO: 770637 - protein, 18 aa, Mycobacterium
LIGGTCVNNGCIPTKTLV

SEQ ID NO: 770638 - protein, 18 aa, Mycobacterium
LIGIARLDFLPAPVSALF

SEQ ID NO: 770639 - protein, 18 aa, Mycobacterium
LIGLWPMGFRRLGMRDVD

SEQ ID NO: 770640 - protein, 24 aa, Mycobacterium
LIGWRRGICGYRRFFSITSLAALR

SEQ ID NO: 770641 - protein, 17 aa, Mycobacterium
LIHCGRLSVEKHVDRSI

SEQ ID NO: 770642 - protein, 25 aa, Mycobacterium
LIKSIGLRLGVPWYAYDTVIFSGEV

SEQ ID NO: 770643 - protein, 24 aa, Mycobacterium
LIKSIGLRLGVPWYAYDTVTFAGE

SEQ ID NO: 770644 - protein, 17 aa, Mycobacterium
LIKVLRKRGRILQSAPD

SEQ ID NO: 770645 - protein, 17 aa, Mycobacterium
LIKVLRKRGRILQSAPN

SEQ ID NO: 770646 - protein, 18 aa, Mycobacterium
LILADAIVRACEDNPDYL

SEQ ID NO: 770647 - protein, 24 aa, Mycobacterium
LILKEALRLLAPVPLVMRKTVRDV

SEQ ID NO: 770648 - protein, 17 aa, Mycobacterium
LILLMGLRADVDRFNNA

SEQ ID NO: 770649 - protein, 20 aa, Mycobacterium
LILRRCHVVLGRGRFFPPLF

SEQ ID NO: 770650 - protein, 19 aa, Mycobacterium
LIMTGPLAWLAGRTAGSRV

SEQ ID NO: 770651 - protein, 19 aa, Mycobacterium
LINACAHRGAMICRRKTDN

SEQ ID NO: 770652 - protein, 18 aa, Mycobacterium
LINALPFLIGKRAGAPQG

SEQ ID NO: 770653 - protein, 18 aa, Mycobacterium
LINAPALALFGRPWIGNG

SEQ ID NO: 770654 - protein, 23 aa, Mycobacterium
LINCAGVGWPGRTIGKDGQYASA

SEQ ID NO: 770655 - protein, 17 aa, Mycobacterium
LINMYGITETTVHASFR

SEQ ID NO: 770656 - protein, 26 aa, Mycobacterium
LINRVLKGAWGFRGWVMSDWGATPSW

SEQ ID NO: 770657 - protein, 17 aa, Mycobacterium
LIPDFLWIDTEYTAKLS

SEQ ID NO: 770658 - protein, 17 aa, Mycobacterium
LIPGGFGIRGIEGKVGA

SEQ ID NO: 770659 - protein, 18 aa, Mycobacterium
LIPKLILPVNDIFITIIM

SEQ ID NO: 770660 - protein, 17 aa, Mycobacterium
LIPSLFTEHAFYFGDTH

SEQ ID NO: 770661 - protein, 18 aa, Mycobacterium
LIRERGYLAFGLKLFTQT

SEQ ID NO: 770662 - protein, 19 aa, Mycobacterium
LIRKGVRFVRCPGWSDYYP

SEQ ID NO: 770663 - protein, 20 aa, Mycobacterium
LIRLGCPRAKVSVLSAGVEV

SEQ ID NO: 770664 - protein, 23 aa, Mycobacterium
LIRLHHSRFPQARFELHQRSGQG

SEQ ID NO: 770665 - protein, 18 aa, Mycobacterium
LIRRAVVVKAEVVAADEK

SEQ ID NO: 770666 - protein, 20 aa, Mycobacterium
LISRLPGWDSPAADAARGRI

SEQ ID NO: 770667 - protein, 18 aa, Mycobacterium
LITCGLCRACRSGDDVHC

SEQ ID NO: 770668 - protein, 24 aa, Mycobacterium
LITPEMYRLIGINAGRHAKGATPS

SEQ ID NO: 770669 - protein, 23 aa, Mycobacterium
LIWPPRSPSGFSLIVDGQARAGA

SEQ ID NO: 770670 - protein, 23 aa, Mycobacterium
LIYKCPRPPSGIVARNDRIDPDE

SEQ ID NO: 770671 - protein, 17 aa, Mycobacterium
LIYREWVETGAYPRLRD

SEQ ID NO: 770672 - protein, 28 aa, Mycobacterium
LKAAGFRWFRTLGVWGIAGSRDRQPNRY

SEQ ID NO: 770673 - protein, 17 aa, Mycobacterium
LKAANTWHATRAIQEAR

SEQ ID NO: 770674 - protein, 19 aa, Mycobacterium
LKAAYWKSARDGLDGRTID

SEQ ID NO: 770675 - protein, 18 aa, Mycobacterium
LKAFFVLMGVASNDTTRH

SEQ ID NO: 770676 - protein, 23 aa, Mycobacterium
LKAFSFDIGYRIAHHDDLTTPPP

SEQ ID NO: 770677 - protein, 17 aa, Mycobacterium
LKAGMILEGVVTNVAAF

SEQ ID NO: 770678 - protein, 17 aa, Mycobacterium
LKAGMVLEGVVTNVAAF

SEQ ID NO: 770679 - protein, 19 aa, Mycobacterium
LKAIFPLAVTSDLYEGANH

SEQ ID NO: 770680 - protein, 23 aa, Mycobacterium
LKAKARAAGLWNLFLPDPELGGG

SEQ ID NO: 770681 - protein, 17 aa, Mycobacterium
LKALDWARRRFGSDLVW

SEQ ID NO: 770682 - protein, 18 aa, Mycobacterium
LKAMTSWHAQHAITVCRE

SEQ ID NO: 770683 - protein, 18 aa, Mycobacterium
LKARIAALEASRTSYEEI

SEQ ID NO: 770684 - protein, 19 aa, Mycobacterium
LKATFDWHIDGCTPLNDEC

SEQ ID NO: 770685 - protein, 22 aa, Mycobacterium
LKDFRFIPCLSQQAPDPVPNGR

SEQ ID NO: 770686 - protein, 21 aa, Mycobacterium
LKDLLERGGLRAGRTERDVRN

SEQ ID NO: 770687 - protein, 18 aa, Mycobacterium
LKDPEWLEVVLRLLDEAD

SEQ ID NO: 770688 - protein, 21 aa, Mycobacterium
LKELHLRLGAATAELSQRLGR

SEQ ID NO: 770689 - protein, 17 aa, Mycobacterium
LKELIIRGGENIAPAEI

SEQ ID NO: 770690 - protein, 21 aa, Mycobacterium
LKERMDWKMPWYTITDGFDAD

SEQ ID NO: 770691 - protein, 17 aa, Mycobacterium
LKFKIRFLRVNRRHHSV

SEQ ID NO: 770692 - protein, 19 aa, Mycobacterium
LKFLADEGVDLIITSGGLG

SEQ ID NO: 770693 - protein, 19 aa, Mycobacterium
LKFPGRLVVGLAVSRLGTS

SEQ ID NO: 770694 - protein, 21 aa, Mycobacterium
LKFTYVVGWPHLWRAYKKFSD

SEQ ID NO: 770695 - protein, 17 aa, Mycobacterium
LKGAEALQDAWRQADID

SEQ ID NO: 770696 - protein, 17 aa, Mycobacterium
LKGAEAMRQAWRNDGVD

SEQ ID NO: 770697 - protein, 17 aa, Mycobacterium
LKGANLWNEVKDRLDKP

SEQ ID NO: 770698 - protein, 20 aa, Mycobacterium
LKGEVKDVLLLDVTPLSLGI

SEQ ID NO: 770699 - protein, 20 aa, Mycobacterium
LKGGVLLAAYGVRRPTKDAD

SEQ ID NO: 770700 - protein, 23 aa, Mycobacterium
LKGIRKWVWERLGGTLYAQKAAD

SEQ ID NO: 770701 - protein, 19 aa, Mycobacterium
LKGMFAFAIVERDSGRVLL

SEQ ID NO: 770702 - protein, 18 aa, Mycobacterium
LKGPVLWVAALIGEEIFD

SEQ ID NO: 770703 - protein, 19 aa, Mycobacterium
LKGWVWKFDPAIFGGHLAE

SEQ ID NO: 770704 - protein, 18 aa, Mycobacterium
LKHTPIRSVLSFKLFRGS

SEQ ID NO: 770705 - protein, 19 aa, Mycobacterium
LKHWHFGPLYTRDEYIRLQ

SEQ ID NO: 770706 - protein, 20 aa, Mycobacterium
LKIALIKSGALFDVLETSGR

SEQ ID NO: 770707 - protein, 17 aa, Mycobacterium
LKICLSEGGIGWVAGLL

SEQ ID NO: 770708 - protein, 17 aa, Mycobacterium
LKIGSGRRLAATTKETL

SEQ ID NO: 770709 - protein, 18 aa, Mycobacterium
LKILWPGYSISWAYGATA

SEQ ID NO: 770710 - protein, 19 aa, Mycobacterium
LKIPILLIRGKLSDVVSPE

SEQ ID NO: 770711 - protein, 20 aa, Mycobacterium
LKIPRLRDAYLKRFPDYSKG

SEQ ID NO: 770712 - protein, 22 aa, Mycobacterium
LKIRLRQGLPMSRLDSAERERA

SEQ ID NO: 770713 - protein, 17 aa, Mycobacterium
LKITEKLLQPWGIVHGG

SEQ ID NO: 770714 - protein, 18 aa, Mycobacterium
LKKLWGLPGTQLGVVAWP

SEQ ID NO: 770715 - protein, 19 aa, Mycobacterium
LKLGFAGSDFGYAMDLGLP

SEQ ID NO: 770716 - protein, 19 aa, Mycobacterium
LKLGGPRLKDVAGLSLTKL

SEQ ID NO: 770717 - protein, 17 aa, Mycobacterium
LKLGLYPSREDWAEART

SEQ ID NO: 770718 - protein, 18 aa, Mycobacterium
LKLGSKWTDSGYVVVDEF

SEQ ID NO: 770719 - protein, 17 aa, Mycobacterium
LKLLIVFNASTAEGKDD

SEQ ID NO: 770720 - protein, 19 aa, Mycobacterium
LKLRHAMQFELKRIQREVG

SEQ ID NO: 770721 - protein, 21 aa, Mycobacterium
LKLRHVMQFELKRIQREIGIT

SEQ ID NO: 770722 - protein, 17 aa, Mycobacterium
LKLSLAAVMVLRERYLL

SEQ ID NO: 770723 - protein, 20 aa, Mycobacterium
LKLSMFVLNAAFYKPALLSR

SEQ ID NO: 770724 - protein, 25 aa, Mycobacterium
LKLVKPLVIAEGFALLSVPTPFVQN

SEQ ID NO: 770725 - protein, 19 aa, Mycobacterium
LKLVRPLVITEGFALLSVP

SEQ ID NO: 770726 - protein, 17 aa, Mycobacterium
LKMDGAWVIGRVRVPTY

SEQ ID NO: 770727 - protein, 19 aa, Mycobacterium
LKMFFAVFLGAGFVTTTHL

SEQ ID NO: 770728 - protein, 17 aa, Mycobacterium
LKMGLEHLAGYENHTGV

SEQ ID NO: 770729 - protein, 25 aa, Mycobacterium
LKMLFSREMLEGVTADNVFPRALAG

SEQ ID NO: 770730 - protein, 18 aa, Mycobacterium
LKNAIDWLSRPFGSSVFK

SEQ ID NO: 770731 - protein, 17 aa, Mycobacterium
LKNAIDWLSRPYGDSAL

SEQ ID NO: 770732 - protein, 17 aa, Mycobacterium
LKNVFAISAGMGYSLGI

SEQ ID NO: 770733 - protein, 21 aa, Mycobacterium
LKNVYAISVGMGYSLGIGENT

SEQ ID NO: 770734 - protein, 23 aa, Mycobacterium
LKPALGRFGVWTGEPATPDQAVE

SEQ ID NO: 770735 - protein, 17 aa, Mycobacterium
LKPEFIKDISIGSLIYD

SEQ ID NO: 770736 - protein, 17 aa, Mycobacterium
LKPEYKGKVSISNPVTS

SEQ ID NO: 770737 - protein, 17 aa, Mycobacterium
LKPGIIMCREKQDSTSA

SEQ ID NO: 770738 - protein, 19 aa, Mycobacterium
LKPLIFCDGYGSTRRIYGR

SEQ ID NO: 770739 - protein, 20 aa, Mycobacterium
LKPRRVAVLAVHTSPLAQPG

SEQ ID NO: 770740 - protein, 17 aa, Mycobacterium
LKQLTGRDVARPRDIAE

SEQ ID NO: 770741 - protein, 18 aa, Mycobacterium
LKQNEFVSLWSQYASPTQ

SEQ ID NO: 770742 - protein, 17 aa, Mycobacterium
LKQNYAYDIGMMRRSRV

SEQ ID NO: 770743 - protein, 18 aa, Mycobacterium
LKQNYLFDMRTIRRGKVA

SEQ ID NO: 770744 - protein, 19 aa, Mycobacterium
LKRFPTWEVDWPNAVPSQT

SEQ ID NO: 770745 - protein, 22 aa, Mycobacterium
LKRHRFSPFFIDYFITPLVAAV

SEQ ID NO: 770746 - protein, 17 aa, Mycobacterium
LKRLSFEGLVEYDRRAV

SEQ ID NO: 770747 - protein, 17 aa, Mycobacterium
LKRPIPFLPDTIGLITG

SEQ ID NO: 770748 - protein, 18 aa, Mycobacterium
LKRPIPFLPNMIGLITGR

SEQ ID NO: 770749 - protein, 19 aa, Mycobacterium
LKRPIPFLPNMIGLITGRA

SEQ ID NO: 770750 - protein, 20 aa, Mycobacterium
LKRPIPFLPNMVGLITGRAS

SEQ ID NO: 770751 - protein, 24 aa, Mycobacterium
LKRPVPFLPARIGLITGRASAAEH

SEQ ID NO: 770752 - protein, 19 aa, Mycobacterium
LKRPWFPIIPTQDWNALIN

SEQ ID NO: 770753 - protein, 17 aa, Mycobacterium
LKRRCLFLHIDFPDAEL

SEQ ID NO: 770754 - protein, 21 aa, Mycobacterium
LKRVRDLGCEYAILYFPEAAY

SEQ ID NO: 770755 - protein, 18 aa, Mycobacterium
LKRVWRWDFGDLSTVTVH

SEQ ID NO: 770756 - protein, 23 aa, Mycobacterium
LKRWPEWDIDMSGARRSRTSTVR

SEQ ID NO: 770757 - protein, 20 aa, Mycobacterium
LKSEPHWYPYVPRMSRLQKR

SEQ ID NO: 770758 - protein, 21 aa, Mycobacterium
LKSKLRPGGLLLNHCITRNNN

SEQ ID NO: 770759 - protein, 20 aa, Mycobacterium
LKSKLRTGGLLLNHCITRPD

SEQ ID NO: 770760 - protein, 17 aa, Mycobacterium
LKSSVAMELVRKQRGLA

SEQ ID NO: 770761 - protein, 17 aa, Mycobacterium
LKSSVAMELVRKQRGLT

SEQ ID NO: 770762 - protein, 19 aa, Mycobacterium
LKSYLPRLAVTYGAAMATG

SEQ ID NO: 770763 - protein, 22 aa, Mycobacterium
LKTELRLRYGVGVYSESRSVSR

SEQ ID NO: 770764 - protein, 21 aa, Mycobacterium
LKTEPAELEWTLARTDHPDAG

SEQ ID NO: 770765 - protein, 19 aa, Mycobacterium
LKTHCKTCLVVRREGSAIR

SEQ ID NO: 770766 - protein, 20 aa, Mycobacterium
LKTHCKTCLVVRREGSAIRR

SEQ ID NO: 770767 - protein, 18 aa, Mycobacterium
LKTLMSRTAGLSLHYVGG

SEQ ID NO: 770768 - protein, 20 aa, Mycobacterium
LKTLWTIASTNPWLSVTPVS

SEQ ID NO: 770769 - protein, 21 aa, Mycobacterium
LKTSFKAGALIGRGSGEAVQV

SEQ ID NO: 770770 - protein, 18 aa, Mycobacterium
LKTSYAWAQARRDGDDPA

SEQ ID NO: 770771 - protein, 18 aa, Mycobacterium
LKTSYAWAQARRDRDDPE

SEQ ID NO: 770772 - protein, 21 aa, Mycobacterium
LKTWWRPGLLCIGDAAHAMSP

SEQ ID NO: 770773 - protein, 18 aa, Mycobacterium
LKVAFDWKSRFNEARGLD

SEQ ID NO: 770774 - protein, 22 aa, Mycobacterium
LKVFRGAACVVHLAWGFQPTRN

SEQ ID NO: 770775 - protein, 17 aa, Mycobacterium
LKVGAARSFAATTQESL

SEQ ID NO: 770776 - protein, 23 aa, Mycobacterium
LKVGDKVGNAWLWSACGSCEQCR

SEQ ID NO: 770777 - protein, 17 aa, Mycobacterium
LKVGTARRFSASTERTL

SEQ ID NO: 770778 - protein, 20 aa, Mycobacterium
LKVLGLCHSVYWTMVGLCEL

SEQ ID NO: 770779 - protein, 17 aa, Mycobacterium
LKVLPGIRIYLGDTDEQ

SEQ ID NO: 770780 - protein, 18 aa, Mycobacterium
LKVPRRLKELNVRLNAAR

SEQ ID NO: 770781 - protein, 18 aa, Mycobacterium
LKWWTSEVQWEIIDRCLQ

SEQ ID NO: 770782 - protein, 20 aa, Mycobacterium
LKYGVKHGFSAAGAATRQFK

SEQ ID NO: 770783 - protein, 22 aa, Mycobacterium
LKYNCPGFVFSTGLPGPLAAAA

SEQ ID NO: 770784 - protein, 21 aa, Mycobacterium
LKYPHMFAAAGLVILNKIDLL

SEQ ID NO: 770785 - protein, 19 aa, Mycobacterium
LLAAMPPFLTGGSMIETVT

SEQ ID NO: 770786 - protein, 19 aa, Mycobacterium
LLAARCLRGLLTMSSQQPD

SEQ ID NO: 770787 - protein, 19 aa, Mycobacterium
LLAARCVRGLLSMSSGEPD

SEQ ID NO: 770788 - protein, 22 aa, Mycobacterium
LLADPRRAAAMGVAGRHWALDN

SEQ ID NO: 770789 - protein, 17 aa, Mycobacterium
LLAEGIEGRCRIVGVVD

SEQ ID NO: 770790 - protein, 31 aa, Mycobacterium
LLAESFNSLFLRNCINYGLPILAVPGISSAV

SEQ ID NO: 770791 - protein, 17 aa, Mycobacterium
LLAGLLRAGRQVKDLVV

SEQ ID NO: 770792 - protein, 18 aa, Mycobacterium
LLAHDWGSIQGWAAVTAD

SEQ ID NO: 770793 - protein, 20 aa, Mycobacterium
LLALFGRLGYRFAPERIPET

SEQ ID NO: 770794 - protein, 18 aa, Mycobacterium
LLALGIPICEGYGMTECT

SEQ ID NO: 770795 - protein, 17 aa, Mycobacterium
LLAPEWVPWEHRVRPGD

SEQ ID NO: 770796 - protein, 17 aa, Mycobacterium
LLAPHWPAPYGRGASPA

SEQ ID NO: 770797 - protein, 18 aa, Mycobacterium
LLAPHWPKPYGRAAGPAE

SEQ ID NO: 770798 - protein, 18 aa, Mycobacterium
LLAPHWPPPYGRGASAAE

SEQ ID NO: 770799 - protein, 19 aa, Mycobacterium
LLAPRTMRPLLERICAEEN

SEQ ID NO: 770800 - protein, 17 aa, Mycobacterium
LLAPVAVPLVYRASIAA

SEQ ID NO: 770801 - protein, 20 aa, Mycobacterium
LLARGWRIFFAHRTFAWSSD

SEQ ID NO: 770802 - protein, 19 aa, Mycobacterium
LLARLGKRVLRPGGVELTR

SEQ ID NO: 770803 - protein, 22 aa, Mycobacterium
LLARRLVDVTGWLAAQPDTTAL

SEQ ID NO: 770804 - protein, 23 aa, Mycobacterium
LLARRLVDVTGWLAGQPDTASLP

SEQ ID NO: 770805 - protein, 23 aa, Mycobacterium
LLASDFRAGCPIAAVAVEAGEGP

SEQ ID NO: 770806 - protein, 19 aa, Mycobacterium
LLASFPYPHLLTVTARLAD

SEQ ID NO: 770807 - protein, 19 aa, Mycobacterium
LLASMAFCIDKIVSYGVDI

SEQ ID NO: 770808 - protein, 17 aa, Mycobacterium
LLATEWALPRLDAETTV

SEQ ID NO: 770809 - protein, 27 aa, Mycobacterium
LLAVPRLGWVNLHFSLLPAWRGAAPVQ

SEQ ID NO: 770810 - protein, 17 aa, Mycobacterium
LLCAEEVDRACAPWGLL

SEQ ID NO: 770811 - protein, 18 aa, Mycobacterium
LLDAFGIPTAGAAGFEAD

SEQ ID NO: 770812 - protein, 22 aa, Mycobacterium
LLDALRWLGLDWDEGPEVDGPY

SEQ ID NO: 770813 - protein, 23 aa, Mycobacterium
LLDDRVRFIPGWFKDTLQDAPIE

SEQ ID NO: 770814 - protein, 33 aa, Mycobacterium
LLDEAWWFPAICWPDGRLQFMLNERMMPAQFIV

SEQ ID NO: 770815 - protein, 17 aa, Mycobacterium
LLDEAWWLPSVFIANGG

SEQ ID NO: 770816 - protein, 20 aa, Mycobacterium
LLDEFSKVWDYRGRARASAT

SEQ ID NO: 770817 - protein, 19 aa, Mycobacterium
LLDGFPRAAAIVVDPGMTV

SEQ ID NO: 770818 - protein, 19 aa, Mycobacterium
LLDGQRVTTHWAFAERLAS

SEQ ID NO: 770819 - protein, 17 aa, Mycobacterium
LLDGRRATTHWAAADLF

SEQ ID NO: 770820 - protein, 19 aa, Mycobacterium
LLDGRRATTHWAFADRLAR

SEQ ID NO: 770821 - protein, 19 aa, Mycobacterium
LLDGRRATTHWAHCQTLAR

SEQ ID NO: 770822 - protein, 18 aa, Mycobacterium
LLDGRRVTTHWAFADRLA

SEQ ID NO: 770823 - protein, 24 aa, Mycobacterium
LLDGYGLACVGGFVPVVLFSDDHD

SEQ ID NO: 770824 - protein, 18 aa, Mycobacterium
LLDHIPEALPIVYTPTVG

SEQ ID NO: 770825 - protein, 18 aa, Mycobacterium
LLDICFLFLIAGLDTVTD

SEQ ID NO: 770826 - protein, 21 aa, Mycobacterium
LLDIGCGWGATLRRALSRYDV

SEQ ID NO: 770827 - protein, 19 aa, Mycobacterium
LLDIGMTWSAYRDATQALI

SEQ ID NO: 770828 - protein, 17 aa, Mycobacterium
LLDLGWLLVCWPDGPNP

SEQ ID NO: 770829 - protein, 24 aa, Mycobacterium
LLDLRPAVVSFTFGLPSAEERRRL

SEQ ID NO: 770830 - protein, 24 aa, Mycobacterium
LLDPFRPGVCERIGIGPEECAKRN

SEQ ID NO: 770831 - protein, 17 aa, Mycobacterium
LLDRARYLKALAVAAEL

SEQ ID NO: 770832 - protein, 24 aa, Mycobacterium
LLDRLPPLLGTWAFGFATRLSRRS

SEQ ID NO: 770833 - protein, 19 aa, Mycobacterium
LLDRPTLVVGHSFGGALAL

SEQ ID NO: 770834 - protein, 17 aa, Mycobacterium
LLDRWAPGRIMLNAYGP

SEQ ID NO: 770835 - protein, 19 aa, Mycobacterium
LLDRWSAVMMNNYGTPPLA

SEQ ID NO: 770836 - protein, 26 aa, Mycobacterium
LLDVGCGWGGMARYAARRGVRVIGAT

SEQ ID NO: 770837 - protein, 18 aa, Mycobacterium
LLDWCRKNDVVFIADEVQ

SEQ ID NO: 770838 - protein, 25 aa, Mycobacterium
LLEAGRWAASWGKRFPVRYIVGRRG

SEQ ID NO: 770839 - protein, 19 aa, Mycobacterium
LLEALNLYADEMINPLANS

SEQ ID NO: 770840 - protein, 17 aa, Mycobacterium
LLEDLNVAWAQRRSGLD

SEQ ID NO: 770841 - protein, 26 aa, Mycobacterium
LLEGYRAASHWAFREFLSAYGAIPDD

SEQ ID NO: 770842 - protein, 22 aa, Mycobacterium
LLEIARFWAGLALFSRERGRYV

SEQ ID NO: 770843 - protein, 17 aa, Mycobacterium
LLELSWEALERSGIDPT

SEQ ID NO: 770844 - protein, 20 aa, Mycobacterium
LLEMSQLPGRGWVEYEPYGT

SEQ ID NO: 770845 - protein, 17 aa, Mycobacterium
LLEQFGLMHAAKRRVST

SEQ ID NO: 770846 - protein, 21 aa, Mycobacterium
LLERCPVCLYAGSIMPKDLLA

SEQ ID NO: 770847 - protein, 18 aa, Mycobacterium
LLERELPVYIVSIGRTFR

SEQ ID NO: 770848 - protein, 18 aa, Mycobacterium
LLERRLGLTTADIERLAK

SEQ ID NO: 770849 - protein, 17 aa, Mycobacterium
LLESFLFYSGFYLPMYW

SEQ ID NO: 770850 - protein, 23 aa, Mycobacterium
LLEVGCGWGLTLQRAMEKYDVNV

SEQ ID NO: 770851 - protein, 19 aa, Mycobacterium
LLEYHWGPDWMVWDAEKTA

SEQ ID NO: 770852 - protein, 19 aa, Mycobacterium
LLEYHWGPDWMVWDAHKTA

SEQ ID NO: 770853 - protein, 19 aa, Mycobacterium
LLEYHWGPDWMVWDAQRTV

SEQ ID NO: 770854 - protein, 18 aa, Mycobacterium
LLFARLLQYRAFKHVAEM

SEQ ID NO: 770855 - protein, 18 aa, Mycobacterium
LLFARLLQYRAFKHVAQM

SEQ ID NO: 770856 - protein, 17 aa, Mycobacterium
LLFCAACGRRMQGAARA

SEQ ID NO: 770857 - protein, 17 aa, Mycobacterium
LLFCAACGRRMQGAARP

SEQ ID NO: 770858 - protein, 18 aa, Mycobacterium
LLFDSGWLLPGNPPEFGG

SEQ ID NO: 770859 - protein, 19 aa, Mycobacterium
LLFDSGWLLPGNPPEFGGR

SEQ ID NO: 770860 - protein, 19 aa, Mycobacterium
LLFGIPYDRIDVVVHPQSI

SEQ ID NO: 770861 - protein, 19 aa, Mycobacterium
LLFGIPYDRIEVVVHPQSV

SEQ ID NO: 770862 - protein, 19 aa, Mycobacterium
LLFGIPYERIEVVVHPQSI

SEQ ID NO: 770863 - protein, 19 aa, Mycobacterium
LLFGLPYDRIEVVVHPQSI

SEQ ID NO: 770864 - protein, 23 aa, Mycobacterium
LLFPFAAGVPTWWRTMEAKVAKL

SEQ ID NO: 770865 - protein, 17 aa, Mycobacterium
LLGAIAWLAEQKPGIYD

SEQ ID NO: 770866 - protein, 17 aa, Mycobacterium
LLGCGFITGWGSSVYAA

SEQ ID NO: 770867 - protein, 18 aa, Mycobacterium
LLGCPRCGTQFDVVHAGA

SEQ ID NO: 770868 - protein, 23 aa, Mycobacterium
LLGFSIKRAVTWSEEAGNTRPRY

SEQ ID NO: 770869 - protein, 18 aa, Mycobacterium
LLGGLAVMFGVLPPLPTT

SEQ ID NO: 770870 - protein, 23 aa, Mycobacterium
LLGGLPVRRLWGIGPVAEEKLHR

SEQ ID NO: 770871 - protein, 18 aa, Mycobacterium
LLGGMPLAGVGGGSTGAG

SEQ ID NO: 770872 - protein, 18 aa, Mycobacterium
LLGHDWGSIQAWAAVTDD

SEQ ID NO: 770873 - protein, 19 aa, Mycobacterium
LLGHLWSIESWVRQILRTR

SEQ ID NO: 770874 - protein, 24 aa, Mycobacterium
LLGIPDAFAWCWAKGGYWRSHIRS

SEQ ID NO: 770875 - protein, 19 aa, Mycobacterium
LLGIWWAGAELVFGDASTD

SEQ ID NO: 770876 - protein, 23 aa, Mycobacterium
LLGKSAYHALTFGWLMSGLARAV

SEQ ID NO: 770877 - protein, 17 aa, Mycobacterium
LLGLECVIYMGAVDTER

SEQ ID NO: 770878 - protein, 18 aa, Mycobacterium
LLGLRFGAAAVRALDEGH

SEQ ID NO: 770879 - protein, 17 aa, Mycobacterium
LLGMLGLIIGGGFDTTT

SEQ ID NO: 770880 - protein, 18 aa, Mycobacterium
LLGPAYRLFYERPVHLVR

SEQ ID NO: 770881 - protein, 17 aa, Mycobacterium
LLGPEYKSPQLIKPEVL

SEQ ID NO: 770882 - protein, 25 aa, Mycobacterium
LLGREWLKPTAYMMAKFGMTLCALG

SEQ ID NO: 770883 - protein, 17 aa, Mycobacterium
LLGRPLIGNGADGTAPG

SEQ ID NO: 770884 - protein, 17 aa, Mycobacterium
LLGSEAMQRACEDALGA

SEQ ID NO: 770885 - protein, 23 aa, Mycobacterium
LLGSLRIGNRFVHTGKPKPEAYA

SEQ ID NO: 770886 - protein, 23 aa, Mycobacterium
LLGSLRVGNRFVHTGKPTPAGYA

SEQ ID NO: 770887 - protein, 17 aa, Mycobacterium
LLGVPFSAPYSFDTPFG

SEQ ID NO: 770888 - protein, 19 aa, Mycobacterium
LLGVPWIVVIGRGWADGTI

SEQ ID NO: 770889 - protein, 18 aa, Mycobacterium
LLHALSLWRKAADDFAPP

SEQ ID NO: 770890 - protein, 19 aa, Mycobacterium
LLHCPRCGTGFDVVGAGAG

SEQ ID NO: 770891 - protein, 19 aa, Mycobacterium
LLHGLPVRRLWGIGPVAEE

SEQ ID NO: 770892 - protein, 18 aa, Mycobacterium
LLHGWPQTWYAWRKVIPL

SEQ ID NO: 770893 - protein, 19 aa, Mycobacterium
LLHHVPRPPALQVGTCTAL

SEQ ID NO: 770894 - protein, 23 aa, Mycobacterium
LLHLVDFPLALGIRPNIPYEEQR

SEQ ID NO: 770895 - protein, 17 aa, Mycobacterium
LLHWARPIAPLILNASS

SEQ ID NO: 770896 - protein, 18 aa, Mycobacterium
LLIARPGFVVGRMTQGMD

SEQ ID NO: 770897 - protein, 19 aa, Mycobacterium
LLIELDIHFRIEDDLYYPA

SEQ ID NO: 770898 - protein, 20 aa, Mycobacterium
LLIPDWRTGSTLQLTGTARL

SEQ ID NO: 770899 - protein, 18 aa, Mycobacterium
LLIRRAGARSSDMAAELA

SEQ ID NO: 770900 - protein, 18 aa, Mycobacterium
LLIRRSGARSADMAAELA

SEQ ID NO: 770901 - protein, 18 aa, Mycobacterium
LLKCGPWHRGGWDPIPER

SEQ ID NO: 770902 - protein, 18 aa, Mycobacterium
LLLAEGIEGRCRIIGPID

SEQ ID NO: 770903 - protein, 17 aa, Mycobacterium
LLLAHGYDHNWVINRAD

SEQ ID NO: 770904 - protein, 18 aa, Mycobacterium
LLLETAWRAIEHSGTAPS

SEQ ID NO: 770905 - protein, 18 aa, Mycobacterium
LLLEVAWEALEDAGQVPE

SEQ ID NO: 770906 - protein, 18 aa, Mycobacterium
LLLEVAWEALEHAGIPPT

SEQ ID NO: 770907 - protein, 18 aa, Mycobacterium
LLLEVAWEALENAGINPR

SEQ ID NO: 770908 - protein, 21 aa, Mycobacterium
LLLEVICARLLLPSASDAESA

SEQ ID NO: 770909 - protein, 22 aa, Mycobacterium
LLLEVMCARLLLPSAADTESAL

SEQ ID NO: 770910 - protein, 21 aa, Mycobacterium
LLLEVVCARLLLPSASDAESA

SEQ ID NO: 770911 - protein, 22 aa, Mycobacterium
LLLEVVCARLLLPSASDTEAAL

SEQ ID NO: 770912 - protein, 22 aa, Mycobacterium
LLLEVVCARLLLPSATDAESAV

SEQ ID NO: 770913 - protein, 21 aa, Mycobacterium
LLLEVVCSRLLLPSASDTESA

SEQ ID NO: 770914 - protein, 17 aa, Mycobacterium
LLLGYQRCRVHERLVSG

SEQ ID NO: 770915 - protein, 18 aa, Mycobacterium
LLLLGALCHDIGKGRGGD

SEQ ID NO: 770916 - protein, 20 aa, Mycobacterium
LLLLTCGAWGQVVRFIPALV

SEQ ID NO: 770917 - protein, 17 aa, Mycobacterium
LLLPLGLRRLRVYASTR

SEQ ID NO: 770918 - protein, 17 aa, Mycobacterium
LLLPLGVRSLRAYGPTR

SEQ ID NO: 770919 - protein, 17 aa, Mycobacterium
LLLRDVFIAAGGTHDDW

SEQ ID NO: 770920 - protein, 26 aa, Mycobacterium
LLLSRFSFRVRYLWFRAWVNSPAGAR

SEQ ID NO: 770921 - protein, 22 aa, Mycobacterium
LLMARHMFTLWAPKRAGVTDGV

SEQ ID NO: 770922 - protein, 18 aa, Mycobacterium
LLMEVFRPLLSSDSGRIP

SEQ ID NO: 770923 - protein, 17 aa, Mycobacterium
LLMPNCLEFIPIQQAIW

SEQ ID NO: 770924 - protein, 21 aa, Mycobacterium
LLMRRCPRRSFTIVGDLAQRR

SEQ ID NO: 770925 - protein, 17 aa, Mycobacterium
LLMSAWLDLPGRPSLVG

SEQ ID NO: 770926 - protein, 23 aa, Mycobacterium
LLNAKTRRPSVCNAAETLLVDRA

SEQ ID NO: 770927 - protein, 17 aa, Mycobacterium
LLNAWGLTVDAEGLRAF

SEQ ID NO: 770928 - protein, 17 aa, Mycobacterium
LLNGFKWFASNCAGEAF

SEQ ID NO: 770929 - protein, 19 aa, Mycobacterium
LLNGRRATTHWAHCQTLAR

SEQ ID NO: 770930 - protein, 17 aa, Mycobacterium
LLNPLALLASQGVPLAF

SEQ ID NO: 770931 - protein, 18 aa, Mycobacterium
LLNRLWKLVSLRCNFFTP

SEQ ID NO: 770932 - protein, 20 aa, Mycobacterium
LLNRWPQWDIDYDSLQLAPT

SEQ ID NO: 770933 - protein, 23 aa, Mycobacterium
LLNSKTRRPSVCNAAETLLIDRA

SEQ ID NO: 770934 - protein, 17 aa, Mycobacterium
LLPEARHALRLSGAFLA

SEQ ID NO: 770935 - protein, 18 aa, Mycobacterium
LLPEWAIPPREEFDFGYP

SEQ ID NO: 770936 - protein, 17 aa, Mycobacterium
LLPGCKAPSSSGGSPSP

SEQ ID NO: 770937 - protein, 17 aa, Mycobacterium
LLPGYLIFRSIIPGRPP

SEQ ID NO: 770938 - protein, 20 aa, Mycobacterium
LLPILTPIVLAFVAKKLTGG

SEQ ID NO: 770939 - protein, 21 aa, Mycobacterium
LLPNLVTVLGWRSCDHTGPVH

SEQ ID NO: 770940 - protein, 22 aa, Mycobacterium
LLPPALKWRLFFASQGKNPKYL

SEQ ID NO: 770941 - protein, 20 aa, Mycobacterium
LLPRMAAAGFGRVVAVSSVY

SEQ ID NO: 770942 - protein, 22 aa, Mycobacterium
LLPSCWRRINAYGIRVNNRSYD

SEQ ID NO: 770943 - protein, 20 aa, Mycobacterium
LLPTVRGAFCLTFMDENTLY

SEQ ID NO: 770944 - protein, 19 aa, Mycobacterium
LLPVHCWFDGDGWGFEVFP

SEQ ID NO: 770945 - protein, 22 aa, Mycobacterium
LLQHWDWLSSMAELSIKIAKQA

SEQ ID NO: 770946 - protein, 23 aa, Mycobacterium
LLQLRRPALLVGRTDPTGLTAGT

SEQ ID NO: 770947 - protein, 18 aa, Mycobacterium
LLQPEQWGGLQADPTVFY

SEQ ID NO: 770948 - protein, 19 aa, Mycobacterium
LLQPLALAPRGIWLGPKEL

SEQ ID NO: 770949 - protein, 18 aa, Mycobacterium
LLQPMGIVHGGVYCSMIE

SEQ ID NO: 770950 - protein, 19 aa, Mycobacterium
LLQRAGCFRTGYRDGETLR

SEQ ID NO: 770951 - protein, 23 aa, Mycobacterium
LLQRMLFESCLLHAGQACILHSR

SEQ ID NO: 770952 - protein, 20 aa, Mycobacterium
LLQRPRCLYFRDVSAACNRR

SEQ ID NO: 770953 - protein, 19 aa, Mycobacterium
LLQRPRCPYFRDVSAACNR

SEQ ID NO: 770954 - protein, 23 aa, Mycobacterium
LLQRSWIAIFWSRFAEAVELIAE

SEQ ID NO: 770955 - protein, 17 aa, Mycobacterium
LLQVRWLCLEGSGDRVD

SEQ ID NO: 770956 - protein, 21 aa, Mycobacterium
LLRACGGIDGLERVRFTSPHP

SEQ ID NO: 770957 - protein, 21 aa, Mycobacterium
LLRAGAIAKRVRRAMDHLPLG

SEQ ID NO: 770958 - protein, 20 aa, Mycobacterium
LLRDRFRLVAIDNRGAGKSS

SEQ ID NO: 770959 - protein, 21 aa, Mycobacterium
LLREAHDWCGLPVSVFRCDMI

SEQ ID NO: 770960 - protein, 22 aa, Mycobacterium
LLREFADVFGIEGETKMRYDAA

SEQ ID NO: 770961 - protein, 23 aa, Mycobacterium
LLREFLDWLFARYLEIVDGEPNP

SEQ ID NO: 770962 - protein, 17 aa, Mycobacterium
LLREFPILVPTGVGFMK

SEQ ID NO: 770963 - protein, 17 aa, Mycobacterium
LLREVNAEFGVTIVVIT

SEQ ID NO: 770964 - protein, 19 aa, Mycobacterium
LLRFFFKSWFRVEVSGVEN

SEQ ID NO: 770965 - protein, 18 aa, Mycobacterium
LLRFFFRSWFRVEVSGIE

SEQ ID NO: 770966 - protein, 18 aa, Mycobacterium
LLRFFFRSWFRVEVSGVE

SEQ ID NO: 770967 - protein, 24 aa, Mycobacterium
LLRGKLWHDTRCEWWYRQNVLVYA

SEQ ID NO: 770968 - protein, 20 aa, Mycobacterium
LLRGLAQWDRLVIVETFAPE

SEQ ID NO: 770969 - protein, 19 aa, Mycobacterium
LLRGRARMAAVFVTGGHFL

SEQ ID NO: 770970 - protein, 24 aa, Mycobacterium
LLRGVPIGPFGRRTAAAGYSHKYG

SEQ ID NO: 770971 - protein, 25 aa, Mycobacterium
LLRHWGIRPDFVLGHSVGEIAAAYA

SEQ ID NO: 770972 - protein, 20 aa, Mycobacterium
LLRKRPDPMAGMDDAPQSIE

SEQ ID NO: 770973 - protein, 22 aa, Mycobacterium
LLRKSGKAVLDWADVVAEESAE

SEQ ID NO: 770974 - protein, 20 aa, Mycobacterium
LLRLKAWRLDVAKEQKVPAY

SEQ ID NO: 770975 - protein, 17 aa, Mycobacterium
LLRPALRGSDAVLSAVG

SEQ ID NO: 770976 - protein, 23 aa, Mycobacterium
LLRREIACVPLLHGGGHERDIRS

SEQ ID NO: 770977 - protein, 19 aa, Mycobacterium
LLRRGGECLAEFDTDITGV

SEQ ID NO: 770978 - protein, 17 aa, Mycobacterium
LLRRPDLLVSLLTYWQH

SEQ ID NO: 770979 - protein, 22 aa, Mycobacterium
LLRRRIKPLVKRRTKALVAAEL

SEQ ID NO: 770980 - protein, 19 aa, Mycobacterium
LLRSCTGWPSGVWIDEPRR

SEQ ID NO: 770981 - protein, 27 aa, Mycobacterium
LLRWLPRLWPSWRIEFWEDRYEEQFRQ

SEQ ID NO: 770982 - protein, 17 aa, Mycobacterium
LLSAEWQAGVSHHVVLS

SEQ ID NO: 770983 - protein, 18 aa, Mycobacterium
LLSDIALDFKPVVQTRYE

SEQ ID NO: 770984 - protein, 18 aa, Mycobacterium
LLSDYALVCIDEFELDDP

SEQ ID NO: 770985 - protein, 17 aa, Mycobacterium
LLSEWRATLIVRESACL

SEQ ID NO: 770986 - protein, 21 aa, Mycobacterium
LLSKLRAGKVLSLSGIMDDLI

SEQ ID NO: 770987 - protein, 26 aa, Mycobacterium
LLSPILRPALRAVLMVQRRLEGRGPY

SEQ ID NO: 770988 - protein, 21 aa, Mycobacterium
LLSRFGAVQVVRPVEWARSNR

SEQ ID NO: 770989 - protein, 21 aa, Mycobacterium
LLSRLREWGVQQVFGYPGDGI

SEQ ID NO: 770990 - protein, 24 aa, Mycobacterium
LLSSRFPMWMAWGPDLTFFCNDAY

SEQ ID NO: 770991 - protein, 17 aa, Mycobacterium
LLTAAGIAAEWCNEPNL

SEQ ID NO: 770992 - protein, 18 aa, Mycobacterium
LLTARGYLLVSFEDVLGR

SEQ ID NO: 770993 - protein, 25 aa, Mycobacterium
LLTCAIRPSGIWGRGDQTMFRKLFE

SEQ ID NO: 770994 - protein, 25 aa, Mycobacterium
LLTCSIRPSGIWGRGDQTMFRKVFE

SEQ ID NO: 770995 - protein, 17 aa, Mycobacterium
LLTEMGYRPSEIVIAGD

SEQ ID NO: 770996 - protein, 21 aa, Mycobacterium
LLTEWFARWVGFLVPTHRPMD

SEQ ID NO: 770997 - protein, 19 aa, Mycobacterium
LLTGWRDAWELGRTARDNA

SEQ ID NO: 770998 - protein, 17 aa, Mycobacterium
LLTILAIALHEVDTIEV

SEQ ID NO: 770999 - protein, 21 aa, Mycobacterium
LLTPRELGGWAAPLPTALSVY

SEQ ID NO: 771000 - protein, 22 aa, Mycobacterium
LLTRATPYIGHFQIRNRGTLGG

SEQ ID NO: 771001 - protein, 17 aa, Mycobacterium
LLTRNGLTLQDFDYYEI

SEQ ID NO: 771002 - protein, 18 aa, Mycobacterium
LLTRVWADEFGRSGVRVN

SEQ ID NO: 771003 - protein, 17 aa, Mycobacterium
LLTRWRPALAVAQNAKV

SEQ ID NO: 771004 - protein, 17 aa, Mycobacterium
LLVALLYSGRIDLKNDA

SEQ ID NO: 771005 - protein, 24 aa, Mycobacterium
LLVDAMGALVFWRLIALFRPVTSE

SEQ ID NO: 771006 - protein, 17 aa, Mycobacterium
LLVEAAWHHKPRYHVGA

SEQ ID NO: 771007 - protein, 22 aa, Mycobacterium
LLVFGRRAGLGAADYVRALPDR

SEQ ID NO: 771008 - protein, 19 aa, Mycobacterium
LLVGKCCGHGSDIVLDFPV

SEQ ID NO: 771009 - protein, 21 aa, Mycobacterium
LLVHRWCGGGSWVMVLLPVVR

SEQ ID NO: 771010 - protein, 17 aa, Mycobacterium
LLVIFGITGDLARKMTF

SEQ ID NO: 771011 - protein, 19 aa, Mycobacterium
LLVLRINFLGMRQFTESLL

SEQ ID NO: 771012 - protein, 17 aa, Mycobacterium
LLVPRAFVPVAALPVTP

SEQ ID NO: 771013 - protein, 26 aa, Mycobacterium
LLVQPAHTLSQAWITSPLGQVVDPVI

SEQ ID NO: 771014 - protein, 19 aa, Mycobacterium
LLVRGGVVFNGYWGNEEET

SEQ ID NO: 771015 - protein, 18 aa, Mycobacterium
LLVRGGVVFSGYWRNEQA

SEQ ID NO: 771016 - protein, 17 aa, Mycobacterium
LLWRRWSPGYRADEDLR

SEQ ID NO: 771017 - protein, 17 aa, Mycobacterium
LLWSFAPPARPRPADMS

SEQ ID NO: 771018 - protein, 17 aa, Mycobacterium
LLWSFAPSDRMTRPRPA

SEQ ID NO: 771019 - protein, 17 aa, Mycobacterium
LLWSHPGAPAFWYQPSR

SEQ ID NO: 771020 - protein, 19 aa, Mycobacterium
LMAAARLDLASVFFYNGSI

SEQ ID NO: 771021 - protein, 18 aa, Mycobacterium
LMAAARLDLASVFLYNGS

SEQ ID NO: 771022 - protein, 18 aa, Mycobacterium
LMAELGFRTVNEAVGQVG

SEQ ID NO: 771023 - protein, 19 aa, Mycobacterium
LMAELGFRTVNEMVGQVGA

SEQ ID NO: 771024 - protein, 18 aa, Mycobacterium
LMAGLPALRRQRLHAQVA

SEQ ID NO: 771025 - protein, 17 aa, Mycobacterium
LMAPHWPAPWGVDADPL

SEQ ID NO: 771026 - protein, 19 aa, Mycobacterium
LMAQLGFRTVNEMVGQVGA

SEQ ID NO: 771027 - protein, 19 aa, Mycobacterium
LMARLWLRSIARYQDGVLT

SEQ ID NO: 771028 - protein, 20 aa, Mycobacterium
LMAYEVLRDIPLHDVEIETP

SEQ ID NO: 771029 - protein, 18 aa, Mycobacterium
LMCGAGYGRIVLTSSIGG

SEQ ID NO: 771030 - protein, 22 aa, Mycobacterium
LMEMMWSFRANGMWSDERGTNM

SEQ ID NO: 771031 - protein, 17 aa, Mycobacterium
LMENLNISRIVQIDPDT

SEQ ID NO: 771032 - protein, 25 aa, Mycobacterium
LMGHARLTVEFTWYGPDGDSITSVA

SEQ ID NO: 771033 - protein, 22 aa, Mycobacterium
LMGTVWMCRAAWPHMRDAGYGR

SEQ ID NO: 771034 - protein, 18 aa, Mycobacterium
LMHGAAQWSVMTAITTGQ

SEQ ID NO: 771035 - protein, 20 aa, Mycobacterium
LMHLMRIASTFGFVPIGGWA

SEQ ID NO: 771036 - protein, 20 aa, Mycobacterium
LMKFYQCIQNVVIPTQPGAG

SEQ ID NO: 771037 - protein, 18 aa, Mycobacterium
LMLARRLPTASAFLHQPG

SEQ ID NO: 771038 - protein, 18 aa, Mycobacterium
LMLEIAWEGLERAGYSPA

SEQ ID NO: 771039 - protein, 18 aa, Mycobacterium
LMLIWACDLIVAADNAKF

SEQ ID NO: 771040 - protein, 18 aa, Mycobacterium
LMLIWACDLIVAADNARF

SEQ ID NO: 771041 - protein, 18 aa, Mycobacterium
LMLIWACDLIVGSEEVRF

SEQ ID NO: 771042 - protein, 22 aa, Mycobacterium
LMLRAPFRLTREVLPHLRPGSA

SEQ ID NO: 771043 - protein, 23 aa, Mycobacterium
LMLRAPFRLTREVLPHMPAGSGI

SEQ ID NO: 771044 - protein, 23 aa, Mycobacterium
LMLRECPRLPAVGCETGDWSHVD

SEQ ID NO: 771045 - protein, 17 aa, Mycobacterium
LMMCLRDALSAVHDEMA

SEQ ID NO: 771046 - protein, 19 aa, Mycobacterium
LMPCFARLYEELGITKADI

SEQ ID NO: 771047 - protein, 22 aa, Mycobacterium
LMRAALPLGLWVPVLPGTRQVT

SEQ ID NO: 771048 - protein, 25 aa, Mycobacterium
LMREYPDLAAFEWAIRAGNIVSSDW

SEQ ID NO: 771049 - protein, 23 aa, Mycobacterium
LMREYPDLAAFEWVIRAEGAAGP

SEQ ID NO: 771050 - protein, 17 aa, Mycobacterium
LMRLTGYGSKWSVEQGD

SEQ ID NO: 771051 - protein, 23 aa, Mycobacterium
LMRNRIDLLIGHGRFVDPHTIEV

SEQ ID NO: 771052 - protein, 23 aa, Mycobacterium
LMRNRIDLLLGHGRFVDPHTIEV

SEQ ID NO: 771053 - protein, 19 aa, Mycobacterium
LMRRCPSRSFTIVGDLAQR

SEQ ID NO: 771054 - protein, 24 aa, Mycobacterium
LMRSCTGWPSGTWIDPPRRTAPDG

SEQ ID NO: 771055 - protein, 20 aa, Mycobacterium
LMRSCTGWPSGVWIDEPRRT

SEQ ID NO: 771056 - protein, 24 aa, Mycobacterium
LMRSCTGWPSGVWIDEPRRTAPDG

SEQ ID NO: 771057 - protein, 18 aa, Mycobacterium
LMRWGLVPPWVKAGEDGG

SEQ ID NO: 771058 - protein, 17 aa, Mycobacterium
LMSAFALGLRLPADYFV

SEQ ID NO: 771059 - protein, 19 aa, Mycobacterium
LMSGYLGSIGFGFPAAMGA

SEQ ID NO: 771060 - protein, 18 aa, Mycobacterium
LMTAAATPYVEWLTTAAA

SEQ ID NO: 771061 - protein, 18 aa, Mycobacterium
LMTAAVTPYVAWLQAGAA

SEQ ID NO: 771062 - protein, 18 aa, Mycobacterium
LMTAMSWLALGRDLEGLP

SEQ ID NO: 771063 - protein, 23 aa, Mycobacterium
LMVKAGVQWGLFGGAVENLGTER

SEQ ID NO: 771064 - protein, 24 aa, Mycobacterium
LMVKAGVQWGLFGGAVENLGTERH

SEQ ID NO: 771065 - protein, 17 aa, Mycobacterium
LMYMGGDGFYWRHTFHP

SEQ ID NO: 771066 - protein, 18 aa, Mycobacterium
LNAARAPFSLSFSTHHVQ

SEQ ID NO: 771067 - protein, 18 aa, Mycobacterium
LNAGANWYAGVESANSST

SEQ ID NO: 771068 - protein, 18 aa, Mycobacterium
LNALIPTAGLDWRQVAVL

SEQ ID NO: 771069 - protein, 17 aa, Mycobacterium
LNAMWRRGDEVFAEVAL

SEQ ID NO: 771070 - protein, 17 aa, Mycobacterium
LNAVMGIVYVHPTYLDL

SEQ ID NO: 771071 - protein, 20 aa, Mycobacterium
LNDCPLRWLAERHGGTNPRA

SEQ ID NO: 771072 - protein, 23 aa, Mycobacterium
LNDPAVGVVCEWACAMFQQPGET

SEQ ID NO: 771073 - protein, 25 aa, Mycobacterium
LNDVLKAAWGYRGWVMSDWGGTPGW

SEQ ID NO: 771074 - protein, 24 aa, Mycobacterium
LNELERVGGRYGLQTMCEGGGTAN

SEQ ID NO: 771075 - protein, 24 aa, Mycobacterium
LNELRTWFGFGVAGNFAGHLEQAG

SEQ ID NO: 771076 - protein, 25 aa, Mycobacterium
LNEPRLRPNIPIMIGGSGEKKTFGL

SEQ ID NO: 771077 - protein, 17 aa, Mycobacterium
LNFISDLNAVMGIVYVH

SEQ ID NO: 771078 - protein, 27 aa, Mycobacterium
LNFVFGEMWLRPGLGMKERRLITVACV

SEQ ID NO: 771079 - protein, 17 aa, Mycobacterium
LNGPRYWLMNAIEKEAQ

SEQ ID NO: 771080 - protein, 17 aa, Mycobacterium
LNGPRYWLMNAIEKQRQ

SEQ ID NO: 771081 - protein, 17 aa, Mycobacterium
LNGRSGYRFGHIEGPMQ

SEQ ID NO: 771082 - protein, 17 aa, Mycobacterium
LNITLLFGFSPRFPFPD

SEQ ID NO: 771083 - protein, 22 aa, Mycobacterium
LNLALEIGCLFSIDTDAHAPGQ

SEQ ID NO: 771084 - protein, 17 aa, Mycobacterium
LNLALEIGCVFSIDTDA

SEQ ID NO: 771085 - protein, 17 aa, Mycobacterium
LNLALEIGCVFSIDTDS

SEQ ID NO: 771086 - protein, 20 aa, Mycobacterium
LNLKEWKAEWGVADPQEARG

SEQ ID NO: 771087 - protein, 21 aa, Mycobacterium
LNLPFPQYVCMRVLSKNPGWS

SEQ ID NO: 771088 - protein, 24 aa, Mycobacterium
LNLPGVAFGHDWLTGAARYAGLLE

SEQ ID NO: 771089 - protein, 23 aa, Mycobacterium
LNLPGVAFGHEWLAGAARYSNLL

SEQ ID NO: 771090 - protein, 17 aa, Mycobacterium
LNLPSGWSYQPNRLTDE

SEQ ID NO: 771091 - protein, 25 aa, Mycobacterium
LNLSFPISLPISIDIGKIVIESFTL

SEQ ID NO: 771092 - protein, 19 aa, Mycobacterium
LNMAIPWIAAERGFIDAVI

SEQ ID NO: 771093 - protein, 19 aa, Mycobacterium
LNMAIPWIAAERGFIDAVV

SEQ ID NO: 771094 - protein, 17 aa, Mycobacterium
LNMATPWIAAERGYIDA

SEQ ID NO: 771095 - protein, 18 aa, Mycobacterium
LNMLIEFGDAFDYTGADF

SEQ ID NO: 771096 - protein, 17 aa, Mycobacterium
LNMMAHLLSTIDYRPVE

SEQ ID NO: 771097 - protein, 19 aa, Mycobacterium
LNMNPRWLGAHPAYTLSKY

SEQ ID NO: 771098 - protein, 19 aa, Mycobacterium
LNPAAGVLVSAAWAQSTGQ

SEQ ID NO: 771099 - protein, 19 aa, Mycobacterium
LNPAAGVMLRAVWAEPTGR

SEQ ID NO: 771100 - protein, 18 aa, Mycobacterium
LNPAAGVMLSALWVAPTG

SEQ ID NO: 771101 - protein, 18 aa, Mycobacterium
LNPEVPWEAMRFAVTTRP

SEQ ID NO: 771102 - protein, 17 aa, Mycobacterium
LNPEVWTWVAVSGLNLL

SEQ ID NO: 771103 - protein, 25 aa, Mycobacterium
LNPIDWKIVAGFMRELMPVDLPAGV

SEQ ID NO: 771104 - protein, 23 aa, Mycobacterium
LNPKSVVVPGHLIDIVVVQEDQW

SEQ ID NO: 771105 - protein, 18 aa, Mycobacterium
LNPQVWPRYCERFHDILG

SEQ ID NO: 771106 - protein, 21 aa, Mycobacterium
LNPRRAAVVAPGFTEPEAVLA

SEQ ID NO: 771107 - protein, 26 aa, Mycobacterium
LNQLWMCGLPGYFPGDLIDFEFSGDT

SEQ ID NO: 771108 - protein, 25 aa, Mycobacterium
LNQLWMCGLPGYFPGDLIDFQFSGD

SEQ ID NO: 771109 - protein, 17 aa, Mycobacterium
LNRAHIGAVIWSDEPDG

SEQ ID NO: 771110 - protein, 21 aa, Mycobacterium
LNRFPEWDIDYSTARLAPTST

SEQ ID NO: 771111 - protein, 24 aa, Mycobacterium
LNRLRRWYCDGALCIGDAAHAMSP

SEQ ID NO: 771112 - protein, 18 aa, Mycobacterium
LNRTRFTAVPGQGLFYRS

SEQ ID NO: 771113 - protein, 17 aa, Mycobacterium
LNSALMFSGAGSGPLLD

SEQ ID NO: 771114 - protein, 22 aa, Mycobacterium
LNSKTRRPSVCNAAETLLVDAA

SEQ ID NO: 771115 - protein, 22 aa, Mycobacterium
LNSKTRRPSVCNAAETLLVDAT

SEQ ID NO: 771116 - protein, 22 aa, Mycobacterium
LNVADAGLCFGRLDGVDGEHLY

SEQ ID NO: 771117 - protein, 25 aa, Mycobacterium
LNVELPFPCVWVAPWSPDAAIEPLR

SEQ ID NO: 771118 - protein, 17 aa, Mycobacterium
LNVLPVYGGSSYAIQLA

SEQ ID NO: 771119 - protein, 23 aa, Mycobacterium
LNWKSRPYLAWPAYGQSKLANLL

SEQ ID NO: 771120 - protein, 17 aa, Mycobacterium
LNWLLGHGEPPQFSRDV

SEQ ID NO: 771121 - protein, 26 aa, Mycobacterium
LNWWESRALYGWTVLVPRTKDQAGEM

SEQ ID NO: 771122 - protein, 17 aa, Mycobacterium
LNYWYPWQVTVLGLGPV

SEQ ID NO: 771123 - protein, 17 aa, Mycobacterium
LPAAAALLALHDLGLGN

SEQ ID NO: 771124 - protein, 20 aa, Mycobacterium
LPAARIAFMLSDSAPVAVLT

SEQ ID NO: 771125 - protein, 21 aa, Mycobacterium
LPAARRRLGIELDDVRKINPD

SEQ ID NO: 771126 - protein, 18 aa, Mycobacterium
LPADFGLPECPRWKVIDR

SEQ ID NO: 771127 - protein, 17 aa, Mycobacterium
LPADFRVVIIGAGIAGI

SEQ ID NO: 771128 - protein, 29 aa, Mycobacterium
LPAEMPAAALWWRLAGTLAPPSLEGTDTK

SEQ ID NO: 771129 - protein, 17 aa, Mycobacterium
LPAGHGLNAATLSYGDL

SEQ ID NO: 771130 - protein, 17 aa, Mycobacterium
LPAGHGLNAATLTYGDL

SEQ ID NO: 771131 - protein, 17 aa, Mycobacterium
LPAGWSYQPRVLTEELR

SEQ ID NO: 771132 - protein, 17 aa, Mycobacterium
LPAHCWFEPHERWGVRI

SEQ ID NO: 771133 - protein, 17 aa, Mycobacterium
LPAHLWAQYGLAGVLEH

SEQ ID NO: 771134 - protein, 20 aa, Mycobacterium
LPAILRKTLTWDRGKEMANH

SEQ ID NO: 771135 - protein, 24 aa, Mycobacterium
LPAKAADSLTEWMLGYVRFHRTYR

SEQ ID NO: 771136 - protein, 25 aa, Mycobacterium
LPAKGSRFIVCSQIQVVYPGVNLTT

SEQ ID NO: 771137 - protein, 17 aa, Mycobacterium
LPALKAFGAIPVADERI

SEQ ID NO: 771138 - protein, 17 aa, Mycobacterium
LPALLAALAERSTACTF

SEQ ID NO: 771139 - protein, 18 aa, Mycobacterium
LPAMRVLVAPDCYGESLS

SEQ ID NO: 771140 - protein, 17 aa, Mycobacterium
LPAMVCYWSELARDAAL

SEQ ID NO: 771141 - protein, 18 aa, Mycobacterium
LPAMVCYWSELAREIVLP

SEQ ID NO: 771142 - protein, 17 aa, Mycobacterium
LPANQVYRRLNWNLAAS

SEQ ID NO: 771143 - protein, 18 aa, Mycobacterium
LPAPLTFVCVFGYTAQTA

SEQ ID NO: 771144 - protein, 19 aa, Mycobacterium
LPAPRWTRVGVHIAESGMR

SEQ ID NO: 771145 - protein, 18 aa, Mycobacterium
LPAPRYGTATTFAQARRI

SEQ ID NO: 771146 - protein, 18 aa, Mycobacterium
LPAQWPVLLCNGAVGIAE

SEQ ID NO: 771147 - protein, 18 aa, Mycobacterium
LPARLVLSALIGRVRIPD

SEQ ID NO: 771148 - protein, 24 aa, Mycobacterium
LPARPELRLLWKVIGLAATVEGAL

SEQ ID NO: 771149 - protein, 18 aa, Mycobacterium
LPASLAYPIVKWKNQMVS

SEQ ID NO: 771150 - protein, 17 aa, Mycobacterium
LPATALAWREGFLDGQH

SEQ ID NO: 771151 - protein, 21 aa, Mycobacterium
LPATFALYLERAWPRHRRLSS

SEQ ID NO: 771152 - protein, 20 aa, Mycobacterium
LPAVRVGRSFRVHAKAVHDM

SEQ ID NO: 771153 - protein, 19 aa, Mycobacterium
LPCRTTVFVGLPHEVMLVE

SEQ ID NO: 771154 - protein, 18 aa, Mycobacterium
LPDALRIAVEALRASSAD

SEQ ID NO: 771155 - protein, 24 aa, Mycobacterium
LPDARPTVWLGVPRVWHKIKVGIE

SEQ ID NO: 771156 - protein, 19 aa, Mycobacterium
LPDCLRAVLTAALCAPVPV

SEQ ID NO: 771157 - protein, 30 aa, Mycobacterium
LPDELPAAALWWRLAAELTPAATVDAPHTG

SEQ ID NO: 771158 - protein, 22 aa, Mycobacterium
LPDERICLCGNTFGPLFGHIPN

SEQ ID NO: 771159 - protein, 23 aa, Mycobacterium
LPDERICLCGNTFGPVFGHVPNL

SEQ ID NO: 771160 - protein, 21 aa, Mycobacterium
LPDGEMAWWLLEDSARSTRLA

SEQ ID NO: 771161 - protein, 17 aa, Mycobacterium
LPDGWVITSSGRISGVT

SEQ ID NO: 771162 - protein, 19 aa, Mycobacterium
LPDIRRWATVVAQLLRPGG

SEQ ID NO: 771163 - protein, 20 aa, Mycobacterium
LPDIRRYGATYMNYVGKPLA

SEQ ID NO: 771164 - protein, 18 aa, Mycobacterium
LPDLKVFICGGASVPPSL

SEQ ID NO: 771165 - protein, 18 aa, Mycobacterium
LPDLKVFICGGASVPPTL

SEQ ID NO: 771166 - protein, 18 aa, Mycobacterium
LPDLKVFICGGASVSPSL

SEQ ID NO: 771167 - protein, 21 aa, Mycobacterium
LPDLLAVLSVRLGRIDRVLYH

SEQ ID NO: 771168 - protein, 18 aa, Mycobacterium
LPDLRICFLHGGGCAPGL

SEQ ID NO: 771169 - protein, 17 aa, Mycobacterium
LPDLVRRSPWGEMFQSA

SEQ ID NO: 771170 - protein, 22 aa, Mycobacterium
LPDPRTGLALKMIADYRNLVAH

SEQ ID NO: 771171 - protein, 24 aa, Mycobacterium
LPDREFDALFTPDRPVIFAYHGYP

SEQ ID NO: 771172 - protein, 17 aa, Mycobacterium
LPDSLLHYMRTRGKNKV

SEQ ID NO: 771173 - protein, 17 aa, Mycobacterium
LPDYFPRPLRERFTSEI

SEQ ID NO: 771174 - protein, 17 aa, Mycobacterium
LPEARYVHLFVARGRVT

SEQ ID NO: 771175 - protein, 20 aa, Mycobacterium
LPEEFRMAVYYADVEGFPYK

SEQ ID NO: 771176 - protein, 21 aa, Mycobacterium
LPEERICLCGNTFGPLFGHIP

SEQ ID NO: 771177 - protein, 20 aa, Mycobacterium
LPEFVCLRILSMYPGMSSAE

SEQ ID NO: 771178 - protein, 19 aa, Mycobacterium
LPEGMGLVLLTDGLFEGHI

SEQ ID NO: 771179 - protein, 20 aa, Mycobacterium
LPEGSGFEFLDKVVGGAVPR

SEQ ID NO: 771180 - protein, 24 aa, Mycobacterium
LPEGSMLVPFSWQRISLHAAGATA

SEQ ID NO: 771181 - protein, 18 aa, Mycobacterium
LPEHLHKVSLSFLVDDLV

SEQ ID NO: 771182 - protein, 18 aa, Mycobacterium
LPEHLVIVGGGFVAAEFA

SEQ ID NO: 771183 - protein, 21 aa, Mycobacterium
LPEIARAGTPLVLIDRGADIE

SEQ ID NO: 771184 - protein, 20 aa, Mycobacterium
LPELDFADAGTWLLVSTTDV

SEQ ID NO: 771185 - protein, 18 aa, Mycobacterium
LPELLGLCDRIYTLSAGR

SEQ ID NO: 771186 - protein, 23 aa, Mycobacterium
LPELPLRVGDTWEEAGPEGNRVF

SEQ ID NO: 771187 - protein, 24 aa, Mycobacterium
LPELPQLRWRVVGAPLGLDRPYFV

SEQ ID NO: 771188 - protein, 20 aa, Mycobacterium
LPELRCLMLTSFTSDEAMLE

SEQ ID NO: 771189 - protein, 20 aa, Mycobacterium
LPENLAYFAVRWKNVLRQAA

SEQ ID NO: 771190 - protein, 24 aa, Mycobacterium
LPERDFPTLISLYLQGRFPLDKFV

SEQ ID NO: 771191 - protein, 23 aa, Mycobacterium
LPERDFPTLISLYLQGRLPLEKF

SEQ ID NO: 771192 - protein, 19 aa, Mycobacterium
LPESIIIAGCGAIGMEFGY

SEQ ID NO: 771193 - protein, 24 aa, Mycobacterium
LPETFAVAWTCLFRNLDLKAGQTL

SEQ ID NO: 771194 - protein, 21 aa, Mycobacterium
LPETFGLYLERAWPRHRRLSG

SEQ ID NO: 771195 - protein, 22 aa, Mycobacterium
LPEWLRRWDVRGGQACEEAIEL

SEQ ID NO: 771196 - protein, 18 aa, Mycobacterium
LPEWLSADVAILGEPTSG

SEQ ID NO: 771197 - protein, 19 aa, Mycobacterium
LPFAGGSWVIWSRGDQAGS

SEQ ID NO: 771198 - protein, 17 aa, Mycobacterium
LPFALALVIRSVLQRFR

SEQ ID NO: 771199 - protein, 24 aa, Mycobacterium
LPFEEGWCRLAFSTGLDRLGVEPT

SEQ ID NO: 771200 - protein, 20 aa, Mycobacterium
LPFIDFPPGYGLRHETDRGF

SEQ ID NO: 771201 - protein, 20 aa, Mycobacterium
LPFPLSSAMLPRFLYTKEIG

SEQ ID NO: 771202 - protein, 24 aa, Mycobacterium
LPFSRIRILLRLSRGSMTVKEVAH

SEQ ID NO: 771203 - protein, 21 aa, Mycobacterium
LPFTVADLFEFLSIRELSRHL

SEQ ID NO: 771204 - protein, 18 aa, Mycobacterium
LPFWCVNHGPTLSMYYRD

SEQ ID NO: 771205 - protein, 17 aa, Mycobacterium
LPGALLVPAIHLVRAAH

SEQ ID NO: 771206 - protein, 23 aa, Mycobacterium
LPGFRPGKAPIRLLEARFGREAM

SEQ ID NO: 771207 - protein, 18 aa, Mycobacterium
LPGFVAGLGDEWVGLSVT

SEQ ID NO: 771208 - protein, 18 aa, Mycobacterium
LPGGLNWPLDLTVSDGRL

SEQ ID NO: 771209 - protein, 24 aa, Mycobacterium
LPGGLPIELGMSIRLARDKNYDLL

SEQ ID NO: 771210 - protein, 25 aa, Mycobacterium
LPGGLRPGDFVGVLGFTSIDYVVHY

SEQ ID NO: 771211 - protein, 23 aa, Mycobacterium
LPGHSPCGLGFRPDGTLLIASAH

SEQ ID NO: 771212 - protein, 22 aa, Mycobacterium
LPGHSPSGLGFRPDGSLLIAST

SEQ ID NO: 771213 - protein, 17 aa, Mycobacterium
LPGHTPSGLGFRPDGSL

SEQ ID NO: 771214 - protein, 17 aa, Mycobacterium
LPGIPGIKDFGGHIFHS

SEQ ID NO: 771215 - protein, 19 aa, Mycobacterium
LPGIWYAGSHGFELTAPDG

SEQ ID NO: 771216 - protein, 18 aa, Mycobacterium
LPGLGGWRRPQAELDESS

SEQ ID NO: 771217 - protein, 18 aa, Mycobacterium
LPGLGSWRRPQAELDESS

SEQ ID NO: 771218 - protein, 20 aa, Mycobacterium
LPGLHKAFYFGMGLVLQDER

SEQ ID NO: 771219 - protein, 17 aa, Mycobacterium
LPGLHSWVDERLAGREQ

SEQ ID NO: 771220 - protein, 20 aa, Mycobacterium
LPGMFAGVVPLVLNTSPTAS

SEQ ID NO: 771221 - protein, 23 aa, Mycobacterium
LPGQRIPLSFGRWPTRDQMVEYF

SEQ ID NO: 771222 - protein, 17 aa, Mycobacterium
LPGRAFLGYCTAKGALA

SEQ ID NO: 771223 - protein, 23 aa, Mycobacterium
LPGRETFSGISLHSARWDPNLDL

SEQ ID NO: 771224 - protein, 19 aa, Mycobacterium
LPGRFLFGFDDGRGDISGL

SEQ ID NO: 771225 - protein, 17 aa, Mycobacterium
LPGRIGAVAAELRRLGV

SEQ ID NO: 771226 - protein, 21 aa, Mycobacterium
LPGRWSFQVVEDYDDGYYRCF

SEQ ID NO: 771227 - protein, 17 aa, Mycobacterium
LPGSHFRSDIGLAAAEG

SEQ ID NO: 771228 - protein, 17 aa, Mycobacterium
LPGTALFVLDRWLRQLP

SEQ ID NO: 771229 - protein, 18 aa, Mycobacterium
LPGVWLIDVERVQREPSA

SEQ ID NO: 771230 - protein, 17 aa, Mycobacterium
LPGWARKPLWLPYFPPL

SEQ ID NO: 771231 - protein, 17 aa, Mycobacterium
LPGWLAYRDALAGAGAD

SEQ ID NO: 771232 - protein, 17 aa, Mycobacterium
LPGYAHRALITSHLQRA

SEQ ID NO: 771233 - protein, 21 aa, Mycobacterium
LPGYEEFAPWLLVEKTGNVHV

SEQ ID NO: 771234 - protein, 17 aa, Mycobacterium
LPGYIWGGTLESYFSHQ

SEQ ID NO: 771235 - protein, 20 aa, Mycobacterium
LPGYQGWQWAAVVASYVGAD

SEQ ID NO: 771236 - protein, 17 aa, Mycobacterium
LPHAVLMMIPEAWENAT

SEQ ID NO: 771237 - protein, 17 aa, Mycobacterium
LPHAVLMMIPEAWENST

SEQ ID NO: 771238 - protein, 18 aa, Mycobacterium
LPHGLPFTELLALHGVPA

SEQ ID NO: 771239 - protein, 17 aa, Mycobacterium
LPHGVEVIGYWGEAVTT

SEQ ID NO: 771240 - protein, 19 aa, Mycobacterium
LPHLQRLAVYTGDALAELE

SEQ ID NO: 771241 - protein, 18 aa, Mycobacterium
LPHVRRSPSEYVREHVRF

SEQ ID NO: 771242 - protein, 22 aa, Mycobacterium
LPHWAGVVPLALRAGTPEPAAD

SEQ ID NO: 771243 - protein, 17 aa, Mycobacterium
LPHWAGVVPLRVTAGAP

SEQ ID NO: 771244 - protein, 18 aa, Mycobacterium
LPHWAGVVPLTLTAGTPV

SEQ ID NO: 771245 - protein, 19 aa, Mycobacterium
LPIMFPLEVRFGAPDDAFL

SEQ ID NO: 771246 - protein, 23 aa, Mycobacterium
LPIPAEAATPFGIMSDALKDSIV

SEQ ID NO: 771247 - protein, 17 aa, Mycobacterium
LPISIDIIRFVKFIVTE

SEQ ID NO: 771248 - protein, 24 aa, Mycobacterium
LPITARYAQHWNFAGGPPEEFARK

SEQ ID NO: 771249 - protein, 17 aa, Mycobacterium
LPITLWPGMKIGQLCIL

SEQ ID NO: 771250 - protein, 17 aa, Mycobacterium
LPITLWPGMKIGQLCLL

SEQ ID NO: 771251 - protein, 18 aa, Mycobacterium
LPITYSRKVFIPVTHLCR

SEQ ID NO: 771252 - protein, 17 aa, Mycobacterium
LPIVEVIAGGDISEAAY

SEQ ID NO: 771253 - protein, 18 aa, Mycobacterium
LPKAIVFRAAIERSPSGK

SEQ ID NO: 771254 - protein, 24 aa, Mycobacterium
LPKAIVFRPVIERSPSGKADYRWA

SEQ ID NO: 771255 - protein, 23 aa, Mycobacterium
LPKFCSGELITAIAMTEPGTGSD

SEQ ID NO: 771256 - protein, 21 aa, Mycobacterium
LPKFCTGEFITAIAMTEPGTG

SEQ ID NO: 771257 - protein, 21 aa, Mycobacterium
LPKFCTGEIITAIAMTEPGTG

SEQ ID NO: 771258 - protein, 19 aa, Mycobacterium
LPKGVMVWDRSRLIEAQRV

SEQ ID NO: 771259 - protein, 25 aa, Mycobacterium
LPKLLKRLVIMGGSFDYPGNTTPVA

SEQ ID NO: 771260 - protein, 17 aa, Mycobacterium
LPKPARPVPPWPTVQRE

SEQ ID NO: 771261 - protein, 17 aa, Mycobacterium
LPLAVPVGASFGETARG

SEQ ID NO: 771262 - protein, 17 aa, Mycobacterium
LPLDALVYINGTPIPIF

SEQ ID NO: 771263 - protein, 17 aa, Mycobacterium
LPLEHPRVYTALIDEDA

SEQ ID NO: 771264 - protein, 18 aa, Mycobacterium
LPLGHGFNALTGEYGDMF

SEQ ID NO: 771265 - protein, 17 aa, Mycobacterium
LPLIVLHGGPGMAHNYV

SEQ ID NO: 771266 - protein, 17 aa, Mycobacterium
LPLKPSQYWARQCYAGA

SEQ ID NO: 771267 - protein, 22 aa, Mycobacterium
LPLLEPFRIISRLVSLIPGVHI

SEQ ID NO: 771268 - protein, 17 aa, Mycobacterium
LPLLGGLAVMFGVLPPL

SEQ ID NO: 771269 - protein, 18 aa, Mycobacterium
LPLLLLDEGHCLRDQALD

SEQ ID NO: 771270 - protein, 20 aa, Mycobacterium
LPLLRPRQVIMLGRPTLHRP

SEQ ID NO: 771271 - protein, 19 aa, Mycobacterium
LPLNCAIGAPVLFGRANVV

SEQ ID NO: 771272 - protein, 17 aa, Mycobacterium
LPLNVTWVNLTTGRSGS

SEQ ID NO: 771273 - protein, 17 aa, Mycobacterium
LPLPAWVADAMWSRASL

SEQ ID NO: 771274 - protein, 18 aa, Mycobacterium
LPLPEWAPALSVAQRLQL

SEQ ID NO: 771275 - protein, 21 aa, Mycobacterium
LPLPFAGGSWVLWERRDESDA

SEQ ID NO: 771276 - protein, 18 aa, Mycobacterium
LPLPGHAVAAAFDGGTHQ

SEQ ID NO: 771277 - protein, 21 aa, Mycobacterium
LPLPYAGNAWVVWDRGGASEA

SEQ ID NO: 771278 - protein, 17 aa, Mycobacterium
LPLRLVYVIPAADVPGG

SEQ ID NO: 771279 - protein, 18 aa, Mycobacterium
LPLRRWAVRQHADTSITV

SEQ ID NO: 771280 - protein, 17 aa, Mycobacterium
LPLSLAIVFEPEDPEQV

SEQ ID NO: 771281 - protein, 22 aa, Mycobacterium
LPLTLWLARFLKFIQTEIFPGG

SEQ ID NO: 771282 - protein, 19 aa, Mycobacterium
LPLTQRLVAIFGDRLNKLD

SEQ ID NO: 771283 - protein, 18 aa, Mycobacterium
LPLVAGMAFSVEPGIYFP

SEQ ID NO: 771284 - protein, 17 aa, Mycobacterium
LPLVLVVHGGPWHRDSW

SEQ ID NO: 771285 - protein, 17 aa, Mycobacterium
LPLVQLLPFLKSQEASL

SEQ ID NO: 771286 - protein, 19 aa, Mycobacterium
LPMMVVCKLLGLPDDDVDK

SEQ ID NO: 771287 - protein, 20 aa, Mycobacterium
LPMVESFAAYGLFSHQRDAC

SEQ ID NO: 771288 - protein, 18 aa, Mycobacterium
LPNGRWLYEYGEPRRLAQ

SEQ ID NO: 771289 - protein, 24 aa, Mycobacterium
LPNPSRVAGLHFFNPAPLQRTVEV

SEQ ID NO: 771290 - protein, 17 aa, Mycobacterium
LPPALIVVAGFDPLRDE

SEQ ID NO: 771291 - protein, 17 aa, Mycobacterium
LPPALVVTAGFDPLRDE

SEQ ID NO: 771292 - protein, 18 aa, Mycobacterium
LPPDIAWPYLQRVGEVVL

SEQ ID NO: 771293 - protein, 17 aa, Mycobacterium
LPPDLDFAALFHGVDER

SEQ ID NO: 771294 - protein, 17 aa, Mycobacterium
LPPEFRAAVVLCDIEGL

SEQ ID NO: 771295 - protein, 19 aa, Mycobacterium
LPPEIAWPYLKRVGEVVLP

SEQ ID NO: 771296 - protein, 23 aa, Mycobacterium
LPPEINSALMFAGPGAGPLLAAA

SEQ ID NO: 771297 - protein, 17 aa, Mycobacterium
LPPERRGSFGIPLPGVV

SEQ ID NO: 771298 - protein, 17 aa, Mycobacterium
LPPGAWPPTSWYADWVS

SEQ ID NO: 771299 - protein, 17 aa, Mycobacterium
LPPGGGISWAYRNLSPY

SEQ ID NO: 771300 - protein, 20 aa, Mycobacterium
LPPHPSHFLWLNWGPSPARQ

SEQ ID NO: 771301 - protein, 18 aa, Mycobacterium
LPPKGRRAMNKALGLDTV

SEQ ID NO: 771302 - protein, 18 aa, Mycobacterium
LPPKGRRWLNKKLGLDNV

SEQ ID NO: 771303 - protein, 17 aa, Mycobacterium
LPPLLAAPPVKTRYVTT

SEQ ID NO: 771304 - protein, 18 aa, Mycobacterium
LPPRTMRGLIGRICEQEG

SEQ ID NO: 771305 - protein, 20 aa, Mycobacterium
LPPVVRRWAGVYSQCTDPDQ

SEQ ID NO: 771306 - protein, 19 aa, Mycobacterium
LPPWNEVLQNLGFSNTTTA

SEQ ID NO: 771307 - protein, 17 aa, Mycobacterium
LPQAGAVAPGFYGGMPP

SEQ ID NO: 771308 - protein, 22 aa, Mycobacterium
LPQCIPNVWLGTVGVNPNPYTG

SEQ ID NO: 771309 - protein, 19 aa, Mycobacterium
LPQDILDWPLNVVVVRSGD

SEQ ID NO: 771310 - protein, 21 aa, Mycobacterium
LPQEWLRFGWFFLVTRHDPKG

SEQ ID NO: 771311 - protein, 21 aa, Mycobacterium
LPQEWLRFGWFFLVTRRDPGG

SEQ ID NO: 771312 - protein, 25 aa, Mycobacterium
LPQFLKGCIQLGAWPLLETTWEMAP

SEQ ID NO: 771313 - protein, 19 aa, Mycobacterium
LPQKLAYALVRWKNALLGI

SEQ ID NO: 771314 - protein, 17 aa, Mycobacterium
LPQLVGAAMARRLSMTG

SEQ ID NO: 771315 - protein, 18 aa, Mycobacterium
LPQPECFESFLNHHWAFD

SEQ ID NO: 771316 - protein, 24 aa, Mycobacterium
LPQTRPLLRRIISISQAHVWSPYL

SEQ ID NO: 771317 - protein, 18 aa, Mycobacterium
LPQVFFVNWFRRGEDHRF

SEQ ID NO: 771318 - protein, 17 aa, Mycobacterium
LPQVFRWARAVDPSQPL

SEQ ID NO: 771319 - protein, 21 aa, Mycobacterium
LPQVVGAAMARRLSMTGEVVD

SEQ ID NO: 771320 - protein, 22 aa, Mycobacterium
LPRADPGLPWPGRLPEPSPAVL

SEQ ID NO: 771321 - protein, 18 aa, Mycobacterium
LPRDAELVVGGRNVVQDV

SEQ ID NO: 771322 - protein, 18 aa, Mycobacterium
LPREEWPTHLRRLIAEQV

SEQ ID NO: 771323 - protein, 17 aa, Mycobacterium
LPRFSRPDCSAPTFCTP

SEQ ID NO: 771324 - protein, 22 aa, Mycobacterium
LPRIECRGGLAARRTAPDTVHL

SEQ ID NO: 771325 - protein, 21 aa, Mycobacterium
LPRIVRGECFFGIGMSEPDSG

SEQ ID NO: 771326 - protein, 19 aa, Mycobacterium
LPRLIAMLFSVLSTMDSDS

SEQ ID NO: 771327 - protein, 18 aa, Mycobacterium
LPRLRPRVFYDLVVEVAL

SEQ ID NO: 771328 - protein, 18 aa, Mycobacterium
LPRMRRVLLVDGQLVADP

SEQ ID NO: 771329 - protein, 17 aa, Mycobacterium
LPRRAEILAGREIAAPG

SEQ ID NO: 771330 - protein, 24 aa, Mycobacterium
LPRRLADGLPIVFGTKVDSIVHKD

SEQ ID NO: 771331 - protein, 17 aa, Mycobacterium
LPRRLQIEFSQAIQKIT

SEQ ID NO: 771332 - protein, 18 aa, Mycobacterium
LPRTVTFKVLKRQLAAQG

SEQ ID NO: 771333 - protein, 19 aa, Mycobacterium
LPRYIGGVLARLQEVWMGR

SEQ ID NO: 771334 - protein, 17 aa, Mycobacterium
LPSAIYHRFARVHTYAP

SEQ ID NO: 771335 - protein, 17 aa, Mycobacterium
LPSFERLRVIGCGTSLN

SEQ ID NO: 771336 - protein, 18 aa, Mycobacterium
LPSHAWPDRVLRITAIDV

SEQ ID NO: 771337 - protein, 29 aa, Mycobacterium
LPSKRIPPTRGWRKVLYRGTFKLINPGQS

SEQ ID NO: 771338 - protein, 21 aa, Mycobacterium
LPSLFTVGVAPSFQVGTAPNQ

SEQ ID NO: 771339 - protein, 17 aa, Mycobacterium
LPSLMVLTGVSSARDAV

SEQ ID NO: 771340 - protein, 17 aa, Mycobacterium
LPSRPVQVIGFTSVPGA

SEQ ID NO: 771341 - protein, 18 aa, Mycobacterium
LPSRRFVSMIAVGRDADP

SEQ ID NO: 771342 - protein, 22 aa, Mycobacterium
LPSRWCSEVDVALYLKDETTHI

SEQ ID NO: 771343 - protein, 18 aa, Mycobacterium
LPSVISWALQEHILGANP

SEQ ID NO: 771344 - protein, 29 aa, Mycobacterium
LPTAFAPAAFRWLGLRDMPNKLMNVAVSS

SEQ ID NO: 771345 - protein, 18 aa, Mycobacterium
LPTALLLRRDRLGSATAR

SEQ ID NO: 771346 - protein, 17 aa, Mycobacterium
LPTGFAFIPGHEIIGVI

SEQ ID NO: 771347 - protein, 19 aa, Mycobacterium
LPTHCWFEPKGWGFQVYPA

SEQ ID NO: 771348 - protein, 18 aa, Mycobacterium
LPTHLVIVGGSYIALEFA

SEQ ID NO: 771349 - protein, 18 aa, Mycobacterium
LPTLMAFKKGKLVFKQAG

SEQ ID NO: 771350 - protein, 20 aa, Mycobacterium
LPTLWLNQAFFSLVAGAGRS

SEQ ID NO: 771351 - protein, 20 aa, Mycobacterium
LPTLYGGDFVSTWKVFEEFA

SEQ ID NO: 771352 - protein, 18 aa, Mycobacterium
LPTPLRWLVGATRFAPVR

SEQ ID NO: 771353 - protein, 17 aa, Mycobacterium
LPTRVLLISAHDESAIV

SEQ ID NO: 771354 - protein, 17 aa, Mycobacterium
LPTRVLLLSAHDDAAIV

SEQ ID NO: 771355 - protein, 17 aa, Mycobacterium
LPTVRGAFCLVFADENT

SEQ ID NO: 771356 - protein, 19 aa, Mycobacterium
LPTVWPGTPYPLGATYDGA

SEQ ID NO: 771357 - protein, 18 aa, Mycobacterium
LPVADFAATVARFNGFAR

SEQ ID NO: 771358 - protein, 17 aa, Mycobacterium
LPVALVWAYPTITDLAT

SEQ ID NO: 771359 - protein, 18 aa, Mycobacterium
LPVARRAGVDVVHCLVQR

SEQ ID NO: 771360 - protein, 17 aa, Mycobacterium
LPVATGDDIVWADAVIF

SEQ ID NO: 771361 - protein, 25 aa, Mycobacterium
LPVDKLRFPVFSWQRITLQEMLHMR

SEQ ID NO: 771362 - protein, 17 aa, Mycobacterium
LPVDNWPVLGGMGNASW

SEQ ID NO: 771363 - protein, 17 aa, Mycobacterium
LPVFAAEMIALYGAGGD

SEQ ID NO: 771364 - protein, 19 aa, Mycobacterium
LPVIFSHGFADSAVIRNPD

SEQ ID NO: 771365 - protein, 24 aa, Mycobacterium
LPVIGSKELIAWLPTLLGLGPADV

SEQ ID NO: 771366 - protein, 25 aa, Mycobacterium
LPVIGTKELIAWLPTLLGLGAADTV

SEQ ID NO: 771367 - protein, 24 aa, Mycobacterium
LPVIGTKELIAWLPTLLGLGSDDV

SEQ ID NO: 771368 - protein, 23 aa, Mycobacterium
LPVIPMPFGFGIWTSHTTPIYLG

SEQ ID NO: 771369 - protein, 20 aa, Mycobacterium
LPVIVLRTSRFFPEQDDNDR

SEQ ID NO: 771370 - protein, 23 aa, Mycobacterium
LPVKCFYLPTAVRGFEREGIDPR

SEQ ID NO: 771371 - protein, 22 aa, Mycobacterium
LPVKLCYSGPFFRYERPQAGRY

SEQ ID NO: 771372 - protein, 23 aa, Mycobacterium
LPVKLCYSGPFFRYERPQAGRYR

SEQ ID NO: 771373 - protein, 18 aa, Mycobacterium
LPVLIAGWLRSRAEADEA

SEQ ID NO: 771374 - protein, 17 aa, Mycobacterium
LPVPDWQVLLAVPADLA

SEQ ID NO: 771375 - protein, 21 aa, Mycobacterium
LPVPEFYGGAVYFAADDVADV

SEQ ID NO: 771376 - protein, 19 aa, Mycobacterium
LPVPEWFPMLGGHEGSGVV

SEQ ID NO: 771377 - protein, 19 aa, Mycobacterium
LPVPLKPYFEADWRFHQTI

SEQ ID NO: 771378 - protein, 17 aa, Mycobacterium
LPVPPGFVLLRDCYRDS

SEQ ID NO: 771379 - protein, 19 aa, Mycobacterium
LPVPPGWQLTQDSGTSYGG

SEQ ID NO: 771380 - protein, 24 aa, Mycobacterium
LPVSAWRIHRCIGMDGTTLVRTLS

SEQ ID NO: 771381 - protein, 23 aa, Mycobacterium
LPVTECWDLLAGVTLGRLVTSVG

SEQ ID NO: 771382 - protein, 17 aa, Mycobacterium
LPVYIISIGRTFRTDEL

SEQ ID NO: 771383 - protein, 18 aa, Mycobacterium
LPVYIVSIGRTFRTDELD

SEQ ID NO: 771384 - protein, 24 aa, Mycobacterium
LPVYRPPLDMARLFGESRLGAGPG

SEQ ID NO: 771385 - protein, 18 aa, Mycobacterium
LPVYVISLGRAFRTDEID

SEQ ID NO: 771386 - protein, 17 aa, Mycobacterium
LPWDYRRVYGVDPDEQS

SEQ ID NO: 771387 - protein, 18 aa, Mycobacterium
LPWIPGLPPGMATWTPDQ

SEQ ID NO: 771388 - protein, 21 aa, Mycobacterium
LPWLRRLGVVYTYDAPWHRGR

SEQ ID NO: 771389 - protein, 18 aa, Mycobacterium
LPWRRPIASLNYLLSSHV

SEQ ID NO: 771390 - protein, 20 aa, Mycobacterium
LPWRTARKNIEFGLEAKGLP

SEQ ID NO: 771391 - protein, 19 aa, Mycobacterium
LPWYYRSGYDVVMYTLPFH

SEQ ID NO: 771392 - protein, 25 aa, Mycobacterium
LPYAGRWVGHEGVERWLRAFGDTWS

SEQ ID NO: 771393 - protein, 17 aa, Mycobacterium
LPYEVFPELGAKSNKRT

SEQ ID NO: 771394 - protein, 17 aa, Mycobacterium
LPYEVLERISTRITNEV

SEQ ID NO: 771395 - protein, 18 aa, Mycobacterium
LPYFSIGMANNFIQMSKT

SEQ ID NO: 771396 - protein, 21 aa, Mycobacterium
LPYPLMHPWWPLKGSDAEANR

SEQ ID NO: 771397 - protein, 19 aa, Mycobacterium
LPYRRSVVCGSAKQAVSLL

SEQ ID NO: 771398 - protein, 19 aa, Mycobacterium
LPYRWPHPWLVDRKSAAQQ

SEQ ID NO: 771399 - protein, 24 aa, Mycobacterium
LQAFARDFFLLWAPYPNSYKRFRD

SEQ ID NO: 771400 - protein, 17 aa, Mycobacterium
LQAGLPVRWETTADTPF

SEQ ID NO: 771401 - protein, 17 aa, Mycobacterium
LQAGTQWLSVRGYRQAE

SEQ ID NO: 771402 - protein, 25 aa, Mycobacterium
LQALRGGAIYDHWLAIGGVKSVLGA

SEQ ID NO: 771403 - protein, 17 aa, Mycobacterium
LQAQCTFSWPPQMDLPG

SEQ ID NO: 771404 - protein, 21 aa, Mycobacterium
LQARFKLSYLFVSHDLSVVKH

SEQ ID NO: 771405 - protein, 20 aa, Mycobacterium
LQDHFNRIDAVLCSTATRTR

SEQ ID NO: 771406 - protein, 19 aa, Mycobacterium
LQEGRSVILDGTWRDPQSR

SEQ ID NO: 771407 - protein, 22 aa, Mycobacterium
LQFARRLAALGARRIVLLSRNG

SEQ ID NO: 771408 - protein, 18 aa, Mycobacterium
LQFDHGWLLPGNPPEFGG

SEQ ID NO: 771409 - protein, 17 aa, Mycobacterium
LQFGLNWFPWILRGVYP

SEQ ID NO: 771410 - protein, 22 aa, Mycobacterium
LQFPIVYVPFLFNRNVRREDIM

SEQ ID NO: 771411 - protein, 17 aa, Mycobacterium
LQFSPLHSWVTDEDFDF

SEQ ID NO: 771412 - protein, 22 aa, Mycobacterium
LQGGRLHFCYNFLGEYEQTLAA

SEQ ID NO: 771413 - protein, 18 aa, Mycobacterium
LQGLSRRFWFAHLRSDPD

SEQ ID NO: 771414 - protein, 20 aa, Mycobacterium
LQGLSRRFWFGHLSDPVEEL

SEQ ID NO: 771415 - protein, 21 aa, Mycobacterium
LQGQCTFSWPPRIDLPGYKPT

SEQ ID NO: 771416 - protein, 21 aa, Mycobacterium
LQGQCTFSWPPRMDLPGYKPN

SEQ ID NO: 771417 - protein, 17 aa, Mycobacterium
LQGWLLRAGNGVNVAVP

SEQ ID NO: 771418 - protein, 19 aa, Mycobacterium
LQHALPITFGYRVACWTAP

SEQ ID NO: 771419 - protein, 18 aa, Mycobacterium
LQHPDTFQRLGVDPPRGV

SEQ ID NO: 771420 - protein, 19 aa, Mycobacterium
LQHPDTFSRLGIDPPRGVL

SEQ ID NO: 771421 - protein, 20 aa, Mycobacterium
LQHPRIARPAVIISAEAIED

SEQ ID NO: 771422 - protein, 20 aa, Mycobacterium
LQHWVPRAGAEFGAHAQNWI

SEQ ID NO: 771423 - protein, 20 aa, Mycobacterium
LQIEAAWVWPEQHQWLKQFG

SEQ ID NO: 771424 - protein, 25 aa, Mycobacterium
LQIIGMCNWVAWWFHKDDATSAEIV

SEQ ID NO: 771425 - protein, 17 aa, Mycobacterium
LQKRFGTLTGVERPAEN

SEQ ID NO: 771426 - protein, 22 aa, Mycobacterium
LQKWVAACLFRYYLDQYTLLYG

SEQ ID NO: 771427 - protein, 18 aa, Mycobacterium
LQLCDAFGLPVLSLVDCP

SEQ ID NO: 771428 - protein, 17 aa, Mycobacterium
LQLCDAFGLPVVSLIDC

SEQ ID NO: 771429 - protein, 18 aa, Mycobacterium
LQLGWRLFGPFLRAATGL

SEQ ID NO: 771430 - protein, 17 aa, Mycobacterium
LQLTLAWTNVLLQRLAP

SEQ ID NO: 771431 - protein, 20 aa, Mycobacterium
LQLWGSLQWMWVWFDPADSR

SEQ ID NO: 771432 - protein, 18 aa, Mycobacterium
LQMRGCGQIHALSSGYAA

SEQ ID NO: 771433 - protein, 17 aa, Mycobacterium
LQMSWKVAPALAAGCTM

SEQ ID NO: 771434 - protein, 19 aa, Mycobacterium
LQMVGLFSEPVVREGDNVT

SEQ ID NO: 771435 - protein, 17 aa, Mycobacterium
LQPEIRLAAPLLAKGLP

SEQ ID NO: 771436 - protein, 19 aa, Mycobacterium
LQPGGAVIGAFLGSRRDTP

SEQ ID NO: 771437 - protein, 18 aa, Mycobacterium
LQPQLGWEANEPDELAQV

SEQ ID NO: 771438 - protein, 17 aa, Mycobacterium
LQQLLRLLPGCKAPSSS

SEQ ID NO: 771439 - protein, 24 aa, Mycobacterium
LQQLSGRHDLMWAMVSDMPAVGSA

SEQ ID NO: 771440 - protein, 20 aa, Mycobacterium
LQQRFPFDLVIFALDCGGEF

SEQ ID NO: 771441 - protein, 19 aa, Mycobacterium
LQQRLKVANAMREDAAQSP

SEQ ID NO: 771442 - protein, 22 aa, Mycobacterium
LQQWRKARALLMNRPLQNIVAR

SEQ ID NO: 771443 - protein, 23 aa, Mycobacterium
LQRACAWAACGRSAFNAGDIPEL

SEQ ID NO: 771444 - protein, 19 aa, Mycobacterium
LQRFVDRFAHFNFRDSMMR

SEQ ID NO: 771445 - protein, 18 aa, Mycobacterium
LQRGCAWSGDGWDVQQTV

SEQ ID NO: 771446 - protein, 24 aa, Mycobacterium
LQRLRLPWWHVWRAADAVGAATPK

SEQ ID NO: 771447 - protein, 22 aa, Mycobacterium
LQRMSTVIGRRVWENAGSPEVD

SEQ ID NO: 771448 - protein, 18 aa, Mycobacterium
LQRPARWMQLLGRHRGQI

SEQ ID NO: 771449 - protein, 20 aa, Mycobacterium
LQRREAWEIIDYVNRLSDPS

SEQ ID NO: 771450 - protein, 22 aa, Mycobacterium
LQRRGCEIGRLILLDAQPGLDG

SEQ ID NO: 771451 - protein, 18 aa, Mycobacterium
LQRRKLLWWTLSRFTTLS

SEQ ID NO: 771452 - protein, 18 aa, Mycobacterium
LQRTRIAVELARTHLRYG

SEQ ID NO: 771453 - protein, 17 aa, Mycobacterium
LQSRLKTGGLLLNHCIT

SEQ ID NO: 771454 - protein, 20 aa, Mycobacterium
LQTGVRWKDLGLVIVDEEQR

SEQ ID NO: 771455 - protein, 17 aa, Mycobacterium
LQTLSECPLRWLTERHG

SEQ ID NO: 771456 - protein, 24 aa, Mycobacterium
LQTRLAAGPVRFYFRVQIAGPGDS

SEQ ID NO: 771457 - protein, 17 aa, Mycobacterium
LQTRLKALRIFDRKPMP

SEQ ID NO: 771458 - protein, 18 aa, Mycobacterium
LQVAEAFGRYGAHMPKLN

SEQ ID NO: 771459 - protein, 18 aa, Mycobacterium
LQVAEAFGRYGAQLRVNV

SEQ ID NO: 771460 - protein, 18 aa, Mycobacterium
LQVAEAFSRYGAHLPKIN

SEQ ID NO: 771461 - protein, 18 aa, Mycobacterium
LQVAEAFSRYGAHLPKVN

SEQ ID NO: 771462 - protein, 18 aa, Mycobacterium
LQVAEAFSRYGAYLPKLN

SEQ ID NO: 771463 - protein, 17 aa, Mycobacterium
LQVANRVELARYAIEHG

SEQ ID NO: 771464 - protein, 18 aa, Mycobacterium
LQVLGIWPILPEEFTLLD

SEQ ID NO: 771465 - protein, 18 aa, Mycobacterium
LQVMISFDKVGREALDAW

SEQ ID NO: 771466 - protein, 17 aa, Mycobacterium
LQWDCFRFGIIQRTDHF

SEQ ID NO: 771467 - protein, 21 aa, Mycobacterium
LQWDLRFGMDVVDALGPHVTD

SEQ ID NO: 771468 - protein, 23 aa, Mycobacterium
LQWRYYLAWWLWNGHEFDPAAAR

SEQ ID NO: 771469 - protein, 19 aa, Mycobacterium
LQYDLWKAKGLRAVPPTAI

SEQ ID NO: 771470 - protein, 21 aa, Mycobacterium
LQYFWPRLVGDTGWELLDSKF

SEQ ID NO: 771471 - protein, 18 aa, Mycobacterium
LRAAAAFKVTAARLGEEV

SEQ ID NO: 771472 - protein, 21 aa, Mycobacterium
LRAAAALGFRTAFVARPLEFG

SEQ ID NO: 771473 - protein, 19 aa, Mycobacterium
LRAAEAFARMWDMGVAESI

SEQ ID NO: 771474 - protein, 18 aa, Mycobacterium
LRAAFWDRDVPKPVQIVP

SEQ ID NO: 771475 - protein, 19 aa, Mycobacterium
LRAAGIPILGKTNMDEFAM

SEQ ID NO: 771476 - protein, 19 aa, Mycobacterium
LRAAGLSYLCWSRHAVDDA

SEQ ID NO: 771477 - protein, 17 aa, Mycobacterium
LRAAGWRRGDAVVLAAA

SEQ ID NO: 771478 - protein, 18 aa, Mycobacterium
LRAAIPVMRQQRFGRIVA

SEQ ID NO: 771479 - protein, 18 aa, Mycobacterium
LRAALPLVDPGAASPKET

SEQ ID NO: 771480 - protein, 17 aa, Mycobacterium
LRAANALDFDDLIGETV

SEQ ID NO: 771481 - protein, 18 aa, Mycobacterium
LRAAVLDFSDNVRRAERA

SEQ ID NO: 771482 - protein, 18 aa, Mycobacterium
LRAAVRIHPIAAVQSEWS

SEQ ID NO: 771483 - protein, 19 aa, Mycobacterium
LRAAWKDIPEVVGAATVTG

SEQ ID NO: 771484 - protein, 17 aa, Mycobacterium
LRAAWLTMIAVASTHQG

SEQ ID NO: 771485 - protein, 22 aa, Mycobacterium
LRACPGPGCVLYFLTDGRREWC

SEQ ID NO: 771486 - protein, 21 aa, Mycobacterium
LRADELHLGFNFRLVKADYDA

SEQ ID NO: 771487 - protein, 20 aa, Mycobacterium
LRAEAAFLWSGRKAVVSGVS

SEQ ID NO: 771488 - protein, 18 aa, Mycobacterium
LRAEFPPERIALHGNNKS

SEQ ID NO: 771489 - protein, 22 aa, Mycobacterium
LRAELIAAPVLDADLLRRGKHN

SEQ ID NO: 771490 - protein, 20 aa, Mycobacterium
LRAFLLDKVAKWWIPERWSF

SEQ ID NO: 771491 - protein, 19 aa, Mycobacterium
LRAGAAVSRPGPRHVRRLD

SEQ ID NO: 771492 - protein, 19 aa, Mycobacterium
LRAGLFGVLYVLDEPSAGL

SEQ ID NO: 771493 - protein, 22 aa, Mycobacterium
LRAGSQWPALAARVLTETPVHG

SEQ ID NO: 771494 - protein, 18 aa, Mycobacterium
LRAGVVNRILAYVAPILL

SEQ ID NO: 771495 - protein, 17 aa, Mycobacterium
LRAKAKAGFAEREGVNL

SEQ ID NO: 771496 - protein, 19 aa, Mycobacterium
LRAKAWRQIRGGSVGLIPQ

SEQ ID NO: 771497 - protein, 17 aa, Mycobacterium
LRAKFGFVFQDPATALN

SEQ ID NO: 771498 - protein, 23 aa, Mycobacterium
LRALKRLKVVAAFQNSTNSPGGM

SEQ ID NO: 771499 - protein, 24 aa, Mycobacterium
LRALKRLKVVAAFQTNRNSPMGMV

SEQ ID NO: 771500 - protein, 20 aa, Mycobacterium
LRALLVRRNELWAPHHVEPH

SEQ ID NO: 771501 - protein, 17 aa, Mycobacterium
LRAMGVRAGGLVVRCRN

SEQ ID NO: 771502 - protein, 18 aa, Mycobacterium
LRAPLDVFLVRKLGVPQW

SEQ ID NO: 771503 - protein, 19 aa, Mycobacterium
LRAPLTWEVDEPCPVPQPA

SEQ ID NO: 771504 - protein, 20 aa, Mycobacterium
LRAQFAAGLSRMYGAEVPAY

SEQ ID NO: 771505 - protein, 21 aa, Mycobacterium
LRAQLRLAGAGLRNTRIDECV

SEQ ID NO: 771506 - protein, 19 aa, Mycobacterium
LRAQWGWRLVAAASTLPTP

SEQ ID NO: 771507 - protein, 23 aa, Mycobacterium
LRARGDGRVVIWAATQFDVLACR

SEQ ID NO: 771508 - protein, 18 aa, Mycobacterium
LRARLDWLGENNLARSIL

SEQ ID NO: 771509 - protein, 17 aa, Mycobacterium
LRARLRLAVGRRRGTAD

SEQ ID NO: 771510 - protein, 17 aa, Mycobacterium
LRARLRLAVTRRRRARK

SEQ ID NO: 771511 - protein, 19 aa, Mycobacterium
LRARLVLLAVADDGMSTVE

SEQ ID NO: 771512 - protein, 23 aa, Mycobacterium
LRARSAGLLTAWVATSFDVLASR

SEQ ID NO: 771513 - protein, 17 aa, Mycobacterium
LRARVAQWFPPRRYLPR

SEQ ID NO: 771514 - protein, 17 aa, Mycobacterium
LRASREWDLPHEVLDAP

SEQ ID NO: 771515 - protein, 19 aa, Mycobacterium
LRATYLRLGHRVEVIEPVR

SEQ ID NO: 771516 - protein, 18 aa, Mycobacterium
LRAVLPPGVTVPLHSHND

SEQ ID NO: 771517 - protein, 18 aa, Mycobacterium
LRAVLTAALCAPVPVTVV

SEQ ID NO: 771518 - protein, 17 aa, Mycobacterium
LRAVTGLALSRTIIFDY

SEQ ID NO: 771519 - protein, 18 aa, Mycobacterium
LRAYELWAGLAADSGRDV

SEQ ID NO: 771520 - protein, 17 aa, Mycobacterium
LRCGSMFEPVAGERFDL

SEQ ID NO: 771521 - protein, 17 aa, Mycobacterium
LRCSPGYQDQRRALRRH

SEQ ID NO: 771522 - protein, 22 aa, Mycobacterium
LRCSVVGPRAWLSKLPDQIRKR

SEQ ID NO: 771523 - protein, 18 aa, Mycobacterium
LRDAFTFNVSTAHALTSA

SEQ ID NO: 771524 - protein, 19 aa, Mycobacterium
LRDAVPCPLVLHGSSGVPD

SEQ ID NO: 771525 - protein, 19 aa, Mycobacterium
LRDAWFWAHEVMAVGMVWN

SEQ ID NO: 771526 - protein, 20 aa, Mycobacterium
LRDAWFWAHEVMAVGMVWNT

SEQ ID NO: 771527 - protein, 18 aa, Mycobacterium
LRDDLCPEWPQPAQEGGS

SEQ ID NO: 771528 - protein, 19 aa, Mycobacterium
LRDEFRPATTLNVLAAAWL

SEQ ID NO: 771529 - protein, 21 aa, Mycobacterium
LRDFLDWLFGRYQQILDTATS

SEQ ID NO: 771530 - protein, 17 aa, Mycobacterium
LRDIEWRIAPGERTGIL

SEQ ID NO: 771531 - protein, 17 aa, Mycobacterium
LRDIYCATLGYPVDATN

SEQ ID NO: 771532 - protein, 23 aa, Mycobacterium
LRDKLRLGTSITRAEFDERNSLW

SEQ ID NO: 771533 - protein, 18 aa, Mycobacterium
LRDLLKFDFYFADSAAFH

SEQ ID NO: 771534 - protein, 19 aa, Mycobacterium
LRDLLKFDFYFADSATFRD

SEQ ID NO: 771535 - protein, 21 aa, Mycobacterium
LRDLTEWAGIRWGDDTPDEGI

SEQ ID NO: 771536 - protein, 18 aa, Mycobacterium
LRDLWLAIAERFISAGAA

SEQ ID NO: 771537 - protein, 23 aa, Mycobacterium
LRDRLPNVSLWNFYGQTEIAPLA

SEQ ID NO: 771538 - protein, 23 aa, Mycobacterium
LRDRLSEVLPAYMVPAAFIEIDQ

SEQ ID NO: 771539 - protein, 23 aa, Mycobacterium
LRDRLSEVLPAYMVPAAFVVIGE

SEQ ID NO: 771540 - protein, 24 aa, Mycobacterium
LRDRLSEVLPPYMVPAAFIEIDQL

SEQ ID NO: 771541 - protein, 25 aa, Mycobacterium
LRDRLSEVLPPYMVPAAFMLIDQLP

SEQ ID NO: 771542 - protein, 23 aa, Mycobacterium
LRDRLSEVLPPYMVPAAFVVIDE

SEQ ID NO: 771543 - protein, 17 aa, Mycobacterium
LRDVEWRIAPGERTGIV

SEQ ID NO: 771544 - protein, 19 aa, Mycobacterium
LRDWAWSGLCLPAVRLGSF

SEQ ID NO: 771545 - protein, 17 aa, Mycobacterium
LREAFGYEAWVLVYDLG

SEQ ID NO: 771546 - protein, 26 aa, Mycobacterium
LREAPILALGIWRWGLGEIPYRQLEH

SEQ ID NO: 771547 - protein, 17 aa, Mycobacterium
LREAVGIVTEWLQRHDF

SEQ ID NO: 771548 - protein, 26 aa, Mycobacterium
LREFLADKVVRWWLPERWAFVDQVPR

SEQ ID NO: 771549 - protein, 17 aa, Mycobacterium
LREGLGRTVDWFQLSLG

SEQ ID NO: 771550 - protein, 24 aa, Mycobacterium
LREGQRLWLSWAMANRDPAVFTDP

SEQ ID NO: 771551 - protein, 18 aa, Mycobacterium
LREGYKVVRMLVDAYDDK

SEQ ID NO: 771552 - protein, 28 aa, Mycobacterium
LRELAKRWCRWRMSCGVGLGQLRSDRLA

SEQ ID NO: 771553 - protein, 18 aa, Mycobacterium
LRELCKMDGAVVLSTDCS

SEQ ID NO: 771554 - protein, 19 aa, Mycobacterium
LRELCKMDGAVVLSTDGSR

SEQ ID NO: 771555 - protein, 25 aa, Mycobacterium
LRELKCGYHGWTWDLAGALKRVPNR

SEQ ID NO: 771556 - protein, 25 aa, Mycobacterium
LRELKCGYHGWTWDLAGTLKRVPNR

SEQ ID NO: 771557 - protein, 20 aa, Mycobacterium
LRELKCGYHGWTWDLTGELR

SEQ ID NO: 771558 - protein, 20 aa, Mycobacterium
LREMFPGTLIMYGAHERHLL

SEQ ID NO: 771559 - protein, 20 aa, Mycobacterium
LREMIKVRGFQVAPAEVEAV

SEQ ID NO: 771560 - protein, 23 aa, Mycobacterium
LRERLGFGDLRWAVSGAAPIPKE

SEQ ID NO: 771561 - protein, 19 aa, Mycobacterium
LRESPAWITGFEHRIESPS

SEQ ID NO: 771562 - protein, 17 aa, Mycobacterium
LRESPCSVTELSAAVGM

SEQ ID NO: 771563 - protein, 18 aa, Mycobacterium
LRETGFWRFVNDPNDPGE

SEQ ID NO: 771564 - protein, 17 aa, Mycobacterium
LREVYEWEQTRSQGLLI

SEQ ID NO: 771565 - protein, 18 aa, Mycobacterium
LREYFGLRPEDLNIDLGP

SEQ ID NO: 771566 - protein, 18 aa, Mycobacterium
LRFARAGAHTVLTRRRHR

SEQ ID NO: 771567 - protein, 19 aa, Mycobacterium
LRFASTFTWNTLPLPAVPT

SEQ ID NO: 771568 - protein, 17 aa, Mycobacterium
LRFASWRDIHQTAVRVA

SEQ ID NO: 771569 - protein, 21 aa, Mycobacterium
LRFAVTVGGLYIDYSKHRVTA

SEQ ID NO: 771570 - protein, 17 aa, Mycobacterium
LRFFDRISWYPVSAEEL

SEQ ID NO: 771571 - protein, 21 aa, Mycobacterium
LRFGELCLEAGLPPGLVNVLP

SEQ ID NO: 771572 - protein, 17 aa, Mycobacterium
LRFGIELVECTEYFKDT

SEQ ID NO: 771573 - protein, 19 aa, Mycobacterium
LRFGLELVECAEFFKDTTF

SEQ ID NO: 771574 - protein, 19 aa, Mycobacterium
LRFGLELVECTDYFSETSF

SEQ ID NO: 771575 - protein, 17 aa, Mycobacterium
LRFLPPIVRNEEKWCQL

SEQ ID NO: 771576 - protein, 17 aa, Mycobacterium
LRFLPPLSMPDELLQEA

SEQ ID NO: 771577 - protein, 18 aa, Mycobacterium
LRFLPPLSMPDHLLDEGL

SEQ ID NO: 771578 - protein, 20 aa, Mycobacterium
LRFLSSPLWRAYTSTYIEGY

SEQ ID NO: 771579 - protein, 20 aa, Mycobacterium
LRFLVHWSAEVFSDFDELKK

SEQ ID NO: 771580 - protein, 18 aa, Mycobacterium
LRFPGYFLVVHDITQFCR

SEQ ID NO: 771581 - protein, 17 aa, Mycobacterium
LRFQIGRWAYRDLIREQ

SEQ ID NO: 771582 - protein, 18 aa, Mycobacterium
LRFQLLWYPSTTFDTSLP

SEQ ID NO: 771583 - protein, 17 aa, Mycobacterium
LRFTSPVTHMARRATED

SEQ ID NO: 771584 - protein, 20 aa, Mycobacterium
LRFVVLDGLAKPGRLEGPDP

SEQ ID NO: 771585 - protein, 18 aa, Mycobacterium
LRFWPRRVTPAIVSFLVE

SEQ ID NO: 771586 - protein, 18 aa, Mycobacterium
LRGAAWVHGYVTSKWAVR

SEQ ID NO: 771587 - protein, 19 aa, Mycobacterium
LRGAFNVVRPAFPLMCGAG

SEQ ID NO: 771588 - protein, 17 aa, Mycobacterium
LRGAIAVARTVPAQLHR

SEQ ID NO: 771589 - protein, 18 aa, Mycobacterium
LRGANLWDEVKDRLDKPG

SEQ ID NO: 771590 - protein, 18 aa, Mycobacterium
LRGANLWDEVKDRMDRPG

SEQ ID NO: 771591 - protein, 28 aa, Mycobacterium
LRGFERFPAWMWRNTVVRDFVAWLRACN

SEQ ID NO: 771592 - protein, 27 aa, Mycobacterium
LRGFERFPAWMWRNTVVRDFVDWLRER

SEQ ID NO: 771593 - protein, 19 aa, Mycobacterium
LRGGAYFFLPGIKALRYLA

SEQ ID NO: 771594 - protein, 26 aa, Mycobacterium
LRGGKRLRPVFAYWGWHAVTTEEPGP

SEQ ID NO: 771595 - protein, 27 aa, Mycobacterium
LRGGKRVRPAFAYWGWRSVIEPADAVA

SEQ ID NO: 771596 - protein, 20 aa, Mycobacterium
LRGGVHFNLLALSGVTPVEA

SEQ ID NO: 771597 - protein, 17 aa, Mycobacterium
LRGGYALTRIREGSEEA

SEQ ID NO: 771598 - protein, 18 aa, Mycobacterium
LRGILGKEIGFVFQDPQS

SEQ ID NO: 771599 - protein, 17 aa, Mycobacterium
LRGKLVRVLRDRDLGTA

SEQ ID NO: 771600 - protein, 19 aa, Mycobacterium
LRGLFRWWGLYTQREQGYD

SEQ ID NO: 771601 - protein, 19 aa, Mycobacterium
LRGLLGAFMFSGPQLEQPA

SEQ ID NO: 771602 - protein, 19 aa, Mycobacterium
LRGLLGAFMFTGPQLDQPA

SEQ ID NO: 771603 - protein, 25 aa, Mycobacterium
LRGMPAGALGRRGAAAGYVNKYGFR

SEQ ID NO: 771604 - protein, 25 aa, Mycobacterium
LRGMPAGALGRRGAAGGYVNKYGFR

SEQ ID NO: 771605 - protein, 20 aa, Mycobacterium
LRGPFWRWYPGLYAGSKLMH

SEQ ID NO: 771606 - protein, 17 aa, Mycobacterium
LRGPRGGMVLATEEYAP

SEQ ID NO: 771607 - protein, 22 aa, Mycobacterium
LRGRGGTHLVAMAVTADSPYGR

SEQ ID NO: 771608 - protein, 19 aa, Mycobacterium
LRGTCFGITAGDEIGYAIA

SEQ ID NO: 771609 - protein, 17 aa, Mycobacterium
LRGTFLLTKACVPHLQK

SEQ ID NO: 771610 - protein, 18 aa, Mycobacterium
LRHAEILVALALSPQGRS

SEQ ID NO: 771611 - protein, 17 aa, Mycobacterium
LRHCVRDAAAAGGPAAD

SEQ ID NO: 771612 - protein, 17 aa, Mycobacterium
LRHGWPKALSDTGFDRS

SEQ ID NO: 771613 - protein, 19 aa, Mycobacterium
LRHPCCGDLVYGADPKLAK

SEQ ID NO: 771614 - protein, 19 aa, Mycobacterium
LRHRLRLGVLAALDQRIAV

SEQ ID NO: 771615 - protein, 24 aa, Mycobacterium
LRHTCGVCKYCLRGDENLCPKSRY

SEQ ID NO: 771616 - protein, 17 aa, Mycobacterium
LRHTVRFAAAVQAALKD

SEQ ID NO: 771617 - protein, 18 aa, Mycobacterium
LRHTVRFGAAVQAALEDG

SEQ ID NO: 771618 - protein, 21 aa, Mycobacterium
LRIAPELFLKKALVGGFDKIF

SEQ ID NO: 771619 - protein, 24 aa, Mycobacterium
LRIAPELFLKRCVVGGFDRVFELN

SEQ ID NO: 771620 - protein, 17 aa, Mycobacterium
LRIFFEFTRGADESGPA

SEQ ID NO: 771621 - protein, 17 aa, Mycobacterium
LRIGASLVHLGHAARLW

SEQ ID NO: 771622 - protein, 17 aa, Mycobacterium
LRIGELTVRAVGGKHAV

SEQ ID NO: 771623 - protein, 19 aa, Mycobacterium
LRIGESYSRIAGVEHRVEN

SEQ ID NO: 771624 - protein, 19 aa, Mycobacterium
LRIGHLVLCDAFRHPAVLA

SEQ ID NO: 771625 - protein, 17 aa, Mycobacterium
LRIGLATADDIRNWSFG

SEQ ID NO: 771626 - protein, 23 aa, Mycobacterium
LRIGWFEGGIAWVPWALQDAEHL

SEQ ID NO: 771627 - protein, 18 aa, Mycobacterium
LRIPNRVGYWYAQGSMVT

SEQ ID NO: 771628 - protein, 18 aa, Mycobacterium
LRIYWALLGWARGRTNRN

SEQ ID NO: 771629 - protein, 26 aa, Mycobacterium
LRKFLADRVVRWWLPERWAFADQVPR

SEQ ID NO: 771630 - protein, 26 aa, Mycobacterium
LRKFLAEKVVRWWLPERWAFVEEIPR

SEQ ID NO: 771631 - protein, 20 aa, Mycobacterium
LRKGMPTAWLIARLSDTALA

SEQ ID NO: 771632 - protein, 17 aa, Mycobacterium
LRKHFNWVRSWYDFAVP

SEQ ID NO: 771633 - protein, 20 aa, Mycobacterium
LRKLFHAVGVVFKGSGFYRT

SEQ ID NO: 771634 - protein, 20 aa, Mycobacterium
LRKLFNSVGIVFKGSGFYRT

SEQ ID NO: 771635 - protein, 24 aa, Mycobacterium
LRKRAIELLELVGLGHRINHQPTR

SEQ ID NO: 771636 - protein, 18 aa, Mycobacterium
LRKRLRRATGRSVPLAAM

SEQ ID NO: 771637 - protein, 20 aa, Mycobacterium
LRKSEPIHWVDVPGGTGGFG

SEQ ID NO: 771638 - protein, 18 aa, Mycobacterium
LRKSRSEMAWAFPAVPMV

SEQ ID NO: 771639 - protein, 24 aa, Mycobacterium
LRKSRSEMAWAFPAVPMVVRAPAA

SEQ ID NO: 771640 - protein, 18 aa, Mycobacterium
LRKTDWLFPQYREIGAFL

SEQ ID NO: 771641 - protein, 21 aa, Mycobacterium
LRKVANCWTLRPSGPAGAATV

SEQ ID NO: 771642 - protein, 21 aa, Mycobacterium
LRKVVGWARDRGCLVASDECY

SEQ ID NO: 771643 - protein, 20 aa, Mycobacterium
LRKVVGWARDRGVLVASDEC

SEQ ID NO: 771644 - protein, 21 aa, Mycobacterium
LRKVVGWARDRGVLVASDECY

SEQ ID NO: 771645 - protein, 21 aa, Mycobacterium
LRKVVTWARERGVLVASDECY

SEQ ID NO: 771646 - protein, 20 aa, Mycobacterium
LRKYRSGGVGTHYYNTVRAA

SEQ ID NO: 771647 - protein, 19 aa, Mycobacterium
LRLADYTGRILEWINVGQP

SEQ ID NO: 771648 - protein, 21 aa, Mycobacterium
LRLALDADLCGAVTGLPAPLA

SEQ ID NO: 771649 - protein, 17 aa, Mycobacterium
LRLALVLCAVRPEIGGV

SEQ ID NO: 771650 - protein, 21 aa, Mycobacterium
LRLAPTPPWHTTRWQVTRIGD

SEQ ID NO: 771651 - protein, 18 aa, Mycobacterium
LRLAQAMHRRAHRCRVMA

SEQ ID NO: 771652 - protein, 19 aa, Mycobacterium
LRLARCVVEDGWPLRRAAE

SEQ ID NO: 771653 - protein, 17 aa, Mycobacterium
LRLATLVIVAGTAKAVT

SEQ ID NO: 771654 - protein, 17 aa, Mycobacterium
LRLAVLAQREYGTAFDL

SEQ ID NO: 771655 - protein, 19 aa, Mycobacterium
LRLDRHFAISVIDCGSTMD

SEQ ID NO: 771656 - protein, 19 aa, Mycobacterium
LRLEGFRDWADIDVDEAQS

SEQ ID NO: 771657 - protein, 17 aa, Mycobacterium
LRLERVVLVGVWTDGSA

SEQ ID NO: 771658 - protein, 19 aa, Mycobacterium
LRLFAGGIAKLWDPANIDF

SEQ ID NO: 771659 - protein, 17 aa, Mycobacterium
LRLFAGLVGAAGVYATQ

SEQ ID NO: 771660 - protein, 19 aa, Mycobacterium
LRLFAGVLREGSWNQARID

SEQ ID NO: 771661 - protein, 18 aa, Mycobacterium
LRLGATVIQAHIAKGQLE

SEQ ID NO: 771662 - protein, 20 aa, Mycobacterium
LRLGDAWVWDMYRPARFVKQ

SEQ ID NO: 771663 - protein, 20 aa, Mycobacterium
LRLGFLAGHLHWKVDQHDDT

SEQ ID NO: 771664 - protein, 18 aa, Mycobacterium
LRLGRPVRYEFSRSDEFT

SEQ ID NO: 771665 - protein, 17 aa, Mycobacterium
LRLGRPVRYEFTRVDEF

SEQ ID NO: 771666 - protein, 17 aa, Mycobacterium
LRLGVAVLVASQHDPLQ

SEQ ID NO: 771667 - protein, 17 aa, Mycobacterium
LRLGWLVLPDRLVDAVL

SEQ ID NO: 771668 - protein, 18 aa, Mycobacterium
LRLITSMLDRGYTIAHVR

SEQ ID NO: 771669 - protein, 19 aa, Mycobacterium
LRLKAWRLDVAKEQKVPAY

SEQ ID NO: 771670 - protein, 18 aa, Mycobacterium
LRLLFKDEVRAVGRELGL

SEQ ID NO: 771671 - protein, 19 aa, Mycobacterium
LRLLFKDEVRAVGRELGLP

SEQ ID NO: 771672 - protein, 19 aa, Mycobacterium
LRLLFPVEWERFRAGAPER

SEQ ID NO: 771673 - protein, 17 aa, Mycobacterium
LRLLGIHIFGSDATDLV

SEQ ID NO: 771674 - protein, 19 aa, Mycobacterium
LRLLLRRIFESAGGTHDDW

SEQ ID NO: 771675 - protein, 19 aa, Mycobacterium
LRLLPALDGFWFGVTPVAL

SEQ ID NO: 771676 - protein, 20 aa, Mycobacterium
LRLLPFRLVLDGTREIDADI

SEQ ID NO: 771677 - protein, 19 aa, Mycobacterium
LRLPATFGIGTYGVSADFV

SEQ ID NO: 771678 - protein, 18 aa, Mycobacterium
LRLPAVVLEVEFALDASG

SEQ ID NO: 771679 - protein, 18 aa, Mycobacterium
LRLPEWQLAVPQVGGPGQ

SEQ ID NO: 771680 - protein, 17 aa, Mycobacterium
LRLPFGRLWGYDVSVSD

SEQ ID NO: 771681 - protein, 17 aa, Mycobacterium
LRLPGFPFQFFCYKRIA

SEQ ID NO: 771682 - protein, 17 aa, Mycobacterium
LRLPMRVRTAIRQTRDV

SEQ ID NO: 771683 - protein, 20 aa, Mycobacterium
LRLPPELDFAALFHGVDERV

SEQ ID NO: 771684 - protein, 25 aa, Mycobacterium
LRLPQRIPSAIAMELALTGDNLPAE

SEQ ID NO: 771685 - protein, 25 aa, Mycobacterium
LRLPQRIPSAIAMELALTGENLSAE

SEQ ID NO: 771686 - protein, 22 aa, Mycobacterium
LRLPTAFCSPNFAYLMASDALD

SEQ ID NO: 771687 - protein, 18 aa, Mycobacterium
LRLPVDIVVADKFAADAT

SEQ ID NO: 771688 - protein, 22 aa, Mycobacterium
LRLRDVGGIVVIDFIDMVLESN

SEQ ID NO: 771689 - protein, 18 aa, Mycobacterium
LRLRGMSAMLTRIKRRLR

SEQ ID NO: 771690 - protein, 19 aa, Mycobacterium
LRLSARMVFEHPVVHDLAV

SEQ ID NO: 771691 - protein, 25 aa, Mycobacterium
LRLSPGLKRGALIGGIRYYDTVVDD

SEQ ID NO: 771692 - protein, 17 aa, Mycobacterium
LRLSRPLPLRVGDIGLL

SEQ ID NO: 771693 - protein, 17 aa, Mycobacterium
LRLTYVIVVEGNLLSRV

SEQ ID NO: 771694 - protein, 17 aa, Mycobacterium
LRLVHKFGAGVNTIDVA

SEQ ID NO: 771695 - protein, 21 aa, Mycobacterium
LRLYERRGLLAPSRTDGGTRR

SEQ ID NO: 771696 - protein, 18 aa, Mycobacterium
LRMADLQARVDLLRHGLL

SEQ ID NO: 771697 - protein, 20 aa, Mycobacterium
LRMDEFPARLIIVPGENDRL

SEQ ID NO: 771698 - protein, 22 aa, Mycobacterium
LRMDEFPARLVIVPGEHDRLQV

SEQ ID NO: 771699 - protein, 21 aa, Mycobacterium
LRMKMLECLLVLHTLPDEADL

SEQ ID NO: 771700 - protein, 24 aa, Mycobacterium
LRMLRPDLTIGFFLHIPFPPVELF

SEQ ID NO: 771701 - protein, 24 aa, Mycobacterium
LRMLRPDVTIGFFLHIPFPPVELF

SEQ ID NO: 771702 - protein, 19 aa, Mycobacterium
LRMMPAFLLAMGLKVGRGM

SEQ ID NO: 771703 - protein, 18 aa, Mycobacterium
LRMPAGRGKVLRWAAPLL

SEQ ID NO: 771704 - protein, 17 aa, Mycobacterium
LRMPVLMCVGDHDQQAS

SEQ ID NO: 771705 - protein, 19 aa, Mycobacterium
LRMRFKWMGLYTQREEGYD

SEQ ID NO: 771706 - protein, 20 aa, Mycobacterium
LRNDIAFSFVFSEPVDGRQL

SEQ ID NO: 771707 - protein, 18 aa, Mycobacterium
LRNEGLNWVTWVDGETTY

SEQ ID NO: 771708 - protein, 20 aa, Mycobacterium
LRNLLARCFERGVDPWDLER

SEQ ID NO: 771709 - protein, 22 aa, Mycobacterium
LRNLLLAVIFEWGIALHGIHSE

SEQ ID NO: 771710 - protein, 19 aa, Mycobacterium
LRNVWRFWYQIPISLPVIG

SEQ ID NO: 771711 - protein, 18 aa, Mycobacterium
LRPAALAELALRAPARPA

SEQ ID NO: 771712 - protein, 19 aa, Mycobacterium
LRPAHHPSHPWGFVNSVIS

SEQ ID NO: 771713 - protein, 17 aa, Mycobacterium
LRPALFPLWLAIRPIAG

SEQ ID NO: 771714 - protein, 27 aa, Mycobacterium
LRPAPEFEAWLSGLGMVGADGRVLPVD

SEQ ID NO: 771715 - protein, 23 aa, Mycobacterium
LRPAPEFEAWLTGLGMADANGRI

SEQ ID NO: 771716 - protein, 21 aa, Mycobacterium
LRPAPEFNDWLERMGMLERDG

SEQ ID NO: 771717 - protein, 20 aa, Mycobacterium
LRPARAAVVAPSFTEPADAL

SEQ ID NO: 771718 - protein, 26 aa, Mycobacterium
LRPASHYSLGWLPRWAKLGSAVPRLA

SEQ ID NO: 771719 - protein, 19 aa, Mycobacterium
LRPAWITDLHNVFGSAAAE

SEQ ID NO: 771720 - protein, 21 aa, Mycobacterium
LRPDELHLGFNFRLTKIDFDA

SEQ ID NO: 771721 - protein, 21 aa, Mycobacterium
LRPDFATGLAPLRWGTGFMLG

SEQ ID NO: 771722 - protein, 21 aa, Mycobacterium
LRPDLDWDKGKTLRWVIDHLH

SEQ ID NO: 771723 - protein, 19 aa, Mycobacterium
LRPDLRPDWAQPAAGGGSY

SEQ ID NO: 771724 - protein, 23 aa, Mycobacterium
LRPEIWGEFTKRFDIDRVCEFYA

SEQ ID NO: 771725 - protein, 25 aa, Mycobacterium
LRPEPRLPAPAGWPFGEDFPRTCGT

SEQ ID NO: 771726 - protein, 25 aa, Mycobacterium
LRPEPRLPVPSGWPFGEDFPRTCGA

SEQ ID NO: 771727 - protein, 19 aa, Mycobacterium
LRPEVVSFTFGLPDDDEVK

SEQ ID NO: 771728 - protein, 19 aa, Mycobacterium
LRPFMGMMGVAFTQDREIT

SEQ ID NO: 771729 - protein, 19 aa, Mycobacterium
LRPGDLLAVAATGAYCYSL

SEQ ID NO: 771730 - protein, 17 aa, Mycobacterium
LRPGGLIGIEHDDTTSR

SEQ ID NO: 771731 - protein, 21 aa, Mycobacterium
LRPGGQAIIEWVPPSMLASRQ

SEQ ID NO: 771732 - protein, 24 aa, Mycobacterium
LRPGGRLGLVWNVRDERLGWVKDL

SEQ ID NO: 771733 - protein, 24 aa, Mycobacterium
LRPGGRLGLVWNVRDERLGWVSDL

SEQ ID NO: 771734 - protein, 20 aa, Mycobacterium
LRPGGWMVIEDYDWTAFGFE

SEQ ID NO: 771735 - protein, 20 aa, Mycobacterium
LRPGGYFAYADLRPSNEIPD

SEQ ID NO: 771736 - protein, 20 aa, Mycobacterium
LRPHFEWRGLGFISQSALKI

SEQ ID NO: 771737 - protein, 18 aa, Mycobacterium
LRPLLIDTVVGFIGPEYL

SEQ ID NO: 771738 - protein, 19 aa, Mycobacterium
LRPLLPDNLAYVIYTSGST

SEQ ID NO: 771739 - protein, 19 aa, Mycobacterium
LRPLYRPGLVHMYHALTWG

SEQ ID NO: 771740 - protein, 17 aa, Mycobacterium
LRPPPPVRYRLADGAAA

SEQ ID NO: 771741 - protein, 19 aa, Mycobacterium
LRPQLLDRFGFAVDIHASR

SEQ ID NO: 771742 - protein, 18 aa, Mycobacterium
LRPRIAFEATSPAELAEL

SEQ ID NO: 771743 - protein, 20 aa, Mycobacterium
LRPRLRWEMLRLAADHADAG

SEQ ID NO: 771744 - protein, 24 aa, Mycobacterium
LRPTRAGAVPTIWNDVMHYLEKNP

SEQ ID NO: 771745 - protein, 17 aa, Mycobacterium
LRPWVPVVSLVKGLEQG

SEQ ID NO: 771746 - protein, 21 aa, Mycobacterium
LRQALEVFGPIFIQTYAGTEP

SEQ ID NO: 771747 - protein, 19 aa, Mycobacterium
LRQALLMARNRLGPTAITA

SEQ ID NO: 771748 - protein, 17 aa, Mycobacterium
LRQAPVLVLGDRREGDA

SEQ ID NO: 771749 - protein, 17 aa, Mycobacterium
LRQARPALQNTIHQADR

SEQ ID NO: 771750 - protein, 17 aa, Mycobacterium
LRQAWLDLHESWLTAKA

SEQ ID NO: 771751 - protein, 17 aa, Mycobacterium
LRQAYPVPRAPYGLAGS

SEQ ID NO: 771752 - protein, 17 aa, Mycobacterium
LRQKCPVAWNENYGGFW

SEQ ID NO: 771753 - protein, 18 aa, Mycobacterium
LRQLAGAAPAVFADFEIS

SEQ ID NO: 771754 - protein, 20 aa, Mycobacterium
LRQLKNAFLVSSRRQGKLVM

SEQ ID NO: 771755 - protein, 19 aa, Mycobacterium
LRQLPGLAVQRLMADGFGF

SEQ ID NO: 771756 - protein, 17 aa, Mycobacterium
LRQMGIDEPVEWSPLPQ

SEQ ID NO: 771757 - protein, 20 aa, Mycobacterium
LRQRIGMVFQHFNLFPHRTV

SEQ ID NO: 771758 - protein, 19 aa, Mycobacterium
LRQTARELAEWVGSRADSA

SEQ ID NO: 771759 - protein, 20 aa, Mycobacterium
LRQTFDYCVTSAFIMSQLAV

SEQ ID NO: 771760 - protein, 19 aa, Mycobacterium
LRQTYPFGMFAVPQSQISR

SEQ ID NO: 771761 - protein, 18 aa, Mycobacterium
LRQVCGLARPTTVDTAMA

SEQ ID NO: 771762 - protein, 19 aa, Mycobacterium
LRQVIGCVFQDFRLLQQKT

SEQ ID NO: 771763 - protein, 19 aa, Mycobacterium
LRRAPRLGFEIDIDDAKIS

SEQ ID NO: 771764 - protein, 19 aa, Mycobacterium
LRRAPRLGFEIDIDDAKLS

SEQ ID NO: 771765 - protein, 17 aa, Mycobacterium
LRRAVGWYRSHDRLHTG

SEQ ID NO: 771766 - protein, 19 aa, Mycobacterium
LRRAVRLLAQMTRQVAVVQ

SEQ ID NO: 771767 - protein, 18 aa, Mycobacterium
LRRDCFRVLLELPGGVAG

SEQ ID NO: 771768 - protein, 18 aa, Mycobacterium
LRRECPRLQAGATVVAAH

SEQ ID NO: 771769 - protein, 23 aa, Mycobacterium
LRRFGELRLRLSVNGDERQNSLV

SEQ ID NO: 771770 - protein, 19 aa, Mycobacterium
LRRFIPFDVDAGVLRSAGA

SEQ ID NO: 771771 - protein, 20 aa, Mycobacterium
LRRFIRRWLGGALLAQPRAT

SEQ ID NO: 771772 - protein, 17 aa, Mycobacterium
LRRFPKIELVGAVDRMR

SEQ ID NO: 771773 - protein, 18 aa, Mycobacterium
LRRFSLLDSLYMIPPPRI

SEQ ID NO: 771774 - protein, 17 aa, Mycobacterium
LRRHFDWVRSWYDFAVP

SEQ ID NO: 771775 - protein, 18 aa, Mycobacterium
LRRLRGLGHLTVLPGHGP

SEQ ID NO: 771776 - protein, 17 aa, Mycobacterium
LRRLWAMPGTQLGVVAW

SEQ ID NO: 771777 - protein, 20 aa, Mycobacterium
LRRMEFAIAVAKTLANQTAE

SEQ ID NO: 771778 - protein, 20 aa, Mycobacterium
LRRMGELFAPFTKIAAGNPF

SEQ ID NO: 771779 - protein, 18 aa, Mycobacterium
LRRNIRWDPLDSVYFAGY

SEQ ID NO: 771780 - protein, 19 aa, Mycobacterium
LRRRGRLAYTYAMGQCIVA

SEQ ID NO: 771781 - protein, 18 aa, Mycobacterium
LRRSIGYAIQQAGLFPHM

SEQ ID NO: 771782 - protein, 17 aa, Mycobacterium
LRRSPAWEVLRPLAQPM

SEQ ID NO: 771783 - protein, 21 aa, Mycobacterium
LRRWLAPAIREWAARPVTASV

SEQ ID NO: 771784 - protein, 23 aa, Mycobacterium
LRRYRAQSGFVFQAHNLFPHMTV

SEQ ID NO: 771785 - protein, 18 aa, Mycobacterium
LRRYWPWTAVGRRMAETD

SEQ ID NO: 771786 - protein, 18 aa, Mycobacterium
LRSAAALRWAISPWAQSQ

SEQ ID NO: 771787 - protein, 18 aa, Mycobacterium
LRSAAPWADGLAGTTLDL

SEQ ID NO: 771788 - protein, 19 aa, Mycobacterium
LRSALALGAARVFAVDPVV

SEQ ID NO: 771789 - protein, 20 aa, Mycobacterium
LRSALAWLCNAVSRFGRNPS

SEQ ID NO: 771790 - protein, 18 aa, Mycobacterium
LRSARGFGGPVIVHVVTR

SEQ ID NO: 771791 - protein, 19 aa, Mycobacterium
LRSATPLGDVFVSIRPPAG

SEQ ID NO: 771792 - protein, 21 aa, Mycobacterium
LRSEINLGFQPFTLEHAIAAH

SEQ ID NO: 771793 - protein, 23 aa, Mycobacterium
LRSELKGDELLGVEVFASALSSP

SEQ ID NO: 771794 - protein, 23 aa, Mycobacterium
LRSELKMLPALPVAELRAQADEL

SEQ ID NO: 771795 - protein, 18 aa, Mycobacterium
LRSGAAIINLCTLGTRDR

SEQ ID NO: 771796 - protein, 17 aa, Mycobacterium
LRSGALLDWAHQTVSGS

SEQ ID NO: 771797 - protein, 19 aa, Mycobacterium
LRSGLKLNFSCTVGGCAAC

SEQ ID NO: 771798 - protein, 20 aa, Mycobacterium
LRSGMTIGIAGWGSRRKPMA

SEQ ID NO: 771799 - protein, 20 aa, Mycobacterium
LRSGWLNGIKHWQVDYRGDA

SEQ ID NO: 771800 - protein, 27 aa, Mycobacterium
LRSIPTLFWREWSFRLTVGRGTLSVIR

SEQ ID NO: 771801 - protein, 19 aa, Mycobacterium
LRSKGFCWIASRDDIAAIW

SEQ ID NO: 771802 - protein, 19 aa, Mycobacterium
LRSKGFCWIASRPSVAAIW

SEQ ID NO: 771803 - protein, 17 aa, Mycobacterium
LRSLLRFVLDLLSDYGL

SEQ ID NO: 771804 - protein, 19 aa, Mycobacterium
LRSRFGFLAIHGGGLEEMT

SEQ ID NO: 771805 - protein, 19 aa, Mycobacterium
LRSRFGFLAIHGGGLERMT

SEQ ID NO: 771806 - protein, 19 aa, Mycobacterium
LRSRFGFLAIHGGSLEKMT

SEQ ID NO: 771807 - protein, 17 aa, Mycobacterium
LRSRFPGGFTSEVRGIF

SEQ ID NO: 771808 - protein, 18 aa, Mycobacterium
LRSSAILGVCKNVLRAQE

SEQ ID NO: 771809 - protein, 19 aa, Mycobacterium
LRSSPDWYRVIGGRGGNGA

SEQ ID NO: 771810 - protein, 21 aa, Mycobacterium
LRSYLRRWVGAAVKPAQASVQ

SEQ ID NO: 771811 - protein, 17 aa, Mycobacterium
LRTALRMQVWAGHTIVE

SEQ ID NO: 771812 - protein, 19 aa, Mycobacterium
LRTATPLGDVFVALKPPSA

SEQ ID NO: 771813 - protein, 18 aa, Mycobacterium
LRTAVLEFMDTVREVEAA

SEQ ID NO: 771814 - protein, 21 aa, Mycobacterium
LRTCPLCEAMCGLEIQVDDGR

SEQ ID NO: 771815 - protein, 18 aa, Mycobacterium
LRTDRDWIADIVRFVTSR

SEQ ID NO: 771816 - protein, 19 aa, Mycobacterium
LRTDRDWIADVMRFVANRR

SEQ ID NO: 771817 - protein, 18 aa, Mycobacterium
LRTDRDWISDIVRFVSQQ

SEQ ID NO: 771818 - protein, 18 aa, Mycobacterium
LRTDWPARLVGAGFEPAK

SEQ ID NO: 771819 - protein, 19 aa, Mycobacterium
LRTEPWLGPASLSMAAAAQ

SEQ ID NO: 771820 - protein, 23 aa, Mycobacterium
LRTEWWQSCLLPVNWKLATAAFM

SEQ ID NO: 771821 - protein, 18 aa, Mycobacterium
LRTGTDFEYELQMAQMNK

SEQ ID NO: 771822 - protein, 17 aa, Mycobacterium
LRTGWSVTVVGHAEPIT

SEQ ID NO: 771823 - protein, 19 aa, Mycobacterium
LRTLVGIYFDVICDLQPVN

SEQ ID NO: 771824 - protein, 17 aa, Mycobacterium
LRTRCAGAWLWSGRRGI

SEQ ID NO: 771825 - protein, 19 aa, Mycobacterium
LRTRGLKIFPLVGWAERGG

SEQ ID NO: 771826 - protein, 17 aa, Mycobacterium
LRTRLDALIGHGVTEVR

SEQ ID NO: 771827 - protein, 17 aa, Mycobacterium
LRTSHRFGKSIGTLADA

SEQ ID NO: 771828 - protein, 19 aa, Mycobacterium
LRTVCLDFKLYAGGMASTV

SEQ ID NO: 771829 - protein, 22 aa, Mycobacterium
LRVALYPTKIVLDFADDRIAQI

SEQ ID NO: 771830 - protein, 18 aa, Mycobacterium
LRVARLLAYRAVSLQDDP

SEQ ID NO: 771831 - protein, 18 aa, Mycobacterium
LRVATAWEFDLYGGTVLL

SEQ ID NO: 771832 - protein, 18 aa, Mycobacterium
LRVAVCRLVARHPALRTG

SEQ ID NO: 771833 - protein, 19 aa, Mycobacterium
LRVEHRVHLGIATATERGL

SEQ ID NO: 771834 - protein, 17 aa, Mycobacterium
LRVGLPMAPNTVFIAFG

SEQ ID NO: 771835 - protein, 17 aa, Mycobacterium
LRVGNRFIHTGKPTPEG

SEQ ID NO: 771836 - protein, 17 aa, Mycobacterium
LRVGNRFVHTVKPTPEA

SEQ ID NO: 771837 - protein, 17 aa, Mycobacterium
LRVGSFFPSLLERRRRI

SEQ ID NO: 771838 - protein, 19 aa, Mycobacterium
LRVGWFEGGIAWVPPALQD

SEQ ID NO: 771839 - protein, 23 aa, Mycobacterium
LRVGWFEGGIAWVPWALQDAEHL

SEQ ID NO: 771840 - protein, 18 aa, Mycobacterium
LRVIFPPGFAERIGADAV

SEQ ID NO: 771841 - protein, 21 aa, Mycobacterium
LRVLDMTTFWAGPSCTHILGM

SEQ ID NO: 771842 - protein, 18 aa, Mycobacterium
LRVLIDWTGAHLAEVEVN

SEQ ID NO: 771843 - protein, 25 aa, Mycobacterium
LRVLQDLYARWPFFRTVLSNMAQVL

SEQ ID NO: 771844 - protein, 20 aa, Mycobacterium
LRVLRLFLGAAYRPVAVHLP

SEQ ID NO: 771845 - protein, 20 aa, Mycobacterium
LRVPRFLWEVGFAAFEIARR

SEQ ID NO: 771846 - protein, 18 aa, Mycobacterium
LRVPTFIRYDLRADGDDL

SEQ ID NO: 771847 - protein, 21 aa, Mycobacterium
LRVRRRARDWYQRLLTDDPGR

SEQ ID NO: 771848 - protein, 22 aa, Mycobacterium
LRVSRVRWVGGYGRMDSATGEA

SEQ ID NO: 771849 - protein, 17 aa, Mycobacterium
LRVSVRMSGPLDVVPAS

SEQ ID NO: 771850 - protein, 17 aa, Mycobacterium
LRVVDTIDIGSAVRDVA

SEQ ID NO: 771851 - protein, 24 aa, Mycobacterium
LRVVKFWVSHGVKVFRVDNPHTKP

SEQ ID NO: 771852 - protein, 17 aa, Mycobacterium
LRVVTVFGGVSQHKQVA

SEQ ID NO: 771853 - protein, 17 aa, Mycobacterium
LRWALPVAYRLPGLGRL

SEQ ID NO: 771854 - protein, 20 aa, Mycobacterium
LRWERFAVVTDIEWIKQTVK

SEQ ID NO: 771855 - protein, 19 aa, Mycobacterium
LRWLASANCLLEIGEDVTE

SEQ ID NO: 771856 - protein, 19 aa, Mycobacterium
LRWLASANCLLELDEDTAE

SEQ ID NO: 771857 - protein, 20 aa, Mycobacterium
LRWPQPNFPVSNFFHGGAAP

SEQ ID NO: 771858 - protein, 18 aa, Mycobacterium
LRWSVWRMAVGNRNITTT

SEQ ID NO: 771859 - protein, 18 aa, Mycobacterium
LRWWEVLRCIASVRSGLV

SEQ ID NO: 771860 - protein, 17 aa, Mycobacterium
LRYADALSMADNVMTFR

SEQ ID NO: 771861 - protein, 20 aa, Mycobacterium
LRYDIRWKVACGRALTQTSF

SEQ ID NO: 771862 - protein, 24 aa, Mycobacterium
LRYFWPRVVGDIGWQLLDSKFAVV

SEQ ID NO: 771863 - protein, 24 aa, Mycobacterium
LRYFWPRVVGDIGWQLLDTKFAVV

SEQ ID NO: 771864 - protein, 20 aa, Mycobacterium
LRYIMPLGEIIFDFFDSLKS

SEQ ID NO: 771865 - protein, 21 aa, Mycobacterium
LRYLAPIAIRGELVWIDLQES

SEQ ID NO: 771866 - protein, 17 aa, Mycobacterium
LRYLLTLYVYRFGVTTV

SEQ ID NO: 771867 - protein, 20 aa, Mycobacterium
LRYPLPAAWCDDVDVALYLK

SEQ ID NO: 771868 - protein, 19 aa, Mycobacterium
LRYPYARGVLIEMYREAKA

SEQ ID NO: 771869 - protein, 20 aa, Mycobacterium
LRYRIGASLPRAVDTSMPRE

SEQ ID NO: 771870 - protein, 25 aa, Mycobacterium
LRYTCGRCAYCLRGRENLCPESRYT

SEQ ID NO: 771871 - protein, 17 aa, Mycobacterium
LRYTEAEWARMLAKQAE

SEQ ID NO: 771872 - protein, 20 aa, Mycobacterium
LRYTMPLGEIIFDFFDALKS

SEQ ID NO: 771873 - protein, 18 aa, Mycobacterium
LSAAAAWDGLAGELESAA

SEQ ID NO: 771874 - protein, 17 aa, Mycobacterium
LSAAGISWKLYRNKTLG

SEQ ID NO: 771875 - protein, 21 aa, Mycobacterium
LSADLNYVWPTARIAVIGAEG

SEQ ID NO: 771876 - protein, 24 aa, Mycobacterium
LSAEAGAILGRWCAALTRAFTHDG

SEQ ID NO: 771877 - protein, 17 aa, Mycobacterium
LSAGFPLLTTKKVHLKS

SEQ ID NO: 771878 - protein, 17 aa, Mycobacterium
LSAGFVIEEGFPIAELR

SEQ ID NO: 771879 - protein, 20 aa, Mycobacterium
LSAKIAFFFTRRKLAQMTGL

SEQ ID NO: 771880 - protein, 24 aa, Mycobacterium
LSALSFKCDVLWSMLDAIDQAYGN

SEQ ID NO: 771881 - protein, 18 aa, Mycobacterium
LSAMPPFLTGGSMIENVA

SEQ ID NO: 771882 - protein, 17 aa, Mycobacterium
LSAPLVRRDGVLREATW

SEQ ID NO: 771883 - protein, 21 aa, Mycobacterium
LSAPMTLRWLTDRFAGLPLTE

SEQ ID NO: 771884 - protein, 20 aa, Mycobacterium
LSAPMTLRWLTDRFAGRPLS

SEQ ID NO: 771885 - protein, 28 aa, Mycobacterium
LSAQMAAFHDRFMNALAGASGSYASAEA

SEQ ID NO: 771886 - protein, 17 aa, Mycobacterium
LSARLGLTARVAHVEGD

SEQ ID NO: 771887 - protein, 21 aa, Mycobacterium
LSASQLRSWFAYRLDGPSPVN

SEQ ID NO: 771888 - protein, 22 aa, Mycobacterium
LSASQLRSWFAYRVDGPSWVNN

SEQ ID NO: 771889 - protein, 23 aa, Mycobacterium
LSATECWDLLKSVALGRIVTTVD

SEQ ID NO: 771890 - protein, 17 aa, Mycobacterium
LSATLARGLKAEGFVVV

SEQ ID NO: 771891 - protein, 23 aa, Mycobacterium
LSAWTIRLLSRFPQRAVVALATN

SEQ ID NO: 771892 - protein, 20 aa, Mycobacterium
LSAYGVRYLFGVPGAKIDSV

SEQ ID NO: 771893 - protein, 17 aa, Mycobacterium
LSCAGLVIGAWPAEPGV

SEQ ID NO: 771894 - protein, 23 aa, Mycobacterium
LSCPADYQLLLALRAYADVVLVG

SEQ ID NO: 771895 - protein, 18 aa, Mycobacterium
LSDAVTWLAAAGRLSDPR

SEQ ID NO: 771896 - protein, 18 aa, Mycobacterium
LSDELLIEVAEAYIGEAA

SEQ ID NO: 771897 - protein, 20 aa, Mycobacterium
LSDIALKWVIEGAAEHGLLL

SEQ ID NO: 771898 - protein, 18 aa, Mycobacterium
LSDLAALARRTGAADDPF

SEQ ID NO: 771899 - protein, 20 aa, Mycobacterium
LSDLQPGDVITFYNDASHSG

SEQ ID NO: 771900 - protein, 20 aa, Mycobacterium
LSDLQPGDVLTFYSDASHAG

SEQ ID NO: 771901 - protein, 23 aa, Mycobacterium
LSDPRLRRIFTFQSLYAGVAPRD

SEQ ID NO: 771902 - protein, 17 aa, Mycobacterium
LSDRADLVWRSTAATAL

SEQ ID NO: 771903 - protein, 24 aa, Mycobacterium
LSDRGKYQLGIGVSRLARARSGHS

SEQ ID NO: 771904 - protein, 17 aa, Mycobacterium
LSDVLGYAAEYAERGIE

SEQ ID NO: 771905 - protein, 17 aa, Mycobacterium
LSDYLGWSAAIPASECA

SEQ ID NO: 771906 - protein, 21 aa, Mycobacterium
LSEHIRLLAAFDHRHIFIDPT

SEQ ID NO: 771907 - protein, 20 aa, Mycobacterium
LSEIRHWLQVFVERFYSFSQ

SEQ ID NO: 771908 - protein, 21 aa, Mycobacterium
LSELPPFLTGGSMIETVTMES

SEQ ID NO: 771909 - protein, 22 aa, Mycobacterium
LSFAELRAAWRADERGVRLDDA

SEQ ID NO: 771910 - protein, 19 aa, Mycobacterium
LSFLDFRKIPLNGLWAETK

SEQ ID NO: 771911 - protein, 20 aa, Mycobacterium
LSFSSLSGWADRGKRDRFID

SEQ ID NO: 771912 - protein, 20 aa, Mycobacterium
LSGADFPAGWQKLNGPQALS

SEQ ID NO: 771913 - protein, 20 aa, Mycobacterium
LSGAGLWPLLALLASAADDP

SEQ ID NO: 771914 - protein, 28 aa, Mycobacterium
LSGFERFPAWMWRNTVVRDFVEWLRTRN

SEQ ID NO: 771915 - protein, 18 aa, Mycobacterium
LSGGHLFSLYDGCRDEGV

SEQ ID NO: 771916 - protein, 25 aa, Mycobacterium
LSGQVGWLARDRWAVPLVHTAHTLA

SEQ ID NO: 771917 - protein, 20 aa, Mycobacterium
LSGRHFVRWLTAWNETVDAM

SEQ ID NO: 771918 - protein, 17 aa, Mycobacterium
LSGSLGAMFGVCGNELS

SEQ ID NO: 771919 - protein, 17 aa, Mycobacterium
LSGTKVWTSGAHLAHAF

SEQ ID NO: 771920 - protein, 18 aa, Mycobacterium
LSGTKVWTSGAHLAHAFI

SEQ ID NO: 771921 - protein, 18 aa, Mycobacterium
LSGVRLGLMHGRLSGDEK

SEQ ID NO: 771922 - protein, 20 aa, Mycobacterium
LSGYEIPTQISIVAEIPRTA

SEQ ID NO: 771923 - protein, 23 aa, Mycobacterium
LSHDTMEVWSWFLVEKDADEEFK

SEQ ID NO: 771924 - protein, 23 aa, Mycobacterium
LSHNCWQYAALVFATARVGVVLV

SEQ ID NO: 771925 - protein, 18 aa, Mycobacterium
LSIKRPNWITAFDRGGVW

SEQ ID NO: 771926 - protein, 17 aa, Mycobacterium
LSIRLGVPCFPDDPLRF

SEQ ID NO: 771927 - protein, 21 aa, Mycobacterium
LSIWPDWVRRWPTASATAAAT

SEQ ID NO: 771928 - protein, 21 aa, Mycobacterium
LSIWPDWVRRWPTASATATAT

SEQ ID NO: 771929 - protein, 21 aa, Mycobacterium
LSKHIRLLAAFDHRHIFLDPD

SEQ ID NO: 771930 - protein, 19 aa, Mycobacterium
LSKLARPTSTWTYMVNDNP

SEQ ID NO: 771931 - protein, 19 aa, Mycobacterium
LSKPFTFKRVEALRPTIQQ

SEQ ID NO: 771932 - protein, 21 aa, Mycobacterium
LSKPFTFRRVEALRPVIQEVT

SEQ ID NO: 771933 - protein, 20 aa, Mycobacterium
LSKPFTFRRVEGLRPAIQKI

SEQ ID NO: 771934 - protein, 20 aa, Mycobacterium
LSKPFTFRRVEGLRPTIQQI

SEQ ID NO: 771935 - protein, 17 aa, Mycobacterium
LSKRGGGVALLLSNIRE

SEQ ID NO: 771936 - protein, 17 aa, Mycobacterium
LSLEGGKVTGERETDEG

SEQ ID NO: 771937 - protein, 17 aa, Mycobacterium
LSLGYPFDAEWYACGQS

SEQ ID NO: 771938 - protein, 18 aa, Mycobacterium
LSLHLGRRHRIGGLPGYV

SEQ ID NO: 771939 - protein, 19 aa, Mycobacterium
LSLRLAVRTPFAFEGLFGH

SEQ ID NO: 771940 - protein, 26 aa, Mycobacterium
LSLRPETQLALGKWGMLSPHGKCYAF

SEQ ID NO: 771941 - protein, 20 aa, Mycobacterium
LSLTGRPLIGNGANGAPGTG

SEQ ID NO: 771942 - protein, 17 aa, Mycobacterium
LSLWARLRRFTVADLDT

SEQ ID NO: 771943 - protein, 24 aa, Mycobacterium
LSMASAFWPYVTWTSMVATQAGEA

SEQ ID NO: 771944 - protein, 24 aa, Mycobacterium
LSMASALGPYVAWTAGVAARAAET

SEQ ID NO: 771945 - protein, 21 aa, Mycobacterium
LSMFERFLPRHLEIIYEINRR

SEQ ID NO: 771946 - protein, 17 aa, Mycobacterium
LSMMWRNDCESPHLQPL

SEQ ID NO: 771947 - protein, 25 aa, Mycobacterium
LSNIKLLGPVGDLLPILRIPGDTAF

SEQ ID NO: 771948 - protein, 17 aa, Mycobacterium
LSNLDGWGRISDAGGFI

SEQ ID NO: 771949 - protein, 17 aa, Mycobacterium
LSPAWVYSKAMRRRAPW

SEQ ID NO: 771950 - protein, 20 aa, Mycobacterium
LSPGLKRSSLIGGIRYYDTV

SEQ ID NO: 771951 - protein, 25 aa, Mycobacterium
LSPHWPEYLGALGFPIHYRGNHLHL

SEQ ID NO: 771952 - protein, 18 aa, Mycobacterium
LSPISGRAGIAVRAALSR

SEQ ID NO: 771953 - protein, 19 aa, Mycobacterium
LSPWLAMDYFEIWRTQPSV

SEQ ID NO: 771954 - protein, 25 aa, Mycobacterium
LSQGRFRFGVGVGWLREEIANHGVD

SEQ ID NO: 771955 - protein, 25 aa, Mycobacterium
LSQGRFRFGVGVGWLREEVANHRVD

SEQ ID NO: 771956 - protein, 22 aa, Mycobacterium
LSQLRLLPFRLVLDGTTEIDAD

SEQ ID NO: 771957 - protein, 17 aa, Mycobacterium
LSQLWFEALAGICAHVQ

SEQ ID NO: 771958 - protein, 23 aa, Mycobacterium
LSRDLTIRLGREVTRISHDATGV

SEQ ID NO: 771959 - protein, 19 aa, Mycobacterium
LSRFADLCVTAFAGFAVVK

SEQ ID NO: 771960 - protein, 24 aa, Mycobacterium
LSRNAYRYEFGWRSTAVDGLLGAA

SEQ ID NO: 771961 - protein, 20 aa, Mycobacterium
LSRPELKAAVGQIVNADGGQ

SEQ ID NO: 771962 - protein, 17 aa, Mycobacterium
LSSALARRGHDVVVYTR

SEQ ID NO: 771963 - protein, 17 aa, Mycobacterium
LSSLFLLASTAALFSTS

SEQ ID NO: 771964 - protein, 17 aa, Mycobacterium
LSSLMAWPTEHLTNAAD

SEQ ID NO: 771965 - protein, 18 aa, Mycobacterium
LSSLPGCWLLVGADEMRR

SEQ ID NO: 771966 - protein, 17 aa, Mycobacterium
LSSPRIVGWIMRTDSAD

SEQ ID NO: 771967 - protein, 17 aa, Mycobacterium
LSSPRIVGWIMRTDSSD

SEQ ID NO: 771968 - protein, 17 aa, Mycobacterium
LSSSHFVRWLTVWNDTV

SEQ ID NO: 771969 - protein, 18 aa, Mycobacterium
LSTCPPILVLTGRPDDSW

SEQ ID NO: 771970 - protein, 24 aa, Mycobacterium
LSTEAGAILGRWCTALTRAFVNDG

SEQ ID NO: 771971 - protein, 17 aa, Mycobacterium
LSTLTWRAATNVTKLPG

SEQ ID NO: 771972 - protein, 25 aa, Mycobacterium
LSTRPAATCLIDWGTADRHAHREGV

SEQ ID NO: 771973 - protein, 18 aa, Mycobacterium
LSTWWADMGAECGRLAQE

SEQ ID NO: 771974 - protein, 22 aa, Mycobacterium
LSTYRFPTGWFIVAFGSDLAAG

SEQ ID NO: 771975 - protein, 22 aa, Mycobacterium
LSTYRFPTGWFIVAFGSDLAPG

SEQ ID NO: 771976 - protein, 17 aa, Mycobacterium
LSVANGWGAQVTEGKKV

SEQ ID NO: 771977 - protein, 21 aa, Mycobacterium
LSVDACRAFKPSPAVYRYVCD

SEQ ID NO: 771978 - protein, 17 aa, Mycobacterium
LSVDGFRALLVLNHEHH

SEQ ID NO: 771979 - protein, 19 aa, Mycobacterium
LSVDVLDLWDNVRAHLDEN

SEQ ID NO: 771980 - protein, 17 aa, Mycobacterium
LSVPPSWAGPATPVVGT

SEQ ID NO: 771981 - protein, 19 aa, Mycobacterium
LSVPPSWAGSTPVVGSSAA

SEQ ID NO: 771982 - protein, 33 aa, Mycobacterium
LSVPRFASAWLWRLRWPLPLLGMGADIPDGQLC

SEQ ID NO: 771983 - protein, 19 aa, Mycobacterium
LSVRWRHGDTWAIVEGPPA

SEQ ID NO: 771984 - protein, 17 aa, Mycobacterium
LSVSFGDDWAWVRRAHD

SEQ ID NO: 771985 - protein, 19 aa, Mycobacterium
LSVTCPRDLVLNAPVKLAE

SEQ ID NO: 771986 - protein, 20 aa, Mycobacterium
LSVVVGESWRAEALAEMMRE

SEQ ID NO: 771987 - protein, 17 aa, Mycobacterium
LSWAAGLRDDGSTTLLV

SEQ ID NO: 771988 - protein, 17 aa, Mycobacterium
LSWGFDRIFAVTMNHSV

SEQ ID NO: 771989 - protein, 17 aa, Mycobacterium
LSYGSGCVAELFAGTVT

SEQ ID NO: 771990 - protein, 18 aa, Mycobacterium
LSYSLDEACLLIFPRREL

SEQ ID NO: 771991 - protein, 18 aa, Mycobacterium
LTAAGIRCDLHLWDGQIH

SEQ ID NO: 771992 - protein, 17 aa, Mycobacterium
LTAAGRRSVLCGNIGDP

SEQ ID NO: 771993 - protein, 17 aa, Mycobacterium
LTAAGRRSVLCGNIGSP

SEQ ID NO: 771994 - protein, 23 aa, Mycobacterium
LTAARAARLKWWTTDLQVRTADR

SEQ ID NO: 771995 - protein, 18 aa, Mycobacterium
LTAARFSQHGQLFQEISA

SEQ ID NO: 771996 - protein, 18 aa, Mycobacterium
LTAASLLKSMPAAVNAPA

SEQ ID NO: 771997 - protein, 20 aa, Mycobacterium
LTADCVPVLFADAAAGVVAG

SEQ ID NO: 771998 - protein, 26 aa, Mycobacterium
LTADRSRAGGGVCAIAAITGASTGPT

SEQ ID NO: 771999 - protein, 20 aa, Mycobacterium
LTAGCWPAWWLSNEDRGEID

SEQ ID NO: 772000 - protein, 19 aa, Mycobacterium
LTAGSWQGPAAMAMAAAVA

SEQ ID NO: 772001 - protein, 18 aa, Mycobacterium
LTAGYALYGTTGWDDVTV

SEQ ID NO: 772002 - protein, 19 aa, Mycobacterium
LTARGWRVAAHPARELYAQ

SEQ ID NO: 772003 - protein, 21 aa, Mycobacterium
LTARLKKVWAPQGLVQRSQGK

SEQ ID NO: 772004 - protein, 19 aa, Mycobacterium
LTARRLACVAALLRRRSGA

SEQ ID NO: 772005 - protein, 18 aa, Mycobacterium
LTATDAYDWGLISAVYPA

SEQ ID NO: 772006 - protein, 24 aa, Mycobacterium
LTCAIRPSGIWGRGDQTMFRKLFE

SEQ ID NO: 772007 - protein, 17 aa, Mycobacterium
LTCPAGIRCGVSQSIVA

SEQ ID NO: 772008 - protein, 17 aa, Mycobacterium
LTCPMFVTTPEFLPQHH

SEQ ID NO: 772009 - protein, 18 aa, Mycobacterium
LTDAGAFRMFVPRQYGGE

SEQ ID NO: 772010 - protein, 21 aa, Mycobacterium
LTDCPLRWLLERHGGDDGRDV

SEQ ID NO: 772011 - protein, 22 aa, Mycobacterium
LTDFPPSMGIRLNIPQPDLRKV

SEQ ID NO: 772012 - protein, 24 aa, Mycobacterium
LTDGWGLAGARGWQGVGHTRMATE

SEQ ID NO: 772013 - protein, 17 aa, Mycobacterium
LTDHSWNRPSWTVADLE

SEQ ID NO: 772014 - protein, 18 aa, Mycobacterium
LTDLLWRMGIRTIGQFAA

SEQ ID NO: 772015 - protein, 19 aa, Mycobacterium
LTDLLWRMGIRTIGQFAAL

SEQ ID NO: 772016 - protein, 18 aa, Mycobacterium
LTDLSWRGPASESMAASA

SEQ ID NO: 772017 - protein, 25 aa, Mycobacterium
LTDLVFAWRACRAVKSNAIVIAGGG

SEQ ID NO: 772018 - protein, 18 aa, Mycobacterium
LTDPNFRLPFGLTVTMDG

SEQ ID NO: 772019 - protein, 21 aa, Mycobacterium
LTDRLRRSFGRMPWTTTQKRL

SEQ ID NO: 772020 - protein, 18 aa, Mycobacterium
LTDWADRGLRVIGLDAGG

SEQ ID NO: 772021 - protein, 17 aa, Mycobacterium
LTDYAEAAHGMFASLST

SEQ ID NO: 772022 - protein, 18 aa, Mycobacterium
LTEAFLWSEFRVVTKTAT

SEQ ID NO: 772023 - protein, 19 aa, Mycobacterium
LTEAILVRRVDWVEEISSV

SEQ ID NO: 772024 - protein, 17 aa, Mycobacterium
LTEALARDRTRHQVSEV

SEQ ID NO: 772025 - protein, 17 aa, Mycobacterium
LTEGGSPVWASDTSGHS

SEQ ID NO: 772026 - protein, 18 aa, Mycobacterium
LTEIPVLWAYARDLYQTP

SEQ ID NO: 772027 - protein, 22 aa, Mycobacterium
LTELCGVISHLLPEAHRDPGRE

SEQ ID NO: 772028 - protein, 25 aa, Mycobacterium
LTELFSRPGVHFISGFYGPLERALR

SEQ ID NO: 772029 - protein, 20 aa, Mycobacterium
LTEVHLFWAAVLFRNVTAED

SEQ ID NO: 772030 - protein, 19 aa, Mycobacterium
LTFEIARFIKFIVTEIFPG

SEQ ID NO: 772031 - protein, 19 aa, Mycobacterium
LTFELARFIKFMVTEIFPG

SEQ ID NO: 772032 - protein, 19 aa, Mycobacterium
LTGACSMAAFTVAMHAGQG

SEQ ID NO: 772033 - protein, 17 aa, Mycobacterium
LTGEGWLGPASASMAAA

SEQ ID NO: 772034 - protein, 19 aa, Mycobacterium
LTGLRLATKLHEWEPKHGV

SEQ ID NO: 772035 - protein, 19 aa, Mycobacterium
LTGLRLATTLHEWQPRDGV

SEQ ID NO: 772036 - protein, 24 aa, Mycobacterium
LTGRPAISVPLHWTDEGLPLGVQF

SEQ ID NO: 772037 - protein, 24 aa, Mycobacterium
LTGRPAISVPLHWTPAGLPLGVQF

SEQ ID NO: 772038 - protein, 24 aa, Mycobacterium
LTGRPAISVPLHWTQNGLPLGVQF

SEQ ID NO: 772039 - protein, 17 aa, Mycobacterium
LTGRPLIGNGADGINGT

SEQ ID NO: 772040 - protein, 17 aa, Mycobacterium
LTGTKVWTSGAHLAHAF

SEQ ID NO: 772041 - protein, 18 aa, Mycobacterium
LTGWRDAWEIGRTVRDNS

SEQ ID NO: 772042 - protein, 18 aa, Mycobacterium
LTGYGLGRIEGWPDDQTI

SEQ ID NO: 772043 - protein, 18 aa, Mycobacterium
LTHEIVHFSQFILTEIFP

SEQ ID NO: 772044 - protein, 17 aa, Mycobacterium
LTIPALKAFGAIPVADK

SEQ ID NO: 772045 - protein, 25 aa, Mycobacterium
LTIPRLKRSLMLGTRWEQEGAQLVP

SEQ ID NO: 772046 - protein, 17 aa, Mycobacterium
LTIRIPFGGGIGAVEHH

SEQ ID NO: 772047 - protein, 24 aa, Mycobacterium
LTKPRWLWQWGKTMRPPNLRVPNQ

SEQ ID NO: 772048 - protein, 21 aa, Mycobacterium
LTKPVRWDLCTATLRDRFQNA

SEQ ID NO: 772049 - protein, 24 aa, Mycobacterium
LTKYAANCFLALKLSYANAMAELA

SEQ ID NO: 772050 - protein, 25 aa, Mycobacterium
LTLAVDFLGFGLFHGGAGGDGGAAT

SEQ ID NO: 772051 - protein, 18 aa, Mycobacterium
LTLCESFRLPVISLCDTP

SEQ ID NO: 772052 - protein, 22 aa, Mycobacterium
LTLGDGRVVIWGTTDRTDEKAE

SEQ ID NO: 772053 - protein, 18 aa, Mycobacterium
LTLHPGVMTGYSHGELAD

SEQ ID NO: 772054 - protein, 18 aa, Mycobacterium
LTLIAFEAMNHWRADGGF

SEQ ID NO: 772055 - protein, 23 aa, Mycobacterium
LTLPATFSLYVERAWPRHRRLSL

SEQ ID NO: 772056 - protein, 18 aa, Mycobacterium
LTLPSGVGIRLFRPPAST

SEQ ID NO: 772057 - protein, 17 aa, Mycobacterium
LTLRLLTVALRRHVVLN

SEQ ID NO: 772058 - protein, 19 aa, Mycobacterium
LTLRYRRGTVLGRPLRAEG

SEQ ID NO: 772059 - protein, 20 aa, Mycobacterium
LTLWSARAVKSFALDAFNTG

SEQ ID NO: 772060 - protein, 24 aa, Mycobacterium
LTMASAFAPYMAWTAGAAARAAEA

SEQ ID NO: 772061 - protein, 17 aa, Mycobacterium
LTMGFAEEVERILADTP

SEQ ID NO: 772062 - protein, 17 aa, Mycobacterium
LTMLGAIGFTWEHDLHL

SEQ ID NO: 772063 - protein, 22 aa, Mycobacterium
LTMLPTRAWSGLVILDPGEDST

SEQ ID NO: 772064 - protein, 21 aa, Mycobacterium
LTNRSTIRWALHQMVASGVVR

SEQ ID NO: 772065 - protein, 17 aa, Mycobacterium
LTPFIWRMDCFGRPHLE

SEQ ID NO: 772066 - protein, 17 aa, Mycobacterium
LTPGPWRLIRVVGDYYK

SEQ ID NO: 772067 - protein, 19 aa, Mycobacterium
LTPIVCIGEALDIREAGDH

SEQ ID NO: 772068 - protein, 19 aa, Mycobacterium
LTPMHAGLVWASLFSHPGL

SEQ ID NO: 772069 - protein, 18 aa, Mycobacterium
LTRAAARWVPGAQEAGIT

SEQ ID NO: 772070 - protein, 17 aa, Mycobacterium
LTRAVLRGGAYVGVHTM

SEQ ID NO: 772071 - protein, 17 aa, Mycobacterium
LTRELPLRISLIRTGAD

SEQ ID NO: 772072 - protein, 20 aa, Mycobacterium
LTRFPRLRIASVENGSSWIF

SEQ ID NO: 772073 - protein, 23 aa, Mycobacterium
LTRLGLPVPPGFVIADASGTSLG

SEQ ID NO: 772074 - protein, 18 aa, Mycobacterium
LTRLLGMVRDCFALAPDA

SEQ ID NO: 772075 - protein, 21 aa, Mycobacterium
LTRRRMLAIAMIRSSNSASLA

SEQ ID NO: 772076 - protein, 22 aa, Mycobacterium
LTRSCKRWFGIGPAAYRAKTRV

SEQ ID NO: 772077 - protein, 21 aa, Mycobacterium
LTRTAGFQWARHNICVNAIAP

SEQ ID NO: 772078 - protein, 22 aa, Mycobacterium
LTRYGLGVLRAWIRHGTIYGKA

SEQ ID NO: 772079 - protein, 18 aa, Mycobacterium
LTSELPLPVNAIAVPDVD

SEQ ID NO: 772080 - protein, 18 aa, Mycobacterium
LTSEQAWSMLGVTPLIGI

SEQ ID NO: 772081 - protein, 23 aa, Mycobacterium
LTSQWPNWGKIFFNNKGVVAKGT

SEQ ID NO: 772082 - protein, 17 aa, Mycobacterium
LTSRHSFSFGDHYDPDN

SEQ ID NO: 772083 - protein, 25 aa, Mycobacterium
LTSRPCPTCRGVGVVIPDPCHQCMG

SEQ ID NO: 772084 - protein, 19 aa, Mycobacterium
LTSRYEIPCTVAGTVTVDG

SEQ ID NO: 772085 - protein, 17 aa, Mycobacterium
LTSSAALTWRRPIASLN

SEQ ID NO: 772086 - protein, 18 aa, Mycobacterium
LTSSQWLGPASMAMVATI

SEQ ID NO: 772087 - protein, 18 aa, Mycobacterium
LTSTFGRWVHSIRSGHGA

SEQ ID NO: 772088 - protein, 17 aa, Mycobacterium
LTTALALAEWIEEHEPV

SEQ ID NO: 772089 - protein, 18 aa, Mycobacterium
LTTALALAEWIEQHAHAC

SEQ ID NO: 772090 - protein, 19 aa, Mycobacterium
LTTALARHGIVLSLQFETD

SEQ ID NO: 772091 - protein, 18 aa, Mycobacterium
LTTCPKCSGRLRKLFGSV

SEQ ID NO: 772092 - protein, 19 aa, Mycobacterium
LTTCPPILVLTGRPDDAWL

SEQ ID NO: 772093 - protein, 27 aa, Mycobacterium
LTTYRESIRWGKWHMPALFTPETYVSA

SEQ ID NO: 772094 - protein, 17 aa, Mycobacterium
LTVAFLLMLARRLPTAS

SEQ ID NO: 772095 - protein, 22 aa, Mycobacterium
LTVAGTRAWLNRQLRPIGKALD

SEQ ID NO: 772096 - protein, 17 aa, Mycobacterium
LTVGLGIGGREEDYRAV

SEQ ID NO: 772097 - protein, 22 aa, Mycobacterium
LTVRSGEHWALLGPNGAGKSTL

SEQ ID NO: 772098 - protein, 20 aa, Mycobacterium
LTWLIAHGRLEIKLAVVSNK

SEQ ID NO: 772099 - protein, 17 aa, Mycobacterium
LTYRVDFTNVVYNRKTN

SEQ ID NO: 772100 - protein, 17 aa, Mycobacterium
LVACGGSAVPLSLMRAF

SEQ ID NO: 772101 - protein, 25 aa, Mycobacterium
LVADTRGGALLAFGLADSLILRQRY

SEQ ID NO: 772102 - protein, 18 aa, Mycobacterium
LVAFWAILATRVEAPELA

SEQ ID NO: 772103 - protein, 18 aa, Mycobacterium
LVAPLTFLAIAGRRVQLE

SEQ ID NO: 772104 - protein, 17 aa, Mycobacterium
LVARAWLDPDFAELART

SEQ ID NO: 772105 - protein, 25 aa, Mycobacterium
LVARAWRAPLQFLFIDGGHSEDAAN

SEQ ID NO: 772106 - protein, 23 aa, Mycobacterium
LVASTRPPVEWLRIPPGGTVLDI

SEQ ID NO: 772107 - protein, 19 aa, Mycobacterium
LVCNPRWTLGQIIAEPALI

SEQ ID NO: 772108 - protein, 20 aa, Mycobacterium
LVCRACPYRAHQHAGAGVQP

SEQ ID NO: 772109 - protein, 23 aa, Mycobacterium
LVDDLRINWVWNPPWGPDKITED

SEQ ID NO: 772110 - protein, 20 aa, Mycobacterium
LVDIPFKFHHPMWRENCDVD

SEQ ID NO: 772111 - protein, 17 aa, Mycobacterium
LVDLRVARLLAYRAVSL

SEQ ID NO: 772112 - protein, 17 aa, Mycobacterium
LVDPVAEQISGMWAANL

SEQ ID NO: 772113 - protein, 22 aa, Mycobacterium
LVEFTLRIMLSFFVAPNEATRS

SEQ ID NO: 772114 - protein, 19 aa, Mycobacterium
LVEHMGLLLGRPVVTISCH

SEQ ID NO: 772115 - protein, 17 aa, Mycobacterium
LVEKLRTALGLEIPGLA

SEQ ID NO: 772116 - protein, 18 aa, Mycobacterium
LVELDGLLLLPGGGPELD

SEQ ID NO: 772117 - protein, 24 aa, Mycobacterium
LVELRLVDWHGWLFVDPSGQDADF

SEQ ID NO: 772118 - protein, 17 aa, Mycobacterium
LVERLVPDFLWISTEHT

SEQ ID NO: 772119 - protein, 23 aa, Mycobacterium
LVFAWRACRAVKSNAIVVARDGA

SEQ ID NO: 772120 - protein, 24 aa, Mycobacterium
LVFCAAVIRAVHKFAGLLRVSVAS

SEQ ID NO: 772121 - protein, 22 aa, Mycobacterium
LVFCAAVIRAVHKYAGLLRVSV

SEQ ID NO: 772122 - protein, 17 aa, Mycobacterium
LVFDGLFLQLPIGSVDA

SEQ ID NO: 772123 - protein, 19 aa, Mycobacterium
LVFGRRAGLGAADYVKSLT

SEQ ID NO: 772124 - protein, 19 aa, Mycobacterium
LVFGRRAGLGASDYVRSLD

SEQ ID NO: 772125 - protein, 18 aa, Mycobacterium
LVFKELRIFGSLGVDYPA

SEQ ID NO: 772126 - protein, 22 aa, Mycobacterium
LVFKELRVLGSLGVDYPAYQSA

SEQ ID NO: 772127 - protein, 21 aa, Mycobacterium
LVGARARYMWVSTFHSTCVRI

SEQ ID NO: 772128 - protein, 17 aa, Mycobacterium
LVGHGRASAMLLTAEKL

SEQ ID NO: 772129 - protein, 24 aa, Mycobacterium
LVGPNLLAGWGFRTDRRAHDEIAA

SEQ ID NO: 772130 - protein, 18 aa, Mycobacterium
LVGPRAFHRLRLDRNRNL

SEQ ID NO: 772131 - protein, 18 aa, Mycobacterium
LVGRPAYHAFTFGWLLSG

SEQ ID NO: 772132 - protein, 25 aa, Mycobacterium
LVHGGPWARDCWYYQPEVQLLANRG

SEQ ID NO: 772133 - protein, 17 aa, Mycobacterium
LVHRYCRAVDRGDVEAL

SEQ ID NO: 772134 - protein, 17 aa, Mycobacterium
LVIDGRLPLGVRIPSER

SEQ ID NO: 772135 - protein, 24 aa, Mycobacterium
LVIKEALRLLAPVPLVMRKTVRDV

SEQ ID NO: 772136 - protein, 23 aa, Mycobacterium
LVIKESLRLVAPVPLVMRKTVTD

SEQ ID NO: 772137 - protein, 17 aa, Mycobacterium
LVKAGKVSKDWNTDATK

SEQ ID NO: 772138 - protein, 18 aa, Mycobacterium
LVKGGVVFNGYWKNEDET

SEQ ID NO: 772139 - protein, 18 aa, Mycobacterium
LVKICRLIMLYHLDRAWA

SEQ ID NO: 772140 - protein, 18 aa, Mycobacterium
LVKPEIMGGTGFLGAHAD

SEQ ID NO: 772141 - protein, 17 aa, Mycobacterium
LVLADAIVRACEDNPDY

SEQ ID NO: 772142 - protein, 17 aa, Mycobacterium
LVLCGAYARGRAVRALS

SEQ ID NO: 772143 - protein, 17 aa, Mycobacterium
LVLELNSIYGLRDPGAY

SEQ ID NO: 772144 - protein, 19 aa, Mycobacterium
LVLGVGPSHHWIIDDMLGL

SEQ ID NO: 772145 - protein, 17 aa, Mycobacterium
LVLGVGPSHHWIVDDML

SEQ ID NO: 772146 - protein, 25 aa, Mycobacterium
LVLHDWGGALGFDWANRHRDRVAGI

SEQ ID NO: 772147 - protein, 17 aa, Mycobacterium
LVLLLVVHHICWDDDSW

SEQ ID NO: 772148 - protein, 19 aa, Mycobacterium
LVLPRRLQIEFSQVIQKIS

SEQ ID NO: 772149 - protein, 22 aa, Mycobacterium
LVLPRRLQIEFSQVIQQITDGE

SEQ ID NO: 772150 - protein, 19 aa, Mycobacterium
LVLRLLYRHGLLRDDPEQD

SEQ ID NO: 772151 - protein, 17 aa, Mycobacterium
LVLTEGGSPVWASDTSG

SEQ ID NO: 772152 - protein, 19 aa, Mycobacterium
LVLTHGWPGSVLEFLEVLG

SEQ ID NO: 772153 - protein, 20 aa, Mycobacterium
LVLYWWPRADLSGVENAILA

SEQ ID NO: 772154 - protein, 19 aa, Mycobacterium
LVMALRWVRDNVAAFGGDP

SEQ ID NO: 772155 - protein, 20 aa, Mycobacterium
LVMLGLPFLFFIHADYGCAG

SEQ ID NO: 772156 - protein, 20 aa, Mycobacterium
LVMRARLTWQQVVLLRAYAK

SEQ ID NO: 772157 - protein, 18 aa, Mycobacterium
LVMSSGFYRAIQRDDVEL

SEQ ID NO: 772158 - protein, 24 aa, Mycobacterium
LVNAWSAAFARYGRTVGQVLLTAH

SEQ ID NO: 772159 - protein, 18 aa, Mycobacterium
LVNFPLSQWLKFAPPIAY

SEQ ID NO: 772160 - protein, 24 aa, Mycobacterium
LVNIPAQIWIRLTGVTGNKIIPPV

SEQ ID NO: 772161 - protein, 23 aa, Mycobacterium
LVNVHSVFSWLGGTGAYGASKAA

SEQ ID NO: 772162 - protein, 17 aa, Mycobacterium
LVPGAAIPSMFDPSSPV

SEQ ID NO: 772163 - protein, 18 aa, Mycobacterium
LVPGCGFGQHRYRLCYTH

SEQ ID NO: 772164 - protein, 20 aa, Mycobacterium
LVPGDIIWAPAIDGAFVLTT

SEQ ID NO: 772165 - protein, 19 aa, Mycobacterium
LVPHPDWHGDWSAARGYEI

SEQ ID NO: 772166 - protein, 17 aa, Mycobacterium
LVPMLAMRLTHFDNLID

SEQ ID NO: 772167 - protein, 18 aa, Mycobacterium
LVPMLSMRLAFFDHLIDI

SEQ ID NO: 772168 - protein, 18 aa, Mycobacterium
LVPPCWRRESTLARNCFG

SEQ ID NO: 772169 - protein, 17 aa, Mycobacterium
LVPRVCDMFFLRYRKEL

SEQ ID NO: 772170 - protein, 18 aa, Mycobacterium
LVQEGAYVFITGRDRTRA

SEQ ID NO: 772171 - protein, 25 aa, Mycobacterium
LVRAGLRPAGIWAYEAHRVAALRPR

SEQ ID NO: 772172 - protein, 17 aa, Mycobacterium
LVRESFADAVSWVAKNL

SEQ ID NO: 772173 - protein, 25 aa, Mycobacterium
LVRHPRLAKGFLRFNFHLLYGSSLP

SEQ ID NO: 772174 - protein, 20 aa, Mycobacterium
LVRKALELMPNVGFVNAYGL

SEQ ID NO: 772175 - protein, 20 aa, Mycobacterium
LVRLRPAPSLGLPAPLSELA

SEQ ID NO: 772176 - protein, 18 aa, Mycobacterium
LVRRALDLLPQVGFVNAY

SEQ ID NO: 772177 - protein, 18 aa, Mycobacterium
LVRRALELLPDVGFVNAY

SEQ ID NO: 772178 - protein, 19 aa, Mycobacterium
LVRRALELLPDVGFVNAYG

SEQ ID NO: 772179 - protein, 24 aa, Mycobacterium
LVRRGCPFSGLLYAGLAITAKGPA

SEQ ID NO: 772180 - protein, 18 aa, Mycobacterium
LVRWPRQVLAEFGLYLPD

SEQ ID NO: 772181 - protein, 17 aa, Mycobacterium
LVRYGLDMCDVWCRQGR

SEQ ID NO: 772182 - protein, 17 aa, Mycobacterium
LVSDLSVAGWAQILEQG

SEQ ID NO: 772183 - protein, 25 aa, Mycobacterium
LVSDWQVGSTFAWRDGDLSITSPEQ

SEQ ID NO: 772184 - protein, 24 aa, Mycobacterium
LVSFEVFIRPALRTAMGLPDPERP

SEQ ID NO: 772185 - protein, 19 aa, Mycobacterium
LVTALAIAILRGFPVVVLV

SEQ ID NO: 772186 - protein, 17 aa, Mycobacterium
LVTCIDIAPYTSGDAAL

SEQ ID NO: 772187 - protein, 23 aa, Mycobacterium
LVTGEILWAPAIDGAFVLTCRGG

SEQ ID NO: 772188 - protein, 17 aa, Mycobacterium
LVTPLPFNIRSTVRDTD

SEQ ID NO: 772189 - protein, 20 aa, Mycobacterium
LVTPSKLWPLTGLDSLSLDK

SEQ ID NO: 772190 - protein, 17 aa, Mycobacterium
LVTVLGWESCDHTGPVH

SEQ ID NO: 772191 - protein, 24 aa, Mycobacterium
LVVFKELRILGALGVDATAYRAAL

SEQ ID NO: 772192 - protein, 19 aa, Mycobacterium
LVVIRLARHLRFRRADSPV

SEQ ID NO: 772193 - protein, 22 aa, Mycobacterium
LVVKCAPGLDFADLREQTGFDG

SEQ ID NO: 772194 - protein, 19 aa, Mycobacterium
LVVLWRRATGFGRGGAPAV

SEQ ID NO: 772195 - protein, 17 aa, Mycobacterium
LVVRLDFHLDRLVMAVY

SEQ ID NO: 772196 - protein, 18 aa, Mycobacterium
LVVSLAKRYTGRGMAFLD

SEQ ID NO: 772197 - protein, 17 aa, Mycobacterium
LVWSWYGSWTLKGWENR

SEQ ID NO: 772198 - protein, 21 aa, Mycobacterium
LVYKKDCGRFGRLRNFRNQAF

SEQ ID NO: 772199 - protein, 17 aa, Mycobacterium
LWALTFLRRRGVSASAV

SEQ ID NO: 772200 - protein, 19 aa, Mycobacterium
LWALWRFGTDPAFTRISME

SEQ ID NO: 772201 - protein, 19 aa, Mycobacterium
LWALWRFGTDPGFTRISME

SEQ ID NO: 772202 - protein, 18 aa, Mycobacterium
LWAPIARYWPDTSTTLLS

SEQ ID NO: 772203 - protein, 23 aa, Mycobacterium
LWAQEIYADLGLRFDGEQAQAIG

SEQ ID NO: 772204 - protein, 18 aa, Mycobacterium
LWARSGYLQPHWPAPYGR

SEQ ID NO: 772205 - protein, 18 aa, Mycobacterium
LWDAAEWSVQAQLDYLQR

SEQ ID NO: 772206 - protein, 17 aa, Mycobacterium
LWECGVIMLGCGTDSVR

SEQ ID NO: 772207 - protein, 22 aa, Mycobacterium
LWEHWDRCAFHWFPGNHLLHVS

SEQ ID NO: 772208 - protein, 22 aa, Mycobacterium
LWEHWDRCALHWFPGNHILHVN

SEQ ID NO: 772209 - protein, 22 aa, Mycobacterium
LWEPARAAFEWSRTTQRADGTW

SEQ ID NO: 772210 - protein, 18 aa, Mycobacterium
LWGAAEWSVQAQLDYLRT

SEQ ID NO: 772211 - protein, 18 aa, Mycobacterium
LWGGGGIGGTGGFGALNG

SEQ ID NO: 772212 - protein, 25 aa, Mycobacterium
LWHVLFRFSAMYARKVPYRYEMDLV

SEQ ID NO: 772213 - protein, 17 aa, Mycobacterium
LWINIAFDLTSDPQELR

SEQ ID NO: 772214 - protein, 22 aa, Mycobacterium
LWLDPVCPFSWNTARWLRAVAE

SEQ ID NO: 772215 - protein, 18 aa, Mycobacterium
LWLLRGGDLARPSMLSPA

SEQ ID NO: 772216 - protein, 20 aa, Mycobacterium
LWLPHYERTEVVGLRTDAPV

SEQ ID NO: 772217 - protein, 17 aa, Mycobacterium
LWMGVAFGLTSDPDELR

SEQ ID NO: 772218 - protein, 21 aa, Mycobacterium
LWPKARCALMGVGAPPLLRSD

SEQ ID NO: 772219 - protein, 18 aa, Mycobacterium
LWQLAFRLVCDFDGDLDT

SEQ ID NO: 772220 - protein, 17 aa, Mycobacterium
LWQSWGIVPDVVLGHSV

SEQ ID NO: 772221 - protein, 18 aa, Mycobacterium
LWRARRVLAVTFPAYGSS

SEQ ID NO: 772222 - protein, 18 aa, Mycobacterium
LWRARRVLAVTFPTRSEA

SEQ ID NO: 772223 - protein, 18 aa, Mycobacterium
LWRMGIRTIGQFAALSRS

SEQ ID NO: 772224 - protein, 18 aa, Mycobacterium
LWRMGIRTIGQFAALSRT

SEQ ID NO: 772225 - protein, 18 aa, Mycobacterium
LWRMGIRTLGQFAALSRT

SEQ ID NO: 772226 - protein, 22 aa, Mycobacterium
LWRWDTDWFWCSRAFGAQNPGI

SEQ ID NO: 772227 - protein, 17 aa, Mycobacterium
LWSGWLGTDLSRFDLDD

SEQ ID NO: 772228 - protein, 18 aa, Mycobacterium
LWSIESWVRQILRTRELA

SEQ ID NO: 772229 - protein, 18 aa, Mycobacterium
LWSLLSITAPGLFPNPAK

SEQ ID NO: 772230 - protein, 21 aa, Mycobacterium
LWSRLRVAITLVQGGDDLTGA

SEQ ID NO: 772231 - protein, 21 aa, Mycobacterium
LWSTRVARWLRRHTRPSASRP

SEQ ID NO: 772232 - protein, 18 aa, Mycobacterium
LWVPDDFAFVRYLAVGLA

SEQ ID NO: 772233 - protein, 20 aa, Mycobacterium
LWWAEVCQIASKLMAQMPSG

SEQ ID NO: 772234 - protein, 18 aa, Mycobacterium
LWYTWRHQLAALSAAGYR

SEQ ID NO: 772235 - protein, 18 aa, Mycobacterium
LYADWPVIAADAVAGFRM

SEQ ID NO: 772236 - protein, 21 aa, Mycobacterium
LYAPMIHPWSGTGMLEDDNGD

SEQ ID NO: 772237 - protein, 19 aa, Mycobacterium
LYARILAGAGVEWGLLGPR

SEQ ID NO: 772238 - protein, 17 aa, Mycobacterium
LYCKTGVRSAEALAALK

SEQ ID NO: 772239 - protein, 21 aa, Mycobacterium
LYCRNRIEIVIAMLGIIKAGA

SEQ ID NO: 772240 - protein, 23 aa, Mycobacterium
LYCRNRIEIVIAMLGIVKAGAIL

SEQ ID NO: 772241 - protein, 19 aa, Mycobacterium
LYERFGFKVVEEIKPTTHG

SEQ ID NO: 772242 - protein, 17 aa, Mycobacterium
LYFPGSPVLSVHGSFAE

SEQ ID NO: 772243 - protein, 17 aa, Mycobacterium
LYFPGSPVLTLRGSFAE

SEQ ID NO: 772244 - protein, 17 aa, Mycobacterium
LYGDRLCRAFDRDRSGM

SEQ ID NO: 772245 - protein, 20 aa, Mycobacterium
LYGPRWAMVRAFNAANDLDR

SEQ ID NO: 772246 - protein, 17 aa, Mycobacterium
LYGRDVLDLLALADLGA

SEQ ID NO: 772247 - protein, 21 aa, Mycobacterium
LYGRWTFQVVEEFDDNYWSPF

SEQ ID NO: 772248 - protein, 18 aa, Mycobacterium
LYGYKWPTLDGMFTPHAS

SEQ ID NO: 772249 - protein, 18 aa, Mycobacterium
LYGYRIPLVYLVQSTSAG

SEQ ID NO: 772250 - protein, 18 aa, Mycobacterium
LYHREWWDRYVVVNRRFA

SEQ ID NO: 772251 - protein, 17 aa, Mycobacterium
LYIALGISGAIQHRAGM

SEQ ID NO: 772252 - protein, 18 aa, Mycobacterium
LYIPYSWYEPMWMENIGL

SEQ ID NO: 772253 - protein, 26 aa, Mycobacterium
LYKLLRSEWLEPRWMIGIDPESEGLA

SEQ ID NO: 772254 - protein, 20 aa, Mycobacterium
LYLERAWPRHRRLSGTVDAA

SEQ ID NO: 772255 - protein, 19 aa, Mycobacterium
LYLERAWPRHRRLSSADDA

SEQ ID NO: 772256 - protein, 17 aa, Mycobacterium
LYLFFSLLFSAGAETTR

SEQ ID NO: 772257 - protein, 21 aa, Mycobacterium
LYLKRAHVFRHLFGEPTDVLA

SEQ ID NO: 772258 - protein, 25 aa, Mycobacterium
LYLRIAPELFLKRCVVGGFDRVFEL

SEQ ID NO: 772259 - protein, 17 aa, Mycobacterium
LYLWEFPKPTISAIHGY

SEQ ID NO: 772260 - protein, 22 aa, Mycobacterium
LYPDSLHAMGWDIGTKGFEIVL

SEQ ID NO: 772261 - protein, 19 aa, Mycobacterium
LYPECPRAYGVAVMSDVGR

SEQ ID NO: 772262 - protein, 23 aa, Mycobacterium
LYPECPRVYGVAVMGDLSRRRWW

SEQ ID NO: 772263 - protein, 20 aa, Mycobacterium
LYPLFNLWGPAYHDKYSNVT

SEQ ID NO: 772264 - protein, 20 aa, Mycobacterium
LYPRVEVEVGFILAADLPGA

SEQ ID NO: 772265 - protein, 21 aa, Mycobacterium
LYPRVEVEVGFILADDLPGAG

SEQ ID NO: 772266 - protein, 21 aa, Mycobacterium
LYPRVEVEVGFILNADLPGAG

SEQ ID NO: 772267 - protein, 23 aa, Mycobacterium
LYPSLSSDQAWAMLGVTPMIGVN

SEQ ID NO: 772268 - protein, 17 aa, Mycobacterium
LYREGFFGLSWPREYGG

SEQ ID NO: 772269 - protein, 19 aa, Mycobacterium
LYREGITSMHFVPSLLGLF

SEQ ID NO: 772270 - protein, 19 aa, Mycobacterium
LYREYALRPPKGVLLYGPP

SEQ ID NO: 772271 - protein, 19 aa, Mycobacterium
LYREYSLRPPKGVLLYGPP

SEQ ID NO: 772272 - protein, 18 aa, Mycobacterium
LYRHFPDKVSLLGAAIVR

SEQ ID NO: 772273 - protein, 17 aa, Mycobacterium
LYRLCGDRNPLHSDPTF

SEQ ID NO: 772274 - protein, 19 aa, Mycobacterium
LYRTLRAGEFIKIVQSGCN

SEQ ID NO: 772275 - protein, 17 aa, Mycobacterium
LYSCFPVPVFNFCDGTG

SEQ ID NO: 772276 - protein, 18 aa, Mycobacterium
LYSCFPVPVFNFCDGTQL

SEQ ID NO: 772277 - protein, 19 aa, Mycobacterium
LYSRFWHKVLYDLGYVSSR

SEQ ID NO: 772278 - protein, 18 aa, Mycobacterium
LYSRTAAFATEFADALSI

SEQ ID NO: 772279 - protein, 21 aa, Mycobacterium
LYTDFRLPFGIDAWETALADA

SEQ ID NO: 772280 - protein, 19 aa, Mycobacterium
LYVERAWPRHRRLSLAIED

SEQ ID NO: 772281 - protein, 22 aa, Mycobacterium
LYVRPAAWGMWTFYELSEEDKR

SEQ ID NO: 772282 - protein, 17 aa, Mycobacterium
LYVSPALVRTDLLHRTD

SEQ ID NO: 772283 - protein, 20 aa, Mycobacterium
LYYLEMPPALFAPIVENLAK

SEQ ID NO: 772284 - protein, 23 aa, Mycobacterium
LYYLEMPPSLFAPIVENLAKADL

SEQ ID NO: 772285 - protein, 19 aa, Mycobacterium
MAAAAAPYVVWLRATAELC

SEQ ID NO: 772286 - protein, 19 aa, Mycobacterium
MAAANVWEGLQLGIRRFDA

SEQ ID NO: 772287 - protein, 18 aa, Mycobacterium
MAAGALQRFGADTAVAIT

SEQ ID NO: 772288 - protein, 19 aa, Mycobacterium
MAAGALRRFGADTAVAITG

SEQ ID NO: 772289 - protein, 18 aa, Mycobacterium
MAAKNGWAAMPFDERAGV

SEQ ID NO: 772290 - protein, 20 aa, Mycobacterium
MAAKRVWAAMPFDERAAVFL

SEQ ID NO: 772291 - protein, 18 aa, Mycobacterium
MAAKVAPYVSWLYTTATQ

SEQ ID NO: 772292 - protein, 17 aa, Mycobacterium
MAALRLNIPAVFVSGGP

SEQ ID NO: 772293 - protein, 20 aa, Mycobacterium
MAALRPGGRVAVMAYQSLED

SEQ ID NO: 772294 - protein, 17 aa, Mycobacterium
MAAMLLDLCDVEHKVAA

SEQ ID NO: 772295 - protein, 17 aa, Mycobacterium
MAAPAWVAVAIPEPTTP

SEQ ID NO: 772296 - protein, 17 aa, Mycobacterium
MAARIAHHLGHRVIGVD

SEQ ID NO: 772297 - protein, 17 aa, Mycobacterium
MACAIGIAPCMHAGQGC

SEQ ID NO: 772298 - protein, 21 aa, Mycobacterium
MADCHPILFLRMADRLKAGAR

SEQ ID NO: 772299 - protein, 20 aa, Mycobacterium
MADCHPILFLRMADRLSSGA

SEQ ID NO: 772300 - protein, 19 aa, Mycobacterium
MADECLRVIGVEVSSQGVG

SEQ ID NO: 772301 - protein, 18 aa, Mycobacterium
MADIIAALRQLMAGTLWK

SEQ ID NO: 772302 - protein, 18 aa, Mycobacterium
MADRVAVMKRVWAGEKLT

SEQ ID NO: 772303 - protein, 21 aa, Mycobacterium
MAEELWLRLGHTTSLAHGPFP

SEQ ID NO: 772304 - protein, 24 aa, Mycobacterium
MAEGSFKMAFAITEPDAGSNSHNI

SEQ ID NO: 772305 - protein, 24 aa, Mycobacterium
MAERRLGGLSGRTAVLVGAGAMGA

SEQ ID NO: 772306 - protein, 23 aa, Mycobacterium
MAEVPVSVPMKWLPDSLALAGVF

SEQ ID NO: 772307 - protein, 17 aa, Mycobacterium
MAFDMRFAALGTTVLGH

SEQ ID NO: 772308 - protein, 20 aa, Mycobacterium
MAGAITPYVAWALTTAAQAE

SEQ ID NO: 772309 - protein, 17 aa, Mycobacterium
MAGDFGGVWYWNRFPGI

SEQ ID NO: 772310 - protein, 17 aa, Mycobacterium
MAGTGFLGAHAEEVYRL

SEQ ID NO: 772311 - protein, 17 aa, Mycobacterium
MAHCLYAGLVTDSGSFR

SEQ ID NO: 772312 - protein, 17 aa, Mycobacterium
MAHFFYIHFGLPTYFKN

SEQ ID NO: 772313 - protein, 23 aa, Mycobacterium
MAHPCPMCLGSLYYCSPKEVIFL

SEQ ID NO: 772314 - protein, 20 aa, Mycobacterium
MAIFYLRLPATFGIGTYGVS

SEQ ID NO: 772315 - protein, 18 aa, Mycobacterium
MAILALHVDVLWKTVDDF

SEQ ID NO: 772316 - protein, 18 aa, Mycobacterium
MAINYGFNKARFITPVAV

SEQ ID NO: 772317 - protein, 18 aa, Mycobacterium
MAIPELPEELFIESLTQL

SEQ ID NO: 772318 - protein, 23 aa, Mycobacterium
MAKKCIAEGWILSLSGTVSFKNA

SEQ ID NO: 772319 - protein, 20 aa, Mycobacterium
MALCRPLWRCYGKILECDLR

SEQ ID NO: 772320 - protein, 18 aa, Mycobacterium
MALELTWEALEHARIPAS

SEQ ID NO: 772321 - protein, 18 aa, Mycobacterium
MALHYEGWVVDIAHNGRE

SEQ ID NO: 772322 - protein, 19 aa, Mycobacterium
MALSQLWLAHIDWTPDLAP

SEQ ID NO: 772323 - protein, 19 aa, Mycobacterium
MAMLGRPLIGNGADGAPGQ

SEQ ID NO: 772324 - protein, 24 aa, Mycobacterium
MAMPMLRLGGAVARATFGRASMAR

SEQ ID NO: 772325 - protein, 18 aa, Mycobacterium
MANGVFWRADSMGQLSAH

SEQ ID NO: 772326 - protein, 17 aa, Mycobacterium
MAPICQMFHTLPIPWVE

SEQ ID NO: 772327 - protein, 17 aa, Mycobacterium
MAQAAGVPVVFLTAYYG

SEQ ID NO: 772328 - protein, 17 aa, Mycobacterium
MAQAVAPYVAWMRTTAA

SEQ ID NO: 772329 - protein, 21 aa, Mycobacterium
MARAAAPYIAWLRTMAEQAEQ

SEQ ID NO: 772330 - protein, 21 aa, Mycobacterium
MARGIEIGHIFQLGQKYTDAF

SEQ ID NO: 772331 - protein, 22 aa, Mycobacterium
MARGIEIGHIFQLGRKYTDAFT

SEQ ID NO: 772332 - protein, 17 aa, Mycobacterium
MARICALNALAAVDSLV

SEQ ID NO: 772333 - protein, 17 aa, Mycobacterium
MARRFLTFNGWLLQRGE

SEQ ID NO: 772334 - protein, 18 aa, Mycobacterium
MASALARRHGIAVDIVDG

SEQ ID NO: 772335 - protein, 19 aa, Mycobacterium
MASAYAPYMAWMAGAGARA

SEQ ID NO: 772336 - protein, 18 aa, Mycobacterium
MASGDMRATMALTEPGGG

SEQ ID NO: 772337 - protein, 18 aa, Mycobacterium
MASGETKVVFAITEPDAG

SEQ ID NO: 772338 - protein, 19 aa, Mycobacterium
MASGRISYALGLRGPAVSL

SEQ ID NO: 772339 - protein, 19 aa, Mycobacterium
MASGRVSYALGLRGPAMTV

SEQ ID NO: 772340 - protein, 18 aa, Mycobacterium
MASMAAFTWLSTRGGGGV

SEQ ID NO: 772341 - protein, 22 aa, Mycobacterium
MASQRTIICWAMGLTQHSHAVA

SEQ ID NO: 772342 - protein, 18 aa, Mycobacterium
MATGECRGAFSMSEPELG

SEQ ID NO: 772343 - protein, 18 aa, Mycobacterium
MATGEVIGCFGLTEPDFG

SEQ ID NO: 772344 - protein, 18 aa, Mycobacterium
MAVICLIGAMLIEDGHSD

SEQ ID NO: 772345 - protein, 18 aa, Mycobacterium
MAVICLIGAMLVEDGHSD

SEQ ID NO: 772346 - protein, 24 aa, Mycobacterium
MAVLGRPLIGDGVDAAAGSGHNGG

SEQ ID NO: 772347 - protein, 17 aa, Mycobacterium
MAWRILKFRPREDSGAT

SEQ ID NO: 772348 - protein, 17 aa, Mycobacterium
MAYEGRIDWAFAELLAL

SEQ ID NO: 772349 - protein, 17 aa, Mycobacterium
MCFPTFTGFSARHLNMH

SEQ ID NO: 772350 - protein, 17 aa, Mycobacterium
MCFPTFTGFSARHLNMT

SEQ ID NO: 772351 - protein, 17 aa, Mycobacterium
MDAWRQGEEFVVEFDLP

SEQ ID NO: 772352 - protein, 23 aa, Mycobacterium
MDEKRWDAVIAVNLLAPQRLTEG

SEQ ID NO: 772353 - protein, 20 aa, Mycobacterium
MDFRPGLPIRLMPRQQAQRS

SEQ ID NO: 772354 - protein, 17 aa, Mycobacterium
MDGAWVIGRVRVPTYKI

SEQ ID NO: 772355 - protein, 17 aa, Mycobacterium
MDGIGSAITAANAAAAI

SEQ ID NO: 772356 - protein, 18 aa, Mycobacterium
MDGWYEWKGTKGAKTPYY

SEQ ID NO: 772357 - protein, 19 aa, Mycobacterium
MDGWYEWRANPDVLSGAGS

SEQ ID NO: 772358 - protein, 23 aa, Mycobacterium
MDIAKGGLLGGVYAYLDNNNQLV

SEQ ID NO: 772359 - protein, 19 aa, Mycobacterium
MDIESVHRWDAYTEAKEAM

SEQ ID NO: 772360 - protein, 17 aa, Mycobacterium
MDLELTGPMAARLWVRL

SEQ ID NO: 772361 - protein, 17 aa, Mycobacterium
MDLTFSLADRWTEAGRH

SEQ ID NO: 772362 - protein, 17 aa, Mycobacterium
MDLTFSLAERWTEGNEP

SEQ ID NO: 772363 - protein, 18 aa, Mycobacterium
MDNLKFLIENGIHAVVGT

SEQ ID NO: 772364 - protein, 23 aa, Mycobacterium
MDNLKFLIGKGIHAVVGTTGFTD

SEQ ID NO: 772365 - protein, 22 aa, Mycobacterium
MDNLRSAFTWSMENSDLEQALR

SEQ ID NO: 772366 - protein, 24 aa, Mycobacterium
MDPPDWLDFIFVTAVPLILSSVSS

SEQ ID NO: 772367 - protein, 25 aa, Mycobacterium
MDPRQRLALELAWELFEDARIVAES

SEQ ID NO: 772368 - protein, 27 aa, Mycobacterium
MDPRQRLALELAWELLEDAFIVPETVR

SEQ ID NO: 772369 - protein, 26 aa, Mycobacterium
MDPRQRLALELTWELFENAFIVPDTL

SEQ ID NO: 772370 - protein, 19 aa, Mycobacterium
MDRFVDWLVDAGCAIHRID

SEQ ID NO: 772371 - protein, 21 aa, Mycobacterium
MDSHPFVWLPILSRVLGTAEL

SEQ ID NO: 772372 - protein, 21 aa, Mycobacterium
MDSRGRFAMGMARPPERFTDG

SEQ ID NO: 772373 - protein, 17 aa, Mycobacterium
MDTEVLSGLGLIANPVS

SEQ ID NO: 772374 - protein, 24 aa, Mycobacterium
MDTHPFEWLPMLSRVLGSAQLVPG

SEQ ID NO: 772375 - protein, 24 aa, Mycobacterium
MDTHPFMWLPMLSRVLGSAQLLPE

SEQ ID NO: 772376 - protein, 18 aa, Mycobacterium
MEAMWTRFQPAIVAAKDL

SEQ ID NO: 772377 - protein, 19 aa, Mycobacterium
MEFCAAESCGKCTPCRVGS

SEQ ID NO: 772378 - protein, 17 aa, Mycobacterium
MEGRAAFEVKIHRIAAD

SEQ ID NO: 772379 - protein, 19 aa, Mycobacterium
MEGRLGFEVKVHRIAADGA

SEQ ID NO: 772380 - protein, 21 aa, Mycobacterium
MEKRTRFGLAAAQQALEDGGV

SEQ ID NO: 772381 - protein, 18 aa, Mycobacterium
MELFCAGTHPFARWSAQQ

SEQ ID NO: 772382 - protein, 20 aa, Mycobacterium
MELGCDAVLLASAVTRAADP

SEQ ID NO: 772383 - protein, 17 aa, Mycobacterium
MELRIAPSEGRRSGERE

SEQ ID NO: 772384 - protein, 17 aa, Mycobacterium
MEMKVLLWAVQRLIAGL

SEQ ID NO: 772385 - protein, 17 aa, Mycobacterium
MEMKVLLWAVQRLIGGL

SEQ ID NO: 772386 - protein, 17 aa, Mycobacterium
MEMKVLLWAVQRLISGL

SEQ ID NO: 772387 - protein, 20 aa, Mycobacterium
MEPDLKWERFITAVRLLAER

SEQ ID NO: 772388 - protein, 21 aa, Mycobacterium
MEPDLKWERFITAVRLLAERL

SEQ ID NO: 772389 - protein, 22 aa, Mycobacterium
MERFSINAAEAFTVIRTLSQDF

SEQ ID NO: 772390 - protein, 22 aa, Mycobacterium
MERYRIDAGQAFEVLKKLSQGA

SEQ ID NO: 772391 - protein, 27 aa, Mycobacterium
MESLYEYGSRAGLWRVLRVFERRGLPL

SEQ ID NO: 772392 - protein, 17 aa, Mycobacterium
MESRFSAAWALLSAGDE

SEQ ID NO: 772393 - protein, 17 aa, Mycobacterium
METGWWATAPTLIVDGG

SEQ ID NO: 772394 - protein, 18 aa, Mycobacterium
MEVCRKWDVLATVIGEVT

SEQ ID NO: 772395 - protein, 17 aa, Mycobacterium
MEVPAFALALMRRSLSG

SEQ ID NO: 772396 - protein, 20 aa, Mycobacterium
MFALGLVSWMYGRPIQTSET

SEQ ID NO: 772397 - protein, 17 aa, Mycobacterium
MFDGRFLGFADFLVRDG

SEQ ID NO: 772398 - protein, 18 aa, Mycobacterium
MFDYYPLRVRTEFPDGSC

SEQ ID NO: 772399 - protein, 18 aa, Mycobacterium
MFELGQWRGHGGSWRGYE

SEQ ID NO: 772400 - protein, 22 aa, Mycobacterium
MFGSDFFSAWGKLGAVRTPTIA

SEQ ID NO: 772401 - protein, 20 aa, Mycobacterium
MFHCNGWCFTWAVGAAGGTH

SEQ ID NO: 772402 - protein, 24 aa, Mycobacterium
MFKIKPERTADCVVAGYRVHKSGD

SEQ ID NO: 772403 - protein, 24 aa, Mycobacterium
MFLDELVLWLAFRVRDAEFFGREA

SEQ ID NO: 772404 - protein, 19 aa, Mycobacterium
MFLELSWEALERAGIEPGG

SEQ ID NO: 772405 - protein, 19 aa, Mycobacterium
MFPRAEWLRALRRVLEATP

SEQ ID NO: 772406 - protein, 18 aa, Mycobacterium
MFRQWSPRITLFLNGAVD

SEQ ID NO: 772407 - protein, 17 aa, Mycobacterium
MFTKLGGLMAERVTDLR

SEQ ID NO: 772408 - protein, 17 aa, Mycobacterium
MFTPALANWGYDDRGTS

SEQ ID NO: 772409 - protein, 17 aa, Mycobacterium
MFYNLPVEGLDIPKSAL

SEQ ID NO: 772410 - protein, 17 aa, Mycobacterium
MGAGWSWSRKVGSDDDH

SEQ ID NO: 772411 - protein, 18 aa, Mycobacterium
MGAMKLILLMGLRADVDR

SEQ ID NO: 772412 - protein, 18 aa, Mycobacterium
MGAQGAWSGSQWLMVEEA

SEQ ID NO: 772413 - protein, 18 aa, Mycobacterium
MGAVLAFEVARRFESLAG

SEQ ID NO: 772414 - protein, 23 aa, Mycobacterium
MGAWAKRTGAIFIRRQTKDIPVY

SEQ ID NO: 772415 - protein, 20 aa, Mycobacterium
MGDDAWLWKLDCEFRLFNYV

SEQ ID NO: 772416 - protein, 17 aa, Mycobacterium
MGEGLAHLHLCDGSGAS

SEQ ID NO: 772417 - protein, 25 aa, Mycobacterium
MGFGLGVVQWGSWLGWIGNLGGYKC

SEQ ID NO: 772418 - protein, 21 aa, Mycobacterium
MGGAVPRYGFRPMVVPRPPAA

SEQ ID NO: 772419 - protein, 19 aa, Mycobacterium
MGGDFGGVWYWNRYPGIQC

SEQ ID NO: 772420 - protein, 17 aa, Mycobacterium
MGGFRPVVEMQFDAFAY

SEQ ID NO: 772421 - protein, 17 aa, Mycobacterium
MGGITIAAWSARYRHMV

SEQ ID NO: 772422 - protein, 17 aa, Mycobacterium
MGGITIAAWSERYRHKV

SEQ ID NO: 772423 - protein, 17 aa, Mycobacterium
MGGITISAWSERYRHKV

SEQ ID NO: 772424 - protein, 19 aa, Mycobacterium
MGGPVELTAGIGLSGGFGT

SEQ ID NO: 772425 - protein, 17 aa, Mycobacterium
MGGRASLIVATRVPDRV

SEQ ID NO: 772426 - protein, 20 aa, Mycobacterium
MGGVPPSVWGGTAAARFKDV

SEQ ID NO: 772427 - protein, 17 aa, Mycobacterium
MGHRLTIVMDAWTISVD

SEQ ID NO: 772428 - protein, 19 aa, Mycobacterium
MGIDHVDIFYSHRIDPVTP

SEQ ID NO: 772429 - protein, 22 aa, Mycobacterium
MGKDGWLTLNWPKEYGGQDRSP

SEQ ID NO: 772430 - protein, 20 aa, Mycobacterium
MGLAELLAGLGIPYDSERGV

SEQ ID NO: 772431 - protein, 22 aa, Mycobacterium
MGLARLWQSWAIEPDVVLGHSV

SEQ ID NO: 772432 - protein, 20 aa, Mycobacterium
MGLARLWQSWGIQPDVVLGH

SEQ ID NO: 772433 - protein, 20 aa, Mycobacterium
MGLARLWQSWGIVPDVVLGH

SEQ ID NO: 772434 - protein, 17 aa, Mycobacterium
MGLPTNFGLSGYSGGLT

SEQ ID NO: 772435 - protein, 20 aa, Mycobacterium
MGMPCGKYLVVMVGLWLPLL

SEQ ID NO: 772436 - protein, 18 aa, Mycobacterium
MGQLSAHYAITVNRIPAF

SEQ ID NO: 772437 - protein, 17 aa, Mycobacterium
MGRPEFPTPVGNYTVLS

SEQ ID NO: 772438 - protein, 17 aa, Mycobacterium
MGRPRFGSWLRNSTRGA

SEQ ID NO: 772439 - protein, 17 aa, Mycobacterium
MGSCALDLCAVAAGRLD

SEQ ID NO: 772440 - protein, 17 aa, Mycobacterium
MGSEAFRADVTMNKGVD

SEQ ID NO: 772441 - protein, 21 aa, Mycobacterium
MGTGIGLCLLRQGAKLRVIAN

SEQ ID NO: 772442 - protein, 19 aa, Mycobacterium
MGTQFCGSALWKHAPSRSR

SEQ ID NO: 772443 - protein, 25 aa, Mycobacterium
MGTVAYRFTWHLPKNRTWSYDGQLK

SEQ ID NO: 772444 - protein, 18 aa, Mycobacterium
MGWIPLWARLAAVAPNLL

SEQ ID NO: 772445 - protein, 17 aa, Mycobacterium
MGWPEWKVGVQYDGIQH

SEQ ID NO: 772446 - protein, 24 aa, Mycobacterium
MGYSFGAGIGMTFHRAARPGPHGQ

SEQ ID NO: 772447 - protein, 23 aa, Mycobacterium
MHFYFPRFCALCMAENATHNLHN

SEQ ID NO: 772448 - protein, 17 aa, Mycobacterium
MHIGWVFTRTERNNAHT

SEQ ID NO: 772449 - protein, 18 aa, Mycobacterium
MHLGPFRPAWGFGGYRTP

SEQ ID NO: 772450 - protein, 24 aa, Mycobacterium
MHPGNWAGAYACWGTENREAAVRF

SEQ ID NO: 772451 - protein, 17 aa, Mycobacterium
MHSRSGLIDEVRASAVD

SEQ ID NO: 772452 - protein, 17 aa, Mycobacterium
MHSRSGLIDEVRASTVD

SEQ ID NO: 772453 - protein, 21 aa, Mycobacterium
MHYPSWRLSYRGIMTPETLDL

SEQ ID NO: 772454 - protein, 18 aa, Mycobacterium
MIANRISYAFGLQGPSMT

SEQ ID NO: 772455 - protein, 20 aa, Mycobacterium
MIANRVSYAFALHGPSMTVD

SEQ ID NO: 772456 - protein, 20 aa, Mycobacterium
MIANRVSYGFALHGPSMTVD

SEQ ID NO: 772457 - protein, 25 aa, Mycobacterium
MIDVIRFWLGLGIDGFRLDAVPYLF

SEQ ID NO: 772458 - protein, 24 aa, Mycobacterium
MIDVMRFWLGLGIDGFRLDAVPYL

SEQ ID NO: 772459 - protein, 18 aa, Mycobacterium
MIEWRWFELEAFIYGDAL

SEQ ID NO: 772460 - protein, 19 aa, Mycobacterium
MIFYRDPMRLMTHLGEKHG

SEQ ID NO: 772461 - protein, 19 aa, Mycobacterium
MIGEIKPGIKGVGVVVPGT

SEQ ID NO: 772462 - protein, 21 aa, Mycobacterium
MIGGSAFRKGTIFERLYRDSA

SEQ ID NO: 772463 - protein, 23 aa, Mycobacterium
MILRRPRAGLSYEALLATVEQRL

SEQ ID NO: 772464 - protein, 20 aa, Mycobacterium
MIPLFYDWLFGMMVSTAGTP

SEQ ID NO: 772465 - protein, 22 aa, Mycobacterium
MIPLFYDWLFGMVVSTADIRPT

SEQ ID NO: 772466 - protein, 21 aa, Mycobacterium
MIPRRIAMELVLTGAPISAAR

SEQ ID NO: 772467 - protein, 17 aa, Mycobacterium
MIRACPVTWPWNLLGWP

SEQ ID NO: 772468 - protein, 22 aa, Mycobacterium
MIRFCAPAQWFARTVRKPFTLH

SEQ ID NO: 772469 - protein, 22 aa, Mycobacterium
MIRYCAPAQWFARTARKPFDIH

SEQ ID NO: 772470 - protein, 22 aa, Mycobacterium
MIRYCAPAQWFARTARKPFTIG

SEQ ID NO: 772471 - protein, 22 aa, Mycobacterium
MIRYCAPAQWFARTARKPFTIH

SEQ ID NO: 772472 - protein, 23 aa, Mycobacterium
MIRYCAPAQWFARTLRRPFTLHG

SEQ ID NO: 772473 - protein, 17 aa, Mycobacterium
MKAYPLWLARGCMPGKL

SEQ ID NO: 772474 - protein, 18 aa, Mycobacterium
MKAYRAALVASWNTFLEN

SEQ ID NO: 772475 - protein, 17 aa, Mycobacterium
MKFEGGVHRVQRVPVTE

SEQ ID NO: 772476 - protein, 21 aa, Mycobacterium
MKHFGGLVSFELADAAAVNAL

SEQ ID NO: 772477 - protein, 22 aa, Mycobacterium
MKHHFAELLGFRYGRSDQQQAV

SEQ ID NO: 772478 - protein, 19 aa, Mycobacterium
MKIPTEYGGLGMSQVAYNR

SEQ ID NO: 772479 - protein, 21 aa, Mycobacterium
MKLARLNGCRRFISMTGGYHG

SEQ ID NO: 772480 - protein, 20 aa, Mycobacterium
MKLDFLITVDWDYYKKFMSV

SEQ ID NO: 772481 - protein, 20 aa, Mycobacterium
MKLDFLLTVDWDYYKKFMSV

SEQ ID NO: 772482 - protein, 20 aa, Mycobacterium
MKLDLLLTVPLDYYKKFMSV

SEQ ID NO: 772483 - protein, 19 aa, Mycobacterium
MKLFSERAVDYFRTASADD

SEQ ID NO: 772484 - protein, 17 aa, Mycobacterium
MKLHLACYQAFDDIGSV

SEQ ID NO: 772485 - protein, 19 aa, Mycobacterium
MKLTEVWQGAGSLAASGEA

SEQ ID NO: 772486 - protein, 18 aa, Mycobacterium
MKNPEFAAAILPTLRGLK

SEQ ID NO: 772487 - protein, 22 aa, Mycobacterium
MKPEVCWQLPIRRTQAWVDRPD

SEQ ID NO: 772488 - protein, 23 aa, Mycobacterium
MKRMGIGGIYLGGWATSAKGSIS

SEQ ID NO: 772489 - protein, 19 aa, Mycobacterium
MKSGWTWRTPLLGRFGSGY

SEQ ID NO: 772490 - protein, 19 aa, Mycobacterium
MKTLFAALRKGYKATDANN

SEQ ID NO: 772491 - protein, 21 aa, Mycobacterium
MKWRWRAKIGKDWKGRTPNLV

SEQ ID NO: 772492 - protein, 24 aa, Mycobacterium
MKWRWRAKVGKGWEGRRPNLVMGS

SEQ ID NO: 772493 - protein, 18 aa, Mycobacterium
MLAAAAAEVSHLGSSLCA

SEQ ID NO: 772494 - protein, 19 aa, Mycobacterium
MLAAFADQAAQAWQLASTQ

SEQ ID NO: 772495 - protein, 23 aa, Mycobacterium
MLACARLGIMHSVVFAGFTAKAL

SEQ ID NO: 772496 - protein, 17 aa, Mycobacterium
MLAGVVPLVLRLSPELT

SEQ ID NO: 772497 - protein, 18 aa, Mycobacterium
MLAMGFAEDVERILSDTP

SEQ ID NO: 772498 - protein, 18 aa, Mycobacterium
MLANWLTYCGWARNDTLV

SEQ ID NO: 772499 - protein, 21 aa, Mycobacterium
MLDLKILLSHVFDGERLTEDH

SEQ ID NO: 772500 - protein, 19 aa, Mycobacterium
MLEAAVAWDSLAAELGSAA

SEQ ID NO: 772501 - protein, 18 aa, Mycobacterium
MLERFRAMEPWLVGGRVH

SEQ ID NO: 772502 - protein, 24 aa, Mycobacterium
MLETWKVAPALAWGNTVVLKPAED

SEQ ID NO: 772503 - protein, 17 aa, Mycobacterium
MLEVSWEALEHAGIDPL

SEQ ID NO: 772504 - protein, 20 aa, Mycobacterium
MLHRGCRAIRELGAIDLVRS

SEQ ID NO: 772505 - protein, 17 aa, Mycobacterium
MLIAIAGRVARAVVAES

SEQ ID NO: 772506 - protein, 17 aa, Mycobacterium
MLISAPIFHAWGLGCLQ

SEQ ID NO: 772507 - protein, 25 aa, Mycobacterium
MLLDWRRLGIDGARLRPAVNATDLA

SEQ ID NO: 772508 - protein, 19 aa, Mycobacterium
MLLELSWEALERAGIDPSG

SEQ ID NO: 772509 - protein, 18 aa, Mycobacterium
MLLPRSRYDEGVAILKSI

SEQ ID NO: 772510 - protein, 18 aa, Mycobacterium
MLLPRSRYDEGVEILKSI

SEQ ID NO: 772511 - protein, 21 aa, Mycobacterium
MLLQRRCVWMVEQGDIPVAEG

SEQ ID NO: 772512 - protein, 19 aa, Mycobacterium
MLLRGMGIPAHYVSGYLHP

SEQ ID NO: 772513 - protein, 20 aa, Mycobacterium
MLLRRNGFRAAHPVVEKDAG

SEQ ID NO: 772514 - protein, 20 aa, Mycobacterium
MLMAAARLDLASVFFYNGSI

SEQ ID NO: 772515 - protein, 18 aa, Mycobacterium
MLNRVRWTLVHYKPPQAL

SEQ ID NO: 772516 - protein, 18 aa, Mycobacterium
MLPHNAVEYFVSYYDYYQ

SEQ ID NO: 772517 - protein, 21 aa, Mycobacterium
MLPPRFQPRASWNANLSILNT

SEQ ID NO: 772518 - protein, 20 aa, Mycobacterium
MLQARGGGQWATFSELVADC

SEQ ID NO: 772519 - protein, 19 aa, Mycobacterium
MLQARLKALRIFERKPMPT

SEQ ID NO: 772520 - protein, 21 aa, Mycobacterium
MLQAVQPYLIWLRETAQQAQQ

SEQ ID NO: 772521 - protein, 26 aa, Mycobacterium
MLQLYALRSAHSWGIGDLGDLRAFVD

SEQ ID NO: 772522 - protein, 25 aa, Mycobacterium
MLQLYGLRSSRSWGVGDLGDLREFV

SEQ ID NO: 772523 - protein, 19 aa, Mycobacterium
MLRAAEWARIVTLSAHSIQ

SEQ ID NO: 772524 - protein, 19 aa, Mycobacterium
MLRDNRFRLPPGITLAAQG

SEQ ID NO: 772525 - protein, 25 aa, Mycobacterium
MLRELRPDLTIGFFLHIPFPPVELF

SEQ ID NO: 772526 - protein, 24 aa, Mycobacterium
MLREMRPDLTIGFFLHIPFPPVEL

SEQ ID NO: 772527 - protein, 21 aa, Mycobacterium
MLRFLSSPLWRAYTSTYVEGY

SEQ ID NO: 772528 - protein, 20 aa, Mycobacterium
MLRLAIATRYGRFVVASRTR

SEQ ID NO: 772529 - protein, 25 aa, Mycobacterium
MLRMLRPDLTIGFFLHIPFPPVELF

SEQ ID NO: 772530 - protein, 21 aa, Mycobacterium
MLRNRPEFHLADTAAMHLGAI

SEQ ID NO: 772531 - protein, 17 aa, Mycobacterium
MLRQWWGPEKTLVPECR

SEQ ID NO: 772532 - protein, 19 aa, Mycobacterium
MLRWKCVESPLGLNHPYWV

SEQ ID NO: 772533 - protein, 21 aa, Mycobacterium
MLSNLKGLFPAAAAAGAQIAT

SEQ ID NO: 772534 - protein, 25 aa, Mycobacterium
MLTCAIRPSGIWGRGDQTMFRKLFE

SEQ ID NO: 772535 - protein, 25 aa, Mycobacterium
MLTCSIRPSGIWGRGDQTMFRKVFE

SEQ ID NO: 772536 - protein, 20 aa, Mycobacterium
MLTWQMALCRPLWRCYGKIL

SEQ ID NO: 772537 - protein, 19 aa, Mycobacterium
MLVPDPKHPGVMRVGTLEE

SEQ ID NO: 772538 - protein, 20 aa, Mycobacterium
MLYKRFRVRSQVWMFGLTPG

SEQ ID NO: 772539 - protein, 23 aa, Mycobacterium
MLYLEIRCILVAKGAGVQGLQNG

SEQ ID NO: 772540 - protein, 19 aa, Mycobacterium
MMARLCRELGLPLVVDAAQ

SEQ ID NO: 772541 - protein, 19 aa, Mycobacterium
MMFDRCVEFLPALRSAAPD

SEQ ID NO: 772542 - protein, 18 aa, Mycobacterium
MMFGEYWDLTALAEDCAA

SEQ ID NO: 772543 - protein, 21 aa, Mycobacterium
MMFPDRWIPNLADQVRAAALA

SEQ ID NO: 772544 - protein, 17 aa, Mycobacterium
MMGCPYRPLNRLWGNQF

SEQ ID NO: 772545 - protein, 17 aa, Mycobacterium
MMHRLLIVIDEAANVAP

SEQ ID NO: 772546 - protein, 17 aa, Mycobacterium
MMIVRYLIDRRVSVEIP

SEQ ID NO: 772547 - protein, 20 aa, Mycobacterium
MMLEAITPYVTWMRSTAVQA

SEQ ID NO: 772548 - protein, 18 aa, Mycobacterium
MMLVRYLLDRDVHAEIPA

SEQ ID NO: 772549 - protein, 17 aa, Mycobacterium
MMMRAFCDLAERHTWTE

SEQ ID NO: 772550 - protein, 21 aa, Mycobacterium
MMTSNFTFRRCESMRPHIQEM

SEQ ID NO: 772551 - protein, 17 aa, Mycobacterium
MMVTFGVGWLKGEFDAL

SEQ ID NO: 772552 - protein, 17 aa, Mycobacterium
MNFDIVYLPPIHPIGKV

SEQ ID NO: 772553 - protein, 19 aa, Mycobacterium
MNKRVCVRIVAQRARSWDH

SEQ ID NO: 772554 - protein, 24 aa, Mycobacterium
MNLPAVAFGHDWLTGVARYSGLLE

SEQ ID NO: 772555 - protein, 18 aa, Mycobacterium
MNLSRRWANDGIRVNAIA

SEQ ID NO: 772556 - protein, 17 aa, Mycobacterium
MNPHWLGAHPSYTLSKY

SEQ ID NO: 772557 - protein, 23 aa, Mycobacterium
MNSRGRFAMKMARPPERFTDGLL

SEQ ID NO: 772558 - protein, 17 aa, Mycobacterium
MNWASCFEMDFTFIHEG

SEQ ID NO: 772559 - protein, 19 aa, Mycobacterium
MPAGLWKRVVDVFAPANVV

SEQ ID NO: 772560 - protein, 20 aa, Mycobacterium
MPAKSAAVAAIFPTVTAPPP

SEQ ID NO: 772561 - protein, 19 aa, Mycobacterium
MPALKFVWADGAADLLTPF

SEQ ID NO: 772562 - protein, 19 aa, Mycobacterium
MPAMPLIKFIDGYETVEEM

SEQ ID NO: 772563 - protein, 18 aa, Mycobacterium
MPAMPLIRFLDGYETIAE

SEQ ID NO: 772564 - protein, 17 aa, Mycobacterium
MPAPGVYGHSFGSGPRY

SEQ ID NO: 772565 - protein, 17 aa, Mycobacterium
MPARAKEAFGIQKRQRQ

SEQ ID NO: 772566 - protein, 20 aa, Mycobacterium
MPARLLRFWFGLRNQAAYSL

SEQ ID NO: 772567 - protein, 17 aa, Mycobacterium
MPARYVIHAATMELGGP

SEQ ID NO: 772568 - protein, 20 aa, Mycobacterium
MPDAEFEAILGLKRRALVVG

SEQ ID NO: 772569 - protein, 18 aa, Mycobacterium
MPDELKPVLARQMEIYAG

SEQ ID NO: 772570 - protein, 18 aa, Mycobacterium
MPDLKFVWADGAADLLTP

SEQ ID NO: 772571 - protein, 19 aa, Mycobacterium
MPDLRCLMLTSFTSDEAML

SEQ ID NO: 772572 - protein, 17 aa, Mycobacterium
MPDLVARVISGVKPVAD

SEQ ID NO: 772573 - protein, 21 aa, Mycobacterium
MPDTRVAFMLTDAAPIVALTT

SEQ ID NO: 772574 - protein, 22 aa, Mycobacterium
MPDTRVGTTFGHEFIGVVEKVG

SEQ ID NO: 772575 - protein, 20 aa, Mycobacterium
MPDYYRWLLYKADHGPAYRY

SEQ ID NO: 772576 - protein, 19 aa, Mycobacterium
MPELYRYLSPNPGETDVLG

SEQ ID NO: 772577 - protein, 18 aa, Mycobacterium
MPERAIACSFNLEYLLVG

SEQ ID NO: 772578 - protein, 17 aa, Mycobacterium
MPFYLMRAIDGWSPMDG

SEQ ID NO: 772579 - protein, 20 aa, Mycobacterium
MPFYVMRAIDGWSPMDGGWQ

SEQ ID NO: 772580 - protein, 20 aa, Mycobacterium
MPGAEWFPGATLNYATEIFR

SEQ ID NO: 772581 - protein, 17 aa, Mycobacterium
MPGFGLVMFGAIREAGA

SEQ ID NO: 772582 - protein, 19 aa, Mycobacterium
MPGGIYAPMMHPWSTGKDV

SEQ ID NO: 772583 - protein, 25 aa, Mycobacterium
MPGLESPRAFGLMEVLRWAPIGDQD

SEQ ID NO: 772584 - protein, 21 aa, Mycobacterium
MPGYEEFTLYPGPDMDKAKQL

SEQ ID NO: 772585 - protein, 20 aa, Mycobacterium
MPIGELWYRKSGTYRNKVQN

SEQ ID NO: 772586 - protein, 21 aa, Mycobacterium
MPIKVPWSLPAARPAHTGDPA

SEQ ID NO: 772587 - protein, 21 aa, Mycobacterium
MPISIGFPFGLSVVAPVNMPL

SEQ ID NO: 772588 - protein, 25 aa, Mycobacterium
MPKAKCFNEALGYWCVARAERYAYE

SEQ ID NO: 772589 - protein, 17 aa, Mycobacterium
MPKVPSFMWLEVDDVVS

SEQ ID NO: 772590 - protein, 18 aa, Mycobacterium
MPLARALQTVHRYDYLDA

SEQ ID NO: 772591 - protein, 21 aa, Mycobacterium
MPLDAGHQWRRGAALSADDVL

SEQ ID NO: 772592 - protein, 26 aa, Mycobacterium
MPLDALRAGLDWGWASFGDWLDRLEG

SEQ ID NO: 772593 - protein, 19 aa, Mycobacterium
MPLMLAESDWDAWLNPDAP

SEQ ID NO: 772594 - protein, 19 aa, Mycobacterium
MPLMLSEGDWDAWLNPDAP

SEQ ID NO: 772595 - protein, 20 aa, Mycobacterium
MPLPLLHRALATWPDTKFVQ

SEQ ID NO: 772596 - protein, 21 aa, Mycobacterium
MPLPLLHRALSTWPDTRFVQV

SEQ ID NO: 772597 - protein, 20 aa, Mycobacterium
MPMRVIGMLLGIPEDRQRAI

SEQ ID NO: 772598 - protein, 19 aa, Mycobacterium
MPMRVIGMLLGIPEEDQRR

SEQ ID NO: 772599 - protein, 19 aa, Mycobacterium
MPMRVIGMLLGLPEDRQRQ

SEQ ID NO: 772600 - protein, 18 aa, Mycobacterium
MPPALFAPIVENLAAADL

SEQ ID NO: 772601 - protein, 24 aa, Mycobacterium
MPPQMLHMILPRKDYEIVEDSWDV

SEQ ID NO: 772602 - protein, 24 aa, Mycobacterium
MPPQMLHMILPRKDYEIVEDSWNV

SEQ ID NO: 772603 - protein, 22 aa, Mycobacterium
MPPQMLHMILPRKDYQIVDDSW

SEQ ID NO: 772604 - protein, 17 aa, Mycobacterium
MPQIRVGLAYGQVLSRF

SEQ ID NO: 772605 - protein, 17 aa, Mycobacterium
MPQMSGIEFLEAAMDIF

SEQ ID NO: 772606 - protein, 17 aa, Mycobacterium
MPQMSGIEFLERAMDLY

SEQ ID NO: 772607 - protein, 20 aa, Mycobacterium
MPRRFYCRARWRTGGVDSET

SEQ ID NO: 772608 - protein, 22 aa, Mycobacterium
MPSLPWPAADDWLAAVRASPLA

SEQ ID NO: 772609 - protein, 19 aa, Mycobacterium
MPSRAYVSAFGFKGPDQQK

SEQ ID NO: 772610 - protein, 17 aa, Mycobacterium
MPSRFAILPRRGGTHDI

SEQ ID NO: 772611 - protein, 17 aa, Mycobacterium
MPTLAGVTWVGRWEMNL

SEQ ID NO: 772612 - protein, 18 aa, Mycobacterium
MPTPFLAVGESFWDFRQV

SEQ ID NO: 772613 - protein, 20 aa, Mycobacterium
MPTTCPECGTVLAPEKEGDA

SEQ ID NO: 772614 - protein, 21 aa, Mycobacterium
MPVAVPWSLSAARPVHSGADA

SEQ ID NO: 772615 - protein, 18 aa, Mycobacterium
MPVGRRVAIVGGDLVALE

SEQ ID NO: 772616 - protein, 18 aa, Mycobacterium
MPVVWAMFEWGRKHLDDT

SEQ ID NO: 772617 - protein, 19 aa, Mycobacterium
MPYKHGFGPFAPEIYRAPM

SEQ ID NO: 772618 - protein, 24 aa, Mycobacterium
MQEGQRLWLSWAMANRDPRLFDQP

SEQ ID NO: 772619 - protein, 17 aa, Mycobacterium
MQREFPMAVHLLEGHMV

SEQ ID NO: 772620 - protein, 17 aa, Mycobacterium
MQRPRCLYFRDVTAACN

SEQ ID NO: 772621 - protein, 19 aa, Mycobacterium
MQRRWSIVMVDEFQDTDPV

SEQ ID NO: 772622 - protein, 22 aa, Mycobacterium
MRACGICGSDAFYIAIGGIPPR

SEQ ID NO: 772623 - protein, 22 aa, Mycobacterium
MRACGICGSDAFYITIGGLPPR

SEQ ID NO: 772624 - protein, 18 aa, Mycobacterium
MRAEERFGPERVITATTL

SEQ ID NO: 772625 - protein, 19 aa, Mycobacterium
MRALIGIGVFRRGSDGRYA

SEQ ID NO: 772626 - protein, 18 aa, Mycobacterium
MRARFLFHCREFEVIEES

SEQ ID NO: 772627 - protein, 18 aa, Mycobacterium
MRDDLALLIKELEQACDK

SEQ ID NO: 772628 - protein, 17 aa, Mycobacterium
MREWARLDPVAAENIRA

SEQ ID NO: 772629 - protein, 17 aa, Mycobacterium
MRFKWRKWLDFDCNWKV

SEQ ID NO: 772630 - protein, 19 aa, Mycobacterium
MRHGMFWSGDLAYRDADGW

SEQ ID NO: 772631 - protein, 19 aa, Mycobacterium
MRHWLGRGADGWRLDAAYA

SEQ ID NO: 772632 - protein, 18 aa, Mycobacterium
MRIKPGTVLTLWTEDAYG

SEQ ID NO: 772633 - protein, 18 aa, Mycobacterium
MRISHCRPPGADRDIVLM

SEQ ID NO: 772634 - protein, 18 aa, Mycobacterium
MRLDMPLLDFFSHGGALK

SEQ ID NO: 772635 - protein, 18 aa, Mycobacterium
MRLDMPLVDFFSRGGALK

SEQ ID NO: 772636 - protein, 18 aa, Mycobacterium
MRLGALFVPLNWRLHTTE

SEQ ID NO: 772637 - protein, 17 aa, Mycobacterium
MRLHWGPIEFRTLAEQA

SEQ ID NO: 772638 - protein, 22 aa, Mycobacterium
MRLIAIPLWHSYMFAIRKDWGY

SEQ ID NO: 772639 - protein, 18 aa, Mycobacterium
MRLQPGRMFLVDTAQGRI

SEQ ID NO: 772640 - protein, 18 aa, Mycobacterium
MRLWAQERVRGWTNDRVR

SEQ ID NO: 772641 - protein, 17 aa, Mycobacterium
MRPDCFDWDAGLKRYLS

SEQ ID NO: 772642 - protein, 17 aa, Mycobacterium
MRRCPSRSFTVVGDLAQ

SEQ ID NO: 772643 - protein, 18 aa, Mycobacterium
MRRIKQSFDPAGILNPGI

SEQ ID NO: 772644 - protein, 18 aa, Mycobacterium
MRRIKRSFDPAGILNPDV

SEQ ID NO: 772645 - protein, 17 aa, Mycobacterium
MRRMLALQSGRRGVVNI

SEQ ID NO: 772646 - protein, 23 aa, Mycobacterium
MRSCTGWPSGTWIDPPRRTAPDG

SEQ ID NO: 772647 - protein, 18 aa, Mycobacterium
MRSLLRMQHRILGGTRRV

SEQ ID NO: 772648 - protein, 22 aa, Mycobacterium
MRSRAAILYEYGHPWTVEEFEL

SEQ ID NO: 772649 - protein, 18 aa, Mycobacterium
MRTFAVELGEHFIRVNSV

SEQ ID NO: 772650 - protein, 17 aa, Mycobacterium
MRTVMCIINGQLRPVLV

SEQ ID NO: 772651 - protein, 18 aa, Mycobacterium
MRTVMCIINGQLRPVLVR

SEQ ID NO: 772652 - protein, 17 aa, Mycobacterium
MRTVMCILNGQLRPVLV

SEQ ID NO: 772653 - protein, 17 aa, Mycobacterium
MRTVMCIMNGQLRPVLV

SEQ ID NO: 772654 - protein, 20 aa, Mycobacterium
MRTWFGFGVAGNFAGHLEQA

SEQ ID NO: 772655 - protein, 19 aa, Mycobacterium
MRTYRIGAILLDLQDPTRI

SEQ ID NO: 772656 - protein, 18 aa, Mycobacterium
MRVVRELSALPAEVEAAR

SEQ ID NO: 772657 - protein, 17 aa, Mycobacterium
MRVVRELSSLAGEVEAA

SEQ ID NO: 772658 - protein, 17 aa, Mycobacterium
MRWKGPSGHSCWFANAP

SEQ ID NO: 772659 - protein, 25 aa, Mycobacterium
MRWPHGRLRYYLAMLAELSQLRLLP

SEQ ID NO: 772660 - protein, 17 aa, Mycobacterium
MRYKWRKWLYFDCNWKV

SEQ ID NO: 772661 - protein, 20 aa, Mycobacterium
MRYTRTLTIQACWEAGKQPP

SEQ ID NO: 772662 - protein, 23 aa, Mycobacterium
MSAALCKRLLWDSAIHHYTPRQV

SEQ ID NO: 772663 - protein, 17 aa, Mycobacterium
MSAHPALLFSLGQSAGD

SEQ ID NO: 772664 - protein, 21 aa, Mycobacterium
MSARLMERWSSRRAAIKARTA

SEQ ID NO: 772665 - protein, 23 aa, Mycobacterium
MSAYRAGGQFLWDALSQAIDAAG

SEQ ID NO: 772666 - protein, 18 aa, Mycobacterium
MSCGWFFCASGYYRYDAG

SEQ ID NO: 772667 - protein, 26 aa, Mycobacterium
MSCPNCLRGDIGNCLRIQLMAFAYDG

SEQ ID NO: 772668 - protein, 18 aa, Mycobacterium
MSECYRIRLNYAQADGGP

SEQ ID NO: 772669 - protein, 17 aa, Mycobacterium
MSEERVRLISPFVGGAF

SEQ ID NO: 772670 - protein, 20 aa, Mycobacterium
MSEVLPLLYLHGLSTSDFGP

SEQ ID NO: 772671 - protein, 28 aa, Mycobacterium
MSFIAVCGQCRWCASGMEYLCDAGIGTL

SEQ ID NO: 772672 - protein, 21 aa, Mycobacterium
MSFPAYVRWARLIRTIEVART

SEQ ID NO: 772673 - protein, 19 aa, Mycobacterium
MSFQPDLCAQVPIVGLVGE

SEQ ID NO: 772674 - protein, 28 aa, Mycobacterium
MSFVAVCGQCRWCASGIEYLCDQGIGTM

SEQ ID NO: 772675 - protein, 17 aa, Mycobacterium
MSFVFAVPEFLTTAAQD

SEQ ID NO: 772676 - protein, 18 aa, Mycobacterium
MSGARIALHAALELARRG

SEQ ID NO: 772677 - protein, 17 aa, Mycobacterium
MSGLRWLQDRGFDGERV

SEQ ID NO: 772678 - protein, 17 aa, Mycobacterium
MSGTGFLGAHAEEVYHL

SEQ ID NO: 772679 - protein, 23 aa, Mycobacterium
MSGWQRLHFRFGIPEPLLEPLAV

SEQ ID NO: 772680 - protein, 17 aa, Mycobacterium
MSISLLRHGRLWGLIAC

SEQ ID NO: 772681 - protein, 26 aa, Mycobacterium
MSISVAFHEPVRWDGWLLYTHESTQV

SEQ ID NO: 772682 - protein, 21 aa, Mycobacterium
MSLSGRWRRQGIDVGFAALAA

SEQ ID NO: 772683 - protein, 18 aa, Mycobacterium
MSPETWAALSTHLNRAQL

SEQ ID NO: 772684 - protein, 22 aa, Mycobacterium
MSQLRTALRLQIAAGRSIGEAL

SEQ ID NO: 772685 - protein, 21 aa, Mycobacterium
MSQLRTALRMQIVAGYPVAEA

SEQ ID NO: 772686 - protein, 17 aa, Mycobacterium
MSRRYHADFSFASYDPA

SEQ ID NO: 772687 - protein, 17 aa, Mycobacterium
MSTELMAAWSSRRLAIE

SEQ ID NO: 772688 - protein, 20 aa, Mycobacterium
MSVGDLIIGWLLQRQAAVAV

SEQ ID NO: 772689 - protein, 23 aa, Mycobacterium
MSVGDLLIGWLLQRQAAVAIEAL

SEQ ID NO: 772690 - protein, 19 aa, Mycobacterium
MSVGDLVIGWLLQRQAAVA

SEQ ID NO: 772691 - protein, 19 aa, Mycobacterium
MSYHLPRIVGTSVAADWML

SEQ ID NO: 772692 - protein, 19 aa, Mycobacterium
MSYYEMKNRAGVVGERGLG

SEQ ID NO: 772693 - protein, 18 aa, Mycobacterium
MTAEDRWLQFSSVSFDAS

SEQ ID NO: 772694 - protein, 18 aa, Mycobacterium
MTCACVLKDGKVRMLVND

SEQ ID NO: 772695 - protein, 17 aa, Mycobacterium
MTCPSLPAGFDFTDPDI

SEQ ID NO: 772696 - protein, 18 aa, Mycobacterium
MTDGRWDPGKDFAMVSAR

SEQ ID NO: 772697 - protein, 18 aa, Mycobacterium
MTEVPAPVVRKIPKEWLD

SEQ ID NO: 772698 - protein, 24 aa, Mycobacterium
MTFAKPYAEWRGMFAGNGMLLPRS

SEQ ID NO: 772699 - protein, 19 aa, Mycobacterium
MTFTQDWFRFERLMVAARC

SEQ ID NO: 772700 - protein, 23 aa, Mycobacterium
MTGWQRLHFRFGIPAPLLEPLAV

SEQ ID NO: 772701 - protein, 19 aa, Mycobacterium
MTHHRWLRALAVFGGMGLR

SEQ ID NO: 772702 - protein, 23 aa, Mycobacterium
MTHWAGKEWDHFLHGTPVGRALN

SEQ ID NO: 772703 - protein, 26 aa, Mycobacterium
MTISVAFHEPVRWDGWLLYTHESTQV

SEQ ID NO: 772704 - protein, 25 aa, Mycobacterium
MTKSLRAGKVFLDWSQNNAAKTTIA

SEQ ID NO: 772705 - protein, 25 aa, Mycobacterium
MTKSLRAGKVFLDWSQNNGSKTTIA

SEQ ID NO: 772706 - protein, 19 aa, Mycobacterium
MTLAGRWRRQGIAVDFATL

SEQ ID NO: 772707 - protein, 17 aa, Mycobacterium
MTLEGTNTWVLRAPRSD

SEQ ID NO: 772708 - protein, 18 aa, Mycobacterium
MTLKSHRWISGTFGPDLS

SEQ ID NO: 772709 - protein, 23 aa, Mycobacterium
MTLTCPFHGWTFRNDGALLKVKD

SEQ ID NO: 772710 - protein, 25 aa, Mycobacterium
MTLVPRARPALRFVEIVAADPSVAA

SEQ ID NO: 772711 - protein, 18 aa, Mycobacterium
MTPAAFVRRPGRWIRAMA

SEQ ID NO: 772712 - protein, 20 aa, Mycobacterium
MTPHWGRGTLVGKLTVPPSW

SEQ ID NO: 772713 - protein, 22 aa, Mycobacterium
MTPSGFEWELGWNPIVVDENTW

SEQ ID NO: 772714 - protein, 24 aa, Mycobacterium
MTSPVRWDLCTEYFKTANDTPAAT

SEQ ID NO: 772715 - protein, 24 aa, Mycobacterium
MTSRPCPTCRGVGTVIPDPCHQCM

SEQ ID NO: 772716 - protein, 25 aa, Mycobacterium
MTSRPCPTCRGVGVVIPDPCHQCMG

SEQ ID NO: 772717 - protein, 17 aa, Mycobacterium
MTVALLLTVTRHVLTAD

SEQ ID NO: 772718 - protein, 17 aa, Mycobacterium
MTVDLEWPGSLVQSVEG

SEQ ID NO: 772719 - protein, 26 aa, Mycobacterium
MTVSVSFHEPVTWGGWLLYTHESTQV

SEQ ID NO: 772720 - protein, 26 aa, Mycobacterium
MTWPHGRLRYYIAMLVELSQLRPLPF

SEQ ID NO: 772721 - protein, 20 aa, Mycobacterium
MTYLQWLRRYVELAIGDGNS

SEQ ID NO: 772722 - protein, 20 aa, Mycobacterium
MTYLQWLRRYVELTIGEGNS

SEQ ID NO: 772723 - protein, 24 aa, Mycobacterium
MVARGCPFSGLLYAGLAITANGPA

SEQ ID NO: 772724 - protein, 17 aa, Mycobacterium
MVCQAWLGPRYQVTSQV

SEQ ID NO: 772725 - protein, 19 aa, Mycobacterium
MVDVLPLTPLQHGLLFHTG

SEQ ID NO: 772726 - protein, 19 aa, Mycobacterium
MVEMFRGGIDWVLNMYQER

SEQ ID NO: 772727 - protein, 18 aa, Mycobacterium
MVFVGGLLPVPGHSFVEH

SEQ ID NO: 772728 - protein, 17 aa, Mycobacterium
MVGAVSVPPTWEGSMPT

SEQ ID NO: 772729 - protein, 17 aa, Mycobacterium
MVIADGFFAFLTKEQII

SEQ ID NO: 772730 - protein, 17 aa, Mycobacterium
MVIRGGENIYPREIEEF

SEQ ID NO: 772731 - protein, 22 aa, Mycobacterium
MVKAGVQWGLFGGAVENLGTQR

SEQ ID NO: 772732 - protein, 22 aa, Mycobacterium
MVKKLSIRLGVPCFPDDPLHFT

SEQ ID NO: 772733 - protein, 22 aa, Mycobacterium
MVKKLSIRLGVPCFPDDPLRFT

SEQ ID NO: 772734 - protein, 23 aa, Mycobacterium
MVLAAKADTAWHLHRLTADINLD

SEQ ID NO: 772735 - protein, 17 aa, Mycobacterium
MVLAITGYVWRQGVGAV

SEQ ID NO: 772736 - protein, 18 aa, Mycobacterium
MVLLQSFIGRNGWHRRIV

SEQ ID NO: 772737 - protein, 20 aa, Mycobacterium
MVLRAMGIPAHYVSGYLHPK

SEQ ID NO: 772738 - protein, 18 aa, Mycobacterium
MVLRGMGIPSRYVSGYLH

SEQ ID NO: 772739 - protein, 17 aa, Mycobacterium
MVPYRGVNIAMMICYDV

SEQ ID NO: 772740 - protein, 19 aa, Mycobacterium
MVQGIAFADAERGPRVSRA

SEQ ID NO: 772741 - protein, 17 aa, Mycobacterium
MVRCVRTALPLLRKAQW

SEQ ID NO: 772742 - protein, 19 aa, Mycobacterium
MVRDFQRIIGLEARAQIQA

SEQ ID NO: 772743 - protein, 19 aa, Mycobacterium
MVRDFQRIIGLEARVQIQA

SEQ ID NO: 772744 - protein, 24 aa, Mycobacterium
MVSCDCCAAPICKRCANKPKVDLW

SEQ ID NO: 772745 - protein, 19 aa, Mycobacterium
MVSFLDFRKIPLVGMWAEM

SEQ ID NO: 772746 - protein, 17 aa, Mycobacterium
MVTEIFPGGRLPSIEKV

SEQ ID NO: 772747 - protein, 17 aa, Mycobacterium
MVTLASWCALRFGETVE

SEQ ID NO: 772748 - protein, 23 aa, Mycobacterium
MWAQDVAAMFGYRSGAESIAAAL

SEQ ID NO: 772749 - protein, 25 aa, Mycobacterium
MWDLSWRTPALLAERGFLYDSSLMD

SEQ ID NO: 772750 - protein, 22 aa, Mycobacterium
MWKTSECWRQWINVGDFPDHPW

SEQ ID NO: 772751 - protein, 17 aa, Mycobacterium
MWLYRLSLAKVKWHSLT

SEQ ID NO: 772752 - protein, 20 aa, Mycobacterium
MWPLDMLQEFLVGQRMAVPA

SEQ ID NO: 772753 - protein, 21 aa, Mycobacterium
MWVQLRAAGLLDHGVSVLALG

SEQ ID NO: 772754 - protein, 21 aa, Mycobacterium
MWWVPVWLLRALEVIVYGPDR

SEQ ID NO: 772755 - protein, 23 aa, Mycobacterium
MYESEIYRRLSLSVLVRLPAGID

SEQ ID NO: 772756 - protein, 23 aa, Mycobacterium
MYFCPGCGHAPHHVFKDWADRYR

SEQ ID NO: 772757 - protein, 17 aa, Mycobacterium
MYGWGLRINELCRLDLA

SEQ ID NO: 772758 - protein, 23 aa, Mycobacterium
MYTDGACQLAFWRDDGYLVCEAR

SEQ ID NO: 772759 - protein, 23 aa, Mycobacterium
MYTMAGEGFAHWLGLDDEDVLLT

SEQ ID NO: 772760 - protein, 23 aa, Mycobacterium
NAADEADLLWALRGGGANFGVVT

SEQ ID NO: 772761 - protein, 17 aa, Mycobacterium
NAAECLIVLTNRHGATA

SEQ ID NO: 772762 - protein, 22 aa, Mycobacterium
NAAFRKALRELTLVLVYEATRA

SEQ ID NO: 772763 - protein, 18 aa, Mycobacterium
NAALYWIALCQIKHGAPG

SEQ ID NO: 772764 - protein, 24 aa, Mycobacterium
NAAYLRWWACLERVVLEAGLRGVL

SEQ ID NO: 772765 - protein, 21 aa, Mycobacterium
NACNGRDGGLIWGNGGAGANG

SEQ ID NO: 772766 - protein, 17 aa, Mycobacterium
NADAAFDVLKWRSQENN

SEQ ID NO: 772767 - protein, 25 aa, Mycobacterium
NADEWLRERGFLPGAGGPGDFRVGF

SEQ ID NO: 772768 - protein, 19 aa, Mycobacterium
NADSIAGNGVWVFDAGVTR

SEQ ID NO: 772769 - protein, 17 aa, Mycobacterium
NAEELAGVLGLDADVLE

SEQ ID NO: 772770 - protein, 20 aa, Mycobacterium
NAELKHGCEFNWDSDGPEYS

SEQ ID NO: 772771 - protein, 20 aa, Mycobacterium
NAERIARWFLPITGDLRAGG

SEQ ID NO: 772772 - protein, 18 aa, Mycobacterium
NAETVFWNGPMGVFEFPA

SEQ ID NO: 772773 - protein, 19 aa, Mycobacterium
NAFHQQFWRSLSGAAASYS

SEQ ID NO: 772774 - protein, 18 aa, Mycobacterium
NAICPGFIATPLAEGVFG

SEQ ID NO: 772775 - protein, 17 aa, Mycobacterium
NAIKVLAVREVMRLLDG

SEQ ID NO: 772776 - protein, 20 aa, Mycobacterium
NAIRECLAWADGWLPGDAAL

SEQ ID NO: 772777 - protein, 20 aa, Mycobacterium
NAIWPDLFIVGGGISRKADK

SEQ ID NO: 772778 - protein, 18 aa, Mycobacterium
NALARLELRVALEEILKR

SEQ ID NO: 772779 - protein, 18 aa, Mycobacterium
NALATAWWMYWRMTKEAE

SEQ ID NO: 772780 - protein, 19 aa, Mycobacterium
NALCAAAVALECGADVDQV

SEQ ID NO: 772781 - protein, 19 aa, Mycobacterium
NALCAGAVALECGASVSQV

SEQ ID NO: 772782 - protein, 24 aa, Mycobacterium
NALDVIREFPIRAAIEEWQQVLIR

SEQ ID NO: 772783 - protein, 24 aa, Mycobacterium
NALKAVPAERLWVNPDCGLKTRKT

SEQ ID NO: 772784 - protein, 20 aa, Mycobacterium
NALKVAFDWKSRHNQARGID

SEQ ID NO: 772785 - protein, 18 aa, Mycobacterium
NALLDWAYGRQFRYTESM

SEQ ID NO: 772786 - protein, 17 aa, Mycobacterium
NALLDWAYGTRMRYREA

SEQ ID NO: 772787 - protein, 21 aa, Mycobacterium
NALLGRPLIGNGTDGLAGTGA

SEQ ID NO: 772788 - protein, 22 aa, Mycobacterium
NALRPQLLAARHTPEGYKTVQA

SEQ ID NO: 772789 - protein, 18 aa, Mycobacterium
NALRSWSVLRFEVTEDPS

SEQ ID NO: 772790 - protein, 24 aa, Mycobacterium
NALWRFLPDRVRVLDFPTNFHYDF

SEQ ID NO: 772791 - protein, 18 aa, Mycobacterium
NAMGRPGLTLGLGPSHEP

SEQ ID NO: 772792 - protein, 20 aa, Mycobacterium
NAMGRPGLTLGLGPSHEPIV

SEQ ID NO: 772793 - protein, 26 aa, Mycobacterium
NAPFLQFTGRPLVGPGTDGAPGTGQA

SEQ ID NO: 772794 - protein, 24 aa, Mycobacterium
NAPTQVLFGRGLIGDGANGTAPGQ

SEQ ID NO: 772795 - protein, 18 aa, Mycobacterium
NARFCYTRVTACGHDAEA

SEQ ID NO: 772796 - protein, 18 aa, Mycobacterium
NARGVPFIFVRTDSAGNI

SEQ ID NO: 772797 - protein, 19 aa, Mycobacterium
NARGVPFIFVRTDSAGNIS

SEQ ID NO: 772798 - protein, 17 aa, Mycobacterium
NARSGLRAAMDILGNIE

SEQ ID NO: 772799 - protein, 22 aa, Mycobacterium
NASAATEFVDWAAMNRQQTVAE

SEQ ID NO: 772800 - protein, 20 aa, Mycobacterium
NASPLEFLLDAVNAPTQTLF

SEQ ID NO: 772801 - protein, 17 aa, Mycobacterium
NATGWKIGWACGAPELI

SEQ ID NO: 772802 - protein, 22 aa, Mycobacterium
NAVELARAWKPATLRATSKTKS

SEQ ID NO: 772803 - protein, 20 aa, Mycobacterium
NAVGGWRGAPRPVLARELLP

SEQ ID NO: 772804 - protein, 17 aa, Mycobacterium
NAVIFCGHFPDGAEKFT

SEQ ID NO: 772805 - protein, 18 aa, Mycobacterium
NAVIFCGHFPDGAEKFTK

SEQ ID NO: 772806 - protein, 20 aa, Mycobacterium
NAVSRWLFRRVLTKFVGAKG

SEQ ID NO: 772807 - protein, 17 aa, Mycobacterium
NAYRFGTVGWPFPATEA

SEQ ID NO: 772808 - protein, 20 aa, Mycobacterium
NCAAFKRWGLYPRMGIAPEE

SEQ ID NO: 772809 - protein, 19 aa, Mycobacterium
NCGTPCPAFAGGSTVTAVA

SEQ ID NO: 772810 - protein, 18 aa, Mycobacterium
NCLVALAILDAVGVSPEQ

SEQ ID NO: 772811 - protein, 18 aa, Mycobacterium
NCNGRIPFDTALLSEVLS

SEQ ID NO: 772812 - protein, 19 aa, Mycobacterium
NCSGRIPFETALLPEVLAE

SEQ ID NO: 772813 - protein, 21 aa, Mycobacterium
NDALLRFACSWIAAEDGTPRT

SEQ ID NO: 772814 - protein, 22 aa, Mycobacterium
NDAMWLRFCAAIDLPDLASDPD

SEQ ID NO: 772815 - protein, 19 aa, Mycobacterium
NDFPPKLVGRMVLNRNVDN

SEQ ID NO: 772816 - protein, 17 aa, Mycobacterium
NDGALGWFGTSPVGTFP

SEQ ID NO: 772817 - protein, 18 aa, Mycobacterium
NDGALGWHGTSPVGTFPA

SEQ ID NO: 772818 - protein, 18 aa, Mycobacterium
NDGALGWKGTSPVGTFPP

SEQ ID NO: 772819 - protein, 18 aa, Mycobacterium
NDGALGWTGTSPVGTFPP

SEQ ID NO: 772820 - protein, 17 aa, Mycobacterium
NDGALGWVGTSPVGTFP

SEQ ID NO: 772821 - protein, 17 aa, Mycobacterium
NDIIEMVTDLTLGHDPA

SEQ ID NO: 772822 - protein, 20 aa, Mycobacterium
NDMYPRLVVAVVRAVGDAAM

SEQ ID NO: 772823 - protein, 19 aa, Mycobacterium
NDPARLAGWWAEQFGGATR

SEQ ID NO: 772824 - protein, 18 aa, Mycobacterium
NDTTLRWLAPGIRVVWGS

SEQ ID NO: 772825 - protein, 17 aa, Mycobacterium
NDWPMARLTLALSPATL

SEQ ID NO: 772826 - protein, 17 aa, Mycobacterium
NEAAFCYQLLVRSFGTN

SEQ ID NO: 772827 - protein, 17 aa, Mycobacterium
NEAAFCYQLLVRSLGTN

SEQ ID NO: 772828 - protein, 17 aa, Mycobacterium
NEAFAPVVMAWLKEIKA

SEQ ID NO: 772829 - protein, 21 aa, Mycobacterium
NEAWWFPAIQWPDGRMQFMLN

SEQ ID NO: 772830 - protein, 17 aa, Mycobacterium
NEDFPRLMVYRGPRRKG

SEQ ID NO: 772831 - protein, 24 aa, Mycobacterium
NEDNRWTVQLAWKVGRSDNLAHFC

SEQ ID NO: 772832 - protein, 20 aa, Mycobacterium
NEDSRWTVQLAWKAGLSDNV

SEQ ID NO: 772833 - protein, 24 aa, Mycobacterium
NEDSRWTVQLAWKAGRSDNIAHFC

SEQ ID NO: 772834 - protein, 21 aa, Mycobacterium
NEDWYQWQWRVHVGLWAAASA

SEQ ID NO: 772835 - protein, 17 aa, Mycobacterium
NEFQYFVEMWNRAAGVM

SEQ ID NO: 772836 - protein, 19 aa, Mycobacterium
NEGLCAIGLRFSEDKTAPR

SEQ ID NO: 772837 - protein, 21 aa, Mycobacterium
NEIKINWVWNPPWGPDKITED

SEQ ID NO: 772838 - protein, 18 aa, Mycobacterium
NELAQYWIRVNTIHPTGV

SEQ ID NO: 772839 - protein, 23 aa, Mycobacterium
NELDRVGGRYGLQTMCEGGGTAN

SEQ ID NO: 772840 - protein, 23 aa, Mycobacterium
NELERVGGRYGLQTMCEGGGTAN

SEQ ID NO: 772841 - protein, 19 aa, Mycobacterium
NELGHPWTVLRATESTDYL

SEQ ID NO: 772842 - protein, 18 aa, Mycobacterium
NELGHPWTVLRATESTKF

SEQ ID NO: 772843 - protein, 18 aa, Mycobacterium
NELGHPWTVLRATPETDF

SEQ ID NO: 772844 - protein, 19 aa, Mycobacterium
NELGHPWTVLRATRGTDYL

SEQ ID NO: 772845 - protein, 25 aa, Mycobacterium
NELGHPWTVLRATRRTDYLVLEMSA

SEQ ID NO: 772846 - protein, 20 aa, Mycobacterium
NELPLRITVIRTRADELVLL

SEQ ID NO: 772847 - protein, 22 aa, Mycobacterium
NELRQRIGMVFQHFNLFPHLSV

SEQ ID NO: 772848 - protein, 23 aa, Mycobacterium
NEPICPPCGSFIRSNAGDIDTAV

SEQ ID NO: 772849 - protein, 23 aa, Mycobacterium
NEPICPPCGTFIRSNGADIDAAV

SEQ ID NO: 772850 - protein, 22 aa, Mycobacterium
NERLYCIPATIDLAGAEIELVS

SEQ ID NO: 772851 - protein, 23 aa, Mycobacterium
NERRTNWLNAFYFGGDHGVEGSV

SEQ ID NO: 772852 - protein, 21 aa, Mycobacterium
NERRWRTGLSLAEGAPVEDIH

SEQ ID NO: 772853 - protein, 20 aa, Mycobacterium
NERSEFRFGQVMTGLTTNAD

SEQ ID NO: 772854 - protein, 23 aa, Mycobacterium
NEVCARTALEIGFNRATGFARRL

SEQ ID NO: 772855 - protein, 21 aa, Mycobacterium
NEVMRSLGLPTMFPTIGGHEG

SEQ ID NO: 772856 - protein, 20 aa, Mycobacterium
NEWGWTWPLNRRVLYNRASA

SEQ ID NO: 772857 - protein, 23 aa, Mycobacterium
NFARRLPMLRGWVADLLDRDARD

SEQ ID NO: 772858 - protein, 19 aa, Mycobacterium
NFEGGPLLRFMSGNLSQQI

SEQ ID NO: 772859 - protein, 17 aa, Mycobacterium
NFELRQGHTLGIVGESG

SEQ ID NO: 772860 - protein, 19 aa, Mycobacterium
NFFPMGAWAKRTGAIFIRR

SEQ ID NO: 772861 - protein, 28 aa, Mycobacterium
NFFPMGAWAKRTGAIFIRRQTKDIPVYR

SEQ ID NO: 772862 - protein, 20 aa, Mycobacterium
NFTGRSWPLADVRLLAPILA

SEQ ID NO: 772863 - protein, 24 aa, Mycobacterium
NFTNVCYTGCRFCAFAQRKGDADA

SEQ ID NO: 772864 - protein, 25 aa, Mycobacterium
NFVFGEMWLRPGLGMKERRLITLAC

SEQ ID NO: 772865 - protein, 25 aa, Mycobacterium
NFVFGEMWLRPGLGMKERRLITVAC

SEQ ID NO: 772866 - protein, 18 aa, Mycobacterium
NFVSDLNAIMGIYYVHTQ

SEQ ID NO: 772867 - protein, 24 aa, Mycobacterium
NGAALRPVHDWVAAFERAWNERLD

SEQ ID NO: 772868 - protein, 25 aa, Mycobacterium
NGAEGAIGAQFVPASSLPTPSGGAG

SEQ ID NO: 772869 - protein, 17 aa, Mycobacterium
NGAGLVCGGVHTANATV

SEQ ID NO: 772870 - protein, 24 aa, Mycobacterium
NGDGKGFVDYVLWGEDGLPLAIVE

SEQ ID NO: 772871 - protein, 24 aa, Mycobacterium
NGDRALCIKAMIEKVVDRMYAEID

SEQ ID NO: 772872 - protein, 24 aa, Mycobacterium
NGDSAPPGWGWVAPYIGMIWPNGD

SEQ ID NO: 772873 - protein, 18 aa, Mycobacterium
NGDTYRVLFGVATTQGVN

SEQ ID NO: 772874 - protein, 18 aa, Mycobacterium
NGFFYKEMPPFCLATEAH

SEQ ID NO: 772875 - protein, 18 aa, Mycobacterium
NGFLWRGDNQGLIFGEPG

SEQ ID NO: 772876 - protein, 18 aa, Mycobacterium
NGFRDIICPPLFLQYAVL

SEQ ID NO: 772877 - protein, 19 aa, Mycobacterium
NGGAAGWWGTGGAGGAGGE

SEQ ID NO: 772878 - protein, 25 aa, Mycobacterium
NGGAGGSAGLWGRGGNGGAGGTGVA

SEQ ID NO: 772879 - protein, 22 aa, Mycobacterium
NGGAGGSAWLIGDGGNGGNGGI

SEQ ID NO: 772880 - protein, 19 aa, Mycobacterium
NGGAGGWIYGHGGDGGIGG

SEQ ID NO: 772881 - protein, 24 aa, Mycobacterium
NGGDGGAGGWLFGDAGAGGQGGTG

SEQ ID NO: 772882 - protein, 19 aa, Mycobacterium
NGGDGGWLLGDGGIGGSGT

SEQ ID NO: 772883 - protein, 18 aa, Mycobacterium
NGGFLERFHGLYIPILDL

SEQ ID NO: 772884 - protein, 26 aa, Mycobacterium
NGGKRLRPAFAYWGWRAVATGEPDSE

SEQ ID NO: 772885 - protein, 18 aa, Mycobacterium
NGGNANWFGSGGAGGQGG

SEQ ID NO: 772886 - protein, 25 aa, Mycobacterium
NGGNGGRLLGLGGAGGDAGNGGVGG

SEQ ID NO: 772887 - protein, 19 aa, Mycobacterium
NGGNGGWLIGSGGAGGVSG

SEQ ID NO: 772888 - protein, 23 aa, Mycobacterium
NGGNGGWLYGLGGQGGMGGNGSS

SEQ ID NO: 772889 - protein, 21 aa, Mycobacterium
NGGSGGLLFGGGGIGGTGGTG

SEQ ID NO: 772890 - protein, 23 aa, Mycobacterium
NGGSWAHRLLDVFDRVYRKRPYD

SEQ ID NO: 772891 - protein, 17 aa, Mycobacterium
NGGVRFSGNAGAGGAGG

SEQ ID NO: 772892 - protein, 24 aa, Mycobacterium
NGGWPFYHMEMMLAGIPIPVPPGE

SEQ ID NO: 772893 - protein, 24 aa, Mycobacterium
NGHKFRAAIHFDDLQWERGYSRVG

SEQ ID NO: 772894 - protein, 23 aa, Mycobacterium
NGIGGDGGDAFLIGNGGNGGAGA

SEQ ID NO: 772895 - protein, 20 aa, Mycobacterium
NGILHPLERITAIAPNPLTG

SEQ ID NO: 772896 - protein, 24 aa, Mycobacterium
NGKPEFVENFFLFIAEEVRELMAE

SEQ ID NO: 772897 - protein, 22 aa, Mycobacterium
NGLDFVRAWLGLILCGAVTVSI

SEQ ID NO: 772898 - protein, 28 aa, Mycobacterium
NGLFWQDDYRLLGIDLKINFGGTSGDYA

SEQ ID NO: 772899 - protein, 21 aa, Mycobacterium
NGLLWRGDYQGNLGAFNYTVT

SEQ ID NO: 772900 - protein, 23 aa, Mycobacterium
NGLNCMSVRWGLWQGTTIAGADD

SEQ ID NO: 772901 - protein, 33 aa, Mycobacterium
NGLRPELWGEFTARFGIKRVCEFYSASESNTAF

SEQ ID NO: 772902 - protein, 21 aa, Mycobacterium
NGMAVSWPRGITCAGEQRSQF

SEQ ID NO: 772903 - protein, 25 aa, Mycobacterium
NGNWTWRYDAIRSFPDFASLWDDVD

SEQ ID NO: 772904 - protein, 22 aa, Mycobacterium
NGPDGRSALFAFTSNAEIARVH

SEQ ID NO: 772905 - protein, 18 aa, Mycobacterium
NGPLALAVGRRLRERYGL

SEQ ID NO: 772906 - protein, 20 aa, Mycobacterium
NGPQALSFVRQRHGLPRGDL

SEQ ID NO: 772907 - protein, 23 aa, Mycobacterium
NGPRFALAGSYALWAYGAPEPTH

SEQ ID NO: 772908 - protein, 26 aa, Mycobacterium
NGPTQAWLGRPLIGNGTDGAAGTGQA

SEQ ID NO: 772909 - protein, 17 aa, Mycobacterium
NGQGVGSLFSWTGDPAV

SEQ ID NO: 772910 - protein, 20 aa, Mycobacterium
NGRFAVNVVSGWFKDEFIHL

SEQ ID NO: 772911 - protein, 24 aa, Mycobacterium
NGRFVFGVGAGWNLEEMRNHGTDP

SEQ ID NO: 772912 - protein, 19 aa, Mycobacterium
NGRIGRLLIVLQFMIDDLL

SEQ ID NO: 772913 - protein, 26 aa, Mycobacterium
NGRWQLSWRLPWIFTCQVHSCLLVDV

SEQ ID NO: 772914 - protein, 20 aa, Mycobacterium
NGRWYWHWDPAFLTKPSEDP

SEQ ID NO: 772915 - protein, 24 aa, Mycobacterium
NGTFTSGFGYRWGALHGGIDIANS

SEQ ID NO: 772916 - protein, 21 aa, Mycobacterium
NGTQMPLMWTQLIPATLEGKA

SEQ ID NO: 772917 - protein, 20 aa, Mycobacterium
NGVHSWGYWDAQLSAMKPDM

SEQ ID NO: 772918 - protein, 20 aa, Mycobacterium
NGVRRWLALDGQPLHRVTVA

SEQ ID NO: 772919 - protein, 17 aa, Mycobacterium
NGVWQFRGPTVIPSGLA

SEQ ID NO: 772920 - protein, 17 aa, Mycobacterium
NGWAMPLPEELRDDLKS

SEQ ID NO: 772921 - protein, 17 aa, Mycobacterium
NGYAIRFFMPEKWTMET

SEQ ID NO: 772922 - protein, 23 aa, Mycobacterium
NGYLGRFLCLEWLERLAETGGRL

SEQ ID NO: 772923 - protein, 23 aa, Mycobacterium
NHCFHVFGAYPWTRFLGRGMDEH

SEQ ID NO: 772924 - protein, 20 aa, Mycobacterium
NHFLAVAIDYLFAHRPEWAA

SEQ ID NO: 772925 - protein, 17 aa, Mycobacterium
NHGLTLWDLDRVFKVDG

SEQ ID NO: 772926 - protein, 17 aa, Mycobacterium
NHGLTLWDLDRVFKVNG

SEQ ID NO: 772927 - protein, 17 aa, Mycobacterium
NHSFKFVLLESLNADVL

SEQ ID NO: 772928 - protein, 22 aa, Mycobacterium
NHTQLPLGFMVEWEATGATVEA

SEQ ID NO: 772929 - protein, 24 aa, Mycobacterium
NHVADRPKLAWFLLQAVRYTPHQL

SEQ ID NO: 772930 - protein, 19 aa, Mycobacterium
NHYLAVAIDYLFSHRGGWA

SEQ ID NO: 772931 - protein, 17 aa, Mycobacterium
NIAKLLGKRARVIGTTL

SEQ ID NO: 772932 - protein, 19 aa, Mycobacterium
NIAPWLRAAHRYGAKVKWA

SEQ ID NO: 772933 - protein, 18 aa, Mycobacterium
NIAPYFKRIEAVEGATES

SEQ ID NO: 772934 - protein, 18 aa, Mycobacterium
NICGRPRITAEINDGKPA

SEQ ID NO: 772935 - protein, 19 aa, Mycobacterium
NIGKLLAKRARVIGTTLRG

SEQ ID NO: 772936 - protein, 18 aa, Mycobacterium
NIGWRIVPIIPDEARTFG

SEQ ID NO: 772937 - protein, 18 aa, Mycobacterium
NIKCLCRFHHLIKTFWAG

SEQ ID NO: 772938 - protein, 17 aa, Mycobacterium
NILPVTFGIPFGFSVVA

SEQ ID NO: 772939 - protein, 22 aa, Mycobacterium
NILWLLKQAFYFSLTSVNEAVS

SEQ ID NO: 772940 - protein, 33 aa, Mycobacterium
NINGWKPVKDVIYSAASALAWPSLSQQTVGSRF

SEQ ID NO: 772941 - protein, 17 aa, Mycobacterium
NIPAWLIFDQQYRDRYI

SEQ ID NO: 772942 - protein, 23 aa, Mycobacterium
NIRSIPTLMAFKQGQLVFNQAGA

SEQ ID NO: 772943 - protein, 20 aa, Mycobacterium
NISHEFRTPLTLIIGPVAEL

SEQ ID NO: 772944 - protein, 19 aa, Mycobacterium
NISHEFRTPLTLILDPVSE

SEQ ID NO: 772945 - protein, 17 aa, Mycobacterium
NITAYWKGYSEYHRDGV

SEQ ID NO: 772946 - protein, 17 aa, Mycobacterium
NITAYWKGYTEYHHDGV

SEQ ID NO: 772947 - protein, 17 aa, Mycobacterium
NITAYWKGYTEYHHEGL

SEQ ID NO: 772948 - protein, 18 aa, Mycobacterium
NIVCPWHGWRWRGDGTNA

SEQ ID NO: 772949 - protein, 17 aa, Mycobacterium
NIYRVVTNLGVFDFNGP

SEQ ID NO: 772950 - protein, 23 aa, Mycobacterium
NIYYRRALMLAACFGRHTTYPQR

SEQ ID NO: 772951 - protein, 25 aa, Mycobacterium
NKAIARFIVRFNDAFRKYGTSDNVL

SEQ ID NO: 772952 - protein, 20 aa, Mycobacterium
NKALRPGYVAAFSVPANQLP

SEQ ID NO: 772953 - protein, 23 aa, Mycobacterium
NKKGGAGWVEWGGCGMVNPNVLR

SEQ ID NO: 772954 - protein, 18 aa, Mycobacterium
NKLSCPIYTFIGSKDWIA

SEQ ID NO: 772955 - protein, 17 aa, Mycobacterium
NKRVCVRIVARRARSWD

SEQ ID NO: 772956 - protein, 19 aa, Mycobacterium
NKTRLAALRVKDFGKRDVM

SEQ ID NO: 772957 - protein, 23 aa, Mycobacterium
NKVMRRLVGMLARRGYHQSMALD

SEQ ID NO: 772958 - protein, 24 aa, Mycobacterium
NKVPGARCALAWSEQTASLAREHN

SEQ ID NO: 772959 - protein, 23 aa, Mycobacterium
NLAREFMELFALGHGNGYTEDDV

SEQ ID NO: 772960 - protein, 25 aa, Mycobacterium
NLASIPGALRWTWDTMKPLYANGAV

SEQ ID NO: 772961 - protein, 17 aa, Mycobacterium
NLAVKWAGKGIRVNAVA

SEQ ID NO: 772962 - protein, 17 aa, Mycobacterium
NLAVKWAPMGIRVNAVA

SEQ ID NO: 772963 - protein, 21 aa, Mycobacterium
NLAYRPPLYRVRTHDGLALCG

SEQ ID NO: 772964 - protein, 21 aa, Mycobacterium
NLDPAVLLAGWPVVESEVRRI

SEQ ID NO: 772965 - protein, 17 aa, Mycobacterium
NLDSCFVVTSAVLPRMK

SEQ ID NO: 772966 - protein, 17 aa, Mycobacterium
NLFTVFGPYGYVGSSYF

SEQ ID NO: 772967 - protein, 19 aa, Mycobacterium
NLGGLICWENWMPQARHAL

SEQ ID NO: 772968 - protein, 18 aa, Mycobacterium
NLGKLLTKRARVIGTTLR

SEQ ID NO: 772969 - protein, 21 aa, Mycobacterium
NLGLPELLGLNALGAPVNAAM

SEQ ID NO: 772970 - protein, 18 aa, Mycobacterium
NLGPKVRRLHYLSVPPKA

SEQ ID NO: 772971 - protein, 17 aa, Mycobacterium
NLHGWPFLLEARKNNGA

SEQ ID NO: 772972 - protein, 23 aa, Mycobacterium
NLIWQCPVVLLADVRSVGVQGDN

SEQ ID NO: 772973 - protein, 18 aa, Mycobacterium
NLLCGNIGSPVLDVLDQP

SEQ ID NO: 772974 - protein, 23 aa, Mycobacterium
NLLRLKAFFARQWRQMPAAHFMA

SEQ ID NO: 772975 - protein, 20 aa, Mycobacterium
NLNMAIPWTAAERGFIDAVI

SEQ ID NO: 772976 - protein, 20 aa, Mycobacterium
NLNMAIPWTAAERGFIDAVV

SEQ ID NO: 772977 - protein, 19 aa, Mycobacterium
NLNPVWRVGFQVREALRAN

SEQ ID NO: 772978 - protein, 23 aa, Mycobacterium
NLPLRPESVFAFGTIAELAAEYG

SEQ ID NO: 772979 - protein, 18 aa, Mycobacterium
NLPPLPGRCGPASRLHRR

SEQ ID NO: 772980 - protein, 17 aa, Mycobacterium
NLQAVGVPGGWLYALGD

SEQ ID NO: 772981 - protein, 26 aa, Mycobacterium
NLRHKGGRWYWHWDPRFIDGTAPHPP

SEQ ID NO: 772982 - protein, 18 aa, Mycobacterium
NLRLWNFYGQTEMAPLAS

SEQ ID NO: 772983 - protein, 19 aa, Mycobacterium
NLSIRLGVPCFPDDPLRFT

SEQ ID NO: 772984 - protein, 17 aa, Mycobacterium
NLVEYGFRLPSACDNRP

SEQ ID NO: 772985 - protein, 20 aa, Mycobacterium
NLVLASRGTPLWATATNGQQ

SEQ ID NO: 772986 - protein, 19 aa, Mycobacterium
NLYLAFGMLSWHLNDRELR

SEQ ID NO: 772987 - protein, 23 aa, Mycobacterium
NLYVYFWRWGTWKVFDANADQPN

SEQ ID NO: 772988 - protein, 22 aa, Mycobacterium
NMFALGLLSWMYGRELEASEAF

SEQ ID NO: 772989 - protein, 22 aa, Mycobacterium
NMFALGLLSWMYGRELEHSEAF

SEQ ID NO: 772990 - protein, 22 aa, Mycobacterium
NMFALGLLSWMYGRPIETSEKF

SEQ ID NO: 772991 - protein, 23 aa, Mycobacterium
NMFALGLLSWMYGRPIETSEKFI

SEQ ID NO: 772992 - protein, 23 aa, Mycobacterium
NMFALGLLSWMYGRPIRTSENFI

SEQ ID NO: 772993 - protein, 17 aa, Mycobacterium
NMFSITGPYGFVLGSYL

SEQ ID NO: 772994 - protein, 20 aa, Mycobacterium
NMILELLDAFGIPTAGAAGF

SEQ ID NO: 772995 - protein, 20 aa, Mycobacterium
NMPEIWKRLDAVGLQTTEAC

SEQ ID NO: 772996 - protein, 21 aa, Mycobacterium
NMPGYRGWQWAVVVAAYPGAD

SEQ ID NO: 772997 - protein, 21 aa, Mycobacterium
NNAEIRWRLDVWNASAQVVGD

SEQ ID NO: 772998 - protein, 17 aa, Mycobacterium
NNARWCSMAICGNRMKA

SEQ ID NO: 772999 - protein, 18 aa, Mycobacterium
NNAVRFAFWTAEEDGLAG

SEQ ID NO: 773000 - protein, 19 aa, Mycobacterium
NNEFIRRWLADLVAETGSG

SEQ ID NO: 773001 - protein, 25 aa, Mycobacterium
NNELGHPWTVLRAGRDTDYLILEMS

SEQ ID NO: 773002 - protein, 21 aa, Mycobacterium
NNELGHPWTVLRATRDTDFLV

SEQ ID NO: 773003 - protein, 17 aa, Mycobacterium
NNFEGWTALASWGEITT

SEQ ID NO: 773004 - protein, 18 aa, Mycobacterium
NNHLAFGFGTHFCLGNQL

SEQ ID NO: 773005 - protein, 21 aa, Mycobacterium
NNIEFLRFLLADERVQAGDLD

SEQ ID NO: 773006 - protein, 24 aa, Mycobacterium
NNPFGGPVGRIFAAAGFRRSRKNP

SEQ ID NO: 773007 - protein, 25 aa, Mycobacterium
NNRGRLSIDVLQRWGTDLLTALVAL

SEQ ID NO: 773008 - protein, 20 aa, Mycobacterium
NNTEVRWKLSLRVTPDAEPP

SEQ ID NO: 773009 - protein, 18 aa, Mycobacterium
NNVMELWSLLSITAPGLF

SEQ ID NO: 773010 - protein, 22 aa, Mycobacterium
NNWPSVFGGPAWTRVTEADGTP

SEQ ID NO: 773011 - protein, 19 aa, Mycobacterium
NPAGTEWQAAAVARATSAV

SEQ ID NO: 773012 - protein, 26 aa, Mycobacterium
NPALPIMTTTMLFFVRDMCSQSFCVR

SEQ ID NO: 773013 - protein, 18 aa, Mycobacterium
NPAVRVRVGGTWRNGTAH

SEQ ID NO: 773014 - protein, 23 aa, Mycobacterium
NPCGVCESCTALAPNAPGSIDVV

SEQ ID NO: 773015 - protein, 23 aa, Mycobacterium
NPDYGLRLSWDFLARSTAGLWEW

SEQ ID NO: 773016 - protein, 19 aa, Mycobacterium
NPEAWRWYREVIGAGRTPV

SEQ ID NO: 773017 - protein, 19 aa, Mycobacterium
NPEAWRWYREVIGGNRTPI

SEQ ID NO: 773018 - protein, 23 aa, Mycobacterium
NPEAWRWYRMAFGKDKTPIVDTW

SEQ ID NO: 773019 - protein, 19 aa, Mycobacterium
NPEIKGCWILARYNDGRPS

SEQ ID NO: 773020 - protein, 21 aa, Mycobacterium
NPEIRPAHLLMALLTQNDGIA

SEQ ID NO: 773021 - protein, 21 aa, Mycobacterium
NPEIRPAHLLVALLGQTDGIA

SEQ ID NO: 773022 - protein, 25 aa, Mycobacterium
NPERVWGWYLWRHYLVADVQPNTGH

SEQ ID NO: 773023 - protein, 25 aa, Mycobacterium
NPERVWGWYLWRHYLVATVEPNEGH

SEQ ID NO: 773024 - protein, 24 aa, Mycobacterium
NPEVIRFLAYTGLRWGEMAALRVC

SEQ ID NO: 773025 - protein, 19 aa, Mycobacterium
NPINIRWSPPEIAYALRDS

SEQ ID NO: 773026 - protein, 17 aa, Mycobacterium
NPKMKRFIFTDRNGIYI

SEQ ID NO: 773027 - protein, 21 aa, Mycobacterium
NPLPLLGIPVRLAQGGTTLYQ

SEQ ID NO: 773028 - protein, 20 aa, Mycobacterium
NPLRFLRAGLKWCRKAAELG

SEQ ID NO: 773029 - protein, 17 aa, Mycobacterium
NPLRFVSAAVKWCRKAE

SEQ ID NO: 773030 - protein, 18 aa, Mycobacterium
NPMARRRLEWQIEQSEDS

SEQ ID NO: 773031 - protein, 25 aa, Mycobacterium
NPMIGFRGCYRYVKEPELFALELEA

SEQ ID NO: 773032 - protein, 23 aa, Mycobacterium
NPNGGLLSRFVGLNVPSLGLDFY

SEQ ID NO: 773033 - protein, 24 aa, Mycobacterium
NPPDRPWNLPAWVNSLFGAAYYHN

SEQ ID NO: 773034 - protein, 20 aa, Mycobacterium
NPRITALMCTADVLALSAMD

SEQ ID NO: 773035 - protein, 23 aa, Mycobacterium
NPRRLAVTCVFRLHDGVNRAALE

SEQ ID NO: 773036 - protein, 24 aa, Mycobacterium
NPRTRSGIMALELLDATPDWDRFR

SEQ ID NO: 773037 - protein, 23 aa, Mycobacterium
NPRTRSGIMALELLDTTPDWDKF

SEQ ID NO: 773038 - protein, 23 aa, Mycobacterium
NPRTRSGIMALELLDTTPDWERF

SEQ ID NO: 773039 - protein, 23 aa, Mycobacterium
NPRTRSGIMALELLDTTPDWQQF

SEQ ID NO: 773040 - protein, 21 aa, Mycobacterium
NPRWCQLCFEKAPGGGVTLPI

SEQ ID NO: 773041 - protein, 19 aa, Mycobacterium
NPVKLRLGIGYVIQNAGLM

SEQ ID NO: 773042 - protein, 17 aa, Mycobacterium
NPVLEWITGTALVPVRE

SEQ ID NO: 773043 - protein, 21 aa, Mycobacterium
NPYQLSWWINRFTEIFQTIAR

SEQ ID NO: 773044 - protein, 18 aa, Mycobacterium
NPYRWGAGLIGRLMPTAV

SEQ ID NO: 773045 - protein, 17 aa, Mycobacterium
NQGAFGFSEPCADCRGT

SEQ ID NO: 773046 - protein, 18 aa, Mycobacterium
NQGDAVGGVGGRGGAGFA

SEQ ID NO: 773047 - protein, 23 aa, Mycobacterium
NQIWQCPVVLLADVRSVGVQGDG

SEQ ID NO: 773048 - protein, 23 aa, Mycobacterium
NQIWQCPVVLLADVRSVGVQGDN

SEQ ID NO: 773049 - protein, 23 aa, Mycobacterium
NQLRRMLADFGIDIDRYGLDDEI

SEQ ID NO: 773050 - protein, 17 aa, Mycobacterium
NQLVVWWLLDPPTGARS

SEQ ID NO: 773051 - protein, 22 aa, Mycobacterium
NQLWMCGLPGYGPGDLIDFEFS

SEQ ID NO: 773052 - protein, 24 aa, Mycobacterium
NQLWMCGLPGYYPGDLIDFEFSGD

SEQ ID NO: 773053 - protein, 24 aa, Mycobacterium
NQLWMCGLPGYYPGDLIDFQFAGD

SEQ ID NO: 773054 - protein, 17 aa, Mycobacterium
NQPAAAITAGMAMVPED

SEQ ID NO: 773055 - protein, 18 aa, Mycobacterium
NQQFALLFVDWLNADADV

SEQ ID NO: 773056 - protein, 18 aa, Mycobacterium
NQQFALLFVDWLRANPGA

SEQ ID NO: 773057 - protein, 23 aa, Mycobacterium
NQVKRLKVGTARRFSRTTEKSLV

SEQ ID NO: 773058 - protein, 17 aa, Mycobacterium
NRAAGRVKLSWFLLHAA

SEQ ID NO: 773059 - protein, 19 aa, Mycobacterium
NRAKLNWWESRALYGWTVL

SEQ ID NO: 773060 - protein, 30 aa, Mycobacterium
NRAKLNWWESRALYGWTVLVPRTKDQAGEM

SEQ ID NO: 773061 - protein, 24 aa, Mycobacterium
NRALRFDRAVTFGMRLDIPSGTAV

SEQ ID NO: 773062 - protein, 22 aa, Mycobacterium
NRARLAILVATNFFGQNTPAIA

SEQ ID NO: 773063 - protein, 25 aa, Mycobacterium
NREVRWRPEHFWKSGTAIDVAVNTY

SEQ ID NO: 773064 - protein, 17 aa, Mycobacterium
NRFTEIFQTIARDLEEF

SEQ ID NO: 773065 - protein, 20 aa, Mycobacterium
NRGSNNFGFGNTNSGNVGFG

SEQ ID NO: 773066 - protein, 20 aa, Mycobacterium
NRGVGAWGEILGDTTVAAAM

SEQ ID NO: 773067 - protein, 21 aa, Mycobacterium
NRHGWRAEHCDHFVIHQTSKA

SEQ ID NO: 773068 - protein, 23 aa, Mycobacterium
NRHRELHNAIALNSSYPSPGSAA

SEQ ID NO: 773069 - protein, 17 aa, Mycobacterium
NRIDLISGIGRFADEHT

SEQ ID NO: 773070 - protein, 17 aa, Mycobacterium
NRIKLLLVDDAQHLDPQ

SEQ ID NO: 773071 - protein, 17 aa, Mycobacterium
NRIRLLALIATNFFGQN

SEQ ID NO: 773072 - protein, 20 aa, Mycobacterium
NRISGGLAVRFARPGETVVT

SEQ ID NO: 773073 - protein, 20 aa, Mycobacterium
NRKSLTFALRFRAPDRTLTE

SEQ ID NO: 773074 - protein, 25 aa, Mycobacterium
NRKSRFPHRWWWVVLTEEPFPRFSV

SEQ ID NO: 773075 - protein, 22 aa, Mycobacterium
NRKVLPGYILVRMDLTDDSWAA

SEQ ID NO: 773076 - protein, 18 aa, Mycobacterium
NRLARWFIGQGFGPEDII

SEQ ID NO: 773077 - protein, 21 aa, Mycobacterium
NRLLPCLPTLLALSASSPFWA

SEQ ID NO: 773078 - protein, 19 aa, Mycobacterium
NRLRCYVVGVSRGAREPLI

SEQ ID NO: 773079 - protein, 18 aa, Mycobacterium
NRLRCYVVGVSRGSREPL

SEQ ID NO: 773080 - protein, 18 aa, Mycobacterium
NRLRPGVLRGECADPPKT

SEQ ID NO: 773081 - protein, 17 aa, Mycobacterium
NRLRPGVVRGEHTHHPT

SEQ ID NO: 773082 - protein, 21 aa, Mycobacterium
NRLYRGRCDLVVLSVALNLLD

SEQ ID NO: 773083 - protein, 20 aa, Mycobacterium
NRLYWMSAWIDPDGTNGGPI

SEQ ID NO: 773084 - protein, 17 aa, Mycobacterium
NRMFQLLGESDCTEQES

SEQ ID NO: 773085 - protein, 20 aa, Mycobacterium
NRPALEVLLLGGKPIREPVF

SEQ ID NO: 773086 - protein, 17 aa, Mycobacterium
NRPDLVGALVLFAGLQP

SEQ ID NO: 773087 - protein, 21 aa, Mycobacterium
NRPEFLDYFAAHHVQVPLRRG

SEQ ID NO: 773088 - protein, 20 aa, Mycobacterium
NRPGACLHLGLHLPAQAVGV

SEQ ID NO: 773089 - protein, 19 aa, Mycobacterium
NRPGDCLVKLGGAGDILAA

SEQ ID NO: 773090 - protein, 19 aa, Mycobacterium
NRPKIGWRRLEAQAVMSRL

SEQ ID NO: 773091 - protein, 23 aa, Mycobacterium
NRPKLPRLINMYGITETTVHASF

SEQ ID NO: 773092 - protein, 17 aa, Mycobacterium
NRPLLRPYLRGCLLESV

SEQ ID NO: 773093 - protein, 21 aa, Mycobacterium
NRPLRGCYRIALLSLKGGVGK

SEQ ID NO: 773094 - protein, 22 aa, Mycobacterium
NRPMRGCYRIALVSLKGGVGKT

SEQ ID NO: 773095 - protein, 17 aa, Mycobacterium
NRPNRRIVIMPTDDAAK

SEQ ID NO: 773096 - protein, 17 aa, Mycobacterium
NRPRWKIDELVEAKAGR

SEQ ID NO: 773097 - protein, 24 aa, Mycobacterium
NRRSRFPHRWWWVTLTDEAFPRLS

SEQ ID NO: 773098 - protein, 18 aa, Mycobacterium
NRSEYRPLDGFVYAITPF

SEQ ID NO: 773099 - protein, 19 aa, Mycobacterium
NRTMLSWLVATNALGQNIT

SEQ ID NO: 773100 - protein, 19 aa, Mycobacterium
NRTPIEWDGYTPPVPAMGA

SEQ ID NO: 773101 - protein, 19 aa, Mycobacterium
NRTPIEWDGYTPPVPAQGL

SEQ ID NO: 773102 - protein, 19 aa, Mycobacterium
NRTPIEWDGYTPPVPAQGV

SEQ ID NO: 773103 - protein, 21 aa, Mycobacterium
NRTVEVWGRLDVAFNNGATIQ

SEQ ID NO: 773104 - protein, 19 aa, Mycobacterium
NRVADAWIKAQAYRLQTFG

SEQ ID NO: 773105 - protein, 19 aa, Mycobacterium
NRVSYFFDLRGPSVTIDTA

SEQ ID NO: 773106 - protein, 19 aa, Mycobacterium
NRVVADLGATGWRLDDGEL

SEQ ID NO: 773107 - protein, 17 aa, Mycobacterium
NRYPRQWMTGTASSAVG

SEQ ID NO: 773108 - protein, 19 aa, Mycobacterium
NRYPRVCGMTGTALAAGEQ

SEQ ID NO: 773109 - protein, 23 aa, Mycobacterium
NSAALARTTGLLAAAEDEVSTAI

SEQ ID NO: 773110 - protein, 19 aa, Mycobacterium
NSCPLPDLLTYVGESAGLG

SEQ ID NO: 773111 - protein, 22 aa, Mycobacterium
NSDVAQAFHWVRHALRRPLAPG

SEQ ID NO: 773112 - protein, 22 aa, Mycobacterium
NSEAPCIGRWAALHAGLPISVP

SEQ ID NO: 773113 - protein, 22 aa, Mycobacterium
NSFRCPYHGWTFGNTGALQGVP

SEQ ID NO: 773114 - protein, 18 aa, Mycobacterium
NSIPWRLPEDLARFKEMT

SEQ ID NO: 773115 - protein, 24 aa, Mycobacterium
NSLITSWRALGWIGPAASEISETS

SEQ ID NO: 773116 - protein, 17 aa, Mycobacterium
NSMLYKRFRVRSQVWMF

SEQ ID NO: 773117 - protein, 18 aa, Mycobacterium
NSSYAYLLWCTDFPSTSA

SEQ ID NO: 773118 - protein, 17 aa, Mycobacterium
NSVEVISAVTNYLKSSQ

SEQ ID NO: 773119 - protein, 17 aa, Mycobacterium
NSVGLHWTSVGTGDFYT

SEQ ID NO: 773120 - protein, 17 aa, Mycobacterium
NTEVVVWTPRRATGRPL

SEQ ID NO: 773121 - protein, 23 aa, Mycobacterium
NTKELRPLIGVALQEVALDLWMS

SEQ ID NO: 773122 - protein, 20 aa, Mycobacterium
NTKSYCRLHHLIKTFRPGWT

SEQ ID NO: 773123 - protein, 17 aa, Mycobacterium
NTLRRWLREQNITNTAA

SEQ ID NO: 773124 - protein, 18 aa, Mycobacterium
NTMETWKRLCDPVAEQVS

SEQ ID NO: 773125 - protein, 29 aa, Mycobacterium
NTPGYSGVMGRLWLARGGTYVLANIRGGG

SEQ ID NO: 773126 - protein, 17 aa, Mycobacterium
NTRALDLLTRWGDALAA

SEQ ID NO: 773127 - protein, 22 aa, Mycobacterium
NTSYRLPLMRKLMFTENEDTDT

SEQ ID NO: 773128 - protein, 18 aa, Mycobacterium
NTVSLGWSSWAIQWLSRI

SEQ ID NO: 773129 - protein, 25 aa, Mycobacterium
NVAFRLSGIAGRAGRAPVMVTDVVH

SEQ ID NO: 773130 - protein, 18 aa, Mycobacterium
NVAISRAKFQAVIVRSPA

SEQ ID NO: 773131 - protein, 25 aa, Mycobacterium
NVATRLWPFWALCRIVYVVDEPNRR

SEQ ID NO: 773132 - protein, 19 aa, Mycobacterium
NVDLVYRFIRDTTWVSVRW

SEQ ID NO: 773133 - protein, 18 aa, Mycobacterium
NVDYSAFNEVHWVAPAEA

SEQ ID NO: 773134 - protein, 19 aa, Mycobacterium
NVEDFKFFWVTGLTADGKI

SEQ ID NO: 773135 - protein, 26 aa, Mycobacterium
NVEFRLRAGLIHDWFTFPFLPDAHED

SEQ ID NO: 773136 - protein, 20 aa, Mycobacterium
NVFGRRAGIAAADFADVHDF

SEQ ID NO: 773137 - protein, 24 aa, Mycobacterium
NVFGRRAGIAAARYARGHDFVDMP

SEQ ID NO: 773138 - protein, 17 aa, Mycobacterium
NVGCLPTKMFVYAADVA

SEQ ID NO: 773139 - protein, 17 aa, Mycobacterium
NVGCLPTKMFVYAAEVA

SEQ ID NO: 773140 - protein, 18 aa, Mycobacterium
NVKKAGFLPQERQWLTEV

SEQ ID NO: 773141 - protein, 17 aa, Mycobacterium
NVKKSGFLPEERAWVSG

SEQ ID NO: 773142 - protein, 26 aa, Mycobacterium
NVKMPSQRGWRHWLYVMTRINLGLSP

SEQ ID NO: 773143 - protein, 17 aa, Mycobacterium
NVKRIGPAWVFQAGASG

SEQ ID NO: 773144 - protein, 17 aa, Mycobacterium
NVLGFRFWWELDPPDGP

SEQ ID NO: 773145 - protein, 25 aa, Mycobacterium
NVLKIRPPLVFSMADVDWFCTEFAG

SEQ ID NO: 773146 - protein, 24 aa, Mycobacterium
NVLKIRPPLVFSRSDVDWFCTELD

SEQ ID NO: 773147 - protein, 20 aa, Mycobacterium
NVPEVFVVYWAALRSGLYIT

SEQ ID NO: 773148 - protein, 19 aa, Mycobacterium
NVPGFPNLFLLAGPGSGTN

SEQ ID NO: 773149 - protein, 21 aa, Mycobacterium
NVRARVALCGLISGYNSADPP

SEQ ID NO: 773150 - protein, 19 aa, Mycobacterium
NVSHEFRTPLTLLLGPLDD

SEQ ID NO: 773151 - protein, 19 aa, Mycobacterium
NVSHEFRTPLTLLLGPVED

SEQ ID NO: 773152 - protein, 23 aa, Mycobacterium
NVSLPVFVARAFGGIIEDVDGNR

SEQ ID NO: 773153 - protein, 17 aa, Mycobacterium
NVSTCLRGDFSGAHLTG

SEQ ID NO: 773154 - protein, 18 aa, Mycobacterium
NVTYRLGVFGGFELGDLA

SEQ ID NO: 773155 - protein, 22 aa, Mycobacterium
NVVCSVGLWARYRKLAVTARAL

SEQ ID NO: 773156 - protein, 17 aa, Mycobacterium
NVWAYAVIVCGHFADGA

SEQ ID NO: 773157 - protein, 24 aa, Mycobacterium
NVWPREVPELAPLVEEYTAQMRRV

SEQ ID NO: 773158 - protein, 17 aa, Mycobacterium
NVYRVVTNLGVFDFNGP

SEQ ID NO: 773159 - protein, 18 aa, Mycobacterium
NWDCPKLRVGAGSFITPV

SEQ ID NO: 773160 - protein, 22 aa, Mycobacterium
NWDYRYCWLRDASMTASALVAL

SEQ ID NO: 773161 - protein, 19 aa, Mycobacterium
NWFAAYAYWYFKLYGHRDV

SEQ ID NO: 773162 - protein, 19 aa, Mycobacterium
NWFWIKVPVGYLFTIANPR

SEQ ID NO: 773163 - protein, 18 aa, Mycobacterium
NWGGYRIAPEVVEFWQGR

SEQ ID NO: 773164 - protein, 20 aa, Mycobacterium
NWMEFVWKPGYADYYPELPG

SEQ ID NO: 773165 - protein, 18 aa, Mycobacterium
NWPWRRWALSWTANTYAR

SEQ ID NO: 773166 - protein, 19 aa, Mycobacterium
NWPWRRWALSWTANTYARL

SEQ ID NO: 773167 - protein, 25 aa, Mycobacterium
NWSALPLEWPLRGWINGALGVIRPR

SEQ ID NO: 773168 - protein, 19 aa, Mycobacterium
NWWEWRELIGPLAADGYRV

SEQ ID NO: 773169 - protein, 19 aa, Mycobacterium
NWYRCFDRNWELTAETPAP

SEQ ID NO: 773170 - protein, 19 aa, Mycobacterium
NWYTEFARIVPLMEKDTHY

SEQ ID NO: 773171 - protein, 20 aa, Mycobacterium
NWYTEFARLAPLMEKDTHYE

SEQ ID NO: 773172 - protein, 20 aa, Mycobacterium
NWYTEFARLAPLMEKDVHYE

SEQ ID NO: 773173 - protein, 19 aa, Mycobacterium
NYAKSLRMFAVLPTIVATD

SEQ ID NO: 773174 - protein, 18 aa, Mycobacterium
NYEAVVAFSERLAGLLPD

SEQ ID NO: 773175 - protein, 17 aa, Mycobacterium
NYGTLYHALGWTITPTS

SEQ ID NO: 773176 - protein, 18 aa, Mycobacterium
NYVAVPWFWTHQYSAKLQ

SEQ ID NO: 773177 - protein, 21 aa, Mycobacterium
NYWGVRGCDDFLTGMTHVVSP

SEQ ID NO: 773178 - protein, 17 aa, Mycobacterium
PAAAPYRSFVSWLAARD

SEQ ID NO: 773179 - protein, 18 aa, Mycobacterium
PAAAYAFSKLAIALFTRE

SEQ ID NO: 773180 - protein, 18 aa, Mycobacterium
PAAIFALPVCRRPAGDTV

SEQ ID NO: 773181 - protein, 22 aa, Mycobacterium
PAAIRLLGAIGYRVVLLETVGV

SEQ ID NO: 773182 - protein, 17 aa, Mycobacterium
PAAMPGFGWPTAVLSGG

SEQ ID NO: 773183 - protein, 19 aa, Mycobacterium
PAAPSWRKGPRHIAGRGPR

SEQ ID NO: 773184 - protein, 20 aa, Mycobacterium
PAAPSWRKGPRHIAGRGPRD

SEQ ID NO: 773185 - protein, 21 aa, Mycobacterium
PAAPSYRSFVSWLDRQDRSAA

SEQ ID NO: 773186 - protein, 18 aa, Mycobacterium
PAAPSYRSFVTWLSEQDR

SEQ ID NO: 773187 - protein, 18 aa, Mycobacterium
PAAPSYRSFVTWLTNQDR

SEQ ID NO: 773188 - protein, 17 aa, Mycobacterium
PAAPYAKAVREWEQLER

SEQ ID NO: 773189 - protein, 25 aa, Mycobacterium
PAARDLACRWAREWVDRLSALNRPQ

SEQ ID NO: 773190 - protein, 24 aa, Mycobacterium
PAARPRIRLAYRLTPTRVLGEQRV

SEQ ID NO: 773191 - protein, 20 aa, Mycobacterium
PAAVCPHVEWALSSTLGAKA

SEQ ID NO: 773192 - protein, 20 aa, Mycobacterium
PAAVCPHVEWALSSTLGSKA

SEQ ID NO: 773193 - protein, 20 aa, Mycobacterium
PAAVCPHVEWALSSTLHAKA

SEQ ID NO: 773194 - protein, 17 aa, Mycobacterium
PAAVLLHLGPGLGNGLA

SEQ ID NO: 773195 - protein, 20 aa, Mycobacterium
PAAVVPWDFDDDGMPISIQL

SEQ ID NO: 773196 - protein, 18 aa, Mycobacterium
PAAWWHAWAPADWDRLAG

SEQ ID NO: 773197 - protein, 20 aa, Mycobacterium
PACGAGRAALTPGAPSADVS

SEQ ID NO: 773198 - protein, 20 aa, Mycobacterium
PACIKAMIEKVVDRMYAEID

SEQ ID NO: 773199 - protein, 18 aa, Mycobacterium
PACKCKHVYFAHPNEGPC

SEQ ID NO: 773200 - protein, 23 aa, Mycobacterium
PACQAGDYSLCWSFTDGVLSPGI

SEQ ID NO: 773201 - protein, 18 aa, Mycobacterium
PADCLRPLQVHALVSEVL

SEQ ID NO: 773202 - protein, 19 aa, Mycobacterium
PADDVYLVFTTNEEIGGVG

SEQ ID NO: 773203 - protein, 19 aa, Mycobacterium
PADFRLWVCLHEVTHRVQF

SEQ ID NO: 773204 - protein, 21 aa, Mycobacterium
PADLRVCPAHHELSAAARAFK

SEQ ID NO: 773205 - protein, 22 aa, Mycobacterium
PADRLAGLFAEFSRVLADPGWL

SEQ ID NO: 773206 - protein, 19 aa, Mycobacterium
PADVLPLWVAEMDVHLPPT

SEQ ID NO: 773207 - protein, 19 aa, Mycobacterium
PADWEPLGAIAIGYAAEPA

SEQ ID NO: 773208 - protein, 19 aa, Mycobacterium
PAEAIAALLQRYPDAESVK

SEQ ID NO: 773209 - protein, 18 aa, Mycobacterium
PAEAIVVGPLHFEPTDQL

SEQ ID NO: 773210 - protein, 18 aa, Mycobacterium
PAEAVWACRSMAATHYAS

SEQ ID NO: 773211 - protein, 18 aa, Mycobacterium
PAECPGRNLVLFTTSTLA

SEQ ID NO: 773212 - protein, 17 aa, Mycobacterium
PAELALRLIPGYVVTPT

SEQ ID NO: 773213 - protein, 20 aa, Mycobacterium
PAELKANWLPESQYVNVIQY

SEQ ID NO: 773214 - protein, 20 aa, Mycobacterium
PAELRPALQRAFASGLPSVV

SEQ ID NO: 773215 - protein, 19 aa, Mycobacterium
PAENGVVMKTRWEGHTKDG

SEQ ID NO: 773216 - protein, 23 aa, Mycobacterium
PAERAARLWYRRFFADSGAAEGR

SEQ ID NO: 773217 - protein, 19 aa, Mycobacterium
PAGAVWRIGDDVTHRELGH

SEQ ID NO: 773218 - protein, 17 aa, Mycobacterium
PAGELLPLMSLPAQMQQ

SEQ ID NO: 773219 - protein, 18 aa, Mycobacterium
PAGEQRLVVELARGSGAR

SEQ ID NO: 773220 - protein, 18 aa, Mycobacterium
PAGGLSWGQVVAGEDALG

SEQ ID NO: 773221 - protein, 18 aa, Mycobacterium
PAGLGVFVGVPTFGDGGG

SEQ ID NO: 773222 - protein, 19 aa, Mycobacterium
PAGLLSFFLSNPVYALSLV

SEQ ID NO: 773223 - protein, 18 aa, Mycobacterium
PAGRIGALAAEFTLDLNP

SEQ ID NO: 773224 - protein, 18 aa, Mycobacterium
PAGRLWANPDCGLKTRNV

SEQ ID NO: 773225 - protein, 20 aa, Mycobacterium
PAGSAIAVVARRAGSGPGVT

SEQ ID NO: 773226 - protein, 18 aa, Mycobacterium
PAGSMPVGLAPMLPTTGS

SEQ ID NO: 773227 - protein, 17 aa, Mycobacterium
PAGSVLIEFGHTKVMCT

SEQ ID NO: 773228 - protein, 18 aa, Mycobacterium
PAHDAARYDQVWKEHVLP

SEQ ID NO: 773229 - protein, 20 aa, Mycobacterium
PAISAFNAWVLLKGLETLAV

SEQ ID NO: 773230 - protein, 18 aa, Mycobacterium
PAISLPLHWTADGLPLGV

SEQ ID NO: 773231 - protein, 18 aa, Mycobacterium
PAKRAGTATALWHLSERL

SEQ ID NO: 773232 - protein, 17 aa, Mycobacterium
PAKRKKPVLKRITESFK

SEQ ID NO: 773233 - protein, 24 aa, Mycobacterium
PALAALCDIFYPRVYLRRGAIVPA

SEQ ID NO: 773234 - protein, 19 aa, Mycobacterium
PALCRAVGRPEWRDDPRFA

SEQ ID NO: 773235 - protein, 17 aa, Mycobacterium
PALESALAILRDITSGP

SEQ ID NO: 773236 - protein, 17 aa, Mycobacterium
PALFEAISLSYLGPLGL

SEQ ID NO: 773237 - protein, 21 aa, Mycobacterium
PALKEIDGWLGLSLLVDRQSG

SEQ ID NO: 773238 - protein, 19 aa, Mycobacterium
PALLRKQLKGAPMPAPKAI

SEQ ID NO: 773239 - protein, 22 aa, Mycobacterium
PALPAARIEFMLSDTAPVAALT

SEQ ID NO: 773240 - protein, 22 aa, Mycobacterium
PALPAARIEFMLSDTAPVAAVS

SEQ ID NO: 773241 - protein, 18 aa, Mycobacterium
PALPAARMEFMLTDAAPI

SEQ ID NO: 773242 - protein, 27 aa, Mycobacterium
PALPLGWADVWMGCQFPSKIVADYADR

SEQ ID NO: 773243 - protein, 24 aa, Mycobacterium
PALPRLMRRLVIMGGAFDYKGNTT

SEQ ID NO: 773244 - protein, 22 aa, Mycobacterium
PALRFELCLGVSGVHYPDDTGR

SEQ ID NO: 773245 - protein, 19 aa, Mycobacterium
PALRRAHGQVVFINSGSGR

SEQ ID NO: 773246 - protein, 18 aa, Mycobacterium
PALRRARGQVIFINSGAG

SEQ ID NO: 773247 - protein, 17 aa, Mycobacterium
PALVAWKLGCSSANAHT

SEQ ID NO: 773248 - protein, 17 aa, Mycobacterium
PALVAWKLGCSSGNAHT

SEQ ID NO: 773249 - protein, 17 aa, Mycobacterium
PALVCLLRSLTLRMTTA

SEQ ID NO: 773250 - protein, 21 aa, Mycobacterium
PALVGHGGWERLQRFAVITQF

SEQ ID NO: 773251 - protein, 17 aa, Mycobacterium
PALVGMPKWYAENGQYL

SEQ ID NO: 773252 - protein, 19 aa, Mycobacterium
PAMAQRTLWAPYWQLLMNA

SEQ ID NO: 773253 - protein, 17 aa, Mycobacterium
PAMAWRYLQLDADDTDP

SEQ ID NO: 773254 - protein, 18 aa, Mycobacterium
PAMIDWLLDQHLRFRRAI

SEQ ID NO: 773255 - protein, 18 aa, Mycobacterium
PAMIRAGGKMWGADGRQK

SEQ ID NO: 773256 - protein, 20 aa, Mycobacterium
PAMSAFNAWVLLKGLETLAV

SEQ ID NO: 773257 - protein, 21 aa, Mycobacterium
PAMSAFNAWVLLKGLETMAIR

SEQ ID NO: 773258 - protein, 18 aa, Mycobacterium
PANIDFAKSLGFKPEVGI

SEQ ID NO: 773259 - protein, 19 aa, Mycobacterium
PANIGLAVADAVNFPAELQ

SEQ ID NO: 773260 - protein, 25 aa, Mycobacterium
PANWLLAARCARGFLSMSSEKPDPA

SEQ ID NO: 773261 - protein, 25 aa, Mycobacterium
PANWWLAARCVRGFLSMSSGKPDPA

SEQ ID NO: 773262 - protein, 18 aa, Mycobacterium
PAPEFETWLRKVGMVDDA

SEQ ID NO: 773263 - protein, 17 aa, Mycobacterium
PAPFFAQRKIFITGANG

SEQ ID NO: 773264 - protein, 17 aa, Mycobacterium
PAPHCRTPIDAYSLTVE

SEQ ID NO: 773265 - protein, 18 aa, Mycobacterium
PAPIRLSPPIGIKGVTYA

SEQ ID NO: 773266 - protein, 19 aa, Mycobacterium
PAPLLRWGINQFDLDQRPT

SEQ ID NO: 773267 - protein, 19 aa, Mycobacterium
PAPPGLRANMIFSADGAAA

SEQ ID NO: 773268 - protein, 19 aa, Mycobacterium
PAPSAGWRKTVYRASFGTI

SEQ ID NO: 773269 - protein, 19 aa, Mycobacterium
PAPTLPMLLPLKDIGVPQP

SEQ ID NO: 773270 - protein, 18 aa, Mycobacterium
PAPVAYRRFVTWLSGQDN

SEQ ID NO: 773271 - protein, 19 aa, Mycobacterium
PAPVPGFRGTRSFGTEEFD

SEQ ID NO: 773272 - protein, 21 aa, Mycobacterium
PAPVPGYRGSRSFGFEEFDPF

SEQ ID NO: 773273 - protein, 21 aa, Mycobacterium
PAPVPGYRGSRSFGLEEFDPF

SEQ ID NO: 773274 - protein, 19 aa, Mycobacterium
PAQLIPTFQWERMLDQDAK

SEQ ID NO: 773275 - protein, 17 aa, Mycobacterium
PAQMAAFLGVLLSGATV

SEQ ID NO: 773276 - protein, 20 aa, Mycobacterium
PAQQRPLLHPSLEDEDAHYE

SEQ ID NO: 773277 - protein, 18 aa, Mycobacterium
PAQRWGVATGHERILLCG

SEQ ID NO: 773278 - protein, 26 aa, Mycobacterium
PAQSRASGVLPRYGVRLTVMAHPPAA

SEQ ID NO: 773279 - protein, 24 aa, Mycobacterium
PARLLVPHLYFWKSAKWVRSIELC

SEQ ID NO: 773280 - protein, 19 aa, Mycobacterium
PARWARWAAPCPIGDAEIR

SEQ ID NO: 773281 - protein, 19 aa, Mycobacterium
PASALLFFLASSRILNRRK

SEQ ID NO: 773282 - protein, 22 aa, Mycobacterium
PASARGSLRLSLGHTSTEADIE

SEQ ID NO: 773283 - protein, 20 aa, Mycobacterium
PASARGSLRLSLGHTSVDAD

SEQ ID NO: 773284 - protein, 20 aa, Mycobacterium
PASARGSLRLSLGHTTVEAD

SEQ ID NO: 773285 - protein, 18 aa, Mycobacterium
PASGRGPVASAISAGSSA

SEQ ID NO: 773286 - protein, 20 aa, Mycobacterium
PASNAAVCWAARDAALRHVP

SEQ ID NO: 773287 - protein, 20 aa, Mycobacterium
PASNAAVCWAARDAAMRNVQ

SEQ ID NO: 773288 - protein, 24 aa, Mycobacterium
PASRPRIRLAYRLTPRRVLGPQRA

SEQ ID NO: 773289 - protein, 20 aa, Mycobacterium
PASYWRRWSICKSVVLRVEL

SEQ ID NO: 773290 - protein, 20 aa, Mycobacterium
PATARLTGRWMRGRLPTVSD

SEQ ID NO: 773291 - protein, 22 aa, Mycobacterium
PATFGFNWQQSPGFFNSSDTPS

SEQ ID NO: 773292 - protein, 18 aa, Mycobacterium
PATGSFSGTGTWLPLLRS

SEQ ID NO: 773293 - protein, 18 aa, Mycobacterium
PATPIIRWLEGVDGPVEE

SEQ ID NO: 773294 - protein, 30 aa, Mycobacterium
PATPWLATTVRLAWRAKLMISASVDARIRL

SEQ ID NO: 773295 - protein, 19 aa, Mycobacterium
PATVVDWGLWKSWADAQPQ

SEQ ID NO: 773296 - protein, 20 aa, Mycobacterium
PATVVEFGMSFGISAVHLAA

SEQ ID NO: 773297 - protein, 18 aa, Mycobacterium
PATYFAGGKIQWILENVP

SEQ ID NO: 773298 - protein, 26 aa, Mycobacterium
PAVMTAYRIGFRFIWEQTLAAARASG

SEQ ID NO: 773299 - protein, 17 aa, Mycobacterium
PAVPCARAARRPHPVHR

SEQ ID NO: 773300 - protein, 20 aa, Mycobacterium
PAVRFVCSWATTDQEVDDVL

SEQ ID NO: 773301 - protein, 17 aa, Mycobacterium
PAVRMGWVSSELAMFRG

SEQ ID NO: 773302 - protein, 17 aa, Mycobacterium
PAVRVGRSFRVHAKAVH

SEQ ID NO: 773303 - protein, 18 aa, Mycobacterium
PAVVYCHAGGFALGNLDT

SEQ ID NO: 773304 - protein, 22 aa, Mycobacterium
PAWDAVCFRLGLLSTLEARAVL

SEQ ID NO: 773305 - protein, 21 aa, Mycobacterium
PAYRWPLVPALALVAAMPALG

SEQ ID NO: 773306 - protein, 20 aa, Mycobacterium
PCALLSCAIPTGYGSAANRA

SEQ ID NO: 773307 - protein, 18 aa, Mycobacterium
PCAWSAEGLLRYLPATAQ

SEQ ID NO: 773308 - protein, 17 aa, Mycobacterium
PCFRELYSELGLEQTDI

SEQ ID NO: 773309 - protein, 19 aa, Mycobacterium
PCGISAFGVLEQFVEQLLA

SEQ ID NO: 773310 - protein, 18 aa, Mycobacterium
PCGNCDRCRDDSRPTSSG

SEQ ID NO: 773311 - protein, 22 aa, Mycobacterium
PCGVCDSCQALAPNAPGSIDVV

SEQ ID NO: 773312 - protein, 18 aa, Mycobacterium
PCLAAAWEHHIMQITDLS

SEQ ID NO: 773313 - protein, 20 aa, Mycobacterium
PCLECKLCVAVCPVGAIGKN

SEQ ID NO: 773314 - protein, 18 aa, Mycobacterium
PCLPCGVHMYLGGGKTLD

SEQ ID NO: 773315 - protein, 17 aa, Mycobacterium
PCLPCGVHMYLGKGKTL

SEQ ID NO: 773316 - protein, 18 aa, Mycobacterium
PCLPCGVHMYLGKGKTLE

SEQ ID NO: 773317 - protein, 22 aa, Mycobacterium
PCLQSRIAAAWLWSRGSATVGG

SEQ ID NO: 773318 - protein, 22 aa, Mycobacterium
PCSMKPRSDLVLQIAGTSDIAK

SEQ ID NO: 773319 - protein, 17 aa, Mycobacterium
PCWKVHLDTGLASDDTP

SEQ ID NO: 773320 - protein, 17 aa, Mycobacterium
PDAAPGILIPFFASHTQ

SEQ ID NO: 773321 - protein, 22 aa, Mycobacterium
PDADRAAAFYGHVLGWTYDPAT

SEQ ID NO: 773322 - protein, 17 aa, Mycobacterium
PDAGLVLREVGLEVLGS

SEQ ID NO: 773323 - protein, 18 aa, Mycobacterium
PDAGLVLREVGLEVMGSA

SEQ ID NO: 773324 - protein, 18 aa, Mycobacterium
PDAIPVLFGHIGEGNLHL

SEQ ID NO: 773325 - protein, 18 aa, Mycobacterium
PDAISLVLSHRAPHRVVV

SEQ ID NO: 773326 - protein, 17 aa, Mycobacterium
PDALARFPITRLVSSPQ

SEQ ID NO: 773327 - protein, 20 aa, Mycobacterium
PDALDVWPAYALKIAPTPTL

SEQ ID NO: 773328 - protein, 18 aa, Mycobacterium
PDALIGFLGPRVYEHLYG

SEQ ID NO: 773329 - protein, 22 aa, Mycobacterium
PDARGLGVLVCFAGTVRAPLGL

SEQ ID NO: 773330 - protein, 20 aa, Mycobacterium
PDAYCTTVFLAILDTESGIL

SEQ ID NO: 773331 - protein, 17 aa, Mycobacterium
PDCARGRLCSGCGRGRI

SEQ ID NO: 773332 - protein, 19 aa, Mycobacterium
PDCCAVVAYGALLREELLA

SEQ ID NO: 773333 - protein, 17 aa, Mycobacterium
PDCGVALEDAEPGHHHE

SEQ ID NO: 773334 - protein, 18 aa, Mycobacterium
PDCTRVVNEWVIERNRNY

SEQ ID NO: 773335 - protein, 17 aa, Mycobacterium
PDDAWLASWSRAEAAVP

SEQ ID NO: 773336 - protein, 18 aa, Mycobacterium
PDDEFAFVVHGTMADPRW

SEQ ID NO: 773337 - protein, 18 aa, Mycobacterium
PDEAWLRRELDAERRHCF

SEQ ID NO: 773338 - protein, 22 aa, Mycobacterium
PDEEKLAWARRVLVAARTERGV

SEQ ID NO: 773339 - protein, 20 aa, Mycobacterium
PDEFRIQLAWLRQSPPDSAN

SEQ ID NO: 773340 - protein, 21 aa, Mycobacterium
PDEIASAIAFLLSDEASFVTA

SEQ ID NO: 773341 - protein, 20 aa, Mycobacterium
PDELRRHIGYVIQGAGLFPH

SEQ ID NO: 773342 - protein, 18 aa, Mycobacterium
PDELRRHIGYVVQGAGLF

SEQ ID NO: 773343 - protein, 26 aa, Mycobacterium
PDELRRWIPLLSRFRVVSVRGPRSAQ

SEQ ID NO: 773344 - protein, 21 aa, Mycobacterium
PDELRTLFLFEALTEAQLAVL

SEQ ID NO: 773345 - protein, 23 aa, Mycobacterium
PDEPRPGFDPCGALADRYKAKAE

SEQ ID NO: 773346 - protein, 21 aa, Mycobacterium
PDEPWMICELDLHQMLHVTAG

SEQ ID NO: 773347 - protein, 19 aa, Mycobacterium
PDERGMRTVMCILNGQLRP

SEQ ID NO: 773348 - protein, 19 aa, Mycobacterium
PDEVPGVLLARGLAEESGK

SEQ ID NO: 773349 - protein, 18 aa, Mycobacterium
PDEVRRHMGLTGQVATVD

SEQ ID NO: 773350 - protein, 17 aa, Mycobacterium
PDFAVGLQPARWGTGFI

SEQ ID NO: 773351 - protein, 20 aa, Mycobacterium
PDFIRLGLMLALERRPAEPR

SEQ ID NO: 773352 - protein, 20 aa, Mycobacterium
PDFIRLGLMLALERRPTEPR

SEQ ID NO: 773353 - protein, 22 aa, Mycobacterium
PDFLSIEIFRPLDLAMVVDPIS

SEQ ID NO: 773354 - protein, 19 aa, Mycobacterium
PDFRVLRKLLAVPLYLDAP

SEQ ID NO: 773355 - protein, 18 aa, Mycobacterium
PDFSELLAGFPSFAGPRV

SEQ ID NO: 773356 - protein, 24 aa, Mycobacterium
PDFVKLAEALGCVGLRCERAEDVE

SEQ ID NO: 773357 - protein, 24 aa, Mycobacterium
PDFVKLAEALGCVGLRCEREEDVA

SEQ ID NO: 773358 - protein, 19 aa, Mycobacterium
PDFVPRVTAILGDLRQLEA

SEQ ID NO: 773359 - protein, 18 aa, Mycobacterium
PDFWQWLIGEVKAADPDV

SEQ ID NO: 773360 - protein, 17 aa, Mycobacterium
PDFWSWLIGQVKTIHPD

SEQ ID NO: 773361 - protein, 19 aa, Mycobacterium
PDGEVWVHCASGYRSSIAA

SEQ ID NO: 773362 - protein, 24 aa, Mycobacterium
PDGISCLRFRLRWKGFRVTVQANH

SEQ ID NO: 773363 - protein, 18 aa, Mycobacterium
PDGKVRWFLGIPYAAPPV

SEQ ID NO: 773364 - protein, 17 aa, Mycobacterium
PDGLPVWIYQFKISTHP

SEQ ID NO: 773365 - protein, 17 aa, Mycobacterium
PDGLPVWIYQFKVSPHR

SEQ ID NO: 773366 - protein, 17 aa, Mycobacterium
PDGPGWRITGQKVWTSY

SEQ ID NO: 773367 - protein, 25 aa, Mycobacterium
PDGRDCPDWVPGELWVGGRGIARGY

SEQ ID NO: 773368 - protein, 17 aa, Mycobacterium
PDGRMIRLDMGWREQQV

SEQ ID NO: 773369 - protein, 21 aa, Mycobacterium
PDGVLRWLALDGQPVHQFTVA

SEQ ID NO: 773370 - protein, 24 aa, Mycobacterium
PDGVLRWLALDGRPIHQFTVAASE

SEQ ID NO: 773371 - protein, 23 aa, Mycobacterium
PDGVPRWLALDGTPLHHATVAAS

SEQ ID NO: 773372 - protein, 18 aa, Mycobacterium
PDGWWKDRGRAMVVLVDR

SEQ ID NO: 773373 - protein, 17 aa, Mycobacterium
PDHGITIGFVFRALTGE

SEQ ID NO: 773374 - protein, 21 aa, Mycobacterium
PDHLRPGSVGQRLPYQQVKIA

SEQ ID NO: 773375 - protein, 17 aa, Mycobacterium
PDHPWAREHRNWFTQLP

SEQ ID NO: 773376 - protein, 25 aa, Mycobacterium
PDIARLKARMGWRMPWFTLTDDFDA

SEQ ID NO: 773377 - protein, 17 aa, Mycobacterium
PDIDLRRTVGWFTTYYP

SEQ ID NO: 773378 - protein, 19 aa, Mycobacterium
PDIDWDKGAALAWIRSLIF

SEQ ID NO: 773379 - protein, 17 aa, Mycobacterium
PDIDWDKGKTLRWVIDH

SEQ ID NO: 773380 - protein, 17 aa, Mycobacterium
PDIPGYAAKVFRAIADA

SEQ ID NO: 773381 - protein, 18 aa, Mycobacterium
PDIRCCILTGAGGYFCAG

SEQ ID NO: 773382 - protein, 23 aa, Mycobacterium
PDKFWAGFCRRMGLAELVADERF

SEQ ID NO: 773383 - protein, 22 aa, Mycobacterium
PDKPWKGGRWVVRTETGSRLPL

SEQ ID NO: 773384 - protein, 24 aa, Mycobacterium
PDKRGLLPFRVWQFYDAMVGFAKS

SEQ ID NO: 773385 - protein, 19 aa, Mycobacterium
PDKYLRIVAAMARENMSVT

SEQ ID NO: 773386 - protein, 17 aa, Mycobacterium
PDLAAGCGFENPTLYRC

SEQ ID NO: 773387 - protein, 18 aa, Mycobacterium
PDLATGLQPMRWGTGYML

SEQ ID NO: 773388 - protein, 22 aa, Mycobacterium
PDLDAATWLHRWHVDHTPVAIE

SEQ ID NO: 773389 - protein, 17 aa, Mycobacterium
PDLDLDRVLTPAGREAA

SEQ ID NO: 773390 - protein, 20 aa, Mycobacterium
PDLDVDLVYRFIRDTTWVSV

SEQ ID NO: 773391 - protein, 22 aa, Mycobacterium
PDLDVDLVYRFIRDTTWVSVRW

SEQ ID NO: 773392 - protein, 18 aa, Mycobacterium
PDLEVCVYAAPTQTVIGG

SEQ ID NO: 773393 - protein, 17 aa, Mycobacterium
PDLFPAWDSLSEAQQKL

SEQ ID NO: 773394 - protein, 19 aa, Mycobacterium
PDLFREWMEAAGIDQLAFD

SEQ ID NO: 773395 - protein, 25 aa, Mycobacterium
PDLGFKRRSCCLFYRVPGGGTCGDC

SEQ ID NO: 773396 - protein, 18 aa, Mycobacterium
PDLGRFGSFGWGVTPQQA

SEQ ID NO: 773397 - protein, 21 aa, Mycobacterium
PDLGRFGVWLGSRSITPGLAR

SEQ ID NO: 773398 - protein, 18 aa, Mycobacterium
PDLIPVFIEEALRTQSPT

SEQ ID NO: 773399 - protein, 17 aa, Mycobacterium
PDLPGLHTGLWAQYLLD

SEQ ID NO: 773400 - protein, 21 aa, Mycobacterium
PDLPLLCAEEVDRACAPWGLM

SEQ ID NO: 773401 - protein, 22 aa, Mycobacterium
PDLPLRFALNLSVFVGVTAEGT

SEQ ID NO: 773402 - protein, 17 aa, Mycobacterium
PDLPPLWQAFGAGRRAD

SEQ ID NO: 773403 - protein, 18 aa, Mycobacterium
PDLPRWALTLGFGSQCVP

SEQ ID NO: 773404 - protein, 18 aa, Mycobacterium
PDLPSWRSAIDVATREWV

SEQ ID NO: 773405 - protein, 19 aa, Mycobacterium
PDLRGRFAVVTGANSGLGF

SEQ ID NO: 773406 - protein, 17 aa, Mycobacterium
PDLRVLVDLGYGNIGVG

SEQ ID NO: 773407 - protein, 20 aa, Mycobacterium
PDLSCPLLGLFGLDDRFPAP

SEQ ID NO: 773408 - protein, 17 aa, Mycobacterium
PDLSVRWLIGVARHKLA

SEQ ID NO: 773409 - protein, 22 aa, Mycobacterium
PDLTSGAFARYLADYIHEQGWQ

SEQ ID NO: 773410 - protein, 17 aa, Mycobacterium
PDLVGALVLFAGLQPSP

SEQ ID NO: 773411 - protein, 17 aa, Mycobacterium
PDLWAAVVLVDITPRME

SEQ ID NO: 773412 - protein, 17 aa, Mycobacterium
PDMATGGMPMRWGTGYM

SEQ ID NO: 773413 - protein, 20 aa, Mycobacterium
PDMFTRLLLSLLITGVAPRS

SEQ ID NO: 773414 - protein, 23 aa, Mycobacterium
PDMKLPIALALGWPDRIAGAAAA

SEQ ID NO: 773415 - protein, 18 aa, Mycobacterium
PDMLSRAAALNWDTNAPA

SEQ ID NO: 773416 - protein, 20 aa, Mycobacterium
PDMTEWWAYLDSVQATYPLS

SEQ ID NO: 773417 - protein, 18 aa, Mycobacterium
PDMWSVLEYGCHVRDVHR

SEQ ID NO: 773418 - protein, 19 aa, Mycobacterium
PDNPWRGSFAQLYLAAVQA

SEQ ID NO: 773419 - protein, 18 aa, Mycobacterium
PDPELVPFVTWTYDDNTT

SEQ ID NO: 773420 - protein, 18 aa, Mycobacterium
PDPFCALEAGWLSHIDHD

SEQ ID NO: 773421 - protein, 22 aa, Mycobacterium
PDPRLDLVRAFSRYFNVDPSYF

SEQ ID NO: 773422 - protein, 20 aa, Mycobacterium
PDPRLTELARMFGSEKIVPA

SEQ ID NO: 773423 - protein, 17 aa, Mycobacterium
PDPVALLRCCGGADLAA

SEQ ID NO: 773424 - protein, 17 aa, Mycobacterium
PDPWPMYRALRDQDPVH

SEQ ID NO: 773425 - protein, 19 aa, Mycobacterium
PDQAAVWGFVRSARAEAPG

SEQ ID NO: 773426 - protein, 19 aa, Mycobacterium
PDQTCLWGFGRAASLEHPQ

SEQ ID NO: 773427 - protein, 17 aa, Mycobacterium
PDQWPALTAPPATAAPA

SEQ ID NO: 773428 - protein, 17 aa, Mycobacterium
PDRAAAIAARLRVGTVN

SEQ ID NO: 773429 - protein, 20 aa, Mycobacterium
PDRACWALQHLLSRRYISKH

SEQ ID NO: 773430 - protein, 17 aa, Mycobacterium
PDRCVAVLAALPAWTGE

SEQ ID NO: 773431 - protein, 19 aa, Mycobacterium
PDRHPHCAWTVVIDESHPA

SEQ ID NO: 773432 - protein, 27 aa, Mycobacterium
PDRITRLIFWSAFVPRPGRSITEEVEQ

SEQ ID NO: 773433 - protein, 23 aa, Mycobacterium
PDRLRSGWLNGIKHWQVDYSGRG

SEQ ID NO: 773434 - protein, 20 aa, Mycobacterium
PDRSGGVLPGYGGSKAALEH

SEQ ID NO: 773435 - protein, 18 aa, Mycobacterium
PDSAAIWPGILGFDDTVL

SEQ ID NO: 773436 - protein, 17 aa, Mycobacterium
PDTALGIRHVAWVKERG

SEQ ID NO: 773437 - protein, 21 aa, Mycobacterium
PDTGSGWVCHAEGTLSTGSVE

SEQ ID NO: 773438 - protein, 18 aa, Mycobacterium
PDTVKLVLLTGRHTIRRH

SEQ ID NO: 773439 - protein, 23 aa, Mycobacterium
PDVAGPYAWWSWRGKAFDNDAGW

SEQ ID NO: 773440 - protein, 18 aa, Mycobacterium
PDVLFVWQVAVARSAQGT

SEQ ID NO: 773441 - protein, 18 aa, Mycobacterium
PDVPKLGSFEVMNRTIDI

SEQ ID NO: 773442 - protein, 29 aa, Mycobacterium
PDVPLLCAEEVDRACAPWGLLAEDHQAAL

SEQ ID NO: 773443 - protein, 21 aa, Mycobacterium
PDVVARLTADWVDRVVAGTGD

SEQ ID NO: 773444 - protein, 19 aa, Mycobacterium
PDVVARLTAEWVDRTVAGA

SEQ ID NO: 773445 - protein, 21 aa, Mycobacterium
PDVVHAYGWLGGLAAQLAARR

SEQ ID NO: 773446 - protein, 19 aa, Mycobacterium
PDVVKAWDLIVKKQAEFEE

SEQ ID NO: 773447 - protein, 22 aa, Mycobacterium
PDVYSNDALICFNSHAFMDDPD

SEQ ID NO: 773448 - protein, 19 aa, Mycobacterium
PDWHGDWSAARGYEIGEKI

SEQ ID NO: 773449 - protein, 20 aa, Mycobacterium
PDWLRWNYATVVWGLATAHE

SEQ ID NO: 773450 - protein, 18 aa, Mycobacterium
PDWVPGEYWVSGRGIARG

SEQ ID NO: 773451 - protein, 17 aa, Mycobacterium
PDWWWPALAFTAVAALD

SEQ ID NO: 773452 - protein, 18 aa, Mycobacterium
PDYHASWDYGGMPVPKDG

SEQ ID NO: 773453 - protein, 22 aa, Mycobacterium
PDYLPGTLLPPGIRATADAAEA

SEQ ID NO: 773454 - protein, 24 aa, Mycobacterium
PDYRGCSSWVRLPVDPRWGEPVHS

SEQ ID NO: 773455 - protein, 25 aa, Mycobacterium
PDYRPAPLPSWPTRLGWAVRDWPET

SEQ ID NO: 773456 - protein, 19 aa, Mycobacterium
PEAAEQWRALALVTTTADL

SEQ ID NO: 773457 - protein, 18 aa, Mycobacterium
PEAFKWIQRAAMDRRTTM

SEQ ID NO: 773458 - protein, 20 aa, Mycobacterium
PEAFTALAARFLGPTLDGVR

SEQ ID NO: 773459 - protein, 22 aa, Mycobacterium
PEAGLKIARRFAHLTYRGETEL

SEQ ID NO: 773460 - protein, 18 aa, Mycobacterium
PEAGPWLRRAEARAEANG

SEQ ID NO: 773461 - protein, 18 aa, Mycobacterium
PEAIAITCGERSWSYGEL

SEQ ID NO: 773462 - protein, 24 aa, Mycobacterium
PEAITAWIVFCCQALTAGAAEATS

SEQ ID NO: 773463 - protein, 20 aa, Mycobacterium
PEAKRFCWNCGKPVGRSSKG

SEQ ID NO: 773464 - protein, 17 aa, Mycobacterium
PEALAPRYVEAMGGIDR

SEQ ID NO: 773465 - protein, 21 aa, Mycobacterium
PEALSRFPITRVISSPQRRAV

SEQ ID NO: 773466 - protein, 20 aa, Mycobacterium
PEALTGVLYRLADVNVPGAE

SEQ ID NO: 773467 - protein, 18 aa, Mycobacterium
PEAPMALCLHGFPDTAYG

SEQ ID NO: 773468 - protein, 23 aa, Mycobacterium
PEAPWVRPPLRSMKWMETFLDTL

SEQ ID NO: 773469 - protein, 19 aa, Mycobacterium
PEARFLTKVRHSAFYATSL

SEQ ID NO: 773470 - protein, 21 aa, Mycobacterium
PEAYLRAAIAWHFGQDTGSPF

SEQ ID NO: 773471 - protein, 20 aa, Mycobacterium
PECDRRIAGINSFGFGGTNA

SEQ ID NO: 773472 - protein, 20 aa, Mycobacterium
PECVEGWGAPALEKERVKPK

SEQ ID NO: 773473 - protein, 17 aa, Mycobacterium
PEDADRAAIAASIHDVV

SEQ ID NO: 773474 - protein, 24 aa, Mycobacterium
PEDDRGWCFTGWFDTSGSQALLGY

SEQ ID NO: 773475 - protein, 18 aa, Mycobacterium
PEDEFAFVVHGTMADPRW

SEQ ID NO: 773476 - protein, 19 aa, Mycobacterium
PEDLRFLIRLARQQGERLG

SEQ ID NO: 773477 - protein, 18 aa, Mycobacterium
PEDLRPGDLLGVAATGAY

SEQ ID NO: 773478 - protein, 21 aa, Mycobacterium
PEDPEWLLAHLADFGTARCEN

SEQ ID NO: 773479 - protein, 21 aa, Mycobacterium
PEDPEWLLAHLADFGTVRCEN

SEQ ID NO: 773480 - protein, 21 aa, Mycobacterium
PEDRLRPVIVHDAKELVYQTP

SEQ ID NO: 773481 - protein, 20 aa, Mycobacterium
PEDVSAFVLFLASDESSYAT

SEQ ID NO: 773482 - protein, 23 aa, Mycobacterium
PEEAGWRVGDDVVHRELGHGWVQ

SEQ ID NO: 773483 - protein, 19 aa, Mycobacterium
PEEEWGLGIDNIDYFRPTG

SEQ ID NO: 773484 - protein, 17 aa, Mycobacterium
PEEFDWLATRLEIARKL

SEQ ID NO: 773485 - protein, 20 aa, Mycobacterium
PEEFRMAVYYADVEGFPYKE

SEQ ID NO: 773486 - protein, 20 aa, Mycobacterium
PEEIAWRAGFIDDDQLATRA

SEQ ID NO: 773487 - protein, 24 aa, Mycobacterium
PEELRPNDEWVLFGYDPLFQAFRD

SEQ ID NO: 773488 - protein, 17 aa, Mycobacterium
PEEVAARRGLPIEDVAP

SEQ ID NO: 773489 - protein, 17 aa, Mycobacterium
PEFARWLQERGRVRMPD

SEQ ID NO: 773490 - protein, 21 aa, Mycobacterium
PEFIGRLPIVASVTNLDRESL

SEQ ID NO: 773491 - protein, 20 aa, Mycobacterium
PEFIGRLPVVASVTNLDKAS

SEQ ID NO: 773492 - protein, 20 aa, Mycobacterium
PEFIGRLPVVASVTNLDKES

SEQ ID NO: 773493 - protein, 19 aa, Mycobacterium
PEFLERIGIGAPEVEQDMI

SEQ ID NO: 773494 - protein, 17 aa, Mycobacterium
PEFLKISPLGTVGDDGT

SEQ ID NO: 773495 - protein, 17 aa, Mycobacterium
PEFLTAAANDLSGIGDA

SEQ ID NO: 773496 - protein, 21 aa, Mycobacterium
PEFPDTFWVNPFGMNFRHITV

SEQ ID NO: 773497 - protein, 23 aa, Mycobacterium
PEFRKLEWSRLAAGVTRRTVVDS

SEQ ID NO: 773498 - protein, 19 aa, Mycobacterium
PEFRLCDYFDLIGGTSTGS

SEQ ID NO: 773499 - protein, 18 aa, Mycobacterium
PEGFSWLYRFIKAQGERN

SEQ ID NO: 773500 - protein, 22 aa, Mycobacterium
PEGKICHWGGWGGSWETMNPDK

SEQ ID NO: 773501 - protein, 21 aa, Mycobacterium
PEGLLNYLALLGWGIADDHDV

SEQ ID NO: 773502 - protein, 21 aa, Mycobacterium
PEGLLNYLALLGWSIADDRDL

SEQ ID NO: 773503 - protein, 20 aa, Mycobacterium
PEGLMSFRWFLSDDLPERPV

SEQ ID NO: 773504 - protein, 20 aa, Mycobacterium
PEGLSGLIWLNTDDASADRA

SEQ ID NO: 773505 - protein, 19 aa, Mycobacterium
PEGQPALGIGEVDGPYHQA

SEQ ID NO: 773506 - protein, 18 aa, Mycobacterium
PEGSRLAVEQALDSSPMK

SEQ ID NO: 773507 - protein, 19 aa, Mycobacterium
PEGSVLVPFAWQGVTLHAA

SEQ ID NO: 773508 - protein, 17 aa, Mycobacterium
PEGWKLLSECVTSPRAV

SEQ ID NO: 773509 - protein, 18 aa, Mycobacterium
PEGWRFDDLLPYFMRSEA

SEQ ID NO: 773510 - protein, 17 aa, Mycobacterium
PEGYAWDALNGKDLLDR

SEQ ID NO: 773511 - protein, 17 aa, Mycobacterium
PEHLHKVSLSFLVDDLV

SEQ ID NO: 773512 - protein, 18 aa, Mycobacterium
PEHPRFLMCTPLSHAGAA

SEQ ID NO: 773513 - protein, 20 aa, Mycobacterium
PEHYYRALALAVRDRMQDRR

SEQ ID NO: 773514 - protein, 21 aa, Mycobacterium
PEIAQFQWRTKVYWVNGTHSR

SEQ ID NO: 773515 - protein, 22 aa, Mycobacterium
PEIARTLALSGVDLFVVSSANM

SEQ ID NO: 773516 - protein, 18 aa, Mycobacterium
PEIGWAARIGRIPMGYFN

SEQ ID NO: 773517 - protein, 17 aa, Mycobacterium
PEIKLGVLPGMGGSQRL

SEQ ID NO: 773518 - protein, 21 aa, Mycobacterium
PEIPAHIEGTIPLAVPVTMTS

SEQ ID NO: 773519 - protein, 17 aa, Mycobacterium
PEIPINLPLSVPLHIPV

SEQ ID NO: 773520 - protein, 17 aa, Mycobacterium
PEIRAPWSLSKPKRRSS

SEQ ID NO: 773521 - protein, 19 aa, Mycobacterium
PEIVIPFLVPDGAHDYPDD

SEQ ID NO: 773522 - protein, 20 aa, Mycobacterium
PEIWAGVAAPVMIWSIAHAA

SEQ ID NO: 773523 - protein, 25 aa, Mycobacterium
PEIWDEFTERFGIARVCEFYAASEG

SEQ ID NO: 773524 - protein, 26 aa, Mycobacterium
PEIWDEFTKRFGIARVCEFYASSEGN

SEQ ID NO: 773525 - protein, 22 aa, Mycobacterium
PEIYRAPLSYPYRDGLLDKELA

SEQ ID NO: 773526 - protein, 17 aa, Mycobacterium
PEKRTRLGVGHFVETLE

SEQ ID NO: 773527 - protein, 18 aa, Mycobacterium
PELACDAPLLAAVLNGAA

SEQ ID NO: 773528 - protein, 17 aa, Mycobacterium
PELAEWGIPTAEALVEV

SEQ ID NO: 773529 - protein, 17 aa, Mycobacterium
PELEILGNLGLVIGGGF

SEQ ID NO: 773530 - protein, 20 aa, Mycobacterium
PELGGFRWLTVGPPGQEDVS

SEQ ID NO: 773531 - protein, 20 aa, Mycobacterium
PELGRFGVWLGSRSITPELA

SEQ ID NO: 773532 - protein, 21 aa, Mycobacterium
PELGRPSWLTAYGLCEQPKLA

SEQ ID NO: 773533 - protein, 18 aa, Mycobacterium
PELIPKLMSAGVIEVAPL

SEQ ID NO: 773534 - protein, 20 aa, Mycobacterium
PELKGKLDGYALRVPIPTGS

SEQ ID NO: 773535 - protein, 19 aa, Mycobacterium
PELLAAFAAMGTEIFETMF

SEQ ID NO: 773536 - protein, 22 aa, Mycobacterium
PELLKRLKALPGFGEQKAKIFL

SEQ ID NO: 773537 - protein, 19 aa, Mycobacterium
PELLLGGPVMSRLQQVVHR

SEQ ID NO: 773538 - protein, 20 aa, Mycobacterium
PELLRWIPFTKGDYWVLKID

SEQ ID NO: 773539 - protein, 20 aa, Mycobacterium
PELLSGPVVTRFELQVSPER

SEQ ID NO: 773540 - protein, 18 aa, Mycobacterium
PELLSRAAALNWDTTEPA

SEQ ID NO: 773541 - protein, 18 aa, Mycobacterium
PELLVSMFGDIDNFTMVK

SEQ ID NO: 773542 - protein, 20 aa, Mycobacterium
PELNILCGLAIGYSDPEFPA

SEQ ID NO: 773543 - protein, 20 aa, Mycobacterium
PELPGVVVRPLLPLTERRLG

SEQ ID NO: 773544 - protein, 21 aa, Mycobacterium
PELPLRFAVNLSVFVATTPEG

SEQ ID NO: 773545 - protein, 18 aa, Mycobacterium
PELPSILCATDLAPADTA

SEQ ID NO: 773546 - protein, 21 aa, Mycobacterium
PELPTDLVIIGGGFVSAEFAH

SEQ ID NO: 773547 - protein, 21 aa, Mycobacterium
PELRAPLTWEVDEPCPVPQPE

SEQ ID NO: 773548 - protein, 19 aa, Mycobacterium
PELRCLMLTSFTSDEAMLE

SEQ ID NO: 773549 - protein, 17 aa, Mycobacterium
PELRGRLVFAWRATGPM

SEQ ID NO: 773550 - protein, 20 aa, Mycobacterium
PELRLPAAVKQILAGYADRP

SEQ ID NO: 773551 - protein, 18 aa, Mycobacterium
PELRRLRTAVVARATEAG

SEQ ID NO: 773552 - protein, 17 aa, Mycobacterium
PELRRPITDLGMVKSID

SEQ ID NO: 773553 - protein, 17 aa, Mycobacterium
PELRRPITELGMVKGID

SEQ ID NO: 773554 - protein, 17 aa, Mycobacterium
PELRRPITELGMVKSVE

SEQ ID NO: 773555 - protein, 17 aa, Mycobacterium
PELRRPITEVGMVKNVT

SEQ ID NO: 773556 - protein, 17 aa, Mycobacterium
PELRSSAILGVCKNVLR

SEQ ID NO: 773557 - protein, 19 aa, Mycobacterium
PELTGKWLGAFFMGPVNTR

SEQ ID NO: 773558 - protein, 17 aa, Mycobacterium
PELVALLAGRRIAVLTG

SEQ ID NO: 773559 - protein, 22 aa, Mycobacterium
PELVRRLCWDWAPVAAAEITST

SEQ ID NO: 773560 - protein, 17 aa, Mycobacterium
PELWCALVAVVGADPPH

SEQ ID NO: 773561 - protein, 23 aa, Mycobacterium
PEMARAFLTFNGFLLRRGELSPR

SEQ ID NO: 773562 - protein, 19 aa, Mycobacterium
PEMARRALAELGEVEGLTV

SEQ ID NO: 773563 - protein, 21 aa, Mycobacterium
PEMLRRAMLYAIERKRAELIA

SEQ ID NO: 773564 - protein, 17 aa, Mycobacterium
PEMLSFVLANSPLKLDW

SEQ ID NO: 773565 - protein, 24 aa, Mycobacterium
PEMPIGAVLLSWLPLFHDMGLILG

SEQ ID NO: 773566 - protein, 23 aa, Mycobacterium
PEMRDCMRRILKGFVERITHDEA

SEQ ID NO: 773567 - protein, 18 aa, Mycobacterium
PEMTARYAATLAATAEAE

SEQ ID NO: 773568 - protein, 19 aa, Mycobacterium
PENKGPLLINARAEKVTTS

SEQ ID NO: 773569 - protein, 20 aa, Mycobacterium
PENKRALADWSWGRQSIDLL

SEQ ID NO: 773570 - protein, 25 aa, Mycobacterium
PENNIACSRWGMLAPDGLCKTFDAD

SEQ ID NO: 773571 - protein, 20 aa, Mycobacterium
PENPRMAALEGVDLLAVPTA

SEQ ID NO: 773572 - protein, 21 aa, Mycobacterium
PEPAPFVPMVAPWASVPEPVR

SEQ ID NO: 773573 - protein, 18 aa, Mycobacterium
PEPDLAIVGMGRRDVSFD

SEQ ID NO: 773574 - protein, 24 aa, Mycobacterium
PEPEWQAASPLPGWDVKALVAHMI

SEQ ID NO: 773575 - protein, 19 aa, Mycobacterium
PEPHQRWVLEQIVTMADSV

SEQ ID NO: 773576 - protein, 18 aa, Mycobacterium
PEPKGCVFEYVYLARPDS

SEQ ID NO: 773577 - protein, 21 aa, Mycobacterium
PEPKLPVPSGWPFGEEFPRTC

SEQ ID NO: 773578 - protein, 19 aa, Mycobacterium
PEPLRSAALAGRAPAKPVG

SEQ ID NO: 773579 - protein, 24 aa, Mycobacterium
PEPLRWLGVRGLYIAYKLADRHEA

SEQ ID NO: 773580 - protein, 18 aa, Mycobacterium
PEPPRGVFEVGYEIGCGI

SEQ ID NO: 773581 - protein, 23 aa, Mycobacterium
PEPRARLIFNFPKPATLARILRD

SEQ ID NO: 773582 - protein, 22 aa, Mycobacterium
PEPRASAAFTRTLRAVVDWRGQ

SEQ ID NO: 773583 - protein, 20 aa, Mycobacterium
PEPRPGPALGGRSVDEVLAD

SEQ ID NO: 773584 - protein, 20 aa, Mycobacterium
PEPSRWGLPVDRLRYPVFSW

SEQ ID NO: 773585 - protein, 21 aa, Mycobacterium
PEPTFRGAVLVGDEPESRLIL

SEQ ID NO: 773586 - protein, 22 aa, Mycobacterium
PEQKQRWAVPILRAEITASLGM

SEQ ID NO: 773587 - protein, 20 aa, Mycobacterium
PEQLKRLVAQISEKPESVQH

SEQ ID NO: 773588 - protein, 20 aa, Mycobacterium
PEQLKRLVAQISEQPETVQH

SEQ ID NO: 773589 - protein, 22 aa, Mycobacterium
PEQPGLYAARGWSMFPTIDRVY

SEQ ID NO: 773590 - protein, 17 aa, Mycobacterium
PEQQLALLAVRLEMAAV

SEQ ID NO: 773591 - protein, 21 aa, Mycobacterium
PEQRLAFVLHDAFAVPFDQIA

SEQ ID NO: 773592 - protein, 17 aa, Mycobacterium
PEQWSGFGALGEAAPES

SEQ ID NO: 773593 - protein, 17 aa, Mycobacterium
PERAIAALIARYPDAET

SEQ ID NO: 773594 - protein, 19 aa, Mycobacterium
PERASSFIGHMLDLEMLLM

SEQ ID NO: 773595 - protein, 23 aa, Mycobacterium
PEREGRAAFLPPYLISGQGLAVD

SEQ ID NO: 773596 - protein, 21 aa, Mycobacterium
PERGALVAAVWLRPPAGPSVL

SEQ ID NO: 773597 - protein, 19 aa, Mycobacterium
PERGCRGCSMMADHVGNLA

SEQ ID NO: 773598 - protein, 19 aa, Mycobacterium
PERGDMGLIPAMTVKCPVA

SEQ ID NO: 773599 - protein, 18 aa, Mycobacterium
PERGEMGLVPAMTVKCAV

SEQ ID NO: 773600 - protein, 19 aa, Mycobacterium
PERHPARHWRGRFREADVA

SEQ ID NO: 773601 - protein, 21 aa, Mycobacterium
PERIIPCQLPWLLDPDLGARM

SEQ ID NO: 773602 - protein, 19 aa, Mycobacterium
PERIIPCQLPWLLDPSAGA

SEQ ID NO: 773603 - protein, 18 aa, Mycobacterium
PERLEIRAELPLTNIHKV

SEQ ID NO: 773604 - protein, 23 aa, Mycobacterium
PERLRSGWLNGIKHWQVDYHSTA

SEQ ID NO: 773605 - protein, 23 aa, Mycobacterium
PERLRSGWLNGIKHWQVDYSGAT

SEQ ID NO: 773606 - protein, 18 aa, Mycobacterium
PERMSARRFWVRYAAEAS

SEQ ID NO: 773607 - protein, 18 aa, Mycobacterium
PERPRLSVLGGDRPRWQT

SEQ ID NO: 773608 - protein, 20 aa, Mycobacterium
PERPTLVMAHGWPDSHVLWD

SEQ ID NO: 773609 - protein, 17 aa, Mycobacterium
PERRGSFGIPLPGVVQH

SEQ ID NO: 773610 - protein, 17 aa, Mycobacterium
PERTGCIGCAACMTGCK

SEQ ID NO: 773611 - protein, 20 aa, Mycobacterium
PERVRPCFRLLRSLRDQARD

SEQ ID NO: 773612 - protein, 24 aa, Mycobacterium
PERVWGWYLWRHYLVADVAPNPGH

SEQ ID NO: 773613 - protein, 22 aa, Mycobacterium
PERYRFSVTLPRTMPAPGAGIV

SEQ ID NO: 773614 - protein, 22 aa, Mycobacterium
PESFTGLVIRWHAPVIIDGADP

SEQ ID NO: 773615 - protein, 20 aa, Mycobacterium
PESHGRGAVNAGLAITTVTA

SEQ ID NO: 773616 - protein, 22 aa, Mycobacterium
PESMKPFLPRTVREVPLDTSAL

SEQ ID NO: 773617 - protein, 23 aa, Mycobacterium
PESPRELGAWGLTEREARMHESL

SEQ ID NO: 773618 - protein, 18 aa, Mycobacterium
PESVRAAFHYVRSGQTVI

SEQ ID NO: 773619 - protein, 18 aa, Mycobacterium
PESWRLAPVRPRAVTTVN

SEQ ID NO: 773620 - protein, 25 aa, Mycobacterium
PETAFPHWFARNWRRQAILRYGENP

SEQ ID NO: 773621 - protein, 17 aa, Mycobacterium
PETDELWVLGDICSGGV

SEQ ID NO: 773622 - protein, 20 aa, Mycobacterium
PETDFPRWFGRNWRRQAMLR

SEQ ID NO: 773623 - protein, 28 aa, Mycobacterium
PETLADLAFAWRVCRAVKSNAIVIAAGG

SEQ ID NO: 773624 - protein, 17 aa, Mycobacterium
PETLRALGLPAMSPTIG

SEQ ID NO: 773625 - protein, 18 aa, Mycobacterium
PETQIAISAWGLLSPEGR

SEQ ID NO: 773626 - protein, 20 aa, Mycobacterium
PEVADHLAALGFTAAAGDVV

SEQ ID NO: 773627 - protein, 17 aa, Mycobacterium
PEVAFAMVQLGLAFDDM

SEQ ID NO: 773628 - protein, 20 aa, Mycobacterium
PEVARCYSLGGAEIVVYPTA

SEQ ID NO: 773629 - protein, 20 aa, Mycobacterium
PEVFDLRPGAIIRDLDLLRP

SEQ ID NO: 773630 - protein, 20 aa, Mycobacterium
PEVIRRSGVDPADIDDIIFA

SEQ ID NO: 773631 - protein, 22 aa, Mycobacterium
PEVKARFGDRFRLEDSINTYYF

SEQ ID NO: 773632 - protein, 19 aa, Mycobacterium
PEVLAVAGRDLASIGSAIS

SEQ ID NO: 773633 - protein, 20 aa, Mycobacterium
PEVLGTFVFAPSAPIQAVRD

SEQ ID NO: 773634 - protein, 17 aa, Mycobacterium
PEVLRGPLLGALGRSRS

SEQ ID NO: 773635 - protein, 17 aa, Mycobacterium
PEVLRLAFREMHNGRPG

SEQ ID NO: 773636 - protein, 19 aa, Mycobacterium
PEVLRRLKRLPGFGDQKAR

SEQ ID NO: 773637 - protein, 24 aa, Mycobacterium
PEVTELKAAVLALIEGVAPHAVLA

SEQ ID NO: 773638 - protein, 22 aa, Mycobacterium
PEVYRAPLSYPYRDGLIDKELA

SEQ ID NO: 773639 - protein, 20 aa, Mycobacterium
PEWLRWNYATVVWGIATAHE

SEQ ID NO: 773640 - protein, 20 aa, Mycobacterium
PEWLRWNYATVVWGLATAHE

SEQ ID NO: 773641 - protein, 19 aa, Mycobacterium
PEYGATCAIFPIDDITLDY

SEQ ID NO: 773642 - protein, 25 aa, Mycobacterium
PEYSHLTLSWVYDWMAQGVPVVAMH

SEQ ID NO: 773643 - protein, 18 aa, Mycobacterium
PEYWGAVEELGFGQIALL

SEQ ID NO: 773644 - protein, 21 aa, Mycobacterium
PFAEPEILTFGYALEQNTDTV

SEQ ID NO: 773645 - protein, 19 aa, Mycobacterium
PFAKLRVAPTASWMFEYYP

SEQ ID NO: 773646 - protein, 21 aa, Mycobacterium
PFAPRCPLVIDECRSAEPELI

SEQ ID NO: 773647 - protein, 21 aa, Mycobacterium
PFAPRCPLVIDECRSDEPELI

SEQ ID NO: 773648 - protein, 21 aa, Mycobacterium
PFAVLRLQYQVARLPLQLIED

SEQ ID NO: 773649 - protein, 17 aa, Mycobacterium
PFAWPPRTTNTAGLASH

SEQ ID NO: 773650 - protein, 22 aa, Mycobacterium
PFDAVVCSLVLCSVRDPGAVLR

SEQ ID NO: 773651 - protein, 23 aa, Mycobacterium
PFDNWPLGWGFDHYWGFLSGAAG

SEQ ID NO: 773652 - protein, 24 aa, Mycobacterium
PFEHARIRLAYGMRLRRLRRYRNA

SEQ ID NO: 773653 - protein, 19 aa, Mycobacterium
PFERERLWMSPPRSVLDKP

SEQ ID NO: 773654 - protein, 18 aa, Mycobacterium
PFFARAVIDALKIHPNIN

SEQ ID NO: 773655 - protein, 18 aa, Mycobacterium
PFFHDMGLMFGIIMPLLE

SEQ ID NO: 773656 - protein, 24 aa, Mycobacterium
PFFMWYDWMAGGWGGRSTKDGSTA

SEQ ID NO: 773657 - protein, 18 aa, Mycobacterium
PFFNWRAGGLRSDVVHPQ

SEQ ID NO: 773658 - protein, 20 aa, Mycobacterium
PFFPRFCGQMFAHLGDRDLA

SEQ ID NO: 773659 - protein, 21 aa, Mycobacterium
PFGGATIRFPRTAGWGNAMRW

SEQ ID NO: 773660 - protein, 22 aa, Mycobacterium
PFGGRPGFGFGFGSGPVDRRAL

SEQ ID NO: 773661 - protein, 17 aa, Mycobacterium
PFHRFRRIDGAAIDSLL

SEQ ID NO: 773662 - protein, 20 aa, Mycobacterium
PFHWECFSFGIIQNEDHFTF

SEQ ID NO: 773663 - protein, 17 aa, Mycobacterium
PFIGFPIPPMIHGATQA

SEQ ID NO: 773664 - protein, 17 aa, Mycobacterium
PFKAEFFSEPGWEPMGD

SEQ ID NO: 773665 - protein, 19 aa, Mycobacterium
PFKPEMRDLLAGRSDRDHI

SEQ ID NO: 773666 - protein, 17 aa, Mycobacterium
PFLDYAFGFRRGQNAGQ

SEQ ID NO: 773667 - protein, 17 aa, Mycobacterium
PFLERMGLTVGWITEES

SEQ ID NO: 773668 - protein, 27 aa, Mycobacterium
PFLHPELHWDFRLPRVVSINVSGHKYG

SEQ ID NO: 773669 - protein, 17 aa, Mycobacterium
PFLRGCLAGGAPITPEL

SEQ ID NO: 773670 - protein, 26 aa, Mycobacterium
PFLRVNLYGVLHCTRAVLPAMITNTW

SEQ ID NO: 773671 - protein, 24 aa, Mycobacterium
PFNFPAMVPMWFFPIAIAAGNTVV

SEQ ID NO: 773672 - protein, 23 aa, Mycobacterium
PFNFPAMVPMWFFPVAIAAGNTV

SEQ ID NO: 773673 - protein, 24 aa, Mycobacterium
PFNVLRPAWKAMVDQGYGRILNIS

SEQ ID NO: 773674 - protein, 23 aa, Mycobacterium
PFPPEPLASIGIQATRWSLDRAD

SEQ ID NO: 773675 - protein, 23 aa, Mycobacterium
PFPPVELFLQMPWRTEIIEGLLG

SEQ ID NO: 773676 - protein, 18 aa, Mycobacterium
PFRLRVCTRDQFRVRPDR

SEQ ID NO: 773677 - protein, 19 aa, Mycobacterium
PFSEQRGATLIAKEPIGVC

SEQ ID NO: 773678 - protein, 20 aa, Mycobacterium
PFSRIRVLRRLARRPMSVKE

SEQ ID NO: 773679 - protein, 21 aa, Mycobacterium
PFSRRGMFRFGHSRRRESALR

SEQ ID NO: 773680 - protein, 26 aa, Mycobacterium
PFTFRIAQTVGWRLWMGVAFGLTSDP

SEQ ID NO: 773681 - protein, 18 aa, Mycobacterium
PFTHMAFRFNECSTKSVA

SEQ ID NO: 773682 - protein, 17 aa, Mycobacterium
PFTTVGLCCYRDGSDSV

SEQ ID NO: 773683 - protein, 25 aa, Mycobacterium
PFYNFLLTVLFEWGVAVHDTDVESL

SEQ ID NO: 773684 - protein, 20 aa, Mycobacterium
PGAEAFRSWRLLVTRYGTPA

SEQ ID NO: 773685 - protein, 17 aa, Mycobacterium
PGAEAWRAWRYLINNVG

SEQ ID NO: 773686 - protein, 17 aa, Mycobacterium
PGAEGRLKVKPAKPSKL

SEQ ID NO: 773687 - protein, 17 aa, Mycobacterium
PGAHEVRPGLQIVAAPW

SEQ ID NO: 773688 - protein, 18 aa, Mycobacterium
PGAIRRLCCDAGVLTDTE

SEQ ID NO: 773689 - protein, 18 aa, Mycobacterium
PGALHRLGFDYAALAAHN

SEQ ID NO: 773690 - protein, 18 aa, Mycobacterium
PGALIGFLGPRVYEHLYG

SEQ ID NO: 773691 - protein, 22 aa, Mycobacterium
PGAMARLGVWPGVGPQLDLHQP

SEQ ID NO: 773692 - protein, 20 aa, Mycobacterium
PGAMGRLGVWSGQGPQLDLH

SEQ ID NO: 773693 - protein, 18 aa, Mycobacterium
PGAMIGFLGPRVYQALYD

SEQ ID NO: 773694 - protein, 17 aa, Mycobacterium
PGAPAFSVGYVQDAHGL

SEQ ID NO: 773695 - protein, 23 aa, Mycobacterium
PGAPALVCVHGFPTAGVDYHALT

SEQ ID NO: 773696 - protein, 17 aa, Mycobacterium
PGARIWAHGNIAAAQAM

SEQ ID NO: 773697 - protein, 19 aa, Mycobacterium
PGARLAWREDATWAPHGGE

SEQ ID NO: 773698 - protein, 18 aa, Mycobacterium
PGARLAWRENAEWAPHGG

SEQ ID NO: 773699 - protein, 17 aa, Mycobacterium
PGATILLRLDRDVPGDV

SEQ ID NO: 773700 - protein, 17 aa, Mycobacterium
PGAVWKNAGLEWDYYDM

SEQ ID NO: 773701 - protein, 17 aa, Mycobacterium
PGAVWSFSIGWGCDKLI

SEQ ID NO: 773702 - protein, 19 aa, Mycobacterium
PGCGTGWHAIEYARAGCSV

SEQ ID NO: 773703 - protein, 18 aa, Mycobacterium
PGCKVCVRESCAQRAFPY

SEQ ID NO: 773704 - protein, 24 aa, Mycobacterium
PGCPFAPRCPLVIDECRAQEPELL

SEQ ID NO: 773705 - protein, 19 aa, Mycobacterium
PGDEISIADVLRCIDGPLA

SEQ ID NO: 773706 - protein, 18 aa, Mycobacterium
PGDFRVGFNASHMQATLP

SEQ ID NO: 773707 - protein, 20 aa, Mycobacterium
PGDGADECWILVPITAAADG

SEQ ID NO: 773708 - protein, 18 aa, Mycobacterium
PGDGTFRVGVDIKAGTYR

SEQ ID NO: 773709 - protein, 18 aa, Mycobacterium
PGDLLAVACTGAYHHSMA

SEQ ID NO: 773710 - protein, 24 aa, Mycobacterium
PGDWREVMEALLLGAFISDGFVSE

SEQ ID NO: 773711 - protein, 22 aa, Mycobacterium
PGEPLPRWQIALYRRTDGRPLW

SEQ ID NO: 773712 - protein, 22 aa, Mycobacterium
PGEPLPRWQIALYWRTDGLPLW

SEQ ID NO: 773713 - protein, 22 aa, Mycobacterium
PGEPLPRWQIALYWRTDGRPLW

SEQ ID NO: 773714 - protein, 17 aa, Mycobacterium
PGERVALLFPRSAQAIV

SEQ ID NO: 773715 - protein, 19 aa, Mycobacterium
PGERVALLLPRTGEAIAAI

SEQ ID NO: 773716 - protein, 20 aa, Mycobacterium
PGESRFYLSLQDELMRRFNG

SEQ ID NO: 773717 - protein, 18 aa, Mycobacterium
PGEVWSQWHSLVFDVSVW

SEQ ID NO: 773718 - protein, 23 aa, Mycobacterium
PGEWGHVELAWWRQVLAGLPGDI

SEQ ID NO: 773719 - protein, 17 aa, Mycobacterium
PGFRELRTTIGRERGWP

SEQ ID NO: 773720 - protein, 18 aa, Mycobacterium
PGFRGCLTLELVNLGKMP

SEQ ID NO: 773721 - protein, 19 aa, Mycobacterium
PGGEPIPGVSFVFVSNSSP

SEQ ID NO: 773722 - protein, 24 aa, Mycobacterium
PGGERRLNVAVTRARREVVLYASF

SEQ ID NO: 773723 - protein, 23 aa, Mycobacterium
PGGFRYGPAFGVELQFWVFDETV

SEQ ID NO: 773724 - protein, 24 aa, Mycobacterium
PGGGRPRVRLAYRLTPNRVLGEQR

SEQ ID NO: 773725 - protein, 19 aa, Mycobacterium
PGGGWGRPPTPLWPDAVGE

SEQ ID NO: 773726 - protein, 26 aa, Mycobacterium
PGGGYKPEGAWAFAVVQAVVKTIAEW

SEQ ID NO: 773727 - protein, 18 aa, Mycobacterium
PGGIYAPMIHPWSSGRDL

SEQ ID NO: 773728 - protein, 18 aa, Mycobacterium
PGGLFGKAAATLFGESPD

SEQ ID NO: 773729 - protein, 24 aa, Mycobacterium
PGGLGGRGGLLWGDGGKGGDGGAP

SEQ ID NO: 773730 - protein, 20 aa, Mycobacterium
PGGPFLAFGQVYAFSQNMVG

SEQ ID NO: 773731 - protein, 22 aa, Mycobacterium
PGGPFLSFGQAYAWGQNGQGAA

SEQ ID NO: 773732 - protein, 22 aa, Mycobacterium
PGGPFLSFGQAYAWGQNGQSAA

SEQ ID NO: 773733 - protein, 17 aa, Mycobacterium
PGGRLAATVARFNGFAA

SEQ ID NO: 773734 - protein, 19 aa, Mycobacterium
PGGRLGLVWNTRDERLGWV

SEQ ID NO: 773735 - protein, 20 aa, Mycobacterium
PGGSGWRWLASALWAEILLS

SEQ ID NO: 773736 - protein, 17 aa, Mycobacterium
PGGTLGLISWTPEGFIG

SEQ ID NO: 773737 - protein, 24 aa, Mycobacterium
PGGYSFPIVREWLASRVAQIPTYT

SEQ ID NO: 773738 - protein, 24 aa, Mycobacterium
PGHGGNGGNAFLFGDGGTGGQGGT

SEQ ID NO: 773739 - protein, 18 aa, Mycobacterium
PGHLWRWELTPISGTRTL

SEQ ID NO: 773740 - protein, 17 aa, Mycobacterium
PGHPEFRHTAGVEITTG

SEQ ID NO: 773741 - protein, 18 aa, Mycobacterium
PGHPEFRHTPGVEITTGP

SEQ ID NO: 773742 - protein, 17 aa, Mycobacterium
PGHPMLRVDRLYADDEG

SEQ ID NO: 773743 - protein, 24 aa, Mycobacterium
PGHYTLRASVDWQQHKPGASHVVN

SEQ ID NO: 773744 - protein, 20 aa, Mycobacterium
PGIAGPAGWCVYLDNDDRSR

SEQ ID NO: 773745 - protein, 22 aa, Mycobacterium
PGIDLRPFWTLGVAALMRDLAA

SEQ ID NO: 773746 - protein, 17 aa, Mycobacterium
PGIGRAGVVGRLSVPPG

SEQ ID NO: 773747 - protein, 18 aa, Mycobacterium
PGILRTPWYTVISGTGDT

SEQ ID NO: 773748 - protein, 19 aa, Mycobacterium
PGITEAWPWTNRQATEASS

SEQ ID NO: 773749 - protein, 17 aa, Mycobacterium
PGIVDALARLRIDGEPA

SEQ ID NO: 773750 - protein, 18 aa, Mycobacterium
PGIWYAGSHGFDLMAPDG

SEQ ID NO: 773751 - protein, 17 aa, Mycobacterium
PGKGRRILVEFDGRPSA

SEQ ID NO: 773752 - protein, 23 aa, Mycobacterium
PGKHAASAFALWFPIEGGADYGD

SEQ ID NO: 773753 - protein, 24 aa, Mycobacterium
PGKHAASAFAMWFPIEGEQDSHEY

SEQ ID NO: 773754 - protein, 25 aa, Mycobacterium
PGKHAVSAFSLWFPLSEEISGYGAL

SEQ ID NO: 773755 - protein, 18 aa, Mycobacterium
PGKRFWRTGAVSFWVLPP

SEQ ID NO: 773756 - protein, 25 aa, Mycobacterium
PGKRIRAGLGLACFRLQPSAATVSP

SEQ ID NO: 773757 - protein, 23 aa, Mycobacterium
PGKWRVIFFWPKDFTFVCPTEIA

SEQ ID NO: 773758 - protein, 18 aa, Mycobacterium
PGLALRSGPAYTTITATT

SEQ ID NO: 773759 - protein, 22 aa, Mycobacterium
PGLCPDCGIPLATAEPGHGHEK

SEQ ID NO: 773760 - protein, 19 aa, Mycobacterium
PGLDNAFRRRWFGWINPAQ

SEQ ID NO: 773761 - protein, 17 aa, Mycobacterium
PGLHKFRLMELVDVLMA

SEQ ID NO: 773762 - protein, 18 aa, Mycobacterium
PGLLRFTLGLGQTLALIM

SEQ ID NO: 773763 - protein, 22 aa, Mycobacterium
PGLPAGRVEFMLADAAPAAVIV

SEQ ID NO: 773764 - protein, 17 aa, Mycobacterium
PGLPRMINMYGITETTV

SEQ ID NO: 773765 - protein, 24 aa, Mycobacterium
PGLRSRFPFQLEFTSCDTDDLVRI

SEQ ID NO: 773766 - protein, 17 aa, Mycobacterium
PGLTASRFVANPFGGPG

SEQ ID NO: 773767 - protein, 17 aa, Mycobacterium
PGLTLGLGPSHEPIVRN

SEQ ID NO: 773768 - protein, 17 aa, Mycobacterium
PGLTVPWVLSARSERAL

SEQ ID NO: 773769 - protein, 17 aa, Mycobacterium
PGLVRWTSLYDMRFVEG

SEQ ID NO: 773770 - protein, 19 aa, Mycobacterium
PGLWLLASLYFRADVRGLD

SEQ ID NO: 773771 - protein, 20 aa, Mycobacterium
PGMGLSGIWLGAVVADASGQ

SEQ ID NO: 773772 - protein, 17 aa, Mycobacterium
PGMPRMINMYGITETTV

SEQ ID NO: 773773 - protein, 21 aa, Mycobacterium
PGMRPVLCLFEGVATGAADGY

SEQ ID NO: 773774 - protein, 18 aa, Mycobacterium
PGMTLLEVGCGWGLTLQR

SEQ ID NO: 773775 - protein, 18 aa, Mycobacterium
PGMTVAWQLPSHVNAAVV

SEQ ID NO: 773776 - protein, 19 aa, Mycobacterium
PGMVLTVRFDDAGDTETFL

SEQ ID NO: 773777 - protein, 19 aa, Mycobacterium
PGNSVTVGFQAAQDGAYSP

SEQ ID NO: 773778 - protein, 17 aa, Mycobacterium
PGNVWQTIEIPRLIGNL

SEQ ID NO: 773779 - protein, 17 aa, Mycobacterium
PGPCAFPDIVPWPTQAA

SEQ ID NO: 773780 - protein, 23 aa, Mycobacterium
PGPEMIAGILLEFNDRLMERHTL

SEQ ID NO: 773781 - protein, 24 aa, Mycobacterium
PGPGARPSAILAYPLVAACPTITQ

SEQ ID NO: 773782 - protein, 23 aa, Mycobacterium
PGPGESWLRPTVDLVKGEAMTPL

SEQ ID NO: 773783 - protein, 19 aa, Mycobacterium
PGPGGVRWVGVSAGGDDES

SEQ ID NO: 773784 - protein, 18 aa, Mycobacterium
PGPHGSVVPGTWRAQRTT

SEQ ID NO: 773785 - protein, 22 aa, Mycobacterium
PGPIGERADWWWYDPFQPQPPP

SEQ ID NO: 773786 - protein, 18 aa, Mycobacterium
PGPWFQWHFDRWTVPPGA

SEQ ID NO: 773787 - protein, 23 aa, Mycobacterium
PGQDGRDGGLLIGNGGNGAAGDF

SEQ ID NO: 773788 - protein, 20 aa, Mycobacterium
PGQGGNGGNANWFGSGGAGG

SEQ ID NO: 773789 - protein, 18 aa, Mycobacterium
PGQILLPGFVDLHTHLRE

SEQ ID NO: 773790 - protein, 18 aa, Mycobacterium
PGQTCWRTARADKFAPIV

SEQ ID NO: 773791 - protein, 17 aa, Mycobacterium
PGQTLCSTWDLTDWRGK

SEQ ID NO: 773792 - protein, 19 aa, Mycobacterium
PGRADWAVHIALWRRDAGT

SEQ ID NO: 773793 - protein, 19 aa, Mycobacterium
PGREPITGVSFAFVSNSSP

SEQ ID NO: 773794 - protein, 18 aa, Mycobacterium
PGRFAVRTPMQWTSGTNG

SEQ ID NO: 773795 - protein, 20 aa, Mycobacterium
PGRFRLGIGAGHPESAKRYD

SEQ ID NO: 773796 - protein, 18 aa, Mycobacterium
PGRLRAAGFTDIDTDVKR

SEQ ID NO: 773797 - protein, 20 aa, Mycobacterium
PGRLSSKFWKLLGASTERNQ

SEQ ID NO: 773798 - protein, 21 aa, Mycobacterium
PGRLSSRFWKLLGASTEKDRS

SEQ ID NO: 773799 - protein, 20 aa, Mycobacterium
PGRLSSRFWRLLGASTEKNR

SEQ ID NO: 773800 - protein, 21 aa, Mycobacterium
PGRMPSKWGAYIDDMAGFDAE

SEQ ID NO: 773801 - protein, 18 aa, Mycobacterium
PGRMSARRFWVRYAAESA

SEQ ID NO: 773802 - protein, 18 aa, Mycobacterium
PGRQLWWSYYMRLLIYVT

SEQ ID NO: 773803 - protein, 23 aa, Mycobacterium
PGRREGWDYPAMVKEAGTKALED

SEQ ID NO: 773804 - protein, 20 aa, Mycobacterium
PGRRPVFALARFVSGRDIPD

SEQ ID NO: 773805 - protein, 20 aa, Mycobacterium
PGRTVCKWGSFLDNVGDFDP

SEQ ID NO: 773806 - protein, 30 aa, Mycobacterium
PGSAMARATWRMCRDCGYYVPLGGALGVMF

SEQ ID NO: 773807 - protein, 17 aa, Mycobacterium
PGSHFRGDIALLAAEGR

SEQ ID NO: 773808 - protein, 26 aa, Mycobacterium
PGSIFPLPALPPWLATDIDNWNIIMA

SEQ ID NO: 773809 - protein, 20 aa, Mycobacterium
PGSLIWKYWGRLDVSFFGNA

SEQ ID NO: 773810 - protein, 19 aa, Mycobacterium
PGSRLGLLSRNCWQYAVLA

SEQ ID NO: 773811 - protein, 19 aa, Mycobacterium
PGTALWLYAHPLRGSLNDH

SEQ ID NO: 773812 - protein, 18 aa, Mycobacterium
PGTDISIADVLRCIDGPL

SEQ ID NO: 773813 - protein, 21 aa, Mycobacterium
PGTDRCGPWIIERAIRDVRGG

SEQ ID NO: 773814 - protein, 21 aa, Mycobacterium
PGTGGTIGIAGVPGSLPSGST

SEQ ID NO: 773815 - protein, 21 aa, Mycobacterium
PGTLEKWDLGYDVLRQHNKGV

SEQ ID NO: 773816 - protein, 20 aa, Mycobacterium
PGTLEKWNLGYDVLRERNRG

SEQ ID NO: 773817 - protein, 18 aa, Mycobacterium
PGTLERWGLGYDVLAQRN

SEQ ID NO: 773818 - protein, 17 aa, Mycobacterium
PGTRHGYHAITLGWYES

SEQ ID NO: 773819 - protein, 17 aa, Mycobacterium
PGTRLIVAGVCMQPDTV

SEQ ID NO: 773820 - protein, 17 aa, Mycobacterium
PGTRWRFEYSPESYTGT

SEQ ID NO: 773821 - protein, 18 aa, Mycobacterium
PGTSFGRWSRLLDQHART

SEQ ID NO: 773822 - protein, 17 aa, Mycobacterium
PGTSVALLFSRSAQAIV

SEQ ID NO: 773823 - protein, 20 aa, Mycobacterium
PGTVVEFGMSFGISAIHLAA

SEQ ID NO: 773824 - protein, 24 aa, Mycobacterium
PGTWGGAIAPDFRVRFGTAYDIEF

SEQ ID NO: 773825 - protein, 17 aa, Mycobacterium
PGVFVIDMDRILREPTA

SEQ ID NO: 773826 - protein, 29 aa, Mycobacterium
PGVGKVNVKLYWDLKISPITFSDITISGP

SEQ ID NO: 773827 - protein, 18 aa, Mycobacterium
PGVHGFRLLPPRTLRHQM

SEQ ID NO: 773828 - protein, 26 aa, Mycobacterium
PGVLARVAALFSRRGFNIASLAVGPT

SEQ ID NO: 773829 - protein, 25 aa, Mycobacterium
PGVLARVASLFSRRGYNIQSLAVGA

SEQ ID NO: 773830 - protein, 19 aa, Mycobacterium
PGVRGIPFIFVRTDSAGNI

SEQ ID NO: 773831 - protein, 17 aa, Mycobacterium
PGVRLWLYTNFHCNLSC

SEQ ID NO: 773832 - protein, 19 aa, Mycobacterium
PGVVLRLGAAVGDAVTAGT

SEQ ID NO: 773833 - protein, 17 aa, Mycobacterium
PGWACYHTEMWVVEVDG

SEQ ID NO: 773834 - protein, 28 aa, Mycobacterium
PGWAKHAWSCFFAPWIAEATIFVYNYRR

SEQ ID NO: 773835 - protein, 20 aa, Mycobacterium
PGWHWRTWHLYPRNAFGSGG

SEQ ID NO: 773836 - protein, 17 aa, Mycobacterium
PGWTMYMISHFHYDPVW

SEQ ID NO: 773837 - protein, 18 aa, Mycobacterium
PGYQGWQWAVVVAAHAGA

SEQ ID NO: 773838 - protein, 19 aa, Mycobacterium
PGYRGWQWAVVVAACPGAG

SEQ ID NO: 773839 - protein, 17 aa, Mycobacterium
PGYVAAFSVPANQLPQV

SEQ ID NO: 773840 - protein, 17 aa, Mycobacterium
PGYVTALLGDRVGEITT

SEQ ID NO: 773841 - protein, 18 aa, Mycobacterium
PHAKGGGAFGQFEVTHDV

SEQ ID NO: 773842 - protein, 20 aa, Mycobacterium
PHAKGGGAHGHFEVTHDVSK

SEQ ID NO: 773843 - protein, 22 aa, Mycobacterium
PHAKGSGAFGHFEVTGDVSRYT

SEQ ID NO: 773844 - protein, 17 aa, Mycobacterium
PHALKYGVTYNHILGVE

SEQ ID NO: 773845 - protein, 23 aa, Mycobacterium
PHCPRSPVIPGIVWYSAETQPDG

SEQ ID NO: 773846 - protein, 24 aa, Mycobacterium
PHGCYPCAGGAWLAVAVADDSQWR

SEQ ID NO: 773847 - protein, 17 aa, Mycobacterium
PHGLAVMWGMDLINFLG

SEQ ID NO: 773848 - protein, 17 aa, Mycobacterium
PHGLPFTELLALHGVSP

SEQ ID NO: 773849 - protein, 24 aa, Mycobacterium
PHIWRSRGGGFVFFAGARGDASFA

SEQ ID NO: 773850 - protein, 19 aa, Mycobacterium
PHKLVLCARLGPLGAARIT

SEQ ID NO: 773851 - protein, 17 aa, Mycobacterium
PHLAAAWEYDWPAPRWE

SEQ ID NO: 773852 - protein, 18 aa, Mycobacterium
PHLFEFGSLIQALNSERV

SEQ ID NO: 773853 - protein, 20 aa, Mycobacterium
PHLQEFLANWFVSVDHVRTD

SEQ ID NO: 773854 - protein, 26 aa, Mycobacterium
PHNDRLFCIPATIDLAGAEIELVSMV

SEQ ID NO: 773855 - protein, 17 aa, Mycobacterium
PHPAALLSRIGHKHASL

SEQ ID NO: 773856 - protein, 18 aa, Mycobacterium
PHPEEFEALAGRCPVFRF

SEQ ID NO: 773857 - protein, 25 aa, Mycobacterium
PHPRAEVFESLRFVLNGEQIRPLEV

SEQ ID NO: 773858 - protein, 18 aa, Mycobacterium
PHQCYRLGEQLGYTTAVT

SEQ ID NO: 773859 - protein, 19 aa, Mycobacterium
PHRGVDTGGVWVWRDAQAV

SEQ ID NO: 773860 - protein, 18 aa, Mycobacterium
PHRPRVINMYGITETTVH

SEQ ID NO: 773861 - protein, 18 aa, Mycobacterium
PHRYSLPLAEVLAGTLAG

SEQ ID NO: 773862 - protein, 23 aa, Mycobacterium
PHTRASALVAEWPARTDAADPDP

SEQ ID NO: 773863 - protein, 17 aa, Mycobacterium
PHTTLGAAIAWAPAPPD

SEQ ID NO: 773864 - protein, 18 aa, Mycobacterium
PHVWAIGDVASWRDHVGG

SEQ ID NO: 773865 - protein, 18 aa, Mycobacterium
PHVWAIGDVASWRDTVGG

SEQ ID NO: 773866 - protein, 18 aa, Mycobacterium
PHWLFPGMQFMPVAARTQ

SEQ ID NO: 773867 - protein, 20 aa, Mycobacterium
PHYKDLRSFYAYDKDKAGKL

SEQ ID NO: 773868 - protein, 22 aa, Mycobacterium
PIAFTRPVWRVDLFGSTESPPG

SEQ ID NO: 773869 - protein, 18 aa, Mycobacterium
PIAIVGMSCRFPGGVDSP

SEQ ID NO: 773870 - protein, 19 aa, Mycobacterium
PIAIVGMSCRFPGGVDSPE

SEQ ID NO: 773871 - protein, 18 aa, Mycobacterium
PIAVIGIGCRFPGADGPA

SEQ ID NO: 773872 - protein, 18 aa, Mycobacterium
PIAVVGMGCRFPGAVDNP

SEQ ID NO: 773873 - protein, 18 aa, Mycobacterium
PIAVVGMGCRFPGGVDNP

SEQ ID NO: 773874 - protein, 20 aa, Mycobacterium
PICAPDLLLAQALLRTKQIK

SEQ ID NO: 773875 - protein, 19 aa, Mycobacterium
PICCPGCGPTLRYRDRAGR

SEQ ID NO: 773876 - protein, 18 aa, Mycobacterium
PICEFVRATGEIHLNSTW

SEQ ID NO: 773877 - protein, 19 aa, Mycobacterium
PICQMFHTLPIPWVEAEDI

SEQ ID NO: 773878 - protein, 19 aa, Mycobacterium
PIEAFIAVANKYGWEHGCE

SEQ ID NO: 773879 - protein, 17 aa, Mycobacterium
PIEEGWKMSAMLTLGYP

SEQ ID NO: 773880 - protein, 25 aa, Mycobacterium
PIERFLEWWAPFANFLYDTAGLPFF

SEQ ID NO: 773881 - protein, 24 aa, Mycobacterium
PIERTVEFLQWFLGTIPIEPIWLC

SEQ ID NO: 773882 - protein, 17 aa, Mycobacterium
PIEWRYTNDPSWVMRDK

SEQ ID NO: 773883 - protein, 18 aa, Mycobacterium
PIEWRYTNDPSWVMREKG

SEQ ID NO: 773884 - protein, 17 aa, Mycobacterium
PIFAEWEADFGRTFVLS

SEQ ID NO: 773885 - protein, 27 aa, Mycobacterium
PIGAPSFKEALRWGAEVYHSLKSVLKK

SEQ ID NO: 773886 - protein, 26 aa, Mycobacterium
PIGAPSFKESLRWGTEVYHSLKSVLK

SEQ ID NO: 773887 - protein, 19 aa, Mycobacterium
PIGIGDLSYRVVITGDPDL

SEQ ID NO: 773888 - protein, 19 aa, Mycobacterium
PIKLMGIDSVLALYSSLDD

SEQ ID NO: 773889 - protein, 19 aa, Mycobacterium
PIKLMGIDSVLALYSSLDG

SEQ ID NO: 773890 - protein, 17 aa, Mycobacterium
PILDPFDPVTVWGYDEC

SEQ ID NO: 773891 - protein, 24 aa, Mycobacterium
PILGLEFFSSAPFRHGDHVAKYRF

SEQ ID NO: 773892 - protein, 18 aa, Mycobacterium
PILKPGSWIGGDRDGNPN

SEQ ID NO: 773893 - protein, 22 aa, Mycobacterium
PIPGDVCFFGFEPWEIGNPAYG

SEQ ID NO: 773894 - protein, 22 aa, Mycobacterium
PIPRYRLEETLSRYPDDAQYIW

SEQ ID NO: 773895 - protein, 20 aa, Mycobacterium
PIRHWLRSGALLDWAHQTVS

SEQ ID NO: 773896 - protein, 18 aa, Mycobacterium
PIRLPRRIVEPMWAVAEW

SEQ ID NO: 773897 - protein, 24 aa, Mycobacterium
PIRVDWRAGCAFTTPPGMWHAHYN

SEQ ID NO: 773898 - protein, 17 aa, Mycobacterium
PITDLGMVKSIDTEPDG

SEQ ID NO: 773899 - protein, 17 aa, Mycobacterium
PITELGMVKGIDISPQG

SEQ ID NO: 773900 - protein, 19 aa, Mycobacterium
PITFGYRVACWTAPLLRHL

SEQ ID NO: 773901 - protein, 19 aa, Mycobacterium
PIVGVSWWLRERGMPIKTL

SEQ ID NO: 773902 - protein, 21 aa, Mycobacterium
PIWEWDGTDLFGWIATVPTPL

SEQ ID NO: 773903 - protein, 18 aa, Mycobacterium
PKAALLLITRVTFDQTGT

SEQ ID NO: 773904 - protein, 30 aa, Mycobacterium
PKASVMTHLRWLKALAAFGGIGLRLKASDT

SEQ ID NO: 773905 - protein, 29 aa, Mycobacterium
PKASVMTHLRWLKALAAFGGIGLRLKSSD

SEQ ID NO: 773906 - protein, 19 aa, Mycobacterium
PKATWAHKSTEDFEPLTAT

SEQ ID NO: 773907 - protein, 17 aa, Mycobacterium
PKDAGGVLIELVEPSPE

SEQ ID NO: 773908 - protein, 20 aa, Mycobacterium
PKFIRFMLRWVIKAPEFLQL

SEQ ID NO: 773909 - protein, 21 aa, Mycobacterium
PKFYWSVFSTRAFEAGLAALT

SEQ ID NO: 773910 - protein, 23 aa, Mycobacterium
PKGPFVDAAERWRTLERAMEARL

SEQ ID NO: 773911 - protein, 28 aa, Mycobacterium
PKGSPRKLAMEFARFLGLPMLNPRMNVT

SEQ ID NO: 773912 - protein, 28 aa, Mycobacterium
PKGSPRKLAMEFARFLGLPTLNQRMNVT

SEQ ID NO: 773913 - protein, 18 aa, Mycobacterium
PKGVLWRQHDIFLSSMGG

SEQ ID NO: 773914 - protein, 18 aa, Mycobacterium
PKGVLWRQHDIFMASFGG

SEQ ID NO: 773915 - protein, 18 aa, Mycobacterium
PKGVLWRQHDIFMTSFGG

SEQ ID NO: 773916 - protein, 18 aa, Mycobacterium
PKHYWSIYQKMIVKGRDF

SEQ ID NO: 773917 - protein, 17 aa, Mycobacterium
PKIPLGRIGRPEELTGL

SEQ ID NO: 773918 - protein, 18 aa, Mycobacterium
PKIPRAGEVIGYTGLDPG

SEQ ID NO: 773919 - protein, 20 aa, Mycobacterium
PKIVKFAGCYHGHADALLAD

SEQ ID NO: 773920 - protein, 20 aa, Mycobacterium
PKIVKFSGCYHGHADALLAD

SEQ ID NO: 773921 - protein, 22 aa, Mycobacterium
PKKQIDGALRFSWSHLTGEVPW

SEQ ID NO: 773922 - protein, 18 aa, Mycobacterium
PKKVFAHGFLFNRGEKMS

SEQ ID NO: 773923 - protein, 19 aa, Mycobacterium
PKLDLGWMVQSWPEDTENP

SEQ ID NO: 773924 - protein, 17 aa, Mycobacterium
PKLGWCWDRNPHTWLGT

SEQ ID NO: 773925 - protein, 19 aa, Mycobacterium
PKLHGGVMLALLAGAARES

SEQ ID NO: 773926 - protein, 17 aa, Mycobacterium
PKLPGIPGIKDFGGHIF

SEQ ID NO: 773927 - protein, 17 aa, Mycobacterium
PKLRQGSYFPDWLLERR

SEQ ID NO: 773928 - protein, 25 aa, Mycobacterium
PKLSAVRQRVRWWSAIALLRCLASS

SEQ ID NO: 773929 - protein, 19 aa, Mycobacterium
PKLTFSWRLMPENLSDAGV

SEQ ID NO: 773930 - protein, 17 aa, Mycobacterium
PKLVGRMVLNRNVDNFF

SEQ ID NO: 773931 - protein, 18 aa, Mycobacterium
PKNSRLGYRETINYATKI

SEQ ID NO: 773932 - protein, 18 aa, Mycobacterium
PKNVRRLEGWIRGHAHDL

SEQ ID NO: 773933 - protein, 25 aa, Mycobacterium
PKPAGVPFLWRWQDVHAKLLKSCDV

SEQ ID NO: 773934 - protein, 20 aa, Mycobacterium
PKPEVWACGYGRPKFAKAVA

SEQ ID NO: 773935 - protein, 19 aa, Mycobacterium
PKPLGMPLQYMVSGMAVAA

SEQ ID NO: 773936 - protein, 17 aa, Mycobacterium
PKPLRRAIAWYRDHDRL

SEQ ID NO: 773937 - protein, 19 aa, Mycobacterium
PKPLSAYLFTKRRETRERV

SEQ ID NO: 773938 - protein, 18 aa, Mycobacterium
PKPWWYRPMYSLFDQFLG

SEQ ID NO: 773939 - protein, 24 aa, Mycobacterium
PKQLEIKLAWAVRREDGWSPRRVT

SEQ ID NO: 773940 - protein, 19 aa, Mycobacterium
PKREWKEVVLLAGGRSDVA

SEQ ID NO: 773941 - protein, 19 aa, Mycobacterium
PKRRYELFRAFDDDRLADV

SEQ ID NO: 773942 - protein, 19 aa, Mycobacterium
PKRRYEVLKALDDDRLADV

SEQ ID NO: 773943 - protein, 21 aa, Mycobacterium
PKRYLCGGVMLSFDEMINALE

SEQ ID NO: 773944 - protein, 17 aa, Mycobacterium
PKSGWRKAVHRLSGGAI

SEQ ID NO: 773945 - protein, 21 aa, Mycobacterium
PKSRILSDLGWRRCPRRKPGA

SEQ ID NO: 773946 - protein, 23 aa, Mycobacterium
PKTAETAIEFGLRVDVQPETAAV

SEQ ID NO: 773947 - protein, 18 aa, Mycobacterium
PKVARLVLDAAVLKDTMV

SEQ ID NO: 773948 - protein, 18 aa, Mycobacterium
PKVVERLGVDMAELEELH

SEQ ID NO: 773949 - protein, 22 aa, Mycobacterium
PKWLELVEPYGFTEAERPDPGL

SEQ ID NO: 773950 - protein, 25 aa, Mycobacterium
PKWWQAPLRWAFRTALGARASLVVR

SEQ ID NO: 773951 - protein, 20 aa, Mycobacterium
PLAAGLLDWQAVRLGHPARD

SEQ ID NO: 773952 - protein, 19 aa, Mycobacterium
PLADTGACWVVQHGKAPTP

SEQ ID NO: 773953 - protein, 18 aa, Mycobacterium
PLAEALRYPAGLIDDFEW

SEQ ID NO: 773954 - protein, 17 aa, Mycobacterium
PLAELRRTGLLDKLLLL

SEQ ID NO: 773955 - protein, 20 aa, Mycobacterium
PLAHLRAFVLIPWLDVDPDA

SEQ ID NO: 773956 - protein, 24 aa, Mycobacterium
PLAMPRLDMVTGLYFLTTEIPGDI

SEQ ID NO: 773957 - protein, 20 aa, Mycobacterium
PLARSVLDAALFLDATSTVP

SEQ ID NO: 773958 - protein, 19 aa, Mycobacterium
PLCFGFHPYLRLPDAARAE

SEQ ID NO: 773959 - protein, 20 aa, Mycobacterium
PLDEVRSAYELLERQHTRGK

SEQ ID NO: 773960 - protein, 29 aa, Mycobacterium
PLDGFPERRARLMIEMHVLGPLHLCQLAI

SEQ ID NO: 773961 - protein, 18 aa, Mycobacterium
PLDICFSAGNLLEDSRSA

SEQ ID NO: 773962 - protein, 19 aa, Mycobacterium
PLDMFGEWNRAYGAAGFTQ

SEQ ID NO: 773963 - protein, 20 aa, Mycobacterium
PLDMFGEWNRAYGPAGFLQY

SEQ ID NO: 773964 - protein, 20 aa, Mycobacterium
PLDMPGVFDTGGWLQPNGIA

SEQ ID NO: 773965 - protein, 18 aa, Mycobacterium
PLDRARPLWELHVIHGLA

SEQ ID NO: 773966 - protein, 20 aa, Mycobacterium
PLDVDLRWVAALLLRNGTIE

SEQ ID NO: 773967 - protein, 18 aa, Mycobacterium
PLDVGGLHMAHWLEGTGL

SEQ ID NO: 773968 - protein, 19 aa, Mycobacterium
PLDVRVCTGGKPLPGMEAR

SEQ ID NO: 773969 - protein, 24 aa, Mycobacterium
PLEHLSFFVLDGWLRQVPVGVVGE

SEQ ID NO: 773970 - protein, 18 aa, Mycobacterium
PLELLSFVAAATTTLGLS

SEQ ID NO: 773971 - protein, 23 aa, Mycobacterium
PLELPAVAVGVAWHPRNNDDAAH

SEQ ID NO: 773972 - protein, 17 aa, Mycobacterium
PLFAANLALPWPDDPLA

SEQ ID NO: 773973 - protein, 18 aa, Mycobacterium
PLFHDMGLILGICAPLVA

SEQ ID NO: 773974 - protein, 18 aa, Mycobacterium
PLFLRIPALRGMLPAVAH

SEQ ID NO: 773975 - protein, 18 aa, Mycobacterium
PLFMAGLWSVWKPAKDAS

SEQ ID NO: 773976 - protein, 21 aa, Mycobacterium
PLFPAHCWFDGDGWGCAVYEP

SEQ ID NO: 773977 - protein, 22 aa, Mycobacterium
PLGEPRPGLGRVGGPGHVAHQP

SEQ ID NO: 773978 - protein, 17 aa, Mycobacterium
PLGFLMYRVMAVLQPAV

SEQ ID NO: 773979 - protein, 17 aa, Mycobacterium
PLGGLALTCDVSDPDQV

SEQ ID NO: 773980 - protein, 17 aa, Mycobacterium
PLGGLTAMGIWGARHAP

SEQ ID NO: 773981 - protein, 19 aa, Mycobacterium
PLGHLWRWELQPAGEGRTL

SEQ ID NO: 773982 - protein, 25 aa, Mycobacterium
PLGLLRMGLPSGISMSAYSGGLTYL

SEQ ID NO: 773983 - protein, 19 aa, Mycobacterium
PLGLYCRASLAKYMDAERL

SEQ ID NO: 773984 - protein, 19 aa, Mycobacterium
PLGVKDLYDTAGIRTTSSS

SEQ ID NO: 773985 - protein, 18 aa, Mycobacterium
PLGVPRPRMIGVLRGFDP

SEQ ID NO: 773986 - protein, 18 aa, Mycobacterium
PLGWPRGRYGPTTRRPVA

SEQ ID NO: 773987 - protein, 20 aa, Mycobacterium
PLHDCFAALEWLHGHAGELG

SEQ ID NO: 773988 - protein, 19 aa, Mycobacterium
PLHDLRTLVGPGWVATDPP

SEQ ID NO: 773989 - protein, 19 aa, Mycobacterium
PLHLCQLAIPAMRERGRGW

SEQ ID NO: 773990 - protein, 19 aa, Mycobacterium
PLHLHRILLQRSWIPIFCS

SEQ ID NO: 773991 - protein, 19 aa, Mycobacterium
PLHLVRLATMLPWAPLVPF

SEQ ID NO: 773992 - protein, 20 aa, Mycobacterium
PLHPKPVYLFAYDPTAFGGK

SEQ ID NO: 773993 - protein, 19 aa, Mycobacterium
PLIDIKPAAGFFNATTGPS

SEQ ID NO: 773994 - protein, 18 aa, Mycobacterium
PLIEAMGLTVGWITAEST

SEQ ID NO: 773995 - protein, 17 aa, Mycobacterium
PLIGNGIDGTATNPNGG

SEQ ID NO: 773996 - protein, 18 aa, Mycobacterium
PLIKRIVLKTVVLLSPRT

SEQ ID NO: 773997 - protein, 18 aa, Mycobacterium
PLILRQAYPVPRAPYGLA

SEQ ID NO: 773998 - protein, 17 aa, Mycobacterium
PLIRRKLAEMIVDVEAA

SEQ ID NO: 773999 - protein, 17 aa, Mycobacterium
PLKRWQLCLDVNTTGVF

SEQ ID NO: 774000 - protein, 17 aa, Mycobacterium
PLLDIGIDWKTYRDAID

SEQ ID NO: 774001 - protein, 19 aa, Mycobacterium
PLLDIGLTDVEAWAFLQEL

SEQ ID NO: 774002 - protein, 18 aa, Mycobacterium
PLLDLPWDIEESPSGMAV

SEQ ID NO: 774003 - protein, 23 aa, Mycobacterium
PLLDLSFGDLQFGNRDTTAIGDG

SEQ ID NO: 774004 - protein, 23 aa, Mycobacterium
PLLEALGLTVGWITAESTSEDRK

SEQ ID NO: 774005 - protein, 18 aa, Mycobacterium
PLLEGELFSSYSMTEPHA

SEQ ID NO: 774006 - protein, 23 aa, Mycobacterium
PLLEPLRAIPFIGRPLADLIQPD

SEQ ID NO: 774007 - protein, 20 aa, Mycobacterium
PLLGICGGFQMLGRVIRDPD

SEQ ID NO: 774008 - protein, 20 aa, Mycobacterium
PLLIAEAGGDPWAIDQSLQA

SEQ ID NO: 774009 - protein, 19 aa, Mycobacterium
PLLIAEAGGDPWAINQSLQ

SEQ ID NO: 774010 - protein, 18 aa, Mycobacterium
PLLPDIFGSVGMTGINGQ

SEQ ID NO: 774011 - protein, 22 aa, Mycobacterium
PLLPEVAWSWLVDALESRMEQV

SEQ ID NO: 774012 - protein, 22 aa, Mycobacterium
PLLPEVAWSWLVEALESRMEHV

SEQ ID NO: 774013 - protein, 23 aa, Mycobacterium
PLLPEWLLPWLLRLYWRRWSPGY

SEQ ID NO: 774014 - protein, 20 aa, Mycobacterium
PLLPRPWYSYTLTGLIGALK

SEQ ID NO: 774015 - protein, 21 aa, Mycobacterium
PLLRPGDRVHVSWSPDASRVL

SEQ ID NO: 774016 - protein, 22 aa, Mycobacterium
PLLRRAGVIFIRRNIGANPLYK

SEQ ID NO: 774017 - protein, 24 aa, Mycobacterium
PLLRRPDLLVSMLTYWQRHPALSY

SEQ ID NO: 774018 - protein, 21 aa, Mycobacterium
PLLRRSGVIFIRRNIGNDQLY

SEQ ID NO: 774019 - protein, 26 aa, Mycobacterium
PLLTPLRFIPVLGNPLADLVEPNLTT

SEQ ID NO: 774020 - protein, 21 aa, Mycobacterium
PLLVVRINFLGTRQFTEALVD

SEQ ID NO: 774021 - protein, 23 aa, Mycobacterium
PLLVWDFRLPRVVSINVSGHKYG

SEQ ID NO: 774022 - protein, 21 aa, Mycobacterium
PLMHGAAQWAVFTAMNTGQSV

SEQ ID NO: 774023 - protein, 25 aa, Mycobacterium
PLMPPQMLHMILPRKDYEIVDDSWD

SEQ ID NO: 774024 - protein, 19 aa, Mycobacterium
PLMRRAGMIFIRRNIAGDP

SEQ ID NO: 774025 - protein, 17 aa, Mycobacterium
PLMRRLRVMRSNAERRE

SEQ ID NO: 774026 - protein, 19 aa, Mycobacterium
PLMRRSGVIFLRRKLDDPL

SEQ ID NO: 774027 - protein, 19 aa, Mycobacterium
PLPAALRWAMRIPGGKALQ

SEQ ID NO: 774028 - protein, 18 aa, Mycobacterium
PLPAPRISPFPAVHQDVS

SEQ ID NO: 774029 - protein, 22 aa, Mycobacterium
PLPARATVTWSLTGALQLMLFP

SEQ ID NO: 774030 - protein, 18 aa, Mycobacterium
PLPESWAELGFLIAVRPD

SEQ ID NO: 774031 - protein, 23 aa, Mycobacterium
PLPEVRSQLALTWGTETFIVPVM

SEQ ID NO: 774032 - protein, 23 aa, Mycobacterium
PLPGHAPSGLGFRPDGTLYIVST

SEQ ID NO: 774033 - protein, 20 aa, Mycobacterium
PLPLDAPMVVLRTHRLQLPS

SEQ ID NO: 774034 - protein, 18 aa, Mycobacterium
PLPLQWGKYRPGTLVAAE

SEQ ID NO: 774035 - protein, 21 aa, Mycobacterium
PLPPGLGRFPLRRVADYPNTA

SEQ ID NO: 774036 - protein, 20 aa, Mycobacterium
PLPQTRFVLRKALAAHLPVI

SEQ ID NO: 774037 - protein, 20 aa, Mycobacterium
PLPQTRFVLRKALSAHLPVI

SEQ ID NO: 774038 - protein, 17 aa, Mycobacterium
PLPREWPALTKAMSPYV

SEQ ID NO: 774039 - protein, 18 aa, Mycobacterium
PLPRRLTGDLVRLPLRVR

SEQ ID NO: 774040 - protein, 19 aa, Mycobacterium
PLPSPRPPVLLGVNSVALA

SEQ ID NO: 774041 - protein, 24 aa, Mycobacterium
PLQGCYRIAVLSLKGGVGKTTITA

SEQ ID NO: 774042 - protein, 21 aa, Mycobacterium
PLQHPETFQRLGVEPPRGVLL

SEQ ID NO: 774043 - protein, 20 aa, Mycobacterium
PLRARRVVVCVDDDAGRAMA

SEQ ID NO: 774044 - protein, 22 aa, Mycobacterium
PLRDWWQVCEWASRLDDDRVRD

SEQ ID NO: 774045 - protein, 19 aa, Mycobacterium
PLRELAGWPALLRGKLSVT

SEQ ID NO: 774046 - protein, 18 aa, Mycobacterium
PLRFCGFVQSMGGTAVVM

SEQ ID NO: 774047 - protein, 22 aa, Mycobacterium
PLRHAVKAWTRCPVVVDPTQVV

SEQ ID NO: 774048 - protein, 18 aa, Mycobacterium
PLRKAGIMKPIFVMLGEH

SEQ ID NO: 774049 - protein, 23 aa, Mycobacterium
PLRLAELFVEAGLPPGVFQVVHG

SEQ ID NO: 774050 - protein, 19 aa, Mycobacterium
PLRLQFWVCGVFEVHDGKI

SEQ ID NO: 774051 - protein, 23 aa, Mycobacterium
PLRLQFWVCGVFEVHNGRITLWR

SEQ ID NO: 774052 - protein, 20 aa, Mycobacterium
PLRLRGMSAMLARIKRRLRE

SEQ ID NO: 774053 - protein, 18 aa, Mycobacterium
PLRLRGMSAMLTRIKRRL

SEQ ID NO: 774054 - protein, 19 aa, Mycobacterium
PLRMMRIDEVIDLYATTDE

SEQ ID NO: 774055 - protein, 20 aa, Mycobacterium
PLRPDCRILACSSVFGTWGG

SEQ ID NO: 774056 - protein, 19 aa, Mycobacterium
PLRPDCRILACSSVFGVWG

SEQ ID NO: 774057 - protein, 17 aa, Mycobacterium
PLRPWPGFTPMIYERYS

SEQ ID NO: 774058 - protein, 19 aa, Mycobacterium
PLRPWPGFTPMIYRQYSEP

SEQ ID NO: 774059 - protein, 21 aa, Mycobacterium
PLRPWPGFVPMIYDRYSQPFF

SEQ ID NO: 774060 - protein, 19 aa, Mycobacterium
PLRPWPGFVPMLYERYSQP

SEQ ID NO: 774061 - protein, 21 aa, Mycobacterium
PLRQHIRFCYAADGVRLAYAA

SEQ ID NO: 774062 - protein, 18 aa, Mycobacterium
PLRVKAAAVGLPADEYHA

SEQ ID NO: 774063 - protein, 19 aa, Mycobacterium
PLRWRLATVPLDLGHPWWV

SEQ ID NO: 774064 - protein, 25 aa, Mycobacterium
PLSLGVAVTEIWNWLAAEQHRPLLK

SEQ ID NO: 774065 - protein, 23 aa, Mycobacterium
PLSRACLLGCGITTGWGSAVNTA

SEQ ID NO: 774066 - protein, 18 aa, Mycobacterium
PLSRGFERFYGFLGGETD

SEQ ID NO: 774067 - protein, 18 aa, Mycobacterium
PLSRGFERFYGFMGGETD

SEQ ID NO: 774068 - protein, 23 aa, Mycobacterium
PLSWEWTDAAGFGETVMAAGPAV

SEQ ID NO: 774069 - protein, 17 aa, Mycobacterium
PLTNWRIPGPELKFEER

SEQ ID NO: 774070 - protein, 17 aa, Mycobacterium
PLTNWRIPGPELKFQEQ

SEQ ID NO: 774071 - protein, 18 aa, Mycobacterium
PLTRLRVDGGLTRSEALM

SEQ ID NO: 774072 - protein, 18 aa, Mycobacterium
PLTRPRIVVFAGDHGVTK

SEQ ID NO: 774073 - protein, 18 aa, Mycobacterium
PLVCRGVLVDVPKLRGVD

SEQ ID NO: 774074 - protein, 23 aa, Mycobacterium
PLVDARAALAIAQRQRQTLGDIE

SEQ ID NO: 774075 - protein, 18 aa, Mycobacterium
PLVGRWVPDFAVANSRGT

SEQ ID NO: 774076 - protein, 18 aa, Mycobacterium
PLVLRMAWHFAGTYRIGD

SEQ ID NO: 774077 - protein, 25 aa, Mycobacterium
PLVLVVHGGPWFRDSWGFDGHVQLL

SEQ ID NO: 774078 - protein, 17 aa, Mycobacterium
PLVMPERDWDRWLDPDA

SEQ ID NO: 774079 - protein, 18 aa, Mycobacterium
PLVNLAVGPLQFDPKFSR

SEQ ID NO: 774080 - protein, 17 aa, Mycobacterium
PLVPAMFSGVLSRLRRT

SEQ ID NO: 774081 - protein, 23 aa, Mycobacterium
PLVRLRVPFTISRSAIDDVERGA

SEQ ID NO: 774082 - protein, 22 aa, Mycobacterium
PLVRLRVPFTVARRDIDDVERG

SEQ ID NO: 774083 - protein, 20 aa, Mycobacterium
PLWALWRFGTEPGFAKMTME

SEQ ID NO: 774084 - protein, 17 aa, Mycobacterium
PLWECWIIEGLAGGRWA

SEQ ID NO: 774085 - protein, 18 aa, Mycobacterium
PLWECWVIEGLEHNRWAI

SEQ ID NO: 774086 - protein, 17 aa, Mycobacterium
PLWKLNLAVMQRFLTFM

SEQ ID NO: 774087 - protein, 22 aa, Mycobacterium
PLWLRLERFAVWLIFEVLAVTL

SEQ ID NO: 774088 - protein, 18 aa, Mycobacterium
PLYHDMGLMLGLCAPVLG

SEQ ID NO: 774089 - protein, 17 aa, Mycobacterium
PLYPIPLLLGGSGPRMM

SEQ ID NO: 774090 - protein, 20 aa, Mycobacterium
PLYWQCWKLDSAVVAQVTAA

SEQ ID NO: 774091 - protein, 24 aa, Mycobacterium
PLYYPRFLTELPYLGQALLLGIPG

SEQ ID NO: 774092 - protein, 19 aa, Mycobacterium
PMAEDRWGMFLGDVSGKGA

SEQ ID NO: 774093 - protein, 22 aa, Mycobacterium
PMATKMTEWPGGVTVFDIRTDA

SEQ ID NO: 774094 - protein, 21 aa, Mycobacterium
PMATKMTEWPGGVTVYDIRTE

SEQ ID NO: 774095 - protein, 19 aa, Mycobacterium
PMCKRLVMSSGFYRAIQRD

SEQ ID NO: 774096 - protein, 20 aa, Mycobacterium
PMDGWYEWRPNPAADGKKAS

SEQ ID NO: 774097 - protein, 24 aa, Mycobacterium
PMDVLWFRLNWRPGDPQELYGVAR

SEQ ID NO: 774098 - protein, 17 aa, Mycobacterium
PMFHAWGFSQLAFAASM

SEQ ID NO: 774099 - protein, 18 aa, Mycobacterium
PMFHAWGFSQLIFAASMA

SEQ ID NO: 774100 - protein, 18 aa, Mycobacterium
PMFHAWGFSQLLLAASFA

SEQ ID NO: 774101 - protein, 20 aa, Mycobacterium
PMGFRRLGMRDVDDFARHAS

SEQ ID NO: 774102 - protein, 18 aa, Mycobacterium
PMGLGLVSQFFGRYFSPD

SEQ ID NO: 774103 - protein, 19 aa, Mycobacterium
PMGPLRLSDLIGLDTMKLI

SEQ ID NO: 774104 - protein, 19 aa, Mycobacterium
PMIGEFCYQCMHSIKAGIK

SEQ ID NO: 774105 - protein, 20 aa, Mycobacterium
PMIHPFCGPTRKLGGDNADF

SEQ ID NO: 774106 - protein, 21 aa, Mycobacterium
PMIVGALPFDVSEPAALMVPT

SEQ ID NO: 774107 - protein, 17 aa, Mycobacterium
PMLFEWTDRETLLYALG

SEQ ID NO: 774108 - protein, 24 aa, Mycobacterium
PMLPPEINSLLMFNGAGSAPMLQA

SEQ ID NO: 774109 - protein, 17 aa, Mycobacterium
PMLSDWRRPQAELDESS

SEQ ID NO: 774110 - protein, 21 aa, Mycobacterium
PMPVIAASLFARFASRQEDSP

SEQ ID NO: 774111 - protein, 17 aa, Mycobacterium
PMRPNGGVLGRFPALTI

SEQ ID NO: 774112 - protein, 23 aa, Mycobacterium
PMSTIALAWLLRRSPVIVPIPGT

SEQ ID NO: 774113 - protein, 17 aa, Mycobacterium
PMSVEFSTILAGLGSEV

SEQ ID NO: 774114 - protein, 17 aa, Mycobacterium
PMTIAAWGFAPALAAGC

SEQ ID NO: 774115 - protein, 18 aa, Mycobacterium
PMWPEPLGRLAFTFRYRG

SEQ ID NO: 774116 - protein, 22 aa, Mycobacterium
PNAECWIHLQLPPSIDAERLAF

SEQ ID NO: 774117 - protein, 18 aa, Mycobacterium
PNAYRFGTVGWPFPATDV

SEQ ID NO: 774118 - protein, 24 aa, Mycobacterium
PNFGKGTLFGAIRPDDVAAHFGRG

SEQ ID NO: 774119 - protein, 20 aa, Mycobacterium
PNFPWPWGLIDLAARVVLPV

SEQ ID NO: 774120 - protein, 17 aa, Mycobacterium
PNFWAWLIGEVKNIDPD

SEQ ID NO: 774121 - protein, 19 aa, Mycobacterium
PNFWAWLIGQIKAVDPDVL

SEQ ID NO: 774122 - protein, 19 aa, Mycobacterium
PNGIPLWAGAAFKHASAGP

SEQ ID NO: 774123 - protein, 18 aa, Mycobacterium
PNGIPLWAGTSFKEAQPG

SEQ ID NO: 774124 - protein, 17 aa, Mycobacterium
PNGPVLLDCLEFDDRLR

SEQ ID NO: 774125 - protein, 20 aa, Mycobacterium
PNGWCMLPPLQSCDKGNACL

SEQ ID NO: 774126 - protein, 20 aa, Mycobacterium
PNGYCGLPLQKSCPHANACL

SEQ ID NO: 774127 - protein, 20 aa, Mycobacterium
PNKHLAFGFGVHFCLGAALA

SEQ ID NO: 774128 - protein, 21 aa, Mycobacterium
PNKNIRLGIEWIDHYSDALPL

SEQ ID NO: 774129 - protein, 21 aa, Mycobacterium
PNKNIRLVIEWIDRYAEALPL

SEQ ID NO: 774130 - protein, 21 aa, Mycobacterium
PNKNIRLVIEWLDRYSDSLSL

SEQ ID NO: 774131 - protein, 18 aa, Mycobacterium
PNLFATHRVRAVDDYPAH

SEQ ID NO: 774132 - protein, 20 aa, Mycobacterium
PNLGRYGVWTAGAVTPKQAA

SEQ ID NO: 774133 - protein, 17 aa, Mycobacterium
PNLKVLVNWGYGNLEHG

SEQ ID NO: 774134 - protein, 20 aa, Mycobacterium
PNLPWPWGLIDLTARVLIPA

SEQ ID NO: 774135 - protein, 17 aa, Mycobacterium
PNLRCLMLTSFTSDEAM

SEQ ID NO: 774136 - protein, 18 aa, Mycobacterium
PNMIPRGGVLGTQHLVDV

SEQ ID NO: 774137 - protein, 25 aa, Mycobacterium
PNMPKSVVINPYFDWGVDRPPSHDY

SEQ ID NO: 774138 - protein, 18 aa, Mycobacterium
PNNLLAMLWTWQNGNVGN

SEQ ID NO: 774139 - protein, 17 aa, Mycobacterium
PNNWWGFQPNDYKIIFH

SEQ ID NO: 774140 - protein, 17 aa, Mycobacterium
PNPESWLLVGISETADR

SEQ ID NO: 774141 - protein, 27 aa, Mycobacterium
PNPSELCSFPLRQCGSGNLFGGNEPAR

SEQ ID NO: 774142 - protein, 23 aa, Mycobacterium
PNQGFRRPMWWRLLDGDRPVVHV

SEQ ID NO: 774143 - protein, 19 aa, Mycobacterium
PNQQFALLFVDWLRANSGV

SEQ ID NO: 774144 - protein, 19 aa, Mycobacterium
PNQQFALLFVDWLTDNPAV

SEQ ID NO: 774145 - protein, 24 aa, Mycobacterium
PNRAWRLYRRLGFTDVIRGYHFAG

SEQ ID NO: 774146 - protein, 24 aa, Mycobacterium
PNRAWRLYRRLGFTDVIRRYHFAG

SEQ ID NO: 774147 - protein, 17 aa, Mycobacterium
PNRMGFWVCDWCGHGSP

SEQ ID NO: 774148 - protein, 18 aa, Mycobacterium
PNRMRWTVVHYRPPESMT

SEQ ID NO: 774149 - protein, 24 aa, Mycobacterium
PNRSARNHLRWIAAANDISAQRVD

SEQ ID NO: 774150 - protein, 24 aa, Mycobacterium
PNRSARSHLRWIAAANRIPASRVD

SEQ ID NO: 774151 - protein, 19 aa, Mycobacterium
PNRWTLCGPYSWTGSGWHA

SEQ ID NO: 774152 - protein, 18 aa, Mycobacterium
PNTFMVFGPFAWSGSSWH

SEQ ID NO: 774153 - protein, 17 aa, Mycobacterium
PNVAEGWTLTRLTAPSR

SEQ ID NO: 774154 - protein, 23 aa, Mycobacterium
PNVNEFFGALGITAAGLGPLGLA

SEQ ID NO: 774155 - protein, 21 aa, Mycobacterium
PNWGVPLFVGWRAMPLAEDSP

SEQ ID NO: 774156 - protein, 17 aa, Mycobacterium
PNWITAFDRGGVWVETE

SEQ ID NO: 774157 - protein, 18 aa, Mycobacterium
PPAALTCWADFLARLREE

SEQ ID NO: 774158 - protein, 17 aa, Mycobacterium
PPAPRCRPGYWPWVDAL

SEQ ID NO: 774159 - protein, 19 aa, Mycobacterium
PPAPWFPKDVDAWNVRWVA

SEQ ID NO: 774160 - protein, 22 aa, Mycobacterium
PPARASVRWDVVKTDGWSSSRL

SEQ ID NO: 774161 - protein, 17 aa, Mycobacterium
PPASWGWGKTAHLLVGS

SEQ ID NO: 774162 - protein, 25 aa, Mycobacterium
PPATRASGVLPRYGVRLTVMAHPPA

SEQ ID NO: 774163 - protein, 19 aa, Mycobacterium
PPATWPLGVAFLRNYDVRV

SEQ ID NO: 774164 - protein, 20 aa, Mycobacterium
PPCAELAALVQRVGPVEAAE

SEQ ID NO: 774165 - protein, 17 aa, Mycobacterium
PPCPLRRNCRLREALRS

SEQ ID NO: 774166 - protein, 26 aa, Mycobacterium
PPDMKLPIALALGWPARVAGAAAACD

SEQ ID NO: 774167 - protein, 25 aa, Mycobacterium
PPDMKLPIALALGWPDRVPAAASAC

SEQ ID NO: 774168 - protein, 23 aa, Mycobacterium
PPDPGQICYLGFTSGTTGEPKGA

SEQ ID NO: 774169 - protein, 21 aa, Mycobacterium
PPDRMPYTFGSWVTEASEADR

SEQ ID NO: 774170 - protein, 18 aa, Mycobacterium
PPEAIDWLLPRGARQVLD

SEQ ID NO: 774171 - protein, 19 aa, Mycobacterium
PPEKFRSMMALMVEAPFLL

SEQ ID NO: 774172 - protein, 19 aa, Mycobacterium
PPEVVDWPLNVVVVRSGDR

SEQ ID NO: 774173 - protein, 20 aa, Mycobacterium
PPGCAIVSDVGRFIAGSWPY

SEQ ID NO: 774174 - protein, 17 aa, Mycobacterium
PPGCPWDNGYIESFNNR

SEQ ID NO: 774175 - protein, 21 aa, Mycobacterium
PPGHLWRWELSPVNAELTTVT

SEQ ID NO: 774176 - protein, 20 aa, Mycobacterium
PPGKDLWWFWTGLTPSYPED

SEQ ID NO: 774177 - protein, 20 aa, Mycobacterium
PPGLGRFPLRRVEDYPDTAP

SEQ ID NO: 774178 - protein, 21 aa, Mycobacterium
PPGNLWRWELSPVNAELTTVT

SEQ ID NO: 774179 - protein, 21 aa, Mycobacterium
PPGRPVWVGDFWDMFGPGHLL

SEQ ID NO: 774180 - protein, 17 aa, Mycobacterium
PPGYEMVTLPGSASLTG

SEQ ID NO: 774181 - protein, 25 aa, Mycobacterium
PPHAMTGTLVWFLPPFVDDISGPPV

SEQ ID NO: 774182 - protein, 18 aa, Mycobacterium
PPHLKAIFPVAATTDLYE

SEQ ID NO: 774183 - protein, 18 aa, Mycobacterium
PPHPAHFLWLNWGPIPPR

SEQ ID NO: 774184 - protein, 20 aa, Mycobacterium
PPHPCPLSFILAPTLIAHGT

SEQ ID NO: 774185 - protein, 19 aa, Mycobacterium
PPHRLVLCARLGPMGAARI

SEQ ID NO: 774186 - protein, 19 aa, Mycobacterium
PPHTRWQPLPTWFERLTRA

SEQ ID NO: 774187 - protein, 19 aa, Mycobacterium
PPIETGEGWLVLTHGVGPM

SEQ ID NO: 774188 - protein, 22 aa, Mycobacterium
PPIPDRVDVVWLEHDEGPARAG

SEQ ID NO: 774189 - protein, 23 aa, Mycobacterium
PPIPEFYGGAVIFDGADAASVLH

SEQ ID NO: 774190 - protein, 17 aa, Mycobacterium
PPKRLSAITSIGSDAWD

SEQ ID NO: 774191 - protein, 17 aa, Mycobacterium
PPKTMRALIGRICEQEG

SEQ ID NO: 774192 - protein, 18 aa, Mycobacterium
PPKTMRALIGRICEQEGV

SEQ ID NO: 774193 - protein, 21 aa, Mycobacterium
PPLAARWMGSEAFRADVTMNK

SEQ ID NO: 774194 - protein, 18 aa, Mycobacterium
PPLDMSRLFGEPRLGGDG

SEQ ID NO: 774195 - protein, 26 aa, Mycobacterium
PPLIPCRRCDFCAKGEFGLCENYDYF

SEQ ID NO: 774196 - protein, 24 aa, Mycobacterium
PPLLALPAEEAWRLAAGGGGTLED

SEQ ID NO: 774197 - protein, 17 aa, Mycobacterium
PPLLKRIVLQTAARLSR

SEQ ID NO: 774198 - protein, 19 aa, Mycobacterium
PPLLLRPVMDAIAFVTESL

SEQ ID NO: 774199 - protein, 19 aa, Mycobacterium
PPLRLLLGRDVLKAMRDKI

SEQ ID NO: 774200 - protein, 20 aa, Mycobacterium
PPLRRPARRRVFTVANQKGG

SEQ ID NO: 774201 - protein, 20 aa, Mycobacterium
PPLRRPRHRRVLTVANQKGG

SEQ ID NO: 774202 - protein, 17 aa, Mycobacterium
PPMPLLFQRAIGNEHRP

SEQ ID NO: 774203 - protein, 23 aa, Mycobacterium
PPMPYAGGGWVVWERRDSTDSAD

SEQ ID NO: 774204 - protein, 18 aa, Mycobacterium
PPMRLRPKILPNGTQDSG

SEQ ID NO: 774205 - protein, 20 aa, Mycobacterium
PPNALVCFPPPPASGSMTKA

SEQ ID NO: 774206 - protein, 19 aa, Mycobacterium
PPNFWAWLIAQAKGIDPDV

SEQ ID NO: 774207 - protein, 21 aa, Mycobacterium
PPPALFRLSVNMDRDDGQLKM

SEQ ID NO: 774208 - protein, 27 aa, Mycobacterium
PPPAPFWAARHRLLLGWVKMLDGQLTA

SEQ ID NO: 774209 - protein, 21 aa, Mycobacterium
PPPDLRAGLTPGRRTDALANI

SEQ ID NO: 774210 - protein, 26 aa, Mycobacterium
PPPPAWYLVGSFLGPTAWPSGNPAML

SEQ ID NO: 774211 - protein, 25 aa, Mycobacterium
PPPPMLWRVVELFVGDLWPNGDVAG

SEQ ID NO: 774212 - protein, 22 aa, Mycobacterium
PPPPTTRMRWPLGSVQVNRYFG

SEQ ID NO: 774213 - protein, 23 aa, Mycobacterium
PPPRIVAGIPVCLCAPSQVEEAK

SEQ ID NO: 774214 - protein, 23 aa, Mycobacterium
PPPRPDVLFVWQVAVAPSAQGTG

SEQ ID NO: 774215 - protein, 20 aa, Mycobacterium
PPPSEGWRRLLYELSGHRIN

SEQ ID NO: 774216 - protein, 23 aa, Mycobacterium
PPPSEGWRRWLYMVSGKLINLGE

SEQ ID NO: 774217 - protein, 17 aa, Mycobacterium
PPPWPPRKHIFGSVNRN

SEQ ID NO: 774218 - protein, 20 aa, Mycobacterium
PPPWRAEALVLLGFSAYVRG

SEQ ID NO: 774219 - protein, 17 aa, Mycobacterium
PPQCARAAVLRAMGLPL

SEQ ID NO: 774220 - protein, 21 aa, Mycobacterium
PPQRYAMFMSYSLAGGAGRTE

SEQ ID NO: 774221 - protein, 25 aa, Mycobacterium
PPQVFGALFSHEWFVDPALPTGTLR

SEQ ID NO: 774222 - protein, 25 aa, Mycobacterium
PPQWGGYRIAPDVVEFWQGRENRLH

SEQ ID NO: 774223 - protein, 19 aa, Mycobacterium
PPQWWRLHELFDAADPVKP

SEQ ID NO: 774224 - protein, 17 aa, Mycobacterium
PPRAVFVAVDFPPPSTH

SEQ ID NO: 774225 - protein, 18 aa, Mycobacterium
PPRIAANRSRLMSLVAAN

SEQ ID NO: 774226 - protein, 18 aa, Mycobacterium
PPRRAVVVADVPGAQPRP

SEQ ID NO: 774227 - protein, 19 aa, Mycobacterium
PPRSWRVIATIQRDGDRFK

SEQ ID NO: 774228 - protein, 17 aa, Mycobacterium
PPRTMRGLIGRICEQEG

SEQ ID NO: 774229 - protein, 20 aa, Mycobacterium
PPRWDTLIVGLDWETEKLDD

SEQ ID NO: 774230 - protein, 18 aa, Mycobacterium
PPSPRIAAVLALEAPTVQ

SEQ ID NO: 774231 - protein, 17 aa, Mycobacterium
PPSVPVFDGDRITLQSV

SEQ ID NO: 774232 - protein, 19 aa, Mycobacterium
PPTEIYGGAGGPGGGGSLD

SEQ ID NO: 774233 - protein, 20 aa, Mycobacterium
PPTFRGDMIWCQLFSEPGAG

SEQ ID NO: 774234 - protein, 18 aa, Mycobacterium
PPTLLWPIGVPFSDGLNT

SEQ ID NO: 774235 - protein, 20 aa, Mycobacterium
PPTPATWGWMLQLYGLRSSR

SEQ ID NO: 774236 - protein, 17 aa, Mycobacterium
PPTRRWGSVLGIQPDGL

SEQ ID NO: 774237 - protein, 25 aa, Mycobacterium
PPTVWSVRWKQRWEPPVPVAITSGT

SEQ ID NO: 774238 - protein, 22 aa, Mycobacterium
PPVCPCSGLIRPSVVWFGEPLP

SEQ ID NO: 774239 - protein, 23 aa, Mycobacterium
PPVEGAFYWLSNREVRWRPAEYW

SEQ ID NO: 774240 - protein, 20 aa, Mycobacterium
PPVKPYRGVFALLEFGSVSR

SEQ ID NO: 774241 - protein, 18 aa, Mycobacterium
PPVTVPLGANAAALAGDG

SEQ ID NO: 774242 - protein, 18 aa, Mycobacterium
PPWDCYFIDGLGKIEGFP

SEQ ID NO: 774243 - protein, 22 aa, Mycobacterium
PPWHSCRGFGKEAPVFVMERVM

SEQ ID NO: 774244 - protein, 17 aa, Mycobacterium
PPWLWPAEIASVLLAGP

SEQ ID NO: 774245 - protein, 24 aa, Mycobacterium
PQAARAALLFGMRFDADAAVRHGL

SEQ ID NO: 774246 - protein, 24 aa, Mycobacterium
PQAARPVLFSTFLMWVLADLFTTL

SEQ ID NO: 774247 - protein, 17 aa, Mycobacterium
PQAEFTSVWGRRDLVEY

SEQ ID NO: 774248 - protein, 17 aa, Mycobacterium
PQAFRLWRNLGLRGFTG

SEQ ID NO: 774249 - protein, 19 aa, Mycobacterium
PQANFVWLPLGARTRDFFE

SEQ ID NO: 774250 - protein, 19 aa, Mycobacterium
PQCRWMKPFGPLRQGTRTL

SEQ ID NO: 774251 - protein, 17 aa, Mycobacterium
PQERVSLHTALKAITID

SEQ ID NO: 774252 - protein, 21 aa, Mycobacterium
PQEWLRFGWYFLVSRRDLAGL

SEQ ID NO: 774253 - protein, 17 aa, Mycobacterium
PQFSALGARALWTLDRI

SEQ ID NO: 774254 - protein, 18 aa, Mycobacterium
PQGILVRDGVLYVVDAGA

SEQ ID NO: 774255 - protein, 17 aa, Mycobacterium
PQGPRIDFCAPIGHGGD

SEQ ID NO: 774256 - protein, 17 aa, Mycobacterium
PQGRRLGKTTGWVHRAS

SEQ ID NO: 774257 - protein, 17 aa, Mycobacterium
PQHRDLISAWAHQLNPG

SEQ ID NO: 774258 - protein, 18 aa, Mycobacterium
PQHREFVQAATITDLPGE

SEQ ID NO: 774259 - protein, 18 aa, Mycobacterium
PQHVGWFRFYFADERWEW

SEQ ID NO: 774260 - protein, 17 aa, Mycobacterium
PQLAAFEFAIRAEDGIA

SEQ ID NO: 774261 - protein, 23 aa, Mycobacterium
PQLRELRAWLGRRLPRYLMPNAI

SEQ ID NO: 774262 - protein, 17 aa, Mycobacterium
PQLRVLVDLGYSDYGPG

SEQ ID NO: 774263 - protein, 23 aa, Mycobacterium
PQQRIALELTWEALENARIPASS

SEQ ID NO: 774264 - protein, 17 aa, Mycobacterium
PQQRLLLEVAWEALENA

SEQ ID NO: 774265 - protein, 17 aa, Mycobacterium
PQQRVAMRVAWKALENS

SEQ ID NO: 774266 - protein, 17 aa, Mycobacterium
PQQRVAMRVAWKALENT

SEQ ID NO: 774267 - protein, 26 aa, Mycobacterium
PQRDRFANLLLRWLPRTVALPVIRAK

SEQ ID NO: 774268 - protein, 23 aa, Mycobacterium
PQRGGPALVCRWCGRIDPTRRCA

SEQ ID NO: 774269 - protein, 22 aa, Mycobacterium
PQRGPLWGAVWLRGSDDADSTS

SEQ ID NO: 774270 - protein, 17 aa, Mycobacterium
PQRIAVWKLIEAFRRRS

SEQ ID NO: 774271 - protein, 19 aa, Mycobacterium
PQRPTILAIHGWPDNHHLW

SEQ ID NO: 774272 - protein, 24 aa, Mycobacterium
PQRVWGWYLWRHYLVADVQPNAGH

SEQ ID NO: 774273 - protein, 17 aa, Mycobacterium
PQSFGYSTLGGWLATRS

SEQ ID NO: 774274 - protein, 18 aa, Mycobacterium
PQTQIAIRNEWGWAEAYL

SEQ ID NO: 774275 - protein, 19 aa, Mycobacterium
PQTVCKWRARFVKDRLDGL

SEQ ID NO: 774276 - protein, 23 aa, Mycobacterium
PQVARAALLFGMRFDADSAVRHG

SEQ ID NO: 774277 - protein, 17 aa, Mycobacterium
PQVFEWARLVDPRQPLT

SEQ ID NO: 774278 - protein, 17 aa, Mycobacterium
PQYWPGYYAVFFDDPIN

SEQ ID NO: 774279 - protein, 17 aa, Mycobacterium
PRAAALLEELGWTTEAH

SEQ ID NO: 774280 - protein, 21 aa, Mycobacterium
PRADEILVRVDAVGICHADTQ

SEQ ID NO: 774281 - protein, 18 aa, Mycobacterium
PRAEFLAGLAAVMRPGDS

SEQ ID NO: 774282 - protein, 23 aa, Mycobacterium
PRAEVLRPGLLVLPVRGAARYFG

SEQ ID NO: 774283 - protein, 18 aa, Mycobacterium
PRAFAVAARVFLRTAAAR

SEQ ID NO: 774284 - protein, 17 aa, Mycobacterium
PRAGLSYETLLATVEQR

SEQ ID NO: 774285 - protein, 19 aa, Mycobacterium
PRAPFRYLGMLPWVGAVAD

SEQ ID NO: 774286 - protein, 19 aa, Mycobacterium
PRAPVGMFAPHSPAGPLAA

SEQ ID NO: 774287 - protein, 19 aa, Mycobacterium
PRASHVIETWANVLDLLER

SEQ ID NO: 774288 - protein, 19 aa, Mycobacterium
PRASHVLETWAHVLDLLER

SEQ ID NO: 774289 - protein, 18 aa, Mycobacterium
PRATIAFCESARALALLR

SEQ ID NO: 774290 - protein, 18 aa, Mycobacterium
PRATILLRLDQAVPDDVR

SEQ ID NO: 774291 - protein, 19 aa, Mycobacterium
PRAVVWLMVRPLANSIAAG

SEQ ID NO: 774292 - protein, 19 aa, Mycobacterium
PRAWLSVVVGRLCLDQLRS

SEQ ID NO: 774293 - protein, 24 aa, Mycobacterium
PRCGWSVPCAKSWAPSKARSRGWP

SEQ ID NO: 774294 - protein, 22 aa, Mycobacterium
PRDGWTLVSWNGKPVWPGWAAK

SEQ ID NO: 774295 - protein, 22 aa, Mycobacterium
PRDIAGRVRLDWESLSQRIHPA

SEQ ID NO: 774296 - protein, 18 aa, Mycobacterium
PRDRGWDIGALFDGSRRD

SEQ ID NO: 774297 - protein, 21 aa, Mycobacterium
PRDRMPVLYCKTGVRSAQALA

SEQ ID NO: 774298 - protein, 19 aa, Mycobacterium
PREEGRRKFGFYGDDAAAA

SEQ ID NO: 774299 - protein, 17 aa, Mycobacterium
PREGGLLISFERMNQVL

SEQ ID NO: 774300 - protein, 20 aa, Mycobacterium
PREIGGRMRLDWESLSQRIH

SEQ ID NO: 774301 - protein, 20 aa, Mycobacterium
PRELAGWLAAALTKADGIAS

SEQ ID NO: 774302 - protein, 17 aa, Mycobacterium
PRELPPIGDLVRVLSET

SEQ ID NO: 774303 - protein, 18 aa, Mycobacterium
PRELTLDDAVVWRRLQIV

SEQ ID NO: 774304 - protein, 22 aa, Mycobacterium
PREPKFMWLTGLTTDGTIVVAN

SEQ ID NO: 774305 - protein, 23 aa, Mycobacterium
PRERPAVVPLSFAQSRLWFIDQL

SEQ ID NO: 774306 - protein, 18 aa, Mycobacterium
PRERPTCDAAYWVDNLRN

SEQ ID NO: 774307 - protein, 18 aa, Mycobacterium
PRESPLLFLREGDRIVLV

SEQ ID NO: 774308 - protein, 17 aa, Mycobacterium
PRETWLRLEVIRGGFPR

SEQ ID NO: 774309 - protein, 20 aa, Mycobacterium
PRETWLRLLLIDAGFPTPST

SEQ ID NO: 774310 - protein, 21 aa, Mycobacterium
PRETWLRLVVVRAGYPPPQTQ

SEQ ID NO: 774311 - protein, 27 aa, Mycobacterium
PRFAEEIAWWVWWCWDQQLRKIEPSLL

SEQ ID NO: 774312 - protein, 19 aa, Mycobacterium
PRFAILKGRGNYLCLNKLH

SEQ ID NO: 774313 - protein, 20 aa, Mycobacterium
PRFCAECGRRMIVQVRPDGW

SEQ ID NO: 774314 - protein, 18 aa, Mycobacterium
PRFCGTAFQNAWLNPVMW

SEQ ID NO: 774315 - protein, 28 aa, Mycobacterium
PRFDPAVWARLGAELGVLGLAVPEADGG

SEQ ID NO: 774316 - protein, 19 aa, Mycobacterium
PRFLMCTPLSHAGAAFFTP

SEQ ID NO: 774317 - protein, 19 aa, Mycobacterium
PRFLMCTPLSHAGAAFFVP

SEQ ID NO: 774318 - protein, 17 aa, Mycobacterium
PRFLVPHIVASAPKVVI

SEQ ID NO: 774319 - protein, 20 aa, Mycobacterium
PRGAMGVSVLVGKLSIPPAE

SEQ ID NO: 774320 - protein, 23 aa, Mycobacterium
PRGCIRCAARVCGIRDGVLFVPF

SEQ ID NO: 774321 - protein, 19 aa, Mycobacterium
PRGGPLLMFSNADCQVLLS

SEQ ID NO: 774322 - protein, 20 aa, Mycobacterium
PRGGVKVAFFRKGIACTPDT

SEQ ID NO: 774323 - protein, 21 aa, Mycobacterium
PRGGVKVAFFRKGVECTPETI

SEQ ID NO: 774324 - protein, 19 aa, Mycobacterium
PRGGYCYEHVALFGAVLQR

SEQ ID NO: 774325 - protein, 20 aa, Mycobacterium
PRGIAGLFFFDGEQIEALAD

SEQ ID NO: 774326 - protein, 17 aa, Mycobacterium
PRGISFLLNRNRLNVAI

SEQ ID NO: 774327 - protein, 18 aa, Mycobacterium
PRGKARRSVAVSALPSLT

SEQ ID NO: 774328 - protein, 20 aa, Mycobacterium
PRGLRLPARLVLSALIGRVR

SEQ ID NO: 774329 - protein, 19 aa, Mycobacterium
PRGVLEIAYRCPNGEPAVV

SEQ ID NO: 774330 - protein, 19 aa, Mycobacterium
PRGVLEIAYRCPNGEPGVV

SEQ ID NO: 774331 - protein, 18 aa, Mycobacterium
PRGVPVIVLAGQVGLDNA

SEQ ID NO: 774332 - protein, 19 aa, Mycobacterium
PRHEVTIGLAFRALTREPG

SEQ ID NO: 774333 - protein, 21 aa, Mycobacterium
PRHPLVCLVIEPFGVAVTMAG

SEQ ID NO: 774334 - protein, 30 aa, Mycobacterium
PRIAALAVIGMCNWVAWWFHEDDAASAEQV

SEQ ID NO: 774335 - protein, 22 aa, Mycobacterium
PRIAGPCSLVIFGVTGDLARKK

SEQ ID NO: 774336 - protein, 19 aa, Mycobacterium
PRIDGCLARLGVDRLAAVL

SEQ ID NO: 774337 - protein, 18 aa, Mycobacterium
PRIDWSKIHLFWGDERYV

SEQ ID NO: 774338 - protein, 17 aa, Mycobacterium
PRIGMWVASGSGYVTEI

SEQ ID NO: 774339 - protein, 19 aa, Mycobacterium
PRILTGEVFFCQGYSEPEA

SEQ ID NO: 774340 - protein, 18 aa, Mycobacterium
PRIRDFRGLSGKQFDGTG

SEQ ID NO: 774341 - protein, 22 aa, Mycobacterium
PRIRDRLAWCYSRTQIMRYRGY

SEQ ID NO: 774342 - protein, 24 aa, Mycobacterium
PRIRFAVKVTEAWFDEDATLWRLH

SEQ ID NO: 774343 - protein, 18 aa, Mycobacterium
PRIRRLGPRGAVRGPAGL

SEQ ID NO: 774344 - protein, 17 aa, Mycobacterium
PRITALIAERISTRTAA

SEQ ID NO: 774345 - protein, 22 aa, Mycobacterium
PRIVAGIPVCLCAPAQIDEAKE

SEQ ID NO: 774346 - protein, 20 aa, Mycobacterium
PRKEWVLEFTIGAAPRSSAV

SEQ ID NO: 774347 - protein, 18 aa, Mycobacterium
PRKLPALIWRILSAPLNA

SEQ ID NO: 774348 - protein, 24 aa, Mycobacterium
PRKQWPTGLAKLGIDLSGKITDGP

SEQ ID NO: 774349 - protein, 18 aa, Mycobacterium
PRKTLGWKTPAEAFHEQL

SEQ ID NO: 774350 - protein, 20 aa, Mycobacterium
PRLAAGDAIGCFGLTEPDFG

SEQ ID NO: 774351 - protein, 20 aa, Mycobacterium
PRLADGILQLSVRDFEYPRS

SEQ ID NO: 774352 - protein, 20 aa, Mycobacterium
PRLAEEIFVLADLARQKARA

SEQ ID NO: 774353 - protein, 21 aa, Mycobacterium
PRLAKRYLAIEGHRALLDNSA

SEQ ID NO: 774354 - protein, 17 aa, Mycobacterium
PRLAPLVYLRIDGKMFI

SEQ ID NO: 774355 - protein, 19 aa, Mycobacterium
PRLAPPPVLERQADQRSDD

SEQ ID NO: 774356 - protein, 20 aa, Mycobacterium
PRLAQLTAIGGFRRWDRMVK

SEQ ID NO: 774357 - protein, 17 aa, Mycobacterium
PRLFPWRTVGGNIELAL

SEQ ID NO: 774358 - protein, 19 aa, Mycobacterium
PRLIPLLTIHAVNSTQAFR

SEQ ID NO: 774359 - protein, 19 aa, Mycobacterium
PRLLARNGLTLQDFDFYEI

SEQ ID NO: 774360 - protein, 17 aa, Mycobacterium
PRLLGHWGTTPGLNLIY

SEQ ID NO: 774361 - protein, 19 aa, Mycobacterium
PRLLLKWIEECFGASSAVE

SEQ ID NO: 774362 - protein, 18 aa, Mycobacterium
PRLLLVVAELPMPMQNVN

SEQ ID NO: 774363 - protein, 22 aa, Mycobacterium
PRLLTPLALAPRGIWLGPKELR

SEQ ID NO: 774364 - protein, 19 aa, Mycobacterium
PRLLTTMPEWLNAATGLDA

SEQ ID NO: 774365 - protein, 20 aa, Mycobacterium
PRLPALLRWRQQLISSGAVS

SEQ ID NO: 774366 - protein, 17 aa, Mycobacterium
PRLPLPEWAPALSVAQR

SEQ ID NO: 774367 - protein, 20 aa, Mycobacterium
PRLPLSAFIPAERRTRNGEG

SEQ ID NO: 774368 - protein, 19 aa, Mycobacterium
PRLPRTALIDVLLRCPPRT

SEQ ID NO: 774369 - protein, 18 aa, Mycobacterium
PRLPRTALVDVLLRHPPR

SEQ ID NO: 774370 - protein, 19 aa, Mycobacterium
PRLPTPALMHYLSEVDYVD

SEQ ID NO: 774371 - protein, 20 aa, Mycobacterium
PRLQLALAWANIVLHRVPAA

SEQ ID NO: 774372 - protein, 20 aa, Mycobacterium
PRLQRVFTFQSLYAGVAPRN

SEQ ID NO: 774373 - protein, 20 aa, Mycobacterium
PRLQRVFTFQSLYAGVSPQR

SEQ ID NO: 774374 - protein, 19 aa, Mycobacterium
PRLRAALAPWLGRTRGLRV

SEQ ID NO: 774375 - protein, 21 aa, Mycobacterium
PRLRECAELLAAHTGRSATQI

SEQ ID NO: 774376 - protein, 18 aa, Mycobacterium
PRLREFALREGLADAAQR

SEQ ID NO: 774377 - protein, 18 aa, Mycobacterium
PRLREFALREGLADAGQR

SEQ ID NO: 774378 - protein, 18 aa, Mycobacterium
PRLREFALREGLADAHAR

SEQ ID NO: 774379 - protein, 18 aa, Mycobacterium
PRLREFALREGLADARLR

SEQ ID NO: 774380 - protein, 18 aa, Mycobacterium
PRLREFALREGLADSQHR

SEQ ID NO: 774381 - protein, 19 aa, Mycobacterium
PRLRHIARFGAGYDGIDPV

SEQ ID NO: 774382 - protein, 21 aa, Mycobacterium
PRLRLELDKGFGWKAEVEAAL

SEQ ID NO: 774383 - protein, 19 aa, Mycobacterium
PRLRLELDKGLGWKAEVEA

SEQ ID NO: 774384 - protein, 17 aa, Mycobacterium
PRLRLVGVAGYEAAVAQ

SEQ ID NO: 774385 - protein, 20 aa, Mycobacterium
PRLRLWNFYGQTEMAPLASA

SEQ ID NO: 774386 - protein, 22 aa, Mycobacterium
PRLSADYGEVRWDAVVTNQNDD

SEQ ID NO: 774387 - protein, 20 aa, Mycobacterium
PRLSFGVGVAEELNYADRAF

SEQ ID NO: 774388 - protein, 20 aa, Mycobacterium
PRLSLGPLPVADHFLDSTAG

SEQ ID NO: 774389 - protein, 20 aa, Mycobacterium
PRLSLQWWVKVESLAKAAGD

SEQ ID NO: 774390 - protein, 19 aa, Mycobacterium
PRLVKRWRRGQALTDAETL

SEQ ID NO: 774391 - protein, 19 aa, Mycobacterium
PRMLECFSLAGALAAATSA

SEQ ID NO: 774392 - protein, 19 aa, Mycobacterium
PRMRGVLALFEGVATGAAD

SEQ ID NO: 774393 - protein, 19 aa, Mycobacterium
PRNAVAFAPMIFLGREFWT

SEQ ID NO: 774394 - protein, 21 aa, Mycobacterium
PRNKECLLRLAALAERLEPSQ

SEQ ID NO: 774395 - protein, 19 aa, Mycobacterium
PRNKECLWRLVALAERMEP

SEQ ID NO: 774396 - protein, 20 aa, Mycobacterium
PRNRMGLAYVERLSEVVDDI

SEQ ID NO: 774397 - protein, 18 aa, Mycobacterium
PRPAAPMLLADSRASARR

SEQ ID NO: 774398 - protein, 17 aa, Mycobacterium
PRPAFSTATFAAGVEKV

SEQ ID NO: 774399 - protein, 26 aa, Mycobacterium
PRPASWWLRRWVHEVAVHRADAAIAL

SEQ ID NO: 774400 - protein, 17 aa, Mycobacterium
PRPAVLADHDWLINQRG

SEQ ID NO: 774401 - protein, 19 aa, Mycobacterium
PRPDFKNRILRAFNDGVRQ

SEQ ID NO: 774402 - protein, 17 aa, Mycobacterium
PRPEGQPALGIGEVDGP

SEQ ID NO: 774403 - protein, 20 aa, Mycobacterium
PRPELATAFPPSPPSPPLPA

SEQ ID NO: 774404 - protein, 21 aa, Mycobacterium
PRPGELCAPVRFLVREDTVVM

SEQ ID NO: 774405 - protein, 20 aa, Mycobacterium
PRPGFWQNLVELGWLGLHVD

SEQ ID NO: 774406 - protein, 18 aa, Mycobacterium
PRPICIETEYSLAERSAD

SEQ ID NO: 774407 - protein, 20 aa, Mycobacterium
PRPITALGHWVHVYVDRVTR

SEQ ID NO: 774408 - protein, 20 aa, Mycobacterium
PRPLPTPVLAFAVRQVDAAA

SEQ ID NO: 774409 - protein, 19 aa, Mycobacterium
PRPPAVILISTYDEQDLSE

SEQ ID NO: 774410 - protein, 21 aa, Mycobacterium
PRPPRCLPRYLPVDSDRKLTA

SEQ ID NO: 774411 - protein, 19 aa, Mycobacterium
PRPRIDLEVGSWYVSTHPG

SEQ ID NO: 774412 - protein, 22 aa, Mycobacterium
PRPRLIGALAMAAVRIALDDWL

SEQ ID NO: 774413 - protein, 19 aa, Mycobacterium
PRPRMLVFGAIDFAAALAR

SEQ ID NO: 774414 - protein, 17 aa, Mycobacterium
PRPRVAPTKAWRKMFGE

SEQ ID NO: 774415 - protein, 20 aa, Mycobacterium
PRPSAVNVYRFWQELNGGKR

SEQ ID NO: 774416 - protein, 20 aa, Mycobacterium
PRPTLCVIHGFFGSPYLLNG

SEQ ID NO: 774417 - protein, 17 aa, Mycobacterium
PRPWILDTLPIVLSAAE

SEQ ID NO: 774418 - protein, 18 aa, Mycobacterium
PRQMPYPLAMELLLTADM

SEQ ID NO: 774419 - protein, 17 aa, Mycobacterium
PRQVIMLGRPTLHRPVS

SEQ ID NO: 774420 - protein, 19 aa, Mycobacterium
PRRAGCPFAPPPGVMALAE

SEQ ID NO: 774421 - protein, 17 aa, Mycobacterium
PRRAGISSFGFGGTNAH

SEQ ID NO: 774422 - protein, 19 aa, Mycobacterium
PRRRPVWVVLPQLRGQVGA

SEQ ID NO: 774423 - protein, 20 aa, Mycobacterium
PRRWRVPAVLSRFKVVRNAM

SEQ ID NO: 774424 - protein, 17 aa, Mycobacterium
PRSALLLITRIAYDQHD

SEQ ID NO: 774425 - protein, 20 aa, Mycobacterium
PRSCAVYGASVLVLPDAALD

SEQ ID NO: 774426 - protein, 20 aa, Mycobacterium
PRSEPYVVVLVRLDEGPQLL

SEQ ID NO: 774427 - protein, 19 aa, Mycobacterium
PRSGVPQVIFYAEPERQEK

SEQ ID NO: 774428 - protein, 23 aa, Mycobacterium
PRSPGPRYGVVPTIMSRPPSGGY

SEQ ID NO: 774429 - protein, 17 aa, Mycobacterium
PRSPLYCAGRRVCEHYP

SEQ ID NO: 774430 - protein, 23 aa, Mycobacterium
PRSRVAPTQAWRKTFGENFFYIL

SEQ ID NO: 774431 - protein, 19 aa, Mycobacterium
PRSSMAPTFVFDGAPAEHS

SEQ ID NO: 774432 - protein, 22 aa, Mycobacterium
PRSVEFLDVLPLNATGKVVKDL

SEQ ID NO: 774433 - protein, 20 aa, Mycobacterium
PRSVVPIAWDTLRKLAEHPN

SEQ ID NO: 774434 - protein, 18 aa, Mycobacterium
PRSWQLKLDLRRDGDRIK

SEQ ID NO: 774435 - protein, 17 aa, Mycobacterium
PRTEYRIDDVWNVVGLR

SEQ ID NO: 774436 - protein, 18 aa, Mycobacterium
PRTGLPLVNVGKVVTSED

SEQ ID NO: 774437 - protein, 17 aa, Mycobacterium
PRTGLQITRTFTVNTDS

SEQ ID NO: 774438 - protein, 19 aa, Mycobacterium
PRTGLSMGEHAAITAKQAG

SEQ ID NO: 774439 - protein, 19 aa, Mycobacterium
PRTGLSMGEHAAITTKQMG

SEQ ID NO: 774440 - protein, 18 aa, Mycobacterium
PRTGLSMGEHQAITAKEM

SEQ ID NO: 774441 - protein, 20 aa, Mycobacterium
PRTGPTVLFLGRFDEPRKGM

SEQ ID NO: 774442 - protein, 19 aa, Mycobacterium
PRTIVEYGLSYGISTLHSA

SEQ ID NO: 774443 - protein, 19 aa, Mycobacterium
PRTRSGIMGVELLDTTPDW

SEQ ID NO: 774444 - protein, 19 aa, Mycobacterium
PRTRSGIMTIELLDTTPDW

SEQ ID NO: 774445 - protein, 24 aa, Mycobacterium
PRTTRFGLTFARRYFDALHRYFGG

SEQ ID NO: 774446 - protein, 19 aa, Mycobacterium
PRVAEGWSLTRLTAPSRLF

SEQ ID NO: 774447 - protein, 18 aa, Mycobacterium
PRVAKRWRRGEPLENAET

SEQ ID NO: 774448 - protein, 21 aa, Mycobacterium
PRVAPTKAWRKMFGENFFYIL

SEQ ID NO: 774449 - protein, 19 aa, Mycobacterium
PRVAQIFGVDAVPTVVALA

SEQ ID NO: 774450 - protein, 20 aa, Mycobacterium
PRVAQSFDATVCWMADSSVL

SEQ ID NO: 774451 - protein, 17 aa, Mycobacterium
PRVARRFGRVLLELGGN

SEQ ID NO: 774452 - protein, 17 aa, Mycobacterium
PRVAWAFEGISYDERLG

SEQ ID NO: 774453 - protein, 23 aa, Mycobacterium
PRVGPLALCYRVFMLPDTKQTMI

SEQ ID NO: 774454 - protein, 20 aa, Mycobacterium
PRVIKRWRRGTPLSEARTVF

SEQ ID NO: 774455 - protein, 23 aa, Mycobacterium
PRVPPSPVTWGWMLQLYALRSAH

SEQ ID NO: 774456 - protein, 19 aa, Mycobacterium
PRVRTLLSFLRKQLAQRCI

SEQ ID NO: 774457 - protein, 26 aa, Mycobacterium
PRVSALIAIDRVHGWGAQKNNDQPDG

SEQ ID NO: 774458 - protein, 17 aa, Mycobacterium
PRVSLAIGGLAVIEGPA

SEQ ID NO: 774459 - protein, 17 aa, Mycobacterium
PRVSLAIGGLAVIEGPV

SEQ ID NO: 774460 - protein, 24 aa, Mycobacterium
PRVTCFRVGLRLDEPDMPNLLVSQ

SEQ ID NO: 774461 - protein, 25 aa, Mycobacterium
PRVTCFRVGLRLNEPRMPNLLVSQR

SEQ ID NO: 774462 - protein, 18 aa, Mycobacterium
PRVTHHLAMIGPLVSCYL

SEQ ID NO: 774463 - protein, 17 aa, Mycobacterium
PRVWPYVIERLLAAGAY

SEQ ID NO: 774464 - protein, 24 aa, Mycobacterium
PRVYSGHVRLCLGYTEPEGGSDVA

SEQ ID NO: 774465 - protein, 19 aa, Mycobacterium
PRWADPVDRLGCLRGISAL

SEQ ID NO: 774466 - protein, 21 aa, Mycobacterium
PRWLPGPRELRAWTLAAGHPE

SEQ ID NO: 774467 - protein, 22 aa, Mycobacterium
PRWLPGPRELRAWTLAAGNPEG

SEQ ID NO: 774468 - protein, 17 aa, Mycobacterium
PRWPFSKVRLAAQTVAR

SEQ ID NO: 774469 - protein, 18 aa, Mycobacterium
PRWPTFGIRLSARPGIPP

SEQ ID NO: 774470 - protein, 24 aa, Mycobacterium
PRWRPDHRPPWLAGYLARARQVVP

SEQ ID NO: 774471 - protein, 17 aa, Mycobacterium
PRWTELRARIRDYLGTK

SEQ ID NO: 774472 - protein, 21 aa, Mycobacterium
PRWTQGRLRWDHVVVLPNTEL

SEQ ID NO: 774473 - protein, 18 aa, Mycobacterium
PRWVGLFRWLKPVLSTSV

SEQ ID NO: 774474 - protein, 19 aa, Mycobacterium
PRYAPPPLLRQMVAAGRLG

SEQ ID NO: 774475 - protein, 17 aa, Mycobacterium
PRYDNFIGGQWVAPTAG

SEQ ID NO: 774476 - protein, 17 aa, Mycobacterium
PRYPINFLADLNAFLGI

SEQ ID NO: 774477 - protein, 30 aa, Mycobacterium
PRYPINFLADLNAFMGIQFVHTDYSYLDPN

SEQ ID NO: 774478 - protein, 21 aa, Mycobacterium
PRYPLNFIADLNAVMGIPFVH

SEQ ID NO: 774479 - protein, 18 aa, Mycobacterium
PSAAWLRKCAELNEHAVT

SEQ ID NO: 774480 - protein, 21 aa, Mycobacterium
PSADEALRWLARVRDGKPEDP

SEQ ID NO: 774481 - protein, 20 aa, Mycobacterium
PSADELIAWCRERLAHFKCP

SEQ ID NO: 774482 - protein, 17 aa, Mycobacterium
PSARLAVQWAAHDAELR

SEQ ID NO: 774483 - protein, 17 aa, Mycobacterium
PSAYPFLAAIDHGLSEV

SEQ ID NO: 774484 - protein, 24 aa, Mycobacterium
PSCGHCSYCARGMGNLCDMGAAIM

SEQ ID NO: 774485 - protein, 23 aa, Mycobacterium
PSCGHCSYCARGMGNMCDLGAAL

SEQ ID NO: 774486 - protein, 18 aa, Mycobacterium
PSCLAGLEQFCERGMVGT

SEQ ID NO: 774487 - protein, 17 aa, Mycobacterium
PSCPGWNLGQLFRHVGR

SEQ ID NO: 774488 - protein, 21 aa, Mycobacterium
PSDARPAPGPVPVAPHESPRH

SEQ ID NO: 774489 - protein, 22 aa, Mycobacterium
PSDEKLDWARRVLAASRNERGV

SEQ ID NO: 774490 - protein, 23 aa, Mycobacterium
PSDLLCVGTDWSASQGDSAATPP

SEQ ID NO: 774491 - protein, 18 aa, Mycobacterium
PSEVARLGYLAGIVATML

SEQ ID NO: 774492 - protein, 23 aa, Mycobacterium
PSEWKVFLELLRKRFETDKDKWT

SEQ ID NO: 774493 - protein, 18 aa, Mycobacterium
PSFLHWINYSVMAHQTGA

SEQ ID NO: 774494 - protein, 17 aa, Mycobacterium
PSFLHWINYSVMAQQTG

SEQ ID NO: 774495 - protein, 17 aa, Mycobacterium
PSFPGFAARLFATDDEE

SEQ ID NO: 774496 - protein, 20 aa, Mycobacterium
PSFSEALRWGAEVYHALKAV

SEQ ID NO: 774497 - protein, 21 aa, Mycobacterium
PSGAAALRWWARMARDPLATY

SEQ ID NO: 774498 - protein, 17 aa, Mycobacterium
PSGFRFYHTHLNPGAEL

SEQ ID NO: 774499 - protein, 19 aa, Mycobacterium
PSGGLACFGEAIPAQAIAQ

SEQ ID NO: 774500 - protein, 17 aa, Mycobacterium
PSGRLPISFPVDLRQTP

SEQ ID NO: 774501 - protein, 23 aa, Mycobacterium
PSGRPAIVMAHGFAGTRDTGLLD

SEQ ID NO: 774502 - protein, 17 aa, Mycobacterium
PSGRYSWRMSLPAMVCY

SEQ ID NO: 774503 - protein, 17 aa, Mycobacterium
PSGSFIFAGPSGVGKTE

SEQ ID NO: 774504 - protein, 18 aa, Mycobacterium
PSGVFSWRPPSALIAEVS

SEQ ID NO: 774505 - protein, 23 aa, Mycobacterium
PSHAVQAPWPLLRTFAAGPALSR

SEQ ID NO: 774506 - protein, 18 aa, Mycobacterium
PSHRLCVLETAAGLTVVI

SEQ ID NO: 774507 - protein, 17 aa, Mycobacterium
PSHYEPFGLVALEAAAA

SEQ ID NO: 774508 - protein, 18 aa, Mycobacterium
PSHYEPFGLVALEAAAAG

SEQ ID NO: 774509 - protein, 20 aa, Mycobacterium
PSIACSRWGMLSPEGQCKTF

SEQ ID NO: 774510 - protein, 17 aa, Mycobacterium
PSICPYGLFDTADGAVQ

SEQ ID NO: 774511 - protein, 23 aa, Mycobacterium
PSIQPKLTFSWRIMPQNLSDAGI

SEQ ID NO: 774512 - protein, 17 aa, Mycobacterium
PSKAELVLAAFIEGMRA

SEQ ID NO: 774513 - protein, 20 aa, Mycobacterium
PSKIRSVGEYAYLRQSVRTN

SEQ ID NO: 774514 - protein, 20 aa, Mycobacterium
PSKLELYLAVLHKHADNLVS

SEQ ID NO: 774515 - protein, 18 aa, Mycobacterium
PSKVAFLAWHAWHDPERG

SEQ ID NO: 774516 - protein, 17 aa, Mycobacterium
PSKYSSLVILTSGTTGT

SEQ ID NO: 774517 - protein, 18 aa, Mycobacterium
PSLAALWARKAELILEHS

SEQ ID NO: 774518 - protein, 17 aa, Mycobacterium
PSLDDVFLMLTGHRTDD

SEQ ID NO: 774519 - protein, 18 aa, Mycobacterium
PSLLPAYLGVGPNNMFPF

SEQ ID NO: 774520 - protein, 19 aa, Mycobacterium
PSLPADLIGSVLVLKELYD

SEQ ID NO: 774521 - protein, 17 aa, Mycobacterium
PSLRAGFGLDDMSDADM

SEQ ID NO: 774522 - protein, 18 aa, Mycobacterium
PSLRFEPGEHGVLNLVLD

SEQ ID NO: 774523 - protein, 20 aa, Mycobacterium
PSLRFGLAFCEASGPRLVRR

SEQ ID NO: 774524 - protein, 21 aa, Mycobacterium
PSLRFGLAFCEASGPRLVRRS

SEQ ID NO: 774525 - protein, 18 aa, Mycobacterium
PSLWIPDLFMLRQIHHAP

SEQ ID NO: 774526 - protein, 19 aa, Mycobacterium
PSLYCLTEPIPPGSYVGIA

SEQ ID NO: 774527 - protein, 22 aa, Mycobacterium
PSMFRRWCRLVGRPELFDDPRF

SEQ ID NO: 774528 - protein, 17 aa, Mycobacterium
PSMPQLRWRVTDVPLGL

SEQ ID NO: 774529 - protein, 18 aa, Mycobacterium
PSMVRWARANGWSAPPGA

SEQ ID NO: 774530 - protein, 19 aa, Mycobacterium
PSNRLSAVSVRVRELCDKY

SEQ ID NO: 774531 - protein, 18 aa, Mycobacterium
PSPDRSTGLFLWQNIFGV

SEQ ID NO: 774532 - protein, 21 aa, Mycobacterium
PSPILPLAFSRWVFARTEPGL

SEQ ID NO: 774533 - protein, 17 aa, Mycobacterium
PSPLVAYWFGPDDADFR

SEQ ID NO: 774534 - protein, 17 aa, Mycobacterium
PSPMLPALRQLPADGPD

SEQ ID NO: 774535 - protein, 17 aa, Mycobacterium
PSPWDWAREQAEKYEQS

SEQ ID NO: 774536 - protein, 18 aa, Mycobacterium
PSPYAFRLADPDADAEKI

SEQ ID NO: 774537 - protein, 19 aa, Mycobacterium
PSRGAWQFIAPTFAAYHQL

SEQ ID NO: 774538 - protein, 28 aa, Mycobacterium
PSRLACGDLAMFKDHYVPVLSSVKAFVN

SEQ ID NO: 774539 - protein, 18 aa, Mycobacterium
PSSGVAFVLGERLGRIDV

SEQ ID NO: 774540 - protein, 18 aa, Mycobacterium
PSSGVAFVLGERLGRVDV

SEQ ID NO: 774541 - protein, 18 aa, Mycobacterium
PSSIWYRIRINLQHVPED

SEQ ID NO: 774542 - protein, 18 aa, Mycobacterium
PSSIWYRIRINLQHVPEG

SEQ ID NO: 774543 - protein, 24 aa, Mycobacterium
PSTIAGRWLVGAIHYKAQRWPEVI

SEQ ID NO: 774544 - protein, 18 aa, Mycobacterium
PSTPGWLKGISQLIGGIS

SEQ ID NO: 774545 - protein, 19 aa, Mycobacterium
PSTRWCAACATELAVAATH

SEQ ID NO: 774546 - protein, 24 aa, Mycobacterium
PSVPDTRLEFMLSDAVPIAAVTTA

SEQ ID NO: 774547 - protein, 20 aa, Mycobacterium
PSVRCFLDVAVAESPRYLED

SEQ ID NO: 774548 - protein, 18 aa, Mycobacterium
PSVREYSSLYGLSDRRQA

SEQ ID NO: 774549 - protein, 18 aa, Mycobacterium
PSVREYSSRFGLSDRRQA

SEQ ID NO: 774550 - protein, 18 aa, Mycobacterium
PSVREYSVRYGLSDRRQA

SEQ ID NO: 774551 - protein, 17 aa, Mycobacterium
PSVRWGSEVVAIVQLAP

SEQ ID NO: 774552 - protein, 22 aa, Mycobacterium
PSVSGLPQWYGDQGMFLTTHYF

SEQ ID NO: 774553 - protein, 17 aa, Mycobacterium
PSWKIKGCYITRIQGDP

SEQ ID NO: 774554 - protein, 21 aa, Mycobacterium
PSWMARAGFQMMDPLKTAKAR

SEQ ID NO: 774555 - protein, 19 aa, Mycobacterium
PSWMARTGFQMLDPLKTAK

SEQ ID NO: 774556 - protein, 21 aa, Mycobacterium
PSWQLAIGVLEAFDHPLMSLL

SEQ ID NO: 774557 - protein, 18 aa, Mycobacterium
PSYSLSEIRHWLMVFAQR

SEQ ID NO: 774558 - protein, 18 aa, Mycobacterium
PSYSLSEIRHWLQVFVER

SEQ ID NO: 774559 - protein, 20 aa, Mycobacterium
PSYTRPASWRGLDVPDVLLS

SEQ ID NO: 774560 - protein, 20 aa, Mycobacterium
PSYTRPPSWRGLDVPEVLLS

SEQ ID NO: 774561 - protein, 20 aa, Mycobacterium
PSYTRPPSWRGLDVPPVLLS

SEQ ID NO: 774562 - protein, 18 aa, Mycobacterium
PTAFPLVLTHGWPGSVLE

SEQ ID NO: 774563 - protein, 19 aa, Mycobacterium
PTAGLDWRQVAVLRSYSRY

SEQ ID NO: 774564 - protein, 21 aa, Mycobacterium
PTAGWRRWLYLASFKQVNVGE

SEQ ID NO: 774565 - protein, 23 aa, Mycobacterium
PTAPRPGAMPPWDSTPVTGIPRV

SEQ ID NO: 774566 - protein, 20 aa, Mycobacterium
PTAPSWRKGPRHIAGRGPRD

SEQ ID NO: 774567 - protein, 25 aa, Mycobacterium
PTARISVVVDELWRAHGLAEMIEQA

SEQ ID NO: 774568 - protein, 18 aa, Mycobacterium
PTARRILAHFGLDHHFEV

SEQ ID NO: 774569 - protein, 18 aa, Mycobacterium
PTARRILAHFGLDRHFEV

SEQ ID NO: 774570 - protein, 17 aa, Mycobacterium
PTARRILAHFGLEQHFE

SEQ ID NO: 774571 - protein, 18 aa, Mycobacterium
PTARRVLAHFGLDAHFEV

SEQ ID NO: 774572 - protein, 18 aa, Mycobacterium
PTARSCIDEVWFLTLDTE

SEQ ID NO: 774573 - protein, 19 aa, Mycobacterium
PTAWIAEGLFGYLPSEAQD

SEQ ID NO: 774574 - protein, 25 aa, Mycobacterium
PTAWLAEGVLIGWLPPEAELRLLDS

SEQ ID NO: 774575 - protein, 21 aa, Mycobacterium
PTDRKTVCLFGDGAGAVVVGP

SEQ ID NO: 774576 - protein, 19 aa, Mycobacterium
PTELLRWVHPSLVASTQGT

SEQ ID NO: 774577 - protein, 18 aa, Mycobacterium
PTELMRWVHPSLVASTQG

SEQ ID NO: 774578 - protein, 21 aa, Mycobacterium
PTFLCILGYAAQKWFLQHCGI

SEQ ID NO: 774579 - protein, 18 aa, Mycobacterium
PTFRGDMIWCQLFSEPGA

SEQ ID NO: 774580 - protein, 19 aa, Mycobacterium
PTFRGEMMWCQLFSEPGAG

SEQ ID NO: 774581 - protein, 21 aa, Mycobacterium
PTFTGRSWPLADVRLLAPILA

SEQ ID NO: 774582 - protein, 18 aa, Mycobacterium
PTGARLAGRHGIGLLSIG

SEQ ID NO: 774583 - protein, 18 aa, Mycobacterium
PTGARLLLCEFVIPEHDR

SEQ ID NO: 774584 - protein, 23 aa, Mycobacterium
PTGGRWNNWAEFFHSDSINNLAY

SEQ ID NO: 774585 - protein, 18 aa, Mycobacterium
PTGIGDLSYRVMISGDPD

SEQ ID NO: 774586 - protein, 19 aa, Mycobacterium
PTGMLCWTKSAGTVPAGTP

SEQ ID NO: 774587 - protein, 21 aa, Mycobacterium
PTGPCLEGWVTLTALAQATQR

SEQ ID NO: 774588 - protein, 19 aa, Mycobacterium
PTGRGGLIIGEPVNVFNWL

SEQ ID NO: 774589 - protein, 23 aa, Mycobacterium
PTGRRYKDSFGMASKRAVAARTA

SEQ ID NO: 774590 - protein, 19 aa, Mycobacterium
PTGWPEWAAANVVRAFVER

SEQ ID NO: 774591 - protein, 17 aa, Mycobacterium
PTHLRRLIAEQVGLLLR

SEQ ID NO: 774592 - protein, 17 aa, Mycobacterium
PTIEHFAPLFVALGASD

SEQ ID NO: 774593 - protein, 19 aa, Mycobacterium
PTIQPKLTFSWRLMPENLS

SEQ ID NO: 774594 - protein, 17 aa, Mycobacterium
PTISLALPVPGDVRGLP

SEQ ID NO: 774595 - protein, 27 aa, Mycobacterium
PTKGVWTSGFGYRWGVLHGGIDIANSI

SEQ ID NO: 774596 - protein, 21 aa, Mycobacterium
PTKIRGVLMGGYFAGLLNRGV

SEQ ID NO: 774597 - protein, 24 aa, Mycobacterium
PTLFRAELMLAWLADVTAGAPDHG

SEQ ID NO: 774598 - protein, 19 aa, Mycobacterium
PTLLFPFAAPRVGGDLSEA

SEQ ID NO: 774599 - protein, 17 aa, Mycobacterium
PTLLGLLGIDAPADVDG

SEQ ID NO: 774600 - protein, 17 aa, Mycobacterium
PTLLWKLIEEIRPDDRV

SEQ ID NO: 774601 - protein, 17 aa, Mycobacterium
PTLSSLMAWPTEHLTNA

SEQ ID NO: 774602 - protein, 26 aa, Mycobacterium
PTLTAAAAWGRLADELATAASSFNSA

SEQ ID NO: 774603 - protein, 17 aa, Mycobacterium
PTLVISVPRVFEKVYNT

SEQ ID NO: 774604 - protein, 22 aa, Mycobacterium
PTLYCISEPIPPGSYVGVEGRL

SEQ ID NO: 774605 - protein, 20 aa, Mycobacterium
PTLYCISEPIPPGSYVGVSG

SEQ ID NO: 774606 - protein, 22 aa, Mycobacterium
PTLYCISEPLPPGSYVGVTGRF

SEQ ID NO: 774607 - protein, 19 aa, Mycobacterium
PTLYTKLAIVQRLLGVDLD

SEQ ID NO: 774608 - protein, 18 aa, Mycobacterium
PTMFCCYAVDDLDAARRA

SEQ ID NO: 774609 - protein, 23 aa, Mycobacterium
PTPCGVCDSCVALAPNGPGNVDV

SEQ ID NO: 774610 - protein, 18 aa, Mycobacterium
PTPCPEYDVSGLTGHLLN

SEQ ID NO: 774611 - protein, 17 aa, Mycobacterium
PTPRLFLDIPNPLASIA

SEQ ID NO: 774612 - protein, 22 aa, Mycobacterium
PTQLPMMLSFLDFRKIPLNGLW

SEQ ID NO: 774613 - protein, 22 aa, Mycobacterium
PTQRWADLRADWNYRRRVAPEI

SEQ ID NO: 774614 - protein, 21 aa, Mycobacterium
PTQVLLRWNLQLGNAVIFGSS

SEQ ID NO: 774615 - protein, 23 aa, Mycobacterium
PTQVRWRPFQFWPANTAVNIDAA

SEQ ID NO: 774616 - protein, 24 aa, Mycobacterium
PTRAAICRFATWWVVLERHGELVR

SEQ ID NO: 774617 - protein, 21 aa, Mycobacterium
PTRADIERCWNLGATVAAQLM

SEQ ID NO: 774618 - protein, 24 aa, Mycobacterium
PTRYWPEFCRLMGLHEVAEDPRFT

SEQ ID NO: 774619 - protein, 22 aa, Mycobacterium
PTSARGSLRLSLGHTSVDADVD

SEQ ID NO: 774620 - protein, 19 aa, Mycobacterium
PTSMGGMGMMPPGAMGGHG

SEQ ID NO: 774621 - protein, 20 aa, Mycobacterium
PTSRMPYRWDDNYPARIGVM

SEQ ID NO: 774622 - protein, 23 aa, Mycobacterium
PTSTIALAWLLRRSPVIVPIPGT

SEQ ID NO: 774623 - protein, 21 aa, Mycobacterium
PTTARLTGRWLRGRLPTLNDW

SEQ ID NO: 774624 - protein, 18 aa, Mycobacterium
PTTCPECGTPLAPEKEGD

SEQ ID NO: 774625 - protein, 18 aa, Mycobacterium
PTTCPECGTTLAPAKEGD

SEQ ID NO: 774626 - protein, 19 aa, Mycobacterium
PTTDYFPLLALLSRTLTED

SEQ ID NO: 774627 - protein, 21 aa, Mycobacterium
PTTHLDWYIAMACFKLAIVIE

SEQ ID NO: 774628 - protein, 21 aa, Mycobacterium
PTTRSGHRWARPGGQLWRAWT

SEQ ID NO: 774629 - protein, 18 aa, Mycobacterium
PTTVVEFGMSFGISTIHL

SEQ ID NO: 774630 - protein, 23 aa, Mycobacterium
PTVFWPIPRVYSGLVRIDRYETS

SEQ ID NO: 774631 - protein, 18 aa, Mycobacterium
PTVMAFRDGVLVYNQPGA

SEQ ID NO: 774632 - protein, 17 aa, Mycobacterium
PTVNMSVGFLPPQDMIE

SEQ ID NO: 774633 - protein, 19 aa, Mycobacterium
PTVVAGLRLRRTVASIVGA

SEQ ID NO: 774634 - protein, 19 aa, Mycobacterium
PTWQWESLISKSTRLVAVT

SEQ ID NO: 774635 - protein, 24 aa, Mycobacterium
PTWSGSLKSLWLGDGEAVGDILVG

SEQ ID NO: 774636 - protein, 23 aa, Mycobacterium
PTWSGSLKSLWLGEGEAIGDVLV

SEQ ID NO: 774637 - protein, 22 aa, Mycobacterium
PTYCLRDYFRILAWKRGSTPGL

SEQ ID NO: 774638 - protein, 18 aa, Mycobacterium
PTYLRYAIYPNIVVIRQD

SEQ ID NO: 774639 - protein, 18 aa, Mycobacterium
PVAACATAAVSVEEGVDK

SEQ ID NO: 774640 - protein, 17 aa, Mycobacterium
PVAVVGIGCRFPGNVTG

SEQ ID NO: 774641 - protein, 17 aa, Mycobacterium
PVAYAVVGPSFWGDGQY

SEQ ID NO: 774642 - protein, 17 aa, Mycobacterium
PVCKACWWDEGAGPRVG

SEQ ID NO: 774643 - protein, 18 aa, Mycobacterium
PVCNLQLPPDWAQHPQLV

SEQ ID NO: 774644 - protein, 17 aa, Mycobacterium
PVCRSGPFTATRPYEVE

SEQ ID NO: 774645 - protein, 20 aa, Mycobacterium
PVCRYCRSRDVGLRAVSGRA

SEQ ID NO: 774646 - protein, 19 aa, Mycobacterium
PVDEVWPGILGFEDTVLPQ

SEQ ID NO: 774647 - protein, 17 aa, Mycobacterium
PVDGGYVFNGRWQFSSG

SEQ ID NO: 774648 - protein, 18 aa, Mycobacterium
PVEGWMPFGRVFETLAWG

SEQ ID NO: 774649 - protein, 19 aa, Mycobacterium
PVEGWMPFGRVFETLAWGR

SEQ ID NO: 774650 - protein, 17 aa, Mycobacterium
PVEQIRMSLAIAGWPKA

SEQ ID NO: 774651 - protein, 17 aa, Mycobacterium
PVESVRPGFSLAIDDGG

SEQ ID NO: 774652 - protein, 19 aa, Mycobacterium
PVEYRWYAGGTWRPADEDW

SEQ ID NO: 774653 - protein, 17 aa, Mycobacterium
PVFDRLAALTGHQPVER

SEQ ID NO: 774654 - protein, 22 aa, Mycobacterium
PVFLRNATAFGFSPRLRADIVL

SEQ ID NO: 774655 - protein, 24 aa, Mycobacterium
PVFRPPLDMARLFGAPTLGPTEDG

SEQ ID NO: 774656 - protein, 23 aa, Mycobacterium
PVFRPPLDMARLFGHPELSSRSG

SEQ ID NO: 774657 - protein, 23 aa, Mycobacterium
PVFRPPLDMARLFGQPELGPTDD

SEQ ID NO: 774658 - protein, 20 aa, Mycobacterium
PVFRRRRFFAGRPIREGEEV

SEQ ID NO: 774659 - protein, 20 aa, Mycobacterium
PVFVRELLEPLGLTAEAPAG

SEQ ID NO: 774660 - protein, 19 aa, Mycobacterium
PVGDYWFWNLRNIVRFDKA

SEQ ID NO: 774661 - protein, 24 aa, Mycobacterium
PVGFEAWIGWFLYRLSPGLMRGAL

SEQ ID NO: 774662 - protein, 20 aa, Mycobacterium
PVGGCSLHLAPVAFAGGRRV

SEQ ID NO: 774663 - protein, 19 aa, Mycobacterium
PVGPSVRIYPLLKELTLDI

SEQ ID NO: 774664 - protein, 18 aa, Mycobacterium
PVGTEWLAVSGYRRIDDE

SEQ ID NO: 774665 - protein, 23 aa, Mycobacterium
PVHRLGGVAVRFLNEAQALTGPC

SEQ ID NO: 774666 - protein, 19 aa, Mycobacterium
PVHSIRLAGLVAHQEVLFG

SEQ ID NO: 774667 - protein, 21 aa, Mycobacterium
PVIGCIHGYCVGLGVLLAGTC

SEQ ID NO: 774668 - protein, 17 aa, Mycobacterium
PVIGSKELIAWLPTLLG

SEQ ID NO: 774669 - protein, 23 aa, Mycobacterium
PVIGSKELIAWLPTLLGLGPGDV

SEQ ID NO: 774670 - protein, 23 aa, Mycobacterium
PVIGSKELIAWLPTLLGLGSADM

SEQ ID NO: 774671 - protein, 23 aa, Mycobacterium
PVIGTKEFIAWLPTLLGLGSADA

SEQ ID NO: 774672 - protein, 23 aa, Mycobacterium
PVIGTKELIAWLPTLLGLGADDL

SEQ ID NO: 774673 - protein, 18 aa, Mycobacterium
PVIPRLFQAMGFLGDGAR

SEQ ID NO: 774674 - protein, 22 aa, Mycobacterium
PVKMPSWLGVPARLVMASLIGN

SEQ ID NO: 774675 - protein, 17 aa, Mycobacterium
PVKRVPLARSLRAAQRH

SEQ ID NO: 774676 - protein, 20 aa, Mycobacterium
PVKVPWSLPSARPAYDGEDA

SEQ ID NO: 774677 - protein, 23 aa, Mycobacterium
PVLARSGARWMPNFIELLQHNLT

SEQ ID NO: 774678 - protein, 19 aa, Mycobacterium
PVLERLYRCGGVELTAKVR

SEQ ID NO: 774679 - protein, 21 aa, Mycobacterium
PVLGPSWRMAHNPARIARGAP

SEQ ID NO: 774680 - protein, 21 aa, Mycobacterium
PVLPQRVPMEFCKLSEAETEN

SEQ ID NO: 774681 - protein, 23 aa, Mycobacterium
PVLRFPLEPILGFVYRRLGDTQA

SEQ ID NO: 774682 - protein, 17 aa, Mycobacterium
PVLRYLAPIAIRGELVW

SEQ ID NO: 774683 - protein, 18 aa, Mycobacterium
PVMGLRISRPFADLFAYF

SEQ ID NO: 774684 - protein, 20 aa, Mycobacterium
PVMLDRCYELLAPALTADST

SEQ ID NO: 774685 - protein, 17 aa, Mycobacterium
PVMLMLLPRRSRPPRDR

SEQ ID NO: 774686 - protein, 18 aa, Mycobacterium
PVMPCHYTGFKLKPVGFF

SEQ ID NO: 774687 - protein, 19 aa, Mycobacterium
PVMRRFLQLDGEFTATTEM

SEQ ID NO: 774688 - protein, 28 aa, Mycobacterium
PVMRVVCPLRGWRDGRRLTPGPTVVGPG

SEQ ID NO: 774689 - protein, 20 aa, Mycobacterium
PVNPMRVVWELSSRLPEYAM

SEQ ID NO: 774690 - protein, 21 aa, Mycobacterium
PVNPRPAPPVTPGKPVTPGVP

SEQ ID NO: 774691 - protein, 19 aa, Mycobacterium
PVPALRAAIERAFSSESVA

SEQ ID NO: 774692 - protein, 24 aa, Mycobacterium
PVPFRLVPPPTRWVSDAQTVAAGA

SEQ ID NO: 774693 - protein, 17 aa, Mycobacterium
PVPGFRGQQRFSDPAQA

SEQ ID NO: 774694 - protein, 18 aa, Mycobacterium
PVPGLRYTEAEWARMLAK

SEQ ID NO: 774695 - protein, 18 aa, Mycobacterium
PVPMAYYSFGGWKSSLFG

SEQ ID NO: 774696 - protein, 18 aa, Mycobacterium
PVPPEDLAKVWAVPVDSP

SEQ ID NO: 774697 - protein, 19 aa, Mycobacterium
PVPPEWFCELTWPAKPLAA

SEQ ID NO: 774698 - protein, 19 aa, Mycobacterium
PVPPLSWWRGIRARKTLED

SEQ ID NO: 774699 - protein, 17 aa, Mycobacterium
PVPRAALFVLDGWLRPV

SEQ ID NO: 774700 - protein, 19 aa, Mycobacterium
PVPRPERQYYWFGEPIDTT

SEQ ID NO: 774701 - protein, 17 aa, Mycobacterium
PVPTVAIGHLHEQTVSV

SEQ ID NO: 774702 - protein, 18 aa, Mycobacterium
PVPTVGLSHLHIPRVSVP

SEQ ID NO: 774703 - protein, 17 aa, Mycobacterium
PVQEWQLADGDVIRLGH

SEQ ID NO: 774704 - protein, 25 aa, Mycobacterium
PVQKAEAAWLWSRRTAAVVGVSAAA

SEQ ID NO: 774705 - protein, 23 aa, Mycobacterium
PVQSLRLYERYGLLMPARSQGGT

SEQ ID NO: 774706 - protein, 22 aa, Mycobacterium
PVSGPLPVMFFIHGGGYFLGSS

SEQ ID NO: 774707 - protein, 17 aa, Mycobacterium
PVSGTWIDIRFSLPPNT

SEQ ID NO: 774708 - protein, 17 aa, Mycobacterium
PVSNWSPHDRDPFSPPA

SEQ ID NO: 774709 - protein, 17 aa, Mycobacterium
PVSVEAFLDEIWAIRHH

SEQ ID NO: 774710 - protein, 20 aa, Mycobacterium
PVSVGFPFGLSVIFPPNLPL

SEQ ID NO: 774711 - protein, 18 aa, Mycobacterium
PVSYWKLNEHEIFQHYRS

SEQ ID NO: 774712 - protein, 17 aa, Mycobacterium
PVTAWQIHRCIGMDGST

SEQ ID NO: 774713 - protein, 22 aa, Mycobacterium
PVTDKWAAFGWDVRAVDGHDVG

SEQ ID NO: 774714 - protein, 17 aa, Mycobacterium
PVTDPRALAALTAFTQP

SEQ ID NO: 774715 - protein, 21 aa, Mycobacterium
PVTPRAAGAIAHLNADHADSL

SEQ ID NO: 774716 - protein, 23 aa, Mycobacterium
PVTRPRIRLAYQLTPRRITGDAR

SEQ ID NO: 774717 - protein, 18 aa, Mycobacterium
PVVDHALGAPVTRRLLVT

SEQ ID NO: 774718 - protein, 19 aa, Mycobacterium
PVVKHLFGLLSVLRDGGYH

SEQ ID NO: 774719 - protein, 18 aa, Mycobacterium
PVVLFFHGGGWSVGDLDS

SEQ ID NO: 774720 - protein, 20 aa, Mycobacterium
PVVLHLHGPWTPKHSEPHSP

SEQ ID NO: 774721 - protein, 18 aa, Mycobacterium
PVVMGRLTWESLPASVRP

SEQ ID NO: 774722 - protein, 17 aa, Mycobacterium
PVVPALGLAVLGARAAG

SEQ ID NO: 774723 - protein, 19 aa, Mycobacterium
PVVWDFRKRLVAGFYAMRQ

SEQ ID NO: 774724 - protein, 17 aa, Mycobacterium
PVVWRVIQHYGIDVGGR

SEQ ID NO: 774725 - protein, 17 aa, Mycobacterium
PVWLAQWGFARPVEQAV

SEQ ID NO: 774726 - protein, 18 aa, Mycobacterium
PVWWTWLGNDYLPLVRDY

SEQ ID NO: 774727 - protein, 17 aa, Mycobacterium
PVYIVSIGRTFRTDELD

SEQ ID NO: 774728 - protein, 19 aa, Mycobacterium
PVYTRLYFRVSDDESSYSF

SEQ ID NO: 774729 - protein, 17 aa, Mycobacterium
PWALMHFMVRLPQKEDA

SEQ ID NO: 774730 - protein, 19 aa, Mycobacterium
PWARLGVNVDADFEPLYII

SEQ ID NO: 774731 - protein, 22 aa, Mycobacterium
PWARPLSHWSMGWLPLSARLAA

SEQ ID NO: 774732 - protein, 18 aa, Mycobacterium
PWAVPKFYWSVFSTRAFE

SEQ ID NO: 774733 - protein, 18 aa, Mycobacterium
PWCPWNIEFIRRMNGLAS

SEQ ID NO: 774734 - protein, 18 aa, Mycobacterium
PWDVWKRELLGLGTEGLR

SEQ ID NO: 774735 - protein, 20 aa, Mycobacterium
PWEPEIEGVHSYVMFCSDPV

SEQ ID NO: 774736 - protein, 19 aa, Mycobacterium
PWGGEWHGYEGFKGWSVEM

SEQ ID NO: 774737 - protein, 20 aa, Mycobacterium
PWGLGTPCWPYFEDVKIERL

SEQ ID NO: 774738 - protein, 18 aa, Mycobacterium
PWGRRTTTVWGQGPAWEL

SEQ ID NO: 774739 - protein, 18 aa, Mycobacterium
PWGSRFPMISVRDQVQAD

SEQ ID NO: 774740 - protein, 22 aa, Mycobacterium
PWHRRAIHVFNVIITDGATYQM

SEQ ID NO: 774741 - protein, 18 aa, Mycobacterium
PWHSSSFVFDGNVIATKL

SEQ ID NO: 774742 - protein, 18 aa, Mycobacterium
PWIGFPGAIAGEWQGQIR

SEQ ID NO: 774743 - protein, 18 aa, Mycobacterium
PWISFPGAIAGEWQGQIR

SEQ ID NO: 774744 - protein, 23 aa, Mycobacterium
PWLDITWRDRFEQMLKRAEARLH

SEQ ID NO: 774745 - protein, 19 aa, Mycobacterium
PWLEPGQWWALVRVGCAGG

SEQ ID NO: 774746 - protein, 24 aa, Mycobacterium
PWLIGDNGFGHWWLGDRVGGTSKY

SEQ ID NO: 774747 - protein, 20 aa, Mycobacterium
PWLMSACAPAAPGVSPVLGE

SEQ ID NO: 774748 - protein, 17 aa, Mycobacterium
PWLPHFYLGHGIGTYPA

SEQ ID NO: 774749 - protein, 19 aa, Mycobacterium
PWLRLGRIQQEWGVSDEVM

SEQ ID NO: 774750 - protein, 19 aa, Mycobacterium
PWLTSRHSFSFGDHYDPEN

SEQ ID NO: 774751 - protein, 23 aa, Mycobacterium
PWNFPMPIACWGFAPALAAGNAV

SEQ ID NO: 774752 - protein, 24 aa, Mycobacterium
PWNYPMMMAVWKFAPALAAGCTVV

SEQ ID NO: 774753 - protein, 18 aa, Mycobacterium
PWPQSPWWVFYYYGSPEQ

SEQ ID NO: 774754 - protein, 21 aa, Mycobacterium
PWPRGRARRKFGFYDQDLQPA

SEQ ID NO: 774755 - protein, 22 aa, Mycobacterium
PWQREMEDAFGFVETVDQLTAI

SEQ ID NO: 774756 - protein, 18 aa, Mycobacterium
PWRAKLVPAERLIVVEST

SEQ ID NO: 774757 - protein, 23 aa, Mycobacterium
PWRLKQNYFFDLRMIRYDKVDEE

SEQ ID NO: 774758 - protein, 20 aa, Mycobacterium
PWRRCVVHLVGPRAFHRLRL

SEQ ID NO: 774759 - protein, 18 aa, Mycobacterium
PWRSKYFLDHKVGELIYY

SEQ ID NO: 774760 - protein, 18 aa, Mycobacterium
PWRSKYFLTRKIGEQIYY

SEQ ID NO: 774761 - protein, 19 aa, Mycobacterium
PWTGCRGWEARFGTQEISQ

SEQ ID NO: 774762 - protein, 18 aa, Mycobacterium
PWTWKSAGTYRVFADFQP

SEQ ID NO: 774763 - protein, 18 aa, Mycobacterium
PWVVPKFYWTILGLSAFL

SEQ ID NO: 774764 - protein, 18 aa, Mycobacterium
PWWLKYVNKVMIGLSKVG

SEQ ID NO: 774765 - protein, 22 aa, Mycobacterium
PWWLQRRLLLCGIRATSPAVDV

SEQ ID NO: 774766 - protein, 21 aa, Mycobacterium
PWWLQRRLLLSGIRAISPAVD

SEQ ID NO: 774767 - protein, 17 aa, Mycobacterium
PWYSYTLTGLIGALKDG

SEQ ID NO: 774768 - protein, 19 aa, Mycobacterium
PYCLAGRLGQCAAMLGYGS

SEQ ID NO: 774769 - protein, 18 aa, Mycobacterium
PYDNEWGWTWPMEPAGAL

SEQ ID NO: 774770 - protein, 20 aa, Mycobacterium
PYFFCCHTCRNCLAGRRNAC

SEQ ID NO: 774771 - protein, 17 aa, Mycobacterium
PYGHGWVTWFPPEGPPR

SEQ ID NO: 774772 - protein, 19 aa, Mycobacterium
PYGLAGSANLVWVSETSTN

SEQ ID NO: 774773 - protein, 18 aa, Mycobacterium
PYLAWLRLTAQQCQQTAA

SEQ ID NO: 774774 - protein, 17 aa, Mycobacterium
PYLDRVGLRPGQRHHPS

SEQ ID NO: 774775 - protein, 20 aa, Mycobacterium
PYLNRPGLHWEFHVDETSQE

SEQ ID NO: 774776 - protein, 24 aa, Mycobacterium
PYNSGRFGKQWAMVHRSIFRLAFP

SEQ ID NO: 774777 - protein, 17 aa, Mycobacterium
PYPELVLAPRDSIFDYT

SEQ ID NO: 774778 - protein, 17 aa, Mycobacterium
PYPKLSLSQRDSIFDYT

SEQ ID NO: 774779 - protein, 17 aa, Mycobacterium
PYPKLVLVQRDSIFDYA

SEQ ID NO: 774780 - protein, 22 aa, Mycobacterium
PYPTARFDGFWIIDVPSKDEAK

SEQ ID NO: 774781 - protein, 25 aa, Mycobacterium
PYRDLRFLARLCAAAAQIKRLGVSA

SEQ ID NO: 774782 - protein, 22 aa, Mycobacterium
PYRLAGELGMPPWRVQKAQKQS

SEQ ID NO: 774783 - protein, 20 aa, Mycobacterium
PYWGRPVPSWGAARPRLLIV

SEQ ID NO: 774784 - protein, 23 aa, Mycobacterium
PYYGRWLRFVSWWPIADALDEQI

SEQ ID NO: 774785 - protein, 20 aa, Mycobacterium
QAAAFGSRFVQALTSGAGAY

SEQ ID NO: 774786 - protein, 21 aa, Mycobacterium
QAAAFHERFLQTLSGGAGAYA

SEQ ID NO: 774787 - protein, 18 aa, Mycobacterium
QAAARLCARVGLHGLATV

SEQ ID NO: 774788 - protein, 20 aa, Mycobacterium
QAAARLCARVGLRGVATVEF

SEQ ID NO: 774789 - protein, 21 aa, Mycobacterium
QAADAVMRWGMQRGAGLGVVA

SEQ ID NO: 774790 - protein, 22 aa, Mycobacterium
QAAEFHERFVLTLAADANTYLT

SEQ ID NO: 774791 - protein, 22 aa, Mycobacterium
QAAELFGWLGPHPDAVAGSAAA

SEQ ID NO: 774792 - protein, 17 aa, Mycobacterium
QAAFDWHEFVAFRGREL

SEQ ID NO: 774793 - protein, 20 aa, Mycobacterium
QAAHARFVEVAARVNTLLDI

SEQ ID NO: 774794 - protein, 17 aa, Mycobacterium
QAAHLWTRTSLRPADVD

SEQ ID NO: 774795 - protein, 18 aa, Mycobacterium
QAAHLWTRTSLRPDDVDV

SEQ ID NO: 774796 - protein, 23 aa, Mycobacterium
QAALDWLNFVAFRGRELAPDGRL

SEQ ID NO: 774797 - protein, 36 aa, Mycobacterium
QAALSRIGSPYSWGGSGPNAFDCSGLVMWSFQQAGI

SEQ ID NO: 774798 - protein, 20 aa, Mycobacterium
QAARARPHFESKVASVADDP

SEQ ID NO: 774799 - protein, 25 aa, Mycobacterium
QAARRCARVLLDLHVVDGRLRRACL

SEQ ID NO: 774800 - protein, 17 aa, Mycobacterium
QAATAWAGLADELGAAA

SEQ ID NO: 774801 - protein, 17 aa, Mycobacterium
QAAVAFKNFQYTAAAQK

SEQ ID NO: 774802 - protein, 17 aa, Mycobacterium
QAAVLRARLDWLGENNL

SEQ ID NO: 774803 - protein, 18 aa, Mycobacterium
QACGLPLLRRPPSVDTAW

SEQ ID NO: 774804 - protein, 22 aa, Mycobacterium
QADCFAGVYLRWVAAGNSPRFA

SEQ ID NO: 774805 - protein, 17 aa, Mycobacterium
QADHILRWIQRWRSSEF

SEQ ID NO: 774806 - protein, 22 aa, Mycobacterium
QAEAFHAQFAQLMANGAGTYAS

SEQ ID NO: 774807 - protein, 22 aa, Mycobacterium
QAEGRGATMIFTRTKRTAQKVA

SEQ ID NO: 774808 - protein, 25 aa, Mycobacterium
QAELHPAPGTWSWRPWSSIVDVEPG

SEQ ID NO: 774809 - protein, 17 aa, Mycobacterium
QAFKYAVGEWTDVDGDE

SEQ ID NO: 774810 - protein, 23 aa, Mycobacterium
QAFPKSRFTGIDFSEPAIAAASQ

SEQ ID NO: 774811 - protein, 17 aa, Mycobacterium
QAFSTWRDTPAPVRGAL

SEQ ID NO: 774812 - protein, 17 aa, Mycobacterium
QAFWSFGGLFLVDSPEQ

SEQ ID NO: 774813 - protein, 20 aa, Mycobacterium
QAGAEFARWLDARGPARVPE

SEQ ID NO: 774814 - protein, 20 aa, Mycobacterium
QAGAYLSAWANALGAMLAEM

SEQ ID NO: 774815 - protein, 20 aa, Mycobacterium
QAGGAGGLLIGNGGNGAPGA

SEQ ID NO: 774816 - protein, 22 aa, Mycobacterium
QAGGLPALFSGLARRPRRRQID

SEQ ID NO: 774817 - protein, 24 aa, Mycobacterium
QAGMYRTGPAWAFQHSGIEPDMMV

SEQ ID NO: 774818 - protein, 21 aa, Mycobacterium
QAGPEFARWLAERGPARMPDI

SEQ ID NO: 774819 - protein, 17 aa, Mycobacterium
QAGTFIWVDPAVDLGLV

SEQ ID NO: 774820 - protein, 19 aa, Mycobacterium
QAHCAMCGEEIKAWMRELD

SEQ ID NO: 774821 - protein, 17 aa, Mycobacterium
QAHDLLVQALETVDKGQ

SEQ ID NO: 774822 - protein, 17 aa, Mycobacterium
QAHGRWRLRGNLRPSPD

SEQ ID NO: 774823 - protein, 18 aa, Mycobacterium
QAHRWRFDGMQAIGPDVL

SEQ ID NO: 774824 - protein, 18 aa, Mycobacterium
QAIAWYLAMARRGQGNEE

SEQ ID NO: 774825 - protein, 22 aa, Mycobacterium
QAIWPHRMFSLLAGFVEAGESF

SEQ ID NO: 774826 - protein, 19 aa, Mycobacterium
QALARLAIRDDIYASLRAL

SEQ ID NO: 774827 - protein, 20 aa, Mycobacterium
QALKPWYGYFCKRPCFHDEY

SEQ ID NO: 774828 - protein, 19 aa, Mycobacterium
QALLARPGWDAGDKSALRA

SEQ ID NO: 774829 - protein, 20 aa, Mycobacterium
QALLGRPLIGNGANGADGTG

SEQ ID NO: 774830 - protein, 21 aa, Mycobacterium
QALLGRPLIGNGANGTTVNGV

SEQ ID NO: 774831 - protein, 26 aa, Mycobacterium
QALLYCAVLHRFLRWRIRDYDPDRHL

SEQ ID NO: 774832 - protein, 17 aa, Mycobacterium
QALQWAMSVAAKRAAAL

SEQ ID NO: 774833 - protein, 17 aa, Mycobacterium
QALQWAMSVAGRRAAAL

SEQ ID NO: 774834 - protein, 25 aa, Mycobacterium
QALRPRYLLMLAEILRFHRAASRLL

SEQ ID NO: 774835 - protein, 18 aa, Mycobacterium
QALSEWRSTPVFGPGQVG

SEQ ID NO: 774836 - protein, 24 aa, Mycobacterium
QALTARPLFGDGADGAPGTGQNGG

SEQ ID NO: 774837 - protein, 23 aa, Mycobacterium
QAMPDWLGAAGIAYRHEPDLGGR

SEQ ID NO: 774838 - protein, 17 aa, Mycobacterium
QANFVWLPLAERTLDFV

SEQ ID NO: 774839 - protein, 21 aa, Mycobacterium
QAPRGSLYFHFPGGKEELATE

SEQ ID NO: 774840 - protein, 17 aa, Mycobacterium
QAQAIALSQAWGTANGT

SEQ ID NO: 774841 - protein, 21 aa, Mycobacterium
QAQRLSARLARIGEVQCDHDR

SEQ ID NO: 774842 - protein, 23 aa, Mycobacterium
QAQYCSVICPFIVQGLVSVPVGT

SEQ ID NO: 774843 - protein, 21 aa, Mycobacterium
QARAWAPVCNLQLPPDWAQHP

SEQ ID NO: 774844 - protein, 25 aa, Mycobacterium
QARDWLSRFDLGPGFDVILPTPSLL

SEQ ID NO: 774845 - protein, 22 aa, Mycobacterium
QARGRGATMVFTRTKRTAQKVS

SEQ ID NO: 774846 - protein, 22 aa, Mycobacterium
QARLVLGQALAWRGRGREAGQV

SEQ ID NO: 774847 - protein, 18 aa, Mycobacterium
QARRAGRIIGAWADAYLG

SEQ ID NO: 774848 - protein, 21 aa, Mycobacterium
QASAFHARFMSALNTGAGAYA

SEQ ID NO: 774849 - protein, 21 aa, Mycobacterium
QASWRLTPFFWQEIDEGILPA

SEQ ID NO: 774850 - protein, 24 aa, Mycobacterium
QATLPGGTPFNWGSDAAAANRGIG

SEQ ID NO: 774851 - protein, 23 aa, Mycobacterium
QATLPGGTPFNWGSDSAAARRGI

SEQ ID NO: 774852 - protein, 20 aa, Mycobacterium
QAVGVPGGWLYALGDTTGRA

SEQ ID NO: 774853 - protein, 17 aa, Mycobacterium
QAVPIMVDWLRHIDERV

SEQ ID NO: 774854 - protein, 18 aa, Mycobacterium
QAVWKPEEEWGLGIDNID

SEQ ID NO: 774855 - protein, 22 aa, Mycobacterium
QAVWPERMFSLLAGFVEAGESF

SEQ ID NO: 774856 - protein, 21 aa, Mycobacterium
QAYKCRVRKPWWRVPYLRPAD

SEQ ID NO: 774857 - protein, 17 aa, Mycobacterium
QAYWSFGGLFFVNSPEQ

SEQ ID NO: 774858 - protein, 23 aa, Mycobacterium
QCAPFCAVQAWPALGRQRLSVAA

SEQ ID NO: 774859 - protein, 17 aa, Mycobacterium
QCARLAQRSALAVGRLG

SEQ ID NO: 774860 - protein, 19 aa, Mycobacterium
QCEWIPPDLLDRGQHRTNT

SEQ ID NO: 774861 - protein, 19 aa, Mycobacterium
QCEWIPPQLLDRGQHRTNT

SEQ ID NO: 774862 - protein, 17 aa, Mycobacterium
QCGSCFNGTAAMAAAAG

SEQ ID NO: 774863 - protein, 18 aa, Mycobacterium
QCGSCFNGTAAMAAVASA

SEQ ID NO: 774864 - protein, 18 aa, Mycobacterium
QCGSCFNGTAAMAAVATA

SEQ ID NO: 774865 - protein, 20 aa, Mycobacterium
QCIDRLWAEVCEHVRGLENQ

SEQ ID NO: 774866 - protein, 25 aa, Mycobacterium
QCKAGRYNLCPEIKFYATPPIDGAF

SEQ ID NO: 774867 - protein, 22 aa, Mycobacterium
QCLPDGVLVDWHRVATFRAPPG

SEQ ID NO: 774868 - protein, 23 aa, Mycobacterium
QCPESAEALALLFAEAGLPAGAY

SEQ ID NO: 774869 - protein, 27 aa, Mycobacterium
QCQQVWCPVCALAALISGEQHPLLTVV

SEQ ID NO: 774870 - protein, 24 aa, Mycobacterium
QDAFPLLITHGWPGSVVEFHKVIE

SEQ ID NO: 774871 - protein, 17 aa, Mycobacterium
QDFTYRFSVPNAGTYWA

SEQ ID NO: 774872 - protein, 18 aa, Mycobacterium
QDGMLWFEVMAPMASSAA

SEQ ID NO: 774873 - protein, 23 aa, Mycobacterium
QDGPGWRFGRFHSRVRRVPEVLG

SEQ ID NO: 774874 - protein, 39 aa, Mycobacterium
QDGTGQNGGILFGNGGSGWNSDVVGMDGGNGGNGGLFGG

SEQ ID NO: 774875 - protein, 22 aa, Mycobacterium
QDIARFKVFDWARSDHWQTDIP

SEQ ID NO: 774876 - protein, 18 aa, Mycobacterium
QDLTCCWDDIIAGSGEIE

SEQ ID NO: 774877 - protein, 26 aa, Mycobacterium
QDPALRPPLTWEVDNPFPLPRLDTYT

SEQ ID NO: 774878 - protein, 23 aa, Mycobacterium
QDPRLLPWRTVMANLGFVQHERT

SEQ ID NO: 774879 - protein, 24 aa, Mycobacterium
QDPRPRLVGALAMAVVRIALDDWL

SEQ ID NO: 774880 - protein, 21 aa, Mycobacterium
QDRCRGWRMCVSGCPYKKVYF

SEQ ID NO: 774881 - protein, 20 aa, Mycobacterium
QDRPRWQLTASVAFDEWAAA

SEQ ID NO: 774882 - protein, 18 aa, Mycobacterium
QDTGTAIVHAWRGRHVLT

SEQ ID NO: 774883 - protein, 23 aa, Mycobacterium
QDVYLRWAVAAFRLATSGVADST

SEQ ID NO: 774884 - protein, 17 aa, Mycobacterium
QEACSFCELTIVPQFGT

SEQ ID NO: 774885 - protein, 26 aa, Mycobacterium
QEADGGLCIWARLPAPMSTALAAAAA

SEQ ID NO: 774886 - protein, 19 aa, Mycobacterium
QEAWLRWDAAPGRDDVADL

SEQ ID NO: 774887 - protein, 26 aa, Mycobacterium
QEFAGLPVRRVWRPTTFYTMLLQQLT

SEQ ID NO: 774888 - protein, 20 aa, Mycobacterium
QEFLRRLGVDAAEVKTLPQR

SEQ ID NO: 774889 - protein, 23 aa, Mycobacterium
QEFPVGFDVWWFRLPRPETDEMY

SEQ ID NO: 774890 - protein, 17 aa, Mycobacterium
QEIFPPGVCNLVCGDRD

SEQ ID NO: 774891 - protein, 21 aa, Mycobacterium
QEIYADLGLRFEGERAEKISE

SEQ ID NO: 774892 - protein, 23 aa, Mycobacterium
QELAELLPGCAGLRVVDSACGHD

SEQ ID NO: 774893 - protein, 22 aa, Mycobacterium
QELESAAALLAGVGSNVGAAGS

SEQ ID NO: 774894 - protein, 18 aa, Mycobacterium
QELGLSWLAEIGAHGVVA

SEQ ID NO: 774895 - protein, 18 aa, Mycobacterium
QELLAAKFMGRWRSGAPL

SEQ ID NO: 774896 - protein, 26 aa, Mycobacterium
QELPPDFKLPPGVFGPDYDTTDEPAK

SEQ ID NO: 774897 - protein, 17 aa, Mycobacterium
QELRLAVLAQREYGTAF

SEQ ID NO: 774898 - protein, 19 aa, Mycobacterium
QELRRVFAPSWLFLAHADQ

SEQ ID NO: 774899 - protein, 18 aa, Mycobacterium
QELSDLIFNLGIGNVGTF

SEQ ID NO: 774900 - protein, 24 aa, Mycobacterium
QELTGRPLIGNGLPGSAGSGVAGA

SEQ ID NO: 774901 - protein, 24 aa, Mycobacterium
QELYFPACFELAVARGMPAHDADE

SEQ ID NO: 774902 - protein, 23 aa, Mycobacterium
QELYFPVCYELAVTQGIPREADH

SEQ ID NO: 774903 - protein, 17 aa, Mycobacterium
QEMRGMWREMWDLSDQC

SEQ ID NO: 774904 - protein, 17 aa, Mycobacterium
QEPAAQVPPGWSPPQPY

SEQ ID NO: 774905 - protein, 18 aa, Mycobacterium
QEPGLSWAAGLRDDGRTT

SEQ ID NO: 774906 - protein, 24 aa, Mycobacterium
QERSRAGAILGPFEAWLGARSLAT

SEQ ID NO: 774907 - protein, 22 aa, Mycobacterium
QEVLSALGRYVTMNQNLTGTGF

SEQ ID NO: 774908 - protein, 22 aa, Mycobacterium
QEVRASGVLPTWAATRKFVDAL

SEQ ID NO: 774909 - protein, 24 aa, Mycobacterium
QEVRWCPGCGDYVILNTIRGFLPE

SEQ ID NO: 774910 - protein, 23 aa, Mycobacterium
QEVRWCPGCGDYVILNTIRNFLP

SEQ ID NO: 774911 - protein, 24 aa, Mycobacterium
QEVRWCPGCGDYVILNTIRNFLPD

SEQ ID NO: 774912 - protein, 21 aa, Mycobacterium
QEWEDPRLIVAILHNNDLNQV

SEQ ID NO: 774913 - protein, 20 aa, Mycobacterium
QEWLRFGWYFLITRRDPKGL

SEQ ID NO: 774914 - protein, 20 aa, Mycobacterium
QEWLRYGWYFLISRRDPAGL

SEQ ID NO: 774915 - protein, 21 aa, Mycobacterium
QEWPPHIKALADAASKRGDAS

SEQ ID NO: 774916 - protein, 17 aa, Mycobacterium
QEYQMVSTRAAHLHAEF

SEQ ID NO: 774917 - protein, 23 aa, Mycobacterium
QFASGRFGVWAGYLADPMLQELE

SEQ ID NO: 774918 - protein, 18 aa, Mycobacterium
QFELKRIQREIGITFIYV

SEQ ID NO: 774919 - protein, 18 aa, Mycobacterium
QFELKRIQREVGITFIYV

SEQ ID NO: 774920 - protein, 17 aa, Mycobacterium
QFHQWFTQTLSGAGLSY

SEQ ID NO: 774921 - protein, 27 aa, Mycobacterium
QFIGNLLPPAMKWKMFFSRQAANRNYL

SEQ ID NO: 774922 - protein, 20 aa, Mycobacterium
QFIPETWRLYGVDANNDGIV

SEQ ID NO: 774923 - protein, 20 aa, Mycobacterium
QFIPETWRLYGVDANNDGVV

SEQ ID NO: 774924 - protein, 18 aa, Mycobacterium
QFNQRWVRLGCDIDLSGL

SEQ ID NO: 774925 - protein, 23 aa, Mycobacterium
QFRPDTPFGFGFGFDPTGRGPGL

SEQ ID NO: 774926 - protein, 17 aa, Mycobacterium
QFTARWGPTGTLITVDG

SEQ ID NO: 774927 - protein, 23 aa, Mycobacterium
QFTHAVALTAVWRAHGVAPDMTV

SEQ ID NO: 774928 - protein, 25 aa, Mycobacterium
QFTHAVSLAHEWRCHGVLPAMTVGH

SEQ ID NO: 774929 - protein, 24 aa, Mycobacterium
QFVHGVALARVWRSHGVVPDITVG

SEQ ID NO: 774930 - protein, 18 aa, Mycobacterium
QGAALWGAGFGGDGAVGG

SEQ ID NO: 774931 - protein, 22 aa, Mycobacterium
QGCALATRMLVPRSHYDQAVEV

SEQ ID NO: 774932 - protein, 21 aa, Mycobacterium
QGCALTSRLLVPAAHKDEIVE

SEQ ID NO: 774933 - protein, 19 aa, Mycobacterium
QGCALTSRLLVPRKHKDEI

SEQ ID NO: 774934 - protein, 17 aa, Mycobacterium
QGEEFVVEFDLPGIDAN

SEQ ID NO: 774935 - protein, 19 aa, Mycobacterium
QGEIIGMEWDRCDLEKGLF

SEQ ID NO: 774936 - protein, 22 aa, Mycobacterium
QGEVSSSWGFRDIINSALDHGV

SEQ ID NO: 774937 - protein, 23 aa, Mycobacterium
QGFAWPWSICRWVTGENPKFGQL

SEQ ID NO: 774938 - protein, 19 aa, Mycobacterium
QGFDHFKVALSIGIMKMVR

SEQ ID NO: 774939 - protein, 17 aa, Mycobacterium
QGFLRCVAALARAADDI

SEQ ID NO: 774940 - protein, 19 aa, Mycobacterium
QGGNARLFGTGGVGGHGGT

SEQ ID NO: 774941 - protein, 21 aa, Mycobacterium
QGGPCARTVLDTALLHAVIAG

SEQ ID NO: 774942 - protein, 21 aa, Mycobacterium
QGGRLLGFHWTKVHLDRPGLG

SEQ ID NO: 774943 - protein, 17 aa, Mycobacterium
QGGWIRKIVGGMMGQQF

SEQ ID NO: 774944 - protein, 17 aa, Mycobacterium
QGILALGRHVFVVDSGA

SEQ ID NO: 774945 - protein, 17 aa, Mycobacterium
QGIPAQFLVDILSDLRT

SEQ ID NO: 774946 - protein, 17 aa, Mycobacterium
QGIRAFRDPMGWQSSRL

SEQ ID NO: 774947 - protein, 17 aa, Mycobacterium
QGLCYFAYLAGYRLVHE

SEQ ID NO: 774948 - protein, 27 aa, Mycobacterium
QGLKIGVPEEIAWRAGFINDDQLAARA

SEQ ID NO: 774949 - protein, 19 aa, Mycobacterium
QGLKISVPEEVAWRVGFID

SEQ ID NO: 774950 - protein, 21 aa, Mycobacterium
QGLPQFVGFAVIRPAQPGGDQ

SEQ ID NO: 774951 - protein, 17 aa, Mycobacterium
QGLPRPPSVPVFDGDRI

SEQ ID NO: 774952 - protein, 17 aa, Mycobacterium
QGLRLAKTLTPWPAAGG

SEQ ID NO: 774953 - protein, 18 aa, Mycobacterium
QGLRLAQTLTPWPATDGQ

SEQ ID NO: 774954 - protein, 17 aa, Mycobacterium
QGLTVAGTRAWLNRQLR

SEQ ID NO: 774955 - protein, 17 aa, Mycobacterium
QGLVGVPLFDIAAAPGF

SEQ ID NO: 774956 - protein, 18 aa, Mycobacterium
QGPAAWPKCASAGGLPPV

SEQ ID NO: 774957 - protein, 19 aa, Mycobacterium
QGPRLRLVHKFGAGVNTID

SEQ ID NO: 774958 - protein, 18 aa, Mycobacterium
QGPWPGGMEWEYVEKPES

SEQ ID NO: 774959 - protein, 20 aa, Mycobacterium
QGRVAFAWRAMDAFYEEEER

SEQ ID NO: 774960 - protein, 22 aa, Mycobacterium
QGRVALDWLDRVDVIGHTQSSS

SEQ ID NO: 774961 - protein, 22 aa, Mycobacterium
QGRVALDWLDRVDVIGQTNASG

SEQ ID NO: 774962 - protein, 20 aa, Mycobacterium
QGSCWRIRLAHDDAAKFDAA

SEQ ID NO: 774963 - protein, 21 aa, Mycobacterium
QGTWDRLWPKLGMQARDEDSQ

SEQ ID NO: 774964 - protein, 19 aa, Mycobacterium
QGVEFAMARACAAGALATL

SEQ ID NO: 774965 - protein, 24 aa, Mycobacterium
QGVLCGSVLSGLRVQPGHWAGAHN

SEQ ID NO: 774966 - protein, 18 aa, Mycobacterium
QGVRRLAQFWGHAWQSAV

SEQ ID NO: 774967 - protein, 21 aa, Mycobacterium
QGVSCAGLVIGSWPAHPSLVE

SEQ ID NO: 774968 - protein, 24 aa, Mycobacterium
QGVSMPLWLSRLVALLIPEHDDRT

SEQ ID NO: 774969 - protein, 26 aa, Mycobacterium
QGWRVPPGFTRFRWDLDSMFGPQARW

SEQ ID NO: 774970 - protein, 18 aa, Mycobacterium
QGWTSWLLQRVLRELLLD

SEQ ID NO: 774971 - protein, 21 aa, Mycobacterium
QGWVNLHFSLLPAWRGAAPVQ

SEQ ID NO: 774972 - protein, 17 aa, Mycobacterium
QHAIWWQVYPLGFVGAF

SEQ ID NO: 774973 - protein, 21 aa, Mycobacterium
QHGFIGINFPEEFGGGGAGMA

SEQ ID NO: 774974 - protein, 18 aa, Mycobacterium
QHGTEILQELGFDDGQIA

SEQ ID NO: 774975 - protein, 18 aa, Mycobacterium
QHHVKRTLVLDGLLGSSR

SEQ ID NO: 774976 - protein, 18 aa, Mycobacterium
QHLLRPLRDVIWGSDESL

SEQ ID NO: 774977 - protein, 19 aa, Mycobacterium
QHLVPEWLWLLGRRVVNAD

SEQ ID NO: 774978 - protein, 27 aa, Mycobacterium
QHNLARLAELLLLWRHGTPDHREVVYL

SEQ ID NO: 774979 - protein, 17 aa, Mycobacterium
QHPPAWDLAGRRGDYVN

SEQ ID NO: 774980 - protein, 17 aa, Mycobacterium
QHPRFATVTARDKAQAV

SEQ ID NO: 774981 - protein, 18 aa, Mycobacterium
QHRCFPVLAGPPGARDTL

SEQ ID NO: 774982 - protein, 28 aa, Mycobacterium
QHRPGRLVVCLDLDWRPQFRVDLISSYK

SEQ ID NO: 774983 - protein, 28 aa, Mycobacterium
QHRPSRLAVCLDLDWRPQFRVDLIPSYK

SEQ ID NO: 774984 - protein, 23 aa, Mycobacterium
QHTRLRPAVNLGLDVLNTALREI

SEQ ID NO: 774985 - protein, 23 aa, Mycobacterium
QHTRLRPAVNLGLDVLNTALREL

SEQ ID NO: 774986 - protein, 17 aa, Mycobacterium
QIADGWLGTSFVPEGAA

SEQ ID NO: 774987 - protein, 17 aa, Mycobacterium
QIADWAICLARTNPDVP

SEQ ID NO: 774988 - protein, 21 aa, Mycobacterium
QIAPDGSFEWRFRPTDPGQLV

SEQ ID NO: 774989 - protein, 22 aa, Mycobacterium
QIARGAPLPAFRDVTLGGNAVA

SEQ ID NO: 774990 - protein, 24 aa, Mycobacterium
QIDFWRFNVAFARQILAQQPISGP

SEQ ID NO: 774991 - protein, 30 aa, Mycobacterium
QIGAPVYKVFNGIFWKHLLERGIPAGSPGR

SEQ ID NO: 774992 - protein, 24 aa, Mycobacterium
QIGDLRWFYVYSGVMWACVFMRTG

SEQ ID NO: 774993 - protein, 19 aa, Mycobacterium
QIGKFRLVFLTGPKGDDGA

SEQ ID NO: 774994 - protein, 19 aa, Mycobacterium
QIGKFRLVFLTGPKSAGDD

SEQ ID NO: 774995 - protein, 18 aa, Mycobacterium
QIGTEWLRSYLALPNYAN

SEQ ID NO: 774996 - protein, 21 aa, Mycobacterium
QIIDRLIEWVAFTPLQNATGE

SEQ ID NO: 774997 - protein, 28 aa, Mycobacterium
QIIGAQAAMFHAEFVRALDIGAGAYWAT

SEQ ID NO: 774998 - protein, 25 aa, Mycobacterium
QIIPWNFPILMAVWKLAPALAAGNA

SEQ ID NO: 774999 - protein, 23 aa, Mycobacterium
QIIPWNFPLLMAVWKLAPALAAG

SEQ ID NO: 775000 - protein, 17 aa, Mycobacterium
QILLARWSAAAAILQRG

SEQ ID NO: 775001 - protein, 18 aa, Mycobacterium
QILLPKFFRQYGAKVQGG

SEQ ID NO: 775002 - protein, 19 aa, Mycobacterium
QILRRPRSGLSYETLLATV

SEQ ID NO: 775003 - protein, 20 aa, Mycobacterium
QILSESGWHTALFGMQHETS

SEQ ID NO: 775004 - protein, 17 aa, Mycobacterium
QILVSWSHPGRCRDEAA

SEQ ID NO: 775005 - protein, 17 aa, Mycobacterium
QILWRQAYDRGPARKPG

SEQ ID NO: 775006 - protein, 24 aa, Mycobacterium
QIPVGPRLGSVVVEVEHLDKGFGG

SEQ ID NO: 775007 - protein, 18 aa, Mycobacterium
QIQRRLGITSVYVTHDQE

SEQ ID NO: 775008 - protein, 17 aa, Mycobacterium
QIRGEWQPLYTFTTEPR

SEQ ID NO: 775009 - protein, 17 aa, Mycobacterium
QIRSIPTLMAFKKGKLL

SEQ ID NO: 775010 - protein, 19 aa, Mycobacterium
QIRSIPTLMAFKKGKLLFN

SEQ ID NO: 775011 - protein, 17 aa, Mycobacterium
QIRSIPTLMAFKKGQLL

SEQ ID NO: 775012 - protein, 18 aa, Mycobacterium
QISCGSCYMCDRQLYTQC

SEQ ID NO: 775013 - protein, 25 aa, Mycobacterium
QIVLARLRLGLTWQELADAIDRPVV

SEQ ID NO: 775014 - protein, 22 aa, Mycobacterium
QIVPVHAALPWSERVATPAEFD

SEQ ID NO: 775015 - protein, 20 aa, Mycobacterium
QIWMPYHWGYSGLVDGDVVN

SEQ ID NO: 775016 - protein, 20 aa, Mycobacterium
QIWRPNVYRQLGLLPTNSAR

SEQ ID NO: 775017 - protein, 22 aa, Mycobacterium
QIYPVLCGSAFKNKGVQPMLDA

SEQ ID NO: 775018 - protein, 18 aa, Mycobacterium
QKARIFLALLGKQYGVTP

SEQ ID NO: 775019 - protein, 20 aa, Mycobacterium
QKARIFLALLGKQYGVTPEG

SEQ ID NO: 775020 - protein, 19 aa, Mycobacterium
QKARIFLALLGKQYGVTPP

SEQ ID NO: 775021 - protein, 22 aa, Mycobacterium
QKFYGAECLFDLGDLPGAADSD

SEQ ID NO: 775022 - protein, 20 aa, Mycobacterium
QKGFVRMARDYGLGALIEKR

SEQ ID NO: 775023 - protein, 19 aa, Mycobacterium
QKHRWAVPVLRGERTASLG

SEQ ID NO: 775024 - protein, 18 aa, Mycobacterium
QKKRWLPGIADGTLTMAF

SEQ ID NO: 775025 - protein, 19 aa, Mycobacterium
QKKRWLPGIADGTLTMAFA

SEQ ID NO: 775026 - protein, 18 aa, Mycobacterium
QKLPAARFVDWWLEASLL

SEQ ID NO: 775027 - protein, 19 aa, Mycobacterium
QKPRTGVGLGMPRIGAPAP

SEQ ID NO: 775028 - protein, 17 aa, Mycobacterium
QKVGIGLARRMSMTGDY

SEQ ID NO: 775029 - protein, 18 aa, Mycobacterium
QKVGVGLARRMSLTGDYL

SEQ ID NO: 775030 - protein, 17 aa, Mycobacterium
QKVGVGLARRMSMTGDY

SEQ ID NO: 775031 - protein, 19 aa, Mycobacterium
QKWLRAGWGTGFTKLSDRM

SEQ ID NO: 775032 - protein, 18 aa, Mycobacterium
QLAAAAWRAQSPIPAESA

SEQ ID NO: 775033 - protein, 20 aa, Mycobacterium
QLAALGIDLTDVFLVLENEG

SEQ ID NO: 775034 - protein, 20 aa, Mycobacterium
QLAEGIALLSKVDWRARGLH

SEQ ID NO: 775035 - protein, 21 aa, Mycobacterium
QLALAWLLKRSPVMLPIPGTS

SEQ ID NO: 775036 - protein, 19 aa, Mycobacterium
QLALTRLWRVYGVEPDAVI

SEQ ID NO: 775037 - protein, 20 aa, Mycobacterium
QLANRLMRWTGFSPDKVARI

SEQ ID NO: 775038 - protein, 24 aa, Mycobacterium
QLARAHLLYGEWLRRMNRRNDARH

SEQ ID NO: 775039 - protein, 18 aa, Mycobacterium
QLARFLVMGAMNWTAEWW

SEQ ID NO: 775040 - protein, 18 aa, Mycobacterium
QLARWLAPRGLVFNEDKT

SEQ ID NO: 775041 - protein, 18 aa, Mycobacterium
QLAWVFGVAAGWTDARAA

SEQ ID NO: 775042 - protein, 19 aa, Mycobacterium
QLCAVAFLLTGRETGRLAA

SEQ ID NO: 775043 - protein, 20 aa, Mycobacterium
QLDGIQSWLGLQGIDLTTPS

SEQ ID NO: 775044 - protein, 19 aa, Mycobacterium
QLDRFAIRLELKYLSESEE

SEQ ID NO: 775045 - protein, 19 aa, Mycobacterium
QLDRFAIRLELRYLSEQDE

SEQ ID NO: 775046 - protein, 18 aa, Mycobacterium
QLDRFAVRLQLGYLAEDL

SEQ ID NO: 775047 - protein, 22 aa, Mycobacterium
QLDTGPNFLGWTRVSAPTATTV

SEQ ID NO: 775048 - protein, 17 aa, Mycobacterium
QLELKWRGLREQLEEQG

SEQ ID NO: 775049 - protein, 26 aa, Mycobacterium
QLFAAGWSACFLSAMGVTAPKHNVKL

SEQ ID NO: 775050 - protein, 17 aa, Mycobacterium
QLFDWYDMDAGMDLNTL

SEQ ID NO: 775051 - protein, 18 aa, Mycobacterium
QLFGWIAFEFGVYRYGLQ

SEQ ID NO: 775052 - protein, 19 aa, Mycobacterium
QLFGWRIDFLDGMPVPYWV

SEQ ID NO: 775053 - protein, 20 aa, Mycobacterium
QLFRRPGLRIGHHHQPPAVQ

SEQ ID NO: 775054 - protein, 24 aa, Mycobacterium
QLFSALELLHAWALIHDDVIDASS

SEQ ID NO: 775055 - protein, 21 aa, Mycobacterium
QLGVARWCFDTTLAYTKERKQ

SEQ ID NO: 775056 - protein, 18 aa, Mycobacterium
QLHVPLSPVVRGRDAARA

SEQ ID NO: 775057 - protein, 17 aa, Mycobacterium
QLIEIGQLFAYRLSRCS

SEQ ID NO: 775058 - protein, 22 aa, Mycobacterium
QLKMSFKAGALIGRGSGEAMQV

SEQ ID NO: 775059 - protein, 19 aa, Mycobacterium
QLLGEHGWHSALFGMQHET

SEQ ID NO: 775060 - protein, 20 aa, Mycobacterium
QLLKCGWRPGDSVILAAAGT

SEQ ID NO: 775061 - protein, 22 aa, Mycobacterium
QLLPAFKKAWSAGGGAYDTLIN

SEQ ID NO: 775062 - protein, 21 aa, Mycobacterium
QLLPIVLPIVLAYIGNQLGSG

SEQ ID NO: 775063 - protein, 17 aa, Mycobacterium
QLLPWALQGVELGADTL

SEQ ID NO: 775064 - protein, 25 aa, Mycobacterium
QLLRSCGRPYPWVQIRVVDPTGRDV

SEQ ID NO: 775065 - protein, 24 aa, Mycobacterium
QLLSARAAVFYEQFVQALSTASGA

SEQ ID NO: 775066 - protein, 18 aa, Mycobacterium
QLNHEFHRAINIAADSPK

SEQ ID NO: 775067 - protein, 19 aa, Mycobacterium
QLPAFTWSHCVSDPSSTSA

SEQ ID NO: 775068 - protein, 24 aa, Mycobacterium
QLPAKLRYAGPFFRYERPQAGRYR

SEQ ID NO: 775069 - protein, 17 aa, Mycobacterium
QLPDAGWFAEHRLARDF

SEQ ID NO: 775070 - protein, 22 aa, Mycobacterium
QLPSFTWDYCVSDPASSAPNRG

SEQ ID NO: 775071 - protein, 28 aa, Mycobacterium
QLPTGITRLRFRLRWRGFRVTVEADHDT

SEQ ID NO: 775072 - protein, 17 aa, Mycobacterium
QLPVGGCSLHLAPVAFA

SEQ ID NO: 775073 - protein, 24 aa, Mycobacterium
QLRLGEYDVLIGINLLREGLDLPE

SEQ ID NO: 775074 - protein, 23 aa, Mycobacterium
QLRREFSEWLGTHFTLDPVRASD

SEQ ID NO: 775075 - protein, 18 aa, Mycobacterium
QLRRMGVGASRRFSTTTR

SEQ ID NO: 775076 - protein, 23 aa, Mycobacterium
QLSPELVKGMAWGLAPYTAAIGG

SEQ ID NO: 775077 - protein, 17 aa, Mycobacterium
QLTLPFGAPKTMLNVKI

SEQ ID NO: 775078 - protein, 18 aa, Mycobacterium
QLTLPFGAPRTMFNVKIG

SEQ ID NO: 775079 - protein, 17 aa, Mycobacterium
QLTLPFQAPRSMFNVRI

SEQ ID NO: 775080 - protein, 21 aa, Mycobacterium
QLTLTELWRSYGIQPDLVIGH

SEQ ID NO: 775081 - protein, 23 aa, Mycobacterium
QLTLTELWRSYGIQPDLVIGHSM

SEQ ID NO: 775082 - protein, 18 aa, Mycobacterium
QLTPHFRPGCKRMLMTSD

SEQ ID NO: 775083 - protein, 17 aa, Mycobacterium
QLTRAGLLPGDRVALRS

SEQ ID NO: 775084 - protein, 23 aa, Mycobacterium
QLTRKRLGTGLIEAFSSSCPQCS

SEQ ID NO: 775085 - protein, 24 aa, Mycobacterium
QLTRKRLGTGLIEAFSTSCTHCGG

SEQ ID NO: 775086 - protein, 24 aa, Mycobacterium
QLTRKRLGTGLIEAFSTTCTHCSG

SEQ ID NO: 775087 - protein, 18 aa, Mycobacterium
QLVTRYLATYAFYRGAFS

SEQ ID NO: 775088 - protein, 21 aa, Mycobacterium
QLWMCGLPGYGPGDLIDLSFS

SEQ ID NO: 775089 - protein, 17 aa, Mycobacterium
QLWRARHGVYAFTDESA

SEQ ID NO: 775090 - protein, 18 aa, Mycobacterium
QLWRYKHAVPFDVSLCCG

SEQ ID NO: 775091 - protein, 21 aa, Mycobacterium
QLYLHFKIVWPAFGKQFVIRA

SEQ ID NO: 775092 - protein, 25 aa, Mycobacterium
QLYRDWKLLTAWAVRLLRATYGQRP

SEQ ID NO: 775093 - protein, 22 aa, Mycobacterium
QMAAELAAVWARVRDDEDIRAA

SEQ ID NO: 775094 - protein, 23 aa, Mycobacterium
QMANAAKPYLVWMRASAAQAEQA

SEQ ID NO: 775095 - protein, 22 aa, Mycobacterium
QMFAKRPKFEFKHLITDDDVAC

SEQ ID NO: 775096 - protein, 23 aa, Mycobacterium
QMGADGWLALGWPKEFGGQDRSV

SEQ ID NO: 775097 - protein, 23 aa, Mycobacterium
QMGCGRTGAFFSFEEAGIVPDIV

SEQ ID NO: 775098 - protein, 23 aa, Mycobacterium
QMGCGRTGPFFSFEAAGIVPDIV

SEQ ID NO: 775099 - protein, 23 aa, Mycobacterium
QMGCGRTGSFFSFEEAGIKPDIV

SEQ ID NO: 775100 - protein, 20 aa, Mycobacterium
QMGKDGWLTLSWPEEFGGQA

SEQ ID NO: 775101 - protein, 24 aa, Mycobacterium
QMGKDGWLTLSWPKEFGGQARPPM

SEQ ID NO: 775102 - protein, 22 aa, Mycobacterium
QMLTGRPLIGNGANGVDGTGAA

SEQ ID NO: 775103 - protein, 24 aa, Mycobacterium
QMLVKLCLKDGIPLINIVRKPEQE

SEQ ID NO: 775104 - protein, 22 aa, Mycobacterium
QMRRFGGIVSFELADADAVHAL

SEQ ID NO: 775105 - protein, 19 aa, Mycobacterium
QMSALLMAIFWRGMDSGET

SEQ ID NO: 775106 - protein, 20 aa, Mycobacterium
QMSECYRVQLTYAVPGGPSL

SEQ ID NO: 775107 - protein, 17 aa, Mycobacterium
QMTRLAPIWSRLAVGGV

SEQ ID NO: 775108 - protein, 27 aa, Mycobacterium
QMVSTRAAHLHAEFVHSLTRAGAAYAA

SEQ ID NO: 775109 - protein, 18 aa, Mycobacterium
QNAIVRWMQRESFAELRE

SEQ ID NO: 775110 - protein, 18 aa, Mycobacterium
QNCRIRWGTVVEVEGEHV

SEQ ID NO: 775111 - protein, 20 aa, Mycobacterium
QNFWPVYGSMSFDESTVAGL

SEQ ID NO: 775112 - protein, 22 aa, Mycobacterium
QNGGDGGLLWGNGGNGGTGAAG

SEQ ID NO: 775113 - protein, 17 aa, Mycobacterium
QNIGIMIAVAQLAATQR

SEQ ID NO: 775114 - protein, 23 aa, Mycobacterium
QNPRPQWPASAALFVGRDGARIT

SEQ ID NO: 775115 - protein, 23 aa, Mycobacterium
QNRVRRYVCLKGPDHGGCGRLTV

SEQ ID NO: 775116 - protein, 18 aa, Mycobacterium
QNVARWLVLYLRRPGGQT

SEQ ID NO: 775117 - protein, 18 aa, Mycobacterium
QNVRLPWTLKDGQDGADA

SEQ ID NO: 775118 - protein, 19 aa, Mycobacterium
QNYYPRNAVAFAPMIFLGR

SEQ ID NO: 775119 - protein, 17 aa, Mycobacterium
QPCPVCGQGTLDHDWAL

SEQ ID NO: 775120 - protein, 17 aa, Mycobacterium
QPDIWRGFAEELGILGA

SEQ ID NO: 775121 - protein, 22 aa, Mycobacterium
QPDKFWAGFCERVGLAELATDE

SEQ ID NO: 775122 - protein, 21 aa, Mycobacterium
QPDLRVLVDLGYSDWGSGQDY

SEQ ID NO: 775123 - protein, 20 aa, Mycobacterium
QPDLRVLVDLGYSDYGPGLS

SEQ ID NO: 775124 - protein, 20 aa, Mycobacterium
QPDLRVLVDLGYTDWGSGQD

SEQ ID NO: 775125 - protein, 18 aa, Mycobacterium
QPDQRWNAVWSFHVQPHW

SEQ ID NO: 775126 - protein, 18 aa, Mycobacterium
QPETLHAIMWLMSDRALP

SEQ ID NO: 775127 - protein, 23 aa, Mycobacterium
QPFDAVVCSLVLCSVDDPEQVVG

SEQ ID NO: 775128 - protein, 17 aa, Mycobacterium
QPFFGFISACVEQALAF

SEQ ID NO: 775129 - protein, 20 aa, Mycobacterium
QPGIGAAIWLHATDVQAIHD

SEQ ID NO: 775130 - protein, 17 aa, Mycobacterium
QPGPGRRLGVLVDHLVK

SEQ ID NO: 775131 - protein, 24 aa, Mycobacterium
QPHAKGGGAFGHFEVTNDVSRYTR

SEQ ID NO: 775132 - protein, 32 aa, Mycobacterium
QPIACPDCGPSLWFRSAAGWVRGSDAALAATQ

SEQ ID NO: 775133 - protein, 24 aa, Mycobacterium
QPIACPDCGPSLWFRSSDGRVDGA

SEQ ID NO: 775134 - protein, 25 aa, Mycobacterium
QPIACPNCGPSLWFRSATEHVAGAD

SEQ ID NO: 775135 - protein, 19 aa, Mycobacterium
QPIEWRYTNDPAWVMREKG

SEQ ID NO: 775136 - protein, 17 aa, Mycobacterium
QPILRRLGLEQTVRPSF

SEQ ID NO: 775137 - protein, 18 aa, Mycobacterium
QPIRTVVPYADFGTALTL

SEQ ID NO: 775138 - protein, 23 aa, Mycobacterium
QPIWWLVRALEFGQDFQTFIKEL

SEQ ID NO: 775139 - protein, 18 aa, Mycobacterium
QPLPDVWHDIGFITVNRR

SEQ ID NO: 775140 - protein, 20 aa, Mycobacterium
QPLYRYAIYQTRTDEFYLYA

SEQ ID NO: 775141 - protein, 25 aa, Mycobacterium
QPMRTGIRFIGKWAMGEYPYHDLYM

SEQ ID NO: 775142 - protein, 19 aa, Mycobacterium
QPPGPRFTTTVAMPEVPRA

SEQ ID NO: 775143 - protein, 24 aa, Mycobacterium
QPPSGGWRLLVYRATFGLVNPGPS

SEQ ID NO: 775144 - protein, 19 aa, Mycobacterium
QPRWPTFGIRLSARPGIPP

SEQ ID NO: 775145 - protein, 17 aa, Mycobacterium
QPVDCRFCHVTVTVKQL

SEQ ID NO: 775146 - protein, 17 aa, Mycobacterium
QPVDCRFCHVTVTVKRH

SEQ ID NO: 775147 - protein, 18 aa, Mycobacterium
QPVFARRHLNAFAPEIVA

SEQ ID NO: 775148 - protein, 18 aa, Mycobacterium
QPVGFPGIVPVIGGASLP

SEQ ID NO: 775149 - protein, 21 aa, Mycobacterium
QPVPPFKWWRGLRARTLLEEY

SEQ ID NO: 775150 - protein, 17 aa, Mycobacterium
QPWSLRYPLVDGQGNFG

SEQ ID NO: 775151 - protein, 18 aa, Mycobacterium
QQALAFRLATSWMFGYVD

SEQ ID NO: 775152 - protein, 18 aa, Mycobacterium
QQALHAFRKFGFQLVIVA

SEQ ID NO: 775153 - protein, 18 aa, Mycobacterium
QQDWLAASPLCFVATTDA

SEQ ID NO: 775154 - protein, 18 aa, Mycobacterium
QQEFPRTAILVLSAHIDA

SEQ ID NO: 775155 - protein, 21 aa, Mycobacterium
QQEVMIWFNHQGPIQPVGSVV

SEQ ID NO: 775156 - protein, 19 aa, Mycobacterium
QQLTLPFGAPRTMLNVKIG

SEQ ID NO: 775157 - protein, 19 aa, Mycobacterium
QQPLWRVLVALSIRHVGPT

SEQ ID NO: 775158 - protein, 20 aa, Mycobacterium
QQQLLCLARALAVNPDVLLL

SEQ ID NO: 775159 - protein, 23 aa, Mycobacterium
QQRAEWGWRLVAAASTLPTPALR

SEQ ID NO: 775160 - protein, 17 aa, Mycobacterium
QQRCWLRQLTPYANRQQ

SEQ ID NO: 775161 - protein, 22 aa, Mycobacterium
QQRIKVALVFGGRSSEHAISCV

SEQ ID NO: 775162 - protein, 20 aa, Mycobacterium
QQRPCGVFGFGDRGFDPVSL

SEQ ID NO: 775163 - protein, 21 aa, Mycobacterium
QQRVARWWIPDDIVIVDELPK

SEQ ID NO: 775164 - protein, 19 aa, Mycobacterium
QQRVTGLVARGEMLDDSLA

SEQ ID NO: 775165 - protein, 23 aa, Mycobacterium
QQRWLEWQKLFLSIIPFPEISAA

SEQ ID NO: 775166 - protein, 22 aa, Mycobacterium
QQTDWRAAIAYARSLDNVDTTR

SEQ ID NO: 775167 - protein, 21 aa, Mycobacterium
QQVCDEWARRGWLAVRYNLPY

SEQ ID NO: 775168 - protein, 21 aa, Mycobacterium
QQVWMPYHWGYTGLVEGDVVN

SEQ ID NO: 775169 - protein, 18 aa, Mycobacterium
QQWLTLWRNTIGYSPPTA

SEQ ID NO: 775170 - protein, 18 aa, Mycobacterium
QQYCHLGGIVAPNQRSDN

SEQ ID NO: 775171 - protein, 20 aa, Mycobacterium
QRAAAVLSFYRYHAHAHNLD

SEQ ID NO: 775172 - protein, 20 aa, Mycobacterium
QRAAGGLGLLIAHPFYVNPF

SEQ ID NO: 775173 - protein, 18 aa, Mycobacterium
QRAFEVLDKLALIDISNN

SEQ ID NO: 775174 - protein, 20 aa, Mycobacterium
QRAIKEAFDPAGLLNPGVML

SEQ ID NO: 775175 - protein, 22 aa, Mycobacterium
QRARAAWLWSGRAGVPAGLSAS

SEQ ID NO: 775176 - protein, 23 aa, Mycobacterium
QRARECLRLLGVATEVLRGRQRT

SEQ ID NO: 775177 - protein, 18 aa, Mycobacterium
QRAREIDTIYGLVAETMK

SEQ ID NO: 775178 - protein, 19 aa, Mycobacterium
QRASNFLLWQAAYAEYVFQ

SEQ ID NO: 775179 - protein, 17 aa, Mycobacterium
QRAVLVLREVLQWKAQE

SEQ ID NO: 775180 - protein, 20 aa, Mycobacterium
QRAYSAWLWTGRRGVIAGLA

SEQ ID NO: 775181 - protein, 19 aa, Mycobacterium
QRCLEWFATIPLWLDLGEL

SEQ ID NO: 775182 - protein, 18 aa, Mycobacterium
QRCPIAWTDTYGGHWVAA

SEQ ID NO: 775183 - protein, 18 aa, Mycobacterium
QRDNCKLIDWPIATLSPV

SEQ ID NO: 775184 - protein, 20 aa, Mycobacterium
QRDWDFAKEFGLPIIEVVTG

SEQ ID NO: 775185 - protein, 19 aa, Mycobacterium
QREEIRWDLANQPGTVLQV

SEQ ID NO: 775186 - protein, 22 aa, Mycobacterium
QRELDRYLPFLATTKVLIAAVR

SEQ ID NO: 775187 - protein, 17 aa, Mycobacterium
QRFEPWYTPQRIECTMM

SEQ ID NO: 775188 - protein, 19 aa, Mycobacterium
QRFGEHFFYILYFQQPGVA

SEQ ID NO: 775189 - protein, 17 aa, Mycobacterium
QRFGVPMGFGGPHAGYL

SEQ ID NO: 775190 - protein, 20 aa, Mycobacterium
QRFGVPMGFGGPHAGYLSVH

SEQ ID NO: 775191 - protein, 17 aa, Mycobacterium
QRFVELLPQLAILDAGG

SEQ ID NO: 775192 - protein, 21 aa, Mycobacterium
QRFYLKHGFTRSGTKTFLVGE

SEQ ID NO: 775193 - protein, 17 aa, Mycobacterium
QRGEIHWCQLFSEPGAG

SEQ ID NO: 775194 - protein, 17 aa, Mycobacterium
QRGLWFEEFEIGTTYLH

SEQ ID NO: 775195 - protein, 19 aa, Mycobacterium
QRGWPVFLVSTVTRENLQP

SEQ ID NO: 775196 - protein, 20 aa, Mycobacterium
QRIAAAWLWSRGSAVIAGAA

SEQ ID NO: 775197 - protein, 20 aa, Mycobacterium
QRIDPVLARSWLLVNGAHYE

SEQ ID NO: 775198 - protein, 20 aa, Mycobacterium
QRIEPLLARSAAWATGESSA

SEQ ID NO: 775199 - protein, 20 aa, Mycobacterium
QRIFGRLGLDYVIVAATSGA

SEQ ID NO: 775200 - protein, 23 aa, Mycobacterium
QRIKSLAIPPAWNEVWISPHING

SEQ ID NO: 775201 - protein, 24 aa, Mycobacterium
QRILRQCSVCLYAGSIMPDDLLAE

SEQ ID NO: 775202 - protein, 22 aa, Mycobacterium
QRIPRKWLDSGVIVMADTLEEL

SEQ ID NO: 775203 - protein, 19 aa, Mycobacterium
QRIPRKWLESGVIISADTL

SEQ ID NO: 775204 - protein, 19 aa, Mycobacterium
QRIPRKWLESGVIITADTL

SEQ ID NO: 775205 - protein, 21 aa, Mycobacterium
QRISERWQRFGFNLNAADLFY

SEQ ID NO: 775206 - protein, 17 aa, Mycobacterium
QRLALGPMHHGRADVIG

SEQ ID NO: 775207 - protein, 18 aa, Mycobacterium
QRLASAWQRLTAVTGTSE

SEQ ID NO: 775208 - protein, 21 aa, Mycobacterium
QRLEALPGWPTGPLSPVHISA

SEQ ID NO: 775209 - protein, 18 aa, Mycobacterium
QRLERVLPRRPDFVFASE

SEQ ID NO: 775210 - protein, 19 aa, Mycobacterium
QRLGEVGRAFVVPRPGANL

SEQ ID NO: 775211 - protein, 20 aa, Mycobacterium
QRLGLEWLHRLALEPRRLAR

SEQ ID NO: 775212 - protein, 17 aa, Mycobacterium
QRLGLPVFVKPARGGSS

SEQ ID NO: 775213 - protein, 18 aa, Mycobacterium
QRLGRPVFGPSFEVDIDS

SEQ ID NO: 775214 - protein, 18 aa, Mycobacterium
QRLGRPVFGPTFEVDIDS

SEQ ID NO: 775215 - protein, 21 aa, Mycobacterium
QRLLFDNGWLLPAQPPEFGGR

SEQ ID NO: 775216 - protein, 21 aa, Mycobacterium
QRLLPLVLPIVLAYLGNQLRP

SEQ ID NO: 775217 - protein, 21 aa, Mycobacterium
QRLNSVLPLWLQYGGSPTQAA

SEQ ID NO: 775218 - protein, 23 aa, Mycobacterium
QRLPILCGLDLTRKVAMTPEHLA

SEQ ID NO: 775219 - protein, 23 aa, Mycobacterium
QRLPILCGLDLTRKVAMTPQHLA

SEQ ID NO: 775220 - protein, 21 aa, Mycobacterium
QRLRAAVMAFFDFVEHDSQGY

SEQ ID NO: 775221 - protein, 17 aa, Mycobacterium
QRLRMAVAYGSAAAALP

SEQ ID NO: 775222 - protein, 17 aa, Mycobacterium
QRLRSGWLNGIKHWQVD

SEQ ID NO: 775223 - protein, 20 aa, Mycobacterium
QRLSERWRRMGLDLDMAELI

SEQ ID NO: 775224 - protein, 19 aa, Mycobacterium
QRLSEVWRMLDPEERTASL

SEQ ID NO: 775225 - protein, 19 aa, Mycobacterium
QRMWQALGFWELVIDTADS

SEQ ID NO: 775226 - protein, 25 aa, Mycobacterium
QRNPEKVWAWYLWRHYMMARVAPNE

SEQ ID NO: 775227 - protein, 17 aa, Mycobacterium
QRPADDVYLVFTTNEEI

SEQ ID NO: 775228 - protein, 19 aa, Mycobacterium
QRPALWFDVMDRVRATHTA

SEQ ID NO: 775229 - protein, 21 aa, Mycobacterium
QRPCPECGFDPSSVHHTEVAG

SEQ ID NO: 775230 - protein, 20 aa, Mycobacterium
QRPELFLGVFERRAQRGPAG

SEQ ID NO: 775231 - protein, 17 aa, Mycobacterium
QRPEVMEVLLGQAVRAD

SEQ ID NO: 775232 - protein, 20 aa, Mycobacterium
QRPRFVAALLDYFNARFDPM

SEQ ID NO: 775233 - protein, 17 aa, Mycobacterium
QRPRITALIAERISTRT

SEQ ID NO: 775234 - protein, 17 aa, Mycobacterium
QRPRTRFTVGIDDDVSG

SEQ ID NO: 775235 - protein, 23 aa, Mycobacterium
QRQAIREFIYWQHVGQLTADALS

SEQ ID NO: 775236 - protein, 19 aa, Mycobacterium
QRQAMCLDVTPGQTSVEVC

SEQ ID NO: 775237 - protein, 19 aa, Mycobacterium
QRRCRRRSITPTWEVRHGQ

SEQ ID NO: 775238 - protein, 21 aa, Mycobacterium
QRRFAAAYGHRGRIVGAVTFN

SEQ ID NO: 775239 - protein, 21 aa, Mycobacterium
QRRFLASEGWIAWSGPAISEL

SEQ ID NO: 775240 - protein, 19 aa, Mycobacterium
QRRLAPRGKTIAVAAHPGT

SEQ ID NO: 775241 - protein, 17 aa, Mycobacterium
QRRLWWSRFDELAPTAV

SEQ ID NO: 775242 - protein, 19 aa, Mycobacterium
QRRRFWPKASSIAVDGGTA

SEQ ID NO: 775243 - protein, 18 aa, Mycobacterium
QRRRFWPKTSGIAVDGGA

SEQ ID NO: 775244 - protein, 19 aa, Mycobacterium
QRRWAAMGIERGWQATMVL

SEQ ID NO: 775245 - protein, 18 aa, Mycobacterium
QRSDLLIALGTRFDDRVT

SEQ ID NO: 775246 - protein, 19 aa, Mycobacterium
QRSGVVFFIAFSPRRGIPT

SEQ ID NO: 775247 - protein, 19 aa, Mycobacterium
QRSQVGFVFQNFNLFPHLT

SEQ ID NO: 775248 - protein, 22 aa, Mycobacterium
QRTWPELIPLLASGRLDVDGIF

SEQ ID NO: 775249 - protein, 17 aa, Mycobacterium
QRVAMRVAWKALENTGL

SEQ ID NO: 775250 - protein, 18 aa, Mycobacterium
QRVCALLAGGGYAEYVAV

SEQ ID NO: 775251 - protein, 20 aa, Mycobacterium
QRVKAGAALRAMRDRGETLR

SEQ ID NO: 775252 - protein, 19 aa, Mycobacterium
QRVTTHWAFAERLASEFPA

SEQ ID NO: 775253 - protein, 19 aa, Mycobacterium
QRVVLVFLPRCGHCPSCAT

SEQ ID NO: 775254 - protein, 20 aa, Mycobacterium
QRVVLVFLPRCGHCVACATQ

SEQ ID NO: 775255 - protein, 17 aa, Mycobacterium
QRWAAEVSRAVWCPIEV

SEQ ID NO: 775256 - protein, 17 aa, Mycobacterium
QRWAHRIAEAFPDVDGI

SEQ ID NO: 775257 - protein, 17 aa, Mycobacterium
QRWARGAGGLLLITHDR

SEQ ID NO: 775258 - protein, 22 aa, Mycobacterium
QRWNAVWSFHVQPHWEDRVRLL

SEQ ID NO: 775259 - protein, 22 aa, Mycobacterium
QRWPETRIEPSLTRISALLDLL

SEQ ID NO: 775260 - protein, 22 aa, Mycobacterium
QRWPETRIEPSLTRISALMDLL

SEQ ID NO: 775261 - protein, 31 aa, Mycobacterium
QRWTRPAGFGRFSWDWEHCLGDTPRWGRWQD

SEQ ID NO: 775262 - protein, 20 aa, Mycobacterium
QRYAAIYGYDERAMAKIVVD

SEQ ID NO: 775263 - protein, 17 aa, Mycobacterium
QRYLKPRGLFLANTSHG

SEQ ID NO: 775264 - protein, 23 aa, Mycobacterium
QRYPRYRWDIALRRDYQRAAFEA

SEQ ID NO: 775265 - protein, 18 aa, Mycobacterium
QRYWGEPFPIVYDADGRA

SEQ ID NO: 775266 - protein, 19 aa, Mycobacterium
QRYWGEPFPIVYDADGRAH

SEQ ID NO: 775267 - protein, 18 aa, Mycobacterium
QRYWGEPFPIVYDADGRP

SEQ ID NO: 775268 - protein, 18 aa, Mycobacterium
QRYWGEPFPIVYDSDGRA

SEQ ID NO: 775269 - protein, 18 aa, Mycobacterium
QSALARWPYPNPRQRSAV

SEQ ID NO: 775270 - protein, 23 aa, Mycobacterium
QSAMVRPALVAANRSDLVSLVLS

SEQ ID NO: 775271 - protein, 30 aa, Mycobacterium
QSDWARRNPQRWSVVDAWVSLGMRLGARSY

SEQ ID NO: 775272 - protein, 22 aa, Mycobacterium
QSEHLFCVPATIDLAGAEIELV

SEQ ID NO: 775273 - protein, 22 aa, Mycobacterium
QSFEWIDCPGFDLAHHVRWVAI

SEQ ID NO: 775274 - protein, 18 aa, Mycobacterium
QSFRPAPAGADWPAEAVW

SEQ ID NO: 775275 - protein, 21 aa, Mycobacterium
QSGSIGLGFAIPVDQAKRIAD

SEQ ID NO: 775276 - protein, 23 aa, Mycobacterium
QSHPRIDCVWEFREPLEPRNNAG

SEQ ID NO: 775277 - protein, 17 aa, Mycobacterium
QSLRLAVMTALQELPAR

SEQ ID NO: 775278 - protein, 23 aa, Mycobacterium
QSLRPVIFSTFLMWLLADLFAVL

SEQ ID NO: 775279 - protein, 24 aa, Mycobacterium
QSLRPVLFSTFLMWVLADLFTFLP

SEQ ID NO: 775280 - protein, 23 aa, Mycobacterium
QSLRPVLFSTFLMWVLADLFTYL

SEQ ID NO: 775281 - protein, 20 aa, Mycobacterium
QSMIDWWGPILYEYYSSTEG

SEQ ID NO: 775282 - protein, 24 aa, Mycobacterium
QSPKESWLRLVLIDAGLPRPTTQI

SEQ ID NO: 775283 - protein, 24 aa, Mycobacterium
QSPKESWLRLVLIQAGLPRPQTQI

SEQ ID NO: 775284 - protein, 23 aa, Mycobacterium
QSPKETWLRLLIVRDGLPKPTTQ

SEQ ID NO: 775285 - protein, 24 aa, Mycobacterium
QSPKETWLRLLLIDAGFPRPQTQI

SEQ ID NO: 775286 - protein, 22 aa, Mycobacterium
QSPKETWLRLLLRDAGLPPVST

SEQ ID NO: 775287 - protein, 24 aa, Mycobacterium
QSPKETWLRLVLVQGGLPRPQTQI

SEQ ID NO: 775288 - protein, 17 aa, Mycobacterium
QSQVVAWWAPSFDEPNG

SEQ ID NO: 775289 - protein, 18 aa, Mycobacterium
QSQVVAWWAPSRDELNGG

SEQ ID NO: 775290 - protein, 17 aa, Mycobacterium
QSQVVAWWSPAFDEPNG

SEQ ID NO: 775291 - protein, 17 aa, Mycobacterium
QSQVVAWWSPAYDEPNG

SEQ ID NO: 775292 - protein, 19 aa, Mycobacterium
QSSEWKDGEALFLRCNIWR

SEQ ID NO: 775293 - protein, 18 aa, Mycobacterium
QSVDGIGAMWARHVREGL

SEQ ID NO: 775294 - protein, 20 aa, Mycobacterium
QSVEGIGAMWARHIREGLSR

SEQ ID NO: 775295 - protein, 22 aa, Mycobacterium
QSVEGIGAMWARHVREGLSQLA

SEQ ID NO: 775296 - protein, 17 aa, Mycobacterium
QSVPGWSWGPVRPGTWR

SEQ ID NO: 775297 - protein, 18 aa, Mycobacterium
QSWPFPIVPIVLIVAHPR

SEQ ID NO: 775298 - protein, 20 aa, Mycobacterium
QSYLAALMPMVWTACERDDF

SEQ ID NO: 775299 - protein, 18 aa, Mycobacterium
QTATLIWYYALLLWGVNA

SEQ ID NO: 775300 - protein, 17 aa, Mycobacterium
QTCPVCLYAGSIMPDDL

SEQ ID NO: 775301 - protein, 24 aa, Mycobacterium
QTDDILLELGFDWDRIIELKTAGA

SEQ ID NO: 775302 - protein, 24 aa, Mycobacterium
QTDEILLELGLDWDRIIELKTAGA

SEQ ID NO: 775303 - protein, 18 aa, Mycobacterium
QTGFARTGALFACEHENV

SEQ ID NO: 775304 - protein, 18 aa, Mycobacterium
QTGFARTGAMFACDHENV

SEQ ID NO: 775305 - protein, 18 aa, Mycobacterium
QTGFARTGAMFACEHEGI

SEQ ID NO: 775306 - protein, 19 aa, Mycobacterium
QTGFARTGAMFACEHEGTD

SEQ ID NO: 775307 - protein, 17 aa, Mycobacterium
QTGGYIHGASGGSGGAS

SEQ ID NO: 775308 - protein, 19 aa, Mycobacterium
QTGIARTGAWFACEHEDLV

SEQ ID NO: 775309 - protein, 18 aa, Mycobacterium
QTGIGRTGTFFAHQQAGI

SEQ ID NO: 775310 - protein, 22 aa, Mycobacterium
QTGRHPLAWGMRVLDVVGPTAV

SEQ ID NO: 775311 - protein, 20 aa, Mycobacterium
QTGSLLGFHWTKIHDASLGE

SEQ ID NO: 775312 - protein, 18 aa, Mycobacterium
QTITCSFLMVCTGYYRYD

SEQ ID NO: 775313 - protein, 20 aa, Mycobacterium
QTLCSTWDLTDWRGKAIRIG

SEQ ID NO: 775314 - protein, 17 aa, Mycobacterium
QTLDWLSANGMTRLLQR

SEQ ID NO: 775315 - protein, 24 aa, Mycobacterium
QTLGFPVALGLELVGPAFSTAAAA

SEQ ID NO: 775316 - protein, 24 aa, Mycobacterium
QTLIDLNVRWRKGQTLDPDWKIEQ

SEQ ID NO: 775317 - protein, 20 aa, Mycobacterium
QTLKDTVHWDDWARNPAEAY

SEQ ID NO: 775318 - protein, 17 aa, Mycobacterium
QTLLARWSAAAAILQQG

SEQ ID NO: 775319 - protein, 21 aa, Mycobacterium
QTLPLRPFRTMAINIDGSLPT

SEQ ID NO: 775320 - protein, 17 aa, Mycobacterium
QTLRASVDWSHALLTEP

SEQ ID NO: 775321 - protein, 19 aa, Mycobacterium
QTLRCCIDWSYQRCSTAEQ

SEQ ID NO: 775322 - protein, 21 aa, Mycobacterium
QTLRHAVAWSYDHLSDAEKVL

SEQ ID NO: 775323 - protein, 21 aa, Mycobacterium
QTLWPERLFSILAGFVEAGES

SEQ ID NO: 775324 - protein, 17 aa, Mycobacterium
QTMFRKLFESVIAGHVK

SEQ ID NO: 775325 - protein, 18 aa, Mycobacterium
QTNEWKDGEALFLRCNIW

SEQ ID NO: 775326 - protein, 18 aa, Mycobacterium
QTPAEWERVLGVNLTGTW

SEQ ID NO: 775327 - protein, 25 aa, Mycobacterium
QTRLGRFVSTYGWRAYALPALVALT

SEQ ID NO: 775328 - protein, 19 aa, Mycobacterium
QTVARWLVLHLRRPGGQTQ

SEQ ID NO: 775329 - protein, 18 aa, Mycobacterium
QTVARWLVLYLRRPGGQT

SEQ ID NO: 775330 - protein, 17 aa, Mycobacterium
QTVLWARMLDRLAGASP

SEQ ID NO: 775331 - protein, 17 aa, Mycobacterium
QTVLWARMLDRLAGDTP

SEQ ID NO: 775332 - protein, 19 aa, Mycobacterium
QTWYAWRKVIPLLAGEFEV

SEQ ID NO: 775333 - protein, 17 aa, Mycobacterium
QVADLFSAFGMYPVGYY

SEQ ID NO: 775334 - protein, 24 aa, Mycobacterium
QVADLSAGIPVRLVCAGSAGSACA

SEQ ID NO: 775335 - protein, 17 aa, Mycobacterium
QVAEAFSRYGAHLSRLN

SEQ ID NO: 775336 - protein, 18 aa, Mycobacterium
QVAKRFGAAEVIAAGRNR

SEQ ID NO: 775337 - protein, 18 aa, Mycobacterium
QVAQRYAAIYGYDERAMA

SEQ ID NO: 775338 - protein, 18 aa, Mycobacterium
QVAQRYAYEYGYDERAMA

SEQ ID NO: 775339 - protein, 24 aa, Mycobacterium
QVARRLARRPAWIRAIDHRMDTHY

SEQ ID NO: 775340 - protein, 18 aa, Mycobacterium
QVCRYRPGRAMVILMLMR

SEQ ID NO: 775341 - protein, 21 aa, Mycobacterium
QVDAKILWLFKRAVPATYTRA

SEQ ID NO: 775342 - protein, 18 aa, Mycobacterium
QVGLPAFMMRAFCDLAER

SEQ ID NO: 775343 - protein, 23 aa, Mycobacterium
QVGYGRLGKWFWGFEQQGVVPDI

SEQ ID NO: 775344 - protein, 20 aa, Mycobacterium
QVIFAYPGVHAIWLHRINHW

SEQ ID NO: 775345 - protein, 22 aa, Mycobacterium
QVIGFREHASWALASDTLDFVD

SEQ ID NO: 775346 - protein, 25 aa, Mycobacterium
QVIRPEFRGGAGFADPVDVPEDAGA

SEQ ID NO: 775347 - protein, 24 aa, Mycobacterium
QVLAKCFLLWAGVLGAISLEVFGQ

SEQ ID NO: 775348 - protein, 17 aa, Mycobacterium
QVLPRLDGFGVVLGGGG

SEQ ID NO: 775349 - protein, 27 aa, Mycobacterium
QVLWTQNMLLPWAWRHLRGRSSGDGRT

SEQ ID NO: 775350 - protein, 19 aa, Mycobacterium
QVPEFRRKAVIIAVGGVYD

SEQ ID NO: 775351 - protein, 24 aa, Mycobacterium
QVPEGVTLLGRWWGMNGQGFAIVE

SEQ ID NO: 775352 - protein, 18 aa, Mycobacterium
QVPRIAVVKGRCFAGNAV

SEQ ID NO: 775353 - protein, 24 aa, Mycobacterium
QVQALSQFVAWPGLLVFQNKAKLL

SEQ ID NO: 775354 - protein, 20 aa, Mycobacterium
QVRFLPGWFKDTLCDAPIDR

SEQ ID NO: 775355 - protein, 18 aa, Mycobacterium
QVRKRFGIRWNLADETAY

SEQ ID NO: 775356 - protein, 23 aa, Mycobacterium
QVRRVCLDGGLLPDMPSGSALVV

SEQ ID NO: 775357 - protein, 17 aa, Mycobacterium
QVRVFEVHPLFARAHTF

SEQ ID NO: 775358 - protein, 23 aa, Mycobacterium
QVTELRGGLLVNWDARESAFPPG

SEQ ID NO: 775359 - protein, 23 aa, Mycobacterium
QVTELRGGLLVNWDVRESAFPAG

SEQ ID NO: 775360 - protein, 23 aa, Mycobacterium
QVTEVRGGLLLNWDVRESAFPHG

SEQ ID NO: 775361 - protein, 17 aa, Mycobacterium
QVVEHWGPPPGELFVDT

SEQ ID NO: 775362 - protein, 18 aa, Mycobacterium
QVVPESLSFCWTLVRDSE

SEQ ID NO: 775363 - protein, 18 aa, Mycobacterium
QVVSRPEPRLALVAMGRR

SEQ ID NO: 775364 - protein, 20 aa, Mycobacterium
QVWMPYHWGGAGLVDGDVVN

SEQ ID NO: 775365 - protein, 18 aa, Mycobacterium
QVWSRGTIALAFAAVLIG

SEQ ID NO: 775366 - protein, 24 aa, Mycobacterium
QWALPEGVPAHWAVYFGTDDTDAG

SEQ ID NO: 775367 - protein, 22 aa, Mycobacterium
QWATPPEFAWDYRVFGSGGTAP

SEQ ID NO: 775368 - protein, 18 aa, Mycobacterium
QWAVCVYCASGPTHPELL

SEQ ID NO: 775369 - protein, 20 aa, Mycobacterium
QWEVPLMLFVIATPEILTAA

SEQ ID NO: 775370 - protein, 17 aa, Mycobacterium
QWFPYFPVRVGAMTPAW

SEQ ID NO: 775371 - protein, 18 aa, Mycobacterium
QWGGLGLNLAQDVELAME

SEQ ID NO: 775372 - protein, 17 aa, Mycobacterium
QWHFDRWTVPPGATEIA

SEQ ID NO: 775373 - protein, 17 aa, Mycobacterium
QWHHDRWTLPPGATEIA

SEQ ID NO: 775374 - protein, 17 aa, Mycobacterium
QWIPGGFLPDGASEAVV

SEQ ID NO: 775375 - protein, 21 aa, Mycobacterium
QWLLIELRTDWTLGATTYTAG

SEQ ID NO: 775376 - protein, 22 aa, Mycobacterium
QWLPGARELRAWVLAAGSPEAD

SEQ ID NO: 775377 - protein, 23 aa, Mycobacterium
QWNEEIKGLWVLARYDDGRPSQL

SEQ ID NO: 775378 - protein, 23 aa, Mycobacterium
QWNEEVKGLWVLARYDDGRPSQL

SEQ ID NO: 775379 - protein, 17 aa, Mycobacterium
QWRARIGIVLQEVSDAG

SEQ ID NO: 775380 - protein, 21 aa, Mycobacterium
QWRELSTRFSVLASPTPGRPC

SEQ ID NO: 775381 - protein, 23 aa, Mycobacterium
QWRFARRRCRFITSGGLSDNPEG

SEQ ID NO: 775382 - protein, 17 aa, Mycobacterium
QWRKGQALEPDWPLDMG

SEQ ID NO: 775383 - protein, 19 aa, Mycobacterium
QWRQAGCSMCLGMNPDQLS

SEQ ID NO: 775384 - protein, 23 aa, Mycobacterium
QWSPQCRWTHQFGPLRRGARTLN

SEQ ID NO: 775385 - protein, 18 aa, Mycobacterium
QWTAQAFSDGWYRTGDVG

SEQ ID NO: 775386 - protein, 21 aa, Mycobacterium
QWYTARLSPMPLRPEERKTTV

SEQ ID NO: 775387 - protein, 23 aa, Mycobacterium
QYADGGCQLAFWRHDEHLVCEAR

SEQ ID NO: 775388 - protein, 26 aa, Mycobacterium
QYGFQCGFCLPGMLLAATDLLDRDPN

SEQ ID NO: 775389 - protein, 22 aa, Mycobacterium
QYKDVILGLVFLKFVSDARDGR

SEQ ID NO: 775390 - protein, 23 aa, Mycobacterium
QYLFPRLKAGGVYVVEDVCANYW

SEQ ID NO: 775391 - protein, 19 aa, Mycobacterium
QYLLEWRVAVAKDLMRSER

SEQ ID NO: 775392 - protein, 17 aa, Mycobacterium
QYMGVNWVGPIIMRHGT

SEQ ID NO: 775393 - protein, 17 aa, Mycobacterium
QYVCMRVLSKNPGWSNA

SEQ ID NO: 775394 - protein, 19 aa, Mycobacterium
QYWSEICAIPLSFITETVQ

SEQ ID NO: 775395 - protein, 18 aa, Mycobacterium
RAAAELVRYAVRRGPSAA

SEQ ID NO: 775396 - protein, 23 aa, Mycobacterium
RAAARVYAGWGFSQAFYWHQEYK

SEQ ID NO: 775397 - protein, 20 aa, Mycobacterium
RAAAVQCVRAGSAGSAGAAS

SEQ ID NO: 775398 - protein, 20 aa, Mycobacterium
RAADAVMRWGMQRGAGLGVR

SEQ ID NO: 775399 - protein, 17 aa, Mycobacterium
RAAEIAGDITVLVNNAG

SEQ ID NO: 775400 - protein, 17 aa, Mycobacterium
RAAELGLAVARELLDLG

SEQ ID NO: 775401 - protein, 18 aa, Mycobacterium
RAAELGWAGLLVPEDLGG

SEQ ID NO: 775402 - protein, 18 aa, Mycobacterium
RAAERPVLFVGLRVGDPA

SEQ ID NO: 775403 - protein, 23 aa, Mycobacterium
RAAEWRPSMDPTRRQRELDDWHR

SEQ ID NO: 775404 - protein, 17 aa, Mycobacterium
RAAFWDRDVPKPVQIVP

SEQ ID NO: 775405 - protein, 22 aa, Mycobacterium
RAAGLKAANTWHASRAIQEARE

SEQ ID NO: 775406 - protein, 22 aa, Mycobacterium
RAAGLKAANTWHASRAIQESRE

SEQ ID NO: 775407 - protein, 18 aa, Mycobacterium
RAAGLKAANTWHASTAIQ

SEQ ID NO: 775408 - protein, 19 aa, Mycobacterium
RAAGVGFSFGYPVDWRVQD

SEQ ID NO: 775409 - protein, 17 aa, Mycobacterium
RAAGVVFRPRDVFVEQT

SEQ ID NO: 775410 - protein, 18 aa, Mycobacterium
RAAHAFGLSATWLQMELG

SEQ ID NO: 775411 - protein, 27 aa, Mycobacterium
RAAHEALGLPYVWGGGGALGPTGGGFD

SEQ ID NO: 775412 - protein, 17 aa, Mycobacterium
RAAIGLGDGVVRISIGL

SEQ ID NO: 775413 - protein, 17 aa, Mycobacterium
RAAIGLGDGVVRISVGL

SEQ ID NO: 775414 - protein, 19 aa, Mycobacterium
RAAKARFAVYIGDLGADTA

SEQ ID NO: 775415 - protein, 23 aa, Mycobacterium
RAAKDWLCLLEAFDAPQRSGLVR

SEQ ID NO: 775416 - protein, 17 aa, Mycobacterium
RAALAWLDGVEQAVVVA

SEQ ID NO: 775417 - protein, 19 aa, Mycobacterium
RAALDLALFRAWYLHEELG

SEQ ID NO: 775418 - protein, 20 aa, Mycobacterium
RAALDLALFRSWRLHEDLGL

SEQ ID NO: 775419 - protein, 17 aa, Mycobacterium
RAALDLLRRRFTKVIWV

SEQ ID NO: 775420 - protein, 17 aa, Mycobacterium
RAALIARVFARMGFGPE

SEQ ID NO: 775421 - protein, 17 aa, Mycobacterium
RAALLDHRVDAVVARLP

SEQ ID NO: 775422 - protein, 19 aa, Mycobacterium
RAALPGWKGATPAERSAVL

SEQ ID NO: 775423 - protein, 17 aa, Mycobacterium
RAAMCVLGKLGIGTSEV

SEQ ID NO: 775424 - protein, 20 aa, Mycobacterium
RAAMRAFDWVSWRLNKKVED

SEQ ID NO: 775425 - protein, 17 aa, Mycobacterium
RAAMTVCETSIQVHGGI

SEQ ID NO: 775426 - protein, 21 aa, Mycobacterium
RAANLPAQWSTRGIDRAVESI

SEQ ID NO: 775427 - protein, 27 aa, Mycobacterium
RAAQELPWHPGRCAAILIGDTVVGHAG

SEQ ID NO: 775428 - protein, 18 aa, Mycobacterium
RAAQHAFMLQGMDEVDDE

SEQ ID NO: 775429 - protein, 19 aa, Mycobacterium
RAAQHLPWHPGRCAEVLVG

SEQ ID NO: 775430 - protein, 20 aa, Mycobacterium
RAAQIAKVYCARATRTVCET

SEQ ID NO: 775431 - protein, 17 aa, Mycobacterium
RAAQRGWAHRPVAERAA

SEQ ID NO: 775432 - protein, 19 aa, Mycobacterium
RAAQTAVDWSRACDGGGPG

SEQ ID NO: 775433 - protein, 17 aa, Mycobacterium
RAARCVANWQGARVEKG

SEQ ID NO: 775434 - protein, 17 aa, Mycobacterium
RAAREFGDTVSAVATSW

SEQ ID NO: 775435 - protein, 18 aa, Mycobacterium
RAAREVLSVLGLNPHLDR

SEQ ID NO: 775436 - protein, 22 aa, Mycobacterium
RAARFGDRVFLKFGDQQMTYGE

SEQ ID NO: 775437 - protein, 24 aa, Mycobacterium
RAARFGDRVFLRFGDQELTYRDAN

SEQ ID NO: 775438 - protein, 25 aa, Mycobacterium
RAARLEALPGWVWRRRDRTPGVYCG

SEQ ID NO: 775439 - protein, 17 aa, Mycobacterium
RAARLGVHVSLAPFQYY

SEQ ID NO: 775440 - protein, 23 aa, Mycobacterium
RAARYGDRIFLRFGDQQLTYRDA

SEQ ID NO: 775441 - protein, 17 aa, Mycobacterium
RAASSIKEKNDWSYEKW

SEQ ID NO: 775442 - protein, 21 aa, Mycobacterium
RAAWYRNRWVRTDSFIDPFPL

SEQ ID NO: 775443 - protein, 17 aa, Mycobacterium
RACAYDFLIPGRGVAVL

SEQ ID NO: 775444 - protein, 19 aa, Mycobacterium
RACGICGSDAFYITIGGIP

SEQ ID NO: 775445 - protein, 21 aa, Mycobacterium
RACGICGSDLHFAAHGAQVLE

SEQ ID NO: 775446 - protein, 21 aa, Mycobacterium
RACGICGSDLHFAAHGPEVLA

SEQ ID NO: 775447 - protein, 19 aa, Mycobacterium
RACGICGTDSFYISIGGLP

SEQ ID NO: 775448 - protein, 18 aa, Mycobacterium
RACISEMRYPEPTFDAPD

SEQ ID NO: 775449 - protein, 19 aa, Mycobacterium
RACKGSRSPTWRWRASHCR

SEQ ID NO: 775450 - protein, 18 aa, Mycobacterium
RACLAGWLGGLAPIPDFN

SEQ ID NO: 775451 - protein, 19 aa, Mycobacterium
RACLLGCGVTTGWGSAVNT

SEQ ID NO: 775452 - protein, 17 aa, Mycobacterium
RACPRLVGWREHVAAGK

SEQ ID NO: 775453 - protein, 21 aa, Mycobacterium
RACPVTWPWNLLGWPSINVPA

SEQ ID NO: 775454 - protein, 22 aa, Mycobacterium
RACTAAGFTPCFRVETHDYVTA

SEQ ID NO: 775455 - protein, 18 aa, Mycobacterium
RADALSALAGRRIHAKFR

SEQ ID NO: 775456 - protein, 22 aa, Mycobacterium
RADARLAMRLILQQHGALPAEP

SEQ ID NO: 775457 - protein, 17 aa, Mycobacterium
RADAVLILTEWQEFVDL

SEQ ID NO: 775458 - protein, 22 aa, Mycobacterium
RADAVLLLTEWQEFVDFDPDAL

SEQ ID NO: 775459 - protein, 19 aa, Mycobacterium
RADEILVRIEAAGVCHTDL

SEQ ID NO: 775460 - protein, 26 aa, Mycobacterium
RADFGWRVVDALGWPASRLDEAIEAA

SEQ ID NO: 775461 - protein, 18 aa, Mycobacterium
RADGALRRSIKFATFLDG

SEQ ID NO: 775462 - protein, 19 aa, Mycobacterium
RADGSCFEGLYAAGEVAGF

SEQ ID NO: 775463 - protein, 19 aa, Mycobacterium
RADLLPGIDGRTFVDIDSL

SEQ ID NO: 775464 - protein, 21 aa, Mycobacterium
RADPGEIVWTWVVYEDDPAQG

SEQ ID NO: 775465 - protein, 23 aa, Mycobacterium
RADPRLPEWRAMAARALAQRDEL

SEQ ID NO: 775466 - protein, 20 aa, Mycobacterium
RADTHLVMFDFSMAGVSPDN

SEQ ID NO: 775467 - protein, 25 aa, Mycobacterium
RADWLSVTRWANWLASVRYSGRTHP

SEQ ID NO: 775468 - protein, 24 aa, Mycobacterium
RAEAGNLWFEWSRSLDNPAEYVLV

SEQ ID NO: 775469 - protein, 20 aa, Mycobacterium
RAEGPWAIGHGMATCTMGSF

SEQ ID NO: 775470 - protein, 22 aa, Mycobacterium
RAEGRYALMPGIIAALAESGTP

SEQ ID NO: 775471 - protein, 22 aa, Mycobacterium
RAEGRYALMPGIIGALADSYTP

SEQ ID NO: 775472 - protein, 22 aa, Mycobacterium
RAEGRYALMPGIIGALAESGTP

SEQ ID NO: 775473 - protein, 22 aa, Mycobacterium
RAEGRYALMPGIIGALAGSGTP

SEQ ID NO: 775474 - protein, 21 aa, Mycobacterium
RAEGRYALMPGIIGALTDFGT

SEQ ID NO: 775475 - protein, 19 aa, Mycobacterium
RAEGVPLPGARLVTVAFAD

SEQ ID NO: 775476 - protein, 23 aa, Mycobacterium
RAEILRRAWELVIARRDDFALAM

SEQ ID NO: 775477 - protein, 19 aa, Mycobacterium
RAELARMFYRIDIHQAIPV

SEQ ID NO: 775478 - protein, 18 aa, Mycobacterium
RAELPLIEEWFEFVGEKL

SEQ ID NO: 775479 - protein, 18 aa, Mycobacterium
RAELPLIEEWLEFVGEKL

SEQ ID NO: 775480 - protein, 20 aa, Mycobacterium
RAELRLAIVTWIERTYHRRR

SEQ ID NO: 775481 - protein, 20 aa, Mycobacterium
RAELVRWLFEQGITAEEIRA

SEQ ID NO: 775482 - protein, 21 aa, Mycobacterium
RAEQRLAAIAARRRVADRELE

SEQ ID NO: 775483 - protein, 23 aa, Mycobacterium
RAERELDEFIGLRRVKEHVKELK

SEQ ID NO: 775484 - protein, 20 aa, Mycobacterium
RAESRWFAGAGFSLVNMTGY

SEQ ID NO: 775485 - protein, 18 aa, Mycobacterium
RAESRWYASQGFTLVNMT

SEQ ID NO: 775486 - protein, 17 aa, Mycobacterium
RAEVKSTLWGPLDTRRA

SEQ ID NO: 775487 - protein, 21 aa, Mycobacterium
RAEVLRPGLLVLSVRGAARYF

SEQ ID NO: 775488 - protein, 19 aa, Mycobacterium
RAEVMLSLRGPTPTGLARS

SEQ ID NO: 775489 - protein, 18 aa, Mycobacterium
RAFESWGRSTPSFRQQAL

SEQ ID NO: 775490 - protein, 17 aa, Mycobacterium
RAFEVLDKLTLIDISNN

SEQ ID NO: 775491 - protein, 17 aa, Mycobacterium
RAFVTGGSRGIGAGIVR

SEQ ID NO: 775492 - protein, 18 aa, Mycobacterium
RAGAEWDVLAAIPASLLP

SEQ ID NO: 775493 - protein, 17 aa, Mycobacterium
RAGAGLVLAGLVADGVT

SEQ ID NO: 775494 - protein, 18 aa, Mycobacterium
RAGARLFHAKGWRVGAVD

SEQ ID NO: 775495 - protein, 20 aa, Mycobacterium
RAGAVIALLLPRSDHAILAI

SEQ ID NO: 775496 - protein, 19 aa, Mycobacterium
RAGAVVALLLPRSDHAILT

SEQ ID NO: 775497 - protein, 22 aa, Mycobacterium
RAGCGRSPVFISDWPRLADGIL

SEQ ID NO: 775498 - protein, 17 aa, Mycobacterium
RAGCKRLLGSATYYKAI

SEQ ID NO: 775499 - protein, 20 aa, Mycobacterium
RAGEELPWHPGRCAEIVVDG

SEQ ID NO: 775500 - protein, 17 aa, Mycobacterium
RAGETLGLLGPNGAGKT

SEQ ID NO: 775501 - protein, 21 aa, Mycobacterium
RAGEVLGCYFLLEPGAPADTG

SEQ ID NO: 775502 - protein, 26 aa, Mycobacterium
RAGGGIFWTRLGLLLQFNPWGDTEWT

SEQ ID NO: 775503 - protein, 17 aa, Mycobacterium
RAGIAFKATAGLHHATR

SEQ ID NO: 775504 - protein, 17 aa, Mycobacterium
RAGKVLKRILALDDNEV

SEQ ID NO: 775505 - protein, 21 aa, Mycobacterium
RAGLELLAWGGRFVEIGKRDI

SEQ ID NO: 775506 - protein, 21 aa, Mycobacterium
RAGLELLSWGGRFVEIGKRDI

SEQ ID NO: 775507 - protein, 18 aa, Mycobacterium
RAGLFGGAGGAGGMGATG

SEQ ID NO: 775508 - protein, 20 aa, Mycobacterium
RAGLHSLPWDGLKLSRGEPA

SEQ ID NO: 775509 - protein, 18 aa, Mycobacterium
RAGLPLAKLIGAQRDSCR

SEQ ID NO: 775510 - protein, 19 aa, Mycobacterium
RAGLPWDCVLSAEIFGHYK

SEQ ID NO: 775511 - protein, 17 aa, Mycobacterium
RAGLPWGTFAERSAQLG

SEQ ID NO: 775512 - protein, 20 aa, Mycobacterium
RAGLVGGLSVPQGWASAAPE

SEQ ID NO: 775513 - protein, 25 aa, Mycobacterium
RAGPDFRRRSCCLIYRLAEDRTAVC

SEQ ID NO: 775514 - protein, 17 aa, Mycobacterium
RAGRFGFVVGVDRVGQA

SEQ ID NO: 775515 - protein, 17 aa, Mycobacterium
RAGRPGVVFVFSGRGSQ

SEQ ID NO: 775516 - protein, 22 aa, Mycobacterium
RAGSARAWWCLTAAGISGVRIL

SEQ ID NO: 775517 - protein, 20 aa, Mycobacterium
RAGSSFGVSRVTAWEELPAA

SEQ ID NO: 775518 - protein, 20 aa, Mycobacterium
RAGTATALWHLSERLTGTTF

SEQ ID NO: 775519 - protein, 20 aa, Mycobacterium
RAGTDFSRRLLTLIRRIEQL

SEQ ID NO: 775520 - protein, 19 aa, Mycobacterium
RAGVDWSQLSGFDDDTTSM

SEQ ID NO: 775521 - protein, 20 aa, Mycobacterium
RAGVELLTFGGRFIEIGKRD

SEQ ID NO: 775522 - protein, 24 aa, Mycobacterium
RAGVLRFVVLDGLAKPGRLVGPDP

SEQ ID NO: 775523 - protein, 19 aa, Mycobacterium
RAGVLRFVVLDGLAKPGRM

SEQ ID NO: 775524 - protein, 20 aa, Mycobacterium
RAGVPMLLLWLWLDQPIWAS

SEQ ID NO: 775525 - protein, 26 aa, Mycobacterium
RAGVVGRLSVPPGWAAAAPEIRSVAT

SEQ ID NO: 775526 - protein, 21 aa, Mycobacterium
RAGWAAVRWRNLTGGIVALHA

SEQ ID NO: 775527 - protein, 17 aa, Mycobacterium
RAGWARRSQFVFSQHCK

SEQ ID NO: 775528 - protein, 21 aa, Mycobacterium
RAHDQFRWFAGGWAVNADLPT

SEQ ID NO: 775529 - protein, 21 aa, Mycobacterium
RAHDQFRWFAGGWKVNADLPT

SEQ ID NO: 775530 - protein, 22 aa, Mycobacterium
RAHDQFRWFAGGWKVNADLPTP

SEQ ID NO: 775531 - protein, 20 aa, Mycobacterium
RAHECLRLLGVATEVLRGRQ

SEQ ID NO: 775532 - protein, 26 aa, Mycobacterium
RAHPDRVWAWYLWRHHMMSAVGPNNA

SEQ ID NO: 775533 - protein, 17 aa, Mycobacterium
RAHPDWVVLADDYGRSL

SEQ ID NO: 775534 - protein, 18 aa, Mycobacterium
RAHPSYWRRLPSRVVWAD

SEQ ID NO: 775535 - protein, 17 aa, Mycobacterium
RAIACSFNLEYLLVGGR

SEQ ID NO: 775536 - protein, 19 aa, Mycobacterium
RAIHFQEWWVRYRAQVPTH

SEQ ID NO: 775537 - protein, 17 aa, Mycobacterium
RAILGLACDTIMISPGA

SEQ ID NO: 775538 - protein, 18 aa, Mycobacterium
RAIRRLCAIAAFDDIDEL

SEQ ID NO: 775539 - protein, 19 aa, Mycobacterium
RAITRACAERGAKALLENG

SEQ ID NO: 775540 - protein, 17 aa, Mycobacterium
RAKEIGLVWKLVEPADL

SEQ ID NO: 775541 - protein, 18 aa, Mycobacterium
RAKLNWWESRALYGWTVL

SEQ ID NO: 775542 - protein, 24 aa, Mycobacterium
RAKVLARYALWLGEHRAEIERLLI

SEQ ID NO: 775543 - protein, 23 aa, Mycobacterium
RAKVLARYAVWLGDHRDEIEKLL

SEQ ID NO: 775544 - protein, 17 aa, Mycobacterium
RALADVRGWRVLEALDE

SEQ ID NO: 775545 - protein, 23 aa, Mycobacterium
RALARLGIYWAQEALAFGMTKRP

SEQ ID NO: 775546 - protein, 18 aa, Mycobacterium
RALARLGLYWAQEALAFG

SEQ ID NO: 775547 - protein, 20 aa, Mycobacterium
RALARPGLRLNYLSIVGLLD

SEQ ID NO: 775548 - protein, 18 aa, Mycobacterium
RALAVFGGLGLRLKSSDT

SEQ ID NO: 775549 - protein, 18 aa, Mycobacterium
RALAVFGGMGLRLKSSDT

SEQ ID NO: 775550 - protein, 24 aa, Mycobacterium
RALDAAAVGVRWVPLPFGRQAIDE

SEQ ID NO: 775551 - protein, 20 aa, Mycobacterium
RALDEWRLLSAAALVGLVEA

SEQ ID NO: 775552 - protein, 19 aa, Mycobacterium
RALDLLTRWGDALAAPPVQ

SEQ ID NO: 775553 - protein, 25 aa, Mycobacterium
RALDRCLRVAWTLADLGGRDLPAAE

SEQ ID NO: 775554 - protein, 21 aa, Mycobacterium
RALELPVRMGLATGEAEPHDA

SEQ ID NO: 775555 - protein, 22 aa, Mycobacterium
RALEVLRRLYARVGDKLVLISV

SEQ ID NO: 775556 - protein, 24 aa, Mycobacterium
RALGCTIKLLSICERITDGDGQER

SEQ ID NO: 775557 - protein, 23 aa, Mycobacterium
RALGVPVHNIWGLRPALQPGTRD

SEQ ID NO: 775558 - protein, 23 aa, Mycobacterium
RALGVPVHNMWGLRPATVAGTSE

SEQ ID NO: 775559 - protein, 20 aa, Mycobacterium
RALIAVRGLHRFAAAEGIAA

SEQ ID NO: 775560 - protein, 17 aa, Mycobacterium
RALLARRNELWSREPAN

SEQ ID NO: 775561 - protein, 18 aa, Mycobacterium
RALPVSFAGRSWWVAIED

SEQ ID NO: 775562 - protein, 19 aa, Mycobacterium
RALREITIELSVFGSEGRQ

SEQ ID NO: 775563 - protein, 23 aa, Mycobacterium
RALRRRVGFVFQHFNLVGRLSCL

SEQ ID NO: 775564 - protein, 23 aa, Mycobacterium
RALSEPLRWIAFNAGFEGGDVVD

SEQ ID NO: 775565 - protein, 19 aa, Mycobacterium
RALVCSPFFATVALATQAI

SEQ ID NO: 775566 - protein, 19 aa, Mycobacterium
RALVKEWLGLEFDPQSASA

SEQ ID NO: 775567 - protein, 20 aa, Mycobacterium
RALYRDHLLVLAALDLAATV

SEQ ID NO: 775568 - protein, 17 aa, Mycobacterium
RAMCAAEISELVKELGG

SEQ ID NO: 775569 - protein, 19 aa, Mycobacterium
RAMGFCLFNNISIGARHAQ

SEQ ID NO: 775570 - protein, 19 aa, Mycobacterium
RAMLLWDFFSKAVRDVWSA

SEQ ID NO: 775571 - protein, 23 aa, Mycobacterium
RAMRLEALPGWTWGPRSRRTSAT

SEQ ID NO: 775572 - protein, 22 aa, Mycobacterium
RANHVKRCRIALGRLRHKEQRA

SEQ ID NO: 775573 - protein, 17 aa, Mycobacterium
RANLKWTPQPAMPGQLR

SEQ ID NO: 775574 - protein, 17 aa, Mycobacterium
RANPGMFSRIVIDYYGT

SEQ ID NO: 775575 - protein, 21 aa, Mycobacterium
RANRLAHRFRRAGLREGDAVA

SEQ ID NO: 775576 - protein, 19 aa, Mycobacterium
RAPFGFAIADFEPGQRLSL

SEQ ID NO: 775577 - protein, 19 aa, Mycobacterium
RAPLDLALFRSWKLHDELG

SEQ ID NO: 775578 - protein, 19 aa, Mycobacterium
RAPLDLALFRSWKLHRELG

SEQ ID NO: 775579 - protein, 17 aa, Mycobacterium
RAPLEFPSIPALFDAHV

SEQ ID NO: 775580 - protein, 17 aa, Mycobacterium
RAPRALPVLVIDGRDDT

SEQ ID NO: 775581 - protein, 25 aa, Mycobacterium
RAPRCGLCPLGQCAWRRAGYPAAQG

SEQ ID NO: 775582 - protein, 19 aa, Mycobacterium
RAPRCGVCPLTHCAWRSRG

SEQ ID NO: 775583 - protein, 17 aa, Mycobacterium
RAPRLGYSIDFEQAKVG

SEQ ID NO: 775584 - protein, 17 aa, Mycobacterium
RAPRPGHRRIVFKFMTS

SEQ ID NO: 775585 - protein, 18 aa, Mycobacterium
RAPRPGLIALPWDRPLAD

SEQ ID NO: 775586 - protein, 19 aa, Mycobacterium
RAPSIDVFAGWRITSRQGG

SEQ ID NO: 775587 - protein, 19 aa, Mycobacterium
RAPSVDVFAGWRITSHQGG

SEQ ID NO: 775588 - protein, 18 aa, Mycobacterium
RAPTEFGIKDNPKLRATA

SEQ ID NO: 775589 - protein, 20 aa, Mycobacterium
RAQAQVVAWWSPAYFEPNGG

SEQ ID NO: 775590 - protein, 19 aa, Mycobacterium
RAQGFTILLSRDVPVNNDA

SEQ ID NO: 775591 - protein, 19 aa, Mycobacterium
RAQMIGGIIWGWGKATLEA

SEQ ID NO: 775592 - protein, 19 aa, Mycobacterium
RAQRRIMLIGWDLDYRTTF

SEQ ID NO: 775593 - protein, 18 aa, Mycobacterium
RARAAGVICRPRDVFVEQ

SEQ ID NO: 775594 - protein, 21 aa, Mycobacterium
RARAASLAGVFERARERGELR

SEQ ID NO: 775595 - protein, 20 aa, Mycobacterium
RARARLAIGSALFGLLRADD

SEQ ID NO: 775596 - protein, 17 aa, Mycobacterium
RARAVGALVVLDACQSV

SEQ ID NO: 775597 - protein, 19 aa, Mycobacterium
RARCVLLGLVAATTAGIVQ

SEQ ID NO: 775598 - protein, 22 aa, Mycobacterium
RARDCLRYARMLDLVVEDEGRW

SEQ ID NO: 775599 - protein, 19 aa, Mycobacterium
RAREVAFALPFTFDEEDYV

SEQ ID NO: 775600 - protein, 17 aa, Mycobacterium
RARFAAGLSAMYAGEVP

SEQ ID NO: 775601 - protein, 22 aa, Mycobacterium
RARGWRGSIQIPRYAYTTRFRA

SEQ ID NO: 775602 - protein, 19 aa, Mycobacterium
RARIEFKLRDWLFARQRYW

SEQ ID NO: 775603 - protein, 19 aa, Mycobacterium
RARLRYGEWLRRANRRPDA

SEQ ID NO: 775604 - protein, 27 aa, Mycobacterium
RARLTGVTWPSEWSRAYFTPVTLMGER

SEQ ID NO: 775605 - protein, 23 aa, Mycobacterium
RARPRLARRYLMLEGHRALTELA

SEQ ID NO: 775606 - protein, 21 aa, Mycobacterium
RARRAIAEFRIRGVSTNIPFL

SEQ ID NO: 775607 - protein, 21 aa, Mycobacterium
RARRALAEFRIRGVATNIGFL

SEQ ID NO: 775608 - protein, 21 aa, Mycobacterium
RARRALAEFRIRGVSTNIPFL

SEQ ID NO: 775609 - protein, 21 aa, Mycobacterium
RARRAMAEFRIRGVSTNIPFL

SEQ ID NO: 775610 - protein, 18 aa, Mycobacterium
RARRDLYEALGFERYAGT

SEQ ID NO: 775611 - protein, 23 aa, Mycobacterium
RARRKGIKVAHAHLRYLNPFPAN

SEQ ID NO: 775612 - protein, 23 aa, Mycobacterium
RARRKGLKVAHAHLRHLNPFPQN

SEQ ID NO: 775613 - protein, 20 aa, Mycobacterium
RARRTALVSANWLGQHSAAI

SEQ ID NO: 775614 - protein, 19 aa, Mycobacterium
RARVDVVARGGLLAGTATV

SEQ ID NO: 775615 - protein, 18 aa, Mycobacterium
RARVVLCGVISSYLTGDH

SEQ ID NO: 775616 - protein, 18 aa, Mycobacterium
RARVVLCGVISSYLTGEH

SEQ ID NO: 775617 - protein, 22 aa, Mycobacterium
RARWALLDARVSDGWWYATSAG

SEQ ID NO: 775618 - protein, 20 aa, Mycobacterium
RARYLKALAVAAELPDVESL

SEQ ID NO: 775619 - protein, 17 aa, Mycobacterium
RARYRAAVDLALNQVDA

SEQ ID NO: 775620 - protein, 19 aa, Mycobacterium
RASAAAAVFEAAQAAIVHP

SEQ ID NO: 775621 - protein, 17 aa, Mycobacterium
RASAMLLTAEKLTPEVA

SEQ ID NO: 775622 - protein, 19 aa, Mycobacterium
RASGGLYRWEARFLQESDQ

SEQ ID NO: 775623 - protein, 20 aa, Mycobacterium
RASKARFAIYLGDLGSDTAA

SEQ ID NO: 775624 - protein, 18 aa, Mycobacterium
RASLWSASFASRVGGLRA

SEQ ID NO: 775625 - protein, 19 aa, Mycobacterium
RASMRAELKQLGAMSNTTT

SEQ ID NO: 775626 - protein, 21 aa, Mycobacterium
RASRARFAVYLGDLGDDTATR

SEQ ID NO: 775627 - protein, 18 aa, Mycobacterium
RASVCVLGPLVGRCKRAK

SEQ ID NO: 775628 - protein, 19 aa, Mycobacterium
RATGMLARLLEPLYATSAI

SEQ ID NO: 775629 - protein, 18 aa, Mycobacterium
RATHPLLWKSGALHRSPD

SEQ ID NO: 775630 - protein, 19 aa, Mycobacterium
RATIAFCKAARALALLADR

SEQ ID NO: 775631 - protein, 17 aa, Mycobacterium
RATLIVRESACLSVEHR

SEQ ID NO: 775632 - protein, 18 aa, Mycobacterium
RATNEFDFNRLIGLLKVP

SEQ ID NO: 775633 - protein, 20 aa, Mycobacterium
RATPPIKWPTVIRHPKTGEE

SEQ ID NO: 775634 - protein, 26 aa, Mycobacterium
RATSHWLTIPALKAFGAIPVADERIV

SEQ ID NO: 775635 - protein, 25 aa, Mycobacterium
RATSHWLTIPALKAFGAVPVADERV

SEQ ID NO: 775636 - protein, 17 aa, Mycobacterium
RATTHWHDARLLARAFR

SEQ ID NO: 775637 - protein, 17 aa, Mycobacterium
RATTHWLAADLFRERYP

SEQ ID NO: 775638 - protein, 17 aa, Mycobacterium
RATTHWRHAGLLQRAYR

SEQ ID NO: 775639 - protein, 18 aa, Mycobacterium
RATVPAWEDVLLGVRSSG

SEQ ID NO: 775640 - protein, 19 aa, Mycobacterium
RAVADAGLTWIGPPVAAIE

SEQ ID NO: 775641 - protein, 20 aa, Mycobacterium
RAVAEFVPRIGTLIDIVHRH

SEQ ID NO: 775642 - protein, 17 aa, Mycobacterium
RAVAFRRFRAADVRSIL

SEQ ID NO: 775643 - protein, 20 aa, Mycobacterium
RAVAKVSAWLLATGDTSDVT

SEQ ID NO: 775644 - protein, 18 aa, Mycobacterium
RAVAREVGKFGVTVNVVS

SEQ ID NO: 775645 - protein, 19 aa, Mycobacterium
RAVARLPLRLVYPDGTSIG

SEQ ID NO: 775646 - protein, 24 aa, Mycobacterium
RAVEAWRGFSRWLMRAYDVLVDED

SEQ ID NO: 775647 - protein, 24 aa, Mycobacterium
RAVFSQGVGVAWPVSRTFNAARGI

SEQ ID NO: 775648 - protein, 18 aa, Mycobacterium
RAVFWVPPYHDFGLISGI

SEQ ID NO: 775649 - protein, 21 aa, Mycobacterium
RAVGLADGWMPFGLRTMQIAD

SEQ ID NO: 775650 - protein, 18 aa, Mycobacterium
RAVIEWGMRCTCPSIDAC

SEQ ID NO: 775651 - protein, 21 aa, Mycobacterium
RAVIPRDHIKSVLDSADVVIW

SEQ ID NO: 775652 - protein, 22 aa, Mycobacterium
RAVKVPARLVAVYAPGCDPMDF

SEQ ID NO: 775653 - protein, 18 aa, Mycobacterium
RAVLCYRDDPGVPFSTAR

SEQ ID NO: 775654 - protein, 20 aa, Mycobacterium
RAVLRWTEFYAHESCGKCTP

SEQ ID NO: 775655 - protein, 21 aa, Mycobacterium
RAVPAERLWVNPDCGLKTRNS

SEQ ID NO: 775656 - protein, 17 aa, Mycobacterium
RAVRDIAARAGVVVVAG

SEQ ID NO: 775657 - protein, 21 aa, Mycobacterium
RAVSLGDGWMPFGLRTSGIRA

SEQ ID NO: 775658 - protein, 32 aa, Mycobacterium
RAVSVSAWGISPGRVTICCRIPTHGTPPRVGV

SEQ ID NO: 775659 - protein, 18 aa, Mycobacterium
RAVVAVLGPRGFRALRLD

SEQ ID NO: 775660 - protein, 18 aa, Mycobacterium
RAVVAVRGLHRFAAAEGL

SEQ ID NO: 775661 - protein, 21 aa, Mycobacterium
RAVVVDEAWRTGSLAAEVTTR

SEQ ID NO: 775662 - protein, 18 aa, Mycobacterium
RAVWRAVAAVDEIFARSG

SEQ ID NO: 775663 - protein, 18 aa, Mycobacterium
RAVWRAVSAVDEIFARCG

SEQ ID NO: 775664 - protein, 18 aa, Mycobacterium
RAVYRHMAKRGGGAIVNQ

SEQ ID NO: 775665 - protein, 17 aa, Mycobacterium
RAWDEGRFDREISPIEA

SEQ ID NO: 775666 - protein, 22 aa, Mycobacterium
RAWFAESFVQLGLIPGDGGTWF

SEQ ID NO: 775667 - protein, 22 aa, Mycobacterium
RAWKAIEATGRFCVNMLHENQQ

SEQ ID NO: 775668 - protein, 19 aa, Mycobacterium
RAWRLSWPDAVTVYELEQP

SEQ ID NO: 775669 - protein, 23 aa, Mycobacterium
RAYFRGECLRKFGADIAAASWDS

SEQ ID NO: 775670 - protein, 17 aa, Mycobacterium
RAYGVAVMSDVGRRRWW

SEQ ID NO: 775671 - protein, 19 aa, Mycobacterium
RAYKPRIVFVDARNKQIDL

SEQ ID NO: 775672 - protein, 23 aa, Mycobacterium
RAYPGRFLLGIGVGHSEATAEYR

SEQ ID NO: 775673 - protein, 18 aa, Mycobacterium
RAYRLAWPAGTVVYEVDM

SEQ ID NO: 775674 - protein, 19 aa, Mycobacterium
RAYRLDWPAATTIFELDQP

SEQ ID NO: 775675 - protein, 19 aa, Mycobacterium
RAYRLDWPAGTTVFELDQP

SEQ ID NO: 775676 - protein, 19 aa, Mycobacterium
RAYRLDWPAGTVVFEVDQP

SEQ ID NO: 775677 - protein, 22 aa, Mycobacterium
RAYRLDWPAGTVVYEIDQPEVI

SEQ ID NO: 775678 - protein, 21 aa, Mycobacterium
RAYRLDWPAGTVVYEIDQPQV

SEQ ID NO: 775679 - protein, 22 aa, Mycobacterium
RAYRLDWPAGVTVFEIDYPELL

SEQ ID NO: 775680 - protein, 19 aa, Mycobacterium
RAYRLGWPAGTVVYEIDQP

SEQ ID NO: 775681 - protein, 18 aa, Mycobacterium
RAYRLGWPPGSVVYEVDQ

SEQ ID NO: 775682 - protein, 21 aa, Mycobacterium
RAYRLNWPSGMTVYEIDQPQV

SEQ ID NO: 775683 - protein, 19 aa, Mycobacterium
RAYRLPWAAGTTVFEIDQP

SEQ ID NO: 775684 - protein, 21 aa, Mycobacterium
RAYRLPWPAGSVVFEIDQPDV

SEQ ID NO: 775685 - protein, 20 aa, Mycobacterium
RAYRLPWPAGTTVFEIDQPQ

SEQ ID NO: 775686 - protein, 20 aa, Mycobacterium
RAYRLPWPAGTTVFEVDQPR

SEQ ID NO: 775687 - protein, 20 aa, Mycobacterium
RAYRLPWPAGTTVYEIDQPE

SEQ ID NO: 775688 - protein, 23 aa, Mycobacterium
RAYRLPWPAGTVVYELDQPRVAE

SEQ ID NO: 775689 - protein, 19 aa, Mycobacterium
RAYRLPWPDGTTVFELDRP

SEQ ID NO: 775690 - protein, 20 aa, Mycobacterium
RAYRLPWPGGTTVYEIDQPQ

SEQ ID NO: 775691 - protein, 19 aa, Mycobacterium
RAYRLPWPSGSVVYEVDQP

SEQ ID NO: 775692 - protein, 19 aa, Mycobacterium
RAYRLPWSAGTVVYEVDQP

SEQ ID NO: 775693 - protein, 20 aa, Mycobacterium
RAYRLRWPAGTVVYEIDQPD

SEQ ID NO: 775694 - protein, 20 aa, Mycobacterium
RAYRLSWPAGTVVFEVDQPE

SEQ ID NO: 775695 - protein, 20 aa, Mycobacterium
RCAARAFGFSATWLQVELGL

SEQ ID NO: 775696 - protein, 24 aa, Mycobacterium
RCAIGVPTPTGWRMLSGDETGWLL

SEQ ID NO: 775697 - protein, 20 aa, Mycobacterium
RCAIGVPTTTGWRMLSGDET

SEQ ID NO: 775698 - protein, 23 aa, Mycobacterium
RCAVGIPDKAGWRMLSGDETGWL

SEQ ID NO: 775699 - protein, 24 aa, Mycobacterium
RCAVGIPTPDGWRMLSGDETGWLL

SEQ ID NO: 775700 - protein, 23 aa, Mycobacterium
RCCTDVWRVGRFLVIDAGLSGPD

SEQ ID NO: 775701 - protein, 18 aa, Mycobacterium
RCEVEWIPPPGLDTGQAR

SEQ ID NO: 775702 - protein, 17 aa, Mycobacterium
RCGCDPVALLGAVKPAR

SEQ ID NO: 775703 - protein, 20 aa, Mycobacterium
RCGHCAPCRAGNYNVCQQIG

SEQ ID NO: 775704 - protein, 18 aa, Mycobacterium
RCGLLIPDWRTGSTLQLT

SEQ ID NO: 775705 - protein, 19 aa, Mycobacterium
RCGMVPAPVDVIWRNHTEN

SEQ ID NO: 775706 - protein, 23 aa, Mycobacterium
RCGSPAWNLPVVFGPIAITYNVR

SEQ ID NO: 775707 - protein, 26 aa, Mycobacterium
RCILIRPAPVPGFRGPRSFAVPEFDP

SEQ ID NO: 775708 - protein, 24 aa, Mycobacterium
RCLNEARFGIVFGALGAARDCLET

SEQ ID NO: 775709 - protein, 22 aa, Mycobacterium
RCPTCQGEGFVSVELLFLPGTY

SEQ ID NO: 775710 - protein, 19 aa, Mycobacterium
RCPYFRAEEPLPWGCNKRT

SEQ ID NO: 775711 - protein, 26 aa, Mycobacterium
RCQQVWCPVCALAAVVNGEEHPLLGV

SEQ ID NO: 775712 - protein, 18 aa, Mycobacterium
RCRAMLLAAHGDVAAAEQ

SEQ ID NO: 775713 - protein, 18 aa, Mycobacterium
RCRLRRMAVDLADPQARD

SEQ ID NO: 775714 - protein, 17 aa, Mycobacterium
RCSFEVFARRLPEGRRY

SEQ ID NO: 775715 - protein, 21 aa, Mycobacterium
RCVGHPFPGMTDVRIVSRNGQ

SEQ ID NO: 775716 - protein, 21 aa, Mycobacterium
RCVRTALPLLRKAQWARIVNF

SEQ ID NO: 775717 - protein, 18 aa, Mycobacterium
RCVYQILKRHYARYTPEM

SEQ ID NO: 775718 - protein, 19 aa, Mycobacterium
RCVYQILKRHYARYTPEMV

SEQ ID NO: 775719 - protein, 17 aa, Mycobacterium
RCWELRHDSHWVALPQE

SEQ ID NO: 775720 - protein, 20 aa, Mycobacterium
RCWPGRCVRRARGRTTTSTP

SEQ ID NO: 775721 - protein, 18 aa, Mycobacterium
RDAALCLAALRVGADPQG

SEQ ID NO: 775722 - protein, 18 aa, Mycobacterium
RDAALCLATLRVGADPHD

SEQ ID NO: 775723 - protein, 17 aa, Mycobacterium
RDACRRKNIRIVAEAPI

SEQ ID NO: 775724 - protein, 20 aa, Mycobacterium
RDAERFLRRKLGDLPAAPLT

SEQ ID NO: 775725 - protein, 20 aa, Mycobacterium
RDAHPRWGPTRIVYELVREG

SEQ ID NO: 775726 - protein, 19 aa, Mycobacterium
RDALASALERPDCPDVSDV

SEQ ID NO: 775727 - protein, 18 aa, Mycobacterium
RDALILAALERWMDENRY

SEQ ID NO: 775728 - protein, 21 aa, Mycobacterium
RDARHSFSFSGLKTAVARYLE

SEQ ID NO: 775729 - protein, 24 aa, Mycobacterium
RDATGHARFNLGLGNIGSGNVGSG

SEQ ID NO: 775730 - protein, 18 aa, Mycobacterium
RDAVLLGLTGRRWGFGRT

SEQ ID NO: 775731 - protein, 17 aa, Mycobacterium
RDAVSIVLDVPRGSAAR

SEQ ID NO: 775732 - protein, 19 aa, Mycobacterium
RDAVTLGLTGHRWGMRRVT

SEQ ID NO: 775733 - protein, 21 aa, Mycobacterium
RDAYLPGLWFKTGDRADVDEN

SEQ ID NO: 775734 - protein, 22 aa, Mycobacterium
RDDCARLAAALVRVSLDTALRD

SEQ ID NO: 775735 - protein, 23 aa, Mycobacterium
RDDEVLPFISIRLWQPISENETE

SEQ ID NO: 775736 - protein, 18 aa, Mycobacterium
RDDIPYHLPIGVHSVEGC

SEQ ID NO: 775737 - protein, 18 aa, Mycobacterium
RDDLPFALALVIRSVLQR

SEQ ID NO: 775738 - protein, 18 aa, Mycobacterium
RDEAVAAIVDWVNRRENV

SEQ ID NO: 775739 - protein, 22 aa, Mycobacterium
RDEAVEMIVRWIADRINEVPTA

SEQ ID NO: 775740 - protein, 19 aa, Mycobacterium
RDEDGRWGLGPAITELAAH

SEQ ID NO: 775741 - protein, 18 aa, Mycobacterium
RDEIAAWLTAAAGEYTYT

SEQ ID NO: 775742 - protein, 18 aa, Mycobacterium
RDEIRIELGSPWVGAGDV

SEQ ID NO: 775743 - protein, 24 aa, Mycobacterium
RDEPGNLWFEWSRSLDDPAVYVLV

SEQ ID NO: 775744 - protein, 18 aa, Mycobacterium
RDEWIGVQADSHWTSDGI

SEQ ID NO: 775745 - protein, 19 aa, Mycobacterium
RDFCWWLGVLGKWDMAAPP

SEQ ID NO: 775746 - protein, 24 aa, Mycobacterium
RDFLARNGLYYTWFMADEPAGERL

SEQ ID NO: 775747 - protein, 17 aa, Mycobacterium
RDFPDYRRGYSVNNVFR

SEQ ID NO: 775748 - protein, 19 aa, Mycobacterium
RDFPEDFTYVLSLQEASAL

SEQ ID NO: 775749 - protein, 17 aa, Mycobacterium
RDFPRPALGSFRGGRVR

SEQ ID NO: 775750 - protein, 19 aa, Mycobacterium
RDGEGRWGLGPAVTELAAH

SEQ ID NO: 775751 - protein, 18 aa, Mycobacterium
RDGLRLPWIPGVRGDTRT

SEQ ID NO: 775752 - protein, 22 aa, Mycobacterium
RDGLWLRLALPRALAGADPAAP

SEQ ID NO: 775753 - protein, 17 aa, Mycobacterium
RDGQAHRIRRCISCENC

SEQ ID NO: 775754 - protein, 18 aa, Mycobacterium
RDGQWYAARLCPSPLRAA

SEQ ID NO: 775755 - protein, 23 aa, Mycobacterium
RDGRPRWTPTIAHLSDGRRVVAR

SEQ ID NO: 775756 - protein, 21 aa, Mycobacterium
RDGRWYWHWDPAFLGKPHDDP

SEQ ID NO: 775757 - protein, 20 aa, Mycobacterium
RDGRWYWHWDPAMMTAPGDD

SEQ ID NO: 775758 - protein, 20 aa, Mycobacterium
RDGRWYWHWDPAMMTAPLDD

SEQ ID NO: 775759 - protein, 21 aa, Mycobacterium
RDGVKVVDLWGGYRNGVARQP

SEQ ID NO: 775760 - protein, 23 aa, Mycobacterium
RDHAKPGYIGYAWTAMEPVNAIP

SEQ ID NO: 775761 - protein, 18 aa, Mycobacterium
RDIAELFVAFLAAHDIEV

SEQ ID NO: 775762 - protein, 17 aa, Mycobacterium
RDIPLRLIHAIPRGADV

SEQ ID NO: 775763 - protein, 17 aa, Mycobacterium
RDIPLRLVYVIDPLEPS

SEQ ID NO: 775764 - protein, 19 aa, Mycobacterium
RDIRRRVGLVFQDPDDQLF

SEQ ID NO: 775765 - protein, 20 aa, Mycobacterium
RDIRRRVGLVFQDPDDQLFM

SEQ ID NO: 775766 - protein, 17 aa, Mycobacterium
RDISGEIGLPVIDGVTA

SEQ ID NO: 775767 - protein, 24 aa, Mycobacterium
RDKLDFGWFKAHEFDVTEVAGSTK

SEQ ID NO: 775768 - protein, 21 aa, Mycobacterium
RDKPAWLDRAWTRIAEEVAAG

SEQ ID NO: 775769 - protein, 18 aa, Mycobacterium
RDLAGFGRRFIDVAADDL

SEQ ID NO: 775770 - protein, 18 aa, Mycobacterium
RDLAGFGRRFIDVDPEDL

SEQ ID NO: 775771 - protein, 17 aa, Mycobacterium
RDLAGFGRRFIDVSSED

SEQ ID NO: 775772 - protein, 25 aa, Mycobacterium
RDLAHWDFYMALAYFKLAIIAAGID

SEQ ID NO: 775773 - protein, 24 aa, Mycobacterium
RDLALACVRAWNDWHFDVWAGSYP

SEQ ID NO: 775774 - protein, 24 aa, Mycobacterium
RDLASRIFADFAYRSGSTTISTGV

SEQ ID NO: 775775 - protein, 25 aa, Mycobacterium
RDLELRWAGLRAHNRWLADFCSLSP

SEQ ID NO: 775776 - protein, 17 aa, Mycobacterium
RDLKIWLADGTNYPGQG

SEQ ID NO: 775777 - protein, 17 aa, Mycobacterium
RDLLKFDFYFADSAAFR

SEQ ID NO: 775778 - protein, 17 aa, Mycobacterium
RDLLRSWGIKHVYDSRS

SEQ ID NO: 775779 - protein, 17 aa, Mycobacterium
RDLMEFRRSVGMLFQRP

SEQ ID NO: 775780 - protein, 17 aa, Mycobacterium
RDLPFTLTYLFDDDGSA

SEQ ID NO: 775781 - protein, 17 aa, Mycobacterium
RDLQAWEYVPLGPFLGK

SEQ ID NO: 775782 - protein, 17 aa, Mycobacterium
RDLRETGFWRFVNDPND

SEQ ID NO: 775783 - protein, 17 aa, Mycobacterium
RDLSREFIRVCTIAPGL

SEQ ID NO: 775784 - protein, 17 aa, Mycobacterium
RDLSSLWVLASSAALFS

SEQ ID NO: 775785 - protein, 19 aa, Mycobacterium
RDLWTSWTRHFWRLQDLVA

SEQ ID NO: 775786 - protein, 20 aa, Mycobacterium
RDLYPGLPLLLLTAKDSLED

SEQ ID NO: 775787 - protein, 21 aa, Mycobacterium
RDMRRRIGLVFQDPFASLNPR

SEQ ID NO: 775788 - protein, 18 aa, Mycobacterium
RDNLMFRAPRFRHHVAPD

SEQ ID NO: 775789 - protein, 21 aa, Mycobacterium
RDNWWLHLQVFSIQRAPRKLK

SEQ ID NO: 775790 - protein, 23 aa, Mycobacterium
RDPDSVRVWSCFATVGDHLPEEL

SEQ ID NO: 775791 - protein, 19 aa, Mycobacterium
RDPFVFVFRCCESCDLAAR

SEQ ID NO: 775792 - protein, 17 aa, Mycobacterium
RDPMGWQSSRLEFLRAW

SEQ ID NO: 775793 - protein, 20 aa, Mycobacterium
RDPRVAVTIADPGKVGKVMR

SEQ ID NO: 775794 - protein, 17 aa, Mycobacterium
RDPSGLWQRSYINMAAQ

SEQ ID NO: 775795 - protein, 18 aa, Mycobacterium
RDPWPEFPHLRTARGAFH

SEQ ID NO: 775796 - protein, 18 aa, Mycobacterium
RDQLRYARFHLGDGTAPD

SEQ ID NO: 775797 - protein, 20 aa, Mycobacterium
RDRAAAFLSRFPQIDFVDVD

SEQ ID NO: 775798 - protein, 19 aa, Mycobacterium
RDRCREVPFLPGATYHFVA

SEQ ID NO: 775799 - protein, 19 aa, Mycobacterium
RDRLCELDFEFPMAGGDLR

SEQ ID NO: 775800 - protein, 21 aa, Mycobacterium
RDRLLPAMRDWLAHSPLGFVA

SEQ ID NO: 775801 - protein, 17 aa, Mycobacterium
RDRTAIAMGRRGTPEEQ

SEQ ID NO: 775802 - protein, 21 aa, Mycobacterium
RDRYRWASWSGRLGIDGTAVE

SEQ ID NO: 775803 - protein, 19 aa, Mycobacterium
RDSALCLATLRVGMQADGV

SEQ ID NO: 775804 - protein, 18 aa, Mycobacterium
RDSLSFKLRHLLILEAKE

SEQ ID NO: 775805 - protein, 19 aa, Mycobacterium
RDSYPRMLGWGRSGSPLLD

SEQ ID NO: 775806 - protein, 18 aa, Mycobacterium
RDTAGWAMRELVVLHEVA

SEQ ID NO: 775807 - protein, 20 aa, Mycobacterium
RDTCHYCTFVTVPGKLRASG

SEQ ID NO: 775808 - protein, 19 aa, Mycobacterium
RDTFPAALIMYGAAEMEML

SEQ ID NO: 775809 - protein, 19 aa, Mycobacterium
RDTGRWRVPLILRLDPKVG

SEQ ID NO: 775810 - protein, 19 aa, Mycobacterium
RDTGRWRVPLILRLDPQVG

SEQ ID NO: 775811 - protein, 19 aa, Mycobacterium
RDTLCWPYGLHLHRDLLAV

SEQ ID NO: 775812 - protein, 23 aa, Mycobacterium
RDTLRWLAERGILVAPGEFYGPA

SEQ ID NO: 775813 - protein, 25 aa, Mycobacterium
RDVGRWRIPVILGLRSDVGEDDVRA

SEQ ID NO: 775814 - protein, 18 aa, Mycobacterium
RDVIRFCAEYGIGRAAAA

SEQ ID NO: 775815 - protein, 23 aa, Mycobacterium
RDVLIRIGDEFAIQVRALTELAE

SEQ ID NO: 775816 - protein, 17 aa, Mycobacterium
RDVNAFLEMLSRVEREL

SEQ ID NO: 775817 - protein, 22 aa, Mycobacterium
RDVSSLGWRCYRLDAADRPAGW

SEQ ID NO: 775818 - protein, 27 aa, Mycobacterium
RDWAGQCLRSPYGLLYTRLTERGGVPM

SEQ ID NO: 775819 - protein, 17 aa, Mycobacterium
RDWAPKVYGAWHLHQAT

SEQ ID NO: 775820 - protein, 23 aa, Mycobacterium
RDWARLGFCDGLLHVTDADTPTE

SEQ ID NO: 775821 - protein, 24 aa, Mycobacterium
RDWLRRFELRPGFEVVLPPPAPLD

SEQ ID NO: 775822 - protein, 18 aa, Mycobacterium
RDYFDMFDMFKATLRGLI

SEQ ID NO: 775823 - protein, 19 aa, Mycobacterium
RDYGARVGIWRMIESLDRH

SEQ ID NO: 775824 - protein, 23 aa, Mycobacterium
RDYSEAMVLPALELYTHGLLTDS

SEQ ID NO: 775825 - protein, 19 aa, Mycobacterium
REAALRLDRHFAISVIDCG

SEQ ID NO: 775826 - protein, 19 aa, Mycobacterium
REACDRLAFDLRWKAAAGL

SEQ ID NO: 775827 - protein, 17 aa, Mycobacterium
REAELPGAVLARVASSH

SEQ ID NO: 775828 - protein, 30 aa, Mycobacterium
REAHLRGAPILAMGVWRWGLGEIRYEQLNR

SEQ ID NO: 775829 - protein, 25 aa, Mycobacterium
REALKAVPARRLWVNPDCGLKTRKV

SEQ ID NO: 775830 - protein, 20 aa, Mycobacterium
REALPRIQLWPFGPEGEYGE

SEQ ID NO: 775831 - protein, 22 aa, Mycobacterium
REARVALGIARRLHRTGATSYQ

SEQ ID NO: 775832 - protein, 17 aa, Mycobacterium
REATAHGALHWAPHHDA

SEQ ID NO: 775833 - protein, 18 aa, Mycobacterium
REAVGPDFIVCYRMSMAD

SEQ ID NO: 775834 - protein, 25 aa, Mycobacterium
RECNASFKTAVKFINWRTPGEGSPV

SEQ ID NO: 775835 - protein, 18 aa, Mycobacterium
RECPAGTVGEIWVHGDNV

SEQ ID NO: 775836 - protein, 22 aa, Mycobacterium
RECTGFIFNRVWAAIKRESLAV

SEQ ID NO: 775837 - protein, 25 aa, Mycobacterium
REDGRWSWRWDPAFVTSNFQFLQGD

SEQ ID NO: 775838 - protein, 25 aa, Mycobacterium
REDLLRLGLQIGDFVALITSPELTA

SEQ ID NO: 775839 - protein, 18 aa, Mycobacterium
REDWLIKLMEGVEDIPGT

SEQ ID NO: 775840 - protein, 18 aa, Mycobacterium
REDWPAALQAAGFDPEQP

SEQ ID NO: 775841 - protein, 18 aa, Mycobacterium
REELPLIEEWFEFVGDKL

SEQ ID NO: 775842 - protein, 20 aa, Mycobacterium
REFASRFGLGFSAEDREENI

SEQ ID NO: 775843 - protein, 18 aa, Mycobacterium
REFVKWDPEHTVIQPLAD

SEQ ID NO: 775844 - protein, 20 aa, Mycobacterium
REGACSACACTVRRGEVRML

SEQ ID NO: 775845 - protein, 24 aa, Mycobacterium
REGFKRIHNCGGFLTGAATFDPAF

SEQ ID NO: 775846 - protein, 23 aa, Mycobacterium
REGHCGACACTLRGGKVSMEVND

SEQ ID NO: 775847 - protein, 23 aa, Mycobacterium
REGHCGACACTLRSGKVNMEVND

SEQ ID NO: 775848 - protein, 20 aa, Mycobacterium
REGHCMTCACVLKDGKVRML

SEQ ID NO: 775849 - protein, 17 aa, Mycobacterium
REGKVPAVMYGHGEEPR

SEQ ID NO: 775850 - protein, 19 aa, Mycobacterium
REGLEIPLLIGGATTSRAH

SEQ ID NO: 775851 - protein, 19 aa, Mycobacterium
REGLLEIGRKLGIPPLATN

SEQ ID NO: 775852 - protein, 18 aa, Mycobacterium
REGLRFWMRTAITHQLFT

SEQ ID NO: 775853 - protein, 20 aa, Mycobacterium
REGRIPLGYFDDADATARTF

SEQ ID NO: 775854 - protein, 19 aa, Mycobacterium
REGRTVLFLGRYDEPRKGM

SEQ ID NO: 775855 - protein, 20 aa, Mycobacterium
REGSQWLALLLEPPSNAVAP

SEQ ID NO: 775856 - protein, 18 aa, Mycobacterium
REGVRFWMRTALTHQLFT

SEQ ID NO: 775857 - protein, 22 aa, Mycobacterium
REHAPLEFGLRVTTFVRDTTDQ

SEQ ID NO: 775858 - protein, 21 aa, Mycobacterium
REHAPLEFGLRVTTLVRDTSE

SEQ ID NO: 775859 - protein, 23 aa, Mycobacterium
REHLDRITALLARVPKTARVECG

SEQ ID NO: 775860 - protein, 22 aa, Mycobacterium
REHSGRLLIRFAGVSDRDAADA

SEQ ID NO: 775861 - protein, 20 aa, Mycobacterium
REHYGLPALRDWLRRQRDER

SEQ ID NO: 775862 - protein, 17 aa, Mycobacterium
REIACAFDLDYVDLADV

SEQ ID NO: 775863 - protein, 20 aa, Mycobacterium
REIARRAGISYGVVYKHFPS

SEQ ID NO: 775864 - protein, 20 aa, Mycobacterium
REICDRYGLVFIADEVMVGF

SEQ ID NO: 775865 - protein, 20 aa, Mycobacterium
REICGMPPPSSGGIAVAATL

SEQ ID NO: 775866 - protein, 22 aa, Mycobacterium
REIENRFGFRLVVGYALSETPY

SEQ ID NO: 775867 - protein, 23 aa, Mycobacterium
REIFPRTVIAMAFGSTMILSQAK

SEQ ID NO: 775868 - protein, 18 aa, Mycobacterium
REINCLPFAPARDNPYSG

SEQ ID NO: 775869 - protein, 19 aa, Mycobacterium
REIPRASLAPVIQAPPVRG

SEQ ID NO: 775870 - protein, 25 aa, Mycobacterium
REIPRPGLLGRFGFMDEKTMRKQAA

SEQ ID NO: 775871 - protein, 23 aa, Mycobacterium
REIRRLGVLGADFRPLVFDGLFL

SEQ ID NO: 775872 - protein, 19 aa, Mycobacterium
REITDWDAVCTRIAASEPW

SEQ ID NO: 775873 - protein, 20 aa, Mycobacterium
REKPGWLARGWERIAEEVAA

SEQ ID NO: 775874 - protein, 20 aa, Mycobacterium
RELAELVSPGGAFVSDGFGV

SEQ ID NO: 775875 - protein, 17 aa, Mycobacterium
RELAGWLAAAVSQADGV

SEQ ID NO: 775876 - protein, 18 aa, Mycobacterium
RELAVAWCEADHNRLEAL

SEQ ID NO: 775877 - protein, 19 aa, Mycobacterium
RELCARFGVPPIEFDGQRD

SEQ ID NO: 775878 - protein, 19 aa, Mycobacterium
RELCARFGVSPIEFDGRSD

SEQ ID NO: 775879 - protein, 20 aa, Mycobacterium
RELCARFGVSPIEFDGRSDA

SEQ ID NO: 775880 - protein, 20 aa, Mycobacterium
RELEAMPDLVARVISAIKPV

SEQ ID NO: 775881 - protein, 20 aa, Mycobacterium
RELEGMPDLVARVISGVKPV

SEQ ID NO: 775882 - protein, 24 aa, Mycobacterium
RELELRWAGLRAHNRWLSDFCSLS

SEQ ID NO: 775883 - protein, 20 aa, Mycobacterium
RELEVLRLLARGYTYREIAE

SEQ ID NO: 775884 - protein, 17 aa, Mycobacterium
RELGCTLLTRTTRSVEL

SEQ ID NO: 775885 - protein, 17 aa, Mycobacterium
RELIVLRTAYLMDCAYE

SEQ ID NO: 775886 - protein, 18 aa, Mycobacterium
RELLNWNPEIGLREGLGR

SEQ ID NO: 775887 - protein, 18 aa, Mycobacterium
RELLPPWVALASRMAILP

SEQ ID NO: 775888 - protein, 18 aa, Mycobacterium
RELLPYSDLDLMLLHDNK

SEQ ID NO: 775889 - protein, 20 aa, Mycobacterium
RELPEWLAADVAILGEPSGG

SEQ ID NO: 775890 - protein, 17 aa, Mycobacterium
RELPEWLSADVAILGEP

SEQ ID NO: 775891 - protein, 17 aa, Mycobacterium
RELPKARVADGVGIPIS

SEQ ID NO: 775892 - protein, 20 aa, Mycobacterium
RELPQRFALQLNDTHPSIGV

SEQ ID NO: 775893 - protein, 17 aa, Mycobacterium
RELRLKLLREHLDLDGK

SEQ ID NO: 775894 - protein, 18 aa, Mycobacterium
RELSALVARSAFGQGSAW

SEQ ID NO: 775895 - protein, 21 aa, Mycobacterium
RELSEALKILACRMPDARVSG

SEQ ID NO: 775896 - protein, 17 aa, Mycobacterium
RELSSWEGLQRWCDHLV

SEQ ID NO: 775897 - protein, 22 aa, Mycobacterium
RELVEFALRIMLSFFVSPNEAT

SEQ ID NO: 775898 - protein, 24 aa, Mycobacterium
RELVEVPVGFKWFVDGLIGGTIGF

SEQ ID NO: 775899 - protein, 23 aa, Mycobacterium
RELVYRHKLVVLKGVHPTPEQFI

SEQ ID NO: 775900 - protein, 22 aa, Mycobacterium
RELWSGDATFVFTRTTAGEIGI

SEQ ID NO: 775901 - protein, 19 aa, Mycobacterium
REMGVAGLEEFLERKTFAV

SEQ ID NO: 775902 - protein, 17 aa, Mycobacterium
REMLPHNAVEYFVSYYD

SEQ ID NO: 775903 - protein, 20 aa, Mycobacterium
REMLRLVEAFGYGWSDLERF

SEQ ID NO: 775904 - protein, 17 aa, Mycobacterium
REMPMAALAGMRRQQSL

SEQ ID NO: 775905 - protein, 18 aa, Mycobacterium
REMWDLSDQCWSQMSTTL

SEQ ID NO: 775906 - protein, 18 aa, Mycobacterium
RENLCAVGIELSDDHLRR

SEQ ID NO: 775907 - protein, 17 aa, Mycobacterium
RENPAWISGIEHRVETP

SEQ ID NO: 775908 - protein, 17 aa, Mycobacterium
RENRLRTALAHLDSLDF

SEQ ID NO: 775909 - protein, 21 aa, Mycobacterium
REPFPGITIKLLWEGDNGAKA

SEQ ID NO: 775910 - protein, 19 aa, Mycobacterium
REPGPRLALLDEQGIDKSM

SEQ ID NO: 775911 - protein, 18 aa, Mycobacterium
REPLDLRGKFPLKAGLVT

SEQ ID NO: 775912 - protein, 17 aa, Mycobacterium
REPLRFIVLDELNKYAP

SEQ ID NO: 775913 - protein, 19 aa, Mycobacterium
REPRCPFAPPPDVMALAES

SEQ ID NO: 775914 - protein, 21 aa, Mycobacterium
REPRGVLEIAYRCPNGEPGVV

SEQ ID NO: 775915 - protein, 22 aa, Mycobacterium
REPRPMVYSGLYPVDGSDYPVL

SEQ ID NO: 775916 - protein, 17 aa, Mycobacterium
REPWLAISPRPCNGDPP

SEQ ID NO: 775917 - protein, 17 aa, Mycobacterium
REQLCGWVEAGIPRVKM

SEQ ID NO: 775918 - protein, 22 aa, Mycobacterium
REQYSLPALRDWLRAQRDDRGG

SEQ ID NO: 775919 - protein, 17 aa, Mycobacterium
RERAEPAVAPWIHRGLT

SEQ ID NO: 775920 - protein, 17 aa, Mycobacterium
RERAGALARAWGLDEVS

SEQ ID NO: 775921 - protein, 19 aa, Mycobacterium
RERFAEFLAGFHLIDEHFR

SEQ ID NO: 775922 - protein, 23 aa, Mycobacterium
RERLDMEILKWLLAEAYARLDDV

SEQ ID NO: 775923 - protein, 24 aa, Mycobacterium
RERLPRVAALFARGAVSTRVVETL

SEQ ID NO: 775924 - protein, 18 aa, Mycobacterium
RERMAGFKVPRSVQFVEA

SEQ ID NO: 775925 - protein, 17 aa, Mycobacterium
RERMRILQEEFIKRGQE

SEQ ID NO: 775926 - protein, 18 aa, Mycobacterium
RERPRVSALIAIDRVHGW

SEQ ID NO: 775927 - protein, 17 aa, Mycobacterium
RERRRVRTLATVTGNPA

SEQ ID NO: 775928 - protein, 19 aa, Mycobacterium
RERTVLILRFFESMTQTQI

SEQ ID NO: 775929 - protein, 19 aa, Mycobacterium
RERTVLVLRFFESMTQTQI

SEQ ID NO: 775930 - protein, 22 aa, Mycobacterium
RERYTLPALRDWLRGQREDRGG

SEQ ID NO: 775931 - protein, 17 aa, Mycobacterium
RESALRWLAKVGAEQLV

SEQ ID NO: 775932 - protein, 23 aa, Mycobacterium
RESFKTFLDRHAEPYKEEWEKNK

SEQ ID NO: 775933 - protein, 17 aa, Mycobacterium
RESMSFTAVPAALKVVA

SEQ ID NO: 775934 - protein, 22 aa, Mycobacterium
RETARVPLRFLMGMRSYVNSAL

SEQ ID NO: 775935 - protein, 32 aa, Mycobacterium
RETDPRCAIVFQEPRLFPWRSLAGNVAYGLPR

SEQ ID NO: 775936 - protein, 21 aa, Mycobacterium
RETFRAIGVDLMFTHIKESLH

SEQ ID NO: 775937 - protein, 20 aa, Mycobacterium
RETWLRLLLIDAGYPAPQTQ

SEQ ID NO: 775938 - protein, 21 aa, Mycobacterium
RETWLRLLLIRAGFPRPQTQI

SEQ ID NO: 775939 - protein, 20 aa, Mycobacterium
REVADLIAPVLGWSQTDIAR

SEQ ID NO: 775940 - protein, 19 aa, Mycobacterium
REVAEFGIRLTLVEPGGTR

SEQ ID NO: 775941 - protein, 21 aa, Mycobacterium
REVAELLLLGMPYRDIGAQLF

SEQ ID NO: 775942 - protein, 21 aa, Mycobacterium
REVAELLLLGMPYRDIGNQLF

SEQ ID NO: 775943 - protein, 21 aa, Mycobacterium
REVAELLLLGMPYRDIGSRLF

SEQ ID NO: 775944 - protein, 20 aa, Mycobacterium
REVAEPLGGLALTCDVSDPD

SEQ ID NO: 775945 - protein, 18 aa, Mycobacterium
REVGYACSVVERFGDSLV

SEQ ID NO: 775946 - protein, 19 aa, Mycobacterium
REVHRLRQPVLLIWGREDR

SEQ ID NO: 775947 - protein, 21 aa, Mycobacterium
REVKIGMARPVWMDDPEFDIT

SEQ ID NO: 775948 - protein, 18 aa, Mycobacterium
REVLDGFGAPSLVGPPGG

SEQ ID NO: 775949 - protein, 19 aa, Mycobacterium
REVLLRDGLQLETPIALAD

SEQ ID NO: 775950 - protein, 20 aa, Mycobacterium
REVLPGIPLVASGGIRTGMD

SEQ ID NO: 775951 - protein, 20 aa, Mycobacterium
REVLSVLGLNPHLDRTSETA

SEQ ID NO: 775952 - protein, 18 aa, Mycobacterium
REVYKLRQPVLLIWGRED

SEQ ID NO: 775953 - protein, 17 aa, Mycobacterium
REWLLIELKSSWQVGDI

SEQ ID NO: 775954 - protein, 17 aa, Mycobacterium
REYAARVAAAVSECGRQ

SEQ ID NO: 775955 - protein, 18 aa, Mycobacterium
REYLRLWIGPAMAAGAGP

SEQ ID NO: 775956 - protein, 20 aa, Mycobacterium
RFAAAYGYRGRIVGAVTFDH

SEQ ID NO: 775957 - protein, 18 aa, Mycobacterium
RFAAHGFAFYALDLDKCG

SEQ ID NO: 775958 - protein, 21 aa, Mycobacterium
RFAELKFIWADGAADFVTPFI

SEQ ID NO: 775959 - protein, 21 aa, Mycobacterium
RFAFASAPVPFVWNQANPAFS

SEQ ID NO: 775960 - protein, 20 aa, Mycobacterium
RFAHELAWWVYTCWREGLRR

SEQ ID NO: 775961 - protein, 19 aa, Mycobacterium
RFAPESKTLYLARWLHPGQ

SEQ ID NO: 775962 - protein, 18 aa, Mycobacterium
RFCAECGRRMIVQIRPDG

SEQ ID NO: 775963 - protein, 18 aa, Mycobacterium
RFCDAYNLPLVFVVDTPG

SEQ ID NO: 775964 - protein, 18 aa, Mycobacterium
RFCDSFNIPLVFVVDTPG

SEQ ID NO: 775965 - protein, 17 aa, Mycobacterium
RFDELKMLILMDPPEHE

SEQ ID NO: 775966 - protein, 17 aa, Mycobacterium
RFDEPRKGMAVLLGALP

SEQ ID NO: 775967 - protein, 23 aa, Mycobacterium
RFDFTADVPWQWNPASPAFSYFM

SEQ ID NO: 775968 - protein, 17 aa, Mycobacterium
RFDIDDVFLGNGVSELI

SEQ ID NO: 775969 - protein, 24 aa, Mycobacterium
RFDPSIPLHRQWRTMLFSGAGPIL

SEQ ID NO: 775970 - protein, 17 aa, Mycobacterium
RFDQRFRALTGLSRKQL

SEQ ID NO: 775971 - protein, 18 aa, Mycobacterium
RFDRGGVIFAEFEPGRSM

SEQ ID NO: 775972 - protein, 19 aa, Mycobacterium
RFDSCLLIGTSTWDVVKMR

SEQ ID NO: 775973 - protein, 18 aa, Mycobacterium
RFDSWKRGVGIKMRAYDN

SEQ ID NO: 775974 - protein, 17 aa, Mycobacterium
RFEFRWEDQFNLSLDPD

SEQ ID NO: 775975 - protein, 18 aa, Mycobacterium
RFGDGWVKLVGDWIDRGI

SEQ ID NO: 775976 - protein, 20 aa, Mycobacterium
RFGELCLEAGLPPGLVNILP

SEQ ID NO: 775977 - protein, 19 aa, Mycobacterium
RFGELCLVAGLPPGLVNIL

SEQ ID NO: 775978 - protein, 23 aa, Mycobacterium
RFGFPWERLQEINPRLIYASIKG

SEQ ID NO: 775979 - protein, 17 aa, Mycobacterium
RFGMFGIRISIAVLRAG

SEQ ID NO: 775980 - protein, 21 aa, Mycobacterium
RFGQAVPRPRAILVVSAHWYI

SEQ ID NO: 775981 - protein, 23 aa, Mycobacterium
RFGWPILRGTQRWCQLFSEPGAG

SEQ ID NO: 775982 - protein, 17 aa, Mycobacterium
RFGWPKRNGFVQPMVDA

SEQ ID NO: 775983 - protein, 23 aa, Mycobacterium
RFIACPFGAPGTRMYRTGDLVRW

SEQ ID NO: 775984 - protein, 17 aa, Mycobacterium
RFILELLGDYGLEDFYL

SEQ ID NO: 775985 - protein, 18 aa, Mycobacterium
RFIPCGILPLFDVAEAAK

SEQ ID NO: 775986 - protein, 24 aa, Mycobacterium
RFIRDTTWVSVRWYKPGGPLSAEQ

SEQ ID NO: 775987 - protein, 21 aa, Mycobacterium
RFKEGPCLDAALDQTVVRTDD

SEQ ID NO: 775988 - protein, 18 aa, Mycobacterium
RFKPSMMGSAVFTGTLDL

SEQ ID NO: 775989 - protein, 21 aa, Mycobacterium
RFLACPFGGPGSRMYRTGDLV

SEQ ID NO: 775990 - protein, 18 aa, Mycobacterium
RFLAHPVMLDVAVQALGA

SEQ ID NO: 775991 - protein, 24 aa, Mycobacterium
RFLERKLRETFGFEGSPIRVNVRV

SEQ ID NO: 775992 - protein, 18 aa, Mycobacterium
RFLFAWPSAKSAVMGGAQ

SEQ ID NO: 775993 - protein, 18 aa, Mycobacterium
RFLFAWPSAKSAVMGGTQ

SEQ ID NO: 775994 - protein, 18 aa, Mycobacterium
RFLLADIHLDWAVDRAGT

SEQ ID NO: 775995 - protein, 20 aa, Mycobacterium
RFLLHLLSWVPVEAGIYRVN

SEQ ID NO: 775996 - protein, 18 aa, Mycobacterium
RFLPTRLAAIPALLADVL

SEQ ID NO: 775997 - protein, 20 aa, Mycobacterium
RFLRRGRKAPGFFVKSADNR

SEQ ID NO: 775998 - protein, 23 aa, Mycobacterium
RFLRRGRKAPGFFVRSADNRYLL

SEQ ID NO: 775999 - protein, 18 aa, Mycobacterium
RFLSVEGFRALLFVNDEL

SEQ ID NO: 776000 - protein, 19 aa, Mycobacterium
RFLTRLGVQAVVWDMRLRH

SEQ ID NO: 776001 - protein, 20 aa, Mycobacterium
RFLVHWSAEVFTDFDELKKN

SEQ ID NO: 776002 - protein, 19 aa, Mycobacterium
RFMWMWPNARISVMGGEQA

SEQ ID NO: 776003 - protein, 21 aa, Mycobacterium
RFNELVLRAGLTAGQITILRG

SEQ ID NO: 776004 - protein, 19 aa, Mycobacterium
RFNIDAGGAFGLLTRLSQQ

SEQ ID NO: 776005 - protein, 18 aa, Mycobacterium
RFNRPHVHAIHRDIRAVI

SEQ ID NO: 776006 - protein, 17 aa, Mycobacterium
RFPKCVVSYACARDDAH

SEQ ID NO: 776007 - protein, 19 aa, Mycobacterium
RFPKFDWPRIDAPSVRSGA

SEQ ID NO: 776008 - protein, 19 aa, Mycobacterium
RFPKFDWPRIDAPYVRPGL

SEQ ID NO: 776009 - protein, 18 aa, Mycobacterium
RFPLMPIPSWMDNPIDPI

SEQ ID NO: 776010 - protein, 18 aa, Mycobacterium
RFPYRNDGALGWHGTSPV

SEQ ID NO: 776011 - protein, 19 aa, Mycobacterium
RFQFDQVRRLLAWATPYRE

SEQ ID NO: 776012 - protein, 18 aa, Mycobacterium
RFRAARVVIDIGVHCGLT

SEQ ID NO: 776013 - protein, 19 aa, Mycobacterium
RFRFVEEMIRLGADARTDG

SEQ ID NO: 776014 - protein, 19 aa, Mycobacterium
RFRGSEVMHTLKITPQGAE

SEQ ID NO: 776015 - protein, 17 aa, Mycobacterium
RFRGWEVAGLTAGLVGL

SEQ ID NO: 776016 - protein, 19 aa, Mycobacterium
RFRGWSAFIGLQVEYSLLE

SEQ ID NO: 776017 - protein, 22 aa, Mycobacterium
RFRHAVKFLRWRPDREPSSCTF

SEQ ID NO: 776018 - protein, 20 aa, Mycobacterium
RFRWPEAAVMEWTPDEFWPA

SEQ ID NO: 776019 - protein, 23 aa, Mycobacterium
RFTAEFLGDCVLLPCTVTGGVAT

SEQ ID NO: 776020 - protein, 20 aa, Mycobacterium
RFTAGFPFEVFDVLRREAPV

SEQ ID NO: 776021 - protein, 19 aa, Mycobacterium
RFTDIPVLIGLRGGANARA

SEQ ID NO: 776022 - protein, 18 aa, Mycobacterium
RFTLGIGPSHHWIVNGQL

SEQ ID NO: 776023 - protein, 17 aa, Mycobacterium
RFTVVAFDLGIKTNTPR

SEQ ID NO: 776024 - protein, 18 aa, Mycobacterium
RFTWHLPKNRTWTYDGQL

SEQ ID NO: 776025 - protein, 22 aa, Mycobacterium
RFVACPFGAFGSRMYRTGDLVR

SEQ ID NO: 776026 - protein, 22 aa, Mycobacterium
RFVPELLARFGIAGPAVGELHR

SEQ ID NO: 776027 - protein, 19 aa, Mycobacterium
RFVVLDGLAKPGRMVGPDP

SEQ ID NO: 776028 - protein, 19 aa, Mycobacterium
RFWHMGAPCPPAIKEAWIN

SEQ ID NO: 776029 - protein, 24 aa, Mycobacterium
RFYRLAQELVWQWMFGRITADSRD

SEQ ID NO: 776030 - protein, 20 aa, Mycobacterium
RGAAERVLRGFALSLLVPPQ

SEQ ID NO: 776031 - protein, 20 aa, Mycobacterium
RGAAERVLRGFALSLLVPQP

SEQ ID NO: 776032 - protein, 17 aa, Mycobacterium
RGACLAGAVLDEGLRRQ

SEQ ID NO: 776033 - protein, 19 aa, Mycobacterium
RGAFHVVRPAFPLMCAAHY

SEQ ID NO: 776034 - protein, 20 aa, Mycobacterium
RGAFHVVRPAFPVMCDNGYG

SEQ ID NO: 776035 - protein, 18 aa, Mycobacterium
RGAFNVVRQAFPVMCRAG

SEQ ID NO: 776036 - protein, 19 aa, Mycobacterium
RGAGGFGYDPVFIADGANR

SEQ ID NO: 776037 - protein, 19 aa, Mycobacterium
RGAIEFENLFPGLLDDMVA

SEQ ID NO: 776038 - protein, 22 aa, Mycobacterium
RGAIPDCMAHWTLARLTTLGVA

SEQ ID NO: 776039 - protein, 21 aa, Mycobacterium
RGALRVIALRAFVGADRDAAL

SEQ ID NO: 776040 - protein, 20 aa, Mycobacterium
RGASWLPLYHDMGLLMLMFP

SEQ ID NO: 776041 - protein, 25 aa, Mycobacterium
RGATIPIIAGFPFPLAVEILPAHLP

SEQ ID NO: 776042 - protein, 17 aa, Mycobacterium
RGAVLPPGRPGGRPWTY

SEQ ID NO: 776043 - protein, 19 aa, Mycobacterium
RGAVNAGLAITTVTANTTI

SEQ ID NO: 776044 - protein, 20 aa, Mycobacterium
RGAVPIGVLVVRGGQGLAVE

SEQ ID NO: 776045 - protein, 21 aa, Mycobacterium
RGAWCPYCVAQLRAFDHATDK

SEQ ID NO: 776046 - protein, 19 aa, Mycobacterium
RGAYHVVRPAFPVMCDAGY

SEQ ID NO: 776047 - protein, 20 aa, Mycobacterium
RGCAHACRYCFARPTHEYLE

SEQ ID NO: 776048 - protein, 17 aa, Mycobacterium
RGCCGIPVIVQLAKLCH

SEQ ID NO: 776049 - protein, 21 aa, Mycobacterium
RGCLGRPWLFAELSAAFNNRP

SEQ ID NO: 776050 - protein, 21 aa, Mycobacterium
RGCLGRPWLFAELSAAFTGAT

SEQ ID NO: 776051 - protein, 21 aa, Mycobacterium
RGCLGRPWLFAELSAAFTGNP

SEQ ID NO: 776052 - protein, 21 aa, Mycobacterium
RGCLGRPWLFAELSAAFTGRP

SEQ ID NO: 776053 - protein, 22 aa, Mycobacterium
RGCTRPGCTVPGYWCQAHHASA

SEQ ID NO: 776054 - protein, 18 aa, Mycobacterium
RGDAPWPPARAGFLTLDH

SEQ ID NO: 776055 - protein, 20 aa, Mycobacterium
RGDFRAPLVVGDRLDTDIEG

SEQ ID NO: 776056 - protein, 18 aa, Mycobacterium
RGDGVIYWQVPKGATLDS

SEQ ID NO: 776057 - protein, 20 aa, Mycobacterium
RGDIKIALFGNHAPKTVNNF

SEQ ID NO: 776058 - protein, 20 aa, Mycobacterium
RGEARRLLLDAARELFARKD

SEQ ID NO: 776059 - protein, 21 aa, Mycobacterium
RGEFPAVVTLDLCRLDQLFSL

SEQ ID NO: 776060 - protein, 19 aa, Mycobacterium
RGEGGLVFTSMSVVLDAED

SEQ ID NO: 776061 - protein, 18 aa, Mycobacterium
RGEIPLSIELTGDPQRVL

SEQ ID NO: 776062 - protein, 17 aa, Mycobacterium
RGELAFLPGQYVNIAVP

SEQ ID NO: 776063 - protein, 18 aa, Mycobacterium
RGEPFPALDTPWINSLRS

SEQ ID NO: 776064 - protein, 18 aa, Mycobacterium
RGEPLAAYLRKMVFWSDV

SEQ ID NO: 776065 - protein, 22 aa, Mycobacterium
RGERHLAAFVAYAAHAQEHALY

SEQ ID NO: 776066 - protein, 21 aa, Mycobacterium
RGESRFTTWAYKFVILEVAHK

SEQ ID NO: 776067 - protein, 19 aa, Mycobacterium
RGEVAWWLFPAGRAGAVTD

SEQ ID NO: 776068 - protein, 19 aa, Mycobacterium
RGFCAGAYMGEMASLGESI

SEQ ID NO: 776069 - protein, 23 aa, Mycobacterium
RGFCWSRGDGLCNVFIPHATAGV

SEQ ID NO: 776070 - protein, 18 aa, Mycobacterium
RGFCWSRGDGLCNVFVPH

SEQ ID NO: 776071 - protein, 24 aa, Mycobacterium
RGFPPYHPRLMLKLLLYGYTSGVR

SEQ ID NO: 776072 - protein, 18 aa, Mycobacterium
RGFWKIQEMRGMWREMWD

SEQ ID NO: 776073 - protein, 18 aa, Mycobacterium
RGGALWKRVHTTSRVWAF

SEQ ID NO: 776074 - protein, 18 aa, Mycobacterium
RGGASILMRAVLSAYGDE

SEQ ID NO: 776075 - protein, 21 aa, Mycobacterium
RGGAWPLTWAQKAMVLAARVL

SEQ ID NO: 776076 - protein, 20 aa, Mycobacterium
RGGCIIRAKFLNRIKDAYDA

SEQ ID NO: 776077 - protein, 20 aa, Mycobacterium
RGGCIIRAKFLNRIKEAFDA

SEQ ID NO: 776078 - protein, 20 aa, Mycobacterium
RGGDALSDYSTVTGPSATGG

SEQ ID NO: 776079 - protein, 28 aa, Mycobacterium
RGGDAWLFVGWCRLREGIRGFQLNRIRH

SEQ ID NO: 776080 - protein, 19 aa, Mycobacterium
RGGEVLVRMAVAGICHSDD

SEQ ID NO: 776081 - protein, 19 aa, Mycobacterium
RGGEWLDWFDAEGIAGVGM

SEQ ID NO: 776082 - protein, 21 aa, Mycobacterium
RGGFPEGCFQTLLVSSGAVER

SEQ ID NO: 776083 - protein, 18 aa, Mycobacterium
RGGFPGMLLGSVSRAVIN

SEQ ID NO: 776084 - protein, 18 aa, Mycobacterium
RGGFPGMLLGSVSRAVVN

SEQ ID NO: 776085 - protein, 18 aa, Mycobacterium
RGGFPGMLLGSVSSAVAQ

SEQ ID NO: 776086 - protein, 18 aa, Mycobacterium
RGGFPGMLLGSVSSTVAH

SEQ ID NO: 776087 - protein, 21 aa, Mycobacterium
RGGGIGHRYGFRYSVLTRPPS

SEQ ID NO: 776088 - protein, 25 aa, Mycobacterium
RGGLQCGFCTPGFLVSAVELLRDPD

SEQ ID NO: 776089 - protein, 17 aa, Mycobacterium
RGGRFAVALGMGGMGYS

SEQ ID NO: 776090 - protein, 21 aa, Mycobacterium
RGGRWYWHWDPQFISGTAAFP

SEQ ID NO: 776091 - protein, 17 aa, Mycobacterium
RGGSVLCAIEVPGDKIS

SEQ ID NO: 776092 - protein, 17 aa, Mycobacterium
RGGSVLCAIEVPPHEIS

SEQ ID NO: 776093 - protein, 19 aa, Mycobacterium
RGGTALRFIRSCSAPLTAE

SEQ ID NO: 776094 - protein, 18 aa, Mycobacterium
RGGVVLATGGFEWDTTLV

SEQ ID NO: 776095 - protein, 18 aa, Mycobacterium
RGGWKPFLHHISKGTPRS

SEQ ID NO: 776096 - protein, 20 aa, Mycobacterium
RGGWKPFLHHISKHMPSPRR

SEQ ID NO: 776097 - protein, 22 aa, Mycobacterium
RGGYRLGPEIARMASTVRLGVV

SEQ ID NO: 776098 - protein, 21 aa, Mycobacterium
RGHGRGGVRIALMMTVGEDPA

SEQ ID NO: 776099 - protein, 23 aa, Mycobacterium
RGHRPGRGFSIGRWHSRVSGYPE

SEQ ID NO: 776100 - protein, 21 aa, Mycobacterium
RGHVLPALMVDRLTRHTAGHP

SEQ ID NO: 776101 - protein, 24 aa, Mycobacterium
RGHWGRRPNALIGMEVDPTVFFDR

SEQ ID NO: 776102 - protein, 18 aa, Mycobacterium
RGICRGSVVGLTRCDLSP

SEQ ID NO: 776103 - protein, 21 aa, Mycobacterium
RGIGALLVRSGHRLLPVTRGG

SEQ ID NO: 776104 - protein, 17 aa, Mycobacterium
RGILGAFMFSGPQLEQL

SEQ ID NO: 776105 - protein, 20 aa, Mycobacterium
RGIPGRAYWFFARTAHHAGM

SEQ ID NO: 776106 - protein, 24 aa, Mycobacterium
RGIPLPFAFVFDELWLAFQGLSTF

SEQ ID NO: 776107 - protein, 18 aa, Mycobacterium
RGIPRYLGDYSDVFDELL

SEQ ID NO: 776108 - protein, 17 aa, Mycobacterium
RGKFPLKAGLVTSLGFG

SEQ ID NO: 776109 - protein, 19 aa, Mycobacterium
RGKLLPRDRVDGLLDPGSP

SEQ ID NO: 776110 - protein, 21 aa, Mycobacterium
RGKRLSLARVRSFNPDSRREG

SEQ ID NO: 776111 - protein, 20 aa, Mycobacterium
RGKWDILRRMGFDDDHIGDS

SEQ ID NO: 776112 - protein, 18 aa, Mycobacterium
RGLAAFIGLRDQRCRTPY

SEQ ID NO: 776113 - protein, 18 aa, Mycobacterium
RGLACPLLVISDGAPGLI

SEQ ID NO: 776114 - protein, 18 aa, Mycobacterium
RGLASLGLDGVRLDSPNR

SEQ ID NO: 776115 - protein, 18 aa, Mycobacterium
RGLCGYRRFFSITSLAGL

SEQ ID NO: 776116 - protein, 18 aa, Mycobacterium
RGLGPWGPNSARPDSSIF

SEQ ID NO: 776117 - protein, 19 aa, Mycobacterium
RGLLCGVVLTAARAKDAEA

SEQ ID NO: 776118 - protein, 20 aa, Mycobacterium
RGLLFCAACGRRMQGAARVG

SEQ ID NO: 776119 - protein, 17 aa, Mycobacterium
RGLPFVANYHVTPWSTV

SEQ ID NO: 776120 - protein, 17 aa, Mycobacterium
RGLPHWADPGARRPGEI

SEQ ID NO: 776121 - protein, 17 aa, Mycobacterium
RGLPMPFELARTQLIVG

SEQ ID NO: 776122 - protein, 17 aa, Mycobacterium
RGLQHWADPGAKRPGEI

SEQ ID NO: 776123 - protein, 17 aa, Mycobacterium
RGLRLQHLVAMGESQSA

SEQ ID NO: 776124 - protein, 17 aa, Mycobacterium
RGLRRWLGEPDDFQDPK

SEQ ID NO: 776125 - protein, 17 aa, Mycobacterium
RGLRVDVAWSLHRSVAG

SEQ ID NO: 776126 - protein, 17 aa, Mycobacterium
RGLRWIDHSMFFPQRFR

SEQ ID NO: 776127 - protein, 18 aa, Mycobacterium
RGLSKVAALEWGRDNIRV

SEQ ID NO: 776128 - protein, 20 aa, Mycobacterium
RGLSRFRYGPGAFKVDFAIE

SEQ ID NO: 776129 - protein, 19 aa, Mycobacterium
RGLSWLPFFHDMGLITALL

SEQ ID NO: 776130 - protein, 17 aa, Mycobacterium
RGLTIDLGFAWTELDGR

SEQ ID NO: 776131 - protein, 17 aa, Mycobacterium
RGLTIDLGFAWTTLEGR

SEQ ID NO: 776132 - protein, 20 aa, Mycobacterium
RGLTSMWRRGDEVFAEVALP

SEQ ID NO: 776133 - protein, 20 aa, Mycobacterium
RGLVFPTPPAPIVAAGTDAL

SEQ ID NO: 776134 - protein, 17 aa, Mycobacterium
RGLVRLARRVWPDGPWD

SEQ ID NO: 776135 - protein, 18 aa, Mycobacterium
RGLVRLARRVWPDHDWDA

SEQ ID NO: 776136 - protein, 17 aa, Mycobacterium
RGMGRNGPWIGGKLTER

SEQ ID NO: 776137 - protein, 17 aa, Mycobacterium
RGMGSLGAMAGRGGAGG

SEQ ID NO: 776138 - protein, 17 aa, Mycobacterium
RGMGSLGAMAGRGSGTG

SEQ ID NO: 776139 - protein, 20 aa, Mycobacterium
RGMLPPRRTRVVINESVCEG

SEQ ID NO: 776140 - protein, 17 aa, Mycobacterium
RGMVDRGWGRVVNIASQ

SEQ ID NO: 776141 - protein, 19 aa, Mycobacterium
RGNGNFGFGNVVGDNNFGF

SEQ ID NO: 776142 - protein, 20 aa, Mycobacterium
RGNLAFRWFLADEVPARPEV

SEQ ID NO: 776143 - protein, 22 aa, Mycobacterium
RGNLAFRWFLADGVPARPEVKL

SEQ ID NO: 776144 - protein, 24 aa, Mycobacterium
RGNLAFRWFLADGVPARPQVRLVQ

SEQ ID NO: 776145 - protein, 22 aa, Mycobacterium
RGNLAFRWFLADGVPQRPEVKL

SEQ ID NO: 776146 - protein, 17 aa, Mycobacterium
RGNLNWGSGNLGNANVG

SEQ ID NO: 776147 - protein, 23 aa, Mycobacterium
RGPARLQIHLSWAPTDEEALAIA

SEQ ID NO: 776148 - protein, 20 aa, Mycobacterium
RGPFPGALWLQVRDIEATQA

SEQ ID NO: 776149 - protein, 20 aa, Mycobacterium
RGPFPGALWLQVRDLDAARA

SEQ ID NO: 776150 - protein, 20 aa, Mycobacterium
RGPFPGALWLQVRDLEATQA

SEQ ID NO: 776151 - protein, 17 aa, Mycobacterium
RGPFRWVALSGDPKDIH

SEQ ID NO: 776152 - protein, 17 aa, Mycobacterium
RGPGRFWGVYGLKKAIA

SEQ ID NO: 776153 - protein, 18 aa, Mycobacterium
RGPGRFWGVYGLKKAIAV

SEQ ID NO: 776154 - protein, 18 aa, Mycobacterium
RGPQRWRIKANWKIGAEN

SEQ ID NO: 776155 - protein, 19 aa, Mycobacterium
RGPQRWRIKANWKIGAENF

SEQ ID NO: 776156 - protein, 18 aa, Mycobacterium
RGPQRWRVKANWKIAAEN

SEQ ID NO: 776157 - protein, 17 aa, Mycobacterium
RGPRFAVPMGLLNAAIP

SEQ ID NO: 776158 - protein, 19 aa, Mycobacterium
RGPTSWPPRVIGRWRHTHS

SEQ ID NO: 776159 - protein, 17 aa, Mycobacterium
RGQACSFGPAWNDPNDH

SEQ ID NO: 776160 - protein, 21 aa, Mycobacterium
RGQARVAGFLLEWEEKPYEWI

SEQ ID NO: 776161 - protein, 23 aa, Mycobacterium
RGQEVVEFACGIPHLLKGSYTEN

SEQ ID NO: 776162 - protein, 19 aa, Mycobacterium
RGQHAVAVFTPRDVAVYLS

SEQ ID NO: 776163 - protein, 18 aa, Mycobacterium
RGQPPIVCGLDLTRRVAM

SEQ ID NO: 776164 - protein, 22 aa, Mycobacterium
RGQPRLLGFHWTKIHLDDPGLG

SEQ ID NO: 776165 - protein, 18 aa, Mycobacterium
RGQVLARFAQWLIDNTGR

SEQ ID NO: 776166 - protein, 18 aa, Mycobacterium
RGQWGFRGTVVSDYWSVP

SEQ ID NO: 776167 - protein, 17 aa, Mycobacterium
RGRALGKGGLWERVQPE

SEQ ID NO: 776168 - protein, 18 aa, Mycobacterium
RGRFASAFGPRAALEYLP

SEQ ID NO: 776169 - protein, 17 aa, Mycobacterium
RGRFRWWGLYTQREQGY

SEQ ID NO: 776170 - protein, 18 aa, Mycobacterium
RGRFRWWGLYTQRKQGYD

SEQ ID NO: 776171 - protein, 20 aa, Mycobacterium
RGRGAMLAIEIVKPGTLEPD

SEQ ID NO: 776172 - protein, 21 aa, Mycobacterium
RGRGGTHLVAMAVTADSPFGR

SEQ ID NO: 776173 - protein, 19 aa, Mycobacterium
RGRGIPLMRSLMHDVDIRP

SEQ ID NO: 776174 - protein, 20 aa, Mycobacterium
RGRGLMCAFDLPTTADRDEL

SEQ ID NO: 776175 - protein, 20 aa, Mycobacterium
RGRGLMCAFSLPSAADRDEL

SEQ ID NO: 776176 - protein, 20 aa, Mycobacterium
RGRGLMCAFSLPTTADRDDV

SEQ ID NO: 776177 - protein, 19 aa, Mycobacterium
RGRGLMCAFSMPTPEDRDA

SEQ ID NO: 776178 - protein, 18 aa, Mycobacterium
RGRLGLLELRGFEMPPHF

SEQ ID NO: 776179 - protein, 18 aa, Mycobacterium
RGRLGLLELRGFEMPPHL

SEQ ID NO: 776180 - protein, 18 aa, Mycobacterium
RGRLGLLELRGFEMPPHP

SEQ ID NO: 776181 - protein, 21 aa, Mycobacterium
RGRRAWSIAWSRWAGPGMSLD

SEQ ID NO: 776182 - protein, 21 aa, Mycobacterium
RGRRIWMLATWNVLYNISKAG

SEQ ID NO: 776183 - protein, 26 aa, Mycobacterium
RGRSWVPAEAFLPADVITPWSHEQSS

SEQ ID NO: 776184 - protein, 22 aa, Mycobacterium
RGRYGLSVGALARWHRPRLETL

SEQ ID NO: 776185 - protein, 25 aa, Mycobacterium
RGSEHFCRLVRPWSCTAVPIHDPLS

SEQ ID NO: 776186 - protein, 17 aa, Mycobacterium
RGSEVLNRIGALGTLPD

SEQ ID NO: 776187 - protein, 20 aa, Mycobacterium
RGSFFPVIPVCSGTGVGTLE

SEQ ID NO: 776188 - protein, 19 aa, Mycobacterium
RGSHPVRLFIGAGMPAGLW

SEQ ID NO: 776189 - protein, 18 aa, Mycobacterium
RGSLRFTFGHTSVPSDVD

SEQ ID NO: 776190 - protein, 25 aa, Mycobacterium
RGSPFALGCLAGWLSTEFPPHVLTG

SEQ ID NO: 776191 - protein, 19 aa, Mycobacterium
RGSRSFGFEEFDPFWQACI

SEQ ID NO: 776192 - protein, 18 aa, Mycobacterium
RGSVMLRMPLHPVAIELL

SEQ ID NO: 776193 - protein, 21 aa, Mycobacterium
RGTMANCLVAIGMDLDIDGVR

SEQ ID NO: 776194 - protein, 21 aa, Mycobacterium
RGTPLGPLRCEAWVDGKEGRK

SEQ ID NO: 776195 - protein, 19 aa, Mycobacterium
RGVARLKALLPFVDGGAQS

SEQ ID NO: 776196 - protein, 18 aa, Mycobacterium
RGVFAMEAMWTRFQPAIV

SEQ ID NO: 776197 - protein, 18 aa, Mycobacterium
RGVGFSFGFPVDARIWDA

SEQ ID NO: 776198 - protein, 19 aa, Mycobacterium
RGVGFSFGFPVDARVWDAV

SEQ ID NO: 776199 - protein, 17 aa, Mycobacterium
RGVGLTALHAWSDVDVF

SEQ ID NO: 776200 - protein, 26 aa, Mycobacterium
RGVGQGRLYFGIGLPELTLPPLDVPG

SEQ ID NO: 776201 - protein, 21 aa, Mycobacterium
RGVGTKGVWRLPDRRALEQVL

SEQ ID NO: 776202 - protein, 17 aa, Mycobacterium
RGVGWKVLRDAGRVVSV

SEQ ID NO: 776203 - protein, 18 aa, Mycobacterium
RGVILGTGGFEWDPALTQ

SEQ ID NO: 776204 - protein, 19 aa, Mycobacterium
RGVLFPKHRTDLLGCAISV

SEQ ID NO: 776205 - protein, 19 aa, Mycobacterium
RGVLFPKHRTDLLGCAVTV

SEQ ID NO: 776206 - protein, 17 aa, Mycobacterium
RGVLGLRAEPHWAGDSF

SEQ ID NO: 776207 - protein, 17 aa, Mycobacterium
RGVPMTAGCVVPRGDVL

SEQ ID NO: 776208 - protein, 18 aa, Mycobacterium
RGVPMTAGCVVPRGDVLE

SEQ ID NO: 776209 - protein, 19 aa, Mycobacterium
RGVTWSRIGAALGITRQSA

SEQ ID NO: 776210 - protein, 19 aa, Mycobacterium
RGYLTWPVIHALRGLPPGA

SEQ ID NO: 776211 - protein, 25 aa, Mycobacterium
RGYPAPRPKFRWCTERLKIKPSNSF

SEQ ID NO: 776212 - protein, 30 aa, Mycobacterium
RGYPAPRPKFRWCTERLKIKPSNTFIRDMV

SEQ ID NO: 776213 - protein, 17 aa, Mycobacterium
RHACGLGTGGLFVDDVA

SEQ ID NO: 776214 - protein, 18 aa, Mycobacterium
RHADGWWPAGAWTPGHYA

SEQ ID NO: 776215 - protein, 18 aa, Mycobacterium
RHAEALGHCSAVLAKDAA

SEQ ID NO: 776216 - protein, 22 aa, Mycobacterium
RHAGRIPRRFWAQASSPAPDRP

SEQ ID NO: 776217 - protein, 24 aa, Mycobacterium
RHAPVRWFEIDPCYVFHPLNGYSE

SEQ ID NO: 776218 - protein, 17 aa, Mycobacterium
RHCKVFIAHDLDVDNRR

SEQ ID NO: 776219 - protein, 18 aa, Mycobacterium
RHEPDVWTDVGWVPTDAG

SEQ ID NO: 776220 - protein, 19 aa, Mycobacterium
RHESVAVCQRAVGMINDQT

SEQ ID NO: 776221 - protein, 19 aa, Mycobacterium
RHFGCGFAPSGWDSLTKHL

SEQ ID NO: 776222 - protein, 17 aa, Mycobacterium
RHFHSFGGLSPNPSVLG

SEQ ID NO: 776223 - protein, 21 aa, Mycobacterium
RHFMYPIPYWLGLDIDTLIPR

SEQ ID NO: 776224 - protein, 19 aa, Mycobacterium
RHGEWLAPGGFDFGAWHFK

SEQ ID NO: 776225 - protein, 20 aa, Mycobacterium
RHGKNLPVRWGRRNRAMARR

SEQ ID NO: 776226 - protein, 19 aa, Mycobacterium
RHHLPLTFHGCYTPRVAAP

SEQ ID NO: 776227 - protein, 20 aa, Mycobacterium
RHIHDFPALWYVPAAGLVYI

SEQ ID NO: 776228 - protein, 23 aa, Mycobacterium
RHKVKRVEAMFGESLRSPALITA

SEQ ID NO: 776229 - protein, 24 aa, Mycobacterium
RHLEGPCVHAAWTRKVVVIDDLGS

SEQ ID NO: 776230 - protein, 18 aa, Mycobacterium
RHLELPAHDYAAVLRNSG

SEQ ID NO: 776231 - protein, 20 aa, Mycobacterium
RHLFSVLMDREWKHGVAAAV

SEQ ID NO: 776232 - protein, 24 aa, Mycobacterium
RHLFSVLMDREWKHGVAAAVDVTL

SEQ ID NO: 776233 - protein, 25 aa, Mycobacterium
RHLFSVLMDREWKYGVAAAVDVTLL

SEQ ID NO: 776234 - protein, 17 aa, Mycobacterium
RHLFTLLMDHHWQDGVS

SEQ ID NO: 776235 - protein, 19 aa, Mycobacterium
RHLGFAGTVERIWAGISPE

SEQ ID NO: 776236 - protein, 18 aa, Mycobacterium
RHLLSWGIGECGVCGEKL

SEQ ID NO: 776237 - protein, 17 aa, Mycobacterium
RHLPRPAGPTMTRKARR

SEQ ID NO: 776238 - protein, 17 aa, Mycobacterium
RHLPRWMYVPDAALPAL

SEQ ID NO: 776239 - protein, 17 aa, Mycobacterium
RHLRRLWAMPGTQLGVV

SEQ ID NO: 776240 - protein, 21 aa, Mycobacterium
RHMMCLRSGLFNEQTDLGMMM

SEQ ID NO: 776241 - protein, 23 aa, Mycobacterium
RHPDGLVWGHGWDESGWPERTPP

SEQ ID NO: 776242 - protein, 17 aa, Mycobacterium
RHPELKAAGAAMATTAL

SEQ ID NO: 776243 - protein, 19 aa, Mycobacterium
RHPHCAWTVIIDEAYPEVK

SEQ ID NO: 776244 - protein, 20 aa, Mycobacterium
RHPLAALGFMYSLRSTAYTE

SEQ ID NO: 776245 - protein, 22 aa, Mycobacterium
RHPLRLAAFGPRAALPATMMAR

SEQ ID NO: 776246 - protein, 22 aa, Mycobacterium
RHPLRLAAFGPRAALPATVMAR

SEQ ID NO: 776247 - protein, 18 aa, Mycobacterium
RHPLVATVCARERAQALV

SEQ ID NO: 776248 - protein, 22 aa, Mycobacterium
RHPRPAPRPSYTVLSSQRSAQA

SEQ ID NO: 776249 - protein, 18 aa, Mycobacterium
RHRCVGFVFQFFNLLPTL

SEQ ID NO: 776250 - protein, 18 aa, Mycobacterium
RHRFPIVLTESVEQFLTA

SEQ ID NO: 776251 - protein, 18 aa, Mycobacterium
RHRFPLVLTEAVTQFLGA

SEQ ID NO: 776252 - protein, 17 aa, Mycobacterium
RHRLWRRLLDWTASVTC

SEQ ID NO: 776253 - protein, 17 aa, Mycobacterium
RHRLWRRLLDWTATVTC

SEQ ID NO: 776254 - protein, 18 aa, Mycobacterium
RHTFAVNIDSFFYVTKAA

SEQ ID NO: 776255 - protein, 23 aa, Mycobacterium
RHVADRRALLLGRRQRGRPEQGD

SEQ ID NO: 776256 - protein, 17 aa, Mycobacterium
RHVKRSLVLDGLLGSAH

SEQ ID NO: 776257 - protein, 20 aa, Mycobacterium
RHYWDKHMCASFMVDPLGLR

SEQ ID NO: 776258 - protein, 18 aa, Mycobacterium
RIAAALNRMYRETADQMT

SEQ ID NO: 776259 - protein, 22 aa, Mycobacterium
RIAAIWRRFFGYDRIGVNDRFL

SEQ ID NO: 776260 - protein, 19 aa, Mycobacterium
RIAAKLGLRPDVRRVPLFG

SEQ ID NO: 776261 - protein, 17 aa, Mycobacterium
RIAALLLEINRRFGTPI

SEQ ID NO: 776262 - protein, 18 aa, Mycobacterium
RIAALVVQPGVEFDHVNV

SEQ ID NO: 776263 - protein, 18 aa, Mycobacterium
RIAAPCRLLDDWIAPGAA

SEQ ID NO: 776264 - protein, 18 aa, Mycobacterium
RIAARVCMWVNRFHEETT

SEQ ID NO: 776265 - protein, 17 aa, Mycobacterium
RIADGWLGTSFVPEGAG

SEQ ID NO: 776266 - protein, 18 aa, Mycobacterium
RIAEETARAEGKPEQALT

SEQ ID NO: 776267 - protein, 17 aa, Mycobacterium
RIAELLGVVGLRREDAS

SEQ ID NO: 776268 - protein, 19 aa, Mycobacterium
RIAELPWGGALVAHHYTRY

SEQ ID NO: 776269 - protein, 19 aa, Mycobacterium
RIALMFALGGSRVRIYNRT

SEQ ID NO: 776270 - protein, 17 aa, Mycobacterium
RIAPLVADWADALGRPI

SEQ ID NO: 776271 - protein, 17 aa, Mycobacterium
RIAPRPVSPWAQALRLA

SEQ ID NO: 776272 - protein, 20 aa, Mycobacterium
RIASMIPDARFEVMPGCGHW

SEQ ID NO: 776273 - protein, 19 aa, Mycobacterium
RIAVLLSPWMEPEPVCVAL

SEQ ID NO: 776274 - protein, 17 aa, Mycobacterium
RICASLGLPERVLTQQL

SEQ ID NO: 776275 - protein, 18 aa, Mycobacterium
RICASLGLPERVLTQQLR

SEQ ID NO: 776276 - protein, 29 aa, Mycobacterium
RICDEWAARGWLAIRYNLPYRRRRPKGPP

SEQ ID NO: 776277 - protein, 19 aa, Mycobacterium
RICGICGGSHLYKSAYALD

SEQ ID NO: 776278 - protein, 18 aa, Mycobacterium
RICGPRPVLAVLGGFHLG

SEQ ID NO: 776279 - protein, 25 aa, Mycobacterium
RICIPAPFYHCFGMVLGNLAATSHG

SEQ ID NO: 776280 - protein, 22 aa, Mycobacterium
RICIPVPFYHCFGMVMGNLAAT

SEQ ID NO: 776281 - protein, 17 aa, Mycobacterium
RIDPAVICLVHDGGDRA

SEQ ID NO: 776282 - protein, 20 aa, Mycobacterium
RIDTWDGFYCFAAELTSPML

SEQ ID NO: 776283 - protein, 17 aa, Mycobacterium
RIEAALVRMARSRHVPL

SEQ ID NO: 776284 - protein, 19 aa, Mycobacterium
RIEATGGLAGRCTQPDTVH

SEQ ID NO: 776285 - protein, 18 aa, Mycobacterium
RIEIEMIRLLTLKAAYLM

SEQ ID NO: 776286 - protein, 22 aa, Mycobacterium
RIEREAAWKIARRGMVRSFQTP

SEQ ID NO: 776287 - protein, 21 aa, Mycobacterium
RIEVELDQCWDLLRQRRALRE

SEQ ID NO: 776288 - protein, 17 aa, Mycobacterium
RIFDGLDRILKANSPEA

SEQ ID NO: 776289 - protein, 23 aa, Mycobacterium
RIFKRIRPAFTYQRSLDVLTAAR

SEQ ID NO: 776290 - protein, 18 aa, Mycobacterium
RIFKRVRPAFSYQRSLDV

SEQ ID NO: 776291 - protein, 17 aa, Mycobacterium
RIFRGAACVVHLAWGFQ

SEQ ID NO: 776292 - protein, 23 aa, Mycobacterium
RIFRRIRPAFSYRRSLDVLTAAR

SEQ ID NO: 776293 - protein, 23 aa, Mycobacterium
RIGAALRWFGLDGVEHPASADAA

SEQ ID NO: 776294 - protein, 19 aa, Mycobacterium
RIGCISRLFGTGIAIGANV

SEQ ID NO: 776295 - protein, 19 aa, Mycobacterium
RIGGNWAFGNPNGHSSAYR

SEQ ID NO: 776296 - protein, 18 aa, Mycobacterium
RIGIPMAAVYAFGSLAGL

SEQ ID NO: 776297 - protein, 19 aa, Mycobacterium
RIGKSFLLLFGVLPFGFDD

SEQ ID NO: 776298 - protein, 22 aa, Mycobacterium
RIGLPTCWDEWFPEVARCYSLG

SEQ ID NO: 776299 - protein, 17 aa, Mycobacterium
RIGPAVEEFVRWATPVI

SEQ ID NO: 776300 - protein, 19 aa, Mycobacterium
RIGPHRVWWLSGLAADPAV

SEQ ID NO: 776301 - protein, 23 aa, Mycobacterium
RIGWDKLPAWLGISVLVGIRDAL

SEQ ID NO: 776302 - protein, 18 aa, Mycobacterium
RIHAELTLGMGITVCSRT

SEQ ID NO: 776303 - protein, 24 aa, Mycobacterium
RIHQAGCMGCIGMGQAPATGRNSL

SEQ ID NO: 776304 - protein, 17 aa, Mycobacterium
RIKGAVEEFVRWATPIM

SEQ ID NO: 776305 - protein, 18 aa, Mycobacterium
RIKGAVEEFVRWATPIMT

SEQ ID NO: 776306 - protein, 18 aa, Mycobacterium
RIKLPKLGWVKFRASRSL

SEQ ID NO: 776307 - protein, 19 aa, Mycobacterium
RILAAAGLRDGRTVDDTSI

SEQ ID NO: 776308 - protein, 18 aa, Mycobacterium
RILAPRSRYEEIVEAVSA

SEQ ID NO: 776309 - protein, 24 aa, Mycobacterium
RILFSLPCYHMFGYIEGLLSAMFV

SEQ ID NO: 776310 - protein, 18 aa, Mycobacterium
RILLPRSRYDEGIEILKN

SEQ ID NO: 776311 - protein, 19 aa, Mycobacterium
RILLPRSRYDEGIEILKNM

SEQ ID NO: 776312 - protein, 26 aa, Mycobacterium
RILLQRSWIAIFWGRFAQAVEMIAQA

SEQ ID NO: 776313 - protein, 18 aa, Mycobacterium
RILTGEVFFCQGYSEPEA

SEQ ID NO: 776314 - protein, 18 aa, Mycobacterium
RIMLPRTTYEQIKVGRQV

SEQ ID NO: 776315 - protein, 17 aa, Mycobacterium
RIMPRIQALAVRDGLVV

SEQ ID NO: 776316 - protein, 19 aa, Mycobacterium
RINAMPAFRGRGFYWHSDF

SEQ ID NO: 776317 - protein, 19 aa, Mycobacterium
RINMMPGFTGGGFYWHSDF

SEQ ID NO: 776318 - protein, 21 aa, Mycobacterium
RINRLRLGVCVTDVGRRNPAV

SEQ ID NO: 776319 - protein, 19 aa, Mycobacterium
RIPDPVKRLLLGRRTITLD

SEQ ID NO: 776320 - protein, 18 aa, Mycobacterium
RIPIPMPVMRAAARLNDL

SEQ ID NO: 776321 - protein, 18 aa, Mycobacterium
RIPLEIDMVIDLRIDRPR

SEQ ID NO: 776322 - protein, 23 aa, Mycobacterium
RIPSAPIRLLWRLVYATPVRNFD

SEQ ID NO: 776323 - protein, 19 aa, Mycobacterium
RIPSTWCGVFGLKPQRDRI

SEQ ID NO: 776324 - protein, 18 aa, Mycobacterium
RIPSTWCGVFGLKTQRDR

SEQ ID NO: 776325 - protein, 20 aa, Mycobacterium
RIRCAAGAFAGLGIDKGDRV

SEQ ID NO: 776326 - protein, 18 aa, Mycobacterium
RIRFPAIVRTVAEVLRAA

SEQ ID NO: 776327 - protein, 19 aa, Mycobacterium
RIRHCAVYGPPAEHMTVRA

SEQ ID NO: 776328 - protein, 19 aa, Mycobacterium
RIRNVGGFSGMYSQGGDGN

SEQ ID NO: 776329 - protein, 18 aa, Mycobacterium
RISGELKGVIAQVESTGS

SEQ ID NO: 776330 - protein, 18 aa, Mycobacterium
RISRDCFRRAMELRSAPV

SEQ ID NO: 776331 - protein, 24 aa, Mycobacterium
RISRLRTAPPFAVHRFWLDRPVSA

SEQ ID NO: 776332 - protein, 24 aa, Mycobacterium
RISWLDSRHSFSFGEHYDPHNTHH

SEQ ID NO: 776333 - protein, 20 aa, Mycobacterium
RITAIAARFVAPVLPGDTLT

SEQ ID NO: 776334 - protein, 17 aa, Mycobacterium
RITALMCTADILALSAM

SEQ ID NO: 776335 - protein, 20 aa, Mycobacterium
RITAPRGWELVRYNGPLPSN

SEQ ID NO: 776336 - protein, 22 aa, Mycobacterium
RITARYAQHWNFVGGPPEEFAR

SEQ ID NO: 776337 - protein, 19 aa, Mycobacterium
RITKSIALFVARWCGVEDT

SEQ ID NO: 776338 - protein, 20 aa, Mycobacterium
RITLWAMAWLARAHFVSGDW

SEQ ID NO: 776339 - protein, 17 aa, Mycobacterium
RITLWRDYFDFFDMLKA

SEQ ID NO: 776340 - protein, 20 aa, Mycobacterium
RIVDLLMDFYPAAIAAFADP

SEQ ID NO: 776341 - protein, 23 aa, Mycobacterium
RIVPGASADLVWLDRDPRTVPPL

SEQ ID NO: 776342 - protein, 18 aa, Mycobacterium
RIVPTCWMVAEYIDKHPE

SEQ ID NO: 776343 - protein, 21 aa, Mycobacterium
RIVRYGCGWIPWGPAADDIQT

SEQ ID NO: 776344 - protein, 17 aa, Mycobacterium
RIVSFDAAGGWNIEEEG

SEQ ID NO: 776345 - protein, 19 aa, Mycobacterium
RIVSIEAFEHFGHENYDDF

SEQ ID NO: 776346 - protein, 26 aa, Mycobacterium
RIYRTGGELHLDWWYDIRRLGPTDVE

SEQ ID NO: 776347 - protein, 20 aa, Mycobacterium
RIYSVYGRNAWKSRVRAHPD

SEQ ID NO: 776348 - protein, 18 aa, Mycobacterium
RKAFNWGLGRVKADLDAK

SEQ ID NO: 776349 - protein, 18 aa, Mycobacterium
RKAKLPKGVMVWDRSRLI

SEQ ID NO: 776350 - protein, 18 aa, Mycobacterium
RKARAALVAGEIDAAEYE

SEQ ID NO: 776351 - protein, 21 aa, Mycobacterium
RKAVILGTGGFEWDQRLVEAY

SEQ ID NO: 776352 - protein, 17 aa, Mycobacterium
RKCRCARLVYANSMHVD

SEQ ID NO: 776353 - protein, 18 aa, Mycobacterium
RKDDPRIGQWLPEVAPST

SEQ ID NO: 776354 - protein, 19 aa, Mycobacterium
RKEACAVIGKSLRAVGEQV

SEQ ID NO: 776355 - protein, 19 aa, Mycobacterium
RKFYEAFAPYGLRETAVKP

SEQ ID NO: 776356 - protein, 20 aa, Mycobacterium
RKFYEAFSPYGLRETAIKPS

SEQ ID NO: 776357 - protein, 17 aa, Mycobacterium
RKGEITAEMAFIAEREG

SEQ ID NO: 776358 - protein, 19 aa, Mycobacterium
RKGILQFRWQRVSRQLTDV

SEQ ID NO: 776359 - protein, 20 aa, Mycobacterium
RKGLEFVRPVAVDLTYIPLV

SEQ ID NO: 776360 - protein, 17 aa, Mycobacterium
RKGMAVLLAALPAVLQR

SEQ ID NO: 776361 - protein, 17 aa, Mycobacterium
RKGMAVLLAALPKLVAR

SEQ ID NO: 776362 - protein, 17 aa, Mycobacterium
RKGMAVLLGALPAVVEP

SEQ ID NO: 776363 - protein, 19 aa, Mycobacterium
RKIAPDILLGIPYAREELD

SEQ ID NO: 776364 - protein, 22 aa, Mycobacterium
RKIPPGSGWRKFIYAISFRQIN

SEQ ID NO: 776365 - protein, 18 aa, Mycobacterium
RKIRAGWVTINHAFDMNA

SEQ ID NO: 776366 - protein, 17 aa, Mycobacterium
RKISERRVFPAVDVNPS

SEQ ID NO: 776367 - protein, 18 aa, Mycobacterium
RKIWSGAATFLFTRTTVG

SEQ ID NO: 776368 - protein, 18 aa, Mycobacterium
RKIWSGAGTFLFTRTTVG

SEQ ID NO: 776369 - protein, 19 aa, Mycobacterium
RKKLGTGLIEAFSSTCTHC

SEQ ID NO: 776370 - protein, 18 aa, Mycobacterium
RKKLVWWDAELGEWTGHD

SEQ ID NO: 776371 - protein, 25 aa, Mycobacterium
RKKRLMDLIHLWLIHRFKAEIVYYV

SEQ ID NO: 776372 - protein, 18 aa, Mycobacterium
RKLAELLTKFADKLDNDD

SEQ ID NO: 776373 - protein, 17 aa, Mycobacterium
RKLAWPKLKAHYGDRLE

SEQ ID NO: 776374 - protein, 23 aa, Mycobacterium
RKLEWADLFVLQFPLWWYSVPAI

SEQ ID NO: 776375 - protein, 17 aa, Mycobacterium
RKLFADWDVQARSVVEN

SEQ ID NO: 776376 - protein, 25 aa, Mycobacterium
RKLGVGWPKEFGGLGFGPIEQSIFV

SEQ ID NO: 776377 - protein, 17 aa, Mycobacterium
RKLILVIAVNRTFCGSK

SEQ ID NO: 776378 - protein, 19 aa, Mycobacterium
RKLLREWAIALGSDGAVFS

SEQ ID NO: 776379 - protein, 19 aa, Mycobacterium
RKLQVGNRVELARYAIEHG

SEQ ID NO: 776380 - protein, 21 aa, Mycobacterium
RKLRYLLNFARLADFEPGAAG

SEQ ID NO: 776381 - protein, 18 aa, Mycobacterium
RKPAHLVVRMYSALTEAV

SEQ ID NO: 776382 - protein, 17 aa, Mycobacterium
RKPALTCPAGIRCGVSQ

SEQ ID NO: 776383 - protein, 23 aa, Mycobacterium
RKPARIPVWFMRQAGRSLPEYRA

SEQ ID NO: 776384 - protein, 18 aa, Mycobacterium
RKPFWWSHFDRLNNPVDE

SEQ ID NO: 776385 - protein, 18 aa, Mycobacterium
RKPLVRRWYGFAEMQKDV

SEQ ID NO: 776386 - protein, 20 aa, Mycobacterium
RKPLVRRWYGFLDMQQEVAR

SEQ ID NO: 776387 - protein, 24 aa, Mycobacterium
RKPTGYDWFVLWTLSPDSLHVLEV

SEQ ID NO: 776388 - protein, 20 aa, Mycobacterium
RKPWVGDFWDMFGAGHMLEL

SEQ ID NO: 776389 - protein, 21 aa, Mycobacterium
RKRAKEMWYLNGKFTAAKAEA

SEQ ID NO: 776390 - protein, 18 aa, Mycobacterium
RKRHEALVGNPLFAKMEF

SEQ ID NO: 776391 - protein, 18 aa, Mycobacterium
RKRIPVVLFAEGGGGRPG

SEQ ID NO: 776392 - protein, 22 aa, Mycobacterium
RKSADLRPARSFAVDYAGWMGL

SEQ ID NO: 776393 - protein, 25 aa, Mycobacterium
RKSAFKRFGFHPEGTIGLWRALAEV

SEQ ID NO: 776394 - protein, 17 aa, Mycobacterium
RKSDSWQGFAWFVEQQC

SEQ ID NO: 776395 - protein, 17 aa, Mycobacterium
RKSFVCGFHGWTYGLDG

SEQ ID NO: 776396 - protein, 18 aa, Mycobacterium
RKSFVCGFHGWTYGLDGA

SEQ ID NO: 776397 - protein, 18 aa, Mycobacterium
RKSTGLEVSDRISVRISV

SEQ ID NO: 776398 - protein, 18 aa, Mycobacterium
RKSTGLEVSDRISVVMSV

SEQ ID NO: 776399 - protein, 17 aa, Mycobacterium
RKTDWLFPQYRELGAFL

SEQ ID NO: 776400 - protein, 20 aa, Mycobacterium
RKTLRELIGALILEPDDEAA

SEQ ID NO: 776401 - protein, 21 aa, Mycobacterium
RKVLPGYILVRMDLTDDSWAA

SEQ ID NO: 776402 - protein, 17 aa, Mycobacterium
RKVYLPSGGTLVIDRTE

SEQ ID NO: 776403 - protein, 18 aa, Mycobacterium
RKYFKSHLDSSVRTVAPR

SEQ ID NO: 776404 - protein, 17 aa, Mycobacterium
RKYKGACIFLNRPGFAG

SEQ ID NO: 776405 - protein, 20 aa, Mycobacterium
RLAAAIRLPAERVVWMNQVH

SEQ ID NO: 776406 - protein, 18 aa, Mycobacterium
RLAAFVGRHRFASISEAQ

SEQ ID NO: 776407 - protein, 20 aa, Mycobacterium
RLAALPGWVWRESREDLWER

SEQ ID NO: 776408 - protein, 20 aa, Mycobacterium
RLAAPWEFVDAGWVRAPRGS

SEQ ID NO: 776409 - protein, 18 aa, Mycobacterium
RLAAYHAFGEACDGITEL

SEQ ID NO: 776410 - protein, 19 aa, Mycobacterium
RLADAWVWDMYRPARFVKQ

SEQ ID NO: 776411 - protein, 18 aa, Mycobacterium
RLADYTGRILEWISVGQP

SEQ ID NO: 776412 - protein, 17 aa, Mycobacterium
RLAEAWDSVGLVCGDPD

SEQ ID NO: 776413 - protein, 19 aa, Mycobacterium
RLAEELVRIIGVLRGMQLK

SEQ ID NO: 776414 - protein, 17 aa, Mycobacterium
RLAESIVAAGAHVLAIK

SEQ ID NO: 776415 - protein, 22 aa, Mycobacterium
RLAGALNRRGVGFGDRVLILML

SEQ ID NO: 776416 - protein, 20 aa, Mycobacterium
RLAGIAWPHIDWSPHGRHPH

SEQ ID NO: 776417 - protein, 19 aa, Mycobacterium
RLAGMDVIASYCLTEPGAG

SEQ ID NO: 776418 - protein, 18 aa, Mycobacterium
RLAHVIVGVLAMRNHSHF

SEQ ID NO: 776419 - protein, 20 aa, Mycobacterium
RLAIVASTWHSQICDALLAG

SEQ ID NO: 776420 - protein, 20 aa, Mycobacterium
RLALDRVLLRAGADGPATDQ

SEQ ID NO: 776421 - protein, 22 aa, Mycobacterium
RLALGVGPSHHWIVRDMLGLPY

SEQ ID NO: 776422 - protein, 17 aa, Mycobacterium
RLALPHMIAEGGGSIIN

SEQ ID NO: 776423 - protein, 21 aa, Mycobacterium
RLANQLMAFHDQFAQALTAGA

SEQ ID NO: 776424 - protein, 20 aa, Mycobacterium
RLAPAPPYRNFVTWLADRDL

SEQ ID NO: 776425 - protein, 24 aa, Mycobacterium
RLAPARLTHCMRWLGAASRAQDIA

SEQ ID NO: 776426 - protein, 24 aa, Mycobacterium
RLAPELRGRLVWAWRADGANPAAR

SEQ ID NO: 776427 - protein, 20 aa, Mycobacterium
RLAPGLKRNSLIGGIRYYDT

SEQ ID NO: 776428 - protein, 21 aa, Mycobacterium
RLAPGLKRSSLIGGIRYYDTV

SEQ ID NO: 776429 - protein, 17 aa, Mycobacterium
RLAPGQRVWFSVKAHEV

SEQ ID NO: 776430 - protein, 20 aa, Mycobacterium
RLAQRLALAVGRRLDDAQPF

SEQ ID NO: 776431 - protein, 17 aa, Mycobacterium
RLARFGAGWIPWGPDAR

SEQ ID NO: 776432 - protein, 18 aa, Mycobacterium
RLARFLFRGNAADKLVGA

SEQ ID NO: 776433 - protein, 20 aa, Mycobacterium
RLARRVWPDHDWDAVGPTPH

SEQ ID NO: 776434 - protein, 19 aa, Mycobacterium
RLARYEIPTEIAIVDAIPR

SEQ ID NO: 776435 - protein, 19 aa, Mycobacterium
RLASSYGHWVYSIRAGGGA

SEQ ID NO: 776436 - protein, 20 aa, Mycobacterium
RLATRHLLRYPGLQRAAERG

SEQ ID NO: 776437 - protein, 18 aa, Mycobacterium
RLATRLGYSETVFVDLPA

SEQ ID NO: 776438 - protein, 20 aa, Mycobacterium
RLAWWPTRLPTLIVSGAADR

SEQ ID NO: 776439 - protein, 17 aa, Mycobacterium
RLCELDFEFPLAGGDAA

SEQ ID NO: 776440 - protein, 23 aa, Mycobacterium
RLCIPVPFYHCFGMVMGNLGCTT

SEQ ID NO: 776441 - protein, 24 aa, Mycobacterium
RLCIPVPFYHCFGMVMGNLGCTTH

SEQ ID NO: 776442 - protein, 23 aa, Mycobacterium
RLCPRAVVVPPRMSAYTRASEAV

SEQ ID NO: 776443 - protein, 17 aa, Mycobacterium
RLCPRFGQRLRTRPFDL

SEQ ID NO: 776444 - protein, 17 aa, Mycobacterium
RLCRELIDAGPPPRSTG

SEQ ID NO: 776445 - protein, 18 aa, Mycobacterium
RLCTCGPLGHTLRMPSHS

SEQ ID NO: 776446 - protein, 21 aa, Mycobacterium
RLDAKPALLRRAIAFIEGNAD

SEQ ID NO: 776447 - protein, 20 aa, Mycobacterium
RLDEALGWAHGSSRAILDGG

SEQ ID NO: 776448 - protein, 18 aa, Mycobacterium
RLDIPTVFVSGGPMEGGS

SEQ ID NO: 776449 - protein, 21 aa, Mycobacterium
RLDLPAIVVIGGYQRGGTWSG

SEQ ID NO: 776450 - protein, 17 aa, Mycobacterium
RLDQMIRYYVEHQLDVI

SEQ ID NO: 776451 - protein, 18 aa, Mycobacterium
RLDQMIRYYVEHQLDVII

SEQ ID NO: 776452 - protein, 17 aa, Mycobacterium
RLDREVRAAILTGAGEK

SEQ ID NO: 776453 - protein, 23 aa, Mycobacterium
RLDRRGRMLWSLPKGHIELGETA

SEQ ID NO: 776454 - protein, 18 aa, Mycobacterium
RLEAGGVTGQFWSVYVPP

SEQ ID NO: 776455 - protein, 20 aa, Mycobacterium
RLEAGRCLLDLRTVAPEEDE

SEQ ID NO: 776456 - protein, 19 aa, Mycobacterium
RLEDCVLRAAHWRSARDGL

SEQ ID NO: 776457 - protein, 18 aa, Mycobacterium
RLEGLEIIPSVLPTAPAG

SEQ ID NO: 776458 - protein, 21 aa, Mycobacterium
RLEGSAVFRWAAFEMGKVGQQ

SEQ ID NO: 776459 - protein, 18 aa, Mycobacterium
RLEKLWLPGVDRLLDCVE

SEQ ID NO: 776460 - protein, 17 aa, Mycobacterium
RLEKWWLPGPDRLLDCV

SEQ ID NO: 776461 - protein, 19 aa, Mycobacterium
RLELLLAEFRRRQADVARS

SEQ ID NO: 776462 - protein, 21 aa, Mycobacterium
RLEMLEGMGWLIVRVVAEDHP

SEQ ID NO: 776463 - protein, 23 aa, Mycobacterium
RLEPRPSVCAASFTTSDDLLSQW

SEQ ID NO: 776464 - protein, 19 aa, Mycobacterium
RLERTRISGVLINLQPDRS

SEQ ID NO: 776465 - protein, 18 aa, Mycobacterium
RLETLLALIEGWVQTVVT

SEQ ID NO: 776466 - protein, 18 aa, Mycobacterium
RLETLLALIEGWVQVVVA

SEQ ID NO: 776467 - protein, 18 aa, Mycobacterium
RLETLLALIEGWVQVVVT

SEQ ID NO: 776468 - protein, 18 aa, Mycobacterium
RLETLLALVEGWVQTVVS

SEQ ID NO: 776469 - protein, 21 aa, Mycobacterium
RLEYLRFSALSGRESIEQHRR

SEQ ID NO: 776470 - protein, 17 aa, Mycobacterium
RLFADTIGMSWRTYLLH

SEQ ID NO: 776471 - protein, 17 aa, Mycobacterium
RLFAGGFGRRFNQGGGG

SEQ ID NO: 776472 - protein, 19 aa, Mycobacterium
RLFCDMLPRDAVPPKLLRD

SEQ ID NO: 776473 - protein, 24 aa, Mycobacterium
RLFEARLGLITAIDHAWPPSEPEP

SEQ ID NO: 776474 - protein, 17 aa, Mycobacterium
RLFELIERMALPTVFFA

SEQ ID NO: 776475 - protein, 17 aa, Mycobacterium
RLFHGRGGTVGRGGGPS

SEQ ID NO: 776476 - protein, 20 aa, Mycobacterium
RLFLPYQVALEFQRNRLNVV

SEQ ID NO: 776477 - protein, 22 aa, Mycobacterium
RLFQIRHCMNLAGQVRQLPPFA

SEQ ID NO: 776478 - protein, 21 aa, Mycobacterium
RLFSGVGWLTIRLMDTVEQYA

SEQ ID NO: 776479 - protein, 23 aa, Mycobacterium
RLGFRRRSCCLFYRLPDGSLCGD

SEQ ID NO: 776480 - protein, 20 aa, Mycobacterium
RLGLESVPFLLSVGDLLLAW

SEQ ID NO: 776481 - protein, 19 aa, Mycobacterium
RLGLLKRREEVLPQLTHND

SEQ ID NO: 776482 - protein, 18 aa, Mycobacterium
RLGLWPSDVELLSKIVRY

SEQ ID NO: 776483 - protein, 20 aa, Mycobacterium
RLGLYWAQEALAFGMTKRPN

SEQ ID NO: 776484 - protein, 18 aa, Mycobacterium
RLGMAVRILERFPSRLAL

SEQ ID NO: 776485 - protein, 19 aa, Mycobacterium
RLGNKRLQVRWMTPVEYAR

SEQ ID NO: 776486 - protein, 17 aa, Mycobacterium
RLGPARTAAICAVSPAL

SEQ ID NO: 776487 - protein, 17 aa, Mycobacterium
RLGPGRTAAICAVSPAL

SEQ ID NO: 776488 - protein, 23 aa, Mycobacterium
RLGQRGPTEFGWDLETYAKRVEA

SEQ ID NO: 776489 - protein, 18 aa, Mycobacterium
RLGRFVGLVVIDRGHPRA

SEQ ID NO: 776490 - protein, 25 aa, Mycobacterium
RLGRKLRIAHAWSLSFDASWQPMIG

SEQ ID NO: 776491 - protein, 18 aa, Mycobacterium
RLGRPLRIAHAWSLSFDA

SEQ ID NO: 776492 - protein, 24 aa, Mycobacterium
RLGRRGPVHVVDWQSVQGLTPSAL

SEQ ID NO: 776493 - protein, 24 aa, Mycobacterium
RLGRRSNVYTTEWDHVQGLTPAGL

SEQ ID NO: 776494 - protein, 17 aa, Mycobacterium
RLGRWCVPGPVAESIAV

SEQ ID NO: 776495 - protein, 18 aa, Mycobacterium
RLGRWCVPGPVAESIAVA

SEQ ID NO: 776496 - protein, 20 aa, Mycobacterium
RLGSCALDLCMVAAGQLDAY

SEQ ID NO: 776497 - protein, 18 aa, Mycobacterium
RLGSDRGLARFIDQVARR

SEQ ID NO: 776498 - protein, 19 aa, Mycobacterium
RLGSELGVLGMAVPESAGG

SEQ ID NO: 776499 - protein, 18 aa, Mycobacterium
RLGTAIAERGWTLVSGGG

SEQ ID NO: 776500 - protein, 18 aa, Mycobacterium
RLGWSDTWVRAADGANPY

SEQ ID NO: 776501 - protein, 19 aa, Mycobacterium
RLHPAITVFAAIPQVRSST

SEQ ID NO: 776502 - protein, 24 aa, Mycobacterium
RLHPEVLAALGIREWDAVALTGTR

SEQ ID NO: 776503 - protein, 18 aa, Mycobacterium
RLHYLRWLLFDVGSGLHF

SEQ ID NO: 776504 - protein, 24 aa, Mycobacterium
RLIGWLHRIIDAFATDADTTLRDI

SEQ ID NO: 776505 - protein, 18 aa, Mycobacterium
RLIKVLRKRGRILQSAPN

SEQ ID NO: 776506 - protein, 19 aa, Mycobacterium
RLILADAIVRACRDQPDYL

SEQ ID NO: 776507 - protein, 20 aa, Mycobacterium
RLISEITWRTGLVADDVIAT

SEQ ID NO: 776508 - protein, 18 aa, Mycobacterium
RLITVILMRCGLRITDAL

SEQ ID NO: 776509 - protein, 19 aa, Mycobacterium
RLKFLVAFRPGFISPTLAA

SEQ ID NO: 776510 - protein, 18 aa, Mycobacterium
RLKPFDVRLHYFDTRRLP

SEQ ID NO: 776511 - protein, 20 aa, Mycobacterium
RLKRPIPFLPNTVGLITGRA

SEQ ID NO: 776512 - protein, 19 aa, Mycobacterium
RLKSGWLNGIKHWQVDYSG

SEQ ID NO: 776513 - protein, 17 aa, Mycobacterium
RLKTAADEIIRWATPIT

SEQ ID NO: 776514 - protein, 17 aa, Mycobacterium
RLLAADMVFDLPVVGEA

SEQ ID NO: 776515 - protein, 18 aa, Mycobacterium
RLLAAGLLRRIDDDTVIL

SEQ ID NO: 776516 - protein, 17 aa, Mycobacterium
RLLAAGLLRRLDEDTVI

SEQ ID NO: 776517 - protein, 17 aa, Mycobacterium
RLLAEPVGLIFAVRDHG

SEQ ID NO: 776518 - protein, 26 aa, Mycobacterium
RLLAEVLRLRGWRVDFLGAQVPTPHL

SEQ ID NO: 776519 - protein, 17 aa, Mycobacterium
RLLAGRRRLAAAIAGGT

SEQ ID NO: 776520 - protein, 18 aa, Mycobacterium
RLLARNGLSLQDFDFYEI

SEQ ID NO: 776521 - protein, 18 aa, Mycobacterium
RLLARNGLTLQDFDFYEI

SEQ ID NO: 776522 - protein, 18 aa, Mycobacterium
RLLASVPIGRFVTTIGTR

SEQ ID NO: 776523 - protein, 18 aa, Mycobacterium
RLLCEQVGAAALVIPEEF

SEQ ID NO: 776524 - protein, 18 aa, Mycobacterium
RLLCEQVGAAALVIPEEL

SEQ ID NO: 776525 - protein, 18 aa, Mycobacterium
RLLCEQVGAAALVVPEEL

SEQ ID NO: 776526 - protein, 26 aa, Mycobacterium
RLLDEWPRAGTVVVMLDGDCAFRQLD

SEQ ID NO: 776527 - protein, 19 aa, Mycobacterium
RLLDRASRWLISYRPQPLA

SEQ ID NO: 776528 - protein, 18 aa, Mycobacterium
RLLDRVASIDGIINTVKG

SEQ ID NO: 776529 - protein, 26 aa, Mycobacterium
RLLEAYARICGRWHAAVPVGNTLDTA

SEQ ID NO: 776530 - protein, 21 aa, Mycobacterium
RLLFDAGWMRWGWPTRIGGLG

SEQ ID NO: 776531 - protein, 18 aa, Mycobacterium
RLLGGPVMRRVQQVVHRL

SEQ ID NO: 776532 - protein, 19 aa, Mycobacterium
RLLGHIARPRNCTELNEAT

SEQ ID NO: 776533 - protein, 17 aa, Mycobacterium
RLLGKGIHPEQHIPPDV

SEQ ID NO: 776534 - protein, 19 aa, Mycobacterium
RLLIEVAWEALEDAGVAPH

SEQ ID NO: 776535 - protein, 20 aa, Mycobacterium
RLLLEVAWEALEHAGIPPSS

SEQ ID NO: 776536 - protein, 23 aa, Mycobacterium
RLLLEVVCARLLLPSASDTEAAL

SEQ ID NO: 776537 - protein, 18 aa, Mycobacterium
RLLLKFTVSSPYRCGLLH

SEQ ID NO: 776538 - protein, 19 aa, Mycobacterium
RLLLRDVFTAAGGTHDDWD

SEQ ID NO: 776539 - protein, 17 aa, Mycobacterium
RLLPGVRAVLCYRDDPG

SEQ ID NO: 776540 - protein, 19 aa, Mycobacterium
RLLPLTIGVLGDWGSGKSS

SEQ ID NO: 776541 - protein, 17 aa, Mycobacterium
RLLRLCARYSAEPGCGP

SEQ ID NO: 776542 - protein, 22 aa, Mycobacterium
RLLRLPIPVQRRVAAGVLSAGH

SEQ ID NO: 776543 - protein, 19 aa, Mycobacterium
RLLRPCYLAALSSLKNSPA

SEQ ID NO: 776544 - protein, 17 aa, Mycobacterium
RLLRPGGVVDMLTSEGG

SEQ ID NO: 776545 - protein, 19 aa, Mycobacterium
RLLRRYRFELAHPHYQPKW

SEQ ID NO: 776546 - protein, 19 aa, Mycobacterium
RLLTEIVRILGRFREPLTT

SEQ ID NO: 776547 - protein, 18 aa, Mycobacterium
RLLTSFFGVSGWGRILVP

SEQ ID NO: 776548 - protein, 19 aa, Mycobacterium
RLMAEVMVRAVLDRIPDYQ

SEQ ID NO: 776549 - protein, 17 aa, Mycobacterium
RLMMKYDPHFFAFLEIP

SEQ ID NO: 776550 - protein, 17 aa, Mycobacterium
RLMPDFWQFPTVSMGLG

SEQ ID NO: 776551 - protein, 18 aa, Mycobacterium
RLMRIYALIRLAYRVLPD

SEQ ID NO: 776552 - protein, 17 aa, Mycobacterium
RLMVRPGQVVSREDLLA

SEQ ID NO: 776553 - protein, 19 aa, Mycobacterium
RLNHQIGWLSPRTRTLVLG

SEQ ID NO: 776554 - protein, 18 aa, Mycobacterium
RLNIPAVFVSGGPMEGGR

SEQ ID NO: 776555 - protein, 18 aa, Mycobacterium
RLPAHLFGIGLYTVNLDL

SEQ ID NO: 776556 - protein, 25 aa, Mycobacterium
RLPAPPPYRRFVAWLAERDRDAARE

SEQ ID NO: 776557 - protein, 22 aa, Mycobacterium
RLPAPPSYRSYLMWLVAQDHAA

SEQ ID NO: 776558 - protein, 21 aa, Mycobacterium
RLPAPVPYRRFVSWLAEQDND

SEQ ID NO: 776559 - protein, 23 aa, Mycobacterium
RLPDALKRFPVTRVVSSPQRRAV

SEQ ID NO: 776560 - protein, 22 aa, Mycobacterium
RLPDAVRYSVRFGKPVLLPASV

SEQ ID NO: 776561 - protein, 20 aa, Mycobacterium
RLPDLIVCRPELAEQVLAVT

SEQ ID NO: 776562 - protein, 21 aa, Mycobacterium
RLPDLRCLMLTSFTSDEATLD

SEQ ID NO: 776563 - protein, 20 aa, Mycobacterium
RLPEGTPMFGFERVEGTIEE

SEQ ID NO: 776564 - protein, 23 aa, Mycobacterium
RLPELPGRVLIVGSGFIAAEFAH

SEQ ID NO: 776565 - protein, 19 aa, Mycobacterium
RLPQHWPWNHLIDTGWANP

SEQ ID NO: 776566 - protein, 23 aa, Mycobacterium
RLPRIAGPCGMVIFGVTGDLARK

SEQ ID NO: 776567 - protein, 25 aa, Mycobacterium
RLPRRISAAFTRFRCGPGAFKVDFA

SEQ ID NO: 776568 - protein, 18 aa, Mycobacterium
RLPSSFTNLFGLRVTTGL

SEQ ID NO: 776569 - protein, 18 aa, Mycobacterium
RLPTPALMHYLSEVDYVD

SEQ ID NO: 776570 - protein, 25 aa, Mycobacterium
RLQAGKCIRLDHSFSAKTISQVVGS

SEQ ID NO: 776571 - protein, 17 aa, Mycobacterium
RLQKRLGTTTVYVTHDQ

SEQ ID NO: 776572 - protein, 20 aa, Mycobacterium
RLQMITNRGVKVWPDGFPET

SEQ ID NO: 776573 - protein, 17 aa, Mycobacterium
RLQVRWMTPVEYARLMG

SEQ ID NO: 776574 - protein, 21 aa, Mycobacterium
RLRAAAAWMRTMFAVVPLAVG

SEQ ID NO: 776575 - protein, 17 aa, Mycobacterium
RLRAATVQLVIVGGGPG

SEQ ID NO: 776576 - protein, 19 aa, Mycobacterium
RLRAAVIARCIAAGVFGAM

SEQ ID NO: 776577 - protein, 21 aa, Mycobacterium
RLRAEMLHRIGMHDLLQPARL

SEQ ID NO: 776578 - protein, 21 aa, Mycobacterium
RLRAPVFNFIAPRLAGLPFSG

SEQ ID NO: 776579 - protein, 17 aa, Mycobacterium
RLRARGATRLVIAPWFL

SEQ ID NO: 776580 - protein, 18 aa, Mycobacterium
RLRCYVVGVARGAREPVI

SEQ ID NO: 776581 - protein, 17 aa, Mycobacterium
RLRCYVVGVSRGAREPL

SEQ ID NO: 776582 - protein, 19 aa, Mycobacterium
RLRDAGCDVVVWDLAGADI

SEQ ID NO: 776583 - protein, 20 aa, Mycobacterium
RLRDGRRVVGHKIGLTSEPM

SEQ ID NO: 776584 - protein, 20 aa, Mycobacterium
RLRDLLCTVLTPLDCDIVQA

SEQ ID NO: 776585 - protein, 17 aa, Mycobacterium
RLREFALREGLADAQQR

SEQ ID NO: 776586 - protein, 17 aa, Mycobacterium
RLREFALREGLADAWLR

SEQ ID NO: 776587 - protein, 18 aa, Mycobacterium
RLRELAVLRIAHLTKCEY

SEQ ID NO: 776588 - protein, 18 aa, Mycobacterium
RLRFKWMGLYTQREQGYD

SEQ ID NO: 776589 - protein, 18 aa, Mycobacterium
RLRGRPAIARRYLALEGH

SEQ ID NO: 776590 - protein, 18 aa, Mycobacterium
RLRHAGALADAVEKLDVV

SEQ ID NO: 776591 - protein, 18 aa, Mycobacterium
RLRHLRPFFLSPLATPNL

SEQ ID NO: 776592 - protein, 22 aa, Mycobacterium
RLRHPLAALGFVYGLRSTILST

SEQ ID NO: 776593 - protein, 21 aa, Mycobacterium
RLRKIFGKVGVVFKGSGFYRT

SEQ ID NO: 776594 - protein, 17 aa, Mycobacterium
RLRLCLVDGGLPEPETQ

SEQ ID NO: 776595 - protein, 18 aa, Mycobacterium
RLRLELDRGLGWKAEVEA

SEQ ID NO: 776596 - protein, 18 aa, Mycobacterium
RLRLELEQGLGWKAGVEA

SEQ ID NO: 776597 - protein, 19 aa, Mycobacterium
RLRQAPILALGGRPEELTD

SEQ ID NO: 776598 - protein, 19 aa, Mycobacterium
RLRRACALIADNLREPLTL

SEQ ID NO: 776599 - protein, 21 aa, Mycobacterium
RLRREGLAWITAHRGGNPAPV

SEQ ID NO: 776600 - protein, 22 aa, Mycobacterium
RLRRGQTLIGFLAPRNADNSIG

SEQ ID NO: 776601 - protein, 17 aa, Mycobacterium
RLRRRIAGVMGYSNDSA

SEQ ID NO: 776602 - protein, 20 aa, Mycobacterium
RLRRVGVTAAVLWVLDGNAR

SEQ ID NO: 776603 - protein, 20 aa, Mycobacterium
RLRSTPALRRLVAQTSLEPR

SEQ ID NO: 776604 - protein, 29 aa, Mycobacterium
RLRVPPAHFVPRFDIGMGIVALDQPIVDR

SEQ ID NO: 776605 - protein, 18 aa, Mycobacterium
RLRVRFMTDRLVFESQMD

SEQ ID NO: 776606 - protein, 20 aa, Mycobacterium
RLRWPCPVPGALPVSEVGDA

SEQ ID NO: 776607 - protein, 17 aa, Mycobacterium
RLRWRWRGGCDARVVKS

SEQ ID NO: 776608 - protein, 17 aa, Mycobacterium
RLRYAVVAHGGFGVAQR

SEQ ID NO: 776609 - protein, 19 aa, Mycobacterium
RLSAIASIGSDAWDRLFSG

SEQ ID NO: 776610 - protein, 20 aa, Mycobacterium
RLSALAGYRWITPMSYTLPF

SEQ ID NO: 776611 - protein, 17 aa, Mycobacterium
RLSARLIGQITWRTRLV

SEQ ID NO: 776612 - protein, 18 aa, Mycobacterium
RLSGEIDRPVSFALIQVD

SEQ ID NO: 776613 - protein, 17 aa, Mycobacterium
RLSLLWRGKGATLEAVA

SEQ ID NO: 776614 - protein, 19 aa, Mycobacterium
RLSPLTVRLMHVMSPMDHG

SEQ ID NO: 776615 - protein, 23 aa, Mycobacterium
RLSPRRVAAYLAKYVTKSLHDFG

SEQ ID NO: 776616 - protein, 18 aa, Mycobacterium
RLSRLGAIVGTAFQISDD

SEQ ID NO: 776617 - protein, 22 aa, Mycobacterium
RLSRLRILTALVLGRLTRSPLY

SEQ ID NO: 776618 - protein, 18 aa, Mycobacterium
RLSRQLCERWGIRQVPLH

SEQ ID NO: 776619 - protein, 17 aa, Mycobacterium
RLSVLGGDRPRWQTTGE

SEQ ID NO: 776620 - protein, 24 aa, Mycobacterium
RLSWARRTYRRWAAKHLHQARSLI

SEQ ID NO: 776621 - protein, 17 aa, Mycobacterium
RLSWDFLARSTAGLRDW

SEQ ID NO: 776622 - protein, 19 aa, Mycobacterium
RLTDFMTEYVFPAEADYDK

SEQ ID NO: 776623 - protein, 18 aa, Mycobacterium
RLTEVALWGDGWPLGVQR

SEQ ID NO: 776624 - protein, 18 aa, Mycobacterium
RLTLPAKFRDALAGGLMV

SEQ ID NO: 776625 - protein, 18 aa, Mycobacterium
RLTRFGALVRVPRSVEAL

SEQ ID NO: 776626 - protein, 19 aa, Mycobacterium
RLVADILRTLRWLNETTGI

SEQ ID NO: 776627 - protein, 19 aa, Mycobacterium
RLVALLGHRCKGADGQSTD

SEQ ID NO: 776628 - protein, 17 aa, Mycobacterium
RLVDFAAGLAFALRGSF

SEQ ID NO: 776629 - protein, 19 aa, Mycobacterium
RLVDRAGRWLLNYRPQPLA

SEQ ID NO: 776630 - protein, 23 aa, Mycobacterium
RLVELRGATLLAHNYQLPAIQDV

SEQ ID NO: 776631 - protein, 19 aa, Mycobacterium
RLVELYSAGLLKLDELVTR

SEQ ID NO: 776632 - protein, 18 aa, Mycobacterium
RLVGDTGWELLDSKFSVV

SEQ ID NO: 776633 - protein, 19 aa, Mycobacterium
RLVKYLAYGWSSLRSRPAL

SEQ ID NO: 776634 - protein, 18 aa, Mycobacterium
RLVLCGAYARGRAVRAVG

SEQ ID NO: 776635 - protein, 18 aa, Mycobacterium
RLVLDWSGSWGIRRSASR

SEQ ID NO: 776636 - protein, 24 aa, Mycobacterium
RLVRSGGLLSEWLLWRATKDADDA

SEQ ID NO: 776637 - protein, 18 aa, Mycobacterium
RLVTSMAILGHDFGMSDD

SEQ ID NO: 776638 - protein, 19 aa, Mycobacterium
RLVVEHSWRIGVVAQSHAA

SEQ ID NO: 776639 - protein, 18 aa, Mycobacterium
RLVVHPGELVNGQAARPR

SEQ ID NO: 776640 - protein, 19 aa, Mycobacterium
RLWCRLSVLAANFELPAAR

SEQ ID NO: 776641 - protein, 26 aa, Mycobacterium
RLWEALEQHLLCPFHYFGVHDAVDLG

SEQ ID NO: 776642 - protein, 19 aa, Mycobacterium
RLWRARRVLAVTFPAHSSS

SEQ ID NO: 776643 - protein, 17 aa, Mycobacterium
RLWSRIVAEVGRDYPDV

SEQ ID NO: 776644 - protein, 24 aa, Mycobacterium
RLWTGVPYQAIWFVQRRRQSAADH

SEQ ID NO: 776645 - protein, 21 aa, Mycobacterium
RLYEMRLRQGLSVKRSELPRH

SEQ ID NO: 776646 - protein, 20 aa, Mycobacterium
RLYGWHRAMRIFDGPDEVHM

SEQ ID NO: 776647 - protein, 27 aa, Mycobacterium
RLYKASWRFTPFFWQEIDEGILPALYA

SEQ ID NO: 776648 - protein, 18 aa, Mycobacterium
RLYLEEWVHLVNELREDL

SEQ ID NO: 776649 - protein, 18 aa, Mycobacterium
RMAAKALRPLPVAHKEMS

SEQ ID NO: 776650 - protein, 19 aa, Mycobacterium
RMAELQAMPGFRLNMDLAA

SEQ ID NO: 776651 - protein, 18 aa, Mycobacterium
RMAFRSAGYWDVTAELDA

SEQ ID NO: 776652 - protein, 24 aa, Mycobacterium
RMAPGHWSGAYACWGTENREAAVR

SEQ ID NO: 776653 - protein, 20 aa, Mycobacterium
RMASGEMRATMALTEPGGGS

SEQ ID NO: 776654 - protein, 18 aa, Mycobacterium
RMDLTFSLAEHWGAGGEP

SEQ ID NO: 776655 - protein, 18 aa, Mycobacterium
RMDLTFSLAERWSEAGEP

SEQ ID NO: 776656 - protein, 21 aa, Mycobacterium
RMDRGRLGALIAETAQAATYR

SEQ ID NO: 776657 - protein, 22 aa, Mycobacterium
RMEIELDQCWDLLRQRRALRES

SEQ ID NO: 776658 - protein, 18 aa, Mycobacterium
RMEKEIADVIALQEKLGL

SEQ ID NO: 776659 - protein, 21 aa, Mycobacterium
RMEPGELVALLGPSGCGKTTA

SEQ ID NO: 776660 - protein, 17 aa, Mycobacterium
RMFDLLVRMGYKEIEVG

SEQ ID NO: 776661 - protein, 18 aa, Mycobacterium
RMFIPGIENLVFMGFAQA

SEQ ID NO: 776662 - protein, 19 aa, Mycobacterium
RMGGWRLAPPLLVDQLAGL

SEQ ID NO: 776663 - protein, 18 aa, Mycobacterium
RMGRFTNFCNLFDMCAIA

SEQ ID NO: 776664 - protein, 25 aa, Mycobacterium
RMGRMIELIQCWKAEPPRLAEIAYC

SEQ ID NO: 776665 - protein, 17 aa, Mycobacterium
RMGSVVLRNGRRAFRMP

SEQ ID NO: 776666 - protein, 18 aa, Mycobacterium
RMHGYWALHEGCLQLRGD

SEQ ID NO: 776667 - protein, 19 aa, Mycobacterium
RMHGYWALHEGCLQLRGEA

SEQ ID NO: 776668 - protein, 20 aa, Mycobacterium
RMHLGAGPGPMLAAATAWDG

SEQ ID NO: 776669 - protein, 20 aa, Mycobacterium
RMIKAGLIAPRFTMRQGRRI

SEQ ID NO: 776670 - protein, 17 aa, Mycobacterium
RMKDLLIVYGRNHYPED

SEQ ID NO: 776671 - protein, 19 aa, Mycobacterium
RMKGRNVLHALGFDAFGLP

SEQ ID NO: 776672 - protein, 26 aa, Mycobacterium
RMLALTARYAHEWNQWSSPGTFREVS

SEQ ID NO: 776673 - protein, 18 aa, Mycobacterium
RMLFPSLYRLAAAGRLPA

SEQ ID NO: 776674 - protein, 24 aa, Mycobacterium
RMLTLPATFGLYVERAWPRHRRLA

SEQ ID NO: 776675 - protein, 25 aa, Mycobacterium
RMLTLPGTFAMYLERAWPRHRRLGG

SEQ ID NO: 776676 - protein, 22 aa, Mycobacterium
RMMTGNFTFRRCESMRPQIQEM

SEQ ID NO: 776677 - protein, 20 aa, Mycobacterium
RMPNGRMPLALWVVGERSLA

SEQ ID NO: 776678 - protein, 21 aa, Mycobacterium
RMRVAPSVFKHVWGVLRLACE

SEQ ID NO: 776679 - protein, 26 aa, Mycobacterium
RMSWPHGRLRYYLAMLAELSQLRLLP

SEQ ID NO: 776680 - protein, 17 aa, Mycobacterium
RMYRAADGYVFLAAPLP

SEQ ID NO: 776681 - protein, 29 aa, Mycobacterium
RNAEIFYGRWGWWPMEGWLSSFADQGLIR

SEQ ID NO: 776682 - protein, 19 aa, Mycobacterium
RNAFVKLVLSNVFGQNAPL

SEQ ID NO: 776683 - protein, 24 aa, Mycobacterium
RNAGIRLGWRSSWVETVLGECLAV

SEQ ID NO: 776684 - protein, 17 aa, Mycobacterium
RNAGLLRWFGDDNLGRD

SEQ ID NO: 776685 - protein, 17 aa, Mycobacterium
RNCIEWPEISFGLAKAG

SEQ ID NO: 776686 - protein, 22 aa, Mycobacterium
RNCYRPQWCRVIDYPFTAGADV

SEQ ID NO: 776687 - protein, 25 aa, Mycobacterium
RNEFAARLMLRFAFERPGRKAATLQ

SEQ ID NO: 776688 - protein, 17 aa, Mycobacterium
RNFLYPRWSDFFDGIDP

SEQ ID NO: 776689 - protein, 21 aa, Mycobacterium
RNGRPRIAGVSSFGFAGTNAH

SEQ ID NO: 776690 - protein, 20 aa, Mycobacterium
RNGSRWALVVGRTLPQRLET

SEQ ID NO: 776691 - protein, 23 aa, Mycobacterium
RNGWPNRCLPILIANQSGWELRN

SEQ ID NO: 776692 - protein, 17 aa, Mycobacterium
RNGWYWTGDLGYRDEAG

SEQ ID NO: 776693 - protein, 20 aa, Mycobacterium
RNHISFGFGVHRCMGNRLAE

SEQ ID NO: 776694 - protein, 25 aa, Mycobacterium
RNIASIPGGLRWTWETMKPLYTNGA

SEQ ID NO: 776695 - protein, 24 aa, Mycobacterium
RNIWQCPVVLLADVRSVGVQGDGR

SEQ ID NO: 776696 - protein, 21 aa, Mycobacterium
RNKERLRRVLITEVGCPVSVT

SEQ ID NO: 776697 - protein, 20 aa, Mycobacterium
RNKTRLAALRVKDFGERQVM

SEQ ID NO: 776698 - protein, 18 aa, Mycobacterium
RNLLPVPWVEPVDIANAV

SEQ ID NO: 776699 - protein, 18 aa, Mycobacterium
RNLPGAQVRFVWHEAGPI

SEQ ID NO: 776700 - protein, 23 aa, Mycobacterium
RNLPGVAFAHDWITSARRYDGTL

SEQ ID NO: 776701 - protein, 19 aa, Mycobacterium
RNLPSAFQVKAFRDATGET

SEQ ID NO: 776702 - protein, 17 aa, Mycobacterium
RNLREVYEWEQTRSQGL

SEQ ID NO: 776703 - protein, 18 aa, Mycobacterium
RNMARLGSFFSDRWMESL

SEQ ID NO: 776704 - protein, 17 aa, Mycobacterium
RNPALLLLHGFPTSSHM

SEQ ID NO: 776705 - protein, 17 aa, Mycobacterium
RNPLRFAPRPDVDADGW

SEQ ID NO: 776706 - protein, 20 aa, Mycobacterium
RNPSRFMAMAGCFVDDHADR

SEQ ID NO: 776707 - protein, 17 aa, Mycobacterium
RNQLRVAMFAAIDPEDI

SEQ ID NO: 776708 - protein, 22 aa, Mycobacterium
RNRCYFCKSHLYTAIRELPTCD

SEQ ID NO: 776709 - protein, 18 aa, Mycobacterium
RNRECLLRLAAMAERFEP

SEQ ID NO: 776710 - protein, 18 aa, Mycobacterium
RNRFVQLVASNVLGLNAP

SEQ ID NO: 776711 - protein, 18 aa, Mycobacterium
RNRGFRVLAGYIFGANHA

SEQ ID NO: 776712 - protein, 22 aa, Mycobacterium
RNRISGAFSVRFARPGETVVTL

SEQ ID NO: 776713 - protein, 17 aa, Mycobacterium
RNSQSWRFAPFFHALLD

SEQ ID NO: 776714 - protein, 21 aa, Mycobacterium
RNVEIPDHFRIFVNDKLTRLE

SEQ ID NO: 776715 - protein, 21 aa, Mycobacterium
RNVEIPDHFRIYVSQKLARLE

SEQ ID NO: 776716 - protein, 28 aa, Mycobacterium
RNWEGLTAWAVRWLRDFTGHHPSPGLDA

SEQ ID NO: 776717 - protein, 24 aa, Mycobacterium
RNWNVDVAQAFHWTRHALRRPLAP

SEQ ID NO: 776718 - protein, 17 aa, Mycobacterium
RNWPTLRGSGLIDPDGP

SEQ ID NO: 776719 - protein, 18 aa, Mycobacterium
RPAARRSGRRFSMRRGVR

SEQ ID NO: 776720 - protein, 19 aa, Mycobacterium
RPAAVLLHLGPGLGNGLAN

SEQ ID NO: 776721 - protein, 20 aa, Mycobacterium
RPADEVRFLMGFNRDVVKRR

SEQ ID NO: 776722 - protein, 21 aa, Mycobacterium
RPAFAYWGWRAITDDPDPWNP

SEQ ID NO: 776723 - protein, 17 aa, Mycobacterium
RPAFPVMCDNGYGRIVL

SEQ ID NO: 776724 - protein, 21 aa, Mycobacterium
RPAGLPGLRQKYGLDIAPANF

SEQ ID NO: 776725 - protein, 19 aa, Mycobacterium
RPAGWWIRRRANEVAVHRA

SEQ ID NO: 776726 - protein, 20 aa, Mycobacterium
RPAKEGEEVLDFGALPPELN

SEQ ID NO: 776727 - protein, 20 aa, Mycobacterium
RPALAISLWAQYMLDNFATV

SEQ ID NO: 776728 - protein, 19 aa, Mycobacterium
RPALEAALGILRDITSGPA

SEQ ID NO: 776729 - protein, 26 aa, Mycobacterium
RPALPWTGVRTCRAWGAASIQQHRYA

SEQ ID NO: 776730 - protein, 17 aa, Mycobacterium
RPAMICDIDHTIPFNHQ

SEQ ID NO: 776731 - protein, 19 aa, Mycobacterium
RPANWWIRRRLHEVAVHRA

SEQ ID NO: 776732 - protein, 20 aa, Mycobacterium
RPAPAGADWPAEAVWPPHGV

SEQ ID NO: 776733 - protein, 22 aa, Mycobacterium
RPAPNWWARLVLRMRSQRAVRR

SEQ ID NO: 776734 - protein, 24 aa, Mycobacterium
RPAPRPAPQFEVMYRLDGCEPAAA

SEQ ID NO: 776735 - protein, 23 aa, Mycobacterium
RPAPSRLRFDSMWTQSRRDILEP

SEQ ID NO: 776736 - protein, 18 aa, Mycobacterium
RPAPWPVASGVYLVRTLD

SEQ ID NO: 776737 - protein, 19 aa, Mycobacterium
RPAPWRGAMEIDRLNVAIG

SEQ ID NO: 776738 - protein, 19 aa, Mycobacterium
RPARGRPVAAWSLAADEAV

SEQ ID NO: 776739 - protein, 22 aa, Mycobacterium
RPATVVEFGMSFGISAVHLASA

SEQ ID NO: 776740 - protein, 17 aa, Mycobacterium
RPAVHALYGFARRADDV

SEQ ID NO: 776741 - protein, 21 aa, Mycobacterium
RPAVIPLSFAQNRLWFIQQLQ

SEQ ID NO: 776742 - protein, 21 aa, Mycobacterium
RPAVIPLSFAQSRLWFLDQLQ

SEQ ID NO: 776743 - protein, 21 aa, Mycobacterium
RPAVVPLSFAQNRLWFLDQLQ

SEQ ID NO: 776744 - protein, 20 aa, Mycobacterium
RPAVVPLSFAQQRLWFIDQL

SEQ ID NO: 776745 - protein, 21 aa, Mycobacterium
RPAVVPLSFAQSRLWFLDQLQ

SEQ ID NO: 776746 - protein, 18 aa, Mycobacterium
RPAWIADLHNVFGSATAQ

SEQ ID NO: 776747 - protein, 18 aa, Mycobacterium
RPDAAPGILIPFFASHTA

SEQ ID NO: 776748 - protein, 25 aa, Mycobacterium
RPDAFPLIITHGWPGSIVEFQKVIA

SEQ ID NO: 776749 - protein, 25 aa, Mycobacterium
RPDAFPLLLTHGWPGSIVEFHKVIE

SEQ ID NO: 776750 - protein, 17 aa, Mycobacterium
RPDARILLCSSVSGVWG

SEQ ID NO: 776751 - protein, 21 aa, Mycobacterium
RPDARLPLARRVTGECLAEDL

SEQ ID NO: 776752 - protein, 21 aa, Mycobacterium
RPDELHLGFNFRLARIEFDGA

SEQ ID NO: 776753 - protein, 21 aa, Mycobacterium
RPDELHLGFNFRLARTDFDAA

SEQ ID NO: 776754 - protein, 17 aa, Mycobacterium
RPDEWPEQVGLDWFPPG

SEQ ID NO: 776755 - protein, 18 aa, Mycobacterium
RPDFKNRILRAFFEGNRH

SEQ ID NO: 776756 - protein, 18 aa, Mycobacterium
RPDGKLVHAALRINGFTV

SEQ ID NO: 776757 - protein, 18 aa, Mycobacterium
RPDHATLYVARWLHPGQR

SEQ ID NO: 776758 - protein, 23 aa, Mycobacterium
RPDLDVDLVYRFIRDTTWVSVRW

SEQ ID NO: 776759 - protein, 19 aa, Mycobacterium
RPDLEIWYTLPVLPSGLTA

SEQ ID NO: 776760 - protein, 20 aa, Mycobacterium
RPDLLVSLLTYWQRHPALSY

SEQ ID NO: 776761 - protein, 24 aa, Mycobacterium
RPDPFCAMESCWLKHMESAHRDVV

SEQ ID NO: 776762 - protein, 24 aa, Mycobacterium
RPDSSIFGLSWAMAAPAWVAVAIP

SEQ ID NO: 776763 - protein, 19 aa, Mycobacterium
RPDTVGFAFHFGDQPFGRV

SEQ ID NO: 776764 - protein, 25 aa, Mycobacterium
RPDVATGLMPLRWGTGYMLGSTRFG

SEQ ID NO: 776765 - protein, 20 aa, Mycobacterium
RPEECQRLGLPVFVKPARGG

SEQ ID NO: 776766 - protein, 17 aa, Mycobacterium
RPEFRRRGLARALLAEL

SEQ ID NO: 776767 - protein, 19 aa, Mycobacterium
RPEGLRRWMAITARIEPYD

SEQ ID NO: 776768 - protein, 18 aa, Mycobacterium
RPEPCWDPTAADWWSYEE

SEQ ID NO: 776769 - protein, 20 aa, Mycobacterium
RPEPRLALVAMGRRDVSFDQ

SEQ ID NO: 776770 - protein, 18 aa, Mycobacterium
RPESAADEIVRWATPVTC

SEQ ID NO: 776771 - protein, 18 aa, Mycobacterium
RPETAADEIVRWATPVTS

SEQ ID NO: 776772 - protein, 22 aa, Mycobacterium
RPETPCAVVAFASWPQEVVLRG

SEQ ID NO: 776773 - protein, 17 aa, Mycobacterium
RPEYAFRHPLIRMVALE

SEQ ID NO: 776774 - protein, 18 aa, Mycobacterium
RPFFCGTYYPKANFLQLL

SEQ ID NO: 776775 - protein, 25 aa, Mycobacterium
RPFLRLEGTAVFRWAAFEMGKVGQR

SEQ ID NO: 776776 - protein, 17 aa, Mycobacterium
RPGAIIRDLDLLRPIYA

SEQ ID NO: 776777 - protein, 18 aa, Mycobacterium
RPGAKLAAWAPIASAAPP

SEQ ID NO: 776778 - protein, 17 aa, Mycobacterium
RPGCDVAGYQCEVHHVA

SEQ ID NO: 776779 - protein, 17 aa, Mycobacterium
RPGCDVPGYQCEVHHVA

SEQ ID NO: 776780 - protein, 18 aa, Mycobacterium
RPGDEVYVSWAPDASLVL

SEQ ID NO: 776781 - protein, 19 aa, Mycobacterium
RPGEFMMMYAFGIGEIAVS

SEQ ID NO: 776782 - protein, 22 aa, Mycobacterium
RPGELRIGYSWSSAINPHPDRE

SEQ ID NO: 776783 - protein, 19 aa, Mycobacterium
RPGGAFPFLGIPLGDLADG

SEQ ID NO: 776784 - protein, 20 aa, Mycobacterium
RPGGRLGLVWNTRDERLGWV

SEQ ID NO: 776785 - protein, 19 aa, Mycobacterium
RPGHEVRWTVLLDGPVRIS

SEQ ID NO: 776786 - protein, 19 aa, Mycobacterium
RPGLIHIYHGLTWGPLIRE

SEQ ID NO: 776787 - protein, 17 aa, Mycobacterium
RPGMRLAVIYDPKDHNR

SEQ ID NO: 776788 - protein, 17 aa, Mycobacterium
RPGMSRVLYALPIEFDI

SEQ ID NO: 776789 - protein, 23 aa, Mycobacterium
RPGNWAGAYACWGTENREAAVRF

SEQ ID NO: 776790 - protein, 17 aa, Mycobacterium
RPGPDLVDLFPAGRAQP

SEQ ID NO: 776791 - protein, 18 aa, Mycobacterium
RPGPRCRLGVLVDHLVPG

SEQ ID NO: 776792 - protein, 19 aa, Mycobacterium
RPGPVAVMYLDLDRLKPIN

SEQ ID NO: 776793 - protein, 19 aa, Mycobacterium
RPGQKLRIVKYLAYGWSSL

SEQ ID NO: 776794 - protein, 22 aa, Mycobacterium
RPGQTRWRLAVEKVLRGVGLRL

SEQ ID NO: 776795 - protein, 17 aa, Mycobacterium
RPGRCVAVLMERSAPAI

SEQ ID NO: 776796 - protein, 20 aa, Mycobacterium
RPGSEISIADVLRCIDGPLA

SEQ ID NO: 776797 - protein, 18 aa, Mycobacterium
RPGTAADEIVRWATPVTS

SEQ ID NO: 776798 - protein, 20 aa, Mycobacterium
RPGTLEKWGLGPERLDEVNP

SEQ ID NO: 776799 - protein, 20 aa, Mycobacterium
RPGTLEKWGLGPSEIKQKNP

SEQ ID NO: 776800 - protein, 20 aa, Mycobacterium
RPGTLEKWGLGYDVLSARNP

SEQ ID NO: 776801 - protein, 19 aa, Mycobacterium
RPGVEHLLRYGATDRVLLS

SEQ ID NO: 776802 - protein, 24 aa, Mycobacterium
RPGVELRLLQTMLALFDLVRKAQG

SEQ ID NO: 776803 - protein, 18 aa, Mycobacterium
RPGVPVLFLDTGYHFAET

SEQ ID NO: 776804 - protein, 18 aa, Mycobacterium
RPGWHVECAAIASSRIGS

SEQ ID NO: 776805 - protein, 21 aa, Mycobacterium
RPGWLPWVIHAMRLGAGVRDG

SEQ ID NO: 776806 - protein, 23 aa, Mycobacterium
RPIAVEAYGLFIFRDCIEATGGS

SEQ ID NO: 776807 - protein, 17 aa, Mycobacterium
RPIDFWPANTTVNIDAS

SEQ ID NO: 776808 - protein, 19 aa, Mycobacterium
RPIEWRYTNDPAWIMRDKG

SEQ ID NO: 776809 - protein, 19 aa, Mycobacterium
RPIEWRYTNDPAWVMRDKG

SEQ ID NO: 776810 - protein, 24 aa, Mycobacterium
RPIKLMGIDSVFPLYLTLDSALSS

SEQ ID NO: 776811 - protein, 19 aa, Mycobacterium
RPITELGMVKSIDTEPDGG

SEQ ID NO: 776812 - protein, 21 aa, Mycobacterium
RPKAIEFFAGIGLARMGLEKA

SEQ ID NO: 776813 - protein, 19 aa, Mycobacterium
RPKLVFVFDEAHLLFADAS

SEQ ID NO: 776814 - protein, 29 aa, Mycobacterium
RPLDGFPERRARLMLEMHVLGPLQLSQLA

SEQ ID NO: 776815 - protein, 17 aa, Mycobacterium
RPLFFALQCMPLNRVRR

SEQ ID NO: 776816 - protein, 19 aa, Mycobacterium
RPLHRPLRALPYVADDLDA

SEQ ID NO: 776817 - protein, 19 aa, Mycobacterium
RPLLDLWWDYELDGDEPSG

SEQ ID NO: 776818 - protein, 18 aa, Mycobacterium
RPLLDVMFAGGREAGVPP

SEQ ID NO: 776819 - protein, 17 aa, Mycobacterium
RPLPVWKRRINDYAENA

SEQ ID NO: 776820 - protein, 17 aa, Mycobacterium
RPLRAKFGFVFQDPATA

SEQ ID NO: 776821 - protein, 17 aa, Mycobacterium
RPLRPSFVDGLRNEIQI

SEQ ID NO: 776822 - protein, 17 aa, Mycobacterium
RPLRPSFVDGLRNEIQV

SEQ ID NO: 776823 - protein, 18 aa, Mycobacterium
RPLRPSFVNGLRNEIQVV

SEQ ID NO: 776824 - protein, 17 aa, Mycobacterium
RPLRPSFVSGLRNEIQV

SEQ ID NO: 776825 - protein, 17 aa, Mycobacterium
RPLSFWPAHTAVTVDAG

SEQ ID NO: 776826 - protein, 17 aa, Mycobacterium
RPLSSPHPPIWIGGNTT

SEQ ID NO: 776827 - protein, 19 aa, Mycobacterium
RPLSWRLVLTIGEPGDPTG

SEQ ID NO: 776828 - protein, 17 aa, Mycobacterium
RPLVAISAAVEWSSAQD

SEQ ID NO: 776829 - protein, 19 aa, Mycobacterium
RPLVPAMFSGVLSRLRRTH

SEQ ID NO: 776830 - protein, 17 aa, Mycobacterium
RPLVPIYLGDDITDEDA

SEQ ID NO: 776831 - protein, 21 aa, Mycobacterium
RPLVRLRVPFTVNRTDVDDVE

SEQ ID NO: 776832 - protein, 18 aa, Mycobacterium
RPLWELHVIHGLAGDRVA

SEQ ID NO: 776833 - protein, 18 aa, Mycobacterium
RPLWEMYLIEGLADGRIA

SEQ ID NO: 776834 - protein, 19 aa, Mycobacterium
RPLWEMYLIEGLEKGRVAL

SEQ ID NO: 776835 - protein, 19 aa, Mycobacterium
RPLWEVYLIQGLQDDKVAL

SEQ ID NO: 776836 - protein, 19 aa, Mycobacterium
RPMAEFESAVGMFANTVLL

SEQ ID NO: 776837 - protein, 26 aa, Mycobacterium
RPMILKRFVKGIAQEAVFQKRVPEKR

SEQ ID NO: 776838 - protein, 21 aa, Mycobacterium
RPPACRFWNLVVWNQFMAVPG

SEQ ID NO: 776839 - protein, 19 aa, Mycobacterium
RPPACRFWNMVVWNQFMAT

SEQ ID NO: 776840 - protein, 24 aa, Mycobacterium
RPPARLIGWTARFLGMVHPGDEVD

SEQ ID NO: 776841 - protein, 24 aa, Mycobacterium
RPPARLIGWTARFLGMVRPGDEVA

SEQ ID NO: 776842 - protein, 24 aa, Mycobacterium
RPPARLVGWTARFLGMVRPGDDVD

SEQ ID NO: 776843 - protein, 21 aa, Mycobacterium
RPPFLKRLVLRTAARLSRRGR

SEQ ID NO: 776844 - protein, 19 aa, Mycobacterium
RPPFWQDMVELGWLGLHID

SEQ ID NO: 776845 - protein, 19 aa, Mycobacterium
RPPFWQNLVELGWLGLHVD

SEQ ID NO: 776846 - protein, 19 aa, Mycobacterium
RPPHLKAIFPLAVTSDLYE

SEQ ID NO: 776847 - protein, 22 aa, Mycobacterium
RPPPCRFWNLVVWNQFMATFGA

SEQ ID NO: 776848 - protein, 21 aa, Mycobacterium
RPPSCRFWNLVVWNQFMATCG

SEQ ID NO: 776849 - protein, 18 aa, Mycobacterium
RPPSFTSRLSRDWTPLPE

SEQ ID NO: 776850 - protein, 20 aa, Mycobacterium
RPPWECWVIEGLKGGRWAIL

SEQ ID NO: 776851 - protein, 18 aa, Mycobacterium
RPQFSAVLECSAAARELG

SEQ ID NO: 776852 - protein, 25 aa, Mycobacterium
RPQLAVTFRNGWLWATVEGRAELVG

SEQ ID NO: 776853 - protein, 26 aa, Mycobacterium
RPQLAVTFRNGWRWATVEGGAELAGP

SEQ ID NO: 776854 - protein, 20 aa, Mycobacterium
RPQLRLEIGYALQCRVDLNR

SEQ ID NO: 776855 - protein, 20 aa, Mycobacterium
RPQMGIAAWIIPSIVAFGTD

SEQ ID NO: 776856 - protein, 19 aa, Mycobacterium
RPQMGIASWIIPSIVAFGT

SEQ ID NO: 776857 - protein, 19 aa, Mycobacterium
RPQMGIATWIIPSIVAFGT

SEQ ID NO: 776858 - protein, 17 aa, Mycobacterium
RPQRPQLVLARIARAVP

SEQ ID NO: 776859 - protein, 23 aa, Mycobacterium
RPQWRVDLIPSYKAHRVAEPEPD

SEQ ID NO: 776860 - protein, 23 aa, Mycobacterium
RPQWRVDLIPSYKAHRVLEENPA

SEQ ID NO: 776861 - protein, 19 aa, Mycobacterium
RPRAGFAIAGVVPGRQLSL

SEQ ID NO: 776862 - protein, 17 aa, Mycobacterium
RPRFEIFVYSPRVEGVH

SEQ ID NO: 776863 - protein, 17 aa, Mycobacterium
RPRIVTIVDELLDAMLA

SEQ ID NO: 776864 - protein, 26 aa, Mycobacterium
RPRKRWALKGFHGFRLKELFDTYPDA

SEQ ID NO: 776865 - protein, 23 aa, Mycobacterium
RPRKSRPAVPAWEDVLLGVRSSG

SEQ ID NO: 776866 - protein, 25 aa, Mycobacterium
RPRKYWVLKGFHGFRLKELFDTYPD

SEQ ID NO: 776867 - protein, 17 aa, Mycobacterium
RPRLAFRTIHGYRRAYR

SEQ ID NO: 776868 - protein, 19 aa, Mycobacterium
RPRLKTSLLAAADMKSTPG

SEQ ID NO: 776869 - protein, 18 aa, Mycobacterium
RPRLKTSLLSAADIKAIP

SEQ ID NO: 776870 - protein, 17 aa, Mycobacterium
RPRLSVMAVGGELVDIC

SEQ ID NO: 776871 - protein, 17 aa, Mycobacterium
RPRLSVMAVGGELVDIS

SEQ ID NO: 776872 - protein, 18 aa, Mycobacterium
RPRMDGLWPAPDELDGFR

SEQ ID NO: 776873 - protein, 18 aa, Mycobacterium
RPRPWRRARHAAAPPARV

SEQ ID NO: 776874 - protein, 19 aa, Mycobacterium
RPRRAAVLGSPIAHSRSPQ

SEQ ID NO: 776875 - protein, 19 aa, Mycobacterium
RPRRAGVSSFGFGGTNAHV

SEQ ID NO: 776876 - protein, 18 aa, Mycobacterium
RPRVVLVDGVPMSALAVQ

SEQ ID NO: 776877 - protein, 19 aa, Mycobacterium
RPRYIELVTEFPLTDTQKI

SEQ ID NO: 776878 - protein, 19 aa, Mycobacterium
RPSARVHRGLAYVPQGQQS

SEQ ID NO: 776879 - protein, 18 aa, Mycobacterium
RPSDPLALWTELWGDALI

SEQ ID NO: 776880 - protein, 19 aa, Mycobacterium
RPSDSVAIALRVGVPIYVE

SEQ ID NO: 776881 - protein, 19 aa, Mycobacterium
RPSEARAASLARIHGLTYV

SEQ ID NO: 776882 - protein, 17 aa, Mycobacterium
RPSERWGQEVVAVVALA

SEQ ID NO: 776883 - protein, 17 aa, Mycobacterium
RPSKRYRYLLIASPAGA

SEQ ID NO: 776884 - protein, 17 aa, Mycobacterium
RPSMLEFMDSVAINAVE

SEQ ID NO: 776885 - protein, 20 aa, Mycobacterium
RPSMRGVPFILVRTDRAGNI

SEQ ID NO: 776886 - protein, 18 aa, Mycobacterium
RPSMRGVPFSFVRVDRAG

SEQ ID NO: 776887 - protein, 19 aa, Mycobacterium
RPSMRGVPFSFVRVDRAGN

SEQ ID NO: 776888 - protein, 19 aa, Mycobacterium
RPSPRWGNEVVAIVQLAEG

SEQ ID NO: 776889 - protein, 18 aa, Mycobacterium
RPSVDWLKGSGIEVDNGV

SEQ ID NO: 776890 - protein, 25 aa, Mycobacterium
RPSYSLKEIRHWLQVFAQRFYSFSQ

SEQ ID NO: 776891 - protein, 26 aa, Mycobacterium
RPSYSLKEIRHWLQVFVQRFYSFSQF

SEQ ID NO: 776892 - protein, 23 aa, Mycobacterium
RPTAELRALIGLRDAAVALIEAE

SEQ ID NO: 776893 - protein, 19 aa, Mycobacterium
RPTGSFLFLGPTGVGKTEL

SEQ ID NO: 776894 - protein, 19 aa, Mycobacterium
RPTIEAELLLSDGSTGRAI

SEQ ID NO: 776895 - protein, 19 aa, Mycobacterium
RPTLAGAVPTIWNDVLHRL

SEQ ID NO: 776896 - protein, 19 aa, Mycobacterium
RPTLAGAVPTIWNDVMHHL

SEQ ID NO: 776897 - protein, 18 aa, Mycobacterium
RPTLYRWFASKEELLSAF

SEQ ID NO: 776898 - protein, 19 aa, Mycobacterium
RPTMPLVPLIDGWETVAEM

SEQ ID NO: 776899 - protein, 19 aa, Mycobacterium
RPTQPGSYPIVLATYEIVC

SEQ ID NO: 776900 - protein, 29 aa, Mycobacterium
RPTYSLKEIRHWLGVFVQRFYSFSQFKRS

SEQ ID NO: 776901 - protein, 18 aa, Mycobacterium
RPVDLVLLDGWPDLALPV

SEQ ID NO: 776902 - protein, 21 aa, Mycobacterium
RPVDWRWPWGEVLDVLDDVGT

SEQ ID NO: 776903 - protein, 17 aa, Mycobacterium
RPVKPPPSEGWRRLLYE

SEQ ID NO: 776904 - protein, 17 aa, Mycobacterium
RPVLAVLGGFHLGFPTT

SEQ ID NO: 776905 - protein, 19 aa, Mycobacterium
RPVNPRIAALAVIGMCNWV

SEQ ID NO: 776906 - protein, 19 aa, Mycobacterium
RPVPGFAIALTDLRPGERA

SEQ ID NO: 776907 - protein, 17 aa, Mycobacterium
RPVRWDLCTAAMKDLGV

SEQ ID NO: 776908 - protein, 22 aa, Mycobacterium
RPVSTWWPWRGRTVHIARAPVP

SEQ ID NO: 776909 - protein, 19 aa, Mycobacterium
RPVTALGHWVHVYVDRTSR

SEQ ID NO: 776910 - protein, 17 aa, Mycobacterium
RPVTFSALTGWEAPDPA

SEQ ID NO: 776911 - protein, 18 aa, Mycobacterium
RPWCLGWHWCGWLENPHR

SEQ ID NO: 776912 - protein, 22 aa, Mycobacterium
RPWRLPPPGGRRELDEAIGQIA

SEQ ID NO: 776913 - protein, 19 aa, Mycobacterium
RPWRPDVVHAHDWLVAHPA

SEQ ID NO: 776914 - protein, 19 aa, Mycobacterium
RPWRVSPPGGRRELDEAIG

SEQ ID NO: 776915 - protein, 18 aa, Mycobacterium
RPWSSYAPTVVKLPDGSV

SEQ ID NO: 776916 - protein, 23 aa, Mycobacterium
RPWVCLLCPLAVFAPRHAANLLR

SEQ ID NO: 776917 - protein, 24 aa, Mycobacterium
RPWVCLLCPLAVFAPRHAVNLLRL

SEQ ID NO: 776918 - protein, 20 aa, Mycobacterium
RPWWEWAATYERAFTAAYDA

SEQ ID NO: 776919 - protein, 18 aa, Mycobacterium
RPYAELLVDGFGIPENLR

SEQ ID NO: 776920 - protein, 21 aa, Mycobacterium
RPYDPPWCRPLLGVRRDVTQA

SEQ ID NO: 776921 - protein, 18 aa, Mycobacterium
RPYTEFDISHSLRAFGWQ

SEQ ID NO: 776922 - protein, 20 aa, Mycobacterium
RQAARDWHEFVAFRGRELCP

SEQ ID NO: 776923 - protein, 23 aa, Mycobacterium
RQADLRAGFWTSVRECPHCDDRG

SEQ ID NO: 776924 - protein, 18 aa, Mycobacterium
RQAMIGIRCSGDTTEVAD

SEQ ID NO: 776925 - protein, 24 aa, Mycobacterium
RQAVWPERMFSLLAGFVEAGESFE

SEQ ID NO: 776926 - protein, 20 aa, Mycobacterium
RQDLGLSWRSPRAAIVESFA

SEQ ID NO: 776927 - protein, 19 aa, Mycobacterium
RQELPLIEEWFEFVGDKLP

SEQ ID NO: 776928 - protein, 17 aa, Mycobacterium
RQFLRRRATLAINTSST

SEQ ID NO: 776929 - protein, 17 aa, Mycobacterium
RQFRWVWRLLFPGYPRP

SEQ ID NO: 776930 - protein, 19 aa, Mycobacterium
RQFTCKYHAWRYALNGDLT

SEQ ID NO: 776931 - protein, 19 aa, Mycobacterium
RQFTCKYHAWRYGLDGELT

SEQ ID NO: 776932 - protein, 18 aa, Mycobacterium
RQFTCKYHAWRYSLDGEL

SEQ ID NO: 776933 - protein, 19 aa, Mycobacterium
RQFTCKYHGWRYGLDGELT

SEQ ID NO: 776934 - protein, 18 aa, Mycobacterium
RQGIEILGPVGLAARTAA

SEQ ID NO: 776935 - protein, 25 aa, Mycobacterium
RQGLTVSGTRAWLNRQLRPIGKAKA

SEQ ID NO: 776936 - protein, 25 aa, Mycobacterium
RQGRAGSRVSIRWEIPCDTAPGQYR

SEQ ID NO: 776937 - protein, 17 aa, Mycobacterium
RQHYAFLVSEEDFDAIY

SEQ ID NO: 776938 - protein, 25 aa, Mycobacterium
RQILPERLHSFFFFNGERIEHLVQA

SEQ ID NO: 776939 - protein, 20 aa, Mycobacterium
RQIRDAFVVGAGYSELMTAD

SEQ ID NO: 776940 - protein, 24 aa, Mycobacterium
RQKFWPERMFSLLAGFVEAGESLE

SEQ ID NO: 776941 - protein, 25 aa, Mycobacterium
RQKRLMDVIHLWLIHRFKAEIVYYV

SEQ ID NO: 776942 - protein, 17 aa, Mycobacterium
RQLHSWAKPAFEIAQTF

SEQ ID NO: 776943 - protein, 17 aa, Mycobacterium
RQLLDLMIHSVYSNKDS

SEQ ID NO: 776944 - protein, 17 aa, Mycobacterium
RQLPLRLVYVIPAADVP

SEQ ID NO: 776945 - protein, 17 aa, Mycobacterium
RQLRFGIRLHVITRDTA

SEQ ID NO: 776946 - protein, 17 aa, Mycobacterium
RQLRWVAAPVFHRRGEV

SEQ ID NO: 776947 - protein, 19 aa, Mycobacterium
RQLVARSGVDPVQIDDVIA

SEQ ID NO: 776948 - protein, 18 aa, Mycobacterium
RQNVEWFARLYGVPRAER

SEQ ID NO: 776949 - protein, 21 aa, Mycobacterium
RQPRVGACWHVNVAETSQAAR

SEQ ID NO: 776950 - protein, 22 aa, Mycobacterium
RQPVPPFKWWRGLRARQLLEDY

SEQ ID NO: 776951 - protein, 23 aa, Mycobacterium
RQQTLRASLEWSHGLLTDTERVL

SEQ ID NO: 776952 - protein, 17 aa, Mycobacterium
RQQTLRASVDWSHALLT

SEQ ID NO: 776953 - protein, 22 aa, Mycobacterium
RQQTLRASVDWSHALLTDTERS

SEQ ID NO: 776954 - protein, 19 aa, Mycobacterium
RQQTLRASVDWSHALLTEP

SEQ ID NO: 776955 - protein, 22 aa, Mycobacterium
RQQTLRASVDWSHALLTEPERI

SEQ ID NO: 776956 - protein, 23 aa, Mycobacterium
RQRAQELLDQFGLTYAGKRLVRT

SEQ ID NO: 776957 - protein, 17 aa, Mycobacterium
RQRIDAILTEVTAADSA

SEQ ID NO: 776958 - protein, 17 aa, Mycobacterium
RQRIGMVFQQFNLFPHR

SEQ ID NO: 776959 - protein, 23 aa, Mycobacterium
RQRLAIEFAERFAIDHASLDDAF

SEQ ID NO: 776960 - protein, 19 aa, Mycobacterium
RQRPGIEWVCGRWTGAQVD

SEQ ID NO: 776961 - protein, 17 aa, Mycobacterium
RQRWCVRLVQGGGFAGP

SEQ ID NO: 776962 - protein, 23 aa, Mycobacterium
RQSCLRYGMSVALLDRVSVVAGD

SEQ ID NO: 776963 - protein, 19 aa, Mycobacterium
RQSKARFSVYIGDLGNDTN

SEQ ID NO: 776964 - protein, 18 aa, Mycobacterium
RQTLLSWRGCRCNWLQYR

SEQ ID NO: 776965 - protein, 17 aa, Mycobacterium
RQVCFALAVTNRAVLAV

SEQ ID NO: 776966 - protein, 17 aa, Mycobacterium
RQVETFANRLARLLISQ

SEQ ID NO: 776967 - protein, 24 aa, Mycobacterium
RQVGFGGLVPKMFGELGTADTVGG

SEQ ID NO: 776968 - protein, 17 aa, Mycobacterium
RQVIGCVFQDFRLLQQK

SEQ ID NO: 776969 - protein, 24 aa, Mycobacterium
RQVWPEIWTAIGPMLAGVVATGRA

SEQ ID NO: 776970 - protein, 22 aa, Mycobacterium
RQWKLAVAGAYHLVGEEPPTTG

SEQ ID NO: 776971 - protein, 18 aa, Mycobacterium
RQWWDWAPGASWRHPWGP

SEQ ID NO: 776972 - protein, 19 aa, Mycobacterium
RQYRYEFLDADGYPTTVDP

SEQ ID NO: 776973 - protein, 19 aa, Mycobacterium
RRAAEEFGLRVVVVERPGS

SEQ ID NO: 776974 - protein, 24 aa, Mycobacterium
RRAAIDFATLWARPGDTVLVAGKG

SEQ ID NO: 776975 - protein, 20 aa, Mycobacterium
RRAALTASRFVACPFGGPGD

SEQ ID NO: 776976 - protein, 17 aa, Mycobacterium
RRADGHWVLPELSTELA

SEQ ID NO: 776977 - protein, 17 aa, Mycobacterium
RRADTMWAFLRSKANTI

SEQ ID NO: 776978 - protein, 19 aa, Mycobacterium
RRAEVAIVFAIRPEGEGFD

SEQ ID NO: 776979 - protein, 21 aa, Mycobacterium
RRAEVSLGEILAWIEHNAHRE

SEQ ID NO: 776980 - protein, 19 aa, Mycobacterium
RRAEYPGAITIVSDEDHLP

SEQ ID NO: 776981 - protein, 18 aa, Mycobacterium
RRAGGCWVLTNHPFLSGR

SEQ ID NO: 776982 - protein, 21 aa, Mycobacterium
RRAGLAVGMSEWFAPAPERSP

SEQ ID NO: 776983 - protein, 19 aa, Mycobacterium
RRAGLTLADIDLFEVNEAF

SEQ ID NO: 776984 - protein, 19 aa, Mycobacterium
RRAGVDVVHCLVQRRADGR

SEQ ID NO: 776985 - protein, 20 aa, Mycobacterium
RRAGYKLARREGAREGRWTL

SEQ ID NO: 776986 - protein, 19 aa, Mycobacterium
RRAKLYYLRELRGKKAKIK

SEQ ID NO: 776987 - protein, 19 aa, Mycobacterium
RRALAALGWDDRHGDRHTA

SEQ ID NO: 776988 - protein, 18 aa, Mycobacterium
RRALAEFTVEGLATVIPF

SEQ ID NO: 776989 - protein, 17 aa, Mycobacterium
RRALVAFGSDVMFGAPT

SEQ ID NO: 776990 - protein, 17 aa, Mycobacterium
RRARQCWEGVQIALGNV

SEQ ID NO: 776991 - protein, 22 aa, Mycobacterium
RRARRRIGMVFQQFNLFPNMTV

SEQ ID NO: 776992 - protein, 17 aa, Mycobacterium
RRARWVVRVIVSMLLFP

SEQ ID NO: 776993 - protein, 20 aa, Mycobacterium
RRATLAGGFFWLYNVISFPQ

SEQ ID NO: 776994 - protein, 19 aa, Mycobacterium
RRATTHWAFADRLAREFPA

SEQ ID NO: 776995 - protein, 20 aa, Mycobacterium
RRATTHWAHCQTLARNYPHV

SEQ ID NO: 776996 - protein, 20 aa, Mycobacterium
RRATTHWAHCQTLARQYPAV

SEQ ID NO: 776997 - protein, 20 aa, Mycobacterium
RRAVARLPLRLVYPDGTAIG

SEQ ID NO: 776998 - protein, 18 aa, Mycobacterium
RRAVELLDLVGIAQPERR

SEQ ID NO: 776999 - protein, 19 aa, Mycobacterium
RRCDGRDAMSYGELIGAVE

SEQ ID NO: 777000 - protein, 19 aa, Mycobacterium
RRCGWFDAVVARYATRVNG

SEQ ID NO: 777001 - protein, 22 aa, Mycobacterium
RRCMDCGIPFCHSGSAGCPLGN

SEQ ID NO: 777002 - protein, 18 aa, Mycobacterium
RRDCAIARPVKPTVFTDL

SEQ ID NO: 777003 - protein, 19 aa, Mycobacterium
RRDDFALAMTLEMGKPLAE

SEQ ID NO: 777004 - protein, 17 aa, Mycobacterium
RRDGRFLVALGMGGMGY

SEQ ID NO: 777005 - protein, 22 aa, Mycobacterium
RRDTSQWGWTWPLNRRVLYNRA

SEQ ID NO: 777006 - protein, 17 aa, Mycobacterium
RRDVWPGILGFEDTVIP

SEQ ID NO: 777007 - protein, 19 aa, Mycobacterium
RREAFRRLALLGVGATAAG

SEQ ID NO: 777008 - protein, 22 aa, Mycobacterium
RREALPRLALWRVNSDGTYAEP

SEQ ID NO: 777009 - protein, 24 aa, Mycobacterium
RRECTGFIFNRVWAAIKRESLAVV

SEQ ID NO: 777010 - protein, 18 aa, Mycobacterium
RREDTCLLLAPHHDVGFT

SEQ ID NO: 777011 - protein, 17 aa, Mycobacterium
RREGTCLLLAPHHDVGD

SEQ ID NO: 777012 - protein, 17 aa, Mycobacterium
RREGWDYPDMARESGTN

SEQ ID NO: 777013 - protein, 18 aa, Mycobacterium
RREHAWGFIDSVPATGLD

SEQ ID NO: 777014 - protein, 19 aa, Mycobacterium
RRELPGLAVATDWLRAHKP

SEQ ID NO: 777015 - protein, 24 aa, Mycobacterium
RREMAYEGKIDWAFAELLALGSLV

SEQ ID NO: 777016 - protein, 25 aa, Mycobacterium
RREMAYEGKVDWAFAELLALGTFLA

SEQ ID NO: 777017 - protein, 26 aa, Mycobacterium
RREMAYEGKVDWAFGELLAFGTLVAE

SEQ ID NO: 777018 - protein, 24 aa, Mycobacterium
RREMAYEGKVDWAFGELLALGSLV

SEQ ID NO: 777019 - protein, 23 aa, Mycobacterium
RRESVGFIFNRIWAAIKREALMV

SEQ ID NO: 777020 - protein, 24 aa, Mycobacterium
RREVPGLDGIEAWAVHAQPGHIVA

SEQ ID NO: 777021 - protein, 17 aa, Mycobacterium
RRFAEYRSRAVTAAALD

SEQ ID NO: 777022 - protein, 19 aa, Mycobacterium
RRFGCEVWDGFGSTENAVT

SEQ ID NO: 777023 - protein, 20 aa, Mycobacterium
RRFGCGFAPSGWDSLTKHLQ

SEQ ID NO: 777024 - protein, 20 aa, Mycobacterium
RRFGCGFAPSGWDSLTKHLV

SEQ ID NO: 777025 - protein, 18 aa, Mycobacterium
RRFIPFDVDSSVLTAAGA

SEQ ID NO: 777026 - protein, 20 aa, Mycobacterium
RRFLASDGWIAWSGPAISEL

SEQ ID NO: 777027 - protein, 25 aa, Mycobacterium
RRFLERRLRESFGFDGTPIRINVRV

SEQ ID NO: 777028 - protein, 18 aa, Mycobacterium
RRFLRMMEGFGLPRNAMR

SEQ ID NO: 777029 - protein, 19 aa, Mycobacterium
RRFLTFNGWLLQRGELPLR

SEQ ID NO: 777030 - protein, 18 aa, Mycobacterium
RRFMDMYRRCYAVLERLL

SEQ ID NO: 777031 - protein, 19 aa, Mycobacterium
RRFNEAFGPFGFPPKAIKP

SEQ ID NO: 777032 - protein, 20 aa, Mycobacterium
RRFRAWIRWNAAIMVHRAQR

SEQ ID NO: 777033 - protein, 21 aa, Mycobacterium
RRFRAWIRWNAAIMVHRAQRP

SEQ ID NO: 777034 - protein, 20 aa, Mycobacterium
RRFSPTASWGCCCRPSTSSR

SEQ ID NO: 777035 - protein, 17 aa, Mycobacterium
RRFTLAAGLLELADREF

SEQ ID NO: 777036 - protein, 18 aa, Mycobacterium
RRFYCHARWHSSELNSET

SEQ ID NO: 777037 - protein, 17 aa, Mycobacterium
RRGDGHWVLPELSTELA

SEQ ID NO: 777038 - protein, 24 aa, Mycobacterium
RRGDGRWAWRWDPAFATSNFQFLQ

SEQ ID NO: 777039 - protein, 18 aa, Mycobacterium
RRGDKYFPAPGVEPHAAV

SEQ ID NO: 777040 - protein, 18 aa, Mycobacterium
RRGDKYFPAPGVQPHAAV

SEQ ID NO: 777041 - protein, 19 aa, Mycobacterium
RRGDVLMVWRLDRLGRSLP

SEQ ID NO: 777042 - protein, 19 aa, Mycobacterium
RRGELDMSIAMVISNHPDL

SEQ ID NO: 777043 - protein, 18 aa, Mycobacterium
RRGELFGCGLGRLKPPKG

SEQ ID NO: 777044 - protein, 20 aa, Mycobacterium
RRGEPWFDPAGFFLAFDEDT

SEQ ID NO: 777045 - protein, 19 aa, Mycobacterium
RRGEPWFDPAGLFLALEGS

SEQ ID NO: 777046 - protein, 18 aa, Mycobacterium
RRGFLQFRWQRVSRQLTE

SEQ ID NO: 777047 - protein, 21 aa, Mycobacterium
RRGGYVLCSFVPASLPAHELD

SEQ ID NO: 777048 - protein, 18 aa, Mycobacterium
RRGLLLLTCGAWGQVVRF

SEQ ID NO: 777049 - protein, 18 aa, Mycobacterium
RRGRLPPGQLGWRKVTEI

SEQ ID NO: 777050 - protein, 20 aa, Mycobacterium
RRGRSRIGGFRAIIGSEPAA

SEQ ID NO: 777051 - protein, 18 aa, Mycobacterium
RRGSFGIPLPGVVQHRIV

SEQ ID NO: 777052 - protein, 24 aa, Mycobacterium
RRGSLPPGRLGWRRAQEITTRSAA

SEQ ID NO: 777053 - protein, 19 aa, Mycobacterium
RRGVTWSRVGEALGITRQS

SEQ ID NO: 777054 - protein, 23 aa, Mycobacterium
RRGYGPEVYRIMHAHISSVKRRA

SEQ ID NO: 777055 - protein, 23 aa, Mycobacterium
RRHGLAGVFALRFDQFALALLSR

SEQ ID NO: 777056 - protein, 17 aa, Mycobacterium
RRHGVGYVEWLTDDVEA

SEQ ID NO: 777057 - protein, 20 aa, Mycobacterium
RRHLLSWGIGECGICGAKLR

SEQ ID NO: 777058 - protein, 23 aa, Mycobacterium
RRHRWPFVIGRVFADPQDPGLGT

SEQ ID NO: 777059 - protein, 17 aa, Mycobacterium
RRIAVGLAHNHLILPNP

SEQ ID NO: 777060 - protein, 20 aa, Mycobacterium
RRIECARKVWAAGVQASRLG

SEQ ID NO: 777061 - protein, 20 aa, Mycobacterium
RRIGDCLGIYTAIRAGRMPE

SEQ ID NO: 777062 - protein, 25 aa, Mycobacterium
RRIGPEFLRPGPGWGGSCLPKDTAA

SEQ ID NO: 777063 - protein, 18 aa, Mycobacterium
RRILELAAALSDDFERAG

SEQ ID NO: 777064 - protein, 17 aa, Mycobacterium
RRILGVIDLTCRARQAD

SEQ ID NO: 777065 - protein, 17 aa, Mycobacterium
RRILVEFDGRPSASTAL

SEQ ID NO: 777066 - protein, 18 aa, Mycobacterium
RRIPEMVDYYLARTSHGS

SEQ ID NO: 777067 - protein, 21 aa, Mycobacterium
RRISERWQRFGFDLNAADLFY

SEQ ID NO: 777068 - protein, 20 aa, Mycobacterium
RRISLVPGPSGFRFYHTHLN

SEQ ID NO: 777069 - protein, 17 aa, Mycobacterium
RRKGAEIVDRFFKELRI

SEQ ID NO: 777070 - protein, 23 aa, Mycobacterium
RRLAAHFFLTFPALDDVRFTHRW

SEQ ID NO: 777071 - protein, 19 aa, Mycobacterium
RRLADLGIFVFRSYGSTEH

SEQ ID NO: 777072 - protein, 18 aa, Mycobacterium
RRLAEPGPWSMLEVLAPT

SEQ ID NO: 777073 - protein, 21 aa, Mycobacterium
RRLAIECLRQLAGAAPAVFAD

SEQ ID NO: 777074 - protein, 22 aa, Mycobacterium
RRLAIECLRQLVAVAPAVFADF

SEQ ID NO: 777075 - protein, 22 aa, Mycobacterium
RRLALDHLPRLAGALSVSTDEL

SEQ ID NO: 777076 - protein, 21 aa, Mycobacterium
RRLAQRLALLAGRRLDEAQPW

SEQ ID NO: 777077 - protein, 20 aa, Mycobacterium
RRLEAGSVWVNRHSDIAPQG

SEQ ID NO: 777078 - protein, 19 aa, Mycobacterium
RRLEHVPIATAVRLPSPDP

SEQ ID NO: 777079 - protein, 17 aa, Mycobacterium
RRLELRGELARGDLKSD

SEQ ID NO: 777080 - protein, 17 aa, Mycobacterium
RRLELTRSFSLAAINPM

SEQ ID NO: 777081 - protein, 23 aa, Mycobacterium
RRLEVELDQCWDLLRQRRALRDS

SEQ ID NO: 777082 - protein, 17 aa, Mycobacterium
RRLFAELMWEYRFGDRH

SEQ ID NO: 777083 - protein, 18 aa, Mycobacterium
RRLFSVLLDEGWTDDIPA

SEQ ID NO: 777084 - protein, 20 aa, Mycobacterium
RRLGDAVFRDMLGLHFSSTR

SEQ ID NO: 777085 - protein, 25 aa, Mycobacterium
RRLGRRGPVHIVDWQFVHGLTPSAL

SEQ ID NO: 777086 - protein, 24 aa, Mycobacterium
RRLGRRGPVHVVDWQNVQGLTPSA

SEQ ID NO: 777087 - protein, 21 aa, Mycobacterium
RRLGVDAIDLFQLHRIDKNFP

SEQ ID NO: 777088 - protein, 19 aa, Mycobacterium
RRLGVDIVLPWDGRDHYLA

SEQ ID NO: 777089 - protein, 20 aa, Mycobacterium
RRLGVPLAQALSAYLRGLDA

SEQ ID NO: 777090 - protein, 19 aa, Mycobacterium
RRLGVPLAQELSAHLRTLE

SEQ ID NO: 777091 - protein, 19 aa, Mycobacterium
RRLGVPLAQELSAYLRGLE

SEQ ID NO: 777092 - protein, 18 aa, Mycobacterium
RRLIPPWVTLGSRLAALP

SEQ ID NO: 777093 - protein, 18 aa, Mycobacterium
RRLIPPWVTLGSRLAAMP

SEQ ID NO: 777094 - protein, 18 aa, Mycobacterium
RRLIPPWVTLGSRMATMP

SEQ ID NO: 777095 - protein, 18 aa, Mycobacterium
RRLKASGIDTVFTLSGGH

SEQ ID NO: 777096 - protein, 18 aa, Mycobacterium
RRLKASGVDTVFTLSGGH

SEQ ID NO: 777097 - protein, 24 aa, Mycobacterium
RRLLAERVMIVFACREKITELRGF

SEQ ID NO: 777098 - protein, 20 aa, Mycobacterium
RRLLGVLIDQEWKYGVATGV

SEQ ID NO: 777099 - protein, 20 aa, Mycobacterium
RRLLHGWPDMTARDLVALAN

SEQ ID NO: 777100 - protein, 19 aa, Mycobacterium
RRLLKLRGATLLAHNYQLP

SEQ ID NO: 777101 - protein, 18 aa, Mycobacterium
RRLLPRLRPAGTHLGTVT

SEQ ID NO: 777102 - protein, 19 aa, Mycobacterium
RRLLRLCARYAPAGDVSGP

SEQ ID NO: 777103 - protein, 18 aa, Mycobacterium
RRLLRLCARYSAHPTVIF

SEQ ID NO: 777104 - protein, 18 aa, Mycobacterium
RRLLRLCARYSSAPTVIF

SEQ ID NO: 777105 - protein, 19 aa, Mycobacterium
RRLPDLKVRVVNVVDIMRL

SEQ ID NO: 777106 - protein, 21 aa, Mycobacterium
RRLPKNLPWDIPGRDQLEQAL

SEQ ID NO: 777107 - protein, 17 aa, Mycobacterium
RRLPLLVSNGADVHVVT

SEQ ID NO: 777108 - protein, 18 aa, Mycobacterium
RRLQIEFSQAIQKITEGE

SEQ ID NO: 777109 - protein, 18 aa, Mycobacterium
RRLQIEFSQVIQKISEGE

SEQ ID NO: 777110 - protein, 20 aa, Mycobacterium
RRLREFSAFDAFSDAELERV

SEQ ID NO: 777111 - protein, 19 aa, Mycobacterium
RRLRKSWLERGASDAELSW

SEQ ID NO: 777112 - protein, 24 aa, Mycobacterium
RRLRLTYEALRRWNERIVCVAITG

SEQ ID NO: 777113 - protein, 19 aa, Mycobacterium
RRLSAIAALTCRRTASDQR

SEQ ID NO: 777114 - protein, 19 aa, Mycobacterium
RRLSGEIDRPVSFALIQVD

SEQ ID NO: 777115 - protein, 17 aa, Mycobacterium
RRLSRNHWGYLDETAGD

SEQ ID NO: 777116 - protein, 19 aa, Mycobacterium
RRLTAMIVKLAARFLALRE

SEQ ID NO: 777117 - protein, 18 aa, Mycobacterium
RRLTECLTRGATRFGWNR

SEQ ID NO: 777118 - protein, 20 aa, Mycobacterium
RRLTSELPLPVNAIARPDQS

SEQ ID NO: 777119 - protein, 21 aa, Mycobacterium
RRLWTVLIFMLWHAIFVEHSV

SEQ ID NO: 777120 - protein, 21 aa, Mycobacterium
RRLWTVLIFMLWHAIFVEQSV

SEQ ID NO: 777121 - protein, 21 aa, Mycobacterium
RRLWTVLIFMLWHSIFVEKTV

SEQ ID NO: 777122 - protein, 23 aa, Mycobacterium
RRLYRLPLAIARLARSGRITQRL

SEQ ID NO: 777123 - protein, 22 aa, Mycobacterium
RRLYTSRGWLPWHGPTSVLSPT

SEQ ID NO: 777124 - protein, 18 aa, Mycobacterium
RRMMEWFGPIIHEYYGGT

SEQ ID NO: 777125 - protein, 19 aa, Mycobacterium
RRMTLSLADDAVFEALVMR

SEQ ID NO: 777126 - protein, 17 aa, Mycobacterium
RRMVLSRTANAYSRILL

SEQ ID NO: 777127 - protein, 20 aa, Mycobacterium
RRNACVNLKMAMLGRADEPP

SEQ ID NO: 777128 - protein, 20 aa, Mycobacterium
RRNAPCVLFFDELDALGHRR

SEQ ID NO: 777129 - protein, 21 aa, Mycobacterium
RRNAPCVLFFDEVDALGHRRS

SEQ ID NO: 777130 - protein, 23 aa, Mycobacterium
RRNYKVLLCYGDPAWFSATLGAW

SEQ ID NO: 777131 - protein, 17 aa, Mycobacterium
RRPAVAAVRADYEKVLR

SEQ ID NO: 777132 - protein, 21 aa, Mycobacterium
RRPDLLVSLLTYWQHHPALSY

SEQ ID NO: 777133 - protein, 20 aa, Mycobacterium
RRPDLPTGKALVIAEGVLVV

SEQ ID NO: 777134 - protein, 17 aa, Mycobacterium
RRPDPYKGKGIRYEGEQ

SEQ ID NO: 777135 - protein, 20 aa, Mycobacterium
RRPFDLSRGPALRVVLLSAP

SEQ ID NO: 777136 - protein, 17 aa, Mycobacterium
RRPGDACAFDIDAAAAA

SEQ ID NO: 777137 - protein, 20 aa, Mycobacterium
RRPGLTASRFIACPFGAPGT

SEQ ID NO: 777138 - protein, 18 aa, Mycobacterium
RRPGVCLTTSGPGFLNGL

SEQ ID NO: 777139 - protein, 18 aa, Mycobacterium
RRPLRWLREMAVKGEDRG

SEQ ID NO: 777140 - protein, 20 aa, Mycobacterium
RRPPEKGSRVRLHPEPGHLH

SEQ ID NO: 777141 - protein, 22 aa, Mycobacterium
RRPRGSYQIAVLGLKGGAGKTT

SEQ ID NO: 777142 - protein, 21 aa, Mycobacterium
RRPRLRLVALMSYEGHIAGFG

SEQ ID NO: 777143 - protein, 22 aa, Mycobacterium
RRPRPGYELVPLVRQVRRRPTS

SEQ ID NO: 777144 - protein, 19 aa, Mycobacterium
RRPYTVILFDEIEKAHPDV

SEQ ID NO: 777145 - protein, 19 aa, Mycobacterium
RRQPTIIGHDGWLAIDRAE

SEQ ID NO: 777146 - protein, 18 aa, Mycobacterium
RRQPVHTVEVLGLNRQRI

SEQ ID NO: 777147 - protein, 23 aa, Mycobacterium
RRRAELRLARLGYLFQDYNLLQS

SEQ ID NO: 777148 - protein, 20 aa, Mycobacterium
RRRARAWLADNLPRLDSGDA

SEQ ID NO: 777149 - protein, 19 aa, Mycobacterium
RRRAVELLELVGIAQPERR

SEQ ID NO: 777150 - protein, 19 aa, Mycobacterium
RRRAVELLELVGISQAERR

SEQ ID NO: 777151 - protein, 18 aa, Mycobacterium
RRRCPLRASGALRTARRW

SEQ ID NO: 777152 - protein, 23 aa, Mycobacterium
RRRFPVEIVRRVREAVGPDFIVC

SEQ ID NO: 777153 - protein, 17 aa, Mycobacterium
RRRFPWGTAEPTADVAN

SEQ ID NO: 777154 - protein, 17 aa, Mycobacterium
RRRGFVVVRWLDNPQAP

SEQ ID NO: 777155 - protein, 19 aa, Mycobacterium
RRRGRARSMGGPERLDRHH

SEQ ID NO: 777156 - protein, 20 aa, Mycobacterium
RRRGRRGRGRGRGEQGGGEG

SEQ ID NO: 777157 - protein, 21 aa, Mycobacterium
RRRGRRGRGRGRGEQGGPDGQ

SEQ ID NO: 777158 - protein, 17 aa, Mycobacterium
RRRGVVVNPVLETSQIP

SEQ ID NO: 777159 - protein, 17 aa, Mycobacterium
RRRHDLPGLEFVQGDAE

SEQ ID NO: 777160 - protein, 19 aa, Mycobacterium
RRRHLLAQFLFRGDAVDLP

SEQ ID NO: 777161 - protein, 17 aa, Mycobacterium
RRRIDAILAGVPAAASP

SEQ ID NO: 777162 - protein, 22 aa, Mycobacterium
RRRIGELWAQFSAVAAGNPHAW

SEQ ID NO: 777163 - protein, 19 aa, Mycobacterium
RRRLFGIAMPVTGAIALSA

SEQ ID NO: 777164 - protein, 19 aa, Mycobacterium
RRRLMALGRAFSVAVRGVD

SEQ ID NO: 777165 - protein, 19 aa, Mycobacterium
RRRLPELAVRVINIVDIMR

SEQ ID NO: 777166 - protein, 18 aa, Mycobacterium
RRRLSLDLLDRWGTDLLE

SEQ ID NO: 777167 - protein, 17 aa, Mycobacterium
RRRLYWSSEGERLTDRQ

SEQ ID NO: 777168 - protein, 18 aa, Mycobacterium
RRRMVVLPWLTPTIASWW

SEQ ID NO: 777169 - protein, 21 aa, Mycobacterium
RRRPFDLSRGPALRVVVLSVP

SEQ ID NO: 777170 - protein, 22 aa, Mycobacterium
RRRRGRRGRGRGRGEQGANDGQ

SEQ ID NO: 777171 - protein, 22 aa, Mycobacterium
RRRRGRRGRGRGRGEQGGSDGP

SEQ ID NO: 777172 - protein, 22 aa, Mycobacterium
RRRRGRRGRGRGRGEQNGDEPS

SEQ ID NO: 777173 - protein, 23 aa, Mycobacterium
RRRRRGRRGRGRGRGEQNDDATS

SEQ ID NO: 777174 - protein, 21 aa, Mycobacterium
RRRSQELLEQFGLMHAAKRRV

SEQ ID NO: 777175 - protein, 17 aa, Mycobacterium
RRRSWAVLGEMAELGDD

SEQ ID NO: 777176 - protein, 18 aa, Mycobacterium
RRRTGIDFDPHWLRHTAA

SEQ ID NO: 777177 - protein, 18 aa, Mycobacterium
RRRVGLVAVHVWSDVGVF

SEQ ID NO: 777178 - protein, 19 aa, Mycobacterium
RRRVLELAAALSDDFERAG

SEQ ID NO: 777179 - protein, 17 aa, Mycobacterium
RRRWGIREVPLHVLVDG

SEQ ID NO: 777180 - protein, 17 aa, Mycobacterium
RRSAFFWGEHTKVAVES

SEQ ID NO: 777181 - protein, 18 aa, Mycobacterium
RRSAIAWRAYRDGSGVDS

SEQ ID NO: 777182 - protein, 17 aa, Mycobacterium
RRSCWCWSTRAPPARTT

SEQ ID NO: 777183 - protein, 17 aa, Mycobacterium
RRSEFRAVDAVSFRLRR

SEQ ID NO: 777184 - protein, 25 aa, Mycobacterium
RRSRFPHRWWWVVLSEEAFPRLAVV

SEQ ID NO: 777185 - protein, 18 aa, Mycobacterium
RRSVRAFAWVGSHAPRRM

SEQ ID NO: 777186 - protein, 20 aa, Mycobacterium
RRTAFDIGEWGLGFMTTSLD

SEQ ID NO: 777187 - protein, 22 aa, Mycobacterium
RRTARLDTLFALTKALGAPLSA

SEQ ID NO: 777188 - protein, 18 aa, Mycobacterium
RRTFAVNIDSFFHVTKAA

SEQ ID NO: 777189 - protein, 19 aa, Mycobacterium
RRTGLRGCCLHRRDQLDRR

SEQ ID NO: 777190 - protein, 24 aa, Mycobacterium
RRTPRWSASVAQEWEPVPHVDREG

SEQ ID NO: 777191 - protein, 23 aa, Mycobacterium
RRTSAVKAFTAWAARRGLLAADP

SEQ ID NO: 777192 - protein, 24 aa, Mycobacterium
RRTSAVKAFTAWAVRRGLLATDPA

SEQ ID NO: 777193 - protein, 24 aa, Mycobacterium
RRTSAVKAFTAWAVRRGLLTGDPA

SEQ ID NO: 777194 - protein, 21 aa, Mycobacterium
RRTVWIPWALGPAAAVMRVLP

SEQ ID NO: 777195 - protein, 24 aa, Mycobacterium
RRVAAVWRPRIQGLRADAYGLADE

SEQ ID NO: 777196 - protein, 17 aa, Mycobacterium
RRVAVFIDGCFWHGCPQ

SEQ ID NO: 777197 - protein, 24 aa, Mycobacterium
RRVCRSCGFYLPLAGSLGVAFGVC

SEQ ID NO: 777198 - protein, 18 aa, Mycobacterium
RRVFRTCRDLGIATVAVY

SEQ ID NO: 777199 - protein, 19 aa, Mycobacterium
RRVFRTCRELGIATVAVYS

SEQ ID NO: 777200 - protein, 17 aa, Mycobacterium
RRVGYALLRDGVEVEVD

SEQ ID NO: 777201 - protein, 19 aa, Mycobacterium
RRVQLEIFTKFSIPINIAR

SEQ ID NO: 777202 - protein, 19 aa, Mycobacterium
RRVTPRARAGLFGEAYRLL

SEQ ID NO: 777203 - protein, 18 aa, Mycobacterium
RRVWRALLTIPYGETRSY

SEQ ID NO: 777204 - protein, 18 aa, Mycobacterium
RRWAAEGVERGWAATMVL

SEQ ID NO: 777205 - protein, 17 aa, Mycobacterium
RRWALSWTANTYARLAL

SEQ ID NO: 777206 - protein, 18 aa, Mycobacterium
RRWCSGTSNRWCEMRVRV

SEQ ID NO: 777207 - protein, 17 aa, Mycobacterium
RRWISVADAIAFVESLG

SEQ ID NO: 777208 - protein, 20 aa, Mycobacterium
RRWLAAWLAERGFEVRYDRI

SEQ ID NO: 777209 - protein, 22 aa, Mycobacterium
RRWLRDRGLKIFPLVGWAERGG

SEQ ID NO: 777210 - protein, 17 aa, Mycobacterium
RRWPRVQSWADIPLDEQ

SEQ ID NO: 777211 - protein, 23 aa, Mycobacterium
RRWQRLLFDNGWLIPGNPPEFGG

SEQ ID NO: 777212 - protein, 24 aa, Mycobacterium
RRWQRLLFDNGWLLPGNPPEFGGR

SEQ ID NO: 777213 - protein, 24 aa, Mycobacterium
RRWQRLLFDNGWLLPSQPPEYGGR

SEQ ID NO: 777214 - protein, 17 aa, Mycobacterium
RRWQRLLFDSGWLLPGN

SEQ ID NO: 777215 - protein, 17 aa, Mycobacterium
RRWWPDLRLQVVEDRGD

SEQ ID NO: 777216 - protein, 20 aa, Mycobacterium
RRYADELIFPAIEVYTEGLM

SEQ ID NO: 777217 - protein, 25 aa, Mycobacterium
RRYALEMAPRLVAFSEDVARRVPDS

SEQ ID NO: 777218 - protein, 19 aa, Mycobacterium
RRYCFDLETDWPIRAAVLT

SEQ ID NO: 777219 - protein, 18 aa, Mycobacterium
RRYESSIAPGAWEALAAA

SEQ ID NO: 777220 - protein, 18 aa, Mycobacterium
RRYESSIAPGAWESLAAA

SEQ ID NO: 777221 - protein, 19 aa, Mycobacterium
RRYIECATRAVARYDWSVV

SEQ ID NO: 777222 - protein, 19 aa, Mycobacterium
RRYILDCALRWMRDFHADG

SEQ ID NO: 777223 - protein, 19 aa, Mycobacterium
RRYLRACQQLGYQDPVLAK

SEQ ID NO: 777224 - protein, 22 aa, Mycobacterium
RRYRAQSGFVFQSHNLFPHKTV

SEQ ID NO: 777225 - protein, 24 aa, Mycobacterium
RRYRMWCRLLRAGALLATGHDLTT

SEQ ID NO: 777226 - protein, 19 aa, Mycobacterium
RSAAHLQAFITYANHAQEL

SEQ ID NO: 777227 - protein, 17 aa, Mycobacterium
RSAAIAYRASMDAFVAA

SEQ ID NO: 777228 - protein, 18 aa, Mycobacterium
RSAAWMFDYYPLRVRTEF

SEQ ID NO: 777229 - protein, 19 aa, Mycobacterium
RSAAYAMRWVAKNIVAAGL

SEQ ID NO: 777230 - protein, 22 aa, Mycobacterium
RSACIKAMIEKVVERMYAEIDD

SEQ ID NO: 777231 - protein, 17 aa, Mycobacterium
RSACLRREVPVDLRQDW

SEQ ID NO: 777232 - protein, 17 aa, Mycobacterium
RSACRRKGIRIVAEAAI

SEQ ID NO: 777233 - protein, 17 aa, Mycobacterium
RSADHGWSDLLQRRESD

SEQ ID NO: 777234 - protein, 19 aa, Mycobacterium
RSAEEVRFLMGFNRDVVRR

SEQ ID NO: 777235 - protein, 17 aa, Mycobacterium
RSAGLLTAWVATGFDVL

SEQ ID NO: 777236 - protein, 17 aa, Mycobacterium
RSAHAVFCRAVIVGPPL

SEQ ID NO: 777237 - protein, 17 aa, Mycobacterium
RSAHPVFRRRRFFNGRP

SEQ ID NO: 777238 - protein, 26 aa, Mycobacterium
RSAITFKIPNLWGLLKVKGRFTEFSG

SEQ ID NO: 777239 - protein, 26 aa, Mycobacterium
RSALLSLTCPWNLTGHPALSVPAGVV

SEQ ID NO: 777240 - protein, 19 aa, Mycobacterium
RSAMHAWARVVSRPEPELA

SEQ ID NO: 777241 - protein, 24 aa, Mycobacterium
RSAMTAFDWYCWRLNKKVEDTQRR

SEQ ID NO: 777242 - protein, 20 aa, Mycobacterium
RSARMDLVFSLAERWTEDGR

SEQ ID NO: 777243 - protein, 25 aa, Mycobacterium
RSARWILPLLWRRWSPGYRGADEDL

SEQ ID NO: 777244 - protein, 17 aa, Mycobacterium
RSATCRVLAAAKGSRTA

SEQ ID NO: 777245 - protein, 20 aa, Mycobacterium
RSATLPGVWQGLYESLLTER

SEQ ID NO: 777246 - protein, 17 aa, Mycobacterium
RSAVAVALTSRFPIVLW

SEQ ID NO: 777247 - protein, 18 aa, Mycobacterium
RSAWPRHLLPALTTAGFA

SEQ ID NO: 777248 - protein, 17 aa, Mycobacterium
RSCRAVKSNAIVIVADG

SEQ ID NO: 777249 - protein, 22 aa, Mycobacterium
RSCSIKHRMASVIFSLEMSKSE

SEQ ID NO: 777250 - protein, 19 aa, Mycobacterium
RSCVVPGCGATRGLHAHHI

SEQ ID NO: 777251 - protein, 19 aa, Mycobacterium
RSDEFICSCCYLVQHRSRL

SEQ ID NO: 777252 - protein, 17 aa, Mycobacterium
RSDVFLTSFLPAHRKKF

SEQ ID NO: 777253 - protein, 17 aa, Mycobacterium
RSEGWRFMRSMNRELSV

SEQ ID NO: 777254 - protein, 23 aa, Mycobacterium
RSEKRPAMTVALDFAMLPPEINS

SEQ ID NO: 777255 - protein, 18 aa, Mycobacterium
RSELTLLGRYVLAVLDEE

SEQ ID NO: 777256 - protein, 18 aa, Mycobacterium
RSEPYVVVLVRLDEGPQL

SEQ ID NO: 777257 - protein, 19 aa, Mycobacterium
RSERARLLLGIADAIEADS

SEQ ID NO: 777258 - protein, 17 aa, Mycobacterium
RSEVAIVCQLARTLLGP

SEQ ID NO: 777259 - protein, 20 aa, Mycobacterium
RSEWLEPRWMIGIDPESEGL

SEQ ID NO: 777260 - protein, 23 aa, Mycobacterium
RSFKEAHLRLVLRSGRTDVEQIR

SEQ ID NO: 777261 - protein, 17 aa, Mycobacterium
RSGALWVAANVDRTLPS

SEQ ID NO: 777262 - protein, 17 aa, Mycobacterium
RSGATVYRYHRDDCLPG

SEQ ID NO: 777263 - protein, 19 aa, Mycobacterium
RSGDSGAIQRHWFAAMEVL

SEQ ID NO: 777264 - protein, 18 aa, Mycobacterium
RSGDTGAMQMHWRSAMDV

SEQ ID NO: 777265 - protein, 22 aa, Mycobacterium
RSGELPDRLRVHSLARTLGTTS

SEQ ID NO: 777266 - protein, 17 aa, Mycobacterium
RSGFLLAPWTAEQIVSE

SEQ ID NO: 777267 - protein, 20 aa, Mycobacterium
RSGGALAAFAAVAAESAGAA

SEQ ID NO: 777268 - protein, 26 aa, Mycobacterium
RSGKWPHIWRIVGEYANFSIFDVETN

SEQ ID NO: 777269 - protein, 22 aa, Mycobacterium
RSGLPFGTCLDAIYLHPCGSAE

SEQ ID NO: 777270 - protein, 18 aa, Mycobacterium
RSGLPFGTCLDATYLHPN

SEQ ID NO: 777271 - protein, 22 aa, Mycobacterium
RSGLPFGTCLDAVYLHPCGSDE

SEQ ID NO: 777272 - protein, 20 aa, Mycobacterium
RSGLPFGTCLNATYLHPCGS

SEQ ID NO: 777273 - protein, 20 aa, Mycobacterium
RSGLPFGTCLQAVYLHPQGG

SEQ ID NO: 777274 - protein, 18 aa, Mycobacterium
RSGLRVSPFALGAMTFGE

SEQ ID NO: 777275 - protein, 17 aa, Mycobacterium
RSGMRFGQVQTRLVGNA

SEQ ID NO: 777276 - protein, 19 aa, Mycobacterium
RSGMTIGIAGWGSRRKPMA

SEQ ID NO: 777277 - protein, 19 aa, Mycobacterium
RSGMTIGIGGWGSRRKPMA

SEQ ID NO: 777278 - protein, 27 aa, Mycobacterium
RSGNCAHFKIQIAFRGKLQLKRHSAAR

SEQ ID NO: 777279 - protein, 19 aa, Mycobacterium
RSGPFAEWLVCDLRSADEI

SEQ ID NO: 777280 - protein, 20 aa, Mycobacterium
RSGPRLNVRALLFGGEALSP

SEQ ID NO: 777281 - protein, 19 aa, Mycobacterium
RSGPVFLYRVPPQDFTDRA

SEQ ID NO: 777282 - protein, 24 aa, Mycobacterium
RSGRSRFCRCGPRGGARLRRGGRR

SEQ ID NO: 777283 - protein, 17 aa, Mycobacterium
RSGWKPFLYHLSSGQPE

SEQ ID NO: 777284 - protein, 19 aa, Mycobacterium
RSHCLRIIMGRKVVELRAS

SEQ ID NO: 777285 - protein, 17 aa, Mycobacterium
RSHWLRRVAALTQQGVR

SEQ ID NO: 777286 - protein, 18 aa, Mycobacterium
RSIVPVRVFWLPPPDRGR

SEQ ID NO: 777287 - protein, 18 aa, Mycobacterium
RSIVPVRVFWLPPPDRSR

SEQ ID NO: 777288 - protein, 17 aa, Mycobacterium
RSIWPRAMAFAAIGAAE

SEQ ID NO: 777289 - protein, 20 aa, Mycobacterium
RSKGIRRIVMLTGDHPDTAE

SEQ ID NO: 777290 - protein, 18 aa, Mycobacterium
RSKLSEMPALWAYARDLF

SEQ ID NO: 777291 - protein, 20 aa, Mycobacterium
RSKLYWDFWEQFRSRVVSEY

SEQ ID NO: 777292 - protein, 24 aa, Mycobacterium
RSLALEHPEIWGGLIDLDDSVPTA

SEQ ID NO: 777293 - protein, 22 aa, Mycobacterium
RSLDFYRLLGLDVPEPDGPHVE

SEQ ID NO: 777294 - protein, 25 aa, Mycobacterium
RSLEEIFIRTGIPYKVVGGVRFYER

SEQ ID NO: 777295 - protein, 18 aa, Mycobacterium
RSLFAFKLHQFIGKGDTV

SEQ ID NO: 777296 - protein, 24 aa, Mycobacterium
RSLHFAMGLARGYSLAVVEGSTSL

SEQ ID NO: 777297 - protein, 19 aa, Mycobacterium
RSLLRDYQEAFGLPDDGWV

SEQ ID NO: 777298 - protein, 19 aa, Mycobacterium
RSLLREAPDSFGLADGAWV

SEQ ID NO: 777299 - protein, 19 aa, Mycobacterium
RSLPQYGFRPTVVARPPAG

SEQ ID NO: 777300 - protein, 21 aa, Mycobacterium
RSLRATLRFAQDMYALIPLIL

SEQ ID NO: 777301 - protein, 25 aa, Mycobacterium
RSLSDWGGLTAEAWKAQHGKLRTDI

SEQ ID NO: 777302 - protein, 17 aa, Mycobacterium
RSMAIEWARDNIQVNAI

SEQ ID NO: 777303 - protein, 17 aa, Mycobacterium
RSMFPYRAAQHSIIVLV

SEQ ID NO: 777304 - protein, 19 aa, Mycobacterium
RSNAGIARRLWVTEGTVEK

SEQ ID NO: 777305 - protein, 19 aa, Mycobacterium
RSNLARYGIAPTYPLDFAA

SEQ ID NO: 777306 - protein, 23 aa, Mycobacterium
RSPESIGSLMGWQATLEAANLTL

SEQ ID NO: 777307 - protein, 18 aa, Mycobacterium
RSPLQLLFIDGGHTEAAA

SEQ ID NO: 777308 - protein, 20 aa, Mycobacterium
RSPRCGICPLSHCRWRSAGF

SEQ ID NO: 777309 - protein, 18 aa, Mycobacterium
RSPWPAWRAHPLLFPFLH

SEQ ID NO: 777310 - protein, 20 aa, Mycobacterium
RSPWSLLRRRRGVLPSIEEA

SEQ ID NO: 777311 - protein, 23 aa, Mycobacterium
RSQGCGMSYVIAGPAAIAAATTE

SEQ ID NO: 777312 - protein, 19 aa, Mycobacterium
RSQMALGFFQAVAGDSAVA

SEQ ID NO: 777313 - protein, 19 aa, Mycobacterium
RSQMAMGFFRHLAADRATV

SEQ ID NO: 777314 - protein, 18 aa, Mycobacterium
RSRAWRREWAYSRAATIY

SEQ ID NO: 777315 - protein, 20 aa, Mycobacterium
RSREVWLMVSGAGKADAAAA

SEQ ID NO: 777316 - protein, 19 aa, Mycobacterium
RSREVWLMVSGSAKADAVA

SEQ ID NO: 777317 - protein, 18 aa, Mycobacterium
RSRFAVRAGRWFYVDGEI

SEQ ID NO: 777318 - protein, 21 aa, Mycobacterium
RSRGAAAIGAWARIENAAVAQ

SEQ ID NO: 777319 - protein, 17 aa, Mycobacterium
RSRGVVGYDRCFMAQKG

SEQ ID NO: 777320 - protein, 19 aa, Mycobacterium
RSRHCVNVVVAGKQPALTY

SEQ ID NO: 777321 - protein, 18 aa, Mycobacterium
RSRIKEIPLFTGPGTLGL

SEQ ID NO: 777322 - protein, 20 aa, Mycobacterium
RSRLEMVLKVLDVDGAVRRV

SEQ ID NO: 777323 - protein, 21 aa, Mycobacterium
RSRLMLDIASWRRKRREELAA

SEQ ID NO: 777324 - protein, 22 aa, Mycobacterium
RSRPLWECWIIEGLPSDRWAIL

SEQ ID NO: 777325 - protein, 20 aa, Mycobacterium
RSRRGAAIGHGQREAYMSFL

SEQ ID NO: 777326 - protein, 22 aa, Mycobacterium
RSRRPGEIASIFVPSVPNLLQL

SEQ ID NO: 777327 - protein, 20 aa, Mycobacterium
RSRRPYPHWHLSASDRLRVV

SEQ ID NO: 777328 - protein, 17 aa, Mycobacterium
RSRSHVVTFPRDLTDRA

SEQ ID NO: 777329 - protein, 18 aa, Mycobacterium
RSSIAASMIDRGDRTVVL

SEQ ID NO: 777330 - protein, 20 aa, Mycobacterium
RSSKTRFAIYLGDLGNDTAA

SEQ ID NO: 777331 - protein, 18 aa, Mycobacterium
RSSPRVGDGFIRLDEAGV

SEQ ID NO: 777332 - protein, 23 aa, Mycobacterium
RSSPRVGDGFIRLDVSGGVKYAS

SEQ ID NO: 777333 - protein, 18 aa, Mycobacterium
RSSPRVGDGFIRLNEGGE

SEQ ID NO: 777334 - protein, 25 aa, Mycobacterium
RSSRYPAGMALRFVRVLRYRDDKSP

SEQ ID NO: 777335 - protein, 19 aa, Mycobacterium
RSSVATWLFGIVKNTASRY

SEQ ID NO: 777336 - protein, 20 aa, Mycobacterium
RSSVSTWLFGIVKHTASRHR

SEQ ID NO: 777337 - protein, 20 aa, Mycobacterium
RSTEEVRFLMGFNREVVRRR

SEQ ID NO: 777338 - protein, 17 aa, Mycobacterium
RSTFPVWMMNAIGDITF

SEQ ID NO: 777339 - protein, 19 aa, Mycobacterium
RSTGLFGFIVDWANDPNVL

SEQ ID NO: 777340 - protein, 20 aa, Mycobacterium
RSTGLFLWQNIFGVWPADGA

SEQ ID NO: 777341 - protein, 23 aa, Mycobacterium
RSTLRRLGVKYVYDSRTTDFADQ

SEQ ID NO: 777342 - protein, 26 aa, Mycobacterium
RSTPRVGDGFIRLDVKGVVDYASPNA

SEQ ID NO: 777343 - protein, 23 aa, Mycobacterium
RSTRAQAALSWRHFESESIEGTP

SEQ ID NO: 777344 - protein, 23 aa, Mycobacterium
RSTTLALRWLVNFSRQRREKTMV

SEQ ID NO: 777345 - protein, 24 aa, Mycobacterium
RSTTLALRWLVTFSRARREKTMVE

SEQ ID NO: 777346 - protein, 17 aa, Mycobacterium
RSVAKWLRRLGVTVLES

SEQ ID NO: 777347 - protein, 19 aa, Mycobacterium
RSVCPFCAVGCAQKVYVTD

SEQ ID NO: 777348 - protein, 17 aa, Mycobacterium
RSVDLLALHVCKDADTG

SEQ ID NO: 777349 - protein, 21 aa, Mycobacterium
RSVEALGRIDVVCFDKTGTLS

SEQ ID NO: 777350 - protein, 18 aa, Mycobacterium
RSVGYFGAGTVEFILDSD

SEQ ID NO: 777351 - protein, 27 aa, Mycobacterium
RSVKYFLNRIGLFPTYVRQILSESEFD

SEQ ID NO: 777352 - protein, 17 aa, Mycobacterium
RSVLCGNIGSPVLEVLD

SEQ ID NO: 777353 - protein, 20 aa, Mycobacterium
RSVRGLWHFGLQPDEVAGFV

SEQ ID NO: 777354 - protein, 17 aa, Mycobacterium
RSVSHLPQWARRWQRLL

SEQ ID NO: 777355 - protein, 21 aa, Mycobacterium
RSVSWLPLYHDMGLLMILFPL

SEQ ID NO: 777356 - protein, 22 aa, Mycobacterium
RSVTLALRWLVSFSKARREKTM

SEQ ID NO: 777357 - protein, 20 aa, Mycobacterium
RSVVEIGDYVGAYFLDDRAA

SEQ ID NO: 777358 - protein, 20 aa, Mycobacterium
RSWPSISRARIRGHDGAAGV

SEQ ID NO: 777359 - protein, 18 aa, Mycobacterium
RSWRLAWPAGTTVYELDQ

SEQ ID NO: 777360 - protein, 20 aa, Mycobacterium
RSYLPGMIEKGWGRAIQIAS

SEQ ID NO: 777361 - protein, 24 aa, Mycobacterium
RSYSPRFLFTWPNSRSAVMGPAQL

SEQ ID NO: 777362 - protein, 19 aa, Mycobacterium
RTAAELASWHQSWATACQK

SEQ ID NO: 777363 - protein, 17 aa, Mycobacterium
RTAAELASWKHRWARAC

SEQ ID NO: 777364 - protein, 17 aa, Mycobacterium
RTAAELFSWGKSWLETC

SEQ ID NO: 777365 - protein, 18 aa, Mycobacterium
RTAATWLPALKAWRRVRR

SEQ ID NO: 777366 - protein, 25 aa, Mycobacterium
RTADEFSWRAGELINAIADGSIKIT

SEQ ID NO: 777367 - protein, 19 aa, Mycobacterium
RTAFDIGEWGIGFMTTSLE

SEQ ID NO: 777368 - protein, 18 aa, Mycobacterium
RTAFPAAIDTEFVTLVAE

SEQ ID NO: 777369 - protein, 25 aa, Mycobacterium
RTAKLPPDFKVVIIGAGIAGMAAAL

SEQ ID NO: 777370 - protein, 22 aa, Mycobacterium
RTALALNHLVCTRFRSDALQII

SEQ ID NO: 777371 - protein, 23 aa, Mycobacterium
RTALALNHLVCTRFRSDALQIIA

SEQ ID NO: 777372 - protein, 18 aa, Mycobacterium
RTALLNRFVTTVVHGMEA

SEQ ID NO: 777373 - protein, 23 aa, Mycobacterium
RTARLQALPGWVWNSDAPGRQVN

SEQ ID NO: 777374 - protein, 18 aa, Mycobacterium
RTASAGQRLAIWARDRGC

SEQ ID NO: 777375 - protein, 19 aa, Mycobacterium
RTDEQWRWLAHTLTVERLK

SEQ ID NO: 777376 - protein, 20 aa, Mycobacterium
RTDHYGWISGLLLELGITSL

SEQ ID NO: 777377 - protein, 19 aa, Mycobacterium
RTDIMPISIGFPFGLSVVA

SEQ ID NO: 777378 - protein, 18 aa, Mycobacterium
RTDRDWLADIVRFVASRR

SEQ ID NO: 777379 - protein, 23 aa, Mycobacterium
RTDRLPLSAPRDWDVPGETGAAG

SEQ ID NO: 777380 - protein, 18 aa, Mycobacterium
RTDVKLVLQDDRNLVLYS

SEQ ID NO: 777381 - protein, 22 aa, Mycobacterium
RTELGWEFIQIYGLTETAPLIT

SEQ ID NO: 777382 - protein, 18 aa, Mycobacterium
RTELVNWTLVTGDDGVLL

SEQ ID NO: 777383 - protein, 18 aa, Mycobacterium
RTELWPGLRETFKTRNGA

SEQ ID NO: 777384 - protein, 17 aa, Mycobacterium
RTEPCTSVAAIAAAPAG

SEQ ID NO: 777385 - protein, 17 aa, Mycobacterium
RTFALMGPTYVKLGQLI

SEQ ID NO: 777386 - protein, 19 aa, Mycobacterium
RTFARRRIDAILAGVPAAA

SEQ ID NO: 777387 - protein, 22 aa, Mycobacterium
RTFARRRIDTILAGVEPVDDAS

SEQ ID NO: 777388 - protein, 20 aa, Mycobacterium
RTFSLGSWWSGVAWSTIKVP

SEQ ID NO: 777389 - protein, 20 aa, Mycobacterium
RTFVCPFHGWCWAIDGRNIY

SEQ ID NO: 777390 - protein, 19 aa, Mycobacterium
RTGDEWKLAARTVYFEQAT

SEQ ID NO: 777391 - protein, 26 aa, Mycobacterium
RTGIYGHARACGWAIRDGVIGNSSTP

SEQ ID NO: 777392 - protein, 18 aa, Mycobacterium
RTGLVAFSLHFPWSQQLP

SEQ ID NO: 777393 - protein, 17 aa, Mycobacterium
RTGLVAFSLHYPWSQKL

SEQ ID NO: 777394 - protein, 24 aa, Mycobacterium
RTGMAVYDWMCWRMNKKAEDRQRR

SEQ ID NO: 777395 - protein, 25 aa, Mycobacterium
RTGMSVYDWMCWRMNKKAEDRQRRE

SEQ ID NO: 777396 - protein, 25 aa, Mycobacterium
RTGQEFSWRAEELFDAIAGGAINIE

SEQ ID NO: 777397 - protein, 19 aa, Mycobacterium
RTGVFSLDAGEWFRSFPAA

SEQ ID NO: 777398 - protein, 18 aa, Mycobacterium
RTGVFSLDARQWFQSFPA

SEQ ID NO: 777399 - protein, 18 aa, Mycobacterium
RTGWVLSEMYYRSGERVP

SEQ ID NO: 777400 - protein, 19 aa, Mycobacterium
RTHGWRWLRVRLAEEPKDP

SEQ ID NO: 777401 - protein, 17 aa, Mycobacterium
RTHLRYGEWLRRVNRRP

SEQ ID NO: 777402 - protein, 19 aa, Mycobacterium
RTIHGYKRAFRIAGSGPAI

SEQ ID NO: 777403 - protein, 19 aa, Mycobacterium
RTIRGCGAPVMSLRTDRDW

SEQ ID NO: 777404 - protein, 24 aa, Mycobacterium
RTITLEHPEIWGAIIDFDNSVPAQ

SEQ ID NO: 777405 - protein, 17 aa, Mycobacterium
RTKMVLGGYSQGAAVAG

SEQ ID NO: 777406 - protein, 17 aa, Mycobacterium
RTKRWPDVLAQFPEATP

SEQ ID NO: 777407 - protein, 24 aa, Mycobacterium
RTLALEHPEFWGGLVDVDESLPAE

SEQ ID NO: 777408 - protein, 23 aa, Mycobacterium
RTLALEHPEIWGGVLDVDASVPA

SEQ ID NO: 777409 - protein, 18 aa, Mycobacterium
RTLCLDAKLYAGGMASTV

SEQ ID NO: 777410 - protein, 17 aa, Mycobacterium
RTLEILERFYGLVLTDC

SEQ ID NO: 777411 - protein, 19 aa, Mycobacterium
RTLGLRRIRHSVVREDNPQ

SEQ ID NO: 777412 - protein, 18 aa, Mycobacterium
RTLGLRRIRHTVVRDDNA

SEQ ID NO: 777413 - protein, 19 aa, Mycobacterium
RTLPFRLVLDGAREIETDL

SEQ ID NO: 777414 - protein, 17 aa, Mycobacterium
RTLPRVMVIGAPEDRIP

SEQ ID NO: 777415 - protein, 17 aa, Mycobacterium
RTLPTRFSTAWDVQAAE

SEQ ID NO: 777416 - protein, 21 aa, Mycobacterium
RTLRVAWSLADLAGRAAPGLD

SEQ ID NO: 777417 - protein, 21 aa, Mycobacterium
RTLRVAWSLADLAGRTSPGLD

SEQ ID NO: 777418 - protein, 21 aa, Mycobacterium
RTLRVAWSLADLAGRVSPSLE

SEQ ID NO: 777419 - protein, 18 aa, Mycobacterium
RTLVEFGGYLGSNFLDDR

SEQ ID NO: 777420 - protein, 24 aa, Mycobacterium
RTLVEVPVGFKWFVGGLLDGTIGF

SEQ ID NO: 777421 - protein, 21 aa, Mycobacterium
RTLWSGMTWQYWLATRRFKES

SEQ ID NO: 777422 - protein, 18 aa, Mycobacterium
RTLYRDRLLVLGALDVAS

SEQ ID NO: 777423 - protein, 19 aa, Mycobacterium
RTPAFWRFARRHWRTGITE

SEQ ID NO: 777424 - protein, 26 aa, Mycobacterium
RTPDEFSWRAGELLTAIADGALTVTV

SEQ ID NO: 777425 - protein, 19 aa, Mycobacterium
RTPESWLLIDFEGEPGQPL

SEQ ID NO: 777426 - protein, 20 aa, Mycobacterium
RTPESWLLIDFEGEPGQPLD

SEQ ID NO: 777427 - protein, 20 aa, Mycobacterium
RTPESWLLIDFEGEPGQPLE

SEQ ID NO: 777428 - protein, 20 aa, Mycobacterium
RTPESWLLIDFEGEPGQPVD

SEQ ID NO: 777429 - protein, 20 aa, Mycobacterium
RTPESWVLIDFEGEPGQPLR

SEQ ID NO: 777430 - protein, 18 aa, Mycobacterium
RTPFRQHVWDRLAEGIRF

SEQ ID NO: 777431 - protein, 17 aa, Mycobacterium
RTPIDWDGYTPPLPAQG

SEQ ID NO: 777432 - protein, 21 aa, Mycobacterium
RTPRLNCFGLHEWAMVYRTDH

SEQ ID NO: 777433 - protein, 18 aa, Mycobacterium
RTPTIASVHGWCIGGGVD

SEQ ID NO: 777434 - protein, 17 aa, Mycobacterium
RTPVFNFIAPKVAGLPF

SEQ ID NO: 777435 - protein, 22 aa, Mycobacterium
RTRAGWTFSGTISWVSGWGLNT

SEQ ID NO: 777436 - protein, 19 aa, Mycobacterium
RTRCLEMIDGPHVTHVLIT

SEQ ID NO: 777437 - protein, 24 aa, Mycobacterium
RTREGWLYCCAVLDAFSRRIVGWS

SEQ ID NO: 777438 - protein, 18 aa, Mycobacterium
RTRFRPHFFPFTEPSAEV

SEQ ID NO: 777439 - protein, 21 aa, Mycobacterium
RTRIPIFIEEALRMDAPVKSQ

SEQ ID NO: 777440 - protein, 18 aa, Mycobacterium
RTRISPISTMLFDADAKI

SEQ ID NO: 777441 - protein, 18 aa, Mycobacterium
RTRKAGAVGLVMAEPLTY

SEQ ID NO: 777442 - protein, 21 aa, Mycobacterium
RTRKAGAVGLVMAEPLTYFFS

SEQ ID NO: 777443 - protein, 19 aa, Mycobacterium
RTRLLELVWGYDFDVETNV

SEQ ID NO: 777444 - protein, 17 aa, Mycobacterium
RTRMWWRPAESIPNDPV

SEQ ID NO: 777445 - protein, 19 aa, Mycobacterium
RTRYDAVWCSGMRAKLGLP

SEQ ID NO: 777446 - protein, 19 aa, Mycobacterium
RTSAPILRRVFGDRIPASV

SEQ ID NO: 777447 - protein, 23 aa, Mycobacterium
RTSAVKIFTAWATRRGLLPTDPA

SEQ ID NO: 777448 - protein, 17 aa, Mycobacterium
RTSDEFNAAVVLVAALN

SEQ ID NO: 777449 - protein, 17 aa, Mycobacterium
RTSGVPVLAVWGRNDPI

SEQ ID NO: 777450 - protein, 20 aa, Mycobacterium
RTSIDAGWLLDYWSDRVYRL

SEQ ID NO: 777451 - protein, 17 aa, Mycobacterium
RTSMKWRAHPAAVLPLW

SEQ ID NO: 777452 - protein, 19 aa, Mycobacterium
RTSPDWANMVGPFGGITAA

SEQ ID NO: 777453 - protein, 22 aa, Mycobacterium
RTSSVKTFTAWAVRRGLIGDDP

SEQ ID NO: 777454 - protein, 18 aa, Mycobacterium
RTTFDWGVPVPDNPEHVM

SEQ ID NO: 777455 - protein, 26 aa, Mycobacterium
RTTFGFRLGFFGPFAIADQAGLDVYV

SEQ ID NO: 777456 - protein, 20 aa, Mycobacterium
RTTLNLKACIKAAADRVVFI

SEQ ID NO: 777457 - protein, 25 aa, Mycobacterium
RTTLNLKACIKAAADRVVFINTGFL

SEQ ID NO: 777458 - protein, 23 aa, Mycobacterium
RTVAYRNGRRWILDGEPVQGTAA

SEQ ID NO: 777459 - protein, 22 aa, Mycobacterium
RTVCIKAMIEKVVERMYAEIDD

SEQ ID NO: 777460 - protein, 19 aa, Mycobacterium
RTVEAMLALGARAEDISAL

SEQ ID NO: 777461 - protein, 20 aa, Mycobacterium
RTVESLGFDTAWLGGSPPAD

SEQ ID NO: 777462 - protein, 18 aa, Mycobacterium
RTVFPLTFAELVRITGGQ

SEQ ID NO: 777463 - protein, 19 aa, Mycobacterium
RTVPLPPWLAKRMADYLAE

SEQ ID NO: 777464 - protein, 18 aa, Mycobacterium
RTVVCWAMGLTQHAHAVA

SEQ ID NO: 777465 - protein, 17 aa, Mycobacterium
RTVVLRLRFDDFGRATR

SEQ ID NO: 777466 - protein, 18 aa, Mycobacterium
RTVVLRLRFDDFGRATRS

SEQ ID NO: 777467 - protein, 17 aa, Mycobacterium
RTVVLRLRFDDFSRATR

SEQ ID NO: 777468 - protein, 17 aa, Mycobacterium
RTYARFLARWQIDTTTG

SEQ ID NO: 777469 - protein, 19 aa, Mycobacterium
RTYRLPWPDGTVVYELDQP

SEQ ID NO: 777470 - protein, 26 aa, Mycobacterium
RTYVCPFHGWCWGLDGHNTFVLRPEA

SEQ ID NO: 777471 - protein, 23 aa, Mycobacterium
RVAAHGDGWCPFPAPAPLAQTAG

SEQ ID NO: 777472 - protein, 20 aa, Mycobacterium
RVAALRRCVPMLARIKDPTL

SEQ ID NO: 777473 - protein, 19 aa, Mycobacterium
RVAALRRCVPMVGQIKDPM

SEQ ID NO: 777474 - protein, 18 aa, Mycobacterium
RVAARLLAVLPRTVKDRA

SEQ ID NO: 777475 - protein, 18 aa, Mycobacterium
RVAARLLAVVPTGVKDRA

SEQ ID NO: 777476 - protein, 19 aa, Mycobacterium
RVACWTAPLLRHLDRLAEL

SEQ ID NO: 777477 - protein, 17 aa, Mycobacterium
RVADGWIKAQAYRLQTF

SEQ ID NO: 777478 - protein, 24 aa, Mycobacterium
RVAELGRAYVRWAVAHPDHYRVMF

SEQ ID NO: 777479 - protein, 19 aa, Mycobacterium
RVAGRLGLRPDVRRVPLFG

SEQ ID NO: 777480 - protein, 17 aa, Mycobacterium
RVAGYRAGWLAITGPKD

SEQ ID NO: 777481 - protein, 17 aa, Mycobacterium
RVAIPVFVGIDYASRVG

SEQ ID NO: 777482 - protein, 23 aa, Mycobacterium
RVAPRLGRQWLLPVCAETWDGYL

SEQ ID NO: 777483 - protein, 17 aa, Mycobacterium
RVAQWFPPRRYLPRTSR

SEQ ID NO: 777484 - protein, 17 aa, Mycobacterium
RVARLLAYRAVALRDDP

SEQ ID NO: 777485 - protein, 22 aa, Mycobacterium
RVARLRLGIGVTDSGRRNPAVT

SEQ ID NO: 777486 - protein, 17 aa, Mycobacterium
RVARWMVVFLQRPGGQA

SEQ ID NO: 777487 - protein, 19 aa, Mycobacterium
RVASDLSNWGRWGDTDELG

SEQ ID NO: 777488 - protein, 17 aa, Mycobacterium
RVATVKAGLGGAVEPVS

SEQ ID NO: 777489 - protein, 17 aa, Mycobacterium
RVCETEWDILTLLDGST

SEQ ID NO: 777490 - protein, 17 aa, Mycobacterium
RVCGGLEPMWLWLNHDG

SEQ ID NO: 777491 - protein, 18 aa, Mycobacterium
RVCRDCGFYLPLGGALGR

SEQ ID NO: 777492 - protein, 18 aa, Mycobacterium
RVDFLWRSARLIGEYDSD

SEQ ID NO: 777493 - protein, 21 aa, Mycobacterium
RVDGAWCFDSRTMFVDQVGDV

SEQ ID NO: 777494 - protein, 18 aa, Mycobacterium
RVDTIRTGDEWKLAARTV

SEQ ID NO: 777495 - protein, 27 aa, Mycobacterium
RVEAVWKPREQWGFGIDNIEYFRPTGE

SEQ ID NO: 777496 - protein, 19 aa, Mycobacterium
RVEGVHLRFGFVARGGLRW

SEQ ID NO: 777497 - protein, 20 aa, Mycobacterium
RVEGVHLRFGFVARGGLRWS

SEQ ID NO: 777498 - protein, 26 aa, Mycobacterium
RVEQGFSWPCVMVFISDWAAPKSLTP

SEQ ID NO: 777499 - protein, 17 aa, Mycobacterium
RVEYKLRDWLFARQRYW

SEQ ID NO: 777500 - protein, 18 aa, Mycobacterium
RVFAHALTWLFGELIAQR

SEQ ID NO: 777501 - protein, 23 aa, Mycobacterium
RVFMPFIGGFGVYGAICADVAAS

SEQ ID NO: 777502 - protein, 18 aa, Mycobacterium
RVFRRIRPAFSYERSLSV

SEQ ID NO: 777503 - protein, 17 aa, Mycobacterium
RVFRTCRDLGIATVAVY

SEQ ID NO: 777504 - protein, 17 aa, Mycobacterium
RVFSEPIALNWAADGTD

SEQ ID NO: 777505 - protein, 18 aa, Mycobacterium
RVGAEGSGGLAAGDNGGA

SEQ ID NO: 777506 - protein, 19 aa, Mycobacterium
RVGALRRCVPMVGQIKDPT

SEQ ID NO: 777507 - protein, 21 aa, Mycobacterium
RVGDRVGIAWLRHTCGVCKYC

SEQ ID NO: 777508 - protein, 19 aa, Mycobacterium
RVGELCPACSRLGPATDDE

SEQ ID NO: 777509 - protein, 19 aa, Mycobacterium
RVGGDWILNGTKYYISGVD

SEQ ID NO: 777510 - protein, 28 aa, Mycobacterium
RVGILFPNCAQWLIAWLAAARIGALTVP

SEQ ID NO: 777511 - protein, 18 aa, Mycobacterium
RVGLLAARCRDLADEMGL

SEQ ID NO: 777512 - protein, 17 aa, Mycobacterium
RVGLPWQTIGAFLRIAT

SEQ ID NO: 777513 - protein, 18 aa, Mycobacterium
RVGLRIVVVLKRDAVAKV

SEQ ID NO: 777514 - protein, 24 aa, Mycobacterium
RVGNRLRPWLPLLLGLTANSAIYR

SEQ ID NO: 777515 - protein, 17 aa, Mycobacterium
RVGRPRLTYEIAPRLDY

SEQ ID NO: 777516 - protein, 19 aa, Mycobacterium
RVGVAWLRYTCGRCAYCLR

SEQ ID NO: 777517 - protein, 21 aa, Mycobacterium
RVGWFEGGIAWVPWALQDAEH

SEQ ID NO: 777518 - protein, 18 aa, Mycobacterium
RVHFARTELVNWTLVTGD

SEQ ID NO: 777519 - protein, 23 aa, Mycobacterium
RVHGRLRLGPGWVSHILQDLAVR

SEQ ID NO: 777520 - protein, 23 aa, Mycobacterium
RVHGRLRLGPGWVSHLLQDLAVS

SEQ ID NO: 777521 - protein, 21 aa, Mycobacterium
RVIAETGVWVFAERARLLGLP

SEQ ID NO: 777522 - protein, 24 aa, Mycobacterium
RVIKEALRLLAPVPLVMRKTVRDV

SEQ ID NO: 777523 - protein, 20 aa, Mycobacterium
RVIRTLRRLGIRSVAVYSDA

SEQ ID NO: 777524 - protein, 18 aa, Mycobacterium
RVIVACFASNVARVQQII

SEQ ID NO: 777525 - protein, 20 aa, Mycobacterium
RVKCALLGWTAFKAALAEAH

SEQ ID NO: 777526 - protein, 19 aa, Mycobacterium
RVKFGWGFNAEIPLASIKD

SEQ ID NO: 777527 - protein, 18 aa, Mycobacterium
RVKRPQMGIAAWIIPSIV

SEQ ID NO: 777528 - protein, 26 aa, Mycobacterium
RVKSISLRLGVPWYAYDTTVFTGEVA

SEQ ID NO: 777529 - protein, 17 aa, Mycobacterium
RVKTWLQFPKWFYDNLP

SEQ ID NO: 777530 - protein, 22 aa, Mycobacterium
RVLDLGSCFGFFPLRLSRNGFD

SEQ ID NO: 777531 - protein, 17 aa, Mycobacterium
RVLDMTTFWAGPCATHF

SEQ ID NO: 777532 - protein, 17 aa, Mycobacterium
RVLDMTTFWAGPCCTHF

SEQ ID NO: 777533 - protein, 29 aa, Mycobacterium
RVLDMTTFWAGPCCTHFLAMLGAEVIHVE

SEQ ID NO: 777534 - protein, 17 aa, Mycobacterium
RVLGGAIAFGGKATEPS

SEQ ID NO: 777535 - protein, 17 aa, Mycobacterium
RVLKLAGIQPVWLREGL

SEQ ID NO: 777536 - protein, 24 aa, Mycobacterium
RVLLRECVEFFAPYLSAARLTGEV

SEQ ID NO: 777537 - protein, 17 aa, Mycobacterium
RVLPVFGLRSAIPAERE

SEQ ID NO: 777538 - protein, 19 aa, Mycobacterium
RVLPVFGLRSAMPAEREAF

SEQ ID NO: 777539 - protein, 19 aa, Mycobacterium
RVLPYCWRDETPLSNHELR

SEQ ID NO: 777540 - protein, 20 aa, Mycobacterium
RVLREISIELSVMGSEGRQG

SEQ ID NO: 777541 - protein, 22 aa, Mycobacterium
RVLREWFAQLVMYSMSATLADS

SEQ ID NO: 777542 - protein, 23 aa, Mycobacterium
RVLRPGGSLGLVWNNRDERLGWV

SEQ ID NO: 777543 - protein, 17 aa, Mycobacterium
RVLSRFVDAIVWRTFGQ

SEQ ID NO: 777544 - protein, 23 aa, Mycobacterium
RVLVHPRPRLSVISVGGELVDVD

SEQ ID NO: 777545 - protein, 24 aa, Mycobacterium
RVMRSDRGFLCFPEVDIHIPFTPG

SEQ ID NO: 777546 - protein, 21 aa, Mycobacterium
RVMRTLRRLRIRSVAVYSDPD

SEQ ID NO: 777547 - protein, 19 aa, Mycobacterium
RVPDEFGLCRYLAAGLAAL

SEQ ID NO: 777548 - protein, 18 aa, Mycobacterium
RVQLEIFTKFSIPINIAR

SEQ ID NO: 777549 - protein, 19 aa, Mycobacterium
RVQRVRWVGGYGRMDSTTG

SEQ ID NO: 777550 - protein, 17 aa, Mycobacterium
RVRAGLHSLPWDGLKLS

SEQ ID NO: 777551 - protein, 23 aa, Mycobacterium
RVRLRGGPVLAELTGRFGASARS

SEQ ID NO: 777552 - protein, 23 aa, Mycobacterium
RVRMMRWGFVPSWAKPGPQGAPE

SEQ ID NO: 777553 - protein, 21 aa, Mycobacterium
RVRPGNCFAPFHWNDAFGEYL

SEQ ID NO: 777554 - protein, 21 aa, Mycobacterium
RVRPGNCFAPFHWNDVFGEYL

SEQ ID NO: 777555 - protein, 20 aa, Mycobacterium
RVSAELSVAVADAMDHAEDS

SEQ ID NO: 777556 - protein, 20 aa, Mycobacterium
RVSDVWAMFDTLRFDLNVVA

SEQ ID NO: 777557 - protein, 22 aa, Mycobacterium
RVSELPFVLPIVELGFDYPDYL

SEQ ID NO: 777558 - protein, 24 aa, Mycobacterium
RVSNALDFGCVWINTHIPLVAEMP

SEQ ID NO: 777559 - protein, 18 aa, Mycobacterium
RVTDAWGVPAARIECSHS

SEQ ID NO: 777560 - protein, 18 aa, Mycobacterium
RVTDCPYPYFASPVELAA

SEQ ID NO: 777561 - protein, 21 aa, Mycobacterium
RVTLKLRRCFDITAANSAQSR

SEQ ID NO: 777562 - protein, 17 aa, Mycobacterium
RVTMPINIRTAADAGTW

SEQ ID NO: 777563 - protein, 23 aa, Mycobacterium
RVVAKCFLLWAAVVGAISLEVFG

SEQ ID NO: 777564 - protein, 24 aa, Mycobacterium
RVVAKCFLLWAGVLGAISLEVFGQ

SEQ ID NO: 777565 - protein, 19 aa, Mycobacterium
RVVDFAAGLAFALRGSFDK

SEQ ID NO: 777566 - protein, 24 aa, Mycobacterium
RVVEWRLDLPLTMFPRTPHDVWQE

SEQ ID NO: 777567 - protein, 17 aa, Mycobacterium
RVVGFKLSGEIKPGVTA

SEQ ID NO: 777568 - protein, 18 aa, Mycobacterium
RVVKRWRRGTPLAEAETV

SEQ ID NO: 777569 - protein, 18 aa, Mycobacterium
RVVKRWRRGTPLAEAQTV

SEQ ID NO: 777570 - protein, 18 aa, Mycobacterium
RVVLVFLPRCGHCAACAT

SEQ ID NO: 777571 - protein, 19 aa, Mycobacterium
RVVMGRGWVQLMRDDVEGA

SEQ ID NO: 777572 - protein, 22 aa, Mycobacterium
RVVMPVVVRWGMYRGVRKNHPL

SEQ ID NO: 777573 - protein, 18 aa, Mycobacterium
RVVRHWIDHGVKFFRVDN

SEQ ID NO: 777574 - protein, 17 aa, Mycobacterium
RVVRHWMDHGVKFFRVD

SEQ ID NO: 777575 - protein, 18 aa, Mycobacterium
RVVSRPEPELALLDAGKR

SEQ ID NO: 777576 - protein, 20 aa, Mycobacterium
RVVTAFPRRPALVAHSVARR

SEQ ID NO: 777577 - protein, 20 aa, Mycobacterium
RVVVLPWDRHIAAGTEIHLD

SEQ ID NO: 777578 - protein, 20 aa, Mycobacterium
RVWEKLRAGIEFAVANEPDD

SEQ ID NO: 777579 - protein, 17 aa, Mycobacterium
RVWPSPLLPALPTMFDG

SEQ ID NO: 777580 - protein, 20 aa, Mycobacterium
RVYCPGWVALFRWIKPVLST

SEQ ID NO: 777581 - protein, 23 aa, Mycobacterium
RVYRLPMNAARVWRVINDSGGGE

SEQ ID NO: 777582 - protein, 19 aa, Mycobacterium
RWADEWRRMAAVAVSSADG

SEQ ID NO: 777583 - protein, 21 aa, Mycobacterium
RWADKFGALVFDATGITTPVE

SEQ ID NO: 777584 - protein, 21 aa, Mycobacterium
RWADQFGGLVFDATGITTPEG

SEQ ID NO: 777585 - protein, 21 aa, Mycobacterium
RWADSFGGLVFDATGITDPAG

SEQ ID NO: 777586 - protein, 18 aa, Mycobacterium
RWAEAAGISVTPGRMYVH

SEQ ID NO: 777587 - protein, 20 aa, Mycobacterium
RWCPPRRWVDIGTFDDATPT

SEQ ID NO: 777588 - protein, 17 aa, Mycobacterium
RWCSGTSNRWCEMRVRI

SEQ ID NO: 777589 - protein, 22 aa, Mycobacterium
RWDPDLRALFGLDAEEMPEIVA

SEQ ID NO: 777590 - protein, 21 aa, Mycobacterium
RWDSLWVYDHFHTVPVPTGEA

SEQ ID NO: 777591 - protein, 20 aa, Mycobacterium
RWDTDWFWCSRAFGAQNPKI

SEQ ID NO: 777592 - protein, 17 aa, Mycobacterium
RWELPAFMQIVAGLAEA

SEQ ID NO: 777593 - protein, 20 aa, Mycobacterium
RWFDIGPCYIFHVANAYETT

SEQ ID NO: 777594 - protein, 18 aa, Mycobacterium
RWGAEVYHALKSVLKKEG

SEQ ID NO: 777595 - protein, 23 aa, Mycobacterium
RWGPLGSVGVRWGPLGKETAGMS

SEQ ID NO: 777596 - protein, 20 aa, Mycobacterium
RWHPVSCLPPMAFDHGPMVT

SEQ ID NO: 777597 - protein, 19 aa, Mycobacterium
RWIDHSMFFPQRFRSPLSI

SEQ ID NO: 777598 - protein, 17 aa, Mycobacterium
RWIRLRLSRGLNLEAGG

SEQ ID NO: 777599 - protein, 18 aa, Mycobacterium
RWIRRVPPLYGQHTQEVL

SEQ ID NO: 777600 - protein, 24 aa, Mycobacterium
RWKGKSVVWSQTWRNLHSGEPAEI

SEQ ID NO: 777601 - protein, 19 aa, Mycobacterium
RWLAESLPAPLPRGTVAVL

SEQ ID NO: 777602 - protein, 18 aa, Mycobacterium
RWLARKMAALALGSSDLP

SEQ ID NO: 777603 - protein, 19 aa, Mycobacterium
RWLFPPFVAVFSPRGVRDV

SEQ ID NO: 777604 - protein, 19 aa, Mycobacterium
RWLLHLLSWVPVEAGIYRV

SEQ ID NO: 777605 - protein, 18 aa, Mycobacterium
RWLPERICWALSDEYHAN

SEQ ID NO: 777606 - protein, 20 aa, Mycobacterium
RWLPGPRELRAWALAAGSPE

SEQ ID NO: 777607 - protein, 17 aa, Mycobacterium
RWLPKFCTGEFITAIAM

SEQ ID NO: 777608 - protein, 25 aa, Mycobacterium
RWLPKFCTGELITAIAMTEPGTGSD

SEQ ID NO: 777609 - protein, 19 aa, Mycobacterium
RWLRWPTAWASRVGCSTRS

SEQ ID NO: 777610 - protein, 26 aa, Mycobacterium
RWLTGMFDRDGWRPGGVVVVGAHNDI

SEQ ID NO: 777611 - protein, 19 aa, Mycobacterium
RWNPKMKRFIFTDRNGIYI

SEQ ID NO: 777612 - protein, 21 aa, Mycobacterium
RWPAVHRLDAAHLFRLALENA

SEQ ID NO: 777613 - protein, 21 aa, Mycobacterium
RWPDPICGIGIIPTALDPSQA

SEQ ID NO: 777614 - protein, 18 aa, Mycobacterium
RWPEAGRWLGERGYDSTL

SEQ ID NO: 777615 - protein, 18 aa, Mycobacterium
RWPEWDIDYPTARLAPTS

SEQ ID NO: 777616 - protein, 18 aa, Mycobacterium
RWPHAGAFGPLIRDPDGA

SEQ ID NO: 777617 - protein, 18 aa, Mycobacterium
RWPRAGALGPLIRDPDGS

SEQ ID NO: 777618 - protein, 19 aa, Mycobacterium
RWQPLPTWFERLTRAGVEA

SEQ ID NO: 777619 - protein, 25 aa, Mycobacterium
RWQRPSGFSRFAWDWEHSLGGTPRW

SEQ ID NO: 777620 - protein, 19 aa, Mycobacterium
RWRAIACATQLLAGKHHRS

SEQ ID NO: 777621 - protein, 17 aa, Mycobacterium
RWRFVAFATDQKASTTL

SEQ ID NO: 777622 - protein, 20 aa, Mycobacterium
RWRKADAALGRPVISNQVHF

SEQ ID NO: 777623 - protein, 20 aa, Mycobacterium
RWRKADAALGRPVVSNQVHF

SEQ ID NO: 777624 - protein, 19 aa, Mycobacterium
RWRRMAEGVLHSKTRDAEA

SEQ ID NO: 777625 - protein, 18 aa, Mycobacterium
RWRRMVEGFRHSKTRDSE

SEQ ID NO: 777626 - protein, 19 aa, Mycobacterium
RWRSRELLTRIASVFQDPE

SEQ ID NO: 777627 - protein, 23 aa, Mycobacterium
RWSAEKHLAFACGRYEGIDQRVI

SEQ ID NO: 777628 - protein, 23 aa, Mycobacterium
RWSAWLVGPWWPAPPGSPAAGVS

SEQ ID NO: 777629 - protein, 19 aa, Mycobacterium
RWSCVQWGKLTPPFVGDAP

SEQ ID NO: 777630 - protein, 22 aa, Mycobacterium
RWSGRGRPRYRLMTADDRAALD

SEQ ID NO: 777631 - protein, 18 aa, Mycobacterium
RWSKLHSQYEYWSQIDTD

SEQ ID NO: 777632 - protein, 20 aa, Mycobacterium
RWSVPEVFWAWVSRMPVPAG

SEQ ID NO: 777633 - protein, 18 aa, Mycobacterium
RWSWFPSDQTVGFTRRMQ

SEQ ID NO: 777634 - protein, 19 aa, Mycobacterium
RWTALGVDLTRDWTTALRS

SEQ ID NO: 777635 - protein, 20 aa, Mycobacterium
RWTMFHSIAFDFSVWELWGP

SEQ ID NO: 777636 - protein, 17 aa, Mycobacterium
RWVFPYAGADAHDTYAI

SEQ ID NO: 777637 - protein, 17 aa, Mycobacterium
RWVQGLQVACERGFPVA

SEQ ID NO: 777638 - protein, 21 aa, Mycobacterium
RWVTECLRASYPLGHGHGPVS

SEQ ID NO: 777639 - protein, 18 aa, Mycobacterium
RWYRTGDMARYWPDGTIE

SEQ ID NO: 777640 - protein, 18 aa, Mycobacterium
RYAGGLVRLLGADDYPNI

SEQ ID NO: 777641 - protein, 23 aa, Mycobacterium
RYDWPVRTGLIIGRLDDDGSRFL

SEQ ID NO: 777642 - protein, 17 aa, Mycobacterium
RYEYRWWDGQSWTDQVS

SEQ ID NO: 777643 - protein, 20 aa, Mycobacterium
RYFEAIPGVWARRSSEVAQT

SEQ ID NO: 777644 - protein, 20 aa, Mycobacterium
RYFEAISGVWARRSSEVAQT

SEQ ID NO: 777645 - protein, 19 aa, Mycobacterium
RYFPVIAESVGTQWRSVPS

SEQ ID NO: 777646 - protein, 17 aa, Mycobacterium
RYFWPRLSPGAFVLLDD

SEQ ID NO: 777647 - protein, 18 aa, Mycobacterium
RYFWPRVVGDTGWQLLDS

SEQ ID NO: 777648 - protein, 18 aa, Mycobacterium
RYFWPRVVGDTGWQLLDT

SEQ ID NO: 777649 - protein, 20 aa, Mycobacterium
RYGFVPRRFRLMLTASGVNR

SEQ ID NO: 777650 - protein, 19 aa, Mycobacterium
RYGTWRLSDVLGYAAEYAE

SEQ ID NO: 777651 - protein, 24 aa, Mycobacterium
RYHGREFIELIAVGATYDLAAAAA

SEQ ID NO: 777652 - protein, 21 aa, Mycobacterium
RYICAGHPYPLLVSADGRSAY

SEQ ID NO: 777653 - protein, 17 aa, Mycobacterium
RYIGGVLARLQEVWMGR

SEQ ID NO: 777654 - protein, 19 aa, Mycobacterium
RYISEGALIMFAGGDPWKI

SEQ ID NO: 777655 - protein, 19 aa, Mycobacterium
RYLALEWLERMDLVDGRVI

SEQ ID NO: 777656 - protein, 21 aa, Mycobacterium
RYLDCPCCAGILKPDIVYFGE

SEQ ID NO: 777657 - protein, 19 aa, Mycobacterium
RYLECPPRALAAAKAVIND

SEQ ID NO: 777658 - protein, 18 aa, Mycobacterium
RYLEYTLRWRNVPKPSIA

SEQ ID NO: 777659 - protein, 17 aa, Mycobacterium
RYLGILFDGLRPEGAHP

SEQ ID NO: 777660 - protein, 17 aa, Mycobacterium
RYLPIWIGQSEAAAIAL

SEQ ID NO: 777661 - protein, 20 aa, Mycobacterium
RYLRRWHRRRALWAGVAIGG

SEQ ID NO: 777662 - protein, 18 aa, Mycobacterium
RYLTFDLDGGAAWEPIAD

SEQ ID NO: 777663 - protein, 19 aa, Mycobacterium
RYPLPSAWCADADVALYLK

SEQ ID NO: 777664 - protein, 22 aa, Mycobacterium
RYPWLEAIGKWLAEHPAGGVMS

SEQ ID NO: 777665 - protein, 19 aa, Mycobacterium
RYQRFAAFWRSRPVNWVWD

SEQ ID NO: 777666 - protein, 19 aa, Mycobacterium
RYRGLRAPHKIKLGVSGCA

SEQ ID NO: 777667 - protein, 21 aa, Mycobacterium
RYRKCFSDGLYLTGDLAKKDA

SEQ ID NO: 777668 - protein, 19 aa, Mycobacterium
RYRLAELALRSKIPLVMLL

SEQ ID NO: 777669 - protein, 18 aa, Mycobacterium
RYRLGLPHAGTWREVLNT

SEQ ID NO: 777670 - protein, 17 aa, Mycobacterium
RYRRMALEQTPIRSILS

SEQ ID NO: 777671 - protein, 18 aa, Mycobacterium
RYRVGAVTAVPADSGGPT

SEQ ID NO: 777672 - protein, 18 aa, Mycobacterium
RYRVLPFTGARKIDSGVV

SEQ ID NO: 777673 - protein, 19 aa, Mycobacterium
RYSGHAIAGVSGFGFGGAN

SEQ ID NO: 777674 - protein, 17 aa, Mycobacterium
RYTGLYIPFMDVSFDGA

SEQ ID NO: 777675 - protein, 19 aa, Mycobacterium
RYTMPLGEIIFDFFDSLKS

SEQ ID NO: 777676 - protein, 17 aa, Mycobacterium
RYTRGRFASAFGPRAAL

SEQ ID NO: 777677 - protein, 24 aa, Mycobacterium
RYTWPRFVCGLPREFFAAVRTELA

SEQ ID NO: 777678 - protein, 24 aa, Mycobacterium
RYVAKYTICPAIAHGLDHEVGSVE

SEQ ID NO: 777679 - protein, 18 aa, Mycobacterium
RYVMMVLRHIPRPVFRKL

SEQ ID NO: 777680 - protein, 18 aa, Mycobacterium
RYVMMVLRHIPRSIFRKL

SEQ ID NO: 777681 - protein, 17 aa, Mycobacterium
RYWSVALESIWHECLEP

SEQ ID NO: 777682 - protein, 19 aa, Mycobacterium
SAAAVWRIRRVAPLLPTVL

SEQ ID NO: 777683 - protein, 17 aa, Mycobacterium
SAAESFASVTAGLAEQA

SEQ ID NO: 777684 - protein, 17 aa, Mycobacterium
SAAFQAAHARFVEVAAR

SEQ ID NO: 777685 - protein, 18 aa, Mycobacterium
SAAGLTRLAGGGFGGGPT

SEQ ID NO: 777686 - protein, 25 aa, Mycobacterium
SAAHKARWGVCLARTDPEAPKHKGI

SEQ ID NO: 777687 - protein, 20 aa, Mycobacterium
SAAIAALFGAHAWQYQAISA

SEQ ID NO: 777688 - protein, 20 aa, Mycobacterium
SAAIASLFAGYARDYQSLSA

SEQ ID NO: 777689 - protein, 19 aa, Mycobacterium
SAAITALFGAHAQTYQALS

SEQ ID NO: 777690 - protein, 17 aa, Mycobacterium
SAALIWRRPRWAKRLQP

SEQ ID NO: 777691 - protein, 18 aa, Mycobacterium
SAALIWRRPRWAKRLQPG

SEQ ID NO: 777692 - protein, 20 aa, Mycobacterium
SAAQLRQWFQFRIDGPNPVN

SEQ ID NO: 777693 - protein, 20 aa, Mycobacterium
SAAQLRTWFAYQIEGPSEVN

SEQ ID NO: 777694 - protein, 19 aa, Mycobacterium
SAAVAALFSDHAHNYQALG

SEQ ID NO: 777695 - protein, 24 aa, Mycobacterium
SAAVPEWAGSAWLRRVPGVAAPVS

SEQ ID NO: 777696 - protein, 26 aa, Mycobacterium
SAAVSSFFGAYARDYQAFSVQVEALH

SEQ ID NO: 777697 - protein, 19 aa, Mycobacterium
SACPMNALRLIEPRPADPS

SEQ ID NO: 777698 - protein, 17 aa, Mycobacterium
SADRAFDVLKWRSQETN

SEQ ID NO: 777699 - protein, 21 aa, Mycobacterium
SADWKLGCIVAVDGVIEPRLL

SEQ ID NO: 777700 - protein, 19 aa, Mycobacterium
SAEDFPRREHLAYQIAEVA

SEQ ID NO: 777701 - protein, 18 aa, Mycobacterium
SAEEVRFLMGFNRDVVRR

SEQ ID NO: 777702 - protein, 25 aa, Mycobacterium
SAELRWRWNAGFSLVFARHYATTAD

SEQ ID NO: 777703 - protein, 24 aa, Mycobacterium
SAEYLFRLALPMGIYGGTLDVFRN

SEQ ID NO: 777704 - protein, 18 aa, Mycobacterium
SAEYLRWLADNDYPLAAV

SEQ ID NO: 777705 - protein, 17 aa, Mycobacterium
SAFGEVWMQPSGTLGLV

SEQ ID NO: 777706 - protein, 18 aa, Mycobacterium
SAFGEVWMQPSGTVGLIG

SEQ ID NO: 777707 - protein, 25 aa, Mycobacterium
SAFLPRIVRGECFFAIGMSEPDSGS

SEQ ID NO: 777708 - protein, 17 aa, Mycobacterium
SAFLSWRVWVPRGPEHF

SEQ ID NO: 777709 - protein, 24 aa, Mycobacterium
SAFPRPENYPSLPTVSFVIPNADN

SEQ ID NO: 777710 - protein, 22 aa, Mycobacterium
SAFSGRCTLILIGDPKQAIYAF

SEQ ID NO: 777711 - protein, 17 aa, Mycobacterium
SAGDARFTWEYDEGRAR

SEQ ID NO: 777712 - protein, 17 aa, Mycobacterium
SAGHLGFDELIAPEETR

SEQ ID NO: 777713 - protein, 25 aa, Mycobacterium
SAGMGRAGLVGGLSVPQGWAMSAPA

SEQ ID NO: 777714 - protein, 18 aa, Mycobacterium
SAGNARFTWEYDEGRARL

SEQ ID NO: 777715 - protein, 24 aa, Mycobacterium
SAGRPPTWDRWWEWGPVFLCSNNN

SEQ ID NO: 777716 - protein, 18 aa, Mycobacterium
SAGSRLLVHDTIHDTLVE

SEQ ID NO: 777717 - protein, 24 aa, Mycobacterium
SAGVVRPDLVIGWWAVPTILEHGS

SEQ ID NO: 777718 - protein, 17 aa, Mycobacterium
SAHFVWPRETLRLGEKY

SEQ ID NO: 777719 - protein, 18 aa, Mycobacterium
SAHFVWVRETLRLGGKFP

SEQ ID NO: 777720 - protein, 26 aa, Mycobacterium
SAIALPDKEVVSILDLNADVDVAIDA

SEQ ID NO: 777721 - protein, 22 aa, Mycobacterium
SAIGKRGGWLAGLHPAELLGSI

SEQ ID NO: 777722 - protein, 18 aa, Mycobacterium
SAIPLGPDLIGKGGAGGA

SEQ ID NO: 777723 - protein, 23 aa, Mycobacterium
SAITFKGRNMWGLVNVKGRFTDF

SEQ ID NO: 777724 - protein, 18 aa, Mycobacterium
SAITWNVLDDLGIGGITD

SEQ ID NO: 777725 - protein, 23 aa, Mycobacterium
SAKDTLLNLGWRGLRGRPRDEPV

SEQ ID NO: 777726 - protein, 17 aa, Mycobacterium
SAKRITAILPFYPYARQ

SEQ ID NO: 777727 - protein, 22 aa, Mycobacterium
SAKRVAGIGGLYGDFFNFYACD

SEQ ID NO: 777728 - protein, 19 aa, Mycobacterium
SALAARLAPWQQALGAAPG

SEQ ID NO: 777729 - protein, 20 aa, Mycobacterium
SALDPELWIWIAASAINATM

SEQ ID NO: 777730 - protein, 17 aa, Mycobacterium
SALFLRRGAQPEGQVWS

SEQ ID NO: 777731 - protein, 18 aa, Mycobacterium
SALGPKLPELWGGSADLA

SEQ ID NO: 777732 - protein, 17 aa, Mycobacterium
SALKALEGDAKWVESVE

SEQ ID NO: 777733 - protein, 25 aa, Mycobacterium
SALLRASGGWPWLAPGNDPGELLTL

SEQ ID NO: 777734 - protein, 20 aa, Mycobacterium
SALLRLAGRYGIGEQQIDDL

SEQ ID NO: 777735 - protein, 18 aa, Mycobacterium
SALLRLAGRYGVGEHEVD

SEQ ID NO: 777736 - protein, 25 aa, Mycobacterium
SALMLASRLQPLWLVRGRISEGRSW

SEQ ID NO: 777737 - protein, 17 aa, Mycobacterium
SALPRTALFVLDPWLRP

SEQ ID NO: 777738 - protein, 17 aa, Mycobacterium
SALRPGSLQALLPPEQR

SEQ ID NO: 777739 - protein, 17 aa, Mycobacterium
SALRRLGLDDAHVRYPG

SEQ ID NO: 777740 - protein, 22 aa, Mycobacterium
SALVSFEVFVRAPLRAAMGHPE

SEQ ID NO: 777741 - protein, 18 aa, Mycobacterium
SAMARTYLGPSFDIHCGG

SEQ ID NO: 777742 - protein, 19 aa, Mycobacterium
SAMLPRFLYTKEIGKRLNN

SEQ ID NO: 777743 - protein, 19 aa, Mycobacterium
SAMRVCGGAAFSKHLPIER

SEQ ID NO: 777744 - protein, 20 aa, Mycobacterium
SANARWGNNIAILAGDYLFA

SEQ ID NO: 777745 - protein, 19 aa, Mycobacterium
SANARWGNNVAILAGDYLL

SEQ ID NO: 777746 - protein, 22 aa, Mycobacterium
SANLCWPDDHTWCLATEIDFDS

SEQ ID NO: 777747 - protein, 19 aa, Mycobacterium
SAPGCDVPGYRCEVHHVRE

SEQ ID NO: 777748 - protein, 18 aa, Mycobacterium
SAPHLEFLVAVARSCCGH

SEQ ID NO: 777749 - protein, 18 aa, Mycobacterium
SAPHLEFLVAVARSCVGH

SEQ ID NO: 777750 - protein, 18 aa, Mycobacterium
SAPLPEFWIKRARKKILH

SEQ ID NO: 777751 - protein, 19 aa, Mycobacterium
SAPMALRWLTDRFAARPLT

SEQ ID NO: 777752 - protein, 17 aa, Mycobacterium
SAPMLEAAVAWDSLAAE

SEQ ID NO: 777753 - protein, 17 aa, Mycobacterium
SAPMLGVVRAADGWVGI

SEQ ID NO: 777754 - protein, 23 aa, Mycobacterium
SAQAAAFHDQFLRALTGAGGAYA

SEQ ID NO: 777755 - protein, 19 aa, Mycobacterium
SARAEWAPEFAIHDLDSPD

SEQ ID NO: 777756 - protein, 18 aa, Mycobacterium
SARAEWAPELAIHHLDSL

SEQ ID NO: 777757 - protein, 22 aa, Mycobacterium
SARASGIGAGFGRAATTATIIV

SEQ ID NO: 777758 - protein, 18 aa, Mycobacterium
SARAWLFTVARNMIIDDR

SEQ ID NO: 777759 - protein, 19 aa, Mycobacterium
SARCVARWDGPKADKGLRR

SEQ ID NO: 777760 - protein, 17 aa, Mycobacterium
SAREVFSTIGFDRASLR

SEQ ID NO: 777761 - protein, 25 aa, Mycobacterium
SARFAESFLRLGLVSGIGGAWFLTR

SEQ ID NO: 777762 - protein, 18 aa, Mycobacterium
SARFPGTQILAAFGQTEM

SEQ ID NO: 777763 - protein, 22 aa, Mycobacterium
SARGIEIGHIFQLGRKYTDAFS

SEQ ID NO: 777764 - protein, 17 aa, Mycobacterium
SARLGSVALSWDGGALT

SEQ ID NO: 777765 - protein, 17 aa, Mycobacterium
SARMHLGAGPGPMLAAA

SEQ ID NO: 777766 - protein, 23 aa, Mycobacterium
SARQAAIALEWLRHNGYQDLLNR

SEQ ID NO: 777767 - protein, 24 aa, Mycobacterium
SARTARLQYWPALKDLSMYSLRIR

SEQ ID NO: 777768 - protein, 23 aa, Mycobacterium
SASMMAAAWAWNLLAAELDSAAN

SEQ ID NO: 777769 - protein, 25 aa, Mycobacterium
SASPGFRIDPVLARSWLLVNGAQYE

SEQ ID NO: 777770 - protein, 23 aa, Mycobacterium
SASVAKEPCRIAATAAGSAAVTA

SEQ ID NO: 777771 - protein, 17 aa, Mycobacterium
SATLDWLMQHGYSSLVR

SEQ ID NO: 777772 - protein, 24 aa, Mycobacterium
SATTPDWVEWIPGSGIWLPDDKLR

SEQ ID NO: 777773 - protein, 19 aa, Mycobacterium
SAVAKARFVRVSPRKARRV

SEQ ID NO: 777774 - protein, 23 aa, Mycobacterium
SAVGDWMLMAAIDALIDGHEYLA

SEQ ID NO: 777775 - protein, 18 aa, Mycobacterium
SAVGRLSVPQSWAATNPT

SEQ ID NO: 777776 - protein, 17 aa, Mycobacterium
SAVGWPFEPVEIGGRIV

SEQ ID NO: 777777 - protein, 18 aa, Mycobacterium
SAVLGFAVDGGWWVLGVH

SEQ ID NO: 777778 - protein, 17 aa, Mycobacterium
SAVLMEMMWSFRANGMW

SEQ ID NO: 777779 - protein, 25 aa, Mycobacterium
SAVRCVRAALPLLRAAEWARVVNVT

SEQ ID NO: 777780 - protein, 17 aa, Mycobacterium
SAVRLPRQIPYTVACDI

SEQ ID NO: 777781 - protein, 19 aa, Mycobacterium
SAWADFYLRAATEWKEAQR

SEQ ID NO: 777782 - protein, 21 aa, Mycobacterium
SAYEALLCRIASLGIAYLHVL

SEQ ID NO: 777783 - protein, 24 aa, Mycobacterium
SAYLGHVIVLWSWALKQPAVGNAE

SEQ ID NO: 777784 - protein, 20 aa, Mycobacterium
SAYPRILDFAAFASIADEVD

SEQ ID NO: 777785 - protein, 21 aa, Mycobacterium
SAYPRILDFAAFASIADEVDA

SEQ ID NO: 777786 - protein, 21 aa, Mycobacterium
SAYPRILDFAAFRAIADEVDA

SEQ ID NO: 777787 - protein, 19 aa, Mycobacterium
SAYPRVLDFAAFRSIADEV

SEQ ID NO: 777788 - protein, 18 aa, Mycobacterium
SAYVASWHAAPLLLAGDK

SEQ ID NO: 777789 - protein, 17 aa, Mycobacterium
SCFLVQHRSRLASEKNG

SEQ ID NO: 777790 - protein, 21 aa, Mycobacterium
SCGACPTCATGEPAYCHDFLA

SEQ ID NO: 777791 - protein, 18 aa, Mycobacterium
SCGKCTPCQTGLRNLCDL

SEQ ID NO: 777792 - protein, 18 aa, Mycobacterium
SCGKCTPCQVGLRNLCDL

SEQ ID NO: 777793 - protein, 20 aa, Mycobacterium
SCGPYRFVYRKRFHKKCETE

SEQ ID NO: 777794 - protein, 17 aa, Mycobacterium
SCIEQLRAADDVLLVAG

SEQ ID NO: 777795 - protein, 24 aa, Mycobacterium
SCLNEARFGIVFGALGAARDSLET

SEQ ID NO: 777796 - protein, 20 aa, Mycobacterium
SCNSIAWAVLDRASRGWRGL

SEQ ID NO: 777797 - protein, 18 aa, Mycobacterium
SCPACGTDGLTPCGPGSV

SEQ ID NO: 777798 - protein, 19 aa, Mycobacterium
SCPDHFLRTKVKPLVLDLP

SEQ ID NO: 777799 - protein, 21 aa, Mycobacterium
SCQAIWRLEHGYLAASDPRRD

SEQ ID NO: 777800 - protein, 22 aa, Mycobacterium
SCQSVIWGLAFGQWVGASASLM

SEQ ID NO: 777801 - protein, 17 aa, Mycobacterium
SCQWFKSQFDPLMGQIN

SEQ ID NO: 777802 - protein, 30 aa, Mycobacterium
SCSPRWLHADPWNFWVLRPWSFSVTHADHF

SEQ ID NO: 777803 - protein, 22 aa, Mycobacterium
SCSYPLTGLRCVNRVYTDYAVF

SEQ ID NO: 777804 - protein, 19 aa, Mycobacterium
SCVALLFSRCIPAIVAMTA

SEQ ID NO: 777805 - protein, 20 aa, Mycobacterium
SDAKAVAFVHDFVNSGRPVA

SEQ ID NO: 777806 - protein, 21 aa, Mycobacterium
SDAKEALAFAVLGFLTFHGLP

SEQ ID NO: 777807 - protein, 18 aa, Mycobacterium
SDALRWGLINEVVPDGTV

SEQ ID NO: 777808 - protein, 18 aa, Mycobacterium
SDCAPWLWEAHVRHGDAG

SEQ ID NO: 777809 - protein, 21 aa, Mycobacterium
SDDFPVLWPVGTRWADNDMFG

SEQ ID NO: 777810 - protein, 18 aa, Mycobacterium
SDDMPGFGLVMFGAIREA

SEQ ID NO: 777811 - protein, 23 aa, Mycobacterium
SDDRCVIEFGLLLTDAAKASGLG

SEQ ID NO: 777812 - protein, 21 aa, Mycobacterium
SDEFDFRYLVGVLSVLADKDA

SEQ ID NO: 777813 - protein, 17 aa, Mycobacterium
SDEFGIQVANTFHGKGV

SEQ ID NO: 777814 - protein, 20 aa, Mycobacterium
SDELKARWLPGIASGEVIMA

SEQ ID NO: 777815 - protein, 23 aa, Mycobacterium
SDEWKIAVLRAYWDLPAMMLQFL

SEQ ID NO: 777816 - protein, 19 aa, Mycobacterium
SDEWTDWRWNRILIEGSNC

SEQ ID NO: 777817 - protein, 22 aa, Mycobacterium
SDFAHPRFRAMRDATPELAWGL

SEQ ID NO: 777818 - protein, 22 aa, Mycobacterium
SDFRGVAGFSVLRTERPGSAIG

SEQ ID NO: 777819 - protein, 18 aa, Mycobacterium
SDFRIMWDNAYAVHTLTR

SEQ ID NO: 777820 - protein, 19 aa, Mycobacterium
SDFRMWVCLHEVTHRVQFS

SEQ ID NO: 777821 - protein, 24 aa, Mycobacterium
SDGFPADMPFLIWGYGATAAGSPG

SEQ ID NO: 777822 - protein, 19 aa, Mycobacterium
SDGGWVWKFDPAIYGGEYL

SEQ ID NO: 777823 - protein, 23 aa, Mycobacterium
SDGKWDPGKDFAMVSARETGPTQ

SEQ ID NO: 777824 - protein, 24 aa, Mycobacterium
SDGRRWRLDFAWPGLRVAAEYDGV

SEQ ID NO: 777825 - protein, 18 aa, Mycobacterium
SDHLPMWLELSIDDGQAY

SEQ ID NO: 777826 - protein, 24 aa, Mycobacterium
SDHPRPQGAFVRFLFQPYVWPEDS

SEQ ID NO: 777827 - protein, 23 aa, Mycobacterium
SDHRPEVLLSFGFVPKLESKIGL

SEQ ID NO: 777828 - protein, 21 aa, Mycobacterium
SDIAEAIAFLVSDRAAWITAT

SEQ ID NO: 777829 - protein, 19 aa, Mycobacterium
SDIGCSWLPLYHDMGLTFL

SEQ ID NO: 777830 - protein, 18 aa, Mycobacterium
SDIIRRAAGVAARSLGSA

SEQ ID NO: 777831 - protein, 17 aa, Mycobacterium
SDIKGARVLALLGDSVT

SEQ ID NO: 777832 - protein, 19 aa, Mycobacterium
SDIKNLVPMFAVFQPTLVV

SEQ ID NO: 777833 - protein, 20 aa, Mycobacterium
SDIKNLVPMFGVFKPTLVIS

SEQ ID NO: 777834 - protein, 23 aa, Mycobacterium
SDLAARLKAAWAPGGLIQRGQGR

SEQ ID NO: 777835 - protein, 26 aa, Mycobacterium
SDLIEEWRFFLGLTKRMGLELWFVNF

SEQ ID NO: 777836 - protein, 17 aa, Mycobacterium
SDLLVIFGITGDLARKM

SEQ ID NO: 777837 - protein, 26 aa, Mycobacterium
SDLRAIPWVLAWSQSRVMLPGWYGTG

SEQ ID NO: 777838 - protein, 18 aa, Mycobacterium
SDMKGLWGFVPACSTPDA

SEQ ID NO: 777839 - protein, 17 aa, Mycobacterium
SDNCKLISWPIATLSPN

SEQ ID NO: 777840 - protein, 19 aa, Mycobacterium
SDPCGYLAWLRELVGPSAW

SEQ ID NO: 777841 - protein, 20 aa, Mycobacterium
SDPIELWAWIGAYDHVVLCQ

SEQ ID NO: 777842 - protein, 21 aa, Mycobacterium
SDPLWKVYVDLGWTELNDPAS

SEQ ID NO: 777843 - protein, 17 aa, Mycobacterium
SDPRLQRVFTFQSLYAG

SEQ ID NO: 777844 - protein, 22 aa, Mycobacterium
SDPRYLPFQSLRGRDFTSMVSV

SEQ ID NO: 777845 - protein, 23 aa, Mycobacterium
SDPSARFGASGGKGGTGGNGGSY

SEQ ID NO: 777846 - protein, 23 aa, Mycobacterium
SDPSGPCLEGWTTLTALAQATRR

SEQ ID NO: 777847 - protein, 22 aa, Mycobacterium
SDQAPRAWRMRIFVQKTDGQVK

SEQ ID NO: 777848 - protein, 18 aa, Mycobacterium
SDQFGIPVANTFHGKGVM

SEQ ID NO: 777849 - protein, 17 aa, Mycobacterium
SDRARWTPFQKLVILDV

SEQ ID NO: 777850 - protein, 19 aa, Mycobacterium
SDRGFFCLPEVNVGLPFTP

SEQ ID NO: 777851 - protein, 20 aa, Mycobacterium
SDRHPHCAWTVIIDDANPAV

SEQ ID NO: 777852 - protein, 19 aa, Mycobacterium
SDRIPKWLVPVIRENLKTG

SEQ ID NO: 777853 - protein, 22 aa, Mycobacterium
SDRYPLVTGYVVDMGGRTVFIS

SEQ ID NO: 777854 - protein, 17 aa, Mycobacterium
SDSPGFRRAGLNGLSRQ

SEQ ID NO: 777855 - protein, 21 aa, Mycobacterium
SDSRPAAAFLAARLTASTLEK

SEQ ID NO: 777856 - protein, 17 aa, Mycobacterium
SDVADWCLLLARTDKDV

SEQ ID NO: 777857 - protein, 19 aa, Mycobacterium
SDVADWCLVLARTDKDVPK

SEQ ID NO: 777858 - protein, 17 aa, Mycobacterium
SDVLARYGPEDPVHRAV

SEQ ID NO: 777859 - protein, 17 aa, Mycobacterium
SDVLPEFIERDAKAVAE

SEQ ID NO: 777860 - protein, 23 aa, Mycobacterium
SDVPPELTALIGRDDDRGTETVA

SEQ ID NO: 777861 - protein, 22 aa, Mycobacterium
SDWTAGLANHFGIRGITINAVA

SEQ ID NO: 777862 - protein, 18 aa, Mycobacterium
SEADRLLAIVPMFHANAW

SEQ ID NO: 777863 - protein, 17 aa, Mycobacterium
SEADWRARIALRQQQIQ

SEQ ID NO: 777864 - protein, 21 aa, Mycobacterium
SEAFKRWGLYPRMGIAPEERD

SEQ ID NO: 777865 - protein, 20 aa, Mycobacterium
SEAIGPFALGQVSGFNSGFF

SEQ ID NO: 777866 - protein, 18 aa, Mycobacterium
SEALALLRLPLVLPSLQI

SEQ ID NO: 777867 - protein, 20 aa, Mycobacterium
SEALTPLLWVPGVAAELAEA

SEQ ID NO: 777868 - protein, 21 aa, Mycobacterium
SEARRALGWWLVGSARAMLAL

SEQ ID NO: 777869 - protein, 19 aa, Mycobacterium
SEASLRWAGSSMTTNGESV

SEQ ID NO: 777870 - protein, 18 aa, Mycobacterium
SEAWALLVSKLRAAHLRE

SEQ ID NO: 777871 - protein, 21 aa, Mycobacterium
SEAYKHLKPVAAYGSGLDLLR

SEQ ID NO: 777872 - protein, 19 aa, Mycobacterium
SECQHVTAKWVGRCLECGT

SEQ ID NO: 777873 - protein, 21 aa, Mycobacterium
SECVPAMVVVHAWQRPQPGPP

SEQ ID NO: 777874 - protein, 18 aa, Mycobacterium
SEDAAFELLRWLSQEANI

SEQ ID NO: 777875 - protein, 19 aa, Mycobacterium
SEDARSWWGNYLVQQANSR

SEQ ID NO: 777876 - protein, 19 aa, Mycobacterium
SEFDIRAGYRWPADVPERV

SEQ ID NO: 777877 - protein, 21 aa, Mycobacterium
SEFHARFTQMLSAGANEYSLA

SEQ ID NO: 777878 - protein, 17 aa, Mycobacterium
SEFVWACTAAGYTFVGP

SEQ ID NO: 777879 - protein, 18 aa, Mycobacterium
SEGRAGIVRSLRAREFDA

SEQ ID NO: 777880 - protein, 20 aa, Mycobacterium
SEGWRLYTRSRFAPYVEKLL

SEQ ID NO: 777881 - protein, 17 aa, Mycobacterium
SEIARWVDEEGLSLDVA

SEQ ID NO: 777882 - protein, 17 aa, Mycobacterium
SEIARWVNEEGLSIDVS

SEQ ID NO: 777883 - protein, 23 aa, Mycobacterium
SEIDYRSSVRWRDAVRVTAECGR

SEQ ID NO: 777884 - protein, 18 aa, Mycobacterium
SEIKGRFGIQLTKDDVFE

SEQ ID NO: 777885 - protein, 21 aa, Mycobacterium
SEKLLKLSFPFDVHADRSASE

SEQ ID NO: 777886 - protein, 17 aa, Mycobacterium
SEKPELAQFTWRTRHNW

SEQ ID NO: 777887 - protein, 24 aa, Mycobacterium
SEKYLNVAESYGWQRIQGQARFAG

SEQ ID NO: 777888 - protein, 17 aa, Mycobacterium
SELDQLIGFFINILVLR

SEQ ID NO: 777889 - protein, 18 aa, Mycobacterium
SELKGFTAIREWAKKFYP

SEQ ID NO: 777890 - protein, 19 aa, Mycobacterium
SELLLRPGQTLAYNGQTLT

SEQ ID NO: 777891 - protein, 21 aa, Mycobacterium
SELLSVPGLFVFGSNDYFGPR

SEQ ID NO: 777892 - protein, 23 aa, Mycobacterium
SELPDLLAVLSVRLGRIDRVLYH

SEQ ID NO: 777893 - protein, 21 aa, Mycobacterium
SELPLDRGWDLGRLYDPDPDR

SEQ ID NO: 777894 - protein, 22 aa, Mycobacterium
SELRAVWLGFMQKWIDQTAALI

SEQ ID NO: 777895 - protein, 17 aa, Mycobacterium
SELRDAGFLIEELREPR

SEQ ID NO: 777896 - protein, 19 aa, Mycobacterium
SELRWSAPVPTFVELSQEA

SEQ ID NO: 777897 - protein, 18 aa, Mycobacterium
SEMASYFPAVPMVVRAPG

SEQ ID NO: 777898 - protein, 17 aa, Mycobacterium
SEMPALWAYARDLFQTP

SEQ ID NO: 777899 - protein, 18 aa, Mycobacterium
SEMRRLISIDAQDRVRVQ

SEQ ID NO: 777900 - protein, 19 aa, Mycobacterium
SEPFSGPGTGFWAKLEAHN

SEQ ID NO: 777901 - protein, 19 aa, Mycobacterium
SEPKQAWFPIDRSMILYYC

SEQ ID NO: 777902 - protein, 20 aa, Mycobacterium
SEPMPVAASFTWEFEDGTSL

SEQ ID NO: 777903 - protein, 20 aa, Mycobacterium
SEPRVAFSILDPTNPYRYLE

SEQ ID NO: 777904 - protein, 21 aa, Mycobacterium
SEPWARLGVNVDADFEPLYII

SEQ ID NO: 777905 - protein, 21 aa, Mycobacterium
SEPWARLGVNVDADFEPLYIV

SEQ ID NO: 777906 - protein, 19 aa, Mycobacterium
SEPYCPVGISPLFETIEDL

SEQ ID NO: 777907 - protein, 20 aa, Mycobacterium
SEQARAWWGNFLMQKANEAN

SEQ ID NO: 777908 - protein, 23 aa, Mycobacterium
SEQERLRRIFAIVDVADRTRIGL

SEQ ID NO: 777909 - protein, 24 aa, Mycobacterium
SEQRLRIGEAWGKLPQEWIEQYEA

SEQ ID NO: 777910 - protein, 19 aa, Mycobacterium
SERARRCHEFLGRLQQTAA

SEQ ID NO: 777911 - protein, 19 aa, Mycobacterium
SESVWWRCHRRLIADVAEL

SEQ ID NO: 777912 - protein, 19 aa, Mycobacterium
SETVSCAAGAAAAPGASGG

SEQ ID NO: 777913 - protein, 31 aa, Mycobacterium
SEVAKLWPWADLEPFAAFGWEARGGYGDAYQ

SEQ ID NO: 777914 - protein, 17 aa, Mycobacterium
SEVARLGYLAGIVTTII

SEQ ID NO: 777915 - protein, 18 aa, Mycobacterium
SEVFPGTQILAAFGQTEM

SEQ ID NO: 777916 - protein, 22 aa, Mycobacterium
SEVPRLAAIGARAAELCGLGPH

SEQ ID NO: 777917 - protein, 18 aa, Mycobacterium
SEVPRLAAMTQKAIDLLK

SEQ ID NO: 777918 - protein, 17 aa, Mycobacterium
SEYDRFALLHGDYRLDN

SEQ ID NO: 777919 - protein, 21 aa, Mycobacterium
SFAASPFRWLAWLSESRAGLT

SEQ ID NO: 777920 - protein, 23 aa, Mycobacterium
SFADRACAAWRAAGRSGQPRLHA

SEQ ID NO: 777921 - protein, 21 aa, Mycobacterium
SFALEPGRIWTFVMHGPDGRD

SEQ ID NO: 777922 - protein, 24 aa, Mycobacterium
SFAMPDVHWGYGFPIGGVAATDID

SEQ ID NO: 777923 - protein, 20 aa, Mycobacterium
SFAQSRLWFIYKYEGPSATY

SEQ ID NO: 777924 - protein, 19 aa, Mycobacterium
SFASLVFYSSWFKLHHPAA

SEQ ID NO: 777925 - protein, 17 aa, Mycobacterium
SFCRRRHDLPGLEFVQG

SEQ ID NO: 777926 - protein, 19 aa, Mycobacterium
SFDDFSWIKTVVVRTAAEP

SEQ ID NO: 777927 - protein, 17 aa, Mycobacterium
SFDEQWRLTARLLASVP

SEQ ID NO: 777928 - protein, 22 aa, Mycobacterium
SFDPKAGWSHRFVPVEAQVVAD

SEQ ID NO: 777929 - protein, 18 aa, Mycobacterium
SFDRFVWDTPVLKINYAL

SEQ ID NO: 777930 - protein, 24 aa, Mycobacterium
SFEEVFIRAGIPYKVVGGVRFYER

SEQ ID NO: 777931 - protein, 18 aa, Mycobacterium
SFELRQGRTLGIVGESGS

SEQ ID NO: 777932 - protein, 24 aa, Mycobacterium
SFFGVSGWGRILVPINFRLAPAEI

SEQ ID NO: 777933 - protein, 19 aa, Mycobacterium
SFGGGTFVHYMLKPNSYHR

SEQ ID NO: 777934 - protein, 18 aa, Mycobacterium
SFGIPWLVIRALSDLAGS

SEQ ID NO: 777935 - protein, 17 aa, Mycobacterium
SFIAVCGQCRWCATGME

SEQ ID NO: 777936 - protein, 19 aa, Mycobacterium
SFLRPLPVQALWGVGSVTA

SEQ ID NO: 777937 - protein, 18 aa, Mycobacterium
SFPAIALCQRFADAGDDP

SEQ ID NO: 777938 - protein, 17 aa, Mycobacterium
SFPAIALCQRFQASGDR

SEQ ID NO: 777939 - protein, 24 aa, Mycobacterium
SFPRRCPSRRPNLMGCNDLGDLLG

SEQ ID NO: 777940 - protein, 18 aa, Mycobacterium
SFQLFPNFVILFWGQGWY

SEQ ID NO: 777941 - protein, 24 aa, Mycobacterium
SFSNIVNSFGRFGSDIVNSVINFA

SEQ ID NO: 777942 - protein, 25 aa, Mycobacterium
SFSRYELLRLLAFSRSGALPITKAS

SEQ ID NO: 777943 - protein, 24 aa, Mycobacterium
SFSRYELLRLLAFSRTGALPITKA

SEQ ID NO: 777944 - protein, 28 aa, Mycobacterium
SFVAVCGQCRWCATGMEYICDVGAFTLT

SEQ ID NO: 777945 - protein, 24 aa, Mycobacterium
SFVKRRMGVALAFDDDVQTARRNA

SEQ ID NO: 777946 - protein, 17 aa, Mycobacterium
SGAAARRLGGCRLAAID

SEQ ID NO: 777947 - protein, 18 aa, Mycobacterium
SGAACPREGGLLISFERM

SEQ ID NO: 777948 - protein, 24 aa, Mycobacterium
SGAAGTAGGWVFGDGGAGGSGAMS

SEQ ID NO: 777949 - protein, 17 aa, Mycobacterium
SGADFPAGWQKLNGTQA

SEQ ID NO: 777950 - protein, 18 aa, Mycobacterium
SGAFLAKLGCTFAVVGHS

SEQ ID NO: 777951 - protein, 24 aa, Mycobacterium
SGAFLAKLGCTFVIVGHSERRTYH

SEQ ID NO: 777952 - protein, 18 aa, Mycobacterium
SGAFLAKLGCTFVVVGHS

SEQ ID NO: 777953 - protein, 18 aa, Mycobacterium
SGAIARGGLRFSDRPEDY

SEQ ID NO: 777954 - protein, 21 aa, Mycobacterium
SGAKELVCFDLGSGDRHTIAS

SEQ ID NO: 777955 - protein, 23 aa, Mycobacterium
SGAKLDVIVPMSFLCDGYGLNVT

SEQ ID NO: 777956 - protein, 24 aa, Mycobacterium
SGAMANCLVAIGMHLDIPAVRARL

SEQ ID NO: 777957 - protein, 22 aa, Mycobacterium
SGAPAGWGWVAPYIGMIWPNGD

SEQ ID NO: 777958 - protein, 24 aa, Mycobacterium
SGARLDPSLARRFMDTFGDILYNA

SEQ ID NO: 777959 - protein, 24 aa, Mycobacterium
SGARLDWPAVFLGWGGRRVSLPTY

SEQ ID NO: 777960 - protein, 21 aa, Mycobacterium
SGAVPDGWRVIGRVLDGPARV

SEQ ID NO: 777961 - protein, 17 aa, Mycobacterium
SGAWQWSSGCDHATWAF

SEQ ID NO: 777962 - protein, 21 aa, Mycobacterium
SGCRMGICFSCTRRKTSGVVR

SEQ ID NO: 777963 - protein, 17 aa, Mycobacterium
SGDLGYGWAKQGLGAAA

SEQ ID NO: 777964 - protein, 17 aa, Mycobacterium
SGDPSWRSGGDGGNGGN

SEQ ID NO: 777965 - protein, 18 aa, Mycobacterium
SGEAIAMRVCIVIVVGDD

SEQ ID NO: 777966 - protein, 23 aa, Mycobacterium
SGEKPWDVWEFRPPNPTGKTVIA

SEQ ID NO: 777967 - protein, 17 aa, Mycobacterium
SGEPVVFIAGHGGAGRT

SEQ ID NO: 777968 - protein, 17 aa, Mycobacterium
SGEWKDGEALFLRCNIW

SEQ ID NO: 777969 - protein, 18 aa, Mycobacterium
SGFEPRLLINPVQGTPPH

SEQ ID NO: 777970 - protein, 28 aa, Mycobacterium
SGFERFPAWMWRNVVVRDFVDWLRARNQ

SEQ ID NO: 777971 - protein, 18 aa, Mycobacterium
SGFPAVVRPVAAAYGQGQ

SEQ ID NO: 777972 - protein, 17 aa, Mycobacterium
SGFRPGSRLGLLSRNCW

SEQ ID NO: 777973 - protein, 24 aa, Mycobacterium
SGGAARLFGIGGAGGAGGHGVAGT

SEQ ID NO: 777974 - protein, 22 aa, Mycobacterium
SGGAGGDAWLFGSGGSGGGGGA

SEQ ID NO: 777975 - protein, 18 aa, Mycobacterium
SGGCHWPDCDSSNTPQIQ

SEQ ID NO: 777976 - protein, 24 aa, Mycobacterium
SGGDAGGMFGVRGLFGTGGAGGTG

SEQ ID NO: 777977 - protein, 17 aa, Mycobacterium
SGGHLFSIYDGCRDEGI

SEQ ID NO: 777978 - protein, 17 aa, Mycobacterium
SGGIPGFHTLMIAPQGG

SEQ ID NO: 777979 - protein, 24 aa, Mycobacterium
SGGIRGPIGLGFRTPCIVISPYSR

SEQ ID NO: 777980 - protein, 25 aa, Mycobacterium
SGGKRLRPIFAYRGWQAVTTEDPDP

SEQ ID NO: 777981 - protein, 21 aa, Mycobacterium
SGGLGGNAWLLGSGGTGGTGG

SEQ ID NO: 777982 - protein, 19 aa, Mycobacterium
SGGMCQRALIAIGLAGRPR

SEQ ID NO: 777983 - protein, 17 aa, Mycobacterium
SGGMLFGNGGAGGNGGT

SEQ ID NO: 777984 - protein, 17 aa, Mycobacterium
SGGRGVHVFLRIKPQWD

SEQ ID NO: 777985 - protein, 17 aa, Mycobacterium
SGGRGVHVFLRIKTDWD

SEQ ID NO: 777986 - protein, 17 aa, Mycobacterium
SGGRLIPGFGIGWSPEE

SEQ ID NO: 777987 - protein, 23 aa, Mycobacterium
SGGRLLLGVGIGWSREEFEALGV

SEQ ID NO: 777988 - protein, 25 aa, Mycobacterium
SGGRLRLCVGVGWLREELEACGADF

SEQ ID NO: 777989 - protein, 24 aa, Mycobacterium
SGGRLTLGVGVGWSREEFAALGVP

SEQ ID NO: 777990 - protein, 23 aa, Mycobacterium
SGGRVSLGVGFGWNTDELADHKV

SEQ ID NO: 777991 - protein, 24 aa, Mycobacterium
SGGRVSVGVGFGWNTDELADHGVP

SEQ ID NO: 777992 - protein, 19 aa, Mycobacterium
SGGRYRLGLDGTELDSDAW

SEQ ID NO: 777993 - protein, 20 aa, Mycobacterium
SGGSAGLWGRGGNGGLGGTG

SEQ ID NO: 777994 - protein, 18 aa, Mycobacterium
SGGSFVRRPAGPPVEKLT

SEQ ID NO: 777995 - protein, 22 aa, Mycobacterium
SGGTVDLAFPGTAGHGGDGGAG

SEQ ID NO: 777996 - protein, 24 aa, Mycobacterium
SGGYGPLVGGWGGDGGAGGDGGGA

SEQ ID NO: 777997 - protein, 17 aa, Mycobacterium
SGHFVWVREPLDLRGKF

SEQ ID NO: 777998 - protein, 18 aa, Mycobacterium
SGHSCWLPTVLCVVDGDH

SEQ ID NO: 777999 - protein, 19 aa, Mycobacterium
SGIGARFGGPEGLRKYCRI

SEQ ID NO: 778000 - protein, 24 aa, Mycobacterium
SGIGFSCLWPETYIATAAVANGAG

SEQ ID NO: 778001 - protein, 18 aa, Mycobacterium
SGILRFVVLDGLAKPGRL

SEQ ID NO: 778002 - protein, 17 aa, Mycobacterium
SGIPYLRFLASNVGRGQ

SEQ ID NO: 778003 - protein, 17 aa, Mycobacterium
SGKRIVAICPFVAAYVD

SEQ ID NO: 778004 - protein, 22 aa, Mycobacterium
SGKYRRVLALAWEKQSESNAMW

SEQ ID NO: 778005 - protein, 21 aa, Mycobacterium
SGLAEMPWRLSIFGDGPDRER

SEQ ID NO: 778006 - protein, 20 aa, Mycobacterium
SGLDKRAAWEDTWALQRRED

SEQ ID NO: 778007 - protein, 18 aa, Mycobacterium
SGLGMALLPIIGWLPDGI

SEQ ID NO: 778008 - protein, 19 aa, Mycobacterium
SGLGRRVAGVLGYDHTRIQ

SEQ ID NO: 778009 - protein, 19 aa, Mycobacterium
SGLKCYRIASKIIKGQGLG

SEQ ID NO: 778010 - protein, 17 aa, Mycobacterium
SGLKFKIRFLRVNRRHH

SEQ ID NO: 778011 - protein, 18 aa, Mycobacterium
SGLMNTGFLPFWNQPVYI

SEQ ID NO: 778012 - protein, 23 aa, Mycobacterium
SGLRSLPWEGLKLAPGEPAIPTQ

SEQ ID NO: 778013 - protein, 18 aa, Mycobacterium
SGLTASRFLACPFGGPGS

SEQ ID NO: 778014 - protein, 18 aa, Mycobacterium
SGLTASRFVACPFGAPGS

SEQ ID NO: 778015 - protein, 18 aa, Mycobacterium
SGLTAWFALVERGRVRAG

SEQ ID NO: 778016 - protein, 25 aa, Mycobacterium
SGLVPRIAVVRGRCFAGNAVIAGAA

SEQ ID NO: 778017 - protein, 23 aa, Mycobacterium
SGMLQRWSQGWVEPVTPPPHPRH

SEQ ID NO: 778018 - protein, 17 aa, Mycobacterium
SGMMPMGMMPHNRGGEG

SEQ ID NO: 778019 - protein, 17 aa, Mycobacterium
SGMSFVIAVPEVVGSAA

SEQ ID NO: 778020 - protein, 20 aa, Mycobacterium
SGMWLYRLSFAKVKWHSLTG

SEQ ID NO: 778021 - protein, 22 aa, Mycobacterium
SGPMLAAAMAWDELAAALQSTA

SEQ ID NO: 778022 - protein, 22 aa, Mycobacterium
SGPMLSAAMAWDGLAVELGSAA

SEQ ID NO: 778023 - protein, 19 aa, Mycobacterium
SGPRIRLAYQLTPRSVRGE

SEQ ID NO: 778024 - protein, 19 aa, Mycobacterium
SGPRLVAYVVTDASLADAA

SEQ ID NO: 778025 - protein, 23 aa, Mycobacterium
SGPRPGRLLPAFVELLIATGCRP

SEQ ID NO: 778026 - protein, 18 aa, Mycobacterium
SGQMLLRRNGFRAAHPVV

SEQ ID NO: 778027 - protein, 24 aa, Mycobacterium
SGQPIVFSHGWPLSADDWDAQLMF

SEQ ID NO: 778028 - protein, 19 aa, Mycobacterium
SGQVGWLARDRWAVPLVHT

SEQ ID NO: 778029 - protein, 21 aa, Mycobacterium
SGRARIAGALAHIDKAAFTRA

SEQ ID NO: 778030 - protein, 19 aa, Mycobacterium
SGRFDAGVFKEDWRFSTKV

SEQ ID NO: 778031 - protein, 17 aa, Mycobacterium
SGRGAEIRPCIACLQSC

SEQ ID NO: 778032 - protein, 20 aa, Mycobacterium
SGRIKLAWFLLNAARYMPAQ

SEQ ID NO: 778033 - protein, 20 aa, Mycobacterium
SGRIKLAWFLLNAARYMPVL

SEQ ID NO: 778034 - protein, 21 aa, Mycobacterium
SGRMYCGLGAGPMLAAATAWD

SEQ ID NO: 778035 - protein, 19 aa, Mycobacterium
SGRTELLAAIFGASTITGG

SEQ ID NO: 778036 - protein, 17 aa, Mycobacterium
SGSAWAMRELVILHELA

SEQ ID NO: 778037 - protein, 24 aa, Mycobacterium
SGSGWLKRFWNNWGPDANIWNTIF

SEQ ID NO: 778038 - protein, 19 aa, Mycobacterium
SGSGWRWLASALWGEILLS

SEQ ID NO: 778039 - protein, 20 aa, Mycobacterium
SGSIGLGFAIPVDQAKRIAD

SEQ ID NO: 778040 - protein, 20 aa, Mycobacterium
SGSMSLSFSDPRFDEVKASV

SEQ ID NO: 778041 - protein, 20 aa, Mycobacterium
SGSPGGWLLGDGGAGGSGAA

SEQ ID NO: 778042 - protein, 18 aa, Mycobacterium
SGSPLLDIGIDWKTYRDA

SEQ ID NO: 778043 - protein, 21 aa, Mycobacterium
SGSSAGFGFGGGGGGGGAGGH

SEQ ID NO: 778044 - protein, 17 aa, Mycobacterium
SGTAVCWDDPGVRACFR

SEQ ID NO: 778045 - protein, 22 aa, Mycobacterium
SGTCPAWVYFWLGAARIGAVSA

SEQ ID NO: 778046 - protein, 22 aa, Mycobacterium
SGTCRLPVTLPQIFGLMQAAQQ

SEQ ID NO: 778047 - protein, 25 aa, Mycobacterium
SGTQWDALCHFFWRGKMYNGHRVAD

SEQ ID NO: 778048 - protein, 18 aa, Mycobacterium
SGVDGAAGIGGRAGAGGA

SEQ ID NO: 778049 - protein, 18 aa, Mycobacterium
SGVLGIRARPTWSGPPEF

SEQ ID NO: 778050 - protein, 24 aa, Mycobacterium
SGVLGRLWLARGGTYVLANIRGGG

SEQ ID NO: 778051 - protein, 18 aa, Mycobacterium
SGVLRFVVLDGLAKPGRL

SEQ ID NO: 778052 - protein, 21 aa, Mycobacterium
SGVMWACVFLRTGARRIHFGE

SEQ ID NO: 778053 - protein, 23 aa, Mycobacterium
SGVMWACVFMRTGARRVHFGETE

SEQ ID NO: 778054 - protein, 22 aa, Mycobacterium
SGVMWACVFMRTGARRVHFGEV

SEQ ID NO: 778055 - protein, 17 aa, Mycobacterium
SGVRRIATEAGITVVAG

SEQ ID NO: 778056 - protein, 17 aa, Mycobacterium
SGWGRSGPWALQDFTDL

SEQ ID NO: 778057 - protein, 22 aa, Mycobacterium
SGWIRTWLDTVLELPWNITTED

SEQ ID NO: 778058 - protein, 17 aa, Mycobacterium
SGWSLTAQDVFNNVART

SEQ ID NO: 778059 - protein, 27 aa, Mycobacterium
SGWWRAPLRWMLRASLALRSRLMVRGA

SEQ ID NO: 778060 - protein, 18 aa, Mycobacterium
SGYLGWLASTGVQAGQAA

SEQ ID NO: 778061 - protein, 17 aa, Mycobacterium
SGYRFAQLVSDIEAVID

SEQ ID NO: 778062 - protein, 17 aa, Mycobacterium
SHALSFASLVFYSAWFK

SEQ ID NO: 778063 - protein, 19 aa, Mycobacterium
SHAWIQAWTGAWWNYDPTH

SEQ ID NO: 778064 - protein, 19 aa, Mycobacterium
SHAWIQAWTGGWWSYDPTL

SEQ ID NO: 778065 - protein, 19 aa, Mycobacterium
SHCYPRFPVFLEEVKRVLR

SEQ ID NO: 778066 - protein, 17 aa, Mycobacterium
SHEGRIGNIGTRSGGAM

SEQ ID NO: 778067 - protein, 18 aa, Mycobacterium
SHEWSVGDTVIWDNRGVL

SEQ ID NO: 778068 - protein, 24 aa, Mycobacterium
SHHLGHNCVLAFLDVDGLKKVNDE

SEQ ID NO: 778069 - protein, 18 aa, Mycobacterium
SHHWPTWGHDNIVEYLSQ

SEQ ID NO: 778070 - protein, 18 aa, Mycobacterium
SHHWPTWGRDNIVEYLSL

SEQ ID NO: 778071 - protein, 18 aa, Mycobacterium
SHHWPTWGREGIVEFLSL

SEQ ID NO: 778072 - protein, 18 aa, Mycobacterium
SHHWPTWGRERIVEFLAL

SEQ ID NO: 778073 - protein, 18 aa, Mycobacterium
SHHWPTWGSERIVEFLSL

SEQ ID NO: 778074 - protein, 18 aa, Mycobacterium
SHIAWTIVRPPKLTNKPL

SEQ ID NO: 778075 - protein, 18 aa, Mycobacterium
SHLCTRPSVVFATEPMDE

SEQ ID NO: 778076 - protein, 20 aa, Mycobacterium
SHLFPAEFAKRAKALATAEG

SEQ ID NO: 778077 - protein, 22 aa, Mycobacterium
SHLPRAVGVAFAIARARKLGVP

SEQ ID NO: 778078 - protein, 19 aa, Mycobacterium
SHLTEQRFAELVPECRGLT

SEQ ID NO: 778079 - protein, 22 aa, Mycobacterium
SHLTVGGLRDWLLDTAARDDSA

SEQ ID NO: 778080 - protein, 20 aa, Mycobacterium
SHMLFPEFSDFFSGFPSFAG

SEQ ID NO: 778081 - protein, 21 aa, Mycobacterium
SHPAGSVLIEFGQTRVMCTAS

SEQ ID NO: 778082 - protein, 17 aa, Mycobacterium
SHPAGSVLVEFGQTRVM

SEQ ID NO: 778083 - protein, 18 aa, Mycobacterium
SHSKRVFCEAVDIVSGIG

SEQ ID NO: 778084 - protein, 18 aa, Mycobacterium
SHSWSVGDTVIWDNNGVL

SEQ ID NO: 778085 - protein, 23 aa, Mycobacterium
SHSWSVGDTVIWDNRGVLHRAAP

SEQ ID NO: 778086 - protein, 18 aa, Mycobacterium
SHVLAVTVSDGWSGEFPD

SEQ ID NO: 778087 - protein, 18 aa, Mycobacterium
SHVYACGASLYFTVVAGQ

SEQ ID NO: 778088 - protein, 17 aa, Mycobacterium
SIACPYHGWQFDGQTGQ

SEQ ID NO: 778089 - protein, 18 aa, Mycobacterium
SIALRRCDGRDAMSYGEL

SEQ ID NO: 778090 - protein, 24 aa, Mycobacterium
SIALSWRLPVVFVVENIRDGSGVR

SEQ ID NO: 778091 - protein, 22 aa, Mycobacterium
SIAVEAYGLFIFRDALAAMGIA

SEQ ID NO: 778092 - protein, 22 aa, Mycobacterium
SIDGEVLLNCMLLAATASSVSG

SEQ ID NO: 778093 - protein, 18 aa, Mycobacterium
SIEPDWLLGYWSDRVHRL

SEQ ID NO: 778094 - protein, 24 aa, Mycobacterium
SIEPSARLNVSWNRDFNALVYVLS

SEQ ID NO: 778095 - protein, 18 aa, Mycobacterium
SIEYRGLLRLQYAVRIGR

SEQ ID NO: 778096 - protein, 19 aa, Mycobacterium
SIFLMCLEDRVLAYGDCAI

SEQ ID NO: 778097 - protein, 20 aa, Mycobacterium
SIFLMCLPDRVLAYGDCAIV

SEQ ID NO: 778098 - protein, 23 aa, Mycobacterium
SIFPVAALAPVFGPIGAHYLGAF

SEQ ID NO: 778099 - protein, 18 aa, Mycobacterium
SIFRRLDVDWALHGFDDT

SEQ ID NO: 778100 - protein, 25 aa, Mycobacterium
SIGCPGCSASICRRCLSEDHVASTA

SEQ ID NO: 778101 - protein, 19 aa, Mycobacterium
SIGELWLGVLVCQAVGAAA

SEQ ID NO: 778102 - protein, 17 aa, Mycobacterium
SIGNRGLLNLGLGNTGN

SEQ ID NO: 778103 - protein, 18 aa, Mycobacterium
SIGPWKGAVAWDVSTGDP

SEQ ID NO: 778104 - protein, 23 aa, Mycobacterium
SIGWLRDFLRAHTGGLVIISHNV

SEQ ID NO: 778105 - protein, 23 aa, Mycobacterium
SIGWLRDFLRAHTGGLVMISHNV

SEQ ID NO: 778106 - protein, 23 aa, Mycobacterium
SIGWLRDFLRSHTGGLVIISHNV

SEQ ID NO: 778107 - protein, 19 aa, Mycobacterium
SIHPPRFLVGLSQRNHTFR

SEQ ID NO: 778108 - protein, 21 aa, Mycobacterium
SIHPPRFLVGLSRKNHTFRVA

SEQ ID NO: 778109 - protein, 18 aa, Mycobacterium
SIISINWAQLDTVFGHFR

SEQ ID NO: 778110 - protein, 18 aa, Mycobacterium
SIITRVAARYGLASTNVP

SEQ ID NO: 778111 - protein, 22 aa, Mycobacterium
SIKEAICKGTLWAIRREAAKPG

SEQ ID NO: 778112 - protein, 17 aa, Mycobacterium
SIKHGHASVIFSLEMSK

SEQ ID NO: 778113 - protein, 20 aa, Mycobacterium
SILARLHFWGVVSDMDVPGG

SEQ ID NO: 778114 - protein, 17 aa, Mycobacterium
SILGLTAMPGWGLYCAG

SEQ ID NO: 778115 - protein, 26 aa, Mycobacterium
SILLSSRFSMWMAWGPELTFFCNSAY

SEQ ID NO: 778116 - protein, 23 aa, Mycobacterium
SIPAARYGQGWGFVEYAHQHGDY

SEQ ID NO: 778117 - protein, 24 aa, Mycobacterium
SIPAWSARIGFQMLDPVKTIKGRL

SEQ ID NO: 778118 - protein, 25 aa, Mycobacterium
SIPLLVWQFREPRLCISSGPLGGGV

SEQ ID NO: 778119 - protein, 18 aa, Mycobacterium
SIPPRLPVPDDFALVRYF

SEQ ID NO: 778120 - protein, 22 aa, Mycobacterium
SIPVKRLRQAGVLELLLALADE

SEQ ID NO: 778121 - protein, 19 aa, Mycobacterium
SIQKEWEWRISRGESLKNL

SEQ ID NO: 778122 - protein, 18 aa, Mycobacterium
SIQKEWEWRVSRGESLKN

SEQ ID NO: 778123 - protein, 23 aa, Mycobacterium
SIRKGEGFEGLWEDVPRLTTPTT

SEQ ID NO: 778124 - protein, 21 aa, Mycobacterium
SISAPGWFLPTIITPTVSPIP

SEQ ID NO: 778125 - protein, 18 aa, Mycobacterium
SISLPMLYALSALGSLKA

SEQ ID NO: 778126 - protein, 18 aa, Mycobacterium
SITWCRRRTVQVGRIAAR

SEQ ID NO: 778127 - protein, 22 aa, Mycobacterium
SIWKGSIAFGLVNVPVKVYSAT

SEQ ID NO: 778128 - protein, 26 aa, Mycobacterium
SIYHDGWRAVCPWPGTSFAESTHKFG

SEQ ID NO: 778129 - protein, 22 aa, Mycobacterium
SKARFTGTISLRYVRGTPLGPL

SEQ ID NO: 778130 - protein, 19 aa, Mycobacterium
SKAVIGLNMLRLWDDRGTL

SEQ ID NO: 778131 - protein, 18 aa, Mycobacterium
SKAWPQREEFLAALRKAV

SEQ ID NO: 778132 - protein, 22 aa, Mycobacterium
SKCPECGTYVFPPRANNCPNPG

SEQ ID NO: 778133 - protein, 18 aa, Mycobacterium
SKEARSWWGNFLVQKANE

SEQ ID NO: 778134 - protein, 21 aa, Mycobacterium
SKGKWDILRAMGFDEDHISDS

SEQ ID NO: 778135 - protein, 18 aa, Mycobacterium
SKHGFTINGTKTFRLGAG

SEQ ID NO: 778136 - protein, 17 aa, Mycobacterium
SKHSFSFGSHYDPDNTH

SEQ ID NO: 778137 - protein, 21 aa, Mycobacterium
SKIELFTGIALLIQRDPITTA

SEQ ID NO: 778138 - protein, 21 aa, Mycobacterium
SKIIKFSGCYHGHVDALLADA

SEQ ID NO: 778139 - protein, 19 aa, Mycobacterium
SKKVAALPWFWSDQYDVKL

SEQ ID NO: 778140 - protein, 22 aa, Mycobacterium
SKLARPTSTWTYMIHDDPRKND

SEQ ID NO: 778141 - protein, 22 aa, Mycobacterium
SKLARPTSTWTYMVHDNPLDDT

SEQ ID NO: 778142 - protein, 22 aa, Mycobacterium
SKLARPTSTWTYMVNDNPLSDD

SEQ ID NO: 778143 - protein, 22 aa, Mycobacterium
SKLELYLAVLKRHVDNLVCGVQ

SEQ ID NO: 778144 - protein, 18 aa, Mycobacterium
SKLLYDYFVELFAQVTNP

SEQ ID NO: 778145 - protein, 19 aa, Mycobacterium
SKLRTGGLLLNHCITRHDN

SEQ ID NO: 778146 - protein, 22 aa, Mycobacterium
SKMNRFFLRGALVARLLSEASW

SEQ ID NO: 778147 - protein, 20 aa, Mycobacterium
SKMPKVFFVNWFRRGDDGGF

SEQ ID NO: 778148 - protein, 18 aa, Mycobacterium
SKMSRVFLRGALGARLLS

SEQ ID NO: 778149 - protein, 17 aa, Mycobacterium
SKPCAWSAEGLLRYLPA

SEQ ID NO: 778150 - protein, 26 aa, Mycobacterium
SKPLVRLRVPFTLSRYEIDNVERGAQ

SEQ ID NO: 778151 - protein, 23 aa, Mycobacterium
SKQPKEHFDFFPLTIDVEERMYA

SEQ ID NO: 778152 - protein, 18 aa, Mycobacterium
SKRFCWNCGKPVGRSTTD

SEQ ID NO: 778153 - protein, 17 aa, Mycobacterium
SKTRRPSVCNAAETLLV

SEQ ID NO: 778154 - protein, 19 aa, Mycobacterium
SKTVIGLNMLRLWDDRGTL

SEQ ID NO: 778155 - protein, 20 aa, Mycobacterium
SKVGLPLVRRALELLPDVGF

SEQ ID NO: 778156 - protein, 27 aa, Mycobacterium
SKVGLPLVRRALELLPHVGFVNAYGLT

SEQ ID NO: 778157 - protein, 20 aa, Mycobacterium
SKVHPCVDWVIVGGCIAGAT

SEQ ID NO: 778158 - protein, 18 aa, Mycobacterium
SKVKAVLVQKGFLDQDYT

SEQ ID NO: 778159 - protein, 20 aa, Mycobacterium
SKVPLPLVRKALSLLPDVGF

SEQ ID NO: 778160 - protein, 27 aa, Mycobacterium
SKVPRPARVACRWLRAVALERLGDIEA

SEQ ID NO: 778161 - protein, 20 aa, Mycobacterium
SKWTASRVDLVFGANSELRA

SEQ ID NO: 778162 - protein, 17 aa, Mycobacterium
SLAAELQAAAGYYQSVV

SEQ ID NO: 778163 - protein, 23 aa, Mycobacterium
SLADPPAVCDFVRRLAADLHDAA

SEQ ID NO: 778164 - protein, 18 aa, Mycobacterium
SLAELFAQIGMRPATAHD

SEQ ID NO: 778165 - protein, 17 aa, Mycobacterium
SLAEVGIGFCFAPLFHP

SEQ ID NO: 778166 - protein, 19 aa, Mycobacterium
SLAHMCQWGLATVRTDPDA

SEQ ID NO: 778167 - protein, 19 aa, Mycobacterium
SLAPRLRVPDTFSLAHHLA

SEQ ID NO: 778168 - protein, 20 aa, Mycobacterium
SLASGRIAYALGVHGPAITV

SEQ ID NO: 778169 - protein, 20 aa, Mycobacterium
SLASLPGRHLLVSPDAMRRD

SEQ ID NO: 778170 - protein, 18 aa, Mycobacterium
SLAYQFGLEWGAQRSRDF

SEQ ID NO: 778171 - protein, 18 aa, Mycobacterium
SLCAIALARAHAQSGVPG

SEQ ID NO: 778172 - protein, 18 aa, Mycobacterium
SLCAWTPEMLDEFGKTKR

SEQ ID NO: 778173 - protein, 18 aa, Mycobacterium
SLCFAVGVYVDFMEATGR

SEQ ID NO: 778174 - protein, 18 aa, Mycobacterium
SLCYRILAEPGLRDRLLA

SEQ ID NO: 778175 - protein, 19 aa, Mycobacterium
SLDAGEWFRSFPAAQASSL

SEQ ID NO: 778176 - protein, 20 aa, Mycobacterium
SLDDVVKFLLPRGAAKKAAK

SEQ ID NO: 778177 - protein, 19 aa, Mycobacterium
SLDGSAAWAECGQVSSTDR

SEQ ID NO: 778178 - protein, 18 aa, Mycobacterium
SLDLPGGIGQHFFFDAGN

SEQ ID NO: 778179 - protein, 18 aa, Mycobacterium
SLDLPGGMGQHFFFDAGN

SEQ ID NO: 778180 - protein, 24 aa, Mycobacterium
SLEDWKCWARWRLIRARAPWLTSD

SEQ ID NO: 778181 - protein, 18 aa, Mycobacterium
SLEDWKDWLRWRVIHGRA

SEQ ID NO: 778182 - protein, 21 aa, Mycobacterium
SLEEARPLFPHHLDTIVNVPA

SEQ ID NO: 778183 - protein, 25 aa, Mycobacterium
SLEEVFIRAGIPYKVVGGVRFYERK

SEQ ID NO: 778184 - protein, 19 aa, Mycobacterium
SLEGELRWCQLFSEPGAGS

SEQ ID NO: 778185 - protein, 18 aa, Mycobacterium
SLFPELRFDEHLIMGEDL

SEQ ID NO: 778186 - protein, 19 aa, Mycobacterium
SLFPGGEGRLVLTDPNDML

SEQ ID NO: 778187 - protein, 24 aa, Mycobacterium
SLFTIPGVPYLLGIQSYLTPQAGA

SEQ ID NO: 778188 - protein, 18 aa, Mycobacterium
SLGIAEWIFPTILDRGSD

SEQ ID NO: 778189 - protein, 17 aa, Mycobacterium
SLGLGEWVVPTLLQHGS

SEQ ID NO: 778190 - protein, 20 aa, Mycobacterium
SLGTRGRMLSLFRDHLGRID

SEQ ID NO: 778191 - protein, 19 aa, Mycobacterium
SLGVTLWAQRLMPLGLAEA

SEQ ID NO: 778192 - protein, 18 aa, Mycobacterium
SLHFAMGLARGYSLAVVE

SEQ ID NO: 778193 - protein, 19 aa, Mycobacterium
SLHIRGVVVLEHMDTVMPA

SEQ ID NO: 778194 - protein, 22 aa, Mycobacterium
SLHKWAELCWLQGGENYLRNGC

SEQ ID NO: 778195 - protein, 17 aa, Mycobacterium
SLHRCIHCGEPFDRIKE

SEQ ID NO: 778196 - protein, 23 aa, Mycobacterium
SLIPLKLRWGISLGALIMHLRQS

SEQ ID NO: 778197 - protein, 17 aa, Mycobacterium
SLKAAQQIADWSTKGYL

SEQ ID NO: 778198 - protein, 23 aa, Mycobacterium
SLKIDRLFAYWELRAMISQLLGS

SEQ ID NO: 778199 - protein, 23 aa, Mycobacterium
SLKLLWRMAFAFAGESERGKRMR

SEQ ID NO: 778200 - protein, 24 aa, Mycobacterium
SLLGGLPVRRLWGIGPVAEEKLHR

SEQ ID NO: 778201 - protein, 24 aa, Mycobacterium
SLLGGLPVRRLWGIGPVAEEKLNR

SEQ ID NO: 778202 - protein, 20 aa, Mycobacterium
SLLPGLRIGLLHGRLPSEQK

SEQ ID NO: 778203 - protein, 17 aa, Mycobacterium
SLLPLGELWVAAARMRR

SEQ ID NO: 778204 - protein, 18 aa, Mycobacterium
SLLPRYVTTRVYAALLES

SEQ ID NO: 778205 - protein, 17 aa, Mycobacterium
SLLRPGGRLFMREGHPF

SEQ ID NO: 778206 - protein, 21 aa, Mycobacterium
SLLRRLVIMGGSYDHRGNTTA

SEQ ID NO: 778207 - protein, 18 aa, Mycobacterium
SLLSARLQSFGQWMNEGA

SEQ ID NO: 778208 - protein, 17 aa, Mycobacterium
SLNHWYRMMGPTFETSV

SEQ ID NO: 778209 - protein, 18 aa, Mycobacterium
SLNPRWPIGQSIAEPLTL

SEQ ID NO: 778210 - protein, 19 aa, Mycobacterium
SLPDPQAWWQMTWRGRPDP

SEQ ID NO: 778211 - protein, 18 aa, Mycobacterium
SLPHRPGAVITREDVLSA

SEQ ID NO: 778212 - protein, 21 aa, Mycobacterium
SLPPGRLGWGWAKFAFTGWKT

SEQ ID NO: 778213 - protein, 24 aa, Mycobacterium
SLPPRFRELMGWSWSGADQRRYEL

SEQ ID NO: 778214 - protein, 18 aa, Mycobacterium
SLPPWLATNLANWNTIMA

SEQ ID NO: 778215 - protein, 19 aa, Mycobacterium
SLQASWTWAPSVFDEDKAA

SEQ ID NO: 778216 - protein, 18 aa, Mycobacterium
SLQCKLPISPSQAMGMMQ

SEQ ID NO: 778217 - protein, 19 aa, Mycobacterium
SLRAFPRPLLYAGAAADAG

SEQ ID NO: 778218 - protein, 20 aa, Mycobacterium
SLRARFGTLKGVERGVQEGD

SEQ ID NO: 778219 - protein, 18 aa, Mycobacterium
SLRARFGTLTGVDRPVAD

SEQ ID NO: 778220 - protein, 20 aa, Mycobacterium
SLRASALFTGLRGRAPVDLD

SEQ ID NO: 778221 - protein, 21 aa, Mycobacterium
SLRAVPTGGDWVRTTMVRKLQ

SEQ ID NO: 778222 - protein, 19 aa, Mycobacterium
SLRGPRGGLVLATAEYSDA

SEQ ID NO: 778223 - protein, 19 aa, Mycobacterium
SLRGPRGGLVLATEEFAPA

SEQ ID NO: 778224 - protein, 20 aa, Mycobacterium
SLRLRFRGVDVVKAGFWSSG

SEQ ID NO: 778225 - protein, 23 aa, Mycobacterium
SLRPELLESLLFPREAINSAAYK

SEQ ID NO: 778226 - protein, 24 aa, Mycobacterium
SLRPEPFGALLYHFGTRKLSFLKN

SEQ ID NO: 778227 - protein, 19 aa, Mycobacterium
SLRPISGLLSVVTLGTTLI

SEQ ID NO: 778228 - protein, 19 aa, Mycobacterium
SLRPSVGRMYRLEFDSAVN

SEQ ID NO: 778229 - protein, 22 aa, Mycobacterium
SLRRAGAGLAEFTGFGRAATDA

SEQ ID NO: 778230 - protein, 18 aa, Mycobacterium
SLRRAVGLADGWMPFGLR

SEQ ID NO: 778231 - protein, 18 aa, Mycobacterium
SLRRAVSLGDGWMPFGLR

SEQ ID NO: 778232 - protein, 21 aa, Mycobacterium
SLRTRFGREITHHEIVGDELR

SEQ ID NO: 778233 - protein, 20 aa, Mycobacterium
SLRVARLLADRVGDFDLVHD

SEQ ID NO: 778234 - protein, 23 aa, Mycobacterium
SLRYVFCGGEPLSLATARRFAEI

SEQ ID NO: 778235 - protein, 18 aa, Mycobacterium
SLSEQWKSSEFLPDPTLW

SEQ ID NO: 778236 - protein, 23 aa, Mycobacterium
SLSKAPFRWSRPVMDRFDAACIA

SEQ ID NO: 778237 - protein, 17 aa, Mycobacterium
SLSRLSSVVLRSNLAAR

SEQ ID NO: 778238 - protein, 19 aa, Mycobacterium
SLSRWMMRPNPEFDGRTPR

SEQ ID NO: 778239 - protein, 19 aa, Mycobacterium
SLTECPQCDGRLRKIFGKV

SEQ ID NO: 778240 - protein, 23 aa, Mycobacterium
SLTFPAVMALLVQKEFFRTYDVG

SEQ ID NO: 778241 - protein, 18 aa, Mycobacterium
SLTGRPLIGNGANGTPGT

SEQ ID NO: 778242 - protein, 17 aa, Mycobacterium
SLVAANLEMRWEMVGSP

SEQ ID NO: 778243 - protein, 18 aa, Mycobacterium
SLVAKWRFVGTDIDWDNT

SEQ ID NO: 778244 - protein, 23 aa, Mycobacterium
SLVERLVPEFLWISTEHTARVSL

SEQ ID NO: 778245 - protein, 19 aa, Mycobacterium
SLVKFHWKPVAGVHSLVWE

SEQ ID NO: 778246 - protein, 18 aa, Mycobacterium
SLVKFRWNGSGVEVLGNT

SEQ ID NO: 778247 - protein, 19 aa, Mycobacterium
SLVRRASCPVAVIRDEDPM

SEQ ID NO: 778248 - protein, 21 aa, Mycobacterium
SLWMAELWKEAGLPDGVFNVL

SEQ ID NO: 778249 - protein, 17 aa, Mycobacterium
SLYEWLSPALGPVSPAA

SEQ ID NO: 778250 - protein, 20 aa, Mycobacterium
SMAAAWTRKGLRVNCIACGA

SEQ ID NO: 778251 - protein, 25 aa, Mycobacterium
SMARRLRLNSRMGLLADDARVVDTL

SEQ ID NO: 778252 - protein, 22 aa, Mycobacterium
SMAVALRLAAFALLRADGSEPV

SEQ ID NO: 778253 - protein, 23 aa, Mycobacterium
SMDSSWRKLLLVCEAVAEPGDVE

SEQ ID NO: 778254 - protein, 20 aa, Mycobacterium
SMFQRFLPRHLEIIYEINRR

SEQ ID NO: 778255 - protein, 20 aa, Mycobacterium
SMGAVVAFEFARIAEQRGIA

SEQ ID NO: 778256 - protein, 19 aa, Mycobacterium
SMGAVVAFEFARVAETHGA

SEQ ID NO: 778257 - protein, 19 aa, Mycobacterium
SMGGLLAFEVARRFEDAGR

SEQ ID NO: 778258 - protein, 17 aa, Mycobacterium
SMITDGLAMRHGKDLTW

SEQ ID NO: 778259 - protein, 22 aa, Mycobacterium
SMLSAVMPYVNWLGVLAAQAEE

SEQ ID NO: 778260 - protein, 22 aa, Mycobacterium
SMMPMRVIGMLLGIPEGDQISV

SEQ ID NO: 778261 - protein, 22 aa, Mycobacterium
SMMPMRVIGMLLGIPESDQIGV

SEQ ID NO: 778262 - protein, 23 aa, Mycobacterium
SMPKSVVINPYFDWGVDRPPGHE

SEQ ID NO: 778263 - protein, 23 aa, Mycobacterium
SMPKSVVISPYFDWGNDRPPDRH

SEQ ID NO: 778264 - protein, 18 aa, Mycobacterium
SMPVGMLVDDRWVWLPTV

SEQ ID NO: 778265 - protein, 18 aa, Mycobacterium
SMRIFKSELREMQSENKG

SEQ ID NO: 778266 - protein, 25 aa, Mycobacterium
SMTGWRLGWMLVPRRFLRAVDRLSS

SEQ ID NO: 778267 - protein, 20 aa, Mycobacterium
SMVDAAICDGDWVVVRQQSV

SEQ ID NO: 778268 - protein, 21 aa, Mycobacterium
SMVSLGWLPPSYIPTGYPYAP

SEQ ID NO: 778269 - protein, 17 aa, Mycobacterium
SMYPRMWAAGGIDYPTL

SEQ ID NO: 778270 - protein, 21 aa, Mycobacterium
SNALCAAAVALECGATLDQVA

SEQ ID NO: 778271 - protein, 21 aa, Mycobacterium
SNALCAAAVALECGATPQQVA

SEQ ID NO: 778272 - protein, 18 aa, Mycobacterium
SNALLDWAYGRRFQYTEH

SEQ ID NO: 778273 - protein, 19 aa, Mycobacterium
SNALLDWAYGRRFRYSEHM

SEQ ID NO: 778274 - protein, 24 aa, Mycobacterium
SNASIKGWPGWSVYAGSKAALHAF

SEQ ID NO: 778275 - protein, 21 aa, Mycobacterium
SNEFFKLWLDPSMTYSCAYFE

SEQ ID NO: 778276 - protein, 21 aa, Mycobacterium
SNEFFKLWLDPSMTYSCGYFD

SEQ ID NO: 778277 - protein, 27 aa, Mycobacterium
SNGLLWRGDYQGLLGFTYESTVPAIPW

SEQ ID NO: 778278 - protein, 26 aa, Mycobacterium
SNGLLWRGDYQGLWGIDYAITIPDTA

SEQ ID NO: 778279 - protein, 19 aa, Mycobacterium
SNGRLGAGIARVRELLAAG

SEQ ID NO: 778280 - protein, 18 aa, Mycobacterium
SNITRLPVRYTFDNRYFN

SEQ ID NO: 778281 - protein, 17 aa, Mycobacterium
SNLARLEFRVGVEQTLQ

SEQ ID NO: 778282 - protein, 20 aa, Mycobacterium
SNLKCLCRFHHLLKTFWTGP

SEQ ID NO: 778283 - protein, 24 aa, Mycobacterium
SNMADCHPILYLRMADRLKAGARL

SEQ ID NO: 778284 - protein, 22 aa, Mycobacterium
SNPIDILAWLLGYNGQASGGLG

SEQ ID NO: 778285 - protein, 17 aa, Mycobacterium
SNPRLQLALAWANIVLH

SEQ ID NO: 778286 - protein, 24 aa, Mycobacterium
SNRAWRLYRRLGFTDVIRQHQFAG

SEQ ID NO: 778287 - protein, 19 aa, Mycobacterium
SNSKWLVAVRMVSEGVDVP

SEQ ID NO: 778288 - protein, 20 aa, Mycobacterium
SNTFYSWVLGPSMTYTCACY

SEQ ID NO: 778289 - protein, 19 aa, Mycobacterium
SNVQVVWEKFCRYFDVEAR

SEQ ID NO: 778290 - protein, 17 aa, Mycobacterium
SNVVAVLGMPVGKVTKI

SEQ ID NO: 778291 - protein, 22 aa, Mycobacterium
SNWLRPWLPSLLALSANSAVYR

SEQ ID NO: 778292 - protein, 19 aa, Mycobacterium
SNYILLGMILEWCDAQYGT

SEQ ID NO: 778293 - protein, 17 aa, Mycobacterium
SPAAAWPGWPSWPPRPA

SEQ ID NO: 778294 - protein, 21 aa, Mycobacterium
SPAAVCPHVEWALSSTLQAKA

SEQ ID NO: 778295 - protein, 21 aa, Mycobacterium
SPAAVCPHVEWALTSTLTSTP

SEQ ID NO: 778296 - protein, 19 aa, Mycobacterium
SPADFDAFLTLLENRGVDV

SEQ ID NO: 778297 - protein, 24 aa, Mycobacterium
SPAPRPAPDRMPARPMPDRMPTHS

SEQ ID NO: 778298 - protein, 18 aa, Mycobacterium
SPARFAIEGGRILPDPGQ

SEQ ID NO: 778299 - protein, 17 aa, Mycobacterium
SPARLAAIVDWEMTTVG

SEQ ID NO: 778300 - protein, 26 aa, Mycobacterium
SPATWIDWLVNWYLPISQLFYNTVGL

SEQ ID NO: 778301 - protein, 24 aa, Mycobacterium
SPAVYRYVCDELRVTPGDCMMVAA

SEQ ID NO: 778302 - protein, 23 aa, Mycobacterium
SPDELTILPGLFVVVGSTEAEAL

SEQ ID NO: 778303 - protein, 24 aa, Mycobacterium
SPDFPGERILGMGFDRDVLVRAGI

SEQ ID NO: 778304 - protein, 19 aa, Mycobacterium
SPDGRYLYIAGYSGVVTVA

SEQ ID NO: 778305 - protein, 20 aa, Mycobacterium
SPDLPPLWRAFGASRRGDGH

SEQ ID NO: 778306 - protein, 17 aa, Mycobacterium
SPDRYRAVTGAQRISLS

SEQ ID NO: 778307 - protein, 18 aa, Mycobacterium
SPEGWKRLTALRRELSAL

SEQ ID NO: 778308 - protein, 23 aa, Mycobacterium
SPELVRRLCWEWAGPRQGAADAI

SEQ ID NO: 778309 - protein, 18 aa, Mycobacterium
SPEQAFRVLQWRSQETNT

SEQ ID NO: 778310 - protein, 19 aa, Mycobacterium
SPFGWTFPYAWPHTPILAA

SEQ ID NO: 778311 - protein, 24 aa, Mycobacterium
SPGFSWKPLHTMPGVSTYYTFYDD

SEQ ID NO: 778312 - protein, 18 aa, Mycobacterium
SPGFSWQPLHTMPGISTF

SEQ ID NO: 778313 - protein, 17 aa, Mycobacterium
SPGSPWLADTWRDRFQQ

SEQ ID NO: 778314 - protein, 17 aa, Mycobacterium
SPHLPLLDPVRAIPVIG

SEQ ID NO: 778315 - protein, 20 aa, Mycobacterium
SPHRVPVWFMRQAGRSLPEY

SEQ ID NO: 778316 - protein, 25 aa, Mycobacterium
SPHSDRLFCVPATIDLAGAEIELVS

SEQ ID NO: 778317 - protein, 21 aa, Mycobacterium
SPKESWLRLLIIGAGLPRPTT

SEQ ID NO: 778318 - protein, 17 aa, Mycobacterium
SPKETWLRLLLLDDGLP

SEQ ID NO: 778319 - protein, 23 aa, Mycobacterium
SPKETWLRLLLMREFPRPQTQIP

SEQ ID NO: 778320 - protein, 20 aa, Mycobacterium
SPKWTGTRVDLVFASNSQLR

SEQ ID NO: 778321 - protein, 23 aa, Mycobacterium
SPLAGTVRFDWDPLRWFEEDEQI

SEQ ID NO: 778322 - protein, 22 aa, Mycobacterium
SPLALRMARSFLGKRSPAVYTL

SEQ ID NO: 778323 - protein, 18 aa, Mycobacterium
SPLEAWKLLSDNPNAVLV

SEQ ID NO: 778324 - protein, 21 aa, Mycobacterium
SPLGWLWQILFGTTFPTSISA

SEQ ID NO: 778325 - protein, 23 aa, Mycobacterium
SPLPDLKPRWERPTTAPDSETPS

SEQ ID NO: 778326 - protein, 18 aa, Mycobacterium
SPLPFARHRWISPGVSPD

SEQ ID NO: 778327 - protein, 22 aa, Mycobacterium
SPLQARCGWAIGWKKDAFFGRD

SEQ ID NO: 778328 - protein, 17 aa, Mycobacterium
SPLRKPKFPAALAPESP

SEQ ID NO: 778329 - protein, 20 aa, Mycobacterium
SPLRPWPGFTPMIYQQYSEP

SEQ ID NO: 778330 - protein, 22 aa, Mycobacterium
SPLRPWPGFVPMIYERYSQPFF

SEQ ID NO: 778331 - protein, 18 aa, Mycobacterium
SPLSIAFPFVSTHNHFAL

SEQ ID NO: 778332 - protein, 17 aa, Mycobacterium
SPLWFAIRAYRQMQTQD

SEQ ID NO: 778333 - protein, 18 aa, Mycobacterium
SPLWFAIRAYRQMRTQDG

SEQ ID NO: 778334 - protein, 24 aa, Mycobacterium
SPLWPEYLGALGFPIHYRGNHLHL

SEQ ID NO: 778335 - protein, 17 aa, Mycobacterium
SPMLVALCDEWARRGFL

SEQ ID NO: 778336 - protein, 18 aa, Mycobacterium
SPNELFRAVGLDYWDEVG

SEQ ID NO: 778337 - protein, 18 aa, Mycobacterium
SPNVLPFPDDWHGTGDNP

SEQ ID NO: 778338 - protein, 27 aa, Mycobacterium
SPPDMRLPIALALGWPRRVPGAAASCD

SEQ ID NO: 778339 - protein, 19 aa, Mycobacterium
SPPSALWATSQSPPMPQTS

SEQ ID NO: 778340 - protein, 17 aa, Mycobacterium
SPQRLDSELTWISEQTG

SEQ ID NO: 778341 - protein, 18 aa, Mycobacterium
SPRDLRFVPTDHGVQTCD

SEQ ID NO: 778342 - protein, 20 aa, Mycobacterium
SPRGYRAMAVIPRLQFAHAD

SEQ ID NO: 778343 - protein, 24 aa, Mycobacterium
SPRRLGRRGPLHVVDWQNVRGLTP

SEQ ID NO: 778344 - protein, 19 aa, Mycobacterium
SPRRVAAYLAKYVTKSLHD

SEQ ID NO: 778345 - protein, 18 aa, Mycobacterium
SPRVWRWDDYVLDLGRYE

SEQ ID NO: 778346 - protein, 22 aa, Mycobacterium
SPSDTATYCPFKGDAGYFDVTA

SEQ ID NO: 778347 - protein, 19 aa, Mycobacterium
SPSGPRLAGKLGTSLLSLS

SEQ ID NO: 778348 - protein, 23 aa, Mycobacterium
SPSGRDCLDWVAGELWVGGANVA

SEQ ID NO: 778349 - protein, 18 aa, Mycobacterium
SPTPVAWTRMRVPRSLMA

SEQ ID NO: 778350 - protein, 19 aa, Mycobacterium
SPTSWPALRAFAAPGHVVY

SEQ ID NO: 778351 - protein, 19 aa, Mycobacterium
SPVCRPDCAGLCPQCGVVL

SEQ ID NO: 778352 - protein, 18 aa, Mycobacterium
SPVEQIRMSLAMAGWPKS

SEQ ID NO: 778353 - protein, 18 aa, Mycobacterium
SPVPLYFQVAQVFEKAIL

SEQ ID NO: 778354 - protein, 21 aa, Mycobacterium
SPVPRAALFVLDRWLRPAPEG

SEQ ID NO: 778355 - protein, 21 aa, Mycobacterium
SPVSCPACIAGLIAGIFGGDQ

SEQ ID NO: 778356 - protein, 20 aa, Mycobacterium
SPWGTWEWLGPAAVGATLPA

SEQ ID NO: 778357 - protein, 19 aa, Mycobacterium
SPWKCWRLLTLETRMQVCR

SEQ ID NO: 778358 - protein, 18 aa, Mycobacterium
SPWRSYVSMHLWRKGIAA

SEQ ID NO: 778359 - protein, 19 aa, Mycobacterium
SPYVASFRAGWAYLSLITV

SEQ ID NO: 778360 - protein, 20 aa, Mycobacterium
SQADVIWKLRYTMRSQIFSR

SEQ ID NO: 778361 - protein, 26 aa, Mycobacterium
SQAGRDCLDWVPGELWIGGDSVASGY

SEQ ID NO: 778362 - protein, 17 aa, Mycobacterium
SQALAFVRQRHGLENGD

SEQ ID NO: 778363 - protein, 18 aa, Mycobacterium
SQANFVWLPLGERSTEFA

SEQ ID NO: 778364 - protein, 18 aa, Mycobacterium
SQANFVWLPLVGRAQQFA

SEQ ID NO: 778365 - protein, 17 aa, Mycobacterium
SQARGGGVIVRIDPDDP

SEQ ID NO: 778366 - protein, 23 aa, Mycobacterium
SQARLGPGRIHHCMRAIGMAERA

SEQ ID NO: 778367 - protein, 22 aa, Mycobacterium
SQESLFKWQRLRLARVEATQPE

SEQ ID NO: 778368 - protein, 18 aa, Mycobacterium
SQGARRFLAHPVMLDVAV

SEQ ID NO: 778369 - protein, 23 aa, Mycobacterium
SQGRFSFVAGMGYRPQEYHAAGK

SEQ ID NO: 778370 - protein, 19 aa, Mycobacterium
SQIPLCLDTGHLLIGGTDP

SEQ ID NO: 778371 - protein, 19 aa, Mycobacterium
SQKFAWARIFRPMVHGYPL

SEQ ID NO: 778372 - protein, 21 aa, Mycobacterium
SQLAWVLGCFTGFGQASRMTQ

SEQ ID NO: 778373 - protein, 18 aa, Mycobacterium
SQLFLGSGVMPWRATVGS

SEQ ID NO: 778374 - protein, 23 aa, Mycobacterium
SQLKPGSVLIGFLAPRTQPELAS

SEQ ID NO: 778375 - protein, 22 aa, Mycobacterium
SQLLSLWGSAGAGGAGGIGGAG

SEQ ID NO: 778376 - protein, 21 aa, Mycobacterium
SQLNRCLFCLDLHTRVALEEG

SEQ ID NO: 778377 - protein, 17 aa, Mycobacterium
SQLVQWPGFAGEIACSA

SEQ ID NO: 778378 - protein, 18 aa, Mycobacterium
SQMWGRFIYHDEIAAGVV

SEQ ID NO: 778379 - protein, 22 aa, Mycobacterium
SQPRKASGSGFGFGPELLDEMT

SEQ ID NO: 778380 - protein, 19 aa, Mycobacterium
SQSNFVWLPLGSRTMDFTE

SEQ ID NO: 778381 - protein, 22 aa, Mycobacterium
SQTRLATWVAIPGHTATPTGSV

SEQ ID NO: 778382 - protein, 25 aa, Mycobacterium
SQWISGEFSKLVQFILNLVNAPSEL

SEQ ID NO: 778383 - protein, 22 aa, Mycobacterium
SQWTDEIFKAFNFHPDATFDEA

SEQ ID NO: 778384 - protein, 17 aa, Mycobacterium
SRAAVRWAMAEATLRGV

SEQ ID NO: 778385 - protein, 19 aa, Mycobacterium
SRAEYAGKVVGDWRPLAVG

SEQ ID NO: 778386 - protein, 23 aa, Mycobacterium
SRAFRLPWPAGTVVYEIDQPLVL

SEQ ID NO: 778387 - protein, 17 aa, Mycobacterium
SRAGLGYEVIVSRLDEE

SEQ ID NO: 778388 - protein, 17 aa, Mycobacterium
SRAGLVVALREVADGDA

SEQ ID NO: 778389 - protein, 17 aa, Mycobacterium
SRAIRWVLVEGTTGAGD

SEQ ID NO: 778390 - protein, 20 aa, Mycobacterium
SRAPGALGLHAALTGAPFSG

SEQ ID NO: 778391 - protein, 20 aa, Mycobacterium
SRAPGGLGLHAALTGAPFSG

SEQ ID NO: 778392 - protein, 19 aa, Mycobacterium
SRAPKVLPFSALDAPNGVA

SEQ ID NO: 778393 - protein, 21 aa, Mycobacterium
SRAPLVPSMLEWLHTARTSMV

SEQ ID NO: 778394 - protein, 21 aa, Mycobacterium
SRAQLLELVWGYDFAADTNVV

SEQ ID NO: 778395 - protein, 20 aa, Mycobacterium
SRASARWCAGARWSVLPEAE

SEQ ID NO: 778396 - protein, 21 aa, Mycobacterium
SRASSVVPRYGVRLTVMAHPP

SEQ ID NO: 778397 - protein, 21 aa, Mycobacterium
SRAWRLPWPAGTTVFELDQPR

SEQ ID NO: 778398 - protein, 22 aa, Mycobacterium
SRAYRLPWPAGTVVYEVDMPEV

SEQ ID NO: 778399 - protein, 21 aa, Mycobacterium
SRAYRLPWPDGTVVYEIDQPD

SEQ ID NO: 778400 - protein, 18 aa, Mycobacterium
SRCPVGWSDNYGGFWTLT

SEQ ID NO: 778401 - protein, 17 aa, Mycobacterium
SRCSWAGAQASRLAADA

SEQ ID NO: 778402 - protein, 22 aa, Mycobacterium
SRELGVQFARQGIRVNALCPGP

SEQ ID NO: 778403 - protein, 17 aa, Mycobacterium
SRELKLLVDRREDLVGQ

SEQ ID NO: 778404 - protein, 18 aa, Mycobacterium
SRERGVPRYNEFRRQLRL

SEQ ID NO: 778405 - protein, 17 aa, Mycobacterium
SREVWLMVSGGTKAEAV

SEQ ID NO: 778406 - protein, 17 aa, Mycobacterium
SRFPGGFTSEVRGIFTY

SEQ ID NO: 778407 - protein, 18 aa, Mycobacterium
SRGDGLCNVFVPHATAGV

SEQ ID NO: 778408 - protein, 21 aa, Mycobacterium
SRGFPRPRFDDGYGRYDGDDY

SEQ ID NO: 778409 - protein, 24 aa, Mycobacterium
SRGFPRPRFDDGYGRYEGRDYDDP

SEQ ID NO: 778410 - protein, 18 aa, Mycobacterium
SRGLIGWRTDFLTETRGT

SEQ ID NO: 778411 - protein, 20 aa, Mycobacterium
SRGLPVLGLCLGLQCIVIEA

SEQ ID NO: 778412 - protein, 17 aa, Mycobacterium
SRGLRFGFITGSAPSTV

SEQ ID NO: 778413 - protein, 21 aa, Mycobacterium
SRGPAVVEFNCRFGDPETQAV

SEQ ID NO: 778414 - protein, 22 aa, Mycobacterium
SRGPMAFNIPRSCSPTMPTTGS

SEQ ID NO: 778415 - protein, 18 aa, Mycobacterium
SRGTPLWATATNGQQVVR

SEQ ID NO: 778416 - protein, 20 aa, Mycobacterium
SRGVLFPKHRTDLIGCAVTV

SEQ ID NO: 778417 - protein, 21 aa, Mycobacterium
SRHACKLFWERGVSGTSGDDI

SEQ ID NO: 778418 - protein, 17 aa, Mycobacterium
SRHDVMWAMVTDMPAAG

SEQ ID NO: 778419 - protein, 17 aa, Mycobacterium
SRHFVRWLTVWNNTVDE

SEQ ID NO: 778420 - protein, 17 aa, Mycobacterium
SRHLLLSAWIKMQDGQL

SEQ ID NO: 778421 - protein, 17 aa, Mycobacterium
SRIALRFVDHTPPVKPG

SEQ ID NO: 778422 - protein, 19 aa, Mycobacterium
SRICASLGLPERVLTQQLR

SEQ ID NO: 778423 - protein, 20 aa, Mycobacterium
SRIDPVLARSWLLVNGTHAD

SEQ ID NO: 778424 - protein, 17 aa, Mycobacterium
SRIFFDWFDAVGVDDIP

SEQ ID NO: 778425 - protein, 19 aa, Mycobacterium
SRIFTEFTYRSGSTTISTG

SEQ ID NO: 778426 - protein, 19 aa, Mycobacterium
SRIPLCLDTGHLLIGGTDP

SEQ ID NO: 778427 - protein, 17 aa, Mycobacterium
SRIRILMRLSRTPMTVK

SEQ ID NO: 778428 - protein, 25 aa, Mycobacterium
SRKLVGIKVGREWRLPRWQFAPDNT

SEQ ID NO: 778429 - protein, 19 aa, Mycobacterium
SRLAAEIIERVPPVERVRL

SEQ ID NO: 778430 - protein, 18 aa, Mycobacterium
SRLALPRWLAESLPAPLP

SEQ ID NO: 778431 - protein, 19 aa, Mycobacterium
SRLCCACFDGNYPIELPKE

SEQ ID NO: 778432 - protein, 17 aa, Mycobacterium
SRLCNWCAHQAHCPSFG

SEQ ID NO: 778433 - protein, 23 aa, Mycobacterium
SRLGEMRRLRVSGPLKAMVEAEW

SEQ ID NO: 778434 - protein, 21 aa, Mycobacterium
SRLLPAITFIFSRAGCDAAVK

SEQ ID NO: 778435 - protein, 17 aa, Mycobacterium
SRLPDYFPRPLRERFTS

SEQ ID NO: 778436 - protein, 20 aa, Mycobacterium
SRLPFGRHRWVLDPACHPID

SEQ ID NO: 778437 - protein, 21 aa, Mycobacterium
SRLPLVPPLLEWLHAVRQPVV

SEQ ID NO: 778438 - protein, 20 aa, Mycobacterium
SRLPLYFPKPLRERFTGEIR

SEQ ID NO: 778439 - protein, 18 aa, Mycobacterium
SRLRLALAEGERLEPPAL

SEQ ID NO: 778440 - protein, 18 aa, Mycobacterium
SRLRRWRLAGGADAGLAT

SEQ ID NO: 778441 - protein, 17 aa, Mycobacterium
SRLSWAAGLRDDGSTTL

SEQ ID NO: 778442 - protein, 20 aa, Mycobacterium
SRLTTALALAQWIEEHRPDC

SEQ ID NO: 778443 - protein, 20 aa, Mycobacterium
SRLVRLGLCLSRISRDELSA

SEQ ID NO: 778444 - protein, 19 aa, Mycobacterium
SRLWRMLLAPGRGIGKLVT

SEQ ID NO: 778445 - protein, 20 aa, Mycobacterium
SRLWRMLLAPGRGIGRLVTG

SEQ ID NO: 778446 - protein, 22 aa, Mycobacterium
SRMPCPYLNPGHYVRGRPLVQG

SEQ ID NO: 778447 - protein, 18 aa, Mycobacterium
SRMPCPYLNPGRYVCDRP

SEQ ID NO: 778448 - protein, 17 aa, Mycobacterium
SRNRRLTVASGRLEDYR

SEQ ID NO: 778449 - protein, 19 aa, Mycobacterium
SRPAITLSWIRELPSLGAA

SEQ ID NO: 778450 - protein, 19 aa, Mycobacterium
SRPAITLSWIRELPSLGAV

SEQ ID NO: 778451 - protein, 19 aa, Mycobacterium
SRPCTACMSAAGGGIAKRT

SEQ ID NO: 778452 - protein, 27 aa, Mycobacterium
SRPDGKWRAVAKVSAWLLAASDTSDVT

SEQ ID NO: 778453 - protein, 24 aa, Mycobacterium
SRPDHAVSIGMVFRALMGETELLR

SEQ ID NO: 778454 - protein, 20 aa, Mycobacterium
SRPGGGWGWAVEPPGAVVAE

SEQ ID NO: 778455 - protein, 20 aa, Mycobacterium
SRPHLPLIVAHMGMPEYRDF

SEQ ID NO: 778456 - protein, 20 aa, Mycobacterium
SRPNPSWPVARVEYSHADSE

SEQ ID NO: 778457 - protein, 17 aa, Mycobacterium
SRPRPAAPMLLADSRAS

SEQ ID NO: 778458 - protein, 17 aa, Mycobacterium
SRPSFWWIRLGNPLAKQ

SEQ ID NO: 778459 - protein, 19 aa, Mycobacterium
SRPSGGWERERAVLAVVDG

SEQ ID NO: 778460 - protein, 19 aa, Mycobacterium
SRPVTCPSIVAAFTAQVDL

SEQ ID NO: 778461 - protein, 18 aa, Mycobacterium
SRQLPLRLVYVIPSQQTG

SEQ ID NO: 778462 - protein, 24 aa, Mycobacterium
SRQLWWGHRIPIWYGPNGEQVCVG

SEQ ID NO: 778463 - protein, 23 aa, Mycobacterium
SRRELACATDLIGYHTYLNRIPV

SEQ ID NO: 778464 - protein, 19 aa, Mycobacterium
SRRIDPRAGTVMVWGAVNA

SEQ ID NO: 778465 - protein, 20 aa, Mycobacterium
SRRKHIAAGYEFVNTPHITK

SEQ ID NO: 778466 - protein, 22 aa, Mycobacterium
SRRKHIEAGYEFVNTPHITKAQ

SEQ ID NO: 778467 - protein, 22 aa, Mycobacterium
SRRKHIEAGYEFVNTPHITKEQ

SEQ ID NO: 778468 - protein, 23 aa, Mycobacterium
SRRLWTLLIFMLWHAIFVDHSVV

SEQ ID NO: 778469 - protein, 23 aa, Mycobacterium
SRRLWTLLIFMLWHAIFVERSVV

SEQ ID NO: 778470 - protein, 22 aa, Mycobacterium
SRRRLVEILSHFDLLKDDTEPP

SEQ ID NO: 778471 - protein, 19 aa, Mycobacterium
SRRTAEMLLALSSSRVSSP

SEQ ID NO: 778472 - protein, 21 aa, Mycobacterium
SRRTECWLVLDIPNLYATAVA

SEQ ID NO: 778473 - protein, 20 aa, Mycobacterium
SRSEMAWAFPAVPMVVRAPA

SEQ ID NO: 778474 - protein, 19 aa, Mycobacterium
SRSGPGWALGTAALATAKS

SEQ ID NO: 778475 - protein, 25 aa, Mycobacterium
SRSTPRAGDGFIRLDVDGVAIYASP

SEQ ID NO: 778476 - protein, 26 aa, Mycobacterium
SRSTPRAGDGFIRLDVNGVVAYASPN

SEQ ID NO: 778477 - protein, 26 aa, Mycobacterium
SRSTPRAGDGFIRLNVDGVVAYASPN

SEQ ID NO: 778478 - protein, 18 aa, Mycobacterium
SRTLGFWLQLGVAGFRVD

SEQ ID NO: 778479 - protein, 23 aa, Mycobacterium
SRTPEWWASWTLDSEELQKESGK

SEQ ID NO: 778480 - protein, 17 aa, Mycobacterium
SRTRPALPTAQLVMTGR

SEQ ID NO: 778481 - protein, 19 aa, Mycobacterium
SRTSFNWGVPVPGHPDHVM

SEQ ID NO: 778482 - protein, 19 aa, Mycobacterium
SRVLGLHFFNPVPVLPLVE

SEQ ID NO: 778483 - protein, 17 aa, Mycobacterium
SRVPLWVEETLRYDTSS

SEQ ID NO: 778484 - protein, 21 aa, Mycobacterium
SRVYRLPWPDGTVVYELDQPK

SEQ ID NO: 778485 - protein, 19 aa, Mycobacterium
SRWGYKFRFGVFRIDDHDL

SEQ ID NO: 778486 - protein, 17 aa, Mycobacterium
SRWHRRRPLWVGVAAGG

SEQ ID NO: 778487 - protein, 17 aa, Mycobacterium
SRWHRRRPLWVGVATGG

SEQ ID NO: 778488 - protein, 17 aa, Mycobacterium
SRYDEGIEILKNMMENF

SEQ ID NO: 778489 - protein, 19 aa, Mycobacterium
SRYTRARFAPAFGPNASLE

SEQ ID NO: 778490 - protein, 20 aa, Mycobacterium
SRYTRSRFAPAFGPAASLEY

SEQ ID NO: 778491 - protein, 22 aa, Mycobacterium
SRYTRSRFAPAFGPKASLEYLP

SEQ ID NO: 778492 - protein, 18 aa, Mycobacterium
SRYTRSRFASAFGPSAAL

SEQ ID NO: 778493 - protein, 18 aa, Mycobacterium
SSAHFVWVRETLRLGEKF

SEQ ID NO: 778494 - protein, 33 aa, Mycobacterium
SSAQFPRPAPRPSYSALGGRAWAAAGLTPLRPW

SEQ ID NO: 778495 - protein, 20 aa, Mycobacterium
SSDLRRWLPLDIHRPTKSTL

SEQ ID NO: 778496 - protein, 20 aa, Mycobacterium
SSDPTAKCVQDFVSSTAASN

SEQ ID NO: 778497 - protein, 21 aa, Mycobacterium
SSEAARAWWGNFLVQKANEAG

SEQ ID NO: 778498 - protein, 21 aa, Mycobacterium
SSEGWRLYTRARFAPYVEKLL

SEQ ID NO: 778499 - protein, 20 aa, Mycobacterium
SSEQARAWWGNFLVQKANEA

SEQ ID NO: 778500 - protein, 19 aa, Mycobacterium
SSFIYGVGFPTLWSHHHLD

SEQ ID NO: 778501 - protein, 21 aa, Mycobacterium
SSFRYAAPAGRDWKIADLAGK

SEQ ID NO: 778502 - protein, 26 aa, Mycobacterium
SSFTTNMPFCIAVAVREMHLTPDEAV

SEQ ID NO: 778503 - protein, 24 aa, Mycobacterium
SSGEARPALMLSWIRDVPSLGAVA

SEQ ID NO: 778504 - protein, 18 aa, Mycobacterium
SSGFPINLLGVWAQLATA

SEQ ID NO: 778505 - protein, 23 aa, Mycobacterium
SSGIGVLRWLPAVPEALAEDPQW

SEQ ID NO: 778506 - protein, 18 aa, Mycobacterium
SSGPNLFETLGFTYIGPT

SEQ ID NO: 778507 - protein, 19 aa, Mycobacterium
SSGVGRFGGRWAIDEFTTE

SEQ ID NO: 778508 - protein, 22 aa, Mycobacterium
SSHLYPRFDVFLTEVARVLRPG

SEQ ID NO: 778509 - protein, 24 aa, Mycobacterium
SSIKKVAPLFGFEWRVDDPGGAVS

SEQ ID NO: 778510 - protein, 18 aa, Mycobacterium
SSIPPVPGKFYWMTPTQV

SEQ ID NO: 778511 - protein, 19 aa, Mycobacterium
SSIREAHAASAGLTTSIAA

SEQ ID NO: 778512 - protein, 17 aa, Mycobacterium
SSIWYRIRINLQHIPPE

SEQ ID NO: 778513 - protein, 17 aa, Mycobacterium
SSIWYRIRINLQHVAED

SEQ ID NO: 778514 - protein, 17 aa, Mycobacterium
SSIWYRIRINLQHVPPD

SEQ ID NO: 778515 - protein, 17 aa, Mycobacterium
SSIWYRIRVNLQHVPVD

SEQ ID NO: 778516 - protein, 19 aa, Mycobacterium
SSKEARSWWGNFLVQKANE

SEQ ID NO: 778517 - protein, 17 aa, Mycobacterium
SSLKGANLWNEVKDRLD

SEQ ID NO: 778518 - protein, 22 aa, Mycobacterium
SSLLPPAVKWKAFFKRQLGNPK

SEQ ID NO: 778519 - protein, 21 aa, Mycobacterium
SSLVRRARCPVAIIRDEDPLM

SEQ ID NO: 778520 - protein, 18 aa, Mycobacterium
SSLVTGWARLHGYPLGIL

SEQ ID NO: 778521 - protein, 18 aa, Mycobacterium
SSLVTGWARLHGYPVGIL

SEQ ID NO: 778522 - protein, 20 aa, Mycobacterium
SSMFRGCVSREFTVLATGKT

SEQ ID NO: 778523 - protein, 21 aa, Mycobacterium
SSPEMIDWLSSYGVPFSPALC

SEQ ID NO: 778524 - protein, 19 aa, Mycobacterium
SSPYATFFDIDWDLDQDGR

SEQ ID NO: 778525 - protein, 18 aa, Mycobacterium
SSRGYRAMTHIPRLQFAH

SEQ ID NO: 778526 - protein, 20 aa, Mycobacterium
SSRPRPATRTLVLPELDETD

SEQ ID NO: 778527 - protein, 20 aa, Mycobacterium
SSRWKKWKRFWGKHRRGGDF

SEQ ID NO: 778528 - protein, 17 aa, Mycobacterium
SSRYVARIRPIRVGRIL

SEQ ID NO: 778529 - protein, 24 aa, Mycobacterium
SSTIPEIPWHYDVTAPIEIPISGN

SEQ ID NO: 778530 - protein, 18 aa, Mycobacterium
SSVATWLFGIVKNTASRH

SEQ ID NO: 778531 - protein, 17 aa, Mycobacterium
SSWFKLHHPAAFCAALL

SEQ ID NO: 778532 - protein, 21 aa, Mycobacterium
SSWKGRWPLGRGFERFYGFLG

SEQ ID NO: 778533 - protein, 18 aa, Mycobacterium
SSYIASWYAAPLLAAQDR

SEQ ID NO: 778534 - protein, 18 aa, Mycobacterium
SSYIKGRVAPVFDLGVGM

SEQ ID NO: 778535 - protein, 17 aa, Mycobacterium
STADGYLKPGLRRRNLN

SEQ ID NO: 778536 - protein, 17 aa, Mycobacterium
STAIARCRRLLDLDADP

SEQ ID NO: 778537 - protein, 24 aa, Mycobacterium
STANGCPRTKMVLGGYSQGAAVMG

SEQ ID NO: 778538 - protein, 17 aa, Mycobacterium
STARLCLVPNLVADHCY

SEQ ID NO: 778539 - protein, 20 aa, Mycobacterium
STARLKCPFTSLGVAPEAAS

SEQ ID NO: 778540 - protein, 19 aa, Mycobacterium
STAVATLFGAHAQQYQSLG

SEQ ID NO: 778541 - protein, 24 aa, Mycobacterium
STCSEFFRYYAGWCSKINGVAYDV

SEQ ID NO: 778542 - protein, 19 aa, Mycobacterium
STDALGWRLGDDGFRIVLT

SEQ ID NO: 778543 - protein, 18 aa, Mycobacterium
STDLRPARSFAVDYAGWV

SEQ ID NO: 778544 - protein, 18 aa, Mycobacterium
STEEVRFLMGFNREVVRR

SEQ ID NO: 778545 - protein, 17 aa, Mycobacterium
STFCSFVAGLLATLREF

SEQ ID NO: 778546 - protein, 19 aa, Mycobacterium
STFRYAAPAGRDWTIYDIA

SEQ ID NO: 778547 - protein, 21 aa, Mycobacterium
STFRYAAPAGREWTTADLAGK

SEQ ID NO: 778548 - protein, 18 aa, Mycobacterium
STGAIAYRALAREFIDRF

SEQ ID NO: 778549 - protein, 29 aa, Mycobacterium
STGELPTLFAWRIADYWKWTRYPDPADYQ

SEQ ID NO: 778550 - protein, 23 aa, Mycobacterium
STGFCVWANRMAIEYLLTAATEY

SEQ ID NO: 778551 - protein, 25 aa, Mycobacterium
STGGDDGPDGWAFAGAGGAGEDGGF

SEQ ID NO: 778552 - protein, 17 aa, Mycobacterium
STIFPFRRVFVVAVVGG

SEQ ID NO: 778553 - protein, 17 aa, Mycobacterium
STIKVLLAMTVLDHLRP

SEQ ID NO: 778554 - protein, 24 aa, Mycobacterium
STITFKIKNMWGLLTVKGEFTNFG

SEQ ID NO: 778555 - protein, 20 aa, Mycobacterium
STLLGFCAAVLFPTSGTVRI

SEQ ID NO: 778556 - protein, 23 aa, Mycobacterium
STLLLTLLFRFMRPLVEHGHIFL

SEQ ID NO: 778557 - protein, 18 aa, Mycobacterium
STLQSGPEFARWLQERGR

SEQ ID NO: 778558 - protein, 18 aa, Mycobacterium
STLTWRVATNVTRLPGLG

SEQ ID NO: 778559 - protein, 18 aa, Mycobacterium
STMGAEGSSGDGGTGGLG

SEQ ID NO: 778560 - protein, 17 aa, Mycobacterium
STPAWRVFAKYYYPFIT

SEQ ID NO: 778561 - protein, 18 aa, Mycobacterium
STPGTRCQLDIAPYTNRL

SEQ ID NO: 778562 - protein, 20 aa, Mycobacterium
STPHPLQWDCFFFGIVQSDG

SEQ ID NO: 778563 - protein, 21 aa, Mycobacterium
STPISSAFCRPTSICWPLPRS

SEQ ID NO: 778564 - protein, 19 aa, Mycobacterium
STPPWWPMRQLVRALGADA

SEQ ID NO: 778565 - protein, 18 aa, Mycobacterium
STPVKEFMRTAAEDTEVR

SEQ ID NO: 778566 - protein, 17 aa, Mycobacterium
STPVKEFMRTAAEDTTV

SEQ ID NO: 778567 - protein, 20 aa, Mycobacterium
STQMSLRYAHLFDHTVRTEY

SEQ ID NO: 778568 - protein, 22 aa, Mycobacterium
STRAALPLLRRSDSAAIVNVSS

SEQ ID NO: 778569 - protein, 19 aa, Mycobacterium
STRAKRWLRARSRPTAGRA

SEQ ID NO: 778570 - protein, 18 aa, Mycobacterium
STRPLVICDLGMPRDVDP

SEQ ID NO: 778571 - protein, 19 aa, Mycobacterium
STRTPRGWIANAYGNRPGL

SEQ ID NO: 778572 - protein, 20 aa, Mycobacterium
STRTRFSFEMGIAQLGGHAV

SEQ ID NO: 778573 - protein, 24 aa, Mycobacterium
STSGWNFAECLSLLTSLTSPASAA

SEQ ID NO: 778574 - protein, 20 aa, Mycobacterium
STTLRCLYRALTPASGDVAV

SEQ ID NO: 778575 - protein, 23 aa, Mycobacterium
STTLRMIVGLARPTSGTATIGGK

SEQ ID NO: 778576 - protein, 24 aa, Mycobacterium
STTPSTRCGWGWNGWAPRRARRYG

SEQ ID NO: 778577 - protein, 21 aa, Mycobacterium
STTQLRWRPIDFWPADTTVSI

SEQ ID NO: 778578 - protein, 24 aa, Mycobacterium
STTTAAVWLRYWVDEIKKPKVRPN

SEQ ID NO: 778579 - protein, 23 aa, Mycobacterium
STVNYRCAMVFGRAVPVTERERE

SEQ ID NO: 778580 - protein, 19 aa, Mycobacterium
STVVLAMWQYLLHRYTQQD

SEQ ID NO: 778581 - protein, 21 aa, Mycobacterium
STWAQDIFKIVSFDIDLAAEE

SEQ ID NO: 778582 - protein, 23 aa, Mycobacterium
SVARIDSWDGFYCFAAEITSPMA

SEQ ID NO: 778583 - protein, 19 aa, Mycobacterium
SVARLKAAGAIVLAKTNLP

SEQ ID NO: 778584 - protein, 20 aa, Mycobacterium
SVDFPRPAPRPAYTALDGDH

SEQ ID NO: 778585 - protein, 23 aa, Mycobacterium
SVDLRPAPSWYGFAATLLVGKER

SEQ ID NO: 778586 - protein, 17 aa, Mycobacterium
SVDNAWVVPHFEKMLYD

SEQ ID NO: 778587 - protein, 20 aa, Mycobacterium
SVDRQIRWFGLDGVENTSST

SEQ ID NO: 778588 - protein, 22 aa, Mycobacterium
SVDWAQVFPEWGLAGNAAFVVA

SEQ ID NO: 778589 - protein, 18 aa, Mycobacterium
SVEKARMLLGWQARVDLR

SEQ ID NO: 778590 - protein, 20 aa, Mycobacterium
SVEMKQRWLPGIADGSQKMA

SEQ ID NO: 778591 - protein, 18 aa, Mycobacterium
SVEPFPLPAEAGVEPDPR

SEQ ID NO: 778592 - protein, 18 aa, Mycobacterium
SVEPFPLPAEQGVEPDPR

SEQ ID NO: 778593 - protein, 18 aa, Mycobacterium
SVEPFPLPGEAGVAPDPR

SEQ ID NO: 778594 - protein, 20 aa, Mycobacterium
SVEWCLSWAGCTAVAFERDE

SEQ ID NO: 778595 - protein, 23 aa, Mycobacterium
SVGGRPALDWADLVRAAGVGGAL

SEQ ID NO: 778596 - protein, 23 aa, Mycobacterium
SVGLPMRCVFALTAMGFLPQSPD

SEQ ID NO: 778597 - protein, 19 aa, Mycobacterium
SVGMPAWLSYTIDGARTRA

SEQ ID NO: 778598 - protein, 22 aa, Mycobacterium
SVGTIRCWFGVGCNATVPVVRI

SEQ ID NO: 778599 - protein, 20 aa, Mycobacterium
SVHVPLRWVGPIKISGSEGQ

SEQ ID NO: 778600 - protein, 18 aa, Mycobacterium
SVIDPGYRYEFIEADDDS

SEQ ID NO: 778601 - protein, 17 aa, Mycobacterium
SVIIQFVVKTVVGLLDW

SEQ ID NO: 778602 - protein, 18 aa, Mycobacterium
SVISELTHALWVGPASAS

SEQ ID NO: 778603 - protein, 19 aa, Mycobacterium
SVKDLRTWHGTVLAAIEFS

SEQ ID NO: 778604 - protein, 24 aa, Mycobacterium
SVLELRPDYGVGIVTGLVRVEGAA

SEQ ID NO: 778605 - protein, 17 aa, Mycobacterium
SVLELRSDYGVGIVTAL

SEQ ID NO: 778606 - protein, 20 aa, Mycobacterium
SVLKTTWSAEGWVTVAGLVA

SEQ ID NO: 778607 - protein, 25 aa, Mycobacterium
SVLLRSSGGWPWLAPGDDPGALLTL

SEQ ID NO: 778608 - protein, 19 aa, Mycobacterium
SVLPYRFGTHSGWLEACYD

SEQ ID NO: 778609 - protein, 17 aa, Mycobacterium
SVLQLRADYGVGIVTAL

SEQ ID NO: 778610 - protein, 19 aa, Mycobacterium
SVLQTTWSAYGWVEVAGRV

SEQ ID NO: 778611 - protein, 18 aa, Mycobacterium
SVMMRLAPVLGRQAAHDQ

SEQ ID NO: 778612 - protein, 18 aa, Mycobacterium
SVNERAVSVSAWGISPGR

SEQ ID NO: 778613 - protein, 20 aa, Mycobacterium
SVNMFAPWIRRIFIATDSAP

SEQ ID NO: 778614 - protein, 20 aa, Mycobacterium
SVNMFAPWIRRIFIATDSTP

SEQ ID NO: 778615 - protein, 19 aa, Mycobacterium
SVPELPLFRRVTTRIARAF

SEQ ID NO: 778616 - protein, 18 aa, Mycobacterium
SVPPFTWWRGIRARQLLE

SEQ ID NO: 778617 - protein, 25 aa, Mycobacterium
SVPPGRLGWNWARFAFNGWKALSWM

SEQ ID NO: 778618 - protein, 18 aa, Mycobacterium
SVPQRLWAKPAITVIGID

SEQ ID NO: 778619 - protein, 23 aa, Mycobacterium
SVPRWLPERLCWLLSDEYHANEG

SEQ ID NO: 778620 - protein, 23 aa, Mycobacterium
SVPRWLPERVCWLLSDEYHSNEG

SEQ ID NO: 778621 - protein, 17 aa, Mycobacterium
SVPTFRPGAQFKAVVSG

SEQ ID NO: 778622 - protein, 19 aa, Mycobacterium
SVPVSGVWVEIPFTLPPNT

SEQ ID NO: 778623 - protein, 20 aa, Mycobacterium
SVQMSWDFLARSTAGLWEWA

SEQ ID NO: 778624 - protein, 17 aa, Mycobacterium
SVQRLEALPGWPTGPLS

SEQ ID NO: 778625 - protein, 17 aa, Mycobacterium
SVRALSVPPTWGVSPTI

SEQ ID NO: 778626 - protein, 20 aa, Mycobacterium
SVRHPLRWHHLALVMWYPDQ

SEQ ID NO: 778627 - protein, 20 aa, Mycobacterium
SVRYRIPMILAIIGGNPMRF

SEQ ID NO: 778628 - protein, 17 aa, Mycobacterium
SVSCPRSGETIVRDGAH

SEQ ID NO: 778629 - protein, 21 aa, Mycobacterium
SVSPASLWPTVPMLLEAAVAD

SEQ ID NO: 778630 - protein, 17 aa, Mycobacterium
SVTAGLASGAWQGPASA

SEQ ID NO: 778631 - protein, 25 aa, Mycobacterium
SVTLSVPLSDIWIDIRFTLPAATVD

SEQ ID NO: 778632 - protein, 19 aa, Mycobacterium
SVTMPGKFAALQFADQRTD

SEQ ID NO: 778633 - protein, 17 aa, Mycobacterium
SVTSGLVGQAWQGPASA

SEQ ID NO: 778634 - protein, 22 aa, Mycobacterium
SVVLHRFLRWRLPDYHPDRHLG

SEQ ID NO: 778635 - protein, 19 aa, Mycobacterium
SVVLRNGRRAFRMPRPAFG

SEQ ID NO: 778636 - protein, 21 aa, Mycobacterium
SVVLSEGWDIMDFVEQLQKLA

SEQ ID NO: 778637 - protein, 24 aa, Mycobacterium
SVVPHTWLRAVPQLGAARAVRLIE

SEQ ID NO: 778638 - protein, 18 aa, Mycobacterium
SVVSGLRMRPGNWAGAYA

SEQ ID NO: 778639 - protein, 17 aa, Mycobacterium
SVWEIWGALSGGGRLVV

SEQ ID NO: 778640 - protein, 18 aa, Mycobacterium
SWAKPAFEIAQTFTETGG

SEQ ID NO: 778641 - protein, 17 aa, Mycobacterium
SWARLAVAARPELTLGR

SEQ ID NO: 778642 - protein, 18 aa, Mycobacterium
SWARLAVAARPGLTLGRA

SEQ ID NO: 778643 - protein, 18 aa, Mycobacterium
SWCALRFGETVELRRSDI

SEQ ID NO: 778644 - protein, 19 aa, Mycobacterium
SWCGYCHRLMSVLKSNGIP

SEQ ID NO: 778645 - protein, 22 aa, Mycobacterium
SWCGYCLRLKTALKAEGIAYDE

SEQ ID NO: 778646 - protein, 21 aa, Mycobacterium
SWDPACIPLRYLVTEDGAEAD

SEQ ID NO: 778647 - protein, 17 aa, Mycobacterium
SWIPLLALAAHDPVRDW

SEQ ID NO: 778648 - protein, 21 aa, Mycobacterium
SWKAIEATGRFCVNVLTEKQK

SEQ ID NO: 778649 - protein, 20 aa, Mycobacterium
SWLPLCHDMGMVGFICIPMK

SEQ ID NO: 778650 - protein, 17 aa, Mycobacterium
SWLPLYHDMGLSMIGFP

SEQ ID NO: 778651 - protein, 18 aa, Mycobacterium
SWQPELWCALVAVVGADP

SEQ ID NO: 778652 - protein, 19 aa, Mycobacterium
SWQRLVPWPDVPAGLAALR

SEQ ID NO: 778653 - protein, 21 aa, Mycobacterium
SWRGLDPWLRHTFEDARHQLP

SEQ ID NO: 778654 - protein, 18 aa, Mycobacterium
SWRRPELDCVHPLDDGSA

SEQ ID NO: 778655 - protein, 19 aa, Mycobacterium
SWRSRELLTRIGSVFQNPE

SEQ ID NO: 778656 - protein, 17 aa, Mycobacterium
SWSRAAVRWAMAEATLR

SEQ ID NO: 778657 - protein, 19 aa, Mycobacterium
SWTEPKGGYFISLDVLPGT

SEQ ID NO: 778658 - protein, 21 aa, Mycobacterium
SWTEPKGGYFISLDVLPGTAR

SEQ ID NO: 778659 - protein, 22 aa, Mycobacterium
SWTEPKGGYFISLDVMPGTARR

SEQ ID NO: 778660 - protein, 20 aa, Mycobacterium
SWYINRVHRLLARVLTLSVP

SEQ ID NO: 778661 - protein, 21 aa, Mycobacterium
SYAKLRGGSGIQWPCNTEHPD

SEQ ID NO: 778662 - protein, 24 aa, Mycobacterium
SYAPKLPWPWGLVDFAARVLKPAP

SEQ ID NO: 778663 - protein, 18 aa, Mycobacterium
SYEPAFAIDVEWTLLASM

SEQ ID NO: 778664 - protein, 21 aa, Mycobacterium
SYEPRSGRVWARLPRANSTDI

SEQ ID NO: 778665 - protein, 21 aa, Mycobacterium
SYGSRCVRPPILYGDVARPEP

SEQ ID NO: 778666 - protein, 21 aa, Mycobacterium
SYGSRCVRPPILYGDVARRKP

SEQ ID NO: 778667 - protein, 20 aa, Mycobacterium
SYGSRCVRPPILYGDVARSH

SEQ ID NO: 778668 - protein, 21 aa, Mycobacterium
SYGSRCVRPPILYGDVIRQHP

SEQ ID NO: 778669 - protein, 21 aa, Mycobacterium
SYGSRCVRPPILYGDVVRTHP

SEQ ID NO: 778670 - protein, 21 aa, Mycobacterium
SYGVAAIDFVLAGDGGAGGAA

SEQ ID NO: 778671 - protein, 22 aa, Mycobacterium
SYKSCFLALVRRFYELGVKDLN

SEQ ID NO: 778672 - protein, 23 aa, Mycobacterium
SYKSCFLAMMRRFYDQGLTEING

SEQ ID NO: 778673 - protein, 24 aa, Mycobacterium
SYKSCYLAMMRRFYDKGVTELNGH

SEQ ID NO: 778674 - protein, 17 aa, Mycobacterium
SYLGLEFHRALIDGMTD

SEQ ID NO: 778675 - protein, 17 aa, Mycobacterium
SYLRAAVRREWPLLVQA

SEQ ID NO: 778676 - protein, 17 aa, Mycobacterium
SYPELVADFGRIRRIAV

SEQ ID NO: 778677 - protein, 21 aa, Mycobacterium
SYRCAAAAWASRTIKHTAAPK

SEQ ID NO: 778678 - protein, 23 aa, Mycobacterium
SYSIKVSPFPAHAVVDIPVHIPF

SEQ ID NO: 778679 - protein, 24 aa, Mycobacterium
SYSRYYCRLDRPMAEVAAGPRDIV

SEQ ID NO: 778680 - protein, 17 aa, Mycobacterium
SYTDFLGGFGIEGLELR

SEQ ID NO: 778681 - protein, 17 aa, Mycobacterium
SYTRPPSWRGLDVPEIL

SEQ ID NO: 778682 - protein, 17 aa, Mycobacterium
SYVPGRWVYKSLSVNYR

SEQ ID NO: 778683 - protein, 24 aa, Mycobacterium
SYVQRLAAILGRQVWEDAGAPEDI

SEQ ID NO: 778684 - protein, 17 aa, Mycobacterium
SYWRDWAQTLTLPERKP

SEQ ID NO: 778685 - protein, 23 aa, Mycobacterium
SYYAEFEGVLAFLQRRMEQTESE

SEQ ID NO: 778686 - protein, 19 aa, Mycobacterium
SYYDDMAWLALALERAARI

SEQ ID NO: 778687 - protein, 20 aa, Mycobacterium
SYYDDMAWLALALERAQRLT

SEQ ID NO: 778688 - protein, 24 aa, Mycobacterium
TAAALRASAAWMRTMFAILPLSVG

SEQ ID NO: 778689 - protein, 18 aa, Mycobacterium
TAAAPVRLLTAALRDAGL

SEQ ID NO: 778690 - protein, 19 aa, Mycobacterium
TAAELSSWQRSWALACQKA

SEQ ID NO: 778691 - protein, 20 aa, Mycobacterium
TAAFATEFADALSIADLVFV

SEQ ID NO: 778692 - protein, 17 aa, Mycobacterium
TAAGIRKTWVFQAFDDE

SEQ ID NO: 778693 - protein, 23 aa, Mycobacterium
TAAGVALEWLRYRAGLASTPLIP

SEQ ID NO: 778694 - protein, 17 aa, Mycobacterium
TAALWLKEHDRLHDAVK

SEQ ID NO: 778695 - protein, 20 aa, Mycobacterium
TAAMSAMWAGWVEVDRLAVL

SEQ ID NO: 778696 - protein, 17 aa, Mycobacterium
TAANFWVGLAILHSLFM

SEQ ID NO: 778697 - protein, 24 aa, Mycobacterium
TAAPGWPTRPGWPNTLAGDGRTEI

SEQ ID NO: 778698 - protein, 21 aa, Mycobacterium
TAAQRFGLWFSKPGNGVSHPT

SEQ ID NO: 778699 - protein, 17 aa, Mycobacterium
TAAQVALAWLLAKGPDI

SEQ ID NO: 778700 - protein, 19 aa, Mycobacterium
TAATRLQVWLTRSSADTFT

SEQ ID NO: 778701 - protein, 21 aa, Mycobacterium
TACIKAMIEKVVERMYAEIDD

SEQ ID NO: 778702 - protein, 18 aa, Mycobacterium
TACLVGFPRRDLSAEETE

SEQ ID NO: 778703 - protein, 18 aa, Mycobacterium
TADAGGLGGNIGVAATAI

SEQ ID NO: 778704 - protein, 23 aa, Mycobacterium
TADLYPRYVCDYGTPAHASSAAD

SEQ ID NO: 778705 - protein, 24 aa, Mycobacterium
TADPEWMAAFALHLERCGFESVVV

SEQ ID NO: 778706 - protein, 25 aa, Mycobacterium
TADPRLIGFLLRFARNSTASRWQKA

SEQ ID NO: 778707 - protein, 21 aa, Mycobacterium
TADYRGALQIATRQEVLERAG

SEQ ID NO: 778708 - protein, 17 aa, Mycobacterium
TAEAWPPSMTPHRELAL

SEQ ID NO: 778709 - protein, 24 aa, Mycobacterium
TAEEFSWRASELFDAISSGVITIE

SEQ ID NO: 778710 - protein, 17 aa, Mycobacterium
TAEELGRALPGVPVVTS

SEQ ID NO: 778711 - protein, 24 aa, Mycobacterium
TAEGFPEWIPRTLAPGSRLSGVAP

SEQ ID NO: 778712 - protein, 19 aa, Mycobacterium
TAEGWILARLDTRRPARFF

SEQ ID NO: 778713 - protein, 17 aa, Mycobacterium
TAEIAAWLISRFAQELG

SEQ ID NO: 778714 - protein, 20 aa, Mycobacterium
TAEIKRVWIAPHVRGLGLGK

SEQ ID NO: 778715 - protein, 22 aa, Mycobacterium
TAELPVDCLLVFGQEGPGVTDA

SEQ ID NO: 778716 - protein, 18 aa, Mycobacterium
TAELRFPAGHSGRIQCSM

SEQ ID NO: 778717 - protein, 25 aa, Mycobacterium
TAEQALGLPYVWGGGGAAGPSGGGF

SEQ ID NO: 778718 - protein, 21 aa, Mycobacterium
TAETFKNGWLRTGDVAREDED

SEQ ID NO: 778719 - protein, 18 aa, Mycobacterium
TAFAWALVLGRLTDRTDV

SEQ ID NO: 778720 - protein, 17 aa, Mycobacterium
TAFDIGEWGLGFMTTSL

SEQ ID NO: 778721 - protein, 18 aa, Mycobacterium
TAFFDEFFLGAADAGVRQ

SEQ ID NO: 778722 - protein, 18 aa, Mycobacterium
TAFFDEFFLGAADSGVRQ

SEQ ID NO: 778723 - protein, 17 aa, Mycobacterium
TAFNFPVAVWSWNTAIA

SEQ ID NO: 778724 - protein, 20 aa, Mycobacterium
TAFNQWWLRLEHIAREAGLK

SEQ ID NO: 778725 - protein, 21 aa, Mycobacterium
TAGKPSLGWRGRRAAERLSER

SEQ ID NO: 778726 - protein, 17 aa, Mycobacterium
TAGLGIRGGAVVSGSFQ

SEQ ID NO: 778727 - protein, 24 aa, Mycobacterium
TAGPARPLATVGIAGRQRVTAGTT

SEQ ID NO: 778728 - protein, 23 aa, Mycobacterium
TAGRLGGFLTLRWTYCDPPSELP

SEQ ID NO: 778729 - protein, 22 aa, Mycobacterium
TAGTDRYGGYGGDGGGGGGGGY

SEQ ID NO: 778730 - protein, 24 aa, Mycobacterium
TAHFCSMCGPKFCSMRISRDVRDA

SEQ ID NO: 778731 - protein, 24 aa, Mycobacterium
TAHFCSMCGPKFCSMRITADIREF

SEQ ID NO: 778732 - protein, 24 aa, Mycobacterium
TAHFCSMCGPKFCSMRITADLKDS

SEQ ID NO: 778733 - protein, 24 aa, Mycobacterium
TAHFCSMCGPKFCSMRITQDVRDF

SEQ ID NO: 778734 - protein, 24 aa, Mycobacterium
TAHFCSMCGPKFCSMRITQDVRDY

SEQ ID NO: 778735 - protein, 22 aa, Mycobacterium
TAHRLLAMLAYRGFVRQDPVSK

SEQ ID NO: 778736 - protein, 21 aa, Mycobacterium
TAIAPAAFRWLGRRDAPNRLM

SEQ ID NO: 778737 - protein, 19 aa, Mycobacterium
TAIEFAVRRLKGAFGVVVT

SEQ ID NO: 778738 - protein, 19 aa, Mycobacterium
TAIRLGAVAPELVKELVLI

SEQ ID NO: 778739 - protein, 18 aa, Mycobacterium
TAITGRWTTGSARTATEV

SEQ ID NO: 778740 - protein, 23 aa, Mycobacterium
TAKGLEFPLVFVTGWEDGMFPHM

SEQ ID NO: 778741 - protein, 23 aa, Mycobacterium
TAKRLAAGYGHWVYSIRAGGGAV

SEQ ID NO: 778742 - protein, 17 aa, Mycobacterium
TALAEFRIEGVRTNIDF

SEQ ID NO: 778743 - protein, 24 aa, Mycobacterium
TALARRLEAGMVWVNNWHIIHPAY

SEQ ID NO: 778744 - protein, 17 aa, Mycobacterium
TALATAYARACHQFADS

SEQ ID NO: 778745 - protein, 17 aa, Mycobacterium
TALLAWREMFSGFDTPT

SEQ ID NO: 778746 - protein, 17 aa, Mycobacterium
TALLPLKPLLSVSGLDS

SEQ ID NO: 778747 - protein, 18 aa, Mycobacterium
TALPANRPLAVLIVSDRG

SEQ ID NO: 778748 - protein, 24 aa, Mycobacterium
TALPEVRSQLALTWGTETFIVPQM

SEQ ID NO: 778749 - protein, 23 aa, Mycobacterium
TALRAAAVLACYRYHADAHGLVG

SEQ ID NO: 778750 - protein, 17 aa, Mycobacterium
TALVAAICRQLRDELSL

SEQ ID NO: 778751 - protein, 18 aa, Mycobacterium
TALVAALCRTLRDEISVA

SEQ ID NO: 778752 - protein, 17 aa, Mycobacterium
TALWLPGQVHVFIHGEA

SEQ ID NO: 778753 - protein, 22 aa, Mycobacterium
TALYPGRFVLGLGVSHGPLVER

SEQ ID NO: 778754 - protein, 17 aa, Mycobacterium
TAMAAGVVRRWLRDRGE

SEQ ID NO: 778755 - protein, 23 aa, Mycobacterium
TAMFEWWFRWRCDTQKYIWWHPI

SEQ ID NO: 778756 - protein, 23 aa, Mycobacterium
TANLLFIRFEFRTGDASGHNMAT

SEQ ID NO: 778757 - protein, 17 aa, Mycobacterium
TAPAEWLVRGGVMLPVY

SEQ ID NO: 778758 - protein, 24 aa, Mycobacterium
TAPARAAYLAGIWGAVASLSPELF

SEQ ID NO: 778759 - protein, 23 aa, Mycobacterium
TAPELDALIGFFINIVVLRNDLS

SEQ ID NO: 778760 - protein, 17 aa, Mycobacterium
TAPKLGAGLDWKTSLQE

SEQ ID NO: 778761 - protein, 18 aa, Mycobacterium
TAPPFAVHRLWLDRPVSA

SEQ ID NO: 778762 - protein, 20 aa, Mycobacterium
TAPYNDIVSWKWTDVPHALG

SEQ ID NO: 778763 - protein, 18 aa, Mycobacterium
TAQAYRAVAEFVPRIGTL

SEQ ID NO: 778764 - protein, 18 aa, Mycobacterium
TAQLPLSLAIVFEPEDPE

SEQ ID NO: 778765 - protein, 18 aa, Mycobacterium
TARAWAWLSGRGYVTPDD

SEQ ID NO: 778766 - protein, 18 aa, Mycobacterium
TARCRRWPRASGVCDDVL

SEQ ID NO: 778767 - protein, 22 aa, Mycobacterium
TARLALPGGLTWVARHVAESYD

SEQ ID NO: 778768 - protein, 23 aa, Mycobacterium
TARQVRLPRRWSIATGLPSGAEK

SEQ ID NO: 778769 - protein, 18 aa, Mycobacterium
TARRAVAYAARFLTADRA

SEQ ID NO: 778770 - protein, 17 aa, Mycobacterium
TARSWAWLSGRNYVTPD

SEQ ID NO: 778771 - protein, 18 aa, Mycobacterium
TARSWAWLSGRNYVTPDD

SEQ ID NO: 778772 - protein, 21 aa, Mycobacterium
TARVVAILDFLARHPHDRFGL

SEQ ID NO: 778773 - protein, 17 aa, Mycobacterium
TASAGQRLAIWARDRGC

SEQ ID NO: 778774 - protein, 27 aa, Mycobacterium
TASQVLLRWNLQLGNAVVFRSAKEEHI

SEQ ID NO: 778775 - protein, 23 aa, Mycobacterium
TATCPEWIYFWLGAARIGAVSAA

SEQ ID NO: 778776 - protein, 22 aa, Mycobacterium
TATCPEWVYFWLGAARIGAVSA

SEQ ID NO: 778777 - protein, 19 aa, Mycobacterium
TATEKASVLSFVLAGHEPL

SEQ ID NO: 778778 - protein, 19 aa, Mycobacterium
TATELARIDAALNTANAAA

SEQ ID NO: 778779 - protein, 18 aa, Mycobacterium
TATHLFLFAGYVEQFRGW

SEQ ID NO: 778780 - protein, 17 aa, Mycobacterium
TATVTWFLPYFQEVVSG

SEQ ID NO: 778781 - protein, 17 aa, Mycobacterium
TATWPRRQQPAYVGEFH

SEQ ID NO: 778782 - protein, 20 aa, Mycobacterium
TAVALACGWAAPSAFIDTYR

SEQ ID NO: 778783 - protein, 17 aa, Mycobacterium
TAVASLFADHAQDYRTI

SEQ ID NO: 778784 - protein, 18 aa, Mycobacterium
TAVASLFSGHGQAYQRLA

SEQ ID NO: 778785 - protein, 25 aa, Mycobacterium
TAVGELWKAISPHLSPISNIVSMLN

SEQ ID NO: 778786 - protein, 26 aa, Mycobacterium
TAVGKPGWPGFVSVPLAAYRRHFETS

SEQ ID NO: 778787 - protein, 19 aa, Mycobacterium
TAVLPRLTPATGLGAAAVA

SEQ ID NO: 778788 - protein, 17 aa, Mycobacterium
TAVMMGVYFNEYQSMLA

SEQ ID NO: 778789 - protein, 25 aa, Mycobacterium
TAVTRCWMSLFSPRVITYRASRGFL

SEQ ID NO: 778790 - protein, 20 aa, Mycobacterium
TAWASAWTFLYINGIELVAG

SEQ ID NO: 778791 - protein, 18 aa, Mycobacterium
TAWLAEGVLIGFLPPEAE

SEQ ID NO: 778792 - protein, 17 aa, Mycobacterium
TAWPGCPPRLLRVAGGH

SEQ ID NO: 778793 - protein, 22 aa, Mycobacterium
TAWPPWRPGVLFAGDSLGAGKP

SEQ ID NO: 778794 - protein, 21 aa, Mycobacterium
TAWPPWRPGVLFTGDSLGAGK

SEQ ID NO: 778795 - protein, 17 aa, Mycobacterium
TAWRLTGLGLRVIAHDP

SEQ ID NO: 778796 - protein, 18 aa, Mycobacterium
TAWWRLVRRLTLGERARD

SEQ ID NO: 778797 - protein, 17 aa, Mycobacterium
TAYAANAAEGWAMATAS

SEQ ID NO: 778798 - protein, 17 aa, Mycobacterium
TAYAWKSVLERGSSSGP

SEQ ID NO: 778799 - protein, 24 aa, Mycobacterium
TAYLGHVIVLWSWALKQPNPDTAE

SEQ ID NO: 778800 - protein, 18 aa, Mycobacterium
TCHYCTFVTVPGKLRAHG

SEQ ID NO: 778801 - protein, 17 aa, Mycobacterium
TCRELGEAVALQYFHAA

SEQ ID NO: 778802 - protein, 17 aa, Mycobacterium
TCSDEGRLAEVILPPAG

SEQ ID NO: 778803 - protein, 22 aa, Mycobacterium
TCSEFFRYYAGWCSKLNGVAYD

SEQ ID NO: 778804 - protein, 17 aa, Mycobacterium
TDACDWIILGAMVGDAK

SEQ ID NO: 778805 - protein, 23 aa, Mycobacterium
TDDLRFLVHWSAEVFSDFDELKK

SEQ ID NO: 778806 - protein, 18 aa, Mycobacterium
TDELRFLVHWSAEVFSDF

SEQ ID NO: 778807 - protein, 18 aa, Mycobacterium
TDELRFLVHWSAEVFTDF

SEQ ID NO: 778808 - protein, 19 aa, Mycobacterium
TDEMIRWVTPVKEFMRTAS

SEQ ID NO: 778809 - protein, 25 aa, Mycobacterium
TDEVSEAIASLFSGHALDYQNLGAR

SEQ ID NO: 778810 - protein, 17 aa, Mycobacterium
TDFARIGSAINAAAQAA

SEQ ID NO: 778811 - protein, 18 aa, Mycobacterium
TDFRSWARVDLDLEPGRT

SEQ ID NO: 778812 - protein, 17 aa, Mycobacterium
TDFRSWSRVELELSPGR

SEQ ID NO: 778813 - protein, 23 aa, Mycobacterium
TDGRSGAIPAIIAEYLGLPQLTH

SEQ ID NO: 778814 - protein, 18 aa, Mycobacterium
TDGRWDPGKDFAMVTARE

SEQ ID NO: 778815 - protein, 24 aa, Mycobacterium
TDGVPRSGAPFGFAVTTEPHDWAW

SEQ ID NO: 778816 - protein, 17 aa, Mycobacterium
TDHLMKFPGKFSEQLLA

SEQ ID NO: 778817 - protein, 20 aa, Mycobacterium
TDHLMRFPGKFSEQLLADHL

SEQ ID NO: 778818 - protein, 24 aa, Mycobacterium
TDHRPEILLSFGFVPKMESEVGLI

SEQ ID NO: 778819 - protein, 24 aa, Mycobacterium
TDHRPEILLSFGFVPKVEARVGLI

SEQ ID NO: 778820 - protein, 24 aa, Mycobacterium
TDHRPEILLSFGFVPKVESRVGLI

SEQ ID NO: 778821 - protein, 24 aa, Mycobacterium
TDHRPELLLSFGFIPKVESRVGLI

SEQ ID NO: 778822 - protein, 21 aa, Mycobacterium
TDIPCSFVLTMLRDPALPLLE

SEQ ID NO: 778823 - protein, 17 aa, Mycobacterium
TDIPNLLAMVISGLQGT

SEQ ID NO: 778824 - protein, 17 aa, Mycobacterium
TDIRFGLGAVRNVGANV

SEQ ID NO: 778825 - protein, 19 aa, Mycobacterium
TDLAWSRITYWRALLTSAV

SEQ ID NO: 778826 - protein, 20 aa, Mycobacterium
TDLAWSRITYWRALLTSAVD

SEQ ID NO: 778827 - protein, 19 aa, Mycobacterium
TDLELYLFFSLLFSAGAET

SEQ ID NO: 778828 - protein, 24 aa, Mycobacterium
TDLFCAPDRCPLIVGNTLVFRDDN

SEQ ID NO: 778829 - protein, 21 aa, Mycobacterium
TDLFPLRGAIIGANRVAELTE

SEQ ID NO: 778830 - protein, 23 aa, Mycobacterium
TDLGIRFMPTVGWAERGDLRAEG

SEQ ID NO: 778831 - protein, 24 aa, Mycobacterium
TDLIRFGSLFLRDGTSLTGQQVVP

SEQ ID NO: 778832 - protein, 19 aa, Mycobacterium
TDLLERFRDLILLQAVPDA

SEQ ID NO: 778833 - protein, 19 aa, Mycobacterium
TDLQCWRAPWKTLVDLGWT

SEQ ID NO: 778834 - protein, 17 aa, Mycobacterium
TDMAHFFYIHFGLPTYF

SEQ ID NO: 778835 - protein, 17 aa, Mycobacterium
TDPQWRALAAIDWDPSF

SEQ ID NO: 778836 - protein, 21 aa, Mycobacterium
TDQLRFLVHWSAEVFTDHDEL

SEQ ID NO: 778837 - protein, 23 aa, Mycobacterium
TDRCRRWPHAGGICDNVLRAVDP

SEQ ID NO: 778838 - protein, 17 aa, Mycobacterium
TDRGWDLAGIYNPDPDV

SEQ ID NO: 778839 - protein, 23 aa, Mycobacterium
TDRLPFLAPIDWESFEPLLRGGF

SEQ ID NO: 778840 - protein, 22 aa, Mycobacterium
TDRLPFLAPIDWESFEPLLRGR

SEQ ID NO: 778841 - protein, 23 aa, Mycobacterium
TDRLPFVAPMNWEAFEPSLRGAI

SEQ ID NO: 778842 - protein, 18 aa, Mycobacterium
TDRWTDWHWYTTVVHTNC

SEQ ID NO: 778843 - protein, 26 aa, Mycobacterium
TDSGSFRWATPRGHRLAARLLDLGAD

SEQ ID NO: 778844 - protein, 17 aa, Mycobacterium
TDTFKWDPSSSYVRKPP

SEQ ID NO: 778845 - protein, 23 aa, Mycobacterium
TDTIPNWFFRPLWHRRDRLRPSV

SEQ ID NO: 778846 - protein, 24 aa, Mycobacterium
TDVDRRLSLLIGWTGDHLAETEVN

SEQ ID NO: 778847 - protein, 17 aa, Mycobacterium
TDVGIGIVRTMMRHAPK

SEQ ID NO: 778848 - protein, 19 aa, Mycobacterium
TDVKWWFGHTLTWARHALR

SEQ ID NO: 778849 - protein, 27 aa, Mycobacterium
TDVLPRRPRFALLKGRGNYLCLNKVHN

SEQ ID NO: 778850 - protein, 23 aa, Mycobacterium
TDVMAIGAIAAWRELGLSVPDDV

SEQ ID NO: 778851 - protein, 23 aa, Mycobacterium
TDVPQWLAGRGWTVRAIPAEVEM

SEQ ID NO: 778852 - protein, 18 aa, Mycobacterium
TDVVIRWNGTINEILGDG

SEQ ID NO: 778853 - protein, 21 aa, Mycobacterium
TDWKIELCDTIADNASSAGFV

SEQ ID NO: 778854 - protein, 22 aa, Mycobacterium
TDWNQFGGYGWGFADLLPYFMR

SEQ ID NO: 778855 - protein, 23 aa, Mycobacterium
TDWQDFLAFRGRELCPGGRLVVL

SEQ ID NO: 778856 - protein, 19 aa, Mycobacterium
TDWRWNRILIEGSNCRDII

SEQ ID NO: 778857 - protein, 22 aa, Mycobacterium
TDYRRLDIAGARTVHGAGREFL

SEQ ID NO: 778858 - protein, 24 aa, Mycobacterium
TEAHGWPDVFALVARYLVEARRRR

SEQ ID NO: 778859 - protein, 18 aa, Mycobacterium
TEAIKLVALVADRGAQVR

SEQ ID NO: 778860 - protein, 20 aa, Mycobacterium
TEALKWLLANAGRLRNERIT

SEQ ID NO: 778861 - protein, 17 aa, Mycobacterium
TEALSWRHGVFLASTLS

SEQ ID NO: 778862 - protein, 17 aa, Mycobacterium
TEARMAIAMARAGGMGV

SEQ ID NO: 778863 - protein, 19 aa, Mycobacterium
TEAVLWLVGPRARYVTGVS

SEQ ID NO: 778864 - protein, 22 aa, Mycobacterium
TEAYLRYFLRGVLESGAVDEPT

SEQ ID NO: 778865 - protein, 19 aa, Mycobacterium
TECADRFDVVQAFTDEALT

SEQ ID NO: 778866 - protein, 21 aa, Mycobacterium
TECDNRFDAVQAFSDDALTTC

SEQ ID NO: 778867 - protein, 18 aa, Mycobacterium
TECPAGTVGEIWVQGDNV

SEQ ID NO: 778868 - protein, 21 aa, Mycobacterium
TECSNKFDVVQAFTDDSLTEC

SEQ ID NO: 778869 - protein, 22 aa, Mycobacterium
TEDARSALAFVRRLRRADTVAT

SEQ ID NO: 778870 - protein, 17 aa, Mycobacterium
TEDEWRAAWPREIAESA

SEQ ID NO: 778871 - protein, 17 aa, Mycobacterium
TEDMSWTFWSWNPNSRD

SEQ ID NO: 778872 - protein, 20 aa, Mycobacterium
TEEIIRWSAPVKEFMRTATR

SEQ ID NO: 778873 - protein, 20 aa, Mycobacterium
TEELRFGYRTSVLKHSDAVI

SEQ ID NO: 778874 - protein, 19 aa, Mycobacterium
TEEMIRWVTPVKEFMRTAA

SEQ ID NO: 778875 - protein, 19 aa, Mycobacterium
TEEMIRWVTPVKHFMRTAA

SEQ ID NO: 778876 - protein, 21 aa, Mycobacterium
TEFLRLTLRTTLELGVDPASL

SEQ ID NO: 778877 - protein, 19 aa, Mycobacterium
TEFNVALPWTKMVVLNPGV

SEQ ID NO: 778878 - protein, 20 aa, Mycobacterium
TEGCVREMLVLAAALSIPDP

SEQ ID NO: 778879 - protein, 20 aa, Mycobacterium
TEGFPNLFLIAGPNSPSVLS

SEQ ID NO: 778880 - protein, 25 aa, Mycobacterium
TEGGVRLSGRWSWATGVMHANWIMV

SEQ ID NO: 778881 - protein, 21 aa, Mycobacterium
TEGKPSLGWRGRRAARKVSET

SEQ ID NO: 778882 - protein, 19 aa, Mycobacterium
TEGPANPLILVFGRVSELS

SEQ ID NO: 778883 - protein, 23 aa, Mycobacterium
TEGRTAWEWLVHLYEKWAAGLDF

SEQ ID NO: 778884 - protein, 25 aa, Mycobacterium
TEHLPLLAPLRFIPYVGDPLAELLE

SEQ ID NO: 778885 - protein, 24 aa, Mycobacterium
TEHRPEILLSFGFVPKMEAKVGLI

SEQ ID NO: 778886 - protein, 17 aa, Mycobacterium
TEIIPLDGFDELDELEL

SEQ ID NO: 778887 - protein, 20 aa, Mycobacterium
TEIRYPLNLIHLATVMWFDG

SEQ ID NO: 778888 - protein, 20 aa, Mycobacterium
TEIVEAYLPLGWQMACHVQG

SEQ ID NO: 778889 - protein, 21 aa, Mycobacterium
TELFPRMPIPQTWYDAGIAHR

SEQ ID NO: 778890 - protein, 23 aa, Mycobacterium
TELFSWPGVHYLSGFYGPLERAL

SEQ ID NO: 778891 - protein, 17 aa, Mycobacterium
TELKYRYARTLDNKLWD

SEQ ID NO: 778892 - protein, 21 aa, Mycobacterium
TELLAALGLHRVWERADAVMA

SEQ ID NO: 778893 - protein, 18 aa, Mycobacterium
TELLRPGWLEIASDRVVA

SEQ ID NO: 778894 - protein, 21 aa, Mycobacterium
TELLVRFFGRRNMLLLLDNCE

SEQ ID NO: 778895 - protein, 17 aa, Mycobacterium
TELMRWVHPGLVASTQG

SEQ ID NO: 778896 - protein, 17 aa, Mycobacterium
TELPFVWGNLGSGRKDP

SEQ ID NO: 778897 - protein, 19 aa, Mycobacterium
TELPWAQRLSQVWRMRDPA

SEQ ID NO: 778898 - protein, 17 aa, Mycobacterium
TELPYVWGNLGAPKDPT

SEQ ID NO: 778899 - protein, 18 aa, Mycobacterium
TELPYVWGTLGAPKDPTL

SEQ ID NO: 778900 - protein, 21 aa, Mycobacterium
TELTWGVGVDKAFEAIATPET

SEQ ID NO: 778901 - protein, 18 aa, Mycobacterium
TELVCTQIAIALGHNNSS

SEQ ID NO: 778902 - protein, 17 aa, Mycobacterium
TEMCFYEAELLRLRAHT

SEQ ID NO: 778903 - protein, 18 aa, Mycobacterium
TEMKAIAVGPDLSRTIAR

SEQ ID NO: 778904 - protein, 23 aa, Mycobacterium
TENPAGSVLIEFGRTKVLCTASV

SEQ ID NO: 778905 - protein, 22 aa, Mycobacterium
TENPAGSVLIEFGRTKVMCTAS

SEQ ID NO: 778906 - protein, 18 aa, Mycobacterium
TENYGGAVGLNWYSTDPT

SEQ ID NO: 778907 - protein, 22 aa, Mycobacterium
TEPAELLAVFLLDAGDGPRTTD

SEQ ID NO: 778908 - protein, 20 aa, Mycobacterium
TEPEAFKWIQRAAMDRRTTM

SEQ ID NO: 778909 - protein, 21 aa, Mycobacterium
TEPEAFKWIQRAAMDRRTTMK

SEQ ID NO: 778910 - protein, 23 aa, Mycobacterium
TEPELDQLIGFFINILVLRNNLD

SEQ ID NO: 778911 - protein, 21 aa, Mycobacterium
TEPKLKCYLEIRCAPSDDLDS

SEQ ID NO: 778912 - protein, 27 aa, Mycobacterium
TEPLSDWKLWASWRLICARAPYLTDPL

SEQ ID NO: 778913 - protein, 21 aa, Mycobacterium
TEPMPSMPVFFWNDDDGSRYR

SEQ ID NO: 778914 - protein, 18 aa, Mycobacterium
TEPTVLPAQWPVLLCNGA

SEQ ID NO: 778915 - protein, 22 aa, Mycobacterium
TEPWRGEPLLSYLRKMVFWAAV

SEQ ID NO: 778916 - protein, 22 aa, Mycobacterium
TEPWYVVTFGGGATPTPTSLGA

SEQ ID NO: 778917 - protein, 24 aa, Mycobacterium
TERAARSTVRFSLGPEVTPDDIDR

SEQ ID NO: 778918 - protein, 19 aa, Mycobacterium
TERHLKKLWGLPGTQLGVV

SEQ ID NO: 778919 - protein, 18 aa, Mycobacterium
TERLKIKPSNSFIRAMVR

SEQ ID NO: 778920 - protein, 22 aa, Mycobacterium
TERWLRERLAVLRPGEHVLGEE

SEQ ID NO: 778921 - protein, 21 aa, Mycobacterium
TERWWLDRMVSVIANSAGIRA

SEQ ID NO: 778922 - protein, 21 aa, Mycobacterium
TERWWLDRMVSVIASSAGIRV

SEQ ID NO: 778923 - protein, 18 aa, Mycobacterium
TETVLLELGMDWDRIDQL

SEQ ID NO: 778924 - protein, 17 aa, Mycobacterium
TETWPPPGVVYREFALR

SEQ ID NO: 778925 - protein, 18 aa, Mycobacterium
TEVFRLPIQMALVNRRFE

SEQ ID NO: 778926 - protein, 17 aa, Mycobacterium
TEVGRILGYTPYRMNTP

SEQ ID NO: 778927 - protein, 18 aa, Mycobacterium
TEVLLRSGAREVVAADVG

SEQ ID NO: 778928 - protein, 17 aa, Mycobacterium
TEVLSGLGLIANPVSAV

SEQ ID NO: 778929 - protein, 17 aa, Mycobacterium
TEVQGRLWGGEAGVPFD

SEQ ID NO: 778930 - protein, 20 aa, Mycobacterium
TEVRHLICRYSRRAALLQIG

SEQ ID NO: 778931 - protein, 19 aa, Mycobacterium
TEVRPILLWHAFEESEHKA

SEQ ID NO: 778932 - protein, 17 aa, Mycobacterium
TEVRPILLWHALEESEH

SEQ ID NO: 778933 - protein, 19 aa, Mycobacterium
TEVTWRWTVYPRNAVAGLA

SEQ ID NO: 778934 - protein, 25 aa, Mycobacterium
TEVVRMCVPLPWAAVAFERLFLFIR

SEQ ID NO: 778935 - protein, 20 aa, Mycobacterium
TEWDRWPSSLAWSADASALI

SEQ ID NO: 778936 - protein, 20 aa, Mycobacterium
TFAAFPWRWVGGDGCIVRLV

SEQ ID NO: 778937 - protein, 22 aa, Mycobacterium
TFACSFRLTGRLFRRRPQESQI

SEQ ID NO: 778938 - protein, 25 aa, Mycobacterium
TFAEVWHFPPWFGRNAAAFDDFMRD

SEQ ID NO: 778939 - protein, 18 aa, Mycobacterium
TFATMTLDWASFIRAGVP

SEQ ID NO: 778940 - protein, 19 aa, Mycobacterium
TFDGYRLGAVVVMDNRPRQ

SEQ ID NO: 778941 - protein, 27 aa, Mycobacterium
TFDIEPRPDQAFEFSVDVPGQVDVELH

SEQ ID NO: 778942 - protein, 20 aa, Mycobacterium
TFDLRWKAACGLPITAAAFH

SEQ ID NO: 778943 - protein, 19 aa, Mycobacterium
TFDLRWKAACGLPVTAGAF

SEQ ID NO: 778944 - protein, 19 aa, Mycobacterium
TFDYLDHFTWWRVVTWMRK

SEQ ID NO: 778945 - protein, 24 aa, Mycobacterium
TFEWPRIAGSFNWATDWFDAIAAD

SEQ ID NO: 778946 - protein, 18 aa, Mycobacterium
TFGGISIHSAEWDPGLDL

SEQ ID NO: 778947 - protein, 19 aa, Mycobacterium
TFHDGFVQALSRAASRYAA

SEQ ID NO: 778948 - protein, 23 aa, Mycobacterium
TFHTLRAAIPVMRRQRYGRIVVT

SEQ ID NO: 778949 - protein, 18 aa, Mycobacterium
TFIRQGLLRFCFTAAEDA

SEQ ID NO: 778950 - protein, 21 aa, Mycobacterium
TFKVKNMWGLLAVKGEFTKFV

SEQ ID NO: 778951 - protein, 24 aa, Mycobacterium
TFLAGARTLLGWGQLGYGLDLSDI

SEQ ID NO: 778952 - protein, 19 aa, Mycobacterium
TFLDREGWDSLTINALATQ

SEQ ID NO: 778953 - protein, 19 aa, Mycobacterium
TFLGPRPAGWWIRRRANEV

SEQ ID NO: 778954 - protein, 19 aa, Mycobacterium
TFLGPRPANWWIRRRLHEV

SEQ ID NO: 778955 - protein, 18 aa, Mycobacterium
TFLVRPAPVPSRFGGSRS

SEQ ID NO: 778956 - protein, 24 aa, Mycobacterium
TFNCLSWLEALGFCGIGESKDFLD

SEQ ID NO: 778957 - protein, 24 aa, Mycobacterium
TFNCLSWLEGLGFCGIGEAKDFLD

SEQ ID NO: 778958 - protein, 18 aa, Mycobacterium
TFNLGFADIGIFNAGAAN

SEQ ID NO: 778959 - protein, 22 aa, Mycobacterium
TFSFGIANPGFWNVGSANIGSY

SEQ ID NO: 778960 - protein, 19 aa, Mycobacterium
TFSRYELLMLLSFSRAGSM

SEQ ID NO: 778961 - protein, 18 aa, Mycobacterium
TFTAMAWTIVKLTTLHRT

SEQ ID NO: 778962 - protein, 25 aa, Mycobacterium
TFTEWTLALVIRVWSWLIMRAIHAE

SEQ ID NO: 778963 - protein, 25 aa, Mycobacterium
TFTGPRPGGWWLRRRLHEVVVHRAD

SEQ ID NO: 778964 - protein, 18 aa, Mycobacterium
TFVCPFHGWCWGIDGRNT

SEQ ID NO: 778965 - protein, 19 aa, Mycobacterium
TFVGAVCRWQAANPAGLVD

SEQ ID NO: 778966 - protein, 28 aa, Mycobacterium
TFVKFHWKPRLGVHSLVWEECQKVAGKD

SEQ ID NO: 778967 - protein, 17 aa, Mycobacterium
TFVTCYETVMPFGGTLH

SEQ ID NO: 778968 - protein, 17 aa, Mycobacterium
TFWPGWSNVQFPDGTIV

SEQ ID NO: 778969 - protein, 22 aa, Mycobacterium
TFWRKRTWFEGGYEPSITLNFM

SEQ ID NO: 778970 - protein, 18 aa, Mycobacterium
TFYGMARWQARLEQKQGF

SEQ ID NO: 778971 - protein, 24 aa, Mycobacterium
TGADALASIMSWQGWEQMFESARF

SEQ ID NO: 778972 - protein, 18 aa, Mycobacterium
TGAFWHVDYMFMPKPFAF

SEQ ID NO: 778973 - protein, 18 aa, Mycobacterium
TGAGLLRAVSMPGAGGTL

SEQ ID NO: 778974 - protein, 22 aa, Mycobacterium
TGAGVSGLWLLSGMRDDGVLTT

SEQ ID NO: 778975 - protein, 21 aa, Mycobacterium
TGAGVSGLWLLSGMREDGVLT

SEQ ID NO: 778976 - protein, 22 aa, Mycobacterium
TGAGVSGLWLLSGMREDGVLTT

SEQ ID NO: 778977 - protein, 23 aa, Mycobacterium
TGAGVSGLWLLSGMSDDGVLTTI

SEQ ID NO: 778978 - protein, 22 aa, Mycobacterium
TGAGVSGLWLLSGMSNDGVLTT

SEQ ID NO: 778979 - protein, 27 aa, Mycobacterium
TGAMGRRAGAAAGYTHKYGFRYSVLTR

SEQ ID NO: 778980 - protein, 17 aa, Mycobacterium
TGATALRTAIMAVKAGE

SEQ ID NO: 778981 - protein, 20 aa, Mycobacterium
TGDCLFPGGVGKTWQPGDFT

SEQ ID NO: 778982 - protein, 17 aa, Mycobacterium
TGDSGFFFDGELFIIGR

SEQ ID NO: 778983 - protein, 25 aa, Mycobacterium
TGEEFGWRAAELFDVIGGGVVNVEI

SEQ ID NO: 778984 - protein, 21 aa, Mycobacterium
TGEGWRLYTRARFAPYVEKLL

SEQ ID NO: 778985 - protein, 25 aa, Mycobacterium
TGEIRVPRMLGVFSVGRVINARTLR

SEQ ID NO: 778986 - protein, 21 aa, Mycobacterium
TGELPFVPGIDAVVRDAEGTL

SEQ ID NO: 778987 - protein, 27 aa, Mycobacterium
TGEVLSVPVGDAFLGRVINPLGQPIDG

SEQ ID NO: 778988 - protein, 26 aa, Mycobacterium
TGEVLSVPVGDAFLGRVVDPLGHPID

SEQ ID NO: 778989 - protein, 26 aa, Mycobacterium
TGEVLSVPVGDAFLGRVVNPLGQPID

SEQ ID NO: 778990 - protein, 26 aa, Mycobacterium
TGEYIAWRLWLHIAFDLTADPAELRE

SEQ ID NO: 778991 - protein, 17 aa, Mycobacterium
TGFARSGAMFACEHEGI

SEQ ID NO: 778992 - protein, 22 aa, Mycobacterium
TGFDCGGLVRYSTQQGAGYDVF

SEQ ID NO: 778993 - protein, 22 aa, Mycobacterium
TGFDPNASWFGWASTWGNQFIS

SEQ ID NO: 778994 - protein, 19 aa, Mycobacterium
TGFLGRYLVLEWLEQLEQV

SEQ ID NO: 778995 - protein, 29 aa, Mycobacterium
TGFLGRYLVLEWLRRLRAVGGKLICLVRA

SEQ ID NO: 778996 - protein, 18 aa, Mycobacterium
TGFTGGLNWYRNFDRNWA

SEQ ID NO: 778997 - protein, 19 aa, Mycobacterium
TGGAGGWLLGNGGAGGAGG

SEQ ID NO: 778998 - protein, 19 aa, Mycobacterium
TGGAGGWLTGAGGTGGAGG

SEQ ID NO: 778999 - protein, 20 aa, Mycobacterium
TGGDGGFLLGQGAAGGAGGN

SEQ ID NO: 779000 - protein, 22 aa, Mycobacterium
TGGELKVRFFASARSQGRKLAF

SEQ ID NO: 779001 - protein, 17 aa, Mycobacterium
TGGFEWDPVLVRAFLRG

SEQ ID NO: 779002 - protein, 19 aa, Mycobacterium
TGGFGGRGGQSVFTANAGG

SEQ ID NO: 779003 - protein, 17 aa, Mycobacterium
TGGHGGWLYGNGGAGGI

SEQ ID NO: 779004 - protein, 17 aa, Mycobacterium
TGGHGSFLFGAAGASCN

SEQ ID NO: 779005 - protein, 31 aa, Mycobacterium
TGGKGSNAPIGFSFGGAGGKGGTGGTGGTAH

SEQ ID NO: 779006 - protein, 17 aa, Mycobacterium
TGGLLFGDGGHGYDGSA

SEQ ID NO: 779007 - protein, 19 aa, Mycobacterium
TGGMPMRWGTGYMLGSKRF

SEQ ID NO: 779008 - protein, 26 aa, Mycobacterium
TGGNAGEFQSLLGIGKGGDGGTGGDG

SEQ ID NO: 779009 - protein, 23 aa, Mycobacterium
TGGSARLVGFGGAGGGGGLGGVG

SEQ ID NO: 779010 - protein, 24 aa, Mycobacterium
TGGTGGFSRYGLGGDGGTGGNAGW

SEQ ID NO: 779011 - protein, 22 aa, Mycobacterium
TGGTSRFGGLGGNGGVGGKAGL

SEQ ID NO: 779012 - protein, 24 aa, Mycobacterium
TGHFYRWRTADGFLSDIRSAATAV

SEQ ID NO: 779013 - protein, 23 aa, Mycobacterium
TGHLRGAVNIGLAGRYAEFAGSV

SEQ ID NO: 779014 - protein, 24 aa, Mycobacterium
TGIGFSCLWPETYIATSAVTNLSD

SEQ ID NO: 779015 - protein, 17 aa, Mycobacterium
TGIGRTGAFYAHQHDGI

SEQ ID NO: 779016 - protein, 18 aa, Mycobacterium
TGIPRPGLSTIFSPSRST

SEQ ID NO: 779017 - protein, 19 aa, Mycobacterium
TGKEFWPLQLLATNKDGTP

SEQ ID NO: 779018 - protein, 17 aa, Mycobacterium
TGLDGLLGVPGSNGQTG

SEQ ID NO: 779019 - protein, 25 aa, Mycobacterium
TGLKIGVPEEIAWRQGFLSDDELCD

SEQ ID NO: 779020 - protein, 20 aa, Mycobacterium
TGLNFPAGVAVDLNGNIYVA

SEQ ID NO: 779021 - protein, 17 aa, Mycobacterium
TGLPCPVCGDTVREVSF

SEQ ID NO: 779022 - protein, 17 aa, Mycobacterium
TGLQITRTFTVNTDSEF

SEQ ID NO: 779023 - protein, 19 aa, Mycobacterium
TGLRLPETVGWDYGSISGL

SEQ ID NO: 779024 - protein, 27 aa, Mycobacterium
TGLRYGNCVPLTYPFALTFPALMSLVT

SEQ ID NO: 779025 - protein, 17 aa, Mycobacterium
TGLSIRETVLFPIVRPH

SEQ ID NO: 779026 - protein, 17 aa, Mycobacterium
TGLVLKWLAPGSDSDSS

SEQ ID NO: 779027 - protein, 17 aa, Mycobacterium
TGMSFPAYVRWARLIRT

SEQ ID NO: 779028 - protein, 18 aa, Mycobacterium
TGMTCGHCELSVREEVSG

SEQ ID NO: 779029 - protein, 18 aa, Mycobacterium
TGNLRWTLTGVVYAEWLL

SEQ ID NO: 779030 - protein, 21 aa, Mycobacterium
TGNPGRSGWTGGAVSAVTAVT

SEQ ID NO: 779031 - protein, 21 aa, Mycobacterium
TGNPGRSGWTGGAVSTVTAVT

SEQ ID NO: 779032 - protein, 17 aa, Mycobacterium
TGNVCLVTLGLNLFSRG

SEQ ID NO: 779033 - protein, 22 aa, Mycobacterium
TGPALSAFNAWILLKGLETLAI

SEQ ID NO: 779034 - protein, 23 aa, Mycobacterium
TGPALSAFNAWVLVKGLETLAIR

SEQ ID NO: 779035 - protein, 17 aa, Mycobacterium
TGPFIGWIRPAVMRALD

SEQ ID NO: 779036 - protein, 19 aa, Mycobacterium
TGPLWKAYVDLGWTELNDP

SEQ ID NO: 779037 - protein, 18 aa, Mycobacterium
TGPRRTSWPLAFKPSTYL

SEQ ID NO: 779038 - protein, 20 aa, Mycobacterium
TGPWAPRLAWLTPPIDDPAF

SEQ ID NO: 779039 - protein, 22 aa, Mycobacterium
TGQAGGDGGLLIGNGGAGGSGA

SEQ ID NO: 779040 - protein, 24 aa, Mycobacterium
TGQAGGPGGWLWGDGGDGGSGTPG

SEQ ID NO: 779041 - protein, 25 aa, Mycobacterium
TGQEFSWRAEELFSAIARGDITVEV

SEQ ID NO: 779042 - protein, 23 aa, Mycobacterium
TGQPAAVVPWDFDDDGMPMSVQL

SEQ ID NO: 779043 - protein, 21 aa, Mycobacterium
TGRAFSGWRPGDLMRSAWEQQ

SEQ ID NO: 779044 - protein, 18 aa, Mycobacterium
TGRAWGFEHCDIEPDMVV

SEQ ID NO: 779045 - protein, 17 aa, Mycobacterium
TGRGGWSNVLLVVPAAT

SEQ ID NO: 779046 - protein, 19 aa, Mycobacterium
TGRKVLLLGHFVKHFVGLG

SEQ ID NO: 779047 - protein, 23 aa, Mycobacterium
TGRLLELLPRFGFDDQACELLAQ

SEQ ID NO: 779048 - protein, 23 aa, Mycobacterium
TGRPAISVPLHWTDRGLPLGVQL

SEQ ID NO: 779049 - protein, 21 aa, Mycobacterium
TGRPPRWVGPVVDQLGFAPMA

SEQ ID NO: 779050 - protein, 22 aa, Mycobacterium
TGRWAAIVARTWFATAAPPAGT

SEQ ID NO: 779051 - protein, 26 aa, Mycobacterium
TGSCKWSLKIAREWSRERVQWGKPVG

SEQ ID NO: 779052 - protein, 19 aa, Mycobacterium
TGSFNRAWAFDQYSDAEVN

SEQ ID NO: 779053 - protein, 17 aa, Mycobacterium
TGSFSINGGNYFGADSP

SEQ ID NO: 779054 - protein, 18 aa, Mycobacterium
TGSFSINGGNYFGADSPF

SEQ ID NO: 779055 - protein, 17 aa, Mycobacterium
TGSLGIGGTGGHGGAGG

SEQ ID NO: 779056 - protein, 22 aa, Mycobacterium
TGSRLPLTLSMLLFDSSGVNKD

SEQ ID NO: 779057 - protein, 17 aa, Mycobacterium
TGSWIFRECGAWGSADP

SEQ ID NO: 779058 - protein, 21 aa, Mycobacterium
TGTAGKCARRASATVASQSTG

SEQ ID NO: 779059 - protein, 19 aa, Mycobacterium
TGTEARLITAMVVREDSMT

SEQ ID NO: 779060 - protein, 24 aa, Mycobacterium
TGTFGWPGAFGTWWHADPKADAIL

SEQ ID NO: 779061 - protein, 22 aa, Mycobacterium
TGTFNWAIDWFDAIARGNDRPA

SEQ ID NO: 779062 - protein, 18 aa, Mycobacterium
TGTFSINGGNYFSPDSPF

SEQ ID NO: 779063 - protein, 20 aa, Mycobacterium
TGTFSWPGAYGTWWQADPSA

SEQ ID NO: 779064 - protein, 20 aa, Mycobacterium
TGTGLRWIMQNGMWNFGLDS

SEQ ID NO: 779065 - protein, 19 aa, Mycobacterium
TGTGWELFGRRAIRQGDWK

SEQ ID NO: 779066 - protein, 17 aa, Mycobacterium
TGTLGVFTVDGFTIPAS

SEQ ID NO: 779067 - protein, 18 aa, Mycobacterium
TGTPWRVGFCGFAPGFAY

SEQ ID NO: 779068 - protein, 17 aa, Mycobacterium
TGTRFECNLTWLELQWG

SEQ ID NO: 779069 - protein, 26 aa, Mycobacterium
TGTVGDLLPILGIPGQMAQNFTNLLP

SEQ ID NO: 779070 - protein, 17 aa, Mycobacterium
TGVDIAIALITPLVGQE

SEQ ID NO: 779071 - protein, 24 aa, Mycobacterium
TGVHCLRLILGGVFDRFPQLQIIV

SEQ ID NO: 779072 - protein, 20 aa, Mycobacterium
TGVKRFGLRPVVGIDPAAVS

SEQ ID NO: 779073 - protein, 17 aa, Mycobacterium
TGVMMGVYFNEYQSMLA

SEQ ID NO: 779074 - protein, 20 aa, Mycobacterium
TGVPCVVDLVAMRDAIADLG

SEQ ID NO: 779075 - protein, 17 aa, Mycobacterium
TGVPGIIFGPALSGGNS

SEQ ID NO: 779076 - protein, 24 aa, Mycobacterium
TGVPLCCIHDGLGLSWSYRALGNY

SEQ ID NO: 779077 - protein, 25 aa, Mycobacterium
TGVRFPVWNGRSGFAIREFARRHGD

SEQ ID NO: 779078 - protein, 18 aa, Mycobacterium
TGVRRIVYLGGFVPECEA

SEQ ID NO: 779079 - protein, 21 aa, Mycobacterium
TGVSNFSGWQLMKSLSLAERH

SEQ ID NO: 779080 - protein, 19 aa, Mycobacterium
TGVSYRPGARFGPTHVRES

SEQ ID NO: 779081 - protein, 19 aa, Mycobacterium
TGVYGGIDVCRWAAADGVI

SEQ ID NO: 779082 - protein, 17 aa, Mycobacterium
TGWFDIAAGDWWDDALA

SEQ ID NO: 779083 - protein, 20 aa, Mycobacterium
TGWKTLSWVDANVWRHLAPK

SEQ ID NO: 779084 - protein, 18 aa, Mycobacterium
TGWVWKFDPAIFSGSLQG

SEQ ID NO: 779085 - protein, 24 aa, Mycobacterium
TGYARRSGLTASRFVACPFGGPGA

SEQ ID NO: 779086 - protein, 24 aa, Mycobacterium
TGYSRRSGLTASRFVACPFGGPGA

SEQ ID NO: 779087 - protein, 20 aa, Mycobacterium
THALELLVIVSFVRGLSVRD

SEQ ID NO: 779088 - protein, 24 aa, Mycobacterium
THANEIYVAWALSQHNAFGGDLAV

SEQ ID NO: 779089 - protein, 24 aa, Mycobacterium
THAVCGRCVMCAKKRPTLCRNKIP

SEQ ID NO: 779090 - protein, 19 aa, Mycobacterium
THCNLDCPICFADSGHQPD

SEQ ID NO: 779091 - protein, 17 aa, Mycobacterium
THFEELCEILARYDVTF

SEQ ID NO: 779092 - protein, 18 aa, Mycobacterium
THFTQIFVLPTFVRGGTN

SEQ ID NO: 779093 - protein, 19 aa, Mycobacterium
THGELLWRDKLVWAGRPNT

SEQ ID NO: 779094 - protein, 20 aa, Mycobacterium
THIALAWSMLRRQDQFRSAL

SEQ ID NO: 779095 - protein, 20 aa, Mycobacterium
THIRPPVKFRVKLDSPEGRV

SEQ ID NO: 779096 - protein, 18 aa, Mycobacterium
THLGWIAKTGWNIEGEPE

SEQ ID NO: 779097 - protein, 18 aa, Mycobacterium
THLLRYPLPAAWADTVDV

SEQ ID NO: 779098 - protein, 18 aa, Mycobacterium
THLLRYPLPAAWCDDVDV

SEQ ID NO: 779099 - protein, 18 aa, Mycobacterium
THLVPRDSIGWVEAEGDY

SEQ ID NO: 779100 - protein, 20 aa, Mycobacterium
THPFAWLPMLSRVLATARLL

SEQ ID NO: 779101 - protein, 17 aa, Mycobacterium
THPFGWLPLLSRVLASA

SEQ ID NO: 779102 - protein, 20 aa, Mycobacterium
THPGCDVPGYWCEVHHTDEW

SEQ ID NO: 779103 - protein, 17 aa, Mycobacterium
THPRSGVPQVIFYAEPE

SEQ ID NO: 779104 - protein, 23 aa, Mycobacterium
THQIGDLIVLFAYNPFSTSAPTK

SEQ ID NO: 779105 - protein, 24 aa, Mycobacterium
THSRLRPPWVTDIDVVFGTSLAET

SEQ ID NO: 779106 - protein, 18 aa, Mycobacterium
THVPEFLERIGIGAPEVE

SEQ ID NO: 779107 - protein, 24 aa, Mycobacterium
THWPPPCRFWNLVVWNQFMATYGP

SEQ ID NO: 779108 - protein, 19 aa, Mycobacterium
THWPWTDQWLMLWRNTIGY

SEQ ID NO: 779109 - protein, 20 aa, Mycobacterium
THYRWLRGMSGIGDMALRLR

SEQ ID NO: 779110 - protein, 24 aa, Mycobacterium
TIAPGARLNIPWRRDFNSLVYVLS

SEQ ID NO: 779111 - protein, 18 aa, Mycobacterium
TIAVQWRATVEWDGDRPV

SEQ ID NO: 779112 - protein, 24 aa, Mycobacterium
TIDHKMRYGSCTKMYTAILILAQI

SEQ ID NO: 779113 - protein, 17 aa, Mycobacterium
TIDPIWTIGPKVHSGCM

SEQ ID NO: 779114 - protein, 19 aa, Mycobacterium
TIEIEAGFFWCMPGDADVA

SEQ ID NO: 779115 - protein, 18 aa, Mycobacterium
TIEIPRLIGNLNVTKIIQ

SEQ ID NO: 779116 - protein, 19 aa, Mycobacterium
TIGEHGMAVMLARGDLAID

SEQ ID NO: 779117 - protein, 22 aa, Mycobacterium
TIGLRFPVQYVIRPRTAEYPDY

SEQ ID NO: 779118 - protein, 17 aa, Mycobacterium
TIGLVFRARMAEPDLLP

SEQ ID NO: 779119 - protein, 17 aa, Mycobacterium
TIGMSWRTYLLHARMLR

SEQ ID NO: 779120 - protein, 19 aa, Mycobacterium
TIHAGEAFGLPSIHEAIAF

SEQ ID NO: 779121 - protein, 19 aa, Mycobacterium
TIHAGEGFGLPSIHEAIAF

SEQ ID NO: 779122 - protein, 18 aa, Mycobacterium
TIHGYKRAFRIAGSGPAI

SEQ ID NO: 779123 - protein, 22 aa, Mycobacterium
TIKRFADRFARFNLQEKVIRPS

SEQ ID NO: 779124 - protein, 23 aa, Mycobacterium
TIKWDMDEMFGGRFCSHNSGNSC

SEQ ID NO: 779125 - protein, 18 aa, Mycobacterium
TILDSWCAALGRAFVADG

SEQ ID NO: 779126 - protein, 24 aa, Mycobacterium
TILEEARVPFLRDVFGAEITTTGL

SEQ ID NO: 779127 - protein, 17 aa, Mycobacterium
TILNGWCSALTRAFITD

SEQ ID NO: 779128 - protein, 19 aa, Mycobacterium
TILRLGIAFLKEARKHSHA

SEQ ID NO: 779129 - protein, 19 aa, Mycobacterium
TILSRRVWENAGSPEVDPD

SEQ ID NO: 779130 - protein, 23 aa, Mycobacterium
TIPSIPLPFGLFLSSPEMQQGVA

SEQ ID NO: 779131 - protein, 23 aa, Mycobacterium
TIRASVLVAEWPVRPGIPDPDPL

SEQ ID NO: 779132 - protein, 18 aa, Mycobacterium
TIRDWAWSLLCTPWARIG

SEQ ID NO: 779133 - protein, 18 aa, Mycobacterium
TIRLPVHLVEQVNKLARI

SEQ ID NO: 779134 - protein, 22 aa, Mycobacterium
TIRPGEIPVFWACGVTPQAAVM

SEQ ID NO: 779135 - protein, 22 aa, Mycobacterium
TIRWSWELGDIAVWDNRATQHY

SEQ ID NO: 779136 - protein, 21 aa, Mycobacterium
TIRWSWELGDVAMWDNRATQH

SEQ ID NO: 779137 - protein, 38 aa, Mycobacterium
TISGKYGYSYKVLGIKFNYPFKYSFDIPAITIPSIQIG

SEQ ID NO: 779138 - protein, 26 aa, Mycobacterium
TITAEFAAPVTRIWQIYADPRQLEKV

SEQ ID NO: 779139 - protein, 24 aa, Mycobacterium
TITARLNFQLAFGARVGQRLAEAR

SEQ ID NO: 779140 - protein, 23 aa, Mycobacterium
TITARLNFQLAFGTRVGQRLTDA

SEQ ID NO: 779141 - protein, 19 aa, Mycobacterium
TITFLDIPAAPGFGNTTAG

SEQ ID NO: 779142 - protein, 18 aa, Mycobacterium
TITSPGLREIVLNDLIGA

SEQ ID NO: 779143 - protein, 23 aa, Mycobacterium
TIYRQEMLRMFGLPESGLAETLR

SEQ ID NO: 779144 - protein, 21 aa, Mycobacterium
TIYRWWPSRHALVADVILEDA

SEQ ID NO: 779145 - protein, 21 aa, Mycobacterium
TIYRWWPSRHALVADVLLEDA

SEQ ID NO: 779146 - protein, 22 aa, Mycobacterium
TIYRWWPSRPALVADVMLEDAD

SEQ ID NO: 779147 - protein, 21 aa, Mycobacterium
TKAVEGLSLFRRRLVTPFIRA

SEQ ID NO: 779148 - protein, 18 aa, Mycobacterium
TKAVIRWSNLVGDRFLAL

SEQ ID NO: 779149 - protein, 22 aa, Mycobacterium
TKCYCRLHWRALCSPDCGPNRV

SEQ ID NO: 779150 - protein, 23 aa, Mycobacterium
TKDGKRLTAELVYSADTGDTPPA

SEQ ID NO: 779151 - protein, 18 aa, Mycobacterium
TKESLAWRIRRFDSGMAW

SEQ ID NO: 779152 - protein, 18 aa, Mycobacterium
TKGPMLINARADKVTSSP

SEQ ID NO: 779153 - protein, 18 aa, Mycobacterium
TKGPMLINARADKVTTSP

SEQ ID NO: 779154 - protein, 20 aa, Mycobacterium
TKGPVPWWWRPSGALFDQFL

SEQ ID NO: 779155 - protein, 18 aa, Mycobacterium
TKHAAVGFAEWLAITYGD

SEQ ID NO: 779156 - protein, 17 aa, Mycobacterium
TKHAAVGFAEWLSITYG

SEQ ID NO: 779157 - protein, 17 aa, Mycobacterium
TKKAGAGQYVFLLYSTL

SEQ ID NO: 779158 - protein, 17 aa, Mycobacterium
TKLGVAVNDHFTARGAV

SEQ ID NO: 779159 - protein, 18 aa, Mycobacterium
TKLSCPIYAYIGDKDWIT

SEQ ID NO: 779160 - protein, 20 aa, Mycobacterium
TKLWTIADLGGWSAADPQLF

SEQ ID NO: 779161 - protein, 25 aa, Mycobacterium
TKNAADWLAARGFKQGLGSLGQISV

SEQ ID NO: 779162 - protein, 19 aa, Mycobacterium
TKNHWDWFDPFYAHRVLWP

SEQ ID NO: 779163 - protein, 18 aa, Mycobacterium
TKPWKIAVDLGTHGVYVT

SEQ ID NO: 779164 - protein, 17 aa, Mycobacterium
TKQACDFRDSLAELNGA

SEQ ID NO: 779165 - protein, 21 aa, Mycobacterium
TKRDARSWLSLRQAEIVARAW

SEQ ID NO: 779166 - protein, 24 aa, Mycobacterium
TKSLRAGKVFLDWSQNSGSKTTIA

SEQ ID NO: 779167 - protein, 18 aa, Mycobacterium
TKTFRLGGHWEQDYVMVR

SEQ ID NO: 779168 - protein, 21 aa, Mycobacterium
TKYRLGRAMARIEAAMSTPGM

SEQ ID NO: 779169 - protein, 22 aa, Mycobacterium
TKYWMDLGMGWQFFAQEDYIRR

SEQ ID NO: 779170 - protein, 18 aa, Mycobacterium
TLADFAYAYLVTVGDDYR

SEQ ID NO: 779171 - protein, 21 aa, Mycobacterium
TLADLVFAWKVGRAVKSNAIV

SEQ ID NO: 779172 - protein, 26 aa, Mycobacterium
TLADLVFAWRTCRAVKSNAIVLAKDG

SEQ ID NO: 779173 - protein, 19 aa, Mycobacterium
TLAEFGMTWRSPRDAIIAT

SEQ ID NO: 779174 - protein, 21 aa, Mycobacterium
TLAEWNRFLAVNLTGTFLSLQ

SEQ ID NO: 779175 - protein, 17 aa, Mycobacterium
TLAHLRSQLALRQEWEA

SEQ ID NO: 779176 - protein, 18 aa, Mycobacterium
TLALLPALRRAHGQVVFI

SEQ ID NO: 779177 - protein, 18 aa, Mycobacterium
TLALLPALRRARGQVIFI

SEQ ID NO: 779178 - protein, 25 aa, Mycobacterium
TLAMGHAMIRAGLSLKRHGTDRPWR

SEQ ID NO: 779179 - protein, 23 aa, Mycobacterium
TLAPCWYCSGLVRQFNIGSLLVG

SEQ ID NO: 779180 - protein, 24 aa, Mycobacterium
TLARPDRRLAVVFGAGGERDPGKR

SEQ ID NO: 779181 - protein, 17 aa, Mycobacterium
TLARWIVRINFSLIAEP

SEQ ID NO: 779182 - protein, 17 aa, Mycobacterium
TLCERFEPSVLYGVPNF

SEQ ID NO: 779183 - protein, 19 aa, Mycobacterium
TLDDAVVWRRLQIVDTEAG

SEQ ID NO: 779184 - protein, 17 aa, Mycobacterium
TLDELFEALTLVQTRKV

SEQ ID NO: 779185 - protein, 19 aa, Mycobacterium
TLDLCRLDQLFSLDEVSGQ

SEQ ID NO: 779186 - protein, 17 aa, Mycobacterium
TLDQAWRAQTIDAARTL

SEQ ID NO: 779187 - protein, 22 aa, Mycobacterium
TLDRVVAVPAMLPQNTRRRQKV

SEQ ID NO: 779188 - protein, 19 aa, Mycobacterium
TLEEYWWAAEQVLTWPDEP

SEQ ID NO: 779189 - protein, 18 aa, Mycobacterium
TLELGYQVGFPWSLGVGI

SEQ ID NO: 779190 - protein, 17 aa, Mycobacterium
TLERFADRFAHFNFRDN

SEQ ID NO: 779191 - protein, 25 aa, Mycobacterium
TLERLKYLPLAPFRVSYAYTNYGVT

SEQ ID NO: 779192 - protein, 17 aa, Mycobacterium
TLFGGLPPGLLVEIDAL

SEQ ID NO: 779193 - protein, 24 aa, Mycobacterium
TLFPDQRFAAIVAVGVFTFAHAGP

SEQ ID NO: 779194 - protein, 17 aa, Mycobacterium
TLFRAGERLRLVIAGRW

SEQ ID NO: 779195 - protein, 19 aa, Mycobacterium
TLFRLPIRLALGPTHVAVV

SEQ ID NO: 779196 - protein, 17 aa, Mycobacterium
TLFRRFGSRAGLMIVLL

SEQ ID NO: 779197 - protein, 17 aa, Mycobacterium
TLGDGWAPFAVGLEQAR

SEQ ID NO: 779198 - protein, 27 aa, Mycobacterium
TLGWKPRVGLARGIRHTVDWLCTTLEP

SEQ ID NO: 779199 - protein, 25 aa, Mycobacterium
TLGYRQSLFWAWLIYGGRLLRGRLP

SEQ ID NO: 779200 - protein, 24 aa, Mycobacterium
TLHDAYRALKAWGLPVSDHTAQVT

SEQ ID NO: 779201 - protein, 22 aa, Mycobacterium
TLHPGTPIDMFKEWVGPSRLFI

SEQ ID NO: 779202 - protein, 20 aa, Mycobacterium
TLHPRFGRWLQLGGHCEDTD

SEQ ID NO: 779203 - protein, 21 aa, Mycobacterium
TLHPRLGRWVQLGGHCEDDHD

SEQ ID NO: 779204 - protein, 18 aa, Mycobacterium
TLHRFVDRFAHFNFRDHM

SEQ ID NO: 779205 - protein, 25 aa, Mycobacterium
TLIKEKWLTANGVIGFFCANAVGDD

SEQ ID NO: 779206 - protein, 17 aa, Mycobacterium
TLISVPLFHATGCNSQL

SEQ ID NO: 779207 - protein, 23 aa, Mycobacterium
TLIWQCPVVLLGDVRSVGVQGDN

SEQ ID NO: 779208 - protein, 23 aa, Mycobacterium
TLKDWADRGIRVIGLDAGGDTVV

SEQ ID NO: 779209 - protein, 22 aa, Mycobacterium
TLKDWADRGLRVIGLDAAGETA

SEQ ID NO: 779210 - protein, 22 aa, Mycobacterium
TLKPEVCWQLPIRRTQEWITRP

SEQ ID NO: 779211 - protein, 19 aa, Mycobacterium
TLLEWCRRNDVVFIADEVQ

SEQ ID NO: 779212 - protein, 19 aa, Mycobacterium
TLLGFCAAVTFPTTGSVWV

SEQ ID NO: 779213 - protein, 17 aa, Mycobacterium
TLLGLGFGEHAVLPVLR

SEQ ID NO: 779214 - protein, 19 aa, Mycobacterium
TLLGRPLIGNGADGAAGTG

SEQ ID NO: 779215 - protein, 18 aa, Mycobacterium
TLLGRPLIGNGANGAPGT

SEQ ID NO: 779216 - protein, 24 aa, Mycobacterium
TLLKRFTKKFAVKRGAMAAGKLLP

SEQ ID NO: 779217 - protein, 22 aa, Mycobacterium
TLLRRLVIMGGAFGPDTNPMAE

SEQ ID NO: 779218 - protein, 18 aa, Mycobacterium
TLMSRLLLEAGVTPWITL

SEQ ID NO: 779219 - protein, 20 aa, Mycobacterium
TLNGTRVWCAGAGFCTHALV

SEQ ID NO: 779220 - protein, 21 aa, Mycobacterium
TLNLKEWKAEWGVVDPQEARG

SEQ ID NO: 779221 - protein, 24 aa, Mycobacterium
TLNLKEWRAEWGISEEHDARGSLT

SEQ ID NO: 779222 - protein, 28 aa, Mycobacterium
TLPAVYRWCGLHARYLISWCRRHGHADV

SEQ ID NO: 779223 - protein, 22 aa, Mycobacterium
TLPDIRCVYWAGGNPFHHHQNL

SEQ ID NO: 779224 - protein, 18 aa, Mycobacterium
TLPFFPFAHAERWLRLLP

SEQ ID NO: 779225 - protein, 25 aa, Mycobacterium
TLPNGRYSWRISLPAMVCYWSELAR

SEQ ID NO: 779226 - protein, 21 aa, Mycobacterium
TLPRPAVRLLEQWLAHSALLR

SEQ ID NO: 779227 - protein, 19 aa, Mycobacterium
TLQCVPAFRLHRSQSVHDL

SEQ ID NO: 779228 - protein, 25 aa, Mycobacterium
TLQMLADCPLRWLLERHGGARGRDV

SEQ ID NO: 779229 - protein, 20 aa, Mycobacterium
TLQRFEAWLTTTLQNAILRD

SEQ ID NO: 779230 - protein, 17 aa, Mycobacterium
TLQWAYRVGDNEFRVGV

SEQ ID NO: 779231 - protein, 17 aa, Mycobacterium
TLREAFRVLESESLIQV

SEQ ID NO: 779232 - protein, 19 aa, Mycobacterium
TLREFLRRFDFLVTPVTTA

SEQ ID NO: 779233 - protein, 18 aa, Mycobacterium
TLRITAKYADHWNFVLGT

SEQ ID NO: 779234 - protein, 21 aa, Mycobacterium
TLRLLIELARAAGLEERRDQM

SEQ ID NO: 779235 - protein, 18 aa, Mycobacterium
TLRNWLGMWSLREAQTRA

SEQ ID NO: 779236 - protein, 17 aa, Mycobacterium
TLRNWLGMWSLRHAQTR

SEQ ID NO: 779237 - protein, 20 aa, Mycobacterium
TLRNWLGMWSLRVAQTRAAP

SEQ ID NO: 779238 - protein, 19 aa, Mycobacterium
TLRNWLGMWSLRVAQTRAE

SEQ ID NO: 779239 - protein, 19 aa, Mycobacterium
TLRPLRPAFSVGLGARLGS

SEQ ID NO: 779240 - protein, 19 aa, Mycobacterium
TLRRAEGKFGFAVKFHRIA

SEQ ID NO: 779241 - protein, 25 aa, Mycobacterium
TLRRIPWLPGTAMVMADLSWLDGNP

SEQ ID NO: 779242 - protein, 19 aa, Mycobacterium
TLRSFLRRRISTTGLVTAS

SEQ ID NO: 779243 - protein, 19 aa, Mycobacterium
TLRSLYFLGARVTGGSPHA

SEQ ID NO: 779244 - protein, 27 aa, Mycobacterium
TLRWLREAAGWGDLIWKFVRVADARVV

SEQ ID NO: 779245 - protein, 32 aa, Mycobacterium
TLRYVFCGGEPLSLALCRRFAAVLPHAELVNL

SEQ ID NO: 779246 - protein, 23 aa, Mycobacterium
TLSFRRLRVLGTTFSVRTADEMA

SEQ ID NO: 779247 - protein, 17 aa, Mycobacterium
TLSGAGLSDGWAVVVDG

SEQ ID NO: 779248 - protein, 23 aa, Mycobacterium
TLSPCWYCSGLVRQFNIGALVIG

SEQ ID NO: 779249 - protein, 23 aa, Mycobacterium
TLSPCWYCSGLVRQFNIGALVVG

SEQ ID NO: 779250 - protein, 23 aa, Mycobacterium
TLSPCWYCSGLVRQFNIGTVVIG

SEQ ID NO: 779251 - protein, 24 aa, Mycobacterium
TLSTAIRAARRWIRAPASTSSSVA

SEQ ID NO: 779252 - protein, 22 aa, Mycobacterium
TLTCPFHGWTFRNDGTLLKVKD

SEQ ID NO: 779253 - protein, 21 aa, Mycobacterium
TLTDCPLRWLAERHGGTNPRD

SEQ ID NO: 779254 - protein, 19 aa, Mycobacterium
TLTGRPLFGNGADATTPGA

SEQ ID NO: 779255 - protein, 18 aa, Mycobacterium
TLTGRPLIGNGANGAAGT

SEQ ID NO: 779256 - protein, 17 aa, Mycobacterium
TLTVGFYQLVCDFLNTF

SEQ ID NO: 779257 - protein, 24 aa, Mycobacterium
TLVIRGGCMLRHCDDTLCERFTRI

SEQ ID NO: 779258 - protein, 23 aa, Mycobacterium
TLWARRPATLEAFADTKAKVAES

SEQ ID NO: 779259 - protein, 23 aa, Mycobacterium
TLWARRPATLEAFADTPAQIAGS

SEQ ID NO: 779260 - protein, 23 aa, Mycobacterium
TLWEHWDRCALHWFPGSHVLHVS

SEQ ID NO: 779261 - protein, 26 aa, Mycobacterium
TLYPFDWLARLPIPVNRRFRSAITDV

SEQ ID NO: 779262 - protein, 24 aa, Mycobacterium
TMARACIDEGWLLSLSGTVSFKNA

SEQ ID NO: 779263 - protein, 22 aa, Mycobacterium
TMDICRPCLGLAFRMHVTAATM

SEQ ID NO: 779264 - protein, 17 aa, Mycobacterium
TMFGWLLGGLSRTSLGN

SEQ ID NO: 779265 - protein, 18 aa, Mycobacterium
TMGIPILYPWANRLSANT

SEQ ID NO: 779266 - protein, 20 aa, Mycobacterium
TMGLGGGYLTEWIGDPAAVT

SEQ ID NO: 779267 - protein, 18 aa, Mycobacterium
TMGLPILYPWANRLGANS

SEQ ID NO: 779268 - protein, 21 aa, Mycobacterium
TMGVFCRRWGVPLIDGGTVRL

SEQ ID NO: 779269 - protein, 20 aa, Mycobacterium
TMLPFCWRGVSLHAGGAGRV

SEQ ID NO: 779270 - protein, 18 aa, Mycobacterium
TMSWPEHTDHAGAAERLR

SEQ ID NO: 779271 - protein, 25 aa, Mycobacterium
TMTAEPRRTRLAAIATVAAAATDTA

SEQ ID NO: 779272 - protein, 17 aa, Mycobacterium
TMVAPLVLSHDVPVQVQ

SEQ ID NO: 779273 - protein, 24 aa, Mycobacterium
TMVDLLSTVLIRWERDDEVRAVVV

SEQ ID NO: 779274 - protein, 18 aa, Mycobacterium
TMVGRLSVPPSWAGTTEV

SEQ ID NO: 779275 - protein, 19 aa, Mycobacterium
TMYLGHGFGCSAAIEQYQL

SEQ ID NO: 779276 - protein, 22 aa, Mycobacterium
TNAPIPVCLDIDAGWRPLGGPV

SEQ ID NO: 779277 - protein, 20 aa, Mycobacterium
TNIEFLRFLLADDDVAAGRL

SEQ ID NO: 779278 - protein, 22 aa, Mycobacterium
TNIEFLRFLLADERVRAGDLDT

SEQ ID NO: 779279 - protein, 18 aa, Mycobacterium
TNIFTGMVGRTWVTPEGQ

SEQ ID NO: 779280 - protein, 19 aa, Mycobacterium
TNLPAQRLLAGFLTGGHLA

SEQ ID NO: 779281 - protein, 17 aa, Mycobacterium
TNNGQFTPSIYGNGGNG

SEQ ID NO: 779282 - protein, 20 aa, Mycobacterium
TNNPWIRFHVPRQWPPWRLV

SEQ ID NO: 779283 - protein, 17 aa, Mycobacterium
TNRKLILVIAVNRTFCG

SEQ ID NO: 779284 - protein, 20 aa, Mycobacterium
TNRSTIRWTLHQMVASGVVR

SEQ ID NO: 779285 - protein, 22 aa, Mycobacterium
TNTFPSWPLAHPFRFVAHNGEI

SEQ ID NO: 779286 - protein, 26 aa, Mycobacterium
TNTFPSWPLAHPFRFVAHNGEINTVR

SEQ ID NO: 779287 - protein, 20 aa, Mycobacterium
TNTFPSWPLAHPYRRVAHNG

SEQ ID NO: 779288 - protein, 19 aa, Mycobacterium
TNTRFCAHWGLAREGRVAY

SEQ ID NO: 779289 - protein, 22 aa, Mycobacterium
TNTRFCAHWGLARNGRVAYVNG

SEQ ID NO: 779290 - protein, 23 aa, Mycobacterium
TNVPRWLSLPARLVMQSLIGRVR

SEQ ID NO: 779291 - protein, 21 aa, Mycobacterium
TNVSHEFRTPLTLLLGPLDDA

SEQ ID NO: 779292 - protein, 24 aa, Mycobacterium
TNYALRMEAAWGREYRRGRIMHKL

SEQ ID NO: 779293 - protein, 18 aa, Mycobacterium
TNYVNSWKRLGFTDSDVA

SEQ ID NO: 779294 - protein, 22 aa, Mycobacterium
TPAARWAFCNGMTPAQRRLTMS

SEQ ID NO: 779295 - protein, 22 aa, Mycobacterium
TPAEFAAACGISGDLQPEPDPE

SEQ ID NO: 779296 - protein, 22 aa, Mycobacterium
TPAEFDRIWVASGMSPIGVFRA

SEQ ID NO: 779297 - protein, 18 aa, Mycobacterium
TPAPRYAGTRVQRVEDGR

SEQ ID NO: 779298 - protein, 23 aa, Mycobacterium
TPAPSRGGSLCTFRETSRILAGL

SEQ ID NO: 779299 - protein, 17 aa, Mycobacterium
TPAPVRGALVARLAELL

SEQ ID NO: 779300 - protein, 17 aa, Mycobacterium
TPAPVRGALVARLGQLL

SEQ ID NO: 779301 - protein, 17 aa, Mycobacterium
TPAQVALAWLRYRADAF

SEQ ID NO: 779302 - protein, 26 aa, Mycobacterium
TPAQVLLRWNLQLGNAVVFRSANAEH

SEQ ID NO: 779303 - protein, 27 aa, Mycobacterium
TPAQVLLRWNLQLGNAVVFRSSQPEHI

SEQ ID NO: 779304 - protein, 21 aa, Mycobacterium
TPAQVLVRWNLQLDNVVVSRS

SEQ ID NO: 779305 - protein, 19 aa, Mycobacterium
TPATPWLASTVRVAWRAKL

SEQ ID NO: 779306 - protein, 22 aa, Mycobacterium
TPCGAGAFTGRFLRSGDTVEVA

SEQ ID NO: 779307 - protein, 22 aa, Mycobacterium
TPDEAFEAWKRCSAGRPCDYTG

SEQ ID NO: 779308 - protein, 20 aa, Mycobacterium
TPEGIKIFLMRRHSAMDFVA

SEQ ID NO: 779309 - protein, 18 aa, Mycobacterium
TPEGPAILDCLEFDDTLR

SEQ ID NO: 779310 - protein, 17 aa, Mycobacterium
TPELVAFMVRYTSGYLC

SEQ ID NO: 779311 - protein, 17 aa, Mycobacterium
TPFLPAGIFDQWGLDAD

SEQ ID NO: 779312 - protein, 22 aa, Mycobacterium
TPGDEVYGLIGFDRDGAAAEFV

SEQ ID NO: 779313 - protein, 26 aa, Mycobacterium
TPGGNGGDGGWLFGSGGNGAAGAAGQ

SEQ ID NO: 779314 - protein, 17 aa, Mycobacterium
TPGLAGLVLGEFRRMSS

SEQ ID NO: 779315 - protein, 25 aa, Mycobacterium
TPGNFFGTMCDFFGLSSFSAMDAAE

SEQ ID NO: 779316 - protein, 20 aa, Mycobacterium
TPGPLKWDLTMGVATDTRES

SEQ ID NO: 779317 - protein, 19 aa, Mycobacterium
TPGPLKWNLTLGVATDTRE

SEQ ID NO: 779318 - protein, 17 aa, Mycobacterium
TPGVFRWRVVVPPRGTW

SEQ ID NO: 779319 - protein, 24 aa, Mycobacterium
TPGYGGGIGRAWLSRGGTFVQANI

SEQ ID NO: 779320 - protein, 20 aa, Mycobacterium
TPHALCWTADFTRDVSRSVI

SEQ ID NO: 779321 - protein, 17 aa, Mycobacterium
TPHVLGCVYSVFTEGYW

SEQ ID NO: 779322 - protein, 17 aa, Mycobacterium
TPIDWSQPFPPAAATSP

SEQ ID NO: 779323 - protein, 17 aa, Mycobacterium
TPIIHWLREAGGATDEF

SEQ ID NO: 779324 - protein, 18 aa, Mycobacterium
TPIRSVLSFKLFRGSQTA

SEQ ID NO: 779325 - protein, 19 aa, Mycobacterium
TPIWCLPKFDFAVPRPLSA

SEQ ID NO: 779326 - protein, 17 aa, Mycobacterium
TPIWGGWITGPTVLGPD

SEQ ID NO: 779327 - protein, 17 aa, Mycobacterium
TPLECPDEFAALIRGAL

SEQ ID NO: 779328 - protein, 18 aa, Mycobacterium
TPLGDLRAEGWITRTDGI

SEQ ID NO: 779329 - protein, 25 aa, Mycobacterium
TPLIRARAAWLWSRRRGIVAGLSAA

SEQ ID NO: 779330 - protein, 19 aa, Mycobacterium
TPLKMCWVPGYSDYYPEAP

SEQ ID NO: 779331 - protein, 23 aa, Mycobacterium
TPLKRWQLCLDVNLTGVFLVTKA

SEQ ID NO: 779332 - protein, 17 aa, Mycobacterium
TPLLKLLLVRAAHATEL

SEQ ID NO: 779333 - protein, 20 aa, Mycobacterium
TPLRPAILWMDARGAAESEQ

SEQ ID NO: 779334 - protein, 18 aa, Mycobacterium
TPLVNWRIPGPELKFEER

SEQ ID NO: 779335 - protein, 18 aa, Mycobacterium
TPLYLRYVIFGGERLTSS

SEQ ID NO: 779336 - protein, 17 aa, Mycobacterium
TPNRLYWMSAWIDPDGT

SEQ ID NO: 779337 - protein, 24 aa, Mycobacterium
TPPARLVGWTSRFLGMVLPGDEIE

SEQ ID NO: 779338 - protein, 20 aa, Mycobacterium
TPPTTMAPVTTTVAPTTVPP

SEQ ID NO: 779339 - protein, 18 aa, Mycobacterium
TPQRAGWFRFYFTDQRWE

SEQ ID NO: 779340 - protein, 19 aa, Mycobacterium
TPRAGLALRRFVAQWLGPA

SEQ ID NO: 779341 - protein, 17 aa, Mycobacterium
TPRRELADFVEWVADRE

SEQ ID NO: 779342 - protein, 22 aa, Mycobacterium
TPRRQCLRITLGTGRNKVTATF

SEQ ID NO: 779343 - protein, 22 aa, Mycobacterium
TPRRYGVRWHFRVPAWSEFVEV

SEQ ID NO: 779344 - protein, 22 aa, Mycobacterium
TPRSGVVVIRLNRPERLNAIND

SEQ ID NO: 779345 - protein, 17 aa, Mycobacterium
TPRWLLHLLSWVPVEAG

SEQ ID NO: 779346 - protein, 19 aa, Mycobacterium
TPRYAEWLLNDADMISAYE

SEQ ID NO: 779347 - protein, 18 aa, Mycobacterium
TPSCPRLSDSIRHAVAEG

SEQ ID NO: 779348 - protein, 21 aa, Mycobacterium
TPSGFEWELGWNPIVVDESTW

SEQ ID NO: 779349 - protein, 17 aa, Mycobacterium
TPSKAWRPTGLPFGGVE

SEQ ID NO: 779350 - protein, 24 aa, Mycobacterium
TPTGERVFLTFLRNQVAAVNELVA

SEQ ID NO: 779351 - protein, 20 aa, Mycobacterium
TPTQLRWRPLSFWPAHTAVT

SEQ ID NO: 779352 - protein, 17 aa, Mycobacterium
TPTVFRPLVNVFFSVIA

SEQ ID NO: 779353 - protein, 17 aa, Mycobacterium
TPVPVFLQRSPHFRPPE

SEQ ID NO: 779354 - protein, 17 aa, Mycobacterium
TPVRARVGHSYIKALMA

SEQ ID NO: 779355 - protein, 17 aa, Mycobacterium
TPVRSRVGHSFIKALMA

SEQ ID NO: 779356 - protein, 17 aa, Mycobacterium
TPWLPGQVQVFIHGEAQ

SEQ ID NO: 779357 - protein, 22 aa, Mycobacterium
TPWLTSRHSFSFGDHYDPDNTH

SEQ ID NO: 779358 - protein, 23 aa, Mycobacterium
TPWNYPFMMAIWKIGPALAAGNT

SEQ ID NO: 779359 - protein, 22 aa, Mycobacterium
TPWSALRWGRIIAEKTDIPAGV

SEQ ID NO: 779360 - protein, 18 aa, Mycobacterium
TQAFSIERAERWGAWALG

SEQ ID NO: 779361 - protein, 22 aa, Mycobacterium
TQALFGRPLIGNGADGAAGTGQ

SEQ ID NO: 779362 - protein, 20 aa, Mycobacterium
TQALLGRALIGNGANGADGT

SEQ ID NO: 779363 - protein, 24 aa, Mycobacterium
TQALLGRPLIGNGASGAPGTGQAG

SEQ ID NO: 779364 - protein, 23 aa, Mycobacterium
TQDSFFPWIWRRLRGLSSADGRE

SEQ ID NO: 779365 - protein, 24 aa, Mycobacterium
TQGMPAYWCRRLANDMVDYVNSYR

SEQ ID NO: 779366 - protein, 17 aa, Mycobacterium
TQHWRIATLLGVASDDL

SEQ ID NO: 779367 - protein, 17 aa, Mycobacterium
TQLCAFAAGVLRAEAAH

SEQ ID NO: 779368 - protein, 17 aa, Mycobacterium
TQLCAFAAGVLRAEASH

SEQ ID NO: 779369 - protein, 18 aa, Mycobacterium
TQLLAWLGADVIKLEAPK

SEQ ID NO: 779370 - protein, 18 aa, Mycobacterium
TQLPITMWQQHFADATTG

SEQ ID NO: 779371 - protein, 19 aa, Mycobacterium
TQLPMMVSFLDFRKIPLVG

SEQ ID NO: 779372 - protein, 22 aa, Mycobacterium
TQLRLGPWVLPKGHMIVGDVWA

SEQ ID NO: 779373 - protein, 20 aa, Mycobacterium
TQLRLKAALVRSIQVSAALD

SEQ ID NO: 779374 - protein, 17 aa, Mycobacterium
TQPQAAKLVEWLKLALD

SEQ ID NO: 779375 - protein, 18 aa, Mycobacterium
TQPVRWDLCTAYLRDHAE

SEQ ID NO: 779376 - protein, 22 aa, Mycobacterium
TQRHLKRLWGLPATQLGVVAWP

SEQ ID NO: 779377 - protein, 22 aa, Mycobacterium
TQSWPAVLTWRAHDEPRMESVR

SEQ ID NO: 779378 - protein, 23 aa, Mycobacterium
TRAAICRFASWWVVLERHGDLIR

SEQ ID NO: 779379 - protein, 18 aa, Mycobacterium
TRAAMQWYWDQYLPDPAL

SEQ ID NO: 779380 - protein, 26 aa, Mycobacterium
TRAEAWPVLCKHLAIIGADGRDPFAT

SEQ ID NO: 779381 - protein, 26 aa, Mycobacterium
TRAEAWPVLCQHLALVAADGRDPVAT

SEQ ID NO: 779382 - protein, 21 aa, Mycobacterium
TRAESRWFASAGFALVNMTGY

SEQ ID NO: 779383 - protein, 21 aa, Mycobacterium
TRAESRWFASAGFSLVNMTGY

SEQ ID NO: 779384 - protein, 20 aa, Mycobacterium
TRAESRWFASQGFTLVNMTG

SEQ ID NO: 779385 - protein, 26 aa, Mycobacterium
TRAFDPLPLCSKICSDGRCPFLHAVR

SEQ ID NO: 779386 - protein, 20 aa, Mycobacterium
TRAGAAISHVATTFGVPAEH

SEQ ID NO: 779387 - protein, 20 aa, Mycobacterium
TRAGDSWILNGFKWFASNCA

SEQ ID NO: 779388 - protein, 18 aa, Mycobacterium
TRAPGPWVRRTKRVPRSP

SEQ ID NO: 779389 - protein, 17 aa, Mycobacterium
TRARISAGLSRQDLARL

SEQ ID NO: 779390 - protein, 19 aa, Mycobacterium
TRARTHLALSWALARSPGG

SEQ ID NO: 779391 - protein, 19 aa, Mycobacterium
TRARVHLALTWALARSPGG

SEQ ID NO: 779392 - protein, 18 aa, Mycobacterium
TRARVSAVRGVNVDAVMR

SEQ ID NO: 779393 - protein, 18 aa, Mycobacterium
TRASPWLTRHPEMPEWHL

SEQ ID NO: 779394 - protein, 18 aa, Mycobacterium
TRAVYKHMAKRGGGAIVN

SEQ ID NO: 779395 - protein, 23 aa, Mycobacterium
TRAYRLGWPGGMTVFEIDQPAVI

SEQ ID NO: 779396 - protein, 20 aa, Mycobacterium
TRCAGAWLWSGRRGIVAGLA

SEQ ID NO: 779397 - protein, 20 aa, Mycobacterium
TRCGDAWLLNGFKWFASNCA

SEQ ID NO: 779398 - protein, 25 aa, Mycobacterium
TRCRLRNGGAWGWRADGYEGAYWCG

SEQ ID NO: 779399 - protein, 25 aa, Mycobacterium
TRDAALYRYLWRSVLEFDGATRFRA

SEQ ID NO: 779400 - protein, 18 aa, Mycobacterium
TRDALAWLRHAGYQRLLD

SEQ ID NO: 779401 - protein, 19 aa, Mycobacterium
TRDAVAAVAGWLRDETATP

SEQ ID NO: 779402 - protein, 20 aa, Mycobacterium
TRDGWRLQIRLDHEQVNPVP

SEQ ID NO: 779403 - protein, 19 aa, Mycobacterium
TRDRLTVAILRDVASEILV

SEQ ID NO: 779404 - protein, 17 aa, Mycobacterium
TRFALRIATELLADGTV

SEQ ID NO: 779405 - protein, 19 aa, Mycobacterium
TRFASRYRVGAAAPGATIT

SEQ ID NO: 779406 - protein, 23 aa, Mycobacterium
TRFDPPYSFSYRVVKCMPPVRHE

SEQ ID NO: 779407 - protein, 22 aa, Mycobacterium
TRFECNLTWLELQWGRTIGQTP

SEQ ID NO: 779408 - protein, 17 aa, Mycobacterium
TRFGWPVFEISTVAREG

SEQ ID NO: 779409 - protein, 17 aa, Mycobacterium
TRFRFFYRVGFTPWEGH

SEQ ID NO: 779410 - protein, 19 aa, Mycobacterium
TRFSASIFEFYADRGAGLL

SEQ ID NO: 779411 - protein, 18 aa, Mycobacterium
TRFTAVPGQGLFYRSGDL

SEQ ID NO: 779412 - protein, 21 aa, Mycobacterium
TRGDGLLVYSVDPLILRQRSP

SEQ ID NO: 779413 - protein, 22 aa, Mycobacterium
TRGHEFLQFLAAVRAELTDPLT

SEQ ID NO: 779414 - protein, 17 aa, Mycobacterium
TRGIIKWGIRDARELES

SEQ ID NO: 779415 - protein, 18 aa, Mycobacterium
TRGPAYWLKHNPYAEWYQ

SEQ ID NO: 779416 - protein, 17 aa, Mycobacterium
TRGRFGTFVARYDPTDA

SEQ ID NO: 779417 - protein, 17 aa, Mycobacterium
TRGSVVFGIEVDSENGP

SEQ ID NO: 779418 - protein, 17 aa, Mycobacterium
TRHPRSLKVCTLLRKPD

SEQ ID NO: 779419 - protein, 17 aa, Mycobacterium
TRIAPALAHRERQIHSG

SEQ ID NO: 779420 - protein, 21 aa, Mycobacterium
TRIGEIVTRLMARFPDVDPAA

SEQ ID NO: 779421 - protein, 22 aa, Mycobacterium
TRIGKSFLLLFGFLPFGFDDIT

SEQ ID NO: 779422 - protein, 19 aa, Mycobacterium
TRILAPRSRYDEIVDAVSN

SEQ ID NO: 779423 - protein, 19 aa, Mycobacterium
TRILAPRSRYDEIVDAVST

SEQ ID NO: 779424 - protein, 20 aa, Mycobacterium
TRILAPRSRYDEVIEKLGEA

SEQ ID NO: 779425 - protein, 19 aa, Mycobacterium
TRIPMTWFQVDQMPLWAKV

SEQ ID NO: 779426 - protein, 20 aa, Mycobacterium
TRIYCAGGWYTGDTLDITTA

SEQ ID NO: 779427 - protein, 17 aa, Mycobacterium
TRKAGAVGLMITEPLDY

SEQ ID NO: 779428 - protein, 17 aa, Mycobacterium
TRKCVFCSKKGKNQVID

SEQ ID NO: 779429 - protein, 19 aa, Mycobacterium
TRKCVFCSKKGQTIDYKDT

SEQ ID NO: 779430 - protein, 18 aa, Mycobacterium
TRKSFAIAGTRVIDTIKL

SEQ ID NO: 779431 - protein, 18 aa, Mycobacterium
TRKSFGIAGARVSDAIKL

SEQ ID NO: 779432 - protein, 19 aa, Mycobacterium
TRKSFGIAGPRVVDGLELS

SEQ ID NO: 779433 - protein, 20 aa, Mycobacterium
TRLAPIWSRLAVGGVLMTIN

SEQ ID NO: 779434 - protein, 22 aa, Mycobacterium
TRLARYEIPTALILTDAIPRTP

SEQ ID NO: 779435 - protein, 17 aa, Mycobacterium
TRLDALIGHGVTEVRSL

SEQ ID NO: 779436 - protein, 22 aa, Mycobacterium
TRLDRFIGLVVIDRGHPRVADL

SEQ ID NO: 779437 - protein, 22 aa, Mycobacterium
TRLEATVLRDGYEWFQYYDRSV

SEQ ID NO: 779438 - protein, 17 aa, Mycobacterium
TRLGALAARLWLPLLNA

SEQ ID NO: 779439 - protein, 19 aa, Mycobacterium
TRLGKITAITVNWSSLESS

SEQ ID NO: 779440 - protein, 23 aa, Mycobacterium
TRLLGFDCAIAYHNRRRIDGSPY

SEQ ID NO: 779441 - protein, 25 aa, Mycobacterium
TRLPEWYRYNAALLLADRTSVVPMA

SEQ ID NO: 779442 - protein, 17 aa, Mycobacterium
TRLPFYANWIRLKSYWG

SEQ ID NO: 779443 - protein, 17 aa, Mycobacterium
TRLPVNRGFHSALVDPA

SEQ ID NO: 779444 - protein, 17 aa, Mycobacterium
TRLPYYANWIRLKSYWG

SEQ ID NO: 779445 - protein, 17 aa, Mycobacterium
TRLQWYVELGIDPQNLR

SEQ ID NO: 779446 - protein, 22 aa, Mycobacterium
TRLRPDLRPDWPQPASGGGSYR

SEQ ID NO: 779447 - protein, 17 aa, Mycobacterium
TRLRRWNAPGGKPRRAG

SEQ ID NO: 779448 - protein, 17 aa, Mycobacterium
TRLRVGLPMAPNTVFIA

SEQ ID NO: 779449 - protein, 23 aa, Mycobacterium
TRLSDRVLLRFGLHQALRLGKPL

SEQ ID NO: 779450 - protein, 23 aa, Mycobacterium
TRLTDRVLLRFGLHRALRIGKPL

SEQ ID NO: 779451 - protein, 26 aa, Mycobacterium
TRLWARMWLLRFTWQRAIDSGDLTSP

SEQ ID NO: 779452 - protein, 22 aa, Mycobacterium
TRLYLPMPFFWVGGFGSGILST

SEQ ID NO: 779453 - protein, 20 aa, Mycobacterium
TRMLLPRSRYDEGVAILKNL

SEQ ID NO: 779454 - protein, 18 aa, Mycobacterium
TRMNEIRLWLPYDEVLPR

SEQ ID NO: 779455 - protein, 24 aa, Mycobacterium
TRMVGGPEVVVWLDTLAALGRSAF

SEQ ID NO: 779456 - protein, 21 aa, Mycobacterium
TRPDAAAGRRGRPSPSPVAEL

SEQ ID NO: 779457 - protein, 18 aa, Mycobacterium
TRPECIEVLFAEVAEGAG

SEQ ID NO: 779458 - protein, 23 aa, Mycobacterium
TRPEFAAAVLGIWRLAATAVLIS

SEQ ID NO: 779459 - protein, 19 aa, Mycobacterium
TRPETAADEIVRWATPVTS

SEQ ID NO: 779460 - protein, 20 aa, Mycobacterium
TRPFGPICEFVRATGEIHLN

SEQ ID NO: 779461 - protein, 19 aa, Mycobacterium
TRPFGPMCVMMRGSGEIYL

SEQ ID NO: 779462 - protein, 20 aa, Mycobacterium
TRPKGTVFFRSGGDGGFGGW

SEQ ID NO: 779463 - protein, 27 aa, Mycobacterium
TRPPIWCPSAAFGLSWSYRGLLDHVDD

SEQ ID NO: 779464 - protein, 21 aa, Mycobacterium
TRPRPEVFAAYGRTFPDLTLT

SEQ ID NO: 779465 - protein, 23 aa, Mycobacterium
TRPRWKRDLAWWFGGKVLATARA

SEQ ID NO: 779466 - protein, 18 aa, Mycobacterium
TRPVEFWPTAAIRAALES

SEQ ID NO: 779467 - protein, 23 aa, Mycobacterium
TRQLRAGKVFVDWSQNSGSKTTV

SEQ ID NO: 779468 - protein, 18 aa, Mycobacterium
TRRAKCLLQTLAFGLGAG

SEQ ID NO: 779469 - protein, 19 aa, Mycobacterium
TRRAMALLAIRNFESYLDT

SEQ ID NO: 779470 - protein, 20 aa, Mycobacterium
TRRFSVEILSRMSGQRSLIS

SEQ ID NO: 779471 - protein, 18 aa, Mycobacterium
TRRIRFWFGDPVPMRRHF

SEQ ID NO: 779472 - protein, 17 aa, Mycobacterium
TRRRLPLLIAPPNVLFA

SEQ ID NO: 779473 - protein, 17 aa, Mycobacterium
TRRVPGYHILKAHMSAS

SEQ ID NO: 779474 - protein, 25 aa, Mycobacterium
TRRWAVAHPACWALLYGSPVPGYHA

SEQ ID NO: 779475 - protein, 17 aa, Mycobacterium
TRRWPDLLTWTSQASSS

SEQ ID NO: 779476 - protein, 19 aa, Mycobacterium
TRSAAKAWAADKITVNALA

SEQ ID NO: 779477 - protein, 20 aa, Mycobacterium
TRSGCYFCFYQRKAEWVGLA

SEQ ID NO: 779478 - protein, 24 aa, Mycobacterium
TRSLRAGKVFLDWSQNNGSKTTIA

SEQ ID NO: 779479 - protein, 23 aa, Mycobacterium
TRTDEFYLYAGFHHLVCDGFGAM

SEQ ID NO: 779480 - protein, 23 aa, Mycobacterium
TRTRLGDPPAWFGVIKPLQIAPV

SEQ ID NO: 779481 - protein, 25 aa, Mycobacterium
TRTTLPGGLTWPLGLAVDADGDLYI

SEQ ID NO: 779482 - protein, 17 aa, Mycobacterium
TRVAAVAPCTSDTGTAG

SEQ ID NO: 779483 - protein, 18 aa, Mycobacterium
TRVAELRGLVAPADAVFL

SEQ ID NO: 779484 - protein, 25 aa, Mycobacterium
TRVPDRVAAALSFHGGRIAVEDDPD

SEQ ID NO: 779485 - protein, 19 aa, Mycobacterium
TRVTVEWPRNTPLLDVLLA

SEQ ID NO: 779486 - protein, 20 aa, Mycobacterium
TRWALDLLRRRFAKVIWVPG

SEQ ID NO: 779487 - protein, 22 aa, Mycobacterium
TRWPELRAALTAAFAAHDRDHW

SEQ ID NO: 779488 - protein, 17 aa, Mycobacterium
TRYAPGGVRSFGPLRAS

SEQ ID NO: 779489 - protein, 21 aa, Mycobacterium
TRYAWGEIWTRPGLDRRSRSM

SEQ ID NO: 779490 - protein, 22 aa, Mycobacterium
TRYELVDGFPRFDVDDVYLGNG

SEQ ID NO: 779491 - protein, 25 aa, Mycobacterium
TRYELVEGFPRFDIDDVFLGNGVSE

SEQ ID NO: 779492 - protein, 17 aa, Mycobacterium
TRYEPVLGMEVHVELST

SEQ ID NO: 779493 - protein, 19 aa, Mycobacterium
TRYFRPRFAAVPFKAGEEQ

SEQ ID NO: 779494 - protein, 17 aa, Mycobacterium
TSAIAAAAADEISAAIA

SEQ ID NO: 779495 - protein, 17 aa, Mycobacterium
TSAIRWVLGRKRIRSGI

SEQ ID NO: 779496 - protein, 23 aa, Mycobacterium
TSAKLRRRAVRIVRDAAGVDEET

SEQ ID NO: 779497 - protein, 22 aa, Mycobacterium
TSAPFSEIWYLLTGQTTLPTSL

SEQ ID NO: 779498 - protein, 21 aa, Mycobacterium
TSAQVALAWLLARGDDIVPIP

SEQ ID NO: 779499 - protein, 20 aa, Mycobacterium
TSEALGGIVMRCAAGMLIES

SEQ ID NO: 779500 - protein, 17 aa, Mycobacterium
TSFARWSALLADHACRP

SEQ ID NO: 779501 - protein, 19 aa, Mycobacterium
TSFARWSALLAERARRPEV

SEQ ID NO: 779502 - protein, 17 aa, Mycobacterium
TSFARWSSLLAEHAKDP

SEQ ID NO: 779503 - protein, 18 aa, Mycobacterium
TSFARWSSLLAEHAQSPA

SEQ ID NO: 779504 - protein, 22 aa, Mycobacterium
TSFDSFELWNAWFRVWTIGTLY

SEQ ID NO: 779505 - protein, 28 aa, Mycobacterium
TSFVAVCGQCRWCASGMEYLCDTGAGTL

SEQ ID NO: 779506 - protein, 28 aa, Mycobacterium
TSFVAVCGQCRWCASGMEYLCDTGSGTL

SEQ ID NO: 779507 - protein, 24 aa, Mycobacterium
TSGEQRLSGFLLWQSAYSEMWFTD

SEQ ID NO: 779508 - protein, 25 aa, Mycobacterium
TSGRIERFLLLWAEGSMTIAVPSTP

SEQ ID NO: 779509 - protein, 19 aa, Mycobacterium
TSHWLTIPALKAFGAIPVA

SEQ ID NO: 779510 - protein, 18 aa, Mycobacterium
TSIAIAMHELVAFRMTPL

SEQ ID NO: 779511 - protein, 20 aa, Mycobacterium
TSKTRFVIVDAIGVTEHEFV

SEQ ID NO: 779512 - protein, 25 aa, Mycobacterium
TSLAKRTQVLFAFRELLNARKEEVA

SEQ ID NO: 779513 - protein, 20 aa, Mycobacterium
TSLAVLRLLAGRARITNGEI

SEQ ID NO: 779514 - protein, 19 aa, Mycobacterium
TSLCPWKGVAHYYTVVVDG

SEQ ID NO: 779515 - protein, 18 aa, Mycobacterium
TSLELEYFGSMWPNNSAV

SEQ ID NO: 779516 - protein, 25 aa, Mycobacterium
TSLIRAGVITPIFKGAGTTLFDEHS

SEQ ID NO: 779517 - protein, 17 aa, Mycobacterium
TSLKSLWVGEGEAVGDV

SEQ ID NO: 779518 - protein, 24 aa, Mycobacterium
TSLPEVRSQLALTWGTETFIVPHI

SEQ ID NO: 779519 - protein, 17 aa, Mycobacterium
TSLPGVMKLAGLVTNTP

SEQ ID NO: 779520 - protein, 18 aa, Mycobacterium
TSLPNWWPSILAPAVAGA

SEQ ID NO: 779521 - protein, 17 aa, Mycobacterium
TSLPNWWPSILAPIVAG

SEQ ID NO: 779522 - protein, 17 aa, Mycobacterium
TSMLCCLPRPARLRESV

SEQ ID NO: 779523 - protein, 28 aa, Mycobacterium
TSNPGWLQWLIDWYMPISQLIYNTVGLP

SEQ ID NO: 779524 - protein, 23 aa, Mycobacterium
TSPDIRALYAFKRLAWWPYSVAM

SEQ ID NO: 779525 - protein, 18 aa, Mycobacterium
TSRLRLAARASLTDDEMA

SEQ ID NO: 779526 - protein, 24 aa, Mycobacterium
TSRPCPTCRGVGVVIPDPCHQCMG

SEQ ID NO: 779527 - protein, 22 aa, Mycobacterium
TSRPDALLPLARRETGECLAED

SEQ ID NO: 779528 - protein, 20 aa, Mycobacterium
TSRSWAWLCGRNYVTPDDVK

SEQ ID NO: 779529 - protein, 20 aa, Mycobacterium
TSSKLSVCFAHLDDVAVRVA

SEQ ID NO: 779530 - protein, 26 aa, Mycobacterium
TSTRYPGGMALRFARVVRYRDDKAAT

SEQ ID NO: 779531 - protein, 18 aa, Mycobacterium
TSTYCPFKGDASYYSVTT

SEQ ID NO: 779532 - protein, 17 aa, Mycobacterium
TSVALLFSRSAQAIVAI

SEQ ID NO: 779533 - protein, 20 aa, Mycobacterium
TSVPAFRPGAQFKAVISGAQ

SEQ ID NO: 779534 - protein, 18 aa, Mycobacterium
TSVPAFRPGAQFKAVVAG

SEQ ID NO: 779535 - protein, 18 aa, Mycobacterium
TSVWGRRDLVEYSVEHAV

SEQ ID NO: 779536 - protein, 18 aa, Mycobacterium
TSWSKPGLIPVALVIVNV

SEQ ID NO: 779537 - protein, 18 aa, Mycobacterium
TSWSKPGLIPVALVVVNV

SEQ ID NO: 779538 - protein, 18 aa, Mycobacterium
TSYRAGVFEAEFGDGSKL

SEQ ID NO: 779539 - protein, 22 aa, Mycobacterium
TTAASRYVDWLGRTAAQAEQSA

SEQ ID NO: 779540 - protein, 23 aa, Mycobacterium
TTAIRYPLRWHHVGLIMWSGDQG

SEQ ID NO: 779541 - protein, 20 aa, Mycobacterium
TTARLTGRWFRGRIPTVNDW

SEQ ID NO: 779542 - protein, 19 aa, Mycobacterium
TTARLTGRWLRGRLPVASD

SEQ ID NO: 779543 - protein, 22 aa, Mycobacterium
TTCGRPFADFELRIGPDTGEVL

SEQ ID NO: 779544 - protein, 21 aa, Mycobacterium
TTCGRPIADFELRLDDSGEVL

SEQ ID NO: 779545 - protein, 18 aa, Mycobacterium
TTCGRPMLGYELRIDGAE

SEQ ID NO: 779546 - protein, 18 aa, Mycobacterium
TTDGAAFHRLCFGLAAGG

SEQ ID NO: 779547 - protein, 18 aa, Mycobacterium
TTEGLSMPEIIRCQKRYL

SEQ ID NO: 779548 - protein, 23 aa, Mycobacterium
TTEYHGLHAFRWIAADGSARFVR

SEQ ID NO: 779549 - protein, 17 aa, Mycobacterium
TTFDWGVPVPDHPDHVM

SEQ ID NO: 779550 - protein, 17 aa, Mycobacterium
TTFPYVLCDATFCKVHI

SEQ ID NO: 779551 - protein, 18 aa, Mycobacterium
TTGAWRAGGDGGSGGDGG

SEQ ID NO: 779552 - protein, 24 aa, Mycobacterium
TTGRLGLIPLRWALACLLIDIGSV

SEQ ID NO: 779553 - protein, 23 aa, Mycobacterium
TTGTSPLQLAINAVSAPAQSLLA

SEQ ID NO: 779554 - protein, 26 aa, Mycobacterium
TTGVWTSGFGYRWGVLHAGIDIANAI

SEQ ID NO: 779555 - protein, 24 aa, Mycobacterium
TTHELWPGKAYPLGATYDGSGTNF

SEQ ID NO: 779556 - protein, 18 aa, Mycobacterium
TTHWRWADELRRLHPKIA

SEQ ID NO: 779557 - protein, 18 aa, Mycobacterium
TTIAHGFMTLALLPRLQH

SEQ ID NO: 779558 - protein, 18 aa, Mycobacterium
TTIFPFRRLFIVAEVGGA

SEQ ID NO: 779559 - protein, 22 aa, Mycobacterium
TTIGIPYLEGWVPRVMADGRTA

SEQ ID NO: 779560 - protein, 17 aa, Mycobacterium
TTKGEAECAQWVAEQLA

SEQ ID NO: 779561 - protein, 17 aa, Mycobacterium
TTLFPPVRPRQWLEIRY

SEQ ID NO: 779562 - protein, 18 aa, Mycobacterium
TTLKAAACLQAFGETSVD

SEQ ID NO: 779563 - protein, 18 aa, Mycobacterium
TTLLGGLGYRGFFELGDA

SEQ ID NO: 779564 - protein, 18 aa, Mycobacterium
TTLRLAMHAVEIGMREVF

SEQ ID NO: 779565 - protein, 22 aa, Mycobacterium
TTLRRFSVARVRLSDLHTVARA

SEQ ID NO: 779566 - protein, 18 aa, Mycobacterium
TTNRPGARFGPRAIRATA

SEQ ID NO: 779567 - protein, 22 aa, Mycobacterium
TTPRVAQMFGVQAVPTVVALAA

SEQ ID NO: 779568 - protein, 19 aa, Mycobacterium
TTPYLPLSWQRKAVQMIAP

SEQ ID NO: 779569 - protein, 21 aa, Mycobacterium
TTQGPGAWPRCSSCSRGDGPV

SEQ ID NO: 779570 - protein, 18 aa, Mycobacterium
TTRFSVRMKHEFYSLVER

SEQ ID NO: 779571 - protein, 18 aa, Mycobacterium
TTRIEFMLTDAAPVAAVT

SEQ ID NO: 779572 - protein, 19 aa, Mycobacterium
TTRRLPFGVAVLGGPTTVV

SEQ ID NO: 779573 - protein, 20 aa, Mycobacterium
TTSICPWKGVASYYTVVVDG

SEQ ID NO: 779574 - protein, 25 aa, Mycobacterium
TTSWCGYCFRLKTALKTEGITYTEV

SEQ ID NO: 779575 - protein, 24 aa, Mycobacterium
TTTLRAGAVLGVIMLGLTGCGGQR

SEQ ID NO: 779576 - protein, 18 aa, Mycobacterium
TTTWRLATLFGLLDAVAA

SEQ ID NO: 779577 - protein, 23 aa, Mycobacterium
TTVEASMIWQWFIDPVVREQFPD

SEQ ID NO: 779578 - protein, 17 aa, Mycobacterium
TTVHWKLNPNGTINTGG

SEQ ID NO: 779579 - protein, 19 aa, Mycobacterium
TTVPTEFQSLVVHDATGDP

SEQ ID NO: 779580 - protein, 17 aa, Mycobacterium
TTVRLEPIIGRIEEDGV

SEQ ID NO: 779581 - protein, 17 aa, Mycobacterium
TTWPDKRIDLYFPGERP

SEQ ID NO: 779582 - protein, 18 aa, Mycobacterium
TVADCLRYEVAPFGITVS

SEQ ID NO: 779583 - protein, 17 aa, Mycobacterium
TVADIYRHFGLTLTDEA

SEQ ID NO: 779584 - protein, 17 aa, Mycobacterium
TVADMMIYLAWTMGGRG

SEQ ID NO: 779585 - protein, 17 aa, Mycobacterium
TVADMMIYLTWTMDGRG

SEQ ID NO: 779586 - protein, 23 aa, Mycobacterium
TVAELKRAYSLGVRSIRVAAHCT

SEQ ID NO: 779587 - protein, 24 aa, Mycobacterium
TVAGSLRASREWGLPHDLLDGKEV

SEQ ID NO: 779588 - protein, 22 aa, Mycobacterium
TVARLGVRPVRCVLIDCAEAGV

SEQ ID NO: 779589 - protein, 19 aa, Mycobacterium
TVDLHWRRVEALRAAIGPL

SEQ ID NO: 779590 - protein, 19 aa, Mycobacterium
TVDQIACVRRACQITEEAV

SEQ ID NO: 779591 - protein, 25 aa, Mycobacterium
TVENGARLNIPWRRDFNALVYVLSG

SEQ ID NO: 779592 - protein, 17 aa, Mycobacterium
TVFASNFLGMWGTQLQA

SEQ ID NO: 779593 - protein, 19 aa, Mycobacterium
TVFGWSMRVGLRVSAARQA

SEQ ID NO: 779594 - protein, 23 aa, Mycobacterium
TVFQCPFCHAWELRDQRLATLAA

SEQ ID NO: 779595 - protein, 21 aa, Mycobacterium
TVFWPIPRVYSGLVRIDRYET

SEQ ID NO: 779596 - protein, 22 aa, Mycobacterium
TVFWPIPRVYSGLVRIDRYETS

SEQ ID NO: 779597 - protein, 23 aa, Mycobacterium
TVGEAFAGLAQMRVKDVLREVFT

SEQ ID NO: 779598 - protein, 23 aa, Mycobacterium
TVGIPMRCVFALTAMGFLPQTGD

SEQ ID NO: 779599 - protein, 22 aa, Mycobacterium
TVGRIWKALGLKPHLVDTFKLS

SEQ ID NO: 779600 - protein, 17 aa, Mycobacterium
TVGSLGWIVIRVINEDR

SEQ ID NO: 779601 - protein, 18 aa, Mycobacterium
TVGVPWLAAFAERSKFAE

SEQ ID NO: 779602 - protein, 20 aa, Mycobacterium
TVIDPRWVLPVADGIGDLAV

SEQ ID NO: 779603 - protein, 19 aa, Mycobacterium
TVIESRVAWYLTDKLNGGW

SEQ ID NO: 779604 - protein, 17 aa, Mycobacterium
TVIKWRDRFAAFGIEGL

SEQ ID NO: 779605 - protein, 18 aa, Mycobacterium
TVLACFKLGIILEGTHAR

SEQ ID NO: 779606 - protein, 18 aa, Mycobacterium
TVLPPLLVPRAFVPVAAL

SEQ ID NO: 779607 - protein, 17 aa, Mycobacterium
TVLQGRVAFAWRAMDAF

SEQ ID NO: 779608 - protein, 19 aa, Mycobacterium
TVLRWPFLDFNKILDRPLE

SEQ ID NO: 779609 - protein, 18 aa, Mycobacterium
TVLTKWKYSEFFRSDLLE

SEQ ID NO: 779610 - protein, 24 aa, Mycobacterium
TVMLRRMAWYWARIWIEVTPVRVL

SEQ ID NO: 779611 - protein, 23 aa, Mycobacterium
TVNRIPAFMTIDAPVNIPITGTI

SEQ ID NO: 779612 - protein, 21 aa, Mycobacterium
TVPDFPNLFLIYGPGTHLAHG

SEQ ID NO: 779613 - protein, 18 aa, Mycobacterium
TVPLPPWLAERMADYLAT

SEQ ID NO: 779614 - protein, 20 aa, Mycobacterium
TVPPLLKWFATRPLIAGVVT

SEQ ID NO: 779615 - protein, 24 aa, Mycobacterium
TVPSIPLPFGLWIGSPQMQQGVAS

SEQ ID NO: 779616 - protein, 24 aa, Mycobacterium
TVPSIPLPFGMWIGGAQMQQGVGS

SEQ ID NO: 779617 - protein, 21 aa, Mycobacterium
TVRNHLRWIAATHRIASRRVD

SEQ ID NO: 779618 - protein, 24 aa, Mycobacterium
TVRRFGEQRLRPFVAEWFESGSVP

SEQ ID NO: 779619 - protein, 19 aa, Mycobacterium
TVRRLCWDWQPPADGDATA

SEQ ID NO: 779620 - protein, 23 aa, Mycobacterium
TVRRLEARLAQWAAALEAGTGRG

SEQ ID NO: 779621 - protein, 21 aa, Mycobacterium
TVRYRLRRIADFTGRDPAVPR

SEQ ID NO: 779622 - protein, 22 aa, Mycobacterium
TVSRLGFGTMRFTGRGIWGEPA

SEQ ID NO: 779623 - protein, 23 aa, Mycobacterium
TVSVEFTSYVPPAITGTFGLPVA

SEQ ID NO: 779624 - protein, 18 aa, Mycobacterium
TVTCPRDLVLSAPVKLTE

SEQ ID NO: 779625 - protein, 20 aa, Mycobacterium
TVTGATIVRWIIYQDTGTAG

SEQ ID NO: 779626 - protein, 22 aa, Mycobacterium
TVVASLFSRYAQAYQVLGADMA

SEQ ID NO: 779627 - protein, 20 aa, Mycobacterium
TVVQHWTVSHLKPSTDTIPY

SEQ ID NO: 779628 - protein, 19 aa, Mycobacterium
TVVWLPRFFTESAMEDLAL

SEQ ID NO: 779629 - protein, 17 aa, Mycobacterium
TVWGVGIAPSITTASLR

SEQ ID NO: 779630 - protein, 25 aa, Mycobacterium
TVWIPRPLGALAFVMRWVPSSVWRR

SEQ ID NO: 779631 - protein, 18 aa, Mycobacterium
TVYRHWPDKGALIADALA

SEQ ID NO: 779632 - protein, 20 aa, Mycobacterium
TWCGYCRRLETQLKAAGIDY

SEQ ID NO: 779633 - protein, 22 aa, Mycobacterium
TWDELPAPIATYLGARPKDDTA

SEQ ID NO: 779634 - protein, 17 aa, Mycobacterium
TWDTMKPLYANGAVYRE

SEQ ID NO: 779635 - protein, 19 aa, Mycobacterium
TWECVAHVYLRRALTSTEL

SEQ ID NO: 779636 - protein, 18 aa, Mycobacterium
TWHGRRFYFTFSAYAQSK

SEQ ID NO: 779637 - protein, 20 aa, Mycobacterium
TWLECLPRGKARRSVAVSAL

SEQ ID NO: 779638 - protein, 23 aa, Mycobacterium
TWLGRFVSTYGWRAYALPVLAVL

SEQ ID NO: 779639 - protein, 18 aa, Mycobacterium
TWLQFPKWFYDNLPVNTM

SEQ ID NO: 779640 - protein, 18 aa, Mycobacterium
TWLQFPQWFYFNIPVNTM

SEQ ID NO: 779641 - protein, 17 aa, Mycobacterium
TWLQFPQWFYLNIPVNT

SEQ ID NO: 779642 - protein, 18 aa, Mycobacterium
TWLRLGALVLVTAGFPRP

SEQ ID NO: 779643 - protein, 23 aa, Mycobacterium
TWPNLRGAPRLGISVLGESHDEA

SEQ ID NO: 779644 - protein, 18 aa, Mycobacterium
TWPPPGVVYREFALRADG

SEQ ID NO: 779645 - protein, 23 aa, Mycobacterium
TWPRLKVAPMLGISVLGETHDEA

SEQ ID NO: 779646 - protein, 18 aa, Mycobacterium
TWQLRARFAAGLSARYAA

SEQ ID NO: 779647 - protein, 21 aa, Mycobacterium
TWRSMIKDGLAMRHGKELTWS

SEQ ID NO: 779648 - protein, 17 aa, Mycobacterium
TWRSMISDGLAMRHGKE

SEQ ID NO: 779649 - protein, 21 aa, Mycobacterium
TWRYDAIRTFPDFSGLWDDVD

SEQ ID NO: 779650 - protein, 18 aa, Mycobacterium
TWSAEGWVTVAGLVADDG

SEQ ID NO: 779651 - protein, 21 aa, Mycobacterium
TWSRWGEPLLPIGVLYDPFVE

SEQ ID NO: 779652 - protein, 17 aa, Mycobacterium
TWVSVRWFRPGGSRTAQ

SEQ ID NO: 779653 - protein, 18 aa, Mycobacterium
TWVSVRWYKPGGALTAQQ

SEQ ID NO: 779654 - protein, 24 aa, Mycobacterium
TYAVPRLLARNGLSLQEFDFYEIH

SEQ ID NO: 779655 - protein, 18 aa, Mycobacterium
TYDAQGWIITATTDGTRF

SEQ ID NO: 779656 - protein, 22 aa, Mycobacterium
TYDKRWDKALGRLTDADAEALQ

SEQ ID NO: 779657 - protein, 20 aa, Mycobacterium
TYENAMRWYSFDPFSHITRE

SEQ ID NO: 779658 - protein, 21 aa, Mycobacterium
TYENAMRWYSFDPFTHISREQ

SEQ ID NO: 779659 - protein, 18 aa, Mycobacterium
TYLLSGLLRCRRCGNRLY

SEQ ID NO: 779660 - protein, 25 aa, Mycobacterium
TYPFRQTRYWPRLRAAGGAPFLSPV

SEQ ID NO: 779661 - protein, 18 aa, Mycobacterium
TYRLDWCTVREVEPEILA

SEQ ID NO: 779662 - protein, 17 aa, Mycobacterium
TYRLDWPSGTTVFEIDL

SEQ ID NO: 779663 - protein, 19 aa, Mycobacterium
TYRQEWPLSDTFRFMVNYL

SEQ ID NO: 779664 - protein, 23 aa, Mycobacterium
TYYYKTGIAFLSWLNGLQPGFTM

SEQ ID NO: 779665 - protein, 19 aa, Mycobacterium
VAAAAAWDVLANGLETASR

SEQ ID NO: 779666 - protein, 19 aa, Mycobacterium
VAAAEWWCRTGTMPREALV

SEQ ID NO: 779667 - protein, 19 aa, Mycobacterium
VAAAWEYAMAGGRVSHTRI

SEQ ID NO: 779668 - protein, 17 aa, Mycobacterium
VAACATAAVSVEEGVDK

SEQ ID NO: 779669 - protein, 22 aa, Mycobacterium
VAACLRAGFPQQRLSCDVLTRF

SEQ ID NO: 779670 - protein, 19 aa, Mycobacterium
VAADFSVGMLKAGARRDVP

SEQ ID NO: 779671 - protein, 17 aa, Mycobacterium
VAADLRTDWSRALEAAG

SEQ ID NO: 779672 - protein, 25 aa, Mycobacterium
VAADPSCGWGWLPYRAAPERAVAAV

SEQ ID NO: 779673 - protein, 21 aa, Mycobacterium
VAADWPPKRVGAVTGIPEARI

SEQ ID NO: 779674 - protein, 19 aa, Mycobacterium
VAAGIPWTLVDGTDRAHPE

SEQ ID NO: 779675 - protein, 23 aa, Mycobacterium
VAAHAAVAWDILQRAKQFRDALA

SEQ ID NO: 779676 - protein, 17 aa, Mycobacterium
VAAICHGPWTLVEAGVA

SEQ ID NO: 779677 - protein, 21 aa, Mycobacterium
VAAICHGPWTLVEAGVAEGRT

SEQ ID NO: 779678 - protein, 19 aa, Mycobacterium
VAAIWGCFLGGIVPVPVAP

SEQ ID NO: 779679 - protein, 17 aa, Mycobacterium
VAAKLPWFTLGDPYVSG

SEQ ID NO: 779680 - protein, 18 aa, Mycobacterium
VAALARWSGDLTIAEDAV

SEQ ID NO: 779681 - protein, 22 aa, Mycobacterium
VAANLEMRWEMVGSPLLSKLLK

SEQ ID NO: 779682 - protein, 22 aa, Mycobacterium
VAARGIEIGHVFQLGRKYADAF

SEQ ID NO: 779683 - protein, 18 aa, Mycobacterium
VAARRVRTAHAFHSRLMD

SEQ ID NO: 779684 - protein, 18 aa, Mycobacterium
VAATIPQLVQLAPQAGQM

SEQ ID NO: 779685 - protein, 18 aa, Mycobacterium
VAAVAGWLRDETATPPAR

SEQ ID NO: 779686 - protein, 20 aa, Mycobacterium
VAAVCPRTKIVLGGMSQGAG

SEQ ID NO: 779687 - protein, 18 aa, Mycobacterium
VAAVPELIGWRVGYEVAE

SEQ ID NO: 779688 - protein, 18 aa, Mycobacterium
VAAWLVLCCRALTAGAQE

SEQ ID NO: 779689 - protein, 24 aa, Mycobacterium
VAAWPRALCVPSWLRQWEDKTSYV

SEQ ID NO: 779690 - protein, 28 aa, Mycobacterium
VAAWPRLVRRLPVLGPWVRNLLDADARE

SEQ ID NO: 779691 - protein, 18 aa, Mycobacterium
VACFSGAVPDGWRVIGRV

SEQ ID NO: 779692 - protein, 17 aa, Mycobacterium
VACGIAGLAAWLPLTRH

SEQ ID NO: 779693 - protein, 28 aa, Mycobacterium
VACGLARHVLCFRTLWEATHGELMKQGK

SEQ ID NO: 779694 - protein, 17 aa, Mycobacterium
VACGRALTQTSFDPSTL

SEQ ID NO: 779695 - protein, 18 aa, Mycobacterium
VACGTAFHSGLLAKYAIE

SEQ ID NO: 779696 - protein, 18 aa, Mycobacterium
VACLGSWNHRVFDVHGIY

SEQ ID NO: 779697 - protein, 20 aa, Mycobacterium
VACPFGGPGDRMYRTGDLVC

SEQ ID NO: 779698 - protein, 21 aa, Mycobacterium
VACPFGRPGVRMYRTGDLARY

SEQ ID NO: 779699 - protein, 19 aa, Mycobacterium
VACSWDCPFDGPTAQKRVL

SEQ ID NO: 779700 - protein, 23 aa, Mycobacterium
VADDLPRLVAMLFSVLSTMDANS

SEQ ID NO: 779701 - protein, 18 aa, Mycobacterium
VADEFPDGVWLFELAAVS

SEQ ID NO: 779702 - protein, 17 aa, Mycobacterium
VADFGRIRRIAVAEETA

SEQ ID NO: 779703 - protein, 17 aa, Mycobacterium
VADIIAPVLGWTAEDIG

SEQ ID NO: 779704 - protein, 21 aa, Mycobacterium
VADILFRVGIDYDLSRVFQEH

SEQ ID NO: 779705 - protein, 17 aa, Mycobacterium
VAEALRLGVKIAGALAS

SEQ ID NO: 779706 - protein, 18 aa, Mycobacterium
VAECLRAGVWEELDAAEL

SEQ ID NO: 779707 - protein, 17 aa, Mycobacterium
VAEELSFEPAFRAAEAA

SEQ ID NO: 779708 - protein, 19 aa, Mycobacterium
VAEFSRWYAGEVDLSAPPP

SEQ ID NO: 779709 - protein, 18 aa, Mycobacterium
VAEFSRWYAGEVDLSDPP

SEQ ID NO: 779710 - protein, 17 aa, Mycobacterium
VAEFVPRISALIDVVHR

SEQ ID NO: 779711 - protein, 23 aa, Mycobacterium
VAEGFPSLSAIILNGGLKLHPRI

SEQ ID NO: 779712 - protein, 26 aa, Mycobacterium
VAEGLAAMGFRCILPTWPLGSHTIPA

SEQ ID NO: 779713 - protein, 22 aa, Mycobacterium
VAEGVRLGARFGVDEGALLNAL

SEQ ID NO: 779714 - protein, 18 aa, Mycobacterium
VAELLLLGLPYRDIGRQL

SEQ ID NO: 779715 - protein, 25 aa, Mycobacterium
VAELPRILGPHGRHMFHLFEGTTSS

SEQ ID NO: 779716 - protein, 18 aa, Mycobacterium
VAELRRRGVTWSRVGEAL

SEQ ID NO: 779717 - protein, 23 aa, Mycobacterium
VAELRSGMTIGLGGWGSRRKPMA

SEQ ID NO: 779718 - protein, 26 aa, Mycobacterium
VAELWRRGSVIGSWLLDLTAIALHES

SEQ ID NO: 779719 - protein, 23 aa, Mycobacterium
VAEMPRFGWPTVVVSGGHDLTTP

SEQ ID NO: 779720 - protein, 18 aa, Mycobacterium
VAEPRLLVDVSRLDLTEV

SEQ ID NO: 779721 - protein, 19 aa, Mycobacterium
VAERLRVLIDWTGAHLAEV

SEQ ID NO: 779722 - protein, 17 aa, Mycobacterium
VAERLRVLIDWTSDHLA

SEQ ID NO: 779723 - protein, 17 aa, Mycobacterium
VAERRLWIAVLKAQAEL

SEQ ID NO: 779724 - protein, 19 aa, Mycobacterium
VAETIDWARTVLALGMDTI

SEQ ID NO: 779725 - protein, 19 aa, Mycobacterium
VAETIDWGRTVLALGMDTI

SEQ ID NO: 779726 - protein, 18 aa, Mycobacterium
VAEYWPEFGANGKSEVTV

SEQ ID NO: 779727 - protein, 17 aa, Mycobacterium
VAFAERYSEGIVPQGIS

SEQ ID NO: 779728 - protein, 19 aa, Mycobacterium
VAFAKRWVTECIRSAYPLG

SEQ ID NO: 779729 - protein, 17 aa, Mycobacterium
VAFDRWLACGAADLEDR

SEQ ID NO: 779730 - protein, 17 aa, Mycobacterium
VAFDYCRYLPGGEEHSR

SEQ ID NO: 779731 - protein, 21 aa, Mycobacterium
VAFHEPVHWDGWLLYSHESTQ

SEQ ID NO: 779732 - protein, 17 aa, Mycobacterium
VAFLLRFGTGVLPEPKT

SEQ ID NO: 779733 - protein, 18 aa, Mycobacterium
VAGCPDVEIVFARGTTEA

SEQ ID NO: 779734 - protein, 19 aa, Mycobacterium
VAGIFGTFADHLAKTLMTP

SEQ ID NO: 779735 - protein, 19 aa, Mycobacterium
VAGLKFYGDRGWLDHPKRF

SEQ ID NO: 779736 - protein, 17 aa, Mycobacterium
VAGLPPGLVNILPAASD

SEQ ID NO: 779737 - protein, 19 aa, Mycobacterium
VAGLRRWGRRITRTGVVAA

SEQ ID NO: 779738 - protein, 17 aa, Mycobacterium
VAGLRWRAPARFPEFTL

SEQ ID NO: 779739 - protein, 19 aa, Mycobacterium
VAGSLRASREWDLPHEVLD

SEQ ID NO: 779740 - protein, 17 aa, Mycobacterium
VAGVPVCLCSTTEVDAA

SEQ ID NO: 779741 - protein, 17 aa, Mycobacterium
VAGWLTGVVDAFEGLSA

SEQ ID NO: 779742 - protein, 18 aa, Mycobacterium
VAGYRPELDLARIGIATQ

SEQ ID NO: 779743 - protein, 17 aa, Mycobacterium
VAHPAQWALLYGSPVPG

SEQ ID NO: 779744 - protein, 19 aa, Mycobacterium
VAHPDRWQLLVGEVELESK

SEQ ID NO: 779745 - protein, 22 aa, Mycobacterium
VAHPGCALAVLAALPAWSGDPD

SEQ ID NO: 779746 - protein, 17 aa, Mycobacterium
VAIARFRLLVAALHAAG

SEQ ID NO: 779747 - protein, 17 aa, Mycobacterium
VAIAVDWTRGAVKTVPP

SEQ ID NO: 779748 - protein, 20 aa, Mycobacterium
VAIEPIYRCGHCAPCRAGNY

SEQ ID NO: 779749 - protein, 19 aa, Mycobacterium
VAIGGAWQAGWAPNDLHEF

SEQ ID NO: 779750 - protein, 20 aa, Mycobacterium
VAIMSVREGIDFGTAVTTDS

SEQ ID NO: 779751 - protein, 19 aa, Mycobacterium
VAINRNRFVQLVASNVLGL

SEQ ID NO: 779752 - protein, 17 aa, Mycobacterium
VAIRLGVDPRKADQMVR

SEQ ID NO: 779753 - protein, 19 aa, Mycobacterium
VAITHGWSLAKSVRYGIAA

SEQ ID NO: 779754 - protein, 19 aa, Mycobacterium
VAITPRFVSWMPLRWLQPL

SEQ ID NO: 779755 - protein, 17 aa, Mycobacterium
VAIVFAIRPEGEGFDSA

SEQ ID NO: 779756 - protein, 22 aa, Mycobacterium
VAKRLPMWTIYEMLGLPEDERD

SEQ ID NO: 779757 - protein, 18 aa, Mycobacterium
VAKWWIPERWSFVSDIPR

SEQ ID NO: 779758 - protein, 21 aa, Mycobacterium
VALAESFARAGIELDPRLTNL

SEQ ID NO: 779759 - protein, 19 aa, Mycobacterium
VALAQAWPGAELRYIAKAK

SEQ ID NO: 779760 - protein, 18 aa, Mycobacterium
VALDQCWDLLRQRRALRE

SEQ ID NO: 779761 - protein, 18 aa, Mycobacterium
VALERIRAFGAKIVVPGH

SEQ ID NO: 779762 - protein, 17 aa, Mycobacterium
VALESIWHECLEPDSRH

SEQ ID NO: 779763 - protein, 17 aa, Mycobacterium
VALFPSWETLPHERLSP

SEQ ID NO: 779764 - protein, 19 aa, Mycobacterium
VALGLARRGAHVAAVDLDE

SEQ ID NO: 779765 - protein, 17 aa, Mycobacterium
VALHFAVHYGWPKGSHL

SEQ ID NO: 779766 - protein, 20 aa, Mycobacterium
VALHRLPVTFVLDRAGITGS

SEQ ID NO: 779767 - protein, 17 aa, Mycobacterium
VALKHPIKLIANALGSP

SEQ ID NO: 779768 - protein, 18 aa, Mycobacterium
VALLGRFLLPLDIARRRL

SEQ ID NO: 779769 - protein, 23 aa, Mycobacterium
VALLRFCLEHGYQLRVIEQMPLD

SEQ ID NO: 779770 - protein, 18 aa, Mycobacterium
VALLWSMRNIYGIEPGDV

SEQ ID NO: 779771 - protein, 17 aa, Mycobacterium
VALPFKWAFPRVFRAFA

SEQ ID NO: 779772 - protein, 18 aa, Mycobacterium
VALPFKWAFPRVYRAFAE

SEQ ID NO: 779773 - protein, 24 aa, Mycobacterium
VALPNGRYGWRISLPAMMAYWSEL

SEQ ID NO: 779774 - protein, 17 aa, Mycobacterium
VALPNIVRLLPVARAAG

SEQ ID NO: 779775 - protein, 18 aa, Mycobacterium
VALPRLAALAQWLEAHLP

SEQ ID NO: 779776 - protein, 19 aa, Mycobacterium
VALQPRFGAGSAQRHRESG

SEQ ID NO: 779777 - protein, 17 aa, Mycobacterium
VALRAKAKAGFAEREGV

SEQ ID NO: 779778 - protein, 17 aa, Mycobacterium
VALRARAKGSFAEREGV

SEQ ID NO: 779779 - protein, 17 aa, Mycobacterium
VALWRVLVALSIRHVGP

SEQ ID NO: 779780 - protein, 24 aa, Mycobacterium
VALYRLLESWGIRPDFVMGHSVGE

SEQ ID NO: 779781 - protein, 25 aa, Mycobacterium
VAMMLSAAMLLRWLGERAGSGRALV

SEQ ID NO: 779782 - protein, 17 aa, Mycobacterium
VAMPIDWGTMTLAEGVN

SEQ ID NO: 779783 - protein, 18 aa, Mycobacterium
VAMREAYHGWTYGTDAVS

SEQ ID NO: 779784 - protein, 17 aa, Mycobacterium
VAMSLPLGAGRLTREWL

SEQ ID NO: 779785 - protein, 18 aa, Mycobacterium
VANCLLALAILDSIGVSP

SEQ ID NO: 779786 - protein, 25 aa, Mycobacterium
VAPGQCVALLFPRCAEAIMAMLAVL

SEQ ID NO: 779787 - protein, 20 aa, Mycobacterium
VAPHQSCLWGFGRAASLELP

SEQ ID NO: 779788 - protein, 24 aa, Mycobacterium
VAPKWAASISGYWRRGRTEETFRV

SEQ ID NO: 779789 - protein, 17 aa, Mycobacterium
VAPRVAQIFGVQAVPTV

SEQ ID NO: 779790 - protein, 25 aa, Mycobacterium
VAPSGRDCLDWVPGELWVGGVNVAA

SEQ ID NO: 779791 - protein, 19 aa, Mycobacterium
VAPSIVFCAAEFVPVIGDL

SEQ ID NO: 779792 - protein, 18 aa, Mycobacterium
VAPSMLWSMTVDLERPGS

SEQ ID NO: 779793 - protein, 21 aa, Mycobacterium
VAPSPARPGAPIPVASAGSGG

SEQ ID NO: 779794 - protein, 20 aa, Mycobacterium
VAPWLDLVRKLGVLAAALSD

SEQ ID NO: 779795 - protein, 19 aa, Mycobacterium
VAPYPGWLGAAATRAAAAG

SEQ ID NO: 779796 - protein, 24 aa, Mycobacterium
VAQALRPTFLVAHQIAARHDVPLR

SEQ ID NO: 779797 - protein, 18 aa, Mycobacterium
VAQAWHWFDPELAVKEVS

SEQ ID NO: 779798 - protein, 19 aa, Mycobacterium
VAQFADWGACLARTDPSAP

SEQ ID NO: 779799 - protein, 17 aa, Mycobacterium
VAQIFGVQAVPTVVALA

SEQ ID NO: 779800 - protein, 18 aa, Mycobacterium
VAQMWDWIYPLGEDPDYE

SEQ ID NO: 779801 - protein, 23 aa, Mycobacterium
VARAGAPTRFWVHVTHGAPADVW

SEQ ID NO: 779802 - protein, 21 aa, Mycobacterium
VARASALFLRRGEHPDGAVWS

SEQ ID NO: 779803 - protein, 20 aa, Mycobacterium
VARCNPRRAPKLAQTVRLRK

SEQ ID NO: 779804 - protein, 19 aa, Mycobacterium
VARFEGYRGFLFGSLNPDV

SEQ ID NO: 779805 - protein, 24 aa, Mycobacterium
VARFKRLDGFDVRYLTGTDEHGLK

SEQ ID NO: 779806 - protein, 22 aa, Mycobacterium
VARIDWARFLPLYQQAGKRSFL

SEQ ID NO: 779807 - protein, 23 aa, Mycobacterium
VARIDWARFLPLYQQAGRRAFLA

SEQ ID NO: 779808 - protein, 19 aa, Mycobacterium
VARIRPIRVGRILDLPMRR

SEQ ID NO: 779809 - protein, 19 aa, Mycobacterium
VARLAVDFRQAFKKDVVID

SEQ ID NO: 779810 - protein, 19 aa, Mycobacterium
VARLILGFVRLAGGEARVE

SEQ ID NO: 779811 - protein, 21 aa, Mycobacterium
VARLKPGIIMCREKGDATSAN

SEQ ID NO: 779812 - protein, 26 aa, Mycobacterium
VARLWPFADLTPFAAFGWEARGGYGD

SEQ ID NO: 779813 - protein, 29 aa, Mycobacterium
VARQAWQPRWLKWALAISRQGAFDHSGIP

SEQ ID NO: 779814 - protein, 25 aa, Mycobacterium
VARQEPRLSWAAGLRDDGTTTLLVT

SEQ ID NO: 779815 - protein, 17 aa, Mycobacterium
VARRLWRDSGLEPADIQ

SEQ ID NO: 779816 - protein, 20 aa, Mycobacterium
VARVRRGPLCLGIDPHPELL

SEQ ID NO: 779817 - protein, 18 aa, Mycobacterium
VARVTAWLLAVGDTADVE

SEQ ID NO: 779818 - protein, 19 aa, Mycobacterium
VASAAAWKLTPFASPQPDT

SEQ ID NO: 779819 - protein, 18 aa, Mycobacterium
VASCLYGFSLLDIIDIAD

SEQ ID NO: 779820 - protein, 17 aa, Mycobacterium
VASDAAGVVGWWVNPQA

SEQ ID NO: 779821 - protein, 20 aa, Mycobacterium
VASIQRLRCANGEPLALMTN

SEQ ID NO: 779822 - protein, 22 aa, Mycobacterium
VASREGLSWIPPGVYMPDGVTV

SEQ ID NO: 779823 - protein, 17 aa, Mycobacterium
VASSWQRLVPWPDVPAG

SEQ ID NO: 779824 - protein, 24 aa, Mycobacterium
VATFPGAVPPNWRVLGTVAATAAD

SEQ ID NO: 779825 - protein, 23 aa, Mycobacterium
VATGEFLAAIGFTQVQALTQVEV

SEQ ID NO: 779826 - protein, 19 aa, Mycobacterium
VATGEVHVCFGVTEPGAGL

SEQ ID NO: 779827 - protein, 24 aa, Mycobacterium
VATGRFPFYLGFSAEVVGIEDAAR

SEQ ID NO: 779828 - protein, 17 aa, Mycobacterium
VATTAWGLRGLRTAERK

SEQ ID NO: 779829 - protein, 27 aa, Mycobacterium
VATTPITSWNNFDVMEFIDNTQTLEPV

SEQ ID NO: 779830 - protein, 17 aa, Mycobacterium
VAVAALFGSHGETYQVL

SEQ ID NO: 779831 - protein, 19 aa, Mycobacterium
VAVCSTGLIGDRLPMDKVL

SEQ ID NO: 779832 - protein, 24 aa, Mycobacterium
VAVDLRFDWPAALTEAGFDPAEPT

SEQ ID NO: 779833 - protein, 24 aa, Mycobacterium
VAVEAIKVFAAVAFQAGELVLLGV

SEQ ID NO: 779834 - protein, 19 aa, Mycobacterium
VAVFRCGMILADTSYAGQL

SEQ ID NO: 779835 - protein, 20 aa, Mycobacterium
VAVICHGPWTLIEAGVAKGR

SEQ ID NO: 779836 - protein, 17 aa, Mycobacterium
VAVICRLLGVPIEDEPK

SEQ ID NO: 779837 - protein, 17 aa, Mycobacterium
VAVICRLLGVPLADEPE

SEQ ID NO: 779838 - protein, 17 aa, Mycobacterium
VAVICRLLGVPLEDEPQ

SEQ ID NO: 779839 - protein, 18 aa, Mycobacterium
VAVKDGRIVAVGAHDDVV

SEQ ID NO: 779840 - protein, 24 aa, Mycobacterium
VAVKQGWFCCWNRANQLHVSTGII

SEQ ID NO: 779841 - protein, 18 aa, Mycobacterium
VAVLFAAMFEDTALRATG

SEQ ID NO: 779842 - protein, 19 aa, Mycobacterium
VAVLLRLTERFDLSPHYFS

SEQ ID NO: 779843 - protein, 21 aa, Mycobacterium
VAVPMFHGFGLGQLMLTLALG

SEQ ID NO: 779844 - protein, 18 aa, Mycobacterium
VAVPWSLRDAHPVHMGAD

SEQ ID NO: 779845 - protein, 23 aa, Mycobacterium
VAVRPGQDWALLLAMVAVILGEG

SEQ ID NO: 779846 - protein, 17 aa, Mycobacterium
VAVRQGLRWTQRMRRSL

SEQ ID NO: 779847 - protein, 18 aa, Mycobacterium
VAVVACEFGFLAGSIGVA

SEQ ID NO: 779848 - protein, 18 aa, Mycobacterium
VAYLTAWHSLCEVGRLSP

SEQ ID NO: 779849 - protein, 19 aa, Mycobacterium
VAYRLGRGVARVEAALSAP

SEQ ID NO: 779850 - protein, 21 aa, Mycobacterium
VAYRLGRSFARLEASLSTPSI

SEQ ID NO: 779851 - protein, 21 aa, Mycobacterium
VCAVDMPFLAVELIDDLARRA

SEQ ID NO: 779852 - protein, 17 aa, Mycobacterium
VCDCAHCASVYGPAAYL

SEQ ID NO: 779853 - protein, 17 aa, Mycobacterium
VCDMFFLRYRKELDQRA

SEQ ID NO: 779854 - protein, 18 aa, Mycobacterium
VCEFLRFCARTGVIEQAV

SEQ ID NO: 779855 - protein, 18 aa, Mycobacterium
VCETEWDLLNLLAPADDG

SEQ ID NO: 779856 - protein, 17 aa, Mycobacterium
VCFPERWLDLRYVGPAR

SEQ ID NO: 779857 - protein, 18 aa, Mycobacterium
VCGECRIPVTAGVLEHRD

SEQ ID NO: 779858 - protein, 20 aa, Mycobacterium
VCGLGMNWQSMWDGLVNGRS

SEQ ID NO: 779859 - protein, 21 aa, Mycobacterium
VCGRIKDLLILAGRNIYPQDI

SEQ ID NO: 779860 - protein, 19 aa, Mycobacterium
VCKHAGVVARYFYENFTDL

SEQ ID NO: 779861 - protein, 17 aa, Mycobacterium
VCLGLPGSLPVLNRAAV

SEQ ID NO: 779862 - protein, 18 aa, Mycobacterium
VCLPHDWLGWRLTGSNDL

SEQ ID NO: 779863 - protein, 19 aa, Mycobacterium
VCLSCGSALGFSLDRMALL

SEQ ID NO: 779864 - protein, 23 aa, Mycobacterium
VCNEILPRWGVETVFVDGDDLAQ

SEQ ID NO: 779865 - protein, 23 aa, Mycobacterium
VCNEILPRWGVETVFVDGDDLEQ

SEQ ID NO: 779866 - protein, 24 aa, Mycobacterium
VCNEILPRWGVETVFVDGEDISQW

SEQ ID NO: 779867 - protein, 24 aa, Mycobacterium
VCNEILPRWGVETVFVDGEDLAQW

SEQ ID NO: 779868 - protein, 18 aa, Mycobacterium
VCPHFPRVAALLDQSVGA

SEQ ID NO: 779869 - protein, 18 aa, Mycobacterium
VCPLRLRHPSGWPLYPIQ

SEQ ID NO: 779870 - protein, 20 aa, Mycobacterium
VCPVCLGLPGALPVLNEAAV

SEQ ID NO: 779871 - protein, 18 aa, Mycobacterium
VCQELGRWRAIAESTDFS

SEQ ID NO: 779872 - protein, 19 aa, Mycobacterium
VCQSCGFAVEVQAGAVEKW

SEQ ID NO: 779873 - protein, 18 aa, Mycobacterium
VCRYILRLSPVIEMTHQD

SEQ ID NO: 779874 - protein, 19 aa, Mycobacterium
VCSAEVPIPYAKHLEEAAL

SEQ ID NO: 779875 - protein, 18 aa, Mycobacterium
VCSQSGVGTLELLDIISR

SEQ ID NO: 779876 - protein, 24 aa, Mycobacterium
VCVRPQPLGAFGLPLGYLLVPAGS

SEQ ID NO: 779877 - protein, 22 aa, Mycobacterium
VCWNEVTHFWALLKYEDIRFVS

SEQ ID NO: 779878 - protein, 23 aa, Mycobacterium
VCYDIRFPALYTELARRGAELIV

SEQ ID NO: 779879 - protein, 23 aa, Mycobacterium
VCYDIRFPALYTELARRGAQLIA

SEQ ID NO: 779880 - protein, 18 aa, Mycobacterium
VDAAEGWVLPGLIDTHVH

SEQ ID NO: 779881 - protein, 24 aa, Mycobacterium
VDAALRAKAGWLWTGRRGVVAGFS

SEQ ID NO: 779882 - protein, 19 aa, Mycobacterium
VDAAMVLYLFGSKAELFRE

SEQ ID NO: 779883 - protein, 22 aa, Mycobacterium
VDAASLALACWAEPDITARPNV

SEQ ID NO: 779884 - protein, 24 aa, Mycobacterium
VDAAWRPDTVWRYRLGSPGSSERV

SEQ ID NO: 779885 - protein, 19 aa, Mycobacterium
VDAFAHWRRAQGLPVCAIA

SEQ ID NO: 779886 - protein, 19 aa, Mycobacterium
VDAFAHWRRAQGLPVCAIG

SEQ ID NO: 779887 - protein, 18 aa, Mycobacterium
VDAGHRWLLHAGDAFYHH

SEQ ID NO: 779888 - protein, 18 aa, Mycobacterium
VDAGHRWVLHAGDAFYHP

SEQ ID NO: 779889 - protein, 21 aa, Mycobacterium
VDAKVGWKGFHAIERDLWQGG

SEQ ID NO: 779890 - protein, 23 aa, Mycobacterium
VDAKWASSISGYWRRGRTEETFR

SEQ ID NO: 779891 - protein, 23 aa, Mycobacterium
VDALHRWLVAWADIYDAHAAVFA

SEQ ID NO: 779892 - protein, 19 aa, Mycobacterium
VDALRCAYATVLIREANYS

SEQ ID NO: 779893 - protein, 17 aa, Mycobacterium
VDARFGTVYLRRGDPAV

SEQ ID NO: 779894 - protein, 22 aa, Mycobacterium
VDARIAARLGLRDDVRRVPLFG

SEQ ID NO: 779895 - protein, 20 aa, Mycobacterium
VDARLLVRVPSGWSLAEAAG

SEQ ID NO: 779896 - protein, 17 aa, Mycobacterium
VDARTAAAFGVAYRTAY

SEQ ID NO: 779897 - protein, 18 aa, Mycobacterium
VDARVRLRLRAEADAVTV

SEQ ID NO: 779898 - protein, 18 aa, Mycobacterium
VDAWLARKERIRQIHELL

SEQ ID NO: 779899 - protein, 23 aa, Mycobacterium
VDAWLCGWDEKFTTALAARGWLG

SEQ ID NO: 779900 - protein, 17 aa, Mycobacterium
VDCIIFASGFEITTEIR

SEQ ID NO: 779901 - protein, 22 aa, Mycobacterium
VDCSATLPGAIGWLKYTIDNEL

SEQ ID NO: 779902 - protein, 23 aa, Mycobacterium
VDDAWPAVLTWRAHDEPRMESVR

SEQ ID NO: 779903 - protein, 24 aa, Mycobacterium
VDDAWRPDTVWRHRLGAGLPGERV

SEQ ID NO: 779904 - protein, 23 aa, Mycobacterium
VDDAWRPDTVWRHRLGSGQPAQR

SEQ ID NO: 779905 - protein, 25 aa, Mycobacterium
VDDAWRPDTVWRYRLGPGAVSEQVY

SEQ ID NO: 779906 - protein, 18 aa, Mycobacterium
VDDDTAFELLRWRSQEAN

SEQ ID NO: 779907 - protein, 17 aa, Mycobacterium
VDDEWRGPASVSMAAAA

SEQ ID NO: 779908 - protein, 22 aa, Mycobacterium
VDDLKAPLLAAVGAADLALERV

SEQ ID NO: 779909 - protein, 19 aa, Mycobacterium
VDDLLRLVLRHSFETEAIN

SEQ ID NO: 779910 - protein, 19 aa, Mycobacterium
VDDWPLLRWRMREYEHGRW

SEQ ID NO: 779911 - protein, 24 aa, Mycobacterium
VDEIKCNVLRPWLEKALADMNVLM

SEQ ID NO: 779912 - protein, 25 aa, Mycobacterium
VDEIVRWATPVHCFQRTAVVDTEIG

SEQ ID NO: 779913 - protein, 19 aa, Mycobacterium
VDEIVRWATPVTSFQRTAL

SEQ ID NO: 779914 - protein, 22 aa, Mycobacterium
VDEPFLLPAHIDLAALRVKFDG

SEQ ID NO: 779915 - protein, 24 aa, Mycobacterium
VDERARAGLFLAMQYPIEVTGVSM

SEQ ID NO: 779916 - protein, 23 aa, Mycobacterium
VDERARAGLFLAMQYPVEVPGVS

SEQ ID NO: 779917 - protein, 24 aa, Mycobacterium
VDERARAGLFLAMQYPVEVPGVSV

SEQ ID NO: 779918 - protein, 22 aa, Mycobacterium
VDEVWPGPGVVYFTRVSAERTR

SEQ ID NO: 779919 - protein, 17 aa, Mycobacterium
VDFVPKVRIEVVVDDSV

SEQ ID NO: 779920 - protein, 17 aa, Mycobacterium
VDFVPKVRVEVVVDDAA

SEQ ID NO: 779921 - protein, 17 aa, Mycobacterium
VDFVPKVRVEVVVDDSA

SEQ ID NO: 779922 - protein, 19 aa, Mycobacterium
VDGEIIWAPAIDGAFVLST

SEQ ID NO: 779923 - protein, 18 aa, Mycobacterium
VDGFPNLFLISGPGAPAV

SEQ ID NO: 779924 - protein, 20 aa, Mycobacterium
VDGGKGWPAQWCHGAPGIGL

SEQ ID NO: 779925 - protein, 18 aa, Mycobacterium
VDGGWRLSGQKIWSSRAP

SEQ ID NO: 779926 - protein, 21 aa, Mycobacterium
VDGGWSLSGTKVWTSGAHLAH

SEQ ID NO: 779927 - protein, 19 aa, Mycobacterium
VDGGWSLTGTKVWTSGAHL

SEQ ID NO: 779928 - protein, 24 aa, Mycobacterium
VDGGYRLSGSWSFGSGTGHAQYIA

SEQ ID NO: 779929 - protein, 24 aa, Mycobacterium
VDGGYRLTGAWSFGSGTGHAEYVA

SEQ ID NO: 779930 - protein, 19 aa, Mycobacterium
VDGLNRFSATLAHDRDNLG

SEQ ID NO: 779931 - protein, 19 aa, Mycobacterium
VDGPMPFPVVPASRPLTAE

SEQ ID NO: 779932 - protein, 24 aa, Mycobacterium
VDGRAAVIPISWAAAGNTSAPPAI

SEQ ID NO: 779933 - protein, 22 aa, Mycobacterium
VDGRFGIGLVDWVMRNEAGLLE

SEQ ID NO: 779934 - protein, 18 aa, Mycobacterium
VDGSWRGPASAAMAAAAA

SEQ ID NO: 779935 - protein, 18 aa, Mycobacterium
VDGYLALRPRAEAVRHQL

SEQ ID NO: 779936 - protein, 18 aa, Mycobacterium
VDHFRYFAGAIRAQEGSL

SEQ ID NO: 779937 - protein, 21 aa, Mycobacterium
VDHVTRLGAAVARTEPETAAE

SEQ ID NO: 779938 - protein, 19 aa, Mycobacterium
VDIAFNWDHFFPLFGDPDG

SEQ ID NO: 779939 - protein, 19 aa, Mycobacterium
VDIAFNWDHFFPLYGAPDG

SEQ ID NO: 779940 - protein, 19 aa, Mycobacterium
VDIAFNWDHFFPLYGDPDG

SEQ ID NO: 779941 - protein, 18 aa, Mycobacterium
VDIALEWLTRGDLNIAQG

SEQ ID NO: 779942 - protein, 19 aa, Mycobacterium
VDIPFKFHHPMWREHCEVD

SEQ ID NO: 779943 - protein, 19 aa, Mycobacterium
VDIPFKFHHPMWRENAEVD

SEQ ID NO: 779944 - protein, 17 aa, Mycobacterium
VDIPVYLGCDWQNVPLH

SEQ ID NO: 779945 - protein, 18 aa, Mycobacterium
VDIPWKLHHPMWIQNAEI

SEQ ID NO: 779946 - protein, 17 aa, Mycobacterium
VDIRFCDLPGVVQHFSI

SEQ ID NO: 779947 - protein, 17 aa, Mycobacterium
VDIVSFWLKPYGFFDRN

SEQ ID NO: 779948 - protein, 23 aa, Mycobacterium
VDKFPRMVDYVLPSGVRIADADR

SEQ ID NO: 779949 - protein, 23 aa, Mycobacterium
VDKFPRMVDYVLPTGVRIADADR

SEQ ID NO: 779950 - protein, 17 aa, Mycobacterium
VDLAEAVARVFSGDIVN

SEQ ID NO: 779951 - protein, 19 aa, Mycobacterium
VDLDPRWVKKIATRGVGAE

SEQ ID NO: 779952 - protein, 19 aa, Mycobacterium
VDLEHRWERVLGRRRLAEL

SEQ ID NO: 779953 - protein, 17 aa, Mycobacterium
VDLFRYEVLMTLRPLPD

SEQ ID NO: 779954 - protein, 17 aa, Mycobacterium
VDLGDDCWFNLRSSNTE

SEQ ID NO: 779955 - protein, 27 aa, Mycobacterium
VDLHRCWPRSLCLAGFDPAAPTAWLVE

SEQ ID NO: 779956 - protein, 17 aa, Mycobacterium
VDLIPSYKAHRVAEPEP

SEQ ID NO: 779957 - protein, 23 aa, Mycobacterium
VDLRDDWPAALLAAGFDPEVPTA

SEQ ID NO: 779958 - protein, 19 aa, Mycobacterium
VDLRDDWPAALRAAGFDPA

SEQ ID NO: 779959 - protein, 17 aa, Mycobacterium
VDLRLSNQFIVFEQTSN

SEQ ID NO: 779960 - protein, 18 aa, Mycobacterium
VDLRQDWPAALQREGFDV

SEQ ID NO: 779961 - protein, 17 aa, Mycobacterium
VDLRRSYPFYGQAHQGG

SEQ ID NO: 779962 - protein, 19 aa, Mycobacterium
VDLRSGWSPPEHIYVEHRR

SEQ ID NO: 779963 - protein, 19 aa, Mycobacterium
VDLRVGVGVAEFVGNGHVE

SEQ ID NO: 779964 - protein, 18 aa, Mycobacterium
VDLTLVFYDCEEIESSAN

SEQ ID NO: 779965 - protein, 23 aa, Mycobacterium
VDLVCSWGPLILGHAHPAVVEAV

SEQ ID NO: 779966 - protein, 23 aa, Mycobacterium
VDLVCSWGPMILGHAHPAVVDAV

SEQ ID NO: 779967 - protein, 23 aa, Mycobacterium
VDLVCSWGPMILGHAHPAVVEAV

SEQ ID NO: 779968 - protein, 17 aa, Mycobacterium
VDLVQLFPAAAYGKNGA

SEQ ID NO: 779969 - protein, 21 aa, Mycobacterium
VDLWLCPACATLRRATRREAR

SEQ ID NO: 779970 - protein, 19 aa, Mycobacterium
VDLYPRLVCNAAYAVLATV

SEQ ID NO: 779971 - protein, 19 aa, Mycobacterium
VDNPFPLPRLDTYTSDPRI

SEQ ID NO: 779972 - protein, 18 aa, Mycobacterium
VDPALLLNCMLLAATESG

SEQ ID NO: 779973 - protein, 23 aa, Mycobacterium
VDPPWRFSFRWCYPEGHTANPEN

SEQ ID NO: 779974 - protein, 17 aa, Mycobacterium
VDPQLVIMLGEYPGRAM

SEQ ID NO: 779975 - protein, 19 aa, Mycobacterium
VDPRMVLEAGFFMPEPGQE

SEQ ID NO: 779976 - protein, 17 aa, Mycobacterium
VDPRPEYTAVIGNPPYI

SEQ ID NO: 779977 - protein, 25 aa, Mycobacterium
VDQRGRIRLAGFGYRVPIVLAGEPV

SEQ ID NO: 779978 - protein, 24 aa, Mycobacterium
VDQYWFWNLRNAVRFDRAVATAAA

SEQ ID NO: 779979 - protein, 17 aa, Mycobacterium
VDRIVVHLAPWLEPEPI

SEQ ID NO: 779980 - protein, 21 aa, Mycobacterium
VDRSTIILAMWQYLLHRYTSQ

SEQ ID NO: 779981 - protein, 25 aa, Mycobacterium
VDRVFAGKVWGAWHLSEAAAGLKLD

SEQ ID NO: 779982 - protein, 25 aa, Mycobacterium
VDRVFAGKVWGAWHLSEALTDLRTD

SEQ ID NO: 779983 - protein, 24 aa, Mycobacterium
VDRVFAGKVWGAWHLSEATSDLQL

SEQ ID NO: 779984 - protein, 24 aa, Mycobacterium
VDRVFAGKVWGAWNLSEAAAELSL

SEQ ID NO: 779985 - protein, 20 aa, Mycobacterium
VDRWWWPALMMFGPPDADSP

SEQ ID NO: 779986 - protein, 19 aa, Mycobacterium
VDSPRRWTHVRLTMYPDGG

SEQ ID NO: 779987 - protein, 19 aa, Mycobacterium
VDSYGGFVFASLAPDGISL

SEQ ID NO: 779988 - protein, 24 aa, Mycobacterium
VDTDLRWRIVIALATAGAIDADGP

SEQ ID NO: 779989 - protein, 20 aa, Mycobacterium
VDTDLRWRIVNALAASGALE

SEQ ID NO: 779990 - protein, 25 aa, Mycobacterium
VDTDLRWRVVTALARAGVIDADGTA

SEQ ID NO: 779991 - protein, 17 aa, Mycobacterium
VDVIGLWGEAARDVDHA

SEQ ID NO: 779992 - protein, 18 aa, Mycobacterium
VDVLRLPVDIVVADKFAA

SEQ ID NO: 779993 - protein, 17 aa, Mycobacterium
VDVLRRLYGRVGDRLVL

SEQ ID NO: 779994 - protein, 17 aa, Mycobacterium
VDVRSGRRWSYAQLLTD

SEQ ID NO: 779995 - protein, 19 aa, Mycobacterium
VDVVFNWDHFFPLYGDPDG

SEQ ID NO: 779996 - protein, 17 aa, Mycobacterium
VDVVLLWWRDGDGDLVD

SEQ ID NO: 779997 - protein, 17 aa, Mycobacterium
VDVVSFWLKPFGFFDRN

SEQ ID NO: 779998 - protein, 21 aa, Mycobacterium
VDWKLSLCSYALPLEDDGTID

SEQ ID NO: 779999 - protein, 23 aa, Mycobacterium
VDWMLGNGGLEWAVKRTADSSQR

SEQ ID NO: 780000 - protein, 17 aa, Mycobacterium
VDYAAFNEVHWVAPAEA

SEQ ID NO: 780001 - protein, 23 aa, Mycobacterium
VEACKGVSVPLRLTSPAPCTTCH

SEQ ID NO: 780002 - protein, 17 aa, Mycobacterium
VEAEGLTVLGWREVPHD

SEQ ID NO: 780003 - protein, 19 aa, Mycobacterium
VEAFHVLWFSGEAHVLRGY

SEQ ID NO: 780004 - protein, 22 aa, Mycobacterium
VEAIRWTTWHAAWLIAEGRPAA

SEQ ID NO: 780005 - protein, 23 aa, Mycobacterium
VEAIRWTTWHAAWLIAHGRPLTE

SEQ ID NO: 780006 - protein, 23 aa, Mycobacterium
VEAKRYPAILAMTSLNDTRVYYV

SEQ ID NO: 780007 - protein, 18 aa, Mycobacterium
VEALRALQCWTEPRSWET

SEQ ID NO: 780008 - protein, 29 aa, Mycobacterium
VEALRWADRPEFADLLGGVVLIDQAVLDH

SEQ ID NO: 780009 - protein, 23 aa, Mycobacterium
VEASRLFLTQMIQHHRGAITMAQ

SEQ ID NO: 780010 - protein, 21 aa, Mycobacterium
VEAVWKPKDEWGLGIDNISHF

SEQ ID NO: 780011 - protein, 21 aa, Mycobacterium
VEAVWKPKEEWGYGIDNIQYF

SEQ ID NO: 780012 - protein, 26 aa, Mycobacterium
VEAVWKPREEWGFGIDNIEYFRPTGE

SEQ ID NO: 780013 - protein, 19 aa, Mycobacterium
VECQSRLLAAYAVGRYALP

SEQ ID NO: 780014 - protein, 17 aa, Mycobacterium
VEDELLRLGARPGCAVT

SEQ ID NO: 780015 - protein, 20 aa, Mycobacterium
VEDWPLLRWRMREYTHGRWG

SEQ ID NO: 780016 - protein, 20 aa, Mycobacterium
VEDWPLLRWRMRQYRHGRWG

SEQ ID NO: 780017 - protein, 18 aa, Mycobacterium
VEEALGWVDAVGIADRRL

SEQ ID NO: 780018 - protein, 17 aa, Mycobacterium
VEEAWKHVAGLTIANDV

SEQ ID NO: 780019 - protein, 19 aa, Mycobacterium
VEEFVRWASPVMTFRRTAA

SEQ ID NO: 780020 - protein, 18 aa, Mycobacterium
VEEFVRWATPVIQFARFA

SEQ ID NO: 780021 - protein, 20 aa, Mycobacterium
VEEKRMFGGLAFLVNGNMSV

SEQ ID NO: 780022 - protein, 23 aa, Mycobacterium
VEEKRPLIELGLKDVLYGTAGAP

SEQ ID NO: 780023 - protein, 22 aa, Mycobacterium
VEELKAPLLAAVGAADLALATV

SEQ ID NO: 780024 - protein, 24 aa, Mycobacterium
VEELLRWATPVMHFRRTVVRDVEI

SEQ ID NO: 780025 - protein, 18 aa, Mycobacterium
VEEMIRWVTPVKEFMRTA

SEQ ID NO: 780026 - protein, 19 aa, Mycobacterium
VEEMVRWASPVMTFRRTAA

SEQ ID NO: 780027 - protein, 17 aa, Mycobacterium
VEFLRFLLADERVQSGD

SEQ ID NO: 780028 - protein, 17 aa, Mycobacterium
VEFLRKRHEALVGNPLF

SEQ ID NO: 780029 - protein, 23 aa, Mycobacterium
VEFPGLLGRAAFRAVDDVSFGIG

SEQ ID NO: 780030 - protein, 21 aa, Mycobacterium
VEFRRRLLATIAHHLKPEGKA

SEQ ID NO: 780031 - protein, 19 aa, Mycobacterium
VEGAFYWLNNREVRWRPEH

SEQ ID NO: 780032 - protein, 19 aa, Mycobacterium
VEGAFYWLNNREVRWRPES

SEQ ID NO: 780033 - protein, 18 aa, Mycobacterium
VEGGWRLTGTKVWTSGAH

SEQ ID NO: 780034 - protein, 19 aa, Mycobacterium
VEGILFAVEWNRFWHDSWG

SEQ ID NO: 780035 - protein, 22 aa, Mycobacterium
VEGPRLLLLGGRSWKVTHIDWE

SEQ ID NO: 780036 - protein, 25 aa, Mycobacterium
VEGRVAVQIPRGWRVERVTDDAGSP

SEQ ID NO: 780037 - protein, 19 aa, Mycobacterium
VEGVVMWTGVLGIADLATN

SEQ ID NO: 780038 - protein, 24 aa, Mycobacterium
VEGWKGDYFPFVFNIRDWNVIMSD

SEQ ID NO: 780039 - protein, 17 aa, Mycobacterium
VEHFSLEIIPWADFIGR

SEQ ID NO: 780040 - protein, 19 aa, Mycobacterium
VEIAGRWAAAAGLDVELTK

SEQ ID NO: 780041 - protein, 18 aa, Mycobacterium
VEIARFWVGLASFDEARD

SEQ ID NO: 780042 - protein, 17 aa, Mycobacterium
VEIGDGFTTARRRGSAA

SEQ ID NO: 780043 - protein, 20 aa, Mycobacterium
VEIGGPFSIELCGGTHVATS

SEQ ID NO: 780044 - protein, 21 aa, Mycobacterium
VEIGGPFSIELCGGTHVRSSA

SEQ ID NO: 780045 - protein, 20 aa, Mycobacterium
VEIGGPFSLELCGGTHVESS

SEQ ID NO: 780046 - protein, 19 aa, Mycobacterium
VEINEAFAPVVLAWAKELD

SEQ ID NO: 780047 - protein, 19 aa, Mycobacterium
VEIRPLYAWSGYRTNEVAF

SEQ ID NO: 780048 - protein, 17 aa, Mycobacterium
VEKRFNLSWAIEGTRSR

SEQ ID NO: 780049 - protein, 18 aa, Mycobacterium
VELARAWPDATLRAVDDV

SEQ ID NO: 780050 - protein, 18 aa, Mycobacterium
VELDERWVIIGPNGAGKT

SEQ ID NO: 780051 - protein, 18 aa, Mycobacterium
VELDERWVILGPNGAGKT

SEQ ID NO: 780052 - protein, 17 aa, Mycobacterium
VELDERWVIVGPNGAGK

SEQ ID NO: 780053 - protein, 18 aa, Mycobacterium
VELDERWVVLGPNGAGKT

SEQ ID NO: 780054 - protein, 18 aa, Mycobacterium
VELGIKWLSLYAFSTENW

SEQ ID NO: 780055 - protein, 25 aa, Mycobacterium
VELLRYCLQHGYQLRIIEQMPLDAS

SEQ ID NO: 780056 - protein, 19 aa, Mycobacterium
VELPGWYRPDPGQARDLAF

SEQ ID NO: 780057 - protein, 26 aa, Mycobacterium
VELPGWYRPNPGLARDLAFIAFSAAG

SEQ ID NO: 780058 - protein, 26 aa, Mycobacterium
VELPGWYRPNPGLARDLAFIAFSSAG

SEQ ID NO: 780059 - protein, 26 aa, Mycobacterium
VELPGWYRPNPGLARDLAFVGFSTIG

SEQ ID NO: 780060 - protein, 23 aa, Mycobacterium
VELRGPDRYRWRLLAGPKTVWDS

SEQ ID NO: 780061 - protein, 19 aa, Mycobacterium
VELRNRLKIATGLTLSPTL

SEQ ID NO: 780062 - protein, 20 aa, Mycobacterium
VELRNRLKIATGLTLSPTLI

SEQ ID NO: 780063 - protein, 21 aa, Mycobacterium
VELRNRLRAVTGLALSRTIIF

SEQ ID NO: 780064 - protein, 17 aa, Mycobacterium
VELRRLAAVLGIDLSRD

SEQ ID NO: 780065 - protein, 18 aa, Mycobacterium
VELVRWAKEQGIAITAEV

SEQ ID NO: 780066 - protein, 17 aa, Mycobacterium
VEMCPAYSNADAARQVA

SEQ ID NO: 780067 - protein, 17 aa, Mycobacterium
VEMLMPCFARLYEELGI

SEQ ID NO: 780068 - protein, 22 aa, Mycobacterium
VEMPEIRSAVVAQLARVDGELA

SEQ ID NO: 780069 - protein, 22 aa, Mycobacterium
VENALKVAFDWKSRHNEAHGID

SEQ ID NO: 780070 - protein, 17 aa, Mycobacterium
VENALKVAFDWKSRHNQ

SEQ ID NO: 780071 - protein, 22 aa, Mycobacterium
VENALKVAFDWKSRHNQALGID

SEQ ID NO: 780072 - protein, 22 aa, Mycobacterium
VENALKVAFDWKSRLNEAQGRS

SEQ ID NO: 780073 - protein, 23 aa, Mycobacterium
VENALKVAFDWKSRWNEAHGIDA

SEQ ID NO: 780074 - protein, 23 aa, Mycobacterium
VENLCAPVLFPAAIGRLFDAGHD

SEQ ID NO: 780075 - protein, 18 aa, Mycobacterium
VEPAWRVGDDVSHTEFGH

SEQ ID NO: 780076 - protein, 19 aa, Mycobacterium
VEPIWSAWIERWPTASATA

SEQ ID NO: 780077 - protein, 17 aa, Mycobacterium
VEPKWVLAMGVCASSGG

SEQ ID NO: 780078 - protein, 24 aa, Mycobacterium
VEPMWAVAEWGYWQILKSAEDAQR

SEQ ID NO: 780079 - protein, 19 aa, Mycobacterium
VEQVWRWPARRTKDNSTST

SEQ ID NO: 780080 - protein, 17 aa, Mycobacterium
VERIRCAAGAFAGLGID

SEQ ID NO: 780081 - protein, 23 aa, Mycobacterium
VERLPFRLVESVIMLRADGDSIA

SEQ ID NO: 780082 - protein, 20 aa, Mycobacterium
VERRARWAVRVIISLLTFPG

SEQ ID NO: 780083 - protein, 23 aa, Mycobacterium
VERVLRVAERLMRTGIDVLHLAD

SEQ ID NO: 780084 - protein, 19 aa, Mycobacterium
VESGLKVARKWGADVKGVP

SEQ ID NO: 780085 - protein, 24 aa, Mycobacterium
VESGPRLQAVWTWAPSLVDAIQVQ

SEQ ID NO: 780086 - protein, 17 aa, Mycobacterium
VESWARLAVAARPELTL

SEQ ID NO: 780087 - protein, 22 aa, Mycobacterium
VETRGRFGTFISRFDPTDAAMA

SEQ ID NO: 780088 - protein, 24 aa, Mycobacterium
VETRMKLKIAREFTQRPVQPQNKR

SEQ ID NO: 780089 - protein, 20 aa, Mycobacterium
VETTAAGLLLAWRGDAGHAA

SEQ ID NO: 780090 - protein, 21 aa, Mycobacterium
VEVALKHPIKLIANALGSPPK

SEQ ID NO: 780091 - protein, 18 aa, Mycobacterium
VEVGDWLRFGISHPCTTF

SEQ ID NO: 780092 - protein, 17 aa, Mycobacterium
VEVLEIRAALGPLIGRL

SEQ ID NO: 780093 - protein, 21 aa, Mycobacterium
VEVLRLSALRGLFSAVIDEPV

SEQ ID NO: 780094 - protein, 22 aa, Mycobacterium
VEVLRLSALRGLFSAVIEDQVT

SEQ ID NO: 780095 - protein, 18 aa, Mycobacterium
VEVPDHFRLYVAEKLARL

SEQ ID NO: 780096 - protein, 17 aa, Mycobacterium
VEVPFAMDFPSTYRLGR

SEQ ID NO: 780097 - protein, 17 aa, Mycobacterium
VEVPTGYSLFRGDIVRP

SEQ ID NO: 780098 - protein, 21 aa, Mycobacterium
VEVPVGFKWFVDGLVGGSIGF

SEQ ID NO: 780099 - protein, 20 aa, Mycobacterium
VEWHKMGAGWSWSRKAGSEL

SEQ ID NO: 780100 - protein, 17 aa, Mycobacterium
VEYARGRFDAIVPDEVL

SEQ ID NO: 780101 - protein, 17 aa, Mycobacterium
VEYARLWLARSADFDML

SEQ ID NO: 780102 - protein, 18 aa, Mycobacterium
VEYLDLIGLLPEVLAVYN

SEQ ID NO: 780103 - protein, 17 aa, Mycobacterium
VEYRTAWQLQRELADAR

SEQ ID NO: 780104 - protein, 27 aa, Mycobacterium
VFAAELFPRMAIPQSWYDAGIAHRADD

SEQ ID NO: 780105 - protein, 17 aa, Mycobacterium
VFAEGALFYVGDPHMAM

SEQ ID NO: 780106 - protein, 17 aa, Mycobacterium
VFAGWRITSHQGGWFAR

SEQ ID NO: 780107 - protein, 17 aa, Mycobacterium
VFAGWRITSRQGGWFVA

SEQ ID NO: 780108 - protein, 24 aa, Mycobacterium
VFANELSFVFGLRPGTPVGELTDP

SEQ ID NO: 780109 - protein, 19 aa, Mycobacterium
VFCLHPAGGVSWPYQVLGT

SEQ ID NO: 780110 - protein, 18 aa, Mycobacterium
VFDALPIAQRTALRQVLV

SEQ ID NO: 780111 - protein, 18 aa, Mycobacterium
VFDGWRIVGYAIHGPTDT

SEQ ID NO: 780112 - protein, 19 aa, Mycobacterium
VFDPVLIRWRLQAGDRTAQ

SEQ ID NO: 780113 - protein, 24 aa, Mycobacterium
VFDRLRFEINLGFQPFNFELAMAA

SEQ ID NO: 780114 - protein, 20 aa, Mycobacterium
VFDVGSSFARLIKAERDDSA

SEQ ID NO: 780115 - protein, 24 aa, Mycobacterium
VFEFLPRRILLPLIRNQHPALRRS

SEQ ID NO: 780116 - protein, 24 aa, Mycobacterium
VFENWLTGLARWFGQLDVDEATSR

SEQ ID NO: 780117 - protein, 17 aa, Mycobacterium
VFETLAWGRRHVVMGAN

SEQ ID NO: 780118 - protein, 20 aa, Mycobacterium
VFFIRDGLKFQHFIRSQKRR

SEQ ID NO: 780119 - protein, 17 aa, Mycobacterium
VFGLLGLVDEVGLVGAD

SEQ ID NO: 780120 - protein, 22 aa, Mycobacterium
VFGLRSPWNGNWRKAVEGGIQI

SEQ ID NO: 780121 - protein, 20 aa, Mycobacterium
VFGPRVRWRMMLKALRDNGF

SEQ ID NO: 780122 - protein, 18 aa, Mycobacterium
VFGRRAGIAAAEYAEAHD

SEQ ID NO: 780123 - protein, 18 aa, Mycobacterium
VFGRRAGIAAAEYAQNHN

SEQ ID NO: 780124 - protein, 17 aa, Mycobacterium
VFGRRAGIAAANYALGH

SEQ ID NO: 780125 - protein, 18 aa, Mycobacterium
VFGRRAGIAAANYARGHD

SEQ ID NO: 780126 - protein, 20 aa, Mycobacterium
VFGVFCRRWGVPLIDGGTVR

SEQ ID NO: 780127 - protein, 19 aa, Mycobacterium
VFHRVIRGFMIQGGDPTGT

SEQ ID NO: 780128 - protein, 19 aa, Mycobacterium
VFHTLRAAIPVMRQQRFGR

SEQ ID NO: 780129 - protein, 20 aa, Mycobacterium
VFKPEFFDEPGWEPMGDQGL

SEQ ID NO: 780130 - protein, 19 aa, Mycobacterium
VFKRIRPAFTYQRSLDVLT

SEQ ID NO: 780131 - protein, 18 aa, Mycobacterium
VFKRMWELYLAYSEAGFR

SEQ ID NO: 780132 - protein, 21 aa, Mycobacterium
VFLIDCGRGVLQRAAAVGVGA

SEQ ID NO: 780133 - protein, 18 aa, Mycobacterium
VFLMDHFYQLPGIGTPDQ

SEQ ID NO: 780134 - protein, 24 aa, Mycobacterium
VFNGWGARDWARWDNDAHIGRFVG

SEQ ID NO: 780135 - protein, 17 aa, Mycobacterium
VFNIPWVLQLRGILHTE

SEQ ID NO: 780136 - protein, 17 aa, Mycobacterium
VFNRLPVRWLYLPWAAE

SEQ ID NO: 780137 - protein, 21 aa, Mycobacterium
VFPLARWSAVLGRRYLRQQVE

SEQ ID NO: 780138 - protein, 20 aa, Mycobacterium
VFPLARWSAVLGRRYLRQRV

SEQ ID NO: 780139 - protein, 20 aa, Mycobacterium
VFPTRSLRDFGFANVDRNPS

SEQ ID NO: 780140 - protein, 18 aa, Mycobacterium
VFPYDWRLSNRYTARQLK

SEQ ID NO: 780141 - protein, 18 aa, Mycobacterium
VFQTHEWAPRVLIANSNL

SEQ ID NO: 780142 - protein, 18 aa, Mycobacterium
VFRIARRVARDRLISTVD

SEQ ID NO: 780143 - protein, 20 aa, Mycobacterium
VFRIFLTRLRLMLAEDDPLF

SEQ ID NO: 780144 - protein, 21 aa, Mycobacterium
VFRIKAGYLLAARAEDGLPLP

SEQ ID NO: 780145 - protein, 18 aa, Mycobacterium
VFRRRRFFSGKPVGRRGQ

SEQ ID NO: 780146 - protein, 17 aa, Mycobacterium
VFSEWPLGVALEQAQIL

SEQ ID NO: 780147 - protein, 20 aa, Mycobacterium
VFSGYRFLRHAAARGIPVAI

SEQ ID NO: 780148 - protein, 21 aa, Mycobacterium
VFSGYRFVRHAAALGIPVAII

SEQ ID NO: 780149 - protein, 19 aa, Mycobacterium
VFSGYRFVRHAAALGRPVA

SEQ ID NO: 780150 - protein, 19 aa, Mycobacterium
VFSGYRFVRHAAARGIPVG

SEQ ID NO: 780151 - protein, 22 aa, Mycobacterium
VFSPRLAGFVLDSFTGRSNAPE

SEQ ID NO: 780152 - protein, 18 aa, Mycobacterium
VFSTIGFDRASLRQIAEE

SEQ ID NO: 780153 - protein, 20 aa, Mycobacterium
VFTPGLAGLVLGEFRRIEQS

SEQ ID NO: 780154 - protein, 17 aa, Mycobacterium
VFTPGLAGLVLGEYRRI

SEQ ID NO: 780155 - protein, 23 aa, Mycobacterium
VFTRPGPQLPLAVVHGVSVGLLI

SEQ ID NO: 780156 - protein, 17 aa, Mycobacterium
VFVALSWSKHPAPQNFE

SEQ ID NO: 780157 - protein, 17 aa, Mycobacterium
VFVALSWSKHPAPQTYE

SEQ ID NO: 780158 - protein, 23 aa, Mycobacterium
VFVGYRWYDARALEVTFPFGHGL

SEQ ID NO: 780159 - protein, 17 aa, Mycobacterium
VFWDELFVFPVLNMRLP

SEQ ID NO: 780160 - protein, 20 aa, Mycobacterium
VFWPIPRVYSGLVRIDRYAT

SEQ ID NO: 780161 - protein, 20 aa, Mycobacterium
VFWPIPRVYSGLVRIDRYET

SEQ ID NO: 780162 - protein, 20 aa, Mycobacterium
VFWPIPRVYSGLVRIDRYPT

SEQ ID NO: 780163 - protein, 21 aa, Mycobacterium
VGAALTRLGFRVIPSDANFVL

SEQ ID NO: 780164 - protein, 17 aa, Mycobacterium
VGACARGLMSREDVDAI

SEQ ID NO: 780165 - protein, 17 aa, Mycobacterium
VGACATAAVSVEEGVDK

SEQ ID NO: 780166 - protein, 17 aa, Mycobacterium
VGACVRGLMSREDVDII

SEQ ID NO: 780167 - protein, 20 aa, Mycobacterium
VGAICGGVGRYAVSKAADYA

SEQ ID NO: 780168 - protein, 17 aa, Mycobacterium
VGALLRYAAGDRAHRRG

SEQ ID NO: 780169 - protein, 17 aa, Mycobacterium
VGALVLTSCDAFENFPP

SEQ ID NO: 780170 - protein, 17 aa, Mycobacterium
VGAPGYLDTVTWRRQIT

SEQ ID NO: 780171 - protein, 17 aa, Mycobacterium
VGAPLRFRHRVYNTAVV

SEQ ID NO: 780172 - protein, 17 aa, Mycobacterium
VGARLNWLLGHGDSPQW

SEQ ID NO: 780173 - protein, 19 aa, Mycobacterium
VGARLNWLLGHGEPPQFSR

SEQ ID NO: 780174 - protein, 19 aa, Mycobacterium
VGASTRFTAQVSLARKYTT

SEQ ID NO: 780175 - protein, 18 aa, Mycobacterium
VGATGVMLGRPCYQIEFS

SEQ ID NO: 780176 - protein, 20 aa, Mycobacterium
VGAWGARPTAQFGYEAAASA

SEQ ID NO: 780177 - protein, 23 aa, Mycobacterium
VGAYFPFGWPMACHVQGDAGVDT

SEQ ID NO: 780178 - protein, 21 aa, Mycobacterium
VGCGWGGAVVRALEKYDVNVI

SEQ ID NO: 780179 - protein, 19 aa, Mycobacterium
VGCGWGSAMARAVERYDVN

SEQ ID NO: 780180 - protein, 23 aa, Mycobacterium
VGCTDCWGRIAADVITMVRPEIA

SEQ ID NO: 780181 - protein, 18 aa, Mycobacterium
VGCVGIGRYARSIVGSTA

SEQ ID NO: 780182 - protein, 22 aa, Mycobacterium
VGDIPWNLIWALLKEVAEAYLA

SEQ ID NO: 780183 - protein, 23 aa, Mycobacterium
VGDIRGAVMLGVYYNEYQSASAG

SEQ ID NO: 780184 - protein, 20 aa, Mycobacterium
VGDRVGIAWLRHTCGVCKYC

SEQ ID NO: 780185 - protein, 17 aa, Mycobacterium
VGDTVIWDNNGVLHRAA

SEQ ID NO: 780186 - protein, 25 aa, Mycobacterium
VGDWALRPTAEFGYRACEAAARGEA

SEQ ID NO: 780187 - protein, 28 aa, Mycobacterium
VGEAYRWFNHSMLYAFQGAFGPLIAPGF

SEQ ID NO: 780188 - protein, 17 aa, Mycobacterium
VGECRRRCASSPPTYAS

SEQ ID NO: 780189 - protein, 23 aa, Mycobacterium
VGEGRKSLTFALRFRAPDRTLTE

SEQ ID NO: 780190 - protein, 24 aa, Mycobacterium
VGEGRVGWRISIPAAMSYWSELAR

SEQ ID NO: 780191 - protein, 18 aa, Mycobacterium
VGEICFKSKIARRSYYKG

SEQ ID NO: 780192 - protein, 21 aa, Mycobacterium
VGELWSRFMQKWVDHITTVIE

SEQ ID NO: 780193 - protein, 23 aa, Mycobacterium
VGFDIPNEFVVGYGLDYAERYRD

SEQ ID NO: 780194 - protein, 18 aa, Mycobacterium
VGFIFQFFNLIPTLTAKE

SEQ ID NO: 780195 - protein, 18 aa, Mycobacterium
VGFPTLWSHHHLDEVTHD

SEQ ID NO: 780196 - protein, 20 aa, Mycobacterium
VGFRMPSVWLAEGHAHAAPV

SEQ ID NO: 780197 - protein, 20 aa, Mycobacterium
VGFRMPSVWLAEGHSAVAPV

SEQ ID NO: 780198 - protein, 20 aa, Mycobacterium
VGFRWWTRCRALELGLTGYA

SEQ ID NO: 780199 - protein, 25 aa, Mycobacterium
VGGAGGKGGLLFGAGGEGGAGGTGG

SEQ ID NO: 780200 - protein, 20 aa, Mycobacterium
VGGARRCAAQSWSLERIRAV

SEQ ID NO: 780201 - protein, 19 aa, Mycobacterium
VGGCAACKLKVISGAVAVD

SEQ ID NO: 780202 - protein, 17 aa, Mycobacterium
VGGEGGAVFGYAQGGTG

SEQ ID NO: 780203 - protein, 26 aa, Mycobacterium
VGGEGGRGGQWFGHGGGGGAGGAGGA

SEQ ID NO: 780204 - protein, 20 aa, Mycobacterium
VGGEQWLAVRGFRLTEGAEP

SEQ ID NO: 780205 - protein, 18 aa, Mycobacterium
VGGFRDWLLDAACRDDAA

SEQ ID NO: 780206 - protein, 25 aa, Mycobacterium
VGGGPRLGTGLALAAQVRRGTSAAA

SEQ ID NO: 780207 - protein, 24 aa, Mycobacterium
VGGIGGRAGLLWGHTGTAGISTLL

SEQ ID NO: 780208 - protein, 19 aa, Mycobacterium
VGGPEWLRRAVMAVIWTGT

SEQ ID NO: 780209 - protein, 21 aa, Mycobacterium
VGGPSTWRLGGAINCGKAQPG

SEQ ID NO: 780210 - protein, 23 aa, Mycobacterium
VGGRSTWRLGGAFNCGKAQPGQI

SEQ ID NO: 780211 - protein, 19 aa, Mycobacterium
VGGRWKFLIVWQLAVQGAQ

SEQ ID NO: 780212 - protein, 19 aa, Mycobacterium
VGGTGGWLLGDGGAGGNGG

SEQ ID NO: 780213 - protein, 20 aa, Mycobacterium
VGGVGGRGGAGFASSAAGGA

SEQ ID NO: 780214 - protein, 25 aa, Mycobacterium
VGGWGQRPTAEFGYLACDAAVSDQD

SEQ ID NO: 780215 - protein, 20 aa, Mycobacterium
VGHIPGAVKIDWHTDLNDPR

SEQ ID NO: 780216 - protein, 26 aa, Mycobacterium
VGHPLRVAHAWSFTFDAAWQPLVALL

SEQ ID NO: 780217 - protein, 17 aa, Mycobacterium
VGIFAELLTPLATGVPV

SEQ ID NO: 780218 - protein, 17 aa, Mycobacterium
VGIGFAFAPQFHPSYRH

SEQ ID NO: 780219 - protein, 17 aa, Mycobacterium
VGIKAAAVYVERISDSD

SEQ ID NO: 780220 - protein, 19 aa, Mycobacterium
VGIPDEWFLAGHVVVGWPR

SEQ ID NO: 780221 - protein, 17 aa, Mycobacterium
VGIPIAEIWGMSELSCV

SEQ ID NO: 780222 - protein, 18 aa, Mycobacterium
VGIRAFELAVKYAQQRST

SEQ ID NO: 780223 - protein, 22 aa, Mycobacterium
VGISVELMAAWSSRRLAIEART

SEQ ID NO: 780224 - protein, 33 aa, Mycobacterium
VGITVLPADRWNLFDPVVIRWRLEVGDRTAQLV

SEQ ID NO: 780225 - protein, 19 aa, Mycobacterium
VGIVEGWRGAVLHRVEVDG

SEQ ID NO: 780226 - protein, 19 aa, Mycobacterium
VGIVEGWRGTVVHRVEVDE

SEQ ID NO: 780227 - protein, 23 aa, Mycobacterium
VGKGDRVILMLGNQVELWESMLA

SEQ ID NO: 780228 - protein, 18 aa, Mycobacterium
VGKLRSSLLNAFSITVDE

SEQ ID NO: 780229 - protein, 23 aa, Mycobacterium
VGKTRLAGEWSQRAYEMGAVVLY

SEQ ID NO: 780230 - protein, 23 aa, Mycobacterium
VGKVCGSTAWTFCIYGIHNWLAG

SEQ ID NO: 780231 - protein, 18 aa, Mycobacterium
VGLARGWPLVKSVRLGIA

SEQ ID NO: 780232 - protein, 20 aa, Mycobacterium
VGLASVRFLLAVGDLLIGWR

SEQ ID NO: 780233 - protein, 19 aa, Mycobacterium
VGLCPLRPAILGALAQRDR

SEQ ID NO: 780234 - protein, 21 aa, Mycobacterium
VGLDEYVDWLVDAGCPIRRIP

SEQ ID NO: 780235 - protein, 20 aa, Mycobacterium
VGLLRAEFMLTEALAGRHPR

SEQ ID NO: 780236 - protein, 20 aa, Mycobacterium
VGLLRAEFMLTEALGGRHPR

SEQ ID NO: 780237 - protein, 17 aa, Mycobacterium
VGLPEARYVHLFVARGR

SEQ ID NO: 780238 - protein, 21 aa, Mycobacterium
VGLPMRCVFALTAMGFLPQPA

SEQ ID NO: 780239 - protein, 22 aa, Mycobacterium
VGLPMRCVFALTAMGFLPQSPE

SEQ ID NO: 780240 - protein, 20 aa, Mycobacterium
VGLRPDVRRLPLFGLGCVAG

SEQ ID NO: 780241 - protein, 22 aa, Mycobacterium
VGLSEFRVDLVIADHDEPDRAL

SEQ ID NO: 780242 - protein, 17 aa, Mycobacterium
VGMSGFFNTAAGGTTNH

SEQ ID NO: 780243 - protein, 18 aa, Mycobacterium
VGNHYVVRNAAWNPKIAA

SEQ ID NO: 780244 - protein, 18 aa, Mycobacterium
VGNLRPGATVTIVGMTKN

SEQ ID NO: 780245 - protein, 21 aa, Mycobacterium
VGNRPKIGWRRYEAQAVLSRL

SEQ ID NO: 780246 - protein, 20 aa, Mycobacterium
VGPAAWWHGWERTDWDRLAG

SEQ ID NO: 780247 - protein, 18 aa, Mycobacterium
VGPDMSFLRPWQATTPLV

SEQ ID NO: 780248 - protein, 17 aa, Mycobacterium
VGPFASMLDRARDLIGS

SEQ ID NO: 780249 - protein, 18 aa, Mycobacterium
VGPPWKVQVDEWLVDPAP

SEQ ID NO: 780250 - protein, 18 aa, Mycobacterium
VGPRAELPLPYNGIPGGS

SEQ ID NO: 780251 - protein, 17 aa, Mycobacterium
VGPRIVPIIPDEARTFG

SEQ ID NO: 780252 - protein, 21 aa, Mycobacterium
VGPRLSALVDHTIWFHRAADF

SEQ ID NO: 780253 - protein, 23 aa, Mycobacterium
VGPRPLIWHVMRYYAHFGHKEFI

SEQ ID NO: 780254 - protein, 24 aa, Mycobacterium
VGPRRFSGELARQWVAAGARIVGG

SEQ ID NO: 780255 - protein, 17 aa, Mycobacterium
VGPSHHWIIDGQLGLPY

SEQ ID NO: 780256 - protein, 20 aa, Mycobacterium
VGPSRLFITIFRDLEGLSHS

SEQ ID NO: 780257 - protein, 27 aa, Mycobacterium
VGPVFWAAELLGIMPIDVIKAAAGLLG

SEQ ID NO: 780258 - protein, 17 aa, Mycobacterium
VGQAGAYLSAWANALGA

SEQ ID NO: 780259 - protein, 17 aa, Mycobacterium
VGQELPELSVAPTYLRS

SEQ ID NO: 780260 - protein, 18 aa, Mycobacterium
VGQNVAWQRWTDIVFGLT

SEQ ID NO: 780261 - protein, 23 aa, Mycobacterium
VGRGDFRAPLVIGDRLDTDIEGA

SEQ ID NO: 780262 - protein, 25 aa, Mycobacterium
VGRIATRVPQEWLLPYVHQRYDEPH

SEQ ID NO: 780263 - protein, 22 aa, Mycobacterium
VGRWPLKFIPPIAVGRGLRPER

SEQ ID NO: 780264 - protein, 19 aa, Mycobacterium
VGSAAIAVCLFRLETEVTA

SEQ ID NO: 780265 - protein, 24 aa, Mycobacterium
VGSAWAGVCTPEFVDVPTEALLRQ

SEQ ID NO: 780266 - protein, 25 aa, Mycobacterium
VGSEGLWKRFCDGFHLDAHAPGMAT

SEQ ID NO: 780267 - protein, 18 aa, Mycobacterium
VGSGGGWPTTFHDVATAL

SEQ ID NO: 780268 - protein, 19 aa, Mycobacterium
VGSLFSWTGDPAVVQGPEE

SEQ ID NO: 780269 - protein, 22 aa, Mycobacterium
VGSWPGILARPAAEVVVGELAD

SEQ ID NO: 780270 - protein, 19 aa, Mycobacterium
VGTAFGVGVSSGFFNTGYS

SEQ ID NO: 780271 - protein, 17 aa, Mycobacterium
VGTCPMGTVAQKGDGAF

SEQ ID NO: 780272 - protein, 21 aa, Mycobacterium
VGTFSWPGAYGTWWQADPTAD

SEQ ID NO: 780273 - protein, 25 aa, Mycobacterium
VGTPWRLTWYRGMAALLNGDYDQAT

SEQ ID NO: 780274 - protein, 22 aa, Mycobacterium
VGTWLVLCCRAMQAGAKEALAI

SEQ ID NO: 780275 - protein, 18 aa, Mycobacterium
VGVACLPGGAPVEIELTV

SEQ ID NO: 780276 - protein, 19 aa, Mycobacterium
VGVALRFLPDSLKAVASRI

SEQ ID NO: 780277 - protein, 17 aa, Mycobacterium
VGVAPSFQVGTAPNQQS

SEQ ID NO: 780278 - protein, 22 aa, Mycobacterium
VGVDEIVEWRAPWVDFEAPELT

SEQ ID NO: 780279 - protein, 21 aa, Mycobacterium
VGVFLPERFGFVFVGAAEMAG

SEQ ID NO: 780280 - protein, 17 aa, Mycobacterium
VGVSSGFFNTGYSEAIG

SEQ ID NO: 780281 - protein, 19 aa, Mycobacterium
VGWPKEYGGLGFGPIEQQI

SEQ ID NO: 780282 - protein, 20 aa, Mycobacterium
VGWTRFIAGMARDVILERSA

SEQ ID NO: 780283 - protein, 18 aa, Mycobacterium
VGWVPWIGILAPQINFFY

SEQ ID NO: 780284 - protein, 19 aa, Mycobacterium
VGYAACFHSALRVVARQQK

SEQ ID NO: 780285 - protein, 21 aa, Mycobacterium
VGYAACHWCHVMAHESFADDE

SEQ ID NO: 780286 - protein, 20 aa, Mycobacterium
VGYEVAEWAERVIAVADPDH

SEQ ID NO: 780287 - protein, 25 aa, Mycobacterium
VGYWRRGALSAARFVACPFGAAGSR

SEQ ID NO: 780288 - protein, 17 aa, Mycobacterium
VHAAGLWQAGIPGYIGV

SEQ ID NO: 780289 - protein, 17 aa, Mycobacterium
VHAECAGLIYLVSELDG

SEQ ID NO: 780290 - protein, 18 aa, Mycobacterium
VHALFRRVLTFGLPTVAA

SEQ ID NO: 780291 - protein, 18 aa, Mycobacterium
VHASLPVMVWIPGGAFVF

SEQ ID NO: 780292 - protein, 18 aa, Mycobacterium
VHFPEGFGGLGVSRGLQA

SEQ ID NO: 780293 - protein, 18 aa, Mycobacterium
VHGLPLYHVHGLVLGLLG

SEQ ID NO: 780294 - protein, 17 aa, Mycobacterium
VHIAKMFGLIYGGDHTD

SEQ ID NO: 780295 - protein, 17 aa, Mycobacterium
VHIPELLALDGIVAARR

SEQ ID NO: 780296 - protein, 17 aa, Mycobacterium
VHLLRSAFATVLVARVD

SEQ ID NO: 780297 - protein, 17 aa, Mycobacterium
VHLNLSWALSRAAGGRK

SEQ ID NO: 780298 - protein, 23 aa, Mycobacterium
VHLPRSDPFWSYADRLTSPGLGG

SEQ ID NO: 780299 - protein, 17 aa, Mycobacterium
VHLRGHFLLTRNAATYW

SEQ ID NO: 780300 - protein, 18 aa, Mycobacterium
VHLRGHFLLTRNAATYWR

SEQ ID NO: 780301 - protein, 18 aa, Mycobacterium
VHLWDWAAGALIASEAGA

SEQ ID NO: 780302 - protein, 17 aa, Mycobacterium
VHPFDLGFVNGFVRRVG

SEQ ID NO: 780303 - protein, 21 aa, Mycobacterium
VHPILLFSLMKGMRSMEGGLG

SEQ ID NO: 780304 - protein, 19 aa, Mycobacterium
VHRFLKLLGGYTFSRHSYS

SEQ ID NO: 780305 - protein, 19 aa, Mycobacterium
VHRNGLRLAKLVNTLLDFS

SEQ ID NO: 780306 - protein, 18 aa, Mycobacterium
VHSHYWLSGQVGWLARDR

SEQ ID NO: 780307 - protein, 18 aa, Mycobacterium
VHVFLRIKPQWDFIEVRR

SEQ ID NO: 780308 - protein, 18 aa, Mycobacterium
VHVFLRIKTDWDFIAVRR

SEQ ID NO: 780309 - protein, 18 aa, Mycobacterium
VHVLRRFGVPSILSATAV

SEQ ID NO: 780310 - protein, 26 aa, Mycobacterium
VHVRIASPPVRWPCFYGIDFASPAEL

SEQ ID NO: 780311 - protein, 22 aa, Mycobacterium
VHVSAIKFPNLELGLPAIDINI

SEQ ID NO: 780312 - protein, 18 aa, Mycobacterium
VHYPFPIDDLVAVDDALK

SEQ ID NO: 780313 - protein, 22 aa, Mycobacterium
VHYRPRPVVGIIAPWNYPVANA

SEQ ID NO: 780314 - protein, 19 aa, Mycobacterium
VIADCMSHWTLPHLVGSAA

SEQ ID NO: 780315 - protein, 18 aa, Mycobacterium
VIAPNLWAGVGLVRGGAG

SEQ ID NO: 780316 - protein, 17 aa, Mycobacterium
VIARIAAGVAHGNAKLS

SEQ ID NO: 780317 - protein, 17 aa, Mycobacterium
VICCPAFGAAGKIGTFN

SEQ ID NO: 780318 - protein, 17 aa, Mycobacterium
VICCPAFGAAGKVGTFN

SEQ ID NO: 780319 - protein, 22 aa, Mycobacterium
VICEVLAWRGIWLSEERRRIGN

SEQ ID NO: 780320 - protein, 19 aa, Mycobacterium
VICRRSRLMGRVAGSGAMA

SEQ ID NO: 780321 - protein, 19 aa, Mycobacterium
VIDCFRAGGGVPYSDYPRF

SEQ ID NO: 780322 - protein, 18 aa, Mycobacterium
VIDPRWVLPVSDGIVELA

SEQ ID NO: 780323 - protein, 24 aa, Mycobacterium
VIDRELRRYLPFLATTKVLMAAVR

SEQ ID NO: 780324 - protein, 24 aa, Mycobacterium
VIEECLRLSLDYAKSRTLWGKEIA

SEQ ID NO: 780325 - protein, 17 aa, Mycobacterium
VIEELREARALGIPARP

SEQ ID NO: 780326 - protein, 18 aa, Mycobacterium
VIEQLNFPGYFLVVHDIT

SEQ ID NO: 780327 - protein, 18 aa, Mycobacterium
VIETLQWMGGFGAIQYYA

SEQ ID NO: 780328 - protein, 20 aa, Mycobacterium
VIEVDGWRVGMGICRDTGID

SEQ ID NO: 780329 - protein, 17 aa, Mycobacterium
VIFAYPGVHAIWGHRIS

SEQ ID NO: 780330 - protein, 17 aa, Mycobacterium
VIFCSFGDMLRVPGSEK

SEQ ID NO: 780331 - protein, 21 aa, Mycobacterium
VIGDCMSHWTLLRLVGLATAA

SEQ ID NO: 780332 - protein, 18 aa, Mycobacterium
VIGFREHASWALASDTLD

SEQ ID NO: 780333 - protein, 17 aa, Mycobacterium
VIGHDWGAVVAWNAAQL

SEQ ID NO: 780334 - protein, 20 aa, Mycobacterium
VIGQIPICWDPDRDAAIDRA

SEQ ID NO: 780335 - protein, 17 aa, Mycobacterium
VIGRGGVDLGRFWSEQR

SEQ ID NO: 780336 - protein, 23 aa, Mycobacterium
VIHDWGSALGFDWANRHRERIGG

SEQ ID NO: 780337 - protein, 19 aa, Mycobacterium
VIICGVGLYAGYVESYQQM

SEQ ID NO: 780338 - protein, 19 aa, Mycobacterium
VIIRGAVYGSLYVTDDRPG

SEQ ID NO: 780339 - protein, 17 aa, Mycobacterium
VIIVPGLWRDFDHTALA

SEQ ID NO: 780340 - protein, 19 aa, Mycobacterium
VILSRCVEVPFRLDFPSTY

SEQ ID NO: 780341 - protein, 19 aa, Mycobacterium
VILSRRVEVPFAMDFPSTY

SEQ ID NO: 780342 - protein, 18 aa, Mycobacterium
VIMPGISGADGRLGDAGA

SEQ ID NO: 780343 - protein, 24 aa, Mycobacterium
VIPHVVRLAGRWLRPGGRFAVEHD

SEQ ID NO: 780344 - protein, 24 aa, Mycobacterium
VIQRELDRYLPFLATTRILIAAVR

SEQ ID NO: 780345 - protein, 24 aa, Mycobacterium
VIQRELDRYLPFLATTRILMAAVR

SEQ ID NO: 780346 - protein, 25 aa, Mycobacterium
VIQVRRLGAAMSFVIASSEMMAAAA

SEQ ID NO: 780347 - protein, 24 aa, Mycobacterium
VIRPIVALAARWLRDGGKCAVEHD

SEQ ID NO: 780348 - protein, 25 aa, Mycobacterium
VIRPSLRPAQRWMLSAGVLSVIGSI

SEQ ID NO: 780349 - protein, 18 aa, Mycobacterium
VISALWWVHWRVTKNPEE

SEQ ID NO: 780350 - protein, 18 aa, Mycobacterium
VIVAPMFHAWGFSQLAFA

SEQ ID NO: 780351 - protein, 18 aa, Mycobacterium
VIVAPMFHAWGFSQLLLA

SEQ ID NO: 780352 - protein, 18 aa, Mycobacterium
VIVGFRWPYVKGPDTEPL

SEQ ID NO: 780353 - protein, 17 aa, Mycobacterium
VIWGHGWDESRWPDGRP

SEQ ID NO: 780354 - protein, 18 aa, Mycobacterium
VIYHARFGPTLAETLEKA

SEQ ID NO: 780355 - protein, 24 aa, Mycobacterium
VKAALTRLGCPYVWGAKGPNQFDC

SEQ ID NO: 780356 - protein, 30 aa, Mycobacterium
VKAAMLRARRRIMLIGWDFDSRVTFERGRK

SEQ ID NO: 780357 - protein, 28 aa, Mycobacterium
VKAGGGACPIRFQCAGCGFYRPDPSYLP

SEQ ID NO: 780358 - protein, 21 aa, Mycobacterium
VKAGVQWGLFGGAIENLGTAT

SEQ ID NO: 780359 - protein, 21 aa, Mycobacterium
VKAGVQWGLFGGAVENLGTER

SEQ ID NO: 780360 - protein, 21 aa, Mycobacterium
VKAICVSPTFVAAVASLAPAA

SEQ ID NO: 780361 - protein, 17 aa, Mycobacterium
VKAIRPGQTFTRTDSGF

SEQ ID NO: 780362 - protein, 21 aa, Mycobacterium
VKALGGRGVFGVELMINGDEV

SEQ ID NO: 780363 - protein, 21 aa, Mycobacterium
VKALGGRGVFGVELMVNGDEV

SEQ ID NO: 780364 - protein, 17 aa, Mycobacterium
VKAPIRWTDINTDDMRP

SEQ ID NO: 780365 - protein, 17 aa, Mycobacterium
VKDACLEYALANDERFG

SEQ ID NO: 780366 - protein, 20 aa, Mycobacterium
VKDFRFNQIVSEEMFLTGSV

SEQ ID NO: 780367 - protein, 17 aa, Mycobacterium
VKDGRIVAVGNWSDVEG

SEQ ID NO: 780368 - protein, 18 aa, Mycobacterium
VKDLRTWHGTVLAAAAFA

SEQ ID NO: 780369 - protein, 18 aa, Mycobacterium
VKDLRTWHGTVLAAEAFV

SEQ ID NO: 780370 - protein, 24 aa, Mycobacterium
VKEARRRWELMAGRSAELLTGHCL

SEQ ID NO: 780371 - protein, 17 aa, Mycobacterium
VKESFAEAVSWVAKNLP

SEQ ID NO: 780372 - protein, 18 aa, Mycobacterium
VKGDGRWRFSRWVVGIDQ

SEQ ID NO: 780373 - protein, 19 aa, Mycobacterium
VKGFSAWYAGHVDLTDPPA

SEQ ID NO: 780374 - protein, 20 aa, Mycobacterium
VKGPDFPTAGLIVGSQGIAD

SEQ ID NO: 780375 - protein, 18 aa, Mycobacterium
VKHWNRWCEGAGIGDVAR

SEQ ID NO: 780376 - protein, 17 aa, Mycobacterium
VKIAFGLNQAVFDELSD

SEQ ID NO: 780377 - protein, 17 aa, Mycobacterium
VKKAAAEHGLWYPPDPS

SEQ ID NO: 780378 - protein, 18 aa, Mycobacterium
VKKILGFDPDKTFEVSED

SEQ ID NO: 780379 - protein, 17 aa, Mycobacterium
VKKVVAEHGLWYPPDPS

SEQ ID NO: 780380 - protein, 20 aa, Mycobacterium
VKKWLAEVLPNFPVYAHMLG

SEQ ID NO: 780381 - protein, 18 aa, Mycobacterium
VKLFDDWSNLGSVSDLSA

SEQ ID NO: 780382 - protein, 18 aa, Mycobacterium
VKLLGRFAAEPTRENIEK

SEQ ID NO: 780383 - protein, 18 aa, Mycobacterium
VKLNFPPPLAHLGSDPST

SEQ ID NO: 780384 - protein, 17 aa, Mycobacterium
VKLPGGLWIVTERAVAT

SEQ ID NO: 780385 - protein, 22 aa, Mycobacterium
VKLVNLPVEWSVRGVDRAADAL

SEQ ID NO: 780386 - protein, 19 aa, Mycobacterium
VKLWRHWDHCALHWFPGSH

SEQ ID NO: 780387 - protein, 21 aa, Mycobacterium
VKMALHYEGWVVDIAHNGREA

SEQ ID NO: 780388 - protein, 25 aa, Mycobacterium
VKNNRLAAVGFVWAFIAAGCEGPTR

SEQ ID NO: 780389 - protein, 19 aa, Mycobacterium
VKPRLLGHWGTTPGLNLVY

SEQ ID NO: 780390 - protein, 19 aa, Mycobacterium
VKQQGVWRISRWVVTADQT

SEQ ID NO: 780391 - protein, 21 aa, Mycobacterium
VKRARLVLDAGVLKDTQVLEY

SEQ ID NO: 780392 - protein, 18 aa, Mycobacterium
VKRMSEFTLGKGLDEKST

SEQ ID NO: 780393 - protein, 25 aa, Mycobacterium
VKRVLRPGGYFAYADIRPCTEIAEW

SEQ ID NO: 780394 - protein, 18 aa, Mycobacterium
VKSHGWGVPGLTWMPGED

SEQ ID NO: 780395 - protein, 17 aa, Mycobacterium
VKSNGWGVPGLSWTPGQ

SEQ ID NO: 780396 - protein, 17 aa, Mycobacterium
VKSTLWGPLDTRRAKGF

SEQ ID NO: 780397 - protein, 21 aa, Mycobacterium
VKVEGGWRLTGQKIWTSVAQF

SEQ ID NO: 780398 - protein, 17 aa, Mycobacterium
VKVIDWFVRATVDRRYE

SEQ ID NO: 780399 - protein, 17 aa, Mycobacterium
VKVPRRLKDLNSQLAKA

SEQ ID NO: 780400 - protein, 19 aa, Mycobacterium
VKVPRRLKELHLRLGAATA

SEQ ID NO: 780401 - protein, 21 aa, Mycobacterium
VKVRGGVILGEFATLVDPQRS

SEQ ID NO: 780402 - protein, 17 aa, Mycobacterium
VKVRPGYEAALAAVLGA

SEQ ID NO: 780403 - protein, 21 aa, Mycobacterium
VLACGICGSDLHFAAHGEEML

SEQ ID NO: 780404 - protein, 17 aa, Mycobacterium
VLAEARLAAYAREFGEE

SEQ ID NO: 780405 - protein, 25 aa, Mycobacterium
VLAGRAGPPTVVWPVTAVSAVTVVS

SEQ ID NO: 780406 - protein, 24 aa, Mycobacterium
VLAGVPWPHGWNRAYFTPVTVLDG

SEQ ID NO: 780407 - protein, 19 aa, Mycobacterium
VLAGWSRRGQPPIVCGLDL

SEQ ID NO: 780408 - protein, 17 aa, Mycobacterium
VLAHDWGSVGIWEYLSR

SEQ ID NO: 780409 - protein, 20 aa, Mycobacterium
VLARAIVRLALSYVSMPPEA

SEQ ID NO: 780410 - protein, 24 aa, Mycobacterium
VLARDFLLTWFVTLAWEVAEAKRL

SEQ ID NO: 780411 - protein, 20 aa, Mycobacterium
VLARPGARHRPAIAATIQGL

SEQ ID NO: 780412 - protein, 23 aa, Mycobacterium
VLARSWVPVSIPGLFAAQATRTP

SEQ ID NO: 780413 - protein, 23 aa, Mycobacterium
VLARSWVPVSIPGLFAAQVVRTP

SEQ ID NO: 780414 - protein, 23 aa, Mycobacterium
VLASWRLLLDIGRLQDGEPYLAG

SEQ ID NO: 780415 - protein, 19 aa, Mycobacterium
VLAVLPFFHIYGLVVLLNV

SEQ ID NO: 780416 - protein, 24 aa, Mycobacterium
VLAVRAGLPPGVFNVVTGIGAEAG

SEQ ID NO: 780417 - protein, 18 aa, Mycobacterium
VLAWLHPPGFDFGPALLA

SEQ ID NO: 780418 - protein, 19 aa, Mycobacterium
VLCALPARYITPMSPKKPR

SEQ ID NO: 780419 - protein, 20 aa, Mycobacterium
VLCALPARYITPSSKKKPRP

SEQ ID NO: 780420 - protein, 23 aa, Mycobacterium
VLCGLPALWLRRLCANMLCKLGV

SEQ ID NO: 780421 - protein, 18 aa, Mycobacterium
VLCGSAFKNKGVQPMLDA

SEQ ID NO: 780422 - protein, 18 aa, Mycobacterium
VLCGVGFYAGFVGSYREM

SEQ ID NO: 780423 - protein, 17 aa, Mycobacterium
VLCMHFAKQAARFFDSA

SEQ ID NO: 780424 - protein, 22 aa, Mycobacterium
VLCTELRISAATLRRDLSELEE

SEQ ID NO: 780425 - protein, 18 aa, Mycobacterium
VLDGLGLDYTIMFPTLAS

SEQ ID NO: 780426 - protein, 17 aa, Mycobacterium
VLDHLRVAMSVAGWDTT

SEQ ID NO: 780427 - protein, 17 aa, Mycobacterium
VLDPRFRTAATWLPALK

SEQ ID NO: 780428 - protein, 18 aa, Mycobacterium
VLDPRFRTAATWPASLRA

SEQ ID NO: 780429 - protein, 22 aa, Mycobacterium
VLDPRLRAAASWPAGVAAGRRV

SEQ ID NO: 780430 - protein, 17 aa, Mycobacterium
VLDSCLYTTPSKYGGEG

SEQ ID NO: 780431 - protein, 22 aa, Mycobacterium
VLDSRINWKLAIDTFSENYHFA

SEQ ID NO: 780432 - protein, 17 aa, Mycobacterium
VLDVFGSWVITDLNVLD

SEQ ID NO: 780433 - protein, 25 aa, Mycobacterium
VLEAARWAATWGQRQPVRFIVGRRG

SEQ ID NO: 780434 - protein, 24 aa, Mycobacterium
VLEAYPGHIARMFGLVFGGDPESH

SEQ ID NO: 780435 - protein, 17 aa, Mycobacterium
VLELTGLDRYVEVRVDG

SEQ ID NO: 780436 - protein, 17 aa, Mycobacterium
VLERIYFRTGDTLISNR

SEQ ID NO: 780437 - protein, 23 aa, Mycobacterium
VLERPRVGTLFVIPGRGDTLRIN

SEQ ID NO: 780438 - protein, 19 aa, Mycobacterium
VLESFKLLTNVSRLFAERC

SEQ ID NO: 780439 - protein, 26 aa, Mycobacterium
VLFLDELVLWLAFSVRDTEFFARESQ

SEQ ID NO: 780440 - protein, 17 aa, Mycobacterium
VLFPGRLPVPAPQLARV

SEQ ID NO: 780441 - protein, 18 aa, Mycobacterium
VLFVPRVVEMVFQRFQAE

SEQ ID NO: 780442 - protein, 17 aa, Mycobacterium
VLGCWKIGAVPVPMHWD

SEQ ID NO: 780443 - protein, 21 aa, Mycobacterium
VLGFREHASWALASDTLEFVD

SEQ ID NO: 780444 - protein, 17 aa, Mycobacterium
VLGHDWGSVAMWEAICD

SEQ ID NO: 780445 - protein, 26 aa, Mycobacterium
VLGPCWPEALGVLSFRMYYRGHNLHL

SEQ ID NO: 780446 - protein, 18 aa, Mycobacterium
VLGPRGFRALRLDRNRNN

SEQ ID NO: 780447 - protein, 19 aa, Mycobacterium
VLGSLKRQGEWTVPTRLAL

SEQ ID NO: 780448 - protein, 19 aa, Mycobacterium
VLGSLKRQGEWVVPSRLAL

SEQ ID NO: 780449 - protein, 20 aa, Mycobacterium
VLGYWQWREGLLRGIAAHHA

SEQ ID NO: 780450 - protein, 20 aa, Mycobacterium
VLHRYLGWRLSGYDPATHLG

SEQ ID NO: 780451 - protein, 19 aa, Mycobacterium
VLHYYWRFVPEADEDGVVE

SEQ ID NO: 780452 - protein, 20 aa, Mycobacterium
VLIDQEWKYGVATGVETALL

SEQ ID NO: 780453 - protein, 18 aa, Mycobacterium
VLIGHDWGGFTAAGIAAY

SEQ ID NO: 780454 - protein, 17 aa, Mycobacterium
VLILKANGKGFCSGHAI

SEQ ID NO: 780455 - protein, 19 aa, Mycobacterium
VLIPGGFGIRGIEGKLGAI

SEQ ID NO: 780456 - protein, 18 aa, Mycobacterium
VLKLSPWVLTARVADQFQ

SEQ ID NO: 780457 - protein, 20 aa, Mycobacterium
VLLCQLEIPVRVALTAARWA

SEQ ID NO: 780458 - protein, 18 aa, Mycobacterium
VLLLHGFGSFWWSWRHQL

SEQ ID NO: 780459 - protein, 20 aa, Mycobacterium
VLLLRRVWTATLGLAGRVAM

SEQ ID NO: 780460 - protein, 18 aa, Mycobacterium
VLLVPHFVRRAIGSRVRP

SEQ ID NO: 780461 - protein, 19 aa, Mycobacterium
VLMDREWKHGVAAAVDVTL

SEQ ID NO: 780462 - protein, 19 aa, Mycobacterium
VLMDREWKYGVAAAVDVTL

SEQ ID NO: 780463 - protein, 23 aa, Mycobacterium
VLNAKTRRPSVCNAAESLLIDAA

SEQ ID NO: 780464 - protein, 18 aa, Mycobacterium
VLNALGITVLAAPGFEAD

SEQ ID NO: 780465 - protein, 18 aa, Mycobacterium
VLNLLRWTSARTIKETFV

SEQ ID NO: 780466 - protein, 17 aa, Mycobacterium
VLNQRRAFIFSESLGGL

SEQ ID NO: 780467 - protein, 21 aa, Mycobacterium
VLNRLKPGIIMCREKQDTTSA

SEQ ID NO: 780468 - protein, 19 aa, Mycobacterium
VLPAQWPVLLCNGAVGIAE

SEQ ID NO: 780469 - protein, 23 aa, Mycobacterium
VLPDRPGLFFAIDAHSMWANTAA

SEQ ID NO: 780470 - protein, 18 aa, Mycobacterium
VLPFCAGSPFPKNVCEWD

SEQ ID NO: 780471 - protein, 19 aa, Mycobacterium
VLPGGLNWPLDLTMGDDGR

SEQ ID NO: 780472 - protein, 24 aa, Mycobacterium
VLPGRWSFQIVEEFDDMYWSLFRE

SEQ ID NO: 780473 - protein, 19 aa, Mycobacterium
VLPHLRPGSAIINITSTFA

SEQ ID NO: 780474 - protein, 23 aa, Mycobacterium
VLPPEINSALIFAGAGSEPMLTA

SEQ ID NO: 780475 - protein, 21 aa, Mycobacterium
VLPPRLRSAFDHDFERQPQMM

SEQ ID NO: 780476 - protein, 22 aa, Mycobacterium
VLPRLDAPTGRRTVLCVRRLEH

SEQ ID NO: 780477 - protein, 17 aa, Mycobacterium
VLQALTFLRGPRTWVLK

SEQ ID NO: 780478 - protein, 17 aa, Mycobacterium
VLQCPFHGWQWSHQGRN

SEQ ID NO: 780479 - protein, 18 aa, Mycobacterium
VLQCPFHGWQWSQEGRNV

SEQ ID NO: 780480 - protein, 18 aa, Mycobacterium
VLQCPFHGWQWSTDGRNV

SEQ ID NO: 780481 - protein, 17 aa, Mycobacterium
VLQRLLPMWDRPLRDVS

SEQ ID NO: 780482 - protein, 18 aa, Mycobacterium
VLRARAGIRPRLTDENKL

SEQ ID NO: 780483 - protein, 26 aa, Mycobacterium
VLREFLDGLQGGFGRTLDTAAKAYAS

SEQ ID NO: 780484 - protein, 19 aa, Mycobacterium
VLRELRAALHFNALSLSGV

SEQ ID NO: 780485 - protein, 19 aa, Mycobacterium
VLRELRGGVHFNLLALSGV

SEQ ID NO: 780486 - protein, 23 aa, Mycobacterium
VLREQRGGLIIQFSSMGGRVGGS

SEQ ID NO: 780487 - protein, 28 aa, Mycobacterium
VLRGGKRLRPAFAYWGFRAVAGTEPEPH

SEQ ID NO: 780488 - protein, 23 aa, Mycobacterium
VLRLPRIPMRFPMYLPGPNRVMI

SEQ ID NO: 780489 - protein, 23 aa, Mycobacterium
VLRPEWPRAALSVGDLGWSDTVP

SEQ ID NO: 780490 - protein, 18 aa, Mycobacterium
VLRRAGLPAPRFGMATSF

SEQ ID NO: 780491 - protein, 24 aa, Mycobacterium
VLRVVKFWISHGVKVFRVDNPHTK

SEQ ID NO: 780492 - protein, 17 aa, Mycobacterium
VLSCLAVGIPHTDLGQV

SEQ ID NO: 780493 - protein, 17 aa, Mycobacterium
VLSGGYWADMAVTAERG

SEQ ID NO: 780494 - protein, 17 aa, Mycobacterium
VLSGLGLIANPVSAVPV

SEQ ID NO: 780495 - protein, 17 aa, Mycobacterium
VLSKGWTEKQFQRLGQI

SEQ ID NO: 780496 - protein, 21 aa, Mycobacterium
VLSLEFARLAGYYLAEGHACL

SEQ ID NO: 780497 - protein, 17 aa, Mycobacterium
VLSQGWDVMDFIQQLQK

SEQ ID NO: 780498 - protein, 21 aa, Mycobacterium
VLTGWWLRRMVAVRQPLREKL

SEQ ID NO: 780499 - protein, 17 aa, Mycobacterium
VLTKGKLPASEWIDVIS

SEQ ID NO: 780500 - protein, 21 aa, Mycobacterium
VLTKPRWFFSFAKTLRPPDLR

SEQ ID NO: 780501 - protein, 18 aa, Mycobacterium
VLTMTYLDGMDWAAAQDA

SEQ ID NO: 780502 - protein, 17 aa, Mycobacterium
VLTRGIIKWGIRDAREL

SEQ ID NO: 780503 - protein, 24 aa, Mycobacterium
VLTRLRGMFAFALWDTVTRELFCA

SEQ ID NO: 780504 - protein, 17 aa, Mycobacterium
VLTRYEPVLGMEVHVEL

SEQ ID NO: 780505 - protein, 17 aa, Mycobacterium
VLTSRYALAVAREKGHA

SEQ ID NO: 780506 - protein, 17 aa, Mycobacterium
VLVFLPRCEHCAACATE

SEQ ID NO: 780507 - protein, 19 aa, Mycobacterium
VLVHPRPRLSVMAVGGELV

SEQ ID NO: 780508 - protein, 20 aa, Mycobacterium
VLVHPRPRLSVMAVGGELVD

SEQ ID NO: 780509 - protein, 22 aa, Mycobacterium
VLVHPRPRLSVMCVGGELVDIS

SEQ ID NO: 780510 - protein, 18 aa, Mycobacterium
VLVIAALARQNGLAAQHS

SEQ ID NO: 780511 - protein, 18 aa, Mycobacterium
VLVLPGLFPVVGSTEAEA

SEQ ID NO: 780512 - protein, 18 aa, Mycobacterium
VLVPFAWQGVTLHAAGAS

SEQ ID NO: 780513 - protein, 18 aa, Mycobacterium
VLVPFSWQGVSLHAGGAS

SEQ ID NO: 780514 - protein, 17 aa, Mycobacterium
VLWLARRARQCWEGVQI

SEQ ID NO: 780515 - protein, 17 aa, Mycobacterium
VLYELPHGLPFTELLAL

SEQ ID NO: 780516 - protein, 19 aa, Mycobacterium
VMAALWPQRCSGLVAVSGY

SEQ ID NO: 780517 - protein, 18 aa, Mycobacterium
VMAARWNRVLGAWPITTS

SEQ ID NO: 780518 - protein, 18 aa, Mycobacterium
VMAARWSKVLGAWPITTA

SEQ ID NO: 780519 - protein, 23 aa, Mycobacterium
VMAGFGRTGEWFAINHFNVVPDL

SEQ ID NO: 780520 - protein, 20 aa, Mycobacterium
VMAPHLWRFLLYQPVVASAG

SEQ ID NO: 780521 - protein, 17 aa, Mycobacterium
VMCRAEVAPILLAAIRD

SEQ ID NO: 780522 - protein, 18 aa, Mycobacterium
VMDRLKPAIVLCRDKQDS

SEQ ID NO: 780523 - protein, 19 aa, Mycobacterium
VMDRLKPGIIMCREKQDTT

SEQ ID NO: 780524 - protein, 18 aa, Mycobacterium
VMGRGSLVTALACGGLAY

SEQ ID NO: 780525 - protein, 22 aa, Mycobacterium
VMHAGKLLALWEGGRPTRIHPD

SEQ ID NO: 780526 - protein, 19 aa, Mycobacterium
VMIKAQVKVGGRGKAGGVK

SEQ ID NO: 780527 - protein, 18 aa, Mycobacterium
VMKKYVWPWLAARRQIVV

SEQ ID NO: 780528 - protein, 25 aa, Mycobacterium
VMLGLRLRQGLPLAHLDAGERERAQ

SEQ ID NO: 780529 - protein, 21 aa, Mycobacterium
VMLLAECWRWGADEGAVRALL

SEQ ID NO: 780530 - protein, 21 aa, Mycobacterium
VMLRLRLRRGLALDDLAADER

SEQ ID NO: 780531 - protein, 18 aa, Mycobacterium
VMLSALWAAGTGQLVLII

SEQ ID NO: 780532 - protein, 20 aa, Mycobacterium
VMPMDVWRDGDTFIVELDVP

SEQ ID NO: 780533 - protein, 17 aa, Mycobacterium
VMPPRGVGVIELRGESL

SEQ ID NO: 780534 - protein, 18 aa, Mycobacterium
VMPPRGVGVIELRGESLT

SEQ ID NO: 780535 - protein, 19 aa, Mycobacterium
VMPYKDGFGPFAPEIYRAP

SEQ ID NO: 780536 - protein, 18 aa, Mycobacterium
VMRAGLTWQQVVLLRAYS

SEQ ID NO: 780537 - protein, 17 aa, Mycobacterium
VMRAGPGAAVWIPKSTR

SEQ ID NO: 780538 - protein, 20 aa, Mycobacterium
VMTHHRWLRALAVFGGLGLR

SEQ ID NO: 780539 - protein, 20 aa, Mycobacterium
VMTHYRWLRALAGFGGLGLR

SEQ ID NO: 780540 - protein, 17 aa, Mycobacterium
VMTHYRWLRGMSGIGDM

SEQ ID NO: 780541 - protein, 25 aa, Mycobacterium
VMVGFGRFGEWFAINAFDVTPDLIT

SEQ ID NO: 780542 - protein, 17 aa, Mycobacterium
VMVRPLIRLSLGKRQAM

SEQ ID NO: 780543 - protein, 17 aa, Mycobacterium
VMVRPLIRLSLGKRQPM

SEQ ID NO: 780544 - protein, 18 aa, Mycobacterium
VMVRPLIRLSLGKRQPMR

SEQ ID NO: 780545 - protein, 19 aa, Mycobacterium
VMYHARFGPTLAEALERYD

SEQ ID NO: 780546 - protein, 18 aa, Mycobacterium
VNAAWRLDDRGVFSDSHG

SEQ ID NO: 780547 - protein, 26 aa, Mycobacterium
VNAFYTSRCNLIAWDRGVFMPVAQKY

SEQ ID NO: 780548 - protein, 18 aa, Mycobacterium
VNAIMGFLYDEHYYAGLT

SEQ ID NO: 780549 - protein, 17 aa, Mycobacterium
VNARPGVVLVIPGDSPH

SEQ ID NO: 780550 - protein, 19 aa, Mycobacterium
VNCVGVFDFYRGVSDIDAD

SEQ ID NO: 780551 - protein, 17 aa, Mycobacterium
VNCWGRLVSGVGAALGK

SEQ ID NO: 780552 - protein, 18 aa, Mycobacterium
VNGAKAWITHGGIADFYS

SEQ ID NO: 780553 - protein, 17 aa, Mycobacterium
VNGFCLGGGIGLVGNAD

SEQ ID NO: 780554 - protein, 18 aa, Mycobacterium
VNGFCVGGGIGLVGNADV

SEQ ID NO: 780555 - protein, 17 aa, Mycobacterium
VNIAMMICYDVEFPENA

SEQ ID NO: 780556 - protein, 21 aa, Mycobacterium
VNIRLAIDWLDRWADDMPLSL

SEQ ID NO: 780557 - protein, 19 aa, Mycobacterium
VNLEGLWLLQAMLGIPQLA

SEQ ID NO: 780558 - protein, 17 aa, Mycobacterium
VNLHFSVLPAWRGAAPV

SEQ ID NO: 780559 - protein, 24 aa, Mycobacterium
VNLLRLKAFFSRQWQQMPAAHFMT

SEQ ID NO: 780560 - protein, 24 aa, Mycobacterium
VNMLGCYYCNLFAAECMERNAGDT

SEQ ID NO: 780561 - protein, 23 aa, Mycobacterium
VNPCGRLPITFPVGLGQTPRPEL

SEQ ID NO: 780562 - protein, 20 aa, Mycobacterium
VNPESWFIYGLYRLSPSFSR

SEQ ID NO: 780563 - protein, 23 aa, Mycobacterium
VNPMRVAWELSNRLPANAIVTAD

SEQ ID NO: 780564 - protein, 22 aa, Mycobacterium
VNPVRLRLGIGYVIQNAGLMPH

SEQ ID NO: 780565 - protein, 24 aa, Mycobacterium
VNPWQWCRWLLIEPAELADTATDT

SEQ ID NO: 780566 - protein, 22 aa, Mycobacterium
VNQLPRKVAMEMLLTGEPITAS

SEQ ID NO: 780567 - protein, 19 aa, Mycobacterium
VNQRWLGGMLTNFQTVHKR

SEQ ID NO: 780568 - protein, 19 aa, Mycobacterium
VNQRWLGGMLTNFSTVHKR

SEQ ID NO: 780569 - protein, 23 aa, Mycobacterium
VNQTRILAPRSRYDEIVDAVSTF

SEQ ID NO: 780570 - protein, 24 aa, Mycobacterium
VNRARASGMTVVFWLDTERPHEVE

SEQ ID NO: 780571 - protein, 23 aa, Mycobacterium
VNRLRPSEIQWALNHDAVHGIAY

SEQ ID NO: 780572 - protein, 24 aa, Mycobacterium
VNRPLRGCYRIALLSLKGGVGKTT

SEQ ID NO: 780573 - protein, 20 aa, Mycobacterium
VNSARILRGPGPAPLRAAAT

SEQ ID NO: 780574 - protein, 24 aa, Mycobacterium
VNSARWATEFSRGTGLDYRGVVAT

SEQ ID NO: 780575 - protein, 23 aa, Mycobacterium
VNSGAPLWDWMKSIPGFDGGGLV

SEQ ID NO: 780576 - protein, 18 aa, Mycobacterium
VNSGRMYLGPGPATLLAA

SEQ ID NO: 780577 - protein, 22 aa, Mycobacterium
VNSWSAAFARYGRTVGQVLLSA

SEQ ID NO: 780578 - protein, 17 aa, Mycobacterium
VNVCSSAAWITGGKQTP

SEQ ID NO: 780579 - protein, 18 aa, Mycobacterium
VNVTLIFSIERHRQAMDA

SEQ ID NO: 780580 - protein, 18 aa, Mycobacterium
VNVYRVVSNLGVFDFGGP

SEQ ID NO: 780581 - protein, 18 aa, Mycobacterium
VNVYRVVTNLGVFDFGGP

SEQ ID NO: 780582 - protein, 23 aa, Mycobacterium
VNYAVRFGFWGAEEEGLLGSTNY

SEQ ID NO: 780583 - protein, 17 aa, Mycobacterium
VNYRLGVLGAMELSSLS

SEQ ID NO: 780584 - protein, 24 aa, Mycobacterium
VNYWRSGDDIVIWVGIPESKTWWR

SEQ ID NO: 780585 - protein, 18 aa, Mycobacterium
VPAAVRFLSCEPLLGTLK

SEQ ID NO: 780586 - protein, 17 aa, Mycobacterium
VPADRTGPAVAIQQATV

SEQ ID NO: 780587 - protein, 17 aa, Mycobacterium
VPAELAALVGRDDDRGT

SEQ ID NO: 780588 - protein, 25 aa, Mycobacterium
VPALRALPEYDLRAVATSRPESAER

SEQ ID NO: 780589 - protein, 26 aa, Mycobacterium
VPALSCAKCRAVARCRHCTGPLSLPA

SEQ ID NO: 780590 - protein, 20 aa, Mycobacterium
VPAPDRVEWVLAHPTGITEI

SEQ ID NO: 780591 - protein, 22 aa, Mycobacterium
VPAPRLPALLAELAPHSADIAR

SEQ ID NO: 780592 - protein, 19 aa, Mycobacterium
VPAQRLWVNPDCGLKTRNA

SEQ ID NO: 780593 - protein, 17 aa, Mycobacterium
VPARLEALGALGGLDRY

SEQ ID NO: 780594 - protein, 21 aa, Mycobacterium
VPARPALELSKIYVLADRHGT

SEQ ID NO: 780595 - protein, 19 aa, Mycobacterium
VPCCFPTCRSITYLLTDGE

SEQ ID NO: 780596 - protein, 18 aa, Mycobacterium
VPCNRKWYSRLAITELLI

SEQ ID NO: 780597 - protein, 24 aa, Mycobacterium
VPDALECLACLAVDAGNHPHAARL

SEQ ID NO: 780598 - protein, 21 aa, Mycobacterium
VPDNLRWGVYVTFEAVTDYAV

SEQ ID NO: 780599 - protein, 19 aa, Mycobacterium
VPEAFPFLKACHHPVESDL

SEQ ID NO: 780600 - protein, 19 aa, Mycobacterium
VPEDLAFAESRIRPSTIAA

SEQ ID NO: 780601 - protein, 17 aa, Mycobacterium
VPEEVAWRVGFIDDATL

SEQ ID NO: 780602 - protein, 23 aa, Mycobacterium
VPELIGWRVGYEVAEWAERVIAV

SEQ ID NO: 780603 - protein, 21 aa, Mycobacterium
VPELQRRGAFRDGYDTTTLRG

SEQ ID NO: 780604 - protein, 21 aa, Mycobacterium
VPELRSGGLGIREVKRLTKAT

SEQ ID NO: 780605 - protein, 18 aa, Mycobacterium
VPELWPWPPVDYRRTLTS

SEQ ID NO: 780606 - protein, 21 aa, Mycobacterium
VPESPRLAALLGLGDLPEVTN

SEQ ID NO: 780607 - protein, 20 aa, Mycobacterium
VPEYLLAVLARFARNLRESN

SEQ ID NO: 780608 - protein, 18 aa, Mycobacterium
VPFAFPDERIDAVVEGDS

SEQ ID NO: 780609 - protein, 18 aa, Mycobacterium
VPFAIAMVKFTFPNQNLL

SEQ ID NO: 780610 - protein, 21 aa, Mycobacterium
VPFAPDCIRIEMGLKTGRSGD

SEQ ID NO: 780611 - protein, 17 aa, Mycobacterium
VPGAPVFGDAGVATPPV

SEQ ID NO: 780612 - protein, 23 aa, Mycobacterium
VPGARAALAWSVETAQLAREHNN

SEQ ID NO: 780613 - protein, 26 aa, Mycobacterium
VPGCGECRYCKAGRPAQCSLVASVVA

SEQ ID NO: 780614 - protein, 23 aa, Mycobacterium
VPGDEVYGLIAFDRDGAAADFVA

SEQ ID NO: 780615 - protein, 19 aa, Mycobacterium
VPGDIIWAPAIDGAFVLTT

SEQ ID NO: 780616 - protein, 22 aa, Mycobacterium
VPGEAFVLGVQWHPEERLDDLR

SEQ ID NO: 780617 - protein, 18 aa, Mycobacterium
VPGHGWRLALLKATFGLV

SEQ ID NO: 780618 - protein, 21 aa, Mycobacterium
VPGIGKRGAERLVLELREKVA

SEQ ID NO: 780619 - protein, 17 aa, Mycobacterium
VPGIWYAGSHGFELTAP

SEQ ID NO: 780620 - protein, 25 aa, Mycobacterium
VPGKPAGAVGFCFGGGLVWQLLAAG

SEQ ID NO: 780621 - protein, 22 aa, Mycobacterium
VPGPYSWWSWRGKAFDNDAGWR

SEQ ID NO: 780622 - protein, 20 aa, Mycobacterium
VPGQGVVRVSQWIEQRDVTS

SEQ ID NO: 780623 - protein, 17 aa, Mycobacterium
VPGRPFGVYIHVPFCIT

SEQ ID NO: 780624 - protein, 21 aa, Mycobacterium
VPGRSVTRWGAFLDDVAGFDC

SEQ ID NO: 780625 - protein, 21 aa, Mycobacterium
VPGRSVTRWGAFLDDVGGFDC

SEQ ID NO: 780626 - protein, 21 aa, Mycobacterium
VPGRTVCKWGAFLDNVGDFDP

SEQ ID NO: 780627 - protein, 20 aa, Mycobacterium
VPGSALWFMHQLANGWSGVK

SEQ ID NO: 780628 - protein, 17 aa, Mycobacterium
VPGVLSVRVVPGTPAAE

SEQ ID NO: 780629 - protein, 17 aa, Mycobacterium
VPHNWTLAAPEIKLAVE

SEQ ID NO: 780630 - protein, 19 aa, Mycobacterium
VPIAARLAAMPSISLQLLG

SEQ ID NO: 780631 - protein, 25 aa, Mycobacterium
VPIDLRLDWPAALRAAGFDPTARTA

SEQ ID NO: 780632 - protein, 19 aa, Mycobacterium
VPIEPIWLCPLRLRDSADG

SEQ ID NO: 780633 - protein, 17 aa, Mycobacterium
VPISIVHRAGVQFPAPA

SEQ ID NO: 780634 - protein, 17 aa, Mycobacterium
VPIVLHFRGAVRRDALQ

SEQ ID NO: 780635 - protein, 20 aa, Mycobacterium
VPLAELFRRSGLDAPAPDDD

SEQ ID NO: 780636 - protein, 17 aa, Mycobacterium
VPLAIAMAASYFRNADE

SEQ ID NO: 780637 - protein, 19 aa, Mycobacterium
VPLARAMRSVHRHDYLNAY

SEQ ID NO: 780638 - protein, 19 aa, Mycobacterium
VPLCFGFHPYLQVPGVARG

SEQ ID NO: 780639 - protein, 20 aa, Mycobacterium
VPLDVGLPWFMRGPGAVTGA

SEQ ID NO: 780640 - protein, 25 aa, Mycobacterium
VPLELRIRAAWLWSGRRAVIGGAAA

SEQ ID NO: 780641 - protein, 20 aa, Mycobacterium
VPLFGFTGCHGLMLLSIRAG

SEQ ID NO: 780642 - protein, 18 aa, Mycobacterium
VPLLPRWLVRRTVGVAAG

SEQ ID NO: 780643 - protein, 23 aa, Mycobacterium
VPLPRISIFLSLFDAHVQRAPLA

SEQ ID NO: 780644 - protein, 17 aa, Mycobacterium
VPLRAGSDIAFLGGVIN

SEQ ID NO: 780645 - protein, 17 aa, Mycobacterium
VPLRIVHVMQWPPGSAT

SEQ ID NO: 780646 - protein, 24 aa, Mycobacterium
VPLRLAELFLEAGLPAGVFQVVQG

SEQ ID NO: 780647 - protein, 25 aa, Mycobacterium
VPLRLAELFLEAGLPPGVFNVVNGD

SEQ ID NO: 780648 - protein, 17 aa, Mycobacterium
VPLSGGLFRALGRIADA

SEQ ID NO: 780649 - protein, 18 aa, Mycobacterium
VPLSNVWGTTLELVDRTG

SEQ ID NO: 780650 - protein, 20 aa, Mycobacterium
VPMFPNLFLLYGPNTNVGSG

SEQ ID NO: 780651 - protein, 19 aa, Mycobacterium
VPMRCVFALTAMGFIPASP

SEQ ID NO: 780652 - protein, 17 aa, Mycobacterium
VPMVFPPWFERFQIKYF

SEQ ID NO: 780653 - protein, 17 aa, Mycobacterium
VPNELPIHVETMLADAR

SEQ ID NO: 780654 - protein, 17 aa, Mycobacterium
VPPFTWWRGLKARQLLE

SEQ ID NO: 780655 - protein, 22 aa, Mycobacterium
VPPGRLGWGWAKFAFGSWTTLS

SEQ ID NO: 780656 - protein, 20 aa, Mycobacterium
VPPGRLGWGWAKFAFNSWKA

SEQ ID NO: 780657 - protein, 24 aa, Mycobacterium
VPPHGWINLHFSLLPAWRGAAPVQ

SEQ ID NO: 780658 - protein, 22 aa, Mycobacterium
VPPKDYFALLALLKRSLTEDEV

SEQ ID NO: 780659 - protein, 19 aa, Mycobacterium
VPPNARWELLAAHAEGKSV

SEQ ID NO: 780660 - protein, 17 aa, Mycobacterium
VPQALQVLGIWPILPEE

SEQ ID NO: 780661 - protein, 23 aa, Mycobacterium
VPQIWPGRAIYRIWPDFDVQPLI

SEQ ID NO: 780662 - protein, 18 aa, Mycobacterium
VPQPYAFRLADPDTDADM

SEQ ID NO: 780663 - protein, 17 aa, Mycobacterium
VPQRLWAKPAITVIGID

SEQ ID NO: 780664 - protein, 21 aa, Mycobacterium
VPQSWMFPPAVRQVAAMFPGT

SEQ ID NO: 780665 - protein, 21 aa, Mycobacterium
VPRAGMGLRRGMLHQLDDQKA

SEQ ID NO: 780666 - protein, 18 aa, Mycobacterium
VPRFTLELKQLWNDLGRP

SEQ ID NO: 780667 - protein, 20 aa, Mycobacterium
VPRRCCRPGCPHYAVATLTF

SEQ ID NO: 780668 - protein, 22 aa, Mycobacterium
VPRRTVCCGLTWISTGQLTTAK

SEQ ID NO: 780669 - protein, 24 aa, Mycobacterium
VPRSFEFVDELPLSGAGKILKRVL

SEQ ID NO: 780670 - protein, 22 aa, Mycobacterium
VPRWLPERVCWLLSDEYHSNEG

SEQ ID NO: 780671 - protein, 21 aa, Mycobacterium
VPSAWRLGVRMLAQGTLAWGS

SEQ ID NO: 780672 - protein, 18 aa, Mycobacterium
VPSCPGWNLGQLFRHVGR

SEQ ID NO: 780673 - protein, 18 aa, Mycobacterium
VPSRLAWEAGAALADSLL

SEQ ID NO: 780674 - protein, 24 aa, Mycobacterium
VPSRLRPAMTAMLSGVVVVNDLSE

SEQ ID NO: 780675 - protein, 23 aa, Mycobacterium
VPSRRVAMPLSWDDPSAREAMER

SEQ ID NO: 780676 - protein, 18 aa, Mycobacterium
VPTCPGWTVADLLGHLWS

SEQ ID NO: 780677 - protein, 18 aa, Mycobacterium
VPTGVGFMKRAGFVTEGR

SEQ ID NO: 780678 - protein, 18 aa, Mycobacterium
VPTSLIFHRFPRGYTMSS

SEQ ID NO: 780679 - protein, 21 aa, Mycobacterium
VPTSRYVWRSPFSAPAAASET

SEQ ID NO: 780680 - protein, 17 aa, Mycobacterium
VPTTRLLAAAQDEVSAA

SEQ ID NO: 780681 - protein, 17 aa, Mycobacterium
VPTVASAVLDPTQIVNW

SEQ ID NO: 780682 - protein, 18 aa, Mycobacterium
VPTYSYCRIYWNGAVLEK

SEQ ID NO: 780683 - protein, 23 aa, Mycobacterium
VPVDLRFDWPTALHDAGFDASLP

SEQ ID NO: 780684 - protein, 17 aa, Mycobacterium
VPVLWVFTARTGAGGQA

SEQ ID NO: 780685 - protein, 17 aa, Mycobacterium
VPVNWLKIDRSFIADVL

SEQ ID NO: 780686 - protein, 22 aa, Mycobacterium
VPVPGIAASLFARFLSRQDESP

SEQ ID NO: 780687 - protein, 18 aa, Mycobacterium
VPVSATWIDIRFTLPANT

SEQ ID NO: 780688 - protein, 21 aa, Mycobacterium
VPYELDCLIFATGFEVGTDYC

SEQ ID NO: 780689 - protein, 21 aa, Mycobacterium
VPYPIEPRAAVGIYDEQTDAM

SEQ ID NO: 780690 - protein, 26 aa, Mycobacterium
VPYYRVLELAPWLGWPRPNFPVSNFF

SEQ ID NO: 780691 - protein, 24 aa, Mycobacterium
VPYYRVLELAPWLKWPEPNFPVSN

SEQ ID NO: 780692 - protein, 25 aa, Mycobacterium
VPYYRVLELAPWLSRPRPNFPVTNF

SEQ ID NO: 780693 - protein, 23 aa, Mycobacterium
VPYYRVLELAPWLSWPQPNFPVS

SEQ ID NO: 780694 - protein, 25 aa, Mycobacterium
VQAAVKVLASWDWETRPSAVMAVDS

SEQ ID NO: 780695 - protein, 17 aa, Mycobacterium
VQACGRAFVKGIERRSR

SEQ ID NO: 780696 - protein, 18 aa, Mycobacterium
VQAFARQRIDAILTEVTA

SEQ ID NO: 780697 - protein, 18 aa, Mycobacterium
VQALRSWQRRALVKYLTA

SEQ ID NO: 780698 - protein, 20 aa, Mycobacterium
VQFGLRWNKFGILAVTATAS

SEQ ID NO: 780699 - protein, 17 aa, Mycobacterium
VQFPAPVKYVAPIAFNV

SEQ ID NO: 780700 - protein, 17 aa, Mycobacterium
VQGFWQREFDILVCTTI

SEQ ID NO: 780701 - protein, 19 aa, Mycobacterium
VQGIWRLGAAMTMLQQPTS

SEQ ID NO: 780702 - protein, 19 aa, Mycobacterium
VQGLPSPYLAIAFPNRPLA

SEQ ID NO: 780703 - protein, 31 aa, Mycobacterium
VQGRCISGGLLLCWPCDLILASDDALFSDPV

SEQ ID NO: 780704 - protein, 31 aa, Mycobacterium
VQGRCISGGLLLCWPCDLIVAADDAQFSDPV

SEQ ID NO: 780705 - protein, 22 aa, Mycobacterium
VQGRLRLGPGWVSHLLQDLAVT

SEQ ID NO: 780706 - protein, 17 aa, Mycobacterium
VQHCRRWAPALDARRSR

SEQ ID NO: 780707 - protein, 22 aa, Mycobacterium
VQIGKFRLVFLTGPKQGEDGGS

SEQ ID NO: 780708 - protein, 20 aa, Mycobacterium
VQIGKFRLVFLTGPKSDDSG

SEQ ID NO: 780709 - protein, 17 aa, Mycobacterium
VQKWRIKSNWKFVSENF

SEQ ID NO: 780710 - protein, 17 aa, Mycobacterium
VQLAALLIGDWDVIALD

SEQ ID NO: 780711 - protein, 18 aa, Mycobacterium
VQLGISLGRRWWGQHVTS

SEQ ID NO: 780712 - protein, 18 aa, Mycobacterium
VQLIKWLPTRSADFVNRW

SEQ ID NO: 780713 - protein, 18 aa, Mycobacterium
VQLILKFIPGMRDRGFGH

SEQ ID NO: 780714 - protein, 19 aa, Mycobacterium
VQLILKFIPGMRERGFGHI

SEQ ID NO: 780715 - protein, 19 aa, Mycobacterium
VQLILKFIPGMRERGYGHI

SEQ ID NO: 780716 - protein, 20 aa, Mycobacterium
VQLILKFIPGMRERKFGQII

SEQ ID NO: 780717 - protein, 19 aa, Mycobacterium
VQLPPRLGGVPVITPALLR

SEQ ID NO: 780718 - protein, 25 aa, Mycobacterium
VQLTRKRLGTGLVEAFSTACTHCGG

SEQ ID NO: 780719 - protein, 25 aa, Mycobacterium
VQLTRKRLGTGLVEAFSTSCPHCSG

SEQ ID NO: 780720 - protein, 23 aa, Mycobacterium
VQLWIPQQVVLEWAVHTMGLLSD

SEQ ID NO: 780721 - protein, 18 aa, Mycobacterium
VQMSELLADFGLDSIPQT

SEQ ID NO: 780722 - protein, 22 aa, Mycobacterium
VQQRAAAVLAFYRYHAHAHNLD

SEQ ID NO: 780723 - protein, 17 aa, Mycobacterium
VQQRAAAVLSFYRYHAH

SEQ ID NO: 780724 - protein, 23 aa, Mycobacterium
VQRLEMVRRISLEIDADVVELGT

SEQ ID NO: 780725 - protein, 23 aa, Mycobacterium
VQRLEMVRRISLELDSDVVELGT

SEQ ID NO: 780726 - protein, 23 aa, Mycobacterium
VQRRLRIGLCMDSPFTPATDNPT

SEQ ID NO: 780727 - protein, 22 aa, Mycobacterium
VQRVGWKWWLAACFQVTDDKEQ

SEQ ID NO: 780728 - protein, 24 aa, Mycobacterium
VQSLRLYERYGLLTPARSDGGTRR

SEQ ID NO: 780729 - protein, 23 aa, Mycobacterium
VQSVLLPRLLDWLSYAPDPDGGL

SEQ ID NO: 780730 - protein, 23 aa, Mycobacterium
VQSVLLPRLLDWLSYAPDPDRGL

SEQ ID NO: 780731 - protein, 24 aa, Mycobacterium
VQSVLLPRLLHWMSYAPDPDGGLL

SEQ ID NO: 780732 - protein, 22 aa, Mycobacterium
VQSVLLPRLLNWMSYTPDPDGG

SEQ ID NO: 780733 - protein, 23 aa, Mycobacterium
VQTGFARTGAWFASEHEGIVPDI

SEQ ID NO: 780734 - protein, 22 aa, Mycobacterium
VQTGIARTGAWFASEHEQLVPD

SEQ ID NO: 780735 - protein, 18 aa, Mycobacterium
VQVIPEKVEVLWRHVRCD

SEQ ID NO: 780736 - protein, 24 aa, Mycobacterium
VQVLGFREHASWALASDTLEFVDL

SEQ ID NO: 780737 - protein, 17 aa, Mycobacterium
VQYRLPITFLLFDNHAH

SEQ ID NO: 780738 - protein, 19 aa, Mycobacterium
VRAAFRYACTRGYEPQYRC

SEQ ID NO: 780739 - protein, 17 aa, Mycobacterium
VRAARWLLGQGAGKGTR

SEQ ID NO: 780740 - protein, 23 aa, Mycobacterium
VRAFARRRIDAILAGVPAADSAD

SEQ ID NO: 780741 - protein, 17 aa, Mycobacterium
VRAGHRLKFWTPGGSST

SEQ ID NO: 780742 - protein, 17 aa, Mycobacterium
VRAGWGFDPVVIPNGVD

SEQ ID NO: 780743 - protein, 17 aa, Mycobacterium
VRALDMLFILHADHEQN

SEQ ID NO: 780744 - protein, 21 aa, Mycobacterium
VRARGAFVLRMMMDPPWSLRI

SEQ ID NO: 780745 - protein, 22 aa, Mycobacterium
VRARTVLCPAPLVEGLVVAAVA

SEQ ID NO: 780746 - protein, 18 aa, Mycobacterium
VRAVGIDFFVRWASGELR

SEQ ID NO: 780747 - protein, 20 aa, Mycobacterium
VRAVQRWAACQGKTLRAVIA

SEQ ID NO: 780748 - protein, 17 aa, Mycobacterium
VRAVRAWIADGGVLVLA

SEQ ID NO: 780749 - protein, 19 aa, Mycobacterium
VRCEVWEGFIFINFDDNAA

SEQ ID NO: 780750 - protein, 19 aa, Mycobacterium
VRCEVWEGFIFINFDHDAA

SEQ ID NO: 780751 - protein, 19 aa, Mycobacterium
VRCEVWEGFIFINLDPAAA

SEQ ID NO: 780752 - protein, 19 aa, Mycobacterium
VRCEVWEGFVFVNLDPDAA

SEQ ID NO: 780753 - protein, 18 aa, Mycobacterium
VRCTRLPVNRGFHSALVD

SEQ ID NO: 780754 - protein, 22 aa, Mycobacterium
VRDACKRYGDFVALDNVNFVVP

SEQ ID NO: 780755 - protein, 19 aa, Mycobacterium
VRDACSMLGLDPLYVANEG

SEQ ID NO: 780756 - protein, 18 aa, Mycobacterium
VRDALDLCLSCKGCLSDC

SEQ ID NO: 780757 - protein, 17 aa, Mycobacterium
VRDALRLGASYTGVEYL

SEQ ID NO: 780758 - protein, 18 aa, Mycobacterium
VRDEWKPLYVFGTQTVPQ

SEQ ID NO: 780759 - protein, 18 aa, Mycobacterium
VRDFQRIIGMEARAQVLD

SEQ ID NO: 780760 - protein, 18 aa, Mycobacterium
VRDFQRIIGMEARVQIQD

SEQ ID NO: 780761 - protein, 19 aa, Mycobacterium
VRDKLWARLRITPHEITRR

SEQ ID NO: 780762 - protein, 17 aa, Mycobacterium
VRDPHGWAGYLTEAIDS

SEQ ID NO: 780763 - protein, 18 aa, Mycobacterium
VRDPHGWAGYLTEAIDTF

SEQ ID NO: 780764 - protein, 19 aa, Mycobacterium
VRDWWSMEWVWSALHLDDG

SEQ ID NO: 780765 - protein, 19 aa, Mycobacterium
VREACLWSAGLAGARRRAT

SEQ ID NO: 780766 - protein, 21 aa, Mycobacterium
VREACLWSRGLAAAGVRRRAS

SEQ ID NO: 780767 - protein, 18 aa, Mycobacterium
VREACLWSSGFAADGVRR

SEQ ID NO: 780768 - protein, 20 aa, Mycobacterium
VREALDLRGKFPLKAGLVTS

SEQ ID NO: 780769 - protein, 19 aa, Mycobacterium
VRENLRIGGYTLRDKKELD

SEQ ID NO: 780770 - protein, 18 aa, Mycobacterium
VREPGCLAVAALLEAYRV

SEQ ID NO: 780771 - protein, 17 aa, Mycobacterium
VRERLGFEWTDRDEWLH

SEQ ID NO: 780772 - protein, 17 aa, Mycobacterium
VREVIGFPARFIADKKD

SEQ ID NO: 780773 - protein, 18 aa, Mycobacterium
VRFAFWGAEEISLDGSKA

SEQ ID NO: 780774 - protein, 25 aa, Mycobacterium
VRFCDAFKIPLVFVVDTPGFLPGAE

SEQ ID NO: 780775 - protein, 17 aa, Mycobacterium
VRFGIGWGAVTILDADA

SEQ ID NO: 780776 - protein, 20 aa, Mycobacterium
VRFGSLFLRDGVSLTGRQVL

SEQ ID NO: 780777 - protein, 19 aa, Mycobacterium
VRFGTAYDIEFQRWVAAVR

SEQ ID NO: 780778 - protein, 17 aa, Mycobacterium
VRFLPGWFKDTLQDAPI

SEQ ID NO: 780779 - protein, 17 aa, Mycobacterium
VRFPAPVPVGSRVRAQS

SEQ ID NO: 780780 - protein, 19 aa, Mycobacterium
VRFPAPVPVGSRVRAQSSL

SEQ ID NO: 780781 - protein, 19 aa, Mycobacterium
VRFPAPVPVGSRVRAQTAL

SEQ ID NO: 780782 - protein, 17 aa, Mycobacterium
VRFPGVPTWFSRTPGRV

SEQ ID NO: 780783 - protein, 19 aa, Mycobacterium
VRFRLPLSLADHLPDIAAY

SEQ ID NO: 780784 - protein, 18 aa, Mycobacterium
VRGDEFFFSLPVVGETCD

SEQ ID NO: 780785 - protein, 17 aa, Mycobacterium
VRGFPFWSVYAASKAVL

SEQ ID NO: 780786 - protein, 17 aa, Mycobacterium
VRGFPGFVDQGPHVDLR

SEQ ID NO: 780787 - protein, 19 aa, Mycobacterium
VRGIFTYRVDDVGLITNMR

SEQ ID NO: 780788 - protein, 17 aa, Mycobacterium
VRGIRLSLAHPDVFSDQ

SEQ ID NO: 780789 - protein, 18 aa, Mycobacterium
VRGLHRFAAAEGIAAIDV

SEQ ID NO: 780790 - protein, 17 aa, Mycobacterium
VRGLRLGTGVSELGNRD

SEQ ID NO: 780791 - protein, 18 aa, Mycobacterium
VRGPMMFDGYLNRPEATA

SEQ ID NO: 780792 - protein, 20 aa, Mycobacterium
VRGPQRWRIKANWKIGVENF

SEQ ID NO: 780793 - protein, 23 aa, Mycobacterium
VRGPYRLGPEIARMASTVRLSVV

SEQ ID NO: 780794 - protein, 21 aa, Mycobacterium
VRGTFGIGLVDWVMRTEAGLL

SEQ ID NO: 780795 - protein, 17 aa, Mycobacterium
VRHAAALGRPVAIVNRG

SEQ ID NO: 780796 - protein, 17 aa, Mycobacterium
VRHLLNWDGHRQANAAI

SEQ ID NO: 780797 - protein, 19 aa, Mycobacterium
VRIALPPALSRYVVEKGSI

SEQ ID NO: 780798 - protein, 18 aa, Mycobacterium
VRIDRFEVLAVRRNGDVV

SEQ ID NO: 780799 - protein, 21 aa, Mycobacterium
VRIPASFCGVVGFKPTHGRIP

SEQ ID NO: 780800 - protein, 19 aa, Mycobacterium
VRIVREFLVRGVAAAIGRG

SEQ ID NO: 780801 - protein, 23 aa, Mycobacterium
VRIWLDPVCPFSWNTARWLDAVA

SEQ ID NO: 780802 - protein, 24 aa, Mycobacterium
VRIWRPRWAAWGLHVVRSGGLIRD

SEQ ID NO: 780803 - protein, 19 aa, Mycobacterium
VRKKRIAWERPLRKADLAA

SEQ ID NO: 780804 - protein, 19 aa, Mycobacterium
VRKLPTLRGRTIVTMFYEN

SEQ ID NO: 780805 - protein, 18 aa, Mycobacterium
VRLAELFAEAGLPPGVFQ

SEQ ID NO: 780806 - protein, 19 aa, Mycobacterium
VRLAELFIEAGLPPGVFQV

SEQ ID NO: 780807 - protein, 20 aa, Mycobacterium
VRLAGRWLRPGGLLAVEHDD

SEQ ID NO: 780808 - protein, 17 aa, Mycobacterium
VRLATEFDVPGSVDNID

SEQ ID NO: 780809 - protein, 17 aa, Mycobacterium
VRLAWSLSTARPVYIGE

SEQ ID NO: 780810 - protein, 17 aa, Mycobacterium
VRLCDAFGIPLIVVVDV

SEQ ID NO: 780811 - protein, 26 aa, Mycobacterium
VRLEPEWLKPTAYMMAKFGMTLCALG

SEQ ID NO: 780812 - protein, 20 aa, Mycobacterium
VRLMRWGLVPPWAKAGADGA

SEQ ID NO: 780813 - protein, 20 aa, Mycobacterium
VRLMRWGLVPPWAKAGEDGA

SEQ ID NO: 780814 - protein, 18 aa, Mycobacterium
VRLMRWGLVPPWAKAGPD

SEQ ID NO: 780815 - protein, 20 aa, Mycobacterium
VRLNHEFHRAINLAADSPRL

SEQ ID NO: 780816 - protein, 18 aa, Mycobacterium
VRLPAHWQTAGVLLGIWW

SEQ ID NO: 780817 - protein, 19 aa, Mycobacterium
VRLPAPVPYRSFITWLSEQ

SEQ ID NO: 780818 - protein, 17 aa, Mycobacterium
VRLPENVRMASADDTIP

SEQ ID NO: 780819 - protein, 22 aa, Mycobacterium
VRLPRIPMRFPMYLPGPNRVMV

SEQ ID NO: 780820 - protein, 18 aa, Mycobacterium
VRLPWKVGDEEFVLHLID

SEQ ID NO: 780821 - protein, 21 aa, Mycobacterium
VRLQCPLLLLWGAEGALASAD

SEQ ID NO: 780822 - protein, 18 aa, Mycobacterium
VRLREIVEGLPLHEQELV

SEQ ID NO: 780823 - protein, 22 aa, Mycobacterium
VRLRPGPRQTFRELLAQTRDSA

SEQ ID NO: 780824 - protein, 18 aa, Mycobacterium
VRLVCAGSAGSACAARAA

SEQ ID NO: 780825 - protein, 18 aa, Mycobacterium
VRLVPLRGRREVHGLTLD

SEQ ID NO: 780826 - protein, 19 aa, Mycobacterium
VRMGMRVEAVWKPKDEWGL

SEQ ID NO: 780827 - protein, 19 aa, Mycobacterium
VRMGMRVEAVWKPKEEWGY

SEQ ID NO: 780828 - protein, 19 aa, Mycobacterium
VRMGMRVEAVWKPREEWGF

SEQ ID NO: 780829 - protein, 19 aa, Mycobacterium
VRMGMRVQAVWKPEEEWGL

SEQ ID NO: 780830 - protein, 19 aa, Mycobacterium
VRMIRWLSARGLIVGTVAS

SEQ ID NO: 780831 - protein, 17 aa, Mycobacterium
VRMSARRFWVRYAAEVA

SEQ ID NO: 780832 - protein, 18 aa, Mycobacterium
VRNALGLRTRWYVSAMET

SEQ ID NO: 780833 - protein, 19 aa, Mycobacterium
VRNGWYWSGDLGYVDRDGF

SEQ ID NO: 780834 - protein, 30 aa, Mycobacterium
VRNVLRLLGPLLRPILRAVFVVQRRLEGRG

SEQ ID NO: 780835 - protein, 18 aa, Mycobacterium
VRNWPRRRMVLSRTANAY

SEQ ID NO: 780836 - protein, 20 aa, Mycobacterium
VRPAGLWAFEALRVAATRPR

SEQ ID NO: 780837 - protein, 20 aa, Mycobacterium
VRPDIMAWKHRKLIMNLGNG

SEQ ID NO: 780838 - protein, 17 aa, Mycobacterium
VRPFLKYQIIAVAAPNS

SEQ ID NO: 780839 - protein, 21 aa, Mycobacterium
VRPGDAIGVFLGRSVHLAVAA

SEQ ID NO: 780840 - protein, 18 aa, Mycobacterium
VRPGNTWAPFHWNDEHGE

SEQ ID NO: 780841 - protein, 17 aa, Mycobacterium
VRPILLWHALEECEHKA

SEQ ID NO: 780842 - protein, 18 aa, Mycobacterium
VRPRGFLEVRYLDSVPDA

SEQ ID NO: 780843 - protein, 18 aa, Mycobacterium
VRPRGSWRSFDVVAETGS

SEQ ID NO: 780844 - protein, 17 aa, Mycobacterium
VRPRVWFGEGWITSVLD

SEQ ID NO: 780845 - protein, 19 aa, Mycobacterium
VRPTLFLGVPRVWVKAKMG

SEQ ID NO: 780846 - protein, 19 aa, Mycobacterium
VRPVWCPRLRRVFPVGRRR

SEQ ID NO: 780847 - protein, 17 aa, Mycobacterium
VRPWIWKTMESFPGNYM

SEQ ID NO: 780848 - protein, 19 aa, Mycobacterium
VRQIARWAGCVGGRSTIVA

SEQ ID NO: 780849 - protein, 20 aa, Mycobacterium
VRQRIGMVFQHFNLFPHMTV

SEQ ID NO: 780850 - protein, 20 aa, Mycobacterium
VRQWLRAHLPGVEMCPAYSN

SEQ ID NO: 780851 - protein, 20 aa, Mycobacterium
VRRAKLYYLRDLRGKKAKIK

SEQ ID NO: 780852 - protein, 22 aa, Mycobacterium
VRRARRAVAEFRIRGVSTNIPF

SEQ ID NO: 780853 - protein, 18 aa, Mycobacterium
VRRAWPRAQIVFVRPRFL

SEQ ID NO: 780854 - protein, 21 aa, Mycobacterium
VRRCGICGSDLHARFHCDELA

SEQ ID NO: 780855 - protein, 17 aa, Mycobacterium
VRRCPRNILTFSHGAHH

SEQ ID NO: 780856 - protein, 22 aa, Mycobacterium
VRRFGELTARLYALEALLARGT

SEQ ID NO: 780857 - protein, 19 aa, Mycobacterium
VRRGRCPPVGRVSDTAGID

SEQ ID NO: 780858 - protein, 17 aa, Mycobacterium
VRRGRCPPVGRVSDTVA

SEQ ID NO: 780859 - protein, 21 aa, Mycobacterium
VRRITERAGLTWGVVQYHFGD

SEQ ID NO: 780860 - protein, 20 aa, Mycobacterium
VRRPEHFDGIHWVQKQIGHL

SEQ ID NO: 780861 - protein, 24 aa, Mycobacterium
VRRPYRWIKQLGIEAAYGRTLAAA

SEQ ID NO: 780862 - protein, 18 aa, Mycobacterium
VRRRGVVVNPVLETSEVP

SEQ ID NO: 780863 - protein, 19 aa, Mycobacterium
VRRRRVEVFGDGSAGAAPD

SEQ ID NO: 780864 - protein, 18 aa, Mycobacterium
VRRWYGWSAGRIINIDIG

SEQ ID NO: 780865 - protein, 18 aa, Mycobacterium
VRRWYGWSAGRIINLDIG

SEQ ID NO: 780866 - protein, 22 aa, Mycobacterium
VRRYIIGAALRWMREFHADGLR

SEQ ID NO: 780867 - protein, 18 aa, Mycobacterium
VRSGRRWSYAQLLTDVRQ

SEQ ID NO: 780868 - protein, 21 aa, Mycobacterium
VRSGVAFDILRRWLIARGCDV

SEQ ID NO: 780869 - protein, 26 aa, Mycobacterium
VRSGVAFDILRRWLIARGFDVAFIRN

SEQ ID NO: 780870 - protein, 20 aa, Mycobacterium
VRSGVAFDILRRWLMARGCD

SEQ ID NO: 780871 - protein, 20 aa, Mycobacterium
VRSGVAFDILRRWLMARGFD

SEQ ID NO: 780872 - protein, 19 aa, Mycobacterium
VRSPFARARINGIDASAAL

SEQ ID NO: 780873 - protein, 19 aa, Mycobacterium
VRSPFARARINSIDASAAL

SEQ ID NO: 780874 - protein, 18 aa, Mycobacterium
VRTAHTWVGVAGTFTTLA

SEQ ID NO: 780875 - protein, 24 aa, Mycobacterium
VRTDAGWRIARRRFTTVLVRTVSA

SEQ ID NO: 780876 - protein, 23 aa, Mycobacterium
VRTFARRRIDAILADVAPADGHD

SEQ ID NO: 780877 - protein, 22 aa, Mycobacterium
VRTFARRRIDTILSGVTAGSGD

SEQ ID NO: 780878 - protein, 18 aa, Mycobacterium
VRTFMKWGREIPFAHDLS

SEQ ID NO: 780879 - protein, 19 aa, Mycobacterium
VRTFMRWGRQIPAEHDLSS

SEQ ID NO: 780880 - protein, 17 aa, Mycobacterium
VRTHSLHDPARWKYVHL

SEQ ID NO: 780881 - protein, 26 aa, Mycobacterium
VRTIAWLPWLVCPLSAPAGAGKTTSM

SEQ ID NO: 780882 - protein, 17 aa, Mycobacterium
VRTRLAEALWKDHEDPL

SEQ ID NO: 780883 - protein, 23 aa, Mycobacterium
VRTRRILLAMGMRYDMPALPGLA

SEQ ID NO: 780884 - protein, 20 aa, Mycobacterium
VRTVLDWALEYDKYVITLCH

SEQ ID NO: 780885 - protein, 22 aa, Mycobacterium
VRVAAFGPRAANVVGLTDQTDL

SEQ ID NO: 780886 - protein, 18 aa, Mycobacterium
VRVDRFDVLAARRGGDGV

SEQ ID NO: 780887 - protein, 23 aa, Mycobacterium
VRVDVPLPQGWENLGALDPAYLI

SEQ ID NO: 780888 - protein, 17 aa, Mycobacterium
VRVGFRLGEPAAGELGV

SEQ ID NO: 780889 - protein, 17 aa, Mycobacterium
VRVIGQIPICWDPDRDA

SEQ ID NO: 780890 - protein, 17 aa, Mycobacterium
VRVIVSLLMFPGQDEAD

SEQ ID NO: 780891 - protein, 18 aa, Mycobacterium
VRVLCGFGTPMGPDDPVP

SEQ ID NO: 780892 - protein, 18 aa, Mycobacterium
VRVLRPGGYFAYADLRPS

SEQ ID NO: 780893 - protein, 17 aa, Mycobacterium
VRVLWALTAGELSVNEL

SEQ ID NO: 780894 - protein, 25 aa, Mycobacterium
VRVMRADRGFFCFPEVDIRIPFTDG

SEQ ID NO: 780895 - protein, 18 aa, Mycobacterium
VRVTRRWGPARIAYLLRL

SEQ ID NO: 780896 - protein, 17 aa, Mycobacterium
VRVYVPFGYEWYGYFVR

SEQ ID NO: 780897 - protein, 20 aa, Mycobacterium
VRWGAEMRFSYTKGLYDYYV

SEQ ID NO: 780898 - protein, 18 aa, Mycobacterium
VRYEAWSFPDFQTGADAL

SEQ ID NO: 780899 - protein, 17 aa, Mycobacterium
VRYRGVAKNDHWLHHRT

SEQ ID NO: 780900 - protein, 20 aa, Mycobacterium
VSAAIAALFGAHAQEYQAIS

SEQ ID NO: 780901 - protein, 20 aa, Mycobacterium
VSAAIAAVFSAHGVQYQAIS

SEQ ID NO: 780902 - protein, 17 aa, Mycobacterium
VSAALVIHHFGSKDGLR

SEQ ID NO: 780903 - protein, 20 aa, Mycobacterium
VSAAVATLFGTYGQTYQALA

SEQ ID NO: 780904 - protein, 24 aa, Mycobacterium
VSACGICGSDLHFAKHGARAIELS

SEQ ID NO: 780905 - protein, 19 aa, Mycobacterium
VSAGIAALFEAHGNAYQTL

SEQ ID NO: 780906 - protein, 24 aa, Mycobacterium
VSAMREFGYHLGLAFQILDDIVGI

SEQ ID NO: 780907 - protein, 27 aa, Mycobacterium
VSAPAQSLLARPIIGNGANATTPGGNG

SEQ ID NO: 780908 - protein, 21 aa, Mycobacterium
VSAPEALTMFLGRPDRPGQAR

SEQ ID NO: 780909 - protein, 17 aa, Mycobacterium
VSAPVELTASPALGALP

SEQ ID NO: 780910 - protein, 21 aa, Mycobacterium
VSARAEWAPTFSIYDVATLDE

SEQ ID NO: 780911 - protein, 23 aa, Mycobacterium
VSARGIEIGHIFQLGRKYTDAFT

SEQ ID NO: 780912 - protein, 23 aa, Mycobacterium
VSARGIEVAHIFQLGRKYTDAFA

SEQ ID NO: 780913 - protein, 23 aa, Mycobacterium
VSARGIEVAHIFQLGRKYTDAFT

SEQ ID NO: 780914 - protein, 23 aa, Mycobacterium
VSARTGAGMTAWFDWLRRFAQGL

SEQ ID NO: 780915 - protein, 19 aa, Mycobacterium
VSAVIAALFDAHAQAYQAL

SEQ ID NO: 780916 - protein, 22 aa, Mycobacterium
VSCVKPAGALYAFPRLDPEVYD

SEQ ID NO: 780917 - protein, 19 aa, Mycobacterium
VSCYWDYSPSFGRGPFRNV

SEQ ID NO: 780918 - protein, 18 aa, Mycobacterium
VSDLPRGGLIIANSDEFT

SEQ ID NO: 780919 - protein, 19 aa, Mycobacterium
VSDLPRGGLIIANSDEFTK

SEQ ID NO: 780920 - protein, 21 aa, Mycobacterium
VSECWELLAGAPIGRLVTNFE

SEQ ID NO: 780921 - protein, 20 aa, Mycobacterium
VSECWELLKSVTLGRLVTSV

SEQ ID NO: 780922 - protein, 17 aa, Mycobacterium
VSELWLRLLEAYRDSFF

SEQ ID NO: 780923 - protein, 23 aa, Mycobacterium
VSEPRPGQRFAFVMDTRLCDAVY

SEQ ID NO: 780924 - protein, 26 aa, Mycobacterium
VSERGKYRLGFAIPRLAHVAGGQNDL

SEQ ID NO: 780925 - protein, 17 aa, Mycobacterium
VSESLVWTARQRLATFV

SEQ ID NO: 780926 - protein, 17 aa, Mycobacterium
VSEVRWNAVVLADDTVL

SEQ ID NO: 780927 - protein, 27 aa, Mycobacterium
VSFEVFIRPALRLAMGLPDPRRPQRTA

SEQ ID NO: 780928 - protein, 17 aa, Mycobacterium
VSFEVFIRPALRSAMGL

SEQ ID NO: 780929 - protein, 19 aa, Mycobacterium
VSFEVTFDFGIPSLAGVLE

SEQ ID NO: 780930 - protein, 18 aa, Mycobacterium
VSFGDDWAWVRRAHDVGV

SEQ ID NO: 780931 - protein, 19 aa, Mycobacterium
VSFRLTGRLFRRRGLETDI

SEQ ID NO: 780932 - protein, 18 aa, Mycobacterium
VSGARVGLAWILAHAPNT

SEQ ID NO: 780933 - protein, 17 aa, Mycobacterium
VSGCLHLAFDYDRDHPF

SEQ ID NO: 780934 - protein, 17 aa, Mycobacterium
VSGLSLNLAVMVRQPED

SEQ ID NO: 780935 - protein, 17 aa, Mycobacterium
VSGPLLSGGYWNLPEAT

SEQ ID NO: 780936 - protein, 19 aa, Mycobacterium
VSGRAYWLGRWRDWMLDHR

SEQ ID NO: 780937 - protein, 23 aa, Mycobacterium
VSGRFGIGLVDWVMRSEAGLLED

SEQ ID NO: 780938 - protein, 17 aa, Mycobacterium
VSGRVAFTFGLEGPAVS

SEQ ID NO: 780939 - protein, 17 aa, Mycobacterium
VSGRVAYAFGLQGPAVT

SEQ ID NO: 780940 - protein, 17 aa, Mycobacterium
VSGVRWVGYGGAPIAPS

SEQ ID NO: 780941 - protein, 17 aa, Mycobacterium
VSGWATKQPKVWWNTGT

SEQ ID NO: 780942 - protein, 18 aa, Mycobacterium
VSGWKLTGQKVWTSAAQK

SEQ ID NO: 780943 - protein, 18 aa, Mycobacterium
VSHFPRAWVAVVTTDGRS

SEQ ID NO: 780944 - protein, 19 aa, Mycobacterium
VSIELADGLGLPVLSVASM

SEQ ID NO: 780945 - protein, 17 aa, Mycobacterium
VSIGAAVAVEWAVAHPG

SEQ ID NO: 780946 - protein, 18 aa, Mycobacterium
VSIGALTTPHAWLAAPAT

SEQ ID NO: 780947 - protein, 19 aa, Mycobacterium
VSIGYRLARGILHNATKAD

SEQ ID NO: 780948 - protein, 24 aa, Mycobacterium
VSIRPGSVLDFFAKVSPVQRVMLE

SEQ ID NO: 780949 - protein, 19 aa, Mycobacterium
VSLAATHRAMWALGDYALM

SEQ ID NO: 780950 - protein, 19 aa, Mycobacterium
VSLAEGWKTQAYAYLGITV

SEQ ID NO: 780951 - protein, 18 aa, Mycobacterium
VSLAELWRSVGVTPDAVI

SEQ ID NO: 780952 - protein, 19 aa, Mycobacterium
VSLAELWRSVGVVPDAVIG

SEQ ID NO: 780953 - protein, 20 aa, Mycobacterium
VSLAIAGLFSAHAKQYQAFS

SEQ ID NO: 780954 - protein, 17 aa, Mycobacterium
VSLALMRTGRTVVAVTH

SEQ ID NO: 780955 - protein, 19 aa, Mycobacterium
VSLELARSMAFYASMSIAD

SEQ ID NO: 780956 - protein, 21 aa, Mycobacterium
VSLGPMVRALREWRKELGDRS

SEQ ID NO: 780957 - protein, 19 aa, Mycobacterium
VSLGRSFPLVGVSGGPTTS

SEQ ID NO: 780958 - protein, 20 aa, Mycobacterium
VSLMPVWRNFFLGNELRKKN

SEQ ID NO: 780959 - protein, 22 aa, Mycobacterium
VSLPRECLLIFGAEGPGITEDA

SEQ ID NO: 780960 - protein, 24 aa, Mycobacterium
VSLVAGGIWLWGDVAGWARSRNYE

SEQ ID NO: 780961 - protein, 19 aa, Mycobacterium
VSMLIPRVVGFKITGERRP

SEQ ID NO: 780962 - protein, 17 aa, Mycobacterium
VSMMFKIGKYLYPDSLT

SEQ ID NO: 780963 - protein, 23 aa, Mycobacterium
VSNWLRPWLPSLLALSANSRVYR

SEQ ID NO: 780964 - protein, 21 aa, Mycobacterium
VSPALLLKCMLMAATEGIASG

SEQ ID NO: 780965 - protein, 21 aa, Mycobacterium
VSPDLVRRLCWDWEAAPDPFE

SEQ ID NO: 780966 - protein, 21 aa, Mycobacterium
VSPDLVRRLCWDWEGAPDPFE

SEQ ID NO: 780967 - protein, 23 aa, Mycobacterium
VSPRWLLRRARVIDAHQLLSETD

SEQ ID NO: 780968 - protein, 18 aa, Mycobacterium
VSPVDCWQHPTINALVAF

SEQ ID NO: 780969 - protein, 25 aa, Mycobacterium
VSQGRFRFGVGVGWLREEIANHGVD

SEQ ID NO: 780970 - protein, 25 aa, Mycobacterium
VSQLRAAHPVFRRRRFFSGEPLGRR

SEQ ID NO: 780971 - protein, 19 aa, Mycobacterium
VSQRLRLLIDWTGDHLAEV

SEQ ID NO: 780972 - protein, 23 aa, Mycobacterium
VSRAGELVSAWAGRLNIAAVNGV

SEQ ID NO: 780973 - protein, 17 aa, Mycobacterium
VSRLAAWHMSKNDPVDA

SEQ ID NO: 780974 - protein, 19 aa, Mycobacterium
VSRSEIWPRVDEALAAVGL

SEQ ID NO: 780975 - protein, 23 aa, Mycobacterium
VSSGMGGLQCRRHSGAVPPRPLP

SEQ ID NO: 780976 - protein, 18 aa, Mycobacterium
VSSLYPFLLTIAVSMTLQ

SEQ ID NO: 780977 - protein, 17 aa, Mycobacterium
VSSPGYEHAWLNPDNTE

SEQ ID NO: 780978 - protein, 17 aa, Mycobacterium
VSSRYKAPFAFTGGSIA

SEQ ID NO: 780979 - protein, 19 aa, Mycobacterium
VSSRYKAPFAFTGGTIAQV

SEQ ID NO: 780980 - protein, 23 aa, Mycobacterium
VSTARCPMTYVLVSPEIMASVAA

SEQ ID NO: 780981 - protein, 17 aa, Mycobacterium
VSTCATCDGFFFRDQDI

SEQ ID NO: 780982 - protein, 22 aa, Mycobacterium
VSTDHCPFCFKGQKEMGLGDFS

SEQ ID NO: 780983 - protein, 27 aa, Mycobacterium
VSTQAAEFHDRFVAALTAGADAYSSAE

SEQ ID NO: 780984 - protein, 19 aa, Mycobacterium
VSTVWPIAKKVVGAVRKVI

SEQ ID NO: 780985 - protein, 25 aa, Mycobacterium
VSVAIAGLLRLHGQQYQQFGAHLSE

SEQ ID NO: 780986 - protein, 19 aa, Mycobacterium
VSVDTFAGFIFLNPDPHAA

SEQ ID NO: 780987 - protein, 24 aa, Mycobacterium
VSVPEEVAWRLGWIDDEQLMRRAR

SEQ ID NO: 780988 - protein, 17 aa, Mycobacterium
VSVSFSGLQLVQLGTAQ

SEQ ID NO: 780989 - protein, 19 aa, Mycobacterium
VSWKLSWPAGDHMGVVPWI

SEQ ID NO: 780990 - protein, 17 aa, Mycobacterium
VSWLGAGVYQLVNIPAQ

SEQ ID NO: 780991 - protein, 17 aa, Mycobacterium
VSWPERGPLLGVDLEGS

SEQ ID NO: 780992 - protein, 19 aa, Mycobacterium
VSYAYGRGGQSGRCKAHDY

SEQ ID NO: 780993 - protein, 24 aa, Mycobacterium
VSYEAGDALGVWPRNAHQLVDEWL

SEQ ID NO: 780994 - protein, 24 aa, Mycobacterium
VSYEAGDALGVWPRNDSRLVDEWL

SEQ ID NO: 780995 - protein, 17 aa, Mycobacterium
VSYKLNLRGPSISLGTG

SEQ ID NO: 780996 - protein, 19 aa, Mycobacterium
VTAAHRWGKYLGMEVESGG

SEQ ID NO: 780997 - protein, 28 aa, Mycobacterium
VTAEPGGPCLRLLGFERIELEPGASRRL

SEQ ID NO: 780998 - protein, 18 aa, Mycobacterium
VTAHWGRGTLVGSLSVPP

SEQ ID NO: 780999 - protein, 18 aa, Mycobacterium
VTAPLHWKVISNAAATSL

SEQ ID NO: 781000 - protein, 22 aa, Mycobacterium
VTAPRWLGLPARLALQALIGRV

SEQ ID NO: 781001 - protein, 25 aa, Mycobacterium
VTARRPGWFNARWVAVAMQNRAQRW

SEQ ID NO: 781002 - protein, 28 aa, Mycobacterium
VTARYNDITAWRWTELPAALGVPDALTF

SEQ ID NO: 781003 - protein, 24 aa, Mycobacterium
VTCFSYRGSIDFGFVTTPEVADDI

SEQ ID NO: 781004 - protein, 18 aa, Mycobacterium
VTCGIGFADLSSFTALTQ

SEQ ID NO: 781005 - protein, 18 aa, Mycobacterium
VTCNAIIPGAVTRMAEGL

SEQ ID NO: 781006 - protein, 19 aa, Mycobacterium
VTDAWKQAHVELPPPGTPV

SEQ ID NO: 781007 - protein, 17 aa, Mycobacterium
VTDFSLAMIDPWPAGYY

SEQ ID NO: 781008 - protein, 18 aa, Mycobacterium
VTDFSLAMIDPWPAGYYG

SEQ ID NO: 781009 - protein, 23 aa, Mycobacterium
VTDGRWSCVHWGDAVAPFPHQEA

SEQ ID NO: 781010 - protein, 26 aa, Mycobacterium
VTDWFGGEPFGVWPWAQRQLAGAQPA

SEQ ID NO: 781011 - protein, 17 aa, Mycobacterium
VTDWLQSRHSFSFGDYY

SEQ ID NO: 781012 - protein, 19 aa, Mycobacterium
VTEAVLWLAGPRSRYVTGV

SEQ ID NO: 781013 - protein, 18 aa, Mycobacterium
VTEFMVYQAALAVVLHRL

SEQ ID NO: 781014 - protein, 18 aa, Mycobacterium
VTEGNYPLAHKVSGSRVG

SEQ ID NO: 781015 - protein, 19 aa, Mycobacterium
VTELFKFFTKCPDWVTYAE

SEQ ID NO: 781016 - protein, 23 aa, Mycobacterium
VTELGRAYVRWAIAHPDHYQVMF

SEQ ID NO: 781017 - protein, 24 aa, Mycobacterium
VTESYRLLKHGGFNRILFLVDRNN

SEQ ID NO: 781018 - protein, 17 aa, Mycobacterium
VTEVRWDAVVLGDGAVL

SEQ ID NO: 781019 - protein, 17 aa, Mycobacterium
VTFAAAVTTVWRNVLPH

SEQ ID NO: 781020 - protein, 25 aa, Mycobacterium
VTFAAFPWRWKKGDGCIVRLVAITD

SEQ ID NO: 781021 - protein, 19 aa, Mycobacterium
VTFGFPFGLSIVAPVNMPL

SEQ ID NO: 781022 - protein, 19 aa, Mycobacterium
VTFGFPFGLSIVVPVNMPL

SEQ ID NO: 781023 - protein, 17 aa, Mycobacterium
VTFPAPVKYVAPIAFNV

SEQ ID NO: 781024 - protein, 17 aa, Mycobacterium
VTFSALTGWEAPDPAWW

SEQ ID NO: 781025 - protein, 23 aa, Mycobacterium
VTFSDRYEPAWVYRGNDAAAVRD

SEQ ID NO: 781026 - protein, 18 aa, Mycobacterium
VTGAHRWGKYLGLQAGEL

SEQ ID NO: 781027 - protein, 18 aa, Mycobacterium
VTGAKVWTSGAHRADAFI

SEQ ID NO: 781028 - protein, 23 aa, Mycobacterium
VTGDPHLRFYAGMPIRTAEGHAL

SEQ ID NO: 781029 - protein, 23 aa, Mycobacterium
VTGLRFGDAVPLTYPFTLTFPAV

SEQ ID NO: 781030 - protein, 17 aa, Mycobacterium
VTGLRPEAFCPAYGLAE

SEQ ID NO: 781031 - protein, 23 aa, Mycobacterium
VTGRFGIGLVDWVMRDEVGLLED

SEQ ID NO: 781032 - protein, 17 aa, Mycobacterium
VTGRPGLMLGNRDAEQT

SEQ ID NO: 781033 - protein, 18 aa, Mycobacterium
VTHLAAWLLRGLRRLGVT

SEQ ID NO: 781034 - protein, 23 aa, Mycobacterium
VTHYRFSLAWPRLQPDGKGPINT

SEQ ID NO: 781035 - protein, 18 aa, Mycobacterium
VTIGYRLARGILHNLKTA

SEQ ID NO: 781036 - protein, 17 aa, Mycobacterium
VTKRFEAELGRRSGLAT

SEQ ID NO: 781037 - protein, 18 aa, Mycobacterium
VTLGIALARLGMFAPALS

SEQ ID NO: 781038 - protein, 17 aa, Mycobacterium
VTLPAYGGTTAWASTEA

SEQ ID NO: 781039 - protein, 17 aa, Mycobacterium
VTLPQIFGLMQAAQQGP

SEQ ID NO: 781040 - protein, 22 aa, Mycobacterium
VTLPRRILVSRVDVIILHTERP

SEQ ID NO: 781041 - protein, 17 aa, Mycobacterium
VTLPSYGGATTWASTVA

SEQ ID NO: 781042 - protein, 18 aa, Mycobacterium
VTLPSYGGTTAWASTEAA

SEQ ID NO: 781043 - protein, 23 aa, Mycobacterium
VTLRAARYLPWHPGRCAEVLVGE

SEQ ID NO: 781044 - protein, 21 aa, Mycobacterium
VTLRGAVSIARRLQDPLAELV

SEQ ID NO: 781045 - protein, 17 aa, Mycobacterium
VTLTKAWGSDPFGSTTV

SEQ ID NO: 781046 - protein, 24 aa, Mycobacterium
VTLVIRGSCLLRHCDDTICERFTR

SEQ ID NO: 781047 - protein, 17 aa, Mycobacterium
VTLWLDPVCPFSWNTAR

SEQ ID NO: 781048 - protein, 19 aa, Mycobacterium
VTLWNRGCEELWGLRADEA

SEQ ID NO: 781049 - protein, 17 aa, Mycobacterium
VTMPGKFAALAFADERT

SEQ ID NO: 781050 - protein, 18 aa, Mycobacterium
VTMPGKFAALRFASTSTE

SEQ ID NO: 781051 - protein, 17 aa, Mycobacterium
VTNLGVFDFGGPDHTMR

SEQ ID NO: 781052 - protein, 19 aa, Mycobacterium
VTPAMWSWWFGWHGCDTRR

SEQ ID NO: 781053 - protein, 18 aa, Mycobacterium
VTPAMWVWWFGWHGCDTR

SEQ ID NO: 781054 - protein, 17 aa, Mycobacterium
VTPGVRRWQSWSTHGDP

SEQ ID NO: 781055 - protein, 20 aa, Mycobacterium
VTPKASWPWVKTLLHSVFDQ

SEQ ID NO: 781056 - protein, 17 aa, Mycobacterium
VTPRPVPPVTPGKPVTP

SEQ ID NO: 781057 - protein, 17 aa, Mycobacterium
VTPVKEFMRTAAEDTTV

SEQ ID NO: 781058 - protein, 17 aa, Mycobacterium
VTPVKHFMRTAAADTVV

SEQ ID NO: 781059 - protein, 17 aa, Mycobacterium
VTPYVSWLTTIAGQAEE

SEQ ID NO: 781060 - protein, 20 aa, Mycobacterium
VTQWTRWRRPVIGMPATPRF

SEQ ID NO: 781061 - protein, 22 aa, Mycobacterium
VTRARVHLALSWALARTPGGRQ

SEQ ID NO: 781062 - protein, 19 aa, Mycobacterium
VTRARVSAVRGVNVDAVMR

SEQ ID NO: 781063 - protein, 19 aa, Mycobacterium
VTRCPRNILTFSHGAHHCL

SEQ ID NO: 781064 - protein, 20 aa, Mycobacterium
VTRCPRNILTFSHGAHHCLG

SEQ ID NO: 781065 - protein, 23 aa, Mycobacterium
VTREKPRRLVVCRDDDWRPQWRV

SEQ ID NO: 781066 - protein, 21 aa, Mycobacterium
VTRLRGRGCRAIAPAWGAWTD

SEQ ID NO: 781067 - protein, 23 aa, Mycobacterium
VTRLRPDLRPDLPQPAAGDGSYR

SEQ ID NO: 781068 - protein, 18 aa, Mycobacterium
VTRPEQRFVLLGGDHTIA

SEQ ID NO: 781069 - protein, 17 aa, Mycobacterium
VTRRLVAMLARRGYSQT

SEQ ID NO: 781070 - protein, 20 aa, Mycobacterium
VTRRLVGMLARRGYNQSMAY

SEQ ID NO: 781071 - protein, 19 aa, Mycobacterium
VTRSRVSAVRGVNVDAVMR

SEQ ID NO: 781072 - protein, 21 aa, Mycobacterium
VTSELLCQAWQGPASAAMASA

SEQ ID NO: 781073 - protein, 21 aa, Mycobacterium
VTSFKLGPRWLMPPMVLATSP

SEQ ID NO: 781074 - protein, 18 aa, Mycobacterium
VTTKLKLSMFVLNAAFYK

SEQ ID NO: 781075 - protein, 19 aa, Mycobacterium
VTTRLGVPGIWYAGSHGFE

SEQ ID NO: 781076 - protein, 17 aa, Mycobacterium
VTTRYEIPCTVSGTVTV

SEQ ID NO: 781077 - protein, 17 aa, Mycobacterium
VTVAHGWASELAEAEPW

SEQ ID NO: 781078 - protein, 19 aa, Mycobacterium
VTVPRTGREPSPWKPVDDA

SEQ ID NO: 781079 - protein, 18 aa, Mycobacterium
VTVQWPWKLTIGDNSWIG

SEQ ID NO: 781080 - protein, 17 aa, Mycobacterium
VTVSDGWSGEFPDANEL

SEQ ID NO: 781081 - protein, 24 aa, Mycobacterium
VTYEAGDALGVWPRNSDQLVDEWL

SEQ ID NO: 781082 - protein, 17 aa, Mycobacterium
VVAAAWVDRLEKLLDAC

SEQ ID NO: 781083 - protein, 17 aa, Mycobacterium
VVAADWPLLAAAYRTRG

SEQ ID NO: 781084 - protein, 18 aa, Mycobacterium
VVAADWPLLAAAYRTRGS

SEQ ID NO: 781085 - protein, 25 aa, Mycobacterium
VVAADWPRLAAAYHTRAQLHILDDL

SEQ ID NO: 781086 - protein, 17 aa, Mycobacterium
VVAANRFALLTLIATNF

SEQ ID NO: 781087 - protein, 17 aa, Mycobacterium
VVAELKAAGALDEAGNV

SEQ ID NO: 781088 - protein, 17 aa, Mycobacterium
VVAEPFTTWVLEDSFSD

SEQ ID NO: 781089 - protein, 19 aa, Mycobacterium
VVAERRLWLAVLRAQAELE

SEQ ID NO: 781090 - protein, 19 aa, Mycobacterium
VVAERRLWLAVLRAQAELG

SEQ ID NO: 781091 - protein, 20 aa, Mycobacterium
VVAERRLWLAVLRAQRELGA

SEQ ID NO: 781092 - protein, 19 aa, Mycobacterium
VVAEWPTSSGFSLDPVAAQ

SEQ ID NO: 781093 - protein, 19 aa, Mycobacterium
VVAGLIFSGVMPRWITPRW

SEQ ID NO: 781094 - protein, 24 aa, Mycobacterium
VVAKIDWSRFLPLYQQAGRRAFLS

SEQ ID NO: 781095 - protein, 19 aa, Mycobacterium
VVAKRLWRDSGLKPADIQT

SEQ ID NO: 781096 - protein, 18 aa, Mycobacterium
VVALRSRLLVKLAGSGGM

SEQ ID NO: 781097 - protein, 24 aa, Mycobacterium
VVARARAAGILFRPRDVFVEQSVA

SEQ ID NO: 781098 - protein, 17 aa, Mycobacterium
VVARELFIRHALVEGEW

SEQ ID NO: 781099 - protein, 24 aa, Mycobacterium
VVARGWRTPLRFLFIDGGHTEDAA

SEQ ID NO: 781100 - protein, 24 aa, Mycobacterium
VVARGWRTPLRFLFIDGGHTEEAA

SEQ ID NO: 781101 - protein, 24 aa, Mycobacterium
VVASGWRAPLRFLFIDGGHSEAAA

SEQ ID NO: 781102 - protein, 18 aa, Mycobacterium
VVAVLGMPVGKVTKITPM

SEQ ID NO: 781103 - protein, 18 aa, Mycobacterium
VVCGIGFADLSGFTVLTR

SEQ ID NO: 781104 - protein, 18 aa, Mycobacterium
VVCGIGFADLSSFTVLTQ

SEQ ID NO: 781105 - protein, 23 aa, Mycobacterium
VVCKTAGVGGPWKFDADSVSLAV

SEQ ID NO: 781106 - protein, 17 aa, Mycobacterium
VVCPIHLGLMRGALESW

SEQ ID NO: 781107 - protein, 18 aa, Mycobacterium
VVDCPYSWSVAARLARIP

SEQ ID NO: 781108 - protein, 17 aa, Mycobacterium
VVDGEIWFETKAKSQKA

SEQ ID NO: 781109 - protein, 20 aa, Mycobacterium
VVDLCSRFLPGMVERRRGAV

SEQ ID NO: 781110 - protein, 26 aa, Mycobacterium
VVDPRTGLPWLAAHAEEFGLVAPPAD

SEQ ID NO: 781111 - protein, 17 aa, Mycobacterium
VVDQAWRAAALAEMIRE

SEQ ID NO: 781112 - protein, 27 aa, Mycobacterium
VVDTDLRWRIVIALARSGEIDADGPET

SEQ ID NO: 781113 - protein, 18 aa, Mycobacterium
VVEALRFHLRDLAVTFRF

SEQ ID NO: 781114 - protein, 29 aa, Mycobacterium
VVECLRLSADCLICLTVRGKHRCDGRRHL

SEQ ID NO: 781115 - protein, 18 aa, Mycobacterium
VVELRSGGLGVREIKRIA

SEQ ID NO: 781116 - protein, 19 aa, Mycobacterium
VVELYNLVVWNECNLELAG

SEQ ID NO: 781117 - protein, 21 aa, Mycobacterium
VVEPLRIALAYAVRRATRPLR

SEQ ID NO: 781118 - protein, 19 aa, Mycobacterium
VVFPGCEFLPLNDERRRIV

SEQ ID NO: 781119 - protein, 18 aa, Mycobacterium
VVFRRLHDGIAFGHTMVH

SEQ ID NO: 781120 - protein, 17 aa, Mycobacterium
VVFYPVIPLGSWVATTE

SEQ ID NO: 781121 - protein, 20 aa, Mycobacterium
VVGAGAWWHGWSRDDYDALA

SEQ ID NO: 781122 - protein, 18 aa, Mycobacterium
VVGARFRPGGFTARFGGD

SEQ ID NO: 781123 - protein, 19 aa, Mycobacterium
VVGELGFRGEIELVSLGGS

SEQ ID NO: 781124 - protein, 24 aa, Mycobacterium
VVGGNGEDAVGYGATGAAGAAGAA

SEQ ID NO: 781125 - protein, 18 aa, Mycobacterium
VVGHSFGGAIALHLAARR

SEQ ID NO: 781126 - protein, 23 aa, Mycobacterium
VVGKIRDAWNIQRDADGTPSITG

SEQ ID NO: 781127 - protein, 18 aa, Mycobacterium
VVGLNCGTPCPAFAGGST

SEQ ID NO: 781128 - protein, 18 aa, Mycobacterium
VVGPAIWAAMADINAVAL

SEQ ID NO: 781129 - protein, 17 aa, Mycobacterium
VVGPAWFTAPGVTERGW

SEQ ID NO: 781130 - protein, 19 aa, Mycobacterium
VVGRLVWNAGLLAPVEGQL

SEQ ID NO: 781131 - protein, 23 aa, Mycobacterium
VVGVAAGREVCWATDLNAGGAAM

SEQ ID NO: 781132 - protein, 22 aa, Mycobacterium
VVGWSAADAREWGETKLGSVGR

SEQ ID NO: 781133 - protein, 19 aa, Mycobacterium
VVHARGAVAFGYFEATGRW

SEQ ID NO: 781134 - protein, 18 aa, Mycobacterium
VVHAYGWLGGLAAQLAAR

SEQ ID NO: 781135 - protein, 19 aa, Mycobacterium
VVHCPSCGRTLFGEFDILQ

SEQ ID NO: 781136 - protein, 18 aa, Mycobacterium
VVHCPYCHGWEVRDEPIG

SEQ ID NO: 781137 - protein, 18 aa, Mycobacterium
VVHGFGWTGPLGVTYPGV

SEQ ID NO: 781138 - protein, 21 aa, Mycobacterium
VVIEPRLWVPDDFAFVRYLAV

SEQ ID NO: 781139 - protein, 17 aa, Mycobacterium
VVIGRGCLGRPWLFAEL

SEQ ID NO: 781140 - protein, 18 aa, Mycobacterium
VVIGRGCLGRPWLFAELS

SEQ ID NO: 781141 - protein, 17 aa, Mycobacterium
VVIGRGWADGTIELRNR

SEQ ID NO: 781142 - protein, 18 aa, Mycobacterium
VVILRREWDFLFNHLRST

SEQ ID NO: 781143 - protein, 17 aa, Mycobacterium
VVILWDWTGEGLDTFRG

SEQ ID NO: 781144 - protein, 17 aa, Mycobacterium
VVINPYFDWGNDRPPDH

SEQ ID NO: 781145 - protein, 17 aa, Mycobacterium
VVIRATWAVARVLTDRS

SEQ ID NO: 781146 - protein, 20 aa, Mycobacterium
VVISDGWDIMDFVSQLQNLA

SEQ ID NO: 781147 - protein, 18 aa, Mycobacterium
VVKTDGWSSSRLEEAIEA

SEQ ID NO: 781148 - protein, 19 aa, Mycobacterium
VVLADAWDLLKFLNDDEYA

SEQ ID NO: 781149 - protein, 23 aa, Mycobacterium
VVLDRPGSVVLWTNCHHPFYDHN

SEQ ID NO: 781150 - protein, 19 aa, Mycobacterium
VVLGDAWDLLKFLDESSFA

SEQ ID NO: 781151 - protein, 19 aa, Mycobacterium
VVLGDAWDLLKFLNDDEYA

SEQ ID NO: 781152 - protein, 19 aa, Mycobacterium
VVLGDAWDLLKFLSDDQYA

SEQ ID NO: 781153 - protein, 18 aa, Mycobacterium
VVLGDAWGLLKFFNDDAY

SEQ ID NO: 781154 - protein, 19 aa, Mycobacterium
VVLGDAWGLLKFLNDDAYA

SEQ ID NO: 781155 - protein, 18 aa, Mycobacterium
VVLGGTMAKYDWTINGEP

SEQ ID NO: 781156 - protein, 21 aa, Mycobacterium
VVLHRFLSWRLPGYRPEEHLG

SEQ ID NO: 781157 - protein, 17 aa, Mycobacterium
VVLRRIATRTGIPDYGY

SEQ ID NO: 781158 - protein, 19 aa, Mycobacterium
VVNRLKPGIIMCREKQDST

SEQ ID NO: 781159 - protein, 23 aa, Mycobacterium
VVPLMPVWRNFFLGQELRKKRFP

SEQ ID NO: 781160 - protein, 17 aa, Mycobacterium
VVPRLHLVPGMRSRLTT

SEQ ID NO: 781161 - protein, 18 aa, Mycobacterium
VVPYDFALDRELWRWVPE

SEQ ID NO: 781162 - protein, 19 aa, Mycobacterium
VVQLLRIGAALADPATLPD

SEQ ID NO: 781163 - protein, 22 aa, Mycobacterium
VVQRLSLRGGLVLDFDDYNEIV

SEQ ID NO: 781164 - protein, 18 aa, Mycobacterium
VVRALDMLFILHADHEQN

SEQ ID NO: 781165 - protein, 17 aa, Mycobacterium
VVRPRLQIVESILQAAV

SEQ ID NO: 781166 - protein, 24 aa, Mycobacterium
VVRQEPRLSWAIGDRADGTTVLVT

SEQ ID NO: 781167 - protein, 24 aa, Mycobacterium
VVRREVIDILGLRKPVVIASGFDR

SEQ ID NO: 781168 - protein, 21 aa, Mycobacterium
VVRRLDWPAGYDARALGNAFL

SEQ ID NO: 781169 - protein, 19 aa, Mycobacterium
VVRRMRLQPGRMFLVDTAQ

SEQ ID NO: 781170 - protein, 22 aa, Mycobacterium
VVRRMRLQPGRMFLVDTAQGRI

SEQ ID NO: 781171 - protein, 21 aa, Mycobacterium
VVRRMRLQPGRMFLVDTTQGR

SEQ ID NO: 781172 - protein, 17 aa, Mycobacterium
VVSCGRYPAKAVVGEVV

SEQ ID NO: 781173 - protein, 19 aa, Mycobacterium
VVSEVRALVRWLRPQATAI

SEQ ID NO: 781174 - protein, 17 aa, Mycobacterium
VVSGWFKDEFIHLGEPW

SEQ ID NO: 781175 - protein, 17 aa, Mycobacterium
VVSLAKRYTGRGMAFLD

SEQ ID NO: 781176 - protein, 17 aa, Mycobacterium
VVSMPCVEWFESQPDDY

SEQ ID NO: 781177 - protein, 17 aa, Mycobacterium
VVSMPCVEWFESQPEDY

SEQ ID NO: 781178 - protein, 21 aa, Mycobacterium
VVSRARLQLTLAWTNVLLQRL

SEQ ID NO: 781179 - protein, 22 aa, Mycobacterium
VVTKPSWLWSFGKGMNIPDLRV

SEQ ID NO: 781180 - protein, 18 aa, Mycobacterium
VVTPLGWVYPDLTNPKVQ

SEQ ID NO: 781181 - protein, 23 aa, Mycobacterium
VVTRYELVDGFPYLDVDDVFLGN

SEQ ID NO: 781182 - protein, 19 aa, Mycobacterium
VVTSPSWRRGLATLGKTLK

SEQ ID NO: 781183 - protein, 20 aa, Mycobacterium
VVTYRFWAERLGIQVDSLSA

SEQ ID NO: 781184 - protein, 17 aa, Mycobacterium
VVVAAGRPCQRCANCRR

SEQ ID NO: 781185 - protein, 17 aa, Mycobacterium
VVVADRFGIDPASMVTD

SEQ ID NO: 781186 - protein, 18 aa, Mycobacterium
VVVAPMFHAWGFSQLIFA

SEQ ID NO: 781187 - protein, 24 aa, Mycobacterium
VVVEARAAGRLMFYGQGAGGAPTA

SEQ ID NO: 781188 - protein, 17 aa, Mycobacterium
VVVGWGYGQDDFGHDTD

SEQ ID NO: 781189 - protein, 17 aa, Mycobacterium
VVVGWGYGRADFPDGAA

SEQ ID NO: 781190 - protein, 20 aa, Mycobacterium
VVVIPEMWRDPATGAVLEDR

SEQ ID NO: 781191 - protein, 19 aa, Mycobacterium
VVVLDARFAGYGASGRNGG

SEQ ID NO: 781192 - protein, 19 aa, Mycobacterium
VVVSGRWPFCSGINHADMM

SEQ ID NO: 781193 - protein, 25 aa, Mycobacterium
VVVSGRWPFCSGISHADMMFAGCFI

SEQ ID NO: 781194 - protein, 23 aa, Mycobacterium
VVWNRHCEDLWGLRADETVGTPL

SEQ ID NO: 781195 - protein, 19 aa, Mycobacterium
VWARPGLRLPPLDLAGCRE

SEQ ID NO: 781196 - protein, 18 aa, Mycobacterium
VWATGFRPDLSWIDAPIF

SEQ ID NO: 781197 - protein, 18 aa, Mycobacterium
VWEKLKAGIEFAIANEAD

SEQ ID NO: 781198 - protein, 17 aa, Mycobacterium
VWELPYYPTYYVPITDV

SEQ ID NO: 781199 - protein, 18 aa, Mycobacterium
VWEVPYYPAYYVPLADVR

SEQ ID NO: 781200 - protein, 17 aa, Mycobacterium
VWGPPSCPATFVDHNFK

SEQ ID NO: 781201 - protein, 24 aa, Mycobacterium
VWHYLLRWALMFGVTEDLLPRTGI

SEQ ID NO: 781202 - protein, 19 aa, Mycobacterium
VWNAIRLLRSEGRTVVLTT

SEQ ID NO: 781203 - protein, 18 aa, Mycobacterium
VWPACRRRIEAIAPRPQS

SEQ ID NO: 781204 - protein, 17 aa, Mycobacterium
VWPGITIPDGGIRFSTD

SEQ ID NO: 781205 - protein, 18 aa, Mycobacterium
VWPGRAYPLGATYDGMGT

SEQ ID NO: 781206 - protein, 21 aa, Mycobacterium
VWPIKPHHWYPALSEEQLVFA

SEQ ID NO: 781207 - protein, 21 aa, Mycobacterium
VWPRYCERFHDILGVHPTARV

SEQ ID NO: 781208 - protein, 18 aa, Mycobacterium
VWTRPAWQLDNWVRDFFG

SEQ ID NO: 781209 - protein, 18 aa, Mycobacterium
VWVGHDWGAVVVWNAPLL

SEQ ID NO: 781210 - protein, 17 aa, Mycobacterium
VWVPVDFEHGALRERLL

SEQ ID NO: 781211 - protein, 19 aa, Mycobacterium
VWVPWALRPMFFAMRLLPQ

SEQ ID NO: 781212 - protein, 17 aa, Mycobacterium
VYAHCFGGIAARYTLDI

SEQ ID NO: 781213 - protein, 17 aa, Mycobacterium
VYCELDFTNPLELTVAT

SEQ ID NO: 781214 - protein, 17 aa, Mycobacterium
VYEALVFDGHRHLTLAS

SEQ ID NO: 781215 - protein, 26 aa, Mycobacterium
VYEDLAWFCIRAWRFGATESHAAGGL

SEQ ID NO: 781216 - protein, 19 aa, Mycobacterium
VYERLWRPAAFYLASGVTT

SEQ ID NO: 781217 - protein, 19 aa, Mycobacterium
VYFELRLGDAWVWDMYRPA

SEQ ID NO: 781218 - protein, 24 aa, Mycobacterium
VYFELRLSDAWVWDLFRPARFVKH

SEQ ID NO: 781219 - protein, 19 aa, Mycobacterium
VYFPGQWGARIEDIVVITE

SEQ ID NO: 781220 - protein, 18 aa, Mycobacterium
VYGTLPWHPDIWLDSEDA

SEQ ID NO: 781221 - protein, 17 aa, Mycobacterium
VYICGPGAFMESAKEAL

SEQ ID NO: 781222 - protein, 18 aa, Mycobacterium
VYIRRWVPELADPATVPD

SEQ ID NO: 781223 - protein, 21 aa, Mycobacterium
VYLPKACTWRQVPDGPTTMLM

SEQ ID NO: 781224 - protein, 17 aa, Mycobacterium
VYNCRACGAELFRSTEK

SEQ ID NO: 781225 - protein, 20 aa, Mycobacterium
VYNQEAWYYNSLKAQLERQL

SEQ ID NO: 781226 - protein, 22 aa, Mycobacterium
VYPHPATVVLFRLARTLKYKAK

SEQ ID NO: 781227 - protein, 19 aa, Mycobacterium
VYPPCSAFEAWFVSAALDD

SEQ ID NO: 781228 - protein, 19 aa, Mycobacterium
VYPTHGFGSFCSATPASGD

SEQ ID NO: 781229 - protein, 18 aa, Mycobacterium
VYRAELALVEVARKTGIR

SEQ ID NO: 781230 - protein, 19 aa, Mycobacterium
VYRLAWAAMRGCPPESVRA

SEQ ID NO: 781231 - protein, 17 aa, Mycobacterium
VYRPRLAGPVPQADEVV

SEQ ID NO: 781232 - protein, 20 aa, Mycobacterium
VYRQEMIRMFGLAESGLAET

SEQ ID NO: 781233 - protein, 19 aa, Mycobacterium
VYSELDWRVGPPVGPLPYL

SEQ ID NO: 781234 - protein, 17 aa, Mycobacterium
VYSGFAFGMGLERTLQF

SEQ ID NO: 781235 - protein, 19 aa, Mycobacterium
VYSGFRFVRHASAKGIPVA

SEQ ID NO: 781236 - protein, 23 aa, Mycobacterium
VYTAVGLPRFYVITVFKQIEPAD

SEQ ID NO: 781237 - protein, 23 aa, Mycobacterium
VYTGLGALCWIPSISRWADVVAS

SEQ ID NO: 781238 - protein, 19 aa, Mycobacterium
VYTPEEFFPLGGLTFDDSV

SEQ ID NO: 781239 - protein, 17 aa, Mycobacterium
VYVDLGWTELNDPASAV

SEQ ID NO: 781240 - protein, 19 aa, Mycobacterium
VYVLDEWLEPVAIGVIGDV

SEQ ID NO: 781241 - protein, 20 aa, Mycobacterium
VYVPFGYEWYGYFVRRLAER

SEQ ID NO: 781242 - protein, 22 aa, Mycobacterium
VYYRRALLLAACFGRAADHPQQ

SEQ ID NO: 781243 - protein, 21 aa, Mycobacterium
VYYRRALMLAACFGRSVEYPQ

SEQ ID NO: 781244 - protein, 20 aa, Mycobacterium
VYYRRALVLAASFGRASEYP

SEQ ID NO: 781245 - protein, 17 aa, Mycobacterium
WAAAALIAAEAGATVWL

SEQ ID NO: 781246 - protein, 17 aa, Mycobacterium
WAACQGKTLRAVIATEQ

SEQ ID NO: 781247 - protein, 17 aa, Mycobacterium
WAAGALIASEAGALVRP

SEQ ID NO: 781248 - protein, 18 aa, Mycobacterium
WAAIRPGPDFEMYRDYHD

SEQ ID NO: 781249 - protein, 18 aa, Mycobacterium
WAAKCPLGTGVTLEVRRI

SEQ ID NO: 781250 - protein, 22 aa, Mycobacterium
WAALRGAILLLRVGKQMIELGL

SEQ ID NO: 781251 - protein, 18 aa, Mycobacterium
WAANRVMGHLGWRVPSSL

SEQ ID NO: 781252 - protein, 17 aa, Mycobacterium
WAAQMEIFFTRSRPYKK

SEQ ID NO: 781253 - protein, 17 aa, Mycobacterium
WAAVGCEPSRMGIGPVG

SEQ ID NO: 781254 - protein, 22 aa, Mycobacterium
WAAYCRPCQAFAPIYEKSARTH

SEQ ID NO: 781255 - protein, 18 aa, Mycobacterium
WACGPAQLIAGMRAAKQY

SEQ ID NO: 781256 - protein, 20 aa, Mycobacterium
WADKFGGLVFDATGITTPEG

SEQ ID NO: 781257 - protein, 20 aa, Mycobacterium
WADKNLREILGDQVGGAISD

SEQ ID NO: 781258 - protein, 19 aa, Mycobacterium
WADPRLRKAPTLHLGGTRA

SEQ ID NO: 781259 - protein, 18 aa, Mycobacterium
WADPRLVVAVLHNNDLNQ

SEQ ID NO: 781260 - protein, 18 aa, Mycobacterium
WADSFGGLVYDATGITEP

SEQ ID NO: 781261 - protein, 19 aa, Mycobacterium
WAEDIFKIVRFDSDLANEQ

SEQ ID NO: 781262 - protein, 18 aa, Mycobacterium
WAERRVELPAGRYETIMP

SEQ ID NO: 781263 - protein, 17 aa, Mycobacterium
WAFAELLALGSLVAEGK

SEQ ID NO: 781264 - protein, 17 aa, Mycobacterium
WAFGELLAFGTLVAEGK

SEQ ID NO: 781265 - protein, 17 aa, Mycobacterium
WAFTWVVDWPMFESAAE

SEQ ID NO: 781266 - protein, 20 aa, Mycobacterium
WAGLETWPGLASVPPTPFPA

SEQ ID NO: 781267 - protein, 17 aa, Mycobacterium
WAGLKAMRSYALATMDV

SEQ ID NO: 781268 - protein, 20 aa, Mycobacterium
WAGLMIERAWGATMVLTEPD

SEQ ID NO: 781269 - protein, 20 aa, Mycobacterium
WAGPPPEWWAQRFGIEPDLA

SEQ ID NO: 781270 - protein, 19 aa, Mycobacterium
WAGPPPLWWAQRFGTEPDL

SEQ ID NO: 781271 - protein, 25 aa, Mycobacterium
WAGPPPQWWAGRFGIEPGLAEALVC

SEQ ID NO: 781272 - protein, 21 aa, Mycobacterium
WAGSLKRHGEWMVPTRLALVR

SEQ ID NO: 781273 - protein, 17 aa, Mycobacterium
WAGVPVFAAWVSEPAEV

SEQ ID NO: 781274 - protein, 28 aa, Mycobacterium
WAIGYRPDYRWIAASAFDGAGRPMQTRG

SEQ ID NO: 781275 - protein, 23 aa, Mycobacterium
WAKGLELYPGWRKYEVRAGKRHI

SEQ ID NO: 781276 - protein, 28 aa, Mycobacterium
WAKRNPRRWSVIDAWAGLGMRLGSRTYG

SEQ ID NO: 781277 - protein, 22 aa, Mycobacterium
WALIGYRLPTPIPRITYADAMR

SEQ ID NO: 781278 - protein, 19 aa, Mycobacterium
WALKELPPRIAGREYGVLS

SEQ ID NO: 781279 - protein, 18 aa, Mycobacterium
WALKYRLAGHRSLSVGDV

SEQ ID NO: 781280 - protein, 17 aa, Mycobacterium
WALLVVRELLLGPKRFT

SEQ ID NO: 781281 - protein, 17 aa, Mycobacterium
WALPVAYRLPGLGRLRA

SEQ ID NO: 781282 - protein, 17 aa, Mycobacterium
WALWRLGSDPAFARISM

SEQ ID NO: 781283 - protein, 18 aa, Mycobacterium
WAMFEWGRKHLDDTSLRL

SEQ ID NO: 781284 - protein, 19 aa, Mycobacterium
WAMLTCYDYSSARVFDDAG

SEQ ID NO: 781285 - protein, 26 aa, Mycobacterium
WAMRHLPFYGRWYRFLVLWPGSDKGL

SEQ ID NO: 781286 - protein, 18 aa, Mycobacterium
WAMVRAFNAANDLDRIEV

SEQ ID NO: 781287 - protein, 18 aa, Mycobacterium
WANPWPMYRALRDHDPVH

SEQ ID NO: 781288 - protein, 19 aa, Mycobacterium
WAPADWDRLAGAVVAGHVI

SEQ ID NO: 781289 - protein, 20 aa, Mycobacterium
WAPADWDRLAGAVVAGHVIE

SEQ ID NO: 781290 - protein, 19 aa, Mycobacterium
WAPGACWHHPFGPRREFCR

SEQ ID NO: 781291 - protein, 18 aa, Mycobacterium
WAPGYAEAGAHNVTFHAE

SEQ ID NO: 781292 - protein, 19 aa, Mycobacterium
WAPKVYGAWHLHQATTDQP

SEQ ID NO: 781293 - protein, 19 aa, Mycobacterium
WAPKVYGAWHLHQATVGQP

SEQ ID NO: 781294 - protein, 18 aa, Mycobacterium
WAPLLWTSLAVKGWMGEH

SEQ ID NO: 781295 - protein, 17 aa, Mycobacterium
WAPLLWTSLAVKSWMGE

SEQ ID NO: 781296 - protein, 18 aa, Mycobacterium
WAPLLWTSLVVKSWMGEH

SEQ ID NO: 781297 - protein, 18 aa, Mycobacterium
WAPPYAEAGAHNVTFHAE

SEQ ID NO: 781298 - protein, 24 aa, Mycobacterium
WAPWCGPCRAFAPTFERSAQNHPD

SEQ ID NO: 781299 - protein, 19 aa, Mycobacterium
WAQDVAAMFGYHSGASAVA

SEQ ID NO: 781300 - protein, 20 aa, Mycobacterium
WAQDVAAMFGYHSGASSAAA

SEQ ID NO: 781301 - protein, 17 aa, Mycobacterium
WAQEIYADLGLRFEGER

SEQ ID NO: 781302 - protein, 18 aa, Mycobacterium
WAQRICGHLPLPRLVWPA

SEQ ID NO: 781303 - protein, 17 aa, Mycobacterium
WAQRRVELPAGRYETIM

SEQ ID NO: 781304 - protein, 18 aa, Mycobacterium
WARDGLRSNLGIGVHGFP

SEQ ID NO: 781305 - protein, 23 aa, Mycobacterium
WAREGRFPYARDVSGLQVGILGL

SEQ ID NO: 781306 - protein, 28 aa, Mycobacterium
WARFSAWADEIFKMFSWDLGEHAEAVET

SEQ ID NO: 781307 - protein, 17 aa, Mycobacterium
WARHGGIVSNGFLEAWY

SEQ ID NO: 781308 - protein, 17 aa, Mycobacterium
WARHNWIPFSRFRGLDR

SEQ ID NO: 781309 - protein, 17 aa, Mycobacterium
WARRGHPTLADIVELER

SEQ ID NO: 781310 - protein, 19 aa, Mycobacterium
WARRGWLAVRYNLPYRRRR

SEQ ID NO: 781311 - protein, 23 aa, Mycobacterium
WARRRFGSDLVWGIEDCRSVTSR

SEQ ID NO: 781312 - protein, 19 aa, Mycobacterium
WASSISGYWRRGRTEETFR

SEQ ID NO: 781313 - protein, 23 aa, Mycobacterium
WASWCGPCKAFAPTFAASAEKHP

SEQ ID NO: 781314 - protein, 18 aa, Mycobacterium
WATARAHRLAARLVELGV

SEQ ID NO: 781315 - protein, 19 aa, Mycobacterium
WATGIFGGGAWQDATETGP

SEQ ID NO: 781316 - protein, 20 aa, Mycobacterium
WATKEIDLFIGSGERVLLLG

SEQ ID NO: 781317 - protein, 17 aa, Mycobacterium
WATPLRCAGAWAAWAAS

SEQ ID NO: 781318 - protein, 17 aa, Mycobacterium
WATWCGPCKMVAPVLEE

SEQ ID NO: 781319 - protein, 17 aa, Mycobacterium
WAVEGGWNIADCVERAY

SEQ ID NO: 781320 - protein, 17 aa, Mycobacterium
WAVPLSWLLPPRIALQI

SEQ ID NO: 781321 - protein, 18 aa, Mycobacterium
WAYLPALEQVAAWHWSLN

SEQ ID NO: 781322 - protein, 18 aa, Mycobacterium
WAYLPALEQVASWYWIVT

SEQ ID NO: 781323 - protein, 18 aa, Mycobacterium
WAYVPALEQVAAWYWSMT

SEQ ID NO: 781324 - protein, 21 aa, Mycobacterium
WCALDTLIFPGILGRTAHVTS

SEQ ID NO: 781325 - protein, 22 aa, Mycobacterium
WCALDTLIFPGILGRTAHVTSP

SEQ ID NO: 781326 - protein, 19 aa, Mycobacterium
WCALTIRLLGRTEIRRLAK

SEQ ID NO: 781327 - protein, 18 aa, Mycobacterium
WCMGEAHAAVVLDALSRR

SEQ ID NO: 781328 - protein, 21 aa, Mycobacterium
WCPHCGSPYSFLPQLSPGDIV

SEQ ID NO: 781329 - protein, 20 aa, Mycobacterium
WCRDRMAGFKVPRAVQFLDS

SEQ ID NO: 781330 - protein, 20 aa, Mycobacterium
WCRERMAGFKVPRSVEFLDV

SEQ ID NO: 781331 - protein, 20 aa, Mycobacterium
WCRERMAGFKVPRYVEFLDE

SEQ ID NO: 781332 - protein, 24 aa, Mycobacterium
WCVISIRTDDEWRRAASVFDHPEW

SEQ ID NO: 781333 - protein, 17 aa, Mycobacterium
WDAAFAYWQQLRTDPGA

SEQ ID NO: 781334 - protein, 20 aa, Mycobacterium
WDALQIPVGVAFFFTNSALG

SEQ ID NO: 781335 - protein, 23 aa, Mycobacterium
WDAREWLRRPTLRHGASADLVCF

SEQ ID NO: 781336 - protein, 24 aa, Mycobacterium
WDAVIAVHLRGHFLLTRNAAAYWR

SEQ ID NO: 781337 - protein, 17 aa, Mycobacterium
WDDELLSFFSIPRQMLP

SEQ ID NO: 781338 - protein, 19 aa, Mycobacterium
WDEAYRLIAEHLKALGSPD

SEQ ID NO: 781339 - protein, 23 aa, Mycobacterium
WDFPIKEFHPFPRALLGVGAHDI

SEQ ID NO: 781340 - protein, 17 aa, Mycobacterium
WDGFRSICFRDGDEVEL

SEQ ID NO: 781341 - protein, 20 aa, Mycobacterium
WDHAIAFARWALADDCPTDI

SEQ ID NO: 781342 - protein, 18 aa, Mycobacterium
WDIFRCVRQVLDVLDPVP

SEQ ID NO: 781343 - protein, 21 aa, Mycobacterium
WDIYRCIRQVLAVLDPIPDPL

SEQ ID NO: 781344 - protein, 17 aa, Mycobacterium
WDLLPGYLIFRSIIPGR

SEQ ID NO: 781345 - protein, 20 aa, Mycobacterium
WDLLPGYLIFRSIIPNRPPT

SEQ ID NO: 781346 - protein, 18 aa, Mycobacterium
WDLPLVFGPIALVYNLPG

SEQ ID NO: 781347 - protein, 17 aa, Mycobacterium
WDLTMGVATDTRESLAN

SEQ ID NO: 781348 - protein, 17 aa, Mycobacterium
WDLTMGVATDTRESLIN

SEQ ID NO: 781349 - protein, 22 aa, Mycobacterium
WDMTIAGYWAWSAWDPQQGEFH

SEQ ID NO: 781350 - protein, 17 aa, Mycobacterium
WDMYRPARFVKQVRVVT

SEQ ID NO: 781351 - protein, 17 aa, Mycobacterium
WDPGKDFAMVTARETAP

SEQ ID NO: 781352 - protein, 20 aa, Mycobacterium
WDPITRIVGSLGIYTKIDFE

SEQ ID NO: 781353 - protein, 23 aa, Mycobacterium
WDPITRIVGSLGIYTKIDFENRE

SEQ ID NO: 781354 - protein, 22 aa, Mycobacterium
WDPRERPSFSAGYWAENLRHTV

SEQ ID NO: 781355 - protein, 18 aa, Mycobacterium
WDQVAGFARKYLAAATGL

SEQ ID NO: 781356 - protein, 20 aa, Mycobacterium
WDREIKRPWFLLNNLDNTEA

SEQ ID NO: 781357 - protein, 19 aa, Mycobacterium
WDRILAVNLRAHIRAADVL

SEQ ID NO: 781358 - protein, 17 aa, Mycobacterium
WDRLGLRGRFVKCVHSV

SEQ ID NO: 781359 - protein, 20 aa, Mycobacterium
WDRLPVEVVREARPWGRNGR

SEQ ID NO: 781360 - protein, 20 aa, Mycobacterium
WDSLWVYDHFHTVPLPSDEA

SEQ ID NO: 781361 - protein, 20 aa, Mycobacterium
WDSLWVYDHFHTVPMPTGEA

SEQ ID NO: 781362 - protein, 19 aa, Mycobacterium
WDSLWVYDHFHTVPVPTDE

SEQ ID NO: 781363 - protein, 17 aa, Mycobacterium
WDTARLVPLLAGLNELA

SEQ ID NO: 781364 - protein, 17 aa, Mycobacterium
WDTLTLFQAVRCRSVTG

SEQ ID NO: 781365 - protein, 17 aa, Mycobacterium
WDVGIKAAAVYVERISD

SEQ ID NO: 781366 - protein, 18 aa, Mycobacterium
WDVLPGYLMFRFIVPSRP

SEQ ID NO: 781367 - protein, 17 aa, Mycobacterium
WEASGGWDGRVSIEVDP

SEQ ID NO: 781368 - protein, 19 aa, Mycobacterium
WEDFERLLLDLGRHELGLR

SEQ ID NO: 781369 - protein, 19 aa, Mycobacterium
WEDRFRPVLTEVIAQGVAE

SEQ ID NO: 781370 - protein, 24 aa, Mycobacterium
WEELAVKLMLKWPNLYYSTSAFAP

SEQ ID NO: 781371 - protein, 18 aa, Mycobacterium
WEFDGPDLFGWIATVPSP

SEQ ID NO: 781372 - protein, 19 aa, Mycobacterium
WEFVDAGWVRAPRGSEPGL

SEQ ID NO: 781373 - protein, 20 aa, Mycobacterium
WEHGRFGAPYLRDSLLSAGA

SEQ ID NO: 781374 - protein, 22 aa, Mycobacterium
WEHGRFSAPYLRDSLLAAGALC

SEQ ID NO: 781375 - protein, 23 aa, Mycobacterium
WEICGALLHGGRLVIVPEPVTRA

SEQ ID NO: 781376 - protein, 17 aa, Mycobacterium
WEKLGIIPPGWVARDAV

SEQ ID NO: 781377 - protein, 17 aa, Mycobacterium
WELARWAPTSVNTQPLR

SEQ ID NO: 781378 - protein, 20 aa, Mycobacterium
WELFGPLVAGARLVFMDAAR

SEQ ID NO: 781379 - protein, 21 aa, Mycobacterium
WELGIGVLLTGVWNTLQIASA

SEQ ID NO: 781380 - protein, 19 aa, Mycobacterium
WELGPGWAKHVTVEFALGT

SEQ ID NO: 781381 - protein, 17 aa, Mycobacterium
WENACRFFSWDPFARTA

SEQ ID NO: 781382 - protein, 17 aa, Mycobacterium
WEPFTHMAFRFNECSTK

SEQ ID NO: 781383 - protein, 19 aa, Mycobacterium
WEQFSLWAEDIFKIVRFDS

SEQ ID NO: 781384 - protein, 17 aa, Mycobacterium
WEQWALRGAELIDFHTA

SEQ ID NO: 781385 - protein, 18 aa, Mycobacterium
WERLSVDVLDLWDNVRAH

SEQ ID NO: 781386 - protein, 19 aa, Mycobacterium
WERRRCFVEAVDGGGKAKW

SEQ ID NO: 781387 - protein, 21 aa, Mycobacterium
WETYSLWGLVDEDLTYREADI

SEQ ID NO: 781388 - protein, 24 aa, Mycobacterium
WEVDEIRPAFILSNVVDIPNAPFE

SEQ ID NO: 781389 - protein, 17 aa, Mycobacterium
WEVHGGTSLAGYVVPHR

SEQ ID NO: 781390 - protein, 17 aa, Mycobacterium
WEVHGGTSLAGYVVPQR

SEQ ID NO: 781391 - protein, 18 aa, Mycobacterium
WEVLTGDEVWNWTDELAQ

SEQ ID NO: 781392 - protein, 17 aa, Mycobacterium
WEYAMAGGRVSHTRIIV

SEQ ID NO: 781393 - protein, 17 aa, Mycobacterium
WFAAYAYWYFKLYGHEK

SEQ ID NO: 781394 - protein, 18 aa, Mycobacterium
WFAAYAYWYFKLYGHQDV

SEQ ID NO: 781395 - protein, 17 aa, Mycobacterium
WFAAYAYWYFKLYGHQN

SEQ ID NO: 781396 - protein, 18 aa, Mycobacterium
WFAGAGFSLVNMTGYPEA

SEQ ID NO: 781397 - protein, 19 aa, Mycobacterium
WFASAGFALVNMTGYPEAV

SEQ ID NO: 781398 - protein, 18 aa, Mycobacterium
WFASAGFSLVNMTGYPEA

SEQ ID NO: 781399 - protein, 18 aa, Mycobacterium
WFCELTWPAKPLAAHHDP

SEQ ID NO: 781400 - protein, 21 aa, Mycobacterium
WFEARWTDRFSLPITGEIIQL

SEQ ID NO: 781401 - protein, 23 aa, Mycobacterium
WFEFLDRGGLVWSRVRLEEVGRF

SEQ ID NO: 781402 - protein, 17 aa, Mycobacterium
WFERFARSFSGTIAGGT

SEQ ID NO: 781403 - protein, 17 aa, Mycobacterium
WFFLCPVAPEIAIRSRA

SEQ ID NO: 781404 - protein, 18 aa, Mycobacterium
WFFLCPVVPELAIRSRAT

SEQ ID NO: 781405 - protein, 18 aa, Mycobacterium
WFGEGWITSVLDLYHENI

SEQ ID NO: 781406 - protein, 19 aa, Mycobacterium
WFGGCCYRCDPCRKGIFIH

SEQ ID NO: 781407 - protein, 19 aa, Mycobacterium
WFHRPLRFDDWVLYATESP

SEQ ID NO: 781408 - protein, 19 aa, Mycobacterium
WFIGQRWEWSDEVARMHGY

SEQ ID NO: 781409 - protein, 20 aa, Mycobacterium
WFIYGLYRLSPSFSRTLTGI

SEQ ID NO: 781410 - protein, 17 aa, Mycobacterium
WFKDEFIHLGEPWLEHD

SEQ ID NO: 781411 - protein, 17 aa, Mycobacterium
WFLADGVPARPEVKLVK

SEQ ID NO: 781412 - protein, 19 aa, Mycobacterium
WFPKDVDAWNVRWVALHLV

SEQ ID NO: 781413 - protein, 22 aa, Mycobacterium
WFPKDVPAWSVRWVFFHMIEEL

SEQ ID NO: 781414 - protein, 17 aa, Mycobacterium
WFRAEVRGLESFPPTGG

SEQ ID NO: 781415 - protein, 17 aa, Mycobacterium
WFREAYPGLDIDQATLL

SEQ ID NO: 781416 - protein, 18 aa, Mycobacterium
WFRFYFADERWEWSPQVA

SEQ ID NO: 781417 - protein, 19 aa, Mycobacterium
WFRREFGVWLTPQTGNFLF

SEQ ID NO: 781418 - protein, 19 aa, Mycobacterium
WFSISAADWDAWVEAQADA

SEQ ID NO: 781419 - protein, 19 aa, Mycobacterium
WGAKIAFFFTRRKLTQMTG

SEQ ID NO: 781420 - protein, 17 aa, Mycobacterium
WGALLARTDPSAPKHSG

SEQ ID NO: 781421 - protein, 21 aa, Mycobacterium
WGAPVAWTFAWLYPQRCAGVV

SEQ ID NO: 781422 - protein, 17 aa, Mycobacterium
WGATGYPQMLLRLGWAP

SEQ ID NO: 781423 - protein, 17 aa, Mycobacterium
WGATLRRALSRYDVDVV

SEQ ID NO: 781424 - protein, 17 aa, Mycobacterium
WGDGWVKLVGDWIDRAV

SEQ ID NO: 781425 - protein, 19 aa, Mycobacterium
WGEAVTAVIVLRPDHPSDD

SEQ ID NO: 781426 - protein, 22 aa, Mycobacterium
WGEPFGHPWGYPAVYDLVLRLR

SEQ ID NO: 781427 - protein, 21 aa, Mycobacterium
WGEVIFPSLGMWGSTFRTPEL

SEQ ID NO: 781428 - protein, 17 aa, Mycobacterium
WGFHHLGSFAVEYRKRW

SEQ ID NO: 781429 - protein, 18 aa, Mycobacterium
WGGATYDVALRFLKEDPW

SEQ ID NO: 781430 - protein, 20 aa, Mycobacterium
WGGEIRPGFEPQPGDVVAHE

SEQ ID NO: 781431 - protein, 17 aa, Mycobacterium
WGGMVRYAARRGVHVLG

SEQ ID NO: 781432 - protein, 18 aa, Mycobacterium
WGGMVRYAARRGVRATGA

SEQ ID NO: 781433 - protein, 19 aa, Mycobacterium
WGGTPGWECALAGLDQECG

SEQ ID NO: 781434 - protein, 17 aa, Mycobacterium
WGHFADDRWELFHIDAD

SEQ ID NO: 781435 - protein, 26 aa, Mycobacterium
WGHYGIRVIDMWPLYVNTAMTKDVKT

SEQ ID NO: 781436 - protein, 19 aa, Mycobacterium
WGIGECGICGAKLRAVTKR

SEQ ID NO: 781437 - protein, 24 aa, Mycobacterium
WGKPEEMAELLAFCASEKAGYLTG

SEQ ID NO: 781438 - protein, 17 aa, Mycobacterium
WGKRRLAYEIAKHTEGI

SEQ ID NO: 781439 - protein, 20 aa, Mycobacterium
WGLDEVHALGALSGSRQAQR

SEQ ID NO: 781440 - protein, 26 aa, Mycobacterium
WGLPVDRLRYPVFSWQRITLQEMTHM

SEQ ID NO: 781441 - protein, 17 aa, Mycobacterium
WGLRRGYSVLVEMDADG

SEQ ID NO: 781442 - protein, 17 aa, Mycobacterium
WGLVPLLAGVAIVDAVA

SEQ ID NO: 781443 - protein, 18 aa, Mycobacterium
WGMLSPHGKCYAFDSRAD

SEQ ID NO: 781444 - protein, 20 aa, Mycobacterium
WGRPVFCAPKMFAIYGGSVK

SEQ ID NO: 781445 - protein, 18 aa, Mycobacterium
WGRSGPWALQDFTDLVAI

SEQ ID NO: 781446 - protein, 17 aa, Mycobacterium
WGRYPLRAHVTVTAPGG

SEQ ID NO: 781447 - protein, 17 aa, Mycobacterium
WGSIARNILKYSPDQIA

SEQ ID NO: 781448 - protein, 17 aa, Mycobacterium
WGSMVRYAARRGVRATG

SEQ ID NO: 781449 - protein, 17 aa, Mycobacterium
WGSRFPVITVRDQVAAD

SEQ ID NO: 781450 - protein, 19 aa, Mycobacterium
WGTNGWRFRHELLREVAAE

SEQ ID NO: 781451 - protein, 18 aa, Mycobacterium
WGVFLPRTARLLAADERV

SEQ ID NO: 781452 - protein, 20 aa, Mycobacterium
WHAVCWGIIIPSGWWRTRDT

SEQ ID NO: 781453 - protein, 17 aa, Mycobacterium
WHEFVAFRGRELCPGGR

SEQ ID NO: 781454 - protein, 23 aa, Mycobacterium
WHERETYDFFGIIFDDHPALTRI

SEQ ID NO: 781455 - protein, 23 aa, Mycobacterium
WHERETYDFFGIVFDGHPSLTRI

SEQ ID NO: 781456 - protein, 18 aa, Mycobacterium
WHGFCYDATSGECMSAPG

SEQ ID NO: 781457 - protein, 18 aa, Mycobacterium
WHMHIGAIALCDPSDVPD

SEQ ID NO: 781458 - protein, 17 aa, Mycobacterium
WHNWEFDVTTGRNVADP

SEQ ID NO: 781459 - protein, 19 aa, Mycobacterium
WHRHGRKIWDVIAVEGATT

SEQ ID NO: 781460 - protein, 24 aa, Mycobacterium
WHRWEELFELARFVGVSRPGYDLR

SEQ ID NO: 781461 - protein, 20 aa, Mycobacterium
WHSLARLAIRDDIYGALRSL

SEQ ID NO: 781462 - protein, 25 aa, Mycobacterium
WHVACARLRLAVAWMQLYRKWQSGD

SEQ ID NO: 781463 - protein, 23 aa, Mycobacterium
WHYHDCVFQWLFITKGWLELQFE

SEQ ID NO: 781464 - protein, 24 aa, Mycobacterium
WIARHFRIPLTIIRICSTYGPQGG

SEQ ID NO: 781465 - protein, 22 aa, Mycobacterium
WIAWRTEDGWGYRFIGDEEPNE

SEQ ID NO: 781466 - protein, 17 aa, Mycobacterium
WIDGPRVVPAGHAITPT

SEQ ID NO: 781467 - protein, 17 aa, Mycobacterium
WIDILPRFHHPREIVLH

SEQ ID NO: 781468 - protein, 20 aa, Mycobacterium
WIDRIRACYPLLYRRSGDQP

SEQ ID NO: 781469 - protein, 24 aa, Mycobacterium
WIGEAANWMSCWTMGLNQSTHGTW

SEQ ID NO: 781470 - protein, 18 aa, Mycobacterium
WIGSFRFVDEITDAVAAL

SEQ ID NO: 781471 - protein, 24 aa, Mycobacterium
WIGTAANWMSCWTMGLNQSTHGTW

SEQ ID NO: 781472 - protein, 24 aa, Mycobacterium
WIINGAKTWSTWAFAADYGLCLAR

SEQ ID NO: 781473 - protein, 18 aa, Mycobacterium
WIPSGISLPAGVRLLEPG

SEQ ID NO: 781474 - protein, 19 aa, Mycobacterium
WIRKRYEVAEGHTPSVQFG

SEQ ID NO: 781475 - protein, 18 aa, Mycobacterium
WIRTVCRPDRWLELRYVA

SEQ ID NO: 781476 - protein, 23 aa, Mycobacterium
WISAWQLPLEWLQIPPGGIALDV

SEQ ID NO: 781477 - protein, 18 aa, Mycobacterium
WITECLKAAYPLGHGHGP

SEQ ID NO: 781478 - protein, 19 aa, Mycobacterium
WITSPLGQVVDPVINAPFE

SEQ ID NO: 781479 - protein, 17 aa, Mycobacterium
WIVDLLIKLGREADAYD

SEQ ID NO: 781480 - protein, 22 aa, Mycobacterium
WIYIPKACTWRQIPDDESTLLM

SEQ ID NO: 781481 - protein, 19 aa, Mycobacterium
WKAACGLPITAAAFHSTTL

SEQ ID NO: 781482 - protein, 18 aa, Mycobacterium
WKAACGLPVTAGAFHSTT

SEQ ID NO: 781483 - protein, 18 aa, Mycobacterium
WKAFFKRQLGNPKYLHDG

SEQ ID NO: 781484 - protein, 18 aa, Mycobacterium
WKALGARFFALRPVTQLH

SEQ ID NO: 781485 - protein, 19 aa, Mycobacterium
WKALGKQVTHWDEWGKNPD

SEQ ID NO: 781486 - protein, 18 aa, Mycobacterium
WKALSWLDANVMRHVAPK

SEQ ID NO: 781487 - protein, 18 aa, Mycobacterium
WKALSWMDANVWRHVAPK

SEQ ID NO: 781488 - protein, 18 aa, Mycobacterium
WKALSWVDENVWRHVVPK

SEQ ID NO: 781489 - protein, 17 aa, Mycobacterium
WKDLYLPVIELLEPRLS

SEQ ID NO: 781490 - protein, 20 aa, Mycobacterium
WKDRGRAMVVLVDRLDRWAA

SEQ ID NO: 781491 - protein, 22 aa, Mycobacterium
WKDWLRWRVIHGRAFLLTDELI

SEQ ID NO: 781492 - protein, 21 aa, Mycobacterium
WKDYTERGGRAFGEFAAFCYH

SEQ ID NO: 781493 - protein, 21 aa, Mycobacterium
WKEQRGARIFVDFNQNARDRT

SEQ ID NO: 781494 - protein, 19 aa, Mycobacterium
WKESAFQLAWLLDILGAQG

SEQ ID NO: 781495 - protein, 17 aa, Mycobacterium
WKEVVLLAGGRSDVAVV

SEQ ID NO: 781496 - protein, 18 aa, Mycobacterium
WKGHCAIGEVPAERWRPF

SEQ ID NO: 781497 - protein, 25 aa, Mycobacterium
WKGKAVLVKLIWRMFRARVFGDRMA

SEQ ID NO: 781498 - protein, 27 aa, Mycobacterium
WKGSRFPMEICISGWAMLNREAAIIPD

SEQ ID NO: 781499 - protein, 18 aa, Mycobacterium
WKHIPGIGAYAAAKAALW

SEQ ID NO: 781500 - protein, 19 aa, Mycobacterium
WKIALCDTIADNASSAGFV

SEQ ID NO: 781501 - protein, 17 aa, Mycobacterium
WKIELCDTIADNASSAG

SEQ ID NO: 781502 - protein, 23 aa, Mycobacterium
WKIGAVPIPMHWDLPEWERDRVR

SEQ ID NO: 781503 - protein, 23 aa, Mycobacterium
WKIGAVPVPMHWDLPEWERNRVL

SEQ ID NO: 781504 - protein, 19 aa, Mycobacterium
WKLDGQKVWNSKAQIADWA

SEQ ID NO: 781505 - protein, 17 aa, Mycobacterium
WKLEHELGYAITHRIPM

SEQ ID NO: 781506 - protein, 19 aa, Mycobacterium
WKLQNEFRIPASQFTQEQI

SEQ ID NO: 781507 - protein, 20 aa, Mycobacterium
WKMDLELGAHYYVKFGNPDV

SEQ ID NO: 781508 - protein, 20 aa, Mycobacterium
WKMDLELGAHYYVKFNNPDV

SEQ ID NO: 781509 - protein, 17 aa, Mycobacterium
WKPGWASAAAWTDDPLF

SEQ ID NO: 781510 - protein, 18 aa, Mycobacterium
WKPLLGVHSLLWDECQQI

SEQ ID NO: 781511 - protein, 21 aa, Mycobacterium
WKPVGGFPITFGWLHAVRRGQ

SEQ ID NO: 781512 - protein, 23 aa, Mycobacterium
WKPVGGFPITLGWINAIRRGQAQ

SEQ ID NO: 781513 - protein, 20 aa, Mycobacterium
WKPVGGFPITVGWLHAIRRG

SEQ ID NO: 781514 - protein, 21 aa, Mycobacterium
WKPVGGFPVTLGWVHATRRGQ

SEQ ID NO: 781515 - protein, 19 aa, Mycobacterium
WKQAHVELPPPGTPVTAPA

SEQ ID NO: 781516 - protein, 17 aa, Mycobacterium
WKRHIREAVRFADSVRF

SEQ ID NO: 781517 - protein, 17 aa, Mycobacterium
WKRHVREAVRFADSVRF

SEQ ID NO: 781518 - protein, 19 aa, Mycobacterium
WKRWRPALQQALVDAVRSV

SEQ ID NO: 781519 - protein, 17 aa, Mycobacterium
WKSMITDGLAMRHGKDL

SEQ ID NO: 781520 - protein, 17 aa, Mycobacterium
WKVFLGVLRERFEQDKT

SEQ ID NO: 781521 - protein, 18 aa, Mycobacterium
WKVFLNLLRNRFESDKGK

SEQ ID NO: 781522 - protein, 18 aa, Mycobacterium
WLAALWRVGFDADQPTAW

SEQ ID NO: 781523 - protein, 17 aa, Mycobacterium
WLAARGFDPIYGARPLR

SEQ ID NO: 781524 - protein, 17 aa, Mycobacterium
WLADGWLALFRTWLADA

SEQ ID NO: 781525 - protein, 19 aa, Mycobacterium
WLAERVRAEMLRRGRTPVP

SEQ ID NO: 781526 - protein, 26 aa, Mycobacterium
WLAPGGFDFGAWHFKRGCEALAERHE

SEQ ID NO: 781527 - protein, 17 aa, Mycobacterium
WLARTGFQMLDPIKTAQ

SEQ ID NO: 781528 - protein, 17 aa, Mycobacterium
WLATFAFFRAAMAAAAP

SEQ ID NO: 781529 - protein, 18 aa, Mycobacterium
WLAVRAMPEFAARNAFGA

SEQ ID NO: 781530 - protein, 17 aa, Mycobacterium
WLAVRGFRLTEGAEPAG

SEQ ID NO: 781531 - protein, 18 aa, Mycobacterium
WLDAEWRLVSHDVRVIVA

SEQ ID NO: 781532 - protein, 21 aa, Mycobacterium
WLDAFTRWRRARGLPATAIAW

SEQ ID NO: 781533 - protein, 20 aa, Mycobacterium
WLDAFVQWRRVRGLPATAIA

SEQ ID NO: 781534 - protein, 23 aa, Mycobacterium
WLDDPRFADAYARFVNATELIAE

SEQ ID NO: 781535 - protein, 22 aa, Mycobacterium
WLDEPCPFYDWRVNEPDKPRVH

SEQ ID NO: 781536 - protein, 19 aa, Mycobacterium
WLDEPCSFYDWRRSEEDGP

SEQ ID NO: 781537 - protein, 20 aa, Mycobacterium
WLDEPCTFYDWRGSETGKPK

SEQ ID NO: 781538 - protein, 19 aa, Mycobacterium
WLDEPCTFYDWRSSETGKP

SEQ ID NO: 781539 - protein, 18 aa, Mycobacterium
WLDEVPRTPAFYFDAITQ

SEQ ID NO: 781540 - protein, 17 aa, Mycobacterium
WLDFARAEIADWPFYDT

SEQ ID NO: 781541 - protein, 21 aa, Mycobacterium
WLDGFTHWRRAQGLPATVIAW

SEQ ID NO: 781542 - protein, 19 aa, Mycobacterium
WLDGLVAWRRAAGLPAATI

SEQ ID NO: 781543 - protein, 19 aa, Mycobacterium
WLDNKVVQWVPDRYWPAHS

SEQ ID NO: 781544 - protein, 18 aa, Mycobacterium
WLDRDAWSRMSIRNTARS

SEQ ID NO: 781545 - protein, 20 aa, Mycobacterium
WLDRLQGFQTLRFAGDRLQH

SEQ ID NO: 781546 - protein, 19 aa, Mycobacterium
WLDTEWRLVADDVRVIVAL

SEQ ID NO: 781547 - protein, 18 aa, Mycobacterium
WLEACYDLGTAVIAPSCG

SEQ ID NO: 781548 - protein, 24 aa, Mycobacterium
WLELPDPPALWGWGKTAHLLVGSL

SEQ ID NO: 781549 - protein, 20 aa, Mycobacterium
WLEPFLPWDGMEMAPLPAAL

SEQ ID NO: 781550 - protein, 22 aa, Mycobacterium
WLEWVFDPAQQWQFPDFSFGQE

SEQ ID NO: 781551 - protein, 18 aa, Mycobacterium
WLFENGPEFTHYEVIDGY

SEQ ID NO: 781552 - protein, 17 aa, Mycobacterium
WLFMRDRCLSIAGGTTQ

SEQ ID NO: 781553 - protein, 21 aa, Mycobacterium
WLFSWCFARRGWAERARLLRQ

SEQ ID NO: 781554 - protein, 19 aa, Mycobacterium
WLGAQAGAFHSQFIQALTG

SEQ ID NO: 781555 - protein, 18 aa, Mycobacterium
WLGDGWVSLLRKWIDDAE

SEQ ID NO: 781556 - protein, 18 aa, Mycobacterium
WLGLILCGAVTVSINPKA

SEQ ID NO: 781557 - protein, 17 aa, Mycobacterium
WLGRRVFAMPMTGGGYA

SEQ ID NO: 781558 - protein, 18 aa, Mycobacterium
WLGTNGFQEACWAWRRLR

SEQ ID NO: 781559 - protein, 18 aa, Mycobacterium
WLIEQRIQASLALLESSD

SEQ ID NO: 781560 - protein, 19 aa, Mycobacterium
WLIGAPRWREAAAARGDGK

SEQ ID NO: 781561 - protein, 17 aa, Mycobacterium
WLIGRGVGRRARVGLLM

SEQ ID NO: 781562 - protein, 17 aa, Mycobacterium
WLKAWRMLIDAKYHGDI

SEQ ID NO: 781563 - protein, 19 aa, Mycobacterium
WLKPTAYMMAKFGMTLCAL

SEQ ID NO: 781564 - protein, 21 aa, Mycobacterium
WLLAGGGLDWATKRTADSASR

SEQ ID NO: 781565 - protein, 19 aa, Mycobacterium
WLLGLRIVPMLAPGSADAN

SEQ ID NO: 781566 - protein, 18 aa, Mycobacterium
WLLGYWSDRVHRLLGACV

SEQ ID NO: 781567 - protein, 21 aa, Mycobacterium
WLLLELEGGWGPSAFLESPGS

SEQ ID NO: 781568 - protein, 18 aa, Mycobacterium
WLLLRLARRYGKVFSVNL

SEQ ID NO: 781569 - protein, 18 aa, Mycobacterium
WLLNGFKWFASNCAGEAF

SEQ ID NO: 781570 - protein, 19 aa, Mycobacterium
WLLRACAKLGIRLVHSAPG

SEQ ID NO: 781571 - protein, 19 aa, Mycobacterium
WLLRELIHALLVKKDHRAA

SEQ ID NO: 781572 - protein, 17 aa, Mycobacterium
WLLRFFDRISWYPVSAE

SEQ ID NO: 781573 - protein, 17 aa, Mycobacterium
WLLRPVSVEAFLDEIWA

SEQ ID NO: 781574 - protein, 19 aa, Mycobacterium
WLNEHGWRATARNAGDEMR

SEQ ID NO: 781575 - protein, 23 aa, Mycobacterium
WLNSGVGNWGGWNSGMGSTGFGN

SEQ ID NO: 781576 - protein, 18 aa, Mycobacterium
WLPADINAGAALPTGDPV

SEQ ID NO: 781577 - protein, 20 aa, Mycobacterium
WLPDHLNAFLPRAVMTPKYS

SEQ ID NO: 781578 - protein, 17 aa, Mycobacterium
WLPGPRELRAWTLAAGT

SEQ ID NO: 781579 - protein, 17 aa, Mycobacterium
WLPGPRELRTWTLAAGS

SEQ ID NO: 781580 - protein, 27 aa, Mycobacterium
WLPRYGGLISSEWEFAKGLQILEEDPE

SEQ ID NO: 781581 - protein, 19 aa, Mycobacterium
WLPTRSADFVNRWKNILLA

SEQ ID NO: 781582 - protein, 23 aa, Mycobacterium
WLPWRGQRLPGYWFVPPGSSGPG

SEQ ID NO: 781583 - protein, 19 aa, Mycobacterium
WLQERGVTIWDEWASEAGE

SEQ ID NO: 781584 - protein, 19 aa, Mycobacterium
WLQERGVTIWDEWASPTGD

SEQ ID NO: 781585 - protein, 19 aa, Mycobacterium
WLRACLVSCWLASDESARS

SEQ ID NO: 781586 - protein, 27 aa, Mycobacterium
WLREGLRFWLRSALTYDLLTWSSVVDR

SEQ ID NO: 781587 - protein, 23 aa, Mycobacterium
WLRRFSTDWPRWGWRRAAKMARR

SEQ ID NO: 781588 - protein, 20 aa, Mycobacterium
WLRRWCSATSNRWCQMRVRL

SEQ ID NO: 781589 - protein, 20 aa, Mycobacterium
WLRYRADAFGVASVPIPGTR

SEQ ID NO: 781590 - protein, 18 aa, Mycobacterium
WLSANGMTRLLQRTVVVL

SEQ ID NO: 781591 - protein, 19 aa, Mycobacterium
WLSRKRIQEEWGISDEVMR

SEQ ID NO: 781592 - protein, 18 aa, Mycobacterium
WLSSDPFYRDSLENDPLA

SEQ ID NO: 781593 - protein, 19 aa, Mycobacterium
WLSSQGHAPYAWSVLGAVA

SEQ ID NO: 781594 - protein, 18 aa, Mycobacterium
WLSTLRCGAHQPVLMRDP

SEQ ID NO: 781595 - protein, 17 aa, Mycobacterium
WLTARGIVALNITSSPG

SEQ ID NO: 781596 - protein, 24 aa, Mycobacterium
WLTGMFDRGAWRPAAVVVVGSDTD

SEQ ID NO: 781597 - protein, 19 aa, Mycobacterium
WLTTLYPLWSHLDADLEYV

SEQ ID NO: 781598 - protein, 17 aa, Mycobacterium
WLVAPAIAYGASGEHQS

SEQ ID NO: 781599 - protein, 19 aa, Mycobacterium
WLVGPRARYVTGVSIPVDA

SEQ ID NO: 781600 - protein, 17 aa, Mycobacterium
WLVLHLRRPGGQTQFAA

SEQ ID NO: 781601 - protein, 24 aa, Mycobacterium
WLVLRECLRLAGGAAQTAVELSRG

SEQ ID NO: 781602 - protein, 18 aa, Mycobacterium
WLVTAAKFEVEWPAEPER

SEQ ID NO: 781603 - protein, 22 aa, Mycobacterium
WLYIPKACTWRQLPDTATTMLM

SEQ ID NO: 781604 - protein, 17 aa, Mycobacterium
WMADLAHEFGLSPPPPE

SEQ ID NO: 781605 - protein, 17 aa, Mycobacterium
WMARTGFQMLDPLKTAK

SEQ ID NO: 781606 - protein, 17 aa, Mycobacterium
WMDIKRKPSEYVKDHIK

SEQ ID NO: 781607 - protein, 17 aa, Mycobacterium
WMDRLGHRVTWDSRTRS

SEQ ID NO: 781608 - protein, 19 aa, Mycobacterium
WMGRVHRFLGLDVGVILAQ

SEQ ID NO: 781609 - protein, 23 aa, Mycobacterium
WMINGAKTWSTWAFAADYGLCLA

SEQ ID NO: 781610 - protein, 17 aa, Mycobacterium
WMLLAAIEALIDGHEYL

SEQ ID NO: 781611 - protein, 17 aa, Mycobacterium
WMRGAREKISFQGLPAR

SEQ ID NO: 781612 - protein, 17 aa, Mycobacterium
WMRLVVLGVKFREAYGV

SEQ ID NO: 781613 - protein, 21 aa, Mycobacterium
WMRRLGAEIDRPVSFALIQVD

SEQ ID NO: 781614 - protein, 23 aa, Mycobacterium
WMRRPHLAEAWEYVWPVSRWQRY

SEQ ID NO: 781615 - protein, 22 aa, Mycobacterium
WMRRPHLLRAWDAAWPASRWYR

SEQ ID NO: 781616 - protein, 17 aa, Mycobacterium
WMRWGWPTRIGGLGGSP

SEQ ID NO: 781617 - protein, 23 aa, Mycobacterium
WMSGISRKGPWTVPPRLRLVTRM

SEQ ID NO: 781618 - protein, 18 aa, Mycobacterium
WNAEGWVGVAGRVVNDGV

SEQ ID NO: 781619 - protein, 18 aa, Mycobacterium
WNAIAEIIARGWDDVLKA

SEQ ID NO: 781620 - protein, 18 aa, Mycobacterium
WNAIRLLRSEGRTVVLTT

SEQ ID NO: 781621 - protein, 18 aa, Mycobacterium
WNAPGGKPRRAGVSSYSM

SEQ ID NO: 781622 - protein, 20 aa, Mycobacterium
WNDWHLEAWAGPYPERIIPC

SEQ ID NO: 781623 - protein, 17 aa, Mycobacterium
WNDWHLEVWAGAYPQRI

SEQ ID NO: 781624 - protein, 22 aa, Mycobacterium
WNFPMTIASWGFAPALAAGNAV

SEQ ID NO: 781625 - protein, 25 aa, Mycobacterium
WNGEEVWPGYGPAPVWNFPATLTNL

SEQ ID NO: 781626 - protein, 19 aa, Mycobacterium
WNGKPVWPGWAAKRTDRDP

SEQ ID NO: 781627 - protein, 17 aa, Mycobacterium
WNLQLGNAVIFGSSNAE

SEQ ID NO: 781628 - protein, 18 aa, Mycobacterium
WNMFKQNIGIMIAVAQLA

SEQ ID NO: 781629 - protein, 18 aa, Mycobacterium
WNPALLALRAELERVFLA

SEQ ID NO: 781630 - protein, 18 aa, Mycobacterium
WNPALLALRGELERVFLA

SEQ ID NO: 781631 - protein, 17 aa, Mycobacterium
WNQIGTIVGKSWDSVID

SEQ ID NO: 781632 - protein, 19 aa, Mycobacterium
WNRLEYRPLEGFVYAITPF

SEQ ID NO: 781633 - protein, 17 aa, Mycobacterium
WNRPSWTVAELEAAKAG

SEQ ID NO: 781634 - protein, 17 aa, Mycobacterium
WNRYLAVNLTGTFLCIR

SEQ ID NO: 781635 - protein, 17 aa, Mycobacterium
WNRYLAVNLTGTFLSIR

SEQ ID NO: 781636 - protein, 18 aa, Mycobacterium
WNTLLALLFEWGVALQHL

SEQ ID NO: 781637 - protein, 24 aa, Mycobacterium
WNVPCRRCPHCLRGETQLCPHGLK

SEQ ID NO: 781638 - protein, 20 aa, Mycobacterium
WNVPQCLIMPKLIPALIAGC

SEQ ID NO: 781639 - protein, 17 aa, Mycobacterium
WPAGTVVYEVDMPEVIE

SEQ ID NO: 781640 - protein, 19 aa, Mycobacterium
WPAGWSAWPPRGYGDTRLE

SEQ ID NO: 781641 - protein, 18 aa, Mycobacterium
WPAKLRLLDGFRHRENLS

SEQ ID NO: 781642 - protein, 24 aa, Mycobacterium
WPAKRAGTAAALWELSERLTGTAF

SEQ ID NO: 781643 - protein, 20 aa, Mycobacterium
WPALCRVVGRPEWLADPRYG

SEQ ID NO: 781644 - protein, 20 aa, Mycobacterium
WPARLRRLIVEQASVILRRT

SEQ ID NO: 781645 - protein, 19 aa, Mycobacterium
WPDGLPLFFRVSATDWLGG

SEQ ID NO: 781646 - protein, 18 aa, Mycobacterium
WPDGPWDTLGTRPHLAVA

SEQ ID NO: 781647 - protein, 24 aa, Mycobacterium
WPDNGKAAGYLFSWTNEASSGPEA

SEQ ID NO: 781648 - protein, 20 aa, Mycobacterium
WPDVQARFAAAVSKTPGLIF

SEQ ID NO: 781649 - protein, 17 aa, Mycobacterium
WPEAVLAAAAWFQGDND

SEQ ID NO: 781650 - protein, 19 aa, Mycobacterium
WPEGKIRSVFEPVVKTTVI

SEQ ID NO: 781651 - protein, 17 aa, Mycobacterium
WPEVRSQLAMTWGTETF

SEQ ID NO: 781652 - protein, 18 aa, Mycobacterium
WPEVYPRLLRVMDADPIC

SEQ ID NO: 781653 - protein, 19 aa, Mycobacterium
WPEYHPGYFGAFVRDPDGN

SEQ ID NO: 781654 - protein, 17 aa, Mycobacterium
WPFCSGINHADMMFAGC

SEQ ID NO: 781655 - protein, 18 aa, Mycobacterium
WPFSKVRLAAQTVAREVE

SEQ ID NO: 781656 - protein, 17 aa, Mycobacterium
WPGDGWVTAAAHERFLN

SEQ ID NO: 781657 - protein, 17 aa, Mycobacterium
WPGFAGEIACSAWPAGA

SEQ ID NO: 781658 - protein, 17 aa, Mycobacterium
WPGGALIAVQFVLNYEE

SEQ ID NO: 781659 - protein, 24 aa, Mycobacterium
WPGISEAITDCWLVTVGGEAVVAD

SEQ ID NO: 781660 - protein, 21 aa, Mycobacterium
WPGLEHQWLDGWFVRASDGHT

SEQ ID NO: 781661 - protein, 20 aa, Mycobacterium
WPGQRFALIFRDWLRSDHQA

SEQ ID NO: 781662 - protein, 17 aa, Mycobacterium
WPGTEQQWLGGWFARAG

SEQ ID NO: 781663 - protein, 26 aa, Mycobacterium
WPGVERCWLDGWLLRAGHGATPADSA

SEQ ID NO: 781664 - protein, 20 aa, Mycobacterium
WPHRCLPMLIANQSGWEVRN

SEQ ID NO: 781665 - protein, 18 aa, Mycobacterium
WPHRGLRSLLTIRVGDAV

SEQ ID NO: 781666 - protein, 17 aa, Mycobacterium
WPIMPVDTVNFWLKPVG

SEQ ID NO: 781667 - protein, 18 aa, Mycobacterium
WPIRAAVLHTGDEHVVSL

SEQ ID NO: 781668 - protein, 21 aa, Mycobacterium
WPKAFAGLGARPVELPTYGFA

SEQ ID NO: 781669 - protein, 25 aa, Mycobacterium
WPKLVARPRLGLSLLAEDHEDAARL

SEQ ID NO: 781670 - protein, 19 aa, Mycobacterium
WPKPLGFVWGLADPVATTN

SEQ ID NO: 781671 - protein, 18 aa, Mycobacterium
WPLADVRLLAPILASKVV

SEQ ID NO: 781672 - protein, 19 aa, Mycobacterium
WPLAEALRYPARLIDEFEW

SEQ ID NO: 781673 - protein, 19 aa, Mycobacterium
WPLCCTEEGGGFIYADGSQ

SEQ ID NO: 781674 - protein, 19 aa, Mycobacterium
WPLGRGFERFYGFLGGETN

SEQ ID NO: 781675 - protein, 17 aa, Mycobacterium
WPLGVAFLRNYDVRVID

SEQ ID NO: 781676 - protein, 17 aa, Mycobacterium
WPLHISLLLAKEYALTG

SEQ ID NO: 781677 - protein, 19 aa, Mycobacterium
WPNHMKLFFNNKGVVAKAT

SEQ ID NO: 781678 - protein, 19 aa, Mycobacterium
WPNRRLVPAPADWVNDDDP

SEQ ID NO: 781679 - protein, 17 aa, Mycobacterium
WPPELLAAFAAMGTEIF

SEQ ID NO: 781680 - protein, 18 aa, Mycobacterium
WPPGWEVLELNPAQVAEQ

SEQ ID NO: 781681 - protein, 18 aa, Mycobacterium
WPPPFWKSAADQGLTSVH

SEQ ID NO: 781682 - protein, 18 aa, Mycobacterium
WPPVRRIDGAYGDRHLVC

SEQ ID NO: 781683 - protein, 18 aa, Mycobacterium
WPRAGAVLPEPVGQVRMR

SEQ ID NO: 781684 - protein, 24 aa, Mycobacterium
WPRLSSTVTGCWLVTVGGEQAIAD

SEQ ID NO: 781685 - protein, 18 aa, Mycobacterium
WPRPNFPVSNFFHGGAAP

SEQ ID NO: 781686 - protein, 19 aa, Mycobacterium
WPRQPGRYFTVRAGSLVAW

SEQ ID NO: 781687 - protein, 20 aa, Mycobacterium
WPRRIAEGLNRMLGGDHVFT

SEQ ID NO: 781688 - protein, 20 aa, Mycobacterium
WPRRMRKMFMGLAARQLPEG

SEQ ID NO: 781689 - protein, 20 aa, Mycobacterium
WPRRRPWRRLSKNAGDQPPC

SEQ ID NO: 781690 - protein, 18 aa, Mycobacterium
WPRSPGWTGAAAVTATEA

SEQ ID NO: 781691 - protein, 17 aa, Mycobacterium
WPRYRTAALDRTPVRSI

SEQ ID NO: 781692 - protein, 19 aa, Mycobacterium
WPSHILVPAIHRNRAEVRE

SEQ ID NO: 781693 - protein, 20 aa, Mycobacterium
WPSKAELVLAAFIEGVRQVA

SEQ ID NO: 781694 - protein, 18 aa, Mycobacterium
WPSKAELVLAAFVEGIRQ

SEQ ID NO: 781695 - protein, 18 aa, Mycobacterium
WPSPMLPALQALPADGPD

SEQ ID NO: 781696 - protein, 18 aa, Mycobacterium
WPSRRSWEAMARVLAHLR

SEQ ID NO: 781697 - protein, 17 aa, Mycobacterium
WPSSLAWSADASALIVT

SEQ ID NO: 781698 - protein, 17 aa, Mycobacterium
WPSVPGRYFTVRAGSLV

SEQ ID NO: 781699 - protein, 17 aa, Mycobacterium
WPTRLGWAVRDWPETVI

SEQ ID NO: 781700 - protein, 18 aa, Mycobacterium
WPTSSGFSLDPVAAQRVS

SEQ ID NO: 781701 - protein, 19 aa, Mycobacterium
WPTVAAWVKWLSTGGDKPD

SEQ ID NO: 781702 - protein, 18 aa, Mycobacterium
WPTVADWVRWISSDGDKP

SEQ ID NO: 781703 - protein, 20 aa, Mycobacterium
WPTVAEWVRWLSAGGDKPTS

SEQ ID NO: 781704 - protein, 20 aa, Mycobacterium
WPVGPSVRIYPLLKELTLDI

SEQ ID NO: 781705 - protein, 24 aa, Mycobacterium
WPVLTWLFCWAFERRGWSERAFLL

SEQ ID NO: 781706 - protein, 17 aa, Mycobacterium
WPVMPADTVSFWLKPVG

SEQ ID NO: 781707 - protein, 20 aa, Mycobacterium
WPVMPVDVVSFWLKPFGFFD

SEQ ID NO: 781708 - protein, 19 aa, Mycobacterium
WPVRTGLIVGRLDGDGSRF

SEQ ID NO: 781709 - protein, 17 aa, Mycobacterium
WPVSLFAERTWHVARPV

SEQ ID NO: 781710 - protein, 23 aa, Mycobacterium
WPYEHLNEAPAYWQALASKCYDA

SEQ ID NO: 781711 - protein, 19 aa, Mycobacterium
WPYGCGGIMLGTHKPDAQW

SEQ ID NO: 781712 - protein, 19 aa, Mycobacterium
WPYVIERLLAAGAYDAWLT

SEQ ID NO: 781713 - protein, 21 aa, Mycobacterium
WQAPLRWAIRGALAVRAGLVV

SEQ ID NO: 781714 - protein, 18 aa, Mycobacterium
WQAPRPLLDIGLTDVEAW

SEQ ID NO: 781715 - protein, 18 aa, Mycobacterium
WQDLRAAFTERGWLDLTH

SEQ ID NO: 781716 - protein, 20 aa, Mycobacterium
WQGWAGGPGGGWGRPPTPLW

SEQ ID NO: 781717 - protein, 20 aa, Mycobacterium
WQIIDAQGWSSRRLAAALEQ

SEQ ID NO: 781718 - protein, 20 aa, Mycobacterium
WQISDARGWSTTRLGNAVET

SEQ ID NO: 781719 - protein, 17 aa, Mycobacterium
WQKILIDRLVRYDVDGE

SEQ ID NO: 781720 - protein, 18 aa, Mycobacterium
WQKLNGPQALSFVRQRHG

SEQ ID NO: 781721 - protein, 19 aa, Mycobacterium
WQMLPRILAITVRDGKVCA

SEQ ID NO: 781722 - protein, 23 aa, Mycobacterium
WQNWSLRVGFNYREGMTLHAVTY

SEQ ID NO: 781723 - protein, 18 aa, Mycobacterium
WQPLHTMPGISTFYTFYD

SEQ ID NO: 781724 - protein, 17 aa, Mycobacterium
WQPVPGFEDLTDITYHR

SEQ ID NO: 781725 - protein, 26 aa, Mycobacterium
WQQFSLWADDVFKAFSFSVDIREVEP

SEQ ID NO: 781726 - protein, 20 aa, Mycobacterium
WQQRFPGLDWKVTAGNSSPI

SEQ ID NO: 781727 - protein, 23 aa, Mycobacterium
WQREMLARIGVPYRVIDVAAGDL

SEQ ID NO: 781728 - protein, 19 aa, Mycobacterium
WQRLCGVLGAAALAGDPRY

SEQ ID NO: 781729 - protein, 17 aa, Mycobacterium
WQRLCQKWDLASAPLDR

SEQ ID NO: 781730 - protein, 20 aa, Mycobacterium
WQRWADLNVRYLRKIGYRGT

SEQ ID NO: 781731 - protein, 17 aa, Mycobacterium
WQRYLGILFDGLRPEGA

SEQ ID NO: 781732 - protein, 19 aa, Mycobacterium
WQWRLVWYRAVSELLTGDY

SEQ ID NO: 781733 - protein, 20 aa, Mycobacterium
WRADGGFGLHVFHKNNELAG

SEQ ID NO: 781734 - protein, 23 aa, Mycobacterium
WRAEERVALSVPRPSAVNIVTGL

SEQ ID NO: 781735 - protein, 19 aa, Mycobacterium
WRAELPLIEEWFEFVGEKL

SEQ ID NO: 781736 - protein, 17 aa, Mycobacterium
WRAGGGWTDGRQRLGTS

SEQ ID NO: 781737 - protein, 22 aa, Mycobacterium
WRAGRFWWDWSETGEPDGRSLT

SEQ ID NO: 781738 - protein, 19 aa, Mycobacterium
WRAPWKTLVDLGWTELAAS

SEQ ID NO: 781739 - protein, 18 aa, Mycobacterium
WRATILVRETAYLAVEDR

SEQ ID NO: 781740 - protein, 19 aa, Mycobacterium
WRATLIVRESACLDIEHRR

SEQ ID NO: 781741 - protein, 18 aa, Mycobacterium
WRATLIVRESACLDVADR

SEQ ID NO: 781742 - protein, 19 aa, Mycobacterium
WRATLIVRESACLDVEDRR

SEQ ID NO: 781743 - protein, 17 aa, Mycobacterium
WRAVQRVGWKWWLAACF

SEQ ID NO: 781744 - protein, 22 aa, Mycobacterium
WRAYPADVLPLWVAEMDVKLAP

SEQ ID NO: 781745 - protein, 18 aa, Mycobacterium
WRDARWLAVVINYRAQRW

SEQ ID NO: 781746 - protein, 19 aa, Mycobacterium
WRDLARGWRITMPNLEQTG

SEQ ID NO: 781747 - protein, 19 aa, Mycobacterium
WREARWVSVVINYRAERWS

SEQ ID NO: 781748 - protein, 22 aa, Mycobacterium
WREILDRIPPWIVSHPYNDLLG

SEQ ID NO: 781749 - protein, 17 aa, Mycobacterium
WRELCAATAPSLAGTRY

SEQ ID NO: 781750 - protein, 23 aa, Mycobacterium
WREVYRLRQPVLLIWGREDRVNP

SEQ ID NO: 781751 - protein, 17 aa, Mycobacterium
WRFPDRLDRVYVNTRAR

SEQ ID NO: 781752 - protein, 18 aa, Mycobacterium
WRFPPIKPFRGAYVLLEF

SEQ ID NO: 781753 - protein, 17 aa, Mycobacterium
WRFTPLKRLRGLHDGSA

SEQ ID NO: 781754 - protein, 19 aa, Mycobacterium
WRFVTLRWSVDNARDIADL

SEQ ID NO: 781755 - protein, 20 aa, Mycobacterium
WRGALKLGIEMRVGPVGIVN

SEQ ID NO: 781756 - protein, 18 aa, Mycobacterium
WRGDRRFVERLSRATLDA

SEQ ID NO: 781757 - protein, 19 aa, Mycobacterium
WRGGASILMRAVLAANGDE

SEQ ID NO: 781758 - protein, 21 aa, Mycobacterium
WRGGCIIRAKFLNRITDAFDN

SEQ ID NO: 781759 - protein, 18 aa, Mycobacterium
WRGIGMIASSGWRLSPAY

SEQ ID NO: 781760 - protein, 25 aa, Mycobacterium
WRGKAVLLKLIWRMFRARVFGDRMA

SEQ ID NO: 781761 - protein, 17 aa, Mycobacterium
WRGLFDANLLASVLTVQ

SEQ ID NO: 781762 - protein, 20 aa, Mycobacterium
WRGMKPPARVLAAYAKAIEE

SEQ ID NO: 781763 - protein, 22 aa, Mycobacterium
WRHNVCGYRRFFSITSLAGIRQ

SEQ ID NO: 781764 - protein, 22 aa, Mycobacterium
WRHWASCFEFDFTYVHGGGSVR

SEQ ID NO: 781765 - protein, 17 aa, Mycobacterium
WRIRRFDSGMAWAEDPP

SEQ ID NO: 781766 - protein, 17 aa, Mycobacterium
WRISKRTVLPMDGSGPA

SEQ ID NO: 781767 - protein, 17 aa, Mycobacterium
WRIVNALAASGALEPDA

SEQ ID NO: 781768 - protein, 17 aa, Mycobacterium
WRIVTALASAGEIDADG

SEQ ID NO: 781769 - protein, 17 aa, Mycobacterium
WRKGPRHIAGRGPRDTY

SEQ ID NO: 781770 - protein, 20 aa, Mycobacterium
WRKPLVRRWYGFAEMQKKVA

SEQ ID NO: 781771 - protein, 18 aa, Mycobacterium
WRKWVYRGSFGVINPGES

SEQ ID NO: 781772 - protein, 17 aa, Mycobacterium
WRLATLFGLLDAVAAAL

SEQ ID NO: 781773 - protein, 19 aa, Mycobacterium
WRLCSELDLTIVQHGGPGS

SEQ ID NO: 781774 - protein, 17 aa, Mycobacterium
WRLGAAMTMLQQPTSQA

SEQ ID NO: 781775 - protein, 19 aa, Mycobacterium
WRLGAHDLVVLWRRATGFG

SEQ ID NO: 781776 - protein, 17 aa, Mycobacterium
WRLGGAFNCGKAQPGQV

SEQ ID NO: 781777 - protein, 17 aa, Mycobacterium
WRLGGAINCGKAQPGQI

SEQ ID NO: 781778 - protein, 17 aa, Mycobacterium
WRLKQNYAYDIGMMRRS

SEQ ID NO: 781779 - protein, 19 aa, Mycobacterium
WRLLCEQVGAAALVIPEEL

SEQ ID NO: 781780 - protein, 19 aa, Mycobacterium
WRLRVSKEMKVPAYVVFTD

SEQ ID NO: 781781 - protein, 17 aa, Mycobacterium
WRLSGFTGHCAVSHRRR

SEQ ID NO: 781782 - protein, 17 aa, Mycobacterium
WRLTGLGLRVIAHDPYC

SEQ ID NO: 781783 - protein, 17 aa, Mycobacterium
WRLVLTIGEPGDPTGDA

SEQ ID NO: 781784 - protein, 19 aa, Mycobacterium
WRLWRAGIVDIRGRGQRRQ

SEQ ID NO: 781785 - protein, 19 aa, Mycobacterium
WRLYGKKTWGTLCEAASII

SEQ ID NO: 781786 - protein, 18 aa, Mycobacterium
WRMPELDPKAALARTSTI

SEQ ID NO: 781787 - protein, 17 aa, Mycobacterium
WRNFFLCGAAELRDGKF

SEQ ID NO: 781788 - protein, 18 aa, Mycobacterium
WRNLLKCRARIDDNGSVQ

SEQ ID NO: 781789 - protein, 17 aa, Mycobacterium
WRNNSGWWGHHVGGAEY

SEQ ID NO: 781790 - protein, 18 aa, Mycobacterium
WRNPWPMYRALRDRDPVH

SEQ ID NO: 781791 - protein, 17 aa, Mycobacterium
WRPDVVHAHDWLVAHPA

SEQ ID NO: 781792 - protein, 21 aa, Mycobacterium
WRPGCPFCWRLRRALRRRRLP

SEQ ID NO: 781793 - protein, 18 aa, Mycobacterium
WRPGCPVEPGQLRRVYVG

SEQ ID NO: 781794 - protein, 20 aa, Mycobacterium
WRPGESGGLLWGMSNPEELP

SEQ ID NO: 781795 - protein, 19 aa, Mycobacterium
WRPGESVPVLPAMQKLSIA

SEQ ID NO: 781796 - protein, 17 aa, Mycobacterium
WRPGLPTPRDEFHIALA

SEQ ID NO: 781797 - protein, 17 aa, Mycobacterium
WRPIDFWPADTTVSIDA

SEQ ID NO: 781798 - protein, 19 aa, Mycobacterium
WRPMFTRGFSYGGKSTLKA

SEQ ID NO: 781799 - protein, 19 aa, Mycobacterium
WRPQFRVDLIPSYKAHRVA

SEQ ID NO: 781800 - protein, 18 aa, Mycobacterium
WRPVLEPVLAELAAGELV

SEQ ID NO: 781801 - protein, 17 aa, Mycobacterium
WRQAGCSMCLGMNPDQL

SEQ ID NO: 781802 - protein, 18 aa, Mycobacterium
WRQPELKAAGAAMATTAL

SEQ ID NO: 781803 - protein, 25 aa, Mycobacterium
WRQWWDWAPGASWRHPFGPDSDIAD

SEQ ID NO: 781804 - protein, 18 aa, Mycobacterium
WRRKYRLLQRLGKSSPDA

SEQ ID NO: 781805 - protein, 17 aa, Mycobacterium
WRRLGCWVSGHGEGWAL

SEQ ID NO: 781806 - protein, 17 aa, Mycobacterium
WRRLKLLFDDLARESDL

SEQ ID NO: 781807 - protein, 18 aa, Mycobacterium
WRRLPFDASWYSSNELAR

SEQ ID NO: 781808 - protein, 20 aa, Mycobacterium
WRRLRIPVIALIHGRCYGGG

SEQ ID NO: 781809 - protein, 18 aa, Mycobacterium
WRRMGLDLDMAELIYHGD

SEQ ID NO: 781810 - protein, 17 aa, Mycobacterium
WRRMIAINMMSPLVGSR

SEQ ID NO: 781811 - protein, 18 aa, Mycobacterium
WRRPRWAKRLQPGPIGDL

SEQ ID NO: 781812 - protein, 19 aa, Mycobacterium
WRRPRWAKRLQPGPVADLL

SEQ ID NO: 781813 - protein, 18 aa, Mycobacterium
WRRPRWGARLGVEPVTAL

SEQ ID NO: 781814 - protein, 20 aa, Mycobacterium
WRRRVGIIGTFAFIRRGDAV

SEQ ID NO: 781815 - protein, 19 aa, Mycobacterium
WRSAGDFRRLFPHIELDPN

SEQ ID NO: 781816 - protein, 20 aa, Mycobacterium
WRSVKRVPLAQALKSVRRYD

SEQ ID NO: 781817 - protein, 17 aa, Mycobacterium
WRTAELLEAMWTCDDFY

SEQ ID NO: 781818 - protein, 17 aa, Mycobacterium
WRTEFFPKFPGTPGTEW

SEQ ID NO: 781819 - protein, 19 aa, Mycobacterium
WRTTFAVNVFGPVELTLAL

SEQ ID NO: 781820 - protein, 17 aa, Mycobacterium
WRTVQEIAKKYPDVEVA

SEQ ID NO: 781821 - protein, 19 aa, Mycobacterium
WRVGFCGFAPGFAYLVDGD

SEQ ID NO: 781822 - protein, 17 aa, Mycobacterium
WRWAAIIATAWQTIRTA

SEQ ID NO: 781823 - protein, 19 aa, Mycobacterium
WRWADELRRLHPKIAVDEN

SEQ ID NO: 781824 - protein, 21 aa, Mycobacterium
WRWDSDWFWCSRAFGVQDPRL

SEQ ID NO: 781825 - protein, 21 aa, Mycobacterium
WRWDTDWFWCSRAFGAQNPRL

SEQ ID NO: 781826 - protein, 21 aa, Mycobacterium
WRWDTDWFWCSRAFGAQNPTL

SEQ ID NO: 781827 - protein, 21 aa, Mycobacterium
WRWDTDWFWCSRAFGVQDPRV

SEQ ID NO: 781828 - protein, 19 aa, Mycobacterium
WRWLPPWPDSVDGIAVMKR

SEQ ID NO: 781829 - protein, 17 aa, Mycobacterium
WRWRLIDMYDRDLTHKW

SEQ ID NO: 781830 - protein, 19 aa, Mycobacterium
WRWSPAHLVVTCGARGARY

SEQ ID NO: 781831 - protein, 21 aa, Mycobacterium
WRWVPGACWRHPFGPHSDLTD

SEQ ID NO: 781832 - protein, 18 aa, Mycobacterium
WRYLLDMDLVRKIKYHGA

SEQ ID NO: 781833 - protein, 20 aa, Mycobacterium
WRYLLVPCAIEFWDEDGGAA

SEQ ID NO: 781834 - protein, 17 aa, Mycobacterium
WSAAFGRYDRTVGQVLL

SEQ ID NO: 781835 - protein, 24 aa, Mycobacterium
WSADRAADFLARWRRAAESTLAPP

SEQ ID NO: 781836 - protein, 18 aa, Mycobacterium
WSAEGWVAVAGRVVSDGV

SEQ ID NO: 781837 - protein, 19 aa, Mycobacterium
WSAGDSFVVPNWMWHAHMN

SEQ ID NO: 781838 - protein, 18 aa, Mycobacterium
WSAGRFSFNVAEGRCATC

SEQ ID NO: 781839 - protein, 17 aa, Mycobacterium
WSALPGVDAIRVYRVPA

SEQ ID NO: 781840 - protein, 21 aa, Mycobacterium
WSATLRRLACDHGHGMVVVHP

SEQ ID NO: 781841 - protein, 19 aa, Mycobacterium
WSDRFAGQFDDGWDALREQ

SEQ ID NO: 781842 - protein, 23 aa, Mycobacterium
WSEWKDPRLIIAILHNNDLNQVT

SEQ ID NO: 781843 - protein, 17 aa, Mycobacterium
WSFGFDVGMTFLEIHGP

SEQ ID NO: 781844 - protein, 18 aa, Mycobacterium
WSGEFCFRPGEPRVSLID

SEQ ID NO: 781845 - protein, 17 aa, Mycobacterium
WSGFRPDRIKALAGAVT

SEQ ID NO: 781846 - protein, 18 aa, Mycobacterium
WSGLPIIANYADWQEERA

SEQ ID NO: 781847 - protein, 17 aa, Mycobacterium
WSGLPYLRFLMANTGRG

SEQ ID NO: 781848 - protein, 18 aa, Mycobacterium
WSGPDWPEMVTAFLDTVD

SEQ ID NO: 781849 - protein, 25 aa, Mycobacterium
WSHSLKSLRPGGCIVIAGATTGMNP

SEQ ID NO: 781850 - protein, 19 aa, Mycobacterium
WSKASGLDLVRLGTTATAE

SEQ ID NO: 781851 - protein, 17 aa, Mycobacterium
WSLDLPVGGAGGAGGWA

SEQ ID NO: 781852 - protein, 17 aa, Mycobacterium
WSLLDLGGGHGWYSAQL

SEQ ID NO: 781853 - protein, 20 aa, Mycobacterium
WSLRVGFNYREGMTLHTVTY

SEQ ID NO: 781854 - protein, 20 aa, Mycobacterium
WSPESGSLLDEWSHKVVWAA

SEQ ID NO: 781855 - protein, 23 aa, Mycobacterium
WSPEYREYFGLCLEFPTLCARAF

SEQ ID NO: 781856 - protein, 17 aa, Mycobacterium
WSPKLMLRPATWVADTV

SEQ ID NO: 781857 - protein, 19 aa, Mycobacterium
WSPKVFGSWNLHRAMSGQP

SEQ ID NO: 781858 - protein, 19 aa, Mycobacterium
WSRDVWKQLAEVGVLGLGF

SEQ ID NO: 781859 - protein, 17 aa, Mycobacterium
WSRFARRSFLSEGRRSV

SEQ ID NO: 781860 - protein, 28 aa, Mycobacterium
WSRTDHYAWIAGLLLDLGIDSIDEVEAA

SEQ ID NO: 781861 - protein, 17 aa, Mycobacterium
WSSAIPLGRPGAADEVS

SEQ ID NO: 781862 - protein, 19 aa, Mycobacterium
WSTQQMRTWANRPWNNEGK

SEQ ID NO: 781863 - protein, 17 aa, Mycobacterium
WSVGMSYLVVGPELLAS

SEQ ID NO: 781864 - protein, 17 aa, Mycobacterium
WSVLPCTVWPTRAAAPP

SEQ ID NO: 781865 - protein, 18 aa, Mycobacterium
WSVPESWVGLKPVQRPRL

SEQ ID NO: 781866 - protein, 17 aa, Mycobacterium
WSWRHQLRGLAGARVVA

SEQ ID NO: 781867 - protein, 21 aa, Mycobacterium
WTAACDGGFIARDLGVPVVVL

SEQ ID NO: 781868 - protein, 17 aa, Mycobacterium
WTALKTLYPVGIDHAPL

SEQ ID NO: 781869 - protein, 20 aa, Mycobacterium
WTARLAAAGRPMFPVRVSVQ

SEQ ID NO: 781870 - protein, 25 aa, Mycobacterium
WTASGGSITARWAVLYELGGNVLCY

SEQ ID NO: 781871 - protein, 17 aa, Mycobacterium
WTATAKTHWVRVLPTQI

SEQ ID NO: 781872 - protein, 21 aa, Mycobacterium
WTEEVFKAFNFQPELTFDEAQ

SEQ ID NO: 781873 - protein, 25 aa, Mycobacterium
WTFLGPRPAHWWVRRRLHEVVVHRA

SEQ ID NO: 781874 - protein, 17 aa, Mycobacterium
WTFWSWNPNSRDTGGIL

SEQ ID NO: 781875 - protein, 19 aa, Mycobacterium
WTGLVSLILLMPGRLEAPL

SEQ ID NO: 781876 - protein, 23 aa, Mycobacterium
WTKKETPSVCDWMIFGKGHCIVI

SEQ ID NO: 781877 - protein, 18 aa, Mycobacterium
WTKLCGVCPIPASTGKTV

SEQ ID NO: 781878 - protein, 19 aa, Mycobacterium
WTLLRRRNGVLPAIEQALH

SEQ ID NO: 781879 - protein, 19 aa, Mycobacterium
WTLRRGRIVLLDGDSPAGL

SEQ ID NO: 781880 - protein, 19 aa, Mycobacterium
WTLTGVVYAEWLLSPRPNG

SEQ ID NO: 781881 - protein, 22 aa, Mycobacterium
WTMKPDVCWQLPIRRSQDWVER

SEQ ID NO: 781882 - protein, 21 aa, Mycobacterium
WTNATAPAWARPLITVNPVLT

SEQ ID NO: 781883 - protein, 17 aa, Mycobacterium
WTNRPGTEYVWFNNVET

SEQ ID NO: 781884 - protein, 22 aa, Mycobacterium
WTNSYYDDMAWLALALERAARV

SEQ ID NO: 781885 - protein, 18 aa, Mycobacterium
WTPALAIPCPNGLLCWAK

SEQ ID NO: 781886 - protein, 17 aa, Mycobacterium
WTPRVAFVNGHGGNVDA

SEQ ID NO: 781887 - protein, 19 aa, Mycobacterium
WTQWIFLQIFNAWFDTDQN

SEQ ID NO: 781888 - protein, 18 aa, Mycobacterium
WTQWIFLQIYNAWFDAAA

SEQ ID NO: 781889 - protein, 19 aa, Mycobacterium
WTQWIFLQIYNAWFDRDQN

SEQ ID NO: 781890 - protein, 18 aa, Mycobacterium
WTQWIFLQIYNAWFDTAA

SEQ ID NO: 781891 - protein, 19 aa, Mycobacterium
WTQWIFLQIYNAWFDTAAG

SEQ ID NO: 781892 - protein, 19 aa, Mycobacterium
WTQWIFLQIYNAWFDTAAN

SEQ ID NO: 781893 - protein, 18 aa, Mycobacterium
WTQWIFLQIYNAWYDEQA

SEQ ID NO: 781894 - protein, 18 aa, Mycobacterium
WTRRAWMGAGYLVARTLD

SEQ ID NO: 781895 - protein, 20 aa, Mycobacterium
WTRSAAKAWAADNVTVNALA

SEQ ID NO: 781896 - protein, 17 aa, Mycobacterium
WTVLRATRDTDFLVLEM

SEQ ID NO: 781897 - protein, 18 aa, Mycobacterium
WTVQLAWKAGLSDNVAHF

SEQ ID NO: 781898 - protein, 17 aa, Mycobacterium
WTVQLAWKAGRSDNLAH

SEQ ID NO: 781899 - protein, 17 aa, Mycobacterium
WVAAPVFHRRGEVLGAL

SEQ ID NO: 781900 - protein, 17 aa, Mycobacterium
WVCGDNVAIGYWNKPEE

SEQ ID NO: 781901 - protein, 17 aa, Mycobacterium
WVDARLVAAAVSFDVCT

SEQ ID NO: 781902 - protein, 17 aa, Mycobacterium
WVGPVVDQLGFAPMAVC

SEQ ID NO: 781903 - protein, 18 aa, Mycobacterium
WVGVRWRNLTGGIVALHA

SEQ ID NO: 781904 - protein, 17 aa, Mycobacterium
WVHYPWRRTVVGVLGPH

SEQ ID NO: 781905 - protein, 18 aa, Mycobacterium
WVIDIDLWGSIHAVEAFV

SEQ ID NO: 781906 - protein, 19 aa, Mycobacterium
WVIRCARVTSRHSAATSTS

SEQ ID NO: 781907 - protein, 23 aa, Mycobacterium
WVKCKRATFKYGLGSEFIDVLKT

SEQ ID NO: 781908 - protein, 19 aa, Mycobacterium
WVKLPAPVKFAFADESIPI

SEQ ID NO: 781909 - protein, 23 aa, Mycobacterium
WVLRGHAFLGYWRTDSALSTVST

SEQ ID NO: 781910 - protein, 23 aa, Mycobacterium
WVNTIFLSTRFKAWRVGGYNEYL

SEQ ID NO: 781911 - protein, 17 aa, Mycobacterium
WVPEFLSLPIAIENSLK

SEQ ID NO: 781912 - protein, 20 aa, Mycobacterium
WVPWRRPGFQLGLDIADIKR

SEQ ID NO: 781913 - protein, 23 aa, Mycobacterium
WVQLRPALLELKSHGGIIQGELS

SEQ ID NO: 781914 - protein, 17 aa, Mycobacterium
WVQQWWSGVFETADGYV

SEQ ID NO: 781915 - protein, 24 aa, Mycobacterium
WVRDALRLGGKFPLKAGMLTSLGF

SEQ ID NO: 781916 - protein, 25 aa, Mycobacterium
WVRETLRLGGKFPLKAGLVTSLGFG

SEQ ID NO: 781917 - protein, 17 aa, Mycobacterium
WVRFGWFFLVTRRDPRG

SEQ ID NO: 781918 - protein, 24 aa, Mycobacterium
WVSPEFLRFGYRTSVLKHSSQWVV

SEQ ID NO: 781919 - protein, 17 aa, Mycobacterium
WVVDIDLWGNIHAVEAF

SEQ ID NO: 781920 - protein, 24 aa, Mycobacterium
WVVWAGSLPAGFAPARLAAAVDEA

SEQ ID NO: 781921 - protein, 22 aa, Mycobacterium
WVYIPKACTWRQIPDSETTLLM

SEQ ID NO: 781922 - protein, 18 aa, Mycobacterium
WWDIAIRMLIKYKNLRLM

SEQ ID NO: 781923 - protein, 17 aa, Mycobacterium
WWDRAVRAWPDYAEYQK

SEQ ID NO: 781924 - protein, 18 aa, Mycobacterium
WWFGHTLTWARHALRDIG

SEQ ID NO: 781925 - protein, 20 aa, Mycobacterium
WWILTCLMRGGLCITGGENT

SEQ ID NO: 781926 - protein, 19 aa, Mycobacterium
WWLKQAFYFSLTAVNDAVK

SEQ ID NO: 781927 - protein, 19 aa, Mycobacterium
WWLQRRLLLAGIRATSPAV

SEQ ID NO: 781928 - protein, 21 aa, Mycobacterium
WWLQRRLMLCGIRAISPAVDA

SEQ ID NO: 781929 - protein, 20 aa, Mycobacterium
WWPRRYRRSSAYWKLVELDQ

SEQ ID NO: 781930 - protein, 17 aa, Mycobacterium
WWPSILAPIVAGVGAWR

SEQ ID NO: 781931 - protein, 20 aa, Mycobacterium
WWQRAVEAFPPYAEYQTKTA

SEQ ID NO: 781932 - protein, 17 aa, Mycobacterium
WWSTAVFYQVYPRSFAD

SEQ ID NO: 781933 - protein, 18 aa, Mycobacterium
WWVQAFCVPAFAVDRPFA

SEQ ID NO: 781934 - protein, 19 aa, Mycobacterium
WYAGGTWRPADEDWFDDAD

SEQ ID NO: 781935 - protein, 18 aa, Mycobacterium
WYCPVCLEVTNSALCGHD

SEQ ID NO: 781936 - protein, 19 aa, Mycobacterium
WYDIRRLGPTDVESFSRQY

SEQ ID NO: 781937 - protein, 28 aa, Mycobacterium
WYIAMACFKLAIVIEGTWSRYLAGRASA

SEQ ID NO: 781938 - protein, 25 aa, Mycobacterium
WYIRIWDFLKSIPIPVWDQLLNLEY

SEQ ID NO: 781939 - protein, 20 aa, Mycobacterium
WYQWHWRVHVGLWAAASASK

SEQ ID NO: 781940 - protein, 26 aa, Mycobacterium
WYRMRMAPSIFRHVWSVLRIACEGFN

SEQ ID NO: 781941 - protein, 19 aa, Mycobacterium
WYSAQLCRRYPTLAATVLD

SEQ ID NO: 781942 - protein, 17 aa, Mycobacterium
WYYNSLKAQLERQLDAA

SEQ ID NO: 781943 - protein, 17 aa, Mycobacterium
YAACFHSALRMIGRQEK

SEQ ID NO: 781944 - protein, 17 aa, Mycobacterium
YAADFGFTSYDPAWIDT

SEQ ID NO: 781945 - protein, 20 aa, Mycobacterium
YAAEVWRLVSPIAQRLGFAI

SEQ ID NO: 781946 - protein, 18 aa, Mycobacterium
YAAGFSRELEDEWQLPEA

SEQ ID NO: 781947 - protein, 23 aa, Mycobacterium
YAAICVAATLAIRGCDHASLMVR

SEQ ID NO: 781948 - protein, 25 aa, Mycobacterium
YAAIEGFTRWRALRYARRIGRDFDL

SEQ ID NO: 781949 - protein, 17 aa, Mycobacterium
YAAVYGYDERAMAKIVV

SEQ ID NO: 781950 - protein, 21 aa, Mycobacterium
YADAHLPYLAWLVETSVDGAR

SEQ ID NO: 781951 - protein, 17 aa, Mycobacterium
YADALSMADNVMTFRNV

SEQ ID NO: 781952 - protein, 17 aa, Mycobacterium
YADMPLFLFHLLEYMDV

SEQ ID NO: 781953 - protein, 26 aa, Mycobacterium
YADVPTRFGLFPSIDPVTFAGDMVGA

SEQ ID NO: 781954 - protein, 18 aa, Mycobacterium
YAFARRRFWLLSESVGGR

SEQ ID NO: 781955 - protein, 19 aa, Mycobacterium
YAFERRRFWLAGDGTTVDA

SEQ ID NO: 781956 - protein, 17 aa, Mycobacterium
YAGEIAHIIGCEPHDVL

SEQ ID NO: 781957 - protein, 17 aa, Mycobacterium
YAGELLYLYNAVRPRNV

SEQ ID NO: 781958 - protein, 20 aa, Mycobacterium
YAGKVVGDWRPLAVGANGSA

SEQ ID NO: 781959 - protein, 17 aa, Mycobacterium
YAGKWVIFFSHPADFTP

SEQ ID NO: 781960 - protein, 18 aa, Mycobacterium
YAGSLGTQVVKIFDLVAA

SEQ ID NO: 781961 - protein, 19 aa, Mycobacterium
YAGVLLLGLCDWMNRKGFH

SEQ ID NO: 781962 - protein, 18 aa, Mycobacterium
YAGVPCWSGGPSYWAHTT

SEQ ID NO: 781963 - protein, 31 aa, Mycobacterium
YAIEGLPAWMGRLTNRWTLRPAGVGTEVTVT

SEQ ID NO: 781964 - protein, 23 aa, Mycobacterium
YAIEHWTRLPVEVELASEFRYRD

SEQ ID NO: 781965 - protein, 17 aa, Mycobacterium
YAKSLRMFAVLPTIVAS

SEQ ID NO: 781966 - protein, 18 aa, Mycobacterium
YALSNSFGLGGNNVVLAF

SEQ ID NO: 781967 - protein, 18 aa, Mycobacterium
YAMTGWRLGWLLVPTELR

SEQ ID NO: 781968 - protein, 21 aa, Mycobacterium
YANKAVPCWMVFDEGYIGRYV

SEQ ID NO: 781969 - protein, 22 aa, Mycobacterium
YANRFGYNVVRDFTGHGIGTTF

SEQ ID NO: 781970 - protein, 23 aa, Mycobacterium
YANRFGYNVVRDFTGHGIGTTFH

SEQ ID NO: 781971 - protein, 19 aa, Mycobacterium
YAPGGVRSFGPLRASLGLD

SEQ ID NO: 781972 - protein, 18 aa, Mycobacterium
YAPSFGRGPFRNVICLSV

SEQ ID NO: 781973 - protein, 25 aa, Mycobacterium
YAPSPPARCTLHWGADRPARLRVPV

SEQ ID NO: 781974 - protein, 21 aa, Mycobacterium
YAQGWCPFRAPAMLAQTARTA

SEQ ID NO: 781975 - protein, 17 aa, Mycobacterium
YAQIWKEHILPLNGAYQ

SEQ ID NO: 781976 - protein, 18 aa, Mycobacterium
YAQIWKEHVLPLSGAYQM

SEQ ID NO: 781977 - protein, 18 aa, Mycobacterium
YARARLAGQLGFPLDGLA

SEQ ID NO: 781978 - protein, 18 aa, Mycobacterium
YARSRPAFGSAIIDYQSV

SEQ ID NO: 781979 - protein, 26 aa, Mycobacterium
YASEIGVPLCSSWGMTETSPLVCSAR

SEQ ID NO: 781980 - protein, 17 aa, Mycobacterium
YASGWLAVRAMPEFAAR

SEQ ID NO: 781981 - protein, 17 aa, Mycobacterium
YASLGLRLDYDPQLREV

SEQ ID NO: 781982 - protein, 17 aa, Mycobacterium
YASVYGYDERAMAKIVV

SEQ ID NO: 781983 - protein, 24 aa, Mycobacterium
YATDEMRAWWGGMWAERILRSDLS

SEQ ID NO: 781984 - protein, 22 aa, Mycobacterium
YATPRLAAIPGVTLVGTADHKA

SEQ ID NO: 781985 - protein, 18 aa, Mycobacterium
YAVPRLLARNGLSLQDFD

SEQ ID NO: 781986 - protein, 22 aa, Mycobacterium
YAVPRLLARNGLSLQDFDFYEI

SEQ ID NO: 781987 - protein, 17 aa, Mycobacterium
YAVPRLLTRNGLTLQDF

SEQ ID NO: 781988 - protein, 17 aa, Mycobacterium
YAYEYGYDERAMAKIVV

SEQ ID NO: 781989 - protein, 20 aa, Mycobacterium
YCGQCPYCLAGRLGQCAAML

SEQ ID NO: 781990 - protein, 17 aa, Mycobacterium
YCPVKWQPVVPGVEVPL

SEQ ID NO: 781991 - protein, 17 aa, Mycobacterium
YCRQALLETPIRSVVAF

SEQ ID NO: 781992 - protein, 20 aa, Mycobacterium
YCRQRVLLLQAWVRQVSSIV

SEQ ID NO: 781993 - protein, 18 aa, Mycobacterium
YCTIHGYRRAYRIAGSGP

SEQ ID NO: 781994 - protein, 21 aa, Mycobacterium
YDAAAGWARRFLDGPRHALAA

SEQ ID NO: 781995 - protein, 18 aa, Mycobacterium
YDAGNPFAPGFTADPNGP

SEQ ID NO: 781996 - protein, 19 aa, Mycobacterium
YDAKFGMRVWHRDFFDAEI

SEQ ID NO: 781997 - protein, 17 aa, Mycobacterium
YDCPRAVLDEALKVTPG

SEQ ID NO: 781998 - protein, 30 aa, Mycobacterium
YDCRSTRELRDWLLIRAWEAGVTPIGVQPV

SEQ ID NO: 781999 - protein, 30 aa, Mycobacterium
YDCRSTRELRDWLLMRAWEAGVTPIGVQPV

SEQ ID NO: 782000 - protein, 22 aa, Mycobacterium
YDCRSTRRLRDWLMNRAIECGV

SEQ ID NO: 782001 - protein, 18 aa, Mycobacterium
YDDLRAGLRMNIIANPGV

SEQ ID NO: 782002 - protein, 18 aa, Mycobacterium
YDDLRAGLRMNLIANPGV

SEQ ID NO: 782003 - protein, 18 aa, Mycobacterium
YDELIARTQWWGRQMLIW

SEQ ID NO: 782004 - protein, 17 aa, Mycobacterium
YDFGIRWGAALAGRFRR

SEQ ID NO: 782005 - protein, 20 aa, Mycobacterium
YDFKEFRVDPAWVPPEEEAL

SEQ ID NO: 782006 - protein, 17 aa, Mycobacterium
YDGFSFLTVMWLEAMGF

SEQ ID NO: 782007 - protein, 24 aa, Mycobacterium
YDGVMGRLWLSRGGTYVLANIRGG

SEQ ID NO: 782008 - protein, 18 aa, Mycobacterium
YDICRPFSLAVNGSSISE

SEQ ID NO: 782009 - protein, 19 aa, Mycobacterium
YDIEIFPTAALIAAGHRLR

SEQ ID NO: 782010 - protein, 17 aa, Mycobacterium
YDIKKWINWAIQFFYSS

SEQ ID NO: 782011 - protein, 20 aa, Mycobacterium
YDILFFWVARMMMFGTFVAD

SEQ ID NO: 782012 - protein, 21 aa, Mycobacterium
YDILFFWVARMMMFGTFVGAD

SEQ ID NO: 782013 - protein, 20 aa, Mycobacterium
YDILFFWVARMMMFGTFVGG

SEQ ID NO: 782014 - protein, 20 aa, Mycobacterium
YDKLRGGSGIQWPCNADYPD

SEQ ID NO: 782015 - protein, 24 aa, Mycobacterium
YDLFFPPALCAEAARFIPAAEFVA

SEQ ID NO: 782016 - protein, 18 aa, Mycobacterium
YDLLEGWDTLVLVDAVPS

SEQ ID NO: 782017 - protein, 18 aa, Mycobacterium
YDLSLWILKVRALTSAWG

SEQ ID NO: 782018 - protein, 17 aa, Mycobacterium
YDLSSLFLLASTAALFS

SEQ ID NO: 782019 - protein, 23 aa, Mycobacterium
YDMSMARFLYWGCDIWLNNPLRP

SEQ ID NO: 782020 - protein, 31 aa, Mycobacterium
YDNGILWRSDYRAQGGFSYAIGLVPITTSLN

SEQ ID NO: 782021 - protein, 17 aa, Mycobacterium
YDPLVPWTAANQLGRDW

SEQ ID NO: 782022 - protein, 17 aa, Mycobacterium
YDPPRKWWQAGPGEGSI

SEQ ID NO: 782023 - protein, 18 aa, Mycobacterium
YDQPRWWSPRGWAHRQEA

SEQ ID NO: 782024 - protein, 17 aa, Mycobacterium
YDRIEVVVHPQSIVHSM

SEQ ID NO: 782025 - protein, 17 aa, Mycobacterium
YDRIEVVVHPQSVVHSM

SEQ ID NO: 782026 - protein, 22 aa, Mycobacterium
YDRTLEGFTMFALNQGETCTCP

SEQ ID NO: 782027 - protein, 17 aa, Mycobacterium
YDSRLIGGGDGSGGGTY

SEQ ID NO: 782028 - protein, 18 aa, Mycobacterium
YDVETCWQDYRLGVFQAP

SEQ ID NO: 782029 - protein, 21 aa, Mycobacterium
YDWPVRTGIIVGRLDSDGSRF

SEQ ID NO: 782030 - protein, 19 aa, Mycobacterium
YEALARWPAYDSLSPLDVF

SEQ ID NO: 782031 - protein, 22 aa, Mycobacterium
YEAPARPELRLEGGEKPAETLA

SEQ ID NO: 782032 - protein, 22 aa, Mycobacterium
YEAPARPELRLEGGTKDADTLA

SEQ ID NO: 782033 - protein, 17 aa, Mycobacterium
YEARAVLDFARRMRRED

SEQ ID NO: 782034 - protein, 19 aa, Mycobacterium
YEARVQISLHWNRGHIRTH

SEQ ID NO: 782035 - protein, 17 aa, Mycobacterium
YEAWPKIVITDVDSTGL

SEQ ID NO: 782036 - protein, 25 aa, Mycobacterium
YEDLAWFCIRAWRFGAPASLGAGGL

SEQ ID NO: 782037 - protein, 25 aa, Mycobacterium
YEDLAWFCVRAWRFGAPASYGAGGL

SEQ ID NO: 782038 - protein, 24 aa, Mycobacterium
YEDVTGRLRVRWVPQRVLQGVSYD

SEQ ID NO: 782039 - protein, 21 aa, Mycobacterium
YEFFCNAGLLLDKRLEELGAS

SEQ ID NO: 782040 - protein, 18 aa, Mycobacterium
YEGHPHFAIPHVVASAPK

SEQ ID NO: 782041 - protein, 24 aa, Mycobacterium
YEGKWRIIFFWPKDFTFVCPTEIA

SEQ ID NO: 782042 - protein, 17 aa, Mycobacterium
YEGMPGGVGGTGGAGGE

SEQ ID NO: 782043 - protein, 21 aa, Mycobacterium
YEGRIDWAFAELLALGSLIAE

SEQ ID NO: 782044 - protein, 17 aa, Mycobacterium
YEIFRLNAVPGTEKLPY

SEQ ID NO: 782045 - protein, 21 aa, Mycobacterium
YEIKDPRLAGVTITDAKVSGD

SEQ ID NO: 782046 - protein, 21 aa, Mycobacterium
YEIKDPRLAGVTITDAKVTND

SEQ ID NO: 782047 - protein, 18 aa, Mycobacterium
YEILRFCAFFAATGDTDG

SEQ ID NO: 782048 - protein, 19 aa, Mycobacterium
YEKLEGVALTFPGKVNRLA

SEQ ID NO: 782049 - protein, 18 aa, Mycobacterium
YEKRFGYVYLVFANGRPA

SEQ ID NO: 782050 - protein, 22 aa, Mycobacterium
YEKTMRLAMEMVDYEGLRAEQA

SEQ ID NO: 782051 - protein, 24 aa, Mycobacterium
YELARDALREWLRRGGKPARLIDI

SEQ ID NO: 782052 - protein, 18 aa, Mycobacterium
YELARPGDEISIADVLRC

SEQ ID NO: 782053 - protein, 17 aa, Mycobacterium
YELARPGTDISIADVLR

SEQ ID NO: 782054 - protein, 18 aa, Mycobacterium
YELDCLIFATGFEVGTDY

SEQ ID NO: 782055 - protein, 18 aa, Mycobacterium
YELFARKVIPHFTGQLTA

SEQ ID NO: 782056 - protein, 17 aa, Mycobacterium
YELLMLLSFSRAGSMPM

SEQ ID NO: 782057 - protein, 17 aa, Mycobacterium
YELMGVPFAKRGKRIDE

SEQ ID NO: 782058 - protein, 21 aa, Mycobacterium
YELVEGFPRFDVDDVYLGNGC

SEQ ID NO: 782059 - protein, 21 aa, Mycobacterium
YELVEGFPRFDVDDVYLGNGV

SEQ ID NO: 782060 - protein, 17 aa, Mycobacterium
YEMFPRSTGGWDDDGKP

SEQ ID NO: 782061 - protein, 17 aa, Mycobacterium
YEMFPRSTGGWDDEGKP

SEQ ID NO: 782062 - protein, 19 aa, Mycobacterium
YEMMRIPTILARAQVAEAE

SEQ ID NO: 782063 - protein, 18 aa, Mycobacterium
YENACRWYSFDPFEHRTR

SEQ ID NO: 782064 - protein, 18 aa, Mycobacterium
YEPLWALCAELDLTVVQH

SEQ ID NO: 782065 - protein, 21 aa, Mycobacterium
YEPRPAAVDVYRFWQERNGGR

SEQ ID NO: 782066 - protein, 17 aa, Mycobacterium
YEPVLGMEVHVELSTAT

SEQ ID NO: 782067 - protein, 17 aa, Mycobacterium
YERIEVVVHPQSIVHSM

SEQ ID NO: 782068 - protein, 18 aa, Mycobacterium
YERKEIRDIVAYLRVLDN

SEQ ID NO: 782069 - protein, 18 aa, Mycobacterium
YERKEIRDIVAYLRVLTN

SEQ ID NO: 782070 - protein, 18 aa, Mycobacterium
YERLFEPAISYGRNGFLV

SEQ ID NO: 782071 - protein, 17 aa, Mycobacterium
YERRGRWNVPRKLTTFA

SEQ ID NO: 782072 - protein, 26 aa, Mycobacterium
YERSSCFWQRIAYLYSRFDDLIAEAS

SEQ ID NO: 782073 - protein, 26 aa, Mycobacterium
YERSTCFWQRIAYLYSRFDALIAEAD

SEQ ID NO: 782074 - protein, 28 aa, Mycobacterium
YERSTCFWQRIAYLYSRFDALIEAVKRQ

SEQ ID NO: 782075 - protein, 26 aa, Mycobacterium
YERSTCFWQRIAYLYSRFDELIVQAT

SEQ ID NO: 782076 - protein, 26 aa, Mycobacterium
YERSTCFWQRIAYLYSRFDSLVDEVK

SEQ ID NO: 782077 - protein, 24 aa, Mycobacterium
YERSTCFWQRIAYLYSRLDELITD

SEQ ID NO: 782078 - protein, 22 aa, Mycobacterium
YESEWGWTWPMNRRVLYNRASA

SEQ ID NO: 782079 - protein, 23 aa, Mycobacterium
YETARLFLDPGFEQSVRETFGDD

SEQ ID NO: 782080 - protein, 22 aa, Mycobacterium
YEVDEVWPGQTYLGLAIQHVRY

SEQ ID NO: 782081 - protein, 23 aa, Mycobacterium
YEVGDRASHHFAWIQRGDESRSI

SEQ ID NO: 782082 - protein, 20 aa, Mycobacterium
YEVIARTAVRAMADVLVEFL

SEQ ID NO: 782083 - protein, 25 aa, Mycobacterium
YEVLRVCMYGDLLFDITGSDPPVDG

SEQ ID NO: 782084 - protein, 17 aa, Mycobacterium
YEYGRPWTVDEFDLDPP

SEQ ID NO: 782085 - protein, 20 aa, Mycobacterium
YEYIPTYILRGLTELHLEFD

SEQ ID NO: 782086 - protein, 19 aa, Mycobacterium
YFAMTGWRLGWLLVPDELK

SEQ ID NO: 782087 - protein, 19 aa, Mycobacterium
YFAMTGWRLGWLLVPEKLR

SEQ ID NO: 782088 - protein, 18 aa, Mycobacterium
YFAQLAFAVFHVVALPIT

SEQ ID NO: 782089 - protein, 18 aa, Mycobacterium
YFAQLAFAVLHVLALPIT

SEQ ID NO: 782090 - protein, 17 aa, Mycobacterium
YFDYLGFDIFYRVEGSG

SEQ ID NO: 782091 - protein, 19 aa, Mycobacterium
YFEAIPGVWARRSSEVAQS

SEQ ID NO: 782092 - protein, 17 aa, Mycobacterium
YFEGWAAVGCEPSRMGI

SEQ ID NO: 782093 - protein, 19 aa, Mycobacterium
YFFESALSPNTFWVELKNL

SEQ ID NO: 782094 - protein, 18 aa, Mycobacterium
YFGGKGCGFVALQQLAIE

SEQ ID NO: 782095 - protein, 18 aa, Mycobacterium
YFHMEMMLAGIPIPVPPG

SEQ ID NO: 782096 - protein, 18 aa, Mycobacterium
YFIGPLVHRFHSAHPGIT

SEQ ID NO: 782097 - protein, 25 aa, Mycobacterium
YFLKRLRNYGSLFLGRWSTVAYSDK

SEQ ID NO: 782098 - protein, 17 aa, Mycobacterium
YFMAAGTPLYAMSSILG

SEQ ID NO: 782099 - protein, 22 aa, Mycobacterium
YFPDPFVGQGWRSGAFESQTSP

SEQ ID NO: 782100 - protein, 18 aa, Mycobacterium
YFRTRKALLHAIATRLAE

SEQ ID NO: 782101 - protein, 19 aa, Mycobacterium
YFTGTGLKGWFQRWFFTAV

SEQ ID NO: 782102 - protein, 24 aa, Mycobacterium
YGAECATLCWPRQADPAANLERLG

SEQ ID NO: 782103 - protein, 17 aa, Mycobacterium
YGAMFGVEIQFWVFEET

SEQ ID NO: 782104 - protein, 19 aa, Mycobacterium
YGDDRIAVRFAYEYHDAAG

SEQ ID NO: 782105 - protein, 18 aa, Mycobacterium
YGDPHFGYSTGYADVPTR

SEQ ID NO: 782106 - protein, 19 aa, Mycobacterium
YGEFPRFHALMAEQSGVVY

SEQ ID NO: 782107 - protein, 18 aa, Mycobacterium
YGEFRYAINNSFGFGGHN

SEQ ID NO: 782108 - protein, 17 aa, Mycobacterium
YGFAPMCAFVDHGEHGT

SEQ ID NO: 782109 - protein, 22 aa, Mycobacterium
YGGDGGLLFGRGGAGGAGGFGN

SEQ ID NO: 782110 - protein, 21 aa, Mycobacterium
YGGGQLLEWLERCIFPAEARL

SEQ ID NO: 782111 - protein, 20 aa, Mycobacterium
YGGLFIRMSWHAAGTYRIQD

SEQ ID NO: 782112 - protein, 21 aa, Mycobacterium
YGGSCALRLALDTPHRVGKLV

SEQ ID NO: 782113 - protein, 28 aa, Mycobacterium
YGGSRVGLPLVRRALELLPDVGFVNAYG

SEQ ID NO: 782114 - protein, 23 aa, Mycobacterium
YGHYGGLFIRMSWHSAGTYRIHD

SEQ ID NO: 782115 - protein, 23 aa, Mycobacterium
YGISWILPRIVGWGAAQDLLLSG

SEQ ID NO: 782116 - protein, 18 aa, Mycobacterium
YGKDGSVMACVFNFAGAE

SEQ ID NO: 782117 - protein, 18 aa, Mycobacterium
YGKGFLLALHLGRQKDAG

SEQ ID NO: 782118 - protein, 17 aa, Mycobacterium
YGKRAYHALTFGWLLAG

SEQ ID NO: 782119 - protein, 18 aa, Mycobacterium
YGKTASQVLLRWNLQLGN

SEQ ID NO: 782120 - protein, 24 aa, Mycobacterium
YGLAGLRVGYAIGHPDVIVALDKV

SEQ ID NO: 782121 - protein, 24 aa, Mycobacterium
YGLAGLRVGYAVAHPDLITALDKV

SEQ ID NO: 782122 - protein, 17 aa, Mycobacterium
YGLELGKPGARVDRFSE

SEQ ID NO: 782123 - protein, 20 aa, Mycobacterium
YGLRLSWDFLARSTAGLRDW

SEQ ID NO: 782124 - protein, 19 aa, Mycobacterium
YGNFVGRVGALAAALGIGI

SEQ ID NO: 782125 - protein, 21 aa, Mycobacterium
YGNRGWLAWPRGFFGDPPPLP

SEQ ID NO: 782126 - protein, 19 aa, Mycobacterium
YGNVLRFLPPLSMPDHLLD

SEQ ID NO: 782127 - protein, 18 aa, Mycobacterium
YGPDCPVVVVYRASQPQE

SEQ ID NO: 782128 - protein, 24 aa, Mycobacterium
YGPDELRFGYRTSILKGTSARVVL

SEQ ID NO: 782129 - protein, 17 aa, Mycobacterium
YGPPRRWQKSKDPDQGS

SEQ ID NO: 782130 - protein, 20 aa, Mycobacterium
YGPVRFPGVPTWFSKTPGRV

SEQ ID NO: 782131 - protein, 18 aa, Mycobacterium
YGQRCWLRQLTPHPTREQ

SEQ ID NO: 782132 - protein, 25 aa, Mycobacterium
YGRAFPFSLVFAALYAARGYHVVLQ

SEQ ID NO: 782133 - protein, 18 aa, Mycobacterium
YGRAPTFLAMTGYEQVRS

SEQ ID NO: 782134 - protein, 17 aa, Mycobacterium
YGRDRIGLLTGDMSVNA

SEQ ID NO: 782135 - protein, 18 aa, Mycobacterium
YGRDRIGLLTGDMSVNAD

SEQ ID NO: 782136 - protein, 21 aa, Mycobacterium
YGRIFRGCGFFDPDKPIKKFT

SEQ ID NO: 782137 - protein, 23 aa, Mycobacterium
YGRILDILERFYGLVLTDCGPGL

SEQ ID NO: 782138 - protein, 18 aa, Mycobacterium
YGRWLRRPGRFPAHAQKL

SEQ ID NO: 782139 - protein, 21 aa, Mycobacterium
YGSGCVAELFAGTVTPGYQQH

SEQ ID NO: 782140 - protein, 18 aa, Mycobacterium
YGSLEIFTGLDLAIDRGS

SEQ ID NO: 782141 - protein, 21 aa, Mycobacterium
YGSSLVTGWARLHGYPIGILA

SEQ ID NO: 782142 - protein, 29 aa, Mycobacterium
YGTGVSCSVCARCTIAAATAAAAGATDTS

SEQ ID NO: 782143 - protein, 19 aa, Mycobacterium
YGVDDVRAFELLRRLSQES

SEQ ID NO: 782144 - protein, 18 aa, Mycobacterium
YHADFSFASYDPAWIDAL

SEQ ID NO: 782145 - protein, 17 aa, Mycobacterium
YHALKSVLKKEGLSTGL

SEQ ID NO: 782146 - protein, 18 aa, Mycobacterium
YHALRPGGIVVVRQLNST

SEQ ID NO: 782147 - protein, 17 aa, Mycobacterium
YHCGDWSQALAEFRAAR

SEQ ID NO: 782148 - protein, 23 aa, Mycobacterium
YHDRCAWCGSTFAGAVLTGQVLR

SEQ ID NO: 782149 - protein, 23 aa, Mycobacterium
YHEPEILRWLFAGDESLTVSRDG

SEQ ID NO: 782150 - protein, 18 aa, Mycobacterium
YHFDRLRFIASVGEPLNP

SEQ ID NO: 782151 - protein, 18 aa, Mycobacterium
YHFLAVLTLSGHRGLERP

SEQ ID NO: 782152 - protein, 20 aa, Mycobacterium
YHGKALGAFTGWQPHYPVTQ

SEQ ID NO: 782153 - protein, 22 aa, Mycobacterium
YHGKRAGAMGCFGTFSFHGTKT

SEQ ID NO: 782154 - protein, 20 aa, Mycobacterium
YHGLHAFRWVAADGSARFVR

SEQ ID NO: 782155 - protein, 17 aa, Mycobacterium
YHGREFIELIVGGTTYD

SEQ ID NO: 782156 - protein, 18 aa, Mycobacterium
YHKIHLYDAFGFTESRTV

SEQ ID NO: 782157 - protein, 17 aa, Mycobacterium
YHPIVFCRFIPTADYLA

SEQ ID NO: 782158 - protein, 17 aa, Mycobacterium
YHPPAAPPWVWVAASAL

SEQ ID NO: 782159 - protein, 18 aa, Mycobacterium
YHRLRLATLVIVAGTAKA

SEQ ID NO: 782160 - protein, 21 aa, Mycobacterium
YHRLWEPKIPLGRIGRPEELT

SEQ ID NO: 782161 - protein, 24 aa, Mycobacterium
YHRLWEPKIPLGRIGRPEELTGLY

SEQ ID NO: 782162 - protein, 23 aa, Mycobacterium
YHWAAWRLGKPVIDHWWQTETGW

SEQ ID NO: 782163 - protein, 21 aa, Mycobacterium
YIDLVCSWGPMLLGHAHPAVV

SEQ ID NO: 782164 - protein, 18 aa, Mycobacterium
YIEARPAITLSWIRELPS

SEQ ID NO: 782165 - protein, 17 aa, Mycobacterium
YIEFGAHVDRAHWDDAE

SEQ ID NO: 782166 - protein, 19 aa, Mycobacterium
YIFHKDLRRAVIFGRNDLV

SEQ ID NO: 782167 - protein, 24 aa, Mycobacterium
YIGIGVFLDGRWRWRSYSLTSSPV

SEQ ID NO: 782168 - protein, 18 aa, Mycobacterium
YIHWPVALSTDFVRIDDM

SEQ ID NO: 782169 - protein, 20 aa, Mycobacterium
YIIECLQLMALRGATTMEVT

SEQ ID NO: 782170 - protein, 18 aa, Mycobacterium
YIKEPDLFALELSALARA

SEQ ID NO: 782171 - protein, 17 aa, Mycobacterium
YILWAAWHRSGLQNRWL

SEQ ID NO: 782172 - protein, 18 aa, Mycobacterium
YINGRPAPLVAYWYGPDD

SEQ ID NO: 782173 - protein, 18 aa, Mycobacterium
YIPPNLHFSRWNPAIDAS

SEQ ID NO: 782174 - protein, 18 aa, Mycobacterium
YIRPRVEVELAFVMGEQL

SEQ ID NO: 782175 - protein, 17 aa, Mycobacterium
YIYCPWHQWGFELATGT

SEQ ID NO: 782176 - protein, 18 aa, Mycobacterium
YKAPFAFTGGSIARVTID

SEQ ID NO: 782177 - protein, 18 aa, Mycobacterium
YKAPFAFTGGTIAQVTID

SEQ ID NO: 782178 - protein, 17 aa, Mycobacterium
YKGACIFLNRPGFAGGI

SEQ ID NO: 782179 - protein, 17 aa, Mycobacterium
YKGACIFLNRPGFPTGI

SEQ ID NO: 782180 - protein, 18 aa, Mycobacterium
YKGACIFLNRPGWPKGIG

SEQ ID NO: 782181 - protein, 20 aa, Mycobacterium
YKIPEPFLVLATQNPVDQEG

SEQ ID NO: 782182 - protein, 25 aa, Mycobacterium
YKLLRSDWLEPRWMVGIDPESEGLA

SEQ ID NO: 782183 - protein, 19 aa, Mycobacterium
YKLLRSEWLEPRWMIGIDP

SEQ ID NO: 782184 - protein, 19 aa, Mycobacterium
YKMVFGHRGINIPVVDHIT

SEQ ID NO: 782185 - protein, 18 aa, Mycobacterium
YKPKAGKVVDGYFAQLPD

SEQ ID NO: 782186 - protein, 23 aa, Mycobacterium
YKPRWGTSLATGWASIHGFPVGI

SEQ ID NO: 782187 - protein, 17 aa, Mycobacterium
YKSEPWARLGVNVDADF

SEQ ID NO: 782188 - protein, 24 aa, Mycobacterium
YKSFFREFRWSSGVADYIAGSAGV

SEQ ID NO: 782189 - protein, 17 aa, Mycobacterium
YKVAALDVMNKVRALNQ

SEQ ID NO: 782190 - protein, 21 aa, Mycobacterium
YKWRKWLYFDCNWKVALEAFN

SEQ ID NO: 782191 - protein, 21 aa, Mycobacterium
YKWRKWLYFDCNWKVAMEAFN

SEQ ID NO: 782192 - protein, 27 aa, Mycobacterium
YKYFWSTEGMLGWKRSFQVGSYIATVL

SEQ ID NO: 782193 - protein, 20 aa, Mycobacterium
YLADCRRLGITVLPPDVNES

SEQ ID NO: 782194 - protein, 18 aa, Mycobacterium
YLAELGFRSIDEAVGHAE

SEQ ID NO: 782195 - protein, 17 aa, Mycobacterium
YLALEWLERMDLVDGKL

SEQ ID NO: 782196 - protein, 18 aa, Mycobacterium
YLALEWLERMDLVDGKVI

SEQ ID NO: 782197 - protein, 23 aa, Mycobacterium
YLARWLHPGQRAFQLATQIALLT

SEQ ID NO: 782198 - protein, 17 aa, Mycobacterium
YLATYAFYRGAFSPAAA

SEQ ID NO: 782199 - protein, 24 aa, Mycobacterium
YLAVEPWVQYGFNLASWAVGWVPW

SEQ ID NO: 782200 - protein, 17 aa, Mycobacterium
YLDCKFAGYLAERRREP

SEQ ID NO: 782201 - protein, 18 aa, Mycobacterium
YLEGPCLTAAWEEQTVHV

SEQ ID NO: 782202 - protein, 25 aa, Mycobacterium
YLERAWPRHRRLGGVGTPRALILAE

SEQ ID NO: 782203 - protein, 17 aa, Mycobacterium
YLIFPALSLRRWRRTLT

SEQ ID NO: 782204 - protein, 17 aa, Mycobacterium
YLKPFWDTHPWERADLR

SEQ ID NO: 782205 - protein, 18 aa, Mycobacterium
YLLAEARLGAYARELGEE

SEQ ID NO: 782206 - protein, 18 aa, Mycobacterium
YLLDFSRRFPDAAVVRLE

SEQ ID NO: 782207 - protein, 17 aa, Mycobacterium
YLLQGGYGWNSRIFGPA

SEQ ID NO: 782208 - protein, 18 aa, Mycobacterium
YLLSRAPGGLGLHAALTG

SEQ ID NO: 782209 - protein, 17 aa, Mycobacterium
YLLTLRSAWQADNNVPN

SEQ ID NO: 782210 - protein, 19 aa, Mycobacterium
YLLTLRSAWQADNRIPNSK

SEQ ID NO: 782211 - protein, 23 aa, Mycobacterium
YLMFRAGAVMRPRVLAVLRPLGL

SEQ ID NO: 782212 - protein, 22 aa, Mycobacterium
YLQMWLRAATAMAMYEAVSQTA

SEQ ID NO: 782213 - protein, 22 aa, Mycobacterium
YLQWLGIDCIWLPPFYDSPLRD

SEQ ID NO: 782214 - protein, 26 aa, Mycobacterium
YLRIAPELFLKRCLVGGFEKVFELNR

SEQ ID NO: 782215 - protein, 25 aa, Mycobacterium
YLRIAPELFLKRCVVGGFDKVFEVN

SEQ ID NO: 782216 - protein, 18 aa, Mycobacterium
YLRRVALYRAMFGSPEDH

SEQ ID NO: 782217 - protein, 20 aa, Mycobacterium
YLRRVMLYRSMFGTPEEHNL

SEQ ID NO: 782218 - protein, 23 aa, Mycobacterium
YLRRWHRRRPLWVGVAIGGTVDG

SEQ ID NO: 782219 - protein, 19 aa, Mycobacterium
YLRTRIESIAPQPLFDTVE

SEQ ID NO: 782220 - protein, 17 aa, Mycobacterium
YLSDIYVSIGMIEIDSE

SEQ ID NO: 782221 - protein, 18 aa, Mycobacterium
YLSELRWWTSPFTTDPSH

SEQ ID NO: 782222 - protein, 17 aa, Mycobacterium
YLTRLGARFERRSTDDP

SEQ ID NO: 782223 - protein, 19 aa, Mycobacterium
YLTRPSLFHFIRTAEEFSW

SEQ ID NO: 782224 - protein, 19 aa, Mycobacterium
YLVPHWPKPWGRAADVLEQ

SEQ ID NO: 782225 - protein, 22 aa, Mycobacterium
YLWPRVEVEVGFLLNADLPGAE

SEQ ID NO: 782226 - protein, 17 aa, Mycobacterium
YLYESRPALSLRAIGAK

SEQ ID NO: 782227 - protein, 21 aa, Mycobacterium
YLYPRVEVEVGFILAGDLPGA

SEQ ID NO: 782228 - protein, 22 aa, Mycobacterium
YLYPRVEVEVGFILSDDLPGAG

SEQ ID NO: 782229 - protein, 18 aa, Mycobacterium
YMAQLGFRTFNEAVGQVG

SEQ ID NO: 782230 - protein, 18 aa, Mycobacterium
YMAQLGFRTINEAVGQAG

SEQ ID NO: 782231 - protein, 18 aa, Mycobacterium
YMAQLGFRTLNEAIGQVK

SEQ ID NO: 782232 - protein, 18 aa, Mycobacterium
YMAQLGFRTVNEAVGQVG

SEQ ID NO: 782233 - protein, 21 aa, Mycobacterium
YMGGDGFYWRHTFHPAYGRGE

SEQ ID NO: 782234 - protein, 17 aa, Mycobacterium
YNALKAWLINVGEDGEW

SEQ ID NO: 782235 - protein, 18 aa, Mycobacterium
YNEIRAVVDPVGFGRTAE

SEQ ID NO: 782236 - protein, 23 aa, Mycobacterium
YNKIHLYDAFGFRESATVAPGHE

SEQ ID NO: 782237 - protein, 19 aa, Mycobacterium
YNPLRFASAAMKWCRKAAE

SEQ ID NO: 782238 - protein, 26 aa, Mycobacterium
YNPLRFLRAGMKWCRKAQELGTLDED

SEQ ID NO: 782239 - protein, 24 aa, Mycobacterium
YNRKGWKVWPTRAVLTAVEPNKRL

SEQ ID NO: 782240 - protein, 23 aa, Mycobacterium
YNSDCGFFIRYCLDVGLDKYGQG

SEQ ID NO: 782241 - protein, 17 aa, Mycobacterium
YNVPIVLHFRGAVRRDA

SEQ ID NO: 782242 - protein, 18 aa, Mycobacterium
YPAAEVRQALTLPAHIPV

SEQ ID NO: 782243 - protein, 20 aa, Mycobacterium
YPAALSITGGLSWSKVAAGD

SEQ ID NO: 782244 - protein, 17 aa, Mycobacterium
YPAALYANFFPRYLRGI

SEQ ID NO: 782245 - protein, 20 aa, Mycobacterium
YPAFPRRRALVAFGSDVMFG

SEQ ID NO: 782246 - protein, 19 aa, Mycobacterium
YPAHEVWTILISPQLFGQW

SEQ ID NO: 782247 - protein, 23 aa, Mycobacterium
YPASEIPAAFAFEHYVHIRYDLL

SEQ ID NO: 782248 - protein, 20 aa, Mycobacterium
YPDIKCVYWSGGNPFHHHQN

SEQ ID NO: 782249 - protein, 24 aa, Mycobacterium
YPEGKRAGLWPGLRETFKSGTSEP

SEQ ID NO: 782250 - protein, 18 aa, Mycobacterium
YPELADWGIPTAEAIVEV

SEQ ID NO: 782251 - protein, 21 aa, Mycobacterium
YPEPARAAAIVRRTVPGASAA

SEQ ID NO: 782252 - protein, 21 aa, Mycobacterium
YPEPARAAAIVRRTVPGATAP

SEQ ID NO: 782253 - protein, 20 aa, Mycobacterium
YPFRCKRVLLGDDFYRALQH

SEQ ID NO: 782254 - protein, 18 aa, Mycobacterium
YPGDFWVYARNKIMVAAR

SEQ ID NO: 782255 - protein, 24 aa, Mycobacterium
YPGEPLPRWQIGLYWRADGEPLWS

SEQ ID NO: 782256 - protein, 26 aa, Mycobacterium
YPGEPLPRWQIGLYWRRDGQPLWSDP

SEQ ID NO: 782257 - protein, 19 aa, Mycobacterium
YPGHIARMFGLVFGGEPAD

SEQ ID NO: 782258 - protein, 21 aa, Mycobacterium
YPGRFLLGIGVGHPEAHTEYR

SEQ ID NO: 782259 - protein, 21 aa, Mycobacterium
YPGRFLLGIGVGHPEAITEYH

SEQ ID NO: 782260 - protein, 18 aa, Mycobacterium
YPGSNVVLCLGMCGQMIY

SEQ ID NO: 782261 - protein, 18 aa, Mycobacterium
YPHDHGWESVTWEQVGER

SEQ ID NO: 782262 - protein, 21 aa, Mycobacterium
YPHRGVDTGGMWVWRHADSVD

SEQ ID NO: 782263 - protein, 24 aa, Mycobacterium
YPHYLRLLLWEGLDRNPLDGNPPA

SEQ ID NO: 782264 - protein, 21 aa, Mycobacterium
YPIIRKMFATFGIDALAKEGL

SEQ ID NO: 782265 - protein, 26 aa, Mycobacterium
YPINFLADLNAFLGIQSLHGQYPSLT

SEQ ID NO: 782266 - protein, 17 aa, Mycobacterium
YPLDCLIFATGFEVGTD

SEQ ID NO: 782267 - protein, 19 aa, Mycobacterium
YPLDHTWASVTWQQVGERV

SEQ ID NO: 782268 - protein, 18 aa, Mycobacterium
YPLLRLPVNLARSAAALT

SEQ ID NO: 782269 - protein, 17 aa, Mycobacterium
YPLPAAWADTVDVQLYL

SEQ ID NO: 782270 - protein, 17 aa, Mycobacterium
YPLPSAWSTDVDVALYL

SEQ ID NO: 782271 - protein, 19 aa, Mycobacterium
YPLRKVHLALVLWFPDDAT

SEQ ID NO: 782272 - protein, 17 aa, Mycobacterium
YPLTPFVRLAFAGDITS

SEQ ID NO: 782273 - protein, 19 aa, Mycobacterium
YPMFRRLREEAPLYYNAQH

SEQ ID NO: 782274 - protein, 18 aa, Mycobacterium
YPNQKWPIAYNVDDITKV

SEQ ID NO: 782275 - protein, 22 aa, Mycobacterium
YPNVNPGLLLKCMLMAATEGIA

SEQ ID NO: 782276 - protein, 17 aa, Mycobacterium
YPPFYFDGAIPFRTLHA

SEQ ID NO: 782277 - protein, 25 aa, Mycobacterium
YPPGQVPLPFAWNGVRLPGRGASAL

SEQ ID NO: 782278 - protein, 17 aa, Mycobacterium
YPQAVPIMVDWLQNLDE

SEQ ID NO: 782279 - protein, 21 aa, Mycobacterium
YPQELYDLWTLWHIASTNPWL

SEQ ID NO: 782280 - protein, 19 aa, Mycobacterium
YPQVCPPEMLADIQHACEA

SEQ ID NO: 782281 - protein, 21 aa, Mycobacterium
YPRLFAALADRGWSRADLAKL

SEQ ID NO: 782282 - protein, 17 aa, Mycobacterium
YPRLVVATITGWGSTGP

SEQ ID NO: 782283 - protein, 21 aa, Mycobacterium
YPTEIPLPFVVGRDLVGRVVH

SEQ ID NO: 782284 - protein, 17 aa, Mycobacterium
YPVAEVREALTLPPHIP

SEQ ID NO: 782285 - protein, 18 aa, Mycobacterium
YPVAEVRQALTLPPHIPV

SEQ ID NO: 782286 - protein, 17 aa, Mycobacterium
YPVLCGSAFKNKGVQPM

SEQ ID NO: 782287 - protein, 20 aa, Mycobacterium
YPVLCGSAFKNKGVQPMLDA

SEQ ID NO: 782288 - protein, 19 aa, Mycobacterium
YPVSLRVGGLSWGQVIGGD

SEQ ID NO: 782289 - protein, 19 aa, Mycobacterium
YPVWKRMREEAPLYYNEKY

SEQ ID NO: 782290 - protein, 18 aa, Mycobacterium
YQAHDWLREHAHLDMGMS

SEQ ID NO: 782291 - protein, 18 aa, Mycobacterium
YQDAITMHECRSAKQLAA

SEQ ID NO: 782292 - protein, 18 aa, Mycobacterium
YQDFAAPVFEEFRSPGMV

SEQ ID NO: 782293 - protein, 18 aa, Mycobacterium
YQFIQYWVDYGVDLAQWG

SEQ ID NO: 782294 - protein, 19 aa, Mycobacterium
YQFTRPRMDGLWPAPDELD

SEQ ID NO: 782295 - protein, 21 aa, Mycobacterium
YQKFGFWPRFLTGLLAKTAAE

SEQ ID NO: 782296 - protein, 31 aa, Mycobacterium
YQLLAAELAAIPDRFTKTVLASANSYASAEA

SEQ ID NO: 782297 - protein, 19 aa, Mycobacterium
YQPVNAWGIPTGRVEQRPA

SEQ ID NO: 782298 - protein, 17 aa, Mycobacterium
YQQSRWWSPRGWAHRQS

SEQ ID NO: 782299 - protein, 17 aa, Mycobacterium
YQRFAAFWRSRPVNWVW

SEQ ID NO: 782300 - protein, 25 aa, Mycobacterium
YQRIFARLGVRYVIVSAVSGAMGGS

SEQ ID NO: 782301 - protein, 17 aa, Mycobacterium
YQTGWKRSLTAMRSQRY

SEQ ID NO: 782302 - protein, 19 aa, Mycobacterium
YQVALEFQRNRLNVVQATS

SEQ ID NO: 782303 - protein, 19 aa, Mycobacterium
YQVPEFRRKAVFIAVGGVY

SEQ ID NO: 782304 - protein, 22 aa, Mycobacterium
YQYPHRCWTCMVPALIREDMIV

SEQ ID NO: 782305 - protein, 17 aa, Mycobacterium
YQYRITPRYEIPCTVTG

SEQ ID NO: 782306 - protein, 17 aa, Mycobacterium
YQYRPQLPFVLGAEIAG

SEQ ID NO: 782307 - protein, 17 aa, Mycobacterium
YQYRVSPRYEIPCTVTG

SEQ ID NO: 782308 - protein, 17 aa, Mycobacterium
YRAAGYWTGRSIGSLLR

SEQ ID NO: 782309 - protein, 19 aa, Mycobacterium
YRALGAWGLPVSEHTTKVS

SEQ ID NO: 782310 - protein, 20 aa, Mycobacterium
YRAPLSYPFRDAEFGKELAT

SEQ ID NO: 782311 - protein, 18 aa, Mycobacterium
YRAPMAHPYRWPSGAENC

SEQ ID NO: 782312 - protein, 20 aa, Mycobacterium
YRAPVSYPYRDGLLDKELAT

SEQ ID NO: 782313 - protein, 22 aa, Mycobacterium
YRAQELLELVGLPGRGDAYPAQ

SEQ ID NO: 782314 - protein, 20 aa, Mycobacterium
YRARAGAVFGSRMLMLEHIG

SEQ ID NO: 782315 - protein, 18 aa, Mycobacterium
YRASAAFLREFAQTLQDE

SEQ ID NO: 782316 - protein, 18 aa, Mycobacterium
YRAVHVIVRYHGRLIEVQ

SEQ ID NO: 782317 - protein, 17 aa, Mycobacterium
YRAVIEYRKPIKFGEDV

SEQ ID NO: 782318 - protein, 18 aa, Mycobacterium
YRCGEAWSTLVHHRPSGR

SEQ ID NO: 782319 - protein, 20 aa, Mycobacterium
YRDADGWIYLAGRTPDWMRI

SEQ ID NO: 782320 - protein, 20 aa, Mycobacterium
YRDADGWIYLAGRTSDWMRV

SEQ ID NO: 782321 - protein, 21 aa, Mycobacterium
YRDAEGWIYLAGRTADWMRVD

SEQ ID NO: 782322 - protein, 17 aa, Mycobacterium
YRDCRILGIGGGTNEIM

SEQ ID NO: 782323 - protein, 20 aa, Mycobacterium
YRDSDGWIYLAGRTADWMRV

SEQ ID NO: 782324 - protein, 20 aa, Mycobacterium
YRDSQGWIYLAGRTADWMRV

SEQ ID NO: 782325 - protein, 20 aa, Mycobacterium
YRDTQGWIYLAGRTSDWLRV

SEQ ID NO: 782326 - protein, 20 aa, Mycobacterium
YRESPAWGFCMWAIAPDQMY

SEQ ID NO: 782327 - protein, 24 aa, Mycobacterium
YRFAHGAARPGVWRGPSSPPRFDD

SEQ ID NO: 782328 - protein, 22 aa, Mycobacterium
YRFIRDATWVSVRWFRPGGSRT

SEQ ID NO: 782329 - protein, 17 aa, Mycobacterium
YRFPGLLPGDRWCVTAM

SEQ ID NO: 782330 - protein, 17 aa, Mycobacterium
YRFPGLLPGDRWCVVAV

SEQ ID NO: 782331 - protein, 17 aa, Mycobacterium
YRFPQLRFIASVGEPLN

SEQ ID NO: 782332 - protein, 17 aa, Mycobacterium
YRFSVPDPGTYWAHPHV

SEQ ID NO: 782333 - protein, 17 aa, Mycobacterium
YRFYRLVVVADRGATVD

SEQ ID NO: 782334 - protein, 17 aa, Mycobacterium
YRGALGLPKAEMPSPDE

SEQ ID NO: 782335 - protein, 21 aa, Mycobacterium
YRGCSHACRYCFARPTHEYLD

SEQ ID NO: 782336 - protein, 22 aa, Mycobacterium
YRGCSHACRYCFARPTHEYLDF

SEQ ID NO: 782337 - protein, 22 aa, Mycobacterium
YRGCSHACRYCFARPTHEYLEF

SEQ ID NO: 782338 - protein, 19 aa, Mycobacterium
YRGCYRYIKEPDLFALELS

SEQ ID NO: 782339 - protein, 30 aa, Mycobacterium
YRGEAVGTFTGWRPAMPVTQWSVTKAVSMP

SEQ ID NO: 782340 - protein, 20 aa, Mycobacterium
YRGKLGYHWVIVGIDYEYNR

SEQ ID NO: 782341 - protein, 17 aa, Mycobacterium
YRGLRAPHKIKLGVSGC

SEQ ID NO: 782342 - protein, 18 aa, Mycobacterium
YRGRACALVRPGTGDQVA

SEQ ID NO: 782343 - protein, 17 aa, Mycobacterium
YRGRGIGIMRGLMQDVT

SEQ ID NO: 782344 - protein, 18 aa, Mycobacterium
YRGSALYKMRTKGRAALV

SEQ ID NO: 782345 - protein, 22 aa, Mycobacterium
YRHPLCLCVHFPAGTLLAETGC

SEQ ID NO: 782346 - protein, 21 aa, Mycobacterium
YRHPLCLRVHFPAGTLLDDTG

SEQ ID NO: 782347 - protein, 17 aa, Mycobacterium
YRIPLVYLVQSTSAGVE

SEQ ID NO: 782348 - protein, 21 aa, Mycobacterium
YRITPRYEIPCTVTGTVTVGE

SEQ ID NO: 782349 - protein, 21 aa, Mycobacterium
YRIVTLWVLRAGVDLTDPAAI

SEQ ID NO: 782350 - protein, 19 aa, Mycobacterium
YRKCFSDGLYLTGDLAKKD

SEQ ID NO: 782351 - protein, 18 aa, Mycobacterium
YRKLAAHFFLTFPQLDDV

SEQ ID NO: 782352 - protein, 20 aa, Mycobacterium
YRLAAQLGMPPWRVQKAQKQ

SEQ ID NO: 782353 - protein, 17 aa, Mycobacterium
YRLAELALRDRVPMVML

SEQ ID NO: 782354 - protein, 17 aa, Mycobacterium
YRLAPGPGLKRNRKELR

SEQ ID NO: 782355 - protein, 20 aa, Mycobacterium
YRLASQLGMPPWRVQKAQKQ

SEQ ID NO: 782356 - protein, 17 aa, Mycobacterium
YRLELARPDYRACWDYG

SEQ ID NO: 782357 - protein, 26 aa, Mycobacterium
YRLGTRLVPRLRWRPVTTEPVTLSSD

SEQ ID NO: 782358 - protein, 18 aa, Mycobacterium
YRLHWPKGTTVFELDQPA

SEQ ID NO: 782359 - protein, 17 aa, Mycobacterium
YRLPITFLLFDNHAHAM

SEQ ID NO: 782360 - protein, 17 aa, Mycobacterium
YRLPVDYAVRITSRGLY

SEQ ID NO: 782361 - protein, 20 aa, Mycobacterium
YRLRRLKQLTGRDVARPRDI

SEQ ID NO: 782362 - protein, 17 aa, Mycobacterium
YRLVDFWRDHRAPAEED

SEQ ID NO: 782363 - protein, 21 aa, Mycobacterium
YRMPWSTMFPLGISSAVIGIA

SEQ ID NO: 782364 - protein, 22 aa, Mycobacterium
YRMRVAPSIFKHVWSVLQIACH

SEQ ID NO: 782365 - protein, 17 aa, Mycobacterium
YRMVVCEEIARINALSF

SEQ ID NO: 782366 - protein, 18 aa, Mycobacterium
YRNGGLFLDTGVLRLRDD

SEQ ID NO: 782367 - protein, 18 aa, Mycobacterium
YRNGGLLLDTGVLSLRDQ

SEQ ID NO: 782368 - protein, 19 aa, Mycobacterium
YRPELPGGQPAGGRSLGPA

SEQ ID NO: 782369 - protein, 18 aa, Mycobacterium
YRPELPGGQPAGGRSLSA

SEQ ID NO: 782370 - protein, 18 aa, Mycobacterium
YRPFRALIRAVLRHAGGV

SEQ ID NO: 782371 - protein, 18 aa, Mycobacterium
YRPFRALIRAVLRHSGGV

SEQ ID NO: 782372 - protein, 17 aa, Mycobacterium
YRPFWAITKHADIMDIE

SEQ ID NO: 782373 - protein, 19 aa, Mycobacterium
YRPGARFGPTHVRESSRLL

SEQ ID NO: 782374 - protein, 18 aa, Mycobacterium
YRPGLIHVYHGVTWGPLM

SEQ ID NO: 782375 - protein, 17 aa, Mycobacterium
YRPGLTFADVDSRATPG

SEQ ID NO: 782376 - protein, 20 aa, Mycobacterium
YRPGTRVRLRIINAAGDSAF

SEQ ID NO: 782377 - protein, 26 aa, Mycobacterium
YRPHRLAVCLDLDWRPAWRVAAIPSY

SEQ ID NO: 782378 - protein, 20 aa, Mycobacterium
YRPQWCRVIDYPFTGRAEVS

SEQ ID NO: 782379 - protein, 19 aa, Mycobacterium
YRPSTALQRFIRSRDITCR

SEQ ID NO: 782380 - protein, 17 aa, Mycobacterium
YRPSVAMDCFVRMRDMT

SEQ ID NO: 782381 - protein, 17 aa, Mycobacterium
YRQMRNFWATLMVSQGT

SEQ ID NO: 782382 - protein, 18 aa, Mycobacterium
YRQMRNFWATLMVSQGTP

SEQ ID NO: 782383 - protein, 17 aa, Mycobacterium
YRRALMLAASFGRSSDY

SEQ ID NO: 782384 - protein, 17 aa, Mycobacterium
YRREVLEALDLDTLESR

SEQ ID NO: 782385 - protein, 17 aa, Mycobacterium
YRREVLETIDLDSVDSK

SEQ ID NO: 782386 - protein, 18 aa, Mycobacterium
YRRGALKHTPIRSVLSFK

SEQ ID NO: 782387 - protein, 18 aa, Mycobacterium
YRRGEVLVAVAGEHLSAV

SEQ ID NO: 782388 - protein, 18 aa, Mycobacterium
YRRQLTFTPKGVIAEETT

SEQ ID NO: 782389 - protein, 18 aa, Mycobacterium
YRRRLCRPALQFTGEVTG

SEQ ID NO: 782390 - protein, 19 aa, Mycobacterium
YRRSLRLPFGNAIVNLTPA

SEQ ID NO: 782391 - protein, 18 aa, Mycobacterium
YRRTAFDIGEWGLGFMTT

SEQ ID NO: 782392 - protein, 20 aa, Mycobacterium
YRRWLGTRLPYYANWIRLKS

SEQ ID NO: 782393 - protein, 24 aa, Mycobacterium
YRSCGGCRSCAAGERAYCSRSMRL

SEQ ID NO: 782394 - protein, 17 aa, Mycobacterium
YRTAALDRTPVRSIMSF

SEQ ID NO: 782395 - protein, 19 aa, Mycobacterium
YRTEVDWATQMSYSGVFVH

SEQ ID NO: 782396 - protein, 19 aa, Mycobacterium
YRTEVEWATQMSYSGIYVH

SEQ ID NO: 782397 - protein, 17 aa, Mycobacterium
YRTGLATTVAWFRIACD

SEQ ID NO: 782398 - protein, 18 aa, Mycobacterium
YRTGWKGRWVRQLTDLVA

SEQ ID NO: 782399 - protein, 17 aa, Mycobacterium
YRTPLFLARLAAAARVY

SEQ ID NO: 782400 - protein, 18 aa, Mycobacterium
YRTVNGWGAAVVGTPERI

SEQ ID NO: 782401 - protein, 18 aa, Mycobacterium
YRVAGYRSGWLVITGPKE

SEQ ID NO: 782402 - protein, 19 aa, Mycobacterium
YRVAGYRSGWLVITGPKEH

SEQ ID NO: 782403 - protein, 22 aa, Mycobacterium
YRVARAWMDARVTKIWAGSNEI

SEQ ID NO: 782404 - protein, 17 aa, Mycobacterium
YRVDAVRAFELLRKLSQ

SEQ ID NO: 782405 - protein, 18 aa, Mycobacterium
YRVGRAVARRGRDIGGDR

SEQ ID NO: 782406 - protein, 21 aa, Mycobacterium
YRVHSLHGYFLRPGDAKERTV

SEQ ID NO: 782407 - protein, 18 aa, Mycobacterium
YRVLFGVATTQGVNPAPL

SEQ ID NO: 782408 - protein, 21 aa, Mycobacterium
YRVLPYCWRDETPLSNHELRM

SEQ ID NO: 782409 - protein, 19 aa, Mycobacterium
YRVPNEFPIHTETMRANPQ

SEQ ID NO: 782410 - protein, 17 aa, Mycobacterium
YRVRDFLQWAAAGGHTG

SEQ ID NO: 782411 - protein, 21 aa, Mycobacterium
YRVSPRYEIPCTVTGTVSADG

SEQ ID NO: 782412 - protein, 25 aa, Mycobacterium
YRVWPDLRVKPHLDKSVATIKADAA

SEQ ID NO: 782413 - protein, 20 aa, Mycobacterium
YRWHMRAGKWALNRDIAAAR

SEQ ID NO: 782414 - protein, 19 aa, Mycobacterium
YRWMIRCVLQGPAETFDAL

SEQ ID NO: 782415 - protein, 19 aa, Mycobacterium
YRWMIRCVVNGPHETIDAL

SEQ ID NO: 782416 - protein, 18 aa, Mycobacterium
YRYPLGLRRWEFPQGTAP

SEQ ID NO: 782417 - protein, 17 aa, Mycobacterium
YRYRLTSRYEIPCTVAG

SEQ ID NO: 782418 - protein, 19 aa, Mycobacterium
YRYTWHLPKNRTWTYDGQL

SEQ ID NO: 782419 - protein, 17 aa, Mycobacterium
YRYWTRPAIVADIDTRR

SEQ ID NO: 782420 - protein, 23 aa, Mycobacterium
YSAAELVNVLPLQNVEQDLLNLV

SEQ ID NO: 782421 - protein, 18 aa, Mycobacterium
YSALVTRWAQLELGMSAW

SEQ ID NO: 782422 - protein, 18 aa, Mycobacterium
YSDFIAWPIRMEVEKRTP

SEQ ID NO: 782423 - protein, 18 aa, Mycobacterium
YSDFIAWPIRMEVERRQP

SEQ ID NO: 782424 - protein, 23 aa, Mycobacterium
YSDGRYSYQLTIYVFRYEEGTAM

SEQ ID NO: 782425 - protein, 18 aa, Mycobacterium
YSGKAIAGVSGFGFGGAN

SEQ ID NO: 782426 - protein, 17 aa, Mycobacterium
YSGSLDHIWALAEHPPA

SEQ ID NO: 782427 - protein, 24 aa, Mycobacterium
YSGVMWACVFMRTGARRVHFGETE

SEQ ID NO: 782428 - protein, 20 aa, Mycobacterium
YSGYRFVRRAAALAIPIAIV

SEQ ID NO: 782429 - protein, 24 aa, Mycobacterium
YSHKWSVGDTVIWDNQGVLHRAAP

SEQ ID NO: 782430 - protein, 22 aa, Mycobacterium
YSLKEIRHWLQVFAQRFYSFSQ

SEQ ID NO: 782431 - protein, 17 aa, Mycobacterium
YSLRGANLWDEVKDRLD

SEQ ID NO: 782432 - protein, 19 aa, Mycobacterium
YSLWHPWCHADIWRTDPET

SEQ ID NO: 782433 - protein, 19 aa, Mycobacterium
YSNGAFWRGDHQGLADISY

SEQ ID NO: 782434 - protein, 23 aa, Mycobacterium
YSNGAFWRGDHQGLVGFSYAINI

SEQ ID NO: 782435 - protein, 24 aa, Mycobacterium
YSNGAFWRGDHQGLVGFSYGFTIP

SEQ ID NO: 782436 - protein, 25 aa, Mycobacterium
YSNGFLWRGDYQGLITISYSSTIPE

SEQ ID NO: 782437 - protein, 23 aa, Mycobacterium
YSNGMFWRGDYQGLVGAHYEIFI

SEQ ID NO: 782438 - protein, 17 aa, Mycobacterium
YSPRFLWMWPNARISVM

SEQ ID NO: 782439 - protein, 26 aa, Mycobacterium
YSPRLRPGTPVSFPVAWDALDRIHPS

SEQ ID NO: 782440 - protein, 19 aa, Mycobacterium
YSPSFGRGPFRNVICLSVN

SEQ ID NO: 782441 - protein, 19 aa, Mycobacterium
YSPVGSALLCRWNDGDDGL

SEQ ID NO: 782442 - protein, 21 aa, Mycobacterium
YSRRWRLRWRPGLAARRVEGR

SEQ ID NO: 782443 - protein, 19 aa, Mycobacterium
YSRVALKWAERYYAAERDL

SEQ ID NO: 782444 - protein, 18 aa, Mycobacterium
YSSGFDWPILGGSGNTTV

SEQ ID NO: 782445 - protein, 18 aa, Mycobacterium
YSSWFKLHHPAAFCAALL

SEQ ID NO: 782446 - protein, 19 aa, Mycobacterium
YSTAARCWSVISGLVGGPW

SEQ ID NO: 782447 - protein, 24 aa, Mycobacterium
YSTGDAEELLWLQAPPPATGSGTS

SEQ ID NO: 782448 - protein, 17 aa, Mycobacterium
YSTHPWVLLAYAVPRNG

SEQ ID NO: 782449 - protein, 18 aa, Mycobacterium
YSVDAAWVVPHFEKMLYD

SEQ ID NO: 782450 - protein, 23 aa, Mycobacterium
YSYYGEVLLDWIVERLANQKGSD

SEQ ID NO: 782451 - protein, 23 aa, Mycobacterium
YSYYGEVLLDWIVERLANQKGSP

SEQ ID NO: 782452 - protein, 19 aa, Mycobacterium
YTAAWKRFGQAVPRPRAIL

SEQ ID NO: 782453 - protein, 19 aa, Mycobacterium
YTARLCPTPLLAEERKTAV

SEQ ID NO: 782454 - protein, 29 aa, Mycobacterium
YTDRTGPIIVEWLGAQGFRVDEPVVVPDG

SEQ ID NO: 782455 - protein, 24 aa, Mycobacterium
YTFGFDFVQGPGFFNSTTTPSSGF

SEQ ID NO: 782456 - protein, 17 aa, Mycobacterium
YTHYYRMGRMIELIQCW

SEQ ID NO: 782457 - protein, 23 aa, Mycobacterium
YTKCAELGLPLCINTGLPGPPIP

SEQ ID NO: 782458 - protein, 18 aa, Mycobacterium
YTLWAAWHRSGLQRRWLS

SEQ ID NO: 782459 - protein, 18 aa, Mycobacterium
YTLWAAWHRSGLQSRWLT

SEQ ID NO: 782460 - protein, 25 aa, Mycobacterium
YTNPGQPIWWLARALEFFQDGEEFW

SEQ ID NO: 782461 - protein, 24 aa, Mycobacterium
YTPEQWWPFIGHLSLDQSIAQGVT

SEQ ID NO: 782462 - protein, 23 aa, Mycobacterium
YTQRPSWPGGIAVGKTAVSSSMI

SEQ ID NO: 782463 - protein, 17 aa, Mycobacterium
YTRLDWAVLDWNTPSIK

SEQ ID NO: 782464 - protein, 17 aa, Mycobacterium
YTRLSWAVLNWNSDALA

SEQ ID NO: 782465 - protein, 17 aa, Mycobacterium
YTRLSWAVLNWNSNAIA

SEQ ID NO: 782466 - protein, 17 aa, Mycobacterium
YTRLSWAVLNWNTDAIT

SEQ ID NO: 782467 - protein, 18 aa, Mycobacterium
YTTQRWPDVLLTAAEELP

SEQ ID NO: 782468 - protein, 23 aa, Mycobacterium
YTWPRFVCGLPREFFAAVRAELA

SEQ ID NO: 782469 - protein, 18 aa, Mycobacterium
YTYWWLKGYNDAVAEVAV

SEQ ID NO: 782470 - protein, 22 aa, Mycobacterium
YVAKYTICPAITHGIDHEIGSV

SEQ ID NO: 782471 - protein, 22 aa, Mycobacterium
YVAKYTICPAVAHGLDGEIGSV

SEQ ID NO: 782472 - protein, 24 aa, Mycobacterium
YVDLVCSWGPMILGHAHPAVVDAV

SEQ ID NO: 782473 - protein, 24 aa, Mycobacterium
YVDLVCSWGPMILGHAHPAVVEAV

SEQ ID NO: 782474 - protein, 17 aa, Mycobacterium
YVDPYLPIESFRIRDEA

SEQ ID NO: 782475 - protein, 18 aa, Mycobacterium
YVERIGIDRIAEYEHALL

SEQ ID NO: 782476 - protein, 24 aa, Mycobacterium
YVFCDATFCKARIGAHVVSQALVV

SEQ ID NO: 782477 - protein, 18 aa, Mycobacterium
YVFRCAILYLRYEVANCH

SEQ ID NO: 782478 - protein, 24 aa, Mycobacterium
YVGDWAAKLERVWSKEQPDVVHAY

SEQ ID NO: 782479 - protein, 24 aa, Mycobacterium
YVGDWAGALAREWAAETPDVVHAY

SEQ ID NO: 782480 - protein, 23 aa, Mycobacterium
YVGIGVLIDGRWRWRSYSLTSAP

SEQ ID NO: 782481 - protein, 23 aa, Mycobacterium
YVICEVLAWRGIWLSEERRRIGN

SEQ ID NO: 782482 - protein, 18 aa, Mycobacterium
YVIGRLIWQAGLLAPVEG

SEQ ID NO: 782483 - protein, 18 aa, Mycobacterium
YVKEPELFALELEALARV

SEQ ID NO: 782484 - protein, 22 aa, Mycobacterium
YVLCEVLAWRGIWLSEERRRIG

SEQ ID NO: 782485 - protein, 25 aa, Mycobacterium
YVLCEVLGWRGIWLSEERRRMGNVD

SEQ ID NO: 782486 - protein, 20 aa, Mycobacterium
YVMECLQLMALRAASTIEVK

SEQ ID NO: 782487 - protein, 18 aa, Mycobacterium
YVMECLQLMALRKATTLE

SEQ ID NO: 782488 - protein, 19 aa, Mycobacterium
YVMPHWPKPWGRAADAVEQ

SEQ ID NO: 782489 - protein, 18 aa, Mycobacterium
YVPKHWDKLCEIIGRPDM

SEQ ID NO: 782490 - protein, 17 aa, Mycobacterium
YVPKSIRLIDVFKGLSP

SEQ ID NO: 782491 - protein, 22 aa, Mycobacterium
YVQRMAVVLGRRVWEHAGSPDV

SEQ ID NO: 782492 - protein, 18 aa, Mycobacterium
YVRKRLGLQDVIMTRDRD

SEQ ID NO: 782493 - protein, 20 aa, Mycobacterium
YVRPAAWGVWTFYQLSDEER

SEQ ID NO: 782494 - protein, 17 aa, Mycobacterium
YVRRPGLTASRFIACPF

SEQ ID NO: 782495 - protein, 19 aa, Mycobacterium
YVRRPGLTASRFVANPFGG

SEQ ID NO: 782496 - protein, 17 aa, Mycobacterium
YVVWGLIRDKWNELGGS

SEQ ID NO: 782497 - protein, 17 aa, Mycobacterium
YVWPWLAARRQIVVNCY

SEQ ID NO: 782498 - protein, 20 aa, Mycobacterium
YWPHTEPIGAMLFLHGGPEG

SEQ ID NO: 782499 - protein, 24 aa, Mycobacterium
YWPSKLELFGAVFTRDGVAMLTAA

SEQ ID NO: 782500 - protein, 20 aa, Mycobacterium
YWRDEFKAGNAVDARIINTS

SEQ ID NO: 782501 - protein, 20 aa, Mycobacterium
YWRRGGLSAAQFVACPFGAA

SEQ ID NO: 782502 - protein, 22 aa, Mycobacterium
YWRRSGLTASRFVACPFAGAGA

SEQ ID NO: 782503 - protein, 22 aa, Mycobacterium
YWRRTALTGARFVACPFGMPGD

SEQ ID NO: 782504 - protein, 24 aa, Mycobacterium
YWSFPHGHLCLWTWAANPQDRPLW

SEQ ID NO: 782505 - protein, 22 aa, Mycobacterium
YYADFEGVLAFLQRKMSQTESE

SEQ ID NO: 782506 - protein, 19 aa, Mycobacterium
YYAMTGWRLGWLLVPTELR

SEQ ID NO: 782507 - protein, 22 aa, Mycobacterium
YYCLDYRAAGLTPQSWFARQAG

SEQ ID NO: 782508 - protein, 18 aa, Mycobacterium
YYDDMAWLALALERAARI

SEQ ID NO: 782509 - protein, 23 aa, Mycobacterium
YYGRWLRFVTWWPIADGAAHLTV

SEQ ID NO: 782510 - protein, 19 aa, Mycobacterium
YYLEMPPALFAPIVENLAA

SEQ ID NO: 782511 - protein, 18 aa, Mycobacterium
YYPWGIPRQFSAVLGSGS

SEQ ID NO: 782512 - protein, 19 aa, Mycobacterium
EMRDWLPRGWHPDRFSVAE

SEQ ID NO: 782513 - protein, 33 aa, Mycobacterium
FRVRVDLMYAKPPIWRRLDLPGDLMLDELHVVL

SEQ ID NO: 782514 - protein, 17 aa, Mycobacterium
DRQKARLAALFAANAHA

SEQ ID NO: 782515 - protein, 19 aa, Mycobacterium
LEHLRGSALGFRNLTNYIA

SEQ ID NO: 782516 - protein, 19 aa, Mycobacterium
LLAFLDRPEIAGGEALAGL

SEQ ID NO: 782517 - protein, 19 aa, Mycobacterium
TVIIDLTPVRDGTGPARLL

SEQ ID NO: 782518 - protein, 22 aa, Mycobacterium
AGLPEHLPLPTDRPYPPIADYR

SEQ ID NO: 782519 - protein, 19 aa, Mycobacterium
DELIGFFVNTLVLRTHTHP

SEQ ID NO: 782520 - protein, 27 aa, Mycobacterium
RSDHAILTILAILKTGAAYLPIDPHHP

SEQ ID NO: 782521 - protein, 19 aa, Mycobacterium
THHPLIQVMLAFQNHPWTQ

SEQ ID NO: 782522 - protein, 20 aa, Mycobacterium
PHQHVLVLLIHHIAADGWSL

SEQ ID NO: 782523 - protein, 21 aa, Mycobacterium
TDLAYWQHTLAGLPEHLPLPT

SEQ ID NO: 782524 - protein, 20 aa, Mycobacterium
YTLWHHQLLGDPHDPTSLLA

SEQ ID NO: 782525 - protein, 28 aa, Mycobacterium
HAVTYNAFFAAAAAPPILIGDPARQHGP

SEQ ID NO: 782526 - protein, 18 aa, Mycobacterium
HPHLDELIGFFVNTLVLR

SEQ ID NO: 782527 - protein, 20 aa, Mycobacterium
PPNPHDLAYLIYTSGTTGTP

SEQ ID NO: 782528 - protein, 27 aa, Mycobacterium
ARQLRLRIDATWRWATSIATAWQTIRT

SEQ ID NO: 782529 - protein, 30 aa, Mycobacterium
NTGLRNLPCHGFWANAAWLEIVLAAADLVT

SEQ ID NO: 782530 - protein, 17 aa, Mycobacterium
PILIGDPARQHGPIRVE

SEQ ID NO: 782531 - protein, 17 aa, Mycobacterium
TWKKSFGHHPLLAFLDR

SEQ ID NO: 782532 - protein, 24 aa, Mycobacterium
DIARYIELFYNRRRLHSALGYRTP

SEQ ID NO: 782533 - protein, 24 aa, Mycobacterium
GMAPTIVQMLKWLGVSKSGFYEWW

SEQ ID NO: 782534 - protein, 19 aa, Mycobacterium
HPHLDELIGFFVNTLVLRT

SEQ ID NO: 782535 - protein, 25 aa, Mycobacterium
ITYIRTWAGWLYLATVIDCFNKEVI

SEQ ID NO: 782536 - protein, 23 aa, Mycobacterium
AIPDGLVLTQPWPATSSEKARGI

SEQ ID NO: 782537 - protein, 22 aa, Mycobacterium
ATYHRWRNQFGGLKAEDAKRLK

SEQ ID NO: 782538 - protein, 26 aa, Mycobacterium
CGKTYLAQTLAKMLNVPFAIADATAL

SEQ ID NO: 782539 - protein, 23 aa, Mycobacterium
DTTYGGRWVVNPSGGLISKGHPL

SEQ ID NO: 782540 - protein, 19 aa, Mycobacterium
ECWAMQAYGAAYTLQELLT

SEQ ID NO: 782541 - protein, 18 aa, Mycobacterium
EGQRRYVESLSAYARQFL

SEQ ID NO: 782542 - protein, 26 aa, Mycobacterium
EHQAIVRDVLAAGDFWGGAGSVACQE

SEQ ID NO: 782543 - protein, 24 aa, Mycobacterium
EKEQTILVFDLGGGTFDVSLLEIG

SEQ ID NO: 782544 - protein, 24 aa, Mycobacterium
EKVRRKPFSVVLFDEIEKAHQEIY

SEQ ID NO: 782545 - protein, 27 aa, Mycobacterium
ESCDTLIVIPNDRLLQMGDAAVSLMDA

SEQ ID NO: 782546 - protein, 32 aa, Mycobacterium; identical to SEQ ID NO: 114674

SEQ ID NO: 782547 - protein, 24 aa, Mycobacterium
GLQARLMSQALRKMTGALNNSGTT

SEQ ID NO: 782548 - protein, 19 aa, Mycobacterium
KSFGHHPLLAFLDRPEIAG

SEQ ID NO: 782549 - protein, 29 aa, Mycobacterium
KSGRDSMFQAILPLRGKIINVEKARIDRV

SEQ ID NO: 782550 - protein, 19 aa, Mycobacterium
KVSALLEALPKVGKVKAQE

SEQ ID NO: 782551 - protein, 26 aa, Mycobacterium
LADFAHRGWIRLEGKSVLISDSERLA

SEQ ID NO: 782552 - protein, 22 aa, Mycobacterium
LGIEFPIFAFTHCRDVVVAVSK

SEQ ID NO: 782553 - protein, 25 aa, Mycobacterium
LHNMRTMRFLPPEKQARKARETLEV

SEQ ID NO: 782554 - protein, 21 aa, Mycobacterium
LKRANAILKAASVFFAAELDR

SEQ ID NO: 782555 - protein, 25 aa, Mycobacterium
MTHLWDGLCSAYRILGFDSAAEGDN

SEQ ID NO: 782556 - protein, 25 aa, Mycobacterium
PDEVARYLFRRVVSWGRSSNVFLRN

SEQ ID NO: 782557 - protein, 28 aa, Mycobacterium
PEAIICFDGFHIMRWINRALDAVFSEAA

SEQ ID NO: 782558 - protein, 45 aa, Mycobacterium
PVAQLPLIAGERPPRVPLSFAQSRLWFLEQLQGPSAVYNIPVVLH

SEQ ID NO: 782559 - protein, 29 aa, Mycobacterium
PVNFVPVIDKDVRRWWRSDSLWQAHDARY

SEQ ID NO: 782560 - protein, 20 aa, Mycobacterium
QALAALPAPWRPDPSRGGGP

SEQ ID NO: 782561 - protein, 32 aa, Mycobacterium; identical to SEQ ID NO: 116847

SEQ ID NO: 782562 - protein, 18 aa, Mycobacterium
QMVSVATAMIPFLEHDDA

SEQ ID NO: 782563 - protein, 24 aa, Mycobacterium
RDECLNINSFWSLAQARVVIGDWK

SEQ ID NO: 782564 - protein, 24 aa, Mycobacterium
RGGLSATRFVACPFGAAGSRMYRT

SEQ ID NO: 782565 - protein, 25 aa, Mycobacterium
RISGKKGERIVYIRTLVTGKSSSAS

SEQ ID NO: 782566 - protein, 27 aa, Mycobacterium
RPEIAEQLLRVLARRLRRTNNNLADLI

SEQ ID NO: 782567 - protein, 20 aa, Mycobacterium
RRRRRWRHLDLGVKRLWLVN

SEQ ID NO: 782568 - protein, 23 aa, Mycobacterium
SDMFGELSIFDPGPRTSSATTIT

SEQ ID NO: 782569 - protein, 26 aa, Mycobacterium
SFVIDAYHQLWHIEKAFRMSKHDLQA

SEQ ID NO: 782570 - protein, 18 aa, Mycobacterium
SIKKFVRTARRYRTVKIK

SEQ ID NO: 782571 - protein, 28 aa, Mycobacterium
SYATVKRRLPIYAQPQWRQSLAAASARR

SEQ ID NO: 782572 - protein, 28 aa, Mycobacterium
TARTAGHPPTWVPLPVHYADYTLWHHQL

SEQ ID NO: 782573 - protein, 19 aa, Mycobacterium
TPQTLINIRPVVAAIKEFF

SEQ ID NO: 782574 - protein, 24 aa, Mycobacterium
VEALIGVFDKIGVKTGIDFFDIAD

SEQ ID NO: 782575 - protein, 19 aa, Mycobacterium
VIPPELRPMVQLDGGRFAT

SEQ ID NO: 782576 - protein, 19 aa, Mycobacterium
VMLAFQNHPWTQHDTPLAL

SEQ ID NO: 782577 - protein, 30 aa, Mycobacterium; identical to SEQ ID NO: 113110

SEQ ID NO: 782578 - protein, 21 aa, Mycobacterium
ANLPCHGFDPNAAWLEIVLAA

SEQ ID NO: 782579 - protein, 25 aa, Mycobacterium
ARTAGHPPAWVPLPVHYADYTLWHH

SEQ ID NO: 782580 - protein, 32 aa, Mycobacterium; identical to SEQ ID NO: 124558

SEQ ID NO: 782581 - protein, 18 aa, Mycobacterium
DEPPGTRMRVALSALTMA

SEQ ID NO: 782582 - protein, 32 aa, Mycobacterium; identical to SEQ ID NO: 113890

SEQ ID NO: 782583 - protein, 17 aa, Mycobacterium
DPNAAWLEIVLAAADLV

SEQ ID NO: 782584 - protein, 18 aa, Mycobacterium
DPVLGARPLRRTIQREIE

SEQ ID NO: 782585 - protein, 24 aa, Mycobacterium
DRLRTRFEWGLITDVQPPELETRI

SEQ ID NO: 782586 - protein, 29 aa, Mycobacterium
DTLVRMAQPWSLRYPLVDGQGNFGSPGND

SEQ ID NO: 782587 - protein, 24 aa, Mycobacterium
EDYTNRGRIITPLKDRFGAEIRTH

SEQ ID NO: 782588 - protein, 24 aa, Mycobacterium
EINTRGDIILFIDELHTLVGAGAA

SEQ ID NO: 782589 - protein, 26 aa, Mycobacterium
ESAQTLLENLFFKEKRYDLARVGRYK

SEQ ID NO: 782590 - protein, 23 aa, Mycobacterium
EVQADIRRKIEIGCYQGLRHRRG

SEQ ID NO: 782591 - protein, 27 aa, Mycobacterium
EWKDGEALFLRCNIWREAAENVAESLT

SEQ ID NO: 782592 - protein, 25 aa, Mycobacterium
FPKGVMWRHEDIYRVLFGGTDFATG

SEQ ID NO: 782593 - protein, 24 aa, Mycobacterium
FSTDPFTIDPIGLGGFTLPQISTP

SEQ ID NO: 782594 - protein, 25 aa, Mycobacterium
GHNYIGTEHILLGLIREGEGVAAQV

SEQ ID NO: 782595 - protein, 27 aa, Mycobacterium
HLGVGVTSIYWYFRKKDDLLNAMTDRA

SEQ ID NO: 782596 - protein, 18 aa, Mycobacterium
IDKGEFVFLIGPSGSGKS

SEQ ID NO: 782597 - protein, 25 aa, Mycobacterium
IKSATFAVHAPFAYGTLSVEQGTHR

SEQ ID NO: 782598 - protein, 18 aa, Mycobacterium
INMPVLDGVSVVTALRAM

SEQ ID NO: 782599 - protein, 28 aa, Mycobacterium
KRYTGRGMAFLDLIQEGNLGLIRAVEKF

SEQ ID NO: 782600 - protein, 20 aa, Mycobacterium
LGLPVVVRPSFTMGGLGSGM

SEQ ID NO: 782601 - protein, 26 aa, Mycobacterium
LKPVHRRVLYAMYDSGFRPDRSHAKS

SEQ ID NO: 782602 - protein, 18 aa, Mycobacterium
LLGLIREGEGVAAQVLVK

SEQ ID NO: 782603 - protein, 19 aa, Mycobacterium
LTEGMRFDKGYISGYFVTD

SEQ ID NO: 782604 - protein, 18 aa, Mycobacterium
MLTIVLRGEGFDTAVIGD

SEQ ID NO: 782605 - protein, 24 aa, Mycobacterium
NCPDILDVPLMAEVLRGLGATVEL

SEQ ID NO: 782606 - protein, 26 aa, Mycobacterium
NKLLGSFELTGIPPAPRGVPQIEVTF

SEQ ID NO: 782607 - protein, 18 aa, Mycobacterium
NSLLDINVFGRRAGIAAA

SEQ ID NO: 782608 - protein, 25 aa, Mycobacterium
PPTDTRAYFRGECLRRFGADIAAAS

SEQ ID NO: 782609 - protein, 25 aa, Mycobacterium
PTWKKSFGHHPLLAFLDRPEIAGGE

SEQ ID NO: 782610 - protein, 17 aa, Mycobacterium
QYALKDDVLYVLEANPR

SEQ ID NO: 782611 - protein, 26 aa, Mycobacterium
RIDVTVRISGFFRDAFPHVVTMLDDA

SEQ ID NO: 782612 - protein, 36 aa, Mycobacterium; identical to SEQ ID NO: 17410

SEQ ID NO: 782613 - protein, 19 aa, Mycobacterium
RKVSPLAVQMIMPNGAAAV

SEQ ID NO: 782614 - protein, 19 aa, Mycobacterium
RLTGRSPILLAGMTPTTVD

SEQ ID NO: 782615 - protein, 28 aa, Mycobacterium
RQEAVLEDPYILLVSSKVSTVKDLLPLL

SEQ ID NO: 782616 - protein, 23 aa, Mycobacterium
RSADLFLGVPFNIASYALLTHMM

SEQ ID NO: 782617 - protein, 26 aa, Mycobacterium
RYTGRGMPLLDLIQEGNLGLIRAMEK

SEQ ID NO: 782618 - protein, 19 aa, Mycobacterium
SATPIPRTLEMSLAGIREM

SEQ ID NO: 782619 - protein, 26 aa, Mycobacterium
SLTPLEFDLLVALARKPRQVFTRDVL

SEQ ID NO: 782620 - protein, 25 aa, Mycobacterium
SRQSLRSFYLQFDGKHELLLALFED

SEQ ID NO: 782621 - protein, 20 aa, Mycobacterium
TDYDTADRLYFEPLTFEDVL

SEQ ID NO: 782622 - protein, 19 aa, Mycobacterium
TGPIHIGGTRWAAVGDALG

SEQ ID NO: 782623 - protein, 19 aa, Mycobacterium
TGSARFRNLIKAEDYDTAL

SEQ ID NO: 782624 - protein, 18 aa, Mycobacterium
TGTGGTQGAGGQGGTGGT

SEQ ID NO: 782625 - protein, 23 aa, Mycobacterium
TTGRLIMQYASQNLIPVTLELGG

SEQ ID NO: 782626 - protein, 18 aa, Mycobacterium
VEMFRKLLDQGQAGDNVG

SEQ ID NO: 782627 - protein, 17 aa, Mycobacterium
VIKVVREIVSGLGLKEA

SEQ ID NO: 782628 - protein, 18 aa, Mycobacterium
VNFGAFVDLGGVDGLVHV

SEQ ID NO: 782629 - protein, 18 aa, Mycobacterium
VSPQLYIALGISGAIQHR

SEQ ID NO: 782630 - protein, 17 aa, Mycobacterium
YLIVRAGEFSRISDVLL

SEQ ID NO: 782631 - protein, 29 aa, Mycobacterium
AAIIAYNYPNQLALAKLAPALAAGCTVVL

SEQ ID NO: 782632 - protein, 18 aa, Mycobacterium
AHGIGVVGLLNVQYALKD

SEQ ID NO: 782633 - protein, 19 aa, Mycobacterium
AKRGFDPVLGARPLRRTIQ

SEQ ID NO: 782634 - protein, 25 aa, Mycobacterium
AKVGRIARVLGPRGLMPNPKTGTVT

SEQ ID NO: 782635 - protein, 26 aa, Mycobacterium
ARLSRRALRWALEALVCQHLSVARVA

SEQ ID NO: 782636 - protein, 22 aa, Mycobacterium
ATATYLVRMLRDIPGLTVTRIA

SEQ ID NO: 782637 - protein, 21 aa, Mycobacterium
ATTAWLIERLQRPTLVMAPNK

SEQ ID NO: 782638 - protein, 24 aa, Mycobacterium
AVGVVHSLWQPMAGRFKDYIAQPR

SEQ ID NO: 782639 - protein, 26 aa, Mycobacterium
AVLSRAQLLELVWGYDFAADTNVVDV

SEQ ID NO: 782640 - protein, 17 aa, Mycobacterium
CAGFLRRAAAYFARHGI

SEQ ID NO: 782641 - protein, 26 aa, Mycobacterium
DAVGRPETWKQAFYARDLAGTVVLVG

SEQ ID NO: 782642 - protein, 17 aa, Mycobacterium
DGRGLALFVSGDNLRKG

SEQ ID NO: 782643 - protein, 28 aa, Mycobacterium
DRDGSDAMRWFLMASPILRGGNLIVTEQ

SEQ ID NO: 782644 - protein, 23 aa, Mycobacterium
DRYINDRFLPDKAIDLIDEAGAR

SEQ ID NO: 782645 - protein, 17 aa, Mycobacterium
EAAFVDIGRGRNGVLYA

SEQ ID NO: 782646 - protein, 30 aa, Mycobacterium
EAELRAWLRRFSTDRPRWGWRRAAKMARRA

SEQ ID NO: 782647 - protein, 19 aa, Mycobacterium
EALVESALWEASLFEEHGF

SEQ ID NO: 782648 - protein, 18 aa, Mycobacterium
EERRLAYVGITRARQRLY

SEQ ID NO: 782649 - protein, 25 aa, Mycobacterium
EREYRTRLKTYLESQLEELGQRGSA

SEQ ID NO: 782650 - protein, 22 aa, Mycobacterium
ESMAMWPGAAVSGWYFSHPQSQ

SEQ ID NO: 782651 - protein, 23 aa, Mycobacterium
EVEALQLEYNWIKEFDPRFNVRY

SEQ ID NO: 782652 - protein, 25 aa, Mycobacterium
FAQAVIDAGLIWIGPSPQSIRDLGD

SEQ ID NO: 782653 - protein, 20 aa, Mycobacterium
FVACPFGGVGERMYRTGDLV

SEQ ID NO: 782654 - protein, 20 aa, Mycobacterium
GEPVSCFLLRIEDNMESIGR

SEQ ID NO: 782655 - protein, 29 aa, Mycobacterium
GERRRVALCKLLLSKPDLLLLDEPTNHLD

SEQ ID NO: 782656 - protein, 26 aa, Mycobacterium
GFPIAKIAAKLAIGYTLDEIVNDITK

SEQ ID NO: 782657 - protein, 31 aa, Mycobacterium; identical to SEQ ID NO: 114747

SEQ ID NO: 782658 - protein, 17 aa, Mycobacterium
GGRVKDLPGVRYKIIRG

SEQ ID NO: 782659 - protein, 21 aa, Mycobacterium
GPASLVLFDVSTLYFETDAGD

SEQ ID NO: 782660 - protein, 25 aa, Mycobacterium
GRLRDELLNLWRFDSLLEARVIIED

SEQ ID NO: 782661 - protein, 33 aa, Mycobacterium; identical to SEQ ID NO: 219115

SEQ ID NO: 782662 - protein, 24 aa, Mycobacterium
HNAVEYFVSYYDYYQPEAYIAQTD

SEQ ID NO: 782663 - protein, 17 aa, Mycobacterium
HNVAFSKPPIGKRGYNE

SEQ ID NO: 782664 - protein, 20 aa, Mycobacterium
IDDMAWMRQLLDWQREAADP

SEQ ID NO: 782665 - protein, 27 aa, Mycobacterium
IEVVKGGLILDIGLRGFLPASLVEMRR

SEQ ID NO: 782666 - protein, 18 aa, Mycobacterium
IQIDTTNVLFIVAGAFAG

SEQ ID NO: 782667 - protein, 20 aa, Mycobacterium
IRLIFQRAREKASEGTPVIV

SEQ ID NO: 782668 - protein, 19 aa, Mycobacterium
KAAEIAINSPLLEASMEGA

SEQ ID NO: 782669 - protein, 20 aa, Mycobacterium
KDKQLYTLDLGSLVAGSRYR

SEQ ID NO: 782670 - protein, 25 aa, Mycobacterium
KGKRYALPHARILMHQPLGGVTGSA

SEQ ID NO: 782671 - protein, 23 aa, Mycobacterium
KGPKIRIHKFKNKTGYHKRQGHR

SEQ ID NO: 782672 - protein, 22 aa, Mycobacterium
KNPRVTLHFTPTSGSWLNLVEV

SEQ ID NO: 782673 - protein, 18 aa, Mycobacterium
KYRDTVRDFWRGEPATLD

SEQ ID NO: 782674 - protein, 25 aa, Mycobacterium
LESLRYDLAVQEIFVFTPKGDVITL

SEQ ID NO: 782675 - protein, 17 aa, Mycobacterium
LGQRLPGYMVPAAVVVV

SEQ ID NO: 782676 - protein, 25 aa, Mycobacterium
LSRGMLEVLPLTHIRGRSLHDSFVI

SEQ ID NO: 782677 - protein, 19 aa, Mycobacterium
LTPEERLLRAIFGEKAREV

SEQ ID NO: 782678 - protein, 24 aa, Mycobacterium
MSPIRPNVIWAMDFQFDTTADGRT

SEQ ID NO: 782679 - protein, 28 aa, Mycobacterium
NPVREAIHAVFLFHAIKAGLDMGIVNAG

SEQ ID NO: 782680 - protein, 24 aa, Mycobacterium
NQSSGVIPIMKLLEDSFSYANQLG

SEQ ID NO: 782681 - protein, 26 aa, Mycobacterium
NRDKRSLVFPVKRLADLGFRVLATEG

SEQ ID NO: 782682 - protein, 19 aa, Mycobacterium
NRLARFLVGLGAGPGQRVA

SEQ ID NO: 782683 - protein, 18 aa, Mycobacterium
PDLVLRWAALLHDIGKPA

SEQ ID NO: 782684 - protein, 18 aa, Mycobacterium
PIYHHLRESIEAHLSIVV

SEQ ID NO: 782685 - protein, 26 aa, Mycobacterium
PTMYVNQPWTIRQYAGFSTAAESNAF

SEQ ID NO: 782686 - protein, 25 aa, Mycobacterium
PVIADIHFQPKYIFAAIDAGCAAVR

SEQ ID NO: 782687 - protein, 28 aa, Mycobacterium
QEIMTELEIAPTRRLRGLGDRQRKALLE

SEQ ID NO: 782688 - protein, 22 aa, Mycobacterium
RAIMEEVLLPVMYDIPSRDDVA

SEQ ID NO: 782689 - protein, 18 aa, Mycobacterium
RFTASRLFGAPPGYVGYE

SEQ ID NO: 782690 - protein, 19 aa, Mycobacterium
RGAGWNVIKVVWGREWDAL

SEQ ID NO: 782691 - protein, 29 aa, Mycobacterium
RIAQAQLVGWLEGLFHGIQTALFAQQMAA

SEQ ID NO: 782692 - protein, 18 aa, Mycobacterium
RMGALALHVAKIARRRHP

SEQ ID NO: 782693 - protein, 17 aa, Mycobacterium
RNVVLEKKWGAPTITND

SEQ ID NO: 782694 - protein, 17 aa, Mycobacterium
RRHGALGGLPPISRLQP

SEQ ID NO: 782695 - protein, 25 aa, Mycobacterium
RRSRGTPRIANRLLRRVRDFAEVRA

SEQ ID NO: 782696 - protein, 27 aa, Mycobacterium
RSDHAILAILAILKTGAAYLPIDPHHP

SEQ ID NO: 782697 - protein, 18 aa, Mycobacterium
RVLRRRGIPYLRDCDPMT

SEQ ID NO: 782698 - protein, 18 aa, Mycobacterium
SCPGPEAALALVGAARRL

SEQ ID NO: 782699 - protein, 25 aa, Mycobacterium
SDALPEPTFVPVLGRIAAGGPILAE

SEQ ID NO: 782700 - protein, 20 aa, Mycobacterium
STRTFPLRSSFAPSYNMTIN

SEQ ID NO: 782701 - protein, 28 aa, Mycobacterium
STVKDLLPLLEKVIQAGKPLLIIAEDVE

SEQ ID NO: 782702 - protein, 24 aa, Mycobacterium
TESTWHRWIAQYGGMKANEAKRLK

SEQ ID NO: 782703 - protein, 30 aa, Mycobacterium
TETRIVVTGNYRAWRHFIAMRASEHADVEI

SEQ ID NO: 782704 - protein, 31 aa, Mycobacterium
TFHGRLLMVQRYRAGWFKARIAEAMGVSRKC

SEQ ID NO: 782705 - protein, 24 aa, Mycobacterium
TIEDHQNSRWIAEPLRLLDCCQET

SEQ ID NO: 782706 - protein, 27 aa, Mycobacterium
TITEVYDYLRLLYARAGTPHCPVCGER

SEQ ID NO: 782707 - protein, 25 aa, Mycobacterium
TSDQEVRWCPGCGDYVILNTIRNFL

SEQ ID NO: 782708 - protein, 24 aa, Mycobacterium
VAALRSIGITPDALILRCDRDVPE

SEQ ID NO: 782709 - protein, 19 aa, Mycobacterium
VGLLNVQYALKDDVLYVLE

SEQ ID NO: 782710 - protein, 18 aa, Mycobacterium
VIIDLTPVRDGTGPARLL

SEQ ID NO: 782711 - protein, 24 aa, Mycobacterium
VMTQELLEFPGGVLGVALNLDEHS

SEQ ID NO: 782712 - protein, 26 aa, Mycobacterium
VPGAGVFVLDSWLRPVPPGTVGELYV

SEQ ID NO: 782713 - protein, 18 aa, Mycobacterium
VRAYANASAAMNLVRALT

SEQ ID NO: 782714 - protein, 17 aa, Mycobacterium
VRCRATVGEVGNAEQAN

SEQ ID NO: 782715 - protein, 22 aa, Mycobacterium
VRLPHGNGETIRLARGASLSDF

SEQ ID NO: 782716 - protein, 26 aa, Mycobacterium
WVRDSTFALWGLYTLGLDREADDFFA

SEQ ID NO: 782717 - protein, 20 aa, Mycobacterium
YDFFGIIFDGHPSLTRIEMP

SEQ ID NO: 782718 - protein, 19 aa, Mycobacterium
YHTFGGWKRSGFGDLNQHG

SEQ ID NO: 782719 - protein, 20 aa, Mycobacterium
YNKLFEERIIFLGVQVDDAS

SEQ ID NO: 782720 - protein, 19 aa, Mycobacterium
YYVQYAHARLSALARNAAE

SEQ ID NO: 782721 - protein, 23 aa, Mycobacterium
AEADHIASFALPIDDLDLTVRSY

SEQ ID NO: 782722 - protein, 18 aa, Mycobacterium
AFKWIQRAAMDRRTTMKR

SEQ ID NO: 782723 - protein, 37 aa, Mycobacterium
AGERPPRVPLSFAQSRLWFLEQLQGPSAVYNIPVVLH

SEQ ID NO: 782724 - protein, 18 aa, Mycobacterium
AGRLMFYGQGAGGAPTAS

SEQ ID NO: 782725 - protein, 24 aa, Mycobacterium
AGYVRKNSLWPATFGLACCAIEMM

SEQ ID NO: 782726 - protein, 18 aa, Mycobacterium
AIITGWDYPSCEAIGLLK

SEQ ID NO: 782727 - protein, 24 aa, Mycobacterium
AISAFIEGWNQRAHPFVWTKTADE

SEQ ID NO: 782728 - protein, 17 aa, Mycobacterium
AKGLEWDAVFLVGLADG

SEQ ID NO: 782729 - protein, 35 aa, Mycobacterium
ALFGHPSFRYYGWGPRMWWWAQTMGIRKFQEMVFT

SEQ ID NO: 782730 - protein, 20 aa, Mycobacterium
ANEILKAAAIFFGAELDRPA

SEQ ID NO: 782731 - protein, 17 aa, Mycobacterium
ANYFAAAAVLPYRQFHD

SEQ ID NO: 782732 - protein, 27 aa, Mycobacterium
APAMPAECLLDRNALIMGYSGVYSSFL

SEQ ID NO: 782733 - protein, 26 aa, Mycobacterium
APEHVHTYRITPLALWNARAAGHDAE

SEQ ID NO: 782734 - protein, 24 aa, Mycobacterium
APGFGDRRKAMLQDMAILTGGQVI

SEQ ID NO: 782735 - protein, 36 aa, Mycobacterium
AQVIDAIWRLRRSNKLFAVLGARKTWIVLRTNGLDV

SEQ ID NO: 782736 - protein, 17 aa, Mycobacterium
ARCAGCVPGWAPLAVQY

SEQ ID NO: 782737 - protein, 35 aa, Mycobacterium
ARERPARLPLSYAQTRLWFLHKYEGPSATYNIPLA

SEQ ID NO: 782738 - protein, 23 aa, Mycobacterium
ASATPLPVIGVPVPLARLDGLDS

SEQ ID NO: 782739 - protein, 28 aa, Mycobacterium
ASRRLPEGLAGIRLLHDLIAAHADDPAQ

SEQ ID NO: 782740 - protein, 24 aa, Mycobacterium
ATGLESTMRFILSAKSAYVDGQVF

SEQ ID NO: 782741 - protein, 17 aa, Mycobacterium
ATRSPIGKRNGWLSGLH

SEQ ID NO: 782742 - protein, 20 aa, Mycobacterium
AVVPLSFTQSGLWFLEQVQG

SEQ ID NO: 782743 - protein, 19 aa, Mycobacterium
CHAFFQFYVADGRLSCQLY

SEQ ID NO: 782744 - protein, 36 aa, Mycobacterium; identical to SEQ ID NO: 113659

SEQ ID NO: 782745 - protein, 21 aa, Mycobacterium
DAVRVFLTPESARQFATRSNR

SEQ ID NO: 782746 - protein, 18 aa, Mycobacterium
DDEFGFFVVMLAVAGNET

SEQ ID NO: 782747 - protein, 19 aa, Mycobacterium
DFTGRLCPAPCEPACVLGI

SEQ ID NO: 782748 - protein, 24 aa, Mycobacterium
DGKHELLLALFEDALSRSADQIRA

SEQ ID NO: 782749 - protein, 25 aa, Mycobacterium
DGTIKIEMNFLPDVYVPCEVCQGAR

SEQ ID NO: 782750 - protein, 24 aa, Mycobacterium
DHSGPLVTELLTEAGFVVDGVVAV

SEQ ID NO: 782751 - protein, 29 aa, Mycobacterium
DHYHDWDMLRANLLQLLIDGTVRPHEPAY

SEQ ID NO: 782752 - protein, 27 aa, Mycobacterium
DIAEEYYISFLLDRANRTYLAMCSVEG

SEQ ID NO: 782753 - protein, 17 aa, Mycobacterium
DIIAWECDYPHSDCFWP

SEQ ID NO: 782754 - protein, 19 aa, Mycobacterium
DILVDRMRREFKVEANVGK

SEQ ID NO: 782755 - protein, 29 aa, Mycobacterium
DITVNVDGFWMLQALLDIRHVAPELRCRP

SEQ ID NO: 782756 - protein, 19 aa, Mycobacterium
DKDDCAAIGLVKFDLLGLG

SEQ ID NO: 782757 - protein, 24 aa, Mycobacterium
DKEGRLILSKKRAQYERAWGTIEA

SEQ ID NO: 782758 - protein, 23 aa, Mycobacterium
DKNPLFLDEQLTRAEFQRITQDL

SEQ ID NO: 782759 - protein, 20 aa, Mycobacterium
DLAYWQHTLAGLPEHLPLPT

SEQ ID NO: 782760 - protein, 23 aa, Mycobacterium
DLHLGQVLRTPESWLLIDFEGEP

SEQ ID NO: 782761 - protein, 24 aa, Mycobacterium
DRATLRISSQLLANWLRHGVITEE

SEQ ID NO: 782762 - protein, 27 aa, Mycobacterium
DTKARVEDIYLPYKPKRRTKAQIAREA

SEQ ID NO: 782763 - protein, 39 aa, Mycobacterium
DTVVIYGDKSNWWAAYALWVFTLFGHPDVRLLNGGRDLW

SEQ ID NO: 782764 - protein, 17 aa, Mycobacterium
DVALGIGGLPRGRVIEI

SEQ ID NO: 782765 - protein, 25 aa, Mycobacterium
DVAVGTLYRYFPSKVHLLVSALGRE

SEQ ID NO: 782766 - protein, 19 aa, Mycobacterium
DVRTVLPPVLSIRNGRRSV

SEQ ID NO: 782767 - protein, 18 aa, Mycobacterium
DVVGLYLNPPERALVLCV

SEQ ID NO: 782768 - protein, 20 aa, Mycobacterium
DWTRLARRMSEISEAPLYID

SEQ ID NO: 782769 - protein, 20 aa, Mycobacterium
DWVIKRKLFQRYQDRYNMEL

SEQ ID NO: 782770 - protein, 17 aa, Mycobacterium
EAAWRGAFLAHGSLTEP

SEQ ID NO: 782771 - protein, 17 aa, Mycobacterium
EAEIRGHRRTYVGALPG

SEQ ID NO: 782772 - protein, 18 aa, Mycobacterium
EDGYLFIGGRSDDTIIRG

SEQ ID NO: 782773 - protein, 23 aa, Mycobacterium
EEVDKMVWATRWGADTIMDLSTG

SEQ ID NO: 782774 - protein, 17 aa, Mycobacterium
EGGGRLVVELTPDEAAA

SEQ ID NO: 782775 - protein, 27 aa, Mycobacterium
EGGQMPIHMRLPKLKGFRNRFRTEYEI

SEQ ID NO: 782776 - protein, 21 aa, Mycobacterium
EIRGHRRTYVGALPGRIVRAI

SEQ ID NO: 782777 - protein, 26 aa, Mycobacterium
EKAVKALWDTILPFAGYAFNKSHAAG

SEQ ID NO: 782778 - protein, 25 aa, Mycobacterium
ELGQPLPLFIKWDDAEYGLRAGEHG

SEQ ID NO: 782779 - protein, 18 aa, Mycobacterium
ELIGFFVNTLVLRTHTHP

SEQ ID NO: 782780 - protein, 23 aa, Mycobacterium
ELPMQMICILLGVPESERHWLFE

SEQ ID NO: 782781 - protein, 19 aa, Mycobacterium
ELRRIAALCAAFDVDGMRA

SEQ ID NO: 782782 - protein, 19 aa, Mycobacterium
ELVPVYPTCHYVMGGIPTT

SEQ ID NO: 782783 - protein, 18 aa, Mycobacterium
EMSPVTCMLLGEDAIRKR

SEQ ID NO: 782784 - protein, 25 aa, Mycobacterium
ERARAGLFLAMQYPVEVPGVSMSNF

SEQ ID NO: 782785 - protein, 24 aa, Mycobacterium
ERYGVPAHQLLHRAGQRKLIGGQE

SEQ ID NO: 782786 - protein, 19 aa, Mycobacterium
ESFKVLLKELQSLCLNVEV

SEQ ID NO: 782787 - protein, 23 aa, Mycobacterium
ETDKPFLMPVEDVFTITGRGTVV

SEQ ID NO: 782788 - protein, 24 aa, Mycobacterium
EVGPTLHRLIRGAEGRVIVACFAS

SEQ ID NO: 782789 - protein, 25 aa, Mycobacterium
FADEFHPELQFDKPYLLAMANAGPG

SEQ ID NO: 782790 - protein, 20 aa, Mycobacterium
FGDLVAMEAYRRSLLEQASG

SEQ ID NO: 782791 - protein, 20 aa, Mycobacterium
FIEHDSQGYRLIFENDYVTE

SEQ ID NO: 782792 - protein, 21 aa, Mycobacterium
FRTDFLTLTRGTGIANAVFDG

SEQ ID NO: 782793 - protein, 26 aa, Mycobacterium
FTYCPTWAGMVYVAFVIDAFARRVIG

SEQ ID NO: 782794 - protein, 19 aa, Mycobacterium
GCATPARVFKGTRMAGRMG

SEQ ID NO: 782795 - protein, 27 aa, Mycobacterium
GDECHMAFHFPLMPRIFMAVRRESRFP

SEQ ID NO: 782796 - protein, 21 aa, Mycobacterium
GDEHLAMLRRLMMDDSFFRGE

SEQ ID NO: 782797 - protein, 19 aa, Mycobacterium
GEFRKLWISRINAAARAND

SEQ ID NO: 782798 - protein, 23 aa, Mycobacterium
GEGKRLYPLTADRAKPAVPFGGA

SEQ ID NO: 782799 - protein, 17 aa, Mycobacterium
GGRLVVELTPDEAAALG

SEQ ID NO: 782800 - protein, 27 aa, Mycobacterium
GHSSLTLYIQLYLGGFGLELSDIESLR

SEQ ID NO: 782801 - protein, 27 aa, Mycobacterium
GIGCSSRFPYYLETYGFHSIHGRAPAI

SEQ ID NO: 782802 - protein, 25 aa, Mycobacterium
GIGFVFQHYAAFKHLTVRDNVAYGL

SEQ ID NO: 782803 - protein, 19 aa, Mycobacterium
GIRLRLFHGRGGTVGRGGG

SEQ ID NO: 782804 - protein, 19 aa, Mycobacterium
GLEWDAVFLVGLADGTLPI

SEQ ID NO: 782805 - protein, 23 aa, Mycobacterium
GLNLSIRDGWWDEWYDGENGWEI

SEQ ID NO: 782806 - protein, 20 aa, Mycobacterium
GLTAQRFVACPFGPAGSRMY

SEQ ID NO: 782807 - protein, 26 aa, Mycobacterium
GRIDPRTRWLLRELVYALLVKKDHAA

SEQ ID NO: 782808 - protein, 24 aa, Mycobacterium
GRLTAHLPSARRLLLFKADGSVSV

SEQ ID NO: 782809 - protein, 26 aa, Mycobacterium
GSIERFFGILTEHYAGAFPAWLAPVQ

SEQ ID NO: 782810 - protein, 29 aa, Mycobacterium
GSPIAAQLAYWQRVLAGMPERLALPTDRP

SEQ ID NO: 782811 - protein, 26 aa, Mycobacterium
GVDLDLPRDALIVFTGLSGSGKSSLA

SEQ ID NO: 782812 - protein, 28 aa, Mycobacterium
GVDYMTVHAGVLLRYVPLTAKRVTGIVS

SEQ ID NO: 782813 - protein, 24 aa, Mycobacterium
GVKGRVLPMCPIALQIEADVSGLE

SEQ ID NO: 782814 - protein, 22 aa, Mycobacterium
GVPDYLGWDWKSKAGIPIVCVP

SEQ ID NO: 782815 - protein, 23 aa, Mycobacterium
GVQGITDLITTPGLINVDFADVK

SEQ ID NO: 782816 - protein, 25 aa, Mycobacterium
HGAYPSTLGYKGFPKSCCTSLNEVI

SEQ ID NO: 782817 - protein, 19 aa, Mycobacterium
HHEMTFSMLYAFSENYVLP

SEQ ID NO: 782818 - protein, 27 aa, Mycobacterium
HPDADIYRSLPGLGVILGARVLGEFGD

SEQ ID NO: 782819 - protein, 21 aa, Mycobacterium
HPTLRLTTNLRIGLEGREARA

SEQ ID NO: 782820 - protein, 19 aa, Mycobacterium
IAMYLCRELTDLSLPKIGQ

SEQ ID NO: 782821 - protein, 35 aa, Mycobacterium
IEGRWATTMRFYAGPTLLVIDELGYLPLPAEAASA

SEQ ID NO: 782822 - protein, 25 aa, Mycobacterium
IETGYVMPHWPKPWGRAADAVEQLV

SEQ ID NO: 782823 - protein, 26 aa, Mycobacterium
IGGQEILFPALLPRAPYETTNRWTEY

SEQ ID NO: 782824 - protein, 23 aa, Mycobacterium
IGTLNWVDWFNNERPHEYLADLT

SEQ ID NO: 782825 - protein, 24 aa, Mycobacterium
ILDVLDNYAFVRTSGYLAGPHDVY

SEQ ID NO: 782826 - protein, 18 aa, Mycobacterium
INVDFADVKGIMSGAGTA

SEQ ID NO: 782827 - protein, 19 aa, Mycobacterium
IPHGLLFERFLNPERPSAP

SEQ ID NO: 782828 - protein, 17 aa, Mycobacterium
IPLRAVLFRVSADEHVL

SEQ ID NO: 782829 - protein, 32 aa, Mycobacterium
IRNRRLYDAIDQWAFCALTRSPGARQFYDHRR

SEQ ID NO: 782830 - protein, 18 aa, Mycobacterium
ITMSAPYLSQLRSGNRTN

SEQ ID NO: 782831 - protein, 20 aa, Mycobacterium
IVPGKVTKLVPFGAFVRVEE

SEQ ID NO: 782832 - protein, 27 aa, Mycobacterium
KEFMVRNTYIYPPKPSMRIISDIFAYT

SEQ ID NO: 782833 - protein, 34 aa, Mycobacterium
KFDYTKGYKFSTYATWWIRQAITRAMADQARTIR

SEQ ID NO: 782834 - protein, 26 aa, Mycobacterium
KGRLTLPAKFRDALAGGLMVTKSQDH

SEQ ID NO: 782835 - protein, 21 aa, Mycobacterium
KIADYPFTTLVPNLGVVSAGE

SEQ ID NO: 782836 - protein, 20 aa, Mycobacterium
KPGTYGAGLLQLIDSRNWRD

SEQ ID NO: 782837 - protein, 17 aa, Mycobacterium
KSNILMLGPTGCGKTYL

SEQ ID NO: 782838 - protein, 21 aa, Mycobacterium
KTLGVPLFQEQLMQLAVDCAG

SEQ ID NO: 782839 - protein, 20 aa, Mycobacterium
KVVDLLTPYVRGGKIALFGG

SEQ ID NO: 782840 - protein, 21 aa, Mycobacterium
KWGQLSNVVLLLPHGHEGQGP

SEQ ID NO: 782841 - protein, 18 aa, Mycobacterium
LCTGVAFPAFPALLAAEQ

SEQ ID NO: 782842 - protein, 27 aa, Mycobacterium
LDALARAGFHTLKLQTYLTAGPKEARA

SEQ ID NO: 782843 - protein, 28 aa, Mycobacterium
LGVDLSVRVLFEWPTVAGLASCVGGVSG

SEQ ID NO: 782844 - protein, 17 aa, Mycobacterium
LIQVMLAFQNHPWTQHT

SEQ ID NO: 782845 - protein, 29 aa, Mycobacterium
LKEYASRGTWIWPPEPSLRLIADTIEFCA

SEQ ID NO: 782846 - protein, 23 aa, Mycobacterium
LKGHPLFAHITLLRSERSPIAAL

SEQ ID NO: 782847 - protein, 19 aa, Mycobacterium
LNLEYKLEVWDSPNSAGVI

SEQ ID NO: 782848 - protein, 19 aa, Mycobacterium
LNRAPTLHRLGIQAFEPML

SEQ ID NO: 782849 - protein, 18 aa, Mycobacterium
LRCIGCGLCIEACPTRAL

SEQ ID NO: 782850 - protein, 18 aa, Mycobacterium
LRNLFKLSSLASFEGQLG

SEQ ID NO: 782851 - protein, 21 aa, Mycobacterium
LSVREVTGVPILFASTGEKLE

SEQ ID NO: 782852 - protein, 26 aa, Mycobacterium
LTLRNRALLELLYSTGARISEAVGLD

SEQ ID NO: 782853 - protein, 18 aa, Mycobacterium
LVARRRGISVLGDRPPMV

SEQ ID NO: 782854 - protein, 19 aa, Mycobacterium
LVDRFFEARKMMSSMLGGM

SEQ ID NO: 782855 - protein, 17 aa, Mycobacterium
LWHHQLLGDPHDPASLL

SEQ ID NO: 782856 - protein, 19 aa, Mycobacterium
LWQIVEFQHVKPGKGPAFV

SEQ ID NO: 782857 - protein, 19 aa, Mycobacterium
MASVKWELEDLSFAILHPK

SEQ ID NO: 782858 - protein, 19 aa, Mycobacterium
MDYLKEGIGLRAMAQRDPL

SEQ ID NO: 782859 - protein, 25 aa, Mycobacterium
MLVAGEDPRFVARRLMILASEDIGM

SEQ ID NO: 782860 - protein, 20 aa, Mycobacterium
MNHLAFHVPAEKFDAYRQRL

SEQ ID NO: 782861 - protein, 25 aa, Mycobacterium
MPGFTTISMYPRMWAASGVDYPTLL

SEQ ID NO: 782862 - protein, 17 aa, Mycobacterium
MVSIYDCYTITVLLSLE

SEQ ID NO: 782863 - protein, 21 aa, Mycobacterium
NEHIHAVMWAARRSGLYYVPI

SEQ ID NO: 782864 - protein, 19 aa, Mycobacterium
NHNYIGTEHILLGLIHEGE

SEQ ID NO: 782865 - protein, 23 aa, Mycobacterium
NLHVHGHSPSWQKIYPGATTVEL

SEQ ID NO: 782866 - protein, 24 aa, Mycobacterium
NTDNMFGFWDWVGGRYSVDSAIGL

SEQ ID NO: 782867 - protein, 19 aa, Mycobacterium
NVLPSMEAAFVDIGRGRNG

SEQ ID NO: 782868 - protein, 29 aa, Mycobacterium
NVTDMAHFFYIHFGLPTYFKNVFEGHIAS

SEQ ID NO: 782869 - protein, 19 aa, Mycobacterium
PAVKRWLTGHPRFVLHFTP

SEQ ID NO: 782870 - protein, 23 aa, Mycobacterium
PDNEFRVVLARRGQHWVSAVRVG

SEQ ID NO: 782871 - protein, 17 aa, Mycobacterium
PEIGHACGHNIIAASAV

SEQ ID NO: 782872 - protein, 19 aa, Mycobacterium
PEIVWYLDEPVADPALVPL

SEQ ID NO: 782873 - protein, 25 aa, Mycobacterium
PGAGVFVLDGWLRPVPPGTVGELYV

SEQ ID NO: 782874 - protein, 25 aa, Mycobacterium
PGMNEIVFPAAILQPPFFDAEADDA

SEQ ID NO: 782875 - protein, 26 aa, Mycobacterium
PGPFDAYLTMRGLKTLVLRMQRHSEN

SEQ ID NO: 782876 - protein, 19 aa, Mycobacterium
PGPHLLVLARGPEGYRRLS

SEQ ID NO: 782877 - protein, 20 aa, Mycobacterium
PIGKRNGWLSGLHATELLGA

SEQ ID NO: 782878 - protein, 24 aa, Mycobacterium
PKEHFDFFPLTVDVEERMYAAGRI

SEQ ID NO: 782879 - protein, 20 aa, Mycobacterium
PKPFALEELLARMRALLRRT

SEQ ID NO: 782880 - protein, 19 aa, Mycobacterium
PLDLTYKEFELLKYLAQHA

SEQ ID NO: 782881 - protein, 20 aa, Mycobacterium
PLRMLRAARFVSQLGFTVAP

SEQ ID NO: 782882 - protein, 17 aa, Mycobacterium
PLTVAVLLRITEVFGVD

SEQ ID NO: 782883 - protein, 19 aa, Mycobacterium
PPSPHDLAYLIYTSGTTGT

SEQ ID NO: 782884 - protein, 35 aa, Mycobacterium; identical to SEQ ID NO: 121775

SEQ ID NO: 782885 - protein, 17 aa, Mycobacterium
PVVASIARKLGALTVGV

SEQ ID NO: 782886 - protein, 18 aa, Mycobacterium
PYSARELIARIRAVLRRG

SEQ ID NO: 782887 - protein, 19 aa, Mycobacterium
QALAALPAPWRPDSSRGGD

SEQ ID NO: 782888 - protein, 26 aa, Mycobacterium
QALNRTQPVFPMLPGTPARASHDYVR

SEQ ID NO: 782889 - protein, 22 aa, Mycobacterium
QEPTVLPSRFPNLLANGSGGIA

SEQ ID NO: 782890 - protein, 20 aa, Mycobacterium
QLTMRVFTGLTLLDTIQGTV

SEQ ID NO: 782891 - protein, 25 aa, Mycobacterium
QMEYMLPRLRGWGESMSRQAGGRAG

SEQ ID NO: 782892 - protein, 20 aa, Mycobacterium
QQIQQLVVARRLLGLSSAEL

SEQ ID NO: 782893 - protein, 17 aa, Mycobacterium
QSGLWFLEQVQGPSAVY

SEQ ID NO: 782894 - protein, 31 aa, Mycobacterium; identical to SEQ ID NO: 116941

SEQ ID NO: 782895 - protein, 28 aa, Mycobacterium
RALELGCGTGFFLLNLIQSGVARRGSVT

SEQ ID NO: 782896 - protein, 29 aa, Mycobacterium
RDEAGQDVLLFIDNIFRFTQAGSEVSTLL

SEQ ID NO: 782897 - protein, 20 aa, Mycobacterium
RDRLVVIIAGYRADLDKFLD

SEQ ID NO: 782898 - protein, 25 aa, Mycobacterium
RGGKVWINIFPDRPLTKKPAETRMG

SEQ ID NO: 782899 - protein, 18 aa, Mycobacterium
RGHDYTDLALVTDGLRAE

SEQ ID NO: 782900 - protein, 18 aa, Mycobacterium
RGSDGQWRLSPKAMRRLG

SEQ ID NO: 782901 - protein, 28 aa, Mycobacterium
RIASPPVKWPCFYGIDFPSPAELIANAV

SEQ ID NO: 782902 - protein, 17 aa, Mycobacterium
RIFGSKPGTYGAGLLQL

SEQ ID NO: 782903 - protein, 21 aa, Mycobacterium
RLCPAPCEPACVLGINQDPVT

SEQ ID NO: 782904 - protein, 26 aa, Mycobacterium
RLDGLDSLLSIVQMPAGVPVATVSIG

SEQ ID NO: 782905 - protein, 25 aa, Mycobacterium
RLRIGHLVLCDAFRHPAVLAKQAVT

SEQ ID NO: 782906 - protein, 30 aa, Mycobacterium; identical to SEQ ID NO: 122186

SEQ ID NO: 782907 - protein, 18 aa, Mycobacterium
RLVVELTPDEAAALGDEL

SEQ ID NO: 782908 - protein, 19 aa, Mycobacterium
RMCRDEFLHYLRIREWQDL

SEQ ID NO: 782909 - protein, 23 aa, Mycobacterium
RNRLNLALTLKQGGNLILLDEPT

SEQ ID NO: 782910 - protein, 34 aa, Mycobacterium
RPALVPLSFAQSRLWFLEQLQGPSAVYNIPVVLH

SEQ ID NO: 782911 - protein, 19 aa, Mycobacterium
RPDTLFGATYLVLAPEHDL

SEQ ID NO: 782912 - protein, 20 aa, Mycobacterium
RRVIGWRAATSMKTALVIDA

SEQ ID NO: 782913 - protein, 23 aa, Mycobacterium
RSARLVVALLAIAKTGAAYLPID

SEQ ID NO: 782914 - protein, 18 aa, Mycobacterium
RSPWAPIVFGTQAPDTGN

SEQ ID NO: 782915 - protein, 18 aa, Mycobacterium
RVKDLPGVRYKIIRGSLD

SEQ ID NO: 782916 - protein, 24 aa, Mycobacterium
RVVDKLLHAPTVRIKQLASAPGGD

SEQ ID NO: 782917 - protein, 20 aa, Mycobacterium
RVYAKSTNLPRVLGGLGVAI

SEQ ID NO: 782918 - protein, 27 aa, Mycobacterium
RWLTGHPRFVLHFTPTSSSWLNLVERW

SEQ ID NO: 782919 - protein, 18 aa, Mycobacterium
RYFLDNVAEWILELDRGR

SEQ ID NO: 782920 - protein, 25 aa, Mycobacterium
SAKRITAVMPFYPYARQDKKHRGRE

SEQ ID NO: 782921 - protein, 17 aa, Mycobacterium
SDYLAGRAFSFISAIDS

SEQ ID NO: 782922 - protein, 25 aa, Mycobacterium
SEGGIGWIPFYLDRSDRHYTNQKWL

SEQ ID NO: 782923 - protein, 24 aa, Mycobacterium
SEPLTEAIPLWKRPQDGAIITGWD

SEQ ID NO: 782924 - protein, 27 aa, Mycobacterium
SGGSFIYVPPGVHVDIPLQAYFRINTE

SEQ ID NO: 782925 - protein, 28 aa, Mycobacterium
SGGVDSTALYPPKRFLGAARNIEEGGSL

SEQ ID NO: 782926 - protein, 29 aa, Mycobacterium
SGRTVGVLANNPLRLGGCLNSESAEKAAR

SEQ ID NO: 782927 - protein, 23 aa, Mycobacterium
SINLPYITVDADKNPLFLDEQLT

SEQ ID NO: 782928 - protein, 26 aa, Mycobacterium
SRAAGDGFARYWLHNGWVTMGGEKMS

SEQ ID NO: 782929 - protein, 22 aa, Mycobacterium
SSLAFDTIFAEGQRRYVESLSA

SEQ ID NO: 782930 - protein, 24 aa, Mycobacterium
STEYDVERYFRDAPLMIVGEGTNE

SEQ ID NO: 782931 - protein, 17 aa, Mycobacterium
SWPPGTRLILRKERPHP

SEQ ID NO: 782932 - protein, 29 aa, Mycobacterium
TAEDGAGWLTFWRSLTARGLSGVKLVTSD

SEQ ID NO: 782933 - protein, 17 aa, Mycobacterium
TCMLLGEDAIRKRGSVG

SEQ ID NO: 782934 - protein, 22 aa, Mycobacterium
TDFGAFVSLLPGRDGLVHISKL

SEQ ID NO: 782935 - protein, 23 aa, Mycobacterium
TETLEPVQMLPAPAQGALAVECR

SEQ ID NO: 782936 - protein, 25 aa, Mycobacterium
TFRDHYLDLDLDLSDVVFLATANVI

SEQ ID NO: 782937 - protein, 21 aa, Mycobacterium
TGAKEILCIRVLGGSSRRYAG

SEQ ID NO: 782938 - protein, 18 aa, Mycobacterium
THHPLIQVMLAFQNHPWT

SEQ ID NO: 782939 - protein, 26 aa, Mycobacterium
TIDVAYRYFATPKRKFIIADTPGHIQ

SEQ ID NO: 782940 - protein, 19 aa, Mycobacterium
TIRIPVHMVEVINKLGRIQ

SEQ ID NO: 782941 - protein, 17 aa, Mycobacterium
TIRLPVHLVEQVNKLAR

SEQ ID NO: 782942 - protein, 18 aa, Mycobacterium
TIVFCGVHFMAETAKILS

SEQ ID NO: 782943 - protein, 33 aa, Mycobacterium; identical to SEQ ID NO: 117916

SEQ ID NO: 782944 - protein, 22 aa, Mycobacterium
TRAMPAYNWMTVAKSALESVNR

SEQ ID NO: 782945 - protein, 18 aa, Mycobacterium
TRITTVLGILKAYTTRVG

SEQ ID NO: 782946 - protein, 26 aa, Mycobacterium
TRRWNPKMKRFIFTDRNGIYIIDLQQ

SEQ ID NO: 782947 - protein, 27 aa, Mycobacterium
TSDEALARVFDYTLAIGKTPIVVNDSR

SEQ ID NO: 782948 - protein, 22 aa, Mycobacterium
TSVLTPTFRYNPAVIAQAFATM

SEQ ID NO: 782949 - protein, 23 aa, Mycobacterium
TTTGVLRLYQFAAAGDLAFPAIN

SEQ ID NO: 782950 - protein, 28 aa, Mycobacterium
TVDAVTFDLRWKAACGLPITAGAFHSTT

SEQ ID NO: 782951 - protein, 29 aa, Mycobacterium
TVGAFDLPGLTLPPLTIPAATTPANITVG

SEQ ID NO: 782952 - protein, 18 aa, Mycobacterium
TYAAPLFVTAEFINNNTG

SEQ ID NO: 782953 - protein, 19 aa, Mycobacterium
VATAMIPFLEHDDANRALM

SEQ ID NO: 782954 - protein, 25 aa, Mycobacterium
VDVFKEKLIRRDISMKAFDAGEPQA

SEQ ID NO: 782955 - protein, 18 aa, Mycobacterium
VEALDRHRLLSDVTRVLA

SEQ ID NO: 782956 - protein, 21 aa, Mycobacterium
VELSTIRLLAKLPTIAAYAYK

SEQ ID NO: 782957 - protein, 18 aa, Mycobacterium
VFDGYRPWAGEIRARHTG

SEQ ID NO: 782958 - protein, 26 aa, Mycobacterium
VFIMGDCDQLMPEYLRFVKGVVDAQD

SEQ ID NO: 782959 - protein, 30 aa, Mycobacterium; identical to SEQ ID NO: 118259

SEQ ID NO: 782960 - protein, 17 aa, Mycobacterium
VKVWIYKGDIVGGKREL

SEQ ID NO: 782961 - protein, 24 aa, Mycobacterium
VQFHPTGMVWPPSVKGILVTEGVR

SEQ ID NO: 782962 - protein, 21 aa, Mycobacterium
VRDVIGLYLNPPEKAVVLCVD

SEQ ID NO: 782963 - protein, 25 aa, Mycobacterium
VRGLPQLSSAPVWCSDIRAGAGLVL

SEQ ID NO: 782964 - protein, 21 aa, Mycobacterium
VRMIEAYHRLSKLNEYSAIDF

SEQ ID NO: 782965 - protein, 29 aa, Mycobacterium
VSLSPTEFTLLRYFVINAGTVLSKPKILD

SEQ ID NO: 782966 - protein, 28 aa, Mycobacterium
VSMTMNGAVLPILALYVVAAEEQGVPPE

SEQ ID NO: 782967 - protein, 31 aa, Mycobacterium; identical to SEQ ID NO: 118502

SEQ ID NO: 782968 - protein, 30 aa, Mycobacterium
VVVGPDRPILRWRKRKWLCPSTVCTRKVFT

SEQ ID NO: 782969 - protein, 21 aa, Mycobacterium
WGNQMRSYVLHPYQMVKDLRT

SEQ ID NO: 782970 - protein, 26 aa, Mycobacterium
WLNLVEVFFSIITRQAIRRGSFNSVK

SEQ ID NO: 782971 - protein, 32 aa, Mycobacterium; identical to SEQ ID NO: 123357

SEQ ID NO: 782972 - protein, 17 aa, Mycobacterium
YTLWHHQLLGDPHDPAS

SEQ ID NO: 782973 - protein, 17 aa, Mycobacterium
AAALRRELLRDGQAFYV

SEQ ID NO: 782974 - protein, 24 aa, Mycobacterium
AAAVDVTLLGRFYERFADHAVEVA

SEQ ID NO: 782975 - protein, 17 aa, Mycobacterium
AADFFDIDGIPGAPPGL

SEQ ID NO: 782976 - protein, 18 aa, Mycobacterium
AAGAAVAALAAGLGGQQR

SEQ ID NO: 782977 - protein, 23 aa, Mycobacterium
AAKGKELVWAPAAFRYVMMVLRH

SEQ ID NO: 782978 - protein, 25 aa, Mycobacterium
AALGNLPLIYPFLVNDPGEGTQAKR

SEQ ID NO: 782979 - protein, 24 aa, Mycobacterium
AASDAFFPFPDGLETLTAAGVKAI

SEQ ID NO: 782980 - protein, 26 aa, Mycobacterium
AASGCVLLPGLPYLGLEHRAAWVEAE

SEQ ID NO: 782981 - protein, 21 aa, Mycobacterium
AAVAALAAGLGGQQRVSACSA

SEQ ID NO: 782982 - protein, 19 aa, Mycobacterium
ADGSTACGCWIYSGVYADE

SEQ ID NO: 782983 - protein, 22 aa, Mycobacterium
ADVFVHYTEIQGSGFRTLEENQ

SEQ ID NO: 782984 - protein, 25 aa, Mycobacterium
ADVSIAFVPPAFSKDAIIEAIDAEI

SEQ ID NO: 782985 - protein, 29 aa, Mycobacterium
AEALAYGDMGLALPILAPGGVASALTHWG

SEQ ID NO: 782986 - protein, 27 aa, Mycobacterium
AEEKFGFLLEAFTFGAPPHGGIAFGWD

SEQ ID NO: 782987 - protein, 23 aa, Mycobacterium
AEIVTWMSVAPALRDGWEDSILQ

SEQ ID NO: 782988 - protein, 26 aa, Mycobacterium
AEQELLLAPEFFSALPQYLPDIAAVD

SEQ ID NO: 782989 - protein, 32 aa, Mycobacterium
AFVNALPVFIASDPVWAKKFADAGVPIVGDDI

SEQ ID NO: 782990 - protein, 25 aa, Mycobacterium
AGAPDRLWVADFTYCRTRAGWAYTA

SEQ ID NO: 782991 - protein, 24 aa, Mycobacterium
AGIERVRATLPRLGELAIGGTAVG

SEQ ID NO: 782992 - protein, 25 aa, Mycobacterium
AGITCAVLIPQGKIAMGKLAQAVMH

SEQ ID NO: 782993 - protein, 27 aa, Mycobacterium
AGLRSLLAYQWAHPGKQLLFMGQEFGQ

SEQ ID NO: 782994 - protein, 21 aa, Mycobacterium
AGMHPWGKWGRDFTEYGVVAA

SEQ ID NO: 782995 - protein, 22 aa, Mycobacterium
AGNKIILFGARTGLDGIGGVSV

SEQ ID NO: 782996 - protein, 23 aa, Mycobacterium
AGSLRLDLSQYRELEAFAAFASD

SEQ ID NO: 782997 - protein, 20 aa, Mycobacterium
AKNDFGLVAIDTLLARMEND

SEQ ID NO: 782998 - protein, 22 aa, Mycobacterium
AKRLVDFAAGLAFALRGSFDKV

SEQ ID NO: 782999 - protein, 28 aa, Mycobacterium
ALAFKVATHPFFGKLTYVRVYSGKVDSG

SEQ ID NO: 783000 - protein, 24 aa, Mycobacterium
ALAVDPEVLLLDEPFGALDAKVRE

SEQ ID NO: 783001 - protein, 19 aa, Mycobacterium
ALENTRFWAPLSLTAEQKH

SEQ ID NO: 783002 - protein, 20 aa, Mycobacterium
ALGIMGKAHALLESLSESAD

SEQ ID NO: 783003 - protein, 25 aa, Mycobacterium
ALGKNLLVAIMPWEGHNYEDAIILS

SEQ ID NO: 783004 - protein, 19 aa, Mycobacterium
ALIALYRNIAGEHPDWDEY

SEQ ID NO: 783005 - protein, 20 aa, Mycobacterium
ALLDEAGVTVTRFVRFEVGQ

SEQ ID NO: 783006 - protein, 18 aa, Mycobacterium
ALLRRLVEAGTRVVQYGY

SEQ ID NO: 783007 - protein, 17 aa, Mycobacterium
ALPEIGHACGHNIIAAS

SEQ ID NO: 783008 - protein, 19 aa, Mycobacterium
ALWEASLFEEHGFGDIKIS

SEQ ID NO: 783009 - protein, 26 aa, Mycobacterium
AMLGQPVSMLIPRVVGFKLTGEIQPG

SEQ ID NO: 783010 - protein, 23 aa, Mycobacterium
AMSKFEVLTAMAFAAFADAPVDV

SEQ ID NO: 783011 - protein, 24 aa, Mycobacterium
ANAAVLHALMTPGERLLGLDLANG

SEQ ID NO: 783012 - protein, 17 aa, Mycobacterium
ANIRLRNQLLDDVSGGY

SEQ ID NO: 783013 - protein, 21 aa, Mycobacterium
ANYVNLLSKTALMQGFNALDQ

SEQ ID NO: 783014 - protein, 20 aa, Mycobacterium
APAHDWLTLTGGAIGYGIPA

SEQ ID NO: 783015 - protein, 25 aa, Mycobacterium
AQGIPPQFLVDILTNLRTDRLVRSH

SEQ ID NO: 783016 - protein, 25 aa, Mycobacterium
AQMGKDGWLTLNWPKEYGGQDRSPM

SEQ ID NO: 783017 - protein, 19 aa, Mycobacterium
AQRTVLCKDPFRAVDERVK

SEQ ID NO: 783018 - protein, 23 aa, Mycobacterium
ARALAADPPILLMDEPFSAVDPV

SEQ ID NO: 783019 - protein, 19 aa, Mycobacterium
ARAWVSAYVSWYNQHHRHS

SEQ ID NO: 783020 - protein, 24 aa, Mycobacterium
ARDFLVPARLHPGSFYALPQSPQL

SEQ ID NO: 783021 - protein, 21 aa, Mycobacterium
ARIALHVRVLYGRDPHHITEA

SEQ ID NO: 783022 - protein, 25 aa, Mycobacterium
ARLQDLGFYTGLVDGYFGLQTHNAL

SEQ ID NO: 783023 - protein, 27 aa, Mycobacterium
ARPDLLAFTAFPKQIWRQIWSNNPQER

SEQ ID NO: 783024 - protein, 19 aa, Mycobacterium
ARRMSEISEAPLYIDDSPN

SEQ ID NO: 783025 - protein, 25 aa, Mycobacterium
ARSVFNRFPYLEPLNHLQVELLRRY

SEQ ID NO: 783026 - protein, 26 aa, Mycobacterium
ARTFGMDSWFPSLKIYNRNGQLYTAV

SEQ ID NO: 783027 - protein, 18 aa, Mycobacterium
ARTTLYRHFSSSTQLLAA

SEQ ID NO: 783028 - protein, 18 aa, Mycobacterium
ARYILPSFIEHSSFGVKE

SEQ ID NO: 783029 - protein, 25 aa, Mycobacterium
ASDSAGFKWLAPYTGSAIAQHWMYD

SEQ ID NO: 783030 - protein, 22 aa, Mycobacterium
ASGCVLLPGLPHLGLEHRAAWV

SEQ ID NO: 783031 - protein, 34 aa, Mycobacterium
ASGVGGRLYSGNGIPDIFGRPLIGDGADGAPGTG

SEQ ID NO: 783032 - protein, 25 aa, Mycobacterium
ATGLRPFDVQLLGALRMLAGDVIEM

SEQ ID NO: 783033 - protein, 24 aa, Mycobacterium
ATMKRLFLELGGKSATIVLEDADF

SEQ ID NO: 783034 - protein, 36 aa, Mycobacterium
ATPLQDLLNVVNAPTQALLGRPLIGDGADGTAPGQA

SEQ ID NO: 783035 - protein, 23 aa, Mycobacterium
AVASFYTMYRRGPTGDYLVGVCT

SEQ ID NO: 783036 - protein, 20 aa, Mycobacterium
AVLHTLNIRLAPEQLAYIAN

SEQ ID NO: 783037 - protein, 19 aa, Mycobacterium
AVLPILHLNGYKIANPTVL

SEQ ID NO: 783038 - protein, 25 aa, Mycobacterium
AVLPVYDPLFDSKKLRHVLVRHEQG

SEQ ID NO: 783039 - protein, 25 aa, Mycobacterium
AVLPVYDPLFDSQKLRHVLVRHEQG

SEQ ID NO: 783040 - protein, 23 aa, Mycobacterium
AVLTTRIYCRPSCPVRPPFARNV

SEQ ID NO: 783041 - protein, 24 aa, Mycobacterium
AVNAGARYIFAIDPVEWKRDQALK

SEQ ID NO: 783042 - protein, 26 aa, Mycobacterium
AVNYPLYVIMSLLGLPEADFPRMLKL

SEQ ID NO: 783043 - protein, 34 aa, Mycobacterium
AVVANLPYNVAVPALLHLLAEFPSIRVVTVMVQA

SEQ ID NO: 783044 - protein, 21 aa, Mycobacterium
AYLIDQPLMRNVLADLAVEAE

SEQ ID NO: 783045 - protein, 22 aa, Mycobacterium
CFLESDLFNQGVRPAINVGVSV

SEQ ID NO: 783046 - protein, 21 aa, Mycobacterium
CGAEPLFLQDYIAVGRTVPER

SEQ ID NO: 783047 - protein, 25 aa, Mycobacterium
CGGQATIPIVYAVSRAVADLGGVPY

SEQ ID NO: 783048 - protein, 27 aa, Mycobacterium
CMDNGMPILVFNLLTNGNIARAVAGEK

SEQ ID NO: 783049 - protein, 22 aa, Mycobacterium
CPLWNVYETFANPGKILVQIAQ

SEQ ID NO: 783050 - protein, 21 aa, Mycobacterium
DAEIPLLVVITEGIPVQDSAY

SEQ ID NO: 783051 - protein, 25 aa, Mycobacterium
DAFGIPLVVVVDVPGYLPGVDQEWG

SEQ ID NO: 783052 - protein, 17 aa, Mycobacterium
DAMLLPIAEDMDPVLAT

SEQ ID NO: 783053 - protein, 26 aa, Mycobacterium
DAQPLPALSDLYLPGAPIGSLAGYVN

SEQ ID NO: 783054 - protein, 18 aa, Mycobacterium
DAVITVPAYFNDAQRQAT

SEQ ID NO: 783055 - protein, 17 aa, Mycobacterium
DDGFFVKALHSIGAPLE

SEQ ID NO: 783056 - protein, 27 aa, Mycobacterium
DDPHKVAMLGLTFDDVLLLPAASDVVP

SEQ ID NO: 783057 - protein, 17 aa, Mycobacterium
DDYLPKPFALEELLARM

SEQ ID NO: 783058 - protein, 32 aa, Mycobacterium; identical to SEQ ID NO: 119404

SEQ ID NO: 783059 - protein, 21 aa, Mycobacterium
DEALLDIYRKLRPGEPPTKES

SEQ ID NO: 783060 - protein, 23 aa, Mycobacterium
DEFEALLLEFLGEAAVTVPELGT

SEQ ID NO: 783061 - protein, 23 aa, Mycobacterium
DEVPLNFLNPRPGTPFGDLEVLP

SEQ ID NO: 783062 - protein, 24 aa, Mycobacterium
DEVVDVVLLWWRDGDGDLVDTLMD

SEQ ID NO: 783063 - protein, 23 aa, Mycobacterium
DFEKTLRFWLERGVDGFRIDVAH

SEQ ID NO: 783064 - protein, 24 aa, Mycobacterium
DGAPAWLRFFGCNPRHHSLAFLPL

SEQ ID NO: 783065 - protein, 26 aa, Mycobacterium
DGGQFREWLGLLDPDIRYVVPVRTTR

SEQ ID NO: 783066 - protein, 34 aa, Mycobacterium; identical to SEQ ID NO: 113787

SEQ ID NO: 783067 - protein, 24 aa, Mycobacterium
DGRTYGHPIVLRPVSSEDAMTADW

SEQ ID NO: 783068 - protein, 26 aa, Mycobacterium
DGSDTVTLVWLGQRRIPGIDSGRTLR

SEQ ID NO: 783069 - protein, 40 aa, Mycobacterium
DIGAYPTPYPVLTTAAIGMFFPGPYRVPKASFNYKTVFSN

SEQ ID NO: 783070 - protein, 24 aa, Mycobacterium
DIRESIHLRALGRQNPLDEFHRLA

SEQ ID NO: 783071 - protein, 24 aa, Mycobacterium
DKEGRLILSKKRAQYERAWGTIEE

SEQ ID NO: 783072 - protein, 22 aa, Mycobacterium
DKGCPMVLGGPLSHVMAAKAVA

SEQ ID NO: 783073 - protein, 19 aa, Mycobacterium
DLLWSRPIKEYPDLKIALS

SEQ ID NO: 783074 - protein, 19 aa, Mycobacterium
DLTQETFIRVFRSVQNYQP

SEQ ID NO: 783075 - protein, 20 aa, Mycobacterium
DLVDGAPKPLLEKVAKEAAD

SEQ ID NO: 783076 - protein, 24 aa, Mycobacterium
DNRTYGHPIVLRPVSSEDAMTADW

SEQ ID NO: 783077 - protein, 23 aa, Mycobacterium
DPQGNVIAWASSGHVGFKGSRKS

SEQ ID NO: 783078 - protein, 17 aa, Mycobacterium
DPSGLDIALFSAGATMS

SEQ ID NO: 783079 - protein, 25 aa, Mycobacterium
DQLMKAALPFGLWVPVLPGTRQVTV

SEQ ID NO: 783080 - protein, 19 aa, Mycobacterium
DQVARLMRICGISGAVRGK

SEQ ID NO: 783081 - protein, 26 aa, Mycobacterium
DQWWVADFTYTWTLAGFVYTAFCVDV

SEQ ID NO: 783082 - protein, 22 aa, Mycobacterium
DRPHEWEILIRLTGLCTGTPAE

SEQ ID NO: 783083 - protein, 19 aa, Mycobacterium
DRRLLRYDTLILDEAHERS

SEQ ID NO: 783084 - protein, 24 aa, Mycobacterium
DTAAGFWLRANGFFVDHGITVKRV

SEQ ID NO: 783085 - protein, 17 aa, Mycobacterium
DVLLLPAASDVVPATAD

SEQ ID NO: 783086 - protein, 18 aa, Mycobacterium
DVLLMTDGRFSGGTTGLC

SEQ ID NO: 783087 - protein, 23 aa, Mycobacterium
DVVGLLLERSVEAVIAILAVLKS

SEQ ID NO: 783088 - protein, 26 aa, Mycobacterium
DYSEAIALARLGWAALAVGTSHAVLD

SEQ ID NO: 783089 - protein, 26 aa, Mycobacterium
EAAVAGAIPVIRPLTQSLAGDTVLRV

SEQ ID NO: 783090 - protein, 19 aa, Mycobacterium
EAFKWIQRAAMDRRTTMKR

SEQ ID NO: 783091 - protein, 23 aa, Mycobacterium
EAGRINHAYLFSGPRGCGKTSSA

SEQ ID NO: 783092 - protein, 20 aa, Mycobacterium
EAHDLCGLPVAVFRSDMILA

SEQ ID NO: 783093 - protein, 19 aa, Mycobacterium
EAMLLMRAGREYALKRALA

SEQ ID NO: 783094 - protein, 24 aa, Mycobacterium
EAPARAYNPLFIWGESGLGKTHLL

SEQ ID NO: 783095 - protein, 27 aa, Mycobacterium
EAVWWGKRVLGLPIHDNWWQTETGGIM

SEQ ID NO: 783096 - protein, 25 aa, Mycobacterium
EDVAKLTYYGLYALQHRGQEAAGIA

SEQ ID NO: 783097 - protein, 25 aa, Mycobacterium
EEVVLRLRALLRRTGVTTVDSGAQL

SEQ ID NO: 783098 - protein, 27 aa, Mycobacterium
EFDHLPEQAFFLIGGLDDLAKKAESLG

SEQ ID NO: 783099 - protein, 23 aa, Mycobacterium
EFDISKLRYHKIVLMADADVDGQ

SEQ ID NO: 783100 - protein, 20 aa, Mycobacterium
EFERPVLLFSGGKDSIVMLH

SEQ ID NO: 783101 - protein, 22 aa, Mycobacterium
EFKRDAVALYRDTEGATIAQIA

SEQ ID NO: 783102 - protein, 42 aa, Mycobacterium; identical to SEQ ID NO: 119775

SEQ ID NO: 783103 - protein, 18 aa, Mycobacterium
EGDLHHQALRALGNRLVG

SEQ ID NO: 783104 - protein, 23 aa, Mycobacterium
EGPIEALPIAAFSMMRAMSTRND

SEQ ID NO: 783105 - protein, 24 aa, Mycobacterium
EGQGFIQLMTQLPQERLIVAVGAV

SEQ ID NO: 783106 - protein, 32 aa, Mycobacterium; identical to SEQ ID NO: 114182

SEQ ID NO: 783107 - protein, 25 aa, Mycobacterium
EGYMWEHDLADWRWGIDVNVLGVIH

SEQ ID NO: 783108 - protein, 24 aa, Mycobacterium
EHSAHYYFRDFWGADSGMLAALHV

SEQ ID NO: 783109 - protein, 25 aa, Mycobacterium
EIRELKRANEILKRAASFFGAELDR

SEQ ID NO: 783110 - protein, 38 aa, Mycobacterium; identical to SEQ ID NO: 119821

SEQ ID NO: 783111 - protein, 30 aa, Mycobacterium; identical to SEQ ID NO: 119824

SEQ ID NO: 783112 - protein, 19 aa, Mycobacterium
EKTRLALAGLVASTANVLL

SEQ ID NO: 783113 - protein, 32 aa, Mycobacterium; identical to SEQ ID NO: 119826

SEQ ID NO: 783114 - protein, 18 aa, Mycobacterium
ELFTALLLSLPGSPVLYY

SEQ ID NO: 783115 - protein, 22 aa, Mycobacterium
ELGLSYLLPRAIGSSRAFEIML

SEQ ID NO: 783116 - protein, 27 aa, Mycobacterium
ELPTYPFQHRRYWLDPAPRADVSAAGL

SEQ ID NO: 783117 - protein, 33 aa, Mycobacterium
ELQRLRLATQLRAGLFGVLYVLDEPSAGLHPAD

SEQ ID NO: 783118 - protein, 21 aa, Mycobacterium
ELRPQLLDRFGLTVDVHASRD

SEQ ID NO: 783119 - protein, 30 aa, Mycobacterium
ELVKVTPMDFLRDTLLWAKLIDKYKGTMTA

SEQ ID NO: 783120 - protein, 25 aa, Mycobacterium
ENQSSGVIPIMKLLEDSFSYANQLG

SEQ ID NO: 783121 - protein, 24 aa, Mycobacterium
EPGDFVILNWRAVCGQCRACKRGR

SEQ ID NO: 783122 - protein, 17 aa, Mycobacterium
EQRSLEDVFLDLTGRKL

SEQ ID NO: 783123 - protein, 17 aa, Mycobacterium
EQVSCELPLQAIAGLMG

SEQ ID NO: 783124 - protein, 24 aa, Mycobacterium
ERDAIPLLDQLYGGALRMTRNPAD

SEQ ID NO: 783125 - protein, 18 aa, Mycobacterium
ERVELRYTMPLGEIIFDF

SEQ ID NO: 783126 - protein, 18 aa, Mycobacterium
ESFKVLLKELQSLCLNVE

SEQ ID NO: 783127 - protein, 27 aa, Mycobacterium
ESIGVRSVCYLPLTYDHRLIDGADAGR

SEQ ID NO: 783128 - protein, 19 aa, Mycobacterium
ETLVRLRPTFGAVNLEDIS

SEQ ID NO: 783129 - protein, 28 aa, Mycobacterium
ETTKRYMHHYNFPPFSTGETGRVGSPKR

SEQ ID NO: 783130 - protein, 18 aa, Mycobacterium
EVIRILQRYKDLQDIIAI

SEQ ID NO: 783131 - protein, 25 aa, Mycobacterium
EVRSEFLNQLQKGAIRKGVVSSIVN

SEQ ID NO: 783132 - protein, 26 aa, Mycobacterium
EVTLNGRVLPIGGVKQKLLAAQRAGL

SEQ ID NO: 783133 - protein, 27 aa, Mycobacterium
EWISAVMTLLPGDLILTGTPAGVGPIE

SEQ ID NO: 783134 - protein, 18 aa, Mycobacterium
EYDVLVGINLLREGLDLP

SEQ ID NO: 783135 - protein, 20 aa, Mycobacterium
EYGRTVVVLTIDPAKRLAQA

SEQ ID NO: 783136 - protein, 19 aa, Mycobacterium
FAAVFARRGLIAEFGISWI

SEQ ID NO: 783137 - protein, 17 aa, Mycobacterium
FAAVRQFRASVCVLGPL

SEQ ID NO: 783138 - protein, 19 aa, Mycobacterium
FAWHIDLAKRTGKPLMIHN

SEQ ID NO: 783139 - protein, 19 aa, Mycobacterium
FEALGDIYRYFHAEEQRHA

SEQ ID NO: 783140 - protein, 17 aa, Mycobacterium
FELQFGTNHLGHFALTG

SEQ ID NO: 783141 - protein, 26 aa, Mycobacterium
FEPQRAGVWLARRPGLARLINLYGTT

SEQ ID NO: 783142 - protein, 25 aa, Mycobacterium
FGAVRMVLALLPHWRERRFGHVVNV

SEQ ID NO: 783143 - protein, 19 aa, Mycobacterium
FHGGSLYGIPMPPGLISHA

SEQ ID NO: 783144 - protein, 23 aa, Mycobacterium
FHKQANVLAALPKSAHPSALAAI

SEQ ID NO: 783145 - protein, 18 aa, Mycobacterium
FIAPFHRAGTNPTLALQR

SEQ ID NO: 783146 - protein, 30 aa, Mycobacterium
FIVEYIGQTRGWFYTLHVLATALFDRPAFK

SEQ ID NO: 783147 - protein, 17 aa, Mycobacterium
FLPASLVEMRRVRDLQP

SEQ ID NO: 783148 - protein, 19 aa, Mycobacterium
FLPASLVEMRRVRDLQPYI

SEQ ID NO: 783149 - protein, 18 aa, Mycobacterium
FQHLPVPFELYSDGIDLP

SEQ ID NO: 783150 - protein, 26 aa, Mycobacterium
FRRVNGHLHLPALRAALEREVAEHVV

SEQ ID NO: 783151 - protein, 18 aa, Mycobacterium
FTNICYTGCRFCAFAQRK

SEQ ID NO: 783152 - protein, 17 aa, Mycobacterium
GAYRLIDFVLSNLVNAR

SEQ ID NO: 783153 - protein, 27 aa, Mycobacterium
GDDTLFLERFVLRPRHIEVQVLADTHG

SEQ ID NO: 783154 - protein, 24 aa, Mycobacterium
GDGRVRARREISVKIPAGVGDGMR

SEQ ID NO: 783155 - protein, 23 aa, Mycobacterium
GDYLEELLDLLDFDGDIDLDVEG

SEQ ID NO: 783156 - protein, 35 aa, Mycobacterium
GEPARAFYGPQFALTFPVLTHYGVGLWVPEVGGAV

SEQ ID NO: 783157 - protein, 21 aa, Mycobacterium
GEPVSCFLLRIEDNMESIGRS

SEQ ID NO: 783158 - protein, 24 aa, Mycobacterium
GEQLDWGTYVFDFGRPEVRNFLVA

SEQ ID NO: 783159 - protein, 22 aa, Mycobacterium
GEQLRQFYKLGVSPIPPNTPNI

SEQ ID NO: 783160 - protein, 17 aa, Mycobacterium
GETERHIRLIFQRAREK

SEQ ID NO: 783161 - protein, 31 aa, Mycobacterium; identical to SEQ ID NO: 114715

SEQ ID NO: 783162 - protein, 24 aa, Mycobacterium
GGAGGTGGWLYGNGGAGGAGGAGA

SEQ ID NO: 783163 - protein, 26 aa, Mycobacterium
GGCAGLRYNLFFDDRTLDGDLTAEFG

SEQ ID NO: 783164 - protein, 19 aa, Mycobacterium
GGCFPPPPGYFERVREICD

SEQ ID NO: 783165 - protein, 17 aa, Mycobacterium
GGIPYAIAKSLAAAPFA

SEQ ID NO: 783166 - protein, 23 aa, Mycobacterium
GGKALKFYASVRMDVRRIETLKD

SEQ ID NO: 783167 - protein, 24 aa, Mycobacterium
GGNGGAAGWWGTGGAGGAGGEGGA

SEQ ID NO: 783168 - protein, 21 aa, Mycobacterium
GGVFASLFTCGIAVPHMIASG

SEQ ID NO: 783169 - protein, 26 aa, Mycobacterium
GGYATHVELPWDAMLLPIAEDMDPVL

SEQ ID NO: 783170 - protein, 20 aa, Mycobacterium
GKLRPPVFGILRYIADAVDE

SEQ ID NO: 783171 - protein, 19 aa, Mycobacterium
GKMLPPKLGLLAYVADAYL

SEQ ID NO: 783172 - protein, 24 aa, Mycobacterium
GKSTIAAALALTLAAGGRKVLLVE

SEQ ID NO: 783173 - protein, 25 aa, Mycobacterium
GLALSPTLIFDYPNSAALAGYMHRE

SEQ ID NO: 783174 - protein, 25 aa, Mycobacterium
GLAMAYKLIDAAAARWRAVNAPHLV

SEQ ID NO: 783175 - protein, 23 aa, Mycobacterium
GLASTDQLYFASGLLDCPGAMFT

SEQ ID NO: 783176 - protein, 30 aa, Mycobacterium; identical to SEQ ID NO: 114827

SEQ ID NO: 783177 - protein, 31 aa, Mycobacterium
GLPSYPHPRLMPDFWEFPTVSMGLGPMNAIY

SEQ ID NO: 783178 - protein, 25 aa, Mycobacterium
GLPVPVTSRHTLLLGPPGTGKTSVA

SEQ ID NO: 783179 - protein, 21 aa, Mycobacterium
GLQIMAPALADDRLYRVGAAY

SEQ ID NO: 783180 - protein, 23 aa, Mycobacterium
GLSALPWQRFGGPAALGEYLQEH

SEQ ID NO: 783181 - protein, 21 aa, Mycobacterium
GLTASRFVACPFGALGARMYR

SEQ ID NO: 783182 - protein, 19 aa, Mycobacterium
GLVAIDTLLARMENDRDRL

SEQ ID NO: 783183 - protein, 19 aa, Mycobacterium
GMGINPFFDAPYEDVSKGI

SEQ ID NO: 783184 - protein, 20 aa, Mycobacterium
GNYLPRFGPYLSSASNPWGE

SEQ ID NO: 783185 - protein, 27 aa, Mycobacterium
GPGENIPAWLVFDQQYRDRYIFAGLQP

SEQ ID NO: 783186 - protein, 18 aa, Mycobacterium
GPGESLQLALSGPGVGPV

SEQ ID NO: 783187 - protein, 23 aa, Mycobacterium
GQAGGAGGLLYGNGGNGAAGTNP

SEQ ID NO: 783188 - protein, 33 aa, Mycobacterium
GRPADPPFEGMWWLYVPMAFDDFAIVLIIQEEP

SEQ ID NO: 783189 - protein, 21 aa, Mycobacterium
GRPLGLLLTRRSENATVTLCH

SEQ ID NO: 783190 - protein, 34 aa, Mycobacterium
GRSGEPFPYPVTVGYMYILKLHHLVDDKIHARST

SEQ ID NO: 783191 - protein, 28 aa, Mycobacterium
GRSVSDALDILRWAPQAASEPVAKVIAS

SEQ ID NO: 783192 - protein, 25 aa, Mycobacterium
GRVKQMLLKIGWPAEDLAGYVDGEA

SEQ ID NO: 783193 - protein, 28 aa, Mycobacterium
GSAKRITAILPFYPYARQDKKHRGREPI

SEQ ID NO: 783194 - protein, 24 aa, Mycobacterium
GSDPLYMLTGVIPATEKVLRRAGL

SEQ ID NO: 783195 - protein, 18 aa, Mycobacterium
GSLGNIAWYLQYAGKKSI

SEQ ID NO: 783196 - protein, 30 aa, Mycobacterium
GSQGALFDTPILVPPQAAMLGTGAIVKRPR

SEQ ID NO: 783197 - protein, 18 aa, Mycobacterium
GSQNNGFFWRGDAQGQIG

SEQ ID NO: 783198 - protein, 20 aa, Mycobacterium
GSQVLVFKDLGLVSQVFDEQ

SEQ ID NO: 783199 - protein, 25 aa, Mycobacterium
GSVLAALGRIDYWFVTDGRRVHKTV

SEQ ID NO: 783200 - protein, 28 aa, Mycobacterium
GTEAPAEMHFYFPKFRALCMAENATHNL

SEQ ID NO: 783201 - protein, 24 aa, Mycobacterium
GTGTPLFCIHATSGISWPYQTLAN

SEQ ID NO: 783202 - protein, 19 aa, Mycobacterium
GTSDGRILRVRGRGVPKRS

SEQ ID NO: 783203 - protein, 20 aa, Mycobacterium
GTYAINWYAFDPCCPFGGYK

SEQ ID NO: 783204 - protein, 20 aa, Mycobacterium
GVAMPLRLTSPAPCTNCHGS

SEQ ID NO: 783205 - protein, 29 aa, Mycobacterium
GVPLGHLGFFVLDGWLRPVPVGVVGELYV

SEQ ID NO: 783206 - protein, 18 aa, Mycobacterium
GVVLLRPASPGTGVIAGG

SEQ ID NO: 783207 - protein, 18 aa, Mycobacterium
GWLEGYLLTGRHGLFNCY

SEQ ID NO: 783208 - protein, 20 aa, Mycobacterium
GYYQVRGGIPYAIAKSLAAA

SEQ ID NO: 783209 - protein, 23 aa, Mycobacterium
HALRRNVNITILLFNNRIYGLTK

SEQ ID NO: 783210 - protein, 36 aa, Mycobacterium; identical to SEQ ID NO: 115086

SEQ ID NO: 783211 - protein, 20 aa, Mycobacterium
HGGYGYLREYGLEKIVRDLR

SEQ ID NO: 783212 - protein, 24 aa, Mycobacterium
HHRAAAVNLHRLITLGLTHTGAGW

SEQ ID NO: 783213 - protein, 27 aa, Mycobacterium
HILEVQRLIRFMPKVVICLVNGWAAGG

SEQ ID NO: 783214 - protein, 24 aa, Mycobacterium
HIYHYAPYEKTALLRLAGRYGVGE

SEQ ID NO: 783215 - protein, 17 aa, Mycobacterium
HLGPSGNYLPRFGPYLS

SEQ ID NO: 783216 - protein, 18 aa, Mycobacterium
HPDVLRELLATFIHTLMG

SEQ ID NO: 783217 - protein, 24 aa, Mycobacterium
HQNSRWIVEPVLRLLDCCQESDGG

SEQ ID NO: 783218 - protein, 23 aa, Mycobacterium
HSAHYYFRDFWGADSGMLAALYV

SEQ ID NO: 783219 - protein, 19 aa, Mycobacterium
HVDIPLQAYFRINTENMGQ

SEQ ID NO: 783220 - protein, 17 aa, Mycobacterium
HVVEVVVGENFTFGKKA

SEQ ID NO: 783221 - protein, 18 aa, Mycobacterium
HYVDIPLPGPRLPHDMAF

SEQ ID NO: 783222 - protein, 22 aa, Mycobacterium
IAMNFSMDGPWGQWVNRWTAEE

SEQ ID NO: 783223 - protein, 21 aa, Mycobacterium
IAMNFTMDGPWGTWVNRWTAE

SEQ ID NO: 783224 - protein, 18 aa, Mycobacterium
IAMYLCRELTDLSLPKIG

SEQ ID NO: 783225 - protein, 28 aa, Mycobacterium
IARVISDVWLSNLLAWLTRRASATDVSK

SEQ ID NO: 783226 - protein, 20 aa, Mycobacterium
IASELILPIAVAVQNRITVN

SEQ ID NO: 783227 - protein, 22 aa, Mycobacterium
ICRREVFRWLARYNTTRRHSYC

SEQ ID NO: 783228 - protein, 17 aa, Mycobacterium
IDDLIAYYVSDDEIFLV

SEQ ID NO: 783229 - protein, 23 aa, Mycobacterium
IDGVRAGALPPGTRLPTVRDLAG

SEQ ID NO: 783230 - protein, 26 aa, Mycobacterium
IEEQSPIVGIWHSGGARLAEGVKALH

SEQ ID NO: 783231 - protein, 18 aa, Mycobacterium
IGLGGLGHMGVKLGAAMG

SEQ ID NO: 783232 - protein, 17 aa, Mycobacterium
IGRVRPGSDSLLRMRLD

SEQ ID NO: 783233 - protein, 21 aa, Mycobacterium
IGTHRLLQTGVRWKDLGLVVV

SEQ ID NO: 783234 - protein, 25 aa, Mycobacterium
IIDSALDGVLFLDEAYALVATGAKN

SEQ ID NO: 783235 - protein, 24 aa, Mycobacterium
IKDSLSPQLLFTDLGLKYVGPVDG

SEQ ID NO: 783236 - protein, 17 aa, Mycobacterium
ILDVMMPGMDGFGVLRR

SEQ ID NO: 783237 - protein, 18 aa, Mycobacterium
ILLKLIQAADYDVKRAET

SEQ ID NO: 783238 - protein, 18 aa, Mycobacterium
IPIMLGAEGPKNVALAAE

SEQ ID NO: 783239 - protein, 22 aa, Mycobacterium
IQAQDFFFRKIVRDKGVALAHV

SEQ ID NO: 783240 - protein, 29 aa, Mycobacterium
IQTAFIYDHFTPFVFTQLEELGFCGRGEA

SEQ ID NO: 783241 - protein, 33 aa, Mycobacterium
ITHRNVVALFTGFGWWRGLTDTDVWAWCHSPAF

SEQ ID NO: 783242 - protein, 27 aa, Mycobacterium
IVEEPPEHLIFIFATTEPEKVLPTIRS

SEQ ID NO: 783243 - protein, 18 aa, Mycobacterium
IYEMYRLLAIAKYEERYV

SEQ ID NO: 783244 - protein, 18 aa, Mycobacterium
IYLPLSNLTAFQTALLDP

SEQ ID NO: 783245 - protein, 25 aa, Mycobacterium
KAQHGVMELLLINHPLDCPMCDKGG

SEQ ID NO: 783246 - protein, 26 aa, Mycobacterium
KDLIDRPMEFLGNLVLLIVGGNDTTR

SEQ ID NO: 783247 - protein, 38 aa, Mycobacterium; identical to SEQ ID NO: 115495

SEQ ID NO: 783248 - protein, 21 aa, Mycobacterium
KEAKIAFLMLPGVGTKEDIKE

SEQ ID NO: 783249 - protein, 23 aa, Mycobacterium
KEGRGIVMRVPLEGGGRLVVELT

SEQ ID NO: 783250 - protein, 26 aa, Mycobacterium
KEIQSRLGFLLDVGLEYLSLSRAAAT

SEQ ID NO: 783251 - protein, 29 aa, Mycobacterium
KELGAMGFKFQFITLAGFHALNYSMFDLA

SEQ ID NO: 783252 - protein, 17 aa, Mycobacterium
KFDYTKGFKFSTYATWW

SEQ ID NO: 783253 - protein, 25 aa, Mycobacterium
KGEVKDVLLLDVTPLSLGIETKGGV

SEQ ID NO: 783254 - protein, 26 aa, Mycobacterium
KGVIGKILPVEDMPFLPDGTPVDIIL

SEQ ID NO: 783255 - protein, 20 aa, Mycobacterium
KLEVYSPNSPLGGALIDAKV

SEQ ID NO: 783256 - protein, 20 aa, Mycobacterium
KLKVLVSIFGRETPVELTFN

SEQ ID NO: 783257 - protein, 34 aa, Mycobacterium
KLRQKRLMTLIHLWLVHRFKADAVYYVTPTEDNQ

SEQ ID NO: 783258 - protein, 18 aa, Mycobacterium
KNDFGLVAIDTLLARMEN

SEQ ID NO: 783259 - protein, 25 aa, Mycobacterium
KQVNRKVLPGYILVRMELNDESWGA

SEQ ID NO: 783260 - protein, 27 aa, Mycobacterium
KRQEDFIGIHFFSPVDKMPLVEIIKGE

SEQ ID NO: 783261 - protein, 26 aa, Mycobacterium
KRRADVVEIFPNPAAFLRLATAVVIE

SEQ ID NO: 783262 - protein, 23 aa, Mycobacterium
KSSLAFDTIFAEGQRRYVESLSA

SEQ ID NO: 783263 - protein, 35 aa, Mycobacterium
KSVRAWRLPMGFTAWPPWRPGVLFTGDSLGAGKPA

SEQ ID NO: 783264 - protein, 23 aa, Mycobacterium
KTLREAVLYLTGMNQRELYGASY

SEQ ID NO: 783265 - protein, 23 aa, Mycobacterium
KVIDRTALILDIFAQHATSREGK

SEQ ID NO: 783266 - protein, 21 aa, Mycobacterium
LAEELVRIIGVLRGMQLKKVP

SEQ ID NO: 783267 - protein, 23 aa, Mycobacterium
LAELTGWSLEIAPEALNCAAPDT

SEQ ID NO: 783268 - protein, 24 aa, Mycobacterium
LAGRHLRRHPNAQPVVLVVTDGEP

SEQ ID NO: 783269 - protein, 17 aa, Mycobacterium
LAKPGRLEGPDPSLLAA

SEQ ID NO: 783270 - protein, 26 aa, Mycobacterium
LARSVFNRFPYLEPLNHLQVELLRRY

SEQ ID NO: 783271 - protein, 17 aa, Mycobacterium
LASMCFPTFTGFSARHL

SEQ ID NO: 783272 - protein, 21 aa, Mycobacterium
LCLTFNGLSKAYRVAGYRAGW

SEQ ID NO: 783273 - protein, 36 aa, Mycobacterium
LDALTPEMLVLADRGFFSYALWRNASDTGADLLWRV

SEQ ID NO: 783274 - protein, 25 aa, Mycobacterium
LDGDEFRLYELIWQRTVASQMADAR

SEQ ID NO: 783275 - protein, 23 aa, Mycobacterium
LDGYGLHIIERVPLPVRANAENI

SEQ ID NO: 783276 - protein, 38 aa, Mycobacterium
LDIDKFAPRLSFFWGIGMNFFMEVAKLRAGRLLWSELV

SEQ ID NO: 783277 - protein, 20 aa, Mycobacterium
LDILVDRMRREFKVEANVGK

SEQ ID NO: 783278 - protein, 21 aa, Mycobacterium
LDLFRTRRVASPAQRVMLIAR

SEQ ID NO: 783279 - protein, 23 aa, Mycobacterium
LDVQTVAMAKWWTTERAMKVLDD

SEQ ID NO: 783280 - protein, 17 aa, Mycobacterium
LFGSCFVVCNEILPRWG

SEQ ID NO: 783281 - protein, 26 aa, Mycobacterium
LFGTPDTWVLWNLTGGPRGGVHVTDV

SEQ ID NO: 783282 - protein, 22 aa, Mycobacterium
LGKMGFVFNFITYGGHQIDGVA

SEQ ID NO: 783283 - protein, 22 aa, Mycobacterium
LGNWTGIPVFKLTEAETTRLLR

SEQ ID NO: 783284 - protein, 28 aa, Mycobacterium
LGQEGMGFIYLMQNLPQERISIAIMAAA

SEQ ID NO: 783285 - protein, 19 aa, Mycobacterium
LGYVVRWIDQGVGCSKVPD

SEQ ID NO: 783286 - protein, 29 aa, Mycobacterium
LHPEYRTMPMVWYIPPLSPVVDAVSRDGH

SEQ ID NO: 783287 - protein, 18 aa, Mycobacterium
LHRLGIQAFEPMLVEGKA

SEQ ID NO: 783288 - protein, 20 aa, Mycobacterium
LIDFVLSNLVNARYLRICVL

SEQ ID NO: 783289 - protein, 18 aa, Mycobacterium
LIIYDEVHLLPAPVFRMT

SEQ ID NO: 783290 - protein, 26 aa, Mycobacterium
LKGEVKDVLLLDVTPLSLGIETKGGV

SEQ ID NO: 783291 - protein, 21 aa, Mycobacterium
LKRRGFRFVGPTTAYALMQAT

SEQ ID NO: 783292 - protein, 41 aa, Mycobacterium
LKSDSVFAFLAAYRRQLFPEEMFADLFPSRRGRPSVPAEVM

SEQ ID NO: 783293 - protein, 25 aa, Mycobacterium
LLRGRVERMHRACLILTFGGGTNEV

SEQ ID NO: 783294 - protein, 19 aa, Mycobacterium
LNRAPTLHRLGIQAFEPQL

SEQ ID NO: 783295 - protein, 17 aa, Mycobacterium
LNVLRIVNEPTAAALAY

SEQ ID NO: 783296 - protein, 19 aa, Mycobacterium
LQNAASIAALFLTTEAVVA

SEQ ID NO: 783297 - protein, 33 aa, Mycobacterium; identical to SEQ ID NO: 121199

SEQ ID NO: 783298 - protein, 28 aa, Mycobacterium
LRYTMPLGEIIFDFFDSLKSRTRGYASL

SEQ ID NO: 783299 - protein, 26 aa, Mycobacterium
LSDDEFGFFVILLAVAGNETTRNSIT

SEQ ID NO: 783300 - protein, 25 aa, Mycobacterium
LSGPGVGPVVIPVAHVPAVAGFGNT

SEQ ID NO: 783301 - protein, 24 aa, Mycobacterium
LSRRYRVPVLSVHAPCLLISQRVW

SEQ ID NO: 783302 - protein, 20 aa, Mycobacterium
LSTKFTRLTGRSPILLAGMT

SEQ ID NO: 783303 - protein, 18 aa, Mycobacterium
LTAAHWLSEENVPVVGVP

SEQ ID NO: 783304 - protein, 18 aa, Mycobacterium
LTFIDKAYEFVKETVAHG

SEQ ID NO: 783305 - protein, 23 aa, Mycobacterium
LTGATRPWQFGDTEPWNISRTLT

SEQ ID NO: 783306 - protein, 17 aa, Mycobacterium
LTMAEWFRDEAGQDVLL

SEQ ID NO: 783307 - protein, 18 aa, Mycobacterium
LVSTNRKLDKAASKGVIH

SEQ ID NO: 783308 - protein, 25 aa, Mycobacterium
MAIYDTMVLAPCDIATYAMGMAASM

SEQ ID NO: 783309 - protein, 26 aa, Mycobacterium
MALGKNLLVAIMPWEGHNYEDAIILS

SEQ ID NO: 783310 - protein, 25 aa, Mycobacterium
MAYEGKIDWAFAELLALGSLVAEGK

SEQ ID NO: 783311 - protein, 23 aa, Mycobacterium
MEYMLPRLRGWGESMSRQAGGRA

SEQ ID NO: 783312 - protein, 21 aa, Mycobacterium
MFSLHVKATMMKVSHPIVFGH

SEQ ID NO: 783313 - protein, 26 aa, Mycobacterium
MGEVRVPAKALWRAQTQRAVENFPIS

SEQ ID NO: 783314 - protein, 26 aa, Mycobacterium
MSRGAIFHHFRDKDALFFALAHEDAE

SEQ ID NO: 783315 - protein, 19 aa, Mycobacterium
MTYAAPLFVTAEFINNNTG

SEQ ID NO: 783316 - protein, 26 aa, Mycobacterium
MVRRHRLLETFLVNELGYGWDEVHDE

SEQ ID NO: 783317 - protein, 25 aa, Mycobacterium
MWAARRSGLYYVPINTHLTAAEAAY

SEQ ID NO: 783318 - protein, 23 aa, Mycobacterium
NAGLTNTGWFNSGLANTGWGNAG

SEQ ID NO: 783319 - protein, 26 aa, Mycobacterium
NDNPYSESWFKTLKYAPAFPERFESI

SEQ ID NO: 783320 - protein, 37 aa, Mycobacterium; identical to SEQ ID NO: 116265

SEQ ID NO: 783321 - protein, 18 aa, Mycobacterium
NDSRGFFTSRVIGTFVNE

SEQ ID NO: 783322 - protein, 23 aa, Mycobacterium
NDSRGFFTSRVIGTFVNEALAML

SEQ ID NO: 783323 - protein, 23 aa, Mycobacterium
NFPQAFTHLALINAVVHVIRAEE

SEQ ID NO: 783324 - protein, 19 aa, Mycobacterium
NFRDVLNVLGLYPGDPGPI

SEQ ID NO: 783325 - protein, 25 aa, Mycobacterium
NGDCVAFFWFADAPDRVPGISSPGA

SEQ ID NO: 783326 - protein, 18 aa, Mycobacterium
NGFFWRGDAQGQIGFDYT

SEQ ID NO: 783327 - protein, 33 aa, Mycobacterium
NGQKTWTTLGQYADWIFCLVRTDPQAPKRQAGI

SEQ ID NO: 783328 - protein, 25 aa, Mycobacterium
NGVCGYRRFFSITSLAGLRQEDRAV

SEQ ID NO: 783329 - protein, 17 aa, Mycobacterium
NIPARLARPQRRPILHL

SEQ ID NO: 783330 - protein, 22 aa, Mycobacterium
NIRLVIEWLDRYAEALPLTVIG

SEQ ID NO: 783331 - protein, 23 aa, Mycobacterium
NLERRKEICGRAYRILTEEVGFP

SEQ ID NO: 783332 - protein, 24 aa, Mycobacterium
NRELLVNVLRHPAFLDGATDTAFF

SEQ ID NO: 783333 - protein, 25 aa, Mycobacterium
NTHPTGPYHLLGWSFGGVLAHQIAI

SEQ ID NO: 783334 - protein, 27 aa, Mycobacterium
NVVDVFIGYLRRKLEANGGPRLLHTVR

SEQ ID NO: 783335 - protein, 30 aa, Mycobacterium; identical to SEQ ID NO: 116398

SEQ ID NO: 783336 - protein, 30 aa, Mycobacterium
PADYTNHIDKWKFTVPFVCGATNLGEALRR

SEQ ID NO: 783337 - protein, 22 aa, Mycobacterium
PAFQGTIKSAVAFGALLSRGIG

SEQ ID NO: 783338 - protein, 17 aa, Mycobacterium
PALACGNAFVLKPSERD

SEQ ID NO: 783339 - protein, 18 aa, Mycobacterium
PAPEDLAPPAPADLPPAP

SEQ ID NO: 783340 - protein, 21 aa, Mycobacterium
PAQAIAQVCELTWQLRGQATG

SEQ ID NO: 783341 - protein, 17 aa, Mycobacterium
PARLKVGIISAGRVGTA

SEQ ID NO: 783342 - protein, 17 aa, Mycobacterium
PASLVEMRRVRDLQPYI

SEQ ID NO: 783343 - protein, 18 aa, Mycobacterium
PAWARKSPQMSEVLPLLY

SEQ ID NO: 783344 - protein, 23 aa, Mycobacterium
PDGRNYMWVARTVERRAARYGQP

SEQ ID NO: 783345 - protein, 26 aa, Mycobacterium
PDLIERKWGLPVRPDQWWVADFTYTW

SEQ ID NO: 783346 - protein, 19 aa, Mycobacterium
PDPHDLAYLIYTSGTTGTP

SEQ ID NO: 783347 - protein, 22 aa, Mycobacterium
PDVEIRYVLLADFDGNPKASKD

SEQ ID NO: 783348 - protein, 32 aa, Mycobacterium
PDYDMSMARLLYWGCDVWLNNPLRPLEACGTS

SEQ ID NO: 783349 - protein, 18 aa, Mycobacterium
PERRAGVAVVPILADVDA

SEQ ID NO: 783350 - protein, 19 aa, Mycobacterium
PEVRSQLAMTWGTETFIVP

SEQ ID NO: 783351 - protein, 18 aa, Mycobacterium
PGAACDIPSLLYSYSFEP

SEQ ID NO: 783352 - protein, 24 aa, Mycobacterium
PGPQNRMISWPYTKLMNSNNMVDQ

SEQ ID NO: 783353 - protein, 27 aa, Mycobacterium
PGTKGLSLFFVPKFLFDFETGELGERN

SEQ ID NO: 783354 - protein, 21 aa, Mycobacterium
PGTRMRVALSALTMAEWFRDE

SEQ ID NO: 783355 - protein, 18 aa, Mycobacterium
PHGVRPLSLGRLDRGWVV

SEQ ID NO: 783356 - protein, 24 aa, Mycobacterium
PISRYLGPWVAEPQLWQDPVPAVD

SEQ ID NO: 783357 - protein, 24 aa, Mycobacterium
PKSSWPWVRTLLHSVFDQPDAESV

SEQ ID NO: 783358 - protein, 25 aa, Mycobacterium
PLDLTYKEFELLKYLAQHAGRVFTR

SEQ ID NO: 783359 - protein, 20 aa, Mycobacterium
PLHHLAFAVLDSSLRPVPPG

SEQ ID NO: 783360 - protein, 21 aa, Mycobacterium
PLLVACDLQRPAAVNQLQVVG

SEQ ID NO: 783361 - protein, 17 aa, Mycobacterium
PMATGVLVIGIERATKI

SEQ ID NO: 783362 - protein, 21 aa, Mycobacterium
PMIMRDTIFCAIPEDADRDAI

SEQ ID NO: 783363 - protein, 20 aa, Mycobacterium
PMTPFERKIVHDAVAAVPGV

SEQ ID NO: 783364 - protein, 24 aa, Mycobacterium
PQLFKQLLMVAGMERYYQIARCYR

SEQ ID NO: 783365 - protein, 29 aa, Mycobacterium
PQQIWSWDITDLRSPWRGVAFKAYSILDI

SEQ ID NO: 783366 - protein, 20 aa, Mycobacterium
PSRLRGWYPGQGEQAPALIN

SEQ ID NO: 783367 - protein, 26 aa, Mycobacterium
PTLDYVVVKAPRFAFEKFPGADATLT

SEQ ID NO: 783368 - protein, 26 aa, Mycobacterium
PTTPLLPPDPHDLAYLIYTSGTTGTP

SEQ ID NO: 783369 - protein, 19 aa, Mycobacterium
PVAYRLLTTLTDPDTAPAV

SEQ ID NO: 783370 - protein, 25 aa, Mycobacterium
PVLDRYDYVLIDCQPSLGLLTVNGL

SEQ ID NO: 783371 - protein, 24 aa, Mycobacterium
QADIVNRWTWIPFGAGRHRCVGAA

SEQ ID NO: 783372 - protein, 24 aa, Mycobacterium
QAGLRTDYLFRLANQRGGIVLGTG

SEQ ID NO: 783373 - protein, 23 aa, Mycobacterium
QAGNIARLSWLAAGYPEEVPGVT

SEQ ID NO: 783374 - protein, 19 aa, Mycobacterium
QAHLASVHPGLEYDRDAIL

SEQ ID NO: 783375 - protein, 19 aa, Mycobacterium
QEVIRILQRYKDLQDIIAI

SEQ ID NO: 783376 - protein, 23 aa, Mycobacterium
QGKTRLLRALTGLLDEWTPVIAG

SEQ ID NO: 783377 - protein, 21 aa, Mycobacterium
QIVPGKVTKLVPFGAFVRVEE

SEQ ID NO: 783378 - protein, 25 aa, Mycobacterium
QKQRIGIARALALQPKILALDEPVS

SEQ ID NO: 783379 - protein, 21 aa, Mycobacterium
QLEMRLNRQLADIEKLQVNVR

SEQ ID NO: 783380 - protein, 20 aa, Mycobacterium
QPMRRIVQARTLSPITSVAG

SEQ ID NO: 783381 - protein, 25 aa, Mycobacterium
QQVRAGLKAIYLSGWQVAGDANLSG

SEQ ID NO: 783382 - protein, 18 aa, Mycobacterium
QRLALACALVGRPELVFL

SEQ ID NO: 783383 - protein, 20 aa, Mycobacterium
QRVMLIARDGGCTKPCCTVG

SEQ ID NO: 783384 - protein, 29 aa, Mycobacterium
QSLEAMRAIGIPVYLLPGNHDPLDASSVY

SEQ ID NO: 783385 - protein, 33 aa, Mycobacterium; identical to SEQ ID NO: 116924

SEQ ID NO: 783386 - protein, 25 aa, Mycobacterium
RADEWLPIVPGTDAALLLAVAHTLF

SEQ ID NO: 783387 - protein, 19 aa, Mycobacterium
RAEFQRITQDLLDRTRQPF

SEQ ID NO: 783388 - protein, 23 aa, Mycobacterium
RAGHRLKFWTPGGSSTPLLTDEH

SEQ ID NO: 783389 - protein, 18 aa, Mycobacterium
RALGPLVHVNLIPLNPTP

SEQ ID NO: 783390 - protein, 26 aa, Mycobacterium
RDELGDWRVILHSPYGLRVHGPLALA

SEQ ID NO: 783391 - protein, 26 aa, Mycobacterium
RDIQVRGYTLRLPLDVLVVASANPED

SEQ ID NO: 783392 - protein, 27 aa, Mycobacterium
RDIQVRGYTLRLPLDVLVVASANPEDY

SEQ ID NO: 783393 - protein, 19 aa, Mycobacterium
RDRAIRRYGQLEERFVALG

SEQ ID NO: 783394 - protein, 17 aa, Mycobacterium
RDRIVSEVAIILRTEKS

SEQ ID NO: 783395 - protein, 36 aa, Mycobacterium
RDVNKAQIYAWRKGIKTLYYIRLRQMALEGTEVEGC

SEQ ID NO: 783396 - protein, 18 aa, Mycobacterium
REAKSYFLNIKGPELLNK

SEQ ID NO: 783397 - protein, 25 aa, Mycobacterium
REALPHAILIADRFHLVKKANDMVD

SEQ ID NO: 783398 - protein, 23 aa, Mycobacterium
REDQALIYRLSGDRNPLHSDPWF

SEQ ID NO: 783399 - protein, 18 aa, Mycobacterium
REELAPMTPFERKIVHDA

SEQ ID NO: 783400 - protein, 31 aa, Mycobacterium
REQSRPELGYRLLQRLGADVAEYGFVETSAK

SEQ ID NO: 783401 - protein, 17 aa, Mycobacterium
RFGFTAHMDFYEPAELE

SEQ ID NO: 783402 - protein, 18 aa, Mycobacterium
RFLDITDEDFRHTFDWCV

SEQ ID NO: 783403 - protein, 18 aa, Mycobacterium
RFRAWRVGGYNEYLYTFF

SEQ ID NO: 783404 - protein, 29 aa, Mycobacterium
RFSTNTFPSWPLAHPFRRIAHNGEINTVT

SEQ ID NO: 783405 - protein, 29 aa, Mycobacterium
RFSTNTFPSWPLAHPFRRVAHNGEINTVT

SEQ ID NO: 783406 - protein, 21 aa, Mycobacterium
RGARVWPGVSIPDGGIRYSSD

SEQ ID NO: 783407 - protein, 19 aa, Mycobacterium
RGDKIWVAGYAVRDPSPRA

SEQ ID NO: 783408 - protein, 24 aa, Mycobacterium
RGGLSATRFVACPFGAGGSRMYRT

SEQ ID NO: 783409 - protein, 20 aa, Mycobacterium
RHVFESLAMNARIALHVRVL

SEQ ID NO: 783410 - protein, 18 aa, Mycobacterium
RIGGLLRYGIPEFKMEKR

SEQ ID NO: 783411 - protein, 34 aa, Mycobacterium; identical to SEQ ID NO: 215366

SEQ ID NO: 783412 - protein, 19 aa, Mycobacterium
RILEEVWGFDFPTSGNALE

SEQ ID NO: 783413 - protein, 24 aa, Mycobacterium
RKEIRDIVAYLRVLDNPGDAVSMR

SEQ ID NO: 783414 - protein, 19 aa, Mycobacterium
RKRRMFDLLVRMGYKEIEV

SEQ ID NO: 783415 - protein, 17 aa, Mycobacterium
RKTWIVLRTNGLDVSRC

SEQ ID NO: 783416 - protein, 23 aa, Mycobacterium
RKVVVFRPLYAVGGQELGYLPGS

SEQ ID NO: 783417 - protein, 19 aa, Mycobacterium
RLAGRLRFACLPTPATLDD

SEQ ID NO: 783418 - protein, 23 aa, Mycobacterium
RLDQEKLCLLVMLGVRADGRKEL

SEQ ID NO: 783419 - protein, 18 aa, Mycobacterium
RLMILASEDIGMADPTAL

SEQ ID NO: 783420 - protein, 28 aa, Mycobacterium
RLPAVDRAILRVAVWELLYADDVPEPVA

SEQ ID NO: 783421 - protein, 18 aa, Mycobacterium
RMLRDIPGLTVTRIASGL

SEQ ID NO: 783422 - protein, 17 aa, Mycobacterium
RMPLLRDLDQASGLPVR

SEQ ID NO: 783423 - protein, 20 aa, Mycobacterium
RPKHYWSIYQKMIVKGRDFD

SEQ ID NO: 783424 - protein, 27 aa, Mycobacterium
RPLTASLGLMILASGHRYGWPVAQGGS

SEQ ID NO: 783425 - protein, 36 aa, Mycobacterium
RPLTLSAPKPMLPTAGLPFLTHLLSRIAAAGIEHVV

SEQ ID NO: 783426 - protein, 20 aa, Mycobacterium
RPPMVTSGLRIGTPALATRG

SEQ ID NO: 783427 - protein, 24 aa, Mycobacterium
RQGIAQLFDVPPLPYQEVKIATAE

SEQ ID NO: 783428 - protein, 17 aa, Mycobacterium
RQVLGPNAVQAGSLNRP

SEQ ID NO: 783429 - protein, 23 aa, Mycobacterium
RQYRDMRILGIGGGTTEILTALA

SEQ ID NO: 783430 - protein, 26 aa, Mycobacterium
RRGGLSAARFVACPFGAAGSRMYRTG

SEQ ID NO: 783431 - protein, 25 aa, Mycobacterium
RRGQPRLRPPFPAVAGLYGCPTVIN

SEQ ID NO: 783432 - protein, 17 aa, Mycobacterium
RRQVLAHDVDRWARSFL

SEQ ID NO: 783433 - protein, 17 aa, Mycobacterium
RRRLGLTATLIREDGRE

SEQ ID NO: 783434 - protein, 25 aa, Mycobacterium
RRRTPPQWFRVPSNTYFNEGALDNL

SEQ ID NO: 783435 - protein, 25 aa, Mycobacterium
RRWNPKMKRFIFTDRNGIYIIDLQQ

SEQ ID NO: 783436 - protein, 17 aa, Mycobacterium
RSMELFKTALRLARHRE

SEQ ID NO: 783437 - protein, 23 aa, Mycobacterium
RSSNFMLWQAAYAEYIFQDKLWP

SEQ ID NO: 783438 - protein, 20 aa, Mycobacterium
RTQIRALGLLKGACAQVNKD

SEQ ID NO: 783439 - protein, 20 aa, Mycobacterium
RVAFLGWSMGGYGALLLGGR

SEQ ID NO: 783440 - protein, 25 aa, Mycobacterium
RVLEVAQFTFVPAAGAILADWGADV

SEQ ID NO: 783441 - protein, 26 aa, Mycobacterium
SACNPYLTFAVLLAAGLRGVEKGYVL

SEQ ID NO: 783442 - protein, 33 aa, Mycobacterium; identical to SEQ ID NO: 122404

SEQ ID NO: 783443 - protein, 29 aa, Mycobacterium
SDTTTDPVLAWLYVLDAWEGGLPSARYLG

SEQ ID NO: 783444 - protein, 20 aa, Mycobacterium
SFGDDPLRMLRAARFVSQLG

SEQ ID NO: 783445 - protein, 24 aa, Mycobacterium
SGDMNNGFFWRGTGQGLIGADYTI

SEQ ID NO: 783446 - protein, 31 aa, Mycobacterium; identical to SEQ ID NO: 132037

SEQ ID NO: 783447 - protein, 26 aa, Mycobacterium
SGGQRRRLQLMLTLLSEPNVLLLDEP

SEQ ID NO: 783448 - protein, 20 aa, Mycobacterium
SGNPYLAFAAMLMAGIDGIK

SEQ ID NO: 783449 - protein, 23 aa, Mycobacterium
SGNPYLAFSAMLMAGLDGIKNKI

SEQ ID NO: 783450 - protein, 24 aa, Mycobacterium
SGYRGKLWTFRQYSGFGTAEESNR

SEQ ID NO: 783451 - protein, 38 aa, Mycobacterium; identical to SEQ ID NO: 117585

SEQ ID NO: 783452 - protein, 31 aa, Mycobacterium
SHAVTYNAFFAAAAAPPILIGDPARQHGPIR

SEQ ID NO: 783453 - protein, 18 aa, Mycobacterium
SHDTPKTAWLFTGQGSQY

SEQ ID NO: 783454 - protein, 20 aa, Mycobacterium
SITPRDALASAGKTLVELFG

SEQ ID NO: 783455 - protein, 19 aa, Mycobacterium
SIYDCYTITVLLSLEDAGF

SEQ ID NO: 783456 - protein, 25 aa, Mycobacterium
SPEGKSRRFAYPPNLYVVDGGAPQV

SEQ ID NO: 783457 - protein, 24 aa, Mycobacterium
SPRRSGPVVWVKDASRSVPVAAAL

SEQ ID NO: 783458 - protein, 20 aa, Mycobacterium
SPVRSAWLDIPSLVEAAKQT

SEQ ID NO: 783459 - protein, 25 aa, Mycobacterium
SRACEALYHFAWDEFCDWYVELAKT

SEQ ID NO: 783460 - protein, 22 aa, Mycobacterium
SRAMPAYNWMTVAKSALESVNR

SEQ ID NO: 783461 - protein, 23 aa, Mycobacterium
SRARLLLLDEPSSGLDPLMENVF

SEQ ID NO: 783462 - protein, 21 aa, Mycobacterium
SRRILGWRVMSTKATPLVTSV

SEQ ID NO: 783463 - protein, 19 aa, Mycobacterium
SSAARHLAARWAAKEAVIK

SEQ ID NO: 783464 - protein, 25 aa, Mycobacterium
SSNKPVLVDFWATWCGPCKMVAPVL

SEQ ID NO: 783465 - protein, 19 aa, Mycobacterium
STNIPFLQAVLDDPDFQAG

SEQ ID NO: 783466 - protein, 19 aa, Mycobacterium
SYALYPHMTVRQNIAFPLT

SEQ ID NO: 783467 - protein, 25 aa, Mycobacterium
TAGPQLVVPILNARFALNAANARWG

SEQ ID NO: 783468 - protein, 17 aa, Mycobacterium
TARFMTRWQGEPDPRHV

SEQ ID NO: 783469 - protein, 18 aa, Mycobacterium
TARKGTLRDTSAFDLAHH

SEQ ID NO: 783470 - protein, 17 aa, Mycobacterium
TDLALVTDGLRAEREQG

SEQ ID NO: 783471 - protein, 23 aa, Mycobacterium
TDPGRFDVIVTDNLFGDIITDLA

SEQ ID NO: 783472 - protein, 18 aa, Mycobacterium
TEAALGIMGKAHALLESL

SEQ ID NO: 783473 - protein, 24 aa, Mycobacterium
TEANVVNFRRQLGRLGLGHDSRRS

SEQ ID NO: 783474 - protein, 23 aa, Mycobacterium
TGDGIGIVFRKGLPLEDMEFHQF

SEQ ID NO: 783475 - protein, 18 aa, Mycobacterium
TGERGLHHLIWEVVDNSV

SEQ ID NO: 783476 - protein, 20 aa, Mycobacterium
TGMFISLMFAGHHTSSGTSA

SEQ ID NO: 783477 - protein, 27 aa, Mycobacterium
TGRARRCGWFDAVIARYATRVNGITDY

SEQ ID NO: 783478 - protein, 19 aa, Mycobacterium
TGSAIAQHWMYDGKHVLIV

SEQ ID NO: 783479 - protein, 21 aa, Mycobacterium
TGWDYPSCEAIGLLKMDFLGL

SEQ ID NO: 783480 - protein, 24 aa, Mycobacterium
THSHRIPDFVKLAEALGCVGLRCE

SEQ ID NO: 783481 - protein, 24 aa, Mycobacterium
THTKAAYLLHAWQPHLTGPTTTHS

SEQ ID NO: 783482 - protein, 20 aa, Mycobacterium
TLPGAAWQRCRTHYTTNLMS

SEQ ID NO: 783483 - protein, 27 aa, Mycobacterium
TNAVYGFTAMLINLLRDEAPTHIAAAF

SEQ ID NO: 783484 - protein, 29 aa, Mycobacterium
TNHAAGWVRMDFIVPSRGLIGFRTDFLTL

SEQ ID NO: 783485 - protein, 21 aa, Mycobacterium
TNLHHALALAGRHLRRHPNAQ

SEQ ID NO: 783486 - protein, 17 aa, Mycobacterium
TNLPRVLGGLGVAIIST

SEQ ID NO: 783487 - protein, 21 aa, Mycobacterium
TNQKWLRRDFGDKLPSDVFRE

SEQ ID NO: 783488 - protein, 17 aa, Mycobacterium
TNWSRRYKANLEKLASG

SEQ ID NO: 783489 - protein, 17 aa, Mycobacterium
TPSGFDIEYGWDAVTVD

SEQ ID NO: 783490 - protein, 22 aa, Mycobacterium
TPSMVLQAALMVLLHKLGAGDD

SEQ ID NO: 783491 - protein, 29 aa, Mycobacterium
TPVLQVREQLLILPIIGVLDSQRARQVTE

SEQ ID NO: 783492 - protein, 30 aa, Mycobacterium; identical to SEQ ID NO: 223610

SEQ ID NO: 783493 - protein, 20 aa, Mycobacterium
TQKFMAIWRASKPVIAQVHG

SEQ ID NO: 783494 - protein, 25 aa, Mycobacterium
TQVSLAGRYLVYVPGASSTGISRKL

SEQ ID NO: 783495 - protein, 24 aa, Mycobacterium
TRAEGVACYQLFISGLLDVTDNVD

SEQ ID NO: 783496 - protein, 27 aa, Mycobacterium
TRYVGDITYLPLATGANLYLATVIDCC

SEQ ID NO: 783497 - protein, 24 aa, Mycobacterium
TSGQRALYELGMTGIPIVNVNNNC

SEQ ID NO: 783498 - protein, 20 aa, Mycobacterium
TTFGRIGVKVWIYKGDIVGG

SEQ ID NO: 783499 - protein, 18 aa, Mycobacterium
TTSLIDYNRAGVPLIEIV

SEQ ID NO: 783500 - protein, 23 aa, Mycobacterium
TTTTERILYYTGISYKIGEVHDG

SEQ ID NO: 783501 - protein, 24 aa, Mycobacterium
TVKNYVSRLLAKLGMERRTQAAVF

SEQ ID NO: 783502 - protein, 17 aa, Mycobacterium
TVLYPRKGVSELTRFTP

SEQ ID NO: 783503 - protein, 17 aa, Mycobacterium
TYFALMDRLGTDGLLTA

SEQ ID NO: 783504 - protein, 19 aa, Mycobacterium
VAALAAGALESAAAGAGCA

SEQ ID NO: 783505 - protein, 19 aa, Mycobacterium
VAALFSRRGFNIESLAVGA

SEQ ID NO: 783506 - protein, 29 aa, Mycobacterium
VAGFSHFTLLLVHALRQQFSRVRVFAFID

SEQ ID NO: 783507 - protein, 24 aa, Mycobacterium
VAHGTFFFHFPTKEHVLLELERRE

SEQ ID NO: 783508 - protein, 24 aa, Mycobacterium
VAIARAFVNRPLVLLADEPTGNLD

SEQ ID NO: 783509 - protein, 28 aa, Mycobacterium
VARAGKLPVTLFTAGGIATPADAAMMMQ

SEQ ID NO: 783510 - protein, 24 aa, Mycobacterium
VAVLLRITEVFGVDATFFASQDDT

SEQ ID NO: 783511 - protein, 31 aa, Mycobacterium; identical to SEQ ID NO: 122924

SEQ ID NO: 783512 - protein, 24 aa, Mycobacterium
VDICPWALREGLILRKLDSEADGT

SEQ ID NO: 783513 - protein, 22 aa, Mycobacterium
VDQGLSLTLFFKDTATTRDVNK

SEQ ID NO: 783514 - protein, 27 aa, Mycobacterium
VDTRRWAGVPFYLRTGKRLGRRVTEIA

SEQ ID NO: 783515 - protein, 26 aa, Mycobacterium
VEEMGGMNIFFVFGSGGSARLVTPEL

SEQ ID NO: 783516 - protein, 18 aa, Mycobacterium
VELLWKLIEQSPGLEITV

SEQ ID NO: 783517 - protein, 38 aa, Mycobacterium; identical to SEQ ID NO: 122970

SEQ ID NO: 783518 - protein, 23 aa, Mycobacterium
VGGGSGWWNFASGGVGYSGVGNV

SEQ ID NO: 783519 - protein, 17 aa, Mycobacterium
VGGTWRINTYPGLACDV

SEQ ID NO: 783520 - protein, 19 aa, Mycobacterium
VGIFPDRAALIRLVGAVLA

SEQ ID NO: 783521 - protein, 18 aa, Mycobacterium
VHAALRQVLGPNAVQAGS

SEQ ID NO: 783522 - protein, 20 aa, Mycobacterium
VIDRTALILDIFAQHATSRE

SEQ ID NO: 783523 - protein, 19 aa, Mycobacterium
VIEPLPNLVFTRDSSIWIG

SEQ ID NO: 783524 - protein, 21 aa, Mycobacterium
VIERSIIGFGARIGPRALIRD

SEQ ID NO: 783525 - protein, 22 aa, Mycobacterium
VKNYVSRLLAKLGMERRTQAAV

SEQ ID NO: 783526 - protein, 41 aa, Mycobacterium
VLNSVIQYFPSAGYLLDVLAVAMRLLAPGGALFIGDVRNLG

SEQ ID NO: 783527 - protein, 17 aa, Mycobacterium
VLTQCRPELIERTFEAC

SEQ ID NO: 783528 - protein, 17 aa, Mycobacterium
VMRVPLEGGGRLVVELT

SEQ ID NO: 783529 - protein, 19 aa, Mycobacterium
VNKVLLQGKKSLAERIVYG

SEQ ID NO: 783530 - protein, 17 aa, Mycobacterium
VPAYFNDAQRQATKDAG

SEQ ID NO: 783531 - protein, 30 aa, Mycobacterium
VPDNMGMLFRRKLVMFGPREVLLTSDEPVV

SEQ ID NO: 783532 - protein, 18 aa, Mycobacterium
VPLSEMFGYVGDLRSKTQ

SEQ ID NO: 783533 - protein, 21 aa, Mycobacterium
VQALTFHAAAHRQLRYFWPRV

SEQ ID NO: 783534 - protein, 20 aa, Mycobacterium
VRAGARILLSPDGPDLRVQP

SEQ ID NO: 783535 - protein, 21 aa, Mycobacterium
VRAKYGWTDVSRFAALGIPAV

SEQ ID NO: 783536 - protein, 22 aa, Mycobacterium
VRDGMATLNPLAAQIIGQLSSL

SEQ ID NO: 783537 - protein, 18 aa, Mycobacterium
VRLPRLIGHSRAMDMILT

SEQ ID NO: 783538 - protein, 20 aa, Mycobacterium
VRQMLRRVTIIDSGSTEFLP

SEQ ID NO: 783539 - protein, 20 aa, Mycobacterium
VRRSNFVYGSTKAGLDGFYL

SEQ ID NO: 783540 - protein, 22 aa, Mycobacterium
VRRSNFVYGSTKAGLDGFYLGL

SEQ ID NO: 783541 - protein, 23 aa, Mycobacterium
VSLGLYSRIFRNNILASGVIPQI

SEQ ID NO: 783542 - protein, 20 aa, Mycobacterium
VSPPFKQAEFDILYGRGISR

SEQ ID NO: 783543 - protein, 26 aa, Mycobacterium
VSVHPVFNLYNKRWPIRGESENLAPA

SEQ ID NO: 783544 - protein, 20 aa, Mycobacterium
VTDAGPLLPRLHKLVRADCT

SEQ ID NO: 783545 - protein, 18 aa, Mycobacterium
VTVLYPRKGVSELTRFTP

SEQ ID NO: 783546 - protein, 26 aa, Mycobacterium
VVIHNHPYYVCVLAALGRLPELVHQT

SEQ ID NO: 783547 - protein, 19 aa, Mycobacterium
VVKGGRRFSFTALVIVGDG

SEQ ID NO: 783548 - protein, 17 aa, Mycobacterium
VVVGENFTFGKKAAGNV

SEQ ID NO: 783549 - protein, 25 aa, Mycobacterium
VVVIGRGVTVGRPLGLLLTRRSENA

SEQ ID NO: 783550 - protein, 17 aa, Mycobacterium
VVYPHHGAALVEAIETR

SEQ ID NO: 783551 - protein, 18 aa, Mycobacterium
VYQINYLRCIGCGLCIEA

SEQ ID NO: 783552 - protein, 22 aa, Mycobacterium
VYRGAEYSVDFVPKVRVEVVVD

SEQ ID NO: 783553 - protein, 20 aa, Mycobacterium
WGELFNIPLTAHFLGGAVIG

SEQ ID NO: 783554 - protein, 25 aa, Mycobacterium
WMECEKILLFSSDYPHWTFDDPRWL

SEQ ID NO: 783555 - protein, 18 aa, Mycobacterium
WNMFKQNIGIMIAVAQLA

SEQ ID NO: 783556 - protein, 18 aa, Mycobacterium
WNPLWKALCDTNTVMNIH

SEQ ID NO: 783557 - protein, 18 aa, Mycobacterium
WNTAMEELIRAYRAMGST

SEQ ID NO: 783558 - protein, 25 aa, Mycobacterium
WRGVAFKAYSILDIYSRKIVGWRVE

SEQ ID NO: 783559 - protein, 18 aa, Mycobacterium
WRWGIDVNVLGVIHGIKA

SEQ ID NO: 783560 - protein, 31 aa, Mycobacterium; identical to SEQ ID NO: 118618

SEQ ID NO: 783561 - protein, 32 aa, Mycobacterium; identical to SEQ ID NO: 118634

SEQ ID NO: 783562 - protein, 23 aa, Mycobacterium
YFEVLHELKLIVDLMYEGGIARM

SEQ ID NO: 783563 - protein, 17 aa, Mycobacterium
YFLNIKGPELLNKFVGE

SEQ ID NO: 783564 - protein, 18 aa, Mycobacterium
YFPDWLLERRKRAERALT

SEQ ID NO: 783565 - protein, 22 aa, Mycobacterium
YGLIVYQEQIMFIAQKVASYTM

SEQ ID NO: 783566 - protein, 18 aa, Mycobacterium
YKLFKRYASHEGGIADTA

SEQ ID NO: 783567 - protein, 20 aa, Mycobacterium
YLCCHYAIRSLMSQAAHHSG

SEQ ID NO: 783568 - protein, 20 aa, Mycobacterium
YNFQFTGQRFFRIRDGRLDG

SEQ ID NO: 783569 - protein, 17 aa, Mycobacterium
YPVARAYLDARVQTIYG

SEQ ID NO: 783570 - protein, 19 aa, Mycobacterium
YRFRARPFDLVSSPSVCEH

SEQ ID NO: 783571 - protein, 20 aa, Mycobacterium
YRMLPRATFCQPQVASFGLT

SEQ ID NO: 783572 - protein, 20 aa, Mycobacterium
YRQLLNIKTVSRRRTPPQWF

SEQ ID NO: 783573 - protein, 18 aa, Mycobacterium
YSGLPSRFPDLKICLSEG

SEQ ID NO: 783574 - protein, 28 aa, Mycobacterium
YSKEYEIERLMRDAPFLLIGEGTSEIQK

SEQ ID NO: 783575 - protein, 24 aa, Mycobacterium
YSQGGLFPIAYTKGTDFRPAKRLP

SEQ ID NO: 783576 - protein, 26 aa, Mycobacterium
YTKGFKFSTYATWWIRQAITRGMADQ

SEQ ID NO: 783577 - protein, 18 aa, Mycobacterium
YVRSFYFQDPDGITLEFA

SEQ ID NO: 783578 - protein, 17 aa, Mycobacterium
YYADFEGVLAFLQRKMA

SEQ ID NO: 783579 - protein, 20 aa, Mycobacterium
AAAAVLPYRQFHDVAENFRY

SEQ ID NO: 783580 - protein, 19 aa, Mycobacterium
AAAGCPLLMTVVSPTICGT

SEQ ID NO: 783581 - protein, 21 aa, Mycobacterium
AAAGRISYRLGLQGPAVAVDT

SEQ ID NO: 783582 - protein, 20 aa, Mycobacterium
AAAGRISYRLGLQGPSVAVD

SEQ ID NO: 783583 - protein, 22 aa, Mycobacterium
AAALCPVSRLFAGATISVDAEL

SEQ ID NO: 783584 - protein, 29 aa, Mycobacterium
AAALTEWFTVDWHRAIVDKWRAAGVRMAD

SEQ ID NO: 783585 - protein, 19 aa, Mycobacterium
AAAVLPYRQFHDVAENFRY

SEQ ID NO: 783586 - protein, 36 aa, Mycobacterium; identical to SEQ ID NO: 112941

SEQ ID NO: 783587 - protein, 23 aa, Mycobacterium
AADRLACWLVGCGVGRGDVVAVV

SEQ ID NO: 783588 - protein, 23 aa, Mycobacterium
AAEDWLCLLEAFDQPHRPGMVRA

SEQ ID NO: 783589 - protein, 28 aa, Mycobacterium
AAEICDGWLPIFYTPRMADTYNAWLDEG

SEQ ID NO: 783590 - protein, 24 aa, Mycobacterium
AAELMGIQIPRFCDHPLLEPVGAC

SEQ ID NO: 783591 - protein, 32 aa, Mycobacterium
AAELSDGTLRFLLWAAALLSPSPPSLMVLNEP

SEQ ID NO: 783592 - protein, 22 aa, Mycobacterium
AAELSMVLLDTAAMADLHMRWM

SEQ ID NO: 783593 - protein, 20 aa, Mycobacterium
AAEPSPLLRRRSLTTRTEAI

SEQ ID NO: 783594 - protein, 18 aa, Mycobacterium
AAFELVVVNLYPFSETVD

SEQ ID NO: 783595 - protein, 23 aa, Mycobacterium
AAGPLREWLHKQRTGLPHVTWKY

SEQ ID NO: 783596 - protein, 23 aa, Mycobacterium
AAITMIEMLAMSDLSLMVKAGVQ

SEQ ID NO: 783597 - protein, 24 aa, Mycobacterium
AAIVGVLELPWVTGQVVHADGGLA

SEQ ID NO: 783598 - protein, 20 aa, Mycobacterium
AAKLLDLQPYLDRKPKDLSG

SEQ ID NO: 783599 - protein, 25 aa, Mycobacterium
AALGDLPLIYPFLVNDPGEGTQAKR

SEQ ID NO: 783600 - protein, 25 aa, Mycobacterium
AALHAPLDAFIVRKLGAPGHEEFAV

SEQ ID NO: 783601 - protein, 23 aa, Mycobacterium
AALISPLRLRGMSAMLARIKRRL

SEQ ID NO: 783602 - protein, 17 aa, Mycobacterium
AALSRRGPHRVLRGDLA

SEQ ID NO: 783603 - protein, 18 aa, Mycobacterium
AANTPMLLKAGLVDGNTE

SEQ ID NO: 783604 - protein, 26 aa, Mycobacterium
AAPDDLLDALSLWAPTQSVTAYDAVA

SEQ ID NO: 783605 - protein, 19 aa, Mycobacterium
AAPYVGWLDAAAGQAAAAA

SEQ ID NO: 783606 - protein, 27 aa, Mycobacterium
AAQISKPMLYLYYGSKEDLFGACLNRE

SEQ ID NO: 783607 - protein, 33 aa, Mycobacterium; identical to SEQ ID NO: 123518

SEQ ID NO: 783608 - protein, 18 aa, Mycobacterium
AARDLQFELAARFRDEIA

SEQ ID NO: 783609 - protein, 19 aa, Mycobacterium
AARDLQFELAARFRDEIAD

SEQ ID NO: 783610 - protein, 29 aa, Mycobacterium
AASAMVAAAGPYASWLGAAAARAAGASAS

SEQ ID NO: 783611 - protein, 32 aa, Mycobacterium; identical to SEQ ID NO: 113016

SEQ ID NO: 783612 - protein, 25 aa, Mycobacterium
AATIKKVFLELGGKSAFIVLDDADL

SEQ ID NO: 783613 - protein, 17 aa, Mycobacterium
AAYTGIDPYFDDLFLMA

SEQ ID NO: 783614 - protein, 25 aa, Mycobacterium
ACDHWGVVPDVYLLGKALGGGVVPL

SEQ ID NO: 783615 - protein, 17 aa, Mycobacterium
ACPGCFKHYGLEERIKA

SEQ ID NO: 783616 - protein, 28 aa, Mycobacterium
ACQIAGITYRQLDYWARTSLVVPSIRSA

SEQ ID NO: 783617 - protein, 31 aa, Mycobacterium
ADAMPAQWSLMVLLAAWLAMRFGELTELRRK

SEQ ID NO: 783618 - protein, 24 aa, Mycobacterium
ADEFHPELQFDKPYLLAMANAGPG

SEQ ID NO: 783619 - protein, 28 aa, Mycobacterium
ADGLFVGRPMWLPLDDAGIVRFYRDVAE

SEQ ID NO: 783620 - protein, 33 aa, Mycobacterium
ADHLIEIPAVSTLLQPLLSTIPLQVFAAAVAQA

SEQ ID NO: 783621 - protein, 35 aa, Mycobacterium
ADKAAHFITVADSFHLPIVFLADNPGMLPGSRSER

SEQ ID NO: 783622 - protein, 28 aa, Mycobacterium
ADKPAVIAEMFRVLVPGGRIGISDVVAE

SEQ ID NO: 783623 - protein, 19 aa, Mycobacterium
ADKYRRLHVIIGDANLAET

SEQ ID NO: 783624 - protein, 21 aa, Mycobacterium
ADLVLPDRYLQAEPLVSIIED

SEQ ID NO: 783625 - protein, 24 aa, Mycobacterium
ADNPDLLIDFARVTLRRGGNTLVG

SEQ ID NO: 783626 - protein, 29 aa, Mycobacterium
ADPSPSDVCEPLFRVWPVSGRTAEALNAQ

SEQ ID NO: 783627 - protein, 25 aa, Mycobacterium
ADRHPGWHALRKLAARITTPLLPDD

SEQ ID NO: 783628 - protein, 19 aa, Mycobacterium
ADRLYFEPLTFEDVLEVFR

SEQ ID NO: 783629 - protein, 23 aa, Mycobacterium
ADRYRRLHVIIGDANLAETSTYL

SEQ ID NO: 783630 - protein, 22 aa, Mycobacterium
ADSGMLAALYVLAALGEQDRPL

SEQ ID NO: 783631 - protein, 27 aa, Mycobacterium
ADSWMEIEAFRLLTLQTAWKIDQFNDY

SEQ ID NO: 783632 - protein, 26 aa, Mycobacterium
ADYKGRRVIVYFYPAASTPGCTKQAC

SEQ ID NO: 783633 - protein, 35 aa, Mycobacterium; identical to SEQ ID NO: 123694

SEQ ID NO: 783634 - protein, 26 aa, Mycobacterium
AEAITDRILLLDGLPNYQRIGSLRVG

SEQ ID NO: 783635 - protein, 27 aa, Mycobacterium
AEALGEGWFWPAAAAHPSLPRGALLQI

SEQ ID NO: 783636 - protein, 20 aa, Mycobacterium
AEAMLLMRAGREYALKRALA

SEQ ID NO: 783637 - protein, 25 aa, Mycobacterium
AEAPARAYNPLFIWGESGLGKTHLL

SEQ ID NO: 783638 - protein, 32 aa, Mycobacterium
AEAQRRYFESVAPYARRLLLPQDAPKVDDITG

SEQ ID NO: 783639 - protein, 24 aa, Mycobacterium
AEDHALRLLNLRRAARSVEGAGPG

SEQ ID NO: 783640 - protein, 24 aa, Mycobacterium
AEEVDKMVWATRWGADTIMDLSTG

SEQ ID NO: 783641 - protein, 22 aa, Mycobacterium
AEFERPVLLFSGGKDSIVMLHL

SEQ ID NO: 783642 - protein, 19 aa, Mycobacterium
AEFGGIDYLVNNAAIFGGM

SEQ ID NO: 783643 - protein, 23 aa, Mycobacterium
AEGHAAKVLNLRSTLLTLAGGDA

SEQ ID NO: 783644 - protein, 28 aa, Mycobacterium
AEGTFEYQALLFIPSHAPFDLFNRDAQT

SEQ ID NO: 783645 - protein, 19 aa, Mycobacterium
AEHGLWYPPDPSSFEICSI

SEQ ID NO: 783646 - protein, 20 aa, Mycobacterium
AEHGLWYPPDPSSFEICSIG

SEQ ID NO: 783647 - protein, 17 aa, Mycobacterium
AEKALDLPTLYASGRAG

SEQ ID NO: 783648 - protein, 22 aa, Mycobacterium
AELAIRFRDKGVVGFDIAGAEA

SEQ ID NO: 783649 - protein, 23 aa, Mycobacterium
AELAIRFRDKGVVGFDIAGAEAG

SEQ ID NO: 783650 - protein, 22 aa, Mycobacterium
AELMLRKATWLYDNGKPCGREA

SEQ ID NO: 783651 - protein, 18 aa, Mycobacterium
AELMRPIARKYDLKEHAY

SEQ ID NO: 783652 - protein, 24 aa, Mycobacterium
AENRMVCLPYPKLLNSIMSVDMAA

SEQ ID NO: 783653 - protein, 40 aa, Mycobacterium
AENRSRFVIEPLEPGFGYTLGNSLRRTLLSSIPGAAVTSI

SEQ ID NO: 783654 - protein, 28 aa, Mycobacterium
AEPEDFVGALIYLLSDASSFYTGQVMYL

SEQ ID NO: 783655 - protein, 24 aa, Mycobacterium
AERDKLWRKVWQQVGRVEDLPKVG

SEQ ID NO: 783656 - protein, 18 aa, Mycobacterium
AERGRMFGSLPEGGRMVA

SEQ ID NO: 783657 - protein, 24 aa, Mycobacterium
AERTAWRICSHNRLWSVFGKRKRG

SEQ ID NO: 783658 - protein, 26 aa, Mycobacterium
AEVLRPGLLVLPVRGAARFFGSEQQA

SEQ ID NO: 783659 - protein, 21 aa, Mycobacterium
AEWIIAAFGLLTAGGVLVPVN

SEQ ID NO: 783660 - protein, 17 aa, Mycobacterium
AFARMFGGSIVPQEVEA

SEQ ID NO: 783661 - protein, 22 aa, Mycobacterium
AFEKRWQLGGVLFSKTFPDQMT

SEQ ID NO: 783662 - protein, 18 aa, Mycobacterium
AFGLLTAGGVLVPVNTRF

SEQ ID NO: 783663 - protein, 17 aa, Mycobacterium
AFLLADMAAAVDSARAT

SEQ ID NO: 783664 - protein, 19 aa, Mycobacterium
AFPLSNWTEFDIWSYIGAE

SEQ ID NO: 783665 - protein, 23 aa, Mycobacterium
AFTASFAGLVPNAGLGAYGVAKY

SEQ ID NO: 783666 - protein, 19 aa, Mycobacterium
AFVGRIQPLKAPDIVLRAV

SEQ ID NO: 783667 - protein, 18 aa, Mycobacterium
AFVSERIGLAAQAYSSAQ

SEQ ID NO: 783668 - protein, 25 aa, Mycobacterium
AFVTDVYARKIVGWKVATEMTQKLV

SEQ ID NO: 783669 - protein, 25 aa, Mycobacterium
AGADPVIMLTAPIPATQKALKKSGL

SEQ ID NO: 783670 - protein, 24 aa, Mycobacterium
AGAETLALGDYRMLPRATFCQPQV

SEQ ID NO: 783671 - protein, 39 aa, Mycobacterium
AGCDKSIPGMLMAAARLDLASVFFYNGSIMPGVAKLTDG

SEQ ID NO: 783672 - protein, 21 aa, Mycobacterium
AGEWVLEDLLIDAEQRLADEG

SEQ ID NO: 783673 - protein, 19 aa, Mycobacterium
AGHIYAVIGLKDTTTGDTL

SEQ ID NO: 783674 - protein, 21 aa, Mycobacterium
AGIIYQATLRRELTRSIGVEW

SEQ ID NO: 783675 - protein, 27 aa, Mycobacterium
AGISRPTFYFYFPSKEAVLLTLLDRVV

SEQ ID NO: 783676 - protein, 29 aa, Mycobacterium
AGLVSEMIVRNICWSTALMLEPDKLALID

SEQ ID NO: 783677 - protein, 17 aa, Mycobacterium
AGMPLRAAARRCPDATF

SEQ ID NO: 783678 - protein, 23 aa, Mycobacterium
AGNKIILFGARTGLDGIGGVSVL

SEQ ID NO: 783679 - protein, 21 aa, Mycobacterium
AGPALACGNAFILKPSERDPS

SEQ ID NO: 783680 - protein, 26 aa, Mycobacterium
AGPDRSILRPASWDIDLPDQFTAAER

SEQ ID NO: 783681 - protein, 28 aa, Mycobacterium
AGPEYSHLTLSWVYDWMAQGVPVVAMHR

SEQ ID NO: 783682 - protein, 27 aa, Mycobacterium
AGQIGYSLLFRLASGSLLGPDRPIELR

SEQ ID NO: 783683 - protein, 19 aa, Mycobacterium
AGRHLAFSTGRHFCLGAAL

SEQ ID NO: 783684 - protein, 29 aa, Mycobacterium
AGRVVEFMLLDRLFPRSVFYSLRLAEHNL

SEQ ID NO: 783685 - protein, 27 aa, Mycobacterium
AGSAPATLLDYFPEDFLLVIDESHVTV

SEQ ID NO: 783686 - protein, 18 aa, Mycobacterium
AGSRFFELIGAPMTSFYD

SEQ ID NO: 783687 - protein, 20 aa, Mycobacterium
AGSRFLLDQPTTSAGRHPDS

SEQ ID NO: 783688 - protein, 24 aa, Mycobacterium
AGSVILNTGPWYPKLHYAFADHCS

SEQ ID NO: 783689 - protein, 25 aa, Mycobacterium
AGTEPAHLLRWQDGIWAECGNVLGV

SEQ ID NO: 783690 - protein, 25 aa, Mycobacterium
AGTGWLHGWRLTFGGEDIGWEGALA

SEQ ID NO: 783691 - protein, 25 aa, Mycobacterium
AGVRRNRFLIYTSADIRALYTFKRV

SEQ ID NO: 783692 - protein, 20 aa, Mycobacterium
AGVSGLWLLSGMREDGVLTT

SEQ ID NO: 783693 - protein, 39 aa, Mycobacterium
AGWQSFRVPCLPSDRLLNLLHYVKWYLDGTLTFRRSCAH

SEQ ID NO: 783694 - protein, 36 aa, Mycobacterium
AHAAGPAIAAVLPGCASRGGIRPLATGYAITAVPTG

SEQ ID NO: 783695 - protein, 23 aa, Mycobacterium
AHAPGQLDFLGYGAQRALDAGVP

SEQ ID NO: 783696 - protein, 19 aa, Mycobacterium
AHAVLVDHLIPPMARAETY

SEQ ID NO: 783697 - protein, 20 aa, Mycobacterium
AHAVLVDHLIPPMARAETYG

SEQ ID NO: 783698 - protein, 24 aa, Mycobacterium
AHDEGWLAEHMLILKLISPENKAY

SEQ ID NO: 783699 - protein, 25 aa, Mycobacterium
AHDEGWLAEHMLILKLISPENKAYY

SEQ ID NO: 783700 - protein, 18 aa, Mycobacterium
AHDRGVFVLAATSNPEGA

SEQ ID NO: 783701 - protein, 35 aa, Mycobacterium
AHERSLNIDFLLGYLRELLPRRPDLKLIVTSATIE

SEQ ID NO: 783702 - protein, 21 aa, Mycobacterium
AHFKFVHKTPIVPVFTRHDFA

SEQ ID NO: 783703 - protein, 22 aa, Mycobacterium
AHGGLGWVYLAFDKNVNDRPVV

SEQ ID NO: 783704 - protein, 19 aa, Mycobacterium
AHMGTICEIAYGFPGYDSV

SEQ ID NO: 783705 - protein, 17 aa, Mycobacterium
AHMLEDVPNLFWCVGYT

SEQ ID NO: 783706 - protein, 18 aa, Mycobacterium
AHNIGHFRFVECSRLVNG

SEQ ID NO: 783707 - protein, 39 aa, Mycobacterium
AHSYYVPAQLFPTADGYLALFITHDGFWKSFAAEAGIGG

SEQ ID NO: 783708 - protein, 25 aa, Mycobacterium
AHTEFPYIFCDATFCKVRVGAHVVS

SEQ ID NO: 783709 - protein, 19 aa, Mycobacterium
AHVDLYFEAAVAGAIPVIR

SEQ ID NO: 783710 - protein, 19 aa, Mycobacterium
AHYGMICDASYSTYFLAHW

SEQ ID NO: 783711 - protein, 25 aa, Mycobacterium
AHYVNDFALALAPFSIRMNAVHPTN

SEQ ID NO: 783712 - protein, 26 aa, Mycobacterium
AIEIGIKWLSLYAFSTENWKRSPEEV

SEQ ID NO: 783713 - protein, 20 aa, Mycobacterium
AIGALSFAYTGPGPLTERVN

SEQ ID NO: 783714 - protein, 23 aa, Mycobacterium
AIGSHWPFEQWGRFLPEQTTAVS

SEQ ID NO: 783715 - protein, 24 aa, Mycobacterium
AIITGWDYPSCEAIGLLKMDFLGL

SEQ ID NO: 783716 - protein, 19 aa, Mycobacterium
AILDEWKTITGLDRKVDDA

SEQ ID NO: 783717 - protein, 22 aa, Mycobacterium
AIMVRMPAFGLDGPWRDRVGFA

SEQ ID NO: 783718 - protein, 19 aa, Mycobacterium
AIQELTLPLALAGDDLIGQ

SEQ ID NO: 783719 - protein, 20 aa, Mycobacterium
AIRAITCLPALVGAWRHVGG

SEQ ID NO: 783720 - protein, 22 aa, Mycobacterium
AITMIEMLAMSDLSLMVKAGVQ

SEQ ID NO: 783721 - protein, 19 aa, Mycobacterium
AITTRLVVPRARYDEAVAI

SEQ ID NO: 783722 - protein, 17 aa, Mycobacterium
AKAKIRQWFAKERREEA

SEQ ID NO: 783723 - protein, 29 aa, Mycobacterium
AKAYAAAWGVPFYAVNHLGGHLAADVYEH

SEQ ID NO: 783724 - protein, 26 aa, Mycobacterium
AKDAAYLPMAPNFDDSLAFLAAQDLI

SEQ ID NO: 783725 - protein, 27 aa, Mycobacterium
AKKRPDFSKLTPLYPNQRLRLETTPDR

SEQ ID NO: 783726 - protein, 18 aa, Mycobacterium
AKRKLIPGLAYLDQSELA

SEQ ID NO: 783727 - protein, 26 aa, Mycobacterium
AKSLAAAPFADILWMETKTADLADAK

SEQ ID NO: 783728 - protein, 26 aa, Mycobacterium
AKSLAAAPFADILWMETKTADLADAR

SEQ ID NO: 783729 - protein, 25 aa, Mycobacterium
AKSPVSFFAYPGMPSDLVPAGCEVH

SEQ ID NO: 783730 - protein, 23 aa, Mycobacterium
AKWGQLSDVVLLLPHGHEGQGPD

SEQ ID NO: 783731 - protein, 19 aa, Mycobacterium
ALAGWNPTWLKLVCTVGAD

SEQ ID NO: 783732 - protein, 19 aa, Mycobacterium
ALAILTARHLDCWVLGTVC

SEQ ID NO: 783733 - protein, 19 aa, Mycobacterium
ALALGAQGAWTGSQWLMVE

SEQ ID NO: 783734 - protein, 25 aa, Mycobacterium
ALALMGKVFALRPHFEWRGLGFISQ

SEQ ID NO: 783735 - protein, 26 aa, Mycobacterium
ALAMDPQHRMLLELSWEALERAGIDP

SEQ ID NO: 783736 - protein, 26 aa, Mycobacterium
ALATQLPHYMVPTALIPIAELPLTVN

SEQ ID NO: 783737 - protein, 18 aa, Mycobacterium
ALAVRGLGSCWIGSTIFA

SEQ ID NO: 783738 - protein, 22 aa, Mycobacterium
ALDITLYRDDLMSKPPRPLEET

SEQ ID NO: 783739 - protein, 19 aa, Mycobacterium
ALDPQRVVLLPDGTEDYWS

SEQ ID NO: 783740 - protein, 25 aa, Mycobacterium
ALEPIGLMRRVGLGETLRIALMGND

SEQ ID NO: 783741 - protein, 27 aa, Mycobacterium
ALESILTVLALRDGVIPPTLNYETPDP

SEQ ID NO: 783742 - protein, 29 aa, Mycobacterium
ALFAVEMGLARLWQSWGFEPDVVLGHSVG

SEQ ID NO: 783743 - protein, 35 aa, Mycobacterium; identical to SEQ ID NO: 124117

SEQ ID NO: 783744 - protein, 24 aa, Mycobacterium
ALGDYEWILAFEAPELHRIVDLMR

SEQ ID NO: 783745 - protein, 20 aa, Mycobacterium
ALGLATFYNALAQEKLLSRE

SEQ ID NO: 783746 - protein, 26 aa, Mycobacterium
ALGTALARLGMFAPALSYLEEPEGPV

SEQ ID NO: 783747 - protein, 18 aa, Mycobacterium
ALHHPCCGDLTYGADPTL

SEQ ID NO: 783748 - protein, 18 aa, Mycobacterium
ALHHPCCGDLVYGADPKL

SEQ ID NO: 783749 - protein, 18 aa, Mycobacterium
ALHTRLPGLGALLAAGEV

SEQ ID NO: 783750 - protein, 19 aa, Mycobacterium
ALINASSLGTRTGRVARRS

SEQ ID NO: 783751 - protein, 20 aa, Mycobacterium
ALNAISGRVAFALGFEGPAV

SEQ ID NO: 783752 - protein, 29 aa, Mycobacterium
ALNCEIVPWCRFARKNYFYPDMPKNYQIS

SEQ ID NO: 783753 - protein, 33 aa, Mycobacterium
ALNCEIVPWCRFARKNYFYPDMPKNYQISQYDE

SEQ ID NO: 783754 - protein, 21 aa, Mycobacterium
ALNDDTRPRKLRPGDSLLVDT

SEQ ID NO: 783755 - protein, 32 aa, Mycobacterium
ALNPETFYWAHATFFMLIIKTAEYFCGGLTEA

SEQ ID NO: 783756 - protein, 27 aa, Mycobacterium
ALPVKLCYAGPFFRYERPQAGRYRQLQ

SEQ ID NO: 783757 - protein, 18 aa, Mycobacterium
ALRKTLGVPLFQEQLMQL

SEQ ID NO: 783758 - protein, 18 aa, Mycobacterium
ALRMLTLPATFGLYVERA

SEQ ID NO: 783759 - protein, 17 aa, Mycobacterium
ALRQVLGPNAVQAGSLN

SEQ ID NO: 783760 - protein, 17 aa, Mycobacterium
ALRVGVPIYVEEPVLAQ

SEQ ID NO: 783761 - protein, 26 aa, Mycobacterium
ALSQARFEFRWNDQFALSLDPDTARE

SEQ ID NO: 783762 - protein, 22 aa, Mycobacterium
ALTAGILRYSRDLAFAAASAYA

SEQ ID NO: 783763 - protein, 30 aa, Mycobacterium; identical to SEQ ID NO: 119060

SEQ ID NO: 783764 - protein, 28 aa, Mycobacterium
ALVLARVARLVFGAWEPKTGAVGSLWDV

SEQ ID NO: 783765 - protein, 22 aa, Mycobacterium
ALVNHVLPYSQLFGPNVVGTAE

SEQ ID NO: 783766 - protein, 24 aa, Mycobacterium
ALVPARGRLLLIDSGEPGPGRRLL

SEQ ID NO: 783767 - protein, 21 aa, Mycobacterium
ALWAATFLRRRGAAADAVLLN

SEQ ID NO: 783768 - protein, 25 aa, Mycobacterium
AMAEGTRFLVLAPVVRTRKGEFADL

SEQ ID NO: 783769 - protein, 18 aa, Mycobacterium
AMALLRRGDLSVTEVCFA

SEQ ID NO: 783770 - protein, 20 aa, Mycobacterium
AMFDPSAVFYMNKIAVGPEA

SEQ ID NO: 783771 - protein, 27 aa, Mycobacterium
AMLGQPVSMLIPRVVGFKLTGEIQPGV

SEQ ID NO: 783772 - protein, 21 aa, Mycobacterium
AMMDYFANFTGKLSHGVYKMP

SEQ ID NO: 783773 - protein, 21 aa, Mycobacterium
AMPQRIWDQKLAEVPMGRAGE

SEQ ID NO: 783774 - protein, 19 aa, Mycobacterium
AMSLAPLAYTLFQRQMRHD

SEQ ID NO: 783775 - protein, 20 aa, Mycobacterium
AMSLAPLAYTLFQRTMRHDP

SEQ ID NO: 783776 - protein, 18 aa, Mycobacterium
AMTLARVDFAANTLTWTG

SEQ ID NO: 783777 - protein, 32 aa, Mycobacterium
ANASIPTPQPVLPRPMFGAAPAAAAATSVHFV

SEQ ID NO: 783778 - protein, 20 aa, Mycobacterium
ANFLSILDEGRIAIAALATG

SEQ ID NO: 783779 - protein, 25 aa, Mycobacterium
ANGIDAPALWPGLPVRPVKGEVLRL

SEQ ID NO: 783780 - protein, 25 aa, Mycobacterium
ANIAPWLRAAHRYGAKVKWAEIDIE

SEQ ID NO: 783781 - protein, 25 aa, Mycobacterium
ANIAPWLRAAHRYGAKVKWAEVDIE

SEQ ID NO: 783782 - protein, 20 aa, Mycobacterium
ANIPLRVPPAELLPERTPHV

SEQ ID NO: 783783 - protein, 17 aa, Mycobacterium
ANLEGGFFIGPTLFDHV

SEQ ID NO: 783784 - protein, 17 aa, Mycobacterium
ANLKRAWELMGMRVHWQ

SEQ ID NO: 783785 - protein, 18 aa, Mycobacterium
ANLNALVGLARPGKFGGD

SEQ ID NO: 783786 - protein, 24 aa, Mycobacterium
APDGTLLWTQRRSIFARGEGGFGG

SEQ ID NO: 783787 - protein, 17 aa, Mycobacterium
APEDLAPPAPADLPPAP

SEQ ID NO: 783788 - protein, 27 aa, Mycobacterium
APEHVHTYRITPLALWNARAAGHDAEQ

SEQ ID NO: 783789 - protein, 24 aa, Mycobacterium
APGDFVILNWRAVCGQCRACKRGR

SEQ ID NO: 783790 - protein, 21 aa, Mycobacterium
APGEIIHHPYFGLTVVSCERG

SEQ ID NO: 783791 - protein, 26 aa, Mycobacterium
APGHTPGSSVLWLDAGRPAVFVGDLT

SEQ ID NO: 783792 - protein, 27 aa, Mycobacterium
APIATVAAMKVAPGHTLSAGSTKPAGP

SEQ ID NO: 783793 - protein, 35 aa, Mycobacterium; identical to SEQ ID NO: 113378

SEQ ID NO: 783794 - protein, 18 aa, Mycobacterium
APLYYNEKYNFYALSRYE

SEQ ID NO: 783795 - protein, 17 aa, Mycobacterium
APMRRLRQVRPVDVWKA

SEQ ID NO: 783796 - protein, 22 aa, Mycobacterium
APNILYLVWDDTGIATWDCFGG

SEQ ID NO: 783797 - protein, 22 aa, Mycobacterium
APPDARFGWPKRNGFVQPMVDA

SEQ ID NO: 783798 - protein, 22 aa, Mycobacterium
APRGSVYYHFPDGRNQILIEAL

SEQ ID NO: 783799 - protein, 18 aa, Mycobacterium
APSWRKGPRHIAGRGPRD

SEQ ID NO: 783800 - protein, 19 aa, Mycobacterium
APVRERLALGFGSSSFRYA

SEQ ID NO: 783801 - protein, 20 aa, Mycobacterium
APVTFVDIAGIVKGASEGAG

SEQ ID NO: 783802 - protein, 19 aa, Mycobacterium
APYSDLIWMETGTPDLELA

SEQ ID NO: 783803 - protein, 21 aa, Mycobacterium
APYSDLIWMETGTPDLELAAK

SEQ ID NO: 783804 - protein, 29 aa, Mycobacterium
AQETLIALTRLRELIDRYPLRGIKGPMGT

SEQ ID NO: 783805 - protein, 17 aa, Mycobacterium
AQFKLREGMPIGARVTL

SEQ ID NO: 783806 - protein, 22 aa, Mycobacterium
AQFQAAGFMRTGPTRPPYTEVP

SEQ ID NO: 783807 - protein, 19 aa, Mycobacterium
AQLFHTSGHLDWYADGMFP

SEQ ID NO: 783808 - protein, 17 aa, Mycobacterium
AQLIARRVREARVFSEV

SEQ ID NO: 783809 - protein, 20 aa, Mycobacterium
AQLLHEVWGYDFFGGTRTVD

SEQ ID NO: 783810 - protein, 18 aa, Mycobacterium
AQLRSDVGMVFQSFNLFA

SEQ ID NO: 783811 - protein, 32 aa, Mycobacterium
AQPALFAVEVALYRLLESWGMRPGLVMGHSVG

SEQ ID NO: 783812 - protein, 24 aa, Mycobacterium
AQRQVPAILDLLATGAINLGELIT

SEQ ID NO: 783813 - protein, 23 aa, Mycobacterium
AQRRDMMWICRDGDRAKNHLLEA

SEQ ID NO: 783814 - protein, 19 aa, Mycobacterium
AQWIEQCTVQRVSLQGGLV

SEQ ID NO: 783815 - protein, 23 aa, Mycobacterium
ARAAGMPGVFGMGLLHGGVLAQR

SEQ ID NO: 783816 - protein, 19 aa, Mycobacterium
ARAALTRAIHKLPIKARII

SEQ ID NO: 783817 - protein, 17 aa, Mycobacterium
ARAILIRPAPVPGFRGP

SEQ ID NO: 783818 - protein, 25 aa, Mycobacterium
ARALAADPPVLLMDEPFGAVDPITR

SEQ ID NO: 783819 - protein, 24 aa, Mycobacterium
ARARYLMLRLLERAGEQRVAIPAL

SEQ ID NO: 783820 - protein, 24 aa, Mycobacterium
ARARYLMLRLLERAGEQRVAIPSL

SEQ ID NO: 783821 - protein, 19 aa, Mycobacterium
ARCDAVALFVKHARASQRS

SEQ ID NO: 783822 - protein, 25 aa, Mycobacterium
ARDEGWLAEHMLILKLISPENKAYY

SEQ ID NO: 783823 - protein, 24 aa, Mycobacterium
AREAGVSLPGPGGLLKAMTKTVIE

SEQ ID NO: 783824 - protein, 23 aa, Mycobacterium
ARGFRFVGILMNGADRRWTEQAL

SEQ ID NO: 783825 - protein, 18 aa, Mycobacterium
ARGPMGLPELTSTKWIVW

SEQ ID NO: 783826 - protein, 18 aa, Mycobacterium
ARIDGLLREIRLVRALSG

SEQ ID NO: 783827 - protein, 27 aa, Mycobacterium
ARKSPQMSEVLPLLYLHGLSSNDFTPA

SEQ ID NO: 783828 - protein, 27 aa, Mycobacterium
ARLDGLDSLLSIVQMPAGVPVATVSIG

SEQ ID NO: 783829 - protein, 27 aa, Mycobacterium
ARLHRHPPVWVPLPVHYADYTLWHHQL

SEQ ID NO: 783830 - protein, 27 aa, Mycobacterium
ARLTVPLGMIILRKGYGLGAMAMAGGS

SEQ ID NO: 783831 - protein, 22 aa, Mycobacterium
ARLVGAMSVPPTWEGSIPKGLS

SEQ ID NO: 783832 - protein, 19 aa, Mycobacterium
ARNLRFRGNMRGSLSGTLA

SEQ ID NO: 783833 - protein, 24 aa, Mycobacterium
ARQALTEAVLWPLQHPDTFARLGV

SEQ ID NO: 783834 - protein, 26 aa, Mycobacterium
ARQLRLRIDATWRWASAIATAWQHLR

SEQ ID NO: 783835 - protein, 22 aa, Mycobacterium
ARRHVGELLGINEATLRNWVEN

SEQ ID NO: 783836 - protein, 18 aa, Mycobacterium
ARRIARNTQLLLLEESHV

SEQ ID NO: 783837 - protein, 23 aa, Mycobacterium
ARSLTLSAFANKVTVGFTSDIKN

SEQ ID NO: 783838 - protein, 31 aa, Mycobacterium
ARTFGMDSWFPSLKIYNRLGQLYTAVDAELM

SEQ ID NO: 783839 - protein, 26 aa, Mycobacterium
ARTFGMDSWFPSLKIYNRNGQLYTSV

SEQ ID NO: 783840 - protein, 24 aa, Mycobacterium
ARVASRVLALLPTVAKDQALRSAA

SEQ ID NO: 783841 - protein, 20 aa, Mycobacterium
ARVCGICPVAYQVSACNAIE

SEQ ID NO: 783842 - protein, 23 aa, Mycobacterium
ARYSRHLIIPDLGLDGQKRLKNA

SEQ ID NO: 783843 - protein, 24 aa, Mycobacterium
ASAGYMLMKPLVETATAAGARALY

SEQ ID NO: 783844 - protein, 25 aa, Mycobacterium
ASDAAEWFAGRLPEDWFDGDPTVIV

SEQ ID NO: 783845 - protein, 27 aa, Mycobacterium
ASFLVKDLHLPWQWGAEWFLDQLVDGD

SEQ ID NO: 783846 - protein, 24 aa, Mycobacterium
ASGRWVPDFLSLPIAIENSLKNQT

SEQ ID NO: 783847 - protein, 23 aa, Mycobacterium
ASGYKISVPHAVRISPDGIYLHE

SEQ ID NO: 783848 - protein, 18 aa, Mycobacterium
ASKRFRRTGTGKIVRQKA

SEQ ID NO: 783849 - protein, 20 aa, Mycobacterium
ASKRIAPIVILTAFSQRELV

SEQ ID NO: 783850 - protein, 24 aa, Mycobacterium
ASLAKALLPIMNPGGSIVGMDFDP

SEQ ID NO: 783851 - protein, 23 aa, Mycobacterium
ASMLEPIWQVMPPSKAEGVWTTH

SEQ ID NO: 783852 - protein, 20 aa, Mycobacterium
ASRFVACPFGGPGARMYRTG

SEQ ID NO: 783853 - protein, 27 aa, Mycobacterium
ASRPIAGPFHFYHCSIPCEGGGALVLG

SEQ ID NO: 783854 - protein, 23 aa, Mycobacterium
ATAAGRAVFTPSLAGLVLGEYRR

SEQ ID NO: 783855 - protein, 17 aa, Mycobacterium
ATAIDALRRPERRRGMA

SEQ ID NO: 783856 - protein, 27 aa, Mycobacterium
ATARPVCAALLEALRRHGVPEQILTDN

SEQ ID NO: 783857 - protein, 19 aa, Mycobacterium
ATGINFGPWGQGGMASSEA

SEQ ID NO: 783858 - protein, 32 aa, Mycobacterium
ATGRFDDEQLFYLRARGIPEDQARRLVVRGFF

SEQ ID NO: 783859 - protein, 25 aa, Mycobacterium
ATKRPEDFRFLIRLARQQGERLGRA

SEQ ID NO: 783860 - protein, 26 aa, Mycobacterium
ATLRTRVPFVHFFDGFRTSHELNTIE

SEQ ID NO: 783861 - protein, 20 aa, Mycobacterium
ATPRHHGISIVLVEPGPGLN

SEQ ID NO: 783862 - protein, 25 aa, Mycobacterium
ATQLGIPIPGFSSALSYYDALRTER

SEQ ID NO: 783863 - protein, 30 aa, Mycobacterium
AVAQEQTWDAFLARFAAIAGPVTLRQWSCV

SEQ ID NO: 783864 - protein, 22 aa, Mycobacterium
AVASYELFSSTEILGRLAMEKM

SEQ ID NO: 783865 - protein, 19 aa, Mycobacterium
AVDLAFQRVLRSVIYEPAS

SEQ ID NO: 783866 - protein, 18 aa, Mycobacterium
AVDWLYSGLPSRFPDLKI

SEQ ID NO: 783867 - protein, 20 aa, Mycobacterium
AVEFPPAGTLTGIAKRELRG

SEQ ID NO: 783868 - protein, 23 aa, Mycobacterium
AVGHLLSAFVAITPLDPSQPDDA

SEQ ID NO: 783869 - protein, 26 aa, Mycobacterium
AVLANAYHLYLQPGPDIVDEAGGLGA

SEQ ID NO: 783870 - protein, 23 aa, Mycobacterium
AVLPSHYEPFGIVALEAAAAGTP

SEQ ID NO: 783871 - protein, 23 aa, Mycobacterium
AVLPSHYEPFGIVALEAAATGTP

SEQ ID NO: 783872 - protein, 17 aa, Mycobacterium
AVLVDRGHRELPLRADY

SEQ ID NO: 783873 - protein, 17 aa, Mycobacterium
AVMRKHRLAERLLVDVI

SEQ ID NO: 783874 - protein, 19 aa, Mycobacterium
AVMRTLLARGLITEAGVDD

SEQ ID NO: 783875 - protein, 18 aa, Mycobacterium
AVNPWMLRMAGEVADGVH

SEQ ID NO: 783876 - protein, 17 aa, Mycobacterium
AVNPYLAFESIEDLIRE

SEQ ID NO: 783877 - protein, 28 aa, Mycobacterium
AVNVATLPFPGFPTDLQPMAIALASIAD

SEQ ID NO: 783878 - protein, 18 aa, Mycobacterium
AVQPDVLLMDEPCSALDP

SEQ ID NO: 783879 - protein, 18 aa, Mycobacterium
AVRGGILDVFPPTAEHPV

SEQ ID NO: 783880 - protein, 17 aa, Mycobacterium
AVRRAVAATRNGRIGVI

SEQ ID NO: 783881 - protein, 20 aa, Mycobacterium
AVRRYVTDAGPLLPRLHKLV

SEQ ID NO: 783882 - protein, 23 aa, Mycobacterium
AVRTVPLPRIVIDALKPRIENRS

SEQ ID NO: 783883 - protein, 26 aa, Mycobacterium
AVSESLRYVAAWNAAFLPSKDLTEGI

SEQ ID NO: 783884 - protein, 17 aa, Mycobacterium
AVTILRLANMIGPAMDT

SEQ ID NO: 783885 - protein, 17 aa, Mycobacterium
AVVSRPWGDRVRLRVQP

SEQ ID NO: 783886 - protein, 19 aa, Mycobacterium
AVVTALRALGNDIPICVLS

SEQ ID NO: 783887 - protein, 17 aa, Mycobacterium
AVYECAVPVIAAVNGFC

SEQ ID NO: 783888 - protein, 18 aa, Mycobacterium
AVYPLVIRAGGGSPRDTL

SEQ ID NO: 783889 - protein, 28 aa, Mycobacterium
AVYQRYMGWFDGNPARLWPHPPEALAPR

SEQ ID NO: 783890 - protein, 21 aa, Mycobacterium
AWLSMVMLEWGSCGQVATAIP

SEQ ID NO: 783891 - protein, 19 aa, Mycobacterium
AWRGAFLAHGSLTEPGRSS

SEQ ID NO: 783892 - protein, 20 aa, Mycobacterium
AWSVAYYVDTARSAAAAALE

SEQ ID NO: 783893 - protein, 31 aa, Mycobacterium
AYDEVVFYQLPGIALALFGRADLATDTGVAV

SEQ ID NO: 783894 - protein, 25 aa, Mycobacterium
AYEQYGLPYTIIRPFNCVGTGEQRA

SEQ ID NO: 783895 - protein, 17 aa, Mycobacterium
AYHAVTYGWLLSGLARA

SEQ ID NO: 783896 - protein, 19 aa, Mycobacterium
AYLGLADAIRLLIVDGRLP

SEQ ID NO: 783897 - protein, 19 aa, Mycobacterium
AYTLFQRTMRHDPSDTYWL

SEQ ID NO: 783898 - protein, 30 aa, Mycobacterium
CAAIGLVKFDLLGLGMLSALHYAIDLVAEH

SEQ ID NO: 783899 - protein, 22 aa, Mycobacterium
CAVAPAGRWIVDPDGAVVRAGL

SEQ ID NO: 783900 - protein, 18 aa, Mycobacterium
CDRLGLLPMYAVNQDKHG

SEQ ID NO: 783901 - protein, 18 aa, Mycobacterium
CDVGSPVVWAARYLSMNG

SEQ ID NO: 783902 - protein, 24 aa, Mycobacterium
CEIFARYDVTFSLGDGLRPGSIAD

SEQ ID NO: 783903 - protein, 19 aa, Mycobacterium
CERIYFDTLTMIKQLLGGL

SEQ ID NO: 783904 - protein, 29 aa, Mycobacterium
CFGEGPRWFEGLLWFSDMLGEAVHTSTMG

SEQ ID NO: 783905 - protein, 19 aa, Mycobacterium
CFLVQHRSRLASEKNGLMI

SEQ ID NO: 783906 - protein, 18 aa, Mycobacterium
CFLVQHRSRLASEKNGVM

SEQ ID NO: 783907 - protein, 29 aa, Mycobacterium
CGDVGWFQLVDKHVILLSGAGANEFFFRS

SEQ ID NO: 783908 - protein, 28 aa, Mycobacterium
CGKLIAAAGWHAWRPAHLHVKVSAPGHE

SEQ ID NO: 783909 - protein, 20 aa, Mycobacterium
CGTCHVIVAPEWSDTVGLCG

SEQ ID NO: 783910 - protein, 17 aa, Mycobacterium
CIARAIAVQPDVLLMDE

SEQ ID NO: 783911 - protein, 22 aa, Mycobacterium
CLTPLHHQSGLLVSLGGAVVGG

SEQ ID NO: 783912 - protein, 17 aa, Mycobacterium
CQALRLGECDLALAGGA

SEQ ID NO: 783913 - protein, 23 aa, Mycobacterium
CQSILGYVVRWIDAGVGCSKVPD

SEQ ID NO: 783914 - protein, 24 aa, Mycobacterium
CQSILGYVVRWVAQGVGCSKVPDI

SEQ ID NO: 783915 - protein, 19 aa, Mycobacterium
CRRLDGMPLAIELAAARVR

SEQ ID NO: 783916 - protein, 24 aa, Mycobacterium
CSETCVGRLRYLGLVLYDVDRVLE

SEQ ID NO: 783917 - protein, 29 aa, Mycobacterium
CSIEPWVFMNWRRAAYYLFTAEVIDARKA

SEQ ID NO: 783918 - protein, 18 aa, Mycobacterium
CVPLLKQLLEAEGVEQSK

SEQ ID NO: 783919 - protein, 19 aa, Mycobacterium
CWRCRNPLIYRAVSSWFVT

SEQ ID NO: 783920 - protein, 30 aa, Mycobacterium
DACLDKYARLFAWLGLWERHTDLAVIPADG

SEQ ID NO: 783921 - protein, 20 aa, Mycobacterium
DAEIKRAYRKLARELHPDVN

SEQ ID NO: 783922 - protein, 20 aa, Mycobacterium
DAFMAVCRKWDVLATVIGEV

SEQ ID NO: 783923 - protein, 17 aa, Mycobacterium
DAFTFNVATAHALTVAA

SEQ ID NO: 783924 - protein, 27 aa, Mycobacterium
DAKPAQVALAWLISLPGVVAIPGASSV

SEQ ID NO: 783925 - protein, 23 aa, Mycobacterium
DAPAPTLAPRRKTRQLMVRDVGV

SEQ ID NO: 783926 - protein, 18 aa, Mycobacterium
DAPGYTTVWARMFAGDAA

SEQ ID NO: 783927 - protein, 21 aa, Mycobacterium
DARFDGWFVTAVLTTRIYCRP

SEQ ID NO: 783928 - protein, 19 aa, Mycobacterium
DARFGWPKRNGFVQPLVDA

SEQ ID NO: 783929 - protein, 27 aa, Mycobacterium
DASAFLGRLALIRIYNGKLRKGQQVAW

SEQ ID NO: 783930 - protein, 39 aa, Mycobacterium
DASEGPLPQTRFVLRKALAAHLPVILVVNKTDRPDARIA

SEQ ID NO: 783931 - protein, 25 aa, Mycobacterium
DASLLLVVLTRFLPPDDPRVRNTVL

SEQ ID NO: 783932 - protein, 21 aa, Mycobacterium
DAVIDYLPSPLDVPPAVGHAP

SEQ ID NO: 783933 - protein, 19 aa, Mycobacterium
DAVSFTLLQDQLQSVLETL

SEQ ID NO: 783934 - protein, 20 aa, Mycobacterium
DAVYPLVIRAGGGSPRDTLS

SEQ ID NO: 783935 - protein, 19 aa, Mycobacterium
DAYHRLLSLVVDGYRREGK

SEQ ID NO: 783936 - protein, 20 aa, Mycobacterium
DAYMVSLLKEYWGEHATADN

SEQ ID NO: 783937 - protein, 26 aa, Mycobacterium
DCPHFDHALAAYYLILPSEVSSNLAR

SEQ ID NO: 783938 - protein, 24 aa, Mycobacterium
DCTGYIVQLPLPKHLDENAALERI

SEQ ID NO: 783939 - protein, 19 aa, Mycobacterium
DDEFGFFVVMLAVAGNETT

SEQ ID NO: 783940 - protein, 24 aa, Mycobacterium
DDEQLVLDLLLQEKILVTQGTGFN

SEQ ID NO: 783941 - protein, 24 aa, Mycobacterium
DDKRLTRRLVSEAGITVPRARLAT

SEQ ID NO: 783942 - protein, 20 aa, Mycobacterium
DDLDFFIVSSSVSSLFGSPG

SEQ ID NO: 783943 - protein, 24 aa, Mycobacterium
DDLNPYARIIADEALRRGIWVEVL

SEQ ID NO: 783944 - protein, 22 aa, Mycobacterium
DDLPALVRTLTATTAMTLSRDA

SEQ ID NO: 783945 - protein, 18 aa, Mycobacterium
DDMLLHVDGWLCEIKDVQ

SEQ ID NO: 783946 - protein, 21 aa, Mycobacterium
DDPVLHICALAYMSDLTLLGS

SEQ ID NO: 783947 - protein, 23 aa, Mycobacterium
DDPYLQVVLQRRLPVVVVDQPKD

SEQ ID NO: 783948 - protein, 17 aa, Mycobacterium
DDREDLPRIIRAGRHLA

SEQ ID NO: 783949 - protein, 23 aa, Mycobacterium
DDRGLFDMVWALEGELTEGGELL

SEQ ID NO: 783950 - protein, 23 aa, Mycobacterium
DDRYMRTLDPWVSLGAACAVTSR

SEQ ID NO: 783951 - protein, 38 aa, Mycobacterium
DDTVILYGGNNNWFAAYAYWYFKLYGHEKVKLLDGGRK

SEQ ID NO: 783952 - protein, 31 aa, Mycobacterium
DDVFSEEFLLQRPLLTAIRRTEPTVLLIDET

SEQ ID NO: 783953 - protein, 20 aa, Mycobacterium
DDVFVALSWTKHPAPQTYQE

SEQ ID NO: 783954 - protein, 25 aa, Mycobacterium
DDVSQLVYLHLRFHGYGDGKWTDSA

SEQ ID NO: 783955 - protein, 17 aa, Mycobacterium
DDWLGEWTFAFPQGSMT

SEQ ID NO: 783956 - protein, 21 aa, Mycobacterium
DDWPIDVADVRESLREAEADI

SEQ ID NO: 783957 - protein, 18 aa, Mycobacterium
DDYLPKPFALEELLARMR

SEQ ID NO: 783958 - protein, 23 aa, Mycobacterium
DDYRPCTGTLRTLDVPALAGVRV

SEQ ID NO: 783959 - protein, 22 aa, Mycobacterium
DEALLDIYRKLRPGEPPTKESA

SEQ ID NO: 783960 - protein, 24 aa, Mycobacterium
DEARKMWASSMNIAGSGWSGQAQA

SEQ ID NO: 783961 - protein, 24 aa, Mycobacterium
DEFDITKLRYHKIVLMADADVDGQ

SEQ ID NO: 783962 - protein, 32 aa, Mycobacterium
DEIFAVNVKGYLLGARAAVPELLKSDGPSMIF

SEQ ID NO: 783963 - protein, 28 aa, Mycobacterium
DEIYTFMDLWFYHCNPRHHSIALTPMPG

SEQ ID NO: 783964 - protein, 28 aa, Mycobacterium
DEQGQDVLLFIDNIFRFTQAGSEVSTLL

SEQ ID NO: 783965 - protein, 23 aa, Mycobacterium
DERLAFYRGLYRDHARYGAALWV

SEQ ID NO: 783966 - protein, 26 aa, Mycobacterium
DEVDAKLWVDMAHFAGLVAAGLHPSP

SEQ ID NO: 783967 - protein, 30 aa, Mycobacterium
DEVRNRRWRNGFRGRYLLFKGEFAHNAPSR

SEQ ID NO: 783968 - protein, 22 aa, Mycobacterium
DEYLEVLYKLWEGSWEDDAVVR

SEQ ID NO: 783969 - protein, 19 aa, Mycobacterium
DFARASFSYGLNAKWPVYL

SEQ ID NO: 783970 - protein, 23 aa, Mycobacterium
DFDMELILCQLIGPVAFARLTGL

SEQ ID NO: 783971 - protein, 19 aa, Mycobacterium
DFEILGPLPRKNIDTGMGV

SEQ ID NO: 783972 - protein, 18 aa, Mycobacterium
DFFTWENMKYLEKPNLAP

SEQ ID NO: 783973 - protein, 21 aa, Mycobacterium
DFGAFVSLLPGRDGLVHISKL

SEQ ID NO: 783974 - protein, 26 aa, Mycobacterium
DFGQIDVHMLQYSGAIWYPMVYDMPA

SEQ ID NO: 783975 - protein, 19 aa, Mycobacterium
DFLRDEKLVLRADLLRPWA

SEQ ID NO: 783976 - protein, 30 aa, Mycobacterium
DFPNQINNVLAFPGVFRGALDAGARRITEK

SEQ ID NO: 783977 - protein, 28 aa, Mycobacterium
DFQVVSIPTMILFKDGQPVKRIVGAKGK

SEQ ID NO: 783978 - protein, 24 aa, Mycobacterium
DGDPLDAMVLLPQSVFPGVIVEAR

SEQ ID NO: 783979 - protein, 23 aa, Mycobacterium
DGDRYLPIWIGQSEAAAIALEQQ

SEQ ID NO: 783980 - protein, 29 aa, Mycobacterium
DGEFVKFGPSWAWPKPVQPHIPVLVGAAG

SEQ ID NO: 783981 - protein, 28 aa, Mycobacterium
DGEFVKFGPSWAWPKPVQSHIPVLVGAA

SEQ ID NO: 783982 - protein, 23 aa, Mycobacterium
DGGTFDWTQGRFPGFTTPDPSYH

SEQ ID NO: 783983 - protein, 21 aa, Mycobacterium
DGGTGGLGGAGGTGGQGTTAV

SEQ ID NO: 783984 - protein, 19 aa, Mycobacterium
DGIINAGALIAFEKGRSWP

SEQ ID NO: 783985 - protein, 17 aa, Mycobacterium
DGKVWVSPVDTIVRVRT

SEQ ID NO: 783986 - protein, 17 aa, Mycobacterium
DGLERVRFTSPHPAEFT

SEQ ID NO: 783987 - protein, 21 aa, Mycobacterium
DGQWRLSPKAMRRLGETALRD

SEQ ID NO: 783988 - protein, 20 aa, Mycobacterium
DGRDAGRRRPPILSEAEFLA

SEQ ID NO: 783989 - protein, 21 aa, Mycobacterium
DGRFQWVVFTSTNAVRAVWEK

SEQ ID NO: 783990 - protein, 25 aa, Mycobacterium
DGTIKIEMNFLPDVYVPCEVCHGAR

SEQ ID NO: 783991 - protein, 27 aa, Mycobacterium
DGTKAGFDLAMLRAVRAAVTVPVIASG

SEQ ID NO: 783992 - protein, 23 aa, Mycobacterium
DGTLSFADFLRRENLELRSDLLR

SEQ ID NO: 783993 - protein, 20 aa, Mycobacterium
DGVQRPLIVFTPKSMLRNKA

SEQ ID NO: 783994 - protein, 25 aa, Mycobacterium
DGVTRELVWPAMRISHCRPPGSDRD

SEQ ID NO: 783995 - protein, 24 aa, Mycobacterium
DHAILAILAVLKTGAAYLPIDPHH

SEQ ID NO: 783996 - protein, 26 aa, Mycobacterium
DHCLGVVFYPVIPAGSWVATTEFKLN

SEQ ID NO: 783997 - protein, 26 aa, Mycobacterium
DHCLGVVFYPVIPLGSWVATTEFKLN

SEQ ID NO: 783998 - protein, 26 aa, Mycobacterium
DHDPSSLALPLALYRAVTAFGRVAVD

SEQ ID NO: 783999 - protein, 27 aa, Mycobacterium
DHHSRRGLLLLVGRRRRLIKYISQIDV

SEQ ID NO: 784000 - protein, 27 aa, Mycobacterium
DHHSRRGLLLLVGRRRRLLKYVAQIDV

SEQ ID NO: 784001 - protein, 27 aa, Mycobacterium
DHHSRRGLLLLVGRRRRLLKYVAQVDV

SEQ ID NO: 784002 - protein, 18 aa, Mycobacterium
DHIEAIANWDPKAEPSIE

SEQ ID NO: 784003 - protein, 20 aa, Mycobacterium
DHLHAVVGEWQLLADLSFAD

SEQ ID NO: 784004 - protein, 20 aa, Mycobacterium
DHMSPPTPFITFRVWHPLSH

SEQ ID NO: 784005 - protein, 21 aa, Mycobacterium
DHVLHICALAYMSDLTLLGSA

SEQ ID NO: 784006 - protein, 25 aa, Mycobacterium
DHVPEQAFFLIGGLDDLAKKAESLG

SEQ ID NO: 784007 - protein, 25 aa, Mycobacterium
DHYHDWDMLRANLLQLLVDGTVRPH

SEQ ID NO: 784008 - protein, 18 aa, Mycobacterium
DHYLIEQMAMFNRERIPE

SEQ ID NO: 784009 - protein, 26 aa, Mycobacterium
DIAEEYYISFLLDRANRTYLAMCSVE

SEQ ID NO: 784010 - protein, 19 aa, Mycobacterium
DIAMLDEDGYLFIGGRSDD

SEQ ID NO: 784011 - protein, 24 aa, Mycobacterium
DIANRLCAQILLLSAEDPTKDIHL

SEQ ID NO: 784012 - protein, 29 aa, Mycobacterium
DIDEIQAQAILDMQLRRLAALERQRIIDD

SEQ ID NO: 784013 - protein, 28 aa, Mycobacterium
DIDEIQAQAILDMQLRRLAALERQRIVD

SEQ ID NO: 784014 - protein, 20 aa, Mycobacterium
DIEGYDFVLLDCPPALGELT

SEQ ID NO: 784015 - protein, 23 aa, Mycobacterium
DIFARYDVTFSLGDGLRPGSIAD

SEQ ID NO: 784016 - protein, 25 aa, Mycobacterium
DIKPEHLILIGQIAQDFGLYTKITG

SEQ ID NO: 784017 - protein, 19 aa, Mycobacterium
DILAFERQWWKFAGVKEDA

SEQ ID NO: 784018 - protein, 21 aa, Mycobacterium
DIRAVNPKIIYARGSALGPRG

SEQ ID NO: 784019 - protein, 22 aa, Mycobacterium
DIRESIHLRALGRQNPLDEFHR

SEQ ID NO: 784020 - protein, 22 aa, Mycobacterium
DIRVIPGTTDVLYRLGELTPPV

SEQ ID NO: 784021 - protein, 26 aa, Mycobacterium
DITAQLLPRPIGLIIGLQLSANPFVL

SEQ ID NO: 784022 - protein, 24 aa, Mycobacterium
DITDLLAQLAIPIPTVTTPQMFIH

SEQ ID NO: 784023 - protein, 20 aa, Mycobacterium
DKAWYIEHRYLSTERAKAVT

SEQ ID NO: 784024 - protein, 28 aa, Mycobacterium
DKGDLRGRFRWWGLYTQRKPGYDGTWTG

SEQ ID NO: 784025 - protein, 18 aa, Mycobacterium
DKRVALVFSAYPTKHARI

SEQ ID NO: 784026 - protein, 21 aa, Mycobacterium
DKVILDDVTLSFYPGAKIGVV

SEQ ID NO: 784027 - protein, 21 aa, Mycobacterium
DKVRTEPPHEGARYTQIAVLE

SEQ ID NO: 784028 - protein, 28 aa, Mycobacterium
DLADAALLVVMRGRLMQALPGGGVMYAV

SEQ ID NO: 784029 - protein, 23 aa, Mycobacterium
DLAHAINRWAAASAAAEARKLAA

SEQ ID NO: 784030 - protein, 20 aa, Mycobacterium
DLAYWQHTLAGLPEHLALPT

SEQ ID NO: 784031 - protein, 23 aa, Mycobacterium
DLGLPLIAVGLYYRSGYFRQSLT

SEQ ID NO: 784032 - protein, 20 aa, Mycobacterium
DLGLVATLVPPALKTRNLDH

SEQ ID NO: 784033 - protein, 24 aa, Mycobacterium
DLGPGDILTRLTAPVIRGLGIGIV

SEQ ID NO: 784034 - protein, 30 aa, Mycobacterium
DLGSMGIRVLAIAPSLFLTGLTAMVPDEMA

SEQ ID NO: 784035 - protein, 25 aa, Mycobacterium
DLHLYEILGAFMKPGDILGHEPMGI

SEQ ID NO: 784036 - protein, 25 aa, Mycobacterium
DLLWGPAMRNYPDLKFAFSEGGIGW

SEQ ID NO: 784037 - protein, 17 aa, Mycobacterium
DLPRIARATKILELARA

SEQ ID NO: 784038 - protein, 17 aa, Mycobacterium
DLQIVRSYKLRGAYNLL

SEQ ID NO: 784039 - protein, 17 aa, Mycobacterium
DLRHVVHPVRTACAAGA

SEQ ID NO: 784040 - protein, 24 aa, Mycobacterium
DLSATDYVYLWVDGIHLKVRLDQE

SEQ ID NO: 784041 - protein, 17 aa, Mycobacterium
DLSLMVKAGVQWGLFGG

SEQ ID NO: 784042 - protein, 21 aa, Mycobacterium
DLSLMVKAGVQWGLFGGAVEN

SEQ ID NO: 784043 - protein, 27 aa, Mycobacterium
DLTTNFLGKPLRAPVLIGAMTGGAELS

SEQ ID NO: 784044 - protein, 17 aa, Mycobacterium
DLVAVRTALQDAGIDYE

SEQ ID NO: 784045 - protein, 20 aa, Mycobacterium
DLVLAIYNPASKTRTWQVGA

SEQ ID NO: 784046 - protein, 19 aa, Mycobacterium
DLVMLARSLAADNAAALAD

SEQ ID NO: 784047 - protein, 21 aa, Mycobacterium
DLVVALERLGRWCVPGPVAES

SEQ ID NO: 784048 - protein, 23 aa, Mycobacterium
DMDPVLATLFNPLGAGIQWGATL

SEQ ID NO: 784049 - protein, 24 aa, Mycobacterium
DMIDGKVFGYFLLGQNPAVGSAHG

SEQ ID NO: 784050 - protein, 27 aa, Mycobacterium
DNFVFPDGMLLVFEPVVWEDGTGGYRG

SEQ ID NO: 784051 - protein, 33 aa, Mycobacterium
DNGGVYFVPAFSGLFAPYWRSDARGAIVGLSRF

SEQ ID NO: 784052 - protein, 17 aa, Mycobacterium
DNISLITRFLRAGIDVC

SEQ ID NO: 784053 - protein, 31 aa, Mycobacterium
DNPGSTPWMLRPLLDLLAHGAPVTIDQLADA

SEQ ID NO: 784054 - protein, 24 aa, Mycobacterium
DNPVNWPRVLTVWRANLIGSSGKG

SEQ ID NO: 784055 - protein, 39 aa, Mycobacterium; identical to SEQ ID NO: 113894

SEQ ID NO: 784056 - protein, 22 aa, Mycobacterium
DNTLVFYIWGDNGASMEGTNTG

SEQ ID NO: 784057 - protein, 17 aa, Mycobacterium
DPDIAYLSGDRLPDGVR

SEQ ID NO: 784058 - protein, 36 aa, Mycobacterium
DPDWQRFHLIGATNTVYFALLARRRMDLYGATTDDF

SEQ ID NO: 784059 - protein, 20 aa, Mycobacterium
DPEILLLDEGLGAVDADFMK

SEQ ID NO: 784060 - protein, 19 aa, Mycobacterium
DPGSPFLELAPLAANGMYD

SEQ ID NO: 784061 - protein, 18 aa, Mycobacterium
DPIWGDKGGLFTIARAIM

SEQ ID NO: 784062 - protein, 25 aa, Mycobacterium
DPKWREAGIFPILSEGALRATLGIL

SEQ ID NO: 784063 - protein, 18 aa, Mycobacterium
DPMLVKRLRRLRASRQKA

SEQ ID NO: 784064 - protein, 29 aa, Mycobacterium
DPQFAQQALSAFRKFGFQLVIVATVQNTT

SEQ ID NO: 784065 - protein, 24 aa, Mycobacterium
DPSLPLLERAKFLAIFASNLDEFY

SEQ ID NO: 784066 - protein, 22 aa, Mycobacterium
DPTLWPQREALKSALQYPALAG

SEQ ID NO: 784067 - protein, 26 aa, Mycobacterium
DPVTAAFLSIHNMCAWMIDSFGTDEQ

SEQ ID NO: 784068 - protein, 17 aa, Mycobacterium
DQFDWLATRLEIARKLR

SEQ ID NO: 784069 - protein, 25 aa, Mycobacterium
DQFELDRPVRLLGVRLELAMDDVPR

SEQ ID NO: 784070 - protein, 24 aa, Mycobacterium
DQGDIVTILAFTGLRWSELVGLRV

SEQ ID NO: 784071 - protein, 20 aa, Mycobacterium
DQGLSLTLFFKDTATTRDVN

SEQ ID NO: 784072 - protein, 24 aa, Mycobacterium
DQLPGYGWVFPMGNGMFNIGLGYV

SEQ ID NO: 784073 - protein, 21 aa, Mycobacterium
DRDIAMVFQSYALYPHMTVRQ

SEQ ID NO: 784074 - protein, 19 aa, Mycobacterium
DREPDWVNTIFLSTRFRAW

SEQ ID NO: 784075 - protein, 24 aa, Mycobacterium
DRESDERMAPIPSLLAVAGVHHHL

SEQ ID NO: 784076 - protein, 19 aa, Mycobacterium
DREYQRMRDLGIAILREVG

SEQ ID NO: 784077 - protein, 21 aa, Mycobacterium
DRFGLAGERLGVVVGGAVLKH

SEQ ID NO: 784078 - protein, 20 aa, Mycobacterium
DRFTASRLFGAPPGYVGYEE

SEQ ID NO: 784079 - protein, 23 aa, Mycobacterium
DRGNFPVFRKRLRQWMMRITAYS

SEQ ID NO: 784080 - protein, 17 aa, Mycobacterium
DRHRIQLVAVPTTSGTG

SEQ ID NO: 784081 - protein, 20 aa, Mycobacterium
DRLALNPQRVDGIAAGLRQV

SEQ ID NO: 784082 - protein, 24 aa, Mycobacterium
DRLEDIWNTFTKLAPKQLIVDENL

SEQ ID NO: 784083 - protein, 17 aa, Mycobacterium
DRLYFEPLTFEDVLEVF

SEQ ID NO: 784084 - protein, 20 aa, Mycobacterium
DRMEILSWFLVERDAPEWLR

SEQ ID NO: 784085 - protein, 20 aa, Mycobacterium
DRMNVFRWSNAIGSLGIEDP

SEQ ID NO: 784086 - protein, 22 aa, Mycobacterium
DRVALWNIVATVDAFLSSGFTP

SEQ ID NO: 784087 - protein, 18 aa, Mycobacterium
DSAYAWAYNVDKGQKTRI

SEQ ID NO: 784088 - protein, 26 aa, Mycobacterium
DSESFEFWREFLASLKARGLSGVHLV

SEQ ID NO: 784089 - protein, 26 aa, Mycobacterium
DSESFEFWREFLASLKARGLTGVHLV

SEQ ID NO: 784090 - protein, 26 aa, Mycobacterium
DSIVMLHLALRAFRPGRLPFPVMHVD

SEQ ID NO: 784091 - protein, 26 aa, Mycobacterium
DSLSGLFYAGPDRMSIFNAGLGNLGV

SEQ ID NO: 784092 - protein, 22 aa, Mycobacterium
DSPLQVTMWTKRLRAVDFTLGY

SEQ ID NO: 784093 - protein, 18 aa, Mycobacterium
DSVITTHGLSWGFDRIFA

SEQ ID NO: 784094 - protein, 25 aa, Mycobacterium
DTDGFWAAVLHRTAERRAATFSTLS

SEQ ID NO: 784095 - protein, 25 aa, Mycobacterium
DTDLAWSRITYWRALLTSAVDQPPH

SEQ ID NO: 784096 - protein, 24 aa, Mycobacterium
DTDQIIPAVFLKRVTRTGFEDGLF

SEQ ID NO: 784097 - protein, 24 aa, Mycobacterium
DTDQIIPAVYLKRVTRTGFEDGLF

SEQ ID NO: 784098 - protein, 23 aa, Mycobacterium
DTLAALQPLLRPKHDREHLDRAL

SEQ ID NO: 784099 - protein, 25 aa, Mycobacterium
DTLADFEILFDGIPLDKLSTSMTIN

SEQ ID NO: 784100 - protein, 19 aa, Mycobacterium
DTPKFFHYVKKDKIAESAV

SEQ ID NO: 784101 - protein, 19 aa, Mycobacterium
DTTWLGRDRFVLSCGHSSL

SEQ ID NO: 784102 - protein, 39 aa, Mycobacterium
DTVVIYGDKSNWWAAYALWVFTLFGHPDVRLLDGGRDLW

SEQ ID NO: 784103 - protein, 17 aa, Mycobacterium
DVALGIGGLPRGRVVEI

SEQ ID NO: 784104 - protein, 26 aa, Mycobacterium
DVAVGTLYRYFPSKVHLLVSALGREF

SEQ ID NO: 784105 - protein, 26 aa, Mycobacterium
DVDDEFFVIVRPAPSGTRLLLSDATA

SEQ ID NO: 784106 - protein, 17 aa, Mycobacterium
DVDRLSAFFDLVQQDPV

SEQ ID NO: 784107 - protein, 26 aa, Mycobacterium
DVERRYRAWIRWNAAIMVHRAQRPGV

SEQ ID NO: 784108 - protein, 28 aa, Mycobacterium
DVFVYHGYSLMFLNGAWVKATPAFNREL

SEQ ID NO: 784109 - protein, 35 aa, Mycobacterium
DVKLPRELVLIGKQFLYVERYMKLLAPKWQMMSDP

SEQ ID NO: 784110 - protein, 18 aa, Mycobacterium
DVMMPGMDGFGVLRRLRA

SEQ ID NO: 784111 - protein, 19 aa, Mycobacterium
DVMMPGMDGFGVLRRLRAD

SEQ ID NO: 784112 - protein, 25 aa, Mycobacterium
DVQGVLFFAYAISAAVDWLYSGLPS

SEQ ID NO: 784113 - protein, 24 aa, Mycobacterium
DVRAKELGLTPLARIVSTGVSGLS

SEQ ID NO: 784114 - protein, 24 aa, Mycobacterium
DVSELLPELTLAQKWDLTATELAR

SEQ ID NO: 784115 - protein, 26 aa, Mycobacterium
DVTLLPGLMDMELNLLIGGPGGPEGL

SEQ ID NO: 784116 - protein, 24 aa, Mycobacterium
DVYACPFAIHDRFLAGNVLTDGGF

SEQ ID NO: 784117 - protein, 28 aa, Mycobacterium
DWLELPDPPESWGWGKTAHLLVGSLAHS

SEQ ID NO: 784118 - protein, 19 aa, Mycobacterium
DWQAYFHLRNRLVVAALHW

SEQ ID NO: 784119 - protein, 22 aa, Mycobacterium
DWREINAKMPKWLRSHPYNDML

SEQ ID NO: 784120 - protein, 17 aa, Mycobacterium
DWSLVDKNSDLLAFARK

SEQ ID NO: 784121 - protein, 18 aa, Mycobacterium
DYKTLFREFGFTAEAVAA

SEQ ID NO: 784122 - protein, 17 aa, Mycobacterium
DYLVKPFVLAELVARVK

SEQ ID NO: 784123 - protein, 18 aa, Mycobacterium
DYMRPAVRLAALMDIDTI

SEQ ID NO: 784124 - protein, 19 aa, Mycobacterium
DYYRNGGILQYVLRNMLKS

SEQ ID NO: 784125 - protein, 17 aa, Mycobacterium
EAAAKMLAGKPFKKEAA

SEQ ID NO: 784126 - protein, 32 aa, Mycobacterium
EAAIATVYAAQLPIPVWWPAEARAAFIEEYAS

SEQ ID NO: 784127 - protein, 17 aa, Mycobacterium
EAAWQAYQHPTRLHWYV

SEQ ID NO: 784128 - protein, 17 aa, Mycobacterium
EACTLIRRLWAEEEPFD

SEQ ID NO: 784129 - protein, 24 aa, Mycobacterium
EAFAPVPLAWLKDIGADEKKLNPN

SEQ ID NO: 784130 - protein, 20 aa, Mycobacterium
EAGARWILDLGPGDILTRLT

SEQ ID NO: 784131 - protein, 33 aa, Mycobacterium; identical to SEQ ID NO: 114082

SEQ ID NO: 784132 - protein, 18 aa, Mycobacterium
EAGNTFLLPPTWTQLDSL

SEQ ID NO: 784133 - protein, 24 aa, Mycobacterium
EAGSKWMFPLLDSMAEVYKKAPEA

SEQ ID NO: 784134 - protein, 24 aa, Mycobacterium
EAIPDGLVLTQPWPATSSEKARGI

SEQ ID NO: 784135 - protein, 32 aa, Mycobacterium
EALKAVAAFRLALPRTMLRFAGGREITLGDLG

SEQ ID NO: 784136 - protein, 32 aa, Mycobacterium
EALKAVGAFRLALPRTMLRFAGGREITLGDLG

SEQ ID NO: 784137 - protein, 19 aa, Mycobacterium
EALYLAKRIDKVSGEGQTV

SEQ ID NO: 784138 - protein, 17 aa, Mycobacterium
EALYYHRQRHPHAEEAL

SEQ ID NO: 784139 - protein, 33 aa, Mycobacterium
EARRGMALAAELRLPLVLVIDTAGPALSADAEQ

SEQ ID NO: 784140 - protein, 18 aa, Mycobacterium
EASSLFRVSRLNCSITTS

SEQ ID NO: 784141 - protein, 21 aa, Mycobacterium
EAVLPFHRFRRIDGAAIDSLL

SEQ ID NO: 784142 - protein, 23 aa, Mycobacterium
EAWAVLEVIFAKYAAPGMCNPAD

SEQ ID NO: 784143 - protein, 26 aa, Mycobacterium
EAYADMPLFLFHLLEYMDVEYELDIE

SEQ ID NO: 784144 - protein, 20 aa, Mycobacterium
EAYEQLILDVLLGEPSLFPV

SEQ ID NO: 784145 - protein, 24 aa, Mycobacterium
EAYERLILDVLLGEPSLFPVNAEV

SEQ ID NO: 784146 - protein, 25 aa, Mycobacterium
EAYERLILDVLLGEPSLFPVNAEVE

SEQ ID NO: 784147 - protein, 20 aa, Mycobacterium
ECAQACGLALLGGPPTPETA

SEQ ID NO: 784148 - protein, 29 aa, Mycobacterium
ECGAFWANDLLWLMDTRYLREHSAKKMSH

SEQ ID NO: 784149 - protein, 34 aa, Mycobacterium
ECIDLALYESLFRGIDWQVILYDQLNFVAERQGN

SEQ ID NO: 784150 - protein, 20 aa, Mycobacterium
EDGYLYIVDRRVDMIVTGGA

SEQ ID NO: 784151 - protein, 25 aa, Mycobacterium
EDIEQWYVSRFLAMRSTAFANPESH

SEQ ID NO: 784152 - protein, 25 aa, Mycobacterium
EDIRLAIVAFGPQTLALGGREFDDV

SEQ ID NO: 784153 - protein, 25 aa, Mycobacterium
EDLMDYLGLHNLKLQMTCQLGGGTH

SEQ ID NO: 784154 - protein, 22 aa, Mycobacterium
EDPARFVANALSPAKVVSVSVI

SEQ ID NO: 784155 - protein, 19 aa, Mycobacterium
EDQSWRYKDLTYWTELAKL

SEQ ID NO: 784156 - protein, 24 aa, Mycobacterium
EDVFPLPRELVGEGSLFLLKVVGE

SEQ ID NO: 784157 - protein, 24 aa, Mycobacterium
EDVPNLFWCVGYTNASWTLRADIT

SEQ ID NO: 784158 - protein, 25 aa, Mycobacterium
EDWAQVMRRLWHGELIFNHDGPMGK

SEQ ID NO: 784159 - protein, 17 aa, Mycobacterium
EDWTEMIDINLAGVWKT

SEQ ID NO: 784160 - protein, 24 aa, Mycobacterium
EEAITLAADWIWERSREEDLAPLL

SEQ ID NO: 784161 - protein, 26 aa, Mycobacterium
EEALPSRPVQVIGFTSVPGAGDNFLV

SEQ ID NO: 784162 - protein, 26 aa, Mycobacterium
EEALPSRPVQVIGFTSVPGAGDNLLV

SEQ ID NO: 784163 - protein, 27 aa, Mycobacterium
EEARKGFFRVPLIRGTITHPVQGEAAA

SEQ ID NO: 784164 - protein, 23 aa, Mycobacterium
EEERYCIDILTQADALTKALQSV

SEQ ID NO: 784165 - protein, 24 aa, Mycobacterium
EEHTRFRRMLSKPFTFRRVEGLRP

SEQ ID NO: 784166 - protein, 26 aa, Mycobacterium
EEKPYTRRPYAPFMTSTLQQEAGRKL

SEQ ID NO: 784167 - protein, 22 aa, Mycobacterium
EELIGILGGETRQLAFAKTPPT

SEQ ID NO: 784168 - protein, 23 aa, Mycobacterium
EELIGQFGIGFYSSFMVADKVEL

SEQ ID NO: 784169 - protein, 19 aa, Mycobacterium
EELILEVGSPRAITFGPQL

SEQ ID NO: 784170 - protein, 31 aa, Mycobacterium
EELLLTLQLEQFTGRLWERFSRELTRYGLGV

SEQ ID NO: 784171 - protein, 22 aa, Mycobacterium
EELRLKYRYLDLRRDGPASAIR

SEQ ID NO: 784172 - protein, 25 aa, Mycobacterium
EELVPLIRRIWNLHEGPVRHEGRFY

SEQ ID NO: 784173 - protein, 26 aa, Mycobacterium
EEMGIDVFLVMPFTSDFMKLTPERYV

SEQ ID NO: 784174 - protein, 17 aa, Mycobacterium
EENKKAFAGPRFLMRIA

SEQ ID NO: 784175 - protein, 25 aa, Mycobacterium
EEPPEHLIFVFATTEPEKVLPTIRS

SEQ ID NO: 784176 - protein, 21 aa, Mycobacterium
EEPPPSTVFLLCAPSVDPEDI

SEQ ID NO: 784177 - protein, 25 aa, Mycobacterium
EEQKKFFLPKIAAGELHFSIGYSEP

SEQ ID NO: 784178 - protein, 25 aa, Mycobacterium
EEVAKLTYYGLYALQHRGQEAAGIA

SEQ ID NO: 784179 - protein, 25 aa, Mycobacterium
EFDEWQRLFLFTRADTIYGGSNEIQ

SEQ ID NO: 784180 - protein, 25 aa, Mycobacterium
EFGHIDVHLLQYSGAIWYPMVYDMP

SEQ ID NO: 784181 - protein, 22 aa, Mycobacterium
EFGRLDTLFNVVGGSLARNVEE

SEQ ID NO: 784182 - protein, 17 aa, Mycobacterium
EFGVHAGMPLRAAARRC

SEQ ID NO: 784183 - protein, 18 aa, Mycobacterium
EFKAMFLDDLLNGSRKQL

SEQ ID NO: 784184 - protein, 20 aa, Mycobacterium
EFLNQLQKGTIRKGVVSSIV

SEQ ID NO: 784185 - protein, 27 aa, Mycobacterium
EFQRRGAPHIHLWMTPPPAVGRSGRTF

SEQ ID NO: 784186 - protein, 20 aa, Mycobacterium
EFRTYRFRAHSMFDPELYRD

SEQ ID NO: 784187 - protein, 17 aa, Mycobacterium
EFYAGLLGSYPLVSIED

SEQ ID NO: 784188 - protein, 18 aa, Mycobacterium
EGAVLRYLSDAFKALRSG

SEQ ID NO: 784189 - protein, 17 aa, Mycobacterium
EGDDVFVALSWTKHPAP

SEQ ID NO: 784190 - protein, 27 aa, Mycobacterium
EGFIGQLFATMKPFVPAPPPGVSPPPL

SEQ ID NO: 784191 - protein, 22 aa, Mycobacterium
EGGGRLVVELTPDEAAALGDEL

SEQ ID NO: 784192 - protein, 26 aa, Mycobacterium
EGGKRPVMLLTSDSAFLFHIAELETA

SEQ ID NO: 784193 - protein, 23 aa, Mycobacterium
EGNLGLIRAVEKFDYTKGYKFST

SEQ ID NO: 784194 - protein, 20 aa, Mycobacterium
EGRGIVMRVPLEGGGRLVVE

SEQ ID NO: 784195 - protein, 22 aa, Mycobacterium
EGRPKHYWSIYQKMIVKGRDFD

SEQ ID NO: 784196 - protein, 26 aa, Mycobacterium
EHAVWALMDYGFRVVISSRFGDIFRG

SEQ ID NO: 784197 - protein, 29 aa, Mycobacterium
EHFGVQWQLVRRLVTIVEFSFAARCTVQR

SEQ ID NO: 784198 - protein, 17 aa, Mycobacterium
EHGRIKTTEPKARALRP

SEQ ID NO: 784199 - protein, 24 aa, Mycobacterium
EHGRSWSRWSFIGAGAPSALTVRD

SEQ ID NO: 784200 - protein, 27 aa, Mycobacterium
EHIDRLVPGDIIWAPAIDGAFVLTTRG

SEQ ID NO: 784201 - protein, 20 aa, Mycobacterium
EHLDVPLRDVMFTEPGLLQQ

SEQ ID NO: 784202 - protein, 17 aa, Mycobacterium
EHLYEMDYLKEGIGLRA

SEQ ID NO: 784203 - protein, 22 aa, Mycobacterium
EHVFDFFLRNKRTEWANYRSHV

SEQ ID NO: 784204 - protein, 25 aa, Mycobacterium
EIAVRVIRTLRRLGIRSVAVYSDPD

SEQ ID NO: 784205 - protein, 18 aa, Mycobacterium
EIFVYSPRVEGVHLRFGF

SEQ ID NO: 784206 - protein, 19 aa, Mycobacterium
EIGPSIGCPLLLKEVGHGI

SEQ ID NO: 784207 - protein, 22 aa, Mycobacterium
EIISEPTDLVAVRTALQDAGID

SEQ ID NO: 784208 - protein, 21 aa, Mycobacterium
EILTFLAAREAAHHRLFSHVP

SEQ ID NO: 784209 - protein, 21 aa, Mycobacterium
EIPGTWLCRNGMEGTLIEGDL

SEQ ID NO: 784210 - protein, 20 aa, Mycobacterium
EISRLVGRSLRACIDLAALG

SEQ ID NO: 784211 - protein, 23 aa, Mycobacterium
EIYRNRWMVLREDDIRRPDGSPG

SEQ ID NO: 784212 - protein, 26 aa, Mycobacterium
EKDAEVWHRLTGNFWLPEKVPVSNDI

SEQ ID NO: 784213 - protein, 35 aa, Mycobacterium
EKFDYTKGYKFSTYATWWIRQAITRAMADQARTIR

SEQ ID NO: 784214 - protein, 26 aa, Mycobacterium
EKKRHEILQLGLLKPKIAILDETDSG

SEQ ID NO: 784215 - protein, 26 aa, Mycobacterium
EKKRHEILQLSLLKPKIAILDETDSG

SEQ ID NO: 784216 - protein, 24 aa, Mycobacterium
EKLDDVVFPLFPQGGGFPRNNDDK

SEQ ID NO: 784217 - protein, 30 aa, Mycobacterium; identical to SEQ ID NO: 114220

SEQ ID NO: 784218 - protein, 24 aa, Mycobacterium
EKRFPQLTVLSIAPLLASTIRAVF

SEQ ID NO: 784219 - protein, 23 aa, Mycobacterium
EKRFSPKMRLAVTAALEHYTATF

SEQ ID NO: 784220 - protein, 18 aa, Mycobacterium
EKTRLALAGLVASTANVL

SEQ ID NO: 784221 - protein, 18 aa, Mycobacterium
ELALEALYLAKRIDKVSG

SEQ ID NO: 784222 - protein, 24 aa, Mycobacterium
ELAQRYPLSIISPKPHAFLNSQYG

SEQ ID NO: 784223 - protein, 25 aa, Mycobacterium
ELCEEAPFYTLGPLATDIAPAYDHI

SEQ ID NO: 784224 - protein, 26 aa, Mycobacterium
ELCEEAPFYTLGPLATDIAPAYDHIT

SEQ ID NO: 784225 - protein, 17 aa, Mycobacterium
ELDLFSFPDEIGSGLAV

SEQ ID NO: 784226 - protein, 26 aa, Mycobacterium
ELDRRGLLRRIGGAPYLHTLISTVPT

SEQ ID NO: 784227 - protein, 25 aa, Mycobacterium
ELEKRRAHVPWVTWGTTAMVARSVA

SEQ ID NO: 784228 - protein, 27 aa, Mycobacterium
ELGAMGFKFQFITLAGFHALNYSMFDL

SEQ ID NO: 784229 - protein, 19 aa, Mycobacterium
ELGDLLHEILVAQVAIYLD

SEQ ID NO: 784230 - protein, 24 aa, Mycobacterium
ELGGDFGGVWYWNRYPGIQCDNES

SEQ ID NO: 784231 - protein, 24 aa, Mycobacterium
ELGGDFGGVWYWNRYPGLQCDNES

SEQ ID NO: 784232 - protein, 20 aa, Mycobacterium
ELGGRLSWALADRLHISRGE

SEQ ID NO: 784233 - protein, 25 aa, Mycobacterium
ELGPIRPPQRLAPYSYALGAEVKHP

SEQ ID NO: 784234 - protein, 25 aa, Mycobacterium
ELGQPLPLFIKWDDADYGLRAAEHG

SEQ ID NO: 784235 - protein, 32 aa, Mycobacterium
ELIALLLPRTHRGIIAILAVLKTGAGYLPIDP

SEQ ID NO: 784236 - protein, 17 aa, Mycobacterium
ELITMLVRFRTQAVATV

SEQ ID NO: 784237 - protein, 21 aa, Mycobacterium
ELITVRGRRLLAHADVVVADR

SEQ ID NO: 784238 - protein, 21 aa, Mycobacterium
ELKKHFRPEFLNRIDDIIVFH

SEQ ID NO: 784239 - protein, 19 aa, Mycobacterium
ELLADVVNRVWFLDAVRGE

SEQ ID NO: 784240 - protein, 20 aa, Mycobacterium
ELLADVVNRVWFLDAVRGEV

SEQ ID NO: 784241 - protein, 23 aa, Mycobacterium
ELLGIDPLYVANEGKFVAVVAPE

SEQ ID NO: 784242 - protein, 18 aa, Mycobacterium
ELLGILCDLYALSVIEDD

SEQ ID NO: 784243 - protein, 19 aa, Mycobacterium
ELNEAFASVVLKFQKDLGI

SEQ ID NO: 784244 - protein, 24 aa, Mycobacterium
ELNRFVFAMPEQLGRVYLGLTDED

SEQ ID NO: 784245 - protein, 25 aa, Mycobacterium
ELPTRYLGLVTAVEYGRRARLAVEA

SEQ ID NO: 784246 - protein, 17 aa, Mycobacterium
ELPTWQWEGLIGKSTRL

SEQ ID NO: 784247 - protein, 19 aa, Mycobacterium
ELRCLMLTSFTSDEAMLEA

SEQ ID NO: 784248 - protein, 17 aa, Mycobacterium
ELREKRFMKIISLAPEV

SEQ ID NO: 784249 - protein, 33 aa, Mycobacterium; identical to SEQ ID NO: 114264

SEQ ID NO: 784250 - protein, 28 aa, Mycobacterium
ELSRAVFSKGIFPAVDPLASSSTILDPG

SEQ ID NO: 784251 - protein, 21 aa, Mycobacterium
ELSVRVIPKQADEFTCSSCFL

SEQ ID NO: 784252 - protein, 21 aa, Mycobacterium
ELTPEERLLRAIFGEKAREVR

SEQ ID NO: 784253 - protein, 18 aa, Mycobacterium
ELVECTEFFKDTTFRVFQ

SEQ ID NO: 784254 - protein, 27 aa, Mycobacterium
ELVGRLMSYKLDRARPLWEMWVIEGVE

SEQ ID NO: 784255 - protein, 24 aa, Mycobacterium
ELVKALLFSLFEGGLRHGLFHGDL

SEQ ID NO: 784256 - protein, 23 aa, Mycobacterium
ELVKALLFSVFEGGLRHGLFHGD

SEQ ID NO: 784257 - protein, 20 aa, Mycobacterium
ELVLVKEIPLYSTCEHHLVS

SEQ ID NO: 784258 - protein, 24 aa, Mycobacterium
ELVPLVRRIWNLHEGPVRHEGRFY

SEQ ID NO: 784259 - protein, 24 aa, Mycobacterium
EMFDTLLVFENFPTGGLAVGKDVP

SEQ ID NO: 784260 - protein, 18 aa, Mycobacterium
EMGIRVRYLHSEVDTLRR

SEQ ID NO: 784261 - protein, 19 aa, Mycobacterium
EMGIRVRYLHSEVDTLRRV

SEQ ID NO: 784262 - protein, 19 aa, Mycobacterium
EMLQAAVVSRPWGDRVRLR

SEQ ID NO: 784263 - protein, 20 aa, Mycobacterium
EMVAKFFRALGDPGRLRLLE

SEQ ID NO: 784264 - protein, 30 aa, Mycobacterium; identical to SEQ ID NO: 125973

SEQ ID NO: 784265 - protein, 20 aa, Mycobacterium
ENAEWYYEFANPGDVVEVRN

SEQ ID NO: 784266 - protein, 26 aa, Mycobacterium
ENHEGVYRFLLKRNRRLYGVAYTLDN

SEQ ID NO: 784267 - protein, 22 aa, Mycobacterium
ENKAYYIAAAFPSACGKTNLAM

SEQ ID NO: 784268 - protein, 23 aa, Mycobacterium
ENLEAFLRVMVYDQKLITPELVD

SEQ ID NO: 784269 - protein, 20 aa, Mycobacterium
ENTHRFVQKLGLPATRIPLH

SEQ ID NO: 784270 - protein, 20 aa, Mycobacterium
EPCHRAILSKGIYGFENVGG

SEQ ID NO: 784271 - protein, 33 aa, Mycobacterium; identical to SEQ ID NO: 114290

SEQ ID NO: 784272 - protein, 17 aa, Mycobacterium
EPDLLVYKELHVVGALG

SEQ ID NO: 784273 - protein, 26 aa, Mycobacterium
EPGAYICVYPFVRSYEWYLLPDEERR

SEQ ID NO: 784274 - protein, 30 aa, Mycobacterium
EPGLLQQTVYAQPALFAFGVAMHAVLTQAG

SEQ ID NO: 784275 - protein, 27 aa, Mycobacterium
EPGNYICVYPFVRSYEWYLLPDEERRR

SEQ ID NO: 784276 - protein, 28 aa, Mycobacterium
EPGPGRRLLDGLALPWSENARPTPDVAD

SEQ ID NO: 784277 - protein, 18 aa, Mycobacterium
EPGRLRIALSTKVPTPLP

SEQ ID NO: 784278 - protein, 17 aa, Mycobacterium
EPHPQIPTTPWHHTHHW

SEQ ID NO: 784279 - protein, 17 aa, Mycobacterium
EPRFPSFKGIMAAKKKE

SEQ ID NO: 784280 - protein, 18 aa, Mycobacterium
EPSLDGVVLHYFLHAEPT

SEQ ID NO: 784281 - protein, 19 aa, Mycobacterium
EPVDISNAVLFLASDESRY

SEQ ID NO: 784282 - protein, 22 aa, Mycobacterium
EPVRLKARLRKVKSPFATQLHA

SEQ ID NO: 784283 - protein, 26 aa, Mycobacterium
EQAGPDALVVVLLPDGGRGYMSKIFN

SEQ ID NO: 784284 - protein, 23 aa, Mycobacterium
EQAPWMGLTLAAMLGQIGLPGGG

SEQ ID NO: 784285 - protein, 25 aa, Mycobacterium
EQARRLVIRGFFGEIISKIAVPEVR

SEQ ID NO: 784286 - protein, 24 aa, Mycobacterium
EQIMPGFLAFHPMGALVGQECVRI

SEQ ID NO: 784287 - protein, 34 aa, Mycobacterium; identical to SEQ ID NO: 126034

SEQ ID NO: 784288 - protein, 23 aa, Mycobacterium
EQKRPGYLLLSTDVARFPTEPPG

SEQ ID NO: 784289 - protein, 26 aa, Mycobacterium
EQQKEFADLLTWLKETLSEHVKEVRL

SEQ ID NO: 784290 - protein, 26 aa, Mycobacterium
EQRASNFLLWQAAYAEYVFQDKLWPD

SEQ ID NO: 784291 - protein, 23 aa, Mycobacterium
EQRDRILIITINRPKAKNAVNAA

SEQ ID NO: 784292 - protein, 26 aa, Mycobacterium
EQTGVATLLLSRPPTNALTRQMYREI

SEQ ID NO: 784293 - protein, 18 aa, Mycobacterium
ERFDVNVIGLTLSKNQHA

SEQ ID NO: 784294 - protein, 26 aa, Mycobacterium
ERGRGYANFLRILDEGRIAIAALSVG

SEQ ID NO: 784295 - protein, 17 aa, Mycobacterium
ERHLAMLTTLRADNSPH

SEQ ID NO: 784296 - protein, 28 aa, Mycobacterium
ERIQRRGMADNYWSMGIPGPCGPSSEIY

SEQ ID NO: 784297 - protein, 19 aa, Mycobacterium
ERKGYLRRDPNRPRAVDVR

SEQ ID NO: 784298 - protein, 25 aa, Mycobacterium
ERNAERYQFLRWGQGAFDDFKVVPP

SEQ ID NO: 784299 - protein, 18 aa, Mycobacterium
ERRILLRALRESVDTGTP

SEQ ID NO: 784300 - protein, 26 aa, Mycobacterium
ERSSHTWFVLTHLLGKPGVRNYDGSW

SEQ ID NO: 784301 - protein, 25 aa, Mycobacterium
ERTAQIVWGARALGGPVPIPEDVNR

SEQ ID NO: 784302 - protein, 29 aa, Mycobacterium
ERVSARVYPALVPLSHPLATVNGAFNAVV

SEQ ID NO: 784303 - protein, 24 aa, Mycobacterium
ESDNLAVKGIYWARRDAEPRHRRI

SEQ ID NO: 784304 - protein, 23 aa, Mycobacterium
ESEAFYMRVAAPGDLRCEGAQLG

SEQ ID NO: 784305 - protein, 17 aa, Mycobacterium
ESKIAFLMLPGVGTKED

SEQ ID NO: 784306 - protein, 26 aa, Mycobacterium
ESLADPLAFLLRKEGFEATVVTDGPA

SEQ ID NO: 784307 - protein, 17 aa, Mycobacterium
ESLLAATTIPMDCHLMI

SEQ ID NO: 784308 - protein, 24 aa, Mycobacterium
ESRAQMATLPRLKPRVFYDLVVEV

SEQ ID NO: 784309 - protein, 22 aa, Mycobacterium
ESSVAFQAAHARFVEVAAKVNA

SEQ ID NO: 784310 - protein, 27 aa, Mycobacterium
ETFADLELAWGPTWSGSLKSLWLGEGE

SEQ ID NO: 784311 - protein, 20 aa, Mycobacterium
ETFGVKRVVARIYDAKRAEV

SEQ ID NO: 784312 - protein, 20 aa, Mycobacterium
ETLVRLRPTFGAVNLEDISA

SEQ ID NO: 784313 - protein, 18 aa, Mycobacterium
ETRRLRPPTRDPARRART

SEQ ID NO: 784314 - protein, 28 aa, Mycobacterium
ETSKRYMHHYNFPPFSTGETGRVGSPKR

SEQ ID NO: 784315 - protein, 18 aa, Mycobacterium
ETTGRLIGWLAKVLAEHP

SEQ ID NO: 784316 - protein, 17 aa, Mycobacterium
ETTPFTLENGLLTGIRK

SEQ ID NO: 784317 - protein, 17 aa, Mycobacterium
EVARAFLTSQKARWAAR

SEQ ID NO: 784318 - protein, 20 aa, Mycobacterium
EVDILTIGLLIAEVKVTYKG

SEQ ID NO: 784319 - protein, 17 aa, Mycobacterium
EVELAKRIEAGLYATQL

SEQ ID NO: 784320 - protein, 17 aa, Mycobacterium
EVGLGYLRLGQPATELS

SEQ ID NO: 784321 - protein, 26 aa, Mycobacterium
EVGPDGLLYFPVMGANEIWRIDPDGG

SEQ ID NO: 784322 - protein, 17 aa, Mycobacterium
EVLRFDLARHRIGVSVV

SEQ ID NO: 784323 - protein, 32 aa, Mycobacterium
EVLRLRWRKGCMPLPRRVIRARVHGRQVYLVP

SEQ ID NO: 784324 - protein, 17 aa, Mycobacterium
EVLTLDILSRRGKTIRP

SEQ ID NO: 784325 - protein, 25 aa, Mycobacterium
EVNLLHDHLVDILLDAAAMGRVHVE

SEQ ID NO: 784326 - protein, 23 aa, Mycobacterium
EVNLLHDHLVDVLLDAAAMGRVH

SEQ ID NO: 784327 - protein, 21 aa, Mycobacterium
EVRDKIERRYATALGQAELAQ

SEQ ID NO: 784328 - protein, 22 aa, Mycobacterium
EVRPDRSTTLALRWLVGYSRQR

SEQ ID NO: 784329 - protein, 23 aa, Mycobacterium
EVRPDRSTTLALRWLVSFSRQRR

SEQ ID NO: 784330 - protein, 25 aa, Mycobacterium
EVRSEFLNQLTKGAIRKGVVSSIVN

SEQ ID NO: 784331 - protein, 18 aa, Mycobacterium
EVSITRRMFRDGASEYEI

SEQ ID NO: 784332 - protein, 25 aa, Mycobacterium
EVTLNGRVLPIGGVKQKLLAAQRAG

SEQ ID NO: 784333 - protein, 26 aa, Mycobacterium
EVVKGGLILDIGLRGFLPASLVEMRR

SEQ ID NO: 784334 - protein, 18 aa, Mycobacterium
EVVTDMWGRPRVRLSGDI

SEQ ID NO: 784335 - protein, 17 aa, Mycobacterium
EVWGWDEAYLGADLPDE

SEQ ID NO: 784336 - protein, 30 aa, Mycobacterium
EVYFELRLADAWVWDMYRPARFVKQVRVVT

SEQ ID NO: 784337 - protein, 29 aa, Mycobacterium
EWHALPARLLAEVLRLRGWQVDFLGAQVP

SEQ ID NO: 784338 - protein, 21 aa, Mycobacterium
EWPENPRFLMCTPLSHAGAAF

SEQ ID NO: 784339 - protein, 19 aa, Mycobacterium
EYAICYFPEAAYDRSGIEL

SEQ ID NO: 784340 - protein, 35 aa, Mycobacterium
EYEPYGTVLIIGAWNYPFYLTLGPAVGAIAAGNTV

SEQ ID NO: 784341 - protein, 24 aa, Mycobacterium
EYGRRVLLVDLDPQGALSAGLGVP

SEQ ID NO: 784342 - protein, 18 aa, Mycobacterium
EYGVWAGVKLPGGQYRKR

SEQ ID NO: 784343 - protein, 18 aa, Mycobacterium
FAALSLDPPLVLFCPTKV

SEQ ID NO: 784344 - protein, 18 aa, Mycobacterium
FAAVRQFRASVCVLGPLV

SEQ ID NO: 784345 - protein, 18 aa, Mycobacterium
FACQSFAALSLDPPLVLF

SEQ ID NO: 784346 - protein, 19 aa, Mycobacterium
FAGILAQVPFVDPLTTILD

SEQ ID NO: 784347 - protein, 19 aa, Mycobacterium
FAHERFWLADRFGVGQQVC

SEQ ID NO: 784348 - protein, 25 aa, Mycobacterium
FAQAVLDAGLIWIGPSPQSIRDLGD

SEQ ID NO: 784349 - protein, 23 aa, Mycobacterium
FAQAYEQIMLLRSAVGMAAPQAT

SEQ ID NO: 784350 - protein, 18 aa, Mycobacterium
FAQKLGWNGIPVTSSYAA

SEQ ID NO: 784351 - protein, 22 aa, Mycobacterium
FARGELPHFAGERGTFLKAPFL

SEQ ID NO: 784352 - protein, 21 aa, Mycobacterium
FASCFAAPLPRGLRAVAQEQT

SEQ ID NO: 784353 - protein, 25 aa, Mycobacterium
FATTELFLERLGLTSLADLPDIAPL

SEQ ID NO: 784354 - protein, 23 aa, Mycobacterium
FATTPRMSTYLVALIAGPYAEWK

SEQ ID NO: 784355 - protein, 17 aa, Mycobacterium
FDEAVGLQWALVARRHG

SEQ ID NO: 784356 - protein, 22 aa, Mycobacterium
FDLQLHQRGMLRPLRAAELSDG

SEQ ID NO: 784357 - protein, 17 aa, Mycobacterium
FDRLRLIQRIADRLPEK

SEQ ID NO: 784358 - protein, 25 aa, Mycobacterium
FDRPEDYWPRQWAHAYVDFAAGEKR

SEQ ID NO: 784359 - protein, 26 aa, Mycobacterium
FDTIGRLWDRIGDKGIGFCLDTCHAW

SEQ ID NO: 784360 - protein, 28 aa, Mycobacterium
FEAAVAGAIPVIRPLTQSLAGDTVLRVA

SEQ ID NO: 784361 - protein, 25 aa, Mycobacterium
FEGQHDVFFPLLLAAGTTGLDLMTN

SEQ ID NO: 784362 - protein, 28 aa, Mycobacterium
FELRLSDAWVWDMYRPARFVKQVRVVTF

SEQ ID NO: 784363 - protein, 17 aa, Mycobacterium
FEMPYGPSVPALYGLIA

SEQ ID NO: 784364 - protein, 21 aa, Mycobacterium
FEVAWRILQATPVTATGLVCA

SEQ ID NO: 784365 - protein, 17 aa, Mycobacterium
FFCTQLPTDVPNDVLSQ

SEQ ID NO: 784366 - protein, 17 aa, Mycobacterium
FFTLLQPEQWGGLQCDP

SEQ ID NO: 784367 - protein, 20 aa, Mycobacterium
FGEPIPVTSLLGFGSGMLLG

SEQ ID NO: 784368 - protein, 28 aa, Mycobacterium
FGGMKLDFLLTIDPEYYKKFMSVNLDGA

SEQ ID NO: 784369 - protein, 20 aa, Mycobacterium
FGIFTPPHQVDYADLLRVWT

SEQ ID NO: 784370 - protein, 18 aa, Mycobacterium
FGKTNLVEALWYSATLGS

SEQ ID NO: 784371 - protein, 24 aa, Mycobacterium
FGPEVKRRIMIGTYALSAGYYDAY

SEQ ID NO: 784372 - protein, 19 aa, Mycobacterium
FGVGGVGGNGAWGAGGIGG

SEQ ID NO: 784373 - protein, 25 aa, Mycobacterium
FGVHPMTLHKWLRQADIDEGTKPGR

SEQ ID NO: 784374 - protein, 26 aa, Mycobacterium
FHAEFAVPLPCTVFLQLLGLPLEDLD

SEQ ID NO: 784375 - protein, 19 aa, Mycobacterium
FHGITTLACRCGHTDCDAA

SEQ ID NO: 784376 - protein, 24 aa, Mycobacterium
FHIDRGYPLFVENLAILGAEIERV

SEQ ID NO: 784377 - protein, 17 aa, Mycobacterium
FHLRDLAVTFRFGEEVT

SEQ ID NO: 784378 - protein, 24 aa, Mycobacterium
FHRRLASFCRVIRFDQRGIGLSSR

SEQ ID NO: 784379 - protein, 18 aa, Mycobacterium
FHTLTGRMHFYLAHDWVE

SEQ ID NO: 784380 - protein, 17 aa, Mycobacterium
FISSPGYEHAWLNPDNT

SEQ ID NO: 784381 - protein, 23 aa, Mycobacterium
FKDAELLGVPWIVVVGRGWADGV

SEQ ID NO: 784382 - protein, 17 aa, Mycobacterium
FKEMTLLELSDFVKKFE

SEQ ID NO: 784383 - protein, 19 aa, Mycobacterium
FKGLQLDIGAPPQFMDFRY

SEQ ID NO: 784384 - protein, 20 aa, Mycobacterium
FKPRYNPWDQRMCLIPDADL

SEQ ID NO: 784385 - protein, 22 aa, Mycobacterium
FKRHKQIDRPCLLGYIDKCSAP

SEQ ID NO: 784386 - protein, 18 aa, Mycobacterium
FLDMVRRRGRIRMEALPE

SEQ ID NO: 784387 - protein, 21 aa, Mycobacterium
FLETDLFNQGVRPAINVGVSV

SEQ ID NO: 784388 - protein, 19 aa, Mycobacterium
FLSPSKLRRRRGADVGFFR

SEQ ID NO: 784389 - protein, 44 aa, Mycobacterium
FLTMASLKWVIANRAFTPWYLVRYWRLLKFKLANPHIITRGMVF

SEQ ID NO: 784390 - protein, 24 aa, Mycobacterium
FLYEGELFVCGRSKDLIIVRGVNC

SEQ ID NO: 784391 - protein, 23 aa, Mycobacterium
FMADHVFSRLAIPSWMARTGFQM

SEQ ID NO: 784392 - protein, 20 aa, Mycobacterium
FMGLGMIYTAMPVTNAVPAV

SEQ ID NO: 784393 - protein, 24 aa, Mycobacterium
FMGPLDGWLRRLGVIEASRENAAA

SEQ ID NO: 784394 - protein, 18 aa, Mycobacterium
FMPAPGYSAYIAPDKYAQ

SEQ ID NO: 784395 - protein, 17 aa, Mycobacterium
FMSGWMGVDLARYGLDE

SEQ ID NO: 784396 - protein, 18 aa, Mycobacterium
FMTAVRQIDEFFLQVVRL

SEQ ID NO: 784397 - protein, 17 aa, Mycobacterium
FNVATAHALTVAAVPLM

SEQ ID NO: 784398 - protein, 23 aa, Mycobacterium
FPEATMCRFGVPLGPVAQPLDGP

SEQ ID NO: 784399 - protein, 22 aa, Mycobacterium
FPQAFTHLALINAVVHVIRAEE

SEQ ID NO: 784400 - protein, 18 aa, Mycobacterium
FPVWTERGGPATIVPMFL

SEQ ID NO: 784401 - protein, 25 aa, Mycobacterium
FQAYSLFPHLTVLDNVAFGLKMRGK

SEQ ID NO: 784402 - protein, 17 aa, Mycobacterium
FQRTPGWVLPRVNFRHP

SEQ ID NO: 784403 - protein, 18 aa, Mycobacterium
FRDRAYPESTELLQRIRS

SEQ ID NO: 784404 - protein, 21 aa, Mycobacterium
FRHTFDWCVTSAFIMSQLVAP

SEQ ID NO: 784405 - protein, 21 aa, Mycobacterium
FRNIVNMLHGVRDGLIRDANN

SEQ ID NO: 784406 - protein, 19 aa, Mycobacterium
FRRMLSKPFTFKRVEALRP

SEQ ID NO: 784407 - protein, 26 aa, Mycobacterium
FRSDALQIIAFGRYARTVTAAELTGL

SEQ ID NO: 784408 - protein, 33 aa, Mycobacterium
FRSFREGTNLKAWLYRILTNTYINSYRKKQRQP

SEQ ID NO: 784409 - protein, 28 aa, Mycobacterium
FSEGAVKALWDTILPFAGYAFNKSHAAG

SEQ ID NO: 784410 - protein, 20 aa, Mycobacterium
FSLTVPRRDGGERRLYLIET

SEQ ID NO: 784411 - protein, 19 aa, Mycobacterium
FSMLYAFSENYVLPISHDE

SEQ ID NO: 784412 - protein, 19 aa, Mycobacterium
FSMLYAFSENYVLPLSHDE

SEQ ID NO: 784413 - protein, 17 aa, Mycobacterium
FTAVRRSVTVDGVATDI

SEQ ID NO: 784414 - protein, 17 aa, Mycobacterium
FTFNVATAHALTVAAVP

SEQ ID NO: 784415 - protein, 19 aa, Mycobacterium
FTGQVWPGDLLSFGGRVTG

SEQ ID NO: 784416 - protein, 17 aa, Mycobacterium
FTLLQDQLQSVLETLSE

SEQ ID NO: 784417 - protein, 29 aa, Mycobacterium
FTSDIKNLLPMFAVFKPTVVVSVPRVFEK

SEQ ID NO: 784418 - protein, 24 aa, Mycobacterium
FTSKTHLLVTLLAREFVRLDEERD

SEQ ID NO: 784419 - protein, 18 aa, Mycobacterium
FTTLVPNLGVVSAGEHTF

SEQ ID NO: 784420 - protein, 26 aa, Mycobacterium
FVGNAGIFDYFAPLVGFDGADLSSAF

SEQ ID NO: 784421 - protein, 17 aa, Mycobacterium
FVQRLSEGIGTIAAAFW

SEQ ID NO: 784422 - protein, 17 aa, Mycobacterium
FVQSKPFRKMGIHSSRT

SEQ ID NO: 784423 - protein, 31 aa, Mycobacterium; identical to SEQ ID NO: 20602

SEQ ID NO: 784424 - protein, 17 aa, Mycobacterium
FVYKGMLTTPQLKAFYL

SEQ ID NO: 784425 - protein, 17 aa, Mycobacterium
FWKAVREVFPATKEQRC

SEQ ID NO: 784426 - protein, 24 aa, Mycobacterium
GAAARVRAKLPSGAELLFCQHHAN

SEQ ID NO: 784427 - protein, 24 aa, Mycobacterium
GAAKAGIISLTLTAARALGRYGVC

SEQ ID NO: 784428 - protein, 22 aa, Mycobacterium
GAALLLDTWALLGRQDLRAAED

SEQ ID NO: 784429 - protein, 24 aa, Mycobacterium
GAEASRLFLTQMIAHHKGAIMMAQ

SEQ ID NO: 784430 - protein, 22 aa, Mycobacterium
GAELSMVLLDTAAMADLHMRWM

SEQ ID NO: 784431 - protein, 22 aa, Mycobacterium
GAFEMAATVDYLFGYDATAGVM

SEQ ID NO: 784432 - protein, 19 aa, Mycobacterium
GAFLAWGDPSLYDSTLRIL

SEQ ID NO: 784433 - protein, 25 aa, Mycobacterium
GAGGGVGLIGFGGAGGFGGASGFGT

SEQ ID NO: 784434 - protein, 25 aa, Mycobacterium
GAGGRGGLLIGLGGNGGTGGFSGPL

SEQ ID NO: 784435 - protein, 18 aa, Mycobacterium
GAGGWLFGDAGAGGQGGT

SEQ ID NO: 784436 - protein, 18 aa, Mycobacterium
GAGWLKVKPVHTLDLVVL

SEQ ID NO: 784437 - protein, 17 aa, Mycobacterium
GAIALGHPLGASGAVLM

SEQ ID NO: 784438 - protein, 23 aa, Mycobacterium
GAIGMEFAYVLKNYGVDVTIVEF

SEQ ID NO: 784439 - protein, 20 aa, Mycobacterium
GAKEILCIRVLGGSSRRYAG

SEQ ID NO: 784440 - protein, 25 aa, Mycobacterium
GAKEQLGILARLAGAALVAKEDAVP

SEQ ID NO: 784441 - protein, 17 aa, Mycobacterium
GAKNHMIIMPDADLDQA

SEQ ID NO: 784442 - protein, 22 aa, Mycobacterium
GALGLRPTLAALASGARLALAN

SEQ ID NO: 784443 - protein, 20 aa, Mycobacterium
GALLLGARLGPARTAGICAI

SEQ ID NO: 784444 - protein, 18 aa, Mycobacterium
GALLLGGRLGPARTAAIC

SEQ ID NO: 784445 - protein, 25 aa, Mycobacterium
GALRYYLLEQNALPDTPLIAMVPVS

SEQ ID NO: 784446 - protein, 25 aa, Mycobacterium
GANLALLVGARPRGPGMERSDLLEA

SEQ ID NO: 784447 - protein, 19 aa, Mycobacterium
GAPDVLRYVMGFGGTPDSA

SEQ ID NO: 784448 - protein, 25 aa, Mycobacterium
GARARFGDVLPFLVKVLAADEPLSL

SEQ ID NO: 784449 - protein, 26 aa, Mycobacterium
GARDFLVPARLQPGSFYALPQSPQLF

SEQ ID NO: 784450 - protein, 21 aa, Mycobacterium
GARDPLRLPGNAHFTFRGCEG

SEQ ID NO: 784451 - protein, 23 aa, Mycobacterium
GARLDSLVPLGPPVMDVALNITC

SEQ ID NO: 784452 - protein, 19 aa, Mycobacterium
GASYWYAHTDQWRYDGYGA

SEQ ID NO: 784453 - protein, 33 aa, Mycobacterium
GATGPDAFDCSGLIKWAFLQNGKSLPRSSQALA

SEQ ID NO: 784454 - protein, 18 aa, Mycobacterium
GAVWLRTTDFGDDKDRVV

SEQ ID NO: 784455 - protein, 24 aa, Mycobacterium
GAYPSTLGYKGFPKSCCTSLNEII

SEQ ID NO: 784456 - protein, 18 aa, Mycobacterium
GCISYEPAFAIDVEWTLL

SEQ ID NO: 784457 - protein, 26 aa, Mycobacterium
GCMALGITGPILRATGLPHDLRKSEP

SEQ ID NO: 784458 - protein, 18 aa, Mycobacterium
GCPLLLKEVGHGIGAAAV

SEQ ID NO: 784459 - protein, 19 aa, Mycobacterium
GCWGPVVKCNVPKRGWING

SEQ ID NO: 784460 - protein, 22 aa, Mycobacterium
GCWGPVVKCNVPKRGWINGVGG

SEQ ID NO: 784461 - protein, 26 aa, Mycobacterium
GDAARFLLEGLPVQVAFHNGAPLYIE

SEQ ID NO: 784462 - protein, 18 aa, Mycobacterium
GDCIFFSAGPPKSSRALL

SEQ ID NO: 784463 - protein, 24 aa, Mycobacterium
GDDGRFLWPGFGENSRVLKWAVER

SEQ ID NO: 784464 - protein, 26 aa, Mycobacterium
GDELRATLLALLGSPHLCSRAFITEQ

SEQ ID NO: 784465 - protein, 19 aa, Mycobacterium
GDFDLSTLRFALSGAEPVE

SEQ ID NO: 784466 - protein, 17 aa, Mycobacterium
GDGGTGGLGGDGGTGGQ

SEQ ID NO: 784467 - protein, 24 aa, Mycobacterium
GDGRVRARREITVKIPAGVGDGMR

SEQ ID NO: 784468 - protein, 17 aa, Mycobacterium
GDKIFYYGGGGQGNHLG

SEQ ID NO: 784469 - protein, 28 aa, Mycobacterium
GDLAEPLGFDGIWLPEHCGTPYGMTPNP

SEQ ID NO: 784470 - protein, 18 aa, Mycobacterium
GDLATAIDALRRPERRRG

SEQ ID NO: 784471 - protein, 18 aa, Mycobacterium
GDLDVMIIALRAPADGPI

SEQ ID NO: 784472 - protein, 30 aa, Mycobacterium
GDREGEAIAWHLLETLKPNIPVKRMVFHEI

SEQ ID NO: 784473 - protein, 19 aa, Mycobacterium
GDSLFNEVFLDNVFVPDEM

SEQ ID NO: 784474 - protein, 17 aa, Mycobacterium
GDSYHTLFAHRSMVELG

SEQ ID NO: 784475 - protein, 17 aa, Mycobacterium
GDTLFLEGCGRTDFPGG

SEQ ID NO: 784476 - protein, 22 aa, Mycobacterium
GDTQLLAHFRSLADKHLEVLAG

SEQ ID NO: 784477 - protein, 27 aa, Mycobacterium
GDWWDAAYLMMWGSNVPITRTPDAHWM

SEQ ID NO: 784478 - protein, 19 aa, Mycobacterium
GEESLYLRPFVIATEPGLG

SEQ ID NO: 784479 - protein, 20 aa, Mycobacterium
GEKTRLALAGLVASTANVLL

SEQ ID NO: 784480 - protein, 19 aa, Mycobacterium
GELPTWQWESLISKSTRLV

SEQ ID NO: 784481 - protein, 28 aa, Mycobacterium
GESMPVPILTLRQWRPLDAARMEVWSWF

SEQ ID NO: 784482 - protein, 17 aa, Mycobacterium
GETVAVLRAFPQIAQHY

SEQ ID NO: 784483 - protein, 24 aa, Mycobacterium
GEVDVYNMGWQKYLDARATDEQRR

SEQ ID NO: 784484 - protein, 20 aa, Mycobacterium
GFERFYGFLGGDTSQYEPAL

SEQ ID NO: 784485 - protein, 18 aa, Mycobacterium
GFERFYGFMGGETDQWYP

SEQ ID NO: 784486 - protein, 26 aa, Mycobacterium
GFGPEVKRRIMIGTYALSAGYYDAYY

SEQ ID NO: 784487 - protein, 18 aa, Mycobacterium
GFRFDLAATLAREFYEVD

SEQ ID NO: 784488 - protein, 19 aa, Mycobacterium
GFRFDLASTLAREFYDVDR

SEQ ID NO: 784489 - protein, 26 aa, Mycobacterium
GFRLGITTDWKSRWYADKQYADYVKE

SEQ ID NO: 784490 - protein, 17 aa, Mycobacterium
GFRNSMTFVLTGLDIEA

SEQ ID NO: 784491 - protein, 19 aa, Mycobacterium
GFRNTMTMVLTGLDIGAKA

SEQ ID NO: 784492 - protein, 27 aa, Mycobacterium
GFTEFVPLPFVHQSSPLYLAGAARPGP

SEQ ID NO: 784493 - protein, 28 aa, Mycobacterium
GGAAGTGTGGIQGAGGQGGTGGAGGSGG

SEQ ID NO: 784494 - protein, 27 aa, Mycobacterium
GGAAGTGTGGIQGAGGQGGTGGTGGQG

SEQ ID NO: 784495 - protein, 27 aa, Mycobacterium
GGAAGTGTGGIQGAGGQGGTGGTGGTG

SEQ ID NO: 784496 - protein, 22 aa, Mycobacterium
GGAGSALGFGLGGAGGAGGASG

SEQ ID NO: 784497 - protein, 18 aa, Mycobacterium
GGAIALGHPLGASGAVLM

SEQ ID NO: 784498 - protein, 19 aa, Mycobacterium
GGAYRLIDFVLSNLVNARY

SEQ ID NO: 784499 - protein, 22 aa, Mycobacterium
GGEDFSWYLEEVPGAMARLGVW

SEQ ID NO: 784500 - protein, 24 aa, Mycobacterium
GGEGKRLYPLTADRAKPAVPFGGA

SEQ ID NO: 784501 - protein, 24 aa, Mycobacterium
GGEKTPEGVGWLYNFIRAQGERNY

SEQ ID NO: 784502 - protein, 24 aa, Mycobacterium
GGGLLRLPERIPYAIAMELALTGD

SEQ ID NO: 784503 - protein, 17 aa, Mycobacterium
GGHLFSVYDGCREEGIR

SEQ ID NO: 784504 - protein, 21 aa, Mycobacterium
GGKTFPLPNPFLVMATQNPIE

SEQ ID NO: 784505 - protein, 21 aa, Mycobacterium
GGLGTFSWPGAYGTWWQADPS

SEQ ID NO: 784506 - protein, 28 aa, Mycobacterium
GGPATIVPMFLLYDYSFLPEGATSKAEG

SEQ ID NO: 784507 - protein, 22 aa, Mycobacterium
GGPLAHPFQPLLNPRLREFALR

SEQ ID NO: 784508 - protein, 32 aa, Mycobacterium
GGRHTPFFNNYRPQFYFRTTDVTGVVTLPEGT

SEQ ID NO: 784509 - protein, 27 aa, Mycobacterium
GGSAVRLVRQIPYTVACDLLLTGRHIT

SEQ ID NO: 784510 - protein, 22 aa, Mycobacterium
GGSGGLLFGDGGVGGAGGAGGI

SEQ ID NO: 784511 - protein, 26 aa, Mycobacterium
GGSLHEPLLTVAWPGAHLGPMGLEGA

SEQ ID NO: 784512 - protein, 26 aa, Mycobacterium
GGTPAKWARIWAQRHPDVLLDLHPVA

SEQ ID NO: 784513 - protein, 20 aa, Mycobacterium
GGVGPLTRAFLLTNVVELAE

SEQ ID NO: 784514 - protein, 20 aa, Mycobacterium
GGYTYGGRIAALADAARENG

SEQ ID NO: 784515 - protein, 19 aa, Mycobacterium
GHFALTNLLLPKLTDRVVT

SEQ ID NO: 784516 - protein, 22 aa, Mycobacterium
GHFGRTDIELPWEQLNKVDDLK

SEQ ID NO: 784517 - protein, 19 aa, Mycobacterium
GHLDPTVFQRLAPGIMPLS

SEQ ID NO: 784518 - protein, 18 aa, Mycobacterium
GHPLGYIATDVYARYFRM

SEQ ID NO: 784519 - protein, 23 aa, Mycobacterium
GHRMLANWLAYCGWARDDTLVRR

SEQ ID NO: 784520 - protein, 17 aa, Mycobacterium
GICFGNQILGRALGLST

SEQ ID NO: 784521 - protein, 28 aa, Mycobacterium
GIDFIEACAWIKENLPGVHISGGISNVS

SEQ ID NO: 784522 - protein, 27 aa, Mycobacterium
GIDFTNIYFYTVLFHALRASNKIAIER

SEQ ID NO: 784523 - protein, 24 aa, Mycobacterium
GIEKNLEYRYWTQGVTFVTRMDYL

SEQ ID NO: 784524 - protein, 25 aa, Mycobacterium
GIGELKFFSQIGYGGGAAAATVQQA

SEQ ID NO: 784525 - protein, 23 aa, Mycobacterium
GIGREMHVIVGQGKLDEILQSRP

SEQ ID NO: 784526 - protein, 25 aa, Mycobacterium
GIPAVTFWAAVPHYVSQPPNPKATV

SEQ ID NO: 784527 - protein, 17 aa, Mycobacterium
GIPVFKLTEEETTRLLR

SEQ ID NO: 784528 - protein, 18 aa, Mycobacterium
GISWPYQTLANHLTNPLI

SEQ ID NO: 784529 - protein, 19 aa, Mycobacterium
GKALKFYSSVRLDVRRIET

SEQ ID NO: 784530 - protein, 23 aa, Mycobacterium
GKQEVWNAIRLLRSEGRTVVLTT

SEQ ID NO: 784531 - protein, 21 aa, Mycobacterium
GKRVAPLLRLGGDPLRIGASL

SEQ ID NO: 784532 - protein, 20 aa, Mycobacterium
GKTMVVTGLHLLGGARADAT

SEQ ID NO: 784533 - protein, 23 aa, Mycobacterium
GKTVLIRRLVEECALRGVSSIVL

SEQ ID NO: 784534 - protein, 24 aa, Mycobacterium
GKYSWVMSPRWFDGTDHLALDTGG

SEQ ID NO: 784535 - protein, 18 aa, Mycobacterium
GLAEIQLPDLQPGSSIMP

SEQ ID NO: 784536 - protein, 26 aa, Mycobacterium
GLGLDFLRHIERCAVLVHVVDCATAE

SEQ ID NO: 784537 - protein, 25 aa, Mycobacterium
GLLEQSRRHAFLASLLGIQHIVLAV

SEQ ID NO: 784538 - protein, 25 aa, Mycobacterium
GLNAKWPVYLSTKNTILKAYDGMFK

SEQ ID NO: 784539 - protein, 19 aa, Mycobacterium
GLPAGSALLVVKRGPNAGS

SEQ ID NO: 784540 - protein, 25 aa, Mycobacterium
GLPAGSALLVVKRGPNAGSRFLLDQ

SEQ ID NO: 784541 - protein, 19 aa, Mycobacterium
GLQIMAPALADDRLYRVGA

SEQ ID NO: 784542 - protein, 26 aa, Mycobacterium
GLRSLLAYQWAHPGKQLLFMGQEFGQ

SEQ ID NO: 784543 - protein, 31 aa, Mycobacterium
GLSKARFTGTITVKYLRGTPLGPLRCEAWVD

SEQ ID NO: 784544 - protein, 23 aa, Mycobacterium
GLSKIARLVDLYAKRPQVQERLT

SEQ ID NO: 784545 - protein, 18 aa, Mycobacterium
GLSSRLFQEVRELRGLAY

SEQ ID NO: 784546 - protein, 17 aa, Mycobacterium
GLSVLRYAIRTEIRLIT

SEQ ID NO: 784547 - protein, 19 aa, Mycobacterium
GLVRHYAARHGLWQLDPDI

SEQ ID NO: 784548 - protein, 25 aa, Mycobacterium
GMADPLPMLTLFDKQVTLRMGQANV

SEQ ID NO: 784549 - protein, 24 aa, Mycobacterium
GMAVPGFPNFFMLYGPNTNVGSNS

SEQ ID NO: 784550 - protein, 28 aa, Mycobacterium
GMEFGQFAAWSYFNRSFFTPGQAKIQGI

SEQ ID NO: 784551 - protein, 18 aa, Mycobacterium
GMIWRYPDYFVVGREQLR

SEQ ID NO: 784552 - protein, 18 aa, Mycobacterium
GMKMQPFMIHYTASKHAV

SEQ ID NO: 784553 - protein, 18 aa, Mycobacterium
GMLAALHVLAALGEQDRP

SEQ ID NO: 784554 - protein, 21 aa, Mycobacterium
GMLRPLRAAELSDGTLRFLLW

SEQ ID NO: 784555 - protein, 26 aa, Mycobacterium
GMLTTPQLKAFYLDLQDDRLTSALGI

SEQ ID NO: 784556 - protein, 19 aa, Mycobacterium
GMPATRFLGPALGSLHMFF

SEQ ID NO: 784557 - protein, 21 aa, Mycobacterium
GMPGVEYYAHPWEFGPRKAKE

SEQ ID NO: 784558 - protein, 25 aa, Mycobacterium
GMPPMAPLAPLLPAATDIGLHIIVT

SEQ ID NO: 784559 - protein, 25 aa, Mycobacterium
GMVRTALFNWAYARHTGGTFVFRIE

SEQ ID NO: 784560 - protein, 30 aa, Mycobacterium
GNAIVRTPVPPLKWWRGIQARKTLEDYFLS

SEQ ID NO: 784561 - protein, 26 aa, Mycobacterium
GNGYRRTPYRIVLARVARLANALRSL

SEQ ID NO: 784562 - protein, 19 aa, Mycobacterium
GNKLLIFQVYDHQTNFPLG

SEQ ID NO: 784563 - protein, 22 aa, Mycobacterium
GNLGLIRAVEKFDYTKGYKFST

SEQ ID NO: 784564 - protein, 25 aa, Mycobacterium
GNSTRARIVLFRKPIERRAKDTIEL

SEQ ID NO: 784565 - protein, 24 aa, Mycobacterium
GNTLVGPITWAVELDERWVVIGPN

SEQ ID NO: 784566 - protein, 18 aa, Mycobacterium
GNVYCNELCFVSGHLPTA

SEQ ID NO: 784567 - protein, 25 aa, Mycobacterium
GPAFQGTIKSAVAFGALLSKGIGDT

SEQ ID NO: 784568 - protein, 20 aa, Mycobacterium
GPALLLGARGRRLDVRQART

SEQ ID NO: 784569 - protein, 27 aa, Mycobacterium
GPDGQPHLTAMWYAVVDGEIWLETKAK

SEQ ID NO: 784570 - protein, 22 aa, Mycobacterium
GPETLRSLYFLSSRVSGGSPHA

SEQ ID NO: 784571 - protein, 28 aa, Mycobacterium
GPGAPPLDRLLAYGRERMKFVREHHALL

SEQ ID NO: 784572 - protein, 28 aa, Mycobacterium
GPGSPPATLLDYFPEDFLLVIDESHVTV

SEQ ID NO: 784573 - protein, 18 aa, Mycobacterium
GPHLLVLARGPEGYRRLS

SEQ ID NO: 784574 - protein, 19 aa, Mycobacterium
GPKALLANGVRYLVDPRVV

SEQ ID NO: 784575 - protein, 20 aa, Mycobacterium
GPLAAFVHALGDVGFDVAVL

SEQ ID NO: 784576 - protein, 18 aa, Mycobacterium
GPLPLQIICDMMGIPEED

SEQ ID NO: 784577 - protein, 29 aa, Mycobacterium
GPSAFQTIIDMWLPLSWSLNMVNRSMGHD

SEQ ID NO: 784578 - protein, 23 aa, Mycobacterium
GQDLTTLLRSGFAPVAFVMGNCV

SEQ ID NO: 784579 - protein, 19 aa, Mycobacterium
GQFDLSSLRFALSGAEPVE

SEQ ID NO: 784580 - protein, 53 aa, Mycobacterium
GQFQVLAEPVQTLGQAWLGSPAGELLDPLVNAPFESLTGRELIGNGAAGVAGV

SEQ ID NO: 784581 - protein, 26 aa, Mycobacterium
GQHQMWAAQFIKYEKPRTWLNSGGLG

SEQ ID NO: 784582 - protein, 29 aa, Mycobacterium
GQRAKNMFALGLLSWMYGRPIETSEKFIR

SEQ ID NO: 784583 - protein, 17 aa, Mycobacterium
GRAFSFISAIDSIGAVP

SEQ ID NO: 784584 - protein, 24 aa, Mycobacterium
GRATLEVCFAILQSAYEDREVVLS

SEQ ID NO: 784585 - protein, 17 aa, Mycobacterium
GRDAGRRRPPVLTEAEF

SEQ ID NO: 784586 - protein, 24 aa, Mycobacterium
GRDPYGVKIFNLSTIITGATDEEA

SEQ ID NO: 784587 - protein, 20 aa, Mycobacterium
GREYVAQFLISGAGALHIPS

SEQ ID NO: 784588 - protein, 19 aa, Mycobacterium
GRGIVLYMRGHEGRGIGLM

SEQ ID NO: 784589 - protein, 23 aa, Mycobacterium
GRGPVATVLIQRGTLRVGDSVVA

SEQ ID NO: 784590 - protein, 18 aa, Mycobacterium
GRHQFPLVLTDTVAQFLA

SEQ ID NO: 784591 - protein, 24 aa, Mycobacterium
GRIERELPDWLAADVAILGEPTGG

SEQ ID NO: 784592 - protein, 23 aa, Mycobacterium
GRIQMGIGGGWYEHEWRAYGYGF

SEQ ID NO: 784593 - protein, 22 aa, Mycobacterium
GRLHTPKRYSRRLRRVMYMSAL

SEQ ID NO: 784594 - protein, 25 aa, Mycobacterium
GRLTAHLPSARRLLLFKADGSVSVH

SEQ ID NO: 784595 - protein, 23 aa, Mycobacterium
GRNMTMVLAPHRGAKTRARARHP

SEQ ID NO: 784596 - protein, 18 aa, Mycobacterium
GRNVPKLRQVIGCVFQDF

SEQ ID NO: 784597 - protein, 21 aa, Mycobacterium
GRPLPPVIAAAFRKAIGGTVH

SEQ ID NO: 784598 - protein, 24 aa, Mycobacterium
GRPSVAWRQDRVRFWAAIAAGAMT

SEQ ID NO: 784599 - protein, 23 aa, Mycobacterium
GRRFLNAGLGFGGGCLPKDIRAF

SEQ ID NO: 784600 - protein, 19 aa, Mycobacterium
GRSIIVLSEGRLLNLGNAT

SEQ ID NO: 784601 - protein, 22 aa, Mycobacterium
GRVAGVHFLMKKNKITEIHGYG

SEQ ID NO: 784602 - protein, 23 aa, Mycobacterium
GRVAGVHFLMKKNKITEIHGYGR

SEQ ID NO: 784603 - protein, 30 aa, Mycobacterium
GRYHSIWLPDHMVSFWPDSIWTPEFTDLAT

SEQ ID NO: 784604 - protein, 19 aa, Mycobacterium
GRYLKKITVSTTTGPGIPV

SEQ ID NO: 784605 - protein, 20 aa, Mycobacterium
GSALLVVKRGPNAGSRFLLD

SEQ ID NO: 784606 - protein, 23 aa, Mycobacterium
GSALVPSWVAFAVTGLLEQHFGR

SEQ ID NO: 784607 - protein, 21 aa, Mycobacterium
GSARFGIRALTAYCVAKGGLE

SEQ ID NO: 784608 - protein, 26 aa, Mycobacterium
GSARKLAMEFARFLGLPPVRRMNVTD

SEQ ID NO: 784609 - protein, 25 aa, Mycobacterium
GSDRRIELWPDWLPRRTFGSAPGQY

SEQ ID NO: 784610 - protein, 23 aa, Mycobacterium
GSGDVLMVAWMDDDALARTLETR

SEQ ID NO: 784611 - protein, 23 aa, Mycobacterium
GSGSSRDWAAKGTLLLGVRAVIA

SEQ ID NO: 784612 - protein, 25 aa, Mycobacterium
GSKMNRFFLRGALVARLLSEAAWKQ

SEQ ID NO: 784613 - protein, 24 aa, Mycobacterium
GSLARLPLILSDGHLRELALTGKD

SEQ ID NO: 784614 - protein, 17 aa, Mycobacterium
GSLERYLEPFSHTVAVM

SEQ ID NO: 784615 - protein, 27 aa, Mycobacterium
GSPVPGAALFVLDKWLRPAPEGVVGEL

SEQ ID NO: 784616 - protein, 21 aa, Mycobacterium
GSQVLVFKDLGLVSQVFDEQT

SEQ ID NO: 784617 - protein, 19 aa, Mycobacterium
GSRFVACPFGAPGARMYRT

SEQ ID NO: 784618 - protein, 24 aa, Mycobacterium
GSTEHWQAWLQRYGGDYTDDAERR

SEQ ID NO: 784619 - protein, 17 aa, Mycobacterium
GSVWAQVTADHLGGLPP

SEQ ID NO: 784620 - protein, 24 aa, Mycobacterium
GTEAPAEMHFYFPRFRALCMAENA

SEQ ID NO: 784621 - protein, 21 aa, Mycobacterium
GTEKLPYSLKVLAENLLRTED

SEQ ID NO: 784622 - protein, 22 aa, Mycobacterium
GTEKNFKWIARSADGWITTPRD

SEQ ID NO: 784623 - protein, 24 aa, Mycobacterium
GTGGTAGWLYGSGGSGGAGGAGTA

SEQ ID NO: 784624 - protein, 26 aa, Mycobacterium
GTGMGIDRLLMALTGLSIRETVLFPI

SEQ ID NO: 784625 - protein, 22 aa, Mycobacterium
GTHGWGYDGVLWYAVHEPYGGP

SEQ ID NO: 784626 - protein, 21 aa, Mycobacterium
GTHGWGYDGVLWYSVHEPYGG

SEQ ID NO: 784627 - protein, 23 aa, Mycobacterium
GTITPFAMIQLADRGQFFVEPGQ

SEQ ID NO: 784628 - protein, 31 aa, Mycobacterium
GTLSEKIDPYLRPLYDALYDMMDPELIPKLM

SEQ ID NO: 784629 - protein, 24 aa, Mycobacterium
GTNIEQLLEAVLLTADAALDLRAN

SEQ ID NO: 784630 - protein, 17 aa, Mycobacterium
GTTYEKISQLKPVFRPN

SEQ ID NO: 784631 - protein, 18 aa, Mycobacterium
GTWDLVLARLLATADQAG

SEQ ID NO: 784632 - protein, 25 aa, Mycobacterium
GVACYPARFQLVLAANPCPCAPADP

SEQ ID NO: 784633 - protein, 27 aa, Mycobacterium
GVAPAIISLTLLPKLSPRAAARYYLTG

SEQ ID NO: 784634 - protein, 23 aa, Mycobacterium
GVARDRWVFPWSAATCNDVYFPV

SEQ ID NO: 784635 - protein, 19 aa, Mycobacterium
GVAWASLRVAWADDTRTFR

SEQ ID NO: 784636 - protein, 27 aa, Mycobacterium
GVDFTNIYFYTVLYHALRASNRIAIER

SEQ ID NO: 784637 - protein, 19 aa, Mycobacterium
GVDPALVDDVIWGCVMQAG

SEQ ID NO: 784638 - protein, 23 aa, Mycobacterium
GVEHTWLGFVDSGLPKGDPPPPL

SEQ ID NO: 784639 - protein, 22 aa, Mycobacterium
GVEQGFIRKSGSWFTYEGEQLG

SEQ ID NO: 784640 - protein, 25 aa, Mycobacterium
GVESAKLNFALGPFASMLDRARDLI

SEQ ID NO: 784641 - protein, 22 aa, Mycobacterium
GVGGTWHWNTYPGIAVDIPSFS

SEQ ID NO: 784642 - protein, 21 aa, Mycobacterium
GVGLGYWRRADLTGTRFVACP

SEQ ID NO: 784643 - protein, 21 aa, Mycobacterium
GVGLHPFGRFEKTAMQMGAEA

SEQ ID NO: 784644 - protein, 20 aa, Mycobacterium
GVHTLPLLYVGGTSVIMPSF

SEQ ID NO: 784645 - protein, 23 aa, Mycobacterium
GVIANNPLRLGGCLNSESAEKSA

SEQ ID NO: 784646 - protein, 29 aa, Mycobacterium
GVIGKILAQEDMPFLPDGTPVDIILNTHG

SEQ ID NO: 784647 - protein, 17 aa, Mycobacterium
GVKDAFLLIRRGDTQTA

SEQ ID NO: 784648 - protein, 24 aa, Mycobacterium
GVLQAPLISALGFAFAAATERGDD

SEQ ID NO: 784649 - protein, 17 aa, Mycobacterium
GVMFSLHVKATMMKVSH

SEQ ID NO: 784650 - protein, 23 aa, Mycobacterium
GVMFSLHVKATMMKVSHPIVFGH

SEQ ID NO: 784651 - protein, 32 aa, Mycobacterium
GVNRTLWSGMTWQYWKALRRLDPSEFEFLDQR

SEQ ID NO: 784652 - protein, 26 aa, Mycobacterium
GVQAYHALTYGWLLSGLARAVTGKGM

SEQ ID NO: 784653 - protein, 17 aa, Mycobacterium
GVQGITDLITTPGLINV

SEQ ID NO: 784654 - protein, 25 aa, Mycobacterium
GVRALRQRLGIHPVFKTVDTCAAEF

SEQ ID NO: 784655 - protein, 17 aa, Mycobacterium
GVRVFFPDPWPKARHHK

SEQ ID NO: 784656 - protein, 17 aa, Mycobacterium
GVSGLWLLSGMSDDGVL

SEQ ID NO: 784657 - protein, 26 aa, Mycobacterium
GVSRPTLYRWFASKEELLATFSRYER

SEQ ID NO: 784658 - protein, 26 aa, Mycobacterium
GVSRRHLEIRWDGQVALLSDLNSTNG

SEQ ID NO: 784659 - protein, 20 aa, Mycobacterium
GVVRPVVFLAYSGEARWRDS

SEQ ID NO: 784660 - protein, 19 aa, Mycobacterium
GWEIQRVCGEVFGLTVRSR

SEQ ID NO: 784661 - protein, 17 aa, Mycobacterium
GWKLEHMPAAMAARTRF

SEQ ID NO: 784662 - protein, 18 aa, Mycobacterium
GWLEGYLLTGRHGMFDCY

SEQ ID NO: 784663 - protein, 21 aa, Mycobacterium
GWLFCPADRPERFAKAAAAAD

SEQ ID NO: 784664 - protein, 22 aa, Mycobacterium
GYGGRTLIKDLSFTLPRNGIVG

SEQ ID NO: 784665 - protein, 19 aa, Mycobacterium
GYRSLREVVLPLTELTVIT

SEQ ID NO: 784666 - protein, 25 aa, Mycobacterium
GYVDATYWRDMGTPEDFVRGSADLV

SEQ ID NO: 784667 - protein, 24 aa, Mycobacterium
GYYQIRGGIPYAIAKSLAAAPFAD

SEQ ID NO: 784668 - protein, 17 aa, Mycobacterium
HAAITTDLIVGFPGETE

SEQ ID NO: 784669 - protein, 23 aa, Mycobacterium
HADAIDFHRWLQWQLDEQLAAAQ

SEQ ID NO: 784670 - protein, 19 aa, Mycobacterium
HALVIPDPFLPGVEPLDGS

SEQ ID NO: 784671 - protein, 20 aa, Mycobacterium
HAPWHIVPCNRKWYSRLAIT

SEQ ID NO: 784672 - protein, 22 aa, Mycobacterium
HASHGYVRYHDVRVPADHVLGG

SEQ ID NO: 784673 - protein, 23 aa, Mycobacterium
HASMMVDLCAMQRFAGPDEIAAP

SEQ ID NO: 784674 - protein, 33 aa, Mycobacterium
HASNLKCLCRFHHLLKTFWTGPRGWTDRQHPDG

SEQ ID NO: 784675 - protein, 17 aa, Mycobacterium
HASNLKVLCRQHHLLKT

SEQ ID NO: 784676 - protein, 18 aa, Mycobacterium
HASPLLVSVFLDKDFTFV

SEQ ID NO: 784677 - protein, 18 aa, Mycobacterium
HAVALQIAALKAKYLTRE

SEQ ID NO: 784678 - protein, 22 aa, Mycobacterium
HCGWPSFFDPANSDAVILRPDD

SEQ ID NO: 784679 - protein, 17 aa, Mycobacterium
HDPDLPPSHHYLAAYHW

SEQ ID NO: 784680 - protein, 17 aa, Mycobacterium
HDPDLPPSHHYLAAYRW

SEQ ID NO: 784681 - protein, 23 aa, Mycobacterium
HDVDRLSAFFDLVQQDPIVSQVK

SEQ ID NO: 784682 - protein, 38 aa, Mycobacterium
HEAFSAEPFIIIGRPPRFMDIAMFIAMDPPQHDLQRAS

SEQ ID NO: 784683 - protein, 24 aa, Mycobacterium
HEDPAAGGWTVPWNLACYCREHHR

SEQ ID NO: 784684 - protein, 23 aa, Mycobacterium
HEGVDWLLAQSEKPDLVFEATSA

SEQ ID NO: 784685 - protein, 26 aa, Mycobacterium
HELRAFCARLLGIAAQRVRVIMRDTG

SEQ ID NO: 784686 - protein, 37 aa, Mycobacterium
HEPLGVVGQIIPWNFPILMAVWKLAPALAAGNAVVLK

SEQ ID NO: 784687 - protein, 17 aa, Mycobacterium
HEQILPRAGWVEHNPVE

SEQ ID NO: 784688 - protein, 25 aa, Mycobacterium
HEVGLAILGPLRELDEVAYLRFASV

SEQ ID NO: 784689 - protein, 17 aa, Mycobacterium
HFAGLVAAGLHPSPVPH

SEQ ID NO: 784690 - protein, 26 aa, Mycobacterium
HFDTAIYAYRKGWLKKINVISSSMVF

SEQ ID NO: 784691 - protein, 27 aa, Mycobacterium
HFFVCSTHDWILFFTTQGRVYRAKAYE

SEQ ID NO: 784692 - protein, 17 aa, Mycobacterium
HFRFVECSRLVNGRPDG

SEQ ID NO: 784693 - protein, 26 aa, Mycobacterium
HGALAERALMPVLPSVEEFPYAIRQV

SEQ ID NO: 784694 - protein, 24 aa, Mycobacterium
HGLRLGVEAALRNLARVAPTQRHR

SEQ ID NO: 784695 - protein, 18 aa, Mycobacterium
HGNVFPNLSFLNAFIAKD

SEQ ID NO: 784696 - protein, 17 aa, Mycobacterium
HGPGCPVCVIPMGRIDD

SEQ ID NO: 784697 - protein, 22 aa, Mycobacterium
HGRGGFAGMLLGSVSTAVVHAV

SEQ ID NO: 784698 - protein, 26 aa, Mycobacterium
HHELGWFARQALRLFDDLRLEHGRLD

SEQ ID NO: 784699 - protein, 26 aa, Mycobacterium
HHELGWFARQALRLFDDLRLVHGRLD

SEQ ID NO: 784700 - protein, 17 aa, Mycobacterium
HHRSAITGKFVKGSTAA

SEQ ID NO: 784701 - protein, 23 aa, Mycobacterium
HICPSCSDLYARDTWQLVHAGAA

SEQ ID NO: 784702 - protein, 34 aa, Mycobacterium; identical to SEQ ID NO: 115115

SEQ ID NO: 784703 - protein, 25 aa, Mycobacterium
HIGPSDHVAWLDDRKWAYVRLEGRA

SEQ ID NO: 784704 - protein, 27 aa, Mycobacterium
HIKDAQTPTLLFPFAAPRVVGDLSEAG

SEQ ID NO: 784705 - protein, 19 aa, Mycobacterium
HIVLMLPTPYPDNVVRWGV

SEQ ID NO: 784706 - protein, 25 aa, Mycobacterium
HKNFGLPYAFGKYDQLFVPEFNAGA

SEQ ID NO: 784707 - protein, 23 aa, Mycobacterium
HKNWNPHDYIPWSDGKNFYALGG

SEQ ID NO: 784708 - protein, 26 aa, Mycobacterium
HKVKHRTFHYPGGLVDFVKHINRTKS

SEQ ID NO: 784709 - protein, 24 aa, Mycobacterium
HLKGHFATMRHAASYWRGLSKEGK

SEQ ID NO: 784710 - protein, 26 aa, Mycobacterium
HLKSVVYELLWFLRGDSNVAWLHEHG

SEQ ID NO: 784711 - protein, 17 aa, Mycobacterium
HLLAGLTQFHTALQNRF

SEQ ID NO: 784712 - protein, 19 aa, Mycobacterium
HLMPVWQGQGYNSGIRDAA

SEQ ID NO: 784713 - protein, 17 aa, Mycobacterium
HLPWLAHHGRWPVGEEW

SEQ ID NO: 784714 - protein, 17 aa, Mycobacterium
HLRRLLERATAAGTKVV

SEQ ID NO: 784715 - protein, 22 aa, Mycobacterium
HLTPTEWGMLEMLVRNRGKLVG

SEQ ID NO: 784716 - protein, 17 aa, Mycobacterium
HLVAGLIATGAIDIGIA

SEQ ID NO: 784717 - protein, 19 aa, Mycobacterium
HLVALVRAGAVFHKGRLLE

SEQ ID NO: 784718 - protein, 21 aa, Mycobacterium
HNIHRNLLSRVFTPRKVLALE

SEQ ID NO: 784719 - protein, 17 aa, Mycobacterium
HPDDIYWCTADPGWVTG

SEQ ID NO: 784720 - protein, 22 aa, Mycobacterium
HPDIDIRWRTVTFALVTHSEGG

SEQ ID NO: 784721 - protein, 19 aa, Mycobacterium
HPEIFKQYFGTVIPAGDNK

SEQ ID NO: 784722 - protein, 18 aa, Mycobacterium
HPGSFYALPQSPQLFKQL

SEQ ID NO: 784723 - protein, 25 aa, Mycobacterium
HPHSLQLIMDSLRYWVTEMHVDGFR

SEQ ID NO: 784724 - protein, 19 aa, Mycobacterium
HPLPESLVGDAARFLLEGL

SEQ ID NO: 784725 - protein, 18 aa, Mycobacterium
HPPFRWQRRYAEGFSDQV

SEQ ID NO: 784726 - protein, 18 aa, Mycobacterium
HPVHRYFLAAKEAEFALG

SEQ ID NO: 784727 - protein, 22 aa, Mycobacterium
HPVLLESYLDGPEVSLFCVVDG

SEQ ID NO: 784728 - protein, 23 aa, Mycobacterium
HQSLGMVAPAARFALAAGPDLSV

SEQ ID NO: 784729 - protein, 17 aa, Mycobacterium
HQVIVVTHLPQVAAYAD

SEQ ID NO: 784730 - protein, 28 aa, Mycobacterium
HRDGSDAMRWFLMASPILRGGNLIVTEQ

SEQ ID NO: 784731 - protein, 22 aa, Mycobacterium
HRHLRRYMNWIPAEYVDAMAPT

SEQ ID NO: 784732 - protein, 18 aa, Mycobacterium
HRKLGTELDLFSFPDEIG

SEQ ID NO: 784733 - protein, 23 aa, Mycobacterium
HRLDRIFLVAPSSTPQRLAMTVE

SEQ ID NO: 784734 - protein, 25 aa, Mycobacterium
HRTGKPHGWIHNELRRRCGGPPIAA

SEQ ID NO: 784735 - protein, 26 aa, Mycobacterium
HSEVDTLRRVELLRQLRLGDYDVLVG

SEQ ID NO: 784736 - protein, 28 aa, Mycobacterium
HSEVDTLRRVELLRQLRLGEYDVLVGIN

SEQ ID NO: 784737 - protein, 25 aa, Mycobacterium
HSLAFDFSVWEIFGALLRGARLVIV

SEQ ID NO: 784738 - protein, 17 aa, Mycobacterium
HSLTYAYRDRRARKGEF

SEQ ID NO: 784739 - protein, 18 aa, Mycobacterium
HSVKVIPGRGAWLEFDVD

SEQ ID NO: 784740 - protein, 23 aa, Mycobacterium
HTALMRSCTGWPSGVWIDEPRRT

SEQ ID NO: 784741 - protein, 30 aa, Mycobacterium
HTIEMERIFGRAWVFLGHESELAKSGDFVV

SEQ ID NO: 784742 - protein, 22 aa, Mycobacterium
HTNHRSLLMRLITPKRLKENED

SEQ ID NO: 784743 - protein, 21 aa, Mycobacterium
HVDAPSPHIDWSAGAVRLLTE

SEQ ID NO: 784744 - protein, 17 aa, Mycobacterium
HVDGRPMVLRRPPAHPR

SEQ ID NO: 784745 - protein, 21 aa, Mycobacterium
HVEVALKHPIKLIANALGSPP

SEQ ID NO: 784746 - protein, 18 aa, Mycobacterium
HVGWLDDRKWAYVRLEGR

SEQ ID NO: 784747 - protein, 19 aa, Mycobacterium
HVITINDYLARRDAEWMGP

SEQ ID NO: 784748 - protein, 18 aa, Mycobacterium
HVLRRQLQKANDLGFSCY

SEQ ID NO: 784749 - protein, 18 aa, Mycobacterium
HVLRRQLTKANELGFSCY

SEQ ID NO: 784750 - protein, 20 aa, Mycobacterium
HVNKLRGRNVPKLRQVIGCV

SEQ ID NO: 784751 - protein, 18 aa, Mycobacterium
HVRDVKFVAAFDVDAKKV

SEQ ID NO: 784752 - protein, 21 aa, Mycobacterium
HVRNLIRRFVEVGVPGYHIED

SEQ ID NO: 784753 - protein, 27 aa, Mycobacterium
HVTVANYEYLVYWRLYQDGNIECEVRA

SEQ ID NO: 784754 - protein, 20 aa, Mycobacterium
HVVTINDYLARRDAEWMGPL

SEQ ID NO: 784755 - protein, 25 aa, Mycobacterium
HYAGAFPAWLAPVQVVGIPVADEHV

SEQ ID NO: 784756 - protein, 17 aa, Mycobacterium
HYFHVRPADQFDAMIHI

SEQ ID NO: 784757 - protein, 24 aa, Mycobacterium
HYGGLFIRMSWHAAGTYRIHDGRG

SEQ ID NO: 784758 - protein, 19 aa, Mycobacterium
HYHKIHLYDAFGFTESRTV

SEQ ID NO: 784759 - protein, 21 aa, Mycobacterium
HYTRLAALDLCPRIRVNAIAP

SEQ ID NO: 784760 - protein, 20 aa, Mycobacterium
HYYDSLLAKVIAWAPTRDEA

SEQ ID NO: 784761 - protein, 18 aa, Mycobacterium
IAAIILESIPGTAGIMVP

SEQ ID NO: 784762 - protein, 18 aa, Mycobacterium
IAALPRIRRAHPGTTLTI

SEQ ID NO: 784763 - protein, 24 aa, Mycobacterium
IADLESREVLLAKLAGAMKGNLAK

SEQ ID NO: 784764 - protein, 23 aa, Mycobacterium
IAETIDWGRTVLALGLDTIDDAV

SEQ ID NO: 784765 - protein, 21 aa, Mycobacterium
IAGITYRQLDYWARTSLVVPS

SEQ ID NO: 784766 - protein, 26 aa, Mycobacterium
IAGLIADIWLANLMAFVGGRATAEQT

SEQ ID NO: 784767 - protein, 26 aa, Mycobacterium
IAIELDGLRLITWRGASRAEQGLPFA

SEQ ID NO: 784768 - protein, 20 aa, Mycobacterium
IAMNMGMDGAWGQWVNRWTA

SEQ ID NO: 784769 - protein, 19 aa, Mycobacterium
IAMPALRLDAAFVHLNLGD

SEQ ID NO: 784770 - protein, 23 aa, Mycobacterium
IARAYVNRPLVLLADEPTGNLDP

SEQ ID NO: 784771 - protein, 21 aa, Mycobacterium
IARNALLGAGFPESVPGVTID

SEQ ID NO: 784772 - protein, 22 aa, Mycobacterium
IARRVFATCRRLGLGTVAVYTD

SEQ ID NO: 784773 - protein, 18 aa, Mycobacterium
IARSFAAALGLQFTRVQF

SEQ ID NO: 784774 - protein, 20 aa, Mycobacterium
IAVQPDVLLMDEPCSALDPI

SEQ ID NO: 784775 - protein, 19 aa, Mycobacterium
ICEVLAWRGIWLSEERRRI

SEQ ID NO: 784776 - protein, 32 aa, Mycobacterium; identical to SEQ ID NO: 120650

SEQ ID NO: 784777 - protein, 28 aa, Mycobacterium
IDAAVPFIQTLLAGCPRLKILATSREFF

SEQ ID NO: 784778 - protein, 24 aa, Mycobacterium
IDASVHIFFPSNKALRKTLREPFK

SEQ ID NO: 784779 - protein, 19 aa, Mycobacterium
IDDMAWMRQLLDWQREAAD

SEQ ID NO: 784780 - protein, 26 aa, Mycobacterium
IDFIEACAWIKENLPGVHISGGISNV

SEQ ID NO: 784781 - protein, 18 aa, Mycobacterium
IDHFLVQADLTVVVPGPL

SEQ ID NO: 784782 - protein, 36 aa, Mycobacterium; identical to SEQ ID NO: 115249

SEQ ID NO: 784783 - protein, 28 aa, Mycobacterium
IDLELRYRGLRAPHKIKLGVSGCARECA

SEQ ID NO: 784784 - protein, 29 aa, Mycobacterium
IDMFGARVDQLPLIWKRLVDAGMESGHAY

SEQ ID NO: 784785 - protein, 25 aa, Mycobacterium
IDRAADVGGTWYWNRYPGIACDVES

SEQ ID NO: 784786 - protein, 17 aa, Mycobacterium
IDVLTQISAVNSALRSV

SEQ ID NO: 784787 - protein, 19 aa, Mycobacterium
IEAGRALVLAFNKWDLVDE

SEQ ID NO: 784788 - protein, 24 aa, Mycobacterium
IEAGRALVLAFNKWDLVDEDRREL

SEQ ID NO: 784789 - protein, 18 aa, Mycobacterium
IEEALELRLGLRGLTSYA

SEQ ID NO: 784790 - protein, 23 aa, Mycobacterium
IEGYNLNMAIPWTAAERGFIDAV

SEQ ID NO: 784791 - protein, 24 aa, Mycobacterium
IERATKILGLLTATSKSYAATIRL

SEQ ID NO: 784792 - protein, 18 aa, Mycobacterium
IERKLYPNVDFYTGLIYR

SEQ ID NO: 784793 - protein, 19 aa, Mycobacterium
IFIADYVLAGYGTGAIMAV

SEQ ID NO: 784794 - protein, 20 aa, Mycobacterium
IFLVNTPQCLMAEGLADLAL

SEQ ID NO: 784795 - protein, 17 aa, Mycobacterium
IFNTRGLETLFETGLRR

SEQ ID NO: 784796 - protein, 19 aa, Mycobacterium
IFQVLLNHPPLARAINDLL

SEQ ID NO: 784797 - protein, 22 aa, Mycobacterium
IGAALGPGWPRAVKSTLQMTFS

SEQ ID NO: 784798 - protein, 27 aa, Mycobacterium
IGADYTITIPQIPLTIGGGGILNIPIT

SEQ ID NO: 784799 - protein, 20 aa, Mycobacterium
IGAPHRWVMSANWKTAADNF

SEQ ID NO: 784800 - protein, 25 aa, Mycobacterium
IGDFNPLLRMASGVNWNFFGSFVFG

SEQ ID NO: 784801 - protein, 24 aa, Mycobacterium
IGEGDTLVLLESMKMEIPVLAEVA

SEQ ID NO: 784802 - protein, 26 aa, Mycobacterium
IGGVPVVMRALLDAGLLHGDCLTVTG

SEQ ID NO: 784803 - protein, 17 aa, Mycobacterium
IGLHIIVTCQMSQAYKA

SEQ ID NO: 784804 - protein, 18 aa, Mycobacterium
IGNVTHGALRSAWIGYWV

SEQ ID NO: 784805 - protein, 23 aa, Mycobacterium
IGRYAVLAAGWPETIPGTTVNRA

SEQ ID NO: 784806 - protein, 17 aa, Mycobacterium
IGYGVLFFASDASSYCS

SEQ ID NO: 784807 - protein, 18 aa, Mycobacterium
IHLVTLLEALPVQETLEA

SEQ ID NO: 784808 - protein, 29 aa, Mycobacterium
IHPWSSGRDLYFNLSLWSAYDVMLMHTVL

SEQ ID NO: 784809 - protein, 19 aa, Mycobacterium
IIDNCDYLMFTGSTATGRQ

SEQ ID NO: 784810 - protein, 24 aa, Mycobacterium
IIDSALDGVLFLDEAYALVSTGAK

SEQ ID NO: 784811 - protein, 18 aa, Mycobacterium
IIGMRFDTTELGDVWTEI

SEQ ID NO: 784812 - protein, 24 aa, Mycobacterium
IIGQGSIGLLFSYVAKAAGARRVT

SEQ ID NO: 784813 - protein, 26 aa, Mycobacterium
IIVQRERDRMAFRSASYWDIVAQLDA

SEQ ID NO: 784814 - protein, 28 aa, Mycobacterium
IKELCRRWYPRIYFGQPEKGLAHRALAD

SEQ ID NO: 784815 - protein, 24 aa, Mycobacterium
IKPGNNLPLRNIPAGTLVHAVELR

SEQ ID NO: 784816 - protein, 23 aa, Mycobacterium
IKPGNNLPLRNIPAGTVIHAVEL

SEQ ID NO: 784817 - protein, 19 aa, Mycobacterium
IKPPYVAAYVLLDGADIPF

SEQ ID NO: 784818 - protein, 19 aa, Mycobacterium
IKQVKYRYLRALDTKHWDD

SEQ ID NO: 784819 - protein, 20 aa, Mycobacterium
ILAAVKRLYLLGKNDRPTGT

SEQ ID NO: 784820 - protein, 17 aa, Mycobacterium
ILDAARRLIAERGPDAV

SEQ ID NO: 784821 - protein, 25 aa, Mycobacterium
ILDVLDNYAFVRTSGYLAGPNDVYV

SEQ ID NO: 784822 - protein, 18 aa, Mycobacterium
ILEEVWGFDFPTSGNALE

SEQ ID NO: 784823 - protein, 18 aa, Mycobacterium
ILGLDIKGHVVKKLLVAE

SEQ ID NO: 784824 - protein, 19 aa, Mycobacterium
ILIPARWVGYPPYHDRRYD

SEQ ID NO: 784825 - protein, 19 aa, Mycobacterium
ILRNFKMPGFTVPEFRRKA

SEQ ID NO: 784826 - protein, 31 aa, Mycobacterium
ILRTEKSVLFVIPWGTHWIIGTTDTDWNLDL

SEQ ID NO: 784827 - protein, 18 aa, Mycobacterium
INEAFASVVLSWARVHEP

SEQ ID NO: 784828 - protein, 18 aa, Mycobacterium
INEALRMMTPLPFNFRQA

SEQ ID NO: 784829 - protein, 17 aa, Mycobacterium
INFTNICYTGCRFCAFA

SEQ ID NO: 784830 - protein, 20 aa, Mycobacterium
INFTNICYTGCRFCAFAQRK

SEQ ID NO: 784831 - protein, 18 aa, Mycobacterium
INMEFVQFHPTGMVWPPS

SEQ ID NO: 784832 - protein, 18 aa, Mycobacterium
INSGFGWHEARVPTIVTS

SEQ ID NO: 784833 - protein, 18 aa, Mycobacterium
IPAACNGLVGLKLSRGLS

SEQ ID NO: 784834 - protein, 18 aa, Mycobacterium
IPAGVFNVVVSNANEVGA

SEQ ID NO: 784835 - protein, 27 aa, Mycobacterium
IPAVNKLGTMGLILRGSDELKKQVLPS

SEQ ID NO: 784836 - protein, 26 aa, Mycobacterium
IPEIAHAWLFDHLIPIAGDVTGPVLE

SEQ ID NO: 784837 - protein, 29 aa, Mycobacterium
IPELYITMLGALRNGSVVSPLFSAFGPEP

SEQ ID NO: 784838 - protein, 18 aa, Mycobacterium
IPNIRYLPALGKVVFRRD

SEQ ID NO: 784839 - protein, 23 aa, Mycobacterium
IPTECEFFSLRGLALLTDTVDKV

SEQ ID NO: 784840 - protein, 19 aa, Mycobacterium
IQRHTLLHEDLKRFFDGFP

SEQ ID NO: 784841 - protein, 32 aa, Mycobacterium
IQTAILYDHFTPYTLLQLEELGFCGKGEAKDF

SEQ ID NO: 784842 - protein, 32 aa, Mycobacterium
IQTAVLYDHFTPFTLIQLEELGFCGRGEAKDF

SEQ ID NO: 784843 - protein, 25 aa, Mycobacterium
IQVMRDMLAAPDQFDWLATRLEIAR

SEQ ID NO: 784844 - protein, 24 aa, Mycobacterium
IRANIRTLLQMAVVLTYGASMPVV

SEQ ID NO: 784845 - protein, 17 aa, Mycobacterium
IRDVGIPGYLRATTGLA

SEQ ID NO: 784846 - protein, 20 aa, Mycobacterium
IRERFGGRIRFFVSAAAALD

SEQ ID NO: 784847 - protein, 20 aa, Mycobacterium
IRETLDLLTRVFPARTCSAG

SEQ ID NO: 784848 - protein, 19 aa, Mycobacterium
IRGEECSAYWPAGTAAWHI

SEQ ID NO: 784849 - protein, 19 aa, Mycobacterium
IRGQECSAYWPAGTAAWHI

SEQ ID NO: 784850 - protein, 19 aa, Mycobacterium
IRHFRPIAPDKTEVTIYCI

SEQ ID NO: 784851 - protein, 17 aa, Mycobacterium
IRIPVHMVEVINKLGRI

SEQ ID NO: 784852 - protein, 20 aa, Mycobacterium
IRLKLNPLKEVIRGKRLIVV

SEQ ID NO: 784853 - protein, 18 aa, Mycobacterium
IRLRLFHGRGGTVGRGGG

SEQ ID NO: 784854 - protein, 19 aa, Mycobacterium
IRRYGQLEERFVALGGYGA

SEQ ID NO: 784855 - protein, 19 aa, Mycobacterium
IRSLAISQRLLGTREIILI

SEQ ID NO: 784856 - protein, 23 aa, Mycobacterium
ISGIDVLAGLRGWLTAPVIVLSA

SEQ ID NO: 784857 - protein, 30 aa, Mycobacterium
ISTDLLYKLLRSDWLEPRWMVGIDPESEGL

SEQ ID NO: 784858 - protein, 22 aa, Mycobacterium
ISVGCNNTCTFCIVPSLRGKEI

SEQ ID NO: 784859 - protein, 23 aa, Mycobacterium
ISVKLIQPVAMDDGLRFAIREGG

SEQ ID NO: 784860 - protein, 32 aa, Mycobacterium
ITADDRYLCINPFFHNFGYKAGILACLQTGAT

SEQ ID NO: 784861 - protein, 22 aa, Mycobacterium
ITDITPYWRPASWAAGVVVVDA

SEQ ID NO: 784862 - protein, 27 aa, Mycobacterium
ITGAKTWISNARRSGLIALLCKTDPHA

SEQ ID NO: 784863 - protein, 18 aa, Mycobacterium
ITGIHRYLRTLVDVGLGY

SEQ ID NO: 784864 - protein, 25 aa, Mycobacterium
ITLSRTHPNLVRKLFSLEVPEIADG

SEQ ID NO: 784865 - protein, 30 aa, Mycobacterium; identical to SEQ ID NO: 115434

SEQ ID NO: 784866 - protein, 18 aa, Mycobacterium
ITPRVVFMEASDDMLVRR

SEQ ID NO: 784867 - protein, 24 aa, Mycobacterium
ITSMPGIGFRLGAEFLAAVGDPAL

SEQ ID NO: 784868 - protein, 25 aa, Mycobacterium
IVQRERDRMAFRSASYWDIVATLDA

SEQ ID NO: 784869 - protein, 17 aa, Mycobacterium
IVRHFFVCSTHDWILFF

SEQ ID NO: 784870 - protein, 24 aa, Mycobacterium
IVSPPVMLQTWTMPSPILEGIGER

SEQ ID NO: 784871 - protein, 20 aa, Mycobacterium
IVTELFKPLPSMVVAHYLGV

SEQ ID NO: 784872 - protein, 18 aa, Mycobacterium
IWATWPTSEDSERPLLMW

SEQ ID NO: 784873 - protein, 17 aa, Mycobacterium
IYLKLVFQGDQLPGYGW

SEQ ID NO: 784874 - protein, 22 aa, Mycobacterium
IYRDVRLLRLYEGTSEIQRLII

SEQ ID NO: 784875 - protein, 30 aa, Mycobacterium; identical to SEQ ID NO: 115465

SEQ ID NO: 784876 - protein, 34 aa, Mycobacterium; identical to SEQ ID NO: 128131

SEQ ID NO: 784877 - protein, 17 aa, Mycobacterium
KAAGLRSLLAYQWAHPG

SEQ ID NO: 784878 - protein, 18 aa, Mycobacterium
KAAKPGEPSWPTPWGRGR

SEQ ID NO: 784879 - protein, 17 aa, Mycobacterium
KAARFVRTCDCFNIPIV

SEQ ID NO: 784880 - protein, 28 aa, Mycobacterium
KADSIVIGGGMCFTFLAAQGFSVGKSLL

SEQ ID NO: 784881 - protein, 21 aa, Mycobacterium
KAGDLALLIGYGAGLSYAAQV

SEQ ID NO: 784882 - protein, 27 aa, Mycobacterium
KAHQDAFIFGPPPLGPGAPPLDRLLAY

SEQ ID NO: 784883 - protein, 20 aa, Mycobacterium
KALGLRPRARIVSQALVGAE

SEQ ID NO: 784884 - protein, 20 aa, Mycobacterium
KAPFVVFDDADLDAAIQGAV

SEQ ID NO: 784885 - protein, 23 aa, Mycobacterium
KATGQALWQVQLIALDATGGEVL

SEQ ID NO: 784886 - protein, 23 aa, Mycobacterium
KDADGYFWFVGRKDDVIKSAGHL

SEQ ID NO: 784887 - protein, 25 aa, Mycobacterium
KDAEVWDRLTGNFWLPEKVPVSNDI

SEQ ID NO: 784888 - protein, 25 aa, Mycobacterium
KDAEVWDRLTGNFWLPEKVPVSNDL

SEQ ID NO: 784889 - protein, 20 aa, Mycobacterium
KDAFLLIRRGDTQTAVHLSD

SEQ ID NO: 784890 - protein, 18 aa, Mycobacterium
KDLRRNFVPAPDTARAVL

SEQ ID NO: 784891 - protein, 24 aa, Mycobacterium
KDLTYWTELAKLLERGRFDGLFIA

SEQ ID NO: 784892 - protein, 24 aa, Mycobacterium
KDRDAVLRKAPWVDVVFGTHNIGS

SEQ ID NO: 784893 - protein, 27 aa, Mycobacterium
KDVLQGQCTFSWPPRMDLPGYKPNTKP

SEQ ID NO: 784894 - protein, 29 aa, Mycobacterium
KEIQSRLGFLLDVGLDYLSLSRAAATLSG

SEQ ID NO: 784895 - protein, 28 aa, Mycobacterium
KELCRRWYPRIYFGQPPKGLAHRALADI

SEQ ID NO: 784896 - protein, 18 aa, Mycobacterium
KELFAKHNVPTTPGRVTD

SEQ ID NO: 784897 - protein, 28 aa, Mycobacterium
KELGAMGFKFQFITLAGFHALNYSMFDL

SEQ ID NO: 784898 - protein, 26 aa, Mycobacterium
KEWAQLLMVAVRVASLPGLLSTTTVF

SEQ ID NO: 784899 - protein, 18 aa, Mycobacterium
KFDLFINLVDLPSPTKDP

SEQ ID NO: 784900 - protein, 24 aa, Mycobacterium
KFFEPGYQRFFVERFPGIVERIDT

SEQ ID NO: 784901 - protein, 19 aa, Mycobacterium
KGFDPDLVDLLIGRGVAAG

SEQ ID NO: 784902 - protein, 18 aa, Mycobacterium
KGFKSFASPTTLRFEPGI

SEQ ID NO: 784903 - protein, 21 aa, Mycobacterium
KGFSLYAIRTILAGRSDELLD

SEQ ID NO: 784904 - protein, 18 aa, Mycobacterium
KGIRYEGEQIRRKVGKTG

SEQ ID NO: 784905 - protein, 18 aa, Mycobacterium
KGNRHFSFGLGVHRCIGS

SEQ ID NO: 784906 - protein, 24 aa, Mycobacterium
KGPKIRIHKFRNKTGYHKRQGHRQ

SEQ ID NO: 784907 - protein, 18 aa, Mycobacterium
KGQQVAWMREVDGLPVIT

SEQ ID NO: 784908 - protein, 31 aa, Mycobacterium
KGRATREAMFARIPLRRFAEPEDFVGALIYL

SEQ ID NO: 784909 - protein, 20 aa, Mycobacterium
KGTLRDTSAFDLAHHVVSEA

SEQ ID NO: 784910 - protein, 17 aa, Mycobacterium
KGVPVPHAPIAEYFVWF

SEQ ID NO: 784911 - protein, 28 aa, Mycobacterium
KHIAGVDTFFVATAPRYSFVSSSLAKEV

SEQ ID NO: 784912 - protein, 23 aa, Mycobacterium
KIAQAWETLMLRLGYQRYGAQGG

SEQ ID NO: 784913 - protein, 20 aa, Mycobacterium
KIGADFYFSVRTMEERLGAN

SEQ ID NO: 784914 - protein, 27 aa, Mycobacterium
KIGYPPTRVWGVPAAGLWAHRLGDQRA

SEQ ID NO: 784915 - protein, 18 aa, Mycobacterium
KIVPAPVTFVDIAGIVKG

SEQ ID NO: 784916 - protein, 19 aa, Mycobacterium
KIYVRFPEAVSMRQYLGEP

SEQ ID NO: 784917 - protein, 24 aa, Mycobacterium
KKLGLERQWLHARSLAFAHPADGR

SEQ ID NO: 784918 - protein, 20 aa, Mycobacterium
KKSFGHHPLLAFLDRPEIAG

SEQ ID NO: 784919 - protein, 18 aa, Mycobacterium
KLFHVGRLDADTEGLLLL

SEQ ID NO: 784920 - protein, 19 aa, Mycobacterium
KLKVLVSIFGRETPVELTF

SEQ ID NO: 784921 - protein, 19 aa, Mycobacterium
KLLAAEGLLALAWPKEHGG

SEQ ID NO: 784922 - protein, 18 aa, Mycobacterium
KLLELENEVLRRAAAYLS

SEQ ID NO: 784923 - protein, 21 aa, Mycobacterium
KLSTKFTRLTGRSPILLAGMT

SEQ ID NO: 784924 - protein, 18 aa, Mycobacterium
KMCLSGIDAIALADQLIR

SEQ ID NO: 784925 - protein, 36 aa, Mycobacterium; identical to SEQ ID NO: 115558

SEQ ID NO: 784926 - protein, 20 aa, Mycobacterium
KMVRKRMRALKYSKQMVDDV

SEQ ID NO: 784927 - protein, 35 aa, Mycobacterium
KNAYVGRTFIQPSQTIRQLGIRLKLNPLKEVIRGK

SEQ ID NO: 784928 - protein, 43 aa, Mycobacterium; identical to SEQ ID NO: 115559

SEQ ID NO: 784929 - protein, 25 aa, Mycobacterium
KPAYIAGDIAYYLDKRQRGFDLCIY

SEQ ID NO: 784930 - protein, 17 aa, Mycobacterium
KPDLVIMDVKMPRRDGI

SEQ ID NO: 784931 - protein, 18 aa, Mycobacterium
KPEGVAWASLRVAWADDT

SEQ ID NO: 784932 - protein, 26 aa, Mycobacterium
KPEKLAKFRDAEGLTFPLLSDPDRKV

SEQ ID NO: 784933 - protein, 24 aa, Mycobacterium
KPERLRSGWLNGIKHWQVDYHTDG

SEQ ID NO: 784934 - protein, 20 aa, Mycobacterium
KPGDLALLIGYGAGLSYAAQ

SEQ ID NO: 784935 - protein, 26 aa, Mycobacterium
KPGEPSWPTPWGRGRPGWHLECSAMA

SEQ ID NO: 784936 - protein, 25 aa, Mycobacterium
KPGEPSWPTPWGRGRPGWHTECVAM

SEQ ID NO: 784937 - protein, 18 aa, Mycobacterium
KPGTYGAGLLQLIDSRNW

SEQ ID NO: 784938 - protein, 18 aa, Mycobacterium
KPPYVAAYVLLDGADIPF

SEQ ID NO: 784939 - protein, 26 aa, Mycobacterium
KPSLAWAETYPGTLSYYLASAFGEVW

SEQ ID NO: 784940 - protein, 17 aa, Mycobacterium
KPVKGMLTGPVTILAWS

SEQ ID NO: 784941 - protein, 18 aa, Mycobacterium
KQAEFDILYGRGISREGS

SEQ ID NO: 784942 - protein, 18 aa, Mycobacterium
KQQWLPGIASGETIMAFA

SEQ ID NO: 784943 - protein, 25 aa, Mycobacterium
KRGKAIIILNPADPPMIMRDTIFCA

SEQ ID NO: 784944 - protein, 24 aa, Mycobacterium
KRLGLERQWLHARSLSFAHPADGR

SEQ ID NO: 784945 - protein, 17 aa, Mycobacterium
KRVALVFSAYPTKHARI

SEQ ID NO: 784946 - protein, 35 aa, Mycobacterium; identical to SEQ ID NO: 115592

SEQ ID NO: 784947 - protein, 25 aa, Mycobacterium
KSQTYPLFQHPGTEFIYMLEGVMDY

SEQ ID NO: 784948 - protein, 24 aa, Mycobacterium
KSRKTPFFMYREDGEPLFMAGLWS

SEQ ID NO: 784949 - protein, 20 aa, Mycobacterium
KSTLLRLLSGIYEPTRGWAQ

SEQ ID NO: 784950 - protein, 22 aa, Mycobacterium
KSVWFQRGPLDEAIRASIAIPG

SEQ ID NO: 784951 - protein, 30 aa, Mycobacterium
KTDVLAFTAFPRAHWQKIWSNNPIERLNKE

SEQ ID NO: 784952 - protein, 22 aa, Mycobacterium
KTELIDRQPLYPGATELALGTA

SEQ ID NO: 784953 - protein, 24 aa, Mycobacterium
KTGHPFLQHLLAHRDATRLKVTVD

SEQ ID NO: 784954 - protein, 34 aa, Mycobacterium
KTLDLSYMESVIWAFKQLWDKGLAYEGYRVLPYC

SEQ ID NO: 784955 - protein, 22 aa, Mycobacterium
KTQKEFLLRQQLAAIRKELGEG

SEQ ID NO: 784956 - protein, 17 aa, Mycobacterium
KTRALAGWNPTWLKLVC

SEQ ID NO: 784957 - protein, 24 aa, Mycobacterium
KTSAAYMLGLLLQSESVAVSDLGA

SEQ ID NO: 784958 - protein, 24 aa, Mycobacterium
KTTTTERILYYTGVNYKIGETHDG

SEQ ID NO: 784959 - protein, 22 aa, Mycobacterium
KTVMHRLLRQYRLELPRPGYTP

SEQ ID NO: 784960 - protein, 24 aa, Mycobacterium
KVAIARDYLLPRQRDRAALTEDEV

SEQ ID NO: 784961 - protein, 17 aa, Mycobacterium
KVDIWGRRRLAYEIAKH

SEQ ID NO: 784962 - protein, 20 aa, Mycobacterium
KVPIYPGYVCAIVGSLVLGK

SEQ ID NO: 784963 - protein, 25 aa, Mycobacterium
KVSEDQLFYLMSRGLTEDEAMAMVV

SEQ ID NO: 784964 - protein, 25 aa, Mycobacterium
KVTKRGGGAALPYKRRLFGQIVAAA

SEQ ID NO: 784965 - protein, 19 aa, Mycobacterium
KVVAFSIPRDDWVPFTGVP

SEQ ID NO: 784966 - protein, 24 aa, Mycobacterium
KVVSWYDNEWGYSNRLVDLVGLVG

SEQ ID NO: 784967 - protein, 17 aa, Mycobacterium
KVYAPFESGLPGPTGRV

SEQ ID NO: 784968 - protein, 17 aa, Mycobacterium
KVYAPFESGLPSPTGRV

SEQ ID NO: 784969 - protein, 18 aa, Mycobacterium
KWELEDLSFAILHPKKYE

SEQ ID NO: 784970 - protein, 22 aa, Mycobacterium
KWREIFGADNYFLELMDHGLSI

SEQ ID NO: 784971 - protein, 26 aa, Mycobacterium
KYGLAALQLYLGVVGYPFLPVGDHVV

SEQ ID NO: 784972 - protein, 19 aa, Mycobacterium
KYRDTVRDYWRGEPATLGE

SEQ ID NO: 784973 - protein, 20 aa, Mycobacterium
LAAADYVLAVLKAGPDEVDG

SEQ ID NO: 784974 - protein, 23 aa, Mycobacterium
LAAADYVLAVLKAGPDEVDGLVE

SEQ ID NO: 784975 - protein, 24 aa, Mycobacterium
LAAGHLTLVPALRDALAEVGRPDI

SEQ ID NO: 784976 - protein, 25 aa, Mycobacterium
LAAGHLTLVPALRDALAKVGRPDIM

SEQ ID NO: 784977 - protein, 20 aa, Mycobacterium
LAAGLDAPFSCREGHCGACA

SEQ ID NO: 784978 - protein, 17 aa, Mycobacterium
LAALRRAVPATKGNTRR

SEQ ID NO: 784979 - protein, 28 aa, Mycobacterium
LAAPSAVPPAPPYYPVRTAAAQIAEPDQ

SEQ ID NO: 784980 - protein, 28 aa, Mycobacterium
LADVYWGDLDVLLLDLPPGTGDIAISVA

SEQ ID NO: 784981 - protein, 25 aa, Mycobacterium
LAELQLRILWEELLPRFENIEVVGE

SEQ ID NO: 784982 - protein, 28 aa, Mycobacterium
LAERNAFRTRWLADVPLLMVRDGDDRIR

SEQ ID NO: 784983 - protein, 17 aa, Mycobacterium
LAFLAVNSTYRGPYTPG

SEQ ID NO: 784984 - protein, 26 aa, Mycobacterium
LAGKLAAWLRGQGHTPLLVACDLQRP

SEQ ID NO: 784985 - protein, 18 aa, Mycobacterium
LAGWVARRRDHGGVIFID

SEQ ID NO: 784986 - protein, 34 aa, Mycobacterium; identical to SEQ ID NO: 115664

SEQ ID NO: 784987 - protein, 24 aa, Mycobacterium
LAKRDSEWMGRVHRFLGLDVGVIL

SEQ ID NO: 784988 - protein, 20 aa, Mycobacterium
LAKSNILMLGPTGCGKTYLA

SEQ ID NO: 784989 - protein, 17 aa, Mycobacterium
LALFVSGDNLRKGAALN

SEQ ID NO: 784990 - protein, 28 aa, Mycobacterium
LALLEVRDLLFARLLQYRAFKHVAEMFA

SEQ ID NO: 784991 - protein, 25 aa, Mycobacterium
LAMDPQQRMFLELSWEALERAGIEP

SEQ ID NO: 784992 - protein, 18 aa, Mycobacterium
LANWLRHGVITEEDVRAS

SEQ ID NO: 784993 - protein, 20 aa, Mycobacterium
LAPKDLEKIIYFAAYVITSV

SEQ ID NO: 784994 - protein, 20 aa, Mycobacterium
LAQITANYLVGLALAQARGT

SEQ ID NO: 784995 - protein, 18 aa, Mycobacterium
LAQLGAELNRRIVAAHQM

SEQ ID NO: 784996 - protein, 22 aa, Mycobacterium
LAQLMSQITRYAPESVFPAIEG

SEQ ID NO: 784997 - protein, 30 aa, Mycobacterium; identical to SEQ ID NO: 120946

SEQ ID NO: 784998 - protein, 19 aa, Mycobacterium
LAREGGLQSVLWAGPERPS

SEQ ID NO: 784999 - protein, 22 aa, Mycobacterium
LARRRTNVLYALIRDNRTWQPD

SEQ ID NO: 785000 - protein, 19 aa, Mycobacterium
LASADVFLTNWLPGALERA

SEQ ID NO: 785001 - protein, 26 aa, Mycobacterium
LASGLDARAYRLAWPAGTVVYEVDQP

SEQ ID NO: 785002 - protein, 19 aa, Mycobacterium
LASLGVFEEAFRRAQEAIE

SEQ ID NO: 785003 - protein, 19 aa, Mycobacterium
LASTTYYFSSLDDLIARAV

SEQ ID NO: 785004 - protein, 35 aa, Mycobacterium; identical to SEQ ID NO: 120958

SEQ ID NO: 785005 - protein, 17 aa, Mycobacterium
LAVRLDVSRLVVVGTGR

SEQ ID NO: 785006 - protein, 19 aa, Mycobacterium
LAWPTAQIAVMGASGAVGF

SEQ ID NO: 785007 - protein, 25 aa, Mycobacterium
LCPQNLDYLIAFFGALYAGRIAVPL

SEQ ID NO: 785008 - protein, 26 aa, Mycobacterium
LCRQYDPLMSPLVWDLAHIGQQEELW

SEQ ID NO: 785009 - protein, 19 aa, Mycobacterium
LCRRRIYHSFNPQGVNIIA

SEQ ID NO: 785010 - protein, 21 aa, Mycobacterium
LDAALGWQRDGAEWIHLVDLD

SEQ ID NO: 785011 - protein, 26 aa, Mycobacterium
LDAARMEVWSWFFVERNAPEEFKQQS

SEQ ID NO: 785012 - protein, 28 aa, Mycobacterium
LDAVPHPKWWFDLLTTEPLAFASLDRWP

SEQ ID NO: 785013 - protein, 28 aa, Mycobacterium
LDDVLRRAVRLLAQLTRQVAVVQYPTLS

SEQ ID NO: 785014 - protein, 25 aa, Mycobacterium
LDEAWWFPAICWPDGRLQFMLNERM

SEQ ID NO: 785015 - protein, 25 aa, Mycobacterium
LDGGPMRDLLRRMQPTEFNDIVAVL

SEQ ID NO: 785016 - protein, 25 aa, Mycobacterium
LDGVRIFEQLAIADPVTAAFLSIHN

SEQ ID NO: 785017 - protein, 20 aa, Mycobacterium
LDGWLNNQQIIRKSRDKSMI

SEQ ID NO: 785018 - protein, 22 aa, Mycobacterium
LDGYGLHIIERVPLPVRANAEN

SEQ ID NO: 785019 - protein, 17 aa, Mycobacterium
LDIALFSAGATMSRVQA

SEQ ID NO: 785020 - protein, 19 aa, Mycobacterium
LDIGAPPQFMDFRYTVHDR

SEQ ID NO: 785021 - protein, 19 aa, Mycobacterium
LDLTGCMALGITGPILRAT

SEQ ID NO: 785022 - protein, 27 aa, Mycobacterium
LDPDTAFLELCPFAAWGSKFPVGGSVV

SEQ ID NO: 785023 - protein, 25 aa, Mycobacterium
LDPYLEILPHFDTLLVMSVEPGFGG

SEQ ID NO: 785024 - protein, 17 aa, Mycobacterium
LDRGVPVCVVPFARDQA

SEQ ID NO: 785025 - protein, 26 aa, Mycobacterium
LDRVPPAVLFGGGVLPAYALAEIINN

SEQ ID NO: 785026 - protein, 19 aa, Mycobacterium
LDSTRGRPFGLYLHGNEGT

SEQ ID NO: 785027 - protein, 29 aa, Mycobacterium
LDTLVNCVGIFDFYRRIQDIPAERIDQAF

SEQ ID NO: 785028 - protein, 29 aa, Mycobacterium
LDTRRLIDRAGRWLLNYRPQPLAVGAEIN

SEQ ID NO: 785029 - protein, 28 aa, Mycobacterium
LEALPERERTVLVLRFFESMTQTQIAER

SEQ ID NO: 785030 - protein, 19 aa, Mycobacterium
LEGWRRFIDADRPEFTLLP

SEQ ID NO: 785031 - protein, 18 aa, Mycobacterium
LEGWRRFVDADPPEFTLL

SEQ ID NO: 785032 - protein, 19 aa, Mycobacterium
LEKIIYFAAYVITSVDDEM

SEQ ID NO: 785033 - protein, 25 aa, Mycobacterium
LELDVSLLSTAWWAAGASVTQGMET

SEQ ID NO: 785034 - protein, 20 aa, Mycobacterium
LEMGIRVRYLHSEVDTLRRV

SEQ ID NO: 785035 - protein, 26 aa, Mycobacterium
LENYHRLTMPSTWLEALVKTYVGDAL

SEQ ID NO: 785036 - protein, 20 aa, Mycobacterium
LERMRSAPTVFIDAAHNPAG

SEQ ID NO: 785037 - protein, 40 aa, Mycobacterium; identical to SEQ ID NO: 115765

SEQ ID NO: 785038 - protein, 25 aa, Mycobacterium
LESVLTVLSLRDGVIPPTLNYETPD

SEQ ID NO: 785039 - protein, 25 aa, Mycobacterium
LFEDRGRRWPVIISGTITDASGRTL

SEQ ID NO: 785040 - protein, 27 aa, Mycobacterium
LFETGLRRWMGLRGRLVQLGPFKMSAS

SEQ ID NO: 785041 - protein, 28 aa, Mycobacterium
LFGGYGYMMEYPIARLYTDARVARIYAG

SEQ ID NO: 785042 - protein, 34 aa, Mycobacterium
LFGHPSFRYHGWGPRMWTWVQMMGLRKFQEMVFT

SEQ ID NO: 785043 - protein, 18 aa, Mycobacterium
LGAPEMRPYIAEMSRIAD

SEQ ID NO: 785044 - protein, 23 aa, Mycobacterium
LGCELRHAHRLVYSEGLDLSGDP

SEQ ID NO: 785045 - protein, 18 aa, Mycobacterium
LGDMRWYLDLMMKKSPAG

SEQ ID NO: 785046 - protein, 32 aa, Mycobacterium
LGELLMVNTWNFNDFNRRPWPTSELRSTSGPV

SEQ ID NO: 785047 - protein, 18 aa, Mycobacterium
LGFPLSYQSLTRNIRARN

SEQ ID NO: 785048 - protein, 19 aa, Mycobacterium
LGGPRLKDVAGLSLTKLFV

SEQ ID NO: 785049 - protein, 24 aa, Mycobacterium
LGHFALTNLLLPKLTDRVVTVSSM

SEQ ID NO: 785050 - protein, 22 aa, Mycobacterium
LGIGVGWCREEFALMGERFEAR

SEQ ID NO: 785051 - protein, 20 aa, Mycobacterium
LGKYDIGIAIGLDKHPRGAF

SEQ ID NO: 785052 - protein, 18 aa, Mycobacterium
LGLATFYNALAQEKVLSR

SEQ ID NO: 785053 - protein, 17 aa, Mycobacterium
LGLIRAMEKFDYTKGFK

SEQ ID NO: 785054 - protein, 30 aa, Mycobacterium
LGLPEEIVARQPFPGPGLGIRIVGEVTAER

SEQ ID NO: 785055 - protein, 25 aa, Mycobacterium
LGLSTYKMVFGHRGINIPVIDHATG

SEQ ID NO: 785056 - protein, 18 aa, Mycobacterium
LGNPTWYARFAAQAMTDP

SEQ ID NO: 785057 - protein, 28 aa, Mycobacterium
LGPLRSFDLAKWQKVIDVNLTGTFLGMR

SEQ ID NO: 785058 - protein, 22 aa, Mycobacterium
LGRAEIRAIFRSSKVGNIAGCL

SEQ ID NO: 785059 - protein, 24 aa, Mycobacterium
LGRRVTEIALVFKRAPHLPFDATM

SEQ ID NO: 785060 - protein, 24 aa, Mycobacterium
LGSLHMFFHRLGPVLARRLLLTGD

SEQ ID NO: 785061 - protein, 22 aa, Mycobacterium
LGSSMYSARLAAAKGLPYVFAH

SEQ ID NO: 785062 - protein, 23 aa, Mycobacterium
LGVDPPRGVLLYGPPGCGKTFVV

SEQ ID NO: 785063 - protein, 23 aa, Mycobacterium
LGVEPPRGVLLYGPPGCGKTFVV

SEQ ID NO: 785064 - protein, 29 aa, Mycobacterium
LGVLRPRGRLMVVAIWEAPAGIDINRSVM

SEQ ID NO: 785065 - protein, 17 aa, Mycobacterium
LGVRHRIDYEGQAAIEL

SEQ ID NO: 785066 - protein, 34 aa, Mycobacterium
LGVVAPVTMTPLWGLPPYWAPGQPSPYLVDGQEM

SEQ ID NO: 785067 - protein, 19 aa, Mycobacterium
LGVYPPEAIGPIGVQRRNG

SEQ ID NO: 785068 - protein, 18 aa, Mycobacterium
LGYADLAFMSSTARLKCP

SEQ ID NO: 785069 - protein, 32 aa, Mycobacterium; identical to SEQ ID NO: 115824

SEQ ID NO: 785070 - protein, 25 aa, Mycobacterium
LHEAKLAMHDLAGRGWTLAGVTSDT

SEQ ID NO: 785071 - protein, 27 aa, Mycobacterium
LHEVRIMLDQYWPSVPHVLIEPGVRTG

SEQ ID NO: 785072 - protein, 28 aa, Mycobacterium
LHILEVQRLIRFMPKVVICLVNGWAAGG

SEQ ID NO: 785073 - protein, 18 aa, Mycobacterium
LHMASLAGAWTALVAGFG

SEQ ID NO: 785074 - protein, 19 aa, Mycobacterium
LHNDIVAPYLLALATEEQK

SEQ ID NO: 785075 - protein, 23 aa, Mycobacterium
LHQKWFNLYDEATRVPFVIARIG

SEQ ID NO: 785076 - protein, 24 aa, Mycobacterium
LHRHPPAWVPLPVHYADYTLWHHQ

SEQ ID NO: 785077 - protein, 23 aa, Mycobacterium
LHVGLARLWQRLTDDPTARAAVI

SEQ ID NO: 785078 - protein, 39 aa, Mycobacterium
LIAGERPPRVPLSFAQSRLWFLEQLQGPSAVYNIPVVLH

SEQ ID NO: 785079 - protein, 24 aa, Mycobacterium
LIDDMVAACLKWEGGYVWACKNYD

SEQ ID NO: 785080 - protein, 17 aa, Mycobacterium
LIETLTRLRDLGNTLIV

SEQ ID NO: 785081 - protein, 17 aa, Mycobacterium
LIGWTRGTGLMGHNDAI

SEQ ID NO: 785082 - protein, 17 aa, Mycobacterium
LIIYDEVHLLPAPVFRM

SEQ ID NO: 785083 - protein, 25 aa, Mycobacterium
LIKSIGLRLGVPWYAYDTVTFSGEV

SEQ ID NO: 785084 - protein, 18 aa, Mycobacterium
LIRAMEKFDYTKGFKFST

SEQ ID NO: 785085 - protein, 17 aa, Mycobacterium
LIRAVEKFDYTKGYKFS

SEQ ID NO: 785086 - protein, 26 aa, Mycobacterium
LISPENKAYYFAAAFPSACGKTNLAM

SEQ ID NO: 785087 - protein, 26 aa, Mycobacterium
LKGAGFYEYVDGKRVGLWPGLADTFG

SEQ ID NO: 785088 - protein, 29 aa, Mycobacterium
LKKELRLKPGDWYVIHSYAGYENKVKANL

SEQ ID NO: 785089 - protein, 24 aa, Mycobacterium
LKKHFRPEFLNRIDDIIVFHQLTQ

SEQ ID NO: 785090 - protein, 24 aa, Mycobacterium
LKLARQPYYRWLAAPVTDADLVEA

SEQ ID NO: 785091 - protein, 31 aa, Mycobacterium; identical to SEQ ID NO: 128859

SEQ ID NO: 785092 - protein, 17 aa, Mycobacterium
LKVAVVCKSLFGKAHTV

SEQ ID NO: 785093 - protein, 22 aa, Mycobacterium
LKVVDLLTPYVRGGKIALFGGA

SEQ ID NO: 785094 - protein, 20 aa, Mycobacterium
LKYFTEHLPATFVYAGIDVE

SEQ ID NO: 785095 - protein, 18 aa, Mycobacterium
LLAFLDRPEIAGGEALAG

SEQ ID NO: 785096 - protein, 17 aa, Mycobacterium
LLAGCTVVLKPAAETPL

SEQ ID NO: 785097 - protein, 27 aa, Mycobacterium
LLDLGLRNYWGYNTFGFFAPHNQYAAN

SEQ ID NO: 785098 - protein, 18 aa, Mycobacterium
LLHEILVAQVAIYLDVEP

SEQ ID NO: 785099 - protein, 17 aa, Mycobacterium
LLIADRWEMADALNIRI

SEQ ID NO: 785100 - protein, 17 aa, Mycobacterium
LLKLIQAADYDVKRAET

SEQ ID NO: 785101 - protein, 17 aa, Mycobacterium
LLLLDEPTNHLDAESVL

SEQ ID NO: 785102 - protein, 17 aa, Mycobacterium
LLMLHPPSETTPSLPEC

SEQ ID NO: 785103 - protein, 17 aa, Mycobacterium
LLRIFDDGDFLDVAAQH

SEQ ID NO: 785104 - protein, 19 aa, Mycobacterium
LLSDVVLPAATWYEKADLS

SEQ ID NO: 785105 - protein, 17 aa, Mycobacterium
LLTDKYELTMLAAALRD

SEQ ID NO: 785106 - protein, 18 aa, Mycobacterium
LLTHYMPAHYSAGWWMDS

SEQ ID NO: 785107 - protein, 18 aa, Mycobacterium
LLTLLNQREIGARRGLIV

SEQ ID NO: 785108 - protein, 18 aa, Mycobacterium
LLVSGLPPHVAAAAACEL

SEQ ID NO: 785109 - protein, 17 aa, Mycobacterium
LLWSRPIKEYPDLKIAL

SEQ ID NO: 785110 - protein, 32 aa, Mycobacterium; identical to SEQ ID NO: 121126

SEQ ID NO: 785111 - protein, 18 aa, Mycobacterium
LMLSFYMKTPGGFDVEFG

SEQ ID NO: 785112 - protein, 18 aa, Mycobacterium
LMNAMTARLALDTLGLRA

SEQ ID NO: 785113 - protein, 19 aa, Mycobacterium
LMRRFNGATLETLLTRLNL

SEQ ID NO: 785114 - protein, 17 aa, Mycobacterium
LNEEFPRLMVYRGPRRK

SEQ ID NO: 785115 - protein, 17 aa, Mycobacterium
LNFQTMVADLTGLEVAN

SEQ ID NO: 785116 - protein, 19 aa, Mycobacterium
LNGLPVSIIIRTTLQDLES

SEQ ID NO: 785117 - protein, 17 aa, Mycobacterium
LNLTSVGGDLPPGPPFS

SEQ ID NO: 785118 - protein, 18 aa, Mycobacterium
LNRWRRLGCWVSGHGEGW

SEQ ID NO: 785119 - protein, 18 aa, Mycobacterium
LNTDLRGLDSLDLGARRL

SEQ ID NO: 785120 - protein, 18 aa, Mycobacterium
LPAATWYEKADLSSTDMH

SEQ ID NO: 785121 - protein, 19 aa, Mycobacterium
LPAIRQQIWTLIRAAKMDH

SEQ ID NO: 785122 - protein, 25 aa, Mycobacterium
LPDMFTRLMLSLVATGIAPGSFYEL

SEQ ID NO: 785123 - protein, 19 aa, Mycobacterium
LPELGIPSLTIPPLTLAEG

SEQ ID NO: 785124 - protein, 29 aa, Mycobacterium
LPERDFPTLIDLYLQGRLPLEQFVSERIG

SEQ ID NO: 785125 - protein, 21 aa, Mycobacterium
LPGAAIWHMAWSDKDDAIDWQ

SEQ ID NO: 785126 - protein, 24 aa, Mycobacterium
LPGVAMMVVLISRGGWCTITVRYD

SEQ ID NO: 785127 - protein, 19 aa, Mycobacterium
LPLRKRQQKVPLNTYVRPG

SEQ ID NO: 785128 - protein, 26 aa, Mycobacterium
LPNMRTVLHCLPPKDWTEPGFMGLGM

SEQ ID NO: 785129 - protein, 17 aa, Mycobacterium
LPRIARATKILDLARAY

SEQ ID NO: 785130 - protein, 18 aa, Mycobacterium
LPTAGLPFQFQTWAEFEG

SEQ ID NO: 785131 - protein, 31 aa, Mycobacterium
LPTIRSRTHHYPFRLLPPKTMRALIGRICEQ

SEQ ID NO: 785132 - protein, 31 aa, Mycobacterium
LPTIRSRTHHYPFRLLPPRTMRGLIGRICEQ

SEQ ID NO: 785133 - protein, 18 aa, Mycobacterium
LPTKFMPAPGYSAYIAPD

SEQ ID NO: 785134 - protein, 26 aa, Mycobacterium
LPVKLCYSGPFFRYERPQAGRYRQLQ

SEQ ID NO: 785135 - protein, 19 aa, Mycobacterium
LPWHRVITASGRPARHLTT

SEQ ID NO: 785136 - protein, 25 aa, Mycobacterium
LQAFPQIAQYYRRRFRHILVDEYQD

SEQ ID NO: 785137 - protein, 25 aa, Mycobacterium
LQALLDEWLVAVWQNRPHDGLRDPV

SEQ ID NO: 785138 - protein, 23 aa, Mycobacterium
LQNRLPCIYLVDSGGAFLPRQDE

SEQ ID NO: 785139 - protein, 24 aa, Mycobacterium
LQQDGMLALARLQRKMRLVESPYR

SEQ ID NO: 785140 - protein, 19 aa, Mycobacterium
LQRKAAIVMQYYRGDEPLK

SEQ ID NO: 785141 - protein, 17 aa, Mycobacterium
LQTGVRWKDLGLVVVDE

SEQ ID NO: 785142 - protein, 20 aa, Mycobacterium
LQVLEELAARWAAVAVAVSV

SEQ ID NO: 785143 - protein, 23 aa, Mycobacterium
LRAGRWSGYIKPDIDLPTLADRI

SEQ ID NO: 785144 - protein, 17 aa, Mycobacterium
LRAWIRHGTIYGKAKAL

SEQ ID NO: 785145 - protein, 22 aa, Mycobacterium
LRDAAELTLFLLDQDGPEPDDT

SEQ ID NO: 785146 - protein, 21 aa, Mycobacterium
LRDRAFYAPAQSRYRIFIVDE

SEQ ID NO: 785147 - protein, 21 aa, Mycobacterium
LRDRAFYAPAQSRYRVFIVDE

SEQ ID NO: 785148 - protein, 23 aa, Mycobacterium
LREAVRVFGFHLSGLDMRQNSDV

SEQ ID NO: 785149 - protein, 21 aa, Mycobacterium
LREELGDLLLQVLFHARIAED

SEQ ID NO: 785150 - protein, 20 aa, Mycobacterium
LREELGDVLLQVLFHARIAE

SEQ ID NO: 785151 - protein, 20 aa, Mycobacterium
LRELDEVAYLRFASVYRSFS

SEQ ID NO: 785152 - protein, 24 aa, Mycobacterium
LREYVGYIVEKRFNLSWSIEGTRS

SEQ ID NO: 785153 - protein, 19 aa, Mycobacterium
LRGIDVAFPLGVLTSVTGV

SEQ ID NO: 785154 - protein, 19 aa, Mycobacterium
LRGLDSLDLGARRLDAAPD

SEQ ID NO: 785155 - protein, 18 aa, Mycobacterium
LRILRRRSLAALRAQVEP

SEQ ID NO: 785156 - protein, 24 aa, Mycobacterium
LRMMTPLPFNFRQAVRDTELLGYF

SEQ ID NO: 785157 - protein, 22 aa, Mycobacterium
LRRANEILKTASAFFAAAEVDR

SEQ ID NO: 785158 - protein, 18 aa, Mycobacterium
LRRGAEIIDASRLMRGKG

SEQ ID NO: 785159 - protein, 26 aa, Mycobacterium
LRRQYDPLMSPLVWDLAHIGQQEELW

SEQ ID NO: 785160 - protein, 18 aa, Mycobacterium
LRRRLRRSVWALCASWYR

SEQ ID NO: 785161 - protein, 23 aa, Mycobacterium
LRRVAGDWQLCRRRLLLDQTVLL

SEQ ID NO: 785162 - protein, 25 aa, Mycobacterium
LRSKPGDWYVIHSYAGYENKVKANL

SEQ ID NO: 785163 - protein, 19 aa, Mycobacterium
LRTRLFAAPGWVVSPGVVK

SEQ ID NO: 785164 - protein, 20 aa, Mycobacterium
LRVTNPSPYMYLLHVPNDAG

SEQ ID NO: 785165 - protein, 17 aa, Mycobacterium
LSALVAHLVGADALILL

SEQ ID NO: 785166 - protein, 24 aa, Mycobacterium
LSANPFVLYPSYREIAHLPLAERV

SEQ ID NO: 785167 - protein, 26 aa, Mycobacterium
LSDDELLGFCLLLLIAGHETTSNLLA

SEQ ID NO: 785168 - protein, 23 aa, Mycobacterium
LSDNRFTVLYPDGEQRLGGAAVV

SEQ ID NO: 785169 - protein, 28 aa, Mycobacterium
LSDPAENLYTLDYYLKLAEQIVEAGAHV

SEQ ID NO: 785170 - protein, 26 aa, Mycobacterium
LSHITWYTVLACFKLGIVIEGTLARA

SEQ ID NO: 785171 - protein, 17 aa, Mycobacterium
LSILPRSVTAFIGPSGC

SEQ ID NO: 785172 - protein, 24 aa, Mycobacterium
LSIRLGVPCFPDDPLRFTGSVTGK

SEQ ID NO: 785173 - protein, 19 aa, Mycobacterium
LSLDNGIHMMWATRNFNAR

SEQ ID NO: 785174 - protein, 18 aa, Mycobacterium
LSPFVTWGTNPGQGVPLA

SEQ ID NO: 785175 - protein, 21 aa, Mycobacterium
LSPRQRAVLLLRDVLQWKAAE

SEQ ID NO: 785176 - protein, 26 aa, Mycobacterium
LSRELIRVVTIAPGLFKTPLLGSLPE

SEQ ID NO: 785177 - protein, 27 aa, Mycobacterium
LSRSVFSKGIFPAVDPLASSSTILDPS

SEQ ID NO: 785178 - protein, 18 aa, Mycobacterium
LSTARFEFRWNDQFALSL

SEQ ID NO: 785179 - protein, 20 aa, Mycobacterium
LSVRVIPKQADEFTCSSCFL

SEQ ID NO: 785180 - protein, 17 aa, Mycobacterium
LSYILGAKIPFLPDVVR

SEQ ID NO: 785181 - protein, 24 aa, Mycobacterium
LTAERTMLNLVCHLSGIATTTAAW

SEQ ID NO: 785182 - protein, 19 aa, Mycobacterium
LTASRFVACPFGGVGARMY

SEQ ID NO: 785183 - protein, 27 aa, Mycobacterium
LTAVAMLVAIFRARPSPFYIMDEVEAA

SEQ ID NO: 785184 - protein, 25 aa, Mycobacterium
LTDDEVLGFMFLMVIAGNETTTKLL

SEQ ID NO: 785185 - protein, 24 aa, Mycobacterium
LTDEQLLNILWNLIGGGVDTTTSQ

SEQ ID NO: 785186 - protein, 24 aa, Mycobacterium
LTEAEFLARREAVERVMVVRDRVR

SEQ ID NO: 785187 - protein, 20 aa, Mycobacterium
LTEALTEALTESQTESPTEA

SEQ ID NO: 785188 - protein, 28 aa, Mycobacterium
LTEGDVGWIPYFLWRAEHVYNRHSGWTL

SEQ ID NO: 785189 - protein, 23 aa, Mycobacterium
LTGTFLGMRVAVDPMIAAGGGSI

SEQ ID NO: 785190 - protein, 32 aa, Mycobacterium
LTLDTRRLIDRASRWLLNYRPQPLAVGAEINR

SEQ ID NO: 785191 - protein, 26 aa, Mycobacterium
LTLEDFLEQMLAIRKMGPIGNLLGML

SEQ ID NO: 785192 - protein, 22 aa, Mycobacterium
LTLEDFLEQMLAVRKMGPIGNL

SEQ ID NO: 785193 - protein, 25 aa, Mycobacterium
LTLRNRALLELLYSTGSRISEAVGL

SEQ ID NO: 785194 - protein, 26 aa, Mycobacterium
LTPVPEYRFPGLLPGDRWCVTALNWL

SEQ ID NO: 785195 - protein, 18 aa, Mycobacterium
LTQETFIRVFRSVQNYQP

SEQ ID NO: 785196 - protein, 28 aa, Mycobacterium
LTTAFGPSTGLWLLLLAKGGGDTEVSSE

SEQ ID NO: 785197 - protein, 18 aa, Mycobacterium
LTYDHRLIDGADAGRFLT

SEQ ID NO: 785198 - protein, 23 aa, Mycobacterium
LTYQMMYELRDFGFSTSIGIGGD

SEQ ID NO: 785199 - protein, 23 aa, Mycobacterium
LVAEPQLLLLDEPFGALDALTRL

SEQ ID NO: 785200 - protein, 18 aa, Mycobacterium
LVAIDTLLARMENDRDRL

SEQ ID NO: 785201 - protein, 32 aa, Mycobacterium
LVDPRILTGALLYIPLLTRMLMNLNAMGLSEE

SEQ ID NO: 785202 - protein, 19 aa, Mycobacterium
LVDVIGLPWEEVHAEACRW

SEQ ID NO: 785203 - protein, 27 aa, Mycobacterium
LVEHFILEDWWGRWLGRWTAEEHLHAI

SEQ ID NO: 785204 - protein, 19 aa, Mycobacterium
LVEQFLTQFYGEQAELGGA

SEQ ID NO: 785205 - protein, 18 aa, Mycobacterium
LVERAGVDPALVDDVIWG

SEQ ID NO: 785206 - protein, 19 aa, Mycobacterium
LVGRLMSYKLDRSRPLWEL

SEQ ID NO: 785207 - protein, 25 aa, Mycobacterium
LVGSVSMTAQWWLDAREPKKEVVAA

SEQ ID NO: 785208 - protein, 17 aa, Mycobacterium
LVGYGCTTCIGNSGPLP

SEQ ID NO: 785209 - protein, 21 aa, Mycobacterium
LVIKPGWGFSFDYQPGQYIGI

SEQ ID NO: 785210 - protein, 19 aa, Mycobacterium
LVKLWLTDEGDIDADWARL

SEQ ID NO: 785211 - protein, 24 aa, Mycobacterium
LVLDQLMYPAMMFGAAGAWSIDVC

SEQ ID NO: 785212 - protein, 23 aa, Mycobacterium
LVLDYERAMLRLGEGENGEPQLY

SEQ ID NO: 785213 - protein, 21 aa, Mycobacterium
LVNLVIALLSTRGYITAEKIR

SEQ ID NO: 785214 - protein, 21 aa, Mycobacterium
LVYAVLNLYPYNPGHLMVVPY

SEQ ID NO: 785215 - protein, 20 aa, Mycobacterium
LVYDARAFFDVAELHSWVAE

SEQ ID NO: 785216 - protein, 17 aa, Mycobacterium
LVYKGMLTTPQLKAFYL

SEQ ID NO: 785217 - protein, 18 aa, Mycobacterium
LWPDYDRRDLWAACEEYV

SEQ ID NO: 785218 - protein, 19 aa, Mycobacterium
LWRHPEDQSWRYKDLTYWT

SEQ ID NO: 785219 - protein, 23 aa, Mycobacterium
LWVTDLTFVPTWAGVAYVCFIVD

SEQ ID NO: 785220 - protein, 24 aa, Mycobacterium
LYELELKRVFGRTWQFLCHEDEIP

SEQ ID NO: 785221 - protein, 17 aa, Mycobacterium
LYGPPGCGKTLIAKAVA

SEQ ID NO: 785222 - protein, 20 aa, Mycobacterium
LYHEAKAAGIIYQATLRHEL

SEQ ID NO: 785223 - protein, 20 aa, Mycobacterium
LYHEAKAAGIIYQATLRREL

SEQ ID NO: 785224 - protein, 18 aa, Mycobacterium
LYHMRDKGIRYGLQTMCE

SEQ ID NO: 785225 - protein, 21 aa, Mycobacterium
LYPQIAARPFGMMIGFQGHHG

SEQ ID NO: 785226 - protein, 25 aa, Mycobacterium
LYTARAQLAPLVFEGTSFGGALMTT

SEQ ID NO: 785227 - protein, 24 aa, Mycobacterium
MADPGSVSYLFTRKGVVTLEKNGL

SEQ ID NO: 785228 - protein, 25 aa, Mycobacterium
MADRAENLRRLAHVAALLADCGNVV

SEQ ID NO: 785229 - protein, 24 aa, Mycobacterium
MADRAENLRRLAHVAVLLADCGHV

SEQ ID NO: 785230 - protein, 17 aa, Mycobacterium
MAELSIFQVLLNHPPLA

SEQ ID NO: 785231 - protein, 33 aa, Mycobacterium
MAETPLFMAHYAPFGLLTPAAWVAMHAQRYMST

SEQ ID NO: 785232 - protein, 35 aa, Mycobacterium
MAHMWFGDLVTMRWWDDLWLNESFATFASVLCQAE

SEQ ID NO: 785233 - protein, 18 aa, Mycobacterium
MALPNARVLIHQPSLQGV

SEQ ID NO: 785234 - protein, 25 aa, Mycobacterium
MALRDRLIVEMLYATGIRVSELCGL

SEQ ID NO: 785235 - protein, 17 aa, Mycobacterium
MAPALADDRLYRVGAAY

SEQ ID NO: 785236 - protein, 19 aa, Mycobacterium
MARLAVHPDAYIRPSPTSG

SEQ ID NO: 785237 - protein, 24 aa, Mycobacterium
MAVFLTHYLGFPLGSALNGAVDAV

SEQ ID NO: 785238 - protein, 19 aa, Mycobacterium
MAYERVTLYGLPLVARRRV

SEQ ID NO: 785239 - protein, 28 aa, Mycobacterium
MCGRSYSPRFLFAWPNSKSAVMGPAQLA

SEQ ID NO: 785240 - protein, 31 aa, Mycobacterium
MCTIGDPLLDLGWMLVCWPDDPNPINAGSAL

SEQ ID NO: 785241 - protein, 19 aa, Mycobacterium
MDAEYWYRNLREPVEFYSC

SEQ ID NO: 785242 - protein, 25 aa, Mycobacterium
MDAHARLLVWELIDALRRDGVTVVL

SEQ ID NO: 785243 - protein, 25 aa, Mycobacterium
MDAPQHTRLRKIISRAFTPRAIERL

SEQ ID NO: 785244 - protein, 25 aa, Mycobacterium
MDDLHRHLFSVLMDREWKHGVAAAV

SEQ ID NO: 785245 - protein, 18 aa, Mycobacterium
MDEGLRFAIREGGRTVGA

SEQ ID NO: 785246 - protein, 24 aa, Mycobacterium
MECEKILLFSSDYPHWTFDDPRWL

SEQ ID NO: 785247 - protein, 23 aa, Mycobacterium
MEEATFLTRFARSVTLVHRRDEF

SEQ ID NO: 785248 - protein, 26 aa, Mycobacterium
MEEFERRFFPIYPASTKVQSWDIFKC

SEQ ID NO: 785249 - protein, 18 aa, Mycobacterium
MEGILAVLAEHVGDVRGG

SEQ ID NO: 785250 - protein, 19 aa, Mycobacterium
MEPITWPEFARQHPFAPAS

SEQ ID NO: 785251 - protein, 19 aa, Mycobacterium
MEREGLEIPLLIGGATTSR

SEQ ID NO: 785252 - protein, 20 aa, Mycobacterium
MERLAPLGPVYQAGTLSGNP

SEQ ID NO: 785253 - protein, 25 aa, Mycobacterium
MGGRPVVAVNLLGWPRDVLPFELAA

SEQ ID NO: 785254 - protein, 18 aa, Mycobacterium
MGLDIGPGSVKRFATLLS

SEQ ID NO: 785255 - protein, 24 aa, Mycobacterium
MGQTPFELIPLYPVGNPAHWHDFF

SEQ ID NO: 785256 - protein, 20 aa, Mycobacterium
MGRHAGWIALNAGLASGAHM

SEQ ID NO: 785257 - protein, 23 aa, Mycobacterium
MGRHAGWIALNSGLASGAHMTLI

SEQ ID NO: 785258 - protein, 19 aa, Mycobacterium
MGRLAGRGFAAYGTAKAAL

SEQ ID NO: 785259 - protein, 24 aa, Mycobacterium
MGVDQGFIRKSGAWFTYEGEQLGQ

SEQ ID NO: 785260 - protein, 17 aa, Mycobacterium
MGYSGVYSSFLKHAIRQ

SEQ ID NO: 785261 - protein, 19 aa, Mycobacterium
MHLHTRLTQRFDAVIVPGV

SEQ ID NO: 785262 - protein, 18 aa, Mycobacterium
MICDASYSTYFLAHWARD

SEQ ID NO: 785263 - protein, 21 aa, Mycobacterium
MIELIAKWRTGASKYGLAALQ

SEQ ID NO: 785264 - protein, 17 aa, Mycobacterium
MLCYVTPKEHLGLPDRK

SEQ ID NO: 785265 - protein, 18 aa, Mycobacterium
MLCYVTPKEHLGLPDRKD

SEQ ID NO: 785266 - protein, 23 aa, Mycobacterium
MLDTLIKEKWLTANGVIGFFPAN

SEQ ID NO: 785267 - protein, 17 aa, Mycobacterium
MLLDHLTHGRIIGGVGP

SEQ ID NO: 785268 - protein, 20 aa, Mycobacterium
MLVELRGWEGPGERGVRVVP

SEQ ID NO: 785269 - protein, 17 aa, Mycobacterium
MPVHQFMHDSRLLDLGL

SEQ ID NO: 785270 - protein, 24 aa, Mycobacterium
MQFAYQFPQLVDRLILVGAGGVTK

SEQ ID NO: 785271 - protein, 20 aa, Mycobacterium
MQLRTGVAMLSYAEDLFFGV

SEQ ID NO: 785272 - protein, 20 aa, Mycobacterium
MRAHQILLARVETALRPYDL

SEQ ID NO: 785273 - protein, 17 aa, Mycobacterium
MRDLGIAILREVGVDTG

SEQ ID NO: 785274 - protein, 25 aa, Mycobacterium
MRSCTGWPSGTWIDPPRRTAPDGSN

SEQ ID NO: 785275 - protein, 18 aa, Mycobacterium
MRVPLAKVIVPTQFGIDV

SEQ ID NO: 785276 - protein, 20 aa, Mycobacterium
MSARHPGNIAALAEIAPPAI

SEQ ID NO: 785277 - protein, 21 aa, Mycobacterium
MSDVLLPRRGTLVAWTTQGFP

SEQ ID NO: 785278 - protein, 23 aa, Mycobacterium
MSGSLLELTLYEKQIRGALYGSS

SEQ ID NO: 785279 - protein, 25 aa, Mycobacterium
MSPVGLARFSTLRGWLSQWSYDDAR

SEQ ID NO: 785280 - protein, 26 aa, Mycobacterium
MTAAPNFAYALLAKRLRRQAKPGDFD

SEQ ID NO: 785281 - protein, 23 aa, Mycobacterium
MTDPAYYNIIVKGALSSPSLVQV

SEQ ID NO: 785282 - protein, 24 aa, Mycobacterium
MTDYMTRLMRYVEFMKKVVPMHDD

SEQ ID NO: 785283 - protein, 22 aa, Mycobacterium
MTELPLIVIDVQRGGPSTGLPT

SEQ ID NO: 785284 - protein, 27 aa, Mycobacterium
MTIDQFAPQISFFFYTHGDFFEEIAKY

SEQ ID NO: 785285 - protein, 26 aa, Mycobacterium
MTVFEHLGRLLIIDCGVMFPTHDEPG

SEQ ID NO: 785286 - protein, 17 aa, Mycobacterium
MVAPLAISSPEGCQTDM

SEQ ID NO: 785287 - protein, 26 aa, Mycobacterium
MVDELERRGARRALITLCVGGGMGVA

SEQ ID NO: 785288 - protein, 17 aa, Mycobacterium
MVDMAHFAGLVAGKVFT

SEQ ID NO: 785289 - protein, 17 aa, Mycobacterium
MVNLHRRYRITTAQLAA

SEQ ID NO: 785290 - protein, 17 aa, Mycobacterium
MVRYTSGYLCVPLDGAI

SEQ ID NO: 785291 - protein, 17 aa, Mycobacterium
MVSYYRPELGLPEMGVV

SEQ ID NO: 785292 - protein, 19 aa, Mycobacterium
MVVQAALAVLLAKISASSD

SEQ ID NO: 785293 - protein, 22 aa, Mycobacterium
MWEHAFYLQYKNVKADYVKAFW

SEQ ID NO: 785294 - protein, 25 aa, Mycobacterium
NADIAWYGPEPSWWAQRLGVDEGLA

SEQ ID NO: 785295 - protein, 24 aa, Mycobacterium
NAGSRFLLDQPITSAGRHPDSDIF

SEQ ID NO: 785296 - protein, 19 aa, Mycobacterium
NAGVLNWGRLWEISAQQWQ

SEQ ID NO: 785297 - protein, 26 aa, Mycobacterium
NAKFGIFIHWGLYSVPGWAPLEADTQ

SEQ ID NO: 785298 - protein, 28 aa, Mycobacterium
NALPEWPQMLLRALMFRLAVHALHPRST

SEQ ID NO: 785299 - protein, 24 aa, Mycobacterium
NAQALTPVLLQAGIDLLVIQGTIV

SEQ ID NO: 785300 - protein, 25 aa, Mycobacterium
NCLGGSLMDYLIPTALEVPHLETGH

SEQ ID NO: 785301 - protein, 23 aa, Mycobacterium
NDAEKRWVLKNPSHLFALDALMA

SEQ ID NO: 785302 - protein, 21 aa, Mycobacterium
NDEYPFLLGHEAAGRVEAVGP

SEQ ID NO: 785303 - protein, 20 aa, Mycobacterium
NDFIGIIDLVEMKAKVWRGE

SEQ ID NO: 785304 - protein, 17 aa, Mycobacterium
NDTPELMPLPIALAHRL

SEQ ID NO: 785305 - protein, 23 aa, Mycobacterium
NEENYLIKKLFTALGALQIENQA

SEQ ID NO: 785306 - protein, 24 aa, Mycobacterium
NEENYLIKKLFTALGALQIENQAR

SEQ ID NO: 785307 - protein, 22 aa, Mycobacterium
NEFFKLWLDPSMTYSCGYFDEN

SEQ ID NO: 785308 - protein, 24 aa, Mycobacterium
NEGLRQVFMGLNPERIMGAALGNG

SEQ ID NO: 785309 - protein, 24 aa, Mycobacterium
NFPQAFTHLALINAVVHVIRAEEE

SEQ ID NO: 785310 - protein, 39 aa, Mycobacterium; identical to SEQ ID NO: 129572

SEQ ID NO: 785311 - protein, 29 aa, Mycobacterium
NGAVVLLMWAGILAYLDRCDYDYVTGCVS

SEQ ID NO: 785312 - protein, 24 aa, Mycobacterium
NGDLANWMVPGSMVKGMGGAMDLV

SEQ ID NO: 785313 - protein, 21 aa, Mycobacterium
NGFVQLVMSNLFGQNAPAIAA

SEQ ID NO: 785314 - protein, 27 aa, Mycobacterium
NGGAGGAAGWWGHGGIGGQGGTGGAAG

SEQ ID NO: 785315 - protein, 20 aa, Mycobacterium
NGGGRFVFISSSAGIFGQPM

SEQ ID NO: 785316 - protein, 21 aa, Mycobacterium
NGILGVGPFPYDDEVDPDLVN

SEQ ID NO: 785317 - protein, 21 aa, Mycobacterium
NGLLRQYFPKGTDLSRWSAED

SEQ ID NO: 785318 - protein, 27 aa, Mycobacterium
NGQKMWTSLIAYADYVWLAVRTNTEAK

SEQ ID NO: 785319 - protein, 34 aa, Mycobacterium; identical to SEQ ID NO: 116287

SEQ ID NO: 785320 - protein, 19 aa, Mycobacterium
NGRLKAERALLATALEDVQ

SEQ ID NO: 785321 - protein, 23 aa, Mycobacterium
NGTAAILLAFYVAAAEKKGVPRE

SEQ ID NO: 785322 - protein, 17 aa, Mycobacterium
NGTKCWITNGGKSSWYT

SEQ ID NO: 785323 - protein, 25 aa, Mycobacterium
NHEGVYRFLLKRNRRLYGVAYTLDN

SEQ ID NO: 785324 - protein, 17 aa, Mycobacterium
NHRGGTVLGPAASPLGA

SEQ ID NO: 785325 - protein, 19 aa, Mycobacterium
NHYLAVFDRATGSALDLFR

SEQ ID NO: 785326 - protein, 24 aa, Mycobacterium
NIARNALLGAGFPESVPGTTVDRQ

SEQ ID NO: 785327 - protein, 27 aa, Mycobacterium
NIASIAGFQPIPFMAVYSASKAFVLTF

SEQ ID NO: 785328 - protein, 19 aa, Mycobacterium
NIDVRYSDASTWYSSYRIG

SEQ ID NO: 785329 - protein, 26 aa, Mycobacterium
NIEDLRAPLLAALGAADLALATVNDL

SEQ ID NO: 785330 - protein, 24 aa, Mycobacterium
NIGFSFCYEAQRQVPAILDLLATG

SEQ ID NO: 785331 - protein, 19 aa, Mycobacterium
NIGQILETHLGWVAKSGWN

SEQ ID NO: 785332 - protein, 21 aa, Mycobacterium
NILGLDIKGHVVKKLLVAEAS

SEQ ID NO: 785333 - protein, 22 aa, Mycobacterium
NIRSFRIRFTGQVWPGDLLSFG

SEQ ID NO: 785334 - protein, 28 aa, Mycobacterium
NKDDAIHAVLHRFPVYKPIVAAVNGTCV

SEQ ID NO: 785335 - protein, 24 aa, Mycobacterium
NKEIDLRFVLGYTPLEFRDTLHML

SEQ ID NO: 785336 - protein, 22 aa, Mycobacterium
NKITLRRRTGGSDAGWHLKLPA

SEQ ID NO: 785337 - protein, 19 aa, Mycobacterium
NKLFEERIIFLGVQVDDAS

SEQ ID NO: 785338 - protein, 26 aa, Mycobacterium
NKVPIYPGYVCAIVGSLLLGKPVKWM

SEQ ID NO: 785339 - protein, 17 aa, Mycobacterium
NLANLPGYRVGGTIHII

SEQ ID NO: 785340 - protein, 17 aa, Mycobacterium
NLDFHVRRVRVSEPGTL

SEQ ID NO: 785341 - protein, 20 aa, Mycobacterium
NLDLGAYLGLLKLDGALVEL

SEQ ID NO: 785342 - protein, 17 aa, Mycobacterium
NLFLDMVRRRGRIRMEA

SEQ ID NO: 785343 - protein, 22 aa, Mycobacterium
NLGLIRAMEKFDYTKGFKFSTY

SEQ ID NO: 785344 - protein, 18 aa, Mycobacterium
NLGLIRAVEKFDYTKGYK

SEQ ID NO: 785345 - protein, 20 aa, Mycobacterium
NLLHDHLVDVLLDAAAMGRV

SEQ ID NO: 785346 - protein, 28 aa, Mycobacterium
NLRLRDGRWYWHWDPAFMTKPGDDPELR

SEQ ID NO: 785347 - protein, 24 aa, Mycobacterium
NLSETLTYLLYMATGQAPMIPLDD

SEQ ID NO: 785348 - protein, 35 aa, Mycobacterium
NLVICTLCSCFPWPVLGLPPYWYKDPVFRARAARE

SEQ ID NO: 785349 - protein, 23 aa, Mycobacterium
NLVNARYLRICVLTQYKSHSLDR

SEQ ID NO: 785350 - protein, 26 aa, Mycobacterium
NMTSTNLHGWPFLLEARKNNGAKIVV

SEQ ID NO: 785351 - protein, 24 aa, Mycobacterium
NNDFKPGFATALMNKDLGLAMDAV

SEQ ID NO: 785352 - protein, 18 aa, Mycobacterium
NPFDVGMTGLLGFASGYK

SEQ ID NO: 785353 - protein, 24 aa, Mycobacterium
NPIMAAAMFLARTSTLIASVDCAL

SEQ ID NO: 785354 - protein, 21 aa, Mycobacterium
NPKLEISGILLTRYDPRTVNA

SEQ ID NO: 785355 - protein, 24 aa, Mycobacterium
NPKPLGMPLQYMVSGMAVRATNRY

SEQ ID NO: 785356 - protein, 19 aa, Mycobacterium
NPVLEPLVAVHREIYPKAD

SEQ ID NO: 785357 - protein, 30 aa, Mycobacterium
NPVVNLLVGPLQFNSKWQSPVLASPFTIVN

SEQ ID NO: 785358 - protein, 25 aa, Mycobacterium
NQIDTPLIFLQNTTGFMVGAEYEQG

SEQ ID NO: 785359 - protein, 22 aa, Mycobacterium
NQLALAMLGAYADGLVAGALRL

SEQ ID NO: 785360 - protein, 22 aa, Mycobacterium
NQRQKFNPLVRLDSVNGGSVED

SEQ ID NO: 785361 - protein, 20 aa, Mycobacterium
NRGHCAAIHLNMPIAYPPAG

SEQ ID NO: 785362 - protein, 20 aa, Mycobacterium
NRIEIVIAMLGIVKAGAILV

SEQ ID NO: 785363 - protein, 18 aa, Mycobacterium
NRLNLALTLKEGGNLILL

SEQ ID NO: 785364 - protein, 23 aa, Mycobacterium
NRLPPVHVFAGINLSFGAMGPLL

SEQ ID NO: 785365 - protein, 18 aa, Mycobacterium
NRMFLQRLKDKLGNHANA

SEQ ID NO: 785366 - protein, 21 aa, Mycobacterium
NSELAALRRPGSFLARQVPQF

SEQ ID NO: 785367 - protein, 21 aa, Mycobacterium
NSTMLNYPLTQYMFCAPDEGA

SEQ ID NO: 785368 - protein, 26 aa, Mycobacterium
NTAVLFAWAVVLSRLTDRRDVVFGTV

SEQ ID NO: 785369 - protein, 20 aa, Mycobacterium
NTFLLPPTWTQLDSLDGRTV

SEQ ID NO: 785370 - protein, 30 aa, Mycobacterium
NTGLRNLPCHGFWANAAWLEIVLAATDLVT

SEQ ID NO: 785371 - protein, 18 aa, Mycobacterium
NVDAVMRTLLARGLITEA

SEQ ID NO: 785372 - protein, 21 aa, Mycobacterium
NVLGSPGFFVEFSKQHALSDD

SEQ ID NO: 785373 - protein, 24 aa, Mycobacterium
NVNLNLAMLTLMQKNLQGTIFGGG

SEQ ID NO: 785374 - protein, 27 aa, Mycobacterium
NVPGKPRVFMLFIGGFGVYLDICAEVA

SEQ ID NO: 785375 - protein, 23 aa, Mycobacterium
NVPQSALYLADVIARGGFPEGCF

SEQ ID NO: 785376 - protein, 27 aa, Mycobacterium
NVVKETLRLHPPLIILMRVAKGEFEVE

SEQ ID NO: 785377 - protein, 26 aa, Mycobacterium
NYGAAKLGLVGLINTLALEGAKYNIH

SEQ ID NO: 785378 - protein, 25 aa, Mycobacterium
NYGVDVTIVEFLPRALPNEDAEVSK

SEQ ID NO: 785379 - protein, 26 aa, Mycobacterium
NYGVDVTIVEFLPRALPNEDAEVSKE

SEQ ID NO: 785380 - protein, 17 aa, Mycobacterium
NYPIIKHAAFPVSAPDG

SEQ ID NO: 785381 - protein, 27 aa, Mycobacterium
NYTYSSAWFDLISPPPKLGRAAVSRGS

SEQ ID NO: 785382 - protein, 20 aa, Mycobacterium
PAAPGFQLVISYNPGYQSVL

SEQ ID NO: 785383 - protein, 23 aa, Mycobacterium
PAAWTHLVGIKPQRGRISTWPLP

SEQ ID NO: 785384 - protein, 26 aa, Mycobacterium
PADYAGKWVIFFSHPADFTPVCTSEF

SEQ ID NO: 785385 - protein, 23 aa, Mycobacterium
PAEVRRRYSGRSLRFAAASGSRM

SEQ ID NO: 785386 - protein, 22 aa, Mycobacterium
PALREELVTALIRSLPKDLRRN

SEQ ID NO: 785387 - protein, 21 aa, Mycobacterium
PALTINKMCLSGIDAIALADQ

SEQ ID NO: 785388 - protein, 25 aa, Mycobacterium
PAPDHLRIVTLPWARDLAAAIERLG

SEQ ID NO: 785389 - protein, 20 aa, Mycobacterium
PARFVANALSPAKVVSVSVI

SEQ ID NO: 785390 - protein, 19 aa, Mycobacterium
PARPRAGLIGCAFADLAEV

SEQ ID NO: 785391 - protein, 24 aa, Mycobacterium
PASDDYYMHFSDGSLIVGIGSPPR

SEQ ID NO: 785392 - protein, 17 aa, Mycobacterium
PASLVLFDVSTLYFETD

SEQ ID NO: 785393 - protein, 28 aa, Mycobacterium
PAVNTPQFSWVLSRLPRHPQPVPPIYQP

SEQ ID NO: 785394 - protein, 18 aa, Mycobacterium
PAVRRAVATTRNGRIGVI

SEQ ID NO: 785395 - protein, 25 aa, Mycobacterium
PAYRAALEILAMGRWPFDRITREST

SEQ ID NO: 785396 - protein, 17 aa, Mycobacterium
PCLLGYIDKCSAPCVGR

SEQ ID NO: 785397 - protein, 22 aa, Mycobacterium
PDALVLWEAQFGDFVNGAQSII

SEQ ID NO: 785398 - protein, 22 aa, Mycobacterium
PDAMVLWEAQFGDFVNGAQSII

SEQ ID NO: 785399 - protein, 23 aa, Mycobacterium
PDDPVLHICALAYMSDLTLLGSA

SEQ ID NO: 785400 - protein, 24 aa, Mycobacterium
PDEFAIVHKLRRVLSGLDSHQAID

SEQ ID NO: 785401 - protein, 26 aa, Mycobacterium
PDEFIWDRPIRRSLAFGRGQHFCIGY

SEQ ID NO: 785402 - protein, 18 aa, Mycobacterium
PDGLVRFVDACHARGLGV

SEQ ID NO: 785403 - protein, 24 aa, Mycobacterium
PDGRDLIISCGVALHHCVVALASM

SEQ ID NO: 785404 - protein, 21 aa, Mycobacterium
PDLEILNHGLTLWDLDRVFKV

SEQ ID NO: 785405 - protein, 24 aa, Mycobacterium
PDMALIPMRTIPNAELHIFPNSGH

SEQ ID NO: 785406 - protein, 17 aa, Mycobacterium
PDPAAMVVGWVGDILSE

SEQ ID NO: 785407 - protein, 17 aa, Mycobacterium
PDVLRELLATFIHTLMG

SEQ ID NO: 785408 - protein, 33 aa, Mycobacterium
PDVVHAHDWLVAHPAIALAQFYDVPMVSTIHAT

SEQ ID NO: 785409 - protein, 24 aa, Mycobacterium
PEAKRWSFPIRPGIAHVRTIAVHP

SEQ ID NO: 785410 - protein, 41 aa, Mycobacterium
PEARTRIRPHFFPFTEPSAEVDVWFVGKKGGPGWVEWGGCG

SEQ ID NO: 785411 - protein, 22 aa, Mycobacterium
PEDPGVMWQFSQAVRGLADGCA

SEQ ID NO: 785412 - protein, 22 aa, Mycobacterium
PEDRYIPSRALADYVRCRDLTC

SEQ ID NO: 785413 - protein, 21 aa, Mycobacterium
PEEIKRAYRKLARDLHPDANP

SEQ ID NO: 785414 - protein, 25 aa, Mycobacterium
PEELRPLLQPWNTQISIAAINGPAH

SEQ ID NO: 785415 - protein, 20 aa, Mycobacterium
PEGIEGRVPFRGPLSSVIHQ

SEQ ID NO: 785416 - protein, 30 aa, Mycobacterium
PEGKMAAVAKRRGWPILKFNSRGGVGLRRQ

SEQ ID NO: 785417 - protein, 23 aa, Mycobacterium
PEGLPSVFVYDGYPGGAGFAERG

SEQ ID NO: 785418 - protein, 29 aa, Mycobacterium
PEHPMEVGAFPLALARRSLSGSNIGGIAE

SEQ ID NO: 785419 - protein, 26 aa, Mycobacterium
PEHPMEVPAFPLLAQRRNLTGSMIGG

SEQ ID NO: 785420 - protein, 19 aa, Mycobacterium
PEILLLDEGIGAVDAEFLK

SEQ ID NO: 785421 - protein, 34 aa, Mycobacterium; identical to SEQ ID NO: 116489

SEQ ID NO: 785422 - protein, 24 aa, Mycobacterium
PETNYRIGFVPQGIGADLIATIEG

SEQ ID NO: 785423 - protein, 35 aa, Mycobacterium
PEYNATIPAVLKNAIDWLSRPYGSGALHGKPAAVI

SEQ ID NO: 785424 - protein, 24 aa, Mycobacterium
PFDAEQPLFLLYTSGTTGKPKGIV

SEQ ID NO: 785425 - protein, 18 aa, Mycobacterium
PFGMDEFLARLRAAVRRN

SEQ ID NO: 785426 - protein, 26 aa, Mycobacterium
PFIRERLTRAWTGLRAMRSYALATMD

SEQ ID NO: 785427 - protein, 20 aa, Mycobacterium
PFNATRLGRLIAEKTDIPPG

SEQ ID NO: 785428 - protein, 17 aa, Mycobacterium
PFSALAFKVATHPFFGK

SEQ ID NO: 785429 - protein, 20 aa, Mycobacterium
PGAAIWHMAWSDKDDAIDWQ

SEQ ID NO: 785430 - protein, 30 aa, Mycobacterium
PGFFGVVTSFYLKLYPRPAVCGTSVYVYPF

SEQ ID NO: 785431 - protein, 17 aa, Mycobacterium
PGFVLKRAVKGTIDSAT

SEQ ID NO: 785432 - protein, 24 aa, Mycobacterium
PGGKTVFVFPGQGAQWLGMGRELC

SEQ ID NO: 785433 - protein, 18 aa, Mycobacterium
PGIYFPGRWGARIEDIVV

SEQ ID NO: 785434 - protein, 22 aa, Mycobacterium
PGKWGEYLLASRATTIYGGTSE

SEQ ID NO: 785435 - protein, 30 aa, Mycobacterium
PGLLDLSSLWQIYGLDRPALKDRTFVPATH

SEQ ID NO: 785436 - protein, 19 aa, Mycobacterium
PGLNLIYAHLNRIIRERDA

SEQ ID NO: 785437 - protein, 25 aa, Mycobacterium
PGLRVGWFEGGIAWVPWALQDAEHL

SEQ ID NO: 785438 - protein, 25 aa, Mycobacterium
PGMNEIVFPAAILQPPFFDADADDA

SEQ ID NO: 785439 - protein, 30 aa, Mycobacterium
PGNDGRGYVLRRLLRRVIRSAKLLDIEGPI

SEQ ID NO: 785440 - protein, 28 aa, Mycobacterium
PGPGENIPAWLIFDQQYRDRYIFAGLQP

SEQ ID NO: 785441 - protein, 21 aa, Mycobacterium
PGSALLFPTLCAPTGDPPLTP

SEQ ID NO: 785442 - protein, 30 aa, Mycobacterium
PGSTFRESLLPMMILMDPPRHDQLRALVSK

SEQ ID NO: 785443 - protein, 26 aa, Mycobacterium
PGTKGLSLFYVPNYLFDPDTGELGPR

SEQ ID NO: 785444 - protein, 19 aa, Mycobacterium
PGTRFGPMGIRRSTNLFGT

SEQ ID NO: 785445 - protein, 22 aa, Mycobacterium
PGTSPFDHFIYVIASDGDIEEG

SEQ ID NO: 785446 - protein, 27 aa, Mycobacterium
PGTYLNSFFEIRPLPYAEAGYGYPEAG

SEQ ID NO: 785447 - protein, 18 aa, Mycobacterium
PGVLLTQIAAVRALARQG

SEQ ID NO: 785448 - protein, 25 aa, Mycobacterium
PHVLQLIMDSLRYWVTEMHVDGFRF

SEQ ID NO: 785449 - protein, 27 aa, Mycobacterium
PIAGAAMFVLDKWLQPVPAGVVGELYL

SEQ ID NO: 785450 - protein, 18 aa, Mycobacterium
PIAVKEAVLPFHRFRRID

SEQ ID NO: 785451 - protein, 24 aa, Mycobacterium
PIEPRLSLQWWVRVESLAKAAGDA

SEQ ID NO: 785452 - protein, 20 aa, Mycobacterium
PIGLALVQFSLAQGATQVIV

SEQ ID NO: 785453 - protein, 22 aa, Mycobacterium
PIRPEYLAGLIDRLAAADAVFT

SEQ ID NO: 785454 - protein, 17 aa, Mycobacterium
PITDGFYYDFDVAEPFT

SEQ ID NO: 785455 - protein, 19 aa, Mycobacterium
PIYHHLRESIEAHLSIVVA

SEQ ID NO: 785456 - protein, 24 aa, Mycobacterium
PKADWKHMWSFQPEIQDYLLGVTA

SEQ ID NO: 785457 - protein, 26 aa, Mycobacterium
PKHKSLTMFLVPLDSPGIEIQGIRTV

SEQ ID NO: 785458 - protein, 26 aa, Mycobacterium
PKLRAGSFFPSLLERRRRIDKALHAV

SEQ ID NO: 785459 - protein, 19 aa, Mycobacterium
PKQQVRCVYVAIGQKGTTI

SEQ ID NO: 785460 - protein, 17 aa, Mycobacterium
PLAYMRRVAKKDIMLNG

SEQ ID NO: 785461 - protein, 21 aa, Mycobacterium
PLDWLVSKFAREVPGVAHALL

SEQ ID NO: 785462 - protein, 28 aa, Mycobacterium
PLGGVSFWASLFPAVWSFCLALRSRGLG

SEQ ID NO: 785463 - protein, 26 aa, Mycobacterium
PLGIIPLLQVDMWEHAFYLQYKNVKA

SEQ ID NO: 785464 - protein, 31 aa, Mycobacterium
PLKPITHPLRADIPIMLGAEGPKNVALAAEI

SEQ ID NO: 785465 - protein, 17 aa, Mycobacterium
PLLPSDDPFYQPPLGFQ

SEQ ID NO: 785466 - protein, 18 aa, Mycobacterium
PLPEGCFALVPLEESIEA

SEQ ID NO: 785467 - protein, 23 aa, Mycobacterium
PLRAGMRLGLIPTVAPYVLPTVL

SEQ ID NO: 785468 - protein, 17 aa, Mycobacterium
PLRHWNAGPGKKVAVIG

SEQ ID NO: 785469 - protein, 25 aa, Mycobacterium
PLRPRFQGLLPAQTRRRKAADPRHH

SEQ ID NO: 785470 - protein, 21 aa, Mycobacterium
PLSYQSLTRNIRARNLRPDCQ

SEQ ID NO: 785471 - protein, 22 aa, Mycobacterium
PLTTILDPSLPLTVTEWDEWGN

SEQ ID NO: 785472 - protein, 20 aa, Mycobacterium
PLVVLPVLFHLLWHRRLVVD

SEQ ID NO: 785473 - protein, 22 aa, Mycobacterium
PMIMRDTIFCAIPEDADRDAIA

SEQ ID NO: 785474 - protein, 19 aa, Mycobacterium
PMRPGWSDALRLSRSVLPH

SEQ ID NO: 785475 - protein, 19 aa, Mycobacterium
PNDGWLMPSGLVVDDGLVC

SEQ ID NO: 785476 - protein, 25 aa, Mycobacterium
PNLYPLGDPPYYAFRIVLGDLGTSG

SEQ ID NO: 785477 - protein, 17 aa, Mycobacterium
PNQLWVTDLTFVPTWAG

SEQ ID NO: 785478 - protein, 35 aa, Mycobacterium; identical to SEQ ID NO: 221356

SEQ ID NO: 785479 - protein, 17 aa, Mycobacterium
PPDARFGWPKRNGFVQP

SEQ ID NO: 785480 - protein, 20 aa, Mycobacterium
PPDPHDLAYLIYTSGTTGTP

SEQ ID NO: 785481 - protein, 20 aa, Mycobacterium
PPEAHGEVFPFVFTAARLTE

SEQ ID NO: 785482 - protein, 19 aa, Mycobacterium
PPFARNVRFYPTAAAAQRA

SEQ ID NO: 785483 - protein, 20 aa, Mycobacterium
PPGFIDTPMLRAAEKNGFLG

SEQ ID NO: 785484 - protein, 27 aa, Mycobacterium
PPGLLMSLGFAPQWVPGYLARADMMFA

SEQ ID NO: 785485 - protein, 19 aa, Mycobacterium
PPGREAYPGDVFYLHSRLL

SEQ ID NO: 785486 - protein, 21 aa, Mycobacterium
PPHNLRELAEAVYWCLDNHEA

SEQ ID NO: 785487 - protein, 19 aa, Mycobacterium
PQAWIEQMKRIGIYGLAIG

SEQ ID NO: 785488 - protein, 22 aa, Mycobacterium
PQITAMLRRLGIEGDFKGGFRV

SEQ ID NO: 785489 - protein, 19 aa, Mycobacterium
PQTSLFGTLSLWQGVDVPG

SEQ ID NO: 785490 - protein, 19 aa, Mycobacterium
PQWLQDLRKNGPHPKNLVA

SEQ ID NO: 785491 - protein, 18 aa, Mycobacterium
PRAVFRKFGLCRICLREM

SEQ ID NO: 785492 - protein, 19 aa, Mycobacterium
PRAVFRKFGLCRICLREMA

SEQ ID NO: 785493 - protein, 24 aa, Mycobacterium
PRDPLLRLSTFFDDGSVELLHERD

SEQ ID NO: 785494 - protein, 29 aa, Mycobacterium
PRFGVDGTLERFVRVPYALPEPQLAEAVE

SEQ ID NO: 785495 - protein, 19 aa, Mycobacterium
PRLRPVDAQWRLGVAAVGL

SEQ ID NO: 785496 - protein, 26 aa, Mycobacterium
PRPEMLLHAILKLHDKIQQMPLGVNR

SEQ ID NO: 785497 - protein, 26 aa, Mycobacterium
PRQEDLINRWTWIPFGAGKHRCVGAA

SEQ ID NO: 785498 - protein, 26 aa, Mycobacterium
PRQEDLINRWTWIPFGAGRHRCVGAA

SEQ ID NO: 785499 - protein, 23 aa, Mycobacterium
PRQVYSWDITKLAGPVKGVYYDA

SEQ ID NO: 785500 - protein, 18 aa, Mycobacterium
PRRSGPVVWVKDASRSVP

SEQ ID NO: 785501 - protein, 18 aa, Mycobacterium
PRSLVWSAAWEMTREAEL

SEQ ID NO: 785502 - protein, 24 aa, Mycobacterium
PSADERRWWFVDPDAAVGAQLGAA

SEQ ID NO: 785503 - protein, 22 aa, Mycobacterium
PSNYFHLLRRHALDGVQRPLIV

SEQ ID NO: 785504 - protein, 17 aa, Mycobacterium
PSRFRRPELAALQLRSL

SEQ ID NO: 785505 - protein, 32 aa, Mycobacterium
PSSPGLASILPSFPALLRKQLKGAPMPAPKAI

SEQ ID NO: 785506 - protein, 18 aa, Mycobacterium
PSSPYSGGALLGDRIRMA

SEQ ID NO: 785507 - protein, 25 aa, Mycobacterium
PSTPSHWRRNLMACTGIEFCKLSFA

SEQ ID NO: 785508 - protein, 18 aa, Mycobacterium
PSVMLGAALLAKKAVEKG

SEQ ID NO: 785509 - protein, 27 aa, Mycobacterium
PTFVVSSAHWRADDDMFGALGLDLRRV

SEQ ID NO: 785510 - protein, 24 aa, Mycobacterium
PTGDAELLLIGWGSSYGPIGEACR

SEQ ID NO: 785511 - protein, 28 aa, Mycobacterium
PTKWDNSFLETLYGYEWELTKSPAGAWQ

SEQ ID NO: 785512 - protein, 26 aa, Mycobacterium
PTLDYVVVKAPRFAFEKFPGADPTLT

SEQ ID NO: 785513 - protein, 17 aa, Mycobacterium
PTMFNPMTYAGMARLAV

SEQ ID NO: 785514 - protein, 26 aa, Mycobacterium
PTMYVNQPWTIRQYAGFSTAADSNAF

SEQ ID NO: 785515 - protein, 21 aa, Mycobacterium
PTNWPGPTLVYRLLTRKPHSG

SEQ ID NO: 785516 - protein, 17 aa, Mycobacterium
PTPFITFRVWHPLSHDR

SEQ ID NO: 785517 - protein, 17 aa, Mycobacterium
PTPPRRKPIQMPGLQDV

SEQ ID NO: 785518 - protein, 25 aa, Mycobacterium
PTQVESMILPPIAHEVRVISIAQFT

SEQ ID NO: 785519 - protein, 23 aa, Mycobacterium
PTVRPDFWELVDYATAHHVGVKF

SEQ ID NO: 785520 - protein, 21 aa, Mycobacterium
PVAQLPLIAGERPPRVPLSFA

SEQ ID NO: 785521 - protein, 23 aa, Mycobacterium
PVARRLMEVYAGFLAHTDAQIGR

SEQ ID NO: 785522 - protein, 21 aa, Mycobacterium
PVAWIHATALRTEPLQFSGRD

SEQ ID NO: 785523 - protein, 17 aa, Mycobacterium
PVAYHTFGGWKRSGFGD

SEQ ID NO: 785524 - protein, 17 aa, Mycobacterium
PVDSIYSPVLKVTYKVD

SEQ ID NO: 785525 - protein, 18 aa, Mycobacterium
PVHQLPQPIAWPGSSDRN

SEQ ID NO: 785526 - protein, 18 aa, Mycobacterium
PVILVVNKTDRPDARIAE

SEQ ID NO: 785527 - protein, 25 aa, Mycobacterium
PVLARELLPERALMGDASAIVALHT

SEQ ID NO: 785528 - protein, 17 aa, Mycobacterium
PVLWKKVAPKLSAGRVQ

SEQ ID NO: 785529 - protein, 26 aa, Mycobacterium
PVMADFWETVLFRAGLYRGSALHAHR

SEQ ID NO: 785530 - protein, 26 aa, Mycobacterium
PVNTWLMEQLIMIDALKRGSAKRITA

SEQ ID NO: 785531 - protein, 27 aa, Mycobacterium
PVPGAALFVLDGWLRPVPPGTVGELYV

SEQ ID NO: 785532 - protein, 18 aa, Mycobacterium
PVRGAMGFRLLVDKRKGA

SEQ ID NO: 785533 - protein, 20 aa, Mycobacterium
PVRWIETQDLLFIEEAAGGL

SEQ ID NO: 785534 - protein, 20 aa, Mycobacterium
PVRYIILTQGHVDHVGGLDS

SEQ ID NO: 785535 - protein, 27 aa, Mycobacterium
PVSGAALFVLDGWLRPVPVGVVGELYV

SEQ ID NO: 785536 - protein, 18 aa, Mycobacterium
PVVKCNVPKRGWINGIGG

SEQ ID NO: 785537 - protein, 17 aa, Mycobacterium
PVVLVAHGGLIAALSAA

SEQ ID NO: 785538 - protein, 34 aa, Mycobacterium; identical to SEQ ID NO: 221533

SEQ ID NO: 785539 - protein, 19 aa, Mycobacterium
PYHAPLLHSAFKLLNWQGG

SEQ ID NO: 785540 - protein, 21 aa, Mycobacterium
PYSGPTAALTDVWRALRASMR

SEQ ID NO: 785541 - protein, 25 aa, Mycobacterium
QAADRLGFTRYWVAEHHNMPSVGAT

SEQ ID NO: 785542 - protein, 24 aa, Mycobacterium
QAAIDRWVQYYNTARPHQSLGMVA

SEQ ID NO: 785543 - protein, 38 aa, Mycobacterium
QADAYRAISLLLRRPPGREAFPGDVFYLHSRLLERCAK

SEQ ID NO: 785544 - protein, 24 aa, Mycobacterium
QAEAYPFMTPIFGKGVVFDASPER

SEQ ID NO: 785545 - protein, 29 aa, Mycobacterium
QAEAYRAISLLLRRPPGREAYPGDVFYLH

SEQ ID NO: 785546 - protein, 18 aa, Mycobacterium
QAEQLDIMVTWGHLYISL

SEQ ID NO: 785547 - protein, 24 aa, Mycobacterium
QAFAADMAFLRNCGIHPVVVHGGG

SEQ ID NO: 785548 - protein, 26 aa, Mycobacterium
QAGISFLLIDMATPGITLRPIKTIDG

SEQ ID NO: 785549 - protein, 19 aa, Mycobacterium
QALASLPPAWRPDPGRGGD

SEQ ID NO: 785550 - protein, 37 aa, Mycobacterium
QATARPPTFVLFTTGFLEAGYRRFLERRLRETFGFEG

SEQ ID NO: 785551 - protein, 20 aa, Mycobacterium
QAVGQLPVDFAASGLSAMSV

SEQ ID NO: 785552 - protein, 21 aa, Mycobacterium
QAYSMTMYAGWRAVIAGFVAR

SEQ ID NO: 785553 - protein, 23 aa, Mycobacterium
QDGSYLAELLLSKGYEVHGLIRR

SEQ ID NO: 785554 - protein, 25 aa, Mycobacterium
QDGWSFLIDAFFHRGLMLMSFDEHL

SEQ ID NO: 785555 - protein, 23 aa, Mycobacterium
QEGLDKVFQVLRAPHTEEPTNWS

SEQ ID NO: 785556 - protein, 27 aa, Mycobacterium
QEIMTELEIAPTRRLRGLGDRQRKALL

SEQ ID NO: 785557 - protein, 25 aa, Mycobacterium
QEISRLIGRSLRACIDLAALGENTI

SEQ ID NO: 785558 - protein, 33 aa, Mycobacterium
QETRRILDRLYGYEVSPVLWKKVAPKLSAGRVQ

SEQ ID NO: 785559 - protein, 34 aa, Mycobacterium; identical to SEQ ID NO: 121822

SEQ ID NO: 785560 - protein, 17 aa, Mycobacterium
QFMDFRYTVHDRWHGEF

SEQ ID NO: 785561 - protein, 23 aa, Mycobacterium
QFRQWVYQIADLCKQLVAQVQGI

SEQ ID NO: 785562 - protein, 26 aa, Mycobacterium
QGEGFVAVELLFLPGTYATCPACGGA

SEQ ID NO: 785563 - protein, 21 aa, Mycobacterium
QGITDLITTPGLINVDFADVK

SEQ ID NO: 785564 - protein, 25 aa, Mycobacterium
QGSPNLFMNILTTNGYCVRFLTDWA

SEQ ID NO: 785565 - protein, 23 aa, Mycobacterium
QGWLADHAVGGVVLFPGAGFVEL

SEQ ID NO: 785566 - protein, 25 aa, Mycobacterium
QGWVPVIGPFFRRGLMLLDFEEHMF

SEQ ID NO: 785567 - protein, 22 aa, Mycobacterium
QIDLDVIIYATGYHLDFLSTVD

SEQ ID NO: 785568 - protein, 17 aa, Mycobacterium
QIGRRLARLARTHQVIV

SEQ ID NO: 785569 - protein, 24 aa, Mycobacterium
QKISELYDRVGFAAAGKFNEFDNL

SEQ ID NO: 785570 - protein, 25 aa, Mycobacterium
QKQWLEIGMLLVQNADVLLLDEPVA

SEQ ID NO: 785571 - protein, 25 aa, Mycobacterium
QLAKAMDRKVWLPSGGTLVIDRTEA

SEQ ID NO: 785572 - protein, 19 aa, Mycobacterium
QLALIIHHLAVDGVSWRIL

SEQ ID NO: 785573 - protein, 17 aa, Mycobacterium
QLATLREFGYGKLSAQE

SEQ ID NO: 785574 - protein, 25 aa, Mycobacterium
QLEENPYLPPYYHPGPEAPEIRYML

SEQ ID NO: 785575 - protein, 28 aa, Mycobacterium
QLGRDRVPTFLLPANPVSALVVFEVMVR

SEQ ID NO: 785576 - protein, 24 aa, Mycobacterium
QLGRWLPEMFGTADEPKLGAFCSS

SEQ ID NO: 785577 - protein, 26 aa, Mycobacterium
QLHAGTLARLEWIKARGYVITDTVDE

SEQ ID NO: 785578 - protein, 24 aa, Mycobacterium
QLHARIWVAQVGRVPLLLLDSDVP

SEQ ID NO: 785579 - protein, 19 aa, Mycobacterium
QLLHEVWGYDFFGGTRTVD

SEQ ID NO: 785580 - protein, 17 aa, Mycobacterium
QLLMKRFPDPTTPEAQQ

SEQ ID NO: 785581 - protein, 18 aa, Mycobacterium
QLLQEVWGYDFFGGTRTV

SEQ ID NO: 785582 - protein, 25 aa, Mycobacterium
QLNAALHRIAITQIRLTDSAGQRYY

SEQ ID NO: 785583 - protein, 17 aa, Mycobacterium
QLNLILKGDNAGTVEAL

SEQ ID NO: 785584 - protein, 18 aa, Mycobacterium
QLNNERVMLGPAGRFASI

SEQ ID NO: 785585 - protein, 34 aa, Mycobacterium
QLRSFLADKVAKWWIPERWSFVSDIPRTSVGKYD

SEQ ID NO: 785586 - protein, 24 aa, Mycobacterium
QMQIKAIFSVLLREYEFEMAQPAD

SEQ ID NO: 785587 - protein, 24 aa, Mycobacterium
QMSVLTGRIFAGHLRSIIGSMTVE

SEQ ID NO: 785588 - protein, 27 aa, Mycobacterium
QNIYAVGDVSRWFHRARGVTMRIEHWT

SEQ ID NO: 785589 - protein, 19 aa, Mycobacterium
QNKARAMQVLAARLQALAE

SEQ ID NO: 785590 - protein, 24 aa, Mycobacterium
QNKISAMRVLQAKLLERKRSEERA

SEQ ID NO: 785591 - protein, 17 aa, Mycobacterium
QNRLRAYDVHRAIEAIV

SEQ ID NO: 785592 - protein, 21 aa, Mycobacterium
QPAPDWFPLLGGHEGAGVVEE

SEQ ID NO: 785593 - protein, 26 aa, Mycobacterium
QPGRGPGRFWGVYGLKKAIAVVEIAQ

SEQ ID NO: 785594 - protein, 36 aa, Mycobacterium
QPGSFYALPQSPQLFKQLLMVAGMERYYQIARCYRD

SEQ ID NO: 785595 - protein, 27 aa, Mycobacterium
QPGTFEGWLHRITTNLFLDMVRRRGRI

SEQ ID NO: 785596 - protein, 24 aa, Mycobacterium
QPKGVVGVISPWNYPMTLTASDSV

SEQ ID NO: 785597 - protein, 26 aa, Mycobacterium
QPSQDRGWVILLARYQRPKAIRQSGV

SEQ ID NO: 785598 - protein, 27 aa, Mycobacterium
QPSQDRGWVILLARYQRPKAIRQSGVS

SEQ ID NO: 785599 - protein, 32 aa, Mycobacterium; identical to SEQ ID NO: 116884

SEQ ID NO: 785600 - protein, 28 aa, Mycobacterium
QPTEPVLKLLKITGDWQKFKGLPGAEGR

SEQ ID NO: 785601 - protein, 26 aa, Mycobacterium
QPWDRDHIHRLFDDLEFRVLRDRLFD

SEQ ID NO: 785602 - protein, 42 aa, Mycobacterium
QQGIFELTWPALPAETFPATGVLPPWALISPHPENLSPDLNQ

SEQ ID NO: 785603 - protein, 22 aa, Mycobacterium
QQQRFLPRILDVTELWCQGYSE

SEQ ID NO: 785604 - protein, 24 aa, Mycobacterium
QQYRDRYIFAGLQPGQRIPRKWLE

SEQ ID NO: 785605 - protein, 25 aa, Mycobacterium
QQYRDRYIFAGLQPGQRIPSKWLES

SEQ ID NO: 785606 - protein, 23 aa, Mycobacterium
QRAWDPVIGPFFEGGLMLLDFDE

SEQ ID NO: 785607 - protein, 19 aa, Mycobacterium
QRLALACALVGRPELVFLD

SEQ ID NO: 785608 - protein, 17 aa, Mycobacterium
QRLLGTREIILIHHTDC

SEQ ID NO: 785609 - protein, 19 aa, Mycobacterium
QRLVNSMFTLSTLVGLSVA

SEQ ID NO: 785610 - protein, 25 aa, Mycobacterium
QRRLEIARALATEPKLLCLDEPAAG

SEQ ID NO: 785611 - protein, 18 aa, Mycobacterium
QRSLAADGIINAGALIAF

SEQ ID NO: 785612 - protein, 24 aa, Mycobacterium
QRSLLGQMLTSRPCPTCRGVGVVI

SEQ ID NO: 785613 - protein, 26 aa, Mycobacterium
QSDLFVKPTLNLWEFSKPTIAQVHGY

SEQ ID NO: 785614 - protein, 34 aa, Mycobacterium
QSESNAMWALSIPIPFIKPVGAGAGGYFAPHVRS

SEQ ID NO: 785615 - protein, 17 aa, Mycobacterium
QSILGYVVRWIDQGVGC

SEQ ID NO: 785616 - protein, 25 aa, Mycobacterium
QSNNITRVGWLTAGLPEHVGATTID

SEQ ID NO: 785617 - protein, 19 aa, Mycobacterium
QSPTKVDFRLARKTTTLGG

SEQ ID NO: 785618 - protein, 27 aa, Mycobacterium
QSPVLASPFTIVNAPFQLLTGQSIVNP

SEQ ID NO: 785619 - protein, 18 aa, Mycobacterium
QTCRTEVFFFPAASHVEK

SEQ ID NO: 785620 - protein, 23 aa, Mycobacterium
QTERPKVLILGSGPNRIGQGIEF

SEQ ID NO: 785621 - protein, 26 aa, Mycobacterium
QTKDIPVYRFVLRAYAAQLVQNHANL

SEQ ID NO: 785622 - protein, 29 aa, Mycobacterium
QTREHVLLARQVGVPYILVALNKADMVDD

SEQ ID NO: 785623 - protein, 27 aa, Mycobacterium
QTREHVLLARQVGVPYILVALNKSDAV

SEQ ID NO: 785624 - protein, 17 aa, Mycobacterium
QVAARMRVLAAPDLEVV

SEQ ID NO: 785625 - protein, 26 aa, Mycobacterium
QVAEPYLPLRAVRHLEKGRVVIFGAG

SEQ ID NO: 785626 - protein, 22 aa, Mycobacterium
QVARAYVTALRDLLRALDVSDV

SEQ ID NO: 785627 - protein, 26 aa, Mycobacterium
QVAVGLLRQQLAPGQLVHGIVTDGGQ

SEQ ID NO: 785628 - protein, 18 aa, Mycobacterium
QVIELHDCFSANELLLYE

SEQ ID NO: 785629 - protein, 19 aa, Mycobacterium
QVIELHDCFSANELLLYEA

SEQ ID NO: 785630 - protein, 23 aa, Mycobacterium
QVLIPAPDYPLWTASTSLAGGTP

SEQ ID NO: 785631 - protein, 23 aa, Mycobacterium
QVNRIILTRPAVEAGERLGFLPG

SEQ ID NO: 785632 - protein, 27 aa, Mycobacterium
QVNRKVLPGYILVRMDLTDDSWAAVRN

SEQ ID NO: 785633 - protein, 24 aa, Mycobacterium
QVRAGLKAIYLSGWQVAGDANLSG

SEQ ID NO: 785634 - protein, 24 aa, Mycobacterium
QVSLAGRYLVYVPGASSTGISRKL

SEQ ID NO: 785635 - protein, 17 aa, Mycobacterium
QVTANYLLGLALAQARG

SEQ ID NO: 785636 - protein, 19 aa, Mycobacterium
QVVRKIRMLLETWDVDRIG

SEQ ID NO: 785637 - protein, 24 aa, Mycobacterium
QVVSWHVMFMSRGKVGPFRVEGTA

SEQ ID NO: 785638 - protein, 25 aa, Mycobacterium
QYEAPLGITLRELLAYAGGVRAGHR

SEQ ID NO: 785639 - protein, 17 aa, Mycobacterium
RAALTKAVPTPGSLPAL

SEQ ID NO: 785640 - protein, 27 aa, Mycobacterium
RAAQLGIELLPLDDLLARADFISVHLP

SEQ ID NO: 785641 - protein, 25 aa, Mycobacterium
RAARVVVPDFQLSLAIGKEGQNARL

SEQ ID NO: 785642 - protein, 26 aa, Mycobacterium
RAARVVVPDFQLSLAIGKEGQNARLA

SEQ ID NO: 785643 - protein, 19 aa, Mycobacterium
RAAYRDFTTNLDTIQAVFS

SEQ ID NO: 785644 - protein, 25 aa, Mycobacterium
RACAAADLVFIGPPPGAIDAMGSKL

SEQ ID NO: 785645 - protein, 19 aa, Mycobacterium
RACGRIDGLERVRFTSPHP

SEQ ID NO: 785646 - protein, 18 aa, Mycobacterium
RADASVYARLREMAAERG

SEQ ID NO: 785647 - protein, 17 aa, Mycobacterium
RADGIDAPALFLTARDS

SEQ ID NO: 785648 - protein, 25 aa, Mycobacterium
RAEESAFVLLALQAPVAGDLRAIVS

SEQ ID NO: 785649 - protein, 19 aa, Mycobacterium
RAELLLGETVMVLGAGALG

SEQ ID NO: 785650 - protein, 20 aa, Mycobacterium
RAFFDVAELHSWVAEDGGRR

SEQ ID NO: 785651 - protein, 26 aa, Mycobacterium
RAGITCAVLIPQGKIAMGKLAQAVMH

SEQ ID NO: 785652 - protein, 26 aa, Mycobacterium
RAGVARSGFYFYFDSKYAVLAQLMAE

SEQ ID NO: 785653 - protein, 29 aa, Mycobacterium
RAGVARSGFYFYFDSKYAVLAVILAEAME

SEQ ID NO: 785654 - protein, 20 aa, Mycobacterium
RAGWAYTAFVTDVYARKIVG

SEQ ID NO: 785655 - protein, 27 aa, Mycobacterium
RAHGADMLLLIVAALDQSALVSMLDRT

SEQ ID NO: 785656 - protein, 18 aa, Mycobacterium
RAHWKAHRLDLTPVLHEP

SEQ ID NO: 785657 - protein, 26 aa, Mycobacterium
RALAAETPLFLLDEPFAALDALTRER

SEQ ID NO: 785658 - protein, 25 aa, Mycobacterium
RALAVDPQVLLLDEPFGALDAKVRE

SEQ ID NO: 785659 - protein, 28 aa, Mycobacterium
RALELGCGTGFFLLNLIQAGVARRGSVT

SEQ ID NO: 785660 - protein, 30 aa, Mycobacterium; identical to SEQ ID NO: 121985

SEQ ID NO: 785661 - protein, 21 aa, Mycobacterium
RALIAVRGLHRFAAAEGLAEL

SEQ ID NO: 785662 - protein, 21 aa, Mycobacterium
RAQIGGTWDLFRYPGVRSDSS

SEQ ID NO: 785663 - protein, 17 aa, Mycobacterium
RAQWLPKMASGEMIGAI

SEQ ID NO: 785664 - protein, 30 aa, Mycobacterium
RARFVVLASGPFHRPKLPGIPGIKDFKGHA

SEQ ID NO: 785665 - protein, 22 aa, Mycobacterium
RARKLYVWDRDLSTAVLADLAI

SEQ ID NO: 785666 - protein, 21 aa, Mycobacterium
RARKSIAQFKLREGMPIGARV

SEQ ID NO: 785667 - protein, 26 aa, Mycobacterium
RASSKYALVIYAAKRARQINDYYNQL

SEQ ID NO: 785668 - protein, 20 aa, Mycobacterium
RAVAGLLVPPGDGPWRLGMS

SEQ ID NO: 785669 - protein, 24 aa, Mycobacterium
RAVAVQLGYDFLPGTTVNRYCSSS

SEQ ID NO: 785670 - protein, 18 aa, Mycobacterium
RCALAWSVETASLAREHN

SEQ ID NO: 785671 - protein, 29 aa, Mycobacterium
RDADYFEGGRYLLLIRPSAPTSDIVTAQQ

SEQ ID NO: 785672 - protein, 19 aa, Mycobacterium
RDAWFWAHEVMAVGMVWNT

SEQ ID NO: 785673 - protein, 23 aa, Mycobacterium
RDDGYRFMLLGRAIERVDMTVRL

SEQ ID NO: 785674 - protein, 25 aa, Mycobacterium
RDEAVHGYYIGYKYQRGLALVDEEK

SEQ ID NO: 785675 - protein, 25 aa, Mycobacterium
RDEGIASNTLWPRTLVATAAVQNLL

SEQ ID NO: 785676 - protein, 25 aa, Mycobacterium
RDEQLPDGTLIWRLPDGHTYVTTPG

SEQ ID NO: 785677 - protein, 40 aa, Mycobacterium
RDFIKSLLDRAYAKKFRFPTFLGAFKYYTSYTLKTFDGKR

SEQ ID NO: 785678 - protein, 19 aa, Mycobacterium
RDFTLWKGAKPGEPSWPTP

SEQ ID NO: 785679 - protein, 25 aa, Mycobacterium
RDGAEWIHLVDLDAAFGRGSNRELL

SEQ ID NO: 785680 - protein, 20 aa, Mycobacterium
RDGYECGLTLTYNDIKEGDV

SEQ ID NO: 785681 - protein, 19 aa, Mycobacterium
RDICIYARESHVVVAEAPT

SEQ ID NO: 785682 - protein, 23 aa, Mycobacterium
RDQRDFTLWKAAKPGEPSWPTPW

SEQ ID NO: 785683 - protein, 28 aa, Mycobacterium
RDRGFIPEGLLNYLALLGWAIADDHDVF

SEQ ID NO: 785684 - protein, 20 aa, Mycobacterium
RDRRLLRYDTLILDEAHERS

SEQ ID NO: 785685 - protein, 24 aa, Mycobacterium
RDSAWLLVSILRQLGLAARFVSGY

SEQ ID NO: 785686 - protein, 18 aa, Mycobacterium
RDTTYLYRDGSDFVFMDS

SEQ ID NO: 785687 - protein, 20 aa, Mycobacterium
RDTTYLYRDGSDFVFMDSQD

SEQ ID NO: 785688 - protein, 35 aa, Mycobacterium; identical to SEQ ID NO: 117051

SEQ ID NO: 785689 - protein, 21 aa, Mycobacterium
RDYVMALGYLQAPVVVAGNDH

SEQ ID NO: 785690 - protein, 21 aa, Mycobacterium
RDYVMALGYLQAPVVVAGNEH

SEQ ID NO: 785691 - protein, 20 aa, Mycobacterium
REACLWSPALAGAGVRRRAT

SEQ ID NO: 785692 - protein, 17 aa, Mycobacterium
REAFEVDILTIGLLIAE

SEQ ID NO: 785693 - protein, 17 aa, Mycobacterium
REAKSYFLNIKGPELLN

SEQ ID NO: 785694 - protein, 17 aa, Mycobacterium
REELDAYVVRRLNLPFR

SEQ ID NO: 785695 - protein, 22 aa, Mycobacterium
REELDAYVVRRLNLPFRDVDWT

SEQ ID NO: 785696 - protein, 23 aa, Mycobacterium
REETPWPVIQEAAKVGLYSPDFF

SEQ ID NO: 785697 - protein, 30 aa, Mycobacterium
REEVKFGIEPWFRYFQKVAAFPQMTMPGEQ

SEQ ID NO: 785698 - protein, 25 aa, Mycobacterium
RELGGCTRVWRFDRMATVCDPGSGR

SEQ ID NO: 785699 - protein, 18 aa, Mycobacterium
RELREKRFMKIISLAPEV

SEQ ID NO: 785700 - protein, 30 aa, Mycobacterium
REPVGVVGAIVPWNFPFEVTINKLGQALGT

SEQ ID NO: 785701 - protein, 18 aa, Mycobacterium
RERGFDLCIYMLGADHHG

SEQ ID NO: 785702 - protein, 18 aa, Mycobacterium
RERLGVHPVYKTVDTCAA

SEQ ID NO: 785703 - protein, 27 aa, Mycobacterium
RERRIIKIRFTRRWGPHRIAAHLRLAR

SEQ ID NO: 785704 - protein, 26 aa, Mycobacterium
RETDGDRYLPIWIGQSEAAAIALEQQ

SEQ ID NO: 785705 - protein, 26 aa, Mycobacterium
REVQNFLRLASPPAASSRFLDLGTDS

SEQ ID NO: 785706 - protein, 18 aa, Mycobacterium
REWILRNSPVPVGTVPIY

SEQ ID NO: 785707 - protein, 17 aa, Mycobacterium
RFCAFAQRKGDADAYSL

SEQ ID NO: 785708 - protein, 28 aa, Mycobacterium
RFFELIGAPMTSFYDWYADLPVASPQVF

SEQ ID NO: 785709 - protein, 18 aa, Mycobacterium
RFGSWLRNSTRGALAMDP

SEQ ID NO: 785710 - protein, 19 aa, Mycobacterium
RFIDADRPEFTLLPDQDWS

SEQ ID NO: 785711 - protein, 27 aa, Mycobacterium
RFIRDTTWVSVRWYQPGGPLTAQQVGQ

SEQ ID NO: 785712 - protein, 25 aa, Mycobacterium
RFLERRLRETFGFEGSPIRINVRVR

SEQ ID NO: 785713 - protein, 27 aa, Mycobacterium
RFRSDALQIIAFGRYARTVTAAELTGL

SEQ ID NO: 785714 - protein, 21 aa, Mycobacterium
RFSSAILPAWARKSPQMSEVL

SEQ ID NO: 785715 - protein, 28 aa, Mycobacterium
RFSTNTFPSWPLAHPFRFVAHNGEINTV

SEQ ID NO: 785716 - protein, 17 aa, Mycobacterium
RFYGFMGGETDQWYPDL

SEQ ID NO: 785717 - protein, 22 aa, Mycobacterium
RGAEVAARIRGLVPGGVPGLVD

SEQ ID NO: 785718 - protein, 18 aa, Mycobacterium
RGDKIWVAGYAVRDPSPR

SEQ ID NO: 785719 - protein, 22 aa, Mycobacterium
RGDLAVAIDALRRPERRRGMAV

SEQ ID NO: 785720 - protein, 30 aa, Mycobacterium
RGEYTTGRGPTPFRWSLTAGPAEPATVAAF

SEQ ID NO: 785721 - protein, 24 aa, Mycobacterium
RGFERFYGFLGGETDQWYPDLVYD

SEQ ID NO: 785722 - protein, 20 aa, Mycobacterium
RGFFTSRVIGTFVNEALAML

SEQ ID NO: 785723 - protein, 25 aa, Mycobacterium
RGGKVWINVFPDRPLTKKPAETRMG

SEQ ID NO: 785724 - protein, 25 aa, Mycobacterium
RGGLSAARFVACPFGAAGSRMYRTG

SEQ ID NO: 785725 - protein, 25 aa, Mycobacterium
RGGMSLWVRLPAPMSTALAAAASRM

SEQ ID NO: 785726 - protein, 17 aa, Mycobacterium
RGIDVSFPLGVLTSVTG

SEQ ID NO: 785727 - protein, 18 aa, Mycobacterium
RGIPLTMEMAKFIRFIVT

SEQ ID NO: 785728 - protein, 19 aa, Mycobacterium
RGLALFVSGDNLRKGAALN

SEQ ID NO: 785729 - protein, 22 aa, Mycobacterium
RGLPVLGICRGAQVLNVALGGT

SEQ ID NO: 785730 - protein, 28 aa, Mycobacterium
RGLTMRFLLVELPNERWRFIITAHHIVI

SEQ ID NO: 785731 - protein, 33 aa, Mycobacterium
RGMAVIISDFLGPINWMRPLRAIAGRHEVLGIE

SEQ ID NO: 785732 - protein, 33 aa, Mycobacterium
RGPEMLSFVLKHSPLKLCWVPGYSDYYPETPGG

SEQ ID NO: 785733 - protein, 25 aa, Mycobacterium
RGQNVYPMTLLGTFSPYMVVHRSSV

SEQ ID NO: 785734 - protein, 19 aa, Mycobacterium
RGRHVPKLRQVIGTVFQDF

SEQ ID NO: 785735 - protein, 30 aa, Mycobacterium
RGRMTIDKFAPQISFFFYTHGDFFEEIAKY

SEQ ID NO: 785736 - protein, 18 aa, Mycobacterium
RGRMTIDQFAPQISFFFY

SEQ ID NO: 785737 - protein, 32 aa, Mycobacterium
RGWGAKRPLPHFDDLLFLGASMSRYPLEGYRE

SEQ ID NO: 785738 - protein, 17 aa, Mycobacterium
RGWILNLTSVGGDLPPG

SEQ ID NO: 785739 - protein, 17 aa, Mycobacterium
RGYLHAEDRYRKCFSDG

SEQ ID NO: 785740 - protein, 28 aa, Mycobacterium
RHDTIGFIFQSYNLIPFLSAVENVELPL

SEQ ID NO: 785741 - protein, 18 aa, Mycobacterium
RHERLWEVLGAHPRSFTT

SEQ ID NO: 785742 - protein, 21 aa, Mycobacterium
RHMRSLLNKAFTPRAIQSQRE

SEQ ID NO: 785743 - protein, 25 aa, Mycobacterium
RHNGLTYFMFDLKAKGVTVRPIVQL

SEQ ID NO: 785744 - protein, 19 aa, Mycobacterium
RHQLNRYPDGLEKCIGCEL

SEQ ID NO: 785745 - protein, 29 aa, Mycobacterium
RIAAVPVNQLIMVKLALNSALLQQGVATS

SEQ ID NO: 785746 - protein, 30 aa, Mycobacterium; identical to SEQ ID NO: 122127

SEQ ID NO: 785747 - protein, 19 aa, Mycobacterium
RIAFLPDYDMSMARLLYWG

SEQ ID NO: 785748 - protein, 22 aa, Mycobacterium
RIDGFPLLRAGICAGAVVKRRG

SEQ ID NO: 785749 - protein, 19 aa, Mycobacterium
RIDLRGAELTAARLRAALP

SEQ ID NO: 785750 - protein, 32 aa, Mycobacterium
RIDYPYADNDEWLKWLLVRRGSGGEFDLQFSE

SEQ ID NO: 785751 - protein, 20 aa, Mycobacterium
RINWTDLMRHKRGFTDPAPA

SEQ ID NO: 785752 - protein, 20 aa, Mycobacterium
RIREWQDLVGQLRSICRDLG

SEQ ID NO: 785753 - protein, 19 aa, Mycobacterium
RIRTYPSMEWYGFVLAWHE

SEQ ID NO: 785754 - protein, 18 aa, Mycobacterium
RISEFAEIIGFYGLSYWY

SEQ ID NO: 785755 - protein, 29 aa, Mycobacterium
RISPDVKMNYLASPPLVIAYGIAGTMDFD

SEQ ID NO: 785756 - protein, 27 aa, Mycobacterium
RITEAVYFVERLVDCLAFELKMDPAEV

SEQ ID NO: 785757 - protein, 19 aa, Mycobacterium
RIVGWIMRTDSSDLPWHRV

SEQ ID NO: 785758 - protein, 18 aa, Mycobacterium
RIVVELKRDAVAKVVLNN

SEQ ID NO: 785759 - protein, 17 aa, Mycobacterium
RIWVTEDGLVVMASEAG

SEQ ID NO: 785760 - protein, 20 aa, Mycobacterium
RKELAWLRRGAPARTSKPKF

SEQ ID NO: 785761 - protein, 20 aa, Mycobacterium
RKFLAYYERDGVLVGVVGGG

SEQ ID NO: 785762 - protein, 17 aa, Mycobacterium
RKIGEFQAVAFKLADMK

SEQ ID NO: 785763 - protein, 17 aa, Mycobacterium
RKLEVFTFSCPLHDDEA

SEQ ID NO: 785764 - protein, 20 aa, Mycobacterium
RKNVREHIAFGRGIHTCAGA

SEQ ID NO: 785765 - protein, 26 aa, Mycobacterium
RKRRQPVTVLLKALGWTNEQIVERFG

SEQ ID NO: 785766 - protein, 21 aa, Mycobacterium
RKVDDALWKRYSAAREAFNRR

SEQ ID NO: 785767 - protein, 21 aa, Mycobacterium
RKVDDALWKRYSAARETFNRR

SEQ ID NO: 785768 - protein, 24 aa, Mycobacterium
RKVVVFRPLYAVGGQELGYLPGSE

SEQ ID NO: 785769 - protein, 17 aa, Mycobacterium
RLCDAFGIPLVVVVDVP

SEQ ID NO: 785770 - protein, 23 aa, Mycobacterium
RLCERLLSYASPLHLYAEEIEPR

SEQ ID NO: 785771 - protein, 25 aa, Mycobacterium
RLDRLTAGVLLFTTRRELRGRYQTL

SEQ ID NO: 785772 - protein, 24 aa, Mycobacterium
RLGAQITIFRLGSDPGLARFIDQV

SEQ ID NO: 785773 - protein, 25 aa, Mycobacterium
RLGMANLDWLVVRDLVMIESATFWK

SEQ ID NO: 785774 - protein, 20 aa, Mycobacterium
RLIDTLVRLRDLGNTLIVVE

SEQ ID NO: 785775 - protein, 19 aa, Mycobacterium
RLLTLLNQREIGARRGLII

SEQ ID NO: 785776 - protein, 22 aa, Mycobacterium
RLNLDELRMLVAGFLMAGTDTT

SEQ ID NO: 785777 - protein, 18 aa, Mycobacterium
RLQPGRMFLVDTAQGRIV

SEQ ID NO: 785778 - protein, 21 aa, Mycobacterium
RLREHLLHELADLNPQPARIP

SEQ ID NO: 785779 - protein, 25 aa, Mycobacterium
RLRELLKFEFLFSARAQFEKDLADE

SEQ ID NO: 785780 - protein, 19 aa, Mycobacterium
RLRIDLSALRIVGDGLAWA

SEQ ID NO: 785781 - protein, 21 aa, Mycobacterium
RLRKVKSPFATQLHAGTLARL

SEQ ID NO: 785782 - protein, 25 aa, Mycobacterium
RLRQKVVVPTLPTAAPRWVVDPDFN

SEQ ID NO: 785783 - protein, 27 aa, Mycobacterium
RLTIDDIRWFDLYSCFPSAIEMTAEAL

SEQ ID NO: 785784 - protein, 31 aa, Mycobacterium
RLTTRVIDLIMPIGKGQRALIVSPPKAGKTT

SEQ ID NO: 785785 - protein, 17 aa, Mycobacterium
RLWEVLGAHPRSFTTAD

SEQ ID NO: 785786 - protein, 24 aa, Mycobacterium
RLYSFKDILVLKIVKRLLDTGISL

SEQ ID NO: 785787 - protein, 33 aa, Mycobacterium
RMVFGYDMFDDFPAVLALIADGKLALAPQITAR

SEQ ID NO: 785788 - protein, 19 aa, Mycobacterium
RMYEEWATLADLREGDRYL

SEQ ID NO: 785789 - protein, 20 aa, Mycobacterium
RNEDPGCPMGSYVAPDAIKN

SEQ ID NO: 785790 - protein, 40 aa, Mycobacterium; identical to SEQ ID NO: 222402

SEQ ID NO: 785791 - protein, 20 aa, Mycobacterium
RNIVNMLHGVRDGLIRDANN

SEQ ID NO: 785792 - protein, 19 aa, Mycobacterium
RNPLLTEAMTRAFVFADAS

SEQ ID NO: 785793 - protein, 22 aa, Mycobacterium
RNQIQLFNALLLSLPGSPVLYY

SEQ ID NO: 785794 - protein, 19 aa, Mycobacterium
RNRLKIATGLTLSPTLIFD

SEQ ID NO: 785795 - protein, 24 aa, Mycobacterium
RNRYWGTPIPVWKSDDPAYPRIDV

SEQ ID NO: 785796 - protein, 17 aa, Mycobacterium
RNVFSYVPGTRALLRAA

SEQ ID NO: 785797 - protein, 23 aa, Mycobacterium
RPAITLSWIRELPSLGAAARPVQ

SEQ ID NO: 785798 - protein, 27 aa, Mycobacterium
RPAMPAECLLDRNALIMGYSGVYSSFL

SEQ ID NO: 785799 - protein, 17 aa, Mycobacterium
RPDTPFRYESDPPFEHD

SEQ ID NO: 785800 - protein, 22 aa, Mycobacterium
RPGGLAVLSYTVWLGPFGGHEM

SEQ ID NO: 785801 - protein, 21 aa, Mycobacterium
RPGLAALLHYAREGDTVVVTA

SEQ ID NO: 785802 - protein, 27 aa, Mycobacterium
RPGQKLRIVKYLAYGWSSLRSRPALRD

SEQ ID NO: 785803 - protein, 24 aa, Mycobacterium
RPGQRSFTLDDLSLRYLRRELRAE

SEQ ID NO: 785804 - protein, 33 aa, Mycobacterium
RPILHLPEHWPWTEHWLTLWRNTIGYSPPLPAT

SEQ ID NO: 785805 - protein, 20 aa, Mycobacterium
RPLLMWLRELAQFGCPVDEC

SEQ ID NO: 785806 - protein, 20 aa, Mycobacterium
RPRKTLGWRTPAEAFAEHLH

SEQ ID NO: 785807 - protein, 18 aa, Mycobacterium
RPSAIYVGPAPRSPESVE

SEQ ID NO: 785808 - protein, 19 aa, Mycobacterium
RPTLRHRIMLRPEAELEGA

SEQ ID NO: 785809 - protein, 23 aa, Mycobacterium
RPVDFGSFLIPRSEYRIDDVWHV

SEQ ID NO: 785810 - protein, 23 aa, Mycobacterium
RPVTPPLVHDFHLPPSGGVGCSS

SEQ ID NO: 785811 - protein, 31 aa, Mycobacterium
RPYDLSFSRYELLRLLAFSRTGALPITKASD

SEQ ID NO: 785812 - protein, 23 aa, Mycobacterium
RQALTYRPSDALARFIRARDLTC

SEQ ID NO: 785813 - protein, 26 aa, Mycobacterium
RQEDFIGIHFFSPVDKMPLVEIIKGE

SEQ ID NO: 785814 - protein, 22 aa, Mycobacterium
RQFQVFLDDVRLPADALVGAQD

SEQ ID NO: 785815 - protein, 20 aa, Mycobacterium
RQFRASVCVLGPLVGRCKKA

SEQ ID NO: 785816 - protein, 20 aa, Mycobacterium
RQFRASVCVLGPLVGRCKRA

SEQ ID NO: 785817 - protein, 18 aa, Mycobacterium
RQFYKLGVSPIPPNKPNI

SEQ ID NO: 785818 - protein, 17 aa, Mycobacterium
RQHYIRILPEDRVVVEL

SEQ ID NO: 785819 - protein, 20 aa, Mycobacterium
RQKFNPLVRLDSVNGGPVED

SEQ ID NO: 785820 - protein, 19 aa, Mycobacterium
RQLTADFNFAWPTARIAVI

SEQ ID NO: 785821 - protein, 19 aa, Mycobacterium
RQMLRRVTIIDSGATEFLP

SEQ ID NO: 785822 - protein, 18 aa, Mycobacterium
RQQRVPLGVVGMIYEGRP

SEQ ID NO: 785823 - protein, 17 aa, Mycobacterium
RQRTLNWCINWSYERCT

SEQ ID NO: 785824 - protein, 27 aa, Mycobacterium
RQRTYIERMASWRMGDRHRGWASVWAL

SEQ ID NO: 785825 - protein, 24 aa, Mycobacterium
RQSDYGVKPYSLLMGSLQVADEVT

SEQ ID NO: 785826 - protein, 23 aa, Mycobacterium
RRAADMLKPCTLELGGKSAAIVL

SEQ ID NO: 785827 - protein, 23 aa, Mycobacterium
RRAEVTSLLRFAGGLHIVGGRVV

SEQ ID NO: 785828 - protein, 19 aa, Mycobacterium
RREQPLPHGLRGLLADLHS

SEQ ID NO: 785829 - protein, 26 aa, Mycobacterium
RRFARERSRWLFSNPDMIHLSILRNH

SEQ ID NO: 785830 - protein, 26 aa, Mycobacterium
RRGALSAARFVACPFGAAGSRMYRTG

SEQ ID NO: 785831 - protein, 26 aa, Mycobacterium
RRGEYLYNFWRDAANPRGLWRRTTLD

SEQ ID NO: 785832 - protein, 26 aa, Mycobacterium
RRGGLSAARFVACPFGAGGSRMYRTG

SEQ ID NO: 785833 - protein, 25 aa, Mycobacterium
RRGKAIIILNPADPPMIMRDTIFCA

SEQ ID NO: 785834 - protein, 25 aa, Mycobacterium
RRGQPRLRPPFPAVAGLYACPTVVN

SEQ ID NO: 785835 - protein, 19 aa, Mycobacterium
RRGRYFDIGSPTDAPGVLT

SEQ ID NO: 785836 - protein, 19 aa, Mycobacterium
RRISMIRSIYPGQTATLSG

SEQ ID NO: 785837 - protein, 22 aa, Mycobacterium
RRLREKFPTLQDPPSDDICYAT

SEQ ID NO: 785838 - protein, 22 aa, Mycobacterium
RRLRRTTWNSGCSSWYLTEDGY

SEQ ID NO: 785839 - protein, 19 aa, Mycobacterium
RRLYGVAYTLDKVGDIYLV

SEQ ID NO: 785840 - protein, 19 aa, Mycobacterium
RRRIWELEKRRAHVPWVTW

SEQ ID NO: 785841 - protein, 25 aa, Mycobacterium
RRRPVLIHRALFGSIERFFGVLTEH

SEQ ID NO: 785842 - protein, 20 aa, Mycobacterium
RRRREELAALGDKVARRVLE

SEQ ID NO: 785843 - protein, 19 aa, Mycobacterium
RRRVKAMSYGLAYGLSAYG

SEQ ID NO: 785844 - protein, 24 aa, Mycobacterium
RRSRGTPRIANRLLRRVRDYAEVR

SEQ ID NO: 785845 - protein, 26 aa, Mycobacterium
RRTMARVFPNLFATHRVRAVGDYASH

SEQ ID NO: 785846 - protein, 17 aa, Mycobacterium
RRVKAMSYGLAYGLSAY

SEQ ID NO: 785847 - protein, 25 aa, Mycobacterium
RRVVDKLLHAPTVRVKQLASAPGGD

SEQ ID NO: 785848 - protein, 26 aa, Mycobacterium
RRWQRLLFDSGWLLPGNPPEFGGRNA

SEQ ID NO: 785849 - protein, 27 aa, Mycobacterium
RRYEGVLDHIVLYSPSIGLAPERIAEN

SEQ ID NO: 785850 - protein, 21 aa, Mycobacterium
RSAAYAMRWVAKNVVAAGLAE

SEQ ID NO: 785851 - protein, 22 aa, Mycobacterium
RSADDIYLLYTGGTTGFPKGVM

SEQ ID NO: 785852 - protein, 19 aa, Mycobacterium
RSDILAFTLPGFATGDRTK

SEQ ID NO: 785853 - protein, 27 aa, Mycobacterium
RSEMEMKVLLWAVQRLIGGLSKIGAER

SEQ ID NO: 785854 - protein, 29 aa, Mycobacterium
RSGFVVNALLVPYLLSAIRMVEAGFATVE

SEQ ID NO: 785855 - protein, 20 aa, Mycobacterium
RSGKIMRRLLRDVAEGRELG

SEQ ID NO: 785856 - protein, 24 aa, Mycobacterium
RSGYPLELLVRAAAAGWRVVELDV

SEQ ID NO: 785857 - protein, 22 aa, Mycobacterium
RSLFEHRAVVVGAGRDELLAGL

SEQ ID NO: 785858 - protein, 23 aa, Mycobacterium
RSLLELAKLDAELSRIAHRSTHL

SEQ ID NO: 785859 - protein, 19 aa, Mycobacterium
RSLWLVDEIKRSPAGKPDY

SEQ ID NO: 785860 - protein, 23 aa, Mycobacterium
RSRDLHDALRRRCLYHWIDYPEP

SEQ ID NO: 785861 - protein, 27 aa, Mycobacterium
RSRERGYAYFLYPPQAPLTETAYDRLA

SEQ ID NO: 785862 - protein, 24 aa, Mycobacterium
RSRQFYESVFGWPVLLEVPDNADE

SEQ ID NO: 785863 - protein, 17 aa, Mycobacterium
RSSLIGGIRYYDTVVDD

SEQ ID NO: 785864 - protein, 26 aa, Mycobacterium
RSSRFTMLVHLPREVGYGIIPRTKNG

SEQ ID NO: 785865 - protein, 17 aa, Mycobacterium
RSTIRWTLHQLVASGVV

SEQ ID NO: 785866 - protein, 18 aa, Mycobacterium
RSVLQWDKDDCAAIGLVK

SEQ ID NO: 785867 - protein, 24 aa, Mycobacterium
RTAEQVFIPLTVGGGVRTVADVDV

SEQ ID NO: 785868 - protein, 18 aa, Mycobacterium
RTAFKPSYGIAEATLLVA

SEQ ID NO: 785869 - protein, 23 aa, Mycobacterium
RTAGYLAIGLAIAAGAPVCVAMT

SEQ ID NO: 785870 - protein, 25 aa, Mycobacterium
RTDVDDWWEYGWVFHAMNTNKRSVT

SEQ ID NO: 785871 - protein, 19 aa, Mycobacterium
RTHGRTWDLLRLTRMPTVQ

SEQ ID NO: 785872 - protein, 26 aa, Mycobacterium
RTIAILRICALLRCAYEWGGQAAFWG

SEQ ID NO: 785873 - protein, 27 aa, Mycobacterium
RTIYLSTLFFHGFIDRGLNEWAGPDAL

SEQ ID NO: 785874 - protein, 24 aa, Mycobacterium
RTLDVPALAGVRVDSGFRAGSVIS

SEQ ID NO: 785875 - protein, 17 aa, Mycobacterium
RTLVAHNVAFDYAFLAA

SEQ ID NO: 785876 - protein, 23 aa, Mycobacterium
RTQHNVYIPWSMTVTPISQSDVG

SEQ ID NO: 785877 - protein, 22 aa, Mycobacterium
RTSLSQVLPPYMVPAAFVVIDE

SEQ ID NO: 785878 - protein, 19 aa, Mycobacterium
RTTLGLDPGFRTGVKVAVV

SEQ ID NO: 785879 - protein, 21 aa, Mycobacterium
RTYFQAYAAACALHFAEKALT

SEQ ID NO: 785880 - protein, 18 aa, Mycobacterium
RVALVEKHDLAFGTSRWS

SEQ ID NO: 785881 - protein, 22 aa, Mycobacterium
RVDAYRFLTQNLGQAFDLALET

SEQ ID NO: 785882 - protein, 19 aa, Mycobacterium
RVGFLGWSMGGYGALLLGA

SEQ ID NO: 785883 - protein, 24 aa, Mycobacterium
RVGISQMHVSRLLAKSLARLRDQL

SEQ ID NO: 785884 - protein, 23 aa, Mycobacterium
RVGISQMHVSRLLAKSLTRLRDQ

SEQ ID NO: 785885 - protein, 17 aa, Mycobacterium
RVHRNAPPFLVIHGSKD

SEQ ID NO: 785886 - protein, 20 aa, Mycobacterium
RVKATLPRLGELAIGGTAVG

SEQ ID NO: 785887 - protein, 19 aa, Mycobacterium
RVLENIYRALRPGGVLLMA

SEQ ID NO: 785888 - protein, 19 aa, Mycobacterium
RVLRTLDIGQACKLTIPSR

SEQ ID NO: 785889 - protein, 18 aa, Mycobacterium
RVLRVGVAEFRRSLDRVM

SEQ ID NO: 785890 - protein, 17 aa, Mycobacterium
RVPLGVVGMIYEGRPNV

SEQ ID NO: 785891 - protein, 26 aa, Mycobacterium
RVSSKYALVIYAAKRARQINDYYNQL

SEQ ID NO: 785892 - protein, 22 aa, Mycobacterium
RVVEWLVDKFKGTSGIDLTKDK

SEQ ID NO: 785893 - protein, 20 aa, Mycobacterium
RVWELETYGALFDRLKDGKI

SEQ ID NO: 785894 - protein, 19 aa, Mycobacterium
RVYAKSTNLPRVLGGLGVA

SEQ ID NO: 785895 - protein, 19 aa, Mycobacterium
RVYQINYLRCIGCGLCIEA

SEQ ID NO: 785896 - protein, 25 aa, Mycobacterium
RWERGRPMELWQMDVVGGLHLRDGI

SEQ ID NO: 785897 - protein, 32 aa, Mycobacterium; identical to SEQ ID NO: 122352

SEQ ID NO: 785898 - protein, 22 aa, Mycobacterium
RWRDGQMALRWCAAGMVEAGKQ

SEQ ID NO: 785899 - protein, 20 aa, Mycobacterium
RYGRLQLVKHPAHGLTLVSF

SEQ ID NO: 785900 - protein, 20 aa, Mycobacterium
RYGRLQLVKHPAHGLTLVSL

SEQ ID NO: 785901 - protein, 21 aa, Mycobacterium
RYINDRFLPDKAIDLIDEAGA

SEQ ID NO: 785902 - protein, 18 aa, Mycobacterium
RYLKKITVSTTTGPGIPV

SEQ ID NO: 785903 - protein, 19 aa, Mycobacterium
RYLRTLVDVGLGYVRLGQP

SEQ ID NO: 785904 - protein, 28 aa, Mycobacterium
RYQTLHTYFLDRLLPVCAQLLDAAVASN

SEQ ID NO: 785905 - protein, 27 aa, Mycobacterium
RYRDRGRPFLAFLYGIAAHKVADAHRA

SEQ ID NO: 785906 - protein, 25 aa, Mycobacterium
RYSRRLRRVMYMSALTAIRCDPDSK

SEQ ID NO: 785907 - protein, 25 aa, Mycobacterium
SAAETYLDIHRIIAAASLTGADAVH

SEQ ID NO: 785908 - protein, 25 aa, Mycobacterium
SAARIGGITYFHEYAYDLLAENERI

SEQ ID NO: 785909 - protein, 26 aa, Mycobacterium
SACNPYLAFAVLLAAGLRGVEKGYVL

SEQ ID NO: 785910 - protein, 23 aa, Mycobacterium
SAESYLDFEKLLDAAAKSGANAI

SEQ ID NO: 785911 - protein, 24 aa, Mycobacterium
SAESYLDFGKLLDAAAKSGANAVH

SEQ ID NO: 785912 - protein, 17 aa, Mycobacterium
SAEVACIPSLYEGFSLP

SEQ ID NO: 785913 - protein, 21 aa, Mycobacterium
SAGHIYAVIGLKDTTTGDTLS

SEQ ID NO: 785914 - protein, 17 aa, Mycobacterium
SAGIIDAGLSRGLAGVS

SEQ ID NO: 785915 - protein, 21 aa, Mycobacterium
SAIPVVAFRLAGDRGYTEFDL

SEQ ID NO: 785916 - protein, 18 aa, Mycobacterium
SALALRFYGDAELYRLIA

SEQ ID NO: 785917 - protein, 25 aa, Mycobacterium
SALARLGPLLVVTATGREADDLTAE

SEQ ID NO: 785918 - protein, 23 aa, Mycobacterium
SALGPKLPELWGGSADLAGSNNT

SEQ ID NO: 785919 - protein, 19 aa, Mycobacterium
SALLVVKRGPNAGSRFLLD

SEQ ID NO: 785920 - protein, 20 aa, Mycobacterium
SALWEASLFEEHGFGDIKIS

SEQ ID NO: 785921 - protein, 18 aa, Mycobacterium
SANLAVLRTPPGGAHYLA

SEQ ID NO: 785922 - protein, 25 aa, Mycobacterium
SAPMCDIFLVLAQAPGGLSCFMLPR

SEQ ID NO: 785923 - protein, 32 aa, Mycobacterium
SARASQTWRYPPFFHALLDAGVYPPCSAFEAW

SEQ ID NO: 785924 - protein, 22 aa, Mycobacterium
SARIDLAFFVGERWTEAGEPAG

SEQ ID NO: 785925 - protein, 25 aa, Mycobacterium
SASGRTLTFPGFLKAYVETVDELVG

SEQ ID NO: 785926 - protein, 20 aa, Mycobacterium
SCFVVCNEILPRWGVETVFV

SEQ ID NO: 785927 - protein, 19 aa, Mycobacterium
SCVPLLKQLLEAEGVEQSK

SEQ ID NO: 785928 - protein, 26 aa, Mycobacterium
SDEALARVFDYTLAIGKTPIVVNDSR

SEQ ID NO: 785929 - protein, 26 aa, Mycobacterium
SDELIDYLTMLSWSALCGIVEAGGSL

SEQ ID NO: 785930 - protein, 23 aa, Mycobacterium
SDGPSMIFTVSNSGFYAAGGGPL

SEQ ID NO: 785931 - protein, 19 aa, Mycobacterium
SDPVIMLTGPTPATRKVLD

SEQ ID NO: 785932 - protein, 33 aa, Mycobacterium
SDTDALLSLLLLIFPHLALAPYMRGLDPILGLD

SEQ ID NO: 785933 - protein, 24 aa, Mycobacterium
SDTVLVFMHPIGGGAYLPMINALA

SEQ ID NO: 785934 - protein, 18 aa, Mycobacterium
SDYLAGRAFSFISAIDSI

SEQ ID NO: 785935 - protein, 32 aa, Mycobacterium
SDYYDKAGLWPYLEKLGFYLVGYGCTTCIGNS

SEQ ID NO: 785936 - protein, 23 aa, Mycobacterium
SEAAVEHLFAVASGLDSAVVGEQ

SEQ ID NO: 785937 - protein, 17 aa, Mycobacterium
SEARILGIFVDGKRVPV

SEQ ID NO: 785938 - protein, 24 aa, Mycobacterium
SEELIGQFGIGFYSSFMVADKVEL

SEQ ID NO: 785939 - protein, 25 aa, Mycobacterium
SEFVIRRAMSQLGVPYSWGGGNANG

SEQ ID NO: 785940 - protein, 20 aa, Mycobacterium
SEGIGTIAAAFWPKPVVVRM

SEQ ID NO: 785941 - protein, 24 aa, Mycobacterium
SEGKRFMFDYIPSVFKGQYAETEE

SEQ ID NO: 785942 - protein, 30 aa, Mycobacterium
SEHFYDSIDPLWWGWRNHMKIFFNNKGVVA

SEQ ID NO: 785943 - protein, 25 aa, Mycobacterium
SEPRRAWFPIDRSMVLYYCSLVEDA

SEQ ID NO: 785944 - protein, 18 aa, Mycobacterium
SEVSFPKPVFHGDTLYAE

SEQ ID NO: 785945 - protein, 20 aa, Mycobacterium
SEVSITRRMFRDGAGEYEIN

SEQ ID NO: 785946 - protein, 23 aa, Mycobacterium
SFELTQKAVMAGIPVLAAVSAPS

SEQ ID NO: 785947 - protein, 25 aa, Mycobacterium
SFFRGELIYVFDGDAAGRAAALKAF

SEQ ID NO: 785948 - protein, 19 aa, Mycobacterium
SFGYLYGTPGFQAPEIVRT

SEQ ID NO: 785949 - protein, 22 aa, Mycobacterium
SFMALNYLYHLMNMIAEGVFER

SEQ ID NO: 785950 - protein, 17 aa, Mycobacterium
SFNLFAHKTILENVTLA

SEQ ID NO: 785951 - protein, 34 aa, Mycobacterium
SFSTTDVEFYKWTQWIFLQIYNAWFDTAANKARP

SEQ ID NO: 785952 - protein, 18 aa, Mycobacterium
SFTPVLIPTSRGILATCT

SEQ ID NO: 785953 - protein, 27 aa, Mycobacterium
SGAGSEPMLAAAAAWDGLSAELGEAAE

SEQ ID NO: 785954 - protein, 25 aa, Mycobacterium
SGASRYRHWLTHKLGTWHDQFDMSG

SEQ ID NO: 785955 - protein, 26 aa, Mycobacterium
SGDDALNLPWLAMGATGFISVISHVA

SEQ ID NO: 785956 - protein, 33 aa, Mycobacterium
SGDMLRRSGPRKDGVPLWWKSAARNKSSVAVDL

SEQ ID NO: 785957 - protein, 25 aa, Mycobacterium
SGEDHAWSYVFLASHRSRGLTGETI

SEQ ID NO: 785958 - protein, 26 aa, Mycobacterium
SGFENIIIRGLFLGQTRKQMLAKVDE

SEQ ID NO: 785959 - protein, 18 aa, Mycobacterium
SGGNGGWFAGNAGAGGNG

SEQ ID NO: 785960 - protein, 29 aa, Mycobacterium
SGGRGIHVFLRIATDWDFVEVRRAGIALA

SEQ ID NO: 785961 - protein, 31 aa, Mycobacterium; identical to SEQ ID NO: 122441

SEQ ID NO: 785962 - protein, 19 aa, Mycobacterium
SGIGFGLHNDIVAPYLLAL

SEQ ID NO: 785963 - protein, 23 aa, Mycobacterium
SGIGSLLMGIPGPSGLHFAGRVG

SEQ ID NO: 785964 - protein, 24 aa, Mycobacterium
SGLDARAYRLDWPAGMTVFEIDQP

SEQ ID NO: 785965 - protein, 17 aa, Mycobacterium
SGLDIALFSAGATMSRV

SEQ ID NO: 785966 - protein, 23 aa, Mycobacterium
SGLDPVRTAYLSQLLIDINAQID

SEQ ID NO: 785967 - protein, 24 aa, Mycobacterium
SGLDPVRTAYLSQLLIDINAQIDA

SEQ ID NO: 785968 - protein, 18 aa, Mycobacterium
SGLRGGILIPARWVGYPP

SEQ ID NO: 785969 - protein, 26 aa, Mycobacterium
SGLRHLNGFPGGPPPRLALSLGDSLA

SEQ ID NO: 785970 - protein, 23 aa, Mycobacterium
SGLVIALLCRGHVLLEGVPGVAK

SEQ ID NO: 785971 - protein, 18 aa, Mycobacterium
SGMNLALAADWRVSGDNA

SEQ ID NO: 785972 - protein, 18 aa, Mycobacterium
SGNLAVLRTPPGAAHYLA

SEQ ID NO: 785973 - protein, 29 aa, Mycobacterium
SGPDELRRWIPLLSRFRVVSVRGPRSAQL

SEQ ID NO: 785974 - protein, 25 aa, Mycobacterium
SGQAGALRLAIARALILVQPEDRPA

SEQ ID NO: 785975 - protein, 23 aa, Mycobacterium
SGQSCILPSRILLPRSRYDEGIE

SEQ ID NO: 785976 - protein, 26 aa, Mycobacterium
SGRPLAMPRLDMVTGLYYLTTEVDAA

SEQ ID NO: 785977 - protein, 25 aa, Mycobacterium
SGTAWQIFPNFQIGQGLTTALCYSA

SEQ ID NO: 785978 - protein, 19 aa, Mycobacterium
SGTLGLGLALAGIIYRHPV

SEQ ID NO: 785979 - protein, 25 aa, Mycobacterium
SGYGLPMALTLFRRDLDVWAPGEHN

SEQ ID NO: 785980 - protein, 24 aa, Mycobacterium
SHDENLHMIFYRDVSAAGLDIAPN

SEQ ID NO: 785981 - protein, 38 aa, Mycobacterium; identical to SEQ ID NO: 122459

SEQ ID NO: 785982 - protein, 18 aa, Mycobacterium
SHGWGVPGLSWLPGEGPD

SEQ ID NO: 785983 - protein, 25 aa, Mycobacterium
SHITWYTVLACFKLGIVIEGTLARA

SEQ ID NO: 785984 - protein, 38 aa, Mycobacterium
SHSLSFASLVFYSSWFKLHHPAAFCAALLRAQPMGFYS

SEQ ID NO: 785985 - protein, 27 aa, Mycobacterium
SIENGSEWVHRLAKRLKKLANQHPRSF

SEQ ID NO: 785986 - protein, 26 aa, Mycobacterium
SIENGSYFVYRLIKRLKKSANNAPYH

SEQ ID NO: 785987 - protein, 22 aa, Mycobacterium
SIIANRVSYFYDFRGPSVAVDT

SEQ ID NO: 785988 - protein, 22 aa, Mycobacterium
SINLPYITVDADKNPLFLDEQL

SEQ ID NO: 785989 - protein, 20 aa, Mycobacterium
SISPRDALASAGKTLVELFG

SEQ ID NO: 785990 - protein, 21 aa, Mycobacterium
SIVPSLKRYVLEMRFKPMPRY

SEQ ID NO: 785991 - protein, 19 aa, Mycobacterium
SKDAFLIRMTEERFEEVIN

SEQ ID NO: 785992 - protein, 17 aa, Mycobacterium
SKEELFNLRFQMATGQL

SEQ ID NO: 785993 - protein, 24 aa, Mycobacterium
SKEELFNLRFQMATGQLSNNRRLR

SEQ ID NO: 785994 - protein, 25 aa, Mycobacterium
SKLPKVFFVNWFRRGDDGRFLWPGF

SEQ ID NO: 785995 - protein, 23 aa, Mycobacterium
SKPAIYRRWPSKAHLVHEAVFPI

SEQ ID NO: 785996 - protein, 19 aa, Mycobacterium
SKPLVRLRVPFTLSRNEID

SEQ ID NO: 785997 - protein, 27 aa, Mycobacterium
SKSLGNVLAIPALLQRVRPAELRYYLG

SEQ ID NO: 785998 - protein, 18 aa, Mycobacterium
SLAPVAAALGEQLGRHVQ

SEQ ID NO: 785999 - protein, 21 aa, Mycobacterium
SLDALEIEALTWQNPATLAAM

SEQ ID NO: 786000 - protein, 19 aa, Mycobacterium
SLDNFVDWLIEAGYPIARI

SEQ ID NO: 786001 - protein, 19 aa, Mycobacterium
SLDPALPDGISRLRFRLRW

SEQ ID NO: 786002 - protein, 23 aa, Mycobacterium
SLDVNRHLLKEIQLRMVFGYDMF

SEQ ID NO: 786003 - protein, 27 aa, Mycobacterium
SLELVEVIQPVLFAVMIALAETLRGYG

SEQ ID NO: 786004 - protein, 20 aa, Mycobacterium
SLEPRWFAWVDDMHDWCISR

SEQ ID NO: 786005 - protein, 23 aa, Mycobacterium
SLPSVLPTALRELIRYVRPPWLR

SEQ ID NO: 786006 - protein, 21 aa, Mycobacterium
SLRERLGIHPVYKTVDTCAAE

SEQ ID NO: 786007 - protein, 25 aa, Mycobacterium
SLRQEGMLALARLQRKMRLVESPYR

SEQ ID NO: 786008 - protein, 19 aa, Mycobacterium
SLSFKLYTAERTAGALNLF

SEQ ID NO: 786009 - protein, 24 aa, Mycobacterium
SLSMTPLVNWRIPGPELKFEERWM

SEQ ID NO: 786010 - protein, 29 aa, Mycobacterium
SLSPTEFTLLRYFIINAGTVLSKPKILDH

SEQ ID NO: 786011 - protein, 31 aa, Mycobacterium
SLTAVAMLVAIFRARPSPFYVMDEVEAALDD

SEQ ID NO: 786012 - protein, 22 aa, Mycobacterium
SLTQLELLLITAAVAEGWAVSV

SEQ ID NO: 786013 - protein, 18 aa, Mycobacterium
SLVLFDVSTLYFETDAGD

SEQ ID NO: 786014 - protein, 17 aa, Mycobacterium
SLVNWDALAAMSGTIVL

SEQ ID NO: 786015 - protein, 21 aa, Mycobacterium
SLVQVAWALVLGALTGRDDVV

SEQ ID NO: 786016 - protein, 19 aa, Mycobacterium
SLWANAWLAGKAAPDDVLD

SEQ ID NO: 786017 - protein, 31 aa, Mycobacterium; identical to SEQ ID NO: 223037

SEQ ID NO: 786018 - protein, 22 aa, Mycobacterium
SMGNYIFTTKVLIDAIRADADD

SEQ ID NO: 786019 - protein, 28 aa, Mycobacterium
SMQRKRFGRIIFIGSVSGMWGIGNQANY

SEQ ID NO: 786020 - protein, 32 aa, Mycobacterium
SNLKVLCRQHHLLKTFWGWRDEQLPDGTLIWR

SEQ ID NO: 786021 - protein, 21 aa, Mycobacterium
SNVMIGSWFAGTYESPGDLMR

SEQ ID NO: 786022 - protein, 28 aa, Mycobacterium
SPEGGWIRTWLDTVLDLPWNVRTEDSTD

SEQ ID NO: 786023 - protein, 17 aa, Mycobacterium
SPEWWVANVKPGRVLFE

SEQ ID NO: 786024 - protein, 17 aa, Mycobacterium
SPFATQLHAGTLARLEW

SEQ ID NO: 786025 - protein, 17 aa, Mycobacterium
SPGRLERMRSAPTVFID

SEQ ID NO: 786026 - protein, 24 aa, Mycobacterium
SPHNERLYCIPATIDLAGAEIELV

SEQ ID NO: 786027 - protein, 24 aa, Mycobacterium
SPLASALMRVGIAPTLIGTRGGRP

SEQ ID NO: 786028 - protein, 26 aa, Mycobacterium
SPQAQRMLKFAFNLLDDGLVGQQLFA

SEQ ID NO: 786029 - protein, 18 aa, Mycobacterium
SPTLLYLAAAGVGTIGIV

SEQ ID NO: 786030 - protein, 24 aa, Mycobacterium
SPVGQMAWIVEKFAAWMDCDGHPE

SEQ ID NO: 786031 - protein, 26 aa, Mycobacterium
SPVPGAALFVLDKWLRPAPEGVVGEL

SEQ ID NO: 786032 - protein, 18 aa, Mycobacterium
SPVRSAWLDVPSLVEAAK

SEQ ID NO: 786033 - protein, 18 aa, Mycobacterium
SQVKLIAEPWDIGEGGYQ

SEQ ID NO: 786034 - protein, 29 aa, Mycobacterium
SQYSPLFHGDSFHHLWYQLTQISVKMKQR

SEQ ID NO: 786035 - protein, 24 aa, Mycobacterium
SRAGWLRWSDKLAAAPLKPGKGPI

SEQ ID NO: 786036 - protein, 24 aa, Mycobacterium
SRARYLMLRLLERAGEQRVAIPSL

SEQ ID NO: 786037 - protein, 19 aa, Mycobacterium
SRERLLEIGPSIGCPLLLK

SEQ ID NO: 786038 - protein, 20 aa, Mycobacterium
SRILEEVWGFDFPTSGNALE

SEQ ID NO: 786039 - protein, 24 aa, Mycobacterium
SRPELLDVLAAAETLLAATGNAVA

SEQ ID NO: 786040 - protein, 22 aa, Mycobacterium
SRQTVHAWLRRYAEEGAALNLE

SEQ ID NO: 786041 - protein, 20 aa, Mycobacterium
SRRCRAVRLVPFDPHLEEGA

SEQ ID NO: 786042 - protein, 25 aa, Mycobacterium
SRYVDAIVWRTFAQERLTAMASGAS

SEQ ID NO: 786043 - protein, 24 aa, Mycobacterium
SSCATCDGFFFRDQDIAVIGGGDS

SEQ ID NO: 786044 - protein, 19 aa, Mycobacterium
SSEWQYHTPLYLGDRLQGT

SEQ ID NO: 786045 - protein, 23 aa, Mycobacterium
SSGGAVPVVPWVVSAKSGSALGA

SEQ ID NO: 786046 - protein, 24 aa, Mycobacterium
SSNEYVVGWIKRGPTGVIGTNKKD

SEQ ID NO: 786047 - protein, 24 aa, Mycobacterium
SSNKAFYRYFAGKDDLILAVMERG

SEQ ID NO: 786048 - protein, 31 aa, Mycobacterium
SSPRLYGGTYNLFHYSLAKLGIEVSFVDDPD

SEQ ID NO: 786049 - protein, 25 aa, Mycobacterium
SSSEIAMFFILLVVAGNETTRNAIS

SEQ ID NO: 786050 - protein, 24 aa, Mycobacterium
SSSTGVLPLLPTSASLLQLCSAAL

SEQ ID NO: 786051 - protein, 22 aa, Mycobacterium
SSTVLFLGRHVGYPVALEGALK

SEQ ID NO: 786052 - protein, 23 aa, Mycobacterium
SSYLLPQLVGRQNAAWLLMSSEW

SEQ ID NO: 786053 - protein, 24 aa, Mycobacterium
SSYLLPQLVGRQNAAWLLMSSEWV

SEQ ID NO: 786054 - protein, 24 aa, Mycobacterium
STAGSLQAQWRGAAGTAAQAAVVR

SEQ ID NO: 786055 - protein, 23 aa, Mycobacterium
STAGTVELLKWAKGQGISITAEV

SEQ ID NO: 786056 - protein, 19 aa, Mycobacterium
STALFLAAQAIRGGIVDCA

SEQ ID NO: 786057 - protein, 18 aa, Mycobacterium
STDLLEVTPFIVLGTSST

SEQ ID NO: 786058 - protein, 23 aa, Mycobacterium
STLLAALLRQNPRFQAGMSGPLA

SEQ ID NO: 786059 - protein, 30 aa, Mycobacterium
STQFLDLEDLPPRIVFVGGGYISFEFAHIA

SEQ ID NO: 786060 - protein, 17 aa, Mycobacterium
STYARFLDITDEDFRHT

SEQ ID NO: 786061 - protein, 25 aa, Mycobacterium
SVAGFRYRVPIVLAGEPVSVVVADN

SEQ ID NO: 786062 - protein, 24 aa, Mycobacterium
SVALGFGFRCGFLGLLHMEITRER

SEQ ID NO: 786063 - protein, 21 aa, Mycobacterium
SVAPLLARALPAMASVHTVIV

SEQ ID NO: 786064 - protein, 20 aa, Mycobacterium
SVATAMIPFLEHDDANRALM

SEQ ID NO: 786065 - protein, 18 aa, Mycobacterium
SVGAQWLDIGIDAAGEGG

SEQ ID NO: 786066 - protein, 23 aa, Mycobacterium
SVIDLNLIATFNISRLAAAHMAK

SEQ ID NO: 786067 - protein, 25 aa, Mycobacterium
SVIHSHPVWATMFAIAHQPIPACID

SEQ ID NO: 786068 - protein, 26 aa, Mycobacterium
SVIHSHPVWATMFAIAHQPIPACIDE

SEQ ID NO: 786069 - protein, 21 aa, Mycobacterium
SVLTPTFRYNPAVIAQAFATM

SEQ ID NO: 786070 - protein, 23 aa, Mycobacterium
SVSVAGYPNLFFTFGPNSGPGHN

SEQ ID NO: 786071 - protein, 26 aa, Mycobacterium
SVYARVNPFGFIETPYRKVVDGVVSD

SEQ ID NO: 786072 - protein, 20 aa, Mycobacterium
SVYHLVPRREVRPVTPPLVH

SEQ ID NO: 786073 - protein, 24 aa, Mycobacterium
SWFAGYRGDLAFASLIVGGGSSEY

SEQ ID NO: 786074 - protein, 26 aa, Mycobacterium
SWVDANVWRKVVPKGWFYNVMVTGVK

SEQ ID NO: 786075 - protein, 17 aa, Mycobacterium
SYAPRPRMLVFGAIDFA

SEQ ID NO: 786076 - protein, 23 aa, Mycobacterium
SYFGPSFMINWLHNSYGGYKAES

SEQ ID NO: 786077 - protein, 20 aa, Mycobacterium
SYGMLKLLVSTEDLKLLGVH

SEQ ID NO: 786078 - protein, 19 aa, Mycobacterium
SYVPGTRALLRAAIYWIHE

SEQ ID NO: 786079 - protein, 19 aa, Mycobacterium
TAAIMSVALLLAHLGEDDA

SEQ ID NO: 786080 - protein, 20 aa, Mycobacterium
TAALENPQWCARAIGEHGDK

SEQ ID NO: 786081 - protein, 20 aa, Mycobacterium
TAAPNFAYSLFAKRLRKQAK

SEQ ID NO: 786082 - protein, 19 aa, Mycobacterium
TAAQRWWRTLDDELTAEAA

SEQ ID NO: 786083 - protein, 19 aa, Mycobacterium
TADWYGRTLHFGVREHAMG

SEQ ID NO: 786084 - protein, 27 aa, Mycobacterium
TAGAHADAYLWIKRPGESDGTCGKGDP

SEQ ID NO: 786085 - protein, 23 aa, Mycobacterium
TAHLLVGSLAHSGKWRAALTPSE

SEQ ID NO: 786086 - protein, 18 aa, Mycobacterium
TAIVKGLRTGTDFEYELQ

SEQ ID NO: 786087 - protein, 28 aa, Mycobacterium
TALLCPFDPLIFFRPRVQRLFDFHYRIE

SEQ ID NO: 786088 - protein, 18 aa, Mycobacterium
TALLRTYISERGKIRARR

SEQ ID NO: 786089 - protein, 21 aa, Mycobacterium
TAPEMTVLVGGLRALGANHGG

SEQ ID NO: 786090 - protein, 20 aa, Mycobacterium
TAPSWRKGPRHIAGRGPRDT

SEQ ID NO: 786091 - protein, 26 aa, Mycobacterium
TAQLRSRSWWSGFDVVLLVDDWHMIV

SEQ ID NO: 786092 - protein, 19 aa, Mycobacterium
TAQWALDRHTFGRPLASYQ

SEQ ID NO: 786093 - protein, 17 aa, Mycobacterium
TARRSFPGLGAVGLLGL

SEQ ID NO: 786094 - protein, 19 aa, Mycobacterium
TASPYLGFGSLRPLLEVAA

SEQ ID NO: 786095 - protein, 24 aa, Mycobacterium
TATGIDIFRIFDALNNLESMRPAI

SEQ ID NO: 786096 - protein, 18 aa, Mycobacterium
TATSFARRIARNTQLLLL

SEQ ID NO: 786097 - protein, 31 aa, Mycobacterium; identical to SEQ ID NO: 117774

SEQ ID NO: 786098 - protein, 19 aa, Mycobacterium
TAYAWRTILARGNGSGPVG

SEQ ID NO: 786099 - protein, 38 aa, Mycobacterium
TDDPAKLALPQWYAQNGQFVTTKFFGMKANKYLHDHNI

SEQ ID NO: 786100 - protein, 25 aa, Mycobacterium
TDEHGRILLIKRRDNTLWALPGGGH

SEQ ID NO: 786101 - protein, 23 aa, Mycobacterium
TDEILMELGLDWDRIIELKTAGA

SEQ ID NO: 786102 - protein, 28 aa, Mycobacterium
TDEPILDPTLPELKLDKGGFAKWIGMTD

SEQ ID NO: 786103 - protein, 26 aa, Mycobacterium
TDHLDWYVALACFKLGIVIEGTWSRY

SEQ ID NO: 786104 - protein, 19 aa, Mycobacterium
TDLLSAWLDAFYVEAFGSE

SEQ ID NO: 786105 - protein, 24 aa, Mycobacterium
TEANIVNFRRQLGRLGLGHDSRRS

SEQ ID NO: 786106 - protein, 25 aa, Mycobacterium
TEDPHLWARTLLDELEQLGFPLSYQ

SEQ ID NO: 786107 - protein, 24 aa, Mycobacterium
TEDRPVQHDGRWGRATLEVCFAIL

SEQ ID NO: 786108 - protein, 25 aa, Mycobacterium
TEFELLRFLMRNPRRALSRTEILDR

SEQ ID NO: 786109 - protein, 22 aa, Mycobacterium
TEFNDIVAVLALYRPGPMGMNA

SEQ ID NO: 786110 - protein, 23 aa, Mycobacterium
TEFNDIVAVLALYRPGPMGMNAH

SEQ ID NO: 786111 - protein, 19 aa, Mycobacterium
TEKLPYSLKVLAENLLRNE

SEQ ID NO: 786112 - protein, 23 aa, Mycobacterium
TEPKARALRPYAEKLITHAKKGT

SEQ ID NO: 786113 - protein, 19 aa, Mycobacterium
TEQRPWTEALIGPARPHLT

SEQ ID NO: 786114 - protein, 19 aa, Mycobacterium
TERQKQILLDIYASFTQQN

SEQ ID NO: 786115 - protein, 21 aa, Mycobacterium
TERTFFRHFPTKEAVLFQDYE

SEQ ID NO: 786116 - protein, 25 aa, Mycobacterium
TESASSFYPGRGGLLYVASKFAVRG

SEQ ID NO: 786117 - protein, 23 aa, Mycobacterium
TETLEPVQMLPAPAQGALAIECR

SEQ ID NO: 786118 - protein, 26 aa, Mycobacterium
TFAQLVTDLPWAQRLSQVWRMHDHDE

SEQ ID NO: 786119 - protein, 17 aa, Mycobacterium
TFGKVMSGGLPAAAFGG

SEQ ID NO: 786120 - protein, 19 aa, Mycobacterium
TFGRIGVKVWIYKGDIVGG

SEQ ID NO: 786121 - protein, 23 aa, Mycobacterium
TFHSTCVRILRNQASLIEGLNSN

SEQ ID NO: 786122 - protein, 18 aa, Mycobacterium
TFSPGRDTPLNPFHTREL

SEQ ID NO: 786123 - protein, 20 aa, Mycobacterium
TGAAGGWFRSSRRPDREWTN

SEQ ID NO: 786124 - protein, 25 aa, Mycobacterium
TGADVSIIFVPPKFAKDAIIEAIDA

SEQ ID NO: 786125 - protein, 32 aa, Mycobacterium; identical to SEQ ID NO: 117833

SEQ ID NO: 786126 - protein, 26 aa, Mycobacterium
TGAVEGWMPFGRVFETLAWGRRHVVM

SEQ ID NO: 786127 - protein, 23 aa, Mycobacterium
TGDALFIGDVGRPDLLASIGFTR

SEQ ID NO: 786128 - protein, 23 aa, Mycobacterium
TGDGLGIVFRKGLPLEDMEFHQF

SEQ ID NO: 786129 - protein, 21 aa, Mycobacterium
TGGLELALYCDILIASENARF

SEQ ID NO: 786130 - protein, 18 aa, Mycobacterium
TGHKWFTSAPMCDIFLVL

SEQ ID NO: 786131 - protein, 18 aa, Mycobacterium
TGIRIQDGLLKQLGSQGV

SEQ ID NO: 786132 - protein, 26 aa, Mycobacterium
TGKLRPALFVVPTDAPGFTYTPIEME

SEQ ID NO: 786133 - protein, 25 aa, Mycobacterium
TGKSVFLKSLIGLLRPERGSVVIDG

SEQ ID NO: 786134 - protein, 28 aa, Mycobacterium
TGRFDDEQLFYLRSRGIPEEQARRLVIR

SEQ ID NO: 786135 - protein, 24 aa, Mycobacterium
TGRVTPFAFMTPVKVAGSTVGLAT

SEQ ID NO: 786136 - protein, 26 aa, Mycobacterium
TGTGGLPMMPMMGGIPSMGGMGSASK

SEQ ID NO: 786137 - protein, 22 aa, Mycobacterium
TGVGFPTDPGLSFGGQGGAGGR

SEQ ID NO: 786138 - protein, 26 aa, Mycobacterium
TGVQRVFYGWAQVWRTKSREAEAIRR

SEQ ID NO: 786139 - protein, 20 aa, Mycobacterium
TGWDYPSCEAIGLLKMDFLG

SEQ ID NO: 786140 - protein, 20 aa, Mycobacterium
THDNLLWNAINVLGTDIGLR

SEQ ID NO: 786141 - protein, 18 aa, Mycobacterium
THGLSWGFDRIFAASANH

SEQ ID NO: 786142 - protein, 25 aa, Mycobacterium
THGYGIHPALLDAALHPLTAALADT

SEQ ID NO: 786143 - protein, 24 aa, Mycobacterium
THQPIEHLAALRAIPKLSVVRPAD

SEQ ID NO: 786144 - protein, 23 aa, Mycobacterium
THQPIEHLAALRAIPNLSVVRPG

SEQ ID NO: 786145 - protein, 24 aa, Mycobacterium
THTNHRALLMRLITPKRLKENEDA

SEQ ID NO: 786146 - protein, 24 aa, Mycobacterium
THYLRVYLAQLRRKLEDDPSHPKH

SEQ ID NO: 786147 - protein, 27 aa, Mycobacterium
TIAHGFMTLALLPRLQHQIYTVNGIKL

SEQ ID NO: 786148 - protein, 26 aa, Mycobacterium
TIDVAYRYFATAKRKFIIADTPGHIQ

SEQ ID NO: 786149 - protein, 30 aa, Mycobacterium
TIGSMSKSFWGGLRVGWIRAERSTLATIAA

SEQ ID NO: 786150 - protein, 19 aa, Mycobacterium
TIMGRIPELYITMLGALRN

SEQ ID NO: 786151 - protein, 18 aa, Mycobacterium
TIVPPIKAILESPDLRLS

SEQ ID NO: 786152 - protein, 17 aa, Mycobacterium
TIYQCLYVQTRGQLRAD

SEQ ID NO: 786153 - protein, 22 aa, Mycobacterium
TKAKELGLTPLARIVSTGVSGL

SEQ ID NO: 786154 - protein, 23 aa, Mycobacterium
TKAKELGLTPLARIVSTGVSGLS

SEQ ID NO: 786155 - protein, 18 aa, Mycobacterium
TKAVPTPGSLPALFAAQV

SEQ ID NO: 786156 - protein, 23 aa, Mycobacterium
TKDVDLGWYTLPKGSLGGNYIKY

SEQ ID NO: 786157 - protein, 18 aa, Mycobacterium
TKMEIFGVGYRVVAKGSN

SEQ ID NO: 786158 - protein, 28 aa, Mycobacterium
TLATITLQNYFRLYDKLAGMTGTAQTEA

SEQ ID NO: 786159 - protein, 33 aa, Mycobacterium
TLEERDIRFVRLWFTDVLGYLKSVAIAPAELEG

SEQ ID NO: 786160 - protein, 23 aa, Mycobacterium
TLERRAKRLIVFDVDSTLVQGEV

SEQ ID NO: 786161 - protein, 22 aa, Mycobacterium
TLETLLTRLNLPDDVPIEAKMV

SEQ ID NO: 786162 - protein, 17 aa, Mycobacterium
TLHSVKVIPGRGAWLEF

SEQ ID NO: 786163 - protein, 40 aa, Mycobacterium
TLIRRRPIGPVAAITPWNFPVVLAFMKLAPALVAGNTVVL

SEQ ID NO: 786164 - protein, 30 aa, Mycobacterium; identical to SEQ ID NO: 132726

SEQ ID NO: 786165 - protein, 20 aa, Mycobacterium
TLLSCLGGILRPKSGAIKFE

SEQ ID NO: 786166 - protein, 17 aa, Mycobacterium
TLMETTLARHTGKDAAT

SEQ ID NO: 786167 - protein, 25 aa, Mycobacterium
TLPYDEPWGWMQPTRHAYGALLLEQ

SEQ ID NO: 786168 - protein, 24 aa, Mycobacterium
TLQNDVVLPYLTDLTTPEQQQRWL

SEQ ID NO: 786169 - protein, 23 aa, Mycobacterium
TLREAVLYLTGMSQRELYGASYR

SEQ ID NO: 786170 - protein, 25 aa, Mycobacterium
TLRGEFLWCQLFSEPGAGSDLASLR

SEQ ID NO: 786171 - protein, 24 aa, Mycobacterium
TLSRTHPNLVRKLFSLEVPEIADG

SEQ ID NO: 786172 - protein, 25 aa, Mycobacterium
TLTVLRLGVPPTLARTLRSTNCIES

SEQ ID NO: 786173 - protein, 18 aa, Mycobacterium
TMGQVAEPYLPLRAVRHL

SEQ ID NO: 786174 - protein, 19 aa, Mycobacterium
TMLAQRLPGLLPPLSESES

SEQ ID NO: 786175 - protein, 24 aa, Mycobacterium
TMPGYTIPGFRRNAVTIATGGVYD

SEQ ID NO: 786176 - protein, 26 aa, Mycobacterium
TMRHDPSDTYWLGRDRFVLSCGHSSL

SEQ ID NO: 786177 - protein, 17 aa, Mycobacterium
TMSFLAMDDPAHLRLRT

SEQ ID NO: 786178 - protein, 20 aa, Mycobacterium
TNAVKHFKFTRKGGKRRIHQ

SEQ ID NO: 786179 - protein, 28 aa, Mycobacterium
TNHAAGWVRMDFIVPSRGLIGFRTDFLT

SEQ ID NO: 786180 - protein, 26 aa, Mycobacterium
TNLDDYPTTPLPPPSPHDLAYLIYTS

SEQ ID NO: 786181 - protein, 25 aa, Mycobacterium
TPADAADALALAICHCWRAPMIARM

SEQ ID NO: 786182 - protein, 22 aa, Mycobacterium
TPAIAATEFDYVEMWAQDVGAM

SEQ ID NO: 786183 - protein, 18 aa, Mycobacterium
TPENPIIFNLPATVEMAT

SEQ ID NO: 786184 - protein, 32 aa, Mycobacterium
TPEYKQVALFSATMPPAIRKLTTKYLHDPLEV

SEQ ID NO: 786185 - protein, 31 aa, Mycobacterium
TPGRVIAQCTFGMWVNLLDAGGYAGREPRRV

SEQ ID NO: 786186 - protein, 23 aa, Mycobacterium
TPGTRMYRTGDLVWWGTDGQLRY

SEQ ID NO: 786187 - protein, 23 aa, Mycobacterium
TPKGCVFEYVYLARPDSTIAGRS

SEQ ID NO: 786188 - protein, 27 aa, Mycobacterium
TPLEPYLEILPQFDTLLIMSVEPGFGG

SEQ ID NO: 786189 - protein, 26 aa, Mycobacterium
TPPNLIKAILQAPVDLLFNGGIGTYI

SEQ ID NO: 786190 - protein, 19 aa, Mycobacterium
TPPTVVMLAGLQGSGKTSL

SEQ ID NO: 786191 - protein, 24 aa, Mycobacterium
TPTWKKTFGHHPLLAFLDRPEIAG

SEQ ID NO: 786192 - protein, 35 aa, Mycobacterium; identical to SEQ ID NO: 117979

SEQ ID NO: 786193 - protein, 21 aa, Mycobacterium
TQFLGEFLRSLPREWELPPIE

SEQ ID NO: 786194 - protein, 27 aa, Mycobacterium
TQRLALSLILILPFYETVRLAEDMAVL

SEQ ID NO: 786195 - protein, 17 aa, Mycobacterium
TRAIHKLPIKARIITRE

SEQ ID NO: 786196 - protein, 24 aa, Mycobacterium
TREDQALIYRLSGDRNPLHSDPWF

SEQ ID NO: 786197 - protein, 18 aa, Mycobacterium
TRETLGFSVLHVVRDNPT

SEQ ID NO: 786198 - protein, 32 aa, Mycobacterium
TRGARQVRLCIDATWRWAAMIATAWQAIRTAF

SEQ ID NO: 786199 - protein, 21 aa, Mycobacterium
TRMNDRCEVEWIPPPGLDTGQ

SEQ ID NO: 786200 - protein, 19 aa, Mycobacterium
TRTEFALLEMLIANPRRVL

SEQ ID NO: 786201 - protein, 30 aa, Mycobacterium
TSADIRALYTFKRVAWWPYSVAMRQVNVLF

SEQ ID NO: 786202 - protein, 19 aa, Mycobacterium
TSAHRWLAGHQLGDTVVLP

SEQ ID NO: 786203 - protein, 19 aa, Mycobacterium
TSAWTLIELIRHPEVYAEV

SEQ ID NO: 786204 - protein, 18 aa, Mycobacterium
TSILATKLTPSVVGQLIA

SEQ ID NO: 786205 - protein, 21 aa, Mycobacterium
TSLVTGWASIHGFPVGILANA

SEQ ID NO: 786206 - protein, 21 aa, Mycobacterium
TSPRRALSELLRRGTKSMPGA

SEQ ID NO: 786207 - protein, 24 aa, Mycobacterium
TSRAPRWAIAYKYPPEEAQTKLLD

SEQ ID NO: 786208 - protein, 18 aa, Mycobacterium
TSVAAFDGQIGQAAYSSS

SEQ ID NO: 786209 - protein, 21 aa, Mycobacterium
TSVHPSLWRQSTLAAKQGLYE

SEQ ID NO: 786210 - protein, 21 aa, Mycobacterium
TTAVSILDRLLHHATVVITDG

SEQ ID NO: 786211 - protein, 24 aa, Mycobacterium
TTDKDGIIMALLAAEILAVTGATP

SEQ ID NO: 786212 - protein, 25 aa, Mycobacterium
TTDQLPLVNVLLGGVALGLADGPTE

SEQ ID NO: 786213 - protein, 25 aa, Mycobacterium
TTEPKARALRPYAEKLITHAKKGAL

SEQ ID NO: 786214 - protein, 24 aa, Mycobacterium
TTGRLIMQYASQNLIPVTLELGGK

SEQ ID NO: 786215 - protein, 28 aa, Mycobacterium
TTGRRRRCGWFDAVIARYATRVNGITDY

SEQ ID NO: 786216 - protein, 30 aa, Mycobacterium
TTLGRVLFNELLPVGYPFVNKQMHKKVQAA

SEQ ID NO: 786217 - protein, 24 aa, Mycobacterium
TTTGVLRLYQFAAAGELAFPAINV

SEQ ID NO: 786218 - protein, 18 aa, Mycobacterium
TVASVYAEYQRRLRAANA

SEQ ID NO: 786219 - protein, 19 aa, Mycobacterium
TVDANLKLGLPADARDYGI

SEQ ID NO: 786220 - protein, 25 aa, Mycobacterium
TVDFYSNILGMPLIKSLDLPGGQGQ

SEQ ID NO: 786221 - protein, 20 aa, Mycobacterium
TVDVTLLRLPTDTTGLAVIP

SEQ ID NO: 786222 - protein, 18 aa, Mycobacterium
TVDYPPVNAIPSRGWFEL

SEQ ID NO: 786223 - protein, 17 aa, Mycobacterium
TVFLLCAPSVDPEDIAI

SEQ ID NO: 786224 - protein, 22 aa, Mycobacterium
TVFQDFRLLQQKTVYENVAFAL

SEQ ID NO: 786225 - protein, 24 aa, Mycobacterium
TVGFDCSGLMLYAFAGVGIKLDHY

SEQ ID NO: 786226 - protein, 28 aa, Mycobacterium
TVGPWAKLATLRLLRSILDMAREDGRIH

SEQ ID NO: 786227 - protein, 23 aa, Mycobacterium
TVHYPKVVLVTGACRFLGGYLTA

SEQ ID NO: 786228 - protein, 17 aa, Mycobacterium
TVIVKPAPETPLDALWL

SEQ ID NO: 786229 - protein, 23 aa, Mycobacterium
TVKNYVSRLLAKLGMERRTQAAV

SEQ ID NO: 786230 - protein, 22 aa, Mycobacterium
TVLPAQWPVLLCNGAVGIAEGW

SEQ ID NO: 786231 - protein, 19 aa, Mycobacterium
TVPAGSAMLLLFGAANRDP

SEQ ID NO: 786232 - protein, 18 aa, Mycobacterium
TVPAYFNDAQRQATKEAG

SEQ ID NO: 786233 - protein, 18 aa, Mycobacterium
TVPGWRSRAERFDMAVLE

SEQ ID NO: 786234 - protein, 19 aa, Mycobacterium
TVQVTLNGYNWLTGIRIQD

SEQ ID NO: 786235 - protein, 28 aa, Mycobacterium
TVRHLEVIALTPARLLMVVITDSGRVDQ

SEQ ID NO: 786236 - protein, 21 aa, Mycobacterium
TVRPCGHPWPFVVDAITRAVC

SEQ ID NO: 786237 - protein, 20 aa, Mycobacterium
TVRPDFWELVDYATAHHVGV

SEQ ID NO: 786238 - protein, 25 aa, Mycobacterium
TVRRDPMAMLPFLGYHVGDYFQHWL

SEQ ID NO: 786239 - protein, 18 aa, Mycobacterium
TVRYLAGRAVWQASATYR

SEQ ID NO: 786240 - protein, 17 aa, Mycobacterium
TVSSLMHHFGYISLKDL

SEQ ID NO: 786241 - protein, 18 aa, Mycobacterium
TVVAKLLMLFGTDEQKST

SEQ ID NO: 786242 - protein, 26 aa, Mycobacterium
TWEHDLHLYLRRVTLYRSMFGTPEEH

SEQ ID NO: 786243 - protein, 20 aa, Mycobacterium
TYKEFELLKYLAQHAGRVFT

SEQ ID NO: 786244 - protein, 19 aa, Mycobacterium
TYRPHSVPIMSNLTGSLAT

SEQ ID NO: 786245 - protein, 25 aa, Mycobacterium
VAAAVDVTLLGRFYERFADHAVEVA

SEQ ID NO: 786246 - protein, 34 aa, Mycobacterium; identical to SEQ ID NO: 147029

SEQ ID NO: 786247 - protein, 24 aa, Mycobacterium
VAADLFTFGKVMSGGLPAAAFGGR

SEQ ID NO: 786248 - protein, 26 aa, Mycobacterium
VAAEIARLALFLTTPAARHITGQTLH

SEQ ID NO: 786249 - protein, 30 aa, Mycobacterium
VADASLSHPYLDTVLFLLGVTRGEIEAADA

SEQ ID NO: 786250 - protein, 25 aa, Mycobacterium
VADNLPPQLITRMVDFGLAAGSRIT

SEQ ID NO: 786251 - protein, 24 aa, Mycobacterium
VAELLDIVGLRRSDASRYPAEFSG

SEQ ID NO: 786252 - protein, 25 aa, Mycobacterium
VAFVNALPVFIASDPVWAKKFEDAG

SEQ ID NO: 786253 - protein, 19 aa, Mycobacterium
VALAHHSGYRTMISHRSGE

SEQ ID NO: 786254 - protein, 23 aa, Mycobacterium
VALGFGFRCGFLGLLHMEITRER

SEQ ID NO: 786255 - protein, 24 aa, Mycobacterium
VALVNSWSAAFARYGRTVGQVLLT

SEQ ID NO: 786256 - protein, 19 aa, Mycobacterium
VAMPLRLTSPAPCTNCHGS

SEQ ID NO: 786257 - protein, 25 aa, Mycobacterium
VAPKRVLPVFGLRSAIPAEREVFVV

SEQ ID NO: 786258 - protein, 17 aa, Mycobacterium
VAPLTMKPDVCWQLPIR

SEQ ID NO: 786259 - protein, 23 aa, Mycobacterium
VARAVGIGDLKFFSQIGYGGGAA

SEQ ID NO: 786260 - protein, 27 aa, Mycobacterium
VATIGEATNLLLMRGMIGKPGAGVCPV

SEQ ID NO: 786261 - protein, 24 aa, Mycobacterium
VATLQATLPAGWRNNPSQPQTTTW

SEQ ID NO: 786262 - protein, 25 aa, Mycobacterium
VAVAGMPNLFFLLGPNTALGHNSVV

SEQ ID NO: 786263 - protein, 20 aa, Mycobacterium
VAVARLVLGPGMRIQAPPNL

SEQ ID NO: 786264 - protein, 24 aa, Mycobacterium
VAVLLRITEVFGVDATFFSSQDDT

SEQ ID NO: 786265 - protein, 31 aa, Mycobacterium; identical to SEQ ID NO: 118148

SEQ ID NO: 786266 - protein, 19 aa, Mycobacterium
VAVPRTEESRFRSMCEARG

SEQ ID NO: 786267 - protein, 24 aa, Mycobacterium
VAVSDWMRAVPEQIRPWVPGTYVT

SEQ ID NO: 786268 - protein, 18 aa, Mycobacterium
VAVTCRVLKLARQPYYRW

SEQ ID NO: 786269 - protein, 26 aa, Mycobacterium
VDAALLLAKALTPEPMRPGWSDALRL

SEQ ID NO: 786270 - protein, 24 aa, Mycobacterium
VDADLFTFGKVMSGGLPAAAFGGR

SEQ ID NO: 786271 - protein, 30 aa, Mycobacterium; identical to SEQ ID NO: 85505

SEQ ID NO: 786272 - protein, 51 aa, Mycobacterium; identical to SEQ ID NO: 215404

SEQ ID NO: 786273 - protein, 25 aa, Mycobacterium
VDIAFNWDHFFPLYGDPDGAHFECW

SEQ ID NO: 786274 - protein, 18 aa, Mycobacterium
VDINLGIRILLGSSYYDD

SEQ ID NO: 786275 - protein, 20 aa, Mycobacterium
VDQPLLDRLDLTYNSASVLA

SEQ ID NO: 786276 - protein, 17 aa, Mycobacterium
VDWLIEAGYPIARIDNY

SEQ ID NO: 786277 - protein, 19 aa, Mycobacterium
VEDLLPFSDETLCRAIAAC

SEQ ID NO: 786278 - protein, 19 aa, Mycobacterium
VEDLLPFSDETLCRAISAC

SEQ ID NO: 786279 - protein, 25 aa, Mycobacterium
VEDVFPLPRELVGEGTLFLLKVVGD

SEQ ID NO: 786280 - protein, 24 aa, Mycobacterium
VEEDGAVYQMRRWYEQFYVDAADV

SEQ ID NO: 786281 - protein, 18 aa, Mycobacterium
VEELLRWETPVPGVARVA

SEQ ID NO: 786282 - protein, 19 aa, Mycobacterium
VELDLFSFPDELGSGLPVF

SEQ ID NO: 786283 - protein, 22 aa, Mycobacterium
VELFMQMPWRTEIVEGLLGADL

SEQ ID NO: 786284 - protein, 18 aa, Mycobacterium
VELGLPEHPMEVPAFPLL

SEQ ID NO: 786285 - protein, 20 aa, Mycobacterium
VERAWGYLRNPRQGHPSTPG

SEQ ID NO: 786286 - protein, 25 aa, Mycobacterium
VERRYRTWIRWNAAIMVHRAQRPGV

SEQ ID NO: 786287 - protein, 25 aa, Mycobacterium
VERSTRFVILLHLPVDHTAQSVAAA

SEQ ID NO: 786288 - protein, 24 aa, Mycobacterium
VESFGFKYGLPMDADMVMDVRFLP

SEQ ID NO: 786289 - protein, 17 aa, Mycobacterium
VETGFLEHLWNAPTKDV

SEQ ID NO: 786290 - protein, 20 aa, Mycobacterium
VEVAGYVPVPLSADAYIELL

SEQ ID NO: 786291 - protein, 24 aa, Mycobacterium
VEVIPDVLRHRLVLTYDALADEIS

SEQ ID NO: 786292 - protein, 26 aa, Mycobacterium
VEYLVDAVFNYPTFSEAYKVAALDVM

SEQ ID NO: 786293 - protein, 18 aa, Mycobacterium
VFAQLMLDEAFSKSDPQF

SEQ ID NO: 786294 - protein, 17 aa, Mycobacterium
VFNLLGPLTNPARPRAG

SEQ ID NO: 786295 - protein, 18 aa, Mycobacterium
VFPLSNWTEFDIWSYIGA

SEQ ID NO: 786296 - protein, 18 aa, Mycobacterium
VFQGILRPMHEKIVGRIA

SEQ ID NO: 786297 - protein, 26 aa, Mycobacterium
VFQMSKPVIPLLRQGGGGSIVNVAST

SEQ ID NO: 786298 - protein, 17 aa, Mycobacterium
VGGGWVGYLSYPDPGAD

SEQ ID NO: 786299 - protein, 32 aa, Mycobacterium
VGGRVRLLPLETDWYYFARLFPEEVTACWSGN

SEQ ID NO: 786300 - protein, 26 aa, Mycobacterium
VGHDQLRLALLLCAVRPEIGGALIRG

SEQ ID NO: 786301 - protein, 27 aa, Mycobacterium
VGKGTLFRRFGSRAGLMMVLLDEDERA

SEQ ID NO: 786302 - protein, 32 aa, Mycobacterium
VGKGTLFRRFGTRAGLMMVLLDEDEKAHQDAF

SEQ ID NO: 786303 - protein, 23 aa, Mycobacterium
VGKSTLFNALTRNDVLAANYPFA

SEQ ID NO: 786304 - protein, 22 aa, Mycobacterium
VGLPTYAFAHERFWLADRFGVG

SEQ ID NO: 786305 - protein, 17 aa, Mycobacterium
VGMVGLSGIPFTNVFNA

SEQ ID NO: 786306 - protein, 20 aa, Mycobacterium
VGQRFPIDPPFGLVAMAWRD

SEQ ID NO: 786307 - protein, 18 aa, Mycobacterium
VGSLWDVVRDRRLNHRPQ

SEQ ID NO: 786308 - protein, 17 aa, Mycobacterium
VGYGLLRVTRDQRWKRF

SEQ ID NO: 786309 - protein, 22 aa, Mycobacterium
VHAALRQVLGPNAVQAGSLNRP

SEQ ID NO: 786310 - protein, 24 aa, Mycobacterium
VHHTERFLVATGARPRPLQFDGHE

SEQ ID NO: 786311 - protein, 20 aa, Mycobacterium
VHHTNQKVPFMLLAGDRDVQ

SEQ ID NO: 786312 - protein, 26 aa, Mycobacterium
VHRENFQIILVDTPGLHRPRTLLGKR

SEQ ID NO: 786313 - protein, 28 aa, Mycobacterium
VIAANPKLFFQLYWLGDRDAIAARVERA

SEQ ID NO: 786314 - protein, 18 aa, Mycobacterium
VIACVRYQIRHGAKLIKV

SEQ ID NO: 786315 - protein, 21 aa, Mycobacterium
VIAILAVLKAGAAYLPIDPAH

SEQ ID NO: 786316 - protein, 18 aa, Mycobacterium
VIDGQLWQIVEFQHVKPG

SEQ ID NO: 786317 - protein, 28 aa, Mycobacterium
VIDPANNVEFFFLRPKDIAIYVGSGQLD

SEQ ID NO: 786318 - protein, 19 aa, Mycobacterium
VIEFCLGIPHLLKGEYTEG

SEQ ID NO: 786319 - protein, 18 aa, Mycobacterium
VIGFNYLGRLGAAADLPG

SEQ ID NO: 786320 - protein, 24 aa, Mycobacterium
VILQSPLDISRPLWTATLVEGLAD

SEQ ID NO: 786321 - protein, 18 aa, Mycobacterium
VIRFLEAGSKVKVTIMFR

SEQ ID NO: 786322 - protein, 25 aa, Mycobacterium
VISGLVIALLCRGHVLLEGVPGVAK

SEQ ID NO: 786323 - protein, 25 aa, Mycobacterium
VITSMPGIGFRLGAEFLAAVGDPAL

SEQ ID NO: 786324 - protein, 26 aa, Mycobacterium
VKAKKLAIVYLTYKLADGRVVLHGHV

SEQ ID NO: 786325 - protein, 33 aa, Mycobacterium
VKDARFRDALFPVWRYHPFFTNTDLPTAEADIT

SEQ ID NO: 786326 - protein, 24 aa, Mycobacterium
VKDVFVPRHRFLSYKAMNDGTAGG

SEQ ID NO: 786327 - protein, 22 aa, Mycobacterium
VKDVFVPRHRFLSYKAMNDHTA

SEQ ID NO: 786328 - protein, 24 aa, Mycobacterium
VKGMLTGPVTILAWSFVRDDQPLA

SEQ ID NO: 786329 - protein, 25 aa, Mycobacterium
VKNNLQTVAALLRLQARRTANAEGR

SEQ ID NO: 786330 - protein, 39 aa, Mycobacterium
VKRHMALWRKRFQREWGEPARYIWKLEFQRRGAPHIHLW

SEQ ID NO: 786331 - protein, 20 aa, Mycobacterium
VLAATHRYGTPLPSSQQRSD

SEQ ID NO: 786332 - protein, 18 aa, Mycobacterium
VLADALARTRLHGLRTNR

SEQ ID NO: 786333 - protein, 18 aa, Mycobacterium
VLAQARVGSYLRYGAYPY

SEQ ID NO: 786334 - protein, 24 aa, Mycobacterium
VLDRYDYVLIDCQPSLGLLTVNGL

SEQ ID NO: 786335 - protein, 18 aa, Mycobacterium
VLDYASPVPAILTMKLMG

SEQ ID NO: 786336 - protein, 23 aa, Mycobacterium
VLEETGLLPHLNPGVMSWSEMAR

SEQ ID NO: 786337 - protein, 24 aa, Mycobacterium
VLEVAMYGFVPSAGAVLAEWGADV

SEQ ID NO: 786338 - protein, 24 aa, Mycobacterium
VLGDPALPHLFFVDGGALAVENAL

SEQ ID NO: 786339 - protein, 18 aa, Mycobacterium
VLGLLRDAYCRHIGVEYT

SEQ ID NO: 786340 - protein, 18 aa, Mycobacterium
VLIPSPDYPLWTASTSLA

SEQ ID NO: 786341 - protein, 17 aa, Mycobacterium
VLLADFDGNPKASKDVR

SEQ ID NO: 786342 - protein, 21 aa, Mycobacterium
VLPLYARLPTAEQQKVFAPHT

SEQ ID NO: 786343 - protein, 22 aa, Mycobacterium
VLQTYPCHPLLQANRVAAAANA

SEQ ID NO: 786344 - protein, 18 aa, Mycobacterium
VLRAFPQIAQHYRRRFRH

SEQ ID NO: 786345 - protein, 30 aa, Mycobacterium
VLRQRSDGRWIWRWDPAFISSNFDVLQGNL

SEQ ID NO: 786346 - protein, 25 aa, Mycobacterium
VLSRAQLLELVWGYDFAADTNVVDV

SEQ ID NO: 786347 - protein, 17 aa, Mycobacterium
VLVISGKDKGAKGKVLV

SEQ ID NO: 786348 - protein, 18 aa, Mycobacterium
VLWEAQFGDFVNGAQSII

SEQ ID NO: 786349 - protein, 17 aa, Mycobacterium
VLYAHLGGQPALNAYSG

SEQ ID NO: 786350 - protein, 22 aa, Mycobacterium
VLYEGYLLYPYRGTSSKNQSRW

SEQ ID NO: 786351 - protein, 24 aa, Mycobacterium
VMAEPLTYFFSDPAARDFVAGVAQ

SEQ ID NO: 786352 - protein, 17 aa, Mycobacterium
VMAKARIGHFVEAQILQ

SEQ ID NO: 786353 - protein, 31 aa, Mycobacterium
VMEKLYLQEWHFYFQNTCRWRDLRKITIAQV

SEQ ID NO: 786354 - protein, 21 aa, Mycobacterium
VNDPMLLVSGMALVTEHLGFG

SEQ ID NO: 786355 - protein, 28 aa, Mycobacterium
VNGALARYASLPTKALFRIPDEISLAEA

SEQ ID NO: 786356 - protein, 17 aa, Mycobacterium
VNNAAIFGGMKLDFLLT

SEQ ID NO: 786357 - protein, 19 aa, Mycobacterium
VNRLLLNNIDVVGVGWGAW

SEQ ID NO: 786358 - protein, 33 aa, Mycobacterium
VNSFSKYYAMTGWRLGWLLVPTELRRAVDCLTG

SEQ ID NO: 786359 - protein, 27 aa, Mycobacterium
VNVATLPFPGFPTDLQPMAIALASIAD

SEQ ID NO: 786360 - protein, 17 aa, Mycobacterium
VNVLGVIHGIKAFVPLL

SEQ ID NO: 786361 - protein, 23 aa, Mycobacterium
VPDGPELVWLGAAMIIGAGSTSF

SEQ ID NO: 786362 - protein, 36 aa, Mycobacterium; identical to SEQ ID NO: 123092

SEQ ID NO: 786363 - protein, 18 aa, Mycobacterium
VPFVDPLTTILDPSLPLT

SEQ ID NO: 786364 - protein, 26 aa, Mycobacterium
VPGAGVFVLDRWLRPVPPGTVGELYV

SEQ ID NO: 786365 - protein, 18 aa, Mycobacterium
VPGTGWPEPGGLLPREAL

SEQ ID NO: 786366 - protein, 21 aa, Mycobacterium
VPIFIADYVLAGYGTGAIMAV

SEQ ID NO: 786367 - protein, 20 aa, Mycobacterium
VPISAILFGGRRKTTVPLIT

SEQ ID NO: 786368 - protein, 20 aa, Mycobacterium
VPISGILFGARRKTTVPLVT

SEQ ID NO: 786369 - protein, 28 aa, Mycobacterium
VPLANLAFFVLDGWLRPVPVGVAGELYV

SEQ ID NO: 786370 - protein, 29 aa, Mycobacterium
VPLSADAYIELLPATWRTIGSAGIRVNHR

SEQ ID NO: 786371 - protein, 20 aa, Mycobacterium
VPLVAVGLYYRSGYFRQSLT

SEQ ID NO: 786372 - protein, 17 aa, Mycobacterium
VPMSTYLYTTSLMHCMT

SEQ ID NO: 786373 - protein, 27 aa, Mycobacterium
VPPGRLGWGWAKFAFNSWTTLSWVDAN

SEQ ID NO: 786374 - protein, 24 aa, Mycobacterium
VPPNGFPVILGPDHPVTGGYPVIG

SEQ ID NO: 786375 - protein, 17 aa, Mycobacterium
VPRAQRWPLMEAAAALR

SEQ ID NO: 786376 - protein, 18 aa, Mycobacterium
VPSALYSLSYKPNPRWSR

SEQ ID NO: 786377 - protein, 27 aa, Mycobacterium
VPSKTFIASTWLRTELRRAPRLGFEID

SEQ ID NO: 786378 - protein, 18 aa, Mycobacterium
VPVPFLTINSVAPTIMAF

SEQ ID NO: 786379 - protein, 17 aa, Mycobacterium
VQALAAAAGIAIANARL

SEQ ID NO: 786380 - protein, 23 aa, Mycobacterium
VQDFSGPFPVEVITRMAGVPEEY

SEQ ID NO: 786381 - protein, 18 aa, Mycobacterium
VQEDVAVVGLSILSGAHL

SEQ ID NO: 786382 - protein, 23 aa, Mycobacterium
VQEPTVLPSRFPNLLANGSGGIA

SEQ ID NO: 786383 - protein, 17 aa, Mycobacterium
VQLARARALLLGRDYVI

SEQ ID NO: 786384 - protein, 23 aa, Mycobacterium
VQRARALAYFAALTIAADDPRRR

SEQ ID NO: 786385 - protein, 25 aa, Mycobacterium
VRDLEYIYCPWHQWGFELATGTTAV

SEQ ID NO: 786386 - protein, 18 aa, Mycobacterium
VRERIPILVAALGPKNVE

SEQ ID NO: 786387 - protein, 26 aa, Mycobacterium
VRGGKQPRILFATQATARPPTFVLFT

SEQ ID NO: 786388 - protein, 23 aa, Mycobacterium
VRKNGVLPYLRPDGKTQVTIAYE

SEQ ID NO: 786389 - protein, 29 aa, Mycobacterium
VRLCDAFGIPLVVIVDVPGYLPGVDQEWG

SEQ ID NO: 786390 - protein, 21 aa, Mycobacterium
VRQQFSLSFTTKVLGGTLAID

SEQ ID NO: 786391 - protein, 21 aa, Mycobacterium
VRSVGAQWLDLGIDAAGEGGY

SEQ ID NO: 786392 - protein, 32 aa, Mycobacterium
VRTQLLVTPALLWLFIRGVRFMYSVDPYLPPG

SEQ ID NO: 786393 - protein, 18 aa, Mycobacterium
VRVLYGRDPHHITEAQYK

SEQ ID NO: 786394 - protein, 24 aa, Mycobacterium
VSAKDIILALIAKIGTGGGQGHVI

SEQ ID NO: 786395 - protein, 37 aa, Mycobacterium
VSELLPMALRLERFAVWLIFELLAVTLVDAKPLSRVL

SEQ ID NO: 786396 - protein, 29 aa, Mycobacterium
VSGEPWQAVAPLRYFNDRAGSIYAGSNEI

SEQ ID NO: 786397 - protein, 26 aa, Mycobacterium
VSIPVLRKDFIVRPYQIHEARAHGAD

SEQ ID NO: 786398 - protein, 25 aa, Mycobacterium
VSLDSPPFYDPWFAKARTSGAIEAR

SEQ ID NO: 786399 - protein, 25 aa, Mycobacterium
VSLDSPPFYDPWFAKARTTGAIESR

SEQ ID NO: 786400 - protein, 27 aa, Mycobacterium
VSMTMNGAVLPILALYVVAAEEQGVPP

SEQ ID NO: 786401 - protein, 26 aa, Mycobacterium
VSRALMYHYFPDKRAFFAAVVKDEAD

SEQ ID NO: 786402 - protein, 26 aa, Mycobacterium
VSSAAGLVALPWHGAYSASKFGLRGV

SEQ ID NO: 786403 - protein, 17 aa, Mycobacterium
VSTAGTRRWLLAPEYMY

SEQ ID NO: 786404 - protein, 30 aa, Mycobacterium
VSVRKTIGMVFQRPNPFPTMSIRDNVVAGL

SEQ ID NO: 786405 - protein, 18 aa, Mycobacterium
VTAAWRVLRVSRWAVEAQ

SEQ ID NO: 786406 - protein, 24 aa, Mycobacterium
VTAKDIILALIAKIGTGGGQGHVI

SEQ ID NO: 786407 - protein, 24 aa, Mycobacterium
VTDDGRLLARIYSESDLLVAECLR

SEQ ID NO: 786408 - protein, 24 aa, Mycobacterium
VTDFSLAMIDPWPAGYYGAQDHYD

SEQ ID NO: 786409 - protein, 25 aa, Mycobacterium
VTDGDLLKGVRYYPGGCTTQSIVMR

SEQ ID NO: 786410 - protein, 17 aa, Mycobacterium
VTDIRVIPGTTDVLYRL

SEQ ID NO: 786411 - protein, 33 aa, Mycobacterium
VTDYYNKAGLWPYLEKLGYYLGGYGCTTCIGNT

SEQ ID NO: 786412 - protein, 17 aa, Mycobacterium
VTELLVDLRERGLDVTR

SEQ ID NO: 786413 - protein, 18 aa, Mycobacterium
VTEQCILYTALDAYVRHF

SEQ ID NO: 786414 - protein, 35 aa, Mycobacterium
VTGLGWYSTKHSVGLWSATPPPTGWRLLDTAVEQA

SEQ ID NO: 786415 - protein, 19 aa, Mycobacterium
VTHDRWFLDEVATTTWEVH

SEQ ID NO: 786416 - protein, 19 aa, Mycobacterium
VTLVRSLYRFSRTPMFTAD

SEQ ID NO: 786417 - protein, 25 aa, Mycobacterium
VTPEKQFTLFFDDVRVPAANLIGTE

SEQ ID NO: 786418 - protein, 24 aa, Mycobacterium
VTRMDYLSPFFNETAYCLGVEKLL

SEQ ID NO: 786419 - protein, 24 aa, Mycobacterium
VTRQTVYRYFPGTQALLVASAMRS

SEQ ID NO: 786420 - protein, 24 aa, Mycobacterium
VTSLGLVQLTRKRLGTGLVEAFST

SEQ ID NO: 786421 - protein, 22 aa, Mycobacterium
VTTLPGAAFFGSSTSFGIIRGG

SEQ ID NO: 786422 - protein, 20 aa, Mycobacterium
VTVPVSFTELALGSTISVPT

SEQ ID NO: 786423 - protein, 32 aa, Mycobacterium
VVAGITPFNFPAMIPLWKAGPALACGNAFILK

SEQ ID NO: 786424 - protein, 17 aa, Mycobacterium
VVARLRVILRRAGKGSA

SEQ ID NO: 786425 - protein, 25 aa, Mycobacterium
VVAVSDWMRAVPEQIRPWVPGTYVT

SEQ ID NO: 786426 - protein, 27 aa, Mycobacterium
VVDVFIGYLRRKLEAGGAPRLLHTVRG

SEQ ID NO: 786427 - protein, 32 aa, Mycobacterium; identical to SEQ ID NO: 118509

SEQ ID NO: 786428 - protein, 26 aa, Mycobacterium
VVKDVFVPRHRFLSYKAMNDGTAGGY

SEQ ID NO: 786429 - protein, 17 aa, Mycobacterium
VVLHFEGDRNGSLRMVR

SEQ ID NO: 786430 - protein, 26 aa, Mycobacterium
VVLSRQRLLELVWGYDFDVDTNVADV

SEQ ID NO: 786431 - protein, 18 aa, Mycobacterium
VVMSWRLRTRHGLPVHDI

SEQ ID NO: 786432 - protein, 17 aa, Mycobacterium
VVNWPRALIECRRALQA

SEQ ID NO: 786433 - protein, 17 aa, Mycobacterium
VVQAALAVLLSKVGATS

SEQ ID NO: 786434 - protein, 20 aa, Mycobacterium
VVRELAYELAPKIRVNGVAP

SEQ ID NO: 786435 - protein, 20 aa, Mycobacterium
VVRFIVPRYVQDDPSLAGVL

SEQ ID NO: 786436 - protein, 19 aa, Mycobacterium
VVRFLPYFTDVIVPDLRSG

SEQ ID NO: 786437 - protein, 25 aa, Mycobacterium
VVRRLNLPFRDVDWTEWDDLLRRVH

SEQ ID NO: 786438 - protein, 18 aa, Mycobacterium
VVRVLGAIEIPVVAQELT

SEQ ID NO: 786439 - protein, 21 aa, Mycobacterium
VVVVSIFVNPLQFGAGEDLDA

SEQ ID NO: 786440 - protein, 18 aa, Mycobacterium
VWELYYLPDDFSQARNVA

SEQ ID NO: 786441 - protein, 18 aa, Mycobacterium
VYPTNDWHERETYDFFGI

SEQ ID NO: 786442 - protein, 22 aa, Mycobacterium
VYRGAEYSVDFVPKVRIEVVVD

SEQ ID NO: 786443 - protein, 18 aa, Mycobacterium
WAAEIRRLAKLRGATVLA

SEQ ID NO: 786444 - protein, 31 aa, Mycobacterium
WAGSYPDRFIPIAILPTWTPEGMCAEIRRVA

SEQ ID NO: 786445 - protein, 24 aa, Mycobacterium
WCALDTLIFPGILGRTAHVTSPCH

SEQ ID NO: 786446 - protein, 17 aa, Mycobacterium
WCRAGTAATITPAGMPG

SEQ ID NO: 786447 - protein, 18 aa, Mycobacterium
WCVRLVQGGGFAGPLLDG

SEQ ID NO: 786448 - protein, 25 aa, Mycobacterium
WDINTPAFEWYYQSGLSVIMPVGGQ

SEQ ID NO: 786449 - protein, 19 aa, Mycobacterium
WDQFVFSTPPAGSGLKPIM

SEQ ID NO: 786450 - protein, 17 aa, Mycobacterium
WDREKLGERLAKLAGGV

SEQ ID NO: 786451 - protein, 18 aa, Mycobacterium
WEHWGKPEIHWYQGGHTG

SEQ ID NO: 786452 - protein, 33 aa, Mycobacterium
WEMCTIGDPLLDLGWLLATWRQPDGSSVFSHAL

SEQ ID NO: 786453 - protein, 30 aa, Mycobacterium
WEQDPDVLDTWFSSALWPFSTMGWPDHTPE

SEQ ID NO: 786454 - protein, 19 aa, Mycobacterium
WGRRRLAYEIAKHAEGIYV

SEQ ID NO: 786455 - protein, 20 aa, Mycobacterium
WGVVNGTKAFLPHLIASGDG

SEQ ID NO: 786456 - protein, 29 aa, Mycobacterium
WHATTNLTKLPFLSGWRRPQEELDESSRA

SEQ ID NO: 786457 - protein, 17 aa, Mycobacterium
WHSLARLAIRDDIYASL

SEQ ID NO: 786458 - protein, 18 aa, Mycobacterium
WHSLARLAIRDDIYGSLR

SEQ ID NO: 786459 - protein, 19 aa, Mycobacterium
WHTDVTFAANYPAASILRA

SEQ ID NO: 786460 - protein, 33 aa, Mycobacterium
WHVEEWCGAYPARFIPMTLPVIWDPEACAKEIR

SEQ ID NO: 786461 - protein, 24 aa, Mycobacterium
WISTEYLFYRDDDGDYWLAGRRGS

SEQ ID NO: 786462 - protein, 21 aa, Mycobacterium
WKYLMALFSSKVDEYADPKVQ

SEQ ID NO: 786463 - protein, 20 aa, Mycobacterium
WLGNLIDAIGVALLPIAPEL

SEQ ID NO: 786464 - protein, 24 aa, Mycobacterium
WLLNGQKIWSSRAPFADMGFGLFR

SEQ ID NO: 786465 - protein, 27 aa, Mycobacterium
WLSTSRELPWRRPIASLNYLLSSHVWR

SEQ ID NO: 786466 - protein, 19 aa, Mycobacterium
WRDGVYAHGDYPRVFQDAA

SEQ ID NO: 786467 - protein, 18 aa, Mycobacterium
WRDMGTPEDFVRGSADLV

SEQ ID NO: 786468 - protein, 32 aa, Mycobacterium; identical to SEQ ID NO: 133968

SEQ ID NO: 786469 - protein, 29 aa, Mycobacterium
WTFDPVRRQFYWHRFFSHQPDLNYDNPAV

SEQ ID NO: 786470 - protein, 19 aa, Mycobacterium
WTRCRALELGLTGYAANQA

SEQ ID NO: 786471 - protein, 19 aa, Mycobacterium
WTSLAHWAQWCFVVARTEK

SEQ ID NO: 786472 - protein, 19 aa, Mycobacterium
WVAGLLDRLDHMLSYHAMY

SEQ ID NO: 786473 - protein, 26 aa, Mycobacterium
WVSDDPRFLFYPAIKELTLDIASEVF

SEQ ID NO: 786474 - protein, 17 aa, Mycobacterium
WVTLLRSAGAHDTYLRT

SEQ ID NO: 786475 - protein, 20 aa, Mycobacterium
YAFSAGGPVLWPDLEAILVV

SEQ ID NO: 786476 - protein, 32 aa, Mycobacterium
YAGNVIARKCGVPYLYRFELMGTPDDVEAVRA

SEQ ID NO: 786477 - protein, 27 aa, Mycobacterium
YAIRASHAFIYVRGEVLPVLRRLQNAV

SEQ ID NO: 786478 - protein, 17 aa, Mycobacterium
YAKLLRDIPFRVGAVVQ

SEQ ID NO: 786479 - protein, 17 aa, Mycobacterium
YAPMIHPWSSGRDLYFN

SEQ ID NO: 786480 - protein, 24 aa, Mycobacterium
YATFFKKYYDLLPDDGRMLLHSIV

SEQ ID NO: 786481 - protein, 29 aa, Mycobacterium
YATSASTPLFFAQAIGRFVRSRRPGETAS

SEQ ID NO: 786482 - protein, 17 aa, Mycobacterium
YATVPLLTHATKQILDQ

SEQ ID NO: 786483 - protein, 19 aa, Mycobacterium
YAVPRLLARNGLSLQDFDF

SEQ ID NO: 786484 - protein, 29 aa, Mycobacterium
YCCMPLFHGNALMALWAPALANGATVCLT

SEQ ID NO: 786485 - protein, 31 aa, Mycobacterium
YCHRSLYHLCQRPGWIGFTRNGGLANYVAVP

SEQ ID NO: 786486 - protein, 17 aa, Mycobacterium
YCHSTAPEIFLAAASQR

SEQ ID NO: 786487 - protein, 29 aa, Mycobacterium
YDLKKWIDWSVDLYYWSPSYSQIYTELKK

SEQ ID NO: 786488 - protein, 21 aa, Mycobacterium
YDMTAFWCRAGTAATITPAGM

SEQ ID NO: 786489 - protein, 17 aa, Mycobacterium
YDTYFFVAALPEGQRAD

SEQ ID NO: 786490 - protein, 17 aa, Mycobacterium
YDVLVGINLLREGLDLP

SEQ ID NO: 786491 - protein, 24 aa, Mycobacterium
YEIRTLFGVMFQDGALFGSMNLFD

SEQ ID NO: 786492 - protein, 17 aa, Mycobacterium
YELNYAGAALARKAADE

SEQ ID NO: 786493 - protein, 17 aa, Mycobacterium
YEMGMDLTPLTDWPGPG

SEQ ID NO: 786494 - protein, 26 aa, Mycobacterium
YFGAVRMVLALLPHWRERRFGHVVNV

SEQ ID NO: 786495 - protein, 21 aa, Mycobacterium
YFMDRYDPIWGDKGGLFTIAR

SEQ ID NO: 786496 - protein, 17 aa, Mycobacterium
YFPRFRALCMAENATHN

SEQ ID NO: 786497 - protein, 24 aa, Mycobacterium
YGAAKLGLVGLINTLAQEGAKYNI

SEQ ID NO: 786498 - protein, 18 aa, Mycobacterium
YGATLRITRLRPSGRGAD

SEQ ID NO: 786499 - protein, 25 aa, Mycobacterium
YGNAIINTLLLYMENHRDELVVFGA

SEQ ID NO: 786500 - protein, 23 aa, Mycobacterium
YIALEFAQMYRRFGARVTVVERG

SEQ ID NO: 786501 - protein, 17 aa, Mycobacterium
YKKSSVLFGLDLAKRDI

SEQ ID NO: 786502 - protein, 17 aa, Mycobacterium
YLEDLAGDYHRFYDSCR

SEQ ID NO: 786503 - protein, 27 aa, Mycobacterium
YLGITVPMFPNLFLLYGPNTNVGSGSI

SEQ ID NO: 786504 - protein, 18 aa, Mycobacterium
YLHAKSREQVPETLWPVL

SEQ ID NO: 786505 - protein, 25 aa, Mycobacterium
YLNRELSWLDFNARVLALAADPSLP

SEQ ID NO: 786506 - protein, 20 aa, Mycobacterium
YNDLHLTLKHIHWNVVGPNF

SEQ ID NO: 786507 - protein, 30 aa, Mycobacterium; identical to SEQ ID NO: 225820

SEQ ID NO: 786508 - protein, 29 aa, Mycobacterium
YNHYPIGWAMAFNTPYKLYKRYASHEGGI

SEQ ID NO: 786509 - protein, 18 aa, Mycobacterium
YPGDAGVLAALLLNRISL

SEQ ID NO: 786510 - protein, 23 aa, Mycobacterium
YQRIREILGRRPTDTELAMYSVM

SEQ ID NO: 786511 - protein, 17 aa, Mycobacterium
YQRLFSLRIGQTLREQF

SEQ ID NO: 786512 - protein, 17 aa, Mycobacterium
YRALRPGGVLLMADIKA

SEQ ID NO: 786513 - protein, 25 aa, Mycobacterium
YRCELYDLPTLWQVASHNPWLSVSP

SEQ ID NO: 786514 - protein, 19 aa, Mycobacterium
YRFSRTPMFTADALRRFRS

SEQ ID NO: 786515 - protein, 24 aa, Mycobacterium
YRIRDRVLRYVFAPDYQELKKAHE

SEQ ID NO: 786516 - protein, 18 aa, Mycobacterium
YRNLREPVEFYSCVAQLL

SEQ ID NO: 786517 - protein, 26 aa, Mycobacterium
YRQMPAADLLAWFDTSRAALVAAFAD

SEQ ID NO: 786518 - protein, 26 aa, Mycobacterium
YSELVISRPMRLTLPAVGAWPEEEVL

SEQ ID NO: 786519 - protein, 25 aa, Mycobacterium
YSGVMWACVFMRTGARRVHFGETEK

SEQ ID NO: 786520 - protein, 26 aa, Mycobacterium
YSKNITALLDLLLTDGKLAPDFDDEV

SEQ ID NO: 786521 - protein, 24 aa, Mycobacterium
YSNRAYLIQIRRAGAGTVLIDPVS

SEQ ID NO: 786522 - protein, 23 aa, Mycobacterium
YSPEQAYLLLGAAPIEGRLSGVV

SEQ ID NO: 786523 - protein, 26 aa, Mycobacterium
YSTEYDVERYFRDAPLMIVGEGTNEI

SEQ ID NO: 786524 - protein, 21 aa, Mycobacterium
YTAVAFTERLAAEGILPSVGS

SEQ ID NO: 786525 - protein, 17 aa, Mycobacterium
YTELQTISRRIGPPGPP

SEQ ID NO: 786526 - protein, 20 aa, Mycobacterium
YTGLIYRALGFPTRMFTVLF

SEQ ID NO: 786527 - protein, 19 aa, Mycobacterium
YTLWHHQLLGDPHDPASLL

SEQ ID NO: 786528 - protein, 17 aa, Mycobacterium
YVALMDGIVMGGGVGVS

SEQ ID NO: 786529 - protein, 25 aa, Mycobacterium
YVHNLIHGFILAAQHLVPGGTAPGQ

SEQ ID NO: 786530 - protein, 21 aa, Mycobacterium
YVKEDVAIRRLLSSGLERAGI

SEQ ID NO: 786531 - protein, 18 aa, Mycobacterium
YVLAVLKAGPDEVDGLVE

SEQ ID NO: 786532 - protein, 17 aa, Mycobacterium
YVRDLAPMLVGEPPALL

SEQ ID NO: 786533 - protein, 18 aa, Mycobacterium
YVSMPLFHSNAVVAGWAP

SEQ ID NO: 786534 - protein, 21 aa, Mycobacterium
YYKKFMSVNLDGALWCTRAVY

SEQ ID NO: 786535 - protein, 18 aa, Mycobacterium
YYNAIVWQDTRTDRIASA

SEQ ID NO: 786536 - protein, 19 aa, Mycobacterium
AAAAAALRRAEKNYGPHVA

SEQ ID NO: 786537 - protein, 18 aa, Mycobacterium
AAAAAELRLAPDTPAYFA

SEQ ID NO: 786538 - protein, 25 aa, Mycobacterium
AAAAAPYLEWLSGMAALAEETAALA

SEQ ID NO: 786539 - protein, 22 aa, Mycobacterium
AAAAAPYVGWLSAAAGQAESAA

SEQ ID NO: 786540 - protein, 24 aa, Mycobacterium
AAAAAPYVTWLSATGLQAAQTAGQ

SEQ ID NO: 786541 - protein, 24 aa, Mycobacterium
AAAAAWAGLAAELGWAASSYATVV

SEQ ID NO: 786542 - protein, 21 aa, Mycobacterium
AAAADLFYELLETHPERWELI

SEQ ID NO: 786543 - protein, 24 aa, Mycobacterium
AAAADLVLAIYNPASRTRTWQVAA

SEQ ID NO: 786544 - protein, 24 aa, Mycobacterium
AAAADMEFPLFVKAVSGGGGRGMR

SEQ ID NO: 786545 - protein, 20 aa, Mycobacterium
AAAAGFPRPILHGLCSYGVV

SEQ ID NO: 786546 - protein, 24 aa, Mycobacterium
AAAAHLQSWQRGLQQALSGVLGLP

SEQ ID NO: 786547 - protein, 18 aa, Mycobacterium
AAAAHWHTYRNRLAEVIS

SEQ ID NO: 786548 - protein, 17 aa, Mycobacterium
AAAAHWYTPDQLQWHTP

SEQ ID NO: 786549 - protein, 27 aa, Mycobacterium
AAAALAAPAAITPPAAPGADPVSVAAA

SEQ ID NO: 786550 - protein, 26 aa, Mycobacterium
AAAAMLPPRWVAVGIGPADGVVDRDA

SEQ ID NO: 786551 - protein, 23 aa, Mycobacterium
AAAAMPLHPLALSVLPELCSRYG

SEQ ID NO: 786552 - protein, 29 aa, Mycobacterium
AAAANPPMIRYPIPPMIHGATQSATWMSI

SEQ ID NO: 786553 - protein, 29 aa, Mycobacterium
AAAANPPMVRYPIPPMIHGATQSATWMSI

SEQ ID NO: 786554 - protein, 20 aa, Mycobacterium
AAAAPHLAWLSATAAQAEQV

SEQ ID NO: 786555 - protein, 25 aa, Mycobacterium
AAAAPLITAVVPPAADPVSLQTAAG

SEQ ID NO: 786556 - protein, 20 aa, Mycobacterium
AAAAPMISTVLPPAADAVSL

SEQ ID NO: 786557 - protein, 31 aa, Mycobacterium
AAAAPTAYDYGPLFVAPQAPEPQERPAPVRT

SEQ ID NO: 786558 - protein, 20 aa, Mycobacterium
AAAAPYVTWLSATAIQAEHT

SEQ ID NO: 786559 - protein, 26 aa, Mycobacterium
AAAAQKAIALLIIVGTHYLTGEEEID

SEQ ID NO: 786560 - protein, 31 aa, Mycobacterium
AAAAQLAHQALPQINFGIGNLGNLNIGNGNI

SEQ ID NO: 786561 - protein, 23 aa, Mycobacterium
AAAAQLLHIKQGPTAAIESVTPP

SEQ ID NO: 786562 - protein, 19 aa, Mycobacterium
AAAARHLASPGRPGRRVAV

SEQ ID NO: 786563 - protein, 26 aa, Mycobacterium
AAAARPLGIPVIVLAGQVVLDKSTIR

SEQ ID NO: 786564 - protein, 25 aa, Mycobacterium
AAAARRLAFIAELASRRAAPSEDAV

SEQ ID NO: 786565 - protein, 29 aa, Mycobacterium
AAAASHGIPLWRYLIGDKPAAMPLPEIQV

SEQ ID NO: 786566 - protein, 21 aa, Mycobacterium
AAAASPFVTWLAATAAQAEQV

SEQ ID NO: 786567 - protein, 27 aa, Mycobacterium
AAAAVGPFTFLRPGTVLGTGGKLGAFV

SEQ ID NO: 786568 - protein, 17 aa, Mycobacterium
AAAAVYILDAAMTVDQV

SEQ ID NO: 786569 - protein, 23 aa, Mycobacterium
AAAAWEGLDVTAVRSLPAYALLD

SEQ ID NO: 786570 - protein, 18 aa, Mycobacterium
AAAAYYTYRSQCSAIAKV

SEQ ID NO: 786571 - protein, 25 aa, Mycobacterium
AAACDDVLGFTLWIAGTPAVTRTLT

SEQ ID NO: 786572 - protein, 26 aa, Mycobacterium
AAACDEFIIYDALPGVPVFEPEPQTT

SEQ ID NO: 786573 - protein, 23 aa, Mycobacterium
AAACRLRILPAGRANAPAAGIAD

SEQ ID NO: 786574 - protein, 23 aa, Mycobacterium
AAADAFVWLRLYQQDLQAKLPRG

SEQ ID NO: 786575 - protein, 26 aa, Mycobacterium
AAADDVLLFKYIIKNTAWQAGKTVTF

SEQ ID NO: 786576 - protein, 30 aa, Mycobacterium
AAADEISMQIAALFGAHGQSFQAVSSQAAL

SEQ ID NO: 786577 - protein, 32 aa, Mycobacterium
AAADEVSAAIAALFGSHAREYQAISAQSAAFH

SEQ ID NO: 786578 - protein, 30 aa, Mycobacterium
AAADLLDEAWWFPAIQWPDGRMQFMLNERM

SEQ ID NO: 786579 - protein, 19 aa, Mycobacterium
AAADLVVLVTPADLRSCAA

SEQ ID NO: 786580 - protein, 20 aa, Mycobacterium
AAADMDGIGSAITAANAAAA

SEQ ID NO: 786581 - protein, 25 aa, Mycobacterium
AAADPLLACVLVGLGVTSLSAAAAA

SEQ ID NO: 786582 - protein, 23 aa, Mycobacterium
AAADQLVLLRLVIGRVARRHDVR

SEQ ID NO: 786583 - protein, 26 aa, Mycobacterium
AAADRRYALEMAPRLVAFSEDVARRV

SEQ ID NO: 786584 - protein, 30 aa, Mycobacterium
AAADWVRRHRKPAFLHLSTVRLMGHAGSDY

SEQ ID NO: 786585 - protein, 26 aa, Mycobacterium
AAADYRYVYAATGKPGWFLFDGLVKH

SEQ ID NO: 786586 - protein, 40 aa, Mycobacterium
AAAEAANTGPLQQLLEAINSPVQALTGRPLIGNGANGAPG

SEQ ID NO: 786587 - protein, 32 aa, Mycobacterium
AAAEAFTARPWCLGWHWCGWLENPHRGFGLKD

SEQ ID NO: 786588 - protein, 49 aa, Mycobacterium
AAAEAVNASPLQTLEQNVLAAINAPSQALTARPLFGDGADGAPGTGQNG

SEQ ID NO: 786589 - protein, 29 aa, Mycobacterium
AAAELGVGFVPYSPLGRGFLTGTVRSAAD

SEQ ID NO: 786590 - protein, 31 aa, Mycobacterium
AAAELGYDGLLAPLTFICVFGYQAQTAFFKY

SEQ ID NO: 786591 - protein, 24 aa, Mycobacterium
AAAELRAPIWIVTRGAQHVIEGDT

SEQ ID NO: 786592 - protein, 23 aa, Mycobacterium
AAAELRLAPGQRVWFSVKAHEVA

SEQ ID NO: 786593 - protein, 18 aa, Mycobacterium
AAAELYWITTVRPDGSPH

SEQ ID NO: 786594 - protein, 28 aa, Mycobacterium
AAAEWFARILFSLFSTPSSIRDLGDPDV

SEQ ID NO: 786595 - protein, 19 aa, Mycobacterium
AAAEWWCRTGTMPREALVE

SEQ ID NO: 786596 - protein, 22 aa, Mycobacterium
AAAEYLILRGVDRRVSREFLEN

SEQ ID NO: 786597 - protein, 18 aa, Mycobacterium
AAAFAGLAAHRVDLPTYA

SEQ ID NO: 786598 - protein, 19 aa, Mycobacterium
AAAFAHAIGVPVHGVCSLD

SEQ ID NO: 786599 - protein, 18 aa, Mycobacterium
AAAFDFLDETCWLALRAL

SEQ ID NO: 786600 - protein, 27 aa, Mycobacterium
AAAFEAAFGATVPPALVAANRAQLRAL

SEQ ID NO: 786601 - protein, 23 aa, Mycobacterium
AAAFEWTHWTVVHPSLVAANRAR

SEQ ID NO: 786602 - protein, 21 aa, Mycobacterium
AAAFGFWADKAPRYLADERIH

SEQ ID NO: 786603 - protein, 19 aa, Mycobacterium
AAAFGHALGVPVHGVCSLD

SEQ ID NO: 786604 - protein, 22 aa, Mycobacterium
AAAFGQWQSLLADGLIRMQDRG

SEQ ID NO: 786605 - protein, 17 aa, Mycobacterium
AAAFKVTAARLGEEVIS

SEQ ID NO: 786606 - protein, 37 aa, Mycobacterium
AAAFPAWRDTSLAKRTQVLFAFRELLNARKEEVAAII

SEQ ID NO: 786607 - protein, 33 aa, Mycobacterium
AAAFPGEPWAVPKFYWSVFSTRAFEAGLAALTP

SEQ ID NO: 786608 - protein, 22 aa, Mycobacterium
AAAFYGHVLGWTYDPATRQVTN

SEQ ID NO: 786609 - protein, 19 aa, Mycobacterium
AAAGCPLLMTVVSPAICGT

SEQ ID NO: 786610 - protein, 27 aa, Mycobacterium
AAAGDLTGIGEALRAATAAAAPSTTSL

SEQ ID NO: 786611 - protein, 25 aa, Mycobacterium
AAAGDTSWFLAAAAAYVLSAAELRG

SEQ ID NO: 786612 - protein, 26 aa, Mycobacterium
AAAGGTLRLLRPLFAAGVGGRLGSGK

SEQ ID NO: 786613 - protein, 23 aa, Mycobacterium
AAAGILGLIKLLLAGRHGRIPPT

SEQ ID NO: 786614 - protein, 28 aa, Mycobacterium
AAAGLMSGYLLARGVLRADAPRPAPVRE

SEQ ID NO: 786615 - protein, 28 aa, Mycobacterium
AAAGLNPFEQLLALLPNIGIGNKGGTGN

SEQ ID NO: 786616 - protein, 29 aa, Mycobacterium
AAAGPGTKLMILPPLIHGAAQWSVMTAIT

SEQ ID NO: 786617 - protein, 26 aa, Mycobacterium
AAAGQLVRVARGGVIKVLAGGAITAG

SEQ ID NO: 786618 - protein, 26 aa, Mycobacterium
AAAGRPIVVRLLVTAMRHAAVSREIA

SEQ ID NO: 786619 - protein, 27 aa, Mycobacterium
AAAGVTWALLTRPIALMTILANVVAGY

SEQ ID NO: 786620 - protein, 18 aa, Mycobacterium
AAAGWADAALLRVDSRNQ

SEQ ID NO: 786621 - protein, 30 aa, Mycobacterium
AAAHAIALQLGWRLMGPSLRAGFGLDDMSD

SEQ ID NO: 786622 - protein, 23 aa, Mycobacterium
AAAHGNFTLGLGLGARVIEHYAF

SEQ ID NO: 786623 - protein, 22 aa, Mycobacterium
AAAHILLQWHVAATGSTKGQAL

SEQ ID NO: 786624 - protein, 27 aa, Mycobacterium
AAAHLDIRHNHVALRILQDEAGVTGVL

SEQ ID NO: 786625 - protein, 24 aa, Mycobacterium
AAAHQAIVGDRLRLALDAALCAAV

SEQ ID NO: 786626 - protein, 30 aa, Mycobacterium
AAAHSPMDVLWFRLNWRPGDPQELYGVARR

SEQ ID NO: 786627 - protein, 22 aa, Mycobacterium
AAAIAGLPDVALPAGIITDLQN

SEQ ID NO: 786628 - protein, 18 aa, Mycobacterium
AAAIFPPGTVISEAAIGL

SEQ ID NO: 786629 - protein, 22 aa, Mycobacterium
AAAIHELFVTTLGASGGSYAAT

SEQ ID NO: 786630 - protein, 31 aa, Mycobacterium
AAAIHVSNWLRPWLPSLLALSANSRVYRNAD

SEQ ID NO: 786631 - protein, 33 aa, Mycobacterium; identical to SEQ ID NO: 118730

SEQ ID NO: 786632 - protein, 19 aa, Mycobacterium
AAAINDPVQALTGRPLIGN

SEQ ID NO: 786633 - protein, 24 aa, Mycobacterium
AAAIRGLGLLASGQPRRAAAEYDD

SEQ ID NO: 786634 - protein, 30 aa, Mycobacterium
AAAIRQVSAPLYYQFLTSTKRLTTADADRA

SEQ ID NO: 786635 - protein, 23 aa, Mycobacterium
AAAKAAILASIAFHTRVHADDVY

SEQ ID NO: 786636 - protein, 24 aa, Mycobacterium
AAAKELVWKLQHASYMAGNYLTGW

SEQ ID NO: 786637 - protein, 25 aa, Mycobacterium
AAAKLIAAARKPVLYVGGGVIRGEA

SEQ ID NO: 786638 - protein, 29 aa, Mycobacterium
AAAKTMNLLDLPWVEPLDIANASLFLASD

SEQ ID NO: 786639 - protein, 28 aa, Mycobacterium
AAAKWREIFGPENFFLELMDHGLDIERR

SEQ ID NO: 786640 - protein, 20 aa, Mycobacterium
AAALAFLRRLHDETRRIDGF

SEQ ID NO: 786641 - protein, 18 aa, Mycobacterium
AAALAIPIAIVNRGPTRG

SEQ ID NO: 786642 - protein, 30 aa, Mycobacterium
AAALAWPGTEQQWLGGWFARAGLGATSRAN

SEQ ID NO: 786643 - protein, 26 aa, Mycobacterium
AAALDDLDAPLWAGLRTLAAHPGAAA

SEQ ID NO: 786644 - protein, 23 aa, Mycobacterium
AAALDRAWPRYDTMRTELAVGQF

SEQ ID NO: 786645 - protein, 22 aa, Mycobacterium
AAALESLTSIRRAGADIVLSYW

SEQ ID NO: 786646 - protein, 22 aa, Mycobacterium
AAALESLTSIRRAGADIVLTYW

SEQ ID NO: 786647 - protein, 18 aa, Mycobacterium
AAALHIAIARRTGDTGVL

SEQ ID NO: 786648 - protein, 18 aa, Mycobacterium
AAALLAAHLPERSAPVLD

SEQ ID NO: 786649 - protein, 21 aa, Mycobacterium
AAALLRVALRCAVELGIGVLH

SEQ ID NO: 786650 - protein, 18 aa, Mycobacterium
AAALMDLALATAGGWGVA

SEQ ID NO: 786651 - protein, 28 aa, Mycobacterium
AAALPEPLPAGPVRRAPLGILAGARSGD

SEQ ID NO: 786652 - protein, 18 aa, Mycobacterium
AAALPHVLAAGGGSLVNI

SEQ ID NO: 786653 - protein, 26 aa, Mycobacterium
AAALPSWEAGLQQWISGLPGVGQLQA

SEQ ID NO: 786654 - protein, 18 aa, Mycobacterium
AAALQTGMRLALFEVFDP

SEQ ID NO: 786655 - protein, 27 aa, Mycobacterium
AAALRAPLDVFLVRKLGVPRWSELAMG

SEQ ID NO: 786656 - protein, 17 aa, Mycobacterium
AAALRARTAFRKLAPSA

SEQ ID NO: 786657 - protein, 19 aa, Mycobacterium
AAALRDGTANRRTTWEVFA

SEQ ID NO: 786658 - protein, 18 aa, Mycobacterium
AAALRDRLDPAKPPHVGV

SEQ ID NO: 786659 - protein, 18 aa, Mycobacterium
AAALRERLDPTRPPHVGV

SEQ ID NO: 786660 - protein, 17 aa, Mycobacterium
AAALRRELLRDGQVFYV

SEQ ID NO: 786661 - protein, 17 aa, Mycobacterium
AAALRTAIARRSGDTGA

SEQ ID NO: 786662 - protein, 26 aa, Mycobacterium
AAALRTGLFKLCGRLDYRLPDTPIVS

SEQ ID NO: 786663 - protein, 22 aa, Mycobacterium
AAALTVYFQFLELRHKVELHNL

SEQ ID NO: 786664 - protein, 18 aa, Mycobacterium
AAALVADTPVRGAMGFRL

SEQ ID NO: 786665 - protein, 25 aa, Mycobacterium
AAALYRHYAGKYELFRDAVLNLGQQ

SEQ ID NO: 786666 - protein, 17 aa, Mycobacterium
AAALYRKATTGQGSVVD

SEQ ID NO: 786667 - protein, 25 aa, Mycobacterium
AAALYRRWDSLWDRLIGACRPGAGA

SEQ ID NO: 786668 - protein, 24 aa, Mycobacterium
AAAMLTAVTPYVSWLTTMATRAEQ

SEQ ID NO: 786669 - protein, 23 aa, Mycobacterium
AAAMNALVSLTLAVAYAGPDPQT

SEQ ID NO: 786670 - protein, 20 aa, Mycobacterium
AAAMPPVARLPSGAEPPAVG

SEQ ID NO: 786671 - protein, 21 aa, Mycobacterium
AAAMRRLSSLLLSLEHPHPTV

SEQ ID NO: 786672 - protein, 17 aa, Mycobacterium
AAAMSAAAVPYADWLSA

SEQ ID NO: 786673 - protein, 26 aa, Mycobacterium
AAAMTAAAAPYSAWLSVAAARAQSAA

SEQ ID NO: 786674 - protein, 24 aa, Mycobacterium
AAANEFPMRLLTVGPLMHGGSQWI

SEQ ID NO: 786675 - protein, 17 aa, Mycobacterium
AAANIPGLPSGLPPGVV

SEQ ID NO: 786676 - protein, 23 aa, Mycobacterium
AAANPDAWFYQRPITLEDHQNSR

SEQ ID NO: 786677 - protein, 28 aa, Mycobacterium
AAANPPMVRYPIPPMIHGATQSATWMAL

SEQ ID NO: 786678 - protein, 28 aa, Mycobacterium
AAANSWLDAFMQWRRAQGLPATSIAWGA

SEQ ID NO: 786679 - protein, 29 aa, Mycobacterium
AAANSWLDAFTHWRQLQGLPATSIAWGAW

SEQ ID NO: 786680 - protein, 27 aa, Mycobacterium
AAANSWLDAFTRWRRARGLPATAIAWG

SEQ ID NO: 786681 - protein, 36 aa, Mycobacterium
AAANSWLDAFVQWRRVRGLPATAIAWGPWAEVGRGA

SEQ ID NO: 786682 - protein, 29 aa, Mycobacterium
AAANVWEGLQLGIRRFDAALGGLGGCPFA

SEQ ID NO: 786683 - protein, 24 aa, Mycobacterium
AAAPAITAVVPPAVDPVSVQTAVG

SEQ ID NO: 786684 - protein, 30 aa, Mycobacterium
AAAPDAGLPLYAGWRTMPLADDAPARALQV

SEQ ID NO: 786685 - protein, 24 aa, Mycobacterium
AAAPFNAFLIAQGLETLSLRIERH

SEQ ID NO: 786686 - protein, 27 aa, Mycobacterium
AAAPGAALFVLVFAKGAFPAEMEPKPN

SEQ ID NO: 786687 - protein, 18 aa, Mycobacterium
AAAPGATITTDRTRPLRA

SEQ ID NO: 786688 - protein, 26 aa, Mycobacterium
AAAPGGFFGIPPVGSLVNAPRGEQTR

SEQ ID NO: 786689 - protein, 22 aa, Mycobacterium
AAAPGPIYIWDGATPENRTGGF

SEQ ID NO: 786690 - protein, 23 aa, Mycobacterium
AAAPGRLLGKPAYHALTFGWLMS

SEQ ID NO: 786691 - protein, 27 aa, Mycobacterium
AAAPGRYIPMVIVPLWDTRLAVEETLR

SEQ ID NO: 786692 - protein, 25 aa, Mycobacterium
AAAPGSRFRIATPPGMRITIADLSV

SEQ ID NO: 786693 - protein, 20 aa, Mycobacterium
AAAPIERILARMPGISQVAV

SEQ ID NO: 786694 - protein, 24 aa, Mycobacterium
AAAPIERILLRHSAINRVAVYAVA

SEQ ID NO: 786695 - protein, 24 aa, Mycobacterium
AAAPIERILLRHSAINRVAVYAVP

SEQ ID NO: 786696 - protein, 25 aa, Mycobacterium
AAAPIPLPPATIPLAQAPPIPAVSA

SEQ ID NO: 786697 - protein, 23 aa, Mycobacterium
AAAPIPTSSWPQLLGRLTEGKHL

SEQ ID NO: 786698 - protein, 22 aa, Mycobacterium
AAAPLITGVVAPAADPVSLRTA

SEQ ID NO: 786699 - protein, 20 aa, Mycobacterium
AAAPLLFETLGTAAQDAPAM

SEQ ID NO: 786700 - protein, 25 aa, Mycobacterium
AAAPNEQLMWWACESDPDTARACHV

SEQ ID NO: 786701 - protein, 19 aa, Mycobacterium
AAAPPPRRKPRRPARAVTG

SEQ ID NO: 786702 - protein, 26 aa, Mycobacterium
AAAPVDRYFGKPAYHALSIGWLMGRL

SEQ ID NO: 786703 - protein, 19 aa, Mycobacterium
AAAPVLVQVPRRGYVPSLA

SEQ ID NO: 786704 - protein, 24 aa, Mycobacterium
AAAPVSFFAYPGRASSLVPPGCEV

SEQ ID NO: 786705 - protein, 20 aa, Mycobacterium
AAAPVYDFRPFIIADADTGH

SEQ ID NO: 786706 - protein, 19 aa, Mycobacterium
AAAPVYDYRPFIIADADTG

SEQ ID NO: 786707 - protein, 22 aa, Mycobacterium
AAAPWPTFCHVPFGILIGAVTD

SEQ ID NO: 786708 - protein, 28 aa, Mycobacterium
AAAQAGVTRFVMVSYFGAGPDHGVPQDD

SEQ ID NO: 786709 - protein, 24 aa, Mycobacterium
AAAQAILGLLPQFSGAAGLGHGIT

SEQ ID NO: 786710 - protein, 25 aa, Mycobacterium
AAAQEDWMFSYGWHALDAVADTARG

SEQ ID NO: 786711 - protein, 24 aa, Mycobacterium
AAAQGLWYPPDPSSFEICSIGGNI

SEQ ID NO: 786712 - protein, 25 aa, Mycobacterium
AAAQLSSWQGMVSGVLSGVPGVSGL

SEQ ID NO: 786713 - protein, 26 aa, Mycobacterium
AAAQLSSWQGMVSGVLSGVPGVSGLV

SEQ ID NO: 786714 - protein, 35 aa, Mycobacterium
AAAQLTSWQQALQSLPGLSGFNLGIGNIGTGNIGS

SEQ ID NO: 786715 - protein, 31 aa, Mycobacterium
AAAQNLDLAVSFSGVQLLQRGSANATTAGFG

SEQ ID NO: 786716 - protein, 22 aa, Mycobacterium
AAAQQFIGRLLIPLGGISEVQP

SEQ ID NO: 786717 - protein, 45 aa, Mycobacterium
AAAQQGLSALKRPWFPIIPTQDWNALINTWGLTYFGAGIVQLVTL

SEQ ID NO: 786718 - protein, 20 aa, Mycobacterium
AAAQWIGVVSFLMSPGTARR

SEQ ID NO: 786719 - protein, 27 aa, Mycobacterium
AAARAGVKRFVMVSYFGAGPDHGLPQE

SEQ ID NO: 786720 - protein, 23 aa, Mycobacterium
AAARAVTTTPWLTSRHSFSFGDH

SEQ ID NO: 786721 - protein, 21 aa, Mycobacterium
AAARFGSVRIAAEDALTWAGA

SEQ ID NO: 786722 - protein, 23 aa, Mycobacterium
AAARFRRPGAPPSATPSSSRRYD

SEQ ID NO: 786723 - protein, 23 aa, Mycobacterium
AAARHMRDLGVGALPICGDDDRL

SEQ ID NO: 786724 - protein, 32 aa, Mycobacterium
AAARKAGRRFAMLSPIVATHRKLATARDDLAT

SEQ ID NO: 786725 - protein, 27 aa, Mycobacterium
AAARKRLLYGRYLGWASGTKRHPKGLI

SEQ ID NO: 786726 - protein, 20 aa, Mycobacterium
AAARLAALAAPGLIVIGRDV

SEQ ID NO: 786727 - protein, 19 aa, Mycobacterium
AAARLGCGLVTAAEKVRAQ

SEQ ID NO: 786728 - protein, 18 aa, Mycobacterium
AAARLGLGPLRRVRPDVV

SEQ ID NO: 786729 - protein, 18 aa, Mycobacterium
AAARLPTPQLLIGAEDVS

SEQ ID NO: 786730 - protein, 25 aa, Mycobacterium
AAARLRAALALLVWERRGESVRATV

SEQ ID NO: 786731 - protein, 22 aa, Mycobacterium
AAARLVVREELEPALRAVPVEE

SEQ ID NO: 786732 - protein, 21 aa, Mycobacterium
AAARPLGIPVIVLAGQVDLDK

SEQ ID NO: 786733 - protein, 17 aa, Mycobacterium
AAARRADIPFGGTVAVI

SEQ ID NO: 786734 - protein, 20 aa, Mycobacterium
AAARTFKAAALAAAAAAPGA

SEQ ID NO: 786735 - protein, 17 aa, Mycobacterium
AAARTTGLLAAAEDEVS

SEQ ID NO: 786736 - protein, 25 aa, Mycobacterium
AAARTWLDDQPGYLPPVGLGEVIRA

SEQ ID NO: 786737 - protein, 19 aa, Mycobacterium
AAARTWLDDQPGYLPPVQL

SEQ ID NO: 786738 - protein, 18 aa, Mycobacterium
AAARVRATLPSGAELLFC

SEQ ID NO: 786739 - protein, 22 aa, Mycobacterium
AAARVRATLPSGAELLFCQHHA

SEQ ID NO: 786740 - protein, 17 aa, Mycobacterium
AAARWITAASLARAETR

SEQ ID NO: 786741 - protein, 21 aa, Mycobacterium
AAASDWYKPLDTGFNPAAEIV

SEQ ID NO: 786742 - protein, 29 aa, Mycobacterium
AAASELGMPPWRIEKAQKQARRWTRDAVA

SEQ ID NO: 786743 - protein, 20 aa, Mycobacterium
AAASIRAMMSILGCDPLDER

SEQ ID NO: 786744 - protein, 25 aa, Mycobacterium
AAASLLAPFSLPPQTSDPSGLARQA

SEQ ID NO: 786745 - protein, 28 aa, Mycobacterium
AAASLNPFQQLLQALPNIGLGNKGGTGN

SEQ ID NO: 786746 - protein, 21 aa, Mycobacterium
AAASMRQWFAQPVRALDAPTQ

SEQ ID NO: 786747 - protein, 25 aa, Mycobacterium
AAASRPPVVFWPPNRGQYLSALSDS

SEQ ID NO: 786748 - protein, 22 aa, Mycobacterium
AAASTPRLWLLGSSMYSARLAA

SEQ ID NO: 786749 - protein, 23 aa, Mycobacterium
AAATLPHDFVGSHPPIGAGDHLP

SEQ ID NO: 786750 - protein, 20 aa, Mycobacterium
AAATPLPRSALAAAVDVLDA

SEQ ID NO: 786751 - protein, 24 aa, Mycobacterium
AAATPLQPLLDAINAPFVAATGRP

SEQ ID NO: 786752 - protein, 20 aa, Mycobacterium
AAATQLPRLHAYSAKLNAAL

SEQ ID NO: 786753 - protein, 23 aa, Mycobacterium
AAATRWAATLAPYGLRWYEEPGD

SEQ ID NO: 786754 - protein, 25 aa, Mycobacterium
AAATWLRGIKVVHVPTTLLAMVDAA

SEQ ID NO: 786755 - protein, 34 aa, Mycobacterium
AAATYAIDRGLAERWQIRRYGFHGTSHRYVSEQA

SEQ ID NO: 786756 - protein, 21 aa, Mycobacterium
AAAVAILQAWLDQRRTLAGGR

SEQ ID NO: 786757 - protein, 21 aa, Mycobacterium
AAAVAPYPGWLGAAATRAAAA

SEQ ID NO: 786758 - protein, 17 aa, Mycobacterium
AAAVDVTLLGRFYERFA

SEQ ID NO: 786759 - protein, 21 aa, Mycobacterium
AAAVEALRKLAAQCPVAVLSG

SEQ ID NO: 786760 - protein, 21 aa, Mycobacterium
AAAVIDAGLTWIGPPVAAVSA

SEQ ID NO: 786761 - protein, 17 aa, Mycobacterium
AAAVLRRPVTVARLQAL

SEQ ID NO: 786762 - protein, 25 aa, Mycobacterium
AAAVNFPDVLLVAGTYQISVPPPFV

SEQ ID NO: 786763 - protein, 22 aa, Mycobacterium
AAAVPLSYGYHPYFTIPGVPRS

SEQ ID NO: 786764 - protein, 28 aa, Mycobacterium
AAAVPPLRTLYRDRLLVLGALDVASVVE

SEQ ID NO: 786765 - protein, 25 aa, Mycobacterium
AAAVPPRPVLSLPLNHPGLAVRIAS

SEQ ID NO: 786766 - protein, 17 aa, Mycobacterium
AAAVRLHKQAHLPYLVY

SEQ ID NO: 786767 - protein, 17 aa, Mycobacterium
AAAVRLHQQAHLPYLVY

SEQ ID NO: 786768 - protein, 22 aa, Mycobacterium
AAAVTFVGSLSLAIGLQLTPER

SEQ ID NO: 786769 - protein, 28 aa, Mycobacterium
AAAVVDWFSVDWHRAIVDKWRAAGVRTA

SEQ ID NO: 786770 - protein, 27 aa, Mycobacterium
AAAVWLARRGLRVWACDISPVAVAAAT

SEQ ID NO: 786771 - protein, 23 aa, Mycobacterium
AAAVWLQALADLVETLLPTIQAQ

SEQ ID NO: 786772 - protein, 19 aa, Mycobacterium
AAAWAGLAEELSSAASSFG

SEQ ID NO: 786773 - protein, 30 aa, Mycobacterium
AAAWDRVYWIMADTLIALERDLYKAAGVTD

SEQ ID NO: 786774 - protein, 24 aa, Mycobacterium
AAAWMFDYYPLRDITERPDGSCEA

SEQ ID NO: 786775 - protein, 28 aa, Mycobacterium
AAAWSLDVSPLQRLIAAAGATLAFAGDR

SEQ ID NO: 786776 - protein, 17 aa, Mycobacterium
AAAWTLHARLVRRHLER

SEQ ID NO: 786777 - protein, 18 aa, Mycobacterium
AAAWVQLMDRLGYDRFLA

SEQ ID NO: 786778 - protein, 18 aa, Mycobacterium
AAAYARWAGRRLPTEAEW

SEQ ID NO: 786779 - protein, 17 aa, Mycobacterium
AAAYDRIPESRYLFNNT

SEQ ID NO: 786780 - protein, 31 aa, Mycobacterium
AAAYEAAFAMTVPPPLIAANRAQLAALIATN

SEQ ID NO: 786781 - protein, 31 aa, Mycobacterium
AAAYEAAYAMTVPPPLIAANRSQLMALIATN

SEQ ID NO: 786782 - protein, 23 aa, Mycobacterium
AAAYETALAASVPPPLVAANRAE

SEQ ID NO: 786783 - protein, 25 aa, Mycobacterium
AAAYSAPGYAFFWNVDQKKMEILGS

SEQ ID NO: 786784 - protein, 24 aa, Mycobacterium
AAAYTQRFIELGLNPDQIVLVVRV

SEQ ID NO: 786785 - protein, 18 aa, Mycobacterium
AACALLVRAWSGSGYEVA

SEQ ID NO: 786786 - protein, 23 aa, Mycobacterium
AACIAAYRRYIRWVVDDPATAEK

SEQ ID NO: 786787 - protein, 26 aa, Mycobacterium
AACKSGGLLPFANFNRIHAVPPCNVT

SEQ ID NO: 786788 - protein, 20 aa, Mycobacterium
AACLAVYRPYVLDTVITFET

SEQ ID NO: 786789 - protein, 33 aa, Mycobacterium
AACLRKTDWLFPQYREIGAFLLRGITPAQMGAV

SEQ ID NO: 786790 - protein, 32 aa, Mycobacterium
AACLRKTDWLFPQYRELGAFLVRGIPPGHVGA

SEQ ID NO: 786791 - protein, 25 aa, Mycobacterium
AACQGHCPPRQFQRARVVVFAGDHG

SEQ ID NO: 786792 - protein, 26 aa, Mycobacterium
AACQGTCPPQPLTRPRIVVFAGDHGV

SEQ ID NO: 786793 - protein, 18 aa, Mycobacterium
AACRAGVIGSFPTHNATS

SEQ ID NO: 786794 - protein, 19 aa, Mycobacterium
AACTAFGIPVLYAPGRNAD

SEQ ID NO: 786795 - protein, 23 aa, Mycobacterium
AACTFTFTFTVAEPGWTMFMVSH

SEQ ID NO: 786796 - protein, 26 aa, Mycobacterium
AACWDAREWLRRPTLRHGASADLVCF

SEQ ID NO: 786797 - protein, 17 aa, Mycobacterium
AACWEARRWLGRPTVEH

SEQ ID NO: 786798 - protein, 25 aa, Mycobacterium
AADAELFIIAAALGGKPALFLVEAS

SEQ ID NO: 786799 - protein, 20 aa, Mycobacterium
AADAELRIGPQRSAHRLSAV

SEQ ID NO: 786800 - protein, 24 aa, Mycobacterium
AADAFFGLPLAEKNRWRRPASENR

SEQ ID NO: 786801 - protein, 31 aa, Mycobacterium
AADAKIGYPPMRVWGVPAAGLWAHRLGDQRA

SEQ ID NO: 786802 - protein, 24 aa, Mycobacterium
AADALGYPVLLKEVGHGIGGAAVA

SEQ ID NO: 786803 - protein, 19 aa, Mycobacterium
AADALKWGLINQVVPDGTV

SEQ ID NO: 786804 - protein, 18 aa, Mycobacterium
AADALLESNPFALLVGML

SEQ ID NO: 786805 - protein, 19 aa, Mycobacterium
AADALTFRGAAMSNPAAAG

SEQ ID NO: 786806 - protein, 23 aa, Mycobacterium
AADAVAAYLPYRDKPRSPEGLKK

SEQ ID NO: 786807 - protein, 23 aa, Mycobacterium
AADAVAAYLPYRSKPRSPEGLKK

SEQ ID NO: 786808 - protein, 29 aa, Mycobacterium
AADAVARFFGNRTWWPRLSSTVTGCWLVT

SEQ ID NO: 786809 - protein, 24 aa, Mycobacterium
AADAVTCYLDRTPPPPPTAAVPVA

SEQ ID NO: 786810 - protein, 33 aa, Mycobacterium
AADAYDAYLRLHLLSHRLVAPHGLNAGGFFGVL

SEQ ID NO: 786811 - protein, 25 aa, Mycobacterium
AADDARFWEPFMARGFTPDSGAAWL

SEQ ID NO: 786812 - protein, 54 aa, Mycobacterium
AADDEVSVAIAALFSGHGQAYRAISAQAAAFHDQFLRALTGAGGAYAAAEAANA

SEQ ID NO: 786813 - protein, 32 aa, Mycobacterium
AADDVLFVDRSLLDVVWPLVGRFTTVRHVIVM

SEQ ID NO: 786814 - protein, 18 aa, Mycobacterium
AADDVLLVAGLRVSQRDK

SEQ ID NO: 786815 - protein, 23 aa, Mycobacterium
AADDWLALLEAFDQPHRPGIVRA

SEQ ID NO: 786816 - protein, 23 aa, Mycobacterium
AADDWMCLLEAFDQPHRSGLVRA

SEQ ID NO: 786817 - protein, 25 aa, Mycobacterium
AADEADLLWALRGGGANFGVVTHLR

SEQ ID NO: 786818 - protein, 32 aa, Mycobacterium
AADEDMLASFILLRRLLLLAWMGTHSHSKESQ

SEQ ID NO: 786819 - protein, 24 aa, Mycobacterium
AADEIPPFAPFLTAAPAKGRGVDQ

SEQ ID NO: 786820 - protein, 53 aa, Mycobacterium
AADEISAAIAELFGNHAQQYQALSAQIARFHDQFVRSLSGAAQTYASAEATGA

SEQ ID NO: 786821 - protein, 23 aa, Mycobacterium
AADEITWDLLFADLSGQYAFETG

SEQ ID NO: 786822 - protein, 25 aa, Mycobacterium
AADENLHMIFYRNMCSAALDLVPDQ

SEQ ID NO: 786823 - protein, 33 aa, Mycobacterium; identical to SEQ ID NO: 123407

SEQ ID NO: 786824 - protein, 31 aa, Mycobacterium
AADETLLALTRLRELLDRYPLRGIKGPMGTG

SEQ ID NO: 786825 - protein, 53 aa, Mycobacterium
AADEVSTAIAALFSQHAKTYQLLAAELAAIPDRFTKTVLASANSYASAEATNA

SEQ ID NO: 786826 - protein, 25 aa, Mycobacterium
AADFGIHPMTLSKWMRQADVDDGAK

SEQ ID NO: 786827 - protein, 17 aa, Mycobacterium
AADFGVHPITLSKWMRQ

SEQ ID NO: 786828 - protein, 27 aa, Mycobacterium
AADFPANPLNLLAFANALAGFQYVHVP

SEQ ID NO: 786829 - protein, 25 aa, Mycobacterium
AADFRQFDFLGIRDLTAGRPIIVVM

SEQ ID NO: 786830 - protein, 24 aa, Mycobacterium
AADFVSARALGCTIKLLAICERLT

SEQ ID NO: 786831 - protein, 24 aa, Mycobacterium
AADFVYTTYIRTTPERLWQAVTDP

SEQ ID NO: 786832 - protein, 23 aa, Mycobacterium
AADGELGTLWYTTTPQPGAAEQW

SEQ ID NO: 786833 - protein, 17 aa, Mycobacterium
AADGFILSTSGLPGQFE

SEQ ID NO: 786834 - protein, 26 aa, Mycobacterium
AADGKRFWLVGLQGDRHWPALCAAVQ

SEQ ID NO: 786835 - protein, 27 aa, Mycobacterium
AADGPPVLPQWPLADGVAALAGAFATM

SEQ ID NO: 786836 - protein, 28 aa, Mycobacterium
AADGRPLVTPVWFVVDEGQLAFNTGRDT

SEQ ID NO: 786837 - protein, 26 aa, Mycobacterium
AADGSLPPVIFQLLHQPVLDDRPTAS

SEQ ID NO: 786838 - protein, 25 aa, Mycobacterium
AADGVYEFQLIAPPLRVVGAVGSPV

SEQ ID NO: 786839 - protein, 20 aa, Mycobacterium
AADGWVRLHANYPHHARVLV

SEQ ID NO: 786840 - protein, 20 aa, Mycobacterium
AADHLIAHILTRYPQMEYGS

SEQ ID NO: 786841 - protein, 23 aa, Mycobacterium
AADHSLPPLAYLVDSETAAVDYV

SEQ ID NO: 786842 - protein, 18 aa, Mycobacterium
AADIEVEALRWADRPEFA

SEQ ID NO: 786843 - protein, 27 aa, Mycobacterium
AADIEVPAPPFWGSRIVKGLAVADYTG

SEQ ID NO: 786844 - protein, 21 aa, Mycobacterium
AADIIAKRWGGGGRPLAQVAG

SEQ ID NO: 786845 - protein, 27 aa, Mycobacterium
AADIKAIPFVIHVMDRLARVVNALGGD

SEQ ID NO: 786846 - protein, 27 aa, Mycobacterium
AADIKAIPPVIHLMDRLARVVNALGGD

SEQ ID NO: 786847 - protein, 22 aa, Mycobacterium
AADILFHQFDIDPPLSGLELEV

SEQ ID NO: 786848 - protein, 20 aa, Mycobacterium
AADIRICSAAATFGNAAILL

SEQ ID NO: 786849 - protein, 36 aa, Mycobacterium
AADKAAHFIMVADAFHLPIVFLADNPGMLPGSRSEK

SEQ ID NO: 786850 - protein, 36 aa, Mycobacterium
AADKAAHFIMVADAFHLPIVFLADNPGMLPGSRSER

SEQ ID NO: 786851 - protein, 33 aa, Mycobacterium; identical to SEQ ID NO: 112942

SEQ ID NO: 786852 - protein, 34 aa, Mycobacterium
AADKAGDFLALCESFGLPVISLCDTPGFMVGPDA

SEQ ID NO: 786853 - protein, 24 aa, Mycobacterium
AADKLRITPPPLSKQIKLLEKELG

SEQ ID NO: 786854 - protein, 19 aa, Mycobacterium
AADKVWLGIALHTTPGVPE

SEQ ID NO: 786855 - protein, 20 aa, Mycobacterium
AADLARLRRISELVDAGINL

SEQ ID NO: 786856 - protein, 19 aa, Mycobacterium
AADLAYFRVLIHSTRNRAL

SEQ ID NO: 786857 - protein, 33 aa, Mycobacterium
AADLGHKGLLAPLTFISVFGYKAQSAFFKHANI

SEQ ID NO: 786858 - protein, 22 aa, Mycobacterium
AADLGPRRALTGEQLAPLLSAT

SEQ ID NO: 786859 - protein, 25 aa, Mycobacterium
AADLHDWYGRYLYFSPDEIEPVEAQ

SEQ ID NO: 786860 - protein, 25 aa, Mycobacterium
AADLHDWYGRYLYFSPDEVEPLESE

SEQ ID NO: 786861 - protein, 26 aa, Mycobacterium
AADLLWSRVIKQFPDVRFALSEGGTG

SEQ ID NO: 786862 - protein, 19 aa, Mycobacterium
AADLNGVIAWAKEARTRLA

SEQ ID NO: 786863 - protein, 19 aa, Mycobacterium
AADLPAGTLLVIVHSGGGR

SEQ ID NO: 786864 - protein, 19 aa, Mycobacterium
AADLPPGTVLVVIHSGGGR

SEQ ID NO: 786865 - protein, 19 aa, Mycobacterium
AADLQILKRGARLVEFAKL

SEQ ID NO: 786866 - protein, 30 aa, Mycobacterium
AADLQVTRYALPNLRALNFVIEGILGQGVA

SEQ ID NO: 786867 - protein, 26 aa, Mycobacterium
AADLRGPVLIGVRPEGWRLTAPDAGI

SEQ ID NO: 786868 - protein, 26 aa, Mycobacterium
AADLRLQRIFVLTFEVDFFARHGFQE

SEQ ID NO: 786869 - protein, 19 aa, Mycobacterium
AADLRTDWSRPLEAAGFDV

SEQ ID NO: 786870 - protein, 17 aa, Mycobacterium
AADLVRAQLQLPADWEP

SEQ ID NO: 786871 - protein, 23 aa, Mycobacterium
AADLVRWVGKLFASLTTPRGSAM

SEQ ID NO: 786872 - protein, 22 aa, Mycobacterium
AADMAVLSLLGPRLSDPAVLEA

SEQ ID NO: 786873 - protein, 20 aa, Mycobacterium
AADMPKLIAACEWLDRHRHS

SEQ ID NO: 786874 - protein, 25 aa, Mycobacterium
AADNSKLWFAIAAALMASGSKSAQR

SEQ ID NO: 786875 - protein, 23 aa, Mycobacterium
AADPDFLMLPKVQSAAEIGLVKR

SEQ ID NO: 786876 - protein, 27 aa, Mycobacterium
AADPGWAYGLYYAILSPLATGTRSILL

SEQ ID NO: 786877 - protein, 18 aa, Mycobacterium
AADPLAGLVLKDLPIPTP

SEQ ID NO: 786878 - protein, 22 aa, Mycobacterium
AADPLFCDLLANLHLHLEHEVD

SEQ ID NO: 786879 - protein, 24 aa, Mycobacterium
AADPLLACVLTGFGVTSLSAAAAA

SEQ ID NO: 786880 - protein, 24 aa, Mycobacterium
AADPLPINPMPAVPVTVPGSAPNN

SEQ ID NO: 786881 - protein, 24 aa, Mycobacterium
AADPPPVPLDAAILFAPVGELVLP

SEQ ID NO: 786882 - protein, 25 aa, Mycobacterium
AADPPQPWNLFMTAQVRTDGAIQYA

SEQ ID NO: 786883 - protein, 25 aa, Mycobacterium
AADPRKWTPRDLLHVAAEQLADATD

SEQ ID NO: 786884 - protein, 28 aa, Mycobacterium
AADPRRVPVWLPYIRGERTPFHDPDRRA

SEQ ID NO: 786885 - protein, 26 aa, Mycobacterium
AADPSLKGPFAGVPFLLKDLGQEYRG

SEQ ID NO: 786886 - protein, 29 aa, Mycobacterium
AADPYGDVFLIIDGWPAFVSEFPDLELQV

SEQ ID NO: 786887 - protein, 30 aa, Mycobacterium
AADRGVVMIGLLADAFPLTDGPDLAARART

SEQ ID NO: 786888 - protein, 17 aa, Mycobacterium
AADRKILWCSPTRDQAE

SEQ ID NO: 786889 - protein, 18 aa, Mycobacterium
AADRLDAILARRPIRLHP

SEQ ID NO: 786890 - protein, 26 aa, Mycobacterium
AADRMRLGHLQAVTLHRLLGSRPDTS

SEQ ID NO: 786891 - protein, 23 aa, Mycobacterium
AADRPLIMAIVNRTPDSFYDKGA

SEQ ID NO: 786892 - protein, 19 aa, Mycobacterium
AADRPLNWNLLGVSAANPA

SEQ ID NO: 786893 - protein, 25 aa, Mycobacterium
AADRPVVLVPAFLAAGYHVRVDVPA

SEQ ID NO: 786894 - protein, 28 aa, Mycobacterium
AADSAELPLFRYIGGPNAHIMPVPMMNI

SEQ ID NO: 786895 - protein, 28 aa, Mycobacterium
AADSAELPLFRYLGGPNAHILPVPMMNI

SEQ ID NO: 786896 - protein, 27 aa, Mycobacterium
AADSAGLALFRYLGGPNAHILPVPMMN

SEQ ID NO: 786897 - protein, 22 aa, Mycobacterium
AADSIWRLVDPAPRQLPAAEAV

SEQ ID NO: 786898 - protein, 23 aa, Mycobacterium
AADTAPFLLVGGLLGDLANHVAR

SEQ ID NO: 786899 - protein, 17 aa, Mycobacterium
AADTIRTHLAPAATRTT

SEQ ID NO: 786900 - protein, 25 aa, Mycobacterium
AADTNFHVTFIRLAENRFLTSVFES

SEQ ID NO: 786901 - protein, 27 aa, Mycobacterium
AADVALWLELRVPRWVTADDRLLVTVL

SEQ ID NO: 786902 - protein, 18 aa, Mycobacterium
AADVATLATWFRTRSHSG

SEQ ID NO: 786903 - protein, 19 aa, Mycobacterium
AADVLGSWPWPALGSVTAH

SEQ ID NO: 786904 - protein, 18 aa, Mycobacterium
AADVRFLPAGAIPRTTSG

SEQ ID NO: 786905 - protein, 24 aa, Mycobacterium
AADWLAGRDIVYLVASPLERAQET

SEQ ID NO: 786906 - protein, 18 aa, Mycobacterium
AADWLFPQYRELGVYLVR

SEQ ID NO: 786907 - protein, 22 aa, Mycobacterium
AADYLIKPFEFSQLETKLTAYA

SEQ ID NO: 786908 - protein, 17 aa, Mycobacterium
AADYWSSTGNRWYDVFA

SEQ ID NO: 786909 - protein, 35 aa, Mycobacterium
AAEAAAVSPLLDAINAPVLAATGRPLIGNGANGAP

SEQ ID NO: 786910 - protein, 23 aa, Mycobacterium
AAEAAFIFAMIAVDLSRLAEDII

SEQ ID NO: 786911 - protein, 17 aa, Mycobacterium
AAEAAGLARWTLNTATE

SEQ ID NO: 786912 - protein, 26 aa, Mycobacterium
AAEAANASPLLGISQDMLNAVNGPTE

SEQ ID NO: 786913 - protein, 24 aa, Mycobacterium
AAEADMVLAIYNPASKTRTWQVGA

SEQ ID NO: 786914 - protein, 23 aa, Mycobacterium
AAEAFALPPGLHPLMVVAVGRLG

SEQ ID NO: 786915 - protein, 24 aa, Mycobacterium
AAEAHRHQYGYPHWVIYDEAHLLS

SEQ ID NO: 786916 - protein, 29 aa, Mycobacterium
AAEAIAALKPIFFGAVALGGSTGVRRTGS

SEQ ID NO: 786917 - protein, 24 aa, Mycobacterium
AAEALIAMDLLPTAILRKLTETDH

SEQ ID NO: 786918 - protein, 24 aa, Mycobacterium
AAEALRWAMLAGEPHVVLADALAE

SEQ ID NO: 786919 - protein, 17 aa, Mycobacterium
AAEAPPWIGALDVVVLA

SEQ ID NO: 786920 - protein, 17 aa, Mycobacterium
AAEAWLTGAGIMDEIAA

SEQ ID NO: 786921 - protein, 24 aa, Mycobacterium
AAEDALWRWMAAAALVRSRADGGV

SEQ ID NO: 786922 - protein, 23 aa, Mycobacterium
AAEDYLDYSGFSRSGLIDQLEYD

SEQ ID NO: 786923 - protein, 19 aa, Mycobacterium
AAEELGFSAFFRSDHYLAM

SEQ ID NO: 786924 - protein, 25 aa, Mycobacterium
AAEESAFAILALQAPVAGDLREVVS

SEQ ID NO: 786925 - protein, 21 aa, Mycobacterium
AAEFFAPISSIHRYLKTLVDV

SEQ ID NO: 786926 - protein, 24 aa, Mycobacterium
AAEFGLREPPPPWLPAETIGEADV

SEQ ID NO: 786927 - protein, 26 aa, Mycobacterium
AAEFMRALLARPADPLGLHAFVTDFD

SEQ ID NO: 786928 - protein, 25 aa, Mycobacterium
AAEFRGFERFSLTHGLLASLPSSEA

SEQ ID NO: 786929 - protein, 26 aa, Mycobacterium
AAEFSALPFDHLFFTGSPAIGAVVGR

SEQ ID NO: 786930 - protein, 19 aa, Mycobacterium
AAEGFTDSYLYSSGRRRGA

SEQ ID NO: 786931 - protein, 25 aa, Mycobacterium
AAEGHSRKFAYPPNLFVVDGGAPQV

SEQ ID NO: 786932 - protein, 27 aa, Mycobacterium
AAEGRRRWRDWEGAWYHAGLAAGGLDV

SEQ ID NO: 786933 - protein, 31 aa, Mycobacterium
AAEHLGVPVPVAGSWLLLIELAGDTDQTERL

SEQ ID NO: 786934 - protein, 17 aa, Mycobacterium
AAEHPYQEWLDAGLFQL

SEQ ID NO: 786935 - protein, 20 aa, Mycobacterium
AAEHVNPGGALLIVDHAAPP

SEQ ID NO: 786936 - protein, 18 aa, Mycobacterium
AAEIADITGLPLLASMKA

SEQ ID NO: 786937 - protein, 25 aa, Mycobacterium
AAEICDGWLPIFYSPRIAGMYNEWL

SEQ ID NO: 786938 - protein, 25 aa, Mycobacterium
AAEICDGWLPIFYTPRMADTYNEWL

SEQ ID NO: 786939 - protein, 25 aa, Mycobacterium
AAEIDGLLRLRPSRGTHLVFDAAAF

SEQ ID NO: 786940 - protein, 23 aa, Mycobacterium
AAEIEVLPITKYFPAIDVVTLSR

SEQ ID NO: 786941 - protein, 24 aa, Mycobacterium
AAEIGFGRRWVLSAWGRAGAAERW

SEQ ID NO: 786942 - protein, 38 aa, Mycobacterium
AAEISWPTAPPAAPPVLAAPAPPVLAAPAPPSAEVAPP

SEQ ID NO: 786943 - protein, 20 aa, Mycobacterium
AAEKVTGIFLVPAQWQAVCA

SEQ ID NO: 786944 - protein, 17 aa, Mycobacterium
AAELARRFAAGGRMFTF

SEQ ID NO: 786945 - protein, 17 aa, Mycobacterium
AAELARRRRGRGLRLNH

SEQ ID NO: 786946 - protein, 24 aa, Mycobacterium
AAELATMFHIYFLGSAEGLIFDVP

SEQ ID NO: 786947 - protein, 24 aa, Mycobacterium
AAELATMFHIYFLGSSEGLIFDVP

SEQ ID NO: 786948 - protein, 20 aa, Mycobacterium
AAELAWVEPILKVTTTLQVA

SEQ ID NO: 786949 - protein, 34 aa, Mycobacterium
AAELDRIGFDAIFITDFLGLNRTLIRHSGPRSFE

SEQ ID NO: 786950 - protein, 24 aa, Mycobacterium
AAELFGWLGAYPDAVVGAAGAITL

SEQ ID NO: 786951 - protein, 17 aa, Mycobacterium
AAELGALAFKTAYARWS

SEQ ID NO: 786952 - protein, 35 aa, Mycobacterium
AAELGLTRFQLLLAAFTWSLYGVTGRTRPIVATPV

SEQ ID NO: 786953 - protein, 24 aa, Mycobacterium
AAELGVIGVLAVELFETVDGRILV

SEQ ID NO: 786954 - protein, 20 aa, Mycobacterium
AAELGVVGVLAVELFETTDG

SEQ ID NO: 786955 - protein, 18 aa, Mycobacterium
AAELGWAGLLVPEDLGGG

SEQ ID NO: 786956 - protein, 20 aa, Mycobacterium
AAELIAALRKGNLSVSATAP

SEQ ID NO: 786957 - protein, 23 aa, Mycobacterium
AAELLGSLLRRLGQKTDLSAGTM

SEQ ID NO: 786958 - protein, 18 aa, Mycobacterium
AAELLLAVGYADLTVAAI

SEQ ID NO: 786959 - protein, 19 aa, Mycobacterium
AAELLLLNEIWQLQSKLTN

SEQ ID NO: 786960 - protein, 24 aa, Mycobacterium
AAELMGIQIPRFCDHPLLDPVGAC

SEQ ID NO: 786961 - protein, 29 aa, Mycobacterium
AAELRGMLGSRLPRYMIPQRIVAVDDIPL

SEQ ID NO: 786962 - protein, 18 aa, Mycobacterium
AAELRLWEALEQHLLCPF

SEQ ID NO: 786963 - protein, 32 aa, Mycobacterium
AAELSDGTLRFLLWAAALLSPDPPPLMVLNEP

SEQ ID NO: 786964 - protein, 30 aa, Mycobacterium
AAELSDGTLRFLLWAAALLSPQPPSLMVLN

SEQ ID NO: 786965 - protein, 23 aa, Mycobacterium
AAELSMVLLDSAAMADLHMRWMD

SEQ ID NO: 786966 - protein, 23 aa, Mycobacterium
AAELSSLGLPKRALVSSSAANVD

SEQ ID NO: 786967 - protein, 20 aa, Mycobacterium
AAELSYSLDEACLHAFPRRE

SEQ ID NO: 786968 - protein, 17 aa, Mycobacterium
AAELVGEIAAKVAAAAG

SEQ ID NO: 786969 - protein, 19 aa, Mycobacterium
AAELVRPISRKYDLAEHAY

SEQ ID NO: 786970 - protein, 28 aa, Mycobacterium
AAELVRRGSPFCGLLYAGLAITTKGPAV

SEQ ID NO: 786971 - protein, 25 aa, Mycobacterium
AAELVRRGSSFSGLLYAGLAITSNG

SEQ ID NO: 786972 - protein, 21 aa, Mycobacterium
AAELVVLGDLPLLDSARTDAL

SEQ ID NO: 786973 - protein, 19 aa, Mycobacterium
AAEMLRPISRKYDLAEHAY

SEQ ID NO: 786974 - protein, 18 aa, Mycobacterium
AAEMNRRCTPRDPIYPLV

SEQ ID NO: 786975 - protein, 23 aa, Mycobacterium
AAENLVMRYVSEAGLPAVALCVS

SEQ ID NO: 786976 - protein, 27 aa, Mycobacterium
AAENPPMIRYPIPPMIHGATQSSTWMS

SEQ ID NO: 786977 - protein, 22 aa, Mycobacterium
AAEPAAPPPPPGAAPVDVPPPP

SEQ ID NO: 786978 - protein, 25 aa, Mycobacterium
AAEPLGDPGLLWRAAARLEIGAQAA

SEQ ID NO: 786979 - protein, 22 aa, Mycobacterium
AAEPLLEGVRWAERSDIWVGPG

SEQ ID NO: 786980 - protein, 18 aa, Mycobacterium
AAEPPVLFWMHGGGMVIG

SEQ ID NO: 786981 - protein, 18 aa, Mycobacterium
AAEPSPLLRRRSLASRSE

SEQ ID NO: 786982 - protein, 17 aa, Mycobacterium
AAEPYEEWLHAGLLDLK

SEQ ID NO: 786983 - protein, 23 aa, Mycobacterium
AAEPYLVKNIDRTGFRMDTLVGI

SEQ ID NO: 786984 - protein, 32 aa, Mycobacterium
AAEQFCRRYPTTLIRWVIGTPTERVVPFGAFG

SEQ ID NO: 786985 - protein, 25 aa, Mycobacterium
AAEQLCMPALRRLGVKFAGLDQPVG

SEQ ID NO: 786986 - protein, 23 aa, Mycobacterium
AAEQLGYDSGWVIHRHFRQGNEH

SEQ ID NO: 786987 - protein, 28 aa, Mycobacterium
AAEQMLRGWEVLWLAQRAATRATLADMT

SEQ ID NO: 786988 - protein, 31 aa, Mycobacterium
AAERAAVCRLFTEPVFRAALISGLGGAEDGE

SEQ ID NO: 786989 - protein, 25 aa, Mycobacterium
AAERAFWQFHASLMEPWDGPACVTF

SEQ ID NO: 786990 - protein, 26 aa, Mycobacterium
AAERAMRILHTTYPPLRRPRHRRVLT

SEQ ID NO: 786991 - protein, 30 aa, Mycobacterium
AAERAMRVLHTTYPPLRRPARRRVFTVANQ

SEQ ID NO: 786992 - protein, 24 aa, Mycobacterium
AAERIAPVITPTPLQLCERLSDIT

SEQ ID NO: 786993 - protein, 19 aa, Mycobacterium
AAERIAWIDPAFAGGDIGQ

SEQ ID NO: 786994 - protein, 27 aa, Mycobacterium
AAERPAPALLIRPDGYLAWAATGSGAD

SEQ ID NO: 786995 - protein, 24 aa, Mycobacterium
AAERVGITALLDRKPRQLSGGQQQ

SEQ ID NO: 786996 - protein, 28 aa, Mycobacterium
AAESAELPLFRYIGGPNAHILPVPMMNI

SEQ ID NO: 786997 - protein, 27 aa, Mycobacterium
AAESMVAAVLPFASWLSATASVAEQAG

SEQ ID NO: 786998 - protein, 24 aa, Mycobacterium
AAESRAVRKYLRGLGYQNEQLDIT

SEQ ID NO: 786999 - protein, 29 aa, Mycobacterium
AAESTARPEWLWAAAHRLGIGPEAAAPAE

SEQ ID NO: 787000 - protein, 19 aa, Mycobacterium
AAESVLLALFPMTNPWLAW

SEQ ID NO: 787001 - protein, 33 aa, Mycobacterium
AAETPFLQSLTPPPPLRVLMSTGSPFPNDGVDP

SEQ ID NO: 787002 - protein, 27 aa, Mycobacterium
AAEVAVLKMLALQFIMSDPKHIAVQAR

SEQ ID NO: 787003 - protein, 32 aa, Mycobacterium
AAEVERPDLVIGWWAVPTILEHGSPEQIEQFV

SEQ ID NO: 787004 - protein, 30 aa, Mycobacterium
AAEVLRARNLLPVPWVEPVDVANAVVFLAS

SEQ ID NO: 787005 - protein, 19 aa, Mycobacterium
AAEVPDRFWLHSRGALPTA

SEQ ID NO: 787006 - protein, 27 aa, Mycobacterium
AAEVSDLLLDWLTAHYGRGYVAARSAL

SEQ ID NO: 787007 - protein, 19 aa, Mycobacterium
AAEWIMRTLMSIEVLPAIS

SEQ ID NO: 787008 - protein, 27 aa, Mycobacterium
AAEYKKLLLAMLQRREAWEIVDYVNRL

SEQ ID NO: 787009 - protein, 24 aa, Mycobacterium
AAFAADMVFLRNCGIHPVVVHGGG

SEQ ID NO: 787010 - protein, 25 aa, Mycobacterium
AAFAADMVFLRNCGIHPVVVHGGGP

SEQ ID NO: 787011 - protein, 25 aa, Mycobacterium
AAFAALPFDHLFFTGSPSVGALVQR

SEQ ID NO: 787012 - protein, 17 aa, Mycobacterium
AAFAIPILSKIDTDSRN

SEQ ID NO: 787013 - protein, 17 aa, Mycobacterium
AAFALSREPIDKAWYDE

SEQ ID NO: 787014 - protein, 17 aa, Mycobacterium
AAFAMTVPPPAIAVNRV

SEQ ID NO: 787015 - protein, 20 aa, Mycobacterium
AAFDRLIALIKRTAGDDRTK

SEQ ID NO: 787016 - protein, 28 aa, Mycobacterium
AAFDTELFGHWWYEGPTWLARVLRALPA

SEQ ID NO: 787017 - protein, 27 aa, Mycobacterium
AAFDTELFGHWWYEGPTWLQRVLRALP

SEQ ID NO: 787018 - protein, 26 aa, Mycobacterium
AAFDTELFGHWWYEGPTWLQRVLRAM

SEQ ID NO: 787019 - protein, 25 aa, Mycobacterium
AAFEAFGRWDILINTAGMIVRKPLA

SEQ ID NO: 787020 - protein, 26 aa, Mycobacterium
AAFETAFMMTVPPPVIAANRAQLAAL

SEQ ID NO: 787021 - protein, 30 aa, Mycobacterium
AAFFACADGFVYLYMTSRAHWLGLKALMGH

SEQ ID NO: 787022 - protein, 17 aa, Mycobacterium
AAFFDWMNSGKLAYAAD

SEQ ID NO: 787023 - protein, 18 aa, Mycobacterium
AAFFERAYNILPDDGRML

SEQ ID NO: 787024 - protein, 36 aa, Mycobacterium
AAFFHGEGAHWLGMGRQLYSIFPVYAKAIDETCEIL

SEQ ID NO: 787025 - protein, 19 aa, Mycobacterium
AAFGARVAIWERDPETCEA

SEQ ID NO: 787026 - protein, 28 aa, Mycobacterium
AAFGAVEIWPIVHFQAPTQPIGNDWLAL

SEQ ID NO: 787027 - protein, 25 aa, Mycobacterium
AAFGGGQYVHYAAKAFLCSEIARWV

SEQ ID NO: 787028 - protein, 27 aa, Mycobacterium
AAFGMALRAWNAGLSVAVFQFVKSAKW

SEQ ID NO: 787029 - protein, 17 aa, Mycobacterium
AAFGPVGAPFLASLTRA

SEQ ID NO: 787030 - protein, 25 aa, Mycobacterium
AAFGREDYWLARIAAGAADTTLDSL

SEQ ID NO: 787031 - protein, 19 aa, Mycobacterium
AAFHDQFVRALTASGGSYA

SEQ ID NO: 787032 - protein, 19 aa, Mycobacterium
AAFHRQLVAGLHSGAAAYT

SEQ ID NO: 787033 - protein, 27 aa, Mycobacterium
AAFIARLLEMAPFRKILYSSDGFGPAE

SEQ ID NO: 787034 - protein, 19 aa, Mycobacterium
AAFIMMLRHPDKVTGFFGV

SEQ ID NO: 787035 - protein, 21 aa, Mycobacterium
AAFLFAITIGNAMRIEPIEVM

SEQ ID NO: 787036 - protein, 20 aa, Mycobacterium
AAFLFAITVGGAMRIEPIEV

SEQ ID NO: 787037 - protein, 20 aa, Mycobacterium
AAFLLVNDLAVLTLRPRLTE

SEQ ID NO: 787038 - protein, 18 aa, Mycobacterium
AAFPAWRDTSLAKRTQVL

SEQ ID NO: 787039 - protein, 18 aa, Mycobacterium
AAFQASHARFVEAAAKVN

SEQ ID NO: 787040 - protein, 19 aa, Mycobacterium
AAFQGAHARFVEAAARVNA

SEQ ID NO: 787041 - protein, 20 aa, Mycobacterium
AAFQRWIARITARLCDDGVP

SEQ ID NO: 787042 - protein, 23 aa, Mycobacterium
AAFQYVRDFLSFLPSDCFGDPPV

SEQ ID NO: 787043 - protein, 27 aa, Mycobacterium
AAFQYVRDYLSFLPANTFDDAPIVNPG

SEQ ID NO: 787044 - protein, 22 aa, Mycobacterium
AAFRERLRTWLTLHVKEFCATG

SEQ ID NO: 787045 - protein, 18 aa, Mycobacterium
AAFSPRPVVYRATDFRSN

SEQ ID NO: 787046 - protein, 24 aa, Mycobacterium
AAFSYSHLFAAMAFAKGIGGDSHF

SEQ ID NO: 787047 - protein, 20 aa, Mycobacterium
AAFTALAHYLAELTALEQEL

SEQ ID NO: 787048 - protein, 19 aa, Mycobacterium
AAFTALSHYLAELTALEQD

SEQ ID NO: 787049 - protein, 18 aa, Mycobacterium
AAFTKTINLYLNGTYNLT

SEQ ID NO: 787050 - protein, 17 aa, Mycobacterium
AAFTMLLRQLRGTPTSE

SEQ ID NO: 787051 - protein, 18 aa, Mycobacterium
AAFWFAETHTCPMHIGGL

SEQ ID NO: 787052 - protein, 24 aa, Mycobacterium
AAFYDRLRELFAAKKSITTFGPYS

SEQ ID NO: 787053 - protein, 20 aa, Mycobacterium
AAFYERLRELFAANKSITTF

SEQ ID NO: 787054 - protein, 20 aa, Mycobacterium
AAFYERLRELFAQKKSITTF

SEQ ID NO: 787055 - protein, 32 aa, Mycobacterium
AAGAAFPDALLTRGLYQYRPEPPFVLGAEIAG

SEQ ID NO: 787056 - protein, 24 aa, Mycobacterium
AAGAAHPGSVWWLFTNVLPGLLSR

SEQ ID NO: 787057 - protein, 23 aa, Mycobacterium
AAGACAGFFRHPPRVPPSRAGAI

SEQ ID NO: 787058 - protein, 54 aa, Mycobacterium
AAGADEVSAVIAALFGTHALEYQAISTQLSVFHEQFVQTLTNGVGAYSAAELVN

SEQ ID NO: 787059 - protein, 25 aa, Mycobacterium
AAGAGLGVFGVVPAGAAISAGTAGP

SEQ ID NO: 787060 - protein, 27 aa, Mycobacterium
AAGAGRSPWSLLRRRRGVLPSIEEALE

SEQ ID NO: 787061 - protein, 20 aa, Mycobacterium
AAGAIAHLNADHADSLLAMA

SEQ ID NO: 787062 - protein, 18 aa, Mycobacterium
AAGALNLFGLRANAFDDE

SEQ ID NO: 787063 - protein, 24 aa, Mycobacterium
AAGALPPTAGTLIRLFHAETTELE

SEQ ID NO: 787064 - protein, 18 aa, Mycobacterium
AAGALTMLPVALVTFAGV

SEQ ID NO: 787065 - protein, 22 aa, Mycobacterium
AAGAMLSALWAGSTGQLVVIIH

SEQ ID NO: 787066 - protein, 20 aa, Mycobacterium
AAGAMPALAVGAACGTVGFA

SEQ ID NO: 787067 - protein, 26 aa, Mycobacterium
AAGAPTLDWLVTRFAREVPGVAHALL

SEQ ID NO: 787068 - protein, 17 aa, Mycobacterium
AAGAYVPGGRYPLVASA

SEQ ID NO: 787069 - protein, 18 aa, Mycobacterium
AAGCPLLMTVVSPTICGT

SEQ ID NO: 787070 - protein, 29 aa, Mycobacterium
AAGDEVMMGWRSFECYLPIVQVSGATAVK

SEQ ID NO: 787071 - protein, 24 aa, Mycobacterium
AAGDGWLAMEFIDGRPAISLAVRT

SEQ ID NO: 787072 - protein, 18 aa, Mycobacterium
AAGDIVVPGLRKPVTAVA

SEQ ID NO: 787073 - protein, 28 aa, Mycobacterium
AAGDLALAQLRRALPKALFVSAHTGEGI

SEQ ID NO: 787074 - protein, 22 aa, Mycobacterium
AAGDPVLILWAQANRDEHAFDE

SEQ ID NO: 787075 - protein, 24 aa, Mycobacterium
AAGDRAFFCDYVLEYLARAGISKE

SEQ ID NO: 787076 - protein, 20 aa, Mycobacterium
AAGDVGLAALWIAKATGARI

SEQ ID NO: 787077 - protein, 30 aa, Mycobacterium
AAGEAGETGTWGNAGLPGKAGDAGGAGAVG

SEQ ID NO: 787078 - protein, 25 aa, Mycobacterium
AAGEAGYPWWSLSPLGMDNDQAIGL

SEQ ID NO: 787079 - protein, 23 aa, Mycobacterium
AAGEEVPFRLVYGGRTRASMAFL

SEQ ID NO: 787080 - protein, 25 aa, Mycobacterium
AAGEKRRWLRDRGLKIFPLVGWAER

SEQ ID NO: 787081 - protein, 36 aa, Mycobacterium
AAGELRRMLAATLPRYLVPHHILLVDEIPLTTNGKV

SEQ ID NO: 787082 - protein, 18 aa, Mycobacterium
AAGERLLAFAHLEPGMRL

SEQ ID NO: 787083 - protein, 23 aa, Mycobacterium
AAGETLFTLYTDTPDRLPAALGE

SEQ ID NO: 787084 - protein, 25 aa, Mycobacterium
AAGFAYARSLRPDTVRTWYATSDAD

SEQ ID NO: 787085 - protein, 27 aa, Mycobacterium
AAGFDAVEFWWPFAEATPSDREVDEFV

SEQ ID NO: 787086 - protein, 22 aa, Mycobacterium
AAGFHWLGLETLHCSPVGLGSA

SEQ ID NO: 787087 - protein, 18 aa, Mycobacterium
AAGFLLADAFGKLSLLAA

SEQ ID NO: 787088 - protein, 23 aa, Mycobacterium
AAGFPAERIVFDSPAKTPTEIAR

SEQ ID NO: 787089 - protein, 19 aa, Mycobacterium
AAGFPRPILHGLCTYGMTC

SEQ ID NO: 787090 - protein, 19 aa, Mycobacterium
AAGFTYDVYRRGDGPGVVL

SEQ ID NO: 787091 - protein, 27 aa, Mycobacterium
AAGFVSLLHILAADAPVLIAIDDVQWL

SEQ ID NO: 787092 - protein, 24 aa, Mycobacterium
AAGGDWFDAVALGDRLVLIVGDVV

SEQ ID NO: 787093 - protein, 27 aa, Mycobacterium
AAGGLGGRGGLLLGNGGAGGVGGVGAT

SEQ ID NO: 787094 - protein, 30 aa, Mycobacterium
AAGGLGLLIAHPFYVNPFGDYPTELQDRHA

SEQ ID NO: 787095 - protein, 18 aa, Mycobacterium
AAGGLHLVFDFSVALWNT

SEQ ID NO: 787096 - protein, 29 aa, Mycobacterium
AAGGLMPPMTPLGPLLPAAADIGLHLVVT

SEQ ID NO: 787097 - protein, 29 aa, Mycobacterium
AAGGLNWDSLPLRLFAGGNAKFWDPADID

SEQ ID NO: 787098 - protein, 27 aa, Mycobacterium
AAGGLNWNSLPLKLFAGGNAKFWDPAD

SEQ ID NO: 787099 - protein, 35 aa, Mycobacterium
AAGGLPSGTLWALDLIEVPSRLRPAMTAMLSGVVV

SEQ ID NO: 787100 - protein, 26 aa, Mycobacterium
AAGGLYRQWALGRRAAGNPWAVPTGW

SEQ ID NO: 787101 - protein, 31 aa, Mycobacterium
AAGGNPCLLTPPPWYPILRGTTQQALFEVAR

SEQ ID NO: 787102 - protein, 27 aa, Mycobacterium
AAGGQKPWLPHFYLGHGIGTSAAEMPM

SEQ ID NO: 787103 - protein, 25 aa, Mycobacterium
AAGGRIALWDIAIGDGGTLGYPLPW

SEQ ID NO: 787104 - protein, 26 aa, Mycobacterium
AAGGVGQILCQWARYLGATVIGTVGS

SEQ ID NO: 787105 - protein, 21 aa, Mycobacterium
AAGGWLLGDGGAGGSAPLFTA

SEQ ID NO: 787106 - protein, 20 aa, Mycobacterium
AAGGWLLGNGGAGGSGAAGQ

SEQ ID NO: 787107 - protein, 20 aa, Mycobacterium
AAGHIYAVIGLKDTTTGDTL

SEQ ID NO: 787108 - protein, 38 aa, Mycobacterium
AAGIDVTLLRELNLMTTKPFLYVFNADESVLTDEARQA

SEQ ID NO: 787109 - protein, 35 aa, Mycobacterium
AAGIILTWNDIADLSAVVPLLARIYPNGKADVNHF

SEQ ID NO: 787110 - protein, 23 aa, Mycobacterium
AAGIPWAQGFYLSRPKSHTHGFA

SEQ ID NO: 787111 - protein, 23 aa, Mycobacterium
AAGISWLTGYPDRNPFEPYSVGD

SEQ ID NO: 787112 - protein, 31 aa, Mycobacterium
AAGKPASVATIAWMGYTPPPNPLDTGSAGDL

SEQ ID NO: 787113 - protein, 24 aa, Mycobacterium
AAGKRIVAVCPYVAKYVSRHHDFD

SEQ ID NO: 787114 - protein, 25 aa, Mycobacterium
AAGKSLLPGPLLPTVAAGAVALLAD

SEQ ID NO: 787115 - protein, 26 aa, Mycobacterium
AAGKTMGIPILYPWANRLGENTYHAE

SEQ ID NO: 787116 - protein, 22 aa, Mycobacterium
AAGKTVFVFPGQGSQLLGMGMG

SEQ ID NO: 787117 - protein, 24 aa, Mycobacterium
AAGLAVKLANMPFTWSTRGAERIA

SEQ ID NO: 787118 - protein, 21 aa, Mycobacterium
AAGLCGLRWVGAVGAVASGAA

SEQ ID NO: 787119 - protein, 25 aa, Mycobacterium
AAGLDARAYRLGWPPGSVVYEVDQP

SEQ ID NO: 787120 - protein, 26 aa, Mycobacterium
AAGLDARAYRLPWPSGSVVYEVDQPD

SEQ ID NO: 787121 - protein, 25 aa, Mycobacterium
AAGLDARCWRLPWPAGTTVYELDQP

SEQ ID NO: 787122 - protein, 26 aa, Mycobacterium
AAGLDARSWRLPWPDGTVVYELDQPK

SEQ ID NO: 787123 - protein, 27 aa, Mycobacterium
AAGLDARTWRLPWPDGTVVYELDQPKV

SEQ ID NO: 787124 - protein, 33 aa, Mycobacterium
AAGLDHLGGLLAGLLLDLGQLGVPGRLVLVGGL

SEQ ID NO: 787125 - protein, 25 aa, Mycobacterium
AAGLDNLIWQCPVVLLADVRSVGVQ

SEQ ID NO: 787126 - protein, 27 aa, Mycobacterium
AAGLDNRIWQCPVVLLADIRSVGVQGD

SEQ ID NO: 787127 - protein, 26 aa, Mycobacterium
AAGLDSRAWRLPWPAGTTVFELDQPR

SEQ ID NO: 787128 - protein, 26 aa, Mycobacterium
AAGLDSRAWRLPWPDGTTVYELDQPA

SEQ ID NO: 787129 - protein, 24 aa, Mycobacterium
AAGLDSRAYRLGWPAGTVVYEIDQ

SEQ ID NO: 787130 - protein, 25 aa, Mycobacterium
AAGLDSRAYRLPWADGTVVYELDVP

SEQ ID NO: 787131 - protein, 26 aa, Mycobacterium
AAGLDSRAYRLPWPDGTTVFELDRPP

SEQ ID NO: 787132 - protein, 26 aa, Mycobacterium
AAGLDSRVYRLPWPDGTVVYELDQPK

SEQ ID NO: 787133 - protein, 24 aa, Mycobacterium
AAGLDTLIWQCPVVLLGDVRSVGV

SEQ ID NO: 787134 - protein, 19 aa, Mycobacterium
AAGLECWTGAADGECCGSG

SEQ ID NO: 787135 - protein, 18 aa, Mycobacterium
AAGLFGNGGLGGGGGSGS

SEQ ID NO: 787136 - protein, 29 aa, Mycobacterium
AAGLGPLGLALAPIIKLFEAIDIKKFGNA

SEQ ID NO: 787137 - protein, 25 aa, Mycobacterium
AAGLGVAFNAKPALRKVADASVSQP

SEQ ID NO: 787138 - protein, 22 aa, Mycobacterium
AAGLIEKVSALLAPYDADEWSS

SEQ ID NO: 787139 - protein, 18 aa, Mycobacterium
AAGLLDWQAVRLGHPARD

SEQ ID NO: 787140 - protein, 18 aa, Mycobacterium
AAGLLFGVGGAGGVGGSA

SEQ ID NO: 787141 - protein, 24 aa, Mycobacterium
AAGLLRGRRRVLDSTPLFDAVATQ

SEQ ID NO: 787142 - protein, 17 aa, Mycobacterium
AAGLLVYALDHRGHGRS

SEQ ID NO: 787143 - protein, 17 aa, Mycobacterium
AAGLPDNKVGAPLLPPV

SEQ ID NO: 787144 - protein, 25 aa, Mycobacterium
AAGLQLPLVLVIDTAGPALSTEAEQ

SEQ ID NO: 787145 - protein, 21 aa, Mycobacterium
AAGLRAAWLTMIAVASTHQGL

SEQ ID NO: 787146 - protein, 19 aa, Mycobacterium
AAGLRRIQWWTDEAGDFGL

SEQ ID NO: 787147 - protein, 22 aa, Mycobacterium
AAGLRTIFRYHRIKSGVLAGHP

SEQ ID NO: 787148 - protein, 17 aa, Mycobacterium
AAGLTFQGWLRNSPYYP

SEQ ID NO: 787149 - protein, 26 aa, Mycobacterium
AAGLVPDLLLSTWDLRPFTDKSDFLV

SEQ ID NO: 787150 - protein, 24 aa, Mycobacterium
AAGMDARAFRLAWPAGTVVYELDQ

SEQ ID NO: 787151 - protein, 38 aa, Mycobacterium
AAGMDTTLLRELNLMTTKPFLYVFNADETVLTDEKRVA

SEQ ID NO: 787152 - protein, 26 aa, Mycobacterium
AAGMPRPDWLVAPAIAYGASGEHQSF

SEQ ID NO: 787153 - protein, 35 aa, Mycobacterium
AAGMRAGVPMLLLWLWLDQPIWASAVSRLEVGLAR

SEQ ID NO: 787154 - protein, 30 aa, Mycobacterium
AAGMSGHDVLLVPTLLTTTPPYALLNQPRG

SEQ ID NO: 787155 - protein, 23 aa, Mycobacterium
AAGNRLTALIDYLRDHILADPSA

SEQ ID NO: 787156 - protein, 20 aa, Mycobacterium
AAGNVAFATIPILEEAGWSD

SEQ ID NO: 787157 - protein, 24 aa, Mycobacterium
AAGPHPFPMMVRDFQRVIGMEARA

SEQ ID NO: 787158 - protein, 29 aa, Mycobacterium
AAGPPVLRKLVWRLPARLQPKPEAVAWAV

SEQ ID NO: 787159 - protein, 20 aa, Mycobacterium
AAGPSWAWNAGPDGRMLLDP

SEQ ID NO: 787160 - protein, 65 aa, Mycobacterium
AAGPTTAMLTAAADEVSTAIAAFFSAHAADYQRLAGQAAALHTQLERVLSAGAVAYAAAETTGTS

SEQ ID NO: 787161 - protein, 19 aa, Mycobacterium
AAGPVRFYFRVQIAGPGDS

SEQ ID NO: 787162 - protein, 22 aa, Mycobacterium
AAGQWFRAYGNENWEFDPDGLM

SEQ ID NO: 787163 - protein, 18 aa, Mycobacterium
AAGRLSDPRPLSCAIAAV

SEQ ID NO: 787164 - protein, 17 aa, Mycobacterium
AAGRPRTYVYRRAGDPC

SEQ ID NO: 787165 - protein, 25 aa, Mycobacterium
AAGRSAVGWWLAGASRAMLELARRH

SEQ ID NO: 787166 - protein, 27 aa, Mycobacterium
AAGRTRRLASLGPLLKGIQARVVDEDG

SEQ ID NO: 787167 - protein, 25 aa, Mycobacterium
AAGRYARVFVGLSRGWLAAADSQPT

SEQ ID NO: 787168 - protein, 25 aa, Mycobacterium
AAGRYILDRAIFDALKRIPRGAGGE

SEQ ID NO: 787169 - protein, 25 aa, Mycobacterium
AAGRYLLDRAIFDALKRIPRGAGGE

SEQ ID NO: 787170 - protein, 25 aa, Mycobacterium
AAGRYVLDRAIFDALRRIERGAGGE

SEQ ID NO: 787171 - protein, 26 aa, Mycobacterium
AAGRYVLDRAIFDALRRINRGTGGEV

SEQ ID NO: 787172 - protein, 24 aa, Mycobacterium
AAGRYVLDRAIFDALRRTERGAGG

SEQ ID NO: 787173 - protein, 24 aa, Mycobacterium
AAGRYVLDRAIFDALRRVDRGVGG

SEQ ID NO: 787174 - protein, 27 aa, Mycobacterium
AAGRYVLDRAIFDALRRVPRGTGGEIQ

SEQ ID NO: 787175 - protein, 32 aa, Mycobacterium
AAGSDRIRFTPYQKLIILDVPDDKIDELRAGL

SEQ ID NO: 787176 - protein, 25 aa, Mycobacterium
AAGSGVLSWWVQFRGKQDGDPCKDA

SEQ ID NO: 787177 - protein, 24 aa, Mycobacterium
AAGSLGMLAIGVGGLEVALAIAGE

SEQ ID NO: 787178 - protein, 22 aa, Mycobacterium
AAGSRLIVPDLLPGDGREALEH

SEQ ID NO: 787179 - protein, 18 aa, Mycobacterium
AAGSYGRAESAGAAVLQT

SEQ ID NO: 787180 - protein, 21 aa, Mycobacterium
AAGTATQRALSASTAGAAAAV

SEQ ID NO: 787181 - protein, 25 aa, Mycobacterium
AAGTFVCNHLMYGVLHHIATQNLPI

SEQ ID NO: 787182 - protein, 26 aa, Mycobacterium
AAGTGQLVLIIHHLAVDGVSWRILLE

SEQ ID NO: 787183 - protein, 24 aa, Mycobacterium
AAGTPLRPAILWMDARGAAESEQT

SEQ ID NO: 787184 - protein, 17 aa, Mycobacterium
AAGTPPIYFGFGSRPIK

SEQ ID NO: 787185 - protein, 24 aa, Mycobacterium
AAGTPWLSFFAPEEMLSLARECGF

SEQ ID NO: 787186 - protein, 17 aa, Mycobacterium
AAGTSGGLSKYLDFRHT

SEQ ID NO: 787187 - protein, 33 aa, Mycobacterium
AAGTTFVVATGRPPRWIRPVVDALGFAPTAVCA

SEQ ID NO: 787188 - protein, 18 aa, Mycobacterium
AAGTTLLRYEPLGVVAAM

SEQ ID NO: 787189 - protein, 26 aa, Mycobacterium
AAGTTVVVPPYLLHRHPQFWPNPEGF

SEQ ID NO: 787190 - protein, 18 aa, Mycobacterium
AAGTWLREYLRGLIARRR

SEQ ID NO: 787191 - protein, 31 aa, Mycobacterium
AAGVAFPDALLTRGLYQYKPDLPFSPGAEVA

SEQ ID NO: 787192 - protein, 32 aa, Mycobacterium
AAGVAFPDALLTRGLYQYRPQLPFVLGAEIAG

SEQ ID NO: 787193 - protein, 33 aa, Mycobacterium
AAGVAFPDALLTRGLYQYRPQLPFVLGAEIAGV

SEQ ID NO: 787194 - protein, 25 aa, Mycobacterium
AAGVAFPDALQSRGLYQYKPEMPYT

SEQ ID NO: 787195 - protein, 34 aa, Mycobacterium
AAGVALEWLRYRAGLASTPLIPVIGPRTTTQLGG

SEQ ID NO: 787196 - protein, 31 aa, Mycobacterium
AAGVARPDLVIGWWAAPTILEHGTPEQIERF

SEQ ID NO: 787197 - protein, 34 aa, Mycobacterium
AAGVDSFWVPDHLNSLFPRTLWNPKNSGAAKLAP

SEQ ID NO: 787198 - protein, 34 aa, Mycobacterium
AAGVEFTFRAAQELPWHPGRCAAILIGDTVVGHA

SEQ ID NO: 787199 - protein, 40 aa, Mycobacterium
AAGVHLGYKCSIRKPWWSTPSLWVPDLFMLRQIHRTPRLS

SEQ ID NO: 787200 - protein, 23 aa, Mycobacterium
AAGVNPIDWKLYSGAFGTDPDKL

SEQ ID NO: 787201 - protein, 31 aa, Mycobacterium
AAGVNRPDLVIGWWAAPTILEHGTPEQIAQF

SEQ ID NO: 787202 - protein, 17 aa, Mycobacterium
AAGVPCIGLLSGGISRA

SEQ ID NO: 787203 - protein, 28 aa, Mycobacterium
AAGVPLKRLYREFPSKAHLVRAVLQRRD

SEQ ID NO: 787204 - protein, 29 aa, Mycobacterium
AAGVPVVFLTALYGLSVLAGLRAGERVLV

SEQ ID NO: 787205 - protein, 22 aa, Mycobacterium
AAGVPWDIRDAQPRIKELAAYG

SEQ ID NO: 787206 - protein, 30 aa, Mycobacterium
AAGVSKALFYFYFPRKEDVLFEVGVLSTKA

SEQ ID NO: 787207 - protein, 26 aa, Mycobacterium
AAGVTMFVPAFLRYDLRKASDEWKIA

SEQ ID NO: 787208 - protein, 32 aa, Mycobacterium
AAGVVRPDLVIGWWAAPTILEHGTPEQIARFV

SEQ ID NO: 787209 - protein, 31 aa, Mycobacterium
AAGVVRPDLVIGWWAAPTILEHGTPEQIERF

SEQ ID NO: 787210 - protein, 19 aa, Mycobacterium
AAGWGLKRLLEATQNRDIT

SEQ ID NO: 787211 - protein, 21 aa, Mycobacterium
AAGWTVLRFWAHEPPAEVAEA

SEQ ID NO: 787212 - protein, 25 aa, Mycobacterium
AAGYDQWIELFRTGLQAMCDRGDLR

SEQ ID NO: 787213 - protein, 25 aa, Mycobacterium
AAGYGLVSFWTAYLKANYPAEYMAG

SEQ ID NO: 787214 - protein, 25 aa, Mycobacterium
AAGYRLPDLAWFQALACFKSAATWS

SEQ ID NO: 787215 - protein, 30 aa, Mycobacterium
AAGYTDVVILAYAAKFASAFYGPFREAVSC

SEQ ID NO: 787216 - protein, 30 aa, Mycobacterium
AAHADRIELVAHPILMPVLKVSGLTELTAI

SEQ ID NO: 787217 - protein, 24 aa, Mycobacterium
AAHAFRPLHYPMTSAIGLGIITAG

SEQ ID NO: 787218 - protein, 23 aa, Mycobacterium
AAHAGYPLLVKPVVKAAGRERSV

SEQ ID NO: 787219 - protein, 19 aa, Mycobacterium
AAHDAFIGMRTRLAESFRD

SEQ ID NO: 787220 - protein, 17 aa, Mycobacterium
AAHDILDRLLASLSGIW

SEQ ID NO: 787221 - protein, 23 aa, Mycobacterium
AAHDLLLLMISQVVQGFTYAYVG

SEQ ID NO: 787222 - protein, 36 aa, Mycobacterium
AAHEHSVVIPFLLPDTPVVAWWPNQAPPIPAQHPLG

SEQ ID NO: 787223 - protein, 23 aa, Mycobacterium
AAHGAALLLNSARPPERVWDSLP

SEQ ID NO: 787224 - protein, 23 aa, Mycobacterium
AAHGAALLLNSSRKPERVWDSLP

SEQ ID NO: 787225 - protein, 19 aa, Mycobacterium
AAHGIPVLKPPRPNSEEFV

SEQ ID NO: 787226 - protein, 25 aa, Mycobacterium
AAHHDLHLWLPHPSDHLWRALGGDR

SEQ ID NO: 787227 - protein, 20 aa, Mycobacterium
AAHHFDPGIQLVLCAGAPDT

SEQ ID NO: 787228 - protein, 18 aa, Mycobacterium
AAHHFGCGFAPSGWDSLT

SEQ ID NO: 787229 - protein, 27 aa, Mycobacterium
AAHHRLFSGVGWLTIRLMDTVEQYAKG

SEQ ID NO: 787230 - protein, 19 aa, Mycobacterium
AAHLLLDILEKRIDAALVI

SEQ ID NO: 787231 - protein, 17 aa, Mycobacterium
AAHLQWHLERQLKTLPL

SEQ ID NO: 787232 - protein, 23 aa, Mycobacterium
AAHLQWHLERQLKTLPLVERTYH

SEQ ID NO: 787233 - protein, 29 aa, Mycobacterium
AAHLRAPLDVFLVRKLGVPQWQELAMGAV

SEQ ID NO: 787234 - protein, 33 aa, Mycobacterium
AAHLTVFQRSPAYTLPWTVRPFAPGELDELKAQ

SEQ ID NO: 787235 - protein, 17 aa, Mycobacterium
AAHLWTRTSLRPADVDV

SEQ ID NO: 787236 - protein, 24 aa, Mycobacterium
AAHPDLVAALILLDPAIGLNGSRV

SEQ ID NO: 787237 - protein, 18 aa, Mycobacterium
AAHPPVTHPVVCTHPITG

SEQ ID NO: 787238 - protein, 26 aa, Mycobacterium
AAHQDWTLPFVTWGYHPLWHGKLTKS

SEQ ID NO: 787239 - protein, 27 aa, Mycobacterium
AAHQELFWAMTRLPFPTVAAVNGAAVG

SEQ ID NO: 787240 - protein, 20 aa, Mycobacterium
AAHQFFEGLIATRAELQQAA

SEQ ID NO: 787241 - protein, 17 aa, Mycobacterium
AAHRGMTVLPLAKSASG

SEQ ID NO: 787242 - protein, 26 aa, Mycobacterium
AAHRRAHGLPAISLGWGLWDQASDMT

SEQ ID NO: 787243 - protein, 28 aa, Mycobacterium
AAHRVDLPTYAFARRRFWLLSESVGGRD

SEQ ID NO: 787244 - protein, 26 aa, Mycobacterium
AAHSVLYTYLLGSVSLQETRPAHRGK

SEQ ID NO: 787245 - protein, 25 aa, Mycobacterium
AAHTVPLGMPTLAATPPAPATPASE

SEQ ID NO: 787246 - protein, 18 aa, Mycobacterium
AAHWAKRLFCSADPGRPT

SEQ ID NO: 787247 - protein, 22 aa, Mycobacterium
AAHWIADRQIAPSLLKYGTESQ

SEQ ID NO: 787248 - protein, 17 aa, Mycobacterium
AAHWIADRQIVPSLLKY

SEQ ID NO: 787249 - protein, 27 aa, Mycobacterium
AAHWIADRQIVPSLLKYGTEHQQSEYL

SEQ ID NO: 787250 - protein, 23 aa, Mycobacterium
AAHYPKIVLVTGACRFLGGYLTA

SEQ ID NO: 787251 - protein, 30 aa, Mycobacterium
AAIAALERQLQLLDKLIGAAMKDLEDPNLD

SEQ ID NO: 787252 - protein, 33 aa, Mycobacterium
AAIADAPLRERRWGQLMLALYRAGRQGEALGAY

SEQ ID NO: 787253 - protein, 25 aa, Mycobacterium
AAIADLRFVNRGIAPILLPRIVASV

SEQ ID NO: 787254 - protein, 38 aa, Mycobacterium
AAIAGLRYIVYGAAPMPLPLLHRALATWPDTKFVQVYG

SEQ ID NO: 787255 - protein, 23 aa, Mycobacterium
AAIAHAWREIILGDADIAICGGV

SEQ ID NO: 787256 - protein, 24 aa, Mycobacterium
AAIALAQTLITAGARPALVLGHSL

SEQ ID NO: 787257 - protein, 19 aa, Mycobacterium
AAIALEWLRHNGYQDLLNR

SEQ ID NO: 787258 - protein, 17 aa, Mycobacterium
AAIALLFENFTTVFVGA

SEQ ID NO: 787259 - protein, 24 aa, Mycobacterium
AAIALYEKLGFARVPVMAVKRKNA

SEQ ID NO: 787260 - protein, 21 aa, Mycobacterium
AAIALYEKLGFRRVPVMAIKR

SEQ ID NO: 787261 - protein, 26 aa, Mycobacterium
AAIANSILVVLSLACAKCLACLGCIA

SEQ ID NO: 787262 - protein, 19 aa, Mycobacterium
AAIARFEALQPQTPRLTNT

SEQ ID NO: 787263 - protein, 19 aa, Mycobacterium
AAIAVMDAVTAYPEPFDAV

SEQ ID NO: 787264 - protein, 25 aa, Mycobacterium
AAIDELIDAVKFTPALTGPQAQLGG

SEQ ID NO: 787265 - protein, 19 aa, Mycobacterium
AAIDLLFANMARPLDQYRI

SEQ ID NO: 787266 - protein, 28 aa, Mycobacterium
AAIDSMNQAWWFPAVAPLPGGAPKVMLA

SEQ ID NO: 787267 - protein, 24 aa, Mycobacterium
AAIEEALRWEPPITTVVRVAVRDC

SEQ ID NO: 787268 - protein, 25 aa, Mycobacterium
AAIEELIDAVKFTPALTGPHAQLTG

SEQ ID NO: 787269 - protein, 37 aa, Mycobacterium
AAIEGRWTTTMRFYAGPTLLVIDELGYLPLPAEAASA

SEQ ID NO: 787270 - protein, 22 aa, Mycobacterium
AAIELCAGAFRVRPVVGVVTFI

SEQ ID NO: 787271 - protein, 24 aa, Mycobacterium
AAIFDPDPCLFVETIRLQSKKGPV

SEQ ID NO: 787272 - protein, 25 aa, Mycobacterium
AAIGDLPLIYPFLVNDPGEGTQAKR

SEQ ID NO: 787273 - protein, 28 aa, Mycobacterium
AAIGLVKFDLLGLGMLSALHYAIDLVAE

SEQ ID NO: 787274 - protein, 25 aa, Mycobacterium
AAIGNWRLFSALLRSLDVPLEDGVD

SEQ ID NO: 787275 - protein, 25 aa, Mycobacterium
AAIGNWRLFSALLRSLHVPLEDGLE

SEQ ID NO: 787276 - protein, 22 aa, Mycobacterium
AAIGRFYDTFIAPRTITAHVQG

SEQ ID NO: 787277 - protein, 23 aa, Mycobacterium
AAIGRIRAMRLALLADRLTATDA

SEQ ID NO: 787278 - protein, 31 aa, Mycobacterium
AAIGRIRAMRMALLPERLPATEALSYGLVSA

SEQ ID NO: 787279 - protein, 26 aa, Mycobacterium
AAIGSEPIIMLTAPGPAAQLCLERAG

SEQ ID NO: 787280 - protein, 29 aa, Mycobacterium
AAIGVSNWLRPWLPSLLALSANSAVYRGA

SEQ ID NO: 787281 - protein, 25 aa, Mycobacterium
AAIHDQFVQALNAGANWYAGVESAN

SEQ ID NO: 787282 - protein, 20 aa, Mycobacterium
AAIHQAFVAALTASANSYEA

SEQ ID NO: 787283 - protein, 18 aa, Mycobacterium
AAIIAYSAALLAPAGSQI

SEQ ID NO: 787284 - protein, 17 aa, Mycobacterium
AAIILESVPGTAGIMVP

SEQ ID NO: 787285 - protein, 21 aa, Mycobacterium
AAIITAMHRLLAATPSRLKLI

SEQ ID NO: 787286 - protein, 32 aa, Mycobacterium
AAIITRGLAEIMRLGIALGAKGATLAGLAGVG

SEQ ID NO: 787287 - protein, 25 aa, Mycobacterium
AAIKDWIDMFTLWPEPASGGIDHQR

SEQ ID NO: 787288 - protein, 23 aa, Mycobacterium
AAIKGMWTVPVFGNPTGVTYSWE

SEQ ID NO: 787289 - protein, 25 aa, Mycobacterium
AAILEAMLALPLYRAVVDAQGGRQE

SEQ ID NO: 787290 - protein, 20 aa, Mycobacterium
AAILKVFRRVSSGINPDIEL

SEQ ID NO: 787291 - protein, 20 aa, Mycobacterium
AAILLAFYVAAAERKGVPRA

SEQ ID NO: 787292 - protein, 20 aa, Mycobacterium
AAILLAFYVAAAERQGVPRA

SEQ ID NO: 787293 - protein, 24 aa, Mycobacterium
AAILNASRRLFLERGYAGTPINAI

SEQ ID NO: 787294 - protein, 24 aa, Mycobacterium
AAILSMIDAFRQVHRVAIAVFADG

SEQ ID NO: 787295 - protein, 20 aa, Mycobacterium
AAIMSVSLLLAHLGLDDAAS

SEQ ID NO: 787296 - protein, 33 aa, Mycobacterium
AAINAPVQELTGRPLIGNGLPGSAGSGVAGAPG

SEQ ID NO: 787297 - protein, 28 aa, Mycobacterium
AAIPDMTEWWAYLDSVQATYPLSYGPQS

SEQ ID NO: 787298 - protein, 24 aa, Mycobacterium
AAIPNAQFRLLPPGPHTPFDIIDD

SEQ ID NO: 787299 - protein, 27 aa, Mycobacterium
AAIPRGVGTKGVWRLPDRRALEQVLTG

SEQ ID NO: 787300 - protein, 17 aa, Mycobacterium
AAIPRRRTDRRAYSSWP

SEQ ID NO: 787301 - protein, 18 aa, Mycobacterium
AAIPRRRTDRRHYSFWPV

SEQ ID NO: 787302 - protein, 29 aa, Mycobacterium
AAIPVPPLPPLPPIINELINWAFDVVNWA

SEQ ID NO: 787303 - protein, 20 aa, Mycobacterium
AAIRDGLPAVLLIPKDVQQA

SEQ ID NO: 787304 - protein, 28 aa, Mycobacterium
AAIRPTTRLIWVETPTNPLLSIADIAGI

SEQ ID NO: 787305 - protein, 20 aa, Mycobacterium
AAIRRRIGYVFPGQGGQRPG

SEQ ID NO: 787306 - protein, 24 aa, Mycobacterium
AAIRSIHTLPAELSLHAAAAKYWV

SEQ ID NO: 787307 - protein, 25 aa, Mycobacterium
AAISRLPVVPSMLEWLHVARTSVVM

SEQ ID NO: 787308 - protein, 30 aa, Mycobacterium
AAISYARARGLPVLGLCLGLQCIVIEAARS

SEQ ID NO: 787309 - protein, 27 aa, Mycobacterium
AAITRKYGVLGWLLVKASILRRGRSGT

SEQ ID NO: 787310 - protein, 20 aa, Mycobacterium
AAIVGVYNTRQGRRLDGETS

SEQ ID NO: 787311 - protein, 37 aa, Mycobacterium
AAIVHPAMVAANRNELVALVISNLFGQNAPAIAATEA

SEQ ID NO: 787312 - protein, 21 aa, Mycobacterium
AAIVRPTRVAPLGAAPPESIA

SEQ ID NO: 787313 - protein, 20 aa, Mycobacterium
AAIVTRLLQDGFRVAACDLL

SEQ ID NO: 787314 - protein, 18 aa, Mycobacterium
AAIWGPLTAVLGRDDVVL

SEQ ID NO: 787315 - protein, 18 aa, Mycobacterium
AAIWRRRNPGWQLSPGEV

SEQ ID NO: 787316 - protein, 24 aa, Mycobacterium
AAKADLVLAIYNPASKTRTWQVGA

SEQ ID NO: 787317 - protein, 20 aa, Mycobacterium
AAKAFLCSEIARWIDEEGLS

SEQ ID NO: 787318 - protein, 23 aa, Mycobacterium
AAKAGITALTLSAARALGRYGVR

SEQ ID NO: 787319 - protein, 17 aa, Mycobacterium
AAKAGVIGLTIAAARDL

SEQ ID NO: 787320 - protein, 24 aa, Mycobacterium
AAKALHALGPRWALVKGGHLRSSE

SEQ ID NO: 787321 - protein, 28 aa, Mycobacterium
AAKALHALGPRWVLVKGGHLRSSDRSCD

SEQ ID NO: 787322 - protein, 18 aa, Mycobacterium
AAKALWRDAGITSPIDEI

SEQ ID NO: 787323 - protein, 23 aa, Mycobacterium
AAKAPRVIRALKLTLNNTAGRDL

SEQ ID NO: 787324 - protein, 21 aa, Mycobacterium
AAKAYVRFALDHPGHYAVMFD

SEQ ID NO: 787325 - protein, 25 aa, Mycobacterium
AAKELAYLGVRVNAIAPGLIRSAMT

SEQ ID NO: 787326 - protein, 24 aa, Mycobacterium
AAKELPAVLPSLPGVGLGGITGAV

SEQ ID NO: 787327 - protein, 22 aa, Mycobacterium
AAKFDAVFFADGLNFGPKATWA

SEQ ID NO: 787328 - protein, 18 aa, Mycobacterium
AAKFLKKALTGEGLPLMR

SEQ ID NO: 787329 - protein, 23 aa, Mycobacterium
AAKGKELVWAPGAFRYVMMVLRH

SEQ ID NO: 787330 - protein, 23 aa, Mycobacterium
AAKGLEWDAVFLVGLADGTLPIS

SEQ ID NO: 787331 - protein, 28 aa, Mycobacterium
AAKHGLVGLMRSYANMLAPHNIRVNTIH

SEQ ID NO: 787332 - protein, 19 aa, Mycobacterium
AAKHLEIVEAFLAASRGGD

SEQ ID NO: 787333 - protein, 27 aa, Mycobacterium
AAKISKPMLYLYYGSKEDLFVACLRRE

SEQ ID NO: 787334 - protein, 26 aa, Mycobacterium
AAKKLRCPLLVQIADFDQYVPADAVA

SEQ ID NO: 787335 - protein, 23 aa, Mycobacterium
AAKLEALLARNATALTAGCHDDV

SEQ ID NO: 787336 - protein, 19 aa, Mycobacterium
AAKLFGFPTVIAHGMFSAA

SEQ ID NO: 787337 - protein, 24 aa, Mycobacterium
AAKLIGAARKPVLYVGGGVIRGEA

SEQ ID NO: 787338 - protein, 17 aa, Mycobacterium
AAKLLRATVRELASARL

SEQ ID NO: 787339 - protein, 18 aa, Mycobacterium
AAKLPGVRVLIAGGPSGS

SEQ ID NO: 787340 - protein, 30 aa, Mycobacterium
AAKLQLPEGAPILFIERLRSVGGVPLSLDT

SEQ ID NO: 787341 - protein, 24 aa, Mycobacterium
AAKLRLPVQWVSRPTAEQRRRYTG

SEQ ID NO: 787342 - protein, 21 aa, Mycobacterium
AAKLRPLPFRIELDDQVIDTD

SEQ ID NO: 787343 - protein, 17 aa, Mycobacterium
AAKLSGELYLRAYTEMY

SEQ ID NO: 787344 - protein, 25 aa, Mycobacterium
AAKLWRTPVVAEALWRITPQALMRQ

SEQ ID NO: 787345 - protein, 30 aa, Mycobacterium
AAKNIPFVFSAWTIRLLSHLPQRAVVGLAT

SEQ ID NO: 787346 - protein, 23 aa, Mycobacterium
AAKNQCRWQWGVLGPEGAESAGI

SEQ ID NO: 787347 - protein, 24 aa, Mycobacterium
AAKNWNHARLNPYAQRRADHEVTV

SEQ ID NO: 787348 - protein, 24 aa, Mycobacterium
AAKPDLLQIITIGSGPIITRCSER

SEQ ID NO: 787349 - protein, 25 aa, Mycobacterium
AAKQVTILAHDKLGPLAGGMGGLGL

SEQ ID NO: 787350 - protein, 26 aa, Mycobacterium
AAKRALPVTYAGQTWWAAVEDIGLLR

SEQ ID NO: 787351 - protein, 19 aa, Mycobacterium
AAKRIAWTKLINSGQICIA

SEQ ID NO: 787352 - protein, 24 aa, Mycobacterium
AAKRPLFTDFAPRLLVSHPSEVKV

SEQ ID NO: 787353 - protein, 22 aa, Mycobacterium
AAKSGIPWTVVRATQFHELAEP

SEQ ID NO: 787354 - protein, 29 aa, Mycobacterium
AAKSLARYKLPKAIVFRAGIQRSPSGKAD

SEQ ID NO: 787355 - protein, 18 aa, Mycobacterium
AAKWLTNRDIAAARLSWD

SEQ ID NO: 787356 - protein, 27 aa, Mycobacterium
AAKWPNRPDPLLAARYPAIAGQNLRGL

SEQ ID NO: 787357 - protein, 22 aa, Mycobacterium
AAKWSKFLDVWPVTVPFPGGAE

SEQ ID NO: 787358 - protein, 30 aa, Mycobacterium
AAKYGAVEVWPMAGPGLPTQPLQGSNWIAL

SEQ ID NO: 787359 - protein, 35 aa, Mycobacterium
AAKYVPKLMELHDGPFILAGWSLGAVLAYACAVGL

SEQ ID NO: 787360 - protein, 21 aa, Mycobacterium
AALAAGARRIVVGLGGSACTD

SEQ ID NO: 787361 - protein, 27 aa, Mycobacterium
AALAARVSRYFPWQFGVDYDAIGHGSP

SEQ ID NO: 787362 - protein, 18 aa, Mycobacterium
AALAARYGATLRITRLRP

SEQ ID NO: 787363 - protein, 27 aa, Mycobacterium
AALADAADWVVWAGSLPAGFAPARLAA

SEQ ID NO: 787364 - protein, 28 aa, Mycobacterium
AALADGQLPVWWPDLVENGFHVVHVPER

SEQ ID NO: 787365 - protein, 17 aa, Mycobacterium
AALAELALVAGGHIGLD

SEQ ID NO: 787366 - protein, 18 aa, Mycobacterium
AALAERLRITKTEAHRWI

SEQ ID NO: 787367 - protein, 17 aa, Mycobacterium
AALAFDVLGTRGAGAPW

SEQ ID NO: 787368 - protein, 17 aa, Mycobacterium
AALAGKFLDRFGVSTEC

SEQ ID NO: 787369 - protein, 25 aa, Mycobacterium
AALAGWPDALVLRVDRRNQVLIANG

SEQ ID NO: 787370 - protein, 19 aa, Mycobacterium
AALAHRLDVYDPAAIHLSR

SEQ ID NO: 787371 - protein, 20 aa, Mycobacterium
AALAIRFRDQGVVGFDIAGA

SEQ ID NO: 787372 - protein, 17 aa, Mycobacterium
AALALISPLIELDPAAK

SEQ ID NO: 787373 - protein, 20 aa, Mycobacterium
AALALLPGPVLQTVTAGAVA

SEQ ID NO: 787374 - protein, 18 aa, Mycobacterium
AALAMLVLTSFEGAIVVA

SEQ ID NO: 787375 - protein, 18 aa, Mycobacterium
AALAMNRRHRRMRFMIKA

SEQ ID NO: 787376 - protein, 26 aa, Mycobacterium
AALAPKRVLPVFGLRSAMPAEREAFV

SEQ ID NO: 787377 - protein, 19 aa, Mycobacterium
AALARELRYLDVSALYTAV

SEQ ID NO: 787378 - protein, 17 aa, Mycobacterium
AALARFDELHRQAPRLH

SEQ ID NO: 787379 - protein, 27 aa, Mycobacterium
AALASQLVPWQSILKGLPGMGSAGAAG

SEQ ID NO: 787380 - protein, 17 aa, Mycobacterium
AALASRMQTLPQVLINV

SEQ ID NO: 787381 - protein, 18 aa, Mycobacterium
AALATALLTLYQQTGQWL

SEQ ID NO: 787382 - protein, 27 aa, Mycobacterium
AALATINRLPVLLLPSDTFATRVSSPV

SEQ ID NO: 787383 - protein, 21 aa, Mycobacterium
AALAWIRSLIFEDSRVLPMYV

SEQ ID NO: 787384 - protein, 17 aa, Mycobacterium
AALAWSVETAQLAREHN

SEQ ID NO: 787385 - protein, 19 aa, Mycobacterium
AALAWVRALGKADVVARDS

SEQ ID NO: 787386 - protein, 29 aa, Mycobacterium
AALAYAAAGWYVLPVRRVAGKAGKHPGGI

SEQ ID NO: 787387 - protein, 20 aa, Mycobacterium
AALAYRPFALALAEAGSDAY

SEQ ID NO: 787388 - protein, 17 aa, Mycobacterium
AALDAPVLLHPGDEMLW

SEQ ID NO: 787389 - protein, 27 aa, Mycobacterium
AALDEALRLWPTAPAYLRAARTDTVLG

SEQ ID NO: 787390 - protein, 22 aa, Mycobacterium
AALDEILRSWRAEHPEIAVIRV

SEQ ID NO: 787391 - protein, 22 aa, Mycobacterium
AALDILGRVGLLPHVVRRMMPR

SEQ ID NO: 787392 - protein, 18 aa, Mycobacterium
AALDKLASLLGSAAAVAV

SEQ ID NO: 787393 - protein, 39 aa, Mycobacterium
AALDLMEDAWWGPTVPLVGRPWFALSERNSPGSIIVNMS

SEQ ID NO: 787394 - protein, 29 aa, Mycobacterium
AALDQQTRLFLGAEIRQIWARTHQTIVFV

SEQ ID NO: 787395 - protein, 45 aa, Mycobacterium
AALDRFAKAGPALERYCKLRDAWLSARRDLLDRRNRMRELALEAD

SEQ ID NO: 787396 - protein, 22 aa, Mycobacterium
AALDTALRRAAAKTFDRLDIDG

SEQ ID NO: 787397 - protein, 22 aa, Mycobacterium
AALDTGPWRRWISGRAAQLGTT

SEQ ID NO: 787398 - protein, 33 aa, Mycobacterium
AALDTIRRYLSYFPPSAWSYPPPLPASEATPGQ

SEQ ID NO: 787399 - protein, 33 aa, Mycobacterium
AALDTIRRYLSYFPPSAWSYPPSLPASGTTARR

SEQ ID NO: 787400 - protein, 17 aa, Mycobacterium
AALEAAALSPDFAARHP

SEQ ID NO: 787401 - protein, 25 aa, Mycobacterium
AALECGLLSEWRATLIVRESACLDI

SEQ ID NO: 787402 - protein, 20 aa, Mycobacterium
AALEDVSIPTLLLSLVHITG

SEQ ID NO: 787403 - protein, 19 aa, Mycobacterium
AALELPGVRAVFTAADLNP

SEQ ID NO: 787404 - protein, 23 aa, Mycobacterium
AALENPQWCARAIAEHGDRVAVG

SEQ ID NO: 787405 - protein, 21 aa, Mycobacterium
AALEQALRRATARTFDRLDID

SEQ ID NO: 787406 - protein, 21 aa, Mycobacterium
AALFDFGERYLLLQAEPLDSD

SEQ ID NO: 787407 - protein, 19 aa, Mycobacterium
AALFPVEIISSMLGVPPGE

SEQ ID NO: 787408 - protein, 17 aa, Mycobacterium
AALGAAFLARMAAGLES

SEQ ID NO: 787409 - protein, 17 aa, Mycobacterium
AALGAAFLARMAAGLET

SEQ ID NO: 787410 - protein, 17 aa, Mycobacterium
AALGADFFVFSGHKIYG

SEQ ID NO: 787411 - protein, 26 aa, Mycobacterium
AALGCAPILVYPASKKPADVRTPQKR

SEQ ID NO: 787412 - protein, 17 aa, Mycobacterium
AALGELLPRSPYATLTS

SEQ ID NO: 787413 - protein, 20 aa, Mycobacterium
AALGFRPFNHHLLHGEIDAI

SEQ ID NO: 787414 - protein, 21 aa, Mycobacterium
AALGIDPRRLLAESPRAIVVT

SEQ ID NO: 787415 - protein, 25 aa, Mycobacterium
AALGKTLPAVLRLSPLLGPVRPPKW

SEQ ID NO: 787416 - protein, 24 aa, Mycobacterium
AALGLEFTLYLLRNPEARERVEAK

SEQ ID NO: 787417 - protein, 21 aa, Mycobacterium
AALGLVPDILINNAGLSTLGP

SEQ ID NO: 787418 - protein, 20 aa, Mycobacterium
AALGNPTWYARFAAQVMTDP

SEQ ID NO: 787419 - protein, 19 aa, Mycobacterium
AALGPHFRLRPDPTPRGSA

SEQ ID NO: 787420 - protein, 17 aa, Mycobacterium
AALGPRVLRLAARRSAG

SEQ ID NO: 787421 - protein, 21 aa, Mycobacterium
AALGPYLRGACRVAFDAPLVV

SEQ ID NO: 787422 - protein, 25 aa, Mycobacterium
AALGRDFLTIWFAQLHHQVADIKRR

SEQ ID NO: 787423 - protein, 22 aa, Mycobacterium
AALGTFLAQLPEPMLLGKVECD

SEQ ID NO: 787424 - protein, 27 aa, Mycobacterium
AALHAGWRALGWWLVGTSRAMLSLARQ

SEQ ID NO: 787425 - protein, 22 aa, Mycobacterium
AALHALVGRLNRAAPPLALRAV

SEQ ID NO: 787426 - protein, 24 aa, Mycobacterium
AALHERRPWRRWIGGRAAQLGTSG

SEQ ID NO: 787427 - protein, 29 aa, Mycobacterium
AALHLWDDAHWDRLSQRYLTLARKTGAMN

SEQ ID NO: 787428 - protein, 21 aa, Mycobacterium
AALHPGPWLSTAVAAARALTR

SEQ ID NO: 787429 - protein, 18 aa, Mycobacterium
AALHRRGPHRVLRGDLAF

SEQ ID NO: 787430 - protein, 27 aa, Mycobacterium
AALHTTVMPFILRGIALLGMDSVLMPI

SEQ ID NO: 787431 - protein, 28 aa, Mycobacterium
AALHTTVMPFILRGVALLGMESVLMAIG

SEQ ID NO: 787432 - protein, 19 aa, Mycobacterium
AALIDELGLKPRKAFGPIR

SEQ ID NO: 787433 - protein, 23 aa, Mycobacterium
AALIEPAALTRDPVHRTGLGGAL

SEQ ID NO: 787434 - protein, 17 aa, Mycobacterium
AALIIERNVLEWRCDPT

SEQ ID NO: 787435 - protein, 22 aa, Mycobacterium
AALISPLRLRGMSAMLTRIKRR

SEQ ID NO: 787436 - protein, 23 aa, Mycobacterium
AALISPLRLRGMSAMLTRIKRRL

SEQ ID NO: 787437 - protein, 28 aa, Mycobacterium
AALITPAHHFPHGLPLHPARRTAVVDWA

SEQ ID NO: 787438 - protein, 18 aa, Mycobacterium
AALKRWTVDYWDATHPYS

SEQ ID NO: 787439 - protein, 27 aa, Mycobacterium
AALLAEKDIWWCLQPFLDDEDAVAVPP

SEQ ID NO: 787440 - protein, 17 aa, Mycobacterium
AALLAFAAGAGLTVVAV

SEQ ID NO: 787441 - protein, 17 aa, Mycobacterium
AALLALGGRREPGAAVI

SEQ ID NO: 787442 - protein, 29 aa, Mycobacterium
AALLAVVDKLPWLSMLPAYFVGVGVRPEH

SEQ ID NO: 787443 - protein, 18 aa, Mycobacterium
AALLDTTEFAQPALFAVE

SEQ ID NO: 787444 - protein, 20 aa, Mycobacterium
AALLELHLRDGRLRRASLGG

SEQ ID NO: 787445 - protein, 17 aa, Mycobacterium
AALLFNPQTAGSVTNRI

SEQ ID NO: 787446 - protein, 22 aa, Mycobacterium
AALLGGTPWRSLVLAGSVHADS

SEQ ID NO: 787447 - protein, 17 aa, Mycobacterium
AALLHYAREGDTVVVTA

SEQ ID NO: 787448 - protein, 20 aa, Mycobacterium
AALLKLPVGNWPVLGGMGNA

SEQ ID NO: 787449 - protein, 19 aa, Mycobacterium
AALLLAAMTLAPGKEMIVS

SEQ ID NO: 787450 - protein, 18 aa, Mycobacterium
AALLLAFERATTGFGWSR

SEQ ID NO: 787451 - protein, 22 aa, Mycobacterium
AALLNCAVAPWRRPRTVECHAG

SEQ ID NO: 787452 - protein, 18 aa, Mycobacterium
AALLSWLAEDFRRVLGFS

SEQ ID NO: 787453 - protein, 24 aa, Mycobacterium
AALLTNLPMVLADVAFHAAQLAST

SEQ ID NO: 787454 - protein, 19 aa, Mycobacterium
AALLWSRIGDQLSGQPRIE

SEQ ID NO: 787455 - protein, 23 aa, Mycobacterium
AALMDPQQRLLLETSWAALEHAG

SEQ ID NO: 787456 - protein, 32 aa, Mycobacterium
AALNAEISLPWQLPGRLLLARAYAAVGEVIEA

SEQ ID NO: 787457 - protein, 29 aa, Mycobacterium
AALNAGTVWVNCFFIRDLRAPFGGVGDSG

SEQ ID NO: 787458 - protein, 24 aa, Mycobacterium
AALNFNPRFLTHLLDRIEAGFRPD

SEQ ID NO: 787459 - protein, 19 aa, Mycobacterium
AALNLFTKALDHADPATQA

SEQ ID NO: 787460 - protein, 22 aa, Mycobacterium
AALPAVKRLLDLVPRRVNPTPT

SEQ ID NO: 787461 - protein, 21 aa, Mycobacterium
AALPAVLQRFPEVQLLIVGRG

SEQ ID NO: 787462 - protein, 27 aa, Mycobacterium
AALPDGALMRRAAYGLATVILRELSAR

SEQ ID NO: 787463 - protein, 26 aa, Mycobacterium
AALPEKAGVAAIPLSPFCDPAAEHAS

SEQ ID NO: 787464 - protein, 18 aa, Mycobacterium
AALPELPSFSLTSDSVTN

SEQ ID NO: 787465 - protein, 17 aa, Mycobacterium
AALPFRALSDAAPVADA

SEQ ID NO: 787466 - protein, 21 aa, Mycobacterium
AALPGYDLLVQAVGGLMSVTG

SEQ ID NO: 787467 - protein, 18 aa, Mycobacterium
AALPKLPTFTLTSESVTD

SEQ ID NO: 787468 - protein, 26 aa, Mycobacterium
AALPQALAVFLAPPSWEALVDRLTGR

SEQ ID NO: 787469 - protein, 29 aa, Mycobacterium
AALPRLHALAPLRYQLVDIPWKLHHPMWI

SEQ ID NO: 787470 - protein, 24 aa, Mycobacterium
AALPYMELVFVPPEIRAFYDYIKN

SEQ ID NO: 787471 - protein, 17 aa, Mycobacterium
AALQALRPHGRLAVMAY

SEQ ID NO: 787472 - protein, 20 aa, Mycobacterium
AALQILPTALVSRAGALVMA

SEQ ID NO: 787473 - protein, 27 aa, Mycobacterium
AALQLRSLPFRPIGIGPLVAARMWQVS

SEQ ID NO: 787474 - protein, 17 aa, Mycobacterium
AALQSLATAAPAAASDP

SEQ ID NO: 787475 - protein, 23 aa, Mycobacterium
AALQYLPPRQRAVLLLRDVLQWR

SEQ ID NO: 787476 - protein, 22 aa, Mycobacterium
AALRAELIGTGLGWRQLDVVEQ

SEQ ID NO: 787477 - protein, 18 aa, Mycobacterium
AALRAVPAQRLWVNPDCG

SEQ ID NO: 787478 - protein, 25 aa, Mycobacterium
AALRCSVVGPRAWLSKLPDQIRKRE

SEQ ID NO: 787479 - protein, 25 aa, Mycobacterium
AALRDLVARRTPLFEFAIRSALAET

SEQ ID NO: 787480 - protein, 23 aa, Mycobacterium
AALRDWLVLGQWENIPVPRQLDR

SEQ ID NO: 787481 - protein, 21 aa, Mycobacterium
AALREAGLEWRQIQLVAGADT

SEQ ID NO: 787482 - protein, 17 aa, Mycobacterium
AALRERLDPTRPPHVGV

SEQ ID NO: 787483 - protein, 19 aa, Mycobacterium
AALRFGELCLEAGLPPGLV

SEQ ID NO: 787484 - protein, 20 aa, Mycobacterium
AALRLEDHGLRWSHAPAVVG

SEQ ID NO: 787485 - protein, 28 aa, Mycobacterium
AALRPYTAGPCRVAFDAPLVVTNPSGQR

SEQ ID NO: 787486 - protein, 18 aa, Mycobacterium
AALRRLYRHPRSGQLVAM

SEQ ID NO: 787487 - protein, 24 aa, Mycobacterium
AALRRMEIRRIGRDGSPWPNTQPT

SEQ ID NO: 787488 - protein, 18 aa, Mycobacterium
AALRRWTEPLTHGGVPSS

SEQ ID NO: 787489 - protein, 17 aa, Mycobacterium
AALRTFLDRHGHRGYRE

SEQ ID NO: 787490 - protein, 19 aa, Mycobacterium
AALRTYSKGLANELAPKGI

SEQ ID NO: 787491 - protein, 27 aa, Mycobacterium
AALRVPLVSVILRRGYGLGAQAMTGGS

SEQ ID NO: 787492 - protein, 17 aa, Mycobacterium
AALSFASEGIQTLGINA

SEQ ID NO: 787493 - protein, 20 aa, Mycobacterium
AALSLLRQVARAVEPPLLDA

SEQ ID NO: 787494 - protein, 18 aa, Mycobacterium
AALSRRGPHRVLRGDLAF

SEQ ID NO: 787495 - protein, 17 aa, Mycobacterium
AALTAAVSARLHRQHKY

SEQ ID NO: 787496 - protein, 25 aa, Mycobacterium
AALTAHPMKFLGALQAIRDVLADNP

SEQ ID NO: 787497 - protein, 25 aa, Mycobacterium
AALTFVHVPYPPLCDWTRRALTCGV

SEQ ID NO: 787498 - protein, 22 aa, Mycobacterium
AALTLRRYHFPSGTAKIIALDT

SEQ ID NO: 787499 - protein, 23 aa, Mycobacterium
AALTPFTQVLQSPAAAAAAVQTA

SEQ ID NO: 787500 - protein, 22 aa, Mycobacterium
AALTQRLPQLSSLTVADMGPLL

SEQ ID NO: 787501 - protein, 20 aa, Mycobacterium
AALTRAIHKLPIKARIVTRE

SEQ ID NO: 787502 - protein, 21 aa, Mycobacterium
AALTRAIHKLPIKARIVTRED

SEQ ID NO: 787503 - protein, 19 aa, Mycobacterium
AALTVLRAEPWRPEAVLRH

SEQ ID NO: 787504 - protein, 26 aa, Mycobacterium
AALTVPLIAVILRRGYGLGAQAMCGG

SEQ ID NO: 787505 - protein, 29 aa, Mycobacterium
AALVAGLRLRLPIIGTTLGTYDAASAAAA

SEQ ID NO: 787506 - protein, 20 aa, Mycobacterium
AALVEFAEALGAPVVSTVGG

SEQ ID NO: 787507 - protein, 17 aa, Mycobacterium
AALVFYLTKADPLLVLR

SEQ ID NO: 787508 - protein, 21 aa, Mycobacterium
AALVHHYFGTKQQLFAAAIHL

SEQ ID NO: 787509 - protein, 25 aa, Mycobacterium
AALVLGCQGAWTGSQWLMVEEASNT

SEQ ID NO: 787510 - protein, 24 aa, Mycobacterium
AALVLSDWPAPDNPAPELPGGARW

SEQ ID NO: 787511 - protein, 23 aa, Mycobacterium
AALVRQIFVYGNSERPYLLAVIV

SEQ ID NO: 787512 - protein, 31 aa, Mycobacterium
AALVRSHFGARRKAFNWGLGRVKADLDAKSA

SEQ ID NO: 787513 - protein, 17 aa, Mycobacterium
AALWAVDEAVSRGVPLR

SEQ ID NO: 787514 - protein, 17 aa, Mycobacterium
AALWESLGVTPDVVIGH

SEQ ID NO: 787515 - protein, 17 aa, Mycobacterium
AALWPQRCSGLVAVSGY

SEQ ID NO: 787516 - protein, 23 aa, Mycobacterium
AALYDGHPFIRIPEVISGASGNR

SEQ ID NO: 787517 - protein, 18 aa, Mycobacterium
AALYRRWASKHDLVQAAL

SEQ ID NO: 787518 - protein, 18 aa, Mycobacterium
AALYRRWDTKCELVHAAL

SEQ ID NO: 787519 - protein, 28 aa, Mycobacterium
AAMAAAAAPYMGWLTAAAVQAGGAAGQA

SEQ ID NO: 787520 - protein, 18 aa, Mycobacterium
AAMAAWENFHAKAGPAIK

SEQ ID NO: 787521 - protein, 20 aa, Mycobacterium
AAMAIELAAVAATVPFAMQR

SEQ ID NO: 787522 - protein, 18 aa, Mycobacterium
AAMAPYCPLTAEALHEQA

SEQ ID NO: 787523 - protein, 26 aa, Mycobacterium
AAMATAAAPYVAWLATAGAQAEQAAS

SEQ ID NO: 787524 - protein, 25 aa, Mycobacterium
AAMEALVAQLTRPVRWDLCTATLRE

SEQ ID NO: 787525 - protein, 20 aa, Mycobacterium
AAMESFWARLQVELLNTRKW

SEQ ID NO: 787526 - protein, 17 aa, Mycobacterium
AAMFAYDVPPSRRAPAE

SEQ ID NO: 787527 - protein, 24 aa, Mycobacterium
AAMGLVAPMLAYKTTRHGSTLIVA

SEQ ID NO: 787528 - protein, 19 aa, Mycobacterium
AAMGSSLMRPLAPRESDTG

SEQ ID NO: 787529 - protein, 25 aa, Mycobacterium
AAMGVITPWLLSEYDRFALLHGDYR

SEQ ID NO: 787530 - protein, 22 aa, Mycobacterium
AAMHDMFVNTLGFSAGTYGATE

SEQ ID NO: 787531 - protein, 30 aa, Mycobacterium
AAMIDDIGRRFGRLDALVLTALGGPRVGLD

SEQ ID NO: 787532 - protein, 17 aa, Mycobacterium
AAMKMAFRISWSRVTER

SEQ ID NO: 787533 - protein, 17 aa, Mycobacterium
AAMLGMTPGVLPGLNEI

SEQ ID NO: 787534 - protein, 21 aa, Mycobacterium
AAMLGPLAVPASWTSVIPAAH

SEQ ID NO: 787535 - protein, 22 aa, Mycobacterium
AAMLGSRWLPDDAPAELARVRH

SEQ ID NO: 787536 - protein, 19 aa, Mycobacterium
AAMLPLLIGLMKAKEYVLL

SEQ ID NO: 787537 - protein, 20 aa, Mycobacterium
AAMMLPPPGMGAPAAPVAGG

SEQ ID NO: 787538 - protein, 20 aa, Mycobacterium
AAMPLNQLMMIKLACNSVLI

SEQ ID NO: 787539 - protein, 37 aa, Mycobacterium
AAMQVLTGPRWRLGGRDLAALWRRALGLAGGPNESSP

SEQ ID NO: 787540 - protein, 21 aa, Mycobacterium
AAMRAGIYWIHETVGFAMTKQ

SEQ ID NO: 787541 - protein, 18 aa, Mycobacterium
AAMRNRFPHQLSGGQRQR

SEQ ID NO: 787542 - protein, 20 aa, Mycobacterium
AAMRRVAAWADGWYGFNLDG

SEQ ID NO: 787543 - protein, 25 aa, Mycobacterium
AAMRVLTGPRWRLGGRDIAALWRRA

SEQ ID NO: 787544 - protein, 22 aa, Mycobacterium
AAMSVQALIDWGIAPDAGDIVV

SEQ ID NO: 787545 - protein, 22 aa, Mycobacterium
AAMSVQALIDWGIAPEAGAVVV

SEQ ID NO: 787546 - protein, 25 aa, Mycobacterium
AAMTAAAAPYAGFLSAASAQAAAAA

SEQ ID NO: 787547 - protein, 25 aa, Mycobacterium
AAMTAAAAPYAGWLSAASAQAAGAA

SEQ ID NO: 787548 - protein, 26 aa, Mycobacterium
AAMTAAASPYAGWLSAAAARAAGAAG

SEQ ID NO: 787549 - protein, 24 aa, Mycobacterium
AAMTAAATPYVGWLAATAAQVKET

SEQ ID NO: 787550 - protein, 23 aa, Mycobacterium
AAMTFCLSIFRRLDVDWALHGFD

SEQ ID NO: 787551 - protein, 30 aa, Mycobacterium
AAMTGWQRLHFRFGIPAPLLEPLAVERLYL

SEQ ID NO: 787552 - protein, 27 aa, Mycobacterium
AAMTTADLFIRYLRPIRQGAARAVPRM

SEQ ID NO: 787553 - protein, 22 aa, Mycobacterium
AAMVAAATPYVAWMSTTATQAE

SEQ ID NO: 787554 - protein, 19 aa, Mycobacterium
AAMVLLIGQSVLQSARIVA

SEQ ID NO: 787555 - protein, 20 aa, Mycobacterium
AANALIRWLAELGVSIAGTH

SEQ ID NO: 787556 - protein, 29 aa, Mycobacterium
AANAVRHALTQLGVPYQWGGTTPGVGLDC

SEQ ID NO: 787557 - protein, 25 aa, Mycobacterium
AANDRFYFRQLLSGRDFAGADPIAQ

SEQ ID NO: 787558 - protein, 26 aa, Mycobacterium
AANFRDVMIALGLYPDPDAAMGVEGA

SEQ ID NO: 787559 - protein, 25 aa, Mycobacterium
AANFRDVMIALGLYPDPDAVMGIEA

SEQ ID NO: 787560 - protein, 22 aa, Mycobacterium
AANFWVGLAILHSLFMREHNTI

SEQ ID NO: 787561 - protein, 23 aa, Mycobacterium
AANGLGSLLPISAAIAVLRNRTR

SEQ ID NO: 787562 - protein, 17 aa, Mycobacterium
AANILCAPLRDGRLRDA

SEQ ID NO: 787563 - protein, 24 aa, Mycobacterium
AANKGLALFPRRINGRYAAMSRSD

SEQ ID NO: 787564 - protein, 29 aa, Mycobacterium
AANLAYLYQTFMTNLFNTVPGGASFYTAM

SEQ ID NO: 787565 - protein, 30 aa, Mycobacterium
AANMAALWDLPMVFLCQNNLYAEMTPTSDT

SEQ ID NO: 787566 - protein, 25 aa, Mycobacterium
AANMAVLWHLPVVIVVESVPGVGVA

SEQ ID NO: 787567 - protein, 22 aa, Mycobacterium
AANMPVLVQVPRRGYVPALSCA

SEQ ID NO: 787568 - protein, 26 aa, Mycobacterium
AANPACTLSFRLPGVDLVLDGVTHRT

SEQ ID NO: 787569 - protein, 17 aa, Mycobacterium
AANPDGDVLWRPGGNRP

SEQ ID NO: 787570 - protein, 23 aa, Mycobacterium
AANPPAILGIRIKGLTSLHLRRS

SEQ ID NO: 787571 - protein, 28 aa, Mycobacterium
AANPPASLVLFSPLIDLTFTLSAARERL

SEQ ID NO: 787572 - protein, 23 aa, Mycobacterium
AANPRYRLWDSHANRFGWAAYLG

SEQ ID NO: 787573 - protein, 20 aa, Mycobacterium
AANPSWVMLYQYGNPANTDA

SEQ ID NO: 787574 - protein, 21 aa, Mycobacterium
AANPVPFYDELRRHGRLVRTR

SEQ ID NO: 787575 - protein, 26 aa, Mycobacterium
AANPYRNLLPLRRLRDRFTANDSPST

SEQ ID NO: 787576 - protein, 17 aa, Mycobacterium
AANRAMLATLVATNLFG

SEQ ID NO: 787577 - protein, 24 aa, Mycobacterium
AANRARLLALVATNFFGQNTPAIM

SEQ ID NO: 787578 - protein, 23 aa, Mycobacterium
AANRFAHALLARGIGPGSRVALM

SEQ ID NO: 787579 - protein, 22 aa, Mycobacterium
AANRLAHLLAGRGVAPGQCVAL

SEQ ID NO: 787580 - protein, 19 aa, Mycobacterium
AANRLSYAFDFRGPSMAID

SEQ ID NO: 787581 - protein, 33 aa, Mycobacterium
AANRNAFVQLVRSNFLGLFGPAIAAAEAQYEAM

SEQ ID NO: 787582 - protein, 35 aa, Mycobacterium
AANRNALVQMVLSNWFGLNAPAIAHIEGLYEQMWA

SEQ ID NO: 787583 - protein, 18 aa, Mycobacterium
AANRNQLVSLVLSNLFGQ

SEQ ID NO: 787584 - protein, 25 aa, Mycobacterium
AANRNVFVQLVMSNLLGQNAPAIAA

SEQ ID NO: 787585 - protein, 32 aa, Mycobacterium
AANRNVFVQLVRSNFFGFNAPAIMAAESQYEE

SEQ ID NO: 787586 - protein, 24 aa, Mycobacterium
AANRTLLIDGLAAMGITKIAPPDG

SEQ ID NO: 787587 - protein, 18 aa, Mycobacterium
AANRVMGHLGWRVPSSLS

SEQ ID NO: 787588 - protein, 26 aa, Mycobacterium
AANRWLTHYQNLLYGLQITTVADPKA

SEQ ID NO: 787589 - protein, 26 aa, Mycobacterium
AANSWLDGFTHWRRAQGLPATVIAWG

SEQ ID NO: 787590 - protein, 36 aa, Mycobacterium
AANTGPLQQLLTLINAPLLAATGRPLIGNGANGAPG

SEQ ID NO: 787591 - protein, 19 aa, Mycobacterium
AANTPMLLKAGLVDGNPEA

SEQ ID NO: 787592 - protein, 18 aa, Mycobacterium
AANVLLTTAAMRAVMGLP

SEQ ID NO: 787593 - protein, 20 aa, Mycobacterium
AANVSPLQQALDAVNAPVQQ

SEQ ID NO: 787594 - protein, 44 aa, Mycobacterium
AANVSPLQVLERDVLGLVNAPTQALLGRPIIGNGADGAPGSGAN

SEQ ID NO: 787595 - protein, 17 aa, Mycobacterium
AANWYARNLRFRGNMRG

SEQ ID NO: 787596 - protein, 17 aa, Mycobacterium
AANYLSVGQIYLLDNPL

SEQ ID NO: 787597 - protein, 18 aa, Mycobacterium
AANYLSVGQIYLLDNPLL

SEQ ID NO: 787598 - protein, 39 aa, Mycobacterium
AAPAETSILPLLQSFLPAPFNAIPNPFEDLDLLVLAAVV

SEQ ID NO: 787599 - protein, 18 aa, Mycobacterium
AAPAGVLLGGGNPVVGLQ

SEQ ID NO: 787600 - protein, 25 aa, Mycobacterium
AAPAGWSHFDADRWELFHIAQDRSQ

SEQ ID NO: 787601 - protein, 17 aa, Mycobacterium
AAPAITAVVPPAVDPVS

SEQ ID NO: 787602 - protein, 20 aa, Mycobacterium
AAPAPLFRTNVEGLRNVLEV

SEQ ID NO: 787603 - protein, 18 aa, Mycobacterium
AAPARRLAAASPDDVAAV

SEQ ID NO: 787604 - protein, 26 aa, Mycobacterium
AAPASAWIFPGQLWVAWQAKSAAEPD

SEQ ID NO: 787605 - protein, 27 aa, Mycobacterium
AAPAVIDAMLLVRLPYHLSSVTQAAAR

SEQ ID NO: 787606 - protein, 25 aa, Mycobacterium
AAPAVKALPGLGGLGGLLGGGATAA

SEQ ID NO: 787607 - protein, 26 aa, Mycobacterium
AAPDARLFIAAFPPGGRFGVPGIDHP

SEQ ID NO: 787608 - protein, 25 aa, Mycobacterium
AAPDDVLDALSLWAPTHSVTAYDSA

SEQ ID NO: 787609 - protein, 24 aa, Mycobacterium
AAPDSVFYSGYYSEAAPFVQQLKD

SEQ ID NO: 787610 - protein, 32 aa, Mycobacterium
AAPEAVGWTVPKFYWTVTAISAMTAGLQALGD

SEQ ID NO: 787611 - protein, 26 aa, Mycobacterium
AAPERLRSGWLNGIKHWQVDYTGKCP

SEQ ID NO: 787612 - protein, 17 aa, Mycobacterium
AAPERPTWRAKVRNLPS

SEQ ID NO: 787613 - protein, 21 aa, Mycobacterium
AAPEVGGTWYFNRYPGARCDV

SEQ ID NO: 787614 - protein, 23 aa, Mycobacterium
AAPFLSYGPFTGNAPRDLCALWP

SEQ ID NO: 787615 - protein, 23 aa, Mycobacterium
AAPGAALYILAFAAGALDQAHPD

SEQ ID NO: 787616 - protein, 25 aa, Mycobacterium
AAPGARFRGYNRLGLMRWERTAVVG

SEQ ID NO: 787617 - protein, 26 aa, Mycobacterium
AAPGASYFVLVFAKGAFPAALETKPN

SEQ ID NO: 787618 - protein, 26 aa, Mycobacterium
AAPGASYFVLVFAKGAFPAEMEPKPN

SEQ ID NO: 787619 - protein, 26 aa, Mycobacterium
AAPGASYFVLVFDKAALSGDGPINGV

SEQ ID NO: 787620 - protein, 22 aa, Mycobacterium
AAPGMLYPGVPGLASAARNSAG

SEQ ID NO: 787621 - protein, 22 aa, Mycobacterium
AAPGNLLGGMPLAGAGAGGHAG

SEQ ID NO: 787622 - protein, 31 aa, Mycobacterium
AAPGPKRQATLNRLLFPAPTKEFEEHREAYG

SEQ ID NO: 787623 - protein, 22 aa, Mycobacterium
AAPGTRFRIGTPAGIRVTVADL

SEQ ID NO: 787624 - protein, 20 aa, Mycobacterium
AAPHHLIADGPLLQHRRTPA

SEQ ID NO: 787625 - protein, 20 aa, Mycobacterium
AAPIILQFDASIDDQYRATV

SEQ ID NO: 787626 - protein, 17 aa, Mycobacterium
AAPIRDGLQSLQKAFRE

SEQ ID NO: 787627 - protein, 23 aa, Mycobacterium
AAPLAALGFTQPLPAEAADHVAA

SEQ ID NO: 787628 - protein, 17 aa, Mycobacterium
AAPLKPGRALDLGCGEG

SEQ ID NO: 787629 - protein, 20 aa, Mycobacterium
AAPLLCAGITLFSPLRHWKA

SEQ ID NO: 787630 - protein, 29 aa, Mycobacterium
AAPLLCAGITLFSPLRHWKAAEGTRLAII

SEQ ID NO: 787631 - protein, 18 aa, Mycobacterium
AAPLLGPLSAISAANPIQ

SEQ ID NO: 787632 - protein, 28 aa, Mycobacterium
AAPLLGPMIQDMLFVQLRHAMETEAVDA

SEQ ID NO: 787633 - protein, 18 aa, Mycobacterium
AAPLRLFTPEMDSFTAHL

SEQ ID NO: 787634 - protein, 18 aa, Mycobacterium
AAPLVRAVGIEALTMLAD

SEQ ID NO: 787635 - protein, 21 aa, Mycobacterium
AAPMLGIVRASDGWIGINCLT

SEQ ID NO: 787636 - protein, 21 aa, Mycobacterium
AAPMPLLYFEAPADFDEPAIR

SEQ ID NO: 787637 - protein, 20 aa, Mycobacterium
AAPMTGVLPPAADEVSELLA

SEQ ID NO: 787638 - protein, 28 aa, Mycobacterium
AAPNPPRPPMPIGGPPPTPPAAPEPQQD

SEQ ID NO: 787639 - protein, 17 aa, Mycobacterium
AAPNVVRLAPPLVITEP

SEQ ID NO: 787640 - protein, 35 aa, Mycobacterium
AAPPAAPPVPLAPPTSPAPPAPPPTGAPGAAPAGL

SEQ ID NO: 787641 - protein, 24 aa, Mycobacterium
AAPPARAPMWWRPDGRVPDDPVLT

SEQ ID NO: 787642 - protein, 41 aa, Mycobacterium
AAPPDTTVVSWLPFFHDMGLMFGIIMPLLEGFHSVLTSPIS

SEQ ID NO: 787643 - protein, 17 aa, Mycobacterium
AAPPFPYTGVKLAAINL

SEQ ID NO: 787644 - protein, 24 aa, Mycobacterium
AAPPGLLCALDLPLITGAGLVRPV

SEQ ID NO: 787645 - protein, 23 aa, Mycobacterium
AAPPPPARRPIPAPPPSHSYAES

SEQ ID NO: 787646 - protein, 18 aa, Mycobacterium
AAPPRMVAYTLAALVGQL

SEQ ID NO: 787647 - protein, 26 aa, Mycobacterium
AAPPRPFRDYLGWLGGWDSQSGEQFW

SEQ ID NO: 787648 - protein, 23 aa, Mycobacterium
AAPRACISEMRYPEPTFDAPDQL

SEQ ID NO: 787649 - protein, 25 aa, Mycobacterium
AAPRELHLLDALPRRGIGKVDRMAL

SEQ ID NO: 787650 - protein, 23 aa, Mycobacterium
AAPRITRMWPRGTGRPLTGLLVA

SEQ ID NO: 787651 - protein, 18 aa, Mycobacterium
AAPRLRSAIREYLRERDI

SEQ ID NO: 787652 - protein, 18 aa, Mycobacterium
AAPRRLDDVLQASDYLIV

SEQ ID NO: 787653 - protein, 21 aa, Mycobacterium
AAPRRNPALRSLFQALERESP

SEQ ID NO: 787654 - protein, 21 aa, Mycobacterium
AAPRRYSYVTYMVAALGQALT

SEQ ID NO: 787655 - protein, 24 aa, Mycobacterium
AAPSLDIGLPWRQYRSVQDGIAGF

SEQ ID NO: 787656 - protein, 19 aa, Mycobacterium
AAPSYRTFHQLRRLVVALA

SEQ ID NO: 787657 - protein, 26 aa, Mycobacterium
AAPTARFCTQFIKLGLGGCDIGVSYT

SEQ ID NO: 787658 - protein, 29 aa, Mycobacterium
AAPTAWLAEGLLIYLPPDAQDRLFDNIAA

SEQ ID NO: 787659 - protein, 29 aa, Mycobacterium
AAPTAWLAEGLLIYLPPEAQDRLFDNITA

SEQ ID NO: 787660 - protein, 29 aa, Mycobacterium
AAPTAWLAEGLLMYLRPEDQDRLFDNITA

SEQ ID NO: 787661 - protein, 22 aa, Mycobacterium
AAPTFRTMPYWESVEPFPLPAE

SEQ ID NO: 787662 - protein, 45 aa, Mycobacterium
AAPTTLQVIFAYPGVHAIWGHRISHWLWNRGARLVARILNEVTRI

SEQ ID NO: 787663 - protein, 17 aa, Mycobacterium
AAPTVLPVLLQGAGLDL

SEQ ID NO: 787664 - protein, 32 aa, Mycobacterium
AAPTWKKSFGHHPLLAFLDRPEIAGGEALAGL

SEQ ID NO: 787665 - protein, 24 aa, Mycobacterium
AAPVFAIVPIFQSLVGTTMSVVPY

SEQ ID NO: 787666 - protein, 18 aa, Mycobacterium
AAPVLGRPAPAGKDLVSV

SEQ ID NO: 787667 - protein, 19 aa, Mycobacterium
AAPVLPPPSAAVRTVLLTG

SEQ ID NO: 787668 - protein, 24 aa, Mycobacterium
AAPVLWSQQVLTTGRLRAVILNSG

SEQ ID NO: 787669 - protein, 25 aa, Mycobacterium
AAPVQPTLPAGWRNNPSQLQSTGWL

SEQ ID NO: 787670 - protein, 19 aa, Mycobacterium
AAPVQWSQQVLTTGNLRAV

SEQ ID NO: 787671 - protein, 20 aa, Mycobacterium
AAPYAGWLNAASAQAANAAG

SEQ ID NO: 787672 - protein, 20 aa, Mycobacterium
AAPYSGWLNAAAVQAAGAAG

SEQ ID NO: 787673 - protein, 17 aa, Mycobacterium
AAPYVAWMTATAAQAEL

SEQ ID NO: 787674 - protein, 23 aa, Mycobacterium
AAQAAILVLPVAIDSGEEWVVLR

SEQ ID NO: 787675 - protein, 19 aa, Mycobacterium
AAQAALLLEALTDAGFDNV

SEQ ID NO: 787676 - protein, 17 aa, Mycobacterium
AAQAIRGGIADCTIALG

SEQ ID NO: 787677 - protein, 17 aa, Mycobacterium
AAQAPEQFTPKRMTYEL

SEQ ID NO: 787678 - protein, 18 aa, Mycobacterium
AAQAPWWEPGSASGYHAM

SEQ ID NO: 787679 - protein, 22 aa, Mycobacterium
AAQASLLVLPVAIDSGEEWVVV

SEQ ID NO: 787680 - protein, 23 aa, Mycobacterium
AAQAYRLHTFGTVTRLAGGGELG

SEQ ID NO: 787681 - protein, 36 aa, Mycobacterium
AAQDYATISELPYAGPLLPGGKRIYLATGYDKWGMT

SEQ ID NO: 787682 - protein, 25 aa, Mycobacterium
AAQDYLMRRMSAVIALLIEARERSV

SEQ ID NO: 787683 - protein, 33 aa, Mycobacterium
AAQEHGFYVLDEFTYPLKWGWVDPDEVVEVLRS

SEQ ID NO: 787684 - protein, 30 aa, Mycobacterium
AAQETLIALVRLRELIDRYPLRGIKGPMGT

SEQ ID NO: 787685 - protein, 25 aa, Mycobacterium
AAQEVPLILMITSYYVRTMEKALAP

SEQ ID NO: 787686 - protein, 24 aa, Mycobacterium
AAQEVQLLLPGRPPPPQADAIADV

SEQ ID NO: 787687 - protein, 20 aa, Mycobacterium
AAQFAMFPDAYAFEVVNLAS

SEQ ID NO: 787688 - protein, 23 aa, Mycobacterium
AAQFHDQFVAAMTSAAGAYSGAE

SEQ ID NO: 787689 - protein, 17 aa, Mycobacterium
AAQGFRVIVPYARGFGS

SEQ ID NO: 787690 - protein, 19 aa, Mycobacterium
AAQGWGWRHAGQNRWATKE

SEQ ID NO: 787691 - protein, 34 aa, Mycobacterium
AAQGYPLHSFPGEPPYVRGPYPTMYVNQPWTIRQ

SEQ ID NO: 787692 - protein, 25 aa, Mycobacterium
AAQHHMHWVSLGLGPGWNHSMASEN

SEQ ID NO: 787693 - protein, 22 aa, Mycobacterium
AAQHRYVLTLAGFAPVSAAPAD

SEQ ID NO: 787694 - protein, 26 aa, Mycobacterium
AAQKRFVPSVRMFSRFTDRARRSVVG

SEQ ID NO: 787695 - protein, 20 aa, Mycobacterium
AAQLAPFIRGLVSTDRPQVG

SEQ ID NO: 787696 - protein, 19 aa, Mycobacterium
AAQLAYWEDALAGMPERLQ

SEQ ID NO: 787697 - protein, 25 aa, Mycobacterium
AAQLDPWLQSLHDLASRLAAALGLS

SEQ ID NO: 787698 - protein, 23 aa, Mycobacterium
AAQLFAHRYLVDPVLTEKKFRGP

SEQ ID NO: 787699 - protein, 22 aa, Mycobacterium
AAQLGFLRTAAIELAPKKITVN

SEQ ID NO: 787700 - protein, 25 aa, Mycobacterium
AAQLGIELLPLDELLSRADFISVHL

SEQ ID NO: 787701 - protein, 17 aa, Mycobacterium
AAQLGTAFLLADEAGST

SEQ ID NO: 787702 - protein, 20 aa, Mycobacterium
AAQLKFLADEGVDLIITSGG

SEQ ID NO: 787703 - protein, 19 aa, Mycobacterium
AAQLLRRVRSRLARLAGSG

SEQ ID NO: 787704 - protein, 19 aa, Mycobacterium
AAQLLVKRFPDPTAPEVQK

SEQ ID NO: 787705 - protein, 24 aa, Mycobacterium
AAQLRSPMWLVTRGAQHVTDTDVV

SEQ ID NO: 787706 - protein, 17 aa, Mycobacterium
AAQLSWQGTDQPAAQLT

SEQ ID NO: 787707 - protein, 17 aa, Mycobacterium
AAQLWIGTSWKMNKGLA

SEQ ID NO: 787708 - protein, 28 aa, Mycobacterium
AAQPAGWFRFYFTDQRWEWSEQVQRLHG

SEQ ID NO: 787709 - protein, 18 aa, Mycobacterium
AAQQAPPTPAPALAHLRG

SEQ ID NO: 787710 - protein, 28 aa, Mycobacterium
AAQQGALRMRFNLAFYADPRHFDEQVTQ

SEQ ID NO: 787711 - protein, 23 aa, Mycobacterium
AAQQRIGWIFNLADVVVAPTTAQ

SEQ ID NO: 787712 - protein, 22 aa, Mycobacterium
AAQQRLWRIRESLAEVLGVYGP

SEQ ID NO: 787713 - protein, 17 aa, Mycobacterium
AAQRAEELLRRGRDLAA

SEQ ID NO: 787714 - protein, 24 aa, Mycobacterium
AAQRAGLELLAWGGRFVEIGKRDI

SEQ ID NO: 787715 - protein, 22 aa, Mycobacterium
AAQRDHDIFGHPLRAGTTAGQR

SEQ ID NO: 787716 - protein, 30 aa, Mycobacterium
AAQRDLSPKAWPRYVWIAEDLPTTATNKIL

SEQ ID NO: 787717 - protein, 19 aa, Mycobacterium
AAQRLLDTLPAAGGKFELS

SEQ ID NO: 787718 - protein, 23 aa, Mycobacterium
AAQRLLPRPLAHTSVHVAVALEA

SEQ ID NO: 787719 - protein, 24 aa, Mycobacterium
AAQRLRHRLPTRPDPHALLGNAFH

SEQ ID NO: 787720 - protein, 27 aa, Mycobacterium
AAQRQYGYYVWPLLLDGQLVGRVDLKA

SEQ ID NO: 787721 - protein, 28 aa, Mycobacterium
AAQSAELPLFRYLGGPNAHILPVPMMNI

SEQ ID NO: 787722 - protein, 17 aa, Mycobacterium
AAQSIRGGLADCALALG

SEQ ID NO: 787723 - protein, 26 aa, Mycobacterium
AAQSPLDISRPLWTATLIEGVQDGRA

SEQ ID NO: 787724 - protein, 25 aa, Mycobacterium
AAQTGPFFLMDIDSFWTPLGSIPEF

SEQ ID NO: 787725 - protein, 21 aa, Mycobacterium
AAQTLFGHPVLRAQAAALPLA

SEQ ID NO: 787726 - protein, 26 aa, Mycobacterium
AAQVAGFSLWATRTLLSGRGDELIDL

SEQ ID NO: 787727 - protein, 25 aa, Mycobacterium
AAQVCDILLGWGAALGARRAYVQVR

SEQ ID NO: 787728 - protein, 21 aa, Mycobacterium
AAQVGALVEATRWPCAVRVHL

SEQ ID NO: 787729 - protein, 17 aa, Mycobacterium
AAQVGVPELPWPDPDGW

SEQ ID NO: 787730 - protein, 27 aa, Mycobacterium
AAQVLAGWQTWLAAADRDTWGLVDMSV

SEQ ID NO: 787731 - protein, 20 aa, Mycobacterium
AAQVLISTLPADVAARYIQA

SEQ ID NO: 787732 - protein, 25 aa, Mycobacterium
AAQVRGEWQPLYEFGTRTAPDIDLL

SEQ ID NO: 787733 - protein, 23 aa, Mycobacterium
AAQVTPFAPPPRSTNPAGTAGQA

SEQ ID NO: 787734 - protein, 22 aa, Mycobacterium
AAQWIELLHQGPGFVRLRGFPI

SEQ ID NO: 787735 - protein, 26 aa, Mycobacterium
AAQYSTLMPLGYPSGIFWLRATMTTP

SEQ ID NO: 787736 - protein, 29 aa, Mycobacterium
AAQYVAAHAPYLAWLTRASADSAAAAARH

SEQ ID NO: 787737 - protein, 19 aa, Mycobacterium
AARAAAPLRWVVQPTLPGS

SEQ ID NO: 787738 - protein, 21 aa, Mycobacterium
AARAAFRRAWGTDPIDMGMGG

SEQ ID NO: 787739 - protein, 25 aa, Mycobacterium
AARAAITKWLIEEKGFCAVAAEADW

SEQ ID NO: 787740 - protein, 18 aa, Mycobacterium
AARAALTVLRAEPWRPEA

SEQ ID NO: 787741 - protein, 19 aa, Mycobacterium
AARAARLKWWTTDLQVRTA

SEQ ID NO: 787742 - protein, 18 aa, Mycobacterium
AARAARLKWWTTELQVRT

SEQ ID NO: 787743 - protein, 24 aa, Mycobacterium
AARAGLATRVLVGLTAALGPDSAA

SEQ ID NO: 787744 - protein, 25 aa, Mycobacterium
AARAHEFLATRAYTYRPRMRADPHA

SEQ ID NO: 787745 - protein, 17 aa, Mycobacterium
AARAHWYTPDQLEWHTP

SEQ ID NO: 787746 - protein, 17 aa, Mycobacterium
AARALIAVRGLHRFAAI

SEQ ID NO: 787747 - protein, 23 aa, Mycobacterium
AARALLEFWWQQDGDGQPLYGFA

SEQ ID NO: 787748 - protein, 17 aa, Mycobacterium
AARALQVMFVLRELRAG

SEQ ID NO: 787749 - protein, 21 aa, Mycobacterium
AARALTPPTLITRVVDALRAG

SEQ ID NO: 787750 - protein, 23 aa, Mycobacterium
AARALVHSGLLTPPSPTAGVRLL

SEQ ID NO: 787751 - protein, 26 aa, Mycobacterium
AARARYGFRDFKLKGGVLPAAEEAKA

SEQ ID NO: 787752 - protein, 23 aa, Mycobacterium
AARASGIPVFYALHRRYRPGDYE

SEQ ID NO: 787753 - protein, 24 aa, Mycobacterium
AARAVLAWDGLRITSPGRLRPCAN

SEQ ID NO: 787754 - protein, 23 aa, Mycobacterium
AARAVWQALPGEAWCLRLAEAAR

SEQ ID NO: 787755 - protein, 23 aa, Mycobacterium
AARAVWQALPGEPWADRFAEAAA

SEQ ID NO: 787756 - protein, 18 aa, Mycobacterium
AARAVWQALPGEQWPQRL

SEQ ID NO: 787757 - protein, 32 aa, Mycobacterium
AARDADYAGFIWFPQLPALDRWRDLYERAARA

SEQ ID NO: 787758 - protein, 34 aa, Mycobacterium
AARDADYAGFIWYPQLPALDHWLKLYQRAARANG

SEQ ID NO: 787759 - protein, 24 aa, Mycobacterium
AARDFATTLQLIGTNALAGATQDD

SEQ ID NO: 787760 - protein, 24 aa, Mycobacterium
AARDYALFRTLYHAGLRSEEVVML

SEQ ID NO: 787761 - protein, 29 aa, Mycobacterium
AARELIEAFWPGPLSIIVRHAPSLSWDLG

SEQ ID NO: 787762 - protein, 18 aa, Mycobacterium
AARELLPERALLGDVTAA

SEQ ID NO: 787763 - protein, 39 aa, Mycobacterium
AAREWNQFLHGNPVGWLLNFTGQRFKGMGKIARGLGEAV

SEQ ID NO: 787764 - protein, 20 aa, Mycobacterium
AARFIGFFATRTRFGLCFRD

SEQ ID NO: 787765 - protein, 29 aa, Mycobacterium
AARFLQLCDAFGIPVVSLVDCPGYMVGPA

SEQ ID NO: 787766 - protein, 19 aa, Mycobacterium
AARFRRPGLEPPAAPSSAR

SEQ ID NO: 787767 - protein, 20 aa, Mycobacterium
AARFRRPGLEPPPTPSSSRA

SEQ ID NO: 787768 - protein, 33 aa, Mycobacterium
AARFVRFCDAFKIPLVFVVDTPGFLPGAEQEKN

SEQ ID NO: 787769 - protein, 33 aa, Mycobacterium
AARFVRLCNAFGIPLIVLVDVPGYLPGVGQEWG

SEQ ID NO: 787770 - protein, 26 aa, Mycobacterium
AARGANLRVFYALHRRYRPGDYETWK

SEQ ID NO: 787771 - protein, 41 aa, Mycobacterium
AARGATGAYLFGWDPLLQPGLPEATLHWLDGLAADTPLVIF

SEQ ID NO: 787772 - protein, 23 aa, Mycobacterium
AARGHNLIVTARREDLLKNLAAR

SEQ ID NO: 787773 - protein, 24 aa, Mycobacterium
AARGHRYRILGLPKSGAEEHELAD

SEQ ID NO: 787774 - protein, 25 aa, Mycobacterium
AARGLAQFGLTWDATRLASQAALQT

SEQ ID NO: 787775 - protein, 18 aa, Mycobacterium
AARGRFMQALPPGGAMVA

SEQ ID NO: 787776 - protein, 32 aa, Mycobacterium
AARGSLLRLWRPPVRPGEWRTLGLFAAADDER

SEQ ID NO: 787777 - protein, 24 aa, Mycobacterium
AARGTVALMWGAEDLVATLGGSSS

SEQ ID NO: 787778 - protein, 17 aa, Mycobacterium
AARGWQTDIWTTEQAFA

SEQ ID NO: 787779 - protein, 26 aa, Mycobacterium
AARHGAGFVLINPLHAASPAPPMEPS

SEQ ID NO: 787780 - protein, 23 aa, Mycobacterium
AARHGIALDPRFSNANPRIAPEY

SEQ ID NO: 787781 - protein, 20 aa, Mycobacterium
AARHGIALDPRFSNSNAHTS

SEQ ID NO: 787782 - protein, 18 aa, Mycobacterium
AARHRTLIPLLSGDPGVV

SEQ ID NO: 787783 - protein, 26 aa, Mycobacterium
AARHYVLRLHQLLAPPPAVITEMIVS

SEQ ID NO: 787784 - protein, 17 aa, Mycobacterium
AARIFMASPATVAASAV

SEQ ID NO: 787785 - protein, 27 aa, Mycobacterium
AARIGALTALTLLLRRERTGTGGAVSV

SEQ ID NO: 787786 - protein, 19 aa, Mycobacterium
AARIILTAVRKKKPRVLVG

SEQ ID NO: 787787 - protein, 17 aa, Mycobacterium
AARILGLTTQVPAKFEA

SEQ ID NO: 787788 - protein, 17 aa, Mycobacterium
AARITMLLHEIPQGCRI

SEQ ID NO: 787789 - protein, 27 aa, Mycobacterium
AARITTPLLPDDYLHLANPLWSARELR

SEQ ID NO: 787790 - protein, 17 aa, Mycobacterium
AARKGLLRVVPPGGTAV

SEQ ID NO: 787791 - protein, 20 aa, Mycobacterium
AARKPPLPDVVKPPSVKPPA

SEQ ID NO: 787792 - protein, 23 aa, Mycobacterium
AARKRLLEIAGRPGNPVICTQGK

SEQ ID NO: 787793 - protein, 26 aa, Mycobacterium
AARKVGRRFAQISPIVATYRKLEAAR

SEQ ID NO: 787794 - protein, 27 aa, Mycobacterium
AARLAAHAAVFWIARGRTATRETAIAR

SEQ ID NO: 787795 - protein, 21 aa, Mycobacterium
AARLALCLATRQVIANGLDIL

SEQ ID NO: 787796 - protein, 20 aa, Mycobacterium
AARLALGSVAQRPWRLYEAE

SEQ ID NO: 787797 - protein, 20 aa, Mycobacterium
AARLAVLPERWREIARPRAN

SEQ ID NO: 787798 - protein, 19 aa, Mycobacterium
AARLAYDVFIHRLRKYIGA

SEQ ID NO: 787799 - protein, 18 aa, Mycobacterium
AARLDWQLRHYPPRTDDV

SEQ ID NO: 787800 - protein, 22 aa, Mycobacterium
AARLDWQLRHYPPRTEDVRLAQ

SEQ ID NO: 787801 - protein, 17 aa, Mycobacterium
AARLEEFPRCVEGLREG

SEQ ID NO: 787802 - protein, 21 aa, Mycobacterium
AARLEIGAHQFGLLAGLVASI

SEQ ID NO: 787803 - protein, 22 aa, Mycobacterium
AARLENLAMLRTLVGAIGTFED

SEQ ID NO: 787804 - protein, 31 aa, Mycobacterium
AARLEPIGLSLPEYICMRILRTYPGMSNSEL

SEQ ID NO: 787805 - protein, 25 aa, Mycobacterium
AARLGRPLRIAHAWSFAFDAAWQPL

SEQ ID NO: 787806 - protein, 25 aa, Mycobacterium
AARLGRPLRIAHAWSFGFDAAWQPL

SEQ ID NO: 787807 - protein, 24 aa, Mycobacterium
AARLNGITYNRLIQGLKAAGVEVD

SEQ ID NO: 787808 - protein, 22 aa, Mycobacterium
AARLNLPHGWAYQPRVLTEELR

SEQ ID NO: 787809 - protein, 17 aa, Mycobacterium
AARLPAGAIITRNLEHF

SEQ ID NO: 787810 - protein, 17 aa, Mycobacterium
AARLPGYMLPSAIVTVE

SEQ ID NO: 787811 - protein, 25 aa, Mycobacterium
AARLQELILRLRPDATLPSIRFGVT

SEQ ID NO: 787812 - protein, 29 aa, Mycobacterium
AARLRAVATWLQTMFAIVPLAVGNRVEDA

SEQ ID NO: 787813 - protein, 17 aa, Mycobacterium
AARLRCEVAASSKLLRP

SEQ ID NO: 787814 - protein, 22 aa, Mycobacterium
AARLRLSRPLPLRVGDIGLLRD

SEQ ID NO: 787815 - protein, 21 aa, Mycobacterium
AARLSQLWFEALAGICAHVQA

SEQ ID NO: 787816 - protein, 17 aa, Mycobacterium
AARLWSPVLACVLSQGV

SEQ ID NO: 787817 - protein, 24 aa, Mycobacterium
AARMDKPLQRYWRDVHVGQAHAIH

SEQ ID NO: 787818 - protein, 21 aa, Mycobacterium
AARMLIRLRSPQQVAFFGDVE

SEQ ID NO: 787819 - protein, 17 aa, Mycobacterium
AARMWRDAFDYVTTSFA

SEQ ID NO: 787820 - protein, 17 aa, Mycobacterium
AARNAATAERDAEFRAN

SEQ ID NO: 787821 - protein, 25 aa, Mycobacterium
AARNARLATVLDRCSYLRDGIAVRD

SEQ ID NO: 787822 - protein, 23 aa, Mycobacterium
AARNKDWFPDEPLVADEPEVSEP

SEQ ID NO: 787823 - protein, 26 aa, Mycobacterium
AARNPDAWFYQRPITLADHQNSRWII

SEQ ID NO: 787824 - protein, 26 aa, Mycobacterium
AARNPDAWFYQRPITLADHQNSRWIV

SEQ ID NO: 787825 - protein, 26 aa, Mycobacterium
AARPAAQLLIYPVIEPAFDTDSYRRC

SEQ ID NO: 787826 - protein, 21 aa, Mycobacterium
AARPALMPMDAWRDGNEFIVE

SEQ ID NO: 787827 - protein, 23 aa, Mycobacterium
AARPCFRIAFGVNDYTLDIGVDQ

SEQ ID NO: 787828 - protein, 37 aa, Mycobacterium
AARPDAGLPDYPALIGPRCRAVWLLTVGAEQVDRDDT

SEQ ID NO: 787829 - protein, 24 aa, Mycobacterium
AARPEDWHMMQPQWLADLSENKQA

SEQ ID NO: 787830 - protein, 25 aa, Mycobacterium
AARPGHEWLPLSLQLILAEILTPSP

SEQ ID NO: 787831 - protein, 21 aa, Mycobacterium
AARPPWEGFRPLRVSAVRWES

SEQ ID NO: 787832 - protein, 31 aa, Mycobacterium
AARPTAWLAEGVLIGFLPPEAETRLLDNVIE

SEQ ID NO: 787833 - protein, 18 aa, Mycobacterium
AARPVGVPAIVVRPDGGV

SEQ ID NO: 787834 - protein, 17 aa, Mycobacterium
AARPVGVPAVVVDPVAP

SEQ ID NO: 787835 - protein, 29 aa, Mycobacterium
AARPVMFSTFLMWVLADLFTTLPEVGDVD

SEQ ID NO: 787836 - protein, 18 aa, Mycobacterium
AARPVRISRFDVLAVRGS

SEQ ID NO: 787837 - protein, 23 aa, Mycobacterium
AARPYRDYIVWLAKQDRSAALAG

SEQ ID NO: 787838 - protein, 28 aa, Mycobacterium
AARQAADLFAWLGPAPDAVVGAAETIAA

SEQ ID NO: 787839 - protein, 24 aa, Mycobacterium
AARQPGLRLPQILELFVEGYADRP

SEQ ID NO: 787840 - protein, 19 aa, Mycobacterium
AARQRFYDALDGYSGCLLV

SEQ ID NO: 787841 - protein, 25 aa, Mycobacterium
AARQRVWWALISDATPYNLGALARV

SEQ ID NO: 787842 - protein, 18 aa, Mycobacterium
AARRAEELVRRGEELAAG

SEQ ID NO: 787843 - protein, 26 aa, Mycobacterium
AARRALSESLLVHPYIRAAREAANNI

SEQ ID NO: 787844 - protein, 19 aa, Mycobacterium
AARRELLVKLALVPADSGL

SEQ ID NO: 787845 - protein, 23 aa, Mycobacterium
AARRHGLRISLSPAPFAGAVGFG

SEQ ID NO: 787846 - protein, 17 aa, Mycobacterium
AARRIKLLKTLADSIGG

SEQ ID NO: 787847 - protein, 21 aa, Mycobacterium
AARRLVAPALMQLGTVLLEDV

SEQ ID NO: 787848 - protein, 22 aa, Mycobacterium
AARRLVHVPMGRFAEPEELAAA

SEQ ID NO: 787849 - protein, 19 aa, Mycobacterium
AARRVVLVHWDDFFRPLSK

SEQ ID NO: 787850 - protein, 17 aa, Mycobacterium
AARSERMSARRFWVRYA

SEQ ID NO: 787851 - protein, 19 aa, Mycobacterium
AARSIVYYVLGYVADEQSR

SEQ ID NO: 787852 - protein, 21 aa, Mycobacterium
AARSLLDRRTARAVLSRLGGP

SEQ ID NO: 787853 - protein, 19 aa, Mycobacterium
AARTFALACPPSVAPESVA

SEQ ID NO: 787854 - protein, 17 aa, Mycobacterium
AARTFLRRWPDPQAWAG

SEQ ID NO: 787855 - protein, 22 aa, Mycobacterium
AARTFPLACPPSVSPDDVAAFI

SEQ ID NO: 787856 - protein, 18 aa, Mycobacterium
AARTGIIRRWADVRFPDI

SEQ ID NO: 787857 - protein, 28 aa, Mycobacterium
AARTGLYHTLGLVQAWLSQPELLDTRLV

SEQ ID NO: 787858 - protein, 17 aa, Mycobacterium
AARTLLRREFGIGMPKL

SEQ ID NO: 787859 - protein, 22 aa, Mycobacterium
AARTPRLLVASDFDGTLAPIVN

SEQ ID NO: 787860 - protein, 19 aa, Mycobacterium
AARTRFFDDFFTDACAAGV

SEQ ID NO: 787861 - protein, 18 aa, Mycobacterium
AARTRYFDEFFADAAAAG

SEQ ID NO: 787862 - protein, 17 aa, Mycobacterium
AARTRYIDAFFAEAGAA

SEQ ID NO: 787863 - protein, 24 aa, Mycobacterium
AARVMCIVNPLRLGYRYSSWVTIR

SEQ ID NO: 787864 - protein, 25 aa, Mycobacterium
AARVPQEWLLPYVHQRYDDAALLAA

SEQ ID NO: 787865 - protein, 26 aa, Mycobacterium
AARVPQEWLLPYVHQRYDDVALLAAP

SEQ ID NO: 787866 - protein, 23 aa, Mycobacterium
AARVRAKLPSGAVLLFCQHHANE

SEQ ID NO: 787867 - protein, 22 aa, Mycobacterium
AARWAATWGQRQPVRFIVGRRG

SEQ ID NO: 787868 - protein, 19 aa, Mycobacterium
AARWHALALAATSADLVGA

SEQ ID NO: 787869 - protein, 21 aa, Mycobacterium
AARYGLWATLRIARLLNGRRG

SEQ ID NO: 787870 - protein, 22 aa, Mycobacterium
AARYPHLVVLSITDFGATGPRS

SEQ ID NO: 787871 - protein, 17 aa, Mycobacterium
AARYPRLIYASASGWGE

SEQ ID NO: 787872 - protein, 22 aa, Mycobacterium
AARYRAAGFWRPRTLCQELQES

SEQ ID NO: 787873 - protein, 20 aa, Mycobacterium
AARYRVLAPDLLGFGQSAKV

SEQ ID NO: 787874 - protein, 23 aa, Mycobacterium
AASAAIPGIFPPVSINGRELIDG

SEQ ID NO: 787875 - protein, 23 aa, Mycobacterium
AASAEATFWRYCIADVTNVQQEL

SEQ ID NO: 787876 - protein, 17 aa, Mycobacterium
AASAGLTTSIAAAAEDE

SEQ ID NO: 787877 - protein, 28 aa, Mycobacterium
AASALLKGLTAHYLLKSVYPVADGDAIL

SEQ ID NO: 787878 - protein, 27 aa, Mycobacterium
AASALLKGLTAHYLLKSVYPVQAGDTV

SEQ ID NO: 787879 - protein, 26 aa, Mycobacterium
AASALLKGLTAHYLLKSVYPVQSGET

SEQ ID NO: 787880 - protein, 20 aa, Mycobacterium
AASAPYVAWLTATAAHAEQT

SEQ ID NO: 787881 - protein, 20 aa, Mycobacterium
AASARFGLLLARTGPDKHRD

SEQ ID NO: 787882 - protein, 19 aa, Mycobacterium
AASAWLLESSDGESALMLA

SEQ ID NO: 787883 - protein, 22 aa, Mycobacterium
AASAWPVVPWVVSGKSDQALAA

SEQ ID NO: 787884 - protein, 23 aa, Mycobacterium
AASDAFFPFPDGLQTLTAAGVTA

SEQ ID NO: 787885 - protein, 24 aa, Mycobacterium
AASDAPDIFIWQAEAPLSTPENIA

SEQ ID NO: 787886 - protein, 26 aa, Mycobacterium
AASETSLLWGLLQTASAGGLTFAISG

SEQ ID NO: 787887 - protein, 26 aa, Mycobacterium
AASFFAKNMLPLLTSTRAVLENVDND

SEQ ID NO: 787888 - protein, 22 aa, Mycobacterium
AASFHAQFIQTMNAGAGAYAAA

SEQ ID NO: 787889 - protein, 18 aa, Mycobacterium
AASFTRTFVRYEPMPEAA

SEQ ID NO: 787890 - protein, 47 aa, Mycobacterium
AASGLPSWQQALSGLPGIGQAAAAPAAALFNLPTVNTGLGNSGQWNL

SEQ ID NO: 787891 - protein, 25 aa, Mycobacterium
AASGTSIYWTGLNKGKRSATIDLRS

SEQ ID NO: 787892 - protein, 26 aa, Mycobacterium
AASGVPFAPPFLPIAGVDPWPSEGAA

SEQ ID NO: 787893 - protein, 30 aa, Mycobacterium
AASIADPLLAAINEPALALTGRPLIGNGAN

SEQ ID NO: 787894 - protein, 29 aa, Mycobacterium
AASIAGYPRVVWIAGGLLKGAAVDDLVRD

SEQ ID NO: 787895 - protein, 32 aa, Mycobacterium
AASITSPLLNALNAPFLAATGRPLIGNGANAA

SEQ ID NO: 787896 - protein, 17 aa, Mycobacterium
AASIYKVGLGSVRFLMA

SEQ ID NO: 787897 - protein, 27 aa, Mycobacterium
AASKHGIVGLMRTLANALAPHRIRVNT

SEQ ID NO: 787898 - protein, 26 aa, Mycobacterium
AASKHGIVGLMRTLANALAPHSIRVN

SEQ ID NO: 787899 - protein, 26 aa, Mycobacterium
AASKHGIVGLMRTLANALAPLNIRVN

SEQ ID NO: 787900 - protein, 25 aa, Mycobacterium
AASLKLPLVLVIDTAGPALSTEAEE

SEQ ID NO: 787901 - protein, 23 aa, Mycobacterium
AASLPEWTPVAALPAPTGMLCWT

SEQ ID NO: 787902 - protein, 25 aa, Mycobacterium
AASLYRHYSGKYDLFRAAVLNLGEQ

SEQ ID NO: 787903 - protein, 23 aa, Mycobacterium
AASNPAWYYNLTTAGTAQVEVGT

SEQ ID NO: 787904 - protein, 18 aa, Mycobacterium
AASNPLIRLVEDAMRFYM

SEQ ID NO: 787905 - protein, 26 aa, Mycobacterium
AASPAAAPFGIVLSNTGLGNTGDWNV

SEQ ID NO: 787906 - protein, 25 aa, Mycobacterium
AASPIEGWMPFRKVFDVVASGRRHV

SEQ ID NO: 787907 - protein, 19 aa, Mycobacterium
AASPIPVEPGWKGFRNLRV

SEQ ID NO: 787908 - protein, 38 aa, Mycobacterium
AASPLLGQPPVLRLFGDLLYLDRYWLEEQQVCDDVLAL

SEQ ID NO: 787909 - protein, 17 aa, Mycobacterium
AASPLPGWDVKALVSHM

SEQ ID NO: 787910 - protein, 22 aa, Mycobacterium
AASPPRWHELAFDPEPHVVQRS

SEQ ID NO: 787911 - protein, 27 aa, Mycobacterium
AASPRETWLRLLLIDAGFPTPSTQLPV

SEQ ID NO: 787912 - protein, 28 aa, Mycobacterium
AASQAYERIFMWFAARDWDAMAEVVADD

SEQ ID NO: 787913 - protein, 19 aa, Mycobacterium
AASQHARIGRRARAAQLLR

SEQ ID NO: 787914 - protein, 26 aa, Mycobacterium
AASQIAERFFAYFAACDWDSLATTLA

SEQ ID NO: 787915 - protein, 24 aa, Mycobacterium
AASQLGWFGVLESLGASGGRVGQR

SEQ ID NO: 787916 - protein, 27 aa, Mycobacterium
AASQSAWPQHLWPALSTAGFANELRNL

SEQ ID NO: 787917 - protein, 21 aa, Mycobacterium
AASRFYANLVLETAQEARRAA

SEQ ID NO: 787918 - protein, 23 aa, Mycobacterium
AASRMLHQLAPGLAVWECDKTVY

SEQ ID NO: 787919 - protein, 18 aa, Mycobacterium
AASRWNLGALYLLPDLRA

SEQ ID NO: 787920 - protein, 47 aa, Mycobacterium
AASRYAATEVANVEQNLLGLINAPTQALFGRPLIGNGADGAAGTGQT

SEQ ID NO: 787921 - protein, 24 aa, Mycobacterium
AASSARLYWESFAVWGRGDRVELP

SEQ ID NO: 787922 - protein, 24 aa, Mycobacterium
AASSARLYWESFKVWGQTERVELP

SEQ ID NO: 787923 - protein, 26 aa, Mycobacterium
AASSMLAAVAPYTSWLGAVSAMAEET

SEQ ID NO: 787924 - protein, 25 aa, Mycobacterium
AASSWGSLLPAVWSFMLAARNRGLG

SEQ ID NO: 787925 - protein, 24 aa, Mycobacterium
AASTRVSARVWATFPRHLVGRVAA

SEQ ID NO: 787926 - protein, 35 aa, Mycobacterium
AASTTPDSPLGWLWQILFGTTFPTSISALLTDLQP

SEQ ID NO: 787927 - protein, 26 aa, Mycobacterium
AASVHLLCEHPEQWELLRRRPELAMR

SEQ ID NO: 787928 - protein, 17 aa, Mycobacterium
AASWFTGTPPPVDALII

SEQ ID NO: 787929 - protein, 17 aa, Mycobacterium
AASWPRWAKVITKVTWT

SEQ ID NO: 787930 - protein, 24 aa, Mycobacterium
AASWQRLRTAPALLPLGHGDERRQ

SEQ ID NO: 787931 - protein, 18 aa, Mycobacterium
AASYLASLNLDGPRRARA

SEQ ID NO: 787932 - protein, 18 aa, Mycobacterium
AATAAFAPAIELIDTRIT

SEQ ID NO: 787933 - protein, 18 aa, Mycobacterium
AATAFLKPALGRPNLTVR

SEQ ID NO: 787934 - protein, 24 aa, Mycobacterium
AATAGWADAALLRVDSRSQVLVAD

SEQ ID NO: 787935 - protein, 19 aa, Mycobacterium
AATAGWAEAALLRVDSRNQ

SEQ ID NO: 787936 - protein, 31 aa, Mycobacterium
AATALARRHPMLRVRFLPDGTQRIAPADEFG

SEQ ID NO: 787937 - protein, 19 aa, Mycobacterium
AATALLTRALQIGLEKDDA

SEQ ID NO: 787938 - protein, 24 aa, Mycobacterium
AATALTPFAPPPRTTSDAGQSGQA

SEQ ID NO: 787939 - protein, 19 aa, Mycobacterium
AATALWFRNYSTWDGVAGI

SEQ ID NO: 787940 - protein, 45 aa, Mycobacterium
AATAPSAWSPPVPPAPVPSAPVAPAPLAAPAPEAPLPSPGSLGSG

SEQ ID NO: 787941 - protein, 26 aa, Mycobacterium
AATARRRAHILLNHLAQALTDSPVSA

SEQ ID NO: 787942 - protein, 23 aa, Mycobacterium
AATARRWQRRLPLSGWTVEESDP

SEQ ID NO: 787943 - protein, 21 aa, Mycobacterium
AATAVWFLNFSTWDGVAGIYL

SEQ ID NO: 787944 - protein, 29 aa, Mycobacterium
AATDLAGLGSTLQIANRAAAATITGVPAA

SEQ ID NO: 787945 - protein, 18 aa, Mycobacterium
AATDLGVSTLLIAGGVAA

SEQ ID NO: 787946 - protein, 25 aa, Mycobacterium
AATDLIGYGPYLDRVGLRPGQRHHP

SEQ ID NO: 787947 - protein, 25 aa, Mycobacterium
AATDLLDQAWWSPGLTHPDGRSAFA

SEQ ID NO: 787948 - protein, 24 aa, Mycobacterium
AATEAGLPPGRAWLLVEMGGADRA

SEQ ID NO: 787949 - protein, 24 aa, Mycobacterium
AATEAVYEQLWAQDVAVMAGYHAG

SEQ ID NO: 787950 - protein, 30 aa, Mycobacterium
AATELLDEAWWFPAIQWPDGRMQFMLNERM

SEQ ID NO: 787951 - protein, 38 aa, Mycobacterium
AATENGLLLTTLWYIREVDPTTLLLTGLTRDGVYLVRD

SEQ ID NO: 787952 - protein, 18 aa, Mycobacterium
AATENWLRACLVSCWLAS

SEQ ID NO: 787953 - protein, 25 aa, Mycobacterium
AATEPFLDPLVFTGGRLKAGGADAA

SEQ ID NO: 787954 - protein, 39 aa, Mycobacterium
AATERGLLLTTLWYIRVVDPTTLLFTGLTRDGVYLIEDG

SEQ ID NO: 787955 - protein, 31 aa, Mycobacterium
AATERLIDPDRLWLWLRANGLDFSGARLTDA

SEQ ID NO: 787956 - protein, 20 aa, Mycobacterium
AATERRGLRPLLDELATIDD

SEQ ID NO: 787957 - protein, 29 aa, Mycobacterium
AATFDVSLWGYFVPLISGAQIMLAAPNEQ

SEQ ID NO: 787958 - protein, 17 aa, Mycobacterium
AATFPMAVGVLAALHQR

SEQ ID NO: 787959 - protein, 26 aa, Mycobacterium
AATGARAAFIIRFGTGVLPDAKTVIQ

SEQ ID NO: 787960 - protein, 20 aa, Mycobacterium
AATGARLAWIPRRAGERGAI

SEQ ID NO: 787961 - protein, 24 aa, Mycobacterium
AATGHVIRTEPCTSVAAIAAAPAG

SEQ ID NO: 787962 - protein, 22 aa, Mycobacterium
AATGIDIFRIFDALNNVESMRP

SEQ ID NO: 787963 - protein, 19 aa, Mycobacterium
AATGLGWTGLALAEDVGGS

SEQ ID NO: 787964 - protein, 19 aa, Mycobacterium
AATGLYIPNFCDPAAVGFP

SEQ ID NO: 787965 - protein, 17 aa, Mycobacterium
AATGTQYRRVQQAWLAA

SEQ ID NO: 787966 - protein, 28 aa, Mycobacterium
AATGTRGDSPPYGYGNLVGGDGGTGADG

SEQ ID NO: 787967 - protein, 25 aa, Mycobacterium
AATGTSIYWTGLNKGKRSVTVDLRS

SEQ ID NO: 787968 - protein, 29 aa, Mycobacterium
AATGVLRPEQFPPNMLVPDPKHPGVMRVG

SEQ ID NO: 787969 - protein, 31 aa, Mycobacterium
AATHLSRLVPQHLMRRLFFTAATVGADTLHH

SEQ ID NO: 787970 - protein, 32 aa, Mycobacterium
AATHLSRLVPQHMMRRLFFTAATVDAATLHHF

SEQ ID NO: 787971 - protein, 17 aa, Mycobacterium
AATHRAMWALGDYALMA

SEQ ID NO: 787972 - protein, 18 aa, Mycobacterium
AATHRAMWALGDYALMAE

SEQ ID NO: 787973 - protein, 18 aa, Mycobacterium
AATIILRIDRTAPDAVLD

SEQ ID NO: 787974 - protein, 24 aa, Mycobacterium
AATIKKVFLELGGKSAFIVLEDAD

SEQ ID NO: 787975 - protein, 25 aa, Mycobacterium
AATIKRMFLELGGKSAFIVLDDADL

SEQ ID NO: 787976 - protein, 23 aa, Mycobacterium
AATKAALDTLTLGLAKELGPSGV

SEQ ID NO: 787977 - protein, 18 aa, Mycobacterium
AATKAAVRSFARTWTLEL

SEQ ID NO: 787978 - protein, 24 aa, Mycobacterium
AATKTFMCQIVSGAALMISALVAT

SEQ ID NO: 787979 - protein, 23 aa, Mycobacterium
AATKTLFDKAWSMVPRRAFGLER

SEQ ID NO: 787980 - protein, 24 aa, Mycobacterium
AATKTPLPMLMPDGANQTAEGAMN

SEQ ID NO: 787981 - protein, 17 aa, Mycobacterium
AATLAEVQWAAAGYIVA

SEQ ID NO: 787982 - protein, 37 aa, Mycobacterium
AATLAIVAKLPISLLRHAVAPHPTINQAWDPLLAQET

SEQ ID NO: 787983 - protein, 22 aa, Mycobacterium
AATLFYGQLFGWTPEERRTADG

SEQ ID NO: 787984 - protein, 25 aa, Mycobacterium
AATLGSAKRLIRGTLFAGASRPVSG

SEQ ID NO: 787985 - protein, 19 aa, Mycobacterium
AATLLKLHRPGNPVILPTV

SEQ ID NO: 787986 - protein, 17 aa, Mycobacterium
AATLLTYGRRRVHRVAV

SEQ ID NO: 787987 - protein, 19 aa, Mycobacterium
AATLPPFDPAAPATNPAGV

SEQ ID NO: 787988 - protein, 19 aa, Mycobacterium
AATLPRRRIRHVQVHDPGI

SEQ ID NO: 787989 - protein, 19 aa, Mycobacterium
AATLPYGLSPLVVPQLKTI

SEQ ID NO: 787990 - protein, 18 aa, Mycobacterium
AATLTKLNQRHGFDCPGC

SEQ ID NO: 787991 - protein, 24 aa, Mycobacterium
AATLTKVFLELGGKSAFLVLDDAD

SEQ ID NO: 787992 - protein, 24 aa, Mycobacterium
AATLTVQSLVTMGLTTGKRGEYAP

SEQ ID NO: 787993 - protein, 23 aa, Mycobacterium
AATLVPLHPPIARRWSPRAFDPA

SEQ ID NO: 787994 - protein, 17 aa, Mycobacterium
AATLVVRYLGPRYPLVS

SEQ ID NO: 787995 - protein, 17 aa, Mycobacterium
AATNRKLDKAASKGVIH

SEQ ID NO: 787996 - protein, 18 aa, Mycobacterium
AATPLGPPAGWPQSLQTA

SEQ ID NO: 787997 - protein, 18 aa, Mycobacterium
AATPPPVRGGRQPRILFA

SEQ ID NO: 787998 - protein, 26 aa, Mycobacterium
AATPQAYIALWRTLLGLDLMATVDIT

SEQ ID NO: 787999 - protein, 23 aa, Mycobacterium
AATPRMPFVITGVNLHATGARRL

SEQ ID NO: 788000 - protein, 32 aa, Mycobacterium
AATPWLAATVSFAWRIRLISSATIDARVRLRQ

SEQ ID NO: 788001 - protein, 25 aa, Mycobacterium
AATPYASATFPWYELGRQAHVRGAV

SEQ ID NO: 788002 - protein, 25 aa, Mycobacterium
AATPYASVTFPWYALGRQVHVRGRV

SEQ ID NO: 788003 - protein, 27 aa, Mycobacterium
AATQDLLREAVLTEGWRLHPDTDPVAA

SEQ ID NO: 788004 - protein, 29 aa, Mycobacterium
AATRAGVQRFVMVSYFGAGPNHGVSVDDS

SEQ ID NO: 788005 - protein, 22 aa, Mycobacterium
AATRALPPIRKLGGGLVEIPRV

SEQ ID NO: 788006 - protein, 24 aa, Mycobacterium
AATRATLVLHLAITRIRELMAEIE

SEQ ID NO: 788007 - protein, 23 aa, Mycobacterium
AATRDFLTRDLNLPTPEQADANQ

SEQ ID NO: 788008 - protein, 25 aa, Mycobacterium
AATRHTPFAWPPRTTNTAGLASHAA

SEQ ID NO: 788009 - protein, 24 aa, Mycobacterium
AATRLGHSVAFFIGTAYGSTETAE

SEQ ID NO: 788010 - protein, 24 aa, Mycobacterium
AATRSALRGWLARAMVRPGQAQDV

SEQ ID NO: 788011 - protein, 17 aa, Mycobacterium
AATRTLAELLTARGWTP

SEQ ID NO: 788012 - protein, 21 aa, Mycobacterium
AATRWPAVRFAVRNTAVQGPN

SEQ ID NO: 788013 - protein, 23 aa, Mycobacterium
AATRWPAVRFAVRNTAVQGPNAV

SEQ ID NO: 788014 - protein, 18 aa, Mycobacterium
AATRWVWVANAANATLDV

SEQ ID NO: 788015 - protein, 29 aa, Mycobacterium
AATSQGIGFIPWFPLAAGPLAAADGPLQR

SEQ ID NO: 788016 - protein, 19 aa, Mycobacterium
AATTRFGRPVAHGMLVAGY

SEQ ID NO: 788017 - protein, 26 aa, Mycobacterium
AATVAHAWSALLRAALRTAARVTGPA

SEQ ID NO: 788018 - protein, 25 aa, Mycobacterium
AATVALFRLPRTLKYKAKPGRSVDR

SEQ ID NO: 788019 - protein, 21 aa, Mycobacterium
AATVHPVLVATNRGQLVSLAL

SEQ ID NO: 788020 - protein, 18 aa, Mycobacterium
AATVIRIAISHYIVPSDD

SEQ ID NO: 788021 - protein, 19 aa, Mycobacterium
AATVIRIAISHYIVRSDDA

SEQ ID NO: 788022 - protein, 24 aa, Mycobacterium
AATVKKVFLELGGKSAFIVLDDLD

SEQ ID NO: 788023 - protein, 19 aa, Mycobacterium
AATVLPYRQFHDVAENFRY

SEQ ID NO: 788024 - protein, 21 aa, Mycobacterium
AATVLRDWRLSLAPNAHVRER

SEQ ID NO: 788025 - protein, 24 aa, Mycobacterium
AATVLVPIYPLAPPKNTGTAATLV

SEQ ID NO: 788026 - protein, 25 aa, Mycobacterium
AATVPLGRLAKPTDVGWAAAFLTSD

SEQ ID NO: 788027 - protein, 26 aa, Mycobacterium
AATVPLGRLAQPADIGWAAAFLASDL

SEQ ID NO: 788028 - protein, 18 aa, Mycobacterium
AATVPPAVVAANRARLAI

SEQ ID NO: 788029 - protein, 25 aa, Mycobacterium
AATVPPPIIAANRSLLAALVATNFF

SEQ ID NO: 788030 - protein, 18 aa, Mycobacterium
AATVPPPLIAANRNQLVS

SEQ ID NO: 788031 - protein, 26 aa, Mycobacterium
AATVPPPVIAANRALLASLVATNFLG

SEQ ID NO: 788032 - protein, 26 aa, Mycobacterium
AATVPPPVIAANRALLATLVATNILG

SEQ ID NO: 788033 - protein, 24 aa, Mycobacterium
AATVPPPVIAANRALLMALIATNI

SEQ ID NO: 788034 - protein, 26 aa, Mycobacterium
AATVPPPVIAANRALLMALIATNIFG

SEQ ID NO: 788035 - protein, 33 aa, Mycobacterium
AATVPPPVIAANRALLMGLVFTNIFGQNTPAIA

SEQ ID NO: 788036 - protein, 27 aa, Mycobacterium
AATWRQFITATLYHRTRRWPDLCALTD

SEQ ID NO: 788037 - protein, 30 aa, Mycobacterium
AATYLAFDLIHRLWLDLGHEVRYVQNVTDV

SEQ ID NO: 788038 - protein, 18 aa, Mycobacterium
AAVAAFFSDRTWWPGISE

SEQ ID NO: 788039 - protein, 24 aa, Mycobacterium
AAVAALDRRFGITGLTKAAVLPVI

SEQ ID NO: 788040 - protein, 24 aa, Mycobacterium
AAVAARTLRRRGFDGRIILVGDEP

SEQ ID NO: 788041 - protein, 28 aa, Mycobacterium
AAVAARVPRLLFLGSSCIYPKFAEQPIK

SEQ ID NO: 788042 - protein, 25 aa, Mycobacterium
AAVALAWLRARPGTVVPIIGARRME

SEQ ID NO: 788043 - protein, 18 aa, Mycobacterium
AAVAMGWTPFYPQFNRSS

SEQ ID NO: 788044 - protein, 21 aa, Mycobacterium
AAVAQLLRLPGGLPVSGIDVA

SEQ ID NO: 788045 - protein, 28 aa, Mycobacterium
AAVATAVVGWRLMTAGPAHLNLRVRAHA

SEQ ID NO: 788046 - protein, 19 aa, Mycobacterium
AAVAVAWALAHPDRCVAVL

SEQ ID NO: 788047 - protein, 17 aa, Mycobacterium
AAVCPHVEWALSSTLGA

SEQ ID NO: 788048 - protein, 17 aa, Mycobacterium
AAVCPHVEWALSSTLGS

SEQ ID NO: 788049 - protein, 18 aa, Mycobacterium
AAVCPHVEWALTSTLTST

SEQ ID NO: 788050 - protein, 26 aa, Mycobacterium
AAVDDFYRRLIADPALTHFFDGVDMK

SEQ ID NO: 788051 - protein, 25 aa, Mycobacterium
AAVDDRYRRFLELGTRRCGALPPAA

SEQ ID NO: 788052 - protein, 29 aa, Mycobacterium
AAVDEVSIQIAALFGAHAHSYQQLSAQAA

SEQ ID NO: 788053 - protein, 32 aa, Mycobacterium
AAVDFSVLYPAGRLVDTPLPAWTHPHLFIEGE

SEQ ID NO: 788054 - protein, 25 aa, Mycobacterium
AAVDGFRFWAVRELSRQRGALREEL

SEQ ID NO: 788055 - protein, 23 aa, Mycobacterium
AAVDHVWLCGPFGMVTDAQAALR

SEQ ID NO: 788056 - protein, 20 aa, Mycobacterium
AAVDIPFLAHAITGLSMAAT

SEQ ID NO: 788057 - protein, 20 aa, Mycobacterium
AAVDKIRRALLAHKVIFFRH

SEQ ID NO: 788058 - protein, 20 aa, Mycobacterium
AAVDLFAEIGYPATGLGEII

SEQ ID NO: 788059 - protein, 26 aa, Mycobacterium
AAVDTTWSAPHLEFLVAVARSCCGHA

SEQ ID NO: 788060 - protein, 19 aa, Mycobacterium
AAVDWLYSGLPSRFPDLKI

SEQ ID NO: 788061 - protein, 19 aa, Mycobacterium
AAVDWLYSGLPSRFPELKI

SEQ ID NO: 788062 - protein, 31 aa, Mycobacterium
AAVEAAAWQVPKFYWTVTSDSALRTGIAALT

SEQ ID NO: 788063 - protein, 36 aa, Mycobacterium
AAVEGFIRQILGWREYMWHLYWHFGPDYTQKNELNA

SEQ ID NO: 788064 - protein, 25 aa, Mycobacterium
AAVEPTWWHAGTPAPIPAITKQGGA

SEQ ID NO: 788065 - protein, 25 aa, Mycobacterium
AAVEPYWAIDELSSAYIHSNIPEVI

SEQ ID NO: 788066 - protein, 29 aa, Mycobacterium
AAVERLDGDPLWLLLISGSGNAKTETVQA

SEQ ID NO: 788067 - protein, 24 aa, Mycobacterium
AAVERPPHLKAIFPLAVTSDLYEG

SEQ ID NO: 788068 - protein, 25 aa, Mycobacterium
AAVERWLDMLPMELVTGSPELGLAW

SEQ ID NO: 788069 - protein, 17 aa, Mycobacterium
AAVFASLRALGGSPPYT

SEQ ID NO: 788070 - protein, 24 aa, Mycobacterium
AAVFATPCVFFVQNNQWAISVPIH

SEQ ID NO: 788071 - protein, 26 aa, Mycobacterium
AAVFDRWSALIAQRFVGDGIPAGRAN

SEQ ID NO: 788072 - protein, 20 aa, Mycobacterium
AAVFLPNCSAFAVVLHGILR

SEQ ID NO: 788073 - protein, 20 aa, Mycobacterium
AAVFPSHYEPFGLVALEAAA

SEQ ID NO: 788074 - protein, 21 aa, Mycobacterium
AAVFPSHYEPFGLVALEAAAA

SEQ ID NO: 788075 - protein, 19 aa, Mycobacterium
AAVFVPRGQAPEGGWPVIA

SEQ ID NO: 788076 - protein, 27 aa, Mycobacterium
AAVGASGFYAKWLPQLVFGEGQRPKAY

SEQ ID NO: 788077 - protein, 27 aa, Mycobacterium
AAVGASGFYAKWLPQLVFGEGQRPRAY

SEQ ID NO: 788078 - protein, 28 aa, Mycobacterium
AAVGASGFYAKWLPQLVFGEGQRPTAYQ

SEQ ID NO: 788079 - protein, 27 aa, Mycobacterium
AAVGDWLAMFSMWPIKQTPGLRCQLDA

SEQ ID NO: 788080 - protein, 17 aa, Mycobacterium
AAVGFVWAFIAAGCEGP

SEQ ID NO: 788081 - protein, 25 aa, Mycobacterium
AAVGIIWPSILFPDDDPATASAQPA

SEQ ID NO: 788082 - protein, 22 aa, Mycobacterium
AAVGKYWEIDEIRPAFIHANVP

SEQ ID NO: 788083 - protein, 23 aa, Mycobacterium
AAVGLVAQHRGLHGLTALVVEAA

SEQ ID NO: 788084 - protein, 26 aa, Mycobacterium
AAVGLVKFDLLGLGMLSALHYCIDLV

SEQ ID NO: 788085 - protein, 26 aa, Mycobacterium
AAVGNKTWFPAWQFDGRRLRADLPRI

SEQ ID NO: 788086 - protein, 24 aa, Mycobacterium
AAVGPDFIICYRMSMADYVEGGQS

SEQ ID NO: 788087 - protein, 18 aa, Mycobacterium
AAVGPYVVPPVNLGAHIA

SEQ ID NO: 788088 - protein, 19 aa, Mycobacterium
AAVGRDRVLVHPRPRLSVI

SEQ ID NO: 788089 - protein, 24 aa, Mycobacterium
AAVGRISYLLGLRGPAVAVDTACS

SEQ ID NO: 788090 - protein, 25 aa, Mycobacterium
AAVGVDPWSWVLGGGEDHALVACFA

SEQ ID NO: 788091 - protein, 25 aa, Mycobacterium
AAVGVVHSLWQPIAGRFKDYIAQPR

SEQ ID NO: 788092 - protein, 23 aa, Mycobacterium
AAVHMLTRHLAGELAPHILVNAI

SEQ ID NO: 788093 - protein, 24 aa, Mycobacterium
AAVHQIYDVVRWAAGPHPDWDGAR

SEQ ID NO: 788094 - protein, 22 aa, Mycobacterium
AAVHRATRPGATLLISCFSDAN

SEQ ID NO: 788095 - protein, 24 aa, Mycobacterium
AAVHRATRPGATLLISCFSDANPP

SEQ ID NO: 788096 - protein, 19 aa, Mycobacterium
AAVHSCVFPAFRAAGRTVT

SEQ ID NO: 788097 - protein, 18 aa, Mycobacterium
AAVIERSFGAWESAWGAP

SEQ ID NO: 788098 - protein, 20 aa, Mycobacterium
AAVIGALQRTGMGGGIGFYV

SEQ ID NO: 788099 - protein, 22 aa, Mycobacterium
AAVIIAVKRLTAAKTRLAPIFS

SEQ ID NO: 788100 - protein, 28 aa, Mycobacterium
AAVKDWFTVDWHRAIVDKWRAAGVRMAD

SEQ ID NO: 788101 - protein, 21 aa, Mycobacterium
AAVLAALARLAAAVAAELVAG

SEQ ID NO: 788102 - protein, 24 aa, Mycobacterium
AAVLDPQQRLLLETTWEALDDAGI

SEQ ID NO: 788103 - protein, 23 aa, Mycobacterium
AAVLDVTWRFYSLPRLRHQTGGG

SEQ ID NO: 788104 - protein, 25 aa, Mycobacterium
AAVLIRTLPLIARGASEGALLLTRD

SEQ ID NO: 788105 - protein, 19 aa, Mycobacterium
AAVLPPSGVVPDMTRFMHP

SEQ ID NO: 788106 - protein, 17 aa, Mycobacterium
AAVLRAMGLPLAGLRVG

SEQ ID NO: 788107 - protein, 26 aa, Mycobacterium
AAVLRGWQRRALVKYLAGQPRDFLAV

SEQ ID NO: 788108 - protein, 19 aa, Mycobacterium
AAVLTPSWAMTSEHFRGVG

SEQ ID NO: 788109 - protein, 38 aa, Mycobacterium
AAVLVAMNALWELSLPRRDLRLLAERLGSDVPFALHGG

SEQ ID NO: 788110 - protein, 19 aa, Mycobacterium
AAVLWRYALRLTGDASQSE

SEQ ID NO: 788111 - protein, 19 aa, Mycobacterium
AAVLWRYALRLTGDTSQSE

SEQ ID NO: 788112 - protein, 23 aa, Mycobacterium
AAVLYETFRPQPAGRDWPAEAMW

SEQ ID NO: 788113 - protein, 17 aa, Mycobacterium
AAVMLRRCETCAADIDE

SEQ ID NO: 788114 - protein, 21 aa, Mycobacterium
AAVNAVRWAAAEALAREVCLR

SEQ ID NO: 788115 - protein, 26 aa, Mycobacterium
AAVNLKIPILLIRGKLSDVVSPEGVQ

SEQ ID NO: 788116 - protein, 26 aa, Mycobacterium
AAVNLTVPILLIRGKLSDVVSPEGVA

SEQ ID NO: 788117 - protein, 17 aa, Mycobacterium
AAVNNKKLAVRYHLLNF

SEQ ID NO: 788118 - protein, 19 aa, Mycobacterium
AAVNPWMLRMAGEVADGVH

SEQ ID NO: 788119 - protein, 24 aa, Mycobacterium
AAVNPWQWCRWLLIEPAELADTAT

SEQ ID NO: 788120 - protein, 22 aa, Mycobacterium
AAVNRFFNGNPVLSTVGGGIEA

SEQ ID NO: 788121 - protein, 22 aa, Mycobacterium
AAVPAAITLLSALGYDLVILET

SEQ ID NO: 788122 - protein, 25 aa, Mycobacterium
AAVPFPLTAWAVRALTRLPQRGVAM

SEQ ID NO: 788123 - protein, 17 aa, Mycobacterium
AAVPHPIDPILLGRTVL

SEQ ID NO: 788124 - protein, 23 aa, Mycobacterium
AAVPIVAAVRRHGVVRYAEVVSA

SEQ ID NO: 788125 - protein, 21 aa, Mycobacterium
AAVPNFRFLPALGQVLFRKDF

SEQ ID NO: 788126 - protein, 26 aa, Mycobacterium
AAVPNIRFLPALSKVLFRKDFPQEDF

SEQ ID NO: 788127 - protein, 28 aa, Mycobacterium
AAVPVMRVIAPHWALLTALARHASQTAV

SEQ ID NO: 788128 - protein, 21 aa, Mycobacterium
AAVQIGRRLAKLARTHQVIVV

SEQ ID NO: 788129 - protein, 23 aa, Mycobacterium
AAVQIISAAWINDAFTGSHTGIY

SEQ ID NO: 788130 - protein, 25 aa, Mycobacterium
AAVQYAPMGIRVNTLMLGPINSVLA

SEQ ID NO: 788131 - protein, 24 aa, Mycobacterium
AAVRDLYGPLIADGVPFLVTDLQT

SEQ ID NO: 788132 - protein, 25 aa, Mycobacterium
AAVRDSGHPVIWLCDPLHANTVSTD

SEQ ID NO: 788133 - protein, 17 aa, Mycobacterium
AAVRELLCAIGEDPDRH

SEQ ID NO: 788134 - protein, 22 aa, Mycobacterium
AAVRELLYAIGEDPDRHGLRET

SEQ ID NO: 788135 - protein, 18 aa, Mycobacterium
AAVRELLYAVGEDPDRHG

SEQ ID NO: 788136 - protein, 31 aa, Mycobacterium
AAVREPWRMALSQLWTADIDWTPDLAPVAAA

SEQ ID NO: 788137 - protein, 19 aa, Mycobacterium
AAVRIALAAVLKLADTTGL

SEQ ID NO: 788138 - protein, 27 aa, Mycobacterium
AAVRKLPIFGGPFRWDDLEWLRAETDL

SEQ ID NO: 788139 - protein, 27 aa, Mycobacterium
AAVRKLPIFGGPFRWDDLEWLRSETDL

SEQ ID NO: 788140 - protein, 27 aa, Mycobacterium
AAVRKLPIFGGPFRWDDLEWLRSQTDL

SEQ ID NO: 788141 - protein, 29 aa, Mycobacterium
AAVRLHTRAHLPYLVYLRNPTTGGVFASW

SEQ ID NO: 788142 - protein, 24 aa, Mycobacterium
AAVRNPWRMALSQLWSAGIDWTPD

SEQ ID NO: 788143 - protein, 22 aa, Mycobacterium
AAVRQFLTLDATRWQYVTGVAD

SEQ ID NO: 788144 - protein, 23 aa, Mycobacterium
AAVRQFLTLDATRWQYVTGVPDE

SEQ ID NO: 788145 - protein, 23 aa, Mycobacterium
AAVRQRFLGLGFTAEFADAYIAM

SEQ ID NO: 788146 - protein, 17 aa, Mycobacterium
AAVRRAATLLGVTCSSF

SEQ ID NO: 788147 - protein, 23 aa, Mycobacterium
AAVRRFGRMFVLGARLTVPVGMI

SEQ ID NO: 788148 - protein, 25 aa, Mycobacterium
AAVRRLAQRLALLAGRRLDEAQPWV

SEQ ID NO: 788149 - protein, 23 aa, Mycobacterium
AAVRRLFRHPKSGQLVAMESRSR

SEQ ID NO: 788150 - protein, 30 aa, Mycobacterium
AAVRSGLGIALLPMIGRLPDGLTVADTMPE

SEQ ID NO: 788151 - protein, 18 aa, Mycobacterium
AAVRTLVPVLLTGLHRHS

SEQ ID NO: 788152 - protein, 19 aa, Mycobacterium
AAVRWAAREATLRKIPVTV

SEQ ID NO: 788153 - protein, 21 aa, Mycobacterium
AAVSALLPGGLASSTAAVGGA

SEQ ID NO: 788154 - protein, 29 aa, Mycobacterium
AAVSHLIPALEILQDALATKALEWQSVVK

SEQ ID NO: 788155 - protein, 20 aa, Mycobacterium
AAVSPLLPAPLIQDRRTGEL

SEQ ID NO: 788156 - protein, 24 aa, Mycobacterium
AAVSTALYRLLGPGSETLGAEVPM

SEQ ID NO: 788157 - protein, 20 aa, Mycobacterium
AAVTATEWGLRGTRRAEVAA

SEQ ID NO: 788158 - protein, 26 aa, Mycobacterium
AAVTEGMWGIPWDKPVRRLNEYLDGL

SEQ ID NO: 788159 - protein, 18 aa, Mycobacterium
AAVTGGCSVILDGTWRDE

SEQ ID NO: 788160 - protein, 26 aa, Mycobacterium
AAVTGWLGRLPVAPRSARAAAALLNH

SEQ ID NO: 788161 - protein, 19 aa, Mycobacterium
AAVTIPVMAKARIGHFVEA

SEQ ID NO: 788162 - protein, 23 aa, Mycobacterium
AAVTISKLWDLFVGEDATLVEVN

SEQ ID NO: 788163 - protein, 21 aa, Mycobacterium
AAVTMDWLRQNGYQDLLGRSC

SEQ ID NO: 788164 - protein, 23 aa, Mycobacterium
AAVTSWLYRIVVNACLDRMRRNK

SEQ ID NO: 788165 - protein, 18 aa, Mycobacterium
AAVTVTEWGLRGTRSAEV

SEQ ID NO: 788166 - protein, 21 aa, Mycobacterium
AAVVAFASWPQQVVLRGTLAD

SEQ ID NO: 788167 - protein, 20 aa, Mycobacterium
AAVVALLHRELSGAGQFVDV

SEQ ID NO: 788168 - protein, 32 aa, Mycobacterium
AAVVELRRSRPYWGPRRLVFELAKRRVSPVPS

SEQ ID NO: 788169 - protein, 19 aa, Mycobacterium
AAVVGRFEAGGRRVEFTPL

SEQ ID NO: 788170 - protein, 17 aa, Mycobacterium
AAVWSMAAKLPPGWPML

SEQ ID NO: 788171 - protein, 24 aa, Mycobacterium
AAVYAMLYVLRRDHPVRIRFDNKT

SEQ ID NO: 788172 - protein, 26 aa, Mycobacterium
AAWADEVRRLLKLRGATLLAHNYQLP

SEQ ID NO: 788173 - protein, 24 aa, Mycobacterium
AAWDGLAIELYTTAASYGSLIAEL

SEQ ID NO: 788174 - protein, 19 aa, Mycobacterium
AAWDRRLARIKLIAESLSS

SEQ ID NO: 788175 - protein, 24 aa, Mycobacterium
AAWEDFLFWLASDRKTARRITRLI

SEQ ID NO: 788176 - protein, 19 aa, Mycobacterium
AAWFDVLKAERRKLRIRSG

SEQ ID NO: 788177 - protein, 17 aa, Mycobacterium
AAWFLDNEPGERPELAP

SEQ ID NO: 788178 - protein, 22 aa, Mycobacterium
AAWFTRPAGPGPYPLVVLAHGL

SEQ ID NO: 788179 - protein, 22 aa, Mycobacterium
AAWGLAETALTYNQIRALLDPL

SEQ ID NO: 788180 - protein, 20 aa, Mycobacterium
AAWIVNRLALRDTDTKHRLA

SEQ ID NO: 788181 - protein, 18 aa, Mycobacterium
AAWLLLSSEWVDADEAHR

SEQ ID NO: 788182 - protein, 20 aa, Mycobacterium
AAWLPLTRHADVSAGQSVLI

SEQ ID NO: 788183 - protein, 17 aa, Mycobacterium
AAWNLKTQIFEGDVLFL

SEQ ID NO: 788184 - protein, 17 aa, Mycobacterium
AAWPAIITPVQRDQVLA

SEQ ID NO: 788185 - protein, 17 aa, Mycobacterium
AAWPASYDASLRVSWRQ

SEQ ID NO: 788186 - protein, 17 aa, Mycobacterium
AAWPGAWQGQNLRDILV

SEQ ID NO: 788187 - protein, 18 aa, Mycobacterium
AAWPLGMVTEFAANAAEG

SEQ ID NO: 788188 - protein, 18 aa, Mycobacterium
AAWRERLAVEAATRSRRA

SEQ ID NO: 788189 - protein, 20 aa, Mycobacterium
AAWRGTWHGGLEFTKKCCAP

SEQ ID NO: 788190 - protein, 19 aa, Mycobacterium
AAWRNAPMLSPPGAAAAIQ

SEQ ID NO: 788191 - protein, 17 aa, Mycobacterium
AAWRTVFTDDFVSDTAE

SEQ ID NO: 788192 - protein, 18 aa, Mycobacterium
AAWSLGRLYWSDREGAAI

SEQ ID NO: 788193 - protein, 23 aa, Mycobacterium
AAWSLIHGFSMLWLNGVLPSDPG

SEQ ID NO: 788194 - protein, 32 aa, Mycobacterium
AAWTGHEGADARYLWPSMFARVADEYDRRYGL

SEQ ID NO: 788195 - protein, 27 aa, Mycobacterium
AAWTGHEGAEARYLWPSMFAEVADEYD

SEQ ID NO: 788196 - protein, 20 aa, Mycobacterium
AAWTLSDIPLLDELVDLLGR

SEQ ID NO: 788197 - protein, 17 aa, Mycobacterium
AAWTQIRDSDYARFIAD

SEQ ID NO: 788198 - protein, 17 aa, Mycobacterium
AAWTYEDPFPEVAPIAR

SEQ ID NO: 788199 - protein, 24 aa, Mycobacterium
AAYAAAMMGMRRAFEVGSLTVVDV

SEQ ID NO: 788200 - protein, 19 aa, Mycobacterium
AAYALYLTLRRDEPVRITY

SEQ ID NO: 788201 - protein, 23 aa, Mycobacterium
AAYAVMMALYHRDVHGGPGQLID

SEQ ID NO: 788202 - protein, 27 aa, Mycobacterium
AAYCLLHAWLQTPLTFAKWDAKPSGKL

SEQ ID NO: 788203 - protein, 24 aa, Mycobacterium
AAYDAIVGGPRYVYERRIASGSKL

SEQ ID NO: 788204 - protein, 20 aa, Mycobacterium
AAYDLFVRTLAVSAGSYAAT

SEQ ID NO: 788205 - protein, 18 aa, Mycobacterium
AAYDRLFAALDWVSDRLA

SEQ ID NO: 788206 - protein, 18 aa, Mycobacterium
AAYDRLFTALDWVSDRLS

SEQ ID NO: 788207 - protein, 23 aa, Mycobacterium
AAYDRLPAPLRALTENLWAVHTN

SEQ ID NO: 788208 - protein, 30 aa, Mycobacterium
AAYEAAFAMTVPPPVIAANRAQLMALVATN

SEQ ID NO: 788209 - protein, 40 aa, Mycobacterium
AAYEAAFGATVPPALVTANRTLLAQLVASNLLGQNTAMIG

SEQ ID NO: 788210 - protein, 30 aa, Mycobacterium
AAYEPDIWWDTFRLPPYGRYTLRTYFRPDV

SEQ ID NO: 788211 - protein, 24 aa, Mycobacterium
AAYGARFAGVAFPGETLKVGIWKE

SEQ ID NO: 788212 - protein, 24 aa, Mycobacterium
AAYHAMSYGWLLAGLGRAITGQDM

SEQ ID NO: 788213 - protein, 28 aa, Mycobacterium
AAYHKLLVWDMMSQPWLTRTAEAALNPL

SEQ ID NO: 788214 - protein, 17 aa, Mycobacterium
AAYIAGDLAYYLDKRKR

SEQ ID NO: 788215 - protein, 25 aa, Mycobacterium
AAYKYPRRIWFVDELPKGPTGKILK

SEQ ID NO: 788216 - protein, 18 aa, Mycobacterium
AAYLAFGSTPCAMDEPPA

SEQ ID NO: 788217 - protein, 21 aa, Mycobacterium
AAYLAGFAWGLSRDYSVLVEM

SEQ ID NO: 788218 - protein, 25 aa, Mycobacterium
AAYLKSLPDAPLLVIKDLQIVVLWE

SEQ ID NO: 788219 - protein, 20 aa, Mycobacterium
AAYLRSVLDRIPGAVILAAH

SEQ ID NO: 788220 - protein, 26 aa, Mycobacterium
AAYNATKWGIIGLIKSVALEVAKEGI

SEQ ID NO: 788221 - protein, 30 aa, Mycobacterium
AAYNPLRLLRSLRAFRRSPLFSPDAVQRFR

SEQ ID NO: 788222 - protein, 20 aa, Mycobacterium
AAYPFVVLDRDHTLRRIVDA

SEQ ID NO: 788223 - protein, 27 aa, Mycobacterium
AAYPLGKNFRPKVWPPVRRIDGAYGDR

SEQ ID NO: 788224 - protein, 20 aa, Mycobacterium
AAYPVAWPAVGVASSVTAPV

SEQ ID NO: 788225 - protein, 18 aa, Mycobacterium
AAYQDFLTEIGYLVPEPE

SEQ ID NO: 788226 - protein, 24 aa, Mycobacterium
AAYQGLPMPLLFVCEDNGIGISTR

SEQ ID NO: 788227 - protein, 25 aa, Mycobacterium
AAYRAYTTFLLGQLLLEVHAHGAEL

SEQ ID NO: 788228 - protein, 17 aa, Mycobacterium
AAYRDAWADPASPPRVQ

SEQ ID NO: 788229 - protein, 26 aa, Mycobacterium
AAYRDGRIHRIWETTWPSWRNVAALE

SEQ ID NO: 788230 - protein, 27 aa, Mycobacterium
AAYRDGRIHRIWETTWPSWRNVAALED

SEQ ID NO: 788231 - protein, 24 aa, Mycobacterium
AAYRDVHGFYYPSGRTKEMFKSGG

SEQ ID NO: 788232 - protein, 17 aa, Mycobacterium
AAYRRYIDHFAIQTERG

SEQ ID NO: 788233 - protein, 18 aa, Mycobacterium
AAYRVGLHQLQREDSPRY

SEQ ID NO: 788234 - protein, 19 aa, Mycobacterium
AAYSVLLHRYTHANDFIVA

SEQ ID NO: 788235 - protein, 33 aa, Mycobacterium
AAYTAISTLLLLYFPFRARRFFYDVDNRRFTSS

SEQ ID NO: 788236 - protein, 21 aa, Mycobacterium
AAYTFDLQWRLSGTPEVAPPL

SEQ ID NO: 788237 - protein, 24 aa, Mycobacterium
AAYTGIDPYFDDLFLMAAEQRFLS

SEQ ID NO: 788238 - protein, 17 aa, Mycobacterium
AAYTGIDPYFDDLLLMS

SEQ ID NO: 788239 - protein, 28 aa, Mycobacterium
AAYVAVKEPWFLDAYRRAWEWADATGWR

SEQ ID NO: 788240 - protein, 18 aa, Mycobacterium
ACAGACGTSILSLPGDRA

SEQ ID NO: 788241 - protein, 17 aa, Mycobacterium
ACAILRRSWPHTRNAFA

SEQ ID NO: 788242 - protein, 21 aa, Mycobacterium
ACALLVHRWCGGGSWVMVLLP

SEQ ID NO: 788243 - protein, 21 aa, Mycobacterium
ACAPVYSHLLYDIVPGEKQII

SEQ ID NO: 788244 - protein, 24 aa, Mycobacterium
ACASARVSAQPWSPCVETSFPVAD

SEQ ID NO: 788245 - protein, 29 aa, Mycobacterium
ACASAWLDGLVAWRRAAGLPAATINWGPW

SEQ ID NO: 788246 - protein, 21 aa, Mycobacterium
ACCRRLRLGSHRPFSQDPAAH

SEQ ID NO: 788247 - protein, 38 aa, Mycobacterium
ACDGIPGSAWIYPGAIPLAPVYRWPDLAGIAVATTAPR

SEQ ID NO: 788248 - protein, 22 aa, Mycobacterium
ACDHHPGPELLWGAVLGTSAVA

SEQ ID NO: 788249 - protein, 18 aa, Mycobacterium
ACDTLGLVFRRPPEYQIL

SEQ ID NO: 788250 - protein, 27 aa, Mycobacterium
ACDVESYVYMPLLEELGYIPTEKYAKG

SEQ ID NO: 788251 - protein, 26 aa, Mycobacterium
ACDVESYVYMPLLEELGYVPSEKYAK

SEQ ID NO: 788252 - protein, 17 aa, Mycobacterium
ACDWITDGSWHSQTLSP

SEQ ID NO: 788253 - protein, 19 aa, Mycobacterium
ACDYAKIREQYGKAIGSHQ

SEQ ID NO: 788254 - protein, 26 aa, Mycobacterium
ACELADFWRFNVQFARQILAEQPNSG

SEQ ID NO: 788255 - protein, 28 aa, Mycobacterium
ACERDGIAFVPYFPLATGGLGDDDELRR

SEQ ID NO: 788256 - protein, 42 aa, Mycobacterium
ACFEAQAEAYQTFGAHTAALHDQIVRALTAGAGGYSAVEAAN

SEQ ID NO: 788257 - protein, 18 aa, Mycobacterium
ACFGYHMGVLGPGEVCVT

SEQ ID NO: 788258 - protein, 18 aa, Mycobacterium
ACFRRYHLGRNGAAHGGA

SEQ ID NO: 788259 - protein, 31 aa, Mycobacterium
ACGFDTPYPPARLEKWWLPGPDRLLDCVERA

SEQ ID NO: 788260 - protein, 31 aa, Mycobacterium
ACGFDTPYPPARLERLWLPGPDRLLDCVERV

SEQ ID NO: 788261 - protein, 18 aa, Mycobacterium
ACGGQLPVGLRGLVANVH

SEQ ID NO: 788262 - protein, 23 aa, Mycobacterium
ACGIEAAYRQPPPVRRDRIPINA

SEQ ID NO: 788263 - protein, 18 aa, Mycobacterium
ACGRIEGLERIRFTSPHP

SEQ ID NO: 788264 - protein, 24 aa, Mycobacterium
ACGRRMIVQVRPDGWWAKCSRHGL

SEQ ID NO: 788265 - protein, 18 aa, Mycobacterium
ACHGFDSLLPEWPGSQRL

SEQ ID NO: 788266 - protein, 20 aa, Mycobacterium
ACILCECNCGIVVQTEGRTL

SEQ ID NO: 788267 - protein, 20 aa, Mycobacterium
ACILCECNCGIVVQVEDRRL

SEQ ID NO: 788268 - protein, 24 aa, Mycobacterium
ACIVDLPTALLLRRNRIDDPDARK

SEQ ID NO: 788269 - protein, 26 aa, Mycobacterium
ACKGSRSPTWRWRASHCRSPPMRGRI

SEQ ID NO: 788270 - protein, 20 aa, Mycobacterium
ACLAGWLGGLAPIPDFNPLA

SEQ ID NO: 788271 - protein, 18 aa, Mycobacterium
ACLAIGPAAELLTPGLHG

SEQ ID NO: 788272 - protein, 29 aa, Mycobacterium
ACLDKYARLYAWLGLWERRTDLAVIPADG

SEQ ID NO: 788273 - protein, 25 aa, Mycobacterium
ACLEHPTWWGGLVDLPVSPAPQDFN

SEQ ID NO: 788274 - protein, 31 aa, Mycobacterium
ACLGDPLIALAWLARTTRKLGRPLRAGQIVL

SEQ ID NO: 788275 - protein, 20 aa, Mycobacterium
ACLHAFPRRELTDAEVVDAG

SEQ ID NO: 788276 - protein, 21 aa, Mycobacterium
ACLRALVRHRLAVAHPGYDSE

SEQ ID NO: 788277 - protein, 19 aa, Mycobacterium
ACLRSLGALGLLDTEVLLP

SEQ ID NO: 788278 - protein, 17 aa, Mycobacterium
ACMALHDPKYTFNVDKP

SEQ ID NO: 788279 - protein, 18 aa, Mycobacterium
ACMDARLDVYRLLGINEG

SEQ ID NO: 788280 - protein, 19 aa, Mycobacterium
ACMDFATTAELLAKLYAAM

SEQ ID NO: 788281 - protein, 23 aa, Mycobacterium
ACMNIVLLRADAPWERLNVADTV

SEQ ID NO: 788282 - protein, 27 aa, Mycobacterium
ACNDPEILHYLPLPVPYTVGDARSFIA

SEQ ID NO: 788283 - protein, 24 aa, Mycobacterium
ACPCVVAARRRSCRRDGSCHPFSS

SEQ ID NO: 788284 - protein, 26 aa, Mycobacterium
ACPDCGPSLWFRSAAGWVRGSDAALA

SEQ ID NO: 788285 - protein, 24 aa, Mycobacterium
ACPGPGCVLYFLTDGRREWCSKPC

SEQ ID NO: 788286 - protein, 18 aa, Mycobacterium
ACPLIAGCRLRHALARAK

SEQ ID NO: 788287 - protein, 25 aa, Mycobacterium
ACPNARDLIFRPPGNTWEQARKHSR

SEQ ID NO: 788288 - protein, 20 aa, Mycobacterium
ACPNCGPSLWFRSATEHVAG

SEQ ID NO: 788289 - protein, 24 aa, Mycobacterium
ACPQVLVRIGLAPALDEVPPPTPR

SEQ ID NO: 788290 - protein, 24 aa, Mycobacterium
ACPRFGQRLRLHPLDLGAPEWVDD

SEQ ID NO: 788291 - protein, 30 aa, Mycobacterium
ACPWANRTLIVRRLLGLEDVLSLGLCGPTH

SEQ ID NO: 788292 - protein, 28 aa, Mycobacterium
ACQSLAQFLDPDTLRYLRDFRFGGDIDG

SEQ ID NO: 788293 - protein, 20 aa, Mycobacterium
ACRALLFENPSPAAALAGLD

SEQ ID NO: 788294 - protein, 19 aa, Mycobacterium
ACRALLFENPSPGAALAGM

SEQ ID NO: 788295 - protein, 28 aa, Mycobacterium
ACRKHHLLKTFWTAWKDVQLPDGTVIWT

SEQ ID NO: 788296 - protein, 19 aa, Mycobacterium
ACRTAFFDTFFLEATRSGI

SEQ ID NO: 788297 - protein, 19 aa, Mycobacterium
ACRTKFFDDYFLAAAGEGI

SEQ ID NO: 788298 - protein, 18 aa, Mycobacterium
ACRTRFYDQFFLDATRGG

SEQ ID NO: 788299 - protein, 28 aa, Mycobacterium
ACSAALRPRYLMMLAEILRFHRAASRLL

SEQ ID NO: 788300 - protein, 17 aa, Mycobacterium
ACSGGVDSLLLATVAHR

SEQ ID NO: 788301 - protein, 19 aa, Mycobacterium
ACSRWGMLSPEGQCKTFDV

SEQ ID NO: 788302 - protein, 23 aa, Mycobacterium
ACSVGTIRCWFGVGCNATVPVVR

SEQ ID NO: 788303 - protein, 24 aa, Mycobacterium
ACTAANPLFIPETGKFTGTRVTVL

SEQ ID NO: 788304 - protein, 23 aa, Mycobacterium
ACTFYVETWNYAHYPRALESILE

SEQ ID NO: 788305 - protein, 18 aa, Mycobacterium
ACTLPPPGWVCSREAGHA

SEQ ID NO: 788306 - protein, 25 aa, Mycobacterium
ACTLRNWLGMWSLREAQTRAEPHLA

SEQ ID NO: 788307 - protein, 26 aa, Mycobacterium
ACTLRNWLGMWSLRVAQTRAAPHLAR

SEQ ID NO: 788308 - protein, 25 aa, Mycobacterium
ACTLRSWLGMWSLRVAQTRADPHLA

SEQ ID NO: 788309 - protein, 21 aa, Mycobacterium
ACTNLLLAMGVLDITVLDSRG

SEQ ID NO: 788310 - protein, 27 aa, Mycobacterium
ACTRRRLPLLIAPPNVLFATVSRYVAD

SEQ ID NO: 788311 - protein, 20 aa, Mycobacterium
ACTVWSNVVLIAGLSRGQLL

SEQ ID NO: 788312 - protein, 20 aa, Mycobacterium
ACVDGKWRFSYRDLTLIDMV

SEQ ID NO: 788313 - protein, 24 aa, Mycobacterium
ACVELTFAAASLGAATAIVNCRLA

SEQ ID NO: 788314 - protein, 25 aa, Mycobacterium
ACVLYACAQLPDLAGRHVAVIGQGS

SEQ ID NO: 788315 - protein, 21 aa, Mycobacterium
ACWLAPLLQDGAKLPFESLLE

SEQ ID NO: 788316 - protein, 25 aa, Mycobacterium
ACYQEGVLRLVIPVAERAKPRKISV

SEQ ID NO: 788317 - protein, 19 aa, Mycobacterium
ADAAAAVPALRTAAACAAA

SEQ ID NO: 788318 - protein, 20 aa, Mycobacterium
ADAADALALAICHCWRAPML

SEQ ID NO: 788319 - protein, 36 aa, Mycobacterium
ADAADWLYSQRFVATRYRGIAKDTWHPLAQALSDLP

SEQ ID NO: 788320 - protein, 21 aa, Mycobacterium
ADAAELLIRLGLEAAQNQVHA

SEQ ID NO: 788321 - protein, 29 aa, Mycobacterium
ADAAERILPVLMRLFQIKSGSPEAALISD

SEQ ID NO: 788322 - protein, 24 aa, Mycobacterium
ADAAGYFVLPTVVTDLPPDSALAT

SEQ ID NO: 788323 - protein, 19 aa, Mycobacterium
ADAALAAGLCGLRWVGAVG

SEQ ID NO: 788324 - protein, 17 aa, Mycobacterium
ADAALLRVDSRNQVLVA

SEQ ID NO: 788325 - protein, 17 aa, Mycobacterium
ADAALVFYLTKADPLLV

SEQ ID NO: 788326 - protein, 23 aa, Mycobacterium
ADAAPRIELVGVRKVFGDGRREV

SEQ ID NO: 788327 - protein, 33 aa, Mycobacterium
ADAARPTPPWPTPKYRWPDSPPSTPISSAFCRP

SEQ ID NO: 788328 - protein, 24 aa, Mycobacterium
ADAASPCILIRRGHRSRLVGAAFT

SEQ ID NO: 788329 - protein, 22 aa, Mycobacterium
ADACCYNPLWPNIDELVRLLES

SEQ ID NO: 788330 - protein, 27 aa, Mycobacterium
ADADELPPLLRSFAAAPPLVSDIDLSV

SEQ ID NO: 788331 - protein, 29 aa, Mycobacterium
ADADLQHWRWMWETNVLGTLRVTRALLPK

SEQ ID NO: 788332 - protein, 25 aa, Mycobacterium
ADADTAIHAILLTGAGPAFCSGGDI

SEQ ID NO: 788333 - protein, 33 aa, Mycobacterium
ADADVCHEAFRAEWLLSFLAADVRRDGPHDLDA

SEQ ID NO: 788334 - protein, 28 aa, Mycobacterium
ADAEERYRFRFPRQQRGRFLCIADFVRS

SEQ ID NO: 788335 - protein, 23 aa, Mycobacterium
ADAEILFQDIPLDKISTSFTING

SEQ ID NO: 788336 - protein, 27 aa, Mycobacterium
ADAFDADFFAAWGKLAAVRTPTIAAVA

SEQ ID NO: 788337 - protein, 25 aa, Mycobacterium
ADAFGADFFAPWGRLAEVRTPTIAA

SEQ ID NO: 788338 - protein, 29 aa, Mycobacterium
ADAGAAFSRGLWWSALRATDWAAADRQRL

SEQ ID NO: 788339 - protein, 25 aa, Mycobacterium
ADAGLLAPHWPPPYGRGASAAEQLL

SEQ ID NO: 788340 - protein, 21 aa, Mycobacterium
ADAGLPRLRPWRDALAEALAT

SEQ ID NO: 788341 - protein, 24 aa, Mycobacterium
ADAGLVFQGWFQKTPYYPHDFFVP

SEQ ID NO: 788342 - protein, 30 aa, Mycobacterium
ADAGRPWWEWAATFERAFSAAYDALGVLPP

SEQ ID NO: 788343 - protein, 24 aa, Mycobacterium
ADAGRPWWEWAATYERAFDEAYES

SEQ ID NO: 788344 - protein, 26 aa, Mycobacterium
ADAGVPWVLMHWRSVAADRPHAAPHY

SEQ ID NO: 788345 - protein, 25 aa, Mycobacterium
ADAHLGRALRWRRYAHTPMNALHQQ

SEQ ID NO: 788346 - protein, 18 aa, Mycobacterium
ADAILARRTDRLPMSAYV

SEQ ID NO: 788347 - protein, 20 aa, Mycobacterium
ADAILVRRTDRLPLSAPRDW

SEQ ID NO: 788348 - protein, 25 aa, Mycobacterium
ADAKITVPALFLAGAADPVLGFARP

SEQ ID NO: 788349 - protein, 23 aa, Mycobacterium
ADAKLIIASAYLPQHEDARAADV

SEQ ID NO: 788350 - protein, 31 aa, Mycobacterium
ADALELIKVHRPAVALLDYRMPQLDGAQVAA

SEQ ID NO: 788351 - protein, 28 aa, Mycobacterium
ADALGRLMRALIGIGVFRRGSDGRYALT

SEQ ID NO: 788352 - protein, 26 aa, Mycobacterium
ADALMAVPVMLARILDLPQAVRARNP

SEQ ID NO: 788353 - protein, 20 aa, Mycobacterium
ADALPALDPALRKVMAGFFE

SEQ ID NO: 788354 - protein, 18 aa, Mycobacterium
ADALPFSDNAFDGAWCLG

SEQ ID NO: 788355 - protein, 24 aa, Mycobacterium
ADALPRRPQFALLKGRRNYLCLNK

SEQ ID NO: 788356 - protein, 25 aa, Mycobacterium
ADALRWRASTLDLARERAALLDLKG

SEQ ID NO: 788357 - protein, 18 aa, Mycobacterium
ADALRYPVKLIDEYPWET

SEQ ID NO: 788358 - protein, 35 aa, Mycobacterium
ADALSRLLRALIGRGIFRRCRDGRYALTPLADALR

SEQ ID NO: 788359 - protein, 22 aa, Mycobacterium
ADALTVLWHSITWQYLPDEERD

SEQ ID NO: 788360 - protein, 20 aa, Mycobacterium
ADALVDYPYAYLITVDDEYR

SEQ ID NO: 788361 - protein, 19 aa, Mycobacterium
ADALVPNAGLRRLTLSGIR

SEQ ID NO: 788362 - protein, 25 aa, Mycobacterium
ADALVSWADPIYLAGRHPLEVLLEN

SEQ ID NO: 788363 - protein, 24 aa, Mycobacterium
ADAMFPARAFDALVALVVGAAAKN

SEQ ID NO: 788364 - protein, 27 aa, Mycobacterium
ADAMPYAPGVYLFRGPSGEVLYVGTAV

SEQ ID NO: 788365 - protein, 27 aa, Mycobacterium
ADAMVASVLPFVSWLSTTAALAEQAAI

SEQ ID NO: 788366 - protein, 25 aa, Mycobacterium
ADANGLPVMVWLHGGAYVSGSGESR

SEQ ID NO: 788367 - protein, 24 aa, Mycobacterium
ADAPDRLRWVIAQAIGTIEDGIGI

SEQ ID NO: 788368 - protein, 20 aa, Mycobacterium
ADAPFLLEWGNHGAALLDIG

SEQ ID NO: 788369 - protein, 18 aa, Mycobacterium
ADAPLLDGYPREGRTVLF

SEQ ID NO: 788370 - protein, 25 aa, Mycobacterium
ADAPLTLVFVHGFCLQMGAFHFQRT

SEQ ID NO: 788371 - protein, 25 aa, Mycobacterium
ADAPSRRRIAFYRSLLGEVDDPSGD

SEQ ID NO: 788372 - protein, 23 aa, Mycobacterium
ADAPVLVTVCRAAAALLGGSASD

SEQ ID NO: 788373 - protein, 26 aa, Mycobacterium
ADAPWMPWNIEFIRRINGLDSVDEVH

SEQ ID NO: 788374 - protein, 25 aa, Mycobacterium
ADAQLAPAVVPWPKVLRAAVRRAVE

SEQ ID NO: 788375 - protein, 30 aa, Mycobacterium
ADARGPAHISYFDPAPLLTAIDPGRADVGQ

SEQ ID NO: 788376 - protein, 20 aa, Mycobacterium
ADARLLAGRRRLAAAIAGGT

SEQ ID NO: 788377 - protein, 22 aa, Mycobacterium
ADARLREGMATLRGLLAGVGAD

SEQ ID NO: 788378 - protein, 26 aa, Mycobacterium
ADARRFWYDEYLVNAYIGNYPKPYVA

SEQ ID NO: 788379 - protein, 25 aa, Mycobacterium
ADASALYRVGYAYAPFHCPDCAASY

SEQ ID NO: 788380 - protein, 29 aa, Mycobacterium
ADATAAVCLPHDWLGWRLTGSNDLADLRT

SEQ ID NO: 788381 - protein, 26 aa, Mycobacterium
ADATDLPVLLYDIPPRSVIPIETETI

SEQ ID NO: 788382 - protein, 23 aa, Mycobacterium
ADATRVQVLWSLTDRELSVNELA

SEQ ID NO: 788383 - protein, 23 aa, Mycobacterium
ADATWFTAVPTIHQILLQRPDEE

SEQ ID NO: 788384 - protein, 24 aa, Mycobacterium
ADAVAYLVNVTVRPGYNFPDAATA

SEQ ID NO: 788385 - protein, 17 aa, Mycobacterium
ADAVLTGAALLASEQLG

SEQ ID NO: 788386 - protein, 22 aa, Mycobacterium
ADAVMILPVSYWKLNEHEIFQH

SEQ ID NO: 788387 - protein, 24 aa, Mycobacterium
ADAVMILPVSYWKLSEREIVAHYR

SEQ ID NO: 788388 - protein, 24 aa, Mycobacterium
ADAVMILPVSYWKLTEREIAQHYR

SEQ ID NO: 788389 - protein, 25 aa, Mycobacterium
ADAVMILPVSYWKLTEREIFQHYRS

SEQ ID NO: 788390 - protein, 24 aa, Mycobacterium
ADAWPKWNAWLEGIADVMGPLLTQ

SEQ ID NO: 788391 - protein, 23 aa, Mycobacterium
ADAYALAHLGAVDAALAAGEAVL

SEQ ID NO: 788392 - protein, 23 aa, Mycobacterium
ADAYIAMLAATLDAPALVTHDVE

SEQ ID NO: 788393 - protein, 22 aa, Mycobacterium
ADAYQQTVARLRRAWIACESHG

SEQ ID NO: 788394 - protein, 27 aa, Mycobacterium
ADAYQRHFFPIYAASAKLQSWTIFATV

SEQ ID NO: 788395 - protein, 23 aa, Mycobacterium
ADAYSLAHLGAVDAALAAGDAIL

SEQ ID NO: 788396 - protein, 20 aa, Mycobacterium
ADAYYFAPQKNFAGDGGLWL

SEQ ID NO: 788397 - protein, 29 aa, Mycobacterium
ADCPIPDPLDLLAFLAGRTTTLGLATGVL

SEQ ID NO: 788398 - protein, 27 aa, Mycobacterium
ADCPIPDPLDLLGFLAGRTTRLGLATG

SEQ ID NO: 788399 - protein, 17 aa, Mycobacterium
ADCPLQRACLNAALERQ

SEQ ID NO: 788400 - protein, 41 aa, Mycobacterium
ADCYDYIGHVLFTWNMPELWRRFTITLRRTLRRELRALGAD

SEQ ID NO: 788401 - protein, 30 aa, Mycobacterium
ADDADFAAHPFLKKGYIGPKALLANGVRYL

SEQ ID NO: 788402 - protein, 27 aa, Mycobacterium
ADDDKGLWLSIIDKLGLPFTDVFLAEE

SEQ ID NO: 788403 - protein, 18 aa, Mycobacterium
ADDDLRLQLLGHARKRLG

SEQ ID NO: 788404 - protein, 26 aa, Mycobacterium
ADDDPLPPIIKLFDDAGYIGVVATNC

SEQ ID NO: 788405 - protein, 18 aa, Mycobacterium
ADDDPNAPARSQTYRDIP

SEQ ID NO: 788406 - protein, 25 aa, Mycobacterium
ADDDQFMTIAKFRAARNLWARVAEV

SEQ ID NO: 788407 - protein, 26 aa, Mycobacterium
ADDDQFMTLAKMRAARRLWARVAEVA

SEQ ID NO: 788408 - protein, 25 aa, Mycobacterium
ADDDRLVGQLYFPSRPGITNEDLGF

SEQ ID NO: 788409 - protein, 30 aa, Mycobacterium
ADDDRPFFAYLPFQAPHWPLQAPDESVAKY

SEQ ID NO: 788410 - protein, 32 aa, Mycobacterium
ADDDYFLKRLRNYGSLFLGRWSTVAYSDKGIA

SEQ ID NO: 788411 - protein, 25 aa, Mycobacterium
ADDEQLVLDLLLSEKILVTQGTGFN

SEQ ID NO: 788412 - protein, 24 aa, Mycobacterium
ADDFAPFMMVISLAGEISVRRSAI

SEQ ID NO: 788413 - protein, 24 aa, Mycobacterium
ADDFDIYVLDFPGYGLSGKPPHPY

SEQ ID NO: 788414 - protein, 17 aa, Mycobacterium
ADDFYFDAFLQVHMPTL

SEQ ID NO: 788415 - protein, 18 aa, Mycobacterium
ADDGFVYRFRHDERDLGD

SEQ ID NO: 788416 - protein, 24 aa, Mycobacterium
ADDGRIGIIPLVETAAGILNAPSL

SEQ ID NO: 788417 - protein, 23 aa, Mycobacterium
ADDGYGILFCDIEHFKSINDRHG

SEQ ID NO: 788418 - protein, 24 aa, Mycobacterium
ADDHALRLLNLRRAARSVEGAGPG

SEQ ID NO: 788419 - protein, 29 aa, Mycobacterium
ADDHSDFIAYLNLWRYLQDQRSQLSGSAF

SEQ ID NO: 788420 - protein, 21 aa, Mycobacterium
ADDIAHRRIAITGVNEFPNLD

SEQ ID NO: 788421 - protein, 23 aa, Mycobacterium
ADDIRLRRMAVFDVLINNADRKG

SEQ ID NO: 788422 - protein, 19 aa, Mycobacterium
ADDIYLLYTGGTTGFPKGV

SEQ ID NO: 788423 - protein, 27 aa, Mycobacterium
ADDKLAIAQGFLLPRQRERAALTSDEV

SEQ ID NO: 788424 - protein, 20 aa, Mycobacterium
ADDKTLFREFGFTPDAVAAA

SEQ ID NO: 788425 - protein, 24 aa, Mycobacterium
ADDKTLFREFGFTPEAVVAAAERT

SEQ ID NO: 788426 - protein, 17 aa, Mycobacterium
ADDLARFHDLKGGLVLL

SEQ ID NO: 788427 - protein, 30 aa, Mycobacterium; identical to SEQ ID NO: 118818

SEQ ID NO: 788428 - protein, 31 aa, Mycobacterium
ADDLLTATLLTARCPVLFAPAMHTEMWLHPA

SEQ ID NO: 788429 - protein, 24 aa, Mycobacterium
ADDLLTATLLTARCPVLYAPAMHT

SEQ ID NO: 788430 - protein, 19 aa, Mycobacterium
ADDLPYWVRVPAPGGVADH

SEQ ID NO: 788431 - protein, 17 aa, Mycobacterium
ADDLVVMGLAWRNEIDG

SEQ ID NO: 788432 - protein, 23 aa, Mycobacterium
ADDLYTLNCEEPVWAQGRVELNY

SEQ ID NO: 788433 - protein, 24 aa, Mycobacterium
ADDPGRHLLLLTGTPHSGDDTAWQ

SEQ ID NO: 788434 - protein, 19 aa, Mycobacterium
ADDPRIGRLLFSAKLSNEV

SEQ ID NO: 788435 - protein, 27 aa, Mycobacterium
ADDPVPVRVLYLGRGLAKATLFGPAEV

SEQ ID NO: 788436 - protein, 26 aa, Mycobacterium
ADDPVPVRVLYLGRGLSKATLFGPAE

SEQ ID NO: 788437 - protein, 26 aa, Mycobacterium
ADDPVPVRVLYLGRGLSKATLFGPSE

SEQ ID NO: 788438 - protein, 26 aa, Mycobacterium
ADDQDLFLRIAPLALGTPVGPEYAGL

SEQ ID NO: 788439 - protein, 27 aa, Mycobacterium
ADDRAYKPLNWMSPPCWLTETEGEGGD

SEQ ID NO: 788440 - protein, 22 aa, Mycobacterium
ADDRGRLVAAFRKVAQAVLTGP

SEQ ID NO: 788441 - protein, 23 aa, Mycobacterium
ADDRIPAYRLSASAKLPGRRGLS

SEQ ID NO: 788442 - protein, 18 aa, Mycobacterium
ADDRLLPALQTSLTGSVA

SEQ ID NO: 788443 - protein, 23 aa, Mycobacterium
ADDRRFLFYPAVKELTLDIASVV

SEQ ID NO: 788444 - protein, 25 aa, Mycobacterium
ADDRSEYIYRFAPLVGIYGGTLEVF

SEQ ID NO: 788445 - protein, 25 aa, Mycobacterium
ADDRYISFVMMQPTKFWADVCKHMD

SEQ ID NO: 788446 - protein, 23 aa, Mycobacterium
ADDTRYHYAGLVLVVDAVESTRA

SEQ ID NO: 788447 - protein, 24 aa, Mycobacterium
ADDVELELGWGRLIFGQTFADPEK

SEQ ID NO: 788448 - protein, 17 aa, Mycobacterium
ADDVGYPVLIKPSAGGG

SEQ ID NO: 788449 - protein, 34 aa, Mycobacterium
ADDVLVHGLPLFHVHGLVLGLLGSLRVGNRFVHT

SEQ ID NO: 788450 - protein, 24 aa, Mycobacterium
ADDVQAALFLMPSGELYAVGNIDP

SEQ ID NO: 788451 - protein, 23 aa, Mycobacterium
ADDVRKQWGELKPLIFCDGYGST

SEQ ID NO: 788452 - protein, 24 aa, Mycobacterium
ADDVRLRRMAVFDVLINNADRKGG

SEQ ID NO: 788453 - protein, 24 aa, Mycobacterium
ADDVRNIAFPKPPVFQRGYSEDEV

SEQ ID NO: 788454 - protein, 24 aa, Mycobacterium
ADDVVLELGWGRLIFGQTFADPER

SEQ ID NO: 788455 - protein, 26 aa, Mycobacterium
ADDWDAQLMFFLGHGYRVVAHDRRGH

SEQ ID NO: 788456 - protein, 20 aa, Mycobacterium
ADDYLRFVRMLLGDGTIDGV

SEQ ID NO: 788457 - protein, 24 aa, Mycobacterium
ADDYPNFSICGIPYYVSGEVTHWS

SEQ ID NO: 788458 - protein, 26 aa, Mycobacterium
ADDYWNHYQLTFALYSVSDRAIPSAY

SEQ ID NO: 788459 - protein, 33 aa, Mycobacterium
ADEALIVEFDAHDGLWMFTNMGVFFNSMDYVYR

SEQ ID NO: 788460 - protein, 24 aa, Mycobacterium
ADEALRMGLVWRVCDPEDLLPEAR

SEQ ID NO: 788461 - protein, 23 aa, Mycobacterium
ADEARLVRWWGPNGFTSTFQSFA

SEQ ID NO: 788462 - protein, 24 aa, Mycobacterium
ADEDSLQLLGWTEATATPQVEVAL

SEQ ID NO: 788463 - protein, 32 aa, Mycobacterium
ADEEGLELYFRRAGAWLALLHCLAATDMHHEN

SEQ ID NO: 788464 - protein, 24 aa, Mycobacterium
ADEERIVWLAEPLVAAKDLPDEPT

SEQ ID NO: 788465 - protein, 25 aa, Mycobacterium
ADEERIVWLAEPLVAEDLPDGFPDA

SEQ ID NO: 788466 - protein, 22 aa, Mycobacterium
ADEERIVWLAEPLVAEDLPDGI

SEQ ID NO: 788467 - protein, 20 aa, Mycobacterium
ADEERIVWLAEPLVAEDLPE

SEQ ID NO: 788468 - protein, 23 aa, Mycobacterium
ADEERIVWLAEPLVAENLPDGHP

SEQ ID NO: 788469 - protein, 17 aa, Mycobacterium
ADEFNAVLLEFLEQDFA

SEQ ID NO: 788470 - protein, 27 aa, Mycobacterium
ADEFPDGVWLFELAAVSDPAAVPDAVA

SEQ ID NO: 788471 - protein, 24 aa, Mycobacterium
ADEFVLLLVVHHICWDDDSWKIFF

SEQ ID NO: 788472 - protein, 34 aa, Mycobacterium
ADEFWDEIFRELSIPYLPVRWRPDNPDSIVDKNA

SEQ ID NO: 788473 - protein, 28 aa, Mycobacterium
ADEGAETVLPFSWQGVCLHAAGASRVRV

SEQ ID NO: 788474 - protein, 24 aa, Mycobacterium
ADEGLCALGLRFSQDWMAPGERFS

SEQ ID NO: 788475 - protein, 22 aa, Mycobacterium
ADEGRLFTRFLKLLPTNEQAIE

SEQ ID NO: 788476 - protein, 24 aa, Mycobacterium
ADEHAQLWRVASLVKAAVPVGLST

SEQ ID NO: 788477 - protein, 21 aa, Mycobacterium
ADEHGLPLWQKLMIYTSESAR

SEQ ID NO: 788478 - protein, 29 aa, Mycobacterium
ADEHSDFISYLNLWNYLREQRNELSGNAF

SEQ ID NO: 788479 - protein, 29 aa, Mycobacterium
ADEICLQMHLLYLSFAIAVGKRAGADTEL

SEQ ID NO: 788480 - protein, 23 aa, Mycobacterium
ADEIGLLVFVTSTGFVAPGVDVA

SEQ ID NO: 788481 - protein, 24 aa, Mycobacterium
ADEIIMEKSLTWLTARNAQRSITE

SEQ ID NO: 788482 - protein, 26 aa, Mycobacterium
ADEIRLANPPLLLATRRLIGDDGTYV

SEQ ID NO: 788483 - protein, 18 aa, Mycobacterium
ADEIVVIAHLARQRARSA

SEQ ID NO: 788484 - protein, 23 aa, Mycobacterium
ADEKPLLCIVDDAQWLDSVSVQT

SEQ ID NO: 788485 - protein, 18 aa, Mycobacterium
ADELALPDFSVPAPRNSA

SEQ ID NO: 788486 - protein, 24 aa, Mycobacterium
ADELGLPALLLDRTLRLDVGAKPT

SEQ ID NO: 788487 - protein, 27 aa, Mycobacterium
ADELGLPTAPFWFAGTVEELTAIGQHA

SEQ ID NO: 788488 - protein, 25 aa, Mycobacterium
ADELGMPLLEIPLRTPFAAVVKAVS

SEQ ID NO: 788489 - protein, 18 aa, Mycobacterium
ADELIAWCRERLAHFKCP

SEQ ID NO: 788490 - protein, 18 aa, Mycobacterium
ADELIGWLRDRLAHYKCP

SEQ ID NO: 788491 - protein, 18 aa, Mycobacterium
ADELIGWLRNRMAHYKCP

SEQ ID NO: 788492 - protein, 27 aa, Mycobacterium
ADELRGYLRRWLAPAIREWAARPVTAS

SEQ ID NO: 788493 - protein, 26 aa, Mycobacterium
ADELVTLVHWGMSPMAVLRAATVTAA

SEQ ID NO: 788494 - protein, 31 aa, Mycobacterium
ADELVTLVNWGLPPLAVLRAATVTAAELINS

SEQ ID NO: 788495 - protein, 27 aa, Mycobacterium
ADELVTLVQWGLPPAAVLKAATVTAAE

SEQ ID NO: 788496 - protein, 19 aa, Mycobacterium
ADEMEWLMDEVGGDGFLIT

SEQ ID NO: 788497 - protein, 23 aa, Mycobacterium
ADENLHMIFYRDVTEAGFEIAPN

SEQ ID NO: 788498 - protein, 24 aa, Mycobacterium
ADENPDLFWAVRGGGGNFGVVVNF

SEQ ID NO: 788499 - protein, 24 aa, Mycobacterium
ADEPASILILFAPGAPREHYFEGL

SEQ ID NO: 788500 - protein, 25 aa, Mycobacterium
ADEPASILMLFAPGAPREAYFEGFA

SEQ ID NO: 788501 - protein, 26 aa, Mycobacterium
ADEPASILMLFAPGAPREAYFEGFAA

SEQ ID NO: 788502 - protein, 24 aa, Mycobacterium
ADEPDIWFQPLIAGFERDPGRGFR

SEQ ID NO: 788503 - protein, 24 aa, Mycobacterium
ADEPGRLLGFHWTKVHPDEPGLGE

SEQ ID NO: 788504 - protein, 23 aa, Mycobacterium
ADEQALFLSDAVPTGFMGADFCD

SEQ ID NO: 788505 - protein, 27 aa, Mycobacterium
ADEQMSALLMAIFLRGMTPGEITRWTA

SEQ ID NO: 788506 - protein, 19 aa, Mycobacterium
ADEQRAIFRRTWLNVGRIE

SEQ ID NO: 788507 - protein, 19 aa, Mycobacterium
ADEQRAIFRRTWLNVGRVE

SEQ ID NO: 788508 - protein, 24 aa, Mycobacterium
ADERALLDDLPVRRLWGIGPVAEE

SEQ ID NO: 788509 - protein, 24 aa, Mycobacterium
ADERAQWPHWVPVGRMGVPEDQAR

SEQ ID NO: 788510 - protein, 28 aa, Mycobacterium
ADERFRERVLPRVPARRWGAADDIGGVA

SEQ ID NO: 788511 - protein, 27 aa, Mycobacterium
ADERITVLHLAPVMLRALLDEVSDRLA

SEQ ID NO: 788512 - protein, 26 aa, Mycobacterium
ADERPGWHALRRLAARITTPLLPDDY

SEQ ID NO: 788513 - protein, 31 aa, Mycobacterium
ADESLDYFLNLMLRAPFRLTREVLPHMPAGS

SEQ ID NO: 788514 - protein, 24 aa, Mycobacterium
ADETLPFISIRLWQPISENETEVC

SEQ ID NO: 788515 - protein, 29 aa, Mycobacterium
ADEVCLQMHLLYLSFAIAVAARAAGDDES

SEQ ID NO: 788516 - protein, 29 aa, Mycobacterium
ADEVCLQMHLLYLSFAIAVRARAADDAQA

SEQ ID NO: 788517 - protein, 25 aa, Mycobacterium
ADEVFAGYHWYPPMGSPAAASLEGS

SEQ ID NO: 788518 - protein, 26 aa, Mycobacterium
ADEVFAGYHWYPPMGSPAAASLQGAV

SEQ ID NO: 788519 - protein, 22 aa, Mycobacterium
ADEVGCFLLHDKGIEGIADPSN

SEQ ID NO: 788520 - protein, 27 aa, Mycobacterium
ADEVIPLLQCRTGFRSTYRPGETLRGR

SEQ ID NO: 788521 - protein, 24 aa, Mycobacterium
ADEVIRHYRLIAAAVDVPVVAYDI

SEQ ID NO: 788522 - protein, 23 aa, Mycobacterium
ADEVMVGFGRFGEWFAINAFDVT

SEQ ID NO: 788523 - protein, 33 aa, Mycobacterium
ADEVRRYILDCALRWMRDFHADGLRLDAVHALV

SEQ ID NO: 788524 - protein, 28 aa, Mycobacterium
ADEVSAAVAALFSSHARAYQALSVQAGQ

SEQ ID NO: 788525 - protein, 25 aa, Mycobacterium
ADEVSAVIAALFAAHGQAYQTLSAQ

SEQ ID NO: 788526 - protein, 26 aa, Mycobacterium
ADEVVDVVLLWWRDGDGDLVDTLMDA

SEQ ID NO: 788527 - protein, 22 aa, Mycobacterium
ADEVWALLRDVTQARIGLGRAG

SEQ ID NO: 788528 - protein, 19 aa, Mycobacterium
ADEWLPCAAGTDGALAMAM

SEQ ID NO: 788529 - protein, 25 aa, Mycobacterium
ADEYMDLVYQLWDSWEPDAVVIDRE

SEQ ID NO: 788530 - protein, 27 aa, Mycobacterium
ADEYWNHYQLTFALYSVSDRAIPSAFD

SEQ ID NO: 788531 - protein, 25 aa, Mycobacterium
ADFAKLWRTLAAELGVAGLLVPESL

SEQ ID NO: 788532 - protein, 28 aa, Mycobacterium
ADFATITSLYPLLAPWVNGVPADELSVV

SEQ ID NO: 788533 - protein, 23 aa, Mycobacterium
ADFEFACMLGIGPLMHAGQGCAA

SEQ ID NO: 788534 - protein, 17 aa, Mycobacterium
ADFELAQGFLLTEGIIA

SEQ ID NO: 788535 - protein, 34 aa, Mycobacterium
ADFEQVLRINLIGTFLVTRESLAALRDGRGPAVV

SEQ ID NO: 788536 - protein, 25 aa, Mycobacterium
ADFGAWLETHFALGADRFSDVLLAV

SEQ ID NO: 788537 - protein, 24 aa, Mycobacterium
ADFHGTPWAPRWTAPALGQHTEEV

SEQ ID NO: 788538 - protein, 17 aa, Mycobacterium
ADFHLVEQYRAEPKPPV

SEQ ID NO: 788539 - protein, 25 aa, Mycobacterium
ADFIFSGFGSIPRYDNAFALSNFNS

SEQ ID NO: 788540 - protein, 22 aa, Mycobacterium
ADFIGGFGLWVDEQRLLHHTYS

SEQ ID NO: 788541 - protein, 20 aa, Mycobacterium
ADFLGLPRHELADAALAAAT

SEQ ID NO: 788542 - protein, 17 aa, Mycobacterium
ADFLHGRWLVLRRGKRT

SEQ ID NO: 788543 - protein, 26 aa, Mycobacterium
ADFLTPFIWRMDTFGRPHLEQTPWAP

SEQ ID NO: 788544 - protein, 17 aa, Mycobacterium
ADFMGGFALWVDEQRRL

SEQ ID NO: 788545 - protein, 25 aa, Mycobacterium
ADFNKAFAPYGLPATAFKPSYGIAE

SEQ ID NO: 788546 - protein, 25 aa, Mycobacterium
ADFNKYVSYFCPSERSGLGDASQLR

SEQ ID NO: 788547 - protein, 28 aa, Mycobacterium
ADFNSVMQVLPPWGIKIIRKAIHRSRGR

SEQ ID NO: 788548 - protein, 25 aa, Mycobacterium
ADFPILRETVHGKPLIWFDNAATTQ

SEQ ID NO: 788549 - protein, 25 aa, Mycobacterium
ADFPRYPINFLADLNAFLGIQSLHG

SEQ ID NO: 788550 - protein, 31 aa, Mycobacterium
ADFQDLITRYAWGEIWTRPGLDRRSRSMITL

SEQ ID NO: 788551 - protein, 22 aa, Mycobacterium
ADFRQRLADWVSDTSLFTDEEL

SEQ ID NO: 788552 - protein, 24 aa, Mycobacterium
ADFTDWLLFDQFSPSIVGRRGLAT

SEQ ID NO: 788553 - protein, 23 aa, Mycobacterium
ADFTTRIVVLTPTDPARFNGTVL

SEQ ID NO: 788554 - protein, 24 aa, Mycobacterium
ADGAHIVMIGILPTLMPEHLDHDW

SEQ ID NO: 788555 - protein, 22 aa, Mycobacterium
ADGAIRVRGLMSHLVHGDDPEN

SEQ ID NO: 788556 - protein, 28 aa, Mycobacterium
ADGALDFVITNVLIIDAVLGIRKADIGI

SEQ ID NO: 788557 - protein, 23 aa, Mycobacterium
ADGALTCLLDLTSPPPAPAQAEG

SEQ ID NO: 788558 - protein, 31 aa, Mycobacterium
ADGANAVNIAFTPNEPQATAGNPGGSGITGE

SEQ ID NO: 788559 - protein, 28 aa, Mycobacterium
ADGAPWASLVTYGLLGGAPVLCVSQMAE

SEQ ID NO: 788560 - protein, 26 aa, Mycobacterium
ADGATFQQLPFALTPGPPVPTRALRD

SEQ ID NO: 788561 - protein, 24 aa, Mycobacterium
ADGAWLAEQAWFDVPLSQGTGGGV

SEQ ID NO: 788562 - protein, 22 aa, Mycobacterium
ADGDFLEIFIDTPIEICEQRDP

SEQ ID NO: 788563 - protein, 18 aa, Mycobacterium
ADGDGLVRWMADLNTKTV

SEQ ID NO: 788564 - protein, 23 aa, Mycobacterium
ADGDGLVRWMADLNTRVVPEHPF

SEQ ID NO: 788565 - protein, 24 aa, Mycobacterium
ADGDGLVRWMADLNTRVVPEHPFM

SEQ ID NO: 788566 - protein, 25 aa, Mycobacterium
ADGDIWDWAVDWDEWKSMSALSDTR

SEQ ID NO: 788567 - protein, 27 aa, Mycobacterium
ADGDPGEALFDYLRLMVLQCGAADRGL

SEQ ID NO: 788568 - protein, 22 aa, Mycobacterium
ADGFNVMPPYLPGGLEDFIEHV

SEQ ID NO: 788569 - protein, 22 aa, Mycobacterium
ADGFRHRIADTRLLLNNALDAG

SEQ ID NO: 788570 - protein, 31 aa, Mycobacterium
ADGFVVLREGDGVHWWTWAGARANATLIAGL

SEQ ID NO: 788571 - protein, 26 aa, Mycobacterium
ADGGLCIWARLPAPMSTALAAAAARL

SEQ ID NO: 788572 - protein, 29 aa, Mycobacterium
ADGGPITWPLHISLLLAKEYALTGARIPA

SEQ ID NO: 788573 - protein, 29 aa, Mycobacterium
ADGGPLTWPLHISLLLAKEFALTGTRIKA

SEQ ID NO: 788574 - protein, 24 aa, Mycobacterium
ADGGSNWYTEFARLAPLMEKDVHY

SEQ ID NO: 788575 - protein, 31 aa, Mycobacterium
ADGHRAVAPVYLYRFDFATPLLRVARLHAAH

SEQ ID NO: 788576 - protein, 20 aa, Mycobacterium
ADGHWLACQVAPEGGTRSQI

SEQ ID NO: 788577 - protein, 23 aa, Mycobacterium
ADGIDAMPWLLAGAKTLSYAINM

SEQ ID NO: 788578 - protein, 23 aa, Mycobacterium
ADGIGMLRFDALGLGGSEGDWGD

SEQ ID NO: 788579 - protein, 19 aa, Mycobacterium
ADGIRSFLGSRLIDVDEAT

SEQ ID NO: 788580 - protein, 36 aa, Mycobacterium
ADGKPWPIPTFIQRVKFLCHWYLPASQRHKGRFTLR

SEQ ID NO: 788581 - protein, 24 aa, Mycobacterium
ADGLAAFCDICVAAFAGFAVVKPQ

SEQ ID NO: 788582 - protein, 24 aa, Mycobacterium
ADGLAIIAPIVIAAGRLLAPGGAI

SEQ ID NO: 788583 - protein, 20 aa, Mycobacterium
ADGLFLACQARPVSDRIRIE

SEQ ID NO: 788584 - protein, 18 aa, Mycobacterium
ADGLLGRISSCSILGSIL

SEQ ID NO: 788585 - protein, 19 aa, Mycobacterium
ADGLLLTMGQPYPVAMAKL

SEQ ID NO: 788586 - protein, 19 aa, Mycobacterium
ADGLPWPDAEQWLTAVRAS

SEQ ID NO: 788587 - protein, 26 aa, Mycobacterium
ADGNMPVRWSGPPAVRHGYLQPAAKC

SEQ ID NO: 788588 - protein, 24 aa, Mycobacterium
ADGPDAFYRGAIAEAIVAAAADTS

SEQ ID NO: 788589 - protein, 29 aa, Mycobacterium
ADGPIPPIAFQLLWYPSTMWDQTLPSFTE

SEQ ID NO: 788590 - protein, 21 aa, Mycobacterium
ADGPLPVMVFIHGGGYLLGSS

SEQ ID NO: 788591 - protein, 25 aa, Mycobacterium
ADGPRLHANWTWAPSALDEDLVRRL

SEQ ID NO: 788592 - protein, 23 aa, Mycobacterium
ADGPTHLFTGDCLFPGGVGKTWK

SEQ ID NO: 788593 - protein, 25 aa, Mycobacterium
ADGQAWLLGRRRGLPQRAPQAHRDP

SEQ ID NO: 788594 - protein, 24 aa, Mycobacterium
ADGQLRARIIFDLDDIDAAFGELD

SEQ ID NO: 788595 - protein, 29 aa, Mycobacterium
ADGQTRRAIIKLLLEGPITAGQIGERLGI

SEQ ID NO: 788596 - protein, 25 aa, Mycobacterium
ADGQYVVGRLVWNAGLLAPVEGQLR

SEQ ID NO: 788597 - protein, 25 aa, Mycobacterium
ADGRPLVAPVWFVVDDGHLVFNTGR

SEQ ID NO: 788598 - protein, 25 aa, Mycobacterium
ADGRRFWIVGLEGDRHWPPLCRAVG

SEQ ID NO: 788599 - protein, 23 aa, Mycobacterium
ADGRVIALLRDEGTRTKSVVVIR

SEQ ID NO: 788600 - protein, 25 aa, Mycobacterium
ADGRYISFVMMQPTKFWADVCRHMD

SEQ ID NO: 788601 - protein, 24 aa, Mycobacterium
ADGSPPYVVRWLDTDHVATVVPGP

SEQ ID NO: 788602 - protein, 17 aa, Mycobacterium
ADGSWVPTFPNARYLVP

SEQ ID NO: 788603 - protein, 23 aa, Mycobacterium
ADGTAGGWLLGNGGAGGSGADGQ

SEQ ID NO: 788604 - protein, 23 aa, Mycobacterium
ADGTFEWRFTPAVPSQLVIREVY

SEQ ID NO: 788605 - protein, 20 aa, Mycobacterium
ADGTIDCPCHGSRFSLDGAV

SEQ ID NO: 788606 - protein, 20 aa, Mycobacterium
ADGTLLWVDGDRRACRKAES

SEQ ID NO: 788607 - protein, 24 aa, Mycobacterium
ADGTSIYWTGLNKGKRSATIDLRA

SEQ ID NO: 788608 - protein, 24 aa, Mycobacterium
ADGTSIYWTGLNKGKRSATIDLRS

SEQ ID NO: 788609 - protein, 25 aa, Mycobacterium
ADGTYETWARGTGAHWELIEHGRVG

SEQ ID NO: 788610 - protein, 22 aa, Mycobacterium
ADGVYAAWFTVLGHGPATGAVI

SEQ ID NO: 788611 - protein, 25 aa, Mycobacterium
ADGVYAAWFTVLGHGPVTGAVIPGE

SEQ ID NO: 788612 - protein, 24 aa, Mycobacterium
ADGVYAAWFTVLGQGPQVGTVVPG

SEQ ID NO: 788613 - protein, 24 aa, Mycobacterium
ADGWSLTPLVRDLALAYASRSVGD

SEQ ID NO: 788614 - protein, 19 aa, Mycobacterium
ADGYRMAVLGLTPEDAQSL

SEQ ID NO: 788615 - protein, 29 aa, Mycobacterium
ADHAGLIRTEFLFLGRRQAPDVDEQLAVY

SEQ ID NO: 788616 - protein, 25 aa, Mycobacterium
ADHAVVLHPGPMLRGMEIAYSVADS

SEQ ID NO: 788617 - protein, 28 aa, Mycobacterium
ADHCLDLPGLFVWRRYHPNPPKGKAIMY

SEQ ID NO: 788618 - protein, 28 aa, Mycobacterium
ADHCLDLPGLFVWRRYHPSRPDGKALLY

SEQ ID NO: 788619 - protein, 30 aa, Mycobacterium
ADHCLDLPGLFVWRRYHPTPAPERGVVYGP

SEQ ID NO: 788620 - protein, 28 aa, Mycobacterium
ADHCLDLPGLFVWRRYHPTRPLGKALLY

SEQ ID NO: 788621 - protein, 29 aa, Mycobacterium
ADHCLDMPGLFVWRRYHPSRPKGKALLYG

SEQ ID NO: 788622 - protein, 18 aa, Mycobacterium
ADHDAFDPAYFSISPKEA

SEQ ID NO: 788623 - protein, 26 aa, Mycobacterium
ADHFDEVPLLLFVFAIDDLGGANIYP

SEQ ID NO: 788624 - protein, 27 aa, Mycobacterium
ADHFEEIPLLLFVFAIDDLGGANIFPA

SEQ ID NO: 788625 - protein, 31 aa, Mycobacterium
ADHISLVERKWRWYYLPIARPRGHDAWSEHA

SEQ ID NO: 788626 - protein, 25 aa, Mycobacterium
ADHITVLHRALASLPPHWRPDPDQR

SEQ ID NO: 788627 - protein, 20 aa, Mycobacterium
ADHLLWLDDPDPRVPATGGF

SEQ ID NO: 788628 - protein, 28 aa, Mycobacterium
ADHMADLGFLPVVTRLLAATPSSGQRLL

SEQ ID NO: 788629 - protein, 19 aa, Mycobacterium
ADHMRQIGRIPATIRYTAQ

SEQ ID NO: 788630 - protein, 18 aa, Mycobacterium
ADHPGLVSALARAQTDGA

SEQ ID NO: 788631 - protein, 36 aa, Mycobacterium
ADHRLPHGVTFIGQPLWGSIGYTLPAALGAAVAHRD

SEQ ID NO: 788632 - protein, 31 aa, Mycobacterium
ADHRPTFDVLFDLWFPPALGARFVEVGEEGI

SEQ ID NO: 788633 - protein, 25 aa, Mycobacterium
ADHTFALILAATRRVLDGDRFLRSR

SEQ ID NO: 788634 - protein, 27 aa, Mycobacterium
ADHVFSRFSIPAWSARIGFQMLDPVKT

SEQ ID NO: 788635 - protein, 24 aa, Mycobacterium
ADIAHRYTGTPIFLRAVEVRTRRY

SEQ ID NO: 788636 - protein, 27 aa, Mycobacterium
ADIARRYPIPIICALLGAPAGDWKLFS

SEQ ID NO: 788637 - protein, 18 aa, Mycobacterium
ADIAVVRILGGYRAWQDG

SEQ ID NO: 788638 - protein, 24 aa, Mycobacterium
ADIDHMPLLPEHLLDEQYLRGRAA

SEQ ID NO: 788639 - protein, 23 aa, Mycobacterium
ADIDHYRSITKLPIILKGICDSD

SEQ ID NO: 788640 - protein, 25 aa, Mycobacterium
ADIDIALLYDAFASNPAMILEEAGF

SEQ ID NO: 788641 - protein, 23 aa, Mycobacterium
ADIEAVLPKVRPIVQAVAERGAE

SEQ ID NO: 788642 - protein, 32 aa, Mycobacterium
ADIEDFWQEAYPKTFWATFHPVQSLMSWDSTG

SEQ ID NO: 788643 - protein, 18 aa, Mycobacterium
ADIEWTVQLMQLRYAHEI

SEQ ID NO: 788644 - protein, 21 aa, Mycobacterium
ADIGCTAVMPHLFGNPGQSVD

SEQ ID NO: 788645 - protein, 22 aa, Mycobacterium
ADIGLVIAVKRLTAAKTRLAPV

SEQ ID NO: 788646 - protein, 18 aa, Mycobacterium
ADIGTIFGASLYGIDEHS

SEQ ID NO: 788647 - protein, 25 aa, Mycobacterium
ADIGYNVVIYPVTTLRLAMHAVEIG

SEQ ID NO: 788648 - protein, 25 aa, Mycobacterium
ADIHLTREWILRNSPVPVGTVPIYQ

SEQ ID NO: 788649 - protein, 25 aa, Mycobacterium
ADIHRLSELDALRDAAASAREALAG

SEQ ID NO: 788650 - protein, 18 aa, Mycobacterium
ADILHQLIEGLEKQAWLL

SEQ ID NO: 788651 - protein, 22 aa, Mycobacterium
ADILSAERRILAAAGLRDGRTV

SEQ ID NO: 788652 - protein, 18 aa, Mycobacterium
ADIPIVGSKFTLALIAEK

SEQ ID NO: 788653 - protein, 22 aa, Mycobacterium
ADIPLAIDHFRYFAGVLRAQEG

SEQ ID NO: 788654 - protein, 27 aa, Mycobacterium
ADIPLAIDHFRYFAGVLRAQEGSLSQI

SEQ ID NO: 788655 - protein, 22 aa, Mycobacterium
ADIPLAIDHFRYFASAIRAQEG

SEQ ID NO: 788656 - protein, 19 aa, Mycobacterium
ADIRICSAAATFGNAAILL

SEQ ID NO: 788657 - protein, 25 aa, Mycobacterium
ADIRQMLDVQVIGTWNVLRAAIPHL

SEQ ID NO: 788658 - protein, 29 aa, Mycobacterium
ADISLDTYPYLPGATTLSAILPSWASAGS

SEQ ID NO: 788659 - protein, 29 aa, Mycobacterium
ADITRLERRIGERLPWLSIRDSGVNLRTR

SEQ ID NO: 788660 - protein, 23 aa, Mycobacterium
ADIVARALSYLRDRYARSPDPDH

SEQ ID NO: 788661 - protein, 21 aa, Mycobacterium
ADIVMLDLSPAAALTLYGDAM

SEQ ID NO: 788662 - protein, 24 aa, Mycobacterium
ADIYRIAHNVAWERWTDIAFGLTS

SEQ ID NO: 788663 - protein, 26 aa, Mycobacterium
ADKAFVMGLLLIRLYEHRRAAHAAAT

SEQ ID NO: 788664 - protein, 19 aa, Mycobacterium
ADKFSVVEALADSLGAAVG

SEQ ID NO: 788665 - protein, 25 aa, Mycobacterium
ADKHPGWHALRKIASRITTPLLPDD

SEQ ID NO: 788666 - protein, 23 aa, Mycobacterium
ADKHPVVFTLTRAAEALLGVAGG

SEQ ID NO: 788667 - protein, 21 aa, Mycobacterium
ADKKIIHIHRFPAEVDAHYSV

SEQ ID NO: 788668 - protein, 18 aa, Mycobacterium
ADKKYSVRFLSRDPGSRR

SEQ ID NO: 788669 - protein, 17 aa, Mycobacterium
ADKLLPRGWAAEIAGQI

SEQ ID NO: 788670 - protein, 23 aa, Mycobacterium
ADKNPMWYLNLKANPKVSVQIKK

SEQ ID NO: 788671 - protein, 22 aa, Mycobacterium
ADKPAVILYPSGTVVTFDDLEA

SEQ ID NO: 788672 - protein, 37 aa, Mycobacterium
ADKPGVGHPILYVAQAWDWIFPLTEDPNYEPAAADSI

SEQ ID NO: 788673 - protein, 35 aa, Mycobacterium
ADKPLKYPHMFAAADLVLINKSDLLPYVDFDIDAC

SEQ ID NO: 788674 - protein, 24 aa, Mycobacterium
ADKPRPVVFLFPGQGSQFSGMGEQ

SEQ ID NO: 788675 - protein, 17 aa, Mycobacterium
ADKPYLERVWTNRWTQQ

SEQ ID NO: 788676 - protein, 27 aa, Mycobacterium
ADKRQYGYYVWPLLMDGRLVARVDLKA

SEQ ID NO: 788677 - protein, 27 aa, Mycobacterium
ADKVVRFMFGLARRYGPAFFTANQLAL

SEQ ID NO: 788678 - protein, 21 aa, Mycobacterium
ADKYRAWLNAHPEAALADLCF

SEQ ID NO: 788679 - protein, 23 aa, Mycobacterium
ADKYRRLHVIIGDANLAETSTYL

SEQ ID NO: 788680 - protein, 25 aa, Mycobacterium
ADLAAALPMLVFSGLMNAGQGCVNQ

SEQ ID NO: 788681 - protein, 20 aa, Mycobacterium
ADLAAFVGDLLRPHLVSAET

SEQ ID NO: 788682 - protein, 24 aa, Mycobacterium
ADLADMPLLLLDEGHCLRDQALEV

SEQ ID NO: 788683 - protein, 19 aa, Mycobacterium
ADLAGACSMAAFTASMHAG

SEQ ID NO: 788684 - protein, 18 aa, Mycobacterium
ADLAGQVMRLLQQALDAS

SEQ ID NO: 788685 - protein, 20 aa, Mycobacterium
ADLAKIGAAIDTVSTAAAAS

SEQ ID NO: 788686 - protein, 18 aa, Mycobacterium
ADLALWSAYRHGADYVLV

SEQ ID NO: 788687 - protein, 21 aa, Mycobacterium
ADLARRLARQVPGCRFSGLGG

SEQ ID NO: 788688 - protein, 22 aa, Mycobacterium
ADLATRIFGVKIPAANVVGETL

SEQ ID NO: 788689 - protein, 19 aa, Mycobacterium
ADLAWLRSRGLDSALRRHV

SEQ ID NO: 788690 - protein, 21 aa, Mycobacterium
ADLDAFVLFSSAAGILGAQGQ

SEQ ID NO: 788691 - protein, 17 aa, Mycobacterium
ADLDALVAAGRIFRDVD

SEQ ID NO: 788692 - protein, 17 aa, Mycobacterium
ADLDCLIRHRVELVITS

SEQ ID NO: 788693 - protein, 19 aa, Mycobacterium
ADLDDYLTRPLWYQELSED

SEQ ID NO: 788694 - protein, 25 aa, Mycobacterium
ADLDGRYLGQFTLPPNLAVSAQRTG

SEQ ID NO: 788695 - protein, 17 aa, Mycobacterium
ADLDLALRRARNAQALI

SEQ ID NO: 788696 - protein, 20 aa, Mycobacterium
ADLDMPSGYAYGKSFRTVKT

SEQ ID NO: 788697 - protein, 17 aa, Mycobacterium
ADLDRAYMEQAVWAPYG

SEQ ID NO: 788698 - protein, 19 aa, Mycobacterium
ADLDRFWAQALTGYAQKID

SEQ ID NO: 788699 - protein, 25 aa, Mycobacterium
ADLDSTLPMLVFSGLMNSGQACVGQ

SEQ ID NO: 788700 - protein, 19 aa, Mycobacterium
ADLDWAAAFAGLAAHRVDL

SEQ ID NO: 788701 - protein, 28 aa, Mycobacterium
ADLDYHLTTLFPPVRPRQWLEIRYLDSL

SEQ ID NO: 788702 - protein, 22 aa, Mycobacterium
ADLEAHGLFFPGGHCKGVCLGG

SEQ ID NO: 788703 - protein, 26 aa, Mycobacterium
ADLEHWRWMWETNVLGTLRVTRALLP

SEQ ID NO: 788704 - protein, 18 aa, Mycobacterium
ADLEPAPVVLLVGFEPED

SEQ ID NO: 788705 - protein, 23 aa, Mycobacterium
ADLESREVLLAKLAGAMKGNLAK

SEQ ID NO: 788706 - protein, 22 aa, Mycobacterium
ADLESREVLLAKLAGAMKGNLN

SEQ ID NO: 788707 - protein, 24 aa, Mycobacterium
ADLESREVLLSKFAGALKAKQSQA

SEQ ID NO: 788708 - protein, 22 aa, Mycobacterium
ADLEVGLLIYNAGANTCREQFL

SEQ ID NO: 788709 - protein, 22 aa, Mycobacterium
ADLEVGLLIYNAGANTCRQKFL

SEQ ID NO: 788710 - protein, 27 aa, Mycobacterium
ADLEYHLTTLFPPVRPRQWLEIRYLDS

SEQ ID NO: 788711 - protein, 20 aa, Mycobacterium
ADLFAAQGVWLVSSITLAAR

SEQ ID NO: 788712 - protein, 25 aa, Mycobacterium
ADLFMIGAAYRRYAIKRPHVYRLMF

SEQ ID NO: 788713 - protein, 19 aa, Mycobacterium
ADLFQALNDIGFSIPAQGC

SEQ ID NO: 788714 - protein, 19 aa, Mycobacterium
ADLFTRIYELPIPVIGAVN

SEQ ID NO: 788715 - protein, 19 aa, Mycobacterium
ADLFYLDEILELGKGIKDF

SEQ ID NO: 788716 - protein, 23 aa, Mycobacterium
ADLIELRRLLYCGEWIHSHVLHI

SEQ ID NO: 788717 - protein, 23 aa, Mycobacterium
ADLISPLRLRGMSAMLARIKRRL

SEQ ID NO: 788718 - protein, 19 aa, Mycobacterium
ADLKALWRIGINVFVETFG

SEQ ID NO: 788719 - protein, 22 aa, Mycobacterium
ADLKVINPFDFFIEDYAETVPF

SEQ ID NO: 788720 - protein, 20 aa, Mycobacterium
ADLKVRALTIEWADNGNSFE

SEQ ID NO: 788721 - protein, 17 aa, Mycobacterium
ADLLARAAPDPALVMIV

SEQ ID NO: 788722 - protein, 17 aa, Mycobacterium
ADLLAVLVKGLDGFVRR

SEQ ID NO: 788723 - protein, 37 aa, Mycobacterium
ADLLAVVARLNRLATQRTRLPLPYAQARLLSTIEDQG

SEQ ID NO: 788724 - protein, 30 aa, Mycobacterium
ADLLDVGYVPPFPYFMDSPNAFRVLPAEFV

SEQ ID NO: 788725 - protein, 21 aa, Mycobacterium
ADLLGGVVLIDQAVLDHAHRA

SEQ ID NO: 788726 - protein, 18 aa, Mycobacterium
ADLLGKRLHRALGPLVHV

SEQ ID NO: 788727 - protein, 18 aa, Mycobacterium
ADLLGLTEIAASAPEPLS

SEQ ID NO: 788728 - protein, 18 aa, Mycobacterium
ADLLGRRLHRALGPLVHV

SEQ ID NO: 788729 - protein, 17 aa, Mycobacterium
ADLLHRGMGAFHAALNT

SEQ ID NO: 788730 - protein, 17 aa, Mycobacterium
ADLLRQDPLVMSVLHSE

SEQ ID NO: 788731 - protein, 17 aa, Mycobacterium
ADLLRRAGRPADALTWY

SEQ ID NO: 788732 - protein, 21 aa, Mycobacterium
ADLLSGYYHAVHKLTLEYVAG

SEQ ID NO: 788733 - protein, 20 aa, Mycobacterium
ADLLTAQGIWLISSITLAAR

SEQ ID NO: 788734 - protein, 20 aa, Mycobacterium
ADLLTHLYGTKVQVANTLQG

SEQ ID NO: 788735 - protein, 21 aa, Mycobacterium
ADLLVTPLYHEQPVLIAAAEL

SEQ ID NO: 788736 - protein, 24 aa, Mycobacterium
ADLLWSRPIKEFPDLKIALSEGGT

SEQ ID NO: 788737 - protein, 17 aa, Mycobacterium
ADLMSVFADGPVVIGPT

SEQ ID NO: 788738 - protein, 23 aa, Mycobacterium
ADLNDYLSRPLWYQQQQADGQAM

SEQ ID NO: 788739 - protein, 23 aa, Mycobacterium
ADLPGELWRLSPDSLSLSGAAAA

SEQ ID NO: 788740 - protein, 25 aa, Mycobacterium
ADLPLAIDHLRYFAGAIRAQEGGLS

SEQ ID NO: 788741 - protein, 25 aa, Mycobacterium
ADLPLCALMTAWVRGRARPEAAAQV

SEQ ID NO: 788742 - protein, 19 aa, Mycobacterium
ADLPLVSAKADVLRQAAGI

SEQ ID NO: 788743 - protein, 24 aa, Mycobacterium
ADLPQLATLFYRQSVEERNHAMML

SEQ ID NO: 788744 - protein, 24 aa, Mycobacterium
ADLPRILELLARFTDDAVAADRIM

SEQ ID NO: 788745 - protein, 18 aa, Mycobacterium
ADLPRLLSLYKRGELKLK

SEQ ID NO: 788746 - protein, 33 aa, Mycobacterium
ADLPSPVVPPKSAAPLPTALRRVLRRARDGVAL

SEQ ID NO: 788747 - protein, 19 aa, Mycobacterium
ADLPTFTYGFAATPHDIFD

SEQ ID NO: 788748 - protein, 26 aa, Mycobacterium
ADLQAAVMYWAYIAYIFGVAEELIPT

SEQ ID NO: 788749 - protein, 24 aa, Mycobacterium
ADLQARVDMLRYGLAGIAAGGKLD

SEQ ID NO: 788750 - protein, 30 aa, Mycobacterium
ADLQEKIRSLRLPLLILHSPTDNTVGIENA

SEQ ID NO: 788751 - protein, 24 aa, Mycobacterium
ADLQRSWLRTGDLGVYLDGELYVT

SEQ ID NO: 788752 - protein, 17 aa, Mycobacterium
ADLRAPRALPVLVIDGR

SEQ ID NO: 788753 - protein, 23 aa, Mycobacterium
ADLRECITTLRRALLVMHSPTDN

SEQ ID NO: 788754 - protein, 24 aa, Mycobacterium
ADLRERIFDAAKRLGYPGPDPVAR

SEQ ID NO: 788755 - protein, 22 aa, Mycobacterium
ADLRHWLVDYLVTNIGCPPDEV

SEQ ID NO: 788756 - protein, 25 aa, Mycobacterium
ADLRPGLLVQLAFAAADFAFQQWVR

SEQ ID NO: 788757 - protein, 25 aa, Mycobacterium
ADLRPGLLVQLAFAAADFGFQQWVR

SEQ ID NO: 788758 - protein, 18 aa, Mycobacterium
ADLRPPVVAPPAVPSIPA

SEQ ID NO: 788759 - protein, 19 aa, Mycobacterium
ADLRYRVAALAGSLSRRGV

SEQ ID NO: 788760 - protein, 17 aa, Mycobacterium
ADLSAWPPAGAVAVDPA

SEQ ID NO: 788761 - protein, 25 aa, Mycobacterium
ADLSGRALPPVAAVAAAAAVATVSA

SEQ ID NO: 788762 - protein, 23 aa, Mycobacterium
ADLTAPPDWMGVDLFGTPGANVP

SEQ ID NO: 788763 - protein, 19 aa, Mycobacterium
ADLTFTVDALPRPGETVLA

SEQ ID NO: 788764 - protein, 19 aa, Mycobacterium
ADLTGACSMAAFTVAMHAG

SEQ ID NO: 788765 - protein, 30 aa, Mycobacterium
ADLVADPVPLDRIAGLLLDAPGPKPRYAVA

SEQ ID NO: 788766 - protein, 19 aa, Mycobacterium
ADLVALLYEAIPAAARRTG

SEQ ID NO: 788767 - protein, 30 aa, Mycobacterium
ADLVFELQLQVYLMLQRPVSWTGGEPADEQ

SEQ ID NO: 788768 - protein, 20 aa, Mycobacterium
ADLVGFFKDPVKGFFRALEF

SEQ ID NO: 788769 - protein, 30 aa, Mycobacterium
ADLVGHLRGFQWFLDRAADGGIPLTGAGYL

SEQ ID NO: 788770 - protein, 22 aa, Mycobacterium
ADLVLPDRHLDPRSLVAMVEDL

SEQ ID NO: 788771 - protein, 17 aa, Mycobacterium
ADLVSCMVALPTQLFRS

SEQ ID NO: 788772 - protein, 22 aa, Mycobacterium
ADLVSEFFCRIINYMDEHSYTR

SEQ ID NO: 788773 - protein, 17 aa, Mycobacterium
ADLWFEVGAATAAARYA

SEQ ID NO: 788774 - protein, 18 aa, Mycobacterium
ADLWVRLTDAVGADARDG

SEQ ID NO: 788775 - protein, 18 aa, Mycobacterium
ADLYFTLMDDLRVDDLLT

SEQ ID NO: 788776 - protein, 24 aa, Mycobacterium
ADMCGHIASLPLDRARPLWEMWVI

SEQ ID NO: 788777 - protein, 27 aa, Mycobacterium
ADMGRKFLTKLGILSPAAAAADPGITN

SEQ ID NO: 788778 - protein, 24 aa, Mycobacterium
ADMHLNAAPWPISYRHKYIPRAFD

SEQ ID NO: 788779 - protein, 18 aa, Mycobacterium
ADMHQNAAEVHRAEAERH

SEQ ID NO: 788780 - protein, 24 aa, Mycobacterium
ADMIEMWIEMAWQDGSFGWIGIAN

SEQ ID NO: 788781 - protein, 25 aa, Mycobacterium
ADMLEPLRMYAHIPRLLNAYGRLEQ

SEQ ID NO: 788782 - protein, 26 aa, Mycobacterium
ADMNCRVLLEIGPRPVLTATALAAWP

SEQ ID NO: 788783 - protein, 26 aa, Mycobacterium
ADMRAYLDRVLSPHWQTILVADGEAA

SEQ ID NO: 788784 - protein, 26 aa, Mycobacterium
ADMTMRWFPVAEAVRRVFTGEIVNSI

SEQ ID NO: 788785 - protein, 21 aa, Mycobacterium
ADNAKWFYDFSVPGDVVEVRN

SEQ ID NO: 788786 - protein, 23 aa, Mycobacterium
ADNCKLISWPIATLSPNGVRTAD

SEQ ID NO: 788787 - protein, 25 aa, Mycobacterium
ADNEAKWFWFEGNFGAYEENKVERL

SEQ ID NO: 788788 - protein, 26 aa, Mycobacterium
ADNHAYRMWLPPLADPTPVNELVTRD

SEQ ID NO: 788789 - protein, 24 aa, Mycobacterium
ADNLKAVKRMPLARALQTVHRYDY

SEQ ID NO: 788790 - protein, 24 aa, Mycobacterium
ADNPGQWLTHCHNIYHGEAGMMTV

SEQ ID NO: 788791 - protein, 24 aa, Mycobacterium
ADNPGTWLMHCHNTYHQVAGMETR

SEQ ID NO: 788792 - protein, 26 aa, Mycobacterium
ADNPSWNGQYAITFMVGPKAGTSMAV

SEQ ID NO: 788793 - protein, 24 aa, Mycobacterium
ADNRLVTGTILRRLLSPAEQFNEW

SEQ ID NO: 788794 - protein, 22 aa, Mycobacterium
ADNSGLLNLAFGSSGYQNVGAL

SEQ ID NO: 788795 - protein, 21 aa, Mycobacterium
ADPAAMLHRLSQHLVPGGIVA

SEQ ID NO: 788796 - protein, 22 aa, Mycobacterium
ADPADVLITLSRTVFRGEGERE

SEQ ID NO: 788797 - protein, 24 aa, Mycobacterium
ADPAGAMVGLWQPLAHKGFQLVGE

SEQ ID NO: 788798 - protein, 18 aa, Mycobacterium
ADPAIWDHPVDHPHVTEP

SEQ ID NO: 788799 - protein, 20 aa, Mycobacterium
ADPALILRELWDLHVEFGMQ

SEQ ID NO: 788800 - protein, 27 aa, Mycobacterium
ADPALPRDRGAFARLLRACGNIDGLER

SEQ ID NO: 788801 - protein, 23 aa, Mycobacterium
ADPALVRLGLAVIRGLLLDLVAT

SEQ ID NO: 788802 - protein, 36 aa, Mycobacterium
ADPAPPRWVLGVVRRLPWLSVVPAYFVGVGIRPEHA

SEQ ID NO: 788803 - protein, 24 aa, Mycobacterium
ADPAPQLALPLRRTRHHRLRPRRH

SEQ ID NO: 788804 - protein, 24 aa, Mycobacterium
ADPDAALLALVRLAENPDAGWDEL

SEQ ID NO: 788805 - protein, 21 aa, Mycobacterium
ADPDDGVWVSLWGADQLARVS

SEQ ID NO: 788806 - protein, 23 aa, Mycobacterium
ADPDFAADGFALAAALVAAADEI

SEQ ID NO: 788807 - protein, 23 aa, Mycobacterium
ADPDLLIDFRDVALLRDGRVLVG

SEQ ID NO: 788808 - protein, 22 aa, Mycobacterium
ADPDLLIDFRDVSLRRGGRTLV

SEQ ID NO: 788809 - protein, 27 aa, Mycobacterium
ADPDLSGPFTGVPFLIKDLAQAYRGFP

SEQ ID NO: 788810 - protein, 23 aa, Mycobacterium
ADPDSTLSFFRRALQLRREHDQF

SEQ ID NO: 788811 - protein, 38 aa, Mycobacterium
ADPDWQRFHLIGATNPVYFALLARRRMDLFGATVEDFA

SEQ ID NO: 788812 - protein, 25 aa, Mycobacterium
ADPELRGPLAGVPFLIKDLDQEYRG

SEQ ID NO: 788813 - protein, 26 aa, Mycobacterium
ADPEQTLLALYRYLGRTPSRLLGVAL

SEQ ID NO: 788814 - protein, 17 aa, Mycobacterium
ADPFSRFSLLEAQLRQM

SEQ ID NO: 788815 - protein, 29 aa, Mycobacterium
ADPGERLYTLDYYLRLAESIVAAGAHVLA

SEQ ID NO: 788816 - protein, 26 aa, Mycobacterium
ADPGHITFAWYPQLVRADLGIGPHQV

SEQ ID NO: 788817 - protein, 26 aa, Mycobacterium
ADPGIATYLDLPLFAGRPARASRGLE

SEQ ID NO: 788818 - protein, 24 aa, Mycobacterium
ADPGLPWPGRLPEPSPAVLLDDPV

SEQ ID NO: 788819 - protein, 26 aa, Mycobacterium
ADPGNPLAILVPFSAAVMDVAAIGAA

SEQ ID NO: 788820 - protein, 25 aa, Mycobacterium
ADPGQIGLEIWQLSGVQAEILARVG

SEQ ID NO: 788821 - protein, 24 aa, Mycobacterium
ADPGRPWPGQLPAPSPAVLLDDPV

SEQ ID NO: 788822 - protein, 21 aa, Mycobacterium
ADPGSVAYLFSRKGVVTLEKN

SEQ ID NO: 788823 - protein, 23 aa, Mycobacterium
ADPGSVAYLFTRKGVVTLDKNGL

SEQ ID NO: 788824 - protein, 21 aa, Mycobacterium
ADPGSVSYLFSRKGVVTLDKD

SEQ ID NO: 788825 - protein, 21 aa, Mycobacterium
ADPHRAVLTAAHDGRIIGYAM

SEQ ID NO: 788826 - protein, 17 aa, Mycobacterium
ADPIAVCAALQLGHENL

SEQ ID NO: 788827 - protein, 27 aa, Mycobacterium
ADPKADAILMFLPQWRMPELDPKAALA

SEQ ID NO: 788828 - protein, 23 aa, Mycobacterium
ADPKLMLTGPIPATAKVLHKAGV

SEQ ID NO: 788829 - protein, 18 aa, Mycobacterium
ADPLAPGALARLILASSV

SEQ ID NO: 788830 - protein, 22 aa, Mycobacterium
ADPLAPYGFSGWVGPEPHGAGL

SEQ ID NO: 788831 - protein, 22 aa, Mycobacterium
ADPLAREAFFAEALDGAARALV

SEQ ID NO: 788832 - protein, 25 aa, Mycobacterium
ADPLAYWRYIPRCVRPAFAKRISII

SEQ ID NO: 788833 - protein, 31 aa, Mycobacterium
ADPLDVASALDWLLYDWLMAHRTDPDSAEIG

SEQ ID NO: 788834 - protein, 17 aa, Mycobacterium
ADPLIRDEFAFLLVSAA

SEQ ID NO: 788835 - protein, 22 aa, Mycobacterium
ADPLTDALPATASSLPSEVIPG

SEQ ID NO: 788836 - protein, 21 aa, Mycobacterium
ADPMPIERFVEYLTTVLSGLA

SEQ ID NO: 788837 - protein, 23 aa, Mycobacterium
ADPMPILTMFDKQIQVRMGQANV

SEQ ID NO: 788838 - protein, 29 aa, Mycobacterium
ADPNLVVRAFLKYQIITVTTPDNALLERG

SEQ ID NO: 788839 - protein, 22 aa, Mycobacterium
ADPPPVPLDAAILFAPVGELVL

SEQ ID NO: 788840 - protein, 29 aa, Mycobacterium
ADPPRHPMRVIPMRLDILSELPTIRVSGR

SEQ ID NO: 788841 - protein, 22 aa, Mycobacterium
ADPRLHAAISRFAERTGVPVVV

SEQ ID NO: 788842 - protein, 23 aa, Mycobacterium
ADPRLLACYDGAAGCWRIEAGTY

SEQ ID NO: 788843 - protein, 25 aa, Mycobacterium
ADPRLQGRFAGVPFLIKDLDQEYQG

SEQ ID NO: 788844 - protein, 20 aa, Mycobacterium
ADPRLRTHRIRRWADLLPQM

SEQ ID NO: 788845 - protein, 23 aa, Mycobacterium
ADPRPMRFHGALRAIRDVLRDRP

SEQ ID NO: 788846 - protein, 19 aa, Mycobacterium
ADPRWRAHHDRMSELGFEI

SEQ ID NO: 788847 - protein, 19 aa, Mycobacterium
ADPRWRAHHDRMSELGFEV

SEQ ID NO: 788848 - protein, 22 aa, Mycobacterium
ADPRYMPFESLRGRDFTSMVSV

SEQ ID NO: 788849 - protein, 27 aa, Mycobacterium
ADPSADVILIYLIQNLPSMSVDVAAAI

SEQ ID NO: 788850 - protein, 26 aa, Mycobacterium
ADPSCGWGWLPYRAAPERAVAAVADF

SEQ ID NO: 788851 - protein, 27 aa, Mycobacterium
ADPSLPSATLLIGAAAAWMFDYYPLRD

SEQ ID NO: 788852 - protein, 17 aa, Mycobacterium
ADPSRAPRHGWFGLVRP

SEQ ID NO: 788853 - protein, 18 aa, Mycobacterium
ADPSWAYARVALRWAERY

SEQ ID NO: 788854 - protein, 26 aa, Mycobacterium
ADPTADLVLIYLIQNLPDLTVDAATA

SEQ ID NO: 788855 - protein, 25 aa, Mycobacterium
ADPTIYRFHEALSLYGPALKELIAE

SEQ ID NO: 788856 - protein, 27 aa, Mycobacterium
ADPTLAAFLSIHNMCAWMVDTYGTEDQ

SEQ ID NO: 788857 - protein, 26 aa, Mycobacterium
ADPTLAPGRIRVMLGTGYSAPSDVLS

SEQ ID NO: 788858 - protein, 26 aa, Mycobacterium
ADPTLDAVYIPLPNGLHGRWTQAALT

SEQ ID NO: 788859 - protein, 18 aa, Mycobacterium
ADPTLELTLLVPGSPGAV

SEQ ID NO: 788860 - protein, 24 aa, Mycobacterium
ADPTPYYRVLREKYPLYHIEKWDT

SEQ ID NO: 788861 - protein, 17 aa, Mycobacterium
ADPTQLADLLLSAFQGG

SEQ ID NO: 788862 - protein, 25 aa, Mycobacterium
ADPTVWTTAAWWRRVRDTQRSDIIT

SEQ ID NO: 788863 - protein, 20 aa, Mycobacterium
ADPVALPRITVDEPAISVTI

SEQ ID NO: 788864 - protein, 20 aa, Mycobacterium
ADPVIMLTAPIPATQKVLKR

SEQ ID NO: 788865 - protein, 21 aa, Mycobacterium
ADPVIMLTAPIPATQKVLKRS

SEQ ID NO: 788866 - protein, 20 aa, Mycobacterium
ADPVIMLTAPIPATQKVLNK

SEQ ID NO: 788867 - protein, 19 aa, Mycobacterium
ADPVIMLTGPTPAARKVLD

SEQ ID NO: 788868 - protein, 19 aa, Mycobacterium
ADPVIMLTGPTPATRKVLD

SEQ ID NO: 788869 - protein, 20 aa, Mycobacterium
ADPVLAATPVLMLSARAGAE

SEQ ID NO: 788870 - protein, 25 aa, Mycobacterium
ADPVNPMRVVWELSSRLPEYAMVAG

SEQ ID NO: 788871 - protein, 20 aa, Mycobacterium
ADPWDVPSGWRIAGRAPTSI

SEQ ID NO: 788872 - protein, 28 aa, Mycobacterium
ADQAAFRRTYPFSPALVSTLRTLASAMQ

SEQ ID NO: 788873 - protein, 24 aa, Mycobacterium
ADQAMALLRMLAGRGFVDGPGGQP

SEQ ID NO: 788874 - protein, 23 aa, Mycobacterium
ADQDRLLVITQEKSWKVKRIRNT

SEQ ID NO: 788875 - protein, 25 aa, Mycobacterium
ADQFAMYGTLPSYRAMLDREGYAGP

SEQ ID NO: 788876 - protein, 31 aa, Mycobacterium
ADQFTAMAWSLMKLATLHRTIRPELLDAPNS

SEQ ID NO: 788877 - protein, 27 aa, Mycobacterium
ADQHTIEAMWFAPTDPLTMAHGVLALD

SEQ ID NO: 788878 - protein, 22 aa, Mycobacterium
ADQIWRMIHEHKVNLLFFTGDA

SEQ ID NO: 788879 - protein, 20 aa, Mycobacterium
ADQLARGPLASGMFGDFAAA

SEQ ID NO: 788880 - protein, 23 aa, Mycobacterium
ADQLFVLQKEALALPYPGVLPDA

SEQ ID NO: 788881 - protein, 24 aa, Mycobacterium
ADQLLIVVALADPPPRTGLVDRAL

SEQ ID NO: 788882 - protein, 25 aa, Mycobacterium
ADQLLIVVALADPPPRTGLVDRALI

SEQ ID NO: 788883 - protein, 21 aa, Mycobacterium
ADQLLMVVALADPPPRSGLVD

SEQ ID NO: 788884 - protein, 24 aa, Mycobacterium
ADQLRDELGDVLLQVLFHARIAEE

SEQ ID NO: 788885 - protein, 21 aa, Mycobacterium
ADQLRPVLERFGALPASEPRI

SEQ ID NO: 788886 - protein, 25 aa, Mycobacterium
ADQLSPFELPLSISPHPAPILTEAE

SEQ ID NO: 788887 - protein, 23 aa, Mycobacterium
ADQPLTGQWPHRANTHGPKGLGY

SEQ ID NO: 788888 - protein, 30 aa, Mycobacterium
ADQPWLADHVVGGVVLFPGAGFVELVIRAG

SEQ ID NO: 788889 - protein, 19 aa, Mycobacterium
ADQPYWGRPATGFGPEAPR

SEQ ID NO: 788890 - protein, 20 aa, Mycobacterium
ADQPYWGRPVPGWGSERPRL

SEQ ID NO: 788891 - protein, 24 aa, Mycobacterium
ADQPYWGRPVPGWGSERPWLLIVG

SEQ ID NO: 788892 - protein, 18 aa, Mycobacterium
ADQRIRQAAPFLSYGPFT

SEQ ID NO: 788893 - protein, 21 aa, Mycobacterium
ADQRPEVMAAFLRAMRSTTDA

SEQ ID NO: 788894 - protein, 25 aa, Mycobacterium
ADQRPPMAGTLEAFLRLVEAGWDAE

SEQ ID NO: 788895 - protein, 25 aa, Mycobacterium
ADRAAIVLRAHRAMQALIGSPPPPP

SEQ ID NO: 788896 - protein, 26 aa, Mycobacterium
ADRAARLEALPGWVWGASGEQRWERG

SEQ ID NO: 788897 - protein, 30 aa, Mycobacterium
ADRAFAAVPAPLLRWGINQFDLDQRPTQVA

SEQ ID NO: 788898 - protein, 22 aa, Mycobacterium
ADRALIMAIVNRTPDSFYDRGA

SEQ ID NO: 788899 - protein, 25 aa, Mycobacterium
ADRAQLLPWTAMRKPHYVRITPTEV

SEQ ID NO: 788900 - protein, 26 aa, Mycobacterium
ADRATGLPWMADLAHEFGLSPPPPEQ

SEQ ID NO: 788901 - protein, 26 aa, Mycobacterium
ADRATGLPWMADLIREFALCPPPTEQ

SEQ ID NO: 788902 - protein, 17 aa, Mycobacterium
ADRAVTTTPWLTSRHSF

SEQ ID NO: 788903 - protein, 17 aa, Mycobacterium
ADRAYTPGGQLLSRREP

SEQ ID NO: 788904 - protein, 24 aa, Mycobacterium
ADRDELIQRLWQRAVIALPAGKVS

SEQ ID NO: 788905 - protein, 25 aa, Mycobacterium
ADRDGLARRDWLVEQLDALVACAAI

SEQ ID NO: 788906 - protein, 24 aa, Mycobacterium
ADRDRLLAERLLTIEWREREPAGC

SEQ ID NO: 788907 - protein, 23 aa, Mycobacterium
ADRDVFLIQRGLPAWDRTLAHEL

SEQ ID NO: 788908 - protein, 17 aa, Mycobacterium
ADRERLLNLKPPTYFDD

SEQ ID NO: 788909 - protein, 20 aa, Mycobacterium
ADRFAPLNLKHRIFRKAAGS

SEQ ID NO: 788910 - protein, 20 aa, Mycobacterium
ADRFIARCLGVPDSGHLLDE

SEQ ID NO: 788911 - protein, 26 aa, Mycobacterium
ADRGAVSCYWDYAPSFGRGPFRNVIC

SEQ ID NO: 788912 - protein, 19 aa, Mycobacterium
ADRGEAIGYAVDWARTGDV

SEQ ID NO: 788913 - protein, 26 aa, Mycobacterium
ADRGLINMPMFHFGALGIIGGLHARG

SEQ ID NO: 788914 - protein, 17 aa, Mycobacterium
ADRGLRVIGLDAAGETA

SEQ ID NO: 788915 - protein, 19 aa, Mycobacterium
ADRGYLEARLLAALAARRD

SEQ ID NO: 788916 - protein, 22 aa, Mycobacterium
ADRHALITQRFLDAGLVIFGKT

SEQ ID NO: 788917 - protein, 22 aa, Mycobacterium
ADRHDLLRGLRLQHLVAMGESQ

SEQ ID NO: 788918 - protein, 19 aa, Mycobacterium
ADRHLARIRTVGLGGSTVP

SEQ ID NO: 788919 - protein, 34 aa, Mycobacterium
ADRILAIVPMFQANAWGLIYAALMAGAELVLPHR

SEQ ID NO: 788920 - protein, 25 aa, Mycobacterium
ADRISAWLYRPTGSGPSPLLVMAHG

SEQ ID NO: 788921 - protein, 34 aa, Mycobacterium
ADRIVLSPHWPEYLGALGFPIHYRGNHLHLRVSG

SEQ ID NO: 788922 - protein, 24 aa, Mycobacterium
ADRLCYSYYRSYGLDVTIVRPFNI

SEQ ID NO: 788923 - protein, 24 aa, Mycobacterium
ADRLDLPAGWSYQPRVLTEELRVD

SEQ ID NO: 788924 - protein, 31 aa, Mycobacterium
ADRLIPHRAWILIYQLYLWDMRFRARRGWRV

SEQ ID NO: 788925 - protein, 17 aa, Mycobacterium
ADRLLLRTVVKAYCDYG

SEQ ID NO: 788926 - protein, 17 aa, Mycobacterium
ADRLMLLDHLTHGRIIG

SEQ ID NO: 788927 - protein, 18 aa, Mycobacterium
ADRLMLLDHLTHGRIIGG

SEQ ID NO: 788928 - protein, 18 aa, Mycobacterium
ADRLPYSLKVLLENLLRN

SEQ ID NO: 788929 - protein, 22 aa, Mycobacterium
ADRLRARLIERINNLRVGHSLD

SEQ ID NO: 788930 - protein, 22 aa, Mycobacterium
ADRLRDGAVRLVIVGGGPGSGK

SEQ ID NO: 788931 - protein, 24 aa, Mycobacterium
ADRLSDRFGLLTRGQRGAPTRQQT

SEQ ID NO: 788932 - protein, 23 aa, Mycobacterium
ADRLSRLWFEALAGICAHVRSGG

SEQ ID NO: 788933 - protein, 19 aa, Mycobacterium
ADRLYFEPLTFEDVLEIYH

SEQ ID NO: 788934 - protein, 20 aa, Mycobacterium
ADRNRRFLLRQRPTGRIGPD

SEQ ID NO: 788935 - protein, 18 aa, Mycobacterium
ADRPALESALAILRDITS

SEQ ID NO: 788936 - protein, 24 aa, Mycobacterium
ADRPFALEPLFTRDPRLIGPVEIL

SEQ ID NO: 788937 - protein, 23 aa, Mycobacterium
ADRPPFLTYSTTPLMLSSRDTAP

SEQ ID NO: 788938 - protein, 18 aa, Mycobacterium
ADRPTFFDMCSDNRMVGG

SEQ ID NO: 788939 - protein, 26 aa, Mycobacterium
ADRPVLIQVPRRGYVPALACARCRTV

SEQ ID NO: 788940 - protein, 24 aa, Mycobacterium
ADRQFDFWFSPATQGCPRQVNRAA

SEQ ID NO: 788941 - protein, 25 aa, Mycobacterium
ADRQSMLFSATMPDPIITLARTFMI

SEQ ID NO: 788942 - protein, 23 aa, Mycobacterium
ADRRLSEDFVPLEDLLQPTMDEI

SEQ ID NO: 788943 - protein, 35 aa, Mycobacterium
ADRRLTVVAGTVALWLWIPAKTTPTVAVLMDSLGR

SEQ ID NO: 788944 - protein, 22 aa, Mycobacterium
ADRRRFLDDLLIQRRPRMAGVR

SEQ ID NO: 788945 - protein, 27 aa, Mycobacterium
ADRRVLVVGRLSIGLYAAAFAAALGAH

SEQ ID NO: 788946 - protein, 24 aa, Mycobacterium
ADRSCWRRWWPDLRLQVVEDRGDK

SEQ ID NO: 788947 - protein, 27 aa, Mycobacterium
ADRSQVERYFAWHYLAEIWARQCEAAA

SEQ ID NO: 788948 - protein, 30 aa, Mycobacterium
ADRSWPDRVITHAPLWCAVDLRDGNQALID

SEQ ID NO: 788949 - protein, 24 aa, Mycobacterium
ADRSWPWPEPRLTYANAVLAEAII

SEQ ID NO: 788950 - protein, 18 aa, Mycobacterium
ADRTDVLALMLRSTYEDG

SEQ ID NO: 788951 - protein, 24 aa, Mycobacterium
ADRVATVLRRMFIRGEITEGTMLP

SEQ ID NO: 788952 - protein, 24 aa, Mycobacterium
ADRVKRWWDSLSANQKRLLTDQHP

SEQ ID NO: 788953 - protein, 22 aa, Mycobacterium
ADRVLARVTAWLLAVSDTTDVA

SEQ ID NO: 788954 - protein, 17 aa, Mycobacterium
ADRVLEHWLASARRDDE

SEQ ID NO: 788955 - protein, 17 aa, Mycobacterium
ADRVYRLAYRLSGNQQD

SEQ ID NO: 788956 - protein, 31 aa, Mycobacterium
ADRWAYLPALEQVASWYWIVTHPGDHGDVRQ

SEQ ID NO: 788957 - protein, 21 aa, Mycobacterium
ADRWQMAAKALRPLPVAHKEM

SEQ ID NO: 788958 - protein, 18 aa, Mycobacterium
ADRWRIGRVFLAGDAAHA

SEQ ID NO: 788959 - protein, 17 aa, Mycobacterium
ADRWRVGRVFLAGDAAH

SEQ ID NO: 788960 - protein, 19 aa, Mycobacterium
ADRWTMFHSIAFDFSVWEL

SEQ ID NO: 788961 - protein, 26 aa, Mycobacterium
ADRYELPVLAPPIPRTVRFAEASASG

SEQ ID NO: 788962 - protein, 26 aa, Mycobacterium
ADRYGLPVLAPPIPRTVRFAEASASG

SEQ ID NO: 788963 - protein, 27 aa, Mycobacterium
ADRYLALEKLWDGFERLKTIDGWTKST

SEQ ID NO: 788964 - protein, 19 aa, Mycobacterium
ADRYRRLHVIIGDANLSET

SEQ ID NO: 788965 - protein, 24 aa, Mycobacterium
ADRYSLAVLAPPIPRTVRFAEATA

SEQ ID NO: 788966 - protein, 26 aa, Mycobacterium
ADRYSLPVLAPPIPRTVRFAEASASG

SEQ ID NO: 788967 - protein, 27 aa, Mycobacterium
ADSAEYWHWVTLVQQAIVVITRDGLTQ

SEQ ID NO: 788968 - protein, 35 aa, Mycobacterium
ADSAPAGWGWIAPYIGMIWPTGNLSKLRTAASEWT

SEQ ID NO: 788969 - protein, 25 aa, Mycobacterium
ADSATPYRTLLALLLKYMSSAKAHG

SEQ ID NO: 788970 - protein, 24 aa, Mycobacterium
ADSDAAPWRQLPFAAAEQNLHRGA

SEQ ID NO: 788971 - protein, 25 aa, Mycobacterium
ADSDDVLPFITLRQWQPISEDETEV

SEQ ID NO: 788972 - protein, 29 aa, Mycobacterium
ADSDLEHWRWMWETNVMGTLRVTRALLPK

SEQ ID NO: 788973 - protein, 29 aa, Mycobacterium
ADSDVAAWPATLDRLLALGGPEAIYVPGH

SEQ ID NO: 788974 - protein, 30 aa, Mycobacterium
ADSGHASWRSVLWARWPGAGPPPQFESADE

SEQ ID NO: 788975 - protein, 25 aa, Mycobacterium
ADSGIGFSCLWPETYIATAAVANGA

SEQ ID NO: 788976 - protein, 32 aa, Mycobacterium
ADSGYASYRNMLWTRWPSSGPPPYFDSVDHYD

SEQ ID NO: 788977 - protein, 31 aa, Mycobacterium
ADSIPDNPWRGSFAQLYLAAVQAGIAARALD

SEQ ID NO: 788978 - protein, 23 aa, Mycobacterium
ADSKRGYYFYRLRRGELFGCGLG

SEQ ID NO: 788979 - protein, 21 aa, Mycobacterium
ADSLGIFDATIPAGPDALDTI

SEQ ID NO: 788980 - protein, 24 aa, Mycobacterium
ADSLGIYLTHLPRPGLTDADRNCI

SEQ ID NO: 788981 - protein, 19 aa, Mycobacterium
ADSLLVASRLLLAISARSI

SEQ ID NO: 788982 - protein, 27 aa, Mycobacterium
ADSSDRIPKWLLPVVHDNLRTGGPVRL

SEQ ID NO: 788983 - protein, 26 aa, Mycobacterium
ADSSFERPFDAIVGRYVLTFQADPAA

SEQ ID NO: 788984 - protein, 26 aa, Mycobacterium
ADSSSGWLFVSSWKADADSLRMRPGD

SEQ ID NO: 788985 - protein, 22 aa, Mycobacterium
ADSTPWPTYPLMFRVSSAHEEG

SEQ ID NO: 788986 - protein, 26 aa, Mycobacterium
ADSVAIDFHKLLFQAISCSALLVRNR

SEQ ID NO: 788987 - protein, 31 aa, Mycobacterium
ADSVGFPPNHPPMRTFLGVPVRIRDEVFGNL

SEQ ID NO: 788988 - protein, 25 aa, Mycobacterium
ADSVQLYLQETLTFLCYTAEAAVPL

SEQ ID NO: 788989 - protein, 30 aa, Mycobacterium
ADSVSLAVMPLFHMAGFGWALAGLWEGAVT

SEQ ID NO: 788990 - protein, 20 aa, Mycobacterium
ADSVWFSELVYSPAVDPFIG

SEQ ID NO: 788991 - protein, 31 aa, Mycobacterium
ADSWIEMESFRLLVLRTAWLIDKHQDYLKVR

SEQ ID NO: 788992 - protein, 24 aa, Mycobacterium
ADSYCRRYRPAARRPQPIDTGMSH

SEQ ID NO: 788993 - protein, 24 aa, Mycobacterium
ADSYGAGFAARAAWRWTKHLHGRA

SEQ ID NO: 788994 - protein, 21 aa, Mycobacterium
ADTADLFIDAIRAILENMGVP

SEQ ID NO: 788995 - protein, 24 aa, Mycobacterium
ADTAGISLFLLDIASAPSGVEVHH

SEQ ID NO: 788996 - protein, 19 aa, Mycobacterium
ADTATALGLAPRAPWHTAR

SEQ ID NO: 788997 - protein, 28 aa, Mycobacterium
ADTDHLELYLFPHTRRVLLLQSTRTDEA

SEQ ID NO: 788998 - protein, 23 aa, Mycobacterium
ADTDLLDQAWWSPGMTHPDGRSA

SEQ ID NO: 788999 - protein, 27 aa, Mycobacterium
ADTDLMDQAWWSPGLTHPDGTSAFALW

SEQ ID NO: 789000 - protein, 28 aa, Mycobacterium
ADTEIARLVPFIEWLRDAYPDHVISADT

SEQ ID NO: 789001 - protein, 25 aa, Mycobacterium
ADTGIGFSCLWPETYIATSAVTNLS

SEQ ID NO: 789002 - protein, 26 aa, Mycobacterium
ADTGSAFWLRTAATLDFDPLTAVHTF

SEQ ID NO: 789003 - protein, 31 aa, Mycobacterium
ADTHDVWLRLHLLSHRLTKPHEANLDGIFGL

SEQ ID NO: 789004 - protein, 25 aa, Mycobacterium
ADTIRRVRLLERGTGSVRWVSPEFL

SEQ ID NO: 789005 - protein, 19 aa, Mycobacterium
ADTLGLPKVLCVHRRFRDG

SEQ ID NO: 789006 - protein, 21 aa, Mycobacterium
ADTLLLLEHPAVYTAGRRTEP

SEQ ID NO: 789007 - protein, 20 aa, Mycobacterium
ADTMHPFFAIAKEINIQFVL

SEQ ID NO: 789008 - protein, 30 aa, Mycobacterium
ADTMTKYILIPTHDLPLLNPLRAVPILGNP

SEQ ID NO: 789009 - protein, 17 aa, Mycobacterium
ADTMWAFLRSKANTIEG

SEQ ID NO: 789010 - protein, 28 aa, Mycobacterium
ADTPELMPLPIALAHRLSRKLTEVRKNG

SEQ ID NO: 789011 - protein, 17 aa, Mycobacterium
ADTRLLAGQRRLASAMA

SEQ ID NO: 789012 - protein, 25 aa, Mycobacterium
ADTRRKAVTFFLHAARRAEIPLSPH

SEQ ID NO: 789013 - protein, 27 aa, Mycobacterium
ADTSGLTLFVVPFDPAAPAQGIEAHHY

SEQ ID NO: 789014 - protein, 35 aa, Mycobacterium
ADTSLLRELNLLTTKPFLYVFNADEAVLTDAARVA

SEQ ID NO: 789015 - protein, 24 aa, Mycobacterium
ADTVAWLRTQPWFTGSFATVGLSY

SEQ ID NO: 789016 - protein, 28 aa, Mycobacterium
ADTVEWLRRQPWFTGRFGTVGLSYLGFT

SEQ ID NO: 789017 - protein, 22 aa, Mycobacterium
ADTVKVPWQAYLSTGHPLLSDQ

SEQ ID NO: 789018 - protein, 19 aa, Mycobacterium
ADTVLHVVLRDGTAVRLRC

SEQ ID NO: 789019 - protein, 25 aa, Mycobacterium
ADTVQLYLQETLTFLCYTAEASVPL

SEQ ID NO: 789020 - protein, 25 aa, Mycobacterium
ADTVQVLPFDVAIPNGFPGTSATFS

SEQ ID NO: 789021 - protein, 21 aa, Mycobacterium
ADTVTLWSKLALESARARRSA

SEQ ID NO: 789022 - protein, 22 aa, Mycobacterium
ADTVVLVGARLNWLLGHGESPQ

SEQ ID NO: 789023 - protein, 29 aa, Mycobacterium
ADTYEWILRNHPGEWMYTQPSWVVTHRPD

SEQ ID NO: 789024 - protein, 21 aa, Mycobacterium
ADVAAFFVLLAVAGNDTTRQT

SEQ ID NO: 789025 - protein, 18 aa, Mycobacterium
ADVAIVWARSEDGILGFV

SEQ ID NO: 789026 - protein, 25 aa, Mycobacterium
ADVAKAWSEFYWLMADELIAREKAL

SEQ ID NO: 789027 - protein, 18 aa, Mycobacterium
ADVALLRRAAAGGADLID

SEQ ID NO: 789028 - protein, 25 aa, Mycobacterium
ADVAPLEMTKWFDTNYHYLVPEIGP

SEQ ID NO: 789029 - protein, 24 aa, Mycobacterium
ADVAPVPREVLVPVLPRDAEGMTS

SEQ ID NO: 789030 - protein, 28 aa, Mycobacterium
ADVAVGTLYRYFPSKVHLLVSALEREFE

SEQ ID NO: 789031 - protein, 24 aa, Mycobacterium
ADVDALLYLPNRDLDRLRKVVDVP

SEQ ID NO: 789032 - protein, 27 aa, Mycobacterium
ADVDDMLWQVPYLPIDPKDVGRTYEAV

SEQ ID NO: 789033 - protein, 22 aa, Mycobacterium
ADVDKPLARYRKIREQWLTARR

SEQ ID NO: 789034 - protein, 24 aa, Mycobacterium
ADVDLAYFTYPIDAGVIPAAANYA

SEQ ID NO: 789035 - protein, 24 aa, Mycobacterium
ADVDLMDQAWWSPGLTHPDGRSAF

SEQ ID NO: 789036 - protein, 21 aa, Mycobacterium
ADVDPLLAPLSNRLPLGCLVG

SEQ ID NO: 789037 - protein, 23 aa, Mycobacterium
ADVDVDVFRRLLGADFTSLPRGD

SEQ ID NO: 789038 - protein, 27 aa, Mycobacterium
ADVEPRMLLVHFLRDQLRLTGTHWGCD

SEQ ID NO: 789039 - protein, 23 aa, Mycobacterium
ADVFGYYTAIAPFMLPHIAGRPV

SEQ ID NO: 789040 - protein, 23 aa, Mycobacterium
ADVFVSYLRRKLEAGGAARVIHT

SEQ ID NO: 789041 - protein, 23 aa, Mycobacterium
ADVGLGYLTLGQPLTTLSGGERQ

SEQ ID NO: 789042 - protein, 19 aa, Mycobacterium
ADVGRFGSFVGAGCDESSC

SEQ ID NO: 789043 - protein, 24 aa, Mycobacterium
ADVGTFIFIATAKEATWAGLASPA

SEQ ID NO: 789044 - protein, 28 aa, Mycobacterium
ADVGTPVIWAARYLSMNGRRRLLGSFNH

SEQ ID NO: 789045 - protein, 29 aa, Mycobacterium
ADVIDGWLVAVPELHSLRAPGHTCLSALE

SEQ ID NO: 789046 - protein, 25 aa, Mycobacterium
ADVIRTRIYVTDISRWREVGDVHAQ

SEQ ID NO: 789047 - protein, 20 aa, Mycobacterium
ADVKIFLTASAEVRAQRRTD

SEQ ID NO: 789048 - protein, 18 aa, Mycobacterium
ADVLGRALVVRRLDMLPV

SEQ ID NO: 789049 - protein, 21 aa, Mycobacterium
ADVLLTAMRPSALRRLGLDDA

SEQ ID NO: 789050 - protein, 18 aa, Mycobacterium
ADVLPLTKSASGGELSRV

SEQ ID NO: 789051 - protein, 22 aa, Mycobacterium
ADVLPLTPLQQGLLFHADAARG

SEQ ID NO: 789052 - protein, 22 aa, Mycobacterium
ADVLQAAGKYPPPPGASEIIGM

SEQ ID NO: 789053 - protein, 20 aa, Mycobacterium
ADVLRAWGKLGYPRRAKRLH

SEQ ID NO: 789054 - protein, 21 aa, Mycobacterium
ADVLRAWGKLGYPRRAKRLHE

SEQ ID NO: 789055 - protein, 22 aa, Mycobacterium
ADVLRAWGKLGYPRRAKRLHEC

SEQ ID NO: 789056 - protein, 24 aa, Mycobacterium
ADVLRPWRVPTRGLVYAKELVDLS

SEQ ID NO: 789057 - protein, 26 aa, Mycobacterium
ADVPGVLFFAYAISAAVDWLYSGLPS

SEQ ID NO: 789058 - protein, 17 aa, Mycobacterium
ADVPQFLAIARAAAERA

SEQ ID NO: 789059 - protein, 19 aa, Mycobacterium
ADVPRWRGYYQAHDQAPHY

SEQ ID NO: 789060 - protein, 24 aa, Mycobacterium
ADVPYAYLVTLHIPAGTPSVLDRI

SEQ ID NO: 789061 - protein, 25 aa, Mycobacterium
ADVQRLAAMLIERDGRIWLERGCPT

SEQ ID NO: 789062 - protein, 22 aa, Mycobacterium
ADVQRWPLAATGTSIYWTGLNK

SEQ ID NO: 789063 - protein, 18 aa, Mycobacterium
ADVRAMFAPKLDAAALLH

SEQ ID NO: 789064 - protein, 17 aa, Mycobacterium
ADVRFVYSPLDALKIAL

SEQ ID NO: 789065 - protein, 31 aa, Mycobacterium
ADVRIAGPAALFDARFQKLGLHPGGGATWML

SEQ ID NO: 789066 - protein, 22 aa, Mycobacterium
ADVRLWVDRAFTVRGAGTVVTG

SEQ ID NO: 789067 - protein, 19 aa, Mycobacterium
ADVRWRMSAGMPATIYRPS

SEQ ID NO: 789068 - protein, 26 aa, Mycobacterium
ADVSQRVGLPGIWYAGSHGFELTAPD

SEQ ID NO: 789069 - protein, 28 aa, Mycobacterium
ADVTMEAWNFRWLCVGPVERDDVGLVLM

SEQ ID NO: 789070 - protein, 25 aa, Mycobacterium
ADVTPLEMTKWFDTNYHYLVPEIGP

SEQ ID NO: 789071 - protein, 26 aa, Mycobacterium
ADVVISQPFWPAYLSAERIAKAPKLK

SEQ ID NO: 789072 - protein, 20 aa, Mycobacterium
ADVVNRVWFLDAVRGEMDVY

SEQ ID NO: 789073 - protein, 24 aa, Mycobacterium
ADVVTPPHDLGPRFTFVTADVTDE

SEQ ID NO: 789074 - protein, 19 aa, Mycobacterium
ADVWGLLVDGRFGNGLPPA

SEQ ID NO: 789075 - protein, 27 aa, Mycobacterium
ADVYQARKFVIWTLRGRHPELTEEALR

SEQ ID NO: 789076 - protein, 18 aa, Mycobacterium
ADWCLLLARTDREAHRHR

SEQ ID NO: 789077 - protein, 28 aa, Mycobacterium
ADWEPTMEALLLGAFISEGFVSEARAGF

SEQ ID NO: 789078 - protein, 18 aa, Mycobacterium
ADWGIDLVPIPTGSMVQG

SEQ ID NO: 789079 - protein, 20 aa, Mycobacterium
ADWITGWHRDKNHPHPSGKP

SEQ ID NO: 789080 - protein, 20 aa, Mycobacterium
ADWLGDGWVSLLRKWIDDAE

SEQ ID NO: 789081 - protein, 20 aa, Mycobacterium
ADWLIGKDILGPRALDKGYT

SEQ ID NO: 789082 - protein, 18 aa, Mycobacterium
ADWLLTFVRTDPDAPKHK

SEQ ID NO: 789083 - protein, 18 aa, Mycobacterium
ADWLNPDGTYRLSAPFPS

SEQ ID NO: 789084 - protein, 23 aa, Mycobacterium
ADWPGMTLCFLEESLGNHREALA

SEQ ID NO: 789085 - protein, 24 aa, Mycobacterium
ADWPISYADLRPHYERLELELPVA

SEQ ID NO: 789086 - protein, 19 aa, Mycobacterium
ADWTAECDVLVAGSGGGGV

SEQ ID NO: 789087 - protein, 20 aa, Mycobacterium
ADWTRLPYEVLERISTRITN

SEQ ID NO: 789088 - protein, 17 aa, Mycobacterium
ADWYGTEAALVYNSGYL

SEQ ID NO: 789089 - protein, 20 aa, Mycobacterium
ADYGLYLPVIIDDPRERGRY

SEQ ID NO: 789090 - protein, 20 aa, Mycobacterium
ADYGQYLRSLVDTSGLRPLR

SEQ ID NO: 789091 - protein, 19 aa, Mycobacterium
ADYIDVLRFAIPEAVANAG

SEQ ID NO: 789092 - protein, 28 aa, Mycobacterium
ADYIREQLPGLWLLASLYFRADVRGLDR

SEQ ID NO: 789093 - protein, 24 aa, Mycobacterium
ADYKGFERIAHLAYVPLAGGDVSV

SEQ ID NO: 789094 - protein, 20 aa, Mycobacterium
ADYKTLFREFGFTAQAVAAA

SEQ ID NO: 789095 - protein, 22 aa, Mycobacterium
ADYLAVHILPRDQPALAELFGG

SEQ ID NO: 789096 - protein, 18 aa, Mycobacterium
ADYLMWVHRDDDAFVCVA

SEQ ID NO: 789097 - protein, 27 aa, Mycobacterium
ADYLNARPITTPFGLYDCDVPCDGAIA

SEQ ID NO: 789098 - protein, 29 aa, Mycobacterium
ADYLRRMGELFAPFTKIAAGNPFAAAPIE

SEQ ID NO: 789099 - protein, 31 aa, Mycobacterium
ADYMATRGIGFLGWNTRFRGFESSFVLDHAL

SEQ ID NO: 789100 - protein, 18 aa, Mycobacterium
ADYPDWFVGIRQNGVVIG

SEQ ID NO: 789101 - protein, 19 aa, Mycobacterium
ADYPLGFAEAQLPSGAALA

SEQ ID NO: 789102 - protein, 26 aa, Mycobacterium
ADYPPLRMMFDRCVEFLPALRSAAPD

SEQ ID NO: 789103 - protein, 32 aa, Mycobacterium
ADYQLSWFDHVFYISVWWGWQDHFREIVNVDP

SEQ ID NO: 789104 - protein, 20 aa, Mycobacterium
ADYRAVLAAINALGANERDH

SEQ ID NO: 789105 - protein, 27 aa, Mycobacterium
ADYRPLDGFVYAITPFNFTSIAGNLPT

SEQ ID NO: 789106 - protein, 27 aa, Mycobacterium
ADYTITIPHIPITVGGGGILKLPLTGE

SEQ ID NO: 789107 - protein, 18 aa, Mycobacterium
ADYVLWQRDAFAPDSEFG

SEQ ID NO: 789108 - protein, 19 aa, Mycobacterium
ADYYPTGGRWNNWAEFFHS

SEQ ID NO: 789109 - protein, 18 aa, Mycobacterium
AEAAAASPLQTLEQQLLG

SEQ ID NO: 789110 - protein, 32 aa, Mycobacterium
AEAAERLGVLGLPFLFFIDAAQGRAGVLYHRY

SEQ ID NO: 789111 - protein, 18 aa, Mycobacterium
AEAAFGYGDLPVACSSLG

SEQ ID NO: 789112 - protein, 18 aa, Mycobacterium
AEAAFVLAMIGVDLSRLA

SEQ ID NO: 789113 - protein, 26 aa, Mycobacterium
AEAAGDGFARFWLHNGWVTMGGEKMS

SEQ ID NO: 789114 - protein, 30 aa, Mycobacterium
AEAAGFASLWTYERLLFPADPVESYAGTDA

SEQ ID NO: 789115 - protein, 25 aa, Mycobacterium
AEAAGLFRDYRGRRYWFCCKGCGPR

SEQ ID NO: 789116 - protein, 25 aa, Mycobacterium
AEAAGLLADLRRLSVGVKLITGDHP

SEQ ID NO: 789117 - protein, 21 aa, Mycobacterium
AEAAGWNHRVAERSDYFDKGV

SEQ ID NO: 789118 - protein, 26 aa, Mycobacterium
AEAAILSGMLPYGPPRRWQKSKDPDQ

SEQ ID NO: 789119 - protein, 25 aa, Mycobacterium
AEAAKLIRAAERPVLFVGLRVGDPA

SEQ ID NO: 789120 - protein, 17 aa, Mycobacterium
AEAALLRVDSRNQVLVS

SEQ ID NO: 789121 - protein, 20 aa, Mycobacterium
AEAALRERFGYDAWVLAYDI

SEQ ID NO: 789122 - protein, 45 aa, Mycobacterium
AEAANASPLQTLEQDLLAGINAPSQMLTGRPLIGNGANGVDGTGA

SEQ ID NO: 789123 - protein, 26 aa, Mycobacterium
AEAAPFIGFPIPPMIHGATQAATFMA

SEQ ID NO: 789124 - protein, 30 aa, Mycobacterium
AEAASAAALAQVWGATAGPTAVLSGAYEAA

SEQ ID NO: 789125 - protein, 26 aa, Mycobacterium
AEAATLTPFMWLRPITNPSGSTLRSA

SEQ ID NO: 789126 - protein, 23 aa, Mycobacterium
AEAAVEHLFAVASGLDSAVVGEQ

SEQ ID NO: 789127 - protein, 19 aa, Mycobacterium
AEAAVRELLLAIGEDPDRG

SEQ ID NO: 789128 - protein, 24 aa, Mycobacterium
AEADHIASFALPIDDLDLTVRSYN

SEQ ID NO: 789129 - protein, 23 aa, Mycobacterium
AEADHIASFALPIEDLDLTVRSY

SEQ ID NO: 789130 - protein, 26 aa, Mycobacterium
AEADRPPLLAWMVQALIQPDTAHPIP

SEQ ID NO: 789131 - protein, 23 aa, Mycobacterium
AEADWFDVVDFGGVGGASWSAYL

SEQ ID NO: 789132 - protein, 23 aa, Mycobacterium
AEAEDFYLRYNCDTYVMGIAGVD

SEQ ID NO: 789133 - protein, 21 aa, Mycobacterium
AEAEFYALLAARQAERASLPS

SEQ ID NO: 789134 - protein, 20 aa, Mycobacterium
AEAFHPYLRELFAQKKSITT

SEQ ID NO: 789135 - protein, 18 aa, Mycobacterium
AEAFLPGGRAPKPGERFS

SEQ ID NO: 789136 - protein, 25 aa, Mycobacterium
AEAFQYVRDFLSFLPSNCFGKPPAI

SEQ ID NO: 789137 - protein, 27 aa, Mycobacterium
AEAFQYVRDFLSFLPSSTFGKPPVVNP

SEQ ID NO: 789138 - protein, 24 aa, Mycobacterium
AEAFQYVRDFLSFLPSSTFGQPPI

SEQ ID NO: 789139 - protein, 25 aa, Mycobacterium
AEAFSFNVLSGHALLRAAVPHLLKS

SEQ ID NO: 789140 - protein, 25 aa, Mycobacterium
AEAFSRYGAHLPKINVLPIYGGSSY

SEQ ID NO: 789141 - protein, 25 aa, Mycobacterium
AEAFSRYGAYLPKLNVLPIYGGSSY

SEQ ID NO: 789142 - protein, 22 aa, Mycobacterium
AEAGHLVRFWALPAGPDGPRML

SEQ ID NO: 789143 - protein, 26 aa, Mycobacterium
AEAGQFLAQLQWRPAGLGPEAMVSAQ

SEQ ID NO: 789144 - protein, 24 aa, Mycobacterium
AEAGVNLVLIARKPGPLQDTAQRC

SEQ ID NO: 789145 - protein, 25 aa, Mycobacterium
AEAGVRTLWLGQMYHYDSITMAAVV

SEQ ID NO: 789146 - protein, 25 aa, Mycobacterium
AEAHLARLAGQFRPDQLAKLAQRLM

SEQ ID NO: 789147 - protein, 25 aa, Mycobacterium
AEAHLARLATRFRPDQLAKLAQRLM

SEQ ID NO: 789148 - protein, 27 aa, Mycobacterium
AEAHVMYVLSRIMPPLARWVSAQMAKA

SEQ ID NO: 789149 - protein, 19 aa, Mycobacterium
AEAIALRPDGRPHRFQVTA

SEQ ID NO: 789150 - protein, 23 aa, Mycobacterium
AEAIAYIVAQPRRVAVNEIVIRP

SEQ ID NO: 789151 - protein, 17 aa, Mycobacterium
AEAIFATVAPGVEAAPR

SEQ ID NO: 789152 - protein, 18 aa, Mycobacterium
AEAILQRHTDRLPLGRPT

SEQ ID NO: 789153 - protein, 20 aa, Mycobacterium
AEAIVKLVAHPRPRVRVTKT

SEQ ID NO: 789154 - protein, 25 aa, Mycobacterium
AEAKVPWVLMHWRSVSAQRPHAAPD

SEQ ID NO: 789155 - protein, 19 aa, Mycobacterium
AEALALQRAYPDELSGIVL

SEQ ID NO: 789156 - protein, 28 aa, Mycobacterium
AEALAYGDMGLALPILAPGGVASALTHW

SEQ ID NO: 789157 - protein, 29 aa, Mycobacterium
AEALAYGDMGLALPLLAPGGVASALTHWG

SEQ ID NO: 789158 - protein, 24 aa, Mycobacterium
AEALGLPWGAVLGAWRADTLMWLR

SEQ ID NO: 789159 - protein, 27 aa, Mycobacterium
AEALGQGWFWPAAAAHPSLPRGALLQI

SEQ ID NO: 789160 - protein, 24 aa, Mycobacterium
AEALKPARLLVSGSAALPVPVFDK

SEQ ID NO: 789161 - protein, 17 aa, Mycobacterium
AEALLAEVARTGSLELP

SEQ ID NO: 789162 - protein, 22 aa, Mycobacterium
AEALPHAYPRHTRPTDAEFTPL

SEQ ID NO: 789163 - protein, 23 aa, Mycobacterium
AEALPPMTPPSRRRAKVLGLRTR

SEQ ID NO: 789164 - protein, 18 aa, Mycobacterium
AEALQAPIYLHPTTPHPA

SEQ ID NO: 789165 - protein, 17 aa, Mycobacterium
AEALRELPPKRRYELFR

SEQ ID NO: 789166 - protein, 24 aa, Mycobacterium
AEALRERLPRVAALFARGAVSTRV

SEQ ID NO: 789167 - protein, 25 aa, Mycobacterium
AEALRGPFWRWSPGLRAGIKLMHNP

SEQ ID NO: 789168 - protein, 22 aa, Mycobacterium
AEALRPARLLVSGSAALPVPVF

SEQ ID NO: 789169 - protein, 19 aa, Mycobacterium
AEALRPPNWIPWEERIRPG

SEQ ID NO: 789170 - protein, 17 aa, Mycobacterium
AEALRVIFPPGFAERIG

SEQ ID NO: 789171 - protein, 23 aa, Mycobacterium
AEALRVWPRDGLPDRPGGWLVTV

SEQ ID NO: 789172 - protein, 22 aa, Mycobacterium
AEALRWAMMAGEPHVVLADALA

SEQ ID NO: 789173 - protein, 23 aa, Mycobacterium
AEALSLLQRCSAALAAPAEVVPA

SEQ ID NO: 789174 - protein, 28 aa, Mycobacterium
AEALSYGDMGLALPILAPSGVASALTNW

SEQ ID NO: 789175 - protein, 26 aa, Mycobacterium
AEALWAELSRTLPEPWRVEALVLLAF

SEQ ID NO: 789176 - protein, 40 aa, Mycobacterium
AEAMLHSDYPLQALLYCAVLHRFLRWRIRDYDPDRHLGGV

SEQ ID NO: 789177 - protein, 22 aa, Mycobacterium
AEAMLIRPDAHLAWRGAPDDTA

SEQ ID NO: 789178 - protein, 25 aa, Mycobacterium
AEANKRLLYVYYTNKETLFDIVVAH

SEQ ID NO: 789179 - protein, 18 aa, Mycobacterium
AEAPLPQGAAPSGAATAP

SEQ ID NO: 789180 - protein, 19 aa, Mycobacterium
AEAPRQFSWSILNRSGELQ

SEQ ID NO: 789181 - protein, 22 aa, Mycobacterium
AEAPWDPRTVLRRLADADPAAT

SEQ ID NO: 789182 - protein, 32 aa, Mycobacterium
AEAQIGWAAWNPQRRARVLMRFIELVNQNTDE

SEQ ID NO: 789183 - protein, 18 aa, Mycobacterium
AEAQRRGTRYWDPLATLG

SEQ ID NO: 789184 - protein, 19 aa, Mycobacterium
AEAQYEAMWAADVSAMTGY

SEQ ID NO: 789185 - protein, 18 aa, Mycobacterium
AEARCLVFPIQWEEPFGM

SEQ ID NO: 789186 - protein, 28 aa, Mycobacterium
AEARIEIEMIRLLTLKAAYLMDTVGNKQ

SEQ ID NO: 789187 - protein, 23 aa, Mycobacterium
AEARIIDEYLPTPLTEAELADVA

SEQ ID NO: 789188 - protein, 23 aa, Mycobacterium
AEARIIDEYLPTPLTEAELADVV

SEQ ID NO: 789189 - protein, 24 aa, Mycobacterium
AEARLRQAPVLVLGDRREGDAFIY

SEQ ID NO: 789190 - protein, 26 aa, Mycobacterium
AEARNALKLSWRYIEAFEAEAAALYA

SEQ ID NO: 789191 - protein, 25 aa, Mycobacterium
AEARSLFDLNVFGLINVTRAVLPHM

SEQ ID NO: 789192 - protein, 23 aa, Mycobacterium
AEARVGWRLMLAGPASVCLRVRA

SEQ ID NO: 789193 - protein, 25 aa, Mycobacterium
AEATAAAWLVSAPPSVVVGGVVNGA

SEQ ID NO: 789194 - protein, 33 aa, Mycobacterium
AEAVLMVTTLDEPPLRLLLGRDVLKAMRDKIAA

SEQ ID NO: 789195 - protein, 24 aa, Mycobacterium
AEAWDGLAAELRLAASSFESVTAN

SEQ ID NO: 789196 - protein, 21 aa, Mycobacterium
AEAWPVLCQHLALVAADGRDP

SEQ ID NO: 789197 - protein, 20 aa, Mycobacterium
AEAWRQISSTPAPLPAVSPD

SEQ ID NO: 789198 - protein, 22 aa, Mycobacterium
AEAWRRVAATPPPLPAPRSTTD

SEQ ID NO: 789199 - protein, 23 aa, Mycobacterium
AEAYLQEALRWLPADINAGAALP

SEQ ID NO: 789200 - protein, 22 aa, Mycobacterium
AEAYPFMTPIFGKGVVFDASPE

SEQ ID NO: 789201 - protein, 28 aa, Mycobacterium
AEAYQYVRDYLSFLPSNHFDNPPIVNPG

SEQ ID NO: 789202 - protein, 27 aa, Mycobacterium
AEAYRAISLLLRRPPGREAYPGDVFYL

SEQ ID NO: 789203 - protein, 20 aa, Mycobacterium
AECAAILRFRENGGGVLTAR

SEQ ID NO: 789204 - protein, 27 aa, Mycobacterium
AECDPLWLRRRVGMCFQRPTPFAGTVA

SEQ ID NO: 789205 - protein, 24 aa, Mycobacterium
AECGRLIRPVTLELGGKSAAVILD

SEQ ID NO: 789206 - protein, 17 aa, Mycobacterium
AECVLLETLVLSILNHD

SEQ ID NO: 789207 - protein, 24 aa, Mycobacterium
AEDAEWYYNFANPGDVVEIRNTGG

SEQ ID NO: 789208 - protein, 31 aa, Mycobacterium
AEDASRAMIWQRPRWAVRLQPATVSDLFAEA

SEQ ID NO: 789209 - protein, 26 aa, Mycobacterium
AEDDLAILGYWLTSQAPPAMRLCHHL

SEQ ID NO: 789210 - protein, 23 aa, Mycobacterium
AEDDWAGMYLLAAASFTDFIGAE

SEQ ID NO: 789211 - protein, 18 aa, Mycobacterium
AEDFGFLGAVFALDQPAT

SEQ ID NO: 789212 - protein, 17 aa, Mycobacterium
AEDFRIIDRISGQPRGA

SEQ ID NO: 789213 - protein, 25 aa, Mycobacterium
AEDGAGWLTFLRSLTARGLSGVRLV

SEQ ID NO: 789214 - protein, 23 aa, Mycobacterium
AEDIAHIVAFLSTALYTDDDDLF

SEQ ID NO: 789215 - protein, 23 aa, Mycobacterium
AEDLASLEFLISASGPLDPETRD

SEQ ID NO: 789216 - protein, 17 aa, Mycobacterium
AEDLFAATWGTNNRWPD

SEQ ID NO: 789217 - protein, 23 aa, Mycobacterium
AEDLKGRAKEAFGAATNNDDLKA

SEQ ID NO: 789218 - protein, 38 aa, Mycobacterium
AEDLWTVLARVLPGAWRAEALALLAVSAYVRGDGVLAG

SEQ ID NO: 789219 - protein, 20 aa, Mycobacterium
AEDPLAERIEFVRKAAGERF

SEQ ID NO: 789220 - protein, 25 aa, Mycobacterium
AEDPQPMRFYNALGAIRAVLQANPD

SEQ ID NO: 789221 - protein, 21 aa, Mycobacterium
AEDPQWGAYLARREKLVEDLA

SEQ ID NO: 789222 - protein, 24 aa, Mycobacterium
AEDQALIITLPVTDAPYLGFQLGS

SEQ ID NO: 789223 - protein, 19 aa, Mycobacterium
AEDRGAFGDVLTAAGLPAP

SEQ ID NO: 789224 - protein, 20 aa, Mycobacterium
AEDRGAFGDVLTAAGLPAPR

SEQ ID NO: 789225 - protein, 29 aa, Mycobacterium
AEDRGVFGDLLVSAGLPAPRFGTATTFEQ

SEQ ID NO: 789226 - protein, 24 aa, Mycobacterium
AEDRVLFFDITFAPLVSGLASSFD

SEQ ID NO: 789227 - protein, 26 aa, Mycobacterium
AEDVRQRYKLLLAASTRAAAGDPRGA

SEQ ID NO: 789228 - protein, 29 aa, Mycobacterium
AEDWDLDALWTALKTLYPVGIKADTLMRR

SEQ ID NO: 789229 - protein, 21 aa, Mycobacterium
AEDYIELLPSCWRRINAYGIR

SEQ ID NO: 789230 - protein, 29 aa, Mycobacterium
AEDYSRTLEILEKFYSVVLTDCGTGLMHS

SEQ ID NO: 789231 - protein, 27 aa, Mycobacterium
AEEAGHFGFLALFAALDNPTSSALTQK

SEQ ID NO: 789232 - protein, 22 aa, Mycobacterium
AEEALCRWMAAAALVRSRADGG

SEQ ID NO: 789233 - protein, 24 aa, Mycobacterium
AEEALIHVLWINAGLSCDGDSVAL

SEQ ID NO: 789234 - protein, 30 aa, Mycobacterium
AEEALRDWLFRVTWALRIWHDLPNCIATAH

SEQ ID NO: 789235 - protein, 28 aa, Mycobacterium
AEEDLAILGFWLTTQAPPAMRLCHHLHG

SEQ ID NO: 789236 - protein, 23 aa, Mycobacterium
AEEDWLAQMQKAFPGRFIVNRIE

SEQ ID NO: 789237 - protein, 24 aa, Mycobacterium
AEEEAFVLLALQAPVAGDLRAIVS

SEQ ID NO: 789238 - protein, 19 aa, Mycobacterium
AEEERIEMWLRADRPQRVR

SEQ ID NO: 789239 - protein, 24 aa, Mycobacterium
AEEFAYLRKTEPIWWNAQPRGVAG

SEQ ID NO: 789240 - protein, 24 aa, Mycobacterium
AEEFGRWFGVRFDGPFVAGTSVTA

SEQ ID NO: 789241 - protein, 24 aa, Mycobacterium
AEEFNSLFFRNAVNAGLPAMTVPG

SEQ ID NO: 789242 - protein, 24 aa, Mycobacterium
AEEFNSLFFRNAVNAGLPAMTVPH

SEQ ID NO: 789243 - protein, 25 aa, Mycobacterium
AEEFRFHIGLAQLAGNALLDLFLRI

SEQ ID NO: 789244 - protein, 26 aa, Mycobacterium
AEEFVYLLNVTVRPGYNFASPDAALT

SEQ ID NO: 789245 - protein, 26 aa, Mycobacterium
AEEGRLFTRFLAMLPTNESMVEELLA

SEQ ID NO: 789246 - protein, 25 aa, Mycobacterium
AEEGRLFTRFLKMLPTNQTMIEELL

SEQ ID NO: 789247 - protein, 24 aa, Mycobacterium
AEEITTLAQLLLARPDALPHDLAG

SEQ ID NO: 789248 - protein, 24 aa, Mycobacterium
AEEKPYTRRPYPPFMTSTLQQEAG

SEQ ID NO: 789249 - protein, 18 aa, Mycobacterium
AEEKWKPGLPAPRDEFHI

SEQ ID NO: 789250 - protein, 18 aa, Mycobacterium
AEELGFPGATSAALAWAV

SEQ ID NO: 789251 - protein, 21 aa, Mycobacterium
AEELGLDWLVEIGAHGVVAGP

SEQ ID NO: 789252 - protein, 18 aa, Mycobacterium
AEELRRLWRARRVLAVTF

SEQ ID NO: 789253 - protein, 27 aa, Mycobacterium
AEELRRLWRARRVLAVTFPAHSSSTET

SEQ ID NO: 789254 - protein, 27 aa, Mycobacterium
AEENLRFELDRYLGWPGQAPSYAIGQR

SEQ ID NO: 789255 - protein, 18 aa, Mycobacterium
AEENYWFRRHEVVYERLS

SEQ ID NO: 789256 - protein, 19 aa, Mycobacterium
AEEPPLQAVLTILRDVTGN

SEQ ID NO: 789257 - protein, 30 aa, Mycobacterium
AEEPVAPVVPLFISGFLSSRKKAAAAALAD

SEQ ID NO: 789258 - protein, 27 aa, Mycobacterium
AEEQMAALLMAILLRGMDRGETARWTS

SEQ ID NO: 789259 - protein, 27 aa, Mycobacterium
AEEQMSALLMAIFLRGMDDGETASWTA

SEQ ID NO: 789260 - protein, 24 aa, Mycobacterium
AEEQMSVGWYASFIPFIVDMSDDS

SEQ ID NO: 789261 - protein, 22 aa, Mycobacterium
AEEQWFSPQQLQWVSRLMREMP

SEQ ID NO: 789262 - protein, 40 aa, Mycobacterium
AEERLEKICRLIMLYHLDRGWCEHLAFLADIRESIHLRAL

SEQ ID NO: 789263 - protein, 27 aa, Mycobacterium
AEERRAFITDVSLIGGLIIAAVDTEGK

SEQ ID NO: 789264 - protein, 19 aa, Mycobacterium
AEERRLAYVGITRARQRLY

SEQ ID NO: 789265 - protein, 24 aa, Mycobacterium
AEETLIHVLWINAGLSCDGDSVAL

SEQ ID NO: 789266 - protein, 21 aa, Mycobacterium
AEEVARVWALLGLTVTGPDVA

SEQ ID NO: 789267 - protein, 23 aa, Mycobacterium
AEEVMAPLGPILVAAAGIGPGVR

SEQ ID NO: 789268 - protein, 22 aa, Mycobacterium
AEEVRRYFGTKVLRTVIPRSVK

SEQ ID NO: 789269 - protein, 24 aa, Mycobacterium
AEEVSRRRTAYDSALWDLGHEDDI

SEQ ID NO: 789270 - protein, 17 aa, Mycobacterium
AEEWTYRFLAAAHAWAV

SEQ ID NO: 789271 - protein, 21 aa, Mycobacterium
AEEYLQVCYKLWEGSWESGAV

SEQ ID NO: 789272 - protein, 23 aa, Mycobacterium
AEEYVRWFERNGLTAVRVGERSL

SEQ ID NO: 789273 - protein, 17 aa, Mycobacterium
AEFALGGATGQLRRIGR

SEQ ID NO: 789274 - protein, 25 aa, Mycobacterium
AEFEKNYFPIYSATSKVQTWDIYAC

SEQ ID NO: 789275 - protein, 19 aa, Mycobacterium
AEFFAQYHDIVTARSRRVP

SEQ ID NO: 789276 - protein, 17 aa, Mycobacterium
AEFFGLMRQFGEGSGQP

SEQ ID NO: 789277 - protein, 19 aa, Mycobacterium
AEFGDRLPVILLDGREHSY

SEQ ID NO: 789278 - protein, 22 aa, Mycobacterium
AEFGGWLMPVSYAGTVSEHNAT

SEQ ID NO: 789279 - protein, 18 aa, Mycobacterium
AEFGMTWRSPRDAIIATF

SEQ ID NO: 789280 - protein, 23 aa, Mycobacterium
AEFGNLPFERLFEPAISHGRKGF

SEQ ID NO: 789281 - protein, 18 aa, Mycobacterium
AEFGPRALGGRSLLADPR

SEQ ID NO: 789282 - protein, 25 aa, Mycobacterium
AEFGQLHLWYFGDAARRQQSELPPR

SEQ ID NO: 789283 - protein, 19 aa, Mycobacterium
AEFGVRLYPMGNLEQGIVH

SEQ ID NO: 789284 - protein, 20 aa, Mycobacterium
AEFHLSYVFVSHNLAVVRKL

SEQ ID NO: 789285 - protein, 23 aa, Mycobacterium
AEFHWITGCIAAQRFSFCSLCFR

SEQ ID NO: 789286 - protein, 19 aa, Mycobacterium
AEFINLKRQGELALFASCR

SEQ ID NO: 789287 - protein, 24 aa, Mycobacterium
AEFLDLPRLALADAALSAATAAGA

SEQ ID NO: 789288 - protein, 19 aa, Mycobacterium
AEFLSMDIALAIVDGVDGA

SEQ ID NO: 789289 - protein, 23 aa, Mycobacterium
AEFLTDLFGLPKPVAVGHFMVVP

SEQ ID NO: 789290 - protein, 19 aa, Mycobacterium
AEFNVEGLATVIPFHRAVV

SEQ ID NO: 789291 - protein, 20 aa, Mycobacterium
AEFPEHREVGGRRAGRLVAP

SEQ ID NO: 789292 - protein, 18 aa, Mycobacterium
AEFQKITQDLLDRTRKPF

SEQ ID NO: 789293 - protein, 24 aa, Mycobacterium
AEFSRYFTHILPSGPVQGDTPEEI

SEQ ID NO: 789294 - protein, 24 aa, Mycobacterium
AEFTKLFDMLARTRPQAAARIILT

SEQ ID NO: 789295 - protein, 19 aa, Mycobacterium
AEFTVEGLATVIPFHRAVV

SEQ ID NO: 789296 - protein, 26 aa, Mycobacterium
AEFVDWQLSRAWSEDLLSRRERVIMA

SEQ ID NO: 789297 - protein, 35 aa, Mycobacterium
AEFVSMIFSVQYRLPGYYRWLLYEADHAGAYRFHR

SEQ ID NO: 789298 - protein, 19 aa, Mycobacterium
AEFVVTLLAASRADLVVVP

SEQ ID NO: 789299 - protein, 29 aa, Mycobacterium
AEFWFDPLCPWCWITSRWILEVQKVRDIE

SEQ ID NO: 789300 - protein, 20 aa, Mycobacterium
AEFYAGLLASYPLVSIEDPL

SEQ ID NO: 789301 - protein, 21 aa, Mycobacterium
AEFYDLPLATLHHVPMRPNGQ

SEQ ID NO: 789302 - protein, 40 aa, Mycobacterium
AEFYGIPLVALHTMPWRPNGQLFPVLPPMLTRTGMTAYDW

SEQ ID NO: 789303 - protein, 24 aa, Mycobacterium
AEFYRRCATVTTRLWPTLTEPLQT

SEQ ID NO: 789304 - protein, 22 aa, Mycobacterium
AEGAAMFVLQRKSAALRAGRRV

SEQ ID NO: 789305 - protein, 24 aa, Mycobacterium
AEGAAMFVLQRKSAALRNGRRVLA

SEQ ID NO: 789306 - protein, 25 aa, Mycobacterium
AEGAFLLCGFLMALADHQQGNNLAA

SEQ ID NO: 789307 - protein, 28 aa, Mycobacterium
AEGAPATLDPVFLPAFESAADDAARTRV

SEQ ID NO: 789308 - protein, 27 aa, Mycobacterium
AEGAQTLIRLLRPYAPDAEITAVHDTQ

SEQ ID NO: 789309 - protein, 19 aa, Mycobacterium
AEGASITRTLLLPGNRSDI

SEQ ID NO: 789310 - protein, 26 aa, Mycobacterium
AEGDDLPLTVYYHGGGWLLGSVDSHD

SEQ ID NO: 789311 - protein, 19 aa, Mycobacterium
AEGDLHHQALRALGNRLVG

SEQ ID NO: 789312 - protein, 31 aa, Mycobacterium
AEGDRLWQYWRDQLAGELPKLGLATDRPRSA

SEQ ID NO: 789313 - protein, 24 aa, Mycobacterium
AEGDSVILTFLPSCGHCSYCARGM

SEQ ID NO: 789314 - protein, 19 aa, Mycobacterium
AEGFDFVAMGRALLAEPDL

SEQ ID NO: 789315 - protein, 22 aa, Mycobacterium
AEGFPEWIPRTLAPGSRLSGVA

SEQ ID NO: 789316 - protein, 27 aa, Mycobacterium
AEGGLNWDSLPLKLFAGGNAKFWNPAD

SEQ ID NO: 789317 - protein, 23 aa, Mycobacterium
AEGGNFVVPVWRSMYEGMQPGGY

SEQ ID NO: 789318 - protein, 20 aa, Mycobacterium
AEGGPYRIFTTDEATEYVLA

SEQ ID NO: 789319 - protein, 24 aa, Mycobacterium
AEGHAAKVLNLRSTLLTLAGGDAM

SEQ ID NO: 789320 - protein, 23 aa, Mycobacterium
AEGHAAKVLNLRSTLLTLSGGDA

SEQ ID NO: 789321 - protein, 24 aa, Mycobacterium
AEGHAVKVLNLRSTLLTIAGGDPM

SEQ ID NO: 789322 - protein, 25 aa, Mycobacterium
AEGHKWAMLTVYDYSTARAFDDAGI

SEQ ID NO: 789323 - protein, 27 aa, Mycobacterium
AEGIGSLDLIRILPASRRHLGRELSVL

SEQ ID NO: 789324 - protein, 22 aa, Mycobacterium
AEGIVASFRHALQSVGAAVPDG

SEQ ID NO: 789325 - protein, 33 aa, Mycobacterium
AEGLFDARLKRPVPFLPARIGLITGRASAAEHD

SEQ ID NO: 789326 - protein, 32 aa, Mycobacterium
AEGLFDPRLKRPIPFLPDTIGLITGRASAAEH

SEQ ID NO: 789327 - protein, 33 aa, Mycobacterium; identical to SEQ ID NO: 123721

SEQ ID NO: 789328 - protein, 32 aa, Mycobacterium
AEGLFDPRLKRPIPFLPNMVGLITGRASAAER

SEQ ID NO: 789329 - protein, 31 aa, Mycobacterium
AEGLFDPRLKRPIPFLPNTVGLITGRASAAE

SEQ ID NO: 789330 - protein, 17 aa, Mycobacterium
AEGLKQAAALMEGHEAD

SEQ ID NO: 789331 - protein, 19 aa, Mycobacterium
AEGLLHYLPAWAHGVLFER

SEQ ID NO: 789332 - protein, 19 aa, Mycobacterium
AEGLLMYLQPEQALALISE

SEQ ID NO: 789333 - protein, 17 aa, Mycobacterium
AEGLLNFTRLEDPPDLL

SEQ ID NO: 789334 - protein, 21 aa, Mycobacterium
AEGLLPYLPPEAQDRLFDNIT

SEQ ID NO: 789335 - protein, 32 aa, Mycobacterium
AEGLPHIPVRLHARSWHRYPEPPPHATAMIIY

SEQ ID NO: 789336 - protein, 23 aa, Mycobacterium
AEGLPLTPELLFEHATVRQIAAA

SEQ ID NO: 789337 - protein, 24 aa, Mycobacterium
AEGLRAFCDICVAAFAGFAIVKPQ

SEQ ID NO: 789338 - protein, 20 aa, Mycobacterium
AEGLRALYLYAAAHQDNAVA

SEQ ID NO: 789339 - protein, 26 aa, Mycobacterium
AEGLRRLFRQFSFPGGIPSHVAAQTP

SEQ ID NO: 789340 - protein, 23 aa, Mycobacterium
AEGLRWIDWVAGETTYSPLPATH

SEQ ID NO: 789341 - protein, 32 aa, Mycobacterium
AEGMNPFDYFKFRYYEKWLGGISQFFVDKGYL

SEQ ID NO: 789342 - protein, 31 aa, Mycobacterium
AEGMNPFDYFKFRYYEKWLGGISQFFVDNGY

SEQ ID NO: 789343 - protein, 21 aa, Mycobacterium
AEGPFPVLLSITPYGKKAPPP

SEQ ID NO: 789344 - protein, 23 aa, Mycobacterium
AEGPLKGILKYYDAPIVSSDIVT

SEQ ID NO: 789345 - protein, 25 aa, Mycobacterium
AEGPPAWLRFFGCNPRHHSLAFLPL

SEQ ID NO: 789346 - protein, 25 aa, Mycobacterium
AEGPPLYSPLKLLDPIANVAEMFIH

SEQ ID NO: 789347 - protein, 23 aa, Mycobacterium
AEGPWAEKPFLTLALHINRELLH

SEQ ID NO: 789348 - protein, 28 aa, Mycobacterium
AEGQPGPVSALFFDLDRLKAINDYLGHT

SEQ ID NO: 789349 - protein, 23 aa, Mycobacterium
AEGRLKGILKYYDAPIVSSDIVT

SEQ ID NO: 789350 - protein, 23 aa, Mycobacterium
AEGRLKGILKYYDAPIVSTDIVT

SEQ ID NO: 789351 - protein, 26 aa, Mycobacterium
AEGRLTWVLDPIDGTVNFLYGIPAYG

SEQ ID NO: 789352 - protein, 18 aa, Mycobacterium
AEGRSGLIGYLPTGFPDV

SEQ ID NO: 789353 - protein, 25 aa, Mycobacterium
AEGSKLIFSYIRQDFIDGTDLYGAR

SEQ ID NO: 789354 - protein, 26 aa, Mycobacterium
AEGTLLLMLAALRRLPELDRATRTGN

SEQ ID NO: 789355 - protein, 24 aa, Mycobacterium
AEGTPYVTPLVRKLASQHNIDLAE

SEQ ID NO: 789356 - protein, 26 aa, Mycobacterium
AEGTVLLMLAALRRLPELDAATRQGR

SEQ ID NO: 789357 - protein, 26 aa, Mycobacterium
AEGTVLLMLAALRRLPQLDRATRAGR

SEQ ID NO: 789358 - protein, 27 aa, Mycobacterium
AEGTVLLMLAALRRLPTLDAAVREDRG

SEQ ID NO: 789359 - protein, 22 aa, Mycobacterium
AEGVADLLRLLGPLTVDEIAER

SEQ ID NO: 789360 - protein, 23 aa, Mycobacterium
AEGVDWLLAQSEKPDLVFEATSA

SEQ ID NO: 789361 - protein, 25 aa, Mycobacterium
AEGVKLPVVLFFHGGGWSVGDLDSY

SEQ ID NO: 789362 - protein, 26 aa, Mycobacterium
AEGVRTRRQLEPWVKRALAYAGSLPP

SEQ ID NO: 789363 - protein, 24 aa, Mycobacterium
AEGWQPVFYLPDKAASIWGEPLAA

SEQ ID NO: 789364 - protein, 24 aa, Mycobacterium
AEGWTLRSVTAPSPLFGANGLRTG

SEQ ID NO: 789365 - protein, 25 aa, Mycobacterium
AEGYHPIVFCRFIPTADYLAEHLRT

SEQ ID NO: 789366 - protein, 24 aa, Mycobacterium
AEGYLWQALVYGGKIIRYAPDGTV

SEQ ID NO: 789367 - protein, 18 aa, Mycobacterium
AEHAGVSRSWLYTQPDLK

SEQ ID NO: 789368 - protein, 24 aa, Mycobacterium
AEHAIRLRGLMSHLVYADAPQQPI

SEQ ID NO: 789369 - protein, 23 aa, Mycobacterium
AEHALFLRQAPIFEQMLIEDGII

SEQ ID NO: 789370 - protein, 18 aa, Mycobacterium
AEHDSAWIRNMELAILKG

SEQ ID NO: 789371 - protein, 27 aa, Mycobacterium
AEHERAFTVFWRAMVGLPALGAVAADE

SEQ ID NO: 789372 - protein, 31 aa, Mycobacterium
AEHGGILLITHYTRILRYIRPEFVHVFVGGR

SEQ ID NO: 789373 - protein, 19 aa, Mycobacterium
AEHGGLFFAAASASSRFAS

SEQ ID NO: 789374 - protein, 20 aa, Mycobacterium
AEHGLPVRTPGARLVPGAAN

SEQ ID NO: 789375 - protein, 23 aa, Mycobacterium
AEHIARVAGLGRVTLVLISHRHG

SEQ ID NO: 789376 - protein, 24 aa, Mycobacterium
AEHIDGLTVLSWPQVISGGFGEEV

SEQ ID NO: 789377 - protein, 21 aa, Mycobacterium
AEHIRYSFGLAHRSNDRGALH

SEQ ID NO: 789378 - protein, 18 aa, Mycobacterium
AEHLAHELGPRFEPPAIL

SEQ ID NO: 789379 - protein, 18 aa, Mycobacterium
AEHLFVFQRTPSSVDQRV

SEQ ID NO: 789380 - protein, 18 aa, Mycobacterium
AEHLIANLSFFAANGYLV

SEQ ID NO: 789381 - protein, 18 aa, Mycobacterium
AEHLKQRWARNTGGLLLV

SEQ ID NO: 789382 - protein, 25 aa, Mycobacterium
AEHLLGETPLLPTPHLYWGGIDIER

SEQ ID NO: 789383 - protein, 23 aa, Mycobacterium
AEHLMTIMRQVGMPNGLAGVGYT

SEQ ID NO: 789384 - protein, 19 aa, Mycobacterium
AEHLPGVKYQWPQGTYLAW

SEQ ID NO: 789385 - protein, 17 aa, Mycobacterium
AEHLRLGAALFESLAVD

SEQ ID NO: 789386 - protein, 19 aa, Mycobacterium
AEHPAFPAPPPREILEGAG

SEQ ID NO: 789387 - protein, 28 aa, Mycobacterium
AEHPEPGDWLYFVTIDGQGTTLFTKDYQ

SEQ ID NO: 789388 - protein, 30 aa, Mycobacterium
AEHQAIIRDVLAAGDFWGGAASVACQEFIT

SEQ ID NO: 789389 - protein, 26 aa, Mycobacterium
AEHQAIIRDVLAAGDFWGGAGSVACQ

SEQ ID NO: 789390 - protein, 18 aa, Mycobacterium
AEHSGILVLPPGTAQPGA

SEQ ID NO: 789391 - protein, 23 aa, Mycobacterium
AEHTPALGQPRRTKHHGLAAPYI

SEQ ID NO: 789392 - protein, 17 aa, Mycobacterium
AEHVRDLLVGGRSMRME

SEQ ID NO: 789393 - protein, 25 aa, Mycobacterium
AEIADGWLPMFYAPRLADMYNEWLD

SEQ ID NO: 789394 - protein, 21 aa, Mycobacterium
AEIALQTWVGQSCPVHATSSG

SEQ ID NO: 789395 - protein, 23 aa, Mycobacterium
AEIARALRPLLPGALLSISFSRG

SEQ ID NO: 789396 - protein, 27 aa, Mycobacterium
AEIATLERQLQLLDKLIGAATKDLQDP

SEQ ID NO: 789397 - protein, 24 aa, Mycobacterium
AEICDGWLPIFYSPRMAGMYNEWL

SEQ ID NO: 789398 - protein, 20 aa, Mycobacterium
AEICDGWLPIFYTPRMADMY

SEQ ID NO: 789399 - protein, 24 aa, Mycobacterium
AEICDGWLPIFYTPRMADTYNEWL

SEQ ID NO: 789400 - protein, 24 aa, Mycobacterium
AEICGHIASLPLDRSRPLWEMWVI

SEQ ID NO: 789401 - protein, 24 aa, Mycobacterium
AEICSALLDLRPLAPVVGVVAGEV

SEQ ID NO: 789402 - protein, 21 aa, Mycobacterium
AEIDFLVYPTVQVPAPTRADL

SEQ ID NO: 789403 - protein, 24 aa, Mycobacterium
AEIDPFRLRLFDGLAAAIGERGYR

SEQ ID NO: 789404 - protein, 24 aa, Mycobacterium
AEIEKLGYGAVWIGGSPAADLSSV

SEQ ID NO: 789405 - protein, 19 aa, Mycobacterium
AEIELLTTLFKGSAIPVST

SEQ ID NO: 789406 - protein, 24 aa, Mycobacterium
AEIGAPIAFAQRAQVGLPAMMMRA

SEQ ID NO: 789407 - protein, 23 aa, Mycobacterium
AEIGLGRRWVMSAWGRAAAAERW

SEQ ID NO: 789408 - protein, 22 aa, Mycobacterium
AEIHLMYLALVSGGAPLRLAEP

SEQ ID NO: 789409 - protein, 22 aa, Mycobacterium
AEILAYLNWVADKLDLRRDITF

SEQ ID NO: 789410 - protein, 23 aa, Mycobacterium
AEILFDQGLGDMFVVRTAGHVID

SEQ ID NO: 789411 - protein, 23 aa, Mycobacterium
AEILRYINWVADKLDLRSGITFN

SEQ ID NO: 789412 - protein, 24 aa, Mycobacterium
AEIMRFCQSFMTELYRHIGEYTDV

SEQ ID NO: 789413 - protein, 18 aa, Mycobacterium
AEINYKFNTLLAAADDVL

SEQ ID NO: 789414 - protein, 18 aa, Mycobacterium
AEIPLLVVITEGIPVQDT

SEQ ID NO: 789415 - protein, 22 aa, Mycobacterium
AEIPLWSTRAKRWLRARSRPTA

SEQ ID NO: 789416 - protein, 25 aa, Mycobacterium
AEIPPDRPALEAALGILRDLTAAPS

SEQ ID NO: 789417 - protein, 26 aa, Mycobacterium
AEIQAPAIYYYFPSREDLIEEVMYCG

SEQ ID NO: 789418 - protein, 23 aa, Mycobacterium
AEIQVPLFINTGDRLKVDTRDAS

SEQ ID NO: 789419 - protein, 23 aa, Mycobacterium
AEIQVPLFINTGDRLKVDTRDGS

SEQ ID NO: 789420 - protein, 27 aa, Mycobacterium
AEIRDGLLYLFLPPLEQVDDFVDLIAR

SEQ ID NO: 789421 - protein, 17 aa, Mycobacterium
AEIRGGPHLKFQLLWYP

SEQ ID NO: 789422 - protein, 19 aa, Mycobacterium
AEIRRAAMLAGNLPAVAAA

SEQ ID NO: 789423 - protein, 22 aa, Mycobacterium
AEIRRYLPAAHRLRSIPDVEQQ

SEQ ID NO: 789424 - protein, 18 aa, Mycobacterium
AEIRTQLGRRLPGYMVPA

SEQ ID NO: 789425 - protein, 18 aa, Mycobacterium
AEIRTTNPPLLLATRHVI

SEQ ID NO: 789426 - protein, 17 aa, Mycobacterium
AEISAAIQERLVRADYG

SEQ ID NO: 789427 - protein, 18 aa, Mycobacterium
AEISAVPAALQLLRPNPS

SEQ ID NO: 789428 - protein, 27 aa, Mycobacterium
AEISCGPYRFVYRKRFHKRAETHLTVI

SEQ ID NO: 789429 - protein, 25 aa, Mycobacterium
AEISKPMLYLYYGSKEELFGACLDR

SEQ ID NO: 789430 - protein, 35 aa, Mycobacterium
AEIVGFYGLNYWYPFQVTALGLGPIWMSANSDAKR

SEQ ID NO: 789431 - protein, 23 aa, Mycobacterium
AEIVTWMSVAPALRDGWEDSILA

SEQ ID NO: 789432 - protein, 31 aa, Mycobacterium
AEIVVKFAAMLPWLAFSRLLGRRAAGLPFAK

SEQ ID NO: 789433 - protein, 17 aa, Mycobacterium
AEIWRRGGTLDGVRVVS

SEQ ID NO: 789434 - protein, 23 aa, Mycobacterium
AEKAIKTQLLMDAIADKLEIQVG

SEQ ID NO: 789435 - protein, 24 aa, Mycobacterium
AEKALLARTIAGKVVPLLADGRIR

SEQ ID NO: 789436 - protein, 26 aa, Mycobacterium
AEKDLRAPFAPRGWFEGLTIEQLDVF

SEQ ID NO: 789437 - protein, 19 aa, Mycobacterium
AEKFLEASTQWRDKFKQQI

SEQ ID NO: 789438 - protein, 30 aa, Mycobacterium
AEKFVAAHVPYLAWLLQNSANATAAALEHD

SEQ ID NO: 789439 - protein, 39 aa, Mycobacterium
AEKLGYSGLVTPLTFTSIPAMAANRYLFESVVVGYDTYM

SEQ ID NO: 789440 - protein, 23 aa, Mycobacterium
AEKMPRRFYCRARWHRSALDSET

SEQ ID NO: 789441 - protein, 39 aa, Mycobacterium
AEKNIPFFATKTRFGLWFRIVAMRTMNFAPMARLFASTV

SEQ ID NO: 789442 - protein, 23 aa, Mycobacterium
AEKSLAVDGLDPARIWGADNHEP

SEQ ID NO: 789443 - protein, 24 aa, Mycobacterium
AEKVTGIFLVPAQWQAVCAAQKAN

SEQ ID NO: 789444 - protein, 23 aa, Mycobacterium
AEKYEIPMIKLTGGQRIDLLGVR

SEQ ID NO: 789445 - protein, 32 aa, Mycobacterium
AELAALTDPWQPAVLALVGTAARAGAAADKPV

SEQ ID NO: 789446 - protein, 18 aa, Mycobacterium
AELAAQYCFPHLRFIASV

SEQ ID NO: 789447 - protein, 18 aa, Mycobacterium
AELAATAAQWSALSSQLV

SEQ ID NO: 789448 - protein, 19 aa, Mycobacterium
AELADGVFVLTDPALSAAV

SEQ ID NO: 789449 - protein, 35 aa, Mycobacterium
AELAEHLIALPSGRYSWRMSLPAMVCYWSELAREI

SEQ ID NO: 789450 - protein, 28 aa, Mycobacterium
AELAHIPVRRFGSVGDIAPTVAFLCTEH

SEQ ID NO: 789451 - protein, 29 aa, Mycobacterium
AELAILVPELLLIGQLIDRSGMAWCIQAF

SEQ ID NO: 789452 - protein, 30 aa, Mycobacterium
AELALRDKIPLVMLLEGAGFRPGGGHYGRT

SEQ ID NO: 789453 - protein, 29 aa, Mycobacterium
AELALRDKIPLVMLLEGAGFRPTGGHYGR

SEQ ID NO: 789454 - protein, 29 aa, Mycobacterium
AELALRDKIPLVMLLEGAGFRPTGTHYGR

SEQ ID NO: 789455 - protein, 29 aa, Mycobacterium
AELALRDRVPMVMLLEGAGFRPSGEHYGR

SEQ ID NO: 789456 - protein, 29 aa, Mycobacterium
AELALRSKIPLVMLLEGAGFRAAAGEHYG

SEQ ID NO: 789457 - protein, 22 aa, Mycobacterium
AELARLDLGSVLIPMPTAGQVQ

SEQ ID NO: 789458 - protein, 24 aa, Mycobacterium
AELARLLRIAVTRLGITSVRFTGG

SEQ ID NO: 789459 - protein, 22 aa, Mycobacterium
AELARRGLGGVRVLHGGMKRQR

SEQ ID NO: 789460 - protein, 26 aa, Mycobacterium
AELATLTDPWQPAVLALVAATVKAGA

SEQ ID NO: 789461 - protein, 36 aa, Mycobacterium
AELCGRLIGMPLERSKPLWEMWVIEGVGGSAAREDG

SEQ ID NO: 789462 - protein, 20 aa, Mycobacterium
AELDALLRQVARRDADAFAA

SEQ ID NO: 789463 - protein, 26 aa, Mycobacterium
AELDERLARALPHLHGILSALADVID

SEQ ID NO: 789464 - protein, 25 aa, Mycobacterium
AELDGGYWFRSIRQTVQFAEAVRAA

SEQ ID NO: 789465 - protein, 24 aa, Mycobacterium
AELDHTLGLLLMREGRGLEVHATE

SEQ ID NO: 789466 - protein, 28 aa, Mycobacterium
AELDLMADWIGWLFAFDDVFDESIDGCD

SEQ ID NO: 789467 - protein, 19 aa, Mycobacterium
AELDMLAALNERVLHHLAN

SEQ ID NO: 789468 - protein, 21 aa, Mycobacterium
AELDVEVPMRVVFGTSSVAGL

SEQ ID NO: 789469 - protein, 29 aa, Mycobacterium
AELDVLRRLIPPWVVLASLTTRIPQPKRN

SEQ ID NO: 789470 - protein, 25 aa, Mycobacterium
AELDWWTSPFVLTDGVPPLALASDT

SEQ ID NO: 789471 - protein, 21 aa, Mycobacterium
AELEALLRGYGYRPITVAGDD

SEQ ID NO: 789472 - protein, 17 aa, Mycobacterium
AELEFDGVIARLVELAY

SEQ ID NO: 789473 - protein, 48 aa, Mycobacterium
AELEPDFQRAYKELAKQVRLPGFRPGRAPVKLLEARFGREAMLDQIVN

SEQ ID NO: 789474 - protein, 50 aa, Mycobacterium
AELEPDFQRAYRELAKQVRLPGFRPGKAPAKLLEARFGREALLDQVVNEA

SEQ ID NO: 789475 - protein, 23 aa, Mycobacterium
AELERRIAQFLGFATVLTSVGQV

SEQ ID NO: 789476 - protein, 17 aa, Mycobacterium
AELERRILLKRVPELPA

SEQ ID NO: 789477 - protein, 18 aa, Mycobacterium
AELFAKWEETPFASASIA

SEQ ID NO: 789478 - protein, 20 aa, Mycobacterium
AELFLTALAVPLLERLRHDA

SEQ ID NO: 789479 - protein, 22 aa, Mycobacterium
AELFPRMRIPQAWYDAGIAVRA

SEQ ID NO: 789480 - protein, 24 aa, Mycobacterium
AELGDLHWFYVYSGVMWACVFLRT

SEQ ID NO: 789481 - protein, 30 aa, Mycobacterium
AELGIELPAVAAPLAAYQPAVRSGNHVYTS

SEQ ID NO: 789482 - protein, 19 aa, Mycobacterium
AELGIPAARRYLAQLTAGE

SEQ ID NO: 789483 - protein, 25 aa, Mycobacterium
AELGPGFFEFTLAPETALRATDNAA

SEQ ID NO: 789484 - protein, 24 aa, Mycobacterium
AELGYPELVAPLTFLAIAGRRVQL

SEQ ID NO: 789485 - protein, 26 aa, Mycobacterium
AELHNFPGIEFSALVASPNGAKRAIA

SEQ ID NO: 789486 - protein, 20 aa, Mycobacterium
AELHRFIELNGPRHNAPATP

SEQ ID NO: 789487 - protein, 26 aa, Mycobacterium
AELHRRANRLARWLIRHGIGAEDIVG

SEQ ID NO: 789488 - protein, 20 aa, Mycobacterium
AELHTSLHRVAMSAGLAPYE

SEQ ID NO: 789489 - protein, 20 aa, Mycobacterium
AELIAQWHEWGIDGVRLRPA

SEQ ID NO: 789490 - protein, 18 aa, Mycobacterium
AELIGWIKAVAGAARRVV

SEQ ID NO: 789491 - protein, 21 aa, Mycobacterium
AELITMLIRFRTQAVASITAT

SEQ ID NO: 789492 - protein, 21 aa, Mycobacterium
AELIYGAAAFGFWADKAPRYL

SEQ ID NO: 789493 - protein, 25 aa, Mycobacterium
AELKDWRLRISKEMSVPAFVVFTDN

SEQ ID NO: 789494 - protein, 19 aa, Mycobacterium
AELLAKWKSTPERPVPLPL

SEQ ID NO: 789495 - protein, 19 aa, Mycobacterium
AELLARLPFELTAGQREVL

SEQ ID NO: 789496 - protein, 27 aa, Mycobacterium
AELLAVELSSFQLHWAPSLRPEAGVVL

SEQ ID NO: 789497 - protein, 18 aa, Mycobacterium
AELLDKLVAEGVVLAPPP

SEQ ID NO: 789498 - protein, 19 aa, Mycobacterium
AELLDVVLAIVRDRPVEPV

SEQ ID NO: 789499 - protein, 17 aa, Mycobacterium
AELLGERTDLSASDLDS

SEQ ID NO: 789500 - protein, 21 aa, Mycobacterium
AELLGLPWVELNPHPLYLPSR

SEQ ID NO: 789501 - protein, 17 aa, Mycobacterium
AELLGMLGLIIGGGFDT

SEQ ID NO: 789502 - protein, 26 aa, Mycobacterium
AELLGRPVPFTAIEFAGPAPASGDAL

SEQ ID NO: 789503 - protein, 32 aa, Mycobacterium
AELLGVPWIELSPHPLYLPSKGLPPIGSGLAP

SEQ ID NO: 789504 - protein, 17 aa, Mycobacterium
AELLLAGGVLYLADEFP

SEQ ID NO: 789505 - protein, 17 aa, Mycobacterium
AELLLLAVPDAELSALV

SEQ ID NO: 789506 - protein, 25 aa, Mycobacterium
AELLPAEHRAFVDDLLLRYGVAQPA

SEQ ID NO: 789507 - protein, 23 aa, Mycobacterium
AELLRDQIIRFAATKLAVPQSRC

SEQ ID NO: 789508 - protein, 21 aa, Mycobacterium
AELLRLDGRLPGLAGAERDEV

SEQ ID NO: 789509 - protein, 18 aa, Mycobacterium
AELLRQQLILAIDGELDV

SEQ ID NO: 789510 - protein, 17 aa, Mycobacterium
AELLRVRAIPGKEPWEH

SEQ ID NO: 789511 - protein, 17 aa, Mycobacterium
AELLVALLYSGRIDLKN

SEQ ID NO: 789512 - protein, 19 aa, Mycobacterium
AELLVARCEALLAAGDVTS

SEQ ID NO: 789513 - protein, 23 aa, Mycobacterium
AELMGIQIPRFCDHPLLDPVGAC

SEQ ID NO: 789514 - protein, 21 aa, Mycobacterium
AELMLRKATWLYDNGKPCGRE

SEQ ID NO: 789515 - protein, 18 aa, Mycobacterium
AELMPAERETALTVAPEA

SEQ ID NO: 789516 - protein, 17 aa, Mycobacterium
AELMRLLVDERRLGWDE

SEQ ID NO: 789517 - protein, 25 aa, Mycobacterium
AELMRRLRAAPPETLAGVAVSVTDI

SEQ ID NO: 789518 - protein, 20 aa, Mycobacterium
AELMWRHYLDPKAAPEAAVP

SEQ ID NO: 789519 - protein, 18 aa, Mycobacterium
AELNGHHVFWTVHARNKR

SEQ ID NO: 789520 - protein, 23 aa, Mycobacterium
AELNLGALLFKRGSVHATNLRRR

SEQ ID NO: 789521 - protein, 25 aa, Mycobacterium
AELNPYLGVRGIRLSLAHPDVFSDQ

SEQ ID NO: 789522 - protein, 25 aa, Mycobacterium
AELPAGSRLLLLWGAANRDPTHFDH

SEQ ID NO: 789523 - protein, 20 aa, Mycobacterium
AELPALRRVLHINGSGPKAL

SEQ ID NO: 789524 - protein, 24 aa, Mycobacterium
AELPDVDWVPADRGWVADLVRTLS

SEQ ID NO: 789525 - protein, 17 aa, Mycobacterium
AELPLGPGQPPILIPLI

SEQ ID NO: 789526 - protein, 22 aa, Mycobacterium
AELPLIEEWFEFVGEKLPTGIK

SEQ ID NO: 789527 - protein, 22 aa, Mycobacterium
AELPLIEEWFEFVGEKLPTGLK

SEQ ID NO: 789528 - protein, 18 aa, Mycobacterium
AELPNGLPQLLLVAGAEL

SEQ ID NO: 789529 - protein, 19 aa, Mycobacterium
AELPPLLRGDRAAAGALGI

SEQ ID NO: 789530 - protein, 23 aa, Mycobacterium
AELPPLTAPLAVILLGGLRELTA

SEQ ID NO: 789531 - protein, 23 aa, Mycobacterium
AELPPVEFSWTSSDVQLYHLGLG

SEQ ID NO: 789532 - protein, 24 aa, Mycobacterium
AELPRPLTLDSFAGLPPAKQPSVR

SEQ ID NO: 789533 - protein, 23 aa, Mycobacterium
AELPSWIGGTWNRSAVLRYGENP

SEQ ID NO: 789534 - protein, 21 aa, Mycobacterium
AELPTARWLVLVGEGTEARQF

SEQ ID NO: 789535 - protein, 25 aa, Mycobacterium
AELPVLRALLHISDAVLRAQYFDEV

SEQ ID NO: 789536 - protein, 29 aa, Mycobacterium
AELQEEILWLCESAHLPVIWATQVLESLA

SEQ ID NO: 789537 - protein, 20 aa, Mycobacterium
AELQRVVASIPIKRLRQAGV

SEQ ID NO: 789538 - protein, 22 aa, Mycobacterium
AELQVRWHSVPIVFCETRPLAE

SEQ ID NO: 789539 - protein, 25 aa, Mycobacterium
AELRAARRMGSKSNLLALIADCERG

SEQ ID NO: 789540 - protein, 34 aa, Mycobacterium
AELRAARRMGSRSPLLALIADCERGLGRPLRAIE

SEQ ID NO: 789541 - protein, 28 aa, Mycobacterium
AELREYIDWQPFFNAWEMKGRFPDILNN

SEQ ID NO: 789542 - protein, 29 aa, Mycobacterium
AELREYIDWQPFFNAWEMKGRFPDILNNP

SEQ ID NO: 789543 - protein, 18 aa, Mycobacterium
AELRGPIWIVTRGAQRVA

SEQ ID NO: 789544 - protein, 17 aa, Mycobacterium
AELRIGVVGLSVGHTLA

SEQ ID NO: 789545 - protein, 25 aa, Mycobacterium
AELRLLAVTAPPPLQNRLRALADTL

SEQ ID NO: 789546 - protein, 35 aa, Mycobacterium
AELRLPLVDLAIPQLAARPPAFREALMGVLNELAV

SEQ ID NO: 789547 - protein, 17 aa, Mycobacterium
AELRLRADARHPPVVQG

SEQ ID NO: 789548 - protein, 23 aa, Mycobacterium
AELRLTPGTRVWYSIKAHEVALH

SEQ ID NO: 789549 - protein, 17 aa, Mycobacterium
AELRQRCQRWPQASAVC

SEQ ID NO: 789550 - protein, 32 aa, Mycobacterium
AELRYRAVPDRYLWFPDFALDRRAWDALQIPV

SEQ ID NO: 789551 - protein, 27 aa, Mycobacterium
AELSCGPYRFVYRKRFHKKCETELTIQ

SEQ ID NO: 789552 - protein, 27 aa, Mycobacterium
AELSDGTIRFLLWAAALSSPRAPSLMV

SEQ ID NO: 789553 - protein, 32 aa, Mycobacterium
AELSDGTLRYLLWAAALLTPRPPQLLVLNEPE

SEQ ID NO: 789554 - protein, 32 aa, Mycobacterium
AELSDGTLRYLLWSAALLSPRPPQLLVLNEPE

SEQ ID NO: 789555 - protein, 29 aa, Mycobacterium
AELSDLELYLFFSLLFSAGAETTRNAVAG

SEQ ID NO: 789556 - protein, 17 aa, Mycobacterium
AELSGNRLPFYNGSNPL

SEQ ID NO: 789557 - protein, 23 aa, Mycobacterium
AELSRELGITEFMLLQTAVAVVL

SEQ ID NO: 789558 - protein, 27 aa, Mycobacterium
AELSSWQRSWALACQKAFAGLEVDPNR

SEQ ID NO: 789559 - protein, 27 aa, Mycobacterium
AELTEVANLLRWLVDGNFTLLGYQRCT

SEQ ID NO: 789560 - protein, 24 aa, Mycobacterium
AELTRMGYRVIPSDANFVLFGAFT

SEQ ID NO: 789561 - protein, 26 aa, Mycobacterium
AELTSPVAFLERPARWMRTLAEHPHT

SEQ ID NO: 789562 - protein, 19 aa, Mycobacterium
AELVALGLLARRPYREPGQ

SEQ ID NO: 789563 - protein, 33 aa, Mycobacterium
AELVKITPLDFLSDILLWPKLIDKYRATMTAAP

SEQ ID NO: 789564 - protein, 23 aa, Mycobacterium
AELVKRDSTFTGVLYAGLAITSN

SEQ ID NO: 789565 - protein, 20 aa, Mycobacterium
AELVPLLDALLERMRAEKVM

SEQ ID NO: 789566 - protein, 19 aa, Mycobacterium
AELVPTIVKLFGTEDSRIG

SEQ ID NO: 789567 - protein, 26 aa, Mycobacterium
AELVRDPRWIALAGPAPRIQLVHDDR

SEQ ID NO: 789568 - protein, 31 aa, Mycobacterium
AELVRRDSPFCGLLYVGLAITAGGPAVVEFN

SEQ ID NO: 789569 - protein, 34 aa, Mycobacterium
AELVSYVRGVLYFRTKRWPDVLAQFPEATPWRHP

SEQ ID NO: 789570 - protein, 35 aa, Mycobacterium
AELVVALLGIWRRGAIHVPLFTAFAPPAITHRLRA

SEQ ID NO: 789571 - protein, 17 aa, Mycobacterium
AELVWLGAAMIIGAGST

SEQ ID NO: 789572 - protein, 25 aa, Mycobacterium
AELWGDSVFHCPFCHGWEARDRPLA

SEQ ID NO: 789573 - protein, 17 aa, Mycobacterium
AELYGPRVESLLGAGVF

SEQ ID NO: 789574 - protein, 23 aa, Mycobacterium
AELYLRDIPPFFALTDSNNTVAG

SEQ ID NO: 789575 - protein, 23 aa, Mycobacterium
AEMARGQYWIHPALPEVVENALL

SEQ ID NO: 789576 - protein, 17 aa, Mycobacterium
AEMAWRILKFRPREDSG

SEQ ID NO: 789577 - protein, 23 aa, Mycobacterium
AEMDWRILKFRPATTPGVAVPDD

SEQ ID NO: 789578 - protein, 18 aa, Mycobacterium
AEMDYDSLTLAQLRARLT

SEQ ID NO: 789579 - protein, 26 aa, Mycobacterium
AEMGRPRWKHAFGYLAGPNGPEPDPA

SEQ ID NO: 789580 - protein, 23 aa, Mycobacterium
AEMIAEQWGFDRTALDEFSLASH

SEQ ID NO: 789581 - protein, 18 aa, Mycobacterium
AEMIAEQWGFSRTQLDEF

SEQ ID NO: 789582 - protein, 24 aa, Mycobacterium
AEMIAQRWGLDRLALDEFSLGSHE

SEQ ID NO: 789583 - protein, 25 aa, Mycobacterium
AEMIETWIEMAWQDGSFGWIGIANL

SEQ ID NO: 789584 - protein, 31 aa, Mycobacterium
AEMLAELMRLFAAGVLKPLPVRAFDIRCAAD

SEQ ID NO: 789585 - protein, 17 aa, Mycobacterium
AEMLKPCTLELGGKSAA

SEQ ID NO: 789586 - protein, 20 aa, Mycobacterium
AEMLVLGSFPSGRRARVLIG

SEQ ID NO: 789587 - protein, 20 aa, Mycobacterium
AEMLWPRMWQMACRLEEIPK

SEQ ID NO: 789588 - protein, 22 aa, Mycobacterium
AEMMIDLFWHGLKGAPAERDAG

SEQ ID NO: 789589 - protein, 18 aa, Mycobacterium
AEMNWRIMKFKPREDQKP

SEQ ID NO: 789590 - protein, 26 aa, Mycobacterium
AEMRARYRLGNRPVVACVSRLVPRKG

SEQ ID NO: 789591 - protein, 26 aa, Mycobacterium
AEMRAVLRVLLTRLPDVHLTGEVGEA

SEQ ID NO: 789592 - protein, 30 aa, Mycobacterium
AEMTGVRLAKPPLLVPVLRAGLGMVSEAHA

SEQ ID NO: 789593 - protein, 31 aa, Mycobacterium
AEMVAALRRFWMFHGMLSEGFQWTSRALAVV

SEQ ID NO: 789594 - protein, 19 aa, Mycobacterium
AEMVLAGRLFFDAPMSYLH

SEQ ID NO: 789595 - protein, 24 aa, Mycobacterium
AEMVRRGSSFSGLLYAGLAITSRG

SEQ ID NO: 789596 - protein, 20 aa, Mycobacterium
AEMWLKLNPQAYRDLAQRHL

SEQ ID NO: 789597 - protein, 33 aa, Mycobacterium
AEMWRRWIYDDYYRSYLLPLEKYGLTIPHDLVE

SEQ ID NO: 789598 - protein, 17 aa, Mycobacterium
AEMWTQDATAMYGYAAA

SEQ ID NO: 789599 - protein, 17 aa, Mycobacterium
AENAIVLRGLMSHMVYA

SEQ ID NO: 789600 - protein, 17 aa, Mycobacterium
AENDFCFDYLPRISGDH

SEQ ID NO: 789601 - protein, 24 aa, Mycobacterium
AENGLLLLMCGPHMNVVRMIPPLV

SEQ ID NO: 789602 - protein, 18 aa, Mycobacterium
AENHRKIVEFMLANARRL

SEQ ID NO: 789603 - protein, 28 aa, Mycobacterium
AENIDARVFFHPLSTTPPFAGSPGGKWA

SEQ ID NO: 789604 - protein, 27 aa, Mycobacterium
AENITQRYFLVSYPRKMDALTRLLETE

SEQ ID NO: 789605 - protein, 20 aa, Mycobacterium
AENMARLLIVARERYHVFRH

SEQ ID NO: 789606 - protein, 22 aa, Mycobacterium
AENMARLLMVARERYHLFRHHQ

SEQ ID NO: 789607 - protein, 22 aa, Mycobacterium
AENMFVGAWPRSGGKIDYDAMR

SEQ ID NO: 789608 - protein, 28 aa, Mycobacterium
AENQLRFAAPPRLDLTLLTSALPEGYKA

SEQ ID NO: 789609 - protein, 30 aa, Mycobacterium
AENQLRFRAPKMLDLSLLVAALPEGYRATE

SEQ ID NO: 789610 - protein, 26 aa, Mycobacterium
AENQLRFSAPRKLDLSLLVAALPEGY

SEQ ID NO: 789611 - protein, 20 aa, Mycobacterium
AENQRRLAYVAAILADAGQV

SEQ ID NO: 789612 - protein, 23 aa, Mycobacterium
AENRALLAQLVATNLFGQNTSAI

SEQ ID NO: 789613 - protein, 18 aa, Mycobacterium
AENRLHAQKALLVWLLEK

SEQ ID NO: 789614 - protein, 41 aa, Mycobacterium
AENRSQFVIEPLEPGFGYTLGNSLRRTLLSSIPGAAVTSIR

SEQ ID NO: 789615 - protein, 18 aa, Mycobacterium
AENTYHWGGKRFCKPCRI

SEQ ID NO: 789616 - protein, 24 aa, Mycobacterium
AENWPGLLPEMRRLLPDLESAPAD

SEQ ID NO: 789617 - protein, 17 aa, Mycobacterium
AENYPWRTDLGHATPQG

SEQ ID NO: 789618 - protein, 27 aa, Mycobacterium
AEPADQRLAIADWVYWQHLAVIMNDAV

SEQ ID NO: 789619 - protein, 18 aa, Mycobacterium
AEPAFAYPIAKQANQIRV

SEQ ID NO: 789620 - protein, 27 aa, Mycobacterium
AEPALASLLVAPYFRSAIESAVDSWRR

SEQ ID NO: 789621 - protein, 24 aa, Mycobacterium
AEPALCRTQYYINRAFAAVGRLLH

SEQ ID NO: 789622 - protein, 25 aa, Mycobacterium
AEPAQPLYARYWLHNRGPAPLGGLP

SEQ ID NO: 789623 - protein, 22 aa, Mycobacterium
AEPAWSTFMGAYWQIGSAAHVP

SEQ ID NO: 789624 - protein, 17 aa, Mycobacterium
AEPDLLPKLLAADALPA

SEQ ID NO: 789625 - protein, 26 aa, Mycobacterium
AEPDLVIMHPATWGALRREKSSFGTY

SEQ ID NO: 789626 - protein, 23 aa, Mycobacterium
AEPDPLFVIGGIGVTPILPMIQA

SEQ ID NO: 789627 - protein, 24 aa, Mycobacterium
AEPDVRPRVLLLGSGELSRELAVA

SEQ ID NO: 789628 - protein, 18 aa, Mycobacterium
AEPGALTAALNWYRAMFL

SEQ ID NO: 789629 - protein, 31 aa, Mycobacterium
AEPGLRDRLLADPSLRHVAIAEALRLDAPVM

SEQ ID NO: 789630 - protein, 24 aa, Mycobacterium
AEPGRLRLVDLGDRLGLAKSTARR

SEQ ID NO: 789631 - protein, 23 aa, Mycobacterium
AEPGRPFSWRPGSDPAVAELVAD

SEQ ID NO: 789632 - protein, 24 aa, Mycobacterium
AEPHPVLPTTPWQHGQHWISSTTA

SEQ ID NO: 789633 - protein, 27 aa, Mycobacterium
AEPHRAWPADLMLAAPPAPRVAVPAQV

SEQ ID NO: 789634 - protein, 19 aa, Mycobacterium
AEPKPPVDAPILALWGDDE

SEQ ID NO: 789635 - protein, 28 aa, Mycobacterium
AEPLDDFLGDFRFYLDFYTKQSAGGLEV

SEQ ID NO: 789636 - protein, 19 aa, Mycobacterium
AEPLLAQLGGRFWFSIDDG

SEQ ID NO: 789637 - protein, 17 aa, Mycobacterium
AEPLLCAVGIDYLTRAI

SEQ ID NO: 789638 - protein, 18 aa, Mycobacterium
AEPLYLDAIGHLGRSRVK

SEQ ID NO: 789639 - protein, 20 aa, Mycobacterium
AEPMPFLLTNTRLARTTWRQ

SEQ ID NO: 789640 - protein, 17 aa, Mycobacterium
AEPPCLGYVFYAPPRAV

SEQ ID NO: 789641 - protein, 26 aa, Mycobacterium
AEPPCLGYVFYAPPRAVPRAQRFPTG

SEQ ID NO: 789642 - protein, 20 aa, Mycobacterium
AEPPMLPMAPVRPGLGASGA

SEQ ID NO: 789643 - protein, 26 aa, Mycobacterium
AEPPNGPPPPARWSRRKPEAAARLEA

SEQ ID NO: 789644 - protein, 21 aa, Mycobacterium
AEPPPWQVLPAVDPIADQTEL

SEQ ID NO: 789645 - protein, 20 aa, Mycobacterium
AEPPRLAEIAYCGIRAGFGA

SEQ ID NO: 789646 - protein, 25 aa, Mycobacterium
AEPQLPLQMRAMVGYMASRTAFFDE

SEQ ID NO: 789647 - protein, 21 aa, Mycobacterium
AEPQRRPLRLIAEKACALTDA

SEQ ID NO: 789648 - protein, 30 aa, Mycobacterium
AEPRFQILAVFDFLYEWFSQPDFRGCMFIN

SEQ ID NO: 789649 - protein, 20 aa, Mycobacterium
AEPRIVVGGSERSDSSRPAV

SEQ ID NO: 789650 - protein, 19 aa, Mycobacterium
AEPSPLLRRRSLTTRTEAI

SEQ ID NO: 789651 - protein, 22 aa, Mycobacterium
AEPVFPLVQAMPVPYVEPEDIS

SEQ ID NO: 789652 - protein, 18 aa, Mycobacterium
AEPWTTRPGVPLPGRAAP

SEQ ID NO: 789653 - protein, 21 aa, Mycobacterium
AEPYDLVAEMPKFSWPTVVVS

SEQ ID NO: 789654 - protein, 25 aa, Mycobacterium
AEPYQEMMGPFAGVYAHCFGGIAAR

SEQ ID NO: 789655 - protein, 25 aa, Mycobacterium
AEQADYVLSLQLRRLTKLDVIELQA

SEQ ID NO: 789656 - protein, 28 aa, Mycobacterium
AEQAGLRPWIATLKLHYVRIIPTEITGR

SEQ ID NO: 789657 - protein, 23 aa, Mycobacterium
AEQALFLRLSVFAGSFDLDAAHG

SEQ ID NO: 789658 - protein, 24 aa, Mycobacterium
AEQARALCLRLLTVRARTRAELEA

SEQ ID NO: 789659 - protein, 24 aa, Mycobacterium
AEQDAIIRLDHPGVLVIEGGPGTG

SEQ ID NO: 789660 - protein, 24 aa, Mycobacterium
AEQDRLARLIILAQTGALLDQRIA

SEQ ID NO: 789661 - protein, 27 aa, Mycobacterium
AEQFHDQFVNTLRAAGYTYEDAEYTNV

SEQ ID NO: 789662 - protein, 23 aa, Mycobacterium
AEQGIVHIIGPQLGLTQPGMTVV

SEQ ID NO: 789663 - protein, 28 aa, Mycobacterium
AEQGVLPDVLYTSLLRRAITTAHLALDA

SEQ ID NO: 789664 - protein, 30 aa, Mycobacterium
AEQHDFYVLDEFTYPLKWGWVDVDDVVSTL

SEQ ID NO: 789665 - protein, 30 aa, Mycobacterium
AEQHPDVPFRFYYGARFVRDLVYLDEIAAL

SEQ ID NO: 789666 - protein, 19 aa, Mycobacterium
AEQHRWLHTQYPDSTRRYL

SEQ ID NO: 789667 - protein, 25 aa, Mycobacterium
AEQIRDQLLALTPLESSFAASLVAL

SEQ ID NO: 789668 - protein, 25 aa, Mycobacterium
AEQIRDQLLALTPLESTFAASLVAL

SEQ ID NO: 789669 - protein, 24 aa, Mycobacterium
AEQISKVVIAYEPVWAIGTGRVAG

SEQ ID NO: 789670 - protein, 20 aa, Mycobacterium
AEQLAFYATIPSYQKVIARE

SEQ ID NO: 789671 - protein, 24 aa, Mycobacterium
AEQLDWGTYVFDFGRPEVRNFLVA

SEQ ID NO: 789672 - protein, 18 aa, Mycobacterium
AEQLFLQFGYRKVTIDEV

SEQ ID NO: 789673 - protein, 18 aa, Mycobacterium
AEQLGVRQVIGLGTIPMA

SEQ ID NO: 789674 - protein, 27 aa, Mycobacterium
AEQLGYSMVFLPEHFLTPTAHLELSGD

SEQ ID NO: 789675 - protein, 30 aa, Mycobacterium
AEQLIDMAVGPLWRIAVLRLTEQQCRIVLT

SEQ ID NO: 789676 - protein, 24 aa, Mycobacterium
AEQLPSVKYQWPQGTYLAWLDCRA

SEQ ID NO: 789677 - protein, 19 aa, Mycobacterium
AEQMGRVHRFLGLDVDVIL

SEQ ID NO: 789678 - protein, 22 aa, Mycobacterium
AEQMKMFLTRLGFGSKMVITGD

SEQ ID NO: 789679 - protein, 21 aa, Mycobacterium
AEQMKMFLTRLGFGSKVVVTG

SEQ ID NO: 789680 - protein, 22 aa, Mycobacterium
AEQMKMFLTRLGFGSKVVVTGD

SEQ ID NO: 789681 - protein, 25 aa, Mycobacterium
AEQMTEFYAGLLKAYPLVSLEDPLY

SEQ ID NO: 789682 - protein, 27 aa, Mycobacterium
AEQPDGGYWMPLFVVLADGVELTDELR

SEQ ID NO: 789683 - protein, 23 aa, Mycobacterium
AEQRAGWDLSPLQVIVSAAEPVR

SEQ ID NO: 789684 - protein, 20 aa, Mycobacterium
AEQRESFRRFAHAGDPLADA

SEQ ID NO: 789685 - protein, 28 aa, Mycobacterium
AEQRPDLVPIFLNALPAPLIEAADVSNA

SEQ ID NO: 789686 - protein, 17 aa, Mycobacterium
AEQRQHILARWSRGPEP

SEQ ID NO: 789687 - protein, 17 aa, Mycobacterium
AEQRQLQLLSGNVDLVV

SEQ ID NO: 789688 - protein, 34 aa, Mycobacterium
AEQSGFGTATLLRHHFRRLIGVTPSDYRKRFNAH

SEQ ID NO: 789689 - protein, 25 aa, Mycobacterium
AEQTGLLLWTSPAKRRYVRITPKEI

SEQ ID NO: 789690 - protein, 27 aa, Mycobacterium
AEQTPASVLYLMSLIGDLLPPGVVNVV

SEQ ID NO: 789691 - protein, 28 aa, Mycobacterium
AEQTPASVLYLMTLIADLLPPGVVNVVN

SEQ ID NO: 789692 - protein, 38 aa, Mycobacterium
AEQVTNFFAPPTVWIALLRCPAFDRYDLTSLRKGYYGA

SEQ ID NO: 789693 - protein, 18 aa, Mycobacterium
AEQWRALALVTTTADLVG

SEQ ID NO: 789694 - protein, 17 aa, Mycobacterium
AEQYAALAGRTLGKVLR

SEQ ID NO: 789695 - protein, 28 aa, Mycobacterium
AEQYVAAHLPYLAWLQQASADSAGAAAQ

SEQ ID NO: 789696 - protein, 28 aa, Mycobacterium
AEQYVAAHLPYVAWLMQASVDTTQAAAQ

SEQ ID NO: 789697 - protein, 24 aa, Mycobacterium
AERAAWWERAVAAFPPYAEYTTRT

SEQ ID NO: 789698 - protein, 33 aa, Mycobacterium
AERADLFLQIAPGTDLALLNGLLHLLVENGDID

SEQ ID NO: 789699 - protein, 17 aa, Mycobacterium
AERAFDVHLLNLNNAGL

SEQ ID NO: 789700 - protein, 27 aa, Mycobacterium
AERAISRTWMRLWRVAPQVLGGCRPIK

SEQ ID NO: 789701 - protein, 28 aa, Mycobacterium
AERAKLSPWIPTLKLHYVRVIPTGITGR

SEQ ID NO: 789702 - protein, 25 aa, Mycobacterium
AERALAARFAAWLRAQRTAVESAGE

SEQ ID NO: 789703 - protein, 25 aa, Mycobacterium
AERAQWWQRAVDAYPPYAEYQAKTS

SEQ ID NO: 789704 - protein, 25 aa, Mycobacterium
AERARKIWAALRQASNVELGGIRLE

SEQ ID NO: 789705 - protein, 24 aa, Mycobacterium
AERARMIVGVLGDIPLIADADTGY

SEQ ID NO: 789706 - protein, 24 aa, Mycobacterium
AERCRPVFATYADPIVHLGPLGSG

SEQ ID NO: 789707 - protein, 20 aa, Mycobacterium
AERDKLWRKVWQQVGRVEEI

SEQ ID NO: 789708 - protein, 37 aa, Mycobacterium
AEREHGGILLITHYTRILRYIQPQFVHVFVGGRIVES

SEQ ID NO: 789709 - protein, 20 aa, Mycobacterium
AERFAGMLLRRLGSGRGTRS

SEQ ID NO: 789710 - protein, 18 aa, Mycobacterium
AERFAQIAAIAFSPRPVP

SEQ ID NO: 789711 - protein, 17 aa, Mycobacterium
AERFEADLRTALEPFMT

SEQ ID NO: 789712 - protein, 17 aa, Mycobacterium
AERFLTDLPGLRLIGLD

SEQ ID NO: 789713 - protein, 22 aa, Mycobacterium
AERFLTELPGLRLIGLDRDPSA

SEQ ID NO: 789714 - protein, 23 aa, Mycobacterium
AERFLTELPGLRLIGLDRDPTAL

SEQ ID NO: 789715 - protein, 20 aa, Mycobacterium
AERFSPFSGFGFFASGLSGF

SEQ ID NO: 789716 - protein, 28 aa, Mycobacterium
AERGDDVLHWFWQAFPVVQESAVHELWD

SEQ ID NO: 789717 - protein, 18 aa, Mycobacterium
AERGLFDFVLVDDGARRR

SEQ ID NO: 789718 - protein, 37 aa, Mycobacterium
AERGLFDSLFLADSLALDGEAYRRPWRACDPIVLFSA

SEQ ID NO: 789719 - protein, 20 aa, Mycobacterium
AERGLLDFLTIDDSLDAQPG

SEQ ID NO: 789720 - protein, 23 aa, Mycobacterium
AERGLLDFLTIDDTLMPQPGRRE

SEQ ID NO: 789721 - protein, 17 aa, Mycobacterium
AERGLRRILTEGGPILL

SEQ ID NO: 789722 - protein, 24 aa, Mycobacterium
AERGYGYGPAFRGLNAMWRRGDEV

SEQ ID NO: 789723 - protein, 24 aa, Mycobacterium
AERGYGYGPAFRGLTSMWRRGDEI

SEQ ID NO: 789724 - protein, 26 aa, Mycobacterium
AERHRWVHYPWRRTVVGVLGPHAFRA

SEQ ID NO: 789725 - protein, 24 aa, Mycobacterium
AERIGLVDLVFPRASFDSTDGGWR

SEQ ID NO: 789726 - protein, 25 aa, Mycobacterium
AERIGLVDLVLPRASFDSPDRGWRS

SEQ ID NO: 789727 - protein, 23 aa, Mycobacterium
AERIGPYLTLLRGISFEQANIQW

SEQ ID NO: 789728 - protein, 19 aa, Mycobacterium
AERIGVVQVLFVGGLDTTK

SEQ ID NO: 789729 - protein, 17 aa, Mycobacterium
AERILAAAADLLRAGGI

SEQ ID NO: 789730 - protein, 25 aa, Mycobacterium
AERIRFVVQLPARSTLWALRDEVAL

SEQ ID NO: 789731 - protein, 28 aa, Mycobacterium
AERITTPLLPDDYLQLANPLWSARELRG

SEQ ID NO: 789732 - protein, 21 aa, Mycobacterium
AERIVIVWQTGDGYRVADVAA

SEQ ID NO: 789733 - protein, 29 aa, Mycobacterium
AERKEVAALLRWLADGHFVLLGYQQCVVG

SEQ ID NO: 789734 - protein, 23 aa, Mycobacterium
AERLAAEAAQFVRRRRVEVFGDG

SEQ ID NO: 789735 - protein, 23 aa, Mycobacterium
AERLAAVASLYRVRKSMYVEAGL

SEQ ID NO: 789736 - protein, 20 aa, Mycobacterium
AERLDWLRTVGADDAIMLGS

SEQ ID NO: 789737 - protein, 26 aa, Mycobacterium
AERLDWVFETFPRLAERRSQVGGTLS

SEQ ID NO: 789738 - protein, 25 aa, Mycobacterium
AERLEALRRTLVARHPGIVVDVLTA

SEQ ID NO: 789739 - protein, 17 aa, Mycobacterium
AERLFAERGFLAVRLED

SEQ ID NO: 789740 - protein, 23 aa, Mycobacterium
AERLFAERGFLAVRLEDIGAAAG

SEQ ID NO: 789741 - protein, 24 aa, Mycobacterium
AERLGFNIALIPPGREEVPAGLRA

SEQ ID NO: 789742 - protein, 23 aa, Mycobacterium
AERLGIDSFLVHRAHALLADSVA

SEQ ID NO: 789743 - protein, 17 aa, Mycobacterium
AERLLARNGWRNTSLAQ

SEQ ID NO: 789744 - protein, 22 aa, Mycobacterium
AERLLRSRLAQLRPGDPIVGEE

SEQ ID NO: 789745 - protein, 19 aa, Mycobacterium
AERLPPRAVTRLVGPLLGA

SEQ ID NO: 789746 - protein, 30 aa, Mycobacterium
AERLQPRIPPSDWPIPMSVLEKLELGEHNA

SEQ ID NO: 789747 - protein, 23 aa, Mycobacterium
AERLRARLIERINNLRVGHSLDP

SEQ ID NO: 789748 - protein, 23 aa, Mycobacterium
AERLRGLRGVEALLPLAPGLADV

SEQ ID NO: 789749 - protein, 17 aa, Mycobacterium
AERLRVLIDWTGAHLAE

SEQ ID NO: 789750 - protein, 17 aa, Mycobacterium
AERLVQLWKVNGSPPEF

SEQ ID NO: 789751 - protein, 25 aa, Mycobacterium
AERLVRAAPGLRYRIYRPAVVMGDS

SEQ ID NO: 789752 - protein, 22 aa, Mycobacterium
AERLVRAVLNCPVPTIAEVTGV

SEQ ID NO: 789753 - protein, 19 aa, Mycobacterium
AERLWPIDAIAERHRRLLA

SEQ ID NO: 789754 - protein, 20 aa, Mycobacterium
AERMAPVLAAERANWAPATG

SEQ ID NO: 789755 - protein, 24 aa, Mycobacterium
AERMPRRFYCRARWRTGGVDSETQ

SEQ ID NO: 789756 - protein, 25 aa, Mycobacterium
AERMRHGMYWSGDLAYRDADGWIYL

SEQ ID NO: 789757 - protein, 26 aa, Mycobacterium
AERMRHGMYWSGDLAYRDSDGWIYLA

SEQ ID NO: 789758 - protein, 25 aa, Mycobacterium
AERMRHGMYWSGDLAYRDSQGWIYL

SEQ ID NO: 789759 - protein, 25 aa, Mycobacterium
AERNRVLPLLGGLAVMFGVLPPLPT

SEQ ID NO: 789760 - protein, 24 aa, Mycobacterium
AERPADWHMLQPLWLDDLSEERRS

SEQ ID NO: 789761 - protein, 19 aa, Mycobacterium
AERPPFICGPLPALDVTDV

SEQ ID NO: 789762 - protein, 32 aa, Mycobacterium
AERPRLSYSLDEACLLIFPRRELSAGEADAAA

SEQ ID NO: 789763 - protein, 23 aa, Mycobacterium
AERPVPLYFSYATTPMHETIQEL

SEQ ID NO: 789764 - protein, 25 aa, Mycobacterium
AERQSMLFSATMPDPIITLARTFMV

SEQ ID NO: 789765 - protein, 18 aa, Mycobacterium
AERRAELKKIIRSPASTP

SEQ ID NO: 789766 - protein, 26 aa, Mycobacterium
AERRGEPWFDPAGLFLALEGSEGAED

SEQ ID NO: 789767 - protein, 22 aa, Mycobacterium
AERRLYELMALMKAADDRLSKG

SEQ ID NO: 789768 - protein, 21 aa, Mycobacterium
AERRRIVELLLNGAPISRDSA

SEQ ID NO: 789769 - protein, 19 aa, Mycobacterium
AERRRLFGMISKVTPERME

SEQ ID NO: 789770 - protein, 26 aa, Mycobacterium
AERRTPPAFYAWRAFARYSPVLPAGR

SEQ ID NO: 789771 - protein, 25 aa, Mycobacterium
AERRYPFPPFTSLDGPYRTVDPAEV

SEQ ID NO: 789772 - protein, 19 aa, Mycobacterium
AERSAVLAKLAKLADDATA

SEQ ID NO: 789773 - protein, 17 aa, Mycobacterium
AERSILPGHPRVLSIAQ

SEQ ID NO: 789774 - protein, 22 aa, Mycobacterium
AERTAWRICSQNRLWSVFGKKR

SEQ ID NO: 789775 - protein, 23 aa, Mycobacterium
AERTAWRICSQNRLWSVFGKKRG

SEQ ID NO: 789776 - protein, 27 aa, Mycobacterium
AERTQLTWPRPPVLCTVKLARRVLTRD

SEQ ID NO: 789777 - protein, 17 aa, Mycobacterium
AERVIMYSRAQLALIRP

SEQ ID NO: 789778 - protein, 26 aa, Mycobacterium
AERVLRGFALSLLVPQPHYDAVTRWV

SEQ ID NO: 789779 - protein, 17 aa, Mycobacterium
AERVNPGGVLLIVDHGA

SEQ ID NO: 789780 - protein, 19 aa, Mycobacterium
AERVSLAHALIGWTKGTGL

SEQ ID NO: 789781 - protein, 19 aa, Mycobacterium
AERVTFATWAIVTGKSPGG

SEQ ID NO: 789782 - protein, 24 aa, Mycobacterium
AERVWEMGFPFRARTRLAGVRLVA

SEQ ID NO: 789783 - protein, 21 aa, Mycobacterium
AERWAITLFDAVPGGAGHVLQ

SEQ ID NO: 789784 - protein, 17 aa, Mycobacterium
AERWLAISVATDEQWRQ

SEQ ID NO: 789785 - protein, 21 aa, Mycobacterium
AERWLRRIAALTRDGVRRRLT

SEQ ID NO: 789786 - protein, 20 aa, Mycobacterium
AERYQLLRWAQQAFTDFSVV

SEQ ID NO: 789787 - protein, 24 aa, Mycobacterium
AERYQPWLDRLLAMDWDNPEHRKI

SEQ ID NO: 789788 - protein, 22 aa, Mycobacterium
AESAPVPSLRDLLRRVEMGIGS

SEQ ID NO: 789789 - protein, 35 aa, Mycobacterium
AESAQLQPLIPLTPEWLAKRMTGTLLATPAVGCSY

SEQ ID NO: 789790 - protein, 19 aa, Mycobacterium
AESDRLFHWDSSGPRPDRH

SEQ ID NO: 789791 - protein, 23 aa, Mycobacterium
AESEALHHRLVRAGVPAVVLNAK

SEQ ID NO: 789792 - protein, 26 aa, Mycobacterium
AESEALLLRWYCRYGGELRRYRVEDA

SEQ ID NO: 789793 - protein, 23 aa, Mycobacterium
AESEDFCRVFRPGGRMLATGEVL

SEQ ID NO: 789794 - protein, 25 aa, Mycobacterium
AESERKFHWPLGRRPDDHPSLSDLG

SEQ ID NO: 789795 - protein, 19 aa, Mycobacterium
AESFARFLERWRVRHPRVV

SEQ ID NO: 789796 - protein, 27 aa, Mycobacterium
AESFDRIDKAYPGRFLLGIGVGHPEAH

SEQ ID NO: 789797 - protein, 24 aa, Mycobacterium
AESFHRIEKAHPGRFLLGIGAGHP

SEQ ID NO: 789798 - protein, 28 aa, Mycobacterium
AESFHRIERAYPGRFLLGIGVGHSEATA

SEQ ID NO: 789799 - protein, 25 aa, Mycobacterium
AESFHRIERIYPGRFRLGIGAGHPE

SEQ ID NO: 789800 - protein, 26 aa, Mycobacterium
AESFKRIEKAYPGRFLLGIGVGHPEH

SEQ ID NO: 789801 - protein, 19 aa, Mycobacterium
AESFLYAHFDQLCETLARY

SEQ ID NO: 789802 - protein, 17 aa, Mycobacterium
AESFWKGKAFQSAYDQA

SEQ ID NO: 789803 - protein, 23 aa, Mycobacterium
AESGLLAPHWPKPYGRNASPAEQ

SEQ ID NO: 789804 - protein, 18 aa, Mycobacterium
AESHLAAIHAKLVELCAL

SEQ ID NO: 789805 - protein, 29 aa, Mycobacterium
AESIDLVVNPMLLPVLSVSGLTDVVTVKP

SEQ ID NO: 789806 - protein, 24 aa, Mycobacterium
AESIRRFRILPVDFTVLTGELTPT

SEQ ID NO: 789807 - protein, 18 aa, Mycobacterium
AESKRFCWNCGKPVGRST

SEQ ID NO: 789808 - protein, 23 aa, Mycobacterium
AESKRFCWNCGRPVGRSTKDGRA

SEQ ID NO: 789809 - protein, 28 aa, Mycobacterium
AESLGYETPLLLNVPSFAICCATILDMG

SEQ ID NO: 789810 - protein, 26 aa, Mycobacterium
AESLHAPRLWPEYHPGYFGAFVRDPD

SEQ ID NO: 789811 - protein, 22 aa, Mycobacterium
AESLHRRVATLAGLPAEVVDEV

SEQ ID NO: 789812 - protein, 25 aa, Mycobacterium
AESLRLLLRRIFESAGGTHDDWDTY

SEQ ID NO: 789813 - protein, 26 aa, Mycobacterium
AESLSQIVWGALYLKSMPPSRGARPV

SEQ ID NO: 789814 - protein, 27 aa, Mycobacterium
AESLTYEMPLILNTPTFTICCATLLDT

SEQ ID NO: 789815 - protein, 18 aa, Mycobacterium
AESLWLELREHGVDVLEL

SEQ ID NO: 789816 - protein, 19 aa, Mycobacterium
AESPHLLADRIRAAVYVGA

SEQ ID NO: 789817 - protein, 28 aa, Mycobacterium
AESPKETWLRLLLMREFPRPQTQIPLVD

SEQ ID NO: 789818 - protein, 27 aa, Mycobacterium
AESPRETWLRLEVIRGGFPRPQTQIPV

SEQ ID NO: 789819 - protein, 28 aa, Mycobacterium
AESPRETWLRLLFVDAGLPYPTTQYVVL

SEQ ID NO: 789820 - protein, 20 aa, Mycobacterium
AESRFTWERIAFDALNIYRQ

SEQ ID NO: 789821 - protein, 28 aa, Mycobacterium
AESRPALMLSWIRDVPALGAAARRLQLE

SEQ ID NO: 789822 - protein, 28 aa, Mycobacterium
AESSADLFTVLPLGELWIAASRLRQVDQ

SEQ ID NO: 789823 - protein, 27 aa, Mycobacterium
AESSDRIPKWLLPVVRDNLRSTGPVRL

SEQ ID NO: 789824 - protein, 27 aa, Mycobacterium
AESTAWATQLRLVQAQLLAKIAAAIGD

SEQ ID NO: 789825 - protein, 22 aa, Mycobacterium
AESTHIFVRAIQDIGLDALAET

SEQ ID NO: 789826 - protein, 20 aa, Mycobacterium
AESTPWPTYPLMYRVSSAHE

SEQ ID NO: 789827 - protein, 24 aa, Mycobacterium
AESTWKLLLDRQSGIRKLEDSFVE

SEQ ID NO: 789828 - protein, 24 aa, Mycobacterium
AESVNSFIRRLPRDRRPRVLAVDS

SEQ ID NO: 789829 - protein, 24 aa, Mycobacterium
AESVSAFLIMLRSVSNPAAVRIVR

SEQ ID NO: 789830 - protein, 22 aa, Mycobacterium
AESWGPLFYEARRAAVAAVNDR

SEQ ID NO: 789831 - protein, 24 aa, Mycobacterium
AESYAYQRPAPIETFPVLSQSVVH

SEQ ID NO: 789832 - protein, 30 aa, Mycobacterium
AESYRAMIADLTSFQWLGPSSAAMIASVLP

SEQ ID NO: 789833 - protein, 29 aa, Mycobacterium
AESYRAMIADLTSFQWLGPSSAAMVASVL

SEQ ID NO: 789834 - protein, 26 aa, Mycobacterium
AESYWRDWAQTLTLPERKPGLMKRSA

SEQ ID NO: 789835 - protein, 23 aa, Mycobacterium
AETARTLLPYVDEIRLVVYPVLL

SEQ ID NO: 789836 - protein, 25 aa, Mycobacterium
AETCAAHRLAWAHLWERVSIEFSNH

SEQ ID NO: 789837 - protein, 24 aa, Mycobacterium
AETDWLGIGLRRGAVYGTHWHGLL

SEQ ID NO: 789838 - protein, 26 aa, Mycobacterium
AETEDLQLLGLLPPAPADANPPDDER

SEQ ID NO: 789839 - protein, 22 aa, Mycobacterium
AETERAMGFCLFNNISIGARHA

SEQ ID NO: 789840 - protein, 26 aa, Mycobacterium
AETHGAAVRKLWVSAGPPPCVVADMP

SEQ ID NO: 789841 - protein, 17 aa, Mycobacterium
AETIDWGRTVLALGMDT

SEQ ID NO: 789842 - protein, 20 aa, Mycobacterium
AETIRGRVPFFAGVTTLNTR

SEQ ID NO: 789843 - protein, 18 aa, Mycobacterium
AETLALGDYRMMPRATFC

SEQ ID NO: 789844 - protein, 25 aa, Mycobacterium
AETLATWFGDLPRQGRPDPADPARA

SEQ ID NO: 789845 - protein, 23 aa, Mycobacterium
AETLLVDRALTDTALPRLVKALQ

SEQ ID NO: 789846 - protein, 23 aa, Mycobacterium
AETLTWSQLYRRTLNVARELSSC

SEQ ID NO: 789847 - protein, 24 aa, Mycobacterium
AETLWEHWDRCALHWFPGSHVLHV

SEQ ID NO: 789848 - protein, 27 aa, Mycobacterium
AETMNPDWPLPLFDLARIASDRGDVER

SEQ ID NO: 789849 - protein, 21 aa, Mycobacterium
AETMRRAVRRQRASLLCIEGG

SEQ ID NO: 789850 - protein, 23 aa, Mycobacterium
AETPEARQWTRDALDVRNRFVLY

SEQ ID NO: 789851 - protein, 17 aa, Mycobacterium
AETPIERKPPWIKTRAK

SEQ ID NO: 789852 - protein, 23 aa, Mycobacterium
AETPLRLVSLVSIDPIPGGDDDQ

SEQ ID NO: 789853 - protein, 19 aa, Mycobacterium
AETQLVLPLTLAMSAHAPT

SEQ ID NO: 789854 - protein, 27 aa, Mycobacterium
AETQTVLWMRMLDRLAGPNPPAIVCID

SEQ ID NO: 789855 - protein, 18 aa, Mycobacterium
AETRAVIAATLAAADTGT

SEQ ID NO: 789856 - protein, 22 aa, Mycobacterium
AETRELLLERLGVALTPEQADE

SEQ ID NO: 789857 - protein, 19 aa, Mycobacterium
AETRFYFVHSYAAQQWEGD

SEQ ID NO: 789858 - protein, 17 aa, Mycobacterium
AETSRPRDFPKNGWVVS

SEQ ID NO: 789859 - protein, 26 aa, Mycobacterium
AETSWDLRKFLWAPKLGCYGIQRIHP

SEQ ID NO: 789860 - protein, 30 aa, Mycobacterium
AETTLGRVLFNELLPRGYPFVNKQMHKKVQ

SEQ ID NO: 789861 - protein, 20 aa, Mycobacterium
AETVPPPEVAANRALLMMLV

SEQ ID NO: 789862 - protein, 20 aa, Mycobacterium
AETWWRRINGLPSAKPDQTE

SEQ ID NO: 789863 - protein, 30 aa, Mycobacterium
AEVAERTYVLLTFISGLLLALSRGDRTIGS

SEQ ID NO: 789864 - protein, 26 aa, Mycobacterium
AEVAGAVLFLLSDLSSYITGQTLLVD

SEQ ID NO: 789865 - protein, 18 aa, Mycobacterium
AEVALAQANSLMLVIGPE

SEQ ID NO: 789866 - protein, 33 aa, Mycobacterium
AEVAPLEMTKWFDTNYHYLVPEIGPDTRFGLHP

SEQ ID NO: 789867 - protein, 23 aa, Mycobacterium
AEVARAWYISALPEAPGRDTAAI

SEQ ID NO: 789868 - protein, 19 aa, Mycobacterium
AEVARWFVEGLVDGVRIDH

SEQ ID NO: 789869 - protein, 19 aa, Mycobacterium
AEVASCLPWYPGQATVEAA

SEQ ID NO: 789870 - protein, 22 aa, Mycobacterium
AEVATEWDRWPSSLAWSADASA

SEQ ID NO: 789871 - protein, 24 aa, Mycobacterium
AEVATYVPGYRLLNEPQFDDPSIH

SEQ ID NO: 789872 - protein, 24 aa, Mycobacterium
AEVDALLYLPDRNVERLREAVDVP

SEQ ID NO: 789873 - protein, 24 aa, Mycobacterium
AEVDGHHVFWTVHARNKKAITLDL

SEQ ID NO: 789874 - protein, 18 aa, Mycobacterium
AEVDGHHVFWTVHARNKR

SEQ ID NO: 789875 - protein, 25 aa, Mycobacterium
AEVDLLIHLPVIALLANTAHPLDPS

SEQ ID NO: 789876 - protein, 24 aa, Mycobacterium
AEVELSWRILDPALDFWASQGRPD

SEQ ID NO: 789877 - protein, 25 aa, Mycobacterium
AEVENPKCHIAWTTLAGIGQVESHN

SEQ ID NO: 789878 - protein, 26 aa, Mycobacterium
AEVEPRMLLVHFLRDQLGLTGTHWGC

SEQ ID NO: 789879 - protein, 27 aa, Mycobacterium
AEVEPRMLLVHFLRDQLRLTGTHWGCD

SEQ ID NO: 789880 - protein, 27 aa, Mycobacterium
AEVERNWFRRVLTGEKLPAIFGSTPHP

SEQ ID NO: 789881 - protein, 23 aa, Mycobacterium
AEVFAFDWLARQFAVTTRLTVEG

SEQ ID NO: 789882 - protein, 23 aa, Mycobacterium
AEVFRYYPYVPGEYLPEGTDLLQ

SEQ ID NO: 789883 - protein, 17 aa, Mycobacterium
AEVGWSFFLGKKVVDRL

SEQ ID NO: 789884 - protein, 20 aa, Mycobacterium
AEVHLPYDRPPLSKEVLRNE

SEQ ID NO: 789885 - protein, 28 aa, Mycobacterium
AEVIAEGLIFLPVGYIGGMLKHVDFLAS

SEQ ID NO: 789886 - protein, 24 aa, Mycobacterium
AEVINRGRYAPRSGWRKAVHRSTG

SEQ ID NO: 789887 - protein, 19 aa, Mycobacterium
AEVKIAHAPLLALLTELME

SEQ ID NO: 789888 - protein, 22 aa, Mycobacterium
AEVLAHWPEVIASPTPAAAGRV

SEQ ID NO: 789889 - protein, 21 aa, Mycobacterium
AEVLALAAALKKDPFSRRPLE

SEQ ID NO: 789890 - protein, 18 aa, Mycobacterium
AEVLAWTETLREAELLGV

SEQ ID NO: 789891 - protein, 23 aa, Mycobacterium
AEVLEMPVTEAVEFFGAGEAKVP

SEQ ID NO: 789892 - protein, 18 aa, Mycobacterium
AEVLGVPRLVVHPGELVN

SEQ ID NO: 789893 - protein, 20 aa, Mycobacterium
AEVLKLINWELASAASEDLS

SEQ ID NO: 789894 - protein, 34 aa, Mycobacterium
AEVLRARNLLPVPWVEPVDIANAVLFLASDEARY

SEQ ID NO: 789895 - protein, 18 aa, Mycobacterium
AEVLRGRKVAPGVRMLIV

SEQ ID NO: 789896 - protein, 17 aa, Mycobacterium
AEVLRIISGGRIIWDPA

SEQ ID NO: 789897 - protein, 26 aa, Mycobacterium
AEVLRPGLLVLPVRGAARYFGSEAVA

SEQ ID NO: 789898 - protein, 32 aa, Mycobacterium
AEVMPEDLIKFGLIPEFIGRLPIVASVTNLDR

SEQ ID NO: 789899 - protein, 26 aa, Mycobacterium
AEVNGQVFIVYGPQVTLVAAPTVERK

SEQ ID NO: 789900 - protein, 27 aa, Mycobacterium
AEVNGQVFIVYGPRVTLVSAPAAEHQF

SEQ ID NO: 789901 - protein, 28 aa, Mycobacterium
AEVNRYPEFLPVVLPRLIADRVGMTPEE

SEQ ID NO: 789902 - protein, 20 aa, Mycobacterium
AEVPAFERLFPPGFEEQRGA

SEQ ID NO: 789903 - protein, 23 aa, Mycobacterium
AEVQHRLRAGLHRITRALHGLEV

SEQ ID NO: 789904 - protein, 24 aa, Mycobacterium
AEVQTYVPGYRLLNDPQFDDPSIN

SEQ ID NO: 789905 - protein, 24 aa, Mycobacterium
AEVQTYVPGYRLLNEPQFDEPSLN

SEQ ID NO: 789906 - protein, 24 aa, Mycobacterium
AEVQTYVPGYRLLNEPQFDEPSVV

SEQ ID NO: 789907 - protein, 17 aa, Mycobacterium
AEVRMLRMLGADLVGMS

SEQ ID NO: 789908 - protein, 28 aa, Mycobacterium
AEVRNFLVANALYWLQEYHIDGLRVDAV

SEQ ID NO: 789909 - protein, 23 aa, Mycobacterium
AEVRQLYLDTLKDWPVDELPEVN

SEQ ID NO: 789910 - protein, 23 aa, Mycobacterium
AEVRQLYLDTLKNWPVDELPEVD

SEQ ID NO: 789911 - protein, 17 aa, Mycobacterium
AEVRRWLTDNLVGEFAA

SEQ ID NO: 789912 - protein, 24 aa, Mycobacterium
AEVSKALVLAYFGSKEDLYVACVE

SEQ ID NO: 789913 - protein, 23 aa, Mycobacterium
AEVTADSHPFWTGDRRIVDSAGQ

SEQ ID NO: 789914 - protein, 18 aa, Mycobacterium
AEVTLLREIGGPVPAGFG

SEQ ID NO: 789915 - protein, 27 aa, Mycobacterium
AEVVGLFGPPLKFDVSLPLSAIGGFAE

SEQ ID NO: 789916 - protein, 27 aa, Mycobacterium
AEVVPVRVYRWKPTPLGGTFDQLVTGI

SEQ ID NO: 789917 - protein, 26 aa, Mycobacterium
AEVVRRLRLPFHMLSDPDFTLAEALH

SEQ ID NO: 789918 - protein, 25 aa, Mycobacterium
AEVVTRWRAGYFTTLKAAPSEHGKW

SEQ ID NO: 789919 - protein, 20 aa, Mycobacterium
AEVWVLVRRESLNRFEHLAL

SEQ ID NO: 789920 - protein, 20 aa, Mycobacterium
AEWAPTFSIYDVATLDELAA

SEQ ID NO: 789921 - protein, 17 aa, Mycobacterium
AEWHFVGVPDLSSLGRD

SEQ ID NO: 789922 - protein, 26 aa, Mycobacterium
AEWHKYWIETRLQWYVDLGIERDNLR

SEQ ID NO: 789923 - protein, 21 aa, Mycobacterium
AEWIIAAFGLLTAGAVLVPVN

SEQ ID NO: 789924 - protein, 30 aa, Mycobacterium
AEWIKVVCFPERWLDLRYVGPAKDAGAAGG

SEQ ID NO: 789925 - protein, 17 aa, Mycobacterium
AEWILRTILSLLSVRGP

SEQ ID NO: 789926 - protein, 17 aa, Mycobacterium
AEWILRTVLSLLSVRGP

SEQ ID NO: 789927 - protein, 20 aa, Mycobacterium
AEWITGVRILSDDPVLTVEQ

SEQ ID NO: 789928 - protein, 18 aa, Mycobacterium
AEWLAAHLTGTDRGLLYL

SEQ ID NO: 789929 - protein, 19 aa, Mycobacterium
AEWLAITYGDDGVGVSCVC

SEQ ID NO: 789930 - protein, 21 aa, Mycobacterium
AEWLELLRELEIPAAPLNTPG

SEQ ID NO: 789931 - protein, 19 aa, Mycobacterium
AEWLVRQGVPFRSAHEAAG

SEQ ID NO: 789932 - protein, 25 aa, Mycobacterium
AEWMAPLLEAMDLTVGWITAESTGA

SEQ ID NO: 789933 - protein, 24 aa, Mycobacterium
AEWMGPLIEAMGLSVGWITAESTS

SEQ ID NO: 789934 - protein, 25 aa, Mycobacterium
AEWMGPLIEAMGLTVGWITAESTAA

SEQ ID NO: 789935 - protein, 24 aa, Mycobacterium
AEWMGPLIEAMGLTVGWITAESTS

SEQ ID NO: 789936 - protein, 28 aa, Mycobacterium
AEWQTMMDINLTGVWKTVKAGIPHMIAG

SEQ ID NO: 789937 - protein, 21 aa, Mycobacterium
AEWRAIWRAVLAAGFELDQRR

SEQ ID NO: 789938 - protein, 17 aa, Mycobacterium
AEWSERFATLAGPWAPV

SEQ ID NO: 789939 - protein, 17 aa, Mycobacterium
AEWSERFATLSGPWAPV

SEQ ID NO: 789940 - protein, 19 aa, Mycobacterium
AEWTAGALLYQCCTAMLAS

SEQ ID NO: 789941 - protein, 19 aa, Mycobacterium
AEWVAKIWPTGNAVTPVPH

SEQ ID NO: 789942 - protein, 19 aa, Mycobacterium
AEYAGASAGLLFSSGYAAN

SEQ ID NO: 789943 - protein, 18 aa, Mycobacterium
AEYAKVFGMEVIAWSQNL

SEQ ID NO: 789944 - protein, 23 aa, Mycobacterium
AEYASQRWDWHDLEVGRTAIVPD

SEQ ID NO: 789945 - protein, 33 aa, Mycobacterium
AEYAVLDARHVIALPASLSWIDAAALPVGLATE

SEQ ID NO: 789946 - protein, 32 aa, Mycobacterium
AEYDALRDVGFWRLTVPREYGGLGFGYQTLMS

SEQ ID NO: 789947 - protein, 25 aa, Mycobacterium
AEYDRDLPHYIPIEQIAKENPEELQ

SEQ ID NO: 789948 - protein, 20 aa, Mycobacterium
AEYDRDLPVYIPVEQIRAEM

SEQ ID NO: 789949 - protein, 24 aa, Mycobacterium
AEYEGFTAIRKWAMQFYPDGRGGS

SEQ ID NO: 789950 - protein, 20 aa, Mycobacterium
AEYFTVPLSNVWGTTLELVD

SEQ ID NO: 789951 - protein, 23 aa, Mycobacterium
AEYGQLVSLFPLQKALPVGDGHP

SEQ ID NO: 789952 - protein, 24 aa, Mycobacterium
AEYGSIIAPTLVLWTSDDPTADVS

SEQ ID NO: 789953 - protein, 25 aa, Mycobacterium
AEYHGLPLVTLHHVPMRPNGQVVAI

SEQ ID NO: 789954 - protein, 18 aa, Mycobacterium
AEYHQNPFIGSHPGMPWD

SEQ ID NO: 789955 - protein, 26 aa, Mycobacterium
AEYKKLLLAMLQRREAWEIIDYVNRL

SEQ ID NO: 789956 - protein, 35 aa, Mycobacterium
AEYMATRGVAFLGWNTRFRGFESNFLLDHALVDIG

SEQ ID NO: 789957 - protein, 18 aa, Mycobacterium
AEYVLYFEAGTKTVLRTH

SEQ ID NO: 789958 - protein, 34 aa, Mycobacterium
AEYVPKLLEMHKGPFVLAGWSLGGALAYACAIGL

SEQ ID NO: 789959 - protein, 17 aa, Mycobacterium
AEYYANDILALVSQAWL

SEQ ID NO: 789960 - protein, 28 aa, Mycobacterium
AFAAAGFEYVWPRIAALVVQPGVEFDHV

SEQ ID NO: 789961 - protein, 28 aa, Mycobacterium
AFAAAGLPSPLPYLLGELPAGSSAHTDH

SEQ ID NO: 789962 - protein, 30 aa, Mycobacterium
AFAAQPGMFTFGWGPVLHQLAAGLGVKIDN

SEQ ID NO: 789963 - protein, 26 aa, Mycobacterium
AFADAFAYARRTLGLPATVVDWGLWK

SEQ ID NO: 789964 - protein, 26 aa, Mycobacterium
AFADFDTWKGLGETALAVIKDPSLID

SEQ ID NO: 789965 - protein, 24 aa, Mycobacterium
AFADHHVPFLWNEANPAFSSMANA

SEQ ID NO: 789966 - protein, 31 aa, Mycobacterium
AFADIAPATRLPWFGPPMSAVSSLTARLMET

SEQ ID NO: 789967 - protein, 18 aa, Mycobacterium
AFADSWKQTLRASDYAAG

SEQ ID NO: 789968 - protein, 25 aa, Mycobacterium
AFAEFGGWLMPVSYAGTVAEHNATR

SEQ ID NO: 789969 - protein, 30 aa, Mycobacterium
AFAEREGVNLTFLPFFAKAAVEALKTHPNV

SEQ ID NO: 789970 - protein, 32 aa, Mycobacterium
AFAEREGVNLTFLPFFARAVIDALKIHPNINA

SEQ ID NO: 789971 - protein, 18 aa, Mycobacterium
AFAFEHYVHIRYDLLQPH

SEQ ID NO: 789972 - protein, 20 aa, Mycobacterium
AFAFSHRSYLDGMLLPEVIQ

SEQ ID NO: 789973 - protein, 19 aa, Mycobacterium
AFAKGTIFSSPSTGAHLVQ

SEQ ID NO: 789974 - protein, 27 aa, Mycobacterium
AFALDTTTWRLATLFGLLDAVAAALDG

SEQ ID NO: 789975 - protein, 19 aa, Mycobacterium
AFALEWRSRYLPSMSEICS

SEQ ID NO: 789976 - protein, 18 aa, Mycobacterium
AFAMTVPPPLIAANRVRL

SEQ ID NO: 789977 - protein, 23 aa, Mycobacterium
AFAPAMVRARFHLWESGETAQMV

SEQ ID NO: 789978 - protein, 21 aa, Mycobacterium
AFAPVQEHYYDEPPRIERGWR

SEQ ID NO: 789979 - protein, 20 aa, Mycobacterium
AFAPVVLSWAADVGGGDGAD

SEQ ID NO: 789980 - protein, 21 aa, Mycobacterium
AFAQMFPHRRFGGGALAVYLN

SEQ ID NO: 789981 - protein, 30 aa, Mycobacterium
AFARQWISAWQLPLEWLQIPPGGIALDVGS

SEQ ID NO: 789982 - protein, 27 aa, Mycobacterium
AFASSFGAPVVFFCQNNQWAISEPVRV

SEQ ID NO: 789983 - protein, 24 aa, Mycobacterium
AFATMACLYPDRIFLGVGTGEALN

SEQ ID NO: 789984 - protein, 25 aa, Mycobacterium
AFATMGCLYPDRIFLGVGTGEALNE

SEQ ID NO: 789985 - protein, 21 aa, Mycobacterium
AFAVHPGIVATSLARHMTNDD

SEQ ID NO: 789986 - protein, 17 aa, Mycobacterium
AFCRPTSICWPLPRSSS

SEQ ID NO: 789987 - protein, 22 aa, Mycobacterium
AFCTSQLAHFKAPKAFIVVEHI

SEQ ID NO: 789988 - protein, 19 aa, Mycobacterium
AFCYDIFSQIGGLLKSDEG

SEQ ID NO: 789989 - protein, 20 aa, Mycobacterium
AFDEDWPNALPWHVTSRGAS

SEQ ID NO: 789990 - protein, 17 aa, Mycobacterium
AFDEGWVKPLPPQTLTG

SEQ ID NO: 789991 - protein, 23 aa, Mycobacterium
AFDEQGFFRTGDLGRWVDGDYLT

SEQ ID NO: 789992 - protein, 30 aa, Mycobacterium
AFDFRVMTPTAWWRVPMQSLVGGLATDAAA

SEQ ID NO: 789993 - protein, 29 aa, Mycobacterium
AFDFRVMTPTAWWRVPMQSLVGGLATDPA

SEQ ID NO: 789994 - protein, 26 aa, Mycobacterium
AFDFSVWEIFGAVLRGRRLLVVPESV

SEQ ID NO: 789995 - protein, 17 aa, Mycobacterium
AFDFSVWEIWSALLHGG

SEQ ID NO: 789996 - protein, 19 aa, Mycobacterium
AFDGLGWDDARGLAQWVVM

SEQ ID NO: 789997 - protein, 19 aa, Mycobacterium
AFDHGPWPRMSHADRMAKV

SEQ ID NO: 789998 - protein, 26 aa, Mycobacterium
AFDLAFCLNHLLLKRIWKPQHRALLQ

SEQ ID NO: 789999 - protein, 17 aa, Mycobacterium
AFDLLRRHSQALNIKLA

SEQ ID NO: 790000 - protein, 28 aa, Mycobacterium
AFDLQTGPVFRLTLLRQSPHEHVLVLAV

SEQ ID NO: 790001 - protein, 26 aa, Mycobacterium
AFDQHRDWLRLMARLSTTMAKQASGL

SEQ ID NO: 790002 - protein, 21 aa, Mycobacterium
AFDQIMMDVALHKLPVTMVLD

SEQ ID NO: 790003 - protein, 22 aa, Mycobacterium
AFDQIMMDVALHKLPVTMVLDR

SEQ ID NO: 790004 - protein, 20 aa, Mycobacterium
AFDRGPWPRMTHAERMAKVE

SEQ ID NO: 790005 - protein, 19 aa, Mycobacterium
AFDSEQPLFLLYTSGTTGK

SEQ ID NO: 790006 - protein, 27 aa, Mycobacterium
AFDTELFGHWWYEGPVWLERVLRALPA

SEQ ID NO: 790007 - protein, 19 aa, Mycobacterium
AFDTRGYRRALLISGTTVL

SEQ ID NO: 790008 - protein, 19 aa, Mycobacterium
AFDVLGSPLPLVPISFDPP

SEQ ID NO: 790009 - protein, 18 aa, Mycobacterium
AFDVSVWEIFAALLGGGR

SEQ ID NO: 790010 - protein, 17 aa, Mycobacterium
AFDWVSWRLNKKVEDAQ

SEQ ID NO: 790011 - protein, 20 aa, Mycobacterium
AFEAAFAATVPPAAVAANRA

SEQ ID NO: 790012 - protein, 26 aa, Mycobacterium
AFEAAFAMTVPPPVIAANRELLATLI

SEQ ID NO: 790013 - protein, 39 aa, Mycobacterium
AFEAAFAMTVPPPVIAVNRVLLANLIATNFFGQNTPAIA

SEQ ID NO: 790014 - protein, 19 aa, Mycobacterium
AFEAGWIQPTWPREHGGRS

SEQ ID NO: 790015 - protein, 19 aa, Mycobacterium
AFEELRVLSLLPSRTTTLN

SEQ ID NO: 790016 - protein, 22 aa, Mycobacterium
AFEERLAWNRHLAAAGWTCLGW

SEQ ID NO: 790017 - protein, 21 aa, Mycobacterium
AFEGPPPWNIGEPQPELAALI

SEQ ID NO: 790018 - protein, 20 aa, Mycobacterium
AFEHDGVVPDILTLSKTLGA

SEQ ID NO: 790019 - protein, 26 aa, Mycobacterium
AFEHFGFERYPAFFDMAYNALPDDGV

SEQ ID NO: 790020 - protein, 24 aa, Mycobacterium
AFEHLLDIRIAFTDVHIFNTPTGM

SEQ ID NO: 790021 - protein, 19 aa, Mycobacterium
AFEKGRSWPRERTRLKLEE

SEQ ID NO: 790022 - protein, 23 aa, Mycobacterium
AFEKLRVWNATMADAGWAAVSWP

SEQ ID NO: 790023 - protein, 23 aa, Mycobacterium
AFEKTLLRPVPDEPFDTALTVTP

SEQ ID NO: 790024 - protein, 23 aa, Mycobacterium
AFELAFALTVPPPVIVANRALLM

SEQ ID NO: 790025 - protein, 20 aa, Mycobacterium
AFELELSLLLCFTGITRDSA

SEQ ID NO: 790026 - protein, 35 aa, Mycobacterium
AFELNVYIPMMARNLLESFTLLSNVSRLFAERCID

SEQ ID NO: 790027 - protein, 34 aa, Mycobacterium
AFELNVYIPVMARNLLESFTLLANVSRLFVDKCV

SEQ ID NO: 790028 - protein, 21 aa, Mycobacterium
AFEMAATVDYLFGYDATAGVM

SEQ ID NO: 790029 - protein, 27 aa, Mycobacterium
AFEPEPAPFVPMVAPWASVPEPVRSPA

SEQ ID NO: 790030 - protein, 19 aa, Mycobacterium
AFEPKPVQRPHLPIWIGGD

SEQ ID NO: 790031 - protein, 18 aa, Mycobacterium
AFEPMLIEGKAIQLHPLV

SEQ ID NO: 790032 - protein, 24 aa, Mycobacterium
AFERHYTWIDPKELSYFRSRITQA

SEQ ID NO: 790033 - protein, 17 aa, Mycobacterium
AFESQDLSHWEKAFAGF

SEQ ID NO: 790034 - protein, 42 aa, Mycobacterium
AFETARVAMVHPLAVAANRNAFVRLVLSNVFGQNAPAIALAE

SEQ ID NO: 790035 - protein, 29 aa, Mycobacterium
AFEWMECEKILLFSSDYPHWTFDDPRWLV

SEQ ID NO: 790036 - protein, 24 aa, Mycobacterium
AFEYVRELLSYLPPNNATDAPRYP

SEQ ID NO: 790037 - protein, 18 aa, Mycobacterium
AFFGEKDYQQLVLIRQMV

SEQ ID NO: 790038 - protein, 17 aa, Mycobacterium
AFFGGLTNLAWSFDNDV

SEQ ID NO: 790039 - protein, 49 aa, Mycobacterium
AFFHTNKVPLYFISPTPFNLLGVDRWIRNFFYLTYFDSFEGTHSRVFVP

SEQ ID NO: 790040 - protein, 19 aa, Mycobacterium
AFFLYLESPTQPLNVCCVL

SEQ ID NO: 790041 - protein, 20 aa, Mycobacterium
AFFLYLETPAQPMNVCCVLE

SEQ ID NO: 790042 - protein, 18 aa, Mycobacterium
AFFPVLVCALSWAQRWFP

SEQ ID NO: 790043 - protein, 20 aa, Mycobacterium
AFFRTALALGVEPLHEPRLW

SEQ ID NO: 790044 - protein, 18 aa, Mycobacterium
AFGDVLTAAGLPAPRYGT

SEQ ID NO: 790045 - protein, 25 aa, Mycobacterium
AFGENPDFPYFRRAIQPLDKATIDN

SEQ ID NO: 790046 - protein, 25 aa, Mycobacterium
AFGEVWVRGPWIASGYYRGEGGDKL

SEQ ID NO: 790047 - protein, 21 aa, Mycobacterium
AFGGFVFYFGVPDDDWYPISM

SEQ ID NO: 790048 - protein, 31 aa, Mycobacterium
AFGGGEYVHYAAKAFLCGEIARWVDEEGLSL

SEQ ID NO: 790049 - protein, 20 aa, Mycobacterium
AFGGIGLRLKSSDTLYCCLP

SEQ ID NO: 790050 - protein, 27 aa, Mycobacterium
AFGHPAFRVKFFKGKLKSGFTALEWNS

SEQ ID NO: 790051 - protein, 20 aa, Mycobacterium
AFGITPALARLYRASGQEVP

SEQ ID NO: 790052 - protein, 23 aa, Mycobacterium
AFGKPIKSFQNSRFLLAELATDA

SEQ ID NO: 790053 - protein, 18 aa, Mycobacterium
AFGKRWVTECLRAAYPLG

SEQ ID NO: 790054 - protein, 17 aa, Mycobacterium
AFGLLTAGAVLVPVNTR

SEQ ID NO: 790055 - protein, 20 aa, Mycobacterium
AFGMALRAWNAGLSVAVFQF

SEQ ID NO: 790056 - protein, 21 aa, Mycobacterium
AFGNLLVQRATLQGFIILDHL

SEQ ID NO: 790057 - protein, 27 aa, Mycobacterium
AFGPTGPWARRLGYGPLVRAAAGFTDL

SEQ ID NO: 790058 - protein, 26 aa, Mycobacterium
AFGRREGAKLGLRGLGDGPRDGMLRG

SEQ ID NO: 790059 - protein, 18 aa, Mycobacterium
AFGSFHMVDGFFLNNQLT

SEQ ID NO: 790060 - protein, 18 aa, Mycobacterium
AFGSFHMVDGFLLNNQLS

SEQ ID NO: 790061 - protein, 18 aa, Mycobacterium
AFGSFHMVDGFLLNNQLT

SEQ ID NO: 790062 - protein, 23 aa, Mycobacterium
AFGSPDLYAWLDGNADVAFLPVE

SEQ ID NO: 790063 - protein, 18 aa, Mycobacterium
AFGTGYRHRARLAELVNL

SEQ ID NO: 790064 - protein, 18 aa, Mycobacterium
AFGTIYAEAQRRYFESVA

SEQ ID NO: 790065 - protein, 18 aa, Mycobacterium
AFGTWWHADPKADAILMF

SEQ ID NO: 790066 - protein, 17 aa, Mycobacterium
AFGWDRITALLAGVDSI

SEQ ID NO: 790067 - protein, 24 aa, Mycobacterium
AFGYEAWVLVYDLGQLARISAAYP

SEQ ID NO: 790068 - protein, 22 aa, Mycobacterium
AFGYWRESGRFILFEAPAVVMA

SEQ ID NO: 790069 - protein, 21 aa, Mycobacterium
AFHDGAPLYIELPVTVEIVVT

SEQ ID NO: 790070 - protein, 25 aa, Mycobacterium
AFHDGAPLYIELPVTVELEVTHTEP

SEQ ID NO: 790071 - protein, 20 aa, Mycobacterium
AFHDGTPLYLELPVSVELEV

SEQ ID NO: 790072 - protein, 20 aa, Mycobacterium
AFHDQFTNTLLAGANSYVSA

SEQ ID NO: 790073 - protein, 21 aa, Mycobacterium
AFHERFVQTLFGGAAAYTAAE

SEQ ID NO: 790074 - protein, 34 aa, Mycobacterium
AFHESLNMAALWNLPVLFCCENNLYAMGTALDRA

SEQ ID NO: 790075 - protein, 17 aa, Mycobacterium
AFHRAEVLLTQPMMVVV

SEQ ID NO: 790076 - protein, 18 aa, Mycobacterium
AFHTHYMASALDGYAAAA

SEQ ID NO: 790077 - protein, 18 aa, Mycobacterium
AFHTKYMASALDGYAAAA

SEQ ID NO: 790078 - protein, 23 aa, Mycobacterium
AFHTQFMAPALEGYAAAAAGIAT

SEQ ID NO: 790079 - protein, 22 aa, Mycobacterium
AFHWTRHALRRPLAPGGSVIVM

SEQ ID NO: 790080 - protein, 17 aa, Mycobacterium
AFHYLTIFGDDGRPLHL

SEQ ID NO: 790081 - protein, 19 aa, Mycobacterium
AFIGARWQADTRPNVPIVL

SEQ ID NO: 790082 - protein, 25 aa, Mycobacterium
AFILVRKRLMQLMGKRFGPVYSARL

SEQ ID NO: 790083 - protein, 18 aa, Mycobacterium
AFIMMLRHPEKVTGFFGV

SEQ ID NO: 790084 - protein, 17 aa, Mycobacterium
AFINGIMLTFVAGQPAV

SEQ ID NO: 790085 - protein, 20 aa, Mycobacterium
AFIYVRGEVLPVLRRLQNAV

SEQ ID NO: 790086 - protein, 18 aa, Mycobacterium
AFKEMTLLELSDFVKKFE

SEQ ID NO: 790087 - protein, 20 aa, Mycobacterium
AFKGALTYEFLWRMLTGGNL

SEQ ID NO: 790088 - protein, 19 aa, Mycobacterium
AFKITTTLDMTLAEAILGA

SEQ ID NO: 790089 - protein, 20 aa, Mycobacterium
AFKLLALQQPVASELRMVVG

SEQ ID NO: 790090 - protein, 31 aa, Mycobacterium
AFKPLSRYFDRVWRPEQLPAALLGAMRVLTD

SEQ ID NO: 790091 - protein, 23 aa, Mycobacterium
AFKPPISWGMRTVGKGFLREYPY

SEQ ID NO: 790092 - protein, 26 aa, Mycobacterium
AFKQERYPIFFERAYDILPNDGRMLL

SEQ ID NO: 790093 - protein, 24 aa, Mycobacterium
AFKTLPRLHLARHVVTIVPTHDHE

SEQ ID NO: 790094 - protein, 17 aa, Mycobacterium
AFLAMDLEYHGRADLAW

SEQ ID NO: 790095 - protein, 18 aa, Mycobacterium
AFLAWGDPSLYDSTLRIL

SEQ ID NO: 790096 - protein, 19 aa, Mycobacterium
AFLAWGDPSLYDSTLRILD

SEQ ID NO: 790097 - protein, 18 aa, Mycobacterium
AFLAWHAWSDAERGNWPP

SEQ ID NO: 790098 - protein, 18 aa, Mycobacterium
AFLAWHAWSDSQRGNWPP

SEQ ID NO: 790099 - protein, 18 aa, Mycobacterium
AFLCGPEPMLRFGADALI

SEQ ID NO: 790100 - protein, 20 aa, Mycobacterium
AFLCGPEPMLRFGAEALLTK

SEQ ID NO: 790101 - protein, 22 aa, Mycobacterium
AFLDGLAAYRRAGGLPGMSLGW

SEQ ID NO: 790102 - protein, 18 aa, Mycobacterium
AFLDLVLEHGSQLRWRTT

SEQ ID NO: 790103 - protein, 19 aa, Mycobacterium
AFLGKDEDLFVFDSLADLV

SEQ ID NO: 790104 - protein, 18 aa, Mycobacterium
AFLGKDEDLFVFSSVADL

SEQ ID NO: 790105 - protein, 21 aa, Mycobacterium
AFLGRLALVRIYNGKLKKGQQ

SEQ ID NO: 790106 - protein, 22 aa, Mycobacterium
AFLGRLALVRIYNGKLRKGQQV

SEQ ID NO: 790107 - protein, 20 aa, Mycobacterium
AFLHVDYRKITPIDTPLLVR

SEQ ID NO: 790108 - protein, 19 aa, Mycobacterium
AFLHVDYRKVTPIDTPLTV

SEQ ID NO: 790109 - protein, 18 aa, Mycobacterium
AFLHYRMIDVSSIKELCR

SEQ ID NO: 790110 - protein, 18 aa, Mycobacterium
AFLLIRRGDTQTAVHLSD

SEQ ID NO: 790111 - protein, 18 aa, Mycobacterium
AFLPHKMIAAYGTAKAAV

SEQ ID NO: 790112 - protein, 23 aa, Mycobacterium
AFLPVLVTGLQWAQGWFSAPEGP

SEQ ID NO: 790113 - protein, 17 aa, Mycobacterium
AFLQARQARRAAAAAPF

SEQ ID NO: 790114 - protein, 18 aa, Mycobacterium
AFLQSFVETLGLGRYVIW

SEQ ID NO: 790115 - protein, 30 aa, Mycobacterium
AFLSSGFTPTELLRWVHPSLVASTQGTGMG

SEQ ID NO: 790116 - protein, 17 aa, Mycobacterium
AFMAGSSELWFAAAVAS

SEQ ID NO: 790117 - protein, 20 aa, Mycobacterium
AFMAVCRKWEVLATVIGEVT

SEQ ID NO: 790118 - protein, 20 aa, Mycobacterium
AFMQAYAVAMQPPMGPVFLS

SEQ ID NO: 790119 - protein, 19 aa, Mycobacterium
AFMTTLSAIRSHLAKPAGI

SEQ ID NO: 790120 - protein, 26 aa, Mycobacterium
AFNADKPFMMYWASGCLHGPHHIMKD

SEQ ID NO: 790121 - protein, 19 aa, Mycobacterium
AFNAYIDAARAVANAIGTH

SEQ ID NO: 790122 - protein, 18 aa, Mycobacterium
AFNIGDMNNGFFGRGDGA

SEQ ID NO: 790123 - protein, 19 aa, Mycobacterium
AFNLMAQLSAEELAAGVVC

SEQ ID NO: 790124 - protein, 19 aa, Mycobacterium
AFNPTYLIDGLASLHSERV

SEQ ID NO: 790125 - protein, 24 aa, Mycobacterium
AFNQVLLEIMPAWGGAERLAAVVG

SEQ ID NO: 790126 - protein, 18 aa, Mycobacterium
AFNRTLVAGSKLFDEVAG

SEQ ID NO: 790127 - protein, 23 aa, Mycobacterium
AFNSSIFSEQVWFLGDALGADLD

SEQ ID NO: 790128 - protein, 19 aa, Mycobacterium
AFPASRWRRYDKLEQFPAG

SEQ ID NO: 790129 - protein, 18 aa, Mycobacterium
AFPASRWRRYDKLSRFPA

SEQ ID NO: 790130 - protein, 20 aa, Mycobacterium
AFPDGRVYRLRTNGPSLPAR

SEQ ID NO: 790131 - protein, 26 aa, Mycobacterium
AFPDVSFTFRQFYPDALVEAVLDGTV

SEQ ID NO: 790132 - protein, 24 aa, Mycobacterium
AFPGATFAVFADPGSLAAFGPNPL

SEQ ID NO: 790133 - protein, 22 aa, Mycobacterium
AFPGMIIGEIALLRHIPRTATV

SEQ ID NO: 790134 - protein, 22 aa, Mycobacterium
AFPQKQVFIKDGDRWMICTGKT

SEQ ID NO: 790135 - protein, 23 aa, Mycobacterium
AFPRHLPIQLVVADRLRDLRTEM

SEQ ID NO: 790136 - protein, 17 aa, Mycobacterium
AFPRIRTSCGRCPDRGR

SEQ ID NO: 790137 - protein, 27 aa, Mycobacterium
AFPSEIAEAVLFLSSPRSSFITGSTLH

SEQ ID NO: 790138 - protein, 17 aa, Mycobacterium
AFPTTMRLTGRWLRGRL

SEQ ID NO: 790139 - protein, 17 aa, Mycobacterium
AFPVPKTLESFDVAASS

SEQ ID NO: 790140 - protein, 19 aa, Mycobacterium
AFPVSRWRRYDKLSRFPCG

SEQ ID NO: 790141 - protein, 32 aa, Mycobacterium
AFPVTQWTRWRQPVIGMPTTPRFVGHGHLLVA

SEQ ID NO: 790142 - protein, 25 aa, Mycobacterium
AFQEPRLFPWRSVRDNVLYGLTRTK

SEQ ID NO: 790143 - protein, 27 aa, Mycobacterium
AFQGVSMPLWLSRLVALLIPEHDDRTE

SEQ ID NO: 790144 - protein, 25 aa, Mycobacterium
AFQLATQIALLTQAKLITGIIAGDD

SEQ ID NO: 790145 - protein, 28 aa, Mycobacterium
AFQSGLSWLIILRKRENFRRAFAGFDFE

SEQ ID NO: 790146 - protein, 19 aa, Mycobacterium
AFQTLLRHNRTYTGYAPII

SEQ ID NO: 790147 - protein, 35 aa, Mycobacterium
AFQYVRDYLSFLPSNTFDYPPIVNPGLEPEITEDD

SEQ ID NO: 790148 - protein, 17 aa, Mycobacterium
AFRAKQLAHQYYGRLIA

SEQ ID NO: 790149 - protein, 19 aa, Mycobacterium
AFRAPLVMVSPEVGLTVVP

SEQ ID NO: 790150 - protein, 20 aa, Mycobacterium
AFRDRMGWDLPWVSSGATTF

SEQ ID NO: 790151 - protein, 17 aa, Mycobacterium
AFRDVDWTQWNDLLHRV

SEQ ID NO: 790152 - protein, 18 aa, Mycobacterium
AFRGALEVISRRELLDRV

SEQ ID NO: 790153 - protein, 18 aa, Mycobacterium
AFRHPLVRTVAYEAQLRA

SEQ ID NO: 790154 - protein, 18 aa, Mycobacterium
AFRISWSRVTERATRFLL

SEQ ID NO: 790155 - protein, 21 aa, Mycobacterium
AFRLLGSVDVVFSNAGIVVAG

SEQ ID NO: 790156 - protein, 29 aa, Mycobacterium
AFRQRFGEHFFYILYFQQPGVADAELNGD

SEQ ID NO: 790157 - protein, 20 aa, Mycobacterium
AFRRYCAPDVKWINTGIPSV

SEQ ID NO: 790158 - protein, 25 aa, Mycobacterium
AFRSALFEMTLRHPILRTTFDLSAY

SEQ ID NO: 790159 - protein, 18 aa, Mycobacterium
AFRTTIGLPGTLATRLQP

SEQ ID NO: 790160 - protein, 17 aa, Mycobacterium
AFRVPTPPEYGPVRVRF

SEQ ID NO: 790161 - protein, 23 aa, Mycobacterium
AFRWWKHMVLSNPDSIIIVVHHY

SEQ ID NO: 790162 - protein, 22 aa, Mycobacterium
AFRYVMMVLRHIPRSIFRRLPI

SEQ ID NO: 790163 - protein, 18 aa, Mycobacterium
AFSCRGFAIKLAGLGDQW

SEQ ID NO: 790164 - protein, 32 aa, Mycobacterium
AFSEGELFIIGRIKDLLIIYGRNHSPDDIEAT

SEQ ID NO: 790165 - protein, 22 aa, Mycobacterium
AFSEPLARRYMAAGASFVLVGA

SEQ ID NO: 790166 - protein, 17 aa, Mycobacterium
AFSIFSRIDIQGAAMPI

SEQ ID NO: 790167 - protein, 18 aa, Mycobacterium
AFSKLAIALFTRELHRRY

SEQ ID NO: 790168 - protein, 19 aa, Mycobacterium
AFSLLALQQPVAGELRSIV

SEQ ID NO: 790169 - protein, 29 aa, Mycobacterium
AFSLLNSLGNPVLWSNSLHWAGVHAGILA

SEQ ID NO: 790170 - protein, 24 aa, Mycobacterium
AFSQLGMLSTYNDDPPAACRPFDK

SEQ ID NO: 790171 - protein, 23 aa, Mycobacterium
AFSRPGIELTKRTLWTGLDAGSL

SEQ ID NO: 790172 - protein, 24 aa, Mycobacterium
AFSSLITHRFPFEETADALRTLRT

SEQ ID NO: 790173 - protein, 24 aa, Mycobacterium
AFTAKFGIPVLTSYAATEFGGGVA

SEQ ID NO: 790174 - protein, 23 aa, Mycobacterium
AFTAQLILVSLFSAGGESTASLL

SEQ ID NO: 790175 - protein, 18 aa, Mycobacterium
AFTDDRELIPLRAPVTPA

SEQ ID NO: 790176 - protein, 24 aa, Mycobacterium
AFTEKYGIPVLTSYAATEFGGGVA

SEQ ID NO: 790177 - protein, 25 aa, Mycobacterium
AFTEKYGIPVLTSYAATEFGGGVAG

SEQ ID NO: 790178 - protein, 17 aa, Mycobacterium
AFTFIDYERDWAGIAET

SEQ ID NO: 790179 - protein, 19 aa, Mycobacterium
AFTGRRPVHPTGLTSPIRA

SEQ ID NO: 790180 - protein, 21 aa, Mycobacterium
AFTHTCFMVTPYEGYVKVAEH

SEQ ID NO: 790181 - protein, 19 aa, Mycobacterium
AFTLFSMTRILTWGKYQSP

SEQ ID NO: 790182 - protein, 25 aa, Mycobacterium
AFTRPARLFGLAKLGYTQSYTYFTW

SEQ ID NO: 790183 - protein, 24 aa, Mycobacterium
AFVAYDKPFWRAEGLSGEALTDTA

SEQ ID NO: 790184 - protein, 19 aa, Mycobacterium
AFVCPSNLLWRAVAYSHRV

SEQ ID NO: 790185 - protein, 34 aa, Mycobacterium
AFVDAGGWDVRFPFLMDLATYCAVLLHSNGSLVA

SEQ ID NO: 790186 - protein, 17 aa, Mycobacterium
AFVDGSTWRVVYDLLVD

SEQ ID NO: 790187 - protein, 21 aa, Mycobacterium
AFVEAQMREILYGATNPPRMM

SEQ ID NO: 790188 - protein, 20 aa, Mycobacterium
AFVGEFVRSGKPVAAICHGP

SEQ ID NO: 790189 - protein, 26 aa, Mycobacterium
AFVGRIQPLKAPDIVLRAAAKLPGVR

SEQ ID NO: 790190 - protein, 25 aa, Mycobacterium
AFVHAHPRWIAQAFADALGPAAGEL

SEQ ID NO: 790191 - protein, 22 aa, Mycobacterium
AFVHAHPRWIAQAFADALGTAA

SEQ ID NO: 790192 - protein, 19 aa, Mycobacterium
AFVLHDVFAVPFEEIAGLL

SEQ ID NO: 790193 - protein, 25 aa, Mycobacterium
AFVLRMMMDPPWSLRIQDDAPLAII

SEQ ID NO: 790194 - protein, 24 aa, Mycobacterium
AFVNALPVFIASDPVWAKKFEDAG

SEQ ID NO: 790195 - protein, 27 aa, Mycobacterium
AFVNGGFPNTPWPLTPGHEIAGRIVEL

SEQ ID NO: 790196 - protein, 18 aa, Mycobacterium
AFVPLLIDEPASVACRRF

SEQ ID NO: 790197 - protein, 23 aa, Mycobacterium
AFVRFRIDGKDWPASPFPSLRMR

SEQ ID NO: 790198 - protein, 19 aa, Mycobacterium
AFVRLMFRHRHRRWRKLAH

SEQ ID NO: 790199 - protein, 20 aa, Mycobacterium
AFVRRMLGQLIPYPERVDMI

SEQ ID NO: 790200 - protein, 22 aa, Mycobacterium
AFVRRPQRWIQALAAGSRTGRV

SEQ ID NO: 790201 - protein, 24 aa, Mycobacterium
AFVSPRTFFRYFPTKESVLFSDDL

SEQ ID NO: 790202 - protein, 29 aa, Mycobacterium
AFWDNIIAPTEKLDFIFDATYDCGTHQAN

SEQ ID NO: 790203 - protein, 18 aa, Mycobacterium
AFYAKRIVAGEGAVVHGA

SEQ ID NO: 790204 - protein, 24 aa, Mycobacterium
AFYDDPVMTWLFPGDRARTTQLCR

SEQ ID NO: 790205 - protein, 24 aa, Mycobacterium
AFYDGDLYITGRVKDLVIIDGRNH

SEQ ID NO: 790206 - protein, 17 aa, Mycobacterium
AFYDKVLGVLGFTRQMD

SEQ ID NO: 790207 - protein, 24 aa, Mycobacterium
AFYEHGLQPWDCAAGALIAAEAGA

SEQ ID NO: 790208 - protein, 17 aa, Mycobacterium
AFYGSTPAYRRVLELHG

SEQ ID NO: 790209 - protein, 17 aa, Mycobacterium
AFYREMMTGVFSADGVL

SEQ ID NO: 790210 - protein, 17 aa, Mycobacterium
AFYRGKVATAAFFAKNM

SEQ ID NO: 790211 - protein, 18 aa, Mycobacterium
AFYRRWAEFTDNLSWPQL

SEQ ID NO: 790212 - protein, 37 aa, Mycobacterium
AFYSQLFGWRIDFLDGMPVPYWVIRVAGRDNGGMRAL

SEQ ID NO: 790213 - protein, 17 aa, Mycobacterium
AFYTSYQAGLVNGELGI

SEQ ID NO: 790214 - protein, 30 aa, Mycobacterium
AGAAAHLPAAPYLHLFLARGRVSVEGIGEL

SEQ ID NO: 790215 - protein, 31 aa, Mycobacterium
AGAAAVRVLTGPRWRLGARDLTALWRRAVTL

SEQ ID NO: 790216 - protein, 27 aa, Mycobacterium
AGAAEALRWAMMRGEPLVVLADALAEA

SEQ ID NO: 790217 - protein, 24 aa, Mycobacterium
AGAAFARWAAFRDAMPLVPSMTVA

SEQ ID NO: 790218 - protein, 30 aa, Mycobacterium
AGAAFPDALLTRGLYQYRPEPPFVLGAEIA

SEQ ID NO: 790219 - protein, 28 aa, Mycobacterium
AGAAGAVTVPVNFLAHAGSDGGIGTGGN

SEQ ID NO: 790220 - protein, 26 aa, Mycobacterium
AGAAGGARFAVSGYGAAFAAVTARSA

SEQ ID NO: 790221 - protein, 17 aa, Mycobacterium
AGAAGIGGLLIGEDGMA

SEQ ID NO: 790222 - protein, 26 aa, Mycobacterium
AGAAGLLGADPWEWVLTGGEDHALVG

SEQ ID NO: 790223 - protein, 22 aa, Mycobacterium
AGAAGSAWRSLAAVPTVATASD

SEQ ID NO: 790224 - protein, 24 aa, Mycobacterium
AGAALFVLDEYLRPVPPGVVGELY

SEQ ID NO: 790225 - protein, 23 aa, Mycobacterium
AGAAPIPGGKLVTEGLEHAVDAV

SEQ ID NO: 790226 - protein, 25 aa, Mycobacterium
AGAAPLITAVVPPAADPVSVATAAG

SEQ ID NO: 790227 - protein, 29 aa, Mycobacterium
AGAASPRETWLRMVLIDAGLPVPVTQIPV

SEQ ID NO: 790228 - protein, 34 aa, Mycobacterium
AGAAVDFSVLYPTGRLLDAPLPAWTHSTLLLDRE

SEQ ID NO: 790229 - protein, 18 aa, Mycobacterium
AGAAWQGPASAAMAAAAA

SEQ ID NO: 790230 - protein, 22 aa, Mycobacterium
AGADAMPWLLAGAKTLSYAVNM

SEQ ID NO: 790231 - protein, 23 aa, Mycobacterium
AGADPVLMLTGPIPATEKVLHKA

SEQ ID NO: 790232 - protein, 18 aa, Mycobacterium
AGADTFVIGVRDAGFHLI

SEQ ID NO: 790233 - protein, 20 aa, Mycobacterium
AGAELLVHGKGEKLRVVPLG

SEQ ID NO: 790234 - protein, 20 aa, Mycobacterium
AGAETLPLGDYRMMPRATFC

SEQ ID NO: 790235 - protein, 29 aa, Mycobacterium
AGAFGYWRESGRFILFEAPAVVLATGGIG

SEQ ID NO: 790236 - protein, 26 aa, Mycobacterium
AGAFHTKYMAPALDRYAAAAAAVTTA

SEQ ID NO: 790237 - protein, 25 aa, Mycobacterium
AGAFPNLLPDDFSILDGIFAGYATV

SEQ ID NO: 790238 - protein, 17 aa, Mycobacterium
AGAGALLSISFPGALIG

SEQ ID NO: 790239 - protein, 25 aa, Mycobacterium
AGAGILYRLHLDLASLSIAEFYADG

SEQ ID NO: 790240 - protein, 22 aa, Mycobacterium
AGAGLAVGLFSPALLASTAVGA

SEQ ID NO: 790241 - protein, 30 aa, Mycobacterium
AGAGLVDHFLFEFADPRRLFGLGGQIHREQ

SEQ ID NO: 790242 - protein, 26 aa, Mycobacterium
AGAGRPIVVRLLVTAMRHAAVSREIA

SEQ ID NO: 790243 - protein, 27 aa, Mycobacterium
AGAHLRNMAFYNFGLRLLRHVREAQQA

SEQ ID NO: 790244 - protein, 26 aa, Mycobacterium
AGAHLRNMAFYNFSLRFLKRMNDAQK

SEQ ID NO: 790245 - protein, 25 aa, Mycobacterium
AGAIALVVPAARWPLAPDAVDALRD

SEQ ID NO: 790246 - protein, 24 aa, Mycobacterium
AGAKATVRFLAGYAALESQRAGLG

SEQ ID NO: 790247 - protein, 26 aa, Mycobacterium
AGAKERPLWHALRTVAGRITTPLLPD

SEQ ID NO: 790248 - protein, 18 aa, Mycobacterium
AGAKVLRQYGIGPLPGVA

SEQ ID NO: 790249 - protein, 32 aa, Mycobacterium
AGALARGLSLLRKFAPEALMDKGIRKANKVTS

SEQ ID NO: 790250 - protein, 26 aa, Mycobacterium
AGALDLRPTAQLPPKSLRRLLEVNVE

SEQ ID NO: 790251 - protein, 17 aa, Mycobacterium
AGALFDALAAEHATIYG

SEQ ID NO: 790252 - protein, 19 aa, Mycobacterium
AGALGLPFPPAMVFEHMTI

SEQ ID NO: 790253 - protein, 19 aa, Mycobacterium
AGALIAFEKGRSWPRERTR

SEQ ID NO: 790254 - protein, 23 aa, Mycobacterium
AGALKNVFAISAGMGYSLGIGEN

SEQ ID NO: 790255 - protein, 19 aa, Mycobacterium
AGALLIGGQGRVVEPLRAA

SEQ ID NO: 790256 - protein, 24 aa, Mycobacterium
AGALLMRRDVSCVPLLHGGGQERD

SEQ ID NO: 790257 - protein, 17 aa, Mycobacterium
AGALRDAGIERGQCVAF

SEQ ID NO: 790258 - protein, 17 aa, Mycobacterium
AGALRFIRSCSAPLTAE

SEQ ID NO: 790259 - protein, 18 aa, Mycobacterium
AGALVVLIDGELTWFVER

SEQ ID NO: 790260 - protein, 30 aa, Mycobacterium
AGALVVLVDGALAWFLERGGRTLLTFTDDP

SEQ ID NO: 790261 - protein, 24 aa, Mycobacterium
AGALVVLVDGHLAWFLERGGRSLL

SEQ ID NO: 790262 - protein, 28 aa, Mycobacterium
AGAMAYLVKPFNINDLVPAIEVAVSRFA

SEQ ID NO: 790263 - protein, 32 aa, Mycobacterium
AGAMLIAVLGFRWQLVIFASPLLGVLCSAYWQ

SEQ ID NO: 790264 - protein, 23 aa, Mycobacterium
AGAMVLALHESATDRLVDTAVAQ

SEQ ID NO: 790265 - protein, 22 aa, Mycobacterium
AGANISVYTLMKLLGHESMATS

SEQ ID NO: 790266 - protein, 18 aa, Mycobacterium
AGANLFVEMSAHPALLFS

SEQ ID NO: 790267 - protein, 19 aa, Mycobacterium
AGAPDWVALALNGKVTLLE

SEQ ID NO: 790268 - protein, 22 aa, Mycobacterium
AGAPGGLLYGNGGNGAAGGPNQ

SEQ ID NO: 790269 - protein, 23 aa, Mycobacterium
AGAPGLSGLGGAGGRGGYLIGSG

SEQ ID NO: 790270 - protein, 18 aa, Mycobacterium
AGAPLLRLAAQTALLQAE

SEQ ID NO: 790271 - protein, 28 aa, Mycobacterium
AGAPLPEPLPEPLPKPPPEPRPGARGGQ

SEQ ID NO: 790272 - protein, 19 aa, Mycobacterium
AGAPLTWPAGWSAWPPRGY

SEQ ID NO: 790273 - protein, 32 aa, Mycobacterium; identical to SEQ ID NO: 630397

SEQ ID NO: 790274 - protein, 18 aa, Mycobacterium
AGAPWPQELLADITGLTT

SEQ ID NO: 790275 - protein, 33 aa, Mycobacterium
AGAQDAMQYGILAGYPLVNIKVTLLDGAYHDVD

SEQ ID NO: 790276 - protein, 22 aa, Mycobacterium
AGAQMAERFLRGGRLYTLGNGG

SEQ ID NO: 790277 - protein, 23 aa, Mycobacterium
AGAQTILPAPAPLGGALVEETAL

SEQ ID NO: 790278 - protein, 21 aa, Mycobacterium
AGARALLGESWRDGGELLALA

SEQ ID NO: 790279 - protein, 27 aa, Mycobacterium
AGARDFQRFLIGKLRDIRAVVLNASLD

SEQ ID NO: 790280 - protein, 26 aa, Mycobacterium
AGARDFQRFLIGKLRDIREVVATASL

SEQ ID NO: 790281 - protein, 23 aa, Mycobacterium
AGARLAFVCAVDMPFLAVELIDD

SEQ ID NO: 790282 - protein, 26 aa, Mycobacterium
AGARLHLDNRPRFLDRILDVTGTFEH

SEQ ID NO: 790283 - protein, 21 aa, Mycobacterium
AGARRRFPWGSAQPSAALANL

SEQ ID NO: 790284 - protein, 20 aa, Mycobacterium
AGARRYCAIGMLTVGDEGRM

SEQ ID NO: 790285 - protein, 22 aa, Mycobacterium
AGARVSLPPRDVEGAGLVLAAA

SEQ ID NO: 790286 - protein, 19 aa, Mycobacterium
AGARWILDLGPGDILTRLT

SEQ ID NO: 790287 - protein, 20 aa, Mycobacterium
AGARWILDLGPGDILTRLTA

SEQ ID NO: 790288 - protein, 32 aa, Mycobacterium
AGASDIRYLNGARLLGIYPVSALAAAIGLNAT

SEQ ID NO: 790289 - protein, 26 aa, Mycobacterium
AGASNVMIGSWFAGTYESPGDLMRDR

SEQ ID NO: 790290 - protein, 30 aa, Mycobacterium
AGASSDIWKNIFWLQQRPGISTAEEAFSGG

SEQ ID NO: 790291 - protein, 26 aa, Mycobacterium
AGASVYPLVWNILLAARNEGYGGTIT

SEQ ID NO: 790292 - protein, 28 aa, Mycobacterium
AGATDALHPGLALRSGPAYTTITATTAG

SEQ ID NO: 790293 - protein, 27 aa, Mycobacterium
AGATEALRWAMMRGEPLVVLADALAEA

SEQ ID NO: 790294 - protein, 24 aa, Mycobacterium
AGATPFLEQLLAAAQRAGTRLPDL

SEQ ID NO: 790295 - protein, 17 aa, Mycobacterium
AGATPFSLYPTSAPEQL

SEQ ID NO: 790296 - protein, 36 aa, Mycobacterium
AGATSWEAMLQPYVPGRWLYRPLSVNYRTPAEIMAV

SEQ ID NO: 790297 - protein, 26 aa, Mycobacterium
AGATVGPFTYLRPGTNLGADGKLGAF

SEQ ID NO: 790298 - protein, 19 aa, Mycobacterium
AGATVPAVVAARAAAVQCV

SEQ ID NO: 790299 - protein, 35 aa, Mycobacterium
AGATVVLKPAFQTPWHATLLARLIAEKTDIPAGVI

SEQ ID NO: 790300 - protein, 22 aa, Mycobacterium
AGATWDYFPGHFDPEYARRQGN

SEQ ID NO: 790301 - protein, 17 aa, Mycobacterium
AGAVAAQLGTAFLLAEE

SEQ ID NO: 790302 - protein, 24 aa, Mycobacterium
AGAVARLLGLRLPGPLDSAGVTVP

SEQ ID NO: 790303 - protein, 33 aa, Mycobacterium
AGAVMVPRLPPSQARVLLMAALTAELPIVEVID

SEQ ID NO: 790304 - protein, 33 aa, Mycobacterium
AGAVNFYGQLLQILKNRLLLADLLRRHPEINDI

SEQ ID NO: 790305 - protein, 19 aa, Mycobacterium
AGAVPLIDHLIARGVVTGG

SEQ ID NO: 790306 - protein, 26 aa, Mycobacterium
AGAVRREIGVPTVFNLLGPLTNPAKP

SEQ ID NO: 790307 - protein, 22 aa, Mycobacterium
AGAVSFLIGDDARFITGTVLVV

SEQ ID NO: 790308 - protein, 35 aa, Mycobacterium
AGAVVAPRLRPPQARVLLMAALAAQRPVREVFSSW

SEQ ID NO: 790309 - protein, 21 aa, Mycobacterium
AGAVVLMPAEGRWLLVDTAGD

SEQ ID NO: 790310 - protein, 17 aa, Mycobacterium
AGAWGIISQGYYLATYG

SEQ ID NO: 790311 - protein, 23 aa, Mycobacterium
AGAWVGTRLAACPEALTGEPSRQ

SEQ ID NO: 790312 - protein, 22 aa, Mycobacterium
AGAYFKGGINPVTVWVSTEYVR

SEQ ID NO: 790313 - protein, 24 aa, Mycobacterium
AGAYGYFEPYDAWLSDFTAAKFLT

SEQ ID NO: 790314 - protein, 38 aa, Mycobacterium
AGCDKSIPGMLMAAARLDLASVFLYNGSIMPGKAKLTD

SEQ ID NO: 790315 - protein, 18 aa, Mycobacterium
AGCRLRHALARAKEAFYA

SEQ ID NO: 790316 - protein, 17 aa, Mycobacterium
AGDAAHLMPPFAGQGLG

SEQ ID NO: 790317 - protein, 22 aa, Mycobacterium
AGDACVLWCSAIRHGVLTGDLD

SEQ ID NO: 790318 - protein, 21 aa, Mycobacterium
AGDAIFGFGRVWRQIREAGAN

SEQ ID NO: 790319 - protein, 24 aa, Mycobacterium
AGDARIGRLLFSTQLANPVVMRKR

SEQ ID NO: 790320 - protein, 27 aa, Mycobacterium
AGDAVALAAFRRGTRGLAAMIASVGAV

SEQ ID NO: 790321 - protein, 20 aa, Mycobacterium
AGDAVFAPGFDNPQWHNGFE

SEQ ID NO: 790322 - protein, 24 aa, Mycobacterium
AGDAVKWVAQLGLRNSGNRPSISL

SEQ ID NO: 790323 - protein, 21 aa, Mycobacterium
AGDAVPLVDALLNATGIKPAD

SEQ ID NO: 790324 - protein, 31 aa, Mycobacterium
AGDELCVCDMAWVVGLPQGLVSHHLRQLKNA

SEQ ID NO: 790325 - protein, 52 aa, Mycobacterium
AGDEVSTAIATLFSEHAQSYQALSAQMAAFHDRFMNALAGASGSYASAEAAN

SEQ ID NO: 790326 - protein, 25 aa, Mycobacterium
AGDEWPHLFLPFRAGASQESELPSD

SEQ ID NO: 790327 - protein, 17 aa, Mycobacterium
AGDFPSRWVYRTSPDFY

SEQ ID NO: 790328 - protein, 23 aa, Mycobacterium
AGDFPVFPDYGDDVYYAVSSVAT

SEQ ID NO: 790329 - protein, 17 aa, Mycobacterium
AGDFVAYLDTSSGNWLV

SEQ ID NO: 790330 - protein, 23 aa, Mycobacterium
AGDGAFGGGPFHTGQGGVGGDGG

SEQ ID NO: 790331 - protein, 24 aa, Mycobacterium
AGDGELLIRGPIVMRGYRHQPEKT

SEQ ID NO: 790332 - protein, 29 aa, Mycobacterium
AGDGGAGGRGGWLIGTGGAGGLGGVGGVG

SEQ ID NO: 790333 - protein, 30 aa, Mycobacterium
AGDGGMGGAAGWLGFGGAGGAGGFGGVVGA

SEQ ID NO: 790334 - protein, 29 aa, Mycobacterium
AGDGGTWTIRFFMPAKWTLDALPVPNDNA

SEQ ID NO: 790335 - protein, 25 aa, Mycobacterium
AGDGWSIIMAGLDFERFGIGGNVVL

SEQ ID NO: 790336 - protein, 30 aa, Mycobacterium; identical to SEQ ID NO: 215817

SEQ ID NO: 790337 - protein, 30 aa, Mycobacterium
AGDHAAICWPLLVGMAKAKYYLLTCETLLG

SEQ ID NO: 790338 - protein, 32 aa, Mycobacterium
AGDHAAICWPLLVGMAKAKYYLLTCETLLGEE

SEQ ID NO: 790339 - protein, 29 aa, Mycobacterium
AGDHAAICWPLLVGMAKAKYYLLTCETLS

SEQ ID NO: 790340 - protein, 21 aa, Mycobacterium
AGDIPDWAVFYLLPVDRQRCQ

SEQ ID NO: 790341 - protein, 25 aa, Mycobacterium
AGDKALCPAPVRVPILFGGRSEATM

SEQ ID NO: 790342 - protein, 20 aa, Mycobacterium
AGDKGAVGDSGFAGGTGGAG

SEQ ID NO: 790343 - protein, 26 aa, Mycobacterium
AGDLALAELRHALPGALFVSAHTGDG

SEQ ID NO: 790344 - protein, 24 aa, Mycobacterium
AGDLANWVIPGKLVKGMGGAMDLV

SEQ ID NO: 790345 - protein, 18 aa, Mycobacterium
AGDLLLLADDYQGRGRDG

SEQ ID NO: 790346 - protein, 34 aa, Mycobacterium
AGDLLRPVLGVPRHPLRLAAFGPRAALPATMMAR

SEQ ID NO: 790347 - protein, 33 aa, Mycobacterium
AGDLQYTEELPVRLAWSLSTARPVYIGEDAPAL

SEQ ID NO: 790348 - protein, 23 aa, Mycobacterium
AGDLRGRVLLAERLGRNIELTVT

SEQ ID NO: 790349 - protein, 28 aa, Mycobacterium
AGDLTLAQLSILLTLLEGGPIRMTELAA

SEQ ID NO: 790350 - protein, 17 aa, Mycobacterium
AGDLVAEYGPQVALPPS

SEQ ID NO: 790351 - protein, 17 aa, Mycobacterium
AGDLWPLRDERIPADVP

SEQ ID NO: 790352 - protein, 23 aa, Mycobacterium
AGDMGFPGFSVYAATKAAVRSFA

SEQ ID NO: 790353 - protein, 21 aa, Mycobacterium
AGDNLDPLFDVLMEHIPAPSG

SEQ ID NO: 790354 - protein, 23 aa, Mycobacterium
AGDNVGLLFKKLSNRDLAAGDVI

SEQ ID NO: 790355 - protein, 18 aa, Mycobacterium
AGDPDGPELLKRLKALPG

SEQ ID NO: 790356 - protein, 24 aa, Mycobacterium
AGDPFRALNPLSWASAAKAEATSI

SEQ ID NO: 790357 - protein, 24 aa, Mycobacterium
AGDPGLLQWIADVLPHTDYLLPND

SEQ ID NO: 790358 - protein, 25 aa, Mycobacterium
AGDPVELLALFKTYGAAGSEALLGS

SEQ ID NO: 790359 - protein, 24 aa, Mycobacterium
AGDQAAFPLGWVHDVVWARDGVTV

SEQ ID NO: 790360 - protein, 24 aa, Mycobacterium
AGDQAGFPLGWVHDVVWAPRKAPV

SEQ ID NO: 790361 - protein, 25 aa, Mycobacterium
AGDQAGFPLGWVHDVVWAPRPAAEP

SEQ ID NO: 790362 - protein, 25 aa, Mycobacterium
AGDQAGFPLGWVHDVVWAPRPVPVP

SEQ ID NO: 790363 - protein, 30 aa, Mycobacterium
AGDRAWAQPLPSTFARWREYRRLHKRLRRR

SEQ ID NO: 790364 - protein, 23 aa, Mycobacterium
AGDRIPAYRLSAGSKLPGRPTMA

SEQ ID NO: 790365 - protein, 23 aa, Mycobacterium
AGDRPLIMAIVNRTPDSFYDKGA

SEQ ID NO: 790366 - protein, 24 aa, Mycobacterium
AGDRPLKRFDSDLVVPDLVRAEVA

SEQ ID NO: 790367 - protein, 29 aa, Mycobacterium
AGDRVAIYLPLIPEAVIAMLACARLGIMH

SEQ ID NO: 790368 - protein, 17 aa, Mycobacterium
AGDRVCIFSATRYEWAI

SEQ ID NO: 790369 - protein, 23 aa, Mycobacterium
AGDRVLVISAALRHIHARIVGIT

SEQ ID NO: 790370 - protein, 30 aa, Mycobacterium
AGDRYAFSELFLRHQRHLHRLARLTTRTPE

SEQ ID NO: 790371 - protein, 24 aa, Mycobacterium
AGDSPGLVFVWHDLQEPLFQTFSR

SEQ ID NO: 790372 - protein, 18 aa, Mycobacterium
AGDTLFLEGCGRTDFPGG

SEQ ID NO: 790373 - protein, 24 aa, Mycobacterium
AGDTPAYFQLYYPEDRDLAESFIR

SEQ ID NO: 790374 - protein, 31 aa, Mycobacterium
AGDTPVTGGLLLARIFQEAGLPPGVLSVMIG

SEQ ID NO: 790375 - protein, 28 aa, Mycobacterium
AGDTPWLVFSPFTPYLRSRGVPPFGPGM

SEQ ID NO: 790376 - protein, 21 aa, Mycobacterium
AGDVAECITLTPGKRAPSVIE

SEQ ID NO: 790377 - protein, 32 aa, Mycobacterium
AGDVALGLVLGSWTLLGLLDRAVDLTVAHVSL

SEQ ID NO: 790378 - protein, 24 aa, Mycobacterium
AGDVALIIAVKRLAAAKTRLAPVF

SEQ ID NO: 790379 - protein, 31 aa, Mycobacterium
AGDVDEELLLQLKSWRLNIAKEQNVPAYVVF

SEQ ID NO: 790380 - protein, 27 aa, Mycobacterium
AGDVFAGVLAAWWPQGAETALRRANVA

SEQ ID NO: 790381 - protein, 25 aa, Mycobacterium
AGDVHWHTLFTQRLYAVVWHGHRLA

SEQ ID NO: 790382 - protein, 23 aa, Mycobacterium
AGDVISRKCGVPYLYRFELMGTQ

SEQ ID NO: 790383 - protein, 25 aa, Mycobacterium
AGDVNEELLLQLKSWRLNTAKEQNV

SEQ ID NO: 790384 - protein, 23 aa, Mycobacterium
AGDWPAAIGALVDAPAVVANGFL

SEQ ID NO: 790385 - protein, 25 aa, Mycobacterium
AGDYLEELLDLLDFDGDIDLDVEGD

SEQ ID NO: 790386 - protein, 25 aa, Mycobacterium
AGDYLEELLDLLDFDGDIDLDVEGN

SEQ ID NO: 790387 - protein, 18 aa, Mycobacterium
AGDYLFATASRLVSRLGP

SEQ ID NO: 790388 - protein, 17 aa, Mycobacterium
AGDYVPVTVPWAKIRDQ

SEQ ID NO: 790389 - protein, 17 aa, Mycobacterium
AGEAIDLLKGVLMPAIM

SEQ ID NO: 790390 - protein, 24 aa, Mycobacterium
AGEASALTTAIRRPCQPPSSDIHS

SEQ ID NO: 790391 - protein, 25 aa, Mycobacterium
AGECDLYLGCDLLVAADAKNLAVAS

SEQ ID NO: 790392 - protein, 24 aa, Mycobacterium
AGEDTFTYGLLYQLEDDLARRCEE

SEQ ID NO: 790393 - protein, 22 aa, Mycobacterium
AGEDVYVPWVPHLDGRDEFRGE

SEQ ID NO: 790394 - protein, 24 aa, Mycobacterium
AGEEYLLYERGGQWVLASGVRAMI

SEQ ID NO: 790395 - protein, 23 aa, Mycobacterium
AGEFARLAGAPPGPDRVSACRKL

SEQ ID NO: 790396 - protein, 18 aa, Mycobacterium
AGEFARLAGGPPGPDRVD

SEQ ID NO: 790397 - protein, 18 aa, Mycobacterium
AGEFLPFALAVSNGGERQ

SEQ ID NO: 790398 - protein, 17 aa, Mycobacterium
AGEFWVPHRLGGGAPSL

SEQ ID NO: 790399 - protein, 19 aa, Mycobacterium
AGEGAFPPDRVKILSTGGM

SEQ ID NO: 790400 - protein, 25 aa, Mycobacterium
AGEGILYRLHLDLASLSIAEFYADG

SEQ ID NO: 790401 - protein, 24 aa, Mycobacterium
AGEGVGGAWYWNRYPGARVDFESM

SEQ ID NO: 790402 - protein, 19 aa, Mycobacterium
AGEHARREGRFLMRSRGRP

SEQ ID NO: 790403 - protein, 25 aa, Mycobacterium
AGEIDTAIAALRPPRHPILDADVHL

SEQ ID NO: 790404 - protein, 20 aa, Mycobacterium
AGEIKACWIICTNPVASVAN

SEQ ID NO: 790405 - protein, 26 aa, Mycobacterium
AGEKRSWLRTRGLKIFPLVGWAERGG

SEQ ID NO: 790406 - protein, 23 aa, Mycobacterium
AGELALLRLACEAADAALSDLIK

SEQ ID NO: 790407 - protein, 17 aa, Mycobacterium
AGELFLHTASHGDSLTP

SEQ ID NO: 790408 - protein, 19 aa, Mycobacterium
AGELFLITHLSRAGWLRWS

SEQ ID NO: 790409 - protein, 29 aa, Mycobacterium
AGELGFTYDTGWYLQFRATEPDDFQLAYA

SEQ ID NO: 790410 - protein, 20 aa, Mycobacterium
AGELGVVGVLAVELFETTDG

SEQ ID NO: 790411 - protein, 17 aa, Mycobacterium
AGELIDMGVYPFVVPFR

SEQ ID NO: 790412 - protein, 23 aa, Mycobacterium
AGELLSVPIGDHRVLVLAGRIHA

SEQ ID NO: 790413 - protein, 23 aa, Mycobacterium
AGELYAVGLATYCASKHAVVAFT

SEQ ID NO: 790414 - protein, 22 aa, Mycobacterium
AGELYVVGRIKDVLIIRGRNHY

SEQ ID NO: 790415 - protein, 24 aa, Mycobacterium
AGEMTYLQWLQRYVELAIGDGDST

SEQ ID NO: 790416 - protein, 20 aa, Mycobacterium
AGENLDPLFDVLMEHIPAPS

SEQ ID NO: 790417 - protein, 32 aa, Mycobacterium
AGEPASYPPATWPLGVAFLRNYDVRVIDGAPP

SEQ ID NO: 790418 - protein, 19 aa, Mycobacterium
AGEPFVGPAGRLLARALED

SEQ ID NO: 790419 - protein, 28 aa, Mycobacterium
AGEPLPDYLRRYPVFYAGPAKTPSGHVS

SEQ ID NO: 790420 - protein, 33 aa, Mycobacterium
AGEPNRPLLRPYLRGCLLESVRLWPTTPAILRD

SEQ ID NO: 790421 - protein, 17 aa, Mycobacterium
AGEPWAVQKLYYNHGFL

SEQ ID NO: 790422 - protein, 29 aa, Mycobacterium
AGEPWTVSKLYYIHGFLRERMRILQDEFI

SEQ ID NO: 790423 - protein, 27 aa, Mycobacterium
AGEPWTVSKLYYNHGFLRARMQLLHDE

SEQ ID NO: 790424 - protein, 20 aa, Mycobacterium
AGEQFWLIAHSAARTRVLDA

SEQ ID NO: 790425 - protein, 31 aa, Mycobacterium
AGEQLRLVVAGRWLWPRNPLTGQFPAAYERR

SEQ ID NO: 790426 - protein, 25 aa, Mycobacterium
AGEQTLINLWASWCAPCREEIPVLD

SEQ ID NO: 790427 - protein, 23 aa, Mycobacterium
AGEQWSFANIAPYFKRIEAVEGA

SEQ ID NO: 790428 - protein, 17 aa, Mycobacterium
AGERAGGTILWMADERA

SEQ ID NO: 790429 - protein, 18 aa, Mycobacterium
AGERAGGTILWMADERAI

SEQ ID NO: 790430 - protein, 20 aa, Mycobacterium
AGERAYCSRSMRLNSAGVRA

SEQ ID NO: 790431 - protein, 20 aa, Mycobacterium
AGERGALEAGALPGLLPGGR

SEQ ID NO: 790432 - protein, 19 aa, Mycobacterium
AGERIALWAPPGASYYSDF

SEQ ID NO: 790433 - protein, 24 aa, Mycobacterium
AGERLPAMPVAHGLGLGFDPPVVS

SEQ ID NO: 790434 - protein, 22 aa, Mycobacterium
AGERLRALFSPGVRTRFGRPSR

SEQ ID NO: 790435 - protein, 17 aa, Mycobacterium
AGERPEMVPLSFAQSRL

SEQ ID NO: 790436 - protein, 36 aa, Mycobacterium
AGERPVVVPLSFAQSRLWFIDQLNGPSPVYNMAAAL

SEQ ID NO: 790437 - protein, 23 aa, Mycobacterium
AGERRRSWAVLGEMAELGDDAVA

SEQ ID NO: 790438 - protein, 24 aa, Mycobacterium
AGETALRLLNLRRAARSVEGAGPG

SEQ ID NO: 790439 - protein, 26 aa, Mycobacterium
AGETASIFLPSVPNLLLLASEMEAQR

SEQ ID NO: 790440 - protein, 42 aa, Mycobacterium
AGETAWLTRPLIDSYHTVWFELHEELILAVGLTREQAARSGD

SEQ ID NO: 790441 - protein, 23 aa, Mycobacterium
AGETGCRIVLPEGFHDGTGVFVF

SEQ ID NO: 790442 - protein, 20 aa, Mycobacterium
AGEVFGAWQTVLAGRFRAQG

SEQ ID NO: 790443 - protein, 29 aa, Mycobacterium
AGEVIAEIHSLRLLNLRRATRAISGAEPG

SEQ ID NO: 790444 - protein, 24 aa, Mycobacterium
AGEVPFFEPGLSEVLRRHTSSGRL

SEQ ID NO: 790445 - protein, 23 aa, Mycobacterium
AGEWDFVVIAGVQEGLWPNMIPR

SEQ ID NO: 790446 - protein, 28 aa, Mycobacterium
AGEWLARILFSLFTTPSPIRNLDDPDAP

SEQ ID NO: 790447 - protein, 24 aa, Mycobacterium
AGEYEAILAAALRLFHEHGFRETG

SEQ ID NO: 790448 - protein, 18 aa, Mycobacterium
AGEYWVPHRLGGSAPTLA

SEQ ID NO: 790449 - protein, 19 aa, Mycobacterium
AGFARLSMAWPPEGAVAVP

SEQ ID NO: 790450 - protein, 30 aa, Mycobacterium
AGFARPLTVIASAATRWVWVPESALDVELV

SEQ ID NO: 790451 - protein, 18 aa, Mycobacterium
AGFAVDYSEAGLYLWVTR

SEQ ID NO: 790452 - protein, 25 aa, Mycobacterium
AGFAVKLVQPLRLHYARTLDTWADA

SEQ ID NO: 790453 - protein, 17 aa, Mycobacterium
AGFCDVALVIGADTTPK

SEQ ID NO: 790454 - protein, 17 aa, Mycobacterium
AGFDATRPTAWLAEGLL

SEQ ID NO: 790455 - protein, 19 aa, Mycobacterium
AGFDERAVPVLACGAYRLV

SEQ ID NO: 790456 - protein, 38 aa, Mycobacterium
AGFDGPVDFVLLDGWKDLYLPVIELLEPRLSTGALVVA

SEQ ID NO: 790457 - protein, 25 aa, Mycobacterium
AGFDKHSWLSAWADFYLRAATEWKE

SEQ ID NO: 790458 - protein, 20 aa, Mycobacterium
AGFDLEMIAAARAAVDVPVI

SEQ ID NO: 790459 - protein, 24 aa, Mycobacterium
AGFDPAEPTAWIAEGLLGYLPPEA

SEQ ID NO: 790460 - protein, 38 aa, Mycobacterium
AGFDPAHPTAWLAEGVLIGWLPPEAELRLLDSIIPLSA

SEQ ID NO: 790461 - protein, 34 aa, Mycobacterium
AGFDPDRPTAWIAEGLLPYLPPDAQDRLLDSITA

SEQ ID NO: 790462 - protein, 17 aa, Mycobacterium
AGFDPTRPTAWLAEGLL

SEQ ID NO: 790463 - protein, 22 aa, Mycobacterium
AGFDTVFVMDHFYQLPGIGEPE

SEQ ID NO: 790464 - protein, 18 aa, Mycobacterium
AGFDWEGWVTGMGSTPQS

SEQ ID NO: 790465 - protein, 17 aa, Mycobacterium
AGFEPWIVSRRSSPWMD

SEQ ID NO: 790466 - protein, 20 aa, Mycobacterium
AGFERWVKALDYLETDVPVY

SEQ ID NO: 790467 - protein, 20 aa, Mycobacterium
AGFFALSNKVASTVAGSAYA

SEQ ID NO: 790468 - protein, 25 aa, Mycobacterium
AGFFDDLVTPFLGVYRDNNLRADSS

SEQ ID NO: 790469 - protein, 18 aa, Mycobacterium
AGFFKQIAGFEAAFGKIA

SEQ ID NO: 790470 - protein, 36 aa, Mycobacterium
AGFGATPLRRRAALGRPRRYPCPPRYFVSRGAQRPG

SEQ ID NO: 790471 - protein, 20 aa, Mycobacterium
AGFGRLRLPREFGGFGVDLP

SEQ ID NO: 790472 - protein, 26 aa, Mycobacterium
AGFGVKLVQPLRLHYARTLDTWAAAL

SEQ ID NO: 790473 - protein, 25 aa, Mycobacterium
AGFHDLAHAFDLKSGILAARATLEA

SEQ ID NO: 790474 - protein, 20 aa, Mycobacterium
AGFHTLNLQTYLTVGPKEAR

SEQ ID NO: 790475 - protein, 30 aa, Mycobacterium
AGFIGRGMLTAACPGLIFTSPNALQIAGAT

SEQ ID NO: 790476 - protein, 27 aa, Mycobacterium
AGFIGSPAMNLFTLPIADSAVTLGDWP

SEQ ID NO: 790477 - protein, 29 aa, Mycobacterium
AGFIGSPAMNLFTLPLVDSAVSLGDWPVA

SEQ ID NO: 790478 - protein, 30 aa, Mycobacterium
AGFLINAAAPDVIRLAPPLIVTEAQLDGFV

SEQ ID NO: 790479 - protein, 17 aa, Mycobacterium
AGFLTARPGVCLTTSGP

SEQ ID NO: 790480 - protein, 27 aa, Mycobacterium
AGFMRILGPQFLSRFSGRILNTHPALL

SEQ ID NO: 790481 - protein, 34 aa, Mycobacterium
AGFPFEVFDVLRREAPVWWHPPTAHTPGGEGFWV

SEQ ID NO: 790482 - protein, 18 aa, Mycobacterium
AGFQLTRVIPTVSPISVI

SEQ ID NO: 790483 - protein, 19 aa, Mycobacterium
AGFQPFPGQSGYAATKAFV

SEQ ID NO: 790484 - protein, 28 aa, Mycobacterium
AGFQQLFDTNVRGTYFLVAAAAKGMVAR

SEQ ID NO: 790485 - protein, 18 aa, Mycobacterium
AGFQWARHNICVNAIAPI

SEQ ID NO: 790486 - protein, 19 aa, Mycobacterium
AGFRWRSGRYPGEDAEPAH

SEQ ID NO: 790487 - protein, 28 aa, Mycobacterium
AGFSHFTLLLVHALRQQFSRVRVFAFID

SEQ ID NO: 790488 - protein, 32 aa, Mycobacterium
AGFSYTMTIPEIPINLPLSVPLHIPVEGRTTE

SEQ ID NO: 790489 - protein, 20 aa, Mycobacterium
AGFTGIYWHVHTHPLMRRAV

SEQ ID NO: 790490 - protein, 20 aa, Mycobacterium
AGFTHHMFLPMELEDALPPP

SEQ ID NO: 790491 - protein, 17 aa, Mycobacterium
AGFVYIGGIQRLLEAGQ

SEQ ID NO: 790492 - protein, 17 aa, Mycobacterium
AGGAAGLIGSGGAGGIG

SEQ ID NO: 790493 - protein, 22 aa, Mycobacterium
AGGAAGLLGNGGTGGAGGAGAN

SEQ ID NO: 790494 - protein, 20 aa, Mycobacterium
AGGAAGLWGSGGAGGAGGST

SEQ ID NO: 790495 - protein, 22 aa, Mycobacterium
AGGAAIFLELGPGAALTAAVDQ

SEQ ID NO: 790496 - protein, 18 aa, Mycobacterium
AGGAALAYRPFALALAEA

SEQ ID NO: 790497 - protein, 24 aa, Mycobacterium
AGGAGGLFFGNGGAGGPGGSGGLN

SEQ ID NO: 790498 - protein, 25 aa, Mycobacterium
AGGAGGLFGGIFGAGGGDGGAGGFT

SEQ ID NO: 790499 - protein, 25 aa, Mycobacterium
AGGAGGLLAGLFGSGGGNGGNGGFG

SEQ ID NO: 790500 - protein, 22 aa, Mycobacterium
AGGAGGLLFGTGGAGGTGGFGG

SEQ ID NO: 790501 - protein, 22 aa, Mycobacterium
AGGAGGLLIGNGGAGGAGGLGG

SEQ ID NO: 790502 - protein, 21 aa, Mycobacterium
AGGAGGLLYGNGGNGAPGANP

SEQ ID NO: 790503 - protein, 25 aa, Mycobacterium
AGGAGGNGGFLFGHGGDGGTGGTGA

SEQ ID NO: 790504 - protein, 29 aa, Mycobacterium
AGGAGGRAGLLGYGGAGGAGGLGGSGGAG

SEQ ID NO: 790505 - protein, 25 aa, Mycobacterium
AGGAGGRGGLLYGSGGAGGSGGEGV

SEQ ID NO: 790506 - protein, 25 aa, Mycobacterium
AGGAGGSAWLFGTGGVGGTGGIGTL

SEQ ID NO: 790507 - protein, 27 aa, Mycobacterium
AGGAGGTGGWWFGNGGVGGAGGAGTAG

SEQ ID NO: 790508 - protein, 27 aa, Mycobacterium
AGGAGGVGGWLFGAGGGGGAGGAGGAT

SEQ ID NO: 790509 - protein, 17 aa, Mycobacterium
AGGAGGWFSGDGGVGGI

SEQ ID NO: 790510 - protein, 23 aa, Mycobacterium
AGGAGGWLFGAGGTGGAGGLTVG

SEQ ID NO: 790511 - protein, 21 aa, Mycobacterium
AGGAGGWLFGNGGAGGTGGTS

SEQ ID NO: 790512 - protein, 22 aa, Mycobacterium
AGGAGGWLMGTGGAGGAGGAGG

SEQ ID NO: 790513 - protein, 20 aa, Mycobacterium
AGGAGGWLYGNGGNGGNGGA

SEQ ID NO: 790514 - protein, 25 aa, Mycobacterium
AGGAGTYFISAFGGAGGTGGSGGLL

SEQ ID NO: 790515 - protein, 26 aa, Mycobacterium
AGGANRQLVSLFGAGGAGGAGGAGAD

SEQ ID NO: 790516 - protein, 23 aa, Mycobacterium
AGGASFYGLGLPAGIASDGLEVI

SEQ ID NO: 790517 - protein, 18 aa, Mycobacterium
AGGATRLLAGPDGWCALT

SEQ ID NO: 790518 - protein, 24 aa, Mycobacterium
AGGCFWGLEDLIRALPGVISTRVG

SEQ ID NO: 790519 - protein, 20 aa, Mycobacterium
AGGCGLFDRAILQSGGLERV

SEQ ID NO: 790520 - protein, 22 aa, Mycobacterium
AGGCSCWIGITPAGPANESMGI

SEQ ID NO: 790521 - protein, 25 aa, Mycobacterium
AGGDAGGLLALNFAGNGGNAGQGAG

SEQ ID NO: 790522 - protein, 24 aa, Mycobacterium
AGGDAGWFGNGGIGGAGGAGYFSS

SEQ ID NO: 790523 - protein, 25 aa, Mycobacterium
AGGDAGWLGCGGAGGAGGITIGGTG

SEQ ID NO: 790524 - protein, 24 aa, Mycobacterium
AGGDALRIRRLARAVTPPLARPTL

SEQ ID NO: 790525 - protein, 32 aa, Mycobacterium
AGGDGGGGGKSGWLGLAGALGGGGTGGSGGAG

SEQ ID NO: 790526 - protein, 21 aa, Mycobacterium
AGGDGGLLWGSGGAGARGGQG

SEQ ID NO: 790527 - protein, 28 aa, Mycobacterium
AGGDRHTVVWLPRFFTESAMEDLALLVK

SEQ ID NO: 790528 - protein, 25 aa, Mycobacterium
AGGDRILFACNRFQELVGGRGTGRG

SEQ ID NO: 790529 - protein, 23 aa, Mycobacterium
AGGDWFDTVALGDRLVLIVGDVV

SEQ ID NO: 790530 - protein, 25 aa, Mycobacterium
AGGEEALYLRPFIIATEPGLGVRPA

SEQ ID NO: 790531 - protein, 26 aa, Mycobacterium
AGGEEALYLRPFIIATEPGLGVRPAK

SEQ ID NO: 790532 - protein, 23 aa, Mycobacterium
AGGFDLLFLADVLGAYDVYGGSR

SEQ ID NO: 790533 - protein, 17 aa, Mycobacterium
AGGFIWADPEADLALVV

SEQ ID NO: 790534 - protein, 20 aa, Mycobacterium
AGGFRKKYLRATSRLLALTA

SEQ ID NO: 790535 - protein, 21 aa, Mycobacterium
AGGFRKKYLRATSRLLALTAA

SEQ ID NO: 790536 - protein, 26 aa, Mycobacterium
AGGGDSLAFFWFKDAPDGVPGISAPA

SEQ ID NO: 790537 - protein, 27 aa, Mycobacterium
AGGGGYILLFCDFAKKHRLIEALEGAE

SEQ ID NO: 790538 - protein, 27 aa, Mycobacterium
AGGGGYILLFCDFAKKHRLIESLESAG

SEQ ID NO: 790539 - protein, 18 aa, Mycobacterium
AGGGIVPAPLLAELIARG

SEQ ID NO: 790540 - protein, 22 aa, Mycobacterium
AGGGPVHLLPRTEWDRVIGINL

SEQ ID NO: 790541 - protein, 25 aa, Mycobacterium
AGGGSQFYVLLPDGVQKINSFVADL

SEQ ID NO: 790542 - protein, 30 aa, Mycobacterium
AGGGTPTRWVYYAWRRAVVRVPEPGLFRRE

SEQ ID NO: 790543 - protein, 31 aa, Mycobacterium
AGGGYFFVVELLDAASFWQSVRSGVLESLGR

SEQ ID NO: 790544 - protein, 23 aa, Mycobacterium
AGGHAAALWPFAGLAAAEGADVL

SEQ ID NO: 790545 - protein, 25 aa, Mycobacterium
AGGHALAPRYHDGAPGAGGVGGDGG

SEQ ID NO: 790546 - protein, 22 aa, Mycobacterium
AGGHGGLLFGDGGAGGSGGGGA

SEQ ID NO: 790547 - protein, 34 aa, Mycobacterium
AGGHIGLRPWPQSPWWVFYYYGSPEQPGCQEAAL

SEQ ID NO: 790548 - protein, 26 aa, Mycobacterium
AGGHKPWLPHFYLGHGIGTGAAEMPM

SEQ ID NO: 790549 - protein, 26 aa, Mycobacterium
AGGHSLLPMMKLRIANPEYLVDINDL

SEQ ID NO: 790550 - protein, 26 aa, Mycobacterium
AGGIDFRLFRTIVFRTDLITDSDALA

SEQ ID NO: 790551 - protein, 19 aa, Mycobacterium
AGGIDYGLLRYLRPDTSEV

SEQ ID NO: 790552 - protein, 33 aa, Mycobacterium
AGGIGGFFEKTFAPLGLRKIQAQVLENLKREVE

SEQ ID NO: 790553 - protein, 21 aa, Mycobacterium
AGGIWLWGDVAGWARSRNYEV

SEQ ID NO: 790554 - protein, 28 aa, Mycobacterium
AGGKAVVMTYWNPVLRKGVDTFARDLAS

SEQ ID NO: 790555 - protein, 26 aa, Mycobacterium
AGGKGGLLLGGGGRGGAGGLGGAGGA

SEQ ID NO: 790556 - protein, 27 aa, Mycobacterium
AGGKGGNAVLFGAGGNGGIGGTGAVGG

SEQ ID NO: 790557 - protein, 24 aa, Mycobacterium
AGGLARHVLCFRTLWEATFNELMK

SEQ ID NO: 790558 - protein, 25 aa, Mycobacterium
AGGLARHVLCFRTLWEATYNELMKR

SEQ ID NO: 790559 - protein, 41 aa, Mycobacterium
AGGLDIDVFAPRLSFFWAIGMNFFMEVAKLRAGRLLWSELV

SEQ ID NO: 790560 - protein, 18 aa, Mycobacterium
AGGLELAIWCDLRVVEED

SEQ ID NO: 790561 - protein, 44 aa, Mycobacterium
AGGLELVGIERIQLGLIGMQLTLTQLWRSYGVQPDLVIGHSMGE

SEQ ID NO: 790562 - protein, 18 aa, Mycobacterium
AGGLGFVAAGYLTADMFA

SEQ ID NO: 790563 - protein, 20 aa, Mycobacterium
AGGLGLVGACDIVVAGRAST

SEQ ID NO: 790564 - protein, 18 aa, Mycobacterium
AGGLLAGLVGAGGGDGGS

SEQ ID NO: 790565 - protein, 17 aa, Mycobacterium
AGGLLFGNGGVGGQGGD

SEQ ID NO: 790566 - protein, 18 aa, Mycobacterium
AGGLLGGLVGAGGGDGGA

SEQ ID NO: 790567 - protein, 22 aa, Mycobacterium
AGGLRRLVLIHAPSGFGKSTLA

SEQ ID NO: 790568 - protein, 23 aa, Mycobacterium
AGGLRYCINSAALRFVHLDDLEE

SEQ ID NO: 790569 - protein, 27 aa, Mycobacterium
AGGLYVQWVLARQAAGDLWAAPSGWRV

SEQ ID NO: 790570 - protein, 27 aa, Mycobacterium
AGGMGGSGGWLLGNGGAGGAGGVGGAG

SEQ ID NO: 790571 - protein, 24 aa, Mycobacterium
AGGNAALLGFAGAGGVGGLGGATG

SEQ ID NO: 790572 - protein, 20 aa, Mycobacterium
AGGNAGFLYGAGGAGGAGGD

SEQ ID NO: 790573 - protein, 22 aa, Mycobacterium
AGGNAGLIGNGGHGGLEHIDGN

SEQ ID NO: 790574 - protein, 23 aa, Mycobacterium
AGGNAGLLFGSGGAGGAGGAAVA

SEQ ID NO: 790575 - protein, 22 aa, Mycobacterium
AGGNAGLLFSSAGAGGFGGFGV

SEQ ID NO: 790576 - protein, 23 aa, Mycobacterium
AGGNAMGLFGNGGIGGAGGVGQN

SEQ ID NO: 790577 - protein, 29 aa, Mycobacterium
AGGNAVVMTYWNPVLRYGVDAFARDLAAA

SEQ ID NO: 790578 - protein, 24 aa, Mycobacterium
AGGNGGLFVGVGGAGGQGGAGGAG

SEQ ID NO: 790579 - protein, 23 aa, Mycobacterium
AGGNGGLFYGDGGAGGAGGTGGG

SEQ ID NO: 790580 - protein, 23 aa, Mycobacterium
AGGNGGLLFSGGGVGGAGGLGPS

SEQ ID NO: 790581 - protein, 23 aa, Mycobacterium
AGGNGGWLFGAGGNGGFGGAATG

SEQ ID NO: 790582 - protein, 24 aa, Mycobacterium
AGGNLEFRTLPVVRYDNIDGQDVN

SEQ ID NO: 790583 - protein, 28 aa, Mycobacterium
AGGNVAFATIPILREDGWSDDGMQSVVR

SEQ ID NO: 790584 - protein, 24 aa, Mycobacterium
AGGPDTLLLLEHPPVYTAGKRTEP

SEQ ID NO: 790585 - protein, 23 aa, Mycobacterium
AGGPLREWLHKQRTGLPHVTWKF

SEQ ID NO: 790586 - protein, 22 aa, Mycobacterium
AGGPPPRMALAAPTGKAAARLQ

SEQ ID NO: 790587 - protein, 25 aa, Mycobacterium
AGGPRPLVFFPGDGSLVLGTDAPDQ

SEQ ID NO: 790588 - protein, 23 aa, Mycobacterium
AGGPVTLLDVRWTLAEPNGEQAY

SEQ ID NO: 790589 - protein, 25 aa, Mycobacterium
AGGQGAALWGAGFGGDGAVGGNSFV

SEQ ID NO: 790590 - protein, 24 aa, Mycobacterium
AGGQLVRGYWKRPGLTAARFVANP

SEQ ID NO: 790591 - protein, 25 aa, Mycobacterium
AGGQVWLMPHNPAFDPIPGNDATVL

SEQ ID NO: 790592 - protein, 24 aa, Mycobacterium
AGGQVWLMPHNPAFDPIPGNEATV

SEQ ID NO: 790593 - protein, 24 aa, Mycobacterium
AGGQVWLMPHNPSFDPIPGNDATV

SEQ ID NO: 790594 - protein, 24 aa, Mycobacterium
AGGRAFVSLPWPVPPGADVEATAT

SEQ ID NO: 790595 - protein, 29 aa, Mycobacterium
AGGRAVVMTYWNPVLRYGVDAFARDLAAA

SEQ ID NO: 790596 - protein, 21 aa, Mycobacterium
AGGRCLDVVRLLRITTDSPAV

SEQ ID NO: 790597 - protein, 25 aa, Mycobacterium
AGGRGLLVLLDALSAILTGELTRRQ

SEQ ID NO: 790598 - protein, 22 aa, Mycobacterium
AGGRISALRWGGSAPRVVFLHG

SEQ ID NO: 790599 - protein, 36 aa, Mycobacterium
AGGRLGYLVATPALIDALLLVRLPYHLSSVTQVAAR

SEQ ID NO: 790600 - protein, 17 aa, Mycobacterium
AGGRRIAVPPRGTRPTT

SEQ ID NO: 790601 - protein, 30 aa, Mycobacterium
AGGRVGWRISIPAMLCYWSELTRPAVIPRD

SEQ ID NO: 790602 - protein, 22 aa, Mycobacterium
AGGSAGLLFGSGGIGGDGGFGS

SEQ ID NO: 790603 - protein, 21 aa, Mycobacterium
AGGSAGLYGAGGAGGAGGAST

SEQ ID NO: 790604 - protein, 24 aa, Mycobacterium
AGGSGAPAPFGSGGAYGGTGGQGG

SEQ ID NO: 790605 - protein, 26 aa, Mycobacterium
AGGSGGAARLFGIGGAGGAGGHGVAG

SEQ ID NO: 790606 - protein, 25 aa, Mycobacterium
AGGSGGLLGGLFGAGGGNGGTGGGA

SEQ ID NO: 790607 - protein, 24 aa, Mycobacterium
AGGSGGLLGGLVGAGGGAGGNGGA

SEQ ID NO: 790608 - protein, 17 aa, Mycobacterium
AGGSGGWLVGNGGAGGI

SEQ ID NO: 790609 - protein, 22 aa, Mycobacterium
AGGSGGWLYGTGGAGGSGGAGG

SEQ ID NO: 790610 - protein, 25 aa, Mycobacterium
AGGSLLLHSLFTYDRRWLHEQGIAL

SEQ ID NO: 790611 - protein, 27 aa, Mycobacterium
AGGSNRDWWPNQLNLKILQKNPDVINP

SEQ ID NO: 790612 - protein, 40 aa, Mycobacterium
AGGSRFLIARQPVGPCLLITPWNFPMAMGTRKLGPAIAAG

SEQ ID NO: 790613 - protein, 24 aa, Mycobacterium
AGGTELLNWYRLGIATEGNVLDIG

SEQ ID NO: 790614 - protein, 20 aa, Mycobacterium
AGGTGGMAGLFGAGGAGGEG

SEQ ID NO: 790615 - protein, 24 aa, Mycobacterium
AGGTGLAPILAMLRTMRAAGSTRT

SEQ ID NO: 790616 - protein, 23 aa, Mycobacterium
AGGTPPIFFGFGSMPVESPSAAL

SEQ ID NO: 790617 - protein, 27 aa, Mycobacterium
AGGTPPYLAPYFAAKAAMDALAVAYAR

SEQ ID NO: 790618 - protein, 18 aa, Mycobacterium
AGGTWRPADEDWFDDADP

SEQ ID NO: 790619 - protein, 30 aa, Mycobacterium
AGGVFRIIEQLPRKVALELVYTGDPISAAD

SEQ ID NO: 790620 - protein, 32 aa, Mycobacterium
AGGVGGAGGRGGWISFLSGQGAGGAGGDGGAG

SEQ ID NO: 790621 - protein, 28 aa, Mycobacterium
AGGVGGTGGLISFLGGHGTGGAGGEGGS

SEQ ID NO: 790622 - protein, 26 aa, Mycobacterium
AGGVLGKVRFLYFSPREYIVIFGSPT

SEQ ID NO: 790623 - protein, 17 aa, Mycobacterium
AGGVLYLADEFPEIGLK

SEQ ID NO: 790624 - protein, 26 aa, Mycobacterium
AGGWHAEWLVLRECLRLAGGAAQTAV

SEQ ID NO: 790625 - protein, 18 aa, Mycobacterium
AGGWLIGNGGNGGVGGIG

SEQ ID NO: 790626 - protein, 18 aa, Mycobacterium
AGGWLLGNGGAGGSGAAG

SEQ ID NO: 790627 - protein, 25 aa, Mycobacterium
AGGWPYFHMEMMLAGIPIPVPPGGP

SEQ ID NO: 790628 - protein, 17 aa, Mycobacterium
AGGYFDAISWRPQQSAG

SEQ ID NO: 790629 - protein, 22 aa, Mycobacterium
AGHAAGLWSLQDACALVVESGR

SEQ ID NO: 790630 - protein, 25 aa, Mycobacterium
AGHALGGGCELAMMCDVLIAADTAK

SEQ ID NO: 790631 - protein, 19 aa, Mycobacterium
AGHDALLPGYDVLTRLLGM

SEQ ID NO: 790632 - protein, 28 aa, Mycobacterium
AGHDRLFDTLFLYENYPVDVSTFMGTHE

SEQ ID NO: 790633 - protein, 35 aa, Mycobacterium
AGHEMINFLIRKGVRLIRCAGWSDYYPNHKGGNAS

SEQ ID NO: 790634 - protein, 24 aa, Mycobacterium
AGHFPFTQSFIDRAIRGDYWNLFA

SEQ ID NO: 790635 - protein, 32 aa, Mycobacterium
AGHFVWVREALDLRGKFPLKAGLVTSLGFGHV

SEQ ID NO: 790636 - protein, 18 aa, Mycobacterium
AGHGALVAPVCDWTIMTG

SEQ ID NO: 790637 - protein, 26 aa, Mycobacterium
AGHHRGPFLVCAALRDSIQAAVATGE

SEQ ID NO: 790638 - protein, 17 aa, Mycobacterium
AGHIYAVIGLKDTTTGD

SEQ ID NO: 790639 - protein, 23 aa, Mycobacterium
AGHLARHAGRIPKRFWAHASSPA

SEQ ID NO: 790640 - protein, 23 aa, Mycobacterium
AGHLARRAGRIPKRFWAQASSPE

SEQ ID NO: 790641 - protein, 23 aa, Mycobacterium
AGHLDVYQWLTVLQEYLVLELVG

SEQ ID NO: 790642 - protein, 18 aa, Mycobacterium
AGHLIKTPGRILVVAGPE

SEQ ID NO: 790643 - protein, 17 aa, Mycobacterium
AGHLWKLVRTFDDPATW

SEQ ID NO: 790644 - protein, 17 aa, Mycobacterium
AGHLWKLVRTFDDPSTW

SEQ ID NO: 790645 - protein, 18 aa, Mycobacterium
AGHLWKLVRTFDDPSTWT

SEQ ID NO: 790646 - protein, 20 aa, Mycobacterium
AGHNFPLACPGLLGAMTVGA

SEQ ID NO: 790647 - protein, 21 aa, Mycobacterium
AGHNFPLACPGLLGAMTVGAT

SEQ ID NO: 790648 - protein, 19 aa, Mycobacterium
AGHNFPLACPGLLGSMTVG

SEQ ID NO: 790649 - protein, 23 aa, Mycobacterium
AGHNRWHPDIPAVLRCVPGDIVA

SEQ ID NO: 790650 - protein, 24 aa, Mycobacterium
AGHPAVSAVLYPGLPGHPGHDVAA

SEQ ID NO: 790651 - protein, 18 aa, Mycobacterium
AGHPYMAQILIKAEPRPS

SEQ ID NO: 790652 - protein, 22 aa, Mycobacterium
AGHPYMCQILMTPQTRGIPFGS

SEQ ID NO: 790653 - protein, 21 aa, Mycobacterium
AGHQLKFWTPGGSSTPLLTAE

SEQ ID NO: 790654 - protein, 25 aa, Mycobacterium
AGHRLARLVLTLAAPGRVAVVAGSG

SEQ ID NO: 790655 - protein, 24 aa, Mycobacterium
AGHRLLIEALRRRDARRVVQLNGA

SEQ ID NO: 790656 - protein, 22 aa, Mycobacterium
AGHRTWLLNAPTTPADAAVAAH

SEQ ID NO: 790657 - protein, 19 aa, Mycobacterium
AGHSALLHRVGKHGLLVSE

SEQ ID NO: 790658 - protein, 20 aa, Mycobacterium
AGHSVRFLARNPAKLQTTVA

SEQ ID NO: 790659 - protein, 28 aa, Mycobacterium
AGHTDVAILAYAAKFASAFYGPFREAVS

SEQ ID NO: 790660 - protein, 25 aa, Mycobacterium
AGHTERFWVGLSTYRPGGIAEKAAA

SEQ ID NO: 790661 - protein, 20 aa, Mycobacterium
AGHVRFVIADAHIGALLLAG

SEQ ID NO: 790662 - protein, 21 aa, Mycobacterium
AGIAAYTRYLAEELAPRGIRV

SEQ ID NO: 790663 - protein, 20 aa, Mycobacterium
AGIALLACMPARPGERELVA

SEQ ID NO: 790664 - protein, 19 aa, Mycobacterium
AGIARHFAAILGSGSLRHH

SEQ ID NO: 790665 - protein, 17 aa, Mycobacterium
AGIAVPHSCREGRCGSC

SEQ ID NO: 790666 - protein, 18 aa, Mycobacterium
AGIDFMLGEWKGGEFYTG

SEQ ID NO: 790667 - protein, 24 aa, Mycobacterium
AGIDGVIINLPFYTPGVVSAVGAA

SEQ ID NO: 790668 - protein, 17 aa, Mycobacterium
AGIDLAELTLPTPPPPI

SEQ ID NO: 790669 - protein, 20 aa, Mycobacterium
AGIDMAKSPSFLWLEVDDVV

SEQ ID NO: 790670 - protein, 26 aa, Mycobacterium
AGIDRPLRLTSPEATALLVALRALLD

SEQ ID NO: 790671 - protein, 20 aa, Mycobacterium
AGIDSWRRVVVTATQLGIPV

SEQ ID NO: 790672 - protein, 27 aa, Mycobacterium
AGIDYLAFSGHKLYAPFGAGVLVGQAD

SEQ ID NO: 790673 - protein, 25 aa, Mycobacterium
AGIEPMFAIAFTRAIVGRQLLEVNP

SEQ ID NO: 790674 - protein, 26 aa, Mycobacterium
AGIERKAIRVILGNPLIAITMLRHDL

SEQ ID NO: 790675 - protein, 19 aa, Mycobacterium
AGIERVKATLPRLGELAIG

SEQ ID NO: 790676 - protein, 33 aa, Mycobacterium
AGIGEIPLDDWLWTLGINLWGPIHGCHVFTPIL

SEQ ID NO: 790677 - protein, 26 aa, Mycobacterium
AGIGGATRLYFCEPIAHRQSGTDAMQ

SEQ ID NO: 790678 - protein, 20 aa, Mycobacterium
AGIGPDIIDDVIWGCVSQVG

SEQ ID NO: 790679 - protein, 25 aa, Mycobacterium
AGIGSLDLIRILPDTRRYLGRHLSV

SEQ ID NO: 790680 - protein, 23 aa, Mycobacterium
AGIGSSFPQIPAPAAPPMGNPVR

SEQ ID NO: 790681 - protein, 18 aa, Mycobacterium
AGIGTLMRIFHHGNVLRE

SEQ ID NO: 790682 - protein, 32 aa, Mycobacterium
AGIHPTILNTRGLVPALRSLSARTAVPTSVTA

SEQ ID NO: 790683 - protein, 20 aa, Mycobacterium
AGIIYQATLRHELYAERGFE

SEQ ID NO: 790684 - protein, 28 aa, Mycobacterium
AGIIYQATLRRELHLSLGVEWAPVDPGT

SEQ ID NO: 790685 - protein, 20 aa, Mycobacterium
AGIKLQPFMIHYTASKHAVT

SEQ ID NO: 790686 - protein, 23 aa, Mycobacterium
AGIKPIIGVEAYIAPASRFDTRR

SEQ ID NO: 790687 - protein, 24 aa, Mycobacterium
AGIKPIIGVEAYIAPASRFDTRRI

SEQ ID NO: 790688 - protein, 21 aa, Mycobacterium
AGIKPIIGVEAYIAPGSRFDT

SEQ ID NO: 790689 - protein, 34 aa, Mycobacterium; identical to SEQ ID NO: 113156

SEQ ID NO: 790690 - protein, 32 aa, Mycobacterium
AGIKRPDYSITGWVILTLIQHGTDWQIERFVE

SEQ ID NO: 790691 - protein, 25 aa, Mycobacterium
AGILAVRGDAPWPPARAGFLTLDHV

SEQ ID NO: 790692 - protein, 29 aa, Mycobacterium
AGILHLGGTRLPFGRHLPFGLTVTMDGRQ

SEQ ID NO: 790693 - protein, 35 aa, Mycobacterium
AGILLGLLHHGDPVAGLTWLPFMDQRYTAVSGGPL

SEQ ID NO: 790694 - protein, 25 aa, Mycobacterium
AGILNFVFGEMWLRPGLGMKERRLI

SEQ ID NO: 790695 - protein, 27 aa, Mycobacterium
AGIPAVTFWAAVPHYVSQPPNPKATVA

SEQ ID NO: 790696 - protein, 19 aa, Mycobacterium
AGIPGFYTRTAYGTNLAEG

SEQ ID NO: 790697 - protein, 19 aa, Mycobacterium
AGIPGSLLGQMALGSLTGG

SEQ ID NO: 790698 - protein, 23 aa, Mycobacterium
AGIPLEHVVLPPPFTLGDTVRVP

SEQ ID NO: 790699 - protein, 24 aa, Mycobacterium
AGIPLPLQWGKYRPGTLVAAEFGL

SEQ ID NO: 790700 - protein, 21 aa, Mycobacterium
AGIPPFYVMDVWLAAAERQRS

SEQ ID NO: 790701 - protein, 23 aa, Mycobacterium
AGIPRWKQLLRNAAEDPRGTLRL

SEQ ID NO: 790702 - protein, 17 aa, Mycobacterium
AGIPWDVAALSINKMCL

SEQ ID NO: 790703 - protein, 19 aa, Mycobacterium
AGIQFLVQGTLYPDVVESG

SEQ ID NO: 790704 - protein, 24 aa, Mycobacterium
AGIQLAVHPLASRALFGVPSAELP

SEQ ID NO: 790705 - protein, 23 aa, Mycobacterium
AGIRHLAPYVGYPTAAVALQQLR

SEQ ID NO: 790706 - protein, 18 aa, Mycobacterium
AGIRKLTVASELYPVLCG

SEQ ID NO: 790707 - protein, 24 aa, Mycobacterium
AGIRLGIPHPGALGSALYLYEKPG

SEQ ID NO: 790708 - protein, 17 aa, Mycobacterium
AGIRRPGANPPADRPWS

SEQ ID NO: 790709 - protein, 27 aa, Mycobacterium
AGIRSLLAYQWAHPGKQLLFMGQEFGQ

SEQ ID NO: 790710 - protein, 27 aa, Mycobacterium
AGISRPTFYFYFPSKEAVLLSLIDPLI

SEQ ID NO: 790711 - protein, 27 aa, Mycobacterium
AGISRPTFYFYFRSKNAVLLSLLDQMN

SEQ ID NO: 790712 - protein, 26 aa, Mycobacterium
AGISRPTFYFYFSSKDAVLLALLDRV

SEQ ID NO: 790713 - protein, 26 aa, Mycobacterium
AGISRPTFYFYFSSKESVLLTLAERI

SEQ ID NO: 790714 - protein, 18 aa, Mycobacterium
AGISRRTLFRYYASKNAI

SEQ ID NO: 790715 - protein, 27 aa, Mycobacterium
AGISTRAVLPEWFIGSGLTAAAYRGAQ

SEQ ID NO: 790716 - protein, 20 aa, Mycobacterium
AGITADVTATWWFLGSPRQS

SEQ ID NO: 790717 - protein, 19 aa, Mycobacterium
AGITALTLSAARALERFGV

SEQ ID NO: 790718 - protein, 26 aa, Mycobacterium
AGITGILTMPWMFYTGPDAGLSEKVD

SEQ ID NO: 790719 - protein, 23 aa, Mycobacterium
AGITLYSPLRHWNAGRNTRLAII

SEQ ID NO: 790720 - protein, 32 aa, Mycobacterium
AGITSIVWAIGYRPDYRWIAASAFDGAGRPMQ

SEQ ID NO: 790721 - protein, 21 aa, Mycobacterium
AGIVEFPPAGTLVGIAKRELK

SEQ ID NO: 790722 - protein, 20 aa, Mycobacterium
AGIVPPRDLVFAFIADEEHG

SEQ ID NO: 790723 - protein, 20 aa, Mycobacterium
AGIVPPRDLVFAFLADEEHG

SEQ ID NO: 790724 - protein, 21 aa, Mycobacterium
AGIVPPRDLVFAFLADEEHGG

SEQ ID NO: 790725 - protein, 20 aa, Mycobacterium
AGIYDLVRALADAGKAVIFV

SEQ ID NO: 790726 - protein, 20 aa, Mycobacterium
AGKALRRIGAPFTPRMFADL

SEQ ID NO: 790727 - protein, 22 aa, Mycobacterium
AGKDFVAVMRRLAAGDGPVDVV

SEQ ID NO: 790728 - protein, 29 aa, Mycobacterium
AGKDHRISTLPWPASKWTSSRDLPEPPKE

SEQ ID NO: 790729 - protein, 26 aa, Mycobacterium
AGKDLPVVGFIWEVLGRIGLGRKDAL

SEQ ID NO: 790730 - protein, 26 aa, Mycobacterium
AGKDLPVVGFLWEVFGRIGIDRKDAV

SEQ ID NO: 790731 - protein, 27 aa, Mycobacterium
AGKDRTGLLVGLLLSSVGVDYADIAAD

SEQ ID NO: 790732 - protein, 22 aa, Mycobacterium
AGKEFFAWDQLTGENPGRGIGE

SEQ ID NO: 790733 - protein, 25 aa, Mycobacterium
AGKELPVVGFIWEVLGRIGIGRKDA

SEQ ID NO: 790734 - protein, 25 aa, Mycobacterium
AGKEYDLSSLFLLASTAALFSTSLK

SEQ ID NO: 790735 - protein, 24 aa, Mycobacterium
AGKGFKAVFLPTTPHPSAPDWHRK

SEQ ID NO: 790736 - protein, 29 aa, Mycobacterium
AGKITYIAVYLQMQLPDSAPLPSFDGVGQ

SEQ ID NO: 790737 - protein, 24 aa, Mycobacterium
AGKKVMLAGFVKYFADRFGPDNVH

SEQ ID NO: 790738 - protein, 19 aa, Mycobacterium
AGKLAKWLKAQGHTPLLVA

SEQ ID NO: 790739 - protein, 19 aa, Mycobacterium
AGKLAKWLKGQGHTPLLVA

SEQ ID NO: 790740 - protein, 23 aa, Mycobacterium
AGKMFNVTGWKIGWACGPSDLIA

SEQ ID NO: 790741 - protein, 26 aa, Mycobacterium
AGKPKPHLITSFWFAFGSPEESRAQV

SEQ ID NO: 790742 - protein, 18 aa, Mycobacterium
AGKPLRALVSICAAGGQG

SEQ ID NO: 790743 - protein, 17 aa, Mycobacterium
AGKPQPTLMRDALSRGS

SEQ ID NO: 790744 - protein, 23 aa, Mycobacterium
AGKPWILPAWSEAEQRLALEDGA

SEQ ID NO: 790745 - protein, 21 aa, Mycobacterium
AGKSGLLFGAGGAGGQGGGGG

SEQ ID NO: 790746 - protein, 17 aa, Mycobacterium
AGKSTFVELTLAPLLTG

SEQ ID NO: 790747 - protein, 24 aa, Mycobacterium
AGKSTLLRILAGDLDPLEGAVSVA

SEQ ID NO: 790748 - protein, 28 aa, Mycobacterium
AGKTAMDVCLWLLRNSVDPGQLSWIKPR

SEQ ID NO: 790749 - protein, 26 aa, Mycobacterium
AGKTDRPIIFPLSNPTSRAEAHPAEL

SEQ ID NO: 790750 - protein, 27 aa, Mycobacterium
AGKTTPNLPYLGGRYARFIDHLETFVA

SEQ ID NO: 790751 - protein, 21 aa, Mycobacterium
AGKTVFVFPGQGAQYAGMGAG

SEQ ID NO: 790752 - protein, 20 aa, Mycobacterium
AGKVPKFDFVPSQAAPAYFT

SEQ ID NO: 790753 - protein, 27 aa, Mycobacterium
AGLAAAHQAILGDRLRLALDSSLCGAV

SEQ ID NO: 790754 - protein, 18 aa, Mycobacterium
AGLAAALAVHRRGRKVVV

SEQ ID NO: 790755 - protein, 21 aa, Mycobacterium
AGLAAEHRLYPPQDPRLTGRS

SEQ ID NO: 790756 - protein, 20 aa, Mycobacterium
AGLAAPWWDSAATASLSGMT

SEQ ID NO: 790757 - protein, 21 aa, Mycobacterium
AGLAEIHRALGPGARFLAVER

SEQ ID NO: 790758 - protein, 17 aa, Mycobacterium
AGLALALVLDRCGKRVE

SEQ ID NO: 790759 - protein, 22 aa, Mycobacterium
AGLAPRLRLVPIRRGRGPGPAS

SEQ ID NO: 790760 - protein, 18 aa, Mycobacterium
AGLCGALRLYHESMGVPV

SEQ ID NO: 790761 - protein, 26 aa, Mycobacterium
AGLDADYWYRNIRQTVQFDQAVRSAS

SEQ ID NO: 790762 - protein, 24 aa, Mycobacterium
AGLDARAHRLAWPAGVTVYELDQP

SEQ ID NO: 790763 - protein, 24 aa, Mycobacterium
AGLDARAYRLSWPPGSVVYEVDQP

SEQ ID NO: 790764 - protein, 25 aa, Mycobacterium
AGLDARTYRLPWPDGTVVYELDQPD

SEQ ID NO: 790765 - protein, 26 aa, Mycobacterium
AGLDNVRILDGGLAAWRAAGYRLETG

SEQ ID NO: 790766 - protein, 25 aa, Mycobacterium
AGLDSRAYRLKWPDGMAVYEIDQPK

SEQ ID NO: 790767 - protein, 26 aa, Mycobacterium
AGLDSRAYRLPWPAITTVFELDQPKV

SEQ ID NO: 790768 - protein, 24 aa, Mycobacterium
AGLDSRAYRLSWPDGTTIFELDRP

SEQ ID NO: 790769 - protein, 23 aa, Mycobacterium
AGLDVPTFRMLAGLRGEVPLVSI

SEQ ID NO: 790770 - protein, 27 aa, Mycobacterium
AGLEDCFAALRWLTALPSVDPARVAIG

SEQ ID NO: 790771 - protein, 21 aa, Mycobacterium
AGLELLGFPVGDPRPPLLPLD

SEQ ID NO: 790772 - protein, 26 aa, Mycobacterium
AGLEQRLRALNFPKIVIGVSGGLDST

SEQ ID NO: 790773 - protein, 25 aa, Mycobacterium
AGLERLGVGLWLPAATMARLAADRA

SEQ ID NO: 790774 - protein, 18 aa, Mycobacterium
AGLFASYARQRPRVLSDW

SEQ ID NO: 790775 - protein, 17 aa, Mycobacterium
AGLFGAGAAGGAGGAGG

SEQ ID NO: 790776 - protein, 17 aa, Mycobacterium
AGLFGDGAAGAAGGDGG

SEQ ID NO: 790777 - protein, 17 aa, Mycobacterium
AGLFNAPASQFARLAAA

SEQ ID NO: 790778 - protein, 22 aa, Mycobacterium
AGLFREALVLPFTSFVDEFSRT

SEQ ID NO: 790779 - protein, 25 aa, Mycobacterium
AGLGAAYLAGFDWGLRRGYSVLVEM

SEQ ID NO: 790780 - protein, 18 aa, Mycobacterium
AGLGLEFPDFPRAGQTAK

SEQ ID NO: 790781 - protein, 24 aa, Mycobacterium
AGLGRIGALPRPEPLRDFVSRVDA

SEQ ID NO: 790782 - protein, 25 aa, Mycobacterium
AGLGRLALSPVFREPRQVLELDRDG

SEQ ID NO: 790783 - protein, 19 aa, Mycobacterium
AGLGTLLFDLLTPAEERNR

SEQ ID NO: 790784 - protein, 17 aa, Mycobacterium
AGLGVPASLLGRLGADE

SEQ ID NO: 790785 - protein, 25 aa, Mycobacterium
AGLGWGMYPIALLDGSFVPITEQHL

SEQ ID NO: 790786 - protein, 29 aa, Mycobacterium
AGLGWHNDGYYFDWLVVDVKPSHELNFPH

SEQ ID NO: 790787 - protein, 19 aa, Mycobacterium
AGLGYQYGPAFQGLTAVWK

SEQ ID NO: 790788 - protein, 27 aa, Mycobacterium
AGLHAPTWCDPAWLDFPGIAFGRPDEA

SEQ ID NO: 790789 - protein, 38 aa, Mycobacterium
AGLHWDRILFCAKEATYKAWFPLTERWLGFEDAHITFD

SEQ ID NO: 790790 - protein, 20 aa, Mycobacterium
AGLHWFRAALATRSPEDPIL

SEQ ID NO: 790791 - protein, 20 aa, Mycobacterium
AGLIADIYLAGVADGVTLIP

SEQ ID NO: 790792 - protein, 23 aa, Mycobacterium
AGLIAPMRPDRYLKIAAAMRREG

SEQ ID NO: 790793 - protein, 18 aa, Mycobacterium
AGLIAPMRPDRYVRIAAA

SEQ ID NO: 790794 - protein, 20 aa, Mycobacterium
AGLIAPRFTMRQGRRILIPV

SEQ ID NO: 790795 - protein, 17 aa, Mycobacterium
AGLIATGAIDIGIACGI

SEQ ID NO: 790796 - protein, 29 aa, Mycobacterium
AGLIFSGVMPRWITPRWDADRHLSHPPSP

SEQ ID NO: 790797 - protein, 20 aa, Mycobacterium
AGLIGFTKSLARELAPRNIM

SEQ ID NO: 790798 - protein, 20 aa, Mycobacterium
AGLIGLTRDLAQQWTGRKGI

SEQ ID NO: 790799 - protein, 18 aa, Mycobacterium
AGLIKTILCLKNRAIPAT

SEQ ID NO: 790800 - protein, 18 aa, Mycobacterium
AGLILLDTTGRRTWPPQP

SEQ ID NO: 790801 - protein, 20 aa, Mycobacterium
AGLISRRLRVLAGLAGLGAG

SEQ ID NO: 790802 - protein, 25 aa, Mycobacterium
AGLKPAFYHESYAARFPQINWEITP

SEQ ID NO: 790803 - protein, 28 aa, Mycobacterium
AGLKSLHEFFTPLLRNLGACARVAVVGS

SEQ ID NO: 790804 - protein, 17 aa, Mycobacterium
AGLKVLHPEIEGFSITA

SEQ ID NO: 790805 - protein, 23 aa, Mycobacterium
AGLKWPNDVLVDGRKLCGILAEV

SEQ ID NO: 790806 - protein, 21 aa, Mycobacterium
AGLLAGAYLKKAGVTGIRVIE

SEQ ID NO: 790807 - protein, 21 aa, Mycobacterium
AGLLAGIKLKAAGLPFTIVEK

SEQ ID NO: 790808 - protein, 20 aa, Mycobacterium
AGLLALGGRCESGAAIIAEH

SEQ ID NO: 790809 - protein, 18 aa, Mycobacterium
AGLLALRGRCESGAAIIA

SEQ ID NO: 790810 - protein, 17 aa, Mycobacterium
AGLLFNDLTVYFALAVR

SEQ ID NO: 790811 - protein, 23 aa, Mycobacterium
AGLLFNDLTVYFALTVRGRLQRG

SEQ ID NO: 790812 - protein, 17 aa, Mycobacterium
AGLLGNGGAGGAGGTGG

SEQ ID NO: 790813 - protein, 20 aa, Mycobacterium
AGLLLRIDPAIRPAMYRCAT

SEQ ID NO: 790814 - protein, 17 aa, Mycobacterium
AGLLRAPAAHTLVSALR

SEQ ID NO: 790815 - protein, 27 aa, Mycobacterium
AGLMPMLHLDEPITPAAPLPGAPRRAG

SEQ ID NO: 790816 - protein, 26 aa, Mycobacterium
AGLPADAFDFVFIDCPPSLGLLTVNA

SEQ ID NO: 790817 - protein, 19 aa, Mycobacterium
AGLPFFGAGIASFFASTAK

SEQ ID NO: 790818 - protein, 19 aa, Mycobacterium
AGLPFTSINYRLSADGIAA

SEQ ID NO: 790819 - protein, 19 aa, Mycobacterium
AGLPGIPLALARPDIHVTL

SEQ ID NO: 790820 - protein, 19 aa, Mycobacterium
AGLPGSPWHERAKKLSPKG

SEQ ID NO: 790821 - protein, 17 aa, Mycobacterium
AGLPLASTTYYFSSLED

SEQ ID NO: 790822 - protein, 18 aa, Mycobacterium
AGLPRLLDLLAGNEPDRV

SEQ ID NO: 790823 - protein, 18 aa, Mycobacterium
AGLPRLLDVLADGEPGTI

SEQ ID NO: 790824 - protein, 20 aa, Mycobacterium
AGLPSLMVLTGVNSAIDAIW

SEQ ID NO: 790825 - protein, 24 aa, Mycobacterium
AGLPSSPWHERAKKLAPKGTGAVL

SEQ ID NO: 790826 - protein, 27 aa, Mycobacterium
AGLPSSPWYELGRKLAPKGTGAVLAFE

SEQ ID NO: 790827 - protein, 25 aa, Mycobacterium
AGLPSSPWYERAKKLAPKGTGAVLS

SEQ ID NO: 790828 - protein, 17 aa, Mycobacterium
AGLPVLASSAPSTSADE

SEQ ID NO: 790829 - protein, 18 aa, Mycobacterium
AGLPWDAIFAAEMVGAFK

SEQ ID NO: 790830 - protein, 17 aa, Mycobacterium
AGLQATTLHRLLGSRPD

SEQ ID NO: 790831 - protein, 28 aa, Mycobacterium
AGLQPIEPAIALILLGGLRELTALFVED

SEQ ID NO: 790832 - protein, 19 aa, Mycobacterium
AGLQVYWEPAAERLADEGF

SEQ ID NO: 790833 - protein, 25 aa, Mycobacterium
AGLRAGIPSLILWTAGDQPMWGSRV

SEQ ID NO: 790834 - protein, 27 aa, Mycobacterium
AGLRAGIPTLILWFTSDQPIFGAAVKR

SEQ ID NO: 790835 - protein, 27 aa, Mycobacterium
AGLRAGIPTLILWTAGDQPFWGSHIKQ

SEQ ID NO: 790836 - protein, 32 aa, Mycobacterium
AGLRAGVPMLILWLWLDQPMWAEAVSALEVGV

SEQ ID NO: 790837 - protein, 26 aa, Mycobacterium
AGLRCLLAYMWAHPGKQLLFMGQEFG

SEQ ID NO: 790838 - protein, 18 aa, Mycobacterium
AGLRFLFEHAHELEVDPQ

SEQ ID NO: 790839 - protein, 20 aa, Mycobacterium
AGLRLPGVLAAFAAACPRVD

SEQ ID NO: 790840 - protein, 20 aa, Mycobacterium
AGLRLPLNSISWKPPKPTFE

SEQ ID NO: 790841 - protein, 25 aa, Mycobacterium
AGLRPAFFDDAIGARFPQIGWEITP

SEQ ID NO: 790842 - protein, 38 aa, Mycobacterium
AGLRRRRMVVLPWLTPTIASWWVGLVTPIPSGLARPLV

SEQ ID NO: 790843 - protein, 17 aa, Mycobacterium
AGLRRTHWWTDEAGDFG

SEQ ID NO: 790844 - protein, 20 aa, Mycobacterium
AGLRTLCLDAKLYAGGMAST

SEQ ID NO: 790845 - protein, 23 aa, Mycobacterium
AGLSARYFYESFADKDEFVSGVF

SEQ ID NO: 790846 - protein, 20 aa, Mycobacterium
AGLSGLLLVHRRSHQAGARL

SEQ ID NO: 790847 - protein, 27 aa, Mycobacterium
AGLSRPTFYFYFKSKDAVLLSLLEPVI

SEQ ID NO: 790848 - protein, 27 aa, Mycobacterium
AGLSRPTFYFYFPSKDAVLFTLFERVI

SEQ ID NO: 790849 - protein, 25 aa, Mycobacterium
AGLSVITWPKRYGGRDAPLLHWVVF

SEQ ID NO: 790850 - protein, 17 aa, Mycobacterium
AGLSWVLDPIDGTVNFV

SEQ ID NO: 790851 - protein, 19 aa, Mycobacterium
AGLTPLLKMHTLGMDFVPD

SEQ ID NO: 790852 - protein, 23 aa, Mycobacterium
AGLTPLLKMHTLGMDFVPDSIHA

SEQ ID NO: 790853 - protein, 25 aa, Mycobacterium
AGLTVNFPYLLDVQASHVAWIIAWA

SEQ ID NO: 790854 - protein, 17 aa, Mycobacterium
AGLTVYVTLFEGALGQA

SEQ ID NO: 790855 - protein, 19 aa, Mycobacterium
AGLTWCRKAQALGTLDEDA

SEQ ID NO: 790856 - protein, 26 aa, Mycobacterium
AGLTWQQVVLLRAYSRYLRQAGFPYS

SEQ ID NO: 790857 - protein, 23 aa, Mycobacterium
AGLVATAMRLVNAIPAVVAAEPG

SEQ ID NO: 790858 - protein, 21 aa, Mycobacterium
AGLVATLRFHTERMAQLAPAG

SEQ ID NO: 790859 - protein, 25 aa, Mycobacterium
AGLVDALRWLAANVPIYAVNVLLST

SEQ ID NO: 790860 - protein, 20 aa, Mycobacterium
AGLVGTNWFGQNTPGIIALD

SEQ ID NO: 790861 - protein, 19 aa, Mycobacterium
AGLVLKDLPIPTPPSGWSV

SEQ ID NO: 790862 - protein, 25 aa, Mycobacterium
AGLVQRQEGRWRLVRAVAGQPAATP

SEQ ID NO: 790863 - protein, 17 aa, Mycobacterium
AGLVRRLSVVHGRVTLS

SEQ ID NO: 790864 - protein, 20 aa, Mycobacterium
AGLWNPLAAAFPGGVLPTFY

SEQ ID NO: 790865 - protein, 23 aa, Mycobacterium
AGLWPFTHFNRTHVAPPLIISEE

SEQ ID NO: 790866 - protein, 24 aa, Mycobacterium
AGMAFHVILGMWMDGWGYELSEPI

SEQ ID NO: 790867 - protein, 20 aa, Mycobacterium
AGMALPPLLLDPDEAVAMAV

SEQ ID NO: 790868 - protein, 20 aa, Mycobacterium
AGMALRFVRVLRYRDDKSPA

SEQ ID NO: 790869 - protein, 18 aa, Mycobacterium
AGMAPILSLLRHMNETEN

SEQ ID NO: 790870 - protein, 20 aa, Mycobacterium
AGMDPGCPFAPRCPLVIDEC

SEQ ID NO: 790871 - protein, 22 aa, Mycobacterium
AGMEFAVLLFAVRKGFTYPRGY

SEQ ID NO: 790872 - protein, 36 aa, Mycobacterium
AGMFGNALSWDDLPWLRSLTDLPLILKGLCHPDDVR

SEQ ID NO: 790873 - protein, 18 aa, Mycobacterium
AGMHPWGKWGNDFTEYGV

SEQ ID NO: 790874 - protein, 20 aa, Mycobacterium
AGMHPWGKWGRDFTEYGVAA

SEQ ID NO: 790875 - protein, 21 aa, Mycobacterium
AGMHPWGKWGRDFTEYGVIAA

SEQ ID NO: 790876 - protein, 24 aa, Mycobacterium
AGMLAQARAKRWPPNVRFVHSRVE

SEQ ID NO: 790877 - protein, 19 aa, Mycobacterium
AGMLILPIDDEDLTVRPLL

SEQ ID NO: 790878 - protein, 20 aa, Mycobacterium
AGMLKPDIVYFGDSVPKDVV

SEQ ID NO: 790879 - protein, 21 aa, Mycobacterium
AGMLPAFRHTVEELFTAGLVR

SEQ ID NO: 790880 - protein, 18 aa, Mycobacterium
AGMLRFAPLNSFPDNRNL

SEQ ID NO: 790881 - protein, 17 aa, Mycobacterium
AGMLTGVTILNNWIRQG

SEQ ID NO: 790882 - protein, 22 aa, Mycobacterium
AGMPELLQLPTDRPYPPVADHR

SEQ ID NO: 790883 - protein, 19 aa, Mycobacterium
AGMPLGILHDLAVGVDADG

SEQ ID NO: 790884 - protein, 25 aa, Mycobacterium
AGMPPRPLHWHVACARLRLAVAWMQ

SEQ ID NO: 790885 - protein, 18 aa, Mycobacterium
AGMQRFAPLNSWPDNVLL

SEQ ID NO: 790886 - protein, 30 aa, Mycobacterium
AGMRAGIPTLILWLWLDQPVWAVGVNQLGI

SEQ ID NO: 790887 - protein, 26 aa, Mycobacterium
AGMVDTFVFLTLARTGDQLQGIKKGV

SEQ ID NO: 790888 - protein, 22 aa, Mycobacterium
AGMVYVTLPPLFVVKAGDERIY

SEQ ID NO: 790889 - protein, 22 aa, Mycobacterium
AGMVYVTMPPLFVVKAGDERIY

SEQ ID NO: 790890 - protein, 26 aa, Mycobacterium
AGMYLQTIMLLLRAEGLDSCPQIAWA

SEQ ID NO: 790891 - protein, 17 aa, Mycobacterium
AGNADFAIAIRTALMRA

SEQ ID NO: 790892 - protein, 19 aa, Mycobacterium
AGNADFAIAIRTALMRGGT

SEQ ID NO: 790893 - protein, 18 aa, Mycobacterium
AGNADFAIAIRTALMRNG

SEQ ID NO: 790894 - protein, 19 aa, Mycobacterium
AGNAIVGYLNLSPARDADS

SEQ ID NO: 790895 - protein, 29 aa, Mycobacterium
AGNALLDLFLRIIVELFRRHWSSTGQALP

SEQ ID NO: 790896 - protein, 23 aa, Mycobacterium
AGNAPLEVFIAAASRLGWDHGCD

SEQ ID NO: 790897 - protein, 24 aa, Mycobacterium
AGNDLLDYAVIEFDPQKVTPTNNI

SEQ ID NO: 790898 - protein, 23 aa, Mycobacterium
AGNEKNFKWIARSADGWITTPRD

SEQ ID NO: 790899 - protein, 27 aa, Mycobacterium
AGNEVATATFWLLDAPDSLARQSRRNP

SEQ ID NO: 790900 - protein, 26 aa, Mycobacterium
AGNGDCIAFFWFRDAPDGVPGLTAPA

SEQ ID NO: 790901 - protein, 31 aa, Mycobacterium
AGNGDLIKKLLPILAPIVLAYIGKQFSQQNA

SEQ ID NO: 790902 - protein, 33 aa, Mycobacterium
AGNGDWVRINGFGTPWWADDIAALAGTSIGGVM

SEQ ID NO: 790903 - protein, 28 aa, Mycobacterium
AGNGGTLPYFPLPLGDLSVPYAGKLVTE

SEQ ID NO: 790904 - protein, 25 aa, Mycobacterium
AGNGGTWFGLYSAGGPGGPARAWIQ

SEQ ID NO: 790905 - protein, 23 aa, Mycobacterium
AGNGLDFVRAWLGLILCGAVTVS

SEQ ID NO: 790906 - protein, 22 aa, Mycobacterium
AGNIGRLAWLAAGYPEEVPGVT

SEQ ID NO: 790907 - protein, 23 aa, Mycobacterium
AGNPIGPSPYLRGGSRKSLLTSL

SEQ ID NO: 790908 - protein, 23 aa, Mycobacterium
AGNPPIPGPAPDNPPPAPGDWSG

SEQ ID NO: 790909 - protein, 23 aa, Mycobacterium
AGNPSFFDWINGEKLSYCVDFEE

SEQ ID NO: 790910 - protein, 23 aa, Mycobacterium
AGNPWAVPTGWRVGGAPAPVRTE

SEQ ID NO: 790911 - protein, 37 aa, Mycobacterium
AGNQLRVYVPFGGQWYGYFMRRLAERPANLAFFLRAL

SEQ ID NO: 790912 - protein, 20 aa, Mycobacterium
AGNRLFMAPLTRSRADADGT

SEQ ID NO: 790913 - protein, 22 aa, Mycobacterium
AGNRLPVPLYPGFDTLGTLEHI

SEQ ID NO: 790914 - protein, 17 aa, Mycobacterium
AGNRWTTATLPSGATVP

SEQ ID NO: 790915 - protein, 36 aa, Mycobacterium
AGNSDLIKQLLPILTPIVLAFVAKKLTGGGAAAAPA

SEQ ID NO: 790916 - protein, 33 aa, Mycobacterium
AGNSDLINKLLPILAPIVLAYLGRKLSGGQSTP

SEQ ID NO: 790917 - protein, 24 aa, Mycobacterium
AGNSFGAFLPKGITLRVYGDANDY

SEQ ID NO: 790918 - protein, 20 aa, Mycobacterium
AGNTVVLKPAPDTPWCAAVL

SEQ ID NO: 790919 - protein, 19 aa, Mycobacterium
AGNVEYFLHLRARADAMSQ

SEQ ID NO: 790920 - protein, 46 aa, Mycobacterium
AGNVGEAYRWFNHSMLYAFQGAFGPLIAPGFILSGIPRGGTEYLVG

SEQ ID NO: 790921 - protein, 31 aa, Mycobacterium
AGNVISRKCGVPYLYRFELMGTPDDVEAVRA

SEQ ID NO: 790922 - protein, 18 aa, Mycobacterium
AGNVKRWRDGQMALRWCA

SEQ ID NO: 790923 - protein, 23 aa, Mycobacterium
AGNVYVTEIWTDRVRVLAADSGR

SEQ ID NO: 790924 - protein, 20 aa, Mycobacterium
AGNYGNFNFGFGNKGDGNIG

SEQ ID NO: 790925 - protein, 19 aa, Mycobacterium
AGPAGLPSCTGTASAAVAI

SEQ ID NO: 790926 - protein, 23 aa, Mycobacterium
AGPAIRPLLRIVINHGLPVADSI

SEQ ID NO: 790927 - protein, 21 aa, Mycobacterium
AGPALACGNAFLLKPSERDPS

SEQ ID NO: 790928 - protein, 21 aa, Mycobacterium
AGPARPLATVGIAGRQRVTAG

SEQ ID NO: 790929 - protein, 18 aa, Mycobacterium
AGPAWLINAVRRAGEAPM

SEQ ID NO: 790930 - protein, 23 aa, Mycobacterium
AGPDGAMWFTINQGNAIGRLETD

SEQ ID NO: 790931 - protein, 25 aa, Mycobacterium
AGPDGLLYFPVMGANEIWRIDPDGG

SEQ ID NO: 790932 - protein, 28 aa, Mycobacterium
AGPDHPTPGWWDGVAGPGAPIDTDTWCA

SEQ ID NO: 790933 - protein, 19 aa, Mycobacterium
AGPDLRQLLIGSEGAFGVI

SEQ ID NO: 790934 - protein, 23 aa, Mycobacterium
AGPDLRQLLLGSEGVFGVITRVR

SEQ ID NO: 790935 - protein, 27 aa, Mycobacterium
AGPDLSFQLLWYPVVTADLSLPSFTEN

SEQ ID NO: 790936 - protein, 19 aa, Mycobacterium
AGPDPKLSLAPVAAALGEQ

SEQ ID NO: 790937 - protein, 18 aa, Mycobacterium
AGPDRSLIRASSWDIDMP

SEQ ID NO: 790938 - protein, 24 aa, Mycobacterium
AGPDVLRLFSALELLQACALIHDD

SEQ ID NO: 790939 - protein, 31 aa, Mycobacterium; identical to SEQ ID NO: 215182

SEQ ID NO: 790940 - protein, 30 aa, Mycobacterium
AGPFDNWPLGWGFDHYWGFLSGAAGQYDPI

SEQ ID NO: 790941 - protein, 24 aa, Mycobacterium
AGPFYDGAIFHRVIDGFMIQGGDP

SEQ ID NO: 790942 - protein, 17 aa, Mycobacterium
AGPGGASGCIPNVGCAT

SEQ ID NO: 790943 - protein, 20 aa, Mycobacterium
AGPGLYRSFSSKQAILDALI

SEQ ID NO: 790944 - protein, 25 aa, Mycobacterium
AGPGRLVWTRVAGDVLDVALLAAGV

SEQ ID NO: 790945 - protein, 26 aa, Mycobacterium
AGPGTKLMVLPPLMHGAAQWSVMTAI

SEQ ID NO: 790946 - protein, 17 aa, Mycobacterium
AGPHELAIALYGVSRHA

SEQ ID NO: 790947 - protein, 24 aa, Mycobacterium
AGPHPFPVMVRDFQRIIGMEARAQ

SEQ ID NO: 790948 - protein, 25 aa, Mycobacterium
AGPHVQLWPHRHGTDAMFAAALRVD

SEQ ID NO: 790949 - protein, 32 aa, Mycobacterium
AGPIHKIWSSYSGFTFPILSDFWPHGAVAEAY

SEQ ID NO: 790950 - protein, 19 aa, Mycobacterium
AGPKIWEKTGLTPADMDVA

SEQ ID NO: 790951 - protein, 25 aa, Mycobacterium
AGPKSPLPPMPIGGPPPAPPEPPPA

SEQ ID NO: 790952 - protein, 24 aa, Mycobacterium
AGPKSPLPPMPIGGPPPVPPEPPP

SEQ ID NO: 790953 - protein, 19 aa, Mycobacterium
AGPLLGRRCGACRLEIDRG

SEQ ID NO: 790954 - protein, 19 aa, Mycobacterium
AGPLMEALAGIEPRPSSTS

SEQ ID NO: 790955 - protein, 18 aa, Mycobacterium
AGPLPIVVYAHGGGFVFC

SEQ ID NO: 790956 - protein, 20 aa, Mycobacterium
AGPLPLQIICDMMGIPESDH

SEQ ID NO: 790957 - protein, 31 aa, Mycobacterium
AGPLSTALIYDLRLGPAWQGLAFGVGMVTEA

SEQ ID NO: 790958 - protein, 28 aa, Mycobacterium
AGPLVDRMLTHYLRLLDNALRAPGDRLT

SEQ ID NO: 790959 - protein, 29 aa, Mycobacterium
AGPMAYPNLWPELPEFRTAWECYYQHMQR

SEQ ID NO: 790960 - protein, 20 aa, Mycobacterium
AGPPALYRPAEDLVATSWGP

SEQ ID NO: 790961 - protein, 25 aa, Mycobacterium
AGPQSWKQFLHPPRQRMWAGTRDGD

SEQ ID NO: 790962 - protein, 27 aa, Mycobacterium
AGPREPKFMWLTGLTTDGTIVVANNYG

SEQ ID NO: 790963 - protein, 24 aa, Mycobacterium
AGPRLWPANTRLAAPPQPTIAVPR

SEQ ID NO: 790964 - protein, 30 aa, Mycobacterium
AGPRPFLRMEGTAVFRWAAFEMGKVGQQAM

SEQ ID NO: 790965 - protein, 18 aa, Mycobacterium
AGPSTLVRAGGQVFLVDC

SEQ ID NO: 790966 - protein, 25 aa, Mycobacterium
AGPSVLYRLHLDLASLSIAEFYSDG

SEQ ID NO: 790967 - protein, 18 aa, Mycobacterium
AGPTAAVLGALGADEVSA

SEQ ID NO: 790968 - protein, 17 aa, Mycobacterium
AGPTLRYAARAPRGEVK

SEQ ID NO: 790969 - protein, 29 aa, Mycobacterium
AGPTPRLNPWRTPIPKVYLCSAATPPGAG

SEQ ID NO: 790970 - protein, 26 aa, Mycobacterium
AGPVEGWMPFGRVFETLAWGRRHVVM

SEQ ID NO: 790971 - protein, 23 aa, Mycobacterium
AGPVHFDIPLREPLVPDPEPHGA

SEQ ID NO: 790972 - protein, 21 aa, Mycobacterium
AGPVILLFPGQGGEAWSVLQR

SEQ ID NO: 790973 - protein, 27 aa, Mycobacterium
AGPVMSRIGWFVESRLAPRLYRRNQYV

SEQ ID NO: 790974 - protein, 28 aa, Mycobacterium
AGPVRDRRPVYVDLLPPCNAGCPAGENI

SEQ ID NO: 790975 - protein, 24 aa, Mycobacterium
AGPVTLDELARPRFTLHTRDGEVD

SEQ ID NO: 790976 - protein, 23 aa, Mycobacterium
AGPWTDGLLFALGGPIYAGTNEI

SEQ ID NO: 790977 - protein, 18 aa, Mycobacterium
AGPYNLLGWSFGGVVAHE

SEQ ID NO: 790978 - protein, 25 aa, Mycobacterium
AGPYTFGFDFVQGPGFFNSTTTPSS

SEQ ID NO: 790979 - protein, 26 aa, Mycobacterium
AGQACILHSRLLLPDAMHDDVVDRLV

SEQ ID NO: 790980 - protein, 27 aa, Mycobacterium
AGQADQVLLFPFAAGVATWWRTVGPKV

SEQ ID NO: 790981 - protein, 22 aa, Mycobacterium
AGQAGGWLIGNGGNGAAGAIEQ

SEQ ID NO: 790982 - protein, 33 aa, Mycobacterium
AGQAPQAPPLPIPLAPQPPVPPPPSPSPGKPPL

SEQ ID NO: 790983 - protein, 24 aa, Mycobacterium
AGQAPTIIFGWGGGTLRSYVDAGQ

SEQ ID NO: 790984 - protein, 25 aa, Mycobacterium
AGQARPIWYLVPDGVVQYVAKHRLY

SEQ ID NO: 790985 - protein, 17 aa, Mycobacterium
AGQAWQGPAAAAMAAAA

SEQ ID NO: 790986 - protein, 19 aa, Mycobacterium
AGQAWQGPASQAMAAAAAP

SEQ ID NO: 790987 - protein, 19 aa, Mycobacterium
AGQCWSITAAGPAEVVVPG

SEQ ID NO: 790988 - protein, 27 aa, Mycobacterium
AGQDAGALLWWLRATGSADFEQTATAS

SEQ ID NO: 790989 - protein, 31 aa, Mycobacterium
AGQDLLDGVFRSAISVAALVVRCRQGAGVEL

SEQ ID NO: 790990 - protein, 28 aa, Mycobacterium
AGQERARLIAMITLWYSEAGRYNVLPID

SEQ ID NO: 790991 - protein, 20 aa, Mycobacterium
AGQFLAWAIARIMAGVVATQ

SEQ ID NO: 790992 - protein, 23 aa, Mycobacterium
AGQFLTLLVRVDGREYRRSYSMS

SEQ ID NO: 790993 - protein, 26 aa, Mycobacterium
AGQIGYSLLFRLASGSLLGPDRSIEL

SEQ ID NO: 790994 - protein, 27 aa, Mycobacterium
AGQIGYSLLFRLASGSLLGPNRPIELR

SEQ ID NO: 790995 - protein, 17 aa, Mycobacterium
AGQLFWNASAPYRDVVF

SEQ ID NO: 790996 - protein, 18 aa, Mycobacterium
AGQLRFWSQRTYARALFA

SEQ ID NO: 790997 - protein, 17 aa, Mycobacterium
AGQLRHAIDMSLMYAPT

SEQ ID NO: 790998 - protein, 25 aa, Mycobacterium
AGQNVLRAFTFPFDQVRVLIVGQDP

SEQ ID NO: 790999 - protein, 23 aa, Mycobacterium
AGQPFLAGPVFASAYHLPVPEDD

SEQ ID NO: 791000 - protein, 22 aa, Mycobacterium
AGQPFLLTAGFFETHRPYPPDR

SEQ ID NO: 791001 - protein, 26 aa, Mycobacterium
AGQPGDLLLQVRRPVDLDGRAALIGD

SEQ ID NO: 791002 - protein, 23 aa, Mycobacterium
AGQPVLLAFAERRLFAVLVLTIR

SEQ ID NO: 791003 - protein, 27 aa, Mycobacterium
AGQPWFAGGTVLVLRRIRTELDSWDEL

SEQ ID NO: 791004 - protein, 20 aa, Mycobacterium
AGQQFFFNGGAGGDGGSVGL

SEQ ID NO: 791005 - protein, 24 aa, Mycobacterium
AGQQHGPAFRGIVGLAVTESGAAR

SEQ ID NO: 791006 - protein, 29 aa, Mycobacterium
AGQRALLSLPEPPSVWRLAAGDAGTLEDL

SEQ ID NO: 791007 - protein, 24 aa, Mycobacterium
AGQRFVVDITMWIDLADAARSDDL

SEQ ID NO: 791008 - protein, 24 aa, Mycobacterium
AGQRIKPPYVAAYVLLDGADIPFL

SEQ ID NO: 791009 - protein, 21 aa, Mycobacterium
AGQRRFALAELFRQPGDSPHR

SEQ ID NO: 791010 - protein, 23 aa, Mycobacterium
AGQSEWLLRPPPTLGQHTEEILR

SEQ ID NO: 791011 - protein, 25 aa, Mycobacterium
AGQSGLTLVAFLRGESMNVYSRPDR

SEQ ID NO: 791012 - protein, 24 aa, Mycobacterium
AGQSIGAFLPPGITLELVGDANDY

SEQ ID NO: 791013 - protein, 24 aa, Mycobacterium
AGQSLGAFLPPGITLELVGDANDY

SEQ ID NO: 791014 - protein, 36 aa, Mycobacterium
AGQVELPDLPWPDPDAWLAALAASPLLGQPPVLRLF

SEQ ID NO: 791015 - protein, 20 aa, Mycobacterium
AGQVPPGFLPILQAYDYAGD

SEQ ID NO: 791016 - protein, 26 aa, Mycobacterium
AGQVRQLPPFAPPIDPAVLVRAIAAG

SEQ ID NO: 791017 - protein, 19 aa, Mycobacterium
AGQVTLPQQALQAAGIAAA

SEQ ID NO: 791018 - protein, 21 aa, Mycobacterium
AGQVWPHQAIAAHVARRVGRP

SEQ ID NO: 791019 - protein, 31 aa, Mycobacterium
AGQWAAQIPLFEKQPGFAAAFMPAGRAPKPG

SEQ ID NO: 791020 - protein, 18 aa, Mycobacterium
AGQWLRGYLRDLIALRRS

SEQ ID NO: 791021 - protein, 18 aa, Mycobacterium
AGQYFLEAFDRTATGWRL

SEQ ID NO: 791022 - protein, 24 aa, Mycobacterium
AGQYFLEAFDRTPTGWRLHGHPQW

SEQ ID NO: 791023 - protein, 25 aa, Mycobacterium
AGRAARIAKFWAAEAGARVAATAQH

SEQ ID NO: 791024 - protein, 33 aa, Mycobacterium
AGRALADTWYRIPAFYFACPATVLGPYDDAPTA

SEQ ID NO: 791025 - protein, 20 aa, Mycobacterium
AGRAPALYELPHGVAFTDVL

SEQ ID NO: 791026 - protein, 25 aa, Mycobacterium
AGRAPAVKFLPPADVLGVYVFLPEA

SEQ ID NO: 791027 - protein, 17 aa, Mycobacterium
AGRASIPNFLPLLAERF

SEQ ID NO: 791028 - protein, 17 aa, Mycobacterium
AGRAVRHPVRLRELPDR

SEQ ID NO: 791029 - protein, 24 aa, Mycobacterium
AGRDAFWRLIAELDAQRLELSRPM

SEQ ID NO: 791030 - protein, 25 aa, Mycobacterium
AGRDCVTATFWLLNAPDSLAAQSKR

SEQ ID NO: 791031 - protein, 25 aa, Mycobacterium
AGRDFMPVVWALFEWGRRHIPNDSP

SEQ ID NO: 791032 - protein, 18 aa, Mycobacterium
AGRDLFWSQGYAATSIDD

SEQ ID NO: 791033 - protein, 25 aa, Mycobacterium
AGRDRAAMMFGLRTTARIAETPSMR

SEQ ID NO: 791034 - protein, 23 aa, Mycobacterium
AGRDRLVPRLDLDELRKIVADAT

SEQ ID NO: 791035 - protein, 19 aa, Mycobacterium
AGRDVIDLLAAAGVPRVVH

SEQ ID NO: 791036 - protein, 23 aa, Mycobacterium
AGRDYPLAELLTGYLARFKDDLR

SEQ ID NO: 791037 - protein, 18 aa, Mycobacterium
AGRELILSCGAVLDHLRV

SEQ ID NO: 791038 - protein, 32 aa, Mycobacterium
AGRFARPAEIAWATAFLLCDQATYITGSELRA

SEQ ID NO: 791039 - protein, 24 aa, Mycobacterium
AGRFSAFLPGWSTATTPVLRAVED

SEQ ID NO: 791040 - protein, 19 aa, Mycobacterium
AGRGFAAYGTAKAALAHYT

SEQ ID NO: 791041 - protein, 19 aa, Mycobacterium
AGRGFAAYGTAKAALSHYT

SEQ ID NO: 791042 - protein, 25 aa, Mycobacterium
AGRGGWARVLVDHLGPRHIGLDNLT

SEQ ID NO: 791043 - protein, 20 aa, Mycobacterium
AGRGIGREHALLFAKEGASV

SEQ ID NO: 791044 - protein, 27 aa, Mycobacterium
AGRGKVLRWAAPLLYALPGLDRWRAPH

SEQ ID NO: 791045 - protein, 32 aa, Mycobacterium
AGRGLFFGTLYPAFWRFPPVKPYRGVFALLEF

SEQ ID NO: 791046 - protein, 25 aa, Mycobacterium
AGRGLGRAYALLLAARGAKVVVNDT

SEQ ID NO: 791047 - protein, 25 aa, Mycobacterium
AGRGLGRAYALLLASRGAKVVVNDI

SEQ ID NO: 791048 - protein, 32 aa, Mycobacterium
AGRGMKLEPGLTLALEPWFGRGTDRLTVDADG

SEQ ID NO: 791049 - protein, 20 aa, Mycobacterium
AGRHAQWPMVLAASPHVADP

SEQ ID NO: 791050 - protein, 23 aa, Mycobacterium
AGRHQLLVFRASQLSLAARPVDV

SEQ ID NO: 791051 - protein, 25 aa, Mycobacterium
AGRIEILRAFLTTTTLFHTPYGRQH

SEQ ID NO: 791052 - protein, 17 aa, Mycobacterium
AGRIMNHVYITQTLDAA

SEQ ID NO: 791053 - protein, 27 aa, Mycobacterium
AGRIRAAGAIFVGPYAPVSLGDYCAGS

SEQ ID NO: 791054 - protein, 27 aa, Mycobacterium
AGRIRSAGAIFVGPYAPVSLGDYCAGS

SEQ ID NO: 791055 - protein, 23 aa, Mycobacterium
AGRKDLVIDPTNLWLTIHESIGH

SEQ ID NO: 791056 - protein, 17 aa, Mycobacterium
AGRKFHWEALVGGQPVV

SEQ ID NO: 791057 - protein, 20 aa, Mycobacterium
AGRLASLLRSLDIGYDSLVG

SEQ ID NO: 791058 - protein, 26 aa, Mycobacterium
AGRLDELIRFFGWLGQREITSLTAID

SEQ ID NO: 791059 - protein, 17 aa, Mycobacterium
AGRLFLSPRTVQAHLTH

SEQ ID NO: 791060 - protein, 19 aa, Mycobacterium
AGRLGHVFGLTGPIMHVDT

SEQ ID NO: 791061 - protein, 26 aa, Mycobacterium
AGRLGLRPDVRRMPLFGLGCVAGAAG

SEQ ID NO: 791062 - protein, 31 aa, Mycobacterium
AGRLGVLPPNTSLLQWFPRALAAGDAAAVSV

SEQ ID NO: 791063 - protein, 25 aa, Mycobacterium
AGRLIDALTLWRKAADDFEPPPRID

SEQ ID NO: 791064 - protein, 19 aa, Mycobacterium
AGRLIDRHRPRTLVLCAGA

SEQ ID NO: 791065 - protein, 25 aa, Mycobacterium
AGRLLHALSLWRKAADDFAPPPPID

SEQ ID NO: 791066 - protein, 24 aa, Mycobacterium
AGRLLHRLRVVPPVFQVVKAVILG

SEQ ID NO: 791067 - protein, 17 aa, Mycobacterium
AGRLMAAAIARSATTGE

SEQ ID NO: 791068 - protein, 31 aa, Mycobacterium
AGRLPAHAGVFLRLIAQRAPDLHRARTDLFA

SEQ ID NO: 791069 - protein, 23 aa, Mycobacterium
AGRLPLFTIILDHSAYQAIEKMR

SEQ ID NO: 791070 - protein, 25 aa, Mycobacterium
AGRLVTYLQYPLYGDVLATANHWDL

SEQ ID NO: 791071 - protein, 23 aa, Mycobacterium
AGRNRWQYLPFGGGPRSCIGDHF

SEQ ID NO: 791072 - protein, 17 aa, Mycobacterium
AGRPADALTWYRAALES

SEQ ID NO: 791073 - protein, 20 aa, Mycobacterium
AGRPCRLLCLEFDDADGCAG

SEQ ID NO: 791074 - protein, 22 aa, Mycobacterium
AGRPIFGICRGSQLLNVARGGS

SEQ ID NO: 791075 - protein, 19 aa, Mycobacterium
AGRPLLLREAVSALHRAAE

SEQ ID NO: 791076 - protein, 31 aa, Mycobacterium
AGRPPFFALTVFARGLLDRLFTRAYLPGVDP

SEQ ID NO: 791077 - protein, 24 aa, Mycobacterium
AGRPPGWWDALVGNGFHAVHLPED

SEQ ID NO: 791078 - protein, 18 aa, Mycobacterium
AGRPPLVEGAFAGLRHWN

SEQ ID NO: 791079 - protein, 21 aa, Mycobacterium
AGRPPRLLAALGPKMIELSGT

SEQ ID NO: 791080 - protein, 24 aa, Mycobacterium
AGRPVAATFWLLDAPNSLAQQSRR

SEQ ID NO: 791081 - protein, 23 aa, Mycobacterium
AGRPYLVEGVGEDFWPAAYDPSI

SEQ ID NO: 791082 - protein, 18 aa, Mycobacterium
AGRQLWVYGRAGQPCRRC

SEQ ID NO: 791083 - protein, 32 aa, Mycobacterium
AGRRATLAGGFFWLYNVISFPQYSIVFINQED

SEQ ID NO: 791084 - protein, 23 aa, Mycobacterium
AGRRCRARFFGRNADVPLTIMGV

SEQ ID NO: 791085 - protein, 24 aa, Mycobacterium
AGRREPIPLPIKTSYAWAAARHGG

SEQ ID NO: 791086 - protein, 23 aa, Mycobacterium
AGRREPLPLPLKTSYAWAQARRD

SEQ ID NO: 791087 - protein, 22 aa, Mycobacterium
AGRRIHAKFRTGGLTKAAYPDE

SEQ ID NO: 791088 - protein, 18 aa, Mycobacterium
AGRRMRFMLKAEMQEVPV

SEQ ID NO: 791089 - protein, 24 aa, Mycobacterium
AGRRRAVMRLLRASPEPMSIAGIA

SEQ ID NO: 791090 - protein, 20 aa, Mycobacterium
AGRRRPPGFVSGLRTRRRLL

SEQ ID NO: 791091 - protein, 21 aa, Mycobacterium
AGRRTIPLPKFAVDVLGKRRQ

SEQ ID NO: 791092 - protein, 25 aa, Mycobacterium
AGRSGAALLFVSPRERHLLKLIEKA

SEQ ID NO: 791093 - protein, 22 aa, Mycobacterium
AGRSGPHRFRWTGAAAAAPCED

SEQ ID NO: 791094 - protein, 25 aa, Mycobacterium
AGRSGTALLFVSPRERHLLRAIEKA

SEQ ID NO: 791095 - protein, 30 aa, Mycobacterium
AGRSKLNWWESRALYGWTVLVPRTKDQAGE

SEQ ID NO: 791096 - protein, 26 aa, Mycobacterium
AGRSQMALGYFTHLAGDGAVAWSGGS

SEQ ID NO: 791097 - protein, 26 aa, Mycobacterium
AGRTELQILLARWSAAAAILQRGKPV

SEQ ID NO: 791098 - protein, 34 aa, Mycobacterium
AGRTGLVLDPYFSAPKMAWIRANLTRDGVVTTTD

SEQ ID NO: 791099 - protein, 28 aa, Mycobacterium
AGRTSKLYRRVRRDIAVSLPQRQYELAG

SEQ ID NO: 791100 - protein, 26 aa, Mycobacterium
AGRTWQVPVTAFWQAHRDAAATYSAL

SEQ ID NO: 791101 - protein, 26 aa, Mycobacterium
AGRVGLRPDVRRLPLFGLGCVAGAAG

SEQ ID NO: 791102 - protein, 27 aa, Mycobacterium
AGRVKRPQMGIATWIIPSIVAFGTEEQ

SEQ ID NO: 791103 - protein, 22 aa, Mycobacterium
AGRVLLIFRGRSDGFGLTIVDR

SEQ ID NO: 791104 - protein, 18 aa, Mycobacterium
AGRVLTLPGLAHPLLPPW

SEQ ID NO: 791105 - protein, 20 aa, Mycobacterium
AGRVNYLMTKARLGAEATDP

SEQ ID NO: 791106 - protein, 23 aa, Mycobacterium
AGRVWAGPLTGPPGFLSARGETT

SEQ ID NO: 791107 - protein, 17 aa, Mycobacterium
AGRWLIKSSKLTRLRED

SEQ ID NO: 791108 - protein, 19 aa, Mycobacterium
AGRWPRYRRGALKHTPIRS

SEQ ID NO: 791109 - protein, 17 aa, Mycobacterium
AGRYHHVAQRFGAAGLL

SEQ ID NO: 791110 - protein, 22 aa, Mycobacterium
AGRYHKVILSRSLEVPFALDFP

SEQ ID NO: 791111 - protein, 19 aa, Mycobacterium
AGRYLLYLDFKVDDTMHTA

SEQ ID NO: 791112 - protein, 32 aa, Mycobacterium
AGRYRSFALGRHQARILLAKNPAGWQEALSMV

SEQ ID NO: 791113 - protein, 26 aa, Mycobacterium
AGSADLIMYLKYNCPGFVFSTGLPGP

SEQ ID NO: 791114 - protein, 17 aa, Mycobacterium
AGSAFFDEAARRGLRTV

SEQ ID NO: 791115 - protein, 18 aa, Mycobacterium
AGSALARHVVAHHGVRQL

SEQ ID NO: 791116 - protein, 20 aa, Mycobacterium
AGSALIELLPPTGRPHILLD

SEQ ID NO: 791117 - protein, 21 aa, Mycobacterium
AGSAWLRRVPGVAAPVSTLDA

SEQ ID NO: 791118 - protein, 22 aa, Mycobacterium
AGSCIFFLGTLWHGGGANNTEA

SEQ ID NO: 791119 - protein, 21 aa, Mycobacterium
AGSCVFFVGTLWHGGGANNTA

SEQ ID NO: 791120 - protein, 22 aa, Mycobacterium
AGSCVFFVGTLWHGGGANSTDR

SEQ ID NO: 791121 - protein, 22 aa, Mycobacterium
AGSCVFFVGTLWHGGGANTSTS

SEQ ID NO: 791122 - protein, 33 aa, Mycobacterium
AGSDARSRPVMLWPYDPLAFNGKGRAAIAIGNP

SEQ ID NO: 791123 - protein, 33 aa, Mycobacterium
AGSDIGCSWLPLYHDMGLTFLLSAAVGGTETWQ

SEQ ID NO: 791124 - protein, 25 aa, Mycobacterium
AGSDRARWTPFQKLVILDVADDKVD

SEQ ID NO: 791125 - protein, 29 aa, Mycobacterium
AGSDRIRFTPYQKLIVLDVPDDKLDELRA

SEQ ID NO: 791126 - protein, 30 aa, Mycobacterium
AGSDRIRFTPYQKLVILDIPDAVLDETIAG

SEQ ID NO: 791127 - protein, 27 aa, Mycobacterium
AGSDRIRFTPYQKLVILDIPDDKLDET

SEQ ID NO: 791128 - protein, 26 aa, Mycobacterium
AGSETSLLWALLQTGSAGGPTFAISG

SEQ ID NO: 791129 - protein, 30 aa, Mycobacterium
AGSGHNGGAGGLLWGNGGDGGAGAAGQAGG

SEQ ID NO: 791130 - protein, 22 aa, Mycobacterium
AGSGLQWVSLRPTVFASNFLGM

SEQ ID NO: 791131 - protein, 23 aa, Mycobacterium
AGSHLLLAVGRRPNTDDLGLEAA

SEQ ID NO: 791132 - protein, 38 aa, Mycobacterium
AGSILCDPWVNPAYFASWFPFPDNSTLDWDKLGACDYL

SEQ ID NO: 791133 - protein, 37 aa, Mycobacterium
AGSILCDPWVNPAYFASWFPFPDNSTLDWDRFGSCDY

SEQ ID NO: 791134 - protein, 45 aa, Mycobacterium
AGSILCDPWVNPAYFASWFPFPDNTGLDWPALGAVDYLYVSHLHK

SEQ ID NO: 791135 - protein, 37 aa, Mycobacterium
AGSILCDPWVNPAYFGSWFPFPDNSGLDWDRLGDCDY

SEQ ID NO: 791136 - protein, 27 aa, Mycobacterium
AGSLNRPGYLRFDFNWQGALSDDQRSQ

SEQ ID NO: 791137 - protein, 27 aa, Mycobacterium
AGSLNRPGYLRFDFNWQGALSDEQRTQ

SEQ ID NO: 791138 - protein, 27 aa, Mycobacterium
AGSLNRPGYLRFDFNWQGPLSDDQRTQ

SEQ ID NO: 791139 - protein, 25 aa, Mycobacterium
AGSLNRPGYLRFDFNWQGPLSEEQR

SEQ ID NO: 791140 - protein, 27 aa, Mycobacterium
AGSLNRPGYLRFDFNWQGPLTEEQRGQ

SEQ ID NO: 791141 - protein, 28 aa, Mycobacterium
AGSLNRPGYLRFDFSWQGPLTEDQRTHI

SEQ ID NO: 791142 - protein, 18 aa, Mycobacterium
AGSLPAEWWGADAPGSPP

SEQ ID NO: 791143 - protein, 22 aa, Mycobacterium
AGSLPMDALGGLGGLSGLAGQG

SEQ ID NO: 791144 - protein, 23 aa, Mycobacterium
AGSLRLDLSQYRELESFAAFASD

SEQ ID NO: 791145 - protein, 24 aa, Mycobacterium
AGSLRLELSQYRELEAFAAFASDL

SEQ ID NO: 791146 - protein, 24 aa, Mycobacterium
AGSNAEFVVGLLAASRAISLRFRS

SEQ ID NO: 791147 - protein, 17 aa, Mycobacterium
AGSPHMYIVSLIAPDQR

SEQ ID NO: 791148 - protein, 23 aa, Mycobacterium
AGSPSLVPLIAENRMRINGLLDR

SEQ ID NO: 791149 - protein, 29 aa, Mycobacterium
AGSPVPPEWFCELTWPAKPLAAHHDPEGT

SEQ ID NO: 791150 - protein, 24 aa, Mycobacterium
AGSRATHIVVWASLDKSKGRAAIK

SEQ ID NO: 791151 - protein, 21 aa, Mycobacterium
AGSRFLLDRPVTSAGRHADND

SEQ ID NO: 791152 - protein, 24 aa, Mycobacterium
AGSRIRVLIAGSWFPRYAANLGTG

SEQ ID NO: 791153 - protein, 35 aa, Mycobacterium
AGSRLLDRLPPLLGTWAFGFATRLSRRSEVLGTVA

SEQ ID NO: 791154 - protein, 24 aa, Mycobacterium
AGSRLPMHATGVGKVLLAYAPPEV

SEQ ID NO: 791155 - protein, 25 aa, Mycobacterium
AGSSLLNPMFLFRGGAPIKEFARNF

SEQ ID NO: 791156 - protein, 27 aa, Mycobacterium
AGSTATMDRLFRAAFRAGPGAALDAGA

SEQ ID NO: 791157 - protein, 25 aa, Mycobacterium
AGSTGRSWLFFGDRHRAASFLYGEE

SEQ ID NO: 791158 - protein, 26 aa, Mycobacterium
AGSTTPVELPFTGLADPHGLAFDSVD

SEQ ID NO: 791159 - protein, 21 aa, Mycobacterium
AGSVLAVLRRLEGHFTLVFTN

SEQ ID NO: 791160 - protein, 17 aa, Mycobacterium
AGSVPLLGRFSLSGGLP

SEQ ID NO: 791161 - protein, 17 aa, Mycobacterium
AGSVYLTRPSLFHFIRT

SEQ ID NO: 791162 - protein, 18 aa, Mycobacterium
AGSWGLITCTKPSGKEAE

SEQ ID NO: 791163 - protein, 23 aa, Mycobacterium
AGSWPYGLPELPGARKRLKSARR

SEQ ID NO: 791164 - protein, 17 aa, Mycobacterium
AGSWPYITKATPGKFTA

SEQ ID NO: 791165 - protein, 21 aa, Mycobacterium
AGSYATGIAFLPQSSKDAAAA

SEQ ID NO: 791166 - protein, 23 aa, Mycobacterium
AGSYATGIAFLPQSSKDAATACA

SEQ ID NO: 791167 - protein, 28 aa, Mycobacterium
AGSYPDRFIPIAILPTWNPEAMCREIRR

SEQ ID NO: 791168 - protein, 24 aa, Mycobacterium
AGTAAIRRSPVFDPVLHVAEVSFD

SEQ ID NO: 791169 - protein, 25 aa, Mycobacterium
AGTAWQIFPNFQIGQGLTSALCYGA

SEQ ID NO: 791170 - protein, 25 aa, Mycobacterium
AGTAWQIFPNFQIGQGLTTALCYSA

SEQ ID NO: 791171 - protein, 23 aa, Mycobacterium
AGTDLRPYFTYSRDKLSFGVSAS

SEQ ID NO: 791172 - protein, 26 aa, Mycobacterium
AGTDLTTPIPLRPRPFRTNTVVSTQT

SEQ ID NO: 791173 - protein, 35 aa, Mycobacterium
AGTDYLFDDLIRTLARRPLSWRLVLTIGEPGDPTG

SEQ ID NO: 791174 - protein, 22 aa, Mycobacterium
AGTDYWFCGPGCRAAFAGKAGA

SEQ ID NO: 791175 - protein, 28 aa, Mycobacterium
AGTEDMSWTFWSWNPNSRDTGGILADDW

SEQ ID NO: 791176 - protein, 28 aa, Mycobacterium
AGTEIARLLPFVEWLRDAYPHQLISVDT

SEQ ID NO: 791177 - protein, 24 aa, Mycobacterium
AGTEKNFRWIARSADGWITTPRDV

SEQ ID NO: 791178 - protein, 27 aa, Mycobacterium
AGTEVLPLYARLPTAEQHKVFASHTGR

SEQ ID NO: 791179 - protein, 19 aa, Mycobacterium
AGTFGYVFDSALRMVPDGV

SEQ ID NO: 791180 - protein, 27 aa, Mycobacterium
AGTGAIGTPGGWLLGDGGAGGSGAPGV

SEQ ID NO: 791181 - protein, 25 aa, Mycobacterium
AGTGGHGGWLYGNGGAGGIGGAGGV

SEQ ID NO: 791182 - protein, 17 aa, Mycobacterium
AGTGGLGGLAGLAGRIV

SEQ ID NO: 791183 - protein, 19 aa, Mycobacterium
AGTGGYGGLLLGQNGSNGS

SEQ ID NO: 791184 - protein, 24 aa, Mycobacterium
AGTGKSLFIICTALLVITACSHKG

SEQ ID NO: 791185 - protein, 34 aa, Mycobacterium
AGTGKSRRGRLAAGATLGALALTSGIAGIVDTSA

SEQ ID NO: 791186 - protein, 28 aa, Mycobacterium
AGTGMGIDRLLMALTGLGIRETILFPIV

SEQ ID NO: 791187 - protein, 25 aa, Mycobacterium
AGTGRLLELLPQFRFDNDACELLAR

SEQ ID NO: 791188 - protein, 23 aa, Mycobacterium
AGTGTQMGLAGTGGAGGELFGAN

SEQ ID NO: 791189 - protein, 25 aa, Mycobacterium
AGTGVRFTPTLTFVLDTMADSARHM

SEQ ID NO: 791190 - protein, 27 aa, Mycobacterium
AGTGWLHGWRLTFGGEDIGWEGALATV

SEQ ID NO: 791191 - protein, 24 aa, Mycobacterium
AGTGWLPGWRLTFGGEDIGWEGAL

SEQ ID NO: 791192 - protein, 24 aa, Mycobacterium
AGTIGPWNLREWVRLMRAGVYPYQ

SEQ ID NO: 791193 - protein, 30 aa, Mycobacterium
AGTKGPIPWWWRPSGALFDQFLGAAETEPV

SEQ ID NO: 791194 - protein, 24 aa, Mycobacterium
AGTKLLEAYAVPPLLHNQALAISV

SEQ ID NO: 791195 - protein, 26 aa, Mycobacterium
AGTLLDLAGPYLPFDNPFTAAGMQYY

SEQ ID NO: 791196 - protein, 18 aa, Mycobacterium
AGTLLGQFPDEVARHLSG

SEQ ID NO: 791197 - protein, 17 aa, Mycobacterium
AGTLLVRGPYGRRFPFS

SEQ ID NO: 791198 - protein, 23 aa, Mycobacterium
AGTLRVSYFASAGAAWMPAVIAT

SEQ ID NO: 791199 - protein, 37 aa, Mycobacterium
AGTLTLHELFPPGQLDWMVLFSSCGYLAGFPGQGAYA

SEQ ID NO: 791200 - protein, 22 aa, Mycobacterium
AGTPALDLRAGIACQLRGFGIT

SEQ ID NO: 791201 - protein, 27 aa, Mycobacterium
AGTPPATLLDYFPDDFLLVIDESHVTV

SEQ ID NO: 791202 - protein, 18 aa, Mycobacterium
AGTPPIYFGFGSTPIERP

SEQ ID NO: 791203 - protein, 25 aa, Mycobacterium
AGTPPYLDPFLGTGTRRRYDTAAER

SEQ ID NO: 791204 - protein, 37 aa, Mycobacterium
AGTQFPIDRLALKAIDDLYFIKLWTSADGAIHEDHVS

SEQ ID NO: 791205 - protein, 28 aa, Mycobacterium
AGTRGLRTYVNLFALIAGANDVTCDVAS

SEQ ID NO: 791206 - protein, 25 aa, Mycobacterium
AGTRYWNGFDFPEIKAPIGRGVASG

SEQ ID NO: 791207 - protein, 23 aa, Mycobacterium
AGTSFTWDLLLVCGDPAAADTYY

SEQ ID NO: 791208 - protein, 21 aa, Mycobacterium
AGTSYWYAHTDQWRYDGYQAD

SEQ ID NO: 791209 - protein, 23 aa, Mycobacterium
AGTTWQNTFGILADIGRFSTVAN

SEQ ID NO: 791210 - protein, 29 aa, Mycobacterium
AGTTYEAISQLKPVFRPNGTITAGNACPL

SEQ ID NO: 791211 - protein, 26 aa, Mycobacterium
AGTVARAFLRQALGVEIVSHVISIGA

SEQ ID NO: 791212 - protein, 36 aa, Mycobacterium
AGTVLVRGPYGRGFPFSLVFARLYAARGYHVVLQSV

SEQ ID NO: 791213 - protein, 24 aa, Mycobacterium
AGTVRFYHDILGFPIVHSVCAVGW

SEQ ID NO: 791214 - protein, 24 aa, Mycobacterium
AGTVRPYIGARFPLADTAAALRYV

SEQ ID NO: 791215 - protein, 24 aa, Mycobacterium
AGTVRPYIGARFPLSETAAALRHV

SEQ ID NO: 791216 - protein, 24 aa, Mycobacterium
AGTVYRHFPAKEDLYRAIAEDRMG

SEQ ID NO: 791217 - protein, 23 aa, Mycobacterium
AGTVYRHFPSKEDLYRAVVAERI

SEQ ID NO: 791218 - protein, 23 aa, Mycobacterium
AGTWFPTPQFAQLGLGNLGSLGN

SEQ ID NO: 791219 - protein, 23 aa, Mycobacterium
AGTYFLCADPRPLGYDDSAAFCA

SEQ ID NO: 791220 - protein, 23 aa, Mycobacterium
AGTYFLCADPRPLGYDDSTAFCA

SEQ ID NO: 791221 - protein, 20 aa, Mycobacterium
AGVACGYWKRSGLTASRFVA

SEQ ID NO: 791222 - protein, 33 aa, Mycobacterium
AGVAKYPARVKCALLGWMAFKDALAQACSDRGA

SEQ ID NO: 791223 - protein, 34 aa, Mycobacterium
AGVAKYPARVKCALLGWMAFKDALAQAITANALA

SEQ ID NO: 791224 - protein, 19 aa, Mycobacterium
AGVALLASMPPRPGERDLV

SEQ ID NO: 791225 - protein, 30 aa, Mycobacterium
AGVAPPRRSIPLPVSYLLAAIGTVKGKLRG

SEQ ID NO: 791226 - protein, 29 aa, Mycobacterium
AGVARQAWQPRWLKWALAISRQGAFDHSG

SEQ ID NO: 791227 - protein, 24 aa, Mycobacterium
AGVARRHFLNYGQTGFTTIQAHAH

SEQ ID NO: 791228 - protein, 25 aa, Mycobacterium
AGVARSGFYFYFDSKYAVLAQILAE

SEQ ID NO: 791229 - protein, 25 aa, Mycobacterium
AGVARSGFYFYFDSKYSVLAQLMAE

SEQ ID NO: 791230 - protein, 28 aa, Mycobacterium
AGVARTPAFWRFARRHWRTGITEMYGSL

SEQ ID NO: 791231 - protein, 22 aa, Mycobacterium
AGVATITVFLDPGLFSTFGFPS

SEQ ID NO: 791232 - protein, 22 aa, Mycobacterium
AGVATWWRTVGPKVAKLPNLSV

SEQ ID NO: 791233 - protein, 25 aa, Mycobacterium
AGVAVRILRLLAAAEAVGGLGACTE

SEQ ID NO: 791234 - protein, 17 aa, Mycobacterium
AGVAYLRHLVDAGLPTA

SEQ ID NO: 791235 - protein, 35 aa, Mycobacterium
AGVCFPDLLLLRGEYQMRLDPPFIPGMEVAGTVRS

SEQ ID NO: 791236 - protein, 24 aa, Mycobacterium
AGVDALQLFDSWAGALSLADYRAA

SEQ ID NO: 791237 - protein, 18 aa, Mycobacterium
AGVDRTAFYGTRPYAHLR

SEQ ID NO: 791238 - protein, 35 aa, Mycobacterium
AGVECSASSFYWPFGFALLGGRFWVADTGNRRVLA

SEQ ID NO: 791239 - protein, 30 aa, Mycobacterium
AGVERPDLVIGWWAAPTILEHGTPEQIEQF

SEQ ID NO: 791240 - protein, 25 aa, Mycobacterium
AGVETLGVGLWLPARTMAGLADDPA

SEQ ID NO: 791241 - protein, 24 aa, Mycobacterium
AGVFGQWISFPDRDLVQIGQGVVG

SEQ ID NO: 791242 - protein, 24 aa, Mycobacterium
AGVFKRHRQIDRPCLLGYIDKCSA

SEQ ID NO: 791243 - protein, 27 aa, Mycobacterium
AGVGKGTIYLYWPSKLELFGAVFTRDG

SEQ ID NO: 791244 - protein, 27 aa, Mycobacterium
AGVGKQTIYRWWPSRPALVADVMLEDA

SEQ ID NO: 791245 - protein, 27 aa, Mycobacterium
AGVGKQTIYRWWPTRPALVADVMLEDA

SEQ ID NO: 791246 - protein, 20 aa, Mycobacterium
AGVGPEIVDDVIWGCVSQVG

SEQ ID NO: 791247 - protein, 35 aa, Mycobacterium
AGVHLAYKCRVRTPWYLVPLVEPADLLLTCMNADT

SEQ ID NO: 791248 - protein, 25 aa, Mycobacterium
AGVHLRMHSWFSRPVIDDGALKGVV

SEQ ID NO: 791249 - protein, 35 aa, Mycobacterium
AGVHRALIDLKNWALLKWLDEPCTFYDWRGSETGK

SEQ ID NO: 791250 - protein, 28 aa, Mycobacterium
AGVIATIETIPLRIPLKAGSTPGASLWG

SEQ ID NO: 791251 - protein, 19 aa, Mycobacterium
AGVIDRLAAVLPGLALEHA

SEQ ID NO: 791252 - protein, 35 aa, Mycobacterium
AGVILLTCGMFGNVIRLLPPLTITDELLAEGLDIM

SEQ ID NO: 791253 - protein, 22 aa, Mycobacterium
AGVINYTLTAAFELAPYGIRVN

SEQ ID NO: 791254 - protein, 18 aa, Mycobacterium
AGVIRTALRDPAFDVLAP

SEQ ID NO: 791255 - protein, 31 aa, Mycobacterium
AGVKQALVYYYFPTMDDLFVEVLRAGAETAL

SEQ ID NO: 791256 - protein, 27 aa, Mycobacterium
AGVLELAWTTGLVRWEDDPQPGWYDTG

SEQ ID NO: 791257 - protein, 29 aa, Mycobacterium
AGVLFAGDLLFIGCTPIVWSGPIENWIAA

SEQ ID NO: 791258 - protein, 17 aa, Mycobacterium
AGVLGWLHSVARSHVEV

SEQ ID NO: 791259 - protein, 28 aa, Mycobacterium
AGVLHLGGTRLPFGDRLPVGLTVTMDGR

SEQ ID NO: 791260 - protein, 20 aa, Mycobacterium
AGVLLLGLCDWMNRKGFHAL

SEQ ID NO: 791261 - protein, 21 aa, Mycobacterium
AGVLRLDGKRALITGATKGIG

SEQ ID NO: 791262 - protein, 23 aa, Mycobacterium
AGVLRRFLLERGELPDTPLVATV

SEQ ID NO: 791263 - protein, 17 aa, Mycobacterium
AGVLRRVLALQTDPYSV

SEQ ID NO: 791264 - protein, 21 aa, Mycobacterium
AGVLSWGRIFEMSPEQWDTVV

SEQ ID NO: 791265 - protein, 25 aa, Mycobacterium
AGVLSWGRLWELTDEQWDAVIGVNL

SEQ ID NO: 791266 - protein, 18 aa, Mycobacterium
AGVLTRTGAIRAGIYTPA

SEQ ID NO: 791267 - protein, 22 aa, Mycobacterium
AGVMRAFEVPSVRAEFGSLGQR

SEQ ID NO: 791268 - protein, 31 aa, Mycobacterium
AGVNIVYLTAPLLTMLPPRGLTGVRTLLVGA

SEQ ID NO: 791269 - protein, 20 aa, Mycobacterium
AGVNPRRFLAELRLDNPDAA

SEQ ID NO: 791270 - protein, 20 aa, Mycobacterium
AGVPAIERLAYFAEAATAQL

SEQ ID NO: 791271 - protein, 17 aa, Mycobacterium
AGVPGLRALFRSGMYFG

SEQ ID NO: 791272 - protein, 23 aa, Mycobacterium
AGVPIVPVIVWGAHRIWPKDHPK

SEQ ID NO: 791273 - protein, 24 aa, Mycobacterium
AGVPIVPVIVWGAQRIWTKGHPKK

SEQ ID NO: 791274 - protein, 25 aa, Mycobacterium
AGVPKTLIQHLIRWVITSGEFDEHV

SEQ ID NO: 791275 - protein, 18 aa, Mycobacterium
AGVPLLRLAAQTALLESE

SEQ ID NO: 791276 - protein, 18 aa, Mycobacterium
AGVPLLVHQPRYSIFDRR

SEQ ID NO: 791277 - protein, 28 aa, Mycobacterium
AGVPPHPCPLSFILAPTLIAHGTQQQKD

SEQ ID NO: 791278 - protein, 31 aa, Mycobacterium
AGVPPPRRSISVPVLYALGALGSLRARLTGK

SEQ ID NO: 791279 - protein, 18 aa, Mycobacterium
AGVPVFAAWVSEPAEVGS

SEQ ID NO: 791280 - protein, 26 aa, Mycobacterium
AGVQDILLIAFALAVAEFLGTGGAPI

SEQ ID NO: 791281 - protein, 26 aa, Mycobacterium
AGVQDILLIAFGLAFTEFLGSVGTAT

SEQ ID NO: 791282 - protein, 25 aa, Mycobacterium
AGVQDILLIAFGLAWAQFVGTGAPI

SEQ ID NO: 791283 - protein, 31 aa, Mycobacterium
AGVQDILLIAFGLAWTQFLSVSAPIGINVEG

SEQ ID NO: 791284 - protein, 28 aa, Mycobacterium
AGVQDILLVAFGLAWAEFLNRSGTPITV

SEQ ID NO: 791285 - protein, 22 aa, Mycobacterium
AGVQPLQVAKWTKGCDAVTAED

SEQ ID NO: 791286 - protein, 24 aa, Mycobacterium
AGVRAVVEPAFWMGQPRTCAGSFI

SEQ ID NO: 791287 - protein, 24 aa, Mycobacterium
AGVRELAVFWTARQIGCSWCVDFG

SEQ ID NO: 791288 - protein, 21 aa, Mycobacterium
AGVRELLLTHIPPWTSREDVI

SEQ ID NO: 791289 - protein, 24 aa, Mycobacterium
AGVRKFHVLAHDWGAAVAWQLAGN

SEQ ID NO: 791290 - protein, 22 aa, Mycobacterium
AGVRRIVYLGGFVPADEALSEH

SEQ ID NO: 791291 - protein, 20 aa, Mycobacterium
AGVRRLVYLGGLHPEGRKLS

SEQ ID NO: 791292 - protein, 27 aa, Mycobacterium
AGVRVRGQSLWRIPGQRARRAVRGLRL

SEQ ID NO: 791293 - protein, 33 aa, Mycobacterium
AGVSAIAQQLAPWQQALALPAADADFSLSIFGL

SEQ ID NO: 791294 - protein, 18 aa, Mycobacterium
AGVSGDDLRWLILGVHHA

SEQ ID NO: 791295 - protein, 19 aa, Mycobacterium
AGVSGLWLLSGMSDDGVLT

SEQ ID NO: 791296 - protein, 19 aa, Mycobacterium
AGVSGLWLLSGMSNDGVLT

SEQ ID NO: 791297 - protein, 33 aa, Mycobacterium
AGVSKYPARVKCALLGWTAFKAALAEAHGPENS

SEQ ID NO: 791298 - protein, 23 aa, Mycobacterium
AGVSNPYLSQIERGLRKPSADVL

SEQ ID NO: 791299 - protein, 17 aa, Mycobacterium
AGVSRIGPVYTPPPYRG

SEQ ID NO: 791300 - protein, 24 aa, Mycobacterium
AGVSTGFFESKLAAGAPVVRVMPN

SEQ ID NO: 791301 - protein, 17 aa, Mycobacterium
AGVTYHLADGRAALCDH

SEQ ID NO: 791302 - protein, 27 aa, Mycobacterium
AGVVFQQPRLFPWRTVGGNVELALKYA

SEQ ID NO: 791303 - protein, 25 aa, Mycobacterium
AGVVHFFGPFLYRSQFHATTEAEES

SEQ ID NO: 791304 - protein, 19 aa, Mycobacterium
AGVVLLRPASPGTGVIAGG

SEQ ID NO: 791305 - protein, 25 aa, Mycobacterium
AGVVLVPINFMLTAEEIAYILGHSR

SEQ ID NO: 791306 - protein, 21 aa, Mycobacterium
AGVVMVPLNWRLVTAEMRHQC

SEQ ID NO: 791307 - protein, 33 aa, Mycobacterium
AGVVNFFGQLLQLLKNRLLLTDLLTRHPEIDDI

SEQ ID NO: 791308 - protein, 26 aa, Mycobacterium
AGVVNFYGQLLQLLKNRLLLSELRHR

SEQ ID NO: 791309 - protein, 32 aa, Mycobacterium
AGVVNFYGQLLQLLKNRLLLTDLLTRHPEIDD

SEQ ID NO: 791310 - protein, 32 aa, Mycobacterium
AGVVSEEVAPWLDLVRKLGVLAAALSDGAPVS

SEQ ID NO: 791311 - protein, 17 aa, Mycobacterium
AGVVSVIELLQAEPGHT

SEQ ID NO: 791312 - protein, 19 aa, Mycobacterium
AGVWKIVGDFGSLPVWFPF

SEQ ID NO: 791313 - protein, 18 aa, Mycobacterium
AGVYAMFHTLRRGEPVRI

SEQ ID NO: 791314 - protein, 20 aa, Mycobacterium
AGVYISWQGIVGDTTLIDLN

SEQ ID NO: 791315 - protein, 36 aa, Mycobacterium
AGVYLSRLFDYLQTSLRSLPLVMVIGSPETSIPVLS

SEQ ID NO: 791316 - protein, 26 aa, Mycobacterium
AGVYQLVNIPAQIWIRLTGVTGNKII

SEQ ID NO: 791317 - protein, 17 aa, Mycobacterium
AGVYVRERHAFGASLLD

SEQ ID NO: 791318 - protein, 20 aa, Mycobacterium
AGWAAVSWPREYGGRGATVL

SEQ ID NO: 791319 - protein, 21 aa, Mycobacterium
AGWARRLVFVNGHGGNVAALA

SEQ ID NO: 791320 - protein, 24 aa, Mycobacterium
AGWDIFYSLFTGNPTTILTAVRDG

SEQ ID NO: 791321 - protein, 24 aa, Mycobacterium
AGWDVTVLLMDLADHPDYRPLQIL

SEQ ID NO: 791322 - protein, 17 aa, Mycobacterium
AGWKWKTGRYPGEDQDP

SEQ ID NO: 791323 - protein, 17 aa, Mycobacterium
AGWLVEQAGFGKGYPGA

SEQ ID NO: 791324 - protein, 24 aa, Mycobacterium
AGWMPFHKLSQWLTYSLLEPFEWA

SEQ ID NO: 791325 - protein, 25 aa, Mycobacterium
AGWQPEIWRAFAEELGILGAALPEE

SEQ ID NO: 791326 - protein, 36 aa, Mycobacterium
AGWQTFRVPCLPTDRLLNLLLYVKGYLDGTLTFRRS

SEQ ID NO: 791327 - protein, 20 aa, Mycobacterium
AGWRVGEGMALAMIATLPPG

SEQ ID NO: 791328 - protein, 20 aa, Mycobacterium
AGWSAVRWRNLTGGIVALHA

SEQ ID NO: 791329 - protein, 18 aa, Mycobacterium
AGWSLYLQDGVPSFAYNY

SEQ ID NO: 791330 - protein, 29 aa, Mycobacterium
AGWSRTDHYAWIAGLLLDLGIDSIDEVEA

SEQ ID NO: 791331 - protein, 27 aa, Mycobacterium
AGWVLDLLGLPAECGVGFVTGAQAANT

SEQ ID NO: 791332 - protein, 21 aa, Mycobacterium
AGWVQPHLPVPWGRAAKPVEQ

SEQ ID NO: 791333 - protein, 17 aa, Mycobacterium
AGWVRAPRGSEPGLRDA

SEQ ID NO: 791334 - protein, 28 aa, Mycobacterium
AGYAANFLVTPSKLWPLTGLDSLSLDKS

SEQ ID NO: 791335 - protein, 19 aa, Mycobacterium
AGYALWAKGIDEYPELRER

SEQ ID NO: 791336 - protein, 37 aa, Mycobacterium
AGYAPTLAAVPRLLDAIYNPWPTPLATAVQAAGGEVI

SEQ ID NO: 791337 - protein, 21 aa, Mycobacterium
AGYAVPHWPAQWGGGLPVDKQ

SEQ ID NO: 791338 - protein, 38 aa, Mycobacterium
AGYDRAFEFPGFVPAYIRPQFCEGRGPFRWVALSGDPK

SEQ ID NO: 791339 - protein, 26 aa, Mycobacterium
AGYEMITFLIRKGVRFVRCPGWSDYY

SEQ ID NO: 791340 - protein, 23 aa, Mycobacterium
AGYETRMRWRDEVDWIAPDRRTH

SEQ ID NO: 791341 - protein, 18 aa, Mycobacterium
AGYGAWVKIRHSDGTVTL

SEQ ID NO: 791342 - protein, 26 aa, Mycobacterium
AGYGRRVLLVDLDPQGALSAGLGIAH

SEQ ID NO: 791343 - protein, 18 aa, Mycobacterium
AGYKAPRTASFVDALPLS

SEQ ID NO: 791344 - protein, 23 aa, Mycobacterium
AGYKAVLLGASLSTRFVPMLTTA

SEQ ID NO: 791345 - protein, 29 aa, Mycobacterium
AGYKFKQYERLWLSWAMANRDPSVFDKPN

SEQ ID NO: 791346 - protein, 25 aa, Mycobacterium
AGYLFETPQRRLFSQYWDLVQNDKL

SEQ ID NO: 791347 - protein, 26 aa, Mycobacterium
AGYLFETPRRPIFSEYWELIVAGELI

SEQ ID NO: 791348 - protein, 17 aa, Mycobacterium
AGYLFSWTNEASSGPEA

SEQ ID NO: 791349 - protein, 19 aa, Mycobacterium
AGYLNRPRWPRLKGRGTFA

SEQ ID NO: 791350 - protein, 29 aa, Mycobacterium
AGYLWSAGLTLFTLGRPLVWLAGAVARSF

SEQ ID NO: 791351 - protein, 21 aa, Mycobacterium
AGYPLVNIKVTLLDGAFHEVD

SEQ ID NO: 791352 - protein, 22 aa, Mycobacterium
AGYPLVNMKVTLLDGAFHEVDS

SEQ ID NO: 791353 - protein, 28 aa, Mycobacterium
AGYRRLRDWLTRLYRIEIDGFIGANFDS

SEQ ID NO: 791354 - protein, 26 aa, Mycobacterium
AGYSHLWKRWRPALQQALVDAVRSVG

SEQ ID NO: 791355 - protein, 24 aa, Mycobacterium
AGYTDMVAPLTFLAIAGRRVQLEI

SEQ ID NO: 791356 - protein, 25 aa, Mycobacterium
AGYVPGVPRLGIPALLMSDAGLGVT

SEQ ID NO: 791357 - protein, 18 aa, Mycobacterium
AGYYGQRLPAPPSYRSYL

SEQ ID NO: 791358 - protein, 25 aa, Mycobacterium
AHAAGIRITLLDTCYLTGGVGQELQ

SEQ ID NO: 791359 - protein, 34 aa, Mycobacterium
AHAAPVYLYRFDYSTPLLRLLTVGAAHATELPYV

SEQ ID NO: 791360 - protein, 17 aa, Mycobacterium
AHAASAGLTTSIAAAAE

SEQ ID NO: 791361 - protein, 24 aa, Mycobacterium
AHAASFVLDRWLRPVPDGVIGELY

SEQ ID NO: 791362 - protein, 24 aa, Mycobacterium
AHAEHFWTWSIDMLGHGYTGKPGH

SEQ ID NO: 791363 - protein, 18 aa, Mycobacterium
AHAFDAEGWFRTGDLGRI

SEQ ID NO: 791364 - protein, 22 aa, Mycobacterium
AHAFRPLHYPLTSAVGMGIIAA

SEQ ID NO: 791365 - protein, 24 aa, Mycobacterium
AHAFTTRRYLDEVTLPALQRGMDR

SEQ ID NO: 791366 - protein, 26 aa, Mycobacterium
AHAGGWLIHLGWARQHGWSPTIADPL

SEQ ID NO: 791367 - protein, 19 aa, Mycobacterium
AHAGTYWFHPHVGTQLDRG

SEQ ID NO: 791368 - protein, 23 aa, Mycobacterium
AHAHLRYLNPFPANLGEVLRRYP

SEQ ID NO: 791369 - protein, 24 aa, Mycobacterium
AHAHLRYLSPLPANLGDVLRRYPQ

SEQ ID NO: 791370 - protein, 18 aa, Mycobacterium
AHAHPLLRDVDRLVDFDK

SEQ ID NO: 791371 - protein, 20 aa, Mycobacterium
AHAISALRQGLLTAKAHTAG

SEQ ID NO: 791372 - protein, 20 aa, Mycobacterium
AHAKQYQAFSVQAATFHEQL

SEQ ID NO: 791373 - protein, 27 aa, Mycobacterium
AHALAAKPLLLILDVKKPRPSDIAIHV

SEQ ID NO: 791374 - protein, 18 aa, Mycobacterium
AHALIAWCRERMAGFKVP

SEQ ID NO: 791375 - protein, 18 aa, Mycobacterium
AHALRFRPFASVREVVRD

SEQ ID NO: 791376 - protein, 24 aa, Mycobacterium
AHAPAPRLTQLLLTALRAGIPPEQ

SEQ ID NO: 791377 - protein, 18 aa, Mycobacterium
AHAPPDRLLRCIEAVLEC

SEQ ID NO: 791378 - protein, 36 aa, Mycobacterium
AHAPPYNRRSKFPHRWWWVTLTDEPFPRFSTVRTPR

SEQ ID NO: 791379 - protein, 24 aa, Mycobacterium
AHAPWYVIPCDRKWYSRLAVTALL

SEQ ID NO: 791380 - protein, 19 aa, Mycobacterium
AHAQIYQAVSAPAAAIHET

SEQ ID NO: 791381 - protein, 18 aa, Mycobacterium
AHAQMYQAVSAQAAAIHE

SEQ ID NO: 791382 - protein, 30 aa, Mycobacterium
AHARATWPLPEPTLAYFPNARFVPSDRDLD

SEQ ID NO: 791383 - protein, 18 aa, Mycobacterium
AHARILGAWVEELVLVGV

SEQ ID NO: 791384 - protein, 18 aa, Mycobacterium
AHARLIVATAYFPQSEDA

SEQ ID NO: 791385 - protein, 27 aa, Mycobacterium
AHARSRGRVLLWPDTFINNFDPAVGKA

SEQ ID NO: 791386 - protein, 22 aa, Mycobacterium
AHATLRLASKLRLLTLAAGDDS

SEQ ID NO: 791387 - protein, 20 aa, Mycobacterium
AHATLVDHLIPPMARAETYG

SEQ ID NO: 791388 - protein, 20 aa, Mycobacterium
AHAVALQIAALKAKYLTRED

SEQ ID NO: 791389 - protein, 19 aa, Mycobacterium
AHAVLYREISAHAAAIHDQ

SEQ ID NO: 791390 - protein, 17 aa, Mycobacterium
AHAVVLFRAGLLTEEQR

SEQ ID NO: 791391 - protein, 17 aa, Mycobacterium
AHAWRQIAYGDADIAIC

SEQ ID NO: 791392 - protein, 26 aa, Mycobacterium
AHAYKVIAANWSLPMKLFERGLDKGS

SEQ ID NO: 791393 - protein, 20 aa, Mycobacterium
AHCESYVIGAMRAKGGKIVS

SEQ ID NO: 791394 - protein, 19 aa, Mycobacterium
AHCRLPLREVMWGSDAELL

SEQ ID NO: 791395 - protein, 24 aa, Mycobacterium
AHDDAFRDWWDLAGNRAASPSTAR

SEQ ID NO: 791396 - protein, 19 aa, Mycobacterium
AHDDAFRSWWDMAGNRAAS

SEQ ID NO: 791397 - protein, 25 aa, Mycobacterium
AHDDLALPDLAYTLARRRVHRPVRT

SEQ ID NO: 791398 - protein, 25 aa, Mycobacterium
AHDEGWLAEHMLILKLISPENKAYF

SEQ ID NO: 791399 - protein, 25 aa, Mycobacterium
AHDELLRFERTLIAIWKAIQAAGAG

SEQ ID NO: 791400 - protein, 17 aa, Mycobacterium
AHDPFLVLADYSSYIEC

SEQ ID NO: 791401 - protein, 26 aa, Mycobacterium
AHDREYWQRPLPPIVLGRSGATSTFW

SEQ ID NO: 791402 - protein, 22 aa, Mycobacterium
AHDRFGSLLWGVRAVFEGFASV

SEQ ID NO: 791403 - protein, 37 aa, Mycobacterium
AHDRGQLYVLPQLDAKILWQLKRTMPGTFTHAMGLIQ

SEQ ID NO: 791404 - protein, 25 aa, Mycobacterium
AHDRGSAGVWRYLARPESRGRLASF

SEQ ID NO: 791405 - protein, 18 aa, Mycobacterium
AHDRPCQKPLTSASARVG

SEQ ID NO: 791406 - protein, 38 aa, Mycobacterium
AHDTLWDFVALQPETLHTIMWLMSDRALPRSYRMMQGF

SEQ ID NO: 791407 - protein, 38 aa, Mycobacterium
AHDTLWDFVSLQPETLHTIMWLMSDRALPRSYRMMEGF

SEQ ID NO: 791408 - protein, 25 aa, Mycobacterium
AHDVAPDWPIGIGDLSYRVVITGDP

SEQ ID NO: 791409 - protein, 24 aa, Mycobacterium
AHDVDVAALPRPLTLDCFSSLPPE

SEQ ID NO: 791410 - protein, 25 aa, Mycobacterium
AHDWPVSLFAERTWHVARPVPERSV

SEQ ID NO: 791411 - protein, 21 aa, Mycobacterium
AHEAFNLATVFRAPCVFFIQN

SEQ ID NO: 791412 - protein, 35 aa, Mycobacterium
AHERSLNIDFLLGYLRELLPRRPDLKIIVTSATIE

SEQ ID NO: 791413 - protein, 33 aa, Mycobacterium
AHERSLNIDFLLGYLRELLPRRPDLKVIVTSAT

SEQ ID NO: 791414 - protein, 34 aa, Mycobacterium
AHERSLNIDFLLGYLRELLPRRPDLKVIVTSATI

SEQ ID NO: 791415 - protein, 34 aa, Mycobacterium
AHERSLNIDFLLGYLRELLPRRPDLRVIVTSATI

SEQ ID NO: 791416 - protein, 34 aa, Mycobacterium
AHERSLNIDFLLGYLRRLLPRRPDLKVIVTSATI

SEQ ID NO: 791417 - protein, 31 aa, Mycobacterium
AHESLVNLPNWLPLTFRIGDGDWLDLDAVTL

SEQ ID NO: 791418 - protein, 28 aa, Mycobacterium
AHEVTHYLFKHPKVDFIWVTGGPKIVAL

SEQ ID NO: 791419 - protein, 24 aa, Mycobacterium
AHFDSMLVKLTCRGRDFPTAVNRA

SEQ ID NO: 791420 - protein, 24 aa, Mycobacterium
AHFDSMLVKLTCRGRDFQTAVARA

SEQ ID NO: 791421 - protein, 18 aa, Mycobacterium
AHFGRRYDDLHTEVALLE

SEQ ID NO: 791422 - protein, 24 aa, Mycobacterium
AHFHTAIPLASLIERAALRYMRSQ

SEQ ID NO: 791423 - protein, 19 aa, Mycobacterium
AHFIGFDALALGDRSLLKE

SEQ ID NO: 791424 - protein, 17 aa, Mycobacterium
AHFSDQPDYVDSWPVHC

SEQ ID NO: 791425 - protein, 21 aa, Mycobacterium
AHFTPTWEIGPAGPFDRWPTG

SEQ ID NO: 791426 - protein, 19 aa, Mycobacterium
AHFTPTWETGPAGPFDRWP

SEQ ID NO: 791427 - protein, 26 aa, Mycobacterium
AHGAGDGFARYWLHNGWVTMGGEKMS

SEQ ID NO: 791428 - protein, 21 aa, Mycobacterium
AHGDFARAYLATGLVPVGKTQ

SEQ ID NO: 791429 - protein, 21 aa, Mycobacterium
AHGDFPRFYLGGNGAVHGGIL

SEQ ID NO: 791430 - protein, 21 aa, Mycobacterium
AHGDWPVKPAPPFVPGHEGCG

SEQ ID NO: 791431 - protein, 20 aa, Mycobacterium
AHGFDLDMAGLVYFGDRNEA

SEQ ID NO: 791432 - protein, 26 aa, Mycobacterium
AHGGPAVPILVHPAPRSVLGEVAAAV

SEQ ID NO: 791433 - protein, 25 aa, Mycobacterium
AHGHRTQLELGGKAPFVVFDDADLD

SEQ ID NO: 791434 - protein, 17 aa, Mycobacterium
AHGIVASFRHALNHIGA

SEQ ID NO: 791435 - protein, 22 aa, Mycobacterium
AHGLARLAGLLKPALEIMWVED

SEQ ID NO: 791436 - protein, 22 aa, Mycobacterium
AHGLDRIVAALRKARLWSPALE

SEQ ID NO: 791437 - protein, 24 aa, Mycobacterium
AHGLEPGPWRLDTLPLVVSAEDWA

SEQ ID NO: 791438 - protein, 25 aa, Mycobacterium
AHGLLRDHLMAGLPALRRQRLHAQV

SEQ ID NO: 791439 - protein, 18 aa, Mycobacterium
AHGLVPFVDDMAGNNGSG

SEQ ID NO: 791440 - protein, 23 aa, Mycobacterium
AHGPAVTPGYWRRNRDDTSAFAG

SEQ ID NO: 791441 - protein, 25 aa, Mycobacterium
AHGPGFHQFAYWSADFDRAMRAVAE

SEQ ID NO: 791442 - protein, 29 aa, Mycobacterium
AHGQDIVLRTYLLAGLAASRLALGQLDLA

SEQ ID NO: 791443 - protein, 23 aa, Mycobacterium
AHGRGLPFSGVVWRAARSDGDES

SEQ ID NO: 791444 - protein, 28 aa, Mycobacterium
AHGRTAAQVLLRWSIQLGNVVISRSANP

SEQ ID NO: 791445 - protein, 24 aa, Mycobacterium
AHGTDVLMFVVVFTGPQSDSDRVM

SEQ ID NO: 791446 - protein, 23 aa, Mycobacterium
AHGTFFFHFPSKEHVLLELERRE

SEQ ID NO: 791447 - protein, 22 aa, Mycobacterium
AHGTFFFHFPTKEHVLIELEAR

SEQ ID NO: 791448 - protein, 21 aa, Mycobacterium
AHGYLLDEFLWDRTNQRTDGY

SEQ ID NO: 791449 - protein, 23 aa, Mycobacterium
AHGYMLLGSFLAPQRNRRTDDYR

SEQ ID NO: 791450 - protein, 20 aa, Mycobacterium
AHGYRLDIPAATAVRFEPGV

SEQ ID NO: 791451 - protein, 23 aa, Mycobacterium
AHHAGMLPVFRHTVEELFTAGLV

SEQ ID NO: 791452 - protein, 26 aa, Mycobacterium
AHHDAVDFHRWLQWQLDDQLTAAQAT

SEQ ID NO: 791453 - protein, 26 aa, Mycobacterium
AHHDDGFYPIPRPRAPLAAATIWAID

SEQ ID NO: 791454 - protein, 24 aa, Mycobacterium
AHHEGRVVFVRYALPGERVRVRVT

SEQ ID NO: 791455 - protein, 17 aa, Mycobacterium
AHHFGDRRGLFTALAAD

SEQ ID NO: 791456 - protein, 18 aa, Mycobacterium
AHHPLLRRTVRCGQPVGR

SEQ ID NO: 791457 - protein, 20 aa, Mycobacterium
AHHQVIVSDVLRAGDFWGGA

SEQ ID NO: 791458 - protein, 19 aa, Mycobacterium
AHHRPLGQQVPRALGLPRM

SEQ ID NO: 791459 - protein, 39 aa, Mycobacterium
AHHRSTYIFLADRHAGWWRAPLRWTLRGSLAVRSRLMVR

SEQ ID NO: 791460 - protein, 41 aa, Mycobacterium
AHHRSTYLFLADRHSGWWRAPLRWMLRASLALRSRLMVRGA

SEQ ID NO: 791461 - protein, 29 aa, Mycobacterium
AHHRYAPVYFYRYDYAPGALRIAGMGATH

SEQ ID NO: 791462 - protein, 19 aa, Mycobacterium
AHHTILFGEAWDQTFTDII

SEQ ID NO: 791463 - protein, 18 aa, Mycobacterium
AHHTLRALVLLGAADLDL

SEQ ID NO: 791464 - protein, 25 aa, Mycobacterium
AHHVAAWRAARLLVLDAFTGAEGAV

SEQ ID NO: 791465 - protein, 24 aa, Mycobacterium
AHHVAAWRAARLLVLDAFTTAEAA

SEQ ID NO: 791466 - protein, 25 aa, Mycobacterium
AHHVAAWRAARLLVLDAFTTAEAAV

SEQ ID NO: 791467 - protein, 25 aa, Mycobacterium
AHHVVRITLASPRLVPYPIEPRAAV

SEQ ID NO: 791468 - protein, 24 aa, Mycobacterium
AHHYLAVYDEHTGVPLYLGRARRT

SEQ ID NO: 791469 - protein, 20 aa, Mycobacterium
AHHYLWRIRKALPSAGHIGV

SEQ ID NO: 791470 - protein, 17 aa, Mycobacterium
AHIDVAGPAFNTGSPWG

SEQ ID NO: 791471 - protein, 19 aa, Mycobacterium
AHIEMLTTKQQLLLDDVES

SEQ ID NO: 791472 - protein, 20 aa, Mycobacterium
AHIFRQVQKLLYDELRVAPS

SEQ ID NO: 791473 - protein, 25 aa, Mycobacterium
AHIRAATLLVPGWVERGRGYFLSVA

SEQ ID NO: 791474 - protein, 18 aa, Mycobacterium
AHIRAHCRHLATVVTIRG

SEQ ID NO: 791475 - protein, 23 aa, Mycobacterium
AHIRIDRLVAMPSLPTTPVGKID

SEQ ID NO: 791476 - protein, 23 aa, Mycobacterium
AHIRVWGPHLPLEDLVAAGLPGF

SEQ ID NO: 791477 - protein, 20 aa, Mycobacterium
AHIVNLCWHGLKHLEADPQL

SEQ ID NO: 791478 - protein, 31 aa, Mycobacterium
AHIVSQPFAWLHTRNHIAMLRLALTQHDRRE

SEQ ID NO: 791479 - protein, 21 aa, Mycobacterium
AHIYTRLDRPLTASLGLMILA

SEQ ID NO: 791480 - protein, 21 aa, Mycobacterium
AHKARAPYQTLLANRITRAAA

SEQ ID NO: 791481 - protein, 17 aa, Mycobacterium
AHKGLMNIALAISAQQV

SEQ ID NO: 791482 - protein, 25 aa, Mycobacterium
AHKTILENVTLAPMKVRKFSKDESR

SEQ ID NO: 791483 - protein, 18 aa, Mycobacterium
AHKTILENVTLAPMKVRR

SEQ ID NO: 791484 - protein, 19 aa, Mycobacterium
AHLAALDVPILQGLCLTSS

SEQ ID NO: 791485 - protein, 18 aa, Mycobacterium
AHLAALIATNLLGQNSPA

SEQ ID NO: 791486 - protein, 17 aa, Mycobacterium
AHLAKLATQYRPDQLAK

SEQ ID NO: 791487 - protein, 25 aa, Mycobacterium
AHLEALGPLMRRALAAAGVQRPDVV

SEQ ID NO: 791488 - protein, 26 aa, Mycobacterium
AHLEALGPTMRRALDAAGIERPDVVA

SEQ ID NO: 791489 - protein, 17 aa, Mycobacterium
AHLFVRRARTGLQLFGS

SEQ ID NO: 791490 - protein, 17 aa, Mycobacterium
AHLGHPLADLVAEVRRV

SEQ ID NO: 791491 - protein, 17 aa, Mycobacterium
AHLGRLSSLLRDKRVPL

SEQ ID NO: 791492 - protein, 26 aa, Mycobacterium
AHLIDAARPFIFDTGLAPAAVGAARA

SEQ ID NO: 791493 - protein, 17 aa, Mycobacterium
AHLLAAEGAGPGTSVAL

SEQ ID NO: 791494 - protein, 30 aa, Mycobacterium
AHLLAELDRVWRRLPFDASWYSSNELARHR

SEQ ID NO: 791495 - protein, 17 aa, Mycobacterium
AHLLAGHGVGPGGCVAV

SEQ ID NO: 791496 - protein, 18 aa, Mycobacterium
AHLLPYHHPVELAHRVAY

SEQ ID NO: 791497 - protein, 20 aa, Mycobacterium
AHLMPVWQGQGYNSGIRDAA

SEQ ID NO: 791498 - protein, 20 aa, Mycobacterium
AHLMPVWQGQGYNSGIRDAF

SEQ ID NO: 791499 - protein, 18 aa, Mycobacterium
AHLNADHADSLLAMARNL

SEQ ID NO: 791500 - protein, 17 aa, Mycobacterium
AHLNTNAAAFAMLRGEL

SEQ ID NO: 791501 - protein, 19 aa, Mycobacterium
AHLPGIQFVDALIDSAHQL

SEQ ID NO: 791502 - protein, 17 aa, Mycobacterium
AHLPGLGAAALAAAGVD

SEQ ID NO: 791503 - protein, 17 aa, Mycobacterium
AHLPTYSQWLSRQDWTP

SEQ ID NO: 791504 - protein, 24 aa, Mycobacterium
AHLPVDPEWGPGWHLGVQSFSDGS

SEQ ID NO: 791505 - protein, 23 aa, Mycobacterium
AHLRDARPLVRLRVPFTVNRTDV

SEQ ID NO: 791506 - protein, 19 aa, Mycobacterium
AHLRVWGDKPAFGVLLGSP

SEQ ID NO: 791507 - protein, 17 aa, Mycobacterium
AHLSKLLRLGEISAVMV

SEQ ID NO: 791508 - protein, 25 aa, Mycobacterium
AHLTRYVGWLIGVEDRWLPTSFRDS

SEQ ID NO: 791509 - protein, 19 aa, Mycobacterium
AHLTTLSQLLSRVPLALQE

SEQ ID NO: 791510 - protein, 25 aa, Mycobacterium
AHLVAAAHRFAPDVQLVLCAGAPDT

SEQ ID NO: 791511 - protein, 27 aa, Mycobacterium
AHLVHPGDLVILIAYGTMSDAEARAYK

SEQ ID NO: 791512 - protein, 27 aa, Mycobacterium
AHLVVALLRAVSVPARLVSVYAPGVNP

SEQ ID NO: 791513 - protein, 20 aa, Mycobacterium
AHLYLRRAYALQSFVGKPAV

SEQ ID NO: 791514 - protein, 19 aa, Mycobacterium
AHMDFYEPAELELVLARSA

SEQ ID NO: 791515 - protein, 18 aa, Mycobacterium
AHMHDPFAAAVALDPSLV

SEQ ID NO: 791516 - protein, 17 aa, Mycobacterium
AHMLPAEIIPTGQFPLA

SEQ ID NO: 791517 - protein, 22 aa, Mycobacterium
AHMRKVVGYARRHLAQRPRGNV

SEQ ID NO: 791518 - protein, 24 aa, Mycobacterium
AHNCQYVFLITNTAPDAPKHKSLT

SEQ ID NO: 791519 - protein, 22 aa, Mycobacterium
AHNCQYVFLITNTDPHARKHKS

SEQ ID NO: 791520 - protein, 33 aa, Mycobacterium
AHNCTIPALFRVLFRGGWRGTVAEVLAGLAPAV

SEQ ID NO: 791521 - protein, 27 aa, Mycobacterium
AHNHLILPNPMHNVAFPRLWAATVRSA

SEQ ID NO: 791522 - protein, 31 aa, Mycobacterium
AHNLRMRQRAPWRPELMPADPTWPVQAQRVI

SEQ ID NO: 791523 - protein, 19 aa, Mycobacterium
AHNPLPVVIPCHRVVRSDG

SEQ ID NO: 791524 - protein, 30 aa, Mycobacterium
AHNQAVLARLLPALVLPGFLLAQSRHDNPS

SEQ ID NO: 791525 - protein, 20 aa, Mycobacterium
AHNVAFDYSFLAAEAELADA

SEQ ID NO: 791526 - protein, 21 aa, Mycobacterium
AHPAVRERWPAAGAVRVRARR

SEQ ID NO: 791527 - protein, 26 aa, Mycobacterium
AHPDDLLATALGSPPPLLVALDNISD

SEQ ID NO: 791528 - protein, 25 aa, Mycobacterium
AHPDHPHYYLATPAALFDAFVDQVE

SEQ ID NO: 791529 - protein, 24 aa, Mycobacterium
AHPDWSVPFVAWGYHPLWHGPIGR

SEQ ID NO: 791530 - protein, 23 aa, Mycobacterium
AHPEDWHMLQPQWLADLSDARRA

SEQ ID NO: 791531 - protein, 23 aa, Mycobacterium
AHPERIGTLIGWQSTMHAAGVSV

SEQ ID NO: 791532 - protein, 18 aa, Mycobacterium
AHPFVDRQLIIVADGHVD

SEQ ID NO: 791533 - protein, 19 aa, Mycobacterium
AHPGLPVWGQGWDESAWPE

SEQ ID NO: 791534 - protein, 19 aa, Mycobacterium
AHPGVIYRTYDLSSETPDR

SEQ ID NO: 791535 - protein, 21 aa, Mycobacterium
AHPGWPMLLGKLRVPAGVVSV

SEQ ID NO: 791536 - protein, 35 aa, Mycobacterium
AHPRFHMHFTPNYSSWLSQVARWFALLTDEKLRRG

SEQ ID NO: 791537 - protein, 24 aa, Mycobacterium
AHPRPLSPPPIWIGGNTRAARRRV

SEQ ID NO: 791538 - protein, 24 aa, Mycobacterium
AHPSLCLLASWVPPASPAGERLRA

SEQ ID NO: 791539 - protein, 19 aa, Mycobacterium
AHPVFRRRRFFSGEPLGRR

SEQ ID NO: 791540 - protein, 17 aa, Mycobacterium
AHPWFVEALANPGRRDR

SEQ ID NO: 791541 - protein, 18 aa, Mycobacterium
AHPWLADHQIYGVAAFPG

SEQ ID NO: 791542 - protein, 28 aa, Mycobacterium
AHPYEEPAFDILPLAPIPGDVGIGRIAS

SEQ ID NO: 791543 - protein, 28 aa, Mycobacterium
AHPYEEPAFDLFPLQTPPGDVGLGRIAT

SEQ ID NO: 791544 - protein, 23 aa, Mycobacterium
AHQAAFLGYRVTVCDARPVFATE

SEQ ID NO: 791545 - protein, 22 aa, Mycobacterium
AHQAIPVIRAFTHFALLANVAE

SEQ ID NO: 791546 - protein, 23 aa, Mycobacterium
AHQGARVLLIGDLLTHEPDTDHH

SEQ ID NO: 791547 - protein, 23 aa, Mycobacterium
AHQGRLKYCYNFLGIDHYMVAAT

SEQ ID NO: 791548 - protein, 25 aa, Mycobacterium
AHQHFAPVYVYQFDYAPWPVRAAGL

SEQ ID NO: 791549 - protein, 18 aa, Mycobacterium
AHQLLGALGFCDESDISV

SEQ ID NO: 791550 - protein, 20 aa, Mycobacterium
AHQPWVIRELSLHQLLHVTD

SEQ ID NO: 791551 - protein, 24 aa, Mycobacterium
AHQRGWPQFADRLLELARAAEPGS

SEQ ID NO: 791552 - protein, 18 aa, Mycobacterium
AHRAGILHRDVKPANILL

SEQ ID NO: 791553 - protein, 21 aa, Mycobacterium
AHRAHAFIVLARTAPVDPAHR

SEQ ID NO: 791554 - protein, 18 aa, Mycobacterium
AHRCRVMAFVDRPVDVTE

SEQ ID NO: 791555 - protein, 29 aa, Mycobacterium
AHREGIKHLKFIFYDWNRLGDGEAQRYVE

SEQ ID NO: 791556 - protein, 24 aa, Mycobacterium
AHREWMSYPVDRRRDLLFALADVV

SEQ ID NO: 791557 - protein, 18 aa, Mycobacterium
AHRFPAPAPPRWSTGRRA

SEQ ID NO: 791558 - protein, 23 aa, Mycobacterium
AHRGFTSFRLPKNSMAAFHEAVQ

SEQ ID NO: 791559 - protein, 21 aa, Mycobacterium
AHRHWALGEAMMRQALAQLKA

SEQ ID NO: 791560 - protein, 17 aa, Mycobacterium
AHRIADTRLLLNTALES

SEQ ID NO: 791561 - protein, 22 aa, Mycobacterium
AHRIHYDWPYATRVEGYPGLVV

SEQ ID NO: 791562 - protein, 17 aa, Mycobacterium
AHRISLRPEMWVRRITG

SEQ ID NO: 791563 - protein, 17 aa, Mycobacterium
AHRKGNLVRPYTLTSGR

SEQ ID NO: 791564 - protein, 23 aa, Mycobacterium
AHRLGHDLTVPHIAIVGAFTGLD

SEQ ID NO: 791565 - protein, 24 aa, Mycobacterium
AHRLHEYLLGHSDLDLIDLAYSLA

SEQ ID NO: 791566 - protein, 22 aa, Mycobacterium
AHRLLAMLTYRGFVRQDPVSKA

SEQ ID NO: 791567 - protein, 17 aa, Mycobacterium
AHRPAVFFDFDGTLSDI

SEQ ID NO: 791568 - protein, 23 aa, Mycobacterium
AHRPRFDALGRWLLSRTADLSTE

SEQ ID NO: 791569 - protein, 31 aa, Mycobacterium
AHRQLRYFWPRVVGDIGWQLLDSKFAVVARA

SEQ ID NO: 791570 - protein, 35 aa, Mycobacterium
AHRQLRYFWPRVVGDIGWQLLDTKFAVVARAASRT

SEQ ID NO: 791571 - protein, 31 aa, Mycobacterium; identical to SEQ ID NO: 113213

SEQ ID NO: 791572 - protein, 32 aa, Mycobacterium
AHRQLRYFWPRVVGDTGWQLLDTKFAVVARAA

SEQ ID NO: 791573 - protein, 26 aa, Mycobacterium
AHRRAHGLAGLSLAWGLWEQASAMTA

SEQ ID NO: 791574 - protein, 33 aa, Mycobacterium
AHRRARRRLAALRLLRYRMLHHHGSRQRLSPIS

SEQ ID NO: 791575 - protein, 20 aa, Mycobacterium
AHRREQLWQTYLGRRSCKTI

SEQ ID NO: 791576 - protein, 23 aa, Mycobacterium
AHRSCCLYVDPPYLGSSRTAGGA

SEQ ID NO: 791577 - protein, 19 aa, Mycobacterium
AHRSVRHPLLATLGRDVRE

SEQ ID NO: 791578 - protein, 18 aa, Mycobacterium
AHRTKLLGAVDYIAAAET

SEQ ID NO: 791579 - protein, 17 aa, Mycobacterium
AHRVMSQFRASFIGKVS

SEQ ID NO: 791580 - protein, 17 aa, Mycobacterium
AHRYGQPGKTFAIGLGC

SEQ ID NO: 791581 - protein, 17 aa, Mycobacterium
AHSAGYVELFYGRPLTQ

SEQ ID NO: 791582 - protein, 26 aa, Mycobacterium
AHSATVDWLTTVLAEDALGGPAALRR

SEQ ID NO: 791583 - protein, 20 aa, Mycobacterium
AHSFLVNEAYLLDAQDYDRW

SEQ ID NO: 791584 - protein, 26 aa, Mycobacterium
AHSGSLVRYLEPFAHTVGVMQTPEAL

SEQ ID NO: 791585 - protein, 24 aa, Mycobacterium
AHSHQPLRWGPPDAPGRYVLVFNG

SEQ ID NO: 791586 - protein, 19 aa, Mycobacterium
AHSHQPLRWGPPEAPDRYV

SEQ ID NO: 791587 - protein, 23 aa, Mycobacterium
AHSLDAPLPPLPPIEQIQGNKSR

SEQ ID NO: 791588 - protein, 25 aa, Mycobacterium
AHSLDPQQRLLLQATWEALEDGGIP

SEQ ID NO: 791589 - protein, 26 aa, Mycobacterium
AHSLRALGFGVLSKSYFRFAQRTWDL

SEQ ID NO: 791590 - protein, 35 aa, Mycobacterium
AHSPGHIHLYQKFGFWPRFLTGLLAKTAAEPATVS

SEQ ID NO: 791591 - protein, 20 aa, Mycobacterium
AHSPLEFLYGLFSDYVRDRR

SEQ ID NO: 791592 - protein, 20 aa, Mycobacterium
AHSPLVELLCTAPVDTAADR

SEQ ID NO: 791593 - protein, 18 aa, Mycobacterium
AHSPWLDITWRDRFEQML

SEQ ID NO: 791594 - protein, 25 aa, Mycobacterium
AHSYYVPAQLFPTADGYLALFITHD

SEQ ID NO: 791595 - protein, 21 aa, Mycobacterium
AHSYYVPAQLFSTAEGFLALF

SEQ ID NO: 791596 - protein, 26 aa, Mycobacterium
AHTATLWRVGFSGFAPGFAYLVDGDP

SEQ ID NO: 791597 - protein, 27 aa, Mycobacterium
AHTDQPVILHWLGDMFDPALRGYWGSG

SEQ ID NO: 791598 - protein, 18 aa, Mycobacterium
AHTDQWRYDGYGADKLAS

SEQ ID NO: 791599 - protein, 18 aa, Mycobacterium
AHTDQWRYDGYGADKLSS

SEQ ID NO: 791600 - protein, 18 aa, Mycobacterium
AHTDQWRYDGYQADALSS

SEQ ID NO: 791601 - protein, 17 aa, Mycobacterium
AHTDQWRYDGYRADTLA

SEQ ID NO: 791602 - protein, 28 aa, Mycobacterium
AHTEIARLIPFIEWLREAYPDQLISVDT

SEQ ID NO: 791603 - protein, 25 aa, Mycobacterium
AHTGPLVWAALAGVPGVLAYRAANT

SEQ ID NO: 791604 - protein, 26 aa, Mycobacterium
AHTGSLWRVGFSGFAPGFAYLVDGDA

SEQ ID NO: 791605 - protein, 24 aa, Mycobacterium
AHTHFLILVLHHVAADEITWDLLF

SEQ ID NO: 791606 - protein, 17 aa, Mycobacterium
AHTLGLHGPAMTVDTAC

SEQ ID NO: 791607 - protein, 20 aa, Mycobacterium
AHTLMPALTTRDGAVRHVLA

SEQ ID NO: 791608 - protein, 19 aa, Mycobacterium
AHTQVPFDLAAAGLELVVI

SEQ ID NO: 791609 - protein, 23 aa, Mycobacterium
AHTVPLGMPSLTPPAPTTIASEA

SEQ ID NO: 791610 - protein, 19 aa, Mycobacterium
AHTVRGLLTAGHEVRLLVA

SEQ ID NO: 791611 - protein, 26 aa, Mycobacterium
AHVAEQLVAPLYYRVIVTGETVDAAF

SEQ ID NO: 791612 - protein, 19 aa, Mycobacterium
AHVAIDFELISAAMRRAGV

SEQ ID NO: 791613 - protein, 27 aa, Mycobacterium
AHVAKFSQFFGFLWPGEYRAFSNAGVD

SEQ ID NO: 791614 - protein, 18 aa, Mycobacterium
AHVDLYFEAAVAGAIPVI

SEQ ID NO: 791615 - protein, 24 aa, Mycobacterium
AHVGITALCDWIDTNRPLLVIHGH

SEQ ID NO: 791616 - protein, 18 aa, Mycobacterium
AHVGVRVNAIAPGLIRSA

SEQ ID NO: 791617 - protein, 29 aa, Mycobacterium
AHVIAAFDTELYGHWWYEGPTWLERVLRA

SEQ ID NO: 791618 - protein, 17 aa, Mycobacterium
AHVILEEAPAWSAPGHG

SEQ ID NO: 791619 - protein, 17 aa, Mycobacterium
AHVLIVKGEFGAAAAML

SEQ ID NO: 791620 - protein, 26 aa, Mycobacterium
AHVPPPVIAANRALLAQLVATNLFGQ

SEQ ID NO: 791621 - protein, 23 aa, Mycobacterium
AHVQLMHRLLHTRGPGFGGVLST

SEQ ID NO: 791622 - protein, 27 aa, Mycobacterium
AHVRRLLIEAAWHHRASYRNPGPTMRA

SEQ ID NO: 791623 - protein, 34 aa, Mycobacterium
AHVRTGRWASIVPQPWIHTLGIPAGASVLRLRRP

SEQ ID NO: 791624 - protein, 18 aa, Mycobacterium
AHVRTWGRNARLTDLMQP

SEQ ID NO: 791625 - protein, 25 aa, Mycobacterium
AHVTGPYRWWTAVGPRLSMVDDGLT

SEQ ID NO: 791626 - protein, 18 aa, Mycobacterium
AHVTYQRALGLLGATDMA

SEQ ID NO: 791627 - protein, 29 aa, Mycobacterium
AHVVTPLSASTLLWPGGRIPEEVLEVQDN

SEQ ID NO: 791628 - protein, 19 aa, Mycobacterium
AHVYGQRCWLRQLSPRVSR

SEQ ID NO: 791629 - protein, 19 aa, Mycobacterium
AHWTLARLTTLGVAADMLL

SEQ ID NO: 791630 - protein, 17 aa, Mycobacterium
AHYFADKSALIRAVLRR

SEQ ID NO: 791631 - protein, 17 aa, Mycobacterium
AHYGARHLLLVSRSGPD

SEQ ID NO: 791632 - protein, 29 aa, Mycobacterium
AHYGMICDSSFPTYLLAHWARDRAEGRMS

SEQ ID NO: 791633 - protein, 22 aa, Mycobacterium
AHYGVFITPFRASLGRLGVIHA

SEQ ID NO: 791634 - protein, 23 aa, Mycobacterium
AHYIDAWLRGDPTQRPPKHPVAD

SEQ ID NO: 791635 - protein, 29 aa, Mycobacterium
AHYVAAKEPWFLDAYRRAWDWADSVGWRP

SEQ ID NO: 791636 - protein, 24 aa, Mycobacterium
AIAAAAVEFLPLSGATVLLDAGTT

SEQ ID NO: 791637 - protein, 18 aa, Mycobacterium
AIAAARLALFGDGTHRVS

SEQ ID NO: 791638 - protein, 30 aa, Mycobacterium
AIAAGHSFVIFLREGFPVNILNPVKAVPEV

SEQ ID NO: 791639 - protein, 27 aa, Mycobacterium
AIAAGVNLLLSPAVFRGFDQVGALSPT

SEQ ID NO: 791640 - protein, 35 aa, Mycobacterium
AIAARKTYLFAFLDDHSRLLPGYRWGYAEDTVRLA

SEQ ID NO: 791641 - protein, 30 aa, Mycobacterium
AIAATGGLIGLWPMGFRRLGMRDVDDFARH

SEQ ID NO: 791642 - protein, 20 aa, Mycobacterium
AIAAVVWEALGRAGFSGGKV

SEQ ID NO: 791643 - protein, 19 aa, Mycobacterium
AIACSFNLEYLLVGGRDAR

SEQ ID NO: 791644 - protein, 20 aa, Mycobacterium
AIADHWARLTFDGAAAGRDY

SEQ ID NO: 791645 - protein, 23 aa, Mycobacterium
AIADPSNWRRWWPDLRLEVTEDR

SEQ ID NO: 791646 - protein, 18 aa, Mycobacterium
AIADQRAPQQRLGGRIYQ

SEQ ID NO: 791647 - protein, 26 aa, Mycobacterium
AIADRPIPYALLPRRARTVYGSAMQK

SEQ ID NO: 791648 - protein, 28 aa, Mycobacterium
AIAEGGWTLPYLPKPWGRASGPIEQIII

SEQ ID NO: 791649 - protein, 28 aa, Mycobacterium
AIAEGGWVLPYLPKPWGRAAGPVEQIII

SEQ ID NO: 791650 - protein, 27 aa, Mycobacterium
AIAEGGWVLPYLPKPWGRASSPVEQVI

SEQ ID NO: 791651 - protein, 27 aa, Mycobacterium
AIAEGGWVLPYLPTPWGRAASPVEQVI

SEQ ID NO: 791652 - protein, 17 aa, Mycobacterium
AIAEGILAAVKRLYLLG

SEQ ID NO: 791653 - protein, 18 aa, Mycobacterium
AIAEHLCATLGPRFTPPK

SEQ ID NO: 791654 - protein, 22 aa, Mycobacterium
AIAELVRVLKVGGTLAVSVPRW

SEQ ID NO: 791655 - protein, 24 aa, Mycobacterium
AIAFPRGMTGPRDDPYAFSFSGLK

SEQ ID NO: 791656 - protein, 26 aa, Mycobacterium
AIAGVLNLVPRWYIGSILRHVDFVAS

SEQ ID NO: 791657 - protein, 24 aa, Mycobacterium
AIAHALERPLDLDRPLWECWVIEG

SEQ ID NO: 791658 - protein, 25 aa, Mycobacterium
AIAHALTRPLDVDRPLWECWIIEGL

SEQ ID NO: 791659 - protein, 17 aa, Mycobacterium
AIAHRLLRRAVARLPLR

SEQ ID NO: 791660 - protein, 19 aa, Mycobacterium
AIAHTQLHPGSVAIAFHGE

SEQ ID NO: 791661 - protein, 25 aa, Mycobacterium
AIAIDDRTLVERPVWSAAAGTVLAG

SEQ ID NO: 791662 - protein, 18 aa, Mycobacterium
AIAIFTRTPDCDPQVPAI

SEQ ID NO: 791663 - protein, 26 aa, Mycobacterium
AIALDKLLDLMPRYEVRWDRCRRVSM

SEQ ID NO: 791664 - protein, 17 aa, Mycobacterium
AIALDRPGYGSSAVYAG

SEQ ID NO: 791665 - protein, 18 aa, Mycobacterium
AIALEAVPYLRRVHVWPD

SEQ ID NO: 791666 - protein, 18 aa, Mycobacterium
AIALEKLLDFMPAFEVDW

SEQ ID NO: 791667 - protein, 18 aa, Mycobacterium
AIALGHPLGATGAKLFAT

SEQ ID NO: 791668 - protein, 19 aa, Mycobacterium
AIALGHPLGATGAKLFATM

SEQ ID NO: 791669 - protein, 19 aa, Mycobacterium
AIALGHPLGATGAKLFTTM

SEQ ID NO: 791670 - protein, 20 aa, Mycobacterium
AIALGHPLGATGAKLFTTML

SEQ ID NO: 791671 - protein, 22 aa, Mycobacterium
AIALHRPGIRFVSFSSVNGFFG

SEQ ID NO: 791672 - protein, 18 aa, Mycobacterium
AIALYRSVGFEQVGLRRR

SEQ ID NO: 791673 - protein, 18 aa, Mycobacterium
AIANLSHEVATMLVITFA

SEQ ID NO: 791674 - protein, 18 aa, Mycobacterium
AIAPGNIPTPLLASSAAG

SEQ ID NO: 791675 - protein, 18 aa, Mycobacterium
AIAPGNIPTPLLATSAAG

SEQ ID NO: 791676 - protein, 23 aa, Mycobacterium
AIAQIEMLAMSDLSLMVKAGVQW

SEQ ID NO: 791677 - protein, 27 aa, Mycobacterium
AIARADAVLLIGARLNWLLGHGESPQW

SEQ ID NO: 791678 - protein, 25 aa, Mycobacterium
AIARALAMDPKLMLFDEPTSALDPE

SEQ ID NO: 791679 - protein, 22 aa, Mycobacterium
AIARALAMNPKLMLFDEPTSAL

SEQ ID NO: 791680 - protein, 27 aa, Mycobacterium
AIARERLGPDRLLVVGLYAVLDTDADA

SEQ ID NO: 791681 - protein, 20 aa, Mycobacterium
AIARHALRYVSEGATLLLDA

SEQ ID NO: 791682 - protein, 19 aa, Mycobacterium
AIARLAGLEILRKSRDDED

SEQ ID NO: 791683 - protein, 20 aa, Mycobacterium
AIARPDCVLLDLHLHDTTGI

SEQ ID NO: 791684 - protein, 25 aa, Mycobacterium
AIARPDLEVVLLEPLLRRSEFLNEV

SEQ ID NO: 791685 - protein, 22 aa, Mycobacterium
AIARRFAHLTYRGEVDLDTRFA

SEQ ID NO: 791686 - protein, 28 aa, Mycobacterium
AIARTPLHAMTLLDIQFIVATAASYVLK

SEQ ID NO: 791687 - protein, 17 aa, Mycobacterium
AIASELALLLNAWRQET

SEQ ID NO: 791688 - protein, 21 aa, Mycobacterium
AIASFARLWVADAHWRAAERV

SEQ ID NO: 791689 - protein, 24 aa, Mycobacterium
AIASFARLWVAEPHWQAAARVMNR

SEQ ID NO: 791690 - protein, 18 aa, Mycobacterium
AIASLGWRLVRVSRDQLS

SEQ ID NO: 791691 - protein, 18 aa, Mycobacterium
AIASPHLVAFNRAYGRTT

SEQ ID NO: 791692 - protein, 22 aa, Mycobacterium
AIASYLVTLYTSLAVLTDDALA

SEQ ID NO: 791693 - protein, 23 aa, Mycobacterium
AIATCYPGYGLPFPSADNIAYLI

SEQ ID NO: 791694 - protein, 24 aa, Mycobacterium
AIAVDPQHRLLLETSWDAVEHAGL

SEQ ID NO: 791695 - protein, 19 aa, Mycobacterium
AIAVFKIVDELPPRDAFVT

SEQ ID NO: 791696 - protein, 22 aa, Mycobacterium
AIAVPVNFRMTPPEIAYLVSDC

SEQ ID NO: 791697 - protein, 21 aa, Mycobacterium
AIAVQPDVLLMDEPCSALDPI

SEQ ID NO: 791698 - protein, 23 aa, Mycobacterium
AICDALQVPLSEVLIGAGERMAR

SEQ ID NO: 791699 - protein, 18 aa, Mycobacterium
AICHCWRAPMIARMAAAE

SEQ ID NO: 791700 - protein, 23 aa, Mycobacterium
AICHCWRAPMIARMAAAEALAAQ

SEQ ID NO: 791701 - protein, 19 aa, Mycobacterium
AICSAYDRLWQLTGSPVVA

SEQ ID NO: 791702 - protein, 19 aa, Mycobacterium
AICVSPTFVAAVASLAPAA

SEQ ID NO: 791703 - protein, 30 aa, Mycobacterium
AIDAIFGVNHLWRRIRAANLPVALSDRLTL

SEQ ID NO: 791704 - protein, 19 aa, Mycobacterium
AIDALPFPEDKKFHKRADI

SEQ ID NO: 791705 - protein, 21 aa, Mycobacterium
AIDALYWRADITDQASWAPIG

SEQ ID NO: 791706 - protein, 18 aa, Mycobacterium
AIDAVAAMVARHLTVEPG

SEQ ID NO: 791707 - protein, 23 aa, Mycobacterium
AIDDAAPPLWARARRRAPAGVID

SEQ ID NO: 791708 - protein, 25 aa, Mycobacterium
AIDDGFFDYLAFTKGFDGAAIRKRY

SEQ ID NO: 791709 - protein, 24 aa, Mycobacterium
AIDDGLLDWLADTAPLPPPDELAQ

SEQ ID NO: 791710 - protein, 26 aa, Mycobacterium
AIDDHHWRFVLRRGVTFHNGERFDAQ

SEQ ID NO: 791711 - protein, 23 aa, Mycobacterium
AIDEIIRRFLGNPDYANLPRKYK

SEQ ID NO: 791712 - protein, 23 aa, Mycobacterium
AIDGKLLVIGFAAGSIPTLTVNR

SEQ ID NO: 791713 - protein, 28 aa, Mycobacterium
AIDGRGMFLTCKFGIEAMLATGGGAIVC

SEQ ID NO: 791714 - protein, 17 aa, Mycobacterium
AIDGYVGLSLLVDRQSG

SEQ ID NO: 791715 - protein, 19 aa, Mycobacterium
AIDIARGRGWLGDDVLGSG

SEQ ID NO: 791716 - protein, 33 aa, Mycobacterium
AIDIEAAFLEYLEMFYNLGIAGRAMRRIGAIEF

SEQ ID NO: 791717 - protein, 22 aa, Mycobacterium
AIDKVNVFVGAFNAGRNTGPTE

SEQ ID NO: 791718 - protein, 17 aa, Mycobacterium
AIDLLFATMARSLEPYR

SEQ ID NO: 791719 - protein, 20 aa, Mycobacterium
AIDMKDMVGMMIVVARQLKR

SEQ ID NO: 791720 - protein, 24 aa, Mycobacterium
AIDPPVSRYVLEAAGFALAKICDR

SEQ ID NO: 791721 - protein, 28 aa, Mycobacterium
AIDRIVGTHWWNPAPLIPLVEVVQATGT

SEQ ID NO: 791722 - protein, 35 aa, Mycobacterium
AIDRLLLETDQLFGWIAFEFGVYRYGLQQRLAPET

SEQ ID NO: 791723 - protein, 35 aa, Mycobacterium
AIDRLLLETDQVFGWIAFEFGVYRYGLQQRLAPRT

SEQ ID NO: 791724 - protein, 42 aa, Mycobacterium
AIDRLLLETDQVFGWVAFEFGLYRYGLQARLAPGTPLARVFW

SEQ ID NO: 791725 - protein, 17 aa, Mycobacterium
AIDRPCLIAMDLGGPKL

SEQ ID NO: 791726 - protein, 21 aa, Mycobacterium
AIDRPVVWTTSALLGQHPIPP

SEQ ID NO: 791727 - protein, 21 aa, Mycobacterium
AIDRWKALIIGTGAVGLIEEM

SEQ ID NO: 791728 - protein, 34 aa, Mycobacterium
AIDTEAAFLEYLDMFYNLGLAGRAMRRIGAVEFA

SEQ ID NO: 791729 - protein, 18 aa, Mycobacterium
AIDTTWRRTSYSGLIRVA

SEQ ID NO: 791730 - protein, 19 aa, Mycobacterium
AIDVADRRPLTAAAAVHDD

SEQ ID NO: 791731 - protein, 24 aa, Mycobacterium
AIDVDQGLWVAMWGGGAVNHYDAF

SEQ ID NO: 791732 - protein, 35 aa, Mycobacterium
AIDVPTLALAFEYDLFFPPALCAEAARFIPAAEFV

SEQ ID NO: 791733 - protein, 18 aa, Mycobacterium
AIDVWHNAWPEFVPFLDY

SEQ ID NO: 791734 - protein, 22 aa, Mycobacterium
AIEAAYRALPTPRRDRIPVNAT

SEQ ID NO: 791735 - protein, 17 aa, Mycobacterium
AIEAAYREPPPPRRDRI

SEQ ID NO: 791736 - protein, 27 aa, Mycobacterium
AIEAGVARFLPWQFGVDYDLIGRGSPQ

SEQ ID NO: 791737 - protein, 27 aa, Mycobacterium
AIEAIYALIYGLTELAATLPLDQFHAA

SEQ ID NO: 791738 - protein, 26 aa, Mycobacterium
AIEAPIAITPWRSVLVFDLDEAIADT

SEQ ID NO: 791739 - protein, 22 aa, Mycobacterium
AIEATYVFPLPARAGVTDFVAD

SEQ ID NO: 791740 - protein, 17 aa, Mycobacterium
AIEDCHDAYRWLRLRGY

SEQ ID NO: 791741 - protein, 31 aa, Mycobacterium
AIEDHLRYSLGRPATLLQPKHYYRALALAVR

SEQ ID NO: 791742 - protein, 31 aa, Mycobacterium
AIEEARGRQLPLRLVYVIPAADVPGGSAQNS

SEQ ID NO: 791743 - protein, 17 aa, Mycobacterium
AIEELPIPFTAVATDLL

SEQ ID NO: 791744 - protein, 18 aa, Mycobacterium
AIEEVVILARRGLREAAF

SEQ ID NO: 791745 - protein, 26 aa, Mycobacterium
AIEEWQQVLIRLTPRQYSISSSPLVS

SEQ ID NO: 791746 - protein, 24 aa, Mycobacterium
AIEFMVELVLFDWPTHIAQIIQAL

SEQ ID NO: 791747 - protein, 20 aa, Mycobacterium
AIEGERWVLSPAALGEFLAE

SEQ ID NO: 791748 - protein, 24 aa, Mycobacterium
AIEGRGIGFTERPPRKPLIAAVEG

SEQ ID NO: 791749 - protein, 23 aa, Mycobacterium
AIEHWVPLLSKDVLTDLLATAGL

SEQ ID NO: 791750 - protein, 22 aa, Mycobacterium
AIEIFATPGYQRYAWRLWHLAQ

SEQ ID NO: 791751 - protein, 18 aa, Mycobacterium
AIEKYWRTTLRRGLSKKE

SEQ ID NO: 791752 - protein, 22 aa, Mycobacterium
AIELARPLLYGAALSLDARDVS

SEQ ID NO: 791753 - protein, 19 aa, Mycobacterium
AIELNIYHLPGDPGPKVSD

SEQ ID NO: 791754 - protein, 25 aa, Mycobacterium
AIEMSDMLLGKQGIDPRVVDLAKQI

SEQ ID NO: 791755 - protein, 18 aa, Mycobacterium
AIEPLVLMVAPLAPHLAE

SEQ ID NO: 791756 - protein, 18 aa, Mycobacterium
AIERALGRYLVGQAAAAG

SEQ ID NO: 791757 - protein, 25 aa, Mycobacterium
AIERDALSLFLAKTFLAEEPDAPVA

SEQ ID NO: 791758 - protein, 17 aa, Mycobacterium
AIERIACGKVLVARDEH

SEQ ID NO: 791759 - protein, 33 aa, Mycobacterium
AIERILDAFYDAWQPYWIPADWSSSVVTFIRAG

SEQ ID NO: 791760 - protein, 36 aa, Mycobacterium
AIERPAVIPLSFAQSRLWFLDQLQGPSAVYNMAAAL

SEQ ID NO: 791761 - protein, 17 aa, Mycobacterium
AIERPIFVTGLPRTGTT

SEQ ID NO: 791762 - protein, 27 aa, Mycobacterium
AIESDGSVRFLGAALTATTGIKGTPKN

SEQ ID NO: 791763 - protein, 31 aa, Mycobacterium
AIESTMLALGTPAPHFSLPNPATGATVSLEE

SEQ ID NO: 791764 - protein, 18 aa, Mycobacterium
AIETYWQWKPTPTETGPT

SEQ ID NO: 791765 - protein, 24 aa, Mycobacterium
AIEVEWMLLHALSRLGRPDGESAY

SEQ ID NO: 791766 - protein, 17 aa, Mycobacterium
AIEVLLWSGDLFERAAT

SEQ ID NO: 791767 - protein, 19 aa, Mycobacterium
AIEWGALVGGSVGLWFLIN

SEQ ID NO: 791768 - protein, 26 aa, Mycobacterium
AIFAIQVGLVALWRSWGVEPEAVLGH

SEQ ID NO: 791769 - protein, 20 aa, Mycobacterium
AIFARLNIGARVALCGLISG

SEQ ID NO: 791770 - protein, 19 aa, Mycobacterium
AIFARLNVGARIALCGLIS

SEQ ID NO: 791771 - protein, 17 aa, Mycobacterium
AIFCLNKTTSQLRAIVT

SEQ ID NO: 791772 - protein, 18 aa, Mycobacterium
AIFCPDPATRKKLLTDIF

SEQ ID NO: 791773 - protein, 19 aa, Mycobacterium
AIFDVLHDWFQSRDGYEGC

SEQ ID NO: 791774 - protein, 26 aa, Mycobacterium
AIFDVMHDWFQLRDGYEGCSFINVLL

SEQ ID NO: 791775 - protein, 25 aa, Mycobacterium
AIFDVMHDWIQLRDGYEGCSFINVL

SEQ ID NO: 791776 - protein, 31 aa, Mycobacterium
AIFGGMKLDFLLTVDWDYYKKFMSVNLDGAL

SEQ ID NO: 791777 - protein, 17 aa, Mycobacterium
AIFGLPSWNLTLEIVES

SEQ ID NO: 791778 - protein, 27 aa, Mycobacterium
AIFGVGDIWRRIRAANLPVALSDRLTL

SEQ ID NO: 791779 - protein, 20 aa, Mycobacterium
AIFGVSEIWRRIRAENLPVA

SEQ ID NO: 791780 - protein, 20 aa, Mycobacterium
AIFGVSHIWRRIRAEELPVA

SEQ ID NO: 791781 - protein, 17 aa, Mycobacterium
AIFVGGFPLVYDGQIVG

SEQ ID NO: 791782 - protein, 30 aa, Mycobacterium
AIFWASLGEIRLFIGWNDRGWFVVTDSDRM

SEQ ID NO: 791783 - protein, 25 aa, Mycobacterium
AIGATLLQDWTQFAAPAVFGTAMRV

SEQ ID NO: 791784 - protein, 21 aa, Mycobacterium
AIGAVLSMHFAKQAAPFFDSA

SEQ ID NO: 791785 - protein, 20 aa, Mycobacterium
AIGAVLSMHFAKQAARFFES

SEQ ID NO: 791786 - protein, 21 aa, Mycobacterium
AIGAVLSMHFARQAAPFFDSA

SEQ ID NO: 791787 - protein, 25 aa, Mycobacterium
AIGCPLINIHHSFLPAFTGASPYKR

SEQ ID NO: 791788 - protein, 27 aa, Mycobacterium
AIGDAPLDDWVWTLGINLWGSIHGCHV

SEQ ID NO: 791789 - protein, 26 aa, Mycobacterium
AIGDVQMLLVPHLPREPIGPDALGEL

SEQ ID NO: 791790 - protein, 20 aa, Mycobacterium
AIGEVLLGHTLLASGRFGDA

SEQ ID NO: 791791 - protein, 29 aa, Mycobacterium
AIGFPTRMFTVLFALGRLPGWIAHWREMH

SEQ ID NO: 791792 - protein, 17 aa, Mycobacterium
AIGFVNSRPKPLSAYLF

SEQ ID NO: 791793 - protein, 25 aa, Mycobacterium
AIGGGFALALACDIRFASPAASFGA

SEQ ID NO: 791794 - protein, 22 aa, Mycobacterium
AIGHAPLRYHKLTLASWAGNDG

SEQ ID NO: 791795 - protein, 20 aa, Mycobacterium
AIGIGMTLALHADIRILAEE

SEQ ID NO: 791796 - protein, 17 aa, Mycobacterium
AIGIQYGPAFSGLSAVL

SEQ ID NO: 791797 - protein, 21 aa, Mycobacterium
AIGIRNAIAPPLRMVRDDDGV

SEQ ID NO: 791798 - protein, 19 aa, Mycobacterium
AIGLAVFLDTKANFQLSEH

SEQ ID NO: 791799 - protein, 30 aa, Mycobacterium
AIGLAVMTELPLLIIDVQRGGPSTGLPTKT

SEQ ID NO: 791800 - protein, 17 aa, Mycobacterium
AIGLQYARYCIERGART

SEQ ID NO: 791801 - protein, 22 aa, Mycobacterium
AIGMEFGYVLKNYGVDVTIVEF

SEQ ID NO: 791802 - protein, 29 aa, Mycobacterium
AIGNAPTALFRLLELIDEGAPAPAAVLGG

SEQ ID NO: 791803 - protein, 24 aa, Mycobacterium
AIGNQRYTLTRFPFLAVNDDTFVL

SEQ ID NO: 791804 - protein, 46 aa, Mycobacterium
AIGPITIQEFTIPSLPLDALVYINGTPIPIFYDFGPITVDETTTDP

SEQ ID NO: 791805 - protein, 18 aa, Mycobacterium
AIGQVQIPRPEQLAYFGG

SEQ ID NO: 791806 - protein, 23 aa, Mycobacterium
AIGSEPIIMLTAPGPAAQRCLER

SEQ ID NO: 791807 - protein, 22 aa, Mycobacterium
AIGSHWPFQEWGRFLPEQTTAV

SEQ ID NO: 791808 - protein, 24 aa, Mycobacterium
AIGSSPQAALPPGATWATDLVSVP

SEQ ID NO: 791809 - protein, 35 aa, Mycobacterium
AIGTFFSQTLPGFLNAPFEQPPPPPPPAPGQSLGD

SEQ ID NO: 791810 - protein, 18 aa, Mycobacterium
AIGTVPHPSPLLAEALAA

SEQ ID NO: 791811 - protein, 17 aa, Mycobacterium
AIGVDLMFTHIKQSLHD

SEQ ID NO: 791812 - protein, 19 aa, Mycobacterium
AIGVIYLPATERQSHYFHV

SEQ ID NO: 791813 - protein, 29 aa, Mycobacterium
AIGVNFIDTYFRSGLYPRELPFVVGTEVC

SEQ ID NO: 791814 - protein, 26 aa, Mycobacterium
AIGVNFIDTYFRSGLYPRETPFIAGS

SEQ ID NO: 791815 - protein, 36 aa, Mycobacterium
AIGVNFIDTYFRSGQYPRPLPFIIGSEVCGTVVAIG

SEQ ID NO: 791816 - protein, 26 aa, Mycobacterium
AIGVNFIDTYFRSGSYPRELPFVIGS

SEQ ID NO: 791817 - protein, 19 aa, Mycobacterium
AIGVVTLAGPIVSGRSGPR

SEQ ID NO: 791818 - protein, 23 aa, Mycobacterium
AIHAKFPDQMLAYNLSPSFNWDT

SEQ ID NO: 791819 - protein, 20 aa, Mycobacterium
AIHDRFVAALAAGAQSYEAA

SEQ ID NO: 791820 - protein, 33 aa, Mycobacterium; identical to SEQ ID NO: 124011

SEQ ID NO: 791821 - protein, 20 aa, Mycobacterium
AIHEMFVNTLATSSGSYAAT

SEQ ID NO: 791822 - protein, 19 aa, Mycobacterium
AIHEMFVNTLSMSSGSYAV

SEQ ID NO: 791823 - protein, 18 aa, Mycobacterium
AIHEMFVTTLQASGGSYA

SEQ ID NO: 791824 - protein, 29 aa, Mycobacterium
AIHFRPGGAFPFLGIPLGDLADGPVGVGE

SEQ ID NO: 791825 - protein, 29 aa, Mycobacterium
AIHGGAFIFPPSFLHWINYSVMAQQTGAT

SEQ ID NO: 791826 - protein, 19 aa, Mycobacterium
AIHHLPVRRDGRFLVALGM

SEQ ID NO: 791827 - protein, 24 aa, Mycobacterium
AIHLLTRIVGLRKATELLMLGEPV

SEQ ID NO: 791828 - protein, 21 aa, Mycobacterium
AIHLSIFGMQPVVKHGSDELK

SEQ ID NO: 791829 - protein, 25 aa, Mycobacterium
AIHMPQMMLAKAWLVAARGSDRGAV

SEQ ID NO: 791830 - protein, 26 aa, Mycobacterium
AIHNLGGPQKMTFADMARAVLVHQSR

SEQ ID NO: 791831 - protein, 33 aa, Mycobacterium
AIHRAIFALAVIGIYPVLFNPKAYRAVGIHPLR

SEQ ID NO: 791832 - protein, 17 aa, Mycobacterium
AIHRFPGSMAKRVQVLA

SEQ ID NO: 791833 - protein, 18 aa, Mycobacterium
AIHTNRIYRRGTVAPFPS

SEQ ID NO: 791834 - protein, 22 aa, Mycobacterium
AIHVIIHALNEWLHEVWGFNYQ

SEQ ID NO: 791835 - protein, 19 aa, Mycobacterium
AIHVLVHALNQWLDEVWGF

SEQ ID NO: 791836 - protein, 32 aa, Mycobacterium
AIHYLAVFDEHTGRPLYLGRQKRIATADQRLI

SEQ ID NO: 791837 - protein, 27 aa, Mycobacterium
AIIASQKFLPRALSEGLNRALGGEHVF

SEQ ID NO: 791838 - protein, 28 aa, Mycobacterium
AIIAYNYPNQLALAKLAPALAAGCTVVL

SEQ ID NO: 791839 - protein, 24 aa, Mycobacterium
AIIDHLRYSIGRPASVLTPAHYYR

SEQ ID NO: 791840 - protein, 18 aa, Mycobacterium
AIIKAFVVLKDGFTADDD

SEQ ID NO: 791841 - protein, 26 aa, Mycobacterium
AIIKGPHVLEFLWAPNGKELSWTLTQ

SEQ ID NO: 791842 - protein, 22 aa, Mycobacterium
AIINAILKIMATSVQLTADMGR

SEQ ID NO: 791843 - protein, 20 aa, Mycobacterium
AIIPDIYLDGRIPHEAYRPT

SEQ ID NO: 791844 - protein, 29 aa, Mycobacterium
AIIRTSVPPFTWWRGLKARQLLEHYFAER

SEQ ID NO: 791845 - protein, 22 aa, Mycobacterium
AIISGTVIAPIGPITIHGGDAS

SEQ ID NO: 791846 - protein, 23 aa, Mycobacterium
AIISILAVLKTGAAYLPIDPALP

SEQ ID NO: 791847 - protein, 23 aa, Mycobacterium
AIITRSHWAIQDPVPDGGTAVFD

SEQ ID NO: 791848 - protein, 33 aa, Mycobacterium
AIIYGYFPGLARDRYHWVYRPGITAGVVPTNDG

SEQ ID NO: 791849 - protein, 25 aa, Mycobacterium
AIKDAEWWRLGLAEEIGGMPAPAPL

SEQ ID NO: 791850 - protein, 25 aa, Mycobacterium
AIKDAEWWRLGLAEEIGGMPAPPPL

SEQ ID NO: 791851 - protein, 25 aa, Mycobacterium
AIKEAGWWRLMLDEQIGGMAAPPPL

SEQ ID NO: 791852 - protein, 17 aa, Mycobacterium
AIKHRLADLWFDVGAAA

SEQ ID NO: 791853 - protein, 17 aa, Mycobacterium
AIKLTFVNPLVTTSMAG

SEQ ID NO: 791854 - protein, 21 aa, Mycobacterium
AIKRAHDEFRWFAGGWPVNAD

SEQ ID NO: 791855 - protein, 29 aa, Mycobacterium
AIKRNDPWATMWAAMFFTGARQGEIIGME

SEQ ID NO: 791856 - protein, 19 aa, Mycobacterium
AIKRPHVYRLMFGSTSAHG

SEQ ID NO: 791857 - protein, 27 aa, Mycobacterium
AIKTAEQALGLPYVWGGGGAAGPSGGG

SEQ ID NO: 791858 - protein, 17 aa, Mycobacterium
AILACDLVAALRYQGRT

SEQ ID NO: 791859 - protein, 24 aa, Mycobacterium
AILAHPTLHIGMRANWFGLAGEAV

SEQ ID NO: 791860 - protein, 27 aa, Mycobacterium
AILAILWEMYPGHPNLLPAYLDSPREL

SEQ ID NO: 791861 - protein, 20 aa, Mycobacterium
AILALHVDVLWKTVDDFTIQ

SEQ ID NO: 791862 - protein, 25 aa, Mycobacterium
AILAMERVEYRILGPQYKSPRLVKP

SEQ ID NO: 791863 - protein, 17 aa, Mycobacterium
AILAPLTFATIFAKLVQ

SEQ ID NO: 791864 - protein, 17 aa, Mycobacterium
AILARASGIDTDRTITA

SEQ ID NO: 791865 - protein, 20 aa, Mycobacterium
AILARLIVPTAQLLDFHAEV

SEQ ID NO: 791866 - protein, 21 aa, Mycobacterium
AILAVLWQMYPGHPNLLPAYL

SEQ ID NO: 791867 - protein, 21 aa, Mycobacterium
AILAVPGIRAALRATPAPIVG

SEQ ID NO: 791868 - protein, 20 aa, Mycobacterium
AILAVPGIRAALRSATAPVV

SEQ ID NO: 791869 - protein, 20 aa, Mycobacterium
AILAVPGVRGALRAAKAPVV

SEQ ID NO: 791870 - protein, 24 aa, Mycobacterium
AILDEGTLYVAKLSSDIPAAEIDG

SEQ ID NO: 791871 - protein, 20 aa, Mycobacterium
AILDTLAGGGAYFFRQLIGD

SEQ ID NO: 791872 - protein, 17 aa, Mycobacterium
AILFAPVGDLVLPALQA

SEQ ID NO: 791873 - protein, 17 aa, Mycobacterium
AILGASLRRGVDLVITS

SEQ ID NO: 791874 - protein, 24 aa, Mycobacterium
AILGHPLKKWPELGIPIVMSDLKF

SEQ ID NO: 791875 - protein, 23 aa, Mycobacterium
AILNIASILSWKHIPGIGAYAAA

SEQ ID NO: 791876 - protein, 25 aa, Mycobacterium
AILNSPMLNYPLTQYMFCSPDEGAA

SEQ ID NO: 791877 - protein, 19 aa, Mycobacterium
AILPLSFGFPFGFSAVIPP

SEQ ID NO: 791878 - protein, 20 aa, Mycobacterium
AILQAGIARGLQPRVHANQL

SEQ ID NO: 791879 - protein, 19 aa, Mycobacterium
AILQTWLDQRRSTAPGPVT

SEQ ID NO: 791880 - protein, 25 aa, Mycobacterium
AILRQAPELAAWPRSPEWTGAEEVH

SEQ ID NO: 791881 - protein, 28 aa, Mycobacterium
AILSATRYEWVILDYAILSVGAVTVPIY

SEQ ID NO: 791882 - protein, 23 aa, Mycobacterium
AILTCRLIDRPLRPSFVSGLRNE

SEQ ID NO: 791883 - protein, 22 aa, Mycobacterium
AILTCRLIDRPLRPTFISGLRN

SEQ ID NO: 791884 - protein, 22 aa, Mycobacterium
AILTPAMLAAHYRLGQHRPAGQ

SEQ ID NO: 791885 - protein, 26 aa, Mycobacterium
AIMARLRSPLLPVVKDRRLLGVITAS

SEQ ID NO: 791886 - protein, 25 aa, Mycobacterium
AIMEAMRLRPIASFIIRVAAKDFEF

SEQ ID NO: 791887 - protein, 18 aa, Mycobacterium
AIMEDFAHHAAVALTLCR

SEQ ID NO: 791888 - protein, 19 aa, Mycobacterium
AIMEDFAHHAAVALTLCRA

SEQ ID NO: 791889 - protein, 21 aa, Mycobacterium
AIMEEVLLPVMYDIPSRDDVA

SEQ ID NO: 791890 - protein, 23 aa, Mycobacterium
AIMEYLDWDKLGKTFYLLDTFAG

SEQ ID NO: 791891 - protein, 19 aa, Mycobacterium
AIMLLGGLRELTATTLESG

SEQ ID NO: 791892 - protein, 17 aa, Mycobacterium
AIMVETLKFHQVQSGPH

SEQ ID NO: 791893 - protein, 24 aa, Mycobacterium
AIMVSLAELWRSVGVTPDAVIGHS

SEQ ID NO: 791894 - protein, 17 aa, Mycobacterium
AIMVVLALAMQEAGELT

SEQ ID NO: 791895 - protein, 18 aa, Mycobacterium
AIMVVLALAMQQSGELVS

SEQ ID NO: 791896 - protein, 17 aa, Mycobacterium
AINAMDLALPRNRGQIP

SEQ ID NO: 791897 - protein, 24 aa, Mycobacterium
AINAPAQTLFGRPFIGNGADGTAA

SEQ ID NO: 791898 - protein, 24 aa, Mycobacterium
AINAPTEALLGRPLIGNGANGTAT

SEQ ID NO: 791899 - protein, 24 aa, Mycobacterium
AINAPTQALLGRPLIGDGAAGTAT

SEQ ID NO: 791900 - protein, 30 aa, Mycobacterium
AINAPVEAATGRPLIGNGTPGAAGSGADGT

SEQ ID NO: 791901 - protein, 20 aa, Mycobacterium
AINDAMLAEFTRTFASLAAD

SEQ ID NO: 791902 - protein, 30 aa, Mycobacterium
AINDYLGHTAGDWFIRVLAERLREGADPRA

SEQ ID NO: 791903 - protein, 20 aa, Mycobacterium
AINLARLATLGLRHGAAGWA

SEQ ID NO: 791904 - protein, 20 aa, Mycobacterium
AINVERLRTPAPGAAASVPA

SEQ ID NO: 791905 - protein, 25 aa, Mycobacterium
AINYLGPVHVCAAFLPGMIETHAGG

SEQ ID NO: 791906 - protein, 18 aa, Mycobacterium
AIPAALDVAIPRGSRTPA

SEQ ID NO: 791907 - protein, 28 aa, Mycobacterium
AIPADGVYAAWFTLLGHGPVTGTVVPGE

SEQ ID NO: 791908 - protein, 27 aa, Mycobacterium
AIPADPNGAWYTSGIRFGSPALTTRGF

SEQ ID NO: 791909 - protein, 28 aa, Mycobacterium
AIPADPNGAWYTSGIRFGTPALTSRGFG

SEQ ID NO: 791910 - protein, 28 aa, Mycobacterium
AIPAGPADWALLGAALLGVAGSGAGLVN

SEQ ID NO: 791911 - protein, 24 aa, Mycobacterium
AIPASIAELAVSLPAAVLADAEEA

SEQ ID NO: 791912 - protein, 26 aa, Mycobacterium
AIPCFETIWMRILDHPDFAVADLSSL

SEQ ID NO: 791913 - protein, 18 aa, Mycobacterium
AIPDCMAHWTLARLTTLG

SEQ ID NO: 791914 - protein, 26 aa, Mycobacterium
AIPDPESFTPIPFIKEGLAIVHCDPH

SEQ ID NO: 791915 - protein, 26 aa, Mycobacterium
AIPGSGLLAALLNFLDGNDGNPYGVF

SEQ ID NO: 791916 - protein, 17 aa, Mycobacterium
AIPHISTGDLFRYNISN

SEQ ID NO: 791917 - protein, 19 aa, Mycobacterium
AIPIETFVARVLAGGYNHG

SEQ ID NO: 791918 - protein, 17 aa, Mycobacterium
AIPIVGAPMAGGPGTPA

SEQ ID NO: 791919 - protein, 18 aa, Mycobacterium
AIPLLDNHARIWGSRAVS

SEQ ID NO: 791920 - protein, 19 aa, Mycobacterium
AIPLNLVLLKDICVRGMEI

SEQ ID NO: 791921 - protein, 17 aa, Mycobacterium
AIPLPGRRARRGVGTAT

SEQ ID NO: 791922 - protein, 17 aa, Mycobacterium
AIPTYREALHRWLAVCD

SEQ ID NO: 791923 - protein, 28 aa, Mycobacterium
AIPVETIEFFWGLGIPVYEVWGESECVG

SEQ ID NO: 791924 - protein, 17 aa, Mycobacterium
AIQAKKVLAVRALADKQ

SEQ ID NO: 791925 - protein, 23 aa, Mycobacterium
AIQALDFFFRKIVRDRGQALQFV

SEQ ID NO: 791926 - protein, 20 aa, Mycobacterium
AIQALWASRLGSLFYDNAQT

SEQ ID NO: 791927 - protein, 26 aa, Mycobacterium
AIQAQDFFFRKIIRDKGQALAYVAGE

SEQ ID NO: 791928 - protein, 31 aa, Mycobacterium
AIQDNGPWHFDLYIHWPVALSTDFVRIDDMN

SEQ ID NO: 791929 - protein, 26 aa, Mycobacterium
AIQESLDSLGPIFGELRDAGRELLEL

SEQ ID NO: 791930 - protein, 27 aa, Mycobacterium
AIQESLNSLGPIFSELRDAGRDLLELR

SEQ ID NO: 791931 - protein, 28 aa, Mycobacterium
AIQGPPRWHGPEVLLRQTSFRALAEPRC

SEQ ID NO: 791932 - protein, 24 aa, Mycobacterium
AIQHRLVELLVFEVKARAVIMKAA

SEQ ID NO: 791933 - protein, 20 aa, Mycobacterium
AIQLLIEYDPQPPFDAGHMS

SEQ ID NO: 791934 - protein, 21 aa, Mycobacterium
AIQQAVLPNAKFGERVLAEVR

SEQ ID NO: 791935 - protein, 31 aa, Mycobacterium
AIQQRINVLEQLMGVYRDLEAVPAALESAYQ

SEQ ID NO: 791936 - protein, 21 aa, Mycobacterium
AIQQVNLFRRLRDGRRVVGHK

SEQ ID NO: 791937 - protein, 17 aa, Mycobacterium
AIRAAGYTRVSLGMQSV

SEQ ID NO: 791938 - protein, 17 aa, Mycobacterium
AIRAILDNPAYRGIRVW

SEQ ID NO: 791939 - protein, 19 aa, Mycobacterium
AIRAIWRSWRTGERLDFRG

SEQ ID NO: 791940 - protein, 39 aa, Mycobacterium
AIRAPRFHLFDVIGQHKLAFLAFLPYSGVLLNWGKLPKR

SEQ ID NO: 791941 - protein, 30 aa, Mycobacterium
AIRARDAVLLGLTGRRWGFGRTSAADRARV

SEQ ID NO: 791942 - protein, 28 aa, Mycobacterium
AIRDNWWLHLQVFSIQRAPRKLKYLAGS

SEQ ID NO: 791943 - protein, 24 aa, Mycobacterium
AIRDNYTELLIKDGARLDTIDILR

SEQ ID NO: 791944 - protein, 19 aa, Mycobacterium
AIREKFWSDASLQTAPWSA

SEQ ID NO: 791945 - protein, 22 aa, Mycobacterium
AIRFEPGVAQQVRLVPLRGTRE

SEQ ID NO: 791946 - protein, 17 aa, Mycobacterium
AIRFVINGAVDPASPLA

SEQ ID NO: 791947 - protein, 22 aa, Mycobacterium
AIRGEIDLVMWGEWPLEASPLR

SEQ ID NO: 791948 - protein, 18 aa, Mycobacterium
AIRGGHPWRAARTANTCS

SEQ ID NO: 791949 - protein, 34 aa, Mycobacterium
AIRGLVSSPLLRCRRTIEPLAEALCLDPVIDDRL

SEQ ID NO: 791950 - protein, 20 aa, Mycobacterium
AIRHAFFTDSRPISLLHEIV

SEQ ID NO: 791951 - protein, 27 aa, Mycobacterium
AIRHAVGLGVRRIVLALGGSASTDGGA

SEQ ID NO: 791952 - protein, 20 aa, Mycobacterium
AIRLDCDVLVIGGGTAGTMA

SEQ ID NO: 791953 - protein, 24 aa, Mycobacterium
AIRLGDYCLGLYGARDYLAEHGTP

SEQ ID NO: 791954 - protein, 25 aa, Mycobacterium
AIRLGLFAGHYRQDRYWSPAVLDEA

SEQ ID NO: 791955 - protein, 25 aa, Mycobacterium
AIRLLQELHAAPLDPGLLGAAVARI

SEQ ID NO: 791956 - protein, 17 aa, Mycobacterium
AIRLLQQLHAAPLDPDL

SEQ ID NO: 791957 - protein, 20 aa, Mycobacterium
AIRMLPAVLSPDAAVQTIVA

SEQ ID NO: 791958 - protein, 23 aa, Mycobacterium
AIRNFVHGIGFQRDVLGAEPATA

SEQ ID NO: 791959 - protein, 25 aa, Mycobacterium
AIRPFPHHCAYGAAKWALRGLTQTA

SEQ ID NO: 791960 - protein, 26 aa, Mycobacterium
AIRPRHPLLPVPPQPPGREPLRRRPA

SEQ ID NO: 791961 - protein, 21 aa, Mycobacterium
AIRQAAWPSGMPGPPGPSAKL

SEQ ID NO: 791962 - protein, 21 aa, Mycobacterium
AIRQAHLASLLGKLSCDELDA

SEQ ID NO: 791963 - protein, 21 aa, Mycobacterium
AIRQIFFRFGEVIVEVVGAPG

SEQ ID NO: 791964 - protein, 25 aa, Mycobacterium
AIRQLRPAVALLDYKMPELDGLEVT

SEQ ID NO: 791965 - protein, 18 aa, Mycobacterium
AIRQVFVKLLDDLPGATW

SEQ ID NO: 791966 - protein, 18 aa, Mycobacterium
AIRRALVPEALVDAAVTA

SEQ ID NO: 791967 - protein, 28 aa, Mycobacterium
AIRRATAEKLPLLALPTSGGTRMQEGAA

SEQ ID NO: 791968 - protein, 23 aa, Mycobacterium
AIRRPGVPEDITELALLLAGEHG

SEQ ID NO: 791969 - protein, 17 aa, Mycobacterium
AIRRRVARLRAQQAHVL

SEQ ID NO: 791970 - protein, 17 aa, Mycobacterium
AIRRTRWQIWKFQHDNT

SEQ ID NO: 791971 - protein, 24 aa, Mycobacterium
AIRSRPFEYWRRHLKTMKGQWAPF

SEQ ID NO: 791972 - protein, 17 aa, Mycobacterium
AIRTLPPAIRSGVEKLR

SEQ ID NO: 791973 - protein, 17 aa, Mycobacterium
AIRTTKKALWHSLEVGM

SEQ ID NO: 791974 - protein, 30 aa, Mycobacterium
AIRVSNRLRPWLHLLLALTANSAIYRGSDS

SEQ ID NO: 791975 - protein, 20 aa, Mycobacterium
AIRYLGHTVTWADLRYRVAA

SEQ ID NO: 791976 - protein, 24 aa, Mycobacterium
AISAALMLIWACDLIVAADDARFS

SEQ ID NO: 791977 - protein, 25 aa, Mycobacterium
AISAALMLIWACDLIVAADNAKFSD

SEQ ID NO: 791978 - protein, 20 aa, Mycobacterium
AISAFWDKAIAPTPKIEFVF

SEQ ID NO: 791979 - protein, 25 aa, Mycobacterium
AISAGLMLIWACDLIVAADNAKFSD

SEQ ID NO: 791980 - protein, 25 aa, Mycobacterium
AISAGLMLIWACDLIVAADNARFSD

SEQ ID NO: 791981 - protein, 44 aa, Mycobacterium
AISAPGWAKHAWSCFFAPWIAEATIFVYNYGRFQAPALLDQIRR

SEQ ID NO: 791982 - protein, 26 aa, Mycobacterium
AISAQMAQFHRQFAQALSAANRSYAL

SEQ ID NO: 791983 - protein, 33 aa, Mycobacterium
AISAQSAAFHERLVQTLRSGASAYLGTELANAQ

SEQ ID NO: 791984 - protein, 33 aa, Mycobacterium
AISAVDTALWDLKGKLLDLPVCRVLGMAHDAVP

SEQ ID NO: 791985 - protein, 28 aa, Mycobacterium
AISAVPPDIALFLDLKQTPAQPVVSAVA

SEQ ID NO: 791986 - protein, 27 aa, Mycobacterium
AISDERVLQIYNALRPNASTKAELDAI

SEQ ID NO: 791987 - protein, 18 aa, Mycobacterium
AISDIIKFQTDLSTGVLN

SEQ ID NO: 791988 - protein, 25 aa, Mycobacterium
AISDNLVSAAPFWEKPRDLADVLTV

SEQ ID NO: 791989 - protein, 23 aa, Mycobacterium
AISDSVVWIWNAVERHTTNVQTG

SEQ ID NO: 791990 - protein, 35 aa, Mycobacterium
AISEEILTALWALIGYRLPTPIPRITYADAMRRFG

SEQ ID NO: 791991 - protein, 25 aa, Mycobacterium
AISELTGIWWFGPAAESMVAAVLPF

SEQ ID NO: 791992 - protein, 36 aa, Mycobacterium
AISGIEVINQWYYNPAYLAIMQNCAYTQMGVWSENS

SEQ ID NO: 791993 - protein, 25 aa, Mycobacterium
AISGPAVFPGYLRPGPDGPAPDPAG

SEQ ID NO: 791994 - protein, 19 aa, Mycobacterium
AISHLPHLLAEALAVTADG

SEQ ID NO: 791995 - protein, 18 aa, Mycobacterium
AISLAQRWGSRNPVPWGG

SEQ ID NO: 791996 - protein, 27 aa, Mycobacterium
AISLFRDPQYVVAILAVLKAGGMCVPL

SEQ ID NO: 791997 - protein, 17 aa, Mycobacterium
AISLPLAQSATGLPIGL

SEQ ID NO: 791998 - protein, 18 aa, Mycobacterium
AISLYRSVGFEQIGLRRR

SEQ ID NO: 791999 - protein, 31 aa, Mycobacterium
AISPEMPVDQYWFWNLRNAVRFDRAVATAAA

SEQ ID NO: 792000 - protein, 25 aa, Mycobacterium
AISPGLLTRFAGYTGLPASGQTTGQ

SEQ ID NO: 792001 - protein, 34 aa, Mycobacterium
AISPPPVDDTWLPKPARPVPPWPTVQREACAAIT

SEQ ID NO: 792002 - protein, 28 aa, Mycobacterium
AISRADAVLLIGARLNWLLGHGESPQWS

SEQ ID NO: 792003 - protein, 17 aa, Mycobacterium
AISRDIPLRLIHAIPRG

SEQ ID NO: 792004 - protein, 26 aa, Mycobacterium
AISRSLAGLFWARIEAIAPGIDTLQL

SEQ ID NO: 792005 - protein, 34 aa, Mycobacterium
AISRSLMDTHPFMWLPMLSRVLGSAQLLPEAVAG

SEQ ID NO: 792006 - protein, 24 aa, Mycobacterium
AISSPADWRRWWPDLQLNVVEERG

SEQ ID NO: 792007 - protein, 23 aa, Mycobacterium
AISTFLDNLAAAMIRLTQTLGPQ

SEQ ID NO: 792008 - protein, 19 aa, Mycobacterium
AISWLRRHKAFNADKPFMM

SEQ ID NO: 792009 - protein, 31 aa, Mycobacterium
AISYARSRGLPVFGLCLGLQCIVIEAARSVG

SEQ ID NO: 792010 - protein, 25 aa, Mycobacterium
AITAALLRGVLRVFEDFRYIREIAD

SEQ ID NO: 792011 - protein, 20 aa, Mycobacterium
AITAVTVTCAAAPTGATIPA

SEQ ID NO: 792012 - protein, 32 aa, Mycobacterium
AITDELWDLLPGYLIFRSIIPNRPPTPHTVQL

SEQ ID NO: 792013 - protein, 24 aa, Mycobacterium
AITFPRGMTGPRDEPYAFSFSGLK

SEQ ID NO: 792014 - protein, 21 aa, Mycobacterium
AITFSTSKWGLRGRSTQVVRL

SEQ ID NO: 792015 - protein, 17 aa, Mycobacterium
AITHILYTSGTTGTPKG

SEQ ID NO: 792016 - protein, 27 aa, Mycobacterium
AITISDLKFMRFIAQEIFPGGEVPSTD

SEQ ID NO: 792017 - protein, 21 aa, Mycobacterium
AITKFDIVITTALVPGRPAPR

SEQ ID NO: 792018 - protein, 27 aa, Mycobacterium
AITLAYNMHYIMLGIAGNLMSEEQNKY

SEQ ID NO: 792019 - protein, 19 aa, Mycobacterium
AITLSWIRELPSLGAVARP

SEQ ID NO: 792020 - protein, 26 aa, Mycobacterium
AITLYRDQLGLRLALDRSFADWGMRL

SEQ ID NO: 792021 - protein, 20 aa, Mycobacterium
AITMARIIGELLPDISVPYG

SEQ ID NO: 792022 - protein, 25 aa, Mycobacterium
AITNPLVFPYDWRLSNRYTARQLKV

SEQ ID NO: 792023 - protein, 32 aa, Mycobacterium
AITNRAVLAVYRPLLEPLGLTHPQYLVMLALW

SEQ ID NO: 792024 - protein, 18 aa, Mycobacterium
AITPLIAAYDFTRFGTIA

SEQ ID NO: 792025 - protein, 34 aa, Mycobacterium
AITPQTRLIWVETPTNPLLSIADIAALAGLGQQS

SEQ ID NO: 792026 - protein, 27 aa, Mycobacterium
AITPRTRLIWVETPTNPLLSIADIAQI

SEQ ID NO: 792027 - protein, 23 aa, Mycobacterium
AITQQARFSSFAALALLGCTNQH

SEQ ID NO: 792028 - protein, 18 aa, Mycobacterium
AITQRTFLWQHCTAMVPG

SEQ ID NO: 792029 - protein, 17 aa, Mycobacterium
AITRANLSLGGPALLFE

SEQ ID NO: 792030 - protein, 20 aa, Mycobacterium
AITRGVGWLRLNRADKRNAL

SEQ ID NO: 792031 - protein, 24 aa, Mycobacterium
AITRNFFKLIAYKDEYEVARMLTD

SEQ ID NO: 792032 - protein, 17 aa, Mycobacterium
AITRRRTDRLPLHPPAH

SEQ ID NO: 792033 - protein, 27 aa, Mycobacterium
AITTFNKAFAPYGLPRTAFKPSYGIAE

SEQ ID NO: 792034 - protein, 19 aa, Mycobacterium
AITTRIKPVTYLSTVAVAM

SEQ ID NO: 792035 - protein, 18 aa, Mycobacterium
AITTRLLVPRARYDEAVE

SEQ ID NO: 792036 - protein, 21 aa, Mycobacterium
AITTRLVVPRARYDEAVAIAA

SEQ ID NO: 792037 - protein, 19 aa, Mycobacterium
AITWHKYVAGLVVQAKLAI

SEQ ID NO: 792038 - protein, 18 aa, Mycobacterium
AITWNVLDDLGIGGITDL

SEQ ID NO: 792039 - protein, 19 aa, Mycobacterium
AIVAMTRTMAVELALDGIR

SEQ ID NO: 792040 - protein, 19 aa, Mycobacterium
AIVAPKPLQDNGIPLWIAG

SEQ ID NO: 792041 - protein, 18 aa, Mycobacterium
AIVAPKPLQNNGIPLWVA

SEQ ID NO: 792042 - protein, 27 aa, Mycobacterium
AIVAVNLLGPIRLTASLLPALLTQRDA

SEQ ID NO: 792043 - protein, 20 aa, Mycobacterium
AIVDIYLPYVRDTAVSFETV

SEQ ID NO: 792044 - protein, 19 aa, Mycobacterium
AIVDPLTELIRRSNERDDV

SEQ ID NO: 792045 - protein, 24 aa, Mycobacterium
AIVEELFPMAAITDLKAFFGASDD

SEQ ID NO: 792046 - protein, 24 aa, Mycobacterium
AIVFPRGMTGPRDDPYTFSFSGLK

SEQ ID NO: 792047 - protein, 17 aa, Mycobacterium
AIVGSDLRPGNIWQTVE

SEQ ID NO: 792048 - protein, 25 aa, Mycobacterium
AIVHLGFGFGIVFINPALEALGWDP

SEQ ID NO: 792049 - protein, 21 aa, Mycobacterium
AIVHLGFGFGIVFINPALEAV

SEQ ID NO: 792050 - protein, 24 aa, Mycobacterium
AIVKRPRIIIDEFGNESIGVRSVS

SEQ ID NO: 792051 - protein, 28 aa, Mycobacterium
AIVKSLAAAPFADILWMETKTADLADAR

SEQ ID NO: 792052 - protein, 29 aa, Mycobacterium
AIVKVAVEAPLKQIAFNSGLEPGVVAEKV

SEQ ID NO: 792053 - protein, 18 aa, Mycobacterium
AIVLFDVPDELTAGDARS

SEQ ID NO: 792054 - protein, 17 aa, Mycobacterium
AIVLYPDFTALDFIGPY

SEQ ID NO: 792055 - protein, 20 aa, Mycobacterium
AIVQAALPYLRRSGNAHVVN

SEQ ID NO: 792056 - protein, 21 aa, Mycobacterium
AIVQIASRRPGTGRWQIVVVE

SEQ ID NO: 792057 - protein, 18 aa, Mycobacterium
AIVRLLDTSHLAAEAVMG

SEQ ID NO: 792058 - protein, 20 aa, Mycobacterium
AIVSFLRYIDTNRASWIVMY

SEQ ID NO: 792059 - protein, 19 aa, Mycobacterium
AIVSSPLVHIGGVFRVLQC

SEQ ID NO: 792060 - protein, 20 aa, Mycobacterium
AIVVLAALMGASRVLGRDQQ

SEQ ID NO: 792061 - protein, 26 aa, Mycobacterium
AIVVLTEWPQFRDLDWRVIARDAPLA

SEQ ID NO: 792062 - protein, 19 aa, Mycobacterium
AIVYPTWYSGRHWDNEWLI

SEQ ID NO: 792063 - protein, 21 aa, Mycobacterium
AIYDAWASLSYERGPLGLPTS

SEQ ID NO: 792064 - protein, 24 aa, Mycobacterium
AIYDTMVLAPCDIATYAMGMAASM

SEQ ID NO: 792065 - protein, 23 aa, Mycobacterium
AIYDTMVLAPCDVATYAMGMAAS

SEQ ID NO: 792066 - protein, 30 aa, Mycobacterium; identical to SEQ ID NO: 236123

SEQ ID NO: 792067 - protein, 18 aa, Mycobacterium
AIYRRWRGKAHLVHEAVF

SEQ ID NO: 792068 - protein, 19 aa, Mycobacterium
AKAAAFIHHLPVDQSFTLE

SEQ ID NO: 792069 - protein, 30 aa, Mycobacterium
AKAAEYGLRPLVRLVSWGLAGVAPDIMGIG

SEQ ID NO: 792070 - protein, 24 aa, Mycobacterium
AKAAGLFNAPASQVARLAAALQEK

SEQ ID NO: 792071 - protein, 17 aa, Mycobacterium
AKACWLRSRRRGVLAGF

SEQ ID NO: 792072 - protein, 24 aa, Mycobacterium
AKADFELWCFAVSSINGCSHCVVA

SEQ ID NO: 792073 - protein, 24 aa, Mycobacterium
AKADGARQRLAANASAVVTEDSIE

SEQ ID NO: 792074 - protein, 32 aa, Mycobacterium
AKAFARLGIRCFGFSPLRLPPELDFAALFHGV

SEQ ID NO: 792075 - protein, 18 aa, Mycobacterium
AKAFLCSEIARWVEEEGL

SEQ ID NO: 792076 - protein, 18 aa, Mycobacterium
AKAFLCSEIARWVNEEGL

SEQ ID NO: 792077 - protein, 22 aa, Mycobacterium
AKAFSRIFAESLWLELREHNVD

SEQ ID NO: 792078 - protein, 22 aa, Mycobacterium
AKAIRGYLSILATMLRAVLARP

SEQ ID NO: 792079 - protein, 27 aa, Mycobacterium
AKALAPVRFFNPLSMRFAKKATIDDIR

SEQ ID NO: 792080 - protein, 26 aa, Mycobacterium
AKALDPQHRLFLQTVFHAFEDAGYDP

SEQ ID NO: 792081 - protein, 21 aa, Mycobacterium
AKALGLRPRARIVSQALVGAE

SEQ ID NO: 792082 - protein, 27 aa, Mycobacterium
AKALHAPLDVLLVRKLGVPLHSELAFG

SEQ ID NO: 792083 - protein, 19 aa, Mycobacterium
AKALLAKRGFDPVLGARPL

SEQ ID NO: 792084 - protein, 17 aa, Mycobacterium
AKALPRSLPAEAAEALI

SEQ ID NO: 792085 - protein, 28 aa, Mycobacterium
AKAPRLVNRLARLPLTKRLGGIAPEREV

SEQ ID NO: 792086 - protein, 25 aa, Mycobacterium
AKAQELGLSWLAEIGAHGVVAGPDS

SEQ ID NO: 792087 - protein, 32 aa, Mycobacterium
AKAQKRQQFLTDLSLVGGLLIASADTAGKPSL

SEQ ID NO: 792088 - protein, 24 aa, Mycobacterium
AKARGLWNLFLPAESGLTNLEYAP

SEQ ID NO: 792089 - protein, 24 aa, Mycobacterium
AKARSWLALEPSAPVRYLTYDLEC

SEQ ID NO: 792090 - protein, 37 aa, Mycobacterium
AKATETWRFPAFFHALLDAGIYPPPSAYEAWFVSTAL

SEQ ID NO: 792091 - protein, 32 aa, Mycobacterium
AKATETWRFPPFFHALLERGVYPPCSAFETWF

SEQ ID NO: 792092 - protein, 27 aa, Mycobacterium
AKATGTTPIRWLIEQRIQASLALLESS

SEQ ID NO: 792093 - protein, 31 aa, Mycobacterium
AKAWEHGRFNAPYLRDALLSAGALCETLETA

SEQ ID NO: 792094 - protein, 25 aa, Mycobacterium
AKAYAAAWGVPFYGVNHLGGHLAAD

SEQ ID NO: 792095 - protein, 29 aa, Mycobacterium
AKAYAAGWGVPFYGVNHLGGHLAADVYDH

SEQ ID NO: 792096 - protein, 29 aa, Mycobacterium
AKAYSAAWGVPFYAVNHLGGHLAADVYEH

SEQ ID NO: 792097 - protein, 20 aa, Mycobacterium
AKCGPWHRGGWDPIPERQRY

SEQ ID NO: 792098 - protein, 22 aa, Mycobacterium
AKCLLQTLAFGLGAGLPEAEWL

SEQ ID NO: 792099 - protein, 22 aa, Mycobacterium
AKCQQVWCPVCALAAVVGGEQH

SEQ ID NO: 792100 - protein, 23 aa, Mycobacterium
AKDAVFLSNLPLGEQLARAAFDH

SEQ ID NO: 792101 - protein, 22 aa, Mycobacterium
AKDAVYLSNLPLGEELARAAVD

SEQ ID NO: 792102 - protein, 30 aa, Mycobacterium
AKDELRFTAPPRLDLSLLTAALPEDYRASE

SEQ ID NO: 792103 - protein, 25 aa, Mycobacterium
AKDERSLRYLAPQFFAIHSVEAEAP

SEQ ID NO: 792104 - protein, 18 aa, Mycobacterium
AKDIGRLEMLERYGWIVV

SEQ ID NO: 792105 - protein, 24 aa, Mycobacterium
AKDKLLAWQTAPAGTEPPGWEWLW

SEQ ID NO: 792106 - protein, 28 aa, Mycobacterium
AKDQLRFSAPPRLDLSLLTAALPEDYKA

SEQ ID NO: 792107 - protein, 28 aa, Mycobacterium
AKDQLRFTAPPRLELSLLASALPEDYQA

SEQ ID NO: 792108 - protein, 26 aa, Mycobacterium
AKDRAARIFGSKPWMALGATRDNRVF

SEQ ID NO: 792109 - protein, 33 aa, Mycobacterium
AKDRYRVIIGTDAHVLYTLSRLAPRRTARMVAK

SEQ ID NO: 792110 - protein, 25 aa, Mycobacterium
AKDVFFYEPIILPEKSSREVQLTLH

SEQ ID NO: 792111 - protein, 17 aa, Mycobacterium
AKDWAAWRTVFTDDFVS

SEQ ID NO: 792112 - protein, 19 aa, Mycobacterium
AKDYRAWFATLPAELTDAV

SEQ ID NO: 792113 - protein, 30 aa, Mycobacterium
AKEALAFAVLGFLTFHGLPGTLPSGTGARR

SEQ ID NO: 792114 - protein, 22 aa, Mycobacterium
AKEIEMWFPAHTTALDGVRADL

SEQ ID NO: 792115 - protein, 24 aa, Mycobacterium
AKEINVQFVLAYTPDEFGDSLRAL

SEQ ID NO: 792116 - protein, 29 aa, Mycobacterium
AKELVVVRPIGFEPLQWVRALAAEDAVPL

SEQ ID NO: 792117 - protein, 30 aa, Mycobacterium
AKELVVVRPIGFEPLTWVRALAAEDPIPSN

SEQ ID NO: 792118 - protein, 34 aa, Mycobacterium
AKEPIGVCGLITPWNWPINQVAVKVYPALATGCT

SEQ ID NO: 792119 - protein, 35 aa, Mycobacterium
AKEPIGVCGLITPWNWPINQVAVKVYPALATGCTV

SEQ ID NO: 792120 - protein, 17 aa, Mycobacterium
AKEPLLQALQRELRRRS

SEQ ID NO: 792121 - protein, 23 aa, Mycobacterium
AKEPLVFRDLLPSSRDVTTALLL

SEQ ID NO: 792122 - protein, 22 aa, Mycobacterium
AKEQLGIVARLASAALVAPQDA

SEQ ID NO: 792123 - protein, 24 aa, Mycobacterium
AKESFRLLGRVDVVFSNAGIVVAG

SEQ ID NO: 792124 - protein, 18 aa, Mycobacterium
AKEYVACRHDLGGALVLS

SEQ ID NO: 792125 - protein, 18 aa, Mycobacterium
AKFALELLRPATVSAQLH

SEQ ID NO: 792126 - protein, 23 aa, Mycobacterium
AKFANWLSGVLDAADALAAVPWL

SEQ ID NO: 792127 - protein, 26 aa, Mycobacterium
AKFATAFPRRGLIGEYGITWILPRLA

SEQ ID NO: 792128 - protein, 25 aa, Mycobacterium
AKFGKLPFETLFEPAIHYAHNGFLV

SEQ ID NO: 792129 - protein, 22 aa, Mycobacterium
AKFKHMSQMTWRSMIRDGMAMR

SEQ ID NO: 792130 - protein, 24 aa, Mycobacterium
AKFNRKIIELNLIGALSVSQHANE

SEQ ID NO: 792131 - protein, 20 aa, Mycobacterium
AKGALIHRLIRTGRALFTAH

SEQ ID NO: 792132 - protein, 21 aa, Mycobacterium
AKGDRLERVAKFGRALGDFSG

SEQ ID NO: 792133 - protein, 22 aa, Mycobacterium
AKGIKLLRREPLGTYDSILALH

SEQ ID NO: 792134 - protein, 17 aa, Mycobacterium
AKGLEWDAVYLVGLADG

SEQ ID NO: 792135 - protein, 25 aa, Mycobacterium
AKGMSSHFVWLNRGKRSVALDLKDD

SEQ ID NO: 792136 - protein, 24 aa, Mycobacterium
AKGRRYTMLLKPGGEFHTHRGIIA

SEQ ID NO: 792137 - protein, 21 aa, Mycobacterium
AKGSYATLLLATKDLDGTFEQ

SEQ ID NO: 792138 - protein, 17 aa, Mycobacterium
AKGYRAWFGTLPAELTE

SEQ ID NO: 792139 - protein, 24 aa, Mycobacterium
AKHAVFDRLVYHKFRAALGGDCHA

SEQ ID NO: 792140 - protein, 27 aa, Mycobacterium
AKHAWQPTWLKWSVSIIGKGALTRAGI

SEQ ID NO: 792141 - protein, 23 aa, Mycobacterium
AKHGIVGLMRAYANHLAPHSIRV

SEQ ID NO: 792142 - protein, 22 aa, Mycobacterium
AKHLLREDDIPWVRVRASAPIA

SEQ ID NO: 792143 - protein, 21 aa, Mycobacterium
AKIANCALGFPVVNIARSSAK

SEQ ID NO: 792144 - protein, 24 aa, Mycobacterium
AKIDLALDQLALQPGMTLLDIGCG

SEQ ID NO: 792145 - protein, 19 aa, Mycobacterium
AKIDLALGKLGLQPGMTLL

SEQ ID NO: 792146 - protein, 18 aa, Mycobacterium
AKIRRLLIDFVGHNATPG

SEQ ID NO: 792147 - protein, 17 aa, Mycobacterium
AKIYCGLGLLKKETVRE

SEQ ID NO: 792148 - protein, 19 aa, Mycobacterium
AKKAPAKRAAKSAAAKAGG

SEQ ID NO: 792149 - protein, 20 aa, Mycobacterium
AKKELVHRLASGAGRRILFM

SEQ ID NO: 792150 - protein, 24 aa, Mycobacterium
AKKHSFILPRPEQIAVVIKSLDGA

SEQ ID NO: 792151 - protein, 17 aa, Mycobacterium
AKKKQLMTDIFALAMEL

SEQ ID NO: 792152 - protein, 17 aa, Mycobacterium
AKKLPDAARSLGKSMRI

SEQ ID NO: 792153 - protein, 43 aa, Mycobacterium
AKKLTIVYEPYPLVGVITPWNGPLSVPLLDVPAALLAGCAVLS

SEQ ID NO: 792154 - protein, 26 aa, Mycobacterium
AKKRPEFGKLTPLYPNERLRLETSPE

SEQ ID NO: 792155 - protein, 27 aa, Mycobacterium
AKKRPEFGKLTPLYPNQRLRLETTTER

SEQ ID NO: 792156 - protein, 27 aa, Mycobacterium
AKKVALWRVLVALSIRHVGPTAARALA

SEQ ID NO: 792157 - protein, 18 aa, Mycobacterium
AKLDSLVPLGPPVMDVAL

SEQ ID NO: 792158 - protein, 19 aa, Mycobacterium
AKLEAVFGNSPLIRQIYVY

SEQ ID NO: 792159 - protein, 24 aa, Mycobacterium
AKLEGDAAFFWAPGGNPKVVVCER

SEQ ID NO: 792160 - protein, 18 aa, Mycobacterium
AKLFGYTMARTYLTGANV

SEQ ID NO: 792161 - protein, 19 aa, Mycobacterium
AKLGLRPDVRRVPLFGLGC

SEQ ID NO: 792162 - protein, 18 aa, Mycobacterium
AKLGRPLKTIVLTACNDL

SEQ ID NO: 792163 - protein, 22 aa, Mycobacterium
AKLISPLRLRGMSAMLTRIKKR

SEQ ID NO: 792164 - protein, 26 aa, Mycobacterium
AKLLADEAVPFLAAYRYKPSGLDKRA

SEQ ID NO: 792165 - protein, 20 aa, Mycobacterium
AKLLALGHPFRHPTVGDALA

SEQ ID NO: 792166 - protein, 17 aa, Mycobacterium
AKLLDLQPYLDRKPKDL

SEQ ID NO: 792167 - protein, 25 aa, Mycobacterium
AKLLEYRRFVSAAGALALFGGWTGV

SEQ ID NO: 792168 - protein, 18 aa, Mycobacterium
AKLLGRITDLYFGGDLEA

SEQ ID NO: 792169 - protein, 20 aa, Mycobacterium
AKLPDCLRAVLTAALCAPVP

SEQ ID NO: 792170 - protein, 30 aa, Mycobacterium
AKLPRGRTRPLWWTLRRPHRPLTYHAAHRM

SEQ ID NO: 792171 - protein, 17 aa, Mycobacterium
AKLQRELLAAAIRLTRP

SEQ ID NO: 792172 - protein, 18 aa, Mycobacterium
AKLRNAPMLVLGGRPEEL

SEQ ID NO: 792173 - protein, 19 aa, Mycobacterium
AKLSGTWLRANFITSLDGG

SEQ ID NO: 792174 - protein, 27 aa, Mycobacterium
AKLSRKYGMPVLSVHAPCLLVSQRVWG

SEQ ID NO: 792175 - protein, 24 aa, Mycobacterium
AKLSRRGLRWALEAIVCQHLTIAR

SEQ ID NO: 792176 - protein, 18 aa, Mycobacterium
AKLTSPVAFLEKPSRWVR

SEQ ID NO: 792177 - protein, 18 aa, Mycobacterium
AKLVGVELPKRAEAAAET

SEQ ID NO: 792178 - protein, 20 aa, Mycobacterium
AKLVSSCDLPLTGKAVVQRV

SEQ ID NO: 792179 - protein, 20 aa, Mycobacterium
AKLVSSCTLPLTGKAVVSRV

SEQ ID NO: 792180 - protein, 17 aa, Mycobacterium
AKMFLHYGDLSDGARLV

SEQ ID NO: 792181 - protein, 22 aa, Mycobacterium
AKMGEMGLFGLPFPEEHGGMGG

SEQ ID NO: 792182 - protein, 18 aa, Mycobacterium
AKMGFVTVAIARGNEKAD

SEQ ID NO: 792183 - protein, 24 aa, Mycobacterium
AKMLKAAGLIRLLQPQKYGGYEAH

SEQ ID NO: 792184 - protein, 29 aa, Mycobacterium
AKMSSLTHGFVKIFCRPATGVVIGGVVVA

SEQ ID NO: 792185 - protein, 22 aa, Mycobacterium
AKMTRKRLRALKYSKQMVDDVS

SEQ ID NO: 792186 - protein, 22 aa, Mycobacterium
AKMVRKRLRALKYSKQMVEDIS

SEQ ID NO: 792187 - protein, 23 aa, Mycobacterium
AKNAGLRRFVFTSSYATVDRRHG

SEQ ID NO: 792188 - protein, 24 aa, Mycobacterium
AKNDFGLVAIDTLLARMENDRDRL

SEQ ID NO: 792189 - protein, 19 aa, Mycobacterium
AKNFGIDRLSPHSDWVVFL

SEQ ID NO: 792190 - protein, 20 aa, Mycobacterium
AKNILPMAFGNLDKSPGIHV

SEQ ID NO: 792191 - protein, 25 aa, Mycobacterium
AKNLGFKRTLLMTTGLRGSGIIEEL

SEQ ID NO: 792192 - protein, 25 aa, Mycobacterium
AKNLRLRHPLAALGFVYGLRSTILS

SEQ ID NO: 792193 - protein, 19 aa, Mycobacterium
AKNPDAWFYQRPITLEDHQ

SEQ ID NO: 792194 - protein, 24 aa, Mycobacterium
AKNPRLWRDLLTCTARAGADGVSI

SEQ ID NO: 792195 - protein, 18 aa, Mycobacterium
AKNRPVWIKGFGEQVPFK

SEQ ID NO: 792196 - protein, 17 aa, Mycobacterium
AKPAGIFTLTDANWMTL

SEQ ID NO: 792197 - protein, 26 aa, Mycobacterium
AKPAQVALAWLISYPGVVAIPGASSV

SEQ ID NO: 792198 - protein, 23 aa, Mycobacterium
AKPDLLQLITTDSAPIINRASAR

SEQ ID NO: 792199 - protein, 21 aa, Mycobacterium
AKPEQLSFAELRAAWRADERG

SEQ ID NO: 792200 - protein, 17 aa, Mycobacterium
AKPFAILTGLAGSGKTQ

SEQ ID NO: 792201 - protein, 22 aa, Mycobacterium
AKPFARPQYVAKFTGLAGGVID

SEQ ID NO: 792202 - protein, 26 aa, Mycobacterium
AKPGHITFGSDWPFAPTAAGKLFAAG

SEQ ID NO: 792203 - protein, 21 aa, Mycobacterium
AKPGYSIVLPPPNVTGSLHMG

SEQ ID NO: 792204 - protein, 22 aa, Mycobacterium
AKPINPMRLFADLSPKLPDNAI

SEQ ID NO: 792205 - protein, 22 aa, Mycobacterium
AKPKIYRHFTDKADLFQAIGQR

SEQ ID NO: 792206 - protein, 22 aa, Mycobacterium
AKPLHRCPLPIEGPYSAAPAQI

SEQ ID NO: 792207 - protein, 19 aa, Mycobacterium
AKPNLLQRGPWRSLHRRIA

SEQ ID NO: 792208 - protein, 29 aa, Mycobacterium
AKPPAGVQPFIIPSFTALTTVRDALGDDS

SEQ ID NO: 792209 - protein, 18 aa, Mycobacterium
AKPRAGLIGCAWGDLAEV

SEQ ID NO: 792210 - protein, 33 aa, Mycobacterium
AKPTLMLLDGNSLAFRAFYALPAENFKTRGGLT

SEQ ID NO: 792211 - protein, 29 aa, Mycobacterium
AKQAEKLSFFPLWSYATPPAIELAERVAS

SEQ ID NO: 792212 - protein, 29 aa, Mycobacterium
AKQAEQLAFFPLWSYATPTAVELAERLAG

SEQ ID NO: 792213 - protein, 29 aa, Mycobacterium
AKQAETLAFFPLWSYATPTAIELAERVAH

SEQ ID NO: 792214 - protein, 30 aa, Mycobacterium
AKQAGLAYGLIYWYFDSKDVLFHSLMAAEE

SEQ ID NO: 792215 - protein, 25 aa, Mycobacterium
AKQALTEAVLWPLQHPDTFARLGVE

SEQ ID NO: 792216 - protein, 21 aa, Mycobacterium
AKQAPFEPLPGDVTHVPYGDV

SEQ ID NO: 792217 - protein, 24 aa, Mycobacterium
AKQAPYRRGFGPFAPEVYRAPMAH

SEQ ID NO: 792218 - protein, 33 aa, Mycobacterium
AKQEMLVEDLVALAVLRLGRPVRYEFSRSDEFT

SEQ ID NO: 792219 - protein, 21 aa, Mycobacterium
AKQIIMLQQTISAEDAWTLGL

SEQ ID NO: 792220 - protein, 18 aa, Mycobacterium
AKQLAQHWAAKSTVTELE

SEQ ID NO: 792221 - protein, 22 aa, Mycobacterium
AKQLGVLATVGFSLVACQTQTP

SEQ ID NO: 792222 - protein, 37 aa, Mycobacterium
AKQWGIDSFLFFPNFMLLIWEPGWYLTYHYWPTTVDK

SEQ ID NO: 792223 - protein, 17 aa, Mycobacterium
AKRAYTRYQPLGVVLAV

SEQ ID NO: 792224 - protein, 24 aa, Mycobacterium
AKRESLGFRAALRDLIDDAPEDLV

SEQ ID NO: 792225 - protein, 25 aa, Mycobacterium
AKRGAVEVWPLVDCSREFGGKGSTS

SEQ ID NO: 792226 - protein, 18 aa, Mycobacterium
AKRGFDPVLGARPLRRTI

SEQ ID NO: 792227 - protein, 27 aa, Mycobacterium
AKRGKAIIILNPADPPMIMRDTIFCAI

SEQ ID NO: 792228 - protein, 25 aa, Mycobacterium
AKRGLRCFAPTWPLGAHPRALGPDA

SEQ ID NO: 792229 - protein, 29 aa, Mycobacterium
AKRIFDITIAYLKTRFQFGRAIGSFQALK

SEQ ID NO: 792230 - protein, 17 aa, Mycobacterium
AKRIPLQHLVGTAAFGP

SEQ ID NO: 792231 - protein, 26 aa, Mycobacterium
AKRKPALHVLLWQRALEPEKEKWALP

SEQ ID NO: 792232 - protein, 17 aa, Mycobacterium
AKRLALQKMSFEVAWRI

SEQ ID NO: 792233 - protein, 25 aa, Mycobacterium
AKRLGLQRQWLHARSLAFAHPADGR

SEQ ID NO: 792234 - protein, 29 aa, Mycobacterium
AKRLHLSRPTLYTKLAIVQRLLGVDLDDA

SEQ ID NO: 792235 - protein, 31 aa, Mycobacterium
AKRLIDYGFHAPTLAFPVSGTLMVEPTESED

SEQ ID NO: 792236 - protein, 17 aa, Mycobacterium
AKRLIGYFQGCVSQWSA

SEQ ID NO: 792237 - protein, 19 aa, Mycobacterium
AKRLLDWPGGLVVYDVRAE

SEQ ID NO: 792238 - protein, 18 aa, Mycobacterium
AKRLPLAIVSSDLQRAYD

SEQ ID NO: 792239 - protein, 19 aa, Mycobacterium
AKRLPPRPPVIDPYLPQNG

SEQ ID NO: 792240 - protein, 23 aa, Mycobacterium
AKRLRMVLMGMFSMACRFDVMPV

SEQ ID NO: 792241 - protein, 22 aa, Mycobacterium
AKRQRRRDGRDAGRRRPPVLSE

SEQ ID NO: 792242 - protein, 21 aa, Mycobacterium
AKRQRRRDGRDAGRRRPPVLT

SEQ ID NO: 792243 - protein, 18 aa, Mycobacterium
AKRRAVLNTHIKLAETIA

SEQ ID NO: 792244 - protein, 22 aa, Mycobacterium
AKRRGFVFPSGEIYGGTRSAWD

SEQ ID NO: 792245 - protein, 26 aa, Mycobacterium
AKRRIIRAARRPHPGRRRPGALLPHH

SEQ ID NO: 792246 - protein, 19 aa, Mycobacterium
AKRTPRLARTRAWHTDVRG

SEQ ID NO: 792247 - protein, 18 aa, Mycobacterium
AKRTPRLARTRAWHTTEV

SEQ ID NO: 792248 - protein, 18 aa, Mycobacterium
AKRTPRLARTRSWHTDVR

SEQ ID NO: 792249 - protein, 21 aa, Mycobacterium
AKRVRKWTRRKYQLLELPQLP

SEQ ID NO: 792250 - protein, 27 aa, Mycobacterium
AKRWGVLHVIWRQKLYPGIGAPSWTAD

SEQ ID NO: 792251 - protein, 29 aa, Mycobacterium
AKRYTGRGMAFLDLIQEGNLGLIRAVEKF

SEQ ID NO: 792252 - protein, 23 aa, Mycobacterium
AKSLRKYQDLGITHFVLSDTPYL

SEQ ID NO: 792253 - protein, 26 aa, Mycobacterium
AKSLTQRTILRLLDPSISAAGVMRAG

SEQ ID NO: 792254 - protein, 18 aa, Mycobacterium
AKSMLMSVSKNLSLLLAK

SEQ ID NO: 792255 - protein, 28 aa, Mycobacterium
AKSMPLSVYVFGPGTRLLNKLLGSSVRF

SEQ ID NO: 792256 - protein, 25 aa, Mycobacterium
AKSPVSFFAYPGMASDLVPAGCTVH

SEQ ID NO: 792257 - protein, 27 aa, Mycobacterium
AKSPVSFFAYPGMPSDLVPAGCAVHLL

SEQ ID NO: 792258 - protein, 22 aa, Mycobacterium
AKSREQIPATLWPILKNQAEEA

SEQ ID NO: 792259 - protein, 30 aa, Mycobacterium
AKSRRKLPEPPGWFGQIKPAALLRADAGPT

SEQ ID NO: 792260 - protein, 23 aa, Mycobacterium
AKSVAPLLTALRHTLDSFVEIGL

SEQ ID NO: 792261 - protein, 22 aa, Mycobacterium
AKSVLVMMTLFAKDGTAKLVPS

SEQ ID NO: 792262 - protein, 18 aa, Mycobacterium
AKSVRIRNLAGFTGLYSE

SEQ ID NO: 792263 - protein, 28 aa, Mycobacterium
AKTAHHNWLLLQAIPDLQELGYPILIGA

SEQ ID NO: 792264 - protein, 29 aa, Mycobacterium
AKTDRAFDLAARKRLPVVLFAEGGGGRPG

SEQ ID NO: 792265 - protein, 18 aa, Mycobacterium
AKTDRVFGLAARKRIPVV

SEQ ID NO: 792266 - protein, 24 aa, Mycobacterium
AKTDVLAFTAFPKAHWQKIWSNNP

SEQ ID NO: 792267 - protein, 26 aa, Mycobacterium
AKTELRNLFRELLTRLKTIEFGEPEL

SEQ ID NO: 792268 - protein, 17 aa, Mycobacterium
AKTFLRQLEQCLGLAQD

SEQ ID NO: 792269 - protein, 21 aa, Mycobacterium
AKTFPVIDGVRYAVPGDRARH

SEQ ID NO: 792270 - protein, 24 aa, Mycobacterium
AKTIRGLGADRFSLVYQAAQPGLG

SEQ ID NO: 792271 - protein, 25 aa, Mycobacterium
AKTKDAIFFPKGSRILFSTPDRALA

SEQ ID NO: 792272 - protein, 20 aa, Mycobacterium
AKTPYFLELEDPAKIALMSR

SEQ ID NO: 792273 - protein, 25 aa, Mycobacterium
AKTPYPSGGPIPRKYYRTLDPFVAL

SEQ ID NO: 792274 - protein, 23 aa, Mycobacterium
AKTQLGWRPLYSSAQALAALASA

SEQ ID NO: 792275 - protein, 29 aa, Mycobacterium
AKTQRPELLPLLAQTYQAAAAMLVKVGDR

SEQ ID NO: 792276 - protein, 21 aa, Mycobacterium
AKTQTVLPFDGLKNPDGVAVD

SEQ ID NO: 792277 - protein, 26 aa, Mycobacterium
AKTSWDLRKFLWAPKLGCYGIQRIHP

SEQ ID NO: 792278 - protein, 29 aa, Mycobacterium
AKTSWDLRKFLWAPRLGCYGIQRIHPLRN

SEQ ID NO: 792279 - protein, 26 aa, Mycobacterium
AKTVCEAGFRNMTYVRDLAPVLVGEP

SEQ ID NO: 792280 - protein, 28 aa, Mycobacterium
AKTVCESGFRNMTYVRDLAPMLVGEPPA

SEQ ID NO: 792281 - protein, 28 aa, Mycobacterium
AKTVCETGFRNMTYVRDLAPMLVGEPPA

SEQ ID NO: 792282 - protein, 40 aa, Mycobacterium
AKVAGSRFYFLTGQGALLQLGLLQLALRLAVDNGFIPMIP

SEQ ID NO: 792283 - protein, 21 aa, Mycobacterium
AKVAILHQPTLAVTAEEIRKT

SEQ ID NO: 792284 - protein, 19 aa, Mycobacterium
AKVATLRPLMRPSGRPESG

SEQ ID NO: 792285 - protein, 21 aa, Mycobacterium
AKVGLINWLIQDPGNPAVAAE

SEQ ID NO: 792286 - protein, 23 aa, Mycobacterium
AKVGLPLLNERVKALAAAQSRDI

SEQ ID NO: 792287 - protein, 26 aa, Mycobacterium
AKVGRIARILGPRGLMPNPKTGTVTP

SEQ ID NO: 792288 - protein, 26 aa, Mycobacterium
AKVGRIARVLGPRGLMPNPKTGTVTP

SEQ ID NO: 792289 - protein, 27 aa, Mycobacterium
AKVGRPAIYRLWRSKAHLIHEAAFPDP

SEQ ID NO: 792290 - protein, 19 aa, Mycobacterium
AKVGVFRPITRRGERRDYI

SEQ ID NO: 792291 - protein, 20 aa, Mycobacterium
AKVINFYRGPLRYAVDMGEW

SEQ ID NO: 792292 - protein, 27 aa, Mycobacterium
AKVKWSAPLGFLAQTPPAITPQGLIVS

SEQ ID NO: 792293 - protein, 17 aa, Mycobacterium
AKVLPGHIDVVRDLLFD

SEQ ID NO: 792294 - protein, 25 aa, Mycobacterium
AKVLRLADIALLVAPNRVLDIDVAQ

SEQ ID NO: 792295 - protein, 21 aa, Mycobacterium
AKVPAFTTWQPPPQPVRVPHS

SEQ ID NO: 792296 - protein, 25 aa, Mycobacterium
AKVRPGVPVIFLDTGYHFAETIGTR

SEQ ID NO: 792297 - protein, 24 aa, Mycobacterium
AKVRRPDGFALPHPPRDDRQFPTH

SEQ ID NO: 792298 - protein, 37 aa, Mycobacterium
AKVSGSRFYFLTGQGALLQLGLLQLAAQLAVSNGFTL

SEQ ID NO: 792299 - protein, 23 aa, Mycobacterium
AKVWSEELFGPVLAVRRAADADE

SEQ ID NO: 792300 - protein, 21 aa, Mycobacterium
AKWASSISGYWRRGRTEETFR

SEQ ID NO: 792301 - protein, 22 aa, Mycobacterium
AKWASSISGYWRRGRTEETFRQ

SEQ ID NO: 792302 - protein, 23 aa, Mycobacterium
AKWASSISGYWRRGRTEETFRQW

SEQ ID NO: 792303 - protein, 23 aa, Mycobacterium
AKWGQLSEVVLLLPHGHEGQGPD

SEQ ID NO: 792304 - protein, 20 aa, Mycobacterium
AKWRDHGFELDWEELGFEGD

SEQ ID NO: 792305 - protein, 26 aa, Mycobacterium
AKWRRYDKMRRWPAGIMPFGDAVASL

SEQ ID NO: 792306 - protein, 21 aa, Mycobacterium
AKWSVPLLRMGGRMLAIKGER

SEQ ID NO: 792307 - protein, 26 aa, Mycobacterium
AKYAGKWELPVIGAVRPPRAVLIRPD

SEQ ID NO: 792308 - protein, 20 aa, Mycobacterium
AKYFGLDGAWGTWVGRWTAE

SEQ ID NO: 792309 - protein, 19 aa, Mycobacterium
AKYGPQEWPRGMRVIARRE

SEQ ID NO: 792310 - protein, 24 aa, Mycobacterium
AKYPGTRWRFEYSPESYTGTELEY

SEQ ID NO: 792311 - protein, 18 aa, Mycobacterium
AKYVGFAPENISVGCGSV

SEQ ID NO: 792312 - protein, 25 aa, Mycobacterium
ALAAAAPMVIWLRGAAQVAHTRAAQ

SEQ ID NO: 792313 - protein, 20 aa, Mycobacterium
ALAAAWIQFEVHDWFSHGTT

SEQ ID NO: 792314 - protein, 19 aa, Mycobacterium
ALAAEGLCGLIFPTHLGGT

SEQ ID NO: 792315 - protein, 24 aa, Mycobacterium
ALAAEPRVLLLDEPMSALDVTAAP

SEQ ID NO: 792316 - protein, 24 aa, Mycobacterium
ALAAETPLFLLDEPFAALDALTRE

SEQ ID NO: 792317 - protein, 18 aa, Mycobacterium
ALAAFEHLVAARAKRIPL

SEQ ID NO: 792318 - protein, 19 aa, Mycobacterium
ALAAHRHARGLPGLSVAWG

SEQ ID NO: 792319 - protein, 34 aa, Mycobacterium
ALAALCDIFYPRVFLRHGGFLPSGTISLTAYFHA

SEQ ID NO: 792320 - protein, 29 aa, Mycobacterium
ALAALPGPVRRRVIRGWLLAGGATGLTDK

SEQ ID NO: 792321 - protein, 19 aa, Mycobacterium
ALAALPWQQACITFAQHMF

SEQ ID NO: 792322 - protein, 20 aa, Mycobacterium
ALAALYRRGVTGRGQVVDVA

SEQ ID NO: 792323 - protein, 19 aa, Mycobacterium
ALAAWWAEVLGWPAEDTDD

SEQ ID NO: 792324 - protein, 18 aa, Mycobacterium
ALACLIPGDTLPPGARVV

SEQ ID NO: 792325 - protein, 18 aa, Mycobacterium
ALACQAWQGPAAAAMAAA

SEQ ID NO: 792326 - protein, 31 aa, Mycobacterium
ALADAFYGHLPAYAVPLFVRVVPELAHTSTF

SEQ ID NO: 792327 - protein, 24 aa, Mycobacterium
ALADGALQEALPRHLILDADGHAY

SEQ ID NO: 792328 - protein, 20 aa, Mycobacterium
ALADGAWPQQRLLANAPIDV

SEQ ID NO: 792329 - protein, 24 aa, Mycobacterium
ALADLDRRLARWKRRHPRLRVESV

SEQ ID NO: 792330 - protein, 21 aa, Mycobacterium
ALADLFLSALFGNHPVGRPVI

SEQ ID NO: 792331 - protein, 23 aa, Mycobacterium
ALADLVAFFKDPVKGFFRALDYT

SEQ ID NO: 792332 - protein, 25 aa, Mycobacterium
ALADPDRALWRLDLFTAEDTAWLTR

SEQ ID NO: 792333 - protein, 30 aa, Mycobacterium
ALADVDGVLALPGARRLLGALPHSHWAAVT

SEQ ID NO: 792334 - protein, 22 aa, Mycobacterium
ALADYAALLKRHGVERVRMVAT

SEQ ID NO: 792335 - protein, 20 aa, Mycobacterium
ALADYLLIENAQRGKSLEVI

SEQ ID NO: 792336 - protein, 26 aa, Mycobacterium
ALAEEILVALWDLVGYRVPTPIDRIT

SEQ ID NO: 792337 - protein, 28 aa, Mycobacterium
ALAEEISQLLYWTQVLMISRGVSLDEVY

SEQ ID NO: 792338 - protein, 27 aa, Mycobacterium
ALAEFKAMFQMKFYAVALLRSRGVPPT

SEQ ID NO: 792339 - protein, 27 aa, Mycobacterium
ALAEFKAMFQMKFYAVALLRTRGVPPT

SEQ ID NO: 792340 - protein, 25 aa, Mycobacterium
ALAEKLAGYVLPMVDVHSPALAGQP

SEQ ID NO: 792341 - protein, 24 aa, Mycobacterium
ALAEKLAGYVLPVIDVHSPALAGQ

SEQ ID NO: 792342 - protein, 18 aa, Mycobacterium
ALAELDALVRPQGQARVV

SEQ ID NO: 792343 - protein, 19 aa, Mycobacterium
ALAELLVEFVRSACRWTPR

SEQ ID NO: 792344 - protein, 35 aa, Mycobacterium
ALAELRATHPLAPTLPLIRRLLVEDAVDSGVVVAI

SEQ ID NO: 792345 - protein, 26 aa, Mycobacterium
ALAERLPAYMVPAAVVVLDALPLTVN

SEQ ID NO: 792346 - protein, 27 aa, Mycobacterium
ALAERQRLYGVSYWTVIDAWAGRESAM

SEQ ID NO: 792347 - protein, 24 aa, Mycobacterium
ALAERRLVRLFHLAGTAARPSYFE

SEQ ID NO: 792348 - protein, 19 aa, Mycobacterium
ALAFGALERIVGTQDLFLL

SEQ ID NO: 792349 - protein, 18 aa, Mycobacterium
ALAFQRRADGLTATSLAW

SEQ ID NO: 792350 - protein, 18 aa, Mycobacterium
ALAFVRRLRRADTVATGG

SEQ ID NO: 792351 - protein, 20 aa, Mycobacterium
ALAFYGRRLYDLMSDYWPTA

SEQ ID NO: 792352 - protein, 17 aa, Mycobacterium
ALAGACAGFFRHPPRVP

SEQ ID NO: 792353 - protein, 20 aa, Mycobacterium
ALAGFAKYLHRCERRPVSRR

SEQ ID NO: 792354 - protein, 30 aa, Mycobacterium
ALAGFVEILPTPFVPAGVFDLWGLPADDQR

SEQ ID NO: 792355 - protein, 20 aa, Mycobacterium
ALAGLDLRWAAVTLDGTRST

SEQ ID NO: 792356 - protein, 20 aa, Mycobacterium
ALAGLPGPRLVIEPGRAIAG

SEQ ID NO: 792357 - protein, 19 aa, Mycobacterium
ALAGQLYAAGIRPGFDSPP

SEQ ID NO: 792358 - protein, 18 aa, Mycobacterium
ALAGRTLGKVLRIDETGG

SEQ ID NO: 792359 - protein, 29 aa, Mycobacterium
ALAGVHPVDLGALGWRGLLDRVDVDPAAV

SEQ ID NO: 792360 - protein, 18 aa, Mycobacterium
ALAGWMDYLRGVSEPLMV

SEQ ID NO: 792361 - protein, 18 aa, Mycobacterium
ALAHDLPAYDSAAIHLSR

SEQ ID NO: 792362 - protein, 22 aa, Mycobacterium
ALAHGLRRLGVSAGSVVGVLCR

SEQ ID NO: 792363 - protein, 21 aa, Mycobacterium
ALAHGRYLGLGLSAYIEPTGA

SEQ ID NO: 792364 - protein, 21 aa, Mycobacterium
ALAHITLAAVGLGVGICTVGS

SEQ ID NO: 792365 - protein, 25 aa, Mycobacterium
ALAHPDRCVAVLAALPAWTGEPGPA

SEQ ID NO: 792366 - protein, 24 aa, Mycobacterium
ALAHQLAWRRLGVESLDRYRHPEF

SEQ ID NO: 792367 - protein, 25 aa, Mycobacterium
ALAHQPAAIMLSFGDLRPFADRIHA

SEQ ID NO: 792368 - protein, 17 aa, Mycobacterium
ALAHYDLTDAIPAALDV

SEQ ID NO: 792369 - protein, 24 aa, Mycobacterium
ALAIALADRWPAARILGVDDSGAA

SEQ ID NO: 792370 - protein, 28 aa, Mycobacterium
ALAIHHELHLWLPHPSDRLWRALAGTRG

SEQ ID NO: 792371 - protein, 20 aa, Mycobacterium
ALAILTARHLDCWVLGTVGK

SEQ ID NO: 792372 - protein, 20 aa, Mycobacterium
ALAILTARHLNCWTLGTVKK

SEQ ID NO: 792373 - protein, 21 aa, Mycobacterium
ALAIVDAFLSTPWSKAERHQR

SEQ ID NO: 792374 - protein, 17 aa, Mycobacterium
ALAKLKPVLLKQDPEAT

SEQ ID NO: 792375 - protein, 37 aa, Mycobacterium
ALAKLSVPRFASAWLWRLRWPLPLLGMGADIPDGQLC

SEQ ID NO: 792376 - protein, 17 aa, Mycobacterium
ALAKMILRTAARLPIMP

SEQ ID NO: 792377 - protein, 25 aa, Mycobacterium
ALAKQYLSYFQGSLGEWEAPDPRLA

SEQ ID NO: 792378 - protein, 29 aa, Mycobacterium
ALAKRGLHRAALPEKPWFGPTSWAGRQQD

SEQ ID NO: 792379 - protein, 25 aa, Mycobacterium
ALAKRHPLLIVSSDLRRALDTAVVL

SEQ ID NO: 792380 - protein, 20 aa, Mycobacterium
ALAKRLHMSRPALYSRLAAI

SEQ ID NO: 792381 - protein, 32 aa, Mycobacterium
ALALATVIGPRPAMLRLMHPIVARLAAVSGEA

SEQ ID NO: 792382 - protein, 20 aa, Mycobacterium
ALALGAQGAWTGSQWLMVEE

SEQ ID NO: 792383 - protein, 18 aa, Mycobacterium
ALALGPANRYVHSAYQVC

SEQ ID NO: 792384 - protein, 18 aa, Mycobacterium
ALALGQIGSLLYMFGSMT

SEQ ID NO: 792385 - protein, 17 aa, Mycobacterium
ALALLPGMPLLAVPLPG

SEQ ID NO: 792386 - protein, 18 aa, Mycobacterium
ALALLRRAGFPPDHPNVQ

SEQ ID NO: 792387 - protein, 25 aa, Mycobacterium
ALALMGRVFALRPHFEWRGLGFISQ

SEQ ID NO: 792388 - protein, 25 aa, Mycobacterium
ALALNNRPRKSLDWKTPAEVFEEQL

SEQ ID NO: 792389 - protein, 21 aa, Mycobacterium
ALALPYPGELPEGAPPPKAFG

SEQ ID NO: 792390 - protein, 21 aa, Mycobacterium
ALALQYFHSAPWVAWTDAGRN

SEQ ID NO: 792391 - protein, 21 aa, Mycobacterium
ALALYHSKRLAAPGQRIVLYG

SEQ ID NO: 792392 - protein, 22 aa, Mycobacterium
ALALYHTKRLASPGQRIVLYTK

SEQ ID NO: 792393 - protein, 18 aa, Mycobacterium
ALALYRSVGFEQIGLRRR

SEQ ID NO: 792394 - protein, 26 aa, Mycobacterium
ALAMDPQHRMLLELSWEALERSGIDP

SEQ ID NO: 792395 - protein, 17 aa, Mycobacterium
ALAMLLVEYGRSATCWA

SEQ ID NO: 792396 - protein, 18 aa, Mycobacterium
ALAMRLAAARPDRVAALL

SEQ ID NO: 792397 - protein, 26 aa, Mycobacterium
ALANARLAYAVFRDVFHDGTRYAALR

SEQ ID NO: 792398 - protein, 18 aa, Mycobacterium
ALANPKLLSRRPWRGLRK

SEQ ID NO: 792399 - protein, 17 aa, Mycobacterium
ALAPHAWRRKPMSVDAI

SEQ ID NO: 792400 - protein, 33 aa, Mycobacterium
ALAPKGIWFAPKDLRLFYQIRQNWRGKAVLLKL

SEQ ID NO: 792401 - protein, 24 aa, Mycobacterium
ALAPKGIWFAPKDLRLFYQVRQSW

SEQ ID NO: 792402 - protein, 24 aa, Mycobacterium
ALAPREVIALLETPRGAVFATEIA

SEQ ID NO: 792403 - protein, 20 aa, Mycobacterium
ALAPSKPIPTPGLSYYAREF

SEQ ID NO: 792404 - protein, 24 aa, Mycobacterium
ALAPTHTLLLAGRPSDRLDAVAER

SEQ ID NO: 792405 - protein, 18 aa, Mycobacterium
ALAPVKPGLSLPLTVRSR

SEQ ID NO: 792406 - protein, 25 aa, Mycobacterium
ALAPVRFFNPIAMRFAKKATRDDIA

SEQ ID NO: 792407 - protein, 24 aa, Mycobacterium
ALAPVRFFNPIGMRFAKKATREDI

SEQ ID NO: 792408 - protein, 17 aa, Mycobacterium
ALAPWLGRTRGLRVDPD

SEQ ID NO: 792409 - protein, 29 aa, Mycobacterium
ALAPYVLYETLGPTLPRGLEGAAALWGLA

SEQ ID NO: 792410 - protein, 24 aa, Mycobacterium
ALAQGRYIGLGFSAYIEPTGAATG

SEQ ID NO: 792411 - protein, 25 aa, Mycobacterium
ALAQGRYLGLGFSAYIEPTGAATGH

SEQ ID NO: 792412 - protein, 27 aa, Mycobacterium
ALAQIAEFAFPVAPWMFGAAGREHMQQ

SEQ ID NO: 792413 - protein, 18 aa, Mycobacterium
ALAQRLVQEEFGCQIALV

SEQ ID NO: 792414 - protein, 25 aa, Mycobacterium
ALARADVVLLVGARLNWLLGHGDSP

SEQ ID NO: 792415 - protein, 27 aa, Mycobacterium
ALAREAPPWVGPLDVLIVAGDDPGDPA

SEQ ID NO: 792416 - protein, 29 aa, Mycobacterium
ALARFDKPAWVLPEVPLLVSPSVEELMKA

SEQ ID NO: 792417 - protein, 29 aa, Mycobacterium
ALARFEEALTLWRGLPELPDGRRGTSEKT

SEQ ID NO: 792418 - protein, 17 aa, Mycobacterium
ALARFPCEPFRPDLVFA

SEQ ID NO: 792419 - protein, 31 aa, Mycobacterium
ALARGKRAVWVPWVIRPMAFTTRFVPQVLWR

SEQ ID NO: 792420 - protein, 17 aa, Mycobacterium
ALARGPIVVAFDGSPGA

SEQ ID NO: 792421 - protein, 22 aa, Mycobacterium
ALARHFRRISYGWVPRSRNAYA

SEQ ID NO: 792422 - protein, 20 aa, Mycobacterium
ALARLPAPPLPTARLRPRPI

SEQ ID NO: 792423 - protein, 23 aa, Mycobacterium
ALARLPERVLGRPAFQVLAGLCG

SEQ ID NO: 792424 - protein, 27 aa, Mycobacterium
ALARPDLRIILLEPLLRRSEFLCAVVA

SEQ ID NO: 792425 - protein, 20 aa, Mycobacterium
ALARQYLLDRNFDAAAATKF

SEQ ID NO: 792426 - protein, 21 aa, Mycobacterium
ALARRDVCTQLWLESGEAWVD

SEQ ID NO: 792427 - protein, 22 aa, Mycobacterium
ALARRHPMLRVEFLPDGTQRIA

SEQ ID NO: 792428 - protein, 20 aa, Mycobacterium
ALARSHAHLPGIQFVDALID

SEQ ID NO: 792429 - protein, 26 aa, Mycobacterium
ALASILSWHRWEELFELARFVGVSRP

SEQ ID NO: 792430 - protein, 34 aa, Mycobacterium
ALASIPRLQFAHSDLLVRSFGTLQGLLAASAGDL

SEQ ID NO: 792431 - protein, 30 aa, Mycobacterium
ALASLADSAGRYLRRWHRRRALWVGVAIGG

SEQ ID NO: 792432 - protein, 24 aa, Mycobacterium
ALASTAHDYLTFARALLGGGQADG

SEQ ID NO: 792433 - protein, 18 aa, Mycobacterium
ALASWDMRIPTGPLNSWL

SEQ ID NO: 792434 - protein, 18 aa, Mycobacterium
ALATAEPGHHHDKIDPRW

SEQ ID NO: 792435 - protein, 21 aa, Mycobacterium
ALATAGIVFIGPPASAIATMG

SEQ ID NO: 792436 - protein, 18 aa, Mycobacterium
ALATAYFETVGMGTALRP

SEQ ID NO: 792437 - protein, 27 aa, Mycobacterium
ALATHHDLYLWLPHPSDALWQTLASDH

SEQ ID NO: 792438 - protein, 20 aa, Mycobacterium
ALATLVVNSIRKTLKAIAVK

SEQ ID NO: 792439 - protein, 19 aa, Mycobacterium
ALATPLRRLLAGADEEAVV

SEQ ID NO: 792440 - protein, 18 aa, Mycobacterium
ALATQLFWEATPSGAPGI

SEQ ID NO: 792441 - protein, 25 aa, Mycobacterium
ALATRHLRRHPNAQPVILVVTDGEP

SEQ ID NO: 792442 - protein, 17 aa, Mycobacterium
ALATRWFDEFEGAGLDG

SEQ ID NO: 792443 - protein, 17 aa, Mycobacterium
ALAVARPNPLLLSGLHV

SEQ ID NO: 792444 - protein, 28 aa, Mycobacterium
ALAVELGAPLDGAWWPHTASIARELPEL

SEQ ID NO: 792445 - protein, 17 aa, Mycobacterium
ALAVHRRGRKVVVLSKV

SEQ ID NO: 792446 - protein, 22 aa, Mycobacterium
ALAVLTADCVPVLFADAAAGVV

SEQ ID NO: 792447 - protein, 17 aa, Mycobacterium
ALAVPYMANLRSWSLDT

SEQ ID NO: 792448 - protein, 17 aa, Mycobacterium
ALAVSVMRKHRLAECLL

SEQ ID NO: 792449 - protein, 17 aa, Mycobacterium
ALAVTIGGLRKSGYRPV

SEQ ID NO: 792450 - protein, 18 aa, Mycobacterium
ALAWMSRQNPEGSRSFAV

SEQ ID NO: 792451 - protein, 22 aa, Mycobacterium
ALAWPGLEHQWLDGWFVRASDG

SEQ ID NO: 792452 - protein, 23 aa, Mycobacterium
ALAWPLFDAIVDQSAFKSVNPWA

SEQ ID NO: 792453 - protein, 28 aa, Mycobacterium
ALAYLARRGILVAPGRFYGPRGREHVRV

SEQ ID NO: 792454 - protein, 17 aa, Mycobacterium
ALAYREFGSDQLANMIL

SEQ ID NO: 792455 - protein, 17 aa, Mycobacterium
ALCAGVLRRFLLERGEL

SEQ ID NO: 792456 - protein, 32 aa, Mycobacterium
ALCARIPSAPIRLLWRLVYATPVRNFDVLNRF

SEQ ID NO: 792457 - protein, 25 aa, Mycobacterium
ALCATFDGFYTLLVSNRDSFAVVRD

SEQ ID NO: 792458 - protein, 20 aa, Mycobacterium
ALCDLMHRRGLAGATVLLGV

SEQ ID NO: 792459 - protein, 19 aa, Mycobacterium
ALCPQAIVVPPRMAAYTQA

SEQ ID NO: 792460 - protein, 17 aa, Mycobacterium
ALCQATRQVIANGLAIL

SEQ ID NO: 792461 - protein, 18 aa, Mycobacterium
ALCRHYVYRLSTAPYGVV

SEQ ID NO: 792462 - protein, 26 aa, Mycobacterium
ALCRSAGYWALPYPVAERLARPTDLD

SEQ ID NO: 792463 - protein, 19 aa, Mycobacterium
ALCSCYPRPILGNSPEWYR

SEQ ID NO: 792464 - protein, 32 aa, Mycobacterium
ALDACLDRYARLFAWLGLWERHTDLAVIPADG

SEQ ID NO: 792465 - protein, 28 aa, Mycobacterium
ALDADCVFYAPLWFDPDEVCRLLRGGKN

SEQ ID NO: 792466 - protein, 28 aa, Mycobacterium
ALDALGYRGFWAGYFAARSAPLGPVPAE

SEQ ID NO: 792467 - protein, 17 aa, Mycobacterium
ALDALSLFSAVSVYCRR

SEQ ID NO: 792468 - protein, 18 aa, Mycobacterium
ALDALYPRLSSGGYCIID

SEQ ID NO: 792469 - protein, 18 aa, Mycobacterium
ALDAPVLLHPADEVLWRM

SEQ ID NO: 792470 - protein, 26 aa, Mycobacterium
ALDARLRELIIMRIGWVTDSVYEWTQ

SEQ ID NO: 792471 - protein, 27 aa, Mycobacterium
ALDASLLLAVLTRFLPPDDPRIRATVN

SEQ ID NO: 792472 - protein, 21 aa, Mycobacterium
ALDAVRESRGLRQPSRAAVAA

SEQ ID NO: 792473 - protein, 17 aa, Mycobacterium
ALDDCHDGYRWLRLLGY

SEQ ID NO: 792474 - protein, 29 aa, Mycobacterium
ALDDCHDGYRWLRLLGYDPEQIVLAGDSA

SEQ ID NO: 792475 - protein, 20 aa, Mycobacterium
ALDDLRWLLDNAADVGVLAF

SEQ ID NO: 792476 - protein, 24 aa, Mycobacterium
ALDDPARPLTVTGGLTFAGGPWCN

SEQ ID NO: 792477 - protein, 32 aa, Mycobacterium
ALDDTNLRRLISLFELLRARSQLIIITHQKPT

SEQ ID NO: 792478 - protein, 39 aa, Mycobacterium
ALDEFALWATSLTQRAVLRLLDPTWTSPGFFRAEKILDV

SEQ ID NO: 792479 - protein, 30 aa, Mycobacterium
ALDEGVWLRPFRTLIYTMPPYICDEGEIRR

SEQ ID NO: 792480 - protein, 20 aa, Mycobacterium
ALDEILHSWRSEHPELSVIR

SEQ ID NO: 792481 - protein, 17 aa, Mycobacterium
ALDELDLTVREGEVHGF

SEQ ID NO: 792482 - protein, 34 aa, Mycobacterium
ALDELLAPLTEPRYLIGRKILTPPVGRFARGIFA

SEQ ID NO: 792483 - protein, 17 aa, Mycobacterium
ALDELVEWALRAVHSFM

SEQ ID NO: 792484 - protein, 35 aa, Mycobacterium
ALDENRVPRWWSVRDLIMAFLQLRDSVVLHRSEYR

SEQ ID NO: 792485 - protein, 30 aa, Mycobacterium
ALDENRVPRWWSVRELIAAFLSLRDSVVLH

SEQ ID NO: 792486 - protein, 17 aa, Mycobacterium
ALDERGIPYRRGEVLVA

SEQ ID NO: 792487 - protein, 17 aa, Mycobacterium
ALDFALPTHAHWDHVSG

SEQ ID NO: 792488 - protein, 24 aa, Mycobacterium
ALDFGCVWINTHIPLVAEMPHGGF

SEQ ID NO: 792489 - protein, 19 aa, Mycobacterium
ALDFKPVPEKLAHWAELGV

SEQ ID NO: 792490 - protein, 19 aa, Mycobacterium
ALDGADMFLGLSAGLVPEE

SEQ ID NO: 792491 - protein, 17 aa, Mycobacterium
ALDGFITGPLSPASLFT

SEQ ID NO: 792492 - protein, 25 aa, Mycobacterium
ALDHPVPVLLSALSPRMLRVATKFT

SEQ ID NO: 792493 - protein, 26 aa, Mycobacterium
ALDIHPIRRTIQHADLLVVRRGEKVV

SEQ ID NO: 792494 - protein, 32 aa, Mycobacterium
ALDIHPIRRTIQHADLLVVRRGEKVVVEVRVV

SEQ ID NO: 792495 - protein, 23 aa, Mycobacterium
ALDIKGIHDPVVRARWARGMDLV

SEQ ID NO: 792496 - protein, 21 aa, Mycobacterium
ALDKVPALNPHQIDDLILGCG

SEQ ID NO: 792497 - protein, 23 aa, Mycobacterium
ALDLDLIERLRDAVPCPLVLHGS

SEQ ID NO: 792498 - protein, 17 aa, Mycobacterium
ALDLLLGGWPADRRTVA

SEQ ID NO: 792499 - protein, 19 aa, Mycobacterium
ALDLLPQVGFVNAYGLTET

SEQ ID NO: 792500 - protein, 19 aa, Mycobacterium
ALDLRKRLRRTVGNSVPVA

SEQ ID NO: 792501 - protein, 27 aa, Mycobacterium
ALDLVGPFDVFTGAALWLAGQGREQQA

SEQ ID NO: 792502 - protein, 23 aa, Mycobacterium
ALDLYLGLANYLNNFKRLGFTDD

SEQ ID NO: 792503 - protein, 20 aa, Mycobacterium
ALDPARHVIIYLANPTIGVR

SEQ ID NO: 792504 - protein, 32 aa, Mycobacterium
ALDPDTFYWAHATFFMLIVKVAEYFCGGLTEA

SEQ ID NO: 792505 - protein, 17 aa, Mycobacterium
ALDPFVALGFAAATTST

SEQ ID NO: 792506 - protein, 17 aa, Mycobacterium
ALDPFVALGFAAATTTS

SEQ ID NO: 792507 - protein, 19 aa, Mycobacterium
ALDPQRVVLLPDATEDYWS

SEQ ID NO: 792508 - protein, 23 aa, Mycobacterium
ALDPQRVVLLPDGTEDFWSAEYR

SEQ ID NO: 792509 - protein, 20 aa, Mycobacterium
ALDPQRVVLLPDGTEDFWSD

SEQ ID NO: 792510 - protein, 17 aa, Mycobacterium
ALDPQRWWRDPRLGPLL

SEQ ID NO: 792511 - protein, 18 aa, Mycobacterium
ALDPVVDLRMRLGEGTGA

SEQ ID NO: 792512 - protein, 24 aa, Mycobacterium
ALDQFVRYLAQELAPHGIPANLVA

SEQ ID NO: 792513 - protein, 17 aa, Mycobacterium
ALDQRIAVRYALPGMSP

SEQ ID NO: 792514 - protein, 26 aa, Mycobacterium
ALDRADDALQWFLRSAAADVDGVTDA

SEQ ID NO: 792515 - protein, 17 aa, Mycobacterium
ALDRAGFKIVATGLREC

SEQ ID NO: 792516 - protein, 27 aa, Mycobacterium
ALDRCRRWFGALPLARRPRGVVAGLVI

SEQ ID NO: 792517 - protein, 19 aa, Mycobacterium
ALDRGIPVCVVPFARDQAE

SEQ ID NO: 792518 - protein, 20 aa, Mycobacterium
ALDRGYWLGDAFASGGSAGY

SEQ ID NO: 792519 - protein, 22 aa, Mycobacterium
ALDRHLHRIALPAPGGRAELAE

SEQ ID NO: 792520 - protein, 20 aa, Mycobacterium
ALDRISAFQMGFLAGASACA

SEQ ID NO: 792521 - protein, 20 aa, Mycobacterium
ALDRVEVPVLLLTGWQDIFL

SEQ ID NO: 792522 - protein, 28 aa, Mycobacterium
ALDRVQVPVLLIGGWQDLFIRQTLRQYA

SEQ ID NO: 792523 - protein, 19 aa, Mycobacterium
ALDRVQVPVLLVGGWQDVF

SEQ ID NO: 792524 - protein, 17 aa, Mycobacterium
ALDRWQYVPFGGGPRSC

SEQ ID NO: 792525 - protein, 37 aa, Mycobacterium
ALDSDYVDLFLIHWPLPTLYDGDFVSTWKVFEEFARD

SEQ ID NO: 792526 - protein, 24 aa, Mycobacterium
ALDSILRNLGLTTLLFGGVNTDQC

SEQ ID NO: 792527 - protein, 27 aa, Mycobacterium
ALDSPQPLWALWRFGIDPSATRLTMEI

SEQ ID NO: 792528 - protein, 31 aa, Mycobacterium
ALDTFEWPRIAGSFNWATDWFDAIAADPASA

SEQ ID NO: 792529 - protein, 20 aa, Mycobacterium
ALDTLPTLGGAPFDMVFIDA

SEQ ID NO: 792530 - protein, 27 aa, Mycobacterium
ALDTRAFALWAKLSGQVPRIAVVKGRC

SEQ ID NO: 792531 - protein, 33 aa, Mycobacterium
ALDVDMVFSPFFNALPIRRLGVLPGSGESVTVP

SEQ ID NO: 792532 - protein, 30 aa, Mycobacterium
ALDVDVIFSPFFNALPIRRVGLHTRTDSVS

SEQ ID NO: 792533 - protein, 29 aa, Mycobacterium
ALDVDVVFSPFFNALPIRRLGLHERADSV

SEQ ID NO: 792534 - protein, 31 aa, Mycobacterium
ALDVDVVFSPFFNALPIRRTGLYQQEGSAVL

SEQ ID NO: 792535 - protein, 19 aa, Mycobacterium
ALDVELLIELRAAIAEVLA

SEQ ID NO: 792536 - protein, 26 aa, Mycobacterium
ALDVHPIRRNIQHADLLVVQRGEKVT

SEQ ID NO: 792537 - protein, 24 aa, Mycobacterium
ALDVLAGALYWRQSILQTTADDDY

SEQ ID NO: 792538 - protein, 20 aa, Mycobacterium
ALDVWVDRFDPDAVKRTRSS

SEQ ID NO: 792539 - protein, 22 aa, Mycobacterium
ALDWHHVYVFTGLSTDELEVAG

SEQ ID NO: 792540 - protein, 20 aa, Mycobacterium
ALDWTQWRVTKKAEDSQRRA

SEQ ID NO: 792541 - protein, 20 aa, Mycobacterium
ALDWVQWRVTKRAEDAQRRA

SEQ ID NO: 792542 - protein, 25 aa, Mycobacterium
ALDYELELGFVLRAPLRNATPREAL

SEQ ID NO: 792543 - protein, 32 aa, Mycobacterium
ALDYLGAKGWQLEGVPLAELFRRSGLDAPAPD

SEQ ID NO: 792544 - protein, 21 aa, Mycobacterium
ALDYTNLLPDRQWARICRTTD

SEQ ID NO: 792545 - protein, 22 aa, Mycobacterium
ALEAALPPALIADDAALVALDT

SEQ ID NO: 792546 - protein, 26 aa, Mycobacterium
ALEAFPQRSYVLPEEPLLCAPTVAEL

SEQ ID NO: 792547 - protein, 24 aa, Mycobacterium
ALEALRIPIEYLAGLFTAGDTAVV

SEQ ID NO: 792548 - protein, 22 aa, Mycobacterium
ALEALVIAGFVRGLSVRDVEAT

SEQ ID NO: 792549 - protein, 33 aa, Mycobacterium
ALEATLHIALRLGHNFIGTEHLLLAILSGHTDT

SEQ ID NO: 792550 - protein, 18 aa, Mycobacterium
ALEAYLARLAVEIPQPKT

SEQ ID NO: 792551 - protein, 18 aa, Mycobacterium
ALECGALSEWRATILVRE

SEQ ID NO: 792552 - protein, 17 aa, Mycobacterium
ALEDYVYFTITATDWRD

SEQ ID NO: 792553 - protein, 30 aa, Mycobacterium
ALEEAKLQRMPKPKPLATRIALVTGAASGI

SEQ ID NO: 792554 - protein, 35 aa, Mycobacterium
ALEEFVLRGGKRLRPAFAYWGFRAVAGTEPEPHIM

SEQ ID NO: 792555 - protein, 31 aa, Mycobacterium
ALEELARLIAAGQLRVPIAASFPLAQIRRAV

SEQ ID NO: 792556 - protein, 24 aa, Mycobacterium
ALEEWPGRLRRLISEQIAVILRRS

SEQ ID NO: 792557 - protein, 19 aa, Mycobacterium
ALEFAQMYRRFGAAVTVVE

SEQ ID NO: 792558 - protein, 33 aa, Mycobacterium
ALEFEALVALLRFPARFFTTAPVSRVAARDLLF

SEQ ID NO: 792559 - protein, 17 aa, Mycobacterium
ALEFLLQTLAALDVATR

SEQ ID NO: 792560 - protein, 37 aa, Mycobacterium
ALEFMEDSWWGPTVPLVGRPWFALSERNSPGSIIVNS

SEQ ID NO: 792561 - protein, 22 aa, Mycobacterium
ALEGELALPLIRTLLTEAEENG

SEQ ID NO: 792562 - protein, 26 aa, Mycobacterium
ALEGGRQLVFCDLGMPRDVDPTVAGL

SEQ ID NO: 792563 - protein, 28 aa, Mycobacterium
ALEGLGFRGFWQGYFAARSAPLGRVAPE

SEQ ID NO: 792564 - protein, 23 aa, Mycobacterium
ALEGYGWHPQAWRHSAGAPPVTS

SEQ ID NO: 792565 - protein, 19 aa, Mycobacterium
ALEHDERFGIWGGLSERER

SEQ ID NO: 792566 - protein, 17 aa, Mycobacterium
ALEHLLDIRIEFEAVQI

SEQ ID NO: 792567 - protein, 45 aa, Mycobacterium
ALELAANLREIWIPRGMFSEGYRWLDLALTALPPLPSPERIRALA

SEQ ID NO: 792568 - protein, 18 aa, Mycobacterium
ALELATLMLLERLAPPER

SEQ ID NO: 792569 - protein, 27 aa, Mycobacterium
ALELGCGTGFFLLNLIQAGVARRGSVT

SEQ ID NO: 792570 - protein, 26 aa, Mycobacterium
ALELGCGTGFFLLNLMQAGVARRGSV

SEQ ID NO: 792571 - protein, 22 aa, Mycobacterium
ALELIKERVPDVALLDYRMPGM

SEQ ID NO: 792572 - protein, 23 aa, Mycobacterium
ALELLASGMWSGAGVLGPEAFDA

SEQ ID NO: 792573 - protein, 20 aa, Mycobacterium
ALELLYTGTMVWAGMGYDSY

SEQ ID NO: 792574 - protein, 18 aa, Mycobacterium
ALELMEDAWWGPTVPLVG

SEQ ID NO: 792575 - protein, 30 aa, Mycobacterium
ALEMSWGDVGLLLTVPYQGLGNAAVSSVTS

SEQ ID NO: 792576 - protein, 30 aa, Mycobacterium
ALENAFGLPEFLPSRLTVDLFRAARGVETT

SEQ ID NO: 792577 - protein, 25 aa, Mycobacterium
ALENTRFWAPLSLTPEQKHSIDDPI

SEQ ID NO: 792578 - protein, 25 aa, Mycobacterium
ALENTRFWAPLSLTPEQKHSIHDPI

SEQ ID NO: 792579 - protein, 20 aa, Mycobacterium
ALEPALSTMLRRTLPLMARM

SEQ ID NO: 792580 - protein, 26 aa, Mycobacterium
ALEPIGLMRRIGLGETLRIALMGNDE

SEQ ID NO: 792581 - protein, 21 aa, Mycobacterium
ALEPLLRRRHGAWIGWPGVPE

SEQ ID NO: 792582 - protein, 21 aa, Mycobacterium
ALEPLLRRRRGAWVGWAGIAE

SEQ ID NO: 792583 - protein, 26 aa, Mycobacterium
ALEPLLRRRRGAWVGWPGVAEADVDA

SEQ ID NO: 792584 - protein, 25 aa, Mycobacterium
ALEPLLRRRRGAWVGWPGVVDEDVD

SEQ ID NO: 792585 - protein, 34 aa, Mycobacterium
ALEPRRLARRYLRDDLPFALALVIRSVLQRFRRT

SEQ ID NO: 792586 - protein, 17 aa, Mycobacterium
ALEPVLHRLDLVMVPMS

SEQ ID NO: 792587 - protein, 18 aa, Mycobacterium
ALEPWSFGIYAGGQSILV

SEQ ID NO: 792588 - protein, 21 aa, Mycobacterium
ALEQHLLCPFHYFGVHDAVDL

SEQ ID NO: 792589 - protein, 25 aa, Mycobacterium
ALEQIRSDPLRRLMLSPGSSPDLGE

SEQ ID NO: 792590 - protein, 25 aa, Mycobacterium
ALEQQFLSVVNTYKIYHLDFDVEGA

SEQ ID NO: 792591 - protein, 25 aa, Mycobacterium
ALERLETLLALVEGWVQTVVSGALG

SEQ ID NO: 792592 - protein, 22 aa, Mycobacterium
ALERLETLLALVEGWVQTVVTD

SEQ ID NO: 792593 - protein, 25 aa, Mycobacterium
ALERPRFDALGRWLLSRTAEISAQR

SEQ ID NO: 792594 - protein, 23 aa, Mycobacterium
ALERVEVPILLLSGWQDLFLDQT

SEQ ID NO: 792595 - protein, 26 aa, Mycobacterium
ALESALTVLSLRDGVIPPTLNYETPD

SEQ ID NO: 792596 - protein, 23 aa, Mycobacterium
ALESFALGDLPGIAAVLVDGVPL

SEQ ID NO: 792597 - protein, 23 aa, Mycobacterium
ALESLLTRLNLPDDVPIEAKMVT

SEQ ID NO: 792598 - protein, 18 aa, Mycobacterium
ALESLTSIRRAGADIVLT

SEQ ID NO: 792599 - protein, 19 aa, Mycobacterium
ALESLTSIRRAGADIVLTY

SEQ ID NO: 792600 - protein, 29 aa, Mycobacterium
ALESVLTVLALRDGVIPPTLNLDNLDPEI

SEQ ID NO: 792601 - protein, 27 aa, Mycobacterium
ALESVLTVLTLRDGVIPPTLNYETPDP

SEQ ID NO: 792602 - protein, 24 aa, Mycobacterium
ALETIALMRKMPAEAVLRMALVGS

SEQ ID NO: 792603 - protein, 26 aa, Mycobacterium
ALEVDVSLLSTAWWAAGASVTQGMDT

SEQ ID NO: 792604 - protein, 26 aa, Mycobacterium
ALEVDVSLLSTAWWAAGASVTQGMET

SEQ ID NO: 792605 - protein, 29 aa, Mycobacterium
ALEVFPRAKAMLPKAIDAGVRIACGTDAP

SEQ ID NO: 792606 - protein, 20 aa, Mycobacterium
ALEVHVPQWRFTRGGQSGAA

SEQ ID NO: 792607 - protein, 28 aa, Mycobacterium
ALEVLARARRPLIVLGKGAAYAQADNEI

SEQ ID NO: 792608 - protein, 22 aa, Mycobacterium
ALEVLPVTEFGLRDAADGFRLM

SEQ ID NO: 792609 - protein, 18 aa, Mycobacterium
ALEVTLRVLRRHGYEPRR

SEQ ID NO: 792610 - protein, 20 aa, Mycobacterium
ALEWIVGHPDRVRSALLLAV

SEQ ID NO: 792611 - protein, 19 aa, Mycobacterium
ALEWMVGHPDRVRSGLLLA

SEQ ID NO: 792612 - protein, 20 aa, Mycobacterium
ALEYDKYVITLCHGPGALLA

SEQ ID NO: 792613 - protein, 17 aa, Mycobacterium
ALEYLLPQGSGVIINIG

SEQ ID NO: 792614 - protein, 18 aa, Mycobacterium
ALFAAAQRRGITPAMAVA

SEQ ID NO: 792615 - protein, 20 aa, Mycobacterium
ALFAGDLLRPSTVSPPMHAE

SEQ ID NO: 792616 - protein, 18 aa, Mycobacterium
ALFAVEMGLARLWQSWGI

SEQ ID NO: 792617 - protein, 27 aa, Mycobacterium
ALFAVEMGLARLWQSWGIEPDVVLGHS

SEQ ID NO: 792618 - protein, 30 aa, Mycobacterium
ALFAVEMGLARLWQSWGIVPDVVLGHSVGQ

SEQ ID NO: 792619 - protein, 38 aa, Mycobacterium
ALFDAQGQAYQLLSARAATFHEQFLQALSGGGASYAAA

SEQ ID NO: 792620 - protein, 20 aa, Mycobacterium
ALFDGLYGELSDWVQGWAPD

SEQ ID NO: 792621 - protein, 33 aa, Mycobacterium
ALFDRFGADLPPLEGIYLAAFAGGPVLLNEMTD

SEQ ID NO: 792622 - protein, 33 aa, Mycobacterium
ALFDRFGADLPPLEGIYLAAFAGQPVLLSQMTY

SEQ ID NO: 792623 - protein, 33 aa, Mycobacterium
ALFDRFGADLPPLEGIYLAAFAGQPVLLTEMTN

SEQ ID NO: 792624 - protein, 23 aa, Mycobacterium
ALFDTPILVPPQAAMLGTGAIVK

SEQ ID NO: 792625 - protein, 20 aa, Mycobacterium
ALFEAPTIRRLAARLGTDGG

SEQ ID NO: 792626 - protein, 18 aa, Mycobacterium
ALFELLQRRITSPENTIR

SEQ ID NO: 792627 - protein, 20 aa, Mycobacterium
ALFENLVGYPTFRGLAAFET

SEQ ID NO: 792628 - protein, 22 aa, Mycobacterium
ALFERLCLEAFQSGLAWITILR

SEQ ID NO: 792629 - protein, 27 aa, Mycobacterium
ALFERRHLLLLGWTKMRDGQLASAGAD

SEQ ID NO: 792630 - protein, 18 aa, Mycobacterium
ALFEYLVMTGVCTDNPVP

SEQ ID NO: 792631 - protein, 19 aa, Mycobacterium
ALFFELDTLPPAERLAFVL

SEQ ID NO: 792632 - protein, 24 aa, Mycobacterium
ALFGAHAWQYQAISAQVAVFHDQF

SEQ ID NO: 792633 - protein, 25 aa, Mycobacterium
ALFGKVAPMLPLDDGAIFAAPDAVA

SEQ ID NO: 792634 - protein, 24 aa, Mycobacterium
ALFGRIRQHVDAWQLLYRTNSMHH

SEQ ID NO: 792635 - protein, 18 aa, Mycobacterium
ALFGRPMVTSPNATIAIE

SEQ ID NO: 792636 - protein, 18 aa, Mycobacterium
ALFGTDAWSLPFELATSQ

SEQ ID NO: 792637 - protein, 18 aa, Mycobacterium
ALFGTWHAGGVYTPLNPR

SEQ ID NO: 792638 - protein, 34 aa, Mycobacterium
ALFHAFAVQMNLISPLWFAIRAYRQMQTQDGVGC

SEQ ID NO: 792639 - protein, 35 aa, Mycobacterium
ALFHAFAVQMNLISPLWFAIRAYRQMRTQDGVGCI

SEQ ID NO: 792640 - protein, 19 aa, Mycobacterium
ALFHEAVHWDIPVAELTTD

SEQ ID NO: 792641 - protein, 20 aa, Mycobacterium
ALFLQDPIGNLWQMLNAFWT

SEQ ID NO: 792642 - protein, 21 aa, Mycobacterium
ALFLQGLLSELLVRAIITRTD

SEQ ID NO: 792643 - protein, 28 aa, Mycobacterium
ALFLVPPERIHGLVFAGLRAATTPVPLR

SEQ ID NO: 792644 - protein, 17 aa, Mycobacterium
ALFLYAAISPEGDRRLL

SEQ ID NO: 792645 - protein, 21 aa, Mycobacterium
ALFRAWYLHEELGLNVMLPVL

SEQ ID NO: 792646 - protein, 25 aa, Mycobacterium
ALFRELRILPPFTQKTTRNLSDEAI

SEQ ID NO: 792647 - protein, 20 aa, Mycobacterium
ALFRESLKLVLPADLLTTEI

SEQ ID NO: 792648 - protein, 19 aa, Mycobacterium
ALFRLLELVDDGVAAPVAV

SEQ ID NO: 792649 - protein, 19 aa, Mycobacterium
ALFRRGAFVDAGGWDVRFP

SEQ ID NO: 792650 - protein, 18 aa, Mycobacterium
ALFSNVLARLSADDWDRT

SEQ ID NO: 792651 - protein, 17 aa, Mycobacterium
ALFTDPAERALHLDWDR

SEQ ID NO: 792652 - protein, 17 aa, Mycobacterium
ALFTPAEEGLLRQWLRT

SEQ ID NO: 792653 - protein, 26 aa, Mycobacterium
ALFTQMAALAAMWRSFGIAPNVTIGH

SEQ ID NO: 792654 - protein, 19 aa, Mycobacterium
ALFVPPPPEMVSGLMADLM

SEQ ID NO: 792655 - protein, 18 aa, Mycobacterium
ALFVPQAITPWPEGNDRT

SEQ ID NO: 792656 - protein, 25 aa, Mycobacterium
ALGADVVALARPLLAPAIESADAVE

SEQ ID NO: 792657 - protein, 18 aa, Mycobacterium
ALGAHHPVRLFIGSGMPA

SEQ ID NO: 792658 - protein, 21 aa, Mycobacterium
ALGAKLPELWGGSADLAGSNN

SEQ ID NO: 792659 - protein, 24 aa, Mycobacterium
ALGALRIPIEYLAGLFTAGDTTVV

SEQ ID NO: 792660 - protein, 29 aa, Mycobacterium
ALGAPKSLQLWVMIETPRAFLRAEEVASA

SEQ ID NO: 792661 - protein, 27 aa, Mycobacterium
ALGAPLDVFLVRKLGVPNWSELAMGAL

SEQ ID NO: 792662 - protein, 31 aa, Mycobacterium
ALGAQVAAFHDQLVTALDAAAGKYASAEVAN

SEQ ID NO: 792663 - protein, 21 aa, Mycobacterium
ALGARFSPAWLTRLVNKGLAG

SEQ ID NO: 792664 - protein, 20 aa, Mycobacterium
ALGARGLRRILTEGGPMLLG

SEQ ID NO: 792665 - protein, 27 aa, Mycobacterium
ALGASRLVIAPWFLAHGRITDRVAAFA

SEQ ID NO: 792666 - protein, 18 aa, Mycobacterium
ALGASWETDLPGGVLAQL

SEQ ID NO: 792667 - protein, 20 aa, Mycobacterium
ALGAVRWAARNAALRNAPLA

SEQ ID NO: 792668 - protein, 29 aa, Mycobacterium
ALGDPHYTYKLDWLAALKDTAEGWLRDDP

SEQ ID NO: 792669 - protein, 30 aa, Mycobacterium
ALGDPHYTYKLEWLAALRDTAAGWLRDDPA

SEQ ID NO: 792670 - protein, 22 aa, Mycobacterium
ALGDPLVIDAVLFEGGAFEEFL

SEQ ID NO: 792671 - protein, 24 aa, Mycobacterium
ALGDTPLVGLQRLSPRWNDGEHGE

SEQ ID NO: 792672 - protein, 24 aa, Mycobacterium
ALGDYEWILAFEAPELDRIVDLMR

SEQ ID NO: 792673 - protein, 24 aa, Mycobacterium
ALGDYEWLLAFEAPELHRIVDLMR

SEQ ID NO: 792674 - protein, 25 aa, Mycobacterium
ALGDYEWLLAFEAPELYRIVDLMRD

SEQ ID NO: 792675 - protein, 21 aa, Mycobacterium
ALGEAAEFLRWTAAQAPDAAG

SEQ ID NO: 792676 - protein, 30 aa, Mycobacterium
ALGEALSVDLPLARLALERLAPGLGVPHTQ

SEQ ID NO: 792677 - protein, 28 aa, Mycobacterium
ALGFPTRMFTVLFALGRMPGWIAHWREM

SEQ ID NO: 792678 - protein, 28 aa, Mycobacterium
ALGFRDLCRYIARSLLETGGFRPRLHPQ

SEQ ID NO: 792679 - protein, 23 aa, Mycobacterium
ALGGFAWRAALELIADRPKPAPK

SEQ ID NO: 792680 - protein, 24 aa, Mycobacterium
ALGGHDLLPGRAFVRREQGAQALM

SEQ ID NO: 792681 - protein, 18 aa, Mycobacterium
ALGGRFIELGKRDIYGDS

SEQ ID NO: 792682 - protein, 27 aa, Mycobacterium
ALGGVAMPKSLLWALHEHILGANPAVW

SEQ ID NO: 792683 - protein, 19 aa, Mycobacterium
ALGHPFGMTGARIATTLLN

SEQ ID NO: 792684 - protein, 20 aa, Mycobacterium
ALGHPFGMTGARIATTLLNN

SEQ ID NO: 792685 - protein, 17 aa, Mycobacterium
ALGIFPPTDEQAAVIAA

SEQ ID NO: 792686 - protein, 17 aa, Mycobacterium
ALGILLKNRGFENFTIF

SEQ ID NO: 792687 - protein, 27 aa, Mycobacterium
ALGIPAKHAPWIAAGLITAFHAFEVNI

SEQ ID NO: 792688 - protein, 18 aa, Mycobacterium
ALGIRHVAWVKERGLPFG

SEQ ID NO: 792689 - protein, 18 aa, Mycobacterium
ALGITAFLVPTDAPGFHV

SEQ ID NO: 792690 - protein, 20 aa, Mycobacterium
ALGKERFGQFLRAGSPSRKL

SEQ ID NO: 792691 - protein, 24 aa, Mycobacterium
ALGKNLLVAVMPWEGHNYEDAIIL

SEQ ID NO: 792692 - protein, 30 aa, Mycobacterium
ALGKTLFDVATLALPGGPLSKLGKLGRGLG

SEQ ID NO: 792693 - protein, 21 aa, Mycobacterium
ALGLDKLRWGVTGAAAIPVET

SEQ ID NO: 792694 - protein, 20 aa, Mycobacterium
ALGLDQLRWGVTGAAAMPVE

SEQ ID NO: 792695 - protein, 18 aa, Mycobacterium
ALGLERVGSLLPGYDANL

SEQ ID NO: 792696 - protein, 18 aa, Mycobacterium
ALGLFPPTDEQAAVIAAP

SEQ ID NO: 792697 - protein, 20 aa, Mycobacterium
ALGLFSAPGQAAYVSAKFAV

SEQ ID NO: 792698 - protein, 18 aa, Mycobacterium
ALGLKPTLAALATGARLA

SEQ ID NO: 792699 - protein, 18 aa, Mycobacterium
ALGLLDEHLGHCVSQAVA

SEQ ID NO: 792700 - protein, 17 aa, Mycobacterium
ALGLRAGGPYLPVTVRT

SEQ ID NO: 792701 - protein, 29 aa, Mycobacterium
ALGLTLTEFRLFHFLVRHAGQAFTRTRLM

SEQ ID NO: 792702 - protein, 22 aa, Mycobacterium
ALGMTGLTAWIGIRDIGKPQPG

SEQ ID NO: 792703 - protein, 21 aa, Mycobacterium
ALGPDGHRYAFFSHPDGSVTP

SEQ ID NO: 792704 - protein, 28 aa, Mycobacterium
ALGPHQPILAILAADLVYLPDAARELIR

SEQ ID NO: 792705 - protein, 22 aa, Mycobacterium
ALGPQLLVLFEGAAALATSLND

SEQ ID NO: 792706 - protein, 21 aa, Mycobacterium
ALGPVVGRRVLITGASGGVGR

SEQ ID NO: 792707 - protein, 24 aa, Mycobacterium
ALGQLLLSHFVIGEAISGLGEAAP

SEQ ID NO: 792708 - protein, 24 aa, Mycobacterium
ALGRDFEVIIYADLVAKDLATVAS

SEQ ID NO: 792709 - protein, 28 aa, Mycobacterium
ALGRDFPPGFLFLDPPDHTRLRKLVSKA

SEQ ID NO: 792710 - protein, 18 aa, Mycobacterium
ALGRLLLGSVSSSVVRGA

SEQ ID NO: 792711 - protein, 20 aa, Mycobacterium
ALGRLTPIEFELLHTPVATA

SEQ ID NO: 792712 - protein, 21 aa, Mycobacterium
ALGRRGGGFVLIGRRHLRSNN

SEQ ID NO: 792713 - protein, 23 aa, Mycobacterium
ALGRSQAQLLRRSVRQFSPEPVD

SEQ ID NO: 792714 - protein, 32 aa, Mycobacterium
ALGRVLHRPTLLVAPQFALSLIFGEFADAELT

SEQ ID NO: 792715 - protein, 28 aa, Mycobacterium
ALGRVLVRPADIYLLDEPLSHLDAKLRA

SEQ ID NO: 792716 - protein, 19 aa, Mycobacterium
ALGRYGVCANAICPRARTA

SEQ ID NO: 792717 - protein, 17 aa, Mycobacterium
ALGSACSVAAFTAAMHA

SEQ ID NO: 792718 - protein, 26 aa, Mycobacterium
ALGSAQPLWALWRFGTEPGFAKMTME

SEQ ID NO: 792719 - protein, 19 aa, Mycobacterium
ALGSIDYWFVTEGRRVHKT

SEQ ID NO: 792720 - protein, 23 aa, Mycobacterium
ALGSPVISLAWLANTLGQQNDCL

SEQ ID NO: 792721 - protein, 24 aa, Mycobacterium
ALGTAELLRLALTSKIKPYSYTST

SEQ ID NO: 792722 - protein, 22 aa, Mycobacterium
ALGTGFFLTWLTTYTDQNGEVL

SEQ ID NO: 792723 - protein, 24 aa, Mycobacterium
ALGTLPLLTQVLDAVELPVLAAGG

SEQ ID NO: 792724 - protein, 31 aa, Mycobacterium
ALGTVGRQFGFVPNMFAMLASNPAVLDVVMS

SEQ ID NO: 792725 - protein, 26 aa, Mycobacterium
ALGTYGPPLKFDVALPLAHIGEFERR

SEQ ID NO: 792726 - protein, 23 aa, Mycobacterium
ALGVALRIAWRALTFAGLHGSDR

SEQ ID NO: 792727 - protein, 26 aa, Mycobacterium
ALGVDAIWINPWYPSPMADAGYDVAD

SEQ ID NO: 792728 - protein, 28 aa, Mycobacterium
ALGVDYIDLYLVHWPDPTTPAAETGEAL

SEQ ID NO: 792729 - protein, 24 aa, Mycobacterium
ALGVELVLLDNFPVWQTQMAVQRR

SEQ ID NO: 792730 - protein, 27 aa, Mycobacterium
ALGVERALAGLAWPDARLVAAAVSFDV

SEQ ID NO: 792731 - protein, 27 aa, Mycobacterium
ALGVHRLLSWGILDTPLTIVPAPTRRS

SEQ ID NO: 792732 - protein, 23 aa, Mycobacterium
ALGVRTLLVIIGERPGLSVADSL

SEQ ID NO: 792733 - protein, 25 aa, Mycobacterium
ALGVSLGVFRLLMGADYTPLAVHLP

SEQ ID NO: 792734 - protein, 24 aa, Mycobacterium
ALGVYFNLANYRNNWKRLGFSDDD

SEQ ID NO: 792735 - protein, 34 aa, Mycobacterium
ALGYDGVVLFLDELVLWLAFSVRDTEFFARESQK

SEQ ID NO: 792736 - protein, 23 aa, Mycobacterium
ALGYFGNTLLLRITTRSQDTFTS

SEQ ID NO: 792737 - protein, 18 aa, Mycobacterium
ALGYIGMVLGSYRWLNPS

SEQ ID NO: 792738 - protein, 19 aa, Mycobacterium
ALHAGLYGALDFGGSRAGN

SEQ ID NO: 792739 - protein, 22 aa, Mycobacterium
ALHAIWSAWRDGGKLRFEGEFY

SEQ ID NO: 792740 - protein, 24 aa, Mycobacterium
ALHALRIPLEYLAGLFTAGDTRVV

SEQ ID NO: 792741 - protein, 19 aa, Mycobacterium
ALHANTFPRFSAYAASKSA

SEQ ID NO: 792742 - protein, 24 aa, Mycobacterium
ALHAPLDAFIVRKLGVPGHEEFAL

SEQ ID NO: 792743 - protein, 19 aa, Mycobacterium
ALHDQFVRAVTSGAASYAG

SEQ ID NO: 792744 - protein, 25 aa, Mycobacterium
ALHEAKLAIHDLQGRGWTLAGVTSD

SEQ ID NO: 792745 - protein, 27 aa, Mycobacterium
ALHEAVLLLAVLLRRYDLVPEPGYQLQ

SEQ ID NO: 792746 - protein, 17 aa, Mycobacterium
ALHERWGGELYWYDGSH

SEQ ID NO: 792747 - protein, 24 aa, Mycobacterium
ALHGARWIDPGLPAYILDTNRRPA

SEQ ID NO: 792748 - protein, 25 aa, Mycobacterium
ALHGLGPRWVLVKGGHLRSSTRSCD

SEQ ID NO: 792749 - protein, 23 aa, Mycobacterium
ALHGLRIVGGRRPWKALRLQSCF

SEQ ID NO: 792750 - protein, 27 aa, Mycobacterium
ALHGNLLEYLCLCLTTICGRWQRAGER

SEQ ID NO: 792751 - protein, 17 aa, Mycobacterium
ALHGYTYTIRGRAEGFD

SEQ ID NO: 792752 - protein, 17 aa, Mycobacterium
ALHHCVVALAAVGWLSK

SEQ ID NO: 792753 - protein, 24 aa, Mycobacterium
ALHHEVTLNRRLAPQSYLGVGEFA

SEQ ID NO: 792754 - protein, 19 aa, Mycobacterium
ALHHQKWTVGGMAKGAGML

SEQ ID NO: 792755 - protein, 19 aa, Mycobacterium
ALHINSLREPYNAYEFDHL

SEQ ID NO: 792756 - protein, 17 aa, Mycobacterium
ALHLLRSRASADLERQV

SEQ ID NO: 792757 - protein, 21 aa, Mycobacterium
ALHPLPITPELRGRLVFAWRA

SEQ ID NO: 792758 - protein, 21 aa, Mycobacterium
ALHRALADLMPWLADRVDALK

SEQ ID NO: 792759 - protein, 17 aa, Mycobacterium
ALHRAPRRRLDLPTYPF

SEQ ID NO: 792760 - protein, 25 aa, Mycobacterium
ALHRATRPGARWFIACFGDGSVNGI

SEQ ID NO: 792761 - protein, 19 aa, Mycobacterium
ALHRLPVTFVLDRAGITGS

SEQ ID NO: 792762 - protein, 22 aa, Mycobacterium
ALHRRCVDVRYLGSWPTESAAG

SEQ ID NO: 792763 - protein, 25 aa, Mycobacterium
ALHRTKWIDDWLPAELNRAGRDKAR

SEQ ID NO: 792764 - protein, 18 aa, Mycobacterium
ALHSGAMPGGWAAAPTPG

SEQ ID NO: 792765 - protein, 18 aa, Mycobacterium
ALHVAKIARRRHPQHALP

SEQ ID NO: 792766 - protein, 20 aa, Mycobacterium
ALHYLAVYDEHTGIPLYLGR

SEQ ID NO: 792767 - protein, 24 aa, Mycobacterium
ALIAALPAILGFVPEKSLVLVSVD

SEQ ID NO: 792768 - protein, 20 aa, Mycobacterium
ALIAARVIARDSLVKTALFG

SEQ ID NO: 792769 - protein, 18 aa, Mycobacterium
ALIAFYEEQIEDAYKTGV

SEQ ID NO: 792770 - protein, 21 aa, Mycobacterium
ALIAGLLKGLLDTGVQPCPNA

SEQ ID NO: 792771 - protein, 29 aa, Mycobacterium
ALIDAVFMEAFRNPLLESLGDGAILTLPS

SEQ ID NO: 792772 - protein, 27 aa, Mycobacterium
ALIDIAKYPEAMVTLPIIVTAIYHERN

SEQ ID NO: 792773 - protein, 23 aa, Mycobacterium
ALIDVAHWASEFPWCGQAAEVLR

SEQ ID NO: 792774 - protein, 21 aa, Mycobacterium
ALIEDALARGSFARPLVVGDR

SEQ ID NO: 792775 - protein, 20 aa, Mycobacterium
ALIEEGLPVIVVMPSPKGMG

SEQ ID NO: 792776 - protein, 23 aa, Mycobacterium
ALIEGMALKPRKAFGPIRVAATG

SEQ ID NO: 792777 - protein, 24 aa, Mycobacterium
ALIENWALWRDAGDWERFATVWHP

SEQ ID NO: 792778 - protein, 21 aa, Mycobacterium
ALIERELGMRLGWAEMTVESV

SEQ ID NO: 792779 - protein, 25 aa, Mycobacterium
ALIEYYVDTFGFLLAARYGEGDRVD

SEQ ID NO: 792780 - protein, 17 aa, Mycobacterium
ALIGLPEAQLTLAHATI

SEQ ID NO: 792781 - protein, 23 aa, Mycobacterium
ALIGRLRRVLAALTADPGQALSS

SEQ ID NO: 792782 - protein, 28 aa, Mycobacterium
ALIKSIGLRLGVPWYAYDTVIFSGEVTT

SEQ ID NO: 792783 - protein, 27 aa, Mycobacterium
ALILENRLQLVTLIATNIFGQNTPAIA

SEQ ID NO: 792784 - protein, 20 aa, Mycobacterium
ALILFDIYRQAAEGTLAAVH

SEQ ID NO: 792785 - protein, 19 aa, Mycobacterium
ALIMDLSRYAVNPRIHLFF

SEQ ID NO: 792786 - protein, 20 aa, Mycobacterium
ALIMDLSRYAVNPRVHLFFG

SEQ ID NO: 792787 - protein, 33 aa, Mycobacterium
ALINMEFIQFHPTGMVWPLSVKGILVTEGVRGD

SEQ ID NO: 792788 - protein, 18 aa, Mycobacterium
ALINQHFLLNGSPPNRRE

SEQ ID NO: 792789 - protein, 20 aa, Mycobacterium
ALINRYPRVCGMTGTALAAG

SEQ ID NO: 792790 - protein, 21 aa, Mycobacterium
ALINRYPRVCGMTGTALAAGE

SEQ ID NO: 792791 - protein, 28 aa, Mycobacterium
ALIPAARNAILPPAMLAELIAQGATIRF

SEQ ID NO: 792792 - protein, 25 aa, Mycobacterium
ALIPPRVTHHLAMIGPLVSCYLDPA

SEQ ID NO: 792793 - protein, 28 aa, Mycobacterium
ALIPQAIEELLRWEPPALQIARYVTRDV

SEQ ID NO: 792794 - protein, 19 aa, Mycobacterium
ALIQAMLRHKRLTRQITVP

SEQ ID NO: 792795 - protein, 17 aa, Mycobacterium
ALIRHHSAFKRIAVVTD

SEQ ID NO: 792796 - protein, 17 aa, Mycobacterium
ALIRRLPEPLVIADDRY

SEQ ID NO: 792797 - protein, 19 aa, Mycobacterium
ALIRVTAFASLNKSPIELS

SEQ ID NO: 792798 - protein, 28 aa, Mycobacterium
ALISGDYNNGLLWRGDYQGNLGAFNYTV

SEQ ID NO: 792799 - protein, 20 aa, Mycobacterium
ALITALHRRTGRTTSPHLQS

SEQ ID NO: 792800 - protein, 25 aa, Mycobacterium
ALITVPLWSTLLARRALRLPWNVTP

SEQ ID NO: 792801 - protein, 21 aa, Mycobacterium
ALKCPVLVQIADFDRFVPADS

SEQ ID NO: 792802 - protein, 23 aa, Mycobacterium
ALKELFDQLGLGRVPLVGNSLGG

SEQ ID NO: 792803 - protein, 18 aa, Mycobacterium
ALKELSVELGAPAYHCDG

SEQ ID NO: 792804 - protein, 30 aa, Mycobacterium
ALKETLRLHPPLIILMRVAQDEFEVAGRPI

SEQ ID NO: 792805 - protein, 30 aa, Mycobacterium
ALKETLRLHPPLIILMRVAQDEFEVAGYPI

SEQ ID NO: 792806 - protein, 17 aa, Mycobacterium
ALKFWTPGGSSTPLFTA

SEQ ID NO: 792807 - protein, 22 aa, Mycobacterium
ALKGAHFIELCDKRKIPLLFLQ

SEQ ID NO: 792808 - protein, 21 aa, Mycobacterium
ALKGMLKPIYEEKELGRAEIR

SEQ ID NO: 792809 - protein, 26 aa, Mycobacterium
ALKHALYPRLLPIAREWWTRLGRTPP

SEQ ID NO: 792810 - protein, 22 aa, Mycobacterium
ALKHGHEPPFKKWLEHWDAAHD

SEQ ID NO: 792811 - protein, 19 aa, Mycobacterium
ALKHRMADLYVMVAAARSV

SEQ ID NO: 792812 - protein, 21 aa, Mycobacterium
ALKNVFAIAVGMGYSLGIGEN

SEQ ID NO: 792813 - protein, 18 aa, Mycobacterium
ALKPREWYDEKDITLRLG

SEQ ID NO: 792814 - protein, 17 aa, Mycobacterium
ALKQCDAMIRLGAVADV

SEQ ID NO: 792815 - protein, 26 aa, Mycobacterium
ALKQSRLWQILGMRSADTYVPEWMWH

SEQ ID NO: 792816 - protein, 18 aa, Mycobacterium
ALKRAGFGTLRLPESLGG

SEQ ID NO: 792817 - protein, 23 aa, Mycobacterium
ALKRLFVLTFETEFFARHGFTEI

SEQ ID NO: 792818 - protein, 20 aa, Mycobacterium
ALKRYGAECATLCWPRQADP

SEQ ID NO: 792819 - protein, 31 aa, Mycobacterium
ALKSVAAFRLALPRAMLRFAGGREITLGDLG

SEQ ID NO: 792820 - protein, 32 aa, Mycobacterium
ALKSVGAFRLALPRVMLRFAGGREITLGDLGA

SEQ ID NO: 792821 - protein, 17 aa, Mycobacterium
ALKYIPGLQSLIRGIAA

SEQ ID NO: 792822 - protein, 27 aa, Mycobacterium
ALLAADAGVPVLLAPAADAAAALTDAS

SEQ ID NO: 792823 - protein, 20 aa, Mycobacterium
ALLAALQRGINARQATAEPV

SEQ ID NO: 792824 - protein, 20 aa, Mycobacterium
ALLAECARRLLETSAVLGFA

SEQ ID NO: 792825 - protein, 27 aa, Mycobacterium
ALLAENDIWWCLQPFLNDEPTIPVTPQ

SEQ ID NO: 792826 - protein, 17 aa, Mycobacterium
ALLAEYLDVPKSTVRLV

SEQ ID NO: 792827 - protein, 20 aa, Mycobacterium
ALLAGCTIVLKPAAETPLTT

SEQ ID NO: 792828 - protein, 19 aa, Mycobacterium
ALLALAPSDIMLLLCGVGF

SEQ ID NO: 792829 - protein, 25 aa, Mycobacterium
ALLALERVEYRILGPQYKSPRLVKP

SEQ ID NO: 792830 - protein, 22 aa, Mycobacterium
ALLARVPSHYPLRSVFHAAGVI

SEQ ID NO: 792831 - protein, 25 aa, Mycobacterium
ALLASFKIWRTATVGGNICLGLPAG

SEQ ID NO: 792832 - protein, 18 aa, Mycobacterium
ALLAVPFVSTDRIEYLDK

SEQ ID NO: 792833 - protein, 18 aa, Mycobacterium
ALLAWVTAQPLPARPVIV

SEQ ID NO: 792834 - protein, 19 aa, Mycobacterium
ALLDDAGVTVTQFVRFEVG

SEQ ID NO: 792835 - protein, 19 aa, Mycobacterium
ALLDEAGVTVTRFARFEVG

SEQ ID NO: 792836 - protein, 20 aa, Mycobacterium
ALLDEAGVTVTRFARFEVGQ

SEQ ID NO: 792837 - protein, 20 aa, Mycobacterium
ALLDELPAQTWSRLDAPLPA

SEQ ID NO: 792838 - protein, 20 aa, Mycobacterium
ALLDEWIVAVWQNRPHDGLR

SEQ ID NO: 792839 - protein, 20 aa, Mycobacterium
ALLDGNLLNVNVNVDLDSDL

SEQ ID NO: 792840 - protein, 20 aa, Mycobacterium
ALLDLAKTGPVAGLPFLPPG

SEQ ID NO: 792841 - protein, 18 aa, Mycobacterium
ALLDMFEYFNAVTAARRE

SEQ ID NO: 792842 - protein, 19 aa, Mycobacterium
ALLDSLGSPPVWSNSLHWA

SEQ ID NO: 792843 - protein, 18 aa, Mycobacterium
ALLDWLFDEQTGSAGVQV

SEQ ID NO: 792844 - protein, 19 aa, Mycobacterium
ALLEGLELKPRKAFGPIRV

SEQ ID NO: 792845 - protein, 19 aa, Mycobacterium
ALLELHNALIRGELAGGYG

SEQ ID NO: 792846 - protein, 18 aa, Mycobacterium
ALLELPRDMTAEELAGGF

SEQ ID NO: 792847 - protein, 17 aa, Mycobacterium
ALLEMLIANPRRVLTRS

SEQ ID NO: 792848 - protein, 20 aa, Mycobacterium
ALLERLHLTEFADVNPYTLS

SEQ ID NO: 792849 - protein, 17 aa, Mycobacterium
ALLESLLKNVPAGGLDL

SEQ ID NO: 792850 - protein, 26 aa, Mycobacterium
ALLEVRDLLFARLLQYRAFKHVAEMF

SEQ ID NO: 792851 - protein, 27 aa, Mycobacterium
ALLEVRDLLFARLLQYRAFKHVAEMFA

SEQ ID NO: 792852 - protein, 20 aa, Mycobacterium
ALLFAKRPLMADAMLRVFFE

SEQ ID NO: 792853 - protein, 24 aa, Mycobacterium
ALLFAKRPLMADAMLRVFFEAYEI

SEQ ID NO: 792854 - protein, 17 aa, Mycobacterium
ALLGDLLPGYMIPARIE

SEQ ID NO: 792855 - protein, 19 aa, Mycobacterium
ALLGGYFAGLLDRTVLEAT

SEQ ID NO: 792856 - protein, 17 aa, Mycobacterium
ALLGLGTLLRADPQRDG

SEQ ID NO: 792857 - protein, 20 aa, Mycobacterium
ALLHARLVSAIALISSPHPA

SEQ ID NO: 792858 - protein, 22 aa, Mycobacterium
ALLHMVWRHELLIDLGRPMTSQ

SEQ ID NO: 792859 - protein, 19 aa, Mycobacterium
ALLKGRRNYLCLNKIHNGG

SEQ ID NO: 792860 - protein, 19 aa, Mycobacterium
ALLKLPVANWPVLGGMGNA

SEQ ID NO: 792861 - protein, 18 aa, Mycobacterium
ALLLELTGRCPAVRLLAT

SEQ ID NO: 792862 - protein, 18 aa, Mycobacterium
ALLLERGFDGLSIEAVAA

SEQ ID NO: 792863 - protein, 18 aa, Mycobacterium
ALLLGDPQTWHALMTALT

SEQ ID NO: 792864 - protein, 17 aa, Mycobacterium
ALLLGVLAGRDGLDPRQ

SEQ ID NO: 792865 - protein, 17 aa, Mycobacterium
ALLLPRRHPGKRSPLWH

SEQ ID NO: 792866 - protein, 17 aa, Mycobacterium
ALLLTHPGIGDAAVIGV

SEQ ID NO: 792867 - protein, 18 aa, Mycobacterium
ALLMLHPPSETTPSLPEC

SEQ ID NO: 792868 - protein, 25 aa, Mycobacterium
ALLNGPRYWLMNAIEKQRQGPQITK

SEQ ID NO: 792869 - protein, 23 aa, Mycobacterium
ALLPAAADPVASLILGELRTAVA

SEQ ID NO: 792870 - protein, 18 aa, Mycobacterium
ALLPATPEPVAALILGEL

SEQ ID NO: 792871 - protein, 26 aa, Mycobacterium
ALLPGAQILPIPVLAEAIRSGAKITP

SEQ ID NO: 792872 - protein, 20 aa, Mycobacterium
ALLPGYRLKHRVQFERLGSG

SEQ ID NO: 792873 - protein, 18 aa, Mycobacterium
ALLPLAGATLPGPVAGRP

SEQ ID NO: 792874 - protein, 21 aa, Mycobacterium
ALLPSLFRGAALSDLPTSEAL

SEQ ID NO: 792875 - protein, 18 aa, Mycobacterium
ALLPTHCWFEPKGWGFQV

SEQ ID NO: 792876 - protein, 18 aa, Mycobacterium
ALLPTVRIRRIYACYDAG

SEQ ID NO: 792877 - protein, 24 aa, Mycobacterium
ALLQCDAMPVLRWVRRMRSNSELP

SEQ ID NO: 792878 - protein, 17 aa, Mycobacterium
ALLQELLSAYGPCGQEA

SEQ ID NO: 792879 - protein, 19 aa, Mycobacterium
ALLQLLTEPLDPIEELLMS

SEQ ID NO: 792880 - protein, 18 aa, Mycobacterium
ALLQTLEACWGDVALMLT

SEQ ID NO: 792881 - protein, 18 aa, Mycobacterium
ALLQTRKALQQLRGSLTG

SEQ ID NO: 792882 - protein, 18 aa, Mycobacterium
ALLQVALGERPSLEQVLT

SEQ ID NO: 792883 - protein, 31 aa, Mycobacterium
ALLQVGETMPRRAPALTAPLLVIHGTDDRLI

SEQ ID NO: 792884 - protein, 29 aa, Mycobacterium
ALLQVGETMPRRAPALTAPLLVVHGTGDR

SEQ ID NO: 792885 - protein, 22 aa, Mycobacterium
ALLRAAIDLFSRPAVHSALSGL

SEQ ID NO: 792886 - protein, 21 aa, Mycobacterium
ALLREGVRVFGFHLCGLDMRQ

SEQ ID NO: 792887 - protein, 18 aa, Mycobacterium
ALLRKGRGQWAPVQDAWE

SEQ ID NO: 792888 - protein, 30 aa, Mycobacterium
ALLRLQSPARPLFTPLAPLAATPDAWVDRA

SEQ ID NO: 792889 - protein, 18 aa, Mycobacterium
ALLRPTLELLARIAARHP

SEQ ID NO: 792890 - protein, 17 aa, Mycobacterium
ALLRRTDMSLLDRWYAA

SEQ ID NO: 792891 - protein, 26 aa, Mycobacterium
ALLRTARAQLICYPSAGWPGTPPSDR

SEQ ID NO: 792892 - protein, 19 aa, Mycobacterium
ALLSMAFPTALVGDAPEVC

SEQ ID NO: 792893 - protein, 18 aa, Mycobacterium
ALLSVLARLTGGRAVVEV

SEQ ID NO: 792894 - protein, 20 aa, Mycobacterium
ALLTALHRRTGRTTSPHLQS

SEQ ID NO: 792895 - protein, 17 aa, Mycobacterium
ALLTALLKAGVITTGRG

SEQ ID NO: 792896 - protein, 20 aa, Mycobacterium
ALLTDRLVGRRIALTGPQSF

SEQ ID NO: 792897 - protein, 17 aa, Mycobacterium
ALLTIPYGETRSYGEVA

SEQ ID NO: 792898 - protein, 18 aa, Mycobacterium
ALLTLTKSLAREYAKHGI

SEQ ID NO: 792899 - protein, 26 aa, Mycobacterium
ALLTSPLARLAVPGLIGEAASDPSLN

SEQ ID NO: 792900 - protein, 18 aa, Mycobacterium
ALLVAYLPASSREEMFGG

SEQ ID NO: 792901 - protein, 20 aa, Mycobacterium
ALLVGARPRTKGMERGDLLE

SEQ ID NO: 792902 - protein, 19 aa, Mycobacterium
ALLVPGFVDMHVHGGGGAS

SEQ ID NO: 792903 - protein, 18 aa, Mycobacterium
ALLVVKRGPNAGSRFLLD

SEQ ID NO: 792904 - protein, 19 aa, Mycobacterium
ALMAEQVDWMLGNGGLDWA

SEQ ID NO: 792905 - protein, 24 aa, Mycobacterium
ALMAHRVMWPLDMLQEFLVGQRMA

SEQ ID NO: 792906 - protein, 20 aa, Mycobacterium
ALMDGRIHRVTLSAKVTSMS

SEQ ID NO: 792907 - protein, 24 aa, Mycobacterium
ALMDLIAAHRIPVISTLAPDAEGV

SEQ ID NO: 792908 - protein, 20 aa, Mycobacterium
ALMERWRCSAWREYRAAADA

SEQ ID NO: 792909 - protein, 19 aa, Mycobacterium
ALMGAKKWVRMPGVHFGPE

SEQ ID NO: 792910 - protein, 23 aa, Mycobacterium
ALMIFHTFMAAYSPAIHIEITPL

SEQ ID NO: 792911 - protein, 25 aa, Mycobacterium
ALMKPGRGPHRYVCGGVLVSFNEWI

SEQ ID NO: 792912 - protein, 20 aa, Mycobacterium
ALMLGKVVRILRRFGALDID

SEQ ID NO: 792913 - protein, 20 aa, Mycobacterium
ALMLPNLQMMAKLRTGQPLG

SEQ ID NO: 792914 - protein, 35 aa, Mycobacterium
ALMRALNPVFNRLPVRWLYLPWAAEGWKREGVDPR

SEQ ID NO: 792915 - protein, 18 aa, Mycobacterium
ALMRFTTARSWLSQWGLD

SEQ ID NO: 792916 - protein, 19 aa, Mycobacterium
ALMTAFGLEDGPPPDRMLI

SEQ ID NO: 792917 - protein, 25 aa, Mycobacterium
ALNAAMDDWLEMSRALLSRIGDHAR

SEQ ID NO: 792918 - protein, 26 aa, Mycobacterium
ALNAINAPIQAATGRPLIGNGTPGDA

SEQ ID NO: 792919 - protein, 20 aa, Mycobacterium
ALNAISGRVAFALGLEGPAV

SEQ ID NO: 792920 - protein, 22 aa, Mycobacterium
ALNAISGRVAFALGLEGPAVAV

SEQ ID NO: 792921 - protein, 29 aa, Mycobacterium
ALNALKEKLFPLATLVTPNLDEVGLLTGI

SEQ ID NO: 792922 - protein, 23 aa, Mycobacterium
ALNARIALHVRTLYGRDPHHITE

SEQ ID NO: 792923 - protein, 22 aa, Mycobacterium
ALNEHILGDPWPSAGVRLEMLE

SEQ ID NO: 792924 - protein, 17 aa, Mycobacterium
ALNGALNRGFNAGNLLL

SEQ ID NO: 792925 - protein, 20 aa, Mycobacterium
ALNGLATLGPQIASPLLNAA

SEQ ID NO: 792926 - protein, 28 aa, Mycobacterium
ALNGQLFQFVLFQTGVDEFYLFGCCHHI

SEQ ID NO: 792927 - protein, 28 aa, Mycobacterium
ALNGYTEILPMPFLPAGVFDAWGLDDND

SEQ ID NO: 792928 - protein, 20 aa, Mycobacterium
ALNHVLRLRAPQAGAMSRAA

SEQ ID NO: 792929 - protein, 26 aa, Mycobacterium
ALNLARLLRLDEVVPVWIPSAADDAT

SEQ ID NO: 792930 - protein, 18 aa, Mycobacterium
ALNLWKQRPDLHTPELRA

SEQ ID NO: 792931 - protein, 20 aa, Mycobacterium
ALNNTRFWAPLSLSAEQKRS

SEQ ID NO: 792932 - protein, 17 aa, Mycobacterium
ALNPAAELYFITGADAL

SEQ ID NO: 792933 - protein, 26 aa, Mycobacterium
ALNPDVFYWAHSTFFMGTILTAERFG

SEQ ID NO: 792934 - protein, 27 aa, Mycobacterium
ALNPETFYWAHATFFMLVIKVAEYFCG

SEQ ID NO: 792935 - protein, 24 aa, Mycobacterium
ALNPETFYWAHATFFMLVVKVAEY

SEQ ID NO: 792936 - protein, 19 aa, Mycobacterium
ALNPQRVVLLPDGTEDYWS

SEQ ID NO: 792937 - protein, 23 aa, Mycobacterium
ALNQRLWLLCGSRQWSSIYARLI

SEQ ID NO: 792938 - protein, 19 aa, Mycobacterium
ALNQWLHETWQFDYKGRIF

SEQ ID NO: 792939 - protein, 21 aa, Mycobacterium
ALNQWMYEQWSFNYQDRIFAT

SEQ ID NO: 792940 - protein, 23 aa, Mycobacterium
ALNQWMYETWSFNYKDRIFATPV

SEQ ID NO: 792941 - protein, 34 aa, Mycobacterium
ALNQWMYETWSFNYRDRIFATPVITLPIVDRALE

SEQ ID NO: 792942 - protein, 21 aa, Mycobacterium
ALNRPQALLRARRLLGACLAA

SEQ ID NO: 792943 - protein, 25 aa, Mycobacterium
ALNRSMLLDGLRRIGVDRLAPTDGA

SEQ ID NO: 792944 - protein, 23 aa, Mycobacterium
ALNSVPGPQLLLNYLGRADVGDA

SEQ ID NO: 792945 - protein, 17 aa, Mycobacterium
ALNTAVWSGGSFIYVPK

SEQ ID NO: 792946 - protein, 26 aa, Mycobacterium
ALNWEPFDLVVCNPPYVPTSPAVDPG

SEQ ID NO: 792947 - protein, 24 aa, Mycobacterium
ALPADPRWGGQLVSLPPGAGEVLA

SEQ ID NO: 792948 - protein, 17 aa, Mycobacterium
ALPAGGTMLAARLPAEL

SEQ ID NO: 792949 - protein, 29 aa, Mycobacterium
ALPALHRGKPFNPLYMHPEAMAGLGLQSG

SEQ ID NO: 792950 - protein, 17 aa, Mycobacterium
ALPALLRERQISGRDAA

SEQ ID NO: 792951 - protein, 30 aa, Mycobacterium
ALPAQLFRSTPIPVCLWFFDTDKGTRSGQV

SEQ ID NO: 792952 - protein, 17 aa, Mycobacterium
ALPARYLTPMSDLKPKS

SEQ ID NO: 792953 - protein, 22 aa, Mycobacterium
ALPATPIIRWLEGVDGPVEEFN

SEQ ID NO: 792954 - protein, 22 aa, Mycobacterium
ALPATVMARWFRTEQARALFGG

SEQ ID NO: 792955 - protein, 19 aa, Mycobacterium
ALPDFSVPAPRNSAQHRSA

SEQ ID NO: 792956 - protein, 18 aa, Mycobacterium
ALPDGSVLRRHSLVRSDN

SEQ ID NO: 792957 - protein, 28 aa, Mycobacterium
ALPDISPRWPPLSKPVIGAINGAAVTGG

SEQ ID NO: 792958 - protein, 23 aa, Mycobacterium
ALPDTLLLHEKWSAAGGVVSTVV

SEQ ID NO: 792959 - protein, 23 aa, Mycobacterium
ALPEFDPFWRDVEVAGLPIVLHA

SEQ ID NO: 792960 - protein, 19 aa, Mycobacterium
ALPELAIYGDPTFIVSTAI

SEQ ID NO: 792961 - protein, 17 aa, Mycobacterium
ALPFGLWVPVLPGTRQV

SEQ ID NO: 792962 - protein, 23 aa, Mycobacterium
ALPGDGFFFAPTVFRVNGRPTEL

SEQ ID NO: 792963 - protein, 26 aa, Mycobacterium
ALPGGLQQLLKTLPNLGIGNIGNANI

SEQ ID NO: 792964 - protein, 21 aa, Mycobacterium
ALPGSWPFVRGGDALRDVKAG

SEQ ID NO: 792965 - protein, 17 aa, Mycobacterium
ALPIAAFSMMRAMSTRN

SEQ ID NO: 792966 - protein, 28 aa, Mycobacterium
ALPIDPEPDLPLRFALNLSVFVGVTAEG

SEQ ID NO: 792967 - protein, 17 aa, Mycobacterium
ALPKPIDHFLVQADLTV

SEQ ID NO: 792968 - protein, 26 aa, Mycobacterium
ALPKVSWVLPGFLLSEHPALPVSIGA

SEQ ID NO: 792969 - protein, 17 aa, Mycobacterium
ALPLEYLGATQSSIDKR

SEQ ID NO: 792970 - protein, 17 aa, Mycobacterium
ALPLHVDIPWSADLAEL

SEQ ID NO: 792971 - protein, 18 aa, Mycobacterium
ALPLMPEPGMRIAVIGGY

SEQ ID NO: 792972 - protein, 19 aa, Mycobacterium
ALPMGIPPNFAAPAANFMA

SEQ ID NO: 792973 - protein, 17 aa, Mycobacterium
ALPNARVLIHQPALSGV

SEQ ID NO: 792974 - protein, 18 aa, Mycobacterium
ALPPLLSELAARTTRRVV

SEQ ID NO: 792975 - protein, 25 aa, Mycobacterium
ALPPRQRRLVILRDLLGISAEEAAH

SEQ ID NO: 792976 - protein, 17 aa, Mycobacterium
ALPPTEPRVLQIRALVL

SEQ ID NO: 792977 - protein, 18 aa, Mycobacterium
ALPREWPIDYDDFRPFYA

SEQ ID NO: 792978 - protein, 20 aa, Mycobacterium
ALPRLVRRRALTYNVSLLLV

SEQ ID NO: 792979 - protein, 18 aa, Mycobacterium
ALPRRGVSALVRRPKRRP

SEQ ID NO: 792980 - protein, 20 aa, Mycobacterium
ALPSEFFFEIAQWANGDSQA

SEQ ID NO: 792981 - protein, 25 aa, Mycobacterium
ALPSMLLPMWDSELGTGLIASLRSL

SEQ ID NO: 792982 - protein, 23 aa, Mycobacterium
ALPSRPVQVIGFTSVPGAGDNFL

SEQ ID NO: 792983 - protein, 18 aa, Mycobacterium
ALPVLEHTGLPYASSERA

SEQ ID NO: 792984 - protein, 19 aa, Mycobacterium
ALPVLPVPPSQKSMLETAF

SEQ ID NO: 792985 - protein, 17 aa, Mycobacterium
ALPVPSLVISQLLGVPY

SEQ ID NO: 792986 - protein, 20 aa, Mycobacterium
ALPVPSVFTSRPQVLKTYTY

SEQ ID NO: 792987 - protein, 18 aa, Mycobacterium
ALPVWKHQFFANGTDEWV

SEQ ID NO: 792988 - protein, 17 aa, Mycobacterium
ALQADPLAPGALARLIL

SEQ ID NO: 792989 - protein, 25 aa, Mycobacterium
ALQAINGYVGLSLLVDRQSGTCIAT

SEQ ID NO: 792990 - protein, 18 aa, Mycobacterium
ALQALELHPLFNPADYVS

SEQ ID NO: 792991 - protein, 23 aa, Mycobacterium
ALQAPLDVLVVRKLGVPFQPELA

SEQ ID NO: 792992 - protein, 37 aa, Mycobacterium
ALQAPSGLMQAPMSALQPLQSMMGMFASPGALGMSGA

SEQ ID NO: 792993 - protein, 23 aa, Mycobacterium
ALQDFDADHFPLLGAVVARRTEA

SEQ ID NO: 792994 - protein, 19 aa, Mycobacterium
ALQDRFFRELPEMAVRRQA

SEQ ID NO: 792995 - protein, 23 aa, Mycobacterium
ALQDVWLALRQYRTRGRPLRVAL

SEQ ID NO: 792996 - protein, 18 aa, Mycobacterium
ALQEFCVAQLWLRDIPPG

SEQ ID NO: 792997 - protein, 17 aa, Mycobacterium
ALQGLRVLVIDLDPQGN

SEQ ID NO: 792998 - protein, 28 aa, Mycobacterium
ALQGMPLVPLGYPRFSLTDDAGLRQAVL

SEQ ID NO: 792999 - protein, 22 aa, Mycobacterium
ALQGVYLDLAPVQLEAGAELAA

SEQ ID NO: 793000 - protein, 17 aa, Mycobacterium
ALQHAILGPAHLPPGFT

SEQ ID NO: 793001 - protein, 17 aa, Mycobacterium
ALQILARTMALTLGRDV

SEQ ID NO: 793002 - protein, 18 aa, Mycobacterium
ALQKFRLDREVRAAILTG

SEQ ID NO: 793003 - protein, 19 aa, Mycobacterium
ALQLGDIENFPFLDPPDKR

SEQ ID NO: 793004 - protein, 18 aa, Mycobacterium
ALQLPPPAGYLDFSAREL

SEQ ID NO: 793005 - protein, 25 aa, Mycobacterium
ALQLRSLPFQPIGIGPLVAARMWQV

SEQ ID NO: 793006 - protein, 19 aa, Mycobacterium
ALQLWVGACLYKGGLDIYR

SEQ ID NO: 793007 - protein, 27 aa, Mycobacterium
ALQMPSIHTKYWYRLFEAVCESKTVLC

SEQ ID NO: 793008 - protein, 17 aa, Mycobacterium
ALQNRPGATRWLGPELG

SEQ ID NO: 793009 - protein, 18 aa, Mycobacterium
ALQQAQFVRITSAGLRES

SEQ ID NO: 793010 - protein, 27 aa, Mycobacterium
ALQRHVTLISLWWSHLRNKGRTGAPRA

SEQ ID NO: 793011 - protein, 25 aa, Mycobacterium
ALQRRPAAVMLSFGELQPFADRIRA

SEQ ID NO: 793012 - protein, 25 aa, Mycobacterium
ALQSAYFIMAIRAVGLAAGPMGGFD

SEQ ID NO: 793013 - protein, 28 aa, Mycobacterium
ALQSWQQALSGLPGLGQAAASAVGAAAA

SEQ ID NO: 793014 - protein, 20 aa, Mycobacterium
ALQVFDSWAGTLSLTDYREY

SEQ ID NO: 793015 - protein, 21 aa, Mycobacterium
ALQVIRAVWTGDDITFEGRHF

SEQ ID NO: 793016 - protein, 18 aa, Mycobacterium
ALQVLAARLQSMAEEQAL

SEQ ID NO: 793017 - protein, 18 aa, Mycobacterium
ALQVPLLDPTDVGAAILQ

SEQ ID NO: 793018 - protein, 21 aa, Mycobacterium
ALQVRTGIAMLSYADTFVFGI

SEQ ID NO: 793019 - protein, 17 aa, Mycobacterium
ALQYEAPYGATLIAKYA

SEQ ID NO: 793020 - protein, 26 aa, Mycobacterium
ALRAAAAALMVPFPPAVAGGSPAAAA

SEQ ID NO: 793021 - protein, 26 aa, Mycobacterium
ALRADLDRFWTQALAGYARAIDETNE

SEQ ID NO: 793022 - protein, 17 aa, Mycobacterium
ALRAKMLDECLSRFVAA

SEQ ID NO: 793023 - protein, 26 aa, Mycobacterium
ALRAPDLATFMALVTAGQPAAPSYFV

SEQ ID NO: 793024 - protein, 24 aa, Mycobacterium
ALRAPLDVLVVRKLGVPFQPELAF

SEQ ID NO: 793025 - protein, 22 aa, Mycobacterium
ALRAPRRTVLDALLLDAAAAAG

SEQ ID NO: 793026 - protein, 26 aa, Mycobacterium
ALRAQKFYVRLFGWKPHAMGESGQAW

SEQ ID NO: 793027 - protein, 31 aa, Mycobacterium
ALRARWPGADLLAAPILRPGSWIGGDRDGNP

SEQ ID NO: 793028 - protein, 19 aa, Mycobacterium
ALRCAYATVLIREANYSQA

SEQ ID NO: 793029 - protein, 18 aa, Mycobacterium
ALRCDARGRWDAQTARTA

SEQ ID NO: 793030 - protein, 30 aa, Mycobacterium
ALRDADVVLLVGARLNWLLGHGEPPQFSRD

SEQ ID NO: 793031 - protein, 29 aa, Mycobacterium
ALRDAGLLTGPVVPGSRYAQWLENASKNG

SEQ ID NO: 793032 - protein, 29 aa, Mycobacterium
ALRDLVARRTPLFEFVIRSALAEHDLDSA

SEQ ID NO: 793033 - protein, 31 aa, Mycobacterium
ALRDMRKHIAWYLHGFPAGGDIRRALALVST

SEQ ID NO: 793034 - protein, 17 aa, Mycobacterium
ALRDRAVYTPRLARRSA

SEQ ID NO: 793035 - protein, 21 aa, Mycobacterium
ALRDRLLFALLAETGMRMGEA

SEQ ID NO: 793036 - protein, 25 aa, Mycobacterium
ALRDTDTKHRLAELGDRLRAAHAEM

SEQ ID NO: 793037 - protein, 28 aa, Mycobacterium
ALRDVVTYRLWRDLARGWRITMPNLEQT

SEQ ID NO: 793038 - protein, 18 aa, Mycobacterium
ALREFIAEVCAMDDVWVA

SEQ ID NO: 793039 - protein, 32 aa, Mycobacterium
ALREGGITAPVLAWLHPPGTDFAPAIAADVEV

SEQ ID NO: 793040 - protein, 26 aa, Mycobacterium
ALREGTVPLQFLFSGTVFTRGAGGLA

SEQ ID NO: 793041 - protein, 17 aa, Mycobacterium
ALREPHRVARYLEDIAG

SEQ ID NO: 793042 - protein, 19 aa, Mycobacterium
ALRERLGLPAAINRYARKS

SEQ ID NO: 793043 - protein, 17 aa, Mycobacterium
ALRESCPIAIPNSLLGM

SEQ ID NO: 793044 - protein, 20 aa, Mycobacterium
ALREVAHEVGFFYLTGHGVS

SEQ ID NO: 793045 - protein, 17 aa, Mycobacterium
ALREYGVRVLVIRPGQV

SEQ ID NO: 793046 - protein, 19 aa, Mycobacterium
ALRFDRAVTFGMRLDIPSG

SEQ ID NO: 793047 - protein, 17 aa, Mycobacterium
ALRFELCLGVSGVHYPD

SEQ ID NO: 793048 - protein, 17 aa, Mycobacterium
ALRGFPNAPMRSVHLWA

SEQ ID NO: 793049 - protein, 27 aa, Mycobacterium
ALRGGATELLLAILRRRPLADTGVQLF

SEQ ID NO: 793050 - protein, 31 aa, Mycobacterium
ALRGGATELLLAILRRVPLADTGVALFGDEA

SEQ ID NO: 793051 - protein, 19 aa, Mycobacterium
ALRGMLKPIYEENQLGRAE

SEQ ID NO: 793052 - protein, 22 aa, Mycobacterium
ALRGTLFMVDTTDLPPIEDPDE

SEQ ID NO: 793053 - protein, 25 aa, Mycobacterium
ALRHGHFAYYSLSALVRLLGEVGLR

SEQ ID NO: 793054 - protein, 26 aa, Mycobacterium
ALRHKVPVFAMAWALVHLAGDGEKTP

SEQ ID NO: 793055 - protein, 26 aa, Mycobacterium
ALRHKVPVFAMAWALVHLAGDGQQTP

SEQ ID NO: 793056 - protein, 25 aa, Mycobacterium
ALRHQPRAVMLSFGDPRPFIGPIRD

SEQ ID NO: 793057 - protein, 20 aa, Mycobacterium
ALRHTSFAQPALFAVEMGLA

SEQ ID NO: 793058 - protein, 25 aa, Mycobacterium
ALRHYELPLRGTDADVLLALSTSYF

SEQ ID NO: 793059 - protein, 22 aa, Mycobacterium
ALRIVRRIVGTLAPKAAPPWDV

SEQ ID NO: 793060 - protein, 19 aa, Mycobacterium
ALRLARRIAAALNAPGGGA

SEQ ID NO: 793061 - protein, 22 aa, Mycobacterium
ALRNLLLRYDGRAEPLLASVPV

SEQ ID NO: 793062 - protein, 23 aa, Mycobacterium
ALRNRIAFYGSTPAYRRVLDVHG

SEQ ID NO: 793063 - protein, 21 aa, Mycobacterium
ALRPAFYSDAIKERFPQINWS

SEQ ID NO: 793064 - protein, 18 aa, Mycobacterium
ALRPDGRPHRFQVTASRF

SEQ ID NO: 793065 - protein, 23 aa, Mycobacterium
ALRPEPRLPAPAGWPFGEDFPRT

SEQ ID NO: 793066 - protein, 20 aa, Mycobacterium
ALRPFLLVASFINPHDVVLF

SEQ ID NO: 793067 - protein, 19 aa, Mycobacterium
ALRPHLMSVAYRLTGTVAD

SEQ ID NO: 793068 - protein, 20 aa, Mycobacterium
ALRPPRRGIYRGVYDAAVDL

SEQ ID NO: 793069 - protein, 26 aa, Mycobacterium
ALRPRPWTKPVAPPSWPRFRTGIAGA

SEQ ID NO: 793070 - protein, 33 aa, Mycobacterium
ALRPYDLSFSRFELLRLLAFSRSGALPITKASD

SEQ ID NO: 793071 - protein, 33 aa, Mycobacterium
ALRPYDLSFSRYELLRLLAFSRSGALPITKASD

SEQ ID NO: 793072 - protein, 33 aa, Mycobacterium; identical to SEQ ID NO: 119059

SEQ ID NO: 793073 - protein, 18 aa, Mycobacterium
ALRQAALVRFLAQGVADT

SEQ ID NO: 793074 - protein, 25 aa, Mycobacterium
ALRQDGMLALARLQRKMRLVESPYR

SEQ ID NO: 793075 - protein, 17 aa, Mycobacterium
ALRQISFRFAADDDQFM

SEQ ID NO: 793076 - protein, 25 aa, Mycobacterium
ALRQMATITELPLTFGGEVHSGTLL

SEQ ID NO: 793077 - protein, 19 aa, Mycobacterium
ALRQVLGPNAVQAGSLNRP

SEQ ID NO: 793078 - protein, 18 aa, Mycobacterium
ALRQYLLDRDALPDSPMV

SEQ ID NO: 793079 - protein, 31 aa, Mycobacterium
ALRRAAKYASGWWSFLTPPDKIAERVEFIKS

SEQ ID NO: 793080 - protein, 18 aa, Mycobacterium
ALRREILPLATVTTPNLF

SEQ ID NO: 793081 - protein, 32 aa, Mycobacterium
ALRRHIYLEETFLFPPLRKAGIMKPIFVMLGE

SEQ ID NO: 793082 - protein, 31 aa, Mycobacterium
ALRRHIYLEEVFLFPPLRDAGIVMPIFVMMR

SEQ ID NO: 793083 - protein, 31 aa, Mycobacterium
ALRRHIYVEEVFLFPPIRQAGMVMPILVMLR

SEQ ID NO: 793084 - protein, 19 aa, Mycobacterium
ALRRKFSASGFIEDVRRYG

SEQ ID NO: 793085 - protein, 29 aa, Mycobacterium
ALRRKFSASNFLVDVRRFGATYANYVGKP

SEQ ID NO: 793086 - protein, 25 aa, Mycobacterium
ALRRSGRIRLPVPRSALAAVDSLNR

SEQ ID NO: 793087 - protein, 21 aa, Mycobacterium
ALRRSIKFGSFLAGIDAVRRV

SEQ ID NO: 793088 - protein, 18 aa, Mycobacterium
ALRRWAHRFYPDTQPAPS

SEQ ID NO: 793089 - protein, 20 aa, Mycobacterium
ALRSALAEEGLPLDAVQLLP

SEQ ID NO: 793090 - protein, 25 aa, Mycobacterium
ALRSAWIGYWVVSTVTRQGVATAAL

SEQ ID NO: 793091 - protein, 18 aa, Mycobacterium
ALRSHQRAIRAIDTGAFT

SEQ ID NO: 793092 - protein, 21 aa, Mycobacterium
ALRSLIPRPLAGRSVLDAGCG

SEQ ID NO: 793093 - protein, 22 aa, Mycobacterium
ALRSLLLRYDGTAEPLLASVPV

SEQ ID NO: 793094 - protein, 18 aa, Mycobacterium
ALRSTFFGSVPPPREAIV

SEQ ID NO: 793095 - protein, 23 aa, Mycobacterium
ALRTLLLRYDGQAEPLLASVPMS

SEQ ID NO: 793096 - protein, 18 aa, Mycobacterium
ALRTMNFAPMTRLLARDV

SEQ ID NO: 793097 - protein, 24 aa, Mycobacterium
ALRVAAYLGGPWRALRVAGVIPAP

SEQ ID NO: 793098 - protein, 18 aa, Mycobacterium
ALRVAELVQRSLIPDSIP

SEQ ID NO: 793099 - protein, 21 aa, Mycobacterium
ALRVGLLDEMKERWRADLLAD

SEQ ID NO: 793100 - protein, 20 aa, Mycobacterium
ALRVIFPPGFAERIGADAVD

SEQ ID NO: 793101 - protein, 17 aa, Mycobacterium
ALRVKFDGGTLPPMFVD

SEQ ID NO: 793102 - protein, 18 aa, Mycobacterium
ALRVKFDGGTLPPMFVDL

SEQ ID NO: 793103 - protein, 24 aa, Mycobacterium
ALRYARLGLVFDPDHFELGRMVEL

SEQ ID NO: 793104 - protein, 19 aa, Mycobacterium
ALRYYLIEQDALPDAPLIA

SEQ ID NO: 793105 - protein, 19 aa, Mycobacterium
ALRYYLIEQDALPGTPLIA

SEQ ID NO: 793106 - protein, 29 aa, Mycobacterium
ALSAAERWHLLASSWLDLPSRPALIGTRG

SEQ ID NO: 793107 - protein, 23 aa, Mycobacterium
ALSAALMLWRKPLASHDPGKIVC

SEQ ID NO: 793108 - protein, 22 aa, Mycobacterium
ALSAFNAWVLVKGLETLAIRVE

SEQ ID NO: 793109 - protein, 31 aa, Mycobacterium
ALSAFNIGGLFLGLVPGYLSAASPPFNIVIS

SEQ ID NO: 793110 - protein, 30 aa, Mycobacterium
ALSAQAALFHQQFVQLMSGGAGQYAAAEAA

SEQ ID NO: 793111 - protein, 17 aa, Mycobacterium
ALSAYFPDSWQCGLLTD

SEQ ID NO: 793112 - protein, 23 aa, Mycobacterium
ALSEGWCPHCGSPYSFLPQLSPG

SEQ ID NO: 793113 - protein, 28 aa, Mycobacterium
ALSEIDEFAFPVAPWMFGAAGREHMKKY

SEQ ID NO: 793114 - protein, 29 aa, Mycobacterium
ALSEKPELAQFTWRTRHNWVSGTHSRATV

SEQ ID NO: 793115 - protein, 19 aa, Mycobacterium
ALSERAYTLLKRAFKQRTV

SEQ ID NO: 793116 - protein, 24 aa, Mycobacterium
ALSEWQRIIDINLTGVFLGIRAVV

SEQ ID NO: 793117 - protein, 24 aa, Mycobacterium
ALSEWRATILVRETAYLAVEDRQK

SEQ ID NO: 793118 - protein, 24 aa, Mycobacterium
ALSFGHLPAIFVPAGPMTSGLPNG

SEQ ID NO: 793119 - protein, 24 aa, Mycobacterium
ALSGLFRDLAVPRLLDRYNTIPAT

SEQ ID NO: 793120 - protein, 27 aa, Mycobacterium
ALSGSGPAYFFLMAEAMVDAGVAVGLS

SEQ ID NO: 793121 - protein, 28 aa, Mycobacterium
ALSGSGPAYFFLMVEALVDAGVAAGLSR

SEQ ID NO: 793122 - protein, 18 aa, Mycobacterium
ALSHLNATLLKRFTKKFA

SEQ ID NO: 793123 - protein, 17 aa, Mycobacterium
ALSHVVLPLPKPVSDAK

SEQ ID NO: 793124 - protein, 24 aa, Mycobacterium
ALSHVYYDDLLYNGFPAGSVTSLG

SEQ ID NO: 793125 - protein, 29 aa, Mycobacterium
ALSKARFEFRWHDQFALSLDPDTAREFHD

SEQ ID NO: 793126 - protein, 27 aa, Mycobacterium
ALSLDDVVKFLLPRGAAKKAAKGAAST

SEQ ID NO: 793127 - protein, 17 aa, Mycobacterium
ALSLIRSFNPDLERGEF

SEQ ID NO: 793128 - protein, 20 aa, Mycobacterium
ALSLKLIEPPPSLTKAQGRR

SEQ ID NO: 793129 - protein, 21 aa, Mycobacterium
ALSLKLIEPPPSLTKARRDAP

SEQ ID NO: 793130 - protein, 17 aa, Mycobacterium
ALSLPLGAGRLTREWLA

SEQ ID NO: 793131 - protein, 19 aa, Mycobacterium
ALSLRHHDFHIGAGGTPWI

SEQ ID NO: 793132 - protein, 18 aa, Mycobacterium
ALSLRRWRRTLLANLTAN

SEQ ID NO: 793133 - protein, 21 aa, Mycobacterium
ALSMHMETQLLTALRTQEVRT

SEQ ID NO: 793134 - protein, 22 aa, Mycobacterium
ALSPLQQGLFALYRLAEDSLDL

SEQ ID NO: 793135 - protein, 29 aa, Mycobacterium
ALSPNALQHYSVFGLLPIAVGQKSGALGI

SEQ ID NO: 793136 - protein, 24 aa, Mycobacterium
ALSPPASWFALNAPGIAGSAPVSV

SEQ ID NO: 793137 - protein, 17 aa, Mycobacterium
ALSPVFAQLLPTAFPNA

SEQ ID NO: 793138 - protein, 23 aa, Mycobacterium
ALSPYVRGDCLVAFDAPLVVTNP

SEQ ID NO: 793139 - protein, 23 aa, Mycobacterium
ALSRALLLCIERVKLIVEPAGAA

SEQ ID NO: 793140 - protein, 24 aa, Mycobacterium
ALSRAPLVPSMLEWLHTARTSMVM

SEQ ID NO: 793141 - protein, 24 aa, Mycobacterium
ALSRFDVLVMPTTPLVATPIPESD

SEQ ID NO: 793142 - protein, 17 aa, Mycobacterium
ALSRFTGRPRFAQLGYT

SEQ ID NO: 793143 - protein, 20 aa, Mycobacterium
ALSRLGCPYVWGATGPGQFD

SEQ ID NO: 793144 - protein, 26 aa, Mycobacterium
ALSRRAAGSLWAAPSGWRVGGVTAPV

SEQ ID NO: 793145 - protein, 32 aa, Mycobacterium
ALSRRLISAWQTPLDWLNIPPGGVALDVGSGP

SEQ ID NO: 793146 - protein, 19 aa, Mycobacterium
ALSSPDRPVRRLMAVSARA

SEQ ID NO: 793147 - protein, 18 aa, Mycobacterium
ALSSWFAATQRPIGGEMA

SEQ ID NO: 793148 - protein, 17 aa, Mycobacterium
ALSTARLSRRLRAAGYL

SEQ ID NO: 793149 - protein, 32 aa, Mycobacterium
ALSTLVVNAIRKTLKAVAVKAPFFGDRRKAFL

SEQ ID NO: 793150 - protein, 25 aa, Mycobacterium
ALSTQMAGFHQQFVTALNSAGASYA

SEQ ID NO: 793151 - protein, 25 aa, Mycobacterium
ALSVGDYHLAKIVGWTLLGHPIDDA

SEQ ID NO: 793152 - protein, 17 aa, Mycobacterium
ALSVRAPIRVRLTQQRP

SEQ ID NO: 793153 - protein, 23 aa, Mycobacterium
ALSVRDMTVCILDRPRHAQLIED

SEQ ID NO: 793154 - protein, 22 aa, Mycobacterium
ALSWAQRWFPSPEGPAVILTHT

SEQ ID NO: 793155 - protein, 17 aa, Mycobacterium
ALSWMDWELATANADLL

SEQ ID NO: 793156 - protein, 17 aa, Mycobacterium
ALSWWRHRQSIIETGIS

SEQ ID NO: 793157 - protein, 17 aa, Mycobacterium
ALTAAALNLHSVGAGMS

SEQ ID NO: 793158 - protein, 26 aa, Mycobacterium
ALTAALNWYRAMFLSTSDPRAKHKVA

SEQ ID NO: 793159 - protein, 20 aa, Mycobacterium
ALTAALRRVLSQPRLAGSMA

SEQ ID NO: 793160 - protein, 23 aa, Mycobacterium
ALTAARVIARDSLVKTAVFGSDP

SEQ ID NO: 793161 - protein, 33 aa, Mycobacterium
ALTAINGPIQTLTGRPLIGNGTPAAAGSGADGA

SEQ ID NO: 793162 - protein, 19 aa, Mycobacterium
ALTAKWNYLRRNYKVLLCY

SEQ ID NO: 793163 - protein, 26 aa, Mycobacterium
ALTAQAATFLEEFLETLTAGARAYAS

SEQ ID NO: 793164 - protein, 20 aa, Mycobacterium
ALTARHWTAHPLCPCGAYFA

SEQ ID NO: 793165 - protein, 26 aa, Mycobacterium
ALTARSLPLVAILWGRDASTLKPILA

SEQ ID NO: 793166 - protein, 24 aa, Mycobacterium
ALTASRFMACPFGAPGTRMYRTGD

SEQ ID NO: 793167 - protein, 23 aa, Mycobacterium
ALTDAFAVGEFYVRSARLGQGEV

SEQ ID NO: 793168 - protein, 26 aa, Mycobacterium
ALTDFPDQRAWLLEDFDNRIGTAVEE

SEQ ID NO: 793169 - protein, 23 aa, Mycobacterium
ALTDIQAAPLRRVRAVIGAAREA

SEQ ID NO: 793170 - protein, 21 aa, Mycobacterium
ALTDLAYFLGCALQPNERRAH

SEQ ID NO: 793171 - protein, 26 aa, Mycobacterium
ALTDVAVLAPVIRPGKILIIGLNYPS

SEQ ID NO: 793172 - protein, 23 aa, Mycobacterium
ALTDYAALLKVHGVERVRMVATS

SEQ ID NO: 793173 - protein, 24 aa, Mycobacterium
ALTEAVFFALSRKAPGFVRWLLRR

SEQ ID NO: 793174 - protein, 21 aa, Mycobacterium
ALTEGITWGWESYPQYLDTIG

SEQ ID NO: 793175 - protein, 27 aa, Mycobacterium
ALTEMLMIVSCYYGLALVLNAVDLDID

SEQ ID NO: 793176 - protein, 21 aa, Mycobacterium
ALTFISGTQWLTHPGSVGVVV

SEQ ID NO: 793177 - protein, 17 aa, Mycobacterium
ALTFPLLSDPDRKALTA

SEQ ID NO: 793178 - protein, 25 aa, Mycobacterium
ALTGEPLRPALPYVAHALREGRLGD

SEQ ID NO: 793179 - protein, 18 aa, Mycobacterium
ALTGLFTFRELRDPGLRT

SEQ ID NO: 793180 - protein, 17 aa, Mycobacterium
ALTGLLGVRKWVRIAGV

SEQ ID NO: 793181 - protein, 24 aa, Mycobacterium
ALTHGRYLGLGFSAYIEATGAATG

SEQ ID NO: 793182 - protein, 25 aa, Mycobacterium
ALTIKKVFLELGGKSAFLVLDDADL

SEQ ID NO: 793183 - protein, 32 aa, Mycobacterium
ALTIPGFSMDGWYGRIFRGCGFFDPDKPIKKF

SEQ ID NO: 793184 - protein, 25 aa, Mycobacterium
ALTKALDIHPIRRTIQHADLVVVRR

SEQ ID NO: 793185 - protein, 18 aa, Mycobacterium
ALTKALLPSMRAAGQGRI

SEQ ID NO: 793186 - protein, 21 aa, Mycobacterium
ALTKLAKFTAKVGYPVRWRDY

SEQ ID NO: 793187 - protein, 22 aa, Mycobacterium
ALTKLNPFTEWLDKMAGLTQQV

SEQ ID NO: 793188 - protein, 17 aa, Mycobacterium
ALTKTLTRDFGAFGIGV

SEQ ID NO: 793189 - protein, 27 aa, Mycobacterium
ALTLDDVVKFLLPRGATKKAAKGAATT

SEQ ID NO: 793190 - protein, 17 aa, Mycobacterium
ALTLFSAWTGVDWSRYG

SEQ ID NO: 793191 - protein, 21 aa, Mycobacterium
ALTLHVLRERIGDKNFFALLQ

SEQ ID NO: 793192 - protein, 20 aa, Mycobacterium
ALTLILTTLLARGHVLIEDL

SEQ ID NO: 793193 - protein, 18 aa, Mycobacterium
ALTLRRYHFPSGTSKIIP

SEQ ID NO: 793194 - protein, 17 aa, Mycobacterium
ALTLTADPARRGQLVSL

SEQ ID NO: 793195 - protein, 18 aa, Mycobacterium
ALTMAEWFRDEAGQDVLL

SEQ ID NO: 793196 - protein, 28 aa, Mycobacterium
ALTMRKAVTPWMRLGLRGMTEPTFDESF

SEQ ID NO: 793197 - protein, 26 aa, Mycobacterium
ALTMSDIRFLKFLRESIFPGGELPSE

SEQ ID NO: 793198 - protein, 26 aa, Mycobacterium
ALTMSDLRFLKFLRESIFPGGEVPSE

SEQ ID NO: 793199 - protein, 26 aa, Mycobacterium
ALTNATLPYVLKLADQGWQAACRSDV

SEQ ID NO: 793200 - protein, 22 aa, Mycobacterium
ALTPGWMALRPLAGRVVKVCSF

SEQ ID NO: 793201 - protein, 24 aa, Mycobacterium
ALTPLGTMYPANFGLGPVAMLGER

SEQ ID NO: 793202 - protein, 18 aa, Mycobacterium
ALTPTLVAAGIDLLVIQG

SEQ ID NO: 793203 - protein, 22 aa, Mycobacterium
ALTQLGVPYHWGGTTPGVGLDC

SEQ ID NO: 793204 - protein, 20 aa, Mycobacterium
ALTQLRRVHPALLDDQLRAS

SEQ ID NO: 793205 - protein, 17 aa, Mycobacterium
ALTQPVSCDLVVIGAGY

SEQ ID NO: 793206 - protein, 23 aa, Mycobacterium
ALTRAALPHLQRGNSPSIVLISS

SEQ ID NO: 793207 - protein, 18 aa, Mycobacterium
ALTREPGLLPRLLEVPAL

SEQ ID NO: 793208 - protein, 19 aa, Mycobacterium
ALTRGIDLRRRVFLHSYEA

SEQ ID NO: 793209 - protein, 21 aa, Mycobacterium
ALTRGIIIADTKFEFGTDAGG

SEQ ID NO: 793210 - protein, 17 aa, Mycobacterium
ALTRKLGERGWIAAGWP

SEQ ID NO: 793211 - protein, 27 aa, Mycobacterium
ALTRLKMYRLLHDLWARRRMAVLHVTH

SEQ ID NO: 793212 - protein, 18 aa, Mycobacterium
ALTRLMLAVNRRFPDVLL

SEQ ID NO: 793213 - protein, 31 aa, Mycobacterium
ALTRLPAVMTQLQKFMWVPQARYEDGFLATG

SEQ ID NO: 793214 - protein, 24 aa, Mycobacterium
ALTRLRRRLPQRPDPHALLGTTFH

SEQ ID NO: 793215 - protein, 23 aa, Mycobacterium
ALTRLVVLRSPFLRDLTEMETSN

SEQ ID NO: 793216 - protein, 22 aa, Mycobacterium
ALTRRLIAASPLRTSHRRPVVS

SEQ ID NO: 793217 - protein, 17 aa, Mycobacterium
ALTSFYQCGDLYRINPH

SEQ ID NO: 793218 - protein, 18 aa, Mycobacterium
ALTSWIRHTHSVGVPVAL

SEQ ID NO: 793219 - protein, 25 aa, Mycobacterium
ALTTDFFVNLLDMSTAWKPSPADDG

SEQ ID NO: 793220 - protein, 17 aa, Mycobacterium
ALTTPEWLALVERCEKV

SEQ ID NO: 793221 - protein, 18 aa, Mycobacterium
ALTVAMKHIKEPPPPLPA

SEQ ID NO: 793222 - protein, 40 aa, Mycobacterium
ALTVFQRTPIWCLPKLDFPVPRLARGFLKYAPGGQLAARA

SEQ ID NO: 793223 - protein, 24 aa, Mycobacterium
ALTVLLKERLLLTVHIDPFTREQT

SEQ ID NO: 793224 - protein, 20 aa, Mycobacterium
ALTVPPPVIASNRALLAALI

SEQ ID NO: 793225 - protein, 33 aa, Mycobacterium
ALTVPVPGTINRFVFALPAIHDRVYLGLTDEPA

SEQ ID NO: 793226 - protein, 21 aa, Mycobacterium
ALTVRLAFDWAQLKPGDKVLI

SEQ ID NO: 793227 - protein, 17 aa, Mycobacterium
ALTWGPLMREIIWRTTG

SEQ ID NO: 793228 - protein, 18 aa, Mycobacterium
ALTYALWALGHHPEIQDR

SEQ ID NO: 793229 - protein, 20 aa, Mycobacterium
ALTYETLTWDAPAEAGYGLA

SEQ ID NO: 793230 - protein, 26 aa, Mycobacterium
ALTYNQIRALLDPLGYARDVGSMAQG

SEQ ID NO: 793231 - protein, 21 aa, Mycobacterium
ALTYPGIRMLATARHLDLAAV

SEQ ID NO: 793232 - protein, 27 aa, Mycobacterium
ALTYTGYSWGPLALTGLAQALGQQGRA

SEQ ID NO: 793233 - protein, 33 aa, Mycobacterium
ALTYVPDFRVLRKLLAVPLYLDAPSTTGVPALA

SEQ ID NO: 793234 - protein, 27 aa, Mycobacterium
ALVAAVWLRPPAGPSVLLLAAHVLAMD

SEQ ID NO: 793235 - protein, 22 aa, Mycobacterium
ALVACFSGAVPDGWRVIGRVLD

SEQ ID NO: 793236 - protein, 24 aa, Mycobacterium
ALVAEPRLLLLDEPFGALDALTRL

SEQ ID NO: 793237 - protein, 25 aa, Mycobacterium
ALVAGLRLRLPIVATALGTYDTASA

SEQ ID NO: 793238 - protein, 25 aa, Mycobacterium
ALVAHPIPRKITFTGSIAGGKNVAV

SEQ ID NO: 793239 - protein, 24 aa, Mycobacterium
ALVAHPRMLILDEPLAALDLRSQH

SEQ ID NO: 793240 - protein, 25 aa, Mycobacterium
ALVAPPTFLAVFGYTAQSAFFEDAN

SEQ ID NO: 793241 - protein, 18 aa, Mycobacterium
ALVARCAALLVILCDPDR

SEQ ID NO: 793242 - protein, 26 aa, Mycobacterium
ALVARDAPLVAILWGRDAATLKPMLG

SEQ ID NO: 793243 - protein, 19 aa, Mycobacterium
ALVARLDRFGIAHAVLAVA

SEQ ID NO: 793244 - protein, 25 aa, Mycobacterium
ALVARLYAQRYLADRGALRGIDADS

SEQ ID NO: 793245 - protein, 28 aa, Mycobacterium
ALVASDIPPLSWFIGNSPPPLLNLLLGE

SEQ ID NO: 793246 - protein, 17 aa, Mycobacterium
ALVAWKLGCSSANAHTL

SEQ ID NO: 793247 - protein, 17 aa, Mycobacterium
ALVCADGDWRRADIPAR

SEQ ID NO: 793248 - protein, 18 aa, Mycobacterium
ALVCADGDWRRAGLPATS

SEQ ID NO: 793249 - protein, 18 aa, Mycobacterium
ALVCAEWPLVVEAKAIAL

SEQ ID NO: 793250 - protein, 32 aa, Mycobacterium; identical to SEQ ID NO: 216148

SEQ ID NO: 793251 - protein, 32 aa, Mycobacterium
ALVCNVPLLDMKRYHLLLAGASWVAEYGDPDN

SEQ ID NO: 793252 - protein, 29 aa, Mycobacterium
ALVDAFFERYGIPILVVYGATEFSGAVAG

SEQ ID NO: 793253 - protein, 25 aa, Mycobacterium
ALVDAFRYRPGQFLTLKIPSEQTGS

SEQ ID NO: 793254 - protein, 20 aa, Mycobacterium
ALVDASWLSQFGQAQAAFNA

SEQ ID NO: 793255 - protein, 28 aa, Mycobacterium
ALVDAVFVEAFRNPLLESLGDSAVLTLP

SEQ ID NO: 793256 - protein, 25 aa, Mycobacterium
ALVDHTIWFHRAADFTDWLLFDQFS

SEQ ID NO: 793257 - protein, 24 aa, Mycobacterium
ALVDIASILSWMPGSGGYGDSKAA

SEQ ID NO: 793258 - protein, 17 aa, Mycobacterium
ALVDLAGRCGAQGDWCD

SEQ ID NO: 793259 - protein, 26 aa, Mycobacterium
ALVDLGSPLWARPAGRAAFTAVLLGP

SEQ ID NO: 793260 - protein, 17 aa, Mycobacterium
ALVDLLDRLLAGGVVIA

SEQ ID NO: 793261 - protein, 24 aa, Mycobacterium
ALVDLLEQPPPQVFRMKGIVAVRE

SEQ ID NO: 793262 - protein, 27 aa, Mycobacterium
ALVDLNNWSLLKWLDEPCSFYDWRRSE

SEQ ID NO: 793263 - protein, 36 aa, Mycobacterium
ALVDPKHWTLLKWLDDPVPFFNWRAGGLRSDVVHPQ

SEQ ID NO: 793264 - protein, 24 aa, Mycobacterium
ALVDVAHWASEFPWCAQAAGVLRK

SEQ ID NO: 793265 - protein, 25 aa, Mycobacterium
ALVEALLVLMCGVGLYAGFVQSPDD

SEQ ID NO: 793266 - protein, 26 aa, Mycobacterium
ALVENSPVIFLGGQRARVTERRVRRG

SEQ ID NO: 793267 - protein, 18 aa, Mycobacterium
ALVERLQVVLLGAQLGDP

SEQ ID NO: 793268 - protein, 18 aa, Mycobacterium
ALVESALWEASLFEEHGF

SEQ ID NO: 793269 - protein, 25 aa, Mycobacterium
ALVETLLVIICGVGLYAGYVESYQQ

SEQ ID NO: 793270 - protein, 24 aa, Mycobacterium
ALVGAQLPWSRLATDAVLGIEGDG

SEQ ID NO: 793271 - protein, 19 aa, Mycobacterium
ALVGAYRKRGSRVAVLAVD

SEQ ID NO: 793272 - protein, 31 aa, Mycobacterium
ALVGKNPPLLPRPWYSYTLTGLIGALKDGQG

SEQ ID NO: 793273 - protein, 18 aa, Mycobacterium
ALVGPCWPAVFSAIGSAV

SEQ ID NO: 793274 - protein, 26 aa, Mycobacterium
ALVGTSRVLLSLRPDLRMPIVETTTS

SEQ ID NO: 793275 - protein, 26 aa, Mycobacterium
ALVHPQIYNHSIRTYLLGAEAARRDG

SEQ ID NO: 793276 - protein, 21 aa, Mycobacterium
ALVITHRPPSCRFWNLVVWNQ

SEQ ID NO: 793277 - protein, 25 aa, Mycobacterium
ALVKAIVYSLFETGFHKGLFHGDLH

SEQ ID NO: 793278 - protein, 23 aa, Mycobacterium
ALVKALLFSVFEGGLRHGLFHGD

SEQ ID NO: 793279 - protein, 17 aa, Mycobacterium
ALVKIPYMPTDLATWYD

SEQ ID NO: 793280 - protein, 17 aa, Mycobacterium
ALVLACAAAGRPAPVDG

SEQ ID NO: 793281 - protein, 28 aa, Mycobacterium
ALVLARVGRLVFGAWEPKTGAVGSLWDV

SEQ ID NO: 793282 - protein, 18 aa, Mycobacterium
ALVLARVGRVVFGAWEPK

SEQ ID NO: 793283 - protein, 20 aa, Mycobacterium
ALVLCHISHVYPTGASLYFT

SEQ ID NO: 793284 - protein, 30 aa, Mycobacterium
ALVLDANFGLPLSILFGVAGAPVAGLDGLA

SEQ ID NO: 793285 - protein, 19 aa, Mycobacterium
ALVLGRPSERWGQEVVALV

SEQ ID NO: 793286 - protein, 19 aa, Mycobacterium
ALVLHYLPEFDMRTGEILG

SEQ ID NO: 793287 - protein, 17 aa, Mycobacterium
ALVLWEAQFGDFVNGAQ

SEQ ID NO: 793288 - protein, 24 aa, Mycobacterium
ALVNLVRQVGVPAWLSYTIEGTRT

SEQ ID NO: 793289 - protein, 25 aa, Mycobacterium
ALVNYPSALLLDEPLGALDLKLRHA

SEQ ID NO: 793290 - protein, 25 aa, Mycobacterium
ALVNYPSALLLDEPLGALDLKLRHV

SEQ ID NO: 793291 - protein, 24 aa, Mycobacterium
ALVPALAKLWAQACAWEPLAPKTL

SEQ ID NO: 793292 - protein, 17 aa, Mycobacterium
ALVQALFNLGEMVTATQ

SEQ ID NO: 793293 - protein, 18 aa, Mycobacterium
ALVQIRYANDEKNGGTGA

SEQ ID NO: 793294 - protein, 27 aa, Mycobacterium
ALVRALNPLINRLPLRLVYAPWAADAW

SEQ ID NO: 793295 - protein, 17 aa, Mycobacterium
ALVREECKEFTVLDSNF

SEQ ID NO: 793296 - protein, 24 aa, Mycobacterium
ALVRELAGLGIWTLGTAETAGGGG

SEQ ID NO: 793297 - protein, 23 aa, Mycobacterium
ALVRHPGIRKIHFTGGGTTARAV

SEQ ID NO: 793298 - protein, 19 aa, Mycobacterium
ALVRLPFGQSVRIGDIVPG

SEQ ID NO: 793299 - protein, 20 aa, Mycobacterium
ALVRLTVSHVVLPTADAETT

SEQ ID NO: 793300 - protein, 27 aa, Mycobacterium
ALVRPSLNIAEWILPSVLAAAPQDLQE

SEQ ID NO: 793301 - protein, 20 aa, Mycobacterium
ALVRTLVEDPRRGRILLGGV

SEQ ID NO: 793302 - protein, 23 aa, Mycobacterium
ALVRVDWISLDPTNRAWINDMPS

SEQ ID NO: 793303 - protein, 27 aa, Mycobacterium
ALVSDPMLLLCDEPLLALDPANARLVS

SEQ ID NO: 793304 - protein, 23 aa, Mycobacterium
ALVSFSRYPVPQPLLVDIVDTMA

SEQ ID NO: 793305 - protein, 27 aa, Mycobacterium
ALVSGLRLRLPIIATTLGTYETASAAA

SEQ ID NO: 793306 - protein, 25 aa, Mycobacterium
ALVSLVLDWHRPVKLFIETKHPVRY

SEQ ID NO: 793307 - protein, 27 aa, Mycobacterium
ALVTAAWREHYPYLVNLAYQMLGDIGD

SEQ ID NO: 793308 - protein, 30 aa, Mycobacterium
ALVTKVPGLALAVLTADCVPVLMADARAGV

SEQ ID NO: 793309 - protein, 17 aa, Mycobacterium
ALVVELLARLHATFWGR

SEQ ID NO: 793310 - protein, 27 aa, Mycobacterium
ALVVGAGAWWHGWSRDDYDALAGAVAA

SEQ ID NO: 793311 - protein, 28 aa, Mycobacterium
ALVVGPPHTLIWPNLFLAEMNVMFVEPQ

SEQ ID NO: 793312 - protein, 24 aa, Mycobacterium
ALVVLERFPVPVLAIAEDGSILFA

SEQ ID NO: 793313 - protein, 17 aa, Mycobacterium
ALVVVSHDRWFLDAVCT

SEQ ID NO: 793314 - protein, 22 aa, Mycobacterium
ALWAATFLRRRGAGACAVLLDP

SEQ ID NO: 793315 - protein, 21 aa, Mycobacterium
ALWAATFLRRRGASACAVLLN

SEQ ID NO: 793316 - protein, 20 aa, Mycobacterium
ALWCMDWPAVAAAGAAGLPP

SEQ ID NO: 793317 - protein, 19 aa, Mycobacterium
ALWEASLFEEHGFGNIKIS

SEQ ID NO: 793318 - protein, 25 aa, Mycobacterium
ALWEENYCVYGVRKLWKAARRAGYD

SEQ ID NO: 793319 - protein, 22 aa, Mycobacterium
ALWETHFIVLLQHFADEYAGAG

SEQ ID NO: 793320 - protein, 20 aa, Mycobacterium
ALWINEPRPLLMNLEQEAEL

SEQ ID NO: 793321 - protein, 17 aa, Mycobacterium
ALWLAEMIEQLDLPEGV

SEQ ID NO: 793322 - protein, 20 aa, Mycobacterium
ALWPNWTPAPLTRRVTEDST

SEQ ID NO: 793323 - protein, 18 aa, Mycobacterium
ALWRRPAFDTDRFVREFF

SEQ ID NO: 793324 - protein, 17 aa, Mycobacterium
ALWVGPVWRSATAIAER

SEQ ID NO: 793325 - protein, 17 aa, Mycobacterium
ALYAFPRLDPEVYDIDD

SEQ ID NO: 793326 - protein, 25 aa, Mycobacterium
ALYDAMFGLLAGQLGDRRATSAAVG

SEQ ID NO: 793327 - protein, 19 aa, Mycobacterium
ALYEMELVGHDFFLFHDKQ

SEQ ID NO: 793328 - protein, 23 aa, Mycobacterium
ALYEMELVGHDFFLFHDQSSGRP

SEQ ID NO: 793329 - protein, 18 aa, Mycobacterium
ALYEPMMELIARSGGNVS

SEQ ID NO: 793330 - protein, 19 aa, Mycobacterium
ALYPEMLARLRQAAAEHAI

SEQ ID NO: 793331 - protein, 23 aa, Mycobacterium
ALYRRWESLWDRLIAACQPDAGA

SEQ ID NO: 793332 - protein, 26 aa, Mycobacterium
ALYRTRGVVPRRLRLLYLSDGEVLDY

SEQ ID NO: 793333 - protein, 27 aa, Mycobacterium
AMAAAAAPYAGWLGLAAARAGDVSAQA

SEQ ID NO: 793334 - protein, 23 aa, Mycobacterium
AMAAAAAPYTGWLSAAAARAVGA

SEQ ID NO: 793335 - protein, 20 aa, Mycobacterium
AMAAGMPGMPFSPMGNHGLG

SEQ ID NO: 793336 - protein, 17 aa, Mycobacterium
AMAALAGAWRNAGGNVI

SEQ ID NO: 793337 - protein, 22 aa, Mycobacterium
AMAEGFEFVAMARALLAEPDLI

SEQ ID NO: 793338 - protein, 17 aa, Mycobacterium
AMAEIGALLRAKFAEPL

SEQ ID NO: 793339 - protein, 19 aa, Mycobacterium
AMAFDTWRLAPPAGSAPLP

SEQ ID NO: 793340 - protein, 26 aa, Mycobacterium
AMAGAELLLGMRRFAPGSSTSLYVYA

SEQ ID NO: 793341 - protein, 28 aa, Mycobacterium
AMAGAELLLGMRRFLPSSPTSLYVYARE

SEQ ID NO: 793342 - protein, 26 aa, Mycobacterium
AMAGAELLLGTRRLAGGSSTSLYVYA

SEQ ID NO: 793343 - protein, 23 aa, Mycobacterium
AMAGFWVTFSSMFKKRLTEQYPE

SEQ ID NO: 793344 - protein, 18 aa, Mycobacterium
AMALRFVADLYESGPASE

SEQ ID NO: 793345 - protein, 18 aa, Mycobacterium
AMALTLRQSQPLVDPAEI

SEQ ID NO: 793346 - protein, 18 aa, Mycobacterium
AMALWFLNFSTWDGVAGI

SEQ ID NO: 793347 - protein, 27 aa, Mycobacterium
AMAPENVSPLVVWLASAEAGAVTGKVF

SEQ ID NO: 793348 - protein, 28 aa, Mycobacterium
AMAPENVSPLVVWLGSVESRDVTGKMFE

SEQ ID NO: 793349 - protein, 33 aa, Mycobacterium
AMAPLVAEAGVPWVLMHWRPVSDDNPHQVPNYR

SEQ ID NO: 793350 - protein, 33 aa, Mycobacterium
AMAPLVAEAGVVWVLMHWRPVSAANPHQVPQYG

SEQ ID NO: 793351 - protein, 23 aa, Mycobacterium
AMAQLLGIAYLRHVLRLEPIAST

SEQ ID NO: 793352 - protein, 22 aa, Mycobacterium
AMAQTLTPQLLERSPDAVIVFV

SEQ ID NO: 793353 - protein, 17 aa, Mycobacterium
AMAQVWTMAGLYGERSG

SEQ ID NO: 793354 - protein, 28 aa, Mycobacterium
AMARATWRMCRDCGYYVPLGGALGVMFG

SEQ ID NO: 793355 - protein, 26 aa, Mycobacterium
AMARECVAAGWLLSLSGTVSFRNARE

SEQ ID NO: 793356 - protein, 22 aa, Mycobacterium
AMARFVETFVRVLGDPELPHLF

SEQ ID NO: 793357 - protein, 27 aa, Mycobacterium
AMARHFDTIARLWDVIGDTGIGFCLDT

SEQ ID NO: 793358 - protein, 20 aa, Mycobacterium
AMARMGLAPADLAERHPQVI

SEQ ID NO: 793359 - protein, 23 aa, Mycobacterium
AMARRCVDAGWLLSLSGTASFRN

SEQ ID NO: 793360 - protein, 24 aa, Mycobacterium
AMARRCVDAGWLLSLSGTASFRNA

SEQ ID NO: 793361 - protein, 25 aa, Mycobacterium
AMASRFLTELMAAHPEWVISEYRPG

SEQ ID NO: 793362 - protein, 20 aa, Mycobacterium
AMATGARRLLRLSIPSPMKT

SEQ ID NO: 793363 - protein, 21 aa, Mycobacterium
AMAVGQAAWRLGAGRSRPGER

SEQ ID NO: 793364 - protein, 18 aa, Mycobacterium
AMAVLGAGLDVAESLLAE

SEQ ID NO: 793365 - protein, 28 aa, Mycobacterium
AMCATCHIYVDDADYLRLPPIADDEDEM

SEQ ID NO: 793366 - protein, 24 aa, Mycobacterium
AMCELEAPDYFRVPKRGKVEIIDP

SEQ ID NO: 793367 - protein, 24 aa, Mycobacterium
AMCELEAPDYFRVPKRGKVEIVDA

SEQ ID NO: 793368 - protein, 18 aa, Mycobacterium
AMDALVAQLTQPVRWDLC

SEQ ID NO: 793369 - protein, 27 aa, Mycobacterium
AMDDLHRHLFTVLMDREWKHGVAAAVD

SEQ ID NO: 793370 - protein, 25 aa, Mycobacterium
AMDEFKAIIRWIQTRGHYSALNVFK

SEQ ID NO: 793371 - protein, 23 aa, Mycobacterium
AMDFYAWGYDKKNHPVRVNPGVF

SEQ ID NO: 793372 - protein, 19 aa, Mycobacterium
AMDLIGERCPILIQLSTGV

SEQ ID NO: 793373 - protein, 20 aa, Mycobacterium
AMDLPEVHGRIHEIRIDEMA

SEQ ID NO: 793374 - protein, 25 aa, Mycobacterium
AMDPDPINSFLQPSGLFGPGQLMSV

SEQ ID NO: 793375 - protein, 24 aa, Mycobacterium
AMDPKLYLVWAKANTSAGYRYSVE

SEQ ID NO: 793376 - protein, 24 aa, Mycobacterium
AMDPQQRLMLEVSWEALEHAGIDP

SEQ ID NO: 793377 - protein, 24 aa, Mycobacterium
AMDPQQRLMLEVSWEALERTGIDP

SEQ ID NO: 793378 - protein, 25 aa, Mycobacterium
AMDRPGLLALLAHALERAGADIRWA

SEQ ID NO: 793379 - protein, 25 aa, Mycobacterium
AMDSRTLYYPVIDEAFRPYAIRRYT

SEQ ID NO: 793380 - protein, 26 aa, Mycobacterium
AMDVVSWHIVLGYLADAWIAVRSGTA

SEQ ID NO: 793381 - protein, 21 aa, Mycobacterium
AMDYVATFDMRRHCTMYLTYW

SEQ ID NO: 793382 - protein, 25 aa, Mycobacterium
AMEEATFLTRFARSVTLVHRREEFR

SEQ ID NO: 793383 - protein, 17 aa, Mycobacterium
AMEFFEEVLPLLARNDE

SEQ ID NO: 793384 - protein, 26 aa, Mycobacterium
AMEGPLPVMVFIHGGGYFLGSSATPL

SEQ ID NO: 793385 - protein, 19 aa, Mycobacterium
AMEIRIQAALRSAPKLPNI

SEQ ID NO: 793386 - protein, 24 aa, Mycobacterium
AMEIWCTQGPLPDIYRPTAAMATP

SEQ ID NO: 793387 - protein, 21 aa, Mycobacterium
AMELGYRHPMGPLRSTDLVGL

SEQ ID NO: 793388 - protein, 18 aa, Mycobacterium
AMELLQKAGVPAGAVLHA

SEQ ID NO: 793389 - protein, 20 aa, Mycobacterium
AMEPLLRKRRGAWVGWPGVP

SEQ ID NO: 793390 - protein, 28 aa, Mycobacterium
AMEVGPDGLLYFPVMGANEIWRIHPDGG

SEQ ID NO: 793391 - protein, 21 aa, Mycobacterium
AMFADVRRALAIAEVIRAATV

SEQ ID NO: 793392 - protein, 22 aa, Mycobacterium
AMFDPSAVFYMEKIAVGPDAAD

SEQ ID NO: 793393 - protein, 19 aa, Mycobacterium
AMFDPSAVFYMNKIAAGPD

SEQ ID NO: 793394 - protein, 20 aa, Mycobacterium
AMFDPSAVFYMNKIAVGPDA

SEQ ID NO: 793395 - protein, 31 aa, Mycobacterium
AMFDVLVEWMSPLLIAYLEAGVEIPPAGTRH

SEQ ID NO: 793396 - protein, 25 aa, Mycobacterium
AMFEQYTDILQLRKLLAGNTPEDRQ

SEQ ID NO: 793397 - protein, 26 aa, Mycobacterium
AMFGVEIQFWVFEETLIRCPIENSLT

SEQ ID NO: 793398 - protein, 23 aa, Mycobacterium
AMGDLKFWGDFDGRGLVILTERP

SEQ ID NO: 793399 - protein, 28 aa, Mycobacterium
AMGDPRILRLYRQRIAPGGFRYGPAFGV

SEQ ID NO: 793400 - protein, 35 aa, Mycobacterium
AMGDRLASWGYVVLVPDVYYREGNWQPFNMATAFG

SEQ ID NO: 793401 - protein, 30 aa, Mycobacterium
AMGFPTRMFTVLFALGRLPGWIAHWREMHG

SEQ ID NO: 793402 - protein, 19 aa, Mycobacterium
AMGLPLAGLRVGDWLVDPQ

SEQ ID NO: 793403 - protein, 28 aa, Mycobacterium
AMGLRPLRHSPLGYGLLLNKPDAALTAS

SEQ ID NO: 793404 - protein, 29 aa, Mycobacterium
AMGMPLSGLRVGDWVVDPRWWDGRRERAV

SEQ ID NO: 793405 - protein, 23 aa, Mycobacterium
AMGPAFWSELPVVFRELDADPDV

SEQ ID NO: 793406 - protein, 17 aa, Mycobacterium
AMGPAFWSEMPELFAAL

SEQ ID NO: 793407 - protein, 22 aa, Mycobacterium
AMGPMQFISETWRLYGVDANND

SEQ ID NO: 793408 - protein, 24 aa, Mycobacterium
AMGQLLGIAYLRHVLQVEPIASAP

SEQ ID NO: 793409 - protein, 26 aa, Mycobacterium
AMGSLTHGFLNLFPLGGGCAAATSEL

SEQ ID NO: 793410 - protein, 28 aa, Mycobacterium
AMGSYPYEDLYMLPAARQFVPVVRNTKL

SEQ ID NO: 793411 - protein, 17 aa, Mycobacterium
AMGTRFLLTSDSTVPDA

SEQ ID NO: 793412 - protein, 25 aa, Mycobacterium
AMGVLAAVPSWAASIPVSMSIPHSG

SEQ ID NO: 793413 - protein, 21 aa, Mycobacterium
AMGWSPFFPQFDRSSLDVADE

SEQ ID NO: 793414 - protein, 18 aa, Mycobacterium
AMGWSRDPTQSALRALIT

SEQ ID NO: 793415 - protein, 20 aa, Mycobacterium
AMGWTPFYPQFNRSSLDVAD

SEQ ID NO: 793416 - protein, 29 aa, Mycobacterium
AMGYEPEDLPWEVPLIELGLDSLMAVRIK

SEQ ID NO: 793417 - protein, 26 aa, Mycobacterium
AMGYPSFHNEYWNPLWKALCDTNTVM

SEQ ID NO: 793418 - protein, 19 aa, Mycobacterium
AMHALLNPGDTILGLSLAH

SEQ ID NO: 793419 - protein, 29 aa, Mycobacterium
AMHDQLMRLWVEAEVFRLAGERLRQQAAT

SEQ ID NO: 793420 - protein, 18 aa, Mycobacterium
AMHDSDLPRPVLDRNGLA

SEQ ID NO: 793421 - protein, 25 aa, Mycobacterium
AMHFNAVYFGIHKLGAVPVPLNTRW

SEQ ID NO: 793422 - protein, 19 aa, Mycobacterium
AMHGARWIDPSRPAEIIDT

SEQ ID NO: 793423 - protein, 17 aa, Mycobacterium
AMHGFIRGAAAYGARRG

SEQ ID NO: 793424 - protein, 18 aa, Mycobacterium
AMHGFIRGVATLGVRRGD

SEQ ID NO: 793425 - protein, 20 aa, Mycobacterium
AMHLRTGVAMLSYSDDLYFG

SEQ ID NO: 793426 - protein, 17 aa, Mycobacterium
AMHQTIYQILRDTGRRP

SEQ ID NO: 793427 - protein, 19 aa, Mycobacterium
AMIALYADLDEAGALPFRV

SEQ ID NO: 793428 - protein, 20 aa, Mycobacterium
AMIANRVSYAFALHGPSMTV

SEQ ID NO: 793429 - protein, 17 aa, Mycobacterium
AMIARRYMHLSGATSRD

SEQ ID NO: 793430 - protein, 28 aa, Mycobacterium
AMIASQKYLPRWLSEGLNRLLGGEHVFT

SEQ ID NO: 793431 - protein, 19 aa, Mycobacterium
AMISVCRACPRLVAWREEV

SEQ ID NO: 793432 - protein, 17 aa, Mycobacterium
AMKAAGWAMSDAKRFSL

SEQ ID NO: 793433 - protein, 19 aa, Mycobacterium
AMKAARVLSLAQDTADRLT

SEQ ID NO: 793434 - protein, 33 aa, Mycobacterium
AMKVPWVEPSDISNAVLWLASDESRFVTGMQLR

SEQ ID NO: 793435 - protein, 18 aa, Mycobacterium
AMLDRLDYVPVPQRDALS

SEQ ID NO: 793436 - protein, 24 aa, Mycobacterium
AMLGAAEPYIAWLSATSAQAEQTA

SEQ ID NO: 793437 - protein, 31 aa, Mycobacterium
AMLGQPVSMLIPRVVGFKITGERRPGVTATD

SEQ ID NO: 793438 - protein, 26 aa, Mycobacterium
AMLGQPVSMLIPRVVGFKLSGEIKPG

SEQ ID NO: 793439 - protein, 22 aa, Mycobacterium
AMLLSRSLALVAAFDHRHVFID

SEQ ID NO: 793440 - protein, 18 aa, Mycobacterium
AMLLTFVGDLTAVSVLVE

SEQ ID NO: 793441 - protein, 25 aa, Mycobacterium
AMLPTSLPDFSLPAAALTGGSPTAW

SEQ ID NO: 793442 - protein, 28 aa, Mycobacterium
AMLQAFIGRMGGVPPSAWGGPAATRFKD

SEQ ID NO: 793443 - protein, 18 aa, Mycobacterium
AMLQLIPEPARAVAEMVR

SEQ ID NO: 793444 - protein, 17 aa, Mycobacterium
AMLRDCPGLRLLVTSRE

SEQ ID NO: 793445 - protein, 19 aa, Mycobacterium
AMLRDWLDAELADSSLAVL

SEQ ID NO: 793446 - protein, 34 aa, Mycobacterium
AMLRGQLLHSWYMLLFQIPRLPEWLFGFNETEAF

SEQ ID NO: 793447 - protein, 25 aa, Mycobacterium
AMLRGWTPLIALQVEYSLLARTVES

SEQ ID NO: 793448 - protein, 19 aa, Mycobacterium
AMLRNITGLAIVDPTDRRA

SEQ ID NO: 793449 - protein, 30 aa, Mycobacterium
AMLRRNCLTLMRLCHHYAGPMVSRGRGAVV

SEQ ID NO: 793450 - protein, 17 aa, Mycobacterium
AMLSRMPMKMNETMLIS

SEQ ID NO: 793451 - protein, 18 aa, Mycobacterium
AMLVSDLVNVRYLSGFTG

SEQ ID NO: 793452 - protein, 28 aa, Mycobacterium
AMLVTDLINVRYLSGFSGSNGALLVFAD

SEQ ID NO: 793453 - protein, 26 aa, Mycobacterium
AMLVTDLVNVRYLSGFTGSNAALLVR

SEQ ID NO: 793454 - protein, 17 aa, Mycobacterium
AMMCSESVWWRCHRRLV

SEQ ID NO: 793455 - protein, 26 aa, Mycobacterium
AMMSGLDIRYDLGDGHPLLGRRMPDL

SEQ ID NO: 793456 - protein, 25 aa, Mycobacterium
AMMSGLDIRYEFGDGHPLLGRRMPD

SEQ ID NO: 793457 - protein, 26 aa, Mycobacterium
AMMSGLGIRYDLGEGHPLLGRRMPDL

SEQ ID NO: 793458 - protein, 19 aa, Mycobacterium
AMNMGMDGAWGQWVNRWTA

SEQ ID NO: 793459 - protein, 21 aa, Mycobacterium
AMNRVFVRCAMVPAPVETIWH

SEQ ID NO: 793460 - protein, 18 aa, Mycobacterium
AMNTVFDGIAPLLGDLRA

SEQ ID NO: 793461 - protein, 18 aa, Mycobacterium
AMNVMLRRTFKATLDFTA

SEQ ID NO: 793462 - protein, 38 aa, Mycobacterium
AMNVTYLHHIAPRLKVLGLCHSVYWTMVGLCELIDVPY

SEQ ID NO: 793463 - protein, 39 aa, Mycobacterium
AMPCNQLPAPVRALSKALPMLKPIVPDPGFPLQLVHHDD

SEQ ID NO: 793464 - protein, 20 aa, Mycobacterium
AMPLIKFIDGYETVEEMATA

SEQ ID NO: 793465 - protein, 18 aa, Mycobacterium
AMPMDAWRDGEQFVVEFD

SEQ ID NO: 793466 - protein, 22 aa, Mycobacterium
AMPQEWFHDLLGPDGRPFRDTE

SEQ ID NO: 793467 - protein, 25 aa, Mycobacterium
AMPRPERLRWYVYTDELPPLTVTAP

SEQ ID NO: 793468 - protein, 20 aa, Mycobacterium
AMPRPLQFLTGEAVLLESRE

SEQ ID NO: 793469 - protein, 25 aa, Mycobacterium
AMPTMPTLPTMPFTGSPGGDDMGAT

SEQ ID NO: 793470 - protein, 28 aa, Mycobacterium
AMPVETLEFFWGLGIPVYEVWGESECVG

SEQ ID NO: 793471 - protein, 19 aa, Mycobacterium
AMPVLKPLHDEAGLTRLIV

SEQ ID NO: 793472 - protein, 18 aa, Mycobacterium
AMPVLKPLHEEAGLQRLI

SEQ ID NO: 793473 - protein, 18 aa, Mycobacterium
AMPVLKVLHDEAELVRLV

SEQ ID NO: 793474 - protein, 27 aa, Mycobacterium
AMPVLPQQALLYRLCGDRNPLHSDPEF

SEQ ID NO: 793475 - protein, 18 aa, Mycobacterium
AMPVYRFGNDAQKQEWLP

SEQ ID NO: 793476 - protein, 18 aa, Mycobacterium
AMPYDLAGRKLLVTAGGT

SEQ ID NO: 793477 - protein, 26 aa, Mycobacterium
AMQFAYQFPQLVDRLILVGAGGVTKD

SEQ ID NO: 793478 - protein, 21 aa, Mycobacterium
AMQHLKLHGSLYMMANRDRDL

SEQ ID NO: 793479 - protein, 23 aa, Mycobacterium
AMQLHGGIGYTWESGIHTYLKRA

SEQ ID NO: 793480 - protein, 18 aa, Mycobacterium
AMRAGVVMVPLNWRLVTA

SEQ ID NO: 793481 - protein, 22 aa, Mycobacterium
AMRAIIARYRRHQPILIALNEM

SEQ ID NO: 793482 - protein, 19 aa, Mycobacterium
AMRAILDRFGARWRRDDLG

SEQ ID NO: 793483 - protein, 26 aa, Mycobacterium
AMRDAELLRRFIPFDVDAGVLRSAGA

SEQ ID NO: 793484 - protein, 19 aa, Mycobacterium
AMRDGKAKVFMAMGGNFVS

SEQ ID NO: 793485 - protein, 18 aa, Mycobacterium
AMRDGQAAVFMAMGGNFA

SEQ ID NO: 793486 - protein, 18 aa, Mycobacterium
AMRDGRAKVFVGMGGNFA

SEQ ID NO: 793487 - protein, 17 aa, Mycobacterium
AMRDLLRRMQPTEFNDI

SEQ ID NO: 793488 - protein, 23 aa, Mycobacterium
AMRELVILHELAHHLCPQDGPAH

SEQ ID NO: 793489 - protein, 25 aa, Mycobacterium
AMREMGLFGLMIPEEYGGLGESLLT

SEQ ID NO: 793490 - protein, 26 aa, Mycobacterium
AMRMLTLPATFALYLERAWPRHRRLS

SEQ ID NO: 793491 - protein, 17 aa, Mycobacterium
AMRRAGTALFPQAPVDA

SEQ ID NO: 793492 - protein, 20 aa, Mycobacterium
AMRRNVNITVLLFNNRIYGL

SEQ ID NO: 793493 - protein, 27 aa, Mycobacterium
AMRRRKDLLPLISFLTRSHAEIITERF

SEQ ID NO: 793494 - protein, 20 aa, Mycobacterium
AMRRWMDSFGDWIATKNGML

SEQ ID NO: 793495 - protein, 23 aa, Mycobacterium
AMRSLSEFWGPQGYPGVLFVAAG

SEQ ID NO: 793496 - protein, 17 aa, Mycobacterium
AMRTPHWHANANELTYC

SEQ ID NO: 793497 - protein, 19 aa, Mycobacterium
AMRVLTGPRWRLGGSDVAA

SEQ ID NO: 793498 - protein, 22 aa, Mycobacterium
AMRVYSRIRLADRHPVIHNLVV

SEQ ID NO: 793499 - protein, 18 aa, Mycobacterium
AMRWSDMAGMQRSLIERA

SEQ ID NO: 793500 - protein, 22 aa, Mycobacterium
AMSAAAVPYADWLSASAAHAQR

SEQ ID NO: 793501 - protein, 23 aa, Mycobacterium
AMSAFNAWVLLKGLETLAVRVEC

SEQ ID NO: 793502 - protein, 24 aa, Mycobacterium
AMSAFNAWVLLKGLETMAIRVEHS

SEQ ID NO: 793503 - protein, 19 aa, Mycobacterium
AMSFGLTALQTARGQYWIH

SEQ ID NO: 793504 - protein, 19 aa, Mycobacterium
AMSFGLTAPEMARGQYWIH

SEQ ID NO: 793505 - protein, 41 aa, Mycobacterium
AMSGWQRLHFRFGIPEPLLEPLAVERLYLNNYFSIAKATRD

SEQ ID NO: 793506 - protein, 23 aa, Mycobacterium
AMSKFEVLVAMAFVAFADAPVDI

SEQ ID NO: 793507 - protein, 22 aa, Mycobacterium
AMSLVRLTELPAGMPVAVVVRQ

SEQ ID NO: 793508 - protein, 24 aa, Mycobacterium
AMSMLMIPPFMHGAAQWASYTAIT

SEQ ID NO: 793509 - protein, 26 aa, Mycobacterium
AMSPICPNVIWAMDFQFDTTADGRTL

SEQ ID NO: 793510 - protein, 20 aa, Mycobacterium
AMSTFRIHRRKKALLQRLPF

SEQ ID NO: 793511 - protein, 18 aa, Mycobacterium
AMSTGPWLRRRKGAEIVD

SEQ ID NO: 793512 - protein, 28 aa, Mycobacterium
AMSVGSFNYLRSDDRWVWSDAVAAMHGY

SEQ ID NO: 793513 - protein, 23 aa, Mycobacterium
AMSVQALIDWGLQPGSGSVVVTG

SEQ ID NO: 793514 - protein, 21 aa, Mycobacterium
AMSVVLYHFGTKDGLIEAVIA

SEQ ID NO: 793515 - protein, 25 aa, Mycobacterium
AMSYRTLMADLAALYLGRDLPELGY

SEQ ID NO: 793516 - protein, 23 aa, Mycobacterium
AMTAFDWFSWRLNKKVEDTQRRE

SEQ ID NO: 793517 - protein, 18 aa, Mycobacterium
AMTAFLEAYPDGGPHLQN

SEQ ID NO: 793518 - protein, 17 aa, Mycobacterium
AMTALDWTQWRVTKKAE

SEQ ID NO: 793519 - protein, 26 aa, Mycobacterium
AMTARAVGLLMRLPQRGIVTVATNVP

SEQ ID NO: 793520 - protein, 25 aa, Mycobacterium
AMTDRPLHHFPTRRMCNLASVTSFY

SEQ ID NO: 793521 - protein, 18 aa, Mycobacterium
AMTFGYLAALDIAATAAA

SEQ ID NO: 793522 - protein, 25 aa, Mycobacterium
AMTGKFEWLDNKVVQWVPDRYWPAH

SEQ ID NO: 793523 - protein, 23 aa, Mycobacterium
AMTGLAVLDLYAGSGALGLEALS

SEQ ID NO: 793524 - protein, 28 aa, Mycobacterium
AMTIAPRTLLCLSTWRAGGHLSDTGFDE

SEQ ID NO: 793525 - protein, 30 aa, Mycobacterium
AMTIGTLKAIRRLGLSIPGDVAFVCYDDFE

SEQ ID NO: 793526 - protein, 17 aa, Mycobacterium
AMTLKCPVALVRSVHAG

SEQ ID NO: 793527 - protein, 20 aa, Mycobacterium
AMTPAFLRVFGFRGGTARAV

SEQ ID NO: 793528 - protein, 29 aa, Mycobacterium
AMTSPAQYWRAVIKAYFDAFGSHRALTVA

SEQ ID NO: 793529 - protein, 19 aa, Mycobacterium
AMTTPKWVHNRIQPIAVRD

SEQ ID NO: 793530 - protein, 19 aa, Mycobacterium
AMTVKCAVALIKSVPAGEG

SEQ ID NO: 793531 - protein, 25 aa, Mycobacterium
AMTVPPPVILANRMQLMSLVATNFF

SEQ ID NO: 793532 - protein, 24 aa, Mycobacterium
AMTVPPPVVAANRALLAALVATNF

SEQ ID NO: 793533 - protein, 26 aa, Mycobacterium
AMVAAITVAITHGWSLAKSVRYGIAA

SEQ ID NO: 793534 - protein, 32 aa, Mycobacterium
AMVAAITVGLSRGWPLPKSVRYGIAAGAAMLL

SEQ ID NO: 793535 - protein, 26 aa, Mycobacterium
AMVANLPYNVAVPALLRILTEFDSVK

SEQ ID NO: 793536 - protein, 32 aa, Mycobacterium
AMVAPIVRAHRLYGLLYAARRSPVAWTDRDRA

SEQ ID NO: 793537 - protein, 25 aa, Mycobacterium
AMVATAMRVVNAVPYVVAAKPGLLS

SEQ ID NO: 793538 - protein, 29 aa, Mycobacterium
AMVDFMATRTAFFDEFFLGAADAGVRQVV

SEQ ID NO: 793539 - protein, 24 aa, Mycobacterium
AMVFQDNALLPWRTVRSNIELALK

SEQ ID NO: 793540 - protein, 17 aa, Mycobacterium
AMVFREPALMNTFASVS

SEQ ID NO: 793541 - protein, 24 aa, Mycobacterium
AMVGDVIMASRWLDYHAAVAFSVT

SEQ ID NO: 793542 - protein, 19 aa, Mycobacterium
AMVGLPPPPDLPPGELTTL

SEQ ID NO: 793543 - protein, 40 aa, Mycobacterium
AMVHPLAVAANRSAFLKLVQSNWLGLNAPAIMATEGHYEQ

SEQ ID NO: 793544 - protein, 23 aa, Mycobacterium
AMVHVDMYRLLDEPGADLLGELD

SEQ ID NO: 793545 - protein, 22 aa, Mycobacterium
AMVLRRLLRLCARYAPAGDVSG

SEQ ID NO: 793546 - protein, 32 aa, Mycobacterium
AMVQALLVRSLVAWFWDEPLRAPLIRHGANLH

SEQ ID NO: 793547 - protein, 31 aa, Mycobacterium
AMVQEAVDRWWWPALMMFGPPDADSPNTAQS

SEQ ID NO: 793548 - protein, 33 aa, Mycobacterium
AMVQSLLVRALVARFWAQPLSAPLVRHGANLHG

SEQ ID NO: 793549 - protein, 32 aa, Mycobacterium
AMVQSLLVRSLVAWFWDEPLRAPLIRHGANLH

SEQ ID NO: 793550 - protein, 24 aa, Mycobacterium
AMVRSPHFRGFTRLGGELTGGLTD

SEQ ID NO: 793551 - protein, 17 aa, Mycobacterium
AMVSAARGYKCVLTMPD

SEQ ID NO: 793552 - protein, 19 aa, Mycobacterium
AMVWKRPRWSARLQRDPVA

SEQ ID NO: 793553 - protein, 21 aa, Mycobacterium
AMWDPAFAQVAERRHWRLETL

SEQ ID NO: 793554 - protein, 21 aa, Mycobacterium
AMWQVIAIGRANLELTAMGLA

SEQ ID NO: 793555 - protein, 20 aa, Mycobacterium
AMYHQFADKAALFREVVEVV

SEQ ID NO: 793556 - protein, 21 aa, Mycobacterium
AMYNNAPALKLYLGDSFEGVI

SEQ ID NO: 793557 - protein, 19 aa, Mycobacterium
AMYPLGPIIAGAGLNITVM

SEQ ID NO: 793558 - protein, 19 aa, Mycobacterium
AMYVDKLLEMGLASEWGIC

SEQ ID NO: 793559 - protein, 18 aa, Mycobacterium
ANAAFFRHPPRTPPTRPG

SEQ ID NO: 793560 - protein, 17 aa, Mycobacterium
ANAAFWGHRNPDQLGPV

SEQ ID NO: 793561 - protein, 36 aa, Mycobacterium
ANAAPSLLNAINAPSLALLGRPLIGNGADGAPGTGA

SEQ ID NO: 793562 - protein, 24 aa, Mycobacterium
ANAAVLHALMSPGERLLGLDLANG

SEQ ID NO: 793563 - protein, 17 aa, Mycobacterium
ANAAYWGFKNPDQLAPV

SEQ ID NO: 793564 - protein, 17 aa, Mycobacterium
ANADTVTLWSKLALESA

SEQ ID NO: 793565 - protein, 29 aa, Mycobacterium
ANAELLYEAGLPRDLFAVVPGPGSVVGTA

SEQ ID NO: 793566 - protein, 27 aa, Mycobacterium
ANAEPPERLIPGPLVWDLTTGVATDTP

SEQ ID NO: 793567 - protein, 18 aa, Mycobacterium
ANAEYLRVHRRARAAELL

SEQ ID NO: 793568 - protein, 17 aa, Mycobacterium
ANAFAQEELTRAGAAFA

SEQ ID NO: 793569 - protein, 37 aa, Mycobacterium
ANAFLDAFAHHRQGLGLPALTIGWGPWSVGMVEELGL

SEQ ID NO: 793570 - protein, 29 aa, Mycobacterium
ANAFTNIGFGNSGFFNFGFGNSGTGNTGV

SEQ ID NO: 793571 - protein, 26 aa, Mycobacterium
ANAHYANMLLAFYLATGQDAANIIAG

SEQ ID NO: 793572 - protein, 24 aa, Mycobacterium
ANAICPGFIATPLAEGVFGMPGME

SEQ ID NO: 793573 - protein, 23 aa, Mycobacterium
ANAIMFMIIGANMLARQLLPGEH

SEQ ID NO: 793574 - protein, 24 aa, Mycobacterium
ANAKTVFFMMREAARRMADNGRIL

SEQ ID NO: 793575 - protein, 27 aa, Mycobacterium
ANALALQFGWRLFAPVLRSATGIEELT

SEQ ID NO: 793576 - protein, 19 aa, Mycobacterium
ANALAVRGIARYSLGLPGW

SEQ ID NO: 793577 - protein, 24 aa, Mycobacterium
ANAPIRIEFEALQSEFVKQGMAAS

SEQ ID NO: 793578 - protein, 18 aa, Mycobacterium
ANAPLLPVTGIEVLLSGL

SEQ ID NO: 793579 - protein, 23 aa, Mycobacterium
ANAQLWRFVVLDAPEQRAAVAGA

SEQ ID NO: 793580 - protein, 38 aa, Mycobacterium
ANAQQNLLNAVNGPTQAWLGRPLIGNGTDGAAGTGQAG

SEQ ID NO: 793581 - protein, 17 aa, Mycobacterium
ANASAMHALLNPGDTIL

SEQ ID NO: 793582 - protein, 30 aa, Mycobacterium
ANASIPTPQPVLPRPMFGAAPAAAAHTSVH

SEQ ID NO: 793583 - protein, 31 aa, Mycobacterium
ANASIPTPQPVLPRPMFGASPAVAAATSVHF

SEQ ID NO: 793584 - protein, 22 aa, Mycobacterium
ANASPLAQLLAAVNAPVQALTG

SEQ ID NO: 793585 - protein, 40 aa, Mycobacterium
ANASPLQELLNAVNAPTQALLGRPLIGNGTDGAPGTGADG

SEQ ID NO: 793586 - protein, 26 aa, Mycobacterium
ANATSQLYYVLYGRGFAAVNGQLVGW

SEQ ID NO: 793587 - protein, 18 aa, Mycobacterium
ANAVCSGFLFAINTAHAL

SEQ ID NO: 793588 - protein, 23 aa, Mycobacterium
ANAWGLTEFPVAASPTLTAAPEA

SEQ ID NO: 793589 - protein, 24 aa, Mycobacterium
ANAYLDAFALYQRRTCGIAAHSVA

SEQ ID NO: 793590 - protein, 23 aa, Mycobacterium
ANDAPIQRFWRDAHAGRVHAAND

SEQ ID NO: 793591 - protein, 40 aa, Mycobacterium
ANDDTVILYGGNNNWFAAYAYWYFKLYGHQDVKLLDGGRK

SEQ ID NO: 793592 - protein, 40 aa, Mycobacterium
ANDDTVILYGGNNNWFAAYAYWYFKLYGHQNVKLLDGGRK

SEQ ID NO: 793593 - protein, 24 aa, Mycobacterium
ANDGFAAELLEWLRNRLAHYKCPR

SEQ ID NO: 793594 - protein, 23 aa, Mycobacterium
ANDLDRIFLVAPSSTHERLAKTI

SEQ ID NO: 793595 - protein, 23 aa, Mycobacterium
ANDLFPMTLMGLTSEVRRVRASE

SEQ ID NO: 793596 - protein, 28 aa, Mycobacterium
ANDPAETRYWYYALQTCRLNEHRAGSGQ

SEQ ID NO: 793597 - protein, 22 aa, Mycobacterium
ANDPEHPYLLILDEMNLAHVER

SEQ ID NO: 793598 - protein, 23 aa, Mycobacterium
ANDPRTVRLRRGLTLPPACRCCG

SEQ ID NO: 793599 - protein, 34 aa, Mycobacterium
ANDPVVWVDHPPYRPFWAITKHADIMAIERANDL

SEQ ID NO: 793600 - protein, 23 aa, Mycobacterium
ANDQPVQRFWRDAHAGRVHAAND

SEQ ID NO: 793601 - protein, 18 aa, Mycobacterium
ANDRGVFVLAATSNPEGA

SEQ ID NO: 793602 - protein, 19 aa, Mycobacterium
ANDVYPPLSKFLGKRLRQP

SEQ ID NO: 793603 - protein, 25 aa, Mycobacterium
ANEADYFIRMWNQAASAMDVYQAET

SEQ ID NO: 793604 - protein, 24 aa, Mycobacterium
ANEDKLPRHLLLGRDAVERWRVKA

SEQ ID NO: 793605 - protein, 23 aa, Mycobacterium
ANEGLCAIGLRFSEDKTAPRERF

SEQ ID NO: 793606 - protein, 17 aa, Mycobacterium
ANEILVAAALGNNNSAI

SEQ ID NO: 793607 - protein, 25 aa, Mycobacterium
ANELDALLWRAARPGEPSWEASFGP

SEQ ID NO: 793608 - protein, 20 aa, Mycobacterium
ANELILRRLRAERPDDAVLS

SEQ ID NO: 793609 - protein, 17 aa, Mycobacterium
ANELLFERFLSPARDGP

SEQ ID NO: 793610 - protein, 18 aa, Mycobacterium
ANELLFERFLSPARDGPP

SEQ ID NO: 793611 - protein, 28 aa, Mycobacterium
ANEPTPQFGPFARSYLAGLIAGLRSETG

SEQ ID NO: 793612 - protein, 24 aa, Mycobacterium
ANEQWIPGGFLPDGASEAVVDGGR

SEQ ID NO: 793613 - protein, 35 aa, Mycobacterium
ANEVGLAILGPLRDLDEVAYLRFASVYRSFSSAED

SEQ ID NO: 793614 - protein, 25 aa, Mycobacterium
ANFAVNPLQWVPVPEGRLVLQTIRS

SEQ ID NO: 793615 - protein, 44 aa, Mycobacterium
ANFDQLMRSFFARSPLPQDATLVSWLPFYHDMGLVLGVCAPILC

SEQ ID NO: 793616 - protein, 29 aa, Mycobacterium
ANFDRSYRLAWWPTRLPTLIVSGAADRIV

SEQ ID NO: 793617 - protein, 25 aa, Mycobacterium
ANFDSPLSLLTPQLARLAAIGGFRK

SEQ ID NO: 793618 - protein, 25 aa, Mycobacterium
ANFDSPLSLLTPQLARLAAIGGFRN

SEQ ID NO: 793619 - protein, 21 aa, Mycobacterium
ANFEGGWLLRFMSGNLCHQIE

SEQ ID NO: 793620 - protein, 23 aa, Mycobacterium
ANFEYGLNCILDHAGRLIEERPK

SEQ ID NO: 793621 - protein, 32 aa, Mycobacterium
ANFHGHHLDDIISLSFFTPAVNQIELHPLLNQ

SEQ ID NO: 793622 - protein, 24 aa, Mycobacterium
ANFLATLPQFVEFVRDGHFDQVAH

SEQ ID NO: 793623 - protein, 20 aa, Mycobacterium
ANFLIQFAANCRRASWKRAM

SEQ ID NO: 793624 - protein, 18 aa, Mycobacterium
ANFPSSFAAASYLPDSGF

SEQ ID NO: 793625 - protein, 31 aa, Mycobacterium
ANFSVSPLQWVPVPPGRLILQTLRSHDQYNT

SEQ ID NO: 793626 - protein, 24 aa, Mycobacterium
ANFTIKGITAELPLPVTISELDDG

SEQ ID NO: 793627 - protein, 40 aa, Mycobacterium
ANGFLNGGVTLPLLLPIGLGFVVLDVPFDGILVAPHATTA

SEQ ID NO: 793628 - protein, 25 aa, Mycobacterium
ANGFNAMRLGVFWTAVEPQPLTYDD

SEQ ID NO: 793629 - protein, 26 aa, Mycobacterium
ANGFTLLIPPVLVKPEIMGGTGFLGA

SEQ ID NO: 793630 - protein, 22 aa, Mycobacterium
ANGGAAGWLLGDGGAGGSGGLE

SEQ ID NO: 793631 - protein, 27 aa, Mycobacterium
ANGGARPWLPHFYLGHGIGVNAAEMPM

SEQ ID NO: 793632 - protein, 27 aa, Mycobacterium
ANGGTKPWLPHFYLGHGIGVNAAEMPM

SEQ ID NO: 793633 - protein, 27 aa, Mycobacterium
ANGGVRPWLPHFYLGHGIGVNAAEMPM

SEQ ID NO: 793634 - protein, 17 aa, Mycobacterium
ANGKRLLANLGKAKAQP

SEQ ID NO: 793635 - protein, 30 aa, Mycobacterium
ANGLSVPRFPTALSTALRPLLPPSAGVTNP

SEQ ID NO: 793636 - protein, 20 aa, Mycobacterium
ANGPLAVQAILRTIRETEGM

SEQ ID NO: 793637 - protein, 20 aa, Mycobacterium
ANGPWIADRLLELGVELAHI

SEQ ID NO: 793638 - protein, 25 aa, Mycobacterium
ANGQIHDWILLTPDGFQYWPQINRE

SEQ ID NO: 793639 - protein, 18 aa, Mycobacterium
ANGRFLGGAERWLRRIAA

SEQ ID NO: 793640 - protein, 23 aa, Mycobacterium
ANGRLLMLGLGPGTDLMFLPDTV

SEQ ID NO: 793641 - protein, 25 aa, Mycobacterium
ANGTDYVLTLRAWLQAQGDPTEAGE

SEQ ID NO: 793642 - protein, 34 aa, Mycobacterium
ANGTTLEMLLEHNGLKPLPRWNELDPESVRFWEE

SEQ ID NO: 793643 - protein, 27 aa, Mycobacterium
ANGTVMLRMPLHPVAIELLREVGPMAV

SEQ ID NO: 793644 - protein, 17 aa, Mycobacterium
ANGVRYLVDPRVVEGTS

SEQ ID NO: 793645 - protein, 22 aa, Mycobacterium
ANHAALLLAQGAGRLLRHTDDR

SEQ ID NO: 793646 - protein, 22 aa, Mycobacterium
ANHLIAGLISAGAIDVGIACGI

SEQ ID NO: 793647 - protein, 19 aa, Mycobacterium
ANHPLFRRRRFFNGKPVGR

SEQ ID NO: 793648 - protein, 20 aa, Mycobacterium
ANHSVWFHRQVDFDDWVLYS

SEQ ID NO: 793649 - protein, 23 aa, Mycobacterium
ANHSVWFHRQVDFDDWVLYSTSS

SEQ ID NO: 793650 - protein, 24 aa, Mycobacterium
ANHSVWFHRQVDFNDWVLYSTSSP

SEQ ID NO: 793651 - protein, 21 aa, Mycobacterium
ANIALITRFLRAGIDVCSTAM

SEQ ID NO: 793652 - protein, 32 aa, Mycobacterium; identical to SEQ ID NO: 147141

SEQ ID NO: 793653 - protein, 30 aa, Mycobacterium
ANIDEVLVLINHYPLRDVGWRGSLQSDKPE

SEQ ID NO: 793654 - protein, 42 aa, Mycobacterium
ANIEVPPGILLFEDPPLHDLHRRLLSRVFTPRRMLAVEDLVR

SEQ ID NO: 793655 - protein, 43 aa, Mycobacterium
ANIEVPPGILLFEDPPLHDLHRRLLSRVFTPRRMLAVEDLVRG

SEQ ID NO: 793656 - protein, 27 aa, Mycobacterium
ANIEYPLEIAGWDRKKRWYRAQELLEL

SEQ ID NO: 793657 - protein, 20 aa, Mycobacterium
ANIPALVYGPISKDIHGFDE

SEQ ID NO: 793658 - protein, 17 aa, Mycobacterium
ANIPPERYQQVDGAPPP

SEQ ID NO: 793659 - protein, 20 aa, Mycobacterium
ANIWQLLEQLGFPESGIAVA

SEQ ID NO: 793660 - protein, 27 aa, Mycobacterium
ANKFTFMPIGELWYRKSGTYRNKVQNL

SEQ ID NO: 793661 - protein, 23 aa, Mycobacterium
ANKGLALFPRRIGGRYAAMSRSD

SEQ ID NO: 793662 - protein, 19 aa, Mycobacterium
ANKILGPGAGLVDRLRDIL

SEQ ID NO: 793663 - protein, 22 aa, Mycobacterium
ANKPAIILYPSGTVVTFDELEA

SEQ ID NO: 793664 - protein, 22 aa, Mycobacterium
ANKVWRGASTRVSLAVSGLPDQ

SEQ ID NO: 793665 - protein, 21 aa, Mycobacterium
ANLAELRRSLSGSATYSVAKN

SEQ ID NO: 793666 - protein, 20 aa, Mycobacterium
ANLARMTIDLIFNAIADEMP

SEQ ID NO: 793667 - protein, 32 aa, Mycobacterium
ANLDKAKAAPLWRVLVALSIRHVGPTAARALA

SEQ ID NO: 793668 - protein, 44 aa, Mycobacterium
ANLEMRWEMVGSPLLSKLLKGDFTFFPRTVIHRLSPGSAEVACF

SEQ ID NO: 793669 - protein, 18 aa, Mycobacterium
ANLGALVALSGPGSLIVS

SEQ ID NO: 793670 - protein, 17 aa, Mycobacterium
ANLGKAKAQPLWRVLVA

SEQ ID NO: 793671 - protein, 25 aa, Mycobacterium
ANLHGRYLLPHFLIHDIADVAADLR

SEQ ID NO: 793672 - protein, 20 aa, Mycobacterium
ANLHYTLQQPYGVVARIVPF

SEQ ID NO: 793673 - protein, 20 aa, Mycobacterium
ANLIVVPLDPALPVADQRAR

SEQ ID NO: 793674 - protein, 24 aa, Mycobacterium
ANLKARVAAVERSQADYRSMVEAI

SEQ ID NO: 793675 - protein, 19 aa, Mycobacterium
ANLLFTSELQRRLDAAGSS

SEQ ID NO: 793676 - protein, 19 aa, Mycobacterium
ANLLFTSELQRRLDAAGST

SEQ ID NO: 793677 - protein, 17 aa, Mycobacterium
ANLLHFGATVPPNTDVY

SEQ ID NO: 793678 - protein, 25 aa, Mycobacterium
ANLNDALLALLPLVGVWRGHGEGRG

SEQ ID NO: 793679 - protein, 23 aa, Mycobacterium
ANLPAVVEESLHWPPDLEPVPPR

SEQ ID NO: 793680 - protein, 20 aa, Mycobacterium
ANLPCHGFDANAAWLEIVLT

SEQ ID NO: 793681 - protein, 19 aa, Mycobacterium
ANLPDLLVLDIMLPDTDGL

SEQ ID NO: 793682 - protein, 20 aa, Mycobacterium
ANLRSFNRWFDEEWGFNYED

SEQ ID NO: 793683 - protein, 24 aa, Mycobacterium
ANLSCPLLGLFGVEDRFPAPAGVA

SEQ ID NO: 793684 - protein, 21 aa, Mycobacterium
ANLSILERALVASGTELTTVA

SEQ ID NO: 793685 - protein, 21 aa, Mycobacterium
ANLTGFMAWLADTGRGDYRDY

SEQ ID NO: 793686 - protein, 18 aa, Mycobacterium
ANLTKAKEQPLWRVLVAL

SEQ ID NO: 793687 - protein, 18 aa, Mycobacterium
ANLTWTPQPAMPGQLRAV

SEQ ID NO: 793688 - protein, 23 aa, Mycobacterium
ANLVAFARMDGAWLASNELAIAK

SEQ ID NO: 793689 - protein, 21 aa, Mycobacterium
ANLVRLPDDVSFVAAASLGCR

SEQ ID NO: 793690 - protein, 33 aa, Mycobacterium
ANLVTSPVQTLTGRPLFGNGADATTPGANGGNG

SEQ ID NO: 793691 - protein, 18 aa, Mycobacterium
ANLVVLQGDLPALQPQEL

SEQ ID NO: 793692 - protein, 20 aa, Mycobacterium
ANLVWTPQPAMPGQLRAVTN

SEQ ID NO: 793693 - protein, 34 aa, Mycobacterium; identical to SEQ ID NO: 216196

SEQ ID NO: 793694 - protein, 34 aa, Mycobacterium
ANMDDARWDAVLAVNLLAPLRLTEGLVGNGTIGE

SEQ ID NO: 793695 - protein, 19 aa, Mycobacterium
ANMLFTMRSALAELNAQGG

SEQ ID NO: 793696 - protein, 25 aa, Mycobacterium
ANMPAPLMAPPAQLPQARVPVQVLV

SEQ ID NO: 793697 - protein, 25 aa, Mycobacterium
ANMVDTFVFLTLARTGDQLQGIKKG

SEQ ID NO: 793698 - protein, 26 aa, Mycobacterium
ANMVDTFVFLTLARTGDQLQGIKKGV

SEQ ID NO: 793699 - protein, 22 aa, Mycobacterium
ANMVDTFVLLTLARSGDQLQGI

SEQ ID NO: 793700 - protein, 21 aa, Mycobacterium
ANNAITPKIGIGANGISRDGK

SEQ ID NO: 793701 - protein, 24 aa, Mycobacterium
ANNFTRLLDRVAPLGYPEVNQMTK

SEQ ID NO: 793702 - protein, 32 aa, Mycobacterium
ANNGLEHYYMITYPGLPLLEPLRALPVIGDPL

SEQ ID NO: 793703 - protein, 17 aa, Mycobacterium
ANNLLADLGLPAPRQKL

SEQ ID NO: 793704 - protein, 22 aa, Mycobacterium
ANNRILLWDSLPDDPVGGRPAD

SEQ ID NO: 793705 - protein, 26 aa, Mycobacterium
ANPAAALPVPGGILADILNFLDGNDG

SEQ ID NO: 793706 - protein, 17 aa, Mycobacterium
ANPAFGAYYDLLTDETG

SEQ ID NO: 793707 - protein, 24 aa, Mycobacterium
ANPANRFHSWIYRARPDVQCIVHT

SEQ ID NO: 793708 - protein, 19 aa, Mycobacterium
ANPAPLLRQVVENQLGYAA

SEQ ID NO: 793709 - protein, 20 aa, Mycobacterium
ANPDYLPGTVLPAGVRATTD

SEQ ID NO: 793710 - protein, 27 aa, Mycobacterium
ANPGAFLASRLRRLSWTSPDTAPTKAG

SEQ ID NO: 793711 - protein, 26 aa, Mycobacterium
ANPGMFQRVVIDYYGTPTPITQVAGI

SEQ ID NO: 793712 - protein, 25 aa, Mycobacterium
ANPGMFSRIVIDYYGAATPITQLAS

SEQ ID NO: 793713 - protein, 22 aa, Mycobacterium
ANPKTHFQIYWLGGRDDVAQRI

SEQ ID NO: 793714 - protein, 23 aa, Mycobacterium
ANPKVRGRRKMRIGYVVSDKMQK

SEQ ID NO: 793715 - protein, 24 aa, Mycobacterium
ANPKVRGRRKMRIGYVVSDKMQKT

SEQ ID NO: 793716 - protein, 22 aa, Mycobacterium
ANPLDARLPFGAAQPKASTPAS

SEQ ID NO: 793717 - protein, 28 aa, Mycobacterium
ANPLDPANLLDLQKFVVATGADIGLAFD

SEQ ID NO: 793718 - protein, 33 aa, Mycobacterium
ANPLIRVLEDAMRFYFEFHFDTGDGYLAHLHDP

SEQ ID NO: 793719 - protein, 17 aa, Mycobacterium
ANPPRWSGELYLELHRG

SEQ ID NO: 793720 - protein, 21 aa, Mycobacterium
ANPQDRPLWDKLDELKATHGD

SEQ ID NO: 793721 - protein, 17 aa, Mycobacterium
ANPRKVIVVPGRLVNLV

SEQ ID NO: 793722 - protein, 26 aa, Mycobacterium
ANPRNLKLRFLSWGAAPASDTLLRQM

SEQ ID NO: 793723 - protein, 37 aa, Mycobacterium
ANPRVHLFFGAKYPCELYDLPTLWEVASMNPWLSVTP

SEQ ID NO: 793724 - protein, 23 aa, Mycobacterium
ANPYGAALVWPRATSESGHRPGR

SEQ ID NO: 793725 - protein, 22 aa, Mycobacterium
ANQLGRLRYAVVAHGGFGVAQR

SEQ ID NO: 793726 - protein, 21 aa, Mycobacterium
ANQLTIWACLDRMSLPMMGPG

SEQ ID NO: 793727 - protein, 19 aa, Mycobacterium
ANQMLFIIDTCYSGRALSV

SEQ ID NO: 793728 - protein, 20 aa, Mycobacterium
ANQNTKLLRVRLGEPFMARQ

SEQ ID NO: 793729 - protein, 19 aa, Mycobacterium
ANQPAVQALLTVLEATAEK

SEQ ID NO: 793730 - protein, 27 aa, Mycobacterium
ANQRAQRFYAKSGFRISGTRTFRLGAG

SEQ ID NO: 793731 - protein, 24 aa, Mycobacterium
ANQRVRMPVPFAQARLLSTIEDRG

SEQ ID NO: 793732 - protein, 17 aa, Mycobacterium
ANQYFGRLISDPSQMTD

SEQ ID NO: 793733 - protein, 19 aa, Mycobacterium
ANRAGHFMPTGLLRSQLDT

SEQ ID NO: 793734 - protein, 24 aa, Mycobacterium
ANRALPWPEDPVAALWHATTLLRE

SEQ ID NO: 793735 - protein, 25 aa, Mycobacterium
ANRALPWPEDPVAALWHATTLLREH

SEQ ID NO: 793736 - protein, 18 aa, Mycobacterium
ANRALTERLVYATQLPDV

SEQ ID NO: 793737 - protein, 22 aa, Mycobacterium
ANRAWRLYRRLGFTDVIREYHF

SEQ ID NO: 793738 - protein, 24 aa, Mycobacterium
ANRDGFLPLAFTVSNVKSTGPGLA

SEQ ID NO: 793739 - protein, 20 aa, Mycobacterium
ANRELTAELALALGAAAARH

SEQ ID NO: 793740 - protein, 28 aa, Mycobacterium
ANRFMQSPLLAAIYERAWRPMFTRGFSY

SEQ ID NO: 793741 - protein, 29 aa, Mycobacterium
ANRGLMQVLAATNWLGFNTPAIMDIEAAY

SEQ ID NO: 793742 - protein, 24 aa, Mycobacterium
ANRIQLMALIATNFFGQNTAAIAA

SEQ ID NO: 793743 - protein, 24 aa, Mycobacterium
ANRIYRVMVDLGLPLWDDTLATPE

SEQ ID NO: 793744 - protein, 17 aa, Mycobacterium
ANRLAHLLAAEGAGPGT

SEQ ID NO: 793745 - protein, 21 aa, Mycobacterium
ANRLAPHGVWLERGEVILSGS

SEQ ID NO: 793746 - protein, 21 aa, Mycobacterium
ANRLCAQILLLAAEDSTKDIS

SEQ ID NO: 793747 - protein, 24 aa, Mycobacterium
ANRLKALRERLFGRSAPGAPNPAQ

SEQ ID NO: 793748 - protein, 17 aa, Mycobacterium
ANRLPDLIGLRQAVYRR

SEQ ID NO: 793749 - protein, 23 aa, Mycobacterium
ANRLPMMIVGRLIGVPDADVDKL

SEQ ID NO: 793750 - protein, 23 aa, Mycobacterium
ANRLRARLIDRINNLRVGHSLDP

SEQ ID NO: 793751 - protein, 44 aa, Mycobacterium
ANRMRWPHGRLRYYLAMLAELSQLRLLPFRLVLDGTTEIDADIT

SEQ ID NO: 793752 - protein, 42 aa, Mycobacterium
ANRMTWPHGRLRYYIAMLVELSQLRPLPFRLVLDGTEEIETD

SEQ ID NO: 793753 - protein, 18 aa, Mycobacterium
ANRNLAWASLPIADVLQV

SEQ ID NO: 793754 - protein, 18 aa, Mycobacterium
ANRPLPLPDMCYAAAATG

SEQ ID NO: 793755 - protein, 23 aa, Mycobacterium
ANRPTISLALPVPGDVRGLPAGT

SEQ ID NO: 793756 - protein, 23 aa, Mycobacterium
ANRRLSEDFVPLEDLLQPTMDEI

SEQ ID NO: 793757 - protein, 35 aa, Mycobacterium
ANRRTTWEVFARRLPPGRRYGVVAGTGRLLELLPQ

SEQ ID NO: 793758 - protein, 17 aa, Mycobacterium
ANRVQLATLIATNFFGQ

SEQ ID NO: 793759 - protein, 24 aa, Mycobacterium
ANRVQLLTLVATNFLGINTPAIAA

SEQ ID NO: 793760 - protein, 28 aa, Mycobacterium
ANRVVEFMLLDRLFPRSVFHSLRQAEQS

SEQ ID NO: 793761 - protein, 22 aa, Mycobacterium
ANRWENVDWEALRVGIAKQALV

SEQ ID NO: 793762 - protein, 30 aa, Mycobacterium
ANRWPAIHTLDAAHLYRLALEKASAGTRLH

SEQ ID NO: 793763 - protein, 25 aa, Mycobacterium
ANRYDTPLLFLHNTTGYMVGKVYEE

SEQ ID NO: 793764 - protein, 21 aa, Mycobacterium
ANRYGPAFYTSYQAGLVNGEL

SEQ ID NO: 793765 - protein, 25 aa, Mycobacterium
ANSDGRLLKLRLHPGVMTGYSHGEL

SEQ ID NO: 793766 - protein, 29 aa, Mycobacterium
ANSGRLLFDPLRAKLAEYARLDFLAGLRV

SEQ ID NO: 793767 - protein, 22 aa, Mycobacterium
ANSTMVINWTVAPAGPGSSVTV

SEQ ID NO: 793768 - protein, 23 aa, Mycobacterium
ANSWVDAFAHWRRAQGLPVCAIG

SEQ ID NO: 793769 - protein, 17 aa, Mycobacterium
ANSWVDALVAYRRSRGL

SEQ ID NO: 793770 - protein, 18 aa, Mycobacterium
ANTALLLAQLRDVPDERR

SEQ ID NO: 793771 - protein, 25 aa, Mycobacterium
ANTKGSYLVYNFGGQFAAPFLTADG

SEQ ID NO: 793772 - protein, 19 aa, Mycobacterium
ANTLYVPPDPFFNDPQWKG

SEQ ID NO: 793773 - protein, 25 aa, Mycobacterium
ANTLYVPPEPFFADRQWAGITDWRA

SEQ ID NO: 793774 - protein, 24 aa, Mycobacterium
ANTPQSYWLDQAFPASTVGGTVAR

SEQ ID NO: 793775 - protein, 18 aa, Mycobacterium
ANTPSLQRGCAWSGDGWD

SEQ ID NO: 793776 - protein, 29 aa, Mycobacterium
ANTQNKIFIVPLGVKRLLLGGLVEPGQYD

SEQ ID NO: 793777 - protein, 25 aa, Mycobacterium
ANTRGWDLSIWLSLNDPERIWDKTE

SEQ ID NO: 793778 - protein, 17 aa, Mycobacterium
ANTSWMEQAFPIALESA

SEQ ID NO: 793779 - protein, 20 aa, Mycobacterium
ANTWGVMWGAEDLFGFLGGT

SEQ ID NO: 793780 - protein, 23 aa, Mycobacterium
ANTWQGRFPYRNDGALGWHGTSP

SEQ ID NO: 793781 - protein, 17 aa, Mycobacterium
ANTWRYNQLIAQQRAII

SEQ ID NO: 793782 - protein, 32 aa, Mycobacterium
ANVALLRRPAGLDERTWLHRWHLDHTRVAIDT

SEQ ID NO: 793783 - protein, 24 aa, Mycobacterium
ANVARWPAALLGDPLPQASEMTVA

SEQ ID NO: 793784 - protein, 22 aa, Mycobacterium
ANVATAMQVLNAVPAVCEAEPG

SEQ ID NO: 793785 - protein, 34 aa, Mycobacterium
ANVAWVLDFLAGRTQFGFFPQRRLRGLALHDGDT

SEQ ID NO: 793786 - protein, 23 aa, Mycobacterium
ANVEAFKRWGVFPRMGIAPTERD

SEQ ID NO: 793787 - protein, 23 aa, Mycobacterium
ANVEAWLVTIAHRRALDLGRARS

SEQ ID NO: 793788 - protein, 30 aa, Mycobacterium
ANVEQWPAMIDWLLDQHLRFRRAIQAIGGL

SEQ ID NO: 793789 - protein, 19 aa, Mycobacterium
ANVGIGNTGARNAGIANSA

SEQ ID NO: 793790 - protein, 24 aa, Mycobacterium
ANVKRWVDDILPLLTDEDPLGVDT

SEQ ID NO: 793791 - protein, 23 aa, Mycobacterium
ANVPTPFGLFPDASPGVVVADLI

SEQ ID NO: 793792 - protein, 24 aa, Mycobacterium
ANVPTPFGLFPDVAPATVFDALVA

SEQ ID NO: 793793 - protein, 22 aa, Mycobacterium
ANVPVPFLTINSVAPTIMHFGT

SEQ ID NO: 793794 - protein, 22 aa, Mycobacterium
ANVQPWLRSANRYGAKVKWAEV

SEQ ID NO: 793795 - protein, 37 aa, Mycobacterium
ANVQQSLLNLINGPTQALLGRPLIGNGADGTAPGQAG

SEQ ID NO: 793796 - protein, 38 aa, Mycobacterium
ANVSPLQDLLGLINAPTQALLGRPLIGNGTNGTAANPN

SEQ ID NO: 793797 - protein, 23 aa, Mycobacterium
ANVSPLQQLLNAINAPVQNLTGR

SEQ ID NO: 793798 - protein, 19 aa, Mycobacterium
ANVTALLQLAAYADALAAS

SEQ ID NO: 793799 - protein, 19 aa, Mycobacterium
ANVYFGPHPTWYAAPGIPH

SEQ ID NO: 793800 - protein, 22 aa, Mycobacterium
ANWDKWFTVHEKWLSDVPETIT

SEQ ID NO: 793801 - protein, 19 aa, Mycobacterium
ANWDPHYHVGHLALPAGAG

SEQ ID NO: 793802 - protein, 17 aa, Mycobacterium
ANWEQIIAGYLPDFRMP

SEQ ID NO: 793803 - protein, 17 aa, Mycobacterium
ANWPADLNILRDNDFRL

SEQ ID NO: 793804 - protein, 30 aa, Mycobacterium
ANYAFFAHQQFRIRLWPLAERLDVLTELVL

SEQ ID NO: 793805 - protein, 23 aa, Mycobacterium
ANYAKSLRMFAVLPTIVATDIRR

SEQ ID NO: 793806 - protein, 26 aa, Mycobacterium
ANYARVPLIVLSANRPYEMLGTGANQ

SEQ ID NO: 793807 - protein, 27 aa, Mycobacterium
ANYARVPLIVLSANRPYEMLGTGANQT

SEQ ID NO: 793808 - protein, 17 aa, Mycobacterium
ANYFAAATVLPYRQFHD

SEQ ID NO: 793809 - protein, 18 aa, Mycobacterium
ANYGVPVLSVHAPCLLIS

SEQ ID NO: 793810 - protein, 23 aa, Mycobacterium
ANYLATLRFELLCLARACGYVHP

SEQ ID NO: 793811 - protein, 29 aa, Mycobacterium
ANYLSVGQIYLLDNPLLRDPLTASHIKPR

SEQ ID NO: 793812 - protein, 17 aa, Mycobacterium
ANYLSVGQIYLLSNPLL

SEQ ID NO: 793813 - protein, 17 aa, Mycobacterium
ANYLYPRVEVEVGFILA

SEQ ID NO: 793814 - protein, 19 aa, Mycobacterium
APAAIRLKPGERHWTLFRQ

SEQ ID NO: 793815 - protein, 26 aa, Mycobacterium
APAALAFLHRLGVAAGLAMGFPMLCA

SEQ ID NO: 793816 - protein, 30 aa, Mycobacterium
APAAPPVREALMRALLRLAARRQPHEIAMA

SEQ ID NO: 793817 - protein, 25 aa, Mycobacterium
APAAWRHYLDAGVLIRDVGIPGYLR

SEQ ID NO: 793818 - protein, 21 aa, Mycobacterium
APACRALFASAHHVVRITLAS

SEQ ID NO: 793819 - protein, 18 aa, Mycobacterium
APAELWLVDSGPDTPTGK

SEQ ID NO: 793820 - protein, 19 aa, Mycobacterium
APAERLAFVLHDVFAVPFD

SEQ ID NO: 793821 - protein, 36 aa, Mycobacterium
APAEWLVRGGVMLPVYQREAMWLSFSASEPAALQIG

SEQ ID NO: 793822 - protein, 37 aa, Mycobacterium
APAEYIMLLVVHHIAWDDGCWRVFFADLTRAYTGAEL

SEQ ID NO: 793823 - protein, 18 aa, Mycobacterium
APAFQPYLGVMEQAYRTC

SEQ ID NO: 793824 - protein, 24 aa, Mycobacterium
APAGDPLRRWGPFPGGMADPERGG

SEQ ID NO: 793825 - protein, 25 aa, Mycobacterium
APAGLYVHWVVIGIAPGPGSTAEGQ

SEQ ID NO: 793826 - protein, 17 aa, Mycobacterium
APAGRWIVDPDGAVVRA

SEQ ID NO: 793827 - protein, 21 aa, Mycobacterium
APAGVEVSWIYRGSRADLAPE

SEQ ID NO: 793828 - protein, 22 aa, Mycobacterium
APAGYHLLVGRGRRLSAEPHAS

SEQ ID NO: 793829 - protein, 24 aa, Mycobacterium
APAHPRVPLSAPGALRWSPVDPVS

SEQ ID NO: 793830 - protein, 17 aa, Mycobacterium
APAIRTLAQGLPTNLAA

SEQ ID NO: 793831 - protein, 25 aa, Mycobacterium
APAKGTPAFGLYAASKAAIRSLGRT

SEQ ID NO: 793832 - protein, 20 aa, Mycobacterium
APAKVPYTRGLHPVGDRVWA

SEQ ID NO: 793833 - protein, 25 aa, Mycobacterium
APALAAGCAVLLKPAEWTPLTTIRI

SEQ ID NO: 793834 - protein, 26 aa, Mycobacterium
APALGHLFPFCAVLQELARRGHDIHV

SEQ ID NO: 793835 - protein, 24 aa, Mycobacterium
APALPVFGMLWKGYARRALRNLSA

SEQ ID NO: 793836 - protein, 30 aa, Mycobacterium
APALSDLELYLFFSLLFSAGAETTRNAVGG

SEQ ID NO: 793837 - protein, 24 aa, Mycobacterium
APALSRRWWAAEGLGAHSRVGSEE

SEQ ID NO: 793838 - protein, 30 aa, Mycobacterium
APALTELINALPFLIGKRAGAPQGSRIRFV

SEQ ID NO: 793839 - protein, 17 aa, Mycobacterium
APALTLPSTGNHHIWAG

SEQ ID NO: 793840 - protein, 21 aa, Mycobacterium
APAMFPKLTDETFRRTFDVHV

SEQ ID NO: 793841 - protein, 18 aa, Mycobacterium
APAMHTEMWLHPATVDNV

SEQ ID NO: 793842 - protein, 22 aa, Mycobacterium
APAMIHVDMYRLLDHTDNQGAD

SEQ ID NO: 793843 - protein, 28 aa, Mycobacterium
APAMPAECLLDRNALIMGYSGVYSSFLK

SEQ ID NO: 793844 - protein, 31 aa, Mycobacterium
APAMPASAEYLRLLRRHNVAATLSGAGPALI

SEQ ID NO: 793845 - protein, 23 aa, Mycobacterium
APAMPLGQWVIPQGYTVLVNISG

SEQ ID NO: 793846 - protein, 26 aa, Mycobacterium
APANAFVMSFLGAVSMLNGALVRPHD

SEQ ID NO: 793847 - protein, 25 aa, Mycobacterium
APANAFVMSFLGAVSSLNGVLVRPH

SEQ ID NO: 793848 - protein, 25 aa, Mycobacterium
APANAFVMSFLGAVSTLNGALVRPH

SEQ ID NO: 793849 - protein, 25 aa, Mycobacterium
APANAFVMSFLGAVSTLNGTLVRPH

SEQ ID NO: 793850 - protein, 25 aa, Mycobacterium
APANRAAWEVLRRFDKPFLCAFSDS

SEQ ID NO: 793851 - protein, 29 aa, Mycobacterium
APAPERTKLPVIPWVVSAKSLSALSSQAH

SEQ ID NO: 793852 - protein, 29 aa, Mycobacterium
APAPHHTRPVRFVWLQSHATRIALLDAMK

SEQ ID NO: 793853 - protein, 24 aa, Mycobacterium
APAPLDVMAALRAPGIAVIAEVKR

SEQ ID NO: 793854 - protein, 18 aa, Mycobacterium
APAPRFSRTRPATPSAPA

SEQ ID NO: 793855 - protein, 21 aa, Mycobacterium
APAQALLGHPIIGTGGSGSQS

SEQ ID NO: 793856 - protein, 23 aa, Mycobacterium
APARALLKKAPALRRIVKRQQAP

SEQ ID NO: 793857 - protein, 23 aa, Mycobacterium
APARALQVMFVLRELRGGVHFNL

SEQ ID NO: 793858 - protein, 23 aa, Mycobacterium
APARAYNPLFIWGESGLGKTHLL

SEQ ID NO: 793859 - protein, 17 aa, Mycobacterium
APARDWARFSAWADEIF

SEQ ID NO: 793860 - protein, 20 aa, Mycobacterium
APARPSLGYLVVGLSHHGSE

SEQ ID NO: 793861 - protein, 19 aa, Mycobacterium
APASRFDTRRIFWGDPSQK

SEQ ID NO: 793862 - protein, 20 aa, Mycobacterium
APASRFDTRRILWGDPGQKS

SEQ ID NO: 793863 - protein, 24 aa, Mycobacterium
APASVVTEYLLLGLRFDRIEDGYV

SEQ ID NO: 793864 - protein, 21 aa, Mycobacterium
APATDLIARKALAAGASAVIT

SEQ ID NO: 793865 - protein, 22 aa, Mycobacterium
APAVAAGIPWTLVDGTDRAHPE

SEQ ID NO: 793866 - protein, 20 aa, Mycobacterium
APAVIAHHPAPSGAPTVLLY

SEQ ID NO: 793867 - protein, 24 aa, Mycobacterium
APAVIARWFTLSHLETHPAERAEW

SEQ ID NO: 793868 - protein, 30 aa, Mycobacterium
APAVIDALLLVRLPYHLSVLTQAAARAALR

SEQ ID NO: 793869 - protein, 29 aa, Mycobacterium
APAVIDALLLVRLPYHLSVLTQAAARAAV

SEQ ID NO: 793870 - protein, 18 aa, Mycobacterium
APAVKRRVDRMLADGVIR

SEQ ID NO: 793871 - protein, 18 aa, Mycobacterium
APAVPVRVQHRSGVLWVL

SEQ ID NO: 793872 - protein, 28 aa, Mycobacterium
APAVRTKLLYMYFPDEFVPVSSRAAIDH

SEQ ID NO: 793873 - protein, 26 aa, Mycobacterium
APAVTMFVPAFLRYDLRKVNGDWKIA

SEQ ID NO: 793874 - protein, 17 aa, Mycobacterium
APAVYLLDGLRARDDRS

SEQ ID NO: 793875 - protein, 20 aa, Mycobacterium
APAWIGIGTADLFHDEDLAY

SEQ ID NO: 793876 - protein, 33 aa, Mycobacterium
APAYLLYVARSMAAWWLAVPAAIDLMLGTTVAG

SEQ ID NO: 793877 - protein, 26 aa, Mycobacterium
APAYTGRLFTAPVPALRLPEESMDPE

SEQ ID NO: 793878 - protein, 24 aa, Mycobacterium
APAYTGRLFTAPVPALRMPDESMD

SEQ ID NO: 793879 - protein, 27 aa, Mycobacterium
APAYTGRMFTAPIPALRLPEESMDPEA

SEQ ID NO: 793880 - protein, 30 aa, Mycobacterium
APCELVDFWRFNVAFARQILAQQPISGPGE

SEQ ID NO: 793881 - protein, 27 aa, Mycobacterium
APCELVDFWRFNVAFARQILDQQPVSA

SEQ ID NO: 793882 - protein, 17 aa, Mycobacterium
APCVLFFDEVDALGHRR

SEQ ID NO: 793883 - protein, 25 aa, Mycobacterium
APDARLFIVAFRPRGRFGVAGVEPE

SEQ ID NO: 793884 - protein, 24 aa, Mycobacterium
APDATFSFNLTLKTWEPLCEQLER

SEQ ID NO: 793885 - protein, 17 aa, Mycobacterium
APDATTFDFLRDKPHAP

SEQ ID NO: 793886 - protein, 18 aa, Mycobacterium
APDDLLPDLVKRLDMLLD

SEQ ID NO: 793887 - protein, 27 aa, Mycobacterium
APDDPKAWLITTAWRRFIDVARAEAAR

SEQ ID NO: 793888 - protein, 25 aa, Mycobacterium
APDEARILRFLAAHGAQPVVDVRTS

SEQ ID NO: 793889 - protein, 18 aa, Mycobacterium
APDERGQRVSDDSFLLCF

SEQ ID NO: 793890 - protein, 18 aa, Mycobacterium
APDFLGCPDVIALARDQR

SEQ ID NO: 793891 - protein, 20 aa, Mycobacterium
APDFRLFWDNAYAVHTLTHD

SEQ ID NO: 793892 - protein, 31 aa, Mycobacterium
APDGHVAFLVALLFFYELTGGMAAVEAAQRA

SEQ ID NO: 793893 - protein, 26 aa, Mycobacterium
APDGRLVFNAFLPREGYVPDAAALQL

SEQ ID NO: 793894 - protein, 24 aa, Mycobacterium
APDGTAITVLPLALVTVIEETPGV

SEQ ID NO: 793895 - protein, 24 aa, Mycobacterium
APDGTFHWQLRPTSPGQLVIREVY

SEQ ID NO: 793896 - protein, 19 aa, Mycobacterium
APDHYTCRSAKAPWELARP

SEQ ID NO: 793897 - protein, 19 aa, Mycobacterium
APDIDLLVGSWFVSTNPSS

SEQ ID NO: 793898 - protein, 18 aa, Mycobacterium
APDIKMLAPIPAGDPDKG

SEQ ID NO: 793899 - protein, 28 aa, Mycobacterium
APDLAEELGIPRRLLPRLRPAGTHLGTV

SEQ ID NO: 793900 - protein, 17 aa, Mycobacterium
APDLASFWRLVETGGSG

SEQ ID NO: 793901 - protein, 24 aa, Mycobacterium
APDLEVIALLSRGKLLYGVVDDEN

SEQ ID NO: 793902 - protein, 23 aa, Mycobacterium
APDLFAGILAQVPFVDPLTTILD

SEQ ID NO: 793903 - protein, 17 aa, Mycobacterium
APDLIRCVSFDNVIPGT

SEQ ID NO: 793904 - protein, 20 aa, Mycobacterium
APDLIYIDLHLVHEVTSPQA

SEQ ID NO: 793905 - protein, 17 aa, Mycobacterium
APDLPPLPIIGPPGTAE

SEQ ID NO: 793906 - protein, 22 aa, Mycobacterium
APDLPSPWPREALDDLLVVLLA

SEQ ID NO: 793907 - protein, 27 aa, Mycobacterium
APDLTLDALLMFGAIGYTWEHDMHLYW

SEQ ID NO: 793908 - protein, 27 aa, Mycobacterium
APDLVETFPFPFPTDRYRYSTNVEPAG

SEQ ID NO: 793909 - protein, 28 aa, Mycobacterium
APDPEIPPGFLFLDPPDHTRLRKLVSKA

SEQ ID NO: 793910 - protein, 26 aa, Mycobacterium
APDPGPLRRLIATLPALEVPRPDWPA

SEQ ID NO: 793911 - protein, 17 aa, Mycobacterium
APDPIIFPRNSDGLYLL

SEQ ID NO: 793912 - protein, 27 aa, Mycobacterium
APDQLERLFAGVYLNLAPVILDAGADY

SEQ ID NO: 793913 - protein, 17 aa, Mycobacterium
APDQRPPVHALYGFARY

SEQ ID NO: 793914 - protein, 18 aa, Mycobacterium
APDQRPPVHALYGFARYA

SEQ ID NO: 793915 - protein, 29 aa, Mycobacterium
APDRDALADLLWRMGIRTLGQFAALSRTD

SEQ ID NO: 793916 - protein, 28 aa, Mycobacterium
APDRNQLIPGLLRGLAARIAQWHDADAL

SEQ ID NO: 793917 - protein, 23 aa, Mycobacterium
APDRPPWDIATQRLTLVRGVVEA

SEQ ID NO: 793918 - protein, 25 aa, Mycobacterium
APDSEYWHIPYFDHLIRVGHAFTKV

SEQ ID NO: 793919 - protein, 19 aa, Mycobacterium
APDTMSYVTALLPVAQGVS

SEQ ID NO: 793920 - protein, 20 aa, Mycobacterium
APDTMSYVTALLPVAQGVSV

SEQ ID NO: 793921 - protein, 25 aa, Mycobacterium
APDTMTYLTALLPVAQGISVYAALR

SEQ ID NO: 793922 - protein, 24 aa, Mycobacterium
APDTMTYLTALLPVAQGVSVYAAL

SEQ ID NO: 793923 - protein, 18 aa, Mycobacterium
APDTPPMVIDFGGGVLGA

SEQ ID NO: 793924 - protein, 25 aa, Mycobacterium
APDVNMLNPMPLFHAGGLNVLANPI

SEQ ID NO: 793925 - protein, 25 aa, Mycobacterium
APEAITALWTDRLLDRIDIEPPGGP

SEQ ID NO: 793926 - protein, 18 aa, Mycobacterium
APEALTGVLYRLADVNVP

SEQ ID NO: 793927 - protein, 25 aa, Mycobacterium
APEANTIVWLIWHTGRMQDAQVADI

SEQ ID NO: 793928 - protein, 29 aa, Mycobacterium
APEDLVWTVVSPPLVIEFDGPRTASYRTA

SEQ ID NO: 793929 - protein, 25 aa, Mycobacterium
APEEDLVSLIYFYEANHDALVTPLS

SEQ ID NO: 793930 - protein, 25 aa, Mycobacterium
APEEDLVSLIYFYEANHDAVVTPLP

SEQ ID NO: 793931 - protein, 25 aa, Mycobacterium
APEEFKALSYKAYLMCFGSTGMFEQ

SEQ ID NO: 793932 - protein, 25 aa, Mycobacterium
APEEHDFLTRMFVSNLRALVALRGA

SEQ ID NO: 793933 - protein, 31 aa, Mycobacterium
APEGTPCLLTPPPWYPILRGTTQQALFEVAR

SEQ ID NO: 793934 - protein, 27 aa, Mycobacterium
APEHIHTYRITPLALWNARAAGHDAEQ

SEQ ID NO: 793935 - protein, 31 aa, Mycobacterium
APEHPPTTFPKWLGRSWIRSAMLRYGENPHQ

SEQ ID NO: 793936 - protein, 27 aa, Mycobacterium
APEHSASWVLPLLWRRWSPGYRADEDL

SEQ ID NO: 793937 - protein, 25 aa, Mycobacterium
APEIELFPTWLRISSQLARYSTSMK

SEQ ID NO: 793938 - protein, 19 aa, Mycobacterium
APEIGGTWYYNRYPGARCD

SEQ ID NO: 793939 - protein, 19 aa, Mycobacterium
APEIRYMLDRRRALGGFLP

SEQ ID NO: 793940 - protein, 20 aa, Mycobacterium
APEIRYMLDRRRALGGFVPS

SEQ ID NO: 793941 - protein, 20 aa, Mycobacterium
APEIRYMLDRRRTLGGFVPE

SEQ ID NO: 793942 - protein, 24 aa, Mycobacterium
APEISFGDDPLRMLRAARFVSQLG

SEQ ID NO: 793943 - protein, 26 aa, Mycobacterium
APEKPSWWRRLLSNRSFQSFLSALGK

SEQ ID NO: 793944 - protein, 17 aa, Mycobacterium
APEKPWFSYVCPGAGHA

SEQ ID NO: 793945 - protein, 27 aa, Mycobacterium
APELRTPWPRQALKDLLVMLAAGPSAV

SEQ ID NO: 793946 - protein, 28 aa, Mycobacterium
APELVKLRQYFDHPLLVEMFADAIADAR

SEQ ID NO: 793947 - protein, 32 aa, Mycobacterium
APELVKLRRYFDHPLFVEMFADAVAAAAQTVP

SEQ ID NO: 793948 - protein, 32 aa, Mycobacterium
APELVKLRSYFDHPLFVEMFADAIAAAATTVP

SEQ ID NO: 793949 - protein, 17 aa, Mycobacterium
APEMHFCIFFDQPTPGD

SEQ ID NO: 793950 - protein, 17 aa, Mycobacterium
APEMLAALRRAGRQDTP

SEQ ID NO: 793951 - protein, 23 aa, Mycobacterium
APEMLRVKGCDRPVAARRLLAAT

SEQ ID NO: 793952 - protein, 26 aa, Mycobacterium
APEMNMGQLSLLLRGKYLVDVQSVTK

SEQ ID NO: 793953 - protein, 21 aa, Mycobacterium
APEMPVPWPREALDDLLVVLS

SEQ ID NO: 793954 - protein, 20 aa, Mycobacterium
APEMTVLVGGLRALGANHGG

SEQ ID NO: 793955 - protein, 17 aa, Mycobacterium
APEPAAAPPPRRKPRRP

SEQ ID NO: 793956 - protein, 27 aa, Mycobacterium
APEPLRHFYIAYRALVRAKVDCIRFTQ

SEQ ID NO: 793957 - protein, 25 aa, Mycobacterium
APEPVLHAALGPGALIAELGSQEQK

SEQ ID NO: 793958 - protein, 27 aa, Mycobacterium
APEQLAARPPWSIGQPQPEILKLIEQG

SEQ ID NO: 793959 - protein, 31 aa, Mycobacterium
APEQLPDGPLPVMFYIYGGGYFLGSSSSPPY

SEQ ID NO: 793960 - protein, 20 aa, Mycobacterium
APERGYAKTFLRQLEQCLGL

SEQ ID NO: 793961 - protein, 26 aa, Mycobacterium
APERLRTLFAERGVFRHLAESDEPLF

SEQ ID NO: 793962 - protein, 23 aa, Mycobacterium
APERPLVGPLLWDLEAGTATDTT

SEQ ID NO: 793963 - protein, 25 aa, Mycobacterium
APERVAAFFEFLKGRIATARKYAPA

SEQ ID NO: 793964 - protein, 25 aa, Mycobacterium
APESPVRLIMVLAVAADLGVCAVFE

SEQ ID NO: 793965 - protein, 22 aa, Mycobacterium
APETSIAKPPFTWTTPEGFAVP

SEQ ID NO: 793966 - protein, 26 aa, Mycobacterium
APEVAGLLALFLLHDARRPARTRADG

SEQ ID NO: 793967 - protein, 26 aa, Mycobacterium
APEVELFPGWIRLATKMSGKFKASAR

SEQ ID NO: 793968 - protein, 24 aa, Mycobacterium
APEVSFYPWRDGGLGDQQTLVGGF

SEQ ID NO: 793969 - protein, 19 aa, Mycobacterium
APEVVPRVIAWLRAQMTTE

SEQ ID NO: 793970 - protein, 21 aa, Mycobacterium
APEYLAWLMDCDMRGTYTFHR

SEQ ID NO: 793971 - protein, 28 aa, Mycobacterium
APFADLPYDLLFNDKVDLILRSSALQSA

SEQ ID NO: 793972 - protein, 19 aa, Mycobacterium
APFAFIDLDAMWANAAQLL

SEQ ID NO: 793973 - protein, 20 aa, Mycobacterium
APFDLHIYPWTERDPASPHG

SEQ ID NO: 793974 - protein, 19 aa, Mycobacterium
APFGLRPQAILPAYGMAEI

SEQ ID NO: 793975 - protein, 18 aa, Mycobacterium
APFMLPHIAGRPVTRKRW

SEQ ID NO: 793976 - protein, 24 aa, Mycobacterium
APFNDIILFTQDWGFRLDEVKVPV

SEQ ID NO: 793977 - protein, 25 aa, Mycobacterium
APFNDIILFTRDWGFRLDEVKVPVR

SEQ ID NO: 793978 - protein, 20 aa, Mycobacterium
APFNVNFRYVKSELQYLLAD

SEQ ID NO: 793979 - protein, 20 aa, Mycobacterium
APFNVNYRYVKSELQYLLAD

SEQ ID NO: 793980 - protein, 22 aa, Mycobacterium
APFPLAGMQLAYWIGRSDEQEL

SEQ ID NO: 793981 - protein, 24 aa, Mycobacterium
APFQHIPRAPQRPAPLPGQDTVDV

SEQ ID NO: 793982 - protein, 17 aa, Mycobacterium
APFSLAWMTAVGERTKR

SEQ ID NO: 793983 - protein, 18 aa, Mycobacterium
APFSLAWMTAVGERTKRM

SEQ ID NO: 793984 - protein, 23 aa, Mycobacterium
APFSLNPVDWVTGAWRTAMDVTG

SEQ ID NO: 793985 - protein, 22 aa, Mycobacterium
APFTEALDRLLTTGPPGSMGEL

SEQ ID NO: 793986 - protein, 26 aa, Mycobacterium
APFTEELVMWWNFVGRSHDEIVAYRE

SEQ ID NO: 793987 - protein, 22 aa, Mycobacterium
APGAAALPPAGFPSLDGFTAVP

SEQ ID NO: 793988 - protein, 17 aa, Mycobacterium
APGALGLHAALTGAPFS

SEQ ID NO: 793989 - protein, 18 aa, Mycobacterium
APGALLDAVPLDPALSVP

SEQ ID NO: 793990 - protein, 35 aa, Mycobacterium
APGALLHDADVYRWPLIPALAMVAAMPALGAAERV

SEQ ID NO: 793991 - protein, 21 aa, Mycobacterium
APGANLLRAVRGGVRLCYDGK

SEQ ID NO: 793992 - protein, 25 aa, Mycobacterium
APGANYIVLVFDKAAFPPDIDGPHP

SEQ ID NO: 793993 - protein, 17 aa, Mycobacterium
APGARLAWRDDARWAPH

SEQ ID NO: 793994 - protein, 30 aa, Mycobacterium
APGARLNIPWRRDFNSLVYVLSGRGSVGAA

SEQ ID NO: 793995 - protein, 25 aa, Mycobacterium
APGASALICIRPHTLSIVGPTAPGA

SEQ ID NO: 793996 - protein, 26 aa, Mycobacterium
APGCWQPITRHLWPAPELVMDTGNSI

SEQ ID NO: 793997 - protein, 23 aa, Mycobacterium
APGDFIELVQGIPGGPHGADPDE

SEQ ID NO: 793998 - protein, 24 aa, Mycobacterium
APGDPLFDPFWQLANDSGITVCYH

SEQ ID NO: 793999 - protein, 18 aa, Mycobacterium
APGEHPMFKAMAASSSSE

SEQ ID NO: 794000 - protein, 25 aa, Mycobacterium
APGEIAPLVQGIWFSGASVTMLHQP

SEQ ID NO: 794001 - protein, 27 aa, Mycobacterium
APGELDFTLVRLPRVLGEAGQLGRSAD

SEQ ID NO: 794002 - protein, 24 aa, Mycobacterium
APGERAMFWPDCLENSFICVSWDE

SEQ ID NO: 794003 - protein, 22 aa, Mycobacterium
APGFAYLVGGDERLVVPRRAEP

SEQ ID NO: 794004 - protein, 24 aa, Mycobacterium
APGFGDRRKAMLQDMAILTGGQVV

SEQ ID NO: 794005 - protein, 24 aa, Mycobacterium
APGFGHRRVAELEDLAVALGGHVI

SEQ ID NO: 794006 - protein, 27 aa, Mycobacterium
APGGALFPKAAVWSPMFMKPPDQDGPG

SEQ ID NO: 794007 - protein, 24 aa, Mycobacterium
APGGGPPRKAWPAGGTGIGGGPPG

SEQ ID NO: 794008 - protein, 25 aa, Mycobacterium
APGGLSCFFLPRILPDGRRNRMFLQ

SEQ ID NO: 794009 - protein, 25 aa, Mycobacterium
APGGLSCFMLPRVLPDGSRNRMFLQ

SEQ ID NO: 794010 - protein, 19 aa, Mycobacterium
APGGTLWTWGPDGVPNRVT

SEQ ID NO: 794011 - protein, 31 aa, Mycobacterium
APGHGEWIKGFAGPFTLLVIADLLGVPMEDR

SEQ ID NO: 794012 - protein, 21 aa, Mycobacterium
APGIATILYDFGPEIGKRYLV

SEQ ID NO: 794013 - protein, 24 aa, Mycobacterium
APGIATYLDLPLISGKAAPDRART

SEQ ID NO: 794014 - protein, 20 aa, Mycobacterium
APGIDLFRRLIEDYERESNV

SEQ ID NO: 794015 - protein, 24 aa, Mycobacterium
APGKSLPLTLLLHSIAMGQNQFAA

SEQ ID NO: 794016 - protein, 23 aa, Mycobacterium
APGLFKTPLLGSLPEEAQASLGK

SEQ ID NO: 794017 - protein, 17 aa, Mycobacterium
APGLRQLAELTGRPTYG

SEQ ID NO: 794018 - protein, 25 aa, Mycobacterium
APGLWFAGYEEPLIGPLRAFRRHAP

SEQ ID NO: 794019 - protein, 18 aa, Mycobacterium
APGMPPRPGAPGMPGMPG

SEQ ID NO: 794020 - protein, 23 aa, Mycobacterium
APGPCDTPLLPPDSWERAEEFVQ

SEQ ID NO: 794021 - protein, 30 aa, Mycobacterium
APGPLMARLDLPRVWRLTRGAGQRVAVIDT

SEQ ID NO: 794022 - protein, 18 aa, Mycobacterium
APGPWRRPERPITSRIAY

SEQ ID NO: 794023 - protein, 25 aa, Mycobacterium
APGRAVICPPGMQLELTPDGRCRLR

SEQ ID NO: 794024 - protein, 20 aa, Mycobacterium
APGRLLGKSAYHALTFGWLM

SEQ ID NO: 794025 - protein, 19 aa, Mycobacterium
APGRPIDAFVVRKSVKTHG

SEQ ID NO: 794026 - protein, 19 aa, Mycobacterium
APGSFFAGFAFSFAQVPNH

SEQ ID NO: 794027 - protein, 37 aa, Mycobacterium
APGSPLLGLMLPYSPIHHLLLAPVPGGRGPVPDALVL

SEQ ID NO: 794028 - protein, 24 aa, Mycobacterium
APGSRLAFDFVPDTAVFADPRWRA

SEQ ID NO: 794029 - protein, 25 aa, Mycobacterium
APGSRLAFEFVPDTAVFADPRWRAH

SEQ ID NO: 794030 - protein, 24 aa, Mycobacterium
APGSYATGIAFLPQSSKDAAAACA

SEQ ID NO: 794031 - protein, 24 aa, Mycobacterium
APGSYATGIAFLPQSSKDASAACA

SEQ ID NO: 794032 - protein, 28 aa, Mycobacterium
APGTGAAGAPGGWLLGDGGAGGSGAPGK

SEQ ID NO: 794033 - protein, 24 aa, Mycobacterium
APGTLHHVYVIEGILRTGPLNDPV

SEQ ID NO: 794034 - protein, 18 aa, Mycobacterium
APGTRRLVRLGVAAPLKA

SEQ ID NO: 794035 - protein, 23 aa, Mycobacterium
APGVLLAVRDIAKRPGLTIGIEP

SEQ ID NO: 794036 - protein, 24 aa, Mycobacterium
APGVPMAVPAIKGPAPLPSEEEAA

SEQ ID NO: 794037 - protein, 31 aa, Mycobacterium
APGVPMVFPPWFENFQIKYINPALKPVARYL

SEQ ID NO: 794038 - protein, 29 aa, Mycobacterium
APGVPMVFPPWFERFQIKYFNPAVKPIVR

SEQ ID NO: 794039 - protein, 20 aa, Mycobacterium
APGWEPLPIQYIDYALWQRA

SEQ ID NO: 794040 - protein, 17 aa, Mycobacterium
APGYAAYAAAKAGVINY

SEQ ID NO: 794041 - protein, 19 aa, Mycobacterium
APHALSMLRGFNLMKQLEE

SEQ ID NO: 794042 - protein, 27 aa, Mycobacterium
APHDTNVALLPIGYADGVFRSLGGRLE

SEQ ID NO: 794043 - protein, 21 aa, Mycobacterium
APHERWGERPLAFVVPAAGHD

SEQ ID NO: 794044 - protein, 28 aa, Mycobacterium
APHGLDIRRELARRLGLAAPSISWHATR

SEQ ID NO: 794045 - protein, 23 aa, Mycobacterium
APHHLIADAPIIERRRTRAGDAH

SEQ ID NO: 794046 - protein, 21 aa, Mycobacterium
APHHLIADGGILAHRRTRAGD

SEQ ID NO: 794047 - protein, 25 aa, Mycobacterium
APHHRWPRHIIDVKTAIAWARANVD

SEQ ID NO: 794048 - protein, 24 aa, Mycobacterium
APHHRWPRHIVDVKTAIAWARANV

SEQ ID NO: 794049 - protein, 27 aa, Mycobacterium
APHHTRLRKIISRGFTPRAIGRLEAEL

SEQ ID NO: 794050 - protein, 26 aa, Mycobacterium
APHHTRLRKIISRGFTPRAIGRLHDE

SEQ ID NO: 794051 - protein, 26 aa, Mycobacterium
APHHTRLRKIISRGFTPRAIGRLRDE

SEQ ID NO: 794052 - protein, 27 aa, Mycobacterium
APHHTRPVRFVWVQDGALRVGLLDEMK

SEQ ID NO: 794053 - protein, 26 aa, Mycobacterium
APHNHLEPVWVPLRDADPLGLDIQLA

SEQ ID NO: 794054 - protein, 26 aa, Mycobacterium
APHRTVRYHHWLAPDAKRSLIAGAHA

SEQ ID NO: 794055 - protein, 18 aa, Mycobacterium
APHVRAYIRRSGAPTYIG

SEQ ID NO: 794056 - protein, 17 aa, Mycobacterium
APIALDPDRITVSFNGS

SEQ ID NO: 794057 - protein, 26 aa, Mycobacterium
APIAVKEAVLPFHRFRRADGAAIDSL

SEQ ID NO: 794058 - protein, 20 aa, Mycobacterium
APIAVRGQCGTAVPDGALPA

SEQ ID NO: 794059 - protein, 25 aa, Mycobacterium
APIERLEELVGIYAELLALLAENGA

SEQ ID NO: 794060 - protein, 17 aa, Mycobacterium
APIGPTLHYQVRAHWRT

SEQ ID NO: 794061 - protein, 30 aa, Mycobacterium
APIGRPLPGTALFVLDRWLRQLPTEVVGEL

SEQ ID NO: 794062 - protein, 26 aa, Mycobacterium
APIKQRFVELLPQLAILDAGGSSESG

SEQ ID NO: 794063 - protein, 18 aa, Mycobacterium
APIMPATGGMPAMPGQTG

SEQ ID NO: 794064 - protein, 19 aa, Mycobacterium
APIPATEFKRKPHWLPAHF

SEQ ID NO: 794065 - protein, 19 aa, Mycobacterium
APIPGRIFAGPGLAQPPGT

SEQ ID NO: 794066 - protein, 18 aa, Mycobacterium
APIRCGLPRLPQGVNPVT

SEQ ID NO: 794067 - protein, 28 aa, Mycobacterium
APIRDSWEFALLRGALQRGLPVLGICRG

SEQ ID NO: 794068 - protein, 25 aa, Mycobacterium
APISPKMVDALRPMMRLVVTNGTAK

SEQ ID NO: 794069 - protein, 19 aa, Mycobacterium
APISRMWVRPFASDEADPA

SEQ ID NO: 794070 - protein, 21 aa, Mycobacterium
APISWPEFAAIHPHAPIAQTT

SEQ ID NO: 794071 - protein, 19 aa, Mycobacterium
APITPLLVQVNGGPLQPIT

SEQ ID NO: 794072 - protein, 37 aa, Mycobacterium
APIVKHLIVFQRTPIWCFPKLDVPLPAAARWAMRIPG

SEQ ID NO: 794073 - protein, 19 aa, Mycobacterium
APIYLHPTTPHPAVMDAWF

SEQ ID NO: 794074 - protein, 25 aa, Mycobacterium
APKHKGITYFLLDMTAPGIEIRPLR

SEQ ID NO: 794075 - protein, 28 aa, Mycobacterium
APKHKSLTMFLVPLDTPGVEIQGIRTVD

SEQ ID NO: 794076 - protein, 27 aa, Mycobacterium
APKHNSLTMFLVPLGTPGVEIQGIRTV

SEQ ID NO: 794077 - protein, 21 aa, Mycobacterium
APKHQGITYFLLDMAADGVEV

SEQ ID NO: 794078 - protein, 20 aa, Mycobacterium
APKHRGISFLLVPMDQPGVE

SEQ ID NO: 794079 - protein, 17 aa, Mycobacterium
APKLRLVPIQRTYDTPV

SEQ ID NO: 794080 - protein, 17 aa, Mycobacterium
APKPKLHPNIRTFREWS

SEQ ID NO: 794081 - protein, 25 aa, Mycobacterium
APKPLDVMAALREPGIAVIAEVKRA

SEQ ID NO: 794082 - protein, 28 aa, Mycobacterium
APKPPAVPAGLAWRRPVDAVADQCPPCE

SEQ ID NO: 794083 - protein, 34 aa, Mycobacterium
APKRLGSFMDSRLWRLLLAPGRGIGRLVTGVMGL

SEQ ID NO: 794084 - protein, 35 aa, Mycobacterium
APKRLGSFMDSRLWRLLLAPGRGIGRLVTGVMGLA

SEQ ID NO: 794085 - protein, 17 aa, Mycobacterium
APKTYVAPIAFNVVPLA

SEQ ID NO: 794086 - protein, 25 aa, Mycobacterium
APKWAASISGYWRRGRTEETFRVWK

SEQ ID NO: 794087 - protein, 17 aa, Mycobacterium
APKYRAYMRQQQGKRWN

SEQ ID NO: 794088 - protein, 19 aa, Mycobacterium
APLAALSRPQLPTGALTSM

SEQ ID NO: 794089 - protein, 24 aa, Mycobacterium
APLAAQGCIPLAIHPAMTFTGSDE

SEQ ID NO: 794090 - protein, 20 aa, Mycobacterium
APLAASRYHTRSRFLPAGLA

SEQ ID NO: 794091 - protein, 26 aa, Mycobacterium
APLAEALLLVLCGVGFYAGFVGSYRE

SEQ ID NO: 794092 - protein, 19 aa, Mycobacterium
APLAGRLQPLRAAAGEVLM

SEQ ID NO: 794093 - protein, 32 aa, Mycobacterium
APLARMEMAIAFPALFRRFPSLEPAEDFADVA

SEQ ID NO: 794094 - protein, 22 aa, Mycobacterium
APLAVRGTRLAILKGLNVPLHE

SEQ ID NO: 794095 - protein, 26 aa, Mycobacterium
APLAVRKVIALWPTLVPREFVPQHVR

SEQ ID NO: 794096 - protein, 25 aa, Mycobacterium
APLEDCYAALTWLAGLPSVDRYRVA

SEQ ID NO: 794097 - protein, 26 aa, Mycobacterium
APLEDCYSALRWLAALPAVDPGRIAI

SEQ ID NO: 794098 - protein, 25 aa, Mycobacterium
APLEVLIAVVNRLGWTHGCELNALE

SEQ ID NO: 794099 - protein, 17 aa, Mycobacterium
APLFASGLIAQEVATET

SEQ ID NO: 794100 - protein, 18 aa, Mycobacterium
APLGIRVNALAPGYVKTD

SEQ ID NO: 794101 - protein, 24 aa, Mycobacterium
APLGRLRGYPGAPGYLRASGGPGW

SEQ ID NO: 794102 - protein, 21 aa, Mycobacterium
APLHAECAGLIYLASELDGYP

SEQ ID NO: 794103 - protein, 25 aa, Mycobacterium
APLHNPPALLCIKVARTMLGDIPHV

SEQ ID NO: 794104 - protein, 20 aa, Mycobacterium
APLIAKYRLGGEQRSFRQPV

SEQ ID NO: 794105 - protein, 21 aa, Mycobacterium
APLLCAGIIGYRALLRADLPP

SEQ ID NO: 794106 - protein, 22 aa, Mycobacterium
APLLCAGIIGYRALMRTRLPAS

SEQ ID NO: 794107 - protein, 18 aa, Mycobacterium
APLLDKPSLIIGKSTVPV

SEQ ID NO: 794108 - protein, 17 aa, Mycobacterium
APLLELPGVAAACDEAR

SEQ ID NO: 794109 - protein, 19 aa, Mycobacterium
APLLEYYQNVLQTIDAVGT

SEQ ID NO: 794110 - protein, 18 aa, Mycobacterium
APLLPSATEIVWRGLTGG

SEQ ID NO: 794111 - protein, 20 aa, Mycobacterium
APLLRHLDRLAELRPRVAVV

SEQ ID NO: 794112 - protein, 19 aa, Mycobacterium
APLLVFYHGGGWSIGDLDT

SEQ ID NO: 794113 - protein, 21 aa, Mycobacterium
APLMAYLVRSMQSGGELAMML

SEQ ID NO: 794114 - protein, 27 aa, Mycobacterium
APLNEWIMEQLLMIDALKRGSAKRITA

SEQ ID NO: 794115 - protein, 18 aa, Mycobacterium
APLNSWPDNANLDKARRL

SEQ ID NO: 794116 - protein, 18 aa, Mycobacterium
APLPFLSIKKIEVHYRPR

SEQ ID NO: 794117 - protein, 23 aa, Mycobacterium
APLPPHDLAYLIVRIVESFLYSD

SEQ ID NO: 794118 - protein, 30 aa, Mycobacterium
APLPPQQAGLLTRLMYRYAKKRFGEVPEPF

SEQ ID NO: 794119 - protein, 19 aa, Mycobacterium
APLRFGELCLEAGLPPGLV

SEQ ID NO: 794120 - protein, 22 aa, Mycobacterium
APLRPFAKREVMPGGLAGAELE

SEQ ID NO: 794121 - protein, 22 aa, Mycobacterium
APLSFPIPGWNVCVDFPIKAGL

SEQ ID NO: 794122 - protein, 20 aa, Mycobacterium
APLSYPYRDGLIDKELATDG

SEQ ID NO: 794123 - protein, 24 aa, Mycobacterium
APLTEQGCVPLAIHPAMTFTGSDE

SEQ ID NO: 794124 - protein, 26 aa, Mycobacterium
APLTQAQRRIWLLDRMSGGGKELCSQ

SEQ ID NO: 794125 - protein, 18 aa, Mycobacterium
APLVLDLGGLDFLAGSGL

SEQ ID NO: 794126 - protein, 17 aa, Mycobacterium
APLVLEVTYVDPAGAPT

SEQ ID NO: 794127 - protein, 17 aa, Mycobacterium
APLVVWAHGGQWVRTTV

SEQ ID NO: 794128 - protein, 22 aa, Mycobacterium
APLYHNERYGFWALSRHADVES

SEQ ID NO: 794129 - protein, 18 aa, Mycobacterium
APMAACYITLGTAGMAGV

SEQ ID NO: 794130 - protein, 24 aa, Mycobacterium
APMCDIFLVLAQAPGGLSCFFLPR

SEQ ID NO: 794131 - protein, 19 aa, Mycobacterium
APMERATPLRRLGDPVDIA

SEQ ID NO: 794132 - protein, 24 aa, Mycobacterium
APMFHALGYLHQSLALTLGCTLIL

SEQ ID NO: 794133 - protein, 27 aa, Mycobacterium
APMIPLDDALRPKWLFGATVHEGCDRA

SEQ ID NO: 794134 - protein, 21 aa, Mycobacterium
APMIPLDDALRPKWLFGNTVH

SEQ ID NO: 794135 - protein, 18 aa, Mycobacterium
APMIPLDDALRPTWLFGQ

SEQ ID NO: 794136 - protein, 19 aa, Mycobacterium
APMLDAAAAWAGLAEELSS

SEQ ID NO: 794137 - protein, 17 aa, Mycobacterium
APMLPATWDAQGVGAAG

SEQ ID NO: 794138 - protein, 17 aa, Mycobacterium
APMLPLDGGAIFARPDA

SEQ ID NO: 794139 - protein, 20 aa, Mycobacterium
APMPDWLRNALSATPGLSTR

SEQ ID NO: 794140 - protein, 22 aa, Mycobacterium
APMPTLADAVLPLRWSEGGESR

SEQ ID NO: 794141 - protein, 20 aa, Mycobacterium
APMQPFFDHPDRMTVLAEFD

SEQ ID NO: 794142 - protein, 32 aa, Mycobacterium
APMRSWSMGAMKLILLMGLRADVDRFNNAANG

SEQ ID NO: 794143 - protein, 22 aa, Mycobacterium
APMSLYRHVATKEELLHAVVDG

SEQ ID NO: 794144 - protein, 23 aa, Mycobacterium
APMTLRWLTDRFAGLPLTEHVIR

SEQ ID NO: 794145 - protein, 23 aa, Mycobacterium
APMTLRWLTDRFAGRPLSEHVIR

SEQ ID NO: 794146 - protein, 20 aa, Mycobacterium
APMVHPYVASKWAVRGLAKS

SEQ ID NO: 794147 - protein, 19 aa, Mycobacterium
APMVHPYVASKWAVRGLTK

SEQ ID NO: 794148 - protein, 25 aa, Mycobacterium
APMVSPFPAVFQDVSLVVPAHVPAQ

SEQ ID NO: 794149 - protein, 17 aa, Mycobacterium
APNFAFELAAERGLPKD

SEQ ID NO: 794150 - protein, 17 aa, Mycobacterium
APNFAFELAAERGLPKE

SEQ ID NO: 794151 - protein, 18 aa, Mycobacterium
APNFAYEWAAQRGLLTPG

SEQ ID NO: 794152 - protein, 18 aa, Mycobacterium
APNFGFDLAVRRTSDDDM

SEQ ID NO: 794153 - protein, 26 aa, Mycobacterium
APNFKDIVIRYITFAPYHMQTMFGAP

SEQ ID NO: 794154 - protein, 28 aa, Mycobacterium
APNINNPLTAVLFFLSTGTRFFKRRKAV

SEQ ID NO: 794155 - protein, 24 aa, Mycobacterium
APNNPLVGLYPTSDGRYISFVMMQ

SEQ ID NO: 794156 - protein, 24 aa, Mycobacterium
APNNPLVGLYTTSDGRYISFVMMQ

SEQ ID NO: 794157 - protein, 24 aa, Mycobacterium
APNPRFLQRMTLVLNQIQRRGFVV

SEQ ID NO: 794158 - protein, 22 aa, Mycobacterium
APNQRRPYRPPARPSGETLNGI

SEQ ID NO: 794159 - protein, 24 aa, Mycobacterium
APNRFIYKGYLIEGVPNAAWSVGY

SEQ ID NO: 794160 - protein, 24 aa, Mycobacterium
APNRMTPFVLPEPKLPAGAPERAA

SEQ ID NO: 794161 - protein, 35 aa, Mycobacterium; identical to SEQ ID NO: 124302

SEQ ID NO: 794162 - protein, 17 aa, Mycobacterium
APNVLLIPGTSSLRHLE

SEQ ID NO: 794163 - protein, 18 aa, Mycobacterium
APNWWARLVLRMRSQRAV

SEQ ID NO: 794164 - protein, 26 aa, Mycobacterium
APPACVAPLYAYLAGDLSARVTGQIF

SEQ ID NO: 794165 - protein, 25 aa, Mycobacterium
APPADFVAPLYAYLASDLASGITGQ

SEQ ID NO: 794166 - protein, 24 aa, Mycobacterium
APPADRLGFVLLANPMNPNGGLLS

SEQ ID NO: 794167 - protein, 27 aa, Mycobacterium
APPAEAPLPGLVLAPRPVSLNPLVSGL

SEQ ID NO: 794168 - protein, 18 aa, Mycobacterium
APPAPRLAPRRVTRQLMV

SEQ ID NO: 794169 - protein, 23 aa, Mycobacterium
APPDPLPQIYFGGSSPAAMPIAA

SEQ ID NO: 794170 - protein, 30 aa, Mycobacterium
APPDSTLVSWLPFYHDMGLVLGVCAPILGG

SEQ ID NO: 794171 - protein, 23 aa, Mycobacterium
APPEDWQLFSGWTDDIKKIFDWN

SEQ ID NO: 794172 - protein, 24 aa, Mycobacterium
APPEHRWKFRYLIVRDHTHRVVAA

SEQ ID NO: 794173 - protein, 32 aa, Mycobacterium
APPEKVWRLLTEPALMKLWWAEGQVAAVVGHT

SEQ ID NO: 794174 - protein, 21 aa, Mycobacterium
APPGVPVPLLIGGNGTRVLQL

SEQ ID NO: 794175 - protein, 26 aa, Mycobacterium
APPHHRWARYLRWVAEQIDMTVVSGD

SEQ ID NO: 794176 - protein, 29 aa, Mycobacterium
APPKMLPEFTSYRRWCELMWQRAAAPEAQ

SEQ ID NO: 794177 - protein, 25 aa, Mycobacterium
APPLDRLVAFGRERIRFVHAHHELL

SEQ ID NO: 794178 - protein, 19 aa, Mycobacterium
APPLLVRQFVKMSVFLPDR

SEQ ID NO: 794179 - protein, 25 aa, Mycobacterium
APPLNMNPHWLGAHPSYTLSKYGMT

SEQ ID NO: 794180 - protein, 21 aa, Mycobacterium
APPLPALPEADASDMDYFVSQ

SEQ ID NO: 794181 - protein, 18 aa, Mycobacterium
APPLVTWATHHVPFVAAV

SEQ ID NO: 794182 - protein, 27 aa, Mycobacterium
APPMVIETLQWMGGFGAIQYYANAADA

SEQ ID NO: 794183 - protein, 18 aa, Mycobacterium
APPNPWFHDLFHTDGRAY

SEQ ID NO: 794184 - protein, 17 aa, Mycobacterium
APPPDCAHDARWIYYSS

SEQ ID NO: 794185 - protein, 30 aa, Mycobacterium
APPPDLGTGLFLWQNIFGVWPSDGEVTDEL

SEQ ID NO: 794186 - protein, 26 aa, Mycobacterium
APPPLDVMAALRQPGIGVIAEVKRAS

SEQ ID NO: 794187 - protein, 25 aa, Mycobacterium
APPPLNVMAALREPGIGVIAEVKRA

SEQ ID NO: 794188 - protein, 17 aa, Mycobacterium
APPPPPEPPAAAPAPVT

SEQ ID NO: 794189 - protein, 22 aa, Mycobacterium
APPPPPVRAYSVNWDAIAQCES

SEQ ID NO: 794190 - protein, 25 aa, Mycobacterium
APPPREMDMLLTAGERISNALVAMA

SEQ ID NO: 794191 - protein, 22 aa, Mycobacterium
APPRLYLSRYAGAARSRLIPPA

SEQ ID NO: 794192 - protein, 28 aa, Mycobacterium
APPRRATLPPLMRGYLRLGAQVCGEPAH

SEQ ID NO: 794193 - protein, 23 aa, Mycobacterium
APPSPALLARLTPLGFDVTHLYG

SEQ ID NO: 794194 - protein, 23 aa, Mycobacterium
APPTGRVLLVWDAPNLDMGLGSI

SEQ ID NO: 794195 - protein, 23 aa, Mycobacterium
APPTLPPFMLADGVASLNAAYAV

SEQ ID NO: 794196 - protein, 53 aa, Mycobacterium
APPTNFPGERPAFGTPSYFAQLAFAVFHVVALPITVPVQFFLGSAEGVPTVIA

SEQ ID NO: 794197 - protein, 27 aa, Mycobacterium
APQADPLWLAWPNHMKIFWNNKGVVAK

SEQ ID NO: 794198 - protein, 25 aa, Mycobacterium
APQALRIWFGVTPVPRRNGKVPAVF

SEQ ID NO: 794199 - protein, 23 aa, Mycobacterium
APQAPCMLFCAPPPPPAEPFNPF

SEQ ID NO: 794200 - protein, 23 aa, Mycobacterium
APQAPFPLATMQHAYWIGRSDEQ

SEQ ID NO: 794201 - protein, 24 aa, Mycobacterium
APQAPMGLIPGWGKLMSKILSAFF

SEQ ID NO: 794202 - protein, 27 aa, Mycobacterium
APQAPQTVAPAPQPPLGGGGSGSGGGS

SEQ ID NO: 794203 - protein, 25 aa, Mycobacterium
APQAVSLFYAIDARCGELGVDWAVV

SEQ ID NO: 794204 - protein, 22 aa, Mycobacterium
APQDPYTQQLLASLPAAEPMSG

SEQ ID NO: 794205 - protein, 19 aa, Mycobacterium
APQFHPSYRHAGAVRREIG

SEQ ID NO: 794206 - protein, 25 aa, Mycobacterium
APQGDYRPALLHDGVVYTAGMTPRR

SEQ ID NO: 794207 - protein, 23 aa, Mycobacterium
APQGIDYVAGFYAAVKAGAIAVP

SEQ ID NO: 794208 - protein, 24 aa, Mycobacterium
APQGLDYIVGFFSAIKAGAIAVPL

SEQ ID NO: 794209 - protein, 27 aa, Mycobacterium
APQGRVDAFLDLFGGGYVDLALNELGV

SEQ ID NO: 794210 - protein, 26 aa, Mycobacterium
APQHYQRIVDKTALKRIGDPATDIGP

SEQ ID NO: 794211 - protein, 22 aa, Mycobacterium
APQLWVVGTRPFGPICEFVRAT

SEQ ID NO: 794212 - protein, 20 aa, Mycobacterium
APQMFSGMLGPLSSMNGLNG

SEQ ID NO: 794213 - protein, 17 aa, Mycobacterium
APQPGEFMMLYAFGVGE

SEQ ID NO: 794214 - protein, 24 aa, Mycobacterium
APQPRLLVLNEPLATELGLDPDWL

SEQ ID NO: 794215 - protein, 28 aa, Mycobacterium
APQQARFTMLPWTHTFTTTIPAVFANLV

SEQ ID NO: 794216 - protein, 23 aa, Mycobacterium
APQSKFLVSIPTPFNAVNFFVEF

SEQ ID NO: 794217 - protein, 25 aa, Mycobacterium
APQTATLIPLLRRDGMSEDGVDRVF

SEQ ID NO: 794218 - protein, 20 aa, Mycobacterium
APQWPELAIGALAGGGGVVL

SEQ ID NO: 794219 - protein, 28 aa, Mycobacterium
APRAITFGPQLDAPLADALRYPVKLIDE

SEQ ID NO: 794220 - protein, 22 aa, Mycobacterium
APRDEFLLLYGIDEDGQISLQV

SEQ ID NO: 794221 - protein, 24 aa, Mycobacterium
APRDPTLRRLLPDFVHPDDDDSAG

SEQ ID NO: 794222 - protein, 25 aa, Mycobacterium
APRDTLASVLRLWTADAARLTQGRP

SEQ ID NO: 794223 - protein, 21 aa, Mycobacterium
APRDVIALIETPRGAVFATEI

SEQ ID NO: 794224 - protein, 22 aa, Mycobacterium
APREPFSVMRPIIESNLGALSK

SEQ ID NO: 794225 - protein, 29 aa, Mycobacterium
APREQVHRHLLRYMNWIPSEFVDAMAPTT

SEQ ID NO: 794226 - protein, 23 aa, Mycobacterium
APRGSAYHYFPGGRTQLLCEAID

SEQ ID NO: 794227 - protein, 24 aa, Mycobacterium
APRGVRGMWKTLRAAAKDPDVGRG

SEQ ID NO: 794228 - protein, 31 aa, Mycobacterium
APRHLGLLAVIAKSFARIHWQNLANFGVLAL

SEQ ID NO: 794229 - protein, 17 aa, Mycobacterium
APRHTHLRKIISRGFTP

SEQ ID NO: 794230 - protein, 26 aa, Mycobacterium
APRKHAARMTWLQTLAHEMRTCVFFE

SEQ ID NO: 794231 - protein, 17 aa, Mycobacterium
APRLFCDMLPADAVPPK

SEQ ID NO: 794232 - protein, 19 aa, Mycobacterium
APRLFPAGPPTDAALVVGA

SEQ ID NO: 794233 - protein, 23 aa, Mycobacterium
APRLLLEVMCARLLLPSAADTES

SEQ ID NO: 794234 - protein, 23 aa, Mycobacterium
APRLLLEVVCARLLLPSASDTEA

SEQ ID NO: 794235 - protein, 23 aa, Mycobacterium
APRLLLEVVCARLLLPSATDAES

SEQ ID NO: 794236 - protein, 22 aa, Mycobacterium
APRLLLEVVCSRLLLPSASDTE

SEQ ID NO: 794237 - protein, 27 aa, Mycobacterium
APRLSGPMTFDITRLGRRPGAMVTVRN

SEQ ID NO: 794238 - protein, 23 aa, Mycobacterium
APRMLFALPRYREGTAERLRMPV

SEQ ID NO: 794239 - protein, 27 aa, Mycobacterium
APRMLGQGTALWRLLRGDDARALFSGV

SEQ ID NO: 794240 - protein, 20 aa, Mycobacterium
APRMPMVPGTWPPGDGKGAP

SEQ ID NO: 794241 - protein, 20 aa, Mycobacterium
APRPAVISYLTVADARAAIG

SEQ ID NO: 794242 - protein, 24 aa, Mycobacterium
APRPDLILLDLNLPKYDGRQLLEK

SEQ ID NO: 794243 - protein, 25 aa, Mycobacterium
APRPDVYIAALGPQLLRLAGRRTQG

SEQ ID NO: 794244 - protein, 26 aa, Mycobacterium
APRPGTRVVALPLLRRGKEVHGIGLS

SEQ ID NO: 794245 - protein, 26 aa, Mycobacterium
APRQAYLAALLGYPAPTYAHVPLVLN

SEQ ID NO: 794246 - protein, 17 aa, Mycobacterium
APRRAMPPQHLADLDET

SEQ ID NO: 794247 - protein, 27 aa, Mycobacterium
APRREGPPGFLFLDPPDHTRLRRLVSK

SEQ ID NO: 794248 - protein, 24 aa, Mycobacterium
APRRIVDLAVQRWGHIDFLINNAG

SEQ ID NO: 794249 - protein, 18 aa, Mycobacterium
APRRWLLVSTGESVDPWA

SEQ ID NO: 794250 - protein, 25 aa, Mycobacterium
APRSLQNFYIAYRAVVRAKVDCVRV

SEQ ID NO: 794251 - protein, 25 aa, Mycobacterium
APRSRWLYRVFPYDEATLLLTHGGS

SEQ ID NO: 794252 - protein, 20 aa, Mycobacterium
APRTASFVDALPLSGAGKVL

SEQ ID NO: 794253 - protein, 25 aa, Mycobacterium
APRTATLIPLLRRDGMSDGDVERVF

SEQ ID NO: 794254 - protein, 17 aa, Mycobacterium
APRTMLCGYAWRVHVNI

SEQ ID NO: 794255 - protein, 20 aa, Mycobacterium
APRTPLLSNLLGISGEMKAA

SEQ ID NO: 794256 - protein, 26 aa, Mycobacterium
APRVEPEVAFLLREPLRGPGVTAADV

SEQ ID NO: 794257 - protein, 20 aa, Mycobacterium
APRVSTVIKADWRTGASDAM

SEQ ID NO: 794258 - protein, 35 aa, Mycobacterium
APRYAELIKRTQWWGRQMLIWGVHVHVGISSAHKV

SEQ ID NO: 794259 - protein, 24 aa, Mycobacterium
APSAGWRKWVYRASGRLINPGESP

SEQ ID NO: 794260 - protein, 18 aa, Mycobacterium
APSAWIAEGLLIYLPAAA

SEQ ID NO: 794261 - protein, 18 aa, Mycobacterium
APSDFWTGYTPSKTEFLP

SEQ ID NO: 794262 - protein, 26 aa, Mycobacterium
APSDIRDRWLPGLIDGSIRGSFALSE

SEQ ID NO: 794263 - protein, 23 aa, Mycobacterium
APSGLPYRMSCQAGLPLGAQAAE

SEQ ID NO: 794264 - protein, 25 aa, Mycobacterium
APSGPGFFYPPTVLSGVPRDAEMVG

SEQ ID NO: 794265 - protein, 25 aa, Mycobacterium
APSHRPLPVMVFIHGGGYILGSSAT

SEQ ID NO: 794266 - protein, 26 aa, Mycobacterium
APSIISLTLLPRLTSRAAGRYFVTGE

SEQ ID NO: 794267 - protein, 24 aa, Mycobacterium
APSIISLTVLPKMSLRSAGRYFVT

SEQ ID NO: 794268 - protein, 29 aa, Mycobacterium
APSLHNSQPWRWVADATAVMLFLDDAAAP

SEQ ID NO: 794269 - protein, 17 aa, Mycobacterium
APSLVFLDEIDALAPRR

SEQ ID NO: 794270 - protein, 21 aa, Mycobacterium
APSLVIRIAPPVGRQLDWMVC

SEQ ID NO: 794271 - protein, 24 aa, Mycobacterium
APSNGFFFAEPRCRVLTGVGAFDP

SEQ ID NO: 794272 - protein, 29 aa, Mycobacterium
APSNNPLISPLGWKALIDTGGLSAVRGLR

SEQ ID NO: 794273 - protein, 29 aa, Mycobacterium
APSPLVERIPGMRAKLFDAARLAASAIGY

SEQ ID NO: 794274 - protein, 21 aa, Mycobacterium
APSRALVRFGFAAGDGLRKLA

SEQ ID NO: 794275 - protein, 19 aa, Mycobacterium
APSRLRCELFAAIQAAHPY

SEQ ID NO: 794276 - protein, 29 aa, Mycobacterium
APSTDAYLGLLRFLLGLDLIDRVVFWMLP

SEQ ID NO: 794277 - protein, 18 aa, Mycobacterium
APSVFAPVPGFRGQQRFS

SEQ ID NO: 794278 - protein, 22 aa, Mycobacterium
APSVFQTRPAGLPGLRQKYGLD

SEQ ID NO: 794279 - protein, 27 aa, Mycobacterium
APSVGLMQPWRFIRITDDTLRSRIHAL

SEQ ID NO: 794280 - protein, 21 aa, Mycobacterium
APSVLAPMLLGATTALAQAFH

SEQ ID NO: 794281 - protein, 18 aa, Mycobacterium
APSYFSLDDWGYACLVGD

SEQ ID NO: 794282 - protein, 20 aa, Mycobacterium
APSYFVYDAILNRKDRDLLD

SEQ ID NO: 794283 - protein, 18 aa, Mycobacterium
APSYRSFVSWLDRQDRSA

SEQ ID NO: 794284 - protein, 26 aa, Mycobacterium
APTADQLGFLLLANPMNPNGGLLSRF

SEQ ID NO: 794285 - protein, 26 aa, Mycobacterium
APTALFRILELIDEGLAPPVSVLGGP

SEQ ID NO: 794286 - protein, 26 aa, Mycobacterium
APTALLSIYRDAVPPRYAKALRNYTY

SEQ ID NO: 794287 - protein, 23 aa, Mycobacterium
APTASGFWHWAVADLPVSVTELP

SEQ ID NO: 794288 - protein, 24 aa, Mycobacterium
APTASGFWHWAVANLPADVTELAE

SEQ ID NO: 794289 - protein, 23 aa, Mycobacterium
APTASGFWHWAVANLPATVTQLP

SEQ ID NO: 794290 - protein, 23 aa, Mycobacterium
APTASWMFEYYPMRDVRELPDGS

SEQ ID NO: 794291 - protein, 19 aa, Mycobacterium
APTASWMFEYYPMREVREL

SEQ ID NO: 794292 - protein, 31 aa, Mycobacterium
APTDTIPNWFFRPLWHRRDRLRPSVPVDGAV

SEQ ID NO: 794293 - protein, 20 aa, Mycobacterium
APTEALFGRGLISNGAAGTA

SEQ ID NO: 794294 - protein, 50 aa, Mycobacterium
APTGAAYLGLLRFLFGLDLIDRVVFWMLPLDDPLPWLLVDRRAMKVTAVH

SEQ ID NO: 794295 - protein, 24 aa, Mycobacterium
APTGAVLLQLRWLCLEGRDDPVNE

SEQ ID NO: 794296 - protein, 24 aa, Mycobacterium
APTGAVLLQVRWLCLEGRDDPVDE

SEQ ID NO: 794297 - protein, 28 aa, Mycobacterium
APTGDRWDAAFAYWQQLRTDPGAVFDTE

SEQ ID NO: 794298 - protein, 26 aa, Mycobacterium
APTGHTIRLLQLPGSWTDFLDAGKGD

SEQ ID NO: 794299 - protein, 31 aa, Mycobacterium
APTGSGKTLAAFLWAIDRLADPAREPSQGTQ

SEQ ID NO: 794300 - protein, 27 aa, Mycobacterium
APTGSSPLLPAMMATPAAHAVPVVSGP

SEQ ID NO: 794301 - protein, 25 aa, Mycobacterium
APTIDTDWYLAWLAREAKNAGVCVD

SEQ ID NO: 794302 - protein, 18 aa, Mycobacterium
APTIGFRVEFDGASAVLA

SEQ ID NO: 794303 - protein, 17 aa, Mycobacterium
APTILEAAGIPAPVVVN

SEQ ID NO: 794304 - protein, 26 aa, Mycobacterium
APTIRYYEHIGLLPDPRRVGGQRRYD

SEQ ID NO: 794305 - protein, 24 aa, Mycobacterium
APTLFPDQRFAAIVAVGVFTFAHA

SEQ ID NO: 794306 - protein, 31 aa, Mycobacterium
APTLREYLGPMTWYWDLMFDRTPGGMTVLGH

SEQ ID NO: 794307 - protein, 22 aa, Mycobacterium
APTPAAIFLGGGLTQPGLLDAC

SEQ ID NO: 794308 - protein, 50 aa, Mycobacterium
APTPAAYLGLLRFLLGLDLIDRVVFWMLPMDDPLPWLLADRRAARVTAVH

SEQ ID NO: 794309 - protein, 25 aa, Mycobacterium
APTPSGVIVTRWAQDPFARGSYSFL

SEQ ID NO: 794310 - protein, 25 aa, Mycobacterium
APTPVAWTRMRAPRSLMAAIGDDAI

SEQ ID NO: 794311 - protein, 25 aa, Mycobacterium
APTPVAWTRMRVPRSLMASIGDDEI

SEQ ID NO: 794312 - protein, 23 aa, Mycobacterium
APTPVAWTRMRVPRSLMGAIGTD

SEQ ID NO: 794313 - protein, 17 aa, Mycobacterium
APTQAIPVPEPEPAPKA

SEQ ID NO: 794314 - protein, 22 aa, Mycobacterium
APTRFGFFGTPVVPIMYAADTE

SEQ ID NO: 794315 - protein, 18 aa, Mycobacterium
APTRPLDPPPPAQAAPTM

SEQ ID NO: 794316 - protein, 28 aa, Mycobacterium
APTTAFASAPFSWVHWLTESRATLTAAP

SEQ ID NO: 794317 - protein, 24 aa, Mycobacterium
APTTGVLPLLPTSASLLQLSSAAL

SEQ ID NO: 794318 - protein, 22 aa, Mycobacterium
APTTLQVIFAYPGVHAIWLHRI

SEQ ID NO: 794319 - protein, 21 aa, Mycobacterium
APTTVLFLHGWTQNREAWDDV

SEQ ID NO: 794320 - protein, 24 aa, Mycobacterium
APTYLYRYDYAPRTLRWSGLGATH

SEQ ID NO: 794321 - protein, 22 aa, Mycobacterium
APTYVYRYDYATAALRLSGMGA

SEQ ID NO: 794322 - protein, 19 aa, Mycobacterium
APVADLGLILVWDDGDDNL

SEQ ID NO: 794323 - protein, 20 aa, Mycobacterium
APVAHYWPEFAQAGKQDITL

SEQ ID NO: 794324 - protein, 19 aa, Mycobacterium
APVAKERGLFRPDAVERLL

SEQ ID NO: 794325 - protein, 19 aa, Mycobacterium
APVARFLARWVREAGPRIL

SEQ ID NO: 794326 - protein, 20 aa, Mycobacterium
APVARYWPEFGQAGKQDITL

SEQ ID NO: 794327 - protein, 19 aa, Mycobacterium
APVARYWPEFGQKGKDAVT

SEQ ID NO: 794328 - protein, 25 aa, Mycobacterium
APVEDRGRRYIAMVLVDSSGAEVVY

SEQ ID NO: 794329 - protein, 24 aa, Mycobacterium
APVEGDWLLLVELAADHDQTDRLA

SEQ ID NO: 794330 - protein, 19 aa, Mycobacterium
APVFAVVGDAKPLPPNTRL

SEQ ID NO: 794331 - protein, 18 aa, Mycobacterium
APVFLLGASANRDPEAWT

SEQ ID NO: 794332 - protein, 29 aa, Mycobacterium
APVGVFVGLATLDVIHRIAKPPAVNEKIT

SEQ ID NO: 794333 - protein, 20 aa, Mycobacterium
APVHRAAVTATEWGLRGTRR

SEQ ID NO: 794334 - protein, 21 aa, Mycobacterium
APVHYSQRLYGAVPGTLIGEI

SEQ ID NO: 794335 - protein, 17 aa, Mycobacterium
APVITVRPGAVEAAPAA

SEQ ID NO: 794336 - protein, 17 aa, Mycobacterium
APVKEFAAAFKPPMRWG

SEQ ID NO: 794337 - protein, 18 aa, Mycobacterium
APVLDADLLRRGKHNGLS

SEQ ID NO: 794338 - protein, 17 aa, Mycobacterium
APVLDRLASYQARSVDI

SEQ ID NO: 794339 - protein, 19 aa, Mycobacterium
APVLDRLIAFTGRRPVHPT

SEQ ID NO: 794340 - protein, 19 aa, Mycobacterium
APVLPLRDRQRVAIRAELR

SEQ ID NO: 794341 - protein, 18 aa, Mycobacterium
APVLSQPSLPLGITARHR

SEQ ID NO: 794342 - protein, 19 aa, Mycobacterium
APVLVLRRTSYTDGDKPLE

SEQ ID NO: 794343 - protein, 27 aa, Mycobacterium
APVMCEPFRQWVIESRFAGPVPAWSAV

SEQ ID NO: 794344 - protein, 23 aa, Mycobacterium
APVMPTGKVIGFLHADRLYSGRI

SEQ ID NO: 794345 - protein, 17 aa, Mycobacterium
APVPALVDLSTKADMVV

SEQ ID NO: 794346 - protein, 18 aa, Mycobacterium
APVPFLTINSVAPTIMAF

SEQ ID NO: 794347 - protein, 28 aa, Mycobacterium
APVPGAALFVLDRWLRPVPPGVVGELYV

SEQ ID NO: 794348 - protein, 26 aa, Mycobacterium
APVPVPRNVPWFPADIDHWTVRWVVM

SEQ ID NO: 794349 - protein, 22 aa, Mycobacterium
APVPWIDHVVAARLLARLGSVD

SEQ ID NO: 794350 - protein, 26 aa, Mycobacterium
APVQHIPKFMLQLPRYVNARSRVARV

SEQ ID NO: 794351 - protein, 25 aa, Mycobacterium
APVQRTWPELIPLLASGRLDVDGIF

SEQ ID NO: 794352 - protein, 26 aa, Mycobacterium
APVQRTWPELIPLLQSGRLDVDGIFT

SEQ ID NO: 794353 - protein, 26 aa, Mycobacterium
APVQRTWSELIPLLESGRLDVDGIFT

SEQ ID NO: 794354 - protein, 25 aa, Mycobacterium
APVQVDTWGGWLFVNMDPDCEPLAD

SEQ ID NO: 794355 - protein, 23 aa, Mycobacterium
APVRDWLYDKVAGIRYRIFGKYD

SEQ ID NO: 794356 - protein, 20 aa, Mycobacterium
APVRERLALGFGSSSFRYAA

SEQ ID NO: 794357 - protein, 19 aa, Mycobacterium
APVRERLALGFGSSTFRYA

SEQ ID NO: 794358 - protein, 17 aa, Mycobacterium
APVRRACYAADRTGHMI

SEQ ID NO: 794359 - protein, 24 aa, Mycobacterium
APVRRAIGWYRSHGRLHTGDQIAM

SEQ ID NO: 794360 - protein, 24 aa, Mycobacterium
APVSGFGFRRPLPPAAADHVAAVA

SEQ ID NO: 794361 - protein, 25 aa, Mycobacterium
APVSLVDCPPYRPFWAITKHADVME

SEQ ID NO: 794362 - protein, 19 aa, Mycobacterium
APVTERLALGFGGSTFRYA

SEQ ID NO: 794363 - protein, 20 aa, Mycobacterium
APVTFVDIAGLVKGASEGAG

SEQ ID NO: 794364 - protein, 25 aa, Mycobacterium
APVTRPRIRLAYQLTPRRITGDARA

SEQ ID NO: 794365 - protein, 25 aa, Mycobacterium
APVVAYVHSPARWAWDRTFRDHEMA

SEQ ID NO: 794366 - protein, 25 aa, Mycobacterium
APVVDGALKIGFSQATQQSPFYVAL

SEQ ID NO: 794367 - protein, 17 aa, Mycobacterium
APVVMHTALRPAAEGVL

SEQ ID NO: 794368 - protein, 19 aa, Mycobacterium
APVVVTYPSSVVGAAFGGT

SEQ ID NO: 794369 - protein, 18 aa, Mycobacterium
APVWDLHGALGIDRLSWA

SEQ ID NO: 794370 - protein, 20 aa, Mycobacterium
APVWMPRAKRNSIRAVQEAI

SEQ ID NO: 794371 - protein, 21 aa, Mycobacterium
APWCPWNIEFIRRMNGLASVD

SEQ ID NO: 794372 - protein, 17 aa, Mycobacterium
APWDTPDGTPPPGTGLS

SEQ ID NO: 794373 - protein, 25 aa, Mycobacterium
APWPDPVDVLPPPHDNRLAQPYGGY

SEQ ID NO: 794374 - protein, 18 aa, Mycobacterium
APWWSRDLWDLRIDPRIP

SEQ ID NO: 794375 - protein, 20 aa, Mycobacterium
APYADLIWMETGVPDLEVAR

SEQ ID NO: 794376 - protein, 18 aa, Mycobacterium
APYEGPPPGPGDLAAIDA

SEQ ID NO: 794377 - protein, 18 aa, Mycobacterium
APYEHSFPFTGRIHRIDA

SEQ ID NO: 794378 - protein, 25 aa, Mycobacterium
APYKRLSRVVFVPDIPRLPSGKVLR

SEQ ID NO: 794379 - protein, 24 aa, Mycobacterium
APYLGFQLGSMWYISLDYINHQTS

SEQ ID NO: 794380 - protein, 17 aa, Mycobacterium
APYLRYLNHKMKRDALV

SEQ ID NO: 794381 - protein, 24 aa, Mycobacterium
APYMRLREHLAATGLVVIGVEFRN

SEQ ID NO: 794382 - protein, 24 aa, Mycobacterium
APYNPYAPDLFTAGWFARYISSYA

SEQ ID NO: 794383 - protein, 24 aa, Mycobacterium
APYQGFQLGSMWYVSLDYINHQTS

SEQ ID NO: 794384 - protein, 21 aa, Mycobacterium
APYQIVMGERRWRAAQEAGLA

SEQ ID NO: 794385 - protein, 27 aa, Mycobacterium
APYRTASLRVNFLRPFHGGGEAHYRAT

SEQ ID NO: 794386 - protein, 19 aa, Mycobacterium
APYSRFAVGAAALVDDHRV

SEQ ID NO: 794387 - protein, 23 aa, Mycobacterium
AQAADLFRWLGPYPDAAVGSAGT

SEQ ID NO: 794388 - protein, 24 aa, Mycobacterium
AQAAELFGWLGPHPDAVAGSAAAI

SEQ ID NO: 794389 - protein, 30 aa, Mycobacterium
AQAAERLGFRRGWLSERFDLKDSGAILGGI

SEQ ID NO: 794390 - protein, 25 aa, Mycobacterium
AQAARQFFARAYQPGWRVTGLTSRS

SEQ ID NO: 794391 - protein, 22 aa, Mycobacterium
AQAATFYQKFVQALSGAGNSYA

SEQ ID NO: 794392 - protein, 17 aa, Mycobacterium
AQAAVRRTPLLLDGMAV

SEQ ID NO: 794393 - protein, 23 aa, Mycobacterium
AQAAVYRAFGVRSLLLANELVDA

SEQ ID NO: 794394 - protein, 19 aa, Mycobacterium
AQAAWRRVLAGFDTPTLVG

SEQ ID NO: 794395 - protein, 25 aa, Mycobacterium
AQADPIVAHIFRTHFWFVEERLRTL

SEQ ID NO: 794396 - protein, 23 aa, Mycobacterium
AQAEALVPQLLAFGATEVHAADR

SEQ ID NO: 794397 - protein, 18 aa, Mycobacterium
AQAELARRFGAAKVLAHE

SEQ ID NO: 794398 - protein, 23 aa, Mycobacterium
AQAELFIVAANYNGRPTLFIVES

SEQ ID NO: 794399 - protein, 26 aa, Mycobacterium
AQAELLARLLPVVRDVRRIGSAALDL

SEQ ID NO: 794400 - protein, 27 aa, Mycobacterium
AQAESFHRWFSQALSAAAGSYASAEAA

SEQ ID NO: 794401 - protein, 26 aa, Mycobacterium
AQAFATMACLYPDRIFLGVGTGEALN

SEQ ID NO: 794402 - protein, 24 aa, Mycobacterium
AQAFATMACLYPDRVFLGVGTGEA

SEQ ID NO: 794403 - protein, 25 aa, Mycobacterium
AQAFHWVRHALRRPLAPGSSVIVMS

SEQ ID NO: 794404 - protein, 17 aa, Mycobacterium
AQAFPRSRFTGIDFSDA

SEQ ID NO: 794405 - protein, 23 aa, Mycobacterium
AQAGGLPALFSGLARRPRRRQID

SEQ ID NO: 794406 - protein, 26 aa, Mycobacterium
AQAGKLPVTLFTAGGIATPADAAMMM

SEQ ID NO: 794407 - protein, 26 aa, Mycobacterium
AQAGRFGIHPALLDAALHAGLYGALD

SEQ ID NO: 794408 - protein, 26 aa, Mycobacterium
AQAGTSMLCCLPRPARLRESVIAHKI

SEQ ID NO: 794409 - protein, 26 aa, Mycobacterium
AQAHAQLAMYQLAVAAGLIADGDEPG

SEQ ID NO: 794410 - protein, 18 aa, Mycobacterium
AQAHRLLERSFAQYQADR

SEQ ID NO: 794411 - protein, 19 aa, Mycobacterium
AQAIAQVCELNWQLRGQAT

SEQ ID NO: 794412 - protein, 23 aa, Mycobacterium
AQAIVAAVGKWPPASGRASALVD

SEQ ID NO: 794413 - protein, 25 aa, Mycobacterium
AQAKMAKISEEFTRWLWSDETRRDT

SEQ ID NO: 794414 - protein, 26 aa, Mycobacterium
AQAKQPLSVFFFDILHRDGRDLLDAP

SEQ ID NO: 794415 - protein, 27 aa, Mycobacterium
AQALGFPDVVAPLTFTSAPGMQCNRRM

SEQ ID NO: 794416 - protein, 18 aa, Mycobacterium
AQALLKHWKTGKPLPTFT

SEQ ID NO: 794417 - protein, 23 aa, Mycobacterium
AQALLVDLDPWGGGIDLLVGGES

SEQ ID NO: 794418 - protein, 28 aa, Mycobacterium
AQALYDDLKPLLQFIVAGGLATTVKAGL

SEQ ID NO: 794419 - protein, 24 aa, Mycobacterium
AQANAAALAPITTVLPAGADEVSA

SEQ ID NO: 794420 - protein, 17 aa, Mycobacterium
AQAPELLPALGKASADV

SEQ ID NO: 794421 - protein, 23 aa, Mycobacterium
AQAQVWFDRAMVWAYAFNHEESI

SEQ ID NO: 794422 - protein, 27 aa, Mycobacterium
AQARAFHERFVQALAFGGSQYASAEAA

SEQ ID NO: 794423 - protein, 24 aa, Mycobacterium
AQARDIPVYRLNDASLIQIGQGKY

SEQ ID NO: 794424 - protein, 31 aa, Mycobacterium
AQARELADRLLTCGPGLVALAVPKVGDLVAW

SEQ ID NO: 794425 - protein, 28 aa, Mycobacterium
AQARELSLLVPPLFLQHFGSTSWVAEDG

SEQ ID NO: 794426 - protein, 21 aa, Mycobacterium
AQARLFRRTLDLAGVRPDQIG

SEQ ID NO: 794427 - protein, 21 aa, Mycobacterium
AQARRAALLTTLFAAATEAEQ

SEQ ID NO: 794428 - protein, 21 aa, Mycobacterium
AQARRRLVASLTTPISLIKHA

SEQ ID NO: 794429 - protein, 20 aa, Mycobacterium
AQARYIVRALKYLRRRNRSY

SEQ ID NO: 794430 - protein, 22 aa, Mycobacterium
AQASILVLPVAIDSGDEWVVLR

SEQ ID NO: 794431 - protein, 21 aa, Mycobacterium
AQASILVLPVAIDSGEEWVVL

SEQ ID NO: 794432 - protein, 22 aa, Mycobacterium
AQASLLVLPVAIESGEEWVLID

SEQ ID NO: 794433 - protein, 31 aa, Mycobacterium
AQASPPDMKLPIALALGWPARVAGAAAACDF

SEQ ID NO: 794434 - protein, 29 aa, Mycobacterium
AQASPPDMKLPIALALGWPDRIAGAAAAC

SEQ ID NO: 794435 - protein, 30 aa, Mycobacterium
AQASPPDMKLPIALALGWPDRVPAAASACD

SEQ ID NO: 794436 - protein, 32 aa, Mycobacterium
AQASPPDMRLPIALALGWPRRVPGAAASCDFS

SEQ ID NO: 794437 - protein, 24 aa, Mycobacterium
AQATDGRIILPRTTYDQINMGQNI

SEQ ID NO: 794438 - protein, 25 aa, Mycobacterium
AQAVLELALIHKYGMSPSSVYLSPA

SEQ ID NO: 794439 - protein, 25 aa, Mycobacterium
AQAVWDLRRLLSWIRSQQAGPMIGL

SEQ ID NO: 794440 - protein, 31 aa, Mycobacterium
AQAWERGRYAAPYLRDSLLAAGALCETLETA

SEQ ID NO: 794441 - protein, 22 aa, Mycobacterium
AQAYPFMTPIFGKGVVFDASPE

SEQ ID NO: 794442 - protein, 21 aa, Mycobacterium
AQAYRLFHAARRLSAAMTGSS

SEQ ID NO: 794443 - protein, 18 aa, Mycobacterium
AQAYRLHTFGTVTRVAGG

SEQ ID NO: 794444 - protein, 23 aa, Mycobacterium
AQAYRLQTFGTVTRLALGGELGA

SEQ ID NO: 794445 - protein, 17 aa, Mycobacterium
AQCAIDAGVAFVNALPV

SEQ ID NO: 794446 - protein, 35 aa, Mycobacterium
AQCIAQMMFTGWWVNPAHLLVLGPYFNDHIYEIDW

SEQ ID NO: 794447 - protein, 18 aa, Mycobacterium
AQCYSHHIVIYWTGYLEA

SEQ ID NO: 794448 - protein, 30 aa, Mycobacterium
AQDAFGDKVLPLYLPAGAGLIGLLSQIHYE

SEQ ID NO: 794449 - protein, 24 aa, Mycobacterium
AQDETALASWFRTAADSGSLEQYL

SEQ ID NO: 794450 - protein, 23 aa, Mycobacterium
AQDGAYSPPTHLLVNGQPVGGDT

SEQ ID NO: 794451 - protein, 26 aa, Mycobacterium
AQDGRRFWIVGLEPERHWPALCRAVG

SEQ ID NO: 794452 - protein, 25 aa, Mycobacterium
AQDHILPPMRSHLKSQVRLTESAGV

SEQ ID NO: 794453 - protein, 25 aa, Mycobacterium
AQDIARFKVFDWARSDHWQTDIPFA

SEQ ID NO: 794454 - protein, 24 aa, Mycobacterium
AQDIAVHFPLYVIMSLLGIPESDF

SEQ ID NO: 794455 - protein, 25 aa, Mycobacterium
AQDKLRTATLRMLLAAIQTEEVSGK

SEQ ID NO: 794456 - protein, 25 aa, Mycobacterium
AQDLHATHWALLRALVAEGPNDLFI

SEQ ID NO: 794457 - protein, 17 aa, Mycobacterium
AQDLLFERVVALSAPGS

SEQ ID NO: 794458 - protein, 33 aa, Mycobacterium
AQDLLWGPAMRNYPDLRFAFSEGGIGWIPFYLD

SEQ ID NO: 794459 - protein, 23 aa, Mycobacterium
AQDLPVHVLVLGGGESRDLSIPD

SEQ ID NO: 794460 - protein, 27 aa, Mycobacterium
AQDLSDLLWSFAPPPRRRPATLSEIPS

SEQ ID NO: 794461 - protein, 26 aa, Mycobacterium
AQDPTPPKLFLLTRNAQPVEAGDRAD

SEQ ID NO: 794462 - protein, 26 aa, Mycobacterium
AQDQVSPLLALAAKVLGALVPGLPAQ

SEQ ID NO: 794463 - protein, 22 aa, Mycobacterium
AQDRAWLGAADKRIAAGAPAVR

SEQ ID NO: 794464 - protein, 27 aa, Mycobacterium
AQDVLARIRPVLGAYGDPILHAGDTGA

SEQ ID NO: 794465 - protein, 27 aa, Mycobacterium
AQDVTEAVLWLVGPRARYVTGVSIPVD

SEQ ID NO: 794466 - protein, 23 aa, Mycobacterium
AQEANWMFALVRTTRTDKKQRGI

SEQ ID NO: 794467 - protein, 25 aa, Mycobacterium
AQEEILRMTLQGCVPLVIGRFSNLA

SEQ ID NO: 794468 - protein, 21 aa, Mycobacterium
AQEEVFGPVLTVLRYRDDDDA

SEQ ID NO: 794469 - protein, 33 aa, Mycobacterium
AQEHIGGYMRVLLKPGGLAQLPMDRINFRNMRA

SEQ ID NO: 794470 - protein, 28 aa, Mycobacterium
AQEIALQNLLPCIYLVDSGGAFLPRQDE

SEQ ID NO: 794471 - protein, 24 aa, Mycobacterium
AQELYFPVCFELAVTKGPPAPDDR

SEQ ID NO: 794472 - protein, 26 aa, Mycobacterium
AQENARLERGLLPSPLLMEGSGVDIV

SEQ ID NO: 794473 - protein, 23 aa, Mycobacterium
AQERLFRKAIDRAGIRPEDVGMI

SEQ ID NO: 794474 - protein, 27 aa, Mycobacterium
AQERREFLTDLSLIGGLIIAAADTEGK

SEQ ID NO: 794475 - protein, 25 aa, Mycobacterium
AQETGIRPGVLYRSSELSKLSDDGR

SEQ ID NO: 794476 - protein, 23 aa, Mycobacterium
AQEVLLDCYLALQRYQKAAVVAH

SEQ ID NO: 794477 - protein, 21 aa, Mycobacterium
AQEYLVWRAAANHFELVRDAD

SEQ ID NO: 794478 - protein, 23 aa, Mycobacterium
AQFADLEPYLDWDLATEPQRYAK

SEQ ID NO: 794479 - protein, 25 aa, Mycobacterium
AQFGNMLSVSLIFVLEMMVAQAESD

SEQ ID NO: 794480 - protein, 21 aa, Mycobacterium
AQFGTLGHRTGIRLDSGIVGG

SEQ ID NO: 794481 - protein, 28 aa, Mycobacterium
AQFIRAGSIIQLLLGNIGRPGGGVFALR

SEQ ID NO: 794482 - protein, 20 aa, Mycobacterium
AQFITWRGIPLIPSDKVPVV

SEQ ID NO: 794483 - protein, 31 aa, Mycobacterium
AQFLAAIEAPIVITPWRSVLVFDLDEGVADT

SEQ ID NO: 794484 - protein, 21 aa, Mycobacterium
AQFLRITRHPAPNLRDADLPA

SEQ ID NO: 794485 - protein, 32 aa, Mycobacterium
AQFPHLRALAVRPAIIWKIYLASAEQSQLGPA

SEQ ID NO: 794486 - protein, 22 aa, Mycobacterium
AQFTIVLPRREGVEYSVEHAVI

SEQ ID NO: 794487 - protein, 22 aa, Mycobacterium
AQFTVVLPRREGVEYSVEHAVV

SEQ ID NO: 794488 - protein, 20 aa, Mycobacterium
AQGFLLSRPIPTDAMETLLA

SEQ ID NO: 794489 - protein, 21 aa, Mycobacterium
AQGHEALRRWASSLQTTAEMG

SEQ ID NO: 794490 - protein, 24 aa, Mycobacterium
AQGIPPQFLVDILTNLRTDRLVRS

SEQ ID NO: 794491 - protein, 23 aa, Mycobacterium
AQGLCEFIDASPSPFHVCATVAA

SEQ ID NO: 794492 - protein, 21 aa, Mycobacterium
AQGLPAMPGSAIKPGGVAAGL

SEQ ID NO: 794493 - protein, 19 aa, Mycobacterium
AQGLPVCAIAWGAWAEVGR

SEQ ID NO: 794494 - protein, 19 aa, Mycobacterium
AQGLQALWKQLSRVLHEYH

SEQ ID NO: 794495 - protein, 24 aa, Mycobacterium
AQGPRCVFTLLREGRGVLLNLGTP

SEQ ID NO: 794496 - protein, 18 aa, Mycobacterium
AQGPRRTLIGLQGLGKRA

SEQ ID NO: 794497 - protein, 18 aa, Mycobacterium
AQGRGLGAALTLLGLHHL

SEQ ID NO: 794498 - protein, 24 aa, Mycobacterium
AQGRGWALPGTFLHPGETLADAVN

SEQ ID NO: 794499 - protein, 20 aa, Mycobacterium
AQGTLLVGGVGWDPSGEWSE

SEQ ID NO: 794500 - protein, 25 aa, Mycobacterium
AQGVGGTWYWNTYPGIAVDIPSYSY

SEQ ID NO: 794501 - protein, 18 aa, Mycobacterium
AQGYAMRLADRLVDQIHA

SEQ ID NO: 794502 - protein, 29 aa, Mycobacterium
AQHAEQWGYRRYWLAEHHFVAVASTVPAL

SEQ ID NO: 794503 - protein, 17 aa, Mycobacterium
AQHFSAQHWPIPQVFVV

SEQ ID NO: 794504 - protein, 25 aa, Mycobacterium
AQHGPRLFHALFAPLGWCAKYAPGL

SEQ ID NO: 794505 - protein, 21 aa, Mycobacterium
AQHLHDWFRRDDQGNLPVLAH

SEQ ID NO: 794506 - protein, 25 aa, Mycobacterium
AQHLHSSFAPLFRPGGVGRTPVTGA

SEQ ID NO: 794507 - protein, 25 aa, Mycobacterium
AQHLLSGAARMFKGYALAAEGISDA

SEQ ID NO: 794508 - protein, 20 aa, Mycobacterium
AQHPLAGFLVGVIGRAQSAG

SEQ ID NO: 794509 - protein, 18 aa, Mycobacterium
AQHPRLPRREALKILGGE

SEQ ID NO: 794510 - protein, 21 aa, Mycobacterium
AQHRATLSRRLGVPVMVQIDE

SEQ ID NO: 794511 - protein, 23 aa, Mycobacterium
AQHRHWDRVLFDAGLSVITWPQK

SEQ ID NO: 794512 - protein, 26 aa, Mycobacterium
AQHSVRWRPWRSYATQHLWTALDHSV

SEQ ID NO: 794513 - protein, 21 aa, Mycobacterium
AQIADALMRKLDPRGVIVVVE

SEQ ID NO: 794514 - protein, 24 aa, Mycobacterium
AQIAQAFVAERIGLAAQAYSSAQR

SEQ ID NO: 794515 - protein, 24 aa, Mycobacterium
AQIDAILWQSEAFGDPLRAAYHEG

SEQ ID NO: 794516 - protein, 24 aa, Mycobacterium
AQIDALLWQAEAFGAPLRDAYAEG

SEQ ID NO: 794517 - protein, 25 aa, Mycobacterium
AQIDRLLVPLLRGDEWWALGMSEPE

SEQ ID NO: 794518 - protein, 21 aa, Mycobacterium
AQIETLLHRYPTRRWIRRARR

SEQ ID NO: 794519 - protein, 25 aa, Mycobacterium
AQIGDLRWFYVYSGVMWACVFMRTG

SEQ ID NO: 794520 - protein, 34 aa, Mycobacterium
AQIHRFIGATMFFLTRRWPDLLTWTSQASSSSGG

SEQ ID NO: 794521 - protein, 24 aa, Mycobacterium
AQINALPEWLKRKAIQRLNGNQDA

SEQ ID NO: 794522 - protein, 24 aa, Mycobacterium
AQIPPADLLIQWRSTRNQLHAALR

SEQ ID NO: 794523 - protein, 18 aa, Mycobacterium
AQIRALGLLKGACAQVNK

SEQ ID NO: 794524 - protein, 18 aa, Mycobacterium
AQISLGIALLERGTEPGR

SEQ ID NO: 794525 - protein, 17 aa, Mycobacterium
AQISSLAEAFHGAGRHT

SEQ ID NO: 794526 - protein, 29 aa, Mycobacterium
AQITRLPEWYRYNAALLLADRTSVVPMAG

SEQ ID NO: 794527 - protein, 19 aa, Mycobacterium
AQIVLLSPGLDTRAWRLPW

SEQ ID NO: 794528 - protein, 17 aa, Mycobacterium
AQIWLKARTGPVAIPGP

SEQ ID NO: 794529 - protein, 17 aa, Mycobacterium
AQIWLSKATINGVLTAA

SEQ ID NO: 794530 - protein, 26 aa, Mycobacterium
AQIYKDYLGWPAISAGAFALTQLALR

SEQ ID NO: 794531 - protein, 17 aa, Mycobacterium
AQKAGAFVNWEGRYRPF

SEQ ID NO: 794532 - protein, 33 aa, Mycobacterium
AQKDRDALLRKAPWVDVVFGTHNIGSLPALLDR

SEQ ID NO: 794533 - protein, 26 aa, Mycobacterium
AQKDRHIVLDRAPWVDVVFGTHNIGS

SEQ ID NO: 794534 - protein, 25 aa, Mycobacterium
AQKERWLPELMTLEKIAAWAITEPD

SEQ ID NO: 794535 - protein, 21 aa, Mycobacterium
AQKFRDYFEFSEPLHTMPSHR

SEQ ID NO: 794536 - protein, 25 aa, Mycobacterium
AQKKKFLPAILAGEVHFAIGYSEPE

SEQ ID NO: 794537 - protein, 24 aa, Mycobacterium
AQKKKFLPAILAGEVHFAIGYTEP

SEQ ID NO: 794538 - protein, 28 aa, Mycobacterium
AQKLYDDLKPLLTFIVAGGLATTVKAGL

SEQ ID NO: 794539 - protein, 31 aa, Mycobacterium; identical to SEQ ID NO: 113407

SEQ ID NO: 794540 - protein, 17 aa, Mycobacterium
AQLAAGKRLGRLLRAAR

SEQ ID NO: 794541 - protein, 20 aa, Mycobacterium
AQLAALVTTNFFGQNTAAIA

SEQ ID NO: 794542 - protein, 30 aa, Mycobacterium
AQLAARPYASATFPWYLLGRQVHVRGRVTK

SEQ ID NO: 794543 - protein, 18 aa, Mycobacterium
AQLADRRAAYLRRLPEGV

SEQ ID NO: 794544 - protein, 21 aa, Mycobacterium
AQLAELTRWFTPAEVLQQATI

SEQ ID NO: 794545 - protein, 19 aa, Mycobacterium
AQLAFFDRYLKHLDVPKPP

SEQ ID NO: 794546 - protein, 26 aa, Mycobacterium
AQLAGYGYTVLLPDVYYRSGDWAPFD

SEQ ID NO: 794547 - protein, 23 aa, Mycobacterium
AQLALQWVLRHPNVTSALIGASS

SEQ ID NO: 794548 - protein, 27 aa, Mycobacterium
AQLAMTPTFLRVFGLRSMRGRAVQELM

SEQ ID NO: 794549 - protein, 29 aa, Mycobacterium
AQLAVTPVMLLLWIRGVRFMYTVDPLLAP

SEQ ID NO: 794550 - protein, 24 aa, Mycobacterium
AQLDRFLLKLNVTLPPRDAEIAIL

SEQ ID NO: 794551 - protein, 21 aa, Mycobacterium
AQLDRFLLKLNVTLPPRDSEI

SEQ ID NO: 794552 - protein, 27 aa, Mycobacterium
AQLELKEYFARWAYSGPLAAMLVPVFA

SEQ ID NO: 794553 - protein, 19 aa, Mycobacterium
AQLFHTSGHLDWYAEGMFP

SEQ ID NO: 794554 - protein, 18 aa, Mycobacterium
AQLGPVSVLVNAAGLDCF

SEQ ID NO: 794555 - protein, 33 aa, Mycobacterium
AQLHAALARYPRELPFLAPFNDGLPAMIAELHT

SEQ ID NO: 794556 - protein, 17 aa, Mycobacterium
AQLIARRVREARVYSEV

SEQ ID NO: 794557 - protein, 34 aa, Mycobacterium
AQLIVSDLSFISLALVLDALIACAGPDADILPMV

SEQ ID NO: 794558 - protein, 27 aa, Mycobacterium
AQLLAIGELFACRLSRFGETEEWAIDT

SEQ ID NO: 794559 - protein, 19 aa, Mycobacterium
AQLLGAPAAQLLSAPAGAV

SEQ ID NO: 794560 - protein, 17 aa, Mycobacterium
AQLLITPELFVTGYDIG

SEQ ID NO: 794561 - protein, 19 aa, Mycobacterium
AQLLLPPTSSAHIAGRRLA

SEQ ID NO: 794562 - protein, 23 aa, Mycobacterium
AQLLYDHRRPPRGILTWSSRVAD

SEQ ID NO: 794563 - protein, 19 aa, Mycobacterium
AQLMSQITRYAPESVFPSI

SEQ ID NO: 794564 - protein, 19 aa, Mycobacterium
AQLPAILRKTLTWDRGKEM

SEQ ID NO: 794565 - protein, 18 aa, Mycobacterium
AQLPALLAEKVKAPTVVP

SEQ ID NO: 794566 - protein, 23 aa, Mycobacterium
AQLPIAPMGLISTRYYVSMNVAD

SEQ ID NO: 794567 - protein, 23 aa, Mycobacterium
AQLPPAEAIAYASAHALCVLAQA

SEQ ID NO: 794568 - protein, 38 aa, Mycobacterium
AQLPQKLAYALVRWKNALLGITFFNLSRRRPELIKSML

SEQ ID NO: 794569 - protein, 19 aa, Mycobacterium
AQLPSLLAEKLKAPSVTAG

SEQ ID NO: 794570 - protein, 17 aa, Mycobacterium
AQLQARCRRIASICTGA

SEQ ID NO: 794571 - protein, 26 aa, Mycobacterium
AQLQRIPHRLAYRRINRNTACYWHTV

SEQ ID NO: 794572 - protein, 21 aa, Mycobacterium
AQLQRLPEHLSTPAKWSDPEL

SEQ ID NO: 794573 - protein, 25 aa, Mycobacterium
AQLRARIWVAQVGRVPLLLLDSDIP

SEQ ID NO: 794574 - protein, 20 aa, Mycobacterium
AQLRERLFHLAGRGAFDIEG

SEQ ID NO: 794575 - protein, 19 aa, Mycobacterium
AQLRERVVLYPSAYDPAVP

SEQ ID NO: 794576 - protein, 32 aa, Mycobacterium
AQLRGAPILAMGVWRWGLGEIAYEQLHRRLDR

SEQ ID NO: 794577 - protein, 22 aa, Mycobacterium
AQLRRRMDVSPAAITYLVDRMI

SEQ ID NO: 794578 - protein, 27 aa, Mycobacterium
AQLRSEILPPLRRPASAGWRKWVYRGS

SEQ ID NO: 794579 - protein, 23 aa, Mycobacterium
AQLRVNVLPIYGGSSYVPQLAGL

SEQ ID NO: 794580 - protein, 24 aa, Mycobacterium
AQLTKGAMYFHFRSKHALAVAIIE

SEQ ID NO: 794581 - protein, 27 aa, Mycobacterium
AQLTSPVAFLERPARWVRALAENPHAW

SEQ ID NO: 794582 - protein, 20 aa, Mycobacterium
AQLVDLVQLGRLGLGGPGHP

SEQ ID NO: 794583 - protein, 22 aa, Mycobacterium
AQLYVHGHALDPRTLFSRAAKS

SEQ ID NO: 794584 - protein, 26 aa, Mycobacterium
AQMDALMTVLTIPRLGVERAQKQYRI

SEQ ID NO: 794585 - protein, 24 aa, Mycobacterium
AQMGEMGLFGLPFPEEYGGMGGDY

SEQ ID NO: 794586 - protein, 25 aa, Mycobacterium
AQMGKDGWLTLSWPKEFGGQARPPM

SEQ ID NO: 794587 - protein, 35 aa, Mycobacterium
AQMGWPLADAIRWPAQLIPTFQWERMLDQDAKMGV

SEQ ID NO: 794588 - protein, 20 aa, Mycobacterium
AQMKWADMAGMQRSLVERAA

SEQ ID NO: 794589 - protein, 29 aa, Mycobacterium
AQMMLRNRPDLVGALVLFAGLQPSPVGAM

SEQ ID NO: 794590 - protein, 26 aa, Mycobacterium
AQMQQDLIDLLPPGAILTQMVQNSFN

SEQ ID NO: 794591 - protein, 33 aa, Mycobacterium
AQNAFGDKVLPLYLPTGLPSCEGLIGLLSQTRY

SEQ ID NO: 794592 - protein, 34 aa, Mycobacterium
AQNAFGDKVLPLYLPTGLPSCRGLIGLLSQARYE

SEQ ID NO: 794593 - protein, 26 aa, Mycobacterium
AQNATKPWLLYYSTGATHAPHHVFKE

SEQ ID NO: 794594 - protein, 27 aa, Mycobacterium
AQNDPKLYLDFYSGLFASSFQPAEDAP

SEQ ID NO: 794595 - protein, 22 aa, Mycobacterium
AQNFMYLARRLVGASTSRASIG

SEQ ID NO: 794596 - protein, 20 aa, Mycobacterium
AQNFRILTSLEPKVLDEQGN

SEQ ID NO: 794597 - protein, 26 aa, Mycobacterium
AQNIDLGFYDTYFGPGAYLPTHAEHA

SEQ ID NO: 794598 - protein, 32 aa, Mycobacterium; identical to SEQ ID NO: 124339

SEQ ID NO: 794599 - protein, 21 aa, Mycobacterium
AQNLLASSRDYFSGPHGAESY

SEQ ID NO: 794600 - protein, 25 aa, Mycobacterium
AQNPGIRRLWPRKYRRSSVYWKLIA

SEQ ID NO: 794601 - protein, 26 aa, Mycobacterium
AQNPTLRRWWPRRYRRSSAYWKLVEL

SEQ ID NO: 794602 - protein, 26 aa, Mycobacterium
AQPAGWFRFHFTDQRWEWSEQVQRMH

SEQ ID NO: 794603 - protein, 23 aa, Mycobacterium
AQPAILVPAFLSRGYHVRTDLPA

SEQ ID NO: 794604 - protein, 33 aa, Mycobacterium
AQPALFAVEVALFRLLESWGIHPDLVLGHSIGE

SEQ ID NO: 794605 - protein, 34 aa, Mycobacterium
AQPALFAVEVALYRLLESWGIRPDFVMGHSVGEI

SEQ ID NO: 794606 - protein, 34 aa, Mycobacterium
AQPALFAVEVALYRLLESWGVRPDFVMGHSVGEL

SEQ ID NO: 794607 - protein, 29 aa, Mycobacterium
AQPALFVLEVALAALWRSWGVTPDVVLGH

SEQ ID NO: 794608 - protein, 26 aa, Mycobacterium
AQPAQVALAWLISYPGVVAIPGASSV

SEQ ID NO: 794609 - protein, 24 aa, Mycobacterium
AQPATFLLQVALTRELAQFGIAPS

SEQ ID NO: 794610 - protein, 17 aa, Mycobacterium
AQPDRPVIALVGDGAMQ

SEQ ID NO: 794611 - protein, 27 aa, Mycobacterium
AQPEEIAHAVLFLCSPRASFITGSTLH

SEQ ID NO: 794612 - protein, 17 aa, Mycobacterium
AQPGPKRQAALNRLLFP

SEQ ID NO: 794613 - protein, 21 aa, Mycobacterium
AQPLDLPFVAVYVAGEGKGAR

SEQ ID NO: 794614 - protein, 24 aa, Mycobacterium
AQPLGTHAYACGPIPMLHTYQELA

SEQ ID NO: 794615 - protein, 20 aa, Mycobacterium
AQPLGVLPQPNELPRGCIAA

SEQ ID NO: 794616 - protein, 18 aa, Mycobacterium
AQPLPGGGFVRRVPSEGL

SEQ ID NO: 794617 - protein, 23 aa, Mycobacterium
AQPLSVFFFDILHRDGVDLLDAP

SEQ ID NO: 794618 - protein, 17 aa, Mycobacterium
AQPLTMVQALNRALHDA

SEQ ID NO: 794619 - protein, 23 aa, Mycobacterium
AQPNLTVLPHALVTRVTFEGDRA

SEQ ID NO: 794620 - protein, 23 aa, Mycobacterium
AQPNRPIAVSLPTRQCTIDKVSA

SEQ ID NO: 794621 - protein, 32 aa, Mycobacterium
AQPQQDIPAMLALWRAGRLPVEKLKSDDLPLS

SEQ ID NO: 794622 - protein, 22 aa, Mycobacterium
AQPRIIVYDGVWADVALEVATK

SEQ ID NO: 794623 - protein, 24 aa, Mycobacterium
AQPRYSAARRGAVAALGPLAAQVG

SEQ ID NO: 794624 - protein, 29 aa, Mycobacterium
AQPSERQWLLLELWTWKEATTKALGTGLG

SEQ ID NO: 794625 - protein, 26 aa, Mycobacterium
AQPTDPVLALLKITGDWQKFKGLPGA

SEQ ID NO: 794626 - protein, 21 aa, Mycobacterium
AQPVFVLDPMLATGGSMVYTL

SEQ ID NO: 794627 - protein, 18 aa, Mycobacterium
AQPVIIAAALLSLSVLRE

SEQ ID NO: 794628 - protein, 19 aa, Mycobacterium
AQQAIRRRAFTKALRITGS

SEQ ID NO: 794629 - protein, 21 aa, Mycobacterium
AQQFAWGPPIGLVARALDVEL

SEQ ID NO: 794630 - protein, 24 aa, Mycobacterium
AQQGAFLGYRVTVCDARPVFATTA

SEQ ID NO: 794631 - protein, 22 aa, Mycobacterium
AQQGPLLVVTATGREADDVTAE

SEQ ID NO: 794632 - protein, 19 aa, Mycobacterium
AQQGVIPLGYLGDKAKTAR

SEQ ID NO: 794633 - protein, 19 aa, Mycobacterium
AQQGYGYPAGYAAGGYPGD

SEQ ID NO: 794634 - protein, 18 aa, Mycobacterium
AQQLATAAIASKEQPRAS

SEQ ID NO: 794635 - protein, 23 aa, Mycobacterium
AQQLDALKVPRLQLPAISDGVDL

SEQ ID NO: 794636 - protein, 22 aa, Mycobacterium
AQQLDALRVPRLELPAISDGVD

SEQ ID NO: 794637 - protein, 21 aa, Mycobacterium
AQQLGFRDWNTAAAGLPTRQG

SEQ ID NO: 794638 - protein, 22 aa, Mycobacterium
AQQLLLDLMPEAGSAMHVGITG

SEQ ID NO: 794639 - protein, 27 aa, Mycobacterium
AQQLPRKVAMQLLLTGEPLTAAAACEW

SEQ ID NO: 794640 - protein, 21 aa, Mycobacterium
AQQRLDLLRDELEQVRADAAA

SEQ ID NO: 794641 - protein, 23 aa, Mycobacterium
AQQRLIEATLARAGLSGADVDYL

SEQ ID NO: 794642 - protein, 25 aa, Mycobacterium
AQQRMWFLSRLEPGSHYYNVPIVLH

SEQ ID NO: 794643 - protein, 23 aa, Mycobacterium
AQQRPEAIAIRYGERQWSWADWS

SEQ ID NO: 794644 - protein, 23 aa, Mycobacterium
AQQRYPAWPASYDASLRVSWRQL

SEQ ID NO: 794645 - protein, 24 aa, Mycobacterium
AQQSWPTVAAWVKWLSTGGDKPDG

SEQ ID NO: 794646 - protein, 31 aa, Mycobacterium
AQQVCPAPPPRELDMLLTAGERISNALVAMA

SEQ ID NO: 794647 - protein, 31 aa, Mycobacterium
AQQVCPAPPPRELDMLLTAGERMSNALVAMA

SEQ ID NO: 794648 - protein, 22 aa, Mycobacterium
AQQVDWTWQMVRDTVLDRVLTN

SEQ ID NO: 794649 - protein, 23 aa, Mycobacterium
AQQVLAYWPEVIASATPQDAGRV

SEQ ID NO: 794650 - protein, 25 aa, Mycobacterium
AQQVLPTYAVICCPAFGAAGKIGTF

SEQ ID NO: 794651 - protein, 23 aa, Mycobacterium
AQQVPRYAGFGTFARLPQRHEVP

SEQ ID NO: 794652 - protein, 18 aa, Mycobacterium
AQQWAWLVHTLTVDTVRE

SEQ ID NO: 794653 - protein, 24 aa, Mycobacterium
AQQWRTVIDVNLIGTWNTCRAAIP

SEQ ID NO: 794654 - protein, 20 aa, Mycobacterium
AQRAGLELLAFGGRFVEIGK

SEQ ID NO: 794655 - protein, 22 aa, Mycobacterium
AQRAGLELLAFGGRFVEIGKRD

SEQ ID NO: 794656 - protein, 22 aa, Mycobacterium
AQRAGLELLSWGGRFVEIGKRD

SEQ ID NO: 794657 - protein, 24 aa, Mycobacterium
AQRAGLSTVFIPQRNQPDLDDVPA

SEQ ID NO: 794658 - protein, 23 aa, Mycobacterium
AQRAGYFGTLPQDFMLSGHSAGG

SEQ ID NO: 794659 - protein, 22 aa, Mycobacterium
AQRAHVLWAHRRARRRLAALRL

SEQ ID NO: 794660 - protein, 24 aa, Mycobacterium
AQRAKIDLALGKLGLRPGMTLLDI

SEQ ID NO: 794661 - protein, 24 aa, Mycobacterium
AQRALHRVISLLADGHSVLTHCFA

SEQ ID NO: 794662 - protein, 24 aa, Mycobacterium
AQRAVHRVVTLLGSGRSVLAHCFA

SEQ ID NO: 794663 - protein, 24 aa, Mycobacterium
AQRFGEFNGFWRDDGFQAATGVHV

SEQ ID NO: 794664 - protein, 24 aa, Mycobacterium
AQRFGEFNGFWREDGFEPANGVHV

SEQ ID NO: 794665 - protein, 23 aa, Mycobacterium
AQRFGVPLFFGGPHAGYMAVRSG

SEQ ID NO: 794666 - protein, 23 aa, Mycobacterium
AQRFSDPLVFGTAGLRGPVRGGP

SEQ ID NO: 794667 - protein, 25 aa, Mycobacterium
AQRFTLLRPMLFTIAYEILGSATES

SEQ ID NO: 794668 - protein, 25 aa, Mycobacterium
AQRGDGWIKLVGDWIDRSVGDLAPL

SEQ ID NO: 794669 - protein, 26 aa, Mycobacterium
AQRGDQIAYWKAVYADLQASGAANPH

SEQ ID NO: 794670 - protein, 21 aa, Mycobacterium
AQRGWELRVDSIGNMFALVEF

SEQ ID NO: 794671 - protein, 23 aa, Mycobacterium
AQRGWLAVRYNLPYRRRRPTGPP

SEQ ID NO: 794672 - protein, 29 aa, Mycobacterium
AQRHGFEVWALWGMALRATVDALASIGLD

SEQ ID NO: 794673 - protein, 33 aa, Mycobacterium
AQRHQFYVLDEFTYPLKWGWVDVGEVVDVLLAR

SEQ ID NO: 794674 - protein, 24 aa, Mycobacterium
AQRILGFEPRFSLDAGMRATEIWL

SEQ ID NO: 794675 - protein, 23 aa, Mycobacterium
AQRIYDPGIILDKDRGLGAVIAQ

SEQ ID NO: 794676 - protein, 20 aa, Mycobacterium
AQRLDWCRTLGTFPVGDKDS

SEQ ID NO: 794677 - protein, 30 aa, Mycobacterium
AQRLLGQIKAIWRINELLNWQVAASGETIA

SEQ ID NO: 794678 - protein, 22 aa, Mycobacterium
AQRLLIAQPPLSQQIRQLEREV

SEQ ID NO: 794679 - protein, 19 aa, Mycobacterium
AQRLLSRNGWRNTTLAQIA

SEQ ID NO: 794680 - protein, 24 aa, Mycobacterium
AQRLLTLDAYVAAGFRVVALLNEP

SEQ ID NO: 794681 - protein, 20 aa, Mycobacterium
AQRLLVSHAMALIAIELEKP

SEQ ID NO: 794682 - protein, 18 aa, Mycobacterium
AQRLMLLAKNGGCTKPGC

SEQ ID NO: 794683 - protein, 21 aa, Mycobacterium
AQRLQLDRIPLYQVHQPNPVV

SEQ ID NO: 794684 - protein, 22 aa, Mycobacterium
AQRLRLLGFQRVDLEPGQVVRV

SEQ ID NO: 794685 - protein, 24 aa, Mycobacterium
AQRLRRYPFDLGAPQWVDDPDFDI

SEQ ID NO: 794686 - protein, 22 aa, Mycobacterium
AQRMLKYAFNLLDDGLVGQQLF

SEQ ID NO: 794687 - protein, 26 aa, Mycobacterium
AQRPRFVAALLDYFNARFDPMTADRD

SEQ ID NO: 794688 - protein, 20 aa, Mycobacterium
AQRRAVLSTLGLRVSIDPTP

SEQ ID NO: 794689 - protein, 24 aa, Mycobacterium
AQRRDMMWICRDGDRAKNHLLEAN

SEQ ID NO: 794690 - protein, 27 aa, Mycobacterium
AQRRLARLALPLMPAGGHIVFVTSHQA

SEQ ID NO: 794691 - protein, 18 aa, Mycobacterium
AQRRNCTGLFLVCSELRS

SEQ ID NO: 794692 - protein, 24 aa, Mycobacterium
AQRSAILMPLRAHDHVAGVIAIAR

SEQ ID NO: 794693 - protein, 33 aa, Mycobacterium
AQRTATIPGFRQRLLTRPFGLGQPSWIEDPAFD

SEQ ID NO: 794694 - protein, 25 aa, Mycobacterium
AQRTHAFIVVHRLDNLRRSGRIGTA

SEQ ID NO: 794695 - protein, 17 aa, Mycobacterium
AQRTLGHLILAGVFERY

SEQ ID NO: 794696 - protein, 24 aa, Mycobacterium
AQRTLTYFGLRSEVLHAAAAMIDL

SEQ ID NO: 794697 - protein, 24 aa, Mycobacterium
AQRVAFVLHDVFAMPFETIAELLH

SEQ ID NO: 794698 - protein, 19 aa, Mycobacterium
AQRVKRFTAFGTLEQSRGV

SEQ ID NO: 794699 - protein, 26 aa, Mycobacterium
AQRVSLAHALIGWTRGTGLMGHNDVI

SEQ ID NO: 794700 - protein, 22 aa, Mycobacterium
AQRWPAGTPVLFPRPTKNIDGT

SEQ ID NO: 794701 - protein, 17 aa, Mycobacterium
AQRWPAVHRDDAASLFR

SEQ ID NO: 794702 - protein, 31 aa, Mycobacterium
AQSGFVEILPTPFLPAGVFDLWGLPADDPRR

SEQ ID NO: 794703 - protein, 23 aa, Mycobacterium
AQSLGLCGFGRFGDPERLARRVE

SEQ ID NO: 794704 - protein, 28 aa, Mycobacterium
AQSPKETWLRLLLIDAGFPRPQTQIAIR

SEQ ID NO: 794705 - protein, 27 aa, Mycobacterium
AQSPKETWLRLVLVQGGLPRPQTQIPV

SEQ ID NO: 794706 - protein, 25 aa, Mycobacterium
AQSPRESWWRKLVLDSGFPPPRTQI

SEQ ID NO: 794707 - protein, 28 aa, Mycobacterium
AQSPRESYLRLLLIDAGFPRPRSQIAVS

SEQ ID NO: 794708 - protein, 27 aa, Mycobacterium
AQSPRESYLRLLLIDAGLARPQTQIPV

SEQ ID NO: 794709 - protein, 27 aa, Mycobacterium
AQSPRETWLRLLLVDEWLDPLRTQVEV

SEQ ID NO: 794710 - protein, 23 aa, Mycobacterium
AQSPRPPIVIGGRGAKRTPALTA

SEQ ID NO: 794711 - protein, 24 aa, Mycobacterium
AQSQVHRFLKLLGGYTFSRHSYSL

SEQ ID NO: 794712 - protein, 24 aa, Mycobacterium
AQSRDFYRSQLWYETFDGDSRRIV

SEQ ID NO: 794713 - protein, 23 aa, Mycobacterium
AQSRYRIFIIDEAHMVTTAGFNA

SEQ ID NO: 794714 - protein, 18 aa, Mycobacterium
AQSWHDQPRWSRAGTRAV

SEQ ID NO: 794715 - protein, 26 aa, Mycobacterium
AQTADRLGYHRFWVAEHHNMPAVAAT

SEQ ID NO: 794716 - protein, 33 aa, Mycobacterium
AQTALDLINQPVLTLTGRPLIGNGANGAAGTGA

SEQ ID NO: 794717 - protein, 25 aa, Mycobacterium
AQTARYPADYLVKLANLSTADAAAI

SEQ ID NO: 794718 - protein, 22 aa, Mycobacterium
AQTDRFLLKEIVRYPSPEQEVD

SEQ ID NO: 794719 - protein, 25 aa, Mycobacterium
AQTDSFTAFVPFAARWPVEVHIYPN

SEQ ID NO: 794720 - protein, 27 aa, Mycobacterium
AQTDYRALLEFFFQIHDPTTKNRQGND

SEQ ID NO: 794721 - protein, 17 aa, Mycobacterium
AQTKRHLVITFGGGVNE

SEQ ID NO: 794722 - protein, 21 aa, Mycobacterium
AQTKRRVAVLGGNRIPFARSD

SEQ ID NO: 794723 - protein, 17 aa, Mycobacterium
AQTLQVLQLPDERLDDL

SEQ ID NO: 794724 - protein, 32 aa, Mycobacterium
AQTLRSAWALTRRLLIVSSRLTWDGRGLAGRP

SEQ ID NO: 794725 - protein, 24 aa, Mycobacterium
AQTLRVGWMALPQALVEPVIAAAG

SEQ ID NO: 794726 - protein, 28 aa, Mycobacterium
AQTNRPVILHWLGSMFDPALTGYWGHDE

SEQ ID NO: 794727 - protein, 25 aa, Mycobacterium
AQTPELAVLLWQRALDPHRGAWALP

SEQ ID NO: 794728 - protein, 23 aa, Mycobacterium
AQTPIDGQYWRRHSRQPVQFAES

SEQ ID NO: 794729 - protein, 17 aa, Mycobacterium
AQTPIERKPPWIKTRAK

SEQ ID NO: 794730 - protein, 27 aa, Mycobacterium
AQTSLEPRHLILPMFVADGIDEPRPIN

SEQ ID NO: 794731 - protein, 25 aa, Mycobacterium
AQTSPMDLITLRKDDWDKVSIALET

SEQ ID NO: 794732 - protein, 25 aa, Mycobacterium
AQTTRAILPRLFGRAFSQVLDAAQS

SEQ ID NO: 794733 - protein, 26 aa, Mycobacterium
AQTVARWLVLYLRRPGGQTQFAAPVW

SEQ ID NO: 794734 - protein, 25 aa, Mycobacterium
AQTWKGLLHLDDWSKDRPGLGLGEN

SEQ ID NO: 794735 - protein, 34 aa, Mycobacterium
AQTWWMSAKLPNDQFLLYGFDGDTGDLGAALDAV

SEQ ID NO: 794736 - protein, 18 aa, Mycobacterium
AQTYQAAAAMLVKVGDRG

SEQ ID NO: 794737 - protein, 19 aa, Mycobacterium
AQVAAFAVAMKMKVPTAGE

SEQ ID NO: 794738 - protein, 25 aa, Mycobacterium
AQVADLLARIRAELPPLAGIAHLAG

SEQ ID NO: 794739 - protein, 23 aa, Mycobacterium
AQVALAWLRYRADAFGVASVPIP

SEQ ID NO: 794740 - protein, 25 aa, Mycobacterium
AQVALAWTLGVAPNVLLIPGTSSLR

SEQ ID NO: 794741 - protein, 17 aa, Mycobacterium
AQVAVAANSPFLLGRHA

SEQ ID NO: 794742 - protein, 19 aa, Mycobacterium
AQVAVYRKALDTAGVDPTT

SEQ ID NO: 794743 - protein, 24 aa, Mycobacterium
AQVDLVLAILRARQMWAGEQSVPG

SEQ ID NO: 794744 - protein, 21 aa, Mycobacterium
AQVDLWFKDIAPSPDLRVRWH

SEQ ID NO: 794745 - protein, 17 aa, Mycobacterium
AQVDVLVSYLPVGSEEA

SEQ ID NO: 794746 - protein, 25 aa, Mycobacterium
AQVERLLVPLLRGDEWWALGMSEPE

SEQ ID NO: 794747 - protein, 29 aa, Mycobacterium
AQVFAKYPNYLHSFAPMPYQPVGEGAEGL

SEQ ID NO: 794748 - protein, 24 aa, Mycobacterium
AQVGRALLRHWAVALGNPADVFDE

SEQ ID NO: 794749 - protein, 25 aa, Mycobacterium
AQVICFQELFYGPYFGIVQDKKYYG

SEQ ID NO: 794750 - protein, 20 aa, Mycobacterium
AQVIPYGPIQLDPSAIVLHY

SEQ ID NO: 794751 - protein, 28 aa, Mycobacterium
AQVIYFGAPLLWAERLVSTWLADVGCGT

SEQ ID NO: 794752 - protein, 27 aa, Mycobacterium
AQVLADALPWLTALNGKIVVVKYGGNA

SEQ ID NO: 794753 - protein, 24 aa, Mycobacterium
AQVLDPQHRLFLQCAWHALEDAGC

SEQ ID NO: 794754 - protein, 25 aa, Mycobacterium
AQVLDPQHRLFLQCAWHALEDANCD

SEQ ID NO: 794755 - protein, 20 aa, Mycobacterium
AQVLHRPAVLPVPALGPRLL

SEQ ID NO: 794756 - protein, 17 aa, Mycobacterium
AQVLLIHGLTGHGQRWQ

SEQ ID NO: 794757 - protein, 19 aa, Mycobacterium
AQVLLYPGLDRDMGAQSIV

SEQ ID NO: 794758 - protein, 18 aa, Mycobacterium
AQVLMYPGLDRDMAAPSM

SEQ ID NO: 794759 - protein, 23 aa, Mycobacterium
AQVLPAFLEFARGAVLVAHNAGF

SEQ ID NO: 794760 - protein, 30 aa, Mycobacterium
AQVNRPLRGCYRIALLSLKGGVGKTTIAAT

SEQ ID NO: 794761 - protein, 30 aa, Mycobacterium
AQVNYLGVVELLQAWRPALAAAERAKAVVI

SEQ ID NO: 794762 - protein, 25 aa, Mycobacterium
AQVPDYLMQIIARFARYLRESNSVD

SEQ ID NO: 794763 - protein, 25 aa, Mycobacterium
AQVPDYLMQVIARFARYLRESHSID

SEQ ID NO: 794764 - protein, 25 aa, Mycobacterium
AQVPDYLMQVIARFARYLRESNSVD

SEQ ID NO: 794765 - protein, 25 aa, Mycobacterium
AQVPEYLLQVIARFARYLRESSSVD

SEQ ID NO: 794766 - protein, 18 aa, Mycobacterium
AQVPIVPMIVWGAHRIWP

SEQ ID NO: 794767 - protein, 18 aa, Mycobacterium
AQVPLFERQPGFAEAFLP

SEQ ID NO: 794768 - protein, 21 aa, Mycobacterium
AQVPRPARAAVRWLRATALER

SEQ ID NO: 794769 - protein, 24 aa, Mycobacterium
AQVQTYVPGYRLLNEPQFDEPSIN

SEQ ID NO: 794770 - protein, 25 aa, Mycobacterium
AQVRLFQRAITLAGIKPAKVGMIEG

SEQ ID NO: 794771 - protein, 25 aa, Mycobacterium
AQVRPGVDVLFLDTGYHFAETIGTR

SEQ ID NO: 794772 - protein, 19 aa, Mycobacterium
AQVRPIHRPPRTPADRHPH

SEQ ID NO: 794773 - protein, 20 aa, Mycobacterium
AQVRPIHRPPRTPADRRPHC

SEQ ID NO: 794774 - protein, 18 aa, Mycobacterium
AQVRPIHRPPRVPPDRHP

SEQ ID NO: 794775 - protein, 20 aa, Mycobacterium
AQVSALVASAPWPYNVLVHV

SEQ ID NO: 794776 - protein, 21 aa, Mycobacterium
AQVTAMVTRILALQAKPTPAD

SEQ ID NO: 794777 - protein, 22 aa, Mycobacterium
AQVTAMVTRILALQAKPTPADA

SEQ ID NO: 794778 - protein, 19 aa, Mycobacterium
AQVVGFHLNRGVLAAARRV

SEQ ID NO: 794779 - protein, 19 aa, Mycobacterium
AQVVLRWHVQRGDIVFPKS

SEQ ID NO: 794780 - protein, 25 aa, Mycobacterium
AQVVPIHVYRWKPTPAGGDFDQLVT

SEQ ID NO: 794781 - protein, 18 aa, Mycobacterium
AQVVRTAWVYTGVNGDFV

SEQ ID NO: 794782 - protein, 24 aa, Mycobacterium
AQVVRYHLLLPHTATRRDLQDAAT

SEQ ID NO: 794783 - protein, 25 aa, Mycobacterium
AQWAVDDPARWARWAAPCPIGDAEI

SEQ ID NO: 794784 - protein, 19 aa, Mycobacterium
AQWEALRRVIGDPEWASDP

SEQ ID NO: 794785 - protein, 19 aa, Mycobacterium
AQWLAGEALIARCPCLLAV

SEQ ID NO: 794786 - protein, 17 aa, Mycobacterium
AQWLGMGQQLHAQFPIF

SEQ ID NO: 794787 - protein, 18 aa, Mycobacterium
AQWPAAPDRRERPHRPRI

SEQ ID NO: 794788 - protein, 19 aa, Mycobacterium
AQWPQWVPVGRMGVPLDQA

SEQ ID NO: 794789 - protein, 19 aa, Mycobacterium
AQWRAVRQPALLIEAGNSV

SEQ ID NO: 794790 - protein, 17 aa, Mycobacterium
AQWWVTLSCGCPYPMCQ

SEQ ID NO: 794791 - protein, 18 aa, Mycobacterium
AQYADVLRRRGGTAAFLV

SEQ ID NO: 794792 - protein, 22 aa, Mycobacterium
AQYCQPWLRPLEAFTLSVSTDI

SEQ ID NO: 794793 - protein, 27 aa, Mycobacterium
AQYEHGLGPWDWAAGALIAREAGAVVI

SEQ ID NO: 794794 - protein, 34 aa, Mycobacterium
AQYETTKTLPPPAPPIPIHFNQGTSGFFNMGPGT

SEQ ID NO: 794795 - protein, 18 aa, Mycobacterium
AQYFSMWVVGSDKPGDKP

SEQ ID NO: 794796 - protein, 25 aa, Mycobacterium
AQYGDGWCPFPAPPRLAQTAGTAVI

SEQ ID NO: 794797 - protein, 19 aa, Mycobacterium
AQYILLTTFTKDGKPKPTP

SEQ ID NO: 794798 - protein, 17 aa, Mycobacterium
AQYLGWVDGSLAWDHTT

SEQ ID NO: 794799 - protein, 18 aa, Mycobacterium
AQYNTYLKQYLVMYTNGM

SEQ ID NO: 794800 - protein, 18 aa, Mycobacterium
AQYPHGYLNYLNIMGQEV

SEQ ID NO: 794801 - protein, 27 aa, Mycobacterium
AQYTAARFLTTPGLQTPVFVRFSTVAG

SEQ ID NO: 794802 - protein, 17 aa, Mycobacterium
AQYWPGFRELRTTIGRE

SEQ ID NO: 794803 - protein, 18 aa, Mycobacterium
ARAAAARMRAAAVAAAVA

SEQ ID NO: 794804 - protein, 19 aa, Mycobacterium
ARAAARRMGARRFEMLDVA

SEQ ID NO: 794805 - protein, 33 aa, Mycobacterium
ARAADPVFMLTGPIPATRYALDKAGLSIDDIDT

SEQ ID NO: 794806 - protein, 31 aa, Mycobacterium
ARAADPVFMLTGPIPATRYALDKTGLSIDDI

SEQ ID NO: 794807 - protein, 23 aa, Mycobacterium
ARAALERDIPVLRPSRPNSAEFV

SEQ ID NO: 794808 - protein, 18 aa, Mycobacterium
ARAALSWWRHRQSIIETG

SEQ ID NO: 794809 - protein, 19 aa, Mycobacterium
ARAALTFRNAIWPALTGRG

SEQ ID NO: 794810 - protein, 21 aa, Mycobacterium
ARAAMIGAVLQTRCRMPINSN

SEQ ID NO: 794811 - protein, 24 aa, Mycobacterium
ARAAMVHPLAVAANRNGFVQLVMS

SEQ ID NO: 794812 - protein, 28 aa, Mycobacterium
ARAAQLGIELLPLDDLLARADFISVHLP

SEQ ID NO: 794813 - protein, 26 aa, Mycobacterium
ARAARLAALPGWVWRESREDLWERLY

SEQ ID NO: 794814 - protein, 24 aa, Mycobacterium
ARAARVHLPLRIFACGGAAVPRAV

SEQ ID NO: 794815 - protein, 23 aa, Mycobacterium
ARAASTPWPTYPLMYRVSAAHEE

SEQ ID NO: 794816 - protein, 19 aa, Mycobacterium
ARAAWWLREVYDLPLAEIA

SEQ ID NO: 794817 - protein, 20 aa, Mycobacterium
ARACGVGIRAFELAVKYAQQ

SEQ ID NO: 794818 - protein, 27 aa, Mycobacterium
ARADADPIRLVWTLYEVAICSGALGKP

SEQ ID NO: 794819 - protein, 18 aa, Mycobacterium
ARADADRPYLLAVQDVVA

SEQ ID NO: 794820 - protein, 23 aa, Mycobacterium
ARADGQLPKMRAIVGFAAETGDA

SEQ ID NO: 794821 - protein, 32 aa, Mycobacterium
ARADLLAFTAFPKQIWRQIWSNNPLSVNRLSG

SEQ ID NO: 794822 - protein, 28 aa, Mycobacterium
ARADLLAFTAFPKQIWRQIWSNNPQERL

SEQ ID NO: 794823 - protein, 23 aa, Mycobacterium
ARADWRGTFRMFNVTQWSERTVI

SEQ ID NO: 794824 - protein, 24 aa, Mycobacterium
ARAEALIGLAHPDYRPWLAECAQH

SEQ ID NO: 794825 - protein, 24 aa, Mycobacterium
ARAEMEMKVLLWAVQRLIAGLSHI

SEQ ID NO: 794826 - protein, 18 aa, Mycobacterium
ARAERIFMYLRTRDDYAG

SEQ ID NO: 794827 - protein, 24 aa, Mycobacterium
ARAERLLAPMRAVATPVLDTVAVH

SEQ ID NO: 794828 - protein, 21 aa, Mycobacterium
ARAFLTSQKARWAARSLLDAA

SEQ ID NO: 794829 - protein, 22 aa, Mycobacterium
ARAFLTSQKARWAARSLLDSPD

SEQ ID NO: 794830 - protein, 24 aa, Mycobacterium
ARAGKLPVTMFTAGGIATPADAAM

SEQ ID NO: 794831 - protein, 23 aa, Mycobacterium
ARAGKTFFGGTLALVLTTVGSRT

SEQ ID NO: 794832 - protein, 26 aa, Mycobacterium
ARAGVGILILTHYVPAIAPGTEDQWR

SEQ ID NO: 794833 - protein, 29 aa, Mycobacterium
ARAHTARLAYYHAAALLLAGKPFKTEASI

SEQ ID NO: 794834 - protein, 30 aa, Mycobacterium; identical to SEQ ID NO: 124367

SEQ ID NO: 794835 - protein, 18 aa, Mycobacterium
ARAINDYLAGRPGYRHVV

SEQ ID NO: 794836 - protein, 23 aa, Mycobacterium
ARAIPHIHALIRLDPHDDLDRPG

SEQ ID NO: 794837 - protein, 24 aa, Mycobacterium
ARAITLVVRFLQLQHRRAERARAG

SEQ ID NO: 794838 - protein, 22 aa, Mycobacterium
ARALAADPPILLMDEAFSAVDP

SEQ ID NO: 794839 - protein, 24 aa, Mycobacterium
ARALAADPPILLMDEPFSAVDPNV

SEQ ID NO: 794840 - protein, 24 aa, Mycobacterium
ARALAADPPILLMDEPFSAVDPVV

SEQ ID NO: 794841 - protein, 22 aa, Mycobacterium
ARALAADPPVLLMDEPFGAVDP

SEQ ID NO: 794842 - protein, 24 aa, Mycobacterium
ARALAADPPVLLMDEPFGAVDPIT

SEQ ID NO: 794843 - protein, 26 aa, Mycobacterium
ARALAIRPRVLLLDEPLAALDAQLRL

SEQ ID NO: 794844 - protein, 20 aa, Mycobacterium
ARALALRPKVILFDEPTSAL

SEQ ID NO: 794845 - protein, 24 aa, Mycobacterium
ARALAPARLLVSGSAALPVPVFDG

SEQ ID NO: 794846 - protein, 26 aa, Mycobacterium
ARALAPVRFFNPIGMRFAKKATRDDI

SEQ ID NO: 794847 - protein, 27 aa, Mycobacterium
ARALARRPRVLLLDEPLAALDALTRLQ

SEQ ID NO: 794848 - protein, 19 aa, Mycobacterium
ARALAYFAALTISADDPRR

SEQ ID NO: 794849 - protein, 19 aa, Mycobacterium
ARALGARYLDTGAMYRIAT

SEQ ID NO: 794850 - protein, 34 aa, Mycobacterium
ARALGLTKLERKLFRTNILPVTFGFPFGLSIVAP

SEQ ID NO: 794851 - protein, 23 aa, Mycobacterium
ARALGPARLLVSGSAPLPVPVFD

SEQ ID NO: 794852 - protein, 27 aa, Mycobacterium
ARALHAPLDVLLVRKLGVPAHSELAFG

SEQ ID NO: 794853 - protein, 20 aa, Mycobacterium
ARALLTARPDLRRAITETTR

SEQ ID NO: 794854 - protein, 26 aa, Mycobacterium
ARALREAVPLIPPEQLLVETDAPFLT

SEQ ID NO: 794855 - protein, 23 aa, Mycobacterium
ARALRVIDWFIDATAQRHYEILE

SEQ ID NO: 794856 - protein, 22 aa, Mycobacterium
ARALSTARLLVSGSAPLPVPVF

SEQ ID NO: 794857 - protein, 22 aa, Mycobacterium
ARALTLSAFASKVTVGFTSDIK

SEQ ID NO: 794858 - protein, 25 aa, Mycobacterium
ARALTPPALVVRLVDMLRAGHAAVV

SEQ ID NO: 794859 - protein, 27 aa, Mycobacterium
ARALVLRPRVLLLDEPLGALDAKLRKQ

SEQ ID NO: 794860 - protein, 26 aa, Mycobacterium
ARALVRNPPVLLLDEPLSHLDASARQ

SEQ ID NO: 794861 - protein, 25 aa, Mycobacterium
ARALVRRGALLTLLARDPAKASATV

SEQ ID NO: 794862 - protein, 26 aa, Mycobacterium
ARALVRTPSAFLFDEPLSNLDAKLRV

SEQ ID NO: 794863 - protein, 19 aa, Mycobacterium
ARAMPIFDTLRPEGERADG

SEQ ID NO: 794864 - protein, 17 aa, Mycobacterium
ARANKILDLARAYGIHE

SEQ ID NO: 794865 - protein, 21 aa, Mycobacterium
ARAPERALAWLFESRRRDQAS

SEQ ID NO: 794866 - protein, 21 aa, Mycobacterium
ARAPHLFRHARAIPGRAAHGW

SEQ ID NO: 794867 - protein, 20 aa, Mycobacterium
ARAPLLAEERRLLLAAMGRA

SEQ ID NO: 794868 - protein, 19 aa, Mycobacterium
ARAPLLAEERRLLVAAMGR

SEQ ID NO: 794869 - protein, 30 aa, Mycobacterium
ARAQLAVTPVLLLLWIRGVRFMYSVDPYLP

SEQ ID NO: 794870 - protein, 23 aa, Mycobacterium
ARAQLRAIFGELLVQLPDIQAGD

SEQ ID NO: 794871 - protein, 23 aa, Mycobacterium
ARAQLRAIFHELFRQLPGIQAGE

SEQ ID NO: 794872 - protein, 23 aa, Mycobacterium
ARAQVITLGLILGALESRTPKDA

SEQ ID NO: 794873 - protein, 26 aa, Mycobacterium
ARARAMALVMLALPGAVFIYNGEELG

SEQ ID NO: 794874 - protein, 25 aa, Mycobacterium
ARARGLGMLSMWSLNRDYPGNIGQA

SEQ ID NO: 794875 - protein, 24 aa, Mycobacterium
ARARHELDLLPDVPGRQALAALVD

SEQ ID NO: 794876 - protein, 26 aa, Mycobacterium
ARARLAGLLGYLKPAPDLAPPVAVQR

SEQ ID NO: 794877 - protein, 20 aa, Mycobacterium
ARARLAGQLGFPLDGLADDE

SEQ ID NO: 794878 - protein, 22 aa, Mycobacterium
ARARLAIGSALFGLLRADDQVP

SEQ ID NO: 794879 - protein, 23 aa, Mycobacterium
ARARPPRIMVIADGDKALDLDTI

SEQ ID NO: 794880 - protein, 25 aa, Mycobacterium
ARARQMLMMPTPFDAIEALSMGLVD

SEQ ID NO: 794881 - protein, 19 aa, Mycobacterium
ARARRFYEEVLGLEVIQPS

SEQ ID NO: 794882 - protein, 26 aa, Mycobacterium
ARARWAAHVSAPMLAGAFAVAWEWDN

SEQ ID NO: 794883 - protein, 24 aa, Mycobacterium
ARASARRLGLDRIPLYQIHQPNPV

SEQ ID NO: 794884 - protein, 22 aa, Mycobacterium
ARASGMTVVFWLDTERPHEVEL

SEQ ID NO: 794885 - protein, 22 aa, Mycobacterium
ARATLRRLYRHPRSGQLVAMES

SEQ ID NO: 794886 - protein, 25 aa, Mycobacterium
ARATLYRHFATKTDLVLAVLQRREQ

SEQ ID NO: 794887 - protein, 28 aa, Mycobacterium
ARATVEAIYALIYGLTELAATLPPEEYQ

SEQ ID NO: 794888 - protein, 17 aa, Mycobacterium
ARATVPAWEDVLLGVRS

SEQ ID NO: 794889 - protein, 18 aa, Mycobacterium
ARATWLRTLSAEPRTCVF

SEQ ID NO: 794890 - protein, 26 aa, Mycobacterium
ARAVEFRPFDVVLANPPYVPEAPMDD

SEQ ID NO: 794891 - protein, 23 aa, Mycobacterium
ARAVLGLPVDTIMISPGAAEVTC

SEQ ID NO: 794892 - protein, 23 aa, Mycobacterium
ARAVPLLIGLGVDALSVTPPAIP

SEQ ID NO: 794893 - protein, 19 aa, Mycobacterium
ARAVQIPTAIRQLTVKLKG

SEQ ID NO: 794894 - protein, 25 aa, Mycobacterium
ARAVRAPWLTRLRPLGEDASLVLET

SEQ ID NO: 794895 - protein, 17 aa, Mycobacterium
ARAVWQALPGESWADRF

SEQ ID NO: 794896 - protein, 29 aa, Mycobacterium
ARAVYEQLPGYALPLFVRVVESIEQTTTF

SEQ ID NO: 794897 - protein, 31 aa, Mycobacterium
ARAWEHGRFGAPYLRDSLLAAGALCETLETA

SEQ ID NO: 794898 - protein, 21 aa, Mycobacterium
ARAYNKFRRGPGAFKVDFAIE

SEQ ID NO: 794899 - protein, 21 aa, Mycobacterium
ARAYREMFAGLYTDPDSVLNT

SEQ ID NO: 794900 - protein, 21 aa, Mycobacterium
ARCALAWSVETATLAREHNNA

SEQ ID NO: 794901 - protein, 23 aa, Mycobacterium
ARCATYPLLAVQAWATHHDTTLR

SEQ ID NO: 794902 - protein, 22 aa, Mycobacterium
ARCDGLIDRVLVGFPPSIDEAT

SEQ ID NO: 794903 - protein, 24 aa, Mycobacterium
ARCPADVDSYYTLSSRFGGETHTV

SEQ ID NO: 794904 - protein, 26 aa, Mycobacterium
ARCTDVMLAIQRLPAPVIARVHGIAT

SEQ ID NO: 794905 - protein, 26 aa, Mycobacterium
ARDADRAWWARRLPELPDPPALPTTG

SEQ ID NO: 794906 - protein, 28 aa, Mycobacterium
ARDAEALADLFRLLGPLTAEEIAQRCAG

SEQ ID NO: 794907 - protein, 30 aa, Mycobacterium
ARDALDRALIDLATYFRDALLVSAKADQPR

SEQ ID NO: 794908 - protein, 26 aa, Mycobacterium
ARDAMPTFRQLFIAGASGIDLERRVY

SEQ ID NO: 794909 - protein, 26 aa, Mycobacterium
ARDAMPTFRQLFLGGASGMELERRAY

SEQ ID NO: 794910 - protein, 17 aa, Mycobacterium
ARDATAYLATRANLAIP

SEQ ID NO: 794911 - protein, 29 aa, Mycobacterium
ARDCLQHISAPTLILHRGRSRYVPVEHGR

SEQ ID NO: 794912 - protein, 17 aa, Mycobacterium
ARDEHGFILAGPDLRDV

SEQ ID NO: 794913 - protein, 18 aa, Mycobacterium
ARDETHWVMAPAIAYGAS

SEQ ID NO: 794914 - protein, 36 aa, Mycobacterium
ARDGLRQYVILAAGLDARAYRLSWPGDSVVYEVDQP

SEQ ID NO: 794915 - protein, 21 aa, Mycobacterium
ARDGRPWGSRFPMISVRDQVQ

SEQ ID NO: 794916 - protein, 26 aa, Mycobacterium
ARDGRRYLDMFSFFASSALGMNHPAL

SEQ ID NO: 794917 - protein, 29 aa, Mycobacterium
ARDGVYEFQLIAPPLRFVGAVGSPVNPIA

SEQ ID NO: 794918 - protein, 25 aa, Mycobacterium
ARDGYGWLQPRLSPIARPALPPHLT

SEQ ID NO: 794919 - protein, 23 aa, Mycobacterium
ARDHLAAELARLRQRHDRLEIEV

SEQ ID NO: 794920 - protein, 23 aa, Mycobacterium
ARDHPEWFTVLPDGTIAYAENPP

SEQ ID NO: 794921 - protein, 23 aa, Mycobacterium
ARDHWRLRKMEELGWIVVRVIAE

SEQ ID NO: 794922 - protein, 23 aa, Mycobacterium
ARDIAYSIAFLASPRAAYLNGTT

SEQ ID NO: 794923 - protein, 25 aa, Mycobacterium
ARDKLFRMALLIRGQAPILWDIGSA

SEQ ID NO: 794924 - protein, 17 aa, Mycobacterium
ARDLADYPLGFAEAQLP

SEQ ID NO: 794925 - protein, 24 aa, Mycobacterium
ARDMAWDYPLGLVAPAGFALHVRR

SEQ ID NO: 794926 - protein, 29 aa, Mycobacterium
ARDMQEVCPDAWLLNYTNPMAMNVTYLHH

SEQ ID NO: 794927 - protein, 24 aa, Mycobacterium
ARDNLAAELARLRQRHDRLEIEVK

SEQ ID NO: 794928 - protein, 25 aa, Mycobacterium
ARDPFGIKPLFMATGPGGTALGSEK

SEQ ID NO: 794929 - protein, 24 aa, Mycobacterium
ARDPFGIKPLFMATGPGGTAVASE

SEQ ID NO: 794930 - protein, 23 aa, Mycobacterium
ARDQEVEGALWVALRSLEEKAKL

SEQ ID NO: 794931 - protein, 29 aa, Mycobacterium
ARDSLPHITAPTLILHRVGTKFVPVEHGR

SEQ ID NO: 794932 - protein, 24 aa, Mycobacterium
ARDSLVKTALFGSDANWGRVLAAV

SEQ ID NO: 794933 - protein, 19 aa, Mycobacterium
ARDTLLISPIILYDHPEVA

SEQ ID NO: 794934 - protein, 28 aa, Mycobacterium
ARDTNGFAYRFALPRAIAFAMRGVADES

SEQ ID NO: 794935 - protein, 22 aa, Mycobacterium
ARDVELFFQAIYPSVTGKRAQG

SEQ ID NO: 794936 - protein, 22 aa, Mycobacterium
ARDYVMALGYLQAPVVVAGDDH

SEQ ID NO: 794937 - protein, 26 aa, Mycobacterium
AREAHAARLPALMEALVSPNATEGVE

SEQ ID NO: 794938 - protein, 18 aa, Mycobacterium
AREALYQYTVRLLTGIAA

SEQ ID NO: 794939 - protein, 18 aa, Mycobacterium
AREALYQYTVRLLTGIAS

SEQ ID NO: 794940 - protein, 18 aa, Mycobacterium
ARECGFAFVIGFDRDGRA

SEQ ID NO: 794941 - protein, 20 aa, Mycobacterium
AREEIFGPVLTVLRYRDEDD

SEQ ID NO: 794942 - protein, 18 aa, Mycobacterium
AREEIFGPVLTVLTYRDE

SEQ ID NO: 794943 - protein, 23 aa, Mycobacterium
AREELLDAAFRAIDGLGATVSMD

SEQ ID NO: 794944 - protein, 23 aa, Mycobacterium
AREELPVQLVVRSVGYRGVAIPG

SEQ ID NO: 794945 - protein, 24 aa, Mycobacterium
AREFASARFGLGRFLADWDRVIEE

SEQ ID NO: 794946 - protein, 22 aa, Mycobacterium
AREFQNFLLAKQREIATIVATA

SEQ ID NO: 794947 - protein, 17 aa, Mycobacterium
AREGGLQSVLWAGPEQV

SEQ ID NO: 794948 - protein, 17 aa, Mycobacterium
AREGGVASALWAGPEHL

SEQ ID NO: 794949 - protein, 17 aa, Mycobacterium
AREGMLAFLQKRQPSWA

SEQ ID NO: 794950 - protein, 25 aa, Mycobacterium
AREHGGRLLLRLAGVTDRDSADALR

SEQ ID NO: 794951 - protein, 22 aa, Mycobacterium
AREHGLQLLFFTDSATGRGQLL

SEQ ID NO: 794952 - protein, 23 aa, Mycobacterium
AREHGRIDILVNNAAIIRDEMMG

SEQ ID NO: 794953 - protein, 24 aa, Mycobacterium
AREHGWPAFADRLLELARAAEPGS

SEQ ID NO: 794954 - protein, 19 aa, Mycobacterium
AREIGRGTVDFYLGLSNYV

SEQ ID NO: 794955 - protein, 19 aa, Mycobacterium
AREIILNVFESITGLRMNH

SEQ ID NO: 794956 - protein, 18 aa, Mycobacterium
AREIILSLFESITGLRMN

SEQ ID NO: 794957 - protein, 22 aa, Mycobacterium
AREKSWYATTPYGLAVLRYEQV

SEQ ID NO: 794958 - protein, 20 aa, Mycobacterium
ARELALIRGGATPGSFTVTR

SEQ ID NO: 794959 - protein, 29 aa, Mycobacterium
ARELDIAPSALYWHFANKQQLLGAVADHV

SEQ ID NO: 794960 - protein, 26 aa, Mycobacterium
ARELDRYLPFLATTKVLMAAVRAGMG

SEQ ID NO: 794961 - protein, 28 aa, Mycobacterium
ARELHAVYPLMSITWNRRIMLEVAVPES

SEQ ID NO: 794962 - protein, 21 aa, Mycobacterium
ARELIARIRAVLRRGGEDDSE

SEQ ID NO: 794963 - protein, 18 aa, Mycobacterium
ARELLPERALLGDADAVT

SEQ ID NO: 794964 - protein, 24 aa, Mycobacterium
ARELLWERIGLSPDGPWTEPVVWT

SEQ ID NO: 794965 - protein, 18 aa, Mycobacterium
ARELSDEDVIAVLARESR

SEQ ID NO: 794966 - protein, 18 aa, Mycobacterium
ARELVRAAQARGVSFADT

SEQ ID NO: 794967 - protein, 21 aa, Mycobacterium
AREMLSALGAALRADGKEGHL

SEQ ID NO: 794968 - protein, 26 aa, Mycobacterium
AREMTALMRAIVASPLPVIAAINGHV

SEQ ID NO: 794969 - protein, 24 aa, Mycobacterium
ARENAILERGLSASPLLLDNPGVD

SEQ ID NO: 794970 - protein, 28 aa, Mycobacterium
ARENARLERGLLPSPLLLDDPGVEIVTQ

SEQ ID NO: 794971 - protein, 25 aa, Mycobacterium
AREPTFIGTRRYVRRQRSWFRRDHR

SEQ ID NO: 794972 - protein, 25 aa, Mycobacterium
AREQERLRRLSESAQRRRAGERRQE

SEQ ID NO: 794973 - protein, 31 aa, Mycobacterium
AREQLDIRLMSWRAHVFAPVSGIPGVQAPGT

SEQ ID NO: 794974 - protein, 17 aa, Mycobacterium
AREQLERRLDLAQRLLL

SEQ ID NO: 794975 - protein, 19 aa, Mycobacterium
AREQPLVAVLWGRDAATLK

SEQ ID NO: 794976 - protein, 26 aa, Mycobacterium
AREQTYFGTRRYVRRQRSWFRRDHRV

SEQ ID NO: 794977 - protein, 27 aa, Mycobacterium
ARERDVWLPIHPVTRRRWPNGRVTHDE

SEQ ID NO: 794978 - protein, 18 aa, Mycobacterium
AREREVLHRIAKGQSIPA

SEQ ID NO: 794979 - protein, 26 aa, Mycobacterium
AREREVWLPVHPVTRRRWPNGRVTHD

SEQ ID NO: 794980 - protein, 28 aa, Mycobacterium
ARERFADKLHLWRYGIDPEDVAGVLAEY

SEQ ID NO: 794981 - protein, 24 aa, Mycobacterium
ARERFGDWPLASTTAKPWAQVALA

SEQ ID NO: 794982 - protein, 22 aa, Mycobacterium
ARERGLAEILRRGLRDGSFPLT

SEQ ID NO: 794983 - protein, 32 aa, Mycobacterium
ARERGRLQFQHQLLLVPLLDTLFDSASWRELG

SEQ ID NO: 794984 - protein, 22 aa, Mycobacterium
ARERGTWLPIRETTRKRWPNGR

SEQ ID NO: 794985 - protein, 20 aa, Mycobacterium
ARERIAAYLAAVGAALDPAS

SEQ ID NO: 794986 - protein, 33 aa, Mycobacterium
ARERLMIDGVPVGRLLPPPPTPVIMPGQPPEGT

SEQ ID NO: 794987 - protein, 17 aa, Mycobacterium
ARESLAEWLAGLQERYP

SEQ ID NO: 794988 - protein, 24 aa, Mycobacterium
ARESVHRWLTKRAGAVVRINGADT

SEQ ID NO: 794989 - protein, 18 aa, Mycobacterium
ARETLYAYVSKLRRLMAG

SEQ ID NO: 794990 - protein, 30 aa, Mycobacterium
ARETSAAYRAQLPQTAPPSSSPRPPSKRSS

SEQ ID NO: 794991 - protein, 17 aa, Mycobacterium
AREVAFALPFTFDEEDY

SEQ ID NO: 794992 - protein, 24 aa, Mycobacterium
AREVFQAPFRPLLPGVSHVPYGDL

SEQ ID NO: 794993 - protein, 19 aa, Mycobacterium
AREVHHIALLIGFGAAAVN

SEQ ID NO: 794994 - protein, 25 aa, Mycobacterium
AREVILRLFGGLLDAAPTLGAGLDW

SEQ ID NO: 794995 - protein, 25 aa, Mycobacterium
AREVILRLFGPLLDAAPTLGAGLDW

SEQ ID NO: 794996 - protein, 19 aa, Mycobacterium
AREVLADRRLFMLGEPAWS

SEQ ID NO: 794997 - protein, 23 aa, Mycobacterium
AREVYPELEGQQIYHMFDRVYQT

SEQ ID NO: 794998 - protein, 19 aa, Mycobacterium
AREWDQFLHGNPVGAIVDF

SEQ ID NO: 794999 - protein, 21 aa, Mycobacterium
AREWRTWPGYSEQERLAAEFA

SEQ ID NO: 795000 - protein, 19 aa, Mycobacterium
ARFAGIIRLYTARQVVEQR

SEQ ID NO: 795001 - protein, 24 aa, Mycobacterium
ARFARGWYCLGLIKDFGDGKPHAV

SEQ ID NO: 795002 - protein, 20 aa, Mycobacterium
ARFDGWFVTAVLTTGIYCRP

SEQ ID NO: 795003 - protein, 19 aa, Mycobacterium
ARFDPIDVGMLHLGGTRLP

SEQ ID NO: 795004 - protein, 24 aa, Mycobacterium
ARFDRISYTWIPRDRNSYADRLAN

SEQ ID NO: 795005 - protein, 17 aa, Mycobacterium
ARFEFRWNDQFALSLDP

SEQ ID NO: 795006 - protein, 23 aa, Mycobacterium
ARFEFRWNDQFALSLDPDSACGF

SEQ ID NO: 795007 - protein, 22 aa, Mycobacterium
ARFELFMEGTRRPELQPFLVEL

SEQ ID NO: 795008 - protein, 25 aa, Mycobacterium
ARFFVGRTRGFYDPLLSIEKVRDHL

SEQ ID NO: 795009 - protein, 22 aa, Mycobacterium
ARFGQPEITLGILPGLGGTQRL

SEQ ID NO: 795010 - protein, 19 aa, Mycobacterium
ARFGVFVAPGVLPRGPDSP

SEQ ID NO: 795011 - protein, 18 aa, Mycobacterium
ARFGVVAQPAFAFVGAAG

SEQ ID NO: 795012 - protein, 24 aa, Mycobacterium
ARFHDLKGGLVLLSALSGIDWSTY

SEQ ID NO: 795013 - protein, 21 aa, Mycobacterium
ARFKDVLDRWNAESLRLYHVL

SEQ ID NO: 795014 - protein, 20 aa, Mycobacterium
ARFKHFLAVTPHRGGRLRSG

SEQ ID NO: 795015 - protein, 18 aa, Mycobacterium
ARFKSPNPIHWANATHAC

SEQ ID NO: 795016 - protein, 28 aa, Mycobacterium
ARFLEALTQYRFDPADLGLLRGFLDADT

SEQ ID NO: 795017 - protein, 17 aa, Mycobacterium
ARFLLGIQQLLGLGQFA

SEQ ID NO: 795018 - protein, 20 aa, Mycobacterium
ARFLLGVQNLLGLGSFADGP

SEQ ID NO: 795019 - protein, 25 aa, Mycobacterium
ARFPDALFPVWRYHPFFTDSDEPVA

SEQ ID NO: 795020 - protein, 21 aa, Mycobacterium
ARFQPLWERTLPDRLGQPYPE

SEQ ID NO: 795021 - protein, 17 aa, Mycobacterium
ARFRRRIGEKGWFGLNW

SEQ ID NO: 795022 - protein, 23 aa, Mycobacterium
ARFSSKIIELNLLGPLSVSQHAN

SEQ ID NO: 795023 - protein, 22 aa, Mycobacterium
ARFSSWYEFFPRSTGGWDPAGN

SEQ ID NO: 795024 - protein, 19 aa, Mycobacterium
ARFVDTFARVLGDPALPHL

SEQ ID NO: 795025 - protein, 17 aa, Mycobacterium
ARFVQHNLWVTKYDPRE

SEQ ID NO: 795026 - protein, 32 aa, Mycobacterium
ARFVRTCDCFNIPIVMFVDVPGFLPGTDQEYN

SEQ ID NO: 795027 - protein, 20 aa, Mycobacterium
ARFVRTCDCFNIPIVMLVDV

SEQ ID NO: 795028 - protein, 21 aa, Mycobacterium
ARFVRYHLVPIAAEEYLSVSD

SEQ ID NO: 795029 - protein, 20 aa, Mycobacterium
ARFVTAWPRPLDVDAMAGAA

SEQ ID NO: 795030 - protein, 32 aa, Mycobacterium
ARGADPVFMLTGPIPATRYALDKTGLTIDDID

SEQ ID NO: 795031 - protein, 20 aa, Mycobacterium
ARGAPPHRLPGGPAFGYMIA

SEQ ID NO: 795032 - protein, 22 aa, Mycobacterium
ARGARLVSICSGAFALAAAGVL

SEQ ID NO: 795033 - protein, 24 aa, Mycobacterium
ARGDADYLFRTWHPRTRPSDVTVD

SEQ ID NO: 795034 - protein, 31 aa, Mycobacterium
ARGDDPVFMLTGPIPATRYALEKTGLTMDDI

SEQ ID NO: 795035 - protein, 30 aa, Mycobacterium
ARGDPHAHVIQRLFLAGMDLQGTIARTKSG

SEQ ID NO: 795036 - protein, 37 aa, Mycobacterium
ARGEIAHRLGMIDPDAWAFVWVVDPPLFEPADDATAA

SEQ ID NO: 795037 - protein, 22 aa, Mycobacterium
ARGEKIILLFESANFDEAVFGD

SEQ ID NO: 795038 - protein, 22 aa, Mycobacterium
ARGFRTLARWWEATASAIEACE

SEQ ID NO: 795039 - protein, 28 aa, Mycobacterium
ARGGFGPFTPGFRSVPFGDSTALARAID

SEQ ID NO: 795040 - protein, 24 aa, Mycobacterium
ARGGLLLYGPPGCGKTFLARAVAG

SEQ ID NO: 795041 - protein, 24 aa, Mycobacterium
ARGHAFIVVHRLDNLRRSGRIGGA

SEQ ID NO: 795042 - protein, 19 aa, Mycobacterium
ARGHFPIESLITTYPAADI

SEQ ID NO: 795043 - protein, 35 aa, Mycobacterium
ARGHLGGLAAAVPAAIRLLAALSYDLIVLETVGVG

SEQ ID NO: 795044 - protein, 21 aa, Mycobacterium
ARGHLYTFHQLIGHADALLDE

SEQ ID NO: 795045 - protein, 23 aa, Mycobacterium
ARGHQAGNLGIVSTAIGFGNTDV

SEQ ID NO: 795046 - protein, 23 aa, Mycobacterium
ARGILFDLPAVVAGAAPLLADAG

SEQ ID NO: 795047 - protein, 17 aa, Mycobacterium
ARGILLTADVSCLKALL

SEQ ID NO: 795048 - protein, 21 aa, Mycobacterium
ARGIRACLLGRFLQDDVRVGA

SEQ ID NO: 795049 - protein, 26 aa, Mycobacterium
ARGKAIIILNPADPPMIMRDTIFCAI

SEQ ID NO: 795050 - protein, 24 aa, Mycobacterium
ARGKPTRMLLLRHGQTELSVQRRY

SEQ ID NO: 795051 - protein, 20 aa, Mycobacterium
ARGLCEFIDASPSPFHVCAT

SEQ ID NO: 795052 - protein, 17 aa, Mycobacterium
ARGLPACPGVVSGRAYS

SEQ ID NO: 795053 - protein, 25 aa, Mycobacterium
ARGLRTLDMFVSGLVASGGLPEGLT

SEQ ID NO: 795054 - protein, 26 aa, Mycobacterium
ARGLRTYVQLFVVIAAANDVKCDVAS

SEQ ID NO: 795055 - protein, 24 aa, Mycobacterium
ARGPALLIIDRQRDVWRVRQILDD

SEQ ID NO: 795056 - protein, 23 aa, Mycobacterium
ARGPLREWLHKQRTGLPHLTWKY

SEQ ID NO: 795057 - protein, 25 aa, Mycobacterium
ARGPMGLPELTSTKWIAWGDGQTRP

SEQ ID NO: 795058 - protein, 25 aa, Mycobacterium
ARGPMGLPELTSTKWIAWGDGQVRP

SEQ ID NO: 795059 - protein, 25 aa, Mycobacterium
ARGPMGLPELTTTKWIVLGDGQIRP

SEQ ID NO: 795060 - protein, 21 aa, Mycobacterium
ARGPSTWYFDTGELDVWEVWA

SEQ ID NO: 795061 - protein, 31 aa, Mycobacterium
ARGQILYDAPELVIPFLVPDGAHSYPDDART

SEQ ID NO: 795062 - protein, 28 aa, Mycobacterium
ARGRALWPILLSIWEWERRWVPEQRDAL

SEQ ID NO: 795063 - protein, 28 aa, Mycobacterium
ARGRDYYTPYRSLLPRGVDQLLVAGRHY

SEQ ID NO: 795064 - protein, 26 aa, Mycobacterium
ARGRSDLLHLLDHPSSIGTLDLRRML

SEQ ID NO: 795065 - protein, 20 aa, Mycobacterium
ARGRSVIALAYADGVLFVAE

SEQ ID NO: 795066 - protein, 19 aa, Mycobacterium
ARGSLRRFVPFDVDASILS

SEQ ID NO: 795067 - protein, 17 aa, Mycobacterium
ARGSRLLPRMEPFVGEL

SEQ ID NO: 795068 - protein, 23 aa, Mycobacterium
ARGTPVFGLFLTAGTTDYGAIDP

SEQ ID NO: 795069 - protein, 18 aa, Mycobacterium
ARGVPHLPVRVRDGVGLV

SEQ ID NO: 795070 - protein, 18 aa, Mycobacterium
ARGYAYGKAFQGLVAVWR

SEQ ID NO: 795071 - protein, 23 aa, Mycobacterium
ARGYGYGPAFQGLTAAWVRGDEI

SEQ ID NO: 795072 - protein, 25 aa, Mycobacterium
ARGYHLELITPVPLPRKPSGDLARL

SEQ ID NO: 795073 - protein, 33 aa, Mycobacterium
ARHAPLDARPLFAANLALPWPDDPLAALWHATT

SEQ ID NO: 795074 - protein, 17 aa, Mycobacterium
ARHDVPLRAVNLERLRN

SEQ ID NO: 795075 - protein, 23 aa, Mycobacterium
ARHEGRVVFVRYALPGERVRVRV

SEQ ID NO: 795076 - protein, 19 aa, Mycobacterium
ARHGITANSLPPFAIETPM

SEQ ID NO: 795077 - protein, 19 aa, Mycobacterium
ARHGLALDPRFTNSNPQTS

SEQ ID NO: 795078 - protein, 24 aa, Mycobacterium
ARHGLARAPRFAAPLPGAGPVDAA

SEQ ID NO: 795079 - protein, 25 aa, Mycobacterium
ARHGVRAALGMIIPGARWNGDCLEI

SEQ ID NO: 795080 - protein, 20 aa, Mycobacterium
ARHGVTNTAFLFRDGTDYLP

SEQ ID NO: 795081 - protein, 29 aa, Mycobacterium
ARHHLSPAPTILWNDDVHWAAGLAALCEA

SEQ ID NO: 795082 - protein, 32 aa, Mycobacterium
ARHITAVLPGRPPLATLFLPHNRGKKSVMADL

SEQ ID NO: 795083 - protein, 18 aa, Mycobacterium
ARHLNCWVLGTVRKGGKD

SEQ ID NO: 795084 - protein, 19 aa, Mycobacterium
ARHLVDLVLPKIPAGGAIA

SEQ ID NO: 795085 - protein, 20 aa, Mycobacterium
ARHPALRTGLRAALDGLRQE

SEQ ID NO: 795086 - protein, 27 aa, Mycobacterium
ARHPAPIWLPALTLTYLGGAKPRTPTL

SEQ ID NO: 795087 - protein, 18 aa, Mycobacterium
ARHPAVHWVSGPVSRGFA

SEQ ID NO: 795088 - protein, 19 aa, Mycobacterium
ARHPAYAVMLTALYDRQVA

SEQ ID NO: 795089 - protein, 23 aa, Mycobacterium
ARHPVKWGLGFGLPEPTTLPYIP

SEQ ID NO: 795090 - protein, 20 aa, Mycobacterium
ARHPVLRFASSIRQVFILGR

SEQ ID NO: 795091 - protein, 25 aa, Mycobacterium
ARHRGVPRDCILELDLLEVPPESVH

SEQ ID NO: 795092 - protein, 18 aa, Mycobacterium
ARHRPVWVKGFGEHVPFK

SEQ ID NO: 795093 - protein, 27 aa, Mycobacterium
ARHSIHNHFIVKSLALIAPGGYVAVLT

SEQ ID NO: 795094 - protein, 26 aa, Mycobacterium
ARHVRSTILLAASAFGRLALDAVHLD

SEQ ID NO: 795095 - protein, 18 aa, Mycobacterium
ARHVVAHHGVRQLVLVSR

SEQ ID NO: 795096 - protein, 22 aa, Mycobacterium
ARHYRIDWQLFDDFLASMRMDL

SEQ ID NO: 795097 - protein, 17 aa, Mycobacterium
ARIADRPAAVLLHLGPG

SEQ ID NO: 795098 - protein, 19 aa, Mycobacterium
ARIADRPAAVLLHLGPGLG

SEQ ID NO: 795099 - protein, 25 aa, Mycobacterium
ARIAGDLIPLLRQRGVFRDDVAPAR

SEQ ID NO: 795100 - protein, 24 aa, Mycobacterium
ARIAGRLGLRPDVRRMPLFGLGCA

SEQ ID NO: 795101 - protein, 17 aa, Mycobacterium
ARIAHIAGTAPISDGAS

SEQ ID NO: 795102 - protein, 25 aa, Mycobacterium
ARIAPSRLAFIGALGPWGPLATPEI

SEQ ID NO: 795103 - protein, 26 aa, Mycobacterium
ARIDAEGYVFLAGRTKDLIIRGGHNI

SEQ ID NO: 795104 - protein, 19 aa, Mycobacterium
ARIDDPWVQLPVPDWPRPG

SEQ ID NO: 795105 - protein, 20 aa, Mycobacterium
ARIDFPAGGLCWTGVGNVAA

SEQ ID NO: 795106 - protein, 31 aa, Mycobacterium
ARIEFKLRDWLFARQRYWGEPFPIVYDADGR

SEQ ID NO: 795107 - protein, 24 aa, Mycobacterium
ARIERGLLFGIVPTAAGVLAAPLA

SEQ ID NO: 795108 - protein, 27 aa, Mycobacterium
ARIGALHRFLAIRDKGLRRKLTPDYDF

SEQ ID NO: 795109 - protein, 23 aa, Mycobacterium
ARIGCGFITWSLAGNPRALDIAL

SEQ ID NO: 795110 - protein, 18 aa, Mycobacterium
ARIGIATQAFIGLEVQQG

SEQ ID NO: 795111 - protein, 33 aa, Mycobacterium
ARIGLANYFAGALLLPYRPFLDAAASTRYDIDQ

SEQ ID NO: 795112 - protein, 20 aa, Mycobacterium
ARIKRFIKTFVMFAAEHPDL

SEQ ID NO: 795113 - protein, 25 aa, Mycobacterium
ARILDAALELLRARGPKAVTMQAVV

SEQ ID NO: 795114 - protein, 18 aa, Mycobacterium
ARILRRQPMPLSLLATHP

SEQ ID NO: 795115 - protein, 18 aa, Mycobacterium
ARINAMRYVLGKFDYDNK

SEQ ID NO: 795116 - protein, 29 aa, Mycobacterium
ARINDIRNQWLFGQAWGVDVAVSTPGAMV

SEQ ID NO: 795117 - protein, 29 aa, Mycobacterium
ARINDLHNEWLFGRSWGIDVAVSTPGAMI

SEQ ID NO: 795118 - protein, 31 aa, Mycobacterium
ARINDLRNEWLFGQSWGIDVAVSTPGAMVAG

SEQ ID NO: 795119 - protein, 18 aa, Mycobacterium
ARIQERCFHHLAAPVLRV

SEQ ID NO: 795120 - protein, 18 aa, Mycobacterium
ARIQIAIAFDELFKRITN

SEQ ID NO: 795121 - protein, 26 aa, Mycobacterium
ARIRDWLDIDHVVVADLFAARTVGAL

SEQ ID NO: 795122 - protein, 23 aa, Mycobacterium
ARISTKLFVPQEITPWPTNGEQV

SEQ ID NO: 795123 - protein, 20 aa, Mycobacterium
ARIVGWIMRTDSADLPWHRV

SEQ ID NO: 795124 - protein, 17 aa, Mycobacterium
ARIWLNRPEAHNAQNRT

SEQ ID NO: 795125 - protein, 21 aa, Mycobacterium
ARIYRCRANGKIQIDMQYGTF

SEQ ID NO: 795126 - protein, 17 aa, Mycobacterium
ARKAATKAPAKKAASKS

SEQ ID NO: 795127 - protein, 25 aa, Mycobacterium
ARKADALLFSLGALGPTSVLVESGA

SEQ ID NO: 795128 - protein, 31 aa, Mycobacterium
ARKAGRRFARLAPIVATYRKLVAAREDLETA

SEQ ID NO: 795129 - protein, 17 aa, Mycobacterium
ARKALFEEGISTSRMGL

SEQ ID NO: 795130 - protein, 17 aa, Mycobacterium
ARKALLPTPQQPPGREP

SEQ ID NO: 795131 - protein, 30 aa, Mycobacterium
ARKFRNHMRDMLFLFKGTPSTSPYCTWVND

SEQ ID NO: 795132 - protein, 25 aa, Mycobacterium
ARKGFFRVPLIGGTITHPVQGEAAA

SEQ ID NO: 795133 - protein, 17 aa, Mycobacterium
ARKHASAVVLRPDGFVY

SEQ ID NO: 795134 - protein, 25 aa, Mycobacterium
ARKHKVPVYAIAPFATRGLQKMSGT

SEQ ID NO: 795135 - protein, 23 aa, Mycobacterium
ARKHQLLLLADEIYDKILYDDAE

SEQ ID NO: 795136 - protein, 23 aa, Mycobacterium
ARKHQLLLLADEIYDKILYDDAK

SEQ ID NO: 795137 - protein, 26 aa, Mycobacterium
ARKLDLPTYPFERRQYWFRDARERPE

SEQ ID NO: 795138 - protein, 30 aa, Mycobacterium
ARKLRAALLKHPALVPLIVGKRSLGMGARM

SEQ ID NO: 795139 - protein, 18 aa, Mycobacterium
ARKNERLMRLPALSTRAT

SEQ ID NO: 795140 - protein, 19 aa, Mycobacterium
ARKSIAQFKLREGMPIGAR

SEQ ID NO: 795141 - protein, 31 aa, Mycobacterium
ARKSPQMSEVLPLLYLHGLSTSDFGPALEQF

SEQ ID NO: 795142 - protein, 30 aa, Mycobacterium
ARKYTLFGTWHYWWQAHLLDCLVDAQVRDP

SEQ ID NO: 795143 - protein, 21 aa, Mycobacterium
ARLAAAIRLPAERVVWMNQVH

SEQ ID NO: 795144 - protein, 40 aa, Mycobacterium
ARLAALRAIMPRLLSVGPWATLALAKPALQRYRPWRGLRR

SEQ ID NO: 795145 - protein, 26 aa, Mycobacterium
ARLAAPLLPLVTEVIWRGLTGERSVH

SEQ ID NO: 795146 - protein, 17 aa, Mycobacterium
ARLAAPLLPSATEIVWR

SEQ ID NO: 795147 - protein, 21 aa, Mycobacterium
ARLAELDLALPEVVAPLASYV

SEQ ID NO: 795148 - protein, 21 aa, Mycobacterium
ARLAFLERHLDLARATTADTD

SEQ ID NO: 795149 - protein, 38 aa, Mycobacterium
ARLAFVCTGMGPQWWQMCRGLLDVFPVFTDSIHRTDRE

SEQ ID NO: 795150 - protein, 19 aa, Mycobacterium
ARLAGLYQSGQLQLDDMIT

SEQ ID NO: 795151 - protein, 27 aa, Mycobacterium
ARLAPGTPLARVFWPRTRIVVTRDDVS

SEQ ID NO: 795152 - protein, 25 aa, Mycobacterium
ARLARVQYWPALKDLSMYSLRIKED

SEQ ID NO: 795153 - protein, 18 aa, Mycobacterium
ARLATIRPFPIADERAVL

SEQ ID NO: 795154 - protein, 28 aa, Mycobacterium
ARLAVANYMALQLGWRLFEPMLRSATGL

SEQ ID NO: 795155 - protein, 23 aa, Mycobacterium
ARLAYLFEVDYVDHFVWVMTDGA

SEQ ID NO: 795156 - protein, 19 aa, Mycobacterium
ARLDEMLLITFGRAASQEL

SEQ ID NO: 795157 - protein, 24 aa, Mycobacterium
ARLDLFGHLIGHLLPPASAKPRVR

SEQ ID NO: 795158 - protein, 19 aa, Mycobacterium
ARLEAARPYAFQITAMLTT

SEQ ID NO: 795159 - protein, 28 aa, Mycobacterium
ARLELNVAFQMLYARYPDITAAGEPVML

SEQ ID NO: 795160 - protein, 24 aa, Mycobacterium
ARLELRVLFEELLGRFGAVLVGQP

SEQ ID NO: 795161 - protein, 24 aa, Mycobacterium
ARLELRVLFEELLSRFAGVRLVRP

SEQ ID NO: 795162 - protein, 23 aa, Mycobacterium
ARLELRVLFEELLSRFGAVQVVR

SEQ ID NO: 795163 - protein, 21 aa, Mycobacterium
ARLENLAMLRTLVGAIGTFED

SEQ ID NO: 795164 - protein, 22 aa, Mycobacterium
ARLEQLDLFPANRNAAGQIVAA

SEQ ID NO: 795165 - protein, 25 aa, Mycobacterium
ARLERFDRSIYLFDVELKHAPNRRQ

SEQ ID NO: 795166 - protein, 24 aa, Mycobacterium
ARLESTGLVVRVAMRGYRVPEMPD

SEQ ID NO: 795167 - protein, 18 aa, Mycobacterium
ARLFAIWETTPYNGHWPQ

SEQ ID NO: 795168 - protein, 24 aa, Mycobacterium
ARLFDAHFHIIDPSFPLIGNEGYF

SEQ ID NO: 795169 - protein, 17 aa, Mycobacterium
ARLGAQITIFRLGSDRG

SEQ ID NO: 795170 - protein, 18 aa, Mycobacterium
ARLGHFYRGVGLTIYEGY

SEQ ID NO: 795171 - protein, 18 aa, Mycobacterium
ARLGLMHSVVFAGFSAAA

SEQ ID NO: 795172 - protein, 18 aa, Mycobacterium
ARLGLVPIPDEPVALRML

SEQ ID NO: 795173 - protein, 23 aa, Mycobacterium
ARLGRPLRIAHAWSLSFDASWQP

SEQ ID NO: 795174 - protein, 27 aa, Mycobacterium
ARLGSSVFVAPWYPPVQLARQLASIDA

SEQ ID NO: 795175 - protein, 26 aa, Mycobacterium
ARLKDVFFYEPIILPEKASREVQLTL

SEQ ID NO: 795176 - protein, 20 aa, Mycobacterium
ARLKRWSVVLRGRGACATLD

SEQ ID NO: 795177 - protein, 17 aa, Mycobacterium
ARLLGLKAACAFADEPD

SEQ ID NO: 795178 - protein, 17 aa, Mycobacterium
ARLLGQIDVVFSNAGIV

SEQ ID NO: 795179 - protein, 18 aa, Mycobacterium
ARLLQVPAAVRVHYSPDD

SEQ ID NO: 795180 - protein, 17 aa, Mycobacterium
ARLLYIHRAGRGAYLDE

SEQ ID NO: 795181 - protein, 22 aa, Mycobacterium
ARLMSVIAWRTYLVRDPEAQRL

SEQ ID NO: 795182 - protein, 24 aa, Mycobacterium
ARLPKIANKLRWPENLWLGVSVED

SEQ ID NO: 795183 - protein, 20 aa, Mycobacterium
ARLPLRLVYPDGTAIGAGDA

SEQ ID NO: 795184 - protein, 29 aa, Mycobacterium
ARLPVDLFRYEVLMTLRPLPDEAIEEIVD

SEQ ID NO: 795185 - protein, 24 aa, Mycobacterium
ARLQDLGFYTGLVDGYFGLQTHNA

SEQ ID NO: 795186 - protein, 17 aa, Mycobacterium
ARLQLPMPLQIVVARRG

SEQ ID NO: 795187 - protein, 32 aa, Mycobacterium
ARLQVLQDLYRRWPFFATVLSNMAQVLAKSDL

SEQ ID NO: 795188 - protein, 33 aa, Mycobacterium
ARLRARGARRLVIAPWFLAPGLITDGVSTYARD

SEQ ID NO: 795189 - protein, 25 aa, Mycobacterium
ARLRARIWVAQVGRVPLLLLDSDVP

SEQ ID NO: 795190 - protein, 21 aa, Mycobacterium
ARLRGLLRRSGQPPTPTAETL

SEQ ID NO: 795191 - protein, 22 aa, Mycobacterium
ARLRLALKEQGIPLWLNSPMTE

SEQ ID NO: 795192 - protein, 17 aa, Mycobacterium
ARLRLAVGRRRGTADGI

SEQ ID NO: 795193 - protein, 18 aa, Mycobacterium
ARLRLELSTSLRGAVLAS

SEQ ID NO: 795194 - protein, 34 aa, Mycobacterium
ARLRRRGARRLVIAPWFLAPGLITDRVWNYARDN

SEQ ID NO: 795195 - protein, 35 aa, Mycobacterium
ARLRRRLRIAHAWSFAFDAAWQPLVALLDGHTVHV

SEQ ID NO: 795196 - protein, 26 aa, Mycobacterium
ARLSDYPYLVPLIDGEMRRPTYVFAS

SEQ ID NO: 795197 - protein, 17 aa, Mycobacterium
ARLSESFALLSRGYRGS

SEQ ID NO: 795198 - protein, 24 aa, Mycobacterium
ARLSVLLAGWPETVPGMTLNRFCG

SEQ ID NO: 795199 - protein, 32 aa, Mycobacterium
ARLTDLRRGVVFLPFHYGYWDTGDDGGKDGHH

SEQ ID NO: 795200 - protein, 40 aa, Mycobacterium
ARLTKPQFVMPTTGVWTSGFGYRWGVLHAGIDIANAIGTP

SEQ ID NO: 795201 - protein, 19 aa, Mycobacterium
ARLTQTLRPDELGKAAQRL

SEQ ID NO: 795202 - protein, 19 aa, Mycobacterium
ARLTSAVLLVLFDRRGRFL

SEQ ID NO: 795203 - protein, 27 aa, Mycobacterium
ARLTVPLGMIILRKAYGLGAMAMAGGS

SEQ ID NO: 795204 - protein, 22 aa, Mycobacterium
ARLTVVWIADWADDMVHLSAQH

SEQ ID NO: 795205 - protein, 23 aa, Mycobacterium
ARLTVVWIADWADDTVHLSAHHA

SEQ ID NO: 795206 - protein, 25 aa, Mycobacterium
ARLTWQQVVLLRAYAKYLRQAGFPY

SEQ ID NO: 795207 - protein, 23 aa, Mycobacterium
ARLVARTTLRLPAQRIRAANFAA

SEQ ID NO: 795208 - protein, 18 aa, Mycobacterium
ARLVDLYAKRPQVQERLT

SEQ ID NO: 795209 - protein, 19 aa, Mycobacterium
ARLVELLKQPQYSPLAVEE

SEQ ID NO: 795210 - protein, 26 aa, Mycobacterium
ARLVFPKPMQHLTITVGLIADLKVIN

SEQ ID NO: 795211 - protein, 18 aa, Mycobacterium
ARLVFTAHSIPLRAASRC

SEQ ID NO: 795212 - protein, 20 aa, Mycobacterium
ARLVGRQQALGLLLSGDRLS

SEQ ID NO: 795213 - protein, 19 aa, Mycobacterium
ARLVMLDRGLPLPELQHPI

SEQ ID NO: 795214 - protein, 20 aa, Mycobacterium
ARLVPHIHALIRLDPRDSDD

SEQ ID NO: 795215 - protein, 19 aa, Mycobacterium
ARLVPHIHALIRLDPSDSD

SEQ ID NO: 795216 - protein, 24 aa, Mycobacterium
ARLYIGRLGIFDRDNDFEPLLLDW

SEQ ID NO: 795217 - protein, 19 aa, Mycobacterium
ARMAAWAPDGALLVSVPST

SEQ ID NO: 795218 - protein, 35 aa, Mycobacterium
ARMADWHRALYDNGFFGLSWPREWGGQDLAPVYDV

SEQ ID NO: 795219 - protein, 20 aa, Mycobacterium
ARMATLLKVLPEKQREILIL

SEQ ID NO: 795220 - protein, 19 aa, Mycobacterium
ARMDLAWSLAERWSADGRP

SEQ ID NO: 795221 - protein, 25 aa, Mycobacterium
ARMEARIALRALLARVPNWEVDLER

SEQ ID NO: 795222 - protein, 25 aa, Mycobacterium
ARMEARIALRALLARVPNWEVDLGR

SEQ ID NO: 795223 - protein, 20 aa, Mycobacterium
ARMEFFRSVVRSAGQAASKT

SEQ ID NO: 795224 - protein, 22 aa, Mycobacterium
ARMELPFFRTVESAPGPTTVVE

SEQ ID NO: 795225 - protein, 20 aa, Mycobacterium
ARMFAGAGSGPMLSAAMAWD

SEQ ID NO: 795226 - protein, 25 aa, Mycobacterium
ARMGHRLTIAMTRWQATVNWVADEP

SEQ ID NO: 795227 - protein, 18 aa, Mycobacterium
ARMLADTGLGWDATRLAS

SEQ ID NO: 795228 - protein, 18 aa, Mycobacterium
ARMLASRLAARRRRAHTG

SEQ ID NO: 795229 - protein, 28 aa, Mycobacterium
ARMLATVSRWLPTPALDALRRRVFGLPK

SEQ ID NO: 795230 - protein, 20 aa, Mycobacterium
ARMMMLGSAPLDRGSPLLAE

SEQ ID NO: 795231 - protein, 27 aa, Mycobacterium
ARMPLHSMTLLNIQFAMATAAAYVLKR

SEQ ID NO: 795232 - protein, 19 aa, Mycobacterium
ARMQAGYRRLTAQTPRTLS

SEQ ID NO: 795233 - protein, 17 aa, Mycobacterium
ARMQYLDLFTWLRGDIL

SEQ ID NO: 795234 - protein, 28 aa, Mycobacterium
ARMRADAQLPLPALPPARPGAPSDVLLT

SEQ ID NO: 795235 - protein, 18 aa, Mycobacterium
ARMWLRDPTPLFRTNVEG

SEQ ID NO: 795236 - protein, 29 aa, Mycobacterium
ARMYGQWCPRPWPDPTRRLLTITTGAVVL

SEQ ID NO: 795237 - protein, 19 aa, Mycobacterium
ARNAGLLAVRILGASDNAL

SEQ ID NO: 795238 - protein, 23 aa, Mycobacterium
ARNAGLLAVRILGASDPALRARI

SEQ ID NO: 795239 - protein, 22 aa, Mycobacterium
ARNAGLLAVRILGATDPQLRGR

SEQ ID NO: 795240 - protein, 23 aa, Mycobacterium
ARNAGLLAVRILGSSDPALRARI

SEQ ID NO: 795241 - protein, 31 aa, Mycobacterium
ARNAVLSEILGFYGLSYWYAEQVTILGLGPI

SEQ ID NO: 795242 - protein, 28 aa, Mycobacterium
ARNEDPACPAGSYVGPKAIKNPDGSSNY

SEQ ID NO: 795243 - protein, 26 aa, Mycobacterium
ARNEVYTLLPPLLPAPGRENPTVTPI

SEQ ID NO: 795244 - protein, 30 aa, Mycobacterium
ARNFQVVSIPTMILFKDGEPVKRIVGAKGK

SEQ ID NO: 795245 - protein, 17 aa, Mycobacterium
ARNHISFGFGVHRCMGN

SEQ ID NO: 795246 - protein, 25 aa, Mycobacterium
ARNHRGFVLSLIAANRIGADVLLLN

SEQ ID NO: 795247 - protein, 23 aa, Mycobacterium
ARNLPRMLVPLANILGPALFQSA

SEQ ID NO: 795248 - protein, 23 aa, Mycobacterium
ARNNTLIELYRGLLEAVTASVAH

SEQ ID NO: 795249 - protein, 28 aa, Mycobacterium
ARNPLFGGIVAHGYLVVSLAAGLFVEPN

SEQ ID NO: 795250 - protein, 23 aa, Mycobacterium
ARNPRQHLAFGFGPHLCLGHNLA

SEQ ID NO: 795251 - protein, 21 aa, Mycobacterium
ARNRALLLQAARNLIAERGAD

SEQ ID NO: 795252 - protein, 26 aa, Mycobacterium
ARNRGLWNLFHPHPEWGPGLTNLEYA

SEQ ID NO: 795253 - protein, 22 aa, Mycobacterium
ARNRVLLLDAARRLVDERGADS

SEQ ID NO: 795254 - protein, 20 aa, Mycobacterium
ARNSGMTVVFWLDTERPHEV

SEQ ID NO: 795255 - protein, 31 aa, Mycobacterium
ARNSQSWRFAPFFHALLDAGVYPPCSAFEAW

SEQ ID NO: 795256 - protein, 25 aa, Mycobacterium
ARNTFYGMARWQAKLEQRQGFLGRV

SEQ ID NO: 795257 - protein, 30 aa, Mycobacterium
ARNVIPKPLQKPHPPVWVACTRPSSVQMAA

SEQ ID NO: 795258 - protein, 19 aa, Mycobacterium
ARNVIPKPMQKPHPPVWVA

SEQ ID NO: 795259 - protein, 26 aa, Mycobacterium
ARNVLESFKLLTNVSRLFAERCIVGL

SEQ ID NO: 795260 - protein, 22 aa, Mycobacterium
ARNVLESFTLLANVSKLFAAKC

SEQ ID NO: 795261 - protein, 18 aa, Mycobacterium
ARNVLPRLSAQRAILQAV

SEQ ID NO: 795262 - protein, 31 aa, Mycobacterium
ARNVVPKPLQKPHPPVWVACTRPASVQMAAQ

SEQ ID NO: 795263 - protein, 18 aa, Mycobacterium
ARPAATGGFMLLLHLHHI

SEQ ID NO: 795264 - protein, 19 aa, Mycobacterium
ARPAEVLRAGYWTDLIGAA

SEQ ID NO: 795265 - protein, 19 aa, Mycobacterium
ARPDGEWRAVAKVSAWLLA

SEQ ID NO: 795266 - protein, 19 aa, Mycobacterium
ARPDLIAGLVLLDPAVGLD

SEQ ID NO: 795267 - protein, 30 aa, Mycobacterium
ARPDVHVVLIEPLLRRSDFLREAIEDVGIE

SEQ ID NO: 795268 - protein, 20 aa, Mycobacterium
ARPDWLDWAQLSAPGPRELT

SEQ ID NO: 795269 - protein, 22 aa, Mycobacterium
ARPDWQLICAVAEHLGFGEHFR

SEQ ID NO: 795270 - protein, 23 aa, Mycobacterium
ARPFALLERFELNAWAEAVRRHR

SEQ ID NO: 795271 - protein, 25 aa, Mycobacterium
ARPGAGFFVLVFAKGAFPADTEQGP

SEQ ID NO: 795272 - protein, 23 aa, Mycobacterium
ARPGARRHLLSWGIGECGVCGEK

SEQ ID NO: 795273 - protein, 17 aa, Mycobacterium
ARPGGVPVWSPYIRGER

SEQ ID NO: 795274 - protein, 28 aa, Mycobacterium
ARPGVHWIREFLPTPKLREVLSAATVFV

SEQ ID NO: 795275 - protein, 22 aa, Mycobacterium
ARPIGRIEGWGHRTVGLGLQQK

SEQ ID NO: 795276 - protein, 19 aa, Mycobacterium
ARPIVLLRRRPHAPVAHAV

SEQ ID NO: 795277 - protein, 22 aa, Mycobacterium
ARPLALYHTKRLASPAQRIMLY

SEQ ID NO: 795278 - protein, 20 aa, Mycobacterium
ARPLIYAGGGLHPLPARTVN

SEQ ID NO: 795279 - protein, 31 aa, Mycobacterium
ARPLVMLLHGFGSFWWSWRHQLRGLAGARVV

SEQ ID NO: 795280 - protein, 31 aa, Mycobacterium
ARPPARLVGWTARFLGMVRPGDDVDFRVERV

SEQ ID NO: 795281 - protein, 30 aa, Mycobacterium; identical to SEQ ID NO: 216368

SEQ ID NO: 795282 - protein, 31 aa, Mycobacterium
ARPQSAQELLRLDPNVWPRNTVRDQSGVACI

SEQ ID NO: 795283 - protein, 18 aa, Mycobacterium
ARPRAGLIGCAFADLAEV

SEQ ID NO: 795284 - protein, 29 aa, Mycobacterium
ARPRQRVTGDMWLAALRGLEALGELGADA

SEQ ID NO: 795285 - protein, 23 aa, Mycobacterium
ARPRSRCFIAMSVILRHAARRRC

SEQ ID NO: 795286 - protein, 27 aa, Mycobacterium
ARPSGQPLLRIWPVSAHTPAALTAQAE

SEQ ID NO: 795287 - protein, 17 aa, Mycobacterium
ARPTAFVVAFGAPGDTP

SEQ ID NO: 795288 - protein, 30 aa, Mycobacterium
ARPTAWLAEGLLMYLPADAQDRLFAQITEL

SEQ ID NO: 795289 - protein, 17 aa, Mycobacterium
ARPTPGRAQFHYLESWL

SEQ ID NO: 795290 - protein, 30 aa, Mycobacterium
ARPTPLPRGEVAWWLFPAGRAGAVTDAGRE

SEQ ID NO: 795291 - protein, 27 aa, Mycobacterium
ARPVRAEWLAPLLDPVPALVVHDGVNE

SEQ ID NO: 795292 - protein, 23 aa, Mycobacterium
ARPVRAPHWLPTPARRRARGAYD

SEQ ID NO: 795293 - protein, 27 aa, Mycobacterium
ARQAAWPPRMFSLLAGFVEAGESFEVC

SEQ ID NO: 795294 - protein, 19 aa, Mycobacterium
ARQAGRIPKRFWAQASSPA

SEQ ID NO: 795295 - protein, 29 aa, Mycobacterium
ARQASTLAYFPLWGYAHPTAVELAERLAG

SEQ ID NO: 795296 - protein, 27 aa, Mycobacterium
ARQDRAELIAWLLERGFSLEHIQASAA

SEQ ID NO: 795297 - protein, 19 aa, Mycobacterium
ARQDVLTKPRGALGRLEDL

SEQ ID NO: 795298 - protein, 25 aa, Mycobacterium
ARQEPRLSWAAGLRDDGTTTLLVTD

SEQ ID NO: 795299 - protein, 31 aa, Mycobacterium
ARQERAAHLPRWPLIVLRTPKGWTGPKMVEG

SEQ ID NO: 795300 - protein, 19 aa, Mycobacterium
ARQFAILRALAGTPVRVPA

SEQ ID NO: 795301 - protein, 17 aa, Mycobacterium
ARQFPPPDPGQICYLGF

SEQ ID NO: 795302 - protein, 19 aa, Mycobacterium
ARQFVMGKRFFLDEFGIDT

SEQ ID NO: 795303 - protein, 24 aa, Mycobacterium
ARQGSFLGYRVTVCDARPVFATRA

SEQ ID NO: 795304 - protein, 23 aa, Mycobacterium
ARQLADPTLVTRALIGCGMSSVY

SEQ ID NO: 795305 - protein, 38 aa, Mycobacterium
ARQLASSGYIGFFLCPVVPELFFRSGIGVKLVGAFERI

SEQ ID NO: 795306 - protein, 18 aa, Mycobacterium
ARQLQRGFRRPDEKLRRL

SEQ ID NO: 795307 - protein, 22 aa, Mycobacterium
ARQLRLRIDSTWRWATTITNAW

SEQ ID NO: 795308 - protein, 30 aa, Mycobacterium
ARQMDIPPKLAIPMRVIASIVAISCQLDAH

SEQ ID NO: 795309 - protein, 17 aa, Mycobacterium
ARQMDLPPKLAIPMRVI

SEQ ID NO: 795310 - protein, 19 aa, Mycobacterium
ARQPYYRWRADPITEAEVI

SEQ ID NO: 795311 - protein, 19 aa, Mycobacterium
ARQPYYRWRANPITDAEII

SEQ ID NO: 795312 - protein, 20 aa, Mycobacterium
ARQPYYRWRANPITDAELVE

SEQ ID NO: 795313 - protein, 27 aa, Mycobacterium
ARQQDIAFVPYFPLGSAFPGFPKVSQN

SEQ ID NO: 795314 - protein, 24 aa, Mycobacterium
ARQRAPLTVLDLDYRPMFWESPAA

SEQ ID NO: 795315 - protein, 20 aa, Mycobacterium
ARQRCVLVALLIDVNRPIPV

SEQ ID NO: 795316 - protein, 26 aa, Mycobacterium
ARQRDIWLPVHPVTRRRWPNGRVTHD

SEQ ID NO: 795317 - protein, 31 aa, Mycobacterium
ARQRDRQWWQRRLPQMPGAPELPTVPVGSRR

SEQ ID NO: 795318 - protein, 19 aa, Mycobacterium
ARQRHVYLPGWAWSSSTGE

SEQ ID NO: 795319 - protein, 22 aa, Mycobacterium
ARQRLAAFIAPIPVSTRDGAPL

SEQ ID NO: 795320 - protein, 22 aa, Mycobacterium
ARQRLLYDLPEAKGALWNEHVG

SEQ ID NO: 795321 - protein, 17 aa, Mycobacterium
ARQRLYLSRAIVRSSWG

SEQ ID NO: 795322 - protein, 35 aa, Mycobacterium
ARQSKNPVLQLFIEILMRLTRRYALTSRTDTVAEA

SEQ ID NO: 795323 - protein, 22 aa, Mycobacterium
ARQTFPTLAPAVRVPVHFSIAE

SEQ ID NO: 795324 - protein, 19 aa, Mycobacterium
ARQTILARRIGDDAVAILG

SEQ ID NO: 795325 - protein, 24 aa, Mycobacterium
ARQVPGLWTIPHTAAGKSQIGGAS

SEQ ID NO: 795326 - protein, 19 aa, Mycobacterium
ARQYRYAYAATGKPGWFLF

SEQ ID NO: 795327 - protein, 17 aa, Mycobacterium
ARRAANRVVFMSDGAVV

SEQ ID NO: 795328 - protein, 22 aa, Mycobacterium
ARRALDFLRGLRRQDTIATGGS

SEQ ID NO: 795329 - protein, 19 aa, Mycobacterium
ARRALSRVFDLPPPVCDFV

SEQ ID NO: 795330 - protein, 23 aa, Mycobacterium
ARRAPALYIIEDVHWIDAVSESM

SEQ ID NO: 795331 - protein, 28 aa, Mycobacterium
ARRARHRPVWIKGFGEHIAFKTPTYAED

SEQ ID NO: 795332 - protein, 23 aa, Mycobacterium
ARRAYDVHPIVTAILDADTPFDE

SEQ ID NO: 795333 - protein, 18 aa, Mycobacterium
ARRAYDVRPIVTAILDDE

SEQ ID NO: 795334 - protein, 18 aa, Mycobacterium
ARRCAELEAVLFEGDDPW

SEQ ID NO: 795335 - protein, 20 aa, Mycobacterium
ARRCRAVRLVPFDPHLEEGA

SEQ ID NO: 795336 - protein, 18 aa, Mycobacterium
ARRCTVGGVGAIAAVAAE

SEQ ID NO: 795337 - protein, 25 aa, Mycobacterium
ARRDADGYFYIAGRYKDMYKSGGEN

SEQ ID NO: 795338 - protein, 29 aa, Mycobacterium
ARRDAEWMGPLLEALGLTVGWITAESTSE

SEQ ID NO: 795339 - protein, 19 aa, Mycobacterium
ARRDGKVPAVLYGHGTDPQ

SEQ ID NO: 795340 - protein, 18 aa, Mycobacterium
ARRDGQVPAVLYGHGTTP

SEQ ID NO: 795341 - protein, 23 aa, Mycobacterium
ARRDGRIPAVLYGHGAEPQHLEL

SEQ ID NO: 795342 - protein, 24 aa, Mycobacterium
ARRDRAAAILRRRTDRRPFGAPRG

SEQ ID NO: 795343 - protein, 19 aa, Mycobacterium
ARREAALASLRLLGHEDTG

SEQ ID NO: 795344 - protein, 24 aa, Mycobacterium
ARREGRVPVVLYGHGTDPQHLELD

SEQ ID NO: 795345 - protein, 24 aa, Mycobacterium
ARRELAQQIAFYSSVKSYETVLDV

SEQ ID NO: 795346 - protein, 25 aa, Mycobacterium
ARRFLHQLYLGYPDSAAARGLAPAE

SEQ ID NO: 795347 - protein, 24 aa, Mycobacterium
ARRFLTFNGWLLQRGELPLRLREL

SEQ ID NO: 795348 - protein, 27 aa, Mycobacterium
ARRFPGGQMIFDLPPSWFAAWARKGMR

SEQ ID NO: 795349 - protein, 26 aa, Mycobacterium
ARRFRAELDIPLILLGGITGGESMDL

SEQ ID NO: 795350 - protein, 21 aa, Mycobacterium
ARRFRVGGRLFTFGNGGSCTD

SEQ ID NO: 795351 - protein, 21 aa, Mycobacterium
ARRFWRDEYLLNAQIADFAKP

SEQ ID NO: 795352 - protein, 19 aa, Mycobacterium
ARRGANLILVARRAERLEA

SEQ ID NO: 795353 - protein, 25 aa, Mycobacterium
ARRGAVYWDPLSTLGFLAAHTRRIR

SEQ ID NO: 795354 - protein, 26 aa, Mycobacterium
ARRGDGWIKLVGDWIDRQIGDLAPLW

SEQ ID NO: 795355 - protein, 40 aa, Mycobacterium
ARRGGTIVFVGLPPGDFPAPIFDIVLKGLTIRGSIVGTRQ

SEQ ID NO: 795356 - protein, 25 aa, Mycobacterium
ARRGGYVLCSFVPASLPAHELDSSD

SEQ ID NO: 795357 - protein, 22 aa, Mycobacterium
ARRGKMFARLIKNIEVAARVGG

SEQ ID NO: 795358 - protein, 18 aa, Mycobacterium
ARRGLPFVANYHVTPWST

SEQ ID NO: 795359 - protein, 27 aa, Mycobacterium
ARRGRHRPVWIKGFGEHIAFKTPTYAE

SEQ ID NO: 795360 - protein, 25 aa, Mycobacterium
ARRGRLIVTMPWHLEPDEALIFEFA

SEQ ID NO: 795361 - protein, 17 aa, Mycobacterium
ARRGVRTHVLPASATFD

SEQ ID NO: 795362 - protein, 18 aa, Mycobacterium
ARRHAGVVASLNARRVAR

SEQ ID NO: 795363 - protein, 18 aa, Mycobacterium
ARRIPLQHLVGSAAFGPI

SEQ ID NO: 795364 - protein, 17 aa, Mycobacterium
ARRIRARLREWLVQIGA

SEQ ID NO: 795365 - protein, 18 aa, Mycobacterium
ARRIWIDNPYVVAKSALV

SEQ ID NO: 795366 - protein, 17 aa, Mycobacterium
ARRKVEAALAGDVPLRD

SEQ ID NO: 795367 - protein, 26 aa, Mycobacterium
ARRLAEKLWYLRILTDEKSASDLGAP

SEQ ID NO: 795368 - protein, 21 aa, Mycobacterium
ARRLAGRLRFACLPTPATLAD

SEQ ID NO: 795369 - protein, 24 aa, Mycobacterium
ARRLALPCHVADADLWFAESPADL

SEQ ID NO: 795370 - protein, 28 aa, Mycobacterium
ARRLAMPELPDELFMGSLCQLIAVDKPW

SEQ ID NO: 795371 - protein, 20 aa, Mycobacterium
ARRLARARAQILSLAQTRLR

SEQ ID NO: 795372 - protein, 18 aa, Mycobacterium
ARRLDKLSRTLLAEAGLT

SEQ ID NO: 795373 - protein, 25 aa, Mycobacterium
ARRLDWDRTLLFRRLKELHLEFAPV

SEQ ID NO: 795374 - protein, 23 aa, Mycobacterium
ARRLFERVQPTLPILLANLVSIN

SEQ ID NO: 795375 - protein, 23 aa, Mycobacterium
ARRLGPHEFFTYVEGRAAQFAGL

SEQ ID NO: 795376 - protein, 17 aa, Mycobacterium
ARRLHPRLLRRQRRQRL

SEQ ID NO: 795377 - protein, 17 aa, Mycobacterium
ARRLITALAGLVTASAE

SEQ ID NO: 795378 - protein, 30 aa, Mycobacterium
ARRLLGQIKAIWRINELLNWQVAASGETIA

SEQ ID NO: 795379 - protein, 22 aa, Mycobacterium
ARRLLRSIAKHNSPPALPVEIG

SEQ ID NO: 795380 - protein, 25 aa, Mycobacterium
ARRLPACEPAIITPLGPVLALHVGA

SEQ ID NO: 795381 - protein, 23 aa, Mycobacterium
ARRLPLFLHPALEPPIGGATDWS

SEQ ID NO: 795382 - protein, 22 aa, Mycobacterium
ARRLQRLVDSLLDFSRIEAGRA

SEQ ID NO: 795383 - protein, 19 aa, Mycobacterium
ARRLQRMVDSLLAFSRIEA

SEQ ID NO: 795384 - protein, 20 aa, Mycobacterium
ARRLQRMVDSLLDFSRIEAG

SEQ ID NO: 795385 - protein, 25 aa, Mycobacterium
ARRLRKDIFDLYGYNAVVHVLSAGG

SEQ ID NO: 795386 - protein, 25 aa, Mycobacterium
ARRLRKDIFDLYGYSAVVHVLSASG

SEQ ID NO: 795387 - protein, 26 aa, Mycobacterium
ARRLRKDIFELYGYNAVVHVLSASGI

SEQ ID NO: 795388 - protein, 22 aa, Mycobacterium
ARRLRLDVLAQRDFRRPFDLAK

SEQ ID NO: 795389 - protein, 23 aa, Mycobacterium
ARRLRLDVLAQRDFRRPFDLSKD

SEQ ID NO: 795390 - protein, 19 aa, Mycobacterium
ARRLRSPILVQLGTNDRVA

SEQ ID NO: 795391 - protein, 17 aa, Mycobacterium
ARRLRVAGAGLIRAWRA

SEQ ID NO: 795392 - protein, 18 aa, Mycobacterium
ARRLSNAPLMMLCSTRTT

SEQ ID NO: 795393 - protein, 17 aa, Mycobacterium
ARRLTGPHRVGPAPWKP

SEQ ID NO: 795394 - protein, 20 aa, Mycobacterium
ARRMGSKSPLLPMIADCERG

SEQ ID NO: 795395 - protein, 18 aa, Mycobacterium
ARRMSEISEAPLYIDDSP

SEQ ID NO: 795396 - protein, 18 aa, Mycobacterium
ARRPEFAGLAPALITCAE

SEQ ID NO: 795397 - protein, 17 aa, Mycobacterium
ARRPMFASKLTGIPPDL

SEQ ID NO: 795398 - protein, 23 aa, Mycobacterium
ARRPVFRRYSLAEELLAVAIAEG

SEQ ID NO: 795399 - protein, 17 aa, Mycobacterium
ARRQGIEFDLAFEAREI

SEQ ID NO: 795400 - protein, 18 aa, Mycobacterium
ARRQMIKQPLWFQRAQVA

SEQ ID NO: 795401 - protein, 26 aa, Mycobacterium
ARRRDGDPAALRPFLLVASFVNPHDI

SEQ ID NO: 795402 - protein, 24 aa, Mycobacterium
ARRREEYVGPWLPEPLLLDEHDAS

SEQ ID NO: 795403 - protein, 29 aa, Mycobacterium
ARRREEYVGPWLPEPLLLDEQDPAADVVL

SEQ ID NO: 795404 - protein, 28 aa, Mycobacterium
ARRREEYVGPWLPEPLLLEDQDPSADVV

SEQ ID NO: 795405 - protein, 25 aa, Mycobacterium
ARRRESYVGPWLPEPLLLDDRDASA

SEQ ID NO: 795406 - protein, 27 aa, Mycobacterium
ARRRFRRSIQTILLAALGRTIAQTVGD

SEQ ID NO: 795407 - protein, 27 aa, Mycobacterium
ARRRGQLVDWTWQMVRDTVLDRLASNP

SEQ ID NO: 795408 - protein, 28 aa, Mycobacterium
ARRRGYAVGLHLLPDLRLQELALIVRSA

SEQ ID NO: 795409 - protein, 17 aa, Mycobacterium
ARRRKLRVELDGLAIAL

SEQ ID NO: 795410 - protein, 22 aa, Mycobacterium
ARRRMAQWLTAIGVDPVRKGAI

SEQ ID NO: 795411 - protein, 24 aa, Mycobacterium
ARRRRARGLRLNHPEAVAVITDHL

SEQ ID NO: 795412 - protein, 24 aa, Mycobacterium
ARRRRTTFALLARVFEPLAQFSRM

SEQ ID NO: 795413 - protein, 19 aa, Mycobacterium
ARRRTNVLYALIRDNRTWQ

SEQ ID NO: 795414 - protein, 20 aa, Mycobacterium
ARRRTNVLYALIRDNRTWQP

SEQ ID NO: 795415 - protein, 18 aa, Mycobacterium
ARRRVGLVGLHAWSDIDV

SEQ ID NO: 795416 - protein, 21 aa, Mycobacterium
ARRRVLDAAIYREAVTRLDKH

SEQ ID NO: 795417 - protein, 24 aa, Mycobacterium
ARRSGMIEQIWRAFFSSLAADGVD

SEQ ID NO: 795418 - protein, 19 aa, Mycobacterium
ARRSLPGDPYFGDPLSTSG

SEQ ID NO: 795419 - protein, 27 aa, Mycobacterium
ARRSRKQPPLQRIIRALIGMDAKMRQY

SEQ ID NO: 795420 - protein, 27 aa, Mycobacterium
ARRSRRRIYWLSLPLDYGLSGTTAAGG

SEQ ID NO: 795421 - protein, 19 aa, Mycobacterium
ARRSVLARTWPVVCDELIG

SEQ ID NO: 795422 - protein, 18 aa, Mycobacterium
ARRTALVSANWLGQHSAA

SEQ ID NO: 795423 - protein, 27 aa, Mycobacterium
ARRTAVLRNWEFFRAPLGGIVCMHREL

SEQ ID NO: 795424 - protein, 19 aa, Mycobacterium
ARRTLQRHLAKRRPPKSGQ

SEQ ID NO: 795425 - protein, 29 aa, Mycobacterium
ARRVADVLGIPFYVWDFADRFKEDVIDDF

SEQ ID NO: 795426 - protein, 29 aa, Mycobacterium
ARRVADVLGIPFYVWDFAEKFQADVIDEF

SEQ ID NO: 795427 - protein, 29 aa, Mycobacterium
ARRVADVLGIPFYVWDFAERFKEDVIDDF

SEQ ID NO: 795428 - protein, 25 aa, Mycobacterium
ARRVALPNIVRLLPVARAAGVRVVH

SEQ ID NO: 795429 - protein, 32 aa, Mycobacterium
ARRVARVCGCIAALLMAILGCTSVTEGTATPD

SEQ ID NO: 795430 - protein, 21 aa, Mycobacterium
ARRVAVPLVPHGRGFALDADA

SEQ ID NO: 795431 - protein, 20 aa, Mycobacterium
ARRVGRPVKLMLTRRHLYAV

SEQ ID NO: 795432 - protein, 21 aa, Mycobacterium
ARRVLHQLYLGFPDSAAAQGI

SEQ ID NO: 795433 - protein, 20 aa, Mycobacterium
ARRVLREFALQVPVGVRFAK

SEQ ID NO: 795434 - protein, 31 aa, Mycobacterium
ARRVPDAAAVWAERGWRFPDRLDRVYVNTRA

SEQ ID NO: 795435 - protein, 23 aa, Mycobacterium
ARRVTEVALVFKRAPHLPFDATM

SEQ ID NO: 795436 - protein, 29 aa, Mycobacterium
ARRVVVVSYLLAEGLFQERLRACGADLVT

SEQ ID NO: 795437 - protein, 29 aa, Mycobacterium
ARRVVVVSYLLAEGLFQERLRACGADVVT

SEQ ID NO: 795438 - protein, 27 aa, Mycobacterium
ARRWCDIWLHEGFACYAEWLWSEHSGG

SEQ ID NO: 795439 - protein, 19 aa, Mycobacterium
ARRYDHVAQRFGAAGLVTY

SEQ ID NO: 795440 - protein, 23 aa, Mycobacterium
ARRYFDALHRYFGGGTGNPSQVW

SEQ ID NO: 795441 - protein, 19 aa, Mycobacterium
ARRYGLPLRVITFAVRGRT

SEQ ID NO: 795442 - protein, 31 aa, Mycobacterium
ARRYSFTVPVDRPIPTPIYLPEAGIACTPHK

SEQ ID NO: 795443 - protein, 19 aa, Mycobacterium
ARRYTLARFELFMEGTRRP

SEQ ID NO: 795444 - protein, 17 aa, Mycobacterium
ARRYVAKYTICPAVAHG

SEQ ID NO: 795445 - protein, 21 aa, Mycobacterium
ARSAADFRAPFAPSGRFEGLE

SEQ ID NO: 795446 - protein, 23 aa, Mycobacterium
ARSAFDTGPWPTAEPAERARCLQ

SEQ ID NO: 795447 - protein, 18 aa, Mycobacterium
ARSAGCPVAVIHQPARRS

SEQ ID NO: 795448 - protein, 18 aa, Mycobacterium
ARSFIRNAVVPRENEILA

SEQ ID NO: 795449 - protein, 18 aa, Mycobacterium
ARSFLFVPGNRPERFSKA

SEQ ID NO: 795450 - protein, 25 aa, Mycobacterium
ARSGGRLEALFLDEGFGSLDADALQ

SEQ ID NO: 795451 - protein, 31 aa, Mycobacterium
ARSGLAYALSKSFVKWYSQSQAERFNARGLR

SEQ ID NO: 795452 - protein, 20 aa, Mycobacterium
ARSGVIHALWAADNAGPDER

SEQ ID NO: 795453 - protein, 19 aa, Mycobacterium
ARSKLYDVVIVDTAGRLGI

SEQ ID NO: 795454 - protein, 19 aa, Mycobacterium
ARSLAEVGIGFCFAPLFHP

SEQ ID NO: 795455 - protein, 19 aa, Mycobacterium
ARSLAMKPKLMLFDEPTSA

SEQ ID NO: 795456 - protein, 23 aa, Mycobacterium
ARSLAQFGLTWDATRLAGQAALQ

SEQ ID NO: 795457 - protein, 17 aa, Mycobacterium
ARSLLLSMVAAVTAAGG

SEQ ID NO: 795458 - protein, 22 aa, Mycobacterium
ARSLMRPLLEHPAALHASIREE

SEQ ID NO: 795459 - protein, 31 aa, Mycobacterium
ARSLPAIQHFLELLRADPRLPEWRAMAARAL

SEQ ID NO: 795460 - protein, 22 aa, Mycobacterium
ARSLTLSAFASKVTVGFTSDIR

SEQ ID NO: 795461 - protein, 19 aa, Mycobacterium
ARSMGVYAVNYPASDQWDT

SEQ ID NO: 795462 - protein, 25 aa, Mycobacterium
ARSRARAAWLWSGRTATLAGYSAAA

SEQ ID NO: 795463 - protein, 20 aa, Mycobacterium
ARSRLNLADGLLVSAVWASA

SEQ ID NO: 795464 - protein, 18 aa, Mycobacterium
ARSTGIGELKFFSQIGYG

SEQ ID NO: 795465 - protein, 26 aa, Mycobacterium
ARSVLYRRWPSRLDLLKAVIRHRGEI

SEQ ID NO: 795466 - protein, 24 aa, Mycobacterium
ARSVSPGWRQAYVSAASLPGPYDI

SEQ ID NO: 795467 - protein, 24 aa, Mycobacterium
ARSWAARWIAETGCEKYREAFSKL

SEQ ID NO: 795468 - protein, 17 aa, Mycobacterium
ARSWHRYAEPPPDATAM

SEQ ID NO: 795469 - protein, 33 aa, Mycobacterium
ARSWQVRDFLARNGLYYTWFMADEPAGERLLNA

SEQ ID NO: 795470 - protein, 25 aa, Mycobacterium
ARTAAAIRRILLTQLGWAPDERTLQ

SEQ ID NO: 795471 - protein, 26 aa, Mycobacterium
ARTAGHPPTWVPLPVHYADYTLWHHQ

SEQ ID NO: 795472 - protein, 19 aa, Mycobacterium
ARTAGYRRVGLWTNDVLTS

SEQ ID NO: 795473 - protein, 28 aa, Mycobacterium
ARTALGPVALPGATLFVFRHAGQEFAVR

SEQ ID NO: 795474 - protein, 21 aa, Mycobacterium
ARTALPTMTLLGAQFVMATAA

SEQ ID NO: 795475 - protein, 25 aa, Mycobacterium
ARTARVQFWPALKDLSMYSLRVRED

SEQ ID NO: 795476 - protein, 26 aa, Mycobacterium
ARTATHLFLFAGYVEQFRGWGPTLRR

SEQ ID NO: 795477 - protein, 23 aa, Mycobacterium
ARTDHFMPAALLRSQLDTLEALG

SEQ ID NO: 795478 - protein, 18 aa, Mycobacterium
ARTDLAWSLAERWSADGR

SEQ ID NO: 795479 - protein, 34 aa, Mycobacterium
ARTDWTVPKHEGLTMFLVPLDSPGITMRRIKEVN

SEQ ID NO: 795480 - protein, 23 aa, Mycobacterium
ARTEPVVFVLEDVHWIDEASESM

SEQ ID NO: 795481 - protein, 19 aa, Mycobacterium
ARTFCFNPMVFAGEKPTTM

SEQ ID NO: 795482 - protein, 25 aa, Mycobacterium
ARTGAPLLFASGAFLGADKAASVDR

SEQ ID NO: 795483 - protein, 27 aa, Mycobacterium
ARTGLVLAPAGGTLRPLRPAFSVGLGA

SEQ ID NO: 795484 - protein, 26 aa, Mycobacterium
ARTGRRYLDMFTFFASSALGMNHPGL

SEQ ID NO: 795485 - protein, 26 aa, Mycobacterium
ARTGRRYLDMFTFVASSALGMNHPAL

SEQ ID NO: 795486 - protein, 20 aa, Mycobacterium
ARTGVFWVREMLPQPKIDEI

SEQ ID NO: 795487 - protein, 22 aa, Mycobacterium
ARTGVFWVREMLPTHKIREILS

SEQ ID NO: 795488 - protein, 27 aa, Mycobacterium
ARTIGARHVIWLPRGLTRDAERFGTRG

SEQ ID NO: 795489 - protein, 27 aa, Mycobacterium
ARTIGGTDFVWLPRGLTRDSERFGTRG

SEQ ID NO: 795490 - protein, 21 aa, Mycobacterium
ARTIWTQCDSYFRSPTGRIVT

SEQ ID NO: 795491 - protein, 29 aa, Mycobacterium
ARTKNMFALGLLSWMYHRPLEGTEQFLRE

SEQ ID NO: 795492 - protein, 30 aa, Mycobacterium
ARTKRMQVAFTPLLARRWSGERIRVYSMHP

SEQ ID NO: 795493 - protein, 23 aa, Mycobacterium
ARTKWFDDFFLAASAAGLAQIVL

SEQ ID NO: 795494 - protein, 20 aa, Mycobacterium
ARTLATRLAARRRRSRAGSI

SEQ ID NO: 795495 - protein, 21 aa, Mycobacterium
ARTLLNCVGALHSRGHEVAWD

SEQ ID NO: 795496 - protein, 21 aa, Mycobacterium
ARTLQLRRLAPATGAVTTLIT

SEQ ID NO: 795497 - protein, 20 aa, Mycobacterium
ARTLRPCHTPLDGDTVFALA

SEQ ID NO: 795498 - protein, 21 aa, Mycobacterium
ARTLVTLPGYPFARQRHWVEY

SEQ ID NO: 795499 - protein, 29 aa, Mycobacterium
ARTLYLNRHSLLYRIKLIEELTGLSLKNP

SEQ ID NO: 795500 - protein, 32 aa, Mycobacterium
ARTMRKAFMGNPILCDLILIRSALSPRAARVG

SEQ ID NO: 795501 - protein, 23 aa, Mycobacterium
ARTPIGRLMGSLKDFSASDLGAI

SEQ ID NO: 795502 - protein, 32 aa, Mycobacterium
ARTQSLWEPLAHWQPRLLAVRSPNAPIVDDAA

SEQ ID NO: 795503 - protein, 24 aa, Mycobacterium
ARTRERGFDIDWTTPALAQAVQVV

SEQ ID NO: 795504 - protein, 25 aa, Mycobacterium
ARTRRAMALLAIRNLDSYLDTGELV

SEQ ID NO: 795505 - protein, 18 aa, Mycobacterium
ARTSILMNLPTSALMDVA

SEQ ID NO: 795506 - protein, 37 aa, Mycobacterium
ARTSPALDLDALIGGFRPLFRALDPDQINALSGQLIS

SEQ ID NO: 795507 - protein, 26 aa, Mycobacterium
ARTSRPRLMAWAPDGALLVSVPSTGQ

SEQ ID NO: 795508 - protein, 31 aa, Mycobacterium
ARTSTFEPLIAIRPGYWRPANFAAATATLDH

SEQ ID NO: 795509 - protein, 27 aa, Mycobacterium
ARTTDPSWVSLMFLASGLVVDIGGMMS

SEQ ID NO: 795510 - protein, 20 aa, Mycobacterium
ARTTLLLAGQAWADAAGGTS

SEQ ID NO: 795511 - protein, 18 aa, Mycobacterium
ARTTSIVAADLFGRTLDA

SEQ ID NO: 795512 - protein, 19 aa, Mycobacterium
ARTVIYYVLGFTVDEQSRL

SEQ ID NO: 795513 - protein, 29 aa, Mycobacterium
ARTVPALLRDGFFTTLRLTEDDRARPQRY

SEQ ID NO: 795514 - protein, 21 aa, Mycobacterium
ARTVVLGHLLRGGSPTSFDRL

SEQ ID NO: 795515 - protein, 25 aa, Mycobacterium
ARTWGASTLIPFFGGLTSIPVSPTL

SEQ ID NO: 795516 - protein, 21 aa, Mycobacterium
ARTWGASTLIPFFGGLTSVPV

SEQ ID NO: 795517 - protein, 17 aa, Mycobacterium
ARTWLDDQPSYLPPVQL

SEQ ID NO: 795518 - protein, 20 aa, Mycobacterium
ARVAAIHEIIGGTPRLWHLV

SEQ ID NO: 795519 - protein, 32 aa, Mycobacterium
ARVAGILAAKRTPDLIPLCHQLALTGVDVDFD

SEQ ID NO: 795520 - protein, 23 aa, Mycobacterium
ARVALLTGVLGDVPLIADADTGF

SEQ ID NO: 795521 - protein, 25 aa, Mycobacterium
ARVATGRFPFYLGFSAEVVGIEDAA

SEQ ID NO: 795522 - protein, 18 aa, Mycobacterium
ARVATVKAGLGGAVEPVS

SEQ ID NO: 795523 - protein, 25 aa, Mycobacterium
ARVDGPMPFPVVPASRPLTAERDRD

SEQ ID NO: 795524 - protein, 19 aa, Mycobacterium
ARVDLLRHGLLGIAAQGRL

SEQ ID NO: 795525 - protein, 25 aa, Mycobacterium
ARVDPSMVLYLFGSKAALFRESLKL

SEQ ID NO: 795526 - protein, 25 aa, Mycobacterium
ARVDWSRFLPLYQQAGRRGFLAELE

SEQ ID NO: 795527 - protein, 30 aa, Mycobacterium
ARVEYKLRDWLFARQRYWGEPFPVVYDSEG

SEQ ID NO: 795528 - protein, 20 aa, Mycobacterium
ARVFLGSRSGKIIRHSPVPV

SEQ ID NO: 795529 - protein, 20 aa, Mycobacterium
ARVFVGLTQGWLSDAGSRPT

SEQ ID NO: 795530 - protein, 26 aa, Mycobacterium
ARVGCGFITWSLARRPGLLDEALQRR

SEQ ID NO: 795531 - protein, 19 aa, Mycobacterium
ARVGLINWLIQDPGNAAVA

SEQ ID NO: 795532 - protein, 27 aa, Mycobacterium
ARVGLQPLVFGLWRMISEYNAARPEVV

SEQ ID NO: 795533 - protein, 18 aa, Mycobacterium
ARVGLVVRLLVEGLTGPA

SEQ ID NO: 795534 - protein, 19 aa, Mycobacterium
ARVGRVVFGAWEPKTGAVG

SEQ ID NO: 795535 - protein, 18 aa, Mycobacterium
ARVGSFGWNTQRHLELYL

SEQ ID NO: 795536 - protein, 26 aa, Mycobacterium
ARVGSYLRYGAYPYAIAIRESLGDGN

SEQ ID NO: 795537 - protein, 25 aa, Mycobacterium
ARVGSYLRYGAYPYAIAVREYVGDG

SEQ ID NO: 795538 - protein, 29 aa, Mycobacterium
ARVHRALYDAGWMRYGWPVDVGGLGGPAL

SEQ ID NO: 795539 - protein, 25 aa, Mycobacterium
ARVHYHVPLHLDPPAPLRTTAHILA

SEQ ID NO: 795540 - protein, 22 aa, Mycobacterium
ARVIGVDRMLLRRWSGKRASTP

SEQ ID NO: 795541 - protein, 27 aa, Mycobacterium
ARVISDVWLSNLLAWLTRRASATDVAK

SEQ ID NO: 795542 - protein, 26 aa, Mycobacterium
ARVISDVWLSNLLAWLTRRASATDVS

SEQ ID NO: 795543 - protein, 27 aa, Mycobacterium
ARVISDVWLSNLLAWLTRRASATDVSK

SEQ ID NO: 795544 - protein, 27 aa, Mycobacterium
ARVKVVVPIYPLLPFGTAADVVPEVAQ

SEQ ID NO: 795545 - protein, 22 aa, Mycobacterium
ARVLDALPDRYRLILESRFLRG

SEQ ID NO: 795546 - protein, 18 aa, Mycobacterium
ARVLFIENVGNLVCPALF

SEQ ID NO: 795547 - protein, 23 aa, Mycobacterium
ARVLHCAALRRLADKTQVVGPRE

SEQ ID NO: 795548 - protein, 22 aa, Mycobacterium
ARVLHSAAFRRLADKTQVVGPR

SEQ ID NO: 795549 - protein, 22 aa, Mycobacterium
ARVLHSAALRRLADKTQVVGPR

SEQ ID NO: 795550 - protein, 28 aa, Mycobacterium
ARVLLRECVEFFAPYLSAARLTGEVRKD

SEQ ID NO: 795551 - protein, 22 aa, Mycobacterium
ARVLPLLTVPHLDREFDYLVSA

SEQ ID NO: 795552 - protein, 17 aa, Mycobacterium
ARVLPQPVLQRLAALAA

SEQ ID NO: 795553 - protein, 26 aa, Mycobacterium
ARVLRRGGLLMVSTPNRITFSPGRDT

SEQ ID NO: 795554 - protein, 31 aa, Mycobacterium
ARVLTFLGRRQLFDPALLAQARVIAAEGGCD

SEQ ID NO: 795555 - protein, 17 aa, Mycobacterium
ARVLVEYAQQRAEWGWR

SEQ ID NO: 795556 - protein, 21 aa, Mycobacterium
ARVMSRFVDLFAAVRVRLREA

SEQ ID NO: 795557 - protein, 23 aa, Mycobacterium
ARVNRLARFLIAAGVGPEAVVGL

SEQ ID NO: 795558 - protein, 21 aa, Mycobacterium
ARVPFLRDVFGAEITTTGLLI

SEQ ID NO: 795559 - protein, 26 aa, Mycobacterium
ARVPTPIGAGLLAAAALIHCGRPDQQ

SEQ ID NO: 795560 - protein, 20 aa, Mycobacterium
ARVQLLRDLGSAAAPFNAFL

SEQ ID NO: 795561 - protein, 22 aa, Mycobacterium
ARVQLLRDLGSAAAPFNAFLIA

SEQ ID NO: 795562 - protein, 24 aa, Mycobacterium
ARVQLLRDLGSAAAPFNAFLVAQG

SEQ ID NO: 795563 - protein, 20 aa, Mycobacterium
ARVQLLRDLGSAASPFNAFL

SEQ ID NO: 795564 - protein, 24 aa, Mycobacterium
ARVQLLRDLGSAASPFNAFLVAQG

SEQ ID NO: 795565 - protein, 26 aa, Mycobacterium
ARVQRALYDAGWSRYGWPEHAGGLGG

SEQ ID NO: 795566 - protein, 20 aa, Mycobacterium
ARVRELLTVTSRWHSSPLDR

SEQ ID NO: 795567 - protein, 21 aa, Mycobacterium
ARVRFRHPLARSAAYRAAPLH

SEQ ID NO: 795568 - protein, 22 aa, Mycobacterium
ARVRMHHRWPIVMVDEFQDTDP

SEQ ID NO: 795569 - protein, 18 aa, Mycobacterium
ARVRQLATAGAFHTHFMA

SEQ ID NO: 795570 - protein, 27 aa, Mycobacterium
ARVRRRAELLIWLNPRAAQAEFRPLTG

SEQ ID NO: 795571 - protein, 24 aa, Mycobacterium
ARVRTLLVIIGERPGLSVADSLGI

SEQ ID NO: 795572 - protein, 23 aa, Mycobacterium
ARVRVRLLRELASTGESLVATHL

SEQ ID NO: 795573 - protein, 18 aa, Mycobacterium
ARVSLACALVGRPDLLVL

SEQ ID NO: 795574 - protein, 19 aa, Mycobacterium
ARVTALWAAKRAAAERAAG

SEQ ID NO: 795575 - protein, 33 aa, Mycobacterium
ARVTQWKNALLDLSLRNRLINFTDRAGFRIEIP

SEQ ID NO: 795576 - protein, 22 aa, Mycobacterium
ARVTRLAREFPLYAGLEDWSLA

SEQ ID NO: 795577 - protein, 26 aa, Mycobacterium
ARVTRRLVAMLARRGYSQTVACEVVI

SEQ ID NO: 795578 - protein, 26 aa, Mycobacterium
ARVVQAIFYNFASFRVRKSLDGAWDS

SEQ ID NO: 795579 - protein, 22 aa, Mycobacterium
ARVVYFGRSPLTAAVARFAREE

SEQ ID NO: 795580 - protein, 18 aa, Mycobacterium
ARVYLKREDLQIVRSYKL

SEQ ID NO: 795581 - protein, 19 aa, Mycobacterium
ARWAALAAGLPETVPAVTV

SEQ ID NO: 795582 - protein, 21 aa, Mycobacterium
ARWAHLLRDFPFEKSEVVRPA

SEQ ID NO: 795583 - protein, 19 aa, Mycobacterium
ARWFALLTDEKLRRGTHRS

SEQ ID NO: 795584 - protein, 25 aa, Mycobacterium
ARWGDGWVKLIGDWIDRGAGDLAPL

SEQ ID NO: 795585 - protein, 17 aa, Mycobacterium
ARWITELWNGRPVAAEL

SEQ ID NO: 795586 - protein, 17 aa, Mycobacterium
ARWLLHTATEYAKVREQ

SEQ ID NO: 795587 - protein, 18 aa, Mycobacterium
ARWMQLLGRHRGQISSAP

SEQ ID NO: 795588 - protein, 19 aa, Mycobacterium
ARWPFAVRKPRTGPPELLY

SEQ ID NO: 795589 - protein, 17 aa, Mycobacterium
ARWRAHLDGLDGPTLLA

SEQ ID NO: 795590 - protein, 18 aa, Mycobacterium
ARWRALGSALTFPADAPE

SEQ ID NO: 795591 - protein, 17 aa, Mycobacterium
ARWRRQPADVPALAKLQ

SEQ ID NO: 795592 - protein, 17 aa, Mycobacterium
ARWTAAGADTLVLQPPV

SEQ ID NO: 795593 - protein, 26 aa, Mycobacterium
ARWTVRVIVSLLMFPGQDEADERAML

SEQ ID NO: 795594 - protein, 33 aa, Mycobacterium
ARYAELIKRTQWWGRQMLIWGVHVHVGISSPNK

SEQ ID NO: 795595 - protein, 22 aa, Mycobacterium
ARYAHEWNQWSSPGTFREVSGR

SEQ ID NO: 795596 - protein, 18 aa, Mycobacterium
ARYAPLRHPGDAFAYDIF

SEQ ID NO: 795597 - protein, 30 aa, Mycobacterium
ARYCRYLDTKRWDDWRRLFTDDFVSDTSQS

SEQ ID NO: 795598 - protein, 25 aa, Mycobacterium
ARYELQLGPLLPRATRVVRETLIAT

SEQ ID NO: 795599 - protein, 19 aa, Mycobacterium
ARYFRVLTSWVGGGFTIAD

SEQ ID NO: 795600 - protein, 23 aa, Mycobacterium
ARYGGYLRASLPPFWATTDPERV

SEQ ID NO: 795601 - protein, 25 aa, Mycobacterium
ARYGSSVVGFLDGWRGLLEDRRVQL

SEQ ID NO: 795602 - protein, 21 aa, Mycobacterium
ARYGVPLPGRPAPLHPNPAGM

SEQ ID NO: 795603 - protein, 31 aa, Mycobacterium
ARYHGQLVGRAVDLVQLFPAAAYGKNGADIR

SEQ ID NO: 795604 - protein, 27 aa, Mycobacterium
ARYLDTGAMYRIATLAVLRAGADLTDP

SEQ ID NO: 795605 - protein, 26 aa, Mycobacterium
ARYNDITAWRWTELPAALGVPDALTF

SEQ ID NO: 795606 - protein, 25 aa, Mycobacterium
ARYPDALFPVWRYHPFFTDTDEPVD

SEQ ID NO: 795607 - protein, 34 aa, Mycobacterium
ARYQLLVQYPNVNPGLLLKCMLMAATEGIASGDT

SEQ ID NO: 795608 - protein, 30 aa, Mycobacterium
ASAAADIERIGALLTQGNAAAASPTINVAS

SEQ ID NO: 795609 - protein, 30 aa, Mycobacterium
ASAAALAPWQTVLQNLPGLSGVNLGIGNIG

SEQ ID NO: 795610 - protein, 25 aa, Mycobacterium
ASAAAMVSAPLFGAEPPRWAAAQIA

SEQ ID NO: 795611 - protein, 26 aa, Mycobacterium
ASAAASLLAPWQQVLRNLGIDIGKNG

SEQ ID NO: 795612 - protein, 26 aa, Mycobacterium
ASAAHTVLYTYLLGSISLDESRGKRQ

SEQ ID NO: 795613 - protein, 33 aa, Mycobacterium
ASAAISRLPLVPPLLEWLHAVRQPVVMDTAKAK

SEQ ID NO: 795614 - protein, 23 aa, Mycobacterium
ASAALPMPLMHTVDLNAGTMDTE

SEQ ID NO: 795615 - protein, 21 aa, Mycobacterium
ASAAMNLMRALTSSGLASLHL

SEQ ID NO: 795616 - protein, 35 aa, Mycobacterium
ASAASIADPLLAAINAPALALTGRPLIGNGANGTP

SEQ ID NO: 795617 - protein, 26 aa, Mycobacterium
ASAAVPAPLLRWGISHFDPDVRSPTV

SEQ ID NO: 795618 - protein, 24 aa, Mycobacterium
ASADAWLLTDVLRGQWGFRGTVVS

SEQ ID NO: 795619 - protein, 25 aa, Mycobacterium
ASADDRRYLLYSPLTKAKVTSEGER

SEQ ID NO: 795620 - protein, 19 aa, Mycobacterium
ASADPERLAFYLRLDPLTW

SEQ ID NO: 795621 - protein, 46 aa, Mycobacterium
ASAEATGAAPLQPVLDLINGPTQALLGRPLIGNGASGAPGTGQAGG

SEQ ID NO: 795622 - protein, 26 aa, Mycobacterium
ASAEDHPDLFWALRGGGGGNFGVTTA

SEQ ID NO: 795623 - protein, 33 aa, Mycobacterium
ASAELGYDGLLAPLTFICVFGYKAQSAFFKHAN

SEQ ID NO: 795624 - protein, 22 aa, Mycobacterium
ASAEYLAVLRRCGVAGVLSGAG

SEQ ID NO: 795625 - protein, 26 aa, Mycobacterium
ASAFEAARMAMIHPLAVAANRNVFVQ

SEQ ID NO: 795626 - protein, 20 aa, Mycobacterium
ASAFSAFAPPPQTTNPAGVA

SEQ ID NO: 795627 - protein, 24 aa, Mycobacterium
ASAGELTIWASTQTPHELRAFAAR

SEQ ID NO: 795628 - protein, 23 aa, Mycobacterium
ASAGFMLMKPLVETATAAGARAR

SEQ ID NO: 795629 - protein, 21 aa, Mycobacterium
ASAGFRYRWRRFRGASDPLTD

SEQ ID NO: 795630 - protein, 27 aa, Mycobacterium
ASAGHLMPFLTGTLRTAVPAPIRLSPP

SEQ ID NO: 795631 - protein, 23 aa, Mycobacterium
ASAGPLLDGVRWAERSNVWVGAR

SEQ ID NO: 795632 - protein, 25 aa, Mycobacterium
ASAGWRGFTMTPAGLRLLADLRRSL

SEQ ID NO: 795633 - protein, 25 aa, Mycobacterium
ASAHEWLRVLKRLQPRLYSISSSPK

SEQ ID NO: 795634 - protein, 35 aa, Mycobacterium
ASAHVRALFDLARLIEILLRWNLDDTTDGPRIKYP

SEQ ID NO: 795635 - protein, 26 aa, Mycobacterium
ASAKAIDDLVLIIGLIGVATVVGTRI

SEQ ID NO: 795636 - protein, 33 aa, Mycobacterium
ASALHRATRPGARWYIWCFAQGAVHGVPTPFQN

SEQ ID NO: 795637 - protein, 30 aa, Mycobacterium
ASALSDLELYLFFSLLFSAGAETTRNAVAG

SEQ ID NO: 795638 - protein, 21 aa, Mycobacterium
ASALSSRIADWEKESAEHHTE

SEQ ID NO: 795639 - protein, 22 aa, Mycobacterium
ASALTPFAPPPRTTNDSAGPAQ

SEQ ID NO: 795640 - protein, 22 aa, Mycobacterium
ASALTWMVERACQQNLPVKPPG

SEQ ID NO: 795641 - protein, 22 aa, Mycobacterium
ASALVDLHKAWVDQRATLHHQL

SEQ ID NO: 795642 - protein, 27 aa, Mycobacterium
ASAPNWGVPLFVGWRAMPLAEDSPARA

SEQ ID NO: 795643 - protein, 17 aa, Mycobacterium
ASAPVARVATVKAGLGG

SEQ ID NO: 795644 - protein, 20 aa, Mycobacterium
ASAPVFVTPGRFAGKVVVVT

SEQ ID NO: 795645 - protein, 23 aa, Mycobacterium
ASAPYVAWLRASAIRAERTASQA

SEQ ID NO: 795646 - protein, 23 aa, Mycobacterium
ASAQAILAVDLLGVALVLQEFGA

SEQ ID NO: 795647 - protein, 28 aa, Mycobacterium
ASAQAQSLGQRFAQALAAGAGSYSSAEA

SEQ ID NO: 795648 - protein, 29 aa, Mycobacterium
ASAQAQVFQRQFAQALAAGATSYAGAESA

SEQ ID NO: 795649 - protein, 35 aa, Mycobacterium
ASAQNLLDLINAPALALFGRPWIGNGADGGTVGGI

SEQ ID NO: 795650 - protein, 28 aa, Mycobacterium
ASAQTDWLDPLIALSFAAAATNRIELAT

SEQ ID NO: 795651 - protein, 21 aa, Mycobacterium
ASARFGLYYTPGSELYHDTLA

SEQ ID NO: 795652 - protein, 23 aa, Mycobacterium
ASARLAGLLIQRGLRPGDRVGVM

SEQ ID NO: 795653 - protein, 23 aa, Mycobacterium
ASARLFLHYGDLTDGTRLVTLLS

SEQ ID NO: 795654 - protein, 33 aa, Mycobacterium
ASARLFVASALAQAGLLLVVTATGREADDLTAE

SEQ ID NO: 795655 - protein, 21 aa, Mycobacterium
ASARMELVAAADLEISVDGST

SEQ ID NO: 795656 - protein, 23 aa, Mycobacterium
ASARRLQLDRIPLYQIHQPNPVV

SEQ ID NO: 795657 - protein, 20 aa, Mycobacterium
ASARVPLGLPLPGCEVRVVT

SEQ ID NO: 795658 - protein, 26 aa, Mycobacterium
ASARYLFEHYGLSSQYLVDNAAALCG

SEQ ID NO: 795659 - protein, 24 aa, Mycobacterium
ASASILAPIRYRALEAFAATSATV

SEQ ID NO: 795660 - protein, 28 aa, Mycobacterium
ASASPLFIPVDRLTGWAWVPLTTDTARN

SEQ ID NO: 795661 - protein, 24 aa, Mycobacterium
ASATDWWLGAERDSPRRLPSEKFV

SEQ ID NO: 795662 - protein, 26 aa, Mycobacterium
ASATETLMRLLIETAWDKANQNLQYW

SEQ ID NO: 795663 - protein, 20 aa, Mycobacterium
ASATFSARLVGAAGSAVAAV

SEQ ID NO: 795664 - protein, 18 aa, Mycobacterium
ASATPLPVIGVPVPLARL

SEQ ID NO: 795665 - protein, 24 aa, Mycobacterium
ASATRYEWVLADFAIMCAGGATTT

SEQ ID NO: 795666 - protein, 27 aa, Mycobacterium
ASAVAARLTPFQRMLQSLPGQVSASAP

SEQ ID NO: 795667 - protein, 23 aa, Mycobacterium
ASAVPLYVHAPYLINVASANNRI

SEQ ID NO: 795668 - protein, 28 aa, Mycobacterium
ASAVPRAWRELLHGWPGLDAAELAELAH

SEQ ID NO: 795669 - protein, 28 aa, Mycobacterium
ASAVPSQWRRLLHGWPGLRTRGLTALAD

SEQ ID NO: 795670 - protein, 27 aa, Mycobacterium
ASAVRREIGVPTVFNLLGPLTNPARPR

SEQ ID NO: 795671 - protein, 20 aa, Mycobacterium
ASAWARLDSSLPAPRHVVER

SEQ ID NO: 795672 - protein, 26 aa, Mycobacterium
ASAWDSLWVYDHFHTVPLPSDEATHE

SEQ ID NO: 795673 - protein, 27 aa, Mycobacterium
ASAWLDALVTWRRASGLPAAVINWGPW

SEQ ID NO: 795674 - protein, 19 aa, Mycobacterium
ASAWRFQRVPTPTLPETPI

SEQ ID NO: 795675 - protein, 19 aa, Mycobacterium
ASAWRNWNHQFDGIRTDTG

SEQ ID NO: 795676 - protein, 18 aa, Mycobacterium
ASAYPYVARVRYFAPEKV

SEQ ID NO: 795677 - protein, 24 aa, Mycobacterium
ASDAAAFFDYLAARPEVLGDRFGV

SEQ ID NO: 795678 - protein, 26 aa, Mycobacterium
ASDAADWFAGRLPEDWFEGAPAVVVD

SEQ ID NO: 795679 - protein, 25 aa, Mycobacterium
ASDAAGFKWLAPYTGSAIGQHWMYD

SEQ ID NO: 795680 - protein, 25 aa, Mycobacterium
ASDAAGFKWLAPYTGSAIGQHWMYN

SEQ ID NO: 795681 - protein, 27 aa, Mycobacterium
ASDAAGFKWLAPYTGSALGQHWMYQGK

SEQ ID NO: 795682 - protein, 22 aa, Mycobacterium
ASDAGCHVFIESSPHPVLTAAI

SEQ ID NO: 795683 - protein, 34 aa, Mycobacterium
ASDALRAVAAFRLALPRTMLRFAGGREITLGDLG

SEQ ID NO: 795684 - protein, 24 aa, Mycobacterium
ASDAQWLPAWESALARVSTAIDSG

SEQ ID NO: 795685 - protein, 17 aa, Mycobacterium
ASDFIDPLFSSGLAVTV

SEQ ID NO: 795686 - protein, 21 aa, Mycobacterium
ASDGFILVPHVTPGGLDPFVD

SEQ ID NO: 795687 - protein, 24 aa, Mycobacterium
ASDGGLWLAVMSPAALARVESVAA

SEQ ID NO: 795688 - protein, 34 aa, Mycobacterium
ASDGHPLMFAAQAWNYMFPLTDPPNYEPSPSDSI

SEQ ID NO: 795689 - protein, 17 aa, Mycobacterium
ASDIDRLEFLAAPGWTI

SEQ ID NO: 795690 - protein, 24 aa, Mycobacterium
ASDIRRWPLAASGTSIYWTGLNKG

SEQ ID NO: 795691 - protein, 35 aa, Mycobacterium
ASDKAARFLQLCDAFGLPVLSLVDCPGYMVGPAAE

SEQ ID NO: 795692 - protein, 33 aa, Mycobacterium
ASDKAARFLQLCDAFGLPVVSLIDCPGYMVGPA

SEQ ID NO: 795693 - protein, 25 aa, Mycobacterium
ASDKPPYSIVLPPPNVTGSLHMGHA

SEQ ID NO: 795694 - protein, 24 aa, Mycobacterium
ASDKPWFTYLCPGAGHAPHHVFKE

SEQ ID NO: 795695 - protein, 23 aa, Mycobacterium
ASDLAARLKAAWAPTGLVQRSQG

SEQ ID NO: 795696 - protein, 23 aa, Mycobacterium
ASDLALAVIRFARQLRSQRSDSK

SEQ ID NO: 795697 - protein, 36 aa, Mycobacterium
ASDLAWHKLSVQPYAAMFWHSFRAEIALACGNVAGA

SEQ ID NO: 795698 - protein, 25 aa, Mycobacterium
ASDLSLAVMRLARQLRFRNPSAPVS

SEQ ID NO: 795699 - protein, 24 aa, Mycobacterium
ASDLSLAVMRLARQLRFRNPSSPV

SEQ ID NO: 795700 - protein, 25 aa, Mycobacterium
ASDLSLAVMRLARQLRFRNPSSPVS

SEQ ID NO: 795701 - protein, 25 aa, Mycobacterium
ASDLSLVVIRLARHLRFRRADSPVS

SEQ ID NO: 795702 - protein, 29 aa, Mycobacterium
ASDNDPVWFWMYVIAALQKISPGVGTRAV

SEQ ID NO: 795703 - protein, 32 aa, Mycobacterium
ASDPGLYLIGKSFRFHPIELAAFMCALEAAVA

SEQ ID NO: 795704 - protein, 25 aa, Mycobacterium
ASDPIDPRWLLDTLGLTEVAQTTYR

SEQ ID NO: 795705 - protein, 28 aa, Mycobacterium
ASDPYGDVFLIIDGWPAFVSEFPDLEGQ

SEQ ID NO: 795706 - protein, 35 aa, Mycobacterium
ASDRGYPIREHLRRLVTGEILWAPAIDGAFVLTCR

SEQ ID NO: 795707 - protein, 24 aa, Mycobacterium
ASDRLEVLFGELAELAGQRNAIDG

SEQ ID NO: 795708 - protein, 29 aa, Mycobacterium
ASDRQRHRLALWARRLLGEAVTQAQYVLA

SEQ ID NO: 795709 - protein, 24 aa, Mycobacterium
ASDSAGFKWLAPYTGSAVAQHWMY

SEQ ID NO: 795710 - protein, 22 aa, Mycobacterium
ASDTAYPVLGGTSQAAGTARTA

SEQ ID NO: 795711 - protein, 26 aa, Mycobacterium
ASDTGLIMYSTTWCGYCRRLETQLKA

SEQ ID NO: 795712 - protein, 25 aa, Mycobacterium
ASDVASCLYGFSLLDIIDIADIADR

SEQ ID NO: 795713 - protein, 20 aa, Mycobacterium
ASDYAQWLPTADFPKLFINA

SEQ ID NO: 795714 - protein, 19 aa, Mycobacterium
ASDYLLLDMALRNHPHRVD

SEQ ID NO: 795715 - protein, 27 aa, Mycobacterium
ASEAEFRLTYPFSPVLVSTLRNLSSVM

SEQ ID NO: 795716 - protein, 24 aa, Mycobacterium
ASEALASFDAVLLGGGPLPATVAI

SEQ ID NO: 795717 - protein, 20 aa, Mycobacterium
ASEALYDWNYQRQLLAIRLA

SEQ ID NO: 795718 - protein, 21 aa, Mycobacterium
ASEALYDWNYQRQLLSIRLAE

SEQ ID NO: 795719 - protein, 24 aa, Mycobacterium
ASEANVIWKLRYTMRSQIFSRGLP

SEQ ID NO: 795720 - protein, 24 aa, Mycobacterium
ASEDVAVLKLSALRGLFSSVIEDQ

SEQ ID NO: 795721 - protein, 26 aa, Mycobacterium
ASEEQWWERSPIFSALNTNKLGITLD

SEQ ID NO: 795722 - protein, 24 aa, Mycobacterium
ASEFATEIAFREAALRGVDVVALH

SEQ ID NO: 795723 - protein, 25 aa, Mycobacterium
ASEFDIYLLDFPGYGLSDKPPEPYV

SEQ ID NO: 795724 - protein, 19 aa, Mycobacterium
ASELALLLNAWRQETNDVI

SEQ ID NO: 795725 - protein, 17 aa, Mycobacterium
ASELATAIAFDEASRRG

SEQ ID NO: 795726 - protein, 23 aa, Mycobacterium
ASELILPIAIAVQNLLSVNDLAQ

SEQ ID NO: 795727 - protein, 18 aa, Mycobacterium
ASELILPIAVAVQNRITV

SEQ ID NO: 795728 - protein, 25 aa, Mycobacterium
ASELVFTLPSYNLNLFLDGVIQAIN

SEQ ID NO: 795729 - protein, 29 aa, Mycobacterium
ASELVVVRPIGFEPLQWVRALAAEEPVPS

SEQ ID NO: 795730 - protein, 25 aa, Mycobacterium
ASEPGGPLLRPVRRAGPDHPGRPRA

SEQ ID NO: 795731 - protein, 20 aa, Mycobacterium
ASEPMREDIRLLGAILGDTV

SEQ ID NO: 795732 - protein, 28 aa, Mycobacterium
ASESAELPLFRYIGGPNAHILPVPMMNI

SEQ ID NO: 795733 - protein, 25 aa, Mycobacterium
ASESGQLLIAPRLDDRYATHGVIAT

SEQ ID NO: 795734 - protein, 24 aa, Mycobacterium
ASESPPIVLFTLQGMDNFQGMTRQ

SEQ ID NO: 795735 - protein, 25 aa, Mycobacterium
ASETGQLLIAPRLDDRYPTYGVLAK

SEQ ID NO: 795736 - protein, 17 aa, Mycobacterium
ASEWLRRKLARKEKVMG

SEQ ID NO: 795737 - protein, 34 aa, Mycobacterium
ASEWVPVHPGTDALLLFAILHTLAERGWIRRPPH

SEQ ID NO: 795738 - protein, 17 aa, Mycobacterium
ASFAHARSRLDEQWSQG

SEQ ID NO: 795739 - protein, 24 aa, Mycobacterium
ASFDKGELPLPPARKVAVVACMDA

SEQ ID NO: 795740 - protein, 17 aa, Mycobacterium
ASFLFLDPPDHTRLRGL

SEQ ID NO: 795741 - protein, 30 aa, Mycobacterium
ASFLVKDLHLPWQWGARWFLDQLVDGDIAN

SEQ ID NO: 795742 - protein, 17 aa, Mycobacterium
ASFMRYIDANRASWIVM

SEQ ID NO: 795743 - protein, 35 aa, Mycobacterium
ASFVNPHDIVLFPAWARRNPLSPSPLDPPSVPPAP

SEQ ID NO: 795744 - protein, 28 aa, Mycobacterium
ASFVNPHDIVLFPAWSRRMPFGPSELDP

SEQ ID NO: 795745 - protein, 40 aa, Mycobacterium
ASFVNPHDIVLFPAWVRRNPLKPSLLDPPPVHPAPTADED

SEQ ID NO: 795746 - protein, 30 aa, Mycobacterium
ASFVNPHDIVLFPAWVRRSPVEPSPLDPPA

SEQ ID NO: 795747 - protein, 17 aa, Mycobacterium
ASFYTAMYNAVKVPLGL

SEQ ID NO: 795748 - protein, 29 aa, Mycobacterium
ASGADPRYTLWQAWHASGLQRRWLAASER

SEQ ID NO: 795749 - protein, 25 aa, Mycobacterium
ASGAGNVVVYHWGSPKIVSAGTANV

SEQ ID NO: 795750 - protein, 24 aa, Mycobacterium
ASGAGWFMVQALTTRARVALAENE

SEQ ID NO: 795751 - protein, 26 aa, Mycobacterium
ASGALVPDLLWHARFPAPEEFSARVD

SEQ ID NO: 795752 - protein, 24 aa, Mycobacterium
ASGAMYADWCLLLARTDPNAPKRH

SEQ ID NO: 795753 - protein, 24 aa, Mycobacterium
ASGAWVGTRLAACPEALTSESTRR

SEQ ID NO: 795754 - protein, 18 aa, Mycobacterium
ASGELLPESVLGELRQHD

SEQ ID NO: 795755 - protein, 21 aa, Mycobacterium
ASGFFEAQAQMLSGLQGLIDT

SEQ ID NO: 795756 - protein, 32 aa, Mycobacterium
ASGGFVVPFIHPDLVWDFRLPRVVSINVSGHK

SEQ ID NO: 795757 - protein, 28 aa, Mycobacterium
ASGGFVVPFLHPELKWDFRLPRVVSINV

SEQ ID NO: 795758 - protein, 21 aa, Mycobacterium
ASGGPFRGWTAQQLTAVTPEQ

SEQ ID NO: 795759 - protein, 27 aa, Mycobacterium
ASGGWSVGAVALVAGWVARTSDPGARI

SEQ ID NO: 795760 - protein, 21 aa, Mycobacterium
ASGHEVFLIVPGAHTGQRRLD

SEQ ID NO: 795761 - protein, 27 aa, Mycobacterium
ASGIALSSYRFPTGWFIVAFASDLAPG

SEQ ID NO: 795762 - protein, 23 aa, Mycobacterium
ASGKLDLALVFNEGPDHSAAAVF

SEQ ID NO: 795763 - protein, 23 aa, Mycobacterium
ASGKLHIDVGFWGGAIPGNTGDL

SEQ ID NO: 795764 - protein, 34 aa, Mycobacterium
ASGKPLDHWDFYMALGYFKIAIIAAGIAYRARMG

SEQ ID NO: 795765 - protein, 23 aa, Mycobacterium
ASGKPPIYFGFGSMPVQSPADAV

SEQ ID NO: 795766 - protein, 30 aa, Mycobacterium
ASGKQRSRLALWSRRLFGEAITQAQYLLAD

SEQ ID NO: 795767 - protein, 23 aa, Mycobacterium
ASGKSLAYQLPVLAALAADPRAR

SEQ ID NO: 795768 - protein, 24 aa, Mycobacterium
ASGLASWQQALQGLAGPAASVIPG

SEQ ID NO: 795769 - protein, 26 aa, Mycobacterium
ASGLDARAYRLPWAAGTTVFEIDQPQ

SEQ ID NO: 795770 - protein, 27 aa, Mycobacterium
ASGLDARAYRLPWPADTVVYELDQPQV

SEQ ID NO: 795771 - protein, 27 aa, Mycobacterium
ASGLDARAYRLPWPAGTTVFEIDQPQV

SEQ ID NO: 795772 - protein, 26 aa, Mycobacterium
ASGLDARAYRLPWPAGTVVYELDQPR

SEQ ID NO: 795773 - protein, 27 aa, Mycobacterium
ASGLDARAYRLPWPDGTVVYEIDQPQV

SEQ ID NO: 795774 - protein, 27 aa, Mycobacterium
ASGLDARAYRLPWPPQTVVYEIDLPQV

SEQ ID NO: 795775 - protein, 26 aa, Mycobacterium
ASGLDARGYRLTWPEGMTLFEIDQPE

SEQ ID NO: 795776 - protein, 28 aa, Mycobacterium
ASGLDARPYRLPWPTGMRVYEIDQPEVI

SEQ ID NO: 795777 - protein, 26 aa, Mycobacterium
ASGLDSRAFRLPWPAGTVVYEIDQPL

SEQ ID NO: 795778 - protein, 26 aa, Mycobacterium
ASGLDSRAWRLPWPDGTVVYELDQPR

SEQ ID NO: 795779 - protein, 27 aa, Mycobacterium
ASGLDSRAYRLPWPAGTTVFEVDQPRV

SEQ ID NO: 795780 - protein, 27 aa, Mycobacterium
ASGLDSRAYRLPWPAGTVVYEVDMPEV

SEQ ID NO: 795781 - protein, 27 aa, Mycobacterium
ASGLDSRAYRLPWPDGTVVYEIDQPDV

SEQ ID NO: 795782 - protein, 26 aa, Mycobacterium
ASGLDSRAYRLPWPDGTVVYEIDQPR

SEQ ID NO: 795783 - protein, 27 aa, Mycobacterium
ASGLDSRAYRLWWPRGTTVYEIDRPQV

SEQ ID NO: 795784 - protein, 25 aa, Mycobacterium
ASGLDTRAYRLAWPPDMTVFEIDQP

SEQ ID NO: 795785 - protein, 26 aa, Mycobacterium
ASGLDTRAYRLHWPKGTTVFELDQPA

SEQ ID NO: 795786 - protein, 27 aa, Mycobacterium
ASGLDTRAYRLLWPAGTVVYEIDQPEV

SEQ ID NO: 795787 - protein, 26 aa, Mycobacterium
ASGLDTRAYRLNWPSGMTVYEIDQPQ

SEQ ID NO: 795788 - protein, 26 aa, Mycobacterium
ASGLDTRAYRLPWPGGTTVYEIDQPQ

SEQ ID NO: 795789 - protein, 25 aa, Mycobacterium
ASGLDTRAYRLTWPAGTTVYELDQP

SEQ ID NO: 795790 - protein, 19 aa, Mycobacterium
ASGLLPPLSDPPPPTDDEL

SEQ ID NO: 795791 - protein, 39 aa, Mycobacterium
ASGLMRYALPGYVPMPVVPLLPIVPLDRRLCIPLVHADD

SEQ ID NO: 795792 - protein, 23 aa, Mycobacterium
ASGLRHLNGFPGGPPPRMALSIG

SEQ ID NO: 795793 - protein, 27 aa, Mycobacterium
ASGLRHMNGFPGGPPPRLALSLGDSLA

SEQ ID NO: 795794 - protein, 28 aa, Mycobacterium
ASGLRHMNGFPGGPPPRLALSLGDSLAG

SEQ ID NO: 795795 - protein, 25 aa, Mycobacterium
ASGLRPFDVQLLGALRMLAGDVIEM

SEQ ID NO: 795796 - protein, 19 aa, Mycobacterium
ASGMFEWRAPFGAMSAANW

SEQ ID NO: 795797 - protein, 32 aa, Mycobacterium
ASGPFDVRIWLDPVCPFSWNTARWLDAVAIGS

SEQ ID NO: 795798 - protein, 20 aa, Mycobacterium
ASGPLYPVSVVLAALVECAD

SEQ ID NO: 795799 - protein, 22 aa, Mycobacterium
ASGPRIRLAYQLTPRSVRGEQR

SEQ ID NO: 795800 - protein, 24 aa, Mycobacterium
ASGPVHLVALPRFPEPGSAVEQGS

SEQ ID NO: 795801 - protein, 19 aa, Mycobacterium
ASGRISYALGLRGPAVSLD

SEQ ID NO: 795802 - protein, 18 aa, Mycobacterium
ASGRISYCLGLAGPAISV

SEQ ID NO: 795803 - protein, 23 aa, Mycobacterium
ASGRPAPHLATRQLERLRAEGVL

SEQ ID NO: 795804 - protein, 32 aa, Mycobacterium
ASGRTFAPFKPKPLFYRQPIYYMSNHLSFVPS

SEQ ID NO: 795805 - protein, 23 aa, Mycobacterium
ASGRTITFAGFLKAYVETVDELA

SEQ ID NO: 795806 - protein, 25 aa, Mycobacterium
ASGRTLTSYPSLRTDLRNAGATVVD

SEQ ID NO: 795807 - protein, 22 aa, Mycobacterium
ASGRWVPDFLSLPIAVDNSLKN

SEQ ID NO: 795808 - protein, 28 aa, Mycobacterium
ASGRYPQRLPGNAHFTFRGCEGDALLML

SEQ ID NO: 795809 - protein, 24 aa, Mycobacterium
ASGRYTLLDPYRGAQLALAEAYRN

SEQ ID NO: 795810 - protein, 36 aa, Mycobacterium
ASGSPLLGLMLPYSPIHHLLLAPVPGADAAAPEALV

SEQ ID NO: 795811 - protein, 26 aa, Mycobacterium
ASGSTSPLHILQQQTLNAINAPFDAL

SEQ ID NO: 795812 - protein, 22 aa, Mycobacterium
ASGTAITTIAAGSTGRAVGTTE

SEQ ID NO: 795813 - protein, 24 aa, Mycobacterium
ASGTPPIFFGFGSLPVESADQTFA

SEQ ID NO: 795814 - protein, 21 aa, Mycobacterium
ASGTPPIYFGFGSMPVESPAA

SEQ ID NO: 795815 - protein, 26 aa, Mycobacterium
ASGVASLLDWPMARWIEFFDANHAAQ

SEQ ID NO: 795816 - protein, 23 aa, Mycobacterium
ASGVHAILIPEIPFSLEPVAAVI

SEQ ID NO: 795817 - protein, 22 aa, Mycobacterium
ASGVSWLTGYPDRTPYDPYSIG

SEQ ID NO: 795818 - protein, 20 aa, Mycobacterium
ASGWQIAAGGLVRFAARPLQ

SEQ ID NO: 795819 - protein, 17 aa, Mycobacterium
ASGYWRKSPEEQRCFGA

SEQ ID NO: 795820 - protein, 24 aa, Mycobacterium
ASHHGMWDLALLTNVPGLRVACPR

SEQ ID NO: 795821 - protein, 23 aa, Mycobacterium
ASHHPIIDPILPDLRSALADLTP

SEQ ID NO: 795822 - protein, 25 aa, Mycobacterium
ASHNGMWDLSILGIIPGIRVAAPRD

SEQ ID NO: 795823 - protein, 25 aa, Mycobacterium
ASHPDGYDGGFLYGSGGSGYNSATS

SEQ ID NO: 795824 - protein, 31 aa, Mycobacterium
ASHPIGSPAYLPFFPELARTGLHVIGCANRY

SEQ ID NO: 795825 - protein, 29 aa, Mycobacterium
ASHRIRVMTIAPGLFDTPLLASLPEEARA

SEQ ID NO: 795826 - protein, 21 aa, Mycobacterium
ASHVARISRLRHPDCAVPADV

SEQ ID NO: 795827 - protein, 20 aa, Mycobacterium
ASHVELYWTMPEFGSLMEKL

SEQ ID NO: 795828 - protein, 20 aa, Mycobacterium
ASHVLETWAHVLDLLERDPM

SEQ ID NO: 795829 - protein, 21 aa, Mycobacterium
ASHVSAPILAGAFAVAWEWEN

SEQ ID NO: 795830 - protein, 21 aa, Mycobacterium
ASHYGIYLITGGPGAGKSALL

SEQ ID NO: 795831 - protein, 23 aa, Mycobacterium
ASIAPKVLILNKADLTDPGAARG

SEQ ID NO: 795832 - protein, 33 aa, Mycobacterium
ASIAYWRLTGAAAAARNLLAVQGAGAALAAGAS

SEQ ID NO: 795833 - protein, 19 aa, Mycobacterium
ASIFAWTRGLQHRGKLDDT

SEQ ID NO: 795834 - protein, 23 aa, Mycobacterium
ASIFDAHQLLLDDDALLGAARAR

SEQ ID NO: 795835 - protein, 19 aa, Mycobacterium
ASIFHWWTYADMARDTGAT

SEQ ID NO: 795836 - protein, 32 aa, Mycobacterium
ASIFNRELEYLFPRSWLFVGHASQVSAPGQFF

SEQ ID NO: 795837 - protein, 31 aa, Mycobacterium
ASIGFPSHHPPMRTFLGVPVRVRDVSLGTLY

SEQ ID NO: 795838 - protein, 18 aa, Mycobacterium
ASIHHQPLREALAKARRL

SEQ ID NO: 795839 - protein, 17 aa, Mycobacterium
ASIIAFGSPVDTLAALP

SEQ ID NO: 795840 - protein, 22 aa, Mycobacterium
ASIKVLAHLLAAAEATTMTPAR

SEQ ID NO: 795841 - protein, 28 aa, Mycobacterium
ASILPEVSLPPWLATNLANWNTIMATLT

SEQ ID NO: 795842 - protein, 17 aa, Mycobacterium
ASIMSWQGWEQMFESAR

SEQ ID NO: 795843 - protein, 26 aa, Mycobacterium
ASIPNFLPLLAERFARQRLRALAKIE

SEQ ID NO: 795844 - protein, 27 aa, Mycobacterium
ASIPVKRLRQAGVLELLLALANETGGN

SEQ ID NO: 795845 - protein, 25 aa, Mycobacterium
ASIRGLVGMIPPGRPFAEVAAELNA

SEQ ID NO: 795846 - protein, 24 aa, Mycobacterium
ASITAYDRVVWVAGGLLKGASVDE

SEQ ID NO: 795847 - protein, 30 aa, Mycobacterium
ASIVDKVVPDFLWINGEYTARVSLNALERN

SEQ ID NO: 795848 - protein, 31 aa, Mycobacterium
ASIWEKWIELSPRYFAFWNKWDPGAISSQHG

SEQ ID NO: 795849 - protein, 17 aa, Mycobacterium
ASKAAPVAARRGDRRKV

SEQ ID NO: 795850 - protein, 18 aa, Mycobacterium
ASKFIKKALTGEGLPLMR

SEQ ID NO: 795851 - protein, 25 aa, Mycobacterium
ASKHALVGLMRVYANLLAPHSIRVN

SEQ ID NO: 795852 - protein, 21 aa, Mycobacterium
ASKIMPVAPFPAVVRQRARAS

SEQ ID NO: 795853 - protein, 21 aa, Mycobacterium
ASKISALRWGGATEPRVVFLH

SEQ ID NO: 795854 - protein, 23 aa, Mycobacterium
ASKLDRFIGLVAIDRGHPRVADR

SEQ ID NO: 795855 - protein, 18 aa, Mycobacterium
ASKLPVMELYRQGISMRE

SEQ ID NO: 795856 - protein, 19 aa, Mycobacterium
ASKRIAPIVVLTAFSQRDL

SEQ ID NO: 795857 - protein, 29 aa, Mycobacterium
ASKSLAPGLRLGWLALPAALVDGVVETKR

SEQ ID NO: 795858 - protein, 24 aa, Mycobacterium
ASLAARYGATLRITRLRPSGRGAD

SEQ ID NO: 795859 - protein, 24 aa, Mycobacterium
ASLADIFVTLFLGAQLIVPKPDAF

SEQ ID NO: 795860 - protein, 22 aa, Mycobacterium
ASLAKMTLALANDKLPPSINYA

SEQ ID NO: 795861 - protein, 23 aa, Mycobacterium
ASLAQLWRSCGVLPDLSIGHSLG

SEQ ID NO: 795862 - protein, 27 aa, Mycobacterium
ASLDAVTKYPWFRGAGRRKFGFYDEDR

SEQ ID NO: 795863 - protein, 24 aa, Mycobacterium
ASLDGALVVLDWAPHRPNGPLPNL

SEQ ID NO: 795864 - protein, 17 aa, Mycobacterium
ASLDLAKHRKLLGDWLA

SEQ ID NO: 795865 - protein, 18 aa, Mycobacterium
ASLEGKALEPWVRALHGC

SEQ ID NO: 795866 - protein, 22 aa, Mycobacterium
ASLEPRWFAWVDDMRDWTISRQ

SEQ ID NO: 795867 - protein, 21 aa, Mycobacterium
ASLESWIYITCHYKAVRPRPR

SEQ ID NO: 795868 - protein, 30 aa, Mycobacterium
ASLESYARYWREAFRLPSMNLRKVAAQIDS

SEQ ID NO: 795869 - protein, 18 aa, Mycobacterium
ASLFHWINYSVTAYQTGA

SEQ ID NO: 795870 - protein, 42 aa, Mycobacterium
ASLFSGHALDYQNLGARMTAFHDQFVAALTAGGGLYSSAEAA

SEQ ID NO: 795871 - protein, 22 aa, Mycobacterium
ASLFSLPNPLAVSYYLGKGAVQ

SEQ ID NO: 795872 - protein, 40 aa, Mycobacterium
ASLGAAVAARPAGSAIAVVARRAGSGPGVTACPAGPAVTA

SEQ ID NO: 795873 - protein, 18 aa, Mycobacterium
ASLGCRFATAFRALVNHG

SEQ ID NO: 795874 - protein, 31 aa, Mycobacterium
ASLGDLVSRELTWIGSFRFVDEITDAVAALN

SEQ ID NO: 795875 - protein, 32 aa, Mycobacterium
ASLGLPSHGLPWYPLLRLPVNLARSAAALTLP

SEQ ID NO: 795876 - protein, 24 aa, Mycobacterium
ASLHAGHLVPLLALRRFQRAGHRP

SEQ ID NO: 795877 - protein, 20 aa, Mycobacterium
ASLHAGHLVPLLTLSRFQRA

SEQ ID NO: 795878 - protein, 18 aa, Mycobacterium
ASLIGDLVRRCRLVMAGE

SEQ ID NO: 795879 - protein, 21 aa, Mycobacterium
ASLIRARRAFRYLPSAPRCKL

SEQ ID NO: 795880 - protein, 24 aa, Mycobacterium
ASLKRSRFFAGLDDDALVAVAAKI

SEQ ID NO: 795881 - protein, 17 aa, Mycobacterium
ASLKYLEVLCSLYTRVV

SEQ ID NO: 795882 - protein, 22 aa, Mycobacterium
ASLLLNRIVLQPGEGLYLPAGN

SEQ ID NO: 795883 - protein, 33 aa, Mycobacterium
ASLLRELNLMTTKPFLYVFNADESVLTDDARKA

SEQ ID NO: 795884 - protein, 17 aa, Mycobacterium
ASLLRFAGGLHIVAGRV

SEQ ID NO: 795885 - protein, 17 aa, Mycobacterium
ASLLRFAGGLHIVSGRV

SEQ ID NO: 795886 - protein, 20 aa, Mycobacterium
ASLLVLPVAIDSGEAWVVLR

SEQ ID NO: 795887 - protein, 25 aa, Mycobacterium
ASLMRVSKMTVYRLVHNGELPAVRV

SEQ ID NO: 795888 - protein, 26 aa, Mycobacterium
ASLMTCEPLRYRPQWAAFGRAPADVS

SEQ ID NO: 795889 - protein, 25 aa, Mycobacterium
ASLPDGALMRRAAYGLATEIIRELT

SEQ ID NO: 795890 - protein, 17 aa, Mycobacterium
ASLPKLPTFTLTSQSVT

SEQ ID NO: 795891 - protein, 24 aa, Mycobacterium
ASLRAGIPTLALWSSADQPYWAAQ

SEQ ID NO: 795892 - protein, 25 aa, Mycobacterium
ASLRAGVPTLILWSSADQPYWGNQL

SEQ ID NO: 795893 - protein, 25 aa, Mycobacterium
ASLRAGVPTLILWSSADQPYWGNQV

SEQ ID NO: 795894 - protein, 27 aa, Mycobacterium
ASLRAGVPTLILWSTADQPYWGNQLKR

SEQ ID NO: 795895 - protein, 28 aa, Mycobacterium
ASLRAGVPTLILWTVGDQPFWGNQLRRM

SEQ ID NO: 795896 - protein, 38 aa, Mycobacterium
ASLRAGVPTLTLWTAGDQPFWGAQLKKLKVGASRRFSA

SEQ ID NO: 795897 - protein, 22 aa, Mycobacterium
ASLREHTWKRSSFSGAEIFGKT

SEQ ID NO: 795898 - protein, 20 aa, Mycobacterium
ASLREHTWKRSSFSGTEIFG

SEQ ID NO: 795899 - protein, 24 aa, Mycobacterium
ASLRGLIEYVTALQLPPVSAEPVS

SEQ ID NO: 795900 - protein, 19 aa, Mycobacterium
ASLRLLGRGGRFIEMGKTD

SEQ ID NO: 795901 - protein, 32 aa, Mycobacterium
ASLRQLRTDYLDLLFLHVWDFATPVEEILRGM

SEQ ID NO: 795902 - protein, 18 aa, Mycobacterium
ASLRSRRRGRGLTLIGGL

SEQ ID NO: 795903 - protein, 18 aa, Mycobacterium
ASLRTEQRWLGRIAPQLP

SEQ ID NO: 795904 - protein, 19 aa, Mycobacterium
ASLSQVLPPYMVPAAFIEI

SEQ ID NO: 795905 - protein, 26 aa, Mycobacterium
ASLTFPAVMALLVQKEFFRTYDVGME

SEQ ID NO: 795906 - protein, 24 aa, Mycobacterium
ASLTINKMCLSGIDAIALADQLIR

SEQ ID NO: 795907 - protein, 17 aa, Mycobacterium
ASLTRLGPLPPLRMQPG

SEQ ID NO: 795908 - protein, 21 aa, Mycobacterium
ASLVDALRPHWDNLLLLVTSD

SEQ ID NO: 795909 - protein, 40 aa, Mycobacterium
ASLVGPLSVPPSWAPPAPVASPLPSALGGTPMVAPPPAMA

SEQ ID NO: 795910 - protein, 29 aa, Mycobacterium
ASLVVGPAAWWHGWERTDWDRLAGAVVAG

SEQ ID NO: 795911 - protein, 21 aa, Mycobacterium
ASLYNYFPNKAELMKAAIAAR

SEQ ID NO: 795912 - protein, 27 aa, Mycobacterium
ASLYTALKPLLQFIVAGGLPTTVKAGL

SEQ ID NO: 795913 - protein, 17 aa, Mycobacterium
ASMAFLDRLAGFGEVEV

SEQ ID NO: 795914 - protein, 26 aa, Mycobacterium
ASMDQQKEWILHMAKLSASLAKQANF

SEQ ID NO: 795915 - protein, 18 aa, Mycobacterium
ASMKAALHRFTQGVAAEL

SEQ ID NO: 795916 - protein, 26 aa, Mycobacterium
ASMLSAVMPYVNWLGVLAAQAEETAG

SEQ ID NO: 795917 - protein, 45 aa, Mycobacterium
ASMQRQPMAWAGPLFRFALFRTSPNQFFLFFCLHHIVVDGFSSVL

SEQ ID NO: 795918 - protein, 26 aa, Mycobacterium
ASMSALRAVPLVPGYGAAKAGIICVT

SEQ ID NO: 795919 - protein, 26 aa, Mycobacterium
ASMSMAAAVMPYIAWMTATAEQCQQA

SEQ ID NO: 795920 - protein, 24 aa, Mycobacterium
ASMSVVTPWLLAEPDRFAVLHGDY

SEQ ID NO: 795921 - protein, 19 aa, Mycobacterium
ASMVLYLFGSKEALFRESL

SEQ ID NO: 795922 - protein, 23 aa, Mycobacterium
ASNAAVCWAARDAALRHVPLTVV

SEQ ID NO: 795923 - protein, 30 aa, Mycobacterium
ASNEYPVGFAWAMCTPFQFTKQFASHFGGT

SEQ ID NO: 795924 - protein, 33 aa, Mycobacterium
ASNEYPVGFAWAMCTPFQFTKQFASHFGGTRNP

SEQ ID NO: 795925 - protein, 24 aa, Mycobacterium
ASNGPPPAARWARRKPEAAARLEA

SEQ ID NO: 795926 - protein, 18 aa, Mycobacterium
ASNGWLAPLPPEGASAIV

SEQ ID NO: 795927 - protein, 27 aa, Mycobacterium
ASNIKCLCRFHHLIKTFWAGFVDTQLP

SEQ ID NO: 795928 - protein, 18 aa, Mycobacterium
ASNLDWTVLGPSRLTMEP

SEQ ID NO: 795929 - protein, 21 aa, Mycobacterium
ASNLGWGFGLQAAAAPGGVAQ

SEQ ID NO: 795930 - protein, 32 aa, Mycobacterium
ASNLKCLCRFHHLLKTFWTGPGGWHDRQDPDG

SEQ ID NO: 795931 - protein, 32 aa, Mycobacterium
ASNLKCLCRFHHLLKTFWTGPGGWHDRQHPDG

SEQ ID NO: 795932 - protein, 31 aa, Mycobacterium
ASNLKCLCRFHHLLKTFWTGRGGWHDRQHPD

SEQ ID NO: 795933 - protein, 27 aa, Mycobacterium
ASNPVPFVDPEFDPWPVYPERDSTPPP

SEQ ID NO: 795934 - protein, 18 aa, Mycobacterium
ASNRLAHLLAGHGVGPGG

SEQ ID NO: 795935 - protein, 25 aa, Mycobacterium
ASNRVRPIIGSRLPIGQAAQAHQLL

SEQ ID NO: 795936 - protein, 29 aa, Mycobacterium
ASNTLARYKLPKAIVFRPVIERSPSGKAD

SEQ ID NO: 795937 - protein, 27 aa, Mycobacterium
ASPAMIWSMAQAAWPRSRSWPSISRAR

SEQ ID NO: 795938 - protein, 25 aa, Mycobacterium
ASPAYLGFNLFQHAIARAVIHGIYE

SEQ ID NO: 795939 - protein, 28 aa, Mycobacterium
ASPDVLALRLRVIELLISSRRFAEALNH

SEQ ID NO: 795940 - protein, 24 aa, Mycobacterium
ASPDYLTLDLVCAYLGLVSVPLQH

SEQ ID NO: 795941 - protein, 32 aa, Mycobacterium
ASPEAVFSVGLFEPPLLGLTIRGIIEGDADPQ

SEQ ID NO: 795942 - protein, 27 aa, Mycobacterium
ASPGLYLIGMPFLRRRKSTLIDGAAAD

SEQ ID NO: 795943 - protein, 23 aa, Mycobacterium
ASPGQAAVFDPATRQLAVLSTDA

SEQ ID NO: 795944 - protein, 21 aa, Mycobacterium
ASPGYFNSTVLPSSGLFNAGT

SEQ ID NO: 795945 - protein, 20 aa, Mycobacterium
ASPHLPIGHLPLGAGEALVV

SEQ ID NO: 795946 - protein, 17 aa, Mycobacterium
ASPHSHILVLSASAERE

SEQ ID NO: 795947 - protein, 24 aa, Mycobacterium
ASPISYVHPDAPPFFVLHGEKDEL

SEQ ID NO: 795948 - protein, 26 aa, Mycobacterium
ASPKETWLRLLLIDAGFPAPETQIPV

SEQ ID NO: 795949 - protein, 18 aa, Mycobacterium
ASPKPLRPKVRGPISFDA

SEQ ID NO: 795950 - protein, 36 aa, Mycobacterium
ASPLAGEPPVLRLFGDLLYLDRYWREEQQVCTDVQA

SEQ ID NO: 795951 - protein, 37 aa, Mycobacterium
ASPLDQLMGVVNAPAQALLGRPLIGNGANGADGTGAA

SEQ ID NO: 795952 - protein, 24 aa, Mycobacterium
ASPLIALLEVSGAVLSWVIDDPRG

SEQ ID NO: 795953 - protein, 17 aa, Mycobacterium
ASPLLKQVFSLIDGRCL

SEQ ID NO: 795954 - protein, 21 aa, Mycobacterium
ASPLQAIEQQLLAAINAPTQT

SEQ ID NO: 795955 - protein, 22 aa, Mycobacterium
ASPLQSLEQQLLAAINAPTQTL

SEQ ID NO: 795956 - protein, 17 aa, Mycobacterium
ASPLQTLEQQLLGVINA

SEQ ID NO: 795957 - protein, 31 aa, Mycobacterium
ASPNHAYHQVPLGTFLWLTKKHLGAHIEDET

SEQ ID NO: 795958 - protein, 23 aa, Mycobacterium
ASPPAPIYGIYGPTGNYVPPGGQ

SEQ ID NO: 795959 - protein, 26 aa, Mycobacterium
ASPPLPPFPPMNPLPPLPPAPAVAVP

SEQ ID NO: 795960 - protein, 20 aa, Mycobacterium
ASPPMLGFGGGLHYCLGVHL

SEQ ID NO: 795961 - protein, 27 aa, Mycobacterium
ASPSRAFWLDRLQGFQTLRFAGDRLQH

SEQ ID NO: 795962 - protein, 30 aa, Mycobacterium
ASPVLHAINYLLGWLDEKYLTTLRDFGGLQ

SEQ ID NO: 795963 - protein, 36 aa, Mycobacterium
ASPVPAILTMKLMGLPLDNWHLYANLFHSVMAVPQD

SEQ ID NO: 795964 - protein, 37 aa, Mycobacterium
ASPVPAILTMKLMGLPYDNWHLYANLFHSVMAVPQDS

SEQ ID NO: 795965 - protein, 22 aa, Mycobacterium
ASPVRYVILTQGHVDHVGGLDS

SEQ ID NO: 795966 - protein, 37 aa, Mycobacterium
ASQADHVLLFPFAAGVPTWWRTMEAKVAKLSNLSVVQ

SEQ ID NO: 795967 - protein, 23 aa, Mycobacterium
ASQADVIWKLRYTMRSQIFSRGL

SEQ ID NO: 795968 - protein, 33 aa, Mycobacterium
ASQAEQVLLFPFAAGVATWWRTAGPKVAGLSNL

SEQ ID NO: 795969 - protein, 24 aa, Mycobacterium
ASQHHLWTAWVDGRPFITLHELYS

SEQ ID NO: 795970 - protein, 17 aa, Mycobacterium
ASQLGNVLGGGGSPTGG

SEQ ID NO: 795971 - protein, 17 aa, Mycobacterium
ASQLHEVGIALMAEFDS

SEQ ID NO: 795972 - protein, 20 aa, Mycobacterium
ASQLRYWEKALDGVKLLNLP

SEQ ID NO: 795973 - protein, 17 aa, Mycobacterium
ASQLVGLGIMRYGIRSE

SEQ ID NO: 795974 - protein, 23 aa, Mycobacterium
ASQMAVLGVWQPGAPAAGLVGLK

SEQ ID NO: 795975 - protein, 22 aa, Mycobacterium
ASQQYIAIAAYFDDADLPQLAA

SEQ ID NO: 795976 - protein, 25 aa, Mycobacterium
ASQSFLAMDPPRHTKLRKLVSAAFT

SEQ ID NO: 795977 - protein, 25 aa, Mycobacterium
ASQSGLTLVAFLRGESMNVYTRPDR

SEQ ID NO: 795978 - protein, 27 aa, Mycobacterium
ASQSISPLTLRQALLGKVLTVGDAVSL

SEQ ID NO: 795979 - protein, 24 aa, Mycobacterium
ASQTFRSWFASRPASPAAGDEVLL

SEQ ID NO: 795980 - protein, 20 aa, Mycobacterium
ASQVALQLGLPAPAPQSADE

SEQ ID NO: 795981 - protein, 27 aa, Mycobacterium
ASQWAADLKARPLVRYTVRTGADGRVR

SEQ ID NO: 795982 - protein, 25 aa, Mycobacterium
ASQYKDVILGLVFLKFVSDARDGRK

SEQ ID NO: 795983 - protein, 27 aa, Mycobacterium
ASRADRERYLSSGLLPVDCRFCHVTVT

SEQ ID NO: 795984 - protein, 19 aa, Mycobacterium
ASRADRERYLTGGLQPVDC

SEQ ID NO: 795985 - protein, 17 aa, Mycobacterium
ASRAEHRLFDRSSTHDW

SEQ ID NO: 795986 - protein, 17 aa, Mycobacterium
ASRALALGFDALATGHY

SEQ ID NO: 795987 - protein, 17 aa, Mycobacterium
ASRALAMAVQWARERHQ

SEQ ID NO: 795988 - protein, 35 aa, Mycobacterium
ASRALFPQWDTTTAALPPPPTPPPPMTPSEIAARA

SEQ ID NO: 795989 - protein, 19 aa, Mycobacterium
ASRALIRTGFLAGDGLRKL

SEQ ID NO: 795990 - protein, 22 aa, Mycobacterium
ASRARKAPGFALLGEAGAEVDL

SEQ ID NO: 795991 - protein, 17 aa, Mycobacterium
ASRARKAPGFALLGEPG

SEQ ID NO: 795992 - protein, 28 aa, Mycobacterium
ASRDKFPRAILNRTFDYGFATGLMVKDV

SEQ ID NO: 795993 - protein, 24 aa, Mycobacterium
ASRDTVTSLKWTLTGLKSRIAVGR

SEQ ID NO: 795994 - protein, 28 aa, Mycobacterium
ASRFAVRAFDWLTWRLSKKLEDAQRGEL

SEQ ID NO: 795995 - protein, 23 aa, Mycobacterium
ASRFGIQDAIWRGVYYTPEGARS

SEQ ID NO: 795996 - protein, 22 aa, Mycobacterium
ASRFTGKFWKLLGAATDKNQSQ

SEQ ID NO: 795997 - protein, 19 aa, Mycobacterium
ASRFVACPFGAPGARMYRT

SEQ ID NO: 795998 - protein, 18 aa, Mycobacterium
ASRFVACPFGAPGSRMYR

SEQ ID NO: 795999 - protein, 19 aa, Mycobacterium
ASRFVACPFGAPGSRMYRT

SEQ ID NO: 796000 - protein, 21 aa, Mycobacterium
ASRGFPNQFFTGFTQVGISAN

SEQ ID NO: 796001 - protein, 28 aa, Mycobacterium
ASRITTPLLPDDYLQLANPLWSARELRG

SEQ ID NO: 796002 - protein, 23 aa, Mycobacterium
ASRLLPNLVTVLGWRSCDHTGPV

SEQ ID NO: 796003 - protein, 17 aa, Mycobacterium
ASRLQVPKARRTLPSVL

SEQ ID NO: 796004 - protein, 22 aa, Mycobacterium
ASRLVSLLGPEAVRLIAETFAQ

SEQ ID NO: 796005 - protein, 17 aa, Mycobacterium
ASRLWVDGLRDGHIEWM

SEQ ID NO: 796006 - protein, 20 aa, Mycobacterium
ASRMLVAGAALRVPLIAVIL

SEQ ID NO: 796007 - protein, 17 aa, Mycobacterium
ASRMTESGLAEEIFVIA

SEQ ID NO: 796008 - protein, 17 aa, Mycobacterium
ASRNRLPRIRCRGGIAA

SEQ ID NO: 796009 - protein, 24 aa, Mycobacterium
ASRPRFQRLWGTPYNFQKVTCTWD

SEQ ID NO: 796010 - protein, 24 aa, Mycobacterium
ASRPRLAAPKPPVPGRKPKPTLAV

SEQ ID NO: 796011 - protein, 23 aa, Mycobacterium
ASRRALLEVPRLGPKAFEQCAGF

SEQ ID NO: 796012 - protein, 21 aa, Mycobacterium
ASRRQWPGGGPLLGPSDFSPL

SEQ ID NO: 796013 - protein, 17 aa, Mycobacterium
ASRRVVLDHAVVGTHNL

SEQ ID NO: 796014 - protein, 19 aa, Mycobacterium
ASRSLHRSRRRFFHSGPVA

SEQ ID NO: 796015 - protein, 17 aa, Mycobacterium
ASRSRLGLAQFAAPRPG

SEQ ID NO: 796016 - protein, 19 aa, Mycobacterium
ASRSVTLSGFIDLLGDLPD

SEQ ID NO: 796017 - protein, 20 aa, Mycobacterium
ASRTLLRVLGIDPPRERLDV

SEQ ID NO: 796018 - protein, 25 aa, Mycobacterium
ASRYVPTEVKVYPGWPSFEAHGGYF

SEQ ID NO: 796019 - protein, 24 aa, Mycobacterium
ASSAPPWLVDRALRHLLTDITGNT

SEQ ID NO: 796020 - protein, 28 aa, Mycobacterium
ASSCQSVIWGLAFGQWVGASASLMGAAA

SEQ ID NO: 796021 - protein, 23 aa, Mycobacterium
ASSIGFIAPIPDATNSAISDAVH

SEQ ID NO: 796022 - protein, 25 aa, Mycobacterium
ASSKMGLIALTMNLSRRWANDGIRV

SEQ ID NO: 796023 - protein, 37 aa, Mycobacterium
ASSMMSMFTFTELIWAEFWVDFPELKFSLTEGDVGWI

SEQ ID NO: 796024 - protein, 23 aa, Mycobacterium
ASSPAWVTLLRSAGAHDTYLRTY

SEQ ID NO: 796025 - protein, 20 aa, Mycobacterium
ASSQFVSGLLLSAASFAEGL

SEQ ID NO: 796026 - protein, 17 aa, Mycobacterium
ASSQGIFVIIDPDAHYG

SEQ ID NO: 796027 - protein, 24 aa, Mycobacterium
ASSQRFVDEYLWALDSLHRHGARA

SEQ ID NO: 796028 - protein, 27 aa, Mycobacterium
ASSQVPLFPVANLPIQPAMSGSVLQLL

SEQ ID NO: 796029 - protein, 24 aa, Mycobacterium
ASSRMLHQLAPGLVLWECDKTVYR

SEQ ID NO: 796030 - protein, 20 aa, Mycobacterium
ASSRVICFNPMVLGGEKGQV

SEQ ID NO: 796031 - protein, 27 aa, Mycobacterium
ASSRVLAIWCMDWPAVAAAAAAGLPAT

SEQ ID NO: 796032 - protein, 22 aa, Mycobacterium
ASSSLLPRWGAGTLVVATSATG

SEQ ID NO: 796033 - protein, 28 aa, Mycobacterium
ASSTKWEKLFRFLALDRLQTRLHRWRLN

SEQ ID NO: 796034 - protein, 23 aa, Mycobacterium
ASSTLVEMTLWSATPPAVPWRGV

SEQ ID NO: 796035 - protein, 20 aa, Mycobacterium
ASSWHILMKGAIILAAVGDL

SEQ ID NO: 796036 - protein, 20 aa, Mycobacterium
ASSWHILMKGAIVLAAVGDV

SEQ ID NO: 796037 - protein, 24 aa, Mycobacterium
ASSWQRLVPWPDVPAGLAALRMRA

SEQ ID NO: 796038 - protein, 24 aa, Mycobacterium
ASTAGTVEILKWAKKQGISITAEV

SEQ ID NO: 796039 - protein, 24 aa, Mycobacterium
ASTAGTVELLKWAKAQGISITAEV

SEQ ID NO: 796040 - protein, 23 aa, Mycobacterium
ASTARRWVTGLTAALPEHVTVLA

SEQ ID NO: 796041 - protein, 35 aa, Mycobacterium
ASTAVLAGLIPGLAPAALVFALANAPLLPVTGIEV

SEQ ID NO: 796042 - protein, 25 aa, Mycobacterium
ASTDDRRYLLYSPLTKAKITSEGER

SEQ ID NO: 796043 - protein, 30 aa, Mycobacterium
ASTFSRDLVDYWLFVIDVAGGDDIPRKRGP

SEQ ID NO: 796044 - protein, 23 aa, Mycobacterium
ASTIPLYVHAPYLINVASANNRI

SEQ ID NO: 796045 - protein, 20 aa, Mycobacterium
ASTLALLVQQHFFMHVDVGM

SEQ ID NO: 796046 - protein, 31 aa, Mycobacterium
ASTLHDCFDWLLRFRWRARAAAWEEGQPMSD

SEQ ID NO: 796047 - protein, 18 aa, Mycobacterium
ASTLILAYAQRHPDRVIG

SEQ ID NO: 796048 - protein, 24 aa, Mycobacterium
ASTLMIEAVAPYLAWMRAAAAQAE

SEQ ID NO: 796049 - protein, 17 aa, Mycobacterium
ASTLVTMSRARTIAATD

SEQ ID NO: 796050 - protein, 21 aa, Mycobacterium
ASTNHILGFPFTDHGLRLGVE

SEQ ID NO: 796051 - protein, 22 aa, Mycobacterium
ASTPLAYRLAYIADLEATFTPS

SEQ ID NO: 796052 - protein, 21 aa, Mycobacterium
ASTPLTFFRKASASISGPFDD

SEQ ID NO: 796053 - protein, 18 aa, Mycobacterium
ASTRPPVEWLRIPPGGTV

SEQ ID NO: 796054 - protein, 27 aa, Mycobacterium
ASTSMIAAVTPYVSWLTTIAGQAEETA

SEQ ID NO: 796055 - protein, 23 aa, Mycobacterium
ASTSPLHTFQQQALGAVNAPVQT

SEQ ID NO: 796056 - protein, 24 aa, Mycobacterium
ASTSPLHTLQQQALNAINAPVEAA

SEQ ID NO: 796057 - protein, 32 aa, Mycobacterium
ASTTTPPYFGGADWLWKPISSNPALAANSATW

SEQ ID NO: 796058 - protein, 31 aa, Mycobacterium
ASTTYTAGTPVLAVFELRLTGSARTTGAAGT

SEQ ID NO: 796059 - protein, 24 aa, Mycobacterium
ASTVFGVRFPGPLGLAAGFDKDGL

SEQ ID NO: 796060 - protein, 24 aa, Mycobacterium
ASTVFGVRFPGPLGLAAGFDKDGT

SEQ ID NO: 796061 - protein, 18 aa, Mycobacterium
ASTVPPPRIAANRSRLMS

SEQ ID NO: 796062 - protein, 32 aa, Mycobacterium
ASTWQLSLLPQTRPLLRRIISISQAHVWSPYL

SEQ ID NO: 796063 - protein, 19 aa, Mycobacterium
ASVADMSWKDFDWLIGINI

SEQ ID NO: 796064 - protein, 34 aa, Mycobacterium
ASVALNLTGPYRLTVGLYRALKASTAAGGASVVN

SEQ ID NO: 796065 - protein, 25 aa, Mycobacterium
ASVDCALGPLWNPVRLAEDIALVDN

SEQ ID NO: 796066 - protein, 22 aa, Mycobacterium
ASVDYWAAIADRWSLELTVVNP

SEQ ID NO: 796067 - protein, 25 aa, Mycobacterium
ASVEFNGFPPLPTYFMNGTGPGAAR

SEQ ID NO: 796068 - protein, 23 aa, Mycobacterium
ASVEQIWWHWNYTASRHSWQQPL

SEQ ID NO: 796069 - protein, 29 aa, Mycobacterium
ASVFNAVRLRGPIARDVIAQHTSLSIATV

SEQ ID NO: 796070 - protein, 21 aa, Mycobacterium
ASVGLPMRCVFALTAMGFLPQ

SEQ ID NO: 796071 - protein, 33 aa, Mycobacterium
ASVGPRELDLGWIIFLHRFFQDLAEVATLPGLP

SEQ ID NO: 796072 - protein, 23 aa, Mycobacterium
ASVGTVLSWTWQPQPLPGQPLDR

SEQ ID NO: 796073 - protein, 18 aa, Mycobacterium
ASVHKKAWKAMFDDYLRA

SEQ ID NO: 796074 - protein, 21 aa, Mycobacterium
ASVHPSLWRQSTLAAKQGLYE

SEQ ID NO: 796075 - protein, 21 aa, Mycobacterium
ASVIFREWQRRGYGGKFFVSP

SEQ ID NO: 796076 - protein, 24 aa, Mycobacterium
ASVIPALFGVAFFNTGQACALPKR

SEQ ID NO: 796077 - protein, 20 aa, Mycobacterium
ASVIPRFRQILRTHPLDLGP

SEQ ID NO: 796078 - protein, 24 aa, Mycobacterium
ASVKPLPSTWWNAGMAGSDTRPVQ

SEQ ID NO: 796079 - protein, 27 aa, Mycobacterium
ASVLAYPRVVWLAGGLLKGASVDAEVA

SEQ ID NO: 796080 - protein, 26 aa, Mycobacterium
ASVLAYPRVVWVAGGLLKGASVDAEV

SEQ ID NO: 796081 - protein, 26 aa, Mycobacterium
ASVLDVLWAAWTRSGLQRRWDGLSQR

SEQ ID NO: 796082 - protein, 18 aa, Mycobacterium
ASVLLAAAFGTHAGVYQA

SEQ ID NO: 796083 - protein, 25 aa, Mycobacterium
ASVLLKGLTAHYLLKSVYPVQAGDT

SEQ ID NO: 796084 - protein, 27 aa, Mycobacterium
ASVLVPVHWATFRLAPHPWAEPVERLV

SEQ ID NO: 796085 - protein, 21 aa, Mycobacterium
ASVMFDELLRRFPKIELVGAV

SEQ ID NO: 796086 - protein, 25 aa, Mycobacterium
ASVPGALIGVWKPGEAPYVRAFGLS

SEQ ID NO: 796087 - protein, 18 aa, Mycobacterium
ASVPLVPGETLLESARRA

SEQ ID NO: 796088 - protein, 20 aa, Mycobacterium
ASVPVHVRPLGDVGARLRLT

SEQ ID NO: 796089 - protein, 22 aa, Mycobacterium
ASVQWTLQMLLDLFEVEPAGEN

SEQ ID NO: 796090 - protein, 19 aa, Mycobacterium
ASVRIALDDWLVHGGSLPE

SEQ ID NO: 796091 - protein, 23 aa, Mycobacterium
ASVRRFGRMFLAGARLTVPLGMI

SEQ ID NO: 796092 - protein, 24 aa, Mycobacterium
ASVRTWMFRVVLNQVHTLARKEAN

SEQ ID NO: 796093 - protein, 38 aa, Mycobacterium
ASVSAPAPIPIGLNATPPPPVPQPMEPFGYVSDNDGSL

SEQ ID NO: 796094 - protein, 29 aa, Mycobacterium
ASVSPLVELLMAAAPGTRWLRDATRGGVG

SEQ ID NO: 796095 - protein, 28 aa, Mycobacterium
ASVSVVRYTPFRPFVIHVNHTGGALNPA

SEQ ID NO: 796096 - protein, 24 aa, Mycobacterium
ASVTGGNPFFLIEALRHVDESGGV

SEQ ID NO: 796097 - protein, 18 aa, Mycobacterium
ASVVLSWARVHEPDMDRV

SEQ ID NO: 796098 - protein, 26 aa, Mycobacterium
ASVVPAPLQGINLGFGNIGSLNLGSG

SEQ ID NO: 796099 - protein, 31 aa, Mycobacterium
ASVVTPFLLPDIPVVAWWPDIAPAVPAQDPL

SEQ ID NO: 796100 - protein, 31 aa, Mycobacterium
ASVVTPFLLPDIPVVAWWPDVAPAVPAQDPL

SEQ ID NO: 796101 - protein, 19 aa, Mycobacterium
ASVWALHDNPQINRVIHSL

SEQ ID NO: 796102 - protein, 19 aa, Mycobacterium
ASVYDIFGMFAVGGSLVAV

SEQ ID NO: 796103 - protein, 18 aa, Mycobacterium
ASVYLVRHPDRYPHHLPS

SEQ ID NO: 796104 - protein, 19 aa, Mycobacterium
ASWEKALSLPSVRGLIVGR

SEQ ID NO: 796105 - protein, 17 aa, Mycobacterium
ASWHQSWATACQKAFAD

SEQ ID NO: 796106 - protein, 21 aa, Mycobacterium
ASWLADFLPSDYYADYRRYRW

SEQ ID NO: 796107 - protein, 23 aa, Mycobacterium
ASWLSFMDHFFQIEPTGLPAEAH

SEQ ID NO: 796108 - protein, 27 aa, Mycobacterium
ASWRGAELVALYAWTDAELPDIPMREW

SEQ ID NO: 796109 - protein, 21 aa, Mycobacterium
ASWTAAMLASGDRLDFRDLPL

SEQ ID NO: 796110 - protein, 23 aa, Mycobacterium
ASWVPYLFYQFEDVYKKMPQEFP

SEQ ID NO: 796111 - protein, 27 aa, Mycobacterium
ASYAPQLWRYWAEHLDPDRARRSDPLR

SEQ ID NO: 796112 - protein, 23 aa, Mycobacterium
ASYARYWREAFRLPAMDHGRLGE

SEQ ID NO: 796113 - protein, 19 aa, Mycobacterium
ASYARYWREAFRLPSMDHA

SEQ ID NO: 796114 - protein, 28 aa, Mycobacterium
ASYEFLRLLEHRLQLQRLKRTHLLPEAD

SEQ ID NO: 796115 - protein, 31 aa, Mycobacterium
ASYEFLRLLEHRLQLQRLKRTHLLPEFDDEE

SEQ ID NO: 796116 - protein, 28 aa, Mycobacterium
ASYEFLRLLEHRLQLQRLKRTHLLPEPD

SEQ ID NO: 796117 - protein, 31 aa, Mycobacterium
ASYEFLRLLEHRLQLQRLKRTHLLPPADDDE

SEQ ID NO: 796118 - protein, 26 aa, Mycobacterium
ASYEFLRLLEHRLQLQRLKRTHMLPD

SEQ ID NO: 796119 - protein, 26 aa, Mycobacterium
ASYEFLRLLEHRLQLQRLKRTHMLPE

SEQ ID NO: 796120 - protein, 27 aa, Mycobacterium
ASYEFLRLLEHRLQLQRLKRTHTLPAP

SEQ ID NO: 796121 - protein, 25 aa, Mycobacterium
ASYFAAIKRDEFFAYHSSVSPWEID

SEQ ID NO: 796122 - protein, 17 aa, Mycobacterium
ASYFSLGDAWDSFTPTE

SEQ ID NO: 796123 - protein, 22 aa, Mycobacterium
ASYGARFAGVVFPGETLSANIW

SEQ ID NO: 796124 - protein, 27 aa, Mycobacterium
ASYLGIKGISGGWRPTPRRSTSTDLHV

SEQ ID NO: 796125 - protein, 18 aa, Mycobacterium
ASYLGVVAEHAAQRGLFA

SEQ ID NO: 796126 - protein, 23 aa, Mycobacterium
ASYPALDRRLAASRPTRADDCAA

SEQ ID NO: 796127 - protein, 22 aa, Mycobacterium
ASYPAVHYLPPDSVNWDVLQRT

SEQ ID NO: 796128 - protein, 22 aa, Mycobacterium
ASYRLGARTLFHQFSAPMYGDD

SEQ ID NO: 796129 - protein, 20 aa, Mycobacterium
ASYRPLETPGLRAPPRPAQG

SEQ ID NO: 796130 - protein, 17 aa, Mycobacterium
ASYRRLLQHVRPMELLG

SEQ ID NO: 796131 - protein, 30 aa, Mycobacterium
ATAADLGHPGLIAPLTFTSAPAMACNQRMF

SEQ ID NO: 796132 - protein, 26 aa, Mycobacterium
ATAATWPDPWPMYRALRDQDPVHHVI

SEQ ID NO: 796133 - protein, 24 aa, Mycobacterium
ATAAYLIEQWLGADPADVLITLSR

SEQ ID NO: 796134 - protein, 21 aa, Mycobacterium
ATACELTLLISPPEVINPVGL

SEQ ID NO: 796135 - protein, 33 aa, Mycobacterium
ATACLRKTDWLFPQYRELGAYLVRGIPPGHVGA

SEQ ID NO: 796136 - protein, 38 aa, Mycobacterium
ATADKADLYLPIRPGTDLALLNGILRVLVQDGAIDEAF

SEQ ID NO: 796137 - protein, 25 aa, Mycobacterium
ATADLTMALLLDVTRRVSEGDRLIR

SEQ ID NO: 796138 - protein, 28 aa, Mycobacterium
ATAEALKPWYGYFCKRPCFHDEYLQAFN

SEQ ID NO: 796139 - protein, 28 aa, Mycobacterium
ATAEALKPWYGYFCKRPCFHDEYLQTFN

SEQ ID NO: 796140 - protein, 26 aa, Mycobacterium
ATAEKSRAELDAQQQVQRAKAEERAE

SEQ ID NO: 796141 - protein, 17 aa, Mycobacterium
ATAFKPSYGIAEATLFV

SEQ ID NO: 796142 - protein, 25 aa, Mycobacterium
ATAFPKWLGRSWRRSAMLRYGENPH

SEQ ID NO: 796143 - protein, 33 aa, Mycobacterium
ATAGHSGSWWIFWPTLLLTLVSDFNALTGPANL

SEQ ID NO: 796144 - protein, 21 aa, Mycobacterium
ATAGLLSRRIELAPQALGFTY

SEQ ID NO: 796145 - protein, 23 aa, Mycobacterium
ATAHYGDMLSARGITTVALNDDG

SEQ ID NO: 796146 - protein, 24 aa, Mycobacterium
ATAIDPQHRLLLETAWEAMEHAGL

SEQ ID NO: 796147 - protein, 24 aa, Mycobacterium
ATAIDPQHRLLLETSWDAIEHAGL

SEQ ID NO: 796148 - protein, 17 aa, Mycobacterium
ATAIRIAISHYIVRSDD

SEQ ID NO: 796149 - protein, 29 aa, Mycobacterium
ATAKPVIPVFINSVATPLGPIRRVRALGA

SEQ ID NO: 796150 - protein, 17 aa, Mycobacterium
ATALAIRQPTPQEWHIL

SEQ ID NO: 796151 - protein, 27 aa, Mycobacterium
ATALAPVRFFNPLSMRFARKATADDIR

SEQ ID NO: 796152 - protein, 21 aa, Mycobacterium
ATALGMFAGLEVGVWEMTEGV

SEQ ID NO: 796153 - protein, 19 aa, Mycobacterium
ATALLRMQAIDTEALRASV

SEQ ID NO: 796154 - protein, 22 aa, Mycobacterium
ATALLYHAAFAPRVAEILPDLP

SEQ ID NO: 796155 - protein, 17 aa, Mycobacterium
ATALMLPNLQMMAKLRT

SEQ ID NO: 796156 - protein, 19 aa, Mycobacterium
ATALPVVRAALLDAYEHQG

SEQ ID NO: 796157 - protein, 28 aa, Mycobacterium
ATALSDLFTPVPWWINTIANHFNRRDFH

SEQ ID NO: 796158 - protein, 22 aa, Mycobacterium
ATALSWVLERLTRHPDALLKAA

SEQ ID NO: 796159 - protein, 26 aa, Mycobacterium
ATALTQWFKGLFAAVPDWRLVIENVV

SEQ ID NO: 796160 - protein, 24 aa, Mycobacterium
ATAMRVVNAIPFVVAAPPGLLSSL

SEQ ID NO: 796161 - protein, 20 aa, Mycobacterium
ATAMRVVNAVPYVVAAEPGL

SEQ ID NO: 796162 - protein, 24 aa, Mycobacterium
ATAMTLRQFGIVNRVGMIVPNHLI

SEQ ID NO: 796163 - protein, 18 aa, Mycobacterium
ATANLLRNFWSNAVIFCG

SEQ ID NO: 796164 - protein, 20 aa, Mycobacterium
ATAPVFGVGLAVQPCEGQER

SEQ ID NO: 796165 - protein, 19 aa, Mycobacterium
ATAQFTWYSVDLPPVMELR

SEQ ID NO: 796166 - protein, 30 aa, Mycobacterium
ATAQRIEILEQLMGVYRDLDGVPAALEAAY

SEQ ID NO: 796167 - protein, 24 aa, Mycobacterium
ATARALLPLLQRKSDRSWRETIEQ

SEQ ID NO: 796168 - protein, 24 aa, Mycobacterium
ATARPLAEALLAEPDRWDLGSVLA

SEQ ID NO: 796169 - protein, 35 aa, Mycobacterium
ATARPPTFVLFTTGFLEAGYRRFLERRLREAFGFE

SEQ ID NO: 796170 - protein, 24 aa, Mycobacterium
ATARPVCEALLAALARHGVPEQIL

SEQ ID NO: 796171 - protein, 29 aa, Mycobacterium
ATARPVIPIFINAIAAPLGPLRRCRALGT

SEQ ID NO: 796172 - protein, 24 aa, Mycobacterium
ATARPVVPIFINSVATPLGPLSRS

SEQ ID NO: 796173 - protein, 18 aa, Mycobacterium
ATARRAMDLIGERCPILI

SEQ ID NO: 796174 - protein, 22 aa, Mycobacterium
ATARRLFAIGELDTRRAIDLAE

SEQ ID NO: 796175 - protein, 18 aa, Mycobacterium
ATARRWFEEFEGAGLDGV

SEQ ID NO: 796176 - protein, 25 aa, Mycobacterium
ATASGLAAAWWLGVTKYAPEIVEVT

SEQ ID NO: 796177 - protein, 26 aa, Mycobacterium
ATASLAGILPWHPDPIYSLGKHGVVG

SEQ ID NO: 796178 - protein, 25 aa, Mycobacterium
ATASLNPATFFLALARAGFNFDKFA

SEQ ID NO: 796179 - protein, 26 aa, Mycobacterium
ATASQPLDWFCSFSSAAALVGSPGQG

SEQ ID NO: 796180 - protein, 26 aa, Mycobacterium
ATASQTFVALPGGLPIVIDGAIVGGI

SEQ ID NO: 796181 - protein, 27 aa, Mycobacterium
ATASRDVDWWLTFSSAAALLGTPGQGA

SEQ ID NO: 796182 - protein, 21 aa, Mycobacterium
ATASTPLTSLLPAGADEVSAQ

SEQ ID NO: 796183 - protein, 27 aa, Mycobacterium
ATATQPLDWFAVFSSAAALLGSPGQGA

SEQ ID NO: 796184 - protein, 27 aa, Mycobacterium
ATATRELDWWLGFSSTASLLGSPGQTA

SEQ ID NO: 796185 - protein, 30 aa, Mycobacterium
ATATRLGGPGQWLLALPPHHIAGMQVLLRS

SEQ ID NO: 796186 - protein, 24 aa, Mycobacterium
ATAVEEILAWLYAQVLGLERVGVQ

SEQ ID NO: 796187 - protein, 21 aa, Mycobacterium
ATAVGLEVVQYPRTGGKGRTR

SEQ ID NO: 796188 - protein, 23 aa, Mycobacterium
ATAVQGWLQLFLDELRVCLHCCG

SEQ ID NO: 796189 - protein, 23 aa, Mycobacterium
ATAVQIVPFLGRYAKHLYVFQRT

SEQ ID NO: 796190 - protein, 24 aa, Mycobacterium
ATAVQLFICFRQGATPVSVGPDRT

SEQ ID NO: 796191 - protein, 24 aa, Mycobacterium
ATAVRFEPGVCRTVRLVPLRGRRE

SEQ ID NO: 796192 - protein, 21 aa, Mycobacterium
ATAVRFEPGVPHTVRLVPLRG

SEQ ID NO: 796193 - protein, 25 aa, Mycobacterium
ATAVWSLEWHTVAPALAVCGGAVRT

SEQ ID NO: 796194 - protein, 21 aa, Mycobacterium
ATAWAIFDRIVADAAPGGVHT

SEQ ID NO: 796195 - protein, 20 aa, Mycobacterium
ATAYPLPRPGDGPAPKPVTL

SEQ ID NO: 796196 - protein, 20 aa, Mycobacterium
ATCCRALGIVVYQRQRPADL

SEQ ID NO: 796197 - protein, 19 aa, Mycobacterium
ATCDVFLTSYLPTRRKKMG

SEQ ID NO: 796198 - protein, 19 aa, Mycobacterium
ATCFAYQWPHRSKGAARFP

SEQ ID NO: 796199 - protein, 17 aa, Mycobacterium
ATCNDVYFPVQRPDLGR

SEQ ID NO: 796200 - protein, 17 aa, Mycobacterium
ATDAEIKRAYRKLAREL

SEQ ID NO: 796201 - protein, 24 aa, Mycobacterium
ATDAPQPWVLDRALRHLLTDITGN

SEQ ID NO: 796202 - protein, 27 aa, Mycobacterium
ATDCGGLSLILYDVTTLYFAAESEDSL

SEQ ID NO: 796203 - protein, 19 aa, Mycobacterium
ATDCVGVTAGAPFASGATS

SEQ ID NO: 796204 - protein, 23 aa, Mycobacterium
ATDDDVIYRRMLSEMLGDPHDLV

SEQ ID NO: 796205 - protein, 22 aa, Mycobacterium
ATDDIALMRALPNMTVIDVADA

SEQ ID NO: 796206 - protein, 27 aa, Mycobacterium
ATDDPALIQNVCFLYHLIGGGTGDWDV

SEQ ID NO: 796207 - protein, 25 aa, Mycobacterium
ATDDQFLSIAKFRAARVLWARVAEV

SEQ ID NO: 796208 - protein, 29 aa, Mycobacterium
ATDELAPFRLPLTISPQPAPRLTVDQAIE

SEQ ID NO: 796209 - protein, 17 aa, Mycobacterium
ATDFHRLPGDEPQFDTV

SEQ ID NO: 796210 - protein, 24 aa, Mycobacterium
ATDGGFYGPRWPGSAGGPPGPQKL

SEQ ID NO: 796211 - protein, 22 aa, Mycobacterium
ATDGLCAMGLRFSEDKLSPGER

SEQ ID NO: 796212 - protein, 18 aa, Mycobacterium
ATDGLLGPTAAALVRGAH

SEQ ID NO: 796213 - protein, 19 aa, Mycobacterium
ATDGRLIIAFGAGYVEAEF

SEQ ID NO: 796214 - protein, 28 aa, Mycobacterium
ATDGVYEFQLIAPPLRFIGAVGSPVNPV

SEQ ID NO: 796215 - protein, 34 aa, Mycobacterium
ATDHKITPFVLTLRLLVIALRHNEILNSAWVESP

SEQ ID NO: 796216 - protein, 19 aa, Mycobacterium
ATDHLMRFPGHFSEQLLPE

SEQ ID NO: 796217 - protein, 18 aa, Mycobacterium
ATDHRYVPAAVFTDPQIA

SEQ ID NO: 796218 - protein, 24 aa, Mycobacterium
ATDLCEFVEFPTELLQVCGDSFAG

SEQ ID NO: 796219 - protein, 17 aa, Mycobacterium
ATDLGVSTLLIAGGVAA

SEQ ID NO: 796220 - protein, 18 aa, Mycobacterium
ATDLLERYVARAAGLRRA

SEQ ID NO: 796221 - protein, 25 aa, Mycobacterium
ATDMQRWRHFAFGVLGFAEGKGPDP

SEQ ID NO: 796222 - protein, 27 aa, Mycobacterium
ATDPAGAFFGLWQPLGHRGFEIIGEAG

SEQ ID NO: 796223 - protein, 25 aa, Mycobacterium
ATDPAIKGIWCIPVYSNPTGSTYSW

SEQ ID NO: 796224 - protein, 24 aa, Mycobacterium
ATDPALGIDWPLVDGAPPTLSDRD

SEQ ID NO: 796225 - protein, 25 aa, Mycobacterium
ATDPELAIDWPLVDGAPPSLSERDA

SEQ ID NO: 796226 - protein, 24 aa, Mycobacterium
ATDPLPVVLFFHGGGFVMGDLDTH

SEQ ID NO: 796227 - protein, 26 aa, Mycobacterium
ATDPRGLLLVADTRGDGLLVYSVDPL

SEQ ID NO: 796228 - protein, 33 aa, Mycobacterium
ATDPRMAAYARSRFTDPLLLSYSREIAALVAAQ

SEQ ID NO: 796229 - protein, 31 aa, Mycobacterium
ATDRISVPYFFNPRLDARIPVLALPRELAAG

SEQ ID NO: 796230 - protein, 24 aa, Mycobacterium
ATDSAPPRWLADHPKITIVRAEDH

SEQ ID NO: 796231 - protein, 24 aa, Mycobacterium
ATDVAAWREFGTKVLGMMEGTGDD

SEQ ID NO: 796232 - protein, 28 aa, Mycobacterium
ATDVEQTFLRRLLTGELRQGALVGVMAD

SEQ ID NO: 796233 - protein, 21 aa, Mycobacterium
ATDVLGPLTMLNVRGLAVQEN

SEQ ID NO: 796234 - protein, 29 aa, Mycobacterium
ATDWQIAAGGLLRFATRPLQLANVVPETV

SEQ ID NO: 796235 - protein, 26 aa, Mycobacterium
ATDYRTLLEFFFQIHDPTTPNRQGND

SEQ ID NO: 796236 - protein, 25 aa, Mycobacterium
ATEAALVLNFVYPKGQALSRLRTAL

SEQ ID NO: 796237 - protein, 33 aa, Mycobacterium
ATEAAVSHLIPALQVLHDALAAKALEWQTVVKS

SEQ ID NO: 796238 - protein, 26 aa, Mycobacterium
ATEAEQTFLLRLLGGELRQGALAGIM

SEQ ID NO: 796239 - protein, 23 aa, Mycobacterium
ATEALRELAHRCPVAVLSGRDLA

SEQ ID NO: 796240 - protein, 17 aa, Mycobacterium
ATEAPLRMLMNNLDPEN

SEQ ID NO: 796241 - protein, 21 aa, Mycobacterium
ATEAVTERRFCYSCGVAALSS

SEQ ID NO: 796242 - protein, 25 aa, Mycobacterium
ATEDLDIVSFWMAAEAQRVMQICHH

SEQ ID NO: 796243 - protein, 27 aa, Mycobacterium
ATEDTIPGSRLLWVDGRPTPPGPLVNT

SEQ ID NO: 796244 - protein, 23 aa, Mycobacterium
ATEEFLRYFTPAPGDARTIAEDV

SEQ ID NO: 796245 - protein, 24 aa, Mycobacterium
ATEEFLRYFTPAPGDGRTFADDVE

SEQ ID NO: 796246 - protein, 24 aa, Mycobacterium
ATEEFLRYFTPAPGDGRTFSDDVE

SEQ ID NO: 796247 - protein, 23 aa, Mycobacterium
ATEEFLRYFTPAPGDGRTLAADV

SEQ ID NO: 796248 - protein, 23 aa, Mycobacterium
ATEEQFGPVLPIFGYDDLDDAVT

SEQ ID NO: 796249 - protein, 21 aa, Mycobacterium
ATEFAGFLWVALDPGAELDVA

SEQ ID NO: 796250 - protein, 22 aa, Mycobacterium
ATEFAGFLWVSLDPGTALDVAA

SEQ ID NO: 796251 - protein, 41 aa, Mycobacterium
ATEFGNRLFTLEWEPVPLPTAAGLPGALLMIGDPTSDPLLS

SEQ ID NO: 796252 - protein, 28 aa, Mycobacterium
ATEHPYHEPLWVPLITAYYVAERQFDAL

SEQ ID NO: 796253 - protein, 17 aa, Mycobacterium
ATEIGWPILATSPSQPP

SEQ ID NO: 796254 - protein, 33 aa, Mycobacterium
ATEILAFINGMETLWLLDPSIPLTEVFKGYAES

SEQ ID NO: 796255 - protein, 18 aa, Mycobacterium
ATEILAGLIPGGGGMARL

SEQ ID NO: 796256 - protein, 22 aa, Mycobacterium
ATEIRLTHFGPAGLLDRIGVVR

SEQ ID NO: 796257 - protein, 17 aa, Mycobacterium
ATELHKMTVARRTLREY

SEQ ID NO: 796258 - protein, 23 aa, Mycobacterium
ATELLLALTNFTATSVPLLRGDV

SEQ ID NO: 796259 - protein, 17 aa, Mycobacterium
ATELPYVWGTLGAPKDP

SEQ ID NO: 796260 - protein, 24 aa, Mycobacterium
ATELRAMLGTRLPRYMVPQRIVLV

SEQ ID NO: 796261 - protein, 24 aa, Mycobacterium
ATELTVPILLIRGKLSDVVSEEAV

SEQ ID NO: 796262 - protein, 20 aa, Mycobacterium
ATELYRGAPFGVGCFVGVWQ

SEQ ID NO: 796263 - protein, 27 aa, Mycobacterium
ATENIDYYLVLANWKLGIVLEKTYAAG

SEQ ID NO: 796264 - protein, 17 aa, Mycobacterium
ATEPDDFQLAYAARLYE

SEQ ID NO: 796265 - protein, 26 aa, Mycobacterium
ATEPEQTFLLRLLGGELRQGALAGIM

SEQ ID NO: 796266 - protein, 23 aa, Mycobacterium
ATEPLPVMVFIHGGGYILGSSAT

SEQ ID NO: 796267 - protein, 28 aa, Mycobacterium
ATEPMPQFGPFARSYLAGLLAGLRTETG

SEQ ID NO: 796268 - protein, 24 aa, Mycobacterium
ATEQLFVLQREALDAPYPGVLPEG

SEQ ID NO: 796269 - protein, 22 aa, Mycobacterium
ATEQPVYRVAAKLRLMADELTE

SEQ ID NO: 796270 - protein, 28 aa, Mycobacterium
ATEQTRAELDAQQQIQRAKADEREEIGD

SEQ ID NO: 796271 - protein, 28 aa, Mycobacterium
ATERGAVPDLFLPLRYGRVALAERMPRR

SEQ ID NO: 796272 - protein, 27 aa, Mycobacterium
ATESEQTFLFRLLSGELRQGALTGIMT

SEQ ID NO: 796273 - protein, 32 aa, Mycobacterium
ATESIAQVRFSWVRPALAGPPAWELLPHELAL

SEQ ID NO: 796274 - protein, 23 aa, Mycobacterium
ATEVAIFIDPQQLVRGILVNERG

SEQ ID NO: 796275 - protein, 25 aa, Mycobacterium
ATEVAIFIDPQQLVRGILVNGRGQR

SEQ ID NO: 796276 - protein, 25 aa, Mycobacterium
ATEVKFRTSWLKPGALFVSVNGTGV

SEQ ID NO: 796277 - protein, 23 aa, Mycobacterium
ATEWHPHDYVPWDRGRNFAQMGG

SEQ ID NO: 796278 - protein, 17 aa, Mycobacterium
ATFAAGIGMLHLIDSAE

SEQ ID NO: 796279 - protein, 25 aa, Mycobacterium
ATFDQIVLPHVWRGVPEIAAVLAAA

SEQ ID NO: 796280 - protein, 20 aa, Mycobacterium
ATFEAAFRIDVRPILPTIAA

SEQ ID NO: 796281 - protein, 25 aa, Mycobacterium
ATFEPLDLQQWPRREWFEHYLDRCP

SEQ ID NO: 796282 - protein, 20 aa, Mycobacterium
ATFETAFADGWHLASAPSER

SEQ ID NO: 796283 - protein, 19 aa, Mycobacterium
ATFFDIDWDLDQDGRIVLP

SEQ ID NO: 796284 - protein, 19 aa, Mycobacterium
ATFFIPGWVAEHRPHLAAS

SEQ ID NO: 796285 - protein, 23 aa, Mycobacterium
ATFLFDTLDGFLDTLLAAAARGV

SEQ ID NO: 796286 - protein, 27 aa, Mycobacterium
ATFLFDTLDGFLDTLLAAAARGVSVRF

SEQ ID NO: 796287 - protein, 18 aa, Mycobacterium
ATFMALFQGRTTVLAPEF

SEQ ID NO: 796288 - protein, 20 aa, Mycobacterium
ATFMRVPDPQTFWTDREYVR

SEQ ID NO: 796289 - protein, 28 aa, Mycobacterium
ATFPISAHYFTVFPLARWSAVLGRRYLR

SEQ ID NO: 796290 - protein, 29 aa, Mycobacterium
ATFPISAHYFTVFPLARWSAVLGRRYLRQ

SEQ ID NO: 796291 - protein, 20 aa, Mycobacterium
ATFQRLWYQVGTNIGHYHSY

SEQ ID NO: 796292 - protein, 18 aa, Mycobacterium
ATFSLRNGHCDIALVVGA

SEQ ID NO: 796293 - protein, 21 aa, Mycobacterium
ATFTPIWRRFVQQGLQPATAE

SEQ ID NO: 796294 - protein, 25 aa, Mycobacterium
ATFVDVLTWALSERAIAKIGRGWLT

SEQ ID NO: 796295 - protein, 24 aa, Mycobacterium
ATGAMFTALWVPNTGQLALMIHHL

SEQ ID NO: 796296 - protein, 33 aa, Mycobacterium
ATGANIVRVALSAPLKQIAFNGGLEPGVVAEKV

SEQ ID NO: 796297 - protein, 30 aa, Mycobacterium
ATGANIVRVALSAPLKQIALNGGLEPGVVA

SEQ ID NO: 796298 - protein, 17 aa, Mycobacterium
ATGARRLLVQLTATDAD

SEQ ID NO: 796299 - protein, 25 aa, Mycobacterium
ATGARWLCETFPTRLERGAGVPAVE

SEQ ID NO: 796300 - protein, 25 aa, Mycobacterium
ATGARWLCETFPTRLERGAGVPSVE

SEQ ID NO: 796301 - protein, 24 aa, Mycobacterium
ATGDDRWLWGGPDRPGQTLAIYKE

SEQ ID NO: 796302 - protein, 23 aa, Mycobacterium
ATGDERWLWGGPDRPGDTLAIYK

SEQ ID NO: 796303 - protein, 23 aa, Mycobacterium
ATGDGIALALWAGVTVSDLEFIQ

SEQ ID NO: 796304 - protein, 24 aa, Mycobacterium
ATGDLMQYLVWTMGGRGAHEGRNA

SEQ ID NO: 796305 - protein, 25 aa, Mycobacterium
ATGDPVRILSPRTAQPGGLSTWLDP

SEQ ID NO: 796306 - protein, 21 aa, Mycobacterium
ATGDRLSRLAGRWLRVPVQAQ

SEQ ID NO: 796307 - protein, 24 aa, Mycobacterium
ATGEPFLRRFRVKFAGNIAHWNME

SEQ ID NO: 796308 - protein, 23 aa, Mycobacterium
ATGEPTVVAASPTSPTAAPQRRP

SEQ ID NO: 796309 - protein, 18 aa, Mycobacterium
ATGFYEKFGYDRPVYTLS

SEQ ID NO: 796310 - protein, 25 aa, Mycobacterium
ATGGFGIHPVLLDAALHALGVADER

SEQ ID NO: 796311 - protein, 25 aa, Mycobacterium
ATGGFVLFYHLLWELTHVCFEHSGL

SEQ ID NO: 796312 - protein, 25 aa, Mycobacterium
ATGGFVLFYHVLWELTHVCFEHPGL

SEQ ID NO: 796313 - protein, 24 aa, Mycobacterium
ATGGGFHQLAYWARDFDAAVADLE

SEQ ID NO: 796314 - protein, 24 aa, Mycobacterium
ATGGRVAFMIRFGNGYLPDAKTVI

SEQ ID NO: 796315 - protein, 21 aa, Mycobacterium
ATGGSWLFYGGRHRADDFLYG

SEQ ID NO: 796316 - protein, 29 aa, Mycobacterium
ATGHAPIRYHSLILAAWRGSEPTAIRLID

SEQ ID NO: 796317 - protein, 20 aa, Mycobacterium
ATGIDIYRIFDALNNVDSMR

SEQ ID NO: 796318 - protein, 22 aa, Mycobacterium
ATGIDYLHIASEGRDFIDGARL

SEQ ID NO: 796319 - protein, 46 aa, Mycobacterium
ATGIKPNLDFPTGPAYYLMGFDIPCFTPIFVMSRITGWTAHIMEQA

SEQ ID NO: 796320 - protein, 19 aa, Mycobacterium
ATGLAVVPVMFDRIMELPP

SEQ ID NO: 796321 - protein, 19 aa, Mycobacterium
ATGLCHTDLTFKSQVPIPA

SEQ ID NO: 796322 - protein, 23 aa, Mycobacterium
ATGLKPFDVQLQGALRMLAGDVV

SEQ ID NO: 796323 - protein, 22 aa, Mycobacterium
ATGLLRAWVLMDGATPLAVEVV

SEQ ID NO: 796324 - protein, 17 aa, Mycobacterium
ATGLNMRLFGGVDLTVD

SEQ ID NO: 796325 - protein, 21 aa, Mycobacterium
ATGLVCALLLTTRGAALTLDQ

SEQ ID NO: 796326 - protein, 17 aa, Mycobacterium
ATGLVIMAMLERSWLMV

SEQ ID NO: 796327 - protein, 26 aa, Mycobacterium
ATGLVPKRIPSFPDLPGIHVLRNFDE

SEQ ID NO: 796328 - protein, 27 aa, Mycobacterium
ATGLWNKWGRYGLFNFHSHTNPKPICY

SEQ ID NO: 796329 - protein, 29 aa, Mycobacterium
ATGLYTYNDVPFCFHYLGPGTQLDGPETM

SEQ ID NO: 796330 - protein, 25 aa, Mycobacterium
ATGMPKFIRFMLRWVIKAPEFLQLD

SEQ ID NO: 796331 - protein, 27 aa, Mycobacterium
ATGPSVETFISAGLWYPPDGGDLVPVS

SEQ ID NO: 796332 - protein, 25 aa, Mycobacterium
ATGQDLLLVTVLKGAVLFVTDLARA

SEQ ID NO: 796333 - protein, 22 aa, Mycobacterium
ATGQPVVVPPKVSIADAGVVES

SEQ ID NO: 796334 - protein, 18 aa, Mycobacterium
ATGQRWAGVALNADLSYA

SEQ ID NO: 796335 - protein, 29 aa, Mycobacterium
ATGRGGLSQLFPIDPRRTAYDRPQRTLLT

SEQ ID NO: 796336 - protein, 24 aa, Mycobacterium
ATGRHQLMQVLWIYEHAIDMDGLR

SEQ ID NO: 796337 - protein, 21 aa, Mycobacterium
ATGRRVFIASYLLAQGLFQQR

SEQ ID NO: 796338 - protein, 23 aa, Mycobacterium
ATGRTLFLARCRAVMTRHYDDAL

SEQ ID NO: 796339 - protein, 28 aa, Mycobacterium
ATGRYADGWVPFVISRPADYARALDAVR

SEQ ID NO: 796340 - protein, 29 aa, Mycobacterium
ATGSGGTVDLAFPGTAGHGGDGGAGGGGG

SEQ ID NO: 796341 - protein, 28 aa, Mycobacterium
ATGSTLAMTFLLPDALLNESARTVRQLI

SEQ ID NO: 796342 - protein, 17 aa, Mycobacterium
ATGTKWSFIPQGDKGAA

SEQ ID NO: 796343 - protein, 25 aa, Mycobacterium
ATGTLPPLLPFVSAPINGVMSVGLK

SEQ ID NO: 796344 - protein, 26 aa, Mycobacterium
ATGVGLAQLRRALPDAVFVSARTGDG

SEQ ID NO: 796345 - protein, 26 aa, Mycobacterium
ATGVLMERFNIDAPAAFVLLTQLSAK

SEQ ID NO: 796346 - protein, 19 aa, Mycobacterium
ATGVLPLNLPPLTAADVAP

SEQ ID NO: 796347 - protein, 31 aa, Mycobacterium
ATGVNTTFPPFPPAPPIMAAPGAPEAGLAAV

SEQ ID NO: 796348 - protein, 21 aa, Mycobacterium
ATGWRLHGHPARWIEIAAEWG

SEQ ID NO: 796349 - protein, 29 aa, Mycobacterium
ATGYLRLREWLTRLYRIEFAGFIGSNFDS

SEQ ID NO: 796350 - protein, 25 aa, Mycobacterium
ATGYNITFPFFDPDFVSAPDNAIRL

SEQ ID NO: 796351 - protein, 21 aa, Mycobacterium
ATHAFWVCDDCDALAAQLSCA

SEQ ID NO: 796352 - protein, 23 aa, Mycobacterium
ATHAWASVWTPQNIWLGLDPTND

SEQ ID NO: 796353 - protein, 17 aa, Mycobacterium
ATHDLIFARTSGERGQA

SEQ ID NO: 796354 - protein, 33 aa, Mycobacterium
ATHERLGGPGQWLLALPAHHVAGFQVLVRSVVA

SEQ ID NO: 796355 - protein, 24 aa, Mycobacterium
ATHGRFQLGLGLGAPVIEGPSYGL

SEQ ID NO: 796356 - protein, 24 aa, Mycobacterium
ATHGVLNLFAALRPVAEDDGETSL

SEQ ID NO: 796357 - protein, 25 aa, Mycobacterium
ATHHDLHLWLPHPSDDLWQALAGVH

SEQ ID NO: 796358 - protein, 27 aa, Mycobacterium
ATHHELHLWLPHPSAALWRSLADLHGV

SEQ ID NO: 796359 - protein, 19 aa, Mycobacterium
ATHKLPFGGVGPSGLGAYH

SEQ ID NO: 796360 - protein, 31 aa, Mycobacterium
ATHLSRLVPQHMMRRLFFTAATVDAATLHHF

SEQ ID NO: 796361 - protein, 30 aa, Mycobacterium
ATHLSRLVPQHMMRRLFFTATTVDAATLHH

SEQ ID NO: 796362 - protein, 29 aa, Mycobacterium
ATHNEPMIPVYIFYSMFGFQRTGDGLWAA

SEQ ID NO: 796363 - protein, 22 aa, Mycobacterium
ATHPMLRTRFLPDGTQQTMPKP

SEQ ID NO: 796364 - protein, 37 aa, Mycobacterium
ATHQRLGGPGAWLLAVPPYHIAGLQVLVRSVLAGRTP

SEQ ID NO: 796365 - protein, 25 aa, Mycobacterium
ATHRAIMLADITGAPLYIVHVSAKQ

SEQ ID NO: 796366 - protein, 24 aa, Mycobacterium
ATHRAIMLSNLTGAPLYVVHVSAK

SEQ ID NO: 796367 - protein, 33 aa, Mycobacterium
ATHRFLANMPGYRGWQWAVVVAAYPGADRATIS

SEQ ID NO: 796368 - protein, 26 aa, Mycobacterium
ATHRKTHLFGPLDRQYFTAGSDAVTV

SEQ ID NO: 796369 - protein, 25 aa, Mycobacterium
ATHVAGPPWIDLLAQVPQVSDDDVD

SEQ ID NO: 796370 - protein, 19 aa, Mycobacterium
ATHVLGPILLTELLTPILA

SEQ ID NO: 796371 - protein, 32 aa, Mycobacterium
ATIAAIIAIRASTGGRRALGAFASGRTVTTNP

SEQ ID NO: 796372 - protein, 21 aa, Mycobacterium
ATIAFTVWTSSLADITRLERR

SEQ ID NO: 796373 - protein, 25 aa, Mycobacterium
ATIDGRTYRQLAEPLRTVGALLDAK

SEQ ID NO: 796374 - protein, 29 aa, Mycobacterium
ATIFATLLAAFYALLYRYSGSDDQVVGAP

SEQ ID NO: 796375 - protein, 23 aa, Mycobacterium
ATIGFDLRGRRFAPFYVADVEGA

SEQ ID NO: 796376 - protein, 30 aa, Mycobacterium
ATIGLSYLGFTQWALLTDPPPELAAAVITV

SEQ ID NO: 796377 - protein, 25 aa, Mycobacterium
ATIHNERFTIGLVDRIRASIVEGCF

SEQ ID NO: 796378 - protein, 32 aa, Mycobacterium
ATIITRGLAEIIRLGIALGAKGATLAGLAGVG

SEQ ID NO: 796379 - protein, 33 aa, Mycobacterium
ATIKPFLTVGSYAPKLPWPWGLVDFAARVLKPA

SEQ ID NO: 796380 - protein, 21 aa, Mycobacterium
ATIKTLPQALRRSLTWDQGHE

SEQ ID NO: 796381 - protein, 27 aa, Mycobacterium
ATILQATLDLPLYRGLVKARGDMQEVM

SEQ ID NO: 796382 - protein, 24 aa, Mycobacterium
ATILRAAAQHWIAWMTQKQELAQS

SEQ ID NO: 796383 - protein, 18 aa, Mycobacterium
ATIMERRLDRDRPLWECW

SEQ ID NO: 796384 - protein, 19 aa, Mycobacterium
ATIMLSFGDLTPFAERIRG

SEQ ID NO: 796385 - protein, 23 aa, Mycobacterium
ATINERHRVVLGAVLRHMKLERD

SEQ ID NO: 796386 - protein, 27 aa, Mycobacterium
ATINGATVQFPWAARSRLPVYGAGYGP

SEQ ID NO: 796387 - protein, 32 aa, Mycobacterium
ATIPIIAGFPFPLAVEILPAHLPLPAKIRTEF

SEQ ID NO: 796388 - protein, 18 aa, Mycobacterium
ATIPILEEAGWSDDGMQS

SEQ ID NO: 796389 - protein, 17 aa, Mycobacterium
ATIPILREDGWTEDGTQ

SEQ ID NO: 796390 - protein, 23 aa, Mycobacterium
ATIPMVHAVSRVVDVPYAEIVAS

SEQ ID NO: 796391 - protein, 17 aa, Mycobacterium
ATIRLPGEAGWGNAMRW

SEQ ID NO: 796392 - protein, 24 aa, Mycobacterium
ATIRPYRPSLSHPVPPAALWGRPG

SEQ ID NO: 796393 - protein, 25 aa, Mycobacterium
ATIRVRMRLFTPNTLDGARRRSFGC

SEQ ID NO: 796394 - protein, 21 aa, Mycobacterium
ATIVPVLAAINPHLGLVVRGP

SEQ ID NO: 796395 - protein, 17 aa, Mycobacterium
ATIVSGAVTRRGGVDTG

SEQ ID NO: 796396 - protein, 31 aa, Mycobacterium
ATKADSLIIGGGMCFTFLAAQGFSVGSSLLQ

SEQ ID NO: 796397 - protein, 23 aa, Mycobacterium
ATKAGIKPIIGIEAYIAPGSRFD

SEQ ID NO: 796398 - protein, 28 aa, Mycobacterium
ATKDVIGAYRFLQRVWRLVIDENTGEIL

SEQ ID NO: 796399 - protein, 23 aa, Mycobacterium
ATKGVAMPLRLTSPAPCTNCHGS

SEQ ID NO: 796400 - protein, 27 aa, Mycobacterium
ATKHPCHGFRRAWAALRYDERREVNKK

SEQ ID NO: 796401 - protein, 24 aa, Mycobacterium
ATKLGLVALRRLHQMRRALADLPA

SEQ ID NO: 796402 - protein, 17 aa, Mycobacterium
ATKMFCGCANRFGGEPN

SEQ ID NO: 796403 - protein, 24 aa, Mycobacterium
ATKPGIYYPPMRKTLEGPAYALER

SEQ ID NO: 796404 - protein, 22 aa, Mycobacterium
ATKPQVPSLSSLPGRPSRPAIG

SEQ ID NO: 796405 - protein, 28 aa, Mycobacterium
ATKPTAWLAEGLLAYLPGAAQDALFENI

SEQ ID NO: 796406 - protein, 25 aa, Mycobacterium
ATKQALTEAVLWPLQHPDTFQRLGV

SEQ ID NO: 796407 - protein, 27 aa, Mycobacterium
ATKSYTAQLLALYLLLTDVAGRDNTAA

SEQ ID NO: 796408 - protein, 17 aa, Mycobacterium
ATKWRELIEKSGGDKKE

SEQ ID NO: 796409 - protein, 17 aa, Mycobacterium
ATKYRMSALRTTPPKPG

SEQ ID NO: 796410 - protein, 17 aa, Mycobacterium
ATLADWLNPDGTYRLSA

SEQ ID NO: 796411 - protein, 17 aa, Mycobacterium
ATLAGLPVRVCRTGYTG

SEQ ID NO: 796412 - protein, 20 aa, Mycobacterium
ATLALLRRVARAVEPPLLDA

SEQ ID NO: 796413 - protein, 32 aa, Mycobacterium
ATLAPLTDAGLTPYRGLKKLRAAGVLGAGRTV

SEQ ID NO: 796414 - protein, 22 aa, Mycobacterium
ATLAPVLRVVSVRRVPSVAVRC

SEQ ID NO: 796415 - protein, 19 aa, Mycobacterium
ATLATWFRTRSHSGSLERY

SEQ ID NO: 796416 - protein, 20 aa, Mycobacterium
ATLDAWLVAEALRTLSTDHR

SEQ ID NO: 796417 - protein, 19 aa, Mycobacterium
ATLELRRRLWSLGLGVAES

SEQ ID NO: 796418 - protein, 24 aa, Mycobacterium
ATLEYSALLFDHPLARDLADVVAV

SEQ ID NO: 796419 - protein, 19 aa, Mycobacterium
ATLFSLRVALMSAQEETEP

SEQ ID NO: 796420 - protein, 19 aa, Mycobacterium
ATLGILEHFPMSEYRPDNL

SEQ ID NO: 796421 - protein, 24 aa, Mycobacterium
ATLGKITLPGPPLRFFDVAGPERT

SEQ ID NO: 796422 - protein, 30 aa, Mycobacterium
ATLGLSYLGFTQWALLTDPPPELATAVITV

SEQ ID NO: 796423 - protein, 29 aa, Mycobacterium
ATLGPLYGLLASLGLLQSALSLAGYGSVQ

SEQ ID NO: 796424 - protein, 18 aa, Mycobacterium
ATLGWVYWHNTSRLHGYL

SEQ ID NO: 796425 - protein, 22 aa, Mycobacterium
ATLHHRAAALVGSLMRELTQDW

SEQ ID NO: 796426 - protein, 20 aa, Mycobacterium
ATLIKIVRYPAQAETSQGVG

SEQ ID NO: 796427 - protein, 22 aa, Mycobacterium
ATLIPHLTFDPLRALQAIERHR

SEQ ID NO: 796428 - protein, 22 aa, Mycobacterium
ATLKAFHHDIGYRIAHHADLNA

SEQ ID NO: 796429 - protein, 29 aa, Mycobacterium
ATLKKRFAEKFWLPDRGYYALALDGDKRP

SEQ ID NO: 796430 - protein, 23 aa, Mycobacterium
ATLKLLRRVASVSEPPLLSAGGQ

SEQ ID NO: 796431 - protein, 20 aa, Mycobacterium
ATLLALRSLTTEIDVPVLWV

SEQ ID NO: 796432 - protein, 23 aa, Mycobacterium
ATLLHSLARIDDWARWLRAAGVD

SEQ ID NO: 796433 - protein, 18 aa, Mycobacterium
ATLLLADLGAEVVKIEPP

SEQ ID NO: 796434 - protein, 19 aa, Mycobacterium
ATLNVEPVRPYPSSSPLTS

SEQ ID NO: 796435 - protein, 24 aa, Mycobacterium
ATLQIGYFIMAVRAVGLAAGPMAG

SEQ ID NO: 796436 - protein, 30 aa, Mycobacterium
ATLQPYLGAYGHLVALREGDLAYLHVHPEG

SEQ ID NO: 796437 - protein, 23 aa, Mycobacterium
ATLQRSLIPPTLSPPRGLTAAAH

SEQ ID NO: 796438 - protein, 33 aa, Mycobacterium
ATLRDLGPVLYGDGWFYLTRREDVLAALRNPEV

SEQ ID NO: 796439 - protein, 22 aa, Mycobacterium
ATLRERSWKRSSFSGTEIFGKT

SEQ ID NO: 796440 - protein, 24 aa, Mycobacterium
ATLRLLRRVAQVVEPPLLQSGGHI

SEQ ID NO: 796441 - protein, 25 aa, Mycobacterium
ATLSLAPNILLIPGTSSVAHLEENI

SEQ ID NO: 796442 - protein, 21 aa, Mycobacterium
ATLSSMLYDVPAGRLDVLDEE

SEQ ID NO: 796443 - protein, 26 aa, Mycobacterium
ATLSTLGYPPFLLARLCSTIDHISHG

SEQ ID NO: 796444 - protein, 26 aa, Mycobacterium
ATLSTLPPRVLGRAAFQVLAGLTGAG

SEQ ID NO: 796445 - protein, 21 aa, Mycobacterium
ATLSTLRRGTQIRLITAMIVR

SEQ ID NO: 796446 - protein, 18 aa, Mycobacterium
ATLTDKHGERFLLGIGVS

SEQ ID NO: 796447 - protein, 23 aa, Mycobacterium
ATLTKILTYHVVPVQAAPADVIG

SEQ ID NO: 796448 - protein, 22 aa, Mycobacterium
ATLTLAWYHATTEQPPGSAVLY

SEQ ID NO: 796449 - protein, 24 aa, Mycobacterium
ATLTPTTWLPFGGGNRRCLGATFA

SEQ ID NO: 796450 - protein, 19 aa, Mycobacterium
ATLTVIVGMLHEIFERHMT

SEQ ID NO: 796451 - protein, 18 aa, Mycobacterium
ATLTVRRLMEVTVLGRPA

SEQ ID NO: 796452 - protein, 17 aa, Mycobacterium
ATLVEVFRRVDALGLEL

SEQ ID NO: 796453 - protein, 21 aa, Mycobacterium
ATLWPLYHDLIVKPEYHREWW

SEQ ID NO: 796454 - protein, 20 aa, Mycobacterium
ATLWPLYHDVIVKPEYHREW

SEQ ID NO: 796455 - protein, 21 aa, Mycobacterium
ATLWPLYHDVIVKPTYHREWW

SEQ ID NO: 796456 - protein, 20 aa, Mycobacterium
ATLYIGLSGLIDPTDPRFTA

SEQ ID NO: 796457 - protein, 23 aa, Mycobacterium
ATMAGWRTDFLNQMGLVIADSVK

SEQ ID NO: 796458 - protein, 25 aa, Mycobacterium
ATMASIHAFNLWLDEDWGFDRPDGR

SEQ ID NO: 796459 - protein, 26 aa, Mycobacterium
ATMASLHAFNLWLDEDWGFDRPDHRI

SEQ ID NO: 796460 - protein, 26 aa, Mycobacterium
ATMASLHAFNLWLDEDWGFDRPDHRV

SEQ ID NO: 796461 - protein, 30 aa, Mycobacterium
ATMASVHAFNLWLDEDWGFDRPGHRIISAP

SEQ ID NO: 796462 - protein, 26 aa, Mycobacterium
ATMASVHAFNLWLDEDWGFNRPDGRI

SEQ ID NO: 796463 - protein, 19 aa, Mycobacterium
ATMETAPAARFIRLVSMIR

SEQ ID NO: 796464 - protein, 19 aa, Mycobacterium
ATMHPSRYLTLIEGVRAVF

SEQ ID NO: 796465 - protein, 21 aa, Mycobacterium
ATMHPSRYLTLIEGVTAVFLT

SEQ ID NO: 796466 - protein, 26 aa, Mycobacterium
ATMKALANFFRIKPAYFTDDEYYEKL

SEQ ID NO: 796467 - protein, 24 aa, Mycobacterium
ATMKRLFLELGGKSATIVLEDAEF

SEQ ID NO: 796468 - protein, 21 aa, Mycobacterium
ATMLAARPAVRYINAASLQVI

SEQ ID NO: 796469 - protein, 18 aa, Mycobacterium
ATMLLADLGAEVTKIEPA

SEQ ID NO: 796470 - protein, 18 aa, Mycobacterium
ATMLLADLGAEVTKIEPR

SEQ ID NO: 796471 - protein, 18 aa, Mycobacterium
ATMLRMLLRPEEELDDAW

SEQ ID NO: 796472 - protein, 26 aa, Mycobacterium
ATMVAHGWLAGPPPGLRPFGTAIHKD

SEQ ID NO: 796473 - protein, 28 aa, Mycobacterium
ATNGLASLPLPAPGLGSGGYSLTAVFSN

SEQ ID NO: 796474 - protein, 24 aa, Mycobacterium
ATNIGFLLAVLDDPDFRAGRVTTS

SEQ ID NO: 796475 - protein, 20 aa, Mycobacterium
ATNIHLAFGPNKVLRGVDLD

SEQ ID NO: 796476 - protein, 18 aa, Mycobacterium
ATNISIITYAGHGQWCRQ

SEQ ID NO: 796477 - protein, 26 aa, Mycobacterium
ATNKQRPVSMFLRALARDLNASTPGK

SEQ ID NO: 796478 - protein, 26 aa, Mycobacterium
ATNLDLYRLPLVHLLIAARGLPARLA

SEQ ID NO: 796479 - protein, 19 aa, Mycobacterium
ATNLTALLRHRTVYAVDLL

SEQ ID NO: 796480 - protein, 20 aa, Mycobacterium
ATNPMWYLNIQANPKVTFQV

SEQ ID NO: 796481 - protein, 20 aa, Mycobacterium
ATNPPLLLATRHLIGDDGTY

SEQ ID NO: 796482 - protein, 32 aa, Mycobacterium
ATNPYDVMAWIDKYFHQPCDLGRAGLPEEVAS

SEQ ID NO: 796483 - protein, 25 aa, Mycobacterium
ATNQLIQLFDDYGRRPQWRRIGLID

SEQ ID NO: 796484 - protein, 25 aa, Mycobacterium
ATNRAGFYRAVPEGPFYGFNREGVE

SEQ ID NO: 796485 - protein, 24 aa, Mycobacterium
ATPAGWSHFDADRWELFHIEADRS

SEQ ID NO: 796486 - protein, 23 aa, Mycobacterium
ATPAGWSHFDADRWELFHIEKDR

SEQ ID NO: 796487 - protein, 22 aa, Mycobacterium
ATPAPFTLEQWAELAAAALEDA

SEQ ID NO: 796488 - protein, 27 aa, Mycobacterium
ATPARAFLRMYYLNKACEIQIAASQLG

SEQ ID NO: 796489 - protein, 24 aa, Mycobacterium
ATPATREWWGGMWADRIVGSRIAR

SEQ ID NO: 796490 - protein, 27 aa, Mycobacterium
ATPAVIDAMLLVRLPYHLSSVTQAAAR

SEQ ID NO: 796491 - protein, 22 aa, Mycobacterium
ATPAYLGFNLFGHAIARALITG

SEQ ID NO: 796492 - protein, 22 aa, Mycobacterium
ATPAYLGFNLFGHAIARAVIHG

SEQ ID NO: 796493 - protein, 17 aa, Mycobacterium
ATPAYYVPPAASPQPDT

SEQ ID NO: 796494 - protein, 18 aa, Mycobacterium
ATPDMRPRRGLNGDFQSL

SEQ ID NO: 796495 - protein, 24 aa, Mycobacterium
ATPEFGEELLAWLRDRLAHYKCPR

SEQ ID NO: 796496 - protein, 27 aa, Mycobacterium
ATPENIARYGLPTNSWILFGSPTHPKS

SEQ ID NO: 796497 - protein, 24 aa, Mycobacterium
ATPFWVHVTHGDPARLWLRLEDGS

SEQ ID NO: 796498 - protein, 24 aa, Mycobacterium
ATPGAFQLVLCDLGTPRPGDTQSY

SEQ ID NO: 796499 - protein, 17 aa, Mycobacterium
ATPGPDGWIRAVGYHDS

SEQ ID NO: 796500 - protein, 35 aa, Mycobacterium
ATPGRPLLRALAGPVRLLRSDGHRGRHLPVRIQPR

SEQ ID NO: 796501 - protein, 18 aa, Mycobacterium
ATPGSRVAVLLPAHWQTA

SEQ ID NO: 796502 - protein, 19 aa, Mycobacterium
ATPIPRTYLCSSATPPGGG

SEQ ID NO: 796503 - protein, 23 aa, Mycobacterium
ATPITNLFGLNLSTPPAGSYTNG

SEQ ID NO: 796504 - protein, 17 aa, Mycobacterium
ATPKGWMKALRAYNQSD

SEQ ID NO: 796505 - protein, 24 aa, Mycobacterium
ATPKPPLPPLPPTPPLPPAPPPTP

SEQ ID NO: 796506 - protein, 21 aa, Mycobacterium
ATPLGPIRRVRALGAAVGAHL

SEQ ID NO: 796507 - protein, 25 aa, Mycobacterium
ATPNGYPHPRLVWINGPTPHQHHAS

SEQ ID NO: 796508 - protein, 23 aa, Mycobacterium
ATPPGPDGWCSLSLHAGGTIGEL

SEQ ID NO: 796509 - protein, 23 aa, Mycobacterium
ATPPTFVAKLNTVDGRRVAAGRD

SEQ ID NO: 796510 - protein, 17 aa, Mycobacterium
ATPQRILLSGQMHGWTL

SEQ ID NO: 796511 - protein, 20 aa, Mycobacterium
ATPRHRGISILLVGHGPGLT

SEQ ID NO: 796512 - protein, 23 aa, Mycobacterium
ATPRMSTYLVALIAGPYARWDDV

SEQ ID NO: 796513 - protein, 20 aa, Mycobacterium
ATPRRLVWVHVSRPIVHVNG

SEQ ID NO: 796514 - protein, 19 aa, Mycobacterium
ATPRYDVTLTKAWGSDPFG

SEQ ID NO: 796515 - protein, 18 aa, Mycobacterium
ATPTARLMAFLGRSVDVG

SEQ ID NO: 796516 - protein, 23 aa, Mycobacterium
ATPTGTYVLACGKTLVIENGRLV

SEQ ID NO: 796517 - protein, 31 aa, Mycobacterium
ATPTWKKSFGLHPLLAFLDRPEIAGGKALAG

SEQ ID NO: 796518 - protein, 17 aa, Mycobacterium
ATPVLMLSARAGAEAVD

SEQ ID NO: 796519 - protein, 22 aa, Mycobacterium
ATPVRLMYRLLHATPFGDYDVL

SEQ ID NO: 796520 - protein, 23 aa, Mycobacterium
ATPVRLPARYVGTHTTLGYASTI

SEQ ID NO: 796521 - protein, 17 aa, Mycobacterium
ATPVRRMGRPEDIAATC

SEQ ID NO: 796522 - protein, 28 aa, Mycobacterium
ATPYSVLVAAFMVWIASYGRQRDMVVGA

SEQ ID NO: 796523 - protein, 21 aa, Mycobacterium
ATQDARWFSLCRVDGVTVTTA

SEQ ID NO: 796524 - protein, 33 aa, Mycobacterium
ATQDYRYIYAATGKPGWFLFDGLVRHDLRTGSE

SEQ ID NO: 796525 - protein, 29 aa, Mycobacterium
ATQESTLGLIFHWADQRGLPLLDLKDLRA

SEQ ID NO: 796526 - protein, 31 aa, Mycobacterium
ATQFHELIKRIFDIQRFSPVLVALRDVRFQP

SEQ ID NO: 796527 - protein, 31 aa, Mycobacterium
ATQFYSMLGMRALYHQGWLATTLHPPLSGWS

SEQ ID NO: 796528 - protein, 19 aa, Mycobacterium
ATQGTRLVPIPGAPPSVTN

SEQ ID NO: 796529 - protein, 27 aa, Mycobacterium
ATQILGMALCRFVLRLPPVVEMTRDEI

SEQ ID NO: 796530 - protein, 18 aa, Mycobacterium
ATQKAVLPAAKFTERTLA

SEQ ID NO: 796531 - protein, 17 aa, Mycobacterium
ATQLLEHYAILLDSALA

SEQ ID NO: 796532 - protein, 24 aa, Mycobacterium
ATQLPEEFWSAHPVLGHIRAFAHY

SEQ ID NO: 796533 - protein, 26 aa, Mycobacterium
ATQLSKMYVLPEFHQAGVAALLMSAA

SEQ ID NO: 796534 - protein, 29 aa, Mycobacterium
ATQNILTAEGIPASLQAPIRGRNAGDAAG

SEQ ID NO: 796535 - protein, 17 aa, Mycobacterium
ATQPGTAALPVGYFGAS

SEQ ID NO: 796536 - protein, 19 aa, Mycobacterium
ATQPRMLALTARYAHEWNQ

SEQ ID NO: 796537 - protein, 28 aa, Mycobacterium
ATQPTGWILEGLLPYLPGAAQDALFERL

SEQ ID NO: 796538 - protein, 20 aa, Mycobacterium
ATQQAVLPTAKFTDRVLAEV

SEQ ID NO: 796539 - protein, 17 aa, Mycobacterium
ATQTPLSALLLAEVFHE

SEQ ID NO: 796540 - protein, 27 aa, Mycobacterium
ATRAGDSWILNGFKWFASNCAGEAFVV

SEQ ID NO: 796541 - protein, 18 aa, Mycobacterium
ATRAIVARELYDDFVAGV

SEQ ID NO: 796542 - protein, 22 aa, Mycobacterium
ATRASAGIGLLPCFMADRHDDL

SEQ ID NO: 796543 - protein, 22 aa, Mycobacterium
ATRAVLPVLQSWLSRDVTGTLV

SEQ ID NO: 796544 - protein, 20 aa, Mycobacterium
ATRDPVMCHNGFQIFGGGVL

SEQ ID NO: 796545 - protein, 21 aa, Mycobacterium
ATRDPVMCHSGFQIFGGGVLG

SEQ ID NO: 796546 - protein, 21 aa, Mycobacterium
ATRDRFVEVVAWAAQVAASLG

SEQ ID NO: 796547 - protein, 23 aa, Mycobacterium
ATREALFELVDDPVVRMLFTLHG

SEQ ID NO: 796548 - protein, 29 aa, Mycobacterium
ATRETLAAGYWQWVELLQAAIRRMKDDGA

SEQ ID NO: 796549 - protein, 21 aa, Mycobacterium
ATREWLATNPARIGQAALLKP

SEQ ID NO: 796550 - protein, 20 aa, Mycobacterium
ATRFALQELDYLFATATAPG

SEQ ID NO: 796551 - protein, 22 aa, Mycobacterium
ATRFAWMGRPAPTLLRAVEPVL

SEQ ID NO: 796552 - protein, 20 aa, Mycobacterium
ATRFLALLGADVLRVDPPSN

SEQ ID NO: 796553 - protein, 23 aa, Mycobacterium
ATRGERLALFRFTFASQDSLPEA

SEQ ID NO: 796554 - protein, 19 aa, Mycobacterium
ATRGISPRVLFLEASDESL

SEQ ID NO: 796555 - protein, 22 aa, Mycobacterium
ATRGLDLSMFVLCSSIAATVGS

SEQ ID NO: 796556 - protein, 25 aa, Mycobacterium
ATRGPWQVMPDTFATFHQPGTSNSA

SEQ ID NO: 796557 - protein, 22 aa, Mycobacterium
ATRIGFTLPQRPAATLAYAGKM

SEQ ID NO: 796558 - protein, 18 aa, Mycobacterium
ATRIVAWFRHGAAPRVTA

SEQ ID NO: 796559 - protein, 24 aa, Mycobacterium
ATRKALLEALLRHVPTGDLDIDEI

SEQ ID NO: 796560 - protein, 24 aa, Mycobacterium
ATRKSLLEVLLAKVPSQNLQLDEI

SEQ ID NO: 796561 - protein, 28 aa, Mycobacterium
ATRLRLADRGYIRPGYAADLVLFDPQTV

SEQ ID NO: 796562 - protein, 18 aa, Mycobacterium
ATRLVRSWLGLPSRAVYK

SEQ ID NO: 796563 - protein, 32 aa, Mycobacterium
ATRMHGRLTQCQPGWLLAPPIAYGASGEHQSF

SEQ ID NO: 796564 - protein, 26 aa, Mycobacterium
ATRNPLRLKRFGWFDDITPVTLDAAD

SEQ ID NO: 796565 - protein, 31 aa, Mycobacterium
ATRNWALDQPARWALLYGSPVPGYHAPAERT

SEQ ID NO: 796566 - protein, 26 aa, Mycobacterium
ATRPDARVWVLVRRQSLGRFERLAAD

SEQ ID NO: 796567 - protein, 20 aa, Mycobacterium
ATRPSAWIAEGLLIYLPAAA

SEQ ID NO: 796568 - protein, 30 aa, Mycobacterium
ATRPTAWLAEGLLIYLPPEAQDALFDTVTA

SEQ ID NO: 796569 - protein, 26 aa, Mycobacterium
ATRPVHFVQMWIVPDQTGIAPSYQQH

SEQ ID NO: 796570 - protein, 30 aa, Mycobacterium
ATRPWQHVLDCLSGYLLLGRRLLAGDDSCA

SEQ ID NO: 796571 - protein, 17 aa, Mycobacterium
ATRQIFRRHGMSATFMA

SEQ ID NO: 796572 - protein, 28 aa, Mycobacterium
ATRQTIGSFIIPPMPFDYVPVVHGHFKA

SEQ ID NO: 796573 - protein, 23 aa, Mycobacterium
ATRRACAAWLWSRRRGIVAGRSA

SEQ ID NO: 796574 - protein, 19 aa, Mycobacterium
ATRRLEILEVSRSGLRRAG

SEQ ID NO: 796575 - protein, 19 aa, Mycobacterium
ATRRWMERFIDYATAKSGM

SEQ ID NO: 796576 - protein, 18 aa, Mycobacterium
ATRRYPGADRPALDNLDL

SEQ ID NO: 796577 - protein, 20 aa, Mycobacterium
ATRTIGVTPGSCGCANYTRE

SEQ ID NO: 796578 - protein, 20 aa, Mycobacterium
ATRVARPDLLALGALLHDIG

SEQ ID NO: 796579 - protein, 18 aa, Mycobacterium
ATRVILALRVVPRSANGL

SEQ ID NO: 796580 - protein, 24 aa, Mycobacterium
ATRVPQEWLLPYVHQRYDEPHDAP

SEQ ID NO: 796581 - protein, 22 aa, Mycobacterium
ATRWADALAPYGLRWYEEPGDP

SEQ ID NO: 796582 - protein, 24 aa, Mycobacterium
ATRWRVGFSGFAPGFAYLIGGDPR

SEQ ID NO: 796583 - protein, 26 aa, Mycobacterium
ATRYEWPIIDFAILSIGAVTVPIYET

SEQ ID NO: 796584 - protein, 24 aa, Mycobacterium
ATRYEWTIIDYAVLSIGAITVPIY

SEQ ID NO: 796585 - protein, 21 aa, Mycobacterium
ATRYHSLTILPDTVPEGLRVI

SEQ ID NO: 796586 - protein, 24 aa, Mycobacterium
ATSALLAALPPALVPAATALMNAA

SEQ ID NO: 796587 - protein, 27 aa, Mycobacterium
ATSASTPLFFAQAIGRFVRSRRAGETA

SEQ ID NO: 796588 - protein, 28 aa, Mycobacterium
ATSASTPLFFAQAIGRFVRSRRQGETAS

SEQ ID NO: 796589 - protein, 28 aa, Mycobacterium
ATSASTPLFFAQAVGRFVRSRRPGETAS

SEQ ID NO: 796590 - protein, 20 aa, Mycobacterium
ATSCPFAEQVRLAYGAGAPA

SEQ ID NO: 796591 - protein, 24 aa, Mycobacterium
ATSELDWFCAFSSAAALVGSPGQG

SEQ ID NO: 796592 - protein, 27 aa, Mycobacterium
ATSEVTSAPWWTDTWVADTVDRAPARF

SEQ ID NO: 796593 - protein, 22 aa, Mycobacterium
ATSLAVFQLIPDPVAAVSEIVR

SEQ ID NO: 796594 - protein, 23 aa, Mycobacterium
ATSLVTVWQRAPMQALARLHALA

SEQ ID NO: 796595 - protein, 28 aa, Mycobacterium
ATSLYHCALPPMGSWLPTYVDLTRSLIT

SEQ ID NO: 796596 - protein, 38 aa, Mycobacterium
ATSNQALLDVINAPTQALLDRPLIGNGANGAAGTGANG

SEQ ID NO: 796597 - protein, 25 aa, Mycobacterium
ATSRAPRWAVAYKYPPEEATTKLLD

SEQ ID NO: 796598 - protein, 18 aa, Mycobacterium
ATSRPIKLMGIDSVLALY

SEQ ID NO: 796599 - protein, 30 aa, Mycobacterium
ATSRPIRLMGIDAMLPLYDALDDALNDISD

SEQ ID NO: 796600 - protein, 20 aa, Mycobacterium
ATSRPLKLVGIADVVDLFAT

SEQ ID NO: 796601 - protein, 26 aa, Mycobacterium
ATSRPPTFVLFTSGFLEAGYRRFLER

SEQ ID NO: 796602 - protein, 24 aa, Mycobacterium
ATSSFSMSWQITRKLMPVRFEVDE

SEQ ID NO: 796603 - protein, 29 aa, Mycobacterium
ATSSGRGLWELAWPPLSSAGAPGAAVVAE

SEQ ID NO: 796604 - protein, 23 aa, Mycobacterium
ATSTHFLQTPACAPIVAAALGCQ

SEQ ID NO: 796605 - protein, 23 aa, Mycobacterium
ATSTHFLQTPACAPIVAAALGTQ

SEQ ID NO: 796606 - protein, 24 aa, Mycobacterium
ATSTSVLARILAAGAARAAGTTSP

SEQ ID NO: 796607 - protein, 25 aa, Mycobacterium
ATSTYLFTHPDVNEFFTGLRGQERD

SEQ ID NO: 796608 - protein, 23 aa, Mycobacterium
ATTASVYSKLMASAAKLKATFAA

SEQ ID NO: 796609 - protein, 26 aa, Mycobacterium
ATTDQPLDWFCSFSSAAAMLGSPGQG

SEQ ID NO: 796610 - protein, 36 aa, Mycobacterium
ATTDVGALLALARRLLLDPVQIGPIRLLGVGFSGLS

SEQ ID NO: 796611 - protein, 37 aa, Mycobacterium
ATTEAGALIAVARRLLLDPIEIGPIRLLGVGFSGLSE

SEQ ID NO: 796612 - protein, 24 aa, Mycobacterium
ATTEASTLIGTARRLLLDPVEIGP

SEQ ID NO: 796613 - protein, 25 aa, Mycobacterium
ATTFGSMWLDVPRPEYPALTQPVSC

SEQ ID NO: 796614 - protein, 30 aa, Mycobacterium
ATTGLRLANPPLLVPVLRAGLGMVDEAHAA

SEQ ID NO: 796615 - protein, 20 aa, Mycobacterium
ATTLDWTIHLTFDTAEVAVA

SEQ ID NO: 796616 - protein, 20 aa, Mycobacterium
ATTLLRSWVHLSMAQLSEVI

SEQ ID NO: 796617 - protein, 23 aa, Mycobacterium
ATTLPGYMMPSSLTVLDVLPKTE

SEQ ID NO: 796618 - protein, 20 aa, Mycobacterium
ATTMPKPWVKWSYEPARAED

SEQ ID NO: 796619 - protein, 18 aa, Mycobacterium
ATTPAEILVWEMHAGIGA

SEQ ID NO: 796620 - protein, 26 aa, Mycobacterium
ATTPARMFGLYPRKGIVSPGADADVV

SEQ ID NO: 796621 - protein, 30 aa, Mycobacterium
ATTPDAVLLGLFKALPGDLSILYPSPAEDK

SEQ ID NO: 796622 - protein, 20 aa, Mycobacterium
ATTPYVTWLKATAAQAELAA

SEQ ID NO: 796623 - protein, 28 aa, Mycobacterium
ATTRIRLMTYILVSGYRNPYLTAKAAAS

SEQ ID NO: 796624 - protein, 21 aa, Mycobacterium
ATTRWPAVQFAIRNTPVQGPH

SEQ ID NO: 796625 - protein, 17 aa, Mycobacterium
ATTSIVGLYALSAGLIP

SEQ ID NO: 796626 - protein, 35 aa, Mycobacterium
ATTTALAHGVWLRPFGKLIYAMPPFICTPEEVAQI

SEQ ID NO: 796627 - protein, 30 aa, Mycobacterium
ATTTLNFNFFVLKLPIRPPALVAKQAGSLN

SEQ ID NO: 796628 - protein, 26 aa, Mycobacterium
ATTVLLAQMFAAGVRRLVLASSMVVY

SEQ ID NO: 796629 - protein, 22 aa, Mycobacterium
ATTVPSLRLLGYGGSRAIAADV

SEQ ID NO: 796630 - protein, 19 aa, Mycobacterium
ATTWFPNDIGRFGRPEEVA

SEQ ID NO: 796631 - protein, 24 aa, Mycobacterium
ATTWPECILFERDDDGLIVHVSVF

SEQ ID NO: 796632 - protein, 23 aa, Mycobacterium
ATVAACHQPFFSTDDWFIGTTEM

SEQ ID NO: 796633 - protein, 19 aa, Mycobacterium
ATVALFRLSRTLKYKAKPG

SEQ ID NO: 796634 - protein, 17 aa, Mycobacterium
ATVARLSDYPYLVPLID

SEQ ID NO: 796635 - protein, 18 aa, Mycobacterium
ATVATAFIGGGNTATASA

SEQ ID NO: 796636 - protein, 19 aa, Mycobacterium
ATVENLSLGGLLPINTNGG

SEQ ID NO: 796637 - protein, 23 aa, Mycobacterium
ATVEWLTTVLAEDALGGPAALRR

SEQ ID NO: 796638 - protein, 20 aa, Mycobacterium
ATVGKPIVLQVTSDVADQLH

SEQ ID NO: 796639 - protein, 26 aa, Mycobacterium
ATVGLSYLGFTQWALLADPPPEMKAA

SEQ ID NO: 796640 - protein, 31 aa, Mycobacterium
ATVHMLRRTTPLRLFWARDYSDYHPEEPGGS

SEQ ID NO: 796641 - protein, 25 aa, Mycobacterium
ATVLLRTLPLMVHGASAGAAILIRD

SEQ ID NO: 796642 - protein, 25 aa, Mycobacterium
ATVLNNWIRQGTVQRGLVVSGEYIS

SEQ ID NO: 796643 - protein, 23 aa, Mycobacterium
ATVLQWVTTFGNPLTWDDLPWLR

SEQ ID NO: 796644 - protein, 28 aa, Mycobacterium
ATVLTRNTFHWVLAFSPGGLSTAKVFAE

SEQ ID NO: 796645 - protein, 26 aa, Mycobacterium
ATVLTTTLPDPTGYGRILRTQDHEII

SEQ ID NO: 796646 - protein, 28 aa, Mycobacterium
ATVPFNVTGLPALSLRFGTSSAGLPINV

SEQ ID NO: 796647 - protein, 20 aa, Mycobacterium
ATVPPPIVAANRIQLATLIA

SEQ ID NO: 796648 - protein, 25 aa, Mycobacterium
ATVPPPQIEVNRALLASLVATNILG

SEQ ID NO: 796649 - protein, 17 aa, Mycobacterium
ATVPPPVIAANRAHLAA

SEQ ID NO: 796650 - protein, 28 aa, Mycobacterium
ATVPVLLDAIYNPWPTPLAAAVAAAGGR

SEQ ID NO: 796651 - protein, 29 aa, Mycobacterium
ATVPVYALPSYFMAAATPLYSLSSILGMA

SEQ ID NO: 796652 - protein, 25 aa, Mycobacterium
ATVQRRYQPMFTALGWDPLGDVEIA

SEQ ID NO: 796653 - protein, 20 aa, Mycobacterium
ATVRLVLVGGGPGAGKSTLA

SEQ ID NO: 796654 - protein, 18 aa, Mycobacterium
ATVRPFVFEFPTLPGTDE

SEQ ID NO: 796655 - protein, 24 aa, Mycobacterium
ATVRRFIDRFAKFNLSQSAIRPSY

SEQ ID NO: 796656 - protein, 21 aa, Mycobacterium
ATVRSFYITVPGSLTAWPQDP

SEQ ID NO: 796657 - protein, 17 aa, Mycobacterium
ATVSRLSPRRVAAYLAK

SEQ ID NO: 796658 - protein, 23 aa, Mycobacterium
ATVTEIIYAGPLTRIAATTAGGV

SEQ ID NO: 796659 - protein, 23 aa, Mycobacterium
ATVVIDQWAVPITAKSVRIRNLA

SEQ ID NO: 796660 - protein, 20 aa, Mycobacterium
ATVVPRPWMTPSPARIDAEY

SEQ ID NO: 796661 - protein, 26 aa, Mycobacterium
ATVVSALTSGPWLGPSAVAMAAAASP

SEQ ID NO: 796662 - protein, 31 aa, Mycobacterium
ATVYQDLAVVSLMPVWRNFFLGNELRKKNIL

SEQ ID NO: 796663 - protein, 19 aa, Mycobacterium
ATVYRYFPSREAVMSGVII

SEQ ID NO: 796664 - protein, 17 aa, Mycobacterium
ATVYRYFPSRESVISGV

SEQ ID NO: 796665 - protein, 23 aa, Mycobacterium
ATWASSISGYWRRGRTEETFREW

SEQ ID NO: 796666 - protein, 18 aa, Mycobacterium
ATWDYFPGHFDPGYARHQ

SEQ ID NO: 796667 - protein, 18 aa, Mycobacterium
ATWKRLCDPMAQQISTVW

SEQ ID NO: 796668 - protein, 20 aa, Mycobacterium
ATWMLQRITGPQAARAALLF

SEQ ID NO: 796669 - protein, 25 aa, Mycobacterium
ATWPASLRAWRRVRDYRPHVVIAEL

SEQ ID NO: 796670 - protein, 19 aa, Mycobacterium
ATWQRHHVLAEAQRLVRSS

SEQ ID NO: 796671 - protein, 22 aa, Mycobacterium
ATWRDIRRHLDGLKADDQLIGR

SEQ ID NO: 796672 - protein, 23 aa, Mycobacterium
ATWTIATPLVRPVSYTLPALPTA

SEQ ID NO: 796673 - protein, 22 aa, Mycobacterium
ATYADYVGPFIAPVGAVRTIAA

SEQ ID NO: 796674 - protein, 30 aa, Mycobacterium
ATYAFDLEWQIPDTPPVAPPLLVHTGSIAA

SEQ ID NO: 796675 - protein, 20 aa, Mycobacterium
ATYCRVRAMLRNITGLAIVD

SEQ ID NO: 796676 - protein, 18 aa, Mycobacterium
ATYDSFHRLLRRATDPDP

SEQ ID NO: 796677 - protein, 17 aa, Mycobacterium
ATYFDLPAATPASPVTV

SEQ ID NO: 796678 - protein, 22 aa, Mycobacterium
ATYFSTTYGTPYFFSANAFHRD

SEQ ID NO: 796679 - protein, 23 aa, Mycobacterium
ATYKAEFTHHHYARRPWARPLSH

SEQ ID NO: 796680 - protein, 28 aa, Mycobacterium
ATYLFTNDYEWDLLLQKSGWSEAEVMGQ

SEQ ID NO: 796681 - protein, 21 aa, Mycobacterium
ATYLRPPATVVMARRARPPRQ

SEQ ID NO: 796682 - protein, 21 aa, Mycobacterium
ATYPVSIPIHGMALNITLQSY

SEQ ID NO: 796683 - protein, 23 aa, Mycobacterium
ATYRPLVAPLRAAGIPKPHRRNS

SEQ ID NO: 796684 - protein, 19 aa, Mycobacterium
ATYSGLALMVLRRAAGLPV

SEQ ID NO: 796685 - protein, 25 aa, Mycobacterium
ATYSYSFEPNPYWSRLFAPGSELKQ

SEQ ID NO: 796686 - protein, 24 aa, Mycobacterium
ATYTGLLEPIRKAFAKANGVKPAL

SEQ ID NO: 796687 - protein, 28 aa, Mycobacterium
ATYTLFTKLKRVALTRNVLLPVGTDYTP

SEQ ID NO: 796688 - protein, 24 aa, Mycobacterium
AVAAAFRDNGFRRGTIVARNRDTG

SEQ ID NO: 796689 - protein, 20 aa, Mycobacterium
AVAAALQRYVDGDAAGAQGI

SEQ ID NO: 796690 - protein, 31 aa, Mycobacterium
AVAAARLRPERLVFWDCYRPHEVQVRMFEVV

SEQ ID NO: 796691 - protein, 17 aa, Mycobacterium
AVAADMSAFFADNPFRF

SEQ ID NO: 796692 - protein, 19 aa, Mycobacterium
AVAAFREGVRLLTGEPVMR

SEQ ID NO: 796693 - protein, 18 aa, Mycobacterium
AVAAHRAVATSTAAATVT

SEQ ID NO: 796694 - protein, 27 aa, Mycobacterium
AVAAKRGWPILKFSSRSGASPASQVRT

SEQ ID NO: 796695 - protein, 24 aa, Mycobacterium
AVAALAAGALICTRAATDTARTAG

SEQ ID NO: 796696 - protein, 28 aa, Mycobacterium
AVAALHAGPIPVFGPALRLDAVRIGATP

SEQ ID NO: 796697 - protein, 22 aa, Mycobacterium
AVAALQQLAAQCPVAILSGRDL

SEQ ID NO: 796698 - protein, 27 aa, Mycobacterium
AVAANRNVFVQLVMSNLFGQNAPAIAA

SEQ ID NO: 796699 - protein, 20 aa, Mycobacterium
AVAAQLGTAFLLAEEAGSSD

SEQ ID NO: 796700 - protein, 36 aa, Mycobacterium
AVAARPFEYWRQRLKTMKGQWAPFQSLIELADDEQA

SEQ ID NO: 796701 - protein, 29 aa, Mycobacterium
AVAARVPRLLFLGSSCIYPKYAPQPISEN

SEQ ID NO: 796702 - protein, 24 aa, Mycobacterium
AVAATMPMITWLQTTAAQAQKRAL

SEQ ID NO: 796703 - protein, 26 aa, Mycobacterium
AVAAVKLIPFALATRAIRAVTSLPQH

SEQ ID NO: 796704 - protein, 19 aa, Mycobacterium
AVAAWPGAWQGQNLRDILI

SEQ ID NO: 796705 - protein, 17 aa, Mycobacterium
AVACGIAGLAAWLPLTR

SEQ ID NO: 796706 - protein, 26 aa, Mycobacterium
AVACGLARHVLCFRTLWEATHGELMK

SEQ ID NO: 796707 - protein, 26 aa, Mycobacterium
AVADAALAVWLRMWNSDSRIARRICS

SEQ ID NO: 796708 - protein, 21 aa, Mycobacterium
AVADALRPFDPGLDPQRLAEQ

SEQ ID NO: 796709 - protein, 17 aa, Mycobacterium
AVADHMPDLTPIAAPER

SEQ ID NO: 796710 - protein, 17 aa, Mycobacterium
AVADHMPDLTPIGEPER

SEQ ID NO: 796711 - protein, 31 aa, Mycobacterium
AVADLFAAFGMFAVGFYDLRSARSPIPVVST

SEQ ID NO: 796712 - protein, 26 aa, Mycobacterium
AVADLGEYFLGLGYVAAAQAALAGGD

SEQ ID NO: 796713 - protein, 20 aa, Mycobacterium
AVADLVAEYGPDVALPPSEL

SEQ ID NO: 796714 - protein, 17 aa, Mycobacterium
AVADPSGHTAFDASGQS

SEQ ID NO: 796715 - protein, 25 aa, Mycobacterium
AVADRASWRRWWPDLRLQVVEDRAD

SEQ ID NO: 796716 - protein, 34 aa, Mycobacterium
AVADRILPVLAGRPLTVLRALRGRAPFMQKNVPK

SEQ ID NO: 796717 - protein, 25 aa, Mycobacterium
AVADRSSWSRWWPDLRLEVVEDRGE

SEQ ID NO: 796718 - protein, 31 aa, Mycobacterium
AVADTFWVNLIGRGYPAPRPKFRWCTERLKI

SEQ ID NO: 796719 - protein, 24 aa, Mycobacterium
AVADWIAMFSTWPVKPTPGMRAQL

SEQ ID NO: 796720 - protein, 28 aa, Mycobacterium
AVADWIKVVCFPDRWLDLRYIGPASAEG

SEQ ID NO: 796721 - protein, 32 aa, Mycobacterium; identical to SEQ ID NO: 113522

SEQ ID NO: 796722 - protein, 19 aa, Mycobacterium
AVAECLTPDSYYALARATY

SEQ ID NO: 796723 - protein, 23 aa, Mycobacterium
AVAEFVPRIGTLIDIVHRHHLTS

SEQ ID NO: 796724 - protein, 23 aa, Mycobacterium
AVAEHALGFMLDLAKKITVSDRA

SEQ ID NO: 796725 - protein, 26 aa, Mycobacterium
AVAEHMSPPLPLIGAGELVSTAAKTL

SEQ ID NO: 796726 - protein, 27 aa, Mycobacterium
AVAENLRYVAAWNAAFLPSKDLTEGIS

SEQ ID NO: 796727 - protein, 24 aa, Mycobacterium
AVAEPPLKLVLIENPGHGGTLNHL

SEQ ID NO: 796728 - protein, 19 aa, Mycobacterium
AVAERGAMFDPSAVFYMNK

SEQ ID NO: 796729 - protein, 29 aa, Mycobacterium
AVAFLPEHRVLFSGDLLTRGIVKVVWSGS

SEQ ID NO: 796730 - protein, 19 aa, Mycobacterium
AVAFPRSPFVTAAAAWELQ

SEQ ID NO: 796731 - protein, 19 aa, Mycobacterium
AVAFPRSPFVTAASAWELQ

SEQ ID NO: 796732 - protein, 19 aa, Mycobacterium
AVAFPRSPFVTAATAWELQ

SEQ ID NO: 796733 - protein, 20 aa, Mycobacterium
AVAFPRSPFVTAATAWELQE

SEQ ID NO: 796734 - protein, 24 aa, Mycobacterium
AVAFTLTRTGLVKLLLAGEDPGRL

SEQ ID NO: 796735 - protein, 18 aa, Mycobacterium
AVAGALPELPFACQLGTR

SEQ ID NO: 796736 - protein, 18 aa, Mycobacterium
AVAGATNGLGGNGGDGGS

SEQ ID NO: 796737 - protein, 26 aa, Mycobacterium
AVAGGLELALWCDLRIVEQDAVLGVF

SEQ ID NO: 796738 - protein, 42 aa, Mycobacterium
AVAGGRLGGFVIPGLSIGNRGLLNLGLGNTGNLNLGWGNAGN

SEQ ID NO: 796739 - protein, 17 aa, Mycobacterium
AVAGHRRARPIRRQRHH

SEQ ID NO: 796740 - protein, 23 aa, Mycobacterium
AVAGRDPSLPRPPRGEAPDRNLA

SEQ ID NO: 796741 - protein, 22 aa, Mycobacterium
AVAGRLARLRPGLDVRVAFCEQ

SEQ ID NO: 796742 - protein, 24 aa, Mycobacterium
AVAGVVRRLGHVPLAIAMAASYFR

SEQ ID NO: 796743 - protein, 25 aa, Mycobacterium
AVAGWSEALLLRVDRRNQVLISDGR

SEQ ID NO: 796744 - protein, 29 aa, Mycobacterium
AVAHDAFDAVMLYPFLTVDAVRTVVERLR

SEQ ID NO: 796745 - protein, 26 aa, Mycobacterium
AVAHPAQWALLYGSPVPGYHAPPERT

SEQ ID NO: 796746 - protein, 21 aa, Mycobacterium
AVAICLPRSWQLVCVMLGIRR

SEQ ID NO: 796747 - protein, 23 aa, Mycobacterium
AVAIDYLFSHRGGWAAQTAVGKT

SEQ ID NO: 796748 - protein, 23 aa, Mycobacterium
AVAIEYLYTQRPSWPGGIAVGKT

SEQ ID NO: 796749 - protein, 17 aa, Mycobacterium
AVAILRLANMIGPAMDT

SEQ ID NO: 796750 - protein, 27 aa, Mycobacterium
AVAINALLDRLPGLRLDPSAPAPHVVG

SEQ ID NO: 796751 - protein, 26 aa, Mycobacterium
AVAIVNLLRILLSNPAVWEKTALIVG

SEQ ID NO: 796752 - protein, 22 aa, Mycobacterium
AVAKARFVRVSPRKARRVIDLV

SEQ ID NO: 796753 - protein, 17 aa, Mycobacterium
AVAKLANILFTKELDRR

SEQ ID NO: 796754 - protein, 53 aa, Mycobacterium
AVAKLFGGYAQQFQALGAQASLFHDQFVQALNGGGFLYAATEAASASPLQAAA

SEQ ID NO: 796755 - protein, 24 aa, Mycobacterium
AVAKLPPWNEVLQNLGFSNTTTAV

SEQ ID NO: 796756 - protein, 26 aa, Mycobacterium
AVAKRLMHVLGTSAYVPDLLLRAPRV

SEQ ID NO: 796757 - protein, 25 aa, Mycobacterium
AVAKRLMHVLGTSAYVPELLMKAPE

SEQ ID NO: 796758 - protein, 26 aa, Mycobacterium
AVAKRLMRVLGTSAYIPELLMRAPEV

SEQ ID NO: 796759 - protein, 19 aa, Mycobacterium
AVALAAALHADVCEIYTDV

SEQ ID NO: 796760 - protein, 19 aa, Mycobacterium
AVALAAALNADVCEIYTDV

SEQ ID NO: 796761 - protein, 17 aa, Mycobacterium
AVALAAYRRGARAVAAM

SEQ ID NO: 796762 - protein, 23 aa, Mycobacterium
AVALALDPVVLVSSYSALFPPPD

SEQ ID NO: 796763 - protein, 18 aa, Mycobacterium
AVALAQFFDVPLVSTIHA

SEQ ID NO: 796764 - protein, 19 aa, Mycobacterium
AVALATWGNLFAVSERDSA

SEQ ID NO: 796765 - protein, 24 aa, Mycobacterium
AVALPFTNLIDYRLQITYEGADPY

SEQ ID NO: 796766 - protein, 18 aa, Mycobacterium
AVALPYCDLFLSAHSLAG

SEQ ID NO: 796767 - protein, 26 aa, Mycobacterium
AVALQDFILMNKTLCGTVFGSCNPKS

SEQ ID NO: 796768 - protein, 20 aa, Mycobacterium
AVALQYFHAAPWVAWSDAGG

SEQ ID NO: 796769 - protein, 26 aa, Mycobacterium
AVAMDALVHILLDDPRRARVLLGGVA

SEQ ID NO: 796770 - protein, 20 aa, Mycobacterium
AVAMFPSWETLPHERLSPGV

SEQ ID NO: 796771 - protein, 33 aa, Mycobacterium
AVAMLPGWARKPLWLPYFPPLEATAVRAAGRVL

SEQ ID NO: 796772 - protein, 24 aa, Mycobacterium
AVANTPQAYWLDQAFPAGSVGARV

SEQ ID NO: 796773 - protein, 18 aa, Mycobacterium
AVAPAAHNLLLLGDPQQL

SEQ ID NO: 796774 - protein, 17 aa, Mycobacterium
AVAPHLKAQGWGRIINI

SEQ ID NO: 796775 - protein, 20 aa, Mycobacterium
AVAPVAPKPPAVPAGLAWRR

SEQ ID NO: 796776 - protein, 19 aa, Mycobacterium
AVAPWIHRGLTSQDVLDTG

SEQ ID NO: 796777 - protein, 20 aa, Mycobacterium
AVAPWIHRGLTSQDVLDTGL

SEQ ID NO: 796778 - protein, 25 aa, Mycobacterium
AVAPYALFTLVQYNLGLIADTVPGK

SEQ ID NO: 796779 - protein, 26 aa, Mycobacterium
AVAQHMSPPLPLIGAGELVSAAAKTL

SEQ ID NO: 796780 - protein, 21 aa, Mycobacterium
AVAQHMSPPLPLVGSGEPLST

SEQ ID NO: 796781 - protein, 17 aa, Mycobacterium
AVAQVLKRRAPAGARVI

SEQ ID NO: 796782 - protein, 22 aa, Mycobacterium
AVARAAGIGELKFFSKIHYGGG

SEQ ID NO: 796783 - protein, 17 aa, Mycobacterium
AVARARDWPAPPAGPWW

SEQ ID NO: 796784 - protein, 30 aa, Mycobacterium
AVAREVACDVKYLARRRTEQLNLEGVRGNG

SEQ ID NO: 796785 - protein, 24 aa, Mycobacterium
AVARGDHLRAIRAGGLKLVTQAGE

SEQ ID NO: 796786 - protein, 18 aa, Mycobacterium
AVARIGRGWLTRDDKHAW

SEQ ID NO: 796787 - protein, 24 aa, Mycobacterium
AVARLVAISKRRKARRTKGPLSLV

SEQ ID NO: 796788 - protein, 18 aa, Mycobacterium
AVARLVLGPGMRIQAPPN

SEQ ID NO: 796789 - protein, 22 aa, Mycobacterium
AVARQLLTRPFGAAVLGPVRSK

SEQ ID NO: 796790 - protein, 26 aa, Mycobacterium
AVARQQRILPFAPANRANGPATGIAD

SEQ ID NO: 796791 - protein, 26 aa, Mycobacterium
AVARRLARFGAGWIPWGPDARDVAAG

SEQ ID NO: 796792 - protein, 25 aa, Mycobacterium
AVARRLMHVLGTSAYVPDLLMRAPR

SEQ ID NO: 796793 - protein, 24 aa, Mycobacterium
AVARRNPYAMVLPVRQHGSVLAHT

SEQ ID NO: 796794 - protein, 28 aa, Mycobacterium
AVARSRAHQLLRLPLRALHATSSGRRRP

SEQ ID NO: 796795 - protein, 24 aa, Mycobacterium
AVARVFLGSRATKIVRHSPVPVVV

SEQ ID NO: 796796 - protein, 24 aa, Mycobacterium
AVARYCVVPPWREGGQAQFIDRRL

SEQ ID NO: 796797 - protein, 23 aa, Mycobacterium
AVASFFAKNFLPLLASTREVIET

SEQ ID NO: 796798 - protein, 24 aa, Mycobacterium
AVASFFAKNFLPLLTSTRDVIETL

SEQ ID NO: 796799 - protein, 23 aa, Mycobacterium
AVASFFAKNFLPLLTSTREVIDT

SEQ ID NO: 796800 - protein, 22 aa, Mycobacterium
AVASFYSMYRREPTGDYLVGVC

SEQ ID NO: 796801 - protein, 23 aa, Mycobacterium
AVASFYTMYRRGPTGEYLVGVCT

SEQ ID NO: 796802 - protein, 20 aa, Mycobacterium
AVASILGVRHRIDYEGQAAI

SEQ ID NO: 796803 - protein, 18 aa, Mycobacterium
AVASLDLGLPLAAGNVVS

SEQ ID NO: 796804 - protein, 20 aa, Mycobacterium
AVASLLGVRHRIDYEGQAAI

SEQ ID NO: 796805 - protein, 20 aa, Mycobacterium
AVASLLGVRHRIDYEGQAAV

SEQ ID NO: 796806 - protein, 23 aa, Mycobacterium
AVATFYSMYRRTPTGDYLVGVCT

SEQ ID NO: 796807 - protein, 23 aa, Mycobacterium
AVATFYSMYRRTPTGEYLVGVCT

SEQ ID NO: 796808 - protein, 36 aa, Mycobacterium
AVATLLPDYMIPTRIVFFEHLPLTANGKLDRRAVAA

SEQ ID NO: 796809 - protein, 23 aa, Mycobacterium
AVATTWHYLFSVAATVASAWEFG

SEQ ID NO: 796810 - protein, 18 aa, Mycobacterium
AVAVADDSQWRGLCDALD

SEQ ID NO: 796811 - protein, 27 aa, Mycobacterium
AVAVAGRLRGTARATITAAPAGTAFAA

SEQ ID NO: 796812 - protein, 37 aa, Mycobacterium
AVAVALTSRFPIVLWVGRDLFLIYNDAYAQILGDKHP

SEQ ID NO: 796813 - protein, 20 aa, Mycobacterium
AVAVHDLTLAVLPGMLARGA

SEQ ID NO: 796814 - protein, 25 aa, Mycobacterium
AVAVPFTGLIDYRLAIRYSDDESAF

SEQ ID NO: 796815 - protein, 18 aa, Mycobacterium
AVAVPVVGWLGKHYLMPL

SEQ ID NO: 796816 - protein, 33 aa, Mycobacterium
AVAVRQRFIALGFPAAFADAYIQLLAATVDKPA

SEQ ID NO: 796817 - protein, 26 aa, Mycobacterium
AVAWARRALRRLLAPTDPALASTVFG

SEQ ID NO: 796818 - protein, 17 aa, Mycobacterium
AVAWLGPAPAQDAEPDG

SEQ ID NO: 796819 - protein, 24 aa, Mycobacterium
AVAYEAITLLRKSPMEAVLRMTLS

SEQ ID NO: 796820 - protein, 18 aa, Mycobacterium
AVCCFGALYLMPEPFDIT

SEQ ID NO: 796821 - protein, 21 aa, Mycobacterium
AVCDLEPYWEAVRKVYAPFES

SEQ ID NO: 796822 - protein, 18 aa, Mycobacterium
AVCERLHTASLRTVVIGL

SEQ ID NO: 796823 - protein, 19 aa, Mycobacterium
AVCERLHTASLRTVVVGAD

SEQ ID NO: 796824 - protein, 19 aa, Mycobacterium
AVCERLIAMPRADRAALAP

SEQ ID NO: 796825 - protein, 18 aa, Mycobacterium
AVCLAMVGAAPLDARWGS

SEQ ID NO: 796826 - protein, 20 aa, Mycobacterium
AVCLSGFPGAAYYLSDELLP

SEQ ID NO: 796827 - protein, 19 aa, Mycobacterium
AVCPPVMIAMMGALNGPDA

SEQ ID NO: 796828 - protein, 24 aa, Mycobacterium
AVCPSCADLYARDTWQLVHAGASG

SEQ ID NO: 796829 - protein, 17 aa, Mycobacterium
AVCRAPAGILAAHDLRP

SEQ ID NO: 796830 - protein, 19 aa, Mycobacterium
AVCRLGDQPPFRAAVLRTG

SEQ ID NO: 796831 - protein, 26 aa, Mycobacterium
AVCTGAPVWHPLSGKLLAVVTVSTML

SEQ ID NO: 796832 - protein, 24 aa, Mycobacterium
AVCTRIAASEPWWPPGTAQGYQVV

SEQ ID NO: 796833 - protein, 20 aa, Mycobacterium
AVCVGIAPDLFELDDDDYAV

SEQ ID NO: 796834 - protein, 28 aa, Mycobacterium
AVCVSPSMLPVLLPEGVERLLVAGVVGF

SEQ ID NO: 796835 - protein, 22 aa, Mycobacterium
AVDAAWQAIALHTTPGIPERRG

SEQ ID NO: 796836 - protein, 21 aa, Mycobacterium
AVDADPWRWVLGGGEDHALVA

SEQ ID NO: 796837 - protein, 26 aa, Mycobacterium
AVDAGDRWILHCGDAFYHVGTLDGQS

SEQ ID NO: 796838 - protein, 17 aa, Mycobacterium
AVDAGPIAFLRDGDRIR

SEQ ID NO: 796839 - protein, 36 aa, Mycobacterium; identical to SEQ ID NO: 639762

SEQ ID NO: 796840 - protein, 18 aa, Mycobacterium
AVDAQLHRVLSRDGFDVG

SEQ ID NO: 796841 - protein, 21 aa, Mycobacterium
AVDATRLLLLATTADAHLCVS

SEQ ID NO: 796842 - protein, 32 aa, Mycobacterium
AVDAYDAYLRLHLLSHRLVAPHGLNADGLFGV

SEQ ID NO: 796843 - protein, 24 aa, Mycobacterium
AVDAYRAAFVPSVYLPQPYVVVSA

SEQ ID NO: 796844 - protein, 28 aa, Mycobacterium
AVDDGRVTLPFWMIYDSAGDRDGVVPPV

SEQ ID NO: 796845 - protein, 25 aa, Mycobacterium
AVDDLGLPDMLLLLATDIAAVDHHE

SEQ ID NO: 796846 - protein, 20 aa, Mycobacterium
AVDDLGLPDMLLLLATDVAA

SEQ ID NO: 796847 - protein, 27 aa, Mycobacterium
AVDETRRWIVVDLINPLLVQQDARLIT

SEQ ID NO: 796848 - protein, 22 aa, Mycobacterium
AVDFFEARKLPFLIAVNDFDGA

SEQ ID NO: 796849 - protein, 32 aa, Mycobacterium
AVDFSVLYPSGRLVDAPLPTWTHRRLLLSRED

SEQ ID NO: 796850 - protein, 25 aa, Mycobacterium
AVDFVACLGSWNHRVFDVHGIYHQD

SEQ ID NO: 796851 - protein, 24 aa, Mycobacterium
AVDFVGWYNAHPHFEQMAPDLSGA

SEQ ID NO: 796852 - protein, 24 aa, Mycobacterium
AVDFVGWYNAHPHFHEMAPDLSCA

SEQ ID NO: 796853 - protein, 24 aa, Mycobacterium
AVDFVGWYNAHPHFREMAPDLSGG

SEQ ID NO: 796854 - protein, 24 aa, Mycobacterium
AVDFVGWYNAHPHFVDMAPDVSGG

SEQ ID NO: 796855 - protein, 19 aa, Mycobacterium
AVDGIMRRLNPSGAMCIIT

SEQ ID NO: 796856 - protein, 22 aa, Mycobacterium
AVDGPLPIDYPVRRGQRSLAAD

SEQ ID NO: 796857 - protein, 25 aa, Mycobacterium
AVDGRPRGHLRKFGLSRVRVRELAH

SEQ ID NO: 796858 - protein, 33 aa, Mycobacterium
AVDHTRRYLRACQQLGYQDPVLAKGFDPIGDRY

SEQ ID NO: 796859 - protein, 24 aa, Mycobacterium
AVDLAVPMIGMLKRKAERRLIDGA

SEQ ID NO: 796860 - protein, 17 aa, Mycobacterium
AVDLDKSYPIWDVLHES

SEQ ID NO: 796861 - protein, 20 aa, Mycobacterium
AVDLDNLLRRAHVSPMVMAG

SEQ ID NO: 796862 - protein, 18 aa, Mycobacterium
AVDLFGPAAVAASLEFLH

SEQ ID NO: 796863 - protein, 18 aa, Mycobacterium
AVDLITTRIYAVVGTIRT

SEQ ID NO: 796864 - protein, 18 aa, Mycobacterium
AVDLLAALLAAPGIQEPE

SEQ ID NO: 796865 - protein, 17 aa, Mycobacterium
AVDLLDPESVWRISAEA

SEQ ID NO: 796866 - protein, 17 aa, Mycobacterium
AVDLLIGLGGSATNDGG

SEQ ID NO: 796867 - protein, 18 aa, Mycobacterium
AVDLLRRDGFGALTVRRV

SEQ ID NO: 796868 - protein, 28 aa, Mycobacterium
AVDLTYIPLVGWAMSASFQAPICAAGMA

SEQ ID NO: 796869 - protein, 17 aa, Mycobacterium
AVDLYHCDAPRAVVLLL

SEQ ID NO: 796870 - protein, 23 aa, Mycobacterium
AVDMPFLAVELIDDLARRARETG

SEQ ID NO: 796871 - protein, 21 aa, Mycobacterium
AVDMPLLSASLIDDLIGLATE

SEQ ID NO: 796872 - protein, 17 aa, Mycobacterium
AVDMRYASADAKFSIRE

SEQ ID NO: 796873 - protein, 23 aa, Mycobacterium
AVDPPYPVIIGTGLLTELEELLC

SEQ ID NO: 796874 - protein, 24 aa, Mycobacterium
AVDPRFVMPIFNGALAGGADYLDM

SEQ ID NO: 796875 - protein, 24 aa, Mycobacterium
AVDPRYYGMMPRGVRLRANMIRAG

SEQ ID NO: 796876 - protein, 34 aa, Mycobacterium
AVDQQPFLQGYLAVDSLWLYLNNGNVIGGNQPTL

SEQ ID NO: 796877 - protein, 27 aa, Mycobacterium
AVDRALQLLATARRPLIVLGKGAAYAR

SEQ ID NO: 796878 - protein, 21 aa, Mycobacterium
AVDRAVLRVAVWELLHAVDVP

SEQ ID NO: 796879 - protein, 18 aa, Mycobacterium
AVDRFAASGPACERYRKL

SEQ ID NO: 796880 - protein, 18 aa, Mycobacterium
AVDRFLQDNAIIGDLDHA

SEQ ID NO: 796881 - protein, 34 aa, Mycobacterium
AVDRGAFHWWLVLATLRWGVICQYQAWRHLSGQA

SEQ ID NO: 796882 - protein, 22 aa, Mycobacterium
AVDRGLLSLDDPLEKFLPGVPG

SEQ ID NO: 796883 - protein, 25 aa, Mycobacterium
AVDRILAYVAPTLLGGPVTAVDDVG

SEQ ID NO: 796884 - protein, 35 aa, Mycobacterium
AVDRLLLETDQLFGWIAFEFGVYRYGLQQRLAPRT

SEQ ID NO: 796885 - protein, 39 aa, Mycobacterium
AVDRLLLETEQLFGWVAFEFGTYRFGLQEHLKPGTPLAR

SEQ ID NO: 796886 - protein, 24 aa, Mycobacterium
AVDSFWRDLVAFTWNIKTVEGHEG

SEQ ID NO: 796887 - protein, 18 aa, Mycobacterium
AVDSGLAWVSLRPSVFAS

SEQ ID NO: 796888 - protein, 24 aa, Mycobacterium
AVDSIRVVNILSAQYRDPGLLLGQ

SEQ ID NO: 796889 - protein, 17 aa, Mycobacterium
AVDTLFYGADDHGIRYS

SEQ ID NO: 796890 - protein, 21 aa, Mycobacterium
AVDTPIWFVLQGRTLFFRTKI

SEQ ID NO: 796891 - protein, 18 aa, Mycobacterium
AVDTVLYPGLPSHPGHEV

SEQ ID NO: 796892 - protein, 23 aa, Mycobacterium
AVDVGYGQLAWSLRCDPRVVVVE

SEQ ID NO: 796893 - protein, 21 aa, Mycobacterium
AVDVTLLGRFYERFADHAVEV

SEQ ID NO: 796894 - protein, 19 aa, Mycobacterium
AVDWDFAASVGAKLARPEP

SEQ ID NO: 796895 - protein, 24 aa, Mycobacterium
AVDYFCVGPCWPTPTKPGRTAPGL

SEQ ID NO: 796896 - protein, 19 aa, Mycobacterium
AVDYVREFATPARKVRATP

SEQ ID NO: 796897 - protein, 29 aa, Mycobacterium
AVEAPLTVTPWRSVLIFDLDEGVADVALR

SEQ ID NO: 796898 - protein, 25 aa, Mycobacterium
AVECALQLQQAPLAPIRLCIGIHTG

SEQ ID NO: 796899 - protein, 19 aa, Mycobacterium
AVEDAYAAFRWAYDHAGEL

SEQ ID NO: 796900 - protein, 25 aa, Mycobacterium
AVEDIRLQLERLLPKGFVTATGVAR

SEQ ID NO: 796901 - protein, 27 aa, Mycobacterium
AVEDLKAWLTTVVSRLALDKLRSAAHR

SEQ ID NO: 796902 - protein, 17 aa, Mycobacterium
AVEEFIRWASPVMTFRR

SEQ ID NO: 796903 - protein, 17 aa, Mycobacterium
AVEELLRWATPVMHFRR

SEQ ID NO: 796904 - protein, 26 aa, Mycobacterium
AVEERGFEWLLFDDHSYFPVDTPDSI

SEQ ID NO: 796905 - protein, 17 aa, Mycobacterium
AVEEVFFHCAKAFLRSD

SEQ ID NO: 796906 - protein, 19 aa, Mycobacterium
AVEGAVILCLAARSTDPLD

SEQ ID NO: 796907 - protein, 24 aa, Mycobacterium
AVEGSLRRLGVDHIDLYYQHRVDP

SEQ ID NO: 796908 - protein, 26 aa, Mycobacterium
AVEHLAALGLKTLARNWRCRYGELDI

SEQ ID NO: 796909 - protein, 20 aa, Mycobacterium
AVEHLFAVASGLDSAVIGEQ

SEQ ID NO: 796910 - protein, 19 aa, Mycobacterium
AVEIAEIAGLPLLAAIKAQ

SEQ ID NO: 796911 - protein, 31 aa, Mycobacterium
AVEKASWQVAKLYWTVIATSALETGLASITQ

SEQ ID NO: 796912 - protein, 20 aa, Mycobacterium
AVELALASYPGFHVTAPPGD

SEQ ID NO: 796913 - protein, 24 aa, Mycobacterium
AVELDLDAIPIAAALPAPMVSPFP

SEQ ID NO: 796914 - protein, 25 aa, Mycobacterium
AVELELYKRLPGDLSILTPSPASDT

SEQ ID NO: 796915 - protein, 20 aa, Mycobacterium
AVELFKPLAAKATRPEVRGG

SEQ ID NO: 796916 - protein, 26 aa, Mycobacterium
AVELGIKWLSLYAFSTENWKRSAEEV

SEQ ID NO: 796917 - protein, 20 aa, Mycobacterium
AVELILCFNQLAYSAFAPAV

SEQ ID NO: 796918 - protein, 17 aa, Mycobacterium
AVELLRRDLDYLERLIT

SEQ ID NO: 796919 - protein, 20 aa, Mycobacterium
AVELSWNALWAQVCAVGARL

SEQ ID NO: 796920 - protein, 17 aa, Mycobacterium
AVELWPVVHAIEPSRKL

SEQ ID NO: 796921 - protein, 30 aa, Mycobacterium
AVEMTVPRGLRLPARLVLSALIGRVRIPDP

SEQ ID NO: 796922 - protein, 31 aa, Mycobacterium
AVEPDPLLPPQLLPQPWVGAAARSAAAACWA

SEQ ID NO: 796923 - protein, 19 aa, Mycobacterium
AVEPPLLDAGGHIVKRMGD

SEQ ID NO: 796924 - protein, 29 aa, Mycobacterium
AVEPSRALTGNDWLALLLEPAESAHTPGT

SEQ ID NO: 796925 - protein, 19 aa, Mycobacterium
AVEPVKVHAFLPAPADIYG

SEQ ID NO: 796926 - protein, 19 aa, Mycobacterium
AVEQARWWERHIVEILSGR

SEQ ID NO: 796927 - protein, 24 aa, Mycobacterium
AVERAFGQGVWLRHLMQPLRPGEE

SEQ ID NO: 796928 - protein, 23 aa, Mycobacterium
AVERFQPAWAARAHLLVSAGRHA

SEQ ID NO: 796929 - protein, 20 aa, Mycobacterium
AVERLRWKGYLKPGGRDDAT

SEQ ID NO: 796930 - protein, 24 aa, Mycobacterium
AVERSQISVADLDDLLLAESLQGG

SEQ ID NO: 796931 - protein, 22 aa, Mycobacterium
AVERTRAALADQGFGVLTEIDM

SEQ ID NO: 796932 - protein, 17 aa, Mycobacterium
AVERTRKALADQGFGVL

SEQ ID NO: 796933 - protein, 24 aa, Mycobacterium
AVESAWLDALVAAGLAPPECAGAD

SEQ ID NO: 796934 - protein, 32 aa, Mycobacterium
AVESILTLFALRDGVIPPTRNLRNLDPEIDLD

SEQ ID NO: 796935 - protein, 24 aa, Mycobacterium
AVESILTVLALRDQVVPPTLNLEN

SEQ ID NO: 796936 - protein, 28 aa, Mycobacterium
AVESILTVLALRDQVVPPTLNLVNLDPE

SEQ ID NO: 796937 - protein, 27 aa, Mycobacterium
AVESPEPPAFLLLGSDALSAYRRVAQA

SEQ ID NO: 796938 - protein, 18 aa, Mycobacterium
AVETGFLEHLWNAPTKDI

SEQ ID NO: 796939 - protein, 18 aa, Mycobacterium
AVEVARQLRRPRALATLD

SEQ ID NO: 796940 - protein, 17 aa, Mycobacterium
AVEVGRRVIFMVTGVLP

SEQ ID NO: 796941 - protein, 29 aa, Mycobacterium
AVEYGLLRPRQVLFTYLHLAASRACTEAL

SEQ ID NO: 796942 - protein, 22 aa, Mycobacterium
AVEYLAVVSVLTEGPWRGSVSA

SEQ ID NO: 796943 - protein, 17 aa, Mycobacterium
AVEYVIMGQVLSAGAGQ

SEQ ID NO: 796944 - protein, 17 aa, Mycobacterium
AVEYVIMGQVLTAGAGQ

SEQ ID NO: 796945 - protein, 20 aa, Mycobacterium
AVFAAPPGIRTTLDMPLITG

SEQ ID NO: 796946 - protein, 17 aa, Mycobacterium
AVFAGIRLAAIDAVATG

SEQ ID NO: 796947 - protein, 25 aa, Mycobacterium
AVFAKNLTHLLLAAPAGARTTLGLD

SEQ ID NO: 796948 - protein, 25 aa, Mycobacterium
AVFAPPRQRPTYLGHDLRCLHQDGE

SEQ ID NO: 796949 - protein, 28 aa, Mycobacterium
AVFAQGFPSPWLIVVAALHAQAEGARGD

SEQ ID NO: 796950 - protein, 20 aa, Mycobacterium
AVFDALLPVITEAGGQLAGL

SEQ ID NO: 796951 - protein, 17 aa, Mycobacterium
AVFDPEMAQLPGAHLVH

SEQ ID NO: 796952 - protein, 30 aa, Mycobacterium
AVFDRFGKDLPPLDGIYLASLAGGEALLTE

SEQ ID NO: 796953 - protein, 19 aa, Mycobacterium
AVFEGYRPWAGEIRARHTG

SEQ ID NO: 796954 - protein, 20 aa, Mycobacterium
AVFELAVTLLPAERSRLHVD

SEQ ID NO: 796955 - protein, 24 aa, Mycobacterium
AVFEMLKILWPGYSISWAYGATAE

SEQ ID NO: 796956 - protein, 17 aa, Mycobacterium
AVFEQVRCLVAAELGLV

SEQ ID NO: 796957 - protein, 20 aa, Mycobacterium
AVFFDYPPHPRTIAHTVRGF

SEQ ID NO: 796958 - protein, 17 aa, Mycobacterium
AVFGSDPNWGRVLAAVG

SEQ ID NO: 796959 - protein, 26 aa, Mycobacterium
AVFGSDPNWGRVLAAVGIAPIALDPD

SEQ ID NO: 796960 - protein, 23 aa, Mycobacterium
AVFKAAYRQGLALVLKGPTGCGK

SEQ ID NO: 796961 - protein, 20 aa, Mycobacterium
AVFKAAYRQGLSLVLKGPTG

SEQ ID NO: 796962 - protein, 21 aa, Mycobacterium
AVFLTHYLGFPLGSGLNGAVD

SEQ ID NO: 796963 - protein, 34 aa, Mycobacterium
AVFNALAARLDFAGLAVLDLYAGSGALGLEAISR

SEQ ID NO: 796964 - protein, 43 aa, Mycobacterium
AVFNDVDLRWVILAARIGILRQPLNIKLFFSDRWVSYSDPDPD

SEQ ID NO: 796965 - protein, 24 aa, Mycobacterium
AVFPHLDVVIAYRPLFGICSGIVP

SEQ ID NO: 796966 - protein, 17 aa, Mycobacterium
AVFPPTAVAVYRKQPHG

SEQ ID NO: 796967 - protein, 17 aa, Mycobacterium
AVFQKRAPAKRPDWVDV

SEQ ID NO: 796968 - protein, 17 aa, Mycobacterium
AVFQQFQGGAIIAKNNQ

SEQ ID NO: 796969 - protein, 19 aa, Mycobacterium
AVFRLFEELAGKNAGEHLA

SEQ ID NO: 796970 - protein, 18 aa, Mycobacterium
AVFSTRGCPYRCTFCGTG

SEQ ID NO: 796971 - protein, 25 aa, Mycobacterium
AVFSTRKFMLVRKRPFNPHARGLGL

SEQ ID NO: 796972 - protein, 26 aa, Mycobacterium
AVFTASFALWVPLPQVLEQCLVEIYT

SEQ ID NO: 796973 - protein, 17 aa, Mycobacterium
AVFTPGLAGLVLGEFRR

SEQ ID NO: 796974 - protein, 19 aa, Mycobacterium
AVFTTPCVFLVQNNQWAIS

SEQ ID NO: 796975 - protein, 21 aa, Mycobacterium
AVFVLPADLPPSVTLDPGAPL

SEQ ID NO: 796976 - protein, 19 aa, Mycobacterium
AVFVNELFALYRAGGAIDA

SEQ ID NO: 796977 - protein, 27 aa, Mycobacterium
AVGAAIGLLDLLLASGGDLVTVLLGAG

SEQ ID NO: 796978 - protein, 27 aa, Mycobacterium
AVGAEVPLLGQIPLDPALVAAGDSGTP

SEQ ID NO: 796979 - protein, 27 aa, Mycobacterium
AVGAEVPLLGRIPLDPALVAAGDSGVP

SEQ ID NO: 796980 - protein, 23 aa, Mycobacterium
AVGALLSMLTKLSGGKAVAEVGT

SEQ ID NO: 796981 - protein, 35 aa, Mycobacterium
AVGARRVILIHWDDFFRPLTKPLRALPYAGDDLDV

SEQ ID NO: 796982 - protein, 26 aa, Mycobacterium
AVGASDAFFPFPDGLQTLIDAGVKAV

SEQ ID NO: 796983 - protein, 26 aa, Mycobacterium
AVGATWYTAVPTIHQILLERAATDRR

SEQ ID NO: 796984 - protein, 23 aa, Mycobacterium
AVGAVFLTYLLPSTKPQNNILSH

SEQ ID NO: 796985 - protein, 25 aa, Mycobacterium
AVGDAMIMGFLFLDEDADAYLVALT

SEQ ID NO: 796986 - protein, 24 aa, Mycobacterium
AVGDHPHLVLAGYSSGGVLAHALG

SEQ ID NO: 796987 - protein, 24 aa, Mycobacterium
AVGDSVILTFLPSCGHCSYCARGM

SEQ ID NO: 796988 - protein, 24 aa, Mycobacterium
AVGEAARRYGWNCLIFEGPGQGAA

SEQ ID NO: 796989 - protein, 29 aa, Mycobacterium
AVGEEVAPWLDLVRKLGLLVGALSAELPT

SEQ ID NO: 796990 - protein, 28 aa, Mycobacterium
AVGEFAARRWQWHDLAVGRTAIVPDVML

SEQ ID NO: 796991 - protein, 25 aa, Mycobacterium
AVGFNVQVPLDIPLSGHLGEIRLSE

SEQ ID NO: 796992 - protein, 20 aa, Mycobacterium
AVGFTNLWTYPGEPDTFCDT

SEQ ID NO: 796993 - protein, 20 aa, Mycobacterium
AVGGFGFCGIPEALIAALVN

SEQ ID NO: 796994 - protein, 23 aa, Mycobacterium
AVGGFGIHPVVLDAALHALGVAD

SEQ ID NO: 796995 - protein, 25 aa, Mycobacterium
AVGGFPNFFMLYGPNTNQGGNSIVY

SEQ ID NO: 796996 - protein, 23 aa, Mycobacterium
AVGGGWIGYLGYPDRAATGRAQR

SEQ ID NO: 796997 - protein, 19 aa, Mycobacterium
AVGGVGGKGIQGGQGLQGG

SEQ ID NO: 796998 - protein, 17 aa, Mycobacterium
AVGHLLAIAPTVRVQTK

SEQ ID NO: 796999 - protein, 18 aa, Mycobacterium
AVGHRLLARLQVEATPQQ

SEQ ID NO: 797000 - protein, 22 aa, Mycobacterium
AVGIEWLARRLADTADPTVMLY

SEQ ID NO: 797001 - protein, 29 aa, Mycobacterium
AVGIRPPRIPIPMPVMRAAARLNDLAARL

SEQ ID NO: 797002 - protein, 19 aa, Mycobacterium
AVGKYWEVDEIRPAFILSN

SEQ ID NO: 797003 - protein, 17 aa, Mycobacterium
AVGLAMAAKRKGIDRVT

SEQ ID NO: 797004 - protein, 18 aa, Mycobacterium
AVGLGCDLDLVDLAGLAH

SEQ ID NO: 797005 - protein, 20 aa, Mycobacterium
AVGLPMRCVFALTAMGFLPQ

SEQ ID NO: 797006 - protein, 17 aa, Mycobacterium
AVGLPTPRLVVEPGRAI

SEQ ID NO: 797007 - protein, 19 aa, Mycobacterium
AVGLRRTQWWTDGAGDFGL

SEQ ID NO: 797008 - protein, 17 aa, Mycobacterium
AVGLTTCYDIRFPGLYT

SEQ ID NO: 797009 - protein, 19 aa, Mycobacterium
AVGMGRFALAKAVEYVKGR

SEQ ID NO: 797010 - protein, 22 aa, Mycobacterium
AVGMGRFALGKAVDYVKTRQVW

SEQ ID NO: 797011 - protein, 19 aa, Mycobacterium
AVGMLIIDFTSRKRMRVNG

SEQ ID NO: 797012 - protein, 19 aa, Mycobacterium
AVGMLMLLHDMTEDHAFDV

SEQ ID NO: 797013 - protein, 24 aa, Mycobacterium
AVGNFLARLVFPTPTRRLTITVGL

SEQ ID NO: 797014 - protein, 19 aa, Mycobacterium
AVGQIPVNFGASGLAAMSV

SEQ ID NO: 797015 - protein, 38 aa, Mycobacterium
AVGQLGQLGQLFTAPLAALAQPLQQLPQQLMQGLQQSA

SEQ ID NO: 797016 - protein, 31 aa, Mycobacterium
AVGRIRAMRMALLPERLPAAEALSWGLVSAV

SEQ ID NO: 797017 - protein, 25 aa, Mycobacterium
AVGRLRAISIPGLDLRRQLRAIWVG

SEQ ID NO: 797018 - protein, 28 aa, Mycobacterium
AVGRRARWLVRVMVSLLVFPGVDEADER

SEQ ID NO: 797019 - protein, 25 aa, Mycobacterium
AVGSGVPFFTAGYAFYKLADVRPGE

SEQ ID NO: 797020 - protein, 20 aa, Mycobacterium
AVGSLLNGVAVDSGTRTVYA

SEQ ID NO: 797021 - protein, 18 aa, Mycobacterium
AVGSWLHRIVVNACLDRL

SEQ ID NO: 797022 - protein, 34 aa, Mycobacterium
AVGTAVSIFPVAALAPVFGPIGAHYLGAFAMTSA

SEQ ID NO: 797023 - protein, 17 aa, Mycobacterium
AVGTLTFTPGQTSKTVA

SEQ ID NO: 797024 - protein, 20 aa, Mycobacterium
AVGVEPPRRGVPIRVMAAAA

SEQ ID NO: 797025 - protein, 28 aa, Mycobacterium
AVGVHNPSLLGLVGMGLPGDIGQRHIQR

SEQ ID NO: 797026 - protein, 26 aa, Mycobacterium
AVGVHRLLCWGIVGTPLTLVPAPTRR

SEQ ID NO: 797027 - protein, 23 aa, Mycobacterium
AVGVPLLELVGLGPQLRVGQLLD

SEQ ID NO: 797028 - protein, 35 aa, Mycobacterium
AVGVQDAINAPFLQFTGRPLVGPGTDGAPGTGQAG

SEQ ID NO: 797029 - protein, 25 aa, Mycobacterium
AVGVVHSLWQPMAGRFKDYIAQPRF

SEQ ID NO: 797030 - protein, 22 aa, Mycobacterium
AVGWLASFVPLAIPTAGASFDE

SEQ ID NO: 797031 - protein, 19 aa, Mycobacterium
AVHAALGRWRHGNDSAFDD

SEQ ID NO: 797032 - protein, 28 aa, Mycobacterium
AVHADDVWRALTAIVYDNRDSWKRAVIE

SEQ ID NO: 797033 - protein, 17 aa, Mycobacterium
AVHAMEERLPFFADMEA

SEQ ID NO: 797034 - protein, 28 aa, Mycobacterium
AVHDNVTLIWPPRSPSGFSLIVDGQARA

SEQ ID NO: 797035 - protein, 34 aa, Mycobacterium
AVHGATSPFLDYHPRWAPSPFPAVLCVSVNDAVV

SEQ ID NO: 797036 - protein, 29 aa, Mycobacterium
AVHGGMIPLFYDWLFGMMVSTAGTPPTRT

SEQ ID NO: 797037 - protein, 17 aa, Mycobacterium
AVHLPAPYGPDGWQLYD

SEQ ID NO: 797038 - protein, 18 aa, Mycobacterium
AVHMGFSDAGAHLRNMAF

SEQ ID NO: 797039 - protein, 20 aa, Mycobacterium
AVHPLAARRLFGVPSAELGA

SEQ ID NO: 797040 - protein, 18 aa, Mycobacterium
AVHPTWEAEFSTLTVPFL

SEQ ID NO: 797041 - protein, 20 aa, Mycobacterium
AVHPWGLYLARPTPGRAQFH

SEQ ID NO: 797042 - protein, 22 aa, Mycobacterium
AVHQSIVGDRLRLALDADLCTA

SEQ ID NO: 797043 - protein, 21 aa, Mycobacterium
AVHRATRPGATLLMSCFCDAN

SEQ ID NO: 797044 - protein, 17 aa, Mycobacterium
AVHVAKIVQRRQPDQVL

SEQ ID NO: 797045 - protein, 17 aa, Mycobacterium
AVHVMEDRLPFFTDLEA

SEQ ID NO: 797046 - protein, 29 aa, Mycobacterium
AVIADIRRYLSYFPPSAWSYPAQLPPDED

SEQ ID NO: 797047 - protein, 23 aa, Mycobacterium
AVIAEMYDALQPRQVRLGTRTLA

SEQ ID NO: 797048 - protein, 20 aa, Mycobacterium
AVIARMNPIIRGWSAYYRGA

SEQ ID NO: 797049 - protein, 20 aa, Mycobacterium
AVIDASLPGLHSWVDERLAG

SEQ ID NO: 797050 - protein, 18 aa, Mycobacterium
AVIDCRVLPGRLADFERE

SEQ ID NO: 797051 - protein, 23 aa, Mycobacterium
AVIEAALPGLHDWVDERLAQNGS

SEQ ID NO: 797052 - protein, 23 aa, Mycobacterium
AVIERSFGGWLTAWQIPEGQSGD

SEQ ID NO: 797053 - protein, 23 aa, Mycobacterium
AVIGAALVRLSAHLDPCVRIDTG

SEQ ID NO: 797054 - protein, 23 aa, Mycobacterium
AVIHALNQWMAEHWTFDYQGRVF

SEQ ID NO: 797055 - protein, 27 aa, Mycobacterium
AVIHVHLRGHFLLTRNAATYWRGASKA

SEQ ID NO: 797056 - protein, 40 aa, Mycobacterium
AVIKRSPIGVLLGIMPWNYPYYQVARFAGPNLVVGNTILL

SEQ ID NO: 797057 - protein, 30 aa, Mycobacterium
AVILAAGLDVRAHRLPWPAGTKVFELDQPQ

SEQ ID NO: 797058 - protein, 29 aa, Mycobacterium
AVILAAGLDVRGYRLPWAAGTTVYELDLP

SEQ ID NO: 797059 - protein, 27 aa, Mycobacterium
AVILAPQGLEYVVAFLGALQAGRIAVP

SEQ ID NO: 797060 - protein, 17 aa, Mycobacterium
AVILASGLDTRAYRLHW

SEQ ID NO: 797061 - protein, 17 aa, Mycobacterium
AVILCLAARSTDPLDRT

SEQ ID NO: 797062 - protein, 18 aa, Mycobacterium
AVINAWPDGSKPTIKDFL

SEQ ID NO: 797063 - protein, 18 aa, Mycobacterium
AVINRLPVRYTFDNRYFN

SEQ ID NO: 797064 - protein, 20 aa, Mycobacterium
AVINTVMPYFPLMHEMTTDH

SEQ ID NO: 797065 - protein, 35 aa, Mycobacterium
AVIPGAAHLVPLDQPLWTCGLIQGLMRDGATVPVA

SEQ ID NO: 797066 - protein, 26 aa, Mycobacterium
AVIPPSYTRGYIGTALRLLERKIAQQ

SEQ ID NO: 797067 - protein, 36 aa, Mycobacterium
AVIRRGDTPMPVRTPLPIQLPEPMAAQLRAAAAAQA

SEQ ID NO: 797068 - protein, 17 aa, Mycobacterium
AVIRRIRPTNPASPVIR

SEQ ID NO: 797069 - protein, 22 aa, Mycobacterium
AVISRIKARYGLPGTIAPYNGH

SEQ ID NO: 797070 - protein, 22 aa, Mycobacterium
AVITAMALAVPLLQQHVSRGLG

SEQ ID NO: 797071 - protein, 17 aa, Mycobacterium
AVITGFPQHRRAYAWWH

SEQ ID NO: 797072 - protein, 18 aa, Mycobacterium
AVIVAGARTPFVRAFGEF

SEQ ID NO: 797073 - protein, 21 aa, Mycobacterium
AVIVEFWLMGTHRGYLGKVPP

SEQ ID NO: 797074 - protein, 18 aa, Mycobacterium
AVIVLEVEFGLDAAGRSA

SEQ ID NO: 797075 - protein, 25 aa, Mycobacterium
AVIWSYLELFGTDRLASLLLVDQMP

SEQ ID NO: 797076 - protein, 18 aa, Mycobacterium
AVIYATGFMPARLDGILG

SEQ ID NO: 797077 - protein, 18 aa, Mycobacterium
AVIYELHLGTFTGAGTLD

SEQ ID NO: 797078 - protein, 17 aa, Mycobacterium
AVIYELHLGTFTGPGTF

SEQ ID NO: 797079 - protein, 23 aa, Mycobacterium
AVKAALALGTPFTAMLFMGEEYA

SEQ ID NO: 797080 - protein, 19 aa, Mycobacterium
AVKAFTAWAVRRGLLTGDP

SEQ ID NO: 797081 - protein, 30 aa, Mycobacterium; identical to SEQ ID NO: 119258

SEQ ID NO: 797082 - protein, 27 aa, Mycobacterium
AVKASFRRRWLSVAILRAAFGFHRGKV

SEQ ID NO: 797083 - protein, 35 aa, Mycobacterium
AVKAYHQLLVWDMMGRPWLTRTAESALNPLIGKSV

SEQ ID NO: 797084 - protein, 18 aa, Mycobacterium
AVKDVSFRIRRGTTLGLV

SEQ ID NO: 797085 - protein, 22 aa, Mycobacterium
AVKETPWLPGQVQVFIHGEAQA

SEQ ID NO: 797086 - protein, 19 aa, Mycobacterium
AVKHGHEPPFKKWLEHWDA

SEQ ID NO: 797087 - protein, 17 aa, Mycobacterium
AVKLHILTRKTLGGLET

SEQ ID NO: 797088 - protein, 23 aa, Mycobacterium
AVKLWRHWDHCALHWFPGSHVLH

SEQ ID NO: 797089 - protein, 23 aa, Mycobacterium
AVKQGWFCCWNRANQLHVSTGII

SEQ ID NO: 797090 - protein, 25 aa, Mycobacterium
AVKRPEDLRFLVRLARQQGERLGRA

SEQ ID NO: 797091 - protein, 18 aa, Mycobacterium
AVKRRYLGKLSGPLLDRV

SEQ ID NO: 797092 - protein, 21 aa, Mycobacterium
AVKRSPLAPSLRRALHHVRGV

SEQ ID NO: 797093 - protein, 17 aa, Mycobacterium
AVKRTREALAQQGFGVL

SEQ ID NO: 797094 - protein, 20 aa, Mycobacterium
AVKRWMGIDVTIDDGRLLIA

SEQ ID NO: 797095 - protein, 17 aa, Mycobacterium
AVKSLQIAFPRAGRAAG

SEQ ID NO: 797096 - protein, 17 aa, Mycobacterium
AVKYHDLQWTWREYLAE

SEQ ID NO: 797097 - protein, 17 aa, Mycobacterium
AVLAAIPAGYRALVVDN

SEQ ID NO: 797098 - protein, 20 aa, Mycobacterium
AVLAALLNRERHGVADVVRV

SEQ ID NO: 797099 - protein, 25 aa, Mycobacterium
AVLAALPEAVVVRTAWVYTGGAGKD

SEQ ID NO: 797100 - protein, 26 aa, Mycobacterium
AVLAALPNAYVVRTSWIFEGGNGADF

SEQ ID NO: 797101 - protein, 30 aa, Mycobacterium
AVLAAQNGVPWWYFHELQGPYRGRRIEAVD

SEQ ID NO: 797102 - protein, 22 aa, Mycobacterium
AVLADLLPSYMVPTRTVFFERF

SEQ ID NO: 797103 - protein, 26 aa, Mycobacterium
AVLADLYGPRRLLTEGLLPSELVFGH

SEQ ID NO: 797104 - protein, 19 aa, Mycobacterium
AVLAFLNYIDANRASWMVL

SEQ ID NO: 797105 - protein, 17 aa, Mycobacterium
AVLAFYRYHAHAHNLDV

SEQ ID NO: 797106 - protein, 19 aa, Mycobacterium
AVLAGIWAELLKLPDVSAA

SEQ ID NO: 797107 - protein, 17 aa, Mycobacterium
AVLAGPRGPVGAIADQR

SEQ ID NO: 797108 - protein, 17 aa, Mycobacterium
AVLALGDSSYELFCNAG

SEQ ID NO: 797109 - protein, 18 aa, Mycobacterium
AVLALHGYTDYFFNTELA

SEQ ID NO: 797110 - protein, 18 aa, Mycobacterium
AVLALVDGLLVVGGADIA

SEQ ID NO: 797111 - protein, 27 aa, Mycobacterium
AVLANPAQVVSGDLLAAINAPVLSLTG

SEQ ID NO: 797112 - protein, 34 aa, Mycobacterium
AVLAPKVLGTTLLAWLAAQHGCPMLVMSSLASLL

SEQ ID NO: 797113 - protein, 29 aa, Mycobacterium
AVLARQTLWPERLFSILAGFVEAGESFET

SEQ ID NO: 797114 - protein, 27 aa, Mycobacterium
AVLASRHEALRLLWPDLSAAAPETVVD

SEQ ID NO: 797115 - protein, 25 aa, Mycobacterium
AVLATGVLNLLRPSDSRDHLLAAVA

SEQ ID NO: 797116 - protein, 23 aa, Mycobacterium
AVLCTPWRELLAEVDPSRLVLEI

SEQ ID NO: 797117 - protein, 17 aa, Mycobacterium
AVLCWNNNPRKILGDVA

SEQ ID NO: 797118 - protein, 18 aa, Mycobacterium
AVLDLKRVADDRFIGAHP

SEQ ID NO: 797119 - protein, 18 aa, Mycobacterium
AVLDLRPPIGRSGRAVIA

SEQ ID NO: 797120 - protein, 18 aa, Mycobacterium
AVLDLRRVADDRFIGSHP

SEQ ID NO: 797121 - protein, 25 aa, Mycobacterium
AVLDRKIPLFGICFGNQLLGRALGR

SEQ ID NO: 797122 - protein, 39 aa, Mycobacterium
AVLEDALVLLHRDKISSLPDLLPLLEKVAEAGKPLLIVA

SEQ ID NO: 797123 - protein, 19 aa, Mycobacterium
AVLENSLVWNELRACAVYE

SEQ ID NO: 797124 - protein, 25 aa, Mycobacterium
AVLEPFAVGVPYFNTFGGNPVSMAA

SEQ ID NO: 797125 - protein, 18 aa, Mycobacterium
AVLERTIAALRASGVLVL

SEQ ID NO: 797126 - protein, 19 aa, Mycobacterium
AVLESLRSHRDGRLAVVFG

SEQ ID NO: 797127 - protein, 27 aa, Mycobacterium
AVLEVRGEVFFMLADFEALNASLVEDG

SEQ ID NO: 797128 - protein, 18 aa, Mycobacterium
AVLFHLGQFIPQGVPDTY

SEQ ID NO: 797129 - protein, 30 aa, Mycobacterium
AVLGAIDSIALLPLYFQLDGSFPNHEANPL

SEQ ID NO: 797130 - protein, 27 aa, Mycobacterium
AVLGAIPSITLAPLYFELDGNFPNHEA

SEQ ID NO: 797131 - protein, 18 aa, Mycobacterium
AVLGALGADEVSAAVAEL

SEQ ID NO: 797132 - protein, 20 aa, Mycobacterium
AVLGAPTPASFTGSLLVGGS

SEQ ID NO: 797133 - protein, 19 aa, Mycobacterium
AVLGDIDALARRLAGLIDQ

SEQ ID NO: 797134 - protein, 29 aa, Mycobacterium
AVLGPAVDGGWWVLGLRSPAAAECLRTVP

SEQ ID NO: 797135 - protein, 29 aa, Mycobacterium
AVLGPIPGATILPLYFELDGTFPNHEANP

SEQ ID NO: 797136 - protein, 18 aa, Mycobacterium
AVLHLLAIAHEADVALTL

SEQ ID NO: 797137 - protein, 21 aa, Mycobacterium
AVLHRMRQTLPIQPVAIGSAG

SEQ ID NO: 797138 - protein, 18 aa, Mycobacterium
AVLHRPAVLPVPSLGPRL

SEQ ID NO: 797139 - protein, 18 aa, Mycobacterium
AVLILRPEPDELRGPQIA

SEQ ID NO: 797140 - protein, 25 aa, Mycobacterium
AVLKDTMVLAYRWPADHKSVTWSLV

SEQ ID NO: 797141 - protein, 19 aa, Mycobacterium
AVLKVIVESAALLGLADES

SEQ ID NO: 797142 - protein, 18 aa, Mycobacterium
AVLLAAGAGRRYGKPKVL

SEQ ID NO: 797143 - protein, 17 aa, Mycobacterium
AVLLHEIGHLLRDHSDR

SEQ ID NO: 797144 - protein, 18 aa, Mycobacterium
AVLLPDDLVWPRGVLETM

SEQ ID NO: 797145 - protein, 21 aa, Mycobacterium
AVLLPDVYYREGDWAPFTMST

SEQ ID NO: 797146 - protein, 22 aa, Mycobacterium
AVLLRECIDFFAPYLAAAKLTG

SEQ ID NO: 797147 - protein, 26 aa, Mycobacterium
AVLLRECVDFFKPYLSAARLTGEVRK

SEQ ID NO: 797148 - protein, 25 aa, Mycobacterium
AVLMSPVAFVQRPARWIRLLATNRG

SEQ ID NO: 797149 - protein, 17 aa, Mycobacterium
AVLNAIWCLGASAVLIS

SEQ ID NO: 797150 - protein, 25 aa, Mycobacterium
AVLNPLRFVYMNTDTVMHVHRIPQG

SEQ ID NO: 797151 - protein, 19 aa, Mycobacterium
AVLNRLRRAQGQLAGVISM

SEQ ID NO: 797152 - protein, 17 aa, Mycobacterium
AVLPDMIETQWGRIVNI

SEQ ID NO: 797153 - protein, 27 aa, Mycobacterium
AVLPEKPELILLDNFPVWQTQMAVQRR

SEQ ID NO: 797154 - protein, 19 aa, Mycobacterium
AVLPGMIERRRGDLIFVGS

SEQ ID NO: 797155 - protein, 17 aa, Mycobacterium
AVLPGMLARGAGGILIS

SEQ ID NO: 797156 - protein, 19 aa, Mycobacterium
AVLPILHLNGYKIANPTLL

SEQ ID NO: 797157 - protein, 17 aa, Mycobacterium
AVLPLSRNADLSPRAKA

SEQ ID NO: 797158 - protein, 19 aa, Mycobacterium
AVLPQFRREWLHTDVTAPV

SEQ ID NO: 797159 - protein, 18 aa, Mycobacterium
AVLPRMKAGSRLVFISSS

SEQ ID NO: 797160 - protein, 21 aa, Mycobacterium
AVLPVVYVTLPDLAVSPATIS

SEQ ID NO: 797161 - protein, 20 aa, Mycobacterium
AVLPVYDPLYDSTKVRHVLV

SEQ ID NO: 797162 - protein, 26 aa, Mycobacterium
AVLQAERFAVFAGVLCGAPYPQAALA

SEQ ID NO: 797163 - protein, 18 aa, Mycobacterium
AVLQIIPSLKGVSDAINK

SEQ ID NO: 797164 - protein, 24 aa, Mycobacterium
AVLQIVWMALQGLPKKQRHKPVHV

SEQ ID NO: 797165 - protein, 26 aa, Mycobacterium
AVLRAYWDLPAMMLQFLRGGAQVAKP

SEQ ID NO: 797166 - protein, 29 aa, Mycobacterium
AVLRAYWDLPAMMLQFLRSGAPAVSPALK

SEQ ID NO: 797167 - protein, 29 aa, Mycobacterium
AVLRFHYQLARFPLQLIEDRVVTRIPTEA

SEQ ID NO: 797168 - protein, 30 aa, Mycobacterium
AVLRLHYQLARFPLQLIEDRVVTRIPAEAR

SEQ ID NO: 797169 - protein, 25 aa, Mycobacterium
AVLRLQYRIARTPLQLFESSVISRM

SEQ ID NO: 797170 - protein, 17 aa, Mycobacterium
AVLRPAFADAGLGLVFL

SEQ ID NO: 797171 - protein, 24 aa, Mycobacterium
AVLRPGGRLVTLSAPPPAGKADEH

SEQ ID NO: 797172 - protein, 25 aa, Mycobacterium
AVLRQAPELSGWPRSPGWTGAAAVT

SEQ ID NO: 797173 - protein, 24 aa, Mycobacterium
AVLRSSAPWEQWALRGAELIDFHT

SEQ ID NO: 797174 - protein, 24 aa, Mycobacterium
AVLRYELQWPSPRAGFGACHDSCL

SEQ ID NO: 797175 - protein, 17 aa, Mycobacterium
AVLSDWLSSYRPDELFD

SEQ ID NO: 797176 - protein, 22 aa, Mycobacterium
AVLSEHHLLRARRVRHLRGIEG

SEQ ID NO: 797177 - protein, 24 aa, Mycobacterium
AVLSIEFLVHAWDYAAATKREVDA

SEQ ID NO: 797178 - protein, 18 aa, Mycobacterium
AVLSIEFLVHAWDYATAV

SEQ ID NO: 797179 - protein, 17 aa, Mycobacterium
AVLTGRHADILVLLSRH

SEQ ID NO: 797180 - protein, 26 aa, Mycobacterium
AVLTLALMGIPLQNWKMYSEPTHAAV

SEQ ID NO: 797181 - protein, 17 aa, Mycobacterium
AVLVAMNSLWELGVPRR

SEQ ID NO: 797182 - protein, 17 aa, Mycobacterium
AVLVCDLVAALKDRGRS

SEQ ID NO: 797183 - protein, 17 aa, Mycobacterium
AVLVDRGHRELPIRADY

SEQ ID NO: 797184 - protein, 17 aa, Mycobacterium
AVLVDRGHRELPVRADY

SEQ ID NO: 797185 - protein, 19 aa, Mycobacterium
AVLVGDPYQLAPVKARGGM

SEQ ID NO: 797186 - protein, 23 aa, Mycobacterium
AVLVGLKYHPGQTPLLTKEWTSD

SEQ ID NO: 797187 - protein, 19 aa, Mycobacterium
AVLVHGAWHSSLHWAAAQR

SEQ ID NO: 797188 - protein, 17 aa, Mycobacterium
AVLWRPQDGTDAPEIAI

SEQ ID NO: 797189 - protein, 18 aa, Mycobacterium
AVMAAEQGWPVLRLEDPR

SEQ ID NO: 797190 - protein, 20 aa, Mycobacterium
AVMAHADWIIDLGPGAGHDG

SEQ ID NO: 797191 - protein, 18 aa, Mycobacterium
AVMCSESVWWRCHRRLIA

SEQ ID NO: 797192 - protein, 18 aa, Mycobacterium
AVMFHLGQFIKQGVPDTY

SEQ ID NO: 797193 - protein, 22 aa, Mycobacterium
AVMGDLSRRRWWPLTEILTTDR

SEQ ID NO: 797194 - protein, 20 aa, Mycobacterium
AVMGIPFVHVKYLDLTAAQV

SEQ ID NO: 797195 - protein, 23 aa, Mycobacterium
AVMLAGLAMKWRWRAKAGDWKGR

SEQ ID NO: 797196 - protein, 26 aa, Mycobacterium
AVMLDQFLRHFAGYVDKPHGSSTPVS

SEQ ID NO: 797197 - protein, 23 aa, Mycobacterium
AVMLGGLAMKWRWRQKVGKDWKG

SEQ ID NO: 797198 - protein, 18 aa, Mycobacterium
AVMLHPGPLDIAAARSLA

SEQ ID NO: 797199 - protein, 18 aa, Mycobacterium
AVMLTALYDRQVAMYQVI

SEQ ID NO: 797200 - protein, 25 aa, Mycobacterium
AVMMELILNAWVAQAIAAAADLGVA

SEQ ID NO: 797201 - protein, 19 aa, Mycobacterium
AVMMNNYGTPPLALASGQG

SEQ ID NO: 797202 - protein, 20 aa, Mycobacterium
AVMPMDAWRDGEKFVVEFDL

SEQ ID NO: 797203 - protein, 21 aa, Mycobacterium
AVMPMDAWREGDKFVVEFDLP

SEQ ID NO: 797204 - protein, 26 aa, Mycobacterium
AVMPPSLLHTWFELLSPEQIVTAYGM

SEQ ID NO: 797205 - protein, 29 aa, Mycobacterium
AVMQILALVRNYLPAHQWVVDGGWNIADS

SEQ ID NO: 797206 - protein, 21 aa, Mycobacterium
AVMRGMLAFLAVNSTYRGPYT

SEQ ID NO: 797207 - protein, 24 aa, Mycobacterium
AVMRPRVLAVLRPLGLGMPEFMCL

SEQ ID NO: 797208 - protein, 17 aa, Mycobacterium
AVMRPVLKTYFRSEVHG

SEQ ID NO: 797209 - protein, 20 aa, Mycobacterium
AVMTLLPGDIILTGTPAGVG

SEQ ID NO: 797210 - protein, 21 aa, Mycobacterium
AVMVAAWDFSLQIPTRTIVDC

SEQ ID NO: 797211 - protein, 30 aa, Mycobacterium
AVMVVDSSRWKKWKRFWGKHRRGGDFALND

SEQ ID NO: 797212 - protein, 20 aa, Mycobacterium
AVMYLVSDSARYITGTALPV

SEQ ID NO: 797213 - protein, 26 aa, Mycobacterium
AVNAAYRALSPPVDSIGLFVREVYPE

SEQ ID NO: 797214 - protein, 34 aa, Mycobacterium
AVNADEPCWGFGPKPRLAGFWIRRQAHEHAVHHA

SEQ ID NO: 797215 - protein, 27 aa, Mycobacterium
AVNADFKRLVTDWQLRGGPGGVPNTHD

SEQ ID NO: 797216 - protein, 25 aa, Mycobacterium
AVNADLLIGAVLVPGAKAPKLIPNS

SEQ ID NO: 797217 - protein, 19 aa, Mycobacterium
AVNAGRRPIPLPPGELLVS

SEQ ID NO: 797218 - protein, 23 aa, Mycobacterium
AVNAPAQALLGRPLIGDGADGSP

SEQ ID NO: 797219 - protein, 44 aa, Mycobacterium
AVNASPLQTLEQQVLSVINAPTEALLGRPLIGDGANGSAPGQAG

SEQ ID NO: 797220 - protein, 19 aa, Mycobacterium
AVNAVVTMPPLITAWARVQ

SEQ ID NO: 797221 - protein, 32 aa, Mycobacterium
AVNEELWDLLPGYLVFRSLLPVRSPTADTVRT

SEQ ID NO: 797222 - protein, 23 aa, Mycobacterium
AVNELMLFDAHNPRSLVYQMERL

SEQ ID NO: 797223 - protein, 28 aa, Mycobacterium
AVNFGPDWSFWPNRFLGSADPAVIGHRM

SEQ ID NO: 797224 - protein, 26 aa, Mycobacterium
AVNFPLYVIMSLLGIPESDFGRMLTY

SEQ ID NO: 797225 - protein, 20 aa, Mycobacterium
AVNGLYVHWVVAGIAPGSGS

SEQ ID NO: 797226 - protein, 25 aa, Mycobacterium
AVNGTVVLGVWQPGAPGAGLVGLKL

SEQ ID NO: 797227 - protein, 25 aa, Mycobacterium
AVNHAIRYPCRVRSLVLLDPALTFA

SEQ ID NO: 797228 - protein, 18 aa, Mycobacterium
AVNIRWSLAEIGYSLRES

SEQ ID NO: 797229 - protein, 17 aa, Mycobacterium
AVNLMAQAFPRSRFTGI

SEQ ID NO: 797230 - protein, 18 aa, Mycobacterium
AVNLRAPALLASAVGKAM

SEQ ID NO: 797231 - protein, 23 aa, Mycobacterium
AVNQIELHPLLNQAALREVNAGY

SEQ ID NO: 797232 - protein, 25 aa, Mycobacterium
AVNQSPIFFLQCGLPRVAFEVTKRM

SEQ ID NO: 797233 - protein, 20 aa, Mycobacterium
AVNSAPWVTVPGRAALLLGD

SEQ ID NO: 797234 - protein, 18 aa, Mycobacterium
AVNTIYRGPATPGSAAAL

SEQ ID NO: 797235 - protein, 26 aa, Mycobacterium
AVNTRAPFFITQHGLSRLRDHGRIIN

SEQ ID NO: 797236 - protein, 28 aa, Mycobacterium
AVNVATLPFPGFPTDLQPMAIGLAAIAD

SEQ ID NO: 797237 - protein, 28 aa, Mycobacterium
AVNVATLPFPGFPTDLQPMAIGLAAVAD

SEQ ID NO: 797238 - protein, 23 aa, Mycobacterium
AVNWLMGQADMDPDWSFGERGER

SEQ ID NO: 797239 - protein, 26 aa, Mycobacterium
AVNYPLYVIMSLLGLPEADFGRMLTL

SEQ ID NO: 797240 - protein, 18 aa, Mycobacterium
AVPAALQSLATAAPAAAS

SEQ ID NO: 797241 - protein, 26 aa, Mycobacterium
AVPAARVRCLLPPCRHRSTALRIAGT

SEQ ID NO: 797242 - protein, 25 aa, Mycobacterium
AVPAERLYRLPVQVDPLAAVAVLHP

SEQ ID NO: 797243 - protein, 19 aa, Mycobacterium
AVPAGIAPAPGAGLELPTD

SEQ ID NO: 797244 - protein, 30 aa, Mycobacterium
AVPAIIAEYLGLPQLTHVRKLSLEGDKVTG

SEQ ID NO: 797245 - protein, 19 aa, Mycobacterium
AVPAPRLPALLAELAPHSA

SEQ ID NO: 797246 - protein, 28 aa, Mycobacterium
AVPAQADWLDPMIALAFAAAASSRIAVA

SEQ ID NO: 797247 - protein, 22 aa, Mycobacterium
AVPASYITVLPPTIEDSFGPHV

SEQ ID NO: 797248 - protein, 20 aa, Mycobacterium
AVPCHVGDPDLWFAENPGDL

SEQ ID NO: 797249 - protein, 20 aa, Mycobacterium
AVPCWMVFDEGYIGRYVSGA

SEQ ID NO: 797250 - protein, 17 aa, Mycobacterium
AVPDGALPAGSTITAVS

SEQ ID NO: 797251 - protein, 26 aa, Mycobacterium
AVPDRFWAQVLPRVRQAHPAAWFVGE

SEQ ID NO: 797252 - protein, 17 aa, Mycobacterium
AVPEMAVRWRAEAPADL

SEQ ID NO: 797253 - protein, 21 aa, Mycobacterium
AVPGFQLVISYNPGYQSVLKS

SEQ ID NO: 797254 - protein, 28 aa, Mycobacterium
AVPGPFDAYLTIRGLKTLPLRMQRHSEN

SEQ ID NO: 797255 - protein, 23 aa, Mycobacterium
AVPGRPRLLLGAFDLAGLGYRIE

SEQ ID NO: 797256 - protein, 26 aa, Mycobacterium
AVPGTRLLAWVRWFESDTFARLPRAY

SEQ ID NO: 797257 - protein, 38 aa, Mycobacterium
AVPIPQHVPWFPKDVPAWSVRWVFFHMIEELARHAGQG

SEQ ID NO: 797258 - protein, 17 aa, Mycobacterium
AVPKILATGLAPYILEY

SEQ ID NO: 797259 - protein, 21 aa, Mycobacterium
AVPLCFGFHPYLQVPGVARGD

SEQ ID NO: 797260 - protein, 20 aa, Mycobacterium
AVPLLELHPVLFGLAGSVRS

SEQ ID NO: 797261 - protein, 19 aa, Mycobacterium
AVPLPRISIFLSLFDAHVQ

SEQ ID NO: 797262 - protein, 18 aa, Mycobacterium
AVPMMVFSGIMNTGQACV

SEQ ID NO: 797263 - protein, 18 aa, Mycobacterium
AVPMMVFSGVMNAGQGCV

SEQ ID NO: 797264 - protein, 24 aa, Mycobacterium
AVPNWVNDALGAPLGPLAGLGTDP

SEQ ID NO: 797265 - protein, 19 aa, Mycobacterium
AVPPRRRHLTAPRTVVLSG

SEQ ID NO: 797266 - protein, 25 aa, Mycobacterium
AVPPSPFPVITNPAGGFGTLASAGL

SEQ ID NO: 797267 - protein, 25 aa, Mycobacterium
AVPQGLNLLRKLGRYVEYGVFGSDV

SEQ ID NO: 797268 - protein, 18 aa, Mycobacterium
AVPQLRESILETIRVRAA

SEQ ID NO: 797269 - protein, 21 aa, Mycobacterium
AVPRAIWNKDLSWLAAQDQSP

SEQ ID NO: 797270 - protein, 27 aa, Mycobacterium
AVPRDYAFDLMLFAQRNPKPCPVLDVL

SEQ ID NO: 797271 - protein, 22 aa, Mycobacterium
AVPRVPELPAVPGVPRVNLVGS

SEQ ID NO: 797272 - protein, 21 aa, Mycobacterium
AVPSLFPFVECQARLVGAYAA

SEQ ID NO: 797273 - protein, 31 aa, Mycobacterium
AVPSRDIPRFVELWRSGRLPVQSLVSSTIAL

SEQ ID NO: 797274 - protein, 28 aa, Mycobacterium
AVPSTPANYFHLLRRHGLDGIHRPLIVF

SEQ ID NO: 797275 - protein, 18 aa, Mycobacterium
AVPSVDLGLIPLGDEPGV

SEQ ID NO: 797276 - protein, 23 aa, Mycobacterium
AVPTGRVFRCGQGARVEFAVGGQ

SEQ ID NO: 797277 - protein, 18 aa, Mycobacterium
AVPTIWNAVLHHLEDDPD

SEQ ID NO: 797278 - protein, 18 aa, Mycobacterium
AVPTMAHRISLRPEMWVR

SEQ ID NO: 797279 - protein, 28 aa, Mycobacterium
AVPVATTLLRRGITAVLLGGRIREATMA

SEQ ID NO: 797280 - protein, 25 aa, Mycobacterium
AVPVPPDIPWFPKDQEAWSVRWVIL

SEQ ID NO: 797281 - protein, 21 aa, Mycobacterium
AVPVTPLNYRLSAEGLRALLD

SEQ ID NO: 797282 - protein, 28 aa, Mycobacterium
AVPYLSDRGWLLTSTPLPELRAANGLAP

SEQ ID NO: 797283 - protein, 24 aa, Mycobacterium
AVQAALLARWMLIGFVHGVMNTDN

SEQ ID NO: 797284 - protein, 25 aa, Mycobacterium
AVQAFGVLLVALQPVDERQLLVDQR

SEQ ID NO: 797285 - protein, 19 aa, Mycobacterium
AVQALLKQADLDVALQFVN

SEQ ID NO: 797286 - protein, 22 aa, Mycobacterium
AVQATFFHPHKVKRDLQVGNRV

SEQ ID NO: 797287 - protein, 25 aa, Mycobacterium
AVQDRLLMAAAAIPAYALLRSPDDL

SEQ ID NO: 797288 - protein, 19 aa, Mycobacterium
AVQEDVAVVGLSILSGAHL

SEQ ID NO: 797289 - protein, 24 aa, Mycobacterium
AVQEDWSFAFGWQALEAVADTARG

SEQ ID NO: 797290 - protein, 28 aa, Mycobacterium
AVQFPAPVKYVAPIAFNVVPLAGSLVDD

SEQ ID NO: 797291 - protein, 28 aa, Mycobacterium
AVQGVIARIDWARFLPLYQQAGKRGFLA

SEQ ID NO: 797292 - protein, 33 aa, Mycobacterium
AVQHLFQAGGKRFRPLFTVLSAQLGPEPDAWQV

SEQ ID NO: 797293 - protein, 18 aa, Mycobacterium
AVQHYAASGYWPHTRIME

SEQ ID NO: 797294 - protein, 17 aa, Mycobacterium
AVQIDRAIAALRPPRRG

SEQ ID NO: 797295 - protein, 38 aa, Mycobacterium
AVQIMTVFVAKGLQFPIVYVPFLFNRNVRREDIMLYHD

SEQ ID NO: 797296 - protein, 37 aa, Mycobacterium
AVQIMTVWVSKGLQFPVVYLPFAFNRNVQPRDVVVFH

SEQ ID NO: 797297 - protein, 39 aa, Mycobacterium
AVQIMTVWVSKGLQFPVVYLPFAFNRYVPEPDLVLFHDD

SEQ ID NO: 797298 - protein, 39 aa, Mycobacterium
AVQIMTVWVSKGLQFPVVYLPFSFNRYVPEREYVLYHED

SEQ ID NO: 797299 - protein, 38 aa, Mycobacterium
AVQIMTVWVSKGLQYPVVYLPFAFNRNIQERELVLFHD

SEQ ID NO: 797300 - protein, 17 aa, Mycobacterium
AVQLAHVIAAQAPLGVQ

SEQ ID NO: 797301 - protein, 19 aa, Mycobacterium
AVQLAVYRLAWAAMRGCPP

SEQ ID NO: 797302 - protein, 21 aa, Mycobacterium
AVQLGSWPLADVLAPWGGMPI

SEQ ID NO: 797303 - protein, 24 aa, Mycobacterium
AVQMRVEALLRYPVKSMLGETVDA

SEQ ID NO: 797304 - protein, 17 aa, Mycobacterium
AVQPDVLLMDEPCSALD

SEQ ID NO: 797305 - protein, 34 aa, Mycobacterium
AVQPFSMDVPIDLNLFIDLPSPIPNVTIPLGDGE

SEQ ID NO: 797306 - protein, 27 aa, Mycobacterium
AVQRAAAVLLILNPAHPISRVAGMLAD

SEQ ID NO: 797307 - protein, 20 aa, Mycobacterium
AVQRATAERLPLLASPSSGG

SEQ ID NO: 797308 - protein, 24 aa, Mycobacterium
AVQRGMRSLGFLGPKPNPYMERST

SEQ ID NO: 797309 - protein, 18 aa, Mycobacterium
AVQRIMFRDGLVLNFEDY

SEQ ID NO: 797310 - protein, 19 aa, Mycobacterium
AVQSLRLYERHGLVTPARS

SEQ ID NO: 797311 - protein, 25 aa, Mycobacterium
AVQSLRLYERYGLLTPARSDGGTRR

SEQ ID NO: 797312 - protein, 22 aa, Mycobacterium
AVQSWIQVPLPASFYEDEKAEA

SEQ ID NO: 797313 - protein, 17 aa, Mycobacterium
AVQSYLEHQGNKFVRRF

SEQ ID NO: 797314 - protein, 19 aa, Mycobacterium
AVQSYLEYQGGKLARRFDP

SEQ ID NO: 797315 - protein, 17 aa, Mycobacterium
AVQTILRLDPHGSLRFA

SEQ ID NO: 797316 - protein, 20 aa, Mycobacterium
AVQTIWARSVVRDLEDAYAC

SEQ ID NO: 797317 - protein, 21 aa, Mycobacterium
AVQTLLLRAVAVLDLADALDE

SEQ ID NO: 797318 - protein, 19 aa, Mycobacterium
AVQTVLYPGLPSHPNHDVA

SEQ ID NO: 797319 - protein, 23 aa, Mycobacterium
AVQVNNIHLVRGMLGKPGCGILQ

SEQ ID NO: 797320 - protein, 22 aa, Mycobacterium
AVQVNNIHLVRGMLGKPGCGVL

SEQ ID NO: 797321 - protein, 26 aa, Mycobacterium
AVQWSPDRFWPPHSTIKLMVGGKPAE

SEQ ID NO: 797322 - protein, 25 aa, Mycobacterium
AVQYAAFPLARLKRAMLIGIPESAI

SEQ ID NO: 797323 - protein, 26 aa, Mycobacterium
AVQYRLPVTFVLFNNNAHAMCVTREQ

SEQ ID NO: 797324 - protein, 27 aa, Mycobacterium
AVRALRDDIIMLRMPGFGLDGPWRDNP

SEQ ID NO: 797325 - protein, 34 aa, Mycobacterium
AVRALRNPIVERLILPWFGYEMWGYMHNAIRHAP

SEQ ID NO: 797326 - protein, 17 aa, Mycobacterium
AVRALVDALPDGPARFI

SEQ ID NO: 797327 - protein, 28 aa, Mycobacterium
AVRAPAVVKLHRWLQEAYEYVNRSPNVL

SEQ ID NO: 797328 - protein, 23 aa, Mycobacterium
AVRARLARFLFRGNAADKLVGAL

SEQ ID NO: 797329 - protein, 21 aa, Mycobacterium
AVRATPFLRRIAITGETDLPC

SEQ ID NO: 797330 - protein, 33 aa, Mycobacterium
AVRAVFIIDPGGIVRAIIYYPLSLGRNFDELLR

SEQ ID NO: 797331 - protein, 18 aa, Mycobacterium
AVRAVRYPGLAQDPAHPV

SEQ ID NO: 797332 - protein, 30 aa, Mycobacterium
AVRAWAMTPNLHWPLEYVDSFAGMFPRLGS

SEQ ID NO: 797333 - protein, 27 aa, Mycobacterium
AVRAWRSFSCWLMRAYDILVDEDQIAQ

SEQ ID NO: 797334 - protein, 26 aa, Mycobacterium
AVRAWRSFSCWLMRAYDVLVDEDQIA

SEQ ID NO: 797335 - protein, 18 aa, Mycobacterium
AVRCELLRSAFAAVIARL

SEQ ID NO: 797336 - protein, 35 aa, Mycobacterium
AVRDADYAGFIWYPQLPALELWRELYQRVARANRG

SEQ ID NO: 797337 - protein, 18 aa, Mycobacterium
AVRDEVGRLPGVERVDVS

SEQ ID NO: 797338 - protein, 23 aa, Mycobacterium
AVRDGMATLGPLAAQIIAQLSSL

SEQ ID NO: 797339 - protein, 26 aa, Mycobacterium
AVRDKIPLVMLLEGAGFRPTGVHYGR

SEQ ID NO: 797340 - protein, 17 aa, Mycobacterium
AVRDVLYYLVRAAELPA

SEQ ID NO: 797341 - protein, 27 aa, Mycobacterium
AVREALPGLPLGVTTGFWALPDAQQRL

SEQ ID NO: 797342 - protein, 17 aa, Mycobacterium
AVREIDFVLARGARLVH

SEQ ID NO: 797343 - protein, 25 aa, Mycobacterium
AVREIDLSALAPYVARPGTVSRNGV

SEQ ID NO: 797344 - protein, 23 aa, Mycobacterium
AVRELWLARDRIAQLRDIAPRRI

SEQ ID NO: 797345 - protein, 25 aa, Mycobacterium
AVRERLPMVIVVYNDGAYGAEYQKL

SEQ ID NO: 797346 - protein, 19 aa, Mycobacterium
AVRFGLFHVLQASARAERR

SEQ ID NO: 797347 - protein, 18 aa, Mycobacterium
AVRGALLGGYFAGLLDRT

SEQ ID NO: 797348 - protein, 29 aa, Mycobacterium
AVRGARAMLLWDFFSKAVRDVWSAAGSVE

SEQ ID NO: 797349 - protein, 18 aa, Mycobacterium
AVRGGICVTPVLGSRSYD

SEQ ID NO: 797350 - protein, 19 aa, Mycobacterium
AVRGGILDLFAPTAEHPVR

SEQ ID NO: 797351 - protein, 25 aa, Mycobacterium
AVRGHYMAPLLGTSSPRRADLLSAV

SEQ ID NO: 797352 - protein, 18 aa, Mycobacterium
AVRGLDFGALSPAVRLHV

SEQ ID NO: 797353 - protein, 35 aa, Mycobacterium
AVRHAVPGFPLGVTTGFWALPDPKKRLRTVEAWEV

SEQ ID NO: 797354 - protein, 23 aa, Mycobacterium
AVRHGGFTLAERKKLAALAFQHT

SEQ ID NO: 797355 - protein, 18 aa, Mycobacterium
AVRIALDDWLSHGGSLPD

SEQ ID NO: 797356 - protein, 24 aa, Mycobacterium
AVRLGLLAGHYRADRFWSQQVLDE

SEQ ID NO: 797357 - protein, 24 aa, Mycobacterium
AVRLGLLAGHYRADRSWSDAVLAD

SEQ ID NO: 797358 - protein, 29 aa, Mycobacterium
AVRLHQQAHLPYLVYLRNPTTGGVFASWG

SEQ ID NO: 797359 - protein, 23 aa, Mycobacterium
AVRLRDGLELVLLQANYADGPDE

SEQ ID NO: 797360 - protein, 21 aa, Mycobacterium
AVRMLKYAFNLLDDGLVGQQL

SEQ ID NO: 797361 - protein, 24 aa, Mycobacterium
AVRMPRAYFALLEGCNHGQTVTMR

SEQ ID NO: 797362 - protein, 22 aa, Mycobacterium
AVRPCPPVVIWSLSPPDLRGDD

SEQ ID NO: 797363 - protein, 25 aa, Mycobacterium
AVRPEPFGALLYHFGTRKLSFLKNR

SEQ ID NO: 797364 - protein, 23 aa, Mycobacterium
AVRPYERLLYAALTGDRQLFARE

SEQ ID NO: 797365 - protein, 28 aa, Mycobacterium
AVRQGKLLASRLLPWARSGHLTLPRGGD

SEQ ID NO: 797366 - protein, 32 aa, Mycobacterium
AVRQGKLLASRLLPWARSGHLTVPRGRDFALA

SEQ ID NO: 797367 - protein, 27 aa, Mycobacterium
AVRQGKLLASRLLPWSRSGHLTVPRGG

SEQ ID NO: 797368 - protein, 27 aa, Mycobacterium
AVRQGKLLASRLLPWSRTGHLTVPRGS

SEQ ID NO: 797369 - protein, 24 aa, Mycobacterium
AVRQRFLGLGFSAGFADAYIAMLA

SEQ ID NO: 797370 - protein, 30 aa, Mycobacterium
AVRQVGNGGLLLPLGLRRLRVYASTRNARY

SEQ ID NO: 797371 - protein, 25 aa, Mycobacterium
AVRRAGGLPLLYYSGRMHDWAATVH

SEQ ID NO: 797372 - protein, 22 aa, Mycobacterium
AVRRFGRMFVLGARLTVPLGMI

SEQ ID NO: 797373 - protein, 17 aa, Mycobacterium
AVRRLRPTIAGFADALL

SEQ ID NO: 797374 - protein, 17 aa, Mycobacterium
AVRRNVFDLLSPRDIRL

SEQ ID NO: 797375 - protein, 25 aa, Mycobacterium
AVRRSAPFATLPRSAFEATLDLLSG

SEQ ID NO: 797376 - protein, 19 aa, Mycobacterium
AVRRYVTDAGPLLPRLHKL

SEQ ID NO: 797377 - protein, 24 aa, Mycobacterium
AVRSAGLFGQYRALIGWGQGRTPG

SEQ ID NO: 797378 - protein, 26 aa, Mycobacterium
AVRSDEFTVFLTPKLLDQQILDYLGG

SEQ ID NO: 797379 - protein, 23 aa, Mycobacterium
AVRSHLAPFLPGHPHAPELPQGH

SEQ ID NO: 797380 - protein, 18 aa, Mycobacterium
AVRSLPAYALLDPDGAAQ

SEQ ID NO: 797381 - protein, 25 aa, Mycobacterium
AVRSRWPGVAPLRVRPRRAATAAHY

SEQ ID NO: 797382 - protein, 26 aa, Mycobacterium
AVRSTRAALPLLRRSDSAAIVNVSSL

SEQ ID NO: 797383 - protein, 20 aa, Mycobacterium
AVRSVRFPGLADDPSHEVAA

SEQ ID NO: 797384 - protein, 20 aa, Mycobacterium
AVRTDLLRRSSTTSYCNYKG

SEQ ID NO: 797385 - protein, 24 aa, Mycobacterium
AVRTKFFDEFFLNATRAGIKQAVI

SEQ ID NO: 797386 - protein, 24 aa, Mycobacterium
AVRTPFAFEGLFGHLAASAVPGVE

SEQ ID NO: 797387 - protein, 33 aa, Mycobacterium
AVRTQLVDGIPFKWWEKLGIIPPGWVARDAVRT

SEQ ID NO: 797388 - protein, 18 aa, Mycobacterium
AVRTQYAFGPTIGSAVNV

SEQ ID NO: 797389 - protein, 22 aa, Mycobacterium
AVRTRFFDDFFLNAARDGIRQS

SEQ ID NO: 797390 - protein, 30 aa, Mycobacterium
AVRVGHHCAWPLHRRFGIAASARASFAVYN

SEQ ID NO: 797391 - protein, 30 aa, Mycobacterium
AVRVGHHCAWPLHRRFGIAATARASFAVYN

SEQ ID NO: 797392 - protein, 27 aa, Mycobacterium
AVRVSMGHALLVPYARATDWPAELKML

SEQ ID NO: 797393 - protein, 22 aa, Mycobacterium
AVRWVRPRDSWLLNRAHIQPGE

SEQ ID NO: 797394 - protein, 24 aa, Mycobacterium
AVRYEAWSFPDFETGAAALRAVTQ

SEQ ID NO: 797395 - protein, 23 aa, Mycobacterium
AVRYSVVFWFAVAGISGGADQDD

SEQ ID NO: 797396 - protein, 25 aa, Mycobacterium
AVSAAARSHVCSMRTIATGTAHATG

SEQ ID NO: 797397 - protein, 25 aa, Mycobacterium
AVSADRKQWFLFNASPDIQSQIEAF

SEQ ID NO: 797398 - protein, 31 aa, Mycobacterium
AVSAGAGRLVWLPASLPAPYREHSLRQLAPT

SEQ ID NO: 797399 - protein, 28 aa, Mycobacterium
AVSARLTTRTLFFARSLPAIQHFLELLR

SEQ ID NO: 797400 - protein, 30 aa, Mycobacterium
AVSARLTTRTLFFARSLPAVAHFLDLLRGD

SEQ ID NO: 797401 - protein, 17 aa, Mycobacterium
AVSDRYWRRYFDNFAEV

SEQ ID NO: 797402 - protein, 19 aa, Mycobacterium
AVSDRYWRRYFDNFAEVMS

SEQ ID NO: 797403 - protein, 34 aa, Mycobacterium
AVSDWMHAVPEQIRPWVPGMYRTLGADGFGISDT

SEQ ID NO: 797404 - protein, 28 aa, Mycobacterium
AVSEAYFAALLGLPFIAVMTASTSPSKI

SEQ ID NO: 797405 - protein, 27 aa, Mycobacterium
AVSESLRYVAAWNAAFLPSKDLTEGIT

SEQ ID NO: 797406 - protein, 19 aa, Mycobacterium
AVSGGIAWIPAHQRSPDRD

SEQ ID NO: 797407 - protein, 22 aa, Mycobacterium
AVSGGIVWIPAHDRAGEPLPVE

SEQ ID NO: 797408 - protein, 24 aa, Mycobacterium
AVSIPLLRKDFVVQPYQIHEARAH

SEQ ID NO: 797409 - protein, 18 aa, Mycobacterium
AVSIPVMAKARIGHFVEA

SEQ ID NO: 797410 - protein, 18 aa, Mycobacterium
AVSIVLDVPRGSAARFGY

SEQ ID NO: 797411 - protein, 23 aa, Mycobacterium
AVSIYRAARPIAGPLSPVMRRRS

SEQ ID NO: 797412 - protein, 21 aa, Mycobacterium
AVSLAKRYLGYFQGKVEGWQA

SEQ ID NO: 797413 - protein, 21 aa, Mycobacterium
AVSLLGDVWWWSTAVNVDSED

SEQ ID NO: 797414 - protein, 21 aa, Mycobacterium
AVSLVPYLLNPDSTGPAFFPP

SEQ ID NO: 797415 - protein, 19 aa, Mycobacterium
AVSNRLFLDALLRGRYPAD

SEQ ID NO: 797416 - protein, 18 aa, Mycobacterium
AVSPYWTIDDIRPALIHT

SEQ ID NO: 797417 - protein, 25 aa, Mycobacterium
AVSQHMSPPLKLIGAGELVGVAGKA

SEQ ID NO: 797418 - protein, 24 aa, Mycobacterium
AVSQTAMTWVPPTAPPPPIQLTNP

SEQ ID NO: 797419 - protein, 17 aa, Mycobacterium
AVSSWFIKVTEFRDRMV

SEQ ID NO: 797420 - protein, 17 aa, Mycobacterium
AVSSWFVRVTEFRDRMV

SEQ ID NO: 797421 - protein, 26 aa, Mycobacterium
AVSTVTFLIQPYQNIVRLTVSHADLA

SEQ ID NO: 797422 - protein, 25 aa, Mycobacterium
AVSVFAKNLKDLLLAAPAGARTTLG

SEQ ID NO: 797423 - protein, 21 aa, Mycobacterium
AVSVFSIEFLVHAWDYATAVG

SEQ ID NO: 797424 - protein, 25 aa, Mycobacterium
AVSVFSIEFLVHAWDYATAVGSDVR

SEQ ID NO: 797425 - protein, 25 aa, Mycobacterium
AVSVGDYHIPKMIGWTLLGEPVDDA

SEQ ID NO: 797426 - protein, 25 aa, Mycobacterium
AVSVGDYHIPKMIGWTLLGHPVDDA

SEQ ID NO: 797427 - protein, 23 aa, Mycobacterium
AVSVYCRRVLSPDAIHTVLPEAL

SEQ ID NO: 797428 - protein, 31 aa, Mycobacterium
AVSWVLHPEPWYLEGKLFKALHLPLNFQGND

SEQ ID NO: 797429 - protein, 25 aa, Mycobacterium
AVTAAEWRRVLRRWLHEATEAPAEV

SEQ ID NO: 797430 - protein, 23 aa, Mycobacterium
AVTAALLHFLPPAQVAKALDQLP

SEQ ID NO: 797431 - protein, 18 aa, Mycobacterium
AVTAITAGSLGGTVETVA

SEQ ID NO: 797432 - protein, 28 aa, Mycobacterium
AVTAITRVVGLNCGTPCPAFAGGSTVTA

SEQ ID NO: 797433 - protein, 24 aa, Mycobacterium
AVTALLDHALLPEGAERLGPVDLP

SEQ ID NO: 797434 - protein, 17 aa, Mycobacterium
AVTALSGSGPAYFLLMV

SEQ ID NO: 797435 - protein, 24 aa, Mycobacterium
AVTASGWSWRHAGRPRWALRDLDV

SEQ ID NO: 797436 - protein, 27 aa, Mycobacterium
AVTASPYLGFGSLRPLLDTAVANGRGV

SEQ ID NO: 797437 - protein, 26 aa, Mycobacterium
AVTAYHKLLVWDLMQRPKVTQLAESV

SEQ ID NO: 797438 - protein, 17 aa, Mycobacterium
AVTCRVLKLARQPYYRW

SEQ ID NO: 797439 - protein, 32 aa, Mycobacterium
AVTDAMPALHLLPLADLLGVVPVLATDVLRRL

SEQ ID NO: 797440 - protein, 20 aa, Mycobacterium
AVTDHRMVVPIPAGWSFAAA

SEQ ID NO: 797441 - protein, 25 aa, Mycobacterium
AVTDPALLGFGSLALALVTTDGTRS

SEQ ID NO: 797442 - protein, 24 aa, Mycobacterium
AVTDPIQLGFARQALIGIRATGDT

SEQ ID NO: 797443 - protein, 31 aa, Mycobacterium
AVTDSMPALHLLPLAGVLGVLPVLATGVMRA

SEQ ID NO: 797444 - protein, 23 aa, Mycobacterium
AVTDWLYWLYITAQLDSAQAIAA

SEQ ID NO: 797445 - protein, 25 aa, Mycobacterium
AVTEALIGAMLYRIFNRAKTVDETI

SEQ ID NO: 797446 - protein, 24 aa, Mycobacterium
AVTEGMWGIPWDKPVRRLNEYLDG

SEQ ID NO: 797447 - protein, 29 aa, Mycobacterium
AVTFPAPVKYVAPIAFNVIPLAGSLVDDG

SEQ ID NO: 797448 - protein, 25 aa, Mycobacterium
AVTGGPLREWLHKQRTGKPHVTWKF

SEQ ID NO: 797449 - protein, 28 aa, Mycobacterium
AVTGTLTLRYRRPTPLDAALRAEARIRE

SEQ ID NO: 797450 - protein, 27 aa, Mycobacterium
AVTHDRYFLDNVAQWILELDRGRAYPY

SEQ ID NO: 797451 - protein, 19 aa, Mycobacterium
AVTHHVPFADWVDGRVLLG

SEQ ID NO: 797452 - protein, 23 aa, Mycobacterium
AVTINKLWELFVAEDATLVEVNP

SEQ ID NO: 797453 - protein, 19 aa, Mycobacterium
AVTIRDLRDRLGLDSGYVT

SEQ ID NO: 797454 - protein, 21 aa, Mycobacterium
AVTISKLWELFVAEDATLVEV

SEQ ID NO: 797455 - protein, 27 aa, Mycobacterium
AVTIVNLIRALLRNPAVWEKTALIIAY

SEQ ID NO: 797456 - protein, 24 aa, Mycobacterium
AVTKLDLVNYYRAVADGALRGVFG

SEQ ID NO: 797457 - protein, 31 aa, Mycobacterium
AVTKTLRFNFFVLKLPVRPPALVAKQAGSLA

SEQ ID NO: 797458 - protein, 18 aa, Mycobacterium
AVTLAALAPRPGERLWDV

SEQ ID NO: 797459 - protein, 17 aa, Mycobacterium
AVTLHRLLGSRPDTSSR

SEQ ID NO: 797460 - protein, 22 aa, Mycobacterium
AVTLLLATARQIPAADASLKAH

SEQ ID NO: 797461 - protein, 17 aa, Mycobacterium
AVTLLQTLRAAVGRSTP

SEQ ID NO: 797462 - protein, 18 aa, Mycobacterium
AVTLSALTPACPAPAVIP

SEQ ID NO: 797463 - protein, 34 aa, Mycobacterium
AVTMPWLDRVSAVLESWYPGIRGGQAIAAILFGD

SEQ ID NO: 797464 - protein, 24 aa, Mycobacterium
AVTNANLFWGLRGGAGCVGIVTDL

SEQ ID NO: 797465 - protein, 31 aa, Mycobacterium
AVTNRAVLAIYRPLLEPLGLTHPQYLVMLAL

SEQ ID NO: 797466 - protein, 31 aa, Mycobacterium
AVTPPLVHPVLGLIGFVPRPVAAAVRTGLDT

SEQ ID NO: 797467 - protein, 30 aa, Mycobacterium
AVTPYASVTFPWYLLGRQVHIRGAVSKVTE

SEQ ID NO: 797468 - protein, 18 aa, Mycobacterium
AVTPYVTWLCATAARAEQ

SEQ ID NO: 797469 - protein, 22 aa, Mycobacterium
AVTQIEMLAMSDLSLMVKAGVQ

SEQ ID NO: 797470 - protein, 21 aa, Mycobacterium
AVTQPLVVAATLLAHEELTKR

SEQ ID NO: 797471 - protein, 28 aa, Mycobacterium
AVTQRHLRRLWAMPGTQLGVVAWPATRK

SEQ ID NO: 797472 - protein, 17 aa, Mycobacterium
AVTRPIDAPLTQPPPAP

SEQ ID NO: 797473 - protein, 25 aa, Mycobacterium
AVTRRMQDAGVWLFAAGLQPADTAT

SEQ ID NO: 797474 - protein, 17 aa, Mycobacterium
AVTRRRRARKGTLEFGD

SEQ ID NO: 797475 - protein, 18 aa, Mycobacterium
AVTRTRKALADHGFGVLT

SEQ ID NO: 797476 - protein, 31 aa, Mycobacterium; identical to SEQ ID NO: 113564

SEQ ID NO: 797477 - protein, 18 aa, Mycobacterium
AVTSLAWLTAAGPGFRPS

SEQ ID NO: 797478 - protein, 31 aa, Mycobacterium
AVTSLWKDGYLQRFELQPFSKQQSIALIETV

SEQ ID NO: 797479 - protein, 30 aa, Mycobacterium
AVTSMHMVPSLLGLILSLPGVTQWKSLRRV

SEQ ID NO: 797480 - protein, 19 aa, Mycobacterium
AVTTAWWKEERGERIFVDF

SEQ ID NO: 797481 - protein, 28 aa, Mycobacterium
AVTTFNKAFAPYGLPRTAFKPSYGIAEA

SEQ ID NO: 797482 - protein, 31 aa, Mycobacterium
AVTTKLHFNFFVLKLPIRPPALVAKQIGSLA

SEQ ID NO: 797483 - protein, 17 aa, Mycobacterium
AVTTSWWKEERGERLFI

SEQ ID NO: 797484 - protein, 18 aa, Mycobacterium
AVTTSWWKEERGQRIFID

SEQ ID NO: 797485 - protein, 31 aa, Mycobacterium
AVTTTLRFNFFVLKLPVRPPALVAKQAGSLA

SEQ ID NO: 797486 - protein, 19 aa, Mycobacterium
AVTTTSWLTSRHSFSFGDH

SEQ ID NO: 797487 - protein, 20 aa, Mycobacterium
AVTTVTTGLTGRASYGGIGA

SEQ ID NO: 797488 - protein, 27 aa, Mycobacterium
AVTVFARNLKDLLLAAPAGNRTTLGLD

SEQ ID NO: 797489 - protein, 25 aa, Mycobacterium
AVTVNWPKALMLCRRMIGAGTTVAD

SEQ ID NO: 797490 - protein, 18 aa, Mycobacterium
AVTVPWKNAIGLAISQAG

SEQ ID NO: 797491 - protein, 17 aa, Mycobacterium
AVTWLAAAGRLSDPRPL

SEQ ID NO: 797492 - protein, 26 aa, Mycobacterium
AVTYNAFFAAAAAPPILIGDPARQHG

SEQ ID NO: 797493 - protein, 25 aa, Mycobacterium
AVVAAEWPLYEVFVRGKRGLNHVHV

SEQ ID NO: 797494 - protein, 25 aa, Mycobacterium
AVVAALARRLAPGGLLVAGFQLGTG

SEQ ID NO: 797495 - protein, 17 aa, Mycobacterium
AVVAFNHAYHGRTNLAM

SEQ ID NO: 797496 - protein, 20 aa, Mycobacterium
AVVAIPHLGILLSSPSSAAT

SEQ ID NO: 797497 - protein, 26 aa, Mycobacterium
AVVALLAARFRIVRYDTRGAGRSAAP

SEQ ID NO: 797498 - protein, 33 aa, Mycobacterium
AVVANLPYNVAVPALLHLLADFPSIQTVTVMVQ

SEQ ID NO: 797499 - protein, 17 aa, Mycobacterium
AVVAPRPGSRPSLAELD

SEQ ID NO: 797500 - protein, 19 aa, Mycobacterium
AVVAQRRSLLAAGITAVSG

SEQ ID NO: 797501 - protein, 20 aa, Mycobacterium
AVVATDWSDGLSASLRAGVG

SEQ ID NO: 797502 - protein, 21 aa, Mycobacterium
AVVAVLARNLAVTLVQLVGAA

SEQ ID NO: 797503 - protein, 21 aa, Mycobacterium
AVVDLDLNLKLQPAKYRQLLQ

SEQ ID NO: 797504 - protein, 32 aa, Mycobacterium
AVVDQRLLVKLPSGWSLAQAAGVPVAFLTAWY

SEQ ID NO: 797505 - protein, 23 aa, Mycobacterium
AVVDVRPAFLLPGFVDAHIHFPQ

SEQ ID NO: 797506 - protein, 24 aa, Mycobacterium
AVVEALVRKLGPDFLVEVLEIRAA

SEQ ID NO: 797507 - protein, 19 aa, Mycobacterium
AVVELLFGTPGFGGGEQLV

SEQ ID NO: 797508 - protein, 22 aa, Mycobacterium
AVVESLIPIGPLTMEVGLNVTC

SEQ ID NO: 797509 - protein, 29 aa, Mycobacterium
AVVFQNPRLLPWRRALANVTFALPQAGPD

SEQ ID NO: 797510 - protein, 28 aa, Mycobacterium
AVVFQNPRLLPWRRALANVTFALRDGGP

SEQ ID NO: 797511 - protein, 28 aa, Mycobacterium
AVVGIGLPLTRDLISRAGISIAALWASN

SEQ ID NO: 797512 - protein, 18 aa, Mycobacterium
AVVHGVSVGLLICYDVEF

SEQ ID NO: 797513 - protein, 35 aa, Mycobacterium
AVVIEPRLWVPDDFAFVRYLAVGLAALHTVNRDRS

SEQ ID NO: 797514 - protein, 31 aa, Mycobacterium
AVVIGISPRRPLDALYRGFCQLLVDQLSAAL

SEQ ID NO: 797515 - protein, 24 aa, Mycobacterium
AVVIGVSPLRPLDSMYRAFCQLLT

SEQ ID NO: 797516 - protein, 22 aa, Mycobacterium
AVVIRAPRSVPLGVFYSMIEII

SEQ ID NO: 797517 - protein, 17 aa, Mycobacterium
AVVITKLDHPRANYDAA

SEQ ID NO: 797518 - protein, 20 aa, Mycobacterium
AVVIYLEYLGITLGELLDAR

SEQ ID NO: 797519 - protein, 29 aa, Mycobacterium
AVVLCHGFPGLWYTWRHQLAALSAAGYRA

SEQ ID NO: 797520 - protein, 17 aa, Mycobacterium
AVVLKPAPETPFTGGLM

SEQ ID NO: 797521 - protein, 18 aa, Mycobacterium
AVVLTEIGRRLAPEPVLH

SEQ ID NO: 797522 - protein, 17 aa, Mycobacterium
AVVPIARQTPTLLVVVD

SEQ ID NO: 797523 - protein, 17 aa, Mycobacterium
AVVPKSTAVVVWQPRRT

SEQ ID NO: 797524 - protein, 19 aa, Mycobacterium
AVVPLGWPIGKYGPTTRRP

SEQ ID NO: 797525 - protein, 31 aa, Mycobacterium; identical to SEQ ID NO: 124696

SEQ ID NO: 797526 - protein, 22 aa, Mycobacterium
AVVPQGAVIPPGSMVAGVPGKV

SEQ ID NO: 797527 - protein, 23 aa, Mycobacterium
AVVPRLHLVPGMRSRLTTSRTPA

SEQ ID NO: 797528 - protein, 33 aa, Mycobacterium
AVVPVNPESWFIYGLYRLSPSFSRTLTGIGSFE

SEQ ID NO: 797529 - protein, 30 aa, Mycobacterium
AVVRASHNSVLIELYRGLIEAITASVATAS

SEQ ID NO: 797530 - protein, 23 aa, Mycobacterium
AVVRLPDFVLGPVSLQVDAGERI

SEQ ID NO: 797531 - protein, 25 aa, Mycobacterium
AVVRVPLFFMLMPRGSSPIEGTQVS

SEQ ID NO: 797532 - protein, 17 aa, Mycobacterium
AVVRYLVAGTPPPAAYT

SEQ ID NO: 797533 - protein, 24 aa, Mycobacterium
AVVSLTRALALQLAPEGIRANTVC

SEQ ID NO: 797534 - protein, 20 aa, Mycobacterium
AVVTALTPFAPLQSLAGLQS

SEQ ID NO: 797535 - protein, 24 aa, Mycobacterium
AVVTATNFLGMSTALIALSETDYF

SEQ ID NO: 797536 - protein, 18 aa, Mycobacterium
AVVTFVRPSLRNGLWHLT

SEQ ID NO: 797537 - protein, 24 aa, Mycobacterium
AVVTGYWNIFKQNIGIMIAVDQLA

SEQ ID NO: 797538 - protein, 24 aa, Mycobacterium
AVVTSLIRYTLRSAALHYPDPTSG

SEQ ID NO: 797539 - protein, 18 aa, Mycobacterium
AVVVDLPRRLGASGVAAL

SEQ ID NO: 797540 - protein, 23 aa, Mycobacterium
AVVVFDHAFHGRSLLTMTMTAKN

SEQ ID NO: 797541 - protein, 19 aa, Mycobacterium
AVVVRGTMPASPIGGHAAV

SEQ ID NO: 797542 - protein, 25 aa, Mycobacterium
AVWEEVILHLPDEVLLVSLSATVSN

SEQ ID NO: 797543 - protein, 20 aa, Mycobacterium
AVWEKFAEFGLDARAFSGVK

SEQ ID NO: 797544 - protein, 29 aa, Mycobacterium
AVWGHRISHWLWRRNARLVARALGEINRI

SEQ ID NO: 797545 - protein, 17 aa, Mycobacterium
AVWHHRPTVGRRGRAVI

SEQ ID NO: 797546 - protein, 18 aa, Mycobacterium
AVWLALRGLEVVGVDVSP

SEQ ID NO: 797547 - protein, 18 aa, Mycobacterium
AVWMRRLPEEGMLPAKLA

SEQ ID NO: 797548 - protein, 17 aa, Mycobacterium
AVWQALPGEQWPQRLAE

SEQ ID NO: 797549 - protein, 24 aa, Mycobacterium
AVWRVRAYGDFWSYCMVAEGAVDI

SEQ ID NO: 797550 - protein, 18 aa, Mycobacterium
AVWTAIRERPARRPAWRP

SEQ ID NO: 797551 - protein, 17 aa, Mycobacterium
AVWTGDDITFEGRHFSA

SEQ ID NO: 797552 - protein, 36 aa, Mycobacterium
AVWTRPAWQLDNWVRDFFGPADDWFKGFTPAAEVTR

SEQ ID NO: 797553 - protein, 34 aa, Mycobacterium
AVWVYETHWWSHRALWHLIFSGALDRHPDLTVVF

SEQ ID NO: 797554 - protein, 19 aa, Mycobacterium
AVWWERAVEAWPDYAEYQQ

SEQ ID NO: 797555 - protein, 17 aa, Mycobacterium
AVYALVYGLVELAATAA

SEQ ID NO: 797556 - protein, 28 aa, Mycobacterium
AVYDAGLAWVHFPVGLGGLDAPPALQAV

SEQ ID NO: 797557 - protein, 18 aa, Mycobacterium
AVYELGMSGIPVVNVNNN

SEQ ID NO: 797558 - protein, 17 aa, Mycobacterium
AVYFDSEDLPQLAKHFY

SEQ ID NO: 797559 - protein, 24 aa, Mycobacterium
AVYGFTSMLINLLRDEAPTHVAAA

SEQ ID NO: 797560 - protein, 21 aa, Mycobacterium
AVYIDAGHLRWHSAEDMAARL

SEQ ID NO: 797561 - protein, 21 aa, Mycobacterium
AVYPFVPAMIEYYLGEKPALA

SEQ ID NO: 797562 - protein, 17 aa, Mycobacterium
AVYPMTKAAVLCLTESL

SEQ ID NO: 797563 - protein, 19 aa, Mycobacterium
AVYPTTDWHERETYDFFGI

SEQ ID NO: 797564 - protein, 19 aa, Mycobacterium
AVYQLRRWYQQFYVDVADI

SEQ ID NO: 797565 - protein, 19 aa, Mycobacterium
AVYQMRRWYQQFYVDVADI

SEQ ID NO: 797566 - protein, 21 aa, Mycobacterium
AVYQMRRWYSQFYVDKADVTP

SEQ ID NO: 797567 - protein, 28 aa, Mycobacterium
AVYQRYMGWFDGNPARLWQHPPEAIGPR

SEQ ID NO: 797568 - protein, 27 aa, Mycobacterium
AVYQRYMGWFDGNPGRLWPHPPEAIGP

SEQ ID NO: 797569 - protein, 35 aa, Mycobacterium
AVYQRYMGWFDGNPGRLWPHPPEELAPRYVEAMGG

SEQ ID NO: 797570 - protein, 28 aa, Mycobacterium
AVYQRYMGWFDGNPGRLWQHPPEALGPR

SEQ ID NO: 797571 - protein, 17 aa, Mycobacterium
AVYRAHWLVARTAEHIG

SEQ ID NO: 797572 - protein, 17 aa, Mycobacterium
AVYRLRLELPQVDPTAL

SEQ ID NO: 797573 - protein, 22 aa, Mycobacterium
AVYRSTAPPLPGRPVRHTLSLV

SEQ ID NO: 797574 - protein, 37 aa, Mycobacterium
AVYRTMLMHLMRIASTFGFVPIGGWALRAIVAALMEW

SEQ ID NO: 797575 - protein, 19 aa, Mycobacterium
AVYSGYRFVRRAAALAIPI

SEQ ID NO: 797576 - protein, 22 aa, Mycobacterium
AVYTLSSGWINDIWAGASPTSP

SEQ ID NO: 797577 - protein, 25 aa, Mycobacterium
AVYTLSTGWINDIWAGASPPAPIYG

SEQ ID NO: 797578 - protein, 19 aa, Mycobacterium
AVYVDGGHSRWVSAEEMAA

SEQ ID NO: 797579 - protein, 19 aa, Mycobacterium
AVYVIPSDVSVVREAAIEA

SEQ ID NO: 797580 - protein, 17 aa, Mycobacterium
AWAAAGVPPRDTGLGAV

SEQ ID NO: 797581 - protein, 21 aa, Mycobacterium
AWAAAWTFLHINGVQLAADFD

SEQ ID NO: 797582 - protein, 18 aa, Mycobacterium
AWAAEQPGFRGERLVNSM

SEQ ID NO: 797583 - protein, 19 aa, Mycobacterium
AWAAGAHLPITLPSGRVRQ

SEQ ID NO: 797584 - protein, 19 aa, Mycobacterium
AWALERLTRHPAILAKAVR

SEQ ID NO: 797585 - protein, 22 aa, Mycobacterium
AWANILLQRKVPADAALNLFTK

SEQ ID NO: 797586 - protein, 20 aa, Mycobacterium
AWANIVLHRVPAARDALARV

SEQ ID NO: 797587 - protein, 20 aa, Mycobacterium
AWAPLRATTQARIGLGRSGD

SEQ ID NO: 797588 - protein, 20 aa, Mycobacterium
AWARDYLSVERLRTLLGPET

SEQ ID NO: 797589 - protein, 28 aa, Mycobacterium
AWASIIPAGWSFLLALRSRGLGSVWTTM

SEQ ID NO: 797590 - protein, 18 aa, Mycobacterium
AWAYQQLGVLPDVVAFGK

SEQ ID NO: 797591 - protein, 17 aa, Mycobacterium
AWCEDAFITAALLARET

SEQ ID NO: 797592 - protein, 18 aa, Mycobacterium
AWCNPHLSPQRSGDSRSE

SEQ ID NO: 797593 - protein, 24 aa, Mycobacterium
AWDFANPVRIPPGSLDLLVVEEAG

SEQ ID NO: 797594 - protein, 24 aa, Mycobacterium
AWDLDRLHRRPIELERFMDLADTR

SEQ ID NO: 797595 - protein, 28 aa, Mycobacterium
AWDQGDHLWMIYLMRVVDAQVVLNKPGS

SEQ ID NO: 797596 - protein, 29 aa, Mycobacterium
AWDQGKHLWMIYLMRIVDAQVVFDKPGSV

SEQ ID NO: 797597 - protein, 17 aa, Mycobacterium
AWDQRFLEIVDGGHLDD

SEQ ID NO: 797598 - protein, 17 aa, Mycobacterium
AWDRIALDCLNIYRQVS

SEQ ID NO: 797599 - protein, 19 aa, Mycobacterium
AWDRPPPGGLPELRDWFAA

SEQ ID NO: 797600 - protein, 18 aa, Mycobacterium
AWEGLATELYTAAAGYGS

SEQ ID NO: 797601 - protein, 18 aa, Mycobacterium
AWELCIHSAALLQRTLDA

SEQ ID NO: 797602 - protein, 19 aa, Mycobacterium
AWELWHRGAGEVHLGLTIL

SEQ ID NO: 797603 - protein, 18 aa, Mycobacterium
AWELYGMRHGYMACLPRG

SEQ ID NO: 797604 - protein, 34 aa, Mycobacterium
AWERALRIPGYAGPPTWFHGDLSPFNILTVDGRL

SEQ ID NO: 797605 - protein, 18 aa, Mycobacterium
AWETPFDEVLDWSEAPFA

SEQ ID NO: 797606 - protein, 26 aa, Mycobacterium
AWEYGVDIDWSLFSGGRRPARVELPG

SEQ ID NO: 797607 - protein, 18 aa, Mycobacterium
AWFYQRPITLEDHQNSRW

SEQ ID NO: 797608 - protein, 25 aa, Mycobacterium
AWGADPIDMGMGGSIPFIAEFAEAF

SEQ ID NO: 797609 - protein, 18 aa, Mycobacterium
AWGKIRSFEAGINHINPI

SEQ ID NO: 797610 - protein, 19 aa, Mycobacterium
AWHEVLPQVKAECAKEAEQ

SEQ ID NO: 797611 - protein, 18 aa, Mycobacterium
AWHLHRLTADINLDVFVV

SEQ ID NO: 797612 - protein, 31 aa, Mycobacterium
AWHRVTRSYRWLTRGLVLASAPRPARRAIVP

SEQ ID NO: 797613 - protein, 18 aa, Mycobacterium
AWHTGGVTLPLTYRFEPG

SEQ ID NO: 797614 - protein, 19 aa, Mycobacterium
AWHVPALREELVTALIKSL

SEQ ID NO: 797615 - protein, 19 aa, Mycobacterium
AWHYRLLAKVMRPLSPLRY

SEQ ID NO: 797616 - protein, 24 aa, Mycobacterium
AWIAEGLLVYLPPEAQDRLFDNIA

SEQ ID NO: 797617 - protein, 17 aa, Mycobacterium
AWIEMRIDQWNGPTPDI

SEQ ID NO: 797618 - protein, 17 aa, Mycobacterium
AWIGIPTELGPAEDALG

SEQ ID NO: 797619 - protein, 20 aa, Mycobacterium
AWIGPTQHRIYALMKEFGVA

SEQ ID NO: 797620 - protein, 18 aa, Mycobacterium
AWIQHILSKLAPTGQAGV

SEQ ID NO: 797621 - protein, 30 aa, Mycobacterium
AWKGESLEEYWWCAEQMLTWPDSDKPANMI

SEQ ID NO: 797622 - protein, 22 aa, Mycobacterium
AWLAEVLPAFPAYAHMLGNFDV

SEQ ID NO: 797623 - protein, 17 aa, Mycobacterium
AWLEVRLPEAPKPVENT

SEQ ID NO: 797624 - protein, 18 aa, Mycobacterium
AWLEVRLPPPPAPVENTP

SEQ ID NO: 797625 - protein, 20 aa, Mycobacterium
AWLFCPADRPERFAKAAAAA

SEQ ID NO: 797626 - protein, 19 aa, Mycobacterium
AWLGRPGLEHGASADLLCF

SEQ ID NO: 797627 - protein, 17 aa, Mycobacterium
AWLLTDFGELPPVQRNA

SEQ ID NO: 797628 - protein, 17 aa, Mycobacterium
AWLNPVMWNAFMGWTGV

SEQ ID NO: 797629 - protein, 18 aa, Mycobacterium
AWLPDEAAGSRVHWRSRE

SEQ ID NO: 797630 - protein, 30 aa, Mycobacterium
AWLPEDRILFTGNLFGPLFGHVPNLMTIRG

SEQ ID NO: 797631 - protein, 20 aa, Mycobacterium
AWLRSTLAGLLKQAGVGSPV

SEQ ID NO: 797632 - protein, 21 aa, Mycobacterium
AWLSMVMLEWGSCGQIATAIP

SEQ ID NO: 797633 - protein, 21 aa, Mycobacterium
AWLSMVMLEWGSCGQVATAAT

SEQ ID NO: 797634 - protein, 21 aa, Mycobacterium
AWLSMVMLEWGSCGQVAVTGP

SEQ ID NO: 797635 - protein, 18 aa, Mycobacterium
AWLVIDVRDVAAVHAALL

SEQ ID NO: 797636 - protein, 23 aa, Mycobacterium
AWNAIGGFDEEFFRYGEAADWQN

SEQ ID NO: 797637 - protein, 18 aa, Mycobacterium
AWNLYYQTVIRRVSKRDP

SEQ ID NO: 797638 - protein, 20 aa, Mycobacterium
AWPAVLTWRAHDEPRMESVR

SEQ ID NO: 797639 - protein, 28 aa, Mycobacterium
AWPEGFAEALIPSIPLRRVGEPEDIVGA

SEQ ID NO: 797640 - protein, 19 aa, Mycobacterium
AWPGLTPRLLRAEQGTETL

SEQ ID NO: 797641 - protein, 29 aa, Mycobacterium
AWPGTDRSWLDGWLLRACHGAPLCANSAV

SEQ ID NO: 797642 - protein, 19 aa, Mycobacterium
AWPNTDFMQAYGLTELCGV

SEQ ID NO: 797643 - protein, 22 aa, Mycobacterium
AWPQQRLLANAPIDVDKPLLAN

SEQ ID NO: 797644 - protein, 18 aa, Mycobacterium
AWPSAQIAVMGASGAVGF

SEQ ID NO: 797645 - protein, 18 aa, Mycobacterium
AWPTAQIAVMGASGAVGF

SEQ ID NO: 797646 - protein, 26 aa, Mycobacterium
AWPVVAEPFAMWVLEDDFADGRPPLE

SEQ ID NO: 797647 - protein, 17 aa, Mycobacterium
AWPYLRVLSRLTGIADP

SEQ ID NO: 797648 - protein, 21 aa, Mycobacterium
AWQAWAGAPDGWLAMPHGEIL

SEQ ID NO: 797649 - protein, 20 aa, Mycobacterium
AWQHTPYWMADRSGGPQFAG

SEQ ID NO: 797650 - protein, 17 aa, Mycobacterium
AWQIRRYGFHGTSHRNV

SEQ ID NO: 797651 - protein, 22 aa, Mycobacterium
AWQQNPLLHRVMQAYLAGAETA

SEQ ID NO: 797652 - protein, 27 aa, Mycobacterium
AWQQRSGLALMFLFDDVLTDAGANEVL

SEQ ID NO: 797653 - protein, 20 aa, Mycobacterium
AWQRLGASALAGWRQRLVRP

SEQ ID NO: 797654 - protein, 20 aa, Mycobacterium
AWQRLRPWPDTVAGLTRLKR

SEQ ID NO: 797655 - protein, 26 aa, Mycobacterium
AWRDGQWYAARLCPSPLRAAERRTAV

SEQ ID NO: 797656 - protein, 26 aa, Mycobacterium
AWRDPRFWWQLRDPFTPSWGEPYAEI

SEQ ID NO: 797657 - protein, 26 aa, Mycobacterium
AWRDPRVWWQLRNPFRPSWGEPYTEI

SEQ ID NO: 797658 - protein, 19 aa, Mycobacterium
AWRELFDPAVNLADRGFDI

SEQ ID NO: 797659 - protein, 17 aa, Mycobacterium
AWREYGLKVLGMVEGKG

SEQ ID NO: 797660 - protein, 17 aa, Mycobacterium
AWRICSQQQLWSVFGKK

SEQ ID NO: 797661 - protein, 19 aa, Mycobacterium
AWRLWSKVHQSYDGPWRDL

SEQ ID NO: 797662 - protein, 22 aa, Mycobacterium
AWRNETPYRPPKPKPRKATRQA

SEQ ID NO: 797663 - protein, 34 aa, Mycobacterium
AWRPAEPGKQPPGHLWRWELSPVNAELTTVTHTY

SEQ ID NO: 797664 - protein, 23 aa, Mycobacterium
AWRPDTVWRHRLGAGLPGERVYH

SEQ ID NO: 797665 - protein, 22 aa, Mycobacterium
AWRPVFSRLAELGIFGVAIPEE

SEQ ID NO: 797666 - protein, 17 aa, Mycobacterium
AWRRGPLTALERLAGPD

SEQ ID NO: 797667 - protein, 17 aa, Mycobacterium
AWRRLRRAIDEANELLY

SEQ ID NO: 797668 - protein, 25 aa, Mycobacterium
AWSAEGFLPFLPTDAQDRLLDSVTA

SEQ ID NO: 797669 - protein, 26 aa, Mycobacterium
AWSAEGLLMYLPPDAQDRLFDAISGL

SEQ ID NO: 797670 - protein, 25 aa, Mycobacterium
AWSAEGLLMYLPPDAQDRLFDNITA

SEQ ID NO: 797671 - protein, 24 aa, Mycobacterium
AWSAEGLLPYLPAAAQELLFERMV

SEQ ID NO: 797672 - protein, 23 aa, Mycobacterium
AWSDAALPELPWFATDGAQEFGG

SEQ ID NO: 797673 - protein, 17 aa, Mycobacterium
AWSDTFLAALRAYPDLA

SEQ ID NO: 797674 - protein, 23 aa, Mycobacterium
AWSDVGVFPILGMDWRDRESQGE

SEQ ID NO: 797675 - protein, 18 aa, Mycobacterium
AWSDVGVFPILGMDWRER

SEQ ID NO: 797676 - protein, 19 aa, Mycobacterium
AWSEAMVAAWIGGIDDELG

SEQ ID NO: 797677 - protein, 17 aa, Mycobacterium
AWTAFLTATPEPQAHHI

SEQ ID NO: 797678 - protein, 23 aa, Mycobacterium
AWTAYGPWLRKPIDGIHWAGTET

SEQ ID NO: 797679 - protein, 19 aa, Mycobacterium
AWTCLFRSLELEPGQLLLI

SEQ ID NO: 797680 - protein, 22 aa, Mycobacterium
AWTGRKIGELVKEPLWAVVQQQ

SEQ ID NO: 797681 - protein, 27 aa, Mycobacterium
AWTHQNFCWLLSTLGPLGSSEAAEEIG

SEQ ID NO: 797682 - protein, 20 aa, Mycobacterium
AWTLAMGHAMIRTGLKVRDS

SEQ ID NO: 797683 - protein, 23 aa, Mycobacterium
AWTPTAFPVEFLSLGAGGVGVPV

SEQ ID NO: 797684 - protein, 20 aa, Mycobacterium
AWTTQGFPPGPPYAGPAGKD

SEQ ID NO: 797685 - protein, 30 aa, Mycobacterium
AWVAELLTSPTWGLVRYAKITTIKAIADIA

SEQ ID NO: 797686 - protein, 20 aa, Mycobacterium
AWVAEQIGAPVYKVFNGIFW

SEQ ID NO: 797687 - protein, 35 aa, Mycobacterium
AWVDDMHDWCISRQLWWGHRIPIWYGPGGEQVCVG

SEQ ID NO: 797688 - protein, 36 aa, Mycobacterium
AWVDNMHDWCISRQLWWGHRIPIWHGPNGETVCVGP

SEQ ID NO: 797689 - protein, 24 aa, Mycobacterium
AWVGSLLEAGWVDSFRLLHPDVDG

SEQ ID NO: 797690 - protein, 18 aa, Mycobacterium
AWVLAMGHSMIRAGFGLD

SEQ ID NO: 797691 - protein, 17 aa, Mycobacterium
AWVLARYDDGRPSQVRL

SEQ ID NO: 797692 - protein, 35 aa, Mycobacterium
AWVLEFEYRRLRLPAPDWQVLLAVPADLAGQRARS

SEQ ID NO: 797693 - protein, 20 aa, Mycobacterium
AWVQAWTGGWWDYDPTNDSE

SEQ ID NO: 797694 - protein, 40 aa, Mycobacterium
AWVQYDPLGAVLIIGPWNYPLYLSLAPLVAAVAAGNCAVI

SEQ ID NO: 797695 - protein, 18 aa, Mycobacterium
AWVTAQPLPARPVIVDLC

SEQ ID NO: 797696 - protein, 18 aa, Mycobacterium
AWVTLLRSAGAHDTYLRT

SEQ ID NO: 797697 - protein, 19 aa, Mycobacterium
AWVTLLRSAGAHDTYLRTY

SEQ ID NO: 797698 - protein, 27 aa, Mycobacterium
AWVTPWSLFVAIPGLLAWQIDLHATWS

SEQ ID NO: 797699 - protein, 19 aa, Mycobacterium
AWWGNFLVQKANEANVALD

SEQ ID NO: 797700 - protein, 31 aa, Mycobacterium
AWYAAIEGFTRWRALRYARRIGRDFDLYPTE

SEQ ID NO: 797701 - protein, 17 aa, Mycobacterium
AWYLQHAGKRSIGPDKI

SEQ ID NO: 797702 - protein, 17 aa, Mycobacterium
AWYLQYAGKKSIGPDKV

SEQ ID NO: 797703 - protein, 18 aa, Mycobacterium
AWYMGNPAAFSYSHLFAA

SEQ ID NO: 797704 - protein, 19 aa, Mycobacterium
AWYSIIHTPADRLAGLFAE

SEQ ID NO: 797705 - protein, 49 aa, Mycobacterium
AYAAAETTGTSPLQLAINAVSAPAQSLLARPIIGNGANATTPGGNGGDG

SEQ ID NO: 797706 - protein, 31 aa, Mycobacterium
AYAADPLDPAWLLDILGLTDAARTTYRRLSG

SEQ ID NO: 797707 - protein, 18 aa, Mycobacterium
AYAAFRWAYDHAGELGAA

SEQ ID NO: 797708 - protein, 17 aa, Mycobacterium
AYAAGLAVGFWEGADDL

SEQ ID NO: 797709 - protein, 19 aa, Mycobacterium
AYAATGKPGWFLFDGLVKH

SEQ ID NO: 797710 - protein, 29 aa, Mycobacterium
AYAATGKPGWFLFDGLVKHDLFTGNQEGY

SEQ ID NO: 797711 - protein, 29 aa, Mycobacterium
AYAATGKPGWFLFDGLVKHDLLTGNQEGI

SEQ ID NO: 797712 - protein, 19 aa, Mycobacterium
AYACFTPSPSLGIPALRQL

SEQ ID NO: 797713 - protein, 28 aa, Mycobacterium
AYADTRPLLFFEYYPELIRMAGVPDPTV

SEQ ID NO: 797714 - protein, 25 aa, Mycobacterium
AYAEGLRAIYLYTATFQDAEVAQAV

SEQ ID NO: 797715 - protein, 24 aa, Mycobacterium
AYAEGLRALYLFTATHQNAEMAKV

SEQ ID NO: 797716 - protein, 26 aa, Mycobacterium
AYAEGLRALYLFTSTYQDASVAEALH

SEQ ID NO: 797717 - protein, 25 aa, Mycobacterium
AYAEGLRALYLYTATFQDAAVAEAA

SEQ ID NO: 797718 - protein, 25 aa, Mycobacterium
AYAEGLRALYLYTATYQDAAVAEAV

SEQ ID NO: 797719 - protein, 18 aa, Mycobacterium
AYAELLLKITGEAPTVVL

SEQ ID NO: 797720 - protein, 43 aa, Mycobacterium
AYAFETLLRYDRAYTGYIPIIGAPWLPDLVRRSPWGEMFQSAG

SEQ ID NO: 797721 - protein, 25 aa, Mycobacterium
AYAHSIALFLRWCARSGRSWQAGVE

SEQ ID NO: 797722 - protein, 19 aa, Mycobacterium
AYALLSKWGSTLESFFMGV

SEQ ID NO: 797723 - protein, 17 aa, Mycobacterium
AYALNLMGPALTVDTAC

SEQ ID NO: 797724 - protein, 22 aa, Mycobacterium
AYALTPEWGIAGWNAAYQRLYP

SEQ ID NO: 797725 - protein, 18 aa, Mycobacterium
AYANLALPALLRERGITG

SEQ ID NO: 797726 - protein, 29 aa, Mycobacterium
AYAQGLRDAGLLPVLKHFPGHGRGSGDSH

SEQ ID NO: 797727 - protein, 24 aa, Mycobacterium
AYAQPYLSRLWARLHGRDVWQEPC

SEQ ID NO: 797728 - protein, 25 aa, Mycobacterium
AYAQPYLSRLWARLHGRDVWQEPCA

SEQ ID NO: 797729 - protein, 20 aa, Mycobacterium
AYAQRMAPVLAAEKSSWAPA

SEQ ID NO: 797730 - protein, 26 aa, Mycobacterium
AYAQSKLAVMLWGLELDRRLRAAASP

SEQ ID NO: 797731 - protein, 26 aa, Mycobacterium
AYAQSKLAVMLWGLELDRRLRAAGSP

SEQ ID NO: 797732 - protein, 20 aa, Mycobacterium
AYAVARTLQPLLINTVVGFI

SEQ ID NO: 797733 - protein, 24 aa, Mycobacterium
AYAVRDWCRFNSAGSLFIDPGSPW

SEQ ID NO: 797734 - protein, 20 aa, Mycobacterium
AYAWADPPVAITTLIRSGFA

SEQ ID NO: 797735 - protein, 21 aa, Mycobacterium
AYCDLAALRRSAPAGPLVSLA

SEQ ID NO: 797736 - protein, 19 aa, Mycobacterium
AYCYVPRRKGYANPITVFT

SEQ ID NO: 797737 - protein, 24 aa, Mycobacterium
AYDAEPFVHLLPEGQLPRTGAVIG

SEQ ID NO: 797738 - protein, 20 aa, Mycobacterium
AYDFGIRWGAALAGRFRRLV

SEQ ID NO: 797739 - protein, 17 aa, Mycobacterium
AYDPYPCVAVDREWNLL

SEQ ID NO: 797740 - protein, 20 aa, Mycobacterium
AYDVRPIVTAILDDETPFDE

SEQ ID NO: 797741 - protein, 25 aa, Mycobacterium
AYEAAFAMTVPPPVIAANRAQLMAL

SEQ ID NO: 797742 - protein, 29 aa, Mycobacterium
AYEAAFAMTVPPPVIAANRAQLMALIATN

SEQ ID NO: 797743 - protein, 28 aa, Mycobacterium
AYEAAFAMTVPPPVIAANRAQLMMLIAT

SEQ ID NO: 797744 - protein, 27 aa, Mycobacterium
AYEAAFLATVPPPVIAANRAQLMALIA

SEQ ID NO: 797745 - protein, 18 aa, Mycobacterium
AYEAAFTATVPPVAIAEN

SEQ ID NO: 797746 - protein, 26 aa, Mycobacterium
AYEAAWAATVPPPVIAANRAELLMLI

SEQ ID NO: 797747 - protein, 18 aa, Mycobacterium
AYELNYAGAALARKAADE

SEQ ID NO: 797748 - protein, 19 aa, Mycobacterium
AYEMAFALTVPPPVIASNR

SEQ ID NO: 797749 - protein, 17 aa, Mycobacterium
AYEPTFIMRGLSELHIT

SEQ ID NO: 797750 - protein, 17 aa, Mycobacterium
AYERMLRLITEQAPTAV

SEQ ID NO: 797751 - protein, 23 aa, Mycobacterium
AYERVKPVFKKWASMVVRAGEPG

SEQ ID NO: 797752 - protein, 24 aa, Mycobacterium
AYETAFVMTVPPPAIAANRLLLMT

SEQ ID NO: 797753 - protein, 29 aa, Mycobacterium
AYETPPGLQLLHCIAFDAAVTGGQTWFCD

SEQ ID NO: 797754 - protein, 20 aa, Mycobacterium
AYFEKYPGVWCHGDWITITD

SEQ ID NO: 797755 - protein, 20 aa, Mycobacterium
AYFKGGINPVSVWVSTDYVR

SEQ ID NO: 797756 - protein, 20 aa, Mycobacterium
AYFKGGVNPVTVWVSTEYVR

SEQ ID NO: 797757 - protein, 24 aa, Mycobacterium
AYGAEPFIHLLPEGQLPKTGSVIG

SEQ ID NO: 797758 - protein, 43 aa, Mycobacterium
AYGALLRDGLLGVPPHGWINLHFSLLPAWRGAAPVQAAIAAGD

SEQ ID NO: 797759 - protein, 20 aa, Mycobacterium
AYGALPYLRKAPGSLMFSTS

SEQ ID NO: 797760 - protein, 19 aa, Mycobacterium
AYGARFAGVAFPGETLNVG

SEQ ID NO: 797761 - protein, 26 aa, Mycobacterium
AYGERFRARFFGRNVNVPLMIIAIGS

SEQ ID NO: 797762 - protein, 17 aa, Mycobacterium
AYGFPALATTSAGLAFA

SEQ ID NO: 797763 - protein, 26 aa, Mycobacterium
AYGGTFRLIDKVFSLWGISYTAVALS

SEQ ID NO: 797764 - protein, 26 aa, Mycobacterium
AYGGTFRLIDKVFTGWNVEYTPVALA

SEQ ID NO: 797765 - protein, 21 aa, Mycobacterium
AYGGTFRLIDKVFTHWGISHT

SEQ ID NO: 797766 - protein, 20 aa, Mycobacterium
AYGGTFRLIDKVFTQWNVDY

SEQ ID NO: 797767 - protein, 21 aa, Mycobacterium
AYGHALQIPVYGVCSLDAIGG

SEQ ID NO: 797768 - protein, 20 aa, Mycobacterium
AYGLAGLRIGYGLAAPAVCG

SEQ ID NO: 797769 - protein, 26 aa, Mycobacterium
AYGPEQILIELLPQAGLAALARGRIS

SEQ ID NO: 797770 - protein, 26 aa, Mycobacterium
AYGPLRPTMRHLPTAEPTPWHVPGTD

SEQ ID NO: 797771 - protein, 18 aa, Mycobacterium
AYGRIDVLVHNAGNVRRG

SEQ ID NO: 797772 - protein, 18 aa, Mycobacterium
AYGWLGGLAAQLAARRQD

SEQ ID NO: 797773 - protein, 23 aa, Mycobacterium
AYGWSPETFIRQGLLRFCFTAAE

SEQ ID NO: 797774 - protein, 41 aa, Mycobacterium
AYHFHEPFGVVGLIIPWNFPLLLAMWKLAPALAAGNTVVLK

SEQ ID NO: 797775 - protein, 20 aa, Mycobacterium
AYHFWGPDALHRLRGMFAFA

SEQ ID NO: 797776 - protein, 32 aa, Mycobacterium
AYHLMGFDIGCFTPIFVMSRITGWTAHVMEQT

SEQ ID NO: 797777 - protein, 17 aa, Mycobacterium
AYHLPLTTDVPRVRVRH

SEQ ID NO: 797778 - protein, 24 aa, Mycobacterium
AYHSAAFFLLGLYALLTTVGESRS

SEQ ID NO: 797779 - protein, 25 aa, Mycobacterium
AYHTAWAAVPHLLSGNRGGVIIFTS

SEQ ID NO: 797780 - protein, 26 aa, Mycobacterium
AYIECAQACGLTLLGGPPTVRTAVDA

SEQ ID NO: 797781 - protein, 22 aa, Mycobacterium
AYIVTGGIGGLGLFLAGEMAAR

SEQ ID NO: 797782 - protein, 31 aa, Mycobacterium
AYKARYVQFLSGAFPNWIRFRDNGTTRYFEY

SEQ ID NO: 797783 - protein, 18 aa, Mycobacterium
AYKEIFAGLYTDPDAVLN

SEQ ID NO: 797784 - protein, 17 aa, Mycobacterium
AYKVSGTLKQGIDSEHA

SEQ ID NO: 797785 - protein, 20 aa, Mycobacterium
AYLAGFAWGLSRDYSVLVEM

SEQ ID NO: 797786 - protein, 18 aa, Mycobacterium
AYLAILRGRATEAEVRLR

SEQ ID NO: 797787 - protein, 30 aa, Mycobacterium
AYLAYHPDIPAPVNPWDPATWAGVSSSGCA

SEQ ID NO: 797788 - protein, 22 aa, Mycobacterium
AYLIDQPLMRNVLADLAIEAEA

SEQ ID NO: 797789 - protein, 20 aa, Mycobacterium
AYLIDQPLMRNVLADLAVEA

SEQ ID NO: 797790 - protein, 18 aa, Mycobacterium
AYLKATFDWHIDGCTPLG

SEQ ID NO: 797791 - protein, 18 aa, Mycobacterium
AYLLLATDFSATSIVAEC

SEQ ID NO: 797792 - protein, 18 aa, Mycobacterium
AYLNGESVFFLLGNRNVE

SEQ ID NO: 797793 - protein, 43 aa, Mycobacterium
AYLNRIFDYLMVSLRSLPLVILIGRPEARIPVLSFAFHDVPAD

SEQ ID NO: 797794 - protein, 39 aa, Mycobacterium
AYLNRIFDYLMVSLRSLPLVMLIGRPEARIPVVSFALQD

SEQ ID NO: 797795 - protein, 17 aa, Mycobacterium
AYLPMINALARAGHHVI

SEQ ID NO: 797796 - protein, 24 aa, Mycobacterium
AYLPRYRLAGADIGLRRGDRVVGG

SEQ ID NO: 797797 - protein, 27 aa, Mycobacterium
AYLQLLVKTLRMPGLLELASLGAPTQL

SEQ ID NO: 797798 - protein, 25 aa, Mycobacterium
AYLRELAFRDFYADVLHHWPASAWR

SEQ ID NO: 797799 - protein, 20 aa, Mycobacterium
AYLRHLVDAGLPTAAALRQI

SEQ ID NO: 797800 - protein, 22 aa, Mycobacterium
AYMPPVPVEALFKRLSSKDGQN

SEQ ID NO: 797801 - protein, 27 aa, Mycobacterium
AYMVAELRPHRLWPNILATMMRLADYL

SEQ ID NO: 797802 - protein, 23 aa, Mycobacterium
AYNARIALHVRTLYGRDPHHITE

SEQ ID NO: 797803 - protein, 23 aa, Mycobacterium
AYNATKWGVIGLAKSLALEVAKE

SEQ ID NO: 797804 - protein, 42 aa, Mycobacterium
AYNDPWVLVVQFACMRLGAIFVPLNFRLARPELEFLCTDSDP

SEQ ID NO: 797805 - protein, 17 aa, Mycobacterium
AYNILSDAPTTLNPLAW

SEQ ID NO: 797806 - protein, 17 aa, Mycobacterium
AYNLDQVLDGDLDALFD

SEQ ID NO: 797807 - protein, 19 aa, Mycobacterium
AYNLLVQLTAEELAAGVVC

SEQ ID NO: 797808 - protein, 18 aa, Mycobacterium
AYNPVRLLRSLRAFRHNP

SEQ ID NO: 797809 - protein, 20 aa, Mycobacterium
AYPAFPRRRALVAFGSDVMF

SEQ ID NO: 797810 - protein, 21 aa, Mycobacterium
AYPGSSWLDMLRPKPSSQPAA

SEQ ID NO: 797811 - protein, 19 aa, Mycobacterium
AYPLEWVDVPEGRLVLQTL

SEQ ID NO: 797812 - protein, 26 aa, Mycobacterium
AYPLGKDFRPKVWPPVRRIDGAYGDR

SEQ ID NO: 797813 - protein, 23 aa, Mycobacterium
AYPQPYLSRLWARLHGRDVWQEP

SEQ ID NO: 797814 - protein, 26 aa, Mycobacterium
AYPQRIIPLQLPWLADPQLAPEEIRR

SEQ ID NO: 797815 - protein, 23 aa, Mycobacterium
AYPRLRDFLVRYATSFGHFQIVG

SEQ ID NO: 797816 - protein, 19 aa, Mycobacterium
AYPRTGSVVVWYSPRRCDR

SEQ ID NO: 797817 - protein, 18 aa, Mycobacterium
AYQAQFTHHMYLPMDEDM

SEQ ID NO: 797818 - protein, 25 aa, Mycobacterium
AYQAWPAGRFLIVTRNDLHGDARRR

SEQ ID NO: 797819 - protein, 18 aa, Mycobacterium
AYQINYLRCIGCGFCIEA

SEQ ID NO: 797820 - protein, 22 aa, Mycobacterium
AYQLEQLRWHQAASALNEILVD

SEQ ID NO: 797821 - protein, 17 aa, Mycobacterium
AYQVHCAEMLDTRLRRI

SEQ ID NO: 797822 - protein, 20 aa, Mycobacterium
AYRAAGYWAGRPLDTILGDA

SEQ ID NO: 797823 - protein, 26 aa, Mycobacterium
AYRAALEILATRRWPFDRITRESTGF

SEQ ID NO: 797824 - protein, 41 aa, Mycobacterium
AYRAGSLLLRGGPLALGFFTGWLFTEFPPHVVTGHALSRVA

SEQ ID NO: 797825 - protein, 20 aa, Mycobacterium
AYRAVIRRMGRDRKLGVGWP

SEQ ID NO: 797826 - protein, 30 aa, Mycobacterium
AYRDELYRRWTGLLSYRYIGRKHSSMDLGE

SEQ ID NO: 797827 - protein, 29 aa, Mycobacterium
AYRDELYRRWTGLLSYRYIGRKHSSMNLG

SEQ ID NO: 797828 - protein, 25 aa, Mycobacterium
AYREGLGFEVLPLSGGERPPFDVLC

SEQ ID NO: 797829 - protein, 20 aa, Mycobacterium
AYRFLPTLGEVDLFLFGEGR

SEQ ID NO: 797830 - protein, 17 aa, Mycobacterium
AYRGWVMSDWGATPSWE

SEQ ID NO: 797831 - protein, 18 aa, Mycobacterium
AYRLVHLICTRTMLVKDA

SEQ ID NO: 797832 - protein, 24 aa, Mycobacterium
AYRPTFVKSLVMAPIRKLDPVGAI

SEQ ID NO: 797833 - protein, 18 aa, Mycobacterium
AYRQGLSLVLKGPTGCGK

SEQ ID NO: 797834 - protein, 19 aa, Mycobacterium
AYRRFGSGAGVPLVLALRF

SEQ ID NO: 797835 - protein, 24 aa, Mycobacterium
AYRRGLWVRTTLADSLRTAARSTP

SEQ ID NO: 797836 - protein, 28 aa, Mycobacterium
AYRSATRCLYFATYAKSAKVRHLRSAPE

SEQ ID NO: 797837 - protein, 24 aa, Mycobacterium
AYRSILNPYLSPAAIKRWKPFVDE

SEQ ID NO: 797838 - protein, 21 aa, Mycobacterium
AYRTHIAAMFTLVYGDGDHAD

SEQ ID NO: 797839 - protein, 25 aa, Mycobacterium
AYSAIWFCPTHITLLKRFADYYKGG

SEQ ID NO: 797840 - protein, 26 aa, Mycobacterium
AYSATKAFDMVFAEALWTELHGKGVD

SEQ ID NO: 797841 - protein, 25 aa, Mycobacterium
AYSCRWRPWRAYATQHLWTTLEHDV

SEQ ID NO: 797842 - protein, 25 aa, Mycobacterium
AYSDRLRRTSIEPDWLLGYWSDRVH

SEQ ID NO: 797843 - protein, 23 aa, Mycobacterium
AYSLGFCKPVPHFAFGSSDRAFG

SEQ ID NO: 797844 - protein, 19 aa, Mycobacterium
AYSQVELFTGRPAPKEAMR

SEQ ID NO: 797845 - protein, 24 aa, Mycobacterium
AYSRRWRLRWRPGLAARRVEGREV

SEQ ID NO: 797846 - protein, 18 aa, Mycobacterium
AYSWRHQIPVLAEAGYHV

SEQ ID NO: 797847 - protein, 28 aa, Mycobacterium
AYTKLKSFGGWLQALAGKWNQLAAEAEK

SEQ ID NO: 797848 - protein, 17 aa, Mycobacterium
AYTLAWMRDVGARMGCS

SEQ ID NO: 797849 - protein, 18 aa, Mycobacterium
AYTLGMVRELWPTPPGQP

SEQ ID NO: 797850 - protein, 32 aa, Mycobacterium
AYTLTDHAAQWRGLFDANLLASVLTVQVLGDH

SEQ ID NO: 797851 - protein, 24 aa, Mycobacterium
AYTPNVVPIWEGIRSYFRDSRNPD

SEQ ID NO: 797852 - protein, 21 aa, Mycobacterium
AYTQLTKLLRERHGHQLYSED

SEQ ID NO: 797853 - protein, 25 aa, Mycobacterium
AYVATQGYPLLKKGIRINAICPGPT

SEQ ID NO: 797854 - protein, 24 aa, Mycobacterium
AYVATRAYPLLKRGIRINAICPGP

SEQ ID NO: 797855 - protein, 20 aa, Mycobacterium
AYVCFRRQGFQKTTIVDIAR

SEQ ID NO: 797856 - protein, 31 aa, Mycobacterium
AYVELTFPISAHYFTVIPLAKRMATLGRAYL

SEQ ID NO: 797857 - protein, 28 aa, Mycobacterium
AYVPGDVTLWPNLTGMQAIDFLTALRGD

SEQ ID NO: 797858 - protein, 17 aa, Mycobacterium
AYVPGDVTLWPTLTGGE

SEQ ID NO: 797859 - protein, 23 aa, Mycobacterium
AYVPRRRTTATRVYRLAAGRRGA

SEQ ID NO: 797860 - protein, 20 aa, Mycobacterium
AYVRERIAHFKAPRSVDFVD

SEQ ID NO: 797861 - protein, 18 aa, Mycobacterium
AYVWLYTEEICRWEHITV

SEQ ID NO: 797862 - protein, 17 aa, Mycobacterium
AYWAMLAEEREVLGPFP

SEQ ID NO: 797863 - protein, 18 aa, Mycobacterium
AYWCRRLANDMVDYVNSY

SEQ ID NO: 797864 - protein, 18 aa, Mycobacterium
AYYAQWAQAWEIQALLRA

SEQ ID NO: 797865 - protein, 25 aa, Mycobacterium
AYYDAAALMLAGKPFKKAASVAKLV

SEQ ID NO: 797866 - protein, 24 aa, Mycobacterium
AYYEDGVHVWDWAAAALIAAEAGA

SEQ ID NO: 797867 - protein, 21 aa, Mycobacterium
AYYEHGLQVWDRAAGALIAAE

SEQ ID NO: 797868 - protein, 28 aa, Mycobacterium
AYYGQRLPAAAPYRSFVSWLAARDRDAA

SEQ ID NO: 797869 - protein, 17 aa, Mycobacterium
AYYPAGIARHFAAILGS

SEQ ID NO: 797870 - protein, 20 aa, Mycobacterium
AYYRLLDGDLRYYKDFTGTG

SEQ ID NO: 797871 - protein, 23 aa, Mycobacterium
AYYRLVDSDLRWYKDYTGTGNSL

SEQ ID NO: 797872 - protein, 17 aa, Mycobacterium
AYYVADDEIFLVPNAAN

SEQ ID NO: 797873 - protein, 32 aa, Mycobacterium
CAAAIEGLILGSYRFSAFRSAKTAPKDAGLHK

SEQ ID NO: 797874 - protein, 20 aa, Mycobacterium
CAAAPRRVAYVFPGQGGQRP

SEQ ID NO: 797875 - protein, 41 aa, Mycobacterium
CAACYDYLGHVLFAWHLPELWRRFTIALRRAITTHLKAIGL

SEQ ID NO: 797876 - protein, 32 aa, Mycobacterium
CAADIDEDLLLRLKAWRLDVAKEQKVPAYVVF

SEQ ID NO: 797877 - protein, 26 aa, Mycobacterium
CAAFLERLDPSIYWMGVHHSRLVKPE

SEQ ID NO: 797878 - protein, 21 aa, Mycobacterium
CAAFVLGMKVARTLLASGEGH

SEQ ID NO: 797879 - protein, 17 aa, Mycobacterium
CAAGALATLVPGAGDCA

SEQ ID NO: 797880 - protein, 24 aa, Mycobacterium
CAAGDGFARYWMHNGWVTMGGEKM

SEQ ID NO: 797881 - protein, 28 aa, Mycobacterium
CAAIGLVKFDLLGLGMLSALHYAMDLVA

SEQ ID NO: 797882 - protein, 28 aa, Mycobacterium
CAAIGLVKFDLLGLGMLSALHYARDLVA

SEQ ID NO: 797883 - protein, 24 aa, Mycobacterium
CAANHLLRRWGLAGHPLVTVPTRG

SEQ ID NO: 797884 - protein, 26 aa, Mycobacterium
CAAQDLMPLAARLAPLRAAAGQILMR

SEQ ID NO: 797885 - protein, 23 aa, Mycobacterium
CAARGVLGFLTLSDPSGGRRRLS

SEQ ID NO: 797886 - protein, 30 aa, Mycobacterium
CAAVTALDPALLIYVLPGSALHTTAVETGL

SEQ ID NO: 797887 - protein, 20 aa, Mycobacterium
CACTTHVPLDLDPPGEHTDH

SEQ ID NO: 797888 - protein, 22 aa, Mycobacterium
CACTTHVPLTPAPSPRRDTTSI

SEQ ID NO: 797889 - protein, 26 aa, Mycobacterium
CADAGMTPLILMPGPVNRGMIFLHED

SEQ ID NO: 797890 - protein, 20 aa, Mycobacterium
CADAQLGLALLARSASFAVV

SEQ ID NO: 797891 - protein, 20 aa, Mycobacterium
CADPPKTAWLFTGQGSQYPG

SEQ ID NO: 797892 - protein, 22 aa, Mycobacterium
CADSFYGAFEAAASKLEARLRK

SEQ ID NO: 797893 - protein, 21 aa, Mycobacterium
CAEAQRRLSTWWADMGAECGR

SEQ ID NO: 797894 - protein, 26 aa, Mycobacterium
CAELALPHIVLARPPWDPGAALVVRS

SEQ ID NO: 797895 - protein, 37 aa, Mycobacterium
CAELDELRRLVPPWVTLGLRIALLPRPRRDYGRYSPW

SEQ ID NO: 797896 - protein, 19 aa, Mycobacterium
CAELVSLLLGTAPSPHDPP

SEQ ID NO: 797897 - protein, 28 aa, Mycobacterium
CAETGLTLRVPPLRLCTDNGAMIASFAA

SEQ ID NO: 797898 - protein, 18 aa, Mycobacterium
CAETWLPMPKEWAALTVD

SEQ ID NO: 797899 - protein, 21 aa, Mycobacterium
CAEWVLVQYATAKIGAILVNI

SEQ ID NO: 797900 - protein, 24 aa, Mycobacterium
CAFGLALIAPRLPPFDVPAGHTED

SEQ ID NO: 797901 - protein, 22 aa, Mycobacterium
CAFGLALIAPRLPPFDVPDGHT

SEQ ID NO: 797902 - protein, 19 aa, Mycobacterium
CAFMGWPASLHEPLRQWVK

SEQ ID NO: 797903 - protein, 18 aa, Mycobacterium
CAGADPNFTPFLANSIEA

SEQ ID NO: 797904 - protein, 18 aa, Mycobacterium
CAGALRQYLLDRDALPDS

SEQ ID NO: 797905 - protein, 20 aa, Mycobacterium
CAGCGFYRPDPSYLPVIEEH

SEQ ID NO: 797906 - protein, 32 aa, Mycobacterium
CAGDVDEELLLRLKAWRLDVAKEQKVPAYVVF

SEQ ID NO: 797907 - protein, 26 aa, Mycobacterium
CAGGGWLCDGVWSAPSPPVILNGNCR

SEQ ID NO: 797908 - protein, 17 aa, Mycobacterium
CAGHGACTVACPEVFVI

SEQ ID NO: 797909 - protein, 29 aa, Mycobacterium
CAGHPYPLLVFPDHRAVFLTSGRRLPVAI

SEQ ID NO: 797910 - protein, 26 aa, Mycobacterium
CAGITLFSPLRHWKAGPGTRLAIIGL

SEQ ID NO: 797911 - protein, 19 aa, Mycobacterium
CAGITLFSPLRHWNAGPGK

SEQ ID NO: 797912 - protein, 18 aa, Mycobacterium
CAGLSPALPQQLSFVKLS

SEQ ID NO: 797913 - protein, 27 aa, Mycobacterium
CAGSFIDYFDSLIGWERYRASQFGIAH

SEQ ID NO: 797914 - protein, 32 aa, Mycobacterium
CAGSVAHFDWLVGCGVPFKAEFFSEPGWEPMG

SEQ ID NO: 797915 - protein, 17 aa, Mycobacterium
CAHFKIQIAFRGKLQLK

SEQ ID NO: 797916 - protein, 23 aa, Mycobacterium
CAHGAAWAAAPRAYRAAGANVIA

SEQ ID NO: 797917 - protein, 33 aa, Mycobacterium
CAISAVDIALWDLRARLLDEPLVVALGAVHDAT

SEQ ID NO: 797918 - protein, 30 aa, Mycobacterium
CAIVFQEPRLFPWRSLAGNVAYGLPRGTSR

SEQ ID NO: 797919 - protein, 17 aa, Mycobacterium
CAIVRRAPRTRFAGVAY

SEQ ID NO: 797920 - protein, 21 aa, Mycobacterium
CAKAFLRSDAWDPQSWDPAAV

SEQ ID NO: 797921 - protein, 24 aa, Mycobacterium
CAKQAPGYFTLDDWGYACLSGDGT

SEQ ID NO: 797922 - protein, 17 aa, Mycobacterium
CALALACDLVVAAPASY

SEQ ID NO: 797923 - protein, 19 aa, Mycobacterium
CALAMLKRHPNLRARFLGR

SEQ ID NO: 797924 - protein, 17 aa, Mycobacterium
CALDPTGMSAVLGGDEA

SEQ ID NO: 797925 - protein, 17 aa, Mycobacterium
CALFLMTAAIFAHGRVQ

SEQ ID NO: 797926 - protein, 17 aa, Mycobacterium
CALGLRFSEDPLVPAAR

SEQ ID NO: 797927 - protein, 22 aa, Mycobacterium
CALGRLTSVAAATALRSRITLR

SEQ ID NO: 797928 - protein, 19 aa, Mycobacterium
CALLNNVAAERDWVADHLA

SEQ ID NO: 797929 - protein, 20 aa, Mycobacterium
CALPARYITPSSKKKPRPLV

SEQ ID NO: 797930 - protein, 19 aa, Mycobacterium
CALTSRLLVPAAHKDEIVE

SEQ ID NO: 797931 - protein, 30 aa, Mycobacterium
CALVENSPVIFLGGQRARITERRVRRGRIQ

SEQ ID NO: 797932 - protein, 31 aa, Mycobacterium
CALVENSPVIFLGGQRARITERRVRRGRIQF

SEQ ID NO: 797933 - protein, 17 aa, Mycobacterium
CAMLVLKRLPDAVRDGD

SEQ ID NO: 797934 - protein, 26 aa, Mycobacterium
CANAWLDALVTWRAAAGLPATTVNWG

SEQ ID NO: 797935 - protein, 20 aa, Mycobacterium
CANGHPFLYPRLVCPVCHDG

SEQ ID NO: 797936 - protein, 17 aa, Mycobacterium
CANIFSGVSLLGALCSC

SEQ ID NO: 797937 - protein, 21 aa, Mycobacterium
CANYLATLRFELLSLARACGY

SEQ ID NO: 797938 - protein, 25 aa, Mycobacterium
CAPAAFRFMSQARHIGKVVLTMPSA

SEQ ID NO: 797939 - protein, 21 aa, Mycobacterium
CAPIWWNEQPIGCGGFDDGGY

SEQ ID NO: 797940 - protein, 30 aa, Mycobacterium
CAPPEVATLRYFWPRLSPGAFVLLDDYANR

SEQ ID NO: 797941 - protein, 31 aa, Mycobacterium
CAPPEVETLRYFWPRLSPGAFVLLDDYANRG

SEQ ID NO: 797942 - protein, 32 aa, Mycobacterium
CAPQLARQLWTMQLPFGIGLPALVAVAASYDA

SEQ ID NO: 797943 - protein, 25 aa, Mycobacterium
CAQAARLIFDALPRAYDDPDDLSAR

SEQ ID NO: 797944 - protein, 30 aa, Mycobacterium
CAQAAVRRTPLLLDGMAVTAAALVAERLAP

SEQ ID NO: 797945 - protein, 28 aa, Mycobacterium
CAQMDNFFITDIYLGATSIILPRPEPEL

SEQ ID NO: 797946 - protein, 22 aa, Mycobacterium
CAQNTARWWRATVFEPEALVGN

SEQ ID NO: 797947 - protein, 25 aa, Mycobacterium
CARDDGWLGGMFPGDDAALTALAAE

SEQ ID NO: 797948 - protein, 25 aa, Mycobacterium
CARDPFGIKPLFMATGAGGTAVASE

SEQ ID NO: 797949 - protein, 20 aa, Mycobacterium
CARHQVEWFWVKGHSGIGDN

SEQ ID NO: 797950 - protein, 17 aa, Mycobacterium
CARIMLGANISQLRTEG

SEQ ID NO: 797951 - protein, 26 aa, Mycobacterium
CARLGIPHLIVRRPPWPAGDATVVSS

SEQ ID NO: 797952 - protein, 22 aa, Mycobacterium
CARLRLAVAWMQLYRKWQSGDL

SEQ ID NO: 797953 - protein, 23 aa, Mycobacterium
CARLTVVWIADWADDTVHLSAHH

SEQ ID NO: 797954 - protein, 17 aa, Mycobacterium
CARRLLETSAVLGFAVD

SEQ ID NO: 797955 - protein, 17 aa, Mycobacterium
CARRRAEQFTWPSSAAG

SEQ ID NO: 797956 - protein, 19 aa, Mycobacterium
CARYICHRLMIDHATVAAV

SEQ ID NO: 797957 - protein, 23 aa, Mycobacterium
CASATRLTPFTSPPPITDPVGLA

SEQ ID NO: 797958 - protein, 17 aa, Mycobacterium
CASFITPTRVYDLDVHT

SEQ ID NO: 797959 - protein, 22 aa, Mycobacterium
CASGHEVFLIVPGQRAERSLLR

SEQ ID NO: 797960 - protein, 17 aa, Mycobacterium
CASLLQLPPASIPFAAG

SEQ ID NO: 797961 - protein, 21 aa, Mycobacterium
CASLVRRLVLAPVGAAHLAAS

SEQ ID NO: 797962 - protein, 24 aa, Mycobacterium
CASTAMVLLVNWAGTCTVIHQGSD

SEQ ID NO: 797963 - protein, 26 aa, Mycobacterium
CASTAWTAAFYALHNWMLALFDERAQ

SEQ ID NO: 797964 - protein, 26 aa, Mycobacterium
CASTAWTASFYTLHNWMLALFDERAQ

SEQ ID NO: 797965 - protein, 26 aa, Mycobacterium
CATDLIGYHTYLNRIPVRDGQRRHPS

SEQ ID NO: 797966 - protein, 24 aa, Mycobacterium
CATDPTLAIDWPLVDGVAASLSDR

SEQ ID NO: 797967 - protein, 19 aa, Mycobacterium
CATDRLDAFGSCRLCLVEI

SEQ ID NO: 797968 - protein, 23 aa, Mycobacterium
CATGFKLWDTGAVPPFPVIGRDG

SEQ ID NO: 797969 - protein, 21 aa, Mycobacterium
CATGFKLWEAGAVPPFPVIGR

SEQ ID NO: 797970 - protein, 20 aa, Mycobacterium
CATLFEPLIGVDLRTMLCAE

SEQ ID NO: 797971 - protein, 27 aa, Mycobacterium
CATSPEYLWRNPAFPTAVELTRLSPEL

SEQ ID NO: 797972 - protein, 20 aa, Mycobacterium
CATWLKRPGSVGSAALGVLH

SEQ ID NO: 797973 - protein, 17 aa, Mycobacterium
CAVIAGMNALFDSGPDL

SEQ ID NO: 797974 - protein, 20 aa, Mycobacterium
CAVIIKPAPETPLDALWLAE

SEQ ID NO: 797975 - protein, 20 aa, Mycobacterium
CAVLSEWLPATTGDIIFADG

SEQ ID NO: 797976 - protein, 18 aa, Mycobacterium
CAVQARVPIWVGGRTLRS

SEQ ID NO: 797977 - protein, 21 aa, Mycobacterium
CAVSSWLYRIVVNACLDRLRR

SEQ ID NO: 797978 - protein, 47 aa, Mycobacterium
CAVVAYGALLKPELLAVPRLGWVNLHFSLLPAWRGAAPVQASIAAGD

SEQ ID NO: 797979 - protein, 29 aa, Mycobacterium
CAWDQGKHLWMIYLMRVVDAQTVLDKPGS

SEQ ID NO: 797980 - protein, 18 aa, Mycobacterium
CCAVVAYGALLSQRLLAV

SEQ ID NO: 797981 - protein, 18 aa, Mycobacterium
CCGWSYGGYLTQAALAFH

SEQ ID NO: 797982 - protein, 17 aa, Mycobacterium
CCRALGIAVYDRRRPAD

SEQ ID NO: 797983 - protein, 22 aa, Mycobacterium
CDAHRIAWSHLWERLSIEFSNH

SEQ ID NO: 797984 - protein, 31 aa, Mycobacterium
CDAKVRGLALMAEVWPLRPDCRILACSSVFG

SEQ ID NO: 797985 - protein, 21 aa, Mycobacterium
CDALDVPLSSVLTDAGERMAG

SEQ ID NO: 797986 - protein, 29 aa, Mycobacterium
CDAPTIDSVLPMFFEFVGNSVLVAHNAGF

SEQ ID NO: 797987 - protein, 18 aa, Mycobacterium
CDAVYPGYGFLSENPELA

SEQ ID NO: 797988 - protein, 25 aa, Mycobacterium
CDDVSSMLLTLRNSTKITLRSLQSE

SEQ ID NO: 797989 - protein, 17 aa, Mycobacterium
CDDYVRALDDLRRDARD

SEQ ID NO: 797990 - protein, 18 aa, Mycobacterium
CDEDLEVAEVAWVPIREL

SEQ ID NO: 797991 - protein, 24 aa, Mycobacterium
CDEELRLNRRFSPQMYLGVVEVTE

SEQ ID NO: 797992 - protein, 25 aa, Mycobacterium
CDELGRLCCWVLLDATRPVSLTLAC

SEQ ID NO: 797993 - protein, 28 aa, Mycobacterium
CDFHLQNPGYFRMIALRTLDVPPGDMAD

SEQ ID NO: 797994 - protein, 20 aa, Mycobacterium
CDGFLLVPDPTPHGLDEFVD

SEQ ID NO: 797995 - protein, 24 aa, Mycobacterium
CDGGFPLDVRYAPTRLRELCKMDG

SEQ ID NO: 797996 - protein, 25 aa, Mycobacterium
CDHFRTNIAFLPDLQAYLDDLLRTR

SEQ ID NO: 797997 - protein, 33 aa, Mycobacterium
CDHGHGMVVVHPSWWPVARVGVVTRAARAVAAG

SEQ ID NO: 797998 - protein, 24 aa, Mycobacterium
CDHWNVVPDVYLLGKALGGGVVPV

SEQ ID NO: 797999 - protein, 19 aa, Mycobacterium
CDIITITQYLRPSPRHHPV

SEQ ID NO: 798000 - protein, 20 aa, Mycobacterium
CDIITITQYLRPSPRHHPVD

SEQ ID NO: 798001 - protein, 20 aa, Mycobacterium
CDIITITQYLRPSPRHHPVE

SEQ ID NO: 798002 - protein, 24 aa, Mycobacterium
CDILARYDVTFSLGDGLRPGSIAD

SEQ ID NO: 798003 - protein, 25 aa, Mycobacterium
CDITPTVYDLLGLTPPQTVKGIAQK

SEQ ID NO: 798004 - protein, 29 aa, Mycobacterium
CDKITPGMLMAALRLNVPTVFVSGGPMEG

SEQ ID NO: 798005 - protein, 25 aa, Mycobacterium
CDKRNTPLLFLQNISGFMVGRDYEA

SEQ ID NO: 798006 - protein, 23 aa, Mycobacterium
CDKTVYRAGWLRDGIVCPAQLGT

SEQ ID NO: 798007 - protein, 21 aa, Mycobacterium
CDKTVYRAGWLREGIVCAAQL

SEQ ID NO: 798008 - protein, 38 aa, Mycobacterium
CDLGPGDVFFWQTALSWMMWNFRLAGLLVGATVVCYSG

SEQ ID NO: 798009 - protein, 29 aa, Mycobacterium
CDLHKTNPLYLLDFLRQSGETPIVLLHCY

SEQ ID NO: 798010 - protein, 29 aa, Mycobacterium
CDLHTTNPLLLLDFLRRSGETPIVLLHCY

SEQ ID NO: 798011 - protein, 26 aa, Mycobacterium
CDLLDIMKTWWALRNEPNVLLLHYGE

SEQ ID NO: 798012 - protein, 17 aa, Mycobacterium
CDLLYDGTDFFEFDAPR

SEQ ID NO: 798013 - protein, 18 aa, Mycobacterium
CDLPGIMQHFTIPISFFD

SEQ ID NO: 798014 - protein, 19 aa, Mycobacterium
CDLPGIMQHFTIPVSFFDE

SEQ ID NO: 798015 - protein, 24 aa, Mycobacterium
CDMLGIDPLYVANEGKFLAVVPHD

SEQ ID NO: 798016 - protein, 23 aa, Mycobacterium
CDQQLRMLCVFNPPVTGQEVHDE

SEQ ID NO: 798017 - protein, 22 aa, Mycobacterium
CDRELGLPLPDAATRKALLEAL

SEQ ID NO: 798018 - protein, 17 aa, Mycobacterium
CDRLGLLPMYAVNQDKH

SEQ ID NO: 798019 - protein, 26 aa, Mycobacterium
CDSFNTPLVFVVDTPGFMPGVEQEKG

SEQ ID NO: 798020 - protein, 32 aa, Mycobacterium
CDSGPSMPARLLRFWFGLRNQAAYSLEDMADD

SEQ ID NO: 798021 - protein, 22 aa, Mycobacterium
CDTFRAIWSDRIEADRLNALIP

SEQ ID NO: 798022 - protein, 19 aa, Mycobacterium
CDTVAWTRTIRPGPTRWRG

SEQ ID NO: 798023 - protein, 24 aa, Mycobacterium
CDVGMGFSWARPTSFARPVVALPN

SEQ ID NO: 798024 - protein, 25 aa, Mycobacterium
CDVKGYYCPTPPRLVWINGPTPHQH

SEQ ID NO: 798025 - protein, 18 aa, Mycobacterium
CDVVYYCVVDTRGWLRHP

SEQ ID NO: 798026 - protein, 23 aa, Mycobacterium
CEAAALHLVFGAGAASIPLTSTK

SEQ ID NO: 798027 - protein, 21 aa, Mycobacterium
CEAGLLPGALTRNAGLHFVCR

SEQ ID NO: 798028 - protein, 19 aa, Mycobacterium
CEAGLLPGALTRNENLHFI

SEQ ID NO: 798029 - protein, 23 aa, Mycobacterium
CEAGLLPGALTRNVGLHFICRDV

SEQ ID NO: 798030 - protein, 23 aa, Mycobacterium
CEAGLLPGALTRNVGLHFVCRDA

SEQ ID NO: 798031 - protein, 25 aa, Mycobacterium
CEAPRAEGTFFLPDGRRLGYAEFGD

SEQ ID NO: 798032 - protein, 25 aa, Mycobacterium
CEARRLRELLAPVRYHHVVVAVRGE

SEQ ID NO: 798033 - protein, 18 aa, Mycobacterium
CEASWTHSPDRPPDLHLS

SEQ ID NO: 798034 - protein, 24 aa, Mycobacterium
CEAVPAGLRTLCAPTIVAALEHMI

SEQ ID NO: 798035 - protein, 21 aa, Mycobacterium
CEAYPGVFAPFGGYSDACVVS

SEQ ID NO: 798036 - protein, 17 aa, Mycobacterium
CECRYDMPVAVWRQLMA

SEQ ID NO: 798037 - protein, 23 aa, Mycobacterium
CEDGLLISFERMNRVLEVDTANQ

SEQ ID NO: 798038 - protein, 18 aa, Mycobacterium
CEDPPTALRYARLGLVFD

SEQ ID NO: 798039 - protein, 25 aa, Mycobacterium
CEEDGPVYQLRRWYEQFYVDVADVT

SEQ ID NO: 798040 - protein, 24 aa, Mycobacterium
CEERLDRFLASPASPLTLSGDTAT

SEQ ID NO: 798041 - protein, 23 aa, Mycobacterium
CEFAMAFDMRYAALGTTVLGHPE

SEQ ID NO: 798042 - protein, 24 aa, Mycobacterium
CEGDPPCPLRRNCRLREALRSAQD

SEQ ID NO: 798043 - protein, 31 aa, Mycobacterium
CEGETWPLLRNARWLPLVIAHGLLDEFVPFF

SEQ ID NO: 798044 - protein, 19 aa, Mycobacterium
CEGGLGVHLLLGRGEANTG

SEQ ID NO: 798045 - protein, 24 aa, Mycobacterium
CEGLYHFAWDEFCDWYLELAKVQM

SEQ ID NO: 798046 - protein, 20 aa, Mycobacterium
CEGRFATSVMRPLAVVKADL

SEQ ID NO: 798047 - protein, 17 aa, Mycobacterium
CEHAAAVLGYPGGQAID

SEQ ID NO: 798048 - protein, 17 aa, Mycobacterium
CEIALSMHPDHIGPATA

SEQ ID NO: 798049 - protein, 24 aa, Mycobacterium
CEILARYDVTFSLGDGLRPGSIAD

SEQ ID NO: 798050 - protein, 18 aa, Mycobacterium
CEITLQPVRRYGVDAAIL

SEQ ID NO: 798051 - protein, 27 aa, Mycobacterium
CEIVAQLYRRLHVPAMPQLSSLTEDVR

SEQ ID NO: 798052 - protein, 18 aa, Mycobacterium
CELVLRMATSPRAADLLG

SEQ ID NO: 798053 - protein, 19 aa, Mycobacterium
CEMRIVLGAMFTTMRVRPV

SEQ ID NO: 798054 - protein, 23 aa, Mycobacterium
CENDYLLHDVLREAWGFKGFVVS

SEQ ID NO: 798055 - protein, 27 aa, Mycobacterium
CENHYNVGWAWALDAPFQWMKQVASHF

SEQ ID NO: 798056 - protein, 24 aa, Mycobacterium
CENLPGLRWPDLSLQGGRLAWSAV

SEQ ID NO: 798057 - protein, 29 aa, Mycobacterium
CEPKPLQRPLPILIGATQPRMLALTARYA

SEQ ID NO: 798058 - protein, 27 aa, Mycobacterium
CEQFGIDFPLFAFSHCRDVVAAVTNAG

SEQ ID NO: 798059 - protein, 29 aa, Mycobacterium
CEQLAAAEPWWEPGTAQGYHMTTFGFIMG

SEQ ID NO: 798060 - protein, 25 aa, Mycobacterium
CERDGLGFIPWAPVAQGGLGQAGDV

SEQ ID NO: 798061 - protein, 25 aa, Mycobacterium
CERSFGPLAFEDQPWRLPVLAQEAS

SEQ ID NO: 798062 - protein, 17 aa, Mycobacterium
CETSFVRMDLAVTLAQQ

SEQ ID NO: 798063 - protein, 23 aa, Mycobacterium
CETSYVRLGLAQQLARHLGAPAV

SEQ ID NO: 798064 - protein, 26 aa, Mycobacterium
CEVDLNYHIRPWRLPPPGGRRELDEA

SEQ ID NO: 798065 - protein, 17 aa, Mycobacterium
CEWWYRQNVLVYATDDV

SEQ ID NO: 798066 - protein, 23 aa, Mycobacterium
CEYDVERYFRDAPLMIVGEGTNE

SEQ ID NO: 798067 - protein, 19 aa, Mycobacterium
CEYLPGKAIVMQMLVRYVD

SEQ ID NO: 798068 - protein, 29 aa, Mycobacterium
CEYPIEVVQLVIFAIQIALGELLRHHGAK

SEQ ID NO: 798069 - protein, 25 aa, Mycobacterium
CFAPHFHPSYRYASAVRREIGVPTV

SEQ ID NO: 798070 - protein, 33 aa, Mycobacterium
CFCNEPIDLSVPWPDPWCFVVDHYVPTSHGGDD

SEQ ID NO: 798071 - protein, 18 aa, Mycobacterium
CFENHYPSWKDSPPAEIV

SEQ ID NO: 798072 - protein, 18 aa, Mycobacterium
CFGAFRTGTLDHHGDFYN

SEQ ID NO: 798073 - protein, 29 aa, Mycobacterium
CFGEGPRWFEGLLWFSDMLGEAVHTVTLG

SEQ ID NO: 798074 - protein, 17 aa, Mycobacterium
CFGLHEWAMVYRTPTVR

SEQ ID NO: 798075 - protein, 35 aa, Mycobacterium
CFGNQILGRALGRSTYKMVFGHRGINIPVVDHITG

SEQ ID NO: 798076 - protein, 34 aa, Mycobacterium
CFGNQLLGRALGRSTYKMTFGHRGINIPVIDHST

SEQ ID NO: 798077 - protein, 23 aa, Mycobacterium
CFLESDLFNQGVRPAINVGVSVS

SEQ ID NO: 798078 - protein, 18 aa, Mycobacterium
CFLVHHRSRLASEKNGMM

SEQ ID NO: 798079 - protein, 17 aa, Mycobacterium
CFLVQHRSRLRSSAGEL

SEQ ID NO: 798080 - protein, 24 aa, Mycobacterium
CFPGLADEWLKWNGQRPFVGTLTM

SEQ ID NO: 798081 - protein, 17 aa, Mycobacterium
CFQVEMTWRSLNAGFAV

SEQ ID NO: 798082 - protein, 17 aa, Mycobacterium
CFVLPVEDSLRSIFATL

SEQ ID NO: 798083 - protein, 19 aa, Mycobacterium
CFVVCNEILPRWGVETVFV

SEQ ID NO: 798084 - protein, 17 aa, Mycobacterium
CFWQRIAYLYSRFDALI

SEQ ID NO: 798085 - protein, 17 aa, Mycobacterium
CFYSRRTVELLVDYLYG

SEQ ID NO: 798086 - protein, 18 aa, Mycobacterium
CFYVLIEGELMMSKLSGG

SEQ ID NO: 798087 - protein, 25 aa, Mycobacterium
CGADLVLPDRYLQAAPLVAIIEDTQ

SEQ ID NO: 798088 - protein, 19 aa, Mycobacterium
CGAEPLFLQDYIAVGKVVP

SEQ ID NO: 798089 - protein, 20 aa, Mycobacterium
CGAEPLFLQDYIAVGRTVPE

SEQ ID NO: 798090 - protein, 18 aa, Mycobacterium
CGAIVCRLVVDDDDLELD

SEQ ID NO: 798091 - protein, 17 aa, Mycobacterium
CGALSPVRYGAASLIVV

SEQ ID NO: 798092 - protein, 30 aa, Mycobacterium
CGCGGLIRPDIVWFGEPLPEGPWHCAVEAT

SEQ ID NO: 798093 - protein, 24 aa, Mycobacterium
CGDCALNRGVFADAYGVVGAVSEV

SEQ ID NO: 798094 - protein, 22 aa, Mycobacterium
CGDDGWRDVLDVNLTGVYHTIE

SEQ ID NO: 798095 - protein, 17 aa, Mycobacterium
CGDDLDVSLLRPGVVVL

SEQ ID NO: 798096 - protein, 30 aa, Mycobacterium
CGDIVSLPHAPYLHLFIARGAVGCEGAGDL

SEQ ID NO: 798097 - protein, 19 aa, Mycobacterium
CGDLFVVAVRTSPDRHTGL

SEQ ID NO: 798098 - protein, 34 aa, Mycobacterium
CGDLSLAYQLFGDGPIPLVFVGPFVGHVELFWTV

SEQ ID NO: 798099 - protein, 19 aa, Mycobacterium
CGDPRDRFSYRIAVRRIPN

SEQ ID NO: 798100 - protein, 26 aa, Mycobacterium
CGDSRYLLELIHNIWDRIQPYMAIYA

SEQ ID NO: 798101 - protein, 17 aa, Mycobacterium
CGDVGWFQLADKQVVLL

SEQ ID NO: 798102 - protein, 24 aa, Mycobacterium
CGDVGWFQLANKHVVLLSGAKANE

SEQ ID NO: 798103 - protein, 25 aa, Mycobacterium
CGEGADALWLAERGWRVVAVDVSAT

SEQ ID NO: 798104 - protein, 22 aa, Mycobacterium
CGEVLLIRRSGGRTRLMARLPG

SEQ ID NO: 798105 - protein, 25 aa, Mycobacterium
CGFDTPYPPARLEKVWLPGPDRLLD

SEQ ID NO: 798106 - protein, 24 aa, Mycobacterium
CGFEYDEALGWPDEGIAPGTRWED

SEQ ID NO: 798107 - protein, 18 aa, Mycobacterium
CGFQYDEALGWPEDGIEP

SEQ ID NO: 798108 - protein, 20 aa, Mycobacterium
CGFWLQAFAGRRRPPGFVSG

SEQ ID NO: 798109 - protein, 19 aa, Mycobacterium
CGGDYEWTRAKAAYFMVGF

SEQ ID NO: 798110 - protein, 21 aa, Mycobacterium
CGGFFSWHVINDVKDAPIRAT

SEQ ID NO: 798111 - protein, 19 aa, Mycobacterium
CGGITDWVRAAAVAAARNV

SEQ ID NO: 798112 - protein, 26 aa, Mycobacterium
CGGKAPDRPGWFYPPTVITDITKDMA

SEQ ID NO: 798113 - protein, 18 aa, Mycobacterium
CGGKVRPSIVWFGEMLPE

SEQ ID NO: 798114 - protein, 33 aa, Mycobacterium
CGGNPAWDLPLVFGPIALVYNLPGVKTLIVDAD

SEQ ID NO: 798115 - protein, 23 aa, Mycobacterium
CGGRPFVMPQMATRFDPAAAWAM

SEQ ID NO: 798116 - protein, 17 aa, Mycobacterium
CGGYQFAVIRHGQLAAA

SEQ ID NO: 798117 - protein, 22 aa, Mycobacterium
CGHCQLGPLLLCRDGPVVGYDV

SEQ ID NO: 798118 - protein, 21 aa, Mycobacterium
CGHCQLGPLLVCRDGPVVGYD

SEQ ID NO: 798119 - protein, 28 aa, Mycobacterium
CGHSSLTLYLQLYLGGFGLELSDIEALR

SEQ ID NO: 798120 - protein, 28 aa, Mycobacterium
CGHSSLTLYLQLYLGGFGLELSDIESLR

SEQ ID NO: 798121 - protein, 20 aa, Mycobacterium
CGIGHLEPYAWCEPGFLARG

SEQ ID NO: 798122 - protein, 20 aa, Mycobacterium
CGIPEKLIRALVDSGIKDLT

SEQ ID NO: 798123 - protein, 18 aa, Mycobacterium
CGIPFCHKGCPLGNLIPE

SEQ ID NO: 798124 - protein, 30 aa, Mycobacterium
CGKHSAIAALPWFWSDQYDLKLQIAGLNAG

SEQ ID NO: 798125 - protein, 24 aa, Mycobacterium
CGKSGLLALTPFAAQSHRALLVAP

SEQ ID NO: 798126 - protein, 30 aa, Mycobacterium
CGKSKKIAALPWFWSDQYDLKLQIAGLNTG

SEQ ID NO: 798127 - protein, 30 aa, Mycobacterium
CGKSKKVAALPWFWSDQYDVKLQIAGLNTG

SEQ ID NO: 798128 - protein, 23 aa, Mycobacterium
CGKSTILRALAGLLKPMGGTATV

SEQ ID NO: 798129 - protein, 25 aa, Mycobacterium
CGKSTLLRGFARLLTPSAGRVILDG

SEQ ID NO: 798130 - protein, 22 aa, Mycobacterium
CGKSTLLRLLAGFESPSEGAVR

SEQ ID NO: 798131 - protein, 20 aa, Mycobacterium
CGKSTLLRLLAGFESPTDGS

SEQ ID NO: 798132 - protein, 26 aa, Mycobacterium
CGKTRFVEHMGLLLQRPVVTISCHDD

SEQ ID NO: 798133 - protein, 27 aa, Mycobacterium
CGLAGTVLRFLPPVAALRHAPTVFDGD

SEQ ID NO: 798134 - protein, 27 aa, Mycobacterium
CGLAGTVLRFVPPLAALSAAPITFDGD

SEQ ID NO: 798135 - protein, 26 aa, Mycobacterium
CGLAGTVLRFVPPLAALSAAVVTFDG

SEQ ID NO: 798136 - protein, 17 aa, Mycobacterium
CGLDWPLDLEGVDYRLT

SEQ ID NO: 798137 - protein, 21 aa, Mycobacterium
CGLGMNWQSMWDGLVNGRSAI

SEQ ID NO: 798138 - protein, 28 aa, Mycobacterium
CGLICDASYPTFLLTHWARDRHRGPKFS

SEQ ID NO: 798139 - protein, 31 aa, Mycobacterium
CGLIDPAWDPKSLLMLLIDIAYSMAASGFSI

SEQ ID NO: 798140 - protein, 28 aa, Mycobacterium
CGLITGYHPPTRPDVLFVWQVAVARSAQ

SEQ ID NO: 798141 - protein, 25 aa, Mycobacterium
CGLRKGEVFALRRCDIAADGSTVRI

SEQ ID NO: 798142 - protein, 29 aa, Mycobacterium
CGMICDASYPTFLLTHWARDRKRGEKLPL

SEQ ID NO: 798143 - protein, 29 aa, Mycobacterium
CGMICDASYPTFLLTHWARDRKRGEKLSL

SEQ ID NO: 798144 - protein, 30 aa, Mycobacterium
CGMICDASYPTFLLTHWARDRRRGDRLPLE

SEQ ID NO: 798145 - protein, 30 aa, Mycobacterium
CGMICDASYPTFLLTHWARDRRRGEKLSLE

SEQ ID NO: 798146 - protein, 17 aa, Mycobacterium
CGNDIWHEVLPPAQTHA

SEQ ID NO: 798147 - protein, 23 aa, Mycobacterium
CGNGLLIENLRRVQARVIVATYM

SEQ ID NO: 798148 - protein, 21 aa, Mycobacterium
CGNGVRVFAHYLRASGMEGRD

SEQ ID NO: 798149 - protein, 17 aa, Mycobacterium
CGNTVVWKPSELTPLTA

SEQ ID NO: 798150 - protein, 23 aa, Mycobacterium
CGPETLRSLYFLGSRVTGGSPHA

SEQ ID NO: 798151 - protein, 23 aa, Mycobacterium
CGPETLRSLYFLSSRVTGGSPHA

SEQ ID NO: 798152 - protein, 18 aa, Mycobacterium
CGPFDRIESPWLVPQGIV

SEQ ID NO: 798153 - protein, 24 aa, Mycobacterium
CGPGGWVRRFVLGNIPVRFPVLPA

SEQ ID NO: 798154 - protein, 19 aa, Mycobacterium
CGPGLGSVWLARRGLEVWG

SEQ ID NO: 798155 - protein, 17 aa, Mycobacterium
CGPHHRLLDNGWTTRKR

SEQ ID NO: 798156 - protein, 19 aa, Mycobacterium
CGPHHRLLQQGWTTRKRRS

SEQ ID NO: 798157 - protein, 18 aa, Mycobacterium
CGPMNRMAFERLAAPVRV

SEQ ID NO: 798158 - protein, 18 aa, Mycobacterium
CGQQLVGFGQLPTPLTGQ

SEQ ID NO: 798159 - protein, 32 aa, Mycobacterium
CGRDAHLRRARFWWRYCRGPVGALHGRCAAAI

SEQ ID NO: 798160 - protein, 20 aa, Mycobacterium
CGRMVALRTVWISDGPGDVP

SEQ ID NO: 798161 - protein, 22 aa, Mycobacterium
CGRNLVVYYHVSRRQGAHLGFM

SEQ ID NO: 798162 - protein, 17 aa, Mycobacterium
CGRRFGRGRAFFGSHAR

SEQ ID NO: 798163 - protein, 17 aa, Mycobacterium
CGRRMIVQVRPDGWHAK

SEQ ID NO: 798164 - protein, 17 aa, Mycobacterium
CGRWRGLRLPMGLSPTT

SEQ ID NO: 798165 - protein, 41 aa, Mycobacterium
CGRYDLPYTTGPLLRQYLLTVRTICKLALPDRFLSATADDA

SEQ ID NO: 798166 - protein, 30 aa, Mycobacterium
CGSADLRPVRLTVDLFRAARNAPTTLNIAV

SEQ ID NO: 798167 - protein, 21 aa, Mycobacterium
CGSARFSLPTLAVEDYPALPA

SEQ ID NO: 798168 - protein, 18 aa, Mycobacterium
CGSNAEFVVALLAASRAD

SEQ ID NO: 798169 - protein, 23 aa, Mycobacterium
CGSPYSFLPQLCAGDIIAGQYEV

SEQ ID NO: 798170 - protein, 23 aa, Mycobacterium
CGSTAMIYLMHVAAAVAVAAAPP

SEQ ID NO: 798171 - protein, 18 aa, Mycobacterium
CGTAVPDGALPAGSTITA

SEQ ID NO: 798172 - protein, 20 aa, Mycobacterium
CGTCHVIVDPQWSDRVGLSG

SEQ ID NO: 798173 - protein, 17 aa, Mycobacterium
CGTGDCSIYLAQHGWRV

SEQ ID NO: 798174 - protein, 20 aa, Mycobacterium
CGTGDYIDFSWFDAVVMALD

SEQ ID NO: 798175 - protein, 27 aa, Mycobacterium
CGTPPHALLTKFAVNLFMIAMVTGLAE

SEQ ID NO: 798176 - protein, 18 aa, Mycobacterium
CGTPVKWVRLDSAPFTDR

SEQ ID NO: 798177 - protein, 18 aa, Mycobacterium
CGTSAYWQQRTDVVVIGT

SEQ ID NO: 798178 - protein, 27 aa, Mycobacterium
CGTTWTQRLISLLIFDGPQLPAPMHLV

SEQ ID NO: 798179 - protein, 23 aa, Mycobacterium
CGTVFAARPQRMSARKFWVRYAA

SEQ ID NO: 798180 - protein, 27 aa, Mycobacterium
CGTVSPAVFWPIPRVYSGLVRIDRYPT

SEQ ID NO: 798181 - protein, 28 aa, Mycobacterium
CGTVSPTVFWPIPRVYSGLVRIDRYATS

SEQ ID NO: 798182 - protein, 22 aa, Mycobacterium
CGVPGVVFHPARRGFLRSQPER

SEQ ID NO: 798183 - protein, 21 aa, Mycobacterium
CGVRPVGRWIVDPDGAVVRAG

SEQ ID NO: 798184 - protein, 27 aa, Mycobacterium
CGVVAMFFGLRQALRFKLRQPGTALGY

SEQ ID NO: 798185 - protein, 17 aa, Mycobacterium
CGWAIRDGVIGNSSTPG

SEQ ID NO: 798186 - protein, 17 aa, Mycobacterium
CGWPSFFDPSASEAVIL

SEQ ID NO: 798187 - protein, 19 aa, Mycobacterium
CGYEFRLETSCYNPAYGSD

SEQ ID NO: 798188 - protein, 26 aa, Mycobacterium
CGYVDATYWRDMGTPEDFVRGSADLV

SEQ ID NO: 798189 - protein, 18 aa, Mycobacterium
CHAFFQFYVADGRLSCQL

SEQ ID NO: 798190 - protein, 18 aa, Mycobacterium
CHDVRVIRLPRHAGSLPV

SEQ ID NO: 798191 - protein, 17 aa, Mycobacterium
CHGLQCGFCTPGFVTSI

SEQ ID NO: 798192 - protein, 33 aa, Mycobacterium
CHGVDGSLFVRPFLKYQIITVVAPNSPLAVGIP

SEQ ID NO: 798193 - protein, 17 aa, Mycobacterium
CHHFAPAMVRRGSGGIV

SEQ ID NO: 798194 - protein, 30 aa, Mycobacterium
CHHGRYHVSPWVIMLPLDSTGEHLLDVDAE

SEQ ID NO: 798195 - protein, 17 aa, Mycobacterium
CHHLNPMPLFHAGGLNV

SEQ ID NO: 798196 - protein, 24 aa, Mycobacterium
CHPDLRNDFPPLRTPETVATHNIP

SEQ ID NO: 798197 - protein, 21 aa, Mycobacterium
CHPILFLRMADRLSSGARLIV

SEQ ID NO: 798198 - protein, 27 aa, Mycobacterium
CHRRGVRWQLLAGPHVRRLLRVCDPQR

SEQ ID NO: 798199 - protein, 25 aa, Mycobacterium
CHSLAFDFSVWEIFGALLRGGRLVV

SEQ ID NO: 798200 - protein, 21 aa, Mycobacterium
CHSLAFDFSVWEIWGALLHGG

SEQ ID NO: 798201 - protein, 21 aa, Mycobacterium
CHTRRRLVHPPGPNATICADC

SEQ ID NO: 798202 - protein, 25 aa, Mycobacterium
CHVHFICPQILPEALSGGITTMIGG

SEQ ID NO: 798203 - protein, 23 aa, Mycobacterium
CHVHLICPQLIPVALGAGVTTII

SEQ ID NO: 798204 - protein, 26 aa, Mycobacterium
CHVHLVCPQLLPEALGSGITTIIGGG

SEQ ID NO: 798205 - protein, 28 aa, Mycobacterium
CHVVLGRGRFFPPLFPPEGMMAEAVARL

SEQ ID NO: 798206 - protein, 24 aa, Mycobacterium
CIAAGLMLCWPCDLIVAADNARFS

SEQ ID NO: 798207 - protein, 28 aa, Mycobacterium
CIAKELDIRFSLYYTLEEFAQTFAHLAA

SEQ ID NO: 798208 - protein, 17 aa, Mycobacterium
CIAPNPLPGNGFDVVIR

SEQ ID NO: 798209 - protein, 26 aa, Mycobacterium
CIARHDARVVFVRYALPGETVRARLV

SEQ ID NO: 798210 - protein, 20 aa, Mycobacterium
CIAVEFRTHFFNFASRAAIE

SEQ ID NO: 798211 - protein, 18 aa, Mycobacterium
CIAVLLAARPELDIPPTA

SEQ ID NO: 798212 - protein, 18 aa, Mycobacterium
CIAVQRWGELSPTRDNVV

SEQ ID NO: 798213 - protein, 17 aa, Mycobacterium
CICAAAVKRRYLGKLSG

SEQ ID NO: 798214 - protein, 18 aa, Mycobacterium
CIDAMIQLRLPVEAGNRR

SEQ ID NO: 798215 - protein, 18 aa, Mycobacterium
CIDILTQISAASSALRSV

SEQ ID NO: 798216 - protein, 17 aa, Mycobacterium
CIDVFHCWAEGDFDAQV

SEQ ID NO: 798217 - protein, 18 aa, Mycobacterium
CIDVLTQISAASSALRSV

SEQ ID NO: 798218 - protein, 17 aa, Mycobacterium
CIDVLTQISAVNSALQS

SEQ ID NO: 798219 - protein, 18 aa, Mycobacterium
CIDVLTQISAVNSALRSV

SEQ ID NO: 798220 - protein, 17 aa, Mycobacterium
CIECPFHGWRWGPDGSN

SEQ ID NO: 798221 - protein, 18 aa, Mycobacterium
CIECPFHGWRWGPEGTNT

SEQ ID NO: 798222 - protein, 20 aa, Mycobacterium
CIEWPEISFGLAKAGLITVP

SEQ ID NO: 798223 - protein, 24 aa, Mycobacterium
CIGCRRRELAVELLRLVAVDSANG

SEQ ID NO: 798224 - protein, 21 aa, Mycobacterium
CIGRWAALHAGLPISVPGLQI

SEQ ID NO: 798225 - protein, 18 aa, Mycobacterium
CIHDGLGLSWSYRALGNY

SEQ ID NO: 798226 - protein, 18 aa, Mycobacterium
CIHPSQVPVVRKAYRPSD

SEQ ID NO: 798227 - protein, 17 aa, Mycobacterium
CILYSALDAYVRHFELV

SEQ ID NO: 798228 - protein, 17 aa, Mycobacterium
CIQRRQGFEQALTSLVP

SEQ ID NO: 798229 - protein, 17 aa, Mycobacterium
CIQTLANIYYRAIYATE

SEQ ID NO: 798230 - protein, 18 aa, Mycobacterium
CIRTLANIYYRAIYGEEV

SEQ ID NO: 798231 - protein, 17 aa, Mycobacterium
CISLRVLRPMAKGLDQL

SEQ ID NO: 798232 - protein, 17 aa, Mycobacterium
CISVTGPFPGFPVPLEG

SEQ ID NO: 798233 - protein, 22 aa, Mycobacterium
CITILPLQHPIVLAKALATADW

SEQ ID NO: 798234 - protein, 22 aa, Mycobacterium
CITVLPLQHPIVLAKALATADW

SEQ ID NO: 798235 - protein, 21 aa, Mycobacterium
CIVDLPTAILLHRNRIADPTA

SEQ ID NO: 798236 - protein, 25 aa, Mycobacterium
CIVLNGGFRLHPSIAALVAGLRLRL

SEQ ID NO: 798237 - protein, 30 aa, Mycobacterium; identical to SEQ ID NO: 641634

SEQ ID NO: 798238 - protein, 27 aa, Mycobacterium
CIYHDVFSYLVDAPWDEIAFRAAVDVV

SEQ ID NO: 798239 - protein, 23 aa, Mycobacterium
CKDIPLLLTTPHFLVEGAIIAAY

SEQ ID NO: 798240 - protein, 27 aa, Mycobacterium
CKDWEPEPLRWIGVRGMYLAYKAADWH

SEQ ID NO: 798241 - protein, 21 aa, Mycobacterium
CKDWNPHDYIPWSDGKNYYAL

SEQ ID NO: 798242 - protein, 28 aa, Mycobacterium
CKEHDLIDPITLLIATGLRRSELLGLRW

SEQ ID NO: 798243 - protein, 27 aa, Mycobacterium
CKGADVAPPLVWSAPLGAALVVDDPDA

SEQ ID NO: 798244 - protein, 17 aa, Mycobacterium
CKGGFLAVDGRSKPFSA

SEQ ID NO: 798245 - protein, 29 aa, Mycobacterium
CKGNPAWDLPLVFGPIALVYNLAGVTNLV

SEQ ID NO: 798246 - protein, 18 aa, Mycobacterium
CKKHGYKGPFDEWLERWP

SEQ ID NO: 798247 - protein, 24 aa, Mycobacterium
CKLVPYAKRTPKLARTRSWITDVK

SEQ ID NO: 798248 - protein, 20 aa, Mycobacterium
CKPGSAMRALPGISAKVVDD

SEQ ID NO: 798249 - protein, 20 aa, Mycobacterium
CKPYGVPVIADGGLQYSGDI

SEQ ID NO: 798250 - protein, 27 aa, Mycobacterium
CKQAIGPGWLYLTAHRRGQAAPADDDA

SEQ ID NO: 798251 - protein, 23 aa, Mycobacterium
CKQLNPRIVWASGTGFGETGPYA

SEQ ID NO: 798252 - protein, 23 aa, Mycobacterium
CKQLTQVWVAVLQAALDALTRAN

SEQ ID NO: 798253 - protein, 24 aa, Mycobacterium
CKQPIEAGWLYITVHRRGQAATSE

SEQ ID NO: 798254 - protein, 18 aa, Mycobacterium
CKRWFGAGPAAYRNRTRL

SEQ ID NO: 798255 - protein, 24 aa, Mycobacterium
CKTAMFEWWFRWRCDTQKYIWWHP

SEQ ID NO: 798256 - protein, 24 aa, Mycobacterium
CKTIPLEAPWEAKKAARWDRMTLA

SEQ ID NO: 798257 - protein, 21 aa, Mycobacterium
CKVLMRDLLPKKAGKPLTITV

SEQ ID NO: 798258 - protein, 19 aa, Mycobacterium
CKVLMRDLLPKKAGKQLTI

SEQ ID NO: 798259 - protein, 25 aa, Mycobacterium
CLAAGVLPVPIYPPDPINPQNSIEG

SEQ ID NO: 798260 - protein, 28 aa, Mycobacterium
CLAGKVMSLLALGKIPAALTAASQLGAL

SEQ ID NO: 798261 - protein, 22 aa, Mycobacterium
CLAGVKVGLLGMKWDLLCPNCR

SEQ ID NO: 798262 - protein, 18 aa, Mycobacterium
CLAGVPFGLRPEAILPAY

SEQ ID NO: 798263 - protein, 26 aa, Mycobacterium
CLAHIYLRRVLAATEAWPVTLEELTI

SEQ ID NO: 798264 - protein, 17 aa, Mycobacterium
CLAPGNIPTPILASSAT

SEQ ID NO: 798265 - protein, 28 aa, Mycobacterium
CLCRKHHLLKTFWGWHDKQLPDATVIWS

SEQ ID NO: 798266 - protein, 29 aa, Mycobacterium
CLCRKHHLLKTFWGWRDVQYPDGTVLWTS

SEQ ID NO: 798267 - protein, 18 aa, Mycobacterium
CLDIDRWSRAGWRVYALG

SEQ ID NO: 798268 - protein, 24 aa, Mycobacterium
CLDKYTRLFASLRTWERHTDIAVV

SEQ ID NO: 798269 - protein, 21 aa, Mycobacterium
CLDLLFRGEIPDGVDPASLMK

SEQ ID NO: 798270 - protein, 18 aa, Mycobacterium
CLDLLFRGEIPEGVDPAS

SEQ ID NO: 798271 - protein, 21 aa, Mycobacterium
CLDLLFRGEIPEGVDPASLMK

SEQ ID NO: 798272 - protein, 34 aa, Mycobacterium
CLDRDLPLLTLPPDVPFRRIVDWAEAHRAAEREA

SEQ ID NO: 798273 - protein, 25 aa, Mycobacterium
CLDRYARLFAALTTWERHTDIAVIP

SEQ ID NO: 798274 - protein, 23 aa, Mycobacterium
CLDVSRWERAGWRVFRLGARIRA

SEQ ID NO: 798275 - protein, 36 aa, Mycobacterium
CLDYAKMRTLWGQNIGQFQLIQLKLAKMEVARINVQ

SEQ ID NO: 798276 - protein, 24 aa, Mycobacterium
CLEYALANDERFGIWGGLSERERR

SEQ ID NO: 798277 - protein, 17 aa, Mycobacterium
CLFLDRQAFDRLLATHP

SEQ ID NO: 798278 - protein, 21 aa, Mycobacterium
CLGTRLQMTWLDEDSPSALKP

SEQ ID NO: 798279 - protein, 20 aa, Mycobacterium
CLGYAFYAPPASVPRARLFP

SEQ ID NO: 798280 - protein, 38 aa, Mycobacterium
CLHDPVWYDHLPYLPFPPNWPVFAPKDKIGDWLEFYTR

SEQ ID NO: 798281 - protein, 19 aa, Mycobacterium
CLHRYPGLAPVLESQTFAC

SEQ ID NO: 798282 - protein, 37 aa, Mycobacterium
CLIHGFMGSAYLFNGLFFSLPWFYRCGYDVVLYTRQG

SEQ ID NO: 798283 - protein, 20 aa, Mycobacterium
CLKRYYARHLFRLLETAPIT

SEQ ID NO: 798284 - protein, 17 aa, Mycobacterium
CLLGRFLQDDVRVGAGE

SEQ ID NO: 798285 - protein, 17 aa, Mycobacterium
CLLISQRVWGPNPIPKL

SEQ ID NO: 798286 - protein, 17 aa, Mycobacterium
CLNAPVYEPLSGADFPA

SEQ ID NO: 798287 - protein, 18 aa, Mycobacterium
CLNPPVVWEADRGWFVTE

SEQ ID NO: 798288 - protein, 25 aa, Mycobacterium
CLPAPARPATLLGWLQADIAANAVR

SEQ ID NO: 798289 - protein, 18 aa, Mycobacterium
CLPKFPLPLGDTSAPCEM

SEQ ID NO: 798290 - protein, 19 aa, Mycobacterium
CLPLPKFSDIRYNYSLAGG

SEQ ID NO: 798291 - protein, 27 aa, Mycobacterium
CLPSDRLLNLLIYIKGYLDGTLTFRRS

SEQ ID NO: 798292 - protein, 17 aa, Mycobacterium
CLPWYASLRLGSYGRSP

SEQ ID NO: 798293 - protein, 19 aa, Mycobacterium
CLPYTVRALATLLDRPAEE

SEQ ID NO: 798294 - protein, 23 aa, Mycobacterium
CLQMHLLVLSFTLAVEARAKGDA

SEQ ID NO: 798295 - protein, 22 aa, Mycobacterium
CLQQAIRRRAFTRALRITGSPD

SEQ ID NO: 798296 - protein, 22 aa, Mycobacterium
CLRERIPNLHFSVSATTRAPRP

SEQ ID NO: 798297 - protein, 24 aa, Mycobacterium
CLRSTFLYVGWRCGADGTDAAIRA

SEQ ID NO: 798298 - protein, 17 aa, Mycobacterium
CLRTFLRDHGHFEVKKG

SEQ ID NO: 798299 - protein, 25 aa, Mycobacterium
CLTEALGLALPGNGSVLATHTARRA

SEQ ID NO: 798300 - protein, 17 aa, Mycobacterium
CLTGLHSWLANWQLRAF

SEQ ID NO: 798301 - protein, 20 aa, Mycobacterium
CLTGNFTICPPALAQYAALA

SEQ ID NO: 798302 - protein, 18 aa, Mycobacterium
CLTLAPAIAVAWNPLIDS

SEQ ID NO: 798303 - protein, 17 aa, Mycobacterium
CLTLGIELLLASDIVVA

SEQ ID NO: 798304 - protein, 19 aa, Mycobacterium
CLTLIPRFSPEKALQIIER

SEQ ID NO: 798305 - protein, 37 aa, Mycobacterium
CLTPTFSASRFLPDVRYFGATFFTYVGKALGYLLATP

SEQ ID NO: 798306 - protein, 25 aa, Mycobacterium
CLTRLLDCDYPRWRDARSEDFRARF

SEQ ID NO: 798307 - protein, 19 aa, Mycobacterium
CLTVAPYLVGGLARRIATG

SEQ ID NO: 798308 - protein, 20 aa, Mycobacterium
CLTVINPYTLAPVGSVRLNG

SEQ ID NO: 798309 - protein, 19 aa, Mycobacterium
CLVAIGMHLDIPAVRARLD

SEQ ID NO: 798310 - protein, 25 aa, Mycobacterium
CLVEALGLALPGNGSLLATHTARKA

SEQ ID NO: 798311 - protein, 17 aa, Mycobacterium
CLVGFPRRDLSAEETED

SEQ ID NO: 798312 - protein, 18 aa, Mycobacterium
CLVLCDDDLRPLRPAILY

SEQ ID NO: 798313 - protein, 19 aa, Mycobacterium
CLVNLTNPPKRPAGTEGNW

SEQ ID NO: 798314 - protein, 19 aa, Mycobacterium
CLVVNYRMPPKASLDQAID

SEQ ID NO: 798315 - protein, 18 aa, Mycobacterium
CLWEALLRGDDFVGEIPA

SEQ ID NO: 798316 - protein, 17 aa, Mycobacterium
CLYLNVWTGPRGEQPRP

SEQ ID NO: 798317 - protein, 27 aa, Mycobacterium
CMDNGMPILVFNLLTDGNIARAVAGER

SEQ ID NO: 798318 - protein, 26 aa, Mycobacterium
CMDNGMPILVFNLLTSGNIARAVAGE

SEQ ID NO: 798319 - protein, 27 aa, Mycobacterium
CMDNGMPILVFNLLVDGNIARAVAGEK

SEQ ID NO: 798320 - protein, 26 aa, Mycobacterium
CMDNRMPILVFNLLTEGNIARAVAGE

SEQ ID NO: 798321 - protein, 18 aa, Mycobacterium
CMHMRIDFDLLSSAGLAT

SEQ ID NO: 798322 - protein, 17 aa, Mycobacterium
CMIDVDFLKDVGFTVVA

SEQ ID NO: 798323 - protein, 17 aa, Mycobacterium
CMIFVAARRSATVSWPL

SEQ ID NO: 798324 - protein, 19 aa, Mycobacterium
CMKAFEKPPTALVLAGGGA

SEQ ID NO: 798325 - protein, 23 aa, Mycobacterium
CMREETFGPTLPVMKVRDVAEAI

SEQ ID NO: 798326 - protein, 27 aa, Mycobacterium
CMSESLPTLFRQAGGYRRQLTFTPKGV

SEQ ID NO: 798327 - protein, 24 aa, Mycobacterium
CNATVPVVRIPIASAISSANTALM

SEQ ID NO: 798328 - protein, 18 aa, Mycobacterium
CNDLLIFMLAGHDTTATA

SEQ ID NO: 798329 - protein, 18 aa, Mycobacterium
CNLACKFCQNWDISKSRE

SEQ ID NO: 798330 - protein, 26 aa, Mycobacterium
CNPAPSTLLLALLSGFERRGRWNVPK

SEQ ID NO: 798331 - protein, 22 aa, Mycobacterium
CNPRHHALAFMPMPNPTGIVHL

SEQ ID NO: 798332 - protein, 27 aa, Mycobacterium
CNPRHHSLAFLPLPTPSGIVHLMIEVE

SEQ ID NO: 798333 - protein, 27 aa, Mycobacterium
CNPRHHSLAFLPLPTPSGIVHLMMEVE

SEQ ID NO: 798334 - protein, 27 aa, Mycobacterium
CNPRHHSLAFLPLPTPSGIVHLMVEVE

SEQ ID NO: 798335 - protein, 27 aa, Mycobacterium
CNPRHHSLAFLPLPTPSGIVHLMVEVQ

SEQ ID NO: 798336 - protein, 23 aa, Mycobacterium
CNPSKLLLDPYSKAIDGIFDWNQ

SEQ ID NO: 798337 - protein, 24 aa, Mycobacterium
CNQRAEATLFPKANSWYMGANVPG

SEQ ID NO: 798338 - protein, 26 aa, Mycobacterium
CNRPAPPPPVPPPARPAARLGADNEA

SEQ ID NO: 798339 - protein, 24 aa, Mycobacterium
CNRRAEATLFPRANSWYMGANVPG

SEQ ID NO: 798340 - protein, 19 aa, Mycobacterium
CNRWQPGVRLLPASDDRCE

SEQ ID NO: 798341 - protein, 19 aa, Mycobacterium
CNSYRYIQFAVANQFYLLS

SEQ ID NO: 798342 - protein, 25 aa, Mycobacterium
CPAHPDWITQILVALATGRAGDITL

SEQ ID NO: 798343 - protein, 26 aa, Mycobacterium
CPAHVYLRRALTSTELWPVSLKEVGR

SEQ ID NO: 798344 - protein, 26 aa, Mycobacterium
CPARPWVCLLCPLAVFAPRHAANLLR

SEQ ID NO: 798345 - protein, 26 aa, Mycobacterium
CPARPWVCLLCPLAVFAPRHAVNLLR

SEQ ID NO: 798346 - protein, 25 aa, Mycobacterium
CPDEFRRPDLRLALMDRQGVYGAVM

SEQ ID NO: 798347 - protein, 23 aa, Mycobacterium
CPDGTWNIDLLERIAPTALDEDT

SEQ ID NO: 798348 - protein, 27 aa, Mycobacterium
CPDPVRVSIFLWGAWNGVLSLNLRPDR

SEQ ID NO: 798349 - protein, 28 aa, Mycobacterium
CPESAELLQLLFLEAGFPQGAYVDIRAT

SEQ ID NO: 798350 - protein, 17 aa, Mycobacterium
CPFITDEFLRRNPAAAV

SEQ ID NO: 798351 - protein, 24 aa, Mycobacterium
CPGPTDTPLFHAQPEKLKEALVKA

SEQ ID NO: 798352 - protein, 19 aa, Mycobacterium
CPGRFLLGIGVGHREAHVE

SEQ ID NO: 798353 - protein, 19 aa, Mycobacterium
CPGVFAGGDMVPCERTVTV

SEQ ID NO: 798354 - protein, 19 aa, Mycobacterium
CPHAIFIDRRKTVPELYVA

SEQ ID NO: 798355 - protein, 23 aa, Mycobacterium
CPHSVIRTTLYPRDRLDAAPATF

SEQ ID NO: 798356 - protein, 20 aa, Mycobacterium
CPISMTYAVVPALRHNPELA

SEQ ID NO: 798357 - protein, 26 aa, Mycobacterium
CPISMTYAVVPALRYNPELAAVYEPL

SEQ ID NO: 798358 - protein, 33 aa, Mycobacterium
CPKCSGRLRKLFGSVGVVFKGSGFYRTDNRSDS

SEQ ID NO: 798359 - protein, 27 aa, Mycobacterium
CPKDKLDSYVRPLLALSAERVRAGRDP

SEQ ID NO: 798360 - protein, 20 aa, Mycobacterium
CPLLYRFRAIDRLPEKPSTA

SEQ ID NO: 798361 - protein, 20 aa, Mycobacterium
CPLLYRFRAIDRLPEPSSTA

SEQ ID NO: 798362 - protein, 21 aa, Mycobacterium
CPLWNVYETFANPGKILVQIA

SEQ ID NO: 798363 - protein, 19 aa, Mycobacterium
CPLWNVYETFGNPGKILVQ

SEQ ID NO: 798364 - protein, 18 aa, Mycobacterium
CPPDRFPGVISEPVVPPV

SEQ ID NO: 798365 - protein, 21 aa, Mycobacterium
CPPDRFPGVITEPVVPPAKAS

SEQ ID NO: 798366 - protein, 26 aa, Mycobacterium
CPPSTITLPALLSAAGFDVWLLNWRG

SEQ ID NO: 798367 - protein, 17 aa, Mycobacterium
CPPYHLAVVIGGTSAEF

SEQ ID NO: 798368 - protein, 34 aa, Mycobacterium
CPQCDGRLRKIFGKVGVVFKGSGFYRTDSREAGK

SEQ ID NO: 798369 - protein, 25 aa, Mycobacterium
CPRRMERLIRTLPTLSLHLLAAIAE

SEQ ID NO: 798370 - protein, 20 aa, Mycobacterium
CPRRWLCANEALHTPGIEGL

SEQ ID NO: 798371 - protein, 25 aa, Mycobacterium
CPRSPVIPGIVWYSAETQPDGWVRL

SEQ ID NO: 798372 - protein, 26 aa, Mycobacterium
CPRTGPPRLLYVGRLEYEKGIQDAIA

SEQ ID NO: 798373 - protein, 17 aa, Mycobacterium
CPRTKMVLGGYSQGAAV

SEQ ID NO: 798374 - protein, 23 aa, Mycobacterium
CPSRSFTIVGDLAQRRSPAGTTS

SEQ ID NO: 798375 - protein, 26 aa, Mycobacterium
CPTDQQLLKILRGFADVVLVGAGTAR

SEQ ID NO: 798376 - protein, 26 aa, Mycobacterium
CPTIAAFLSIHNMCAWMIDTFGTAEQ

SEQ ID NO: 798377 - protein, 18 aa, Mycobacterium
CPVALAFPEGPQSELLEE

SEQ ID NO: 798378 - protein, 30 aa, Mycobacterium
CPVAWNENYGGFWFLSSYDAVSRTARDGDT

SEQ ID NO: 798379 - protein, 21 aa, Mycobacterium
CPVFPGRRYLDWTLDDPTGLD

SEQ ID NO: 798380 - protein, 25 aa, Mycobacterium
CPVKRQWPRLLSHIQQGYLTPSDIV

SEQ ID NO: 798381 - protein, 17 aa, Mycobacterium
CPWHSDAEWIRIKQDER

SEQ ID NO: 798382 - protein, 17 aa, Mycobacterium
CPYFPGKRYENWELADP

SEQ ID NO: 798383 - protein, 25 aa, Mycobacterium
CQAMIDDLRLFGRDWGFRLPDVTVP

SEQ ID NO: 798384 - protein, 24 aa, Mycobacterium
CQDNELTWIDWANADAGLLEFTRT

SEQ ID NO: 798385 - protein, 18 aa, Mycobacterium
CQERADWLSVTRWANWLA

SEQ ID NO: 798386 - protein, 19 aa, Mycobacterium
CQFAVGLSRQLYGRTIASE

SEQ ID NO: 798387 - protein, 22 aa, Mycobacterium
CQGVCPPKQFERARVVVFAGDH

SEQ ID NO: 798388 - protein, 24 aa, Mycobacterium
CQGWLEGYLLTGRHGLFSCYEAFV

SEQ ID NO: 798389 - protein, 26 aa, Mycobacterium
CQHPIPADSLIWKYWGRFDVMYFGSG

SEQ ID NO: 798390 - protein, 23 aa, Mycobacterium
CQIAGITYRQLDYWARTSLVVPS

SEQ ID NO: 798391 - protein, 17 aa, Mycobacterium
CQRLLFSATLDAGVDVL

SEQ ID NO: 798392 - protein, 25 aa, Mycobacterium
CQRYPGAARRVIRHLNARLLPTGYP

SEQ ID NO: 798393 - protein, 25 aa, Mycobacterium
CQTRPYFDGMLLHTRTHLPAGRALT

SEQ ID NO: 798394 - protein, 22 aa, Mycobacterium
CRAALRHMVPARRGSIINTASF

SEQ ID NO: 798395 - protein, 23 aa, Mycobacterium
CRAARRLFGFPVVCAEGAALPMA

SEQ ID NO: 798396 - protein, 24 aa, Mycobacterium
CRADGYLVELLTPAGRQLYSLMAG

SEQ ID NO: 798397 - protein, 24 aa, Mycobacterium
CRATQWLDLRFVSGPGDLLRGMVA

SEQ ID NO: 798398 - protein, 26 aa, Mycobacterium
CRAYAYDLLAFARWLRDEQLGVAEVN

SEQ ID NO: 798399 - protein, 17 aa, Mycobacterium
CRCTGYRAILDALEGKV

SEQ ID NO: 798400 - protein, 24 aa, Mycobacterium
CRDDDWRPQWRVDLIPSYKAHRVA

SEQ ID NO: 798401 - protein, 22 aa, Mycobacterium
CRDFRVDRRKVITIPHGATLPC

SEQ ID NO: 798402 - protein, 25 aa, Mycobacterium
CRDKCHYCTFVTVPGKLRAEGKGMF

SEQ ID NO: 798403 - protein, 22 aa, Mycobacterium
CRDKCHYCTFVTVPGKLRAQGQ

SEQ ID NO: 798404 - protein, 19 aa, Mycobacterium
CRDLTCRFPGCSRPAMICD

SEQ ID NO: 798405 - protein, 17 aa, Mycobacterium
CRDLTCRWPGCDCPALA

SEQ ID NO: 798406 - protein, 32 aa, Mycobacterium
CRDYAHLVVALLRAVKVPARLVAVYAPGCDPM

SEQ ID NO: 798407 - protein, 25 aa, Mycobacterium
CRDYAHLVVALLRAVNVPARLVSVY

SEQ ID NO: 798408 - protein, 18 aa, Mycobacterium
CREEIEPLDFVFPYAVRS

SEQ ID NO: 798409 - protein, 24 aa, Mycobacterium
CRGEVPLGTLIELLAGYHGVDADA

SEQ ID NO: 798410 - protein, 27 aa, Mycobacterium
CRGLTIRRFEFPNLKALNFVVAGFLGD

SEQ ID NO: 798411 - protein, 19 aa, Mycobacterium
CRGPVEWDLAMLGAAAVAE

SEQ ID NO: 798412 - protein, 24 aa, Mycobacterium
CRNRIEIVIAMLGIIKAGAILINV

SEQ ID NO: 798413 - protein, 17 aa, Mycobacterium
CRPVTGWATMAMATDWS

SEQ ID NO: 798414 - protein, 24 aa, Mycobacterium
CRPWLIAEIEAVRPQLIVCLGATA

SEQ ID NO: 798415 - protein, 18 aa, Mycobacterium
CRQGFPRRDLDAAEVDAV

SEQ ID NO: 798416 - protein, 17 aa, Mycobacterium
CRQWAAKGYAGMLADYG

SEQ ID NO: 798417 - protein, 19 aa, Mycobacterium
CRRAIPRMLRRGAGHIVNV

SEQ ID NO: 798418 - protein, 23 aa, Mycobacterium
CRRFCGPLAHPAQWWVTLSCGCP

SEQ ID NO: 798419 - protein, 20 aa, Mycobacterium
CRRFISMTGGYHGKTLGALS

SEQ ID NO: 798420 - protein, 18 aa, Mycobacterium
CRRHDVLLVFDEIATGFG

SEQ ID NO: 798421 - protein, 19 aa, Mycobacterium
CRRLDGIPLAIELAASRMA

SEQ ID NO: 798422 - protein, 33 aa, Mycobacterium
CRRLRPDFATGLAPLRWGTGFMLGSNRFGPFGR

SEQ ID NO: 798423 - protein, 23 aa, Mycobacterium
CRRPIEEPLPGLKRFRIASKIVK

SEQ ID NO: 798424 - protein, 17 aa, Mycobacterium
CRRRYFTQPDFQSIAVT

SEQ ID NO: 798425 - protein, 27 aa, Mycobacterium
CRSLGQFLDPDTLRYLRDFRFGGDIDG

SEQ ID NO: 798426 - protein, 21 aa, Mycobacterium
CRTEYFINRSFAAVGRHLQRH

SEQ ID NO: 798427 - protein, 28 aa, Mycobacterium
CRTHGRTWDLLRLTRMPTVQVDVGYITN

SEQ ID NO: 798428 - protein, 27 aa, Mycobacterium
CRTHHLVKTFWGWQEKQLPDGTLIFTS

SEQ ID NO: 798429 - protein, 25 aa, Mycobacterium
CRTLPQQALLYRLSGDMNPIHADPE

SEQ ID NO: 798430 - protein, 17 aa, Mycobacterium
CRTTFNCTEACPRGIQV

SEQ ID NO: 798431 - protein, 19 aa, Mycobacterium
CRWHGLPLTGKTCEFGWAP

SEQ ID NO: 798432 - protein, 29 aa, Mycobacterium
CRYNDGIGHPFWFSRRLFGELTQLHGDKG

SEQ ID NO: 798433 - protein, 25 aa, Mycobacterium
CSAATILTPFGRPPRITSDGGQSGQ

SEQ ID NO: 798434 - protein, 18 aa, Mycobacterium
CSAKELYEIRTLFGVLFQ

SEQ ID NO: 798435 - protein, 17 aa, Mycobacterium
CSALKRSYRDQLRAHCP

SEQ ID NO: 798436 - protein, 23 aa, Mycobacterium
CSAMARTYLGPEFDIHCGGMDLV

SEQ ID NO: 798437 - protein, 22 aa, Mycobacterium
CSAMARTYLGPSFDIHCGGMDL

SEQ ID NO: 798438 - protein, 31 aa, Mycobacterium
CSATVEGLILGSYRFTAFRSAKTAPKDEGLR

SEQ ID NO: 798439 - protein, 20 aa, Mycobacterium
CSAVTFMIPVNLKPVDVTLP

SEQ ID NO: 798440 - protein, 24 aa, Mycobacterium
CSDEQFPTMPFAALGYDVVHCGFS

SEQ ID NO: 798441 - protein, 26 aa, Mycobacterium
CSDESLDLRWWPLDALPDGTDFGLDQ

SEQ ID NO: 798442 - protein, 31 aa, Mycobacterium
CSDRSGFVVNFLLVPYLLSAIRMVEGGVATI

SEQ ID NO: 798443 - protein, 24 aa, Mycobacterium
CSEAMLFHYFGDKRGIFEQVVSRQ

SEQ ID NO: 798444 - protein, 24 aa, Mycobacterium
CSETCVGRLRYLGLVLYDVDRVLQ

SEQ ID NO: 798445 - protein, 27 aa, Mycobacterium
CSFDPIYRHVLATPGKRIRAGLGLACF

SEQ ID NO: 798446 - protein, 23 aa, Mycobacterium
CSFEQVAYLLWHGELPTGRQLTE

SEQ ID NO: 798447 - protein, 20 aa, Mycobacterium
CSFLMVCTGYYRYDGGYLPE

SEQ ID NO: 798448 - protein, 17 aa, Mycobacterium
CSFRLTGRLFRRRPQES

SEQ ID NO: 798449 - protein, 25 aa, Mycobacterium
CSFYGPLHEYFIRRAVDAVRPGGYV

SEQ ID NO: 798450 - protein, 25 aa, Mycobacterium
CSGARLIVTLLNRLEREGASRGLAT

SEQ ID NO: 798451 - protein, 20 aa, Mycobacterium
CSGLTKPFPTKLTADATYVV

SEQ ID NO: 798452 - protein, 20 aa, Mycobacterium
CSGPGELLDALIDHWEQHGD

SEQ ID NO: 798453 - protein, 32 aa, Mycobacterium
CSGRLRKLFHAVGVVFKGSGFYRTDSREATKK

SEQ ID NO: 798454 - protein, 18 aa, Mycobacterium
CSGYGLNWRFGAENLMLV

SEQ ID NO: 798455 - protein, 27 aa, Mycobacterium
CSIEPWVFMNWRRASYYLYLNEVIDAH

SEQ ID NO: 798456 - protein, 20 aa, Mycobacterium
CSIKHQLPSIVFSLEMSKTE

SEQ ID NO: 798457 - protein, 20 aa, Mycobacterium
CSIKHQLPSVIFSLEMSKTE

SEQ ID NO: 798458 - protein, 19 aa, Mycobacterium
CSIKHRMASVIFSLEMSKS

SEQ ID NO: 798459 - protein, 25 aa, Mycobacterium
CSINTPCGCWIFLEGMNLADIKAVL

SEQ ID NO: 798460 - protein, 24 aa, Mycobacterium
CSNKKVFSQLPRLQALALSAVNTS

SEQ ID NO: 798461 - protein, 25 aa, Mycobacterium
CSPKVSAILLRRLSTLAAQREPAPT

SEQ ID NO: 798462 - protein, 31 aa, Mycobacterium
CSPQAWASAAPLLLVRAFLGLEPDVPHRKLT

SEQ ID NO: 798463 - protein, 17 aa, Mycobacterium
CSPSFNWRKHLDDSTIA

SEQ ID NO: 798464 - protein, 24 aa, Mycobacterium
CSPSRFCWGVWLRGICRGSVVGLT

SEQ ID NO: 798465 - protein, 17 aa, Mycobacterium
CSRAFGAQNPRLRRWWP

SEQ ID NO: 798466 - protein, 20 aa, Mycobacterium
CSRATLYRYFENREALHIAY

SEQ ID NO: 798467 - protein, 26 aa, Mycobacterium
CSREHPVPLLFVHGGWHGAWCWEHFL

SEQ ID NO: 798468 - protein, 31 aa, Mycobacterium
CSRESTVPYALRGLLFCAACGRRMQGAARAG

SEQ ID NO: 798469 - protein, 30 aa, Mycobacterium
CSRESTVPYALRGLLFCAACGRRMQGAARP

SEQ ID NO: 798470 - protein, 31 aa, Mycobacterium
CSRESTVPYALRGLLFCAACGRRMQGAARPG

SEQ ID NO: 798471 - protein, 30 aa, Mycobacterium
CSRESTVPYALRGLLFCAACGRRMQGAARV

SEQ ID NO: 798472 - protein, 19 aa, Mycobacterium
CSRFPLSHVAIAGIDWGVL

SEQ ID NO: 798473 - protein, 25 aa, Mycobacterium
CSSCFLVQHQNRLALQRGNEQICVD

SEQ ID NO: 798474 - protein, 24 aa, Mycobacterium
CSSLGLPERILVQPLRTLSGGQRR

SEQ ID NO: 798475 - protein, 18 aa, Mycobacterium
CSSSLVAFHLACQGIANG

SEQ ID NO: 798476 - protein, 23 aa, Mycobacterium
CSTWDLTDWQGNPIRLGFTARSA

SEQ ID NO: 798477 - protein, 19 aa, Mycobacterium
CSVALLCDILLISEDAYLA

SEQ ID NO: 798478 - protein, 17 aa, Mycobacterium
CSVLLKPSERTPLTAEV

SEQ ID NO: 798479 - protein, 25 aa, Mycobacterium
CSVRGWAVGFGCNLALAADFTVAAD

SEQ ID NO: 798480 - protein, 21 aa, Mycobacterium
CSVSGRRPTPGTAAYGAAKAG

SEQ ID NO: 798481 - protein, 26 aa, Mycobacterium
CTAEHPVPLLFVHGGWHGAWCWEHFQ

SEQ ID NO: 798482 - protein, 25 aa, Mycobacterium
CTAGHPPPLLVTADAKSRYLEPSGG

SEQ ID NO: 798483 - protein, 20 aa, Mycobacterium
CTALGCRAPLIVVTNSATRW

SEQ ID NO: 798484 - protein, 26 aa, Mycobacterium
CTALPLVSAPGRWSWHDRWSSGPVRA

SEQ ID NO: 798485 - protein, 17 aa, Mycobacterium
CTAPIEIVARFLGVLEL

SEQ ID NO: 798486 - protein, 18 aa, Mycobacterium
CTATLRDRFQNAESAGIV

SEQ ID NO: 798487 - protein, 21 aa, Mycobacterium
CTDFARWRALGIGKDAIMRIN

SEQ ID NO: 798488 - protein, 25 aa, Mycobacterium
CTDHWRARFQSPFPGAAAPSHILQL

SEQ ID NO: 798489 - protein, 19 aa, Mycobacterium
CTDIHKSFGGVPVLKGISL

SEQ ID NO: 798490 - protein, 17 aa, Mycobacterium
CTDLRLDKSERPYGSVI

SEQ ID NO: 798491 - protein, 23 aa, Mycobacterium
CTDSDPIVLIHDAGMREVAVDIA

SEQ ID NO: 798492 - protein, 23 aa, Mycobacterium
CTECGALLMHRTRSSALMMAAAM

SEQ ID NO: 798493 - protein, 27 aa, Mycobacterium
CTEDIDLGWYRLPKGSLGANYLKYQGI

SEQ ID NO: 798494 - protein, 27 aa, Mycobacterium
CTERGIAFVPFFPLGSAFVPDNPVLGN

SEQ ID NO: 798495 - protein, 17 aa, Mycobacterium
CTFVTVPGKLRAQGAGM

SEQ ID NO: 798496 - protein, 18 aa, Mycobacterium
CTFVTVPGKLRAQGAGMY

SEQ ID NO: 798497 - protein, 17 aa, Mycobacterium
CTFVTVPGKLRAQGMGM

SEQ ID NO: 798498 - protein, 17 aa, Mycobacterium
CTFVTVPGKLRAQGQGM

SEQ ID NO: 798499 - protein, 19 aa, Mycobacterium
CTGFIFNRVWAAIKRESLA

SEQ ID NO: 798500 - protein, 20 aa, Mycobacterium
CTGHAIAMGAFLLCSGDHRV

SEQ ID NO: 798501 - protein, 24 aa, Mycobacterium
CTGKQYRFVLPGPHLTMTEQAQCV

SEQ ID NO: 798502 - protein, 31 aa, Mycobacterium
CTGMPFAFVGKPRRWIRRPPPLYGQHTGEVL

SEQ ID NO: 798503 - protein, 22 aa, Mycobacterium
CTGQTWYQIAPTIRYELRGVKP

SEQ ID NO: 798504 - protein, 22 aa, Mycobacterium
CTGSFILAQAGLLDGRRATTHW

SEQ ID NO: 798505 - protein, 23 aa, Mycobacterium
CTGSFILAQAGLLNGKRATTHWR

SEQ ID NO: 798506 - protein, 28 aa, Mycobacterium
CTGTGMGIDRLLMCLTGLSIRETVLFPI

SEQ ID NO: 798507 - protein, 28 aa, Mycobacterium
CTGTVLLEYPVWMWHWARPGDPAVPWER

SEQ ID NO: 798508 - protein, 29 aa, Mycobacterium
CTGWSYGGYLTLAALTFHPELFAAGISIC

SEQ ID NO: 798509 - protein, 23 aa, Mycobacterium
CTGYIVQLPLPKHLDENAALERV

SEQ ID NO: 798510 - protein, 24 aa, Mycobacterium
CTHQTLHYQLLNSVQPYGLSSSSR

SEQ ID NO: 798511 - protein, 17 aa, Mycobacterium
CTIALGFEKMQPGSLSG

SEQ ID NO: 798512 - protein, 24 aa, Mycobacterium
CTIEGHYRRPMDIEWAKDGLDGKL

SEQ ID NO: 798513 - protein, 25 aa, Mycobacterium
CTIRDDLLVLLRKLHRRDDVGRIVL

SEQ ID NO: 798514 - protein, 24 aa, Mycobacterium
CTIRNDLLVLLRQLHRRDDVDRIV

SEQ ID NO: 798515 - protein, 24 aa, Mycobacterium
CTKDVDLGWYTLPKGSLGGNYLKY

SEQ ID NO: 798516 - protein, 20 aa, Mycobacterium
CTLIGRAYLYGLMAGGEAGV

SEQ ID NO: 798517 - protein, 23 aa, Mycobacterium
CTLRNWLGMWSLRHAQTRAERHL

SEQ ID NO: 798518 - protein, 24 aa, Mycobacterium
CTLRNWLGMWSLRVAQTRAEPHLA

SEQ ID NO: 798519 - protein, 19 aa, Mycobacterium
CTMRWAGRLLPAASRKLPD

SEQ ID NO: 798520 - protein, 21 aa, Mycobacterium
CTPARHFSGRLFSRDTTLWAS

SEQ ID NO: 798521 - protein, 23 aa, Mycobacterium
CTPELPTPWPREVLDDLLVVLLA

SEQ ID NO: 798522 - protein, 22 aa, Mycobacterium
CTPHALCWTADFTRDVSRSVID

SEQ ID NO: 798523 - protein, 23 aa, Mycobacterium
CTPHDLWPNQYPAPTASALATTS

SEQ ID NO: 798524 - protein, 23 aa, Mycobacterium
CTPHNLWPNQYPAPTASALATTS

SEQ ID NO: 798525 - protein, 20 aa, Mycobacterium
CTPIQQQLWARLSVFAGSFD

SEQ ID NO: 798526 - protein, 17 aa, Mycobacterium
CTQLWLESGEAWVDSRR

SEQ ID NO: 798527 - protein, 20 aa, Mycobacterium
CTQMLAWYGADVLKVERPGG

SEQ ID NO: 798528 - protein, 26 aa, Mycobacterium
CTRDVDLGWYTLPKGSVGGSYIKYRG

SEQ ID NO: 798529 - protein, 17 aa, Mycobacterium
CTRLIRSATPNATLTLV

SEQ ID NO: 798530 - protein, 25 aa, Mycobacterium
CTRRGRLRSGRLGRRRLRGCRGGRL

SEQ ID NO: 798531 - protein, 33 aa, Mycobacterium
CTRVTPYFELPRYPWQRQRLRDELPEFVQMKYG

SEQ ID NO: 798532 - protein, 22 aa, Mycobacterium
CTSLYGVPTMFIAELGLADFAT

SEQ ID NO: 798533 - protein, 29 aa, Mycobacterium
CTTRGIAFVPFFPLGAAFMRPNPVLGHQL

SEQ ID NO: 798534 - protein, 25 aa, Mycobacterium
CTVEDPDLFSYRREPRTGRLASVIW

SEQ ID NO: 798535 - protein, 17 aa, Mycobacterium
CTVLLDGAAVRSCLLFA

SEQ ID NO: 798536 - protein, 25 aa, Mycobacterium
CTVLLDGRRVTTCLTFAVAADGARI

SEQ ID NO: 798537 - protein, 22 aa, Mycobacterium
CTVLVDGRRINSCLALAVMHDG

SEQ ID NO: 798538 - protein, 24 aa, Mycobacterium
CTVLVDGRRINSCLTLAVMHEGAQ

SEQ ID NO: 798539 - protein, 25 aa, Mycobacterium
CTVLVDGRRVTSCLTFAVAADGMRV

SEQ ID NO: 798540 - protein, 27 aa, Mycobacterium
CTVRDDLLILLRRLHRRADVTRIVVQM

SEQ ID NO: 798541 - protein, 24 aa, Mycobacterium
CTVRGWAVGLGCNLALAADFTVAD

SEQ ID NO: 798542 - protein, 24 aa, Mycobacterium
CTVRGWAVGLGCNLALAADFTVAT

SEQ ID NO: 798543 - protein, 25 aa, Mycobacterium
CVAAGDWLFLAGQLPTEFGDTGLAP

SEQ ID NO: 798544 - protein, 23 aa, Mycobacterium
CVAGTALIAGLLKGLLDAGVTPH

SEQ ID NO: 798545 - protein, 27 aa, Mycobacterium
CVAHVYLRRALTSTELWPVALKEIDLG

SEQ ID NO: 798546 - protein, 18 aa, Mycobacterium
CVALLFARVHGDTALRAT

SEQ ID NO: 798547 - protein, 18 aa, Mycobacterium
CVAQLRAFDHATDKLREN

SEQ ID NO: 798548 - protein, 23 aa, Mycobacterium
CVDFCAWHPGVAAQVMCALALWA

SEQ ID NO: 798549 - protein, 19 aa, Mycobacterium
CVDLANTVWLFLHSGSRGV

SEQ ID NO: 798550 - protein, 24 aa, Mycobacterium
CVDRSAIRGFYLWAAEHQGVENPV

SEQ ID NO: 798551 - protein, 19 aa, Mycobacterium
CVETITNALSALPSVRTVE

SEQ ID NO: 798552 - protein, 18 aa, Mycobacterium
CVFALTAMGFLPQTGDEV

SEQ ID NO: 798553 - protein, 17 aa, Mycobacterium
CVFFESPRRLAETLRDA

SEQ ID NO: 798554 - protein, 23 aa, Mycobacterium
CVGCRKRELAVELLRVVAESTGN

SEQ ID NO: 798555 - protein, 25 aa, Mycobacterium
CVGEDIRWALVPGTAVHRVLRICDP

SEQ ID NO: 798556 - protein, 25 aa, Mycobacterium
CVGEFHYLHHLPGGTRYDDPNAMGA

SEQ ID NO: 798557 - protein, 18 aa, Mycobacterium
CVGGFVPVVLHDAEHDPA

SEQ ID NO: 798558 - protein, 17 aa, Mycobacterium
CVGLQLLLDAPQRVSSA

SEQ ID NO: 798559 - protein, 25 aa, Mycobacterium
CVGQTLLDFMFRHIQPYFTEDINQL

SEQ ID NO: 798560 - protein, 17 aa, Mycobacterium
CVGRLRYLGVVLYDADR

SEQ ID NO: 798561 - protein, 20 aa, Mycobacterium
CVGTARRGPATDGLLGPTAA

SEQ ID NO: 798562 - protein, 18 aa, Mycobacterium
CVGYCNAYIHYLTTPEEY

SEQ ID NO: 798563 - protein, 26 aa, Mycobacterium
CVHASMDLYKWAYKLGPLVASDLVAD

SEQ ID NO: 798564 - protein, 17 aa, Mycobacterium
CVHLQRLLREAPAELVG

SEQ ID NO: 798565 - protein, 40 aa, Mycobacterium
CVIHGFMGSWYLANGRFFSLPWYYRAGYDVLMYTLPFHGK

SEQ ID NO: 798566 - protein, 19 aa, Mycobacterium
CVIVRRGRRNRFTGAAFRA

SEQ ID NO: 798567 - protein, 18 aa, Mycobacterium
CVLACACDRRLIGAEAAI

SEQ ID NO: 798568 - protein, 17 aa, Mycobacterium
CVLFFYDTSKNGARRWH

SEQ ID NO: 798569 - protein, 18 aa, Mycobacterium
CVLPDFRYWARAADGTVE

SEQ ID NO: 798570 - protein, 28 aa, Mycobacterium
CVMAPRQWRGLRRWLGEPDDFQDPKYDV

SEQ ID NO: 798571 - protein, 28 aa, Mycobacterium
CVMAPRQWRGLRRWLGEPQDFQDPRYDV

SEQ ID NO: 798572 - protein, 27 aa, Mycobacterium
CVMTHAAFLSVMPYAVSVLGLGPHSRD

SEQ ID NO: 798573 - protein, 17 aa, Mycobacterium
CVPLLKQLLEAEGVEQS

SEQ ID NO: 798574 - protein, 17 aa, Mycobacterium
CVQLLDTLSGLSGQDNG

SEQ ID NO: 798575 - protein, 18 aa, Mycobacterium
CVQNSSTTWPKLKDLPSL

SEQ ID NO: 798576 - protein, 21 aa, Mycobacterium
CVRELMELTLFGPTPAQADAA

SEQ ID NO: 798577 - protein, 17 aa, Mycobacterium
CVRILRNQASLLPGLNS

SEQ ID NO: 798578 - protein, 20 aa, Mycobacterium
CVRWGTLSPPFYPEAGADPV

SEQ ID NO: 798579 - protein, 19 aa, Mycobacterium
CVSGPLLAGGYWKLPDATA

SEQ ID NO: 798580 - protein, 26 aa, Mycobacterium
CVSGVYPLEALLEVVFHRGSKMHDIV

SEQ ID NO: 798581 - protein, 24 aa, Mycobacterium
CVSPRDLGYPLKAFITVVVDQHKL

SEQ ID NO: 798582 - protein, 23 aa, Mycobacterium
CVSPSTALTMFLGCADRPDRVRA

SEQ ID NO: 798583 - protein, 17 aa, Mycobacterium
CVTLLRDRLIGALHVAA

SEQ ID NO: 798584 - protein, 24 aa, Mycobacterium
CVVDARAWLRDPAPLFHTNVEGLR

SEQ ID NO: 798585 - protein, 25 aa, Mycobacterium
CVVDLPTALLLRRDRLGSATARAHL

SEQ ID NO: 798586 - protein, 19 aa, Mycobacterium
CVVDTRAWLRDPAPLFRTN

SEQ ID NO: 798587 - protein, 23 aa, Mycobacterium
CVVDTRAWLRDPSPLFRTNVEGL

SEQ ID NO: 798588 - protein, 17 aa, Mycobacterium
CVVDTRAWLRDTSPLFR

SEQ ID NO: 798589 - protein, 25 aa, Mycobacterium
CVVPTLEHGPLPRAPQALRIPAKEN

SEQ ID NO: 798590 - protein, 24 aa, Mycobacterium
CVVPTLEHGPLPRAPQALRTPAAE

SEQ ID NO: 798591 - protein, 17 aa, Mycobacterium
CVVVAPSKLQKPAGDRV

SEQ ID NO: 798592 - protein, 17 aa, Mycobacterium
CVYKPVAGEAPLWDFPD

SEQ ID NO: 798593 - protein, 25 aa, Mycobacterium
CWAPNLVIRIAPPVGRHLDWMVCRT

SEQ ID NO: 798594 - protein, 31 aa, Mycobacterium; identical to SEQ ID NO: 124824

SEQ ID NO: 798595 - protein, 18 aa, Mycobacterium
CWLPFDAAVDCYGAFIVE

SEQ ID NO: 798596 - protein, 18 aa, Mycobacterium
CWPLLEHAGVRRIQARIG

SEQ ID NO: 798597 - protein, 18 aa, Mycobacterium
CWPRSLCLAGFDPAAPTA

SEQ ID NO: 798598 - protein, 23 aa, Mycobacterium
CWQKISRDLWPAPELVMDTGNSI

SEQ ID NO: 798599 - protein, 22 aa, Mycobacterium
CWRCRNPLIYRAVSSWFIKVTE

SEQ ID NO: 798600 - protein, 19 aa, Mycobacterium
CWRCRNPLIYRAVSSWFVA

SEQ ID NO: 798601 - protein, 20 aa, Mycobacterium
CWRCRNPLIYRAVSSWFVKV

SEQ ID NO: 798602 - protein, 19 aa, Mycobacterium
CWRCRNPLIYRAVSSWFVR

SEQ ID NO: 798603 - protein, 18 aa, Mycobacterium
CWVFPRGMRRDGGVGAGS

SEQ ID NO: 798604 - protein, 18 aa, Mycobacterium
CWYCSGLVRQFNIGALVV

SEQ ID NO: 798605 - protein, 24 aa, Mycobacterium
CWYSRIFSYARELKYFAASGSPLR

SEQ ID NO: 798606 - protein, 20 aa, Mycobacterium
CYAALLWLRQQQWVDPSRIA

SEQ ID NO: 798607 - protein, 25 aa, Mycobacterium
CYDEVFIGGQWRKPANPQQLEVISP

SEQ ID NO: 798608 - protein, 31 aa, Mycobacterium
CYDYAGHVLFAWHLPELWRRFTITMRRTLRK

SEQ ID NO: 798609 - protein, 39 aa, Mycobacterium
CYDYTGHVLFTWHLPELWRRFTITLRRTLRRELRASGAD

SEQ ID NO: 798610 - protein, 38 aa, Mycobacterium
CYDYTGHVLFTWHLPELWRRFTITLRRTLRRELRASGV

SEQ ID NO: 798611 - protein, 24 aa, Mycobacterium
CYEAWAWLQLGHGDIALVYGVGRG

SEQ ID NO: 798612 - protein, 24 aa, Mycobacterium
CYEFVGRLRLLWRGFDGGQDVRRY

SEQ ID NO: 798613 - protein, 21 aa, Mycobacterium
CYEFVGRLRLLWRGFDGGQQA

SEQ ID NO: 798614 - protein, 21 aa, Mycobacterium
CYEILRDWRSFSSKPMLEGNP

SEQ ID NO: 798615 - protein, 29 aa, Mycobacterium
CYFDALPEALLPVAAPNWNYLHIHNDVIP

SEQ ID NO: 798616 - protein, 18 aa, Mycobacterium
CYGIQRIHPLKNVMILAG

SEQ ID NO: 798617 - protein, 20 aa, Mycobacterium
CYGIQRIHPLRNVLILAGAG

SEQ ID NO: 798618 - protein, 27 aa, Mycobacterium
CYGSSDRIPKWLVPVIRENLKTGAPIR

SEQ ID NO: 798619 - protein, 19 aa, Mycobacterium
CYIPLLEELNYMPSKKFAD

SEQ ID NO: 798620 - protein, 21 aa, Mycobacterium
CYLAMPLFHSNGVAAGWAVAI

SEQ ID NO: 798621 - protein, 23 aa, Mycobacterium
CYLGLAWDVDYPGPLSVLHPEVC

SEQ ID NO: 798622 - protein, 23 aa, Mycobacterium
CYLNDEPIFLGRNGRISVFGSER

SEQ ID NO: 798623 - protein, 25 aa, Mycobacterium
CYLSMPLFHSNAVLAGWSVALNAGA

SEQ ID NO: 798624 - protein, 25 aa, Mycobacterium
CYPDPPPESLPIKGFLSFDDTRADV

SEQ ID NO: 798625 - protein, 21 aa, Mycobacterium
CYPHFRRFLAEVVRVLRPGGY

SEQ ID NO: 798626 - protein, 21 aa, Mycobacterium
CYPHFSRFLAEVVRVLRPGGY

SEQ ID NO: 798627 - protein, 25 aa, Mycobacterium
CYPLLQFREMLQDLGLLRKYKGQLL

SEQ ID NO: 798628 - protein, 18 aa, Mycobacterium
CYPRFPVFLEEVKRVLRP

SEQ ID NO: 798629 - protein, 18 aa, Mycobacterium
CYPTAALLALLPAVAEDL

SEQ ID NO: 798630 - protein, 23 aa, Mycobacterium
CYPTAALLALLPAVAEGLIDPAV

SEQ ID NO: 798631 - protein, 26 aa, Mycobacterium
CYSMSSRYNLLCRPAVVAVADGQARL

SEQ ID NO: 798632 - protein, 28 aa, Mycobacterium
CYTGQRLPAPPPYRRFVAWLAERDRDAA

SEQ ID NO: 798633 - protein, 24 aa, Mycobacterium
CYVHPEIEFFLLKAGADDGTPPIP

SEQ ID NO: 798634 - protein, 26 aa, Mycobacterium
CYVHPEIEFFLLNPGPEDGTEPVPID

SEQ ID NO: 798635 - protein, 19 aa, Mycobacterium
CYVQKQVPFFVDYSRRYTD

SEQ ID NO: 798636 - protein, 25 aa, Mycobacterium
CYVSMPLFHSNAVVAGWAPAVCSGA

SEQ ID NO: 798637 - protein, 24 aa, Mycobacterium
DAAAAQLPRLRGYSAKLVAALGKV

SEQ ID NO: 798638 - protein, 20 aa, Mycobacterium
DAAAAWEGLASDLGTAASSF

SEQ ID NO: 798639 - protein, 24 aa, Mycobacterium
DAAAELRLAPGDRVWFSVKAHEVT

SEQ ID NO: 798640 - protein, 21 aa, Mycobacterium
DAAAFIHHLPVDQSFTLEAGR

SEQ ID NO: 798641 - protein, 23 aa, Mycobacterium
DAAAGANVLAYGSGAQATVDQGT

SEQ ID NO: 798642 - protein, 25 aa, Mycobacterium
DAAAGFILDGFPRTVDQADALAAME

SEQ ID NO: 798643 - protein, 26 aa, Mycobacterium
DAAAIPSLIADAYELALSAPAGPVWV

SEQ ID NO: 798644 - protein, 17 aa, Mycobacterium
DAAAKMLAGKPFKKEAA

SEQ ID NO: 798645 - protein, 18 aa, Mycobacterium
DAAAKWYHDHLGMIVLHE

SEQ ID NO: 798646 - protein, 22 aa, Mycobacterium
DAAALLHRLSVTTPVRHFVLFS

SEQ ID NO: 798647 - protein, 24 aa, Mycobacterium
DAAARLLHTLPGVSVAGLLSPRQT

SEQ ID NO: 798648 - protein, 25 aa, Mycobacterium
DAAARWARRFLDGPRHALAAAKAGI

SEQ ID NO: 798649 - protein, 27 aa, Mycobacterium
DAAASWRRYLDAGVLIRDVGIPGYLRV

SEQ ID NO: 798650 - protein, 26 aa, Mycobacterium
DAAAVGVRWVPLPFGRQAIDEFGTPV

SEQ ID NO: 798651 - protein, 25 aa, Mycobacterium
DAAAVIREYLLLGLRFDRIEEGYVD

SEQ ID NO: 798652 - protein, 29 aa, Mycobacterium
DAAAWCAAGWYYRALGRPAAPRGANASVV

SEQ ID NO: 798653 - protein, 21 aa, Mycobacterium
DAAAWQAPYGRLAELGIFGVA

SEQ ID NO: 798654 - protein, 26 aa, Mycobacterium
DAADGLVLAQLRQALPGAVFVSARTG

SEQ ID NO: 798655 - protein, 18 aa, Mycobacterium
DAADRLWIPVHRDWRLNE

SEQ ID NO: 798656 - protein, 23 aa, Mycobacterium
DAADRMLFLLDQDGPEPDDAERG

SEQ ID NO: 798657 - protein, 26 aa, Mycobacterium
DAADVLYRLAFRKIDMPDPRAELASS

SEQ ID NO: 798658 - protein, 21 aa, Mycobacterium
DAAEWLLPKAMWLKKHDPDAY

SEQ ID NO: 798659 - protein, 17 aa, Mycobacterium
DAAFDLVTSRHPIEVRW

SEQ ID NO: 798660 - protein, 32 aa, Mycobacterium
DAAFHDVLLATVRSVQAALPHLAVNGGAIVTT

SEQ ID NO: 798661 - protein, 26 aa, Mycobacterium
DAAFRQRYWARNHVGWRHMADTLPNA

SEQ ID NO: 798662 - protein, 17 aa, Mycobacterium
DAAFYRGKVATAAFFAK

SEQ ID NO: 798663 - protein, 17 aa, Mycobacterium
DAAGAAARFTELTTRAT

SEQ ID NO: 798664 - protein, 25 aa, Mycobacterium
DAAGAPLLRHRIELGSGALGDDEIA

SEQ ID NO: 798665 - protein, 27 aa, Mycobacterium
DAAGIRALAGLWRSLTRKEVFPTQPVT

SEQ ID NO: 798666 - protein, 25 aa, Mycobacterium
DAAGLHRLVEVLIERGYRVIGPTLR

SEQ ID NO: 798667 - protein, 24 aa, Mycobacterium
DAAGNLWVTLVLANKIVAISPDGR

SEQ ID NO: 798668 - protein, 22 aa, Mycobacterium
DAAGPLNRFYKGIAAGSNVADQ

SEQ ID NO: 798669 - protein, 25 aa, Mycobacterium
DAAGRAWVLRRPPLGHLLASAHDVV

SEQ ID NO: 798670 - protein, 17 aa, Mycobacterium
DAAGRRPLWTYAHVPAG

SEQ ID NO: 798671 - protein, 29 aa, Mycobacterium
DAAGTFVCNHLMYGVLHHIAKNGLPIRAG

SEQ ID NO: 798672 - protein, 30 aa, Mycobacterium
DAAHCPAYFQLLIKSLLQPGLLELAQTAVP

SEQ ID NO: 798673 - protein, 23 aa, Mycobacterium
DAAHFLCELKIDGVALSLVYRDG

SEQ ID NO: 798674 - protein, 19 aa, Mycobacterium
DAAHFNVVLAHTVCLAGAF

SEQ ID NO: 798675 - protein, 18 aa, Mycobacterium
DAAIDWYHDHLGMILVHE

SEQ ID NO: 798676 - protein, 19 aa, Mycobacterium
DAAIIRITPRRIISFGIDD

SEQ ID NO: 798677 - protein, 17 aa, Mycobacterium
DAAILGASLRRGVDLVI

SEQ ID NO: 798678 - protein, 21 aa, Mycobacterium
DAAIPLVFRLLGETGSHAPVL

SEQ ID NO: 798679 - protein, 25 aa, Mycobacterium
DAAKALHALGPKWALVKGGHLRTSA

SEQ ID NO: 798680 - protein, 22 aa, Mycobacterium
DAALACARYALPGRFHGHSIVE

SEQ ID NO: 798681 - protein, 18 aa, Mycobacterium
DAALADRVVDGPGGFSGV

SEQ ID NO: 798682 - protein, 21 aa, Mycobacterium
DAALALLRQVARALEPPLLDA

SEQ ID NO: 798683 - protein, 17 aa, Mycobacterium
DAALALWMQLHDSAFPA

SEQ ID NO: 798684 - protein, 26 aa, Mycobacterium
DAALARDFLTIWFAQLHSQVAEIRKR

SEQ ID NO: 798685 - protein, 29 aa, Mycobacterium
DAALARDFLTIWFAQLYRHVADIKARIGA

SEQ ID NO: 798686 - protein, 18 aa, Mycobacterium
DAALCAAVIGAPAPLAHP

SEQ ID NO: 798687 - protein, 20 aa, Mycobacterium
DAALDRFGPPAGDPAWVVKD

SEQ ID NO: 798688 - protein, 18 aa, Mycobacterium
DAALGVRRDFVKKLLARK

SEQ ID NO: 798689 - protein, 19 aa, Mycobacterium
DAALLTLAAAFEATGMRRT

SEQ ID NO: 798690 - protein, 20 aa, Mycobacterium
DAALPLTYRFEPGAADDGVT

SEQ ID NO: 798691 - protein, 33 aa, Mycobacterium
DAALRRAATFGSGWWPFLTKPEQIAEKLDYIKS

SEQ ID NO: 798692 - protein, 23 aa, Mycobacterium
DAALVCVPPYHIAGVGAALSNLY

SEQ ID NO: 798693 - protein, 18 aa, Mycobacterium
DAALVFYLTKADPLLVLR

SEQ ID NO: 798694 - protein, 18 aa, Mycobacterium
DAALVRWLTAAIEPGTVG

SEQ ID NO: 798695 - protein, 27 aa, Mycobacterium
DAAMKHHFAELLGFRYGRSDQQQAVVE

SEQ ID NO: 798696 - protein, 24 aa, Mycobacterium
DAAMRVRLLLAPEVDVRFGIGWGA

SEQ ID NO: 798697 - protein, 18 aa, Mycobacterium
DAAMRYWQQLHTDPGAEF

SEQ ID NO: 798698 - protein, 21 aa, Mycobacterium
DAAMSAVLSWTACVDARRSGA

SEQ ID NO: 798699 - protein, 25 aa, Mycobacterium
DAANGFILDGFPRSLQQAKALHEML

SEQ ID NO: 798700 - protein, 25 aa, Mycobacterium
DAANGFILDGFPRSTEQAKALHAML

SEQ ID NO: 798701 - protein, 23 aa, Mycobacterium
DAANRYPEFLPERLRSLIAGRVG

SEQ ID NO: 798702 - protein, 23 aa, Mycobacterium
DAAPGPFTGVPFLIKDIGQDYAG

SEQ ID NO: 798703 - protein, 26 aa, Mycobacterium
DAAPGRITAVLGLHDLLGGGHAGQYG

SEQ ID NO: 798704 - protein, 24 aa, Mycobacterium
DAAPSLVRAFRRNLPGTPVVCEAV

SEQ ID NO: 798705 - protein, 24 aa, Mycobacterium
DAAQDWLYLLEAFDQPHRPGLVRA

SEQ ID NO: 798706 - protein, 28 aa, Mycobacterium
DAAQEVPLILMILSYYIKTVEKAMAPEK

SEQ ID NO: 798707 - protein, 27 aa, Mycobacterium
DAAQGAFLPPLLLRAEDPTAAAVHEVE

SEQ ID NO: 798708 - protein, 24 aa, Mycobacterium
DAAQGFILDGFPRSVEQAKALAEM

SEQ ID NO: 798709 - protein, 25 aa, Mycobacterium
DAAQGTRLVPIPGAPPSLAGMDPGC

SEQ ID NO: 798710 - protein, 21 aa, Mycobacterium
DAAQQHRLAVIDPGLYQRVNG

SEQ ID NO: 798711 - protein, 23 aa, Mycobacterium
DAAQRMAAFQRYAEDMITEIDSR

SEQ ID NO: 798712 - protein, 25 aa, Mycobacterium
DAAQRWYALALVATSADLVGDARGA

SEQ ID NO: 798713 - protein, 23 aa, Mycobacterium
DAARAAFRRAWGTDPIDMGMGGS

SEQ ID NO: 798714 - protein, 23 aa, Mycobacterium
DAARFLLEGMPVQVAFHDGAPLY

SEQ ID NO: 798715 - protein, 24 aa, Mycobacterium
DAARFLLEGMPVQVAFHDGAPLYI

SEQ ID NO: 798716 - protein, 32 aa, Mycobacterium
DAARSMNMLAVPWIDPLDVANAALFLASDEAR

SEQ ID NO: 798717 - protein, 34 aa, Mycobacterium
DAASGGFVVPFLNPLLVWDFRLPRVVSINVSGHK

SEQ ID NO: 798718 - protein, 22 aa, Mycobacterium
DAASLSPFVTWGTNPGQGVPLS

SEQ ID NO: 798719 - protein, 25 aa, Mycobacterium
DAASPAVPWIITAKSPEALLAQAAR

SEQ ID NO: 798720 - protein, 23 aa, Mycobacterium
DAASVTVNYRFAPDRSVPAALQH

SEQ ID NO: 798721 - protein, 17 aa, Mycobacterium
DAATRAALLDRFGMFGI

SEQ ID NO: 798722 - protein, 29 aa, Mycobacterium
DAATRARLLDRFGMFGIRISIAVLKAGVT

SEQ ID NO: 798723 - protein, 23 aa, Mycobacterium
DAATRRVVLARLDKPGPLRFFEA

SEQ ID NO: 798724 - protein, 22 aa, Mycobacterium
DAATWRRIFDTNVIGAALVTAA

SEQ ID NO: 798725 - protein, 30 aa, Mycobacterium
DAAVLVVLTEWPEFRKLEWSRLAAGVTRRT

SEQ ID NO: 798726 - protein, 29 aa, Mycobacterium
DAAVPVPRDIPWFPKDQRAWSVRWVILHV

SEQ ID NO: 798727 - protein, 34 aa, Mycobacterium
DAAVRNPWRMALSQLWLAHIDWTPDLAPVTAATP

SEQ ID NO: 798728 - protein, 35 aa, Mycobacterium
DAAVRNPWRMALSQLWTAHIEWSPDLAPVAAAGVD

SEQ ID NO: 798729 - protein, 24 aa, Mycobacterium
DAAVTALSALPTAGVPVLCVRINA

SEQ ID NO: 798730 - protein, 21 aa, Mycobacterium
DAAWRAAFDHEQTCVAIIKHA

SEQ ID NO: 798731 - protein, 18 aa, Mycobacterium
DAAWRAAWDQDKACAAII

SEQ ID NO: 798732 - protein, 18 aa, Mycobacterium
DAAWRQLIGNVGDEFALL

SEQ ID NO: 798733 - protein, 20 aa, Mycobacterium
DAAWSAFIGARWQADTRPNV

SEQ ID NO: 798734 - protein, 25 aa, Mycobacterium
DAAYDRLFAALDWLSERLAGQRYLV

SEQ ID NO: 798735 - protein, 22 aa, Mycobacterium
DAAYLLTSWHPASRPRELTLDD

SEQ ID NO: 798736 - protein, 19 aa, Mycobacterium
DAAYPPRLAQSWDSVGLVC

SEQ ID NO: 798737 - protein, 24 aa, Mycobacterium
DAAYRQAAPPPWSIGRPQPELARL

SEQ ID NO: 798738 - protein, 18 aa, Mycobacterium
DACCYNPLWPDIDELVRL

SEQ ID NO: 798739 - protein, 28 aa, Mycobacterium
DACDRLRDRFLLALLYDAGMRIGEALGL

SEQ ID NO: 798740 - protein, 17 aa, Mycobacterium
DACPVFPGRRYLDWTLD

SEQ ID NO: 798741 - protein, 18 aa, Mycobacterium
DACRGGCMAAKFFTGLPL

SEQ ID NO: 798742 - protein, 24 aa, Mycobacterium
DACVKLLVVPSLTSPALGAIVVRA

SEQ ID NO: 798743 - protein, 29 aa, Mycobacterium
DADAAELGTFFLTGLFALLSTGAHDEALL

SEQ ID NO: 798744 - protein, 20 aa, Mycobacterium
DADAFYDPDPLAPGRMTTKW

SEQ ID NO: 798745 - protein, 17 aa, Mycobacterium
DADAGELGVIFLTGLFA

SEQ ID NO: 798746 - protein, 21 aa, Mycobacterium
DADARFYFVHSYAAQRWEGHP

SEQ ID NO: 798747 - protein, 24 aa, Mycobacterium
DADARVWVLVRRQSLSRFERLASD

SEQ ID NO: 798748 - protein, 26 aa, Mycobacterium
DADASRFRIAFTSQFRHPGIRAATIG

SEQ ID NO: 798749 - protein, 29 aa, Mycobacterium
DADATFWEPFLSRGFSPDSGATWLLPRLA

SEQ ID NO: 798750 - protein, 25 aa, Mycobacterium
DADAWRPVFARLAELGIFGVAIPEE

SEQ ID NO: 798751 - protein, 25 aa, Mycobacterium
DADDPEWLRWNYATVVWGIATAHEL

SEQ ID NO: 798752 - protein, 26 aa, Mycobacterium
DADDPEWLRWNYATVVWGLATAHELY

SEQ ID NO: 798753 - protein, 25 aa, Mycobacterium
DADERLTLIVVYDLDDFDSAIDELD

SEQ ID NO: 798754 - protein, 26 aa, Mycobacterium
DADFDARWFGWVNPADKAVRAAREFG

SEQ ID NO: 798755 - protein, 24 aa, Mycobacterium
DADFEPLYIISPDKKATVADLKDK

SEQ ID NO: 798756 - protein, 22 aa, Mycobacterium
DADFSFLPRFGPGKGLGVIPRE

SEQ ID NO: 798757 - protein, 25 aa, Mycobacterium
DADFSLFGKVAPMLPLDGGAIFARP

SEQ ID NO: 798758 - protein, 25 aa, Mycobacterium
DADFYALEAEKFWPRVWQMACRLEE

SEQ ID NO: 798759 - protein, 23 aa, Mycobacterium
DADGAWIVGGLKDLVILKSTGSE

SEQ ID NO: 798760 - protein, 23 aa, Mycobacterium
DADGKILLQILHAGRYAYHPFSV

SEQ ID NO: 798761 - protein, 29 aa, Mycobacterium
DADGLRALFTTWITLPQPSLDVLVPAVLD

SEQ ID NO: 798762 - protein, 24 aa, Mycobacterium
DADGRVIALLRDDGPRTRSVVVIR

SEQ ID NO: 798763 - protein, 23 aa, Mycobacterium
DADGRVIALLRDEGRRTKSVVVI

SEQ ID NO: 798764 - protein, 22 aa, Mycobacterium
DADIVMLDLTPAATLRLYGDAM

SEQ ID NO: 798765 - protein, 27 aa, Mycobacterium
DADLALAERILLNSKTRRPSVCNAAET

SEQ ID NO: 798766 - protein, 27 aa, Mycobacterium
DADLDHWRWMWETNVIGTLRVTRALLP

SEQ ID NO: 798767 - protein, 28 aa, Mycobacterium
DADLDHWRWMWETNVLGTLRVTRALLPK

SEQ ID NO: 798768 - protein, 26 aa, Mycobacterium
DADLDSTLPMLLFSGLMNSGQACVGQ

SEQ ID NO: 798769 - protein, 32 aa, Mycobacterium
DADLFAELLANFIIFTTSLGPRWFGTAEPDVR

SEQ ID NO: 798770 - protein, 20 aa, Mycobacterium
DADLFTFGKVMSGGLPAAAF

SEQ ID NO: 798771 - protein, 19 aa, Mycobacterium
DADLLLVATGRRSNADLLD

SEQ ID NO: 798772 - protein, 23 aa, Mycobacterium
DADLLRTVESLGFDTAWLGGSPP

SEQ ID NO: 798773 - protein, 18 aa, Mycobacterium
DADLMASVYFKDGVDEHG

SEQ ID NO: 798774 - protein, 20 aa, Mycobacterium
DADLRWQPELYRALVDRVQA

SEQ ID NO: 798775 - protein, 25 aa, Mycobacterium
DADLSRTVGWFTSKYPVALDFDRNT

SEQ ID NO: 798776 - protein, 23 aa, Mycobacterium
DADLSRTVGWFTSKYPVSLAVGE

SEQ ID NO: 798777 - protein, 21 aa, Mycobacterium
DADLVIVSIPQKNVPDLADGI

SEQ ID NO: 798778 - protein, 23 aa, Mycobacterium
DADLVRLTELPPGSPVAVVVRQL

SEQ ID NO: 798779 - protein, 18 aa, Mycobacterium
DADMRRAWAEADAAERDA

SEQ ID NO: 798780 - protein, 27 aa, Mycobacterium
DADMSGWSLIYLGVLSKYGVAMFHGGT

SEQ ID NO: 798781 - protein, 17 aa, Mycobacterium
DADNFWEKAWLTKSINE

SEQ ID NO: 798782 - protein, 22 aa, Mycobacterium
DADNMLLICGDGRKVALDPHLV

SEQ ID NO: 798783 - protein, 25 aa, Mycobacterium
DADNNIPLVYQYRHAFGRRLWELPA

SEQ ID NO: 798784 - protein, 30 aa, Mycobacterium
DADPDLIIGRYIPNLVPRLFNLDRDFIQEI

SEQ ID NO: 798785 - protein, 23 aa, Mycobacterium
DADPLGPYGFSGWVGPEPHGAAM

SEQ ID NO: 798786 - protein, 23 aa, Mycobacterium
DADPLGPYGFSGWVGPEPHGAGN

SEQ ID NO: 798787 - protein, 25 aa, Mycobacterium
DADRLRPLLPDNLAYVIYTSGSTGR

SEQ ID NO: 798788 - protein, 18 aa, Mycobacterium
DADRLRSPAFDVQRERII

SEQ ID NO: 798789 - protein, 24 aa, Mycobacterium
DADRRWLAGLLARSPSRLVYVGHA

SEQ ID NO: 798790 - protein, 25 aa, Mycobacterium
DADRTWLAKLLAQAPSRLLYVGHAS

SEQ ID NO: 798791 - protein, 24 aa, Mycobacterium
DADRYRRLHVIIGDANLAETSTYL

SEQ ID NO: 798792 - protein, 28 aa, Mycobacterium
DADSDVAAWPATLGRLLAVGGPDAIYVP

SEQ ID NO: 798793 - protein, 26 aa, Mycobacterium
DADSEAKWFWFEGNFGAYEENKVERL

SEQ ID NO: 798794 - protein, 18 aa, Mycobacterium
DADSFWNFVLHKGDAVAD

SEQ ID NO: 798795 - protein, 27 aa, Mycobacterium
DADSIYLSPAPLYHTAPSVWSMSAQAG

SEQ ID NO: 798796 - protein, 22 aa, Mycobacterium
DADSLPLLRRAGAALENPVVAD

SEQ ID NO: 798797 - protein, 19 aa, Mycobacterium
DADSPFLELSPLAAWGSAF

SEQ ID NO: 798798 - protein, 26 aa, Mycobacterium
DADTLADLVFAWKVGRAVKSNAIVIA

SEQ ID NO: 798799 - protein, 24 aa, Mycobacterium
DADTLRLHRPVIVKDLPGGGRRLD

SEQ ID NO: 798800 - protein, 30 aa, Mycobacterium
DADTPLDKVVLARALRLTAEAPWDPRTVLR

SEQ ID NO: 798801 - protein, 20 aa, Mycobacterium
DADTRFYFVHSYAAQQWEGS

SEQ ID NO: 798802 - protein, 21 aa, Mycobacterium
DADTRFYFVHSYAAQRWEGSP

SEQ ID NO: 798803 - protein, 22 aa, Mycobacterium
DADTVWLGIALHTTPGVPEFLA

SEQ ID NO: 798804 - protein, 23 aa, Mycobacterium
DADVAAFFVLLAVAGNDTTRQAT

SEQ ID NO: 798805 - protein, 26 aa, Mycobacterium
DADVLIDLIRRYAPKVSLIVTSHQHF

SEQ ID NO: 798806 - protein, 25 aa, Mycobacterium
DADVPIVPVIVWGAQRIWTKGQPRH

SEQ ID NO: 798807 - protein, 19 aa, Mycobacterium
DADWFVWYEHGGLGYFWQA

SEQ ID NO: 798808 - protein, 21 aa, Mycobacterium
DADWLDDGWVALLRKWIDDAE

SEQ ID NO: 798809 - protein, 19 aa, Mycobacterium
DADWQLVEGLPVATAPRVI

SEQ ID NO: 798810 - protein, 24 aa, Mycobacterium
DADYFCAGPCWPTPTKPGRPAPGL

SEQ ID NO: 798811 - protein, 32 aa, Mycobacterium
DADYGGFIWYPRLPALDLWLRLYDGAARANGG

SEQ ID NO: 798812 - protein, 25 aa, Mycobacterium
DADYIRRIILFQRALDVGARLVIAG

SEQ ID NO: 798813 - protein, 24 aa, Mycobacterium
DADYYICGPAPFMDTVEASLLDSG

SEQ ID NO: 798814 - protein, 22 aa, Mycobacterium
DAEALVRLGVTLLTVGCDGPDY

SEQ ID NO: 798815 - protein, 18 aa, Mycobacterium
DAEAWLTDRRREIDAKLW

SEQ ID NO: 798816 - protein, 22 aa, Mycobacterium
DAEFDQLLRRLQALEDEYPELR

SEQ ID NO: 798817 - protein, 19 aa, Mycobacterium
DAEFPKFRQLLPAEHTAVA

SEQ ID NO: 798818 - protein, 20 aa, Mycobacterium
DAEFPKFRQLLPAEHTAVAS

SEQ ID NO: 798819 - protein, 20 aa, Mycobacterium
DAEFPKFRQLLPTEHTAIAT

SEQ ID NO: 798820 - protein, 24 aa, Mycobacterium
DAEFPKFRQLLPTEHTALATIAIS

SEQ ID NO: 798821 - protein, 19 aa, Mycobacterium
DAEFPKFRQLLPVEHTAVA

SEQ ID NO: 798822 - protein, 29 aa, Mycobacterium
DAEFRARLPLIRDLPVVLAYAASATERLI

SEQ ID NO: 798823 - protein, 24 aa, Mycobacterium
DAEGELLCFVVLAPSASLADVEAA

SEQ ID NO: 798824 - protein, 21 aa, Mycobacterium
DAEGKLRDLSWAPAADAEVIP

SEQ ID NO: 798825 - protein, 37 aa, Mycobacterium
DAEGPAIIRYLPMEELIAAFLPVLFPGMEIVQHHAFR

SEQ ID NO: 798826 - protein, 20 aa, Mycobacterium
DAEIAAHIRGWGPLSVAKHE

SEQ ID NO: 798827 - protein, 26 aa, Mycobacterium
DAEIARVVPFIEWVRGAHPDLLISVD

SEQ ID NO: 798828 - protein, 24 aa, Mycobacterium
DAEILFDGIPLDKISTSFTINGTA

SEQ ID NO: 798829 - protein, 38 aa, Mycobacterium
DAEIVISQPFWPAYLTKERIAKAPKLKLALTAGIGSDH

SEQ ID NO: 798830 - protein, 24 aa, Mycobacterium
DAEKAKLWRKLPKMGLEETHEYAK

SEQ ID NO: 798831 - protein, 33 aa, Mycobacterium
DAELAALQLWGSLQWMWVWFDPADSRTPEEVGA

SEQ ID NO: 798832 - protein, 24 aa, Mycobacterium
DAELANRIIKLNTLAHLRSQLALR

SEQ ID NO: 798833 - protein, 22 aa, Mycobacterium
DAELFIVAAQFNGKPALFIVEA

SEQ ID NO: 798834 - protein, 23 aa, Mycobacterium
DAELFWVARPMVDFIVEAASSLP

SEQ ID NO: 798835 - protein, 23 aa, Mycobacterium
DAELIPHTFVVDCAAIGCTCGES

SEQ ID NO: 798836 - protein, 21 aa, Mycobacterium
DAELLAPRRAITGEQLAPQLP

SEQ ID NO: 798837 - protein, 23 aa, Mycobacterium
DAELQGLLELRPPALLVGREHPD

SEQ ID NO: 798838 - protein, 17 aa, Mycobacterium
DAELRLTYVIVVEGNLL

SEQ ID NO: 798839 - protein, 22 aa, Mycobacterium
DAELRSPIWLVTRDGQRVTDTD

SEQ ID NO: 798840 - protein, 27 aa, Mycobacterium
DAELTLAYILGVLLIGAPGWQLLTECV

SEQ ID NO: 798841 - protein, 27 aa, Mycobacterium
DAELTLAYILGVLLIGSAGWQLLAECV

SEQ ID NO: 798842 - protein, 23 aa, Mycobacterium
DAELVRRLVGAAAEQAWHLSEEL

SEQ ID NO: 798843 - protein, 23 aa, Mycobacterium
DAELYGDLLSILAALAAGDGADH

SEQ ID NO: 798844 - protein, 24 aa, Mycobacterium
DAEMLILGSFPNGRRARVLIGSTA

SEQ ID NO: 798845 - protein, 26 aa, Mycobacterium
DAENRTPLFPFGFGLSYTTFSYSELS

SEQ ID NO: 798846 - protein, 26 aa, Mycobacterium
DAEPPPRLPAPHHRPHWGEDGVLPAS

SEQ ID NO: 798847 - protein, 24 aa, Mycobacterium
DAEPVFPLVQAMPIPYVEPEDISE

SEQ ID NO: 798848 - protein, 17 aa, Mycobacterium
DAEQLLKGVWEFLVRRE

SEQ ID NO: 798849 - protein, 23 aa, Mycobacterium
DAERDWEDFWAATRPIELTATVE

SEQ ID NO: 798850 - protein, 20 aa, Mycobacterium
DAERFAVFAGLLGGADYPQA

SEQ ID NO: 798851 - protein, 24 aa, Mycobacterium
DAERGNWPPGFPEGKRPTYSLKEI

SEQ ID NO: 798852 - protein, 18 aa, Mycobacterium
DAERLRSPAFDVQRERII

SEQ ID NO: 798853 - protein, 18 aa, Mycobacterium
DAERMAARLARYRRIGLP

SEQ ID NO: 798854 - protein, 29 aa, Mycobacterium
DAESVLWLEQHLASYPGAILAVTHDRYFL

SEQ ID NO: 798855 - protein, 27 aa, Mycobacterium
DAETRDLFLTLLTVSGVGPRLAMATLA

SEQ ID NO: 798856 - protein, 24 aa, Mycobacterium
DAETVVLHPADVPFFVELCKTLGK

SEQ ID NO: 798857 - protein, 23 aa, Mycobacterium
DAEVAAFFVLLAVAGNDTTRQTT

SEQ ID NO: 798858 - protein, 23 aa, Mycobacterium
DAEVAAFFVLLSVAGNDTTRQTI

SEQ ID NO: 798859 - protein, 25 aa, Mycobacterium
DAEVARDWNIRRYGFHGTSHQYVSE

SEQ ID NO: 798860 - protein, 20 aa, Mycobacterium
DAEVLISGRLLNMISADEPD

SEQ ID NO: 798861 - protein, 27 aa, Mycobacterium
DAEVRKLFEVNYFGAVNMIKAVLPGMR

SEQ ID NO: 798862 - protein, 18 aa, Mycobacterium
DAEWRFVGVPDLSSLQRD

SEQ ID NO: 798863 - protein, 19 aa, Mycobacterium
DAEWRGIAVLMVGGGLVSR

SEQ ID NO: 798864 - protein, 18 aa, Mycobacterium
DAEWYFNTVNVGDPVIVK

SEQ ID NO: 798865 - protein, 24 aa, Mycobacterium
DAEWYWPERRLTYNNAALAEAMIA

SEQ ID NO: 798866 - protein, 24 aa, Mycobacterium
DAEYLTPFEAGVGTLPPFYKTHAD

SEQ ID NO: 798867 - protein, 24 aa, Mycobacterium
DAEYPLLGPWGSARVFSPQKGADA

SEQ ID NO: 798868 - protein, 27 aa, Mycobacterium
DAFAADPLLHKLIGLLARVAAALDEVA

SEQ ID NO: 798869 - protein, 17 aa, Mycobacterium
DAFDRQRLVAEPAKSAG

SEQ ID NO: 798870 - protein, 18 aa, Mycobacterium
DAFDTLLVPGGVPADFSF

SEQ ID NO: 798871 - protein, 27 aa, Mycobacterium
DAFDYVRELLSYLPPNNFTDPPRYPAA

SEQ ID NO: 798872 - protein, 22 aa, Mycobacterium
DAFEFALVRAALRRAMPVLGIC

SEQ ID NO: 798873 - protein, 21 aa, Mycobacterium
DAFEHFPPPILKPVILAAKSK

SEQ ID NO: 798874 - protein, 30 aa, Mycobacterium
DAFENFPPPILKPVILAAKSKPLFRAAIQT

SEQ ID NO: 798875 - protein, 19 aa, Mycobacterium
DAFFASVEQLTRPTLRGRP

SEQ ID NO: 798876 - protein, 22 aa, Mycobacterium
DAFGGLDVFFANAGIAYPTPLL

SEQ ID NO: 798877 - protein, 19 aa, Mycobacterium
DAFGGNHHLLRDSVGRGEH

SEQ ID NO: 798878 - protein, 28 aa, Mycobacterium
DAFIHNPAGFHQPRPPWLMSACAPARVG

SEQ ID NO: 798879 - protein, 17 aa, Mycobacterium
DAFITYLALIHAVESAA

SEQ ID NO: 798880 - protein, 18 aa, Mycobacterium
DAFKAMLGELLRAAQRAG

SEQ ID NO: 798881 - protein, 28 aa, Mycobacterium
DAFKKERWPAFWDWAYETLPNDSRMLMH

SEQ ID NO: 798882 - protein, 17 aa, Mycobacterium
DAFLRDVYSEQAILADG

SEQ ID NO: 798883 - protein, 18 aa, Mycobacterium
DAFLTLLENRGVDVLIYN

SEQ ID NO: 798884 - protein, 23 aa, Mycobacterium
DAFMAGLLDTLWEQGLLGADRRT

SEQ ID NO: 798885 - protein, 22 aa, Mycobacterium
DAFMAVCRKWEVLATVIGEVTD

SEQ ID NO: 798886 - protein, 25 aa, Mycobacterium
DAFNAMPMRRAVHAVFECCYSVPLA

SEQ ID NO: 798887 - protein, 23 aa, Mycobacterium
DAFNLARRLATEEGLLVGISSGA

SEQ ID NO: 798888 - protein, 22 aa, Mycobacterium
DAFRGFLHDYLLTAVASALGGG

SEQ ID NO: 798889 - protein, 20 aa, Mycobacterium
DAFRRIEFQLDPPTGDIGLL

SEQ ID NO: 798890 - protein, 25 aa, Mycobacterium
DAFSRTLPIALPVICSRWYGVIPPI

SEQ ID NO: 798891 - protein, 31 aa, Mycobacterium
DAFTAAFMVATAWEWELADRLRLASACATCS

SEQ ID NO: 798892 - protein, 17 aa, Mycobacterium
DAFTIERLRAGGAVLIG

SEQ ID NO: 798893 - protein, 30 aa, Mycobacterium
DAFTISKIRIKVVLHQWPGINITVYDGDIG

SEQ ID NO: 798894 - protein, 17 aa, Mycobacterium
DAFTRACAIEWGPDGVR

SEQ ID NO: 798895 - protein, 17 aa, Mycobacterium
DAFVLQSHPAPLNTWLM

SEQ ID NO: 798896 - protein, 17 aa, Mycobacterium
DAFVSFGLPVRGVARSA

SEQ ID NO: 798897 - protein, 22 aa, Mycobacterium
DAFYITIGGIPPRQGHTPLGHE

SEQ ID NO: 798898 - protein, 17 aa, Mycobacterium
DAGAACAIVRRAPRTRF

SEQ ID NO: 798899 - protein, 23 aa, Mycobacterium
DAGAALLLERAPAGSAGIALAGF

SEQ ID NO: 798900 - protein, 23 aa, Mycobacterium
DAGAALLLERVPAGGSGITLAGF

SEQ ID NO: 798901 - protein, 29 aa, Mycobacterium
DAGAHLRNMAFYNFPLRLLKRTRDADRAG

SEQ ID NO: 798902 - protein, 33 aa, Mycobacterium
DAGAHLRNMAFYNFPLRLLKRTWDAERAGKPFL

SEQ ID NO: 798903 - protein, 30 aa, Mycobacterium
DAGAHLRNMAFYNYPLRLLKRVRDAQLSGR

SEQ ID NO: 798904 - protein, 22 aa, Mycobacterium
DAGAIIGYLNLSPAREGETAMA

SEQ ID NO: 798905 - protein, 23 aa, Mycobacterium
DAGAKILLQILHAGRYAYHPFSV

SEQ ID NO: 798906 - protein, 29 aa, Mycobacterium
DAGAMAYLVKPFSITDLIPAIEVAVSRFS

SEQ ID NO: 798907 - protein, 28 aa, Mycobacterium
DAGAMAYLVKPFTASDLIPAIELAVSRF

SEQ ID NO: 798908 - protein, 24 aa, Mycobacterium
DAGAMLRILFSRLGKPHVGSPQAF

SEQ ID NO: 798909 - protein, 38 aa, Mycobacterium
DAGANGFAGFGGLGGEGGWVGNITLGPIGVDGVGLIGH

SEQ ID NO: 798910 - protein, 30 aa, Mycobacterium
DAGAPALRMQLLWYPATTWDTSLPSFAENA

SEQ ID NO: 798911 - protein, 17 aa, Mycobacterium
DAGAQMLLLNPVGIDAS

SEQ ID NO: 798912 - protein, 25 aa, Mycobacterium
DAGARLHATWTWALSALSHNQVDRI

SEQ ID NO: 798913 - protein, 32 aa, Mycobacterium
DAGARWILDLGPGDLLTRLTAPVIRGLGIGIV

SEQ ID NO: 798914 - protein, 25 aa, Mycobacterium
DAGATALLYHSAFAPRLAEVLADLP

SEQ ID NO: 798915 - protein, 30 aa, Mycobacterium
DAGATRRATLNRLLFPGPTKEFEAHREQYG

SEQ ID NO: 798916 - protein, 18 aa, Mycobacterium
DAGCYGVGFMRAALREAT

SEQ ID NO: 798917 - protein, 26 aa, Mycobacterium
DAGDAAEWFAGRLPEKWFDGDPTVIV

SEQ ID NO: 798918 - protein, 26 aa, Mycobacterium
DAGDWVFTKWRYSAFHRSALLERMHA

SEQ ID NO: 798919 - protein, 27 aa, Mycobacterium
DAGELGVIFLTGLFALLATGATTPDAR

SEQ ID NO: 798920 - protein, 31 aa, Mycobacterium
DAGEPWAVSKLYYIHGFLRARMQLLHDEAVK

SEQ ID NO: 798921 - protein, 30 aa, Mycobacterium
DAGEPWTVSKLYYIHGFLRERMRILQEEFI

SEQ ID NO: 798922 - protein, 26 aa, Mycobacterium
DAGFDKSRPTAWIAEGLFGYLPSEAQ

SEQ ID NO: 798923 - protein, 20 aa, Mycobacterium
DAGFDPSVPTAWIAEGLLGY

SEQ ID NO: 798924 - protein, 19 aa, Mycobacterium
DAGFERWVKALASLKTDVP

SEQ ID NO: 798925 - protein, 18 aa, Mycobacterium
DAGFPRPKRLEEFSFDAN

SEQ ID NO: 798926 - protein, 19 aa, Mycobacterium
DAGGLPPTARPLVMLLHGF

SEQ ID NO: 798927 - protein, 21 aa, Mycobacterium
DAGGRALLVPPFGQGEHQVHA

SEQ ID NO: 798928 - protein, 25 aa, Mycobacterium
DAGHPVLLESFLDGPEVSLFCVVDG

SEQ ID NO: 798929 - protein, 21 aa, Mycobacterium
DAGHTTFLELAPNPVALMQVG

SEQ ID NO: 798930 - protein, 22 aa, Mycobacterium
DAGIAISIMGTGLAAAALAANG

SEQ ID NO: 798931 - protein, 24 aa, Mycobacterium
DAGIALSILGTGLAAAALAGNGTP

SEQ ID NO: 798932 - protein, 22 aa, Mycobacterium
DAGIKPIIGIEAYIAPASRFDT

SEQ ID NO: 798933 - protein, 35 aa, Mycobacterium
DAGITYIHDTVWPGLTELDGYVGLSLLVDRQTGRC

SEQ ID NO: 798934 - protein, 18 aa, Mycobacterium
DAGLFAVALPFVNLIDYR

SEQ ID NO: 798935 - protein, 30 aa, Mycobacterium
DAGLIAPGPWFQWHFDRWTVPPGATEIART

SEQ ID NO: 798936 - protein, 17 aa, Mycobacterium
DAGLLGKGGYGGNGGAG

SEQ ID NO: 798937 - protein, 25 aa, Mycobacterium
DAGLLLAHHPLLLRGVDTVAASTPK

SEQ ID NO: 798938 - protein, 19 aa, Mycobacterium
DAGLNPKILPGGTGLTCDF

SEQ ID NO: 798939 - protein, 30 aa, Mycobacterium
DAGLPGPLVWSWYGSWTLKGWENRYAIMSD

SEQ ID NO: 798940 - protein, 28 aa, Mycobacterium
DAGLPKPGVWPLCHSLAFDVSVWEIWGA

SEQ ID NO: 798941 - protein, 19 aa, Mycobacterium
DAGLRRYLGAAPPAGHGPH

SEQ ID NO: 798942 - protein, 23 aa, Mycobacterium
DAGLSVIAWPKKYGGRDATLLQW

SEQ ID NO: 798943 - protein, 25 aa, Mycobacterium
DAGLSVITWPKKYGGRDAPLLHWVV

SEQ ID NO: 798944 - protein, 22 aa, Mycobacterium
DAGLVLYPGTYLDPDVLAHCSP

SEQ ID NO: 798945 - protein, 26 aa, Mycobacterium
DAGMERILFTHIAVPVMTRLKQPERQ

SEQ ID NO: 798946 - protein, 20 aa, Mycobacterium
DAGMPLISDPGYRLVAACAE

SEQ ID NO: 798947 - protein, 39 aa, Mycobacterium
DAGPALTRALSFLPTFPFPKETLTNWMRGDYANLTLVVD

SEQ ID NO: 798948 - protein, 25 aa, Mycobacterium
DAGPAMLYRLHLDLASLSIAEFYPD

SEQ ID NO: 798949 - protein, 23 aa, Mycobacterium
DAGPAVYWMVRHYWKHPEDRGEL

SEQ ID NO: 798950 - protein, 26 aa, Mycobacterium
DAGPGILYRLHLDLASLSIAEFYSDG

SEQ ID NO: 798951 - protein, 17 aa, Mycobacterium
DAGPLLARLHKLVRADC

SEQ ID NO: 798952 - protein, 19 aa, Mycobacterium
DAGPLPKHTRWLPGSYRYR

SEQ ID NO: 798953 - protein, 23 aa, Mycobacterium
DAGQIYFVGIWYVDEFVRTEQGW

SEQ ID NO: 798954 - protein, 28 aa, Mycobacterium
DAGQLLAQLQWRPELLAPEVMLSAQMLA

SEQ ID NO: 798955 - protein, 37 aa, Mycobacterium
DAGQSLLNIVNSPAQALLGRPLFGNGINGAPGTGQDG

SEQ ID NO: 798956 - protein, 23 aa, Mycobacterium
DAGRINHAYLFSGPRGCGKTSSA

SEQ ID NO: 798957 - protein, 28 aa, Mycobacterium
DAGRLGLIPLRWALACLLIDTESVTLPV

SEQ ID NO: 798958 - protein, 27 aa, Mycobacterium
DAGRLLRGMLAARLAFLVTGGTGAGKT

SEQ ID NO: 798959 - protein, 25 aa, Mycobacterium
DAGRQWVTSQWRWDTLAARLAELLR

SEQ ID NO: 798960 - protein, 23 aa, Mycobacterium
DAGSPGWLTPIAELLTAADAELA

SEQ ID NO: 798961 - protein, 30 aa, Mycobacterium
DAGSVANWWARHLRLRPGMAASLAGNLATM

SEQ ID NO: 798962 - protein, 17 aa, Mycobacterium
DAGTAIIIHEKADNFAN

SEQ ID NO: 798963 - protein, 20 aa, Mycobacterium
DAGTFYGDGGVGGAGGAGGN

SEQ ID NO: 798964 - protein, 25 aa, Mycobacterium
DAGTPTFESVRDKIEARYATAQGSA

SEQ ID NO: 798965 - protein, 25 aa, Mycobacterium
DAGTPTFESVREKIESRYATALGAA

SEQ ID NO: 798966 - protein, 22 aa, Mycobacterium
DAGTRFYFVHSYAVQKWELETP

SEQ ID NO: 798967 - protein, 43 aa, Mycobacterium
DAGVLFAGDLLFIGCTPIVWNGPIANWIAACDAMIALDAPIVV

SEQ ID NO: 798968 - protein, 43 aa, Mycobacterium
DAGVLFGGDLLFIGCTPIVWAGPIANWIAACDTMIALDAPTVV

SEQ ID NO: 798969 - protein, 41 aa, Mycobacterium
DAGVLFGGDLLFIGCTPIVWAGPIANWVAACDAMIALDAPT

SEQ ID NO: 798970 - protein, 17 aa, Mycobacterium
DAGVLIRDVGIPGYLRA

SEQ ID NO: 798971 - protein, 24 aa, Mycobacterium
DAGVLRLRIPVAEKAKPRKIAVDR

SEQ ID NO: 798972 - protein, 21 aa, Mycobacterium
DAGWAAVSWPREYGGRGASVL

SEQ ID NO: 798973 - protein, 17 aa, Mycobacterium
DAHAALIRRANARLVVF

SEQ ID NO: 798974 - protein, 28 aa, Mycobacterium
DAHAPGQLDFFGYGAQRALDAGVPVDRI

SEQ ID NO: 798975 - protein, 25 aa, Mycobacterium
DAHAPGQLDFLGYGAQRALDAGVPA

SEQ ID NO: 798976 - protein, 21 aa, Mycobacterium
DAHAQAYQALSAQAALFHQQF

SEQ ID NO: 798977 - protein, 21 aa, Mycobacterium
DAHDPIDWSEALSLPMCLLHK

SEQ ID NO: 798978 - protein, 36 aa, Mycobacterium
DAHDRGQLYVLPQFDARFMWQAKRLAPDTYTKALGI

SEQ ID NO: 798979 - protein, 25 aa, Mycobacterium
DAHDRGRFYVVPQLDAKLVWHLKRH

SEQ ID NO: 798980 - protein, 21 aa, Mycobacterium
DAHERLCAFQRRGLREVHDVD

SEQ ID NO: 798981 - protein, 25 aa, Mycobacterium
DAHGDIVRRGAFTKSLAAGQPIPLL

SEQ ID NO: 798982 - protein, 17 aa, Mycobacterium
DAHGTLYLATRGGYFVV

SEQ ID NO: 798983 - protein, 24 aa, Mycobacterium
DAHHYLYVYDGHTGQSLYLGRAKR

SEQ ID NO: 798984 - protein, 22 aa, Mycobacterium
DAHIYYRRALGLTAALGRSGGA

SEQ ID NO: 798985 - protein, 28 aa, Mycobacterium
DAHLYLRRAYGIAHFLGGSRRWVRRVAA

SEQ ID NO: 798986 - protein, 27 aa, Mycobacterium
DAHPATWRLFLFPPQGAPPELYARLAQ

SEQ ID NO: 798987 - protein, 20 aa, Mycobacterium
DAHPLGARPFAREQYRNKFV

SEQ ID NO: 798988 - protein, 31 aa, Mycobacterium
DAHQVTVLHFMPGWLEMLVEVGRGRLSSVRV

SEQ ID NO: 798989 - protein, 24 aa, Mycobacterium
DAHRGASLIVWAIAEGRSAAHAVD

SEQ ID NO: 798990 - protein, 24 aa, Mycobacterium
DAHRGASLVVWAIAEGRSAAHAVD

SEQ ID NO: 798991 - protein, 25 aa, Mycobacterium
DAHTIALGLRLNWVRPETRRTLEVG

SEQ ID NO: 798992 - protein, 29 aa, Mycobacterium
DAIAAAIGLLDLLLASGGDLVTVLLGAGV

SEQ ID NO: 798993 - protein, 20 aa, Mycobacterium
DAIAALPRIRRAHPGTTLTI

SEQ ID NO: 798994 - protein, 27 aa, Mycobacterium
DAIAASYAPLFRKLLKGTRLRIDVAQL

SEQ ID NO: 798995 - protein, 27 aa, Mycobacterium
DAIAGFFKELPGKALDWGKNLVHGLIQ

SEQ ID NO: 798996 - protein, 28 aa, Mycobacterium
DAIALQLGWRLFGPFLRAATGLDDNHPP

SEQ ID NO: 798997 - protein, 29 aa, Mycobacterium
DAICVLGKGVWLYLRPDNPMGFRIGITKE

SEQ ID NO: 798998 - protein, 24 aa, Mycobacterium
DAIDGRPRGHLRKFGLSRVRVREL

SEQ ID NO: 798999 - protein, 17 aa, Mycobacterium
DAIDGWRRVVVTATQLG

SEQ ID NO: 799000 - protein, 25 aa, Mycobacterium
DAIDPWIVQLTQIINFTNAVLHILG

SEQ ID NO: 799001 - protein, 19 aa, Mycobacterium
DAIDSVGGIGGKGGGGADG

SEQ ID NO: 799002 - protein, 29 aa, Mycobacterium
DAIELTVFGALRLIQGFTPALEESKGAVV

SEQ ID NO: 799003 - protein, 27 aa, Mycobacterium
DAIELTVFGALRMVQAFTPALAEANGA

SEQ ID NO: 799004 - protein, 30 aa, Mycobacterium
DAIGDRFNSWLCRLSLGYAQLWQGDLTGAT

SEQ ID NO: 799005 - protein, 27 aa, Mycobacterium
DAIGFAFPHYFILPTYSSASSYRIRPL

SEQ ID NO: 799006 - protein, 28 aa, Mycobacterium
DAIGFGFPHYFLLPQYSSASSYRIRPLG

SEQ ID NO: 799007 - protein, 31 aa, Mycobacterium
DAIGLPSRPSAWRKNMMACTGIEFCKLSFAE

SEQ ID NO: 799008 - protein, 17 aa, Mycobacterium
DAIIAQWAAQRLPTDII

SEQ ID NO: 799009 - protein, 20 aa, Mycobacterium
DAIILGPLRLQFWVCGRFDI

SEQ ID NO: 799010 - protein, 21 aa, Mycobacterium
DAIKHFFVHYKDLEPGKFVKT

SEQ ID NO: 799011 - protein, 30 aa, Mycobacterium
DAILAWIAEGAPPIYFGFGSTPLTSPAEQF

SEQ ID NO: 799012 - protein, 20 aa, Mycobacterium
DAILLRMPGFGLDGPWRDNP

SEQ ID NO: 799013 - protein, 26 aa, Mycobacterium
DAILNGPVTYLPPPGPGGYVISEVRS

SEQ ID NO: 799014 - protein, 34 aa, Mycobacterium
DAILPKEFILVGKQLLYVERYTKLLAPDWQPVGD

SEQ ID NO: 799015 - protein, 25 aa, Mycobacterium
DAILRAGVPMLLIRGQMSDLVSQDR

SEQ ID NO: 799016 - protein, 24 aa, Mycobacterium
DAILTCRLIDRPLRPSFVNGLRNE

SEQ ID NO: 799017 - protein, 17 aa, Mycobacterium
DAILVRRPEHFDGIHWV

SEQ ID NO: 799018 - protein, 20 aa, Mycobacterium
DAIMDLRDALLGASPEFLDP

SEQ ID NO: 799019 - protein, 20 aa, Mycobacterium
DAIMVILALAMQEAGELAAN

SEQ ID NO: 799020 - protein, 19 aa, Mycobacterium
DAIMVVLALAMQEAGELAS

SEQ ID NO: 799021 - protein, 21 aa, Mycobacterium
DAIRADIPYWTQPAPEQPHAP

SEQ ID NO: 799022 - protein, 28 aa, Mycobacterium
DAIRPAAIKYQLPIRQWVFRSDSERKTH

SEQ ID NO: 799023 - protein, 20 aa, Mycobacterium
DAIRRLGFGLLNKVVLRFDE

SEQ ID NO: 799024 - protein, 25 aa, Mycobacterium
DAIRRLLDRVASIDGIINTVKGIFT

SEQ ID NO: 799025 - protein, 28 aa, Mycobacterium
DAIRTFNKAFAPYGLPRTAFKPSYGIAE

SEQ ID NO: 799026 - protein, 23 aa, Mycobacterium
DAIRYLHAHVRLLWMCPERLTAE

SEQ ID NO: 799027 - protein, 20 aa, Mycobacterium
DAISAFWDKAIAPTTRIEFV

SEQ ID NO: 799028 - protein, 20 aa, Mycobacterium
DAITELFLQALRAPGEQGPL

SEQ ID NO: 799029 - protein, 23 aa, Mycobacterium
DAITPTFAALLPEAFPNAELVDA

SEQ ID NO: 799030 - protein, 24 aa, Mycobacterium
DAITPTFAALLPEAFPNAELVDAE

SEQ ID NO: 799031 - protein, 19 aa, Mycobacterium
DAIWDVVIERMGWLEAETS

SEQ ID NO: 799032 - protein, 18 aa, Mycobacterium
DAIYLHPCGSAEFRPILG

SEQ ID NO: 799033 - protein, 21 aa, Mycobacterium
DAIYLYSLWVDPSARNCGLGH

SEQ ID NO: 799034 - protein, 37 aa, Mycobacterium
DAKAFARLGIRCFGFAPLKLPPELDFASLFHGVDERV

SEQ ID NO: 799035 - protein, 37 aa, Mycobacterium
DAKAFARLGIRCFGFSPLRLPPDLDFTSLFHGVDERV

SEQ ID NO: 799036 - protein, 23 aa, Mycobacterium
DAKAYVALHALLDEPASDAALTE

SEQ ID NO: 799037 - protein, 24 aa, Mycobacterium
DAKESRGVLALRARGALVNIGHDG

SEQ ID NO: 799038 - protein, 24 aa, Mycobacterium
DAKGALRVLELHPLLNPAAYVYAD

SEQ ID NO: 799039 - protein, 23 aa, Mycobacterium
DAKGNTIAWLYSQRRFEVPSEQI

SEQ ID NO: 799040 - protein, 36 aa, Mycobacterium
DAKHFARLGIRCFGFAPLRLPPDLDFAALFHGVDER

SEQ ID NO: 799041 - protein, 19 aa, Mycobacterium
DAKHLLQSWIPLVALSAHD

SEQ ID NO: 799042 - protein, 22 aa, Mycobacterium
DAKITVPALFIGGTADPVLAFT

SEQ ID NO: 799043 - protein, 23 aa, Mycobacterium
DAKLGDWLEVSRALLTRVGDHAR

SEQ ID NO: 799044 - protein, 21 aa, Mycobacterium
DAKLRKQLQLELRALQREVGI

SEQ ID NO: 799045 - protein, 23 aa, Mycobacterium
DAKRFDMLVLRRQLAQLEGDAVA

SEQ ID NO: 799046 - protein, 23 aa, Mycobacterium
DAKRLVDFAAGLAFALRGSFDKV

SEQ ID NO: 799047 - protein, 24 aa, Mycobacterium
DAKRLVDFAAGLAFALRGSFDKVA

SEQ ID NO: 799048 - protein, 22 aa, Mycobacterium
DAKRLYIGGHGAFGALRTLIFK

SEQ ID NO: 799049 - protein, 17 aa, Mycobacterium
DAKTYRFNPFDLTKVWP

SEQ ID NO: 799050 - protein, 25 aa, Mycobacterium
DAKTYRYNPFDLTKVWPHGDYPLHE

SEQ ID NO: 799051 - protein, 18 aa, Mycobacterium
DAKVWSRLGSELGVLGMA

SEQ ID NO: 799052 - protein, 19 aa, Mycobacterium
DALALRDWAHTGVSDLITH

SEQ ID NO: 799053 - protein, 17 aa, Mycobacterium
DALAPVLRGLAPAAEFV

SEQ ID NO: 799054 - protein, 21 aa, Mycobacterium
DALAPYVDWSLDAVLRGGVAE

SEQ ID NO: 799055 - protein, 24 aa, Mycobacterium
DALAQHPILIERPFVVTAKGTRLA

SEQ ID NO: 799056 - protein, 27 aa, Mycobacterium
DALARDFLTIWFAQLYQHVADARQRTG

SEQ ID NO: 799057 - protein, 19 aa, Mycobacterium
DALARFVDAIPSHILVALD

SEQ ID NO: 799058 - protein, 19 aa, Mycobacterium
DALARRLAGLIDQVEATVA

SEQ ID NO: 799059 - protein, 19 aa, Mycobacterium
DALARRWAQYLQSQRPSSA

SEQ ID NO: 799060 - protein, 18 aa, Mycobacterium
DALASGCRLGVIGAGFVG

SEQ ID NO: 799061 - protein, 19 aa, Mycobacterium
DALATLRNAPLRNIPPMVV

SEQ ID NO: 799062 - protein, 17 aa, Mycobacterium
DALDALGAPKSLQLWVM

SEQ ID NO: 799063 - protein, 30 aa, Mycobacterium
DALDEPALPGQWPFIRGGDALRDVKSGWKV

SEQ ID NO: 799064 - protein, 22 aa, Mycobacterium
DALDEQLIAARATFTRAKDDEV

SEQ ID NO: 799065 - protein, 41 aa, Mycobacterium
DALDPLLRMKMFRRVCGGLEPMWLWLNHDGTPRPKHAWYKT

SEQ ID NO: 799066 - protein, 25 aa, Mycobacterium
DALDRALIDLAGYFRDALLVSANAA

SEQ ID NO: 799067 - protein, 18 aa, Mycobacterium
DALDRLMRALVGEGVFRR

SEQ ID NO: 799068 - protein, 20 aa, Mycobacterium
DALDVLEHLLPSGSLTAARV

SEQ ID NO: 799069 - protein, 27 aa, Mycobacterium
DALDYVRDLLSYLPPNNYAEPPRYPAP

SEQ ID NO: 799070 - protein, 18 aa, Mycobacterium
DALEGPLAFVEKRKPVWK

SEQ ID NO: 799071 - protein, 23 aa, Mycobacterium
DALELARRMATEEGLLVGISSGA

SEQ ID NO: 799072 - protein, 17 aa, Mycobacterium
DALELDILVNSLSPRSK

SEQ ID NO: 799073 - protein, 22 aa, Mycobacterium
DALELLPLPVVAEEIMFSTLGT

SEQ ID NO: 799074 - protein, 21 aa, Mycobacterium
DALEMLYSGALVRAGMGYAPY

SEQ ID NO: 799075 - protein, 17 aa, Mycobacterium
DALERALSRWPADGIPA

SEQ ID NO: 799076 - protein, 21 aa, Mycobacterium
DALFNEVFLDNVLVPDEMVVG

SEQ ID NO: 799077 - protein, 18 aa, Mycobacterium
DALFTGLIAIHGLRSTDA

SEQ ID NO: 799078 - protein, 30 aa, Mycobacterium
DALGFGRPLDYQPWIGFPGAIAGEWQGQIR

SEQ ID NO: 799079 - protein, 19 aa, Mycobacterium
DALGIGYEIVPGVPAFAAA

SEQ ID NO: 799080 - protein, 20 aa, Mycobacterium
DALGIGYEIVPGVPAFAAAA

SEQ ID NO: 799081 - protein, 21 aa, Mycobacterium
DALGLGAVRPVTVADAGMLGR

SEQ ID NO: 799082 - protein, 23 aa, Mycobacterium
DALGMPLSRVRFALGDSSFPPAP

SEQ ID NO: 799083 - protein, 21 aa, Mycobacterium
DALGWIAFQLRDALSTGRFAP

SEQ ID NO: 799084 - protein, 23 aa, Mycobacterium
DALHGLLLQRKWSSITMADVASA

SEQ ID NO: 799085 - protein, 30 aa, Mycobacterium
DALIDLEMPIWEGAPFTAFLLGRSDIDDVV

SEQ ID NO: 799086 - protein, 23 aa, Mycobacterium
DALITALWEEWPPSGARASIHSY

SEQ ID NO: 799087 - protein, 29 aa, Mycobacterium
DALITGHPLLRHRGPQLLPAIFSHSQRDC

SEQ ID NO: 799088 - protein, 24 aa, Mycobacterium
DALITGHPLLRRDGPQLLPAIFSY

SEQ ID NO: 799089 - protein, 24 aa, Mycobacterium
DALKADGIVGVRLNWRHHGEGGEH

SEQ ID NO: 799090 - protein, 33 aa, Mycobacterium
DALKSVPHYGIGYGLLRYLYAPTGRVLGAQRTP

SEQ ID NO: 799091 - protein, 21 aa, Mycobacterium
DALLGVPVPADFTGSLLASGS

SEQ ID NO: 799092 - protein, 33 aa, Mycobacterium
DALLLGAILEIEKLRRAFWRALVTEINPTTVSD

SEQ ID NO: 799093 - protein, 18 aa, Mycobacterium
DALLLPTTTEHPSLAAVA

SEQ ID NO: 799094 - protein, 26 aa, Mycobacterium
DALLPAAAEPVATLILAELRTAVATS

SEQ ID NO: 799095 - protein, 27 aa, Mycobacterium
DALLPNFLRVWGPRGAFLPLLRAAASN

SEQ ID NO: 799096 - protein, 25 aa, Mycobacterium
DALLRFPVMLMLLPRRSRPPRDRAP

SEQ ID NO: 799097 - protein, 22 aa, Mycobacterium
DALLVDLDPWGGGIDLLMGCEN

SEQ ID NO: 799098 - protein, 30 aa, Mycobacterium
DALLVTDLINIRYLTGFTGSAAALWVAAGD

SEQ ID NO: 799099 - protein, 22 aa, Mycobacterium
DALPAGLFAAGLPQTPEIISAA

SEQ ID NO: 799100 - protein, 18 aa, Mycobacterium
DALPALRHIVRIPVDADD

SEQ ID NO: 799101 - protein, 30 aa, Mycobacterium
DALPARPELRLLWKVIGLAATVEGALPIPA

SEQ ID NO: 799102 - protein, 24 aa, Mycobacterium
DALPEPTFVPVLGRIAAGGPILAE

SEQ ID NO: 799103 - protein, 18 aa, Mycobacterium
DALPGTGHRLLSRDALCR

SEQ ID NO: 799104 - protein, 21 aa, Mycobacterium
DALPRDFCDLLSPAMVDELIA

SEQ ID NO: 799105 - protein, 19 aa, Mycobacterium
DALPYDLAGRKVLVTAGGT

SEQ ID NO: 799106 - protein, 24 aa, Mycobacterium
DALQGVYLSMAPLILEAGAGYAAA

SEQ ID NO: 799107 - protein, 24 aa, Mycobacterium
DALRAGLDWGWASFGDWLDRLEGR

SEQ ID NO: 799108 - protein, 22 aa, Mycobacterium
DALRMLTLPATFSLYVERAWPR

SEQ ID NO: 799109 - protein, 18 aa, Mycobacterium
DALRRIEVALTDAGASLA

SEQ ID NO: 799110 - protein, 25 aa, Mycobacterium
DALRRLHSIRNCYSDILQKGQTNLA

SEQ ID NO: 799111 - protein, 18 aa, Mycobacterium
DALRRRPELWPNAVEEIL

SEQ ID NO: 799112 - protein, 20 aa, Mycobacterium
DALRRYLSKLFDLWEMTWSV

SEQ ID NO: 799113 - protein, 23 aa, Mycobacterium
DALRTLLQAWPADSGRVVACLPG

SEQ ID NO: 799114 - protein, 21 aa, Mycobacterium
DALSAYRRVAQARAEEIDKWA

SEQ ID NO: 799115 - protein, 26 aa, Mycobacterium
DALSIADLVFVLDVYGAREAPLPGVT

SEQ ID NO: 799116 - protein, 28 aa, Mycobacterium
DALSQRLQLLTWLIAHGRLEIKLAVVSN

SEQ ID NO: 799117 - protein, 37 aa, Mycobacterium
DALTPQWEVTLAPANLPWLPDHTVLGSVVLPGTAYLD

SEQ ID NO: 799118 - protein, 21 aa, Mycobacterium
DALTRAIHKLPIKARIVTREE

SEQ ID NO: 799119 - protein, 34 aa, Mycobacterium
DALTRLTMHALLLDLWRRHGFGVLLITHDVDEAV

SEQ ID NO: 799120 - protein, 21 aa, Mycobacterium
DALVARDGLVLGELPAGSVIG

SEQ ID NO: 799121 - protein, 22 aa, Mycobacterium
DALVGLCWPAVFAAIGDAKTTD

SEQ ID NO: 799122 - protein, 19 aa, Mycobacterium
DALVLLTESVFPGCVVEAR

SEQ ID NO: 799123 - protein, 20 aa, Mycobacterium
DALVMATGSYPFVPPVPGGD

SEQ ID NO: 799124 - protein, 21 aa, Mycobacterium
DALVTATPRLALAVVTADCVP

SEQ ID NO: 799125 - protein, 22 aa, Mycobacterium
DALVTLLMMVFATGADARKALG

SEQ ID NO: 799126 - protein, 17 aa, Mycobacterium
DALVTVWGKILGCDAVV

SEQ ID NO: 799127 - protein, 22 aa, Mycobacterium
DALWGGPDGMYARRLGVTRAAG

SEQ ID NO: 799128 - protein, 18 aa, Mycobacterium
DALWLAEMIEQLDLPDGV

SEQ ID NO: 799129 - protein, 20 aa, Mycobacterium
DALWRRFKAAQDAFFTARNA

SEQ ID NO: 799130 - protein, 20 aa, Mycobacterium
DALWSGRRFVVQDTGGWEPD

SEQ ID NO: 799131 - protein, 18 aa, Mycobacterium
DALWTDLVALMKVGVRRG

SEQ ID NO: 799132 - protein, 19 aa, Mycobacterium
DALWTGRRFVVQDTGGWEP

SEQ ID NO: 799133 - protein, 19 aa, Mycobacterium
DALYEMELVGHDFFLFHDK

SEQ ID NO: 799134 - protein, 22 aa, Mycobacterium
DALYERVLRHKAEVVRPLAETD

SEQ ID NO: 799135 - protein, 19 aa, Mycobacterium
DAMAKLVNQMTSPVRWDLC

SEQ ID NO: 799136 - protein, 29 aa, Mycobacterium
DAMAPENISPLVVWLGSAESRDVTGKVFE

SEQ ID NO: 799137 - protein, 29 aa, Mycobacterium
DAMAPENVSPLVVWLGSAGSRDVTGKVFE

SEQ ID NO: 799138 - protein, 23 aa, Mycobacterium
DAMAVGLAAWRLGAGRSRPGARV

SEQ ID NO: 799139 - protein, 26 aa, Mycobacterium
DAMCDNLWWRIGHHFKVRAVPEKFQV

SEQ ID NO: 799140 - protein, 25 aa, Mycobacterium
DAMEKLVAQLTKPVRWDLCTATLRD

SEQ ID NO: 799141 - protein, 23 aa, Mycobacterium
DAMFAAPMWAFADAYSAFVDTYM

SEQ ID NO: 799142 - protein, 27 aa, Mycobacterium
DAMFGTWHYWWQAHLLDCLVDAQLRDP

SEQ ID NO: 799143 - protein, 18 aa, Mycobacterium
DAMFYPEFSLWCGTTATA

SEQ ID NO: 799144 - protein, 19 aa, Mycobacterium
DAMFYPEFSLWCGTTATAD

SEQ ID NO: 799145 - protein, 17 aa, Mycobacterium
DAMIQIWTSEKAEFHGE

SEQ ID NO: 799146 - protein, 17 aa, Mycobacterium
DAMLDWQTARFTGLAIG

SEQ ID NO: 799147 - protein, 29 aa, Mycobacterium
DAMLVTDLINVRYLSGFSGSNGALLVFAD

SEQ ID NO: 799148 - protein, 25 aa, Mycobacterium
DAMPFYDAIMKLNEPANAIAGDAMQ

SEQ ID NO: 799149 - protein, 26 aa, Mycobacterium
DAMPPRAPVRLLWKAIDMAAAAEAAV

SEQ ID NO: 799150 - protein, 20 aa, Mycobacterium
DAMPTFRQVFMAGASGMTLE

SEQ ID NO: 799151 - protein, 22 aa, Mycobacterium
DAMPTFRQVFMAGASGMTLERR

SEQ ID NO: 799152 - protein, 23 aa, Mycobacterium
DAMPVGIAAWRLGAGRSRPGEAV

SEQ ID NO: 799153 - protein, 23 aa, Mycobacterium
DAMSPVFAQLLPAAFPNAELVDG

SEQ ID NO: 799154 - protein, 25 aa, Mycobacterium
DAMSVLRRLNGMPRYLIAGLTHPKV

SEQ ID NO: 799155 - protein, 18 aa, Mycobacterium
DAMSYRVLVSDLAQLYRG

SEQ ID NO: 799156 - protein, 33 aa, Mycobacterium
DAMVAAITVGLARGWPLVKSVRLGIAAGAAMLL

SEQ ID NO: 799157 - protein, 18 aa, Mycobacterium
DAMVGFGLPVRRSRRATA

SEQ ID NO: 799158 - protein, 21 aa, Mycobacterium
DAMYPLQRFVHWMGDDDIAGA

SEQ ID NO: 799159 - protein, 21 aa, Mycobacterium
DANFFALLKDWTTRYRHSSVV

SEQ ID NO: 799160 - protein, 27 aa, Mycobacterium
DANGAAILLRTLPLVAGGKSLGAAVLI

SEQ ID NO: 799161 - protein, 26 aa, Mycobacterium
DANGVRRWLALDGQPLHRVTVAASEL

SEQ ID NO: 799162 - protein, 32 aa, Mycobacterium
DANKIFDGVNLALLVGARPRGPGMERSDLLEA

SEQ ID NO: 799163 - protein, 24 aa, Mycobacterium
DANKIFDGVNLALLVGARPRTKGM

SEQ ID NO: 799164 - protein, 24 aa, Mycobacterium
DANLRGAWLVCQAAGRVLLEQGDG

SEQ ID NO: 799165 - protein, 25 aa, Mycobacterium
DANPLGKILLCRVRRGRIEENFIGE

SEQ ID NO: 799166 - protein, 17 aa, Mycobacterium
DANQTIYSFTGASPRFL

SEQ ID NO: 799167 - protein, 17 aa, Mycobacterium
DANRGCFAAFRAVYECA

SEQ ID NO: 799168 - protein, 18 aa, Mycobacterium
DANWMTLMADRPVDALWG

SEQ ID NO: 799169 - protein, 23 aa, Mycobacterium
DAPAAFVLLTQLSAKYRQVLPET

SEQ ID NO: 799170 - protein, 25 aa, Mycobacterium
DAPAATIALPYDIAGALTGFHTDDI

SEQ ID NO: 799171 - protein, 26 aa, Mycobacterium
DAPANAFVMSFLGAVSALNGALVRPH

SEQ ID NO: 799172 - protein, 29 aa, Mycobacterium
DAPAWARRLYSRLTHYATKPGIYYPPMRK

SEQ ID NO: 799173 - protein, 29 aa, Mycobacterium
DAPDEGQGVPWWPLAVRGARSPGAPTVEL

SEQ ID NO: 799174 - protein, 27 aa, Mycobacterium
DAPDQVALPFPFHTGAELVRLAEENRC

SEQ ID NO: 799175 - protein, 29 aa, Mycobacterium
DAPELVKLRPYFDHPLFVEMFAGAITDAA

SEQ ID NO: 799176 - protein, 30 aa, Mycobacterium
DAPELVKLRPYFDHPVFVEMFAASVASAAA

SEQ ID NO: 799177 - protein, 17 aa, Mycobacterium
DAPFLGPVLADDLARQL

SEQ ID NO: 799178 - protein, 27 aa, Mycobacterium
DAPGLARALCWMIERTFYQASKISPDA

SEQ ID NO: 799179 - protein, 23 aa, Mycobacterium
DAPGRVELILNRSPFYAESGGQI

SEQ ID NO: 799180 - protein, 28 aa, Mycobacterium
DAPHHTRLRKIISRGFTPRAIGRLRDEL

SEQ ID NO: 799181 - protein, 26 aa, Mycobacterium
DAPHHTRLRKIISRGFTPRAVGRLRS

SEQ ID NO: 799182 - protein, 31 aa, Mycobacterium
DAPIAFGDDLRKVLLGLRRAKSNVDRLKLVG

SEQ ID NO: 799183 - protein, 17 aa, Mycobacterium
DAPIIHGLALILHHLRH

SEQ ID NO: 799184 - protein, 23 aa, Mycobacterium
DAPKHKGITYFLVDMKTPGIVIR

SEQ ID NO: 799185 - protein, 29 aa, Mycobacterium
DAPKHKRLTLFLIPMDRPGFTVRPIPSML

SEQ ID NO: 799186 - protein, 28 aa, Mycobacterium
DAPKPKRLTLFLIPMDRPGITVRPIPSM

SEQ ID NO: 799187 - protein, 28 aa, Mycobacterium
DAPKRLGSFMDGRLWKMLLGSSRGLGRI

SEQ ID NO: 799188 - protein, 33 aa, Mycobacterium
DAPKRLGSFMDSRLWRMLLAPGRGIGKLVTGAV

SEQ ID NO: 799189 - protein, 17 aa, Mycobacterium
DAPLERFGLRAPDGRLI

SEQ ID NO: 799190 - protein, 26 aa, Mycobacterium
DAPLGYLLYRVASLLRPEVSAVLGPL

SEQ ID NO: 799191 - protein, 17 aa, Mycobacterium
DAPLLLNLVIGGLTPDQ

SEQ ID NO: 799192 - protein, 20 aa, Mycobacterium
DAPLPVWTRRRMLLRPDRAG

SEQ ID NO: 799193 - protein, 19 aa, Mycobacterium
DAPLVVDIGSGLLAPHPLL

SEQ ID NO: 799194 - protein, 20 aa, Mycobacterium
DAPLVWCVAALLGQHPMEAA

SEQ ID NO: 799195 - protein, 18 aa, Mycobacterium
DAPMVNRALPGLDLPNLD

SEQ ID NO: 799196 - protein, 18 aa, Mycobacterium
DAPMVNRALQGLDLTRLD

SEQ ID NO: 799197 - protein, 18 aa, Mycobacterium
DAPMYHTTAFPGSFVPRT

SEQ ID NO: 799198 - protein, 17 aa, Mycobacterium
DAPNLERFVQDEMLYGL

SEQ ID NO: 799199 - protein, 17 aa, Mycobacterium
DAPNLIDLLTAMYAGVF

SEQ ID NO: 799200 - protein, 20 aa, Mycobacterium
DAPPPIVILTGRPQDNWLAS

SEQ ID NO: 799201 - protein, 17 aa, Mycobacterium
DAPPSRIRHRRFRRGTD

SEQ ID NO: 799202 - protein, 23 aa, Mycobacterium
DAPQFLLSLIDSSAARGASGVEV

SEQ ID NO: 799203 - protein, 26 aa, Mycobacterium
DAPQGTRLVPIPGAPPSLVGLEPGCP

SEQ ID NO: 799204 - protein, 26 aa, Mycobacterium
DAPQLLTFPDVFPNGLANKYTFGPIG

SEQ ID NO: 799205 - protein, 27 aa, Mycobacterium
DAPQLLTFPDVFPNGLANKYTFGPIGE

SEQ ID NO: 799206 - protein, 27 aa, Mycobacterium
DAPRAPEVSFFAWRDGTLGPQQTLVGG

SEQ ID NO: 799207 - protein, 29 aa, Mycobacterium
DAPRIDAVLPMFLEFARGAVLVAHNAGFD

SEQ ID NO: 799208 - protein, 21 aa, Mycobacterium
DAPRRIVDLAVSRWGRIDFLI

SEQ ID NO: 799209 - protein, 35 aa, Mycobacterium
DAPRYAELIKRTQWWGRQMLIWGVHVHVGVSSAHK

SEQ ID NO: 799210 - protein, 31 aa, Mycobacterium
DAPRYAELIKRTQWWGRQMTIWGVHVHVGVS

SEQ ID NO: 799211 - protein, 35 aa, Mycobacterium
DAPRYDELIARTQWWGRQMLIWGVHVHVGISSKHK

SEQ ID NO: 799212 - protein, 23 aa, Mycobacterium
DAPSWVAAALAVTPWVVVRRGRA

SEQ ID NO: 799213 - protein, 26 aa, Mycobacterium
DAPTASGFWHWAVANLPADVTELPAG

SEQ ID NO: 799214 - protein, 33 aa, Mycobacterium
DAPTGPRPFLRLEGSAVFRWAAFEMGKVGRQAM

SEQ ID NO: 799215 - protein, 17 aa, Mycobacterium
DAPTLLTGTRWLDVARG

SEQ ID NO: 799216 - protein, 32 aa, Mycobacterium
DAPTLNHLMPVKLKWGISLGALIMHLRESKLI

SEQ ID NO: 799217 - protein, 27 aa, Mycobacterium
DAPTVSGFWHWAVFNLPATVTELPAGV

SEQ ID NO: 799218 - protein, 28 aa, Mycobacterium
DAPVISAVLPMFFEFAGNSVFVAHNAGF

SEQ ID NO: 799219 - protein, 20 aa, Mycobacterium
DAPVNTDSPVYRGFIGNLVF

SEQ ID NO: 799220 - protein, 18 aa, Mycobacterium
DAPVRRYLPEFAVADPAV

SEQ ID NO: 799221 - protein, 18 aa, Mycobacterium
DAPVRVRVEGHVGYYAAG

SEQ ID NO: 799222 - protein, 21 aa, Mycobacterium
DAPVRYTERLYGATPGAVIEE

SEQ ID NO: 799223 - protein, 17 aa, Mycobacterium
DAPWPGSLDDWLATCHA

SEQ ID NO: 799224 - protein, 27 aa, Mycobacterium
DAPYAHGWATWFPPDGPPRTGRFGPAP

SEQ ID NO: 799225 - protein, 25 aa, Mycobacterium
DAPYLGFQLGSMWYISLDYINHQTS

SEQ ID NO: 799226 - protein, 19 aa, Mycobacterium
DAQAKVYRMALKAAGVEPG

SEQ ID NO: 799227 - protein, 24 aa, Mycobacterium
DAQAWLTALNDVRLALGAMLGIDS

SEQ ID NO: 799228 - protein, 24 aa, Mycobacterium
DAQDRLFDMFTALSAPHSQVAIEV

SEQ ID NO: 799229 - protein, 19 aa, Mycobacterium
DAQFRWLSVDLPPVVDLRR

SEQ ID NO: 799230 - protein, 25 aa, Mycobacterium
DAQGALSLLLRLTSGAGLGSPAKGG

SEQ ID NO: 799231 - protein, 22 aa, Mycobacterium
DAQGRIVIATYPQRAKSANIRR

SEQ ID NO: 799232 - protein, 20 aa, Mycobacterium
DAQGYFRTGDLGHWVDDEYL

SEQ ID NO: 799233 - protein, 17 aa, Mycobacterium
DAQIAELIYGAAAFGFW

SEQ ID NO: 799234 - protein, 18 aa, Mycobacterium
DAQILPRSFVPFKEIEGF

SEQ ID NO: 799235 - protein, 18 aa, Mycobacterium
DAQNVWLAIALHTTPGIT

SEQ ID NO: 799236 - protein, 27 aa, Mycobacterium
DAQPEWFYIVRFNLAELWHGYTGTTTD

SEQ ID NO: 799237 - protein, 20 aa, Mycobacterium
DAQRECIEMAYYGGLTYAEV

SEQ ID NO: 799238 - protein, 24 aa, Mycobacterium
DAQREGVQINWLRTITAFDDHEIR

SEQ ID NO: 799239 - protein, 20 aa, Mycobacterium
DAQRVERFYVWFADFAVPES

SEQ ID NO: 799240 - protein, 24 aa, Mycobacterium
DAQTGAFDLLLGDAGPALVGDEIA

SEQ ID NO: 799241 - protein, 17 aa, Mycobacterium
DAQTLVRKHQPLYARVT

SEQ ID NO: 799242 - protein, 30 aa, Mycobacterium
DAQVALPYLVFAQYLALFSSLEYGKTPDNP

SEQ ID NO: 799243 - protein, 20 aa, Mycobacterium
DAQVNWWRPGGTAWFTVLHQ

SEQ ID NO: 799244 - protein, 24 aa, Mycobacterium
DAQWSWRQYLEGSTARAAALLAAA

SEQ ID NO: 799245 - protein, 18 aa, Mycobacterium
DAQYDARLVSRLSDAPAE

SEQ ID NO: 799246 - protein, 22 aa, Mycobacterium
DARAAIDWYVDVLGASVVGAPI

SEQ ID NO: 799247 - protein, 27 aa, Mycobacterium
DARAARRLFAAAYRPGWRLSGFTGHCA

SEQ ID NO: 799248 - protein, 24 aa, Mycobacterium
DARALLSGYYRLEDPRRFDPQSCE

SEQ ID NO: 799249 - protein, 19 aa, Mycobacterium
DARARIDQLLDPGSFRELG

SEQ ID NO: 799250 - protein, 17 aa, Mycobacterium
DARARIGHLLDPGTFQE

SEQ ID NO: 799251 - protein, 27 aa, Mycobacterium
DARARILDLFGFAAAHPRLCRNVVPST

SEQ ID NO: 799252 - protein, 54 aa, Mycobacterium
DARDSPSLSVVPPPPAWYLVGSFLGPTAWPSGNPAMLRLTAAQWENLATGFSAV

SEQ ID NO: 799253 - protein, 19 aa, Mycobacterium
DARELGLPEVRLYTNEKMT

SEQ ID NO: 799254 - protein, 33 aa, Mycobacterium
DARFDGWFVIAVLTTRIYCRPSCPVRPPFARNV

SEQ ID NO: 799255 - protein, 21 aa, Mycobacterium
DARFHLAIAELAGVPSLTAAV

SEQ ID NO: 799256 - protein, 27 aa, Mycobacterium
DARFLDALFPVWRYHPFFTDSDEPVDA

SEQ ID NO: 799257 - protein, 22 aa, Mycobacterium
DARFSALRRHYEYRLSTASFGV

SEQ ID NO: 799258 - protein, 29 aa, Mycobacterium
DARGDDRPFFMWYDWMAGGWGGRSTKDGS

SEQ ID NO: 799259 - protein, 17 aa, Mycobacterium
DARGWTSVASPMGRLLA

SEQ ID NO: 799260 - protein, 26 aa, Mycobacterium
DARGYGYGPAFRGLTAMWARGEELFA

SEQ ID NO: 799261 - protein, 22 aa, Mycobacterium
DARIGRLLFSTHLANPVVVRKR

SEQ ID NO: 799262 - protein, 25 aa, Mycobacterium
DARKYVDSWILGSPQEFGRIGGEQM

SEQ ID NO: 799263 - protein, 26 aa, Mycobacterium
DARLAIKAPRWPSMTSWKLATEVDRV

SEQ ID NO: 799264 - protein, 24 aa, Mycobacterium
DARLAYLFEVDYVDHFVWVVTDGV

SEQ ID NO: 799265 - protein, 22 aa, Mycobacterium
DARLDRFLGVMPADIPVAVEFR

SEQ ID NO: 799266 - protein, 23 aa, Mycobacterium
DARLDSFLQLMPASIRVAVELRH

SEQ ID NO: 799267 - protein, 23 aa, Mycobacterium
DARLLEWRLGQLQEISRIAQPFG

SEQ ID NO: 799268 - protein, 19 aa, Mycobacterium
DARLLVDLADRAGAGGGAV

SEQ ID NO: 799269 - protein, 19 aa, Mycobacterium
DARLQIAFYFTVKTYDSLV

SEQ ID NO: 799270 - protein, 22 aa, Mycobacterium
DARLRELIIMRIGWVTGSVYEW

SEQ ID NO: 799271 - protein, 25 aa, Mycobacterium
DARLRELIIMRIGWVTGSVYEWTQH

SEQ ID NO: 799272 - protein, 19 aa, Mycobacterium
DARLRMLRSFDPRSSAHAL

SEQ ID NO: 799273 - protein, 21 aa, Mycobacterium
DARLVLAQALSWQGRGREAAA

SEQ ID NO: 799274 - protein, 18 aa, Mycobacterium
DARNLATMLGLDAPSQPS

SEQ ID NO: 799275 - protein, 31 aa, Mycobacterium
DARPGGHFSLPALLLLISGLPKFLSLEEGIG

SEQ ID NO: 799276 - protein, 28 aa, Mycobacterium
DARPLFAANLALPWPDDPLAALWHATTL

SEQ ID NO: 799277 - protein, 20 aa, Mycobacterium
DARPTVWGAVPRVWEKLKAG

SEQ ID NO: 799278 - protein, 19 aa, Mycobacterium
DARQRRRSAGGLSAQDLLR

SEQ ID NO: 799279 - protein, 26 aa, Mycobacterium
DARREWTFPAWVPVPVAEFAIGVARR

SEQ ID NO: 799280 - protein, 23 aa, Mycobacterium
DARRGKMFARLIKNIEVAARVGG

SEQ ID NO: 799281 - protein, 20 aa, Mycobacterium
DARRPADRFSLDSAPPARAG

SEQ ID NO: 799282 - protein, 22 aa, Mycobacterium
DARRRLHLLHEVEWVQLDRSYA

SEQ ID NO: 799283 - protein, 22 aa, Mycobacterium
DARSLIDAVSFLHQVAAGEKPE

SEQ ID NO: 799284 - protein, 31 aa, Mycobacterium
DARSQRVDFTSLPWTHTIETSAPAVIASVVA

SEQ ID NO: 799285 - protein, 18 aa, Mycobacterium
DARSTMVCLLPAGRAAIE

SEQ ID NO: 799286 - protein, 27 aa, Mycobacterium
DARTGERFLDMFTFFASSALGMNHSAL

SEQ ID NO: 799287 - protein, 18 aa, Mycobacterium
DARTLLAKFGLRADHVER

SEQ ID NO: 799288 - protein, 36 aa, Mycobacterium
DARVQPVIVGLQLALTRLWRVYGVEPDAVIGHSMGE

SEQ ID NO: 799289 - protein, 20 aa, Mycobacterium
DARVVAYPGSSWLDMLRPKP

SEQ ID NO: 799290 - protein, 18 aa, Mycobacterium
DARWFSLCKVDGVTVTTA

SEQ ID NO: 799291 - protein, 18 aa, Mycobacterium
DARWLVMHRGGLSIACNL

SEQ ID NO: 799292 - protein, 18 aa, Mycobacterium
DASAALELPGVRAVFTAA

SEQ ID NO: 799293 - protein, 26 aa, Mycobacterium
DASALMIPLVGFLPADDPRVLATIDA

SEQ ID NO: 799294 - protein, 17 aa, Mycobacterium
DASALRRVLRRARDGVA

SEQ ID NO: 799295 - protein, 25 aa, Mycobacterium
DASANLAVLRTPPGGANYLASAIDR

SEQ ID NO: 799296 - protein, 22 aa, Mycobacterium
DASARRLYGVPVVVSLAQAEGV

SEQ ID NO: 799297 - protein, 30 aa, Mycobacterium; identical to SEQ ID NO: 124897

SEQ ID NO: 799298 - protein, 38 aa, Mycobacterium
DASEGPLPQTRFVLRKALSAHLPVILVVNKTDRPDARI

SEQ ID NO: 799299 - protein, 27 aa, Mycobacterium
DASGALLTLAPPVAAAWNPLVDSLSAP

SEQ ID NO: 799300 - protein, 23 aa, Mycobacterium
DASGLSWLTGFSDRTPFEPYSVG

SEQ ID NO: 799301 - protein, 29 aa, Mycobacterium
DASHNFHRKIIELNLLSALLVSQRANAVM

SEQ ID NO: 799302 - protein, 25 aa, Mycobacterium
DASLLDIFVTLSLGARLIVPKPGAF

SEQ ID NO: 799303 - protein, 25 aa, Mycobacterium
DASLLLARALTPEPMRPGWADALRM

SEQ ID NO: 799304 - protein, 18 aa, Mycobacterium
DASLLLAVLNRFLPSDDP

SEQ ID NO: 799305 - protein, 22 aa, Mycobacterium
DASLLLAVLTRFLPADDPRIRA

SEQ ID NO: 799306 - protein, 24 aa, Mycobacterium
DASLLLAVLTRFLPPDDPRVRNTV

SEQ ID NO: 799307 - protein, 31 aa, Mycobacterium
DASLPTAWLAEGLLMYLPAEAQDRLFELVTE

SEQ ID NO: 799308 - protein, 38 aa, Mycobacterium
DASLQALVFVARRLPDAPLALLFGVRCGTALPGLPELA

SEQ ID NO: 799309 - protein, 24 aa, Mycobacterium
DASLREHAWKRSSFNGTEIFGKTV

SEQ ID NO: 799310 - protein, 20 aa, Mycobacterium
DASLRLLARGGRFIEMGKTD

SEQ ID NO: 799311 - protein, 23 aa, Mycobacterium
DASLRLLVRGGRFLEMGKTDIRD

SEQ ID NO: 799312 - protein, 21 aa, Mycobacterium
DASLRSWLAFGAEKVAEVAVL

SEQ ID NO: 799313 - protein, 23 aa, Mycobacterium
DASLVHHYYGTKQQLFAAAIQIP

SEQ ID NO: 799314 - protein, 17 aa, Mycobacterium
DASLVVGPAAWWHAWAP

SEQ ID NO: 799315 - protein, 31 aa, Mycobacterium
DASLVVGPAAWWHAWAPADWDRLAGAVVAGH

SEQ ID NO: 799316 - protein, 25 aa, Mycobacterium
DASPAFLGFNLFQHAIARAVIHATY

SEQ ID NO: 799317 - protein, 25 aa, Mycobacterium
DASPAFLGFNLFQHAIARAVIHGTY

SEQ ID NO: 799318 - protein, 26 aa, Mycobacterium
DASPAFLGFNLFQHAIARAVIYGTYQ

SEQ ID NO: 799319 - protein, 28 aa, Mycobacterium
DASPSQLALAWLLKRSPVMLPIPGTSKV

SEQ ID NO: 799320 - protein, 24 aa, Mycobacterium
DASPYLVAAALLAAGLRGLQEELP

SEQ ID NO: 799321 - protein, 26 aa, Mycobacterium
DASQRWITLAFTWTGLRALGVPDDAL

SEQ ID NO: 799322 - protein, 25 aa, Mycobacterium
DASQTLIPHAFWQSYLQHRDQLLPF

SEQ ID NO: 799323 - protein, 17 aa, Mycobacterium
DASRWQGFSTRAIHGGF

SEQ ID NO: 799324 - protein, 23 aa, Mycobacterium
DASTLSPFVTWGTNPGQGVPLSE

SEQ ID NO: 799325 - protein, 23 aa, Mycobacterium
DASTLTPFVTWGTNPGQGVPLGA

SEQ ID NO: 799326 - protein, 30 aa, Mycobacterium
DASTNWRSAFLRMPYQRDALARRGVIAETF

SEQ ID NO: 799327 - protein, 31 aa, Mycobacterium
DASTPFDAFIRLISPTRLFTTAFKDIQSLAQ

SEQ ID NO: 799328 - protein, 22 aa, Mycobacterium
DASTWVVFFTDHGAAFPRAKST

SEQ ID NO: 799329 - protein, 20 aa, Mycobacterium
DASVANFWMATPQQLYRELD

SEQ ID NO: 799330 - protein, 21 aa, Mycobacterium
DASYEFAEFGAVLSPGAGKVE

SEQ ID NO: 799331 - protein, 23 aa, Mycobacterium
DATAEFAWGLLIATVRNLAEEHR

SEQ ID NO: 799332 - protein, 23 aa, Mycobacterium
DATAGDFLFVPPGGLHAFQNDSG

SEQ ID NO: 799333 - protein, 24 aa, Mycobacterium
DATAKGWRLTQAVVSFSDAQGARA

SEQ ID NO: 799334 - protein, 25 aa, Mycobacterium
DATALPVVLYDIPPRSVIPIQPETI

SEQ ID NO: 799335 - protein, 17 aa, Mycobacterium
DATAMFVSLFAQHLHDW

SEQ ID NO: 799336 - protein, 20 aa, Mycobacterium
DATDEKMFVPMPGLPLEAAI

SEQ ID NO: 799337 - protein, 27 aa, Mycobacterium
DATDLFEAALLGDPLWRARGVHGGFVC

SEQ ID NO: 799338 - protein, 17 aa, Mycobacterium
DATDLPVLLYDIPGRSG

SEQ ID NO: 799339 - protein, 36 aa, Mycobacterium
DATDLPVVLYDIPPRSVVPIAWDTLRKLAEHPNIVA

SEQ ID NO: 799340 - protein, 21 aa, Mycobacterium
DATEVYACDLTLDKFIDAPTL

SEQ ID NO: 799341 - protein, 17 aa, Mycobacterium
DATFQAAFPLKGKPPNV

SEQ ID NO: 799342 - protein, 30 aa, Mycobacterium
DATFVTSRHRLLQGWAYMQDGQLAAAAAAI

SEQ ID NO: 799343 - protein, 17 aa, Mycobacterium
DATGFGMTGGDGAMGGA

SEQ ID NO: 799344 - protein, 26 aa, Mycobacterium
DATHAWAAVWVPPDGWIAFDPTNDTI

SEQ ID NO: 799345 - protein, 24 aa, Mycobacterium
DATHAWASVWTPQNLWLGLDPTNN

SEQ ID NO: 799346 - protein, 27 aa, Mycobacterium
DATKGSPLAWLLTMAHRRAVDRVRAEQ

SEQ ID NO: 799347 - protein, 17 aa, Mycobacterium
DATLIVASAYTPATREA

SEQ ID NO: 799348 - protein, 23 aa, Mycobacterium
DATLREHTWKRSAFSGTEIFGKT

SEQ ID NO: 799349 - protein, 17 aa, Mycobacterium
DATLRHVPLTLVHMVNQ

SEQ ID NO: 799350 - protein, 25 aa, Mycobacterium
DATLRLLRRVAQVAEPPLLEAGGHI

SEQ ID NO: 799351 - protein, 17 aa, Mycobacterium
DATLVAAQIFALDATKA

SEQ ID NO: 799352 - protein, 28 aa, Mycobacterium
DATLVKFELLADPNVPLPGFVLKRAVKG

SEQ ID NO: 799353 - protein, 20 aa, Mycobacterium
DATLVLRVDPGPDAVVISTS

SEQ ID NO: 799354 - protein, 17 aa, Mycobacterium
DATLYRVRGACHSWLIG

SEQ ID NO: 799355 - protein, 17 aa, Mycobacterium
DATMRIHRPGREPALLT

SEQ ID NO: 799356 - protein, 20 aa, Mycobacterium
DATNLQRVLVRRGVISQTGT

SEQ ID NO: 799357 - protein, 19 aa, Mycobacterium
DATNLQRVLVRRGVLTPTG

SEQ ID NO: 799358 - protein, 24 aa, Mycobacterium
DATNSRGLWRRTTLDRYRRHDPEW

SEQ ID NO: 799359 - protein, 25 aa, Mycobacterium
DATPEWFYIVKFMMADLWHGYTGPS

SEQ ID NO: 799360 - protein, 26 aa, Mycobacterium
DATPEWFYIVRFNLSELFYGYTGTST

SEQ ID NO: 799361 - protein, 28 aa, Mycobacterium
DATPSQLALAWLLKRSPVMLPIPGTSKV

SEQ ID NO: 799362 - protein, 25 aa, Mycobacterium
DATQGTRLVPIPGAPPSLAGLDRGC

SEQ ID NO: 799363 - protein, 20 aa, Mycobacterium
DATRAAQSLAWKASVHTAEL

SEQ ID NO: 799364 - protein, 24 aa, Mycobacterium
DATRGLLLERGFDKLTIEAVAARA

SEQ ID NO: 799365 - protein, 20 aa, Mycobacterium
DATRLIMLNMDPPRHSRLRH

SEQ ID NO: 799366 - protein, 24 aa, Mycobacterium
DATRLIPMLSDVQPEIFFAPPRIW

SEQ ID NO: 799367 - protein, 18 aa, Mycobacterium
DATRRLSVALADEAPRPG

SEQ ID NO: 799368 - protein, 17 aa, Mycobacterium
DATSYLRGPSVLVAHGE

SEQ ID NO: 799369 - protein, 29 aa, Mycobacterium
DATTLFESLLPRYLTTRVYAALLESAASE

SEQ ID NO: 799370 - protein, 28 aa, Mycobacterium
DATTLFESLLPRYLTTRVYAAMLESAAS

SEQ ID NO: 799371 - protein, 27 aa, Mycobacterium
DATTLFESLLPRYLTTRVYEALLESAA

SEQ ID NO: 799372 - protein, 28 aa, Mycobacterium
DATTLFESLLPRYVTTRVYAALLESAAS

SEQ ID NO: 799373 - protein, 25 aa, Mycobacterium
DATVEVIVACSWDCPFDGPTAQKRV

SEQ ID NO: 799374 - protein, 22 aa, Mycobacterium
DATVLLPDFPVPDLRNALQELG

SEQ ID NO: 799375 - protein, 31 aa, Mycobacterium
DATVQGLVLGGYRFAEFRSAKTAPKDAGLQK

SEQ ID NO: 799376 - protein, 26 aa, Mycobacterium
DATWRFTAIQRGKQLFTCDLRTLRDD

SEQ ID NO: 799377 - protein, 17 aa, Mycobacterium
DATYFGTMLVFNGMVDG

SEQ ID NO: 799378 - protein, 28 aa, Mycobacterium
DATYLPCGQGQFLYLATVIDCFSRRLVG

SEQ ID NO: 799379 - protein, 24 aa, Mycobacterium
DAVADFWRIIEHYRITTFSTVPTV

SEQ ID NO: 799380 - protein, 24 aa, Mycobacterium
DAVADLLPRPLLDVMFAGGREAGV

SEQ ID NO: 799381 - protein, 30 aa, Mycobacterium
DAVADLTVAFLLMLARRLPTASAFLHQPGI

SEQ ID NO: 799382 - protein, 23 aa, Mycobacterium
DAVAEMTVALLLAATRHVLPADA

SEQ ID NO: 799383 - protein, 19 aa, Mycobacterium
DAVAEMTVALLLASTRHLL

SEQ ID NO: 799384 - protein, 19 aa, Mycobacterium
DAVAEMTVALLLTVTRHVL

SEQ ID NO: 799385 - protein, 22 aa, Mycobacterium
DAVAEMTVALLLVTTRQLLPAD

SEQ ID NO: 799386 - protein, 20 aa, Mycobacterium
DAVASIAWLGYDAPDSLKDV

SEQ ID NO: 799387 - protein, 29 aa, Mycobacterium
DAVATNLLRYLWPDVTLVGGPVGAPVLLA

SEQ ID NO: 799388 - protein, 21 aa, Mycobacterium
DAVAVYTPIFGLNAMIAAHLG

SEQ ID NO: 799389 - protein, 18 aa, Mycobacterium
DAVAWVARNLPSRPTVPV

SEQ ID NO: 799390 - protein, 25 aa, Mycobacterium
DAVAWVARSLPTRPTIPVLAGVLLT

SEQ ID NO: 799391 - protein, 27 aa, Mycobacterium
DAVCCFGALYLMPEPFRIAREMVRVLG

SEQ ID NO: 799392 - protein, 25 aa, Mycobacterium
DAVCCFGALYLMPEPFRVAREMLRV

SEQ ID NO: 799393 - protein, 28 aa, Mycobacterium
DAVDGRPRGYLRKFGLSRVRVRELVHDG

SEQ ID NO: 799394 - protein, 18 aa, Mycobacterium
DAVDMWLEEGRRLVHYPP

SEQ ID NO: 799395 - protein, 17 aa, Mycobacterium
DAVDWLVEHEGAQVSWL

SEQ ID NO: 799396 - protein, 27 aa, Mycobacterium
DAVELHFGHLYLPSSFLSPLINRRKDD

SEQ ID NO: 799397 - protein, 27 aa, Mycobacterium
DAVELHFGHLYLPSSFLSPLINRRKDE

SEQ ID NO: 799398 - protein, 26 aa, Mycobacterium
DAVELHFGHLYLPSSFLSPLINRRRD

SEQ ID NO: 799399 - protein, 24 aa, Mycobacterium
DAVELPAWYRQNPGLARDLAFIAF

SEQ ID NO: 799400 - protein, 30 aa, Mycobacterium
DAVERLGLLGLPFLFYIDAAEGRASVIYRR

SEQ ID NO: 799401 - protein, 22 aa, Mycobacterium
DAVERVALIKELFAAGISSDGV

SEQ ID NO: 799402 - protein, 20 aa, Mycobacterium
DAVFPLVIRAGGGSPRDTLS

SEQ ID NO: 799403 - protein, 23 aa, Mycobacterium
DAVFSPRLAGFVLDSFTGRSNAP

SEQ ID NO: 799404 - protein, 25 aa, Mycobacterium
DAVGADPWGWVLGGGEDHALVACFS

SEQ ID NO: 799405 - protein, 31 aa, Mycobacterium
DAVGEPLHLGLARLGLLDQPGHLRQLGVVTD

SEQ ID NO: 799406 - protein, 25 aa, Mycobacterium
DAVGKLYVQRYFPPGAKARIDELVA

SEQ ID NO: 799407 - protein, 18 aa, Mycobacterium
DAVGPPFGIPAGSGGNGG

SEQ ID NO: 799408 - protein, 25 aa, Mycobacterium
DAVGRPETWKQAFYARDLAGTVVLV

SEQ ID NO: 799409 - protein, 28 aa, Mycobacterium
DAVIAANWSLPMKLFERTLDRGSQTFGV

SEQ ID NO: 799410 - protein, 29 aa, Mycobacterium
DAVIADYGFFGILPFLLGNRADRPPFLTY

SEQ ID NO: 799411 - protein, 30 aa, Mycobacterium
DAVIAVHLRGHFLLTRNAAAYWRSKAKAGD

SEQ ID NO: 799412 - protein, 25 aa, Mycobacterium
DAVICAYVGLYWYHRPDDVTIYGDH

SEQ ID NO: 799413 - protein, 24 aa, Mycobacterium
DAVIGVNLTGTWRTLRATVPPMIE

SEQ ID NO: 799414 - protein, 42 aa, Mycobacterium
DAVITDAFFLGVIPLLLDPTLARPPIMAYSTTPLFLSSRDTA

SEQ ID NO: 799415 - protein, 22 aa, Mycobacterium
DAVIVEFWLMGTHRGYLGKIPP

SEQ ID NO: 799416 - protein, 23 aa, Mycobacterium
DAVIVEFWLMGTHRGYLGKVPPT

SEQ ID NO: 799417 - protein, 28 aa, Mycobacterium
DAVKGSPLAWLLTMAHRRAIDRVRAEQA

SEQ ID NO: 799418 - protein, 17 aa, Mycobacterium
DAVLANLRGLAERVGLA

SEQ ID NO: 799419 - protein, 28 aa, Mycobacterium
DAVLARDFLLTWFVTLAWEVAEAKRLTG

SEQ ID NO: 799420 - protein, 17 aa, Mycobacterium
DAVLKRTIQTHRGWLFK

SEQ ID NO: 799421 - protein, 17 aa, Mycobacterium
DAVLLALALEYVDDRTA

SEQ ID NO: 799422 - protein, 20 aa, Mycobacterium
DAVLLPGGFPEQFTAELSAN

SEQ ID NO: 799423 - protein, 17 aa, Mycobacterium
DAVLRVLAPLGLVFDER

SEQ ID NO: 799424 - protein, 26 aa, Mycobacterium
DAVLVAQAWHWFDPELAVKEVSRVLR

SEQ ID NO: 799425 - protein, 23 aa, Mycobacterium
DAVLWAIGKVRPNTGWLPEQLLD

SEQ ID NO: 799426 - protein, 25 aa, Mycobacterium
DAVLYEGYLLYPYRGDAAKNQCRWQ

SEQ ID NO: 799427 - protein, 28 aa, Mycobacterium
DAVNAPTQALLGRPLIGNGADGSAPGQA

SEQ ID NO: 799428 - protein, 24 aa, Mycobacterium
DAVNAPVQQLTGRPLIGNGADGIN

SEQ ID NO: 799429 - protein, 22 aa, Mycobacterium
DAVNLLHLIYSLIMVAMAVEIM

SEQ ID NO: 799430 - protein, 25 aa, Mycobacterium
DAVNRYPEFLPQRLRELIAAHIGMP

SEQ ID NO: 799431 - protein, 31 aa, Mycobacterium
DAVPHYGIGYGLLRYLYAPTARLLGDGRPAD

SEQ ID NO: 799432 - protein, 20 aa, Mycobacterium
DAVPIVEILPAPQVSPFPAV

SEQ ID NO: 799433 - protein, 25 aa, Mycobacterium
DAVPSLLQLPVSWLGAGVYQSLNIP

SEQ ID NO: 799434 - protein, 26 aa, Mycobacterium
DAVQADYVLALQLRRLTKLDVIELQA

SEQ ID NO: 799435 - protein, 27 aa, Mycobacterium
DAVQKQIDHFLAMELLYKNQDDYNAGN

SEQ ID NO: 799436 - protein, 23 aa, Mycobacterium
DAVQLPAWYRQNPGLARDLAFIA

SEQ ID NO: 799437 - protein, 26 aa, Mycobacterium
DAVQRVRPLLSCYGDPVLHVGPTGAG

SEQ ID NO: 799438 - protein, 17 aa, Mycobacterium
DAVQWLADHEGAEVTWL

SEQ ID NO: 799439 - protein, 23 aa, Mycobacterium
DAVREFVVELLQWATAKLERYER

SEQ ID NO: 799440 - protein, 21 aa, Mycobacterium
DAVRLPFRRHRPILLLSRPEH

SEQ ID NO: 799441 - protein, 21 aa, Mycobacterium
DAVRLRKALELLARRHPSLAT

SEQ ID NO: 799442 - protein, 24 aa, Mycobacterium
DAVRPTFLVLQSAMCIGLARTALA

SEQ ID NO: 799443 - protein, 21 aa, Mycobacterium
DAVRVFLTPESARQFASRSNR

SEQ ID NO: 799444 - protein, 19 aa, Mycobacterium
DAVSFTLLQDQLQSVLDTL

SEQ ID NO: 799445 - protein, 21 aa, Mycobacterium
DAVSFTLLQDQLQSVLDTLSE

SEQ ID NO: 799446 - protein, 25 aa, Mycobacterium
DAVSGPFVLGLWNGNGDGLALQGSR

SEQ ID NO: 799447 - protein, 22 aa, Mycobacterium
DAVSKYWEIDEIRPAFIHANVP

SEQ ID NO: 799448 - protein, 18 aa, Mycobacterium
DAVSLRRILNTPRRGIGD

SEQ ID NO: 799449 - protein, 28 aa, Mycobacterium
DAVTAGQPLIWLEAMKMEHTISAPTDGV

SEQ ID NO: 799450 - protein, 26 aa, Mycobacterium
DAVTALLARLPQQYPLTGVIHAAGVL

SEQ ID NO: 799451 - protein, 22 aa, Mycobacterium
DAVTCYLDRSPALPPAVTVPVA

SEQ ID NO: 799452 - protein, 31 aa, Mycobacterium
DAVTEQGIGFIPWFPLAAGPLAAPDGPLQRI

SEQ ID NO: 799453 - protein, 30 aa, Mycobacterium
DAVTIGEVWVLDNLLWAEYLRPDELHLGFN

SEQ ID NO: 799454 - protein, 18 aa, Mycobacterium
DAVTIPVMAKARIGHFVE

SEQ ID NO: 799455 - protein, 23 aa, Mycobacterium
DAVTKYPWPRGRARRKFGFYDQD

SEQ ID NO: 799456 - protein, 24 aa, Mycobacterium
DAVTLGLTGHRWGMRRVTAEEKAR

SEQ ID NO: 799457 - protein, 23 aa, Mycobacterium
DAVTQCWMSLFSPRVITYRASRG

SEQ ID NO: 799458 - protein, 22 aa, Mycobacterium
DAVTTSWWKEERGKRLFIDYNQ

SEQ ID NO: 799459 - protein, 20 aa, Mycobacterium
DAVTVLSGLRHGSTLGGPIA

SEQ ID NO: 799460 - protein, 20 aa, Mycobacterium
DAVVATPPMPGRVTRCALGD

SEQ ID NO: 799461 - protein, 22 aa, Mycobacterium
DAVVLRFGLFYGPGASNSDLIM

SEQ ID NO: 799462 - protein, 26 aa, Mycobacterium
DAVVNLNLKGPFRLSALIGERMVADG

SEQ ID NO: 799463 - protein, 19 aa, Mycobacterium
DAVVNLNLKGPFRLSALVG

SEQ ID NO: 799464 - protein, 21 aa, Mycobacterium
DAVVPKVRPIVDAVAARGADA

SEQ ID NO: 799465 - protein, 17 aa, Mycobacterium
DAVVVPGGFSYGDYLRC

SEQ ID NO: 799466 - protein, 21 aa, Mycobacterium
DAVVVPLLLSDAYHARIDLPT

SEQ ID NO: 799467 - protein, 24 aa, Mycobacterium
DAVYRAAKLLGYRPNLAARNLARG

SEQ ID NO: 799468 - protein, 21 aa, Mycobacterium
DAVYYPLYAKCAELELALCIN

SEQ ID NO: 799469 - protein, 19 aa, Mycobacterium
DAWAMIKVTPMIGVNDDPS

SEQ ID NO: 799470 - protein, 17 aa, Mycobacterium
DAWDLLKFLDESSFALD

SEQ ID NO: 799471 - protein, 23 aa, Mycobacterium
DAWKQAHVELPPPGTPVTAPADP

SEQ ID NO: 799472 - protein, 18 aa, Mycobacterium
DAWLARLLAGERSIEVLA

SEQ ID NO: 799473 - protein, 17 aa, Mycobacterium
DAWLARWSRAEAAVPHP

SEQ ID NO: 799474 - protein, 20 aa, Mycobacterium
DAWLLALRSELELAAARLNA

SEQ ID NO: 799475 - protein, 19 aa, Mycobacterium
DAWLTARHDLSDRRNRMRE

SEQ ID NO: 799476 - protein, 21 aa, Mycobacterium
DAWLTPIIMKKGRPAHTLSVL

SEQ ID NO: 799477 - protein, 25 aa, Mycobacterium
DAWRPDTVWRYRLGPGAVSEQVYHE

SEQ ID NO: 799478 - protein, 19 aa, Mycobacterium
DAYALLSRTFLGAAVDFDE

SEQ ID NO: 799479 - protein, 20 aa, Mycobacterium
DAYAPLPQDFPPPPPPVNVC

SEQ ID NO: 799480 - protein, 20 aa, Mycobacterium
DAYDRFVDLPVCDDLALADH

SEQ ID NO: 799481 - protein, 19 aa, Mycobacterium
DAYFALMDHLGTDGLLTAV

SEQ ID NO: 799482 - protein, 21 aa, Mycobacterium
DAYGGTFRLIDKVFTRWNVEY

SEQ ID NO: 799483 - protein, 26 aa, Mycobacterium
DAYGVPILLSALGPAMLRLAGERAGG

SEQ ID NO: 799484 - protein, 26 aa, Mycobacterium
DAYGYDRPLYALGFDTIFAGPAGDFF

SEQ ID NO: 799485 - protein, 18 aa, Mycobacterium
DAYIAMLAESLDKPALVT

SEQ ID NO: 799486 - protein, 18 aa, Mycobacterium
DAYKQRPLLRIWDKHHRP

SEQ ID NO: 799487 - protein, 20 aa, Mycobacterium
DAYLLVTELILTNAPGVTGT

SEQ ID NO: 799488 - protein, 27 aa, Mycobacterium
DAYLRAWEFRPTRAEPLFAIAARYRAD

SEQ ID NO: 799489 - protein, 30 aa, Mycobacterium
DAYLRDRFVQWAFRLRRVGRRAGPHHGARP

SEQ ID NO: 799490 - protein, 21 aa, Mycobacterium
DAYNHYAVGWAHALCAPYQWT

SEQ ID NO: 799491 - protein, 21 aa, Mycobacterium
DAYNLGWKLAAVIYGAPEKLL

SEQ ID NO: 799492 - protein, 18 aa, Mycobacterium
DAYPMFAEAFDAVLAELD

SEQ ID NO: 799493 - protein, 23 aa, Mycobacterium
DAYQRRGIGTMLLTALAIAARTD

SEQ ID NO: 799494 - protein, 22 aa, Mycobacterium
DAYRDRLLVLAALDLAATVENE

SEQ ID NO: 799495 - protein, 20 aa, Mycobacterium
DAYTPLAWWGSDTSRIRLGT

SEQ ID NO: 799496 - protein, 17 aa, Mycobacterium
DAYVVRRLNLPFRDVDW

SEQ ID NO: 799497 - protein, 18 aa, Mycobacterium
DAYVYLAESIRAWPDQAS

SEQ ID NO: 799498 - protein, 18 aa, Mycobacterium
DAYWLLRESISSPDPVIY

SEQ ID NO: 799499 - protein, 18 aa, Mycobacterium
DAYWRAANYLSVGQIYLL

SEQ ID NO: 799500 - protein, 25 aa, Mycobacterium
DAYYEHGLKVWDRAAGALIAAEAGA

SEQ ID NO: 799501 - protein, 32 aa, Mycobacterium
DCADIDAGALRRALTLFRDMDPAVAATVLGAS

SEQ ID NO: 799502 - protein, 22 aa, Mycobacterium
DCAIAARELPVGLALRARLGAI

SEQ ID NO: 799503 - protein, 17 aa, Mycobacterium
DCAIYLAQQGWQVTGVD

SEQ ID NO: 799504 - protein, 21 aa, Mycobacterium
DCALPHWAGVVPLRVTAGAPV

SEQ ID NO: 799505 - protein, 23 aa, Mycobacterium
DCANDLLHMLAEGTFPNIGDLAM

SEQ ID NO: 799506 - protein, 19 aa, Mycobacterium
DCCFHRSVFLPRPAVKLIG

SEQ ID NO: 799507 - protein, 21 aa, Mycobacterium
DCCLWLLRNGVPADAVRWVRP

SEQ ID NO: 799508 - protein, 18 aa, Mycobacterium
DCDEWHFTIFFDQPTPGD

SEQ ID NO: 799509 - protein, 23 aa, Mycobacterium
DCDGQYVLRHSLVIDCIAAQCDC

SEQ ID NO: 799510 - protein, 29 aa, Mycobacterium
DCDPDFTTVIWRKLVLNALAGLMALSGRR

SEQ ID NO: 799511 - protein, 25 aa, Mycobacterium
DCDTLLIVGSNFPYTQFLPEFGQAR

SEQ ID NO: 799512 - protein, 18 aa, Mycobacterium
DCFGIPIITLEDVPGFLP

SEQ ID NO: 799513 - protein, 26 aa, Mycobacterium
DCFNIPIVMLVDVPGFLPGTGQEYNG

SEQ ID NO: 799514 - protein, 23 aa, Mycobacterium
DCFSPELLPHAFVIDCEAVGCAC

SEQ ID NO: 799515 - protein, 25 aa, Mycobacterium
DCFSPELLPHAFVVDCDAVGCGCFE

SEQ ID NO: 799516 - protein, 19 aa, Mycobacterium
DCGGVLLPSLPQGYDNSGF

SEQ ID NO: 799517 - protein, 27 aa, Mycobacterium
DCGLAGTVLRFVPPIAALSAQTVTFDG

SEQ ID NO: 799518 - protein, 18 aa, Mycobacterium
DCGQRYIVLESKALSDCV

SEQ ID NO: 799519 - protein, 23 aa, Mycobacterium
DCGRCRRTIRAIISAHLGGHTAH

SEQ ID NO: 799520 - protein, 19 aa, Mycobacterium
DCGRCRRTVRAIIASSSGD

SEQ ID NO: 799521 - protein, 24 aa, Mycobacterium
DCGSAVVPTYRWPSHLWHGRCEGH

SEQ ID NO: 799522 - protein, 26 aa, Mycobacterium
DCGVERLLFLGSSCIYPKFAEQPIRE

SEQ ID NO: 799523 - protein, 21 aa, Mycobacterium
DCGVRHLWPQPAQAKCPLTLF

SEQ ID NO: 799524 - protein, 18 aa, Mycobacterium
DCHAVLPDFPFAPMRAEH

SEQ ID NO: 799525 - protein, 26 aa, Mycobacterium
DCHDGYRWLRLLGYDPEQIVLAGDSA

SEQ ID NO: 799526 - protein, 17 aa, Mycobacterium
DCHLMIENPDRWAPPYA

SEQ ID NO: 799527 - protein, 19 aa, Mycobacterium
DCILAMPVLADRMLRTARQ

SEQ ID NO: 799528 - protein, 26 aa, Mycobacterium
DCLAGTYLRWVAQNNSPRFTLSTGDG

SEQ ID NO: 799529 - protein, 19 aa, Mycobacterium
DCLELARKLTADFPTIALV

SEQ ID NO: 799530 - protein, 22 aa, Mycobacterium
DCLLLDLDGTLFRGRRATEGAV

SEQ ID NO: 799531 - protein, 17 aa, Mycobacterium
DCLLLDLDGTVFRGHEA

SEQ ID NO: 799532 - protein, 24 aa, Mycobacterium
DCLTAGCWPAWWLSNEDRGEIDIL

SEQ ID NO: 799533 - protein, 18 aa, Mycobacterium
DCPAPRTGIVLAANEFLS

SEQ ID NO: 799534 - protein, 28 aa, Mycobacterium
DCPIPDPLDLLAFLAGHTTSLGLATGVL

SEQ ID NO: 799535 - protein, 26 aa, Mycobacterium
DCPMAPLAPLTLAWVAARRITINGNL

SEQ ID NO: 799536 - protein, 22 aa, Mycobacterium
DCPMAPLSPLTLAWVAANRVTI

SEQ ID NO: 799537 - protein, 20 aa, Mycobacterium
DCPPSLGVLTLNGLTAADEV

SEQ ID NO: 799538 - protein, 22 aa, Mycobacterium
DCPPSLGVLTLNGLTAADEVIV

SEQ ID NO: 799539 - protein, 19 aa, Mycobacterium
DCPVRPAGRWIVDPDGAVV

SEQ ID NO: 799540 - protein, 18 aa, Mycobacterium
DCPYPYFASPVELAASVD

SEQ ID NO: 799541 - protein, 18 aa, Mycobacterium
DCQGLARVDFFLTDDGPV

SEQ ID NO: 799542 - protein, 17 aa, Mycobacterium
DCRFCHVTVTVKQLGPG

SEQ ID NO: 799543 - protein, 23 aa, Mycobacterium
DCRILACSSVFGTWGGYGHAAYA

SEQ ID NO: 799544 - protein, 17 aa, Mycobacterium
DCRIREAAPYAADETRA

SEQ ID NO: 799545 - protein, 29 aa, Mycobacterium
DCRVHGRTWDLLRLTRMPTVQVDVGYISN

SEQ ID NO: 799546 - protein, 25 aa, Mycobacterium
DCSDPARLAGWWAEHFGGTAHELLP

SEQ ID NO: 799547 - protein, 23 aa, Mycobacterium
DCSGLTQWAFAQATDGRIILPRT

SEQ ID NO: 799548 - protein, 18 aa, Mycobacterium
DCSIYLAQHGWRVTAVDF

SEQ ID NO: 799549 - protein, 25 aa, Mycobacterium
DCTDGFGAAFWRRPEAYLDATVRAG

SEQ ID NO: 799550 - protein, 24 aa, Mycobacterium
DCTGYIVQLPLPKHLDENAALERV

SEQ ID NO: 799551 - protein, 22 aa, Mycobacterium
DCTLASRTLLPTLNGPFDDVEA

SEQ ID NO: 799552 - protein, 17 aa, Mycobacterium
DCTPTVYRWRRDKALLD

SEQ ID NO: 799553 - protein, 17 aa, Mycobacterium
DCVFFSAGPPKPSRALL

SEQ ID NO: 799554 - protein, 22 aa, Mycobacterium
DCVFYAPLWSDPDEVCRLLRGG

SEQ ID NO: 799555 - protein, 22 aa, Mycobacterium
DCVFYAPLWSDPEEVCRLLRGG

SEQ ID NO: 799556 - protein, 22 aa, Mycobacterium
DCVFYAPLWSDVDEICRLLRGG

SEQ ID NO: 799557 - protein, 17 aa, Mycobacterium
DCVGNACNGRDGGLIWG

SEQ ID NO: 799558 - protein, 17 aa, Mycobacterium
DCVLLDLHLPDASGMDA

SEQ ID NO: 799559 - protein, 20 aa, Mycobacterium
DCYSALKWLSALPAVDPSRV

SEQ ID NO: 799560 - protein, 24 aa, Mycobacterium
DDAAFIPRVTAILADLRQLEAVAA

SEQ ID NO: 799561 - protein, 20 aa, Mycobacterium
DDAAFLAMDLEFHGRGNLGD

SEQ ID NO: 799562 - protein, 24 aa, Mycobacterium
DDAAFLAMDLEFLGSPELSAFFVD

SEQ ID NO: 799563 - protein, 26 aa, Mycobacterium
DDAAHQLINPDFARPLRPVAAVPQLE

SEQ ID NO: 799564 - protein, 18 aa, Mycobacterium
DDAAIIRIRARSAGLLTA

SEQ ID NO: 799565 - protein, 25 aa, Mycobacterium
DDAALICVPPYHIAGVSAALSNLYA

SEQ ID NO: 799566 - protein, 24 aa, Mycobacterium
DDAALLLQTIPTRGSIPAGVPTDP

SEQ ID NO: 799567 - protein, 21 aa, Mycobacterium
DDAALPLTYRFEPGAADDGVT

SEQ ID NO: 799568 - protein, 20 aa, Mycobacterium
DDAAPLIEFGRRAKREVLHP

SEQ ID NO: 799569 - protein, 25 aa, Mycobacterium
DDAARGLRFAVTVGGLYIDYSKHRV

SEQ ID NO: 799570 - protein, 31 aa, Mycobacterium
DDAASIATWVGFLGFFVNRFEPLTWVEEAIE

SEQ ID NO: 799571 - protein, 23 aa, Mycobacterium
DDAENYLITPVVDVLASLAESNA

SEQ ID NO: 799572 - protein, 38 aa, Mycobacterium
DDAERFAEFYRRWSLVTTRVWPTLLQPLRTRAQMREHV

SEQ ID NO: 799573 - protein, 23 aa, Mycobacterium
DDAFARIAEALPAAARAAAAATP

SEQ ID NO: 799574 - protein, 18 aa, Mycobacterium
DDAGPAIALALNGFGHVV

SEQ ID NO: 799575 - protein, 23 aa, Mycobacterium
DDAGPLSAALLPNGILKTYNGFP

SEQ ID NO: 799576 - protein, 17 aa, Mycobacterium
DDAGRLFVVGRDDEMIV

SEQ ID NO: 799577 - protein, 28 aa, Mycobacterium
DDAGYLVTPVPLLYRPTSNTLVGHVSRA

SEQ ID NO: 799578 - protein, 24 aa, Mycobacterium
DDAILVLSDWMRLLDSGYDWDYPI

SEQ ID NO: 799579 - protein, 28 aa, Mycobacterium
DDAISRWLQMGVGPWFVIRGMTQRVRFR

SEQ ID NO: 799580 - protein, 25 aa, Mycobacterium
DDAIYPALALLPANDIRIIDVWHTD

SEQ ID NO: 799581 - protein, 22 aa, Mycobacterium
DDALLDEFLTLVPDHIPVAVEL

SEQ ID NO: 799582 - protein, 24 aa, Mycobacterium
DDALLVDLDPWGGGLDLLLGAEDA

SEQ ID NO: 799583 - protein, 20 aa, Mycobacterium
DDALLVVLNIDDEPLHVSLP

SEQ ID NO: 799584 - protein, 25 aa, Mycobacterium
DDALRTLILLVLDTGVQVRDALIAG

SEQ ID NO: 799585 - protein, 20 aa, Mycobacterium
DDALWQRFKAAQDRFFAARN

SEQ ID NO: 799586 - protein, 32 aa, Mycobacterium
DDALYEMELVGHDFFLFFDKETERPTVVYRRH

SEQ ID NO: 799587 - protein, 21 aa, Mycobacterium
DDALYEMELVGHDFFLFHDKE

SEQ ID NO: 799588 - protein, 26 aa, Mycobacterium
DDAMDELYRRLFSVLLDEGWTDDIPA

SEQ ID NO: 799589 - protein, 24 aa, Mycobacterium
DDAPNLLIVLIDDAGFGGPDTFGG

SEQ ID NO: 799590 - protein, 24 aa, Mycobacterium
DDAPPARYGPPPWWSSTSSTGYRP

SEQ ID NO: 799591 - protein, 24 aa, Mycobacterium
DDARPILRLFPTEVPTGVGFMKRA

SEQ ID NO: 799592 - protein, 24 aa, Mycobacterium
DDARVGRLLFSTQLADPVVVRKRA

SEQ ID NO: 799593 - protein, 17 aa, Mycobacterium
DDATIACDVGSHYIYMA

SEQ ID NO: 799594 - protein, 27 aa, Mycobacterium
DDAVAGHWLLARLGKRVLRPGGVELTR

SEQ ID NO: 799595 - protein, 24 aa, Mycobacterium
DDAVFWEPFLDRGFSPDSGSTWLV

SEQ ID NO: 799596 - protein, 20 aa, Mycobacterium
DDAVPLAFLAAGSGITPVIG

SEQ ID NO: 799597 - protein, 24 aa, Mycobacterium
DDAVREYLYPIAANRIRGVKLPGP

SEQ ID NO: 799598 - protein, 23 aa, Mycobacterium
DDAVREYLYPIAASRVRGVALPG

SEQ ID NO: 799599 - protein, 19 aa, Mycobacterium
DDAYLDPLQFRADSVLGVA

SEQ ID NO: 799600 - protein, 24 aa, Mycobacterium
DDCDMVFVNLYHQPLGAPMTYRAA

SEQ ID NO: 799601 - protein, 26 aa, Mycobacterium
DDCGGHAIGPHWLSAGGFEATPGDSA

SEQ ID NO: 799602 - protein, 17 aa, Mycobacterium
DDCGVRRAGRWIIDPDG

SEQ ID NO: 799603 - protein, 23 aa, Mycobacterium
DDCLDGYRWLRAQGYAAEQIVLA

SEQ ID NO: 799604 - protein, 24 aa, Mycobacterium
DDCRGHPAWFEPTEWLGGPRAADY

SEQ ID NO: 799605 - protein, 24 aa, Mycobacterium
DDDAAFLHCAFIKAGMPSPLRDEQ

SEQ ID NO: 799606 - protein, 24 aa, Mycobacterium
DDDALFADFVTWTAEILAARGVPA

SEQ ID NO: 799607 - protein, 23 aa, Mycobacterium
DDDALMLTDALPTGYFGAQLGDI

SEQ ID NO: 799608 - protein, 26 aa, Mycobacterium
DDDARLRDLLCTVLTPLDCDIVQAGS

SEQ ID NO: 799609 - protein, 21 aa, Mycobacterium
DDDAWAVFTRWQEAGGPSVEE

SEQ ID NO: 799610 - protein, 26 aa, Mycobacterium
DDDDFGKYPFLVKGYIGPKALRSNDV

SEQ ID NO: 799611 - protein, 28 aa, Mycobacterium
DDDDRRPWLRRVGRWLADHPGGGVISCS

SEQ ID NO: 799612 - protein, 31 aa, Mycobacterium
DDDEALVITHWPPPCRFWNLVVWNQFMATYG

SEQ ID NO: 799613 - protein, 25 aa, Mycobacterium
DDDFDDVFSKLLARPVRLLTSRPDG

SEQ ID NO: 799614 - protein, 19 aa, Mycobacterium
DDDFIEWSVSYSQKPFPDP

SEQ ID NO: 799615 - protein, 37 aa, Mycobacterium
DDDGNIPLVYQYRHPFGRRLWELPAGLLDASGEPAHL

SEQ ID NO: 799616 - protein, 24 aa, Mycobacterium
DDDGSYLRWHLLDHLPEQYQRPGI

SEQ ID NO: 799617 - protein, 26 aa, Mycobacterium
DDDGSYLRWHLLDHMPEQFQLPGIVH

SEQ ID NO: 799618 - protein, 18 aa, Mycobacterium
DDDKYCIDILTQISAASS

SEQ ID NO: 799619 - protein, 24 aa, Mycobacterium
DDDLALIDAYWRAANYLSVGQIYL

SEQ ID NO: 799620 - protein, 23 aa, Mycobacterium
DDDLDVLGYWITSQAPPVMQTCH

SEQ ID NO: 799621 - protein, 23 aa, Mycobacterium
DDDLRPLRPAILYGIDTRASEEI

SEQ ID NO: 799622 - protein, 30 aa, Mycobacterium
DDDMFGALGLDLRRVLHGECGWEYFAPVVV

SEQ ID NO: 799623 - protein, 23 aa, Mycobacterium
DDDNIWYAMPLAQGSLTDYVDTV

SEQ ID NO: 799624 - protein, 22 aa, Mycobacterium
DDDPCLGYVFYAPPRSVPRAVR

SEQ ID NO: 799625 - protein, 23 aa, Mycobacterium
DDDPRWPLLQAERSALITLNVPF

SEQ ID NO: 799626 - protein, 23 aa, Mycobacterium
DDDPYGLLRFAGDPLPTLRELGG

SEQ ID NO: 799627 - protein, 24 aa, Mycobacterium
DDDPYLQVVLQRRLPVVVVDQPKE

SEQ ID NO: 799628 - protein, 25 aa, Mycobacterium
DDDQFMTLAKMRAARQLWARVAEVA

SEQ ID NO: 799629 - protein, 25 aa, Mycobacterium
DDDQFVTLAKMRAVRQLWARVAEVL

SEQ ID NO: 799630 - protein, 25 aa, Mycobacterium
DDDQLAILDIRPFTRGHTLVIPKIH

SEQ ID NO: 799631 - protein, 25 aa, Mycobacterium
DDDRTLLTFTYGTKAPADSSLTVDV

SEQ ID NO: 799632 - protein, 25 aa, Mycobacterium
DDDRYPWLEAIGKWLAEHPAGGVMS

SEQ ID NO: 799633 - protein, 29 aa, Mycobacterium
DDDSPMMFLPGVIVAMWGGQVRSLADHLG

SEQ ID NO: 799634 - protein, 25 aa, Mycobacterium
DDDVARAMPIFDALRPPGDVADGFV

SEQ ID NO: 799635 - protein, 24 aa, Mycobacterium
DDDYLAILDIRPFTRGHTLVIPKR

SEQ ID NO: 799636 - protein, 22 aa, Mycobacterium
DDEAFLLDLLNTTPVVEGVPTD

SEQ ID NO: 799637 - protein, 25 aa, Mycobacterium
DDEALIVEFEAHDGLWMLTNMGVFF

SEQ ID NO: 799638 - protein, 28 aa, Mycobacterium
DDEALLFVELGKRLAPGPFLACTLGARV

SEQ ID NO: 799639 - protein, 24 aa, Mycobacterium
DDEALRPIIRFDGTDYPIGIHPLV

SEQ ID NO: 799640 - protein, 28 aa, Mycobacterium
DDEANIAPWLRAANRYGAKVKWAEVDIE

SEQ ID NO: 799641 - protein, 25 aa, Mycobacterium
DDEEKLLRPLALAPKGIWLGPNELR

SEQ ID NO: 799642 - protein, 24 aa, Mycobacterium
DDEELVLDLLLSEKILVTQGTGFN

SEQ ID NO: 799643 - protein, 24 aa, Mycobacterium
DDEFAAFQKAWFAELHSAGYAVPH

SEQ ID NO: 799644 - protein, 19 aa, Mycobacterium
DDEFGFFVIMLAVAGNETS

SEQ ID NO: 799645 - protein, 28 aa, Mycobacterium
DDEGHLSPRWVGKLMAGALPDHWTAHTL

SEQ ID NO: 799646 - protein, 34 aa, Mycobacterium
DDEGRFWLRTVVPRYYPIPDDGPVGRLLAATKRH

SEQ ID NO: 799647 - protein, 19 aa, Mycobacterium
DDEGYLFIGGRSDDTIIRG

SEQ ID NO: 799648 - protein, 26 aa, Mycobacterium
DDEHIARIAALGRIALVLISHRHGDH

SEQ ID NO: 799649 - protein, 22 aa, Mycobacterium
DDEHWLQFGPGAVGVGWDSGLL

SEQ ID NO: 799650 - protein, 25 aa, Mycobacterium
DDELARIDAYWRAANYLSVGQIYLL

SEQ ID NO: 799651 - protein, 24 aa, Mycobacterium
DDELDVLGYWLTSQAPPVMQICHH

SEQ ID NO: 799652 - protein, 23 aa, Mycobacterium
DDELDVWLISWVPGHATELHDHG

SEQ ID NO: 799653 - protein, 36 aa, Mycobacterium
DDELKWNQQTWRRVLDGGHWLPFSHPQVLAAATAEL

SEQ ID NO: 799654 - protein, 17 aa, Mycobacterium
DDELWVLGTANTPARLV

SEQ ID NO: 799655 - protein, 30 aa, Mycobacterium
DDEPDWVNTIFLSTRFKAWRVGGYNEYLYT

SEQ ID NO: 799656 - protein, 18 aa, Mycobacterium
DDEPQILRALRINLSVRG

SEQ ID NO: 799657 - protein, 24 aa, Mycobacterium
DDEQLVLDLLLQEKILVVQGTGFN

SEQ ID NO: 799658 - protein, 24 aa, Mycobacterium
DDEQYLFQAMRVGASGYLLKSISS

SEQ ID NO: 799659 - protein, 28 aa, Mycobacterium
DDERAAQLAALLGPRWATPHQAYWDAMF

SEQ ID NO: 799660 - protein, 23 aa, Mycobacterium
DDERAWLRARELQKRLYDGGFAG

SEQ ID NO: 799661 - protein, 25 aa, Mycobacterium
DDERFDYMYKFVSTRKIQPGTSAAA

SEQ ID NO: 799662 - protein, 24 aa, Mycobacterium
DDERGRRFLVAAAKIAYVEIGVAD

SEQ ID NO: 799663 - protein, 21 aa, Mycobacterium
DDERHWAFRAVASGNAIAVQN

SEQ ID NO: 799664 - protein, 28 aa, Mycobacterium
DDESGRPLWPMIIMRTPKGWTGPATVDG

SEQ ID NO: 799665 - protein, 32 aa, Mycobacterium
DDETLVRYIDRFLMFYIRTADRLQRTAPWVEQ

SEQ ID NO: 799666 - protein, 24 aa, Mycobacterium
DDEVLPFISIRLWQPISENETEVC

SEQ ID NO: 799667 - protein, 21 aa, Mycobacterium
DDEVMSWIASGPPPICFASGS

SEQ ID NO: 799668 - protein, 24 aa, Mycobacterium
DDEWGRPLYGSAALFERVSLEAFQ

SEQ ID NO: 799669 - protein, 23 aa, Mycobacterium
DDFASRPFDRALVHVFAGLVQQS

SEQ ID NO: 799670 - protein, 25 aa, Mycobacterium
DDFATAWRHGASPLLRALLDAGTVE

SEQ ID NO: 799671 - protein, 21 aa, Mycobacterium
DDFDRERLVPEPAKSAALPGT

SEQ ID NO: 799672 - protein, 21 aa, Mycobacterium
DDFFALFLDPNMVYTCAYFKD

SEQ ID NO: 799673 - protein, 22 aa, Mycobacterium
DDFFALFQDPTRIYSCAYFEPP

SEQ ID NO: 799674 - protein, 20 aa, Mycobacterium
DDFFALFQDPTRTYSCAYFE

SEQ ID NO: 799675 - protein, 21 aa, Mycobacterium
DDFFRLFLDPTMTYSCAYFDR

SEQ ID NO: 799676 - protein, 17 aa, Mycobacterium
DDFFRLFLDPTQTYSCA

SEQ ID NO: 799677 - protein, 19 aa, Mycobacterium
DDFGFFWVTAVTADGEIVV

SEQ ID NO: 799678 - protein, 30 aa, Mycobacterium
DDFLATIAVTRLVLGPKMRVQAPPNLVSRS

SEQ ID NO: 799679 - protein, 20 aa, Mycobacterium
DDFRRAWLTRVAVVAGRAGF

SEQ ID NO: 799680 - protein, 32 aa, Mycobacterium
DDFRVVIFGSNLPAPLRWLERRTRDDLLHPLR

SEQ ID NO: 799681 - protein, 24 aa, Mycobacterium
DDFTDIFDVFPWADGEPVQFGSLT

SEQ ID NO: 799682 - protein, 24 aa, Mycobacterium
DDGALRIRAVPPLPARLADRVGSR

SEQ ID NO: 799683 - protein, 27 aa, Mycobacterium
DDGCSDLFYSIWWPRLPGDDSDVPQGK

SEQ ID NO: 799684 - protein, 22 aa, Mycobacterium
DDGDFFFFARDDDVIIMAGYRI

SEQ ID NO: 799685 - protein, 22 aa, Mycobacterium
DDGDFGYRPLFAAVMDTLRELT

SEQ ID NO: 799686 - protein, 26 aa, Mycobacterium
DDGEFFMVHVALLGPRRPGVSLAPGA

SEQ ID NO: 799687 - protein, 23 aa, Mycobacterium
DDGETLRIVYLLLAGQPDRRVEL

SEQ ID NO: 799688 - protein, 24 aa, Mycobacterium
DDGFVNVVYRWARTGDLSAALAAA

SEQ ID NO: 799689 - protein, 23 aa, Mycobacterium
DDGGFDLLFIADAVGQLDVFGGD

SEQ ID NO: 799690 - protein, 18 aa, Mycobacterium
DDGGHRPFWTYAHVPAGS

SEQ ID NO: 799691 - protein, 25 aa, Mycobacterium
DDGHPVLLESFLDGPEVSLLCIVDG

SEQ ID NO: 799692 - protein, 19 aa, Mycobacterium
DDGIAHHLVRIDDPILRVP

SEQ ID NO: 799693 - protein, 24 aa, Mycobacterium
DDGIALFRRIVDHFPYGELQFDAF

SEQ ID NO: 799694 - protein, 23 aa, Mycobacterium
DDGILMGFGYHRDRDEGQLVLLD

SEQ ID NO: 799695 - protein, 23 aa, Mycobacterium
DDGILMGYGYHRDRDEGQLLLLD

SEQ ID NO: 799696 - protein, 18 aa, Mycobacterium
DDGIPHLPMLRPAHGPAA

SEQ ID NO: 799697 - protein, 21 aa, Mycobacterium
DDGKLHRFVNIYVNDEDVRFS

SEQ ID NO: 799698 - protein, 24 aa, Mycobacterium
DDGKMPMFTVTNPPGTVTVTTCLD

SEQ ID NO: 799699 - protein, 27 aa, Mycobacterium
DDGLAVREILLLRLRALLARAHGDDTT

SEQ ID NO: 799700 - protein, 18 aa, Mycobacterium
DDGLAVVSFAPGYGGRGL

SEQ ID NO: 799701 - protein, 20 aa, Mycobacterium
DDGLPGWRTLPDLLSESDIV

SEQ ID NO: 799702 - protein, 20 aa, Mycobacterium
DDGMLEWRLAGLPVHEGEAV

SEQ ID NO: 799703 - protein, 23 aa, Mycobacterium
DDGNLVLYARDKAVWSTGTNGQD

SEQ ID NO: 799704 - protein, 24 aa, Mycobacterium
DDGNYLRWHLLDHMPEQYQLPGIV

SEQ ID NO: 799705 - protein, 18 aa, Mycobacterium
DDGPGILMVFCTARVYDG

SEQ ID NO: 799706 - protein, 24 aa, Mycobacterium
DDGPIALALVKRGLPAETELMTGG

SEQ ID NO: 799707 - protein, 20 aa, Mycobacterium
DDGPIRLLAQEPTKLFRATV

SEQ ID NO: 799708 - protein, 23 aa, Mycobacterium
DDGQLRALEERLGYLRELDDRRN

SEQ ID NO: 799709 - protein, 23 aa, Mycobacterium
DDGQLVMFVEVLGGALGATTGEM

SEQ ID NO: 799710 - protein, 22 aa, Mycobacterium
DDGREFVITDTVGFVRHLPTQL

SEQ ID NO: 799711 - protein, 18 aa, Mycobacterium
DDGRFRVTRWTIEPGGAI

SEQ ID NO: 799712 - protein, 18 aa, Mycobacterium
DDGRLLARIYSESDLLVA

SEQ ID NO: 799713 - protein, 30 aa, Mycobacterium
DDGRLYVADGTYFYAVLPDGSLHTVGMLFS

SEQ ID NO: 799714 - protein, 25 aa, Mycobacterium
DDGRPGWRPLPELLATSDIVSLHLP

SEQ ID NO: 799715 - protein, 23 aa, Mycobacterium
DDGRRFLAYYERDGVLVGVVGGA

SEQ ID NO: 799716 - protein, 24 aa, Mycobacterium
DDGRRFTELYNVNKLSSAGLLGST

SEQ ID NO: 799717 - protein, 24 aa, Mycobacterium
DDGRRFTELYNVTKLSSAGLLGSS

SEQ ID NO: 799718 - protein, 20 aa, Mycobacterium
DDGRSWRRLLGPLADDCDGV

SEQ ID NO: 799719 - protein, 20 aa, Mycobacterium
DDGRTLLTFAYGTKAPADND

SEQ ID NO: 799720 - protein, 27 aa, Mycobacterium
DDGRYVIGRLIWQAGLLAPVEGPLRHV

SEQ ID NO: 799721 - protein, 31 aa, Mycobacterium
DDGSCEFLKQYAKPFSLLVIADLLGVPEEDH

SEQ ID NO: 799722 - protein, 24 aa, Mycobacterium
DDGSELIFAIHNYVIELADTIIVV

SEQ ID NO: 799723 - protein, 28 aa, Mycobacterium
DDGSFDLALFALSFHHLSPAQAAAVFAE

SEQ ID NO: 799724 - protein, 18 aa, Mycobacterium
DDGSIIEGLYAAGNVSAP

SEQ ID NO: 799725 - protein, 25 aa, Mycobacterium
DDGSYLRWHLLDHMPEQYQLPGIVH

SEQ ID NO: 799726 - protein, 24 aa, Mycobacterium
DDGSYWTGLVFADGKRWPEERTTW

SEQ ID NO: 799727 - protein, 18 aa, Mycobacterium
DDGTIIEGLYAAGNVSAP

SEQ ID NO: 799728 - protein, 24 aa, Mycobacterium
DDGTIPIPSWCNFVDVVAVGGAGG

SEQ ID NO: 799729 - protein, 18 aa, Mycobacterium
DDGWRLHGPIEEWISTAA

SEQ ID NO: 799730 - protein, 27 aa, Mycobacterium
DDGWVRPQLLEYLRTAPDFYFDEMSQI

SEQ ID NO: 799731 - protein, 24 aa, Mycobacterium
DDGYGARFGLLRRDDPFGDVRWFD

SEQ ID NO: 799732 - protein, 23 aa, Mycobacterium
DDGYTHFVELGPHPVLAASILES

SEQ ID NO: 799733 - protein, 28 aa, Mycobacterium
DDHAGKWRVVFFWPKDFTFVCPTEIAAF

SEQ ID NO: 799734 - protein, 28 aa, Mycobacterium
DDHEGKWRVVFFWPKDFTFVCPTEIAAF

SEQ ID NO: 799735 - protein, 30 aa, Mycobacterium
DDHPGKWRVIFFWPKDFTFVCPTEIAAFGR

SEQ ID NO: 799736 - protein, 22 aa, Mycobacterium
DDHQRIFHWTNVILGFGDPDLT

SEQ ID NO: 799737 - protein, 23 aa, Mycobacterium
DDHYLAWVLHHIVADGWSAAGLL

SEQ ID NO: 799738 - protein, 18 aa, Mycobacterium
DDHYVLTADLPGVDPGSV

SEQ ID NO: 799739 - protein, 25 aa, Mycobacterium
DDIAGALAWLVSDEARYITGVALPV

SEQ ID NO: 799740 - protein, 20 aa, Mycobacterium
DDIALFTRISGDRNPLHYDE

SEQ ID NO: 799741 - protein, 31 aa, Mycobacterium
DDIAPPPRPAIPPLLRGYLRLGAQACGEPAH

SEQ ID NO: 799742 - protein, 25 aa, Mycobacterium
DDIELRPPLFIAGLPRTGTTHLHNM

SEQ ID NO: 799743 - protein, 20 aa, Mycobacterium
DDIESLFYHASLLKRLIGEA

SEQ ID NO: 799744 - protein, 17 aa, Mycobacterium
DDIFAMLRAHVSTGGYA

SEQ ID NO: 799745 - protein, 30 aa, Mycobacterium
DDIGFEVLKLSPWVLTARVADQFQAGPCFL

SEQ ID NO: 799746 - protein, 28 aa, Mycobacterium
DDIHLNLRFTDLFQWPKVFGGGGVFSSI

SEQ ID NO: 799747 - protein, 24 aa, Mycobacterium
DDIKKRRGDLPKFLDGVVADPSAG

SEQ ID NO: 799748 - protein, 23 aa, Mycobacterium
DDIKPVLLDVADYAWDKATDEFL

SEQ ID NO: 799749 - protein, 23 aa, Mycobacterium
DDIKTNLLRTEGVSWIAVSAVHV

SEQ ID NO: 799750 - protein, 22 aa, Mycobacterium
DDILLELGFDWDRIIELKTAGA

SEQ ID NO: 799751 - protein, 18 aa, Mycobacterium
DDILVRLTAFMIEHGLAV

SEQ ID NO: 799752 - protein, 19 aa, Mycobacterium
DDINFLTLNAFFTSIGGGT

SEQ ID NO: 799753 - protein, 21 aa, Mycobacterium
DDIRPQGLLHMAVVRSTRAHA

SEQ ID NO: 799754 - protein, 23 aa, Mycobacterium
DDISGVVAFLASDDARWITGQWL

SEQ ID NO: 799755 - protein, 32 aa, Mycobacterium
DDIVRHFFVSSTHDWILFFTTQGRVYRAKAYE

SEQ ID NO: 799756 - protein, 23 aa, Mycobacterium
DDKARALRVIDWFVSATAERRYE

SEQ ID NO: 799757 - protein, 23 aa, Mycobacterium
DDKAWYIEHRFLSTERAKAVTRG

SEQ ID NO: 799758 - protein, 22 aa, Mycobacterium
DDKAWYIEHRYLSTDRAKAVTR

SEQ ID NO: 799759 - protein, 18 aa, Mycobacterium
DDKFLGYLTERRREPRGD

SEQ ID NO: 799760 - protein, 24 aa, Mycobacterium
DDKKPAMTLPPDLQAASALDTGAG

SEQ ID NO: 799761 - protein, 23 aa, Mycobacterium
DDKLARWLTEQPVYFVGTAPSGS

SEQ ID NO: 799762 - protein, 23 aa, Mycobacterium
DDKRLTRRIVSEAGITVPKGRLA

SEQ ID NO: 799763 - protein, 20 aa, Mycobacterium
DDKRLTRRLVKEAGINVPRV

SEQ ID NO: 799764 - protein, 20 aa, Mycobacterium
DDKTLFREFGFTPEAVAAAA

SEQ ID NO: 799765 - protein, 23 aa, Mycobacterium
DDKVDYLVTELDKLGLPSNPSNW

SEQ ID NO: 799766 - protein, 18 aa, Mycobacterium
DDKVQLALAWISCQNYTA

SEQ ID NO: 799767 - protein, 17 aa, Mycobacterium
DDLAAQMVRAALDKVPS

SEQ ID NO: 799768 - protein, 17 aa, Mycobacterium
DDLAHKVLAVPIAQRRA

SEQ ID NO: 799769 - protein, 20 aa, Mycobacterium
DDLAKIDTKLFVPLETTPWT

SEQ ID NO: 799770 - protein, 25 aa, Mycobacterium
DDLALLPVDSIPVPGPVGILDALAA

SEQ ID NO: 799771 - protein, 24 aa, Mycobacterium
DDLARLYHDLMFGKGLACVRGFPV

SEQ ID NO: 799772 - protein, 23 aa, Mycobacterium
DDLDAETLYRFIKALSGVAKETV

SEQ ID NO: 799773 - protein, 24 aa, Mycobacterium
DDLDFLRLAVLDALLVLRADAEPV

SEQ ID NO: 799774 - protein, 19 aa, Mycobacterium
DDLDRVFTPDAYIDYTALG

SEQ ID NO: 799775 - protein, 21 aa, Mycobacterium
DDLDVLGYWVTSQAPPVMQLC

SEQ ID NO: 799776 - protein, 26 aa, Mycobacterium
DDLDVSLLRPGVVVLVAFDPAAREEL

SEQ ID NO: 799777 - protein, 25 aa, Mycobacterium
DDLGAKGFPRLLRVSARLPATGSNK

SEQ ID NO: 799778 - protein, 25 aa, Mycobacterium
DDLGEFVAWLRLPLQARHGQVAVLP

SEQ ID NO: 799779 - protein, 24 aa, Mycobacterium
DDLGELLWSFAPSDRMTRPRPASL

SEQ ID NO: 799780 - protein, 23 aa, Mycobacterium
DDLGPVWVFSGQGSQWAAMGADL

SEQ ID NO: 799781 - protein, 23 aa, Mycobacterium
DDLHCTISVPMVDAALGCTVTVD

SEQ ID NO: 799782 - protein, 25 aa, Mycobacterium
DDLHRAISTFARMDAVLITAVNGVA

SEQ ID NO: 799783 - protein, 26 aa, Mycobacterium
DDLHRHLFSVLMDREWKYGVAAAVDV

SEQ ID NO: 799784 - protein, 25 aa, Mycobacterium
DDLHRHLFTVLMDREWKYGVAAAVD

SEQ ID NO: 799785 - protein, 26 aa, Mycobacterium
DDLILKHDPASFRRGRASRRGRYFDI

SEQ ID NO: 799786 - protein, 17 aa, Mycobacterium
DDLKDYAPRIWYEDGAY

SEQ ID NO: 799787 - protein, 19 aa, Mycobacterium
DDLKVLPGIRIYLGDTDEQ

SEQ ID NO: 799788 - protein, 20 aa, Mycobacterium
DDLKVWRRRVDAFQSQLRRD

SEQ ID NO: 799789 - protein, 34 aa, Mycobacterium
DDLLALFAHALGLPANPFVALADRPTWTMNINHY

SEQ ID NO: 799790 - protein, 36 aa, Mycobacterium
DDLLARLRLPIPEVTTPQMFTYQLLDRARADRKRIV

SEQ ID NO: 799791 - protein, 19 aa, Mycobacterium
DDLLLRYGVAQPAEPQRRT

SEQ ID NO: 799792 - protein, 22 aa, Mycobacterium
DDLLSQWVTYGAGGGFALGLDS

SEQ ID NO: 799793 - protein, 29 aa, Mycobacterium
DDLLTATLLTARCPVLFAPAMHTEMWLHP

SEQ ID NO: 799794 - protein, 25 aa, Mycobacterium
DDLLTATLLTARCPVMFAPAMHTEM

SEQ ID NO: 799795 - protein, 29 aa, Mycobacterium
DDLLTATLLTATCPVLFAPAMHTEMWLHP

SEQ ID NO: 799796 - protein, 26 aa, Mycobacterium
DDLLTRLHLARQRPQWRRRVLGPDSP

SEQ ID NO: 799797 - protein, 22 aa, Mycobacterium
DDLMWLVCQRRWGPKQVIDLRP

SEQ ID NO: 799798 - protein, 26 aa, Mycobacterium
DDLNPQHRALRKMIPDVYRGFAETSN

SEQ ID NO: 799799 - protein, 24 aa, Mycobacterium
DDLNPYARIIADEAIRRGIWVEVL

SEQ ID NO: 799800 - protein, 20 aa, Mycobacterium
DDLPPRTRLPALRQVWTAER

SEQ ID NO: 799801 - protein, 22 aa, Mycobacterium
DDLPTLIRTLTGTTALVLTGDP

SEQ ID NO: 799802 - protein, 18 aa, Mycobacterium
DDLQAVIAMLKNADLDVA

SEQ ID NO: 799803 - protein, 23 aa, Mycobacterium
DDLRAGLRMNIIANPGVEKANFE

SEQ ID NO: 799804 - protein, 22 aa, Mycobacterium
DDLRCGGAPMVPIGAERSGEPD

SEQ ID NO: 799805 - protein, 21 aa, Mycobacterium
DDLRDIVLGIVRERPLEPVAR

SEQ ID NO: 799806 - protein, 19 aa, Mycobacterium
DDLRLFAAIVDAARSYAAG

SEQ ID NO: 799807 - protein, 18 aa, Mycobacterium
DDLRVPMRFGEELAMLIP

SEQ ID NO: 799808 - protein, 21 aa, Mycobacterium
DDLRWLILGVHHAASINIAGS

SEQ ID NO: 799809 - protein, 20 aa, Mycobacterium
DDLRWWPADALPDGTDHALA

SEQ ID NO: 799810 - protein, 31 aa, Mycobacterium
DDLTAIFAVLYWRMLTPPPLDRLPTVGNRRY

SEQ ID NO: 799811 - protein, 21 aa, Mycobacterium
DDLTELWVRPAQSLPAVAEDL

SEQ ID NO: 799812 - protein, 27 aa, Mycobacterium
DDLTLTVPVSFTELALGATISVPTLEG

SEQ ID NO: 799813 - protein, 23 aa, Mycobacterium
DDLTPAWLAGPTEVLAALSIESG

SEQ ID NO: 799814 - protein, 21 aa, Mycobacterium
DDLTYCSLRLDPDSLQTVLSR

SEQ ID NO: 799815 - protein, 22 aa, Mycobacterium
DDLVASLLLVHGLHPHDVHRRV

SEQ ID NO: 799816 - protein, 23 aa, Mycobacterium
DDLVGALSVIRPLSRSASEEVAV

SEQ ID NO: 799817 - protein, 36 aa, Mycobacterium
DDLVLYFCEAITRCWKQIIHFTPKFTAPEPESVAKR

SEQ ID NO: 799818 - protein, 21 aa, Mycobacterium
DDLVPLLQRAGRFRTRYREGE

SEQ ID NO: 799819 - protein, 22 aa, Mycobacterium
DDLVRLQRVSVLIEAGINLAGI

SEQ ID NO: 799820 - protein, 24 aa, Mycobacterium
DDLVRQRFGRLGFPAGFADAYLAM

SEQ ID NO: 799821 - protein, 18 aa, Mycobacterium
DDLVWPRGVLETMAKVRA

SEQ ID NO: 799822 - protein, 22 aa, Mycobacterium
DDLYNLVYDPAFLTLAWERVRT

SEQ ID NO: 799823 - protein, 21 aa, Mycobacterium
DDLYPFVLPVAVLEKMRFIHT

SEQ ID NO: 799824 - protein, 38 aa, Mycobacterium
DDMAPICQMFHTLPIPWVEPIDISNAVLFLASDEARYI

SEQ ID NO: 799825 - protein, 29 aa, Mycobacterium
DDMFGALGLDLRRVLHGECGWEYFAPVVV

SEQ ID NO: 799826 - protein, 23 aa, Mycobacterium
DDMFRSLQALAQLPGDPTVFPGH

SEQ ID NO: 799827 - protein, 24 aa, Mycobacterium
DDMGRAILALYRSATQPAMAEAGR

SEQ ID NO: 799828 - protein, 19 aa, Mycobacterium
DDMHLRRNRWTPLGAYGRA

SEQ ID NO: 799829 - protein, 17 aa, Mycobacterium
DDMLSPMESTDSDDVLN

SEQ ID NO: 799830 - protein, 25 aa, Mycobacterium
DDMQRATVYLPRATVRGLKQAALDQ

SEQ ID NO: 799831 - protein, 33 aa, Mycobacterium
DDMRDWTISRQLWWGHRIPIWYGPNGEQVCVGP

SEQ ID NO: 799832 - protein, 22 aa, Mycobacterium
DDMWGFARHNVVPDLVTMGKPM

SEQ ID NO: 799833 - protein, 25 aa, Mycobacterium
DDNCLAILDIRPFTRGHTLVLPKKH

SEQ ID NO: 799834 - protein, 20 aa, Mycobacterium
DDNERLIPYRASRSAFAFRD

SEQ ID NO: 799835 - protein, 17 aa, Mycobacterium
DDNHPDLPGWLRRRRPA

SEQ ID NO: 799836 - protein, 34 aa, Mycobacterium
DDNNLARRILDARLMWVWLATHEYFMVDVDAATA

SEQ ID NO: 799837 - protein, 26 aa, Mycobacterium
DDNNPVWFLAHLLESIRRVHPGVAES

SEQ ID NO: 799838 - protein, 28 aa, Mycobacterium
DDNNVVWFLAHLLESIRQVRPALAASLG

SEQ ID NO: 799839 - protein, 19 aa, Mycobacterium
DDNPYPVWRRMRDEAPLYY

SEQ ID NO: 799840 - protein, 18 aa, Mycobacterium
DDNYLYYSGNEKAYPYVD

SEQ ID NO: 799841 - protein, 20 aa, Mycobacterium
DDPAFRQVFAAQFLPDGTRA

SEQ ID NO: 799842 - protein, 24 aa, Mycobacterium
DDPAIWDHPIIHPHTADPDHHGFG

SEQ ID NO: 799843 - protein, 37 aa, Mycobacterium; identical to SEQ ID NO: 119391

SEQ ID NO: 799844 - protein, 32 aa, Mycobacterium
DDPAKLALPQWYAQNGQFVTTKFFGMKANKYI

SEQ ID NO: 799845 - protein, 18 aa, Mycobacterium
DDPALRFELCLGVSGVHY

SEQ ID NO: 799846 - protein, 24 aa, Mycobacterium
DDPAPPAILFLTAGSGITPIMSML

SEQ ID NO: 799847 - protein, 40 aa, Mycobacterium
DDPAQLLDVWRPKELPAQPAPVLLFVPGGAWVHGSRVLQG

SEQ ID NO: 799848 - protein, 24 aa, Mycobacterium
DDPARKWFTAIDSDTLLIIDEAGM

SEQ ID NO: 799849 - protein, 24 aa, Mycobacterium
DDPATVRRYVRTFVLPAIVASPPD

SEQ ID NO: 799850 - protein, 23 aa, Mycobacterium
DDPDGLVSLTLGFDGRLLEVRIA

SEQ ID NO: 799851 - protein, 19 aa, Mycobacterium
DDPDWLLDLVTRLTDRHEA

SEQ ID NO: 799852 - protein, 31 aa, Mycobacterium
DDPEAIAGGWWQDAFLYSRALTIAGGANEVL

SEQ ID NO: 799853 - protein, 29 aa, Mycobacterium
DDPEHRIYRTVLNPYLSPAAVKRWEPFID

SEQ ID NO: 799854 - protein, 25 aa, Mycobacterium
DDPEIRAPWSLSKPKRRSSPSSRLG

SEQ ID NO: 799855 - protein, 23 aa, Mycobacterium
DDPELVPDEWVSYALRPAQIEFW

SEQ ID NO: 799856 - protein, 26 aa, Mycobacterium
DDPEQVVLALYRYLGRTPSRLLGVAL

SEQ ID NO: 799857 - protein, 17 aa, Mycobacterium
DDPFTFDVLNRLAAQHN

SEQ ID NO: 799858 - protein, 26 aa, Mycobacterium
DDPGPVRRLIATLPALEVPRPDWPAE

SEQ ID NO: 799859 - protein, 27 aa, Mycobacterium
DDPHEIGPVDYVFLGLKAHSYPSCGPL

SEQ ID NO: 799860 - protein, 32 aa, Mycobacterium
DDPHKVAMLGLTFDDVLLLPAASDVLPAGADT

SEQ ID NO: 799861 - protein, 24 aa, Mycobacterium
DDPHPMRFYNALGAIRAVLQDNRD

SEQ ID NO: 799862 - protein, 24 aa, Mycobacterium
DDPIDRFLATFALMLRRVSLSATE

SEQ ID NO: 799863 - protein, 18 aa, Mycobacterium
DDPIGDLAALWQVWQPQK

SEQ ID NO: 799864 - protein, 24 aa, Mycobacterium
DDPKHRVLRAIGADWFRPKAMRDM

SEQ ID NO: 799865 - protein, 20 aa, Mycobacterium
DDPLAALWQLNSDPALTVLN

SEQ ID NO: 799866 - protein, 24 aa, Mycobacterium
DDPLAFERLVALRLIRIDGTQAII

SEQ ID NO: 799867 - protein, 19 aa, Mycobacterium
DDPLLIHIVVHALNEWLHE

SEQ ID NO: 799868 - protein, 26 aa, Mycobacterium
DDPLPDEVLWRIFDNARFAPSGGNRQ

SEQ ID NO: 799869 - protein, 24 aa, Mycobacterium
DDPLPFSVVPARRPLDVSGPQELT

SEQ ID NO: 799870 - protein, 22 aa, Mycobacterium
DDPLQAALLFDKALVIWSGEPF

SEQ ID NO: 799871 - protein, 26 aa, Mycobacterium
DDPPHDEWQPLPTWFGRLNGAGVSAR

SEQ ID NO: 799872 - protein, 19 aa, Mycobacterium
DDPPHWFEHVPGKPQIRAS

SEQ ID NO: 799873 - protein, 27 aa, Mycobacterium
DDPQQVVLALYKYLGRTPSRLLGLALT

SEQ ID NO: 799874 - protein, 19 aa, Mycobacterium
DDPRFCDVLPLIQNADAAA

SEQ ID NO: 799875 - protein, 23 aa, Mycobacterium
DDPRIWPNIVAAQLDWDLELIGR

SEQ ID NO: 799876 - protein, 23 aa, Mycobacterium
DDPRIWPNIVAAQLDWDVELIGR

SEQ ID NO: 799877 - protein, 23 aa, Mycobacterium
DDPRIWPNLVAGQLDWDVELIGR

SEQ ID NO: 799878 - protein, 23 aa, Mycobacterium
DDPRNVFWTTGSVSRAGGILAMD

SEQ ID NO: 799879 - protein, 27 aa, Mycobacterium
DDPRRVTDRLPCYALYTDPPLGRVGMT

SEQ ID NO: 799880 - protein, 17 aa, Mycobacterium
DDPRWRLLDPGELVHVD

SEQ ID NO: 799881 - protein, 25 aa, Mycobacterium
DDPRYIHALGSFGRALGFAGEAARA

SEQ ID NO: 799882 - protein, 29 aa, Mycobacterium
DDPTKIAMLGLTFDDVLLLPAASDVIPAT

SEQ ID NO: 799883 - protein, 29 aa, Mycobacterium
DDPTKVAMLGLTFDDVLLLPAASDVVPAT

SEQ ID NO: 799884 - protein, 26 aa, Mycobacterium
DDPTQNAWWWDLLAHGRSSTYCSYFD

SEQ ID NO: 799885 - protein, 24 aa, Mycobacterium
DDPVIREKLIPRYGLGCKRPSMSN

SEQ ID NO: 799886 - protein, 22 aa, Mycobacterium
DDPVLHICALAYMSDLTLLSSS

SEQ ID NO: 799887 - protein, 24 aa, Mycobacterium
DDPVRLSLHLGRRHRIGGLPGYVA

SEQ ID NO: 799888 - protein, 18 aa, Mycobacterium
DDPYTFYEALRNKCPVAK

SEQ ID NO: 799889 - protein, 18 aa, Mycobacterium
DDQGWMRKTSAVRDALYR

SEQ ID NO: 799890 - protein, 24 aa, Mycobacterium
DDQIAFTYARIVRELRRRGELIGS

SEQ ID NO: 799891 - protein, 24 aa, Mycobacterium
DDQIVRLAFSMSGPPYLELIEVVP

SEQ ID NO: 799892 - protein, 24 aa, Mycobacterium
DDQRHVVCWIGWDPALSRDAELRF

SEQ ID NO: 799893 - protein, 33 aa, Mycobacterium
DDQRLRRLLMFVARQEPRLNWAIGQRPEGTVLV

SEQ ID NO: 799894 - protein, 24 aa, Mycobacterium
DDQRTGFDCGGLVRYSTQQGAGYD

SEQ ID NO: 799895 - protein, 24 aa, Mycobacterium
DDQRTLFLPPYVAYGFQTQVDDTE

SEQ ID NO: 799896 - protein, 32 aa, Mycobacterium
DDQSWRYKDLSYWTNLATLLERGRFDGLFIAD

SEQ ID NO: 799897 - protein, 37 aa, Mycobacterium
DDQVGAFQALRGRGRRPLIANPFQSCAGRRQLVRVGL

SEQ ID NO: 799898 - protein, 19 aa, Mycobacterium
DDQVRFLPGWFKDTLQDAP

SEQ ID NO: 799899 - protein, 25 aa, Mycobacterium
DDRAYKPLNWMSPPCWLTEETGDQA

SEQ ID NO: 799900 - protein, 17 aa, Mycobacterium
DDRDDLPRIIRAGKHLA

SEQ ID NO: 799901 - protein, 26 aa, Mycobacterium
DDRDKWADRFKKVGHFIERNAKGDRL

SEQ ID NO: 799902 - protein, 18 aa, Mycobacterium
DDRDSLTVYLRFPREHWP

SEQ ID NO: 799903 - protein, 22 aa, Mycobacterium
DDRFLLSVTFRLGRLGVPVVAE

SEQ ID NO: 799904 - protein, 22 aa, Mycobacterium
DDRFRWSFAGARRLKGIKGDVK

SEQ ID NO: 799905 - protein, 22 aa, Mycobacterium
DDRGPVWLFSGQGSQWAGMGAE

SEQ ID NO: 799906 - protein, 23 aa, Mycobacterium
DDRGRMVLPLTGGYEIAPRMALP

SEQ ID NO: 799907 - protein, 17 aa, Mycobacterium
DDRGTVYLSTAGGYFAL

SEQ ID NO: 799908 - protein, 17 aa, Mycobacterium
DDRIADRPAITYREVRA

SEQ ID NO: 799909 - protein, 25 aa, Mycobacterium
DDRICIPAPFYHCFGMVLGNLAATS

SEQ ID NO: 799910 - protein, 24 aa, Mycobacterium
DDRIVTWLVDKFKGSSGIDLTKDK

SEQ ID NO: 799911 - protein, 24 aa, Mycobacterium
DDRIVTWLVDKFKGTSGIDLTKDK

SEQ ID NO: 799912 - protein, 23 aa, Mycobacterium
DDRLAYLDQAAFLGLRAGYGSLI

SEQ ID NO: 799913 - protein, 23 aa, Mycobacterium
DDRLLVTVLIGHLSLAIGHVRQF

SEQ ID NO: 799914 - protein, 36 aa, Mycobacterium
DDRLTIHDYLWRWDSDWFWCSRAFGVQDPRLRRWWP

SEQ ID NO: 799915 - protein, 25 aa, Mycobacterium
DDRMRHGMFWSGDLAYRDADGWIYL

SEQ ID NO: 799916 - protein, 30 aa, Mycobacterium
DDRMRSYLIGIARLDFLPAPVSALFGGWNL

SEQ ID NO: 799917 - protein, 18 aa, Mycobacterium
DDRPALKKAGFLTRDPRA

SEQ ID NO: 799918 - protein, 17 aa, Mycobacterium
DDRPIYGLQAWNFYHTA

SEQ ID NO: 799919 - protein, 24 aa, Mycobacterium
DDRQLPVRRRADVTWVDRADAGDA

SEQ ID NO: 799920 - protein, 21 aa, Mycobacterium
DDRRERFVELTDAVWRVRAYG

SEQ ID NO: 799921 - protein, 25 aa, Mycobacterium
DDRRTLLWLANQRAVEYHPALGLAD

SEQ ID NO: 799922 - protein, 25 aa, Mycobacterium
DDRRTLLWLANQRAVEYHPALGPAD

SEQ ID NO: 799923 - protein, 17 aa, Mycobacterium
DDRSLIPGFIEESLRMD

SEQ ID NO: 799924 - protein, 23 aa, Mycobacterium
DDRTGLRARWDALQASFVDNPKQ

SEQ ID NO: 799925 - protein, 25 aa, Mycobacterium
DDRTGPLIVEWLAKRGYDVTEQMVV

SEQ ID NO: 799926 - protein, 29 aa, Mycobacterium
DDRTGSFIYPIPELIAHLSRYQTLQPGDV

SEQ ID NO: 799927 - protein, 23 aa, Mycobacterium
DDRTVAFYPPAFSAAAQAQLRAL

SEQ ID NO: 799928 - protein, 22 aa, Mycobacterium
DDRVMLADPLAGIGPGLGQFIQ

SEQ ID NO: 799929 - protein, 26 aa, Mycobacterium
DDRVVAKCFLLWAAVVGAISLEVFGQ

SEQ ID NO: 799930 - protein, 17 aa, Mycobacterium
DDRYMRTLDPWVSLGTA

SEQ ID NO: 799931 - protein, 21 aa, Mycobacterium
DDRYPWLDKVGEWLAAHRDGG

SEQ ID NO: 799932 - protein, 20 aa, Mycobacterium
DDSFLLCFNAHDEPLEFVAP

SEQ ID NO: 799933 - protein, 25 aa, Mycobacterium
DDSFTPVFLRNATAFGFSPRLRADI

SEQ ID NO: 799934 - protein, 23 aa, Mycobacterium
DDSGLMELTWAPITLPEGRAGRI

SEQ ID NO: 799935 - protein, 23 aa, Mycobacterium
DDSGWFEVQPRFGRAMITALARL

SEQ ID NO: 799936 - protein, 21 aa, Mycobacterium
DDSIILEDVPIMALSPIVNTR

SEQ ID NO: 799937 - protein, 24 aa, Mycobacterium
DDSIPNRWLVRPGALRPRHWDVEP

SEQ ID NO: 799938 - protein, 37 aa, Mycobacterium
DDSIRSVSWLPLYHDMGLLMILFPLCGGRITLMSPVS

SEQ ID NO: 799939 - protein, 22 aa, Mycobacterium
DDSLALLIYTSGSTGAPKGAMY

SEQ ID NO: 799940 - protein, 21 aa, Mycobacterium
DDSLLELLNTKIRALPGVIST

SEQ ID NO: 799941 - protein, 21 aa, Mycobacterium
DDSRLRWLRRGEVPTLGNWFR

SEQ ID NO: 799942 - protein, 24 aa, Mycobacterium
DDSRRLLMMIGKDLGLDTKRYSPR

SEQ ID NO: 799943 - protein, 24 aa, Mycobacterium
DDSTIRDFVPLLVERRVTTELEGA

SEQ ID NO: 799944 - protein, 21 aa, Mycobacterium
DDSWKIFFDDLSAAYNHGPQP

SEQ ID NO: 799945 - protein, 17 aa, Mycobacterium
DDSWNFTEVFRLPIQMA

SEQ ID NO: 799946 - protein, 23 aa, Mycobacterium
DDTAKAALLFALETDLPVIVDAD

SEQ ID NO: 799947 - protein, 26 aa, Mycobacterium
DDTAPPRLYLSRYAGASRPRLAAPKP

SEQ ID NO: 799948 - protein, 22 aa, Mycobacterium
DDTEGYDFVLMDCPPALGELTT

SEQ ID NO: 799949 - protein, 25 aa, Mycobacterium
DDTFAAIAGLLRRGNRYATAANALI

SEQ ID NO: 799950 - protein, 21 aa, Mycobacterium
DDTIRLGQFLKLANLIDSGAD

SEQ ID NO: 799951 - protein, 28 aa, Mycobacterium
DDTNLRRLIGLFEMLRDRSQLIIITHQK

SEQ ID NO: 799952 - protein, 26 aa, Mycobacterium
DDTNLRRLLGLFEQLRDRSQLIIITH

SEQ ID NO: 799953 - protein, 22 aa, Mycobacterium
DDTPLWLFADQLGPAVHGGEHA

SEQ ID NO: 799954 - protein, 34 aa, Mycobacterium
DDTPTLMLLDGNSLAFRAFYALPAENFKTQGGLT

SEQ ID NO: 799955 - protein, 24 aa, Mycobacterium
DDTPWRTEYLYSRAATIYGGTAEV

SEQ ID NO: 799956 - protein, 24 aa, Mycobacterium
DDTRLALFTLRRNLTFHAVDLALM

SEQ ID NO: 799957 - protein, 25 aa, Mycobacterium
DDTSKATLMAAWTSLYNASKQEASS

SEQ ID NO: 799958 - protein, 25 aa, Mycobacterium
DDTVLARLYGWHRAMRIFDGPDEVH

SEQ ID NO: 799959 - protein, 25 aa, Mycobacterium
DDTVPARRREWPSPMLPALEALPVD

SEQ ID NO: 799960 - protein, 24 aa, Mycobacterium
DDTVPKFMDGLLDIARDGVDRAVS

SEQ ID NO: 799961 - protein, 35 aa, Mycobacterium
DDTVREYLYPIAASRLRGLRLPGPLQRRNEELALL

SEQ ID NO: 799962 - protein, 18 aa, Mycobacterium
DDVAEPPPPPPRWRPRPA

SEQ ID NO: 799963 - protein, 26 aa, Mycobacterium
DDVANAVAWLVSDQARYVTGVTLPVD

SEQ ID NO: 799964 - protein, 24 aa, Mycobacterium
DDVAQLPPWLGSTFRRSAVLRYGE

SEQ ID NO: 799965 - protein, 25 aa, Mycobacterium
DDVARAVAFLVSEDARFITGEALSV

SEQ ID NO: 799966 - protein, 25 aa, Mycobacterium
DDVARAYIIYRQRRAELRAGKALLG

SEQ ID NO: 799967 - protein, 28 aa, Mycobacterium
DDVDRIVVHLAPWLEPEPICLAIKHVRV

SEQ ID NO: 799968 - protein, 23 aa, Mycobacterium
DDVDRVTFVFGPNRLAPPVGPVT

SEQ ID NO: 799969 - protein, 26 aa, Mycobacterium
DDVENYLLTPYVDVLAALAESAAPAG

SEQ ID NO: 799970 - protein, 24 aa, Mycobacterium
DDVEPYLQRACDWAVCGRAAFNAR

SEQ ID NO: 799971 - protein, 20 aa, Mycobacterium
DDVFVALSWTKHPAPQTYEE

SEQ ID NO: 799972 - protein, 23 aa, Mycobacterium
DDVGAPRRALFDALTGFLRRLSV

SEQ ID NO: 799973 - protein, 35 aa, Mycobacterium
DDVGHWPTLFDDDALTAALFGLGAFIEKAGTGGGL

SEQ ID NO: 799974 - protein, 20 aa, Mycobacterium
DDVIFCSFGDMLRVPGSHQD

SEQ ID NO: 799975 - protein, 28 aa, Mycobacterium
DDVIGYRIDPVLARSWLLVNGAHADRFQ

SEQ ID NO: 799976 - protein, 22 aa, Mycobacterium
DDVILHTYFTPETLQRAVKTVK

SEQ ID NO: 799977 - protein, 17 aa, Mycobacterium
DDVILHTYFTPETLQRS

SEQ ID NO: 799978 - protein, 23 aa, Mycobacterium
DDVKPMSSAERRAILSFLESGVD

SEQ ID NO: 799979 - protein, 18 aa, Mycobacterium
DDVLGTWFAVLCWNNNPR

SEQ ID NO: 799980 - protein, 18 aa, Mycobacterium
DDVLLLLEAIRAGDGFLA

SEQ ID NO: 799981 - protein, 19 aa, Mycobacterium
DDVLNLLHLVYSMIMVSMA

SEQ ID NO: 799982 - protein, 18 aa, Mycobacterium
DDVLPMNFAPPIGPELVS

SEQ ID NO: 799983 - protein, 19 aa, Mycobacterium
DDVLRAFDPQGCTFTGVIT

SEQ ID NO: 799984 - protein, 24 aa, Mycobacterium
DDVLRLGLHRLAITEFPQVRALAP

SEQ ID NO: 799985 - protein, 18 aa, Mycobacterium
DDVLRRAVRLLAQLTRQV

SEQ ID NO: 799986 - protein, 17 aa, Mycobacterium
DDVLRYVVALRGRDAPP

SEQ ID NO: 799987 - protein, 33 aa, Mycobacterium
DDVLVHGLPLFHVHGLVLGLLGSLRMGNRFVHT

SEQ ID NO: 799988 - protein, 33 aa, Mycobacterium
DDVLVHGLPLFHVHGLVLGLLGSLRVGNRFIHT

SEQ ID NO: 799989 - protein, 23 aa, Mycobacterium
DDVMRNWRFLQQNDVQILHGPGR

SEQ ID NO: 799990 - protein, 24 aa, Mycobacterium
DDVPDDVLQCYLELVLDGLVARLA

SEQ ID NO: 799991 - protein, 35 aa, Mycobacterium
DDVPDHQRWLGTRLPFYANWIRLKSYWGTADNNYP

SEQ ID NO: 799992 - protein, 25 aa, Mycobacterium
DDVRRYLSYFPPSAWSYPSPQPTGA

SEQ ID NO: 799993 - protein, 24 aa, Mycobacterium
DDVRTAWMSVHPQFDGNRITGYAA

SEQ ID NO: 799994 - protein, 22 aa, Mycobacterium
DDVRVRPLRPENAAYLIYTSGS

SEQ ID NO: 799995 - protein, 18 aa, Mycobacterium
DDVRWELGRFGKLNVRHG

SEQ ID NO: 799996 - protein, 25 aa, Mycobacterium
DDVSQLVYLHLRFHGYGEGKWTDSA

SEQ ID NO: 799997 - protein, 29 aa, Mycobacterium
DDVSTFDLYSCFPVPVFNFCDGTGLATDD

SEQ ID NO: 799998 - protein, 27 aa, Mycobacterium
DDVSTFDLYSCFPVPVFNFCDGTQLAT

SEQ ID NO: 799999 - protein, 25 aa, Mycobacterium
DDVTSKHRTLPLGSLLIVDDDHALT

SEQ ID NO: 800000 - protein, 22 aa, Mycobacterium
DDVTSVFRYYANLVASEAERVV

SEQ ID NO: 800001 - protein, 25 aa, Mycobacterium
DDVTTIWGLLLPPDAAAYTARIAAL

SEQ ID NO: 800002 - protein, 28 aa, Mycobacterium
DDVVALTREVLGAGIPLFGICFGNQILG

SEQ ID NO: 800003 - protein, 17 aa, Mycobacterium
DDVVDRMRWLEAETSRA

SEQ ID NO: 800004 - protein, 22 aa, Mycobacterium
DDVVPFISIRTWQPINEHETEV

SEQ ID NO: 800005 - protein, 22 aa, Mycobacterium
DDVWTFLMQEANPWGYSNKELL

SEQ ID NO: 800006 - protein, 29 aa, Mycobacterium
DDVYLSPAPIYHTAPLKWCGGVQALGGTV

SEQ ID NO: 800007 - protein, 17 aa, Mycobacterium
DDWAVHVALWQRRANGR

SEQ ID NO: 800008 - protein, 24 aa, Mycobacterium
DDWDKVSIALETRPGALRPGVVMT

SEQ ID NO: 800009 - protein, 21 aa, Mycobacterium
DDWIAVTIRDDAQWHALVDVM

SEQ ID NO: 800010 - protein, 19 aa, Mycobacterium
DDWILTGTKMWITNGSVAD

SEQ ID NO: 800011 - protein, 17 aa, Mycobacterium
DDWIVLSALPSDVLTDA

SEQ ID NO: 800012 - protein, 19 aa, Mycobacterium
DDWLFPTYRDSMALAARGI

SEQ ID NO: 800013 - protein, 20 aa, Mycobacterium
DDWQQYCFVPDFSGTGLIET

SEQ ID NO: 800014 - protein, 24 aa, Mycobacterium
DDWRALFQANLETAFFMSQAISGE

SEQ ID NO: 800015 - protein, 20 aa, Mycobacterium
DDWSKLWWVRADGVASIHHS

SEQ ID NO: 800016 - protein, 17 aa, Mycobacterium
DDWWGNLFDTQCPTRIV

SEQ ID NO: 800017 - protein, 23 aa, Mycobacterium
DDYFASVHMPLAETIPGVVNITY

SEQ ID NO: 800018 - protein, 30 aa, Mycobacterium
DDYLNARPITTPFGLFDCDVPCDAAIAVIV

SEQ ID NO: 800019 - protein, 29 aa, Mycobacterium
DDYLNARPITTPFGLYDCDVPCDGAIAVI

SEQ ID NO: 800020 - protein, 17 aa, Mycobacterium
DDYLNGLNLYRANMPAP

SEQ ID NO: 800021 - protein, 37 aa, Mycobacterium
DDYLTKPFSFRVLVARLRALVRRGVPQRPAVLTAGSL

SEQ ID NO: 800022 - protein, 33 aa, Mycobacterium; identical to SEQ ID NO: 216822

SEQ ID NO: 800023 - protein, 20 aa, Mycobacterium
DDYPFILNTGRLQHQWHTMT

SEQ ID NO: 800024 - protein, 22 aa, Mycobacterium
DDYSFTLIPESMKPFLPRTVRE

SEQ ID NO: 800025 - protein, 32 aa, Mycobacterium
DDYTRTLDILERFYGLVLTDCGTGLLHSAMSA

SEQ ID NO: 800026 - protein, 17 aa, Mycobacterium
DDYVRRLAGAAVAAVGF

SEQ ID NO: 800027 - protein, 26 aa, Mycobacterium
DEAAELMINLFWHGLRGAPEEREAAA

SEQ ID NO: 800028 - protein, 27 aa, Mycobacterium
DEAAELMINLFWRGLKGTPSDAGTPPV

SEQ ID NO: 800029 - protein, 25 aa, Mycobacterium
DEAAEMMIDLFWRGLKGAPSDREIG

SEQ ID NO: 800030 - protein, 18 aa, Mycobacterium
DEAAGRAWPSRRSWEAMA

SEQ ID NO: 800031 - protein, 18 aa, Mycobacterium
DEAALEAALPPALIADDA

SEQ ID NO: 800032 - protein, 18 aa, Mycobacterium
DEAALLDALVSGGIAGAG

SEQ ID NO: 800033 - protein, 29 aa, Mycobacterium
DEAAYLVEYLDLIGLLPEVLAVYNPMTSA

SEQ ID NO: 800034 - protein, 24 aa, Mycobacterium
DEADRLDMRLAKIDAATRELQAVT

SEQ ID NO: 800035 - protein, 17 aa, Mycobacterium
DEADRVILYLRPTKFVS

SEQ ID NO: 800036 - protein, 29 aa, Mycobacterium
DEAEFDAERWYRILQDQSVSVWYTAPTGI

SEQ ID NO: 800037 - protein, 23 aa, Mycobacterium
DEAEQDWLRRQPTIPLRTDTERL

SEQ ID NO: 800038 - protein, 20 aa, Mycobacterium
DEAFDRAFSAGASPLVPIDS

SEQ ID NO: 800039 - protein, 19 aa, Mycobacterium
DEAFKLVKINPLVSWTDQD

SEQ ID NO: 800040 - protein, 24 aa, Mycobacterium
DEAFRPYAIRRYTLGGGAEPVEVF

SEQ ID NO: 800041 - protein, 23 aa, Mycobacterium
DEAGLDTTYLSDAADREANEADV

SEQ ID NO: 800042 - protein, 25 aa, Mycobacterium
DEAHRSIYGVWRGVLEYFDAHVVGL

SEQ ID NO: 800043 - protein, 19 aa, Mycobacterium
DEAIAVMRALWSTDGPTSH

SEQ ID NO: 800044 - protein, 17 aa, Mycobacterium
DEAIERVVLTVAAAFDA

SEQ ID NO: 800045 - protein, 33 aa, Mycobacterium; identical to SEQ ID NO: 124983

SEQ ID NO: 800046 - protein, 19 aa, Mycobacterium
DEAIPLLRAAADELLRGGR

SEQ ID NO: 800047 - protein, 23 aa, Mycobacterium
DEAKLELMFQVNIAGMARVTDAV

SEQ ID NO: 800048 - protein, 30 aa, Mycobacterium
DEAKRMGLFGYAIPQEWGGLGLNLMQDVEL

SEQ ID NO: 800049 - protein, 23 aa, Mycobacterium
DEALHRIRKSAKRLRYVASAEGA

SEQ ID NO: 800050 - protein, 20 aa, Mycobacterium
DEALPFTAIAADASLVRADG

SEQ ID NO: 800051 - protein, 24 aa, Mycobacterium
DEALVITHRPPACRFWNLVVWNQF

SEQ ID NO: 800052 - protein, 26 aa, Mycobacterium
DEAQEKFGFLLDAFSYGAPPHGGIAF

SEQ ID NO: 800053 - protein, 27 aa, Mycobacterium
DEAQRPRPLYPIPLLLGGSGPRMMRLV

SEQ ID NO: 800054 - protein, 30 aa, Mycobacterium
DEAQWPLPSTRWTPLYLHDAGLRAAPPDAA

SEQ ID NO: 800055 - protein, 27 aa, Mycobacterium
DEARELALLALRLGRAPGAYRLSDLLL

SEQ ID NO: 800056 - protein, 24 aa, Mycobacterium
DEARKMWASSMNIAGAGWSGQAQA

SEQ ID NO: 800057 - protein, 27 aa, Mycobacterium
DEARKNFFRVPLIGGTITHPVQGEDSA

SEQ ID NO: 800058 - protein, 20 aa, Mycobacterium
DEARRLITALAGLVAASVEY

SEQ ID NO: 800059 - protein, 22 aa, Mycobacterium
DEARRLITALAGLVTASAEYLG

SEQ ID NO: 800060 - protein, 31 aa, Mycobacterium
DEATERLSLLGLPFLFFIDAAQGRASVLYHR

SEQ ID NO: 800061 - protein, 31 aa, Mycobacterium
DEAVYGPDGLALPMRLALPGAVNRGNATQAV

SEQ ID NO: 800062 - protein, 18 aa, Mycobacterium
DEAWKSVQLLTDKVLPAL

SEQ ID NO: 800063 - protein, 25 aa, Mycobacterium
DEAWLQAAFDEFYARRARGAQLVTR

SEQ ID NO: 800064 - protein, 22 aa, Mycobacterium
DEAYTNYTPVPLYGYRAKDVTQ

SEQ ID NO: 800065 - protein, 23 aa, Mycobacterium
DECERLGLPAYVKPARGGSSIGV

SEQ ID NO: 800066 - protein, 27 aa, Mycobacterium
DECGDVGWFQLAGKHVILLSGASANEF

SEQ ID NO: 800067 - protein, 25 aa, Mycobacterium
DECGQLMREYPDLAAFEWAIRAGNI

SEQ ID NO: 800068 - protein, 21 aa, Mycobacterium
DECIHAWRRLTRAGTDLESTP

SEQ ID NO: 800069 - protein, 17 aa, Mycobacterium
DECSDLFYSIWWPRIPG

SEQ ID NO: 800070 - protein, 23 aa, Mycobacterium
DEDAAPTVYAARAAYEAAGIGPD

SEQ ID NO: 800071 - protein, 17 aa, Mycobacterium
DEDAIKTLSMIWKKTLY

SEQ ID NO: 800072 - protein, 24 aa, Mycobacterium
DEDAVAAILRYCTEHRIAIVPFGG

SEQ ID NO: 800073 - protein, 25 aa, Mycobacterium
DEDAVATILRYCSHHRIAVVPFGGG

SEQ ID NO: 800074 - protein, 23 aa, Mycobacterium
DEDFSRALAARGWLGMTVPEEYG

SEQ ID NO: 800075 - protein, 17 aa, Mycobacterium
DEDFVQAWLHRVMPRLT

SEQ ID NO: 800076 - protein, 24 aa, Mycobacterium
DEDGDFWMLDGRGTAIRTAHGVVY

SEQ ID NO: 800077 - protein, 23 aa, Mycobacterium
DEDGFLYIVDRRVDMIVSGGANV

SEQ ID NO: 800078 - protein, 23 aa, Mycobacterium
DEDGFLYLTDRKAFMIISGGVNI

SEQ ID NO: 800079 - protein, 25 aa, Mycobacterium
DEDGKSFFILPSGTSKEDAKKAVVM

SEQ ID NO: 800080 - protein, 23 aa, Mycobacterium
DEDGVVEFLLTAAAIGQLFKANA

SEQ ID NO: 800081 - protein, 25 aa, Mycobacterium
DEDGYLLQIFTRPLVDRPTVFFELI

SEQ ID NO: 800082 - protein, 20 aa, Mycobacterium
DEDKVVWLSQTTLSVDETME

SEQ ID NO: 800083 - protein, 21 aa, Mycobacterium
DEDLFVFDSLADLVAFVRSDT

SEQ ID NO: 800084 - protein, 25 aa, Mycobacterium
DEDLGAAWDWALSATGPTLLDVRCD

SEQ ID NO: 800085 - protein, 31 aa, Mycobacterium
DEDPDLPTLIVAPYFRSAIEAAIDGWRRVVV

SEQ ID NO: 800086 - protein, 29 aa, Mycobacterium
DEDPDLPTLIVAPYFRSAIEDAIDGWRRV

SEQ ID NO: 800087 - protein, 17 aa, Mycobacterium
DEDPLIPHPAQAPVVVG

SEQ ID NO: 800088 - protein, 24 aa, Mycobacterium
DEDPSPTVFAAKAAYEAAGIGPED

SEQ ID NO: 800089 - protein, 26 aa, Mycobacterium
DEDRLTALFDFYGYRVLSVDAINETS

SEQ ID NO: 800090 - protein, 23 aa, Mycobacterium
DEDSLALLIYTSGSTGAPKGAMY

SEQ ID NO: 800091 - protein, 23 aa, Mycobacterium
DEDVRPLQILGADTLDLESVLAS

SEQ ID NO: 800092 - protein, 17 aa, Mycobacterium
DEEAFLAALPALAMTAF

SEQ ID NO: 800093 - protein, 21 aa, Mycobacterium
DEEAISLLLTKDARVLLRECV

SEQ ID NO: 800094 - protein, 23 aa, Mycobacterium
DEEAIYLHGLFEQLEQKKFRINL

SEQ ID NO: 800095 - protein, 18 aa, Mycobacterium
DEEGFRMGLLGAGALSNH

SEQ ID NO: 800096 - protein, 25 aa, Mycobacterium
DEEGPPILVQILHQPMLDSDATPSR

SEQ ID NO: 800097 - protein, 19 aa, Mycobacterium
DEEGRLFVVGRDDEMIVSG

SEQ ID NO: 800098 - protein, 27 aa, Mycobacterium
DEEIARVVPFIEWLRGTFPDQVISVDT

SEQ ID NO: 800099 - protein, 25 aa, Mycobacterium
DEEKEWMLPLLDLRNALDVADDRHL

SEQ ID NO: 800100 - protein, 23 aa, Mycobacterium
DEELRKLRYILNFARLADFEPGA

SEQ ID NO: 800101 - protein, 29 aa, Mycobacterium
DEEPDWVNTIFLSTRFRAWRVGGYNEYLY

SEQ ID NO: 800102 - protein, 17 aa, Mycobacterium
DEEPLVEALDFLPDSRL

SEQ ID NO: 800103 - protein, 18 aa, Mycobacterium
DEEPLVELVDFLPDSRLS

SEQ ID NO: 800104 - protein, 25 aa, Mycobacterium
DEEQFGPVLPILRYSRVDEAVERAN

SEQ ID NO: 800105 - protein, 17 aa, Mycobacterium
DEERFSLLLGVMGAGDL

SEQ ID NO: 800106 - protein, 24 aa, Mycobacterium
DEERIEMWLRARTAQHVRVAALDL

SEQ ID NO: 800107 - protein, 30 aa, Mycobacterium
DEESERLLRGFLTPALWDAGLYCRADDRGD

SEQ ID NO: 800108 - protein, 24 aa, Mycobacterium
DEETARWAFERLGPERFGDTTVTP

SEQ ID NO: 800109 - protein, 24 aa, Mycobacterium
DEETFTQIHNFLWRGGLPGTYETC

SEQ ID NO: 800110 - protein, 22 aa, Mycobacterium
DEETLPVLPRPGADFRAVEVLP

SEQ ID NO: 800111 - protein, 25 aa, Mycobacterium
DEETQPLVICDLGMPRDVDPAVAGL

SEQ ID NO: 800112 - protein, 17 aa, Mycobacterium
DEEWDAVIAVHLRGHFL

SEQ ID NO: 800113 - protein, 25 aa, Mycobacterium
DEEWTTLWWVRADGFAHILDTPDPR

SEQ ID NO: 800114 - protein, 24 aa, Mycobacterium
DEFDIAKLRYHKIVLMADADVDGQ

SEQ ID NO: 800115 - protein, 24 aa, Mycobacterium
DEFDIARLRYHKIVLMADADVDGQ

SEQ ID NO: 800116 - protein, 24 aa, Mycobacterium
DEFDLSKLRYHKIVLMADADVDGQ

SEQ ID NO: 800117 - protein, 21 aa, Mycobacterium
DEFDTYWRHGGSGPLRNLIDA

SEQ ID NO: 800118 - protein, 17 aa, Mycobacterium
DEFEVHLFVDPLGTSRM

SEQ ID NO: 800119 - protein, 19 aa, Mycobacterium
DEFFRRAYSVLPDDGVMLL

SEQ ID NO: 800120 - protein, 20 aa, Mycobacterium
DEFHPLFGSPMWDAADDARR

SEQ ID NO: 800121 - protein, 19 aa, Mycobacterium
DEFHPLFGSPMWNAADEAR

SEQ ID NO: 800122 - protein, 22 aa, Mycobacterium
DEFIWCVQGLPSPYLAIAFPNR

SEQ ID NO: 800123 - protein, 24 aa, Mycobacterium
DEFKEPLYAAPPLLLRMVEAGQLG

SEQ ID NO: 800124 - protein, 20 aa, Mycobacterium
DEFKFPFDLLDSTKIIPEEQ

SEQ ID NO: 800125 - protein, 22 aa, Mycobacterium
DEFLHYLRIREWQDLVGQLRSI

SEQ ID NO: 800126 - protein, 26 aa, Mycobacterium
DEFLHYLRIREWQDLVGQLRSIARDI

SEQ ID NO: 800127 - protein, 19 aa, Mycobacterium
DEFMARLKATPDAKGVIFI

SEQ ID NO: 800128 - protein, 28 aa, Mycobacterium
DEFRETELFRLLLPARFGGLQASFPELL

SEQ ID NO: 800129 - protein, 20 aa, Mycobacterium
DEGATVPFIARYRKEATGSL

SEQ ID NO: 800130 - protein, 24 aa, Mycobacterium
DEGGRLKFLVRLASWPSGEARVLG

SEQ ID NO: 800131 - protein, 23 aa, Mycobacterium
DEGIASNTLWPRTLVATAAVQNL

SEQ ID NO: 800132 - protein, 24 aa, Mycobacterium
DEGIRAAALLRKQNPESPVLVLSH

SEQ ID NO: 800133 - protein, 23 aa, Mycobacterium
DEGLLRYPDLLTETTRDVWLVTG

SEQ ID NO: 800134 - protein, 24 aa, Mycobacterium
DEGLRQVFVGLNPERIMGAALGNG

SEQ ID NO: 800135 - protein, 25 aa, Mycobacterium
DEGLRRLFRQFSFPGGIPSHVAPET

SEQ ID NO: 800136 - protein, 35 aa, Mycobacterium
DEGLTLPHPLAHLRAFVLIPWLDVDPDATLTVAGE

SEQ ID NO: 800137 - protein, 20 aa, Mycobacterium
DEGPLARFYSAGVGIVAPTP

SEQ ID NO: 800138 - protein, 23 aa, Mycobacterium
DEGQFFEHRLLVDHAQPNCKSNV

SEQ ID NO: 800139 - protein, 22 aa, Mycobacterium
DEGQFLWPGFGENSRVLKWIVD

SEQ ID NO: 800140 - protein, 24 aa, Mycobacterium
DEGRALLAELLDRATQPELVYSHS

SEQ ID NO: 800141 - protein, 20 aa, Mycobacterium
DEGRIARIWLNRPEAHNAQS

SEQ ID NO: 800142 - protein, 23 aa, Mycobacterium
DEGRSFVLTDTVGFVRHLPTQLV

SEQ ID NO: 800143 - protein, 28 aa, Mycobacterium
DEGSGFTYWPEGPLAAPKRLLPPINNRG

SEQ ID NO: 800144 - protein, 21 aa, Mycobacterium
DEGSTVPFIARYRKEVTGSLD

SEQ ID NO: 800145 - protein, 24 aa, Mycobacterium
DEGSVLVPFSWQGVSLHAGGASAV

SEQ ID NO: 800146 - protein, 24 aa, Mycobacterium
DEGTPLFATLPLTPGSDPESAALY

SEQ ID NO: 800147 - protein, 17 aa, Mycobacterium
DEGVIALALVKRGLPVD

SEQ ID NO: 800148 - protein, 27 aa, Mycobacterium
DEGVTSFKLFMAYPGVYYSTDGQILRA

SEQ ID NO: 800149 - protein, 19 aa, Mycobacterium
DEGWLVRRQGLGTFVAEPV

SEQ ID NO: 800150 - protein, 24 aa, Mycobacterium
DEGYDPQLWRKLAAQGVTGLLIDP

SEQ ID NO: 800151 - protein, 17 aa, Mycobacterium
DEGYRRKFRKEMAQKYG

SEQ ID NO: 800152 - protein, 19 aa, Mycobacterium
DEGYRRRFRKDYDNKFGPR

SEQ ID NO: 800153 - protein, 17 aa, Mycobacterium
DEGYWVISKHRDVREVS

SEQ ID NO: 800154 - protein, 31 aa, Mycobacterium
DEHDPALPLTLPAVYRWCGLHARYLISWCRR

SEQ ID NO: 800155 - protein, 28 aa, Mycobacterium
DEHFAALPPLQRLALDRVLLRAGADGPA

SEQ ID NO: 800156 - protein, 20 aa, Mycobacterium
DEHGFILAGPDLRDVCGWTL

SEQ ID NO: 800157 - protein, 22 aa, Mycobacterium
DEHGKLVAVSWPQALDAAARGL

SEQ ID NO: 800158 - protein, 21 aa, Mycobacterium
DEHGTVLLAVRGLLMGTGLSE

SEQ ID NO: 800159 - protein, 27 aa, Mycobacterium
DEHGVTAMFFIVTPNRDQLNRLGELVG

SEQ ID NO: 800160 - protein, 24 aa, Mycobacterium
DEHHQELEYLLKTAGFDDDDTKSY

SEQ ID NO: 800161 - protein, 24 aa, Mycobacterium
DEHIARIAALGRVALVLISHRHGD

SEQ ID NO: 800162 - protein, 24 aa, Mycobacterium
DEHIARVAALGRIGLVLISHRHGD

SEQ ID NO: 800163 - protein, 26 aa, Mycobacterium
DEHLPQLLRSCGRPYPWVQIRVVDPT

SEQ ID NO: 800164 - protein, 24 aa, Mycobacterium
DEHLRLPLREVIWGADASLLEGTE

SEQ ID NO: 800165 - protein, 24 aa, Mycobacterium
DEHNVPHLPLITWQDNRALRVHNG

SEQ ID NO: 800166 - protein, 22 aa, Mycobacterium
DEHPHLFMPFRSGAAAEAPVPD

SEQ ID NO: 800167 - protein, 25 aa, Mycobacterium
DEHQQRYLKPLLEGKIRSAFAMTEP

SEQ ID NO: 800168 - protein, 25 aa, Mycobacterium
DEHQTPEFLINWDNGNELFGDLPKA

SEQ ID NO: 800169 - protein, 25 aa, Mycobacterium
DEHRRRIGELWAQFSAVAAGNPHAW

SEQ ID NO: 800170 - protein, 29 aa, Mycobacterium
DEHSDFMSYLNLWHYLRGQRKSLSGSAFR

SEQ ID NO: 800171 - protein, 29 aa, Mycobacterium
DEHSDFMSYLNLWRYLREQRTEMSGNAFR

SEQ ID NO: 800172 - protein, 25 aa, Mycobacterium
DEHSVLVNPLIYDGYSSIGCAPCTA

SEQ ID NO: 800173 - protein, 26 aa, Mycobacterium
DEHTEIPLGLYCRASLAKYMDAERLF

SEQ ID NO: 800174 - protein, 17 aa, Mycobacterium
DEHVHLLDLLRTRSESA

SEQ ID NO: 800175 - protein, 26 aa, Mycobacterium
DEIAPLVRELLGVPDLPLACVLEGGT

SEQ ID NO: 800176 - protein, 24 aa, Mycobacterium
DEIDGLAWVPADRAWVPDLVAALS

SEQ ID NO: 800177 - protein, 27 aa, Mycobacterium
DEIDNLIPAWLATPSPVLVGATSEALP

SEQ ID NO: 800178 - protein, 25 aa, Mycobacterium
DEIEALWPMVIARAAVLLVSDLQQI

SEQ ID NO: 800179 - protein, 22 aa, Mycobacterium
DEIEALYYLHPLTGEVIRQVDS

SEQ ID NO: 800180 - protein, 26 aa, Mycobacterium
DEIEELVLQLALYCGVAAANSAFRIA

SEQ ID NO: 800181 - protein, 23 aa, Mycobacterium
DEIEVGLRYYAAAFFKVIPQVNA

SEQ ID NO: 800182 - protein, 21 aa, Mycobacterium
DEIFKMFSWDLGEHAEAVETA

SEQ ID NO: 800183 - protein, 20 aa, Mycobacterium
DEIFVDLKRRVAALTSSGSA

SEQ ID NO: 800184 - protein, 27 aa, Mycobacterium
DEIFYDPQHPYTWGLLGSLPRVEDTNQ

SEQ ID NO: 800185 - protein, 21 aa, Mycobacterium
DEIGFFKLLQPEQWGGLQADP

SEQ ID NO: 800186 - protein, 24 aa, Mycobacterium
DEIGFTQLLYDDHIGKVSLIGAGM

SEQ ID NO: 800187 - protein, 18 aa, Mycobacterium
DEIIPLQVPQADGSVITF

SEQ ID NO: 800188 - protein, 28 aa, Mycobacterium
DEIIRVRVLPTWLRLDARFGSVYRRRGH

SEQ ID NO: 800189 - protein, 26 aa, Mycobacterium
DEIKGALRKLTISSEAYLVLCGSAFK

SEQ ID NO: 800190 - protein, 19 aa, Mycobacterium
DEILARFTAVPSQELILPY

SEQ ID NO: 800191 - protein, 24 aa, Mycobacterium
DEIPARFTSIDAGILHLGGTRLPF

SEQ ID NO: 800192 - protein, 18 aa, Mycobacterium
DEIPVRFNAIDAGVLHLG

SEQ ID NO: 800193 - protein, 27 aa, Mycobacterium
DEIRDLLAFRNPASLPVFIGNPADDSA

SEQ ID NO: 800194 - protein, 24 aa, Mycobacterium
DEIRFLEPELYRQGINAWVDLVSA

SEQ ID NO: 800195 - protein, 24 aa, Mycobacterium
DEIRPLFYEWFIRADTSLSFVIYS

SEQ ID NO: 800196 - protein, 19 aa, Mycobacterium
DEIRRIITWLGIGDEFAAI

SEQ ID NO: 800197 - protein, 23 aa, Mycobacterium
DEIRWALDLLRKRFAKVIWIPGN

SEQ ID NO: 800198 - protein, 23 aa, Mycobacterium
DEIRWALDLLRKRFAKVIWVPGN

SEQ ID NO: 800199 - protein, 17 aa, Mycobacterium
DEISAVAALSFASEGIQ

SEQ ID NO: 800200 - protein, 25 aa, Mycobacterium
DEITLTMKLKRRPILAKYAAEIEEL

SEQ ID NO: 800201 - protein, 24 aa, Mycobacterium
DEITLTMKLKRRPIVTKYAAEIEE

SEQ ID NO: 800202 - protein, 25 aa, Mycobacterium
DEITRALTLLDELWKRYQKVQVEGH

SEQ ID NO: 800203 - protein, 19 aa, Mycobacterium
DEIVDRFCILGPAPAHISK

SEQ ID NO: 800204 - protein, 20 aa, Mycobacterium
DEIVPLKITQLDGSVTEFCV

SEQ ID NO: 800205 - protein, 20 aa, Mycobacterium
DEIVSFFILLTIAGNDTTRQ

SEQ ID NO: 800206 - protein, 20 aa, Mycobacterium
DEIYLALYGSWKDPADDDKY

SEQ ID NO: 800207 - protein, 27 aa, Mycobacterium
DEIYTFMDLWFYHCNPRHHSIALTPMP

SEQ ID NO: 800208 - protein, 29 aa, Mycobacterium
DEKAQQHALLFGPPPLGPGAPPLERLLAY

SEQ ID NO: 800209 - protein, 17 aa, Mycobacterium
DEKAQWPQWVPVGRMGV

SEQ ID NO: 800210 - protein, 25 aa, Mycobacterium
DEKATWWDRAVEAYPPYAEYQTKTD

SEQ ID NO: 800211 - protein, 25 aa, Mycobacterium
DEKATWWDRAVRAWPDYAEYQKNTD

SEQ ID NO: 800212 - protein, 20 aa, Mycobacterium
DEKDPRWRFGVPPANNANYA

SEQ ID NO: 800213 - protein, 23 aa, Mycobacterium
DEKFRAFLAEQPDLGPKQWPSYV

SEQ ID NO: 800214 - protein, 25 aa, Mycobacterium
DEKGMVNVLCAPGVWSRYRKVAQTA

SEQ ID NO: 800215 - protein, 18 aa, Mycobacterium
DEKGRMMLPAYLLSAHKA

SEQ ID NO: 800216 - protein, 26 aa, Mycobacterium
DEKLDWVLETFPRLAERRSQVGGTLS

SEQ ID NO: 800217 - protein, 24 aa, Mycobacterium
DEKRMFGGLAFLIDGHLAVAVSGQ

SEQ ID NO: 800218 - protein, 17 aa, Mycobacterium
DEKRMFGGLAFLVNGNM

SEQ ID NO: 800219 - protein, 26 aa, Mycobacterium
DEKTIYLATQMLLDDAPKALVTLEFQ

SEQ ID NO: 800220 - protein, 18 aa, Mycobacterium
DEKVDWARRVLAAARTER

SEQ ID NO: 800221 - protein, 23 aa, Mycobacterium
DEKYELGLRNRVNRRPRGSYQIA

SEQ ID NO: 800222 - protein, 18 aa, Mycobacterium
DELAALLRRRGATVTSAA

SEQ ID NO: 800223 - protein, 17 aa, Mycobacterium
DELAALRRNGAQRPVLE

SEQ ID NO: 800224 - protein, 23 aa, Mycobacterium
DELAAPLDLLLTSATRPFASRMM

SEQ ID NO: 800225 - protein, 24 aa, Mycobacterium
DELADPPRWLFENGPEFTHYEVID

SEQ ID NO: 800226 - protein, 35 aa, Mycobacterium
DELAERPALSLTLDQACLLMFPRRDLTVDESQSVG

SEQ ID NO: 800227 - protein, 22 aa, Mycobacterium
DELAEWLAVARLRAGEAVSTPA

SEQ ID NO: 800228 - protein, 24 aa, Mycobacterium
DELAGFTAIRRWAKQFYPDGIGGS

SEQ ID NO: 800229 - protein, 19 aa, Mycobacterium
DELAKRLIVLVEPVEAIVD

SEQ ID NO: 800230 - protein, 23 aa, Mycobacterium
DELCALLRRRGATVTSAPAITMV

SEQ ID NO: 800231 - protein, 24 aa, Mycobacterium
DELDALLWRAARPGEPSWPSPFGD

SEQ ID NO: 800232 - protein, 22 aa, Mycobacterium
DELDFLRLAVLDALLVLQADSM

SEQ ID NO: 800233 - protein, 30 aa, Mycobacterium
DELERLFPRTAAELFSWGKSWLETCQNAFA

SEQ ID NO: 800234 - protein, 33 aa, Mycobacterium
DELERLWTAPVETPAYRRGAMPAVDRTPRTTTW

SEQ ID NO: 800235 - protein, 30 aa, Mycobacterium; identical to SEQ ID NO: 113717

SEQ ID NO: 800236 - protein, 18 aa, Mycobacterium
DELERMGRAARLAEATAP

SEQ ID NO: 800237 - protein, 18 aa, Mycobacterium
DELFAGPTAIAFITGEPV

SEQ ID NO: 800238 - protein, 28 aa, Mycobacterium
DELFIRSYMRHCEVARYPNILKNALRCA

SEQ ID NO: 800239 - protein, 33 aa, Mycobacterium
DELFNEKFDLMAKLLPGAPVTWSGTLRSALDNV

SEQ ID NO: 800240 - protein, 27 aa, Mycobacterium
DELGFTKAAIYYHFRTREQLLGAVVEP

SEQ ID NO: 800241 - protein, 28 aa, Mycobacterium
DELGKLTNALWDAVWRPANPLAHATAEQ

SEQ ID NO: 800242 - protein, 26 aa, Mycobacterium
DELGLPILQVPVSTPFIAITRAVIDE

SEQ ID NO: 800243 - protein, 20 aa, Mycobacterium
DELGPYFVLLSVAGNDTTRT

SEQ ID NO: 800244 - protein, 17 aa, Mycobacterium
DELGTALLLITHDLALA

SEQ ID NO: 800245 - protein, 19 aa, Mycobacterium
DELGWRGLIAQSTDLDALA

SEQ ID NO: 800246 - protein, 26 aa, Mycobacterium
DELHTAFQFDFLRSPWRAANLRGVID

SEQ ID NO: 800247 - protein, 19 aa, Mycobacterium
DELIEVVRLLEQGGLDLDT

SEQ ID NO: 800248 - protein, 17 aa, Mycobacterium
DELIGIAGLLLLAGHET

SEQ ID NO: 800249 - protein, 23 aa, Mycobacterium
DELILAALEFWMDEHHYAGLAEQ

SEQ ID NO: 800250 - protein, 26 aa, Mycobacterium
DELKETLLKLLGSPHLCSRAFITEQY

SEQ ID NO: 800251 - protein, 19 aa, Mycobacterium
DELLAGMHVPRRMMPEIRP

SEQ ID NO: 800252 - protein, 18 aa, Mycobacterium
DELLASGEVLWSGAGSLS

SEQ ID NO: 800253 - protein, 21 aa, Mycobacterium
DELLFCGGVAQRFAPLRAAIQ

SEQ ID NO: 800254 - protein, 20 aa, Mycobacterium
DELLLALFDRTIAQSVQTWR

SEQ ID NO: 800255 - protein, 21 aa, Mycobacterium
DELLLALFDRTMAQTAQLWRT

SEQ ID NO: 800256 - protein, 21 aa, Mycobacterium
DELLLALFDRTMSQTAQLWRA

SEQ ID NO: 800257 - protein, 20 aa, Mycobacterium
DELLLAVATRLRSAVSEDTL

SEQ ID NO: 800258 - protein, 26 aa, Mycobacterium
DELLLHRLRHLLNRLNRAVPAQGATS

SEQ ID NO: 800259 - protein, 22 aa, Mycobacterium
DELLRDGVLVDLYPLVRKSIRV

SEQ ID NO: 800260 - protein, 24 aa, Mycobacterium
DELLTGRENIRMIGGLYGIRRRDL

SEQ ID NO: 800261 - protein, 20 aa, Mycobacterium
DELLTLLLVDAYSDLADAVD

SEQ ID NO: 800262 - protein, 26 aa, Mycobacterium
DELLTRLVEALPPRAALLVTADHGGF

SEQ ID NO: 800263 - protein, 23 aa, Mycobacterium
DELPERHHLLLSRGPYTVAEETE

SEQ ID NO: 800264 - protein, 24 aa, Mycobacterium
DELRATLLALLGSPHLCSRAFITE

SEQ ID NO: 800265 - protein, 26 aa, Mycobacterium
DELRELLPPWVALASRMAILPPRLRR

SEQ ID NO: 800266 - protein, 21 aa, Mycobacterium
DELRERFAPMRILTGIEVDIL

SEQ ID NO: 800267 - protein, 30 aa, Mycobacterium
DELRPLKALASRMPCPYLNPGRYVCDRPLV

SEQ ID NO: 800268 - protein, 28 aa, Mycobacterium
DELRPLKALASRMSCPYLNPGRYVSGRP

SEQ ID NO: 800269 - protein, 23 aa, Mycobacterium
DELRQFGIPLVSHLPGVGHNYQD

SEQ ID NO: 800270 - protein, 25 aa, Mycobacterium
DELRRHIGYVIQGAGLFPHFTVGDN

SEQ ID NO: 800271 - protein, 24 aa, Mycobacterium
DELRRHIGYVIQGAGLFPHYTVGE

SEQ ID NO: 800272 - protein, 28 aa, Mycobacterium
DELRRRGEGIGLTTVYRTLQAMATAGVV

SEQ ID NO: 800273 - protein, 18 aa, Mycobacterium
DELRRRGENIGLTTVYRT

SEQ ID NO: 800274 - protein, 19 aa, Mycobacterium
DELRWLPVKDAIKTVSYAV

SEQ ID NO: 800275 - protein, 30 aa, Mycobacterium
DELSSGDFPVLWPVLTRWADNDMFGHLNNA

SEQ ID NO: 800276 - protein, 21 aa, Mycobacterium
DELTGLPVLVLDPMLATGGSL

SEQ ID NO: 800277 - protein, 31 aa, Mycobacterium
DELVAEGVTSFKLFMAYPGVYYSDDGQILRA

SEQ ID NO: 800278 - protein, 20 aa, Mycobacterium
DELVAMTYERWQRCWRIAQR

SEQ ID NO: 800279 - protein, 20 aa, Mycobacterium
DELVELDGLLLLPGGGPELD

SEQ ID NO: 800280 - protein, 25 aa, Mycobacterium
DELVRDLTWRLAPGERIGLVGVNGS

SEQ ID NO: 800281 - protein, 30 aa, Mycobacterium
DELVTLVEWGIPPLAVLRAATVTAAELINV

SEQ ID NO: 800282 - protein, 30 aa, Mycobacterium
DELVTLVEWGLPPLAVLRAATTTAAELINK

SEQ ID NO: 800283 - protein, 32 aa, Mycobacterium
DELVVLVPELLLIGQLIDRSGMAWCISSFGRD

SEQ ID NO: 800284 - protein, 32 aa, Mycobacterium
DEMELVQWGIPRLSILFWSMGDVPLAHQVLGE

SEQ ID NO: 800285 - protein, 27 aa, Mycobacterium
DEMRAIVQAAWRRPSTGRWLVVLIEDA

SEQ ID NO: 800286 - protein, 18 aa, Mycobacterium
DEMRFMAGAQRALQGPLA

SEQ ID NO: 800287 - protein, 21 aa, Mycobacterium
DEMRMFGGLAFLIGGHMAVAV

SEQ ID NO: 800288 - protein, 28 aa, Mycobacterium
DEMRRRADAAGWLRYGLPARFGGRDGTN

SEQ ID NO: 800289 - protein, 28 aa, Mycobacterium
DEMRRRADAAGWLRYGLPSQFGGRDGSN

SEQ ID NO: 800290 - protein, 21 aa, Mycobacterium
DEMYKYLVAVSRQPDHAKIRA

SEQ ID NO: 800291 - protein, 17 aa, Mycobacterium
DENDALLRFARDWIART

SEQ ID NO: 800292 - protein, 24 aa, Mycobacterium
DENFLGILDIRPFTRGHTLVIPKT

SEQ ID NO: 800293 - protein, 18 aa, Mycobacterium
DENIDYLLGCRDEISWRY

SEQ ID NO: 800294 - protein, 25 aa, Mycobacterium
DENKRKFREALERKMSKSSGGSDHK

SEQ ID NO: 800295 - protein, 21 aa, Mycobacterium
DENKVVWLSQTTLSVDETMEI

SEQ ID NO: 800296 - protein, 22 aa, Mycobacterium
DENKVVWLSQTTLSVDETMEIV

SEQ ID NO: 800297 - protein, 25 aa, Mycobacterium
DENLEAYYRPASPGMRLLGLAHRAA

SEQ ID NO: 800298 - protein, 22 aa, Mycobacterium
DENLHMIFYRDVSAAGLDIAPN

SEQ ID NO: 800299 - protein, 22 aa, Mycobacterium
DENLHMIFYRDVSEAAFDLAPN

SEQ ID NO: 800300 - protein, 22 aa, Mycobacterium
DENLHMIFYRDVSEAGFEIAPD

SEQ ID NO: 800301 - protein, 24 aa, Mycobacterium
DENLHMIFYRNMVEAGLEIAPNQA

SEQ ID NO: 800302 - protein, 25 aa, Mycobacterium
DENLHMIFYRNMVSAGLEIAPNQAV

SEQ ID NO: 800303 - protein, 25 aa, Mycobacterium
DENLPVSAWRIHRCIGMDGTTLVRT

SEQ ID NO: 800304 - protein, 22 aa, Mycobacterium
DENLRLAWPFENAPVDLLAAAR

SEQ ID NO: 800305 - protein, 24 aa, Mycobacterium
DENLVIAQELLKAAAAAKIILEIE

SEQ ID NO: 800306 - protein, 24 aa, Mycobacterium
DENLVIAQELLKAAVAAKIILEIE

SEQ ID NO: 800307 - protein, 24 aa, Mycobacterium
DENPAVKDRLFPTAFGPATIDGRI

SEQ ID NO: 800308 - protein, 22 aa, Mycobacterium
DENRLRWKPYLKGGSREDAASV

SEQ ID NO: 800309 - protein, 28 aa, Mycobacterium
DENSSTAFNQWWLRLEHIAREAGLKLVM

SEQ ID NO: 800310 - protein, 31 aa, Mycobacterium
DENSVALAALPLFHVNALVVTILAPLLRGQH

SEQ ID NO: 800311 - protein, 28 aa, Mycobacterium
DEPANGHLLLPPWFIDKAGPDGIEAHGD

SEQ ID NO: 800312 - protein, 24 aa, Mycobacterium
DEPARAELAFKLAAGGRRVAVVSS

SEQ ID NO: 800313 - protein, 23 aa, Mycobacterium
DEPAVLSALSWEDYCAADAGTPA

SEQ ID NO: 800314 - protein, 24 aa, Mycobacterium
DEPDPLALLIYTSGSTGAPKGAMY

SEQ ID NO: 800315 - protein, 23 aa, Mycobacterium
DEPDRFLITRPPGKSLAFGHGIH

SEQ ID NO: 800316 - protein, 17 aa, Mycobacterium
DEPEIVIKYFGPRAAER

SEQ ID NO: 800317 - protein, 33 aa, Mycobacterium; identical to SEQ ID NO: 216845

SEQ ID NO: 800318 - protein, 18 aa, Mycobacterium
DEPFAALDAGLRVRVRED

SEQ ID NO: 800319 - protein, 20 aa, Mycobacterium
DEPFMLPAHIDLAALRVKFD

SEQ ID NO: 800320 - protein, 25 aa, Mycobacterium
DEPGAAALWFALETNLPVIVDADGL

SEQ ID NO: 800321 - protein, 35 aa, Mycobacterium
DEPGMLLEPGLGFFPWGMVDQHFIKRGRFGRLVVG

SEQ ID NO: 800322 - protein, 18 aa, Mycobacterium
DEPHAVIVDIDRLRASSA

SEQ ID NO: 800323 - protein, 18 aa, Mycobacterium
DEPIPAKMIIIMDPPEHR

SEQ ID NO: 800324 - protein, 25 aa, Mycobacterium
DEPKFHAWIFDFMAGTDLGPEGDTE

SEQ ID NO: 800325 - protein, 20 aa, Mycobacterium
DEPLRLVWCGRLSSEKRALE

SEQ ID NO: 800326 - protein, 17 aa, Mycobacterium
DEPLWSESWYADFVDAP

SEQ ID NO: 800327 - protein, 24 aa, Mycobacterium
DEPNPFAMLFAHLYGFNAETVYLS

SEQ ID NO: 800328 - protein, 18 aa, Mycobacterium
DEPQLRFEMCLGVSGVHY

SEQ ID NO: 800329 - protein, 21 aa, Mycobacterium
DEPRISAMRAFYRETGQGALA

SEQ ID NO: 800330 - protein, 25 aa, Mycobacterium
DEPRKGMSVLLEALPKLVERFSDVQ

SEQ ID NO: 800331 - protein, 26 aa, Mycobacterium
DEPRPGFWQNLVELGWLGLHVDEEYG

SEQ ID NO: 800332 - protein, 17 aa, Mycobacterium
DEPTLDALLIMSLTQES

SEQ ID NO: 800333 - protein, 29 aa, Mycobacterium
DEPTTLITSDTLRRIPLGDILARVERDLP

SEQ ID NO: 800334 - protein, 17 aa, Mycobacterium
DEPVAALWHAATLLREQ

SEQ ID NO: 800335 - protein, 17 aa, Mycobacterium
DEPVTAWALFRYDQVFA

SEQ ID NO: 800336 - protein, 33 aa, Mycobacterium
DEPYDRAFSGGVPPLYAIEKGPFHAAAFGVSDL

SEQ ID NO: 800337 - protein, 23 aa, Mycobacterium
DEPYGNYNRILLSNVLAGVDDPT

SEQ ID NO: 800338 - protein, 22 aa, Mycobacterium
DEPYTALAVVWSFLLDTSAGLG

SEQ ID NO: 800339 - protein, 27 aa, Mycobacterium
DEQAGAILFLLSDLSNYVTGQTLLVDG

SEQ ID NO: 800340 - protein, 22 aa, Mycobacterium
DEQALFLSDAVPTGFMGADFCD

SEQ ID NO: 800341 - protein, 19 aa, Mycobacterium
DEQFIQNPQLLYARMHRTG

SEQ ID NO: 800342 - protein, 20 aa, Mycobacterium
DEQFMAWRRSYDTPPPQIEA

SEQ ID NO: 800343 - protein, 21 aa, Mycobacterium
DEQFYLFGLGHHISVDGLGMA

SEQ ID NO: 800344 - protein, 22 aa, Mycobacterium
DEQGNYIFPEGFDPETNEWLEG

SEQ ID NO: 800345 - protein, 24 aa, Mycobacterium
DEQGRILLIKRRDNTLWALPGGGH

SEQ ID NO: 800346 - protein, 22 aa, Mycobacterium
DEQIYGFMRNLLPAGAETTSRS

SEQ ID NO: 800347 - protein, 19 aa, Mycobacterium
DEQKARWFPGFCSGELISA

SEQ ID NO: 800348 - protein, 25 aa, Mycobacterium
DEQKKFFLPKIAAGDLHFSIGYSEP

SEQ ID NO: 800349 - protein, 25 aa, Mycobacterium
DEQKKFFLPKIAAGKLHFSIGYSEP

SEQ ID NO: 800350 - protein, 23 aa, Mycobacterium
DEQKLRWAVPILRAQITASLGMS

SEQ ID NO: 800351 - protein, 26 aa, Mycobacterium
DEQKMRKAWRKYLPRHYRVKPKTKVA

SEQ ID NO: 800352 - protein, 24 aa, Mycobacterium
DEQKQRWLPGMLSGEQIGAYSLSE

SEQ ID NO: 800353 - protein, 29 aa, Mycobacterium
DEQKRKFLRPLFTGEQIYCQLFSEPGAGS

SEQ ID NO: 800354 - protein, 25 aa, Mycobacterium
DEQLVALLRLRPDLTQPPPGSIAAL

SEQ ID NO: 800355 - protein, 28 aa, Mycobacterium
DEQQQDVLLFIDNIFRFTQAGSEVSTLL

SEQ ID NO: 800356 - protein, 23 aa, Mycobacterium
DEQRGFLRSLRRKKRNPDEGEPN

SEQ ID NO: 800357 - protein, 30 aa, Mycobacterium
DEQRHHLADNAAFFREILPGRDAPLGSPGG

SEQ ID NO: 800358 - protein, 24 aa, Mycobacterium
DEQRIEMWLRSTRAQRVRIDALDL

SEQ ID NO: 800359 - protein, 24 aa, Mycobacterium
DEQRRQWLDPLLHGEIRSAFSMTE

SEQ ID NO: 800360 - protein, 23 aa, Mycobacterium
DEQTRLWIRAGWVTPVPAAKREK

SEQ ID NO: 800361 - protein, 25 aa, Mycobacterium
DEQWDQVIRLIKQLGFMPPDVQLSG

SEQ ID NO: 800362 - protein, 24 aa, Mycobacterium
DEQYGQRLAAFVVLNPGSGATVDT

SEQ ID NO: 800363 - protein, 20 aa, Mycobacterium
DEQYLFQALRVGAAGYLLKS

SEQ ID NO: 800364 - protein, 25 aa, Mycobacterium
DERAAIYRWTWNAPTATAFVGVPTN

SEQ ID NO: 800365 - protein, 17 aa, Mycobacterium
DERAKWATYPILAVQGW

SEQ ID NO: 800366 - protein, 33 aa, Mycobacterium
DERALVGHATRWRPWRSYATQYLWTTLEHPVNQ

SEQ ID NO: 800367 - protein, 24 aa, Mycobacterium
DERARLMFMLGTLTPDRVTRDAGA

SEQ ID NO: 800368 - protein, 25 aa, Mycobacterium
DERARLPIDPEWGPGWHLGVVGLDD

SEQ ID NO: 800369 - protein, 25 aa, Mycobacterium
DEREKLLRRIGLAAGKYWVCKRATP

SEQ ID NO: 800370 - protein, 26 aa, Mycobacterium
DERETLLRRIGLAAAKYWVCKRATPH

SEQ ID NO: 800371 - protein, 28 aa, Mycobacterium
DERFQAARWMWDYFIDLIASRRRNLGDD

SEQ ID NO: 800372 - protein, 27 aa, Mycobacterium
DERFTSRVLPRVPVRRWGAAEDVAGVG

SEQ ID NO: 800373 - protein, 29 aa, Mycobacterium
DERGCLKLSSRLLLNLIRGLPEDSEFKTH

SEQ ID NO: 800374 - protein, 23 aa, Mycobacterium
DERGHVLLTLHPRLGRWVQLGGH

SEQ ID NO: 800375 - protein, 17 aa, Mycobacterium
DERGLPLWQKLTVYTSE

SEQ ID NO: 800376 - protein, 21 aa, Mycobacterium
DERGRRFLVHTSKIAYVEIGP

SEQ ID NO: 800377 - protein, 17 aa, Mycobacterium
DERICLCGNTFGPVFGH

SEQ ID NO: 800378 - protein, 25 aa, Mycobacterium
DERIGPLSFPLGKQQRPATAVVAGD

SEQ ID NO: 800379 - protein, 19 aa, Mycobacterium
DERLAVLGAILDEYQKRAI

SEQ ID NO: 800380 - protein, 17 aa, Mycobacterium
DERLAWVKPQLGLYLGG

SEQ ID NO: 800381 - protein, 19 aa, Mycobacterium
DERLLWPKYQEAYQAMLEK

SEQ ID NO: 800382 - protein, 17 aa, Mycobacterium
DERLQALGAVRLTARVD

SEQ ID NO: 800383 - protein, 24 aa, Mycobacterium
DERLRLDRWWRELPDEARAALVTC

SEQ ID NO: 800384 - protein, 23 aa, Mycobacterium
DERMIADWRAGMAPPAPPRPGLG

SEQ ID NO: 800385 - protein, 17 aa, Mycobacterium
DERPHVHLAARPGVLTA

SEQ ID NO: 800386 - protein, 17 aa, Mycobacterium
DERPNLVRFLLGVQYAN

SEQ ID NO: 800387 - protein, 17 aa, Mycobacterium
DERPQVHLAARPGVLTA

SEQ ID NO: 800388 - protein, 29 aa, Mycobacterium
DERQTLINFLEFQQNAFFAVAYGLTDEQA

SEQ ID NO: 800389 - protein, 17 aa, Mycobacterium
DERREFLAGLSPETVHE

SEQ ID NO: 800390 - protein, 23 aa, Mycobacterium
DERRRESMLMSLRSRSQDPAHRL

SEQ ID NO: 800391 - protein, 25 aa, Mycobacterium
DERSALLEFLAYHQSAYFAVSYGLT

SEQ ID NO: 800392 - protein, 27 aa, Mycobacterium
DERSTPPWWPMRQLVRALGADADEVLE

SEQ ID NO: 800393 - protein, 25 aa, Mycobacterium
DERTAGFLAIGLAVGAGAPACVAMT

SEQ ID NO: 800394 - protein, 24 aa, Mycobacterium
DERTAGFLAVGLAAASGSPVPVAM

SEQ ID NO: 800395 - protein, 24 aa, Mycobacterium
DERTPFAAVTWFRPDHTIDVSAPC

SEQ ID NO: 800396 - protein, 17 aa, Mycobacterium
DERVAGLPGPLVNLVEE

SEQ ID NO: 800397 - protein, 24 aa, Mycobacterium
DERVLREWFAQLVMYSMSATLADS

SEQ ID NO: 800398 - protein, 23 aa, Mycobacterium
DERWNDFVVPGLGIRCVDDRPWV

SEQ ID NO: 800399 - protein, 23 aa, Mycobacterium
DERWRLIQYLIEHPDLETRDRVA

SEQ ID NO: 800400 - protein, 19 aa, Mycobacterium
DERWRLQTPGGLRTPARLW

SEQ ID NO: 800401 - protein, 18 aa, Mycobacterium
DERYFIPQQFENPANPAV

SEQ ID NO: 800402 - protein, 20 aa, Mycobacterium
DESAIVYRALADGAAGFLPK

SEQ ID NO: 800403 - protein, 26 aa, Mycobacterium
DESALPYQRPPLSKSYLADKCELAEL

SEQ ID NO: 800404 - protein, 30 aa, Mycobacterium
DESEVARLWPFADLTPFAAFGWEARGGYGD

SEQ ID NO: 800405 - protein, 30 aa, Mycobacterium
DESIKFYETLGFSLKFRDGAHFAALDGGAV

SEQ ID NO: 800406 - protein, 19 aa, Mycobacterium
DESITFYRKLFGVEPAKVK

SEQ ID NO: 800407 - protein, 29 aa, Mycobacterium
DESKRLMRDYPYLAGFLRAVRAENADQTG

SEQ ID NO: 800408 - protein, 33 aa, Mycobacterium
DESLYDGLMWIFRTIFEPWEKHPRMLQAYVRAQ

SEQ ID NO: 800409 - protein, 24 aa, Mycobacterium
DESPRYQLVMGERRWRAAQQAGVA

SEQ ID NO: 800410 - protein, 24 aa, Mycobacterium
DESQGLLLQLLDPANRPDPYGLCA

SEQ ID NO: 800411 - protein, 30 aa, Mycobacterium
DESTRRVRLMRWGLVPPWVKAGEDGGPDTK

SEQ ID NO: 800412 - protein, 26 aa, Mycobacterium
DESVNAFYHLGWLCVWAVLEAVAEPG

SEQ ID NO: 800413 - protein, 18 aa, Mycobacterium
DESWQVFLADLTAAYVHG

SEQ ID NO: 800414 - protein, 25 aa, Mycobacterium
DETAAQWIGLISFLMSPGTARSLNF

SEQ ID NO: 800415 - protein, 27 aa, Mycobacterium
DETAWRCGQWYTARLSPMPLRPEERKT

SEQ ID NO: 800416 - protein, 27 aa, Mycobacterium
DETCIQMHLLYLGFARAVAKRTDPVTA

SEQ ID NO: 800417 - protein, 25 aa, Mycobacterium
DETEALLRRIGLAASKYWVCKRSTP

SEQ ID NO: 800418 - protein, 26 aa, Mycobacterium
DETESLLRRIGLAASKYWVCKRATPH

SEQ ID NO: 800419 - protein, 25 aa, Mycobacterium
DETGMVNVLCAPGVWARHRKLANSA

SEQ ID NO: 800420 - protein, 25 aa, Mycobacterium
DETGMVNVLCTPAVWARHRKLANAA

SEQ ID NO: 800421 - protein, 24 aa, Mycobacterium
DETGMVNVLCTPGVWARHRKLANT

SEQ ID NO: 800422 - protein, 25 aa, Mycobacterium
DETGMVNVLCTPGVWVRHRKLANTA

SEQ ID NO: 800423 - protein, 24 aa, Mycobacterium
DETGWLLGDYILSQPQDGTRIVAS

SEQ ID NO: 800424 - protein, 24 aa, Mycobacterium
DETGWLLGDYILSTQPDSSIPPVV

SEQ ID NO: 800425 - protein, 28 aa, Mycobacterium
DETLDHFLGVMLRAPFRLARDVIVHMQP

SEQ ID NO: 800426 - protein, 25 aa, Mycobacterium
DETPLGKWWRDMKLARVGGGTDEVL

SEQ ID NO: 800427 - protein, 26 aa, Mycobacterium
DETPMLLQPGVLSLAWGSVVRQLAAG

SEQ ID NO: 800428 - protein, 26 aa, Mycobacterium
DETRHWVVVDLINPLLTQLDARLITA

SEQ ID NO: 800429 - protein, 20 aa, Mycobacterium
DETRRLFAGGGFGGRRFDAG

SEQ ID NO: 800430 - protein, 26 aa, Mycobacterium
DETRSVTGFFWVDDPRWLLYVQDSGG

SEQ ID NO: 800431 - protein, 29 aa, Mycobacterium
DETSDFMSYLNLWRYLRERRSALSGSGFR

SEQ ID NO: 800432 - protein, 25 aa, Mycobacterium
DETTDPLVICDLGMPRDVDPAVAGL

SEQ ID NO: 800433 - protein, 18 aa, Mycobacterium
DETTFEFLKGRPHAPKGA

SEQ ID NO: 800434 - protein, 17 aa, Mycobacterium
DETTWKKAGFDAAVTAF

SEQ ID NO: 800435 - protein, 28 aa, Mycobacterium
DETVLALHRYLGLTPSRLLALSLADAVG

SEQ ID NO: 800436 - protein, 25 aa, Mycobacterium
DETVQFSARFLFLGTGYYDYDAGFT

SEQ ID NO: 800437 - protein, 26 aa, Mycobacterium
DEVAELRRMFGIPDYFIRVQTADLAA

SEQ ID NO: 800438 - protein, 21 aa, Mycobacterium
DEVAHLARLSRLALTDGELDS

SEQ ID NO: 800439 - protein, 19 aa, Mycobacterium
DEVAKVALFLASDLSSYMT

SEQ ID NO: 800440 - protein, 25 aa, Mycobacterium
DEVASAILFMACDLSSGITGQALDV

SEQ ID NO: 800441 - protein, 30 aa, Mycobacterium
DEVDAKLWVDMAHFAGLVAAGLHPSPVPHA

SEQ ID NO: 800442 - protein, 24 aa, Mycobacterium
DEVDILLTHTQLPDLPFVGCGGEV

SEQ ID NO: 800443 - protein, 27 aa, Mycobacterium
DEVDLSGPTAWLFGPEAHGLPAEVAAL

SEQ ID NO: 800444 - protein, 22 aa, Mycobacterium
DEVFAGYHWYPPMAEPAAASLD

SEQ ID NO: 800445 - protein, 35 aa, Mycobacterium
DEVFGLLAALGDPLLWSIPLHWAGVHAGILANSPD

SEQ ID NO: 800446 - protein, 40 aa, Mycobacterium
DEVGDGMRWAMRHLPFYGRWYRFLVLWPGSDKGLDAAESD

SEQ ID NO: 800447 - protein, 22 aa, Mycobacterium
DEVGPVLRAILQTAAHEPTTHE

SEQ ID NO: 800448 - protein, 26 aa, Mycobacterium
DEVIFGWRSFELYPPQVQVAGATAIQ

SEQ ID NO: 800449 - protein, 25 aa, Mycobacterium
DEVLFAWRSFEIYPLQVRTAGATPV

SEQ ID NO: 800450 - protein, 25 aa, Mycobacterium
DEVLFGWRSFEIYPLQVRTAGATPV

SEQ ID NO: 800451 - protein, 26 aa, Mycobacterium
DEVLFGWRSFETYPLVVRVAGATPVQ

SEQ ID NO: 800452 - protein, 22 aa, Mycobacterium
DEVLLRLFGKAVELAFLAVPDE

SEQ ID NO: 800453 - protein, 23 aa, Mycobacterium
DEVLYLLRIRGRASVPIVSTVGS

SEQ ID NO: 800454 - protein, 19 aa, Mycobacterium
DEVNFLTLNAFFTSIGGGT

SEQ ID NO: 800455 - protein, 27 aa, Mycobacterium
DEVNTRLLQRLTVAEFFGLMRQFGEGS

SEQ ID NO: 800456 - protein, 19 aa, Mycobacterium
DEVPYFWSDHYDVKLQMLG

SEQ ID NO: 800457 - protein, 25 aa, Mycobacterium
DEVQIGKFRLVFLTGPKQGDDDGGA

SEQ ID NO: 800458 - protein, 26 aa, Mycobacterium
DEVQIGKFRLVFLTGPKSAGDDSASG

SEQ ID NO: 800459 - protein, 24 aa, Mycobacterium
DEVRKRFDLISRKLPMFRQRVVPS

SEQ ID NO: 800460 - protein, 27 aa, Mycobacterium
DEVRRYIIGAALRWMREFHADGLRLDA

SEQ ID NO: 800461 - protein, 32 aa, Mycobacterium
DEVRTYILECALRWMRDFHADGLRLDAVHALM

SEQ ID NO: 800462 - protein, 25 aa, Mycobacterium
DEVSAAVTAMFGNHAQAYQAVSTQA

SEQ ID NO: 800463 - protein, 19 aa, Mycobacterium
DEVSALQAALFTAYGTLYQ

SEQ ID NO: 800464 - protein, 24 aa, Mycobacterium
DEVSAVIAFLASPGARYVTGTTVV

SEQ ID NO: 800465 - protein, 25 aa, Mycobacterium
DEVSDMFYSIWWPKEPGGASDIPPE

SEQ ID NO: 800466 - protein, 26 aa, Mycobacterium
DEVSDMFYSIWWPKLPGETSDIPPAE

SEQ ID NO: 800467 - protein, 24 aa, Mycobacterium
DEVSFAISALFDAHAQAYQALSAQ

SEQ ID NO: 800468 - protein, 22 aa, Mycobacterium
DEVSPAVLFLSSDAARYITGTT

SEQ ID NO: 800469 - protein, 50 aa, Mycobacterium
DEVSVAVVGLFRGLGQDYQLFGAQLEQFHQRFVQILDAARTAYLETETAA

SEQ ID NO: 800470 - protein, 51 aa, Mycobacterium
DEVSVAVVGLFRGLGQDYQLFGAQLEQFHQRFVQILDAARTAYLETETAAA

SEQ ID NO: 800471 - protein, 22 aa, Mycobacterium
DEVTFACWAAKPDSWPADTPDP

SEQ ID NO: 800472 - protein, 35 aa, Mycobacterium
DEVTRRVIVPLGLRDTYWPAPDDTGLRKPFAHGYE

SEQ ID NO: 800473 - protein, 27 aa, Mycobacterium
DEVVGQDHLLAPGSPLRRLVEGSGVAS

SEQ ID NO: 800474 - protein, 26 aa, Mycobacterium
DEVVGQEHLLAPGSPLRRLVEGSGMA

SEQ ID NO: 800475 - protein, 24 aa, Mycobacterium
DEVVHLILDVMTAKLPYTAISRTM

SEQ ID NO: 800476 - protein, 17 aa, Mycobacterium
DEVWRTIHDHKVNLLFF

SEQ ID NO: 800477 - protein, 18 aa, Mycobacterium
DEVWRTIHEHKVNLLFFT

SEQ ID NO: 800478 - protein, 24 aa, Mycobacterium
DEVYAFLGGIFRRGLEKEGLADKL

SEQ ID NO: 800479 - protein, 31 aa, Mycobacterium
DEWAARGWLAIRYNLPYRRRRPKGPPSGSAQ

SEQ ID NO: 800480 - protein, 19 aa, Mycobacterium
DEWFLAGHVVVGWPRGKHG

SEQ ID NO: 800481 - protein, 22 aa, Mycobacterium
DEWGNRAILTKPVKAPTSIPEM

SEQ ID NO: 800482 - protein, 18 aa, Mycobacterium
DEWKIPRVKIKIGESWGS

SEQ ID NO: 800483 - protein, 18 aa, Mycobacterium
DEWLREPLLRACRDGNST

SEQ ID NO: 800484 - protein, 21 aa, Mycobacterium
DEWPGLLRRLVSEQVSLILRR

SEQ ID NO: 800485 - protein, 21 aa, Mycobacterium
DEWPSAIRRLVSGQISLLLRR

SEQ ID NO: 800486 - protein, 26 aa, Mycobacterium
DEWQENHAWLYGPAALQVMRFLATLH

SEQ ID NO: 800487 - protein, 19 aa, Mycobacterium
DEWQPLYEFSTVSRPPIDL

SEQ ID NO: 800488 - protein, 22 aa, Mycobacterium
DEYEWAPLRLPPEVTRLSASTR

SEQ ID NO: 800489 - protein, 23 aa, Mycobacterium
DEYEWVPLRLPPDVTRLSASIRL

SEQ ID NO: 800490 - protein, 22 aa, Mycobacterium
DEYGIPFLGIRGITDGPGDPLR

SEQ ID NO: 800491 - protein, 25 aa, Mycobacterium
DEYKEPLYAAPPLLLRMVEAGRLGK

SEQ ID NO: 800492 - protein, 23 aa, Mycobacterium
DEYLEVLYKLWEGSWEDDAVVRD

SEQ ID NO: 800493 - protein, 20 aa, Mycobacterium
DEYMEMLGGLLRAAQRAGTV

SEQ ID NO: 800494 - protein, 24 aa, Mycobacterium
DEYNALKAWLISVGADGEWPLFLD

SEQ ID NO: 800495 - protein, 23 aa, Mycobacterium
DEYRAVLRFGGLDEAGLHRIGLT

SEQ ID NO: 800496 - protein, 27 aa, Mycobacterium
DEYRDLWTSWTRHFWRLQDLVALCRQA

SEQ ID NO: 800497 - protein, 21 aa, Mycobacterium
DEYTEVLYKLWEGSWEDDAVG

SEQ ID NO: 800498 - protein, 20 aa, Mycobacterium
DEYVAMCAKLFATVGRQFSD

SEQ ID NO: 800499 - protein, 21 aa, Mycobacterium
DEYVRTYTDLPFLVKLEERGG

SEQ ID NO: 800500 - protein, 21 aa, Mycobacterium
DFAALLLYRLGRLPSDRSSIV

SEQ ID NO: 800501 - protein, 21 aa, Mycobacterium
DFAAQLLTGFSPPGATAAVYT

SEQ ID NO: 800502 - protein, 30 aa, Mycobacterium
DFAARPALLATFPFPHLLTLDITLADRTLT

SEQ ID NO: 800503 - protein, 23 aa, Mycobacterium
DFAARRVYPPRYQLGEWVIPRGE

SEQ ID NO: 800504 - protein, 19 aa, Mycobacterium
DFADAWWDPLLAALKDDET

SEQ ID NO: 800505 - protein, 25 aa, Mycobacterium
DFADLAVRLGWYDQAHFINDFRGML

SEQ ID NO: 800506 - protein, 25 aa, Mycobacterium
DFADRITHVWTNTQAYLVVVHLEAP

SEQ ID NO: 800507 - protein, 24 aa, Mycobacterium
DFADYPRMLLAECARLNRAGLTTC

SEQ ID NO: 800508 - protein, 26 aa, Mycobacterium
DFAEGRSFLLPPTWTQLDALNGRTVA

SEQ ID NO: 800509 - protein, 25 aa, Mycobacterium
DFAFQMAGALALRDAAAATKINLLE

SEQ ID NO: 800510 - protein, 19 aa, Mycobacterium
DFAFVWVNGARQKFSRPCY

SEQ ID NO: 800511 - protein, 17 aa, Mycobacterium
DFAGYGAALQRLDDAIT

SEQ ID NO: 800512 - protein, 23 aa, Mycobacterium
DFAHPRFRAMRDATPELAWGLMI

SEQ ID NO: 800513 - protein, 19 aa, Mycobacterium
DFAIAIRTALFKDGRAYVQ

SEQ ID NO: 800514 - protein, 18 aa, Mycobacterium
DFAIAIRTALMRGGTAYV

SEQ ID NO: 800515 - protein, 18 aa, Mycobacterium
DFAILVRLPGNPSAIKVF

SEQ ID NO: 800516 - protein, 26 aa, Mycobacterium
DFAIPPAMRRILARVPLMQRAFRASS

SEQ ID NO: 800517 - protein, 24 aa, Mycobacterium
DFALDVFMRLHVMELKPAFAEATA

SEQ ID NO: 800518 - protein, 17 aa, Mycobacterium
DFANYRKRVERDRQAVI

SEQ ID NO: 800519 - protein, 29 aa, Mycobacterium
DFAPFSQMMHTLPVPWVEAVDISNAVLFL

SEQ ID NO: 800520 - protein, 18 aa, Mycobacterium
DFAQRGWIRVQGKSILID

SEQ ID NO: 800521 - protein, 19 aa, Mycobacterium
DFAQVMRKLWHGELIFNHD

SEQ ID NO: 800522 - protein, 23 aa, Mycobacterium
DFAQVMRRLWQGEVIFNHDGPIG

SEQ ID NO: 800523 - protein, 26 aa, Mycobacterium
DFARPLTVIAGAATRWVWVANAANAT

SEQ ID NO: 800524 - protein, 23 aa, Mycobacterium
DFASSFGILVLTRAYADWSADIN

SEQ ID NO: 800525 - protein, 26 aa, Mycobacterium
DFATGPPPPALPYLDVADPGPNDPAT

SEQ ID NO: 800526 - protein, 21 aa, Mycobacterium
DFAYRNPACGAALLQSALPLA

SEQ ID NO: 800527 - protein, 19 aa, Mycobacterium
DFCAKGGWLDHIGVDIAPV

SEQ ID NO: 800528 - protein, 19 aa, Mycobacterium
DFCDFLAGKTDRLIREMEQ

SEQ ID NO: 800529 - protein, 22 aa, Mycobacterium
DFCGRYEWLFAALRHELADWQY

SEQ ID NO: 800530 - protein, 24 aa, Mycobacterium
DFCRPDWMVMVDADWVFQIDVDIR

SEQ ID NO: 800531 - protein, 17 aa, Mycobacterium
DFDAAIATPDQMAKVGR

SEQ ID NO: 800532 - protein, 38 aa, Mycobacterium
DFDALFTPDKPIIFAYHGYPWLIHRLAYRHTNHDRMHV

SEQ ID NO: 800533 - protein, 23 aa, Mycobacterium
DFDAMLQRALPRTALIQLSDYVL

SEQ ID NO: 800534 - protein, 23 aa, Mycobacterium
DFDEWHQHAQWWDQEGPRVRERL

SEQ ID NO: 800535 - protein, 17 aa, Mycobacterium
DFDKVMDANLRGAWLVC

SEQ ID NO: 800536 - protein, 17 aa, Mycobacterium
DFDLSSLRWALSGSEQV

SEQ ID NO: 800537 - protein, 21 aa, Mycobacterium
DFDPDVVILDLGLPGIDGLEV

SEQ ID NO: 800538 - protein, 17 aa, Mycobacterium
DFDRLLAKRGTRVSFDI

SEQ ID NO: 800539 - protein, 25 aa, Mycobacterium
DFDVPDQLELLARYTRHFVACDYYD

SEQ ID NO: 800540 - protein, 18 aa, Mycobacterium
DFEEIQIPTPPRLGSVVV

SEQ ID NO: 800541 - protein, 22 aa, Mycobacterium
DFEHWSIHRKPPAFEDLEPRTE

SEQ ID NO: 800542 - protein, 20 aa, Mycobacterium
DFEIFRGRWLVEPSPTGSRV

SEQ ID NO: 800543 - protein, 18 aa, Mycobacterium
DFEILGPLPRKNIDTGMG

SEQ ID NO: 800544 - protein, 20 aa, Mycobacterium
DFEILGPLPRKNIDTGMGIE

SEQ ID NO: 800545 - protein, 31 aa, Mycobacterium
DFEISLPTLPQQALLYRLCGDRNPLHSDPTF

SEQ ID NO: 800546 - protein, 29 aa, Mycobacterium
DFEKTPAIRFLLIELPDNRWHLVITAHHI

SEQ ID NO: 800547 - protein, 24 aa, Mycobacterium
DFENMHGLMLPFLEQFVVKARYAD

SEQ ID NO: 800548 - protein, 26 aa, Mycobacterium
DFETSWLDPFTEFRFPRIGTAVFDGV

SEQ ID NO: 800549 - protein, 18 aa, Mycobacterium
DFFALFQDPTRTYSCAYF

SEQ ID NO: 800550 - protein, 23 aa, Mycobacterium
DFFALGAAYRRYAIERPHMYRLM

SEQ ID NO: 800551 - protein, 20 aa, Mycobacterium
DFFAMTADVLGAVLPGAVAE

SEQ ID NO: 800552 - protein, 23 aa, Mycobacterium
DFFEGVMMPELFMADAMGASGKP

SEQ ID NO: 800553 - protein, 22 aa, Mycobacterium
DFFEGVMMPELFMADAVGATGK

SEQ ID NO: 800554 - protein, 19 aa, Mycobacterium
DFFGLFQDPSRIYSCAYFE

SEQ ID NO: 800555 - protein, 17 aa, Mycobacterium
DFFGSEQAYTAVFDSFV

SEQ ID NO: 800556 - protein, 27 aa, Mycobacterium
DFFTADWTHLPLSGGLPWAQPEPRRPR

SEQ ID NO: 800557 - protein, 17 aa, Mycobacterium
DFFTLAHNILPSDGVML

SEQ ID NO: 800558 - protein, 27 aa, Mycobacterium
DFGADPVLLASFPYPHVLSLTARLAER

SEQ ID NO: 800559 - protein, 19 aa, Mycobacterium
DFGAFQHAPARKLDLPTYP

SEQ ID NO: 800560 - protein, 20 aa, Mycobacterium
DFGAFVSLLPGRDGLVHISK

SEQ ID NO: 800561 - protein, 18 aa, Mycobacterium
DFGALEITTCLRRGEIEM

SEQ ID NO: 800562 - protein, 19 aa, Mycobacterium
DFGFDAFRRHVRRRLHLLE

SEQ ID NO: 800563 - protein, 20 aa, Mycobacterium
DFGFQQWVRQSGRPWPLDRY

SEQ ID NO: 800564 - protein, 20 aa, Mycobacterium
DFGKWEGLTFSEASERDPEL

SEQ ID NO: 800565 - protein, 20 aa, Mycobacterium
DFGLHGIAMSRFSGLWVGMK

SEQ ID NO: 800566 - protein, 17 aa, Mycobacterium
DFGMQMAAAARLAARFP

SEQ ID NO: 800567 - protein, 31 aa, Mycobacterium
DFGPERDAWYEAYFAWELALLKETEGDPFFD

SEQ ID NO: 800568 - protein, 18 aa, Mycobacterium
DFGRTWIVGRDPAPRQQA

SEQ ID NO: 800569 - protein, 26 aa, Mycobacterium
DFGTGYSVLTYLKSLPVDSLKIDKGF

SEQ ID NO: 800570 - protein, 20 aa, Mycobacterium
DFGVLGASQAALRNSRGRLR

SEQ ID NO: 800571 - protein, 17 aa, Mycobacterium
DFGVPFTLTRRGALTAE

SEQ ID NO: 800572 - protein, 17 aa, Mycobacterium
DFHARAARYIAEGLAHN

SEQ ID NO: 800573 - protein, 27 aa, Mycobacterium
DFHEALNFAAVFRAPVIFLVQNNGFAI

SEQ ID NO: 800574 - protein, 17 aa, Mycobacterium
DFHFHPHITAPSGKPGM

SEQ ID NO: 800575 - protein, 27 aa, Mycobacterium
DFHGPSYQHPPAWDLAGRRDRHVNGVV

SEQ ID NO: 800576 - protein, 19 aa, Mycobacterium
DFHIRRIGVPAPGGRKELE

SEQ ID NO: 800577 - protein, 18 aa, Mycobacterium
DFHKQPEFLAPQDKGPWG

SEQ ID NO: 800578 - protein, 23 aa, Mycobacterium
DFHKQPEFLAPQDNGPWAVFDLS

SEQ ID NO: 800579 - protein, 18 aa, Mycobacterium
DFHLAYAAALATAGRFAD

SEQ ID NO: 800580 - protein, 18 aa, Mycobacterium
DFHLAYAAALATTGDYAK

SEQ ID NO: 800581 - protein, 17 aa, Mycobacterium
DFHRRVVELSGNATLGI

SEQ ID NO: 800582 - protein, 20 aa, Mycobacterium
DFHSIFEDITHCPAYFASLT

SEQ ID NO: 800583 - protein, 17 aa, Mycobacterium
DFHVRRIGVPAPGGRRE

SEQ ID NO: 800584 - protein, 18 aa, Mycobacterium
DFHVRRIGVPAPGGRREL

SEQ ID NO: 800585 - protein, 18 aa, Mycobacterium
DFIDLFRNGLRGLAPDGS

SEQ ID NO: 800586 - protein, 26 aa, Mycobacterium
DFIEGYNLNMAIPWIAAERGFIDAVV

SEQ ID NO: 800587 - protein, 19 aa, Mycobacterium
DFIEHVVPILQRRGLFRTE

SEQ ID NO: 800588 - protein, 28 aa, Mycobacterium
DFIETTGIPFLPMSMAKGLLPDSHPCSA

SEQ ID NO: 800589 - protein, 18 aa, Mycobacterium
DFIGFSQPLDDLPTVEGT

SEQ ID NO: 800590 - protein, 18 aa, Mycobacterium
DFIICYRMSMADYVEHGQ

SEQ ID NO: 800591 - protein, 23 aa, Mycobacterium
DFIQRPRFLAISEFGPDAFIYHE

SEQ ID NO: 800592 - protein, 25 aa, Mycobacterium
DFKEALWLRRWCSATSNRWCQMRVR

SEQ ID NO: 800593 - protein, 24 aa, Mycobacterium
DFKGIPVAIKAWPAVIEKFPSAVL

SEQ ID NO: 800594 - protein, 30 aa, Mycobacterium
DFLATVAVTRLVLGPKMRIQAPPNLVSRDE

SEQ ID NO: 800595 - protein, 29 aa, Mycobacterium
DFLDEEFLRNMWAEFFRSIWTVRSPIRLM

SEQ ID NO: 800596 - protein, 21 aa, Mycobacterium
DFLGERFRRAVPTGRVFRCGQ

SEQ ID NO: 800597 - protein, 24 aa, Mycobacterium
DFLGGGLNWPLDLTVGADGAVYVA

SEQ ID NO: 800598 - protein, 26 aa, Mycobacterium
DFLGKFWNFPEVRRRWREAQDMLVQS

SEQ ID NO: 800599 - protein, 24 aa, Mycobacterium
DFLHEGWLVLRRGKRHIAGVRRVT

SEQ ID NO: 800600 - protein, 18 aa, Mycobacterium
DFLIVATGLLHHPRVPAI

SEQ ID NO: 800601 - protein, 19 aa, Mycobacterium
DFLNLRTYGYKDLTHWMEK

SEQ ID NO: 800602 - protein, 17 aa, Mycobacterium
DFLPGDPAALGPTLADA

SEQ ID NO: 800603 - protein, 18 aa, Mycobacterium
DFLPGDPARLGPTLADAA

SEQ ID NO: 800604 - protein, 18 aa, Mycobacterium
DFLQAHFYFSPRTDTEFW

SEQ ID NO: 800605 - protein, 19 aa, Mycobacterium
DFLRNFWMQMIRNPVGSLR

SEQ ID NO: 800606 - protein, 24 aa, Mycobacterium
DFLRTQAPHLLPVSGSPGVTPSDA

SEQ ID NO: 800607 - protein, 18 aa, Mycobacterium
DFLTRDLHLPTPEQARAA

SEQ ID NO: 800608 - protein, 28 aa, Mycobacterium
DFMADHVFSRIDIPGWLARTGFQMLDPI

SEQ ID NO: 800609 - protein, 18 aa, Mycobacterium
DFMKDQFPMAVHLLDGMA

SEQ ID NO: 800610 - protein, 19 aa, Mycobacterium
DFMTTGWFTGFVPITVPTV

SEQ ID NO: 800611 - protein, 17 aa, Mycobacterium
DFNFAWPTARIAVIGAD

SEQ ID NO: 800612 - protein, 18 aa, Mycobacterium
DFNFAWPTARIAVIGADG

SEQ ID NO: 800613 - protein, 23 aa, Mycobacterium
DFNLDFHLRRVRVPEPGTLRQVM

SEQ ID NO: 800614 - protein, 41 aa, Mycobacterium
DFNRRLLGLGLDARGVFWLPPYHDFGLISVILSGLAGSGEV

SEQ ID NO: 800615 - protein, 21 aa, Mycobacterium
DFNRVYAFYDELMRNGIRVFP

SEQ ID NO: 800616 - protein, 23 aa, Mycobacterium
DFNSISALRPLIAPWTTDIAEGD

SEQ ID NO: 800617 - protein, 26 aa, Mycobacterium
DFPASVLAVLRRLDGHFTLVFANADD

SEQ ID NO: 800618 - protein, 18 aa, Mycobacterium
DFPILQRVMRSGNQLAYL

SEQ ID NO: 800619 - protein, 20 aa, Mycobacterium
DFPLNGVVAGFQKAIAGQTV

SEQ ID NO: 800620 - protein, 17 aa, Mycobacterium
DFPMALSYVLDPTAAAD

SEQ ID NO: 800621 - protein, 30 aa, Mycobacterium
DFPNQINNVLAFPGVFRGALAAGARRITEK

SEQ ID NO: 800622 - protein, 26 aa, Mycobacterium
DFPNQINNVLAFPGVFRGALDAEATK

SEQ ID NO: 800623 - protein, 29 aa, Mycobacterium
DFPNQINNVLAFPGVFRGALDAGARQITE

SEQ ID NO: 800624 - protein, 29 aa, Mycobacterium
DFPNQINNVLAFPGVFRGALDAGARRITE

SEQ ID NO: 800625 - protein, 22 aa, Mycobacterium
DFPTLAHVWDYRSKAIIAGADR

SEQ ID NO: 800626 - protein, 27 aa, Mycobacterium
DFPTRHPYGLALWQNHIEHILADWVGE

SEQ ID NO: 800627 - protein, 18 aa, Mycobacterium
DFPTVAFPNPEEPGASDA

SEQ ID NO: 800628 - protein, 19 aa, Mycobacterium
DFPVYPLNVLALANAVAGI

SEQ ID NO: 800629 - protein, 23 aa, Mycobacterium
DFQDIGLLRFLQAHLDDIAPTTP

SEQ ID NO: 800630 - protein, 18 aa, Mycobacterium
DFQHMITQYAWGSIWTRP

SEQ ID NO: 800631 - protein, 26 aa, Mycobacterium
DFQPDAIMITPSYMLTLLDAMDRVGI

SEQ ID NO: 800632 - protein, 26 aa, Mycobacterium
DFRARLKAAYAEHPPVPLPGVPDAIR

SEQ ID NO: 800633 - protein, 23 aa, Mycobacterium
DFRATNPSAWWRVPVTIQNFAQD

SEQ ID NO: 800634 - protein, 19 aa, Mycobacterium
DFRDVGIAAVSIWMGSLLT

SEQ ID NO: 800635 - protein, 20 aa, Mycobacterium
DFRDWLLETITKPHGAQILK

SEQ ID NO: 800636 - protein, 28 aa, Mycobacterium
DFRGKKAVLLVFFPLAFTGVCQGELDHV

SEQ ID NO: 800637 - protein, 17 aa, Mycobacterium
DFRLARKTTTLGGVEIK

SEQ ID NO: 800638 - protein, 17 aa, Mycobacterium
DFRLARKTTTLGGVHIP

SEQ ID NO: 800639 - protein, 18 aa, Mycobacterium
DFRLFWDNAYAVHTLTHD

SEQ ID NO: 800640 - protein, 17 aa, Mycobacterium
DFRLLQQKTVYENVAFA

SEQ ID NO: 800641 - protein, 17 aa, Mycobacterium
DFRLVRKTTTLGGMHLK

SEQ ID NO: 800642 - protein, 20 aa, Mycobacterium
DFRRIFVTDAIMSGLPPHIA

SEQ ID NO: 800643 - protein, 20 aa, Mycobacterium
DFRRRSCCLIYRLAEDRTAV

SEQ ID NO: 800644 - protein, 23 aa, Mycobacterium
DFRSEARWPQYAPAAAEIGVLSG

SEQ ID NO: 800645 - protein, 28 aa, Mycobacterium
DFRTQFETNFWGVYNVSKAALPVLREQR

SEQ ID NO: 800646 - protein, 25 aa, Mycobacterium
DFSAGRCFLLPPTWTQLDSLAGRTV

SEQ ID NO: 800647 - protein, 23 aa, Mycobacterium
DFSALFPVQVITQMLGVPEEYRK

SEQ ID NO: 800648 - protein, 27 aa, Mycobacterium
DFSDDTSHYLWTWTDEPAGALRARMFA

SEQ ID NO: 800649 - protein, 20 aa, Mycobacterium
DFSDIPRALGVPYTYWGVGC

SEQ ID NO: 800650 - protein, 26 aa, Mycobacterium
DFSELWRTLAADLGVAGLLVPESLGG

SEQ ID NO: 800651 - protein, 30 aa, Mycobacterium
DFSFASYDPAWIDALFRTVAQLRSNGSAVL

SEQ ID NO: 800652 - protein, 22 aa, Mycobacterium
DFSGIRVLDLYAGSGALGLEAL

SEQ ID NO: 800653 - protein, 26 aa, Mycobacterium
DFSGKFTDFFESNLGKRMVKAARSPI

SEQ ID NO: 800654 - protein, 20 aa, Mycobacterium
DFSGPFPVEVITRMAGVEPE

SEQ ID NO: 800655 - protein, 24 aa, Mycobacterium
DFSKPAIVILGYGLKPDGSMRDKL

SEQ ID NO: 800656 - protein, 25 aa, Mycobacterium
DFSKPAIVILGYGLKPDGTMRLILH

SEQ ID NO: 800657 - protein, 21 aa, Mycobacterium
DFSLVELPAKLPRATLKKLES

SEQ ID NO: 800658 - protein, 24 aa, Mycobacterium
DFSQRAWDPVIGPFFEGGLMLRDF

SEQ ID NO: 800659 - protein, 20 aa, Mycobacterium
DFSRPLARVVLAAAPALSLG

SEQ ID NO: 800660 - protein, 23 aa, Mycobacterium
DFSRPLARVVLSSAPATVLSETG

SEQ ID NO: 800661 - protein, 17 aa, Mycobacterium
DFSVLYPAGELVDAPLP

SEQ ID NO: 800662 - protein, 21 aa, Mycobacterium
DFSVWEIFGALLGGGRLLVVP

SEQ ID NO: 800663 - protein, 21 aa, Mycobacterium
DFTDPDIYAHRLPVREFAELR

SEQ ID NO: 800664 - protein, 19 aa, Mycobacterium
DFTDRDVELLLVIGRLIAG

SEQ ID NO: 800665 - protein, 28 aa, Mycobacterium
DFTGDYWRAQLLGTVDFLGAARTLADME

SEQ ID NO: 800666 - protein, 29 aa, Mycobacterium
DFTLRADQTLPWHPGRCAAVLIGDVVVGH

SEQ ID NO: 800667 - protein, 17 aa, Mycobacterium
DFTLWKGEKPGEPSWPT

SEQ ID NO: 800668 - protein, 18 aa, Mycobacterium
DFTSSLLLDVDLTGLPTA

SEQ ID NO: 800669 - protein, 25 aa, Mycobacterium
DFVAAIWGCFLGGIVPVPVAPNVVG

SEQ ID NO: 800670 - protein, 21 aa, Mycobacterium
DFVEKRWQLPPGSIRAEFGTG

SEQ ID NO: 800671 - protein, 19 aa, Mycobacterium
DFVFGTMRPDLEKPTLKDV

SEQ ID NO: 800672 - protein, 30 aa, Mycobacterium
DFVNRWKNILLAVAQYRLARRFPRSMRKAL

SEQ ID NO: 800673 - protein, 20 aa, Mycobacterium
DFVPFGMGLVQLGLGEEAVI

SEQ ID NO: 800674 - protein, 27 aa, Mycobacterium
DFVPPEDEFWLTLAPTNRLVTARNRQQ

SEQ ID NO: 800675 - protein, 17 aa, Mycobacterium
DFVQAWLHRVMPRLTRA

SEQ ID NO: 800676 - protein, 24 aa, Mycobacterium
DFVRDIAAPLPMAVIGDMLGVLPT

SEQ ID NO: 800677 - protein, 20 aa, Mycobacterium
DFVRDLAAPLPMAVIGDMLG

SEQ ID NO: 800678 - protein, 23 aa, Mycobacterium
DFVRDLAAPLPMAVIGDMLGVLP

SEQ ID NO: 800679 - protein, 20 aa, Mycobacterium
DFVRYMYQQDRGLAPWDGGW

SEQ ID NO: 800680 - protein, 31 aa, Mycobacterium
DFVSRFIGLGRGYRWLQRLDAAGLPLHDVAR

SEQ ID NO: 800681 - protein, 30 aa, Mycobacterium
DFVTDIAVNFPLYVILSLLGLPEEDFGRMH

SEQ ID NO: 800682 - protein, 24 aa, Mycobacterium
DFVTPFIWRMDTFGRPHLEQTPWA

SEQ ID NO: 800683 - protein, 25 aa, Mycobacterium
DFVTPFIWRMDTFGRPHLEQTPWSP

SEQ ID NO: 800684 - protein, 23 aa, Mycobacterium
DFVTPFIWRMDVFGRPHLEQTPW

SEQ ID NO: 800685 - protein, 26 aa, Mycobacterium
DFVTVYRMHPLIPDDYTFLSLAGDTA

SEQ ID NO: 800686 - protein, 20 aa, Mycobacterium
DFVVKCAPGIDFDEVRRLGF

SEQ ID NO: 800687 - protein, 20 aa, Mycobacterium
DFVVLPDLDAALSLTPSAVA

SEQ ID NO: 800688 - protein, 25 aa, Mycobacterium
DFWRMQSWVEIPAASTVRPASYPTL

SEQ ID NO: 800689 - protein, 20 aa, Mycobacterium
DFYALDRLWGDCPVVPVDLT

SEQ ID NO: 800690 - protein, 19 aa, Mycobacterium
DFYALDRLWSDCPVVPVDL

SEQ ID NO: 800691 - protein, 17 aa, Mycobacterium
DFYARVLADDQLCGFFT

SEQ ID NO: 800692 - protein, 24 aa, Mycobacterium
DFYDLDFITPQWSPGPIEAPDPKV

SEQ ID NO: 800693 - protein, 25 aa, Mycobacterium
DFYDLDFITPQWSPGPIGAVDPKVD

SEQ ID NO: 800694 - protein, 20 aa, Mycobacterium
DFYFDAFLQVHMPTLSRGPV

SEQ ID NO: 800695 - protein, 26 aa, Mycobacterium
DFYNAAGKDGLLLLDRHLESQEAGGD

SEQ ID NO: 800696 - protein, 17 aa, Mycobacterium
DFYRRVLADDELAGFFT

SEQ ID NO: 800697 - protein, 19 aa, Mycobacterium
DGAAAPLLVFYHGGGWSIG

SEQ ID NO: 800698 - protein, 20 aa, Mycobacterium
DGAAAVLLMDSDKAKALGLR

SEQ ID NO: 800699 - protein, 25 aa, Mycobacterium
DGAAEYVFRFAPLVGIYGGTLEVFR

SEQ ID NO: 800700 - protein, 20 aa, Mycobacterium
DGAAFHRLCFGLAAGGVGNR

SEQ ID NO: 800701 - protein, 24 aa, Mycobacterium
DGAAKFTAIAANAYCPAILSGHGA

SEQ ID NO: 800702 - protein, 32 aa, Mycobacterium
DGAAQHGLPPRWLEFLRRWDPAGWPRPKSSAA

SEQ ID NO: 800703 - protein, 21 aa, Mycobacterium
DGAAQLLMKRFPDPTTPEAQK

SEQ ID NO: 800704 - protein, 30 aa, Mycobacterium
DGAAYLFTNDYEWELLLSKTGWSEADVQQK

SEQ ID NO: 800705 - protein, 19 aa, Mycobacterium
DGAAYLVQARPITTLGHTT

SEQ ID NO: 800706 - protein, 21 aa, Mycobacterium
DGADIPFLHLVADIDAHEVRM

SEQ ID NO: 800707 - protein, 18 aa, Mycobacterium
DGADLKPRKLRPGDSLLV

SEQ ID NO: 800708 - protein, 24 aa, Mycobacterium
DGADLRVVYLFLAGRPDRRVELEC

SEQ ID NO: 800709 - protein, 27 aa, Mycobacterium
DGADYIINGRKWWTSGAADPRCKILIV

SEQ ID NO: 800710 - protein, 23 aa, Mycobacterium
DGAEWIHLVDLDAAFGRGSNREL

SEQ ID NO: 800711 - protein, 20 aa, Mycobacterium
DGAEWLLDRLPRLLGADDEP

SEQ ID NO: 800712 - protein, 19 aa, Mycobacterium
DGAFGLWAAAAPSTRHLTA

SEQ ID NO: 800713 - protein, 21 aa, Mycobacterium
DGAGIMLQIPDKFFRAVLAEQ

SEQ ID NO: 800714 - protein, 25 aa, Mycobacterium
DGAGVRATWVMVPPETMDQGIEYYK

SEQ ID NO: 800715 - protein, 30 aa, Mycobacterium
DGAHHHGLPRRWIQFLERWDPANWPQRRED

SEQ ID NO: 800716 - protein, 24 aa, Mycobacterium
DGAHIVMIGILPTLMPEHLSEGWM

SEQ ID NO: 800717 - protein, 26 aa, Mycobacterium
DGAHLLVWTTTPWTLPSNLAVAVNPD

SEQ ID NO: 800718 - protein, 26 aa, Mycobacterium
DGAHLLVWTTTPWTLPSNLAVAVNPE

SEQ ID NO: 800719 - protein, 22 aa, Mycobacterium
DGAIIERLAPGGLLAIAVLSEV

SEQ ID NO: 800720 - protein, 32 aa, Mycobacterium
DGAIVAPRPLQDGGLPLWIAGGGEKVTLRIAA

SEQ ID NO: 800721 - protein, 24 aa, Mycobacterium
DGALGLVLGIRRLRAYGAARNAHY

SEQ ID NO: 800722 - protein, 23 aa, Mycobacterium
DGALLDLTLTVRGTSRPLRLPVG

SEQ ID NO: 800723 - protein, 17 aa, Mycobacterium
DGALLGSGLAPQGSVPE

SEQ ID NO: 800724 - protein, 30 aa, Mycobacterium
DGALPAIDAVLLAAALWRGVELVIASMGGA

SEQ ID NO: 800725 - protein, 20 aa, Mycobacterium
DGALPLLAPMSEVAGRLAAQ

SEQ ID NO: 800726 - protein, 19 aa, Mycobacterium
DGALPLLAPMSEVAGRLSA

SEQ ID NO: 800727 - protein, 19 aa, Mycobacterium
DGALPSFPLPLGDLSLVDT

SEQ ID NO: 800728 - protein, 19 aa, Mycobacterium
DGALYLRMDEFPARLVIVP

SEQ ID NO: 800729 - protein, 22 aa, Mycobacterium
DGAPAWLRFLGVNPRHHSLAFM

SEQ ID NO: 800730 - protein, 19 aa, Mycobacterium
DGAPFYVNPTSAAMRAAQS

SEQ ID NO: 800731 - protein, 18 aa, Mycobacterium
DGAPLNSDQARELASALL

SEQ ID NO: 800732 - protein, 22 aa, Mycobacterium
DGAQPTLFMRTYGWGTELQNRD

SEQ ID NO: 800733 - protein, 25 aa, Mycobacterium
DGAQQRMLNVLLALQLTREHVPSEL

SEQ ID NO: 800734 - protein, 27 aa, Mycobacterium
DGAQRLYRGRFLFFGSGYYNYDEGYTP

SEQ ID NO: 800735 - protein, 24 aa, Mycobacterium
DGARELHLVVRFLQLQHRRAEREV

SEQ ID NO: 800736 - protein, 25 aa, Mycobacterium
DGARLDTIDILRYARATYPDASAVN

SEQ ID NO: 800737 - protein, 25 aa, Mycobacterium
DGARLPAHLWAQYGLAGVLEHEGFV

SEQ ID NO: 800738 - protein, 24 aa, Mycobacterium
DGARRRSFGCKAPRTRFSYKLTRR

SEQ ID NO: 800739 - protein, 18 aa, Mycobacterium
DGASCDLSWTPPAGGQVA

SEQ ID NO: 800740 - protein, 25 aa, Mycobacterium
DGASKKLFGENFFGTNPSLGTDPAV

SEQ ID NO: 800741 - protein, 17 aa, Mycobacterium
DGASLAVGGFGLCGIPE

SEQ ID NO: 800742 - protein, 26 aa, Mycobacterium
DGASMWFRSFFGVPSSITAPDGRPVN

SEQ ID NO: 800743 - protein, 25 aa, Mycobacterium
DGASMWFRSYFGVPSSIKAPDGRPV

SEQ ID NO: 800744 - protein, 25 aa, Mycobacterium
DGASMWFRSYFGVPSSITAPDGRPI

SEQ ID NO: 800745 - protein, 25 aa, Mycobacterium
DGASMWFRSYFGVPSSITAPDGRPV

SEQ ID NO: 800746 - protein, 24 aa, Mycobacterium
DGASWRRLLGPLVTNFAAVVDFML

SEQ ID NO: 800747 - protein, 26 aa, Mycobacterium
DGATGTYDSRLIGGGDGSGGGTYGVD

SEQ ID NO: 800748 - protein, 22 aa, Mycobacterium
DGATIAAVLLPGSTLLGMDLAK

SEQ ID NO: 800749 - protein, 23 aa, Mycobacterium
DGATRLLSIPLRHAYAALWRVGV

SEQ ID NO: 800750 - protein, 25 aa, Mycobacterium
DGATRLRHILMDLPAAAPVVVVGGG

SEQ ID NO: 800751 - protein, 27 aa, Mycobacterium
DGATVGPFSYLRPGTVLGADGKLGAFV

SEQ ID NO: 800752 - protein, 23 aa, Mycobacterium
DGATVVLLARRKLLLDEVVEIIG

SEQ ID NO: 800753 - protein, 26 aa, Mycobacterium
DGATYIPPVVFLRKTMPIAGGHDADF

SEQ ID NO: 800754 - protein, 20 aa, Mycobacterium
DGATYVLERGIRTDFALVHA

SEQ ID NO: 800755 - protein, 17 aa, Mycobacterium
DGAVHGFMTMPMLDIAH

SEQ ID NO: 800756 - protein, 21 aa, Mycobacterium
DGAVLPILHLNGYKIANPTVL

SEQ ID NO: 800757 - protein, 22 aa, Mycobacterium
DGAWHLHELTRGLDLSAFVMFS

SEQ ID NO: 800758 - protein, 22 aa, Mycobacterium
DGAWHLHELTRHLDLSAFVVFS

SEQ ID NO: 800759 - protein, 27 aa, Mycobacterium
DGAWRDLRVWWQLRNPFTPSWGEPYTQ

SEQ ID NO: 800760 - protein, 18 aa, Mycobacterium
DGAWWPRADRITNELPEL

SEQ ID NO: 800761 - protein, 23 aa, Mycobacterium
DGCAPFVLFGMPDAERIRNDLHH

SEQ ID NO: 800762 - protein, 26 aa, Mycobacterium
DGCDDLDFHWLDVGWHVLLRRWMSDA

SEQ ID NO: 800763 - protein, 24 aa, Mycobacterium
DGCPKSFWRIDVAPLSRIALHYRD

SEQ ID NO: 800764 - protein, 22 aa, Mycobacterium
DGCRVPLPWSGDAPPFGFSTCA

SEQ ID NO: 800765 - protein, 18 aa, Mycobacterium
DGCRVPMPWAGTAPPFGF

SEQ ID NO: 800766 - protein, 21 aa, Mycobacterium
DGCTKVTFRLSYQAPGGLVGY

SEQ ID NO: 800767 - protein, 18 aa, Mycobacterium
DGDAALAAAWDAARDWDA

SEQ ID NO: 800768 - protein, 19 aa, Mycobacterium
DGDAFGRLILLYDPEGADA

SEQ ID NO: 800769 - protein, 31 aa, Mycobacterium
DGDANLVAMPLFHVGGIGYALFGIRSGAPTF

SEQ ID NO: 800770 - protein, 25 aa, Mycobacterium
DGDAVMVFVPAFPDGGRTTRDGVHY

SEQ ID NO: 800771 - protein, 26 aa, Mycobacterium
DGDDAPPRLYLTRYARAKRPTVPGLP

SEQ ID NO: 800772 - protein, 24 aa, Mycobacterium
DGDDPIELWAWVGAYDHVALCQLW

SEQ ID NO: 800773 - protein, 24 aa, Mycobacterium
DGDDVLYRSYALPVTLRAGDGVQI

SEQ ID NO: 800774 - protein, 23 aa, Mycobacterium
DGDDWVINGWKFFSSNAATASFL

SEQ ID NO: 800775 - protein, 24 aa, Mycobacterium
DGDDWVINGWKFFSSNAATASFLI

SEQ ID NO: 800776 - protein, 31 aa, Mycobacterium
DGDEMTRVIWKFIKDMLILPHLDINLDYYDL

SEQ ID NO: 800777 - protein, 27 aa, Mycobacterium
DGDEMTRVIWKLIKDKLILPHLDINLE

SEQ ID NO: 800778 - protein, 20 aa, Mycobacterium
DGDFFGVIVQLPGASGVVHD

SEQ ID NO: 800779 - protein, 24 aa, Mycobacterium
DGDFPIRSHVLYEGARFPLGVVSS

SEQ ID NO: 800780 - protein, 24 aa, Mycobacterium
DGDFPVAIPLPIVPAGPIRARVNQ

SEQ ID NO: 800781 - protein, 17 aa, Mycobacterium
DGDFVQMKKLCGGIGAL

SEQ ID NO: 800782 - protein, 26 aa, Mycobacterium
DGDHIRARFDVLTKPRLFGRRVGSHV

SEQ ID NO: 800783 - protein, 17 aa, Mycobacterium
DGDIDITGKFRDTLKAD

SEQ ID NO: 800784 - protein, 28 aa, Mycobacterium
DGDILGWSWLVPPYHWRFDARAAEMTRA

SEQ ID NO: 800785 - protein, 24 aa, Mycobacterium
DGDILLLQAIAAQTALAIGRSELL

SEQ ID NO: 800786 - protein, 26 aa, Mycobacterium
DGDKPLEVVLFHHRPERYEFCVTLPR

SEQ ID NO: 800787 - protein, 25 aa, Mycobacterium
DGDLAIYLCGPPPMVEAVRTHLNTA

SEQ ID NO: 800788 - protein, 20 aa, Mycobacterium
DGDLFADYLAWRAKNPSDDL

SEQ ID NO: 800789 - protein, 37 aa, Mycobacterium
DGDLHGFITGYHPPPRPDVLFVWQVAVAPSAQGTGLA

SEQ ID NO: 800790 - protein, 26 aa, Mycobacterium
DGDLISAWLYRPAGGGPAPLLVMAHG

SEQ ID NO: 800791 - protein, 23 aa, Mycobacterium
DGDLLKGVRFFGGGCTTQSIVMR

SEQ ID NO: 800792 - protein, 22 aa, Mycobacterium
DGDLLQGVRYFGGGCTTQSIVM

SEQ ID NO: 800793 - protein, 24 aa, Mycobacterium
DGDLSLGALVLLITGIPKFLNLEE

SEQ ID NO: 800794 - protein, 21 aa, Mycobacterium
DGDLYFSCTIPNLIVGTVGNG

SEQ ID NO: 800795 - protein, 30 aa, Mycobacterium
DGDPAEPDLAWQPPLWRALVARVDAVPPHV

SEQ ID NO: 800796 - protein, 28 aa, Mycobacterium
DGDPLDALVLLPEPLFPGVLVEARPVGM

SEQ ID NO: 800797 - protein, 23 aa, Mycobacterium
DGDPLDALVLLPESVFPGVIVEA

SEQ ID NO: 800798 - protein, 25 aa, Mycobacterium
DGDPLDAMVLLPEAVFPGVLVAARP

SEQ ID NO: 800799 - protein, 24 aa, Mycobacterium
DGDPNLIIGKYIPNLVPKPFTLDR

SEQ ID NO: 800800 - protein, 18 aa, Mycobacterium
DGDPRWRLLDPGELVHVD

SEQ ID NO: 800801 - protein, 24 aa, Mycobacterium
DGDPVWLRFYGCNPRHHALAFMPM

SEQ ID NO: 800802 - protein, 39 aa, Mycobacterium
DGDRMQAFWDQAMRLRDLLKFDFYFADSAAFRANIAEEM

SEQ ID NO: 800803 - protein, 20 aa, Mycobacterium
DGDRWIINGAKTWSTSAFAA

SEQ ID NO: 800804 - protein, 32 aa, Mycobacterium
DGDSATRRAALNRLLFPGPTKEFLAHREQYGD

SEQ ID NO: 800805 - protein, 22 aa, Mycobacterium
DGDSFFTVVDEDEKQRVPGDPE

SEQ ID NO: 800806 - protein, 24 aa, Mycobacterium
DGDSLRYYPAFAGPALDALNATQL

SEQ ID NO: 800807 - protein, 23 aa, Mycobacterium
DGDTLQLLGWTEATATPQVEVAL

SEQ ID NO: 800808 - protein, 27 aa, Mycobacterium
DGDVFVYVIYIRTTPERLWHAITNPGT

SEQ ID NO: 800809 - protein, 17 aa, Mycobacterium
DGDYLVRQFGFFPTESG

SEQ ID NO: 800810 - protein, 21 aa, Mycobacterium
DGEAARRFGCGFAPSGWDSLT

SEQ ID NO: 800811 - protein, 31 aa, Mycobacterium
DGEALVITHRPPPCRFWNLVVWNQFMATFGA

SEQ ID NO: 800812 - protein, 26 aa, Mycobacterium
DGEAMDAFLLLSRAEGIIPAIESAHA

SEQ ID NO: 800813 - protein, 25 aa, Mycobacterium
DGEATYRFPLVVAPRYTTGHPVGGD

SEQ ID NO: 800814 - protein, 23 aa, Mycobacterium
DGEAVWLGVIPQDAPAGGDPLQA

SEQ ID NO: 800815 - protein, 23 aa, Mycobacterium
DGEDLSWLWDVRFEHFEETAVVA

SEQ ID NO: 800816 - protein, 27 aa, Mycobacterium
DGEELLRRIKALPGFGAVKAQIFLALL

SEQ ID NO: 800817 - protein, 23 aa, Mycobacterium
DGEFEYNLQWKPVGGFPVTLGWV

SEQ ID NO: 800818 - protein, 28 aa, Mycobacterium
DGEFVKFGPSWAWPKPVQPHIPILVGAA

SEQ ID NO: 800819 - protein, 29 aa, Mycobacterium
DGEFVNFGPSWAWPKPVQAHIPVLVGAAG

SEQ ID NO: 800820 - protein, 17 aa, Mycobacterium
DGEGIGLTTVYRTLQSM

SEQ ID NO: 800821 - protein, 18 aa, Mycobacterium
DGEGWLRITDRLREMIKV

SEQ ID NO: 800822 - protein, 23 aa, Mycobacterium
DGEIHTVSPWRLSQYWAAVHEPD

SEQ ID NO: 800823 - protein, 20 aa, Mycobacterium
DGEILLRGPGLMTSYHDLPD

SEQ ID NO: 800824 - protein, 20 aa, Mycobacterium
DGEILLRGPGLMTSYHDLPE

SEQ ID NO: 800825 - protein, 24 aa, Mycobacterium
DGEIMLLMGFVNLAGELGIKLEKA

SEQ ID NO: 800826 - protein, 18 aa, Mycobacterium
DGELLRLGDLALPIAPGT

SEQ ID NO: 800827 - protein, 36 aa, Mycobacterium
DGELWAANLSGLQGWIRLFVNIGSPAQLRVIALLDP

SEQ ID NO: 800828 - protein, 22 aa, Mycobacterium
DGELWRVDFAWPDLRLAAEYDS

SEQ ID NO: 800829 - protein, 22 aa, Mycobacterium
DGEPAVFLLDPTIDSVVAKAER

SEQ ID NO: 800830 - protein, 23 aa, Mycobacterium
DGEPAWLRFLGVNPRHHSLAFMP

SEQ ID NO: 800831 - protein, 26 aa, Mycobacterium
DGEPFDQLPFALTPGPPIPTTALRES

SEQ ID NO: 800832 - protein, 26 aa, Mycobacterium
DGEPVAGLTWLPFTGEKYSALVGGPL

SEQ ID NO: 800833 - protein, 35 aa, Mycobacterium
DGERAWILLIALASRWWQRGIGSALLPAWATTRPV

SEQ ID NO: 800834 - protein, 25 aa, Mycobacterium
DGERFRARFFGRNVNVPLMIIGIGT

SEQ ID NO: 800835 - protein, 23 aa, Mycobacterium
DGERLTAERIFLNVGGRAVVPEF

SEQ ID NO: 800836 - protein, 19 aa, Mycobacterium
DGERLTLHPTQLVLATGMS

SEQ ID NO: 800837 - protein, 31 aa, Mycobacterium
DGERRAIHFQEWWVRYRAKVPTHSFAYVGAD

SEQ ID NO: 800838 - protein, 22 aa, Mycobacterium
DGERRPGWVGLPLAGVQTRVLD

SEQ ID NO: 800839 - protein, 21 aa, Mycobacterium
DGERWCVALSGGPDSLALTAV

SEQ ID NO: 800840 - protein, 27 aa, Mycobacterium
DGERYAGWWEIIAIYEPNSLEFIDGFS

SEQ ID NO: 800841 - protein, 23 aa, Mycobacterium
DGETLSRWTSFTATPSVAMDITR

SEQ ID NO: 800842 - protein, 23 aa, Mycobacterium
DGEVAAFFVLLSVAANDTTRQTT

SEQ ID NO: 800843 - protein, 24 aa, Mycobacterium
DGEVISLAPPRSGLRSYLAVRGGI

SEQ ID NO: 800844 - protein, 23 aa, Mycobacterium
DGEVLLRTDVLGHRLIDVAAVEL

SEQ ID NO: 800845 - protein, 22 aa, Mycobacterium
DGEVLMAQLLRIATESAPDLRA

SEQ ID NO: 800846 - protein, 18 aa, Mycobacterium
DGFAHFLVSAGLGVHTER

SEQ ID NO: 800847 - protein, 37 aa, Mycobacterium
DGFEGSWRVNCLGPFLGIRTALPHLRRVDGAAVVNTC

SEQ ID NO: 800848 - protein, 17 aa, Mycobacterium
DGFELAAHRVIGLLREV

SEQ ID NO: 800849 - protein, 18 aa, Mycobacterium
DGFFSRPGLLRVATRRPL

SEQ ID NO: 800850 - protein, 27 aa, Mycobacterium
DGFGRLDMSPFFGPGWVRDPDYLTVNV

SEQ ID NO: 800851 - protein, 17 aa, Mycobacterium
DGFGRLREWRNDEFARL

SEQ ID NO: 800852 - protein, 18 aa, Mycobacterium
DGFILQLADPAIVQWTVG

SEQ ID NO: 800853 - protein, 18 aa, Mycobacterium
DGFLLQLADPDITKWMIE

SEQ ID NO: 800854 - protein, 17 aa, Mycobacterium
DGFLPGTLRVRRRARDW

SEQ ID NO: 800855 - protein, 23 aa, Mycobacterium
DGFMAIGSCRLPTIAAVNGAAVG

SEQ ID NO: 800856 - protein, 25 aa, Mycobacterium
DGFPRVVPVGFYWTGERIVVSTAPT

SEQ ID NO: 800857 - protein, 20 aa, Mycobacterium
DGFRFDLASTLAREFYDVDR

SEQ ID NO: 800858 - protein, 24 aa, Mycobacterium
DGFSWRLENALPVPVFVQAMAQVT

SEQ ID NO: 800859 - protein, 18 aa, Mycobacterium
DGFTMNCLSWIEALGFCG

SEQ ID NO: 800860 - protein, 21 aa, Mycobacterium
DGFTQLYLDVLRRFDSMYSGP

SEQ ID NO: 800861 - protein, 21 aa, Mycobacterium
DGFVFTVPKLRAAEQVTAAVW

SEQ ID NO: 800862 - protein, 27 aa, Mycobacterium
DGFVGLRVVPWLWNAPPTDRRYYPLFA

SEQ ID NO: 800863 - protein, 21 aa, Mycobacterium
DGFVWHCYLPTITPGQRYGFR

SEQ ID NO: 800864 - protein, 25 aa, Mycobacterium
DGFYSQFAPNLPEWNLRGSFSTGAD

SEQ ID NO: 800865 - protein, 18 aa, Mycobacterium
DGFYWRHTFHPAYGRGEV

SEQ ID NO: 800866 - protein, 25 aa, Mycobacterium
DGGAALWPLLTPIMRSREFLYTGDR

SEQ ID NO: 800867 - protein, 25 aa, Mycobacterium
DGGADLLIIETIFDSLNAKAAVFAV

SEQ ID NO: 800868 - protein, 25 aa, Mycobacterium
DGGAGGQGGLFGNAGTTGAGGDGGN

SEQ ID NO: 800869 - protein, 27 aa, Mycobacterium
DGGAGGRGGWLVGGGGAGGSAGSGGGG

SEQ ID NO: 800870 - protein, 23 aa, Mycobacterium
DGGAGVFGGLGGDGGTGGQLFGN

SEQ ID NO: 800871 - protein, 22 aa, Mycobacterium
DGGAGVVAALRPAPRSSAAHSI

SEQ ID NO: 800872 - protein, 24 aa, Mycobacterium
DGGALPRWYPGAHIDLHLPSGRIR

SEQ ID NO: 800873 - protein, 24 aa, Mycobacterium
DGGATVIFQWTYSQTKPRDVIWNQ

SEQ ID NO: 800874 - protein, 21 aa, Mycobacterium
DGGATVPFIARYRKEATGGLD

SEQ ID NO: 800875 - protein, 17 aa, Mycobacterium
DGGAWERLNVKRAWSVC

SEQ ID NO: 800876 - protein, 23 aa, Mycobacterium
DGGDGGGFGVRPVRRHRLQQADV

SEQ ID NO: 800877 - protein, 25 aa, Mycobacterium
DGGDLYINGVMYQHGGAGFDGLPGE

SEQ ID NO: 800878 - protein, 18 aa, Mycobacterium
DGGELRYADLRKLRGVWL

SEQ ID NO: 800879 - protein, 28 aa, Mycobacterium
DGGFGAFLLFDHDWAPPAAKLRSYELFA

SEQ ID NO: 800880 - protein, 19 aa, Mycobacterium
DGGFLWAPMRDKAGRPQYH

SEQ ID NO: 800881 - protein, 20 aa, Mycobacterium
DGGGFGDPPSLPMLPGSWAP

SEQ ID NO: 800882 - protein, 22 aa, Mycobacterium
DGGGYPVHKPVTAGWNGYGDLQ

SEQ ID NO: 800883 - protein, 17 aa, Mycobacterium
DGGHFYLRSHIDAVAAL

SEQ ID NO: 800884 - protein, 25 aa, Mycobacterium
DGGHGGLLIGNGGIGGIGGTGGVGG

SEQ ID NO: 800885 - protein, 27 aa, Mycobacterium
DGGLFNGILARYLALVATALPGTSPAD

SEQ ID NO: 800886 - protein, 23 aa, Mycobacterium
DGGLGGTGFFGVGGAGGAAGNAG

SEQ ID NO: 800887 - protein, 24 aa, Mycobacterium
DGGLHAVHPQALFARCLTALRERI

SEQ ID NO: 800888 - protein, 31 aa, Mycobacterium
DGGLLARFPGFYIPFLDVSFNGATPAANPYP

SEQ ID NO: 800889 - protein, 31 aa, Mycobacterium
DGGLLNPNHFLAVAIDYLFAHRPEWAAETAV

SEQ ID NO: 800890 - protein, 18 aa, Mycobacterium
DGGLQPLPAPRFSRTRPD

SEQ ID NO: 800891 - protein, 24 aa, Mycobacterium
DGGLTRLGPLPPLRMDPAGDQIMR

SEQ ID NO: 800892 - protein, 22 aa, Mycobacterium
DGGLWLAVMSPAALARIEAIKG

SEQ ID NO: 800893 - protein, 25 aa, Mycobacterium
DGGMHSLWTDILARQVFAPRVPRDY

SEQ ID NO: 800894 - protein, 22 aa, Mycobacterium
DGGMSWALPRVVGKARAADILL

SEQ ID NO: 800895 - protein, 22 aa, Mycobacterium
DGGNAGLLFSSAGSGGFGGSST

SEQ ID NO: 800896 - protein, 27 aa, Mycobacterium
DGGNGGFGYVLIAGPNVTVGSETRGGT

SEQ ID NO: 800897 - protein, 22 aa, Mycobacterium
DGGNGGGLFNIGRGGDGGNGGN

SEQ ID NO: 800898 - protein, 28 aa, Mycobacterium
DGGNGGSGGFAFTFGTGNIIAGVGGDGG

SEQ ID NO: 800899 - protein, 27 aa, Mycobacterium
DGGPLTWPLHISLLLAKEYALTGTRIK

SEQ ID NO: 800900 - protein, 23 aa, Mycobacterium
DGGPYTVIFQGALASQDVPLLVA

SEQ ID NO: 800901 - protein, 21 aa, Mycobacterium
DGGRAGLLFGSAGVGGQGGDG

SEQ ID NO: 800902 - protein, 18 aa, Mycobacterium
DGGRAGWLSGNAGAGGAG

SEQ ID NO: 800903 - protein, 19 aa, Mycobacterium
DGGRAGWLSGNAGAGGGGG

SEQ ID NO: 800904 - protein, 24 aa, Mycobacterium
DGGRFDPMFAAAGLSTDLVPQVLS

SEQ ID NO: 800905 - protein, 22 aa, Mycobacterium
DGGRGGWLYGNGGVGGTGGTGG

SEQ ID NO: 800906 - protein, 34 aa, Mycobacterium
DGGRGYLSKVFNDAWMSSYGFLRSRLDGSVSEPT

SEQ ID NO: 800907 - protein, 32 aa, Mycobacterium
DGGRGYMAKIFNDAWMSSYGFLRSRLDGSTEQ

SEQ ID NO: 800908 - protein, 34 aa, Mycobacterium
DGGRGYMSKIFNDAWMSSYGFLRSRLDGRTDAST

SEQ ID NO: 800909 - protein, 32 aa, Mycobacterium; identical to SEQ ID NO: 216905

SEQ ID NO: 800910 - protein, 32 aa, Mycobacterium
DGGRGYMSKIFNDAWMSSYGFLRTRLDGSTEE

SEQ ID NO: 800911 - protein, 28 aa, Mycobacterium
DGGRIQKLLRIFANPRLPVLGDYYEPWT

SEQ ID NO: 800912 - protein, 18 aa, Mycobacterium
DGGRLAKLARIFANPKLP

SEQ ID NO: 800913 - protein, 18 aa, Mycobacterium
DGGRSLVRKTLGIEFPGC

SEQ ID NO: 800914 - protein, 21 aa, Mycobacterium
DGGSALLFGSGGDGGQGGTGL

SEQ ID NO: 800915 - protein, 26 aa, Mycobacterium
DGGTDAYFRPDDWPKALPAHGLPGYL

SEQ ID NO: 800916 - protein, 22 aa, Mycobacterium
DGGTDLSYWMQMGPGRSGLSVA

SEQ ID NO: 800917 - protein, 18 aa, Mycobacterium
DGGTFDWTQGRHPGFTTP

SEQ ID NO: 800918 - protein, 26 aa, Mycobacterium
DGGTPWPAKSLPVPLVVALIGAHASD

SEQ ID NO: 800919 - protein, 23 aa, Mycobacterium
DGGTVRLPRLIGHGRAMDLILTG

SEQ ID NO: 800920 - protein, 18 aa, Mycobacterium
DGGTVRLPRLIGHSRAMD

SEQ ID NO: 800921 - protein, 23 aa, Mycobacterium
DGGTVRLPRLIGHSRAMDLILTG

SEQ ID NO: 800922 - protein, 29 aa, Mycobacterium
DGGTVRNWPWRRWALSWTANTYARLALGI

SEQ ID NO: 800923 - protein, 24 aa, Mycobacterium
DGGVGGWGVLAAAGGKGGDAIGLF

SEQ ID NO: 800924 - protein, 21 aa, Mycobacterium
DGGVQALRVWGAGATGSRLVT

SEQ ID NO: 800925 - protein, 23 aa, Mycobacterium
DGGVSGSGGLFGGGGDGGHGGQG

SEQ ID NO: 800926 - protein, 18 aa, Mycobacterium
DGGWLLGDGGIGGSGTPG

SEQ ID NO: 800927 - protein, 17 aa, Mycobacterium
DGGWRGGFLPGTDPDRG

SEQ ID NO: 800928 - protein, 30 aa, Mycobacterium
DGGYDILTPLIWRLDTFWLSMRDQTPWVDR

SEQ ID NO: 800929 - protein, 29 aa, Mycobacterium
DGGYDILTPLIWRLDTFWVSMRDQTPWVD

SEQ ID NO: 800930 - protein, 29 aa, Mycobacterium
DGGYHDTEIIRWLFTPDPSLTVTRDGSRD

SEQ ID NO: 800931 - protein, 26 aa, Mycobacterium
DGGYHDTEIVRWLFTPDPSLTVTRDG

SEQ ID NO: 800932 - protein, 22 aa, Mycobacterium
DGGYHEPEILRWLFAGDESLTV

SEQ ID NO: 800933 - protein, 17 aa, Mycobacterium
DGGYLIVGGMGGLGFVV

SEQ ID NO: 800934 - protein, 29 aa, Mycobacterium
DGGYRDTEIVRWLFTPDPSLTITHDGSRD

SEQ ID NO: 800935 - protein, 23 aa, Mycobacterium
DGGYWMPLFVVPADGVKLDDGLR

SEQ ID NO: 800936 - protein, 20 aa, Mycobacterium
DGHALALRAGSGLINMEFIQ

SEQ ID NO: 800937 - protein, 20 aa, Mycobacterium
DGHDRVRWVPGRVLKGVAYD

SEQ ID NO: 800938 - protein, 24 aa, Mycobacterium
DGHEWFQYYDRAVPGTLKQGEATK

SEQ ID NO: 800939 - protein, 18 aa, Mycobacterium
DGHFMPPIPHRRRMFAGG

SEQ ID NO: 800940 - protein, 27 aa, Mycobacterium
DGHFVPNLTLGLPVVDSLLAATDIPID

SEQ ID NO: 800941 - protein, 25 aa, Mycobacterium
DGHGRLELFEYIHPPVIESKPTLPN

SEQ ID NO: 800942 - protein, 26 aa, Mycobacterium
DGHHPVAGIYPISLNPAKNSSAEILK

SEQ ID NO: 800943 - protein, 20 aa, Mycobacterium
DGHINVIRSFLAQLPVEIDA

SEQ ID NO: 800944 - protein, 17 aa, Mycobacterium
DGHIVMRSVAGIRGVTE

SEQ ID NO: 800945 - protein, 25 aa, Mycobacterium
DGHKAKVYGFPPLGAPPMSAPHLDT

SEQ ID NO: 800946 - protein, 24 aa, Mycobacterium
DGHPSGVFSWRPPSALIAEVSDVL

SEQ ID NO: 800947 - protein, 23 aa, Mycobacterium
DGHRALGWSTAGRIAPGAAADLV

SEQ ID NO: 800948 - protein, 23 aa, Mycobacterium
DGHRGDFLYVPPGAVHGFRNGAD

SEQ ID NO: 800949 - protein, 19 aa, Mycobacterium
DGHRHLTLASYPGMRDRTV

SEQ ID NO: 800950 - protein, 25 aa, Mycobacterium
DGHVRSRIVPWFGPGAVITTPRHHV

SEQ ID NO: 800951 - protein, 20 aa, Mycobacterium
DGHWDLCLDYRRSTTDPTGL

SEQ ID NO: 800952 - protein, 18 aa, Mycobacterium
DGHWLACEVAPEGATRSQ

SEQ ID NO: 800953 - protein, 19 aa, Mycobacterium
DGIAPLLGDLRAAGVRLAV

SEQ ID NO: 800954 - protein, 28 aa, Mycobacterium
DGIAPVLSTPFVGGVAIGLRPGLINTVP

SEQ ID NO: 800955 - protein, 21 aa, Mycobacterium
DGIDIFIYVTEGSYDTVMWQK

SEQ ID NO: 800956 - protein, 27 aa, Mycobacterium
DGIDPRLRSDAYWPQLADQLVKAARIT

SEQ ID NO: 800957 - protein, 18 aa, Mycobacterium
DGIGLRLPIIETDSGTFE

SEQ ID NO: 800958 - protein, 31 aa, Mycobacterium
DGIGVGGVLRRGTTALLIDIVGRPPERLLLE

SEQ ID NO: 800959 - protein, 24 aa, Mycobacterium
DGIHQAMEFLPWANRFATGDLKDS

SEQ ID NO: 800960 - protein, 25 aa, Mycobacterium
DGIHQAMEFLPWANRVQLGDPVTDE

SEQ ID NO: 800961 - protein, 24 aa, Mycobacterium
DGIHRLLWVLAPEKLAGIAQAQGR

SEQ ID NO: 800962 - protein, 25 aa, Mycobacterium
DGIIEKLPRMLGTQAAGAAPLVLGE

SEQ ID NO: 800963 - protein, 18 aa, Mycobacterium
DGIINAGALIKFEKGRSW

SEQ ID NO: 800964 - protein, 23 aa, Mycobacterium
DGIKRRAPLPPEITIDPADLPAA

SEQ ID NO: 800965 - protein, 34 aa, Mycobacterium
DGILAPPHAMTGTLVWFLPPFVDDISGPPVSGIL

SEQ ID NO: 800966 - protein, 17 aa, Mycobacterium
DGILGFVVPTDTPGFVG

SEQ ID NO: 800967 - protein, 29 aa, Mycobacterium
DGIQRIPRALARLEVPLIGAINGAAIGAG

SEQ ID NO: 800968 - protein, 20 aa, Mycobacterium
DGIQRPLIVFTPKSMLRNKA

SEQ ID NO: 800969 - protein, 23 aa, Mycobacterium
DGIRQILLSMRRGDLLTPNAAEP

SEQ ID NO: 800970 - protein, 22 aa, Mycobacterium
DGIRVLELGTLIAGPFAGRLLG

SEQ ID NO: 800971 - protein, 22 aa, Mycobacterium
DGIRYLYAFGTPSGRAGSAYLS

SEQ ID NO: 800972 - protein, 25 aa, Mycobacterium
DGISCLRFRLRWKGFRVTVQANHSD

SEQ ID NO: 800973 - protein, 25 aa, Mycobacterium
DGISLDVFVDWLIRAGHPIDRVDDY

SEQ ID NO: 800974 - protein, 26 aa, Mycobacterium
DGISRLRFRLRWRDFGVTVDANHSDV

SEQ ID NO: 800975 - protein, 27 aa, Mycobacterium
DGISRLRFRLRWRGYRLTVDANHSTVT

SEQ ID NO: 800976 - protein, 18 aa, Mycobacterium
DGIVKLPSGVFRPYAGVS

SEQ ID NO: 800977 - protein, 22 aa, Mycobacterium
DGIVTGLRLMTRMVATGASLAA

SEQ ID NO: 800978 - protein, 18 aa, Mycobacterium
DGIYLRRVERRAVPLPLP

SEQ ID NO: 800979 - protein, 23 aa, Mycobacterium
DGKARWYRNRWVRSLSACAGLGE

SEQ ID NO: 800980 - protein, 17 aa, Mycobacterium
DGKAWGSRFPVITVRDQ

SEQ ID NO: 800981 - protein, 20 aa, Mycobacterium
DGKAWLFAPNGLADGPLPTH

SEQ ID NO: 800982 - protein, 23 aa, Mycobacterium
DGKDFVAVMRRLAAGDGPVKVVA

SEQ ID NO: 800983 - protein, 25 aa, Mycobacterium
DGKDLPVVGFLWEVLGRIGIGRKDA

SEQ ID NO: 800984 - protein, 24 aa, Mycobacterium
DGKEIAGRLAARIGSGLLVDVVEV

SEQ ID NO: 800985 - protein, 17 aa, Mycobacterium
DGKFHWQGTIYAKPEGG

SEQ ID NO: 800986 - protein, 24 aa, Mycobacterium
DGKHELLLALFEDALSRSADQIHA

SEQ ID NO: 800987 - protein, 25 aa, Mycobacterium
DGKITVWKDYWDMNSLVAFAPPNHF

SEQ ID NO: 800988 - protein, 17 aa, Mycobacterium
DGKLAWAGLSALTPDSD

SEQ ID NO: 800989 - protein, 22 aa, Mycobacterium
DGKLKGILKYYDAPIVSSDIVT

SEQ ID NO: 800990 - protein, 17 aa, Mycobacterium
DGKPHVRLWAKLEDRNP

SEQ ID NO: 800991 - protein, 17 aa, Mycobacterium
DGKPLVSALLGAPDLLD

SEQ ID NO: 800992 - protein, 17 aa, Mycobacterium
DGKPWGSRFPLISVRDQ

SEQ ID NO: 800993 - protein, 20 aa, Mycobacterium
DGKRYLDCLAAYSAVNFGHG

SEQ ID NO: 800994 - protein, 24 aa, Mycobacterium
DGKSTLIGRLLYDSKSIFADQLAA

SEQ ID NO: 800995 - protein, 23 aa, Mycobacterium
DGKTGDYVAIPPQRHALHAIEDS

SEQ ID NO: 800996 - protein, 19 aa, Mycobacterium
DGKWPHIWRIVGEYANYSI

SEQ ID NO: 800997 - protein, 17 aa, Mycobacterium
DGLAAAAPGWIGSSELA

SEQ ID NO: 800998 - protein, 26 aa, Mycobacterium
DGLAALVQLVRYAGPGQLMRTAAHGL

SEQ ID NO: 800999 - protein, 25 aa, Mycobacterium
DGLAAVLPCYWIYAEVGAALAERGS

SEQ ID NO: 801000 - protein, 27 aa, Mycobacterium
DGLAAVLPCYWIYARVGAELMQRGSSD

SEQ ID NO: 801001 - protein, 25 aa, Mycobacterium
DGLADDCVIVCPLHGHTFDLSSGEE

SEQ ID NO: 801002 - protein, 25 aa, Mycobacterium
DGLAELQIRWPNVPMVFCETRQLAQ

SEQ ID NO: 801003 - protein, 26 aa, Mycobacterium
DGLALDVLTLFSYPLHPPGKPERART

SEQ ID NO: 801004 - protein, 18 aa, Mycobacterium
DGLAPIAGGLLQKDVRHA

SEQ ID NO: 801005 - protein, 17 aa, Mycobacterium
DGLARHPIATRAPWTTE

SEQ ID NO: 801006 - protein, 27 aa, Mycobacterium
DGLAVIAPIVRLAGRWLRPGGLIGIEH

SEQ ID NO: 801007 - protein, 17 aa, Mycobacterium
DGLDFLRLAVLDALLVL

SEQ ID NO: 801008 - protein, 25 aa, Mycobacterium
DGLDLTIPQGIVYCLLGRNGAGKTT

SEQ ID NO: 801009 - protein, 18 aa, Mycobacterium
DGLERVRFTSPHPAEFTD

SEQ ID NO: 801010 - protein, 17 aa, Mycobacterium
DGLGRAYYRSRLAAGNS

SEQ ID NO: 801011 - protein, 19 aa, Mycobacterium
DGLGVHLFLGRGEANTGGA

SEQ ID NO: 801012 - protein, 21 aa, Mycobacterium
DGLHHWWMVQDPARAAAMLTR

SEQ ID NO: 801013 - protein, 20 aa, Mycobacterium
DGLIDFHLDFALGEPDLIRI

SEQ ID NO: 801014 - protein, 18 aa, Mycobacterium
DGLIVLPATTRASIERKI

SEQ ID NO: 801015 - protein, 20 aa, Mycobacterium
DGLKYPARLIDEYAWETDLG

SEQ ID NO: 801016 - protein, 26 aa, Mycobacterium
DGLLMAPTYAVPRLLARNGLSLQEFD

SEQ ID NO: 801017 - protein, 27 aa, Mycobacterium
DGLLMAPTYAVPRLLTRNGLTLQDFDY

SEQ ID NO: 801018 - protein, 19 aa, Mycobacterium
DGLLVIPATRPSAPVAGLD

SEQ ID NO: 801019 - protein, 23 aa, Mycobacterium
DGLNGLLLPDAYPDGGLIELTRD

SEQ ID NO: 801020 - protein, 19 aa, Mycobacterium
DGLPFINADYTLTLSRLPD

SEQ ID NO: 801021 - protein, 17 aa, Mycobacterium
DGLPGWRDTMHLPVPQR

SEQ ID NO: 801022 - protein, 25 aa, Mycobacterium
DGLQIEDPIPLSAKLELLASIAATG

SEQ ID NO: 801023 - protein, 29 aa, Mycobacterium
DGLQIEKPIPLAAKLELLAAIAATGVREV

SEQ ID NO: 801024 - protein, 25 aa, Mycobacterium
DGLQIEKPVPLSAKLELLAAVAATG

SEQ ID NO: 801025 - protein, 24 aa, Mycobacterium
DGLRALLTAIHRDLRELSAVITTV

SEQ ID NO: 801026 - protein, 32 aa, Mycobacterium
DGLRIDHVAGLWRLWWIPPGDGPDKGTYVHYD

SEQ ID NO: 801027 - protein, 32 aa, Mycobacterium
DGLRIDHVAGLWRLWWIPPGDGPDRGTYVHYD

SEQ ID NO: 801028 - protein, 20 aa, Mycobacterium
DGLRKFYFDTALSASESALP

SEQ ID NO: 801029 - protein, 33 aa, Mycobacterium
DGLRRDYRWAEAERHLWIADVRGTWHIREAEEH

SEQ ID NO: 801030 - protein, 23 aa, Mycobacterium
DGLRRFHRHLQQGRLSRSIERSR

SEQ ID NO: 801031 - protein, 24 aa, Mycobacterium
DGLRSLPWDGLKLSRGEAAVPSRM

SEQ ID NO: 801032 - protein, 20 aa, Mycobacterium
DGLRVGPMICFDVEFPEIAR

SEQ ID NO: 801033 - protein, 17 aa, Mycobacterium
DGLRYPARLIDEYAWET

SEQ ID NO: 801034 - protein, 27 aa, Mycobacterium
DGLSDPCGYLAWLRELVGPSAWIVIEK

SEQ ID NO: 801035 - protein, 32 aa, Mycobacterium
DGLSDPCGYLQWLRELVGQQAWIVIEKILAAD

SEQ ID NO: 801036 - protein, 37 aa, Mycobacterium
DGLSDPCGYLTWLRELLGPDAWIVIEKILAVDEALEP

SEQ ID NO: 801037 - protein, 22 aa, Mycobacterium
DGLSISGPIRWASNVFPDALMV

SEQ ID NO: 801038 - protein, 19 aa, Mycobacterium
DGLSLFDHWRDGYKTLHGM

SEQ ID NO: 801039 - protein, 22 aa, Mycobacterium
DGLSLRMEPGELVALLGPSGCG

SEQ ID NO: 801040 - protein, 25 aa, Mycobacterium
DGLSRFADLCVTAFAGFAVVKPQVA

SEQ ID NO: 801041 - protein, 19 aa, Mycobacterium
DGLTDDEYFWQPVPGCWTV

SEQ ID NO: 801042 - protein, 19 aa, Mycobacterium
DGLTGPAVLTLLGARATAE

SEQ ID NO: 801043 - protein, 22 aa, Mycobacterium
DGLTMFLVPINHPGITLRRITQ

SEQ ID NO: 801044 - protein, 25 aa, Mycobacterium
DGLTMLAAHPELVVNRRAPTVLTPH

SEQ ID NO: 801045 - protein, 20 aa, Mycobacterium
DGLTMLSYFNATTGNMEIRV

SEQ ID NO: 801046 - protein, 19 aa, Mycobacterium
DGLTPERMLETLRPDIWVK

SEQ ID NO: 801047 - protein, 24 aa, Mycobacterium
DGLTRWLTGMFDRDGWRPGGVVVV

SEQ ID NO: 801048 - protein, 23 aa, Mycobacterium
DGLTYGLLRYLNPDVDLGDSDPA

SEQ ID NO: 801049 - protein, 24 aa, Mycobacterium
DGLTYGLLRYLNPDVDLGGSDPVI

SEQ ID NO: 801050 - protein, 30 aa, Mycobacterium
DGLVAALRHRGLHARWLSWDDPETLDADVV

SEQ ID NO: 801051 - protein, 33 aa, Mycobacterium
DGLVGEILARRPGWFDARWLQVAINHRAQRWSD

SEQ ID NO: 801052 - protein, 25 aa, Mycobacterium
DGLVMETAFLPIFASLPKPTREQEV

SEQ ID NO: 801053 - protein, 17 aa, Mycobacterium
DGLVRFVDACHARGLGV

SEQ ID NO: 801054 - protein, 25 aa, Mycobacterium
DGLVRSPRLLYRVPNMRSTYRVVPL

SEQ ID NO: 801055 - protein, 22 aa, Mycobacterium
DGLWPEDAPAPDPAAGAPIPTA

SEQ ID NO: 801056 - protein, 22 aa, Mycobacterium
DGMDLAALHRCCVALDGVGRAA

SEQ ID NO: 801057 - protein, 17 aa, Mycobacterium
DGMDLVVLGLGGRSVPP

SEQ ID NO: 801058 - protein, 23 aa, Mycobacterium
DGMESLLGAIYLQHGIDTAREVI

SEQ ID NO: 801059 - protein, 24 aa, Mycobacterium
DGMESLLGAIYLQHGIEVSRKVIL

SEQ ID NO: 801060 - protein, 22 aa, Mycobacterium
DGMFKVNWRVPAGPFQLMDQVG

SEQ ID NO: 801061 - protein, 29 aa, Mycobacterium
DGMGGASGFSIVFPPGQDGGGGGIGGSGG

SEQ ID NO: 801062 - protein, 23 aa, Mycobacterium
DGMGNPQILWRQAYDRGPARKPG

SEQ ID NO: 801063 - protein, 31 aa, Mycobacterium
DGMHIVMPLLMGPTRARYFLLTGQQLSVAEA

SEQ ID NO: 801064 - protein, 18 aa, Mycobacterium
DGMLDIGVRYLSRQTGSL

SEQ ID NO: 801065 - protein, 24 aa, Mycobacterium
DGMLGMLILAQHDLAMLLKTADIA

SEQ ID NO: 801066 - protein, 24 aa, Mycobacterium
DGMLGVGWPKEFGGRGFGPIEQQI

SEQ ID NO: 801067 - protein, 18 aa, Mycobacterium
DGMPHRVLRTGLVDKLES

SEQ ID NO: 801068 - protein, 17 aa, Mycobacterium
DGMPHRVLRTGLVEKLE

SEQ ID NO: 801069 - protein, 18 aa, Mycobacterium
DGMPHRVLRTGLVEKLEG

SEQ ID NO: 801070 - protein, 25 aa, Mycobacterium
DGMPRVDAVVFLLRTLNAADVALLK

SEQ ID NO: 801071 - protein, 25 aa, Mycobacterium
DGMRKLFRQFSFPGGIPSHVAAETP

SEQ ID NO: 801072 - protein, 20 aa, Mycobacterium
DGMSKLSGWLTPEARATWEA

SEQ ID NO: 801073 - protein, 23 aa, Mycobacterium
DGMSLAEFWSSKGALSYLGLAVA

SEQ ID NO: 801074 - protein, 21 aa, Mycobacterium
DGMSRISGWLTPEARAGLDAV

SEQ ID NO: 801075 - protein, 26 aa, Mycobacterium
DGNAWVRAEAELYSWGPSIPDDLRKQ

SEQ ID NO: 801076 - protein, 26 aa, Mycobacterium
DGNDHFEFFVFPYGDTALTRTTRRSD

SEQ ID NO: 801077 - protein, 26 aa, Mycobacterium
DGNDLTILTFGNGLWMSLRVARRLEQ

SEQ ID NO: 801078 - protein, 19 aa, Mycobacterium
DGNDMIGWSLSGPASAPAD

SEQ ID NO: 801079 - protein, 17 aa, Mycobacterium
DGNFFELDWALQRHNEF

SEQ ID NO: 801080 - protein, 23 aa, Mycobacterium
DGNIIGARLDRLGLRPLRTVETA

SEQ ID NO: 801081 - protein, 24 aa, Mycobacterium
DGNKFTPGVILSPGGRKSSSANGW

SEQ ID NO: 801082 - protein, 24 aa, Mycobacterium
DGNLALMPLSLYFSEGKVKVELAL

SEQ ID NO: 801083 - protein, 25 aa, Mycobacterium
DGNLTLVPLSLYFTGGKVKVELALA

SEQ ID NO: 801084 - protein, 22 aa, Mycobacterium
DGNLWVRGPSIATGYWNCPDPI

SEQ ID NO: 801085 - protein, 25 aa, Mycobacterium
DGNLYLRDLVLALQWVRDNIAQFGG

SEQ ID NO: 801086 - protein, 26 aa, Mycobacterium
DGNLYLRDLVMALQWIQDNIAEFGGD

SEQ ID NO: 801087 - protein, 24 aa, Mycobacterium
DGNPLALLELPRTLTRDALAGVFG

SEQ ID NO: 801088 - protein, 29 aa, Mycobacterium
DGNPYRVFTPFFRAWRDHGWRAPADSGPG

SEQ ID NO: 801089 - protein, 17 aa, Mycobacterium
DGNQIMELLGVPAGPIV

SEQ ID NO: 801090 - protein, 20 aa, Mycobacterium
DGNWWEIVAVRENGYAADFA

SEQ ID NO: 801091 - protein, 24 aa, Mycobacterium
DGPAHPVHAAIAAGFRCMGTEHPG

SEQ ID NO: 801092 - protein, 31 aa, Mycobacterium
DGPAIAHDVAPFLPPPFRDLAESVLGAADAS

SEQ ID NO: 801093 - protein, 22 aa, Mycobacterium
DGPAIELPSLRNLAYGGSKVGL

SEQ ID NO: 801094 - protein, 23 aa, Mycobacterium
DGPDLRSRLPERADVVLAGLRFT

SEQ ID NO: 801095 - protein, 27 aa, Mycobacterium
DGPFPLDAFKKVIGVNLIGTFNVLRLA

SEQ ID NO: 801096 - protein, 31 aa, Mycobacterium
DGPGDPLRLPGFPFQFFCYKRIAAVNAARVT

SEQ ID NO: 801097 - protein, 25 aa, Mycobacterium
DGPGSPLKFLVRAAGWPGGRTRVLG

SEQ ID NO: 801098 - protein, 25 aa, Mycobacterium
DGPGWHWRTWHLYPRNAFGSGGSGG

SEQ ID NO: 801099 - protein, 27 aa, Mycobacterium
DGPIAEAWLPFHVPMSYHGAFTNRVAH

SEQ ID NO: 801100 - protein, 17 aa, Mycobacterium
DGPIRLLAHEPTKLFRA

SEQ ID NO: 801101 - protein, 21 aa, Mycobacterium
DGPIRLVDVFDGRAQLIVYHH

SEQ ID NO: 801102 - protein, 17 aa, Mycobacterium
DGPLDRLLRPGGVVDML

SEQ ID NO: 801103 - protein, 17 aa, Mycobacterium
DGPLIQPVAMFSSFPTI

SEQ ID NO: 801104 - protein, 22 aa, Mycobacterium
DGPLKGILKYYDAPIVSSDIVT

SEQ ID NO: 801105 - protein, 22 aa, Mycobacterium
DGPLLHANWRWATSALTDEQVN

SEQ ID NO: 801106 - protein, 17 aa, Mycobacterium
DGPLLLLGPSLGTTTAT

SEQ ID NO: 801107 - protein, 20 aa, Mycobacterium
DGPLTAFPGALWLQVRDVYE

SEQ ID NO: 801108 - protein, 25 aa, Mycobacterium
DGPMGKYPILFLDPDFDEDIRLALV

SEQ ID NO: 801109 - protein, 26 aa, Mycobacterium
DGPMGKYPILFLDPDFNEDIRLALVA

SEQ ID NO: 801110 - protein, 25 aa, Mycobacterium
DGPNGAYWMPLFITMAPGHTFDDAL

SEQ ID NO: 801111 - protein, 32 aa, Mycobacterium
DGPQARGLFDGALDLWLALTAAALAGAAKRAV

SEQ ID NO: 801112 - protein, 24 aa, Mycobacterium
DGPQEFHLVLLDNGRTRVLADEVG

SEQ ID NO: 801113 - protein, 24 aa, Mycobacterium
DGPRVILLGIPTRGVTLASRLATN

SEQ ID NO: 801114 - protein, 27 aa, Mycobacterium
DGPTGFPTLVEALLHTGFDTAEVTAIL

SEQ ID NO: 801115 - protein, 22 aa, Mycobacterium
DGPTIAVLYYRAQHLAGNTGYV

SEQ ID NO: 801116 - protein, 22 aa, Mycobacterium
DGPVAFVFLRQFGSAFAVRQAQ

SEQ ID NO: 801117 - protein, 17 aa, Mycobacterium
DGPVNRLLRPGGLVDQL

SEQ ID NO: 801118 - protein, 21 aa, Mycobacterium
DGPWDTLGTRPHLAVAAGAVG

SEQ ID NO: 801119 - protein, 27 aa, Mycobacterium
DGPYPTARFDGFWIIDVPSKDEAKKWA

SEQ ID NO: 801120 - protein, 24 aa, Mycobacterium
DGQDFVVDITVWMDLRPAAVSDDL

SEQ ID NO: 801121 - protein, 28 aa, Mycobacterium
DGQDGHPVLAAVLRKGYKLGDRVLRTAM

SEQ ID NO: 801122 - protein, 22 aa, Mycobacterium
DGQFDWGQPLFSYNFGDPDSRN

SEQ ID NO: 801123 - protein, 21 aa, Mycobacterium
DGQFPTLPFFELGYEVAHVGF

SEQ ID NO: 801124 - protein, 24 aa, Mycobacterium
DGQGRPVLLFVMGMARSGTSAITR

SEQ ID NO: 801125 - protein, 17 aa, Mycobacterium
DGQIFRRKLPSSAMEAF

SEQ ID NO: 801126 - protein, 25 aa, Mycobacterium
DGQILLFDSLQFAPRYRCADLASEV

SEQ ID NO: 801127 - protein, 18 aa, Mycobacterium
DGQLLELLSDGWLAAAPP

SEQ ID NO: 801128 - protein, 28 aa, Mycobacterium
DGQLVDAPLPVWANRRLLLATADARRHG

SEQ ID NO: 801129 - protein, 30 aa, Mycobacterium
DGQLYIADGTYFYVALPDGSLQTAGMLFSP

SEQ ID NO: 801130 - protein, 25 aa, Mycobacterium
DGQQATWDRLWPQLGRQARDGDEPP

SEQ ID NO: 801131 - protein, 24 aa, Mycobacterium
DGQRILVDGIWPRGIRKDDPRVGI

SEQ ID NO: 801132 - protein, 25 aa, Mycobacterium
DGQRVLVDRIWPRGIRKDDPRVGIW

SEQ ID NO: 801133 - protein, 26 aa, Mycobacterium
DGQRVMLKLSLPSEVNFYRPLIEHPK

SEQ ID NO: 801134 - protein, 26 aa, Mycobacterium
DGQRVMLKLSLPTEANYYRPLIEHPK

SEQ ID NO: 801135 - protein, 23 aa, Mycobacterium
DGQVIVLTCSPDRYASVHGAHHI

SEQ ID NO: 801136 - protein, 25 aa, Mycobacterium
DGQVRFRLLDTLRDYGRTHLSAAEH

SEQ ID NO: 801137 - protein, 20 aa, Mycobacterium
DGQWRLSPKAMRQLGQTALR

SEQ ID NO: 801138 - protein, 18 aa, Mycobacterium
DGQYHGYLELYWAAKDLI

SEQ ID NO: 801139 - protein, 23 aa, Mycobacterium
DGRAAVIPISWAAAGNTSAPPAI

SEQ ID NO: 801140 - protein, 23 aa, Mycobacterium
DGRAFRLDLPPSVSWFDVDQPSV

SEQ ID NO: 801141 - protein, 24 aa, Mycobacterium
DGRAGTPFTLLHGLADDAVPVGAS

SEQ ID NO: 801142 - protein, 25 aa, Mycobacterium
DGRAKKALELTFRHALRLGHNYIGT

SEQ ID NO: 801143 - protein, 35 aa, Mycobacterium
DGRAPFFVIAVFARGLLHRLFTRAYLPSPDLDADR

SEQ ID NO: 801144 - protein, 24 aa, Mycobacterium
DGRAPFVLFRMPGAEIIRKSLRDK

SEQ ID NO: 801145 - protein, 24 aa, Mycobacterium
DGRAPLGWIDADGLRRHRNGAALP

SEQ ID NO: 801146 - protein, 22 aa, Mycobacterium
DGRAPTLRRWYPSTDGSWDAKS

SEQ ID NO: 801147 - protein, 23 aa, Mycobacterium
DGRAPTLRRWYPSTGGSWDAAAA

SEQ ID NO: 801148 - protein, 22 aa, Mycobacterium
DGRAQLYPQLVPFSAGPAECPG

SEQ ID NO: 801149 - protein, 25 aa, Mycobacterium
DGRASWYRNRWVRSMPVCAALGESP

SEQ ID NO: 801150 - protein, 25 aa, Mycobacterium
DGRDILFFALPGHLPRPVADRRPLP

SEQ ID NO: 801151 - protein, 21 aa, Mycobacterium
DGRDLLPPLEPPASANPNILP

SEQ ID NO: 801152 - protein, 27 aa, Mycobacterium
DGRDPWRLDGPWRTPLIAVAHGWCMTL

SEQ ID NO: 801153 - protein, 26 aa, Mycobacterium
DGRDQIIHQVAVNPLYMALNGGSPDV

SEQ ID NO: 801154 - protein, 24 aa, Mycobacterium
DGRDWGLEYLWGVLTPGDEFQPFW

SEQ ID NO: 801155 - protein, 26 aa, Mycobacterium
DGREALLRRIGLAASKYWVCKRATPH

SEQ ID NO: 801156 - protein, 33 aa, Mycobacterium
DGREFFGLLIRICLGIAAWLRGAFATAGPQIQC

SEQ ID NO: 801157 - protein, 24 aa, Mycobacterium
DGREVLFFALPGNVPAPVADRRPL

SEQ ID NO: 801158 - protein, 21 aa, Mycobacterium
DGREYVAQFLISGAGALHIPS

SEQ ID NO: 801159 - protein, 21 aa, Mycobacterium
DGRFEIILAPERPAGYEGNFI

SEQ ID NO: 801160 - protein, 23 aa, Mycobacterium
DGRFEILLGPRRPGEHTGNFIAT

SEQ ID NO: 801161 - protein, 20 aa, Mycobacterium
DGRFTISRMQAMGFPADSII

SEQ ID NO: 801162 - protein, 25 aa, Mycobacterium
DGRFVGFADFLLRDGERYRVVDTKL

SEQ ID NO: 801163 - protein, 23 aa, Mycobacterium
DGRGAPLMPCGRCRQLLFEHGGP

SEQ ID NO: 801164 - protein, 25 aa, Mycobacterium
DGRHELLAYLVLAANLTFDAYHRHL

SEQ ID NO: 801165 - protein, 21 aa, Mycobacterium
DGRHYMWVARTVERRAHRYGQ

SEQ ID NO: 801166 - protein, 24 aa, Mycobacterium
DGRIVGTAYFRRFHLGRNGAVHGG

SEQ ID NO: 801167 - protein, 21 aa, Mycobacterium
DGRIWITLASPRNALAEWLLP

SEQ ID NO: 801168 - protein, 22 aa, Mycobacterium
DGRKFLAYYERDGALAGVVGGG

SEQ ID NO: 801169 - protein, 18 aa, Mycobacterium
DGRKTVIDTLVLATGFNL

SEQ ID NO: 801170 - protein, 24 aa, Mycobacterium
DGRLATLWIPERHFHSFGGLSPNP

SEQ ID NO: 801171 - protein, 24 aa, Mycobacterium
DGRLDGVRWPDIVSRVFGRIDPLA

SEQ ID NO: 801172 - protein, 17 aa, Mycobacterium
DGRLHYVYNFLGERQQL

SEQ ID NO: 801173 - protein, 22 aa, Mycobacterium
DGRLHYVYNWLGERIQTISAPE

SEQ ID NO: 801174 - protein, 17 aa, Mycobacterium
DGRLILDPLCESAPKLL

SEQ ID NO: 801175 - protein, 25 aa, Mycobacterium
DGRLTVPISATYPLDEAAAALDASR

SEQ ID NO: 801176 - protein, 18 aa, Mycobacterium
DGRLVHFAPGALGADIRP

SEQ ID NO: 801177 - protein, 21 aa, Mycobacterium
DGRLVLDQRIRTATKAHAAMV

SEQ ID NO: 801178 - protein, 21 aa, Mycobacterium
DGRLVVLIKFSHAITDGVGAV

SEQ ID NO: 801179 - protein, 18 aa, Mycobacterium
DGRLYIVQARPETAASQR

SEQ ID NO: 801180 - protein, 25 aa, Mycobacterium
DGRMLLHTILMYQWQEYPALGVTLT

SEQ ID NO: 801181 - protein, 17 aa, Mycobacterium
DGRMLLHTILTYTQKQQ

SEQ ID NO: 801182 - protein, 23 aa, Mycobacterium
DGRPFEFSYDLFRADRVRLTATM

SEQ ID NO: 801183 - protein, 23 aa, Mycobacterium
DGRPFFCGTYYPKDAFLQLLSAI

SEQ ID NO: 801184 - protein, 21 aa, Mycobacterium
DGRPFYCGTYYPKAGFLQLLS

SEQ ID NO: 801185 - protein, 19 aa, Mycobacterium
DGRPFYTGTYYPKQGFLQL

SEQ ID NO: 801186 - protein, 30 aa, Mycobacterium
DGRPIAPGPRPRLARPLSWGRAAPADTGSF

SEQ ID NO: 801187 - protein, 22 aa, Mycobacterium
DGRPLHAQTYFSVGGGFIVAEG

SEQ ID NO: 801188 - protein, 17 aa, Mycobacterium
DGRPQVHLAARPGVLTA

SEQ ID NO: 801189 - protein, 21 aa, Mycobacterium
DGRPTVLFLCIHNAGRSQMAL

SEQ ID NO: 801190 - protein, 23 aa, Mycobacterium
DGRQWFRDDLSFADPSTPRTGSA

SEQ ID NO: 801191 - protein, 26 aa, Mycobacterium
DGRRATSHWLTIPALKAFGAIPVADE

SEQ ID NO: 801192 - protein, 25 aa, Mycobacterium
DGRRATSHWLTIPALKAFGAVPVAD

SEQ ID NO: 801193 - protein, 24 aa, Mycobacterium
DGRRFVPELLARFGIAGPAVGELH

SEQ ID NO: 801194 - protein, 23 aa, Mycobacterium
DGRRLRLLGFERVELEPGATRRV

SEQ ID NO: 801195 - protein, 29 aa, Mycobacterium
DGRRPRDLLLDAYLLRAMGIAGWAPALTE

SEQ ID NO: 801196 - protein, 25 aa, Mycobacterium
DGRRQPHIGPFRVPGIPAFIDPEHD

SEQ ID NO: 801197 - protein, 30 aa, Mycobacterium
DGRRSRGLLLDAYLLRAMGIAGWAPALNEC

SEQ ID NO: 801198 - protein, 23 aa, Mycobacterium
DGRRVHRVLLEIGELCALVPDSM

SEQ ID NO: 801199 - protein, 21 aa, Mycobacterium
DGRRWHQSLVLQRVSPATVRD

SEQ ID NO: 801200 - protein, 24 aa, Mycobacterium
DGRRWRALFDWTSQRFDMLAEDIM

SEQ ID NO: 801201 - protein, 22 aa, Mycobacterium
DGRRWRALFERPARNFDLLTAD

SEQ ID NO: 801202 - protein, 17 aa, Mycobacterium
DGRSEFSYGSFVRTVAL

SEQ ID NO: 801203 - protein, 19 aa, Mycobacterium
DGRTLLTTTLAEPGTLLLG

SEQ ID NO: 801204 - protein, 17 aa, Mycobacterium
DGRTYFWVARTSSTSTG

SEQ ID NO: 801205 - protein, 31 aa, Mycobacterium
DGRTYQFNALFLDPYLWKLQVGGKRLVQKAR

SEQ ID NO: 801206 - protein, 26 aa, Mycobacterium
DGRVARLARAFLPKLTDEQLLAGGLT

SEQ ID NO: 801207 - protein, 23 aa, Mycobacterium
DGRVFRLAVPPSVSWFDVDQPGV

SEQ ID NO: 801208 - protein, 25 aa, Mycobacterium
DGRVLVGPLDWTVELDERWVIVGPN

SEQ ID NO: 801209 - protein, 23 aa, Mycobacterium
DGRVRARREISVKIPAGVGDGMR

SEQ ID NO: 801210 - protein, 23 aa, Mycobacterium
DGRVSHVVAFLDGSLFPKFGLPP

SEQ ID NO: 801211 - protein, 20 aa, Mycobacterium
DGRWLLSHNGIVDRAVLPVT

SEQ ID NO: 801212 - protein, 24 aa, Mycobacterium
DGRWQIKSLHLTRTILRMTGGDDG

SEQ ID NO: 801213 - protein, 23 aa, Mycobacterium
DGRWSCVQWGTLKPPFYPDLTQG

SEQ ID NO: 801214 - protein, 20 aa, Mycobacterium
DGRWSCVRWGTLSPPFYPEA

SEQ ID NO: 801215 - protein, 22 aa, Mycobacterium
DGRYQWVVFTSTNAVRAVWEKF

SEQ ID NO: 801216 - protein, 17 aa, Mycobacterium
DGRYRIAPLVIATQARV

SEQ ID NO: 801217 - protein, 27 aa, Mycobacterium
DGRYSYQLTIYIFRYGEGTAMAIMHPD

SEQ ID NO: 801218 - protein, 20 aa, Mycobacterium
DGSAALLFMSAEKAKELGLK

SEQ ID NO: 801219 - protein, 23 aa, Mycobacterium
DGSAIPVVAFRLAKDRGYTEFDV

SEQ ID NO: 801220 - protein, 23 aa, Mycobacterium
DGSARTYLLTPGSFVTGKQLSAA

SEQ ID NO: 801221 - protein, 29 aa, Mycobacterium
DGSASYYLPRLIGIAKTKQLMLTNRVLSA

SEQ ID NO: 801222 - protein, 24 aa, Mycobacterium
DGSDAIADWPLLNALTATSSGATW

SEQ ID NO: 801223 - protein, 19 aa, Mycobacterium
DGSDAIVLGCAGMAEMCRA

SEQ ID NO: 801224 - protein, 24 aa, Mycobacterium
DGSDFVATMRRLAAGDGAIDVVAD

SEQ ID NO: 801225 - protein, 23 aa, Mycobacterium
DGSDFVFMLQLAEGVDNPLVDIP

SEQ ID NO: 801226 - protein, 64 aa, Mycobacterium
DGSDRACSWLPIYHDMGLAFLLTAVLSGMPLWQAPTGAFSAAPLRWADWLSASAATFTAGPNFG

SEQ ID NO: 801227 - protein, 27 aa, Mycobacterium
DGSDTLAIPQFLSNPWWAEAASAERRA

SEQ ID NO: 801228 - protein, 25 aa, Mycobacterium
DGSDTVTLVWLGQRRIPGIDSGRKL

SEQ ID NO: 801229 - protein, 24 aa, Mycobacterium
DGSDVIVLGCAGMARLCRDISGEI

SEQ ID NO: 801230 - protein, 21 aa, Mycobacterium
DGSDWILNGSKMWITNGSVAD

SEQ ID NO: 801231 - protein, 42 aa, Mycobacterium
DGSELAVRTYRDVLLWNRDPNSSAWSPFSRQPVMGPAVSNES

SEQ ID NO: 801232 - protein, 27 aa, Mycobacterium
DGSEYTLNMFPLRKSYVRRLMREAGFT

SEQ ID NO: 801233 - protein, 26 aa, Mycobacterium
DGSGADPLWFLSLLSQDAVDLLELGL

SEQ ID NO: 801234 - protein, 27 aa, Mycobacterium
DGSGEGFVRRLWWRTVVDLPEDPLLHT

SEQ ID NO: 801235 - protein, 25 aa, Mycobacterium
DGSHIVMIGILPTLMPEHLTGHWMS

SEQ ID NO: 801236 - protein, 23 aa, Mycobacterium
DGSKPFDFVFHGGSGSLKSEIED

SEQ ID NO: 801237 - protein, 32 aa, Mycobacterium
DGSKPVIGTVMRQGYKLGDQVLRHALVGVIDT

SEQ ID NO: 801238 - protein, 32 aa, Mycobacterium
DGSLHTVGMLFSPGYPGFLRGVTASGPGEFVV

SEQ ID NO: 801239 - protein, 25 aa, Mycobacterium
DGSLQPYPNLATLLRAMKLSDSGGQ

SEQ ID NO: 801240 - protein, 28 aa, Mycobacterium
DGSMPQWHTYFPPIGGFRFSMFTIPPRG

SEQ ID NO: 801241 - protein, 25 aa, Mycobacterium
DGSPAGITAVLWATAEAVSAGVPLR

SEQ ID NO: 801242 - protein, 24 aa, Mycobacterium
DGSPAVKALLARTTRWGSYLTDID

SEQ ID NO: 801243 - protein, 24 aa, Mycobacterium
DGSPKILKQCTLPLTGKGVVDMII

SEQ ID NO: 801244 - protein, 18 aa, Mycobacterium
DGSPLRYNQLDPYLPDFV

SEQ ID NO: 801245 - protein, 21 aa, Mycobacterium
DGSPLVYNRADPKLPDLVVCR

SEQ ID NO: 801246 - protein, 30 aa, Mycobacterium
DGSPYQVFTPFFRKWQDARWRAPAGTGPGS

SEQ ID NO: 801247 - protein, 28 aa, Mycobacterium
DGSRDAGLAMLLLSRPPTNAMTRQVYRE

SEQ ID NO: 801248 - protein, 26 aa, Mycobacterium
DGSRGDTPLGPFNVDGHSGGDGGRGG

SEQ ID NO: 801249 - protein, 29 aa, Mycobacterium
DGSRIFTWHLAIAMRPKLWMFNSVGNLGH

SEQ ID NO: 801250 - protein, 26 aa, Mycobacterium
DGSRLPSLMWAQYGLAGLLEFEGFVR

SEQ ID NO: 801251 - protein, 29 aa, Mycobacterium
DGSRPRDLLLDAYLLRAMGIAGWAPALTE

SEQ ID NO: 801252 - protein, 24 aa, Mycobacterium
DGSRRDLPWREPGVSAWQILVSEF

SEQ ID NO: 801253 - protein, 19 aa, Mycobacterium
DGSRRYLQAAADAGLRRAV

SEQ ID NO: 801254 - protein, 31 aa, Mycobacterium
DGSSILLHFHATAFLNASGWSSAPAGYTRRI

SEQ ID NO: 801255 - protein, 24 aa, Mycobacterium
DGSSNWYTEFARLAPLMEKDTHYE

SEQ ID NO: 801256 - protein, 26 aa, Mycobacterium
DGSTPPLLEVVRPATFLFAAGQETVT

SEQ ID NO: 801257 - protein, 26 aa, Mycobacterium
DGSTWTLRWLLGRLGYRAYGWRLGLN

SEQ ID NO: 801258 - protein, 30 aa, Mycobacterium
DGSVEHFNWLEALGFQFERSYYPGKVVVPP

SEQ ID NO: 801259 - protein, 26 aa, Mycobacterium
DGSVPPLLEVVRPATFLFAAGQETVT

SEQ ID NO: 801260 - protein, 24 aa, Mycobacterium
DGSVSMFEYCVTRLVWSYLQDAAN

SEQ ID NO: 801261 - protein, 25 aa, Mycobacterium
DGSWRISHISYYRLYEAMQNTKDIG

SEQ ID NO: 801262 - protein, 18 aa, Mycobacterium
DGSYIITGGLGGLGLFFA

SEQ ID NO: 801263 - protein, 18 aa, Mycobacterium
DGSYIITGGLGGLGLFLA

SEQ ID NO: 801264 - protein, 24 aa, Mycobacterium
DGSYIITGGLGGLGLFLAEKMATA

SEQ ID NO: 801265 - protein, 17 aa, Mycobacterium
DGSYLAELLLSKGYEVH

SEQ ID NO: 801266 - protein, 19 aa, Mycobacterium
DGSYWFRTVTPRHYPIPTD

SEQ ID NO: 801267 - protein, 21 aa, Mycobacterium
DGTAAIWQRPPDLDLDGDGRL

SEQ ID NO: 801268 - protein, 24 aa, Mycobacterium
DGTARLALPGGLTWVARHVAESYD

SEQ ID NO: 801269 - protein, 22 aa, Mycobacterium
DGTATMWTAPPAIDTDGDGVPD

SEQ ID NO: 801270 - protein, 23 aa, Mycobacterium
DGTAVRIFFHTEIDEKFGGRGLA

SEQ ID NO: 801271 - protein, 24 aa, Mycobacterium
DGTDHRLRRKLLTPPFHGKSIKNY

SEQ ID NO: 801272 - protein, 26 aa, Mycobacterium
DGTDTVMLVWLGQRRIPGIESGRTLL

SEQ ID NO: 801273 - protein, 24 aa, Mycobacterium
DGTDYLDMFTFFASSALGMNHPML

SEQ ID NO: 801274 - protein, 29 aa, Mycobacterium
DGTFHKMEFANWDAVLKVHLYGGYNVIRA

SEQ ID NO: 801275 - protein, 24 aa, Mycobacterium
DGTFHRWSLWLDDAKVLSRIQRVI

SEQ ID NO: 801276 - protein, 19 aa, Mycobacterium
DGTFRVGVDIKAGTYRSAG

SEQ ID NO: 801277 - protein, 30 aa, Mycobacterium
DGTHPVVGTVMRRGYRVGEQVIRHAMVGVV

SEQ ID NO: 801278 - protein, 24 aa, Mycobacterium
DGTIKIEMNFLPDVYVPCEVCHGA

SEQ ID NO: 801279 - protein, 22 aa, Mycobacterium
DGTIRAVIAWPTEDIALSDICT

SEQ ID NO: 801280 - protein, 26 aa, Mycobacterium
DGTLFGFLLMCGQACESGTRLLLHAS

SEQ ID NO: 801281 - protein, 20 aa, Mycobacterium
DGTLLGAERIFLNVGGRAVV

SEQ ID NO: 801282 - protein, 21 aa, Mycobacterium
DGTLLIASAHDRLVLRYDGDT

SEQ ID NO: 801283 - protein, 27 aa, Mycobacterium
DGTLLRWLRRKNAPAVVLRPDGFIYAA

SEQ ID NO: 801284 - protein, 22 aa, Mycobacterium
DGTLTVLWHSITWQYLSADERA

SEQ ID NO: 801285 - protein, 21 aa, Mycobacterium
DGTPFFLDPWGRADAVVNAYW

SEQ ID NO: 801286 - protein, 24 aa, Mycobacterium
DGTPIPYFVVRPAGARGPGPTMLY

SEQ ID NO: 801287 - protein, 24 aa, Mycobacterium
DGTPVIPMTLLGTFSPYMVVHKSS

SEQ ID NO: 801288 - protein, 25 aa, Mycobacterium
DGTPYAVVTVCRRLWRGNLEAVREL

SEQ ID NO: 801289 - protein, 29 aa, Mycobacterium
DGTPYQVFTPFLRKWREVGWRSPAKSGAE

SEQ ID NO: 801290 - protein, 20 aa, Mycobacterium
DGTPYVTPLVRKLAEENNID

SEQ ID NO: 801291 - protein, 18 aa, Mycobacterium
DGTQVAWGRGGDGGDGGQ

SEQ ID NO: 801292 - protein, 23 aa, Mycobacterium
DGTRIAYLAPWQNRLNIWVENVD

SEQ ID NO: 801293 - protein, 24 aa, Mycobacterium
DGTRIPISIVYRGGIQLPAPAMIY

SEQ ID NO: 801294 - protein, 24 aa, Mycobacterium
DGTRYNTAFAYLDDLRESGRLTVL

SEQ ID NO: 801295 - protein, 17 aa, Mycobacterium
DGTTACGCWIYSGVYAG

SEQ ID NO: 801296 - protein, 22 aa, Mycobacterium
DGTTEWIPPPQLALPGETRHDD

SEQ ID NO: 801297 - protein, 19 aa, Mycobacterium
DGTTMFPFRRLFIVAEVGG

SEQ ID NO: 801298 - protein, 24 aa, Mycobacterium
DGTTNPLYGTGFDGSAGLNGTAEG

SEQ ID NO: 801299 - protein, 37 aa, Mycobacterium
DGTTTLLVTDLAGGWIPPHVRLPAHVSLLEPSARRHD

SEQ ID NO: 801300 - protein, 43 aa, Mycobacterium
DGTTTLLVTDLAGGWMPPHVRLPAHVTLLEPAARRRDANVVDL

SEQ ID NO: 801301 - protein, 23 aa, Mycobacterium
DGTVDIEYKFGFSGNPWGELEGI

SEQ ID NO: 801302 - protein, 26 aa, Mycobacterium
DGTVGYLPQSLPFTGDLTVAAVLGIA

SEQ ID NO: 801303 - protein, 33 aa, Mycobacterium
DGTVIDLAWTPPRFGHVLVFRTPDPPSADAHGI

SEQ ID NO: 801304 - protein, 20 aa, Mycobacterium
DGTVNFLYGIPAYGVSVGVR

SEQ ID NO: 801305 - protein, 19 aa, Mycobacterium
DGTVRWFGTVMAAGFDSLV

SEQ ID NO: 801306 - protein, 30 aa, Mycobacterium
DGTVTAARRTWPSPLLPALPSLMDDSGGDI

SEQ ID NO: 801307 - protein, 28 aa, Mycobacterium
DGTVTLGPIWDWQPSHVFEYLAGRGIAP

SEQ ID NO: 801308 - protein, 20 aa, Mycobacterium
DGTWDAILAVVLTAAADADR

SEQ ID NO: 801309 - protein, 17 aa, Mycobacterium
DGTWLSTFAPGAPFAIA

SEQ ID NO: 801310 - protein, 27 aa, Mycobacterium
DGTWNTLYRKWLSVLGPAPAPPRPRYV

SEQ ID NO: 801311 - protein, 22 aa, Mycobacterium
DGTWTWRYDSFRKGDGFEGLWD

SEQ ID NO: 801312 - protein, 21 aa, Mycobacterium
DGTYAILVYPGDSGSAVAVGV

SEQ ID NO: 801313 - protein, 18 aa, Mycobacterium
DGVAGRPLRDVLGAYLDT

SEQ ID NO: 801314 - protein, 30 aa, Mycobacterium
DGVAILARNHRWFIIANYAAHRAGARVILL

SEQ ID NO: 801315 - protein, 26 aa, Mycobacterium
DGVATLLAPYFGMLPAGTWRDEREAN

SEQ ID NO: 801316 - protein, 17 aa, Mycobacterium
DGVATLLAPYFGMVPAG

SEQ ID NO: 801317 - protein, 24 aa, Mycobacterium
DGVDFLVFPDACLGGYIGDFHRPD

SEQ ID NO: 801318 - protein, 28 aa, Mycobacterium
DGVDRIVVHLAPWLEPEPICWAINHVRV

SEQ ID NO: 801319 - protein, 27 aa, Mycobacterium
DGVDTALRFTHGPISWGTAAAVEAVQH

SEQ ID NO: 801320 - protein, 25 aa, Mycobacterium
DGVDYFFVTPERFQQLIDDNALLEW

SEQ ID NO: 801321 - protein, 23 aa, Mycobacterium
DGVDYLFTPFSAGNVDVFADIVR

SEQ ID NO: 801322 - protein, 24 aa, Mycobacterium
DGVEYPLDCLIFATGFEVGTDYSQ

SEQ ID NO: 801323 - protein, 24 aa, Mycobacterium
DGVGGTWFWNTYPGIAVDIPSFSY

SEQ ID NO: 801324 - protein, 24 aa, Mycobacterium
DGVGGTWHWNTYPGIAVDIPSYSY

SEQ ID NO: 801325 - protein, 20 aa, Mycobacterium
DGVGYLLKSRIGDVGEFADA

SEQ ID NO: 801326 - protein, 17 aa, Mycobacterium
DGVHIHPAIYRTVLAAV

SEQ ID NO: 801327 - protein, 17 aa, Mycobacterium
DGVIGWLLSGPEHTYHV

SEQ ID NO: 801328 - protein, 23 aa, Mycobacterium
DGVKLAYPAWVPRPVTDDQFVVH

SEQ ID NO: 801329 - protein, 17 aa, Mycobacterium
DGVLHLVPGLRVAPTGQ

SEQ ID NO: 801330 - protein, 21 aa, Mycobacterium
DGVLRFFKYIAAHTDIALGMF

SEQ ID NO: 801331 - protein, 21 aa, Mycobacterium
DGVLVCVAQCRPNTAPTVLQT

SEQ ID NO: 801332 - protein, 25 aa, Mycobacterium
DGVMPGGMRFAYLSAPAAALPYMEL

SEQ ID NO: 801333 - protein, 24 aa, Mycobacterium
DGVNPVPADAPFSYADSGQQGHDV

SEQ ID NO: 801334 - protein, 23 aa, Mycobacterium
DGVPELWPWPPVDYRRTLTSPIR

SEQ ID NO: 801335 - protein, 28 aa, Mycobacterium
DGVPGPDRVPLLALLRSTPLTEDQIRQV

SEQ ID NO: 801336 - protein, 27 aa, Mycobacterium
DGVPGPDRVPLLELLRSTPLTEDQIKE

SEQ ID NO: 801337 - protein, 17 aa, Mycobacterium
DGVPIHRAIVQRLRQRE

SEQ ID NO: 801338 - protein, 20 aa, Mycobacterium
DGVPSILAPALRPLWDSLDD

SEQ ID NO: 801339 - protein, 24 aa, Mycobacterium
DGVPTPVFRLLHVADTYNPVAPAD

SEQ ID NO: 801340 - protein, 26 aa, Mycobacterium
DGVPVAGLTWLPFMGEKYAAVTGGPL

SEQ ID NO: 801341 - protein, 23 aa, Mycobacterium
DGVPVWISGPQYETWKHTQLVID

SEQ ID NO: 801342 - protein, 20 aa, Mycobacterium
DGVQVVLRKPIKGTGWTVRD

SEQ ID NO: 801343 - protein, 20 aa, Mycobacterium
DGVRCAVQFFPSHDVYTWDA

SEQ ID NO: 801344 - protein, 20 aa, Mycobacterium
DGVRQSWIDATPLGRLQTPD

SEQ ID NO: 801345 - protein, 34 aa, Mycobacterium
DGVRREYLWAEADRHLWIADDRGAWHLREAEEHK

SEQ ID NO: 801346 - protein, 25 aa, Mycobacterium
DGVTRELVWPSMRISYCRPPGSDRD

SEQ ID NO: 801347 - protein, 24 aa, Mycobacterium
DGVVIPSPFDLSTLMRNPRLKARM

SEQ ID NO: 801348 - protein, 18 aa, Mycobacterium
DGVVLWLATATAIAERIA

SEQ ID NO: 801349 - protein, 25 aa, Mycobacterium
DGVVRPVMFMAYSGEARWRDSAGEE

SEQ ID NO: 801350 - protein, 26 aa, Mycobacterium
DGVYEFQLVAPPLRFVGAVGSPVNPI

SEQ ID NO: 801351 - protein, 26 aa, Mycobacterium
DGVYRGAYLERLLAGLLADLGVRTFG

SEQ ID NO: 801352 - protein, 24 aa, Mycobacterium
DGVYVRRRFTFDPRLQRAAEMPNA

SEQ ID NO: 801353 - protein, 24 aa, Mycobacterium
DGWAADVDALLAERARLIEPPVRE

SEQ ID NO: 801354 - protein, 18 aa, Mycobacterium
DGWAPFNVSLRQARDWLS

SEQ ID NO: 801355 - protein, 28 aa, Mycobacterium
DGWFAGAVGPRLPWIPGLPPGMATWTPD

SEQ ID NO: 801356 - protein, 24 aa, Mycobacterium
DGWNNFNLSLQRDIKRFRIFENWE

SEQ ID NO: 801357 - protein, 23 aa, Mycobacterium
DGWQLWMRPEAVPGLRRLTDAVH

SEQ ID NO: 801358 - protein, 19 aa, Mycobacterium
DGWRRWEPAVRTLLSAMPI

SEQ ID NO: 801359 - protein, 21 aa, Mycobacterium
DGWRRYVALVVDAISVGQRGP

SEQ ID NO: 801360 - protein, 22 aa, Mycobacterium
DGWSLPILLQEIFASYFGHRLP

SEQ ID NO: 801361 - protein, 21 aa, Mycobacterium
DGWSLPVFVGEYITLYAADGD

SEQ ID NO: 801362 - protein, 25 aa, Mycobacterium
DGWSMPVFINEMMILYQAGGHLSAL

SEQ ID NO: 801363 - protein, 23 aa, Mycobacterium
DGWSVAPARLPFTLGAGEYLEAD

SEQ ID NO: 801364 - protein, 19 aa, Mycobacterium
DGWVKLVGDWIDRGIGDLA

SEQ ID NO: 801365 - protein, 24 aa, Mycobacterium
DGWVLTVARNRLRDRWKSHGYRLT

SEQ ID NO: 801366 - protein, 18 aa, Mycobacterium
DGWVRLRGEAALVLPSGP

SEQ ID NO: 801367 - protein, 18 aa, Mycobacterium
DGWVRLRGEAALVLPTGA

SEQ ID NO: 801368 - protein, 19 aa, Mycobacterium
DGWWMDPLVEYAARLGVSD

SEQ ID NO: 801369 - protein, 18 aa, Mycobacterium
DGYAADIALPLDLLDSEP

SEQ ID NO: 801370 - protein, 26 aa, Mycobacterium
DGYALVDEALLPLLAGHVRVEWAGDI

SEQ ID NO: 801371 - protein, 19 aa, Mycobacterium
DGYFYIVDRTKDLIIRGGY

SEQ ID NO: 801372 - protein, 31 aa, Mycobacterium
DGYIDVKGLCLTLWQAAWRVSEDLPSDVDVA

SEQ ID NO: 801373 - protein, 26 aa, Mycobacterium
DGYPEGELYFPGSPILSVHGTFAECV

SEQ ID NO: 801374 - protein, 23 aa, Mycobacterium
DGYPYRQRPTPIPTLEQAISAVP

SEQ ID NO: 801375 - protein, 30 aa, Mycobacterium
DGYTNAEIAGLLFISARTVEWHLSKIFAKL

SEQ ID NO: 801376 - protein, 23 aa, Mycobacterium
DGYYQVRAYAREYLASRGVTVVE

SEQ ID NO: 801377 - protein, 24 aa, Mycobacterium
DHAAALPSPFFFDIAQWADEDVET

SEQ ID NO: 801378 - protein, 22 aa, Mycobacterium
DHAAMFGLPVCGPIHPTPAGLV

SEQ ID NO: 801379 - protein, 19 aa, Mycobacterium
DHAGFVAIYALIRQAAAKA

SEQ ID NO: 801380 - protein, 20 aa, Mycobacterium
DHAKWRHVLAEYFSPGRVKG

SEQ ID NO: 801381 - protein, 27 aa, Mycobacterium
DHAMLATGLLALYQLTSEPGWLTSACD

SEQ ID NO: 801382 - protein, 25 aa, Mycobacterium
DHAPAGLLHLAVLGSPLAHARITSI

SEQ ID NO: 801383 - protein, 18 aa, Mycobacterium
DHAQLNWPEGEGGFMLGS

SEQ ID NO: 801384 - protein, 18 aa, Mycobacterium
DHARRWQRPSGFSRFAWD

SEQ ID NO: 801385 - protein, 23 aa, Mycobacterium
DHASRLLLRVLGIDPPDHELDVW

SEQ ID NO: 801386 - protein, 24 aa, Mycobacterium
DHATYLAECLLLGTGTPTTDRHDV

SEQ ID NO: 801387 - protein, 28 aa, Mycobacterium
DHAVKSMFFGWPLISEDLALATITFTSR

SEQ ID NO: 801388 - protein, 35 aa, Mycobacterium
DHAWFIAETIGAGSFPWVLAITSPYTDAAHRQAFL

SEQ ID NO: 801389 - protein, 23 aa, Mycobacterium
DHAYDVLRSIRLPGSHFRNDIAQ

SEQ ID NO: 801390 - protein, 23 aa, Mycobacterium
DHCLGVVFYPVIPMGSWVATTEF

SEQ ID NO: 801391 - protein, 26 aa, Mycobacterium
DHCLGVVFYPVIPPGSWVATTEFKLN

SEQ ID NO: 801392 - protein, 17 aa, Mycobacterium
DHCLSVLLQAWGDDPFE

SEQ ID NO: 801393 - protein, 28 aa, Mycobacterium
DHCSEHISLMLLSAPLALNWLKNRFRGT

SEQ ID NO: 801394 - protein, 18 aa, Mycobacterium
DHCYAMTLAKRLKAMGSE

SEQ ID NO: 801395 - protein, 27 aa, Mycobacterium
DHDADPRLAPLLAWRQQLVDSGAVAPR

SEQ ID NO: 801396 - protein, 25 aa, Mycobacterium
DHDELLRFEKTLIAIWRAIQSAGQT

SEQ ID NO: 801397 - protein, 23 aa, Mycobacterium
DHDGLFILVPADATWRPENRGAP

SEQ ID NO: 801398 - protein, 23 aa, Mycobacterium
DHDGLVRWMADLNTRTLPQQPFM

SEQ ID NO: 801399 - protein, 25 aa, Mycobacterium
DHDHLYGLAWNPMTLIDVLKKVDGA

SEQ ID NO: 801400 - protein, 17 aa, Mycobacterium
DHDKFLKNITHHYWKDN

SEQ ID NO: 801401 - protein, 17 aa, Mycobacterium
DHDLAWYANQELPFLLE

SEQ ID NO: 801402 - protein, 21 aa, Mycobacterium
DHDLEFFVMFGSAGSTIAAPG

SEQ ID NO: 801403 - protein, 24 aa, Mycobacterium
DHDLLVVGLGPVGLAAGMIGRGMG

SEQ ID NO: 801404 - protein, 17 aa, Mycobacterium
DHDPLVRGLRRLGHDVN

SEQ ID NO: 801405 - protein, 17 aa, Mycobacterium
DHDVTIGLVFRARMAEP

SEQ ID NO: 801406 - protein, 27 aa, Mycobacterium
DHDYSSLQLVFFGAAPIQPDTVRKMRQ

SEQ ID NO: 801407 - protein, 24 aa, Mycobacterium
DHEFTFPMEFKPGQGGWQLSRRTA

SEQ ID NO: 801408 - protein, 26 aa, Mycobacterium
DHEISVILARLLFLMFGDDTEMWENE

SEQ ID NO: 801409 - protein, 25 aa, Mycobacterium
DHEIVPGVPAFAAAAAALGTELTVP

SEQ ID NO: 801410 - protein, 25 aa, Mycobacterium
DHELDLIDAYWRAANYLSVGQIYLL

SEQ ID NO: 801411 - protein, 25 aa, Mycobacterium
DHELFAQGLALLLTREWGESFTVGG

SEQ ID NO: 801412 - protein, 26 aa, Mycobacterium
DHERIAPLVADWADALGRPIDVALQD

SEQ ID NO: 801413 - protein, 24 aa, Mycobacterium
DHFAARGFAFYALDLHKCGRSRRD

SEQ ID NO: 801414 - protein, 18 aa, Mycobacterium
DHFAMLEVTLALATLIRG

SEQ ID NO: 801415 - protein, 25 aa, Mycobacterium
DHFARRGFAFYALDLRKCGRSRQDG

SEQ ID NO: 801416 - protein, 20 aa, Mycobacterium
DHFASRGFAFYALDLHKCGR

SEQ ID NO: 801417 - protein, 20 aa, Mycobacterium
DHFDERLGRNVLGPGVVPVL

SEQ ID NO: 801418 - protein, 20 aa, Mycobacterium
DHFDETPLLLFVFAIDDHGG

SEQ ID NO: 801419 - protein, 22 aa, Mycobacterium
DHFDFFPLTVDVEERMYAAGRI

SEQ ID NO: 801420 - protein, 17 aa, Mycobacterium
DHFDVWPGNDWFDKTVT

SEQ ID NO: 801421 - protein, 19 aa, Mycobacterium
DHFRYFAGVLRAQEGSLSQ

SEQ ID NO: 801422 - protein, 23 aa, Mycobacterium
DHFSRRCRAVRLVPFDPHLEEGA

SEQ ID NO: 801423 - protein, 23 aa, Mycobacterium
DHGDRLLVISEKKAWKVKRIRNT

SEQ ID NO: 801424 - protein, 22 aa, Mycobacterium
DHGEILDWLHRLRGPVRVVYEA

SEQ ID NO: 801425 - protein, 23 aa, Mycobacterium
DHGELVMFLMTRMPPGASRAKPT

SEQ ID NO: 801426 - protein, 23 aa, Mycobacterium
DHGVFMYMEFEPGRPLVGTLEYG

SEQ ID NO: 801427 - protein, 17 aa, Mycobacterium
DHHLLTGDFPIPSYPVL

SEQ ID NO: 801428 - protein, 24 aa, Mycobacterium
DHHLPQGFRRIDPARVPAAHPDHR

SEQ ID NO: 801429 - protein, 23 aa, Mycobacterium
DHHPAGRPPIHQLTRTRFGAHHH

SEQ ID NO: 801430 - protein, 24 aa, Mycobacterium
DHHPVYYMPQWDTFALSRFEDIWE

SEQ ID NO: 801431 - protein, 25 aa, Mycobacterium
DHHPVYYMPQWDTFALSRFEDIWKV

SEQ ID NO: 801432 - protein, 19 aa, Mycobacterium
DHHRGWASVWVLHDNAQLN

SEQ ID NO: 801433 - protein, 19 aa, Mycobacterium
DHHRIEHMLFDGALSPEGG

SEQ ID NO: 801434 - protein, 27 aa, Mycobacterium
DHHSRRGLLLLVGRRRRLLKYVAKVDV

SEQ ID NO: 801435 - protein, 22 aa, Mycobacterium
DHIDTMVLYPSLGLCAPSLEDP

SEQ ID NO: 801436 - protein, 24 aa, Mycobacterium
DHIEFFGHWLHRGATYRSRALPRG

SEQ ID NO: 801437 - protein, 18 aa, Mycobacterium
DHIGTPFTLLHGLADDVV

SEQ ID NO: 801438 - protein, 26 aa, Mycobacterium
DHILPVLADRPLTVLRTLRGQKPFVQ

SEQ ID NO: 801439 - protein, 25 aa, Mycobacterium
DHKAAHLPYLVYLRHPTTGGVFASW

SEQ ID NO: 801440 - protein, 25 aa, Mycobacterium
DHKSLRYFFESALSPNTFWVELKNL

SEQ ID NO: 801441 - protein, 17 aa, Mycobacterium
DHLAAAFELHRCPQPET

SEQ ID NO: 801442 - protein, 18 aa, Mycobacterium
DHLAALGNPTWYARFAAQ

SEQ ID NO: 801443 - protein, 25 aa, Mycobacterium
DHLERGTLDLSKLDYLVLDEADEML

SEQ ID NO: 801444 - protein, 27 aa, Mycobacterium
DHLERLWTPYRMNYLAEAPLKREDSAR

SEQ ID NO: 801445 - protein, 31 aa, Mycobacterium
DHLHAVVAEWQLLADLSFADYLMWVHRDDDA

SEQ ID NO: 801446 - protein, 37 aa, Mycobacterium
DHLHAVVGEWQLLADLSFADYLMWVRRDDGHLVCVAQ

SEQ ID NO: 801447 - protein, 36 aa, Mycobacterium
DHLHAVVGEWQLLADLSFADYLMWVRRDDGKLVCVA

SEQ ID NO: 801448 - protein, 40 aa, Mycobacterium
DHLHAVVGEWQLLADLSFADYLMWVRRDDGVLVCVAQCRP

SEQ ID NO: 801449 - protein, 26 aa, Mycobacterium
DHLIDAARPFIFDTGLAPAAVGAAHA

SEQ ID NO: 801450 - protein, 36 aa, Mycobacterium
DHLIEIPAVSTLYQPLLSTIPMQVFAAAVAQARGYD

SEQ ID NO: 801451 - protein, 18 aa, Mycobacterium
DHLPLLEGLDLNGIQVFD

SEQ ID NO: 801452 - protein, 17 aa, Mycobacterium
DHLQQRVARWWIPDDIV

SEQ ID NO: 801453 - protein, 23 aa, Mycobacterium
DHLQRLWSPHRMSYIAEAVKAPS

SEQ ID NO: 801454 - protein, 23 aa, Mycobacterium
DHLQRLWTPHRMSYIAEAPMKKR

SEQ ID NO: 801455 - protein, 28 aa, Mycobacterium
DHLQRLWTPYRMTYLAEAPLKRDPNGSG

SEQ ID NO: 801456 - protein, 25 aa, Mycobacterium
DHLRESMLVALLSGGHLLLESVPGL

SEQ ID NO: 801457 - protein, 20 aa, Mycobacterium
DHLRLEITGPWAPYSFTSLG

SEQ ID NO: 801458 - protein, 18 aa, Mycobacterium
DHLRRIGELWARFNAVAV

SEQ ID NO: 801459 - protein, 18 aa, Mycobacterium
DHLSADRRHLLFSVSKSL

SEQ ID NO: 801460 - protein, 24 aa, Mycobacterium
DHLTRMGLRILHRNWRCRYGELDV

SEQ ID NO: 801461 - protein, 21 aa, Mycobacterium
DHLVILEKFDAALALDVIERF

SEQ ID NO: 801462 - protein, 18 aa, Mycobacterium
DHNPRWQGITRTYTPQDV

SEQ ID NO: 801463 - protein, 28 aa, Mycobacterium
DHNQLVISRPMRLTLPPAAGWPEEEVLI

SEQ ID NO: 801464 - protein, 24 aa, Mycobacterium
DHNWRNYALHFFETRLTSDTIGLA

SEQ ID NO: 801465 - protein, 24 aa, Mycobacterium
DHPDLRCLMLTSFTSDEAMLEAIL

SEQ ID NO: 801466 - protein, 21 aa, Mycobacterium
DHPDQKRCYAYYLDAAIEIGG

SEQ ID NO: 801467 - protein, 22 aa, Mycobacterium
DHPDQWVLLAQHPDLAANAAEE

SEQ ID NO: 801468 - protein, 24 aa, Mycobacterium
DHPEDWHMFQPQWLADLSDARRAR

SEQ ID NO: 801469 - protein, 24 aa, Mycobacterium
DHPEKSLIRPLHGKGGRNAHGRIT

SEQ ID NO: 801470 - protein, 34 aa, Mycobacterium
DHPEKWQQFYGDKPTFVFTTRELPVPAGADVRFV

SEQ ID NO: 801471 - protein, 20 aa, Mycobacterium
DHPEWGFAGYVHHFIDKPTI

SEQ ID NO: 801472 - protein, 24 aa, Mycobacterium
DHPFFARIWPFIVAHEAEPVRALR

SEQ ID NO: 801473 - protein, 17 aa, Mycobacterium
DHPFNPVSLALGAEATF

SEQ ID NO: 801474 - protein, 19 aa, Mycobacterium
DHPGAGFGATPLRRRAALG

SEQ ID NO: 801475 - protein, 17 aa, Mycobacterium
DHPLAQHDSLTLADIAN

SEQ ID NO: 801476 - protein, 19 aa, Mycobacterium
DHPLYAGPLPMTIAGVEQA

SEQ ID NO: 801477 - protein, 21 aa, Mycobacterium
DHPMGCKRLVFSSEFLTALAR

SEQ ID NO: 801478 - protein, 25 aa, Mycobacterium
DHPNVQFLQRYLVAPRPDLGRNEPC

SEQ ID NO: 801479 - protein, 24 aa, Mycobacterium
DHPPDNYTWIPYGGGVRRCIGAAF

SEQ ID NO: 801480 - protein, 24 aa, Mycobacterium
DHPTLNILVTMAGIMRVEDWHHPE

SEQ ID NO: 801481 - protein, 18 aa, Mycobacterium
DHPVARMTELIAALRAIF

SEQ ID NO: 801482 - protein, 24 aa, Mycobacterium
DHPVHRYFLAAKETEFALGGATRQ

SEQ ID NO: 801483 - protein, 31 aa, Mycobacterium
DHPVHRYFLAAKQSEFALGSATGQLLRIGRE

SEQ ID NO: 801484 - protein, 26 aa, Mycobacterium
DHPVRAVFIRAPWVERVGAGVTVLAR

SEQ ID NO: 801485 - protein, 32 aa, Mycobacterium
DHQEVAALLRWLGNGNFLLLGYQPCEVDDGMV

SEQ ID NO: 801486 - protein, 26 aa, Mycobacterium
DHQGHSYWWGGNLMGVKDRPIVLNTP

SEQ ID NO: 801487 - protein, 24 aa, Mycobacterium
DHQPPALLMLHPPSETTPSLPECT

SEQ ID NO: 801488 - protein, 24 aa, Mycobacterium
DHQPPTGLLPFGRPQMAGGALGSV

SEQ ID NO: 801489 - protein, 20 aa, Mycobacterium
DHQQGRASLWRNGIQRYVPV

SEQ ID NO: 801490 - protein, 20 aa, Mycobacterium
DHQRATPLLVLTVGKTDDVT

SEQ ID NO: 801491 - protein, 20 aa, Mycobacterium
DHQWIAAHLSWNGGGNDGWL

SEQ ID NO: 801492 - protein, 18 aa, Mycobacterium
DHRAFLAAGLPTGGSWPN

SEQ ID NO: 801493 - protein, 17 aa, Mycobacterium
DHRAKLPAAQIHRVLTQ

SEQ ID NO: 801494 - protein, 19 aa, Mycobacterium
DHRALRVLGLKTVELTELW

SEQ ID NO: 801495 - protein, 25 aa, Mycobacterium
DHRARLQVLGDRWFGHGIGRASFAS

SEQ ID NO: 801496 - protein, 18 aa, Mycobacterium
DHRAVILRAYYRGSSVAD

SEQ ID NO: 801497 - protein, 19 aa, Mycobacterium
DHRAYDEILPYLVPHHRVI

SEQ ID NO: 801498 - protein, 21 aa, Mycobacterium
DHRDFLHWNTWDGRSRAGRKT

SEQ ID NO: 801499 - protein, 28 aa, Mycobacterium
DHRDTYDALFDLFFPAALGARTVLDDES

SEQ ID NO: 801500 - protein, 29 aa, Mycobacterium
DHRDTYDAMFDLWFPAALGARAVITEEQA

SEQ ID NO: 801501 - protein, 25 aa, Mycobacterium
DHRDVFGLLGLVDEVGLVGADHRLV

SEQ ID NO: 801502 - protein, 20 aa, Mycobacterium
DHRDYWKKAVVERTGLPFSR

SEQ ID NO: 801503 - protein, 25 aa, Mycobacterium
DHREPLMFSLGIWHGVRRFLVLRDV

SEQ ID NO: 801504 - protein, 28 aa, Mycobacterium
DHRETYDALFDLYFPAALGAKTVLDDDE

SEQ ID NO: 801505 - protein, 28 aa, Mycobacterium
DHRETYDAMFDLWFPAALGARAVVAEDE

SEQ ID NO: 801506 - protein, 29 aa, Mycobacterium
DHRETYDAMFDLWFPAALGARAVVTDDGA

SEQ ID NO: 801507 - protein, 25 aa, Mycobacterium
DHRHDRWFLFNYFHCDDADTVQAVW

SEQ ID NO: 801508 - protein, 24 aa, Mycobacterium
DHRPEILLSFGFVPKVEARVGLIN

SEQ ID NO: 801509 - protein, 23 aa, Mycobacterium
DHRPTVMLLGGGALSRELALAFQ

SEQ ID NO: 801510 - protein, 25 aa, Mycobacterium
DHRRRVGQLWARFNAVAVANPYAWI

SEQ ID NO: 801511 - protein, 24 aa, Mycobacterium
DHRSFWWFVRDLIYTYRQQPEIGW

SEQ ID NO: 801512 - protein, 17 aa, Mycobacterium
DHRWNDFVVGGLGIRCV

SEQ ID NO: 801513 - protein, 17 aa, Mycobacterium
DHRYVPAAVFTDPQLAA

SEQ ID NO: 801514 - protein, 26 aa, Mycobacterium
DHSDYYVLLVEYWLRAQRDPQLRDRL

SEQ ID NO: 801515 - protein, 23 aa, Mycobacterium
DHSGPLVTELLGEAGFVVDGVVV

SEQ ID NO: 801516 - protein, 21 aa, Mycobacterium
DHSKLWFAMAAGLLASRSQSA

SEQ ID NO: 801517 - protein, 18 aa, Mycobacterium
DHSKLWFVIAAGLGAVGG

SEQ ID NO: 801518 - protein, 28 aa, Mycobacterium
DHSRRLWTVLIFMLWHAIFVEHSVVPQI

SEQ ID NO: 801519 - protein, 27 aa, Mycobacterium
DHSRRLWTVLIFMLWHAIFVEQSVRPQ

SEQ ID NO: 801520 - protein, 31 aa, Mycobacterium
DHSRRLWTVLIFMLWHSIFVEKTVHPAISEP

SEQ ID NO: 801521 - protein, 28 aa, Mycobacterium
DHSTGESRLLFRPLPQLDPSQLAPMRPV

SEQ ID NO: 801522 - protein, 17 aa, Mycobacterium
DHSVWFHAAADLSDWML

SEQ ID NO: 801523 - protein, 19 aa, Mycobacterium
DHSVWFHRPFDPHEWHRYE

SEQ ID NO: 801524 - protein, 29 aa, Mycobacterium
DHSWGVRDWWSMDWLWSALHLNDGTHLHG

SEQ ID NO: 801525 - protein, 29 aa, Mycobacterium
DHSWGVRDWWSMDWMWSAVHLDDGTHLHG

SEQ ID NO: 801526 - protein, 28 aa, Mycobacterium
DHSWGVRDWWSMEWVWSALHLDDGTHLH

SEQ ID NO: 801527 - protein, 28 aa, Mycobacterium
DHTDEVVLPFFWQGVSLHAAGASAVRAR

SEQ ID NO: 801528 - protein, 19 aa, Mycobacterium
DHTEAQHLGLGYGIHSCLG

SEQ ID NO: 801529 - protein, 24 aa, Mycobacterium
DHTGAFSQLPLPHARLVVSAWRHR

SEQ ID NO: 801530 - protein, 22 aa, Mycobacterium
DHTIALPALQAMHAIHGPVALV

SEQ ID NO: 801531 - protein, 20 aa, Mycobacterium
DHTIRATILIAEFPPRNADP

SEQ ID NO: 801532 - protein, 18 aa, Mycobacterium
DHTLGLPMGWHRGYHSLT

SEQ ID NO: 801533 - protein, 26 aa, Mycobacterium
DHTPEGLLHLAVLGSPVAHARIVAID

SEQ ID NO: 801534 - protein, 23 aa, Mycobacterium
DHTPGFERTLIARAFDFFNEQVY

SEQ ID NO: 801535 - protein, 28 aa, Mycobacterium
DHTSGRIERFLLLWAEGSMTIAVPSTPA

SEQ ID NO: 801536 - protein, 17 aa, Mycobacterium
DHTWTAQPLADEYGIPV

SEQ ID NO: 801537 - protein, 35 aa, Mycobacterium
DHVAAVALFGKPSPRFMRVLNDPPVVVGPYYASKA

SEQ ID NO: 801538 - protein, 21 aa, Mycobacterium
DHVAEWRTWPGYSEQERLAAE

SEQ ID NO: 801539 - protein, 17 aa, Mycobacterium
DHVAQRFGAAGLVTYAL

SEQ ID NO: 801540 - protein, 22 aa, Mycobacterium
DHVDLHRFVFLSTIGTIAVGRN

SEQ ID NO: 801541 - protein, 19 aa, Mycobacterium
DHVGWLDDRKWAYVRLEGR

SEQ ID NO: 801542 - protein, 25 aa, Mycobacterium
DHVLAEMKLLRPLLSSGDYLVVEDS

SEQ ID NO: 801543 - protein, 37 aa, Mycobacterium
DHVLAYVAIMGTAWLLDVPGYLLNLLPEPVADRFDPR

SEQ ID NO: 801544 - protein, 19 aa, Mycobacterium
DHVLLPGFVDLHTHLREPG

SEQ ID NO: 801545 - protein, 20 aa, Mycobacterium
DHVMYVWVDALTNYLTGAGY

SEQ ID NO: 801546 - protein, 20 aa, Mycobacterium
DHVMYVWVDALTNYLTGVGF

SEQ ID NO: 801547 - protein, 20 aa, Mycobacterium
DHVMYVWVDALTNYLTGVGY

SEQ ID NO: 801548 - protein, 20 aa, Mycobacterium
DHVRPWDTTLYAVFGEVPLE

SEQ ID NO: 801549 - protein, 18 aa, Mycobacterium
DHVTAVFRHDDLASALAA

SEQ ID NO: 801550 - protein, 22 aa, Mycobacterium
DHVVGRVVAILALAALIHRDRT

SEQ ID NO: 801551 - protein, 19 aa, Mycobacterium
DHVVLLSPNLTRTVGALAE

SEQ ID NO: 801552 - protein, 28 aa, Mycobacterium
DHVVSLTREVLGAGIPLFGICFGNQILG

SEQ ID NO: 801553 - protein, 18 aa, Mycobacterium
DHVYLVPLHAAVDLLTAL

SEQ ID NO: 801554 - protein, 22 aa, Mycobacterium
DHWAMFESIRFDLNLVIAGDDG

SEQ ID NO: 801555 - protein, 21 aa, Mycobacterium
DHWFEVYRGTLPSPQMRWCTK

SEQ ID NO: 801556 - protein, 17 aa, Mycobacterium
DHWMDMTSAHPFRRNTP

SEQ ID NO: 801557 - protein, 25 aa, Mycobacterium
DHYDDDWTQLWWVRADGVAAIHHDG

SEQ ID NO: 801558 - protein, 24 aa, Mycobacterium
DHYDDDWTQLWWVRADGVAQIHPA

SEQ ID NO: 801559 - protein, 26 aa, Mycobacterium
DHYDQYLTLHGLRLVFERNRDAQGGR

SEQ ID NO: 801560 - protein, 22 aa, Mycobacterium
DHYFASWFERFARSFSGTIAGG

SEQ ID NO: 801561 - protein, 21 aa, Mycobacterium
DHYFASWFERYARSFGGTIAG

SEQ ID NO: 801562 - protein, 22 aa, Mycobacterium
DHYFASWFERYARSFSGTIAGG

SEQ ID NO: 801563 - protein, 26 aa, Mycobacterium
DHYHDWDMLRANLLQLLVDGTVRPHE

SEQ ID NO: 801564 - protein, 26 aa, Mycobacterium
DHYPSLDLAFRICAVFDLPVEAVFSR

SEQ ID NO: 801565 - protein, 25 aa, Mycobacterium
DHYRPIGWDAAYRLIADQLGALDSP

SEQ ID NO: 801566 - protein, 19 aa, Mycobacterium
DHYSFRVGNLLFLMLSDRN

SEQ ID NO: 801567 - protein, 28 aa, Mycobacterium
DIAAGEYGYHLPYFHQMLAAGAVDCLQA

SEQ ID NO: 801568 - protein, 25 aa, Mycobacterium
DIADGEFFVILGPSGAGKTTTLKSV

SEQ ID NO: 801569 - protein, 26 aa, Mycobacterium
DIAEEYYISFLLDRSNRTYLAMCSVE

SEQ ID NO: 801570 - protein, 19 aa, Mycobacterium
DIAELLLVARKVLTGVLSD

SEQ ID NO: 801571 - protein, 19 aa, Mycobacterium
DIAEPLPRSLVWSAAWEMT

SEQ ID NO: 801572 - protein, 20 aa, Mycobacterium
DIAEPLPRSLVWSAAWEMTR

SEQ ID NO: 801573 - protein, 24 aa, Mycobacterium
DIAEPLPRSLVWSAAWEMTREAEL

SEQ ID NO: 801574 - protein, 24 aa, Mycobacterium
DIAFNWDHFFPLYGDPDGAHYECW

SEQ ID NO: 801575 - protein, 20 aa, Mycobacterium
DIAGLVRAVGFRDPAKRLSV

SEQ ID NO: 801576 - protein, 17 aa, Mycobacterium
DIAGRYADGWWPAGAWT

SEQ ID NO: 801577 - protein, 17 aa, Mycobacterium
DIAIVRIEQLAPLPKRR

SEQ ID NO: 801578 - protein, 18 aa, Mycobacterium
DIALAAAIPRRRTDRRAY

SEQ ID NO: 801579 - protein, 18 aa, Mycobacterium
DIALAAAIPRRRTDRRYY

SEQ ID NO: 801580 - protein, 20 aa, Mycobacterium
DIALGGFYNYFSSKEELLEA

SEQ ID NO: 801581 - protein, 20 aa, Mycobacterium
DIAMVFQNYALYPHLTVAEN

SEQ ID NO: 801582 - protein, 19 aa, Mycobacterium
DIAMVFQSYALYPHMTVRQ

SEQ ID NO: 801583 - protein, 24 aa, Mycobacterium
DIANKLCAQILLLTAEDPTKDIHL

SEQ ID NO: 801584 - protein, 17 aa, Mycobacterium
DIAPPPELLVVNKIDAA

SEQ ID NO: 801585 - protein, 22 aa, Mycobacterium
DIARAGTWLDAATFTLTEDACA

SEQ ID NO: 801586 - protein, 28 aa, Mycobacterium
DIARLAHRVLRHRLILGFEAASARITPD

SEQ ID NO: 801587 - protein, 29 aa, Mycobacterium
DIARLKARMGWRMPWFTLTDDFDADFGVD

SEQ ID NO: 801588 - protein, 26 aa, Mycobacterium
DIARMSVLLAGWPETVPGMTLSRFCG

SEQ ID NO: 801589 - protein, 17 aa, Mycobacterium
DIAVFYRTNNNSRSLEE

SEQ ID NO: 801590 - protein, 20 aa, Mycobacterium
DIAVTILRLANMIGPAMDTA

SEQ ID NO: 801591 - protein, 17 aa, Mycobacterium
DIAVWRVGSRHDPLKTD

SEQ ID NO: 801592 - protein, 19 aa, Mycobacterium
DIAYLLFTSGTTGASKCCI

SEQ ID NO: 801593 - protein, 20 aa, Mycobacterium
DICDALAASFNPFCGLTSAQ

SEQ ID NO: 801594 - protein, 17 aa, Mycobacterium
DICFIPSGNTQTFLGER

SEQ ID NO: 801595 - protein, 19 aa, Mycobacterium
DICIYARESHVLVARSPAE

SEQ ID NO: 801596 - protein, 21 aa, Mycobacterium
DICPWALREGVILRRLDSEGD

SEQ ID NO: 801597 - protein, 30 aa, Mycobacterium
DICTLFEHFGLRLRRQLPLGPTGAGTYLYE

SEQ ID NO: 801598 - protein, 17 aa, Mycobacterium
DICVPLARRGGTVLIYG

SEQ ID NO: 801599 - protein, 30 aa, Mycobacterium
DIDDIQAQAILDMQLRRLAALERQKIVDDL

SEQ ID NO: 801600 - protein, 26 aa, Mycobacterium
DIDDLEFALRLGVDLVALSFVRSPAD

SEQ ID NO: 801601 - protein, 17 aa, Mycobacterium
DIDDPGRRRFLSVSLVG

SEQ ID NO: 801602 - protein, 34 aa, Mycobacterium
DIDDPPVLLIMGLGAQLLLWRTAFCEQLVSHGLR

SEQ ID NO: 801603 - protein, 29 aa, Mycobacterium
DIDEHQGIYRWLWPVRTVTWSRATFSKAT

SEQ ID NO: 801604 - protein, 26 aa, Mycobacterium
DIDEIQAQAILDMQLRRLAALERQRI

SEQ ID NO: 801605 - protein, 26 aa, Mycobacterium
DIDELIEFLLRMIQSMVIAPPEPPRD

SEQ ID NO: 801606 - protein, 23 aa, Mycobacterium
DIDERAFWPAYQDAYQAVLEKTS

SEQ ID NO: 801607 - protein, 18 aa, Mycobacterium
DIDFFGLHIPKGSTMMVN

SEQ ID NO: 801608 - protein, 22 aa, Mycobacterium
DIDFHIRRIAVPAPGGRRELEE

SEQ ID NO: 801609 - protein, 46 aa, Mycobacterium
DIDFIMDIGAYPTPYPVLTTAAIGMFFPGPYRIPKASFSYKTVFSN

SEQ ID NO: 801610 - protein, 22 aa, Mycobacterium
DIDFRFVATIVYRTDLIEDREV

SEQ ID NO: 801611 - protein, 18 aa, Mycobacterium
DIDGFLEAGIRWRNRKDD

SEQ ID NO: 801612 - protein, 19 aa, Mycobacterium
DIDGVLRWARASRDRLGQL

SEQ ID NO: 801613 - protein, 18 aa, Mycobacterium
DIDGVLVTSWEPIDGAAQ

SEQ ID NO: 801614 - protein, 22 aa, Mycobacterium
DIDGVLVTSWKPIPGAAETLRT

SEQ ID NO: 801615 - protein, 18 aa, Mycobacterium
DIDGVLVTSWQPIEGAAQ

SEQ ID NO: 801616 - protein, 28 aa, Mycobacterium
DIDHPVHRYFLAAKQTEFAVGGATGQLL

SEQ ID NO: 801617 - protein, 21 aa, Mycobacterium
DIDITGKFRDTLKADMTATDA

SEQ ID NO: 801618 - protein, 24 aa, Mycobacterium
DIDLHLVLGSWRILGAVQQSLDIV

SEQ ID NO: 801619 - protein, 20 aa, Mycobacterium
DIDLLAAKLEQAHDLLVQAL

SEQ ID NO: 801620 - protein, 24 aa, Mycobacterium
DIDLSRTVGWFTAKYPAALSVGDL

SEQ ID NO: 801621 - protein, 26 aa, Mycobacterium
DIDLSRTVGWFTTKYPVALTVADVPW

SEQ ID NO: 801622 - protein, 26 aa, Mycobacterium
DIDLSRTVGWFTTKYPVSLSVGGLSW

SEQ ID NO: 801623 - protein, 18 aa, Mycobacterium
DIDMRCLLIIGSSQTQWY

SEQ ID NO: 801624 - protein, 25 aa, Mycobacterium
DIDPGVIMYLWRTAGMSVDDIESML

SEQ ID NO: 801625 - protein, 24 aa, Mycobacterium
DIDRGGVFAAFFGTVALLSPQDQA

SEQ ID NO: 801626 - protein, 35 aa, Mycobacterium
DIDRLVELFTAEAIWEMPPYVGWYRGAQDIITLIH

SEQ ID NO: 801627 - protein, 25 aa, Mycobacterium
DIDSDALMLHYLPEVDLSTGAIVGA

SEQ ID NO: 801628 - protein, 19 aa, Mycobacterium
DIDSIPYPLATPADLDETA

SEQ ID NO: 801629 - protein, 25 aa, Mycobacterium
DIDTDVIVSWLPCFHDMGMTGYLTV

SEQ ID NO: 801630 - protein, 17 aa, Mycobacterium
DIDVLLVDDIQFIEGKE

SEQ ID NO: 801631 - protein, 26 aa, Mycobacterium
DIDVLVLATGFRLFYDPQIYRDTPVT

SEQ ID NO: 801632 - protein, 17 aa, Mycobacterium
DIDVRFGLGWGAVTVLD

SEQ ID NO: 801633 - protein, 32 aa, Mycobacterium
DIDWDNTYFGVKSLILERFATVHSLALQQTLY

SEQ ID NO: 801634 - protein, 23 aa, Mycobacterium
DIDYRMFQTIVFRTDLIVDPEVL

SEQ ID NO: 801635 - protein, 24 aa, Mycobacterium
DIEADAWIIHSSPKAEWLDRYSEA

SEQ ID NO: 801636 - protein, 23 aa, Mycobacterium
DIEALGYGAIWAGGSPPAELDWI

SEQ ID NO: 801637 - protein, 17 aa, Mycobacterium
DIEAVRRAVPAATLKVI

SEQ ID NO: 801638 - protein, 24 aa, Mycobacterium
DIEDLEFAVRLGVDLVALSFVRSP

SEQ ID NO: 801639 - protein, 26 aa, Mycobacterium
DIEDLLAKLAIPIPTVTTPQMFMYRV

SEQ ID NO: 801640 - protein, 19 aa, Mycobacterium
DIEDLTFALDLGVDLVALS

SEQ ID NO: 801641 - protein, 19 aa, Mycobacterium
DIEGLGYEAATALLAAQVI

SEQ ID NO: 801642 - protein, 23 aa, Mycobacterium
DIEHMPLRPEHLLDTDYLAQRAA

SEQ ID NO: 801643 - protein, 19 aa, Mycobacterium
DIELLWKLIEQNPGLELTV

SEQ ID NO: 801644 - protein, 20 aa, Mycobacterium
DIELWERMFTTHVMGPVALT

SEQ ID NO: 801645 - protein, 20 aa, Mycobacterium
DIEMAYYQRLLTDDESHTLA

SEQ ID NO: 801646 - protein, 23 aa, Mycobacterium
DIEPIMQLLVDAEMKMFAGLSTP

SEQ ID NO: 801647 - protein, 24 aa, Mycobacterium
DIERPVSFTLLQTGGAPTLYREQL

SEQ ID NO: 801648 - protein, 19 aa, Mycobacterium
DIERQEAIASLGWRLVRVS

SEQ ID NO: 801649 - protein, 32 aa, Mycobacterium
DIERSHLLTRLDSLLIRPVCGGKPIVGPELST

SEQ ID NO: 801650 - protein, 19 aa, Mycobacterium
DIERTIALNYYAPLRLIRG

SEQ ID NO: 801651 - protein, 29 aa, Mycobacterium
DIERTMTLNYYSPLRLIRGFAPGMRERGA

SEQ ID NO: 801652 - protein, 26 aa, Mycobacterium
DIETSEWLWVLDPIDGTSNFVHGLPL

SEQ ID NO: 801653 - protein, 17 aa, Mycobacterium
DIEVPLARHAISSVGAL

SEQ ID NO: 801654 - protein, 35 aa, Mycobacterium
DIEVTILSYVRWPDSVRPLLPPVRPARYMPDRHRI

SEQ ID NO: 801655 - protein, 30 aa, Mycobacterium
DIEWVIADGAVWLVQARPITTLGSAGSTAG

SEQ ID NO: 801656 - protein, 19 aa, Mycobacterium
DIEYKFGFVGNPWGELEGV

SEQ ID NO: 801657 - protein, 19 aa, Mycobacterium
DIFTDPFTFDIARDPNKHL

SEQ ID NO: 801658 - protein, 17 aa, Mycobacterium
DIFVFEGTVIEAPNGTG

SEQ ID NO: 801659 - protein, 20 aa, Mycobacterium
DIFWFSFFHEAAHVLLHGKK

SEQ ID NO: 801660 - protein, 17 aa, Mycobacterium
DIFYERFPEELKGAAPR

SEQ ID NO: 801661 - protein, 26 aa, Mycobacterium
DIGAFTPIFVMSRITGWTAHIIEQTA

SEQ ID NO: 801662 - protein, 26 aa, Mycobacterium
DIGAFVVWLRLPTALRQGGIAVLPSV

SEQ ID NO: 801663 - protein, 24 aa, Mycobacterium
DIGAPPQFMDFRFTIHDRWHGEFR

SEQ ID NO: 801664 - protein, 22 aa, Mycobacterium
DIGATPLLRHRVELGTGSVTDD

SEQ ID NO: 801665 - protein, 22 aa, Mycobacterium
DIGFHEMLLLDDQTAAGAVALV

SEQ ID NO: 801666 - protein, 17 aa, Mycobacterium
DIGFRMPTLWFADGHST

SEQ ID NO: 801667 - protein, 17 aa, Mycobacterium
DIGGACVLLVDGLGAEL

SEQ ID NO: 801668 - protein, 19 aa, Mycobacterium
DIGGEGLCLSLSGGTNCCG

SEQ ID NO: 801669 - protein, 25 aa, Mycobacterium
DIGGVRMFFIYDPDGTPIELLELPA

SEQ ID NO: 801670 - protein, 19 aa, Mycobacterium
DIGLIHLPSADKRLRHRVV

SEQ ID NO: 801671 - protein, 38 aa, Mycobacterium
DIGPARMYIFTSFHQSPLPLALLARMAGVPWVGAICVD

SEQ ID NO: 801672 - protein, 19 aa, Mycobacterium
DIGPLNRYQFAGGTVLSVN

SEQ ID NO: 801673 - protein, 35 aa, Mycobacterium
DIGRLRWQFDRIARGVPLAAPWDARRARELDGLSL

SEQ ID NO: 801674 - protein, 17 aa, Mycobacterium
DIGVAARGGSDPIVAVA

SEQ ID NO: 801675 - protein, 19 aa, Mycobacterium
DIGVPYRQYRRIQQGITGF

SEQ ID NO: 801676 - protein, 18 aa, Mycobacterium
DIHALLPESARRAYDVHP

SEQ ID NO: 801677 - protein, 23 aa, Mycobacterium
DIHQAIPVIRAFSHFALLANVAE

SEQ ID NO: 801678 - protein, 23 aa, Mycobacterium
DIHRAIPVIRAFSHFALLANVAE

SEQ ID NO: 801679 - protein, 24 aa, Mycobacterium
DIHRALPVIRAFSHFALLANVAED

SEQ ID NO: 801680 - protein, 18 aa, Mycobacterium
DIHRPARPHLTFSVGAHF

SEQ ID NO: 801681 - protein, 18 aa, Mycobacterium
DIIAAPAWDALRKNHDQI

SEQ ID NO: 801682 - protein, 30 aa, Mycobacterium
DIIAELASMMPMRVIGMLLGIPESDQIGVR

SEQ ID NO: 801683 - protein, 29 aa, Mycobacterium
DIIAELASMMPMRVIGMLLGIPESEQVSV

SEQ ID NO: 801684 - protein, 17 aa, Mycobacterium
DIILNLKSLVVSSEEDE

SEQ ID NO: 801685 - protein, 17 aa, Mycobacterium
DIILYGATGFVGKLTAQ

SEQ ID NO: 801686 - protein, 19 aa, Mycobacterium
DIITITQYLRPSARHHPVE

SEQ ID NO: 801687 - protein, 23 aa, Mycobacterium
DIKLDPLPPDRRPTDLPGLSGLG

SEQ ID NO: 801688 - protein, 25 aa, Mycobacterium
DIKPEHLILIGQIAQEFGLYTKITG

SEQ ID NO: 801689 - protein, 20 aa, Mycobacterium
DIKRFRIFENWEGDAATACE

SEQ ID NO: 801690 - protein, 26 aa, Mycobacterium
DIKRPVWPMIVLRTPKGWTGPKVVDG

SEQ ID NO: 801691 - protein, 25 aa, Mycobacterium
DIKRSAIPILCREALEAAAWDAYAS

SEQ ID NO: 801692 - protein, 30 aa, Mycobacterium
DIKTLVPTFGIFKPTFIVSVPRIFEKVYNT

SEQ ID NO: 801693 - protein, 20 aa, Mycobacterium
DILAFERQWWKFAGAKEEAI

SEQ ID NO: 801694 - protein, 19 aa, Mycobacterium
DILAFERQWWKFAGVKEEA

SEQ ID NO: 801695 - protein, 19 aa, Mycobacterium
DILAFERQWWKYAGSKEDA

SEQ ID NO: 801696 - protein, 20 aa, Mycobacterium
DILAFERQWWKYAGSKEDAI

SEQ ID NO: 801697 - protein, 17 aa, Mycobacterium
DILAVQWHPEDRHATAD

SEQ ID NO: 801698 - protein, 17 aa, Mycobacterium
DILAWRQRTLTGRRWFD

SEQ ID NO: 801699 - protein, 26 aa, Mycobacterium
DILDAMMVFFDLWISAGMTPRVDPLD

SEQ ID NO: 801700 - protein, 21 aa, Mycobacterium
DILDDLVLLGALEDKVVFSSF

SEQ ID NO: 801701 - protein, 30 aa, Mycobacterium
DILGYPAEGLPYRWPHPWLVDQQGARQQQA

SEQ ID NO: 801702 - protein, 21 aa, Mycobacterium
DILHEPGMTLYQSKNGLFLDT

SEQ ID NO: 801703 - protein, 18 aa, Mycobacterium
DILIHNAGNVRRGSLREL

SEQ ID NO: 801704 - protein, 18 aa, Mycobacterium
DILLRRPPRTRSGGPLPH

SEQ ID NO: 801705 - protein, 30 aa, Mycobacterium
DILRSRRALLLRLLAEHLPDWQPVPGKGGM

SEQ ID NO: 801706 - protein, 25 aa, Mycobacterium
DILSATLVYQLALTGAARMIVTARG

SEQ ID NO: 801707 - protein, 22 aa, Mycobacterium
DILSCFAVRLGFDREFFARAHD

SEQ ID NO: 801708 - protein, 27 aa, Mycobacterium
DILSRTRAPVLFAMGRFLGADRVAGLD

SEQ ID NO: 801709 - protein, 17 aa, Mycobacterium
DILVANAGVLGWGRLWE

SEQ ID NO: 801710 - protein, 17 aa, Mycobacterium
DILVPPGFTRTLGAPPA

SEQ ID NO: 801711 - protein, 18 aa, Mycobacterium
DILYIQDVVRRIYVDPAI

SEQ ID NO: 801712 - protein, 28 aa, Mycobacterium
DIMAIERANDLWLSAPRPLLATAEADDL

SEQ ID NO: 801713 - protein, 22 aa, Mycobacterium
DIMARVVGFHLNRGVLAAARRV

SEQ ID NO: 801714 - protein, 19 aa, Mycobacterium
DIMLLLCGVGFAVRHTPNR

SEQ ID NO: 801715 - protein, 18 aa, Mycobacterium
DIMRKDIYQVQWTEGGHG

SEQ ID NO: 801716 - protein, 28 aa, Mycobacterium
DINGLLRVAMLYNDFWLAETAKERAEIQ

SEQ ID NO: 801717 - protein, 30 aa, Mycobacterium
DINHLELIHDWFGRPLWEMRPADVDVYFGK

SEQ ID NO: 801718 - protein, 28 aa, Mycobacterium
DINIMPQVWAMRYTLERAMRGQDTIAAT

SEQ ID NO: 801719 - protein, 17 aa, Mycobacterium
DINLFLDGIEQIVDGDP

SEQ ID NO: 801720 - protein, 34 aa, Mycobacterium
DINLRGLMYVTKAALPHLLVAARNSPRSVADVVN

SEQ ID NO: 801721 - protein, 21 aa, Mycobacterium
DINPYLGYAALLAAGLEGIER

SEQ ID NO: 801722 - protein, 23 aa, Mycobacterium
DINSLYKVGLGSVRFLMSVGDLV

SEQ ID NO: 801723 - protein, 34 aa, Mycobacterium
DINTPRVRIPEFPLNVYVFTPIHVGDVGPIVLPP

SEQ ID NO: 801724 - protein, 22 aa, Mycobacterium
DINVRGTFLLTKAALPHLRTSV

SEQ ID NO: 801725 - protein, 21 aa, Mycobacterium
DIPAWARRWQRLLFDSGWLLP

SEQ ID NO: 801726 - protein, 18 aa, Mycobacterium
DIPDPLELLSFVAAATTT

SEQ ID NO: 801727 - protein, 32 aa, Mycobacterium
DIPEVAELWRRGSVIGSWLLDLTAIALHESPE

SEQ ID NO: 801728 - protein, 17 aa, Mycobacterium
DIPGACDSTLLIAERVQ

SEQ ID NO: 801729 - protein, 19 aa, Mycobacterium
DIPGALDFRARVAGWAGEA

SEQ ID NO: 801730 - protein, 18 aa, Mycobacterium
DIPGLVLIPAAADKIEIP

SEQ ID NO: 801731 - protein, 19 aa, Mycobacterium
DIPKTKMCPAPTAPIPILV

SEQ ID NO: 801732 - protein, 24 aa, Mycobacterium
DIPKTKMSPAPTAPIPILVGGHAD

SEQ ID NO: 801733 - protein, 21 aa, Mycobacterium
DIPLAIDHFRYFAGAIRAQEG

SEQ ID NO: 801734 - protein, 27 aa, Mycobacterium
DIPLITDDAWGLDYSFCSRLPPSALEC

SEQ ID NO: 801735 - protein, 20 aa, Mycobacterium
DIPLMLTTPHFLVEGAIIAA

SEQ ID NO: 801736 - protein, 18 aa, Mycobacterium
DIPLREPLVPDPEPRGAV

SEQ ID NO: 801737 - protein, 20 aa, Mycobacterium
DIPRELRLAVRESLLALLSE

SEQ ID NO: 801738 - protein, 20 aa, Mycobacterium
DIPRLPSGKVLRRVLKELHG

SEQ ID NO: 801739 - protein, 20 aa, Mycobacterium
DIPSLDMHPSMRLRIEHYLQ

SEQ ID NO: 801740 - protein, 19 aa, Mycobacterium
DIPTFIYSFSYDQKTTWSK

SEQ ID NO: 801741 - protein, 17 aa, Mycobacterium
DIPTVAMAKWWTTERAM

SEQ ID NO: 801742 - protein, 34 aa, Mycobacterium
DIQSHLYSFSFAPNKFWTRTYARQPEILAYLESV

SEQ ID NO: 801743 - protein, 30 aa, Mycobacterium
DIQTAFIYDHFTPFVFVQLEELGFCGRGEA

SEQ ID NO: 801744 - protein, 34 aa, Mycobacterium
DIQTAILYDHFTPFTLIQLEELGFCGKGEAKDFI

SEQ ID NO: 801745 - protein, 17 aa, Mycobacterium
DIQTNVIPGDDQPAGPQ

SEQ ID NO: 801746 - protein, 20 aa, Mycobacterium
DIRAFNPKIIIARGTGLGVR

SEQ ID NO: 801747 - protein, 21 aa, Mycobacterium
DIRAIPTLMAFKKGTPVLNRA

SEQ ID NO: 801748 - protein, 18 aa, Mycobacterium
DIRAVRRIDSLYLDGDLV

SEQ ID NO: 801749 - protein, 24 aa, Mycobacterium
DIRAWVGHYFDYMDHHGAFVLASA

SEQ ID NO: 801750 - protein, 21 aa, Mycobacterium
DIRESIHLRALGRQNPLDEFH

SEQ ID NO: 801751 - protein, 25 aa, Mycobacterium
DIRKAVPNWLVWTHGCPGGETSAQV

SEQ ID NO: 801752 - protein, 17 aa, Mycobacterium
DIRLFGKPESFVKRRMG

SEQ ID NO: 801753 - protein, 25 aa, Mycobacterium
DIRRMPWRVHVFTPVTGIPGVRGAG

SEQ ID NO: 801754 - protein, 17 aa, Mycobacterium
DIRRVFLGSRSTKIIRE

SEQ ID NO: 801755 - protein, 17 aa, Mycobacterium
DIRVAAELALPHRRRRD

SEQ ID NO: 801756 - protein, 18 aa, Mycobacterium
DIRWALVPSRAVSRLLEI

SEQ ID NO: 801757 - protein, 23 aa, Mycobacterium
DIRWFDIEPCYVYHPLNAYSELR

SEQ ID NO: 801758 - protein, 17 aa, Mycobacterium
DIRYGARNAGYHGGAAP

SEQ ID NO: 801759 - protein, 23 aa, Mycobacterium
DIRYYWDRHMSASFMVDPLGLEL

SEQ ID NO: 801760 - protein, 23 aa, Mycobacterium
DISFDHWQRVVNVNLHGVFHVVQ

SEQ ID NO: 801761 - protein, 21 aa, Mycobacterium
DISFNWMPLEHVGGIVMSHLQ

SEQ ID NO: 801762 - protein, 19 aa, Mycobacterium
DISGLVRAIGFREPPKRLS

SEQ ID NO: 801763 - protein, 26 aa, Mycobacterium
DISPKWPPMTKPVIGAINGAAVTGGL

SEQ ID NO: 801764 - protein, 18 aa, Mycobacterium
DISPLEAWKLLSDNPNAV

SEQ ID NO: 801765 - protein, 17 aa, Mycobacterium
DISPLQARCGWAIGWKK

SEQ ID NO: 801766 - protein, 18 aa, Mycobacterium
DISPRWPAMAKPVIGAIN

SEQ ID NO: 801767 - protein, 23 aa, Mycobacterium
DISRWREVAAVHAEFFGAIRPAA

SEQ ID NO: 801768 - protein, 21 aa, Mycobacterium
DISSIPWTRFTGFTLTIAPGW

SEQ ID NO: 801769 - protein, 20 aa, Mycobacterium
DISVESLIIESFFPADPATG

SEQ ID NO: 801770 - protein, 24 aa, Mycobacterium
DITAIDTHWIWQDGQRITKQPFEI

SEQ ID NO: 801771 - protein, 24 aa, Mycobacterium
DITAQIFPRPIGLVLGLELSGNPF

SEQ ID NO: 801772 - protein, 17 aa, Mycobacterium
DITFPERGVVVVGGANE

SEQ ID NO: 801773 - protein, 24 aa, Mycobacterium
DITGFGLLGHLHKLARASGVTAVI

SEQ ID NO: 801774 - protein, 20 aa, Mycobacterium
DITLAVDHFRYFAGAIRAQE

SEQ ID NO: 801775 - protein, 25 aa, Mycobacterium
DITPEHLILIGQIAKDFGLYTKITG

SEQ ID NO: 801776 - protein, 26 aa, Mycobacterium
DITSNTYYDWFLDHDFIAFYGTAICT

SEQ ID NO: 801777 - protein, 17 aa, Mycobacterium
DITVCILDRPRHGELIQ

SEQ ID NO: 801778 - protein, 33 aa, Mycobacterium
DITVNLEGLWLLQAMLGIPQLAPELRGRPYGQP

SEQ ID NO: 801779 - protein, 21 aa, Mycobacterium
DITYDLRLAGPGNKYSWTINE

SEQ ID NO: 801780 - protein, 27 aa, Mycobacterium
DIVADFALPIPSLVICELLGVPYEDRT

SEQ ID NO: 801781 - protein, 17 aa, Mycobacterium
DIVAIRFALEPPAAGRA

SEQ ID NO: 801782 - protein, 20 aa, Mycobacterium
DIVEILLAAAPSTRWMRDAT

SEQ ID NO: 801783 - protein, 28 aa, Mycobacterium
DIVELTPEARARYFQAWTATQAEFVDDP

SEQ ID NO: 801784 - protein, 17 aa, Mycobacterium
DIVGFTSPSGNIGCMID

SEQ ID NO: 801785 - protein, 20 aa, Mycobacterium
DIVGIGFKAVHVSAIKFPNL

SEQ ID NO: 801786 - protein, 17 aa, Mycobacterium
DIVGLYLDPPERAIVLC

SEQ ID NO: 801787 - protein, 18 aa, Mycobacterium
DIVHAHDWLVAHPAVALA

SEQ ID NO: 801788 - protein, 20 aa, Mycobacterium
DIVINPVRYSGQPTFVGRRV

SEQ ID NO: 801789 - protein, 21 aa, Mycobacterium
DIVIREIRSITWCRRRTIQVA

SEQ ID NO: 801790 - protein, 30 aa, Mycobacterium
DIVKDWLADLEYLVAAILSELNRIIFAVEQ

SEQ ID NO: 801791 - protein, 34 aa, Mycobacterium
DIVKHFFVCSTHDWILFFTTKGRVYRAKAYDLPE

SEQ ID NO: 801792 - protein, 17 aa, Mycobacterium
DIVLDGVRLPATALLGA

SEQ ID NO: 801793 - protein, 18 aa, Mycobacterium
DIVLLDEPTNDLDLDGLD

SEQ ID NO: 801794 - protein, 17 aa, Mycobacterium
DIVLRAAAKLPGVRIVV

SEQ ID NO: 801795 - protein, 22 aa, Mycobacterium
DIVMNRTFWVGTFPGLTKPMLD

SEQ ID NO: 801796 - protein, 20 aa, Mycobacterium
DIVMVKPAMAYLDVLRQVAD

SEQ ID NO: 801797 - protein, 19 aa, Mycobacterium
DIVMVRMPGFGLDGPWRDN

SEQ ID NO: 801798 - protein, 17 aa, Mycobacterium
DIVNAYNLILQTPSLRG

SEQ ID NO: 801799 - protein, 20 aa, Mycobacterium
DIVPILDRTVYWLTTGYEAA

SEQ ID NO: 801800 - protein, 19 aa, Mycobacterium
DIVRMHGAFELFGKVRDHV

SEQ ID NO: 801801 - protein, 19 aa, Mycobacterium
DIVSGVGYTALLVAGWRAL

SEQ ID NO: 801802 - protein, 25 aa, Mycobacterium
DIVSSVGYTALLVAGWRALHAVGPQ

SEQ ID NO: 801803 - protein, 19 aa, Mycobacterium
DIVSWARYPLGVVHEFVKR

SEQ ID NO: 801804 - protein, 23 aa, Mycobacterium
DIVTAAWLHDIGYSPDLVDTGFH

SEQ ID NO: 801805 - protein, 26 aa, Mycobacterium
DIVTELFKPLPSMVVAHYLGVPEADR

SEQ ID NO: 801806 - protein, 23 aa, Mycobacterium
DIVTRLWESFPAAALLGDQQRAV

SEQ ID NO: 801807 - protein, 33 aa, Mycobacterium
DIVVAAGFMKILGAGFLSRFPGRVLNSHPALLP

SEQ ID NO: 801808 - protein, 18 aa, Mycobacterium
DIVVDPPEHWSEADRFGM

SEQ ID NO: 801809 - protein, 19 aa, Mycobacterium
DIVVHLRRAGDRDGSTPPH

SEQ ID NO: 801810 - protein, 20 aa, Mycobacterium
DIVVLLQALLDHHGTLRLHA

SEQ ID NO: 801811 - protein, 21 aa, Mycobacterium
DIVVVHTGWWTRFLATRDGGE

SEQ ID NO: 801812 - protein, 21 aa, Mycobacterium
DIVWADAVIFGSPTRFGSPAA

SEQ ID NO: 801813 - protein, 19 aa, Mycobacterium
DIVWADAVVFGSPTRFGSP

SEQ ID NO: 801814 - protein, 22 aa, Mycobacterium
DIVYVHGNVISSRRGELSVLAD

SEQ ID NO: 801815 - protein, 22 aa, Mycobacterium
DIVYVHGTVISSRRGELSVLAD

SEQ ID NO: 801816 - protein, 24 aa, Mycobacterium
DIVYYCEDLPVTVYAVLINRGRGL

SEQ ID NO: 801817 - protein, 25 aa, Mycobacterium
DIWGRRRLAYEIAKHAEGIYAVIDV

SEQ ID NO: 801818 - protein, 18 aa, Mycobacterium
DIWHSFLDIESFRKKSQL

SEQ ID NO: 801819 - protein, 19 aa, Mycobacterium
DIWHTFLSVEGFTEATARL

SEQ ID NO: 801820 - protein, 17 aa, Mycobacterium
DIWIPERDPGNTRLVMG

SEQ ID NO: 801821 - protein, 22 aa, Mycobacterium
DIYAWVLEYRSQLSTRLSELDL

SEQ ID NO: 801822 - protein, 27 aa, Mycobacterium
DIYKVQSMLPPRFQPRASWNANLSILN

SEQ ID NO: 801823 - protein, 20 aa, Mycobacterium
DIYLKLLFEGDQLPGYGWVF

SEQ ID NO: 801824 - protein, 19 aa, Mycobacterium
DIYVLDFPGYGLSDKPRQP

SEQ ID NO: 801825 - protein, 34 aa, Mycobacterium
DKAALDACLDRYARLFAALVPWDKQTDIAVMPAD

SEQ ID NO: 801826 - protein, 35 aa, Mycobacterium
DKAASFIRFCDAYNLPLVFVVDTPGALPGVSEEKN

SEQ ID NO: 801827 - protein, 34 aa, Mycobacterium
DKAASFIRFCDSYNLPLVFVVDTPGAMPGVAEEK

SEQ ID NO: 801828 - protein, 19 aa, Mycobacterium
DKADKFTRDRLGFSVLHVV

SEQ ID NO: 801829 - protein, 23 aa, Mycobacterium
DKAEWLIDLLGKLGTEDDAYHAV

SEQ ID NO: 801830 - protein, 21 aa, Mycobacterium
DKAFDEGWVRPLPPEKLTGKK

SEQ ID NO: 801831 - protein, 26 aa, Mycobacterium
DKAGDALFKQLLLEKLRYSNSSQRVN

SEQ ID NO: 801832 - protein, 25 aa, Mycobacterium
DKAIAAATPMVTWLATASAQAKIRA

SEQ ID NO: 801833 - protein, 17 aa, Mycobacterium
DKAIDLLIACHLAGCGY

SEQ ID NO: 801834 - protein, 17 aa, Mycobacterium
DKAIWNMTADDFDLVMR

SEQ ID NO: 801835 - protein, 29 aa, Mycobacterium
DKAKQQPLWRVLVALSIRHVGPTAARALA

SEQ ID NO: 801836 - protein, 25 aa, Mycobacterium
DKAQAIPLPRHHLDAVAVIESRRSV

SEQ ID NO: 801837 - protein, 22 aa, Mycobacterium
DKARALRVIDWFLSATTERRYE

SEQ ID NO: 801838 - protein, 25 aa, Mycobacterium
DKARAMRVIEWFIGATTQRRYEILD

SEQ ID NO: 801839 - protein, 17 aa, Mycobacterium
DKARDRLGFKPVVSYHE

SEQ ID NO: 801840 - protein, 18 aa, Mycobacterium
DKDDCAAIGLVKFDLLGL

SEQ ID NO: 801841 - protein, 32 aa, Mycobacterium
DKDDCAAIGLVKFDMLGLGMLSALHYAIDLVA

SEQ ID NO: 801842 - protein, 28 aa, Mycobacterium
DKDDLRGRFRWWGLYTQREQGYDGTWTG

SEQ ID NO: 801843 - protein, 24 aa, Mycobacterium
DKDEHIERLAALGRISLVLISHRH

SEQ ID NO: 801844 - protein, 22 aa, Mycobacterium
DKDGQPFPPWTDAESAFEAWKK

SEQ ID NO: 801845 - protein, 32 aa, Mycobacterium
DKDPELIIGRYIPNLVPRPFTLDRDFIQEIRD

SEQ ID NO: 801846 - protein, 26 aa, Mycobacterium
DKDPNWFRYHHLFAEFLRHRLERDHP

SEQ ID NO: 801847 - protein, 20 aa, Mycobacterium
DKDRLIPVAGSRQLMECIGS

SEQ ID NO: 801848 - protein, 28 aa, Mycobacterium
DKDVDDLLWQVPYLPIDPKDVGRTYEAV

SEQ ID NO: 801849 - protein, 24 aa, Mycobacterium
DKEFTKKLWSAAGLPIGPHAVLRP

SEQ ID NO: 801850 - protein, 20 aa, Mycobacterium
DKELAFPNAILALFHYPDKS

SEQ ID NO: 801851 - protein, 20 aa, Mycobacterium
DKELAFPNAVLALFHYPDKA

SEQ ID NO: 801852 - protein, 20 aa, Mycobacterium
DKELAFPNAVLALFHYPDKG

SEQ ID NO: 801853 - protein, 26 aa, Mycobacterium
DKESDPRYLPFQSLRGRDFTSMVSVP

SEQ ID NO: 801854 - protein, 23 aa, Mycobacterium
DKFAGRGLANRLIAAALADTRAS

SEQ ID NO: 801855 - protein, 28 aa, Mycobacterium
DKFFSRNCRTWLGIALMMQGHLAEAKEV

SEQ ID NO: 801856 - protein, 20 aa, Mycobacterium
DKFLKNITHHYWKDNGQGVG

SEQ ID NO: 801857 - protein, 17 aa, Mycobacterium
DKFPRMVDYVLPTGVRI

SEQ ID NO: 801858 - protein, 23 aa, Mycobacterium
DKGELVMFLTTRMPPGAPRAKPA

SEQ ID NO: 801859 - protein, 22 aa, Mycobacterium
DKGEMVMFLMTRMPPDAPHNKP

SEQ ID NO: 801860 - protein, 24 aa, Mycobacterium
DKGFGGRTLIKDLSFTLPRNGIVG

SEQ ID NO: 801861 - protein, 23 aa, Mycobacterium
DKGFNGRTLIKDLSFTLPRNGIV

SEQ ID NO: 801862 - protein, 25 aa, Mycobacterium
DKGFYHAWRMLAPADHKLSRRVRAV

SEQ ID NO: 801863 - protein, 17 aa, Mycobacterium
DKGHYLLAATFGNVHGV

SEQ ID NO: 801864 - protein, 25 aa, Mycobacterium
DKGIAVIFISHSMPHVLEVCDRIQV

SEQ ID NO: 801865 - protein, 25 aa, Mycobacterium
DKGKTLRWVIEHLRSRTAPPATSLV

SEQ ID NO: 801866 - protein, 24 aa, Mycobacterium
DKGLRRWRAVARSAARQSRRPHIP

SEQ ID NO: 801867 - protein, 23 aa, Mycobacterium
DKGLRRWRSVARSAARQSRRAYI

SEQ ID NO: 801868 - protein, 19 aa, Mycobacterium
DKGLWAPHLGPELGGQGFG

SEQ ID NO: 801869 - protein, 31 aa, Mycobacterium
DKGNDIITLAKWLRVNMIALALTEGSEEAYE

SEQ ID NO: 801870 - protein, 24 aa, Mycobacterium
DKGPWAVFDLSLGRAMYSGFTMGG

SEQ ID NO: 801871 - protein, 25 aa, Mycobacterium
DKGPWGAFDMSLGKAMYAGFTLGGL

SEQ ID NO: 801872 - protein, 28 aa, Mycobacterium
DKGRLTLPAKFRDALAGGLMVTKSQDHS

SEQ ID NO: 801873 - protein, 20 aa, Mycobacterium
DKGVAPLGCLRPVNPPVGVG

SEQ ID NO: 801874 - protein, 22 aa, Mycobacterium
DKHIFETSLYFVPPRNARERLA

SEQ ID NO: 801875 - protein, 23 aa, Mycobacterium
DKHWNAFIEAVRPPWASELYSTL

SEQ ID NO: 801876 - protein, 29 aa, Mycobacterium
DKIDGPYYFFGVFAKLAKLPSFTPMMLPR

SEQ ID NO: 801877 - protein, 22 aa, Mycobacterium
DKIDGVVALIMALSRAIAAREA

SEQ ID NO: 801878 - protein, 21 aa, Mycobacterium
DKIDQRLTVLGIDNTITYKAG

SEQ ID NO: 801879 - protein, 22 aa, Mycobacterium
DKIGADFYFSVRTMEERLGANV

SEQ ID NO: 801880 - protein, 19 aa, Mycobacterium
DKIGTSVPFALVLGADPIT

SEQ ID NO: 801881 - protein, 24 aa, Mycobacterium
DKISQLKPVFRPNGTITAGNACPL

SEQ ID NO: 801882 - protein, 27 aa, Mycobacterium
DKITLSVPFHRVPPNSFTAAELRYLEA

SEQ ID NO: 801883 - protein, 22 aa, Mycobacterium
DKITSFKVLVRPLKAIQVVVPK

SEQ ID NO: 801884 - protein, 26 aa, Mycobacterium
DKKDNFTGYKLLIADVIGGTLKAVPR

SEQ ID NO: 801885 - protein, 25 aa, Mycobacterium
DKKIRLAPQYLLDDLPRLAARLERP

SEQ ID NO: 801886 - protein, 25 aa, Mycobacterium
DKKIRLAPQYLLDDLPRLAARMERP

SEQ ID NO: 801887 - protein, 21 aa, Mycobacterium
DKKLFWIENSTRRWDGYNYFP

SEQ ID NO: 801888 - protein, 24 aa, Mycobacterium
DKKYTPQEISARVLMKLKRDAESY

SEQ ID NO: 801889 - protein, 19 aa, Mycobacterium
DKLAKWSSPLLRPGGRMLA

SEQ ID NO: 801890 - protein, 20 aa, Mycobacterium
DKLALLLEFANELPPLPSDL

SEQ ID NO: 801891 - protein, 17 aa, Mycobacterium
DKLFQLARKVPVTTIIV

SEQ ID NO: 801892 - protein, 17 aa, Mycobacterium
DKLLLLAGQDESPAPDA

SEQ ID NO: 801893 - protein, 25 aa, Mycobacterium
DKLLRTSMELGGNAPFIVFDDADVD

SEQ ID NO: 801894 - protein, 25 aa, Mycobacterium
DKLLRTSMELGGNAPFVVFDDADVD

SEQ ID NO: 801895 - protein, 23 aa, Mycobacterium
DKLPDRSLIAFLPVNVRPKGDEG

SEQ ID NO: 801896 - protein, 20 aa, Mycobacterium
DKLQLLLEFANELPPLPAHL

SEQ ID NO: 801897 - protein, 24 aa, Mycobacterium
DKLQLPVIALHRKIRFVDVTEQVH

SEQ ID NO: 801898 - protein, 23 aa, Mycobacterium
DKLQSKLAYRHSGYPGGLHSRTT

SEQ ID NO: 801899 - protein, 28 aa, Mycobacterium
DKLRHKMAYRHSGYPGGLRKRTIGELMQ

SEQ ID NO: 801900 - protein, 17 aa, Mycobacterium
DKLRQHLEECPACLRHY

SEQ ID NO: 801901 - protein, 20 aa, Mycobacterium
DKLRRFVSFVNAPDQPDSTI

SEQ ID NO: 801902 - protein, 20 aa, Mycobacterium
DKLRRTLGRLPWTMNEKRSP

SEQ ID NO: 801903 - protein, 20 aa, Mycobacterium
DKLSRFPCGIIPFGDAIASF

SEQ ID NO: 801904 - protein, 25 aa, Mycobacterium
DKLTRWSVPFLRDGGRMLPIKGERA

SEQ ID NO: 801905 - protein, 26 aa, Mycobacterium
DKLWGTTVFQCPFCHAWELRDQRLAT

SEQ ID NO: 801906 - protein, 34 aa, Mycobacterium
DKLWSSLRRIPLAELRRTGLLDKLLLLAGEPESV

SEQ ID NO: 801907 - protein, 24 aa, Mycobacterium
DKMDPQQRLLLEVAWEALEHAGIP

SEQ ID NO: 801908 - protein, 27 aa, Mycobacterium
DKMGNVTAWRFLSPPSAFLEGLTVGAD

SEQ ID NO: 801909 - protein, 17 aa, Mycobacterium
DKMLAACRPGAPTRDLL

SEQ ID NO: 801910 - protein, 21 aa, Mycobacterium
DKNEHVFYSLRTAQQVANNVA

SEQ ID NO: 801911 - protein, 22 aa, Mycobacterium
DKNWTRRVTDVRNWFVFSASER

SEQ ID NO: 801912 - protein, 22 aa, Mycobacterium
DKPAYSIVLPPPNVTGSLHMGH

SEQ ID NO: 801913 - protein, 35 aa, Mycobacterium
DKPGVGHPILYVAQAWDWIFPLGDNPDYEPDPSGS

SEQ ID NO: 801914 - protein, 29 aa, Mycobacterium
DKPLKYPVMFRAVDVVLLNKIDLVAHLDA

SEQ ID NO: 801915 - protein, 33 aa, Mycobacterium
DKPLKYPVMFRSVDVLLLNKIDLVPHLDVDVDT

SEQ ID NO: 801916 - protein, 26 aa, Mycobacterium
DKPMKGMLTGPVTILAWSFVRDDQPL

SEQ ID NO: 801917 - protein, 30 aa, Mycobacterium
DKPQSPDEIMLLAPNVWPRNLVRGADGVVT

SEQ ID NO: 801918 - protein, 23 aa, Mycobacterium
DKPTYALVMPYDGRRFRLVEQFR

SEQ ID NO: 801919 - protein, 27 aa, Mycobacterium
DKPVHFVQMWVIPDRAGLTPGYEQREI

SEQ ID NO: 801920 - protein, 19 aa, Mycobacterium
DKPWSGFNYYKGDYQSTVA

SEQ ID NO: 801921 - protein, 23 aa, Mycobacterium
DKQALRLLGSVALARAARGEDDV

SEQ ID NO: 801922 - protein, 22 aa, Mycobacterium
DKRARLLAEGYDPYPVAIERTH

SEQ ID NO: 801923 - protein, 28 aa, Mycobacterium
DKRGPLTVPIWYQYSPGGEPWVLTGNGS

SEQ ID NO: 801924 - protein, 24 aa, Mycobacterium
DKRMPRIAGPCSVIIFGVTGDLAR

SEQ ID NO: 801925 - protein, 25 aa, Mycobacterium
DKRNRPVLVFVLDAGMPGLTQGKPF

SEQ ID NO: 801926 - protein, 21 aa, Mycobacterium
DKRRSILTPVITTYRTDADLR

SEQ ID NO: 801927 - protein, 23 aa, Mycobacterium
DKRSNTLLLERLAAERPADAVLS

SEQ ID NO: 801928 - protein, 21 aa, Mycobacterium
DKRVALVFSAYPTKHARIGNA

SEQ ID NO: 801929 - protein, 28 aa, Mycobacterium
DKSDLRGRFRWWGLYTQREQGYDGTFTG

SEQ ID NO: 801930 - protein, 21 aa, Mycobacterium
DKSFYEGKIAAASFFAKNMLP

SEQ ID NO: 801931 - protein, 26 aa, Mycobacterium
DKSRLRLGLFGAKFPKEPLLRALDTH

SEQ ID NO: 801932 - protein, 24 aa, Mycobacterium
DKSRPLWEMYLVEGLSKNRLALYT

SEQ ID NO: 801933 - protein, 27 aa, Mycobacterium
DKSRWGYKFRFGVFRIDDHDLDVIRSA

SEQ ID NO: 801934 - protein, 17 aa, Mycobacterium
DKSYPIWDVLHESMGFG

SEQ ID NO: 801935 - protein, 33 aa, Mycobacterium
DKTILQAIELWKIVDRPNLLIKIPATEAGVPAI

SEQ ID NO: 801936 - protein, 33 aa, Mycobacterium
DKTIRNFLESTGLPFLPMSMAKGLLPDTHPQSV

SEQ ID NO: 801937 - protein, 22 aa, Mycobacterium
DKTLMFPTLASLLEERLRDDPV

SEQ ID NO: 801938 - protein, 34 aa, Mycobacterium
DKTRTKFDLSLDPLVPLPGFVIKRAIKGVIEINT

SEQ ID NO: 801939 - protein, 22 aa, Mycobacterium
DKVARFLLGLGAKYGPERLLAG

SEQ ID NO: 801940 - protein, 26 aa, Mycobacterium
DKVARFMFGLARRYGPAFFTANQLGL

SEQ ID NO: 801941 - protein, 25 aa, Mycobacterium
DKVARFMLGLARRYGPAFYTANQLA

SEQ ID NO: 801942 - protein, 24 aa, Mycobacterium
DKVATKVFLLSPADIDVSAEERRR

SEQ ID NO: 801943 - protein, 37 aa, Mycobacterium
DKVDGPYYFFGVLARLAVLPSLTPILLPDTGRTNIVP

SEQ ID NO: 801944 - protein, 19 aa, Mycobacterium
DKVEWKSHGTTVRGTVEGK

SEQ ID NO: 801945 - protein, 17 aa, Mycobacterium
DKVFQVLRAPHTEEPTN

SEQ ID NO: 801946 - protein, 22 aa, Mycobacterium
DKVILDDVTLSFYPGAKIGVVG

SEQ ID NO: 801947 - protein, 24 aa, Mycobacterium
DKVLAGLRPFPVAVTTIDGGFANG

SEQ ID NO: 801948 - protein, 18 aa, Mycobacterium
DKVLSTYGQLFLASGRAN

SEQ ID NO: 801949 - protein, 20 aa, Mycobacterium
DKVNLDITWLRDESLEDADN

SEQ ID NO: 801950 - protein, 19 aa, Mycobacterium
DKVPALNPHQIDDLIMGCG

SEQ ID NO: 801951 - protein, 23 aa, Mycobacterium
DKVPALNPHQIDDLIMGCGLPGG

SEQ ID NO: 801952 - protein, 24 aa, Mycobacterium
DKVSGLYIVIAVLSALMHRAATGS

SEQ ID NO: 801953 - protein, 19 aa, Mycobacterium
DKVTLWYCSANRDEEKFAD

SEQ ID NO: 801954 - protein, 17 aa, Mycobacterium
DKVVVWYPAANRDPAVF

SEQ ID NO: 801955 - protein, 25 aa, Mycobacterium
DKYARHDGRWKFRQRTIVADWAYRN

SEQ ID NO: 801956 - protein, 21 aa, Mycobacterium
DKYDAKAYAVRFAREANIALD

SEQ ID NO: 801957 - protein, 28 aa, Mycobacterium
DKYGYDRPLYALGFDTLFAGPAGEFFKR

SEQ ID NO: 801958 - protein, 27 aa, Mycobacterium
DLAADRPLRVTLLRLGAEDFVVLLVVH

SEQ ID NO: 801959 - protein, 23 aa, Mycobacterium
DLAAFAGDLLRPVTVSAGLHAEA

SEQ ID NO: 801960 - protein, 19 aa, Mycobacterium
DLAAFTAIVPCGISDAGVT

SEQ ID NO: 801961 - protein, 17 aa, Mycobacterium
DLAAGAGPLPLAVGVDE

SEQ ID NO: 801962 - protein, 31 aa, Mycobacterium; identical to SEQ ID NO: 125185

SEQ ID NO: 801963 - protein, 28 aa, Mycobacterium
DLAAHPVVRSRYPMLARALLSGASGQLR

SEQ ID NO: 801964 - protein, 17 aa, Mycobacterium
DLAAIVADFRPGPGRRL

SEQ ID NO: 801965 - protein, 22 aa, Mycobacterium
DLAALAMMITLFSAGGESTASL

SEQ ID NO: 801966 - protein, 26 aa, Mycobacterium
DLAALDNGTWLRRGVADASGTVVALL

SEQ ID NO: 801967 - protein, 30 aa, Mycobacterium
DLAALRDVIGDRLFVVDGIQGFGVIEAPWE

SEQ ID NO: 801968 - protein, 21 aa, Mycobacterium
DLAARLLRRDLLFAYVGARMA

SEQ ID NO: 801969 - protein, 26 aa, Mycobacterium
DLAAVAPLPVLVAALGPVMLTLAGER

SEQ ID NO: 801970 - protein, 29 aa, Mycobacterium
DLAAVQPCPPLVLWDLTAGPDPTPTPEDG

SEQ ID NO: 801971 - protein, 21 aa, Mycobacterium
DLAAWLTTVVSRLGLDRLRSA

SEQ ID NO: 801972 - protein, 30 aa, Mycobacterium
DLACSGLRFAYDGLIPLPDGARLREQHRVP

SEQ ID NO: 801973 - protein, 19 aa, Mycobacterium
DLADFHRVMAVNVLGVMAG

SEQ ID NO: 801974 - protein, 25 aa, Mycobacterium
DLADTQVLGMPLGDIIRQAMADPNA

SEQ ID NO: 801975 - protein, 28 aa, Mycobacterium
DLADVTTRLGVPGIWYAGSHGFELTAPD

SEQ ID NO: 801976 - protein, 29 aa, Mycobacterium
DLAEPAGRRWPLYGPAMLGKSIHSVSAMP

SEQ ID NO: 801977 - protein, 18 aa, Mycobacterium
DLAERQVLVLERVVVTVL

SEQ ID NO: 801978 - protein, 29 aa, Mycobacterium
DLAERVGWQWRLVWYRAVSELLTGDYDSA

SEQ ID NO: 801979 - protein, 17 aa, Mycobacterium
DLAFATPDASRRIKGAV

SEQ ID NO: 801980 - protein, 22 aa, Mycobacterium
DLAFQPKPVQRPHPPIWFGGHA

SEQ ID NO: 801981 - protein, 20 aa, Mycobacterium
DLAFRICDVFGLPVEAVFSR

SEQ ID NO: 801982 - protein, 34 aa, Mycobacterium
DLAGHLIRVMTIAPGLFDTPLLAGLPEPARESLG

SEQ ID NO: 801983 - protein, 40 aa, Mycobacterium
DLAGLILNAPSFPGWDSFGAMVNHFRFIRDHQKHVKKIAV

SEQ ID NO: 801984 - protein, 21 aa, Mycobacterium
DLAGMLSRYGALSPPRAVAIV

SEQ ID NO: 801985 - protein, 19 aa, Mycobacterium
DLAGVPLITLPRGTGIRRQ

SEQ ID NO: 801986 - protein, 20 aa, Mycobacterium
DLAILIGPQQAWLNSEEFLE

SEQ ID NO: 801987 - protein, 20 aa, Mycobacterium
DLAILIGPQQGWLNSEEFLD

SEQ ID NO: 801988 - protein, 19 aa, Mycobacterium
DLAILMAVASAYTDIALPA

SEQ ID NO: 801989 - protein, 18 aa, Mycobacterium
DLAIMILGGVAVPLQTSA

SEQ ID NO: 801990 - protein, 19 aa, Mycobacterium
DLAKALLAYFTGHLGISTT

SEQ ID NO: 801991 - protein, 24 aa, Mycobacterium
DLAKINRFRWIRDKDLRAKFTPDY

SEQ ID NO: 801992 - protein, 38 aa, Mycobacterium
DLAKIRATMDSNYYGTLAMIRAFAPILARNGGGAILNV

SEQ ID NO: 801993 - protein, 17 aa, Mycobacterium
DLAKLLAPPLPAGPAAS

SEQ ID NO: 801994 - protein, 18 aa, Mycobacterium
DLAKLRILLVTPQARGLG

SEQ ID NO: 801995 - protein, 26 aa, Mycobacterium
DLALACVRAWNDWHFDVWAGSYPDRI

SEQ ID NO: 801996 - protein, 17 aa, Mycobacterium
DLALFRAWYLHEELGLN

SEQ ID NO: 801997 - protein, 19 aa, Mycobacterium
DLALFRSWKLHDELGLNIV

SEQ ID NO: 801998 - protein, 29 aa, Mycobacterium
DLALLEIRDLLFARLLQYRAFKHVAEMFA

SEQ ID NO: 801999 - protein, 18 aa, Mycobacterium
DLALLLSASVKRYPSPMM

SEQ ID NO: 802000 - protein, 19 aa, Mycobacterium
DLALLMTLEMGKPLPESRG

SEQ ID NO: 802001 - protein, 18 aa, Mycobacterium
DLALLQRVQRAIGLARVD

SEQ ID NO: 802002 - protein, 21 aa, Mycobacterium
DLALLRRRVPADRWSSLAHST

SEQ ID NO: 802003 - protein, 18 aa, Mycobacterium
DLALPRNRGQIPQPNEYP

SEQ ID NO: 802004 - protein, 28 aa, Mycobacterium
DLALQVCPVPPPRELDMLLTAGERISNA

SEQ ID NO: 802005 - protein, 22 aa, Mycobacterium
DLALRDLNLWGLQQDIATLDGL

SEQ ID NO: 802006 - protein, 17 aa, Mycobacterium
DLALRTMNFAPMTRLLA

SEQ ID NO: 802007 - protein, 25 aa, Mycobacterium
DLALSCALWVGMGRVLRTLDIGQAC

SEQ ID NO: 802008 - protein, 26 aa, Mycobacterium
DLALSCALWVGMGRVLRTLDIGQACK

SEQ ID NO: 802009 - protein, 32 aa, Mycobacterium
DLALSCALWVGMGRVLRTLDIGQACMLTLPSR

SEQ ID NO: 802010 - protein, 26 aa, Mycobacterium
DLALSCALWVGMGRVLRTLDIGQACR

SEQ ID NO: 802011 - protein, 21 aa, Mycobacterium
DLALTMMSALQGGLLMAQTTR

SEQ ID NO: 802012 - protein, 28 aa, Mycobacterium
DLALVVLTDRDFGEWARGPWPAISDSVL

SEQ ID NO: 802013 - protein, 26 aa, Mycobacterium
DLANAELLATFFRFATSAAGTTMQPD

SEQ ID NO: 802014 - protein, 33 aa, Mycobacterium
DLANDVVAEWLIRWLRETGVSVLLMDPLGSFYD

SEQ ID NO: 802015 - protein, 18 aa, Mycobacterium
DLAPALVPPLVGPEGRHD

SEQ ID NO: 802016 - protein, 18 aa, Mycobacterium
DLAPGLDPVSFTVTLDGG

SEQ ID NO: 802017 - protein, 17 aa, Mycobacterium
DLAPLFASGLIAQEVAT

SEQ ID NO: 802018 - protein, 20 aa, Mycobacterium
DLAPLLRERLPPDDPLVSYA

SEQ ID NO: 802019 - protein, 17 aa, Mycobacterium
DLAQHGFIGINFPEEFG

SEQ ID NO: 802020 - protein, 33 aa, Mycobacterium
DLAQQVCPVPPPRELDMLLTAGERISNALVAMA

SEQ ID NO: 802021 - protein, 21 aa, Mycobacterium
DLARDGLTLTGFLGLSDTPRA

SEQ ID NO: 802022 - protein, 25 aa, Mycobacterium
DLARGLFDAGPWNRVAPLRLFGHSM

SEQ ID NO: 802023 - protein, 35 aa, Mycobacterium
DLARKKLMPAIYDLANRGLLPASFALVGFARRDWE

SEQ ID NO: 802024 - protein, 37 aa, Mycobacterium
DLARKKLMPAIYDLANRGLLPPSFALVGFARRDWADE

SEQ ID NO: 802025 - protein, 37 aa, Mycobacterium
DLARKKLMPAIYDLANRGLLPPSFALVGFARRDWANE

SEQ ID NO: 802026 - protein, 23 aa, Mycobacterium
DLARMRALAREAIEAGALGFASS

SEQ ID NO: 802027 - protein, 21 aa, Mycobacterium
DLARRAAMRSPLQVGVGIGAG

SEQ ID NO: 802028 - protein, 20 aa, Mycobacterium
DLARRLARQVPGCRFSGLGG

SEQ ID NO: 802029 - protein, 17 aa, Mycobacterium
DLARTIWTQCDSYFRSP

SEQ ID NO: 802030 - protein, 26 aa, Mycobacterium
DLASEIPLWAKLFRIAKDEHVLVIVV

SEQ ID NO: 802031 - protein, 24 aa, Mycobacterium
DLASKYWELVIGQFPEWDQVFNRE

SEQ ID NO: 802032 - protein, 22 aa, Mycobacterium
DLASMISGRRPLEEAAAALDDL

SEQ ID NO: 802033 - protein, 20 aa, Mycobacterium
DLATAAAVMLRRCETCAGDV

SEQ ID NO: 802034 - protein, 22 aa, Mycobacterium
DLATLIAAPYFRDAVEKGIDSW

SEQ ID NO: 802035 - protein, 24 aa, Mycobacterium
DLATNWLFGYVDVVLIRAERLYEV

SEQ ID NO: 802036 - protein, 25 aa, Mycobacterium
DLATPKGWMTALWAYNQSDPYARSV

SEQ ID NO: 802037 - protein, 26 aa, Mycobacterium
DLATRRSIFIPILRVASIEPNAVTLS

SEQ ID NO: 802038 - protein, 26 aa, Mycobacterium
DLATRRSIFIPMLRVAAIEPNAVTLS

SEQ ID NO: 802039 - protein, 23 aa, Mycobacterium
DLATVTLRALIDRTGLGEGDVDD

SEQ ID NO: 802040 - protein, 17 aa, Mycobacterium
DLAVHEIDLALDALQRG

SEQ ID NO: 802041 - protein, 26 aa, Mycobacterium
DLAVKLLPVWRHWISAALPHIRGPRV

SEQ ID NO: 802042 - protein, 17 aa, Mycobacterium
DLAVLSLLGPRLADQTI

SEQ ID NO: 802043 - protein, 28 aa, Mycobacterium
DLAVLTLRPRLIEVLGVDPLTDAGMRRW

SEQ ID NO: 802044 - protein, 20 aa, Mycobacterium
DLAVRLGWYDQAHFINDFRS

SEQ ID NO: 802045 - protein, 20 aa, Mycobacterium
DLAYFRVLIHHSGNRALALL

SEQ ID NO: 802046 - protein, 28 aa, Mycobacterium
DLAYRVAVGLYRYSLLDIIDIADIADID

SEQ ID NO: 802047 - protein, 29 aa, Mycobacterium
DLAYRVAVGLYRYSLLDIIDIADIIEIDT

SEQ ID NO: 802048 - protein, 24 aa, Mycobacterium
DLAYTTIMTVLQRLAKKNLVVQHR

SEQ ID NO: 802049 - protein, 25 aa, Mycobacterium
DLAYTTIMTVLQRLAKKNLVVQHRD

SEQ ID NO: 802050 - protein, 30 aa, Mycobacterium
DLCKHLASMHPSRYLTLIEGVTAVFIADVE

SEQ ID NO: 802051 - protein, 17 aa, Mycobacterium
DLCLPLPKFSDIRYNYS

SEQ ID NO: 802052 - protein, 17 aa, Mycobacterium
DLCPHGCYPCAGGAWLA

SEQ ID NO: 802053 - protein, 32 aa, Mycobacterium
DLCRGPHIPTTRYIPAFKLTRSSAAYWRGDQN

SEQ ID NO: 802054 - protein, 31 aa, Mycobacterium
DLCRGPHIPTTRYIPAFTLTRSSAAYWRGDQ

SEQ ID NO: 802055 - protein, 26 aa, Mycobacterium
DLCYEYNLFILSRTKIRTTEKIPPGR

SEQ ID NO: 802056 - protein, 19 aa, Mycobacterium
DLDAAIEKLLAHKLRRRHR

SEQ ID NO: 802057 - protein, 25 aa, Mycobacterium
DLDAAIKWYHDHLGMIVLHEEVNEE

SEQ ID NO: 802058 - protein, 27 aa, Mycobacterium
DLDADWLDIGWVALLNQWMTEAHDAGV

SEQ ID NO: 802059 - protein, 19 aa, Mycobacterium
DLDAFRRVLRDGEIGRLVP

SEQ ID NO: 802060 - protein, 32 aa, Mycobacterium
DLDALITKVWKTPAFFLTHPLGVAAFGRECTY

SEQ ID NO: 802061 - protein, 31 aa, Mycobacterium
DLDALITKVWKTPGFFLTHPLGVAAFGREAT

SEQ ID NO: 802062 - protein, 26 aa, Mycobacterium
DLDALITKVWKTPSFFLTHPQGIAAF

SEQ ID NO: 802063 - protein, 26 aa, Mycobacterium
DLDALPRVPRWLRPFARFQARDHLWD

SEQ ID NO: 802064 - protein, 22 aa, Mycobacterium
DLDAYATTAWRLGHSREAVRLA

SEQ ID NO: 802065 - protein, 25 aa, Mycobacterium
DLDDALLALLPLIGVWRGEGEGRDA

SEQ ID NO: 802066 - protein, 18 aa, Mycobacterium
DLDDLLTGRGERLPAQAV

SEQ ID NO: 802067 - protein, 21 aa, Mycobacterium
DLDDLLTRLQPIARLLECETE

SEQ ID NO: 802068 - protein, 30 aa, Mycobacterium
DLDDWKCWARWRLIRSRAPWLTRDLVDQDF

SEQ ID NO: 802069 - protein, 17 aa, Mycobacterium
DLDEAWRRADGEPEVRV

SEQ ID NO: 802070 - protein, 17 aa, Mycobacterium
DLDEFLRNAGGSFWHQV

SEQ ID NO: 802071 - protein, 24 aa, Mycobacterium
DLDEGFALLSDDFTYWSLVTRSTC

SEQ ID NO: 802072 - protein, 23 aa, Mycobacterium
DLDESYEWGLNLLDAIVAEQESI

SEQ ID NO: 802073 - protein, 22 aa, Mycobacterium
DLDFLNLAVLDALLTLGADTVV

SEQ ID NO: 802074 - protein, 30 aa, Mycobacterium
DLDGETLTRMVNLLLAVSMFAADPALWQIT

SEQ ID NO: 802075 - protein, 17 aa, Mycobacterium
DLDGLRVWLHTNNLHTL

SEQ ID NO: 802076 - protein, 27 aa, Mycobacterium
DLDILSATLVYQLALAGAARMIVTARA

SEQ ID NO: 802077 - protein, 21 aa, Mycobacterium
DLDIPAGQFYSLLGASGCGKT

SEQ ID NO: 802078 - protein, 21 aa, Mycobacterium
DLDIRPGELVALLGPSGCGKT

SEQ ID NO: 802079 - protein, 24 aa, Mycobacterium
DLDITRIIRPLRRFLNALGDRNAR

SEQ ID NO: 802080 - protein, 21 aa, Mycobacterium
DLDIWLISWVPGHATELHDHG

SEQ ID NO: 802081 - protein, 25 aa, Mycobacterium
DLDKPKLVFFFDEAHLLFSDASKAF

SEQ ID NO: 802082 - protein, 26 aa, Mycobacterium
DLDKPKLVFFFDEAHLLFTDASKAFL

SEQ ID NO: 802083 - protein, 17 aa, Mycobacterium
DLDKSYPIWDVLHESMG

SEQ ID NO: 802084 - protein, 25 aa, Mycobacterium
DLDLFKHLHRAGLRRVFVGLETGSY

SEQ ID NO: 802085 - protein, 18 aa, Mycobacterium
DLDLPSGGRVRYRKIRDG

SEQ ID NO: 802086 - protein, 23 aa, Mycobacterium
DLDLSLFVMFSSMAGLVGSSGQA

SEQ ID NO: 802087 - protein, 23 aa, Mycobacterium
DLDLTIDLAFADLAVNYRLTLRN

SEQ ID NO: 802088 - protein, 20 aa, Mycobacterium
DLDLVLRTRGIRYIVLTGIT

SEQ ID NO: 802089 - protein, 26 aa, Mycobacterium
DLDMWEKVIFNLLSNALKFTFEGSVS

SEQ ID NO: 802090 - protein, 18 aa, Mycobacterium
DLDNYLTRPLWYQQQLDT

SEQ ID NO: 802091 - protein, 22 aa, Mycobacterium
DLDPDLAWQPELWRALVAAVPA

SEQ ID NO: 802092 - protein, 25 aa, Mycobacterium
DLDPGHFLYQPFLHTRGLGEKDLSL

SEQ ID NO: 802093 - protein, 24 aa, Mycobacterium
DLDPGMWETIVLNLLSNAVKYTLH

SEQ ID NO: 802094 - protein, 28 aa, Mycobacterium
DLDPLVDYPEGWLWDLVGRNAPGSATVD

SEQ ID NO: 802095 - protein, 18 aa, Mycobacterium
DLDPYLDWDLANEPERYA

SEQ ID NO: 802096 - protein, 23 aa, Mycobacterium
DLDQAGRFRGLADAGLAAGNDAQ

SEQ ID NO: 802097 - protein, 17 aa, Mycobacterium
DLDQAMGWAPKRSPDAP

SEQ ID NO: 802098 - protein, 30 aa, Mycobacterium
DLDQRRDWLELFPFLLTRRPESYGALTEPV

SEQ ID NO: 802099 - protein, 22 aa, Mycobacterium
DLDRARRFYERLGWHGQVVQET

SEQ ID NO: 802100 - protein, 22 aa, Mycobacterium
DLDRATLPALRHIVRVPIDEND

SEQ ID NO: 802101 - protein, 25 aa, Mycobacterium
DLDRERLLAEVLRSASRDGLVSAAH

SEQ ID NO: 802102 - protein, 24 aa, Mycobacterium
DLDRGYVKAVRRRWIREEHYRRMY

SEQ ID NO: 802103 - protein, 17 aa, Mycobacterium
DLDRIFLVAPSSTPERL

SEQ ID NO: 802104 - protein, 30 aa, Mycobacterium
DLDRLLVDTMIRLARLLWDRKDAAAVDVVT

SEQ ID NO: 802105 - protein, 29 aa, Mycobacterium
DLDRPATGLLFFLASSRILNRRKGVRMSM

SEQ ID NO: 802106 - protein, 20 aa, Mycobacterium
DLDTDFLLLAAGSGITPMMA

SEQ ID NO: 802107 - protein, 40 aa, Mycobacterium
DLDTDVIVSWLPLFHDMGMTGFLTVPMLFGAELVKITPLD

SEQ ID NO: 802108 - protein, 26 aa, Mycobacterium
DLDTFVRKLLRLFESPKTRADLKAGR

SEQ ID NO: 802109 - protein, 25 aa, Mycobacterium
DLDTLLEFYHYPAEHWIHLRTTNPI

SEQ ID NO: 802110 - protein, 25 aa, Mycobacterium
DLDTPVVMINLLQFKPDGVANYQRY

SEQ ID NO: 802111 - protein, 21 aa, Mycobacterium
DLDTSLKLWERGEQLAKRCEE

SEQ ID NO: 802112 - protein, 25 aa, Mycobacterium
DLDVAERILLNSKTRRPSVCNAAET

SEQ ID NO: 802113 - protein, 19 aa, Mycobacterium
DLDVIVYATGYYLDFLSTV

SEQ ID NO: 802114 - protein, 17 aa, Mycobacterium
DLDVLGYWVTSQAPPVM

SEQ ID NO: 802115 - protein, 23 aa, Mycobacterium
DLDVLLPGMQPGAAFPPATMPPV

SEQ ID NO: 802116 - protein, 22 aa, Mycobacterium
DLDVLYVTSMARPPLPRFPEDG

SEQ ID NO: 802117 - protein, 22 aa, Mycobacterium
DLDVRGFFGLDDSVRPGFQQIR

SEQ ID NO: 802118 - protein, 24 aa, Mycobacterium
DLDVSAFVMFSSMAGLAGASGQAN

SEQ ID NO: 802119 - protein, 20 aa, Mycobacterium
DLDWQSVWDRGWTLAAAAEE

SEQ ID NO: 802120 - protein, 25 aa, Mycobacterium
DLDYHLTTLFPPVRPRQWLEIRYLD

SEQ ID NO: 802121 - protein, 28 aa, Mycobacterium
DLDYHLTTLFPPVRPRRWLELRYLDAAP

SEQ ID NO: 802122 - protein, 30 aa, Mycobacterium
DLEAGLRLISLLRPLWLRGGRTLEGIAGLD

SEQ ID NO: 802123 - protein, 37 aa, Mycobacterium
DLEAWTKNHWDWFDPFYAHRVLWPNRAYKPDLDILIA

SEQ ID NO: 802124 - protein, 20 aa, Mycobacterium
DLEDLVRIESVWADPGRRSE

SEQ ID NO: 802125 - protein, 21 aa, Mycobacterium
DLEDPGLRRLLGAADVVIESS

SEQ ID NO: 802126 - protein, 23 aa, Mycobacterium
DLEFDLLMLVAPILRKLADSDTR

SEQ ID NO: 802127 - protein, 23 aa, Mycobacterium
DLEFNLFEVLALEKALATGDFGD

SEQ ID NO: 802128 - protein, 21 aa, Mycobacterium
DLEGRLLAGLLAPYGDEPTPT

SEQ ID NO: 802129 - protein, 23 aa, Mycobacterium
DLEGYLPLGVERVLLGLPTEPRD

SEQ ID NO: 802130 - protein, 31 aa, Mycobacterium; identical to SEQ ID NO: 125201

SEQ ID NO: 802131 - protein, 23 aa, Mycobacterium
DLEHRARRLVADRGAVSCYWDYA

SEQ ID NO: 802132 - protein, 23 aa, Mycobacterium
DLEKTLRFWLDRGVDGFRIDVAH

SEQ ID NO: 802133 - protein, 26 aa, Mycobacterium
DLELIGRIGWTCRDVWWAATQDPRSW

SEQ ID NO: 802134 - protein, 23 aa, Mycobacterium
DLELILTTRRITHLIFTGIATDV

SEQ ID NO: 802135 - protein, 18 aa, Mycobacterium
DLELLDWPEPVKAMQRNW

SEQ ID NO: 802136 - protein, 25 aa, Mycobacterium
DLELLFGPLDVCDCAHCASVYGPAA

SEQ ID NO: 802137 - protein, 18 aa, Mycobacterium
DLELLREAWLTATKARNA

SEQ ID NO: 802138 - protein, 19 aa, Mycobacterium
DLELLYVGAMFHDIGLTEP

SEQ ID NO: 802139 - protein, 27 aa, Mycobacterium
DLELRYRGLRAPHKIKMGVSGCARECA

SEQ ID NO: 802140 - protein, 33 aa, Mycobacterium
DLEMGPAIRFLLIELPGDRWRFLITAHHIVIGG

SEQ ID NO: 802141 - protein, 26 aa, Mycobacterium
DLEPDNFLYQPFLHTRGLGEKDLSLA

SEQ ID NO: 802142 - protein, 22 aa, Mycobacterium
DLEPTRPILHGLLGDIDAAALS

SEQ ID NO: 802143 - protein, 18 aa, Mycobacterium
DLEPYLDWDLATEPERYA

SEQ ID NO: 802144 - protein, 20 aa, Mycobacterium
DLEQLSRHFLTRARAVHIIP

SEQ ID NO: 802145 - protein, 21 aa, Mycobacterium
DLERALALAGYHRVEVRTVLA

SEQ ID NO: 802146 - protein, 18 aa, Mycobacterium
DLERAVMDHLWSAPEPQT

SEQ ID NO: 802147 - protein, 20 aa, Mycobacterium
DLERDMGLPPGSLQATVAAY

SEQ ID NO: 802148 - protein, 20 aa, Mycobacterium
DLERRILLSRVPELPERLAE

SEQ ID NO: 802149 - protein, 19 aa, Mycobacterium
DLERRVAEFLGFTEVFTSV

SEQ ID NO: 802150 - protein, 21 aa, Mycobacterium
DLERRVAQFLGFATVLTSVGQ

SEQ ID NO: 802151 - protein, 19 aa, Mycobacterium
DLERWALPTRFGSEYRTAL

SEQ ID NO: 802152 - protein, 17 aa, Mycobacterium
DLESGFTAVRRLKQPAA

SEQ ID NO: 802153 - protein, 23 aa, Mycobacterium
DLESLEFVAFDRVPPGPGEIEVA

SEQ ID NO: 802154 - protein, 24 aa, Mycobacterium
DLETGVEYPLAPGTMYLLNGHERH

SEQ ID NO: 802155 - protein, 25 aa, Mycobacterium
DLETLMTALTPLERLACGEPANAPE

SEQ ID NO: 802156 - protein, 21 aa, Mycobacterium
DLETWLVHITGYDAVSLQPNA

SEQ ID NO: 802157 - protein, 29 aa, Mycobacterium
DLEYGRLKLPVPTWQVLLDVPTELAAQRA

SEQ ID NO: 802158 - protein, 18 aa, Mycobacterium
DLFAAFGMEPVGCYDLRS

SEQ ID NO: 802159 - protein, 27 aa, Mycobacterium
DLFADDWALRRFAGISNLPAVPQHLSA

SEQ ID NO: 802160 - protein, 24 aa, Mycobacterium
DLFAGILAQVPFVDALTTILDPSL

SEQ ID NO: 802161 - protein, 19 aa, Mycobacterium
DLFARKVIPYFKGQLEAPR

SEQ ID NO: 802162 - protein, 19 aa, Mycobacterium
DLFFDFEGDPLWTVDGREW

SEQ ID NO: 802163 - protein, 20 aa, Mycobacterium
DLFGGLFGRGAQQPRPSRPR

SEQ ID NO: 802164 - protein, 24 aa, Mycobacterium
DLFIDPHFPGFTTQVLFTPEQLWP

SEQ ID NO: 802165 - protein, 18 aa, Mycobacterium
DLFIGSGERVLLLGPSGS

SEQ ID NO: 802166 - protein, 21 aa, Mycobacterium
DLFNRFTHDAFWRDPERIPAG

SEQ ID NO: 802167 - protein, 17 aa, Mycobacterium
DLFPSQRGRPSIPAEVM

SEQ ID NO: 802168 - protein, 27 aa, Mycobacterium
DLFSPANISPLVAYLASEKCPLSGKVF

SEQ ID NO: 802169 - protein, 24 aa, Mycobacterium
DLGARWVGPIRTATKYRMSALRTT

SEQ ID NO: 802170 - protein, 24 aa, Mycobacterium
DLGCDYAICYFPEAAYDRSGIELF

SEQ ID NO: 802171 - protein, 17 aa, Mycobacterium
DLGCEYAICYFPEAAYD

SEQ ID NO: 802172 - protein, 21 aa, Mycobacterium
DLGDAILLPGLMDMEVNLLMG

SEQ ID NO: 802173 - protein, 25 aa, Mycobacterium
DLGDGRWFNIRMSNTEPLLRLNVEA

SEQ ID NO: 802174 - protein, 25 aa, Mycobacterium
DLGDPDRWQPWREFIASVRAQLPLN

SEQ ID NO: 802175 - protein, 29 aa, Mycobacterium
DLGEAMRTLISVPLFHVTGCNSQLLAATR

SEQ ID NO: 802176 - protein, 24 aa, Mycobacterium
DLGEDLLAVIAPKPGFSGGEGELT

SEQ ID NO: 802177 - protein, 22 aa, Mycobacterium
DLGEGFGVWRLGDDDAMLDIVT

SEQ ID NO: 802178 - protein, 17 aa, Mycobacterium
DLGELEFVLLRRRSVLS

SEQ ID NO: 802179 - protein, 23 aa, Mycobacterium
DLGEYFLERYLAHSGDTAPKPLH

SEQ ID NO: 802180 - protein, 25 aa, Mycobacterium
DLGGLSIALLAYKLSLKGKEAPVID

SEQ ID NO: 802181 - protein, 24 aa, Mycobacterium
DLGGLSIALLAYQLSLNGEPAPVI

SEQ ID NO: 802182 - protein, 26 aa, Mycobacterium
DLGGLSIALLAYQLSLNGQPAPVIDG

SEQ ID NO: 802183 - protein, 32 aa, Mycobacterium
DLGGRHAIRLPYPDGLRLDVQFLPKDEAPPTT

SEQ ID NO: 802184 - protein, 27 aa, Mycobacterium
DLGGSWLLPKLVGLQQAKRLALLAETI

SEQ ID NO: 802185 - protein, 19 aa, Mycobacterium
DLGGWLTAAMDAHGAWDVG

SEQ ID NO: 802186 - protein, 18 aa, Mycobacterium
DLGIAWRSPKAAIVESLR

SEQ ID NO: 802187 - protein, 24 aa, Mycobacterium
DLGIHPVTLSKWLKQDDIDRGVRP

SEQ ID NO: 802188 - protein, 23 aa, Mycobacterium
DLGKLKPAFEGLAALGGFDDVAR

SEQ ID NO: 802189 - protein, 22 aa, Mycobacterium
DLGKWQKVIDVNLTGTFLGMRA

SEQ ID NO: 802190 - protein, 17 aa, Mycobacterium
DLGLIRLRHAVGVYSAG

SEQ ID NO: 802191 - protein, 23 aa, Mycobacterium
DLGLLRGFLDADTLDYLAGYRFG

SEQ ID NO: 802192 - protein, 20 aa, Mycobacterium
DLGLPLWDDTLATPELLIEA

SEQ ID NO: 802193 - protein, 22 aa, Mycobacterium
DLGNLRPLIPLQIDPPEHAKYR

SEQ ID NO: 802194 - protein, 25 aa, Mycobacterium
DLGPGDILTRLTAPVIRGLGIGIVP

SEQ ID NO: 802195 - protein, 24 aa, Mycobacterium
DLGPGDILTRLTAPVIRGLGVGIV

SEQ ID NO: 802196 - protein, 18 aa, Mycobacterium
DLGPVALALVKRGLPADT

SEQ ID NO: 802197 - protein, 24 aa, Mycobacterium
DLGPVALALVKRGLPADTALMTGA

SEQ ID NO: 802198 - protein, 25 aa, Mycobacterium
DLGQINGLPATLLITTTLQELEKAA

SEQ ID NO: 802199 - protein, 18 aa, Mycobacterium
DLGRHLPRRLAVTYLDAL

SEQ ID NO: 802200 - protein, 17 aa, Mycobacterium
DLGRIEMSFVVASTEML

SEQ ID NO: 802201 - protein, 20 aa, Mycobacterium
DLGSAIGGALRDGGHDPDQA

SEQ ID NO: 802202 - protein, 25 aa, Mycobacterium
DLGSGEIRTIVWATGFRPDLSWIDA

SEQ ID NO: 802203 - protein, 24 aa, Mycobacterium
DLGSLGIRALAIAPSLFATGLTEG

SEQ ID NO: 802204 - protein, 30 aa, Mycobacterium
DLGSMGIRVLAIAPSLFLTGLTSMVPDEMA

SEQ ID NO: 802205 - protein, 18 aa, Mycobacterium
DLGSMRFYRETALAVGFE

SEQ ID NO: 802206 - protein, 24 aa, Mycobacterium
DLGSVGIRVLGIAPSLFATGLTQG

SEQ ID NO: 802207 - protein, 17 aa, Mycobacterium
DLGSWTIAAGCVAGVHA

SEQ ID NO: 802208 - protein, 20 aa, Mycobacterium
DLGVLLAEVGWSVAPVPVYA

SEQ ID NO: 802209 - protein, 28 aa, Mycobacterium
DLGYLDAAGFIYFAGRRGDWIRVDGENM

SEQ ID NO: 802210 - protein, 23 aa, Mycobacterium
DLHAELTRYQLVIWTAGNVSARV

SEQ ID NO: 802211 - protein, 21 aa, Mycobacterium
DLHALAKMHLELTRAGVANTM

SEQ ID NO: 802212 - protein, 17 aa, Mycobacterium
DLHDVLRIYLQAAIPSI

SEQ ID NO: 802213 - protein, 20 aa, Mycobacterium
DLHFTVRVPMVEAALGTSVS

SEQ ID NO: 802214 - protein, 19 aa, Mycobacterium
DLHGALGIDRLSWASFHHN

SEQ ID NO: 802215 - protein, 24 aa, Mycobacterium
DLHGPAVLRLPVTAALIAGLSRVR

SEQ ID NO: 802216 - protein, 21 aa, Mycobacterium
DLHGPFDYHLTRKLCKLAEEL

SEQ ID NO: 802217 - protein, 28 aa, Mycobacterium
DLHIGNLRTALLAWLLAHSTGRRFLMRV

SEQ ID NO: 802218 - protein, 19 aa, Mycobacterium
DLHIVSFDVLFADADRVCL

SEQ ID NO: 802219 - protein, 28 aa, Mycobacterium
DLHKMWRTRDRKGYHVEYGYSCMGYEIA

SEQ ID NO: 802220 - protein, 26 aa, Mycobacterium
DLHPAGMHLLRCPTVGRALEVLSEAR

SEQ ID NO: 802221 - protein, 18 aa, Mycobacterium
DLHPGNYRFGLDGSLGIV

SEQ ID NO: 802222 - protein, 23 aa, Mycobacterium
DLHPYRVRHLLDRYGSLIGEVLK

SEQ ID NO: 802223 - protein, 31 aa, Mycobacterium
DLHRARRWRGSPERFGMSAAILLGDLALSWA

SEQ ID NO: 802224 - protein, 19 aa, Mycobacterium
DLHRRGLLDEMTMQASLDS

SEQ ID NO: 802225 - protein, 24 aa, Mycobacterium
DLHRRLLGVLIDQEWKYGVATGVE

SEQ ID NO: 802226 - protein, 45 aa, Mycobacterium
DLHRTDPLLLLPLLRCMAPVPVLLLHCYPFHRQAGYLAQAFDHVH

SEQ ID NO: 802227 - protein, 20 aa, Mycobacterium
DLHVLNPPRHQLRSVDGLVV

SEQ ID NO: 802228 - protein, 38 aa, Mycobacterium
DLHWDRILFCAKEATYKAWFPLTKRWLGFEDAHITFES

SEQ ID NO: 802229 - protein, 20 aa, Mycobacterium
DLHWRRVEALRAAIGPLTPD

SEQ ID NO: 802230 - protein, 17 aa, Mycobacterium
DLIAALLKQGRLLIGDV

SEQ ID NO: 802231 - protein, 23 aa, Mycobacterium
DLIADFAMQLPVAIIAEILGLPR

SEQ ID NO: 802232 - protein, 21 aa, Mycobacterium
DLIADVVYQIGALQAIAHACG

SEQ ID NO: 802233 - protein, 17 aa, Mycobacterium
DLICDYARVATGHPLPR

SEQ ID NO: 802234 - protein, 34 aa, Mycobacterium
DLIDDLAHCPAYHKLLLKSLTTAGLMELPNSCTP

SEQ ID NO: 802235 - protein, 24 aa, Mycobacterium
DLIDDLVAFFSAGLAAPTPLTLRP

SEQ ID NO: 802236 - protein, 28 aa, Mycobacterium
DLIDLKVVIPRRPIWAYSAPGSGAPWNV

SEQ ID NO: 802237 - protein, 25 aa, Mycobacterium
DLIDLLPAGKIPAGFLPVLQAYDYA

SEQ ID NO: 802238 - protein, 28 aa, Mycobacterium
DLIDPDAWAFTWVVDWPMFESAAEATAS

SEQ ID NO: 802239 - protein, 27 aa, Mycobacterium
DLIDPDPMFVPKLLGPLLTCDGVHLVK

SEQ ID NO: 802240 - protein, 27 aa, Mycobacterium
DLIDPNAWAFTWVVDFPMFEAADEATA

SEQ ID NO: 802241 - protein, 20 aa, Mycobacterium
DLIEHPTVKAAYRTVAETWL

SEQ ID NO: 802242 - protein, 23 aa, Mycobacterium
DLIEPDLRYLVNWGYGDPAYGWS

SEQ ID NO: 802243 - protein, 18 aa, Mycobacterium
DLIGLIRQHAPKVSLIVT

SEQ ID NO: 802244 - protein, 30 aa, Mycobacterium
DLIIALARNHSRMLLHLGADPERVRLLRSF

SEQ ID NO: 802245 - protein, 34 aa, Mycobacterium
DLILGSQGLTPTLYPQLAAIAPTVFTGAPGAGWE

SEQ ID NO: 802246 - protein, 24 aa, Mycobacterium
DLILKHDPGSFRRGRASRRGRYFD

SEQ ID NO: 802247 - protein, 20 aa, Mycobacterium
DLIQESLGWVPYTQLANLTG

SEQ ID NO: 802248 - protein, 18 aa, Mycobacterium
DLIQLKLLRDYATNAPLY

SEQ ID NO: 802249 - protein, 23 aa, Mycobacterium
DLISAHLQGWTLDRLPAVDRAVL

SEQ ID NO: 802250 - protein, 23 aa, Mycobacterium
DLISAHLQGWTLERLPAVDRAIL

SEQ ID NO: 802251 - protein, 18 aa, Mycobacterium
DLITANFIGTILSAVRSD

SEQ ID NO: 802252 - protein, 34 aa, Mycobacterium
DLITGVVAPLAPLHGWGPDPYLTPGLTELSSQAG

SEQ ID NO: 802253 - protein, 26 aa, Mycobacterium
DLITRGINVLVINPVDPKGVTPSLAA

SEQ ID NO: 802254 - protein, 22 aa, Mycobacterium
DLITSHLQGWTLDRLPAVDRAI

SEQ ID NO: 802255 - protein, 19 aa, Mycobacterium
DLITVRGRRLLAQADVVVA

SEQ ID NO: 802256 - protein, 22 aa, Mycobacterium
DLKALHDQALAAAAQAKKAVEQ

SEQ ID NO: 802257 - protein, 18 aa, Mycobacterium
DLKALLPESARRAYDVHP

SEQ ID NO: 802258 - protein, 25 aa, Mycobacterium
DLKEALLRRIGLAASKYWVCKRSTP

SEQ ID NO: 802259 - protein, 19 aa, Mycobacterium
DLKGASFPWRTIRGEECSA

SEQ ID NO: 802260 - protein, 17 aa, Mycobacterium
DLKKAGLQIPPPSKKEQ

SEQ ID NO: 802261 - protein, 21 aa, Mycobacterium
DLKLVTFELGGKSPTVIFDDA

SEQ ID NO: 802262 - protein, 17 aa, Mycobacterium
DLKPGMTLLDIGCGWGT

SEQ ID NO: 802263 - protein, 17 aa, Mycobacterium
DLKPGSLGALNPLVDTV

SEQ ID NO: 802264 - protein, 18 aa, Mycobacterium
DLKPLLEFIVAGGLATTV

SEQ ID NO: 802265 - protein, 23 aa, Mycobacterium
DLKRAHLELGGKAPVVIFNDADI

SEQ ID NO: 802266 - protein, 17 aa, Mycobacterium
DLKRLHREVPVTSIYVT

SEQ ID NO: 802267 - protein, 25 aa, Mycobacterium
DLKVLTETLLPHFKGIGGALMNFDS

SEQ ID NO: 802268 - protein, 28 aa, Mycobacterium
DLLAAINAPVLSLTGRPLIGNGANGAPG

SEQ ID NO: 802269 - protein, 22 aa, Mycobacterium
DLLAALLAGVPWRSERRQMYDR

SEQ ID NO: 802270 - protein, 27 aa, Mycobacterium
DLLAATVIYRFLFAHADLDPALSEHIV

SEQ ID NO: 802271 - protein, 24 aa, Mycobacterium
DLLAELTVALLTRAKMRDPGKGYV

SEQ ID NO: 802272 - protein, 17 aa, Mycobacterium
DLLAEWKAAGRAAKDVD

SEQ ID NO: 802273 - protein, 26 aa, Mycobacterium
DLLALSLQGLYQAFFQGYGGYANPGT

SEQ ID NO: 802274 - protein, 24 aa, Mycobacterium
DLLATATMDLDRIGNAINAGSTAA

SEQ ID NO: 802275 - protein, 26 aa, Mycobacterium
DLLAVELSSFQLHWAPSLRPEAGVVL

SEQ ID NO: 802276 - protein, 26 aa, Mycobacterium
DLLAVELSSFQLHWAPSVRPEAGVVL

SEQ ID NO: 802277 - protein, 20 aa, Mycobacterium
DLLCLTFNGLSKAYRVAGYR

SEQ ID NO: 802278 - protein, 19 aa, Mycobacterium
DLLDFFAELTIYTSSACLI

SEQ ID NO: 802279 - protein, 19 aa, Mycobacterium
DLLDHLLPHDWRVDVQALD

SEQ ID NO: 802280 - protein, 19 aa, Mycobacterium
DLLDHLLPHDWRVDVQQLD

SEQ ID NO: 802281 - protein, 31 aa, Mycobacterium
DLLDPDPMFVPKLLGPLLIAEGVHLVKGFYR

SEQ ID NO: 802282 - protein, 26 aa, Mycobacterium
DLLDQLLKLWVEQGALPARMSALGDV

SEQ ID NO: 802283 - protein, 26 aa, Mycobacterium
DLLDRLHVVALPMRVRFRGITTREVA

SEQ ID NO: 802284 - protein, 29 aa, Mycobacterium
DLLDRSGGFGTLLLLGHDWAAPKATFHSY

SEQ ID NO: 802285 - protein, 22 aa, Mycobacterium
DLLEAKYFMMRVRCDGGALSAA

SEQ ID NO: 802286 - protein, 19 aa, Mycobacterium
DLLEQLDPDVPFPAAANGP

SEQ ID NO: 802287 - protein, 18 aa, Mycobacterium
DLLEYWSGRRWPSGRHRV

SEQ ID NO: 802288 - protein, 28 aa, Mycobacterium
DLLGAINAPVLALTGRPLIGNGANGAPG

SEQ ID NO: 802289 - protein, 20 aa, Mycobacterium
DLLGDLAVKPVIPLPVNCAT

SEQ ID NO: 802290 - protein, 17 aa, Mycobacterium
DLLGKRRTGRFLPAGAK

SEQ ID NO: 802291 - protein, 31 aa, Mycobacterium
DLLGLINAPALALLHRPLIGDGTDGAAGSGQ

SEQ ID NO: 802292 - protein, 18 aa, Mycobacterium
DLLGMPRPICIETEYSLA

SEQ ID NO: 802293 - protein, 21 aa, Mycobacterium
DLLGPDGLLAHRSEQAPLAGK

SEQ ID NO: 802294 - protein, 24 aa, Mycobacterium
DLLGPDGLLAHRSPAAPLAGTFER

SEQ ID NO: 802295 - protein, 25 aa, Mycobacterium
DLLGRPTAWLFGPESRGLPSDVAGA

SEQ ID NO: 802296 - protein, 20 aa, Mycobacterium
DLLGVVARLNRLATQRIQMP

SEQ ID NO: 802297 - protein, 19 aa, Mycobacterium
DLLHTGHIRLLRQARELGD

SEQ ID NO: 802298 - protein, 30 aa, Mycobacterium
DLLIAHAGELEKFQWFVRAHLESAGGQLTH

SEQ ID NO: 802299 - protein, 26 aa, Mycobacterium
DLLIEWQRDFFDFGHVAYMYGKLIES

SEQ ID NO: 802300 - protein, 21 aa, Mycobacterium
DLLKGVQYYPGGCTTQSIVMR

SEQ ID NO: 802301 - protein, 18 aa, Mycobacterium
DLLLACHLAGCGYSMCES

SEQ ID NO: 802302 - protein, 21 aa, Mycobacterium
DLLLQVLFHARIAEDAALLPF

SEQ ID NO: 802303 - protein, 22 aa, Mycobacterium
DLLLQVLFHARIAEDAALLPFT

SEQ ID NO: 802304 - protein, 21 aa, Mycobacterium
DLLLSAWDLRPFTDDSDFLVA

SEQ ID NO: 802305 - protein, 25 aa, Mycobacterium
DLLLVPAVLDLPDAPGARLVSNIVD

SEQ ID NO: 802306 - protein, 21 aa, Mycobacterium
DLLMLRGEYQMKVPAPFVPGL

SEQ ID NO: 802307 - protein, 22 aa, Mycobacterium
DLLNFFKDPVKGFFRALDYTLP

SEQ ID NO: 802308 - protein, 18 aa, Mycobacterium
DLLPAARPGTLFIDSSTV

SEQ ID NO: 802309 - protein, 20 aa, Mycobacterium
DLLPEAFAVAREAAWRVLDQ

SEQ ID NO: 802310 - protein, 24 aa, Mycobacterium
DLLPEAFAVAREAAWRVLNQRHFD

SEQ ID NO: 802311 - protein, 23 aa, Mycobacterium
DLLPHRRVPLRAIQRDIGIGGLF

SEQ ID NO: 802312 - protein, 20 aa, Mycobacterium
DLLRGKISKFSLDALVDIAS

SEQ ID NO: 802313 - protein, 24 aa, Mycobacterium
DLLRHYLSQWYWQVKDYVAGLTPD

SEQ ID NO: 802314 - protein, 25 aa, Mycobacterium
DLLRNAIVSFLRYIDQNQASWIVMY

SEQ ID NO: 802315 - protein, 22 aa, Mycobacterium
DLLRQRRALRETGQDPREAEIR

SEQ ID NO: 802316 - protein, 17 aa, Mycobacterium
DLLRRNLTRYGSDELVP

SEQ ID NO: 802317 - protein, 21 aa, Mycobacterium
DLLRVLSEKDLLRPHPERPGT

SEQ ID NO: 802318 - protein, 24 aa, Mycobacterium
DLLRYTQTITLWNGLDRVDCRTVV

SEQ ID NO: 802319 - protein, 25 aa, Mycobacterium
DLLSAPAIKLLIRRAGARSSDMAAE

SEQ ID NO: 802320 - protein, 26 aa, Mycobacterium
DLLSAPAVKLLIRKAGAQSADMAAEL

SEQ ID NO: 802321 - protein, 27 aa, Mycobacterium
DLLSGGPVVLFFYPAAMTPGCTKEACH

SEQ ID NO: 802322 - protein, 37 aa, Mycobacterium
DLLTADIMGPLLRIPRHPLALTRFGVPTVLPAAATAQ

SEQ ID NO: 802323 - protein, 20 aa, Mycobacterium
DLLTPFIWRMDCFGRPHLEQ

SEQ ID NO: 802324 - protein, 19 aa, Mycobacterium
DLLTPFMWRMDCFGRPHLE

SEQ ID NO: 802325 - protein, 17 aa, Mycobacterium
DLLTPVPEYRFPGLLPG

SEQ ID NO: 802326 - protein, 36 aa, Mycobacterium
DLLVDPFATFLKWAPMLYSLAYQAFQTWPMLGAVIA

SEQ ID NO: 802327 - protein, 17 aa, Mycobacterium
DLLVGHGRFIDPHTIMV

SEQ ID NO: 802328 - protein, 17 aa, Mycobacterium
DLLVLLAAGPAAVATIE

SEQ ID NO: 802329 - protein, 17 aa, Mycobacterium
DLLVRGPGWRRVPALRA

SEQ ID NO: 802330 - protein, 20 aa, Mycobacterium
DLLVVHYPYFETAGSPFTET

SEQ ID NO: 802331 - protein, 24 aa, Mycobacterium
DLLWGPAMRNYPDLKFAFSEGGIG

SEQ ID NO: 802332 - protein, 17 aa, Mycobacterium
DLLYREGITSMHFVPSL

SEQ ID NO: 802333 - protein, 24 aa, Mycobacterium
DLMDDREAQWLWAASSGERFEAPP

SEQ ID NO: 802334 - protein, 21 aa, Mycobacterium
DLMGREMLDQRFAGMKEALEN

SEQ ID NO: 802335 - protein, 17 aa, Mycobacterium
DLMKVFSDGPVVVGPTA

SEQ ID NO: 802336 - protein, 18 aa, Mycobacterium
DLMMSIDFRMTSTTLVSD

SEQ ID NO: 802337 - protein, 19 aa, Mycobacterium
DLMMSIDFRMTSTTLVSDI

SEQ ID NO: 802338 - protein, 20 aa, Mycobacterium
DLMPEAFAVAREASWRVLSQ

SEQ ID NO: 802339 - protein, 19 aa, Mycobacterium
DLMQLKLFRDYATNAPLYP

SEQ ID NO: 802340 - protein, 31 aa, Mycobacterium
DLMREHGVLKRILLIYREGIHRLQVGDPAPT

SEQ ID NO: 802341 - protein, 24 aa, Mycobacterium
DLMRVRHRLSKLLLRHGRVYSGGQ

SEQ ID NO: 802342 - protein, 17 aa, Mycobacterium
DLMRWVHPSLVANTQGT

SEQ ID NO: 802343 - protein, 20 aa, Mycobacterium
DLMSRIHAERNDRARTAGSG

SEQ ID NO: 802344 - protein, 21 aa, Mycobacterium
DLMTHLAIPIPTVTTPQMFTY

SEQ ID NO: 802345 - protein, 19 aa, Mycobacterium
DLMVAAARQAADAPLLAAV

SEQ ID NO: 802346 - protein, 20 aa, Mycobacterium
DLMVDKLLVLDSHRCDFGPV

SEQ ID NO: 802347 - protein, 24 aa, Mycobacterium
DLNAAMLALLPLVGVWRGEGEGRD

SEQ ID NO: 802348 - protein, 19 aa, Mycobacterium
DLNAHWSRLWSGQKEILEY

SEQ ID NO: 802349 - protein, 23 aa, Mycobacterium
DLNAWLADAGMPLTWRDRCGDAH

SEQ ID NO: 802350 - protein, 33 aa, Mycobacterium
DLNDPVRRALIPPLQQIVKERGLWATHLGPHLG

SEQ ID NO: 802351 - protein, 23 aa, Mycobacterium
DLNDYLNRPLWYQQQEADGVAMP

SEQ ID NO: 802352 - protein, 18 aa, Mycobacterium
DLNFQQRWLVVDVATECD

SEQ ID NO: 802353 - protein, 17 aa, Mycobacterium
DLNILRDNDFRLLAMTP

SEQ ID NO: 802354 - protein, 22 aa, Mycobacterium
DLNMNPYPVFARIREEAPLYYN

SEQ ID NO: 802355 - protein, 17 aa, Mycobacterium
DLNPYARVIADEALRRG

SEQ ID NO: 802356 - protein, 27 aa, Mycobacterium
DLNRLRTLYLTHRFGQRIASRGEGAVI

SEQ ID NO: 802357 - protein, 17 aa, Mycobacterium
DLNSQALPALRHIVRIP

SEQ ID NO: 802358 - protein, 17 aa, Mycobacterium
DLNVNGTMYVLKHAARE

SEQ ID NO: 802359 - protein, 19 aa, Mycobacterium
DLNVNGTMYVLKHAAREMV

SEQ ID NO: 802360 - protein, 32 aa, Mycobacterium
DLNWQARRYSPWLAYSQSKLANLLFTSELQRR

SEQ ID NO: 802361 - protein, 27 aa, Mycobacterium
DLNWRSRPYSAWLAYSQSKLANLLFTS

SEQ ID NO: 802362 - protein, 18 aa, Mycobacterium
DLPAADAIMLLAAHISRH

SEQ ID NO: 802363 - protein, 24 aa, Mycobacterium
DLPAERLTLLRDWLGPGYGHPTSQ

SEQ ID NO: 802364 - protein, 17 aa, Mycobacterium
DLPAIDAIAHRLNAVSV

SEQ ID NO: 802365 - protein, 20 aa, Mycobacterium
DLPALVEWYRRRDLPAWLAL

SEQ ID NO: 802366 - protein, 17 aa, Mycobacterium
DLPAPDGAAPLVLISAG

SEQ ID NO: 802367 - protein, 31 aa, Mycobacterium
DLPAPQANFVWLPLGARTRDFFERAADARIV

SEQ ID NO: 802368 - protein, 27 aa, Mycobacterium
DLPAQPAPVLIFLPGGAWVHGRCMGQG

SEQ ID NO: 802369 - protein, 20 aa, Mycobacterium
DLPATIYDLLARSAAQHANK

SEQ ID NO: 802370 - protein, 21 aa, Mycobacterium
DLPATPWLIPESTGLELLYRM

SEQ ID NO: 802371 - protein, 19 aa, Mycobacterium
DLPAWQRVQDINLKSVYLS

SEQ ID NO: 802372 - protein, 18 aa, Mycobacterium
DLPDFPFTKADPLIVNRL

SEQ ID NO: 802373 - protein, 21 aa, Mycobacterium
DLPDRRVALYVLPRTLDDVPG

SEQ ID NO: 802374 - protein, 27 aa, Mycobacterium
DLPEPGSFATGIAFLPQSAKDAATACE

SEQ ID NO: 802375 - protein, 31 aa, Mycobacterium
DLPEPTYPLHLRLCEDCLLLQIPALITPEDT

SEQ ID NO: 802376 - protein, 17 aa, Mycobacterium
DLPETRRHILASDLTAL

SEQ ID NO: 802377 - protein, 25 aa, Mycobacterium
DLPEYYRYPPDVNGIWLRANFISSV

SEQ ID NO: 802378 - protein, 18 aa, Mycobacterium
DLPFLVKLEERGGVTVPG

SEQ ID NO: 802379 - protein, 17 aa, Mycobacterium
DLPFSEIVAYLAALGDA

SEQ ID NO: 802380 - protein, 22 aa, Mycobacterium
DLPGLLAKAKLRTWLDTINNGA

SEQ ID NO: 802381 - protein, 20 aa, Mycobacterium
DLPGPAILRHSATVALLGGL

SEQ ID NO: 802382 - protein, 17 aa, Mycobacterium
DLPGRVDYVPAGRQWCA

SEQ ID NO: 802383 - protein, 19 aa, Mycobacterium
DLPGSFYRPTLIADVAETS

SEQ ID NO: 802384 - protein, 18 aa, Mycobacterium
DLPIPLPVVGGHEGAGTV

SEQ ID NO: 802385 - protein, 19 aa, Mycobacterium
DLPIPLPVVGGHEGAGTVV

SEQ ID NO: 802386 - protein, 32 aa, Mycobacterium
DLPIQPKPVQRPHPPIWFGGRAPKALARAVRH

SEQ ID NO: 802387 - protein, 33 aa, Mycobacterium
DLPKKQIDGALRFSWSHLTGEVPWDVVAQRLAQ

SEQ ID NO: 802388 - protein, 20 aa, Mycobacterium
DLPLITGNGLLRPVPGPPPD

SEQ ID NO: 802389 - protein, 20 aa, Mycobacterium
DLPLTLYSDPFAESLECQPF

SEQ ID NO: 802390 - protein, 26 aa, Mycobacterium
DLPPSHHYLAAYRWLDSAFPESFGAD

SEQ ID NO: 802391 - protein, 27 aa, Mycobacterium
DLPPSHHYLAAYRWLETGFGAHAVVHL

SEQ ID NO: 802392 - protein, 28 aa, Mycobacterium
DLPPSQANFVWLPLVGRAQQFAADAADA

SEQ ID NO: 802393 - protein, 18 aa, Mycobacterium
DLPRIIRAGKHLARPKRY

SEQ ID NO: 802394 - protein, 23 aa, Mycobacterium
DLPRLAEALTPSLARKPRFAILK

SEQ ID NO: 802395 - protein, 18 aa, Mycobacterium
DLPRLKVRFIGSAVSPEA

SEQ ID NO: 802396 - protein, 25 aa, Mycobacterium
DLPRLSSLELFPQSPLMTLETYRSI

SEQ ID NO: 802397 - protein, 17 aa, Mycobacterium
DLPSRDVILTALRRAIA

SEQ ID NO: 802398 - protein, 19 aa, Mycobacterium
DLPTAWLAEALISHLPGPS

SEQ ID NO: 802399 - protein, 21 aa, Mycobacterium
DLPVDPTLLFDGMFALVQHSL

SEQ ID NO: 802400 - protein, 18 aa, Mycobacterium
DLPVYIPVEQIRAEMPEE

SEQ ID NO: 802401 - protein, 17 aa, Mycobacterium
DLPYFTGSLARQYASTL

SEQ ID NO: 802402 - protein, 28 aa, Mycobacterium
DLPYSIDKLWSVLPDLNKYDEWMTIHTG

SEQ ID NO: 802403 - protein, 25 aa, Mycobacterium
DLQAAIPLIPLGQLLVETDAPFLTP

SEQ ID NO: 802404 - protein, 26 aa, Mycobacterium
DLQELGYPILIGASRKRFLGSLLTDL

SEQ ID NO: 802405 - protein, 24 aa, Mycobacterium
DLQELITEAWLTQAPRKLVQEFLA

SEQ ID NO: 802406 - protein, 23 aa, Mycobacterium
DLQEQLGLSYLFISHDLGVIHHV

SEQ ID NO: 802407 - protein, 18 aa, Mycobacterium
DLQERYGLSYLFVSHDLS

SEQ ID NO: 802408 - protein, 22 aa, Mycobacterium
DLQIEPLSYFLNGFDGIRSATG

SEQ ID NO: 802409 - protein, 17 aa, Mycobacterium
DLQILLNPAHPSRITQG

SEQ ID NO: 802410 - protein, 23 aa, Mycobacterium
DLQLALYMCYELHYRGFSGVDPT

SEQ ID NO: 802411 - protein, 21 aa, Mycobacterium
DLQLDFFISTSSIASVWGGFG

SEQ ID NO: 802412 - protein, 20 aa, Mycobacterium
DLQLRNRLRESVFRSYVHPY

SEQ ID NO: 802413 - protein, 20 aa, Mycobacterium
DLQLWVGACLYKGVVDVHRL

SEQ ID NO: 802414 - protein, 18 aa, Mycobacterium
DLQPFPLPALACLLRSIT

SEQ ID NO: 802415 - protein, 28 aa, Mycobacterium
DLQPRVAYSDPLILQLASRMYSVADRTD

SEQ ID NO: 802416 - protein, 24 aa, Mycobacterium
DLQPYASFFYNTEGLPYFSIGMAN

SEQ ID NO: 802417 - protein, 33 aa, Mycobacterium
DLQQRFPEVVVRPLIRFANPTRQLLVQAERSQL

SEQ ID NO: 802418 - protein, 17 aa, Mycobacterium
DLQRHGLQWNWPEVDCA

SEQ ID NO: 802419 - protein, 22 aa, Mycobacterium
DLQRLPGLVAIAYQHETSRCGD

SEQ ID NO: 802420 - protein, 18 aa, Mycobacterium
DLQRLVVEIDRIVVAVGE

SEQ ID NO: 802421 - protein, 24 aa, Mycobacterium
DLQTALGHIDAVRPSLVVVDSVQT

SEQ ID NO: 802422 - protein, 27 aa, Mycobacterium
DLQTVMSIFGTPFFASTSLAGLGMSML

SEQ ID NO: 802423 - protein, 19 aa, Mycobacterium
DLQWERKYNRVAAYGQSKL

SEQ ID NO: 802424 - protein, 19 aa, Mycobacterium
DLQWERRYNRVAAYGQSKL

SEQ ID NO: 802425 - protein, 20 aa, Mycobacterium
DLRAAFTERGWLDLTHTRRD

SEQ ID NO: 802426 - protein, 23 aa, Mycobacterium
DLRAPLLAALGAADLALATVNDL

SEQ ID NO: 802427 - protein, 23 aa, Mycobacterium
DLRAVLRDYARDMLLPSLEIYTE

SEQ ID NO: 802428 - protein, 19 aa, Mycobacterium
DLRAVLRDYSRDMILPALE

SEQ ID NO: 802429 - protein, 22 aa, Mycobacterium
DLRAWLTTVVSRLGLDKLRSAA

SEQ ID NO: 802430 - protein, 23 aa, Mycobacterium
DLRAWLTTVVSRLGLDKLRSAAH

SEQ ID NO: 802431 - protein, 23 aa, Mycobacterium
DLRDARLRLAADDLVRRQVEFQN

SEQ ID NO: 802432 - protein, 22 aa, Mycobacterium
DLRDEPRWPKYAPAAVEHGVLS

SEQ ID NO: 802433 - protein, 29 aa, Mycobacterium
DLRDKIKSLRLPLLILHSPTDNTVGIGNA

SEQ ID NO: 802434 - protein, 22 aa, Mycobacterium
DLRDWFEFLDRGGLVWSRVRLE

SEQ ID NO: 802435 - protein, 26 aa, Mycobacterium
DLRDWRQWWDWAPGASWRHPFGPDSD

SEQ ID NO: 802436 - protein, 26 aa, Mycobacterium
DLRDWRQWWDWAPGASWRHPWGPDSD

SEQ ID NO: 802437 - protein, 26 aa, Mycobacterium
DLRDWRQWWEWTPGADWRHPFGPDSS

SEQ ID NO: 802438 - protein, 30 aa, Mycobacterium
DLREGDRYLIVNPFFHTFGYKAGCIASLIR

SEQ ID NO: 802439 - protein, 24 aa, Mycobacterium
DLRELLEVLHLVFGGLHHHGARGV

SEQ ID NO: 802440 - protein, 33 aa, Mycobacterium
DLREPLPGDPPYVAVPYLDRMDLAYAAADLVIC

SEQ ID NO: 802441 - protein, 18 aa, Mycobacterium
DLRETGFWRFVNDPDDPS

SEQ ID NO: 802442 - protein, 31 aa, Mycobacterium
DLRGLTPAVRRRVIRLWLLAGGAQDLNDNQI

SEQ ID NO: 802443 - protein, 20 aa, Mycobacterium
DLRIRREETWGPVTDGAAAG

SEQ ID NO: 802444 - protein, 21 aa, Mycobacterium
DLRITRSLALPDPPRHRLRLA

SEQ ID NO: 802445 - protein, 31 aa, Mycobacterium
DLRKFLADKVARWWLPERWAVAEEIPRTSVG

SEQ ID NO: 802446 - protein, 33 aa, Mycobacterium
DLRKFLAEKVVRWWLPERWAFVEEIPRTSVGKY

SEQ ID NO: 802447 - protein, 17 aa, Mycobacterium
DLRLADDAPVPLRPANF

SEQ ID NO: 802448 - protein, 20 aa, Mycobacterium
DLRLIAQFNGGLDGYLHALR

SEQ ID NO: 802449 - protein, 21 aa, Mycobacterium
DLRNERIIVWAPPGVSHYTDF

SEQ ID NO: 802450 - protein, 20 aa, Mycobacterium
DLRPEVVSFTFGLPDDDEVK

SEQ ID NO: 802451 - protein, 23 aa, Mycobacterium
DLRPEWVMPPDEVPFAFPDERID

SEQ ID NO: 802452 - protein, 31 aa, Mycobacterium
DLRPGAIIRDLDLLRPIYAQTAAYGHFGRTD

SEQ ID NO: 802453 - protein, 32 aa, Mycobacterium
DLRPGAIVRDLDLLRPIYAPTAAYGHFGRTDI

SEQ ID NO: 802454 - protein, 17 aa, Mycobacterium
DLRPPIGRSGRAVIAGA

SEQ ID NO: 802455 - protein, 32 aa, Mycobacterium
DLRQGDRYLIVNPFFHIFGYKAGCIASLIRGA

SEQ ID NO: 802456 - protein, 26 aa, Mycobacterium
DLRQIDFVVLLGGCALDFEIPELIAD

SEQ ID NO: 802457 - protein, 20 aa, Mycobacterium
DLRQRMHGLLGYGLALEGLA

SEQ ID NO: 802458 - protein, 19 aa, Mycobacterium
DLRRFVFTSTYATVGRRRG

SEQ ID NO: 802459 - protein, 22 aa, Mycobacterium
DLRRHYGERYRIVRAESGPDAL

SEQ ID NO: 802460 - protein, 19 aa, Mycobacterium
DLRSDWPKALADAGFDKSR

SEQ ID NO: 802461 - protein, 24 aa, Mycobacterium
DLRSGKRTVLLAEALRLARQRDSA

SEQ ID NO: 802462 - protein, 26 aa, Mycobacterium
DLRSRPWVTYVVWNAGLRGFDNHLTK

SEQ ID NO: 802463 - protein, 32 aa, Mycobacterium
DLRTGDRYLIVNPFFHIFGYKAGCIASLIRGA

SEQ ID NO: 802464 - protein, 20 aa, Mycobacterium
DLRTWHGTVLAAAAFADADP

SEQ ID NO: 802465 - protein, 18 aa, Mycobacterium
DLRVALLSVPEGSTAYLA

SEQ ID NO: 802466 - protein, 19 aa, Mycobacterium
DLRVRNGFRQSMFGSYMRP

SEQ ID NO: 802467 - protein, 17 aa, Mycobacterium
DLRWRVVTALARAGVID

SEQ ID NO: 802468 - protein, 17 aa, Mycobacterium
DLRWWADRIREWTAQGR

SEQ ID NO: 802469 - protein, 17 aa, Mycobacterium
DLRWWPAEELPPGADHA

SEQ ID NO: 802470 - protein, 20 aa, Mycobacterium
DLSAEFFGAPLRAPVLIGAM

SEQ ID NO: 802471 - protein, 25 aa, Mycobacterium
DLSAGTMWLLNRPGTYSIEKAQKML

SEQ ID NO: 802472 - protein, 21 aa, Mycobacterium
DLSAKAWPRYVRIAADLPSTA

SEQ ID NO: 802473 - protein, 18 aa, Mycobacterium
DLSALKPMVSKPGTVINN

SEQ ID NO: 802474 - protein, 22 aa, Mycobacterium
DLSAREFALAEMFLRHPGQVLT

SEQ ID NO: 802475 - protein, 30 aa, Mycobacterium
DLSAYLATGEPLWVAGAFTLDGLGGWFIDR

SEQ ID NO: 802476 - protein, 18 aa, Mycobacterium
DLSDLGDWLVMHEGWRSE

SEQ ID NO: 802477 - protein, 18 aa, Mycobacterium
DLSELGEWLVIHEGWRSE

SEQ ID NO: 802478 - protein, 31 aa, Mycobacterium
DLSELRQYIDWQPFFNAWEMKGKFPDILNNP

SEQ ID NO: 802479 - protein, 25 aa, Mycobacterium
DLSERLVLMSRQYGLEPQQLLQMLQ

SEQ ID NO: 802480 - protein, 17 aa, Mycobacterium
DLSGPARWFLDHARVAL

SEQ ID NO: 802481 - protein, 22 aa, Mycobacterium
DLSHPWGHGAPAWPYFEDVKIE

SEQ ID NO: 802482 - protein, 29 aa, Mycobacterium
DLSHTWIDPILVAGPWILFGVAVVRGGCT

SEQ ID NO: 802483 - protein, 25 aa, Mycobacterium
DLSILETTTRWRPYLTGERTSYTYY

SEQ ID NO: 802484 - protein, 22 aa, Mycobacterium
DLSLAYQVFGDGPVELVWAGSF

SEQ ID NO: 802485 - protein, 19 aa, Mycobacterium
DLSLFGPLRNPELVKAFGV

SEQ ID NO: 802486 - protein, 21 aa, Mycobacterium
DLSLFLAPREGVPPKPVRLTL

SEQ ID NO: 802487 - protein, 21 aa, Mycobacterium
DLSLMVKAGVQWGLFGGAIEN

SEQ ID NO: 802488 - protein, 20 aa, Mycobacterium
DLSLMVKAGVQWGLFGGAVE

SEQ ID NO: 802489 - protein, 24 aa, Mycobacterium
DLSLPEPLSPVRFLAAVPITANEA

SEQ ID NO: 802490 - protein, 32 aa, Mycobacterium
DLSLPRALVDSFRLGLMGLAAASYRDLRPTKL

SEQ ID NO: 802491 - protein, 26 aa, Mycobacterium
DLSNPNLFTFHVTPGENNIGIGNTGN

SEQ ID NO: 802492 - protein, 17 aa, Mycobacterium
DLSPIFQNALPIVMAEA

SEQ ID NO: 802493 - protein, 17 aa, Mycobacterium
DLSPIRADFAEGLTLAT

SEQ ID NO: 802494 - protein, 26 aa, Mycobacterium
DLSPKAWPRYVWIADELPSTATNKVL

SEQ ID NO: 802495 - protein, 27 aa, Mycobacterium
DLSQLFEGVFLDLVPVIFENTGNDLDA

SEQ ID NO: 802496 - protein, 35 aa, Mycobacterium
DLSREFIRVCTIAPGLFKTPLLGSLPEEAQASLGK

SEQ ID NO: 802497 - protein, 31 aa, Mycobacterium
DLSRELIRVVTIAPGLFKTPLLGSLPEEAQK

SEQ ID NO: 802498 - protein, 22 aa, Mycobacterium
DLSRLAEDIILWSSTEFGYVTL

SEQ ID NO: 802499 - protein, 18 aa, Mycobacterium
DLSRPVVFGHEFVGRIAA

SEQ ID NO: 802500 - protein, 24 aa, Mycobacterium
DLSRRLLDEPLALSGGQSWWGGID

SEQ ID NO: 802501 - protein, 24 aa, Mycobacterium
DLSRSISEIVPLEDLPLGIEKLER

SEQ ID NO: 802502 - protein, 30 aa, Mycobacterium
DLSRTVGWFTAKYPVALRFGKPQWAKIVSG

SEQ ID NO: 802503 - protein, 20 aa, Mycobacterium
DLSRTVGWFTSKYPVALTVG

SEQ ID NO: 802504 - protein, 19 aa, Mycobacterium
DLSSLLIGGARRQWRTGIA

SEQ ID NO: 802505 - protein, 22 aa, Mycobacterium
DLSSLRFIMWGATPVSAGIAET

SEQ ID NO: 802506 - protein, 35 aa, Mycobacterium
DLSSYLIRVNTIAPGLFETPLLNSLPEAALTALKA

SEQ ID NO: 802507 - protein, 24 aa, Mycobacterium
DLSTEFLGRRLAAPVLIGAMTGGA

SEQ ID NO: 802508 - protein, 23 aa, Mycobacterium
DLSTTFFGANLRSPILIGAMTGG

SEQ ID NO: 802509 - protein, 17 aa, Mycobacterium
DLSVAIDALRRPERRRG

SEQ ID NO: 802510 - protein, 22 aa, Mycobacterium
DLSVYDIFGMFSVGAAVVAVDA

SEQ ID NO: 802511 - protein, 17 aa, Mycobacterium
DLSYLLTLLADGELDPQ

SEQ ID NO: 802512 - protein, 17 aa, Mycobacterium
DLTAKIHRLRQPVIAAV

SEQ ID NO: 802513 - protein, 22 aa, Mycobacterium
DLTARLLGARISGTDRRGKYLW

SEQ ID NO: 802514 - protein, 22 aa, Mycobacterium
DLTARLLGARITGTDRRGKYLW

SEQ ID NO: 802515 - protein, 19 aa, Mycobacterium
DLTASWLAAVIGAGPIADF

SEQ ID NO: 802516 - protein, 31 aa, Mycobacterium
DLTDKPFGVNLTILPAINPPPYDEYRQVIVD

SEQ ID NO: 802517 - protein, 22 aa, Mycobacterium
DLTDRLWSARLLTDAPQEITAV

SEQ ID NO: 802518 - protein, 19 aa, Mycobacterium
DLTDWQGQPMRIGFVARTG

SEQ ID NO: 802519 - protein, 18 aa, Mycobacterium
DLTECGVKIVWDQDHTHA

SEQ ID NO: 802520 - protein, 25 aa, Mycobacterium
DLTERLVLMSRQYGLEPQQLIQILQ

SEQ ID NO: 802521 - protein, 26 aa, Mycobacterium
DLTFASLPYRIMHEFQIPLYDQMRER

SEQ ID NO: 802522 - protein, 18 aa, Mycobacterium
DLTFLSSYCTGYERFERY

SEQ ID NO: 802523 - protein, 22 aa, Mycobacterium
DLTGIAVLDLYAGSGALGLEAL

SEQ ID NO: 802524 - protein, 25 aa, Mycobacterium
DLTGLLAEFKPEVIFHLAAQISVKR

SEQ ID NO: 802525 - protein, 17 aa, Mycobacterium
DLTGLTTVRDLAFRASP

SEQ ID NO: 802526 - protein, 22 aa, Mycobacterium
DLTGLTVPYWKTRLGSAHVTGT

SEQ ID NO: 802527 - protein, 18 aa, Mycobacterium
DLTGRPRALLKRNVLDSI

SEQ ID NO: 802528 - protein, 18 aa, Mycobacterium
DLTHKWYVEIGFCEDDIH

SEQ ID NO: 802529 - protein, 26 aa, Mycobacterium
DLTKALCAGAHAAGVIVLSCGTYGNV

SEQ ID NO: 802530 - protein, 32 aa, Mycobacterium
DLTKLPLPTLVLPPALRVALTPGWMALRPLAG

SEQ ID NO: 802531 - protein, 21 aa, Mycobacterium
DLTLDKFLDEATLAAAPSLPK

SEQ ID NO: 802532 - protein, 23 aa, Mycobacterium
DLTLNGVRLDRLTPRGAVAAGIG

SEQ ID NO: 802533 - protein, 17 aa, Mycobacterium
DLTLPPLEIPGITIPNL

SEQ ID NO: 802534 - protein, 25 aa, Mycobacterium
DLTLPPLELAGISIPAFSLPPITVP

SEQ ID NO: 802535 - protein, 19 aa, Mycobacterium
DLTNIADILLRVALGIIVF

SEQ ID NO: 802536 - protein, 20 aa, Mycobacterium
DLTNLPLRRSSHQPLLHRVW

SEQ ID NO: 802537 - protein, 25 aa, Mycobacterium
DLTQETFIRVFRSLQNYQPGTFEGW

SEQ ID NO: 802538 - protein, 25 aa, Mycobacterium
DLTQRHGAWWALGASWETDLPGGVL

SEQ ID NO: 802539 - protein, 22 aa, Mycobacterium
DLTRARRRTVLRMIEGDRILDA

SEQ ID NO: 802540 - protein, 25 aa, Mycobacterium
DLTRRLLHSGLALPTLLVAATAATV

SEQ ID NO: 802541 - protein, 47 aa, Mycobacterium
DLTTLAVPPFAPWIPKWLWALQRRMLSPFFVWFTVGLYDPPVRKRLG

SEQ ID NO: 802542 - protein, 26 aa, Mycobacterium
DLTVAIIHALNQWMLEHWGFSHANRV

SEQ ID NO: 802543 - protein, 22 aa, Mycobacterium
DLTVVDLTRALAGPHAAMMLGD

SEQ ID NO: 802544 - protein, 19 aa, Mycobacterium
DLTYCSLRLDPESLQTALQ

SEQ ID NO: 802545 - protein, 18 aa, Mycobacterium
DLTYNDVFIMPNRSLVAS

SEQ ID NO: 802546 - protein, 21 aa, Mycobacterium
DLVAAHRVFTALIAAMRVFRT

SEQ ID NO: 802547 - protein, 17 aa, Mycobacterium
DLVAALPHRAAQRVWQL

SEQ ID NO: 802548 - protein, 18 aa, Mycobacterium
DLVALMKVGLRRGKIIAV

SEQ ID NO: 802549 - protein, 18 aa, Mycobacterium
DLVALMKVGLRRGQIVVV

SEQ ID NO: 802550 - protein, 25 aa, Mycobacterium
DLVAPLARALALGVHRLLSWGILDT

SEQ ID NO: 802551 - protein, 24 aa, Mycobacterium
DLVAPLARALAVGVHRLLCWGIVG

SEQ ID NO: 802552 - protein, 30 aa, Mycobacterium
DLVARLQVLIDLGLGYLTLSRRTPTVSPGE

SEQ ID NO: 802553 - protein, 20 aa, Mycobacterium
DLVASLLLVHGLHPHDVHRR

SEQ ID NO: 802554 - protein, 17 aa, Mycobacterium
DLVAVRQALQEAGIDYE

SEQ ID NO: 802555 - protein, 19 aa, Mycobacterium
DLVAWRRHIHRYPELGRQE

SEQ ID NO: 802556 - protein, 19 aa, Mycobacterium
DLVDGAPKPLLEKVAKEAA

SEQ ID NO: 802557 - protein, 18 aa, Mycobacterium
DLVDGLVSAIRVLSAGIS

SEQ ID NO: 802558 - protein, 38 aa, Mycobacterium
DLVDGTAFVRLLRYLPGGTLLESGYLPPAAVAGLGDVA

SEQ ID NO: 802559 - protein, 23 aa, Mycobacterium
DLVDIYHRALWDPGLSGPVNAVA

SEQ ID NO: 802560 - protein, 23 aa, Mycobacterium
DLVDIYHRALWDTALSGPVNAVA

SEQ ID NO: 802561 - protein, 21 aa, Mycobacterium
DLVDLPHLVTAYYTLEPDPDD

SEQ ID NO: 802562 - protein, 26 aa, Mycobacterium
DLVDPALLRPGRLERLVFVEPPDAAA

SEQ ID NO: 802563 - protein, 29 aa, Mycobacterium
DLVDPDAWAFVWVVDPPLFEPADEATAAG

SEQ ID NO: 802564 - protein, 19 aa, Mycobacterium
DLVDSAPKPLLEKVAKEAA

SEQ ID NO: 802565 - protein, 24 aa, Mycobacterium
DLVEEIFPRLLRGDEFWCQGFSEP

SEQ ID NO: 802566 - protein, 24 aa, Mycobacterium
DLVEQPLLARVDLGASPAAVHAID

SEQ ID NO: 802567 - protein, 17 aa, Mycobacterium
DLVERLAIPLPVEMICH

SEQ ID NO: 802568 - protein, 23 aa, Mycobacterium
DLVEWQLRVAAGEKLPFAQDDIE

SEQ ID NO: 802569 - protein, 21 aa, Mycobacterium
DLVEYYFNQPWSDGLPVVPPT

SEQ ID NO: 802570 - protein, 20 aa, Mycobacterium
DLVFIGFAQAIPTLFPFVEC

SEQ ID NO: 802571 - protein, 22 aa, Mycobacterium
DLVGALSVIRPLSRSASEEVSV

SEQ ID NO: 802572 - protein, 19 aa, Mycobacterium
DLVGFFKDPVKGFFRALEF

SEQ ID NO: 802573 - protein, 26 aa, Mycobacterium
DLVGNNFPVFFIQDGIKFPDFVHAVK

SEQ ID NO: 802574 - protein, 26 aa, Mycobacterium
DLVGNNFPVFFIQDGIKFPDLVHAVK

SEQ ID NO: 802575 - protein, 21 aa, Mycobacterium
DLVGRFLLKGGETIWVDGPLT

SEQ ID NO: 802576 - protein, 19 aa, Mycobacterium
DLVGRFLLKGGETVWVDGP

SEQ ID NO: 802577 - protein, 20 aa, Mycobacterium
DLVGTSLPHPFVDRQLIIVA

SEQ ID NO: 802578 - protein, 18 aa, Mycobacterium
DLVHLTPVGSHRGTVQPL

SEQ ID NO: 802579 - protein, 17 aa, Mycobacterium
DLVIFGSPTWWDTVSMP

SEQ ID NO: 802580 - protein, 23 aa, Mycobacterium
DLVIPMIGLLKRKAERRLTDTAL

SEQ ID NO: 802581 - protein, 20 aa, Mycobacterium
DLVKLWLTDEGDIDARWTSL

SEQ ID NO: 802582 - protein, 21 aa, Mycobacterium
DLVKLWLTDEGDIDARWVELS

SEQ ID NO: 802583 - protein, 25 aa, Mycobacterium
DLVKRPEWLAPMLPVIRDDLRMCGV

SEQ ID NO: 802584 - protein, 20 aa, Mycobacterium
DLVLAIYNPASKTRIWQVGA

SEQ ID NO: 802585 - protein, 23 aa, Mycobacterium
DLVLDALTMFGAIGFTWEHDLHL

SEQ ID NO: 802586 - protein, 22 aa, Mycobacterium
DLVLDTLTMFGAIGYTWEHDLH

SEQ ID NO: 802587 - protein, 19 aa, Mycobacterium
DLVLQQFKIANGEKLDITE

SEQ ID NO: 802588 - protein, 20 aa, Mycobacterium
DLVLRRWHGLGPMGGTDLDA

SEQ ID NO: 802589 - protein, 17 aa, Mycobacterium
DLVLWDLSTLGHSGIED

SEQ ID NO: 802590 - protein, 20 aa, Mycobacterium
DLVMALVSGVLRQYLAERNA

SEQ ID NO: 802591 - protein, 17 aa, Mycobacterium
DLVMIESATFWKEAPEV

SEQ ID NO: 802592 - protein, 30 aa, Mycobacterium
DLVNPHPMFVPWLVGPLLTREGIHLVKSFY

SEQ ID NO: 802593 - protein, 29 aa, Mycobacterium
DLVNPNPMFVPWLVGPLLTGEGIHLVKSF

SEQ ID NO: 802594 - protein, 17 aa, Mycobacterium
DLVPLLFAHTTYKTYAE

SEQ ID NO: 802595 - protein, 23 aa, Mycobacterium
DLVQETYLRAWKSYQGFQGRSSV

SEQ ID NO: 802596 - protein, 17 aa, Mycobacterium
DLVQIVADFRPGPDCRL

SEQ ID NO: 802597 - protein, 18 aa, Mycobacterium
DLVQLFPAAAYGKNGADI

SEQ ID NO: 802598 - protein, 20 aa, Mycobacterium
DLVRAQLLVAAGEPLPDEML

SEQ ID NO: 802599 - protein, 25 aa, Mycobacterium
DLVRDFTFEFPTRVIARLLGLPADD

SEQ ID NO: 802600 - protein, 18 aa, Mycobacterium
DLVRDGVFVGYQLDRAFA

SEQ ID NO: 802601 - protein, 22 aa, Mycobacterium
DLVRIVADFRPGPRCRLGVLVD

SEQ ID NO: 802602 - protein, 18 aa, Mycobacterium
DLVRLGVDGHRWGGLPLR

SEQ ID NO: 802603 - protein, 25 aa, Mycobacterium
DLVRQFTFEFPTRVIATLLGLPADD

SEQ ID NO: 802604 - protein, 26 aa, Mycobacterium
DLVSKIVGPPMPLTFQRMGLGDLVDD

SEQ ID NO: 802605 - protein, 28 aa, Mycobacterium
DLVSLTQILAWDLPLTKKIGDLLANQAR

SEQ ID NO: 802606 - protein, 27 aa, Mycobacterium
DLVSLTQILAWDLPLTKKLSDQVAKQA

SEQ ID NO: 802607 - protein, 26 aa, Mycobacterium
DLVSLTQVVAWDLPLTKKVSDQVAKQ

SEQ ID NO: 802608 - protein, 17 aa, Mycobacterium
DLVSQYTCRLLKYMDKE

SEQ ID NO: 802609 - protein, 17 aa, Mycobacterium
DLVTTLWQEHQVGVLLV

SEQ ID NO: 802610 - protein, 30 aa, Mycobacterium
DLVTVALVVPLFEWYRQLLPDRLHQIGEIL

SEQ ID NO: 802611 - protein, 22 aa, Mycobacterium
DLVVALERLGYWGVPGPVTESI

SEQ ID NO: 802612 - protein, 25 aa, Mycobacterium
DLVVFALSFHHLPPSLAAKVFVEGT

SEQ ID NO: 802613 - protein, 23 aa, Mycobacterium
DLVVGALPFDLTGPAALHAPASA

SEQ ID NO: 802614 - protein, 22 aa, Mycobacterium
DLVVLARYMQILTPGFIEQVGC

SEQ ID NO: 802615 - protein, 18 aa, Mycobacterium
DLVVLDHDLAVTAVMRAG

SEQ ID NO: 802616 - protein, 23 aa, Mycobacterium
DLVVPMIGLLKRKAERRLTDTAL

SEQ ID NO: 802617 - protein, 31 aa, Mycobacterium
DLVVPRPEVTRWFDALVAAGVRPAGLWAYEA

SEQ ID NO: 802618 - protein, 23 aa, Mycobacterium
DLVVPYRTGLLLPVAEFETRLPA

SEQ ID NO: 802619 - protein, 18 aa, Mycobacterium
DLVVRRRLRELRAQRGMT

SEQ ID NO: 802620 - protein, 17 aa, Mycobacterium
DLVWQIGTGYFGCRNDD

SEQ ID NO: 802621 - protein, 18 aa, Mycobacterium
DLVYGLGTLITGLPGVLS

SEQ ID NO: 802622 - protein, 19 aa, Mycobacterium
DLVYGLGTLITGLPGVLSR

SEQ ID NO: 802623 - protein, 18 aa, Mycobacterium
DLWAGWERLRAKGLAAAE

SEQ ID NO: 802624 - protein, 17 aa, Mycobacterium
DLWDYRGINPVPEPKPF

SEQ ID NO: 802625 - protein, 25 aa, Mycobacterium
DLWGRYRLRGSGRPPFPPAGLPHDR

SEQ ID NO: 802626 - protein, 17 aa, Mycobacterium
DLWLAIAERFISAGAAE

SEQ ID NO: 802627 - protein, 18 aa, Mycobacterium
DLWLFRGRSGPDRAIQTL

SEQ ID NO: 802628 - protein, 17 aa, Mycobacterium
DLYAVQLDVALSGPLDP

SEQ ID NO: 802629 - protein, 21 aa, Mycobacterium
DLYCELAGRPPLTVPARQVEI

SEQ ID NO: 802630 - protein, 32 aa, Mycobacterium
DLYGFFAAMTVPPVAPFPEAFHLHKACAVVWC

SEQ ID NO: 802631 - protein, 27 aa, Mycobacterium
DLYQHWDAFQEWARTAALPAPSARVGT

SEQ ID NO: 802632 - protein, 19 aa, Mycobacterium
DLYSCFPSAVQVAANELGL

SEQ ID NO: 802633 - protein, 20 aa, Mycobacterium
DLYVVMARLRRTTGPDAQML

SEQ ID NO: 802634 - protein, 29 aa, Mycobacterium
DMAAVDALLVRLFIRLSMALWGRRDGRAV

SEQ ID NO: 802635 - protein, 21 aa, Mycobacterium
DMADYLILGACNPPLAHQAVL

SEQ ID NO: 802636 - protein, 27 aa, Mycobacterium
DMAGCSLTVMWLDEELERYWAAPADTP

SEQ ID NO: 802637 - protein, 22 aa, Mycobacterium
DMAGTAGFLWLEVDDVVRETMA

SEQ ID NO: 802638 - protein, 41 aa, Mycobacterium
DMAKVPYYRVLELAPWLSWPQPNFPVSNFFHGGAAPLNAIL

SEQ ID NO: 802639 - protein, 21 aa, Mycobacterium
DMAKWQKVIDVNLTGTFLGMQ

SEQ ID NO: 802640 - protein, 19 aa, Mycobacterium
DMALVPMRTIPNAEFHVFP

SEQ ID NO: 802641 - protein, 20 aa, Mycobacterium
DMALVPMRTIPNAELHVFPN

SEQ ID NO: 802642 - protein, 29 aa, Mycobacterium
DMAQLYDGFSFLTVMWLEAMGFCEHGKVG

SEQ ID NO: 802643 - protein, 24 aa, Mycobacterium
DMARPRFGSWLRNPTRGSLAMDPR

SEQ ID NO: 802644 - protein, 20 aa, Mycobacterium
DMARPRFGSWLRNSTRGALA

SEQ ID NO: 802645 - protein, 41 aa, Mycobacterium
DMARRGLEPFTFRPALTVGWRLWMDIGFKLASDPDELRELL

SEQ ID NO: 802646 - protein, 17 aa, Mycobacterium
DMCTFGFRFKPWHSPRF

SEQ ID NO: 802647 - protein, 22 aa, Mycobacterium
DMDDFLVLQRDWGADGGLRTVP

SEQ ID NO: 802648 - protein, 18 aa, Mycobacterium
DMDDGLPGSIWIDEALRT

SEQ ID NO: 802649 - protein, 25 aa, Mycobacterium
DMDEPKHRILRRIVSPLFTPKAVNG

SEQ ID NO: 802650 - protein, 23 aa, Mycobacterium
DMDPVLATLFNPLGAGIQWGKTL

SEQ ID NO: 802651 - protein, 24 aa, Mycobacterium
DMDQLFITAAAYPPEILLTGIIVN

SEQ ID NO: 802652 - protein, 23 aa, Mycobacterium
DMDTLLTLLGAAGTAFVITVPGA

SEQ ID NO: 802653 - protein, 24 aa, Mycobacterium
DMDTLLTLLGVAGAAFVIAVPGAD

SEQ ID NO: 802654 - protein, 27 aa, Mycobacterium
DMDWDDFEWLMGINFWGVAHGTKAFMP

SEQ ID NO: 802655 - protein, 24 aa, Mycobacterium
DMEAGFERWLKALDYLQTDVQVYL

SEQ ID NO: 802656 - protein, 23 aa, Mycobacterium
DMEDYLILGACNPPLAHRAIGVN

SEQ ID NO: 802657 - protein, 23 aa, Mycobacterium
DMEDYLILGACNPPLAHRAVNAD

SEQ ID NO: 802658 - protein, 25 aa, Mycobacterium
DMELPFAGVHRLIAVLWGEPVEELP

SEQ ID NO: 802659 - protein, 18 aa, Mycobacterium
DMEPFFDAFRAVKPYLIT

SEQ ID NO: 802660 - protein, 17 aa, Mycobacterium
DMFFRYNQSLQHFINKS

SEQ ID NO: 802661 - protein, 17 aa, Mycobacterium
DMFHVLGGYGPDLGGEI

SEQ ID NO: 802662 - protein, 18 aa, Mycobacterium
DMFVHTRGLAEKDLKLAL

SEQ ID NO: 802663 - protein, 17 aa, Mycobacterium
DMFVVRTAGQAIDSAVL

SEQ ID NO: 802664 - protein, 22 aa, Mycobacterium
DMGLMLGEYWDLTALAADCAAD

SEQ ID NO: 802665 - protein, 22 aa, Mycobacterium
DMGLMLGEYWDLTALAADCATD

SEQ ID NO: 802666 - protein, 22 aa, Mycobacterium
DMGLMLGEYWDLTALADDCARD

SEQ ID NO: 802667 - protein, 20 aa, Mycobacterium
DMGLVLGVCAPILGGYRADL

SEQ ID NO: 802668 - protein, 18 aa, Mycobacterium
DMGLVLGVCAPILSGHRA

SEQ ID NO: 802669 - protein, 26 aa, Mycobacterium
DMGMGGSIPFIAEFAAAFPQAKILVT

SEQ ID NO: 802670 - protein, 17 aa, Mycobacterium
DMGMVFQAYSLFPHLTV

SEQ ID NO: 802671 - protein, 18 aa, Mycobacterium
DMGPLDFPSINWAPIEWS

SEQ ID NO: 802672 - protein, 25 aa, Mycobacterium
DMGPLDFPSTNWAPIEWRNIEDQEK

SEQ ID NO: 802673 - protein, 23 aa, Mycobacterium
DMGRFAQALLDRVAGRPSPFPLS

SEQ ID NO: 802674 - protein, 26 aa, Mycobacterium
DMGRNFLTKLGILSPATAAADPGITN

SEQ ID NO: 802675 - protein, 22 aa, Mycobacterium
DMGTKLYAARSLLLSAAEKFDA

SEQ ID NO: 802676 - protein, 28 aa, Mycobacterium
DMGTVAYRFTWHLPKNRTWSYDGQLKMA

SEQ ID NO: 802677 - protein, 25 aa, Mycobacterium
DMGVEHGFIRKSGSWFTYEGEQLGQ

SEQ ID NO: 802678 - protein, 30 aa, Mycobacterium
DMHAHRLALLWPEMYPRLLRIMDADPIYQD

SEQ ID NO: 802679 - protein, 19 aa, Mycobacterium
DMHALRLQGSPSARARIGL

SEQ ID NO: 802680 - protein, 18 aa, Mycobacterium
DMHFFADPVAPRFLDTLT

SEQ ID NO: 802681 - protein, 25 aa, Mycobacterium
DMHMHRLEAFDPQLYARIVQTPREV

SEQ ID NO: 802682 - protein, 31 aa, Mycobacterium
DMHPAQLVTRYLATYAFYRGAFSPAAARLRN

SEQ ID NO: 802683 - protein, 31 aa, Mycobacterium
DMHPGHLVTRWLATFAFFRAAMAAAAPRLQN

SEQ ID NO: 802684 - protein, 25 aa, Mycobacterium
DMHTYACGLLHFRTQRWSDVLGLFP

SEQ ID NO: 802685 - protein, 25 aa, Mycobacterium
DMHVAALVGALRLLDQLKATWSGTV

SEQ ID NO: 802686 - protein, 30 aa, Mycobacterium
DMHVHRLAVLWPEVYPRLLRVMDADPICQD

SEQ ID NO: 802687 - protein, 18 aa, Mycobacterium
DMIARIVAELRTGRGAVI

SEQ ID NO: 802688 - protein, 19 aa, Mycobacterium
DMIEPIEFPELLRLRRWCS

SEQ ID NO: 802689 - protein, 19 aa, Mycobacterium
DMIIDVALDLAAHQSAQSP

SEQ ID NO: 802690 - protein, 24 aa, Mycobacterium
DMIKGLERGHLWFHLHGRTLCGGY

SEQ ID NO: 802691 - protein, 20 aa, Mycobacterium
DMIMTAMMLLRKGGTCVLTG

SEQ ID NO: 802692 - protein, 24 aa, Mycobacterium
DMITALICHGTLTRFPKLRIASVE

SEQ ID NO: 802693 - protein, 25 aa, Mycobacterium
DMITSLICHGTLTRFPKLRIASVEN

SEQ ID NO: 802694 - protein, 21 aa, Mycobacterium
DMKFTRFIYKEIFPGGQLPSD

SEQ ID NO: 802695 - protein, 24 aa, Mycobacterium
DMKGKPIILLTTVGAKTGKLRKTP

SEQ ID NO: 802696 - protein, 24 aa, Mycobacterium
DMKGKPILVLTTIGAKTGKLRKTP

SEQ ID NO: 802697 - protein, 18 aa, Mycobacterium
DMKSGDAVFLHLAATVTP

SEQ ID NO: 802698 - protein, 18 aa, Mycobacterium
DMKTPGITVRPLREITGE

SEQ ID NO: 802699 - protein, 17 aa, Mycobacterium
DMLAAAASDLTNIGSTL

SEQ ID NO: 802700 - protein, 19 aa, Mycobacterium
DMLDLDGLVTWIGERHARG

SEQ ID NO: 802701 - protein, 25 aa, Mycobacterium
DMLDRCTEFLPILRGAQLDDLDPVR

SEQ ID NO: 802702 - protein, 17 aa, Mycobacterium
DMLGLPYQRPAAYTRDY

SEQ ID NO: 802703 - protein, 18 aa, Mycobacterium
DMLLLDDATPVWVSAAVT

SEQ ID NO: 802704 - protein, 19 aa, Mycobacterium
DMLPRPLLDVLFATDRETA

SEQ ID NO: 802705 - protein, 24 aa, Mycobacterium
DMLSGALEALRFDGSVFSDPSQWG

SEQ ID NO: 802706 - protein, 20 aa, Mycobacterium
DMLSTVYRLVADGALPMPQS

SEQ ID NO: 802707 - protein, 24 aa, Mycobacterium
DMLTALICHGTLTRFPRLRIASVE

SEQ ID NO: 802708 - protein, 25 aa, Mycobacterium
DMLTSLICHGTLTRFPKLRIASVEN

SEQ ID NO: 802709 - protein, 26 aa, Mycobacterium
DMLVEGRHFRLDWSTPHDIGRKAIAQ

SEQ ID NO: 802710 - protein, 17 aa, Mycobacterium
DMMAWTLAMGHAMIRAG

SEQ ID NO: 802711 - protein, 20 aa, Mycobacterium
DMMEILLRIFDDGDIFEISE

SEQ ID NO: 802712 - protein, 20 aa, Mycobacterium
DMMKIHMGVAMISSSIAEKV

SEQ ID NO: 802713 - protein, 33 aa, Mycobacterium
DMMLNARYYARQAVKLLAPKRVQGLLPGVVKTV

SEQ ID NO: 802714 - protein, 25 aa, Mycobacterium
DMMRLWVEAEVLRLAGERLRQQAAS

SEQ ID NO: 802715 - protein, 25 aa, Mycobacterium
DMNCKLLVEIGPRPVLTAAALSAWP

SEQ ID NO: 802716 - protein, 20 aa, Mycobacterium
DMNCKVLLEIGPQPVLTAAA

SEQ ID NO: 802717 - protein, 21 aa, Mycobacterium
DMNLWKAQRVLQSAGAGVLDL

SEQ ID NO: 802718 - protein, 31 aa, Mycobacterium
DMPGVTPAMWSWWFGWHGCDTRRYKLWHPRA

SEQ ID NO: 802719 - protein, 31 aa, Mycobacterium
DMPGVTPAMWVWWFGWHGCDTRRYKLWHPRA

SEQ ID NO: 802720 - protein, 23 aa, Mycobacterium
DMPNDLPILRWAGHGVAMGNAHP

SEQ ID NO: 802721 - protein, 18 aa, Mycobacterium
DMPPPQWGDAGMYLQTIM

SEQ ID NO: 802722 - protein, 18 aa, Mycobacterium
DMPPVVWTVLMSSLSWFL

SEQ ID NO: 802723 - protein, 17 aa, Mycobacterium
DMQLELILPVSGTSIYT

SEQ ID NO: 802724 - protein, 17 aa, Mycobacterium
DMQLRRLAALERQRIVD

SEQ ID NO: 802725 - protein, 27 aa, Mycobacterium
DMQNLALFTKFWRKALPTLSNSAFMDE

SEQ ID NO: 802726 - protein, 17 aa, Mycobacterium
DMQRWMEFSAKSDLLMY

SEQ ID NO: 802727 - protein, 19 aa, Mycobacterium
DMRAWFSDQAHSRGLTYEC

SEQ ID NO: 802728 - protein, 25 aa, Mycobacterium
DMRCKWRKWLTFQCNWKVAMEAFNE

SEQ ID NO: 802729 - protein, 20 aa, Mycobacterium
DMRDLAPAVARLRHLLDLDA

SEQ ID NO: 802730 - protein, 17 aa, Mycobacterium
DMREVLAGIRALGLTRP

SEQ ID NO: 802731 - protein, 17 aa, Mycobacterium
DMREYLTRLLRSADYRV

SEQ ID NO: 802732 - protein, 26 aa, Mycobacterium
DMRGRRIWMLATWNVLYNISKAGLDV

SEQ ID NO: 802733 - protein, 22 aa, Mycobacterium
DMRHHLDRVLSAHFETIVAADG

SEQ ID NO: 802734 - protein, 23 aa, Mycobacterium
DMRSAWFARDEVERMIREGVIAD

SEQ ID NO: 802735 - protein, 19 aa, Mycobacterium
DMSDAALRSLYADIKRLSP

SEQ ID NO: 802736 - protein, 19 aa, Mycobacterium
DMSFDRWRQQWQGVHTQNA

SEQ ID NO: 802737 - protein, 18 aa, Mycobacterium
DMSLLDRWYAAIGHELHT

SEQ ID NO: 802738 - protein, 24 aa, Mycobacterium
DMSLVQRVWHLAGILNAIGDELGR

SEQ ID NO: 802739 - protein, 28 aa, Mycobacterium
DMSLVTMATGLIPYVGRAAQTAAEIAMV

SEQ ID NO: 802740 - protein, 21 aa, Mycobacterium
DMSWKDFDWLIGINIGGVVNG

SEQ ID NO: 802741 - protein, 19 aa, Mycobacterium
DMTEGMLELLLRELDVHPG

SEQ ID NO: 802742 - protein, 21 aa, Mycobacterium
DMTEGMLELLLRELDVHPGDV

SEQ ID NO: 802743 - protein, 24 aa, Mycobacterium
DMTEGMLELLLRELDVHPGDVIEV

SEQ ID NO: 802744 - protein, 28 aa, Mycobacterium
DMTHDDWRWVIDIDLWGSIHAVEAFLPG

SEQ ID NO: 802745 - protein, 30 aa, Mycobacterium
DMTKIELRRLSYVQRLAAILGRQVWEDAGA

SEQ ID NO: 802746 - protein, 27 aa, Mycobacterium
DMTLDMPLIDFFSRGGSLKSSWYGDCL

SEQ ID NO: 802747 - protein, 26 aa, Mycobacterium
DMTLEMPLVDFFSHGGSLKSSWYGDC

SEQ ID NO: 802748 - protein, 25 aa, Mycobacterium
DMTRTFVLGKAADWQLEIYQLVADS

SEQ ID NO: 802749 - protein, 23 aa, Mycobacterium
DMTRTFVLGKAADWQLELYQLVS

SEQ ID NO: 802750 - protein, 17 aa, Mycobacterium
DMTVCILDRPRHAQLIE

SEQ ID NO: 802751 - protein, 27 aa, Mycobacterium
DMTVLIDLQFATMWMQPLMINDASKVA

SEQ ID NO: 802752 - protein, 23 aa, Mycobacterium
DMTVRWFPLTEAVSKVFTGEIVN

SEQ ID NO: 802753 - protein, 24 aa, Mycobacterium
DMVDGKVFGYFLLGQNPAVGSAHG

SEQ ID NO: 802754 - protein, 22 aa, Mycobacterium
DMVLAMSAGTLRKLLLRYDGQA

SEQ ID NO: 802755 - protein, 19 aa, Mycobacterium
DMWGRPKVRLSGEIAKHLE

SEQ ID NO: 802756 - protein, 21 aa, Mycobacterium
DMYAYLHDQTLRLLNRGYTGV

SEQ ID NO: 802757 - protein, 19 aa, Mycobacterium
DMYWSLFREHERRLRDEFM

SEQ ID NO: 802758 - protein, 18 aa, Mycobacterium
DNAAFRTALRDLTLMLVY

SEQ ID NO: 802759 - protein, 32 aa, Mycobacterium
DNAGAFEPGTPWLLRFFDQINWYPVSGEELLE

SEQ ID NO: 802760 - protein, 29 aa, Mycobacterium
DNAGPNLAFQLLWYPSTMWDQSLPSFKEN

SEQ ID NO: 802761 - protein, 25 aa, Mycobacterium
DNAGRLDCTVWGGIMSRVAAARGIA

SEQ ID NO: 802762 - protein, 28 aa, Mycobacterium
DNAKDEARRNWIISALARGGDIGSLQRF

SEQ ID NO: 802763 - protein, 17 aa, Mycobacterium
DNALLEWADIHGGLHRS

SEQ ID NO: 802764 - protein, 20 aa, Mycobacterium
DNALLKSVLSQPGAGGVLVI

SEQ ID NO: 802765 - protein, 31 aa, Mycobacterium
DNANLDKARRLLWPIKQKYGNKISWADLIAY

SEQ ID NO: 802766 - protein, 29 aa, Mycobacterium
DNAQQELYLPDVIAILRRDGQTVSARHID

SEQ ID NO: 802767 - protein, 18 aa, Mycobacterium
DNARRAAAACPALAIEIH

SEQ ID NO: 802768 - protein, 31 aa, Mycobacterium
DNASLDKARRLLWPIKKKYGNKISWADLITY

SEQ ID NO: 802769 - protein, 27 aa, Mycobacterium
DNASLDKARRLLWPVKKKYGKNLSWAD

SEQ ID NO: 802770 - protein, 23 aa, Mycobacterium
DNASWVYRTLYARVGNRADAEDL

SEQ ID NO: 802771 - protein, 25 aa, Mycobacterium
DNATGWVNFPLPYEGPPGLVHGGFL

SEQ ID NO: 802772 - protein, 22 aa, Mycobacterium
DNAVPPLPRGAAWVFVEVVGDT

SEQ ID NO: 802773 - protein, 36 aa, Mycobacterium
DNAWFIAESVGAGSFPWVLAITPPYTDSAQRSAFFD

SEQ ID NO: 802774 - protein, 19 aa, Mycobacterium
DNAYALMWGAEDLFAELGG

SEQ ID NO: 802775 - protein, 23 aa, Mycobacterium
DNCKLIDWPIATLSPVGVRTSDG

SEQ ID NO: 802776 - protein, 22 aa, Mycobacterium
DNCKLISWPIATLSPNGVRTAD

SEQ ID NO: 802777 - protein, 19 aa, Mycobacterium
DNCKLVPWPVTGVSAIGVR

SEQ ID NO: 802778 - protein, 18 aa, Mycobacterium
DNCQAAFDVFPDFAFYPQ

SEQ ID NO: 802779 - protein, 29 aa, Mycobacterium
DNDAYCYIPLLEELGFMPSKKFADGAEIF

SEQ ID NO: 802780 - protein, 22 aa, Mycobacterium
DNDIDTVWFGAAAPLALLAQRA

SEQ ID NO: 802781 - protein, 22 aa, Mycobacterium
DNDIRGDWLTAMRSTLAGMTAS

SEQ ID NO: 802782 - protein, 26 aa, Mycobacterium
DNDIVLVDFWASWCGPCKAFAPTFAA

SEQ ID NO: 802783 - protein, 25 aa, Mycobacterium
DNDNELFFGSYQPLAATSGLRIGAE

SEQ ID NO: 802784 - protein, 33 aa, Mycobacterium
DNDPALYLIGKRYRFHPLALSNFLAALEASVLN

SEQ ID NO: 802785 - protein, 29 aa, Mycobacterium
DNDPGLPTLIVDPYFRDAIEAAIDSWRRV

SEQ ID NO: 802786 - protein, 23 aa, Mycobacterium
DNDRTPVFYCKTGIRSAEVLAIV

SEQ ID NO: 802787 - protein, 24 aa, Mycobacterium
DNDWYQWHWRVHVGLWAAASASKI

SEQ ID NO: 802788 - protein, 25 aa, Mycobacterium
DNDYDLSSLFLLASTAALFSPSIKE

SEQ ID NO: 802789 - protein, 26 aa, Mycobacterium
DNEAATFGIAYLTAWHSLCEVGRLSP

SEQ ID NO: 802790 - protein, 22 aa, Mycobacterium
DNECRFLLQRGPAEDVTALGWQ

SEQ ID NO: 802791 - protein, 26 aa, Mycobacterium
DNEIVLVDFWASWCGPCKAFAPTFAA

SEQ ID NO: 802792 - protein, 25 aa, Mycobacterium
DNEQVLFCGLWYDDEFARTPEGWRM

SEQ ID NO: 802793 - protein, 18 aa, Mycobacterium
DNERLIPYRASRSAFAFK

SEQ ID NO: 802794 - protein, 19 aa, Mycobacterium
DNERLIPYRASRSAFAFKD

SEQ ID NO: 802795 - protein, 18 aa, Mycobacterium
DNERLIRYRASRSAFAFK

SEQ ID NO: 802796 - protein, 26 aa, Mycobacterium
DNESYCYIPLLEELDFMPSKKFADGA

SEQ ID NO: 802797 - protein, 29 aa, Mycobacterium
DNESYCYIPLLEELGFMPSKKFADGAEIF

SEQ ID NO: 802798 - protein, 25 aa, Mycobacterium
DNETGVIYRAWRSRANMHQQLSRLR

SEQ ID NO: 802799 - protein, 23 aa, Mycobacterium
DNEVWGIARFTDPTARQGLEAAG

SEQ ID NO: 802800 - protein, 21 aa, Mycobacterium
DNEWVQREIQWRVELAEKAAA

SEQ ID NO: 802801 - protein, 19 aa, Mycobacterium
DNFLVTDVYLGATSIILPR

SEQ ID NO: 802802 - protein, 30 aa, Mycobacterium
DNFMTQGWFTGLIPITVPIAAASFGDAAWA

SEQ ID NO: 802803 - protein, 30 aa, Mycobacterium
DNFMTQGWFTGLIPITVPIGAASFGEAAWA

SEQ ID NO: 802804 - protein, 28 aa, Mycobacterium
DNFMTQGWFTGLIPITVPIGAASFTEAA

SEQ ID NO: 802805 - protein, 25 aa, Mycobacterium
DNFQALLRNAGWVGPLLGDLISPIR

SEQ ID NO: 802806 - protein, 21 aa, Mycobacterium
DNFVFPPGMVLVLEPVVWEDG

SEQ ID NO: 802807 - protein, 29 aa, Mycobacterium
DNGAPPIAFQLLWYPSTMWDASLPSFTEN

SEQ ID NO: 802808 - protein, 18 aa, Mycobacterium
DNGAWDSLWVYDHFHTVP

SEQ ID NO: 802809 - protein, 30 aa, Mycobacterium
DNGDPDVNNLYWNMSLWGDYNVVLMQTDLS

SEQ ID NO: 802810 - protein, 26 aa, Mycobacterium
DNGDSPHRFLYYPAENHWVLTPQHAK

SEQ ID NO: 802811 - protein, 22 aa, Mycobacterium
DNGEYLVQILGAPGASSHLLAT

SEQ ID NO: 802812 - protein, 27 aa, Mycobacterium
DNGFIPMIPPVLVRPEVMAGTGFLGAH

SEQ ID NO: 802813 - protein, 26 aa, Mycobacterium
DNGGWPFYHMEMMLAGIPIPVPPGEA

SEQ ID NO: 802814 - protein, 26 aa, Mycobacterium
DNGGWPFYHMEMMLAGIPIPVPPGEP

SEQ ID NO: 802815 - protein, 26 aa, Mycobacterium
DNGIDLAFQVLWYPATTFDTTLPSMV

SEQ ID NO: 802816 - protein, 28 aa, Mycobacterium
DNGIDRMRAWPLWWGSSAAWHGPQVLDR

SEQ ID NO: 802817 - protein, 19 aa, Mycobacterium
DNGKAAGYLFSWTNEASSG

SEQ ID NO: 802818 - protein, 24 aa, Mycobacterium
DNGMTPIPTRHSLERIRAVRRTAK

SEQ ID NO: 802819 - protein, 26 aa, Mycobacterium
DNGNWTWRYDAIRSFPDFASLWDDVD

SEQ ID NO: 802820 - protein, 24 aa, Mycobacterium
DNGPWAVFDLSLGRAMYSGFTIGG

SEQ ID NO: 802821 - protein, 24 aa, Mycobacterium
DNGRGGWGGWGGPATMFGSGGAGG

SEQ ID NO: 802822 - protein, 23 aa, Mycobacterium
DNGRILSFVTTMVGALAPTYSAY

SEQ ID NO: 802823 - protein, 21 aa, Mycobacterium
DNGSAFWRALTTETAPELAGI

SEQ ID NO: 802824 - protein, 24 aa, Mycobacterium
DNHDVVFLALPHGYSAALAAQLEP

SEQ ID NO: 802825 - protein, 22 aa, Mycobacterium
DNHFVPNLTLGLPVVESLLKVT

SEQ ID NO: 802826 - protein, 23 aa, Mycobacterium
DNHGSVYVIDYHDRVLKLPAQSN

SEQ ID NO: 802827 - protein, 20 aa, Mycobacterium
DNHQYLGPVLWSPSGETPDW

SEQ ID NO: 802828 - protein, 25 aa, Mycobacterium
DNIDDVWFPLFEPTDGTDERDLLGP

SEQ ID NO: 802829 - protein, 19 aa, Mycobacterium
DNILVDLYPVVRKSIRCGS

SEQ ID NO: 802830 - protein, 17 aa, Mycobacterium
DNIPPLVAVAQHLGLGG

SEQ ID NO: 802831 - protein, 18 aa, Mycobacterium
DNIPPLVAVAQHLGVRGA

SEQ ID NO: 802832 - protein, 20 aa, Mycobacterium
DNIRFFAGAARRLPGQATAE

SEQ ID NO: 802833 - protein, 21 aa, Mycobacterium
DNIWMTLLTMNTQPVHFDARY

SEQ ID NO: 802834 - protein, 24 aa, Mycobacterium
DNKRKFREALERKMAKSSGATDHK

SEQ ID NO: 802835 - protein, 35 aa, Mycobacterium
DNKRVFSELPRLQALALSALLIAPLGLTTAFPGFV

SEQ ID NO: 802836 - protein, 25 aa, Mycobacterium
DNKTLLTSLFFLGNSLYLPTGFAPA

SEQ ID NO: 802837 - protein, 26 aa, Mycobacterium
DNKVGAPLLPPVLGGGMPAAPGHVLA

SEQ ID NO: 802838 - protein, 25 aa, Mycobacterium
DNLDQLFITAAAYPPEILLTGIIVN

SEQ ID NO: 802839 - protein, 25 aa, Mycobacterium
DNLHVGLAGLWRRLSEDRSARAAVL

SEQ ID NO: 802840 - protein, 25 aa, Mycobacterium
DNLLTMVRRLPPDAMWQVIAIGRAN

SEQ ID NO: 802841 - protein, 25 aa, Mycobacterium
DNLNWWLGEWSWVFDKYSTMFVQWT

SEQ ID NO: 802842 - protein, 24 aa, Mycobacterium
DNLPKQFDLVAAERGRMLAMSSTM

SEQ ID NO: 802843 - protein, 18 aa, Mycobacterium
DNLRHMVRFAAAVRAALE

SEQ ID NO: 802844 - protein, 33 aa, Mycobacterium
DNLRQLHAFLSDTVLMTGFGFGPPVVTPTWGEL

SEQ ID NO: 802845 - protein, 34 aa, Mycobacterium
DNLRQLHAFLSDTVLMTGFGFTPPVVTPTWGELA

SEQ ID NO: 802846 - protein, 25 aa, Mycobacterium
DNLRQLYAFLSDTVLMTGYGFAPPL

SEQ ID NO: 802847 - protein, 25 aa, Mycobacterium
DNLVDVLLVALRPLDGLIAMHNTIA

SEQ ID NO: 802848 - protein, 23 aa, Mycobacterium
DNLYMMGTFRLEPGQALVLDIAP

SEQ ID NO: 802849 - protein, 26 aa, Mycobacterium
DNMCGGRWWQPIALAAYEQNPKRTWE

SEQ ID NO: 802850 - protein, 24 aa, Mycobacterium
DNMGMLFRKHLVMFGPREVLLTSD

SEQ ID NO: 802851 - protein, 18 aa, Mycobacterium
DNMHELMLPFLEHFVMKS

SEQ ID NO: 802852 - protein, 27 aa, Mycobacterium
DNNDHFEFFVFPYAETALTRTTRRSEE

SEQ ID NO: 802853 - protein, 23 aa, Mycobacterium
DNPAGFHQPRPPWLMSRCATAPV

SEQ ID NO: 802854 - protein, 26 aa, Mycobacterium
DNPAYRFVNIYRVVTNLGVFDFNGPD

SEQ ID NO: 802855 - protein, 25 aa, Mycobacterium
DNPGTWVMHCHNMYHLAAGMMTRLD

SEQ ID NO: 802856 - protein, 28 aa, Mycobacterium
DNPLALLIAMLLDQQIPMEVAFAGPKKI

SEQ ID NO: 802857 - protein, 30 aa, Mycobacterium
DNPLFTPLDQPRIGRYLAPGLPVSIGGVYP

SEQ ID NO: 802858 - protein, 22 aa, Mycobacterium
DNPRILPRLQVQLRRRQISITT

SEQ ID NO: 802859 - protein, 23 aa, Mycobacterium
DNPTKKLDWDLTGLRLATTLHEW

SEQ ID NO: 802860 - protein, 17 aa, Mycobacterium
DNPTVVRVLGAIEIPVV

SEQ ID NO: 802861 - protein, 24 aa, Mycobacterium
DNQGWVLFPNYFMTIRAGECHVIM

SEQ ID NO: 802862 - protein, 21 aa, Mycobacterium
DNQIWQCPVVLLADVRSVGVQ

SEQ ID NO: 802863 - protein, 20 aa, Mycobacterium
DNQLAWQWYLNGADPEEAAP

SEQ ID NO: 802864 - protein, 18 aa, Mycobacterium
DNQLVLVDFWAAYCRPCQ

SEQ ID NO: 802865 - protein, 25 aa, Mycobacterium
DNQPGFLGFQLLRPVKGENRYFVVT

SEQ ID NO: 802866 - protein, 25 aa, Mycobacterium
DNQPGFLGFQLLRPVKGETRYFVVT

SEQ ID NO: 802867 - protein, 29 aa, Mycobacterium
DNQPTLGMMMFTLFQKRLLGSLYGEANPR

SEQ ID NO: 802868 - protein, 17 aa, Mycobacterium
DNRCYLVLPPGAGKTMI

SEQ ID NO: 802869 - protein, 44 aa, Mycobacterium
DNRGSIRPVLRIAPLSVAGLLRTRLFGQRTVVLTSATLALGGRF

SEQ ID NO: 802870 - protein, 27 aa, Mycobacterium
DNRGSQFYLALYWAQELAAQNDDEDLR

SEQ ID NO: 802871 - protein, 25 aa, Mycobacterium
DNRGSQFYLALYWAQELAEQTDDAE

SEQ ID NO: 802872 - protein, 26 aa, Mycobacterium
DNRGSQFYLAMYWAQELAAQNEDQQL

SEQ ID NO: 802873 - protein, 25 aa, Mycobacterium
DNRGSQFYLAMYWAQELAEQTDDKE

SEQ ID NO: 802874 - protein, 25 aa, Mycobacterium
DNRGSQFYLARYWAEELANQSDDEE

SEQ ID NO: 802875 - protein, 26 aa, Mycobacterium
DNRGSQFYLSLFWAQALAEQTEDAEL

SEQ ID NO: 802876 - protein, 29 aa, Mycobacterium
DNRKLLSVMPMVLAPPFVSEAFHHHTRLE

SEQ ID NO: 802877 - protein, 21 aa, Mycobacterium
DNRLPPVHMFGGVNLSFGVMG

SEQ ID NO: 802878 - protein, 23 aa, Mycobacterium
DNRLTEVALWGDGWPLGVQRATT

SEQ ID NO: 802879 - protein, 39 aa, Mycobacterium
DNRSQFTIEPLEPGFGYTLGNSLRRTLLSSIPGAAVTSI

SEQ ID NO: 802880 - protein, 26 aa, Mycobacterium
DNRSVLHFEWTDDPRWLIYLQDTNGD

SEQ ID NO: 802881 - protein, 24 aa, Mycobacterium
DNRTYGHPIVLRPVTSEDAMTADW

SEQ ID NO: 802882 - protein, 17 aa, Mycobacterium
DNRVTLLDALREHLQVT

SEQ ID NO: 802883 - protein, 24 aa, Mycobacterium
DNSLRAQYGDLLPVVLLDGTEHSY

SEQ ID NO: 802884 - protein, 25 aa, Mycobacterium
DNSLVLVDFWASYCRPCHAFAPTYE

SEQ ID NO: 802885 - protein, 22 aa, Mycobacterium
DNSVVHFFGPYAYRSVFHSTTP

SEQ ID NO: 802886 - protein, 21 aa, Mycobacterium
DNTNIAIPDWARPAATSYPAA

SEQ ID NO: 802887 - protein, 17 aa, Mycobacterium
DNTSLFLKDESFREVIS

SEQ ID NO: 802888 - protein, 21 aa, Mycobacterium
DNVFATPILQQGMPLGADVVV

SEQ ID NO: 802889 - protein, 22 aa, Mycobacterium
DNVFATPLLQQGIPLGVDVVVY

SEQ ID NO: 802890 - protein, 20 aa, Mycobacterium
DNVFVALSWSKHPAPQTYEE

SEQ ID NO: 802891 - protein, 20 aa, Mycobacterium
DNVGLLFKKLTKSDLAAGDV

SEQ ID NO: 802892 - protein, 21 aa, Mycobacterium
DNVMMYWVNAAAASSARLYWE

SEQ ID NO: 802893 - protein, 27 aa, Mycobacterium
DNVPVQVQVLLRLSFALNSIGELDDAR

SEQ ID NO: 802894 - protein, 25 aa, Mycobacterium
DNVSKLLWANWHRGLGELAMDVIGK

SEQ ID NO: 802895 - protein, 25 aa, Mycobacterium
DNVSKLLWANWHRSLGELAMDVIGK

SEQ ID NO: 802896 - protein, 38 aa, Mycobacterium
DNVSLDKARRLLWPIKQKYGNKISWADLLVFTGNVALE

SEQ ID NO: 802897 - protein, 40 aa, Mycobacterium
DNVSLDKARRLLWPVKQKYGSKISWADLIIFAGNCALDSM

SEQ ID NO: 802898 - protein, 27 aa, Mycobacterium
DNVTINQLLPMLIDSPRQLQMAQLLSE

SEQ ID NO: 802899 - protein, 26 aa, Mycobacterium
DNVVQWVPDRFWPAHSTVALSVGGLR

SEQ ID NO: 802900 - protein, 17 aa, Mycobacterium
DNWPQHELALPAGHGLL

SEQ ID NO: 802901 - protein, 24 aa, Mycobacterium
DNWSADTPALTVSLRGLVDCVVEV

SEQ ID NO: 802902 - protein, 24 aa, Mycobacterium
DNWSTDVPALTVSLRGLVDCVVEV

SEQ ID NO: 802903 - protein, 26 aa, Mycobacterium
DNWYRGELIFVFDGDAAGQAAALKAF

SEQ ID NO: 802904 - protein, 17 aa, Mycobacterium
DNYAMRAILDRFGARWR

SEQ ID NO: 802905 - protein, 17 aa, Mycobacterium
DNYLLNGKKFFTTGTLY

SEQ ID NO: 802906 - protein, 18 aa, Mycobacterium
DNYLTYYRQFADQVVGPA

SEQ ID NO: 802907 - protein, 17 aa, Mycobacterium
DNYPDLKIPYHSRWRHF

SEQ ID NO: 802908 - protein, 27 aa, Mycobacterium
DNYVRQHGPLNRFTWVYPTVTQERHDQ

SEQ ID NO: 802909 - protein, 19 aa, Mycobacterium
DNYWSMGIPGPCGPSSEIY

SEQ ID NO: 802910 - protein, 27 aa, Mycobacterium
DPAADFDYWRPLMANLPEPLELPGPHG

SEQ ID NO: 802911 - protein, 20 aa, Mycobacterium
DPAAIIRLRARSAGLLTAWV

SEQ ID NO: 802912 - protein, 32 aa, Mycobacterium
DPAAIRAALADRLPPYMVPAAVVVLEALPLTG

SEQ ID NO: 802913 - protein, 29 aa, Mycobacterium
DPAAPTAWLVEGLLPFLSVAAQDLLFGDV

SEQ ID NO: 802914 - protein, 21 aa, Mycobacterium
DPAARLLRWVQLCGAETRVFG

SEQ ID NO: 802915 - protein, 22 aa, Mycobacterium
DPAARLNSLFDDAELQRSDDAE

SEQ ID NO: 802916 - protein, 18 aa, Mycobacterium
DPAATCDLLVSSGATWYG

SEQ ID NO: 802917 - protein, 25 aa, Mycobacterium
DPAATFSPVWLRRNGIEYTVDHIVV

SEQ ID NO: 802918 - protein, 24 aa, Mycobacterium
DPAATLAVPIPALAHRVLEIYWQQ

SEQ ID NO: 802919 - protein, 18 aa, Mycobacterium
DPADLIVIRARPSSRDAT

SEQ ID NO: 802920 - protein, 18 aa, Mycobacterium
DPADTVFLDILRSGPVMA

SEQ ID NO: 802921 - protein, 21 aa, Mycobacterium
DPADVIRVTRRRACWLNQTFK

SEQ ID NO: 802922 - protein, 20 aa, Mycobacterium
DPAEAVVAAARWARSELDYL

SEQ ID NO: 802923 - protein, 25 aa, Mycobacterium
DPAELRRWGWLITAIDNDDPARAVR

SEQ ID NO: 802924 - protein, 21 aa, Mycobacterium
DPAEPYLRLQGPNQWPAALPE

SEQ ID NO: 802925 - protein, 19 aa, Mycobacterium
DPAGLPLRLLAHEDGTPIL

SEQ ID NO: 802926 - protein, 20 aa, Mycobacterium
DPAGQSFFLLPPSAGGGDAR

SEQ ID NO: 802927 - protein, 23 aa, Mycobacterium
DPAGTTFHTLKTAAAAAAVTAVT

SEQ ID NO: 802928 - protein, 26 aa, Mycobacterium
DPAHRLITIILMRCGLRITDALRLRR

SEQ ID NO: 802929 - protein, 20 aa, Mycobacterium
DPAHRPTYIGHDLRALHADA

SEQ ID NO: 802930 - protein, 25 aa, Mycobacterium
DPAIADFVFELFHRTPPAGRGGWAR

SEQ ID NO: 802931 - protein, 24 aa, Mycobacterium
DPALAARYTWANRLIAVVSDGSAV

SEQ ID NO: 802932 - protein, 18 aa, Mycobacterium
DPALILAGQLRMARTLLD

SEQ ID NO: 802933 - protein, 17 aa, Mycobacterium
DPALIYHYFGSKEGLLD

SEQ ID NO: 802934 - protein, 24 aa, Mycobacterium
DPALLRTRLKLRGSVPLSVVITRI

SEQ ID NO: 802935 - protein, 23 aa, Mycobacterium
DPALPRNRGAFAELLRACGDIDG

SEQ ID NO: 802936 - protein, 25 aa, Mycobacterium
DPALPRNRGAFAELLRACGRIPGLE

SEQ ID NO: 802937 - protein, 26 aa, Mycobacterium
DPALPSARLRVAPTASWMFEYYPMRE

SEQ ID NO: 802938 - protein, 20 aa, Mycobacterium
DPALRRYFDELAADHLEVIA

SEQ ID NO: 802939 - protein, 21 aa, Mycobacterium
DPALTHFFDGVDMKRLKTHQR

SEQ ID NO: 802940 - protein, 20 aa, Mycobacterium
DPALVHHYFGTKLDLFREVV

SEQ ID NO: 802941 - protein, 17 aa, Mycobacterium
DPALVPLYFIAKEARKH

SEQ ID NO: 802942 - protein, 26 aa, Mycobacterium
DPALWQEVLVRLTPRQYSISSSPLVS

SEQ ID NO: 802943 - protein, 22 aa, Mycobacterium
DPALYAHLWKIVQHYDINIISA

SEQ ID NO: 802944 - protein, 18 aa, Mycobacterium
DPAPLWKNYIEQGWTELT

SEQ ID NO: 802945 - protein, 28 aa, Mycobacterium
DPAPTVRALYGRILRQRPLDVCKTAQAN

SEQ ID NO: 802946 - protein, 33 aa, Mycobacterium
DPAQLRARLGDRLPAYMVPAAVVALDALPLTPN

SEQ ID NO: 802947 - protein, 26 aa, Mycobacterium
DPAQLRLQNLLKAEQFPYTSKTGWVY

SEQ ID NO: 802948 - protein, 31 aa, Mycobacterium
DPAQPTAWLAEGLLPFLPGAAQDLLFERIAD

SEQ ID NO: 802949 - protein, 38 aa, Mycobacterium
DPAQVLPVTAPRWLGLPARLALQALIGRVRVPGPVNAM

SEQ ID NO: 802950 - protein, 20 aa, Mycobacterium
DPAQYRDRFPRELSGGQQQR

SEQ ID NO: 802951 - protein, 21 aa, Mycobacterium
DPARPLTVTGGLTFAGGPWSN

SEQ ID NO: 802952 - protein, 18 aa, Mycobacterium
DPARRRGGRRPDRHVRVD

SEQ ID NO: 802953 - protein, 27 aa, Mycobacterium
DPASAALLRQLWAAGLLLSDGRPNPKT

SEQ ID NO: 802954 - protein, 18 aa, Mycobacterium
DPASWRVILGELGAALTA

SEQ ID NO: 802955 - protein, 23 aa, Mycobacterium
DPATFPQRVLAGLLALWEDPASG

SEQ ID NO: 802956 - protein, 18 aa, Mycobacterium
DPATFTRVGHLGVFSLPG

SEQ ID NO: 802957 - protein, 23 aa, Mycobacterium
DPATGLPWMAELIDEFELTKPPA

SEQ ID NO: 802958 - protein, 28 aa, Mycobacterium
DPATGRFLWQNIFGVWPVSGLENGKVGA

SEQ ID NO: 802959 - protein, 30 aa, Mycobacterium
DPATGWLTLLQTWINDAWKAGLPDANAMVV

SEQ ID NO: 802960 - protein, 23 aa, Mycobacterium
DPATIAALRYLLDNVASGLTVVV

SEQ ID NO: 802961 - protein, 21 aa, Mycobacterium
DPATLIGPLIHETAYRDMLGA

SEQ ID NO: 802962 - protein, 25 aa, Mycobacterium
DPATNYDVMFVPQGIGADLIATIEG

SEQ ID NO: 802963 - protein, 18 aa, Mycobacterium
DPATPITPAAPAAPVDRV

SEQ ID NO: 802964 - protein, 26 aa, Mycobacterium
DPATTWVHLAPLLRTDFPAETLAALV

SEQ ID NO: 802965 - protein, 23 aa, Mycobacterium
DPAVARWIRRVCRPTQWLELRFV

SEQ ID NO: 802966 - protein, 21 aa, Mycobacterium
DPAVFFDRFIARVGAFAAALD

SEQ ID NO: 802967 - protein, 25 aa, Mycobacterium
DPAVKALPSTWWNAGMAGSDTRPVQ

SEQ ID NO: 802968 - protein, 29 aa, Mycobacterium
DPAVLQNPYAFYAMLREQAPVWMVPGTDV

SEQ ID NO: 802969 - protein, 19 aa, Mycobacterium
DPAVRVVLLTGEGRNFCAG

SEQ ID NO: 802970 - protein, 29 aa, Mycobacterium
DPAVRWNPTLPAFIDAIRFATKRASHNPD

SEQ ID NO: 802971 - protein, 19 aa, Mycobacterium
DPAVTARRRLRMICHGLGH

SEQ ID NO: 802972 - protein, 20 aa, Mycobacterium
DPAVTERIGRLLRAHGLRRM

SEQ ID NO: 802973 - protein, 17 aa, Mycobacterium
DPAWNRHLPEANSFLSE

SEQ ID NO: 802974 - protein, 17 aa, Mycobacterium
DPAWTVAALLGQHPLSA

SEQ ID NO: 802975 - protein, 25 aa, Mycobacterium
DPCALQPHMPIWVGGRTKRSLRRAL

SEQ ID NO: 802976 - protein, 17 aa, Mycobacterium
DPCDFVIFGGTGDLAAR

SEQ ID NO: 802977 - protein, 19 aa, Mycobacterium
DPCLCQFLVNARLEAGRNP

SEQ ID NO: 802978 - protein, 17 aa, Mycobacterium
DPDAGLLAYRRVSEALA

SEQ ID NO: 802979 - protein, 22 aa, Mycobacterium
DPDAPFSAFVFKVQAGMDSAHR

SEQ ID NO: 802980 - protein, 28 aa, Mycobacterium
DPDAPTLSGFWHWAVANLPAEVTELPED

SEQ ID NO: 802981 - protein, 24 aa, Mycobacterium
DPDDASVRFLLTAGAIGSLYKERA

SEQ ID NO: 802982 - protein, 27 aa, Mycobacterium
DPDDPPVLLIMGLGAQLLLWRTGFCER

SEQ ID NO: 802983 - protein, 26 aa, Mycobacterium
DPDEFARRLPLMAAKRVFSEPIALNW

SEQ ID NO: 802984 - protein, 27 aa, Mycobacterium
DPDEFIWDRPIRRSLAFGRGQHFCIGY

SEQ ID NO: 802985 - protein, 31 aa, Mycobacterium
DPDEFYVHKPTYLAGHRAVLRRLIGDKAVKM

SEQ ID NO: 802986 - protein, 23 aa, Mycobacterium
DPDEFYVHKPTYQAGHRAVLRRL

SEQ ID NO: 802987 - protein, 24 aa, Mycobacterium
DPDEFYVHKPTYQAGHRAVLRRLI

SEQ ID NO: 802988 - protein, 22 aa, Mycobacterium
DPDFHIRRIAVPAPGGRRELEE

SEQ ID NO: 802989 - protein, 30 aa, Mycobacterium
DPDGDYLVVFRQLLLWPIDKSGKIIGEDSY

SEQ ID NO: 802990 - protein, 25 aa, Mycobacterium
DPDGGLLAYRRLSEALATQSWYLST

SEQ ID NO: 802991 - protein, 24 aa, Mycobacterium
DPDGGLLAYRRLSEALSGESWYLA

SEQ ID NO: 802992 - protein, 20 aa, Mycobacterium
DPDGKSFFLLPRGTGGGEAR

SEQ ID NO: 802993 - protein, 24 aa, Mycobacterium
DPDGMRFPHLYGPLPVAAVTSVTT

SEQ ID NO: 802994 - protein, 33 aa, Mycobacterium
DPDGRDLILSCGAALHHCVVALAAMGWRADVHR

SEQ ID NO: 802995 - protein, 25 aa, Mycobacterium
DPDGRDLMLSCGAALHHCVVALAAV

SEQ ID NO: 802996 - protein, 24 aa, Mycobacterium
DPDGRYRLGRIEGPYFYDSDGKDV

SEQ ID NO: 802997 - protein, 26 aa, Mycobacterium
DPDHDFFAAPIEWQQRLWPTEEFELA

SEQ ID NO: 802998 - protein, 17 aa, Mycobacterium
DPDHLLGDEFTLRDLRL

SEQ ID NO: 802999 - protein, 24 aa, Mycobacterium
DPDIITAGWRKLLTNALAGFMALS

SEQ ID NO: 803000 - protein, 25 aa, Mycobacterium
DPDLDTWELYYLPDDFSQANNLAAE

SEQ ID NO: 803001 - protein, 20 aa, Mycobacterium
DPDLFPIDESGYSILEEHEV

SEQ ID NO: 803002 - protein, 17 aa, Mycobacterium
DPDLHHRWLNDTSITPP

SEQ ID NO: 803003 - protein, 21 aa, Mycobacterium
DPDLLIVCSHDRKLYEHAKAT

SEQ ID NO: 803004 - protein, 19 aa, Mycobacterium
DPDLWAALARLPDKQRHAV

SEQ ID NO: 803005 - protein, 24 aa, Mycobacterium
DPDNAAVIWRLLGDAASDGAGVLV

SEQ ID NO: 803006 - protein, 25 aa, Mycobacterium
DPDNVVLTYYRPFKVPVSHGARPAW

SEQ ID NO: 803007 - protein, 21 aa, Mycobacterium
DPDPIFIRSSPKVWTAAGVTA

SEQ ID NO: 803008 - protein, 18 aa, Mycobacterium
DPDQLLYRTGDRARYLPD

SEQ ID NO: 803009 - protein, 25 aa, Mycobacterium
DPDQLRTVFLDYLDYLRSPQAATHS

SEQ ID NO: 803010 - protein, 24 aa, Mycobacterium
DPDRANARRHIGFGRGVHSCIGAP

SEQ ID NO: 803011 - protein, 26 aa, Mycobacterium
DPDRGLLAYRRLSEALATQSWYLATL

SEQ ID NO: 803012 - protein, 23 aa, Mycobacterium
DPDRILFTHIAVPVMTRLRQPER

SEQ ID NO: 803013 - protein, 25 aa, Mycobacterium
DPDRKIVELPRPAGVVLALTPTTNP

SEQ ID NO: 803014 - protein, 19 aa, Mycobacterium
DPDSPFLELSPLAAYGSAF

SEQ ID NO: 803015 - protein, 24 aa, Mycobacterium
DPDSTLSFFRRALELRKRRVEFDG

SEQ ID NO: 803016 - protein, 26 aa, Mycobacterium
DPDTAFLELCPFAAWGTKFPVGGSVV

SEQ ID NO: 803017 - protein, 26 aa, Mycobacterium
DPDTLADLVFAWRTCRAVKSNAIVLA

SEQ ID NO: 803018 - protein, 23 aa, Mycobacterium
DPDTPLLFAGFDALLHGHPKPHA

SEQ ID NO: 803019 - protein, 28 aa, Mycobacterium
DPDTYHWAAWRLGKPVIDHWWQTETGWA

SEQ ID NO: 803020 - protein, 26 aa, Mycobacterium
DPDVDLYPRLVCNAAYAVLATVIQLA

SEQ ID NO: 803021 - protein, 25 aa, Mycobacterium
DPDVVELPGWYRPNPGLARDLAFIG

SEQ ID NO: 803022 - protein, 24 aa, Mycobacterium
DPDWLRGPDGLGLLTGTRVPAEAS

SEQ ID NO: 803023 - protein, 37 aa, Mycobacterium
DPDWQRFHLIGATNTVYFALLARRRMDLYGATLEDFA

SEQ ID NO: 803024 - protein, 24 aa, Mycobacterium
DPDYLTVNVWTPRTERAPGHPVMV

SEQ ID NO: 803025 - protein, 23 aa, Mycobacterium
DPEAFRALAARFLGPAVTAVQTR

SEQ ID NO: 803026 - protein, 17 aa, Mycobacterium
DPEAMLFPHLYGPLPVD

SEQ ID NO: 803027 - protein, 24 aa, Mycobacterium
DPEASLAFYRDVLGFEVRLDVGKG

SEQ ID NO: 803028 - protein, 22 aa, Mycobacterium
DPEDLLAEVVYQIGALQAIAQA

SEQ ID NO: 803029 - protein, 22 aa, Mycobacterium
DPEFVARLRARLEAALTLPNRT

SEQ ID NO: 803030 - protein, 18 aa, Mycobacterium
DPEFYALEAEMLWPRMWQ

SEQ ID NO: 803031 - protein, 34 aa, Mycobacterium
DPEGRDLILSCGAALNHCIIALAATGWQAKVCRL

SEQ ID NO: 803032 - protein, 26 aa, Mycobacterium
DPEHDFFAAPIEWQQRLWPTEEFELA

SEQ ID NO: 803033 - protein, 17 aa, Mycobacterium
DPEHRIYRNVLNPYLSP

SEQ ID NO: 803034 - protein, 20 aa, Mycobacterium
DPEHVILVVRVLAEGLSRTA

SEQ ID NO: 803035 - protein, 18 aa, Mycobacterium
DPEIAYAGPWAQAKFRAG

SEQ ID NO: 803036 - protein, 18 aa, Mycobacterium
DPEILRTNLAAVILQMAA

SEQ ID NO: 803037 - protein, 28 aa, Mycobacterium
DPEILRTNLAAVLLQMAALQLGAPPGYV

SEQ ID NO: 803038 - protein, 24 aa, Mycobacterium
DPEILRTNLAAVLLQMAALQLGDV

SEQ ID NO: 803039 - protein, 30 aa, Mycobacterium
DPEKWNVFDPVLIRWRLQAGDRTAQLVSLS

SEQ ID NO: 803040 - protein, 23 aa, Mycobacterium
DPELAIARWGIAYAVGPNYNKAW

SEQ ID NO: 803041 - protein, 19 aa, Mycobacterium
DPELALAMAGGALLGLGNL

SEQ ID NO: 803042 - protein, 23 aa, Mycobacterium
DPELAWAAVRAWNDWHLEAWAGP

SEQ ID NO: 803043 - protein, 19 aa, Mycobacterium
DPELCDIPIVVLTTSAAEE

SEQ ID NO: 803044 - protein, 20 aa, Mycobacterium
DPELCRYDRILFASDADPDG

SEQ ID NO: 803045 - protein, 23 aa, Mycobacterium
DPELFASALALNPTGRMGTPREV

SEQ ID NO: 803046 - protein, 18 aa, Mycobacterium
DPELFPIDESGYSILEEH

SEQ ID NO: 803047 - protein, 23 aa, Mycobacterium
DPELFTGFIAWTAEVLDARGVPV

SEQ ID NO: 803048 - protein, 20 aa, Mycobacterium
DPELILCQLVGPVAFARLTG

SEQ ID NO: 803049 - protein, 20 aa, Mycobacterium
DPELLAHYRALAGDHLEVLA

SEQ ID NO: 803050 - protein, 20 aa, Mycobacterium
DPELPPPLRRLVLEGQAGVK

SEQ ID NO: 803051 - protein, 28 aa, Mycobacterium
DPELPRDRGAFAKLLRACGGIDGLERVR

SEQ ID NO: 803052 - protein, 34 aa, Mycobacterium
DPELSLYALRDSVGTPFLLLAGMEPDLKWERFIT

SEQ ID NO: 803053 - protein, 20 aa, Mycobacterium
DPEMPMLTLADLGVLRDIRQ

SEQ ID NO: 803054 - protein, 26 aa, Mycobacterium
DPENSALFFLLGFYALLVTNHDSKLV

SEQ ID NO: 803055 - protein, 23 aa, Mycobacterium
DPENVFFYITVYNEPYVQPPEPD

SEQ ID NO: 803056 - protein, 24 aa, Mycobacterium
DPEPGTILVVPRLNRRRGVAGDTL

SEQ ID NO: 803057 - protein, 28 aa, Mycobacterium
DPEPLADYLFPAAKILDPFGLENMRYKW

SEQ ID NO: 803058 - protein, 23 aa, Mycobacterium
DPEPPHWNLVADRIVDGWPDGHP

SEQ ID NO: 803059 - protein, 28 aa, Mycobacterium
DPEPRARLIFNFPKPATLARILRDADAA

SEQ ID NO: 803060 - protein, 27 aa, Mycobacterium
DPERKKLFRGLFRGTGKYYSGVKWTWY

SEQ ID NO: 803061 - protein, 18 aa, Mycobacterium
DPERRYDCYPHQLSGGQK

SEQ ID NO: 803062 - protein, 20 aa, Mycobacterium
DPERTPLRIPDAALSGLEPQ

SEQ ID NO: 803063 - protein, 19 aa, Mycobacterium
DPESILAWLDAYDPARTYG

SEQ ID NO: 803064 - protein, 29 aa, Mycobacterium
DPESMLFPHLYGPLPVGAVIRVTDYRPGA

SEQ ID NO: 803065 - protein, 25 aa, Mycobacterium
DPESSLAFYRDILGFEVRLDVGKGE

SEQ ID NO: 803066 - protein, 23 aa, Mycobacterium
DPESTFSFFRHIIKLRKERAEFD

SEQ ID NO: 803067 - protein, 17 aa, Mycobacterium
DPESVWRISAEAADLEV

SEQ ID NO: 803068 - protein, 17 aa, Mycobacterium
DPETLARFLALAAELRG

SEQ ID NO: 803069 - protein, 18 aa, Mycobacterium
DPETLARQFAIPGTPGLE

SEQ ID NO: 803070 - protein, 28 aa, Mycobacterium
DPEVARFWRKPWPRPQIASYLFDQHCSA

SEQ ID NO: 803071 - protein, 22 aa, Mycobacterium
DPEVFAPLIANLSERDPFLVNA

SEQ ID NO: 803072 - protein, 23 aa, Mycobacterium
DPEVPPALRRLVLEGRAGVERAL

SEQ ID NO: 803073 - protein, 34 aa, Mycobacterium
DPEVRQLILLDAPAVLGWAGFRDVAQRYSLGMTE

SEQ ID NO: 803074 - protein, 34 aa, Mycobacterium
DPEVRQLILLDAPSVLGWAGFRDVAQRYSLGMTE

SEQ ID NO: 803075 - protein, 22 aa, Mycobacterium
DPEVTRYLMWSPHPDVAATRRV

SEQ ID NO: 803076 - protein, 22 aa, Mycobacterium
DPEYKAPLRPLAPVSHLAFDEP

SEQ ID NO: 803077 - protein, 27 aa, Mycobacterium
DPEYPASAILTNYLPRYLRGICDDADA

SEQ ID NO: 803078 - protein, 31 aa, Mycobacterium
DPFAQTLRLGLIPTVAPYVLPMVLSGLSREF

SEQ ID NO: 803079 - protein, 22 aa, Mycobacterium
DPFGIPVRPGLTTAIEQTALGQ

SEQ ID NO: 803080 - protein, 20 aa, Mycobacterium
DPFHDEIGFLLWDKADGQVI

SEQ ID NO: 803081 - protein, 17 aa, Mycobacterium
DPFLSEFRSTTGDFVKL

SEQ ID NO: 803082 - protein, 22 aa, Mycobacterium
DPFRLRGKDLLAYRRRVQMVFQ

SEQ ID NO: 803083 - protein, 26 aa, Mycobacterium
DPGAGAMLSALWAPAEGKLALVIHHL

SEQ ID NO: 803084 - protein, 18 aa, Mycobacterium
DPGARIAAIFPDGPMRYH

SEQ ID NO: 803085 - protein, 39 aa, Mycobacterium
DPGAYLNRPGFWHGAIGVAACWLGGARRVADPLYRCAAS

SEQ ID NO: 803086 - protein, 26 aa, Mycobacterium
DPGDISYPYYLINGRIPAAPTTFSAK

SEQ ID NO: 803087 - protein, 28 aa, Mycobacterium
DPGDLGPLSVFFFDLLHVDGRDLLDLPT

SEQ ID NO: 803088 - protein, 25 aa, Mycobacterium
DPGDPAVLLIMGLGAQMLMWRTEFC

SEQ ID NO: 803089 - protein, 37 aa, Mycobacterium
DPGDYLNRPGFWHGAIGVAACWIGGARRVADPLYRCA

SEQ ID NO: 803090 - protein, 18 aa, Mycobacterium
DPGFPMDSAWRGALPPEN

SEQ ID NO: 803091 - protein, 19 aa, Mycobacterium
DPGFSWTPVILSDGAHHTN

SEQ ID NO: 803092 - protein, 21 aa, Mycobacterium
DPGFVIFRRQIDGAWTDVTCA

SEQ ID NO: 803093 - protein, 19 aa, Mycobacterium
DPGGIWRDGVYAHGDYPRV

SEQ ID NO: 803094 - protein, 20 aa, Mycobacterium
DPGHAFPALELCRRFRAAGD

SEQ ID NO: 803095 - protein, 25 aa, Mycobacterium
DPGHIWWIRSQLREQLIQDVRRRIR

SEQ ID NO: 803096 - protein, 25 aa, Mycobacterium
DPGLAELPWAGLARTELLFAAVEPL

SEQ ID NO: 803097 - protein, 18 aa, Mycobacterium
DPGPMRRLIATLPALEVP

SEQ ID NO: 803098 - protein, 33 aa, Mycobacterium
DPGQLSWIKPRDAWLIDRATLQPGPTFIKQFRD

SEQ ID NO: 803099 - protein, 25 aa, Mycobacterium
DPGRDKLDFGWFKAHEFDVTEVAGS

SEQ ID NO: 803100 - protein, 26 aa, Mycobacterium
DPGRDPVYAEDWVNLVALAVNEENAS

SEQ ID NO: 803101 - protein, 20 aa, Mycobacterium
DPGRFDIPESVIGFLRGELG

SEQ ID NO: 803102 - protein, 23 aa, Mycobacterium
DPGRFFEELLAIIGPQAGRYWSH

SEQ ID NO: 803103 - protein, 22 aa, Mycobacterium
DPGRLAAPWEFVDAGWVRAPRG

SEQ ID NO: 803104 - protein, 20 aa, Mycobacterium
DPGRLFGRMLGCDLGVNPPF

SEQ ID NO: 803105 - protein, 21 aa, Mycobacterium
DPGRRQLLWAAAIECRMHGLP

SEQ ID NO: 803106 - protein, 19 aa, Mycobacterium
DPGSVSYLFSRKGVVTLEK

SEQ ID NO: 803107 - protein, 31 aa, Mycobacterium
DPGVGKSTLLLKVAHRWALSGRRALYISGEE

SEQ ID NO: 803108 - protein, 34 aa, Mycobacterium
DPGVWLRLNQVDAGHLWWIRSQLRSLLVDDVRRR

SEQ ID NO: 803109 - protein, 34 aa, Mycobacterium
DPGVWLRLQQVDAGHLWWIRSQLRSLLVDDVRRR

SEQ ID NO: 803110 - protein, 18 aa, Mycobacterium
DPGWLSSDPFYLDALEND

SEQ ID NO: 803111 - protein, 23 aa, Mycobacterium
DPGYSWTPIILSDGAHHTNATYY

SEQ ID NO: 803112 - protein, 21 aa, Mycobacterium
DPHALLGNAFHSWVQKFYGAE

SEQ ID NO: 803113 - protein, 17 aa, Mycobacterium
DPHARTAWSAEGLLVYL

SEQ ID NO: 803114 - protein, 21 aa, Mycobacterium
DPHAWAIPRLMGTAKAAFVAV

SEQ ID NO: 803115 - protein, 21 aa, Mycobacterium
DPHEELIWIQIGSTGGPSADI

SEQ ID NO: 803116 - protein, 31 aa, Mycobacterium
DPHFNAAIVRPLLRFFFRSWFRVEVSGVENL

SEQ ID NO: 803117 - protein, 24 aa, Mycobacterium
DPHGGVWLRTQAERLGLHQVWIKD

SEQ ID NO: 803118 - protein, 24 aa, Mycobacterium
DPHGPVAFWGYSQGGGATASAAEL

SEQ ID NO: 803119 - protein, 19 aa, Mycobacterium
DPHGRIVFLDFGIVGRLDQ

SEQ ID NO: 803120 - protein, 19 aa, Mycobacterium
DPHHQARLLLPVTADLLRG

SEQ ID NO: 803121 - protein, 25 aa, Mycobacterium
DPHIADDPFWPRLATHLDGAARAGA

SEQ ID NO: 803122 - protein, 25 aa, Mycobacterium
DPHPELLRAWDLPTTADGLAAFCDI

SEQ ID NO: 803123 - protein, 23 aa, Mycobacterium
DPHPMRFYNALGAIRAVLQRNPD

SEQ ID NO: 803124 - protein, 36 aa, Mycobacterium
DPHRADKWAGFPLPSPRPPVLLGVNSVALASLAGAR

SEQ ID NO: 803125 - protein, 24 aa, Mycobacterium
DPHRLEILLCLHRAPGICVSDLAA

SEQ ID NO: 803126 - protein, 19 aa, Mycobacterium
DPHVIVLFGATGDLAKRKL

SEQ ID NO: 803127 - protein, 19 aa, Mycobacterium
DPIAIWTVLADFGGLHAWA

SEQ ID NO: 803128 - protein, 25 aa, Mycobacterium
DPICPFAWVTSRWLLEAAQSTHTPV

SEQ ID NO: 803129 - protein, 29 aa, Mycobacterium
DPIDIGKAWWVGNIVYLWDGEHYVQKQMG

SEQ ID NO: 803130 - protein, 31 aa, Mycobacterium
DPIDRIIAMCIAPFELFAEIAGFRSASFMTV

SEQ ID NO: 803131 - protein, 20 aa, Mycobacterium
DPIEGGRRLANYLRVLTMEA

SEQ ID NO: 803132 - protein, 24 aa, Mycobacterium
DPIILQHMFAGVSAHICLDLGIAA

SEQ ID NO: 803133 - protein, 17 aa, Mycobacterium
DPILFRLSKGRINMGPI

SEQ ID NO: 803134 - protein, 35 aa, Mycobacterium
DPIMEQNIAFLFLPGWKWTLRWDTGKRKWDLVSER

SEQ ID NO: 803135 - protein, 21 aa, Mycobacterium
DPIPAHLAGDVAPPVFAIVPV

SEQ ID NO: 803136 - protein, 22 aa, Mycobacterium
DPIPEMLDLLRTSLPDTPALLG

SEQ ID NO: 803137 - protein, 25 aa, Mycobacterium
DPIRVDWRAGCAFTTPPGMWHAHYN

SEQ ID NO: 803138 - protein, 21 aa, Mycobacterium
DPIVLVLPQDHRLGRRPVVDL

SEQ ID NO: 803139 - protein, 21 aa, Mycobacterium
DPIYPLVDFLTRSADKIAAMR

SEQ ID NO: 803140 - protein, 23 aa, Mycobacterium
DPKDPSLGSPVVAWLASPEAGHV

SEQ ID NO: 803141 - protein, 25 aa, Mycobacterium
DPKGFTETLTWWQVYRRATIVADEL

SEQ ID NO: 803142 - protein, 25 aa, Mycobacterium
DPKGKQMRFLPFGSSPGRTHRAHAV

SEQ ID NO: 803143 - protein, 19 aa, Mycobacterium
DPKLWREMLDLSADAHAAG

SEQ ID NO: 803144 - protein, 22 aa, Mycobacterium
DPKQPLCLMLDAPTAGGVCAAQ

SEQ ID NO: 803145 - protein, 17 aa, Mycobacterium
DPKRAAMRIAPRTMLCA

SEQ ID NO: 803146 - protein, 24 aa, Mycobacterium
DPKRLQSGWLNGIKHWQVDFTGAS

SEQ ID NO: 803147 - protein, 21 aa, Mycobacterium
DPKRRIPWFGPDMSVASCATA

SEQ ID NO: 803148 - protein, 22 aa, Mycobacterium
DPKTAVIIGAGYIGLEMAEGLT

SEQ ID NO: 803149 - protein, 17 aa, Mycobacterium
DPKVRVVVLTAVGASFC

SEQ ID NO: 803150 - protein, 31 aa, Mycobacterium
DPLAAQWLIRVFLALWYWPMHDEEAEKAAVL

SEQ ID NO: 803151 - protein, 21 aa, Mycobacterium
DPLALARRIAAALNAPDVGGT

SEQ ID NO: 803152 - protein, 17 aa, Mycobacterium
DPLALIAPAGTEGGATQ

SEQ ID NO: 803153 - protein, 28 aa, Mycobacterium
DPLALRDRLIVELLYATGIRVSELCGLD

SEQ ID NO: 803154 - protein, 18 aa, Mycobacterium
DPLCYVDPYLPIESFRRR

SEQ ID NO: 803155 - protein, 17 aa, Mycobacterium
DPLDIAAAAVYLASPAG

SEQ ID NO: 803156 - protein, 20 aa, Mycobacterium
DPLDYRLVEAYWLGGGVGAD

SEQ ID NO: 803157 - protein, 20 aa, Mycobacterium
DPLEFFTDAVTRTAPARAAY

SEQ ID NO: 803158 - protein, 20 aa, Mycobacterium
DPLFGSHMWDGSAVPIGENL

SEQ ID NO: 803159 - protein, 21 aa, Mycobacterium
DPLLGVATAWLFGPESHGLSA

SEQ ID NO: 803160 - protein, 22 aa, Mycobacterium
DPLLHGIGGTLIRLYGPDHVRV

SEQ ID NO: 803161 - protein, 19 aa, Mycobacterium
DPLNPIYGIYGPTGGYVAP

SEQ ID NO: 803162 - protein, 20 aa, Mycobacterium
DPLPISPVQLINPGLSVTGH

SEQ ID NO: 803163 - protein, 24 aa, Mycobacterium
DPLPLLTRDGVLSVALPCAVTDAM

SEQ ID NO: 803164 - protein, 17 aa, Mycobacterium
DPLPVRPDRFLANGDTV

SEQ ID NO: 803165 - protein, 19 aa, Mycobacterium
DPLRIATHERPLLNLAGAV

SEQ ID NO: 803166 - protein, 21 aa, Mycobacterium
DPLRKSILFALGDAYAQRLAG

SEQ ID NO: 803167 - protein, 17 aa, Mycobacterium
DPLRPLLEHTRALGEKD

SEQ ID NO: 803168 - protein, 23 aa, Mycobacterium
DPLTTILDPALPLTVTEWDEWGN

SEQ ID NO: 803169 - protein, 18 aa, Mycobacterium
DPLVAAVYDPVLERHHAL

SEQ ID NO: 803170 - protein, 20 aa, Mycobacterium
DPLVIDLGYGALPITTLELA

SEQ ID NO: 803171 - protein, 19 aa, Mycobacterium
DPLVISLLTGAAKPDLLQI

SEQ ID NO: 803172 - protein, 24 aa, Mycobacterium
DPLWLRRRVGMCFQRPTPFPGTVA

SEQ ID NO: 803173 - protein, 20 aa, Mycobacterium
DPLWTDDGVQWGLEYMFGVL

SEQ ID NO: 803174 - protein, 18 aa, Mycobacterium
DPMATGVLVIGIERATKI

SEQ ID NO: 803175 - protein, 30 aa, Mycobacterium
DPMECAEVLDWPAKLRLLEGFRQRENLSWS

SEQ ID NO: 803176 - protein, 21 aa, Mycobacterium
DPMGPIMQLFDDAGYIGVVAT

SEQ ID NO: 803177 - protein, 27 aa, Mycobacterium
DPMIREWLTVLLRRDLGLVVMMGVPGR

SEQ ID NO: 803178 - protein, 19 aa, Mycobacterium
DPMIVLEDADIELAANAAV

SEQ ID NO: 803179 - protein, 17 aa, Mycobacterium
DPMLVKRLRRLRASRQK

SEQ ID NO: 803180 - protein, 22 aa, Mycobacterium
DPMPIYIVEFTPEELWGPRAEP

SEQ ID NO: 803181 - protein, 17 aa, Mycobacterium
DPNAAPVFEPPGADLSG

SEQ ID NO: 803182 - protein, 22 aa, Mycobacterium
DPNDVHFFELPGADLSGEELTV

SEQ ID NO: 803183 - protein, 26 aa, Mycobacterium
DPNDVRFIYFFDSKSTRRWHALMWDH

SEQ ID NO: 803184 - protein, 35 aa, Mycobacterium
DPNEVRADFLRLFRRALGGVPPAPTPIAGHYVRCS

SEQ ID NO: 803185 - protein, 17 aa, Mycobacterium
DPNFKPFLAGPIEDAEA

SEQ ID NO: 803186 - protein, 17 aa, Mycobacterium
DPNFRLPFGLTVTMDGR

SEQ ID NO: 803187 - protein, 19 aa, Mycobacterium
DPNGIVPRVIPLASMDIAK

SEQ ID NO: 803188 - protein, 20 aa, Mycobacterium
DPNIIPQWRGGPTSPEFAAL

SEQ ID NO: 803189 - protein, 34 aa, Mycobacterium
DPNLLFVNAGMVQFVPFFLGQRTPPYNTATSVQK

SEQ ID NO: 803190 - protein, 19 aa, Mycobacterium
DPNLNLPVVLGGNMMQYNW

SEQ ID NO: 803191 - protein, 19 aa, Mycobacterium
DPNPMFVERALGLLEKVDS

SEQ ID NO: 803192 - protein, 19 aa, Mycobacterium
DPNPMFVERALGLLEKVES

SEQ ID NO: 803193 - protein, 36 aa, Mycobacterium
DPNQKWAPRYLGQPIYNLLLTLLFEWGVAVHDMDID

SEQ ID NO: 803194 - protein, 26 aa, Mycobacterium
DPNQPALVVWLGVTPYLTRGAIDATL

SEQ ID NO: 803195 - protein, 20 aa, Mycobacterium
DPNQWAFVNASGGCHWPDCD

SEQ ID NO: 803196 - protein, 24 aa, Mycobacterium
DPNSFFFTTPMEWQQRLWPTEEFE

SEQ ID NO: 803197 - protein, 23 aa, Mycobacterium
DPNTVRALDIATTKLVWCDADAT

SEQ ID NO: 803198 - protein, 25 aa, Mycobacterium
DPPALPIDLIITNANIYLPLSNLTA

SEQ ID NO: 803199 - protein, 26 aa, Mycobacterium
DPPAQALVVPLLQQGGPPYGFLVAAL

SEQ ID NO: 803200 - protein, 23 aa, Mycobacterium
DPPDHGRLRRLVAAPFTPRAIEG

SEQ ID NO: 803201 - protein, 17 aa, Mycobacterium
DPPDHTRLRRFVTSAFT

SEQ ID NO: 803202 - protein, 44 aa, Mycobacterium
DPPEGLPKVMKPILQLAPDLSCPLLGLFGLDDRFPAPAAVAALD

SEQ ID NO: 803203 - protein, 23 aa, Mycobacterium
DPPFRAMIIQIDDDRLILGMNYH

SEQ ID NO: 803204 - protein, 23 aa, Mycobacterium
DPPGGWPEPLRSKALAGRAPAKP

SEQ ID NO: 803205 - protein, 24 aa, Mycobacterium
DPPGGWPEPLRSKALAGRPPAKPQ

SEQ ID NO: 803206 - protein, 25 aa, Mycobacterium
DPPGPGEVLVRLAATGLCHSDEHLV

SEQ ID NO: 803207 - protein, 17 aa, Mycobacterium
DPPHRFVYTFTAAWTLA

SEQ ID NO: 803208 - protein, 24 aa, Mycobacterium
DPPIALGDNLRRTLLKLRRSKSNV

SEQ ID NO: 803209 - protein, 19 aa, Mycobacterium
DPPLVLFCPTKQSRAWKAI

SEQ ID NO: 803210 - protein, 17 aa, Mycobacterium
DPPLVLFCPTKVSRSWQ

SEQ ID NO: 803211 - protein, 28 aa, Mycobacterium
DPPPFINKPFDFEFLTTRGPAIVGSPAE

SEQ ID NO: 803212 - protein, 33 aa, Mycobacterium
DPPQGQWQPLPTWFERLTWAGISTRAVLPEWFI

SEQ ID NO: 803213 - protein, 17 aa, Mycobacterium
DPPQWLKDLRKNGPHPK

SEQ ID NO: 803214 - protein, 24 aa, Mycobacterium
DPPRSGEVLVRLAATGLCHSDEHI

SEQ ID NO: 803215 - protein, 22 aa, Mycobacterium
DPPTRLLELALDIGCVFSIDTD

SEQ ID NO: 803216 - protein, 24 aa, Mycobacterium
DPPTRLLNLALEIGCVFSIDTDSH

SEQ ID NO: 803217 - protein, 17 aa, Mycobacterium
DPPVAITTLIRSGFAAV

SEQ ID NO: 803218 - protein, 18 aa, Mycobacterium
DPPVVEPLQVEDPVFGTD

SEQ ID NO: 803219 - protein, 18 aa, Mycobacterium
DPPVVVGPYYASKAIDLC

SEQ ID NO: 803220 - protein, 25 aa, Mycobacterium
DPPYVAVPYLDRMDLAYAAADLVIC

SEQ ID NO: 803221 - protein, 25 aa, Mycobacterium
DPPYVAVPYLERMDLAYAAADLAVC

SEQ ID NO: 803222 - protein, 20 aa, Mycobacterium
DPQAARIWLLQALTGRRASE

SEQ ID NO: 803223 - protein, 25 aa, Mycobacterium
DPQAMRMILLQILTGRRASEIRTCD

SEQ ID NO: 803224 - protein, 33 aa, Mycobacterium
DPQFAQQALQAFRKFGFQLVIVATVQNATTIQP

SEQ ID NO: 803225 - protein, 19 aa, Mycobacterium
DPQGNVIAWASSGHVGFKG

SEQ ID NO: 803226 - protein, 25 aa, Mycobacterium
DPQGRSLFAFKLHQFIGKGDTVYTT

SEQ ID NO: 803227 - protein, 21 aa, Mycobacterium
DPQHLLRRKLVNAGFTRKRVM

SEQ ID NO: 803228 - protein, 20 aa, Mycobacterium
DPQHRMLLEVAWEALEHAGI

SEQ ID NO: 803229 - protein, 23 aa, Mycobacterium
DPQILRLYRRRIAPGGFRYGAMF

SEQ ID NO: 803230 - protein, 33 aa, Mycobacterium
DPQIVKKRQRRLTGIDEIVLSLTAKGLTTGEVA

SEQ ID NO: 803231 - protein, 24 aa, Mycobacterium
DPQLFATALALNPTGRMATPQEVA

SEQ ID NO: 803232 - protein, 18 aa, Mycobacterium
DPQLRHLAAARTDLSPPV

SEQ ID NO: 803233 - protein, 22 aa, Mycobacterium
DPQPGLALIKSWAAQGWLHRIV

SEQ ID NO: 803234 - protein, 25 aa, Mycobacterium
DPQQLAMLSINPPTAHLLLDRFVNL

SEQ ID NO: 803235 - protein, 17 aa, Mycobacterium
DPQQRLLLEVAWEALEN

SEQ ID NO: 803236 - protein, 22 aa, Mycobacterium
DPQQRMALELTWEALEHARIPA

SEQ ID NO: 803237 - protein, 21 aa, Mycobacterium
DPQQRVALRVAWRALEGTGIN

SEQ ID NO: 803238 - protein, 22 aa, Mycobacterium
DPQQRVALRVAWRALENAGINP

SEQ ID NO: 803239 - protein, 22 aa, Mycobacterium
DPQQRVALRVAWRALENSGINP

SEQ ID NO: 803240 - protein, 24 aa, Mycobacterium
DPQQRVAMRVAWKALENTGLNPGA

SEQ ID NO: 803241 - protein, 17 aa, Mycobacterium
DPQRFIGGRPSTFGWIP

SEQ ID NO: 803242 - protein, 18 aa, Mycobacterium
DPQRFLFMNTDTAVHLHR

SEQ ID NO: 803243 - protein, 27 aa, Mycobacterium
DPQRVGRFRFFLDGHRWEWSDAVARMH

SEQ ID NO: 803244 - protein, 23 aa, Mycobacterium
DPQSGLALIKSWAAQGWLHRIVD

SEQ ID NO: 803245 - protein, 24 aa, Mycobacterium
DPQSLDRDLAFSELGFDSQMTVVL

SEQ ID NO: 803246 - protein, 26 aa, Mycobacterium
DPQTFIPYLLDLHRQGKFPFDKLITT

SEQ ID NO: 803247 - protein, 19 aa, Mycobacterium
DPQTGTPLIVPRASRHARV

SEQ ID NO: 803248 - protein, 20 aa, Mycobacterium
DPQVIAAWYAATDHGIALHC

SEQ ID NO: 803249 - protein, 17 aa, Mycobacterium
DPQVRWLLSTVPTSMIF

SEQ ID NO: 803250 - protein, 17 aa, Mycobacterium
DPRAVLETAEREKVGLM

SEQ ID NO: 803251 - protein, 24 aa, Mycobacterium
DPRCGLLIPDWRTGSTLQLTGTAR

SEQ ID NO: 803252 - protein, 19 aa, Mycobacterium
DPRDDMFSRLIAAEITRED

SEQ ID NO: 803253 - protein, 25 aa, Mycobacterium
DPRDLPFTLTYLFDEGSFDEGSFDE

SEQ ID NO: 803254 - protein, 25 aa, Mycobacterium
DPRDPLLRLATFFDDGSVELLHERD

SEQ ID NO: 803255 - protein, 24 aa, Mycobacterium
DPRDPLLRLSNFFDDGTVVLLHER

SEQ ID NO: 803256 - protein, 24 aa, Mycobacterium
DPREFLGARFDAGLAWVHFPVGFG

SEQ ID NO: 803257 - protein, 23 aa, Mycobacterium
DPRETRYWYYALQTCRLGDHRSG

SEQ ID NO: 803258 - protein, 17 aa, Mycobacterium
DPRFPVFSATGLTEALP

SEQ ID NO: 803259 - protein, 17 aa, Mycobacterium
DPRFRFFGNVRVGEHVQ

SEQ ID NO: 803260 - protein, 19 aa, Mycobacterium
DPRFSIARLSLLDRGMVFV

SEQ ID NO: 803261 - protein, 20 aa, Mycobacterium
DPRFTIAAIPPRNDPRDVVV

SEQ ID NO: 803262 - protein, 22 aa, Mycobacterium
DPRGLTLTGGLPYFGGPGNNYS

SEQ ID NO: 803263 - protein, 30 aa, Mycobacterium
DPRINAPIPAQPTIPLGPPPPDSPERGPGM

SEQ ID NO: 803264 - protein, 24 aa, Mycobacterium
DPRINLLSDMWFEAARKSGFDVAT

SEQ ID NO: 803265 - protein, 23 aa, Mycobacterium
DPRIPTPVLATYLGNRFPDAGWS

SEQ ID NO: 803266 - protein, 20 aa, Mycobacterium
DPRKAVVVRPPAGLPGSVLA

SEQ ID NO: 803267 - protein, 21 aa, Mycobacterium
DPRLFYVGRTTELIKTSGANV

SEQ ID NO: 803268 - protein, 17 aa, Mycobacterium
DPRLGPVEYRQATWRAL

SEQ ID NO: 803269 - protein, 17 aa, Mycobacterium
DPRPLLGLPPLTTDDRD

SEQ ID NO: 803270 - protein, 24 aa, Mycobacterium
DPRPPMVTSGLRIGTPALASRGFS

SEQ ID NO: 803271 - protein, 19 aa, Mycobacterium
DPRPPPRRWLTATWSITAS

SEQ ID NO: 803272 - protein, 24 aa, Mycobacterium
DPRPQPRVEVHVHRIAAVAGHRRA

SEQ ID NO: 803273 - protein, 49 aa, Mycobacterium
DPRQARFLTLASLKWVIANRAYTPWYLVRYWRLLKFKLANPHIITRGMV

SEQ ID NO: 803274 - protein, 50 aa, Mycobacterium
DPRQARFLTLASLKWVLRNRAYTPWYLVRYWRLLKFKLANPHIITRGMVF

SEQ ID NO: 803275 - protein, 17 aa, Mycobacterium
DPRQLREVCRRATDRFG

SEQ ID NO: 803276 - protein, 27 aa, Mycobacterium
DPRQRLALELTWELFENAFIVPDTLRT

SEQ ID NO: 803277 - protein, 18 aa, Mycobacterium
DPRQRLLLEVAWEALEDA

SEQ ID NO: 803278 - protein, 19 aa, Mycobacterium
DPRRWVLGWVNERKLTALR

SEQ ID NO: 803279 - protein, 30 aa, Mycobacterium
DPRTLTPDGAIVLLLCLTCLSGTAQRIQGD

SEQ ID NO: 803280 - protein, 23 aa, Mycobacterium
DPRTPMIMIGPGTGIAPFRGFLQ

SEQ ID NO: 803281 - protein, 21 aa, Mycobacterium
DPRTTIVVRAGWQWTTVEGIA

SEQ ID NO: 803282 - protein, 33 aa, Mycobacterium
DPRVLTGALLYIPLLTRMLINLNAWGLSEERLY

SEQ ID NO: 803283 - protein, 20 aa, Mycobacterium
DPRVQTFAETELRSLLIHDA

SEQ ID NO: 803284 - protein, 20 aa, Mycobacterium
DPRVTLPYTDAAWASIVDLG

SEQ ID NO: 803285 - protein, 20 aa, Mycobacterium
DPRVTLPYTDASWAAINALG

SEQ ID NO: 803286 - protein, 17 aa, Mycobacterium
DPRWSVREVLESPLRAY

SEQ ID NO: 803287 - protein, 18 aa, Mycobacterium
DPRYLRDLRRLCDEHAVL

SEQ ID NO: 803288 - protein, 27 aa, Mycobacterium
DPRYTLWAAWHRSGLQRRWLSVSERGG

SEQ ID NO: 803289 - protein, 27 aa, Mycobacterium
DPSAGSPLAWLLTLAHRRAVDRVRSEE

SEQ ID NO: 803290 - protein, 17 aa, Mycobacterium
DPSALGGFASYTPALKA

SEQ ID NO: 803291 - protein, 24 aa, Mycobacterium
DPSAPWPGKLPDPAPVVLSDEPVE

SEQ ID NO: 803292 - protein, 26 aa, Mycobacterium
DPSEWKVFLELLRKRFETDKDKWTKI

SEQ ID NO: 803293 - protein, 23 aa, Mycobacterium
DPSGLDIALFSAGKTMSLVQAPR

SEQ ID NO: 803294 - protein, 29 aa, Mycobacterium
DPSIPLHRQWRTMLFSGAGPILNSLREML

SEQ ID NO: 803295 - protein, 20 aa, Mycobacterium
DPSIYWMGMHHSRLIKRDSN

SEQ ID NO: 803296 - protein, 28 aa, Mycobacterium
DPSKGSALAWLLTIAHRRAVDRVRSEEA

SEQ ID NO: 803297 - protein, 19 aa, Mycobacterium
DPSLRQNICFLYHVLGGGT

SEQ ID NO: 803298 - protein, 23 aa, Mycobacterium
DPSLVMRYYGNKGKLFAAAANFD

SEQ ID NO: 803299 - protein, 17 aa, Mycobacterium
DPSLWRSASLAGARIDV

SEQ ID NO: 803300 - protein, 17 aa, Mycobacterium
DPSLWRTASLAGARVDV

SEQ ID NO: 803301 - protein, 26 aa, Mycobacterium
DPSMTLLGRVFFADLALLGVGDISVE

SEQ ID NO: 803302 - protein, 34 aa, Mycobacterium
DPSMVAAHLAGRYPDLGWLIDAPTTHNAPYNLAR

SEQ ID NO: 803303 - protein, 22 aa, Mycobacterium
DPSQWPLNLGSERDWGFVSQPI

SEQ ID NO: 803304 - protein, 20 aa, Mycobacterium
DPSTARLCLVPNLVADHCYE

SEQ ID NO: 803305 - protein, 26 aa, Mycobacterium
DPSVIPGLLKGRRLTKPLIAAVEGPA

SEQ ID NO: 803306 - protein, 25 aa, Mycobacterium
DPSVPLRLAELFLEAGLPAGVFQVV

SEQ ID NO: 803307 - protein, 23 aa, Mycobacterium
DPSVPLRLAELFLEAGLPPGVFN

SEQ ID NO: 803308 - protein, 25 aa, Mycobacterium
DPSVPLVPTMLRASWRRLGGHAAAL

SEQ ID NO: 803309 - protein, 25 aa, Mycobacterium
DPSYGNFIIGCPLANALAVRGIARY

SEQ ID NO: 803310 - protein, 24 aa, Mycobacterium
DPTAAYVLDSWLRPVPAGVAGELY

SEQ ID NO: 803311 - protein, 25 aa, Mycobacterium
DPTAKIPGRYFAGPVLPMPPDSSSA

SEQ ID NO: 803312 - protein, 28 aa, Mycobacterium
DPTAYDVIVPLGARWPVYEQSLVGTWVT

SEQ ID NO: 803313 - protein, 26 aa, Mycobacterium
DPTFAVHDTLFYCVANMPSAVPKTST

SEQ ID NO: 803314 - protein, 27 aa, Mycobacterium
DPTGDYLIWRELLDYSAKSDRALLFVT

SEQ ID NO: 803315 - protein, 23 aa, Mycobacterium
DPTGLDIALFSAGKTMSLVQAPR

SEQ ID NO: 803316 - protein, 24 aa, Mycobacterium
DPTIKGIWCVPVYSNPTGATYSTD

SEQ ID NO: 803317 - protein, 24 aa, Mycobacterium
DPTIKGMWTVPVFGNPTGVTYSWE

SEQ ID NO: 803318 - protein, 24 aa, Mycobacterium
DPTIYRFHEALAVYGPAIKELIHE

SEQ ID NO: 803319 - protein, 20 aa, Mycobacterium
DPTLFSHRRGAPTGRLASLV

SEQ ID NO: 803320 - protein, 30 aa, Mycobacterium
DPTLPFTGTPPMPTMPFTPPPAATPDTTEA

SEQ ID NO: 803321 - protein, 21 aa, Mycobacterium
DPTLWPQREALKSALQYPALA

SEQ ID NO: 803322 - protein, 25 aa, Mycobacterium
DPTLWPQREALKSALQYPALAGPVF

SEQ ID NO: 803323 - protein, 18 aa, Mycobacterium
DPTPLFRTNVEGLRHVLD

SEQ ID NO: 803324 - protein, 25 aa, Mycobacterium
DPTPQLRNVLLPHALELRRAGALGD

SEQ ID NO: 803325 - protein, 20 aa, Mycobacterium
DPTRIVLWGVSLAGGHVMAV

SEQ ID NO: 803326 - protein, 22 aa, Mycobacterium
DPTRLRLLSILLTASDGEVCGC

SEQ ID NO: 803327 - protein, 24 aa, Mycobacterium
DPTRPPLRGPGRFLADYEAGLEAA

SEQ ID NO: 803328 - protein, 23 aa, Mycobacterium
DPTSPSDLWWAYATRCRPGDDSI

SEQ ID NO: 803329 - protein, 24 aa, Mycobacterium
DPTSTFYFDDVVQLLLDMAARARP

SEQ ID NO: 803330 - protein, 17 aa, Mycobacterium
DPTTVMKAIWESLLLRG

SEQ ID NO: 803331 - protein, 23 aa, Mycobacterium
DPTVVQHALMTSLWHLTPDMCAI

SEQ ID NO: 803332 - protein, 21 aa, Mycobacterium
DPVAMTPLYNASALWGRGLIG

SEQ ID NO: 803333 - protein, 23 aa, Mycobacterium
DPVCPFAWAASRWLLDAAHKTDT

SEQ ID NO: 803334 - protein, 25 aa, Mycobacterium
DPVCPFSWVTAHWLLDAAQSTQTPV

SEQ ID NO: 803335 - protein, 20 aa, Mycobacterium
DPVEGFAAMWADVRRPELRQ

SEQ ID NO: 803336 - protein, 35 aa, Mycobacterium
DPVFVFSGMGPQWWGMARALLERPGIFRDAAAEID

SEQ ID NO: 803337 - protein, 24 aa, Mycobacterium
DPVGHSPHLIAPRLRSIGAAAPPS

SEQ ID NO: 803338 - protein, 20 aa, Mycobacterium
DPVGTWGPDGRPINGGPAGA

SEQ ID NO: 803339 - protein, 20 aa, Mycobacterium
DPVIFLKPNTAIIGPNVPIQ

SEQ ID NO: 803340 - protein, 17 aa, Mycobacterium
DPVILLHQEKISSLPDL

SEQ ID NO: 803341 - protein, 18 aa, Mycobacterium
DPVIMLTGPTPATKKVLD

SEQ ID NO: 803342 - protein, 25 aa, Mycobacterium
DPVIRNKVMRLWAQERVRGWTNDRV

SEQ ID NO: 803343 - protein, 30 aa, Mycobacterium
DPVIVRLLAEHQPFQRFIERLYGVLIGDAG

SEQ ID NO: 803344 - protein, 20 aa, Mycobacterium
DPVIVRLLAQHQPFQHFIAR

SEQ ID NO: 803345 - protein, 23 aa, Mycobacterium
DPVKLRLGIGYVIQNAGLMPHQR

SEQ ID NO: 803346 - protein, 24 aa, Mycobacterium
DPVKLRLGIGYVIQSAGLMPHLRV

SEQ ID NO: 803347 - protein, 26 aa, Mycobacterium
DPVKQRVQVLWLALSADETAGSLGTR

SEQ ID NO: 803348 - protein, 29 aa, Mycobacterium
DPVKVARFPKFDWPRIDAPYVRPGLDDDA

SEQ ID NO: 803349 - protein, 25 aa, Mycobacterium
DPVLADAPRRRHLLRPGRQPARDDL

SEQ ID NO: 803350 - protein, 33 aa, Mycobacterium
DPVLAEWFLRRFSLLDSLYMIPPPRIVGRAMAH

SEQ ID NO: 803351 - protein, 20 aa, Mycobacterium
DPVLRWVHGTGLRPVISALT

SEQ ID NO: 803352 - protein, 27 aa, Mycobacterium
DPVLVGEPLIGPLYRHGSDDADIAIVE

SEQ ID NO: 803353 - protein, 17 aa, Mycobacterium
DPVLYAMCGALSRSGPT

SEQ ID NO: 803354 - protein, 18 aa, Mycobacterium
DPVPFLMTVVTRICLNVL

SEQ ID NO: 803355 - protein, 29 aa, Mycobacterium
DPVPGQVGLLLRGLLGLARQPLRALAATP

SEQ ID NO: 803356 - protein, 32 aa, Mycobacterium
DPVPVPTIGWLTWHIVYWWSGALASLSGDTPR

SEQ ID NO: 803357 - protein, 23 aa, Mycobacterium
DPVRFIQMWVTPDDSGIDPGYQQ

SEQ ID NO: 803358 - protein, 25 aa, Mycobacterium
DPVRGMQLFLDEAIHVLPQLHAALD

SEQ ID NO: 803359 - protein, 36 aa, Mycobacterium
DPVRLAALRKVVPRLLYMKPWETPAITNPGLRRYWP

SEQ ID NO: 803360 - protein, 22 aa, Mycobacterium
DPVRLRAQRVWIVDPLDGTREF

SEQ ID NO: 803361 - protein, 20 aa, Mycobacterium
DPVRVKIMSELFGAPDGEVI

SEQ ID NO: 803362 - protein, 18 aa, Mycobacterium
DPVSKPESLAKLVQARQP

SEQ ID NO: 803363 - protein, 25 aa, Mycobacterium
DPVTALLKQFPHLRLIVAHMGMPEY

SEQ ID NO: 803364 - protein, 25 aa, Mycobacterium
DPVTLLFEVKNIRQWIYPSAPELYQ

SEQ ID NO: 803365 - protein, 19 aa, Mycobacterium
DPWFVAQIDELVGLRAELV

SEQ ID NO: 803366 - protein, 19 aa, Mycobacterium
DPWHGAWFHPYSFTRLEVL

SEQ ID NO: 803367 - protein, 22 aa, Mycobacterium
DPWKINSTLQSGRPARISNLAK

SEQ ID NO: 803368 - protein, 17 aa, Mycobacterium
DPWSPDALVWPLLTVID

SEQ ID NO: 803369 - protein, 26 aa, Mycobacterium
DPWTTRPGFPWPGRPAPLHPNAAGMR

SEQ ID NO: 803370 - protein, 25 aa, Mycobacterium
DPWVADFVYRLFATTPPTGRGAWGR

SEQ ID NO: 803371 - protein, 21 aa, Mycobacterium
DPWVQLPVPDWPRPGKATFVE

SEQ ID NO: 803372 - protein, 20 aa, Mycobacterium
DPYIPFGNAPNFAAGRLSYF

SEQ ID NO: 803373 - protein, 19 aa, Mycobacterium
DPYLWLEDIGGDEPLNWVR

SEQ ID NO: 803374 - protein, 22 aa, Mycobacterium
DPYPCVAVDREWNLLRANAGAG

SEQ ID NO: 803375 - protein, 18 aa, Mycobacterium
DPYPVWKRMRDEAPLYYN

SEQ ID NO: 803376 - protein, 24 aa, Mycobacterium
DPYPYYRRLRDEAPLYHNEELGFW

SEQ ID NO: 803377 - protein, 20 aa, Mycobacterium
DPYRLCAQFRDRGPLQLPDA

SEQ ID NO: 803378 - protein, 22 aa, Mycobacterium
DPYRLWPRVVAEAARQVPHPVF

SEQ ID NO: 803379 - protein, 18 aa, Mycobacterium
DPYRVGRRPWRRRRRAHH

SEQ ID NO: 803380 - protein, 21 aa, Mycobacterium
DPYWQRYIDGQLELARLSAGE

SEQ ID NO: 803381 - protein, 17 aa, Mycobacterium
DQAAAGEFYLLTQPGYV

SEQ ID NO: 803382 - protein, 23 aa, Mycobacterium
DQAAIYKVGLGSVRFLMSVGDLV

SEQ ID NO: 803383 - protein, 18 aa, Mycobacterium
DQAALQRATAEKSRAELD

SEQ ID NO: 803384 - protein, 17 aa, Mycobacterium
DQAAMIALYADLDEAGA

SEQ ID NO: 803385 - protein, 23 aa, Mycobacterium
DQAAYLKWAVEAFRLATSGVEDS

SEQ ID NO: 803386 - protein, 32 aa, Mycobacterium
DQAKKMGLFGYAIPQRWGGLGLNLMQDVELAM

SEQ ID NO: 803387 - protein, 30 aa, Mycobacterium
DQAMRLRDLLKFDFYFADSAAFRANIAEEM

SEQ ID NO: 803388 - protein, 27 aa, Mycobacterium
DQAPPSGRLLLGLRDRGIPIDWSGTAL

SEQ ID NO: 803389 - protein, 24 aa, Mycobacterium
DQAQIDPMPLLDSFIRELTDRGGL

SEQ ID NO: 803390 - protein, 18 aa, Mycobacterium
DQAQVIAHLLDLVTAQAG

SEQ ID NO: 803391 - protein, 18 aa, Mycobacterium
DQARRIAAEIGYPVLVRP

SEQ ID NO: 803392 - protein, 28 aa, Mycobacterium
DQARRLIVRGFFAEIIQKIAVPAVRERL

SEQ ID NO: 803393 - protein, 28 aa, Mycobacterium
DQASVWALHQYLVGLRRRYPWLHTASTS

SEQ ID NO: 803394 - protein, 22 aa, Mycobacterium
DQASWAPIGRPIANARLYIVDT

SEQ ID NO: 803395 - protein, 21 aa, Mycobacterium
DQAWIENDFIPTVAKRGAAII

SEQ ID NO: 803396 - protein, 21 aa, Mycobacterium
DQAWIENDFIPTVAKRGAAVI

SEQ ID NO: 803397 - protein, 17 aa, Mycobacterium
DQAWRRGPLTALERLAG

SEQ ID NO: 803398 - protein, 17 aa, Mycobacterium
DQAYLASVLGFPLVESA

SEQ ID NO: 803399 - protein, 21 aa, Mycobacterium
DQCISLHHSAYDFALNKPDTE

SEQ ID NO: 803400 - protein, 27 aa, Mycobacterium
DQCLNFLSALAPYGLPAAAMHPAWGMS

SEQ ID NO: 803401 - protein, 23 aa, Mycobacterium
DQDAELERLLRLGARPADIGQTG

SEQ ID NO: 803402 - protein, 25 aa, Mycobacterium
DQDDYLRWAVGAFRLATSGVADSTQ

SEQ ID NO: 803403 - protein, 19 aa, Mycobacterium
DQDGYLFIGGRSDDTIIRG

SEQ ID NO: 803404 - protein, 18 aa, Mycobacterium
DQDLVIVSPGFGPSAPVV

SEQ ID NO: 803405 - protein, 28 aa, Mycobacterium
DQDQSFLMPPSLRDWLPDDHLALFVSEL

SEQ ID NO: 803406 - protein, 22 aa, Mycobacterium
DQDVAAWLAAGKPPICFATGSI

SEQ ID NO: 803407 - protein, 40 aa, Mycobacterium
DQEDAILPLLRELGIGFVAYSPLGRGFLTGAIRSTEGLPD

SEQ ID NO: 803408 - protein, 24 aa, Mycobacterium
DQEDYLRWAVGSFRLATSGVDDST

SEQ ID NO: 803409 - protein, 25 aa, Mycobacterium
DQERYPLLEETLELDLSGLAAEEKE

SEQ ID NO: 803410 - protein, 32 aa, Mycobacterium
DQETFVGGALRLRRAWWGIGEAGNLMVRGPIS

SEQ ID NO: 803411 - protein, 26 aa, Mycobacterium
DQEYRNRYIFAGLQPGQKIPSKWIES

SEQ ID NO: 803412 - protein, 20 aa, Mycobacterium
DQFAASMYMNGPSGALPLAN

SEQ ID NO: 803413 - protein, 25 aa, Mycobacterium
DQFQAGPCFLIGDAAHRLPPTGGLG

SEQ ID NO: 803414 - protein, 23 aa, Mycobacterium
DQGDMIITNLLLPGLDEVTNEKE

SEQ ID NO: 803415 - protein, 26 aa, Mycobacterium
DQGDPPYRGLVSMSFAWPTDDTGGYP

SEQ ID NO: 803416 - protein, 24 aa, Mycobacterium
DQGGRLLGFHWTKVHLDRPGLGEV

SEQ ID NO: 803417 - protein, 21 aa, Mycobacterium
DQGIRSLWSHQLAAADLAHDG

SEQ ID NO: 803418 - protein, 24 aa, Mycobacterium
DQGKHLWMVYLMRVVDAQVVLDRP

SEQ ID NO: 803419 - protein, 20 aa, Mycobacterium
DQGLSLTLFFKDTASTRDVN

SEQ ID NO: 803420 - protein, 23 aa, Mycobacterium
DQGLSLTLFFMDTATTREVNKAQ

SEQ ID NO: 803421 - protein, 20 aa, Mycobacterium
DQGLWAPHLSPELGGQGFGA

SEQ ID NO: 803422 - protein, 23 aa, Mycobacterium
DQGPSWVPIFARMTDGRRVAARS

SEQ ID NO: 803423 - protein, 24 aa, Mycobacterium
DQGPWGAFDMSLGKAMYAGFTIGG

SEQ ID NO: 803424 - protein, 23 aa, Mycobacterium
DQGRALLPSMMRYQVPMWPERAL

SEQ ID NO: 803425 - protein, 25 aa, Mycobacterium
DQGRALLPTLLRYQVPLWPERLLTR

SEQ ID NO: 803426 - protein, 26 aa, Mycobacterium
DQGRALLPTLLRYQVPLWPERLLTRD

SEQ ID NO: 803427 - protein, 30 aa, Mycobacterium; identical to SEQ ID NO: 119584

SEQ ID NO: 803428 - protein, 25 aa, Mycobacterium
DQGRRPAIVVPLRSATNNLGVIAVA

SEQ ID NO: 803429 - protein, 21 aa, Mycobacterium
DQGRSFQAFYDFLLSEQRQAE

SEQ ID NO: 803430 - protein, 18 aa, Mycobacterium
DQGVLIRDVGIPGYLRAT

SEQ ID NO: 803431 - protein, 26 aa, Mycobacterium
DQGYALLQTLLPYQVPLWPERLLTRD

SEQ ID NO: 803432 - protein, 28 aa, Mycobacterium
DQGYRYRELGYWTDLARTLEAGGFDALF

SEQ ID NO: 803433 - protein, 29 aa, Mycobacterium
DQHLATQLAAFFRTRRFRVYTTDDVIGVE

SEQ ID NO: 803434 - protein, 24 aa, Mycobacterium
DQHLERHVLMFERGQALGLDPVQQ

SEQ ID NO: 803435 - protein, 30 aa, Mycobacterium
DQHLNEAIFLPLLRVFFKSWFRVEVSGIEN

SEQ ID NO: 803436 - protein, 17 aa, Mycobacterium
DQHPVYYLPQWDTFAIS

SEQ ID NO: 803437 - protein, 17 aa, Mycobacterium
DQIDWHWTSQLRPRFDG

SEQ ID NO: 803438 - protein, 17 aa, Mycobacterium
DQIGGLVTRLTLSSDGD

SEQ ID NO: 803439 - protein, 17 aa, Mycobacterium
DQIPTGKPLLFLAEGIS

SEQ ID NO: 803440 - protein, 24 aa, Mycobacterium
DQIRQRFDLISRELPMFRQRVVES

SEQ ID NO: 803441 - protein, 18 aa, Mycobacterium
DQITRLPEYYPTRTEAQI

SEQ ID NO: 803442 - protein, 17 aa, Mycobacterium
DQIVLVVRVLAEGLSRA

SEQ ID NO: 803443 - protein, 32 aa, Mycobacterium
DQKFKFHRPILAHDRLFFDTYLDSVIESHGTV

SEQ ID NO: 803444 - protein, 33 aa, Mycobacterium
DQKFRFHRPILAGDKLFFHTYLDSVIESHGTVL

SEQ ID NO: 803445 - protein, 25 aa, Mycobacterium
DQKLIFHRPIVVGDKLWFDSYLDSV

SEQ ID NO: 803446 - protein, 27 aa, Mycobacterium
DQKLKFHRPIRVGDRLYFDSYLDSVLE

SEQ ID NO: 803447 - protein, 17 aa, Mycobacterium
DQKTQVIEIFRSLSQVL

SEQ ID NO: 803448 - protein, 21 aa, Mycobacterium
DQKVMLKLSLPTVANHYKSLV

SEQ ID NO: 803449 - protein, 29 aa, Mycobacterium
DQKWGELVYDGLWFSPLKSALESFVANTQ

SEQ ID NO: 803450 - protein, 26 aa, Mycobacterium
DQKWWAERIPDLPDPPRLPLIPVAEQ

SEQ ID NO: 803451 - protein, 25 aa, Mycobacterium
DQLAMNPLAWLDDKFVRYLEDRRKE

SEQ ID NO: 803452 - protein, 37 aa, Mycobacterium
DQLDPWVELVKLLERGKFDSIFFADVVGLYDDYRGGW

SEQ ID NO: 803453 - protein, 40 aa, Mycobacterium
DQLERKPTGYDWFVLWTLSPDSLHVLEVYLAAVIGIDDST

SEQ ID NO: 803454 - protein, 20 aa, Mycobacterium
DQLFRPLVAGQRWIAAGLFE

SEQ ID NO: 803455 - protein, 24 aa, Mycobacterium
DQLGFDVNTPWKKLPAKARKAILE

SEQ ID NO: 803456 - protein, 17 aa, Mycobacterium
DQLGQLLGGWKGASGSA

SEQ ID NO: 803457 - protein, 17 aa, Mycobacterium
DQLIHLDALTPARYRVL

SEQ ID NO: 803458 - protein, 17 aa, Mycobacterium
DQLKRLGGYNWFGAVEP

SEQ ID NO: 803459 - protein, 24 aa, Mycobacterium
DQLLIEWQRDFFDFGHVVKGYAKL

SEQ ID NO: 803460 - protein, 22 aa, Mycobacterium
DQLLNNRLLAIEWQQQRLPESV

SEQ ID NO: 803461 - protein, 17 aa, Mycobacterium
DQLLQADQIFLNVGGRA

SEQ ID NO: 803462 - protein, 17 aa, Mycobacterium
DQLLVALSERFGDHSSL

SEQ ID NO: 803463 - protein, 20 aa, Mycobacterium
DQLMKAALPHGLWVPVLPGT

SEQ ID NO: 803464 - protein, 27 aa, Mycobacterium
DQLNDIALYLNFDMLGSINAGYFTDDG

SEQ ID NO: 803465 - protein, 24 aa, Mycobacterium
DQLRDWKAEFPDAVVVSYVNTTAA

SEQ ID NO: 803466 - protein, 19 aa, Mycobacterium
DQLRFLELFEKDLAPRLRR

SEQ ID NO: 803467 - protein, 18 aa, Mycobacterium
DQLRIRELLTRIGTEEDG

SEQ ID NO: 803468 - protein, 18 aa, Mycobacterium
DQLRLMRPEQQLAALDKF

SEQ ID NO: 803469 - protein, 17 aa, Mycobacterium
DQLRRLAATGEPVCELA

SEQ ID NO: 803470 - protein, 34 aa, Mycobacterium; identical to SEQ ID NO: 125375

SEQ ID NO: 803471 - protein, 18 aa, Mycobacterium
DQLRSRPVLAQPLAAITA

SEQ ID NO: 803472 - protein, 18 aa, Mycobacterium
DQLRTQVIDGVRAGALPP

SEQ ID NO: 803473 - protein, 19 aa, Mycobacterium
DQLRWLAHSAAATNTKLLL

SEQ ID NO: 803474 - protein, 21 aa, Mycobacterium
DQLSEKILFEELGPGQLVTVD

SEQ ID NO: 803475 - protein, 25 aa, Mycobacterium
DQLVQAVLCAKVDLLWNGGIGTYVK

SEQ ID NO: 803476 - protein, 23 aa, Mycobacterium
DQLWITPSQMFKGDLRPEILVRL

SEQ ID NO: 803477 - protein, 28 aa, Mycobacterium
DQMGLTNVVIMLPFVRRVAEADLVLETM

SEQ ID NO: 803478 - protein, 24 aa, Mycobacterium
DQMLAYNCSPSFNWKKHLDDSTIA

SEQ ID NO: 803479 - protein, 18 aa, Mycobacterium
DQMRAVLGLGPEVSVLTP

SEQ ID NO: 803480 - protein, 21 aa, Mycobacterium
DQMRLALLLCAVRPEIGGVLI

SEQ ID NO: 803481 - protein, 17 aa, Mycobacterium
DQNGRLFVVGRDDEMIV

SEQ ID NO: 803482 - protein, 20 aa, Mycobacterium
DQNGWIRAVGYHDSVAGPLT

SEQ ID NO: 803483 - protein, 26 aa, Mycobacterium
DQNLWRLVVPLLSDRFRIVLFDHVGS

SEQ ID NO: 803484 - protein, 22 aa, Mycobacterium
DQNWLENDFIPTVAKRGAAVID

SEQ ID NO: 803485 - protein, 24 aa, Mycobacterium
DQPAWSYAGLALRWSERYYAAERE

SEQ ID NO: 803486 - protein, 22 aa, Mycobacterium
DQPFLLGVTNLKIPSYKSCFLA

SEQ ID NO: 803487 - protein, 23 aa, Mycobacterium
DQPKIIEHILQSPLVTEVMVLST

SEQ ID NO: 803488 - protein, 24 aa, Mycobacterium
DQPLAIVTCYLPADLPHDAVEPLL

SEQ ID NO: 803489 - protein, 17 aa, Mycobacterium
DQPPLDINWIVVRMTDA

SEQ ID NO: 803490 - protein, 23 aa, Mycobacterium
DQPRHWVGHLNVIKSIQDRTGGF

SEQ ID NO: 803491 - protein, 25 aa, Mycobacterium
DQPRLLTPLALAPRGIWLGPKELRS

SEQ ID NO: 803492 - protein, 23 aa, Mycobacterium
DQPWRADLLGRKLHATLGPLVHV

SEQ ID NO: 803493 - protein, 25 aa, Mycobacterium
DQPWRRAHLSTPVRNLVLAATFEWG

SEQ ID NO: 803494 - protein, 22 aa, Mycobacterium
DQPYLRVTPKISWSLNLRGEPV

SEQ ID NO: 803495 - protein, 29 aa, Mycobacterium
DQQYRAVASGHWPLIRYNPVLRSTGRPPF

SEQ ID NO: 803496 - protein, 17 aa, Mycobacterium
DQRAAPLVPIYLGDDIT

SEQ ID NO: 803497 - protein, 27 aa, Mycobacterium
DQRAAVFLRAADLLSGPWREKVAAATM

SEQ ID NO: 803498 - protein, 20 aa, Mycobacterium
DQRDDILALLLRSAYEDGSS

SEQ ID NO: 803499 - protein, 22 aa, Mycobacterium
DQRGRIRLAGFGYRVPIVLAGE

SEQ ID NO: 803500 - protein, 17 aa, Mycobacterium
DQRIAVRYALPGMSPAD

SEQ ID NO: 803501 - protein, 25 aa, Mycobacterium
DQRMRHGMYWSGDLAYRDADGWIYL

SEQ ID NO: 803502 - protein, 27 aa, Mycobacterium
DQRPEWFYIVRFNLSQLWHGYTGPGND

SEQ ID NO: 803503 - protein, 21 aa, Mycobacterium
DQRPITVPVLLTLTERFDLPS

SEQ ID NO: 803504 - protein, 24 aa, Mycobacterium
DQRRRARLLADLEDLLLAEGFKNL

SEQ ID NO: 803505 - protein, 25 aa, Mycobacterium
DQRYGSSVVGFLDGWRGLLEDRRIQ

SEQ ID NO: 803506 - protein, 18 aa, Mycobacterium
DQSFDIVLAMYGRVAAIA

SEQ ID NO: 803507 - protein, 17 aa, Mycobacterium
DQSLVPDPHPYFDYLRS

SEQ ID NO: 803508 - protein, 26 aa, Mycobacterium
DQSVLRMFEMYPGYLQSFSQTLVDND

SEQ ID NO: 803509 - protein, 25 aa, Mycobacterium
DQTEALFRRIGLAASKYWVCKRSTP

SEQ ID NO: 803510 - protein, 26 aa, Mycobacterium
DQTERLKFLVAFRPGLVPPTLAAQQA

SEQ ID NO: 803511 - protein, 25 aa, Mycobacterium
DQTQWLVIDLSGLSFFSTAGFSALH

SEQ ID NO: 803512 - protein, 22 aa, Mycobacterium
DQTRWRTAVEKVLRGVGLRLMV

SEQ ID NO: 803513 - protein, 25 aa, Mycobacterium
DQTTGMWSTPWTWKSAGTYRVFADF

SEQ ID NO: 803514 - protein, 26 aa, Mycobacterium
DQTVAVIDYLIPGLAEAIRQSGLPKV

SEQ ID NO: 803515 - protein, 17 aa, Mycobacterium
DQVAEKLFPTLINPVRE

SEQ ID NO: 803516 - protein, 24 aa, Mycobacterium
DQVAGVIGLLSRPELKAAVGQIVN

SEQ ID NO: 803517 - protein, 26 aa, Mycobacterium
DQVATLFRMWLRDAVRRVADAALELV

SEQ ID NO: 803518 - protein, 26 aa, Mycobacterium
DQVATLFRMWLRDAVRRVADGCLEVV

SEQ ID NO: 803519 - protein, 26 aa, Mycobacterium
DQVATLFRMWLRDAVRRVATGVLEVV

SEQ ID NO: 803520 - protein, 18 aa, Mycobacterium
DQVDLLALSLQGLYQAFF

SEQ ID NO: 803521 - protein, 32 aa, Mycobacterium
DQVDLLCAFVKWQGLRLLEDQLRELRQRNVPL

SEQ ID NO: 803522 - protein, 23 aa, Mycobacterium
DQVFNLFEVLGVEKALGAGDYSD

SEQ ID NO: 803523 - protein, 24 aa, Mycobacterium
DQVFYGHVLGFKGLERRCVVLVIN

SEQ ID NO: 803524 - protein, 29 aa, Mycobacterium
DQVGRLLALGYFAAVLRWVEHDPPQFDLK

SEQ ID NO: 803525 - protein, 20 aa, Mycobacterium
DQVLQLIRSLDRPGRLTLVE

SEQ ID NO: 803526 - protein, 21 aa, Mycobacterium
DQVLQVWAKVLDLLERDPMEC

SEQ ID NO: 803527 - protein, 30 aa, Mycobacterium
DQVMRLRDLLKFDFYFADSAAFRANIAEEM

SEQ ID NO: 803528 - protein, 22 aa, Mycobacterium
DQVNTEFYFKFLRSPDGNGITD

SEQ ID NO: 803529 - protein, 26 aa, Mycobacterium
DQVSPLMVLAARVLGALVPGLPVQEL

SEQ ID NO: 803530 - protein, 25 aa, Mycobacterium
DQVTGPFILGLWNENGDGLALQGTR

SEQ ID NO: 803531 - protein, 24 aa, Mycobacterium
DQVVSHILDLILTGKLRSGDRVDR

SEQ ID NO: 803532 - protein, 20 aa, Mycobacterium
DQVYLDLLTGWRDAWEIGRT

SEQ ID NO: 803533 - protein, 18 aa, Mycobacterium
DQWGNIVAGVRLARQQDG

SEQ ID NO: 803534 - protein, 18 aa, Mycobacterium
DQWGRFDEAFAALRGWEA

SEQ ID NO: 803535 - protein, 31 aa, Mycobacterium
DQWNPFHHMVVIYALFPNIVLSVTIANGELF

SEQ ID NO: 803536 - protein, 25 aa, Mycobacterium
DQYGIDKPGFLDKAGLQATRAWAEG

SEQ ID NO: 803537 - protein, 18 aa, Mycobacterium
DQYLPLKVIKAQLDALPD

SEQ ID NO: 803538 - protein, 21 aa, Mycobacterium
DQYNLIIQDPDIQAPPTATRS

SEQ ID NO: 803539 - protein, 19 aa, Mycobacterium
DQYPNAEKFFWVQEEPANQ

SEQ ID NO: 803540 - protein, 18 aa, Mycobacterium
DQYRQPFVALLQSPEARA

SEQ ID NO: 803541 - protein, 19 aa, Mycobacterium
DQYRQPFVALLQSPEARAD

SEQ ID NO: 803542 - protein, 18 aa, Mycobacterium
DRAALWYGRLHAPDSVVQ

SEQ ID NO: 803543 - protein, 20 aa, Mycobacterium
DRAAMVRAVYPSLLAMSAAG

SEQ ID NO: 803544 - protein, 31 aa, Mycobacterium
DRAAVFLRAADLLSGPWRAILNAATMLGQSK

SEQ ID NO: 803545 - protein, 21 aa, Mycobacterium
DRAAWQGWSSVSGRWGDPATA

SEQ ID NO: 803546 - protein, 18 aa, Mycobacterium
DRACAPWGLLAEDKQATL

SEQ ID NO: 803547 - protein, 17 aa, Mycobacterium
DRACAPWGLLGEDKQAT

SEQ ID NO: 803548 - protein, 18 aa, Mycobacterium
DRACAPWGLLGEDKQATL

SEQ ID NO: 803549 - protein, 23 aa, Mycobacterium
DRADRLWIPVRRSWRLNERHYGA

SEQ ID NO: 803550 - protein, 23 aa, Mycobacterium
DRADWMFALVRTGSGGKPSDGIT

SEQ ID NO: 803551 - protein, 27 aa, Mycobacterium
DRAESLDPWWPELSKPVIGAINGAAVT

SEQ ID NO: 803552 - protein, 22 aa, Mycobacterium
DRAFRSVLARVPFDLDHPYWVR

SEQ ID NO: 803553 - protein, 25 aa, Mycobacterium
DRAGEVLGCYFLLEPGAPADTGGPA

SEQ ID NO: 803554 - protein, 26 aa, Mycobacterium
DRAGTITPFALIQLADRGQFFVEPGQ

SEQ ID NO: 803555 - protein, 31 aa, Mycobacterium
DRAGWFPVAVARRKLLAGQRPLLDELMAAPE

SEQ ID NO: 803556 - protein, 27 aa, Mycobacterium
DRAIAALRPPRRGIYDAVIDLGGRSVT

SEQ ID NO: 803557 - protein, 29 aa, Mycobacterium
DRAIDYRRDGWWQGLGPYDLVLDALGGTS

SEQ ID NO: 803558 - protein, 22 aa, Mycobacterium
DRAIGGLMLLSGLRSAEVLGLR

SEQ ID NO: 803559 - protein, 22 aa, Mycobacterium
DRAIPGVLTLRYRQLRERLRRR

SEQ ID NO: 803560 - protein, 29 aa, Mycobacterium
DRAKASVITQLLPVLDDLDRARSHGDLDS

SEQ ID NO: 803561 - protein, 18 aa, Mycobacterium
DRAKILARTLDDAIGKLL

SEQ ID NO: 803562 - protein, 22 aa, Mycobacterium
DRALAGLMLLSGLRSGELLTLD

SEQ ID NO: 803563 - protein, 17 aa, Mycobacterium
DRALFTEAARLGLLGFS

SEQ ID NO: 803564 - protein, 26 aa, Mycobacterium
DRALPLLTPFARIMRRAPLTDDLRAP

SEQ ID NO: 803565 - protein, 27 aa, Mycobacterium
DRALRPLRAPRWLPTPARRRARAAVAA

SEQ ID NO: 803566 - protein, 28 aa, Mycobacterium
DRALVRTRLVELFELFDPADPEVVVGRR

SEQ ID NO: 803567 - protein, 24 aa, Mycobacterium
DRANPFVAAVLRRLSPRARVRVGA

SEQ ID NO: 803568 - protein, 19 aa, Mycobacterium
DRAPVPFHLLPLVARELGK

SEQ ID NO: 803569 - protein, 33 aa, Mycobacterium
DRAQHLPVPIFLQRSPHFRPPRTSDTPMIMIGP

SEQ ID NO: 803570 - protein, 30 aa, Mycobacterium
DRAQQALAFRLATSWMFGYVDAALNRAEQA

SEQ ID NO: 803571 - protein, 31 aa, Mycobacterium
DRAREMTTLLRAILELRLPVIGAIDGHVRAG

SEQ ID NO: 803572 - protein, 33 aa, Mycobacterium
DRARTGVFILDARQWFQSFPAAAGSSLFSKLQE

SEQ ID NO: 803573 - protein, 27 aa, Mycobacterium
DRASCKFMKMITPAALLRCLVEGADEV

SEQ ID NO: 803574 - protein, 28 aa, Mycobacterium
DRASCTYMKMITPAALLRCLVEGADEVH

SEQ ID NO: 803575 - protein, 19 aa, Mycobacterium
DRASLWSASFASRVGGLRA

SEQ ID NO: 803576 - protein, 17 aa, Mycobacterium
DRASVTVNYRFAPDRSV

SEQ ID NO: 803577 - protein, 30 aa, Mycobacterium
DRATAQALKPWYGYFCKRPCFHDEYLQTFN

SEQ ID NO: 803578 - protein, 26 aa, Mycobacterium
DRATGQFLWQNIFGVWPVTGEVSEQL

SEQ ID NO: 803579 - protein, 17 aa, Mycobacterium
DRATKILGLLTGASKSY

SEQ ID NO: 803580 - protein, 23 aa, Mycobacterium
DRATLRISSQLLANWLRHDVITE

SEQ ID NO: 803581 - protein, 24 aa, Mycobacterium
DRATLRISSQLLANWLRHGVITSE

SEQ ID NO: 803582 - protein, 25 aa, Mycobacterium
DRATLRISSQLLANWLRHGVITSED

SEQ ID NO: 803583 - protein, 19 aa, Mycobacterium
DRAVAVNLLLPFVHRAHVA

SEQ ID NO: 803584 - protein, 20 aa, Mycobacterium
DRAVFRLLRELADVIVVGAG

SEQ ID NO: 803585 - protein, 20 aa, Mycobacterium
DRAVLHMPFKSELATMGQTV

SEQ ID NO: 803586 - protein, 18 aa, Mycobacterium
DRAVLHTALRLPRDAALT

SEQ ID NO: 803587 - protein, 17 aa, Mycobacterium
DRAVLHTALRLPRDAKL

SEQ ID NO: 803588 - protein, 22 aa, Mycobacterium
DRAVLVYPPGLDFVCGLLGCMA

SEQ ID NO: 803589 - protein, 26 aa, Mycobacterium
DRAYKPLNWMSPPCWLSEQAGDPPVW

SEQ ID NO: 803590 - protein, 26 aa, Mycobacterium
DRAYKPLNWMSPPCWLTEEPGGDSPV

SEQ ID NO: 803591 - protein, 24 aa, Mycobacterium
DRAYKPLNWMSPPCWLTEESGPQS

SEQ ID NO: 803592 - protein, 23 aa, Mycobacterium
DRAYKPLNWMSPPCWVTEQDTET

SEQ ID NO: 803593 - protein, 21 aa, Mycobacterium
DRAYTLGLTPLPPVDPTELLA

SEQ ID NO: 803594 - protein, 18 aa, Mycobacterium
DRDAAWPAIAAQLSRTVG

SEQ ID NO: 803595 - protein, 20 aa, Mycobacterium
DRDAIFKVFRRVSGGINPDI

SEQ ID NO: 803596 - protein, 22 aa, Mycobacterium
DRDAVMRALLDCPVHAITEIGQ

SEQ ID NO: 803597 - protein, 23 aa, Mycobacterium
DRDDADFRAAWSPAPMRSPRGRQ

SEQ ID NO: 803598 - protein, 27 aa, Mycobacterium
DRDDVAALLRWLGNGNFLLLGYQRCHV

SEQ ID NO: 803599 - protein, 27 aa, Mycobacterium
DRDDVAALLRWLGNGNFLLLGYQRCRV

SEQ ID NO: 803600 - protein, 25 aa, Mycobacterium
DRDELLRFEKTLMAIWRAIQSAGQS

SEQ ID NO: 803601 - protein, 24 aa, Mycobacterium
DRDELLRFEKTLMAIWRAIQSAGR

SEQ ID NO: 803602 - protein, 31 aa, Mycobacterium
DRDELLVEVPFGRLPTAYPYTLMISQADTEA

SEQ ID NO: 803603 - protein, 25 aa, Mycobacterium
DRDEPAVRWWPIAVSVARDTGILSV

SEQ ID NO: 803604 - protein, 26 aa, Mycobacterium
DRDGHWWYESLSDAPMPDWLVSALAT

SEQ ID NO: 803605 - protein, 26 aa, Mycobacterium
DRDGQWWYESLSGAPMPDWLRNALSA

SEQ ID NO: 803606 - protein, 26 aa, Mycobacterium
DRDGRWWYESLSGAPMPDWLAAALAT

SEQ ID NO: 803607 - protein, 20 aa, Mycobacterium
DRDGWLALMTDDVVIEDPIG

SEQ ID NO: 803608 - protein, 19 aa, Mycobacterium
DRDGYLYLHDRIKDMIVSG

SEQ ID NO: 803609 - protein, 20 aa, Mycobacterium
DRDHAVFFATRVLGGLAAAD

SEQ ID NO: 803610 - protein, 24 aa, Mycobacterium
DRDHLDTMVLYPSLGLCVPSLENP

SEQ ID NO: 803611 - protein, 18 aa, Mycobacterium
DRDKGILREWRIIEALDG

SEQ ID NO: 803612 - protein, 19 aa, Mycobacterium
DRDLLMWCHRNRCTDNRVR

SEQ ID NO: 803613 - protein, 19 aa, Mycobacterium
DRDLQLVVNSLWASGAEAV

SEQ ID NO: 803614 - protein, 19 aa, Mycobacterium
DRDMRGHRVLDDSFILCFN

SEQ ID NO: 803615 - protein, 32 aa, Mycobacterium
DRDNDFEPLLLDWRAPMARPFYVATAANPENM

SEQ ID NO: 803616 - protein, 28 aa, Mycobacterium
DRDPGHFWVWSINPCFPNQPGCLQIYAT

SEQ ID NO: 803617 - protein, 23 aa, Mycobacterium
DRDQLNEALALGAPPAGGGAGSD

SEQ ID NO: 803618 - protein, 23 aa, Mycobacterium
DRDQVFAAVRHASSALGGFDIMV

SEQ ID NO: 803619 - protein, 24 aa, Mycobacterium
DRDRELLGLLRKAKVRGAALTALE

SEQ ID NO: 803620 - protein, 23 aa, Mycobacterium
DRDRPLWEIWVIEGLSDNRWAML

SEQ ID NO: 803621 - protein, 23 aa, Mycobacterium
DRDRPLWEMWVIEGLHGGDAVSV

SEQ ID NO: 803622 - protein, 23 aa, Mycobacterium
DRDRPLWEMWVIEGLRGGDALSV

SEQ ID NO: 803623 - protein, 21 aa, Mycobacterium
DRDRVYSPLEAAKLAKETSSK

SEQ ID NO: 803624 - protein, 20 aa, Mycobacterium
DRDRWRQVATPKGEIAALLP

SEQ ID NO: 803625 - protein, 24 aa, Mycobacterium
DRDTTQLVPYDALRRARSSVGFPT

SEQ ID NO: 803626 - protein, 22 aa, Mycobacterium
DRDTWRLVLRGLDETASRRYGK

SEQ ID NO: 803627 - protein, 26 aa, Mycobacterium
DRDVIDAFLSWYLPDIDISDPGALPV

SEQ ID NO: 803628 - protein, 18 aa, Mycobacterium
DRDWAPKVYGAWHLHQAT

SEQ ID NO: 803629 - protein, 20 aa, Mycobacterium
DREAAFAHFGRRFDDLATEV

SEQ ID NO: 803630 - protein, 22 aa, Mycobacterium
DREAARAAWRKALEGFEAPTLV

SEQ ID NO: 803631 - protein, 27 aa, Mycobacterium
DREFAYRVLRAWLHTLRDRLTVDASAH

SEQ ID NO: 803632 - protein, 23 aa, Mycobacterium
DREGAMVALVERLDRWASSQGET

SEQ ID NO: 803633 - protein, 34 aa, Mycobacterium
DREGEAIAWHLLETLKPRIPVKRMVFHEITEPAI

SEQ ID NO: 803634 - protein, 30 aa, Mycobacterium
DREGEAIAWHLLETLKPRVPVKRMVFHEIT

SEQ ID NO: 803635 - protein, 21 aa, Mycobacterium
DREHAALGFPYPPVGQRFEML

SEQ ID NO: 803636 - protein, 30 aa, Mycobacterium
DREHIDLPQAQLALLRAVVEVQPRTVVVLS

SEQ ID NO: 803637 - protein, 19 aa, Mycobacterium
DREIEVPKLVFTEPIPIVS

SEQ ID NO: 803638 - protein, 19 aa, Mycobacterium
DREILGIAEAIRASGLSAG

SEQ ID NO: 803639 - protein, 19 aa, Mycobacterium
DREILGIAEAIRGSGLSAG

SEQ ID NO: 803640 - protein, 23 aa, Mycobacterium
DREINILFAVDLFNEGLDIPEVD

SEQ ID NO: 803641 - protein, 20 aa, Mycobacterium
DREIRRPTYVFAAVDHAGAD

SEQ ID NO: 803642 - protein, 24 aa, Mycobacterium
DREKQVLIAWFQTESKDLVAERLF

SEQ ID NO: 803643 - protein, 24 aa, Mycobacterium
DREKWMFAHVPFAKKIYRTRLWLR

SEQ ID NO: 803644 - protein, 19 aa, Mycobacterium
DRELAETWHIKRYGFHGTS

SEQ ID NO: 803645 - protein, 20 aa, Mycobacterium
DRELLGISEALRASGLAAGI

SEQ ID NO: 803646 - protein, 26 aa, Mycobacterium
DRELLPDVAALPPLLDRYGWTGRRDG

SEQ ID NO: 803647 - protein, 25 aa, Mycobacterium
DRELSRYADWSLLEELTRDEASSRM

SEQ ID NO: 803648 - protein, 21 aa, Mycobacterium
DREMLIDFHDWDAPALAGITY

SEQ ID NO: 803649 - protein, 22 aa, Mycobacterium
DREMLIDFHDWDAPALAGITYE

SEQ ID NO: 803650 - protein, 19 aa, Mycobacterium
DREPALYPELMGLIAECGG

SEQ ID NO: 803651 - protein, 32 aa, Mycobacterium
DREPDWVNTIFLSTRFRAWRVGGYNEYLYTFF

SEQ ID NO: 803652 - protein, 30 aa, Mycobacterium
DREREVAELLLLGMPYRDIGNQLFISAKTV

SEQ ID NO: 803653 - protein, 24 aa, Mycobacterium
DRERKMGFNLAFGYGIHSCLGAAL

SEQ ID NO: 803654 - protein, 21 aa, Mycobacterium
DRERLGLPVFVKPSRGGSSIG

SEQ ID NO: 803655 - protein, 21 aa, Mycobacterium
DRERLLRDGLVGMATIVGIRR

SEQ ID NO: 803656 - protein, 19 aa, Mycobacterium
DRERYLTGGLQPVDCRFCH

SEQ ID NO: 803657 - protein, 26 aa, Mycobacterium
DREVLFCPDQFLGAHVKRVTGRQNLH

SEQ ID NO: 803658 - protein, 19 aa, Mycobacterium
DREVLFCPDQFLGAHVRRE

SEQ ID NO: 803659 - protein, 19 aa, Mycobacterium
DREVLFCPDQFLGAHVRRV

SEQ ID NO: 803660 - protein, 26 aa, Mycobacterium
DREVLFCPDQFLGAHVRRVTGRKNLH

SEQ ID NO: 803661 - protein, 26 aa, Mycobacterium
DREVLFCPDQFLGAHVRRVTGRTNMH

SEQ ID NO: 803662 - protein, 20 aa, Mycobacterium
DREVTPPRRFGALSIDVAAR

SEQ ID NO: 803663 - protein, 17 aa, Mycobacterium
DREYQKMRDLGIAILRE

SEQ ID NO: 803664 - protein, 18 aa, Mycobacterium
DREYQKMRDLGIAILREV

SEQ ID NO: 803665 - protein, 18 aa, Mycobacterium
DREYQRMRDLGIAILREV

SEQ ID NO: 803666 - protein, 19 aa, Mycobacterium
DRFAAHGFAFYALDLDKCG

SEQ ID NO: 803667 - protein, 38 aa, Mycobacterium
DRFATSASALQRYRKLRDTWLSARRDLLDRRNRARELA

SEQ ID NO: 803668 - protein, 25 aa, Mycobacterium
DRFDEWMTIFAGWRSPVPDTIEEGT

SEQ ID NO: 803669 - protein, 17 aa, Mycobacterium
DRFDLRGQRLGAVVGGA

SEQ ID NO: 803670 - protein, 17 aa, Mycobacterium
DRFFEARKMMSQMAGQM

SEQ ID NO: 803671 - protein, 17 aa, Mycobacterium
DRFFEARKMMSSMAGQM

SEQ ID NO: 803672 - protein, 18 aa, Mycobacterium
DRFGFTAHMDFYEPAELE

SEQ ID NO: 803673 - protein, 20 aa, Mycobacterium
DRFGIPTVIDILAELEKPGR

SEQ ID NO: 803674 - protein, 21 aa, Mycobacterium
DRFGLSWQIVPDRLYELISDP

SEQ ID NO: 803675 - protein, 23 aa, Mycobacterium
DRFGLSWQIVPDRLYELLSDPDP

SEQ ID NO: 803676 - protein, 19 aa, Mycobacterium
DRFHLVIDVIDRVVGLSSR

SEQ ID NO: 803677 - protein, 21 aa, Mycobacterium
DRFITLDAPYRPDPARRHAYD

SEQ ID NO: 803678 - protein, 18 aa, Mycobacterium
DRFMKYLTGCADFFRRGV

SEQ ID NO: 803679 - protein, 22 aa, Mycobacterium
DRFPAGIQMRLLCQEPMMFVCR

SEQ ID NO: 803680 - protein, 24 aa, Mycobacterium
DRFPDGQWYVDLAPITIPAVVPVA

SEQ ID NO: 803681 - protein, 19 aa, Mycobacterium
DRFSYRIAVRRIPNGNGGS

SEQ ID NO: 803682 - protein, 29 aa, Mycobacterium
DRFVWDTPVLKINYALDAPVPWRSKNLND

SEQ ID NO: 803683 - protein, 18 aa, Mycobacterium
DRGAAGVALLASMPPRPG

SEQ ID NO: 803684 - protein, 30 aa, Mycobacterium
DRGAGLDGLSLPLLRSWLSAGAAAGAARTT

SEQ ID NO: 803685 - protein, 25 aa, Mycobacterium
DRGAQIRLEFEPGLLRLSAGADDVG

SEQ ID NO: 803686 - protein, 18 aa, Mycobacterium
DRGARLVELLKQPQYSPL

SEQ ID NO: 803687 - protein, 34 aa, Mycobacterium
DRGARVLLREFVDYWQHLLTEGDFTAGCPVAAAA

SEQ ID NO: 803688 - protein, 20 aa, Mycobacterium
DRGFEWLRENWPEESLSGVG

SEQ ID NO: 803689 - protein, 29 aa, Mycobacterium
DRGFFDDLVSPFLGLYRDNNLRPDSSAEK

SEQ ID NO: 803690 - protein, 29 aa, Mycobacterium
DRGFFDDLVTPFLGLYRDDNLRPDSSAEK

SEQ ID NO: 803691 - protein, 23 aa, Mycobacterium
DRGGLLVEGARVRRLSHHRGRVR

SEQ ID NO: 803692 - protein, 23 aa, Mycobacterium
DRGILTVALARMQAMRTPPDYAE

SEQ ID NO: 803693 - protein, 21 aa, Mycobacterium
DRGIPIDWSGTALHRRARRIA

SEQ ID NO: 803694 - protein, 18 aa, Mycobacterium
DRGIREMVILRVGTLSGS

SEQ ID NO: 803695 - protein, 27 aa, Mycobacterium
DRGIVFQQYALLPWRTARKNIEFGLEA

SEQ ID NO: 803696 - protein, 27 aa, Mycobacterium
DRGKIEALLRILEPFGIREIVQSGVVS

SEQ ID NO: 803697 - protein, 27 aa, Mycobacterium
DRGKLEALLRVLEPFGIREIAQSGMVA

SEQ ID NO: 803698 - protein, 24 aa, Mycobacterium
DRGKNLAYFGLRNALSAPHRTGRH

SEQ ID NO: 803699 - protein, 19 aa, Mycobacterium
DRGKYQLGIGVSRLARARS

SEQ ID NO: 803700 - protein, 32 aa, Mycobacterium
DRGLHVLVFGPFRALRLATALRSAAGTTERTG

SEQ ID NO: 803701 - protein, 25 aa, Mycobacterium
DRGLHVLVFGPLRALRLATALGCAA

SEQ ID NO: 803702 - protein, 18 aa, Mycobacterium
DRGLIRLLELRPDLSQPP

SEQ ID NO: 803703 - protein, 25 aa, Mycobacterium
DRGMPLTFEIARFIKFIVTEIFPGG

SEQ ID NO: 803704 - protein, 23 aa, Mycobacterium
DRGNFPVFRKRLRQWMMRITAYA

SEQ ID NO: 803705 - protein, 33 aa, Mycobacterium
DRGNFPVFRKRLRQWMMRITAYADRLLDDLDVL

SEQ ID NO: 803706 - protein, 32 aa, Mycobacterium
DRGNFPVFRKRLRQWMMRITAYSDRLLEDLDV

SEQ ID NO: 803707 - protein, 24 aa, Mycobacterium
DRGPDRVLRVADILFRVGIDYDLS

SEQ ID NO: 803708 - protein, 23 aa, Mycobacterium
DRGPLLVGPADRLSPLMLAFRRA

SEQ ID NO: 803709 - protein, 26 aa, Mycobacterium
DRGPSQWLLRLLATQTQRAELVPLLD

SEQ ID NO: 803710 - protein, 21 aa, Mycobacterium
DRGPVWVFSGQGSQWAAMGAD

SEQ ID NO: 803711 - protein, 18 aa, Mycobacterium
DRGRALEPLPFPGAVYHV

SEQ ID NO: 803712 - protein, 24 aa, Mycobacterium
DRGRPIALLSPMPEGGPYQQMLAS

SEQ ID NO: 803713 - protein, 20 aa, Mycobacterium
DRGRRFLIDAAKIAYVEIGV

SEQ ID NO: 803714 - protein, 21 aa, Mycobacterium
DRGRVLARWSPPGESGAQCGG

SEQ ID NO: 803715 - protein, 24 aa, Mycobacterium
DRGRWGCVLGGDPDRRITAMRARE

SEQ ID NO: 803716 - protein, 25 aa, Mycobacterium
DRGRWGCVLGGDPLRRVTAMRAREL

SEQ ID NO: 803717 - protein, 30 aa, Mycobacterium
DRGSALETLSLPLLRAWLASASGAGVARTT

SEQ ID NO: 803718 - protein, 22 aa, Mycobacterium
DRGTLAPWVTPISHAIGDGIVK

SEQ ID NO: 803719 - protein, 24 aa, Mycobacterium
DRGTWTPAPVFAMIAQRGRVVRQE

SEQ ID NO: 803720 - protein, 17 aa, Mycobacterium
DRGWDLADLFDPDPDTP

SEQ ID NO: 803721 - protein, 17 aa, Mycobacterium
DRGWDLAELFDPDPDTP

SEQ ID NO: 803722 - protein, 18 aa, Mycobacterium
DRGWHLLAVLERLERLAG

SEQ ID NO: 803723 - protein, 17 aa, Mycobacterium
DRGYDESLWRLLCEQVG

SEQ ID NO: 803724 - protein, 22 aa, Mycobacterium
DRGYGYGPAFRGLTSMWRRGDE

SEQ ID NO: 803725 - protein, 26 aa, Mycobacterium
DRGYHLELIVPVPLPRRLTGDLVRLP

SEQ ID NO: 803726 - protein, 24 aa, Mycobacterium
DRHDHSHYYVMGSESLRSITDIAS

SEQ ID NO: 803727 - protein, 17 aa, Mycobacterium
DRHILNCAVIGELVEAG

SEQ ID NO: 803728 - protein, 27 aa, Mycobacterium
DRHLAPRPGTDAALLFAIVHVLFDENL

SEQ ID NO: 803729 - protein, 25 aa, Mycobacterium
DRHLPRGLRRWSSALLAAGITVGLG

SEQ ID NO: 803730 - protein, 17 aa, Mycobacterium
DRHPCIAEVFRAGDATS

SEQ ID NO: 803731 - protein, 25 aa, Mycobacterium
DRHRELLRLMTFIEGLDDATPRLRV

SEQ ID NO: 803732 - protein, 25 aa, Mycobacterium
DRHTQPLIRLPLCAEALAIRLIPDA

SEQ ID NO: 803733 - protein, 24 aa, Mycobacterium
DRHTQPLIRLPLGTDELALRLIPS

SEQ ID NO: 803734 - protein, 23 aa, Mycobacterium
DRHTVICVLTHDPKFDVPVLEVA

SEQ ID NO: 803735 - protein, 21 aa, Mycobacterium
DRHVRVDLVVAQLVRDHAEVV

SEQ ID NO: 803736 - protein, 23 aa, Mycobacterium
DRHWPALCRVVGRPEWLADPRYG

SEQ ID NO: 803737 - protein, 20 aa, Mycobacterium
DRIAIWSDAVKFDLVTASRD

SEQ ID NO: 803738 - protein, 20 aa, Mycobacterium
DRIALLMYNDLYPDMVIGCL

SEQ ID NO: 803739 - protein, 20 aa, Mycobacterium
DRIASWFQSSPAKEGPFSGA

SEQ ID NO: 803740 - protein, 30 aa, Mycobacterium
DRIATGALWRDFGLPPFERLRVIACGTSLN

SEQ ID NO: 803741 - protein, 20 aa, Mycobacterium
DRIDPRFPVFSAASLAEALP

SEQ ID NO: 803742 - protein, 17 aa, Mycobacterium
DRIFRALQDAGFDDWTL

SEQ ID NO: 803743 - protein, 22 aa, Mycobacterium
DRIGALWSRFSAVAARNPHAWN

SEQ ID NO: 803744 - protein, 33 aa, Mycobacterium
DRIHRLLRLSRHVPWDLWELDLLVRTTHLGGGA

SEQ ID NO: 803745 - protein, 17 aa, Mycobacterium
DRIIADRVAAGRPVLGV

SEQ ID NO: 803746 - protein, 25 aa, Mycobacterium
DRIIPAVDRFEPELIIVSAGFDAHE

SEQ ID NO: 803747 - protein, 19 aa, Mycobacterium
DRIIPLSNTPLFLTSIVPS

SEQ ID NO: 803748 - protein, 24 aa, Mycobacterium
DRIIRSMAGSEWSLLVLAQPLAEH

SEQ ID NO: 803749 - protein, 18 aa, Mycobacterium
DRILPIMNDVAAVDSPIR

SEQ ID NO: 803750 - protein, 25 aa, Mycobacterium
DRILRYAFELAQRRPRRLLTSATKS

SEQ ID NO: 803751 - protein, 18 aa, Mycobacterium
DRILVELTDHARATFAEI

SEQ ID NO: 803752 - protein, 26 aa, Mycobacterium
DRINDALRGPFFVLREAKVDPRLVDL

SEQ ID NO: 803753 - protein, 22 aa, Mycobacterium
DRINELDRRLKSGPLRDAGSDT

SEQ ID NO: 803754 - protein, 21 aa, Mycobacterium
DRINHFIPNVTFDPIIVPGCL

SEQ ID NO: 803755 - protein, 18 aa, Mycobacterium
DRIPLGPFAIRTSYRARL

SEQ ID NO: 803756 - protein, 25 aa, Mycobacterium
DRIPLHPMRVYAELAPLLDRDAIVV

SEQ ID NO: 803757 - protein, 18 aa, Mycobacterium
DRIPLYQIHQSNPVVPDT

SEQ ID NO: 803758 - protein, 29 aa, Mycobacterium
DRIPSNVLVAEWIPYSALLPNVDVMITNG

SEQ ID NO: 803759 - protein, 21 aa, Mycobacterium
DRIQAIYPSGPYNLLGWSFGG

SEQ ID NO: 803760 - protein, 31 aa, Mycobacterium
DRIQPVLVGIQLALTALWRSHGVTPDAVVGH

SEQ ID NO: 803761 - protein, 32 aa, Mycobacterium
DRIQPVLVGMQLALTQLWRSYGVEPDAVIGHS

SEQ ID NO: 803762 - protein, 23 aa, Mycobacterium
DRIVEWLVDKFKGTSGIDLTKDK

SEQ ID NO: 803763 - protein, 19 aa, Mycobacterium
DRIVEYLAVRARRAQRGLQ

SEQ ID NO: 803764 - protein, 17 aa, Mycobacterium
DRIWDRHILNCAVIGEL

SEQ ID NO: 803765 - protein, 19 aa, Mycobacterium
DRKAEAVQWFLHAADADVE

SEQ ID NO: 803766 - protein, 21 aa, Mycobacterium
DRKALLDRLTAEKLPDGWDAD

SEQ ID NO: 803767 - protein, 25 aa, Mycobacterium
DRKGPGRPPLMFRAVRQMDRGGTRH

SEQ ID NO: 803768 - protein, 23 aa, Mycobacterium
DRKIALIASLWNAIMTTALVQLV

SEQ ID NO: 803769 - protein, 17 aa, Mycobacterium
DRKQLLVVLGRDDLASV

SEQ ID NO: 803770 - protein, 25 aa, Mycobacterium
DRKRRHSLLPLLQNYREPAEPIRGG

SEQ ID NO: 803771 - protein, 24 aa, Mycobacterium
DRKRRQPVTVLLKALGWSNEQIHE

SEQ ID NO: 803772 - protein, 28 aa, Mycobacterium
DRKRRQPVTVLLKALGWTNEQIVERFGF

SEQ ID NO: 803773 - protein, 28 aa, Mycobacterium
DRKRRQPVTVLLKALGWTSERITERFGF

SEQ ID NO: 803774 - protein, 19 aa, Mycobacterium
DRLAADPRLPLDRAALDAA

SEQ ID NO: 803775 - protein, 25 aa, Mycobacterium
DRLAADPRLPLDRPALDAALADRQA

SEQ ID NO: 803776 - protein, 19 aa, Mycobacterium
DRLAAEEWRSLRLAVKQET

SEQ ID NO: 803777 - protein, 25 aa, Mycobacterium
DRLAEPRWLRFTPAGFDAGESGQFR

SEQ ID NO: 803778 - protein, 23 aa, Mycobacterium
DRLAKMLRFAVDEVFQMQSEARA

SEQ ID NO: 803779 - protein, 21 aa, Mycobacterium
DRLALNPQRIDGIAAGLRQVA

SEQ ID NO: 803780 - protein, 17 aa, Mycobacterium
DRLATLRRRAIKAADEA

SEQ ID NO: 803781 - protein, 19 aa, Mycobacterium
DRLCELDFEFPLAGGDAAA

SEQ ID NO: 803782 - protein, 24 aa, Mycobacterium
DRLDEIWNTFTKLAPKQLIVDEVL

SEQ ID NO: 803783 - protein, 21 aa, Mycobacterium
DRLDGLWEEDGPGRAHRGQID

SEQ ID NO: 803784 - protein, 25 aa, Mycobacterium
DRLDRAVLLALTRSFGGGPVGLSTL

SEQ ID NO: 803785 - protein, 18 aa, Mycobacterium
DRLEFLAAPGWTIIRVSH

SEQ ID NO: 803786 - protein, 31 aa, Mycobacterium
DRLGLDYLDLYLIHWPAPKLGKYVESFEGMK

SEQ ID NO: 803787 - protein, 31 aa, Mycobacterium
DRLGLDYVDLYLIHWPAPAAGKYVDAFGGLI

SEQ ID NO: 803788 - protein, 21 aa, Mycobacterium
DRLGYALIRLSGQITGPAELP

SEQ ID NO: 803789 - protein, 24 aa, Mycobacterium
DRLHVVALPMRVRFRGITTREVAL

SEQ ID NO: 803790 - protein, 18 aa, Mycobacterium
DRLIAFTGRRPVHPTGLT

SEQ ID NO: 803791 - protein, 18 aa, Mycobacterium
DRLIELHKLMDATLIPVI

SEQ ID NO: 803792 - protein, 22 aa, Mycobacterium
DRLIFGSDFPYQAGPRYVSSAT

SEQ ID NO: 803793 - protein, 20 aa, Mycobacterium
DRLKSELLVLMDGLERLAQA

SEQ ID NO: 803794 - protein, 18 aa, Mycobacterium
DRLKSFLRHGITTIKSVG

SEQ ID NO: 803795 - protein, 32 aa, Mycobacterium
DRLLAIVPMFHANAWGLIYAALMSGADLVLPD

SEQ ID NO: 803796 - protein, 17 aa, Mycobacterium
DRLLAKGGTMLGTARVN

SEQ ID NO: 803797 - protein, 17 aa, Mycobacterium
DRLLDPGSPFLELAPLA

SEQ ID NO: 803798 - protein, 17 aa, Mycobacterium
DRLLIAEAMAHLSDEHR

SEQ ID NO: 803799 - protein, 23 aa, Mycobacterium
DRLLLFLAAELARKHRSAGLALS

SEQ ID NO: 803800 - protein, 29 aa, Mycobacterium
DRLNVELPFPCVWVAPWSPDAAIEPLRHS

SEQ ID NO: 803801 - protein, 25 aa, Mycobacterium
DRLPIEDSWTPITLREGGTPLLPAP

SEQ ID NO: 803802 - protein, 21 aa, Mycobacterium
DRLPKVGALFLAGLLSELLVR

SEQ ID NO: 803803 - protein, 30 aa, Mycobacterium
DRLPSYMMPSRLVPLPQLPVTVNGKLDGGA

SEQ ID NO: 803804 - protein, 19 aa, Mycobacterium
DRLPTRVVLLSAFDDSPVV

SEQ ID NO: 803805 - protein, 19 aa, Mycobacterium
DRLQFALCVDPRRAHLRKL

SEQ ID NO: 803806 - protein, 23 aa, Mycobacterium
DRLQRLWTPHRMTYIADAVKGGS

SEQ ID NO: 803807 - protein, 26 aa, Mycobacterium
DRLRDRFLFSLLAASGLRVGEALGLR

SEQ ID NO: 803808 - protein, 18 aa, Mycobacterium
DRLRELALVWEEGELLYL

SEQ ID NO: 803809 - protein, 22 aa, Mycobacterium
DRLRMADLRVTRPRVAVLEVVD

SEQ ID NO: 803810 - protein, 19 aa, Mycobacterium
DRLRVHSLARTLGTTSKRV

SEQ ID NO: 803811 - protein, 25 aa, Mycobacterium
DRLSAPRVVWVMVPAGNITTGVIKE

SEQ ID NO: 803812 - protein, 19 aa, Mycobacterium
DRLSDRLGLPALARIVSWA

SEQ ID NO: 803813 - protein, 24 aa, Mycobacterium
DRLSTGVLAIRKAGKLPPPVHAER

SEQ ID NO: 803814 - protein, 20 aa, Mycobacterium
DRLTAGVLLFTVRRDARAAY

SEQ ID NO: 803815 - protein, 18 aa, Mycobacterium
DRLTALLDGLMGPESLEA

SEQ ID NO: 803816 - protein, 19 aa, Mycobacterium
DRLTGRPGYRFVPHDICDP

SEQ ID NO: 803817 - protein, 31 aa, Mycobacterium
DRLTIHDYFWRWDTDWFWCSRAFGAQNPRLR

SEQ ID NO: 803818 - protein, 32 aa, Mycobacterium
DRLTIHDYFWRWDTDWFWCSRAFGVQDPRVRR

SEQ ID NO: 803819 - protein, 34 aa, Mycobacterium
DRLTLDMRRLLDRASRWLISYRPQPLAVGAEINR

SEQ ID NO: 803820 - protein, 18 aa, Mycobacterium
DRLTLVSRAFHSDQLGPF

SEQ ID NO: 803821 - protein, 29 aa, Mycobacterium
DRLTTHDYFWRWDTDWFWCSRAFGAQNPT

SEQ ID NO: 803822 - protein, 20 aa, Mycobacterium
DRLTVVHWLETVQGLPTAAG

SEQ ID NO: 803823 - protein, 23 aa, Mycobacterium
DRLVAGWQVVALEPYGGAWLNSW

SEQ ID NO: 803824 - protein, 18 aa, Mycobacterium
DRLVELNFDALTTPEWLA

SEQ ID NO: 803825 - protein, 19 aa, Mycobacterium
DRLVIAPNLWAGVGLVRGG

SEQ ID NO: 803826 - protein, 28 aa, Mycobacterium
DRLVNVNIGGVFWAIHAAIPHFGEGSRI

SEQ ID NO: 803827 - protein, 30 aa, Mycobacterium
DRLWHAVPCFPTVSELWLRLLEAYRDASDH

SEQ ID NO: 803828 - protein, 18 aa, Mycobacterium
DRLWSDCPVVPVNLAPTS

SEQ ID NO: 803829 - protein, 24 aa, Mycobacterium
DRLYALAASRLYPGWVAYEKRAEG

SEQ ID NO: 803830 - protein, 18 aa, Mycobacterium
DRLYFEPLTFEDVLEIYY

SEQ ID NO: 803831 - protein, 19 aa, Mycobacterium
DRMAYIPKDQLAAAMATDP

SEQ ID NO: 803832 - protein, 31 aa, Mycobacterium
DRMERYLALASPMLRTMDALLPQLEALVATG

SEQ ID NO: 803833 - protein, 27 aa, Mycobacterium
DRMFGTWHYWWQAHLLDCLIDAELRDP

SEQ ID NO: 803834 - protein, 31 aa, Mycobacterium
DRMGKPAQLPLPVLIAGWLRSRAEADEAEVR

SEQ ID NO: 803835 - protein, 33 aa, Mycobacterium
DRMKARAALLDHLPLITFEQQVGIALAVRKECL

SEQ ID NO: 803836 - protein, 18 aa, Mycobacterium
DRMLDLGVVIQPTGDHQN

SEQ ID NO: 803837 - protein, 18 aa, Mycobacterium
DRMLELGVIIQPTGDHQN

SEQ ID NO: 803838 - protein, 23 aa, Mycobacterium
DRMNLFYQHAVPLAVDVAARALD

SEQ ID NO: 803839 - protein, 22 aa, Mycobacterium
DRMPYAWNPNYPARIGVMPREG

SEQ ID NO: 803840 - protein, 26 aa, Mycobacterium
DRMRDMGLFGLMIPQEYGGLGESLLT

SEQ ID NO: 803841 - protein, 18 aa, Mycobacterium
DRMRQAVVQCPAAALRIE

SEQ ID NO: 803842 - protein, 22 aa, Mycobacterium
DRMRRRWRIVLVDEFQDTDPIQ

SEQ ID NO: 803843 - protein, 19 aa, Mycobacterium
DRMRVSHMLGFDDPVKMVA

SEQ ID NO: 803844 - protein, 18 aa, Mycobacterium
DRMSLPMMGPGRWLRDVF

SEQ ID NO: 803845 - protein, 38 aa, Mycobacterium
DRMVAGWQVVALQPYGGAWLNSWLDRDLGISGRLTLRD

SEQ ID NO: 803846 - protein, 23 aa, Mycobacterium
DRMWSDDIAVWRVGARRDDGKAR

SEQ ID NO: 803847 - protein, 18 aa, Mycobacterium
DRMWSGLLLHPLETAENA

SEQ ID NO: 803848 - protein, 28 aa, Mycobacterium
DRNADIAWAGPPPEWWAQRFGIEPDLAE

SEQ ID NO: 803849 - protein, 27 aa, Mycobacterium
DRNADIAWAGPPPLWWAQRFGTEPDLA

SEQ ID NO: 803850 - protein, 28 aa, Mycobacterium
DRNPEVIRFLAYTGLRWGEMAALRVCDF

SEQ ID NO: 803851 - protein, 24 aa, Mycobacterium
DRNRADMFVHITLVGLLNSPRLSR

SEQ ID NO: 803852 - protein, 19 aa, Mycobacterium
DRNRRITAWVKDKLAELAA

SEQ ID NO: 803853 - protein, 34 aa, Mycobacterium
DRNTHGCSWLPLYHDMGLSMIGFPTVYGGHSTLM

SEQ ID NO: 803854 - protein, 32 aa, Mycobacterium
DRNTHGVSWLPLYHDMGLSMIGFPAVYGGHST

SEQ ID NO: 803855 - protein, 33 aa, Mycobacterium; identical to SEQ ID NO: 113957

SEQ ID NO: 803856 - protein, 34 aa, Mycobacterium
DRNVCTWLCFVTIGPLFVFGLHKPNHDFRRFPRP

SEQ ID NO: 803857 - protein, 27 aa, Mycobacterium
DRNYVHSLEWLWLTEPLSEGPGESWIN

SEQ ID NO: 803858 - protein, 19 aa, Mycobacterium
DRPAPARLGAMRGSTRGAL

SEQ ID NO: 803859 - protein, 23 aa, Mycobacterium
DRPDTVGFAFHFGDQPFGRVVTD

SEQ ID NO: 803860 - protein, 25 aa, Mycobacterium
DRPFTFEQKAYLLPAAAIDTARWVD

SEQ ID NO: 803861 - protein, 22 aa, Mycobacterium
DRPFVALPVFPSRLFRHSSVYV

SEQ ID NO: 803862 - protein, 19 aa, Mycobacterium
DRPGDGVAVLRLNRPKQLN

SEQ ID NO: 803863 - protein, 28 aa, Mycobacterium
DRPGDPTLRRLLPDFYKLDPGDPMTLDA

SEQ ID NO: 803864 - protein, 25 aa, Mycobacterium
DRPIDTAWRRTSYSGLLRAAEESGV

SEQ ID NO: 803865 - protein, 20 aa, Mycobacterium
DRPITAQAPWPIGYDDVEPY

SEQ ID NO: 803866 - protein, 22 aa, Mycobacterium
DRPIVARLAPGGLLAIAVLSEV

SEQ ID NO: 803867 - protein, 23 aa, Mycobacterium
DRPLKRLLSALTPKRPKPASSHD

SEQ ID NO: 803868 - protein, 28 aa, Mycobacterium
DRPLPWATMHKLTAPTLLTWGRDDRVSP

SEQ ID NO: 803869 - protein, 20 aa, Mycobacterium
DRPLRPSFVDGLRNEIQIVV

SEQ ID NO: 803870 - protein, 26 aa, Mycobacterium
DRPLTPLEFAYFVIQLMVAGNETSRN

SEQ ID NO: 803871 - protein, 31 aa, Mycobacterium
DRPLVMLLHGFGSFWWSWRHQLRGLTGARVV

SEQ ID NO: 803872 - protein, 22 aa, Mycobacterium
DRPLVVFVGRITRQKGVAHLVA

SEQ ID NO: 803873 - protein, 29 aa, Mycobacterium
DRPPGVRELLWEPMHLYPDDIRRGITNSS

SEQ ID NO: 803874 - protein, 22 aa, Mycobacterium
DRPRAAGRRGAPAQAGAAVPLR

SEQ ID NO: 803875 - protein, 18 aa, Mycobacterium
DRPRPIPAGIRAIATALA

SEQ ID NO: 803876 - protein, 25 aa, Mycobacterium
DRPSFIALRTIIGYPAPKLMNTGKA

SEQ ID NO: 803877 - protein, 20 aa, Mycobacterium
DRPSGITRRTSECVPAMVVV

SEQ ID NO: 803878 - protein, 25 aa, Mycobacterium
DRPSPFAASLLFGYVGAFMYEGDTP

SEQ ID NO: 803879 - protein, 17 aa, Mycobacterium
DRPVALGIIHERLVPLV

SEQ ID NO: 803880 - protein, 27 aa, Mycobacterium
DRPVPMLSYIDIRKLPFGDYFDGLRAG

SEQ ID NO: 803881 - protein, 26 aa, Mycobacterium
DRPVPQLLAMGLLRRVDAETVILPRH

SEQ ID NO: 803882 - protein, 27 aa, Mycobacterium
DRPVPRLLAAGLLRRLDEDTVILPRLV

SEQ ID NO: 803883 - protein, 23 aa, Mycobacterium
DRPVRRLMAVSARAGIVVTGTEV

SEQ ID NO: 803884 - protein, 19 aa, Mycobacterium
DRPVVLVTHGGLIAALTAA

SEQ ID NO: 803885 - protein, 25 aa, Mycobacterium
DRPVYTLGHYGLFMGPLDGWLRRLG

SEQ ID NO: 803886 - protein, 25 aa, Mycobacterium
DRPVYTLSHDILFMGLTGSLFRRTG

SEQ ID NO: 803887 - protein, 18 aa, Mycobacterium
DRPWRRAGVVRYAAARVR

SEQ ID NO: 803888 - protein, 18 aa, Mycobacterium
DRQAFGAALLDEPTIRFT

SEQ ID NO: 803889 - protein, 17 aa, Mycobacterium
DRQFRTVLATLNEYRDP

SEQ ID NO: 803890 - protein, 26 aa, Mycobacterium
DRQHEHMYQLMLARDLDGLLDATTRH

SEQ ID NO: 803891 - protein, 23 aa, Mycobacterium
DRQNVREQIAFIRGAHSCPGAPL

SEQ ID NO: 803892 - protein, 17 aa, Mycobacterium
DRQPVLGQLLLRHAHRL

SEQ ID NO: 803893 - protein, 23 aa, Mycobacterium
DRQQLREAIWARAAQIRRQYLET

SEQ ID NO: 803894 - protein, 26 aa, Mycobacterium
DRQRAVLAAFPGWGPVAKVFDAQPEG

SEQ ID NO: 803895 - protein, 25 aa, Mycobacterium
DRQRNRIDMMLDRRVDGLILGDARS

SEQ ID NO: 803896 - protein, 26 aa, Mycobacterium
DRQRQYSLLPLLHNYQKPEKPINGSM

SEQ ID NO: 803897 - protein, 21 aa, Mycobacterium
DRQTNRHLGFGAGVHRCLGSN

SEQ ID NO: 803898 - protein, 18 aa, Mycobacterium
DRQVVFFGIGFETTAPAN

SEQ ID NO: 803899 - protein, 25 aa, Mycobacterium
DRQWRALVDLMDDPPWCDAGLSTAA

SEQ ID NO: 803900 - protein, 18 aa, Mycobacterium
DRRAAIVHAVQWAREGDI

SEQ ID NO: 803901 - protein, 23 aa, Mycobacterium
DRRAKRLIVFDVDSTLIQGEVIE

SEQ ID NO: 803902 - protein, 24 aa, Mycobacterium
DRRAVAVDLRFDWPAALTEAGFDP

SEQ ID NO: 803903 - protein, 22 aa, Mycobacterium
DRRAWRVALIRNLITKNAKGNR

SEQ ID NO: 803904 - protein, 17 aa, Mycobacterium
DRRDRIPSVWRTSPNTA

SEQ ID NO: 803905 - protein, 25 aa, Mycobacterium
DRRDWPLFRSVFTDDCELDYGEIGR

SEQ ID NO: 803906 - protein, 24 aa, Mycobacterium
DRRGKYLWLTLDAGAPTTGRDDPD

SEQ ID NO: 803907 - protein, 24 aa, Mycobacterium
DRRGLPMHYFPPRAHPAKVLLERA

SEQ ID NO: 803908 - protein, 21 aa, Mycobacterium
DRRHRLWFEVLKPMSSECAGR

SEQ ID NO: 803909 - protein, 21 aa, Mycobacterium
DRRIRSFSAIPSPHDVLTEFP

SEQ ID NO: 803910 - protein, 27 aa, Mycobacterium
DRRLGEARLFPLTQFMGDVYAGALLIE

SEQ ID NO: 803911 - protein, 22 aa, Mycobacterium
DRRLRQLPTPTLVLWGRDDKIN

SEQ ID NO: 803912 - protein, 25 aa, Mycobacterium
DRRMNLLMEVFRPLLSSDSGRIPLQ

SEQ ID NO: 803913 - protein, 18 aa, Mycobacterium
DRRPLYEQVADRLREFID

SEQ ID NO: 803914 - protein, 18 aa, Mycobacterium
DRRPVLDEKQWATLLSNL

SEQ ID NO: 803915 - protein, 26 aa, Mycobacterium
DRRQGWPALNLFYNTAFDAAHQLISD

SEQ ID NO: 803916 - protein, 22 aa, Mycobacterium
DRRQLIEFCLLASQYDGLAATM

SEQ ID NO: 803917 - protein, 31 aa, Mycobacterium
DRRQWWIDRIRACYPLLYRRSGDQPGLRRQR

SEQ ID NO: 803918 - protein, 18 aa, Mycobacterium
DRRRADAILQRRTDRLPF

SEQ ID NO: 803919 - protein, 22 aa, Mycobacterium
DRRRLMLAPFHRDVIERQAGLI

SEQ ID NO: 803920 - protein, 18 aa, Mycobacterium
DRRRLWGRGLSAIDAHLL

SEQ ID NO: 803921 - protein, 25 aa, Mycobacterium
DRRRPIAQLRPLLGDGPLSAVLARS

SEQ ID NO: 803922 - protein, 30 aa, Mycobacterium
DRRRPVSQLRPLMTPFLIDCVIACAEAPRT

SEQ ID NO: 803923 - protein, 25 aa, Mycobacterium
DRRRSWQKWRQGLAAIWESPEGQQI

SEQ ID NO: 803924 - protein, 28 aa, Mycobacterium
DRRRVSALQQLGWLIVPIVAEDVRYRPR

SEQ ID NO: 803925 - protein, 24 aa, Mycobacterium
DRRTLTLSIWHRSDLPKASAHPWV

SEQ ID NO: 803926 - protein, 26 aa, Mycobacterium
DRRTPALWKALTDAGVFGLALAGEHG

SEQ ID NO: 803927 - protein, 30 aa, Mycobacterium
DRRTQRFVRALLTGYLLYTLGGDKAYREFA

SEQ ID NO: 803928 - protein, 29 aa, Mycobacterium
DRRTRLIRAWTAPVLLLQGAHDPLQPREF

SEQ ID NO: 803929 - protein, 23 aa, Mycobacterium
DRRTYTAKHLILAAGTWGTQHLL

SEQ ID NO: 803930 - protein, 30 aa, Mycobacterium
DRRVGLLLQDALLFPHMTVAANVAFGPHSR

SEQ ID NO: 803931 - protein, 23 aa, Mycobacterium
DRRVMNHVYITQTLDAAVWGAEL

SEQ ID NO: 803932 - protein, 22 aa, Mycobacterium
DRRYHYVPTYILRGLTELHLEF

SEQ ID NO: 803933 - protein, 21 aa, Mycobacterium
DRRYQYVPTYILRGLTELHLD

SEQ ID NO: 803934 - protein, 24 aa, Mycobacterium
DRRYQYVPTYILRGLTELHLEFTL

SEQ ID NO: 803935 - protein, 24 aa, Mycobacterium
DRRYQYVPTYILRGLTELHLEFTP

SEQ ID NO: 803936 - protein, 19 aa, Mycobacterium
DRRYTYEPTYILRGLSELH

SEQ ID NO: 803937 - protein, 23 aa, Mycobacterium
DRSALLTEFLTRLADRVESWRAA

SEQ ID NO: 803938 - protein, 27 aa, Mycobacterium
DRSAPIPGRLFAAPALAQPSGVSPADD

SEQ ID NO: 803939 - protein, 29 aa, Mycobacterium
DRSEGTLLFGRFAFSVRYTWFRNWVNSPA

SEQ ID NO: 803940 - protein, 24 aa, Mycobacterium
DRSESPWRALFGRRQWVEMEQQTA

SEQ ID NO: 803941 - protein, 24 aa, Mycobacterium
DRSFYALDRLWADCPVVAVDLAEG

SEQ ID NO: 803942 - protein, 28 aa, Mycobacterium
DRSGFIVNALLVPYLLSAIRMAEAGVAT

SEQ ID NO: 803943 - protein, 20 aa, Mycobacterium
DRSGIWRDGVYAHGDYPRVF

SEQ ID NO: 803944 - protein, 24 aa, Mycobacterium
DRSGKWIGMRYPYELNLVGDAKDT

SEQ ID NO: 803945 - protein, 26 aa, Mycobacterium
DRSGTITPFALLQLADRGQFFVEPGQ

SEQ ID NO: 803946 - protein, 28 aa, Mycobacterium
DRSIVPVRVFWLPPPDRGRLARLTGLLP

SEQ ID NO: 803947 - protein, 25 aa, Mycobacterium
DRSIVPVRVFWLPPPDRSRVAKVAG

SEQ ID NO: 803948 - protein, 25 aa, Mycobacterium
DRSKLGEYLLFAQAVANAVVIDPAN

SEQ ID NO: 803949 - protein, 34 aa, Mycobacterium
DRSKVKRILLTSGKLYYDLLARKNSDKRDDVAIV

SEQ ID NO: 803950 - protein, 25 aa, Mycobacterium
DRSKVRRILLTSGKIYYELAARKAK

SEQ ID NO: 803951 - protein, 21 aa, Mycobacterium
DRSNGLWRPSPGSVYPTLQLL

SEQ ID NO: 803952 - protein, 18 aa, Mycobacterium
DRSPLQTNPLLGVAAQLL

SEQ ID NO: 803953 - protein, 23 aa, Mycobacterium
DRSRPLWEMYFVEGLANNRIAVV

SEQ ID NO: 803954 - protein, 24 aa, Mycobacterium
DRSRPLWEMYLVEGLSKNRLAIYT

SEQ ID NO: 803955 - protein, 25 aa, Mycobacterium
DRSRPLWEVYLIQGLQDDKVALLTK

SEQ ID NO: 803956 - protein, 23 aa, Mycobacterium
DRSSGWAWLPFRAAVADAVSKVR

SEQ ID NO: 803957 - protein, 22 aa, Mycobacterium
DRSVRALVLTGAGRGFCAGIDV

SEQ ID NO: 803958 - protein, 29 aa, Mycobacterium
DRSVVPVRVFWLPPPDRGRIAKLAGLLPG

SEQ ID NO: 803959 - protein, 30 aa, Mycobacterium
DRTAHDLHLLLPDPYTFPSSLLIEHLNSDL

SEQ ID NO: 803960 - protein, 22 aa, Mycobacterium
DRTDMPLGFFNSHSTGLVLTPE

SEQ ID NO: 803961 - protein, 20 aa, Mycobacterium
DRTDPSYLRPLRLESEPVDR

SEQ ID NO: 803962 - protein, 24 aa, Mycobacterium
DRTDVVFASHHWPTWGRDNIVEYL

SEQ ID NO: 803963 - protein, 25 aa, Mycobacterium
DRTDVVFASHHWPTWGREGIVEFLS

SEQ ID NO: 803964 - protein, 22 aa, Mycobacterium
DRTFDHVLEAKGKYVIPGGVDA

SEQ ID NO: 803965 - protein, 22 aa, Mycobacterium
DRTGELLFFNYSKQAPFMRYGV

SEQ ID NO: 803966 - protein, 24 aa, Mycobacterium
DRTGLWGRLLPEWGAIRDLPPRDV

SEQ ID NO: 803967 - protein, 18 aa, Mycobacterium
DRTGPIIPIKLGAHAKRQ

SEQ ID NO: 803968 - protein, 19 aa, Mycobacterium
DRTGPIIVEWLGAQGFRVD

SEQ ID NO: 803969 - protein, 23 aa, Mycobacterium
DRTGPLVTELLGEAGFVVDGVVV

SEQ ID NO: 803970 - protein, 20 aa, Mycobacterium
DRTHRAMWTDFNAWVQAQGA

SEQ ID NO: 803971 - protein, 17 aa, Mycobacterium
DRTIPAGSLELSGERRK

SEQ ID NO: 803972 - protein, 18 aa, Mycobacterium
DRTKPLPLSPVQANLWYL

SEQ ID NO: 803973 - protein, 28 aa, Mycobacterium
DRTKVRTRLIELFELFDPADPEVIAGRR

SEQ ID NO: 803974 - protein, 23 aa, Mycobacterium
DRTPLLEWLRRRGVDEVDVVGIA

SEQ ID NO: 803975 - protein, 20 aa, Mycobacterium
DRTRFGTEVTALHWDEQRAQ

SEQ ID NO: 803976 - protein, 22 aa, Mycobacterium
DRTRPLWEMYIADGLADNKIAV

SEQ ID NO: 803977 - protein, 28 aa, Mycobacterium
DRTRQPYVVSFQLNWDRAFGPGAAGWVI

SEQ ID NO: 803978 - protein, 28 aa, Mycobacterium
DRTSFVPGVLLALRRIGERPGLTVGIEP

SEQ ID NO: 803979 - protein, 26 aa, Mycobacterium
DRTSFVPGVLLAVRRITEHPGLTVGL

SEQ ID NO: 803980 - protein, 27 aa, Mycobacterium
DRTSFVPGVLLAVRRVRERPGLTIGIE

SEQ ID NO: 803981 - protein, 28 aa, Mycobacterium
DRTTVRTRLIELFDLFDPADPAVIAGRR

SEQ ID NO: 803982 - protein, 19 aa, Mycobacterium
DRTTWRDGAFRWYKPEDTV

SEQ ID NO: 803983 - protein, 18 aa, Mycobacterium
DRTVDIEYKFGFAGNPWG

SEQ ID NO: 803984 - protein, 20 aa, Mycobacterium
DRTWRGIGMIASSGWRLSPA

SEQ ID NO: 803985 - protein, 17 aa, Mycobacterium
DRTYEPLLLVRCLQRHP

SEQ ID NO: 803986 - protein, 27 aa, Mycobacterium
DRTYIHSLDWLWLNDILHSVEAECWAT

SEQ ID NO: 803987 - protein, 27 aa, Mycobacterium
DRTYIRFFTRRSIVRIFKKAGLRIQRI

SEQ ID NO: 803988 - protein, 17 aa, Mycobacterium
DRTYLITGGLGALGLRT

SEQ ID NO: 803989 - protein, 25 aa, Mycobacterium
DRTYPIIEHIYPGPQLYRAGPMFNP

SEQ ID NO: 803990 - protein, 25 aa, Mycobacterium
DRVAIYMPLIPEAVISMLACARLGI

SEQ ID NO: 803991 - protein, 27 aa, Mycobacterium
DRVAIYMPLVPEAVIAMLACARLGIMH

SEQ ID NO: 803992 - protein, 23 aa, Mycobacterium
DRVALWNIIATVDAFLSAGFTPA

SEQ ID NO: 803993 - protein, 23 aa, Mycobacterium
DRVALWNMVATVDAFLSAGFTPT

SEQ ID NO: 803994 - protein, 18 aa, Mycobacterium
DRVASLRLALADIDAQVA

SEQ ID NO: 803995 - protein, 18 aa, Mycobacterium
DRVATRIFGLPVVQRWTT

SEQ ID NO: 803996 - protein, 28 aa, Mycobacterium
DRVCIFSATRYEWAIVDLAILSVGAVTV

SEQ ID NO: 803997 - protein, 18 aa, Mycobacterium
DRVDPTGWLAKRGLSPGG

SEQ ID NO: 803998 - protein, 22 aa, Mycobacterium
DRVDTEFYFKFLRSPDGNGITD

SEQ ID NO: 803999 - protein, 25 aa, Mycobacterium
DRVEGPLLSLLLATTGRVAGCDDLT

SEQ ID NO: 804000 - protein, 24 aa, Mycobacterium
DRVEPFRPYQINADLLSLADPEAI

SEQ ID NO: 804001 - protein, 19 aa, Mycobacterium
DRVFGRIDPIAAAGLRYRV

SEQ ID NO: 804002 - protein, 23 aa, Mycobacterium
DRVFRLPENVSFEAGAGLLFNDL

SEQ ID NO: 804003 - protein, 19 aa, Mycobacterium
DRVGIAWLRHTCGACRYCT

SEQ ID NO: 804004 - protein, 20 aa, Mycobacterium
DRVGIAWLRHTCGVCKYCLR

SEQ ID NO: 804005 - protein, 19 aa, Mycobacterium
DRVHALVPELLIPGRTEAQ

SEQ ID NO: 804006 - protein, 18 aa, Mycobacterium
DRVHARVPAFLVPGRTEA

SEQ ID NO: 804007 - protein, 32 aa, Mycobacterium
DRVIAPDFNFMLIGAAFYRDTYRRTTDGWKIS

SEQ ID NO: 804008 - protein, 28 aa, Mycobacterium
DRVIAPDFNFMLIGAGFYHDRYRRTADG

SEQ ID NO: 804009 - protein, 18 aa, Mycobacterium
DRVIFTDGELYRQELRRV

SEQ ID NO: 804010 - protein, 21 aa, Mycobacterium
DRVLAAILFEQTMDRTIEGKP

SEQ ID NO: 804011 - protein, 24 aa, Mycobacterium
DRVLAAQHGWLAPLPPEGASAIVF

SEQ ID NO: 804012 - protein, 24 aa, Mycobacterium
DRVLAAQHGWLSPLPPEGASAILH

SEQ ID NO: 804013 - protein, 32 aa, Mycobacterium
DRVLLQLPNRASFAVALFGLMRAGAIPVMCLP

SEQ ID NO: 804014 - protein, 21 aa, Mycobacterium
DRVLNERLLTIEWQQRELPEV

SEQ ID NO: 804015 - protein, 28 aa, Mycobacterium
DRVLSARIWIAQVGRIPLLLLDSDIAEN

SEQ ID NO: 804016 - protein, 24 aa, Mycobacterium
DRVLTHLPLFRRSTQQRFSSRLRP

SEQ ID NO: 804017 - protein, 22 aa, Mycobacterium
DRVLTMTYLEGLDWSAAQRADQ

SEQ ID NO: 804018 - protein, 24 aa, Mycobacterium
DRVMRVNLLGVMAGTRDAARHMAD

SEQ ID NO: 804019 - protein, 25 aa, Mycobacterium
DRVNRFIPNPTFDPIIVPGCLDLLF

SEQ ID NO: 804020 - protein, 30 aa, Mycobacterium
DRVPDAQLPDLLLLDDLLGIAAPGAELPRI

SEQ ID NO: 804021 - protein, 18 aa, Mycobacterium
DRVPGPHFDPALAGTVLR

SEQ ID NO: 804022 - protein, 24 aa, Mycobacterium
DRVQPTLFAMQVSLAATLASYGVR

SEQ ID NO: 804023 - protein, 32 aa, Mycobacterium
DRVRAMFPHTPPAELTLLPTPRRNPEGRKPIS

SEQ ID NO: 804024 - protein, 20 aa, Mycobacterium
DRVRPGVTAALRTLTRSVIA

SEQ ID NO: 804025 - protein, 24 aa, Mycobacterium
DRVRPVSAALRAYALLATSADRGA

SEQ ID NO: 804026 - protein, 20 aa, Mycobacterium
DRVRQIFIFCPRSSRHVGLS

SEQ ID NO: 804027 - protein, 26 aa, Mycobacterium
DRVRRWVRDRLDRPPPDAFLAEVLAA

SEQ ID NO: 804028 - protein, 19 aa, Mycobacterium
DRVRSLWGLVGAAGEPGDL

SEQ ID NO: 804029 - protein, 21 aa, Mycobacterium
DRVRVPAAWRVLGVQTTGAGD

SEQ ID NO: 804030 - protein, 24 aa, Mycobacterium
DRVVALPELLRDAGYLTLMSGKWH

SEQ ID NO: 804031 - protein, 25 aa, Mycobacterium
DRVVALPELLRDAGYLTLMSGKWHL

SEQ ID NO: 804032 - protein, 24 aa, Mycobacterium
DRVVDWLVDKFKGTSGIDLTKDKM

SEQ ID NO: 804033 - protein, 19 aa, Mycobacterium
DRVVLATKFGLISHTGRNG

SEQ ID NO: 804034 - protein, 22 aa, Mycobacterium
DRVVLDMLAPWETLPAVAETLV

SEQ ID NO: 804035 - protein, 24 aa, Mycobacterium
DRVVLDMLSPWEVLPAVAEALVPG

SEQ ID NO: 804036 - protein, 18 aa, Mycobacterium
DRWAFAMLVAAFVGMRRF

SEQ ID NO: 804037 - protein, 20 aa, Mycobacterium
DRWKLARRRIFVDESVLRMQ

SEQ ID NO: 804038 - protein, 18 aa, Mycobacterium
DRWQPGARLLPASDDRCE

SEQ ID NO: 804039 - protein, 18 aa, Mycobacterium
DRWRAARLPAAGLHLDSA

SEQ ID NO: 804040 - protein, 19 aa, Mycobacterium
DRWRIGRRVLTINALETRS

SEQ ID NO: 804041 - protein, 19 aa, Mycobacterium
DRWRRTSGIHKVRDPRALA

SEQ ID NO: 804042 - protein, 28 aa, Mycobacterium
DRWVEGADWIVWQLTGRYVRNISTAGYK

SEQ ID NO: 804043 - protein, 21 aa, Mycobacterium
DRYEQLWNLLDAKPTFGFADR

SEQ ID NO: 804044 - protein, 27 aa, Mycobacterium
DRYGTVWRVDFLWRSARLIGEYDSDEW

SEQ ID NO: 804045 - protein, 20 aa, Mycobacterium
DRYHAFLHIGAHEALSAAAA

SEQ ID NO: 804046 - protein, 17 aa, Mycobacterium
DRYLGIIDRVRTAIPHA

SEQ ID NO: 804047 - protein, 17 aa, Mycobacterium
DRYLWLLEEMKTARYDD

SEQ ID NO: 804048 - protein, 19 aa, Mycobacterium
DRYPGAREFFWVQEEPANQ

SEQ ID NO: 804049 - protein, 17 aa, Mycobacterium
DRYPNAKEFFWVQEEPA

SEQ ID NO: 804050 - protein, 26 aa, Mycobacterium
DRYPTYGVLAKILQVGRIAGGGAAAV

SEQ ID NO: 804051 - protein, 20 aa, Mycobacterium
DRYQATVPVPFVPGSEFAGV

SEQ ID NO: 804052 - protein, 18 aa, Mycobacterium
DRYRKCFSDGLYLTGDLA

SEQ ID NO: 804053 - protein, 19 aa, Mycobacterium
DRYRKCFSDGLYLTGDLAK

SEQ ID NO: 804054 - protein, 18 aa, Mycobacterium
DRYRRAITAARQRGYAVG

SEQ ID NO: 804055 - protein, 20 aa, Mycobacterium
DRYTGAELPVLRALLHISDA

SEQ ID NO: 804056 - protein, 20 aa, Mycobacterium
DRYTQLFARNARIWDWPATG

SEQ ID NO: 804057 - protein, 17 aa, Mycobacterium
DRYVPVLDQLRMRYLDD

SEQ ID NO: 804058 - protein, 20 aa, Mycobacterium
DRYYERYMDFIPVALEQPTS

SEQ ID NO: 804059 - protein, 17 aa, Mycobacterium
DSAAAAAALRRAEKNYG

SEQ ID NO: 804060 - protein, 30 aa, Mycobacterium
DSAAFKEFYGHVLSWTFEPGRIADGWGVQN

SEQ ID NO: 804061 - protein, 20 aa, Mycobacterium
DSAAFTAALAAVGAAYVSTA

SEQ ID NO: 804062 - protein, 25 aa, Mycobacterium
DSAALTGWLYGRDVLDLLALADLGA

SEQ ID NO: 804063 - protein, 27 aa, Mycobacterium
DSAARSDVQVYRTLLSALPEGVAAGDY

SEQ ID NO: 804064 - protein, 21 aa, Mycobacterium
DSAAYLLPRLKPGLSVLDVGC

SEQ ID NO: 804065 - protein, 27 aa, Mycobacterium
DSAEWKVFLGLLRSRFETDKGKWTKIA

SEQ ID NO: 804066 - protein, 26 aa, Mycobacterium
DSAEWKVFLNLLRNRFESDKGKWTKI

SEQ ID NO: 804067 - protein, 25 aa, Mycobacterium
DSAEYKVFLNLLRERFETDKDKWTK

SEQ ID NO: 804068 - protein, 18 aa, Mycobacterium
DSAFLFHIAELETAARQN

SEQ ID NO: 804069 - protein, 22 aa, Mycobacterium
DSAGHYLPGSLPSYEQLLEITT

SEQ ID NO: 804070 - protein, 24 aa, Mycobacterium
DSAGKVQWVLGNLGAIPTVQIDYK

SEQ ID NO: 804071 - protein, 17 aa, Mycobacterium
DSAGRLFVVGRDDEMIV

SEQ ID NO: 804072 - protein, 20 aa, Mycobacterium
DSAGWVWSAGLPSSLVDATG

SEQ ID NO: 804073 - protein, 27 aa, Mycobacterium
DSAICHIATILLTRIATCWRTGEHCVL

SEQ ID NO: 804074 - protein, 18 aa, Mycobacterium
DSAILTVGLLAGSMLEEA

SEQ ID NO: 804075 - protein, 17 aa, Mycobacterium
DSALRLYATLNRSLVDQ

SEQ ID NO: 804076 - protein, 23 aa, Mycobacterium
DSALVHHYFGTKEKLFAAAVHVP

SEQ ID NO: 804077 - protein, 22 aa, Mycobacterium
DSALVHHYFGTKEQLFAAAVHI

SEQ ID NO: 804078 - protein, 32 aa, Mycobacterium
DSAPFIAMAVFARGLLNHLFTRVYLPGERLDD

SEQ ID NO: 804079 - protein, 28 aa, Mycobacterium
DSAPKLLTPAPFFDATVVTAIESGLRAL

SEQ ID NO: 804080 - protein, 25 aa, Mycobacterium
DSAPPEFVAPVYAYLASDLARQVTG

SEQ ID NO: 804081 - protein, 23 aa, Mycobacterium
DSAQVRLKRMYPGGHYRATTSTV

SEQ ID NO: 804082 - protein, 26 aa, Mycobacterium
DSARGPVHLIALPRFPEPGSTVEKGS

SEQ ID NO: 804083 - protein, 17 aa, Mycobacterium
DSARLYCERNWGTGFPE

SEQ ID NO: 804084 - protein, 25 aa, Mycobacterium
DSARQAAIALDWLRKHGYQDLASRA

SEQ ID NO: 804085 - protein, 23 aa, Mycobacterium
DSASLLTAPLLRTSARRLAERTA

SEQ ID NO: 804086 - protein, 23 aa, Mycobacterium
DSATPGFDFFRLSFESLRDAVVD

SEQ ID NO: 804087 - protein, 27 aa, Mycobacterium
DSAVAGHWLLARLGKRVLRPGGVELTR

SEQ ID NO: 804088 - protein, 20 aa, Mycobacterium
DSAVALLTGPIGRVDPVTLR

SEQ ID NO: 804089 - protein, 22 aa, Mycobacterium
DSAVAWARRYLECPPRALAAAK

SEQ ID NO: 804090 - protein, 22 aa, Mycobacterium
DSAWLLVSILRQFGLAARFVSG

SEQ ID NO: 804091 - protein, 24 aa, Mycobacterium
DSAWTRRNPFPARLAANRLLTSPG

SEQ ID NO: 804092 - protein, 25 aa, Mycobacterium
DSAYFWEGVAAHELRLQKRPDGSLQ

SEQ ID NO: 804093 - protein, 25 aa, Mycobacterium
DSCQIDHLVLFSPNRDRIIATLCGR

SEQ ID NO: 804094 - protein, 21 aa, Mycobacterium
DSCYWERLRGVGGTLDEVIAN

SEQ ID NO: 804095 - protein, 25 aa, Mycobacterium
DSDAALICVPPYHIAGVGAALSNLY

SEQ ID NO: 804096 - protein, 25 aa, Mycobacterium
DSDAWSEVLIGWIDKYPIASIEDPL

SEQ ID NO: 804097 - protein, 26 aa, Mycobacterium
DSDDVVDVVLLWWRDDDGDLVDALMD

SEQ ID NO: 804098 - protein, 24 aa, Mycobacterium
DSDEFRLYELVWQRTVASQMADAR

SEQ ID NO: 804099 - protein, 21 aa, Mycobacterium
DSDERLFEDSLAAEEARDLAG

SEQ ID NO: 804100 - protein, 26 aa, Mycobacterium
DSDFMSYLNLWRYLGEQRRALSRSAF

SEQ ID NO: 804101 - protein, 27 aa, Mycobacterium
DSDLAAWPATLDRLLAVGGPGATYVPG

SEQ ID NO: 804102 - protein, 23 aa, Mycobacterium
DSDLDSLRRLYATSEWLHRETTR

SEQ ID NO: 804103 - protein, 21 aa, Mycobacterium
DSDLLLGEMAFVPSPTAAAED

SEQ ID NO: 804104 - protein, 25 aa, Mycobacterium
DSDLMTAPGPRPLSPGFSETVVLRV

SEQ ID NO: 804105 - protein, 26 aa, Mycobacterium
DSDLNPTWIWHALYGLILQGCEQAMA

SEQ ID NO: 804106 - protein, 35 aa, Mycobacterium
DSDLRLPHPLAHLRPFVMIPWLDVDPAAEVPLPDG

SEQ ID NO: 804107 - protein, 24 aa, Mycobacterium
DSDLVLAFFLKQMDEHDAVRVRDA

SEQ ID NO: 804108 - protein, 25 aa, Mycobacterium
DSDNEAKWFWFEGNFGGYEENKIER

SEQ ID NO: 804109 - protein, 23 aa, Mycobacterium
DSDPLWKVYVDLGWTELNDPASA

SEQ ID NO: 804110 - protein, 23 aa, Mycobacterium
DSDPRWPLLQAERSALLSLNVPY

SEQ ID NO: 804111 - protein, 37 aa, Mycobacterium
DSDTYRTWLSDRFLPQDILDWPLNVVVVRSGDRTILV

SEQ ID NO: 804112 - protein, 29 aa, Mycobacterium
DSDVAAWPATLERLLAIGGPDAIYVPGHG

SEQ ID NO: 804113 - protein, 28 aa, Mycobacterium
DSDVDDILWQVPYLPIDPKDVGRNYEAV

SEQ ID NO: 804114 - protein, 21 aa, Mycobacterium
DSDYLAVFIPGGHGVLLGIPD

SEQ ID NO: 804115 - protein, 25 aa, Mycobacterium
DSEDATVRFLLTAGAIGSLFKERAS

SEQ ID NO: 804116 - protein, 24 aa, Mycobacterium
DSEFGLVAYLYTNDTRRGWRVSEQ

SEQ ID NO: 804117 - protein, 23 aa, Mycobacterium
DSEGIATTVLLPAGPNDPKDSAC

SEQ ID NO: 804118 - protein, 20 aa, Mycobacterium
DSEIRYVFRLGDATHIAVGD

SEQ ID NO: 804119 - protein, 25 aa, Mycobacterium
DSEKLWDISMHALYARMGAVLTPEV

SEQ ID NO: 804120 - protein, 23 aa, Mycobacterium
DSELLDFTVLARVFGYPSTAEAQ

SEQ ID NO: 804121 - protein, 21 aa, Mycobacterium
DSELRQKGIDLALSGKLIGNA

SEQ ID NO: 804122 - protein, 24 aa, Mycobacterium
DSEMRMMCVFNPPVTGREVHDESG

SEQ ID NO: 804123 - protein, 18 aa, Mycobacterium
DSEPLLPNWKHLPVGYHG

SEQ ID NO: 804124 - protein, 23 aa, Mycobacterium
DSEQLAYVVAFDPTGRKLDALAA

SEQ ID NO: 804125 - protein, 19 aa, Mycobacterium
DSEQNWADLYLPAGPQQVD

SEQ ID NO: 804126 - protein, 25 aa, Mycobacterium
DSEQPIFVGWALGIDELAWANAMYG

SEQ ID NO: 804127 - protein, 35 aa, Mycobacterium
DSEVLIMDYLVHQRRLFPLIAKSYALQFAQNELVG

SEQ ID NO: 804128 - protein, 38 aa, Mycobacterium
DSEVLIMDYLVHQRRLFPLIARSYALQFAQNELVSRCH

SEQ ID NO: 804129 - protein, 20 aa, Mycobacterium
DSEWRTEYLYSRAATIYGGT

SEQ ID NO: 804130 - protein, 21 aa, Mycobacterium
DSFEIFVGEILHRIFNKSPHL

SEQ ID NO: 804131 - protein, 27 aa, Mycobacterium
DSFGPHHRLIFPLNTILELDELPEEQW

SEQ ID NO: 804132 - protein, 22 aa, Mycobacterium
DSFGPNGLPLHATLSLDPGELT

SEQ ID NO: 804133 - protein, 18 aa, Mycobacterium
DSFLLCFNAHYEPIDFML

SEQ ID NO: 804134 - protein, 35 aa, Mycobacterium
DSFLNPIYRDSILAHISIPLLLRVSSQGWGHYLET

SEQ ID NO: 804135 - protein, 26 aa, Mycobacterium
DSFTMQCWIWPTMPTKIEGYWAPGEQ

SEQ ID NO: 804136 - protein, 17 aa, Mycobacterium
DSFWRDLVSFTWNIKTV

SEQ ID NO: 804137 - protein, 21 aa, Mycobacterium
DSFYRGIPGHVIVDALTAMGF

SEQ ID NO: 804138 - protein, 28 aa, Mycobacterium
DSGAAATWLPGGALRIVECRPAFIHDSN

SEQ ID NO: 804139 - protein, 23 aa, Mycobacterium
DSGAPPPFAPWDTADETPPPGKG

SEQ ID NO: 804140 - protein, 34 aa, Mycobacterium
DSGAQFVVATGRPPRWIRPVVDALGFAPIAVCAN

SEQ ID NO: 804141 - protein, 35 aa, Mycobacterium
DSGARFWGRFGAAGLLLRAPLPNGQPAVLLQHRAW

SEQ ID NO: 804142 - protein, 26 aa, Mycobacterium
DSGDPAQWLYALTARLPMGQADRYAI

SEQ ID NO: 804143 - protein, 26 aa, Mycobacterium
DSGDPGLMALFRRLAADRLKVVAGDK

SEQ ID NO: 804144 - protein, 26 aa, Mycobacterium
DSGDTRLPYSWRGISLHAAAAKRIRA

SEQ ID NO: 804145 - protein, 29 aa, Mycobacterium
DSGGLFHGIQLWVNLPRKDKFAAPRYQSI

SEQ ID NO: 804146 - protein, 27 aa, Mycobacterium
DSGGPAPIFQWLIYPRTDFAGRTRSAS

SEQ ID NO: 804147 - protein, 21 aa, Mycobacterium
DSGGWYLLRPDGLGCQDARTT

SEQ ID NO: 804148 - protein, 25 aa, Mycobacterium
DSGHPVLLESFLDGPEVSLFCVVDG

SEQ ID NO: 804149 - protein, 25 aa, Mycobacterium
DSGHTLVLPIRFAGIHVYGDIAEGV

SEQ ID NO: 804150 - protein, 17 aa, Mycobacterium
DSGLEAHRARMIAVGLV

SEQ ID NO: 804151 - protein, 23 aa, Mycobacterium
DSGLRPLRQTLSQLRLRELLVEV

SEQ ID NO: 804152 - protein, 20 aa, Mycobacterium
DSGLVENPYPYYETLRQRCP

SEQ ID NO: 804153 - protein, 21 aa, Mycobacterium
DSGMLAALYVLAALGEQSRPL

SEQ ID NO: 804154 - protein, 24 aa, Mycobacterium
DSGNWVRIITIAYFEEPRKNGKTT

SEQ ID NO: 804155 - protein, 24 aa, Mycobacterium
DSGPWAAFDLSLGRAMYSGFTMGG

SEQ ID NO: 804156 - protein, 23 aa, Mycobacterium
DSGQAAALYSWLGADMDGLTALS

SEQ ID NO: 804157 - protein, 23 aa, Mycobacterium
DSGREPVWYIAPDDELAAAFYRN

SEQ ID NO: 804158 - protein, 24 aa, Mycobacterium
DSGREPVWYIAPEDELAAAFYRNS

SEQ ID NO: 804159 - protein, 27 aa, Mycobacterium
DSGSLNVPLPLRLGVNALGPAITTAAA

SEQ ID NO: 804160 - protein, 23 aa, Mycobacterium
DSGTLPPVRYGAASLIVVNKLDQ

SEQ ID NO: 804161 - protein, 19 aa, Mycobacterium
DSGVPTFESVREKIESRSS

SEQ ID NO: 804162 - protein, 20 aa, Mycobacterium
DSGVQLLRLLEGDTTPGRVD

SEQ ID NO: 804163 - protein, 23 aa, Mycobacterium
DSGWDPLLDSLLAEDPSLAGEDM

SEQ ID NO: 804164 - protein, 26 aa, Mycobacterium
DSHAPGQLEFLGYGAQRALDAGLEAD

SEQ ID NO: 804165 - protein, 17 aa, Mycobacterium
DSHERPLRWSSLDELRA

SEQ ID NO: 804166 - protein, 17 aa, Mycobacterium
DSHREFWVYPASATIDD

SEQ ID NO: 804167 - protein, 22 aa, Mycobacterium
DSIDLLELFTMWTAGFPEPRTF

SEQ ID NO: 804168 - protein, 17 aa, Mycobacterium
DSIEWMSRNLARRDSVI

SEQ ID NO: 804169 - protein, 20 aa, Mycobacterium
DSIGLALRLSDEIVVQTADS

SEQ ID NO: 804170 - protein, 29 aa, Mycobacterium
DSIGNMFALVEFIPGAPYILIGSHLDSQP

SEQ ID NO: 804171 - protein, 20 aa, Mycobacterium
DSIIAILAVLAAGAAYVPVD

SEQ ID NO: 804172 - protein, 21 aa, Mycobacterium
DSIKHFFVHYKDLEPGKFVEA

SEQ ID NO: 804173 - protein, 17 aa, Mycobacterium
DSILDAAARWRGPIPGR

SEQ ID NO: 804174 - protein, 23 aa, Mycobacterium
DSILGWPAMVRVSNKEFVTNAED

SEQ ID NO: 804175 - protein, 23 aa, Mycobacterium
DSILRALALNRFAKSPMLVGGQM

SEQ ID NO: 804176 - protein, 24 aa, Mycobacterium
DSILRVLAMHRFAKSPMLVGGQML

SEQ ID NO: 804177 - protein, 33 aa, Mycobacterium
DSILTLPHPLAHQRAFVMVPWLDVDPAAELTAP

SEQ ID NO: 804178 - protein, 25 aa, Mycobacterium
DSIPSDLTVYALYRAVRDDGAGELG

SEQ ID NO: 804179 - protein, 24 aa, Mycobacterium
DSIVFRLMFNTLRATYEPALPALD

SEQ ID NO: 804180 - protein, 25 aa, Mycobacterium
DSKGYCFQIDLTWRAINNGFSVVEV

SEQ ID NO: 804181 - protein, 27 aa, Mycobacterium
DSKGYCFQIDLTWRTICNGFTIVEAPI

SEQ ID NO: 804182 - protein, 26 aa, Mycobacterium
DSKIRRQLMHVLLDELRRNLCIETEF

SEQ ID NO: 804183 - protein, 23 aa, Mycobacterium
DSKPYGLHRGWITPYLDEDGSVL

SEQ ID NO: 804184 - protein, 26 aa, Mycobacterium
DSLADPLAFLLRKEGFEATIVNDGPS

SEQ ID NO: 804185 - protein, 20 aa, Mycobacterium
DSLAEYVLELARTLIKPHER

SEQ ID NO: 804186 - protein, 23 aa, Mycobacterium
DSLALLDIIAPDIMKIDLGLVQR

SEQ ID NO: 804187 - protein, 20 aa, Mycobacterium
DSLATWVCGPAPTPQNAAAV

SEQ ID NO: 804188 - protein, 23 aa, Mycobacterium
DSLDCFFVYLARHPDHRHQLVER

SEQ ID NO: 804189 - protein, 20 aa, Mycobacterium
DSLIELGGKVWRFVDTAGLR

SEQ ID NO: 804190 - protein, 24 aa, Mycobacterium
DSLITALWEEWPPAGARASIHSYV

SEQ ID NO: 804191 - protein, 17 aa, Mycobacterium
DSLKWAGMDAAVVASKW

SEQ ID NO: 804192 - protein, 23 aa, Mycobacterium
DSLLDDLSLRLGWAERTVELPAG

SEQ ID NO: 804193 - protein, 18 aa, Mycobacterium
DSLLLGPVRVTFQRTLRI

SEQ ID NO: 804194 - protein, 19 aa, Mycobacterium
DSLLLLEHPEVYTAGRRTL

SEQ ID NO: 804195 - protein, 22 aa, Mycobacterium
DSLLMLDYDFGSILDYLAELGI

SEQ ID NO: 804196 - protein, 25 aa, Mycobacterium
DSLLSKVVLSRALRLVADAPLDARV

SEQ ID NO: 804197 - protein, 19 aa, Mycobacterium
DSLLVLIEAIPQALPHVSG

SEQ ID NO: 804198 - protein, 25 aa, Mycobacterium
DSLMPDPTDPGFWAVTRRADIVAVS

SEQ ID NO: 804199 - protein, 28 aa, Mycobacterium
DSLPEWPQMLLRALMFRLAVHALHPRST

SEQ ID NO: 804200 - protein, 27 aa, Mycobacterium
DSLPLTAATAALPIPLGHALELNAGTM

SEQ ID NO: 804201 - protein, 20 aa, Mycobacterium
DSLPTELRGRWIRMLTHCRR

SEQ ID NO: 804202 - protein, 21 aa, Mycobacterium
DSLRAILIRGAGADFCAGADW

SEQ ID NO: 804203 - protein, 18 aa, Mycobacterium
DSLRERLRIQISRTTIIR

SEQ ID NO: 804204 - protein, 20 aa, Mycobacterium
DSLRRFLLEETYELLDAVRS

SEQ ID NO: 804205 - protein, 18 aa, Mycobacterium
DSLRSLAPAGRLLVIGFT

SEQ ID NO: 804206 - protein, 29 aa, Mycobacterium
DSLRVEWWQSCRLPVNWKLAAAAFMEGYH

SEQ ID NO: 804207 - protein, 22 aa, Mycobacterium
DSLSFKLRHLLMLEAKEVILHD

SEQ ID NO: 804208 - protein, 17 aa, Mycobacterium
DSLSPRGLLVCFGTASG

SEQ ID NO: 804209 - protein, 23 aa, Mycobacterium
DSLSVLMTKNRVRHVPVLDGKKL

SEQ ID NO: 804210 - protein, 23 aa, Mycobacterium
DSLTWKIFGDWRGLLQGPWAGSM

SEQ ID NO: 804211 - protein, 19 aa, Mycobacterium
DSLVHEVDITRYLFGEEIA

SEQ ID NO: 804212 - protein, 18 aa, Mycobacterium
DSLVKTAVFGSDPNWGRV

SEQ ID NO: 804213 - protein, 19 aa, Mycobacterium
DSLVPLGPPVMDVALNITC

SEQ ID NO: 804214 - protein, 19 aa, Mycobacterium
DSLVPLGPPVMDVALNVTC

SEQ ID NO: 804215 - protein, 19 aa, Mycobacterium
DSLYLDGDLVDRAALRDRF

SEQ ID NO: 804216 - protein, 20 aa, Mycobacterium
DSLYRLRIPGDRAHLLNCYL

SEQ ID NO: 804217 - protein, 26 aa, Mycobacterium
DSMASWFTGVFRRLPDVLFDIRIEDQ

SEQ ID NO: 804218 - protein, 18 aa, Mycobacterium
DSMEALGLVLIDESFRSL

SEQ ID NO: 804219 - protein, 21 aa, Mycobacterium
DSMKRMFLELGGKSAAIVLDD

SEQ ID NO: 804220 - protein, 23 aa, Mycobacterium
DSMPLLERAKFLAIFASNLDEFY

SEQ ID NO: 804221 - protein, 25 aa, Mycobacterium
DSMRAGLKALAWMARQTAGGQPGGK

SEQ ID NO: 804222 - protein, 20 aa, Mycobacterium
DSMRAGLQALAWIAHGGGDR

SEQ ID NO: 804223 - protein, 37 aa, Mycobacterium
DSMSPINLAMTEFKMFYNLPVEGLDIPKSALGAGLGM

SEQ ID NO: 804224 - protein, 23 aa, Mycobacterium
DSNFKVVAVVKPGGERTQCPADV

SEQ ID NO: 804225 - protein, 26 aa, Mycobacterium
DSNGAPLFTVVNPPGTVSVSALMDGR

SEQ ID NO: 804226 - protein, 25 aa, Mycobacterium
DSNLLSRILTYHVVQGQLSPAKVVG

SEQ ID NO: 804227 - protein, 26 aa, Mycobacterium
DSNLYLRDLVLALQWVRDNIAGFGGD

SEQ ID NO: 804228 - protein, 24 aa, Mycobacterium
DSNTGLFNAGSFNSGIGSAVNQSV

SEQ ID NO: 804229 - protein, 25 aa, Mycobacterium
DSNTGMHLLIGILTALIQRDKTGKG

SEQ ID NO: 804230 - protein, 17 aa, Mycobacterium
DSPAAVRLKFARDVLAE

SEQ ID NO: 804231 - protein, 23 aa, Mycobacterium
DSPAGLRLPLDAVSWQPAPQSAE

SEQ ID NO: 804232 - protein, 23 aa, Mycobacterium
DSPAGLRLPLDSISWRPPRPTFD

SEQ ID NO: 804233 - protein, 25 aa, Mycobacterium
DSPARALQVMFVLRELRAALHFNAL

SEQ ID NO: 804234 - protein, 24 aa, Mycobacterium
DSPARPIGLLGAILAWHGTDNLAE

SEQ ID NO: 804235 - protein, 22 aa, Mycobacterium
DSPDPPLHVWTDNPGDPWAGRI

SEQ ID NO: 804236 - protein, 21 aa, Mycobacterium
DSPFDPNWMKGAIASNCIVLA

SEQ ID NO: 804237 - protein, 35 aa, Mycobacterium
DSPFPGLTTHAYLWTPANILFYSPATDADFDDLAA

SEQ ID NO: 804238 - protein, 26 aa, Mycobacterium
DSPGTTPSVWTGSPSPSAEAGEHGAG

SEQ ID NO: 804239 - protein, 27 aa, Mycobacterium
DSPKPPPRRITLTLPAVQNSREVWLVV

SEQ ID NO: 804240 - protein, 24 aa, Mycobacterium
DSPLGPVRFTAMPRFPDPGDAVAH

SEQ ID NO: 804241 - protein, 23 aa, Mycobacterium
DSPLLAPSQFLAAKLLGTPDGPP

SEQ ID NO: 804242 - protein, 24 aa, Mycobacterium
DSPLQVTIWVKRLRAVDFTLGYEV

SEQ ID NO: 804243 - protein, 21 aa, Mycobacterium
DSPLQVTMWTKRLRAVDFTLG

SEQ ID NO: 804244 - protein, 21 aa, Mycobacterium
DSPNLVKLIAFTGRNPGWSPA

SEQ ID NO: 804245 - protein, 22 aa, Mycobacterium
DSPNWLSVLPQDFSNMAAVQQG

SEQ ID NO: 804246 - protein, 27 aa, Mycobacterium
DSPRGQPRLLGFHWTKIHLDDPGLGEV

SEQ ID NO: 804247 - protein, 21 aa, Mycobacterium
DSPRHWIAHLNVLRDIQDRTG

SEQ ID NO: 804248 - protein, 20 aa, Mycobacterium
DSPRHWVGHLNVLRDIQDRT

SEQ ID NO: 804249 - protein, 25 aa, Mycobacterium
DSPRLPAAAALLALHDLGLGNQINA

SEQ ID NO: 804250 - protein, 28 aa, Mycobacterium
DSPRVVLLGIPTRGVSLARRLATHIREY

SEQ ID NO: 804251 - protein, 29 aa, Mycobacterium
DSPTAWIAEGLLPYLPPEAQDRLLDNITA

SEQ ID NO: 804252 - protein, 24 aa, Mycobacterium
DSPTDLPERLSLFGHTRLPVTEIE

SEQ ID NO: 804253 - protein, 18 aa, Mycobacterium
DSPVRVLLKVTGVPAGEA

SEQ ID NO: 804254 - protein, 27 aa, Mycobacterium
DSPWRAPEYLQTLPLRRLASPREVARC

SEQ ID NO: 804255 - protein, 19 aa, Mycobacterium
DSQLRVLTRREFAGMISVA

SEQ ID NO: 804256 - protein, 24 aa, Mycobacterium
DSQMTVVLCHRLAAATGLRLPETV

SEQ ID NO: 804257 - protein, 23 aa, Mycobacterium
DSQRGNWPPGFPDDKRPSYSLSE

SEQ ID NO: 804258 - protein, 26 aa, Mycobacterium
DSRAPSTPWPTYPLMYRVSAAHEEGG

SEQ ID NO: 804259 - protein, 17 aa, Mycobacterium
DSRAYRLAVPASAQWFD

SEQ ID NO: 804260 - protein, 21 aa, Mycobacterium
DSRAYRLDWAPGTTVFELDQP

SEQ ID NO: 804261 - protein, 17 aa, Mycobacterium
DSRAYRLDWPAGTTVYE

SEQ ID NO: 804262 - protein, 23 aa, Mycobacterium
DSRDPRSLAEFYVRLIGGEITAD

SEQ ID NO: 804263 - protein, 21 aa, Mycobacterium
DSRESLFWVSANGVRFGIAND

SEQ ID NO: 804264 - protein, 21 aa, Mycobacterium
DSRFAGLIRAFNALFPGRMFG

SEQ ID NO: 804265 - protein, 17 aa, Mycobacterium
DSRFDRQLWTKLAEADI

SEQ ID NO: 804266 - protein, 17 aa, Mycobacterium
DSRGRVVRRIDLGWPCY

SEQ ID NO: 804267 - protein, 26 aa, Mycobacterium
DSRGTYFLCADPRPLGYDDSTAFCAE

SEQ ID NO: 804268 - protein, 23 aa, Mycobacterium
DSRHLVLPLEQYPTLTDFGMANR

SEQ ID NO: 804269 - protein, 25 aa, Mycobacterium
DSRHVLDRYILAKLAVLREDLTRSM

SEQ ID NO: 804270 - protein, 26 aa, Mycobacterium
DSRLDLELPLARHAISSVGALSFKIG

SEQ ID NO: 804271 - protein, 21 aa, Mycobacterium
DSRLLTRELFYTAVTRAKAKV

SEQ ID NO: 804272 - protein, 17 aa, Mycobacterium
DSRLQDWPDALWRIVRE

SEQ ID NO: 804273 - protein, 22 aa, Mycobacterium
DSRLRVLARREFAGMISVAIES

SEQ ID NO: 804274 - protein, 22 aa, Mycobacterium
DSRLRVLTRREFAGMISVAIES

SEQ ID NO: 804275 - protein, 17 aa, Mycobacterium
DSRLRWLRRGEVPTLGN

SEQ ID NO: 804276 - protein, 25 aa, Mycobacterium
DSRQAMLFSATMPDPIITLARTFMN

SEQ ID NO: 804277 - protein, 21 aa, Mycobacterium
DSRQVSPGGLFLALPGARADG

SEQ ID NO: 804278 - protein, 23 aa, Mycobacterium
DSRRAVVAPLLLASAYHARLDIP

SEQ ID NO: 804279 - protein, 21 aa, Mycobacterium
DSRRLFQFVVAAEAPTLAAAA

SEQ ID NO: 804280 - protein, 29 aa, Mycobacterium
DSRRQVDVLIHLVLGYLAAPATTIDLGNT

SEQ ID NO: 804281 - protein, 39 aa, Mycobacterium
DSRSQFVIEPLEPGFGYTLGNSLRRTLLSSIPGAAVTSI

SEQ ID NO: 804282 - protein, 23 aa, Mycobacterium
DSRWTVQLAWKAGLSDNVAHFRY

SEQ ID NO: 804283 - protein, 27 aa, Mycobacterium
DSRYNPDYLPGTLLPPGIRATADAAEA

SEQ ID NO: 804284 - protein, 23 aa, Mycobacterium
DSSFFAVPREFERKLWPTEDFEL

SEQ ID NO: 804285 - protein, 22 aa, Mycobacterium
DSSKLLIAPNLWAGVGLVRGGA

SEQ ID NO: 804286 - protein, 21 aa, Mycobacterium
DSSLDWLVARFAQDVAGVTHA

SEQ ID NO: 804287 - protein, 23 aa, Mycobacterium
DSSPVRYIIFTQGHVDHVGGLDS

SEQ ID NO: 804288 - protein, 27 aa, Mycobacterium
DSTEHRVFLNLLRKRFETDKDKWTKIA

SEQ ID NO: 804289 - protein, 17 aa, Mycobacterium
DSTELVRLWGDPVTEVS

SEQ ID NO: 804290 - protein, 23 aa, Mycobacterium
DSTFYGDLFPHAVKWRGNVYLED

SEQ ID NO: 804291 - protein, 28 aa, Mycobacterium
DSTGPAFFPPIVAIALPFEHQHPSEFPS

SEQ ID NO: 804292 - protein, 27 aa, Mycobacterium
DSTRAVALQRAFSTRYFRPYTNSDVVG

SEQ ID NO: 804293 - protein, 20 aa, Mycobacterium
DSTRGRPFGLWLHGNEGTEG

SEQ ID NO: 804294 - protein, 19 aa, Mycobacterium
DSTRSAGTAVAKQPGRPTG

SEQ ID NO: 804295 - protein, 30 aa, Mycobacterium
DSTRVRFDLTVDLLVPLPGFVVRRGAKGVM

SEQ ID NO: 804296 - protein, 25 aa, Mycobacterium
DSTTVGLFTYPVLQAADVLAYDTDL

SEQ ID NO: 804297 - protein, 33 aa, Mycobacterium
DSTVLLHIALKAFWPAPLPFSLLHVDTGHNLPE

SEQ ID NO: 804298 - protein, 20 aa, Mycobacterium
DSTWALFGDGKLTNLPGGIE

SEQ ID NO: 804299 - protein, 24 aa, Mycobacterium
DSVALPVVYVHLPDMSITADLVTY

SEQ ID NO: 804300 - protein, 21 aa, Mycobacterium
DSVAQLELLLPAMAGLVATLR

SEQ ID NO: 804301 - protein, 19 aa, Mycobacterium
DSVAYFYRVFTMDTEPGRR

SEQ ID NO: 804302 - protein, 25 aa, Mycobacterium
DSVDWPLLVQAGWVGLDAPESLGGA

SEQ ID NO: 804303 - protein, 23 aa, Mycobacterium
DSVELPGWYRPNPGLARDLAFVG

SEQ ID NO: 804304 - protein, 22 aa, Mycobacterium
DSVERLVIGAARPALDAWHRHG

SEQ ID NO: 804305 - protein, 23 aa, Mycobacterium
DSVGLKLHYVSPAGEMGFPGALS

SEQ ID NO: 804306 - protein, 17 aa, Mycobacterium
DSVILVLDIEHPESLLA

SEQ ID NO: 804307 - protein, 24 aa, Mycobacterium
DSVKGKAKEVFGAVTGNESLTAEG

SEQ ID NO: 804308 - protein, 17 aa, Mycobacterium
DSVLALYSSLDDALSGI

SEQ ID NO: 804309 - protein, 23 aa, Mycobacterium
DSVLFSRINLSMTAILAALGATI

SEQ ID NO: 804310 - protein, 18 aa, Mycobacterium
DSVLLPIESRREIWTQIE

SEQ ID NO: 804311 - protein, 25 aa, Mycobacterium
DSVLMMADCFDLPLDEVKFSYELGA

SEQ ID NO: 804312 - protein, 32 aa, Mycobacterium
DSVLPIVPMFHANAWGLPYAALMAGADLVLPD

SEQ ID NO: 804313 - protein, 18 aa, Mycobacterium
DSVLPPSVRARVVVEAGI

SEQ ID NO: 804314 - protein, 20 aa, Mycobacterium
DSVLPTILRRQTALGVGWAR

SEQ ID NO: 804315 - protein, 24 aa, Mycobacterium
DSVLRGLYPAIDLAPHTAPRQRHR

SEQ ID NO: 804316 - protein, 26 aa, Mycobacterium
DSVPDALWPAAVFTLTTLLDDPVAAE

SEQ ID NO: 804317 - protein, 27 aa, Mycobacterium
DSVPEDFWPALVFTLVALLDDPVAAGI

SEQ ID NO: 804318 - protein, 31 aa, Mycobacterium
DSVQMPIGPRRALWEKLGGPLKPRHLDDVTH

SEQ ID NO: 804319 - protein, 18 aa, Mycobacterium
DSVRILPDGTLPNVTAWV

SEQ ID NO: 804320 - protein, 24 aa, Mycobacterium
DSVRRLEVLTYDGLRMWVGRTGED

SEQ ID NO: 804321 - protein, 18 aa, Mycobacterium
DSVSQLELLLPAMAGLVA

SEQ ID NO: 804322 - protein, 21 aa, Mycobacterium
DSVTWLNGGLFIEAYRPRIAQ

SEQ ID NO: 804323 - protein, 21 aa, Mycobacterium
DSVVFDRGGYTYGGRIAALAD

SEQ ID NO: 804324 - protein, 23 aa, Mycobacterium
DSVVQLELLLPAMAGLVGSLTFD

SEQ ID NO: 804325 - protein, 24 aa, Mycobacterium
DSVVRLRPYPVLRTYSIYDVDPDL

SEQ ID NO: 804326 - protein, 25 aa, Mycobacterium
DSVYLSPAPLYHTAPSVWSMSAQAG

SEQ ID NO: 804327 - protein, 17 aa, Mycobacterium
DSWDPACIPLHHLVTAD

SEQ ID NO: 804328 - protein, 22 aa, Mycobacterium
DSWGPKLRFGAPPGAGAGGAAA

SEQ ID NO: 804329 - protein, 17 aa, Mycobacterium
DSWLLSGHKNPVLAGDC

SEQ ID NO: 804330 - protein, 19 aa, Mycobacterium
DSWVIWNLTGGVRSGVHVT

SEQ ID NO: 804331 - protein, 28 aa, Mycobacterium
DSYEYRNLPEHPAFYWYTERIAEQRSVL

SEQ ID NO: 804332 - protein, 26 aa, Mycobacterium
DSYGPHHRLIFPLNTILELENVPEGQ

SEQ ID NO: 804333 - protein, 23 aa, Mycobacterium
DSYGRFMRIRAFDCWMHEQDIRH

SEQ ID NO: 804334 - protein, 23 aa, Mycobacterium
DSYHGLIFGTWNPAPVGLRESLG

SEQ ID NO: 804335 - protein, 20 aa, Mycobacterium
DSYMVSLLKEYWGEHATAEN

SEQ ID NO: 804336 - protein, 19 aa, Mycobacterium
DSYRYLLDRGYAPGKIVFA

SEQ ID NO: 804337 - protein, 28 aa, Mycobacterium
DSYSLVAMTYFPDPFVGQGWRSGAFESQ

SEQ ID NO: 804338 - protein, 25 aa, Mycobacterium
DTAAALRLGFLAGHLHWKVDQHDDT

SEQ ID NO: 804339 - protein, 23 aa, Mycobacterium
DTAAGFILDGYPRSVEQAKALHE

SEQ ID NO: 804340 - protein, 26 aa, Mycobacterium
DTAAKKALELTFRQALRLGHNYIGTE

SEQ ID NO: 804341 - protein, 24 aa, Mycobacterium
DTAAWLRDQPWFTGTFATIGLSYL

SEQ ID NO: 804342 - protein, 17 aa, Mycobacterium
DTADLLNWLDSQTKRNL

SEQ ID NO: 804343 - protein, 26 aa, Mycobacterium
DTAEDRVWKLTWYLGGHSASLSELLP

SEQ ID NO: 804344 - protein, 24 aa, Mycobacterium
DTAELLAHLALPIPSVVTPQMFTH

SEQ ID NO: 804345 - protein, 27 aa, Mycobacterium
DTAGRLGGFLTLRWTYCDPPSELPKAS

SEQ ID NO: 804346 - protein, 24 aa, Mycobacterium
DTAGRWRALALVATAADLLGAARG

SEQ ID NO: 804347 - protein, 30 aa, Mycobacterium
DTAHGPVRFPGVPTWFSRTPGRVSGPAPQL

SEQ ID NO: 804348 - protein, 20 aa, Mycobacterium
DTAHYLWAWTDRAAGALRVR

SEQ ID NO: 804349 - protein, 24 aa, Mycobacterium
DTAIQGFEGIYIHAVYYPGENQIQ

SEQ ID NO: 804350 - protein, 32 aa, Mycobacterium
DTAIRVGNRLRPWLPLLLGLTANSAIYRNADS

SEQ ID NO: 804351 - protein, 17 aa, Mycobacterium
DTAKATLAALIARHRVD

SEQ ID NO: 804352 - protein, 20 aa, Mycobacterium
DTALASVAAVAVLGTATETI

SEQ ID NO: 804353 - protein, 20 aa, Mycobacterium
DTALAWARRCPAAEWGSVEI

SEQ ID NO: 804354 - protein, 26 aa, Mycobacterium
DTALLADLLVLIKATPPAKQLRRILP

SEQ ID NO: 804355 - protein, 23 aa, Mycobacterium
DTALLDERLADFAPLPAPDDVLA

SEQ ID NO: 804356 - protein, 17 aa, Mycobacterium
DTALSERVLWPATSAEA

SEQ ID NO: 804357 - protein, 19 aa, Mycobacterium
DTALYRYLWRSVLAFDGAA

SEQ ID NO: 804358 - protein, 28 aa, Mycobacterium
DTAPPSLRAFYIAYRAVVRAKVDCVRLS

SEQ ID NO: 804359 - protein, 24 aa, Mycobacterium
DTAQHLWTLDNPAYGWFGLSSAVR

SEQ ID NO: 804360 - protein, 24 aa, Mycobacterium
DTARDRGWRFEPAPHPTGKRVLVV

SEQ ID NO: 804361 - protein, 23 aa, Mycobacterium
DTARIDAVFRKGAYSAGYSGFEA

SEQ ID NO: 804362 - protein, 25 aa, Mycobacterium
DTARNWWAQRIPQLPDPPSLPTTGD

SEQ ID NO: 804363 - protein, 27 aa, Mycobacterium
DTARREWTLPAWAPVPVSELALGRARR

SEQ ID NO: 804364 - protein, 17 aa, Mycobacterium
DTARRKAPCVLFFDEVD

SEQ ID NO: 804365 - protein, 25 aa, Mycobacterium
DTARVLSRFVDAIVWRTFGQDRLDA

SEQ ID NO: 804366 - protein, 20 aa, Mycobacterium
DTATWIVVRLLGTTVRYVVD

SEQ ID NO: 804367 - protein, 21 aa, Mycobacterium
DTAVFDRGGYTYGGRIAALAD

SEQ ID NO: 804368 - protein, 19 aa, Mycobacterium
DTAVLVGALPPRVAGVADD

SEQ ID NO: 804369 - protein, 27 aa, Mycobacterium
DTAVPLCFGFHPYLRLPDAARAEWVVH

SEQ ID NO: 804370 - protein, 24 aa, Mycobacterium
DTAWDIPSPPLLPQSQRDVRDAVN

SEQ ID NO: 804371 - protein, 23 aa, Mycobacterium
DTAWLTAAFEEFYDRRARAAQLV

SEQ ID NO: 804372 - protein, 22 aa, Mycobacterium
DTAWQSLIGLLDRRLPELPTDL

SEQ ID NO: 804373 - protein, 18 aa, Mycobacterium
DTAYAWAYNVDKGQKTRI

SEQ ID NO: 804374 - protein, 19 aa, Mycobacterium
DTCREEMRRLGRDPVPAAV

SEQ ID NO: 804375 - protein, 26 aa, Mycobacterium
DTCYLSMPLFHSNAIMAGWAPAVAAG

SEQ ID NO: 804376 - protein, 27 aa, Mycobacterium
DTDAAARVLLLWGRRPADPSRIRSRVG

SEQ ID NO: 804377 - protein, 22 aa, Mycobacterium
DTDAYFLLSLLQVMFDENLVAP

SEQ ID NO: 804378 - protein, 26 aa, Mycobacterium
DTDCERLLRRRLASLRPDDAILGEED

SEQ ID NO: 804379 - protein, 24 aa, Mycobacterium
DTDDLNVIAIRYLPDERASSLPDD

SEQ ID NO: 804380 - protein, 25 aa, Mycobacterium
DTDDLTPLRLAVPAEFRAEPAAARR

SEQ ID NO: 804381 - protein, 23 aa, Mycobacterium
DTDDPRFLPPGDLPARISAWYVE

SEQ ID NO: 804382 - protein, 47 aa, Mycobacterium
DTDDTRSPLRKPKFPAALAPESPLPDLKPRWERPTTAPDSETPSITQ

SEQ ID NO: 804383 - protein, 25 aa, Mycobacterium
DTDEFRLYELIWQRTVASQMADARG

SEQ ID NO: 804384 - protein, 23 aa, Mycobacterium
DTDFTVVWPRRDGVEYSIEHAVV

SEQ ID NO: 804385 - protein, 25 aa, Mycobacterium
DTDGDWPSFPLPLGDTWSSTRGDLL

SEQ ID NO: 804386 - protein, 29 aa, Mycobacterium
DTDGTIGPLTIPLIDIPAGPGFGNSSTSP

SEQ ID NO: 804387 - protein, 26 aa, Mycobacterium
DTDGVMLWFIQDESGLHLRCRYPDTA

SEQ ID NO: 804388 - protein, 23 aa, Mycobacterium
DTDHVGKLGWLDKIVSPECVLTH

SEQ ID NO: 804389 - protein, 26 aa, Mycobacterium
DTDIAWSRITYWRALLASAIDEPPHE

SEQ ID NO: 804390 - protein, 22 aa, Mycobacterium
DTDIDWLRLAWADYSNQLRWFD

SEQ ID NO: 804391 - protein, 27 aa, Mycobacterium
DTDLAWARITYWRALLTSAVDLPPHEP

SEQ ID NO: 804392 - protein, 26 aa, Mycobacterium
DTDLAWARITYWRALLTSAVDLTPHE

SEQ ID NO: 804393 - protein, 25 aa, Mycobacterium
DTDLAWSRVTYWRALLAAAVDQEPF

SEQ ID NO: 804394 - protein, 24 aa, Mycobacterium
DTDLLDLTVLSRTFGYPSTVEAQD

SEQ ID NO: 804395 - protein, 28 aa, Mycobacterium
DTDLSWSRITYWRALLASALDQAPYEGI

SEQ ID NO: 804396 - protein, 23 aa, Mycobacterium
DTDLVVLDFHQWREGLLRGIAAH

SEQ ID NO: 804397 - protein, 24 aa, Mycobacterium
DTDNMFGFWDWVGGRYSVDSAIGL

SEQ ID NO: 804398 - protein, 23 aa, Mycobacterium
DTDPLVLGRFNPVAVPVLGDVGV

SEQ ID NO: 804399 - protein, 23 aa, Mycobacterium
DTDQIIPAVYLKRVTRTGFEDGL

SEQ ID NO: 804400 - protein, 24 aa, Mycobacterium
DTDREPWLRRIAEWICEHGRAGTG

SEQ ID NO: 804401 - protein, 24 aa, Mycobacterium
DTDRWLRDFFGPAAATDWVKPTTT

SEQ ID NO: 804402 - protein, 26 aa, Mycobacterium
DTDTERLLRERLVQLRPGDPILGEEG

SEQ ID NO: 804403 - protein, 32 aa, Mycobacterium
DTDTMLSLLLMILPHLALAPYVRGMDPVLGLD

SEQ ID NO: 804404 - protein, 31 aa, Mycobacterium
DTDTPMLAVDGFPRLLRLNSVRFTVVSIDAD

SEQ ID NO: 804405 - protein, 25 aa, Mycobacterium
DTDTQYAFTRPIAGHMFGNYDGVLK

SEQ ID NO: 804406 - protein, 21 aa, Mycobacterium
DTDTQYAFTRPIAGHMFTNYD

SEQ ID NO: 804407 - protein, 27 aa, Mycobacterium
DTDVFGLRWADFCRFTFFSDLCTALDD

SEQ ID NO: 804408 - protein, 35 aa, Mycobacterium
DTEGQWWYESLAGAPLPAWLRDLAPTPSRPHTVDW

SEQ ID NO: 804409 - protein, 20 aa, Mycobacterium
DTELLEYHWGPDWMVWDAQR

SEQ ID NO: 804410 - protein, 17 aa, Mycobacterium
DTELLGYYLPKGTNVIA

SEQ ID NO: 804411 - protein, 24 aa, Mycobacterium
DTELRVRCIRQLRDALREHVEELR

SEQ ID NO: 804412 - protein, 27 aa, Mycobacterium
DTENYRSIWMYLKELEFRQGFIDIPVN

SEQ ID NO: 804413 - protein, 33 aa, Mycobacterium
DTEPWRGEPLLSYLRKMVFWAAVTPEAADLAVL

SEQ ID NO: 804414 - protein, 25 aa, Mycobacterium
DTEQRQRWFPGLAAGTLLTAIAMTE

SEQ ID NO: 804415 - protein, 25 aa, Mycobacterium
DTEQVLFLGLWYDDAAVRTRHGWRL

SEQ ID NO: 804416 - protein, 20 aa, Mycobacterium
DTERGMAYTRIGYAAPLDSI

SEQ ID NO: 804417 - protein, 26 aa, Mycobacterium
DTERRFRAWIRWNAAIMVHRAQRPGV

SEQ ID NO: 804418 - protein, 26 aa, Mycobacterium
DTERSARAWLFTVARNMIIDDRRSAR

SEQ ID NO: 804419 - protein, 27 aa, Mycobacterium
DTERYALFDAVVALLAMASASAPVVLV

SEQ ID NO: 804420 - protein, 25 aa, Mycobacterium
DTETERWLRERLAVLRPGEHVLGEE

SEQ ID NO: 804421 - protein, 32 aa, Mycobacterium
DTETLVRYIDRFLMYYIRTADRLQRTAPWVES

SEQ ID NO: 804422 - protein, 31 aa, Mycobacterium
DTETLVRYIDRFLMYYVRTADRLQRTAPWVE

SEQ ID NO: 804423 - protein, 26 aa, Mycobacterium
DTETVVLALHRYLGRTPSKLLALSLT

SEQ ID NO: 804424 - protein, 25 aa, Mycobacterium
DTEVILPGHGPLWRGPVRDAAAQAA

SEQ ID NO: 804425 - protein, 36 aa, Mycobacterium
DTEVLIMDYLMHQRRLFPLIARSYALQFAQNELVSK

SEQ ID NO: 804426 - protein, 19 aa, Mycobacterium
DTEVWFPAGPVGTASVLAE

SEQ ID NO: 804427 - protein, 17 aa, Mycobacterium
DTEWLPPPHLDHGQPRT

SEQ ID NO: 804428 - protein, 18 aa, Mycobacterium
DTFARVLGDPALPHLFFV

SEQ ID NO: 804429 - protein, 20 aa, Mycobacterium
DTFATLLLAQLRGLQFDFLA

SEQ ID NO: 804430 - protein, 18 aa, Mycobacterium
DTFGQDGHGWYFSSRRVD

SEQ ID NO: 804431 - protein, 20 aa, Mycobacterium
DTFHVWWDPELADGIAAAGA

SEQ ID NO: 804432 - protein, 23 aa, Mycobacterium
DTFRDFWKIRNPVKAIREGREYM

SEQ ID NO: 804433 - protein, 22 aa, Mycobacterium
DTFRNRVPGPHFDRALAGAVLH

SEQ ID NO: 804434 - protein, 19 aa, Mycobacterium
DTFSRVLGDPALPHLFFVD

SEQ ID NO: 804435 - protein, 27 aa, Mycobacterium
DTFVELSAHPSLLYPLGDIVGDESVVV

SEQ ID NO: 804436 - protein, 20 aa, Mycobacterium
DTFVTVMKFLGADGSLRSDG

SEQ ID NO: 804437 - protein, 25 aa, Mycobacterium
DTGALPLAPRNPLSLRQMARAVRAL

SEQ ID NO: 804438 - protein, 26 aa, Mycobacterium
DTGATKMWMARLYPTYECNTCLVSNG

SEQ ID NO: 804439 - protein, 27 aa, Mycobacterium
DTGATKMWMARLYPTYEKNTCLISNGL

SEQ ID NO: 804440 - protein, 27 aa, Mycobacterium
DTGATKMWMARLYPTYEPNTCLVSNGL

SEQ ID NO: 804441 - protein, 27 aa, Mycobacterium
DTGATKMWMARLYPTYQRNTCLISNGL

SEQ ID NO: 804442 - protein, 27 aa, Mycobacterium
DTGAWIRLHRRFDIDAMLRHIESDRIT

SEQ ID NO: 804443 - protein, 26 aa, Mycobacterium
DTGEYLEPGLRETGFWRFVSDPDDPS

SEQ ID NO: 804444 - protein, 21 aa, Mycobacterium
DTGFFNYGDGGLHVGWLSSGD

SEQ ID NO: 804445 - protein, 24 aa, Mycobacterium
DTGGYTPPWPGLGAYGVSKAALER

SEQ ID NO: 804446 - protein, 21 aa, Mycobacterium
DTGLDGLLGVPGSNGQTGEIV

SEQ ID NO: 804447 - protein, 22 aa, Mycobacterium
DTGMRIYVLIAGGIAVPQFLGS

SEQ ID NO: 804448 - protein, 24 aa, Mycobacterium
DTGMSFPAYVRWARLIRTIEVART

SEQ ID NO: 804449 - protein, 18 aa, Mycobacterium
DTGMTYQAWQAQWNQAME

SEQ ID NO: 804450 - protein, 24 aa, Mycobacterium
DTGNPPQFPVLHSGWEQVGDGAIQ

SEQ ID NO: 804451 - protein, 19 aa, Mycobacterium
DTGPLWKAYVDLGWTELND

SEQ ID NO: 804452 - protein, 29 aa, Mycobacterium
DTGRFSWRDLIWRISRRDFGPGKGPAYER

SEQ ID NO: 804453 - protein, 25 aa, Mycobacterium
DTGSEAFLRYWPADLHMIGKDIIRF

SEQ ID NO: 804454 - protein, 23 aa, Mycobacterium
DTGSPAAYYVWVHDFSASVDASS

SEQ ID NO: 804455 - protein, 23 aa, Mycobacterium
DTGVDFWHPVMPGVLRCANGVVL

SEQ ID NO: 804456 - protein, 33 aa, Mycobacterium
DTHARVGLLPTWGLSVRLPQKVGIGLARRMSMT

SEQ ID NO: 804457 - protein, 29 aa, Mycobacterium
DTHARVGLLPTWGLSVRLPQKVGVGLARR

SEQ ID NO: 804458 - protein, 28 aa, Mycobacterium
DTHARVGLLPTWGLSVRLPQKVGVGMAR

SEQ ID NO: 804459 - protein, 29 aa, Mycobacterium
DTHARVGLLPTWGLSVRLPQKVGVGMARR

SEQ ID NO: 804460 - protein, 25 aa, Mycobacterium
DTHEQLLFCCAFLYVCSGYYRYDEG

SEQ ID NO: 804461 - protein, 24 aa, Mycobacterium
DTHGSTLRFAPPLVITADEIDWAV

SEQ ID NO: 804462 - protein, 25 aa, Mycobacterium
DTHGSTLRFAPPLVITAQEIDWAVR

SEQ ID NO: 804463 - protein, 22 aa, Mycobacterium
DTHGSTLRFAPPLVVTEQEIDW

SEQ ID NO: 804464 - protein, 22 aa, Mycobacterium
DTHGSTLRFAPPLVVTSEEIDW

SEQ ID NO: 804465 - protein, 29 aa, Mycobacterium
DTHLITSHCLLPLLVTRPGGLLVEISDGT

SEQ ID NO: 804466 - protein, 19 aa, Mycobacterium
DTHLLRYPLPSAWCADADV

SEQ ID NO: 804467 - protein, 25 aa, Mycobacterium
DTHLPRARLRLRQVDHLKCVRTTEF

SEQ ID NO: 804468 - protein, 21 aa, Mycobacterium
DTHLTRLRLITSMLDRGYNIA

SEQ ID NO: 804469 - protein, 22 aa, Mycobacterium
DTHLTRLRLITSMLDRGYTIAH

SEQ ID NO: 804470 - protein, 19 aa, Mycobacterium
DTHRPDVIAIERVFANQNA

SEQ ID NO: 804471 - protein, 23 aa, Mycobacterium
DTHRPDVLAIERVFSQLNVTTVM

SEQ ID NO: 804472 - protein, 21 aa, Mycobacterium
DTHTCRTFEIPACGGLFVGER

SEQ ID NO: 804473 - protein, 25 aa, Mycobacterium
DTIARLWDHIGDMGIGFCLDTCHAW

SEQ ID NO: 804474 - protein, 21 aa, Mycobacterium
DTIAVIAREPLTGAQLAAQFE

SEQ ID NO: 804475 - protein, 19 aa, Mycobacterium
DTIELWRKISTVEDPEWTR

SEQ ID NO: 804476 - protein, 35 aa, Mycobacterium
DTIGGYAERMLLSAPLLLPIPRDLNPKHAALAEPM

SEQ ID NO: 804477 - protein, 34 aa, Mycobacterium
DTIGGYAERMLLSAPLLLPVPNGLDFRHAALTEP

SEQ ID NO: 804478 - protein, 24 aa, Mycobacterium
DTILRGGVPMLLIRGQMSDLVSQE

SEQ ID NO: 804479 - protein, 23 aa, Mycobacterium
DTIMRIPELPEHLVIVGGGFVAA

SEQ ID NO: 804480 - protein, 25 aa, Mycobacterium
DTIRQHVYDIVRGKRWPSAYSGRVL

SEQ ID NO: 804481 - protein, 19 aa, Mycobacterium
DTIVFCGVHFMAETAKILS

SEQ ID NO: 804482 - protein, 19 aa, Mycobacterium
DTIVLVAGLYRAAVAREAE

SEQ ID NO: 804483 - protein, 18 aa, Mycobacterium
DTIYGIVGIPITDLARVA

SEQ ID NO: 804484 - protein, 20 aa, Mycobacterium
DTKAIRLLGLVAPAEVWRQA

SEQ ID NO: 804485 - protein, 24 aa, Mycobacterium
DTKDPNLIKLLPPAPVAADVPADQ

SEQ ID NO: 804486 - protein, 27 aa, Mycobacterium
DTKGDLPAFAELLSRLPWPLNKTTSVN

SEQ ID NO: 804487 - protein, 26 aa, Mycobacterium
DTKKKDPFYVWRYGLESYHSVFNYAP

SEQ ID NO: 804488 - protein, 30 aa, Mycobacterium
DTKLAPDTALGRVIFHVLEPGKVARPNAPF

SEQ ID NO: 804489 - protein, 17 aa, Mycobacterium
DTKLARQAQLRTLTRKY

SEQ ID NO: 804490 - protein, 24 aa, Mycobacterium
DTKRKFREALDRKMAKSSTGSDHK

SEQ ID NO: 804491 - protein, 23 aa, Mycobacterium
DTLAAMICHGAMSRFPDLKVFCV

SEQ ID NO: 804492 - protein, 18 aa, Mycobacterium
DTLALLEDRWRDVVDALD

SEQ ID NO: 804493 - protein, 18 aa, Mycobacterium
DTLALLEDRWRDVVDALN

SEQ ID NO: 804494 - protein, 24 aa, Mycobacterium
DTLAPGHGSLWRGPIRLATEEARA

SEQ ID NO: 804495 - protein, 17 aa, Mycobacterium
DTLDRWWSDVCGTLGAP

SEQ ID NO: 804496 - protein, 23 aa, Mycobacterium
DTLEALLIGRKPRLPAKTVCTEC

SEQ ID NO: 804497 - protein, 27 aa, Mycobacterium
DTLEETALWLDLTYSGSTPVVLTGAMR

SEQ ID NO: 804498 - protein, 23 aa, Mycobacterium
DTLFEIWSLTRFPNDASAGKPTP

SEQ ID NO: 804499 - protein, 22 aa, Mycobacterium
DTLFLERFVQRPRHIEVQVLAD

SEQ ID NO: 804500 - protein, 25 aa, Mycobacterium
DTLGPFCATLARLCGKQLVLPMNSG

SEQ ID NO: 804501 - protein, 27 aa, Mycobacterium
DTLGTRLMLAIWRGRAGDIPGAITELE

SEQ ID NO: 804502 - protein, 28 aa, Mycobacterium
DTLHADLAWTYQYPLPAVAAIAGLVAFY

SEQ ID NO: 804503 - protein, 21 aa, Mycobacterium
DTLLDEFPRLRERYTVAAGQL

SEQ ID NO: 804504 - protein, 24 aa, Mycobacterium
DTLLISEYYGLRTAGLRGLAVRSS

SEQ ID NO: 804505 - protein, 20 aa, Mycobacterium
DTLLLLEHSPVYTAGRRTEP

SEQ ID NO: 804506 - protein, 20 aa, Mycobacterium
DTLLPIGRTAPPVTTAHNCP

SEQ ID NO: 804507 - protein, 19 aa, Mycobacterium
DTLLPPDLFNRFTHDAFWR

SEQ ID NO: 804508 - protein, 24 aa, Mycobacterium
DTLLSAQWRNGMIPHIVFANGVDG

SEQ ID NO: 804509 - protein, 18 aa, Mycobacterium
DTLLVYENFPPGAVAGAG

SEQ ID NO: 804510 - protein, 18 aa, Mycobacterium
DTLLWAKLIDKYGGTMTA

SEQ ID NO: 804511 - protein, 17 aa, Mycobacterium
DTLLWAKLIDKYKGTMT

SEQ ID NO: 804512 - protein, 19 aa, Mycobacterium
DTLRRALYQTLRGYLGQES

SEQ ID NO: 804513 - protein, 23 aa, Mycobacterium
DTLRRHFTLTPDPAPRGSAPAQL

SEQ ID NO: 804514 - protein, 43 aa, Mycobacterium
DTLRSVMMRHRDGMRLRYVDPFRAELERLGRMVFGPTFEVDID

SEQ ID NO: 804515 - protein, 17 aa, Mycobacterium
DTLRYALEQAPAGVFVD

SEQ ID NO: 804516 - protein, 22 aa, Mycobacterium
DTLTFCWNIVRDQADLADAALE

SEQ ID NO: 804517 - protein, 25 aa, Mycobacterium
DTLVLGCTHYPLLSGLIQLAMGDHV

SEQ ID NO: 804518 - protein, 25 aa, Mycobacterium
DTLVLGCTHYPLLSGLIQLAMGEHV

SEQ ID NO: 804519 - protein, 25 aa, Mycobacterium
DTLVLGCTHYPLLSGLIQLAMGEQV

SEQ ID NO: 804520 - protein, 25 aa, Mycobacterium
DTLWQLALRFYGDAELYRLIATASG

SEQ ID NO: 804521 - protein, 30 aa, Mycobacterium
DTLYGPDGLALPMRLALPGAVNRGNAAQAV

SEQ ID NO: 804522 - protein, 23 aa, Mycobacterium
DTLYSCLPLYHNNALTVALSSVI

SEQ ID NO: 804523 - protein, 22 aa, Mycobacterium
DTLYSCLPLYHNNALTVAVSSV

SEQ ID NO: 804524 - protein, 18 aa, Mycobacterium
DTMGQMNTAFRNIVTMLN

SEQ ID NO: 804525 - protein, 23 aa, Mycobacterium
DTMKRILLELGGKSASIVLDDAQ

SEQ ID NO: 804526 - protein, 19 aa, Mycobacterium
DTMLSWRRYGAEARQLAGT

SEQ ID NO: 804527 - protein, 17 aa, Mycobacterium
DTMPWLMAGAKTLSYAV

SEQ ID NO: 804528 - protein, 19 aa, Mycobacterium
DTMRLLDFGGDAADAALAA

SEQ ID NO: 804529 - protein, 26 aa, Mycobacterium
DTNIYYRRALMLAACFGRHTTYPQRV

SEQ ID NO: 804530 - protein, 32 aa, Mycobacterium
DTNLKGVWHTLLATVPSIIRKGQGGSIVLVSS

SEQ ID NO: 804531 - protein, 25 aa, Mycobacterium
DTNPGLMQMVTPFLPDYIAEPEDIA

SEQ ID NO: 804532 - protein, 24 aa, Mycobacterium
DTNRGWCAWMPAIARLFPDAKVIA

SEQ ID NO: 804533 - protein, 20 aa, Mycobacterium
DTNRGWCAWMPAIARLFPEA

SEQ ID NO: 804534 - protein, 20 aa, Mycobacterium
DTNSSFDPQIVKKRQRRLTG

SEQ ID NO: 804535 - protein, 22 aa, Mycobacterium
DTNTLRMFLSERGKIRSRRVTG

SEQ ID NO: 804536 - protein, 20 aa, Mycobacterium
DTNVRGAYFLVAGLVPGMLN

SEQ ID NO: 804537 - protein, 26 aa, Mycobacterium
DTNVYYRRALLLAACFGRAADHPQQV

SEQ ID NO: 804538 - protein, 26 aa, Mycobacterium
DTNVYYRRALMLAACFGRSVEYPQRV

SEQ ID NO: 804539 - protein, 25 aa, Mycobacterium
DTNVYYRRALMLAASFGRASEYPQK

SEQ ID NO: 804540 - protein, 25 aa, Mycobacterium
DTNVYYRRALMLAASFGRSSDYPQK

SEQ ID NO: 804541 - protein, 24 aa, Mycobacterium
DTNVYYRRALVLAASFGRASEYPQ

SEQ ID NO: 804542 - protein, 22 aa, Mycobacterium
DTNYHYIVPEIAPTTKFALNPD

SEQ ID NO: 804543 - protein, 18 aa, Mycobacterium
DTPALRALEFRRGQIASP

SEQ ID NO: 804544 - protein, 22 aa, Mycobacterium
DTPATKVVVLTGAGRFFCAGGD

SEQ ID NO: 804545 - protein, 28 aa, Mycobacterium
DTPELMPLPIALAHRLARRLTEVRKNGV

SEQ ID NO: 804546 - protein, 27 aa, Mycobacterium
DTPELMPLPIALAHRLSRRLTEVRKNG

SEQ ID NO: 804547 - protein, 17 aa, Mycobacterium
DTPIWFGLDGDALVFRT

SEQ ID NO: 804548 - protein, 22 aa, Mycobacterium
DTPKHWVAHLRVLAGIQDRTGG

SEQ ID NO: 804549 - protein, 24 aa, Mycobacterium
DTPLARLYSWHRAMRIFDGPDEVH

SEQ ID NO: 804550 - protein, 23 aa, Mycobacterium
DTPLITVPPFVAPHHTSSVASLV

SEQ ID NO: 804551 - protein, 19 aa, Mycobacterium
DTPLQARGWIREAEGRKAF

SEQ ID NO: 804552 - protein, 17 aa, Mycobacterium
DTPLRQHPVLLPVAEDI

SEQ ID NO: 804553 - protein, 31 aa, Mycobacterium
DTPNELLKPLPLVPYTPKWLARKMEVLAMGT

SEQ ID NO: 804554 - protein, 18 aa, Mycobacterium
DTPQISAALLAECARRLL

SEQ ID NO: 804555 - protein, 21 aa, Mycobacterium
DTPRHWIAHLNVLRDIQDRTG

SEQ ID NO: 804556 - protein, 20 aa, Mycobacterium
DTPRHWVGHLNVLRDIQDRT

SEQ ID NO: 804557 - protein, 24 aa, Mycobacterium
DTPRPPEGDWLGTPYLAFERQGSI

SEQ ID NO: 804558 - protein, 22 aa, Mycobacterium
DTPRTRTVLLKGWEQFDEPVDR

SEQ ID NO: 804559 - protein, 25 aa, Mycobacterium
DTPTGERVFLTFLRNQVAAVNELVA

SEQ ID NO: 804560 - protein, 32 aa, Mycobacterium
DTPTLMLLDGNSLAFRAFYALPAENFKTQSGL

SEQ ID NO: 804561 - protein, 17 aa, Mycobacterium
DTPVALFGHSMGGMLAF

SEQ ID NO: 804562 - protein, 29 aa, Mycobacterium
DTPVKAARYLYPRVEVEVGFILAGDLPGA

SEQ ID NO: 804563 - protein, 19 aa, Mycobacterium
DTPVLPPPDVAAAAELLLL

SEQ ID NO: 804564 - protein, 19 aa, Mycobacterium
DTPWCAAVLGRIIAEHTDF

SEQ ID NO: 804565 - protein, 23 aa, Mycobacterium
DTPWRAEYLYSRAATIYGGTAEI

SEQ ID NO: 804566 - protein, 20 aa, Mycobacterium
DTPWRPEYLYSRAATIYGGT

SEQ ID NO: 804567 - protein, 24 aa, Mycobacterium
DTPYSGVAAIFRSSLEKGEPPRVF

SEQ ID NO: 804568 - protein, 21 aa, Mycobacterium
DTQFPALPLFELGYEVAHVGF

SEQ ID NO: 804569 - protein, 17 aa, Mycobacterium
DTQGFRRGNLTYRHMLE

SEQ ID NO: 804570 - protein, 20 aa, Mycobacterium
DTQHELLAAALLEKASHVAA

SEQ ID NO: 804571 - protein, 18 aa, Mycobacterium
DTQQLLRKAGITVRPRDV

SEQ ID NO: 804572 - protein, 23 aa, Mycobacterium
DTQRQCIELAYYGGLTYAEVSQR

SEQ ID NO: 804573 - protein, 23 aa, Mycobacterium
DTQVFLCGPPELMDATTAALTSG

SEQ ID NO: 804574 - protein, 22 aa, Mycobacterium
DTQVTWLTEEAYDRLKAELDQL

SEQ ID NO: 804575 - protein, 23 aa, Mycobacterium
DTRARTFFSRAPLTPFPDAVRAT

SEQ ID NO: 804576 - protein, 21 aa, Mycobacterium
DTRAWILNRPVAGGATTYFQA

SEQ ID NO: 804577 - protein, 19 aa, Mycobacterium
DTRDRFVDVMLAEAGWGLT

SEQ ID NO: 804578 - protein, 20 aa, Mycobacterium
DTREGLIVSMRLYSDTRAHE

SEQ ID NO: 804579 - protein, 23 aa, Mycobacterium
DTREQLRRHLEACPGCFKHYGLE

SEQ ID NO: 804580 - protein, 17 aa, Mycobacterium
DTRFAQQMKILFPIFTS

SEQ ID NO: 804581 - protein, 31 aa, Mycobacterium
DTRGATRRRVLALGIRLLDHGHFRSGGDEYA

SEQ ID NO: 804582 - protein, 50 aa, Mycobacterium
DTRGGALLAFGLADSLILRQRYPVPGAPYGLAYSATLIWVSQTATNTVIG

SEQ ID NO: 804583 - protein, 22 aa, Mycobacterium
DTRGWGPPFVDGDSAWFASANR

SEQ ID NO: 804584 - protein, 18 aa, Mycobacterium
DTRIATGPLNAWLKEVVA

SEQ ID NO: 804585 - protein, 17 aa, Mycobacterium
DTRIDPEGYPRISADDA

SEQ ID NO: 804586 - protein, 17 aa, Mycobacterium
DTRKKLMTDIFALAMEL

SEQ ID NO: 804587 - protein, 23 aa, Mycobacterium
DTRKTLPGLRALQKYAVRVGGGV

SEQ ID NO: 804588 - protein, 21 aa, Mycobacterium
DTRLGLTWISLLHGRTRASLA

SEQ ID NO: 804589 - protein, 19 aa, Mycobacterium
DTRLILLDSLPTLDTNTNP

SEQ ID NO: 804590 - protein, 18 aa, Mycobacterium
DTRLLGETELWQLAFDVV

SEQ ID NO: 804591 - protein, 18 aa, Mycobacterium
DTRLLSETELWQLAYDVV

SEQ ID NO: 804592 - protein, 24 aa, Mycobacterium
DTRLRGLLALIRSDPRVQAFAEVE

SEQ ID NO: 804593 - protein, 19 aa, Mycobacterium
DTRLRRIGALLADGRIDWR

SEQ ID NO: 804594 - protein, 24 aa, Mycobacterium
DTRPVTVAVLLRLTERFDLSPHYF

SEQ ID NO: 804595 - protein, 24 aa, Mycobacterium
DTRPYRLNLPSHLQWIEADLPQLL

SEQ ID NO: 804596 - protein, 26 aa, Mycobacterium
DTRQPSLNVLLWQRALEPERDKWSLP

SEQ ID NO: 804597 - protein, 25 aa, Mycobacterium
DTRTSLLDMLRERAGLPGTKKACDH

SEQ ID NO: 804598 - protein, 19 aa, Mycobacterium
DTRVLAAMLSGAIAVGVLH

SEQ ID NO: 804599 - protein, 19 aa, Mycobacterium
DTRVLRGWSTLPVTLGPAR

SEQ ID NO: 804600 - protein, 22 aa, Mycobacterium
DTRVLRGWSTLPVTLGPARALA

SEQ ID NO: 804601 - protein, 33 aa, Mycobacterium
DTRVTLPSEPLWYSGPSWLAPVALKSLTKLSNK

SEQ ID NO: 804602 - protein, 17 aa, Mycobacterium
DTRWHPVNRLPPMAFDH

SEQ ID NO: 804603 - protein, 17 aa, Mycobacterium
DTRWIHRAAHDLMGVNP

SEQ ID NO: 804604 - protein, 17 aa, Mycobacterium
DTSAAAAALSPWGAGPQ

SEQ ID NO: 804605 - protein, 26 aa, Mycobacterium
DTSDPVLRKYFPNVVSPVAGVGFSTL

SEQ ID NO: 804606 - protein, 26 aa, Mycobacterium
DTSDRWVTLAFTWTGLRALGVPEESL

SEQ ID NO: 804607 - protein, 17 aa, Mycobacterium
DTSFFLLGKLDDAHAVW

SEQ ID NO: 804608 - protein, 24 aa, Mycobacterium
DTSFNNWILGRTPAGRWGTVDDLV

SEQ ID NO: 804609 - protein, 31 aa, Mycobacterium
DTSFSMVMENRWLPMKRTALALNHLVSTRFR

SEQ ID NO: 804610 - protein, 26 aa, Mycobacterium
DTSGALPVMVWIPGGAFVYGAGQLQL

SEQ ID NO: 804611 - protein, 24 aa, Mycobacterium
DTSGPLVTELLAEAGFVVDGVVVV

SEQ ID NO: 804612 - protein, 18 aa, Mycobacterium
DTSIAMPMLLMNRRTLDT

SEQ ID NO: 804613 - protein, 25 aa, Mycobacterium
DTSIVIQKALLRLPAEQRAAVIAVD

SEQ ID NO: 804614 - protein, 24 aa, Mycobacterium
DTSKATLMAAWTSLYNASKNEAGA

SEQ ID NO: 804615 - protein, 19 aa, Mycobacterium
DTSKPWFAIGGIDEARVPQ

SEQ ID NO: 804616 - protein, 25 aa, Mycobacterium
DTSKSALMAAWTSLYDASKNEPNRP

SEQ ID NO: 804617 - protein, 28 aa, Mycobacterium
DTSRREWTLPVWAPMPVSELLLGRARRP

SEQ ID NO: 804618 - protein, 34 aa, Mycobacterium
DTSSRLLANQFLYGAPFPVPIPDVMRTDLLVMIG

SEQ ID NO: 804619 - protein, 21 aa, Mycobacterium
DTSSYCPFKGEASYYSVTSSA

SEQ ID NO: 804620 - protein, 23 aa, Mycobacterium
DTSTAPTAFIPMSARSEARLAAA

SEQ ID NO: 804621 - protein, 21 aa, Mycobacterium
DTSTYCPFKGDASYYSVTTSS

SEQ ID NO: 804622 - protein, 29 aa, Mycobacterium
DTTATFEWAFRWLAANRPPASPPRLIHGD

SEQ ID NO: 804623 - protein, 27 aa, Mycobacterium
DTTATFEWAFRWLRARRPPPSTAVLVH

SEQ ID NO: 804624 - protein, 24 aa, Mycobacterium
DTTAYPDALYLTCSDWPVGPPADG

SEQ ID NO: 804625 - protein, 33 aa, Mycobacterium
DTTCWIYGGLTLNPLFWPARHDETLLMKAIYEF

SEQ ID NO: 804626 - protein, 18 aa, Mycobacterium
DTTGFLKLIAERGSGRLL

SEQ ID NO: 804627 - protein, 27 aa, Mycobacterium
DTTGSLPVMVWIPGGAFVYGAGQFQLY

SEQ ID NO: 804628 - protein, 27 aa, Mycobacterium
DTTGVPSTAWGLLPLATGVAVVDAISA

SEQ ID NO: 804629 - protein, 30 aa, Mycobacterium
DTTLGRVLFNELLPPGYPFVNKQMHKKVQA

SEQ ID NO: 804630 - protein, 27 aa, Mycobacterium
DTTMFKVMYGWGLRINELCRLDLADMY

SEQ ID NO: 804631 - protein, 23 aa, Mycobacterium
DTTMQFMLTTQRLAGLPGLVADY

SEQ ID NO: 804632 - protein, 22 aa, Mycobacterium
DTTMRMLCVFNPPVTGQEIHDE

SEQ ID NO: 804633 - protein, 24 aa, Mycobacterium
DTTNVAVMCGEPTWWRCHRRMIAD

SEQ ID NO: 804634 - protein, 20 aa, Mycobacterium
DTTPDFLTLYAPKPEEDTRP

SEQ ID NO: 804635 - protein, 22 aa, Mycobacterium
DTTPLYGDCAFLEKWPGVPVGN

SEQ ID NO: 804636 - protein, 23 aa, Mycobacterium
DTTPSMFAQLQAFGLLTDVPLTV

SEQ ID NO: 804637 - protein, 22 aa, Mycobacterium
DTTRLPALLDANPQAKLYADPQ

SEQ ID NO: 804638 - protein, 22 aa, Mycobacterium
DTTRMRRDLGYSPKWTTGEAFD

SEQ ID NO: 804639 - protein, 18 aa, Mycobacterium
DTTRMRTELGYQPKWTTA

SEQ ID NO: 804640 - protein, 18 aa, Mycobacterium
DTTRRFFEAFAASGIRRE

SEQ ID NO: 804641 - protein, 29 aa, Mycobacterium
DTTTDPVLAWLYVVDAWEGGLPSARYIGV

SEQ ID NO: 804642 - protein, 29 aa, Mycobacterium
DTTTDPVLAWLYVVNAYEGGLPSARYLGV

SEQ ID NO: 804643 - protein, 18 aa, Mycobacterium
DTTTLRGLLGLPRPANRY

SEQ ID NO: 804644 - protein, 21 aa, Mycobacterium
DTTVAYYPPAFSPDSRRRLQE

SEQ ID NO: 804645 - protein, 18 aa, Mycobacterium
DTVALWHKIRTVEDPGWT

SEQ ID NO: 804646 - protein, 19 aa, Mycobacterium
DTVALWRKVSTVEDPEWTR

SEQ ID NO: 804647 - protein, 19 aa, Mycobacterium
DTVAPLLEGSGVRVGLKWP

SEQ ID NO: 804648 - protein, 34 aa, Mycobacterium
DTVDAISVLMTKNRVRHVPVLDGKKLIGIVSIGD

SEQ ID NO: 804649 - protein, 18 aa, Mycobacterium
DTVDFWHRQFDGADPDIG

SEQ ID NO: 804650 - protein, 25 aa, Mycobacterium
DTVEAFLVFGSLRRTAAELHLHHST

SEQ ID NO: 804651 - protein, 20 aa, Mycobacterium
DTVFLDILRSGPVMAHLAAW

SEQ ID NO: 804652 - protein, 28 aa, Mycobacterium
DTVGARLLVLRRLAYPDDARLGPSLRVV

SEQ ID NO: 804653 - protein, 23 aa, Mycobacterium
DTVGARLTVLRRLAHPDDARLGP

SEQ ID NO: 804654 - protein, 26 aa, Mycobacterium
DTVGLHRLVEVLIQRGYRVIGPTLRD

SEQ ID NO: 804655 - protein, 19 aa, Mycobacterium
DTVHRYIALVAKGGADELV

SEQ ID NO: 804656 - protein, 21 aa, Mycobacterium
DTVIGVNLSGTWRTLRAAVPA

SEQ ID NO: 804657 - protein, 21 aa, Mycobacterium
DTVLFSAFGRNWRWADRVCTE

SEQ ID NO: 804658 - protein, 18 aa, Mycobacterium
DTVLLLASGASEITPDAA

SEQ ID NO: 804659 - protein, 17 aa, Mycobacterium
DTVLWDVLCNQVGVAGI

SEQ ID NO: 804660 - protein, 23 aa, Mycobacterium
DTVMRIAELPKHLVIVGSGFVAA

SEQ ID NO: 804661 - protein, 24 aa, Mycobacterium
DTVPRGYRIVSRPGAVTRRAISML

SEQ ID NO: 804662 - protein, 24 aa, Mycobacterium
DTVPRGYRLVARPGAVSRRAISLL

SEQ ID NO: 804663 - protein, 18 aa, Mycobacterium
DTVRAFYGMLTRALDRPP

SEQ ID NO: 804664 - protein, 19 aa, Mycobacterium
DTVRRWIDSGTLESTKDEA

SEQ ID NO: 804665 - protein, 20 aa, Mycobacterium
DTVRRWINQGALEVSHDAAG

SEQ ID NO: 804666 - protein, 25 aa, Mycobacterium
DTVRVIRQPWWAPMVDMAEGPAVLI

SEQ ID NO: 804667 - protein, 19 aa, Mycobacterium
DTVSILSAAWTPSAPDTDE

SEQ ID NO: 804668 - protein, 27 aa, Mycobacterium
DTVTAGQPLLWLEAMKMEHTITAPADG

SEQ ID NO: 804669 - protein, 20 aa, Mycobacterium
DTVTTSWWKEQRGARIFVDF

SEQ ID NO: 804670 - protein, 20 aa, Mycobacterium
DTVVFDRGGYTYGGRIAALA

SEQ ID NO: 804671 - protein, 21 aa, Mycobacterium
DTVVFDRGGYTYGGRIAALAD

SEQ ID NO: 804672 - protein, 39 aa, Mycobacterium
DTVVIYGDKSNWWAAYALWVFTLFGHPDVRLLDGGRSLW

SEQ ID NO: 804673 - protein, 20 aa, Mycobacterium
DTVWGLLNVLLERTRYDPGN

SEQ ID NO: 804674 - protein, 20 aa, Mycobacterium
DTWCYFDALPDELTTAALPN

SEQ ID NO: 804675 - protein, 24 aa, Mycobacterium
DTWDGFPCFTAEICSPMLGVPFSG

SEQ ID NO: 804676 - protein, 23 aa, Mycobacterium
DTWDGFYCFAAELTSPMLEVPFS

SEQ ID NO: 804677 - protein, 28 aa, Mycobacterium
DTWKLLVNARWLPYVIAHGLLDELVPFP

SEQ ID NO: 804678 - protein, 17 aa, Mycobacterium
DTWLLRTAGGEDVRARA

SEQ ID NO: 804679 - protein, 17 aa, Mycobacterium
DTWQAAFNLIRTRGYEH

SEQ ID NO: 804680 - protein, 18 aa, Mycobacterium
DTWRLAVATAPHLLSKSV

SEQ ID NO: 804681 - protein, 19 aa, Mycobacterium
DTWTTAYLGLHDKPIVLLD

SEQ ID NO: 804682 - protein, 27 aa, Mycobacterium
DTYADTFDLPRFTPILVGGQPSTPRGE

SEQ ID NO: 804683 - protein, 17 aa, Mycobacterium
DTYAQEYQTFGAHMAAF

SEQ ID NO: 804684 - protein, 19 aa, Mycobacterium
DTYDGFPIRPLYTSRDDVG

SEQ ID NO: 804685 - protein, 24 aa, Mycobacterium
DTYGRFMRIRTFDCWMHEQDIRQA

SEQ ID NO: 804686 - protein, 22 aa, Mycobacterium
DTYLVHHPAALLGKPVERVVID

SEQ ID NO: 804687 - protein, 26 aa, Mycobacterium
DTYNKGDYGFFWITAVTTDGDIVVAN

SEQ ID NO: 804688 - protein, 17 aa, Mycobacterium
DTYRSWFEYTETGEILR

SEQ ID NO: 804689 - protein, 32 aa, Mycobacterium
DTYTGAELLGLRYLPPFPYFQQDASPNAFTVL

SEQ ID NO: 804690 - protein, 28 aa, Mycobacterium
DVAAAAIGLVDLLLAPGGDLVTVLIGAG

SEQ ID NO: 804691 - protein, 25 aa, Mycobacterium
DVAAALERRRPLIETLITGVASGRG

SEQ ID NO: 804692 - protein, 20 aa, Mycobacterium
DVAAAVFGGWLSYRSPDRHA

SEQ ID NO: 804693 - protein, 22 aa, Mycobacterium
DVAAKRIAWIKLLNGGQTCVAP

SEQ ID NO: 804694 - protein, 24 aa, Mycobacterium
DVAAKRIAWIKLLNGGQTCVAPDY

SEQ ID NO: 804695 - protein, 21 aa, Mycobacterium
DVAALARLGITEVAAVIGGSM

SEQ ID NO: 804696 - protein, 26 aa, Mycobacterium
DVAARIMHEPLILQLASGPSRRRRVR

SEQ ID NO: 804697 - protein, 23 aa, Mycobacterium
DVAARLGRLTKAEQWSGFGDFGF

SEQ ID NO: 804698 - protein, 22 aa, Mycobacterium
DVAARRIAWVKLLNSGQTCIAP

SEQ ID NO: 804699 - protein, 21 aa, Mycobacterium
DVAATLMRKLGNRVPGVLAGQ

SEQ ID NO: 804700 - protein, 20 aa, Mycobacterium
DVAAVLAWFEHYDALAVAKD

SEQ ID NO: 804701 - protein, 18 aa, Mycobacterium
DVAAWREYGLKVLGMVEG

SEQ ID NO: 804702 - protein, 24 aa, Mycobacterium
DVADAPWTPAQFAAGPTATVALAA

SEQ ID NO: 804703 - protein, 18 aa, Mycobacterium
DVADLAFQPKPVQRPHPP

SEQ ID NO: 804704 - protein, 22 aa, Mycobacterium
DVADPLPPHRYRLVNQGAGAPE

SEQ ID NO: 804705 - protein, 28 aa, Mycobacterium
DVAEGLYAIRDLAAPLVFPVVPSGHSDH

SEQ ID NO: 804706 - protein, 24 aa, Mycobacterium
DVAELLPELTLAQKWDLTANELAR

SEQ ID NO: 804707 - protein, 19 aa, Mycobacterium
DVAELVWLGERRPAAEHLS

SEQ ID NO: 804708 - protein, 25 aa, Mycobacterium
DVAEMTYLQWLRRYVELTIGEGNST

SEQ ID NO: 804709 - protein, 23 aa, Mycobacterium
DVAERILLNSKTRRPSVCNAAET

SEQ ID NO: 804710 - protein, 32 aa, Mycobacterium
DVAFANWKALGARFIALRPATQLHWTGHDHPD

SEQ ID NO: 804711 - protein, 25 aa, Mycobacterium
DVAGAKPWFAIGGIDGVRLPEVLAA

SEQ ID NO: 804712 - protein, 41 aa, Mycobacterium
DVAGLRRRVMVVLPFLTPTIASWWVGLVTPIPSGLARPLVE

SEQ ID NO: 804713 - protein, 24 aa, Mycobacterium
DVAGPALLLPLRATDTCAGVVVLL

SEQ ID NO: 804714 - protein, 21 aa, Mycobacterium
DVAGRAFALSAPVLLTTATAA

SEQ ID NO: 804715 - protein, 23 aa, Mycobacterium
DVAGSPWIDLLTQVPQVSDDDVD

SEQ ID NO: 804716 - protein, 29 aa, Mycobacterium
DVAGVDPLWLRRRVGMCFQRPTPFPGTVA

SEQ ID NO: 804717 - protein, 23 aa, Mycobacterium
DVAGVLSLRITPGASASATQSEL

SEQ ID NO: 804718 - protein, 17 aa, Mycobacterium
DVAHFLRKHDEPVLLAV

SEQ ID NO: 804719 - protein, 19 aa, Mycobacterium
DVAIVRLEQLAPLPKRRLA

SEQ ID NO: 804720 - protein, 17 aa, Mycobacterium
DVAKLSYYGLYALQHRG

SEQ ID NO: 804721 - protein, 22 aa, Mycobacterium
DVAKRFARMWRGDHAPRNEHGP

SEQ ID NO: 804722 - protein, 22 aa, Mycobacterium
DVALALHCPLGPIALAACLQID

SEQ ID NO: 804723 - protein, 18 aa, Mycobacterium
DVALALHELAIPTIAKVT

SEQ ID NO: 804724 - protein, 20 aa, Mycobacterium
DVALGEWFFAFPMGSHTDEP

SEQ ID NO: 804725 - protein, 18 aa, Mycobacterium
DVALHVIGAIGLITLGRS

SEQ ID NO: 804726 - protein, 23 aa, Mycobacterium
DVALIGFAGAPFTLASYLIEGGP

SEQ ID NO: 804727 - protein, 24 aa, Mycobacterium
DVALILGVPMDFRLGFGAVFGPQT

SEQ ID NO: 804728 - protein, 25 aa, Mycobacterium
DVALIVGVPMDFRLGFGGVFGPQTQ

SEQ ID NO: 804729 - protein, 23 aa, Mycobacterium
DVALIVGVPMDFRLGFGGVFGSQ

SEQ ID NO: 804730 - protein, 19 aa, Mycobacterium
DVALLDYRMPGMDGAQVAA

SEQ ID NO: 804731 - protein, 20 aa, Mycobacterium
DVALPLTYRFEPGAADDGVT

SEQ ID NO: 804732 - protein, 17 aa, Mycobacterium
DVALQRAIEQGWHPGPR

SEQ ID NO: 804733 - protein, 18 aa, Mycobacterium
DVALRRAWETFCYQVKAA

SEQ ID NO: 804734 - protein, 17 aa, Mycobacterium
DVALTKYHWVEKINHVH

SEQ ID NO: 804735 - protein, 19 aa, Mycobacterium
DVALVPRFSLSVTAETLAA

SEQ ID NO: 804736 - protein, 22 aa, Mycobacterium
DVAMVYYFFGNKEGLFNAAVLD

SEQ ID NO: 804737 - protein, 22 aa, Mycobacterium
DVAMVYYFFGNKEGLFTASTLT

SEQ ID NO: 804738 - protein, 31 aa, Mycobacterium
DVANPVAMMLSAAMLLRWLGERAGSGRALVG

SEQ ID NO: 804739 - protein, 22 aa, Mycobacterium
DVAPPPPAGAPAWRVQNDRYGP

SEQ ID NO: 804740 - protein, 20 aa, Mycobacterium
DVAPPPWVAPGEWWALIRVG

SEQ ID NO: 804741 - protein, 27 aa, Mycobacterium
DVAPRPGRIWLQITAYDGRRPGFGDDA

SEQ ID NO: 804742 - protein, 25 aa, Mycobacterium
DVAPSTLRWWEKQGVLSSPAQHSGR

SEQ ID NO: 804743 - protein, 18 aa, Mycobacterium
DVAQLPGAVRRLAPGRRY

SEQ ID NO: 804744 - protein, 28 aa, Mycobacterium
DVAQLYDGFTYLTLAWLEALGVCGDGEA

SEQ ID NO: 804745 - protein, 20 aa, Mycobacterium
DVAQRLLTRNGWRSTTLAQI

SEQ ID NO: 804746 - protein, 17 aa, Mycobacterium
DVARLIRQRIFDGTYRA

SEQ ID NO: 804747 - protein, 24 aa, Mycobacterium
DVARRPDFLRLLRGGTRGALPRQQ

SEQ ID NO: 804748 - protein, 27 aa, Mycobacterium
DVARVHVRSWQWAFRGLISQDYLDNLS

SEQ ID NO: 804749 - protein, 28 aa, Mycobacterium
DVATDHQLQRWLLPTVRGEKHEAYAITE

SEQ ID NO: 804750 - protein, 21 aa, Mycobacterium
DVATLLPHYAGGLVAAEVEVL

SEQ ID NO: 804751 - protein, 23 aa, Mycobacterium
DVATNLLVYLGPGATLVGGPFGQ

SEQ ID NO: 804752 - protein, 20 aa, Mycobacterium
DVAVMLGLAYVLATEGLADR

SEQ ID NO: 804753 - protein, 22 aa, Mycobacterium
DVAVRRLWVSAGPAPSAVAAMP

SEQ ID NO: 804754 - protein, 20 aa, Mycobacterium
DVAVTILRLANLIGPGMDTA

SEQ ID NO: 804755 - protein, 22 aa, Mycobacterium
DVAVYLCGPPPMVEAVRTHLTN

SEQ ID NO: 804756 - protein, 19 aa, Mycobacterium
DVCDIDHTVPFPLGPTHPS

SEQ ID NO: 804757 - protein, 20 aa, Mycobacterium
DVCFTWRFGDAPACRALFAS

SEQ ID NO: 804758 - protein, 24 aa, Mycobacterium
DVCLGQHVMPFPAGTIGVHAGPFM

SEQ ID NO: 804759 - protein, 28 aa, Mycobacterium
DVDAALRLMKPLRILIKPKVYGIENVPT

SEQ ID NO: 804760 - protein, 27 aa, Mycobacterium
DVDAATWIIVQLLGSTIRYVVDEPPIA

SEQ ID NO: 804761 - protein, 21 aa, Mycobacterium
DVDAAWLLDTPTAYVECAQAC

SEQ ID NO: 804762 - protein, 27 aa, Mycobacterium
DVDAESLWHVDYFMRVMAGAAIEANQR

SEQ ID NO: 804763 - protein, 18 aa, Mycobacterium
DVDALLDLAKTGPVAGLP

SEQ ID NO: 804764 - protein, 24 aa, Mycobacterium
DVDALNVIAVRYLPDARRHGALPD

SEQ ID NO: 804765 - protein, 22 aa, Mycobacterium
DVDALVEMLAPDAVWTSDGGGK

SEQ ID NO: 804766 - protein, 24 aa, Mycobacterium
DVDDALWRRFKAAQDAFFTARNAA

SEQ ID NO: 804767 - protein, 24 aa, Mycobacterium
DVDDDGVVVLLKTAVPDSERVRVE

SEQ ID NO: 804768 - protein, 27 aa, Mycobacterium
DVDDEFFVIVRPAPAGTRLLLSDATAA

SEQ ID NO: 804769 - protein, 25 aa, Mycobacterium
DVDDLNVIAIRYLPEARVLAPPDDA

SEQ ID NO: 804770 - protein, 27 aa, Mycobacterium
DVDDPLRIVLVAPPYFDIPPKGYGGTE

SEQ ID NO: 804771 - protein, 23 aa, Mycobacterium
DVDDPLYVLAGRSEGYVPYYDAY

SEQ ID NO: 804772 - protein, 38 aa, Mycobacterium
DVDDPPVLLIMGLGAQLLLWRTAFCQKLIDQGLRVIRY

SEQ ID NO: 804773 - protein, 31 aa, Mycobacterium
DVDEIQAQAILDMQLRRLAALERQKIIDDLA

SEQ ID NO: 804774 - protein, 25 aa, Mycobacterium
DVDFDWAALPFYYVPGEPFTTHFCN

SEQ ID NO: 804775 - protein, 34 aa, Mycobacterium
DVDFRSIVQWLHAATLFLLAPSWRYRPAADKREF

SEQ ID NO: 804776 - protein, 26 aa, Mycobacterium
DVDGDIPLLLDMPPPYTARALTDSSC

SEQ ID NO: 804777 - protein, 24 aa, Mycobacterium
DVDGFWAAVLHRTAERRAGSMLAL

SEQ ID NO: 804778 - protein, 25 aa, Mycobacterium
DVDGYGIHPALLDAALQPLAAAFTD

SEQ ID NO: 804779 - protein, 25 aa, Mycobacterium
DVDKPKLVFIFDEAHLLFADASKAF

SEQ ID NO: 804780 - protein, 23 aa, Mycobacterium
DVDKYLITPVVDVLAALAESNAP

SEQ ID NO: 804781 - protein, 24 aa, Mycobacterium
DVDLALLYDGFTFNCVSWLEALGF

SEQ ID NO: 804782 - protein, 25 aa, Mycobacterium
DVDLEYHIRPWRLPAPGGRRELDEA

SEQ ID NO: 804783 - protein, 18 aa, Mycobacterium
DVDLIDEAVRRFHLADAR

SEQ ID NO: 804784 - protein, 23 aa, Mycobacterium
DVDLRRSYPFYGQLHQGGIATPP

SEQ ID NO: 804785 - protein, 35 aa, Mycobacterium
DVDLTVFDIMLLAHGWALKHWHFGPLYTRDEYIRL

SEQ ID NO: 804786 - protein, 34 aa, Mycobacterium
DVDLTVFDIMLLAHGWALKHWHFGPTYTLDEYIA

SEQ ID NO: 804787 - protein, 18 aa, Mycobacterium
DVDMRCLLIIGSSQTQWY

SEQ ID NO: 804788 - protein, 29 aa, Mycobacterium
DVDPALRRPGRFDRMIFVGLPDAEARAGI

SEQ ID NO: 804789 - protein, 24 aa, Mycobacterium
DVDPDHTIPAYQYARTITYTVDLI

SEQ ID NO: 804790 - protein, 39 aa, Mycobacterium
DVDPIDVYRILRVTNPSPYMYLLQIPNSAGAIDFSIVGS

SEQ ID NO: 804791 - protein, 37 aa, Mycobacterium
DVDPLEVYRILRVTNPSPYMYLLHAPDSEGGTAFSIV

SEQ ID NO: 804792 - protein, 23 aa, Mycobacterium
DVDPMLFDRSYFLEPDSKSSKSY

SEQ ID NO: 804793 - protein, 18 aa, Mycobacterium
DVDPNIPSLPFLSTVTDP

SEQ ID NO: 804794 - protein, 25 aa, Mycobacterium
DVDPRVPLGQALRDALLAFNTFGES

SEQ ID NO: 804795 - protein, 24 aa, Mycobacterium
DVDQLARSMLLLLGDHHDHQESSE

SEQ ID NO: 804796 - protein, 17 aa, Mycobacterium
DVDQPSVIGLRRQLYDD

SEQ ID NO: 804797 - protein, 23 aa, Mycobacterium
DVDRIFQDVFRSPAGPFRMMDQV

SEQ ID NO: 804798 - protein, 18 aa, Mycobacterium
DVDRMAALAPAGYTLATD

SEQ ID NO: 804799 - protein, 25 aa, Mycobacterium
DVDRPLWECWIIEGLNDNRWAILLK

SEQ ID NO: 804800 - protein, 24 aa, Mycobacterium
DVDRRLSLLIGWTGDHLAETEVND

SEQ ID NO: 804801 - protein, 24 aa, Mycobacterium
DVDSPWVWVLDPVDGTFNYAAGSP

SEQ ID NO: 804802 - protein, 18 aa, Mycobacterium
DVDTPWKKLPAAAKKAIL

SEQ ID NO: 804803 - protein, 26 aa, Mycobacterium
DVDTYRFHPALIDGAFQTLFGAPFSG

SEQ ID NO: 804804 - protein, 20 aa, Mycobacterium
DVDVELLLNERLRMGTFDDN

SEQ ID NO: 804805 - protein, 33 aa, Mycobacterium
DVDVLWIQFHSAMTDIWLGRHGDAARLAEDMLL

SEQ ID NO: 804806 - protein, 38 aa, Mycobacterium
DVDVRGASWLPLYHDMGLLMLMFPLCGGRMTLMSPLSF

SEQ ID NO: 804807 - protein, 21 aa, Mycobacterium
DVDWRKRQLLQLVKLMEENEA

SEQ ID NO: 804808 - protein, 17 aa, Mycobacterium
DVDYCCMPLFHGNAIMA

SEQ ID NO: 804809 - protein, 25 aa, Mycobacterium
DVDYFCVGPCWPTPTKPGRAAPGLD

SEQ ID NO: 804810 - protein, 25 aa, Mycobacterium
DVEADLREWLLGQARYFGVERNAAL

SEQ ID NO: 804811 - protein, 22 aa, Mycobacterium
DVEALEALGVLRRVVGGAIALQ

SEQ ID NO: 804812 - protein, 19 aa, Mycobacterium
DVEALMAMLAPDAAWMADS

SEQ ID NO: 804813 - protein, 22 aa, Mycobacterium
DVEALMAMLAPDATWLADSGGK

SEQ ID NO: 804814 - protein, 22 aa, Mycobacterium
DVEARLDLTGRPRFVTARKKGG

SEQ ID NO: 804815 - protein, 22 aa, Mycobacterium
DVEAVLPKVRPIVQAVAERGAE

SEQ ID NO: 804816 - protein, 22 aa, Mycobacterium
DVEAWVAGYFDYLDRNGAFVIR

SEQ ID NO: 804817 - protein, 23 aa, Mycobacterium
DVEDPLYVLAGRDEGYVPFYDEY

SEQ ID NO: 804818 - protein, 19 aa, Mycobacterium
DVEFDGEWKRPARAVLVFT

SEQ ID NO: 804819 - protein, 23 aa, Mycobacterium
DVEHPLLGPTGAAAVFGPQKGAD

SEQ ID NO: 804820 - protein, 17 aa, Mycobacterium
DVEIWRHKTRIDNPLLV

SEQ ID NO: 804821 - protein, 23 aa, Mycobacterium
DVELAFLGLIPQSITATQLLYRT

SEQ ID NO: 804822 - protein, 27 aa, Mycobacterium
DVELIGRIGWTCRDIWWAATQDPRAWA

SEQ ID NO: 804823 - protein, 26 aa, Mycobacterium
DVELIGRIGWTCRDVWWAATQDPRAW

SEQ ID NO: 804824 - protein, 18 aa, Mycobacterium
DVELLALAQLIGAAGTLV

SEQ ID NO: 804825 - protein, 19 aa, Mycobacterium
DVELLALAQLIGAAGTLVA

SEQ ID NO: 804826 - protein, 26 aa, Mycobacterium
DVENFFRARGGPIMIKALAGGGGRGM

SEQ ID NO: 804827 - protein, 30 aa, Mycobacterium
DVERHLRVILHGWLALTFEICRQRIIDPTT

SEQ ID NO: 804828 - protein, 21 aa, Mycobacterium
DVERLVLSRAVAWHCEDRVMR

SEQ ID NO: 804829 - protein, 18 aa, Mycobacterium
DVERQRVTLRPDPRGRQA

SEQ ID NO: 804830 - protein, 26 aa, Mycobacterium
DVERRFRAWIRWNAAIMVHRAQRPGV

SEQ ID NO: 804831 - protein, 23 aa, Mycobacterium
DVERRGFLALIRDAHLEATGGGP

SEQ ID NO: 804832 - protein, 23 aa, Mycobacterium
DVERRLLTVLNNPTTSPFGNPIP

SEQ ID NO: 804833 - protein, 18 aa, Mycobacterium
DVERWPEWTASVTSLAAL

SEQ ID NO: 804834 - protein, 22 aa, Mycobacterium
DVESVLPKVRPIVQAVAERGAE

SEQ ID NO: 804835 - protein, 25 aa, Mycobacterium
DVESVVLALYRYLGRTPSRLVGVAL

SEQ ID NO: 804836 - protein, 22 aa, Mycobacterium
DVETAARWFGLLSPGADADRSV

SEQ ID NO: 804837 - protein, 19 aa, Mycobacterium
DVETLLRRIPTATHGIVNE

SEQ ID NO: 804838 - protein, 18 aa, Mycobacterium
DVETTRLLLGAVPAAFHA

SEQ ID NO: 804839 - protein, 25 aa, Mycobacterium
DVEVFPTLRSIRFALDGEALRRLAA

SEQ ID NO: 804840 - protein, 19 aa, Mycobacterium
DVEVGDWLRFGISHPCTTF

SEQ ID NO: 804841 - protein, 25 aa, Mycobacterium
DVFAGVLAAHWPPDGASPAQRLRAL

SEQ ID NO: 804842 - protein, 23 aa, Mycobacterium
DVFAGVLAANWPPNPGSADERRL

SEQ ID NO: 804843 - protein, 17 aa, Mycobacterium
DVFASRLPDYFPRPLRE

SEQ ID NO: 804844 - protein, 24 aa, Mycobacterium
DVFASRLPSYFPKPLRERFAPEIR

SEQ ID NO: 804845 - protein, 18 aa, Mycobacterium
DVFAVHRIDEQLTKAMDR

SEQ ID NO: 804846 - protein, 18 aa, Mycobacterium
DVFCRFSTVLGSRGSADT

SEQ ID NO: 804847 - protein, 24 aa, Mycobacterium
DVFCSVVRRVALPDAFFAIDGMIE

SEQ ID NO: 804848 - protein, 25 aa, Mycobacterium
DVFCSVVRRVALPDAFFAIDGQTET

SEQ ID NO: 804849 - protein, 26 aa, Mycobacterium
DVFCSVVRRVALPDAFFALDGQTETF

SEQ ID NO: 804850 - protein, 24 aa, Mycobacterium
DVFCSVVRRVALPDSFFAIDGQIE

SEQ ID NO: 804851 - protein, 25 aa, Mycobacterium
DVFCSVVRRVALPDSFFAIDGQLET

SEQ ID NO: 804852 - protein, 24 aa, Mycobacterium
DVFCSVVRRVALPDSFFAVDGQIE

SEQ ID NO: 804853 - protein, 24 aa, Mycobacterium
DVFCSVVRRVVLPDSFFAIDGQTE

SEQ ID NO: 804854 - protein, 23 aa, Mycobacterium
DVFDAFVDRLAPGGALVVCVDDP

SEQ ID NO: 804855 - protein, 24 aa, Mycobacterium
DVFDLNVKALWACSLAVGAHMRER

SEQ ID NO: 804856 - protein, 19 aa, Mycobacterium
DVFDVILTAQRAAAAAGVV

SEQ ID NO: 804857 - protein, 18 aa, Mycobacterium
DVFFLHLSGNRSLVGDRM

SEQ ID NO: 804858 - protein, 23 aa, Mycobacterium
DVFGNGMLLSRHIRLIAAFDHRH

SEQ ID NO: 804859 - protein, 27 aa, Mycobacterium
DVFIHRLRKYIGAYLAVLGHTDALTFT

SEQ ID NO: 804860 - protein, 25 aa, Mycobacterium
DVFIHSMRAAAIAKLGFDYAAVADL

SEQ ID NO: 804861 - protein, 21 aa, Mycobacterium
DVFISYLRRKLERDGVPRVIH

SEQ ID NO: 804862 - protein, 17 aa, Mycobacterium
DVFLQMRNQSHTLVWEG

SEQ ID NO: 804863 - protein, 20 aa, Mycobacterium
DVFLTNWLPGALERARLTVA

SEQ ID NO: 804864 - protein, 20 aa, Mycobacterium
DVFLTNWLPGALERARLTVD

SEQ ID NO: 804865 - protein, 20 aa, Mycobacterium
DVFLTNWLPGALERARLTVE

SEQ ID NO: 804866 - protein, 21 aa, Mycobacterium
DVFLTSFLPAHRNKFGIDVDD

SEQ ID NO: 804867 - protein, 18 aa, Mycobacterium
DVFPFLRDWFSARLDECP

SEQ ID NO: 804868 - protein, 19 aa, Mycobacterium
DVFTLGPGSMYLLDGNERH

SEQ ID NO: 804869 - protein, 17 aa, Mycobacterium
DVFVHYSEIQGGGYRSL

SEQ ID NO: 804870 - protein, 17 aa, Mycobacterium
DVFVHYSEISGSGFRSL

SEQ ID NO: 804871 - protein, 25 aa, Mycobacterium
DVFVRNLLHLFENPKTRADLRHGRL

SEQ ID NO: 804872 - protein, 24 aa, Mycobacterium
DVFVYHGYSLMHLCGVWVKATPAF

SEQ ID NO: 804873 - protein, 17 aa, Mycobacterium
DVFYWAHATFFKSTLLA

SEQ ID NO: 804874 - protein, 17 aa, Mycobacterium
DVFYWAHATFFVGTIHV

SEQ ID NO: 804875 - protein, 17 aa, Mycobacterium
DVFYWAHATFFVGTLHV

SEQ ID NO: 804876 - protein, 39 aa, Mycobacterium
DVGADGLFVGRPMWLPLDDAGIVRFYRDITEALPGVPVV

SEQ ID NO: 804877 - protein, 25 aa, Mycobacterium
DVGARLRLTRALPLRIGDIGLLRDP

SEQ ID NO: 804878 - protein, 26 aa, Mycobacterium
DVGDITLGERLILSSGFVAVTVVVAR

SEQ ID NO: 804879 - protein, 26 aa, Mycobacterium
DVGDITLGERLILSSGFVAVTVVVER

SEQ ID NO: 804880 - protein, 21 aa, Mycobacterium
DVGDLARSMLLLHGIHDDDDH

SEQ ID NO: 804881 - protein, 18 aa, Mycobacterium
DVGDPLLQLGRPVDLHRG

SEQ ID NO: 804882 - protein, 24 aa, Mycobacterium
DVGERPAILMPLTSDQHTLGVIVV

SEQ ID NO: 804883 - protein, 25 aa, Mycobacterium
DVGERPAIVIPLIADGAVLGVIAVA

SEQ ID NO: 804884 - protein, 23 aa, Mycobacterium
DVGFRMPSVWLADGHRKVAPVYL

SEQ ID NO: 804885 - protein, 19 aa, Mycobacterium
DVGFRMPSVWLAEGHSAVA

SEQ ID NO: 804886 - protein, 26 aa, Mycobacterium
DVGGRKISLWTPPGVYTVLDKGNPVV

SEQ ID NO: 804887 - protein, 19 aa, Mycobacterium
DVGGTFILSRTPGLLGVHA

SEQ ID NO: 804888 - protein, 19 aa, Mycobacterium
DVGLLSTVPLAVLALGGEA

SEQ ID NO: 804889 - protein, 18 aa, Mycobacterium
DVGLPVREFRRHGRDEAV

SEQ ID NO: 804890 - protein, 22 aa, Mycobacterium
DVGLRVPKILDYAAMAGGGYAA

SEQ ID NO: 804891 - protein, 22 aa, Mycobacterium
DVGPLDLRRLSMPLVAIVTEPQ

SEQ ID NO: 804892 - protein, 17 aa, Mycobacterium
DVGPLFYEPTVLTDVTH

SEQ ID NO: 804893 - protein, 18 aa, Mycobacterium
DVGPWFRWASVGVDSAAM

SEQ ID NO: 804894 - protein, 24 aa, Mycobacterium
DVGQRLVELVQLYVPADAKPKPHV

SEQ ID NO: 804895 - protein, 19 aa, Mycobacterium
DVGRLLLRCADRPGLVAAI

SEQ ID NO: 804896 - protein, 20 aa, Mycobacterium
DVGRLRWKPYNKPGSRDTAT

SEQ ID NO: 804897 - protein, 24 aa, Mycobacterium
DVGRRRWWPLARALNTDRLEQMYA

SEQ ID NO: 804898 - protein, 18 aa, Mycobacterium
DVGSFACAPLLDGYPRPG

SEQ ID NO: 804899 - protein, 23 aa, Mycobacterium
DVGSGPRLWIVTRGAQQVSFGES

SEQ ID NO: 804900 - protein, 27 aa, Mycobacterium
DVGSLARLPLILNDGHLRELALTGRDI

SEQ ID NO: 804901 - protein, 20 aa, Mycobacterium
DVGSWWTCYPGRAEYFTHWG

SEQ ID NO: 804902 - protein, 18 aa, Mycobacterium
DVGSWWTCYPGRPDYFTH

SEQ ID NO: 804903 - protein, 40 aa, Mycobacterium
DVGSYPTPYPVLTTAAIGMFFPGPYRVPKASFNYKTVFSN

SEQ ID NO: 804904 - protein, 25 aa, Mycobacterium
DVGTSWALLPQIYTNNRPTRPGSID

SEQ ID NO: 804905 - protein, 21 aa, Mycobacterium
DVGVAGIWRLLERVDEILDHD

SEQ ID NO: 804906 - protein, 21 aa, Mycobacterium
DVGWFQLADKHVVLLSGAKAN

SEQ ID NO: 804907 - protein, 17 aa, Mycobacterium
DVGWFQLADKQVVLLSG

SEQ ID NO: 804908 - protein, 28 aa, Mycobacterium
DVGWTLRLLSAPGSELLLPLIAPSPVVR

SEQ ID NO: 804909 - protein, 29 aa, Mycobacterium
DVGWVVGHSYIVYAPLMLGATTVLYEGKP

SEQ ID NO: 804910 - protein, 46 aa, Mycobacterium
DVGYGLLRVTRDKKWKPFNLGNLLYNTLLMLLFEWGVGTQHLELGK

SEQ ID NO: 804911 - protein, 27 aa, Mycobacterium
DVHARRYELLDCRLTDAGFTWYEVSNW

SEQ ID NO: 804912 - protein, 22 aa, Mycobacterium
DVHAYIEEKIFYPQLLKRGGED

SEQ ID NO: 804913 - protein, 25 aa, Mycobacterium
DVHDEGDYGFFWVTAVTTDGEIVVA

SEQ ID NO: 804914 - protein, 24 aa, Mycobacterium
DVHDVFVLQIAGSKRWIVHEPVHA

SEQ ID NO: 804915 - protein, 19 aa, Mycobacterium
DVHELIIIGSGPAGYTAAV

SEQ ID NO: 804916 - protein, 17 aa, Mycobacterium
DVHLGGPALFGPIGMIV

SEQ ID NO: 804917 - protein, 25 aa, Mycobacterium
DVHLRGAFHVMRPAWRIMREQRYGR

SEQ ID NO: 804918 - protein, 24 aa, Mycobacterium
DVHRAIPVIRAFTHFALLANVAED

SEQ ID NO: 804919 - protein, 23 aa, Mycobacterium
DVHRKLLSRMFTPRKIAALEPMI

SEQ ID NO: 804920 - protein, 17 aa, Mycobacterium
DVHTMKYFGQEMVAWRA

SEQ ID NO: 804921 - protein, 22 aa, Mycobacterium
DVHVGLPMRCVFALTAMGFLPQ

SEQ ID NO: 804922 - protein, 17 aa, Mycobacterium
DVHYFMPVRVTTALGAG

SEQ ID NO: 804923 - protein, 27 aa, Mycobacterium
DVIAELAAMMPMRVIGMLLGIPESEQV

SEQ ID NO: 804924 - protein, 22 aa, Mycobacterium
DVIAFLKRWLLVSDERARHMLK

SEQ ID NO: 804925 - protein, 21 aa, Mycobacterium
DVIAQFLPQSPFVTKLGIVAD

SEQ ID NO: 804926 - protein, 27 aa, Mycobacterium
DVICAKGFPSYFLIVADLIGYAKSVGI

SEQ ID NO: 804927 - protein, 24 aa, Mycobacterium
DVIFGYDHFHWPAGTLSSQGVVLD

SEQ ID NO: 804928 - protein, 18 aa, Mycobacterium
DVIGARFAAWPQISELIQ

SEQ ID NO: 804929 - protein, 25 aa, Mycobacterium
DVIGARFAVWPQISELLEKLFAGQS

SEQ ID NO: 804930 - protein, 19 aa, Mycobacterium
DVIGELLHRLPVPRTGASP

SEQ ID NO: 804931 - protein, 21 aa, Mycobacterium
DVIKHFFVHYKDLEPGKFVKA

SEQ ID NO: 804932 - protein, 18 aa, Mycobacterium
DVILPRLDEHVPQSTIER

SEQ ID NO: 804933 - protein, 20 aa, Mycobacterium
DVINHFKKGFAPSGGGSVVP

SEQ ID NO: 804934 - protein, 23 aa, Mycobacterium
DVIPLIRALYPHAYRLTREHADA

SEQ ID NO: 804935 - protein, 24 aa, Mycobacterium
DVIQNHLLQLLALTALEEPVSFSP

SEQ ID NO: 804936 - protein, 19 aa, Mycobacterium
DVIRPGVPWMLTRTHARLA

SEQ ID NO: 804937 - protein, 28 aa, Mycobacterium
DVIRRKAGLPPATYFSGGKLQWILDNVD

SEQ ID NO: 804938 - protein, 20 aa, Mycobacterium
DVIRRYHFAGDPRAFAILGR

SEQ ID NO: 804939 - protein, 20 aa, Mycobacterium
DVIVLGLARGGIPVAWEVAA

SEQ ID NO: 804940 - protein, 17 aa, Mycobacterium
DVIVRLTGARYQDIFSV

SEQ ID NO: 804941 - protein, 22 aa, Mycobacterium
DVKGKAKEAIGTVAGRDDMVRE

SEQ ID NO: 804942 - protein, 37 aa, Mycobacterium
DVKLEMPPLPVWFTGRDPVLRFLAARAFAKAGDIAMI

SEQ ID NO: 804943 - protein, 24 aa, Mycobacterium
DVKLGRLAAILRDKRIPLELCPSS

SEQ ID NO: 804944 - protein, 23 aa, Mycobacterium
DVKLLAETIGVDKILFGSDWPHG

SEQ ID NO: 804945 - protein, 39 aa, Mycobacterium
DVKLLARLFGLPYFPITPLFPLAGPMGLVPLPSKWHIAF

SEQ ID NO: 804946 - protein, 22 aa, Mycobacterium
DVKLPRELVLIGKQFLYVERYM

SEQ ID NO: 804947 - protein, 42 aa, Mycobacterium
DVKLPRELVLIGKQFLYVERYMKLLAPKWQMMSDPALTGYFA

SEQ ID NO: 804948 - protein, 35 aa, Mycobacterium
DVKLPRELVLIGKQFLYVERYMKLLAPNWQMMSDP

SEQ ID NO: 804949 - protein, 40 aa, Mycobacterium
DVKLPRELVLIGKQFLYVERYMKLLAPRWQMMDDPELKGY

SEQ ID NO: 804950 - protein, 39 aa, Mycobacterium
DVKPLARLLGLPYFPITPLFPWAGPAGLIPLPSKWHIAF

SEQ ID NO: 804951 - protein, 17 aa, Mycobacterium
DVKPLLRKLGRVNVTTK

SEQ ID NO: 804952 - protein, 29 aa, Mycobacterium
DVLAAGTAWPVRPLRRPVLALPDGTPGIE

SEQ ID NO: 804953 - protein, 18 aa, Mycobacterium
DVLAIRPPRAPLTEAHFS

SEQ ID NO: 804954 - protein, 19 aa, Mycobacterium
DVLARRCPNWMRLSEPKLE

SEQ ID NO: 804955 - protein, 17 aa, Mycobacterium
DVLARWPVPGPDDDKYT

SEQ ID NO: 804956 - protein, 25 aa, Mycobacterium
DVLARYVPVLNDLRMRYLDDEDRTG

SEQ ID NO: 804957 - protein, 28 aa, Mycobacterium
DVLAVELSSFQLYWAPSLRPEAGVVLNI

SEQ ID NO: 804958 - protein, 23 aa, Mycobacterium
DVLDALSVWAPKQSVTAYDAVAA

SEQ ID NO: 804959 - protein, 17 aa, Mycobacterium
DVLDFWSMIKPELPDVK

SEQ ID NO: 804960 - protein, 18 aa, Mycobacterium
DVLDLCDVLWDPHRADKW

SEQ ID NO: 804961 - protein, 28 aa, Mycobacterium
DVLDRYVPVLTDLRLRYLDNHDFHGDIV

SEQ ID NO: 804962 - protein, 17 aa, Mycobacterium
DVLELEPALRPAAERRR

SEQ ID NO: 804963 - protein, 19 aa, Mycobacterium
DVLERMIIFQDIQAGVMVS

SEQ ID NO: 804964 - protein, 25 aa, Mycobacterium
DVLETRLALELWSAREAAYRSTDDD

SEQ ID NO: 804965 - protein, 18 aa, Mycobacterium
DVLFIGLAATVPAPRRSA

SEQ ID NO: 804966 - protein, 17 aa, Mycobacterium
DVLFLEWTADAGHHRVD

SEQ ID NO: 804967 - protein, 21 aa, Mycobacterium
DVLGAEFIMFASDYPHWDGEW

SEQ ID NO: 804968 - protein, 28 aa, Mycobacterium
DVLGAHLGPYCWPAAIKMIESGALPMDE

SEQ ID NO: 804969 - protein, 24 aa, Mycobacterium
DVLGAWFAVLCWNNNPRKILGEPA

SEQ ID NO: 804970 - protein, 20 aa, Mycobacterium
DVLGDWFAVLCWNNNPRKIL

SEQ ID NO: 804971 - protein, 23 aa, Mycobacterium
DVLGERWTLLILRELVGGARRYG

SEQ ID NO: 804972 - protein, 20 aa, Mycobacterium
DVLGILLSAIDSRRAVQFPH

SEQ ID NO: 804973 - protein, 24 aa, Mycobacterium
DVLGLLSPVLLFVPPEPPDVVLVV

SEQ ID NO: 804974 - protein, 19 aa, Mycobacterium
DVLGRLQEGFDGREKEIGA

SEQ ID NO: 804975 - protein, 17 aa, Mycobacterium
DVLGSPRRWAVLAYPRV

SEQ ID NO: 804976 - protein, 26 aa, Mycobacterium
DVLGTPLIPVIGHPGASLGAAVIAAV

SEQ ID NO: 804977 - protein, 17 aa, Mycobacterium
DVLGTRGAGAPWANYRL

SEQ ID NO: 804978 - protein, 18 aa, Mycobacterium
DVLGYWVTSQAPPVMQIC

SEQ ID NO: 804979 - protein, 18 aa, Mycobacterium
DVLHVPDHLGGSAPFPVM

SEQ ID NO: 804980 - protein, 20 aa, Mycobacterium
DVLITSWVTNFAADPAPLQV

SEQ ID NO: 804981 - protein, 17 aa, Mycobacterium
DVLKAERRKLRIRSGNA

SEQ ID NO: 804982 - protein, 17 aa, Mycobacterium
DVLKIEILQAIPRVPYG

SEQ ID NO: 804983 - protein, 24 aa, Mycobacterium
DVLKPLLDELGLVGYPKTSGGRGV

SEQ ID NO: 804984 - protein, 20 aa, Mycobacterium
DVLLAFTDLAEAIGDCPRGC

SEQ ID NO: 804985 - protein, 20 aa, Mycobacterium
DVLLAPTLREAWAVIAPMLA

SEQ ID NO: 804986 - protein, 25 aa, Mycobacterium
DVLLDMYRRCRALLMPGVEDFGIVP

SEQ ID NO: 804987 - protein, 21 aa, Mycobacterium
DVLLDPFRPGVCERIGIGPEE

SEQ ID NO: 804988 - protein, 24 aa, Mycobacterium
DVLLGKCLTLWAALIGAVGLEVFG

SEQ ID NO: 804989 - protein, 28 aa, Mycobacterium
DVLLHTLPMFHCNGWGWPYAATGMGARH

SEQ ID NO: 804990 - protein, 21 aa, Mycobacterium
DVLLKVRLRQGLPVGLLNSEE

SEQ ID NO: 804991 - protein, 17 aa, Mycobacterium
DVLLLPAASDVIPATAD

SEQ ID NO: 804992 - protein, 18 aa, Mycobacterium
DVLLPGHGDVWRGPIREA

SEQ ID NO: 804993 - protein, 17 aa, Mycobacterium
DVLLTQLEAKLGLDKTI

SEQ ID NO: 804994 - protein, 18 aa, Mycobacterium
DVLLVGHGHFSRALMTRW

SEQ ID NO: 804995 - protein, 19 aa, Mycobacterium
DVLNLLHLLYSMVTVSFPV

SEQ ID NO: 804996 - protein, 18 aa, Mycobacterium
DVLPGFWQRTIDLGPDPD

SEQ ID NO: 804997 - protein, 27 aa, Mycobacterium
DVLPLTPLQQGLLFQAGFAEAAGAEAA

SEQ ID NO: 804998 - protein, 23 aa, Mycobacterium
DVLPPEWNLDFAAALTRLLTATC

SEQ ID NO: 804999 - protein, 27 aa, Mycobacterium
DVLPSPTNWWSLTPGNYTTILKQSTSV

SEQ ID NO: 805000 - protein, 27 aa, Mycobacterium
DVLQAQCTFSWPPQMDLPGYKPNTKPH

SEQ ID NO: 805001 - protein, 18 aa, Mycobacterium
DVLQCYLELVLDGLVARL

SEQ ID NO: 805002 - protein, 19 aa, Mycobacterium
DVLRAWGKLGYPRRAKRLH

SEQ ID NO: 805003 - protein, 18 aa, Mycobacterium
DVLRKPRNILTFSHGNHH

SEQ ID NO: 805004 - protein, 19 aa, Mycobacterium
DVLRPLLDELGLVGYPKTS

SEQ ID NO: 805005 - protein, 24 aa, Mycobacterium
DVLRPLLEELGLVGYPKTSGGRGI

SEQ ID NO: 805006 - protein, 18 aa, Mycobacterium
DVLRRKILAHGWAVQYVG

SEQ ID NO: 805007 - protein, 17 aa, Mycobacterium
DVLRRKSGALPDLVHTH

SEQ ID NO: 805008 - protein, 18 aa, Mycobacterium
DVLRRKSGALPDLVHTHP

SEQ ID NO: 805009 - protein, 29 aa, Mycobacterium
DVLRRRGGTAAFLVWGDPSLYDSTIRVVE

SEQ ID NO: 805010 - protein, 17 aa, Mycobacterium
DVLRRWLTANGYDVAFI

SEQ ID NO: 805011 - protein, 24 aa, Mycobacterium
DVLRRYPMVVCPEMNLGQLSLLLR

SEQ ID NO: 805012 - protein, 21 aa, Mycobacterium
DVLRVHLDTARYQLLVQYPNV

SEQ ID NO: 805013 - protein, 24 aa, Mycobacterium
DVLSARFCLLATGPLSAALRPNFR

SEQ ID NO: 805014 - protein, 18 aa, Mycobacterium
DVLSILAFTFTMVTGGND

SEQ ID NO: 805015 - protein, 20 aa, Mycobacterium
DVLTIERFAHLIGGARMGTG

SEQ ID NO: 805016 - protein, 18 aa, Mycobacterium
DVLTIFTDRTWAKNLRDG

SEQ ID NO: 805017 - protein, 19 aa, Mycobacterium
DVLTNVLVSQLPPGPAYYP

SEQ ID NO: 805018 - protein, 19 aa, Mycobacterium
DVLTRLLGMRRVYDTLLGQ

SEQ ID NO: 805019 - protein, 24 aa, Mycobacterium
DVLTSFVALFGEGFVASAGGVPAA

SEQ ID NO: 805020 - protein, 24 aa, Mycobacterium
DVLVAFGRYPAFEGRLPALGTDFA

SEQ ID NO: 805021 - protein, 18 aa, Mycobacterium
DVLVFGLARGGVPVAWEI

SEQ ID NO: 805022 - protein, 20 aa, Mycobacterium
DVLVFGLARGGVPVAWEVAA

SEQ ID NO: 805023 - protein, 22 aa, Mycobacterium
DVLVGLVRQYAPKVSLIVTSHQ

SEQ ID NO: 805024 - protein, 17 aa, Mycobacterium
DVLVIGFGMGGGCAAVS

SEQ ID NO: 805025 - protein, 20 aa, Mycobacterium
DVLVLGLARGGVPVAWEVAA

SEQ ID NO: 805026 - protein, 17 aa, Mycobacterium
DVLVLVPEPFRDERGLF

SEQ ID NO: 805027 - protein, 23 aa, Mycobacterium
DVLVPPRADLWGRTLRRQPWPLS

SEQ ID NO: 805028 - protein, 18 aa, Mycobacterium
DVMDGHFVPNLTLGLPVV

SEQ ID NO: 805029 - protein, 23 aa, Mycobacterium
DVMDLAQWLIAENGYYTNCIHSA

SEQ ID NO: 805030 - protein, 18 aa, Mycobacterium
DVMFNALADRLPDLAPLG

SEQ ID NO: 805031 - protein, 33 aa, Mycobacterium
DVMGFGKPLDEIPMLLQPGVLSLAWGSVIRQMA

SEQ ID NO: 805032 - protein, 33 aa, Mycobacterium
DVMGFGKPLDEIPMLLQPGVLSLAWGSVVRQLA

SEQ ID NO: 805033 - protein, 18 aa, Mycobacterium
DVMLGIVEVLRLVTDRGD

SEQ ID NO: 805034 - protein, 25 aa, Mycobacterium
DVMLRATQHLPWHPGRCAEVLVGEA

SEQ ID NO: 805035 - protein, 21 aa, Mycobacterium
DVMMGIVEMLRLVTDRGDTVI

SEQ ID NO: 805036 - protein, 29 aa, Mycobacterium
DVMNTHGTIGFPMQSAFDAAHAARGGAMG

SEQ ID NO: 805037 - protein, 17 aa, Mycobacterium
DVMPYTFGDNWLYDASP

SEQ ID NO: 805038 - protein, 17 aa, Mycobacterium
DVMPYTFGNNWFADAAA

SEQ ID NO: 805039 - protein, 17 aa, Mycobacterium
DVMPYTFGNNWFADAPA

SEQ ID NO: 805040 - protein, 17 aa, Mycobacterium
DVMPYTFGNNWFADAPP

SEQ ID NO: 805041 - protein, 25 aa, Mycobacterium
DVMTLSPLQLGLFALAMASGAASDD

SEQ ID NO: 805042 - protein, 24 aa, Mycobacterium
DVMTVVQRLELVRRIGLVIDDDVV

SEQ ID NO: 805043 - protein, 24 aa, Mycobacterium
DVMTVVQRLELVRRIGLVIDYDAV

SEQ ID NO: 805044 - protein, 21 aa, Mycobacterium
DVNAAYQLFHQVRRLVTVMTK

SEQ ID NO: 805045 - protein, 26 aa, Mycobacterium
DVNDQPWRADLLGKKLHGALGPLAHV

SEQ ID NO: 805046 - protein, 17 aa, Mycobacterium
DVNLFLDGVRQALDGDP

SEQ ID NO: 805047 - protein, 21 aa, Mycobacterium
DVNLLLRNAVLTFAGHDHQAS

SEQ ID NO: 805048 - protein, 24 aa, Mycobacterium
DVNPYLAVAAIVAGGLYGVERGLE

SEQ ID NO: 805049 - protein, 17 aa, Mycobacterium
DVNPYYAYAATIAAGLD

SEQ ID NO: 805050 - protein, 24 aa, Mycobacterium
DVNQYLAVAALIAGGLYGIENKLE

SEQ ID NO: 805051 - protein, 32 aa, Mycobacterium
DVNRDFWSRFLRNFWRNFWRIRDLKELLREDW

SEQ ID NO: 805052 - protein, 23 aa, Mycobacterium
DVNRFPIPKRFLDSEIPVVGALA

SEQ ID NO: 805053 - protein, 24 aa, Mycobacterium
DVNTAEFVVALLAAARIGAVVAPL

SEQ ID NO: 805054 - protein, 25 aa, Mycobacterium
DVNVRAPFVLSREVARRMIPRRAGS

SEQ ID NO: 805055 - protein, 23 aa, Mycobacterium
DVPAAVRFLSCEPLIGPLDGLNL

SEQ ID NO: 805056 - protein, 17 aa, Mycobacterium
DVPAFDASDVRLAIVAS

SEQ ID NO: 805057 - protein, 23 aa, Mycobacterium
DVPEPVLALIGKDLPPVSGPAPA

SEQ ID NO: 805058 - protein, 23 aa, Mycobacterium
DVPFGPDLLFTASDLPGFVLHVE

SEQ ID NO: 805059 - protein, 23 aa, Mycobacterium
DVPFHVVVPLLREGFGVAGLDPA

SEQ ID NO: 805060 - protein, 20 aa, Mycobacterium
DVPFRVMTRLLRAVGQASGL

SEQ ID NO: 805061 - protein, 24 aa, Mycobacterium
DVPGIVYQFSFAKNPNWSRTFPKG

SEQ ID NO: 805062 - protein, 29 aa, Mycobacterium
DVPHIAVFDTAFFHQLPPAAATYAIDREL

SEQ ID NO: 805063 - protein, 27 aa, Mycobacterium
DVPILPQQALLYRLCGDRNPLHSDPEF

SEQ ID NO: 805064 - protein, 18 aa, Mycobacterium
DVPKHDGLTMFLVPINHP

SEQ ID NO: 805065 - protein, 20 aa, Mycobacterium
DVPKHEGLTMFLVPIAHPGI

SEQ ID NO: 805066 - protein, 21 aa, Mycobacterium
DVPKHEGLTMFLVPISHPGIT

SEQ ID NO: 805067 - protein, 28 aa, Mycobacterium
DVPKHKGITYFLLDMKTPGITVRPLREI

SEQ ID NO: 805068 - protein, 17 aa, Mycobacterium
DVPLDDGTTWRIEIERA

SEQ ID NO: 805069 - protein, 17 aa, Mycobacterium
DVPLMGYLRQMFFEPFG

SEQ ID NO: 805070 - protein, 23 aa, Mycobacterium
DVPLPQGWENLGALDPAYLIADK

SEQ ID NO: 805071 - protein, 23 aa, Mycobacterium
DVPNEVLQCYLDLVLDGLVARLA

SEQ ID NO: 805072 - protein, 24 aa, Mycobacterium
DVPNYRRFWAITRHADVMDIERDN

SEQ ID NO: 805073 - protein, 18 aa, Mycobacterium
DVPPGDFGSPLRLLAQAL

SEQ ID NO: 805074 - protein, 24 aa, Mycobacterium
DVPPIEVVLVRLRDARLTRKALAV

SEQ ID NO: 805075 - protein, 26 aa, Mycobacterium
DVPPNDQIFAPRLGPIRARLSGPESI

SEQ ID NO: 805076 - protein, 17 aa, Mycobacterium
DVPPVVWTVLMASLSRF

SEQ ID NO: 805077 - protein, 18 aa, Mycobacterium
DVPPVVWTVLMTSLSRFL

SEQ ID NO: 805078 - protein, 19 aa, Mycobacterium
DVPRHKGISAFIISMHQDG

SEQ ID NO: 805079 - protein, 17 aa, Mycobacterium
DVPSAVLHIYLDVVLDG

SEQ ID NO: 805080 - protein, 25 aa, Mycobacterium
DVPTAGWGWLPLATGVAVVDAVAPL

SEQ ID NO: 805081 - protein, 22 aa, Mycobacterium
DVPTFRMLAGLSGRVPLVSIVS

SEQ ID NO: 805082 - protein, 18 aa, Mycobacterium
DVPTGWRMIATGADARRS

SEQ ID NO: 805083 - protein, 26 aa, Mycobacterium
DVPVALRPAFVAYLNRKYATCVPKTV

SEQ ID NO: 805084 - protein, 22 aa, Mycobacterium
DVPVEFLVQGTLYPDVVESGGG

SEQ ID NO: 805085 - protein, 22 aa, Mycobacterium
DVPVFGRLVIVADPRLAKKVFT

SEQ ID NO: 805086 - protein, 18 aa, Mycobacterium
DVPVIKLLDDASVAGLAD

SEQ ID NO: 805087 - protein, 18 aa, Mycobacterium
DVPVRWLTGTLDPVITPE

SEQ ID NO: 805088 - protein, 25 aa, Mycobacterium
DVPYPAGHSGLLYRIARHGLVVSEY

SEQ ID NO: 805089 - protein, 17 aa, Mycobacterium
DVQAGAVSFRFGDRTQL

SEQ ID NO: 805090 - protein, 27 aa, Mycobacterium
DVQAGLAMLAPIWGFEPLLDTEDSVAR

SEQ ID NO: 805091 - protein, 27 aa, Mycobacterium
DVQAGLAMLAPIWGYAPLLDIDDATAR

SEQ ID NO: 805092 - protein, 31 aa, Mycobacterium
DVQAGLAMLAPIWGYAPLLDIDDRTAREQLA

SEQ ID NO: 805093 - protein, 26 aa, Mycobacterium
DVQAGLAMLAPIWGYAPMLDIDDETA

SEQ ID NO: 805094 - protein, 26 aa, Mycobacterium
DVQAGLAMLAPIWGYKPLLDTDDATA

SEQ ID NO: 805095 - protein, 26 aa, Mycobacterium
DVQAGLAMLAPIWGYKPLLDTDDGTA

SEQ ID NO: 805096 - protein, 17 aa, Mycobacterium
DVQATHAAWIIARALER

SEQ ID NO: 805097 - protein, 42 aa, Mycobacterium
DVQFATFPETVIPYYPYFSFVQRPFEMRPEHLRLLDQAVAIP

SEQ ID NO: 805098 - protein, 29 aa, Mycobacterium
DVQGPDLFACLGPFPKATPENIARYGLPT

SEQ ID NO: 805099 - protein, 17 aa, Mycobacterium
DVQIWRHKARIDNPLLV

SEQ ID NO: 805100 - protein, 26 aa, Mycobacterium
DVQKFATFFLMMDPPEHTVYRRLISS

SEQ ID NO: 805101 - protein, 17 aa, Mycobacterium
DVQLYHLGLGAGADPMD

SEQ ID NO: 805102 - protein, 25 aa, Mycobacterium
DVQNMLLEFGVISRRYLHATGEHKV

SEQ ID NO: 805103 - protein, 20 aa, Mycobacterium
DVQRAWQTRIRRIHDLLVRA

SEQ ID NO: 805104 - protein, 24 aa, Mycobacterium
DVQTAKLLGFHWTKRHLDKPGMGE

SEQ ID NO: 805105 - protein, 26 aa, Mycobacterium
DVQTDSFEWLVGSDRWRQAAIDRGEE

SEQ ID NO: 805106 - protein, 28 aa, Mycobacterium
DVQTESFEWLIGAEDWFQRAVDRGDVDP

SEQ ID NO: 805107 - protein, 26 aa, Mycobacterium
DVQTFYEIAYLLYPETTLIQPSIVRM

SEQ ID NO: 805108 - protein, 18 aa, Mycobacterium
DVQTIYGVVGIPITDLAR

SEQ ID NO: 805109 - protein, 17 aa, Mycobacterium
DVQTKLHALLETLSESA

SEQ ID NO: 805110 - protein, 24 aa, Mycobacterium
DVQWNFEKFLLAPGGEVVKRFRPR

SEQ ID NO: 805111 - protein, 18 aa, Mycobacterium
DVRAFWGDELKTVKSPYP

SEQ ID NO: 805112 - protein, 22 aa, Mycobacterium
DVRAGWDWLPEASGLPPERIVV

SEQ ID NO: 805113 - protein, 17 aa, Mycobacterium
DVRAHAPVRLNASDWRV

SEQ ID NO: 805114 - protein, 17 aa, Mycobacterium
DVRALVLTGAGGAFCSG

SEQ ID NO: 805115 - protein, 19 aa, Mycobacterium
DVRATHPLLWSGDALQRSA

SEQ ID NO: 805116 - protein, 23 aa, Mycobacterium
DVRDPLYVLAGRDEGYVPYYDEY

SEQ ID NO: 805117 - protein, 23 aa, Mycobacterium
DVREHIFEPFFTTKPFGEGTGLG

SEQ ID NO: 805118 - protein, 17 aa, Mycobacterium
DVREQLLPGLLAGTTVA

SEQ ID NO: 805119 - protein, 24 aa, Mycobacterium
DVRGDVDWAALAAAPGPLILHATA

SEQ ID NO: 805120 - protein, 24 aa, Mycobacterium
DVRGDVDWAALAAAPGPLILHATP

SEQ ID NO: 805121 - protein, 20 aa, Mycobacterium
DVRGEGFFFSIELVKDQATK

SEQ ID NO: 805122 - protein, 18 aa, Mycobacterium
DVRGEGYFYGIELVKDKA

SEQ ID NO: 805123 - protein, 21 aa, Mycobacterium
DVRGFLNPIPHVSYVHGADKV

SEQ ID NO: 805124 - protein, 18 aa, Mycobacterium
DVRHIVALQLLTSPLHTF

SEQ ID NO: 805125 - protein, 23 aa, Mycobacterium
DVRHTVLPIARWQYDIVAADGGC

SEQ ID NO: 805126 - protein, 21 aa, Mycobacterium
DVRIEWGPLRHGPGHNIALYF

SEQ ID NO: 805127 - protein, 20 aa, Mycobacterium
DVRIGLHNIPVDRRPLWIER

SEQ ID NO: 805128 - protein, 21 aa, Mycobacterium
DVRKSAVLSLSRWVSTEPAVR

SEQ ID NO: 805129 - protein, 20 aa, Mycobacterium
DVRLPFHRPVDDMNGLAQAI

SEQ ID NO: 805130 - protein, 23 aa, Mycobacterium
DVRLPFPAPVDDVPGLSKAIRVL

SEQ ID NO: 805131 - protein, 24 aa, Mycobacterium
DVRLRAAMPQRMPTWRAFWADGDP

SEQ ID NO: 805132 - protein, 27 aa, Mycobacterium
DVRLSRYSYLVSLLPPRIVDDLGAAVR

SEQ ID NO: 805133 - protein, 19 aa, Mycobacterium
DVRLVAIAVDWTRGAVKTV

SEQ ID NO: 805134 - protein, 19 aa, Mycobacterium
DVRLVSRVSDAPAVPARLV

SEQ ID NO: 805135 - protein, 25 aa, Mycobacterium
DVRNWPRRRMVLSRTANAYSRILLG

SEQ ID NO: 805136 - protein, 17 aa, Mycobacterium
DVRPILPTITVPTLVLH

SEQ ID NO: 805137 - protein, 17 aa, Mycobacterium
DVRPLQIVGARVLDLED

SEQ ID NO: 805138 - protein, 19 aa, Mycobacterium
DVRPRVVVLGSGDLSRELA

SEQ ID NO: 805139 - protein, 19 aa, Mycobacterium
DVRPSLFGDPFACRFSLRD

SEQ ID NO: 805140 - protein, 24 aa, Mycobacterium
DVRPTVWGAVPRVWEKLKAAIEFT

SEQ ID NO: 805141 - protein, 26 aa, Mycobacterium
DVRQRYALLGPPIPGMELRISPTHRS

SEQ ID NO: 805142 - protein, 23 aa, Mycobacterium
DVRQVFGAGPLRLAGRMDGVGEQ

SEQ ID NO: 805143 - protein, 24 aa, Mycobacterium
DVRRRAGAIWTRRTDRLPFVAPMN

SEQ ID NO: 805144 - protein, 21 aa, Mycobacterium
DVRRRILSMLAQGMLRPGSRL

SEQ ID NO: 805145 - protein, 25 aa, Mycobacterium
DVRRVFENVPMLLVGLEGPEHRFVA

SEQ ID NO: 805146 - protein, 25 aa, Mycobacterium
DVRSAVIPVARWQYDIVASGGGCRV

SEQ ID NO: 805147 - protein, 27 aa, Mycobacterium
DVRTDVGALVAFLLGGDATFITGQTIH

SEQ ID NO: 805148 - protein, 22 aa, Mycobacterium
DVRTIYQTALGLEGLIRNAGVH

SEQ ID NO: 805149 - protein, 23 aa, Mycobacterium
DVRTLFDTHIFGTVATIKAVLPG

SEQ ID NO: 805150 - protein, 19 aa, Mycobacterium
DVRTLLAKFGLRADHVERE

SEQ ID NO: 805151 - protein, 18 aa, Mycobacterium
DVRTLLAKFGLTADHVER

SEQ ID NO: 805152 - protein, 17 aa, Mycobacterium
DVRTMKYFDQELIAWRA

SEQ ID NO: 805153 - protein, 17 aa, Mycobacterium
DVRTPFGLFPDVSPGTI

SEQ ID NO: 805154 - protein, 28 aa, Mycobacterium
DVRTVAAARWPAVRFAVRNTAVQGPSAV

SEQ ID NO: 805155 - protein, 20 aa, Mycobacterium
DVRTVLPPALSIRNGRRSVV

SEQ ID NO: 805156 - protein, 17 aa, Mycobacterium
DVRVAAELALPHRRRRD

SEQ ID NO: 805157 - protein, 22 aa, Mycobacterium
DVRVIVALGGFAWQVALRMSGA

SEQ ID NO: 805158 - protein, 27 aa, Mycobacterium
DVRVIVALGGFAWQVVLAMVRRTGGTV

SEQ ID NO: 805159 - protein, 21 aa, Mycobacterium
DVRVNVFEKLPTRYGLVRAGV

SEQ ID NO: 805160 - protein, 23 aa, Mycobacterium
DVRWFDIEPCYVYHPLNAYSEHR

SEQ ID NO: 805161 - protein, 24 aa, Mycobacterium
DVRWFDIEPCYVYHPLNAYSEMRN

SEQ ID NO: 805162 - protein, 17 aa, Mycobacterium
DVRYLGSWPTGSPAGVL

SEQ ID NO: 805163 - protein, 22 aa, Mycobacterium
DVRYSILPVARWQYDIVAADGG

SEQ ID NO: 805164 - protein, 23 aa, Mycobacterium
DVRYYWDNHMSASFMVDPLGLQL

SEQ ID NO: 805165 - protein, 28 aa, Mycobacterium
DVSAKAATPWLAATVRFAWRTRLMSSAA

SEQ ID NO: 805166 - protein, 22 aa, Mycobacterium
DVSALLPASVHQRLLGKLRGQA

SEQ ID NO: 805167 - protein, 17 aa, Mycobacterium
DVSDDFFALFQDPTRIY

SEQ ID NO: 805168 - protein, 25 aa, Mycobacterium
DVSELLPELTLAQKWDLTATELARN

SEQ ID NO: 805169 - protein, 25 aa, Mycobacterium
DVSETVLFLVSDSGRYYTGTTLMLD

SEQ ID NO: 805170 - protein, 27 aa, Mycobacterium
DVSGGAAFFLCRRASRLRAHAAQWALP

SEQ ID NO: 805171 - protein, 27 aa, Mycobacterium
DVSGGAAFLLCRRASRLNSHAAQWALP

SEQ ID NO: 805172 - protein, 26 aa, Mycobacterium
DVSGGAAFLLCRRASRLSSHSAQWAL

SEQ ID NO: 805173 - protein, 26 aa, Mycobacterium
DVSGGAAFLLCRRASRLTSHAAQWAL

SEQ ID NO: 805174 - protein, 25 aa, Mycobacterium
DVSGYPRLFAALADRGWSRADLAKL

SEQ ID NO: 805175 - protein, 19 aa, Mycobacterium
DVSIAEIFGLLICGGRLVI

SEQ ID NO: 805176 - protein, 19 aa, Mycobacterium
DVSIFIDKSIPVAGGMAGG

SEQ ID NO: 805177 - protein, 36 aa, Mycobacterium
DVSIQAGIINLLLDLQARFKLSYLFVSHDLSVVKHL

SEQ ID NO: 805178 - protein, 23 aa, Mycobacterium
DVSLLDTDLALMAPRIAAYHAGD

SEQ ID NO: 805179 - protein, 26 aa, Mycobacterium
DVSLPELGGFRWLTVGPPGQEDVSIV

SEQ ID NO: 805180 - protein, 24 aa, Mycobacterium
DVSLPVVRAFISRIKDRAKGVEVS

SEQ ID NO: 805181 - protein, 18 aa, Mycobacterium
DVSLRPRSLREFIGQPRV

SEQ ID NO: 805182 - protein, 19 aa, Mycobacterium
DVSLRPRSLREFIGQPRVR

SEQ ID NO: 805183 - protein, 31 aa, Mycobacterium; identical to SEQ ID NO: 217329

SEQ ID NO: 805184 - protein, 21 aa, Mycobacterium
DVSLVRLTELPVGMPVAVVVR

SEQ ID NO: 805185 - protein, 30 aa, Mycobacterium
DVSNRLRPTLHLFLALTANSAVYRKADSGY

SEQ ID NO: 805186 - protein, 24 aa, Mycobacterium
DVSPRTLYRYFGVKEALLISDDQI

SEQ ID NO: 805187 - protein, 24 aa, Mycobacterium
DVSPSTFFRYFGSKESLLLADDLD

SEQ ID NO: 805188 - protein, 25 aa, Mycobacterium
DVSQLVYLHLRFHGYGDGRWTDSAV

SEQ ID NO: 805189 - protein, 17 aa, Mycobacterium
DVSQLWEFVPIAEADRP

SEQ ID NO: 805190 - protein, 24 aa, Mycobacterium
DVSQRLGVPGIWYAGSHGFELTAP

SEQ ID NO: 805191 - protein, 24 aa, Mycobacterium
DVSRIERFAHPVLLERQRAAEMAS

SEQ ID NO: 805192 - protein, 18 aa, Mycobacterium
DVSRLAPNVWPQNTVRGD

SEQ ID NO: 805193 - protein, 35 aa, Mycobacterium
DVSTRYALDLFATLGLQLLIVTPLQKVHVIEPYVK

SEQ ID NO: 805194 - protein, 37 aa, Mycobacterium
DVSTRYALDLFATLGLQLLIVTPLQKVHVIEPYVKAI

SEQ ID NO: 805195 - protein, 21 aa, Mycobacterium
DVSVLRNAGWLPKISLSDGIE

SEQ ID NO: 805196 - protein, 19 aa, Mycobacterium
DVSVSFGGRPVLRDVEWRI

SEQ ID NO: 805197 - protein, 17 aa, Mycobacterium
DVSVWEIFAPLLRGGRL

SEQ ID NO: 805198 - protein, 25 aa, Mycobacterium
DVSVWEIFGALLRGGPAGGGARGGQ

SEQ ID NO: 805199 - protein, 24 aa, Mycobacterium
DVSYLDLNFALNVTPSGGLDVSVV

SEQ ID NO: 805200 - protein, 17 aa, Mycobacterium
DVTALPFADGAFDVVIS

SEQ ID NO: 805201 - protein, 20 aa, Mycobacterium
DVTAWMLEKCRTFYASLSSD

SEQ ID NO: 805202 - protein, 26 aa, Mycobacterium
DVTCGRMFIFIGAAPRTDWLDGVLAR

SEQ ID NO: 805203 - protein, 21 aa, Mycobacterium
DVTDIILNLKALVVSSEEDEP

SEQ ID NO: 805204 - protein, 21 aa, Mycobacterium
DVTDIILNLKGLVVSSEEDEP

SEQ ID NO: 805205 - protein, 40 aa, Mycobacterium
DVTDLIPAGPLLDGGIAFTFAIYYLPMPAADPFDTLDELL

SEQ ID NO: 805206 - protein, 28 aa, Mycobacterium
DVTDRYQVPVLLAALGPTMLRLAGERAG

SEQ ID NO: 805207 - protein, 37 aa, Mycobacterium
DVTESFRLNPAPWLGVYWLFGGFLRKRRNIRDMTKTL

SEQ ID NO: 805208 - protein, 24 aa, Mycobacterium
DVTFERTLLLADHTWASSTATISA

SEQ ID NO: 805209 - protein, 26 aa, Mycobacterium
DVTFTGVLPMLLRDDARPPVVVCGVG

SEQ ID NO: 805210 - protein, 20 aa, Mycobacterium
DVTGALFQFLAPQGMRSLGT

SEQ ID NO: 805211 - protein, 32 aa, Mycobacterium
DVTGDPFARLHQLWELLLPGVVAEASLPYFQQ

SEQ ID NO: 805212 - protein, 25 aa, Mycobacterium
DVTGGGWGFLLSKLSRQGAKLVKGI

SEQ ID NO: 805213 - protein, 23 aa, Mycobacterium
DVTGGNRWLSQPAAIFCSADPAL

SEQ ID NO: 805214 - protein, 17 aa, Mycobacterium
DVTLGVRPEDLLVAPDP

SEQ ID NO: 805215 - protein, 26 aa, Mycobacterium
DVTLLPGLMDMELNLLIGGPEGLPSP

SEQ ID NO: 805216 - protein, 25 aa, Mycobacterium
DVTLLPGLMDMELNLLIGGPGGPEG

SEQ ID NO: 805217 - protein, 28 aa, Mycobacterium
DVTLNGRQWLTDLHIEEGLLRLGAEAVE

SEQ ID NO: 805218 - protein, 24 aa, Mycobacterium
DVTLNLAGLSLLQKSLQGSIFGGG

SEQ ID NO: 805219 - protein, 25 aa, Mycobacterium
DVTLNLSMLTLLQKNLQGTIFGGGN

SEQ ID NO: 805220 - protein, 27 aa, Mycobacterium
DVTLTSTFRATRAALRYFREAGHGGVI

SEQ ID NO: 805221 - protein, 24 aa, Mycobacterium
DVTPGRLRDALDEGQIVLVAGFQG

SEQ ID NO: 805222 - protein, 17 aa, Mycobacterium
DVTPGRLRTALDEGQVV

SEQ ID NO: 805223 - protein, 23 aa, Mycobacterium
DVTPYDPVYFPFDPALRDRQDLG

SEQ ID NO: 805224 - protein, 24 aa, Mycobacterium
DVTSLYKVGLGSVRFLMSVGDLII

SEQ ID NO: 805225 - protein, 23 aa, Mycobacterium
DVTSLYKVGLGSVRFLMSVGDLV

SEQ ID NO: 805226 - protein, 17 aa, Mycobacterium
DVTVAVANDFRSARRLE

SEQ ID NO: 805227 - protein, 17 aa, Mycobacterium
DVTVCILDRPRHAKLME

SEQ ID NO: 805228 - protein, 18 aa, Mycobacterium
DVTVPFGDLPAPDGAAPL

SEQ ID NO: 805229 - protein, 26 aa, Mycobacterium
DVTVPIPTLPALLAGINRISAECDVL

SEQ ID NO: 805230 - protein, 19 aa, Mycobacterium
DVTVVEFLARALPNEDAEV

SEQ ID NO: 805231 - protein, 17 aa, Mycobacterium
DVTVWSLARSGDRGFFR

SEQ ID NO: 805232 - protein, 19 aa, Mycobacterium
DVTYDLLRKLGLTTVFGNP

SEQ ID NO: 805233 - protein, 20 aa, Mycobacterium
DVVALLQALIDRHPMLRLCV

SEQ ID NO: 805234 - protein, 20 aa, Mycobacterium
DVVAMLGYHADTSAAAAALS

SEQ ID NO: 805235 - protein, 24 aa, Mycobacterium
DVVARFCRSLFRAGRRFDLVATRA

SEQ ID NO: 805236 - protein, 26 aa, Mycobacterium
DVVATAAWGWLSLATGLAVIDAVTPL

SEQ ID NO: 805237 - protein, 24 aa, Mycobacterium
DVVATPYKSQFITAAPGSTAVNIE

SEQ ID NO: 805238 - protein, 19 aa, Mycobacterium
DVVAWVRDLEYGRLKLPVP

SEQ ID NO: 805239 - protein, 24 aa, Mycobacterium
DVVAYLRRWLLVNDERARQMLRFL

SEQ ID NO: 805240 - protein, 31 aa, Mycobacterium
DVVDPRTGLPWLAAHAEEFGLVAPPADQRSA

SEQ ID NO: 805241 - protein, 24 aa, Mycobacterium
DVVDTWWRVMQFAAYAAYTRTDAF

SEQ ID NO: 805242 - protein, 18 aa, Mycobacterium
DVVFASHHWPTWGHDNIV

SEQ ID NO: 805243 - protein, 20 aa, Mycobacterium
DVVFGLHRKAVLHKERRRSA

SEQ ID NO: 805244 - protein, 24 aa, Mycobacterium
DVVGCYRMLPPPGAIAAGGLYSAT

SEQ ID NO: 805245 - protein, 21 aa, Mycobacterium
DVVGILDRRGIDTAHLVGLSL

SEQ ID NO: 805246 - protein, 25 aa, Mycobacterium
DVVHDRGPWKLIIAQHFASADELMA

SEQ ID NO: 805247 - protein, 23 aa, Mycobacterium
DVVHLASPALLGYGGLHAARHLG

SEQ ID NO: 805248 - protein, 22 aa, Mycobacterium
DVVHLASPALLGYGGLRAARRL

SEQ ID NO: 805249 - protein, 17 aa, Mycobacterium
DVVILDLGLPDISGIDV

SEQ ID NO: 805250 - protein, 38 aa, Mycobacterium
DVVILNSVLQYFPGVGYLLDVLAKAIGLLAPGGALFLG

SEQ ID NO: 805251 - protein, 20 aa, Mycobacterium
DVVIPAKLLNPNAPPKLGAI

SEQ ID NO: 805252 - protein, 22 aa, Mycobacterium
DVVKAGFWSSGPVLLQALGILD

SEQ ID NO: 805253 - protein, 19 aa, Mycobacterium
DVVLEAWRRHIVGGGWRGD

SEQ ID NO: 805254 - protein, 17 aa, Mycobacterium
DVVLFSIPTSPYALTTW

SEQ ID NO: 805255 - protein, 21 aa, Mycobacterium
DVVLGRLAVAAATLLRGKHKP

SEQ ID NO: 805256 - protein, 19 aa, Mycobacterium
DVVLHFEGDKHSALRMVRG

SEQ ID NO: 805257 - protein, 18 aa, Mycobacterium
DVVLHFEGDRNGGLRMVR

SEQ ID NO: 805258 - protein, 20 aa, Mycobacterium
DVVLIATGASPRILPSARPD

SEQ ID NO: 805259 - protein, 19 aa, Mycobacterium
DVVLLLPGSAHRDERAFRD

SEQ ID NO: 805260 - protein, 19 aa, Mycobacterium
DVVLLLPGSAHRDERVFQN

SEQ ID NO: 805261 - protein, 19 aa, Mycobacterium
DVVLLQLEISPTTAIAAAQ

SEQ ID NO: 805262 - protein, 18 aa, Mycobacterium
DVVLLVDDWHMVTAAAGM

SEQ ID NO: 805263 - protein, 17 aa, Mycobacterium
DVVLMDMRLGDGSGAQA

SEQ ID NO: 805264 - protein, 19 aa, Mycobacterium
DVVLPGSCTRAFDAHPGDE

SEQ ID NO: 805265 - protein, 21 aa, Mycobacterium
DVVLPLTDGWLDAVKAETGGR

SEQ ID NO: 805266 - protein, 18 aa, Mycobacterium
DVVLPWDGRDHYLAGIYR

SEQ ID NO: 805267 - protein, 17 aa, Mycobacterium
DVVLRKPRPARPELVVL

SEQ ID NO: 805268 - protein, 17 aa, Mycobacterium
DVVLRLPQQRYLVVDYK

SEQ ID NO: 805269 - protein, 21 aa, Mycobacterium
DVVLVAQAWHWVDAERAIPEV

SEQ ID NO: 805270 - protein, 17 aa, Mycobacterium
DVVLWAIGRVRPNTGWL

SEQ ID NO: 805271 - protein, 18 aa, Mycobacterium
DVVLWYTVGAHHVVCPED

SEQ ID NO: 805272 - protein, 20 aa, Mycobacterium
DVVMALVSGVLRTFLSHRDE

SEQ ID NO: 805273 - protein, 19 aa, Mycobacterium
DVVMLVGARLNWLLGHGDA

SEQ ID NO: 805274 - protein, 18 aa, Mycobacterium
DVVMVRMPGFGLEGPWRD

SEQ ID NO: 805275 - protein, 33 aa, Mycobacterium
DVVNAMVTTLPAYNLKLFLDGILQVLDGDPAGL

SEQ ID NO: 805276 - protein, 23 aa, Mycobacterium
DVVPARQLVDLLLAQTGRGDVRR

SEQ ID NO: 805277 - protein, 19 aa, Mycobacterium
DVVPPGDLRMALAALASDS

SEQ ID NO: 805278 - protein, 23 aa, Mycobacterium
DVVQNHLLQVLALVAMEPPVGAG

SEQ ID NO: 805279 - protein, 24 aa, Mycobacterium
DVVQNHLLQVLALVAMEPPVGPGA

SEQ ID NO: 805280 - protein, 23 aa, Mycobacterium
DVVRFAGGWLFDRAMAGWDVTVL

SEQ ID NO: 805281 - protein, 17 aa, Mycobacterium
DVVRTEGPWKLIIAQHF

SEQ ID NO: 805282 - protein, 24 aa, Mycobacterium
DVVRYAGGWLFDRAMAGWDVTVLV

SEQ ID NO: 805283 - protein, 24 aa, Mycobacterium
DVVTIFKAMQFDIGAPPQYMDFRY

SEQ ID NO: 805284 - protein, 18 aa, Mycobacterium
DVVVADRLAPPELLAELP

SEQ ID NO: 805285 - protein, 23 aa, Mycobacterium
DVVVLIQALLDRHAMLRLQVARD

SEQ ID NO: 805286 - protein, 17 aa, Mycobacterium
DVVVLLDSITRLGRAYN

SEQ ID NO: 805287 - protein, 20 aa, Mycobacterium
DVVVPIFDQLYVGRQCLGIS

SEQ ID NO: 805288 - protein, 18 aa, Mycobacterium
DVVVSAWLLVYAQNRAEL

SEQ ID NO: 805289 - protein, 25 aa, Mycobacterium
DVVYHHGWWQPQRPLTAIGAQMNIG

SEQ ID NO: 805290 - protein, 24 aa, Mycobacterium
DVVYRIPLVPNARRFKSGHRIQLV

SEQ ID NO: 805291 - protein, 23 aa, Mycobacterium
DVVYVHGTVISSRRGELSVLADS

SEQ ID NO: 805292 - protein, 17 aa, Mycobacterium
DVVYYCVVDARMWLRDP

SEQ ID NO: 805293 - protein, 21 aa, Mycobacterium
DVVYYLVHAIGQPGFRDADRA

SEQ ID NO: 805294 - protein, 30 aa, Mycobacterium
DVWAGSYPDRIIGCQLPWLLDPELGAKMIY

SEQ ID NO: 805295 - protein, 18 aa, Mycobacterium
DVWEFRPPNPTGKTVIAV

SEQ ID NO: 805296 - protein, 47 aa, Mycobacterium
DVWEGVVGIFRDYGYRRLRSKARLKFLVKDWGVAKFREILETEYLKR

SEQ ID NO: 805297 - protein, 45 aa, Mycobacterium
DVWEGVVSIFRDYGYRRLRSKARLKFLIKDWGVEKFREVLETEYL

SEQ ID NO: 805298 - protein, 43 aa, Mycobacterium
DVWEGVVSVFRDYGYRRLRAKARLKFLIKDWGVEKFRQVLEEE

SEQ ID NO: 805299 - protein, 32 aa, Mycobacterium
DVWEWTASPLRPWPGFVPMIYERYSQPFFDGD

SEQ ID NO: 805300 - protein, 19 aa, Mycobacterium
DVWGLLVDGKFGQGLPPAE

SEQ ID NO: 805301 - protein, 19 aa, Mycobacterium
DVWNFKDRMPIFPVPEGED

SEQ ID NO: 805302 - protein, 18 aa, Mycobacterium
DVWRMHRLGYEGHYTLRF

SEQ ID NO: 805303 - protein, 18 aa, Mycobacterium
DVWRRKDLPAQPAPVLIF

SEQ ID NO: 805304 - protein, 23 aa, Mycobacterium
DVWTDELFGPVLAIRRAADAEEA

SEQ ID NO: 805305 - protein, 20 aa, Mycobacterium
DVWTPRDRMPIFPVPEGHDP

SEQ ID NO: 805306 - protein, 18 aa, Mycobacterium
DVWTPRDRMPVFPVPDGH

SEQ ID NO: 805307 - protein, 19 aa, Mycobacterium
DVYACPFAIHDRFLAGNVL

SEQ ID NO: 805308 - protein, 23 aa, Mycobacterium
DVYACPFAIHDRFLAGNVLSDGG

SEQ ID NO: 805309 - protein, 18 aa, Mycobacterium
DVYAPDFLRGCASGVQTL

SEQ ID NO: 805310 - protein, 20 aa, Mycobacterium
DVYDYIKSYSPYENIRAADY

SEQ ID NO: 805311 - protein, 17 aa, Mycobacterium
DVYGLGLTLFTALTGHA

SEQ ID NO: 805312 - protein, 23 aa, Mycobacterium
DVYGVGATLFCALTGHPPFERRK

SEQ ID NO: 805313 - protein, 18 aa, Mycobacterium
DVYPKLTLQSLVAFPTAK

SEQ ID NO: 805314 - protein, 27 aa, Mycobacterium
DVYREELTRIFYGPYWHPIAHRAELAE

SEQ ID NO: 805315 - protein, 18 aa, Mycobacterium
DVYRMLRVTNPSPYMYLL

SEQ ID NO: 805316 - protein, 22 aa, Mycobacterium
DVYTLWAPRWRADGDEWEAFLG

SEQ ID NO: 805317 - protein, 24 aa, Mycobacterium
DVYVFRCAILYLRYEVANCHSSRG

SEQ ID NO: 805318 - protein, 18 aa, Mycobacterium
DVYWIRTGSLTLGVVPAL

SEQ ID NO: 805319 - protein, 22 aa, Mycobacterium
DWAALPFDQRAAVFLRAADLLS

SEQ ID NO: 805320 - protein, 28 aa, Mycobacterium
DWAARYTWPRFVCGLPREFFAAVRAELA

SEQ ID NO: 805321 - protein, 26 aa, Mycobacterium
DWALQRHGDFLAGFAPLTFIGNHDVT

SEQ ID NO: 805322 - protein, 18 aa, Mycobacterium
DWALRHSVAAWPAVCSGL

SEQ ID NO: 805323 - protein, 23 aa, Mycobacterium
DWASLDHRRLAPIGANDLGAYLS

SEQ ID NO: 805324 - protein, 24 aa, Mycobacterium
DWAVHIALWQRSVGVDGGLSDAVV

SEQ ID NO: 805325 - protein, 28 aa, Mycobacterium
DWAVRYTWPRFVCGLPREFFAAVRTELA

SEQ ID NO: 805326 - protein, 25 aa, Mycobacterium
DWDAPPVPGLYWATPRRTSLYGTKL

SEQ ID NO: 805327 - protein, 32 aa, Mycobacterium
DWDDELLGFFGVPRSMLPQIRPSSDPAGYGTT

SEQ ID NO: 805328 - protein, 24 aa, Mycobacterium
DWDDIARWQLIDKALGLGVPEPDE

SEQ ID NO: 805329 - protein, 19 aa, Mycobacterium
DWDELARWEMIDKALNLGN

SEQ ID NO: 805330 - protein, 24 aa, Mycobacterium
DWDELNRLLLTDRPLRGRLFAVLG

SEQ ID NO: 805331 - protein, 27 aa, Mycobacterium
DWDERIVTWLVDKFKASAGIDLTKDKM

SEQ ID NO: 805332 - protein, 24 aa, Mycobacterium
DWDGLPDDLAWQKALWQALCERID

SEQ ID NO: 805333 - protein, 20 aa, Mycobacterium
DWDGYTPPVPAQGLGIREFE

SEQ ID NO: 805334 - protein, 27 aa, Mycobacterium
DWDRDKYFPVEIFPKAAALGMGGIYVN

SEQ ID NO: 805335 - protein, 23 aa, Mycobacterium
DWDRLRSAILGDALFRAGSERFA

SEQ ID NO: 805336 - protein, 24 aa, Mycobacterium
DWDRNYVHSLDWRWLTAPMADGPG

SEQ ID NO: 805337 - protein, 18 aa, Mycobacterium
DWDSQGLRLAQELTPWPA

SEQ ID NO: 805338 - protein, 25 aa, Mycobacterium
DWEPADEFLPFKPTAFRMVAMGKRP

SEQ ID NO: 805339 - protein, 25 aa, Mycobacterium
DWEPADEFLPFRPTAFRMVAMGKRP

SEQ ID NO: 805340 - protein, 19 aa, Mycobacterium
DWETFVPMGWPDAKVAVVI

SEQ ID NO: 805341 - protein, 18 aa, Mycobacterium
DWETQGLTLATKLTRWPA

SEQ ID NO: 805342 - protein, 20 aa, Mycobacterium
DWEVVVATAYNPGDAADGVE

SEQ ID NO: 805343 - protein, 17 aa, Mycobacterium
DWFATLPAELTDAVTHH

SEQ ID NO: 805344 - protein, 26 aa, Mycobacterium
DWFGGEPFGVWPWAQRQLAGAQPAVL

SEQ ID NO: 805345 - protein, 25 aa, Mycobacterium
DWGADGSGLFMKYLRRGSGYYIDVG

SEQ ID NO: 805346 - protein, 18 aa, Mycobacterium
DWGATSAAFRDLLAEWKA

SEQ ID NO: 805347 - protein, 26 aa, Mycobacterium
DWGDPRCPLWLKAETLQPIGAFKIRG

SEQ ID NO: 805348 - protein, 17 aa, Mycobacterium
DWGGVAANLRCEHRRIV

SEQ ID NO: 805349 - protein, 30 aa, Mycobacterium
DWHARPGAFHRLSPPWQPMRLIAEASSLED

SEQ ID NO: 805350 - protein, 21 aa, Mycobacterium
DWHDTMEALLLGAFISEGCVS

SEQ ID NO: 805351 - protein, 30 aa, Mycobacterium
DWHIDEWCGAYPARFIPMAIPVIWDAEACA

SEQ ID NO: 805352 - protein, 30 aa, Mycobacterium
DWHIDEWCGAYPARFVPMAIPVIWDAEACA

SEQ ID NO: 805353 - protein, 17 aa, Mycobacterium
DWHMLQPQWIADLSDER

SEQ ID NO: 805354 - protein, 18 aa, Mycobacterium
DWHRAVQLAISWGDGRRE

SEQ ID NO: 805355 - protein, 21 aa, Mycobacterium
DWHTPPRARKPQRHVRLFGEI

SEQ ID NO: 805356 - protein, 21 aa, Mycobacterium
DWHTPPRARKPQRRLELRGEL

SEQ ID NO: 805357 - protein, 19 aa, Mycobacterium
DWHWAHQLRPRLAGLTDDE

SEQ ID NO: 805358 - protein, 19 aa, Mycobacterium
DWIAKAYIESYRGPHGDEP

SEQ ID NO: 805359 - protein, 21 aa, Mycobacterium
DWIATRKNARWLRTAQRGKWV

SEQ ID NO: 805360 - protein, 19 aa, Mycobacterium
DWIDAHVQKKYLADGSLPS

SEQ ID NO: 805361 - protein, 18 aa, Mycobacterium
DWIPRLATMDVIASYCLT

SEQ ID NO: 805362 - protein, 23 aa, Mycobacterium
DWKALHLPAPYGPGDWQLYDLAS

SEQ ID NO: 805363 - protein, 17 aa, Mycobacterium
DWKVPDPAGQPLPAVRA

SEQ ID NO: 805364 - protein, 19 aa, Mycobacterium
DWLAGWLDTFDPPLRNHTQ

SEQ ID NO: 805365 - protein, 17 aa, Mycobacterium
DWLFTRYDEIVAATTDP

SEQ ID NO: 805366 - protein, 18 aa, Mycobacterium
DWLLGYWSDRVHRLLGAC

SEQ ID NO: 805367 - protein, 20 aa, Mycobacterium
DWLNFVAFRGRELAPDGRLV

SEQ ID NO: 805368 - protein, 18 aa, Mycobacterium
DWLRLTHSDLRNFQRWLA

SEQ ID NO: 805369 - protein, 18 aa, Mycobacterium
DWLRRYYMRYSGPGGMTE

SEQ ID NO: 805370 - protein, 23 aa, Mycobacterium
DWLRSYLALPNYANNLLRLGFTE

SEQ ID NO: 805371 - protein, 19 aa, Mycobacterium
DWLVTRFAREVPGVAHALL

SEQ ID NO: 805372 - protein, 18 aa, Mycobacterium
DWMNRPHLAAAWEYDWPA

SEQ ID NO: 805373 - protein, 19 aa, Mycobacterium
DWMPAQELGFMYGRSFRDL

SEQ ID NO: 805374 - protein, 27 aa, Mycobacterium
DWMVGQLATVYFRAYQLAYDMGKQAER

SEQ ID NO: 805375 - protein, 20 aa, Mycobacterium
DWNSKRHFELSWAIPGIAAV

SEQ ID NO: 805376 - protein, 31 aa, Mycobacterium
DWNVPKHEGLTMFLVPLRHPGVTINRIKQVN

SEQ ID NO: 805377 - protein, 22 aa, Mycobacterium
DWNYQRQLLSIRLAEARGGEHL

SEQ ID NO: 805378 - protein, 19 aa, Mycobacterium
DWPAALRAAGFDAATPTAW

SEQ ID NO: 805379 - protein, 18 aa, Mycobacterium
DWPAVRAALPRHRGVSAL

SEQ ID NO: 805380 - protein, 20 aa, Mycobacterium
DWPDMLATHLSGERTGLIDC

SEQ ID NO: 805381 - protein, 22 aa, Mycobacterium
DWPILAHAPAPLPVTMGARTIS

SEQ ID NO: 805382 - protein, 17 aa, Mycobacterium
DWPQIQLVAGADTIRNG

SEQ ID NO: 805383 - protein, 18 aa, Mycobacterium
DWQAIVHALKRDPFGRTA

SEQ ID NO: 805384 - protein, 17 aa, Mycobacterium
DWQTALVLVPHPDDPEY

SEQ ID NO: 805385 - protein, 17 aa, Mycobacterium
DWRDELMPHYQQAQRML

SEQ ID NO: 805386 - protein, 18 aa, Mycobacterium
DWRDPYAGTPWHKHVPAR

SEQ ID NO: 805387 - protein, 17 aa, Mycobacterium
DWRRTLLAKMADAEIDF

SEQ ID NO: 805388 - protein, 20 aa, Mycobacterium
DWSALPAPTFASAVPYREPR

SEQ ID NO: 805389 - protein, 17 aa, Mycobacterium
DWSDGLSASLRAGVGAA

SEQ ID NO: 805390 - protein, 19 aa, Mycobacterium
DWSHMWSFQPEIQEYLLGV

SEQ ID NO: 805391 - protein, 19 aa, Mycobacterium
DWSHWPVRVLGHADPTTIG

SEQ ID NO: 805392 - protein, 22 aa, Mycobacterium
DWSMIYAGRHPDSLPFLSELQR

SEQ ID NO: 805393 - protein, 24 aa, Mycobacterium
DWSPNFDVWPYNTFTSRVTPEMIG

SEQ ID NO: 805394 - protein, 17 aa, Mycobacterium
DWSRIPPRQIRLDELVT

SEQ ID NO: 805395 - protein, 25 aa, Mycobacterium
DWSRPGRMWWSVPPGVDQFHTWQET

SEQ ID NO: 805396 - protein, 19 aa, Mycobacterium
DWSVIDRLPDVTAPVLVIA

SEQ ID NO: 805397 - protein, 19 aa, Mycobacterium
DWTIRHSVAAWPAVCSGLR

SEQ ID NO: 805398 - protein, 20 aa, Mycobacterium
DWTLKQLFRHVGRGNRWAAQ

SEQ ID NO: 805399 - protein, 17 aa, Mycobacterium
DWTPLPVPWAVQAVDRI

SEQ ID NO: 805400 - protein, 23 aa, Mycobacterium
DWTRLARRMSEISEAPLYIDDSP

SEQ ID NO: 805401 - protein, 24 aa, Mycobacterium
DWTRLARRMSEISEAPLYIDDSPN

SEQ ID NO: 805402 - protein, 25 aa, Mycobacterium
DWTRMARRMGEISDAPLFIDDSPNL

SEQ ID NO: 805403 - protein, 23 aa, Mycobacterium
DWTSRHTVAAWPALCSGLRAEAR

SEQ ID NO: 805404 - protein, 18 aa, Mycobacterium
DWVLVTRPDGTPYAWIDA

SEQ ID NO: 805405 - protein, 25 aa, Mycobacterium
DWVNTIFLSTRFRAWRVGGYNEYLY

SEQ ID NO: 805406 - protein, 18 aa, Mycobacterium
DWVPAHFPKDAWALARFD

SEQ ID NO: 805407 - protein, 28 aa, Mycobacterium
DWVQHAIWWQVYPLGFVGAFPVPQSNEP

SEQ ID NO: 805408 - protein, 34 aa, Mycobacterium
DWVRANLLAAPPPWIDIFIARNFHYLTELHCPAR

SEQ ID NO: 805409 - protein, 31 aa, Mycobacterium
DWVRVNGFGTPWWADDLAALAGTPVGGVMLA

SEQ ID NO: 805410 - protein, 20 aa, Mycobacterium
DWVRVNGFGTPWWADDLDTL

SEQ ID NO: 805411 - protein, 20 aa, Mycobacterium
DWVTSWFERLNLKDVTLFVQ

SEQ ID NO: 805412 - protein, 17 aa, Mycobacterium
DWYCWRLNKKVEDTQRR

SEQ ID NO: 805413 - protein, 23 aa, Mycobacterium
DYAAFNEVHWVAPADAVWACRTL

SEQ ID NO: 805414 - protein, 22 aa, Mycobacterium
DYAAFNEVHWVAPAEAVWACRN

SEQ ID NO: 805415 - protein, 19 aa, Mycobacterium
DYAARWFITLADGTDESRT

SEQ ID NO: 805416 - protein, 24 aa, Mycobacterium
DYADELAQWLTSRQPHLITAAHWQ

SEQ ID NO: 805417 - protein, 25 aa, Mycobacterium
DYAGLELRVLRLDTEYAWAEDPPSR

SEQ ID NO: 805418 - protein, 17 aa, Mycobacterium
DYAGMLKFGFDDARPVL

SEQ ID NO: 805419 - protein, 21 aa, Mycobacterium
DYAHRLAPLATRYAERLKIVM

SEQ ID NO: 805420 - protein, 18 aa, Mycobacterium
DYAKTRKLWGQEIGQFQL

SEQ ID NO: 805421 - protein, 17 aa, Mycobacterium
DYALMFPTLASLVEERM

SEQ ID NO: 805422 - protein, 22 aa, Mycobacterium
DYALRRRSLLAQVYSGRTGVSE

SEQ ID NO: 805423 - protein, 17 aa, Mycobacterium
DYALVCADGDWRRADIP

SEQ ID NO: 805424 - protein, 25 aa, Mycobacterium
DYALWTPKWLIEKFVDFQIPEDMLG

SEQ ID NO: 805425 - protein, 31 aa, Mycobacterium
DYAPLPLREPVRSLVWIQGVLRDVPTAEVPA

SEQ ID NO: 805426 - protein, 31 aa, Mycobacterium
DYAPLPLREPVRSLVWIRGRLQHVPNGEVAD

SEQ ID NO: 805427 - protein, 25 aa, Mycobacterium
DYAQRMAPVLAAEKARWAPSAGEPM

SEQ ID NO: 805428 - protein, 38 aa, Mycobacterium
DYARAHWGGLLAPPALLMGWLTTPPWQPGERDSAGSLA

SEQ ID NO: 805429 - protein, 18 aa, Mycobacterium
DYARQFQALSARAEQFHD

SEQ ID NO: 805430 - protein, 31 aa, Mycobacterium
DYARTLEILERFYGLVLTDCGTGLLHSAMSA

SEQ ID NO: 805431 - protein, 24 aa, Mycobacterium
DYARVLSPLHRLLRDIVGQGITEG

SEQ ID NO: 805432 - protein, 23 aa, Mycobacterium
DYARVLTPLHRLTRDIVGQGITE

SEQ ID NO: 805433 - protein, 20 aa, Mycobacterium
DYATLLPLADIGTAFVITMP

SEQ ID NO: 805434 - protein, 23 aa, Mycobacterium
DYATNAPLYPRLHEYFRAGQVPL

SEQ ID NO: 805435 - protein, 27 aa, Mycobacterium
DYAVLNATIRYLMFSVFAVRPGELGEQ

SEQ ID NO: 805436 - protein, 31 aa, Mycobacterium
DYCCMPLFHGNAIMALWAPALANGATVCLTP

SEQ ID NO: 805437 - protein, 23 aa, Mycobacterium
DYDAKFGMRVWHRDFFDAEIVAC

SEQ ID NO: 805438 - protein, 18 aa, Mycobacterium
DYDFHLFTEIGTASAGVL

SEQ ID NO: 805439 - protein, 18 aa, Mycobacterium
DYDLAISAYLLVYARDRD

SEQ ID NO: 805440 - protein, 25 aa, Mycobacterium
DYDMLTWRKVKLPRQPRYGDLLIYP

SEQ ID NO: 805441 - protein, 26 aa, Mycobacterium
DYDSQTLFLGCVLHDLGAGSAAPGKA

SEQ ID NO: 805442 - protein, 18 aa, Mycobacterium
DYDYLIYAVGSTGATPPA

SEQ ID NO: 805443 - protein, 25 aa, Mycobacterium
DYEIDLIDDRPLREALKPYMRRGRR

SEQ ID NO: 805444 - protein, 19 aa, Mycobacterium
DYEIEIAVVIGKPGYRIER

SEQ ID NO: 805445 - protein, 32 aa, Mycobacterium
DYEIKVICDKGFPAYFLIVADLINYAKSVGIR

SEQ ID NO: 805446 - protein, 23 aa, Mycobacterium
DYEIPGLADAIRRSGLPKVPTSV

SEQ ID NO: 805447 - protein, 22 aa, Mycobacterium
DYELALLLRDIFTAAGGTHDNW

SEQ ID NO: 805448 - protein, 24 aa, Mycobacterium
DYELVLDPRFRTAATWLPALKAWR

SEQ ID NO: 805449 - protein, 24 aa, Mycobacterium
DYELVLDPRFRTAATWPASLRAWR

SEQ ID NO: 805450 - protein, 29 aa, Mycobacterium
DYETRQHWQRFWLVDPLDGTKEFIKGSDE

SEQ ID NO: 805451 - protein, 18 aa, Mycobacterium
DYETWKHIAPVQRAAWSR

SEQ ID NO: 805452 - protein, 27 aa, Mycobacterium
DYEVLDLLDALVGKSLLIVDRLSGRSR

SEQ ID NO: 805453 - protein, 18 aa, Mycobacterium
DYFAPILASRRAEPKDDL

SEQ ID NO: 805454 - protein, 22 aa, Mycobacterium
DYFCVGPCWPTPTKPGREAPGL

SEQ ID NO: 805455 - protein, 23 aa, Mycobacterium
DYFKKTFSWLPDDGVQMLHTIII

SEQ ID NO: 805456 - protein, 27 aa, Mycobacterium
DYFRKLSGYDTLRLVLAKSTILVEGPC

SEQ ID NO: 805457 - protein, 17 aa, Mycobacterium
DYFTAAFELLAAGGKSA

SEQ ID NO: 805458 - protein, 18 aa, Mycobacterium
DYFVHRLAEGKTKNEIMR

SEQ ID NO: 805459 - protein, 21 aa, Mycobacterium
DYFVSQLEIVLPVLGVNAIRV

SEQ ID NO: 805460 - protein, 18 aa, Mycobacterium
DYFVTPALQRFTGSIPAE

SEQ ID NO: 805461 - protein, 21 aa, Mycobacterium
DYGAALDFYRDVLGWRTESES

SEQ ID NO: 805462 - protein, 28 aa, Mycobacterium
DYGAIYDKWLTLGPLVDKFGLTTKGITV

SEQ ID NO: 805463 - protein, 18 aa, Mycobacterium
DYGDFLRSLVDIGGDRPL

SEQ ID NO: 805464 - protein, 27 aa, Mycobacterium
DYGGMGGDYFALALALEELGKVDQSVA

SEQ ID NO: 805465 - protein, 26 aa, Mycobacterium
DYGHAFVSFLDKYPNALSPRSSLLVL

SEQ ID NO: 805466 - protein, 17 aa, Mycobacterium
DYGLAFRLLSSAHENVM

SEQ ID NO: 805467 - protein, 18 aa, Mycobacterium
DYGLAVERAIDAYLEAWP

SEQ ID NO: 805468 - protein, 19 aa, Mycobacterium
DYGLLRYLRADTAERLAPL

SEQ ID NO: 805469 - protein, 21 aa, Mycobacterium
DYGLVAWPKTSGSRGFHIYAR

SEQ ID NO: 805470 - protein, 18 aa, Mycobacterium
DYGPDFGLTYVLDGLAAM

SEQ ID NO: 805471 - protein, 18 aa, Mycobacterium
DYGPELRQWLVERLGLAE

SEQ ID NO: 805472 - protein, 31 aa, Mycobacterium
DYGRILDILERFYGLVLTDCGPGLLHSVMKS

SEQ ID NO: 805473 - protein, 27 aa, Mycobacterium
DYGTYYKGHLYIAGRIKDLVIIDGRNH

SEQ ID NO: 805474 - protein, 31 aa, Mycobacterium
DYGVGLGLNFLPRATAGLLPWRDRLDAGAHW

SEQ ID NO: 805475 - protein, 19 aa, Mycobacterium
DYGVRAPFRLVQFDLALAH

SEQ ID NO: 805476 - protein, 18 aa, Mycobacterium
DYGYPLRGTVHDPTARRM

SEQ ID NO: 805477 - protein, 20 aa, Mycobacterium
DYHFRRSALPRPGRVRELLE

SEQ ID NO: 805478 - protein, 18 aa, Mycobacterium
DYHLAYAAALVDKGEYDK

SEQ ID NO: 805479 - protein, 19 aa, Mycobacterium
DYHLRRSALPEPGRVRDLL

SEQ ID NO: 805480 - protein, 20 aa, Mycobacterium
DYHLRRSALPEPGRVRDLLE

SEQ ID NO: 805481 - protein, 25 aa, Mycobacterium
DYHNVAQMHYPSWRLSYRGIMTPET

SEQ ID NO: 805482 - protein, 19 aa, Mycobacterium
DYILELLLEQSTADIAYED

SEQ ID NO: 805483 - protein, 17 aa, Mycobacterium
DYILRTVNTVLAIPLTH

SEQ ID NO: 805484 - protein, 19 aa, Mycobacterium
DYIMKPFKPKELVARVRAR

SEQ ID NO: 805485 - protein, 21 aa, Mycobacterium
DYIVVFLGALEAGFIAVPLSV

SEQ ID NO: 805486 - protein, 19 aa, Mycobacterium
DYIWPRRSAAAARAYCRDL

SEQ ID NO: 805487 - protein, 25 aa, Mycobacterium
DYKGRQVVVYFYPAASTPGCTKQAC

SEQ ID NO: 805488 - protein, 24 aa, Mycobacterium
DYKGRRVVVYFYPAASTPGCTKEA

SEQ ID NO: 805489 - protein, 30 aa, Mycobacterium
DYKRHAGLDLLPRLLLRGGDRGDELDVAVV

SEQ ID NO: 805490 - protein, 24 aa, Mycobacterium
DYLAELTMLILAKAQAKDPAGGYA

SEQ ID NO: 805491 - protein, 24 aa, Mycobacterium
DYLEDEAYWRKNLPPEGGHDYQLP

SEQ ID NO: 805492 - protein, 18 aa, Mycobacterium
DYLHRMLQFLQWQKRRRG

SEQ ID NO: 805493 - protein, 17 aa, Mycobacterium
DYLKRLTADLRRARRRV

SEQ ID NO: 805494 - protein, 19 aa, Mycobacterium
DYLKVIWNAQEWSPKDAPQ

SEQ ID NO: 805495 - protein, 31 aa, Mycobacterium
DYLLGCRDEISWRYFPGFEPLPYDADSLGQM

SEQ ID NO: 805496 - protein, 21 aa, Mycobacterium
DYLLQSADLCRRELFDAYTGT

SEQ ID NO: 805497 - protein, 20 aa, Mycobacterium
DYLNWESRSWRLSETGDYQE

SEQ ID NO: 805498 - protein, 17 aa, Mycobacterium
DYLQAGSIYPAMQNFYL

SEQ ID NO: 805499 - protein, 20 aa, Mycobacterium
DYLRQHGFTVLDRNWRCRHG

SEQ ID NO: 805500 - protein, 30 aa, Mycobacterium
DYLRTLEVLERFYSLVLTDCGTGLIHSAMS

SEQ ID NO: 805501 - protein, 18 aa, Mycobacterium
DYLTWDARSWRLDADGQF

SEQ ID NO: 805502 - protein, 20 aa, Mycobacterium
DYLVRQFGFFPTESGYAGVA

SEQ ID NO: 805503 - protein, 34 aa, Mycobacterium
DYMATRGVGFLGWNTRYRGFESSFLLDHALVDIG

SEQ ID NO: 805504 - protein, 23 aa, Mycobacterium
DYNELVITAPMRLTLPAIETSPA

SEQ ID NO: 805505 - protein, 26 aa, Mycobacterium
DYNLEFLDHIVAHPAIRWVGNANELN

SEQ ID NO: 805506 - protein, 19 aa, Mycobacterium
DYNLQWKPIGGFPVTVGWI

SEQ ID NO: 805507 - protein, 17 aa, Mycobacterium
DYPAFAAQPGIFTFGWG

SEQ ID NO: 805508 - protein, 18 aa, Mycobacterium
DYPALNDLLPWSSTGVTA

SEQ ID NO: 805509 - protein, 23 aa, Mycobacterium
DYPDELLHCIWAWQNRDANLVRS

SEQ ID NO: 805510 - protein, 17 aa, Mycobacterium
DYPFRCKRVLLGDDYYR

SEQ ID NO: 805511 - protein, 32 aa, Mycobacterium
DYPGDPWVVPKFYWTILGLSAFLAGRQALTPD

SEQ ID NO: 805512 - protein, 19 aa, Mycobacterium
DYPHWSYDSPAYAFNRFPP

SEQ ID NO: 805513 - protein, 31 aa, Mycobacterium
DYPQFQRWSISLLSWILNPERGLAAAAALCE

SEQ ID NO: 805514 - protein, 30 aa, Mycobacterium
DYPQFQRWSISLLSWILNPERGLAASSALC

SEQ ID NO: 805515 - protein, 30 aa, Mycobacterium
DYPQFQRWSISLLSWMLNPERGLAASAALC

SEQ ID NO: 805516 - protein, 25 aa, Mycobacterium
DYPVNFDVWWFKLPREGDADFSFLP

SEQ ID NO: 805517 - protein, 18 aa, Mycobacterium
DYPVVVMAPEGTGWHVKC

SEQ ID NO: 805518 - protein, 29 aa, Mycobacterium
DYQATRTHFFDEYFLAAAAAGIRQVVILA

SEQ ID NO: 805519 - protein, 18 aa, Mycobacterium
DYQFVHIDAEAFDGPYGN

SEQ ID NO: 805520 - protein, 28 aa, Mycobacterium
DYRGAKNVLLVFFPLAFTGICQGELDQI

SEQ ID NO: 805521 - protein, 28 aa, Mycobacterium
DYRGTKDVLLVFFPLAFTGICQGELDQV

SEQ ID NO: 805522 - protein, 29 aa, Mycobacterium
DYRKFLDRNLIGHIPLIGGGLSLLVSDGV

SEQ ID NO: 805523 - protein, 17 aa, Mycobacterium
DYRLVLAAAQREALGLL

SEQ ID NO: 805524 - protein, 26 aa, Mycobacterium
DYRPLDGFVYAITPFNFTSIAGNLPT

SEQ ID NO: 805525 - protein, 25 aa, Mycobacterium
DYRRDDWWRGLGHYDLVLDALGGTS

SEQ ID NO: 805526 - protein, 24 aa, Mycobacterium
DYRREMGELFAPFTKVAAKNPFAS

SEQ ID NO: 805527 - protein, 24 aa, Mycobacterium
DYRRQMGELFAPFTKVAAKNPFAS

SEQ ID NO: 805528 - protein, 21 aa, Mycobacterium
DYRRWPLTESGDSIYWAGLNK

SEQ ID NO: 805529 - protein, 24 aa, Mycobacterium
DYRTLLEFFFQIHDPTTKNRQGND

SEQ ID NO: 805530 - protein, 18 aa, Mycobacterium
DYRTLRSAEKALRDQGFA

SEQ ID NO: 805531 - protein, 26 aa, Mycobacterium
DYSEAIALSRLGWAALAVGTSHAVLD

SEQ ID NO: 805532 - protein, 28 aa, Mycobacterium
DYSKFLDRSLIGRVPLIGGVLSLLTSDG

SEQ ID NO: 805533 - protein, 25 aa, Mycobacterium
DYSLGAFAVWLRDFLDELGVSQATV

SEQ ID NO: 805534 - protein, 23 aa, Mycobacterium
DYSRRYTDLPFLIKLEERGDMLV

SEQ ID NO: 805535 - protein, 26 aa, Mycobacterium
DYSVWEIWGPLLNGGRLLMVPDAVVR

SEQ ID NO: 805536 - protein, 24 aa, Mycobacterium
DYTERLPEFLSWTRSVRNLLNAPE

SEQ ID NO: 805537 - protein, 23 aa, Mycobacterium
DYTPLALCTKAIQTLVRLPQRSV

SEQ ID NO: 805538 - protein, 19 aa, Mycobacterium
DYTQLRFPKRQGMRIDFIL

SEQ ID NO: 805539 - protein, 18 aa, Mycobacterium
DYTRRLLGAVPQPDPGRR

SEQ ID NO: 805540 - protein, 36 aa, Mycobacterium
DYTSRGWAMNSLFDGIPALLSDLRAAGVRLAVATSK

SEQ ID NO: 805541 - protein, 22 aa, Mycobacterium
DYTTRMVVLTPADPARFNGTVL

SEQ ID NO: 805542 - protein, 17 aa, Mycobacterium
DYVAGFYAAIKAGTIAV

SEQ ID NO: 805543 - protein, 18 aa, Mycobacterium
DYVDVGLRVPKILDYAAM

SEQ ID NO: 805544 - protein, 17 aa, Mycobacterium
DYVELHRRHGCTLQIGG

SEQ ID NO: 805545 - protein, 17 aa, Mycobacterium
DYVELHRRYGCRLQIGG

SEQ ID NO: 805546 - protein, 19 aa, Mycobacterium
DYVMALGYLQAPVVVAGDD

SEQ ID NO: 805547 - protein, 24 aa, Mycobacterium
DYVNAMRLRTLIQAAWNEMFTGID

SEQ ID NO: 805548 - protein, 25 aa, Mycobacterium
DYVQPRAVIYHRALGAQFADVLARE

SEQ ID NO: 805549 - protein, 25 aa, Mycobacterium
DYVTAVAPELLPRITRYEPAGSPEA

SEQ ID NO: 805550 - protein, 34 aa, Mycobacterium
DYVTIVLPNSIDWAYAVLACWKLGAVPQPLSARM

SEQ ID NO: 805551 - protein, 17 aa, Mycobacterium
DYWDFNSLVSFAPPNHF

SEQ ID NO: 805552 - protein, 24 aa, Mycobacterium
DYYEKYRQYRWDLGLRRDYQRAAF

SEQ ID NO: 805553 - protein, 24 aa, Mycobacterium
DYYGIPMATLHYIPMRPNGRVVPG

SEQ ID NO: 805554 - protein, 25 aa, Mycobacterium
DYYGQTHVPLTLKIPGLTGFTTGKP

SEQ ID NO: 805555 - protein, 21 aa, Mycobacterium
DYYLARGVTWVQDAWVEPADV

SEQ ID NO: 805556 - protein, 18 aa, Mycobacterium
DYYLSIAQVMVPHIAGRP

SEQ ID NO: 805557 - protein, 20 aa, Mycobacterium
DYYRNGGILQYVLRNMLKSG

SEQ ID NO: 805558 - protein, 25 aa, Mycobacterium
EAAAAALLPGPLLSTATASAVAGLA

SEQ ID NO: 805559 - protein, 24 aa, Mycobacterium
EAAAAWGSLADELQVAASSFSSVT

SEQ ID NO: 805560 - protein, 26 aa, Mycobacterium
EAAAIDPQHRLLLETAWEAVEHSGLN

SEQ ID NO: 805561 - protein, 23 aa, Mycobacterium
EAAALGRRVLFLASGGLSHDPPV

SEQ ID NO: 805562 - protein, 17 aa, Mycobacterium
EAAALLAAARRPVVIAG

SEQ ID NO: 805563 - protein, 23 aa, Mycobacterium
EAAAPFSAFVFKVQAGMDSAHRD

SEQ ID NO: 805564 - protein, 21 aa, Mycobacterium
EAAARLRLARALPLRVGDVGL

SEQ ID NO: 805565 - protein, 24 aa, Mycobacterium
EAADAALTDLVRRGGLRPGRTERE

SEQ ID NO: 805566 - protein, 17 aa, Mycobacterium
EAADASVYLVRHPDRYP

SEQ ID NO: 805567 - protein, 24 aa, Mycobacterium
EAADLGPRRALTGEPLAPQLSATA

SEQ ID NO: 805568 - protein, 24 aa, Mycobacterium
EAADLGPRRALTGEPLPAQLTATA

SEQ ID NO: 805569 - protein, 23 aa, Mycobacterium
EAAEAFLAGRIRFPAIVRTVAEV

SEQ ID NO: 805570 - protein, 26 aa, Mycobacterium
EAAEAFLQRRIGFPVIVKTVADVLHA

SEQ ID NO: 805571 - protein, 24 aa, Mycobacterium
EAAEDWLYLLEAFDQPHRPGLVRA

SEQ ID NO: 805572 - protein, 24 aa, Mycobacterium
EAAELGPRRALSGEPLAPVLAATA

SEQ ID NO: 805573 - protein, 24 aa, Mycobacterium
EAAELGPRRALSGEPLPPVLAATA

SEQ ID NO: 805574 - protein, 19 aa, Mycobacterium
EAAELLAAAVRNAVRIPLA

SEQ ID NO: 805575 - protein, 18 aa, Mycobacterium
EAAELMTAAVRSGIRIPL

SEQ ID NO: 805576 - protein, 28 aa, Mycobacterium
EAAEVFETWLHQLAGWFGQLDIGDEQSR

SEQ ID NO: 805577 - protein, 26 aa, Mycobacterium
EAAEWFAGRLPDGWFTGDPTVIVDRE

SEQ ID NO: 805578 - protein, 20 aa, Mycobacterium
EAAFAMTVPPPAVAANRAQL

SEQ ID NO: 805579 - protein, 25 aa, Mycobacterium
EAAFAMTVPPPVIAANRVLLANLVA

SEQ ID NO: 805580 - protein, 25 aa, Mycobacterium
EAAFDRLFGALDWLSDRLASRRYLV

SEQ ID NO: 805581 - protein, 19 aa, Mycobacterium
EAAFLWHLTLDAGDSRTRI

SEQ ID NO: 805582 - protein, 20 aa, Mycobacterium
EAAFQFRLTVTAGDDAMRVE

SEQ ID NO: 805583 - protein, 27 aa, Mycobacterium
EAAFSVGEFLALGYLPGVDVIVDSDEL

SEQ ID NO: 805584 - protein, 22 aa, Mycobacterium
EAAFTRWKALGATFIAARPSTQ

SEQ ID NO: 805585 - protein, 18 aa, Mycobacterium
EAAFVMTVPPPVVAANRV

SEQ ID NO: 805586 - protein, 21 aa, Mycobacterium
EAAGALWFALETDLPVLVDAD

SEQ ID NO: 805587 - protein, 27 aa, Mycobacterium
EAAGEWFARILFSLFSTPSSTLDMDDP

SEQ ID NO: 805588 - protein, 25 aa, Mycobacterium
EAAGLLRDILAARLAFVVSGGTGAG

SEQ ID NO: 805589 - protein, 17 aa, Mycobacterium
EAAGSVFGIMLTARRVA

SEQ ID NO: 805590 - protein, 30 aa, Mycobacterium
EAAGVPVAFLTAWYGLADLAGVRAGESVLV

SEQ ID NO: 805591 - protein, 26 aa, Mycobacterium
EAAGYKPGLIVLSAADWEAVELLNAT

SEQ ID NO: 805592 - protein, 29 aa, Mycobacterium
EAAHAAVRLGGLRPLLVTDPGLIEAGWVD

SEQ ID NO: 805593 - protein, 27 aa, Mycobacterium
EAAHARMFQLPLYPTLTLAEQDRVIGV

SEQ ID NO: 805594 - protein, 23 aa, Mycobacterium
EAAIDGWRRVVVTATQLGIPIPG

SEQ ID NO: 805595 - protein, 24 aa, Mycobacterium
EAAIGVFLYVRYQPAFPLSQGGVC

SEQ ID NO: 805596 - protein, 25 aa, Mycobacterium
EAAIKAALWELIWAGRVCGDTFAPV

SEQ ID NO: 805597 - protein, 25 aa, Mycobacterium
EAAKHKGITYFLIDMKSPGIVIRPL

SEQ ID NO: 805598 - protein, 24 aa, Mycobacterium
EAAKLDAVFLADSPVLDPHIRHRT

SEQ ID NO: 805599 - protein, 25 aa, Mycobacterium
EAAKLIAAARKPVLYVGGGVIRGDA

SEQ ID NO: 805600 - protein, 17 aa, Mycobacterium
EAAKLLERFRAMEPWLD

SEQ ID NO: 805601 - protein, 22 aa, Mycobacterium
EAAKPFIAALCDAQAALAGAAG

SEQ ID NO: 805602 - protein, 19 aa, Mycobacterium
EAALADHLLWLDDPDPRVP

SEQ ID NO: 805603 - protein, 20 aa, Mycobacterium
EAALALDVRVLVLGGGEDRN

SEQ ID NO: 805604 - protein, 20 aa, Mycobacterium
EAALALMLDGLKPGGLLLLR

SEQ ID NO: 805605 - protein, 24 aa, Mycobacterium
EAALLAPRPSLTGPALPPQLAATA

SEQ ID NO: 805606 - protein, 18 aa, Mycobacterium
EAALPGLHDWVDEQLAQD

SEQ ID NO: 805607 - protein, 23 aa, Mycobacterium
EAALTALKALTLHPNRLGDPAEY

SEQ ID NO: 805608 - protein, 27 aa, Mycobacterium
EAAMLELLLGAWLAQGITAAAQLGVAD

SEQ ID NO: 805609 - protein, 21 aa, Mycobacterium
EAANALRQFGLRTHVIEMMPR

SEQ ID NO: 805610 - protein, 18 aa, Mycobacterium
EAANALRQFGLRTHVLEM

SEQ ID NO: 805611 - protein, 25 aa, Mycobacterium
EAANASFLQDPLQTALNAINTPVQD

SEQ ID NO: 805612 - protein, 48 aa, Mycobacterium
EAANASPLQAAQQQALAVINAPTNALLGRPLIGNGTDGLAGTGAAGGA

SEQ ID NO: 805613 - protein, 22 aa, Mycobacterium
EAANFERISGELKGVIAQVEST

SEQ ID NO: 805614 - protein, 18 aa, Mycobacterium
EAANGVPIPIAWPDRLVA

SEQ ID NO: 805615 - protein, 23 aa, Mycobacterium
EAANLLRSPVRLGRDEYGGLARD

SEQ ID NO: 805616 - protein, 29 aa, Mycobacterium
EAANSSPLQALQDLTLNAINAPAQSLFGR

SEQ ID NO: 805617 - protein, 25 aa, Mycobacterium
EAAPPYTVPGGLLLERRTNGITALE

SEQ ID NO: 805618 - protein, 23 aa, Mycobacterium
EAAPVLRSFAVKVPVGVGFAKRA

SEQ ID NO: 805619 - protein, 19 aa, Mycobacterium
EAAPYAADETRALTLWALS

SEQ ID NO: 805620 - protein, 41 aa, Mycobacterium
EAAQAAMIHPLLVAANRNTFVRLVMSNLFGFNAPAIAAAEF

SEQ ID NO: 805621 - protein, 19 aa, Mycobacterium
EAAQLPLALLTPDMRDRQI

SEQ ID NO: 805622 - protein, 18 aa, Mycobacterium
EAAQQTWFRASALAERVG

SEQ ID NO: 805623 - protein, 22 aa, Mycobacterium
EAAQRISQSVPWPLIREQTPSD

SEQ ID NO: 805624 - protein, 29 aa, Mycobacterium
EAARAARVIVPDFQLSLAIGKEGQNARLA

SEQ ID NO: 805625 - protein, 23 aa, Mycobacterium
EAARAWWGNFLVQKANEAGVELD

SEQ ID NO: 805626 - protein, 22 aa, Mycobacterium
EAARAWWGNFLVRKANENGVEL

SEQ ID NO: 805627 - protein, 20 aa, Mycobacterium
EAAREWYFSDAYQAAAKIRQ

SEQ ID NO: 805628 - protein, 24 aa, Mycobacterium
EAARFSSAFTFQYSKRPGTPAAEL

SEQ ID NO: 805629 - protein, 23 aa, Mycobacterium
EAARIRETIAALGGLPGADHGEH

SEQ ID NO: 805630 - protein, 17 aa, Mycobacterium
EAARLMVYTAAARAERG

SEQ ID NO: 805631 - protein, 19 aa, Mycobacterium
EAARLMVYTAAARAERGEK

SEQ ID NO: 805632 - protein, 18 aa, Mycobacterium
EAARWGVRELFLTGGEPF

SEQ ID NO: 805633 - protein, 24 aa, Mycobacterium
EAASLLSARLQSFGQWMNEGATSA

SEQ ID NO: 805634 - protein, 38 aa, Mycobacterium
EAASQNLLNLVNAPTQALLNRPLIGNGANGAAGTGASG

SEQ ID NO: 805635 - protein, 26 aa, Mycobacterium
EAATLYDMFVRTLGVSAGTYAAAETA

SEQ ID NO: 805636 - protein, 31 aa, Mycobacterium
EAATSQGIAFIPWFPLASGPLAAPDGPLRKI

SEQ ID NO: 805637 - protein, 18 aa, Mycobacterium
EAAVAWDGLSAELGTAAE

SEQ ID NO: 805638 - protein, 18 aa, Mycobacterium
EAAVEEIGILLTAARQPH

SEQ ID NO: 805639 - protein, 22 aa, Mycobacterium
EAAVEHLFAVTSGLDSAVIGEQ

SEQ ID NO: 805640 - protein, 24 aa, Mycobacterium
EAAVKRREWMAGRRDRLADQRDRI

SEQ ID NO: 805641 - protein, 24 aa, Mycobacterium
EAAVNLLSRLTFCGARAGRAHLQQ

SEQ ID NO: 805642 - protein, 25 aa, Mycobacterium
EAAVPAWQLLGVVDQYWQSGPAPAT

SEQ ID NO: 805643 - protein, 29 aa, Mycobacterium
EAAVRDLIPALEYLQQALATKAKAWKTVV

SEQ ID NO: 805644 - protein, 17 aa, Mycobacterium
EAAVRELLIAIGEDPER

SEQ ID NO: 805645 - protein, 22 aa, Mycobacterium
EAAVRHLIPALEVLHDALASKA

SEQ ID NO: 805646 - protein, 29 aa, Mycobacterium
EAAVVEHSLWWPVDVPPAELAAALVPLHD

SEQ ID NO: 805647 - protein, 26 aa, Mycobacterium
EAAWANRLTVESLPLFGADWTRTADL

SEQ ID NO: 805648 - protein, 25 aa, Mycobacterium
EAAWWFITMERSCQAQLLAMAAGEP

SEQ ID NO: 805649 - protein, 25 aa, Mycobacterium
EAAYQQLPAPLRTLADNLWAVHTNR

SEQ ID NO: 805650 - protein, 17 aa, Mycobacterium
EAAYREPPPPRRDRIPI

SEQ ID NO: 805651 - protein, 24 aa, Mycobacterium
EACARALFVHPNTVRYRLKRITDF

SEQ ID NO: 805652 - protein, 35 aa, Mycobacterium
EACARKLFIHPNTVRYRLKRITDFTGRDPTVPRDA

SEQ ID NO: 805653 - protein, 33 aa, Mycobacterium
EACARKLFVHPNTIRYRLKRITDFTGRDPTQPR

SEQ ID NO: 805654 - protein, 34 aa, Mycobacterium
EACARKLFVHPNTIRYRLKRITDFTGRDPTQPRD

SEQ ID NO: 805655 - protein, 35 aa, Mycobacterium; identical to SEQ ID NO: 114069

SEQ ID NO: 805656 - protein, 34 aa, Mycobacterium
EACARKLFVHPNTVRYRLKRITDFTGRDPTQPRD

SEQ ID NO: 805657 - protein, 26 aa, Mycobacterium
EACARKLFVHPNTVRYRLRRIADFTG

SEQ ID NO: 805658 - protein, 20 aa, Mycobacterium
EACLAVVKLGLEAIIVKALE

SEQ ID NO: 805659 - protein, 18 aa, Mycobacterium
EACPVRIDIPSILVHLRA

SEQ ID NO: 805660 - protein, 24 aa, Mycobacterium
EACRDTLRWLAERGILVAPGEFYG

SEQ ID NO: 805661 - protein, 26 aa, Mycobacterium
EACRTLEFLGFKAARIADVGVAGIWR

SEQ ID NO: 805662 - protein, 19 aa, Mycobacterium
EACSLAVLIERAAKLQLAA

SEQ ID NO: 805663 - protein, 17 aa, Mycobacterium
EACTLAVLIERAAKLQL

SEQ ID NO: 805664 - protein, 25 aa, Mycobacterium
EACTRLIRSALPDSTLLVVVDPQPD

SEQ ID NO: 805665 - protein, 33 aa, Mycobacterium
EADAVFLARALLRDPAWIWRAAEQLGHQLPHPV

SEQ ID NO: 805666 - protein, 24 aa, Mycobacterium
EADDLPLNRMLLASTAAHYAWDDV

SEQ ID NO: 805667 - protein, 25 aa, Mycobacterium
EADDPAPLWLAAPVTEVLPRVVVGP

SEQ ID NO: 805668 - protein, 29 aa, Mycobacterium
EADEMLDLGFLPDIERILALAPSADAGRQ

SEQ ID NO: 805669 - protein, 47 aa, Mycobacterium
EADEMLDLGFLPDIERILKQIPAKRQAMLFSATMPDPIITLARTFMT

SEQ ID NO: 805670 - protein, 28 aa, Mycobacterium
EADEMLDLGFLPDIERILQLTPDSRQAM

SEQ ID NO: 805671 - protein, 33 aa, Mycobacterium
EADEMLDLGFLPDIERILRQIPADRQSMLFSAT

SEQ ID NO: 805672 - protein, 31 aa, Mycobacterium
EADEMLDLGFLPDIERILRQIPAERQSMLFS

SEQ ID NO: 805673 - protein, 26 aa, Mycobacterium
EADEMLDLGFLPDIERILRQIPEERQ

SEQ ID NO: 805674 - protein, 32 aa, Mycobacterium
EADEMLDLGFLPDIERILRQIPVDRQSMLFSA

SEQ ID NO: 805675 - protein, 28 aa, Mycobacterium
EADFDAERWYRILQDQGVSVWYTAPTAI

SEQ ID NO: 805676 - protein, 28 aa, Mycobacterium
EADGAGLYPWIPTLKLHYVRIIPAQITG

SEQ ID NO: 805677 - protein, 17 aa, Mycobacterium
EADGLVFPTRRWVHPIG

SEQ ID NO: 805678 - protein, 34 aa, Mycobacterium
EADGYPLHSFPGEPPFVRGPYPTMYVNQPWTIRQ

SEQ ID NO: 805679 - protein, 27 aa, Mycobacterium
EADHLADLGFLPTVTRILAATPAGGQR

SEQ ID NO: 805680 - protein, 19 aa, Mycobacterium
EADHLDFFGSEQAYTAVFD

SEQ ID NO: 805681 - protein, 29 aa, Mycobacterium
EADHMADLGFLPGVTRILAATPNGGQRLL

SEQ ID NO: 805682 - protein, 28 aa, Mycobacterium
EADHMADLGFLPGVTRILAATPRGGQRL

SEQ ID NO: 805683 - protein, 28 aa, Mycobacterium
EADHMADLGFLPGVTRILAATPSGGQRL

SEQ ID NO: 805684 - protein, 30 aa, Mycobacterium
EADIAALHRFGLPLVVIDPLNQPTTRITSV

SEQ ID NO: 805685 - protein, 20 aa, Mycobacterium
EADLAARYLGAARDLGMDAV

SEQ ID NO: 805686 - protein, 26 aa, Mycobacterium
EADLEHWRWMWETNVVGTLQVTRALL

SEQ ID NO: 805687 - protein, 28 aa, Mycobacterium
EADLPAFGKLLSSFPWPLNKTTTVAKCA

SEQ ID NO: 805688 - protein, 26 aa, Mycobacterium
EADLRSDIWIKLMGNVAFNPLSALTR

SEQ ID NO: 805689 - protein, 25 aa, Mycobacterium
EADNPHILTLSPPITLEPKWFERTT

SEQ ID NO: 805690 - protein, 19 aa, Mycobacterium
EADPAVRVIVLTGAGKGFC

SEQ ID NO: 805691 - protein, 18 aa, Mycobacterium
EADPLALRLRVFALAAVA

SEQ ID NO: 805692 - protein, 24 aa, Mycobacterium
EADPTLDRILLGTALRQLSDEHRA

SEQ ID NO: 805693 - protein, 33 aa, Mycobacterium
EADQLLEGLLARRRGWFEARWVRIAMYHRAARW

SEQ ID NO: 805694 - protein, 19 aa, Mycobacterium
EADQSIRLFGWYREAIQQI

SEQ ID NO: 805695 - protein, 17 aa, Mycobacterium
EADQWLVPSPQLIETHA

SEQ ID NO: 805696 - protein, 29 aa, Mycobacterium
EADREIGLLLPCNVLVRADPDRPGDVLVE

SEQ ID NO: 805697 - protein, 28 aa, Mycobacterium
EADRPSLATTLLPGLLEALARNVSRGAV

SEQ ID NO: 805698 - protein, 21 aa, Mycobacterium
EADRRLRLADEQIERRLDQAR

SEQ ID NO: 805699 - protein, 21 aa, Mycobacterium
EADRRLSALLWAVADTAIAED

SEQ ID NO: 805700 - protein, 25 aa, Mycobacterium
EADRTWMIDTLLALLQTPSPSGRTD

SEQ ID NO: 805701 - protein, 25 aa, Mycobacterium
EADRTWMVDTLLALLQTPSPAGRTD

SEQ ID NO: 805702 - protein, 23 aa, Mycobacterium
EADRVELILDRTPFYAEAGGQIA

SEQ ID NO: 805703 - protein, 23 aa, Mycobacterium
EADTLLMLGTDFPYQQFYPENAT

SEQ ID NO: 805704 - protein, 24 aa, Mycobacterium
EADTLLMLGTDFPYQQFYPENATV

SEQ ID NO: 805705 - protein, 25 aa, Mycobacterium
EADTPLYLRYVIFGGERLTSSDLIP

SEQ ID NO: 805706 - protein, 24 aa, Mycobacterium
EADVPIVPVIVWGAQRIWTKGHPR

SEQ ID NO: 805707 - protein, 23 aa, Mycobacterium
EADVPLRLWQQEWPPGPRASRDA

SEQ ID NO: 805708 - protein, 29 aa, Mycobacterium
EADWDDMIGVNLSGVWKTVKAAVPHLISG

SEQ ID NO: 805709 - protein, 27 aa, Mycobacterium
EAEAAQPLYARYWLHNRGPAPLGGLPA

SEQ ID NO: 805710 - protein, 24 aa, Mycobacterium
EAEAHPHWLVQRTVIDVIEPIEFP

SEQ ID NO: 805711 - protein, 17 aa, Mycobacterium
EAEAILAQIQRLLGSPW

SEQ ID NO: 805712 - protein, 28 aa, Mycobacterium
EAEDKFGFLLEAFTFGAPPHGGIAFGWD

SEQ ID NO: 805713 - protein, 21 aa, Mycobacterium
EAEEALFYRPVHPLLGQPVRA

SEQ ID NO: 805714 - protein, 30 aa, Mycobacterium
EAEGLKELYTFFTPLLRNLAPCARVVVVGT

SEQ ID NO: 805715 - protein, 26 aa, Mycobacterium
EAEGLLGWLHRVLEHLPGPDRLHPLY

SEQ ID NO: 805716 - protein, 17 aa, Mycobacterium
EAEGLPYRSVLGLADLG

SEQ ID NO: 805717 - protein, 26 aa, Mycobacterium
EAEHKAYAIPFPPLGERFDRLTEQLE

SEQ ID NO: 805718 - protein, 24 aa, Mycobacterium
EAEHYLWTWIDQAAGTIRARMFAP

SEQ ID NO: 805719 - protein, 18 aa, Mycobacterium
EAEIIYQIGALQAIAHVA

SEQ ID NO: 805720 - protein, 23 aa, Mycobacterium
EAEIRGHRRTYVGALPGRIVRAI

SEQ ID NO: 805721 - protein, 26 aa, Mycobacterium
EAEKRGLTPMLALKSWAVTGCAPEKM

SEQ ID NO: 805722 - protein, 27 aa, Mycobacterium
EAEKRSLEPLLTLRSWSVTGCAPETMG

SEQ ID NO: 805723 - protein, 24 aa, Mycobacterium
EAELDQLIGFFVNILVLRNDLTGN

SEQ ID NO: 805724 - protein, 25 aa, Mycobacterium
EAELDQLIGFFVNILVLRNDMDGNP

SEQ ID NO: 805725 - protein, 18 aa, Mycobacterium
EAELIDYCRAHLAAYKCP

SEQ ID NO: 805726 - protein, 18 aa, Mycobacterium
EAELIEYCRAHLAGYKCP

SEQ ID NO: 805727 - protein, 25 aa, Mycobacterium
EAELLGTAFLLIVAGYETTVNLLAN

SEQ ID NO: 805728 - protein, 39 aa, Mycobacterium
EAELLLEPLARELVVVRPIGFEPMRWIRALAAEEPLPST

SEQ ID NO: 805729 - protein, 24 aa, Mycobacterium
EAELMAWAVPQAANQFWMLGEPER

SEQ ID NO: 805730 - protein, 20 aa, Mycobacterium
EAEMAGARQALDAALAELTE

SEQ ID NO: 805731 - protein, 18 aa, Mycobacterium
EAEMFVGIELSATMLFNH

SEQ ID NO: 805732 - protein, 17 aa, Mycobacterium
EAEMLYALAILEASEGE

SEQ ID NO: 805733 - protein, 17 aa, Mycobacterium
EAEPLSSRPTGWRTRVR

SEQ ID NO: 805734 - protein, 23 aa, Mycobacterium
EAERDWEDFWAATRPIELTATVE

SEQ ID NO: 805735 - protein, 24 aa, Mycobacterium
EAEREGVRINWLRTITAFDHTELQ

SEQ ID NO: 805736 - protein, 24 aa, Mycobacterium
EAERIGFRRVFISERWDLKEADVI

SEQ ID NO: 805737 - protein, 25 aa, Mycobacterium
EAERNRVLPLLGGLAVVFGQLPPMP

SEQ ID NO: 805738 - protein, 40 aa, Mycobacterium
EAESLWGVLARALPAPWRAEALVLLAFSAYVRGDGPLTGV

SEQ ID NO: 805739 - protein, 28 aa, Mycobacterium
EAEVEARTTLLDWLRETLGLTGAKKGCN

SEQ ID NO: 805740 - protein, 25 aa, Mycobacterium
EAEVPIVPVIVWGAHRIWTKDHPRN

SEQ ID NO: 805741 - protein, 23 aa, Mycobacterium
EAFAAEPDFFWSPVNTLEDVVAD

SEQ ID NO: 805742 - protein, 19 aa, Mycobacterium
EAFALADHLLNCGPELVAL

SEQ ID NO: 805743 - protein, 24 aa, Mycobacterium
EAFAPVPMAWLKDIGADEKKLNPN

SEQ ID NO: 805744 - protein, 24 aa, Mycobacterium
EAFAPVPMAWLKDIGADETKLNPN

SEQ ID NO: 805745 - protein, 21 aa, Mycobacterium
EAFARIDTEFHLAVVRCARNN

SEQ ID NO: 805746 - protein, 18 aa, Mycobacterium
EAFASVVLAWQAETGADL

SEQ ID NO: 805747 - protein, 17 aa, Mycobacterium
EAFAWHIDLAKRCGKPL

SEQ ID NO: 805748 - protein, 26 aa, Mycobacterium
EAFDADFFAAWGKLAAVRTPTIAAVA

SEQ ID NO: 805749 - protein, 23 aa, Mycobacterium
EAFDCSGLVQWSYARAGIHLDRT

SEQ ID NO: 805750 - protein, 21 aa, Mycobacterium
EAFDRWGLVPRMFVGAATRDL

SEQ ID NO: 805751 - protein, 23 aa, Mycobacterium
EAFELVVVNLYPFSQTVESGASV

SEQ ID NO: 805752 - protein, 19 aa, Mycobacterium
EAFFVLSGTWRLYNGENWA

SEQ ID NO: 805753 - protein, 22 aa, Mycobacterium
EAFGLLCRTEGIIPAIESAHAV

SEQ ID NO: 805754 - protein, 33 aa, Mycobacterium
EAFGLLDALGKPVLWSMPLHWAGVHAGILANSP

SEQ ID NO: 805755 - protein, 24 aa, Mycobacterium
EAFGRGRPPVLYRASRRMDPSGPT

SEQ ID NO: 805756 - protein, 17 aa, Mycobacterium
EAFGRPVFGFQNTKFIL

SEQ ID NO: 805757 - protein, 17 aa, Mycobacterium
EAFGRPVFGFQNTKFTL

SEQ ID NO: 805758 - protein, 25 aa, Mycobacterium
EAFHQQFVQLMTTGAGSYAAAEAAN

SEQ ID NO: 805759 - protein, 19 aa, Mycobacterium
EAFHYRYHPLTLRVEEIIA

SEQ ID NO: 805760 - protein, 17 aa, Mycobacterium
EAFICGPGPFMAAAEEA

SEQ ID NO: 805761 - protein, 21 aa, Mycobacterium
EAFKRLLDINVLGVFHTVRAT

SEQ ID NO: 805762 - protein, 17 aa, Mycobacterium
EAFLPGLLEHGGHIAFT

SEQ ID NO: 805763 - protein, 18 aa, Mycobacterium
EAFLPKLLEHGGHIAFTA

SEQ ID NO: 805764 - protein, 17 aa, Mycobacterium
EAFLQGFRSFFGESAAD

SEQ ID NO: 805765 - protein, 30 aa, Mycobacterium
EAFLRLETEGWLRLYPKRGALVVPITPEER

SEQ ID NO: 805766 - protein, 25 aa, Mycobacterium
EAFPLVILEAMAWAVPVAASAVCAV

SEQ ID NO: 805767 - protein, 23 aa, Mycobacterium
EAFRERPVLVELILMRTSELSSE

SEQ ID NO: 805768 - protein, 20 aa, Mycobacterium
EAFRRLYFDTITHGVPQLEL

SEQ ID NO: 805769 - protein, 19 aa, Mycobacterium
EAFRTLCRTEGIIPAIESA

SEQ ID NO: 805770 - protein, 24 aa, Mycobacterium
EAFSRYGAHLPKVNVLPIYGGSSY

SEQ ID NO: 805771 - protein, 23 aa, Mycobacterium
EAFTALAARFLGPSLDGVRPVTR

SEQ ID NO: 805772 - protein, 18 aa, Mycobacterium
EAFTYFHPARTVRERIEH

SEQ ID NO: 805773 - protein, 19 aa, Mycobacterium
EAFVLAEKLGLSAQSLFDV

SEQ ID NO: 805774 - protein, 22 aa, Mycobacterium
EAFVLGVQWHPEERLDDLRLFR

SEQ ID NO: 805775 - protein, 17 aa, Mycobacterium
EAFWIHVNRETEMPARI

SEQ ID NO: 805776 - protein, 23 aa, Mycobacterium
EAGAILREKIVALAAHHLKVAES

SEQ ID NO: 805777 - protein, 37 aa, Mycobacterium
EAGALLFPGARGWITYLWVPPFASEKVRRRLRPMASN

SEQ ID NO: 805778 - protein, 24 aa, Mycobacterium
EAGARELHLYHLGLAGPDRRHLLG

SEQ ID NO: 805779 - protein, 31 aa, Mycobacterium
EAGATPYMVMLAAFGALLHRYTHADDVLIAS

SEQ ID NO: 805780 - protein, 23 aa, Mycobacterium
EAGDWISCWTMGLNQSTHGTWNT

SEQ ID NO: 805781 - protein, 25 aa, Mycobacterium
EAGFNIAGLFVGGPLSKGGTVAKGV

SEQ ID NO: 805782 - protein, 23 aa, Mycobacterium
EAGFVIVAIPPAHRAAIEFDPPL

SEQ ID NO: 805783 - protein, 23 aa, Mycobacterium
EAGFVIVAIPPAHRASIEFTPPL

SEQ ID NO: 805784 - protein, 25 aa, Mycobacterium
EAGGGRPLLAIARFGRFLAEVDIED

SEQ ID NO: 805785 - protein, 33 aa, Mycobacterium
EAGGKDNWFWIKVPVGYLYTIANPRTDWCFTTE

SEQ ID NO: 805786 - protein, 25 aa, Mycobacterium
EAGGLGAFMNWPGPTFTDSGGFQVL

SEQ ID NO: 805787 - protein, 20 aa, Mycobacterium
EAGGPLLFPISSSSTEGLRQ

SEQ ID NO: 805788 - protein, 29 aa, Mycobacterium
EAGHADVVILAYAAKFASAFYGPFREAVS

SEQ ID NO: 805789 - protein, 21 aa, Mycobacterium
EAGHLLAPPRTTLALDVLVDN

SEQ ID NO: 805790 - protein, 23 aa, Mycobacterium
EAGHLVRLWTLPDGPDGPCMVGL

SEQ ID NO: 805791 - protein, 24 aa, Mycobacterium
EAGHLVRVIPTESALRFVGAATFE

SEQ ID NO: 805792 - protein, 17 aa, Mycobacterium
EAGHRLPPLGELGDEFG

SEQ ID NO: 805793 - protein, 21 aa, Mycobacterium
EAGIAVFKVAFARWVEVEHET

SEQ ID NO: 805794 - protein, 17 aa, Mycobacterium
EAGIGFTVPLKTKTDDF

SEQ ID NO: 805795 - protein, 25 aa, Mycobacterium
EAGIIVPPPDFLPRVREICTQRNVL

SEQ ID NO: 805796 - protein, 33 aa, Mycobacterium
EAGKARILIGPDAYVFDLLTRLAPTHYYDVMNL

SEQ ID NO: 805797 - protein, 22 aa, Mycobacterium
EAGKFFGWLDQRGITALTELDT

SEQ ID NO: 805798 - protein, 29 aa, Mycobacterium
EAGKRLRLLQQYFFVTCSLQDILSIHLKR

SEQ ID NO: 805799 - protein, 23 aa, Mycobacterium
EAGLIAEALAMLGLRRLHVKRVV

SEQ ID NO: 805800 - protein, 23 aa, Mycobacterium
EAGLIAVPLPVPQFGIHDERISA

SEQ ID NO: 805801 - protein, 21 aa, Mycobacterium
EAGLLAPHWPAPYGRGASPAE

SEQ ID NO: 805802 - protein, 19 aa, Mycobacterium
EAGLLPGALTRNAGLHFVC

SEQ ID NO: 805803 - protein, 19 aa, Mycobacterium
EAGLLVDRLAVRATLVTAE

SEQ ID NO: 805804 - protein, 26 aa, Mycobacterium
EAGLMACLPYTWKQVVDTPLFAENEL

SEQ ID NO: 805805 - protein, 18 aa, Mycobacterium
EAGLMRHTLQPSEVADFL

SEQ ID NO: 805806 - protein, 19 aa, Mycobacterium
EAGLPAAGVWALCHSLAFD

SEQ ID NO: 805807 - protein, 24 aa, Mycobacterium
EAGLRKLHLLPSSPLDELRKQFPH

SEQ ID NO: 805808 - protein, 18 aa, Mycobacterium
EAGLVHRVIGRSGGIFIS

SEQ ID NO: 805809 - protein, 26 aa, Mycobacterium
EAGMAPFILMPGPINRGMIYLHEDPE

SEQ ID NO: 805810 - protein, 33 aa, Mycobacterium
EAGMTEPLYKMPWSTMFPLGISSATIGICEGAL

SEQ ID NO: 805811 - protein, 17 aa, Mycobacterium
EAGNIAVPLFAPELPGH

SEQ ID NO: 805812 - protein, 23 aa, Mycobacterium
EAGPAGAFRPLWAHNRTDERQAL

SEQ ID NO: 805813 - protein, 26 aa, Mycobacterium
EAGPGILYRLHLDLASLSIAEFYSDG

SEQ ID NO: 805814 - protein, 22 aa, Mycobacterium
EAGQWWRSYGNELWEFTSEGLM

SEQ ID NO: 805815 - protein, 28 aa, Mycobacterium
EAGRAARVIVPDFQLSLAIGKEGQNARL

SEQ ID NO: 805816 - protein, 31 aa, Mycobacterium
EAGRGRPFPDLILASLLRLKVNDVREVAVLG

SEQ ID NO: 805817 - protein, 22 aa, Mycobacterium
EAGRINHAYLFSGPRGCGKTSS

SEQ ID NO: 805818 - protein, 26 aa, Mycobacterium
EAGRPVPVRIYRAAPTPAPVVVYCHA

SEQ ID NO: 805819 - protein, 37 aa, Mycobacterium
EAGRRGAPLVILYAATLPIGAWPVVPVPTGFLDWQRQ

SEQ ID NO: 805820 - protein, 24 aa, Mycobacterium
EAGRWAASWGKRFPVRYIVGRRGD

SEQ ID NO: 805821 - protein, 25 aa, Mycobacterium
EAGSKWLFPLLDQLADVYKKTPESF

SEQ ID NO: 805822 - protein, 25 aa, Mycobacterium
EAGSKWLFPLLEQLADVYKKTPESF

SEQ ID NO: 805823 - protein, 24 aa, Mycobacterium
EAGSVDLDAWRALGSELGVVGLSL

SEQ ID NO: 805824 - protein, 24 aa, Mycobacterium
EAGTFDALFFADGLNYGPPATWAY

SEQ ID NO: 805825 - protein, 31 aa, Mycobacterium
EAGVALGWLASRWPGLLPDARRLLPDLHTEA

SEQ ID NO: 805826 - protein, 25 aa, Mycobacterium
EAGVDLALISYYFGSKRGLVGEALA

SEQ ID NO: 805827 - protein, 30 aa, Mycobacterium
EAGVLFVQCTRPWIMPYGSGNLEYPLTEPW

SEQ ID NO: 805828 - protein, 26 aa, Mycobacterium
EAGVPIVPLIVWGAQRIWTKDHPKDL

SEQ ID NO: 805829 - protein, 20 aa, Mycobacterium
EAGVPLLRQDGRGIALTEAG

SEQ ID NO: 805830 - protein, 31 aa, Mycobacterium
EAGVPPPRRSIPVPVLYTLGALGSLRARLTG

SEQ ID NO: 805831 - protein, 25 aa, Mycobacterium
EAGVPYFSLAMLPGGRRGRQSPPAG

SEQ ID NO: 805832 - protein, 17 aa, Mycobacterium
EAGWIQPTWPREHGGRS

SEQ ID NO: 805833 - protein, 26 aa, Mycobacterium
EAGYIAFYRPEFIEFFAEHHVQLPLR

SEQ ID NO: 805834 - protein, 20 aa, Mycobacterium
EAGYRGERFADWPSDLVGNN

SEQ ID NO: 805835 - protein, 24 aa, Mycobacterium
EAHAHTRFVLVGRPGPPPAATGAD

SEQ ID NO: 805836 - protein, 24 aa, Mycobacterium
EAHFDLLISLYAGPLWDHCQRYLK

SEQ ID NO: 805837 - protein, 23 aa, Mycobacterium
EAHGFDRRFAFPHGGHLINLHIA

SEQ ID NO: 805838 - protein, 31 aa, Mycobacterium
EAHGFSHLWTFDSHLLWQEPYVLYSQILHET

SEQ ID NO: 805839 - protein, 29 aa, Mycobacterium
EAHGRTPAQVLIRWSLQLGNIVIPRSSSP

SEQ ID NO: 805840 - protein, 23 aa, Mycobacterium
EAHLARLATQYRPDQLAKLAQRL

SEQ ID NO: 805841 - protein, 22 aa, Mycobacterium
EAHLQVLLAEHVQLLGEGYTLV

SEQ ID NO: 805842 - protein, 29 aa, Mycobacterium
EAHLRGAPILAMGVWRWGLGEIRYEQLNR

SEQ ID NO: 805843 - protein, 24 aa, Mycobacterium
EAHLRKHAPWGARVSVERGDIGQP

SEQ ID NO: 805844 - protein, 23 aa, Mycobacterium
EAHPVGFQWVIEAKARGTEVIHI

SEQ ID NO: 805845 - protein, 23 aa, Mycobacterium
EAHPVGFQWVIEAKTRGAQVIHI

SEQ ID NO: 805846 - protein, 30 aa, Mycobacterium
EAHPWRWRLIDMYDRDLTHKWYVEIGFCED

SEQ ID NO: 805847 - protein, 28 aa, Mycobacterium
EAHQSALDRWWKLRLEWAKGQDPLGGRF

SEQ ID NO: 805848 - protein, 22 aa, Mycobacterium
EAHRFLVNEAYLLDAQDYDRWL

SEQ ID NO: 805849 - protein, 21 aa, Mycobacterium
EAHRLCLRPLPFLDDGASAAV

SEQ ID NO: 805850 - protein, 24 aa, Mycobacterium
EAHRSIYGVWRGVLEYFDAHVIGL

SEQ ID NO: 805851 - protein, 17 aa, Mycobacterium
EAHWRRHLDKTRELLLA

SEQ ID NO: 805852 - protein, 17 aa, Mycobacterium
EAIADSGWTLVWGGGNL

SEQ ID NO: 805853 - protein, 19 aa, Mycobacterium
EAIAERVLWLSTSMVHHAN

SEQ ID NO: 805854 - protein, 29 aa, Mycobacterium
EAIAIANRLLPCLPTLLALSASSPFWADG

SEQ ID NO: 805855 - protein, 25 aa, Mycobacterium
EAIAKFAANIPFPKRLGTPAEYADA

SEQ ID NO: 805856 - protein, 17 aa, Mycobacterium
EAIANWDPKAEPSIEIQ

SEQ ID NO: 805857 - protein, 26 aa, Mycobacterium
EAIAQVLRMTVFVASVPTFTEHSRVA

SEQ ID NO: 805858 - protein, 24 aa, Mycobacterium
EAIASFARLWVADPHWQAAERVMT

SEQ ID NO: 805859 - protein, 17 aa, Mycobacterium
EAIDFFARGLVHPTVHT

SEQ ID NO: 805860 - protein, 24 aa, Mycobacterium
EAIDGMLPRPLLEVLFDIDRGAGG

SEQ ID NO: 805861 - protein, 22 aa, Mycobacterium
EAIDLLKGVLMPAIMSAVKPPV

SEQ ID NO: 805862 - protein, 26 aa, Mycobacterium
EAIDPLLPEVAWSWLVEALESRTEHV

SEQ ID NO: 805863 - protein, 26 aa, Mycobacterium
EAIDSPLIWTIAALLGQHPVPEVKAN

SEQ ID NO: 805864 - protein, 25 aa, Mycobacterium
EAIEEQHFWPLVREALEDGDELADK

SEQ ID NO: 805865 - protein, 26 aa, Mycobacterium
EAIGLLKMDFLGLRNLTIIGDAIANI

SEQ ID NO: 805866 - protein, 26 aa, Mycobacterium
EAIGLLKMDFLGLRNLTIIGDAIDNI

SEQ ID NO: 805867 - protein, 26 aa, Mycobacterium
EAIGLLKMDFLGLRNLTIIGDAIENI

SEQ ID NO: 805868 - protein, 26 aa, Mycobacterium
EAIGLLKMDFLGLRNLTIIGDALDNI

SEQ ID NO: 805869 - protein, 26 aa, Mycobacterium
EAIGLLKMDFLGLRNLTIIGDALENI

SEQ ID NO: 805870 - protein, 26 aa, Mycobacterium
EAIGLLKMDFLGLRNLTIIGDCIENI

SEQ ID NO: 805871 - protein, 25 aa, Mycobacterium
EAIGLLKMDFLGLRNLTVIGDALDN

SEQ ID NO: 805872 - protein, 23 aa, Mycobacterium
EAIGLNFLDTYLRSGRYAAETPF

SEQ ID NO: 805873 - protein, 25 aa, Mycobacterium
EAIGLWQEVAGLPLDRIQRRGMADN

SEQ ID NO: 805874 - protein, 20 aa, Mycobacterium
EAIGVAARLRMTCVATGAAG

SEQ ID NO: 805875 - protein, 18 aa, Mycobacterium
EAIHEYIRRNASKVLLLT

SEQ ID NO: 805876 - protein, 22 aa, Mycobacterium
EAIKHFFVHYKDLEPGKFVKAA

SEQ ID NO: 805877 - protein, 40 aa, Mycobacterium
EAIKREIFRLVGLDWKGFTSAVILPQGSFQTLLQAPPADR

SEQ ID NO: 805878 - protein, 17 aa, Mycobacterium
EAILAAHQWAYGRDSCS

SEQ ID NO: 805879 - protein, 20 aa, Mycobacterium
EAILAQIQRLLGSPWTDEHG

SEQ ID NO: 805880 - protein, 19 aa, Mycobacterium
EAILTLRMAEFSEAGPRED

SEQ ID NO: 805881 - protein, 24 aa, Mycobacterium
EAIMVLPVLFHLLWHRRLGVDLSA

SEQ ID NO: 805882 - protein, 30 aa, Mycobacterium
EAINAFNKAFAPYGLRPTAFKPSYGIAEAT

SEQ ID NO: 805883 - protein, 18 aa, Mycobacterium
EAIPAQAIAQVCELTWQL

SEQ ID NO: 805884 - protein, 24 aa, Mycobacterium
EAIPAQAIAQVCELTWQLKGQATG

SEQ ID NO: 805885 - protein, 25 aa, Mycobacterium
EAIPSGYLPILRALDADGAEIVLVH

SEQ ID NO: 805886 - protein, 18 aa, Mycobacterium
EAIPTSLQNWYNGTNGKV

SEQ ID NO: 805887 - protein, 22 aa, Mycobacterium
EAIRKMTTLPASRIGITDRGSL

SEQ ID NO: 805888 - protein, 24 aa, Mycobacterium
EAIRLRVPVPGIAASLFARFLSRQ

SEQ ID NO: 805889 - protein, 17 aa, Mycobacterium
EAIRRGLQMLAPGGRFV

SEQ ID NO: 805890 - protein, 23 aa, Mycobacterium
EAIRRRVGRLRAQRAHVLWAHRR

SEQ ID NO: 805891 - protein, 31 aa, Mycobacterium
EAIRSGAKITPLWLPGPDPEPHYRPSAKLAA

SEQ ID NO: 805892 - protein, 25 aa, Mycobacterium
EAISIDPQHRLLLETSWEAIEHAGL

SEQ ID NO: 805893 - protein, 28 aa, Mycobacterium
EAISRQLPLRLVYVIPSQQTGSVHAPDW

SEQ ID NO: 805894 - protein, 27 aa, Mycobacterium
EAITDRILLLDGLPNYQRLFSLRIGQT

SEQ ID NO: 805895 - protein, 28 aa, Mycobacterium
EAITDRILLLDGLPNYQRLFSLRIGQTL

SEQ ID NO: 805896 - protein, 19 aa, Mycobacterium
EAITLPLKEFDLLEYLIRN

SEQ ID NO: 805897 - protein, 24 aa, Mycobacterium
EAITRAIRLILGGARFIATNPDVT

SEQ ID NO: 805898 - protein, 29 aa, Mycobacterium
EAIVADIRRLSELDALREAAQTARVALAG

SEQ ID NO: 805899 - protein, 27 aa, Mycobacterium
EAIVHLGFGFGIVFINPALAAVDWDPP

SEQ ID NO: 805900 - protein, 18 aa, Mycobacterium
EAIVPVLPAPMCFDPTAR

SEQ ID NO: 805901 - protein, 28 aa, Mycobacterium
EAIVSADARLVVFPELSLSGYRADAQPV

SEQ ID NO: 805902 - protein, 22 aa, Mycobacterium
EAIYIWHDVLGREPFFDAPDVF

SEQ ID NO: 805903 - protein, 21 aa, Mycobacterium
EAKAELLGVDPALIEMHGAVS

SEQ ID NO: 805904 - protein, 24 aa, Mycobacterium
EAKALYLSAGYRPLYDQTLTADEV

SEQ ID NO: 805905 - protein, 17 aa, Mycobacterium
EAKASWSPKFMLREATW

SEQ ID NO: 805906 - protein, 26 aa, Mycobacterium
EAKAYSLTFPDWKPADFKYWPAENGV

SEQ ID NO: 805907 - protein, 19 aa, Mycobacterium
EAKIAFLMLPGVGTKEDIK

SEQ ID NO: 805908 - protein, 17 aa, Mycobacterium
EAKLKWPNDVLVDTGKL

SEQ ID NO: 805909 - protein, 23 aa, Mycobacterium
EAKLLGFHWTKIHHQPDLGEVYV

SEQ ID NO: 805910 - protein, 31 aa, Mycobacterium; identical to SEQ ID NO: 147924

SEQ ID NO: 805911 - protein, 20 aa, Mycobacterium
EAKNRAAAQRLAEIRESMRE

SEQ ID NO: 805912 - protein, 17 aa, Mycobacterium
EAKPELMRIVTVDSALI

SEQ ID NO: 805913 - protein, 17 aa, Mycobacterium
EAKRAAKWDRMTLAQWL

SEQ ID NO: 805914 - protein, 25 aa, Mycobacterium
EAKRFPQLTVLSIAPLLASTIRAVF

SEQ ID NO: 805915 - protein, 28 aa, Mycobacterium
EAKRYLEYTLRWRNVPKPSIAAVQGRCI

SEQ ID NO: 805916 - protein, 30 aa, Mycobacterium
EAKTLPGMLAGVVPLVLRLSPELTVAEFCR

SEQ ID NO: 805917 - protein, 20 aa, Mycobacterium
EAKVLVRRLYRRCTTGALVK

SEQ ID NO: 805918 - protein, 18 aa, Mycobacterium
EAKYFMLRVRCDGGALSA

SEQ ID NO: 805919 - protein, 25 aa, Mycobacterium
EALAALAELPQTASALISGRALEVL

SEQ ID NO: 805920 - protein, 20 aa, Mycobacterium
EALALLRRSPGLTKAKETVA

SEQ ID NO: 805921 - protein, 25 aa, Mycobacterium
EALALQYFHIAPWVAWSDAGQRPRL

SEQ ID NO: 805922 - protein, 25 aa, Mycobacterium
EALAMDPQQRLLLETSWEALEDAGI

SEQ ID NO: 805923 - protein, 19 aa, Mycobacterium
EALAPLLGTWTGQGAGEYP

SEQ ID NO: 805924 - protein, 19 aa, Mycobacterium
EALAREKMGGAYPLDVPLE

SEQ ID NO: 805925 - protein, 26 aa, Mycobacterium
EALARVFDYVLAIKKTPIVVNDSRGF

SEQ ID NO: 805926 - protein, 18 aa, Mycobacterium
EALARWARDILAQRAEPA

SEQ ID NO: 805927 - protein, 21 aa, Mycobacterium
EALATLVVNSIRKTLRAVAVK

SEQ ID NO: 805928 - protein, 18 aa, Mycobacterium
EALAWFDHWLKSRDTGIL

SEQ ID NO: 805929 - protein, 24 aa, Mycobacterium
EALAWYGCIFGREPDLRPVAGVAE

SEQ ID NO: 805930 - protein, 26 aa, Mycobacterium
EALAYETPLMLNVPSFAICCATILDM

SEQ ID NO: 805931 - protein, 27 aa, Mycobacterium
EALAYGDMGLSLPILAPGGVAAALTHW

SEQ ID NO: 805932 - protein, 32 aa, Mycobacterium
EALDAYLPTLASHWRRVLGGYTLLDVAHKVVG

SEQ ID NO: 805933 - protein, 28 aa, Mycobacterium
EALDEHLRLPLRRVLWGTDAAVLQNTEF

SEQ ID NO: 805934 - protein, 23 aa, Mycobacterium
EALDFYARGLIHPTVEGAALEDI

SEQ ID NO: 805935 - protein, 32 aa, Mycobacterium
EALDMWMQSPPHRAIILNCAFNAGGFATARDG

SEQ ID NO: 805936 - protein, 25 aa, Mycobacterium
EALDPQRVLLLPDGTEDFWSDDYRD

SEQ ID NO: 805937 - protein, 28 aa, Mycobacterium
EALDRTGLWGRLFPEWGPVRDLPPRDIV

SEQ ID NO: 805938 - protein, 30 aa, Mycobacterium; identical to SEQ ID NO: 114087

SEQ ID NO: 805939 - protein, 18 aa, Mycobacterium
EALDWFARILHPDAAHPV

SEQ ID NO: 805940 - protein, 25 aa, Mycobacterium
EALEVPLSEVLIVAGERLAGEERAA

SEQ ID NO: 805941 - protein, 25 aa, Mycobacterium
EALEWVFHPFLSTMILARPKDISVV

SEQ ID NO: 805942 - protein, 17 aa, Mycobacterium
EALFDAFRRGEIATLVV

SEQ ID NO: 805943 - protein, 17 aa, Mycobacterium
EALFDAFRRGEIGTLVV

SEQ ID NO: 805944 - protein, 24 aa, Mycobacterium
EALGDHDYLLRFTQDYDAPVVVRV

SEQ ID NO: 805945 - protein, 26 aa, Mycobacterium
EALGEGWFWPAAAAHPSLPRGALLQI

SEQ ID NO: 805946 - protein, 21 aa, Mycobacterium
EALGHALVIEPFVDTVVVAGG

SEQ ID NO: 805947 - protein, 28 aa, Mycobacterium
EALGKMQPLLIVSSDLRRAYDTAMTLGE

SEQ ID NO: 805948 - protein, 32 aa, Mycobacterium
EALGKTLFDGLTLALPGGPLSKVGKAGSRAAD

SEQ ID NO: 805949 - protein, 18 aa, Mycobacterium
EALGLAGATLRRGAVAAV

SEQ ID NO: 805950 - protein, 21 aa, Mycobacterium
EALGLLALVLLTEARRPARTG

SEQ ID NO: 805951 - protein, 20 aa, Mycobacterium
EALGNPTWYARFAAQAMTDP

SEQ ID NO: 805952 - protein, 20 aa, Mycobacterium
EALGYGAVWVGGSPPAELVW

SEQ ID NO: 805953 - protein, 21 aa, Mycobacterium
EALHYPYHPLSLRVEQIIASG

SEQ ID NO: 805954 - protein, 21 aa, Mycobacterium
EALIERLLDVPIFNADTAQAM

SEQ ID NO: 805955 - protein, 22 aa, Mycobacterium
EALIGVFDKIGVKTGIDFFDIA

SEQ ID NO: 805956 - protein, 17 aa, Mycobacterium
EALIKLADPVRRLDAII

SEQ ID NO: 805957 - protein, 20 aa, Mycobacterium
EALIQLAAQCPVAVLSGRDL

SEQ ID NO: 805958 - protein, 29 aa, Mycobacterium
EALKALHRRCADVRYLGSWPTGSPAGALP

SEQ ID NO: 805959 - protein, 22 aa, Mycobacterium
EALKIVNGTRFGLSTSVFSRDL

SEQ ID NO: 805960 - protein, 18 aa, Mycobacterium
EALKIYAQPKRLGRQSAS

SEQ ID NO: 805961 - protein, 19 aa, Mycobacterium
EALKNYAGLDFLRTLQVVP

SEQ ID NO: 805962 - protein, 17 aa, Mycobacterium
EALLAEPGRWDLSSLLA

SEQ ID NO: 805963 - protein, 20 aa, Mycobacterium
EALLALHRPGDPGVLPTVWD

SEQ ID NO: 805964 - protein, 18 aa, Mycobacterium
EALLDPDSPFLELSPLAA

SEQ ID NO: 805965 - protein, 17 aa, Mycobacterium
EALLEWARAQRLAPRPV

SEQ ID NO: 805966 - protein, 21 aa, Mycobacterium
EALLLELAYELEEARPWARIH

SEQ ID NO: 805967 - protein, 22 aa, Mycobacterium
EALLPHLAPLLEGPATWDTMPT

SEQ ID NO: 805968 - protein, 17 aa, Mycobacterium
EALLRDVGIRFNGAEKT

SEQ ID NO: 805969 - protein, 19 aa, Mycobacterium
EALLSHRVLAPLVTEAPGI

SEQ ID NO: 805970 - protein, 18 aa, Mycobacterium
EALLTTYRKLREEWLAAR

SEQ ID NO: 805971 - protein, 18 aa, Mycobacterium
EALLTVFPDARLIWAHRD

SEQ ID NO: 805972 - protein, 20 aa, Mycobacterium
EALLYAAGKLETLGSALAAE

SEQ ID NO: 805973 - protein, 20 aa, Mycobacterium
EALPALNSFVLPGGSPLSAL

SEQ ID NO: 805974 - protein, 29 aa, Mycobacterium
EALPDARPTLWLGVPRVWHKIQAGIETKL

SEQ ID NO: 805975 - protein, 17 aa, Mycobacterium
EALPERERTVLVLRFFD

SEQ ID NO: 805976 - protein, 20 aa, Mycobacterium
EALPFDERRLRQALNALDCG

SEQ ID NO: 805977 - protein, 24 aa, Mycobacterium
EALPKIQLWPIDANGEYGRAQEIT

SEQ ID NO: 805978 - protein, 19 aa, Mycobacterium
EALPPTEPRVLQIRALVLG

SEQ ID NO: 805979 - protein, 24 aa, Mycobacterium
EALQAFDAIYFGAVGWPSVPDHIS

SEQ ID NO: 805980 - protein, 29 aa, Mycobacterium
EALQERLDALLRLEGFRDWADIDVDEAQS

SEQ ID NO: 805981 - protein, 23 aa, Mycobacterium
EALQIILPMIKGETPTFSGEYYS

SEQ ID NO: 805982 - protein, 31 aa, Mycobacterium
EALQSDPLAPGFLPRLILSASTAATGCRAIL

SEQ ID NO: 805983 - protein, 17 aa, Mycobacterium
EALQWFIHAAEADVEGV

SEQ ID NO: 805984 - protein, 22 aa, Mycobacterium
EALRAAFPDHPLRLDPNAAWTP

SEQ ID NO: 805985 - protein, 23 aa, Mycobacterium
EALRADLDRFWTQALTNYAQTID

SEQ ID NO: 805986 - protein, 17 aa, Mycobacterium
EALRCLKRRLSDAVYRQ

SEQ ID NO: 805987 - protein, 20 aa, Mycobacterium
EALREFGVRVLVIRPGQVRT

SEQ ID NO: 805988 - protein, 22 aa, Mycobacterium
EALREFGVRVLVIRPGQVRTRM

SEQ ID NO: 805989 - protein, 27 aa, Mycobacterium
EALRGFPPVPSRWIDPGSLPEWLVPPG

SEQ ID NO: 805990 - protein, 17 aa, Mycobacterium
EALRLESPFRGHHRHVL

SEQ ID NO: 805991 - protein, 19 aa, Mycobacterium
EALRLRRPDVTWLLVNDLT

SEQ ID NO: 805992 - protein, 23 aa, Mycobacterium
EALRMDAPVKSQFRLAKKTTQLG

SEQ ID NO: 805993 - protein, 20 aa, Mycobacterium
EALRMGLVWRVCQPDELLPQ

SEQ ID NO: 805994 - protein, 24 aa, Mycobacterium
EALRRAYIAMARNTKLAAAGALTS

SEQ ID NO: 805995 - protein, 21 aa, Mycobacterium
EALRYDIRWKVACGRALTQTS

SEQ ID NO: 805996 - protein, 20 aa, Mycobacterium
EALSAADPTLAAFLSIHNMC

SEQ ID NO: 805997 - protein, 17 aa, Mycobacterium
EALSIRPTGGGIGRVRD

SEQ ID NO: 805998 - protein, 33 aa, Mycobacterium
EALSTLVVNAIRKTLKAVAVKAPFFGDRRKAFL

SEQ ID NO: 805999 - protein, 18 aa, Mycobacterium
EALTSRFVLAPAARSKLS

SEQ ID NO: 806000 - protein, 19 aa, Mycobacterium
EALVDKPLIRRKLAEMIVD

SEQ ID NO: 806001 - protein, 19 aa, Mycobacterium
EALVESALWEAGLFEEHGF

SEQ ID NO: 806002 - protein, 17 aa, Mycobacterium
EALVESAMWEASLFEEH

SEQ ID NO: 806003 - protein, 18 aa, Mycobacterium
EALVFAYDGLRERGLRSV

SEQ ID NO: 806004 - protein, 21 aa, Mycobacterium
EALVITHRPPACRFWNMVVWN

SEQ ID NO: 806005 - protein, 20 aa, Mycobacterium
EALVPFVTAIVTSVSLDDGT

SEQ ID NO: 806006 - protein, 25 aa, Mycobacterium
EALVRVTWISLDPTNRGWINDMPSY

SEQ ID NO: 806007 - protein, 17 aa, Mycobacterium
EALVVLRHLLHNTANIT

SEQ ID NO: 806008 - protein, 19 aa, Mycobacterium
EALYLAKRIDKVSGEGETV

SEQ ID NO: 806009 - protein, 17 aa, Mycobacterium
EAMARMVARLRAQHRYI

SEQ ID NO: 806010 - protein, 23 aa, Mycobacterium
EAMKLVYELAFGKLGLQRVHGSV

SEQ ID NO: 806011 - protein, 26 aa, Mycobacterium
EAMLAPLRNILGAIATFEGLDSDVVA

SEQ ID NO: 806012 - protein, 22 aa, Mycobacterium
EAMLDVLRFWLDLGIDGFRLDA

SEQ ID NO: 806013 - protein, 22 aa, Mycobacterium
EAMLLMRAGREYALKRALESLG

SEQ ID NO: 806014 - protein, 24 aa, Mycobacterium
EAMLNTAWLHKPMFTLRGGTNEVL

SEQ ID NO: 806015 - protein, 23 aa, Mycobacterium
EAMLRQAPILALGGRPEELTETP

SEQ ID NO: 806016 - protein, 17 aa, Mycobacterium
EAMLVATVRAFIDRDVR

SEQ ID NO: 806017 - protein, 33 aa, Mycobacterium
EAMMEIFGRHPSFVHSFPPMPVQPNGFMTADEV

SEQ ID NO: 806018 - protein, 21 aa, Mycobacterium
EAMNLLISWTMSSATQPTESS

SEQ ID NO: 806019 - protein, 23 aa, Mycobacterium
EAMPFSVDALFFESALPTDGRIH

SEQ ID NO: 806020 - protein, 22 aa, Mycobacterium
EAMRAIGLPELVEDERFASPAA

SEQ ID NO: 806021 - protein, 18 aa, Mycobacterium
EAMTAAAGDLAGIGSSVA

SEQ ID NO: 806022 - protein, 20 aa, Mycobacterium
EAMTWPLLEVIDGSLEQPWC

SEQ ID NO: 806023 - protein, 27 aa, Mycobacterium
EANAPVLLGLIGLWYNNFFGAETRAVL

SEQ ID NO: 806024 - protein, 24 aa, Mycobacterium
EANDKTMFDALAPALDALDAALEG

SEQ ID NO: 806025 - protein, 26 aa, Mycobacterium
EANFMLIGAAFYRDQYRRTAAGWRIS

SEQ ID NO: 806026 - protein, 17 aa, Mycobacterium
EANIVFAYLATQSGIDL

SEQ ID NO: 806027 - protein, 22 aa, Mycobacterium
EANIVNYKRQLGRLGLGHDSRR

SEQ ID NO: 806028 - protein, 25 aa, Mycobacterium
EANPDDDNWLWNINFHGVVNGTRAF

SEQ ID NO: 806029 - protein, 34 aa, Mycobacterium
EANPFALLVGMLLDQQIPMEVAFAGPKKIADRMG

SEQ ID NO: 806030 - protein, 27 aa, Mycobacterium
EANRAWRLYRRLGFTDIIRGYYFAGDP

SEQ ID NO: 806031 - protein, 29 aa, Mycobacterium
EANRAWRLYRRLGFTDVIRGYHFAGDPRA

SEQ ID NO: 806032 - protein, 32 aa, Mycobacterium
EANRRGIPVLLRPVVLADLMAGYRTLMVTGTH

SEQ ID NO: 806033 - protein, 23 aa, Mycobacterium
EANTLALWGTFAAVGFRGHLVTS

SEQ ID NO: 806034 - protein, 17 aa, Mycobacterium
EANTMYPGFAKQATADN

SEQ ID NO: 806035 - protein, 17 aa, Mycobacterium
EANVDVLVSYLPVGSEE

SEQ ID NO: 806036 - protein, 25 aa, Mycobacterium
EANVPIVPVIVWGAQRIWTKDHPRK

SEQ ID NO: 806037 - protein, 26 aa, Mycobacterium
EANYARVPLIVLSANRPYELLGTGAN

SEQ ID NO: 806038 - protein, 26 aa, Mycobacterium
EANYARVPLIVLTANRPYELLGTGAN

SEQ ID NO: 806039 - protein, 25 aa, Mycobacterium
EAPALDELAYLLGRNPDVAEVLTAS

SEQ ID NO: 806040 - protein, 25 aa, Mycobacterium
EAPARAYNPLFIWGESGLGKTHLLH

SEQ ID NO: 806041 - protein, 17 aa, Mycobacterium
EAPARFDRGFWVDPTLF

SEQ ID NO: 806042 - protein, 25 aa, Mycobacterium
EAPARPAPQFEVMYLLTGCDAAAAD

SEQ ID NO: 806043 - protein, 23 aa, Mycobacterium
EAPDLPGAFYRPTLIADVDESSE

SEQ ID NO: 806044 - protein, 23 aa, Mycobacterium
EAPDRWVTYFHTADIQTTLAAVT

SEQ ID NO: 806045 - protein, 21 aa, Mycobacterium
EAPEVWIGELPEWIVAPEYGI

SEQ ID NO: 806046 - protein, 25 aa, Mycobacterium
EAPGRRDICIYAREPHVIVAEAPNE

SEQ ID NO: 806047 - protein, 19 aa, Mycobacterium
EAPGVRFAGLGGATETPVH

SEQ ID NO: 806048 - protein, 19 aa, Mycobacterium
EAPIKQALIAASQRIVLLA

SEQ ID NO: 806049 - protein, 28 aa, Mycobacterium
EAPIYYNERYNFWALSRHADVEKALSDW

SEQ ID NO: 806050 - protein, 21 aa, Mycobacterium
EAPLPRVSIFLSLLDAHVQRA

SEQ ID NO: 806051 - protein, 17 aa, Mycobacterium
EAPLRVTVIRTGSAEYV

SEQ ID NO: 806052 - protein, 25 aa, Mycobacterium
EAPLYYNDKYNFFALSRYADVSRAL

SEQ ID NO: 806053 - protein, 17 aa, Mycobacterium
EAPMFPLEAAMLPGQDL

SEQ ID NO: 806054 - protein, 24 aa, Mycobacterium
EAPRTWHRRLKRIITQGILGCLED

SEQ ID NO: 806055 - protein, 17 aa, Mycobacterium
EAPRYIRVIPYVEDHRN

SEQ ID NO: 806056 - protein, 17 aa, Mycobacterium
EAPSILMPLMNAVGITS

SEQ ID NO: 806057 - protein, 22 aa, Mycobacterium
EAPSKGWRRALLKVSGGLINVG

SEQ ID NO: 806058 - protein, 19 aa, Mycobacterium
EAPVARRLRESFGGGKSAP

SEQ ID NO: 806059 - protein, 17 aa, Mycobacterium
EAPVLFAMGHFLGSDRV

SEQ ID NO: 806060 - protein, 19 aa, Mycobacterium
EAPVYYSERWDFYALTRNE

SEQ ID NO: 806061 - protein, 21 aa, Mycobacterium
EAPWHIDRSLRHLLTDITGNT

SEQ ID NO: 806062 - protein, 22 aa, Mycobacterium
EAQALLEQYAQTLGISSGSYGD

SEQ ID NO: 806063 - protein, 21 aa, Mycobacterium
EAQALLGYQLWLGVHEQLSGD

SEQ ID NO: 806064 - protein, 25 aa, Mycobacterium
EAQDFADAWWDPLLGALHDPVESGL

SEQ ID NO: 806065 - protein, 20 aa, Mycobacterium
EAQDRFVFVESWASGEALAE

SEQ ID NO: 806066 - protein, 18 aa, Mycobacterium
EAQFLTRGQYKSAANLFT

SEQ ID NO: 806067 - protein, 20 aa, Mycobacterium
EAQGLLLQLLDPATRADPYP

SEQ ID NO: 806068 - protein, 28 aa, Mycobacterium
EAQGWHVHPLIHSINPYGPIGFGTAPGI

SEQ ID NO: 806069 - protein, 24 aa, Mycobacterium
EAQIAKFDLALGKLGLEPGMTLLD

SEQ ID NO: 806070 - protein, 25 aa, Mycobacterium
EAQILSRIALVLYGLGHDADPALVD

SEQ ID NO: 806071 - protein, 27 aa, Mycobacterium
EAQISKPMLYLYYGSKEDLFGACLNRE

SEQ ID NO: 806072 - protein, 26 aa, Mycobacterium
EAQISKPMLYLYYGSKEELFGACLHR

SEQ ID NO: 806073 - protein, 20 aa, Mycobacterium
EAQIVLRLLLERTTVIEAAD

SEQ ID NO: 806074 - protein, 17 aa, Mycobacterium
EAQKGWAAWNPQRRARV

SEQ ID NO: 806075 - protein, 22 aa, Mycobacterium
EAQKRHFLPRILTGDDRWCQGF

SEQ ID NO: 806076 - protein, 19 aa, Mycobacterium
EAQLELKWRALKEELESRG

SEQ ID NO: 806077 - protein, 23 aa, Mycobacterium
EAQLKLLELRRILEPFAVRVAAS

SEQ ID NO: 806078 - protein, 18 aa, Mycobacterium
EAQLRFLADQGVDLIITS

SEQ ID NO: 806079 - protein, 22 aa, Mycobacterium
EAQLTLIQAIRDSGVRDLALRT

SEQ ID NO: 806080 - protein, 26 aa, Mycobacterium
EAQMSALLMAIFLRGMTGHEIARWTA

SEQ ID NO: 806081 - protein, 21 aa, Mycobacterium
EAQQWYPAAKILLGSAATTAD

SEQ ID NO: 806082 - protein, 23 aa, Mycobacterium
EAQRDRFLFKINVGYPTPEEERE

SEQ ID NO: 806083 - protein, 23 aa, Mycobacterium
EAQRDRFLFKLNVDYPSPEEERE

SEQ ID NO: 806084 - protein, 23 aa, Mycobacterium
EAQRQPGFALVRTTFRADGDTRT

SEQ ID NO: 806085 - protein, 25 aa, Mycobacterium
EAQRRALDQLLVLGTLLEGHAEHVM

SEQ ID NO: 806086 - protein, 32 aa, Mycobacterium
EAQRRYFESVAPYARRLLLPTGAPKVDDITGL

SEQ ID NO: 806087 - protein, 20 aa, Mycobacterium
EAQRYGVAVNAISPLAMSRM

SEQ ID NO: 806088 - protein, 35 aa, Mycobacterium
EAQTLANLYLALDKDLTIIPVLNKIDLPAADPERY

SEQ ID NO: 806089 - protein, 17 aa, Mycobacterium
EAQVIVAEIRRLLGAAW

SEQ ID NO: 806090 - protein, 27 aa, Mycobacterium
EAQVPIVPMIVWGAQRIWPKGHPKNLF

SEQ ID NO: 806091 - protein, 22 aa, Mycobacterium
EARAALWRTLFGLDSMERVSIV

SEQ ID NO: 806092 - protein, 19 aa, Mycobacterium
EARACEEAIRFLAQEADRA

SEQ ID NO: 806093 - protein, 25 aa, Mycobacterium
EARAEITKWLIEEKGFCAVAAEADW

SEQ ID NO: 806094 - protein, 24 aa, Mycobacterium
EARAPALLPGFGPLPTGSLRELAG

SEQ ID NO: 806095 - protein, 17 aa, Mycobacterium
EARARHGWIMDTYLLRA

SEQ ID NO: 806096 - protein, 24 aa, Mycobacterium
EARARLALRRFAPLLTDRSVTRVN

SEQ ID NO: 806097 - protein, 28 aa, Mycobacterium
EARAYGVARALRPLLIDTVVGFIGPEYL

SEQ ID NO: 806098 - protein, 18 aa, Mycobacterium
EARCRSPIALGPHGPELL

SEQ ID NO: 806099 - protein, 20 aa, Mycobacterium
EARDPFVRLGPAAAMYYNAL

SEQ ID NO: 806100 - protein, 20 aa, Mycobacterium
EARDPLGVDLAIDRVRGRYG

SEQ ID NO: 806101 - protein, 23 aa, Mycobacterium
EARDYVMALGYLQAPVVVAGSDH

SEQ ID NO: 806102 - protein, 17 aa, Mycobacterium
EAREESMRIATAAKRDY

SEQ ID NO: 806103 - protein, 25 aa, Mycobacterium
EARELLDSYPRHSWLQYARLDDQLG

SEQ ID NO: 806104 - protein, 22 aa, Mycobacterium
EARFARFHLGRNGAVHGGALGM

SEQ ID NO: 806105 - protein, 24 aa, Mycobacterium
EARGDFLAFRRRVATDDLPRFESE

SEQ ID NO: 806106 - protein, 24 aa, Mycobacterium
EARHHPVDVLILATGFHGLTGSLT

SEQ ID NO: 806107 - protein, 21 aa, Mycobacterium
EARHRPGWLPIPLRSIARLTA

SEQ ID NO: 806108 - protein, 22 aa, Mycobacterium
EARHRPGWLPIPLRSIARLTAV

SEQ ID NO: 806109 - protein, 22 aa, Mycobacterium
EARHRPSWLPIPLRSIARLTAG

SEQ ID NO: 806110 - protein, 31 aa, Mycobacterium
EARIKFNCLAPGMWPAWWLSNDDPGRSGEVD

SEQ ID NO: 806111 - protein, 18 aa, Mycobacterium
EARIKIFAECTITDLLLD

SEQ ID NO: 806112 - protein, 25 aa, Mycobacterium
EARIPFLREPFGETITTIGLLIAEV

SEQ ID NO: 806113 - protein, 26 aa, Mycobacterium
EARIPFLREPFGPTIDTIGLLIAEVN

SEQ ID NO: 806114 - protein, 31 aa, Mycobacterium
EARKAGRRFARLAPIVATYRKLESARGDLET

SEQ ID NO: 806115 - protein, 26 aa, Mycobacterium
EARKGFFRVPLIGGTITHPVQGEAAA

SEQ ID NO: 806116 - protein, 26 aa, Mycobacterium
EARKNFFRVPLIGSTITHPVQGEAAA

SEQ ID NO: 806117 - protein, 19 aa, Mycobacterium
EARKRSPIALGPLGPEVLG

SEQ ID NO: 806118 - protein, 23 aa, Mycobacterium
EARLAHRVGLREDVKRIPLFGLG

SEQ ID NO: 806119 - protein, 17 aa, Mycobacterium
EARLHEPDLRRSNDPLL

SEQ ID NO: 806120 - protein, 19 aa, Mycobacterium
EARLKWPNDVLAGSAAAMG

SEQ ID NO: 806121 - protein, 18 aa, Mycobacterium
EARLPTMAEQALASGSPQ

SEQ ID NO: 806122 - protein, 30 aa, Mycobacterium
EARLRAAPLRVLLRHRPISLSGQRVATLTR

SEQ ID NO: 806123 - protein, 24 aa, Mycobacterium
EARLRQAPILALGGRPEELTDAAD

SEQ ID NO: 806124 - protein, 21 aa, Mycobacterium
EARPNYFEYLLPAVRRRRADQ

SEQ ID NO: 806125 - protein, 27 aa, Mycobacterium
EARQHGRFLLTRGMLIGADPVHTVIVE

SEQ ID NO: 806126 - protein, 24 aa, Mycobacterium
EARRAAHRAGYRGAMYPWQSGSDG

SEQ ID NO: 806127 - protein, 24 aa, Mycobacterium
EARRALGWWLVGSARAMLALARQH

SEQ ID NO: 806128 - protein, 24 aa, Mycobacterium
EARRGGLYPWIATQKERFVRITPQ

SEQ ID NO: 806129 - protein, 33 aa, Mycobacterium
EARRGMALAAELRLPLVLMIDTAGPALSAEAEQ

SEQ ID NO: 806130 - protein, 25 aa, Mycobacterium
EARRHGWTFPYLYDESQDVARAFSA

SEQ ID NO: 806131 - protein, 26 aa, Mycobacterium
EARRLQQLWPRYDAMRIELAVGQFAD

SEQ ID NO: 806132 - protein, 17 aa, Mycobacterium
EARRRDARYVLEAMCIG

SEQ ID NO: 806133 - protein, 17 aa, Mycobacterium
EARRRGHRIYIVDVDMG

SEQ ID NO: 806134 - protein, 17 aa, Mycobacterium
EARRRSVAVHALRSRPD

SEQ ID NO: 806135 - protein, 24 aa, Mycobacterium
EARSAIWRVLVRDFFQAWIRRSDT

SEQ ID NO: 806136 - protein, 23 aa, Mycobacterium
EARTVFLEVINFPKPLVSAVNGP

SEQ ID NO: 806137 - protein, 24 aa, Mycobacterium
EARVPFLREPFGADITTIGLLIAD

SEQ ID NO: 806138 - protein, 19 aa, Mycobacterium
EARWRRQPADVPALAKLQR

SEQ ID NO: 806139 - protein, 18 aa, Mycobacterium
EARWRRQPGDVPALAKLQ

SEQ ID NO: 806140 - protein, 21 aa, Mycobacterium
EARWTISPMLSGTFSKSATHS

SEQ ID NO: 806141 - protein, 22 aa, Mycobacterium
EARYGIVWGAMGAARSAWQCAL

SEQ ID NO: 806142 - protein, 19 aa, Mycobacterium
EARYRIPVRLAYGATEFAG

SEQ ID NO: 806143 - protein, 32 aa, Mycobacterium
EASAALIWRRPRWAKRLQPGPIGDLLAEGHAM

SEQ ID NO: 806144 - protein, 32 aa, Mycobacterium
EASAALIWRRPRWAKRLQPGPVADLLAESHAL

SEQ ID NO: 806145 - protein, 23 aa, Mycobacterium
EASCVGVDRFARVRDIAALDFVS

SEQ ID NO: 806146 - protein, 19 aa, Mycobacterium
EASFFVDRLSEESMPLAGL

SEQ ID NO: 806147 - protein, 22 aa, Mycobacterium
EASFLLPTDLPLGYHRVHLRSG

SEQ ID NO: 806148 - protein, 26 aa, Mycobacterium
EASGKALLPGPLLPTVAAGAVALLAD

SEQ ID NO: 806149 - protein, 28 aa, Mycobacterium
EASGLAEPLPLVRMVLAATAEDRRIGYG

SEQ ID NO: 806150 - protein, 24 aa, Mycobacterium
EASGSRFLLFPTVAHSHAERVRPE

SEQ ID NO: 806151 - protein, 21 aa, Mycobacterium
EASHPLLLSTLVKFTSDREIA

SEQ ID NO: 806152 - protein, 31 aa, Mycobacterium
EASIEEFRAGRIATIPLGRFADPIEIANAAV

SEQ ID NO: 806153 - protein, 25 aa, Mycobacterium
EASLPYFQQFLRREVMRHTAADASD

SEQ ID NO: 806154 - protein, 30 aa, Mycobacterium
EASLVERLVPEFLWISTEHTARVSLDALER

SEQ ID NO: 806155 - protein, 37 aa, Mycobacterium
EASMRWQAILHRKGWAAPAWPVKYGGQPWSLAQHYIF

SEQ ID NO: 806156 - protein, 17 aa, Mycobacterium
EASPLRQAPHTAEMVCA

SEQ ID NO: 806157 - protein, 26 aa, Mycobacterium
EASPVEVDLLTLFSYPVHPPGKPERA

SEQ ID NO: 806158 - protein, 22 aa, Mycobacterium
EASQYLADIDLIAAIKAAVTET

SEQ ID NO: 806159 - protein, 25 aa, Mycobacterium
EASRADRERYLNSGLLPVDCRFCHV

SEQ ID NO: 806160 - protein, 22 aa, Mycobacterium
EASRLPCRYANPGPFVAGRPLV

SEQ ID NO: 806161 - protein, 32 aa, Mycobacterium
EASRRGIPVMLRPLVLAKLMDGRTTVMVTGTH

SEQ ID NO: 806162 - protein, 45 aa, Mycobacterium
EASTAATLQSLPQDLLNVVNAPTQALLGRALIGNGANGADGTGQN

SEQ ID NO: 806163 - protein, 27 aa, Mycobacterium
EASVLAYPRVIWVAGGLLKGASVDAEV

SEQ ID NO: 806164 - protein, 25 aa, Mycobacterium
EASVPYFSLAMLPGGRRSTVVAGTV

SEQ ID NO: 806165 - protein, 29 aa, Mycobacterium
EASWADVAMMLSIPYQGLGNAAISAVATD

SEQ ID NO: 806166 - protein, 23 aa, Mycobacterium
EASYPAVQYIPIGDVLPGRLSPS

SEQ ID NO: 806167 - protein, 27 aa, Mycobacterium
EATAEPLFTAVTLAAGAPALKAGGEAA

SEQ ID NO: 806168 - protein, 24 aa, Mycobacterium
EATAFIYIGEICRYLLNQPRKVTD

SEQ ID NO: 806169 - protein, 21 aa, Mycobacterium
EATALMLPNLQMMARLRTGQP

SEQ ID NO: 806170 - protein, 24 aa, Mycobacterium
EATARWTRYLGTVSGPLMLADGAV

SEQ ID NO: 806171 - protein, 23 aa, Mycobacterium
EATATYLVRMLRDFPGLTVTRLA

SEQ ID NO: 806172 - protein, 26 aa, Mycobacterium
EATDFGLHPALFDAALHVATELLGEQ

SEQ ID NO: 806173 - protein, 25 aa, Mycobacterium
EATDRYLPRWSGKLTPHVLRHFCAS

SEQ ID NO: 806174 - protein, 26 aa, Mycobacterium
EATGPMPLLPNGRWLYEHGDPRRLAQ

SEQ ID NO: 806175 - protein, 25 aa, Mycobacterium
EATGSFNRAWAFDQYSDAEVNQAIA

SEQ ID NO: 806176 - protein, 26 aa, Mycobacterium
EATHRAIMLAKITGAPLYVVHVSAKQ

SEQ ID NO: 806177 - protein, 24 aa, Mycobacterium
EATLADLSLPVLRSWLGAQARQGA

SEQ ID NO: 806178 - protein, 17 aa, Mycobacterium
EATLELVDKFRATGLCV

SEQ ID NO: 806179 - protein, 20 aa, Mycobacterium
EATLTYEWGFSEPPEVESDA

SEQ ID NO: 806180 - protein, 29 aa, Mycobacterium
EATNPVPRQVLVPVLPPNADELATWLSGL

SEQ ID NO: 806181 - protein, 19 aa, Mycobacterium
EATPLHRLGDVEDLGRLCV

SEQ ID NO: 806182 - protein, 29 aa, Mycobacterium
EATRQLRPQLILLDVYLPDMTGLEVLQQL

SEQ ID NO: 806183 - protein, 21 aa, Mycobacterium
EATSLLGRLSAFFAAAMDAES

SEQ ID NO: 806184 - protein, 39 aa, Mycobacterium
EATSVQQILLDAINAPTQALLGRPLIGNGANAAPGSGAN

SEQ ID NO: 806185 - protein, 27 aa, Mycobacterium
EATVPYFSLAMLPGGRRRASVVGSVAV

SEQ ID NO: 806186 - protein, 24 aa, Mycobacterium
EAVAAFARLWVAEEHWAAADKVMN

SEQ ID NO: 806187 - protein, 24 aa, Mycobacterium
EAVAAFARLWVSDEHWAAADKVMK

SEQ ID NO: 806188 - protein, 20 aa, Mycobacterium
EAVALFPSWETLPHERLSPG

SEQ ID NO: 806189 - protein, 21 aa, Mycobacterium
EAVAMLRAGATRLGLSGTRSV

SEQ ID NO: 806190 - protein, 21 aa, Mycobacterium
EAVAQFGHIDILIANAGVLSW

SEQ ID NO: 806191 - protein, 19 aa, Mycobacterium
EAVAWMWRHYGGDASLPDE

SEQ ID NO: 806192 - protein, 27 aa, Mycobacterium
EAVCDLEPYWEALRKVYAPFDVAAAGP

SEQ ID NO: 806193 - protein, 18 aa, Mycobacterium
EAVCLLGNYYTMYFALHR

SEQ ID NO: 806194 - protein, 24 aa, Mycobacterium
EAVDPAGTLLLAPGTLGALGLSEG

SEQ ID NO: 806195 - protein, 23 aa, Mycobacterium
EAVEVVIGLPRTLGNRAGSSAQD

SEQ ID NO: 806196 - protein, 22 aa, Mycobacterium
EAVGHFLSAFVAITPLDPSQPD

SEQ ID NO: 806197 - protein, 23 aa, Mycobacterium
EAVGPDFIVCYRMSMADYVEDGQ

SEQ ID NO: 806198 - protein, 21 aa, Mycobacterium
EAVGRFIFIDTAKPEIWAGVA

SEQ ID NO: 806199 - protein, 19 aa, Mycobacterium
EAVGYRSWPTYFATLDQLV

SEQ ID NO: 806200 - protein, 27 aa, Mycobacterium
EAVHALRPFIARYAGKNLLAGQFVALF

SEQ ID NO: 806201 - protein, 25 aa, Mycobacterium
EAVHALRPFLARYAGKNLVAGQFVA

SEQ ID NO: 806202 - protein, 24 aa, Mycobacterium
EAVHAMEQRLPFFAELDASQRASV

SEQ ID NO: 806203 - protein, 21 aa, Mycobacterium
EAVHLALRTLLAEGGSGEADE

SEQ ID NO: 806204 - protein, 25 aa, Mycobacterium
EAVLAGWRMLLDAGRLQDGEPHLAG

SEQ ID NO: 806205 - protein, 24 aa, Mycobacterium
EAVLAGWRMLLDNARMQDGEPHLA

SEQ ID NO: 806206 - protein, 23 aa, Mycobacterium
EAVLASWRLLLDIGRLQDGEPYL

SEQ ID NO: 806207 - protein, 23 aa, Mycobacterium
EAVLFLEATSLFTLALAAVHDIE

SEQ ID NO: 806208 - protein, 21 aa, Mycobacterium
EAVLPFHRFRKADGAQIDSLL

SEQ ID NO: 806209 - protein, 18 aa, Mycobacterium
EAVLRLSFDRLTKVSRRR

SEQ ID NO: 806210 - protein, 17 aa, Mycobacterium
EAVLSPFTRRRMFAKRY

SEQ ID NO: 806211 - protein, 20 aa, Mycobacterium
EAVLTGWRMLLDNGRMQDGE

SEQ ID NO: 806212 - protein, 17 aa, Mycobacterium
EAVLWAIGRVTPNTGWL

SEQ ID NO: 806213 - protein, 25 aa, Mycobacterium
EAVMLAGLAMKWRWRDKFAGKDGDG

SEQ ID NO: 806214 - protein, 24 aa, Mycobacterium
EAVNAMQDRLPFFAELEASQRASV

SEQ ID NO: 806215 - protein, 28 aa, Mycobacterium
EAVNGQLFIVYGPTVTLLAAPTVEAKFT

SEQ ID NO: 806216 - protein, 34 aa, Mycobacterium
EAVNHLFQAGGKRFRPLFTVLSAQLGPEPDAWQV

SEQ ID NO: 806217 - protein, 21 aa, Mycobacterium
EAVNLALRTLLREGASDEEED

SEQ ID NO: 806218 - protein, 31 aa, Mycobacterium
EAVPDVIEEWKWRGVPVWYHDGMICTGETYK

SEQ ID NO: 806219 - protein, 26 aa, Mycobacterium
EAVPGVRLVLTYLDAPRVAFSTARHE

SEQ ID NO: 806220 - protein, 20 aa, Mycobacterium
EAVPIAAFAQMRIVMSTKND

SEQ ID NO: 806221 - protein, 18 aa, Mycobacterium
EAVPYLRRVHVWPDCDRA

SEQ ID NO: 806222 - protein, 35 aa, Mycobacterium
EAVQAGRFLVLPHPHVLDLYRRKGSDYDRWIAGMR

SEQ ID NO: 806223 - protein, 17 aa, Mycobacterium
EAVQARIKWLMADKSKG

SEQ ID NO: 806224 - protein, 30 aa, Mycobacterium
EAVRAAWPDGLPLFFRVSATDWLGGDTDDA

SEQ ID NO: 806225 - protein, 17 aa, Mycobacterium
EAVRALAGRLGLSVAVA

SEQ ID NO: 806226 - protein, 23 aa, Mycobacterium
EAVRFYRDLVGLPLYETFGESYG

SEQ ID NO: 806227 - protein, 36 aa, Mycobacterium
EAVRPLLANLPLRERTVLELRFFKGMTQSQIAAQIG

SEQ ID NO: 806228 - protein, 26 aa, Mycobacterium
EAVRRRPYTVILFDEIEKAHPDVFDV

SEQ ID NO: 806229 - protein, 18 aa, Mycobacterium
EAVSLWHADADLKGVDAV

SEQ ID NO: 806230 - protein, 23 aa, Mycobacterium
EAVTFYAKLFNTQPAKLKEGYAN

SEQ ID NO: 806231 - protein, 32 aa, Mycobacterium
EAVTGSPHERLWRARLTPGERPYPVAHRVRGV

SEQ ID NO: 806232 - protein, 44 aa, Mycobacterium
EAVTKLFRDYGYRRLRAKARLKFLVKDWGVAKFREILETEYLQR

SEQ ID NO: 806233 - protein, 23 aa, Mycobacterium
EAVTPVKVRRLRRLAGLWLSEQD

SEQ ID NO: 806234 - protein, 36 aa, Mycobacterium
EAVTQLFRDYGYRRLRAKARLKFLVKDWGVEKFREV

SEQ ID NO: 806235 - protein, 18 aa, Mycobacterium
EAVWERWAQNLTELGRHA

SEQ ID NO: 806236 - protein, 18 aa, Mycobacterium
EAVYIWHDTAGRPPYFDV

SEQ ID NO: 806237 - protein, 22 aa, Mycobacterium
EAWESHWPVARWHRYLRAQLDG

SEQ ID NO: 806238 - protein, 17 aa, Mycobacterium
EAWGYLNRALPADELRG

SEQ ID NO: 806239 - protein, 17 aa, Mycobacterium
EAWLRLSGTDRDGIANL

SEQ ID NO: 806240 - protein, 21 aa, Mycobacterium
EAWLVTRSLGSAGLRFDRQCQ

SEQ ID NO: 806241 - protein, 21 aa, Mycobacterium
EAWNGTMRLVAYIQADLDASE

SEQ ID NO: 806242 - protein, 24 aa, Mycobacterium
EAWPPTAWFEGWATGIDVFDVERD

SEQ ID NO: 806243 - protein, 23 aa, Mycobacterium
EAWRRGPLAALDRLAPAAAKAVA

SEQ ID NO: 806244 - protein, 20 aa, Mycobacterium
EAWRRHIVGGGWRGDNLVLI

SEQ ID NO: 806245 - protein, 25 aa, Mycobacterium
EAWSVRWVILHVINELARHAGHADI

SEQ ID NO: 806246 - protein, 26 aa, Mycobacterium
EAYADMPLFLFHLLEYMDVEYELDID

SEQ ID NO: 806247 - protein, 23 aa, Mycobacterium
EAYATRPFLAPAPLAPNGRGLPT

SEQ ID NO: 806248 - protein, 27 aa, Mycobacterium
EAYEDLAWFCVRAWRFGAPASLGAGGL

SEQ ID NO: 806249 - protein, 24 aa, Mycobacterium
EAYERLILDVLLGEPSLFPVNEEV

SEQ ID NO: 806250 - protein, 27 aa, Mycobacterium
EAYLDRLLDLLLIGVLRIWFDNDVNAP

SEQ ID NO: 806251 - protein, 23 aa, Mycobacterium
EAYPRRPDGITFFPFRRVFVVAQ

SEQ ID NO: 806252 - protein, 18 aa, Mycobacterium
EAYQLLRDGLGMSAPQIA

SEQ ID NO: 806253 - protein, 22 aa, Mycobacterium
EAYQRIFDRLKVRYVIVSAVSG

SEQ ID NO: 806254 - protein, 18 aa, Mycobacterium
EAYRAIDSAELLLRSIDA

SEQ ID NO: 806255 - protein, 27 aa, Mycobacterium
EAYRGHVFWDSLFVSPVLSVRMPNVAR

SEQ ID NO: 806256 - protein, 17 aa, Mycobacterium
EAYRLLMEVLGTAATLR

SEQ ID NO: 806257 - protein, 28 aa, Mycobacterium
EAYTWLTAELANLRLAFRWTADNNDLDD

SEQ ID NO: 806258 - protein, 18 aa, Mycobacterium
EAYTYFHPARSVRERIEH

SEQ ID NO: 806259 - protein, 21 aa, Mycobacterium
EAYVLHARRYLAGGEAIHPRQ

SEQ ID NO: 806260 - protein, 24 aa, Mycobacterium
ECAISTWLYPILLEEVAAPPERQP

SEQ ID NO: 806261 - protein, 20 aa, Mycobacterium
ECAQACGLSLLGGPPSPETA

SEQ ID NO: 806262 - protein, 23 aa, Mycobacterium
ECAQAYRVLSIHAADFHGSFVQA

SEQ ID NO: 806263 - protein, 32 aa, Mycobacterium
ECARSSFVMTPPTGIWYPMQGAVYALLATWVD

SEQ ID NO: 806264 - protein, 25 aa, Mycobacterium
ECCRLRKVVPLKKALNGYAAWVTGL

SEQ ID NO: 806265 - protein, 35 aa, Mycobacterium
ECCRLRKVVPLRKSLAGYAAWVTGLRRVDAPTRAN

SEQ ID NO: 806266 - protein, 34 aa, Mycobacterium
ECCRLRKVVPLRRVLSGYSAWVTGLRRSEAATRA

SEQ ID NO: 806267 - protein, 25 aa, Mycobacterium
ECCRLRKVVPLSKTLRGYSAWVTGL

SEQ ID NO: 806268 - protein, 30 aa, Mycobacterium
ECCRLRKVVPLTKALRGYSAWVTGIRRVEA

SEQ ID NO: 806269 - protein, 38 aa, Mycobacterium
ECCRLRKVVPLTNALRGYAAWITGLRRVESPTRANAPV

SEQ ID NO: 806270 - protein, 24 aa, Mycobacterium
ECDFVWDLAAPLPMAVIGDMLGVL

SEQ ID NO: 806271 - protein, 24 aa, Mycobacterium
ECDKTVYRAGWLRDGIVCPAQLGT

SEQ ID NO: 806272 - protein, 38 aa, Mycobacterium
ECDPVLRTAVGWLSEPLAKMAGYHLGWWDVNGVPVDGS

SEQ ID NO: 806273 - protein, 19 aa, Mycobacterium
ECFVRQRVPFFVDYVRRFT

SEQ ID NO: 806274 - protein, 26 aa, Mycobacterium
ECGAFWANDLLWLMDTRYLREHSAKK

SEQ ID NO: 806275 - protein, 26 aa, Mycobacterium
ECGAFWASDLLWLMDTRYLREHSAKK

SEQ ID NO: 806276 - protein, 17 aa, Mycobacterium
ECGAQIDALLWQAEAFG

SEQ ID NO: 806277 - protein, 27 aa, Mycobacterium
ECGLDFARWYPWYRRTAAGLHFMRTHR

SEQ ID NO: 806278 - protein, 29 aa, Mycobacterium
ECGQMLADLRWIGESLAAAAAGYAQMEHA

SEQ ID NO: 806279 - protein, 22 aa, Mycobacterium
ECGRLLLKFTVSSPYRCGLLHA

SEQ ID NO: 806280 - protein, 18 aa, Mycobacterium
ECGRRMIVQIRPDGWWAR

SEQ ID NO: 806281 - protein, 19 aa, Mycobacterium
ECGRRMIVQVRPDGWWAQC

SEQ ID NO: 806282 - protein, 23 aa, Mycobacterium
ECHHLLATWGALVAALGSVLGPQ

SEQ ID NO: 806283 - protein, 24 aa, Mycobacterium
ECKATGLLPFANFNRIHAVPPCSV

SEQ ID NO: 806284 - protein, 27 aa, Mycobacterium
ECLAHVYLRRALTSTELWPVGLEDLEV

SEQ ID NO: 806285 - protein, 30 aa, Mycobacterium
ECLAPQHFLLTEWFARWVGFLVPTHRPMDN

SEQ ID NO: 806286 - protein, 34 aa, Mycobacterium
ECLPTLLRPGQRLLVFLPLAHVLARSLTLSAFAS

SEQ ID NO: 806287 - protein, 25 aa, Mycobacterium
ECLQRLGWFRVRVVPRHSPRSILYR

SEQ ID NO: 806288 - protein, 18 aa, Mycobacterium
ECMFECLPEIDPSADEST

SEQ ID NO: 806289 - protein, 17 aa, Mycobacterium
ECPAPEPIPGAVSLKLP

SEQ ID NO: 806290 - protein, 18 aa, Mycobacterium
ECPDLLDVVFLDNDDWDR

SEQ ID NO: 806291 - protein, 24 aa, Mycobacterium
ECPPGLLMTLGMNPQWAPAHLHRE

SEQ ID NO: 806292 - protein, 23 aa, Mycobacterium
ECPYRDALRLLSRDGRPTVAGYD

SEQ ID NO: 806293 - protein, 19 aa, Mycobacterium
ECQYIVTGSFYYDTYDNGV

SEQ ID NO: 806294 - protein, 17 aa, Mycobacterium
ECRAEGVQWTLVAGPAV

SEQ ID NO: 806295 - protein, 26 aa, Mycobacterium
ECRHNLGYWDGGQWWGAGPGAHGHVG

SEQ ID NO: 806296 - protein, 26 aa, Mycobacterium
ECRHNLGYWDGGQWWGAGPGAHGYVG

SEQ ID NO: 806297 - protein, 21 aa, Mycobacterium
ECRMVFLRRQLDDPGLRDGER

SEQ ID NO: 806298 - protein, 28 aa, Mycobacterium
ECTARGIAFVPFFPLGAAFVQPNPVLTH

SEQ ID NO: 806299 - protein, 24 aa, Mycobacterium
ECTGYIVQLPLPKHLDENAALERV

SEQ ID NO: 806300 - protein, 24 aa, Mycobacterium
ECTGYIVQLPLPKHLNENAALERI

SEQ ID NO: 806301 - protein, 21 aa, Mycobacterium
ECVEGTWRFSYRDLTLIDMVG

SEQ ID NO: 806302 - protein, 24 aa, Mycobacterium
ECVPAMVVVHAWQRPQPGPPSSTV

SEQ ID NO: 806303 - protein, 28 aa, Mycobacterium
ECWMHLGIDLFWFALPPAQLDLDRVRPE

SEQ ID NO: 806304 - protein, 19 aa, Mycobacterium
ECYVRKQVPFFADFARRYT

SEQ ID NO: 806305 - protein, 30 aa, Mycobacterium
EDAAEALAARTLLPVPWVEAVDISNAVVFL

SEQ ID NO: 806306 - protein, 24 aa, Mycobacterium
EDAAFELLRWLSQEANIKLRPLAE

SEQ ID NO: 806307 - protein, 17 aa, Mycobacterium
EDAAIAQLFAGLNPERI

SEQ ID NO: 806308 - protein, 24 aa, Mycobacterium
EDAALICVPPYHIAGVSAAMSNLY

SEQ ID NO: 806309 - protein, 22 aa, Mycobacterium
EDADFLRRHAVLPDDRIAAVQT

SEQ ID NO: 806310 - protein, 25 aa, Mycobacterium
EDADMLGPVDLPPGVRRPAGTPDGV

SEQ ID NO: 806311 - protein, 31 aa, Mycobacterium
EDAEPLFSLFQAMPIPYIEPEDMANLGVFLA

SEQ ID NO: 806312 - protein, 25 aa, Mycobacterium
EDAEVLLRLDPSVWPTMYHCAIVSQ

SEQ ID NO: 806313 - protein, 32 aa, Mycobacterium
EDAGFVVVAPHPYFPRLRLELDKGLGWKAEVE

SEQ ID NO: 806314 - protein, 24 aa, Mycobacterium
EDAGRNFLPAPGPVKVYDTPTGPG

SEQ ID NO: 806315 - protein, 24 aa, Mycobacterium
EDAGWPEPLARRRFLEHHDPQVIT

SEQ ID NO: 806316 - protein, 20 aa, Mycobacterium
EDAIRLRGLMTHMVHADAPE

SEQ ID NO: 806317 - protein, 25 aa, Mycobacterium
EDAISVRRPLARLGMGLHRRPRQPQ

SEQ ID NO: 806318 - protein, 29 aa, Mycobacterium
EDAKKRPDFTKLTPLYPNQRLRLETTTEK

SEQ ID NO: 806319 - protein, 24 aa, Mycobacterium
EDANLVRLTELPAGPPVAVVVRQL

SEQ ID NO: 806320 - protein, 24 aa, Mycobacterium
EDAPIMDLGVLVLPIFRGKRHAQR

SEQ ID NO: 806321 - protein, 29 aa, Mycobacterium
EDAQEKFGFLLDAFAFGAPPHGGIAFGWD

SEQ ID NO: 806322 - protein, 23 aa, Mycobacterium
EDAQWPMELVFMVEAALALSHRE

SEQ ID NO: 806323 - protein, 27 aa, Mycobacterium
EDARALLLEIAPRCALITPSAPHECAA

SEQ ID NO: 806324 - protein, 23 aa, Mycobacterium
EDARAVFIFRPSRPLDYDHRDVE

SEQ ID NO: 806325 - protein, 24 aa, Mycobacterium
EDARCAARAFGFSATWLQVELGLI

SEQ ID NO: 806326 - protein, 21 aa, Mycobacterium
EDAWHFPYEAVAFVVHGDISA

SEQ ID NO: 806327 - protein, 26 aa, Mycobacterium
EDCIVGLPTGLLLRGRRPPDTATRSR

SEQ ID NO: 806328 - protein, 25 aa, Mycobacterium
EDCYAALRWLSVQGWIDPTRIAVGG

SEQ ID NO: 806329 - protein, 21 aa, Mycobacterium
EDCYSALTWLAGLPSVDRYRV

SEQ ID NO: 806330 - protein, 25 aa, Mycobacterium
EDDATAMLMLPFFNYADGNHDAIHE

SEQ ID NO: 806331 - protein, 26 aa, Mycobacterium
EDDGYLAILDIRPFSRGHTLVLPKRH

SEQ ID NO: 806332 - protein, 18 aa, Mycobacterium
EDDMFGRRKWTFHHSFAP

SEQ ID NO: 806333 - protein, 26 aa, Mycobacterium
EDDPEFNTLFRRILVEQRAALAEVID

SEQ ID NO: 806334 - protein, 29 aa, Mycobacterium
EDDPLQRMWQALGFWELVIDTADSIAFRL

SEQ ID NO: 806335 - protein, 23 aa, Mycobacterium
EDDQAHVDLLWSLSRAPDADAAL

SEQ ID NO: 806336 - protein, 24 aa, Mycobacterium
EDDRSLFVLPVDLPDGLELDTARE

SEQ ID NO: 806337 - protein, 24 aa, Mycobacterium
EDEALVADIRRLSELDALRDAVQT

SEQ ID NO: 806338 - protein, 18 aa, Mycobacterium
EDEDGFWFIVDRVKDMIV

SEQ ID NO: 806339 - protein, 26 aa, Mycobacterium
EDEEIYSFLRLLLPAGVETTYRSLGS

SEQ ID NO: 806340 - protein, 27 aa, Mycobacterium
EDEEIYSFLRLLLPAGVETTYRSLGSL

SEQ ID NO: 806341 - protein, 21 aa, Mycobacterium
EDEIALVWIGGQNRGLRFLAD

SEQ ID NO: 806342 - protein, 21 aa, Mycobacterium
EDEIQVVADLAWRHARSEVHE

SEQ ID NO: 806343 - protein, 20 aa, Mycobacterium
EDEIVSFFILLTIAGNDTTR

SEQ ID NO: 806344 - protein, 26 aa, Mycobacterium
EDELGTISFLPWGRMDTVYAAVVQSV

SEQ ID NO: 806345 - protein, 24 aa, Mycobacterium
EDEMAFPRLYGVQTRFFDDFFVAA

SEQ ID NO: 806346 - protein, 19 aa, Mycobacterium
EDERKHHYLWRIRNALPSG

SEQ ID NO: 806347 - protein, 25 aa, Mycobacterium
EDESPIVFLRLRKAARKHGLPVYAV

SEQ ID NO: 806348 - protein, 25 aa, Mycobacterium
EDESPIVFLRLRKAARKHKVPVYAI

SEQ ID NO: 806349 - protein, 25 aa, Mycobacterium
EDESPIVFLRLRKAARKNGLPVYAL

SEQ ID NO: 806350 - protein, 30 aa, Mycobacterium
EDETAWRGGEWYVARLFPGPLSADERQTTI

SEQ ID NO: 806351 - protein, 26 aa, Mycobacterium
EDETGMVNVLCSQGIWARHRKLAQTA

SEQ ID NO: 806352 - protein, 26 aa, Mycobacterium
EDETTLAFLDIRPITRGHTLVIPKAH

SEQ ID NO: 806353 - protein, 22 aa, Mycobacterium
EDEVKLLRQAWLTATRARNALV

SEQ ID NO: 806354 - protein, 58 aa, Mycobacterium
EDEVSTAIASLFSASAQEYQMVSTRAAHLHAEFVHSLTRAGAAYAAAEAVNASPLQTL

SEQ ID NO: 806355 - protein, 26 aa, Mycobacterium
EDFAAVFRYELLPLLQEYLFEDYAAL

SEQ ID NO: 806356 - protein, 19 aa, Mycobacterium
EDFEGWAKWVAVGGALAIH

SEQ ID NO: 806357 - protein, 19 aa, Mycobacterium
EDFEREIEALRAHRQVPTS

SEQ ID NO: 806358 - protein, 18 aa, Mycobacterium
EDFLSLNVWAPSGTQPGD

SEQ ID NO: 806359 - protein, 23 aa, Mycobacterium
EDFPWDTPALAAYFAERAKGGVG

SEQ ID NO: 806360 - protein, 17 aa, Mycobacterium
EDFVLGGGKRLRPAFAY

SEQ ID NO: 806361 - protein, 25 aa, Mycobacterium
EDFWLKVGIDPIRIMTGAGNLYTLR

SEQ ID NO: 806362 - protein, 22 aa, Mycobacterium
EDGAFGLLRVLGAAMARLAEAE

SEQ ID NO: 806363 - protein, 25 aa, Mycobacterium
EDGAQLWFVLDPRSPGSGLSVQPQR

SEQ ID NO: 806364 - protein, 24 aa, Mycobacterium
EDGDRIRFASALPALLAGGGVDTR

SEQ ID NO: 806365 - protein, 21 aa, Mycobacterium
EDGEFFFLEMNTRLQVEHPVT

SEQ ID NO: 806366 - protein, 23 aa, Mycobacterium
EDGGWIWFDITTDTAVTLLNGGW

SEQ ID NO: 806367 - protein, 26 aa, Mycobacterium
EDGQMRDWLSRWLRTRGFSVEVDPIG

SEQ ID NO: 806368 - protein, 27 aa, Mycobacterium
EDGRPFRLGFLLHLDRDIPPAQAYREA

SEQ ID NO: 806369 - protein, 18 aa, Mycobacterium
EDGRRILFSLPCYHMFGY

SEQ ID NO: 806370 - protein, 18 aa, Mycobacterium
EDGRRLFLALAADADVVI

SEQ ID NO: 806371 - protein, 20 aa, Mycobacterium
EDGRWYVDCLAAAGAMSLGW

SEQ ID NO: 806372 - protein, 24 aa, Mycobacterium
EDGSYWTGLVYADGKRWPVERTTW

SEQ ID NO: 806373 - protein, 24 aa, Mycobacterium
EDGVVILLTAHPPAEHAEGARKAA

SEQ ID NO: 806374 - protein, 28 aa, Mycobacterium
EDHAGKWRVVFFWPKDFTFVCPTEIAAF

SEQ ID NO: 806375 - protein, 25 aa, Mycobacterium
EDHALVACFAAAVPAGWRVIGRVVD

SEQ ID NO: 806376 - protein, 32 aa, Mycobacterium
EDHALVATFPGAVPPNWRVLGTVAATAADGAP

SEQ ID NO: 806377 - protein, 29 aa, Mycobacterium
EDHAMLATGLLALYQLTSDAAWLTAASGL

SEQ ID NO: 806378 - protein, 23 aa, Mycobacterium
EDHAWSYVFLASDRSRGITGGNA

SEQ ID NO: 806379 - protein, 20 aa, Mycobacterium
EDHFFGFNTYAPARLHQAAH

SEQ ID NO: 806380 - protein, 21 aa, Mycobacterium
EDHGLVAWPKTSGSRGFHIYA

SEQ ID NO: 806381 - protein, 22 aa, Mycobacterium
EDHHLIEFIYEGITPEVREEIG

SEQ ID NO: 806382 - protein, 27 aa, Mycobacterium
EDHIGAIPFVLKQRADIPIVGSKFTLA

SEQ ID NO: 806383 - protein, 25 aa, Mycobacterium
EDHLLRSLAPVVGRTRIYCVGVDRA

SEQ ID NO: 806384 - protein, 27 aa, Mycobacterium
EDHLQRLWTPYRMTYLAEAPMKRDNGK

SEQ ID NO: 806385 - protein, 24 aa, Mycobacterium
EDHLRLLGVLNSSVACFWLKQNSH

SEQ ID NO: 806386 - protein, 28 aa, Mycobacterium
EDHPGKWRVVFFWPKDFTFVCPTEIAAF

SEQ ID NO: 806387 - protein, 17 aa, Mycobacterium
EDHQFYSRMYASGLRRV

SEQ ID NO: 806388 - protein, 23 aa, Mycobacterium
EDHRRRHPHVAAQRLRRCLHKTR

SEQ ID NO: 806389 - protein, 27 aa, Mycobacterium
EDHVVQQVWMPYHWGYTGLVEGDVVND

SEQ ID NO: 806390 - protein, 25 aa, Mycobacterium
EDIANLAVFLLSDAAGWITGQAINV

SEQ ID NO: 806391 - protein, 23 aa, Mycobacterium
EDIAPVVAFLASDEARFITGATI

SEQ ID NO: 806392 - protein, 19 aa, Mycobacterium
EDIGHLAAFLATKEAGYIT

SEQ ID NO: 806393 - protein, 25 aa, Mycobacterium
EDIGRQLARRRLGYGRGARMAFEAD

SEQ ID NO: 806394 - protein, 21 aa, Mycobacterium
EDIGWATAFLASDAASYISGA

SEQ ID NO: 806395 - protein, 18 aa, Mycobacterium
EDILRVGDWVLVHVGFAM

SEQ ID NO: 806396 - protein, 29 aa, Mycobacterium
EDIMRPLLRFPHHPLMLARFGTPTVLPAS

SEQ ID NO: 806397 - protein, 23 aa, Mycobacterium
EDIPALFELWRAAGAVDHPTSLV

SEQ ID NO: 806398 - protein, 21 aa, Mycobacterium
EDIPALRTWTAQLFEAGYVGA

SEQ ID NO: 806399 - protein, 18 aa, Mycobacterium
EDIPVEEAILTGVAHDRG

SEQ ID NO: 806400 - protein, 25 aa, Mycobacterium
EDIRLALVAFGPNTLALGGRVFDDV

SEQ ID NO: 806401 - protein, 26 aa, Mycobacterium
EDIRLALVALGPKSLALGGRVFDDVI

SEQ ID NO: 806402 - protein, 23 aa, Mycobacterium
EDIWFAHDYVPFDRGENFAFLGG

SEQ ID NO: 806403 - protein, 23 aa, Mycobacterium
EDIYNPLRFVSAAVKWCRKAEEL

SEQ ID NO: 806404 - protein, 22 aa, Mycobacterium
EDKAWFVEHRFLSTERAKAVTR

SEQ ID NO: 806405 - protein, 17 aa, Mycobacterium
EDKYCIDVLTQISAVNS

SEQ ID NO: 806406 - protein, 21 aa, Mycobacterium
EDLAGFRLIVSQRGSLMRALV

SEQ ID NO: 806407 - protein, 22 aa, Mycobacterium
EDLAGLPFVGPAGRLLDRALEA

SEQ ID NO: 806408 - protein, 24 aa, Mycobacterium
EDLAGPILFLSAPASDFLTGHVVY

SEQ ID NO: 806409 - protein, 26 aa, Mycobacterium
EDLAGYLRSLWDLMPDTRADIEAVHR

SEQ ID NO: 806410 - protein, 25 aa, Mycobacterium
EDLAMHGIPRVFRWSRGVDIERFAP

SEQ ID NO: 806411 - protein, 24 aa, Mycobacterium
EDLANYVWYVLDGAGGSVGVSLDP

SEQ ID NO: 806412 - protein, 19 aa, Mycobacterium
EDLAWIKAQWPGKLVVKGI

SEQ ID NO: 806413 - protein, 23 aa, Mycobacterium
EDLDAFLKELRVPRDGRLYGIER

SEQ ID NO: 806414 - protein, 24 aa, Mycobacterium
EDLDLLVLAAVVVSLGALGVSAIQ

SEQ ID NO: 806415 - protein, 31 aa, Mycobacterium
EDLFDAVTHIPLFKILGFGGPGDANTTFEEF

SEQ ID NO: 806416 - protein, 17 aa, Mycobacterium
EDLFVRPEFRRRGLARA

SEQ ID NO: 806417 - protein, 19 aa, Mycobacterium
EDLFWRQGKYGEFDVAEYS

SEQ ID NO: 806418 - protein, 22 aa, Mycobacterium
EDLGLPVFVKPARAGSSFGVSR

SEQ ID NO: 806419 - protein, 17 aa, Mycobacterium
EDLGPVFGPPWCSDAID

SEQ ID NO: 806420 - protein, 18 aa, Mycobacterium
EDLGWYVADNLPPQLITR

SEQ ID NO: 806421 - protein, 23 aa, Mycobacterium
EDLHEIPRRYSAIDLGLIHTGGT

SEQ ID NO: 806422 - protein, 18 aa, Mycobacterium
EDLLFGSYGLDQCLDLTQ

SEQ ID NO: 806423 - protein, 24 aa, Mycobacterium
EDLLGALTVIRPLSRSAGEEVAVG

SEQ ID NO: 806424 - protein, 24 aa, Mycobacterium
EDLLGALTVIRPLSRSASSEVAVG

SEQ ID NO: 806425 - protein, 25 aa, Mycobacterium
EDLLGGIPLAGFFAAGEIGPVFGRN

SEQ ID NO: 806426 - protein, 17 aa, Mycobacterium
EDLLGWCRERMAGFKVP

SEQ ID NO: 806427 - protein, 18 aa, Mycobacterium
EDLLPFSDETLCRAIAAC

SEQ ID NO: 806428 - protein, 17 aa, Mycobacterium
EDLLPFSDETLCRAISA

SEQ ID NO: 806429 - protein, 32 aa, Mycobacterium
EDLLRFDGRRWLLARRIILFDESVIRMQNLAV

SEQ ID NO: 806430 - protein, 25 aa, Mycobacterium
EDLNQLWMCGLPGYFPGDLIDFEFS

SEQ ID NO: 806431 - protein, 27 aa, Mycobacterium
EDLNQLWMCGLPGYFPGDLIDFQFSGD

SEQ ID NO: 806432 - protein, 23 aa, Mycobacterium
EDLNQLWMCGLPGYYPGDLIDFE

SEQ ID NO: 806433 - protein, 22 aa, Mycobacterium
EDLPLFGAFWDRPAQVPTAGTA

SEQ ID NO: 806434 - protein, 23 aa, Mycobacterium
EDLPSAIYHRFARVHSYAAVHRS

SEQ ID NO: 806435 - protein, 27 aa, Mycobacterium
EDLRLALRAATLYYLDGLTQAEIASRL

SEQ ID NO: 806436 - protein, 17 aa, Mycobacterium
EDLRPFSVSILHPGRTL

SEQ ID NO: 806437 - protein, 17 aa, Mycobacterium
EDLRRPVRSRMRAAVSL

SEQ ID NO: 806438 - protein, 29 aa, Mycobacterium
EDLSADYLLVFRQLVLWPVDADGFIEGED

SEQ ID NO: 806439 - protein, 22 aa, Mycobacterium
EDLSRILAPDYARRAREIAARM

SEQ ID NO: 806440 - protein, 38 aa, Mycobacterium
EDLTERLVLTSRQYGIEPQQLFAYLQENNQLPSMFADV

SEQ ID NO: 806441 - protein, 26 aa, Mycobacterium
EDLTRPGRMWWSVPPGVHTFHTWQEM

SEQ ID NO: 806442 - protein, 25 aa, Mycobacterium
EDLVAFRTAVINRLLWRVHELDPSH

SEQ ID NO: 806443 - protein, 19 aa, Mycobacterium
EDLVFAWRACRAVKSNAIV

SEQ ID NO: 806444 - protein, 32 aa, Mycobacterium
EDLVFLRKTLNRAGIPFLLIRNHSGRPILAVD

SEQ ID NO: 806445 - protein, 19 aa, Mycobacterium
EDLYLGLWKRRDLLETAKV

SEQ ID NO: 806446 - protein, 22 aa, Mycobacterium
EDMAALRVVPPRDYVAATEAIA

SEQ ID NO: 806447 - protein, 26 aa, Mycobacterium
EDMANTVAWLVSEDARYITGVALPVD

SEQ ID NO: 806448 - protein, 24 aa, Mycobacterium
EDMESYLILGACNPPLAHRAIGVT

SEQ ID NO: 806449 - protein, 26 aa, Mycobacterium
EDMLAVLLDFFNYFAALTASRREHPT

SEQ ID NO: 806450 - protein, 29 aa, Mycobacterium
EDMPAYLSTSLFAFWIVDSAYSLDGRRNL

SEQ ID NO: 806451 - protein, 24 aa, Mycobacterium
EDMQEFFDLWLDTNGYQCCDLLDI

SEQ ID NO: 806452 - protein, 21 aa, Mycobacterium
EDNAVWIYRTIYARVGNKPDA

SEQ ID NO: 806453 - protein, 18 aa, Mycobacterium
EDNKTTCALALFSTGEQL

SEQ ID NO: 806454 - protein, 28 aa, Mycobacterium
EDNRAWRLYRRLGFTDILRGYYFAGDPR

SEQ ID NO: 806455 - protein, 25 aa, Mycobacterium
EDNSGSWPASLRPALATAGFATGVR

SEQ ID NO: 806456 - protein, 20 aa, Mycobacterium
EDNVVLFPALATAGVPLVRI

SEQ ID NO: 806457 - protein, 17 aa, Mycobacterium
EDPAFAAGFARLYNEWI

SEQ ID NO: 806458 - protein, 17 aa, Mycobacterium
EDPAGFGPALQVVTDHG

SEQ ID NO: 806459 - protein, 18 aa, Mycobacterium
EDPARFAGLLADRLTRMV

SEQ ID NO: 806460 - protein, 17 aa, Mycobacterium
EDPARFVANALSPAKVV

SEQ ID NO: 806461 - protein, 22 aa, Mycobacterium
EDPARFVANALSPAKVVSVTVI

SEQ ID NO: 806462 - protein, 25 aa, Mycobacterium
EDPARGFLPTGGLVLRVAEPAGAGV

SEQ ID NO: 806463 - protein, 18 aa, Mycobacterium
EDPAVIRAAILRGASGAQ

SEQ ID NO: 806464 - protein, 24 aa, Mycobacterium
EDPDAVIELLAAPATRIISLTITE

SEQ ID NO: 806465 - protein, 28 aa, Mycobacterium
EDPDPDLLLLFSALELLHAWALIHDDVI

SEQ ID NO: 806466 - protein, 26 aa, Mycobacterium
EDPENVFFYLTIYNEPYQQPAEPENL

SEQ ID NO: 806467 - protein, 19 aa, Mycobacterium
EDPFSFNIMRNPNPHMGFG

SEQ ID NO: 806468 - protein, 35 aa, Mycobacterium
EDPGPLRRLIATLPALEVPRPDWPHEAVVVGPLHF

SEQ ID NO: 806469 - protein, 26 aa, Mycobacterium
EDPGWANLLDLLAALGLPVEPMGVDD

SEQ ID NO: 806470 - protein, 25 aa, Mycobacterium
EDPGWANLLDLLAALGLVAEPVRVD

SEQ ID NO: 806471 - protein, 24 aa, Mycobacterium
EDPHPMRFYNALGAIRTVLHDNPD

SEQ ID NO: 806472 - protein, 24 aa, Mycobacterium
EDPHYTYKLDWLAALRDTAQCWLK

SEQ ID NO: 806473 - protein, 17 aa, Mycobacterium
EDPPAMLTFGGGVHFCL

SEQ ID NO: 806474 - protein, 17 aa, Mycobacterium
EDPPLHDIHRRLLSRVF

SEQ ID NO: 806475 - protein, 24 aa, Mycobacterium
EDPRFLMITPLSHAGAAYFLPTLI

SEQ ID NO: 806476 - protein, 20 aa, Mycobacterium
EDPRFRFFGNIKVGEQVSAT

SEQ ID NO: 806477 - protein, 24 aa, Mycobacterium
EDPRFTIAAIPPRNDPRDAVVARD

SEQ ID NO: 806478 - protein, 25 aa, Mycobacterium
EDPRPGLLAHLAFAAGDYGFQRWIR

SEQ ID NO: 806479 - protein, 23 aa, Mycobacterium
EDPRRYSVLPLSARTPEALVRLA

SEQ ID NO: 806480 - protein, 23 aa, Mycobacterium
EDPTAGPVLDWVREQLRVAAAQT

SEQ ID NO: 806481 - protein, 25 aa, Mycobacterium
EDPYPYYRRLRDEAPLYRNDDLKFW

SEQ ID NO: 806482 - protein, 23 aa, Mycobacterium
EDQAHRFAWLPFGGGAHKCIGMH

SEQ ID NO: 806483 - protein, 25 aa, Mycobacterium
EDQARVILFLACELSAFVTGHTIPT

SEQ ID NO: 806484 - protein, 22 aa, Mycobacterium
EDQEAFRLIRQNTTTPLAVGEV

SEQ ID NO: 806485 - protein, 19 aa, Mycobacterium
EDQFTMYSYYRDELGLPEM

SEQ ID NO: 806486 - protein, 28 aa, Mycobacterium
EDQFWGDRYGVVADPFGHHWSLGQPVRE

SEQ ID NO: 806487 - protein, 23 aa, Mycobacterium
EDQIFTITLDEALKIYAEPKRRG

SEQ ID NO: 806488 - protein, 19 aa, Mycobacterium
EDRAATISLIHACLAPRHL

SEQ ID NO: 806489 - protein, 19 aa, Mycobacterium
EDRADAFLALPGGIGTLEE

SEQ ID NO: 806490 - protein, 18 aa, Mycobacterium
EDRAVLHTALRLPRDAEL

SEQ ID NO: 806491 - protein, 25 aa, Mycobacterium
EDRCGPIITEWLTQRGFSAGEPEVV

SEQ ID NO: 806492 - protein, 22 aa, Mycobacterium
EDREFFFKVLDLLTEYSAAHPQ

SEQ ID NO: 806493 - protein, 27 aa, Mycobacterium
EDRGAFGDLLSTAGLPAPKYGTATTFA

SEQ ID NO: 806494 - protein, 17 aa, Mycobacterium
EDRGYGYDGIFDEYTIR

SEQ ID NO: 806495 - protein, 23 aa, Mycobacterium
EDRHGILALLDLPHRDLGELLSD

SEQ ID NO: 806496 - protein, 17 aa, Mycobacterium
EDRLAGVVSVIELLQAE

SEQ ID NO: 806497 - protein, 29 aa, Mycobacterium
EDRLEKICRMIMLYHLDRGWADHLAYLAD

SEQ ID NO: 806498 - protein, 22 aa, Mycobacterium
EDRLLVTVLIGHLSLAMQHVRQ

SEQ ID NO: 806499 - protein, 22 aa, Mycobacterium
EDRLLVTVLISHLSLAMQHVRQ

SEQ ID NO: 806500 - protein, 23 aa, Mycobacterium
EDRLRLLSATLHDFLAGIPADIS

SEQ ID NO: 806501 - protein, 25 aa, Mycobacterium
EDRLRTRFEWGLITDVQPPELETRI

SEQ ID NO: 806502 - protein, 19 aa, Mycobacterium
EDRPPLKKAGFLTRDPRAT

SEQ ID NO: 806503 - protein, 23 aa, Mycobacterium
EDRPRIFGIFDQILKALAPEAHP

SEQ ID NO: 806504 - protein, 25 aa, Mycobacterium
EDRQQIRLWLDTFLHREPGEVEMSE

SEQ ID NO: 806505 - protein, 31 aa, Mycobacterium
EDRQRCLEWFATIPLWLDLGELRVVHACWHD

SEQ ID NO: 806506 - protein, 18 aa, Mycobacterium
EDRQWTRDALDVRNRFVL

SEQ ID NO: 806507 - protein, 23 aa, Mycobacterium
EDRRHWHTPCWGNRANRSPTRRW

SEQ ID NO: 806508 - protein, 23 aa, Mycobacterium
EDRRLPTVLFQTTVTKLRDLLAA

SEQ ID NO: 806509 - protein, 17 aa, Mycobacterium
EDRRPTLSWPRDVPLAG

SEQ ID NO: 806510 - protein, 26 aa, Mycobacterium
EDRRRHVVNALWRLGALSLGRAPSSA

SEQ ID NO: 806511 - protein, 26 aa, Mycobacterium
EDRVILVDLSLAKLLAPVLSKLDSVH

SEQ ID NO: 806512 - protein, 17 aa, Mycobacterium
EDRYLMTVIATASNPRF

SEQ ID NO: 806513 - protein, 24 aa, Mycobacterium
EDSLLQVFVLRPCIVAGPHAYSLA

SEQ ID NO: 806514 - protein, 21 aa, Mycobacterium
EDSPVRPVAYKGALRALAAEM

SEQ ID NO: 806515 - protein, 22 aa, Mycobacterium
EDSRLLTRELFYTAVTRAKTRV

SEQ ID NO: 806516 - protein, 21 aa, Mycobacterium
EDSRLLTRELFYTAVTRAQTR

SEQ ID NO: 806517 - protein, 25 aa, Mycobacterium
EDSTDYEWIPLRLPPDVTRVTASIR

SEQ ID NO: 806518 - protein, 24 aa, Mycobacterium
EDSTFYGDLFPHAVRWRGVIYLED

SEQ ID NO: 806519 - protein, 23 aa, Mycobacterium
EDTAYPHVAVAAARLIAEGKADR

SEQ ID NO: 806520 - protein, 34 aa, Mycobacterium
EDTEVLLMLGTDFPYRQFYPPKATVIQVDIRGEH

SEQ ID NO: 806521 - protein, 22 aa, Mycobacterium
EDTFTYGLLYQQESDLAESCRA

SEQ ID NO: 806522 - protein, 26 aa, Mycobacterium
EDTKVELQMLPGASLRDVLRPKPSSQ

SEQ ID NO: 806523 - protein, 17 aa, Mycobacterium
EDTMHFAVLSGVRAWVE

SEQ ID NO: 806524 - protein, 24 aa, Mycobacterium
EDTPWRSEYLYSRAASIYGGTAEI

SEQ ID NO: 806525 - protein, 24 aa, Mycobacterium
EDTTPPLYALRNHLGLKAFDSTVA

SEQ ID NO: 806526 - protein, 25 aa, Mycobacterium
EDTTVVWVQLRPALLELKSHGGIIQ

SEQ ID NO: 806527 - protein, 23 aa, Mycobacterium
EDTVGRLLETIRLGVLGPGESLP

SEQ ID NO: 806528 - protein, 21 aa, Mycobacterium
EDTVIIYRRSAAQMPAHEHEI

SEQ ID NO: 806529 - protein, 24 aa, Mycobacterium
EDTVLARSYGWHRAMRLFDGPDEV

SEQ ID NO: 806530 - protein, 19 aa, Mycobacterium
EDTVVWWACDDWDAASAEV

SEQ ID NO: 806531 - protein, 25 aa, Mycobacterium
EDVANAVAWLVSDEARYITGVALPV

SEQ ID NO: 806532 - protein, 26 aa, Mycobacterium
EDVANAVAWLVSDQARYITGVTLPVD

SEQ ID NO: 806533 - protein, 27 aa, Mycobacterium
EDVANAVAWLVSDQARYITGVTLPVDA

SEQ ID NO: 806534 - protein, 25 aa, Mycobacterium
EDVANLAMFLLSDAACYITGQVINV

SEQ ID NO: 806535 - protein, 26 aa, Mycobacterium
EDVANLRNLLYSLITVSLAVELWRQP

SEQ ID NO: 806536 - protein, 25 aa, Mycobacterium
EDVAPVVQGIWRLGAAMTMLQQPTS

SEQ ID NO: 806537 - protein, 30 aa, Mycobacterium
EDVDTVFGVQLLGPFNVLRPAWKAMVDQGY

SEQ ID NO: 806538 - protein, 24 aa, Mycobacterium
EDVFPLPRELVGEGTLFLLKVVGD

SEQ ID NO: 806539 - protein, 23 aa, Mycobacterium
EDVFVPTYRLIKVTDIYAGTTPG

SEQ ID NO: 806540 - protein, 25 aa, Mycobacterium
EDVKGKAKEAVGAVAGRDDLTREGQ

SEQ ID NO: 806541 - protein, 28 aa, Mycobacterium
EDVLAALRPHFRLRPDPAPRGSAPAELW

SEQ ID NO: 806542 - protein, 18 aa, Mycobacterium
EDVLALSPLQQGLFALYR

SEQ ID NO: 806543 - protein, 17 aa, Mycobacterium
EDVLARLPRRSLAFDVG

SEQ ID NO: 806544 - protein, 35 aa, Mycobacterium
EDVLRPHGLTFSRYELLMLLSFSRAGSMPMAKASA

SEQ ID NO: 806545 - protein, 33 aa, Mycobacterium
EDVLVHGLPLYHVHGLVLGLLGSLRVGNRFVHT

SEQ ID NO: 806546 - protein, 18 aa, Mycobacterium
EDVPSEVILGYLDLVLDG

SEQ ID NO: 806547 - protein, 23 aa, Mycobacterium
EDVRARIGVLSQVPGLWAELVTQ

SEQ ID NO: 806548 - protein, 29 aa, Mycobacterium
EDVRRFRVTYLNYVGKPLALILSTPERPD

SEQ ID NO: 806549 - protein, 24 aa, Mycobacterium
EDVRRNFIDLLSPAELDMLAALNE

SEQ ID NO: 806550 - protein, 25 aa, Mycobacterium
EDVRRNFIELLTPAELDMLAALNER

SEQ ID NO: 806551 - protein, 24 aa, Mycobacterium
EDVRRRILSMLAQGTLHPGSRLGS

SEQ ID NO: 806552 - protein, 20 aa, Mycobacterium
EDVRTLIYLSVPPSAMKPMI

SEQ ID NO: 806553 - protein, 27 aa, Mycobacterium
EDVSCARMFIFIGAAPRTEWLDGVLAR

SEQ ID NO: 806554 - protein, 24 aa, Mycobacterium
EDVTSLYKVGLGSVRFLMSVGDLV

SEQ ID NO: 806555 - protein, 34 aa, Mycobacterium
EDWAHDLAVNLNGPFYLCRAALPRLLERGGNIVN

SEQ ID NO: 806556 - protein, 31 aa, Mycobacterium
EDWDLEKLWEGLRQLYPVGIDHRDLIDSDAI

SEQ ID NO: 806557 - protein, 22 aa, Mycobacterium
EDWEPFLRVNLYGVLHCTRAVL

SEQ ID NO: 806558 - protein, 18 aa, Mycobacterium
EDWHGRCDGDRRGVGGPV

SEQ ID NO: 806559 - protein, 20 aa, Mycobacterium
EDWINIGYFIFERGVFDYLE

SEQ ID NO: 806560 - protein, 18 aa, Mycobacterium
EDWMARFILGFGAEVQVL

SEQ ID NO: 806561 - protein, 18 aa, Mycobacterium
EDWMTRLVLGFGSAVRVL

SEQ ID NO: 806562 - protein, 25 aa, Mycobacterium
EDWQLFADWTEEIFKALNFQPDVTF

SEQ ID NO: 806563 - protein, 19 aa, Mycobacterium
EDWSPALLRALIAVFDLNG

SEQ ID NO: 806564 - protein, 23 aa, Mycobacterium
EDWYQWQWRVHVGLWAAASASKL

SEQ ID NO: 806565 - protein, 30 aa, Mycobacterium
EDYALSGAGLWPLLALLASAADDPAGAELA

SEQ ID NO: 806566 - protein, 23 aa, Mycobacterium
EDYAPLMAYLVRSMQTGGDLANM

SEQ ID NO: 806567 - protein, 19 aa, Mycobacterium
EDYFEAKALLFDPASALRA

SEQ ID NO: 806568 - protein, 20 aa, Mycobacterium
EDYKQFLTEIGYLEPEPADF

SEQ ID NO: 806569 - protein, 29 aa, Mycobacterium
EDYLDARPITTPFGLYDCDVPCDGAIAVI

SEQ ID NO: 806570 - protein, 22 aa, Mycobacterium
EDYLDYTAFSREGLIQQLEYEG

SEQ ID NO: 806571 - protein, 17 aa, Mycobacterium
EDYLILGACNPALAHRA

SEQ ID NO: 806572 - protein, 19 aa, Mycobacterium
EDYWHDEVLTKPPQRPAYV

SEQ ID NO: 806573 - protein, 24 aa, Mycobacterium
EEAAARGLWHIAVTSGLVTGDDAA

SEQ ID NO: 806574 - protein, 24 aa, Mycobacterium
EEAAARLAMLPVVAAVGPYDGTLS

SEQ ID NO: 806575 - protein, 33 aa, Mycobacterium
EEAAKMMEAYKDKPTIVLPGTGGSVSGTAVNEW

SEQ ID NO: 806576 - protein, 29 aa, Mycobacterium
EEAAYPLGAGFRPKVWPPVRRIDGAYGDR

SEQ ID NO: 806577 - protein, 23 aa, Mycobacterium
EEACSLAVLIERAAKLQLAAMAA

SEQ ID NO: 806578 - protein, 24 aa, Mycobacterium
EEACSLGILIERAAKLQLAAMAAG

SEQ ID NO: 806579 - protein, 25 aa, Mycobacterium
EEAEALLLPQLQMMARLRTGQPLNA

SEQ ID NO: 806580 - protein, 29 aa, Mycobacterium
EEAEERFLAGLPLPYIPSARDIAYSIAFL

SEQ ID NO: 806581 - protein, 34 aa, Mycobacterium
EEAELRAWLRRFSTDWPRWGWRRAAKMARRAGWA

SEQ ID NO: 806582 - protein, 26 aa, Mycobacterium
EEAFYAALEFWSALHGFVLLEMTGVM

SEQ ID NO: 806583 - protein, 26 aa, Mycobacterium
EEAGPDALIVVLLPDGGRGYMAKIFN

SEQ ID NO: 806584 - protein, 24 aa, Mycobacterium
EEAILVRLTELPPGSPVAVVVRQL

SEQ ID NO: 806585 - protein, 29 aa, Mycobacterium
EEAKKRPEFTKLTPLYPNQRLRLETSSDK

SEQ ID NO: 806586 - protein, 24 aa, Mycobacterium
EEAKLFTRFLKLLPTNEPKIELLL

SEQ ID NO: 806587 - protein, 29 aa, Mycobacterium
EEAKSYRFNPFDLTKVWPHSDYPLIDVGK

SEQ ID NO: 806588 - protein, 27 aa, Mycobacterium
EEANALLREFVGMTLNLPTPEEAAAAE

SEQ ID NO: 806589 - protein, 30 aa, Mycobacterium
EEAPSPLVQRIPGMRAKLFDAARLAAEAIG

SEQ ID NO: 806590 - protein, 18 aa, Mycobacterium
EEAQPIHLLINNAGVMTP

SEQ ID NO: 806591 - protein, 23 aa, Mycobacterium
EEARGGVLFIDEAYRLVPKTEGH

SEQ ID NO: 806592 - protein, 26 aa, Mycobacterium
EEARKNFFRVPLIGGTVTHPVQGEAA

SEQ ID NO: 806593 - protein, 24 aa, Mycobacterium
EEARLRGAGLRALWVCRGEDQRDA

SEQ ID NO: 806594 - protein, 24 aa, Mycobacterium
EEASGLFHRAIVQSAPLGLGDERA

SEQ ID NO: 806595 - protein, 20 aa, Mycobacterium
EEATFLTRFARSVTLIHRRD

SEQ ID NO: 806596 - protein, 18 aa, Mycobacterium
EEAVAVGDLVRLMEFRKG

SEQ ID NO: 806597 - protein, 17 aa, Mycobacterium
EEAYGSLSGFMTAAGIS

SEQ ID NO: 806598 - protein, 23 aa, Mycobacterium
EEAYTLAMLLADALGPEAFRQRV

SEQ ID NO: 806599 - protein, 19 aa, Mycobacterium
EECARKRGLILGRQEYDGM

SEQ ID NO: 806600 - protein, 24 aa, Mycobacterium
EEDGPVYQLRRWYEQFYVDVADVT

SEQ ID NO: 806601 - protein, 24 aa, Mycobacterium
EEDKAWFIEHRFLSTERAKAVTRG

SEQ ID NO: 806602 - protein, 18 aa, Mycobacterium
EEDKLRTVLWGWAGKPVD

SEQ ID NO: 806603 - protein, 17 aa, Mycobacterium
EEDKYCIDILTQISAIN

SEQ ID NO: 806604 - protein, 28 aa, Mycobacterium
EEDLNQLWMCGLPGYYPGDLIDFQFAGD

SEQ ID NO: 806605 - protein, 29 aa, Mycobacterium
EEDRRRLRRKQRLYLEEWVHLVNELREDL

SEQ ID NO: 806606 - protein, 19 aa, Mycobacterium
EEDVWIPAEMKQFAKRYAT

SEQ ID NO: 806607 - protein, 21 aa, Mycobacterium
EEDWDEMIDINLSGVWKSVKA

SEQ ID NO: 806608 - protein, 26 aa, Mycobacterium
EEEHLAYAIPFPPLGERFDRLTEQLQ

SEQ ID NO: 806609 - protein, 20 aa, Mycobacterium
EEEMLAMNPERQPTSRLSCQ

SEQ ID NO: 806610 - protein, 23 aa, Mycobacterium
EEERRLLYVGITRARTHLALSWA

SEQ ID NO: 806611 - protein, 23 aa, Mycobacterium
EEERRLLYVGITRARTHLALTWA

SEQ ID NO: 806612 - protein, 20 aa, Mycobacterium
EEERRLLYVGVTRARVHLAL

SEQ ID NO: 806613 - protein, 21 aa, Mycobacterium
EEERRLLYVGVTRARVHLALS

SEQ ID NO: 806614 - protein, 25 aa, Mycobacterium
EEESPIVFLRLRKGVRKNGVQVVAV

SEQ ID NO: 806615 - protein, 25 aa, Mycobacterium
EEESPIVYLRLRKAVRKNGVQVMSV

SEQ ID NO: 806616 - protein, 25 aa, Mycobacterium
EEESPVVFLRLRKGVRKRGLKVLTI

SEQ ID NO: 806617 - protein, 27 aa, Mycobacterium
EEEWCEEAPFYTLGPLATDIAPAYDHI

SEQ ID NO: 806618 - protein, 17 aa, Mycobacterium
EEEWRGHWPSPGVIDEP

SEQ ID NO: 806619 - protein, 29 aa, Mycobacterium
EEFARGLVDVPFLGPILADDLAQRLGRAV

SEQ ID NO: 806620 - protein, 21 aa, Mycobacterium
EEFAYPIPVTVICKILGVPVE

SEQ ID NO: 806621 - protein, 24 aa, Mycobacterium
EEFDADFFGFTPQAAKALDPQHRL

SEQ ID NO: 806622 - protein, 20 aa, Mycobacterium
EEFGFATAPLVVAGCIMMRV

SEQ ID NO: 806623 - protein, 17 aa, Mycobacterium
EEFGFHVGLAQLAGNAL

SEQ ID NO: 806624 - protein, 25 aa, Mycobacterium
EEFKEPLYGPPPLLLRMVEAGQLGK

SEQ ID NO: 806625 - protein, 28 aa, Mycobacterium
EEFLAGPNLLGNAWPLFAQSMAMVADGF

SEQ ID NO: 806626 - protein, 17 aa, Mycobacterium
EEFLLTHPDIEDVHVVG

SEQ ID NO: 806627 - protein, 19 aa, Mycobacterium
EEFLRNMWADFFRNPIRQL

SEQ ID NO: 806628 - protein, 17 aa, Mycobacterium
EEFQAKWAPSIVVGLGR

SEQ ID NO: 806629 - protein, 20 aa, Mycobacterium
EEFRASRIMLERARANDKIT

SEQ ID NO: 806630 - protein, 18 aa, Mycobacterium
EEFRSCQLTFRAQAAPWN

SEQ ID NO: 806631 - protein, 27 aa, Mycobacterium
EEFSFHDLRHYLASLLIASGADIKTVQ

SEQ ID NO: 806632 - protein, 26 aa, Mycobacterium
EEGALLREFVGMTLNLPTPEEAEAAE

SEQ ID NO: 806633 - protein, 55 aa, Mycobacterium
EEGDRGVSWLPFFHDMGLITVLLSPMLGHHISFMTPAAFVRRPGRWIRAMARKPD

SEQ ID NO: 806634 - protein, 17 aa, Mycobacterium
EEGIIDPFKVTRAALES

SEQ ID NO: 806635 - protein, 25 aa, Mycobacterium
EEGIKFFVYANLDYGLKKSGYDSRF

SEQ ID NO: 806636 - protein, 25 aa, Mycobacterium
EEGIRFLVYGNLDYGLKKAGYDSRY

SEQ ID NO: 806637 - protein, 27 aa, Mycobacterium
EEGKGFQYILDGLNPERMLIAAEALGI

SEQ ID NO: 806638 - protein, 22 aa, Mycobacterium
EEGLLRQWLRTVAEHLDTPAAP

SEQ ID NO: 806639 - protein, 21 aa, Mycobacterium
EEGLLRRYLEVDRAWRDHLLV

SEQ ID NO: 806640 - protein, 17 aa, Mycobacterium
EEGLRFQVLAPVVRTRK

SEQ ID NO: 806641 - protein, 34 aa, Mycobacterium
EEGPVREQVPVRLVLRLPEWQLAVPQVGGPGQEA

SEQ ID NO: 806642 - protein, 23 aa, Mycobacterium
EEGRIFEELSLRGCVAALDGSDV

SEQ ID NO: 806643 - protein, 24 aa, Mycobacterium
EEGRLFTRFLKMLPTNKAMIDELL

SEQ ID NO: 806644 - protein, 20 aa, Mycobacterium
EEGRRKFGFYGDDAAAAQWV

SEQ ID NO: 806645 - protein, 22 aa, Mycobacterium
EEGTLRMLWVTATNPAVSLPEL

SEQ ID NO: 806646 - protein, 22 aa, Mycobacterium
EEGTLRMLWVTATNPLVSLPEL

SEQ ID NO: 806647 - protein, 27 aa, Mycobacterium
EEHHLAATGWLPSPLILAAAVAGRTRN

SEQ ID NO: 806648 - protein, 20 aa, Mycobacterium
EEHPPLRFVRSCSAPLDPAT

SEQ ID NO: 806649 - protein, 27 aa, Mycobacterium
EEHRAKLREFLGTMLNLPTPEQAAAAQ

SEQ ID NO: 806650 - protein, 24 aa, Mycobacterium
EEHRLRRLVDWFDHAIALGASGVA

SEQ ID NO: 806651 - protein, 24 aa, Mycobacterium
EEHTRFRRMLSKPFTFRRVEALRP

SEQ ID NO: 806652 - protein, 24 aa, Mycobacterium
EEIAAMAAFLLSPDASFVSGQALA

SEQ ID NO: 806653 - protein, 24 aa, Mycobacterium
EEIAAMAAFLLSPDASFVTGQAIA

SEQ ID NO: 806654 - protein, 20 aa, Mycobacterium
EEIAFWQKSPTKSCPMVWTH

SEQ ID NO: 806655 - protein, 24 aa, Mycobacterium
EEICAWIRMKPGRPPLDADKVREF

SEQ ID NO: 806656 - protein, 27 aa, Mycobacterium
EEIDGPLPPRLRVLAIILAAEQTVVAA

SEQ ID NO: 806657 - protein, 22 aa, Mycobacterium
EEIELLLLRHEGIERAALVAMP

SEQ ID NO: 806658 - protein, 25 aa, Mycobacterium
EEIFEHTEPRWWLGKGFVGEYAGAV

SEQ ID NO: 806659 - protein, 24 aa, Mycobacterium
EEIFGPVLSVLRFTDLDAAIAQAN

SEQ ID NO: 806660 - protein, 18 aa, Mycobacterium
EEIFGPVLVVIPFEDEDD

SEQ ID NO: 806661 - protein, 23 aa, Mycobacterium
EEIGYARLTIPLVAARAGATPPA

SEQ ID NO: 806662 - protein, 24 aa, Mycobacterium
EEILKRFPAWEVDWANAVPSETAA

SEQ ID NO: 806663 - protein, 24 aa, Mycobacterium
EEILKRWPDWTIDLGNAVRSPTAT

SEQ ID NO: 806664 - protein, 28 aa, Mycobacterium
EEIPDRITRLIFWSAFVPRPGRSITEEV

SEQ ID NO: 806665 - protein, 25 aa, Mycobacterium
EEIPEQLLPQLGKFSRRSLLEVIQK

SEQ ID NO: 806666 - protein, 26 aa, Mycobacterium
EEIPPALLEPFKGPWGTDTLLDLMCT

SEQ ID NO: 806667 - protein, 23 aa, Mycobacterium
EEIRLFNRLLTRVMSLSRFDTRA

SEQ ID NO: 806668 - protein, 37 aa, Mycobacterium
EEITRVVPFIEWLRSTFPDRLISIDTWRAAVAKQACA

SEQ ID NO: 806669 - protein, 26 aa, Mycobacterium
EEIVALGQLFRLPIAALGNGATIRDM

SEQ ID NO: 806670 - protein, 25 aa, Mycobacterium
EEIVELGQLFRLPIAALGNGATIRN

SEQ ID NO: 806671 - protein, 26 aa, Mycobacterium
EEIVELGQLFRLPIAALGNGSTIREM

SEQ ID NO: 806672 - protein, 40 aa, Mycobacterium
EEIVRQLRLRDIGGIVVIDFIDMVLESNRDLVLRRLTEAL

SEQ ID NO: 806673 - protein, 18 aa, Mycobacterium
EEIVTRCLPLADNVARHF

SEQ ID NO: 806674 - protein, 28 aa, Mycobacterium
EEKARALGLRPLAAFRSWSYVSVDPADE

SEQ ID NO: 806675 - protein, 18 aa, Mycobacterium
EEKETRGPSDERARSGGP

SEQ ID NO: 806676 - protein, 27 aa, Mycobacterium
EEKFGFLLEAFMFGAPPHGGIAFGWDR

SEQ ID NO: 806677 - protein, 23 aa, Mycobacterium
EEKVTGIFLVPAQWQAVCAEQRA

SEQ ID NO: 806678 - protein, 25 aa, Mycobacterium
EELAARFARPLRFGTAGLRGPVRGG

SEQ ID NO: 806679 - protein, 32 aa, Mycobacterium
EELADAYAKAWYKLIHRDLGPLSRYLGPLVPK

SEQ ID NO: 806680 - protein, 37 aa, Mycobacterium
EELADRYGPLPLPVQRLVAVASLRLLCREMGITDLSV

SEQ ID NO: 806681 - protein, 21 aa, Mycobacterium
EELAQWRAAIGVNLDGAYHTA

SEQ ID NO: 806682 - protein, 17 aa, Mycobacterium
EELAQWRAVTGVNLDGA

SEQ ID NO: 806683 - protein, 18 aa, Mycobacterium
EELATLLEPGRTYQFNAL

SEQ ID NO: 806684 - protein, 26 aa, Mycobacterium
EELDVDFGELLWSFAPPARPRPADMS

SEQ ID NO: 806685 - protein, 19 aa, Mycobacterium
EELEQIWRGRVERIDDLIA

SEQ ID NO: 806686 - protein, 21 aa, Mycobacterium
EELFEWHRQNVAAPGGSEWSG

SEQ ID NO: 806687 - protein, 19 aa, Mycobacterium
EELFGPVAVVYRVADAEEA

SEQ ID NO: 806688 - protein, 27 aa, Mycobacterium
EELFSGVDLLPTLLDLLGVPVPDEVEG

SEQ ID NO: 806689 - protein, 18 aa, Mycobacterium
EELFSGVDLLPTLLELLG

SEQ ID NO: 806690 - protein, 26 aa, Mycobacterium
EELGEQLPIYRPPLDMSRLFGEPRLG

SEQ ID NO: 806691 - protein, 19 aa, Mycobacterium
EELGHPLVDKVRGKGLLQG

SEQ ID NO: 806692 - protein, 26 aa, Mycobacterium
EELGIDVFLVMPFTSDFMKLTPERYI

SEQ ID NO: 806693 - protein, 27 aa, Mycobacterium
EELGIDVFLVMPFTTDFMKLTPDRFIH

SEQ ID NO: 806694 - protein, 27 aa, Mycobacterium
EELGIDVFLVMPFTTDFMKLTPDRYIH

SEQ ID NO: 806695 - protein, 28 aa, Mycobacterium
EELGIDVFLVMPFTTDFMKLTPDRYVHE

SEQ ID NO: 806696 - protein, 27 aa, Mycobacterium
EELGKALVPTPLLGTTLAEIALLSVGR

SEQ ID NO: 806697 - protein, 22 aa, Mycobacterium
EELGLTWLCEIGAHGVAAGPDS

SEQ ID NO: 806698 - protein, 17 aa, Mycobacterium
EELGPVSILVNAAGLSD

SEQ ID NO: 806699 - protein, 26 aa, Mycobacterium
EELGRALACLPWISSAALGATALVSS

SEQ ID NO: 806700 - protein, 26 aa, Mycobacterium
EELIGILGGQTRQLAFAKTPPTVVML

SEQ ID NO: 806701 - protein, 17 aa, Mycobacterium
EELLADWYGTEAALVYN

SEQ ID NO: 806702 - protein, 18 aa, Mycobacterium
EELLAESAIALPDKEVVS

SEQ ID NO: 806703 - protein, 22 aa, Mycobacterium
EELLARMRALLRRTVSDDSGDS

SEQ ID NO: 806704 - protein, 17 aa, Mycobacterium
EELLGRFAQHQIDALIL

SEQ ID NO: 806705 - protein, 38 aa, Mycobacterium
EELLPGIRNILNTLPPHPSHFLWLNWGPSPARQDMAYS

SEQ ID NO: 806706 - protein, 19 aa, Mycobacterium
EELLRYLSIIQNGQRRVAH

SEQ ID NO: 806707 - protein, 22 aa, Mycobacterium
EELLRYLSIIQNGQRRVALEDI

SEQ ID NO: 806708 - protein, 22 aa, Mycobacterium
EELLRYLSIIQTGQRRVALEDI

SEQ ID NO: 806709 - protein, 23 aa, Mycobacterium
EELLVERAVGAILRDIRKRAGSD

SEQ ID NO: 806710 - protein, 20 aa, Mycobacterium
EELMRYLSIIQTGQRRIAVE

SEQ ID NO: 806711 - protein, 22 aa, Mycobacterium
EELMRYLSIIQTGQRRIAVEDI

SEQ ID NO: 806712 - protein, 19 aa, Mycobacterium
EELMRYLSIIQTGQRRVAV

SEQ ID NO: 806713 - protein, 25 aa, Mycobacterium
EELPDISLVPVYRQFFELASVRSEE

SEQ ID NO: 806714 - protein, 18 aa, Mycobacterium
EELPFKHDALAYGLYELP

SEQ ID NO: 806715 - protein, 20 aa, Mycobacterium
EELPGDPLALIAPAGTEGGA

SEQ ID NO: 806716 - protein, 33 aa, Mycobacterium
EELPGPGTVFLNVNWSFKAPVRPGDVITGRVEV

SEQ ID NO: 806717 - protein, 23 aa, Mycobacterium
EELPLIEEWFEFVGDKLPTGVRD

SEQ ID NO: 806718 - protein, 26 aa, Mycobacterium
EELPLIEEWLQFIGEKLPTGIKDEFD

SEQ ID NO: 806719 - protein, 30 aa, Mycobacterium
EELQLPVLRAQLRWMEAVLAVWHGDFAEAG

SEQ ID NO: 806720 - protein, 25 aa, Mycobacterium
EELRATLLALLGSPHLCSRAFITEQ

SEQ ID NO: 806721 - protein, 22 aa, Mycobacterium
EELRLKYRYLDLRRDGPAAALR

SEQ ID NO: 806722 - protein, 22 aa, Mycobacterium
EELRLKYRYLDLRRDGPAEAIR

SEQ ID NO: 806723 - protein, 26 aa, Mycobacterium
EELRQTIPELPWLTRKRIQQEWGVSD

SEQ ID NO: 806724 - protein, 26 aa, Mycobacterium
EELRRLWRARRVLAVTFPAYGSSTET

SEQ ID NO: 806725 - protein, 22 aa, Mycobacterium
EELSALGLLKRFVKGRVVRANE

SEQ ID NO: 806726 - protein, 23 aa, Mycobacterium
EELSAYLQTRLARYEIPTALILT

SEQ ID NO: 806727 - protein, 26 aa, Mycobacterium
EELSPMLAIIPLQLLAMQLAIGRGEN

SEQ ID NO: 806728 - protein, 17 aa, Mycobacterium
EELSPMTPFERKIVHDA

SEQ ID NO: 806729 - protein, 24 aa, Mycobacterium
EELTDLLWRMGIRTIGQFAALSAT

SEQ ID NO: 806730 - protein, 25 aa, Mycobacterium
EELTDLLWRMGIRTIGQFAALSRSD

SEQ ID NO: 806731 - protein, 25 aa, Mycobacterium
EELTDLLWRMGIRTIGQFAALSRTD

SEQ ID NO: 806732 - protein, 18 aa, Mycobacterium
EELTGFKKPIRACLVDLG

SEQ ID NO: 806733 - protein, 23 aa, Mycobacterium
EELTLAAPLVLPGGTSVAVEVIV

SEQ ID NO: 806734 - protein, 22 aa, Mycobacterium
EELVGILGGQTRELVFAKTPPT

SEQ ID NO: 806735 - protein, 18 aa, Mycobacterium
EELVMLATRFTEFAVHVV

SEQ ID NO: 806736 - protein, 20 aa, Mycobacterium
EELVMWWNFVGRSHDDIAAY

SEQ ID NO: 806737 - protein, 17 aa, Mycobacterium
EELVPVQLIGKLTLDRN

SEQ ID NO: 806738 - protein, 19 aa, Mycobacterium
EELVRRGEELAAGKAVTVD

SEQ ID NO: 806739 - protein, 23 aa, Mycobacterium
EELWFAHDYVPFDRGENFAFLGG

SEQ ID NO: 806740 - protein, 24 aa, Mycobacterium
EELWFAHDYVPFDRGENFAFLGGR

SEQ ID NO: 806741 - protein, 32 aa, Mycobacterium
EELWLPWRGQRLPGYWFVPPGSSGPGPTLVAT

SEQ ID NO: 806742 - protein, 31 aa, Mycobacterium
EEMAAKLAGFGYAVLLPDVYYRTADWAPFDM

SEQ ID NO: 806743 - protein, 23 aa, Mycobacterium
EEMARLFAWRPDAVTAAADLGEQ

SEQ ID NO: 806744 - protein, 26 aa, Mycobacterium
EEMDAAFAKAWFKLMHRDMGPVSRYL

SEQ ID NO: 806745 - protein, 24 aa, Mycobacterium
EEMGFDVNTPWKKLPAKARRAILE

SEQ ID NO: 806746 - protein, 28 aa, Mycobacterium
EEMGRALVCSPFFATVALATQAILASED

SEQ ID NO: 806747 - protein, 23 aa, Mycobacterium
EEMIRFCAPAQWFARTVRKPFTL

SEQ ID NO: 806748 - protein, 31 aa, Mycobacterium
EEMRDELARLLQFVLDLLADYGLDDFYLELS

SEQ ID NO: 806749 - protein, 30 aa, Mycobacterium
EEMVDELLREFLDWLFARYLEIVDGEPNPL

SEQ ID NO: 806750 - protein, 31 aa, Mycobacterium
EEMVDELLRSFLDWLFARYREIVDGEANPLE

SEQ ID NO: 806751 - protein, 31 aa, Mycobacterium
EEMVDELLRSFLDWLFARYREIVDSEANPLE

SEQ ID NO: 806752 - protein, 23 aa, Mycobacterium
EEMYKYLVAVSRQPDHDKIRAYC

SEQ ID NO: 806753 - protein, 23 aa, Mycobacterium
EENAELFWGLRGGKATLGIVTSV

SEQ ID NO: 806754 - protein, 24 aa, Mycobacterium
EENILKTLNPLFLDELRAEFDRAR

SEQ ID NO: 806755 - protein, 17 aa, Mycobacterium
EENIRFIQALAASDIRY

SEQ ID NO: 806756 - protein, 17 aa, Mycobacterium
EENITLPSIYFAHRRKV

SEQ ID NO: 806757 - protein, 27 aa, Mycobacterium
EENYNLSYVQRMAVVLGRRVWEHAGSP

SEQ ID NO: 806758 - protein, 24 aa, Mycobacterium
EEPAFDIFAMVPPPGDAGLGRVGM

SEQ ID NO: 806759 - protein, 24 aa, Mycobacterium
EEPAFDILALVPPPADVGLGRIGT

SEQ ID NO: 806760 - protein, 27 aa, Mycobacterium
EEPANQGAWPTFGLNLPEVVPRLTGLT

SEQ ID NO: 806761 - protein, 26 aa, Mycobacterium
EEPANQGAWPTLGLTLPEVLPDKLAG

SEQ ID NO: 806762 - protein, 18 aa, Mycobacterium
EEPAPTPTLGFTAPEPED

SEQ ID NO: 806763 - protein, 19 aa, Mycobacterium
EEPDSYLAYGFAVHNCTAP

SEQ ID NO: 806764 - protein, 23 aa, Mycobacterium
EEPHLLVLFDGGTAALIEPAALT

SEQ ID NO: 806765 - protein, 25 aa, Mycobacterium
EEPRKEWQLQFTIGSAPRSSSVVAT

SEQ ID NO: 806766 - protein, 21 aa, Mycobacterium
EEPRWIYYSSGTTAAPKGARH

SEQ ID NO: 806767 - protein, 17 aa, Mycobacterium
EEPWPAHKELFDRAWKS

SEQ ID NO: 806768 - protein, 22 aa, Mycobacterium
EEPWPAHKELYDRAWTSEDIIE

SEQ ID NO: 806769 - protein, 27 aa, Mycobacterium
EEQAGAILFLLSDLSSYITGQTLLVDG

SEQ ID NO: 806770 - protein, 25 aa, Mycobacterium
EEQARALCLRLLTARARTRAELRGR

SEQ ID NO: 806771 - protein, 24 aa, Mycobacterium
EEQIYQMYRLLALAKYEERYVIPT

SEQ ID NO: 806772 - protein, 26 aa, Mycobacterium
EEQKAKWLPDLTAGRALAGFGLTEPG

SEQ ID NO: 806773 - protein, 24 aa, Mycobacterium
EEQKKFFLPKIASGELHFSIGYSE

SEQ ID NO: 806774 - protein, 25 aa, Mycobacterium
EEQKKFFLPRIAKGDLHFSIGYSEP

SEQ ID NO: 806775 - protein, 24 aa, Mycobacterium
EEQKKRWLPGIADGTLTMAFAITE

SEQ ID NO: 806776 - protein, 25 aa, Mycobacterium
EEQKKRWLPGIADGTLTMAFAITEP

SEQ ID NO: 806777 - protein, 23 aa, Mycobacterium
EEQKQRWLPKFCSGELITAIAMT

SEQ ID NO: 806778 - protein, 23 aa, Mycobacterium
EEQKQRWLPKFCTGEFITAIAMT

SEQ ID NO: 806779 - protein, 23 aa, Mycobacterium
EEQKQRWLPKFCTGEIITAIAMT

SEQ ID NO: 806780 - protein, 23 aa, Mycobacterium
EEQKQRWLPKFCTGELITAIAMT

SEQ ID NO: 806781 - protein, 24 aa, Mycobacterium
EEQKQRWLPRFASGELIGALAMTE

SEQ ID NO: 806782 - protein, 27 aa, Mycobacterium
EEQKTRWLPDLTAGRALAGFGLTEPGA

SEQ ID NO: 806783 - protein, 27 aa, Mycobacterium
EEQLAVLTDFFNYFAALTASRREHPTE

SEQ ID NO: 806784 - protein, 17 aa, Mycobacterium
EEQLLEVMERREELMAE

SEQ ID NO: 806785 - protein, 17 aa, Mycobacterium
EEQLLHHPSIFSAAAVA

SEQ ID NO: 806786 - protein, 17 aa, Mycobacterium
EEQLLSHPAIRSAAAVP

SEQ ID NO: 806787 - protein, 19 aa, Mycobacterium
EEQLWGTLLASAAATRNAQ

SEQ ID NO: 806788 - protein, 19 aa, Mycobacterium
EEQLWGTLLASAAATRNTQ

SEQ ID NO: 806789 - protein, 23 aa, Mycobacterium
EEQRKLWVPKLASMDAIASYCLT

SEQ ID NO: 806790 - protein, 28 aa, Mycobacterium
EEQRPPFWQQLVELGWLGLHIGEEHGGS

SEQ ID NO: 806791 - protein, 27 aa, Mycobacterium
EEQRRGLTIDLGFAWTTLEGRDIAFVD

SEQ ID NO: 806792 - protein, 17 aa, Mycobacterium
EEQSLYHSGAFFQLYVT

SEQ ID NO: 806793 - protein, 27 aa, Mycobacterium
EEQVAALLMAIYLRGMNGAETAAWTAA

SEQ ID NO: 806794 - protein, 17 aa, Mycobacterium
EEQWNALRGAGAGSRDL

SEQ ID NO: 806795 - protein, 21 aa, Mycobacterium
EERARFAERFGAVATIAVAPG

SEQ ID NO: 806796 - protein, 25 aa, Mycobacterium
EEREHWWKLAVEAYPPYAEYQTKTD

SEQ ID NO: 806797 - protein, 19 aa, Mycobacterium
EERFFDFVVTPRRRADGSI

SEQ ID NO: 806798 - protein, 23 aa, Mycobacterium
EERHRMFQALAAKYAFFGDYQSR

SEQ ID NO: 806799 - protein, 26 aa, Mycobacterium
EERHSQQWAQKGFVRMARDYGLGALI

SEQ ID NO: 806800 - protein, 17 aa, Mycobacterium
EERIEMWLRADRGQRVR

SEQ ID NO: 806801 - protein, 27 aa, Mycobacterium
EERIPNEIVLPILERIGAFGLLVPREY

SEQ ID NO: 806802 - protein, 23 aa, Mycobacterium
EERLLDERLLTIEWQQRELPRPE

SEQ ID NO: 806803 - protein, 22 aa, Mycobacterium
EERLLRLGLESLRLWRDGGFLD

SEQ ID NO: 806804 - protein, 27 aa, Mycobacterium
EERLPKPGVWPLCHSLAFDASVWEISN

SEQ ID NO: 806805 - protein, 19 aa, Mycobacterium
EERLRLDSELRQKGIDLAL

SEQ ID NO: 806806 - protein, 35 aa, Mycobacterium
EERPFTVTRPDRLPVWIYQFKISPHRTIPRATTTA

SEQ ID NO: 806807 - protein, 21 aa, Mycobacterium
EERPYHFTRPDGLAVSLYAFR

SEQ ID NO: 806808 - protein, 18 aa, Mycobacterium
EERRIIRRKSFSMVPCTV

SEQ ID NO: 806809 - protein, 17 aa, Mycobacterium
EERRLAYVGITRARRRL

SEQ ID NO: 806810 - protein, 21 aa, Mycobacterium
EERRLFRELFYQHHRARPNVR

SEQ ID NO: 806811 - protein, 22 aa, Mycobacterium
EERRLLYVAITRAEDTLLVSGH

SEQ ID NO: 806812 - protein, 21 aa, Mycobacterium
EERRLLYVGITRARVHLALSW

SEQ ID NO: 806813 - protein, 19 aa, Mycobacterium
EERRLLYVGVTRARVHLTL

SEQ ID NO: 806814 - protein, 20 aa, Mycobacterium
EERRRMFELPRSSWDDYDRS

SEQ ID NO: 806815 - protein, 21 aa, Mycobacterium
EERRRMFELPRSSWDDYDTSL

SEQ ID NO: 806816 - protein, 22 aa, Mycobacterium
EERSMIHAFANFFPLGGGGAAA

SEQ ID NO: 806817 - protein, 33 aa, Mycobacterium
EERTRVRFDLILDLAAPYPTFLVRRAKQMVLDI

SEQ ID NO: 806818 - protein, 17 aa, Mycobacterium
EERVGIITLNRPKALNA

SEQ ID NO: 806819 - protein, 20 aa, Mycobacterium
EERVRMLRSFDPRSGAHALD

SEQ ID NO: 806820 - protein, 25 aa, Mycobacterium
EERVTVDFPYREGLFQGVLQERRAD

SEQ ID NO: 806821 - protein, 26 aa, Mycobacterium
EESERLLRGFLTPALWEAGLYCRADD

SEQ ID NO: 806822 - protein, 23 aa, Mycobacterium
EESGITLVAFLREDSMNIYTRAD

SEQ ID NO: 806823 - protein, 23 aa, Mycobacterium
EESGITLVAFLREDSMNVYTRPD

SEQ ID NO: 806824 - protein, 18 aa, Mycobacterium
EESILARFKQFADAGVTD

SEQ ID NO: 806825 - protein, 30 aa, Mycobacterium
EESKGHFYGVGLINWWDPSGTRSTLEQLKS

SEQ ID NO: 806826 - protein, 18 aa, Mycobacterium
EESKRFCWNCGKPVGRST

SEQ ID NO: 806827 - protein, 26 aa, Mycobacterium
EESLALLDGLPLRYDRARVNFAYGQT

SEQ ID NO: 806828 - protein, 23 aa, Mycobacterium
EESLCFAGANLIPLRGAPEDMDA

SEQ ID NO: 806829 - protein, 28 aa, Mycobacterium
EESLHYEMPLILNVPTFTICCATLLDTG

SEQ ID NO: 806830 - protein, 24 aa, Mycobacterium
EESLNEMLTAYPPLGKRPGSVRSH

SEQ ID NO: 806831 - protein, 26 aa, Mycobacterium
EESPLRPRLWRQRSSAWRRWPQAISM

SEQ ID NO: 806832 - protein, 19 aa, Mycobacterium
EESRFRAMCEARGLPAVRI

SEQ ID NO: 806833 - protein, 21 aa, Mycobacterium
EESRLRMLRSFDPRSGAYVLD

SEQ ID NO: 806834 - protein, 29 aa, Mycobacterium
EESRPPFWQNLVELGWLGLHVDEEHGGSG

SEQ ID NO: 806835 - protein, 26 aa, Mycobacterium
EESYLALLDALRWLGMDWDEGPEVGG

SEQ ID NO: 806836 - protein, 25 aa, Mycobacterium
EETALIARWLAAPDVRIVRTAGQTD

SEQ ID NO: 806837 - protein, 17 aa, Mycobacterium
EETFRVWKQELAAAEAT

SEQ ID NO: 806838 - protein, 25 aa, Mycobacterium
EETGAALLPAPFIGSAVLATALIEA

SEQ ID NO: 806839 - protein, 29 aa, Mycobacterium
EETGAALLPAPFISSAVLTVALINAVGSD

SEQ ID NO: 806840 - protein, 34 aa, Mycobacterium
EETGEPHWAPWYAGRPILVTANDYGLRLYNGDTG

SEQ ID NO: 806841 - protein, 19 aa, Mycobacterium
EETGLLPHLNPGVMSWSEM

SEQ ID NO: 806842 - protein, 33 aa, Mycobacterium
EETHPLWIVRRTMIDVIKPIDFKEALWLRRWCS

SEQ ID NO: 806843 - protein, 23 aa, Mycobacterium
EETKLVLISILEELLEISDVDPE

SEQ ID NO: 806844 - protein, 21 aa, Mycobacterium
EETVPMFVAALKPIEWRYDND

SEQ ID NO: 806845 - protein, 25 aa, Mycobacterium
EEVAEVIRFLISPAASYIQGAAIAV

SEQ ID NO: 806846 - protein, 25 aa, Mycobacterium
EEVASYLFHAFGTNLQFAPGEFNFV

SEQ ID NO: 806847 - protein, 24 aa, Mycobacterium
EEVASYLFHAFGTNLQFGPDEFNF

SEQ ID NO: 806848 - protein, 25 aa, Mycobacterium
EEVASYLFHAFGTNLQFGPGEFNFV

SEQ ID NO: 806849 - protein, 25 aa, Mycobacterium
EEVASYLFHAYGTNLQFAPGEFNFV

SEQ ID NO: 806850 - protein, 18 aa, Mycobacterium
EEVDLALTLFKNDFEIAY

SEQ ID NO: 806851 - protein, 28 aa, Mycobacterium
EEVDRACAPWGLLAEDHQAALLAGIEVA

SEQ ID NO: 806852 - protein, 20 aa, Mycobacterium
EEVFGPVASMYRAADIDEAI

SEQ ID NO: 806853 - protein, 27 aa, Mycobacterium
EEVFTRAIPFDLLITNLGIQDLEGTGP

SEQ ID NO: 806854 - protein, 25 aa, Mycobacterium
EEVGRFLYGGWTRPLSADAVAGLLE

SEQ ID NO: 806855 - protein, 22 aa, Mycobacterium
EEVGRFVAWLRLPAAGRVGNVS

SEQ ID NO: 806856 - protein, 25 aa, Mycobacterium
EEVKKWWDSLSPQRRGRLIDEHPPE

SEQ ID NO: 806857 - protein, 24 aa, Mycobacterium
EEVLDGVILHYFLHAEPSAVTARA

SEQ ID NO: 806858 - protein, 20 aa, Mycobacterium
EEVLFTIRPDRWLSADFTGD

SEQ ID NO: 806859 - protein, 23 aa, Mycobacterium
EEVLKDFLDWLFTRYDEIVAATT

SEQ ID NO: 806860 - protein, 24 aa, Mycobacterium
EEVLPGHPAGILAGPNIAKEVARG

SEQ ID NO: 806861 - protein, 24 aa, Mycobacterium
EEVPAGLRALRAPTIAAALEHMID

SEQ ID NO: 806862 - protein, 24 aa, Mycobacterium
EEVRERIFEPFFTTKPFGEGTGLG

SEQ ID NO: 806863 - protein, 25 aa, Mycobacterium
EEVSKLTYYGLYALQHRGQEAAGIA

SEQ ID NO: 806864 - protein, 18 aa, Mycobacterium
EEVSWKLSWPAGDHMGVV

SEQ ID NO: 806865 - protein, 17 aa, Mycobacterium
EEVTGLDLVALQLAIAG

SEQ ID NO: 806866 - protein, 20 aa, Mycobacterium
EEVTRAVLFLVDEASSHITG

SEQ ID NO: 806867 - protein, 26 aa, Mycobacterium
EEVVLRLRALLRRTGVATATGGAKLV

SEQ ID NO: 806868 - protein, 21 aa, Mycobacterium
EEVVLRLRALLRRTGVTSEDG

SEQ ID NO: 806869 - protein, 25 aa, Mycobacterium
EEVVLRLRALLRRTGVTTLDSGAQL

SEQ ID NO: 806870 - protein, 32 aa, Mycobacterium
EEVWELIEKHKINMLFFAGDAIGRPLIDALDT

SEQ ID NO: 806871 - protein, 17 aa, Mycobacterium
EEWDYTFRLNVGAYFHL

SEQ ID NO: 806872 - protein, 18 aa, Mycobacterium
EEWLALWSEHYQLGEKLR

SEQ ID NO: 806873 - protein, 30 aa, Mycobacterium
EEWLERISRQIMLYHLDRGWADHLAYLSDV

SEQ ID NO: 806874 - protein, 18 aa, Mycobacterium
EEWLMDPVGFRPEVGTRF

SEQ ID NO: 806875 - protein, 29 aa, Mycobacterium
EEWMALGVGPWFVIRGIPQRVTYRGHPCE

SEQ ID NO: 806876 - protein, 18 aa, Mycobacterium
EEWNCDKGRWAFSYATQP

SEQ ID NO: 806877 - protein, 17 aa, Mycobacterium
EEWNCDKGRWAFTYATQ

SEQ ID NO: 806878 - protein, 21 aa, Mycobacterium
EEYLEVCYKLWEASWEPGAVV

SEQ ID NO: 806879 - protein, 20 aa, Mycobacterium
EEYLKRPLIDGPAPEPVTRP

SEQ ID NO: 806880 - protein, 17 aa, Mycobacterium
EEYLLSSVARRLQSKSN

SEQ ID NO: 806881 - protein, 20 aa, Mycobacterium
EEYLLYERSGEWVLATGVHA

SEQ ID NO: 806882 - protein, 24 aa, Mycobacterium
EEYLYRPAPPLSCPITALGGVGDV

SEQ ID NO: 806883 - protein, 24 aa, Mycobacterium
EEYRPFRALIRAVLRHSGGVRIDH

SEQ ID NO: 806884 - protein, 24 aa, Mycobacterium
EEYVAAHAPYLVWLEQARGKSIAA

SEQ ID NO: 806885 - protein, 25 aa, Mycobacterium
EEYVAVTRRFTGAIPGLRASHSIAS

SEQ ID NO: 806886 - protein, 20 aa, Mycobacterium
EEYVPKIINLDIRGCFAMTE

SEQ ID NO: 806887 - protein, 17 aa, Mycobacterium
EEYWGPQVPFPKRMGRS

SEQ ID NO: 806888 - protein, 21 aa, Mycobacterium
EFAAELLTWLRDRLAHYKCPK

SEQ ID NO: 806889 - protein, 21 aa, Mycobacterium
EFAALFNTILINVTAFFRDAE

SEQ ID NO: 806890 - protein, 24 aa, Mycobacterium
EFAALPFDHLFFTGSPSVGVLVQR

SEQ ID NO: 806891 - protein, 21 aa, Mycobacterium
EFAARARAWLADNMPAIDRDA

SEQ ID NO: 806892 - protein, 24 aa, Mycobacterium
EFAARARAWLADNMPPIDPESPPP

SEQ ID NO: 806893 - protein, 21 aa, Mycobacterium
EFAARARAWLADNMPSVDPMS

SEQ ID NO: 806894 - protein, 19 aa, Mycobacterium
EFAARRWDWDDLEVGRTAL

SEQ ID NO: 806895 - protein, 29 aa, Mycobacterium
EFADAPRPDLILLDLNLPKYDGRQLLEKI

SEQ ID NO: 806896 - protein, 18 aa, Mycobacterium
EFADIMQRWGFDAEAALG

SEQ ID NO: 806897 - protein, 24 aa, Mycobacterium
EFADRIAHIWTNTKNYLVAIHLEG

SEQ ID NO: 806898 - protein, 23 aa, Mycobacterium
EFAEPNALWKLVPRPLVGSYSVR

SEQ ID NO: 806899 - protein, 31 aa, Mycobacterium
EFAEREGVNLTFLPFIARAVIDALKIHPNVN

SEQ ID NO: 806900 - protein, 18 aa, Mycobacterium
EFAILGRQVAIGGQLLEL

SEQ ID NO: 806901 - protein, 42 aa, Mycobacterium
EFAKTSWQLRKFLWAPKLGCYGIQRIHLLRNVMILAGAGVGG

SEQ ID NO: 806902 - protein, 22 aa, Mycobacterium
EFALYTRVLQLVWRVTPERLLI

SEQ ID NO: 806903 - protein, 23 aa, Mycobacterium
EFAPWVKRVPAGGGNPRAGATVV

SEQ ID NO: 806904 - protein, 19 aa, Mycobacterium
EFASQLPAFTWSHCVSDPS

SEQ ID NO: 806905 - protein, 28 aa, Mycobacterium
EFASYAPGLWRYWAEHLDPNRARQDDPA

SEQ ID NO: 806906 - protein, 28 aa, Mycobacterium
EFATALQRTLLPPSLPHIDGLQAAAYFR

SEQ ID NO: 806907 - protein, 17 aa, Mycobacterium
EFAVGLSRQLYGRTIAS

SEQ ID NO: 806908 - protein, 18 aa, Mycobacterium
EFAVLGRQVAIGGQLLEL

SEQ ID NO: 806909 - protein, 18 aa, Mycobacterium
EFAVLSRQVAVGGQLLEL

SEQ ID NO: 806910 - protein, 25 aa, Mycobacterium
EFAYGVLRAWLHTLRDRLPVEAAAH

SEQ ID NO: 806911 - protein, 18 aa, Mycobacterium
EFCGNWYVDDLPPMMFIK

SEQ ID NO: 806912 - protein, 20 aa, Mycobacterium
EFCVAQLWLRDIPPGTPWNN

SEQ ID NO: 806913 - protein, 18 aa, Mycobacterium
EFDAAIATPDQMAKVGRI

SEQ ID NO: 806914 - protein, 25 aa, Mycobacterium
EFDEWQRLYLFSRADTIYGGSNEIQ

SEQ ID NO: 806915 - protein, 23 aa, Mycobacterium
EFDGKLWISMDFVDGTDAASLLR

SEQ ID NO: 806916 - protein, 18 aa, Mycobacterium
EFDGRIITVPFSFKEIDG

SEQ ID NO: 806917 - protein, 22 aa, Mycobacterium
EFDHLLIRKRLLTRAQRAVIDS

SEQ ID NO: 806918 - protein, 21 aa, Mycobacterium
EFDIFVLDFPGYGLSDKPPEP

SEQ ID NO: 806919 - protein, 17 aa, Mycobacterium
EFDKLTNAWAELLDPHI

SEQ ID NO: 806920 - protein, 17 aa, Mycobacterium
EFDLAFDAAYRGEAPDG

SEQ ID NO: 806921 - protein, 32 aa, Mycobacterium
EFDNQAMHLALEAIWLMLGAANRYFSAQQPWV

SEQ ID NO: 806922 - protein, 18 aa, Mycobacterium
EFDPFWKRVVETGVLVIM

SEQ ID NO: 806923 - protein, 18 aa, Mycobacterium
EFDPSRFVFANKTMVGVS

SEQ ID NO: 806924 - protein, 23 aa, Mycobacterium
EFDRAQWRALRMSTPLKLTEDEL

SEQ ID NO: 806925 - protein, 30 aa, Mycobacterium
EFDRIWVASGMSPIGVFRAIDRVGLDVALD

SEQ ID NO: 806926 - protein, 26 aa, Mycobacterium
EFDTSWLDPFTEFRFPRIGTAVLGGV

SEQ ID NO: 806927 - protein, 17 aa, Mycobacterium
EFDWAHHRLGPPGDWAP

SEQ ID NO: 806928 - protein, 18 aa, Mycobacterium
EFDWDAHPLGPPQEWSRE

SEQ ID NO: 806929 - protein, 22 aa, Mycobacterium
EFEAILGLKRRALVVGRDPGGD

SEQ ID NO: 806930 - protein, 20 aa, Mycobacterium
EFEALLLEFLGESAVTVPEL

SEQ ID NO: 806931 - protein, 18 aa, Mycobacterium
EFEARDIPLLRGNIVITA

SEQ ID NO: 806932 - protein, 26 aa, Mycobacterium
EFEAYAAQFQFAAPTLPLVCNRTGAV

SEQ ID NO: 806933 - protein, 25 aa, Mycobacterium
EFEDGRPFVLTDTVGFVRHLPTQLV

SEQ ID NO: 806934 - protein, 42 aa, Mycobacterium
EFEEARRIAWLPSEVGKRPPGHLWRWELRPLDDDRTQVTHTY

SEQ ID NO: 806935 - protein, 24 aa, Mycobacterium
EFEGKYFTVPLPPEQGTGLGKALK

SEQ ID NO: 806936 - protein, 34 aa, Mycobacterium
EFEIPISLETTICLIYVPFVGCVLHVSVTVPITT

SEQ ID NO: 806937 - protein, 26 aa, Mycobacterium
EFERDRLIAWTVLGKIQPPIGHVYGY

SEQ ID NO: 806938 - protein, 21 aa, Mycobacterium
EFERPVLLFSGGKDSIVMLHL

SEQ ID NO: 806939 - protein, 24 aa, Mycobacterium
EFERTILLPRGMDYKVQFPGPTGT

SEQ ID NO: 806940 - protein, 31 aa, Mycobacterium
EFERVRLHPYFTVRILNQVPGLRKLAEVAGN

SEQ ID NO: 806941 - protein, 27 aa, Mycobacterium
EFERVRLHPYLTVRILNQVPGLGRLAE

SEQ ID NO: 806942 - protein, 23 aa, Mycobacterium
EFESYAAQFRFAAPTMPLVCNRT

SEQ ID NO: 806943 - protein, 20 aa, Mycobacterium
EFFADVHTLDRARAYNFECW

SEQ ID NO: 806944 - protein, 29 aa, Mycobacterium
EFFATPGYGPWLRENLHYSQALRIGDRVE

SEQ ID NO: 806945 - protein, 27 aa, Mycobacterium
EFFDIGAIVYFLRKVIWSVPDFTVQRY

SEQ ID NO: 806946 - protein, 24 aa, Mycobacterium
EFFDNPLVRCINFIGSVPTGRMLA

SEQ ID NO: 806947 - protein, 29 aa, Mycobacterium
EFFGIEYPILLAPMALVSGGRLAAAVTAA

SEQ ID NO: 806948 - protein, 17 aa, Mycobacterium
EFFGRLQETHQRRMQEL

SEQ ID NO: 806949 - protein, 17 aa, Mycobacterium
EFFGVITQLPGASGRIT

SEQ ID NO: 806950 - protein, 17 aa, Mycobacterium
EFFMRYLTWGLRGVTDG

SEQ ID NO: 806951 - protein, 17 aa, Mycobacterium
EFFPRSTGGWDPAGNPV

SEQ ID NO: 806952 - protein, 24 aa, Mycobacterium
EFGAFLEYQPPEAAAWLASAIDAA

SEQ ID NO: 806953 - protein, 22 aa, Mycobacterium
EFGAVFPLIPGHELVGVVDAVG

SEQ ID NO: 806954 - protein, 18 aa, Mycobacterium
EFGCRLLFDQVRAAGRDV

SEQ ID NO: 806955 - protein, 25 aa, Mycobacterium
EFGDPQGRAIFWLHGTPGARRQIPT

SEQ ID NO: 806956 - protein, 18 aa, Mycobacterium
EFGFATAPLVVAGCIMMR

SEQ ID NO: 806957 - protein, 17 aa, Mycobacterium
EFGFHEYLEVKSTLGYA

SEQ ID NO: 806958 - protein, 23 aa, Mycobacterium
EFGGGKALLLKAGAFDDVAAAVM

SEQ ID NO: 806959 - protein, 35 aa, Mycobacterium
EFGGQSLRPVIFSTFLMWLLADLFTVLDEVGDIDK

SEQ ID NO: 806960 - protein, 18 aa, Mycobacterium
EFGGTRLVAAPGPSSDPV

SEQ ID NO: 806961 - protein, 26 aa, Mycobacterium
EFGHIDVHMLQYSGAIWYPMVYDMPA

SEQ ID NO: 806962 - protein, 18 aa, Mycobacterium
EFGPFPEYQPREAAAWLA

SEQ ID NO: 806963 - protein, 26 aa, Mycobacterium
EFGSPHGGTWLPWLTDRGFTAVHSQA

SEQ ID NO: 806964 - protein, 21 aa, Mycobacterium
EFGVFIPQGWRLDLVGIAPER

SEQ ID NO: 806965 - protein, 18 aa, Mycobacterium
EFGVQNPVLYRLMFGQAE

SEQ ID NO: 806966 - protein, 26 aa, Mycobacterium
EFGVSATFFIVTPNRDQLAELAALVD

SEQ ID NO: 806967 - protein, 23 aa, Mycobacterium
EFGWISQPADWHEQIDACLEYFQ

SEQ ID NO: 806968 - protein, 17 aa, Mycobacterium
EFGYFQFGGSDIILLFQ

SEQ ID NO: 806969 - protein, 27 aa, Mycobacterium
EFHADVLTILLALWSTPDPAQADQFLL

SEQ ID NO: 806970 - protein, 19 aa, Mycobacterium
EFHCAMPWIPLKYRGHFEG

SEQ ID NO: 806971 - protein, 21 aa, Mycobacterium
EFHDSLMEPWDGPAAVCFTDG

SEQ ID NO: 806972 - protein, 21 aa, Mycobacterium
EFHERFVRAMAAGAASYATAE

SEQ ID NO: 806973 - protein, 27 aa, Mycobacterium
EFHIEPLMFHLAGIPSYLVVGELAINR

SEQ ID NO: 806974 - protein, 20 aa, Mycobacterium
EFHLFGLCHHINLDGLGMAV

SEQ ID NO: 806975 - protein, 25 aa, Mycobacterium
EFHRPTVLVPAFLSRGYHVSRDIPS

SEQ ID NO: 806976 - protein, 17 aa, Mycobacterium
EFHVEGLATVIPFHRAV

SEQ ID NO: 806977 - protein, 17 aa, Mycobacterium
EFIDASPSPFHACRTAA

SEQ ID NO: 806978 - protein, 17 aa, Mycobacterium
EFIDASPSPFHVCATAA

SEQ ID NO: 806979 - protein, 25 aa, Mycobacterium
EFIDLATFDGWLQRWRDLGPDADAM

SEQ ID NO: 806980 - protein, 28 aa, Mycobacterium
EFIEPFVLAAYLGALTRRIRFNTFVVKF

SEQ ID NO: 806981 - protein, 27 aa, Mycobacterium
EFIETTGIPFLPMSMAKGLLPDSHPQS

SEQ ID NO: 806982 - protein, 21 aa, Mycobacterium
EFIGEFWYHYDEAHYAELAAR

SEQ ID NO: 806983 - protein, 18 aa, Mycobacterium
EFIGRHFDIGPADRCLAL

SEQ ID NO: 806984 - protein, 18 aa, Mycobacterium
EFIKDISIGSLIYDDERQ

SEQ ID NO: 806985 - protein, 28 aa, Mycobacterium
EFIKEWNKLSMWEQLGWPAEECLTAGES

SEQ ID NO: 806986 - protein, 17 aa, Mycobacterium
EFIVAMLGVLKSGAAYM

SEQ ID NO: 806987 - protein, 17 aa, Mycobacterium
EFKAMFLDDLLNGSRKQ

SEQ ID NO: 806988 - protein, 21 aa, Mycobacterium
EFKEFWSGLMQKWIAATAALI

SEQ ID NO: 806989 - protein, 22 aa, Mycobacterium
EFKQFTLFFIPVARWKRRVFEV

SEQ ID NO: 806990 - protein, 18 aa, Mycobacterium
EFLARLCNTAMWIDHGTI

SEQ ID NO: 806991 - protein, 19 aa, Mycobacterium
EFLARLRAAVRRGTPDSAE

SEQ ID NO: 806992 - protein, 30 aa, Mycobacterium
EFLEGHPAVRWVKYPFLQSHPQYELAKRQM

SEQ ID NO: 806993 - protein, 28 aa, Mycobacterium
EFLGITIPQFNFPAPAHWYFPTQADGSV

SEQ ID NO: 806994 - protein, 18 aa, Mycobacterium
EFLGLLEALPADMPRVLT

SEQ ID NO: 806995 - protein, 18 aa, Mycobacterium
EFLGVQHPILLAPMAMTS

SEQ ID NO: 806996 - protein, 21 aa, Mycobacterium
EFLHYLRIREWQDLVGQLRGI

SEQ ID NO: 806997 - protein, 21 aa, Mycobacterium
EFLHYLRIREWQDLVGQLRSI

SEQ ID NO: 806998 - protein, 25 aa, Mycobacterium
EFLLNLDMRFAVRGKALFNQVETGL

SEQ ID NO: 806999 - protein, 31 aa, Mycobacterium
EFLQGHPAVRWVRYPYLPSHPQYDLAKRQMS

SEQ ID NO: 807000 - protein, 29 aa, Mycobacterium
EFLQRRRFVEPWIGWLIAAGVSPGDIVVC

SEQ ID NO: 807001 - protein, 28 aa, Mycobacterium
EFLRMEADWEAAYLLALRAAWQADNKIP

SEQ ID NO: 807002 - protein, 24 aa, Mycobacterium
EFLRTFWTRLMRNPIGALRELWAP

SEQ ID NO: 807003 - protein, 18 aa, Mycobacterium
EFLSMDIALAVVDGLDAA

SEQ ID NO: 807004 - protein, 18 aa, Mycobacterium
EFLTRATAQRPDAVAVAD

SEQ ID NO: 807005 - protein, 26 aa, Mycobacterium
EFLTVARKFWDSWAPGAVLADVENGV

SEQ ID NO: 807006 - protein, 18 aa, Mycobacterium
EFLTYLRTGDLPGTSRIG

SEQ ID NO: 807007 - protein, 19 aa, Mycobacterium
EFLVAGDKFVFLEINPRIQ

SEQ ID NO: 807008 - protein, 20 aa, Mycobacterium
EFMVFDDSFRQAWSSGYHNL

SEQ ID NO: 807009 - protein, 26 aa, Mycobacterium
EFMVFDETYRQAWAGGYRGLTPASDY

SEQ ID NO: 807010 - protein, 19 aa, Mycobacterium
EFNAAYMSGAAVAASLGLP

SEQ ID NO: 807011 - protein, 19 aa, Mycobacterium
EFNAVLLEFLEQDFADGRG

SEQ ID NO: 807012 - protein, 24 aa, Mycobacterium
EFNDRLMERHTLGGRLSRDELLTA

SEQ ID NO: 807013 - protein, 23 aa, Mycobacterium
EFNLIDNLAYPLPVAVICRLLGV

SEQ ID NO: 807014 - protein, 23 aa, Mycobacterium
EFNLKKMWLSPNGTIRNILGGTI

SEQ ID NO: 807015 - protein, 19 aa, Mycobacterium
EFNSARMYAGPGPLSLVAA

SEQ ID NO: 807016 - protein, 19 aa, Mycobacterium
EFNVPTQDARWFRLCTVDG

SEQ ID NO: 807017 - protein, 41 aa, Mycobacterium
EFPHNAFQLRRPLFEPLPGTLPEPEIWARLVRALGVVGDAE

SEQ ID NO: 807018 - protein, 17 aa, Mycobacterium
EFPMLSGELGPVDRRRA

SEQ ID NO: 807019 - protein, 23 aa, Mycobacterium
EFPNVDRVLSLKSPFHAAVTVPT

SEQ ID NO: 807020 - protein, 18 aa, Mycobacterium
EFPTRIISTLLGLPPEDL

SEQ ID NO: 807021 - protein, 17 aa, Mycobacterium
EFPTRIISTLLGLPRDD

SEQ ID NO: 807022 - protein, 21 aa, Mycobacterium
EFQAARGWFAAGGLVPGGNGC

SEQ ID NO: 807023 - protein, 18 aa, Mycobacterium
EFQKGGAPAVYLLDGLRA

SEQ ID NO: 807024 - protein, 17 aa, Mycobacterium
EFQLIAPPLRVTGAVGS

SEQ ID NO: 807025 - protein, 25 aa, Mycobacterium
EFQRRVWRALQTIPYGETRSYGEIA

SEQ ID NO: 807026 - protein, 23 aa, Mycobacterium
EFQSLRPHLMAVAYRLTGSVADA

SEQ ID NO: 807027 - protein, 17 aa, Mycobacterium
EFRAPLPLGIDPAAGDH

SEQ ID NO: 807028 - protein, 24 aa, Mycobacterium
EFRDGLLSHWISVIDGLALAQQLG

SEQ ID NO: 807029 - protein, 17 aa, Mycobacterium
EFRQVRLAAQTVAREVE

SEQ ID NO: 807030 - protein, 30 aa, Mycobacterium
EFRRLAARHSVYWITIKDAPLVGVPELGGE

SEQ ID NO: 807031 - protein, 17 aa, Mycobacterium
EFRRLRAKVSEDTVSAV

SEQ ID NO: 807032 - protein, 20 aa, Mycobacterium
EFRRRLLATIAHHLKPEGKA

SEQ ID NO: 807033 - protein, 22 aa, Mycobacterium
EFRTELRDWLSQNLTDELVAAR

SEQ ID NO: 807034 - protein, 18 aa, Mycobacterium
EFRVVFGSLFPGGEGRLR

SEQ ID NO: 807035 - protein, 29 aa, Mycobacterium
EFRYYLPVLVRAVVGYFADPATRAAMPGL

SEQ ID NO: 807036 - protein, 17 aa, Mycobacterium
EFSDLRAWQPRRGGDGA

SEQ ID NO: 807037 - protein, 24 aa, Mycobacterium
EFSEWQRLYLFSRSDTIYGGSNEI

SEQ ID NO: 807038 - protein, 22 aa, Mycobacterium
EFSGAYPWEWTARMMDEWSAHL

SEQ ID NO: 807039 - protein, 35 aa, Mycobacterium
EFSGQSLRPVIFSTFLMWLLADLFAVLPEVGDVDK

SEQ ID NO: 807040 - protein, 35 aa, Mycobacterium
EFSGQSLRPVLFSTFLMWVLADLFTFLPEVGDLDK

SEQ ID NO: 807041 - protein, 26 aa, Mycobacterium
EFSKSPFYVGTRLRRWNAPGGKPRRA

SEQ ID NO: 807042 - protein, 24 aa, Mycobacterium
EFSSALWLKFNLLAEAHTRDVPRV

SEQ ID NO: 807043 - protein, 18 aa, Mycobacterium
EFSTYFVPLIEARRVEPR

SEQ ID NO: 807044 - protein, 25 aa, Mycobacterium
EFSVRRRYWMVIPRELRQVGRVRAV

SEQ ID NO: 807045 - protein, 18 aa, Mycobacterium
EFSYGSFVRTVALPAGAD

SEQ ID NO: 807046 - protein, 17 aa, Mycobacterium
EFSYGSFVRTVALPSGA

SEQ ID NO: 807047 - protein, 26 aa, Mycobacterium
EFSYIENYVPRPLLDLPWDIEESPSG

SEQ ID NO: 807048 - protein, 25 aa, Mycobacterium
EFTCSSCFLVQHRSRLRRSSSGLPV

SEQ ID NO: 807049 - protein, 25 aa, Mycobacterium
EFTCSSCFLVQHRSRLRSSNAGVSI

SEQ ID NO: 807050 - protein, 21 aa, Mycobacterium
EFTLQCVPAFRLHRSQSVHDL

SEQ ID NO: 807051 - protein, 28 aa, Mycobacterium
EFTRFAGAPPRRWLAEEFRNIQDGGHSC

SEQ ID NO: 807052 - protein, 34 aa, Mycobacterium
EFTSMIYSVQYRLPSYYRWLLYEADHRGAYRFHR

SEQ ID NO: 807053 - protein, 19 aa, Mycobacterium
EFVAISALRDAYRDRLLVL

SEQ ID NO: 807054 - protein, 24 aa, Mycobacterium
EFVCLRILSMYPGMSSAELSRHAG

SEQ ID NO: 807055 - protein, 25 aa, Mycobacterium
EFVDVVTKLWDSWPADGLRPDAATG

SEQ ID NO: 807056 - protein, 22 aa, Mycobacterium
EFVDWSLLDVLRGAAGAPGLDR

SEQ ID NO: 807057 - protein, 18 aa, Mycobacterium
EFVENFFMFIAEEVREYM

SEQ ID NO: 807058 - protein, 19 aa, Mycobacterium
EFVENFFMFIAEEVREYMA

SEQ ID NO: 807059 - protein, 17 aa, Mycobacterium
EFVEVHWSRWGEAYVTP

SEQ ID NO: 807060 - protein, 17 aa, Mycobacterium
EFVKPHLALYIGGMGAK

SEQ ID NO: 807061 - protein, 20 aa, Mycobacterium
EFVKRRLKVIDDAAARFTAE

SEQ ID NO: 807062 - protein, 19 aa, Mycobacterium
EFVLLRRRSVLSEPEQALC

SEQ ID NO: 807063 - protein, 19 aa, Mycobacterium
EFVRPTLAGNKIGALAITE

SEQ ID NO: 807064 - protein, 18 aa, Mycobacterium
EFVRRVIDTLVLPAIYAS

SEQ ID NO: 807065 - protein, 29 aa, Mycobacterium
EFVTAVRVPWPATAGFGYVKLKSAESSWP

SEQ ID NO: 807066 - protein, 17 aa, Mycobacterium
EFVTPTHATYYSIAPPL

SEQ ID NO: 807067 - protein, 31 aa, Mycobacterium
EFVTSLQLLLTFPFPNFGIKQSVRGDYLNVF

SEQ ID NO: 807068 - protein, 17 aa, Mycobacterium
EFWSLRETLMEEADRLH

SEQ ID NO: 807069 - protein, 17 aa, Mycobacterium
EFWTTDPALLQAQLDVN

SEQ ID NO: 807070 - protein, 24 aa, Mycobacterium
EFYDLDFITPQWSPGPIDAPDPKV

SEQ ID NO: 807071 - protein, 17 aa, Mycobacterium
EFYDLSHPWGHGAPAWP

SEQ ID NO: 807072 - protein, 18 aa, Mycobacterium
EFYEQGLGWVPKSAPDGV

SEQ ID NO: 807073 - protein, 28 aa, Mycobacterium
EFYGNRGWLAWPRGFFGDPPPLPDVTVR

SEQ ID NO: 807074 - protein, 22 aa, Mycobacterium
EFYGQYFIGHWPDDTRIIPVCR

SEQ ID NO: 807075 - protein, 27 aa, Mycobacterium
EFYITRLVDPKLSFVDSGWPPAAPEVT

SEQ ID NO: 807076 - protein, 17 aa, Mycobacterium
EFYPADNPIITIVKSGA

SEQ ID NO: 807077 - protein, 30 aa, Mycobacterium
EFYRNWEGLTAWAVRWLRDFTGHHPSPGLD

SEQ ID NO: 807078 - protein, 19 aa, Mycobacterium
EFYVQVYRLDLASGDLGEL

SEQ ID NO: 807079 - protein, 27 aa, Mycobacterium
EGAAEALRWAMMRGEPLVVLADALAEA

SEQ ID NO: 807080 - protein, 18 aa, Mycobacterium
EGAALYIELPVSVELEVT

SEQ ID NO: 807081 - protein, 22 aa, Mycobacterium
EGADALWLADRGWQVVAVDVSD

SEQ ID NO: 807082 - protein, 23 aa, Mycobacterium
EGADIIAVDIAGPLPPCVPYDHA

SEQ ID NO: 807083 - protein, 20 aa, Mycobacterium
EGADIIMVKPAMGYLDVVAA

SEQ ID NO: 807084 - protein, 20 aa, Mycobacterium
EGADPFVQLFSESAGRVLVA

SEQ ID NO: 807085 - protein, 27 aa, Mycobacterium
EGADRLALGPLMSGMFGDFAAADAFHN

SEQ ID NO: 807086 - protein, 21 aa, Mycobacterium
EGAERLGPVDLPFGARRPPGL

SEQ ID NO: 807087 - protein, 26 aa, Mycobacterium
EGAFRPYYPDVVFIDPFRADAAEKLT

SEQ ID NO: 807088 - protein, 27 aa, Mycobacterium
EGAFRVPALVRWPGVIPAGVASGEFMA

SEQ ID NO: 807089 - protein, 24 aa, Mycobacterium
EGAGHAFFSVDRPAYRAEAALDGW

SEQ ID NO: 807090 - protein, 24 aa, Mycobacterium
EGAGHSFFSVDRPAYRPEAAVDGW

SEQ ID NO: 807091 - protein, 23 aa, Mycobacterium
EGAGPRVGAWFTGRNELPERTWE

SEQ ID NO: 807092 - protein, 19 aa, Mycobacterium
EGAGRRLELLAALATGRTR

SEQ ID NO: 807093 - protein, 26 aa, Mycobacterium
EGAHGAPLPGMPFGQLAGNGGNGVSG
